United States Patent 7,250,289 (METHODS OF GENETIC ANALYSIS OF MOUSE) - sequence listing, part 23

SEQ ID NO: 883732 - DNA, 25 bp, Mus musculus
tggcactgcaggtcatggtgacctt

SEQ ID NO: 883733 - DNA, 25 bp, Mus musculus
tggcactgctcaacttggtgctcta

SEQ ID NO: 883734 - DNA, 25 bp, Mus musculus
tggcactgctcatcttggtgctcta

SEQ ID NO: 883735 - DNA, 25 bp, Mus musculus
tggcactgctgaaactcaaccacag

SEQ ID NO: 883736 - DNA, 25 bp, Mus musculus
tggcactgctgatactcaaccacag

SEQ ID NO: 883737 - DNA, 25 bp, Mus musculus
tggcactgcttcaaacagtagcaac

SEQ ID NO: 883738 - DNA, 25 bp, Mus musculus
tggcactgcttctaacagtagcaac

SEQ ID NO: 883739 - DNA, 25 bp, Mus musculus
tggcactggacgacgagactctcaa

SEQ ID NO: 883740 - DNA, 25 bp, Mus musculus
tggcactggacgtcgagactctcaa

SEQ ID NO: 883741 - DNA, 25 bp, Mus musculus
tggcactggagtcgccagtatttac

SEQ ID NO: 883742 - DNA, 25 bp, Mus musculus
tggcactggagtggccagtatttac

SEQ ID NO: 883743 - DNA, 25 bp, Mus musculus
tggcactgggccagcagaactgagt

SEQ ID NO: 883744 - DNA, 25 bp, Mus musculus
tggcactgggcctgcagaactgagt

SEQ ID NO: 883745 - DNA, 25 bp, Mus musculus
tggcactgtaatatcatcccttttg

SEQ ID NO: 883746 - DNA, 25 bp, Mus musculus
tggcactgtaatttcatcccttttg

SEQ ID NO: 883747 - DNA, 25 bp, Mus musculus
tggcactgtggcagcgtaccgattg

SEQ ID NO: 883748 - DNA, 25 bp, Mus musculus
tggcactgtggctgcgtaccgattg

SEQ ID NO: 883749 - DNA, 25 bp, Mus musculus
tggcactgttggcaattggttccca

SEQ ID NO: 883750 - DNA, 25 bp, Mus musculus
tggcactgttgggaattggttccca

SEQ ID NO: 883751 - DNA, 25 bp, Mus musculus
tggcacttaccaagccttcgtaagt

SEQ ID NO: 883752 - DNA, 25 bp, Mus musculus
tggcacttaccatgccttcgtaagt

SEQ ID NO: 883753 - DNA, 25 bp, Mus musculus
tggcacttagcacgaagcccaaggt

SEQ ID NO: 883754 - DNA, 25 bp, Mus musculus
tggcacttagcaggaagcccaaggt

SEQ ID NO: 883755 - DNA, 25 bp, Mus musculus
tggcacttccctcaatacgtttggg

SEQ ID NO: 883756 - DNA, 25 bp, Mus musculus
tggcacttccctgaatacgtttggg

SEQ ID NO: 883757 - DNA, 25 bp, Mus musculus
tggcacttgaaaacgggcagaagaa

SEQ ID NO: 883758 - DNA, 25 bp, Mus musculus
tggcacttgaaatcgggcagaagaa

SEQ ID NO: 883759 - DNA, 25 bp, Mus musculus
tggcacttgcccagtgacatgatgg

SEQ ID NO: 883760 - DNA, 25 bp, Mus musculus
tggcacttgccctgtgacatgatgg

SEQ ID NO: 883761 - DNA, 25 bp, Mus musculus
tggcacttgctacccagccagtcta

SEQ ID NO: 883762 - DNA, 25 bp, Mus musculus
tggcacttgctagccagccagtcta

SEQ ID NO: 883763 - DNA, 25 bp, Mus musculus
tggcacttgtacaccagtattctga

SEQ ID NO: 883764 - DNA, 25 bp, Mus musculus
tggcacttgtactccagtattctga

SEQ ID NO: 883765 - DNA, 25 bp, Mus musculus
tggcactttaaacggcctgatccag

SEQ ID NO: 883766 - DNA, 25 bp, Mus musculus
tggcactttaaagggcctgatccag

SEQ ID NO: 883767 - DNA, 25 bp, Mus musculus
tggcactttattactgtcagcaaca

SEQ ID NO: 883768 - DNA, 25 bp, Mus musculus
tggcactttatttctgtcagcaaca

SEQ ID NO: 883769 - DNA, 25 bp, Mus musculus
tggcactttcggcatgactactcac

SEQ ID NO: 883770 - DNA, 25 bp, Mus musculus
tggcactttcgggatgactactcac

SEQ ID NO: 883771 - DNA, 25 bp, Mus musculus
tggcagaaaagacctccatctccac

SEQ ID NO: 883772 - DNA, 25 bp, Mus musculus
tggcagaaaagagctccatctccac

SEQ ID NO: 883773 - DNA, 25 bp, Mus musculus
tggcagaaaggccgattttttacct

SEQ ID NO: 883774 - DNA, 25 bp, Mus musculus
tggcagaaaggcggattttttacct

SEQ ID NO: 883775 - DNA, 25 bp, Mus musculus
tggcagaaatatcaccgctcacaaa

SEQ ID NO: 883776 - DNA, 25 bp, Mus musculus
tggcagaaatatgaccgctcacaaa

SEQ ID NO: 883777 - DNA, 25 bp, Mus musculus
tggcagaacgaacaccacattttga

SEQ ID NO: 883778 - DNA, 25 bp, Mus musculus
tggcagaacgaagaccacattttga

SEQ ID NO: 883779 - DNA, 25 bp, Mus musculus
tggcagaacgttcaacagtcctttc

SEQ ID NO: 883780 - DNA, 25 bp, Mus musculus
tggcagaacgttgaacagtcctttc

SEQ ID NO: 883781 - DNA, 25 bp, Mus musculus
tggcagaacttcacctagcacatag

SEQ ID NO: 883782 - DNA, 25 bp, Mus musculus
tggcagaacttctcctagcacatag

SEQ ID NO: 883783 - DNA, 25 bp, Mus musculus
tggcagaagagaacagtggtcccct

SEQ ID NO: 883784 - DNA, 25 bp, Mus musculus
tggcagaagagatcagtggtcccct

SEQ ID NO: 883785 - DNA, 25 bp, Mus musculus
tggcagaaggaccacctcctcagca

SEQ ID NO: 883786 - DNA, 25 bp, Mus musculus
tggcagaaggacgacctcctcagca

SEQ ID NO: 883787 - DNA, 25 bp, Mus musculus
tggcagaagtcaactgtggccccta

SEQ ID NO: 883788 - DNA, 25 bp, Mus musculus
tggcagaagtcatctgtggccccta

SEQ ID NO: 883789 - DNA, 25 bp, Mus musculus
tggcagaatacacgaagtatatcca

SEQ ID NO: 883790 - DNA, 25 bp, Mus musculus
tggcagaatacaggaagtatatcca

SEQ ID NO: 883791 - DNA, 25 bp, Mus musculus
tggcagaatgaacgtttttcccaac

SEQ ID NO: 883792 - DNA, 25 bp, Mus musculus
tggcagaatgaaggtttttcccaac

SEQ ID NO: 883793 - DNA, 25 bp, Mus musculus
tggcagacaaggcagcgtctacagt

SEQ ID NO: 883794 - DNA, 25 bp, Mus musculus
tggcagacaagggagcgtctacagt

SEQ ID NO: 883795 - DNA, 25 bp, Mus musculus
tggcagacaccacgactcttgcaga

SEQ ID NO: 883796 - DNA, 25 bp, Mus musculus
tggcagacaccaggactcttgcaga

SEQ ID NO: 883797 - DNA, 25 bp, Mus musculus
tggcagacatttcccattaaaattg

SEQ ID NO: 883798 - DNA, 25 bp, Mus musculus
tggcagacatttgccattaaaattg

SEQ ID NO: 883799 - DNA, 25 bp, Mus musculus
tggcagaccacgagaccttcaacaa

SEQ ID NO: 883800 - DNA, 25 bp, Mus musculus
tggcagaccacgtgaccttcaacaa

SEQ ID NO: 883801 - DNA, 25 bp, Mus musculus
tggcagaccagtacacagaactcta

SEQ ID NO: 883802 - DNA, 25 bp, Mus musculus
tggcagaccagttcacagaactcta

SEQ ID NO: 883803 - DNA, 25 bp, Mus musculus
tggcagaccctacgcaagctggaat

SEQ ID NO: 883804 - DNA, 25 bp, Mus musculus
tggcagaccctaggcaagctggaat

SEQ ID NO: 883805 - DNA, 25 bp, Mus musculus
tggcagaccctgcacaacgctggta

SEQ ID NO: 883806 - DNA, 25 bp, Mus musculus
tggcagaccctggacaacgctggta

SEQ ID NO: 883807 - DNA, 25 bp, Mus musculus
tggcagacctagactgaccctataa

SEQ ID NO: 883808 - DNA, 25 bp, Mus musculus
tggcagacctagtctgaccctataa

SEQ ID NO: 883809 - DNA, 25 bp, Mus musculus
tggcagaccttaatcttgaacccta

SEQ ID NO: 883810 - DNA, 25 bp, Mus musculus
tggcagaccttattcttgaacccta

SEQ ID NO: 883811 - DNA, 25 bp, Mus musculus
tggcagacgcatccctactgaagaa

SEQ ID NO: 883812 - DNA, 25 bp, Mus musculus
tggcagacgcatgcctactgaagaa

SEQ ID NO: 883813 - DNA, 25 bp, Mus musculus
tggcagactgatcatccacgcagat

SEQ ID NO: 883814 - DNA, 25 bp, Mus musculus
tggcagactgatgatccacgcagat

SEQ ID NO: 883815 - DNA, 25 bp, Mus musculus
tggcagactgccaaagagaccttgt

SEQ ID NO: 883816 - DNA, 25 bp, Mus musculus
tggcagactgccagacttcatctat

SEQ ID NO: 883817 - DNA, 25 bp, Mus musculus
tggcagactgcctaagagaccttgt

SEQ ID NO: 883818 - DNA, 25 bp, Mus musculus
tggcagactgcctgacttcatctat

SEQ ID NO: 883819 - DNA, 25 bp, Mus musculus
tggcagactgtgctttctagtacct

SEQ ID NO: 883820 - DNA, 25 bp, Mus musculus
tggcagactgtggtttctagtacct

SEQ ID NO: 883821 - DNA, 25 bp, Mus musculus
tggcagacttacctctcaggagtgt

SEQ ID NO: 883822 - DNA, 25 bp, Mus musculus
tggcagacttacgtctcaggagtgt

SEQ ID NO: 883823 - DNA, 25 bp, Mus musculus
tggcagacttccaagtcatcttctg

SEQ ID NO: 883824 - DNA, 25 bp, Mus musculus
tggcagacttcctagtcatcttctg

SEQ ID NO: 883825 - DNA, 25 bp, Mus musculus
tggcagacttctaggttcagcagat

SEQ ID NO: 883826 - DNA, 25 bp, Mus musculus
tggcagacttcttggttcagcagat

SEQ ID NO: 883827 - DNA, 25 bp, Mus musculus
tggcagagaaaacccgcaaactttt

SEQ ID NO: 883828 - DNA, 25 bp, Mus musculus
tggcagagaaaagccgcaaactttt

SEQ ID NO: 883829 - DNA, 25 bp, Mus musculus
tggcagagacaccagaacacctgtg

SEQ ID NO: 883830 - DNA, 25 bp, Mus musculus
tggcagagacacgagaacacctgtg

SEQ ID NO: 883831 - DNA, 25 bp, Mus musculus
tggcagagacagaggcgcgctatgg

SEQ ID NO: 883832 - DNA, 25 bp, Mus musculus
tggcagagacagtggcgcgctatgg

SEQ ID NO: 883833 - DNA, 25 bp, Mus musculus
tggcagagaccaactcagcattcca

SEQ ID NO: 883834 - DNA, 25 bp, Mus musculus
tggcagagaccatctcagcattcca

SEQ ID NO: 883835 - DNA, 25 bp, Mus musculus
tggcagagactaaggccctgggttc

SEQ ID NO: 883836 - DNA, 25 bp, Mus musculus
tggcagagactatggccctgggttc

SEQ ID NO: 883837 - DNA, 25 bp, Mus musculus
tggcagagataactccgacaccctt

SEQ ID NO: 883838 - DNA, 25 bp, Mus musculus
tggcagagataagtccgacaccctt

SEQ ID NO: 883839 - DNA, 25 bp, Mus musculus
tggcagagcaggacagaggcagttt

SEQ ID NO: 883840 - DNA, 25 bp, Mus musculus
tggcagagcaggtcagaggcagttt

SEQ ID NO: 883841 - DNA, 25 bp, Mus musculus
tggcagagcgctatgactccacatt

SEQ ID NO: 883842 - DNA, 25 bp, Mus musculus
tggcagagcgctttgactccacatt

SEQ ID NO: 883843 - DNA, 25 bp, Mus musculus
tggcagagcggtcctgtttgaccct

SEQ ID NO: 883844 - DNA, 25 bp, Mus musculus
tggcagagcggtgctgtttgaccct

SEQ ID NO: 883845 - DNA, 25 bp, Mus musculus
tggcagagctacacggaaacttctc

SEQ ID NO: 883846 - DNA, 25 bp, Mus musculus
tggcagagctactcggaaacttctc

SEQ ID NO: 883847 - DNA, 25 bp, Mus musculus
tggcagagctgcctgacactggctt

SEQ ID NO: 883848 - DNA, 25 bp, Mus musculus
tggcagagctgcgtgacactggctt

SEQ ID NO: 883849 - DNA, 25 bp, Mus musculus
tggcagaggcatacttgcagaggct

SEQ ID NO: 883850 - DNA, 25 bp, Mus musculus
tggcagaggcattcttgcagaggct

SEQ ID NO: 883851 - DNA, 25 bp, Mus musculus
tggcagaggctgaccacggcacctt

SEQ ID NO: 883852 - DNA, 25 bp, Mus musculus
tggcagaggctgtccacggcacctt

SEQ ID NO: 883853 - DNA, 25 bp, Mus musculus
tggcagagtgtgagcttccagctat

SEQ ID NO: 883854 - DNA, 25 bp, Mus musculus
tggcagagtgtgtgcttccagctat

SEQ ID NO: 883855 - DNA, 25 bp, Mus musculus
tggcagatcaccatcttcatacaca

SEQ ID NO: 883856 - DNA, 25 bp, Mus musculus
tggcagatcaccttcttcatacaca

SEQ ID NO: 883857 - DNA, 25 bp, Mus musculus
tggcagatccgaactacctaccggc

SEQ ID NO: 883858 - DNA, 25 bp, Mus musculus
tggcagatccgatctacctaccggc

SEQ ID NO: 883859 - DNA, 25 bp, Mus musculus
tggcagatgcctatggtatggaact

SEQ ID NO: 883860 - DNA, 25 bp, Mus musculus
tggcagatgcctttggtatggaact

SEQ ID NO: 883861 - DNA, 25 bp, Mus musculus
tggcagatggtacaaccctttgctt

SEQ ID NO: 883862 - DNA, 25 bp, Mus musculus
tggcagatggtagaaccctttgctt

SEQ ID NO: 883863 - DNA, 25 bp, Mus musculus
tggcagattcttcagctttcagatg

SEQ ID NO: 883864 - DNA, 25 bp, Mus musculus
tggcagattcttgagctttcagatg

SEQ ID NO: 883865 - DNA, 25 bp, Mus musculus
tggcagatttagagacctgggatta

SEQ ID NO: 883866 - DNA, 25 bp, Mus musculus
tggcagatttagtgacctgggatta

SEQ ID NO: 883867 - DNA, 25 bp, Mus musculus
tggcagatttcaaccgccagaacct

SEQ ID NO: 883868 - DNA, 25 bp, Mus musculus
tggcagatttcatccgccagaacct

SEQ ID NO: 883869 - DNA, 25 bp, Mus musculus
tggcagcaacagacacagctcagcg

SEQ ID NO: 883870 - DNA, 25 bp, Mus musculus
tggcagcaacagtcacagctcagcg

SEQ ID NO: 883871 - DNA, 25 bp, Mus musculus
tggcagcaaccaacatcgctctgtc

SEQ ID NO: 883872 - DNA, 25 bp, Mus musculus
tggcagcaaccaagtgacctacgag

SEQ ID NO: 883873 - DNA, 25 bp, Mus musculus
tggcagcaaccatcatcgctctgtc

SEQ ID NO: 883874 - DNA, 25 bp, Mus musculus
tggcagcaaccatgtgacctacgag

SEQ ID NO: 883875 - DNA, 25 bp, Mus musculus
tggcagcaagccactgcactatcct

SEQ ID NO: 883876 - DNA, 25 bp, Mus musculus
tggcagcaagcctctgcactatcct

SEQ ID NO: 883877 - DNA, 25 bp, Mus musculus
tggcagcaagcgaaggcaaaggact

SEQ ID NO: 883878 - DNA, 25 bp, Mus musculus
tggcagcaagcgatctgccagctga

SEQ ID NO: 883879 - DNA, 25 bp, Mus musculus
tggcagcaagcgtaggcaaaggact

SEQ ID NO: 883880 - DNA, 25 bp, Mus musculus
tggcagcaagcgttctgccagctga

SEQ ID NO: 883881 - DNA, 25 bp, Mus musculus
tggcagcaatctcgctctgggcttc

SEQ ID NO: 883882 - DNA, 25 bp, Mus musculus
tggcagcaatctggctctgggcttc

SEQ ID NO: 883883 - DNA, 25 bp, Mus musculus
tggcagcacccaccaggagcatatc

SEQ ID NO: 883884 - DNA, 25 bp, Mus musculus
tggcagcacccagcaggagcatatc

SEQ ID NO: 883885 - DNA, 25 bp, Mus musculus
tggcagcaccccagtaaacctggag

SEQ ID NO: 883886 - DNA, 25 bp, Mus musculus
tggcagcacccctgtaaacctggag

SEQ ID NO: 883887 - DNA, 25 bp, Mus musculus
tggcagcacgtgcctgcagactcac

SEQ ID NO: 883888 - DNA, 25 bp, Mus musculus
tggcagcacgtggctgcagactcac

SEQ ID NO: 883889 - DNA, 25 bp, Mus musculus
tggcagcactacactcggaagcggg

SEQ ID NO: 883890 - DNA, 25 bp, Mus musculus
tggcagcactactctcggaagcggg

SEQ ID NO: 883891 - DNA, 25 bp, Mus musculus
tggcagcactttcagcccgggtgct

SEQ ID NO: 883892 - DNA, 25 bp, Mus musculus
tggcagcactttgagcccgggtgct

SEQ ID NO: 883893 - DNA, 25 bp, Mus musculus
tggcagcagaatcctcctcatcaca

SEQ ID NO: 883894 - DNA, 25 bp, Mus musculus
tggcagcagaatgctcctcatcaca

SEQ ID NO: 883895 - DNA, 25 bp, Mus musculus
tggcagcagacactacctactgtga

SEQ ID NO: 883896 - DNA, 25 bp, Mus musculus
tggcagcagacagtacctactgtga

SEQ ID NO: 883897 - DNA, 25 bp, Mus musculus
tggcagcagagtctttcctccctct

SEQ ID NO: 883898 - DNA, 25 bp, Mus musculus
tggcagcagagtgtttcctccctct

SEQ ID NO: 883899 - DNA, 25 bp, Mus musculus
tggcagcagcacagcatgcccgtga

SEQ ID NO: 883900 - DNA, 25 bp, Mus musculus
tggcagcagcactgcatgcccgtga

SEQ ID NO: 883901 - DNA, 25 bp, Mus musculus
tggcagcagcccagagttcgagttt

SEQ ID NO: 883902 - DNA, 25 bp, Mus musculus
tggcagcagccctgagttcgagttt

SEQ ID NO: 883903 - DNA, 25 bp, Mus musculus
tggcagcaggatctgaagaccataa

SEQ ID NO: 883904 - DNA, 25 bp, Mus musculus
tggcagcaggatgtgaagaccataa

SEQ ID NO: 883905 - DNA, 25 bp, Mus musculus
tggcagcaggtcatcgaggcacttt

SEQ ID NO: 883906 - DNA, 25 bp, Mus musculus
tggcagcaggtcttcgaggcacttt

SEQ ID NO: 883907 - DNA, 25 bp, Mus musculus
tggcagcagtgtcacgtctaagatc

SEQ ID NO: 883908 - DNA, 25 bp, Mus musculus
tggcagcagtgtgacgtctaagatc

SEQ ID NO: 883909 - DNA, 25 bp, Mus musculus
tggcagcagttaactaaagctttga

SEQ ID NO: 883910 - DNA, 25 bp, Mus musculus
tggcagcagttatctaaagctttga

SEQ ID NO: 883911 - DNA, 25 bp, Mus musculus
tggcagcatagcctcaatttccttt

SEQ ID NO: 883912 - DNA, 25 bp, Mus musculus
tggcagcatagcgtcaatttccttt

SEQ ID NO: 883913 - DNA, 25 bp, Mus musculus
tggcagcatgaaccaggactccctc

SEQ ID NO: 883914 - DNA, 25 bp, Mus musculus
tggcagcatgaagcaggactccctc

SEQ ID NO: 883915 - DNA, 25 bp, Mus musculus
tggcagcatgcacaaggactataca

SEQ ID NO: 883916 - DNA, 25 bp, Mus musculus
tggcagcatgcagaaggactataca

SEQ ID NO: 883917 - DNA, 25 bp, Mus musculus
tggcagcattccacaactggaacct

SEQ ID NO: 883918 - DNA, 25 bp, Mus musculus
tggcagcattcctcaactggaacct

SEQ ID NO: 883919 - DNA, 25 bp, Mus musculus
tggcagcattttacaaccctgtatt

SEQ ID NO: 883920 - DNA, 25 bp, Mus musculus
tggcagcatttttcaaccctgtatt

SEQ ID NO: 883921 - DNA, 25 bp, Mus musculus
tggcagccaaagcacgaggatccct

SEQ ID NO: 883922 - DNA, 25 bp, Mus musculus
tggcagccaaaggacgaggatccct

SEQ ID NO: 883923 - DNA, 25 bp, Mus musculus
tggcagccagaacgtgtcactcaga

SEQ ID NO: 883924 - DNA, 25 bp, Mus musculus
tggcagccagaaggtgtcactcaga

SEQ ID NO: 883925 - DNA, 25 bp, Mus musculus
tggcagccagacctcagtaggcagc

SEQ ID NO: 883926 - DNA, 25 bp, Mus musculus
tggcagccagacgtcagtaggcagc

SEQ ID NO: 883927 - DNA, 25 bp, Mus musculus
tggcagccagatatgtgagcagttc

SEQ ID NO: 883928 - DNA, 25 bp, Mus musculus
tggcagccagatttgtgagcagttc

SEQ ID NO: 883929 - DNA, 25 bp, Mus musculus
tggcagccagcgaagcacagataaa

SEQ ID NO: 883930 - DNA, 25 bp, Mus musculus
tggcagccagcgtagcacagataaa

SEQ ID NO: 883931 - DNA, 25 bp, Mus musculus
tggcagccatgcacaaggctaccaa

SEQ ID NO: 883932 - DNA, 25 bp, Mus musculus
tggcagccatgctcaaggctaccaa

SEQ ID NO: 883933 - DNA, 25 bp, Mus musculus
tggcagccatggagggctatgccct

SEQ ID NO: 883934 - DNA, 25 bp, Mus musculus
tggcagccatggtgggctatgccct

SEQ ID NO: 883935 - DNA, 25 bp, Mus musculus
tggcagcccacgacaaactagtttt

SEQ ID NO: 883936 - DNA, 25 bp, Mus musculus
tggcagcccacgtcaaactagtttt

SEQ ID NO: 883937 - DNA, 25 bp, Mus musculus
tggcagcccataactctaatctcag

SEQ ID NO: 883938 - DNA, 25 bp, Mus musculus
tggcagcccatatctctaatctcag

SEQ ID NO: 883939 - DNA, 25 bp, Mus musculus
tggcagcccatcaaggcgcataact

SEQ ID NO: 883940 - DNA, 25 bp, Mus musculus
tggcagcccatctaggcgcataact

SEQ ID NO: 883941 - DNA, 25 bp, Mus musculus
tggcagccccgtcgagactgatgaa

SEQ ID NO: 883942 - DNA, 25 bp, Mus musculus
tggcagccccgtggagactgatgaa

SEQ ID NO: 883943 - DNA, 25 bp, Mus musculus
tggcagcccgagatggacttgtcct

SEQ ID NO: 883944 - DNA, 25 bp, Mus musculus
tggcagcccgagttggacttgtcct

SEQ ID NO: 883945 - DNA, 25 bp, Mus musculus
tggcagccctcacctaatcgtgtaa

SEQ ID NO: 883946 - DNA, 25 bp, Mus musculus
tggcagccctcagctaatcgtgtaa

SEQ ID NO: 883947 - DNA, 25 bp, Mus musculus
tggcagcccttaagacggtgtgtaa

SEQ ID NO: 883948 - DNA, 25 bp, Mus musculus
tggcagcccttatgacggtgtgtaa

SEQ ID NO: 883949 - DNA, 25 bp, Mus musculus
tggcagccgtggagacccaggcatt

SEQ ID NO: 883950 - DNA, 25 bp, Mus musculus
tggcagccgtggtgacccaggcatt

SEQ ID NO: 883951 - DNA, 25 bp, Mus musculus
tggcagcctacgaggttttcagcta

SEQ ID NO: 883952 - DNA, 25 bp, Mus musculus
tggcagcctacgtggttttcagcta

SEQ ID NO: 883953 - DNA, 25 bp, Mus musculus
tggcagcctcgtcgccaccttgtgg

SEQ ID NO: 883954 - DNA, 25 bp, Mus musculus
tggcagcctcgtggccaccttgtgg

SEQ ID NO: 883955 - DNA, 25 bp, Mus musculus
tggcagcctgtcatcattggcctgg

SEQ ID NO: 883956 - DNA, 25 bp, Mus musculus
tggcagcctgtcttcattggcctgg

SEQ ID NO: 883957 - DNA, 25 bp, Mus musculus
tggcagcgccccagacgttggaaac

SEQ ID NO: 883958 - DNA, 25 bp, Mus musculus
tggcagcgcccctgacgttggaaac

SEQ ID NO: 883959 - DNA, 25 bp, Mus musculus
tggcagcggctgcttgctcttgctc

SEQ ID NO: 883960 - DNA, 25 bp, Mus musculus
tggcagcggctggttgctcttgctc

SEQ ID NO: 883961 - DNA, 25 bp, Mus musculus
tggcagcgggcacaaaactcttcat

SEQ ID NO: 883962 - DNA, 25 bp, Mus musculus
tggcagcgggcagaaaactcttcat

SEQ ID NO: 883963 - DNA, 25 bp, Mus musculus
tggcagcgtgccacatgatggagaa

SEQ ID NO: 883964 - DNA, 25 bp, Mus musculus
tggcagcgtgcctcatgatggagaa

SEQ ID NO: 883965 - DNA, 25 bp, Mus musculus
tggcagctaatgctacgaggctctt

SEQ ID NO: 883966 - DNA, 25 bp, Mus musculus
tggcagctaatggtacgaggctctt

SEQ ID NO: 883967 - DNA, 25 bp, Mus musculus
tggcagctacagagagcacctgtct

SEQ ID NO: 883968 - DNA, 25 bp, Mus musculus
tggcagctacagtgagcacctgtct

SEQ ID NO: 883969 - DNA, 25 bp, Mus musculus
tggcagctactcctgagttttgcac

SEQ ID NO: 883970 - DNA, 25 bp, Mus musculus
tggcagctactcgtgagttttgcac

SEQ ID NO: 883971 - DNA, 25 bp, Mus musculus
tggcagctatttcccctacctaaaa

SEQ ID NO: 883972 - DNA, 25 bp, Mus musculus
tggcagctatttgccctacctaaaa

SEQ ID NO: 883973 - DNA, 25 bp, Mus musculus
tggcagctcacaatggtcacataga

SEQ ID NO: 883974 - DNA, 25 bp, Mus musculus
tggcagctcacattggtcacataga

SEQ ID NO: 883975 - DNA, 25 bp, Mus musculus
tggcagctcaggcttcaagtcagtg

SEQ ID NO: 883976 - DNA, 25 bp, Mus musculus
tggcagctcagggttcaagtcagtg

SEQ ID NO: 883977 - DNA, 25 bp, Mus musculus
tggcagctcataaccgtttctaatt

SEQ ID NO: 883978 - DNA, 25 bp, Mus musculus
tggcagctcatatccgtttctaatt

SEQ ID NO: 883979 - DNA, 25 bp, Mus musculus
tggcagctccagacatttgcatgag

SEQ ID NO: 883980 - DNA, 25 bp, Mus musculus
tggcagctccagtcatttgcatgag

SEQ ID NO: 883981 - DNA, 25 bp, Mus musculus
tggcagctccctcaggtatgtgaca

SEQ ID NO: 883982 - DNA, 25 bp, Mus musculus
tggcagctccctgaggtatgtgaca

SEQ ID NO: 883983 - DNA, 25 bp, Mus musculus
tggcagctccgaccaaggatcagaa

SEQ ID NO: 883984 - DNA, 25 bp, Mus musculus
tggcagctccgagcaaggatcagaa

SEQ ID NO: 883985 - DNA, 25 bp, Mus musculus
tggcagctctctcccctgaaaagga

SEQ ID NO: 883986 - DNA, 25 bp, Mus musculus
tggcagctctctgccctgaaaagga

SEQ ID NO: 883987 - DNA, 25 bp, Mus musculus
tggcagctcttacccatgatgcaac

SEQ ID NO: 883988 - DNA, 25 bp, Mus musculus
tggcagctcttagccatgatgcaac

SEQ ID NO: 883989 - DNA, 25 bp, Mus musculus
tggcagctgagtcgcttgatcacaa

SEQ ID NO: 883990 - DNA, 25 bp, Mus musculus
tggcagctgagtggcttgatcacaa

SEQ ID NO: 883991 - DNA, 25 bp, Mus musculus
tggcagctgatgaatgtcttacccc

SEQ ID NO: 883992 - DNA, 25 bp, Mus musculus
tggcagctgatgtatgtcttacccc

SEQ ID NO: 883993 - DNA, 25 bp, Mus musculus
tggcagctgccaatccagtctatgg

SEQ ID NO: 883994 - DNA, 25 bp, Mus musculus
tggcagctgccattccagtctatgg

SEQ ID NO: 883995 - DNA, 25 bp, Mus musculus
tggcagctgctcatcctccattatg

SEQ ID NO: 883996 - DNA, 25 bp, Mus musculus
tggcagctgctcattcatggagtcc

SEQ ID NO: 883997 - DNA, 25 bp, Mus musculus
tggcagctgctcttcctccattatg

SEQ ID NO: 883998 - DNA, 25 bp, Mus musculus
tggcagctgctctttcatggagtcc

SEQ ID NO: 883999 - DNA, 25 bp, Mus musculus
tggcagctgtggctgttatttctcc

SEQ ID NO: 884000 - DNA, 25 bp, Mus musculus
tggcagctgtgggtgttatttctcc

SEQ ID NO: 884001 - DNA, 25 bp, Mus musculus
tggcagctttgaaatgcgcaagaca

SEQ ID NO: 884002 - DNA, 25 bp, Mus musculus
tggcagctttgatatgcgcaagaca

SEQ ID NO: 884003 - DNA, 25 bp, Mus musculus
tggcagctttggacattctttttaa

SEQ ID NO: 884004 - DNA, 25 bp, Mus musculus
tggcagctttggagcagtgtacttt

SEQ ID NO: 884005 - DNA, 25 bp, Mus musculus
tggcagctttggtcattctttttaa

SEQ ID NO: 884006 - DNA, 25 bp, Mus musculus
tggcagctttggtgcagtgtacttt

SEQ ID NO: 884007 - DNA, 25 bp, Mus musculus
tggcaggaaatcacttccctgcttg

SEQ ID NO: 884008 - DNA, 25 bp, Mus musculus
tggcaggaaatctcttccctgcttg

SEQ ID NO: 884009 - DNA, 25 bp, Mus musculus
tggcaggaacttctggcttccccaa

SEQ ID NO: 884010 - DNA, 25 bp, Mus musculus
tggcaggaacttgtggcttccccaa

SEQ ID NO: 884011 - DNA, 25 bp, Mus musculus
tggcaggaagtgaccccaacaggga

SEQ ID NO: 884012 - DNA, 25 bp, Mus musculus
tggcaggaagtgacccgggtccttc

SEQ ID NO: 884013 - DNA, 25 bp, Mus musculus
tggcaggaagtgtccccaacaggga

SEQ ID NO: 884014 - DNA, 25 bp, Mus musculus
tggcaggaagtgtcccgggtccttc

SEQ ID NO: 884015 - DNA, 25 bp, Mus musculus
tggcaggaccaacctctctgaagta

SEQ ID NO: 884016 - DNA, 25 bp, Mus musculus
tggcaggaccaagctctctgaagta

SEQ ID NO: 884017 - DNA, 25 bp, Mus musculus
tggcaggactaactacactacatgt

SEQ ID NO: 884018 - DNA, 25 bp, Mus musculus
tggcaggactaagtacactacatgt

SEQ ID NO: 884019 - DNA, 25 bp, Mus musculus
tggcaggagtctcaccagctgcctg

SEQ ID NO: 884020 - DNA, 25 bp, Mus musculus
tggcaggagtctgaccagctgcctg

SEQ ID NO: 884021 - DNA, 25 bp, Mus musculus
tggcaggatgtgagagccacaccat

SEQ ID NO: 884022 - DNA, 25 bp, Mus musculus
tggcaggatgtgtgagccacaccat

SEQ ID NO: 884023 - DNA, 25 bp, Mus musculus
tggcaggcaacaccatttccatctt

SEQ ID NO: 884024 - DNA, 25 bp, Mus musculus
tggcaggcaacagcatttccatctt

SEQ ID NO: 884025 - DNA, 25 bp, Mus musculus
tggcaggcatttcacacctgagcac

SEQ ID NO: 884026 - DNA, 25 bp, Mus musculus
tggcaggcatttgacacctgagcac

SEQ ID NO: 884027 - DNA, 25 bp, Mus musculus
tggcaggccttcagtcttagttttc

SEQ ID NO: 884028 - DNA, 25 bp, Mus musculus
tggcaggccttctgtcttagttttc

SEQ ID NO: 884029 - DNA, 25 bp, Mus musculus
tggcaggcggttatgatcttttcca

SEQ ID NO: 884030 - DNA, 25 bp, Mus musculus
tggcaggcggttttgatcttttcca

SEQ ID NO: 884031 - DNA, 25 bp, Mus musculus
tggcaggctaggaaactcccacaat

SEQ ID NO: 884032 - DNA, 25 bp, Mus musculus
tggcaggctaggtaactcccacaat

SEQ ID NO: 884033 - DNA, 25 bp, Mus musculus
tggcaggctcctataagttcatctc

SEQ ID NO: 884034 - DNA, 25 bp, Mus musculus
tggcaggctcctttaagttcatctc

SEQ ID NO: 884035 - DNA, 25 bp, Mus musculus
tggcaggctctgaagctacaaggta

SEQ ID NO: 884036 - DNA, 25 bp, Mus musculus
tggcaggctctgtagctacaaggta

SEQ ID NO: 884037 - DNA, 25 bp, Mus musculus
tggcaggctgcgacaaggcatctgt

SEQ ID NO: 884038 - DNA, 25 bp, Mus musculus
tggcaggctgcgtcaaggcatctgt

SEQ ID NO: 884039 - DNA, 25 bp, Mus musculus
tggcagggaatacccagccaccagg

SEQ ID NO: 884040 - DNA, 25 bp, Mus musculus
tggcagggaatagccagccaccagg

SEQ ID NO: 884041 - DNA, 25 bp, Mus musculus
tggcagggaccaacagctcaatgtc

SEQ ID NO: 884042 - DNA, 25 bp, Mus musculus
tggcagggaccatcagctcaatgtc

SEQ ID NO: 884043 - DNA, 25 bp, Mus musculus
tggcagggacgcagagctccattct

SEQ ID NO: 884044 - DNA, 25 bp, Mus musculus
tggcagggacgctgagctccattct

SEQ ID NO: 884045 - DNA, 25 bp, Mus musculus
tggcagggagcactattaccttccg

SEQ ID NO: 884046 - DNA, 25 bp, Mus musculus
tggcagggagcagtattaccttccg

SEQ ID NO: 884047 - DNA, 25 bp, Mus musculus
tggcagggagctaagactgtagctt

SEQ ID NO: 884048 - DNA, 25 bp, Mus musculus
tggcagggagcttagactgtagctt

SEQ ID NO: 884049 - DNA, 25 bp, Mus musculus
tggcagggcacaaccttcttagcat

SEQ ID NO: 884050 - DNA, 25 bp, Mus musculus
tggcagggcacatccttcttagcat

SEQ ID NO: 884051 - DNA, 25 bp, Mus musculus
tggcagggcctaactaatgctctgt

SEQ ID NO: 884052 - DNA, 25 bp, Mus musculus
tggcagggcctatctaatgctctgt

SEQ ID NO: 884053 - DNA, 25 bp, Mus musculus
tggcagggcctgataattgcctctc

SEQ ID NO: 884054 - DNA, 25 bp, Mus musculus
tggcagggcctgttaattgcctctc

SEQ ID NO: 884055 - DNA, 25 bp, Mus musculus
tggcagggctagaccttgctcatgc

SEQ ID NO: 884056 - DNA, 25 bp, Mus musculus
tggcagggctagtccttgctcatgc

SEQ ID NO: 884057 - DNA, 25 bp, Mus musculus
tggcagggtcttataaaactcttga

SEQ ID NO: 884058 - DNA, 25 bp, Mus musculus
tggcagggtcttttaaaactcttga

SEQ ID NO: 884059 - DNA, 25 bp, Mus musculus
tggcagggtttccatttgaccagaa

SEQ ID NO: 884060 - DNA, 25 bp, Mus musculus
tggcagggtttcgatttgaccagaa

SEQ ID NO: 884061 - DNA, 25 bp, Mus musculus
tggcaggtagtcagtgggcacccaa

SEQ ID NO: 884062 - DNA, 25 bp, Mus musculus
tggcaggtagtctgtgggcacccaa

SEQ ID NO: 884063 - DNA, 25 bp, Mus musculus
tggcaggtatctcttagccttacaa

SEQ ID NO: 884064 - DNA, 25 bp, Mus musculus
tggcaggtatctgttagccttacaa

SEQ ID NO: 884065 - DNA, 25 bp, Mus musculus
tggcaggtcgccagggtatccatat

SEQ ID NO: 884066 - DNA, 25 bp, Mus musculus
tggcaggtcgcctgggtatccatat

SEQ ID NO: 884067 - DNA, 25 bp, Mus musculus
tggcaggtgaccatgggcttctgtc

SEQ ID NO: 884068 - DNA, 25 bp, Mus musculus
tggcaggtgaccttgggcttctgtc

SEQ ID NO: 884069 - DNA, 25 bp, Mus musculus
tggcaggtgactatgcctggaacct

SEQ ID NO: 884070 - DNA, 25 bp, Mus musculus
tggcaggtgactttgcctggaacct

SEQ ID NO: 884071 - DNA, 25 bp, Mus musculus
tggcaggtgagaactggaaccatct

SEQ ID NO: 884072 - DNA, 25 bp, Mus musculus
tggcaggtgagatctggaaccatct

SEQ ID NO: 884073 - DNA, 25 bp, Mus musculus
tggcaggtgcgcacgtttgtgttaa

SEQ ID NO: 884074 - DNA, 25 bp, Mus musculus
tggcaggtgcgctcgtttgtgttaa

SEQ ID NO: 884075 - DNA, 25 bp, Mus musculus
tggcaggttaatacttctcggacac

SEQ ID NO: 884076 - DNA, 25 bp, Mus musculus
tggcaggttaattcttctcggacac

SEQ ID NO: 884077 - DNA, 25 bp, Mus musculus
tggcaggttcagatactgacagcac

SEQ ID NO: 884078 - DNA, 25 bp, Mus musculus
tggcaggttcagttactgacagcac

SEQ ID NO: 884079 - DNA, 25 bp, Mus musculus
tggcaggttcatactctgtgtcaaa

SEQ ID NO: 884080 - DNA, 25 bp, Mus musculus
tggcaggttcattctctgtgtcaaa

SEQ ID NO: 884081 - DNA, 25 bp, Mus musculus
tggcaggttttcatccgtgcgtgtg

SEQ ID NO: 884082 - DNA, 25 bp, Mus musculus
tggcaggttttcttccgtgcgtgtg

SEQ ID NO: 884083 - DNA, 25 bp, Mus musculus
tggcagtaaaaaagaatgtctccct

SEQ ID NO: 884084 - DNA, 25 bp, Mus musculus
tggcagtaaaaatgaatgtctccct

SEQ ID NO: 884085 - DNA, 25 bp, Mus musculus
tggcagtaaatacagctacccacct

SEQ ID NO: 884086 - DNA, 25 bp, Mus musculus
tggcagtaaatagagctacccacct

SEQ ID NO: 884087 - DNA, 25 bp, Mus musculus
tggcagtaccagaattagccgcttt

SEQ ID NO: 884088 - DNA, 25 bp, Mus musculus
tggcagtaccagtattagccgcttt

SEQ ID NO: 884089 - DNA, 25 bp, Mus musculus
tggcagtactcactctggaaaggga

SEQ ID NO: 884090 - DNA, 25 bp, Mus musculus
tggcagtactcagtctggaaaggga

SEQ ID NO: 884091 - DNA, 25 bp, Mus musculus
tggcagtagcttacccagcttcagt

SEQ ID NO: 884092 - DNA, 25 bp, Mus musculus
tggcagtagcttctgtcagggccct

SEQ ID NO: 884093 - DNA, 25 bp, Mus musculus
tggcagtagcttgtgtcagggccct

SEQ ID NO: 884094 - DNA, 25 bp, Mus musculus
tggcagtagctttcccagcttcagt

SEQ ID NO: 884095 - DNA, 25 bp, Mus musculus
tggcagtatgttatagcacccgacc

SEQ ID NO: 884096 - DNA, 25 bp, Mus musculus
tggcagtatgttttagcacccgacc

SEQ ID NO: 884097 - DNA, 25 bp, Mus musculus
tggcagtcaccaccttaatctccag

SEQ ID NO: 884098 - DNA, 25 bp, Mus musculus
tggcagtcaccagcttaatctccag

SEQ ID NO: 884099 - DNA, 25 bp, Mus musculus
tggcagtcacttacttggatcgcgt

SEQ ID NO: 884100 - DNA, 25 bp, Mus musculus
tggcagtcactttcttggatcgcgt

SEQ ID NO: 884101 - DNA, 25 bp, Mus musculus
tggcagtcccaccagcattgacaag

SEQ ID NO: 884102 - DNA, 25 bp, Mus musculus
tggcagtcccacgagcattgacaag

SEQ ID NO: 884103 - DNA, 25 bp, Mus musculus
tggcagtcggaaagcccccagaaaa

SEQ ID NO: 884104 - DNA, 25 bp, Mus musculus
tggcagtcggaacggatttttgttt

SEQ ID NO: 884105 - DNA, 25 bp, Mus musculus
tggcagtcggaagggatttttgttt

SEQ ID NO: 884106 - DNA, 25 bp, Mus musculus
tggcagtcggaatgcccccagaaaa

SEQ ID NO: 884107 - DNA, 25 bp, Mus musculus
tggcagtctaccagcgcatccccga

SEQ ID NO: 884108 - DNA, 25 bp, Mus musculus
tggcagtctacctgcgcatccccga

SEQ ID NO: 884109 - DNA, 25 bp, Mus musculus
tggcagtctgaaactatgtcccttc

SEQ ID NO: 884110 - DNA, 25 bp, Mus musculus
tggcagtctgaatctatgtcccttc

SEQ ID NO: 884111 - DNA, 25 bp, Mus musculus
tggcagtctgtcaccttgaaggcta

SEQ ID NO: 884112 - DNA, 25 bp, Mus musculus
tggcagtctgtctccttgaaggcta

SEQ ID NO: 884113 - DNA, 25 bp, Mus musculus
tggcagtcttatctgcaaagatcgt

SEQ ID NO: 884114 - DNA, 25 bp, Mus musculus
tggcagtcttatgtgcaaagatcgt

SEQ ID NO: 884115 - DNA, 25 bp, Mus musculus
tggcagtgacacactgttttctcag

SEQ ID NO: 884116 - DNA, 25 bp, Mus musculus
tggcagtgacactctgttttctcag

SEQ ID NO: 884117 - DNA, 25 bp, Mus musculus
tggcagtgaccacaggataccccag

SEQ ID NO: 884118 - DNA, 25 bp, Mus musculus
tggcagtgaccagaggataccccag

SEQ ID NO: 884119 - DNA, 25 bp, Mus musculus
tggcagtgagcactcagctcaggaa

SEQ ID NO: 884120 - DNA, 25 bp, Mus musculus
tggcagtgagcagtcagctcaggaa

SEQ ID NO: 884121 - DNA, 25 bp, Mus musculus
tggcagtgagtgagctgagccctca

SEQ ID NO: 884122 - DNA, 25 bp, Mus musculus
tggcagtgagtgtgctgagccctca

SEQ ID NO: 884123 - DNA, 25 bp, Mus musculus
tggcagtgataccatcaagcctgat

SEQ ID NO: 884124 - DNA, 25 bp, Mus musculus
tggcagtgatacgatcaagcctgat

SEQ ID NO: 884125 - DNA, 25 bp, Mus musculus
tggcagtgcagacgcttgcagggtt

SEQ ID NO: 884126 - DNA, 25 bp, Mus musculus
tggcagtgcagaggcttgcagggtt

SEQ ID NO: 884127 - DNA, 25 bp, Mus musculus
tggcagtgcattctggagcccagaa

SEQ ID NO: 884128 - DNA, 25 bp, Mus musculus
tggcagtgcattgtggagcccagaa

SEQ ID NO: 884129 - DNA, 25 bp, Mus musculus
tggcagtgctcacatctggatggtt

SEQ ID NO: 884130 - DNA, 25 bp, Mus musculus
tggcagtgctcagatctggatggtt

SEQ ID NO: 884131 - DNA, 25 bp, Mus musculus
tggcagtggcacagtggacttcgat

SEQ ID NO: 884132 - DNA, 25 bp, Mus musculus
tggcagtggcactgtggacttcgat

SEQ ID NO: 884133 - DNA, 25 bp, Mus musculus
tggcagtggcctatccgtggcactg

SEQ ID NO: 884134 - DNA, 25 bp, Mus musculus
tggcagtggcctttccgtggcactg

SEQ ID NO: 884135 - DNA, 25 bp, Mus musculus
tggcagtggctaatgcaatgttttt

SEQ ID NO: 884136 - DNA, 25 bp, Mus musculus
tggcagtggctattgcaatgttttt

SEQ ID NO: 884137 - DNA, 25 bp, Mus musculus
tggcagtgggatacacatcttcctg

SEQ ID NO: 884138 - DNA, 25 bp, Mus musculus
tggcagtgggattcacatcttcctg

SEQ ID NO: 884139 - DNA, 25 bp, Mus musculus
tggcagtgggcccattcctacacat

SEQ ID NO: 884140 - DNA, 25 bp, Mus musculus
tggcagtgggccgattcctacacat

SEQ ID NO: 884141 - DNA, 25 bp, Mus musculus
tggcagttaaacataccttcatttt

SEQ ID NO: 884142 - DNA, 25 bp, Mus musculus
tggcagttaaacttaccttcatttt

SEQ ID NO: 884143 - DNA, 25 bp, Mus musculus
tggcagttaagcacatcagtacatt

SEQ ID NO: 884144 - DNA, 25 bp, Mus musculus
tggcagttaagctcatcagtacatt

SEQ ID NO: 884145 - DNA, 25 bp, Mus musculus
tggcagttcgggaccaaccagagct

SEQ ID NO: 884146 - DNA, 25 bp, Mus musculus
tggcagttcgggtccaaccagagct

SEQ ID NO: 884147 - DNA, 25 bp, Mus musculus
tggcagttctgacgagctcacaact

SEQ ID NO: 884148 - DNA, 25 bp, Mus musculus
tggcagttctgaggagctcacaact

SEQ ID NO: 884149 - DNA, 25 bp, Mus musculus
tggcagttctgcaaaaatttgtttc

SEQ ID NO: 884150 - DNA, 25 bp, Mus musculus
tggcagttctgctaaaatttgtttc

SEQ ID NO: 884151 - DNA, 25 bp, Mus musculus
tggcagttgagtaccctgcatccca

SEQ ID NO: 884152 - DNA, 25 bp, Mus musculus
tggcagttgagttccctgcatccca

SEQ ID NO: 884153 - DNA, 25 bp, Mus musculus
tggcagtttacaacaccctaactct

SEQ ID NO: 884154 - DNA, 25 bp, Mus musculus
tggcagtttacatcaccctaactct

SEQ ID NO: 884155 - DNA, 25 bp, Mus musculus
tggcagtttaggatcacaggtttga

SEQ ID NO: 884156 - DNA, 25 bp, Mus musculus
tggcagtttaggttcacaggtttga

SEQ ID NO: 884157 - DNA, 25 bp, Mus musculus
tggcataaaaggctcgtttaaaaca

SEQ ID NO: 884158 - DNA, 25 bp, Mus musculus
tggcataaaagggtcgtttaaaaca

SEQ ID NO: 884159 - DNA, 25 bp, Mus musculus
tggcataaacccaactttactgaaa

SEQ ID NO: 884160 - DNA, 25 bp, Mus musculus
tggcataaaccctactttactgaaa

SEQ ID NO: 884161 - DNA, 25 bp, Mus musculus
tggcataaacctcacttgggaacat

SEQ ID NO: 884162 - DNA, 25 bp, Mus musculus
tggcataaacctgacttgggaacat

SEQ ID NO: 884163 - DNA, 25 bp, Mus musculus
tggcataagcacaatgtctccaact

SEQ ID NO: 884164 - DNA, 25 bp, Mus musculus
tggcataagcactatgtctccaact

SEQ ID NO: 884165 - DNA, 25 bp, Mus musculus
tggcataattttctgtggctggtac

SEQ ID NO: 884166 - DNA, 25 bp, Mus musculus
tggcataattttgtgtggctggtac

SEQ ID NO: 884167 - DNA, 25 bp, Mus musculus
tggcatacacacactgcatgttact

SEQ ID NO: 884168 - DNA, 25 bp, Mus musculus
tggcatacacactctgcatgttact

SEQ ID NO: 884169 - DNA, 25 bp, Mus musculus
tggcatacagaccagttttaggact

SEQ ID NO: 884170 - DNA, 25 bp, Mus musculus
tggcatacagacgagttttaggact

SEQ ID NO: 884171 - DNA, 25 bp, Mus musculus
tggcatacatagacacattcacata

SEQ ID NO: 884172 - DNA, 25 bp, Mus musculus
tggcatacatagtcacattcacata

SEQ ID NO: 884173 - DNA, 25 bp, Mus musculus
tggcatacatccacagttgggcaaa

SEQ ID NO: 884174 - DNA, 25 bp, Mus musculus
tggcatacatcctcagttgggcaaa

SEQ ID NO: 884175 - DNA, 25 bp, Mus musculus
tggcataccatcaaatatcagaagg

SEQ ID NO: 884176 - DNA, 25 bp, Mus musculus
tggcataccatctaatatcagaagg

SEQ ID NO: 884177 - DNA, 25 bp, Mus musculus
tggcatacgccgaggactatatcat

SEQ ID NO: 884178 - DNA, 25 bp, Mus musculus
tggcatacgccgtggactatatcat

SEQ ID NO: 884179 - DNA, 25 bp, Mus musculus
tggcatactgtactggaacgctgaa

SEQ ID NO: 884180 - DNA, 25 bp, Mus musculus
tggcatactgtagtggaacgctgaa

SEQ ID NO: 884181 - DNA, 25 bp, Mus musculus
tggcatactttcacacaagcattta

SEQ ID NO: 884182 - DNA, 25 bp, Mus musculus
tggcatactttcacagactgagctc

SEQ ID NO: 884183 - DNA, 25 bp, Mus musculus
tggcatactttctcacaagcattta

SEQ ID NO: 884184 - DNA, 25 bp, Mus musculus
tggcatactttctcagactgagctc

SEQ ID NO: 884185 - DNA, 25 bp, Mus musculus
tggcatagcccgcagttgacaaaga

SEQ ID NO: 884186 - DNA, 25 bp, Mus musculus
tggcatagcccggagttgacaaaga

SEQ ID NO: 884187 - DNA, 25 bp, Mus musculus
tggcatagctggattgcacctggca

SEQ ID NO: 884188 - DNA, 25 bp, Mus musculus
tggcatagctggtttgcacctggca

SEQ ID NO: 884189 - DNA, 25 bp, Mus musculus
tggcataggctaattggtgactgta

SEQ ID NO: 884190 - DNA, 25 bp, Mus musculus
tggcataggctatttggtgactgta

SEQ ID NO: 884191 - DNA, 25 bp, Mus musculus
tggcatatacatcgtcactggcttc

SEQ ID NO: 884192 - DNA, 25 bp, Mus musculus
tggcatatacatggtcactggcttc

SEQ ID NO: 884193 - DNA, 25 bp, Mus musculus
tggcatatccataaatcccagttat

SEQ ID NO: 884194 - DNA, 25 bp, Mus musculus
tggcatatccattaatcccagttat

SEQ ID NO: 884195 - DNA, 25 bp, Mus musculus
tggcatatcgccactgttccaggaa

SEQ ID NO: 884196 - DNA, 25 bp, Mus musculus
tggcatatcgcctctgttccaggaa

SEQ ID NO: 884197 - DNA, 25 bp, Mus musculus
tggcatatctgaaggcttgaccctg

SEQ ID NO: 884198 - DNA, 25 bp, Mus musculus
tggcatatctgatggcttgaccctg

SEQ ID NO: 884199 - DNA, 25 bp, Mus musculus
tggcatcaaggacaagaccattgcg

SEQ ID NO: 884200 - DNA, 25 bp, Mus musculus
tggcatcaaggagaagaccattgcg

SEQ ID NO: 884201 - DNA, 25 bp, Mus musculus
tggcatcaataacatccgagaactg

SEQ ID NO: 884202 - DNA, 25 bp, Mus musculus
tggcatcaataagatccgagaactg

SEQ ID NO: 884203 - DNA, 25 bp, Mus musculus
tggcatcacgagagggcagttcact

SEQ ID NO: 884204 - DNA, 25 bp, Mus musculus
tggcatcacgagtgggcagttcact

SEQ ID NO: 884205 - DNA, 25 bp, Mus musculus
tggcatcactagagtttgtagtgta

SEQ ID NO: 884206 - DNA, 25 bp, Mus musculus
tggcatcactagtgtttgtagtgta

SEQ ID NO: 884207 - DNA, 25 bp, Mus musculus
tggcatcagtatacatgggagactc

SEQ ID NO: 884208 - DNA, 25 bp, Mus musculus
tggcatcagtattcatgggagactc

SEQ ID NO: 884209 - DNA, 25 bp, Mus musculus
tggcatcagttgacctgactgctat

SEQ ID NO: 884210 - DNA, 25 bp, Mus musculus
tggcatcagttgtcctgactgctat

SEQ ID NO: 884211 - DNA, 25 bp, Mus musculus
tggcatcatcagaggttgtgagtca

SEQ ID NO: 884212 - DNA, 25 bp, Mus musculus
tggcatcatcagctgtaggtggaac

SEQ ID NO: 884213 - DNA, 25 bp, Mus musculus
tggcatcatcaggtgtaggtggaac

SEQ ID NO: 884214 - DNA, 25 bp, Mus musculus
tggcatcatcagtggttgtgagtca

SEQ ID NO: 884215 - DNA, 25 bp, Mus musculus
tggcatcatccgcatggacctagag

SEQ ID NO: 884216 - DNA, 25 bp, Mus musculus
tggcatcatccggatggacctagag

SEQ ID NO: 884217 - DNA, 25 bp, Mus musculus
tggcatccagagaaagctactgctt

SEQ ID NO: 884218 - DNA, 25 bp, Mus musculus
tggcatccagagtaagctactgctt

SEQ ID NO: 884219 - DNA, 25 bp, Mus musculus
tggcatccaggcagcgcagacagtg

SEQ ID NO: 884220 - DNA, 25 bp, Mus musculus
tggcatccaggctgcgcagacagtg

SEQ ID NO: 884221 - DNA, 25 bp, Mus musculus
tggcatccaggtccgttacatgaag

SEQ ID NO: 884222 - DNA, 25 bp, Mus musculus
tggcatccaggtgcgttacatgaag

SEQ ID NO: 884223 - DNA, 25 bp, Mus musculus
tggcatccagtgagggctacgtgct

SEQ ID NO: 884224 - DNA, 25 bp, Mus musculus
tggcatccagtgtgggctacgtgct

SEQ ID NO: 884225 - DNA, 25 bp, Mus musculus
tggcatcccagactgttccaacaca

SEQ ID NO: 884226 - DNA, 25 bp, Mus musculus
tggcatcccagagtgttccaacaca

SEQ ID NO: 884227 - DNA, 25 bp, Mus musculus
tggcatcccaggcttgtgccacttc

SEQ ID NO: 884228 - DNA, 25 bp, Mus musculus
tggcatcccagggttgtgccacttc

SEQ ID NO: 884229 - DNA, 25 bp, Mus musculus
tggcatcccatgacagacacaagct

SEQ ID NO: 884230 - DNA, 25 bp, Mus musculus
tggcatcccatgtcagacacaagct

SEQ ID NO: 884231 - DNA, 25 bp, Mus musculus
tggcatccccaaagtgatttctcct

SEQ ID NO: 884232 - DNA, 25 bp, Mus musculus
tggcatccccaatgtgatttctcct

SEQ ID NO: 884233 - DNA, 25 bp, Mus musculus
tggcatcccgcaaaaaagcacatgg

SEQ ID NO: 884234 - DNA, 25 bp, Mus musculus
tggcatcccgcataaaagcacatgg

SEQ ID NO: 884235 - DNA, 25 bp, Mus musculus
tggcatccctctcagaaagcaatgt

SEQ ID NO: 884236 - DNA, 25 bp, Mus musculus
tggcatccctctgagaaagcaatgt

SEQ ID NO: 884237 - DNA, 25 bp, Mus musculus
tggcatcctactcttcaggttaaaa

SEQ ID NO: 884238 - DNA, 25 bp, Mus musculus
tggcatcctactgttcaggttaaaa

SEQ ID NO: 884239 - DNA, 25 bp, Mus musculus
tggcatcctccaagcagagcagcag

SEQ ID NO: 884240 - DNA, 25 bp, Mus musculus
tggcatcctccatgcagagcagcag

SEQ ID NO: 884241 - DNA, 25 bp, Mus musculus
tggcatcctggacctcagagtccag

SEQ ID NO: 884242 - DNA, 25 bp, Mus musculus
tggcatcctggagctcagagtccag

SEQ ID NO: 884243 - DNA, 25 bp, Mus musculus
tggcatccttgtctctgagagaaca

SEQ ID NO: 884244 - DNA, 25 bp, Mus musculus
tggcatccttgtgtctgagagaaca

SEQ ID NO: 884245 - DNA, 25 bp, Mus musculus
tggcatcgatcaaggattcctttcc

SEQ ID NO: 884246 - DNA, 25 bp, Mus musculus
tggcatcgatcatggattcctttcc

SEQ ID NO: 884247 - DNA, 25 bp, Mus musculus
tggcatcgcattcctgtgtgcatga

SEQ ID NO: 884248 - DNA, 25 bp, Mus musculus
tggcatcgcattgctgtgtgcatga

SEQ ID NO: 884249 - DNA, 25 bp, Mus musculus
tggcatcgctgtctgttcttgatca

SEQ ID NO: 884250 - DNA, 25 bp, Mus musculus
tggcatcgctgtgtgttcttgatca

SEQ ID NO: 884251 - DNA, 25 bp, Mus musculus
tggcatcgggatccaaccagccgtg

SEQ ID NO: 884252 - DNA, 25 bp, Mus musculus
tggcatcgggatgcaaccagccgtg

SEQ ID NO: 884253 - DNA, 25 bp, Mus musculus
tggcatctagcaaggagggatcctt

SEQ ID NO: 884254 - DNA, 25 bp, Mus musculus
tggcatctagcatggagggatcctt

SEQ ID NO: 884255 - DNA, 25 bp, Mus musculus
tggcatctatcacctgagacatcct

SEQ ID NO: 884256 - DNA, 25 bp, Mus musculus
tggcatctatcagctgagacatcct

SEQ ID NO: 884257 - DNA, 25 bp, Mus musculus
tggcatctatctcattccctgggaa

SEQ ID NO: 884258 - DNA, 25 bp, Mus musculus
tggcatctatctgattccctgggaa

SEQ ID NO: 884259 - DNA, 25 bp, Mus musculus
tggcatctatttaattcataagcac

SEQ ID NO: 884260 - DNA, 25 bp, Mus musculus
tggcatctattttattcataagcac

SEQ ID NO: 884261 - DNA, 25 bp, Mus musculus
tggcatctccatcgcttccgttggc

SEQ ID NO: 884262 - DNA, 25 bp, Mus musculus
tggcatctccatggcttccgttggc

SEQ ID NO: 884263 - DNA, 25 bp, Mus musculus
tggcatctctgaacaccagtggcag

SEQ ID NO: 884264 - DNA, 25 bp, Mus musculus
tggcatctctgatcaccagtggcag

SEQ ID NO: 884265 - DNA, 25 bp, Mus musculus
tggcatctgagtagcagcacctgat

SEQ ID NO: 884266 - DNA, 25 bp, Mus musculus
tggcatctgagttgcagcacctgat

SEQ ID NO: 884267 - DNA, 25 bp, Mus musculus
tggcatctgatcagctcaagacctc

SEQ ID NO: 884268 - DNA, 25 bp, Mus musculus
tggcatctgatctgctcaagacctc

SEQ ID NO: 884269 - DNA, 25 bp, Mus musculus
tggcatctggatccactggcataaa

SEQ ID NO: 884270 - DNA, 25 bp, Mus musculus
tggcatctggatgcactggcataaa

SEQ ID NO: 884271 - DNA, 25 bp, Mus musculus
tggcatctggtgatcgctgctcgcg

SEQ ID NO: 884272 - DNA, 25 bp, Mus musculus
tggcatctggtgttcgctgctcgcg

SEQ ID NO: 884273 - DNA, 25 bp, Mus musculus
tggcatctgtctcttttcgcatata

SEQ ID NO: 884274 - DNA, 25 bp, Mus musculus
tggcatctgtctgttttcgcatata

SEQ ID NO: 884275 - DNA, 25 bp, Mus musculus
tggcatctgtgcactcatgacagca

SEQ ID NO: 884276 - DNA, 25 bp, Mus musculus
tggcatctgtgctctcatgacagca

SEQ ID NO: 884277 - DNA, 25 bp, Mus musculus
tggcatctgtgtagtggaggtttca

SEQ ID NO: 884278 - DNA, 25 bp, Mus musculus
tggcatctgtgttgtggaggtttca

SEQ ID NO: 884279 - DNA, 25 bp, Mus musculus
tggcatcttactatttctctgggtt

SEQ ID NO: 884280 - DNA, 25 bp, Mus musculus
tggcatcttactttttctctgggtt

SEQ ID NO: 884281 - DNA, 25 bp, Mus musculus
tggcatcttaggctggttacttaac

SEQ ID NO: 884282 - DNA, 25 bp, Mus musculus
tggcatcttagggtggttacttaac

SEQ ID NO: 884283 - DNA, 25 bp, Mus musculus
tggcatcttgacaatcaccttgtaa

SEQ ID NO: 884284 - DNA, 25 bp, Mus musculus
tggcatcttgactatcaccttgtaa

SEQ ID NO: 884285 - DNA, 25 bp, Mus musculus
tggcatcttgctaaaggcgtgggct

SEQ ID NO: 884286 - DNA, 25 bp, Mus musculus
tggcatcttgcttaaggcgtgggct

SEQ ID NO: 884287 - DNA, 25 bp, Mus musculus
tggcatcttgtcaggaggctttgag

SEQ ID NO: 884288 - DNA, 25 bp, Mus musculus
tggcatcttgtctggaggctttgag

SEQ ID NO: 884289 - DNA, 25 bp, Mus musculus
tggcatcttgttactttaatatgat

SEQ ID NO: 884290 - DNA, 25 bp, Mus musculus
tggcatcttgtttctttaatatgat

SEQ ID NO: 884291 - DNA, 25 bp, Mus musculus
tggcatctttctatgagctccagct

SEQ ID NO: 884292 - DNA, 25 bp, Mus musculus
tggcatctttctttgagctccagct

SEQ ID NO: 884293 - DNA, 25 bp, Mus musculus
tggcatcttttgagtgttccaagat

SEQ ID NO: 884294 - DNA, 25 bp, Mus musculus
tggcatcttttgtgtgttccaagat

SEQ ID NO: 884295 - DNA, 25 bp, Mus musculus
tggcatgaacaaacgcccttcctga

SEQ ID NO: 884296 - DNA, 25 bp, Mus musculus
tggcatgaacaatcgcccttcctga

SEQ ID NO: 884297 - DNA, 25 bp, Mus musculus
tggcatgaacctagagtggtctcag

SEQ ID NO: 884298 - DNA, 25 bp, Mus musculus
tggcatgaaccttgagtggtctcag

SEQ ID NO: 884299 - DNA, 25 bp, Mus musculus
tggcatgaattgacagcaggagctc

SEQ ID NO: 884300 - DNA, 25 bp, Mus musculus
tggcatgaattgtcagcaggagctc

SEQ ID NO: 884301 - DNA, 25 bp, Mus musculus
tggcatgacagactccatccaatct

SEQ ID NO: 884302 - DNA, 25 bp, Mus musculus
tggcatgacagagtccatccaatct

SEQ ID NO: 884303 - DNA, 25 bp, Mus musculus
tggcatgaccatatctagcccattg

SEQ ID NO: 884304 - DNA, 25 bp, Mus musculus
tggcatgaccatttctagcccattg

SEQ ID NO: 884305 - DNA, 25 bp, Mus musculus
tggcatgacggacatgaactactac

SEQ ID NO: 884306 - DNA, 25 bp, Mus musculus
tggcatgacggagatgaactactac

SEQ ID NO: 884307 - DNA, 25 bp, Mus musculus
tggcatgatcttccaagaatcacac

SEQ ID NO: 884308 - DNA, 25 bp, Mus musculus
tggcatgatcttgcaagaatcacac

SEQ ID NO: 884309 - DNA, 25 bp, Mus musculus
tggcatgatgaacctgcccagtcct

SEQ ID NO: 884310 - DNA, 25 bp, Mus musculus
tggcatgatgaagctgcccagtcct

SEQ ID NO: 884311 - DNA, 25 bp, Mus musculus
tggcatgattctaatattgtacctc

SEQ ID NO: 884312 - DNA, 25 bp, Mus musculus
tggcatgattcttatattgtacctc

SEQ ID NO: 884313 - DNA, 25 bp, Mus musculus
tggcatgattgcactattgaagaca

SEQ ID NO: 884314 - DNA, 25 bp, Mus musculus
tggcatgattgctctattgaagaca

SEQ ID NO: 884315 - DNA, 25 bp, Mus musculus
tggcatgattgtcgatcccctgaga

SEQ ID NO: 884316 - DNA, 25 bp, Mus musculus
tggcatgattgtggatcccctgaga

SEQ ID NO: 884317 - DNA, 25 bp, Mus musculus
tggcatgcagctaggtagcctgagt

SEQ ID NO: 884318 - DNA, 25 bp, Mus musculus
tggcatgcagcttggtagcctgagt

SEQ ID NO: 884319 - DNA, 25 bp, Mus musculus
tggcatgcatgcacgttttaacgtt

SEQ ID NO: 884320 - DNA, 25 bp, Mus musculus
tggcatgcatgctcgttttaacgtt

SEQ ID NO: 884321 - DNA, 25 bp, Mus musculus
tggcatgcatttctcagtgttggta

SEQ ID NO: 884322 - DNA, 25 bp, Mus musculus
tggcatgcatttgtcagtgttggta

SEQ ID NO: 884323 - DNA, 25 bp, Mus musculus
tggcatgctggcagcaagtacttgc

SEQ ID NO: 884324 - DNA, 25 bp, Mus musculus
tggcatgctggctgcaagtacttgc

SEQ ID NO: 884325 - DNA, 25 bp, Mus musculus
tggcatggagacaccttccttttac

SEQ ID NO: 884326 - DNA, 25 bp, Mus musculus
tggcatggagactccttccttttac

SEQ ID NO: 884327 - DNA, 25 bp, Mus musculus
tggcatggaggaagcccagctttgt

SEQ ID NO: 884328 - DNA, 25 bp, Mus musculus
tggcatggaggatgcccagctttgt

SEQ ID NO: 884329 - DNA, 25 bp, Mus musculus
tggcatggatacacattcctcacgt

SEQ ID NO: 884330 - DNA, 25 bp, Mus musculus
tggcatggatactcattcctcacgt

SEQ ID NO: 884331 - DNA, 25 bp, Mus musculus
tggcatggatgaaaacagactcact

SEQ ID NO: 884332 - DNA, 25 bp, Mus musculus
tggcatggatgataacagactcact

SEQ ID NO: 884333 - DNA, 25 bp, Mus musculus
tggcatggatggctcagtctgaata

SEQ ID NO: 884334 - DNA, 25 bp, Mus musculus
tggcatggatgggtcagtctgaata

SEQ ID NO: 884335 - DNA, 25 bp, Mus musculus
tggcatggccatagttctgactaac

SEQ ID NO: 884336 - DNA, 25 bp, Mus musculus
tggcatggccattgttctgactaac

SEQ ID NO: 884337 - DNA, 25 bp, Mus musculus
tggcatggccttccgtgttcctacc

SEQ ID NO: 884338 - DNA, 25 bp, Mus musculus
tggcatggccttgcgtgttcctacc

SEQ ID NO: 884339 - DNA, 25 bp, Mus musculus
tggcatgggaagagcttgctttagt

SEQ ID NO: 884340 - DNA, 25 bp, Mus musculus
tggcatgggaagtgcttgctttagt

SEQ ID NO: 884341 - DNA, 25 bp, Mus musculus
tggcatgggcaccacacattggaac

SEQ ID NO: 884342 - DNA, 25 bp, Mus musculus
tggcatgggcacgacacattggaac

SEQ ID NO: 884343 - DNA, 25 bp, Mus musculus
tggcatgggtttctattctgacaaa

SEQ ID NO: 884344 - DNA, 25 bp, Mus musculus
tggcatgggtttgtattctgacaaa

SEQ ID NO: 884345 - DNA, 25 bp, Mus musculus
tggcatggtactccctgagcatgga

SEQ ID NO: 884346 - DNA, 25 bp, Mus musculus
tggcatggtactgcctgagcatgga

SEQ ID NO: 884347 - DNA, 25 bp, Mus musculus
tggcatggtctaacaaacatactgt

SEQ ID NO: 884348 - DNA, 25 bp, Mus musculus
tggcatggtctatcaaacatactgt

SEQ ID NO: 884349 - DNA, 25 bp, Mus musculus
tggcatgtacttctgcttgaatgtc

SEQ ID NO: 884350 - DNA, 25 bp, Mus musculus
tggcatgtacttgtgcttgaatgtc

SEQ ID NO: 884351 - DNA, 25 bp, Mus musculus
tggcatgtcacaatcctggagcagc

SEQ ID NO: 884352 - DNA, 25 bp, Mus musculus
tggcatgtcacattcctggagcagc

SEQ ID NO: 884353 - DNA, 25 bp, Mus musculus
tggcatgtcagaaccacaatggata

SEQ ID NO: 884354 - DNA, 25 bp, Mus musculus
tggcatgtcagatccacaatggata

SEQ ID NO: 884355 - DNA, 25 bp, Mus musculus
tggcatgtcctgcacagcagtgtgt

SEQ ID NO: 884356 - DNA, 25 bp, Mus musculus
tggcatgtcctggacagcagtgtgt

SEQ ID NO: 884357 - DNA, 25 bp, Mus musculus
tggcatgtgaccatcattcccgcag

SEQ ID NO: 884358 - DNA, 25 bp, Mus musculus
tggcatgtgaccccgggaccaaata

SEQ ID NO: 884359 - DNA, 25 bp, Mus musculus
tggcatgtgaccgcgggaccaaata

SEQ ID NO: 884360 - DNA, 25 bp, Mus musculus
tggcatgtgaccttcattcccgcag

SEQ ID NO: 884361 - DNA, 25 bp, Mus musculus
tggcatgtgagaatccagctgtgct

SEQ ID NO: 884362 - DNA, 25 bp, Mus musculus
tggcatgtgagattccagctgtgct

SEQ ID NO: 884363 - DNA, 25 bp, Mus musculus
tggcatgtgccaatcacgttctatc

SEQ ID NO: 884364 - DNA, 25 bp, Mus musculus
tggcatgtgccattcacgttctatc

SEQ ID NO: 884365 - DNA, 25 bp, Mus musculus
tggcatgtgtccagggcaccaggtc

SEQ ID NO: 884366 - DNA, 25 bp, Mus musculus
tggcatgtgtcctgggcaccaggtc

SEQ ID NO: 884367 - DNA, 25 bp, Mus musculus
tggcatgtgtgcacccatacatatg

SEQ ID NO: 884368 - DNA, 25 bp, Mus musculus
tggcatgtgtgcacctttaacacaa

SEQ ID NO: 884369 - DNA, 25 bp, Mus musculus
tggcatgtgtgctcccatacatatg

SEQ ID NO: 884370 - DNA, 25 bp, Mus musculus
tggcatgtgtgctcctttaacacaa

SEQ ID NO: 884371 - DNA, 25 bp, Mus musculus
tggcatgtgtttcgagctcaggttc

SEQ ID NO: 884372 - DNA, 25 bp, Mus musculus
tggcatgtgtttggagctcaggttc

SEQ ID NO: 884373 - DNA, 25 bp, Mus musculus
tggcatgttcatcaaacctgggacc

SEQ ID NO: 884374 - DNA, 25 bp, Mus musculus
tggcatgttcatgaaacctgggacc

SEQ ID NO: 884375 - DNA, 25 bp, Mus musculus
tggcatgttccaactggcctgggag

SEQ ID NO: 884376 - DNA, 25 bp, Mus musculus
tggcatgttccatctggcctgggag

SEQ ID NO: 884377 - DNA, 25 bp, Mus musculus
tggcattaagtcctaagttctcccg

SEQ ID NO: 884378 - DNA, 25 bp, Mus musculus
tggcattaagtcgtaagttctcccg

SEQ ID NO: 884379 - DNA, 25 bp, Mus musculus
tggcattactctatgctctgctcct

SEQ ID NO: 884380 - DNA, 25 bp, Mus musculus
tggcattactctttgctctgctcct

SEQ ID NO: 884381 - DNA, 25 bp, Mus musculus
tggcattagcacagcccataaggca

SEQ ID NO: 884382 - DNA, 25 bp, Mus musculus
tggcattagcactgcccataaggca

SEQ ID NO: 884383 - DNA, 25 bp, Mus musculus
tggcattcaaccaccagggtggact

SEQ ID NO: 884384 - DNA, 25 bp, Mus musculus
tggcattcaacctccagggtggact

SEQ ID NO: 884385 - DNA, 25 bp, Mus musculus
tggcattcaatgcagacaccgaagt

SEQ ID NO: 884386 - DNA, 25 bp, Mus musculus
tggcattcaatggagacaccgaagt

SEQ ID NO: 884387 - DNA, 25 bp, Mus musculus
tggcattcacaaagctgattcaatt

SEQ ID NO: 884388 - DNA, 25 bp, Mus musculus
tggcattcacaatgctgattcaatt

SEQ ID NO: 884389 - DNA, 25 bp, Mus musculus
tggcattcactcactacttatctga

SEQ ID NO: 884390 - DNA, 25 bp, Mus musculus
tggcattcactctctacttatctga

SEQ ID NO: 884391 - DNA, 25 bp, Mus musculus
tggcattcagaaccattctccgaaa

SEQ ID NO: 884392 - DNA, 25 bp, Mus musculus
tggcattcagaagcattctccgaaa

SEQ ID NO: 884393 - DNA, 25 bp, Mus musculus
tggcattcagctagggttcagactc

SEQ ID NO: 884394 - DNA, 25 bp, Mus musculus
tggcattcagcttgggttcagactc

SEQ ID NO: 884395 - DNA, 25 bp, Mus musculus
tggcattcagtaacgacagagcact

SEQ ID NO: 884396 - DNA, 25 bp, Mus musculus
tggcattcagtatcgacagagcact

SEQ ID NO: 884397 - DNA, 25 bp, Mus musculus
tggcattccaaaactgatcacagct

SEQ ID NO: 884398 - DNA, 25 bp, Mus musculus
tggcattccaaatctgatcacagct

SEQ ID NO: 884399 - DNA, 25 bp, Mus musculus
tggcattccaggctgacttttgctc

SEQ ID NO: 884400 - DNA, 25 bp, Mus musculus
tggcattccagggtgacttttgctc

SEQ ID NO: 884401 - DNA, 25 bp, Mus musculus
tggcattcccaccatgacattaagt

SEQ ID NO: 884402 - DNA, 25 bp, Mus musculus
tggcattcccacgatgacattaagt

SEQ ID NO: 884403 - DNA, 25 bp, Mus musculus
tggcattcccatcacatgattcttc

SEQ ID NO: 884404 - DNA, 25 bp, Mus musculus
tggcattcccatgacatgattcttc

SEQ ID NO: 884405 - DNA, 25 bp, Mus musculus
tggcattccccaagatatgattgga

SEQ ID NO: 884406 - DNA, 25 bp, Mus musculus
tggcattccccatgatatgattgga

SEQ ID NO: 884407 - DNA, 25 bp, Mus musculus
tggcattccgttagaattccttctt

SEQ ID NO: 884408 - DNA, 25 bp, Mus musculus
tggcattccgtttgaattccttctt

SEQ ID NO: 884409 - DNA, 25 bp, Mus musculus
tggcattcctgtatcactatcttag

SEQ ID NO: 884410 - DNA, 25 bp, Mus musculus
tggcattcctgtttcactatcttag

SEQ ID NO: 884411 - DNA, 25 bp, Mus musculus
tggcattcgtgacgccctggatttg

SEQ ID NO: 884412 - DNA, 25 bp, Mus musculus
tggcattcgtgaggccctggatttg

SEQ ID NO: 884413 - DNA, 25 bp, Mus musculus
tggcattctatcaagttcctcagtt

SEQ ID NO: 884414 - DNA, 25 bp, Mus musculus
tggcattctatctagttcctcagtt

SEQ ID NO: 884415 - DNA, 25 bp, Mus musculus
tggcattctcagcttaagttctctc

SEQ ID NO: 884416 - DNA, 25 bp, Mus musculus
tggcattctcaggttaagttctctc

SEQ ID NO: 884417 - DNA, 25 bp, Mus musculus
tggcattctcttcctatgtgcactg

SEQ ID NO: 884418 - DNA, 25 bp, Mus musculus
tggcattctcttgctatgtgcactg

SEQ ID NO: 884419 - DNA, 25 bp, Mus musculus
tggcattctgcaccctacaagagtg

SEQ ID NO: 884420 - DNA, 25 bp, Mus musculus
tggcattctgcacctgatagccaaa

SEQ ID NO: 884421 - DNA, 25 bp, Mus musculus
tggcattctgcagcctacaagagtg

SEQ ID NO: 884422 - DNA, 25 bp, Mus musculus
tggcattctgcagctgatagccaaa

SEQ ID NO: 884423 - DNA, 25 bp, Mus musculus
tggcattctgctacttttccactga

SEQ ID NO: 884424 - DNA, 25 bp, Mus musculus
tggcattctgcttcttttccactga

SEQ ID NO: 884425 - DNA, 25 bp, Mus musculus
tggcattctttaccctctgattcta

SEQ ID NO: 884426 - DNA, 25 bp, Mus musculus
tggcattctttagcctctgattcta

SEQ ID NO: 884427 - DNA, 25 bp, Mus musculus
tggcattgaaggcactctagctagc

SEQ ID NO: 884428 - DNA, 25 bp, Mus musculus
tggcattgaagggactctagctagc

SEQ ID NO: 884429 - DNA, 25 bp, Mus musculus
tggcattgagacagtaaattcattt

SEQ ID NO: 884430 - DNA, 25 bp, Mus musculus
tggcattgagactgtaaattcattt

SEQ ID NO: 884431 - DNA, 25 bp, Mus musculus
tggcattgcaaaaataaccaccttt

SEQ ID NO: 884432 - DNA, 25 bp, Mus musculus
tggcattgcaaaaggccttttctct

SEQ ID NO: 884433 - DNA, 25 bp, Mus musculus
tggcattgcaaatataaccaccttt

SEQ ID NO: 884434 - DNA, 25 bp, Mus musculus
tggcattgcaaatggccttttctct

SEQ ID NO: 884435 - DNA, 25 bp, Mus musculus
tggcattgccacctttaaagaaaga

SEQ ID NO: 884436 - DNA, 25 bp, Mus musculus
tggcattgccacgtttaaagaaaga

SEQ ID NO: 884437 - DNA, 25 bp, Mus musculus
tggcattgccgcctttgaatctgtg

SEQ ID NO: 884438 - DNA, 25 bp, Mus musculus
tggcattgccgcgtttgaatctgtg

SEQ ID NO: 884439 - DNA, 25 bp, Mus musculus
tggcattgccggagcctttcggaga

SEQ ID NO: 884440 - DNA, 25 bp, Mus musculus
tggcattgccggtgcctttcggaga

SEQ ID NO: 884441 - DNA, 25 bp, Mus musculus
tggcattgccttccaagccacttta

SEQ ID NO: 884442 - DNA, 25 bp, Mus musculus
tggcattgccttgcaagccacttta

SEQ ID NO: 884443 - DNA, 25 bp, Mus musculus
tggcattgcgtaagctgttcacgat

SEQ ID NO: 884444 - DNA, 25 bp, Mus musculus
tggcattgcgtatgctgttcacgat

SEQ ID NO: 884445 - DNA, 25 bp, Mus musculus
tggcattgctccaggtgcttcacac

SEQ ID NO: 884446 - DNA, 25 bp, Mus musculus
tggcattgctcctggtgcttcacac

SEQ ID NO: 884447 - DNA, 25 bp, Mus musculus
tggcattgggctccggctctacctc

SEQ ID NO: 884448 - DNA, 25 bp, Mus musculus
tggcattgggctgcggctctacctc

SEQ ID NO: 884449 - DNA, 25 bp, Mus musculus
tggcattggtgtacaacgtgttgaa

SEQ ID NO: 884450 - DNA, 25 bp, Mus musculus
tggcattggtgttcaacgtgttgaa

SEQ ID NO: 884451 - DNA, 25 bp, Mus musculus
tggcattgtagaataccattggcag

SEQ ID NO: 884452 - DNA, 25 bp, Mus musculus
tggcattgtagattaccattggcag

SEQ ID NO: 884453 - DNA, 25 bp, Mus musculus
tggcatttaaaacccgcatgttctt

SEQ ID NO: 884454 - DNA, 25 bp, Mus musculus
tggcatttaaaagccgcatgttctt

SEQ ID NO: 884455 - DNA, 25 bp, Mus musculus
tggcatttacttcccatgcttgttt

SEQ ID NO: 884456 - DNA, 25 bp, Mus musculus
tggcatttacttgccatgcttgttt

SEQ ID NO: 884457 - DNA, 25 bp, Mus musculus
tggcatttagagacggcagtggttc

SEQ ID NO: 884458 - DNA, 25 bp, Mus musculus
tggcatttagagtcggcagtggttc

SEQ ID NO: 884459 - DNA, 25 bp, Mus musculus
tggcatttatgtatgggtaccatgt

SEQ ID NO: 884460 - DNA, 25 bp, Mus musculus
tggcatttatgtttgggtaccatgt

SEQ ID NO: 884461 - DNA, 25 bp, Mus musculus
tggcatttcagaaactaacacttca

SEQ ID NO: 884462 - DNA, 25 bp, Mus musculus
tggcatttcagatactaacacttca

SEQ ID NO: 884463 - DNA, 25 bp, Mus musculus
tggcatttcgttaaggcatctctgg

SEQ ID NO: 884464 - DNA, 25 bp, Mus musculus
tggcatttcgtttaggcatctctgg

SEQ ID NO: 884465 - DNA, 25 bp, Mus musculus
tggcatttctcactcgtgacacaca

SEQ ID NO: 884466 - DNA, 25 bp, Mus musculus
tggcatttctcagtcgtgacacaca

SEQ ID NO: 884467 - DNA, 25 bp, Mus musculus
tggcatttctgcctgaatccagaga

SEQ ID NO: 884468 - DNA, 25 bp, Mus musculus
tggcatttctgcgtgaatccagaga

SEQ ID NO: 884469 - DNA, 25 bp, Mus musculus
tggcatttctttatgtgacccgaac

SEQ ID NO: 884470 - DNA, 25 bp, Mus musculus
tggcatttctttttgtgacccgaac

SEQ ID NO: 884471 - DNA, 25 bp, Mus musculus
tggcatttgcatcgtgtcttcacaa

SEQ ID NO: 884472 - DNA, 25 bp, Mus musculus
tggcatttgcatggtgtcttcacaa

SEQ ID NO: 884473 - DNA, 25 bp, Mus musculus
tggcatttgttacatcacaggcttt

SEQ ID NO: 884474 - DNA, 25 bp, Mus musculus
tggcatttgttagatcacaggcttt

SEQ ID NO: 884475 - DNA, 25 bp, Mus musculus
tggcattttaacaactgcacccctg

SEQ ID NO: 884476 - DNA, 25 bp, Mus musculus
tggcattttaactactgcacccctg

SEQ ID NO: 884477 - DNA, 25 bp, Mus musculus
tggcattttggtcttcccctaacta

SEQ ID NO: 884478 - DNA, 25 bp, Mus musculus
tggcattttggtgttcccctaacta

SEQ ID NO: 884479 - DNA, 25 bp, Mus musculus
tggcatttttatatgggcttttcaa

SEQ ID NO: 884480 - DNA, 25 bp, Mus musculus
tggcatttttatttgggcttttcaa

SEQ ID NO: 884481 - DNA, 25 bp, Mus musculus
tggcattttttcctaaacatcatat

SEQ ID NO: 884482 - DNA, 25 bp, Mus musculus
tggcattttttcgtaaacatcatat

SEQ ID NO: 884483 - DNA, 25 bp, Mus musculus
tggccaaaaataaaactactcaggt

SEQ ID NO: 884484 - DNA, 25 bp, Mus musculus
tggccaaaaatataactactcaggt

SEQ ID NO: 884485 - DNA, 25 bp, Mus musculus
tggccaaaactccatttcatgtctg

SEQ ID NO: 884486 - DNA, 25 bp, Mus musculus
tggccaaaactcgatttcatgtctg

SEQ ID NO: 884487 - DNA, 25 bp, Mus musculus
tggccaaaatacagcctgcactatt

SEQ ID NO: 884488 - DNA, 25 bp, Mus musculus
tggccaaaatactgcctgcactatt

SEQ ID NO: 884489 - DNA, 25 bp, Mus musculus
tggccaaaatcacaaactcctcctt

SEQ ID NO: 884490 - DNA, 25 bp, Mus musculus
tggccaaaatcagaaactcctcctt

SEQ ID NO: 884491 - DNA, 25 bp, Mus musculus
tggccaaacacgctactaaaaactt

SEQ ID NO: 884492 - DNA, 25 bp, Mus musculus
tggccaaacacggtactaaaaactt

SEQ ID NO: 884493 - DNA, 25 bp, Mus musculus
tggccaaaccagagaacccgcaggg

SEQ ID NO: 884494 - DNA, 25 bp, Mus musculus
tggccaaaccagtgaacccgcaggg

SEQ ID NO: 884495 - DNA, 25 bp, Mus musculus
tggccaaacccactaagctggaaat

SEQ ID NO: 884496 - DNA, 25 bp, Mus musculus
tggccaaacccagtaagctggaaat

SEQ ID NO: 884497 - DNA, 25 bp, Mus musculus
tggccaaactacacttgactttcca

SEQ ID NO: 884498 - DNA, 25 bp, Mus musculus
tggccaaactactcttgactttcca

SEQ ID NO: 884499 - DNA, 25 bp, Mus musculus
tggccaaagcccctctggaagggaa

SEQ ID NO: 884500 - DNA, 25 bp, Mus musculus
tggccaaagcccgtctggaagggaa

SEQ ID NO: 884501 - DNA, 25 bp, Mus musculus
tggccaaagcctacagacacaccga

SEQ ID NO: 884502 - DNA, 25 bp, Mus musculus
tggccaaagccttcagacacaccga

SEQ ID NO: 884503 - DNA, 25 bp, Mus musculus
tggccaaagcgtcgctcctctatga

SEQ ID NO: 884504 - DNA, 25 bp, Mus musculus
tggccaaagcgtggctcctctatga

SEQ ID NO: 884505 - DNA, 25 bp, Mus musculus
tggccaaaggccagatgctgctgtc

SEQ ID NO: 884506 - DNA, 25 bp, Mus musculus
tggccaaaggcctgatgctgctgtc

SEQ ID NO: 884507 - DNA, 25 bp, Mus musculus
tggccaaatcacatcacctccctga

SEQ ID NO: 884508 - DNA, 25 bp, Mus musculus
tggccaaatcacttcacctccctga

SEQ ID NO: 884509 - DNA, 25 bp, Mus musculus
tggccaaatccactgctattgaaac

SEQ ID NO: 884510 - DNA, 25 bp, Mus musculus
tggccaaatccagtgctattgaaac

SEQ ID NO: 884511 - DNA, 25 bp, Mus musculus
tggccaaatccgcatagtcccatta

SEQ ID NO: 884512 - DNA, 25 bp, Mus musculus
tggccaaatccggatagtcccatta

SEQ ID NO: 884513 - DNA, 25 bp, Mus musculus
tggccaaatctcctgccccaatagg

SEQ ID NO: 884514 - DNA, 25 bp, Mus musculus
tggccaaatctcgtgccccaatagg

SEQ ID NO: 884515 - DNA, 25 bp, Mus musculus
tggccaaatgccattgcagcctttg

SEQ ID NO: 884516 - DNA, 25 bp, Mus musculus
tggccaaatgcctttgcagcctttg

SEQ ID NO: 884517 - DNA, 25 bp, Mus musculus
tggccaaatggaagcctctgctgct

SEQ ID NO: 884518 - DNA, 25 bp, Mus musculus
tggccaaatggatgcctctgctgct

SEQ ID NO: 884519 - DNA, 25 bp, Mus musculus
tggccaaatgtcagcaacttgcctc

SEQ ID NO: 884520 - DNA, 25 bp, Mus musculus
tggccaaatgtctgcaacttgcctc

SEQ ID NO: 884521 - DNA, 25 bp, Mus musculus
tggccaacaacacagagttccagcc

SEQ ID NO: 884522 - DNA, 25 bp, Mus musculus
tggccaacaacagagagttccagcc

SEQ ID NO: 884523 - DNA, 25 bp, Mus musculus
tggccaacaataagctcccaaatgg

SEQ ID NO: 884524 - DNA, 25 bp, Mus musculus
tggccaacaatatgctcccaaatgg

SEQ ID NO: 884525 - DNA, 25 bp, Mus musculus
tggccaacactaaatgaactcactg

SEQ ID NO: 884526 - DNA, 25 bp, Mus musculus
tggccaacactatatgaactcactg

SEQ ID NO: 884527 - DNA, 25 bp, Mus musculus
tggccaacagtcctcctgcacgttt

SEQ ID NO: 884528 - DNA, 25 bp, Mus musculus
tggccaacagtcgtcctgcacgttt

SEQ ID NO: 884529 - DNA, 25 bp, Mus musculus
tggccaaccatgcacagacatgtct

SEQ ID NO: 884530 - DNA, 25 bp, Mus musculus
tggccaaccatggacagacatgtct

SEQ ID NO: 884531 - DNA, 25 bp, Mus musculus
tggccaaccgtgaacaaggatggta

SEQ ID NO: 884532 - DNA, 25 bp, Mus musculus
tggccaaccgtgtacaaggatggta

SEQ ID NO: 884533 - DNA, 25 bp, Mus musculus
tggccaaccttcagctatgtatgta

SEQ ID NO: 884534 - DNA, 25 bp, Mus musculus
tggccaaccttctgctatgtatgta

SEQ ID NO: 884535 - DNA, 25 bp, Mus musculus
tggccaacctttcctgtagacaaac

SEQ ID NO: 884536 - DNA, 25 bp, Mus musculus
tggccaacctttgctgtagacaaac

SEQ ID NO: 884537 - DNA, 25 bp, Mus musculus
tggccaacgaggactcaccagagac

SEQ ID NO: 884538 - DNA, 25 bp, Mus musculus
tggccaacgaggtctcaccagagac

SEQ ID NO: 884539 - DNA, 25 bp, Mus musculus
tggccaacggtcaagacaacaagct

SEQ ID NO: 884540 - DNA, 25 bp, Mus musculus
tggccaacggtctagacaacaagct

SEQ ID NO: 884541 - DNA, 25 bp, Mus musculus
tggccaactaccagttttttctgat

SEQ ID NO: 884542 - DNA, 25 bp, Mus musculus
tggccaactacctgttttttctgat

SEQ ID NO: 884543 - DNA, 25 bp, Mus musculus
tggccaactggaaggtgccaggcaa

SEQ ID NO: 884544 - DNA, 25 bp, Mus musculus
tggccaactggatggtgccaggcaa

SEQ ID NO: 884545 - DNA, 25 bp, Mus musculus
tggccaacttcaaatgccatcccaa

SEQ ID NO: 884546 - DNA, 25 bp, Mus musculus
tggccaacttcacgacttttcagac

SEQ ID NO: 884547 - DNA, 25 bp, Mus musculus
tggccaacttcaggacttttcagac

SEQ ID NO: 884548 - DNA, 25 bp, Mus musculus
tggccaacttcatatgccatcccaa

SEQ ID NO: 884549 - DNA, 25 bp, Mus musculus
tggccaacttccctatcacgtgtgt

SEQ ID NO: 884550 - DNA, 25 bp, Mus musculus
tggccaacttccgtatcacgtgtgt

SEQ ID NO: 884551 - DNA, 25 bp, Mus musculus
tggccaacttgcctattatgacgtt

SEQ ID NO: 884552 - DNA, 25 bp, Mus musculus
tggccaacttgcgtattatgacgtt

SEQ ID NO: 884553 - DNA, 25 bp, Mus musculus
tggccaacttggcttagtcccaggt

SEQ ID NO: 884554 - DNA, 25 bp, Mus musculus
tggccaacttgggttagtcccaggt

SEQ ID NO: 884555 - DNA, 25 bp, Mus musculus
tggccaagaccaaagtgtatatgaa

SEQ ID NO: 884556 - DNA, 25 bp, Mus musculus
tggccaagaccaccagattactcct

SEQ ID NO: 884557 - DNA, 25 bp, Mus musculus
tggccaagaccagcagattactcct

SEQ ID NO: 884558 - DNA, 25 bp, Mus musculus
tggccaagaccatagtgtatatgaa

SEQ ID NO: 884559 - DNA, 25 bp, Mus musculus
tggccaagacctctctgggtgatga

SEQ ID NO: 884560 - DNA, 25 bp, Mus musculus
tggccaagacctgtctgggtgatga

SEQ ID NO: 884561 - DNA, 25 bp, Mus musculus
tggccaagatcacccacactgatgt

SEQ ID NO: 884562 - DNA, 25 bp, Mus musculus
tggccaagatcagccacactgatgt

SEQ ID NO: 884563 - DNA, 25 bp, Mus musculus
tggccaagatttcattgacaagccc

SEQ ID NO: 884564 - DNA, 25 bp, Mus musculus
tggccaagatttgattgacaagccc

SEQ ID NO: 884565 - DNA, 25 bp, Mus musculus
tggccaagcagcacaccgacagctt

SEQ ID NO: 884566 - DNA, 25 bp, Mus musculus
tggccaagcagctcaccgacagctt

SEQ ID NO: 884567 - DNA, 25 bp, Mus musculus
tggccaagcccacgagttgtagagt

SEQ ID NO: 884568 - DNA, 25 bp, Mus musculus
tggccaagcccaggagttgtagagt

SEQ ID NO: 884569 - DNA, 25 bp, Mus musculus
tggccaagccttcaaacacagtagt

SEQ ID NO: 884570 - DNA, 25 bp, Mus musculus
tggccaagccttgaaacacagtagt

SEQ ID NO: 884571 - DNA, 25 bp, Mus musculus
tggccaagcgtcagcgggttcatat

SEQ ID NO: 884572 - DNA, 25 bp, Mus musculus
tggccaagcgtctgcgggttcatat

SEQ ID NO: 884573 - DNA, 25 bp, Mus musculus
tggccaagctcccttgttatttgct

SEQ ID NO: 884574 - DNA, 25 bp, Mus musculus
tggccaagctccgttgttatttgct

SEQ ID NO: 884575 - DNA, 25 bp, Mus musculus
tggccaaggacgaccagaacggaga

SEQ ID NO: 884576 - DNA, 25 bp, Mus musculus
tggccaaggacgcaagaactagttt

SEQ ID NO: 884577 - DNA, 25 bp, Mus musculus
tggccaaggacggaagaactagttt

SEQ ID NO: 884578 - DNA, 25 bp, Mus musculus
tggccaaggacgtccagaacggaga

SEQ ID NO: 884579 - DNA, 25 bp, Mus musculus
tggccaaggattactccgtgctcaa

SEQ ID NO: 884580 - DNA, 25 bp, Mus musculus
tggccaaggatttctccgtgctcaa

SEQ ID NO: 884581 - DNA, 25 bp, Mus musculus
tggccaaggcccagcgcatgacgga

SEQ ID NO: 884582 - DNA, 25 bp, Mus musculus
tggccaaggccctgcgcatgacgga

SEQ ID NO: 884583 - DNA, 25 bp, Mus musculus
tggccaaggtccaggtgttcggaaa

SEQ ID NO: 884584 - DNA, 25 bp, Mus musculus
tggccaaggtcctggtgttcggaaa

SEQ ID NO: 884585 - DNA, 25 bp, Mus musculus
tggccaagttcaatcagagcactcc

SEQ ID NO: 884586 - DNA, 25 bp, Mus musculus
tggccaagttcattcagagcactcc

SEQ ID NO: 884587 - DNA, 25 bp, Mus musculus
tggccaagttccacctgttgttttt

SEQ ID NO: 884588 - DNA, 25 bp, Mus musculus
tggccaagttcctcctgttgttttt

SEQ ID NO: 884589 - DNA, 25 bp, Mus musculus
tggccaatagcactcgatattttgc

SEQ ID NO: 884590 - DNA, 25 bp, Mus musculus
tggccaatagcagtcgatattttgc

SEQ ID NO: 884591 - DNA, 25 bp, Mus musculus
tggccaatattcagatatctccctg

SEQ ID NO: 884592 - DNA, 25 bp, Mus musculus
tggccaatattctgatatctccctg

SEQ ID NO: 884593 - DNA, 25 bp, Mus musculus
tggccaatcgtgatccttcagatca

SEQ ID NO: 884594 - DNA, 25 bp, Mus musculus
tggccaatcgtgttccttcagatca

SEQ ID NO: 884595 - DNA, 25 bp, Mus musculus
tggccaatgccacaagacagtttat

SEQ ID NO: 884596 - DNA, 25 bp, Mus musculus
tggccaatgccagaagacagtttat

SEQ ID NO: 884597 - DNA, 25 bp, Mus musculus
tggccaatgcccagtcattcaggat

SEQ ID NO: 884598 - DNA, 25 bp, Mus musculus
tggccaatgccctgtcattcaggat

SEQ ID NO: 884599 - DNA, 25 bp, Mus musculus
tggccaatgtcaccaccatggtaaa

SEQ ID NO: 884600 - DNA, 25 bp, Mus musculus
tggccaatgtcagcaccatggtaaa

SEQ ID NO: 884601 - DNA, 25 bp, Mus musculus
tggccaatgtctacactctaacttg

SEQ ID NO: 884602 - DNA, 25 bp, Mus musculus
tggccaatgtcttcactctaacttg

SEQ ID NO: 884603 - DNA, 25 bp, Mus musculus
tggccaatgtgaaccttgcccactg

SEQ ID NO: 884604 - DNA, 25 bp, Mus musculus
tggccaatgtgatccttgcccactg

SEQ ID NO: 884605 - DNA, 25 bp, Mus musculus
tggccacaactactctgaaggtcac

SEQ ID NO: 884606 - DNA, 25 bp, Mus musculus
tggccacaactagtctgaaggtcac

SEQ ID NO: 884607 - DNA, 25 bp, Mus musculus
tggccacaagctccaagggacttac

SEQ ID NO: 884608 - DNA, 25 bp, Mus musculus
tggccacaagctgcaagggacttac

SEQ ID NO: 884609 - DNA, 25 bp, Mus musculus
tggccacaagttccggcaggcagac

SEQ ID NO: 884610 - DNA, 25 bp, Mus musculus
tggccacaagttgcggcaggcagac

SEQ ID NO: 884611 - DNA, 25 bp, Mus musculus
tggccacaatgtcatatcatgtgac

SEQ ID NO: 884612 - DNA, 25 bp, Mus musculus
tggccacaatgtgatatcatgtgac

SEQ ID NO: 884613 - DNA, 25 bp, Mus musculus
tggccacacagtatggctgggtgct

SEQ ID NO: 884614 - DNA, 25 bp, Mus musculus
tggccacacagtttggctgggtgct

SEQ ID NO: 884615 - DNA, 25 bp, Mus musculus
tggccacaccacacgtttatacgga

SEQ ID NO: 884616 - DNA, 25 bp, Mus musculus
tggccacaccactcgtttatacgga

SEQ ID NO: 884617 - DNA, 25 bp, Mus musculus
tggccacaccagcatttttatgcgg

SEQ ID NO: 884618 - DNA, 25 bp, Mus musculus
tggccacaccagcttggctgcagtg

SEQ ID NO: 884619 - DNA, 25 bp, Mus musculus
tggccacaccaggatttttatgcgg

SEQ ID NO: 884620 - DNA, 25 bp, Mus musculus
tggccacaccaggttggctgcagtg

SEQ ID NO: 884621 - DNA, 25 bp, Mus musculus
tggccacaccatcatcaattgcaga

SEQ ID NO: 884622 - DNA, 25 bp, Mus musculus
tggccacaccatgatcaattgcaga

SEQ ID NO: 884623 - DNA, 25 bp, Mus musculus
tggccacagactagcagaaccgagt

SEQ ID NO: 884624 - DNA, 25 bp, Mus musculus
tggccacagacttgcagaaccgagt

SEQ ID NO: 884625 - DNA, 25 bp, Mus musculus
tggccacagatacctaccatgtttg

SEQ ID NO: 884626 - DNA, 25 bp, Mus musculus
tggccacagatagctaccatgtttg

SEQ ID NO: 884627 - DNA, 25 bp, Mus musculus
tggccacagcctcagagttatttag

SEQ ID NO: 884628 - DNA, 25 bp, Mus musculus
tggccacagcctgagagttatttag

SEQ ID NO: 884629 - DNA, 25 bp, Mus musculus
tggccacagcttctagactacctaa

SEQ ID NO: 884630 - DNA, 25 bp, Mus musculus
tggccacagcttgtagactacctaa

SEQ ID NO: 884631 - DNA, 25 bp, Mus musculus
tggccacagggacatcaggcgttta

SEQ ID NO: 884632 - DNA, 25 bp, Mus musculus
tggccacagggagatcaggcgttta

SEQ ID NO: 884633 - DNA, 25 bp, Mus musculus
tggccacataacaaggcttccatgt

SEQ ID NO: 884634 - DNA, 25 bp, Mus musculus
tggccacataactaggcttccatgt

SEQ ID NO: 884635 - DNA, 25 bp, Mus musculus
tggccacatacaaaggagctccctt

SEQ ID NO: 884636 - DNA, 25 bp, Mus musculus
tggccacatacataggagctccctt

SEQ ID NO: 884637 - DNA, 25 bp, Mus musculus
tggccacatcagctcaagggaagct

SEQ ID NO: 884638 - DNA, 25 bp, Mus musculus
tggccacatcaggtcaagggaagct

SEQ ID NO: 884639 - DNA, 25 bp, Mus musculus
tggccacatgaaaattaacagatct

SEQ ID NO: 884640 - DNA, 25 bp, Mus musculus
tggccacatgaatattaacagatct

SEQ ID NO: 884641 - DNA, 25 bp, Mus musculus
tggccacatggacagcagcacctgt

SEQ ID NO: 884642 - DNA, 25 bp, Mus musculus
tggccacatggagagcagcacctgt

SEQ ID NO: 884643 - DNA, 25 bp, Mus musculus
tggccacattatacagcttcctctt

SEQ ID NO: 884644 - DNA, 25 bp, Mus musculus
tggccacattattcagcttcctctt

SEQ ID NO: 884645 - DNA, 25 bp, Mus musculus
tggccacattctcctagtcactgtg

SEQ ID NO: 884646 - DNA, 25 bp, Mus musculus
tggccacattctgctagtcactgtg

SEQ ID NO: 884647 - DNA, 25 bp, Mus musculus
tggccacattgcaagcaccactacg

SEQ ID NO: 884648 - DNA, 25 bp, Mus musculus
tggccacattgctagcaccactacg

SEQ ID NO: 884649 - DNA, 25 bp, Mus musculus
tggccaccaaacaagagactttccg

SEQ ID NO: 884650 - DNA, 25 bp, Mus musculus
tggccaccaaactagagactttccg

SEQ ID NO: 884651 - DNA, 25 bp, Mus musculus
tggccaccaacgagggacgctgtag

SEQ ID NO: 884652 - DNA, 25 bp, Mus musculus
tggccaccaacgtgggacgctgtag

SEQ ID NO: 884653 - DNA, 25 bp, Mus musculus
tggccaccagccaaaggagctatga

SEQ ID NO: 884654 - DNA, 25 bp, Mus musculus
tggccaccagcctaaggagctatga

SEQ ID NO: 884655 - DNA, 25 bp, Mus musculus
tggccaccatctatgaaccctgaat

SEQ ID NO: 884656 - DNA, 25 bp, Mus musculus
tggccaccatctctgttggtgtact

SEQ ID NO: 884657 - DNA, 25 bp, Mus musculus
tggccaccatctgtgttggtgtact

SEQ ID NO: 884658 - DNA, 25 bp, Mus musculus
tggccaccatctttgaaccctgaat

SEQ ID NO: 884659 - DNA, 25 bp, Mus musculus
tggccaccattacagacctgggact

SEQ ID NO: 884660 - DNA, 25 bp, Mus musculus
tggccaccattagagacctgggact

SEQ ID NO: 884661 - DNA, 25 bp, Mus musculus
tggccaccatttactgggtcacggt

SEQ ID NO: 884662 - DNA, 25 bp, Mus musculus
tggccaccattttctgggtcacggt

SEQ ID NO: 884663 - DNA, 25 bp, Mus musculus
tggccacccacgaagcttatggaga

SEQ ID NO: 884664 - DNA, 25 bp, Mus musculus
tggccacccacgtagcttatggaga

SEQ ID NO: 884665 - DNA, 25 bp, Mus musculus
tggccacccagcagacaggacctgt

SEQ ID NO: 884666 - DNA, 25 bp, Mus musculus
tggccacccagctgacaggacctgt

SEQ ID NO: 884667 - DNA, 25 bp, Mus musculus
tggccacccatcaggtctgaatcaa

SEQ ID NO: 884668 - DNA, 25 bp, Mus musculus
tggccacccatctggtctgaatcaa

SEQ ID NO: 884669 - DNA, 25 bp, Mus musculus
tggccaccctcaaaactaagctagg

SEQ ID NO: 884670 - DNA, 25 bp, Mus musculus
tggccaccctcacagttctaactta

SEQ ID NO: 884671 - DNA, 25 bp, Mus musculus
tggccaccctcagagttctaactta

SEQ ID NO: 884672 - DNA, 25 bp, Mus musculus
tggccaccctcataactaagctagg

SEQ ID NO: 884673 - DNA, 25 bp, Mus musculus
tggccaccggacattgcctggaaaa

SEQ ID NO: 884674 - DNA, 25 bp, Mus musculus
tggccaccggactttgcctggaaaa

SEQ ID NO: 884675 - DNA, 25 bp, Mus musculus
tggccacctgacaaataaacattat

SEQ ID NO: 884676 - DNA, 25 bp, Mus musculus
tggccacctgacaggaacatagaag

SEQ ID NO: 884677 - DNA, 25 bp, Mus musculus
tggccacctgactaataaacattat

SEQ ID NO: 884678 - DNA, 25 bp, Mus musculus
tggccacctgactggaacatagaag

SEQ ID NO: 884679 - DNA, 25 bp, Mus musculus
tggccacctggaacatgagcatgct

SEQ ID NO: 884680 - DNA, 25 bp, Mus musculus
tggccacctggatcatgagcatgct

SEQ ID NO: 884681 - DNA, 25 bp, Mus musculus
tggccaccttgcacagggatggact

SEQ ID NO: 884682 - DNA, 25 bp, Mus musculus
tggccaccttgctcagggatggact

SEQ ID NO: 884683 - DNA, 25 bp, Mus musculus
tggccacctttgcaataagggcact

SEQ ID NO: 884684 - DNA, 25 bp, Mus musculus
tggccacctttggaataagggcact

SEQ ID NO: 884685 - DNA, 25 bp, Mus musculus
tggccacgggatcccatgtgtcttt

SEQ ID NO: 884686 - DNA, 25 bp, Mus musculus
tggccacgggatgccatgtgtcttt

SEQ ID NO: 884687 - DNA, 25 bp, Mus musculus
tggccacggtgtctctgcacagaaa

SEQ ID NO: 884688 - DNA, 25 bp, Mus musculus
tggccacggtgtgtctgcacagaaa

SEQ ID NO: 884689 - DNA, 25 bp, Mus musculus
tggccacgtcagatacacagctaca

SEQ ID NO: 884690 - DNA, 25 bp, Mus musculus
tggccacgtcagttacacagctaca

SEQ ID NO: 884691 - DNA, 25 bp, Mus musculus
tggccactcagcacagtgtgtgtgt

SEQ ID NO: 884692 - DNA, 25 bp, Mus musculus
tggccactcagctcagtgtgtgtgt

SEQ ID NO: 884693 - DNA, 25 bp, Mus musculus
tggccactccacaaatttcgtgatt

SEQ ID NO: 884694 - DNA, 25 bp, Mus musculus
tggccactccactaatttcgtgatt

SEQ ID NO: 884695 - DNA, 25 bp, Mus musculus
tggccactccctatgagacgatcta

SEQ ID NO: 884696 - DNA, 25 bp, Mus musculus
tggccactccctttgagacgatcta

SEQ ID NO: 884697 - DNA, 25 bp, Mus musculus
tggccactgacacccaagatctgat

SEQ ID NO: 884698 - DNA, 25 bp, Mus musculus
tggccactgacagccaagatctgat

SEQ ID NO: 884699 - DNA, 25 bp, Mus musculus
tggccactgcatcccttaatttatt

SEQ ID NO: 884700 - DNA, 25 bp, Mus musculus
tggccactgcatgccttaatttatt

SEQ ID NO: 884701 - DNA, 25 bp, Mus musculus
tggccactgctcctgatctgcaaag

SEQ ID NO: 884702 - DNA, 25 bp, Mus musculus
tggccactgctcgtgatctgcaaag

SEQ ID NO: 884703 - DNA, 25 bp, Mus musculus
tggccactggccagtacacaagaat

SEQ ID NO: 884704 - DNA, 25 bp, Mus musculus
tggccactggcctgtacacaagaat

SEQ ID NO: 884705 - DNA, 25 bp, Mus musculus
tggccactggtgcatccataagtgt

SEQ ID NO: 884706 - DNA, 25 bp, Mus musculus
tggccactggtggatccataagtgt

SEQ ID NO: 884707 - DNA, 25 bp, Mus musculus
tggccactggttcctacacgaagac

SEQ ID NO: 884708 - DNA, 25 bp, Mus musculus
tggccactggttgctacacgaagac

SEQ ID NO: 884709 - DNA, 25 bp, Mus musculus
tggccactgtcacaccatgggtaag

SEQ ID NO: 884710 - DNA, 25 bp, Mus musculus
tggccactgtcagaccatgggtaag

SEQ ID NO: 884711 - DNA, 25 bp, Mus musculus
tggccactgtgcctggaagctagct

SEQ ID NO: 884712 - DNA, 25 bp, Mus musculus
tggccactgtgcgtggaagctagct

SEQ ID NO: 884713 - DNA, 25 bp, Mus musculus
tggccacttcacataactcatatag

SEQ ID NO: 884714 - DNA, 25 bp, Mus musculus
tggccacttcacttaactcatatag

SEQ ID NO: 884715 - DNA, 25 bp, Mus musculus
tggccacttcagcaaccggatggtt

SEQ ID NO: 884716 - DNA, 25 bp, Mus musculus
tggccacttcaggaaccggatggtt

SEQ ID NO: 884717 - DNA, 25 bp, Mus musculus
tggccacttcgtctgcaccgagtgt

SEQ ID NO: 884718 - DNA, 25 bp, Mus musculus
tggccacttcgtgtgcaccgagtgt

SEQ ID NO: 884719 - DNA, 25 bp, Mus musculus
tggccacttctaagaccaactctag

SEQ ID NO: 884720 - DNA, 25 bp, Mus musculus
tggccacttctatgaccaactctag

SEQ ID NO: 884721 - DNA, 25 bp, Mus musculus
tggccacttggcactgggtagccaa

SEQ ID NO: 884722 - DNA, 25 bp, Mus musculus
tggccacttggctctgggtagccaa

SEQ ID NO: 884723 - DNA, 25 bp, Mus musculus
tggccacttgttagcttgcacactg

SEQ ID NO: 884724 - DNA, 25 bp, Mus musculus
tggccacttgtttgcttgcacactg

SEQ ID NO: 884725 - DNA, 25 bp, Mus musculus
tggccactttacacttctagacaaa

SEQ ID NO: 884726 - DNA, 25 bp, Mus musculus
tggccactttactcttctagacaaa

SEQ ID NO: 884727 - DNA, 25 bp, Mus musculus
tggccactttccaatgcagtgatta

SEQ ID NO: 884728 - DNA, 25 bp, Mus musculus
tggccactttcctatgcagtgatta

SEQ ID NO: 884729 - DNA, 25 bp, Mus musculus
tggccagaaaccagacttgtcacat

SEQ ID NO: 884730 - DNA, 25 bp, Mus musculus
tggccagaaacctgacttgtcacat

SEQ ID NO: 884731 - DNA, 25 bp, Mus musculus
tggccagaaacgcagtttttcccac

SEQ ID NO: 884732 - DNA, 25 bp, Mus musculus
tggccagaaacggagtttttcccac

SEQ ID NO: 884733 - DNA, 25 bp, Mus musculus
tggccagaacccaggaggcacggtc

SEQ ID NO: 884734 - DNA, 25 bp, Mus musculus
tggccagaaccctggaggcacggtc

SEQ ID NO: 884735 - DNA, 25 bp, Mus musculus
tggccagaacctattttgtcgtacg

SEQ ID NO: 884736 - DNA, 25 bp, Mus musculus
tggccagaaccttttttgtcgtacg

SEQ ID NO: 884737 - DNA, 25 bp, Mus musculus
tggccagaagcaaaatgctgtcacc

SEQ ID NO: 884738 - DNA, 25 bp, Mus musculus
tggccagaagcataatgctgtcacc

SEQ ID NO: 884739 - DNA, 25 bp, Mus musculus
tggccagaagccatcagatgaggtt

SEQ ID NO: 884740 - DNA, 25 bp, Mus musculus
tggccagaagccttcagatgaggtt

SEQ ID NO: 884741 - DNA, 25 bp, Mus musculus
tggccagaatcacccctcaatcagg

SEQ ID NO: 884742 - DNA, 25 bp, Mus musculus
tggccagaatcagccctcaatcagg

SEQ ID NO: 884743 - DNA, 25 bp, Mus musculus
tggccagacactcaaatctatgagc

SEQ ID NO: 884744 - DNA, 25 bp, Mus musculus
tggccagacactgaaatctatgagc

SEQ ID NO: 884745 - DNA, 25 bp, Mus musculus
tggccagacggtcagcaccatcatg

SEQ ID NO: 884746 - DNA, 25 bp, Mus musculus
tggccagacggtgagcaccatcatg

SEQ ID NO: 884747 - DNA, 25 bp, Mus musculus
tggccagactacattaccgcactta

SEQ ID NO: 884748 - DNA, 25 bp, Mus musculus
tggccagactactttaccgcactta

SEQ ID NO: 884749 - DNA, 25 bp, Mus musculus
tggccagactcacctgctaaccaga

SEQ ID NO: 884750 - DNA, 25 bp, Mus musculus
tggccagactcagctgctaaccaga

SEQ ID NO: 884751 - DNA, 25 bp, Mus musculus
tggccagagcagagtagcagtcgac

SEQ ID NO: 884752 - DNA, 25 bp, Mus musculus
tggccagagcagtgtagcagtcgac

SEQ ID NO: 884753 - DNA, 25 bp, Mus musculus
tggccagagcttctccatgacagtg

SEQ ID NO: 884754 - DNA, 25 bp, Mus musculus
tggccagagcttgtccatgacagtg

SEQ ID NO: 884755 - DNA, 25 bp, Mus musculus
tggccagaggtccaccatgtgaaat

SEQ ID NO: 884756 - DNA, 25 bp, Mus musculus
tggccagaggtcgaccatgtgaaat

SEQ ID NO: 884757 - DNA, 25 bp, Mus musculus
tggccagatgacagacagtatttgc

SEQ ID NO: 884758 - DNA, 25 bp, Mus musculus
tggccagatgactgacagtatttgc

SEQ ID NO: 884759 - DNA, 25 bp, Mus musculus
tggccagatgtactgaccgtcaaac

SEQ ID NO: 884760 - DNA, 25 bp, Mus musculus
tggccagatgtagtgaccgtcaaac

SEQ ID NO: 884761 - DNA, 25 bp, Mus musculus
tggccagatgtcattgggtctcctg

SEQ ID NO: 884762 - DNA, 25 bp, Mus musculus
tggccagatgtctttgggtctcctg

SEQ ID NO: 884763 - DNA, 25 bp, Mus musculus
tggccagattatctcaggtgtacct

SEQ ID NO: 884764 - DNA, 25 bp, Mus musculus
tggccagattatgtcaggtgtacct

SEQ ID NO: 884765 - DNA, 25 bp, Mus musculus
tggccagcaaacagtctttccacta

SEQ ID NO: 884766 - DNA, 25 bp, Mus musculus
tggccagcaaactgtctttccacta

SEQ ID NO: 884767 - DNA, 25 bp, Mus musculus
tggccagcaaccagatgggcagtgc

SEQ ID NO: 884768 - DNA, 25 bp, Mus musculus
tggccagcaacctgatgggcagtgc

SEQ ID NO: 884769 - DNA, 25 bp, Mus musculus
tggccagcaaggcatccctgggaaa

SEQ ID NO: 884770 - DNA, 25 bp, Mus musculus
tggccagcaagggatccctgggaaa

SEQ ID NO: 884771 - DNA, 25 bp, Mus musculus
tggccagcaccaatttctacatcaa

SEQ ID NO: 884772 - DNA, 25 bp, Mus musculus
tggccagcaccattttctacatcaa

SEQ ID NO: 884773 - DNA, 25 bp, Mus musculus
tggccagcacctcaaggtcttccag

SEQ ID NO: 884774 - DNA, 25 bp, Mus musculus
tggccagcacctcagacagtcatgc

SEQ ID NO: 884775 - DNA, 25 bp, Mus musculus
tggccagcacctgaaggtcttccag

SEQ ID NO: 884776 - DNA, 25 bp, Mus musculus
tggccagcacctgagacagtcatgc

SEQ ID NO: 884777 - DNA, 25 bp, Mus musculus
tggccagcacttacgtctcggagat

SEQ ID NO: 884778 - DNA, 25 bp, Mus musculus
tggccagcactttcgtctcggagat

SEQ ID NO: 884779 - DNA, 25 bp, Mus musculus
tggccagcagaacgtaccagggacc

SEQ ID NO: 884780 - DNA, 25 bp, Mus musculus
tggccagcagaaggtaccagggacc

SEQ ID NO: 884781 - DNA, 25 bp, Mus musculus
tggccagcagacatcagggagcctc

SEQ ID NO: 884782 - DNA, 25 bp, Mus musculus
tggccagcagacttcagggagcctc

SEQ ID NO: 884783 - DNA, 25 bp, Mus musculus
tggccagcagatcagcagatcggtt

SEQ ID NO: 884784 - DNA, 25 bp, Mus musculus
tggccagcagatgagcagatcggtt

SEQ ID NO: 884785 - DNA, 25 bp, Mus musculus
tggccagcagccagtaatttctgag

SEQ ID NO: 884786 - DNA, 25 bp, Mus musculus
tggccagcagcctgtaatttctgag

SEQ ID NO: 884787 - DNA, 25 bp, Mus musculus
tggccagcaggaccaactcctcaga

SEQ ID NO: 884788 - DNA, 25 bp, Mus musculus
tggccagcaggagcaactcctcaga

SEQ ID NO: 884789 - DNA, 25 bp, Mus musculus
tggccagcagtacttagggatcctc

SEQ ID NO: 884790 - DNA, 25 bp, Mus musculus
tggccagcagtagttagggatcctc

SEQ ID NO: 884791 - DNA, 25 bp, Mus musculus
tggccagcagtgcaccactggagaa

SEQ ID NO: 884792 - DNA, 25 bp, Mus musculus
tggccagcagtggaccactggagaa

SEQ ID NO: 884793 - DNA, 25 bp, Mus musculus
tggccagcataaactctagcaacct

SEQ ID NO: 884794 - DNA, 25 bp, Mus musculus
tggccagcataatctctagcaacct

SEQ ID NO: 884795 - DNA, 25 bp, Mus musculus
tggccagcatctctctcctggagaa

SEQ ID NO: 884796 - DNA, 25 bp, Mus musculus
tggccagcatctgtctcctggagaa

SEQ ID NO: 884797 - DNA, 25 bp, Mus musculus
tggccagccaccatttaatttgtgt

SEQ ID NO: 884798 - DNA, 25 bp, Mus musculus
tggccagccaccttttaatttgtgt

SEQ ID NO: 884799 - DNA, 25 bp, Mus musculus
tggccagccagacctgcttgaaaaa

SEQ ID NO: 884800 - DNA, 25 bp, Mus musculus
tggccagccagagctgcttgaaaaa

SEQ ID NO: 884801 - DNA, 25 bp, Mus musculus
tggccagccccaaagttcaaaatct

SEQ ID NO: 884802 - DNA, 25 bp, Mus musculus
tggccagccccatagttcaaaatct

SEQ ID NO: 884803 - DNA, 25 bp, Mus musculus
tggccagccctgaatacagcaacct

SEQ ID NO: 884804 - DNA, 25 bp, Mus musculus
tggccagccctgtatacagcaacct

SEQ ID NO: 884805 - DNA, 25 bp, Mus musculus
tggccagcccttagtctgactgtgg

SEQ ID NO: 884806 - DNA, 25 bp, Mus musculus
tggccagccctttgtctgactgtgg

SEQ ID NO: 884807 - DNA, 25 bp, Mus musculus
tggccagccgccatcaagagggcag

SEQ ID NO: 884808 - DNA, 25 bp, Mus musculus
tggccagccgccttcaagagggcag

SEQ ID NO: 884809 - DNA, 25 bp, Mus musculus
tggccagcctatcagttttgtctta

SEQ ID NO: 884810 - DNA, 25 bp, Mus musculus
tggccagcctatgagttttgtctta

SEQ ID NO: 884811 - DNA, 25 bp, Mus musculus
tggccagcctggaaagtcaagtctt

SEQ ID NO: 884812 - DNA, 25 bp, Mus musculus
tggccagcctggtaagtcaagtctt

SEQ ID NO: 884813 - DNA, 25 bp, Mus musculus
tggccagcctttactatgcttttgt

SEQ ID NO: 884814 - DNA, 25 bp, Mus musculus
tggccagccttttctatgcttttgt

SEQ ID NO: 884815 - DNA, 25 bp, Mus musculus
tggccagcgacacccagtcggagat

SEQ ID NO: 884816 - DNA, 25 bp, Mus musculus
tggccagcgacagccagtcggagat

SEQ ID NO: 884817 - DNA, 25 bp, Mus musculus
tggccagcgccgagctctgagcgaa

SEQ ID NO: 884818 - DNA, 25 bp, Mus musculus
tggccagcgccgtgctctgagcgaa

SEQ ID NO: 884819 - DNA, 25 bp, Mus musculus
tggccagcggacagatccagatcac

SEQ ID NO: 884820 - DNA, 25 bp, Mus musculus
tggccagcggactgatccagatcac

SEQ ID NO: 884821 - DNA, 25 bp, Mus musculus
tggccagcgggcctaattgaaacag

SEQ ID NO: 884822 - DNA, 25 bp, Mus musculus
tggccagcgggcgtaattgaaacag

SEQ ID NO: 884823 - DNA, 25 bp, Mus musculus
tggccagctctgcaactgcagggtc

SEQ ID NO: 884824 - DNA, 25 bp, Mus musculus
tggccagctctggaactgcagggtc

SEQ ID NO: 884825 - DNA, 25 bp, Mus musculus
tggccagctgcaacttgggtagcac

SEQ ID NO: 884826 - DNA, 25 bp, Mus musculus
tggccagctgcatcttgggtagcac

SEQ ID NO: 884827 - DNA, 25 bp, Mus musculus
tggccagctgtcaaccacgatgaca

SEQ ID NO: 884828 - DNA, 25 bp, Mus musculus
tggccagctgtctaccacgatgaca

SEQ ID NO: 884829 - DNA, 25 bp, Mus musculus
tggccagcttagaccatacatctgc

SEQ ID NO: 884830 - DNA, 25 bp, Mus musculus
tggccagcttagtccatacatctgc

SEQ ID NO: 884831 - DNA, 25 bp, Mus musculus
tggccagctttactgtgcctgctga

SEQ ID NO: 884832 - DNA, 25 bp, Mus musculus
tggccagctttagtgtgcctgctga

SEQ ID NO: 884833 - DNA, 25 bp, Mus musculus
tggccaggaatacaacatcactagg

SEQ ID NO: 884834 - DNA, 25 bp, Mus musculus
tggccaggaatagaacatcactagg

SEQ ID NO: 884835 - DNA, 25 bp, Mus musculus
tggccaggactcactgatgatgcca

SEQ ID NO: 884836 - DNA, 25 bp, Mus musculus
tggccaggactctctgatgatgcca

SEQ ID NO: 884837 - DNA, 25 bp, Mus musculus
tggccaggagccagcctgcaaggaa

SEQ ID NO: 884838 - DNA, 25 bp, Mus musculus
tggccaggagcctgcctgcaaggaa

SEQ ID NO: 884839 - DNA, 25 bp, Mus musculus
tggccaggattcaaccttctgtgag

SEQ ID NO: 884840 - DNA, 25 bp, Mus musculus
tggccaggattctaccttctgtgag

SEQ ID NO: 884841 - DNA, 25 bp, Mus musculus
tggccaggccacattcagttgagat

SEQ ID NO: 884842 - DNA, 25 bp, Mus musculus
tggccaggccactttcagttgagat

SEQ ID NO: 884843 - DNA, 25 bp, Mus musculus
tggccaggccctaaatcctagagag

SEQ ID NO: 884844 - DNA, 25 bp, Mus musculus
tggccaggcccttaatcctagagag

SEQ ID NO: 884845 - DNA, 25 bp, Mus musculus
tggccaggcgtcatagtattgtcgg

SEQ ID NO: 884846 - DNA, 25 bp, Mus musculus
tggccaggcgtcttagtattgtcgg

SEQ ID NO: 884847 - DNA, 25 bp, Mus musculus
tggccaggctaaccgttcagctaaa

SEQ ID NO: 884848 - DNA, 25 bp, Mus musculus
tggccaggctaagcgttcagctaaa

SEQ ID NO: 884849 - DNA, 25 bp, Mus musculus
tggccagggctgatgtgtcaatcac

SEQ ID NO: 884850 - DNA, 25 bp, Mus musculus
tggccagggctgttgtgtcaatcac

SEQ ID NO: 884851 - DNA, 25 bp, Mus musculus
tggccagggttcatgggaagcacct

SEQ ID NO: 884852 - DNA, 25 bp, Mus musculus
tggccagggttcttgggaagcacct

SEQ ID NO: 884853 - DNA, 25 bp, Mus musculus
tggccaggtacgcaggaaagctcac

SEQ ID NO: 884854 - DNA, 25 bp, Mus musculus
tggccaggtacggaggaaagctcac

SEQ ID NO: 884855 - DNA, 25 bp, Mus musculus
tggccaggtataaccatgtagatat

SEQ ID NO: 884856 - DNA, 25 bp, Mus musculus
tggccaggtatatccatgtagatat

SEQ ID NO: 884857 - DNA, 25 bp, Mus musculus
tggccaggtcatctgatctgcctaa

SEQ ID NO: 884858 - DNA, 25 bp, Mus musculus
tggccaggtcatgtgatctgcctaa

SEQ ID NO: 884859 - DNA, 25 bp, Mus musculus
tggccaggtccaacaattttatgct

SEQ ID NO: 884860 - DNA, 25 bp, Mus musculus
tggccaggtccatcaattttatgct

SEQ ID NO: 884861 - DNA, 25 bp, Mus musculus
tggccaggtcctctactgtgaagga

SEQ ID NO: 884862 - DNA, 25 bp, Mus musculus
tggccaggtcctgtactgtgaagga

SEQ ID NO: 884863 - DNA, 25 bp, Mus musculus
tggccaggttcacctcactactttc

SEQ ID NO: 884864 - DNA, 25 bp, Mus musculus
tggccaggttcagctcactactttc

SEQ ID NO: 884865 - DNA, 25 bp, Mus musculus
tggccaggtttcaggtcgcagtttt

SEQ ID NO: 884866 - DNA, 25 bp, Mus musculus
tggccaggtttctggtcgcagtttt

SEQ ID NO: 884867 - DNA, 25 bp, Mus musculus
tggccagtaaggaatttctgatcct

SEQ ID NO: 884868 - DNA, 25 bp, Mus musculus
tggccagtaaggtatttctgatcct

SEQ ID NO: 884869 - DNA, 25 bp, Mus musculus
tggccagtacttcggctgacataag

SEQ ID NO: 884870 - DNA, 25 bp, Mus musculus
tggccagtacttctgggtcttgaga

SEQ ID NO: 884871 - DNA, 25 bp, Mus musculus
tggccagtacttgggctgacataag

SEQ ID NO: 884872 - DNA, 25 bp, Mus musculus
tggccagtacttgtgggtcttgaga

SEQ ID NO: 884873 - DNA, 25 bp, Mus musculus
tggccagtagccacagctgactgtg

SEQ ID NO: 884874 - DNA, 25 bp, Mus musculus
tggccagtagcctcagctgactgtg

SEQ ID NO: 884875 - DNA, 25 bp, Mus musculus
tggccagtcaacacacagggtgtgt

SEQ ID NO: 884876 - DNA, 25 bp, Mus musculus
tggccagtcaactcacagggtgtgt

SEQ ID NO: 884877 - DNA, 25 bp, Mus musculus
tggccagtcagcctggaattcactc

SEQ ID NO: 884878 - DNA, 25 bp, Mus musculus
tggccagtcagcgtggaattcactc

SEQ ID NO: 884879 - DNA, 25 bp, Mus musculus
tggccagtcccaatgctatgaattg

SEQ ID NO: 884880 - DNA, 25 bp, Mus musculus
tggccagtcccattgctatgaattg

SEQ ID NO: 884881 - DNA, 25 bp, Mus musculus
tggccagtcctaaacctgtagaagt

SEQ ID NO: 884882 - DNA, 25 bp, Mus musculus
tggccagtcctatacctgtagaagt

SEQ ID NO: 884883 - DNA, 25 bp, Mus musculus
tggccagtcctgaaagccacaagag

SEQ ID NO: 884884 - DNA, 25 bp, Mus musculus
tggccagtcctgtaagccacaagag

SEQ ID NO: 884885 - DNA, 25 bp, Mus musculus
tggccagtccttagcctggtggtca

SEQ ID NO: 884886 - DNA, 25 bp, Mus musculus
tggccagtcctttgcctggtggtca

SEQ ID NO: 884887 - DNA, 25 bp, Mus musculus
tggccagtcttgaataaccccagta

SEQ ID NO: 884888 - DNA, 25 bp, Mus musculus
tggccagtcttgtataaccccagta

SEQ ID NO: 884889 - DNA, 25 bp, Mus musculus
tggccagtgcccaccagagaaatcg

SEQ ID NO: 884890 - DNA, 25 bp, Mus musculus
tggccagtgccctccagagaaatcg

SEQ ID NO: 884891 - DNA, 25 bp, Mus musculus
tggccagtggacactctgcctggat

SEQ ID NO: 884892 - DNA, 25 bp, Mus musculus
tggccagtggactctctgcctggat

SEQ ID NO: 884893 - DNA, 25 bp, Mus musculus
tggccagtggctatcggcacaacat

SEQ ID NO: 884894 - DNA, 25 bp, Mus musculus
tggccagtggctttcggcacaacat

SEQ ID NO: 884895 - DNA, 25 bp, Mus musculus
tggccagtgtaacccttggacttta

SEQ ID NO: 884896 - DNA, 25 bp, Mus musculus
tggccagtgtaagccttggacttta

SEQ ID NO: 884897 - DNA, 25 bp, Mus musculus
tggccagtgtagcagtcttgacgca

SEQ ID NO: 884898 - DNA, 25 bp, Mus musculus
tggccagtgtaggagtcttgacgca

SEQ ID NO: 884899 - DNA, 25 bp, Mus musculus
tggccagtgtataagctctcaagtt

SEQ ID NO: 884900 - DNA, 25 bp, Mus musculus
tggccagtgtattagctctcaagtt

SEQ ID NO: 884901 - DNA, 25 bp, Mus musculus
tggccagtgtctaataggtccttcc

SEQ ID NO: 884902 - DNA, 25 bp, Mus musculus
tggccagtgtcttataggtccttcc

SEQ ID NO: 884903 - DNA, 25 bp, Mus musculus
tggccagtgtgtctcagctagtaca

SEQ ID NO: 884904 - DNA, 25 bp, Mus musculus
tggccagtgtgtgtcagctagtaca

SEQ ID NO: 884905 - DNA, 25 bp, Mus musculus
tggccagtgttcatcaaggtgcact

SEQ ID NO: 884906 - DNA, 25 bp, Mus musculus
tggccagtgttcttcaaggtgcact

SEQ ID NO: 884907 - DNA, 25 bp, Mus musculus
tggccagttaccactgtctatttta

SEQ ID NO: 884908 - DNA, 25 bp, Mus musculus
tggccagttacctctgtctatttta

SEQ ID NO: 884909 - DNA, 25 bp, Mus musculus
tggccagttcccaacaaaatgctgt

SEQ ID NO: 884910 - DNA, 25 bp, Mus musculus
tggccagttccctacaaaatgctgt

SEQ ID NO: 884911 - DNA, 25 bp, Mus musculus
tggccagttgccattgaagatgaac

SEQ ID NO: 884912 - DNA, 25 bp, Mus musculus
tggccagttgcctttgaagatgaac

SEQ ID NO: 884913 - DNA, 25 bp, Mus musculus
tggccagtttctcatgcatgcagct

SEQ ID NO: 884914 - DNA, 25 bp, Mus musculus
tggccagtttctgatgcatgcagct

SEQ ID NO: 884915 - DNA, 25 bp, Mus musculus
tggccataacttcagtgtctcctaa

SEQ ID NO: 884916 - DNA, 25 bp, Mus musculus
tggccataacttgagtgtctcctaa

SEQ ID NO: 884917 - DNA, 25 bp, Mus musculus
tggccatactgcctgcccagtagaa

SEQ ID NO: 884918 - DNA, 25 bp, Mus musculus
tggccatactgcctgggcaacccgt

SEQ ID NO: 884919 - DNA, 25 bp, Mus musculus
tggccatactgcgtgcccagtagaa

SEQ ID NO: 884920 - DNA, 25 bp, Mus musculus
tggccatactgcgtgggcaacccgt

SEQ ID NO: 884921 - DNA, 25 bp, Mus musculus
tggccatagaccaccttggaagaat

SEQ ID NO: 884922 - DNA, 25 bp, Mus musculus
tggccatagacctccttggaagaat

SEQ ID NO: 884923 - DNA, 25 bp, Mus musculus
tggccataggtcactttcagctctt

SEQ ID NO: 884924 - DNA, 25 bp, Mus musculus
tggccataggtctctttcagctctt

SEQ ID NO: 884925 - DNA, 25 bp, Mus musculus
tggccatattaaccacacaagctga

SEQ ID NO: 884926 - DNA, 25 bp, Mus musculus
tggccatattaagcacacaagctga

SEQ ID NO: 884927 - DNA, 25 bp, Mus musculus
tggccatattctacggtcttctgcg

SEQ ID NO: 884928 - DNA, 25 bp, Mus musculus
tggccatattcttcggtcttctgcg

SEQ ID NO: 884929 - DNA, 25 bp, Mus musculus
tggccatcaaccaagtgttcgatat

SEQ ID NO: 884930 - DNA, 25 bp, Mus musculus
tggccatcaacctagtgttcgatat

SEQ ID NO: 884931 - DNA, 25 bp, Mus musculus
tggccatcaactactaagcctgaga

SEQ ID NO: 884932 - DNA, 25 bp, Mus musculus
tggccatcaacttctaagcctgaga

SEQ ID NO: 884933 - DNA, 25 bp, Mus musculus
tggccatcaattaccgagaggagag

SEQ ID NO: 884934 - DNA, 25 bp, Mus musculus
tggccatcaatttccgagaggagag

SEQ ID NO: 884935 - DNA, 25 bp, Mus musculus
tggccatcacctaccagtagtaatt

SEQ ID NO: 884936 - DNA, 25 bp, Mus musculus
tggccatcaccttccagtagtaatt

SEQ ID NO: 884937 - DNA, 25 bp, Mus musculus
tggccatcagacaactggaggagtt

SEQ ID NO: 884938 - DNA, 25 bp, Mus musculus
tggccatcagactactggaggagtt

SEQ ID NO: 884939 - DNA, 25 bp, Mus musculus
tggccatcagttcctgagcccagag

SEQ ID NO: 884940 - DNA, 25 bp, Mus musculus
tggccatcagttgctgagcccagag

SEQ ID NO: 884941 - DNA, 25 bp, Mus musculus
tggccatcataccttactttcttgt

SEQ ID NO: 884942 - DNA, 25 bp, Mus musculus
tggccatcatacgttactttcttgt

SEQ ID NO: 884943 - DNA, 25 bp, Mus musculus
tggccatcattaatctgctctgaga

SEQ ID NO: 884944 - DNA, 25 bp, Mus musculus
tggccatcattattctgctctgaga

SEQ ID NO: 884945 - DNA, 25 bp, Mus musculus
tggccatcattcacacaaagtcttg

SEQ ID NO: 884946 - DNA, 25 bp, Mus musculus
tggccatcattctcacaaagtcttg

SEQ ID NO: 884947 - DNA, 25 bp, Mus musculus
tggccatccatcaacgtgagtagtg

SEQ ID NO: 884948 - DNA, 25 bp, Mus musculus
tggccatccatctacgtgagtagtg

SEQ ID NO: 884949 - DNA, 25 bp, Mus musculus
tggccatccatgacacagaggtcat

SEQ ID NO: 884950 - DNA, 25 bp, Mus musculus
tggccatccatgtcacagaggtcat

SEQ ID NO: 884951 - DNA, 25 bp, Mus musculus
tggccatcctcaccattggagatgc

SEQ ID NO: 884952 - DNA, 25 bp, Mus musculus
tggccatcctcagcattggagatgc

SEQ ID NO: 884953 - DNA, 25 bp, Mus musculus
tggccatcctgtagaacccaatgca

SEQ ID NO: 884954 - DNA, 25 bp, Mus musculus
tggccatcctgtatcgctttgatca

SEQ ID NO: 884955 - DNA, 25 bp, Mus musculus
tggccatcctgttgaacccaatgca

SEQ ID NO: 884956 - DNA, 25 bp, Mus musculus
tggccatcctgtttcgctttgatca

SEQ ID NO: 884957 - DNA, 25 bp, Mus musculus
tggccatcgaaactgccaacgagct

SEQ ID NO: 884958 - DNA, 25 bp, Mus musculus
tggccatcgaaagtgccaacgagct

SEQ ID NO: 884959 - DNA, 25 bp, Mus musculus
tggccatcgactacctttgagtcag

SEQ ID NO: 884960 - DNA, 25 bp, Mus musculus
tggccatcgacttcctttgagtcag

SEQ ID NO: 884961 - DNA, 25 bp, Mus musculus
tggccatcggacctgatttcaagtc

SEQ ID NO: 884962 - DNA, 25 bp, Mus musculus
tggccatcggacgtgatttcaagtc

SEQ ID NO: 884963 - DNA, 25 bp, Mus musculus
tggccatcggcgcttccattgctgt

SEQ ID NO: 884964 - DNA, 25 bp, Mus musculus
tggccatcggcggttccattgctgt

SEQ ID NO: 884965 - DNA, 25 bp, Mus musculus
tggccatcgggtagcagtctgtctt

SEQ ID NO: 884966 - DNA, 25 bp, Mus musculus
tggccatcgggttgcagtctgtctt

SEQ ID NO: 884967 - DNA, 25 bp, Mus musculus
tggccatcgtctatacactgattgt

SEQ ID NO: 884968 - DNA, 25 bp, Mus musculus
tggccatcgtctttacactgattgt

SEQ ID NO: 884969 - DNA, 25 bp, Mus musculus
tggccatcgttgacccttataacaa

SEQ ID NO: 884970 - DNA, 25 bp, Mus musculus
tggccatcgttgtcccttataacaa

SEQ ID NO: 884971 - DNA, 25 bp, Mus musculus
tggccatctacgacacaatgcagta

SEQ ID NO: 884972 - DNA, 25 bp, Mus musculus
tggccatctacgtcacaatgcagta

SEQ ID NO: 884973 - DNA, 25 bp, Mus musculus
tggccatctgccaagtaaagctttt

SEQ ID NO: 884974 - DNA, 25 bp, Mus musculus
tggccatctgcctagtaaagctttt

SEQ ID NO: 884975 - DNA, 25 bp, Mus musculus
tggccatctgttacccactgagata

SEQ ID NO: 884976 - DNA, 25 bp, Mus musculus
tggccatctgtttcccactgagata

SEQ ID NO: 884977 - DNA, 25 bp, Mus musculus
tggccatcttaccatgcctggaagt

SEQ ID NO: 884978 - DNA, 25 bp, Mus musculus
tggccatcttacgatgcctggaagt

SEQ ID NO: 884979 - DNA, 25 bp, Mus musculus
tggccatcttcacgcggcggaacga

SEQ ID NO: 884980 - DNA, 25 bp, Mus musculus
tggccatcttcaggcggcggaacga

SEQ ID NO: 884981 - DNA, 25 bp, Mus musculus
tggccatcttggaggtcagttgttc

SEQ ID NO: 884982 - DNA, 25 bp, Mus musculus
tggccatcttggtggtcagttgttc

SEQ ID NO: 884983 - DNA, 25 bp, Mus musculus
tggccatgacctccagctttggatg

SEQ ID NO: 884984 - DNA, 25 bp, Mus musculus
tggccatgacctgcagctttggatg

SEQ ID NO: 884985 - DNA, 25 bp, Mus musculus
tggccatgaggaactattgttcgaa

SEQ ID NO: 884986 - DNA, 25 bp, Mus musculus
tggccatgaggatctattgttcgaa

SEQ ID NO: 884987 - DNA, 25 bp, Mus musculus
tggccatgcccaagagcacgccaag

SEQ ID NO: 884988 - DNA, 25 bp, Mus musculus
tggccatgcccatgagcacgccaag

SEQ ID NO: 884989 - DNA, 25 bp, Mus musculus
tggccatgccccataacagtggtga

SEQ ID NO: 884990 - DNA, 25 bp, Mus musculus
tggccatgccccttaacagtggtga

SEQ ID NO: 884991 - DNA, 25 bp, Mus musculus
tggccatgctcaacttgttcaggaa

SEQ ID NO: 884992 - DNA, 25 bp, Mus musculus
tggccatgctcatcttgttcaggaa

SEQ ID NO: 884993 - DNA, 25 bp, Mus musculus
tggccatggattcgacaagtcacca

SEQ ID NO: 884994 - DNA, 25 bp, Mus musculus
tggccatggattggacaagtcacca

SEQ ID NO: 884995 - DNA, 25 bp, Mus musculus
tggccatgggccacatgcctagaat

SEQ ID NO: 884996 - DNA, 25 bp, Mus musculus
tggccatgggcctcatgcctagaat

SEQ ID NO: 884997 - DNA, 25 bp, Mus musculus
tggccatgtattaggcacaccaata

SEQ ID NO: 884998 - DNA, 25 bp, Mus musculus
tggccatgtatttggcacaccaata

SEQ ID NO: 884999 - DNA, 25 bp, Mus musculus
tggccatgtgtgaccgtgtctggaa

SEQ ID NO: 885000 - DNA, 25 bp, Mus musculus
tggccatgtgtgtccgtgtctggaa

SEQ ID NO: 885001 - DNA, 25 bp, Mus musculus
tggccattcataatagttctattac

SEQ ID NO: 885002 - DNA, 25 bp, Mus musculus
tggccattcatattagttctattac

SEQ ID NO: 885003 - DNA, 25 bp, Mus musculus
tggccattctaacccagacaaccaa

SEQ ID NO: 885004 - DNA, 25 bp, Mus musculus
tggccattctaagccagacaaccaa

SEQ ID NO: 885005 - DNA, 25 bp, Mus musculus
tggccattctctcgaagcactttat

SEQ ID NO: 885006 - DNA, 25 bp, Mus musculus
tggccattctctggaagcactttat

SEQ ID NO: 885007 - DNA, 25 bp, Mus musculus
tggccattctgcagtctgctggagc

SEQ ID NO: 885008 - DNA, 25 bp, Mus musculus
tggccattctgctgtctgctggagc

SEQ ID NO: 885009 - DNA, 25 bp, Mus musculus
tggccattctggagatgtcataaga

SEQ ID NO: 885010 - DNA, 25 bp, Mus musculus
tggccattctggcactacgcagact

SEQ ID NO: 885011 - DNA, 25 bp, Mus musculus
tggccattctgggactacgcagact

SEQ ID NO: 885012 - DNA, 25 bp, Mus musculus
tggccattctggtgatgtcataaga

SEQ ID NO: 885013 - DNA, 25 bp, Mus musculus
tggccattcttcaccggatcataga

SEQ ID NO: 885014 - DNA, 25 bp, Mus musculus
tggccattcttcagttcaaatctgg

SEQ ID NO: 885015 - DNA, 25 bp, Mus musculus
tggccattcttctccggatcataga

SEQ ID NO: 885016 - DNA, 25 bp, Mus musculus
tggccattcttctgttcaaatctgg

SEQ ID NO: 885017 - DNA, 25 bp, Mus musculus
tggccattgaccacggcttggagga

SEQ ID NO: 885018 - DNA, 25 bp, Mus musculus
tggccattgacctcggcttggagga

SEQ ID NO: 885019 - DNA, 25 bp, Mus musculus
tggccattgatgcactgccctcaaa

SEQ ID NO: 885020 - DNA, 25 bp, Mus musculus
tggccattgatggactgccctcaaa

SEQ ID NO: 885021 - DNA, 25 bp, Mus musculus
tggccattgcaacgcactggatcgt

SEQ ID NO: 885022 - DNA, 25 bp, Mus musculus
tggccattgcaaggcactggatcgt

SEQ ID NO: 885023 - DNA, 25 bp, Mus musculus
tggccattgccactgtgatctatct

SEQ ID NO: 885024 - DNA, 25 bp, Mus musculus
tggccattgccagtgtgatctatct

SEQ ID NO: 885025 - DNA, 25 bp, Mus musculus
tggccattgggcagagtcctcatat

SEQ ID NO: 885026 - DNA, 25 bp, Mus musculus
tggccattgggctgagtcctcatat

SEQ ID NO: 885027 - DNA, 25 bp, Mus musculus
tggccattggtaaccagcacagagc

SEQ ID NO: 885028 - DNA, 25 bp, Mus musculus
tggccattggtatccagcacagagc

SEQ ID NO: 885029 - DNA, 25 bp, Mus musculus
tggccattggtgacttccttgttga

SEQ ID NO: 885030 - DNA, 25 bp, Mus musculus
tggccattggtgtcttccttgttga

SEQ ID NO: 885031 - DNA, 25 bp, Mus musculus
tggccattggttacatagttatcac

SEQ ID NO: 885032 - DNA, 25 bp, Mus musculus
tggccattggtttcatagttatcac

SEQ ID NO: 885033 - DNA, 25 bp, Mus musculus
tggccattgtcaaagcacagagatt

SEQ ID NO: 885034 - DNA, 25 bp, Mus musculus
tggccattgtcatagcacagagatt

SEQ ID NO: 885035 - DNA, 25 bp, Mus musculus
tggccatttaataccattgcagaaa

SEQ ID NO: 885036 - DNA, 25 bp, Mus musculus
tggccatttaattccattgcagaaa

SEQ ID NO: 885037 - DNA, 25 bp, Mus musculus
tggccattttaacagcaaccgtatt

SEQ ID NO: 885038 - DNA, 25 bp, Mus musculus
tggccattttaagagcaaccgtatt

SEQ ID NO: 885039 - DNA, 25 bp, Mus musculus
tggccattttcccttgcacagggtt

SEQ ID NO: 885040 - DNA, 25 bp, Mus musculus
tggccattttccgttgcacagggtt

SEQ ID NO: 885041 - DNA, 25 bp, Mus musculus
tggcccaaaggcaggcacagctggt

SEQ ID NO: 885042 - DNA, 25 bp, Mus musculus
tggcccaaaggctggcacagctggt

SEQ ID NO: 885043 - DNA, 25 bp, Mus musculus
tggcccaagagcctttccttgatga

SEQ ID NO: 885044 - DNA, 25 bp, Mus musculus
tggcccaagagcgtttccttgatga

SEQ ID NO: 885045 - DNA, 25 bp, Mus musculus
tggcccaagctgagaatggatccca

SEQ ID NO: 885046 - DNA, 25 bp, Mus musculus
tggcccaagctgtgaatggatccca

SEQ ID NO: 885047 - DNA, 25 bp, Mus musculus
tggcccaaggacagtatccctagaa

SEQ ID NO: 885048 - DNA, 25 bp, Mus musculus
tggcccaaggactgtatccctagaa

SEQ ID NO: 885049 - DNA, 25 bp, Mus musculus
tggcccaagggcattattcatccac

SEQ ID NO: 885050 - DNA, 25 bp, Mus musculus
tggcccaagggctttattcatccac

SEQ ID NO: 885051 - DNA, 25 bp, Mus musculus
tggcccaagggtactgactcgcagc

SEQ ID NO: 885052 - DNA, 25 bp, Mus musculus
tggcccaagggttctgactcgcagc

SEQ ID NO: 885053 - DNA, 25 bp, Mus musculus
tggcccaagtagagatgtctgcctt

SEQ ID NO: 885054 - DNA, 25 bp, Mus musculus
tggcccaagtagtgatgtctgcctt

SEQ ID NO: 885055 - DNA, 25 bp, Mus musculus
tggcccaagtcccagcagcaaaaaa

SEQ ID NO: 885056 - DNA, 25 bp, Mus musculus
tggcccaagtccgagcagcaaaaaa

SEQ ID NO: 885057 - DNA, 25 bp, Mus musculus
tggcccaagtggcagttttgagtaa

SEQ ID NO: 885058 - DNA, 25 bp, Mus musculus
tggcccaagtgggagttttgagtaa

SEQ ID NO: 885059 - DNA, 25 bp, Mus musculus
tggcccaattccattatggctgaag

SEQ ID NO: 885060 - DNA, 25 bp, Mus musculus
tggcccaattcctttatggctgaag

SEQ ID NO: 885061 - DNA, 25 bp, Mus musculus
tggcccacagagaagaacaagcatg

SEQ ID NO: 885062 - DNA, 25 bp, Mus musculus
tggcccacagagtagaacaagcatg

SEQ ID NO: 885063 - DNA, 25 bp, Mus musculus
tggcccacagcaacttatgacagct

SEQ ID NO: 885064 - DNA, 25 bp, Mus musculus
tggcccacagcatcttatgacagct

SEQ ID NO: 885065 - DNA, 25 bp, Mus musculus
tggcccaccaagatgtacaactacg

SEQ ID NO: 885066 - DNA, 25 bp, Mus musculus
tggcccaccaagttgtacaactacg

SEQ ID NO: 885067 - DNA, 25 bp, Mus musculus
tggcccaccataaccctgtggaaaa

SEQ ID NO: 885068 - DNA, 25 bp, Mus musculus
tggcccaccatatccctgtggaaaa

SEQ ID NO: 885069 - DNA, 25 bp, Mus musculus
tggcccaccgtgaacagcttgaaag

SEQ ID NO: 885070 - DNA, 25 bp, Mus musculus
tggcccaccgtgtacagcttgaaag

SEQ ID NO: 885071 - DNA, 25 bp, Mus musculus
tggcccacctagacatcacagggct

SEQ ID NO: 885072 - DNA, 25 bp, Mus musculus
tggcccacctagcacagtgtgcagg

SEQ ID NO: 885073 - DNA, 25 bp, Mus musculus
tggcccacctaggacagtgtgcagg

SEQ ID NO: 885074 - DNA, 25 bp, Mus musculus
tggcccacctagtcatcacagggct

SEQ ID NO: 885075 - DNA, 25 bp, Mus musculus
tggcccacgtggaaacttcagagag

SEQ ID NO: 885076 - DNA, 25 bp, Mus musculus
tggcccacgtggtaacttcagagag

SEQ ID NO: 885077 - DNA, 25 bp, Mus musculus
tggcccactacaaccaagtgcctga

SEQ ID NO: 885078 - DNA, 25 bp, Mus musculus
tggcccactacatccaagtgcctga

SEQ ID NO: 885079 - DNA, 25 bp, Mus musculus
tggcccactctaagcagatgctgaa

SEQ ID NO: 885080 - DNA, 25 bp, Mus musculus
tggcccactctatgcagatgctgaa

SEQ ID NO: 885081 - DNA, 25 bp, Mus musculus
tggcccactggaaaggtccgatttg

SEQ ID NO: 885082 - DNA, 25 bp, Mus musculus
tggcccactggataggtccgatttg

SEQ ID NO: 885083 - DNA, 25 bp, Mus musculus
tggcccactggcattcagttctgct

SEQ ID NO: 885084 - DNA, 25 bp, Mus musculus
tggcccactggctttcagttctgct

SEQ ID NO: 885085 - DNA, 25 bp, Mus musculus
tggcccacttctctagaaatagctg

SEQ ID NO: 885086 - DNA, 25 bp, Mus musculus
tggcccacttctgtagaaatagctg

SEQ ID NO: 885087 - DNA, 25 bp, Mus musculus
tggcccagaactcaactaagctctt

SEQ ID NO: 885088 - DNA, 25 bp, Mus musculus
tggcccagaactgaactaagctctt

SEQ ID NO: 885089 - DNA, 25 bp, Mus musculus
tggcccagaatgacagattgcttta

SEQ ID NO: 885090 - DNA, 25 bp, Mus musculus
tggcccagaatgtcagattgcttta

SEQ ID NO: 885091 - DNA, 25 bp, Mus musculus
tggcccagacccagatccatggaag

SEQ ID NO: 885092 - DNA, 25 bp, Mus musculus
tggcccagaccctgatccatggaag

SEQ ID NO: 885093 - DNA, 25 bp, Mus musculus
tggcccagacctcagttaagacaat

SEQ ID NO: 885094 - DNA, 25 bp, Mus musculus
tggcccagacctgagttaagacaat

SEQ ID NO: 885095 - DNA, 25 bp, Mus musculus
tggcccagagttacacagcagctat

SEQ ID NO: 885096 - DNA, 25 bp, Mus musculus
tggcccagagtttcacagcagctat

SEQ ID NO: 885097 - DNA, 25 bp, Mus musculus
tggcccagatccatactctgaacat

SEQ ID NO: 885098 - DNA, 25 bp, Mus musculus
tggcccagatccttactctgaacat

SEQ ID NO: 885099 - DNA, 25 bp, Mus musculus
tggcccagatgcctttgcacctgca

SEQ ID NO: 885100 - DNA, 25 bp, Mus musculus
tggcccagatgcgtttgcacctgca

SEQ ID NO: 885101 - DNA, 25 bp, Mus musculus
tggcccagcagacgtagcccaggct

SEQ ID NO: 885102 - DNA, 25 bp, Mus musculus
tggcccagcagaggtagcccaggct

SEQ ID NO: 885103 - DNA, 25 bp, Mus musculus
tggcccagcagtccagtgccctgta

SEQ ID NO: 885104 - DNA, 25 bp, Mus musculus
tggcccagcagtgcagtgccctgta

SEQ ID NO: 885105 - DNA, 25 bp, Mus musculus
tggcccagcatcaaccacacaatgg

SEQ ID NO: 885106 - DNA, 25 bp, Mus musculus
tggcccagcatctaccacacaatgg

SEQ ID NO: 885107 - DNA, 25 bp, Mus musculus
tggcccagcatgagaacttagcagt

SEQ ID NO: 885108 - DNA, 25 bp, Mus musculus
tggcccagcatgcagttaagagaac

SEQ ID NO: 885109 - DNA, 25 bp, Mus musculus
tggcccagcatggagttaagagaac

SEQ ID NO: 885110 - DNA, 25 bp, Mus musculus
tggcccagcatgtgaacttagcagt

SEQ ID NO: 885111 - DNA, 25 bp, Mus musculus
tggcccagctccagtgagaactcaa

SEQ ID NO: 885112 - DNA, 25 bp, Mus musculus
tggcccagctcctgtgagaactcaa

SEQ ID NO: 885113 - DNA, 25 bp, Mus musculus
tggcccagctggcagccttgtacca

SEQ ID NO: 885114 - DNA, 25 bp, Mus musculus
tggcccagctgggagccttgtacca

SEQ ID NO: 885115 - DNA, 25 bp, Mus musculus
tggcccaggcaaccattgacaggaa

SEQ ID NO: 885116 - DNA, 25 bp, Mus musculus
tggcccaggcaactgttctagatgt

SEQ ID NO: 885117 - DNA, 25 bp, Mus musculus
tggcccaggcaagcattgacaggaa

SEQ ID NO: 885118 - DNA, 25 bp, Mus musculus
tggcccaggcaagtgttctagatgt

SEQ ID NO: 885119 - DNA, 25 bp, Mus musculus
tggcccaggcataccttgcattgtt

SEQ ID NO: 885120 - DNA, 25 bp, Mus musculus
tggcccaggcattccttgcattgtt

SEQ ID NO: 885121 - DNA, 25 bp, Mus musculus
tggcccaggccgatatagatttcct

SEQ ID NO: 885122 - DNA, 25 bp, Mus musculus
tggcccaggccgttatagatttcct

SEQ ID NO: 885123 - DNA, 25 bp, Mus musculus
tggcccaggttaacagccagctaga

SEQ ID NO: 885124 - DNA, 25 bp, Mus musculus
tggcccaggttatcagccagctaga

SEQ ID NO: 885125 - DNA, 25 bp, Mus musculus
tggcccagtgatcatgtctcttgag

SEQ ID NO: 885126 - DNA, 25 bp, Mus musculus
tggcccagtgatgatgtctcttgag

SEQ ID NO: 885127 - DNA, 25 bp, Mus musculus
tggcccagttacatgcttgtgtgaa

SEQ ID NO: 885128 - DNA, 25 bp, Mus musculus
tggcccagttacttgcttgtgtgaa

SEQ ID NO: 885129 - DNA, 25 bp, Mus musculus
tggcccagttcaaagcacctatgag

SEQ ID NO: 885130 - DNA, 25 bp, Mus musculus
tggcccagttcatagcacctatgag

SEQ ID NO: 885131 - DNA, 25 bp, Mus musculus
tggcccagttggattttatgtcagt

SEQ ID NO: 885132 - DNA, 25 bp, Mus musculus
tggcccagttggtttttatgtcagt

SEQ ID NO: 885133 - DNA, 25 bp, Mus musculus
tggcccagtttaacaagcacccaag

SEQ ID NO: 885134 - DNA, 25 bp, Mus musculus
tggcccagtttatcaagcacccaag

SEQ ID NO: 885135 - DNA, 25 bp, Mus musculus
tggcccataaccacctatagtagtg

SEQ ID NO: 885136 - DNA, 25 bp, Mus musculus
tggcccataacctcctatagtagtg

SEQ ID NO: 885137 - DNA, 25 bp, Mus musculus
tggcccatagccactagtctatata

SEQ ID NO: 885138 - DNA, 25 bp, Mus musculus
tggcccatagcctctagtctatata

SEQ ID NO: 885139 - DNA, 25 bp, Mus musculus
tggcccatccctattattaacattg

SEQ ID NO: 885140 - DNA, 25 bp, Mus musculus
tggcccatcccttttattaacattg

SEQ ID NO: 885141 - DNA, 25 bp, Mus musculus
tggcccatcgctcgttcttcagaga

SEQ ID NO: 885142 - DNA, 25 bp, Mus musculus
tggcccatcgctggttcttcagaga

SEQ ID NO: 885143 - DNA, 25 bp, Mus musculus
tggcccatcttgcacagttcttggg

SEQ ID NO: 885144 - DNA, 25 bp, Mus musculus
tggcccatcttggacagttcttggg

SEQ ID NO: 885145 - DNA, 25 bp, Mus musculus
tggcccatctttccttagccaagaa

SEQ ID NO: 885146 - DNA, 25 bp, Mus musculus
tggcccatctttgcttagccaagaa

SEQ ID NO: 885147 - DNA, 25 bp, Mus musculus
tggcccatgagaccattaagtttat

SEQ ID NO: 885148 - DNA, 25 bp, Mus musculus
tggcccatgagagcattaagtttat

SEQ ID NO: 885149 - DNA, 25 bp, Mus musculus
tggcccatgatcacgaccagttata

SEQ ID NO: 885150 - DNA, 25 bp, Mus musculus
tggcccatgatctcgaccagttata

SEQ ID NO: 885151 - DNA, 25 bp, Mus musculus
tggcccatgcagcaggccaaatcat

SEQ ID NO: 885152 - DNA, 25 bp, Mus musculus
tggcccatgcaggaggccaaatcat

SEQ ID NO: 885153 - DNA, 25 bp, Mus musculus
tggcccatgccactagttctagagg

SEQ ID NO: 885154 - DNA, 25 bp, Mus musculus
tggcccatgccagtagttctagagg

SEQ ID NO: 885155 - DNA, 25 bp, Mus musculus
tggcccatgctcacagagtccaaaa

SEQ ID NO: 885156 - DNA, 25 bp, Mus musculus
tggcccatgctctcagagtccaaaa

SEQ ID NO: 885157 - DNA, 25 bp, Mus musculus
tggcccatggcaaatgtgtgcccca

SEQ ID NO: 885158 - DNA, 25 bp, Mus musculus
tggcccatggcatatgtgtgcccca

SEQ ID NO: 885159 - DNA, 25 bp, Mus musculus
tggcccatggtaatgcatcttctta

SEQ ID NO: 885160 - DNA, 25 bp, Mus musculus
tggcccatggtattgcatcttctta

SEQ ID NO: 885161 - DNA, 25 bp, Mus musculus
tggcccatgtggacctgactggaga

SEQ ID NO: 885162 - DNA, 25 bp, Mus musculus
tggcccatgtggtcctgactggaga

SEQ ID NO: 885163 - DNA, 25 bp, Mus musculus
tggcccatgtttaaactcccactgg

SEQ ID NO: 885164 - DNA, 25 bp, Mus musculus
tggcccatgttttaactcccactgg

SEQ ID NO: 885165 - DNA, 25 bp, Mus musculus
tggcccattaatactctgtcatgtg

SEQ ID NO: 885166 - DNA, 25 bp, Mus musculus
tggcccattaattctctgtcatgtg

SEQ ID NO: 885167 - DNA, 25 bp, Mus musculus
tggccccaaaccatgcttctgtgag

SEQ ID NO: 885168 - DNA, 25 bp, Mus musculus
tggccccaaaccttgcttctgtgag

SEQ ID NO: 885169 - DNA, 25 bp, Mus musculus
tggccccaaagacactctgcaggtg

SEQ ID NO: 885170 - DNA, 25 bp, Mus musculus
tggccccaaagagactctgcaggtg

SEQ ID NO: 885171 - DNA, 25 bp, Mus musculus
tggccccaaattcctaggagctgtg

SEQ ID NO: 885172 - DNA, 25 bp, Mus musculus
tggccccaaattgctaggagctgtg

SEQ ID NO: 885173 - DNA, 25 bp, Mus musculus
tggccccaactcaagaaccaagtgg

SEQ ID NO: 885174 - DNA, 25 bp, Mus musculus
tggccccaactctagaaccaagtgg

SEQ ID NO: 885175 - DNA, 25 bp, Mus musculus
tggccccaagctagagagacccatc

SEQ ID NO: 885176 - DNA, 25 bp, Mus musculus
tggccccaagcttgagagacccatc

SEQ ID NO: 885177 - DNA, 25 bp, Mus musculus
tggccccacacaaagtctagaggta

SEQ ID NO: 885178 - DNA, 25 bp, Mus musculus
tggccccacacatagtctagaggta

SEQ ID NO: 885179 - DNA, 25 bp, Mus musculus
tggccccaccgactaattgaggttt

SEQ ID NO: 885180 - DNA, 25 bp, Mus musculus
tggccccaccgagtaattgaggttt

SEQ ID NO: 885181 - DNA, 25 bp, Mus musculus
tggccccacggcaatgtatttatgg

SEQ ID NO: 885182 - DNA, 25 bp, Mus musculus
tggccccacggctatgtatttatgg

SEQ ID NO: 885183 - DNA, 25 bp, Mus musculus
tggccccactggaagagacattgat

SEQ ID NO: 885184 - DNA, 25 bp, Mus musculus
tggccccactggtagagacattgat

SEQ ID NO: 885185 - DNA, 25 bp, Mus musculus
tggccccagaaacgagatcctgacc

SEQ ID NO: 885186 - DNA, 25 bp, Mus musculus
tggccccagaaaggagatcctgacc

SEQ ID NO: 885187 - DNA, 25 bp, Mus musculus
tggccccagattagcatttcttcta

SEQ ID NO: 885188 - DNA, 25 bp, Mus musculus
tggccccagatttgcatttcttcta

SEQ ID NO: 885189 - DNA, 25 bp, Mus musculus
tggccccagctcatggttcattaaa

SEQ ID NO: 885190 - DNA, 25 bp, Mus musculus
tggccccagctcttggttcattaaa

SEQ ID NO: 885191 - DNA, 25 bp, Mus musculus
tggccccagctgagggacctgcaag

SEQ ID NO: 885192 - DNA, 25 bp, Mus musculus
tggccccagctgtgggacctgcaag

SEQ ID NO: 885193 - DNA, 25 bp, Mus musculus
tggccccaggacagtttgcagaagt

SEQ ID NO: 885194 - DNA, 25 bp, Mus musculus
tggccccaggactgtttgcagaagt

SEQ ID NO: 885195 - DNA, 25 bp, Mus musculus
tggccccaggcgatacacacaagag

SEQ ID NO: 885196 - DNA, 25 bp, Mus musculus
tggccccaggcgttacacacaagag

SEQ ID NO: 885197 - DNA, 25 bp, Mus musculus
tggccccagtgcagattaaggttga

SEQ ID NO: 885198 - DNA, 25 bp, Mus musculus
tggccccagtgctgattaaggttga

SEQ ID NO: 885199 - DNA, 25 bp, Mus musculus
tggccccagtggaaagtttcaaaag

SEQ ID NO: 885200 - DNA, 25 bp, Mus musculus
tggccccagtggtaagtttcaaaag

SEQ ID NO: 885201 - DNA, 25 bp, Mus musculus
tggccccataagctgcagctgtctg

SEQ ID NO: 885202 - DNA, 25 bp, Mus musculus
tggccccataaggtgcagctgtctg

SEQ ID NO: 885203 - DNA, 25 bp, Mus musculus
tggccccatgggaaccagacacaac

SEQ ID NO: 885204 - DNA, 25 bp, Mus musculus
tggccccatgggtaccagacacaac

SEQ ID NO: 885205 - DNA, 25 bp, Mus musculus
tggccccattccatgaatttttgtg

SEQ ID NO: 885206 - DNA, 25 bp, Mus musculus
tggccccattccttgaatttttgtg

SEQ ID NO: 885207 - DNA, 25 bp, Mus musculus
tggccccctattccattatattttt

SEQ ID NO: 885208 - DNA, 25 bp, Mus musculus
tggccccctattgcattatattttt

SEQ ID NO: 885209 - DNA, 25 bp, Mus musculus
tggccccctggcaaagatgtttaga

SEQ ID NO: 885210 - DNA, 25 bp, Mus musculus
tggccccctggctaagatgtttaga

SEQ ID NO: 885211 - DNA, 25 bp, Mus musculus
tggcccccttaaccatgttggagta

SEQ ID NO: 885212 - DNA, 25 bp, Mus musculus
tggcccccttaagcatgttggagta

SEQ ID NO: 885213 - DNA, 25 bp, Mus musculus
tggccccgaaacactcaggagctaa

SEQ ID NO: 885214 - DNA, 25 bp, Mus musculus
tggccccgaaactctcaggagctaa

SEQ ID NO: 885215 - DNA, 25 bp, Mus musculus
tggccccgaagtattagtcccaact

SEQ ID NO: 885216 - DNA, 25 bp, Mus musculus
tggccccgaagttttagtcccaact

SEQ ID NO: 885217 - DNA, 25 bp, Mus musculus
tggccccgagtgatgtgttttgccc

SEQ ID NO: 885218 - DNA, 25 bp, Mus musculus
tggccccgagtgttgtgttttgccc

SEQ ID NO: 885219 - DNA, 25 bp, Mus musculus
tggccccgcatcattgagcattagt

SEQ ID NO: 885220 - DNA, 25 bp, Mus musculus
tggccccgcatctttgagcattagt

SEQ ID NO: 885221 - DNA, 25 bp, Mus musculus
tggccccggaccatggagaaaggat

SEQ ID NO: 885222 - DNA, 25 bp, Mus musculus
tggccccggaccttggagaaaggat

SEQ ID NO: 885223 - DNA, 25 bp, Mus musculus
tggccccggccaagtgtgctgtgcc

SEQ ID NO: 885224 - DNA, 25 bp, Mus musculus
tggccccggccacacaggtattaaa

SEQ ID NO: 885225 - DNA, 25 bp, Mus musculus
tggccccggccagacaggtattaaa

SEQ ID NO: 885226 - DNA, 25 bp, Mus musculus
tggccccggccatgtgtgctgtgcc

SEQ ID NO: 885227 - DNA, 25 bp, Mus musculus
tggccccgggagagggatcaatgca

SEQ ID NO: 885228 - DNA, 25 bp, Mus musculus
tggccccgggagtgggatcaatgca

SEQ ID NO: 885229 - DNA, 25 bp, Mus musculus
tggccccgtagtctgcaatggacaa

SEQ ID NO: 885230 - DNA, 25 bp, Mus musculus
tggccccgtagtgtgcaatggacaa

SEQ ID NO: 885231 - DNA, 25 bp, Mus musculus
tggccccgtctgattcaaataagtg

SEQ ID NO: 885232 - DNA, 25 bp, Mus musculus
tggccccgtctgtttcaaataagtg

SEQ ID NO: 885233 - DNA, 25 bp, Mus musculus
tggcccctaaggagttcaccagaac

SEQ ID NO: 885234 - DNA, 25 bp, Mus musculus
tggcccctaaggtgttcaccagaac

SEQ ID NO: 885235 - DNA, 25 bp, Mus musculus
tggcccctacacaatgactgacatg

SEQ ID NO: 885236 - DNA, 25 bp, Mus musculus
tggcccctacactatgactgacatg

SEQ ID NO: 885237 - DNA, 25 bp, Mus musculus
tggcccctagatataacagtaagtt

SEQ ID NO: 885238 - DNA, 25 bp, Mus musculus
tggcccctagatttaacagtaagtt

SEQ ID NO: 885239 - DNA, 25 bp, Mus musculus
tggcccctaggcacatatttattac

SEQ ID NO: 885240 - DNA, 25 bp, Mus musculus
tggcccctaggctcatatttattac

SEQ ID NO: 885241 - DNA, 25 bp, Mus musculus
tggcccctaggtactacttaagtgg

SEQ ID NO: 885242 - DNA, 25 bp, Mus musculus
tggcccctaggttctacttaagtgg

SEQ ID NO: 885243 - DNA, 25 bp, Mus musculus
tggcccctagtcaccaggaaacaat

SEQ ID NO: 885244 - DNA, 25 bp, Mus musculus
tggcccctagtcctgggaactctgt

SEQ ID NO: 885245 - DNA, 25 bp, Mus musculus
tggcccctagtcgtgggaactctgt

SEQ ID NO: 885246 - DNA, 25 bp, Mus musculus
tggcccctagtctccaggaaacaat

SEQ ID NO: 885247 - DNA, 25 bp, Mus musculus
tggcccctatttcaaagttcattac

SEQ ID NO: 885248 - DNA, 25 bp, Mus musculus
tggcccctatttgaaagttcattac

SEQ ID NO: 885249 - DNA, 25 bp, Mus musculus
tggcccctcattcttaaattgcatc

SEQ ID NO: 885250 - DNA, 25 bp, Mus musculus
tggcccctcattgttaaattgcatc

SEQ ID NO: 885251 - DNA, 25 bp, Mus musculus
tggcccctccatctaaataccatga

SEQ ID NO: 885252 - DNA, 25 bp, Mus musculus
tggcccctccatgtaaataccatga

SEQ ID NO: 885253 - DNA, 25 bp, Mus musculus
tggcccctcccacagtaagaaagta

SEQ ID NO: 885254 - DNA, 25 bp, Mus musculus
tggcccctcccagagtaagaaagta

SEQ ID NO: 885255 - DNA, 25 bp, Mus musculus
tggcccctcttgaaaatcaccacaa

SEQ ID NO: 885256 - DNA, 25 bp, Mus musculus
tggcccctcttgtaaatcaccacaa

SEQ ID NO: 885257 - DNA, 25 bp, Mus musculus
tggcccctgaagatattacccgagc

SEQ ID NO: 885258 - DNA, 25 bp, Mus musculus
tggcccctgaagttattacccgagc

SEQ ID NO: 885259 - DNA, 25 bp, Mus musculus
tggcccctgcagaatgatgaagcca

SEQ ID NO: 885260 - DNA, 25 bp, Mus musculus
tggcccctgcagtatgatgaagcca

SEQ ID NO: 885261 - DNA, 25 bp, Mus musculus
tggcccctgcataagtgctgacaat

SEQ ID NO: 885262 - DNA, 25 bp, Mus musculus
tggcccctgcattagtgctgacaat

SEQ ID NO: 885263 - DNA, 25 bp, Mus musculus
tggcccctgggactatgaactacac

SEQ ID NO: 885264 - DNA, 25 bp, Mus musculus
tggcccctgggagtatgaactacac

SEQ ID NO: 885265 - DNA, 25 bp, Mus musculus
tggcccctgggcaaatttgaaagga

SEQ ID NO: 885266 - DNA, 25 bp, Mus musculus
tggcccctgggcactgttttaaagc

SEQ ID NO: 885267 - DNA, 25 bp, Mus musculus
tggcccctgggcatagtaattttta

SEQ ID NO: 885268 - DNA, 25 bp, Mus musculus
tggcccctgggctaatttgaaagga

SEQ ID NO: 885269 - DNA, 25 bp, Mus musculus
tggcccctgggctctgttttaaagc

SEQ ID NO: 885270 - DNA, 25 bp, Mus musculus
tggcccctgggcttagtaattttta

SEQ ID NO: 885271 - DNA, 25 bp, Mus musculus
tggcccctggtgctcagactagata

SEQ ID NO: 885272 - DNA, 25 bp, Mus musculus
tggcccctggtggtcagactagata

SEQ ID NO: 885273 - DNA, 25 bp, Mus musculus
tggcccctgtgactgcgtgtgcata

SEQ ID NO: 885274 - DNA, 25 bp, Mus musculus
tggcccctgtgagtgcgtgtgcata

SEQ ID NO: 885275 - DNA, 25 bp, Mus musculus
tggccccttccacaatatactcttt

SEQ ID NO: 885276 - DNA, 25 bp, Mus musculus
tggccccttccagaatatactcttt

SEQ ID NO: 885277 - DNA, 25 bp, Mus musculus
tggccccttctacaggttccaggga

SEQ ID NO: 885278 - DNA, 25 bp, Mus musculus
tggccccttctagaggttccaggga

SEQ ID NO: 885279 - DNA, 25 bp, Mus musculus
tggccccttgtaagtgctgttacct

SEQ ID NO: 885280 - DNA, 25 bp, Mus musculus
tggccccttgtatgtgctgttacct

SEQ ID NO: 885281 - DNA, 25 bp, Mus musculus
tggccccttgtgctgtatcatagtt

SEQ ID NO: 885282 - DNA, 25 bp, Mus musculus
tggccccttgtggtgtatcatagtt

SEQ ID NO: 885283 - DNA, 25 bp, Mus musculus
tggccccttttgcattggtccctcg

SEQ ID NO: 885284 - DNA, 25 bp, Mus musculus
tggccccttttggattggtccctcg

SEQ ID NO: 885285 - DNA, 25 bp, Mus musculus
tggcccgacttgcagctctgtagag

SEQ ID NO: 885286 - DNA, 25 bp, Mus musculus
tggcccgacttggagctctgtagag

SEQ ID NO: 885287 - DNA, 25 bp, Mus musculus
tggcccgagaccaacgtcccttttg

SEQ ID NO: 885288 - DNA, 25 bp, Mus musculus
tggcccgagacctacgtcccttttg

SEQ ID NO: 885289 - DNA, 25 bp, Mus musculus
tggcccgaggagcttgggccaggca

SEQ ID NO: 885290 - DNA, 25 bp, Mus musculus
tggcccgaggaggttgggccaggca

SEQ ID NO: 885291 - DNA, 25 bp, Mus musculus
tggcccgattcacggaggatcaccc

SEQ ID NO: 885292 - DNA, 25 bp, Mus musculus
tggcccgattcagggaggatcaccc

SEQ ID NO: 885293 - DNA, 25 bp, Mus musculus
tggcccgattgcactgtaggaagtc

SEQ ID NO: 885294 - DNA, 25 bp, Mus musculus
tggcccgattgctctgtaggaagtc

SEQ ID NO: 885295 - DNA, 25 bp, Mus musculus
tggcccgcaaatacagcactgcttc

SEQ ID NO: 885296 - DNA, 25 bp, Mus musculus
tggcccgcaaattcagcactgcttc

SEQ ID NO: 885297 - DNA, 25 bp, Mus musculus
tggcccgcaagcctgaacagctgct

SEQ ID NO: 885298 - DNA, 25 bp, Mus musculus
tggcccgcaagcgtgaacagctgct

SEQ ID NO: 885299 - DNA, 25 bp, Mus musculus
tggcccgcatagactcgggaggcta

SEQ ID NO: 885300 - DNA, 25 bp, Mus musculus
tggcccgcatagtctcgggaggcta

SEQ ID NO: 885301 - DNA, 25 bp, Mus musculus
tggcccgccttgatttgcagctgag

SEQ ID NO: 885302 - DNA, 25 bp, Mus musculus
tggcccgccttgttttgcagctgag

SEQ ID NO: 885303 - DNA, 25 bp, Mus musculus
tggcccgcggatcgaactcagcata

SEQ ID NO: 885304 - DNA, 25 bp, Mus musculus
tggcccgcggatggaactcagcata

SEQ ID NO: 885305 - DNA, 25 bp, Mus musculus
tggcccgctctcatgatgggaagtt

SEQ ID NO: 885306 - DNA, 25 bp, Mus musculus
tggcccgctctcctgggatgtaaag

SEQ ID NO: 885307 - DNA, 25 bp, Mus musculus
tggcccgctctcgtgggatgtaaag

SEQ ID NO: 885308 - DNA, 25 bp, Mus musculus
tggcccgctctcttgatgggaagtt

SEQ ID NO: 885309 - DNA, 25 bp, Mus musculus
tggcccgctgaacacaacactgtgt

SEQ ID NO: 885310 - DNA, 25 bp, Mus musculus
tggcccgctgaagacaacactgtgt

SEQ ID NO: 885311 - DNA, 25 bp, Mus musculus
tggcccggaaatacaaccgtagcga

SEQ ID NO: 885312 - DNA, 25 bp, Mus musculus
tggcccggaaattcaaccgtagcga

SEQ ID NO: 885313 - DNA, 25 bp, Mus musculus
tggcccggaaccatgtcaagcggat

SEQ ID NO: 885314 - DNA, 25 bp, Mus musculus
tggcccggaaccttgtcaagcggat

SEQ ID NO: 885315 - DNA, 25 bp, Mus musculus
tggcccggaagcatctacacaactt

SEQ ID NO: 885316 - DNA, 25 bp, Mus musculus
tggcccggaagcttctacacaactt

SEQ ID NO: 885317 - DNA, 25 bp, Mus musculus
tggcccggacctcaaactgagttgt

SEQ ID NO: 885318 - DNA, 25 bp, Mus musculus
tggcccggacctctttgaaacacac

SEQ ID NO: 885319 - DNA, 25 bp, Mus musculus
tggcccggacctgaaactgagttgt

SEQ ID NO: 885320 - DNA, 25 bp, Mus musculus
tggcccggacctgtttgaaacacac

SEQ ID NO: 885321 - DNA, 25 bp, Mus musculus
tggcccgggatcacgacaatcagga

SEQ ID NO: 885322 - DNA, 25 bp, Mus musculus
tggcccgggatctcgacaatcagga

SEQ ID NO: 885323 - DNA, 25 bp, Mus musculus
tggcccggtaccaggacgagatcaa

SEQ ID NO: 885324 - DNA, 25 bp, Mus musculus
tggcccggtacctggacgagatcaa

SEQ ID NO: 885325 - DNA, 25 bp, Mus musculus
tggcccggtccaagcccttagagga

SEQ ID NO: 885326 - DNA, 25 bp, Mus musculus
tggcccggtccatgcccttagagga

SEQ ID NO: 885327 - DNA, 25 bp, Mus musculus
tggcccgtaacaatttgaggaggac

SEQ ID NO: 885328 - DNA, 25 bp, Mus musculus
tggcccgtaacactcctaaaggcat

SEQ ID NO: 885329 - DNA, 25 bp, Mus musculus
tggcccgtaacagtcctaaaggcat

SEQ ID NO: 885330 - DNA, 25 bp, Mus musculus
tggcccgtaacattttgaggaggac

SEQ ID NO: 885331 - DNA, 25 bp, Mus musculus
tggcccgtaagcaggtcatcatcga

SEQ ID NO: 885332 - DNA, 25 bp, Mus musculus
tggcccgtaagctggtcatcatcga

SEQ ID NO: 885333 - DNA, 25 bp, Mus musculus
tggcccgtacctcgagatcttgaat

SEQ ID NO: 885334 - DNA, 25 bp, Mus musculus
tggcccgtacctggagatcttgaat

SEQ ID NO: 885335 - DNA, 25 bp, Mus musculus
tggcccgtcccacagcactggagtt

SEQ ID NO: 885336 - DNA, 25 bp, Mus musculus
tggcccgtcccagagcactggagtt

SEQ ID NO: 885337 - DNA, 25 bp, Mus musculus
tggcccgtgaagaacagtggtaaac

SEQ ID NO: 885338 - DNA, 25 bp, Mus musculus
tggcccgtgaagtacagtggtaaac

SEQ ID NO: 885339 - DNA, 25 bp, Mus musculus
tggcccgtgacaacttgctcaagac

SEQ ID NO: 885340 - DNA, 25 bp, Mus musculus
tggcccgtgacatcttgctcaagac

SEQ ID NO: 885341 - DNA, 25 bp, Mus musculus
tggcccgtgactatgaagcgactca

SEQ ID NO: 885342 - DNA, 25 bp, Mus musculus
tggcccgtgactttgaagcgactca

SEQ ID NO: 885343 - DNA, 25 bp, Mus musculus
tggcccgtggacaggataagcagat

SEQ ID NO: 885344 - DNA, 25 bp, Mus musculus
tggcccgtggactggataagcagat

SEQ ID NO: 885345 - DNA, 25 bp, Mus musculus
tggcccgtggctattttgtcctgaa

SEQ ID NO: 885346 - DNA, 25 bp, Mus musculus
tggcccgtggcttttttgtcctgaa

SEQ ID NO: 885347 - DNA, 25 bp, Mus musculus
tggcccgtgtaactgtgctcttgtc

SEQ ID NO: 885348 - DNA, 25 bp, Mus musculus
tggcccgtgtaagtgtgctcttgtc

SEQ ID NO: 885349 - DNA, 25 bp, Mus musculus
tggcccgtgtggactaggaacacat

SEQ ID NO: 885350 - DNA, 25 bp, Mus musculus
tggcccgtgtggtctaggaacacat

SEQ ID NO: 885351 - DNA, 25 bp, Mus musculus
tggcccgtgtttagccctgagcact

SEQ ID NO: 885352 - DNA, 25 bp, Mus musculus
tggcccgtgttttgccctgagcact

SEQ ID NO: 885353 - DNA, 25 bp, Mus musculus
tggccctaaagcatgctgcataatt

SEQ ID NO: 885354 - DNA, 25 bp, Mus musculus
tggccctaaagcttgctgcataatt

SEQ ID NO: 885355 - DNA, 25 bp, Mus musculus
tggccctaagaacctcaggattaaa

SEQ ID NO: 885356 - DNA, 25 bp, Mus musculus
tggccctaagaagctcaggattaaa

SEQ ID NO: 885357 - DNA, 25 bp, Mus musculus
tggccctaattcacattgtcctttt

SEQ ID NO: 885358 - DNA, 25 bp, Mus musculus
tggccctaattcatggttatagctg

SEQ ID NO: 885359 - DNA, 25 bp, Mus musculus
tggccctaattctcattgtcctttt

SEQ ID NO: 885360 - DNA, 25 bp, Mus musculus
tggccctaattcttggttatagctg

SEQ ID NO: 885361 - DNA, 25 bp, Mus musculus
tggccctacagacactgcttttaaa

SEQ ID NO: 885362 - DNA, 25 bp, Mus musculus
tggccctacagagactgcttttaaa

SEQ ID NO: 885363 - DNA, 25 bp, Mus musculus
tggccctacccaagtaggacacgaa

SEQ ID NO: 885364 - DNA, 25 bp, Mus musculus
tggccctacccatgtaggacacgaa

SEQ ID NO: 885365 - DNA, 25 bp, Mus musculus
tggccctactacacttgcagcagta

SEQ ID NO: 885366 - DNA, 25 bp, Mus musculus
tggccctactactcttgcagcagta

SEQ ID NO: 885367 - DNA, 25 bp, Mus musculus
tggccctacttcagtgtgctcgagc

SEQ ID NO: 885368 - DNA, 25 bp, Mus musculus
tggccctacttctgtgtgctcgagc

SEQ ID NO: 885369 - DNA, 25 bp, Mus musculus
tggccctataatcccagtcttatga

SEQ ID NO: 885370 - DNA, 25 bp, Mus musculus
tggccctataatgccagtcttatga

SEQ ID NO: 885371 - DNA, 25 bp, Mus musculus
tggccctcaacaaacttcacactat

SEQ ID NO: 885372 - DNA, 25 bp, Mus musculus
tggccctcaacatacttcacactat

SEQ ID NO: 885373 - DNA, 25 bp, Mus musculus
tggccctcaactcggttaggaccat

SEQ ID NO: 885374 - DNA, 25 bp, Mus musculus
tggccctcaactgggttaggaccat

SEQ ID NO: 885375 - DNA, 25 bp, Mus musculus
tggccctcaatacagagtactcgcc

SEQ ID NO: 885376 - DNA, 25 bp, Mus musculus
tggccctcaatagagagtactcgcc

SEQ ID NO: 885377 - DNA, 25 bp, Mus musculus
tggccctcacttcctagatgcagat

SEQ ID NO: 885378 - DNA, 25 bp, Mus musculus
tggccctcacttgctagatgcagat

SEQ ID NO: 885379 - DNA, 25 bp, Mus musculus
tggccctcagagattcatgtgtttg

SEQ ID NO: 885380 - DNA, 25 bp, Mus musculus
tggccctcagagtttcatgtgtttg

SEQ ID NO: 885381 - DNA, 25 bp, Mus musculus
tggccctcagccctggaagagcaag

SEQ ID NO: 885382 - DNA, 25 bp, Mus musculus
tggccctcagccgtggaagagcaag

SEQ ID NO: 885383 - DNA, 25 bp, Mus musculus
tggccctcagctaggtagcttcaga

SEQ ID NO: 885384 - DNA, 25 bp, Mus musculus
tggccctcagcttggtagcttcaga

SEQ ID NO: 885385 - DNA, 25 bp, Mus musculus
tggccctcattgacctggaacttgg

SEQ ID NO: 885386 - DNA, 25 bp, Mus musculus
tggccctcattgtcctggaacttgg

SEQ ID NO: 885387 - DNA, 25 bp, Mus musculus
tggccctccactcatgtgccaggaa

SEQ ID NO: 885388 - DNA, 25 bp, Mus musculus
tggccctccactgatgtgccaggaa

SEQ ID NO: 885389 - DNA, 25 bp, Mus musculus
tggccctccggtacatgaagcagga

SEQ ID NO: 885390 - DNA, 25 bp, Mus musculus
tggccctccggttcatgaagcagga

SEQ ID NO: 885391 - DNA, 25 bp, Mus musculus
tggccctcctggaggccggatgctc

SEQ ID NO: 885392 - DNA, 25 bp, Mus musculus
tggccctcctggtggccggatgctc

SEQ ID NO: 885393 - DNA, 25 bp, Mus musculus
tggccctcgcgaccctttaggatgt

SEQ ID NO: 885394 - DNA, 25 bp, Mus musculus
tggccctcgcgagcctttaggatgt

SEQ ID NO: 885395 - DNA, 25 bp, Mus musculus
tggccctcttccaggtgtgagggat

SEQ ID NO: 885396 - DNA, 25 bp, Mus musculus
tggccctcttcctggtgtgagggat

SEQ ID NO: 885397 - DNA, 25 bp, Mus musculus
tggccctgaactaggactgcgctgc

SEQ ID NO: 885398 - DNA, 25 bp, Mus musculus
tggccctgaacttggactgcgctgc

SEQ ID NO: 885399 - DNA, 25 bp, Mus musculus
tggccctgaaggagtgctatcctct

SEQ ID NO: 885400 - DNA, 25 bp, Mus musculus
tggccctgaaggtgtgctatcctct

SEQ ID NO: 885401 - DNA, 25 bp, Mus musculus
tggccctgaatgacctcaaactcac

SEQ ID NO: 885402 - DNA, 25 bp, Mus musculus
tggccctgaatgtcctcaaactcac

SEQ ID NO: 885403 - DNA, 25 bp, Mus musculus
tggccctgacctaacagtctttgag

SEQ ID NO: 885404 - DNA, 25 bp, Mus musculus
tggccctgacctcagctcaaagggt

SEQ ID NO: 885405 - DNA, 25 bp, Mus musculus
tggccctgacctgagctcaaagggt

SEQ ID NO: 885406 - DNA, 25 bp, Mus musculus
tggccctgaccttacagtctttgag

SEQ ID NO: 885407 - DNA, 25 bp, Mus musculus
tggccctgaggcatacttctctacc

SEQ ID NO: 885408 - DNA, 25 bp, Mus musculus
tggccctgaggcttacttctctacc

SEQ ID NO: 885409 - DNA, 25 bp, Mus musculus
tggccctgagtcagccttcaggctg

SEQ ID NO: 885410 - DNA, 25 bp, Mus musculus
tggccctgagtctgccttcaggctg

SEQ ID NO: 885411 - DNA, 25 bp, Mus musculus
tggccctgatgccagtgaactgctt

SEQ ID NO: 885412 - DNA, 25 bp, Mus musculus
tggccctgatgcgagtgaactgctt

SEQ ID NO: 885413 - DNA, 25 bp, Mus musculus
tggccctgattgctctgtcgactgc

SEQ ID NO: 885414 - DNA, 25 bp, Mus musculus
tggccctgattggtctgtcgactgc

SEQ ID NO: 885415 - DNA, 25 bp, Mus musculus
tggccctgcacacctgtacttatgt

SEQ ID NO: 885416 - DNA, 25 bp, Mus musculus
tggccctgcacagctgtacttatgt

SEQ ID NO: 885417 - DNA, 25 bp, Mus musculus
tggccctgcattaatgccaggcata

SEQ ID NO: 885418 - DNA, 25 bp, Mus musculus
tggccctgcatttatgccaggcata

SEQ ID NO: 885419 - DNA, 25 bp, Mus musculus
tggccctgccaaatacttactagta

SEQ ID NO: 885420 - DNA, 25 bp, Mus musculus
tggccctgccaattacttactagta

SEQ ID NO: 885421 - DNA, 25 bp, Mus musculus
tggccctgccttacgaagctggaga

SEQ ID NO: 885422 - DNA, 25 bp, Mus musculus
tggccctgcctttcgaagctggaga

SEQ ID NO: 885423 - DNA, 25 bp, Mus musculus
tggccctgcttaatctcagagcctt

SEQ ID NO: 885424 - DNA, 25 bp, Mus musculus
tggccctgcttattctcagagcctt

SEQ ID NO: 885425 - DNA, 25 bp, Mus musculus
tggccctggagaccctacagtaaat

SEQ ID NO: 885426 - DNA, 25 bp, Mus musculus
tggccctggagagcctacagtaaat

SEQ ID NO: 885427 - DNA, 25 bp, Mus musculus
tggccctggccaagtgtgtcgtgcc

SEQ ID NO: 885428 - DNA, 25 bp, Mus musculus
tggccctggccactactccagagag

SEQ ID NO: 885429 - DNA, 25 bp, Mus musculus
tggccctggccagtactccagagag

SEQ ID NO: 885430 - DNA, 25 bp, Mus musculus
tggccctggccatgtgtgtcgtgcc

SEQ ID NO: 885431 - DNA, 25 bp, Mus musculus
tggccctggccgcatctacgctgtt

SEQ ID NO: 885432 - DNA, 25 bp, Mus musculus
tggccctggccggatctacgctgtt

SEQ ID NO: 885433 - DNA, 25 bp, Mus musculus
tggccctggcctcagagagacctgc

SEQ ID NO: 885434 - DNA, 25 bp, Mus musculus
tggccctggcctgagagagacctgc

SEQ ID NO: 885435 - DNA, 25 bp, Mus musculus
tggccctgggtcatgttctgagagc

SEQ ID NO: 885436 - DNA, 25 bp, Mus musculus
tggccctgggtcttgttctgagagc

SEQ ID NO: 885437 - DNA, 25 bp, Mus musculus
tggccctgggtgagacatgaagctt

SEQ ID NO: 885438 - DNA, 25 bp, Mus musculus
tggccctgggtgtgacatgaagctt

SEQ ID NO: 885439 - DNA, 25 bp, Mus musculus
tggccctgtaggcattacccgccag

SEQ ID NO: 885440 - DNA, 25 bp, Mus musculus
tggccctgtagggattacccgccag

SEQ ID NO: 885441 - DNA, 25 bp, Mus musculus
tggccctgtcccagtagcttgatga

SEQ ID NO: 885442 - DNA, 25 bp, Mus musculus
tggccctgtccctgtagcttgatga

SEQ ID NO: 885443 - DNA, 25 bp, Mus musculus
tggccctgtggcaaagtcctgttac

SEQ ID NO: 885444 - DNA, 25 bp, Mus musculus
tggccctgtggctaagtcctgttac

SEQ ID NO: 885445 - DNA, 25 bp, Mus musculus
tggccctgtttgcagatccagtggt

SEQ ID NO: 885446 - DNA, 25 bp, Mus musculus
tggccctgtttggagatccagtggt

SEQ ID NO: 885447 - DNA, 25 bp, Mus musculus
tggcccttactaccttcttgaagag

SEQ ID NO: 885448 - DNA, 25 bp, Mus musculus
tggcccttactagcttcttgaagag

SEQ ID NO: 885449 - DNA, 25 bp, Mus musculus
tggcccttagacacagctttctgcc

SEQ ID NO: 885450 - DNA, 25 bp, Mus musculus
tggcccttagactcagctttctgcc

SEQ ID NO: 885451 - DNA, 25 bp, Mus musculus
tggcccttcacaactacagttgttg

SEQ ID NO: 885452 - DNA, 25 bp, Mus musculus
tggcccttcacatctacagttgttg

SEQ ID NO: 885453 - DNA, 25 bp, Mus musculus
tggcccttccctcggggataggtgt

SEQ ID NO: 885454 - DNA, 25 bp, Mus musculus
tggcccttccctgggggataggtgt

SEQ ID NO: 885455 - DNA, 25 bp, Mus musculus
tggcccttccttatatgtttctgat

SEQ ID NO: 885456 - DNA, 25 bp, Mus musculus
tggcccttccttttatgtttctgat

SEQ ID NO: 885457 - DNA, 25 bp, Mus musculus
tggcccttcgagactctatggaaga

SEQ ID NO: 885458 - DNA, 25 bp, Mus musculus
tggcccttcgagtctctatggaaga

SEQ ID NO: 885459 - DNA, 25 bp, Mus musculus
tggcccttctcgctgaacatgcaag

SEQ ID NO: 885460 - DNA, 25 bp, Mus musculus
tggcccttctcggtgaacatgcaag

SEQ ID NO: 885461 - DNA, 25 bp, Mus musculus
tggcccttgagactggactgctgca

SEQ ID NO: 885462 - DNA, 25 bp, Mus musculus
tggcccttgagagtggactgctgca

SEQ ID NO: 885463 - DNA, 25 bp, Mus musculus
tggcccttgcctatgaatgtggaaa

SEQ ID NO: 885464 - DNA, 25 bp, Mus musculus
tggcccttgcctttgaatgtggaaa

SEQ ID NO: 885465 - DNA, 25 bp, Mus musculus
tggcccttggccatgtgtgaccgtg

SEQ ID NO: 885466 - DNA, 25 bp, Mus musculus
tggcccttggccttgtgtgaccgtg

SEQ ID NO: 885467 - DNA, 25 bp, Mus musculus
tggcccttgtcacttcagaggaagc

SEQ ID NO: 885468 - DNA, 25 bp, Mus musculus
tggcccttgtcagttcagaggaagc

SEQ ID NO: 885469 - DNA, 25 bp, Mus musculus
tggcccttgtccaagtattattcag

SEQ ID NO: 885470 - DNA, 25 bp, Mus musculus
tggcccttgtcctagtattattcag

SEQ ID NO: 885471 - DNA, 25 bp, Mus musculus
tggcccttgtgtatgcatcttctta

SEQ ID NO: 885472 - DNA, 25 bp, Mus musculus
tggcccttgtgtttgcatcttctta

SEQ ID NO: 885473 - DNA, 25 bp, Mus musculus
tggccctttcccagcatggcaaggt

SEQ ID NO: 885474 - DNA, 25 bp, Mus musculus
tggccctttccctgcatggcaaggt

SEQ ID NO: 885475 - DNA, 25 bp, Mus musculus
tggccctttcttcaacacagatgag

SEQ ID NO: 885476 - DNA, 25 bp, Mus musculus
tggccctttcttgaacacagatgag

SEQ ID NO: 885477 - DNA, 25 bp, Mus musculus
tggccctttgttcctggacacacag

SEQ ID NO: 885478 - DNA, 25 bp, Mus musculus
tggccctttgttgctggacacacag

SEQ ID NO: 885479 - DNA, 25 bp, Mus musculus
tggcccttttctctagtccttggga

SEQ ID NO: 885480 - DNA, 25 bp, Mus musculus
tggcccttttctgtagtccttggga

SEQ ID NO: 885481 - DNA, 25 bp, Mus musculus
tggccgaactctatggcggccccga

SEQ ID NO: 885482 - DNA, 25 bp, Mus musculus
tggccgaactctttggcggccccga

SEQ ID NO: 885483 - DNA, 25 bp, Mus musculus
tggccgaagggcatggtcctctagc

SEQ ID NO: 885484 - DNA, 25 bp, Mus musculus
tggccgaagggcttggtcctctagc

SEQ ID NO: 885485 - DNA, 25 bp, Mus musculus
tggccgaatggccttatggacctgc

SEQ ID NO: 885486 - DNA, 25 bp, Mus musculus
tggccgaatggcgttatggacctgc

SEQ ID NO: 885487 - DNA, 25 bp, Mus musculus
tggccgacagataggctcctaccct

SEQ ID NO: 885488 - DNA, 25 bp, Mus musculus
tggccgacagattggctcctaccct

SEQ ID NO: 885489 - DNA, 25 bp, Mus musculus
tggccgacaggtctcccatgagaaa

SEQ ID NO: 885490 - DNA, 25 bp, Mus musculus
tggccgacaggtgtcccatgagaaa

SEQ ID NO: 885491 - DNA, 25 bp, Mus musculus
tggccgaccaggacaccggtactaa

SEQ ID NO: 885492 - DNA, 25 bp, Mus musculus
tggccgaccaggtcaccggtactaa

SEQ ID NO: 885493 - DNA, 25 bp, Mus musculus
tggccgacggagagatcctggacaa

SEQ ID NO: 885494 - DNA, 25 bp, Mus musculus
tggccgacggagtgatcctggacaa

SEQ ID NO: 885495 - DNA, 25 bp, Mus musculus
tggccgactaaacaatgctgagaaa

SEQ ID NO: 885496 - DNA, 25 bp, Mus musculus
tggccgactaaagaatgctgagaaa

SEQ ID NO: 885497 - DNA, 25 bp, Mus musculus
tggccgacttaaaggttttgtgaat

SEQ ID NO: 885498 - DNA, 25 bp, Mus musculus
tggccgacttaatggttttgtgaat

SEQ ID NO: 885499 - DNA, 25 bp, Mus musculus
tggccgacttggacactctgcgtag

SEQ ID NO: 885500 - DNA, 25 bp, Mus musculus
tggccgacttggtcactctgcgtag

SEQ ID NO: 885501 - DNA, 25 bp, Mus musculus
tggccgacttttcgcgcatggtgtg

SEQ ID NO: 885502 - DNA, 25 bp, Mus musculus
tggccgacttttggcgcatggtgtg

SEQ ID NO: 885503 - DNA, 25 bp, Mus musculus
tggccgagaacgaggccgccactcg

SEQ ID NO: 885504 - DNA, 25 bp, Mus musculus
tggccgagaacgtggccgccactcg

SEQ ID NO: 885505 - DNA, 25 bp, Mus musculus
tggccgagagcgagaacattccctt

SEQ ID NO: 885506 - DNA, 25 bp, Mus musculus
tggccgagagcgtgaacattccctt

SEQ ID NO: 885507 - DNA, 25 bp, Mus musculus
tggccgagatttcaccttctggcaa

SEQ ID NO: 885508 - DNA, 25 bp, Mus musculus
tggccgagatttgaccttctggcaa

SEQ ID NO: 885509 - DNA, 25 bp, Mus musculus
tggccgaggtttctagtgcttcata

SEQ ID NO: 885510 - DNA, 25 bp, Mus musculus
tggccgaggtttgtagtgcttcata

SEQ ID NO: 885511 - DNA, 25 bp, Mus musculus
tggccgagtactccgtgaagaccaa

SEQ ID NO: 885512 - DNA, 25 bp, Mus musculus
tggccgagtactgcgtgaagaccaa

SEQ ID NO: 885513 - DNA, 25 bp, Mus musculus
tggccgagttcaactctgctatgaa

SEQ ID NO: 885514 - DNA, 25 bp, Mus musculus
tggccgagttcatctctgctatgaa

SEQ ID NO: 885515 - DNA, 25 bp, Mus musculus
tggccgagttgcatattttcatgaa

SEQ ID NO: 885516 - DNA, 25 bp, Mus musculus
tggccgagttgcttattttcatgaa

SEQ ID NO: 885517 - DNA, 25 bp, Mus musculus
tggccgatatgcatacacagactgg

SEQ ID NO: 885518 - DNA, 25 bp, Mus musculus
tggccgatatgcttacacagactgg

SEQ ID NO: 885519 - DNA, 25 bp, Mus musculus
tggccgatccgcagatggatgtgaa

SEQ ID NO: 885520 - DNA, 25 bp, Mus musculus
tggccgatccgctgatggatgtgaa

SEQ ID NO: 885521 - DNA, 25 bp, Mus musculus
tggccgatcttcagcttgtcagtgg

SEQ ID NO: 885522 - DNA, 25 bp, Mus musculus
tggccgatcttctgcttgtcagtgg

SEQ ID NO: 885523 - DNA, 25 bp, Mus musculus
tggccgatgcacactgttatgcaca

SEQ ID NO: 885524 - DNA, 25 bp, Mus musculus
tggccgatgcactctgttatgcaca

SEQ ID NO: 885525 - DNA, 25 bp, Mus musculus
tggccgcaaccaaacccttgtaggg

SEQ ID NO: 885526 - DNA, 25 bp, Mus musculus
tggccgcaaccatacccttgtaggg

SEQ ID NO: 885527 - DNA, 25 bp, Mus musculus
tggccgcaccttatggaggattcaa

SEQ ID NO: 885528 - DNA, 25 bp, Mus musculus
tggccgcaccttttggaggattcaa

SEQ ID NO: 885529 - DNA, 25 bp, Mus musculus
tggccgcatccaacttacagaacag

SEQ ID NO: 885530 - DNA, 25 bp, Mus musculus
tggccgcatccatcttacagaacag

SEQ ID NO: 885531 - DNA, 25 bp, Mus musculus
tggccgccaccaactggaggagatc

SEQ ID NO: 885532 - DNA, 25 bp, Mus musculus
tggccgccaccatctggaggagatc

SEQ ID NO: 885533 - DNA, 25 bp, Mus musculus
tggccgccattaaacaggtcctgat

SEQ ID NO: 885534 - DNA, 25 bp, Mus musculus
tggccgccattatacaggtcctgat

SEQ ID NO: 885535 - DNA, 25 bp, Mus musculus
tggccgccgacgaggagcctgctac

SEQ ID NO: 885536 - DNA, 25 bp, Mus musculus
tggccgccgacgtggagcctgctac

SEQ ID NO: 885537 - DNA, 25 bp, Mus musculus
tggccgcctacaagtcaagtgcaag

SEQ ID NO: 885538 - DNA, 25 bp, Mus musculus
tggccgcctacatgtcaagtgcaag

SEQ ID NO: 885539 - DNA, 25 bp, Mus musculus
tggccgctcactcggcttgtgtagc

SEQ ID NO: 885540 - DNA, 25 bp, Mus musculus
tggccgctcactgggcttgtgtagc

SEQ ID NO: 885541 - DNA, 25 bp, Mus musculus
tggccggaagagacagcacactgtt

SEQ ID NO: 885542 - DNA, 25 bp, Mus musculus
tggccggaagagtcagcacactgtt

SEQ ID NO: 885543 - DNA, 25 bp, Mus musculus
tggccggcagctacaaggccacaga

SEQ ID NO: 885544 - DNA, 25 bp, Mus musculus
tggccggcagcttcaaggccacaga

SEQ ID NO: 885545 - DNA, 25 bp, Mus musculus
tggccggcattgaggctgtcacagc

SEQ ID NO: 885546 - DNA, 25 bp, Mus musculus
tggccggcattgtggctgtcacagc

SEQ ID NO: 885547 - DNA, 25 bp, Mus musculus
tggccggccttacagaggccatctg

SEQ ID NO: 885548 - DNA, 25 bp, Mus musculus
tggccggccttagagaggccatctg

SEQ ID NO: 885549 - DNA, 25 bp, Mus musculus
tggccgggcaccatctaaccaaatt

SEQ ID NO: 885550 - DNA, 25 bp, Mus musculus
tggccgggcaccttctaaccaaatt

SEQ ID NO: 885551 - DNA, 25 bp, Mus musculus
tggccgggtgttagacatgcttaac

SEQ ID NO: 885552 - DNA, 25 bp, Mus musculus
tggccgggtgtttgacatgcttaac

SEQ ID NO: 885553 - DNA, 25 bp, Mus musculus
tggccggtagcaattccacaggcgg

SEQ ID NO: 885554 - DNA, 25 bp, Mus musculus
tggccggtagcatttccacaggcgg

SEQ ID NO: 885555 - DNA, 25 bp, Mus musculus
tggccggtggatcagcagttctact

SEQ ID NO: 885556 - DNA, 25 bp, Mus musculus
tggccggtggatgagcagttctact

SEQ ID NO: 885557 - DNA, 25 bp, Mus musculus
tggccggttccaaaatcagttccta

SEQ ID NO: 885558 - DNA, 25 bp, Mus musculus
tggccggttccataatcagttccta

SEQ ID NO: 885559 - DNA, 25 bp, Mus musculus
tggccgtaagcactttcgtaacact

SEQ ID NO: 885560 - DNA, 25 bp, Mus musculus
tggccgtaagcagtttcgtaacact

SEQ ID NO: 885561 - DNA, 25 bp, Mus musculus
tggccgtatgtcagctgccagcaca

SEQ ID NO: 885562 - DNA, 25 bp, Mus musculus
tggccgtatgtctgctgccagcaca

SEQ ID NO: 885563 - DNA, 25 bp, Mus musculus
tggccgtcagacagttgctacatac

SEQ ID NO: 885564 - DNA, 25 bp, Mus musculus
tggccgtcagactgttgctacatac

SEQ ID NO: 885565 - DNA, 25 bp, Mus musculus
tggccgtcatggcaactgcacacat

SEQ ID NO: 885566 - DNA, 25 bp, Mus musculus
tggccgtcatgggaactgcacacat

SEQ ID NO: 885567 - DNA, 25 bp, Mus musculus
tggccgtcattcaaagggcagatat

SEQ ID NO: 885568 - DNA, 25 bp, Mus musculus
tggccgtcattctaagggcagatat

SEQ ID NO: 885569 - DNA, 25 bp, Mus musculus
tggccgtccactctggaatcgtgac

SEQ ID NO: 885570 - DNA, 25 bp, Mus musculus
tggccgtccactgtggaatcgtgac

SEQ ID NO: 885571 - DNA, 25 bp, Mus musculus
tggccgtcgctcctaaagcgtttta

SEQ ID NO: 885572 - DNA, 25 bp, Mus musculus
tggccgtcgctcgtaaagcgtttta

SEQ ID NO: 885573 - DNA, 25 bp, Mus musculus
tggccgtgcagaagctcatggtgca

SEQ ID NO: 885574 - DNA, 25 bp, Mus musculus
tggccgtgcagatgctcatggtgca

SEQ ID NO: 885575 - DNA, 25 bp, Mus musculus
tggccgtgcatcactatttattggg

SEQ ID NO: 885576 - DNA, 25 bp, Mus musculus
tggccgtgcatctctatttattggg

SEQ ID NO: 885577 - DNA, 25 bp, Mus musculus
tggccgtgccggacctagtcaaaga

SEQ ID NO: 885578 - DNA, 25 bp, Mus musculus
tggccgtgccggtcctagtcaaaga

SEQ ID NO: 885579 - DNA, 25 bp, Mus musculus
tggccgtgctgtccgcaaactgcag

SEQ ID NO: 885580 - DNA, 25 bp, Mus musculus
tggccgtgctgtgcgcaaactgcag

SEQ ID NO: 885581 - DNA, 25 bp, Mus musculus
tggccgtgggcgacatcaagaacgt

SEQ ID NO: 885582 - DNA, 25 bp, Mus musculus
tggccgtgggcgtcatcaagaacgt

SEQ ID NO: 885583 - DNA, 25 bp, Mus musculus
tggccgtggtaaagtatgtgcagaa

SEQ ID NO: 885584 - DNA, 25 bp, Mus musculus
tggccgtggtaatgtatgtgcagaa

SEQ ID NO: 885585 - DNA, 25 bp, Mus musculus
tggccgttactgatcttacttcatc

SEQ ID NO: 885586 - DNA, 25 bp, Mus musculus
tggccgttactgttcttacttcatc

SEQ ID NO: 885587 - DNA, 25 bp, Mus musculus
tggccgttatgaagagctggctcat

SEQ ID NO: 885588 - DNA, 25 bp, Mus musculus
tggccgttatgatgagctggctcat

SEQ ID NO: 885589 - DNA, 25 bp, Mus musculus
tggccgttattgagattctcggttt

SEQ ID NO: 885590 - DNA, 25 bp, Mus musculus
tggccgttattgtgattctcggttt

SEQ ID NO: 885591 - DNA, 25 bp, Mus musculus
tggccgttccatccagtactaaatg

SEQ ID NO: 885592 - DNA, 25 bp, Mus musculus
tggccgttccatgcagtactaaatg

SEQ ID NO: 885593 - DNA, 25 bp, Mus musculus
tggccgttcctgagagccgtctttt

SEQ ID NO: 885594 - DNA, 25 bp, Mus musculus
tggccgttcctgtgagccgtctttt

SEQ ID NO: 885595 - DNA, 25 bp, Mus musculus
tggccgttgaccatcttttgacttt

SEQ ID NO: 885596 - DNA, 25 bp, Mus musculus
tggccgttgaccttcttttgacttt

SEQ ID NO: 885597 - DNA, 25 bp, Mus musculus
tggccgttgtgtatgaggttgtacc

SEQ ID NO: 885598 - DNA, 25 bp, Mus musculus
tggccgttgtgtttgaggttgtacc

SEQ ID NO: 885599 - DNA, 25 bp, Mus musculus
tggccgtttccaaaagtatttcagg

SEQ ID NO: 885600 - DNA, 25 bp, Mus musculus
tggccgtttccataagtatttcagg

SEQ ID NO: 885601 - DNA, 25 bp, Mus musculus
tggccgtttctgacaagcctggaga

SEQ ID NO: 885602 - DNA, 25 bp, Mus musculus
tggccgtttctgtcaagcctggaga

SEQ ID NO: 885603 - DNA, 25 bp, Mus musculus
tggcctaaaaccaatcctggtgtcc

SEQ ID NO: 885604 - DNA, 25 bp, Mus musculus
tggcctaaaacctatcctggtgtcc

SEQ ID NO: 885605 - DNA, 25 bp, Mus musculus
tggcctaaacaaagacagtcccgag

SEQ ID NO: 885606 - DNA, 25 bp, Mus musculus
tggcctaaacaatgacagtcccgag

SEQ ID NO: 885607 - DNA, 25 bp, Mus musculus
tggcctaaactcaatagctgtctta

SEQ ID NO: 885608 - DNA, 25 bp, Mus musculus
tggcctaaactctatagctgtctta

SEQ ID NO: 885609 - DNA, 25 bp, Mus musculus
tggcctaaagcaaccccaatttcaa

SEQ ID NO: 885610 - DNA, 25 bp, Mus musculus
tggcctaaagcatccccaatttcaa

SEQ ID NO: 885611 - DNA, 25 bp, Mus musculus
tggcctaacagaagtcctcttgctc

SEQ ID NO: 885612 - DNA, 25 bp, Mus musculus
tggcctaacagatgtcctcttgctc

SEQ ID NO: 885613 - DNA, 25 bp, Mus musculus
tggcctaacattaactgcagcgact

SEQ ID NO: 885614 - DNA, 25 bp, Mus musculus
tggcctaacatttactgcagcgact

SEQ ID NO: 885615 - DNA, 25 bp, Mus musculus
tggcctaaccccagagaaagctttc

SEQ ID NO: 885616 - DNA, 25 bp, Mus musculus
tggcctaacccctgagaaagctttc

SEQ ID NO: 885617 - DNA, 25 bp, Mus musculus
tggcctaactgcaatatcatctgat

SEQ ID NO: 885618 - DNA, 25 bp, Mus musculus
tggcctaactgctatatcatctgat

SEQ ID NO: 885619 - DNA, 25 bp, Mus musculus
tggcctaaggctcgcacgtaaacct

SEQ ID NO: 885620 - DNA, 25 bp, Mus musculus
tggcctaaggctggcacgtaaacct

SEQ ID NO: 885621 - DNA, 25 bp, Mus musculus
tggcctacaaataactgcacacagt

SEQ ID NO: 885622 - DNA, 25 bp, Mus musculus
tggcctacaaattactgcacacagt

SEQ ID NO: 885623 - DNA, 25 bp, Mus musculus
tggcctacaacccttaacctagagc

SEQ ID NO: 885624 - DNA, 25 bp, Mus musculus
tggcctacaaccgttaacctagagc

SEQ ID NO: 885625 - DNA, 25 bp, Mus musculus
tggcctacaagcactaaggtgcatg

SEQ ID NO: 885626 - DNA, 25 bp, Mus musculus
tggcctacaagctctaaggtgcatg

SEQ ID NO: 885627 - DNA, 25 bp, Mus musculus
tggcctacacgtctacacgcacaaa

SEQ ID NO: 885628 - DNA, 25 bp, Mus musculus
tggcctacacgtgtacacgcacaaa

SEQ ID NO: 885629 - DNA, 25 bp, Mus musculus
tggcctacagccacgtttgtaatgg

SEQ ID NO: 885630 - DNA, 25 bp, Mus musculus
tggcctacagcctcgtttgtaatgg

SEQ ID NO: 885631 - DNA, 25 bp, Mus musculus
tggcctacagcgcagagaacacttt

SEQ ID NO: 885632 - DNA, 25 bp, Mus musculus
tggcctacagcggagagaacacttt

SEQ ID NO: 885633 - DNA, 25 bp, Mus musculus
tggcctacagctcgatattattgag

SEQ ID NO: 885634 - DNA, 25 bp, Mus musculus
tggcctacagctggatattattgag

SEQ ID NO: 885635 - DNA, 25 bp, Mus musculus
tggcctacccagacacccaaaggtt

SEQ ID NO: 885636 - DNA, 25 bp, Mus musculus
tggcctacccagattgtatcatgtg

SEQ ID NO: 885637 - DNA, 25 bp, Mus musculus
tggcctacccagtcacccaaaggtt

SEQ ID NO: 885638 - DNA, 25 bp, Mus musculus
tggcctacccagtttgtatcatgtg

SEQ ID NO: 885639 - DNA, 25 bp, Mus musculus
tggcctacgcgcagggcaaggactt

SEQ ID NO: 885640 - DNA, 25 bp, Mus musculus
tggcctacgcgctgggcaaggactt

SEQ ID NO: 885641 - DNA, 25 bp, Mus musculus
tggcctacgggcatatctgtgccaa

SEQ ID NO: 885642 - DNA, 25 bp, Mus musculus
tggcctacgggcttatctgtgccaa

SEQ ID NO: 885643 - DNA, 25 bp, Mus musculus
tggcctactccaactgtcagcatga

SEQ ID NO: 885644 - DNA, 25 bp, Mus musculus
tggcctactccatctgtcagcatga

SEQ ID NO: 885645 - DNA, 25 bp, Mus musculus
tggcctactcgtctgaggactacgt

SEQ ID NO: 885646 - DNA, 25 bp, Mus musculus
tggcctactcgtgtgaggactacgt

SEQ ID NO: 885647 - DNA, 25 bp, Mus musculus
tggcctactgctctttaacacagtg

SEQ ID NO: 885648 - DNA, 25 bp, Mus musculus
tggcctactgctgtttaacacagtg

SEQ ID NO: 885649 - DNA, 25 bp, Mus musculus
tggcctactggcctgagcacagaaa

SEQ ID NO: 885650 - DNA, 25 bp, Mus musculus
tggcctactggcgtgagcacagaaa

SEQ ID NO: 885651 - DNA, 25 bp, Mus musculus
tggcctactgtgaagcccacgtgcg

SEQ ID NO: 885652 - DNA, 25 bp, Mus musculus
tggcctactgtgaggcacatgccaa

SEQ ID NO: 885653 - DNA, 25 bp, Mus musculus
tggcctactgtgtagcccacgtgcg

SEQ ID NO: 885654 - DNA, 25 bp, Mus musculus
tggcctactgtgtggcacatgccaa

SEQ ID NO: 885655 - DNA, 25 bp, Mus musculus
tggcctagagctctctgcccaaagc

SEQ ID NO: 885656 - DNA, 25 bp, Mus musculus
tggcctagagctgtctgcccaaagc

SEQ ID NO: 885657 - DNA, 25 bp, Mus musculus
tggcctagcctgaggttctgggaca

SEQ ID NO: 885658 - DNA, 25 bp, Mus musculus
tggcctagcctgtggttctgggaca

SEQ ID NO: 885659 - DNA, 25 bp, Mus musculus
tggcctaggctcacaaaggaggata

SEQ ID NO: 885660 - DNA, 25 bp, Mus musculus
tggcctaggctctcaaaggaggata

SEQ ID NO: 885661 - DNA, 25 bp, Mus musculus
tggcctagtaggcattggctcttcc

SEQ ID NO: 885662 - DNA, 25 bp, Mus musculus
tggcctagtagggattggctcttcc

SEQ ID NO: 885663 - DNA, 25 bp, Mus musculus
tggcctagtcggacaccgtggaaga

SEQ ID NO: 885664 - DNA, 25 bp, Mus musculus
tggcctagtcggtcaccgtggaaga

SEQ ID NO: 885665 - DNA, 25 bp, Mus musculus
tggcctatcatccacaagtgtgctc

SEQ ID NO: 885666 - DNA, 25 bp, Mus musculus
tggcctatcatcgacaagtgtgctc

SEQ ID NO: 885667 - DNA, 25 bp, Mus musculus
tggcctatccgtaagttcagcatga

SEQ ID NO: 885668 - DNA, 25 bp, Mus musculus
tggcctatccgtcgcactgcgggaa

SEQ ID NO: 885669 - DNA, 25 bp, Mus musculus
tggcctatccgtggcactgcgggaa

SEQ ID NO: 885670 - DNA, 25 bp, Mus musculus
tggcctatccgttagttcagcatga

SEQ ID NO: 885671 - DNA, 25 bp, Mus musculus
tggcctatcttcatgctcagttact

SEQ ID NO: 885672 - DNA, 25 bp, Mus musculus
tggcctatcttcttgctcagttact

SEQ ID NO: 885673 - DNA, 25 bp, Mus musculus
tggcctatgcagcagggagcctcac

SEQ ID NO: 885674 - DNA, 25 bp, Mus musculus
tggcctatgcaggagggagcctcac

SEQ ID NO: 885675 - DNA, 25 bp, Mus musculus
tggcctatgctaccctttcccaagg

SEQ ID NO: 885676 - DNA, 25 bp, Mus musculus
tggcctatgctagcctttcccaagg

SEQ ID NO: 885677 - DNA, 25 bp, Mus musculus
tggcctatggaaccacttttaacca

SEQ ID NO: 885678 - DNA, 25 bp, Mus musculus
tggcctatggaagcacttttaacca

SEQ ID NO: 885679 - DNA, 25 bp, Mus musculus
tggcctatggctccttagtcctcaa

SEQ ID NO: 885680 - DNA, 25 bp, Mus musculus
tggcctatggctgcttagtcctcaa

SEQ ID NO: 885681 - DNA, 25 bp, Mus musculus
tggcctatggttaccagcctgatat

SEQ ID NO: 885682 - DNA, 25 bp, Mus musculus
tggcctatggtttccagcctgatat

SEQ ID NO: 885683 - DNA, 25 bp, Mus musculus
tggcctatgtgacattgaccccaac

SEQ ID NO: 885684 - DNA, 25 bp, Mus musculus
tggcctatgtgagattgaccccaac

SEQ ID NO: 885685 - DNA, 25 bp, Mus musculus
tggcctatgttactctgtgtggatc

SEQ ID NO: 885686 - DNA, 25 bp, Mus musculus
tggcctatgttagtctgtgtggatc

SEQ ID NO: 885687 - DNA, 25 bp, Mus musculus
tggcctcaaacaactcagaatcctc

SEQ ID NO: 885688 - DNA, 25 bp, Mus musculus
tggcctcaaacatctcagaatcctc

SEQ ID NO: 885689 - DNA, 25 bp, Mus musculus
tggcctcaaactatctgtacagctg

SEQ ID NO: 885690 - DNA, 25 bp, Mus musculus
tggcctcaaactttctgtacagctg

SEQ ID NO: 885691 - DNA, 25 bp, Mus musculus
tggcctcaaattcatcatgaagtca

SEQ ID NO: 885692 - DNA, 25 bp, Mus musculus
tggcctcaaattgatcatgaagtca

SEQ ID NO: 885693 - DNA, 25 bp, Mus musculus
tggcctcaaccacggctctttaatt

SEQ ID NO: 885694 - DNA, 25 bp, Mus musculus
tggcctcaaccagggctctttaatt

SEQ ID NO: 885695 - DNA, 25 bp, Mus musculus
tggcctcaactgactggttttcttt

SEQ ID NO: 885696 - DNA, 25 bp, Mus musculus
tggcctcaactgtctggttttcttt

SEQ ID NO: 885697 - DNA, 25 bp, Mus musculus
tggcctcaagctccctgaaactgat

SEQ ID NO: 885698 - DNA, 25 bp, Mus musculus
tggcctcaagctctatatgtacctg

SEQ ID NO: 885699 - DNA, 25 bp, Mus musculus
tggcctcaagctgcctgaaactgat

SEQ ID NO: 885700 - DNA, 25 bp, Mus musculus
tggcctcaagctgtatatgtacctg

SEQ ID NO: 885701 - DNA, 25 bp, Mus musculus
tggcctcaaggacacgatctgcagt

SEQ ID NO: 885702 - DNA, 25 bp, Mus musculus
tggcctcaaggagacgatctgcagt

SEQ ID NO: 885703 - DNA, 25 bp, Mus musculus
tggcctcaatgtaaagcttttctgg

SEQ ID NO: 885704 - DNA, 25 bp, Mus musculus
tggcctcaatgttaagcttttctgg

SEQ ID NO: 885705 - DNA, 25 bp, Mus musculus
tggcctcacacaacgctgtgtcttc

SEQ ID NO: 885706 - DNA, 25 bp, Mus musculus
tggcctcacacatcgctgtgtcttc

SEQ ID NO: 885707 - DNA, 25 bp, Mus musculus
tggcctcaccagactgtacagctaa

SEQ ID NO: 885708 - DNA, 25 bp, Mus musculus
tggcctcaccagtctgtacagctaa

SEQ ID NO: 885709 - DNA, 25 bp, Mus musculus
tggcctcacctcctaagatattagt

SEQ ID NO: 885710 - DNA, 25 bp, Mus musculus
tggcctcacctcgtaagatattagt

SEQ ID NO: 885711 - DNA, 25 bp, Mus musculus
tggcctcaccttcctgagtgggcat

SEQ ID NO: 885712 - DNA, 25 bp, Mus musculus
tggcctcaccttgctgagtgggcat

SEQ ID NO: 885713 - DNA, 25 bp, Mus musculus
tggcctcacggtaagggaaactcct

SEQ ID NO: 885714 - DNA, 25 bp, Mus musculus
tggcctcacggttagggaaactcct

SEQ ID NO: 885715 - DNA, 25 bp, Mus musculus
tggcctcactctaaacctgaaaacc

SEQ ID NO: 885716 - DNA, 25 bp, Mus musculus
tggcctcactcttaacctgaaaacc

SEQ ID NO: 885717 - DNA, 25 bp, Mus musculus
tggcctcactgcattcaaggacaca

SEQ ID NO: 885718 - DNA, 25 bp, Mus musculus
tggcctcactgctttcaaggacaca

SEQ ID NO: 885719 - DNA, 25 bp, Mus musculus
tggcctcactgtcaagactgtgtca

SEQ ID NO: 885720 - DNA, 25 bp, Mus musculus
tggcctcactgtgaagactgtgtca

SEQ ID NO: 885721 - DNA, 25 bp, Mus musculus
tggcctcacttccaaattcatgctg

SEQ ID NO: 885722 - DNA, 25 bp, Mus musculus
tggcctcacttcgaaattcatgctg

SEQ ID NO: 885723 - DNA, 25 bp, Mus musculus
tggcctcagactcaaaatctcccaa

SEQ ID NO: 885724 - DNA, 25 bp, Mus musculus
tggcctcagactgaaaatctcccaa

SEQ ID NO: 885725 - DNA, 25 bp, Mus musculus
tggcctcagagtaagaagcatggtt

SEQ ID NO: 885726 - DNA, 25 bp, Mus musculus
tggcctcagagttagaagcatggtt

SEQ ID NO: 885727 - DNA, 25 bp, Mus musculus
tggcctcagattcacccaggaggga

SEQ ID NO: 885728 - DNA, 25 bp, Mus musculus
tggcctcagattgacccaggaggga

SEQ ID NO: 885729 - DNA, 25 bp, Mus musculus
tggcctcagctcaggctttgagatg

SEQ ID NO: 885730 - DNA, 25 bp, Mus musculus
tggcctcagctctggctttgagatg

SEQ ID NO: 885731 - DNA, 25 bp, Mus musculus
tggcctcaggcccagtttctaatga

SEQ ID NO: 885732 - DNA, 25 bp, Mus musculus
tggcctcaggccgagtttctaatga

SEQ ID NO: 885733 - DNA, 25 bp, Mus musculus
tggcctcaggttctgctgctcttca

SEQ ID NO: 885734 - DNA, 25 bp, Mus musculus
tggcctcaggttgtgctgctcttca

SEQ ID NO: 885735 - DNA, 25 bp, Mus musculus
tggcctcagtgcacttgggaaagct

SEQ ID NO: 885736 - DNA, 25 bp, Mus musculus
tggcctcagtgctcttgggaaagct

SEQ ID NO: 885737 - DNA, 25 bp, Mus musculus
tggcctcagtggcattggatgtatc

SEQ ID NO: 885738 - DNA, 25 bp, Mus musculus
tggcctcagtgggattggatgtatc

SEQ ID NO: 885739 - DNA, 25 bp, Mus musculus
tggcctcataaaccctgcagaagac

SEQ ID NO: 885740 - DNA, 25 bp, Mus musculus
tggcctcataaagcctgcagaagac

SEQ ID NO: 885741 - DNA, 25 bp, Mus musculus
tggcctcatacgatcattttcattg

SEQ ID NO: 885742 - DNA, 25 bp, Mus musculus
tggcctcatacgttcattttcattg

SEQ ID NO: 885743 - DNA, 25 bp, Mus musculus
tggcctcatatcatctgttgttgga

SEQ ID NO: 885744 - DNA, 25 bp, Mus musculus
tggcctcatatcttctgttgttgga

SEQ ID NO: 885745 - DNA, 25 bp, Mus musculus
tggcctcatcacagttgtgactatt

SEQ ID NO: 885746 - DNA, 25 bp, Mus musculus
tggcctcatcactgttgtgactatt

SEQ ID NO: 885747 - DNA, 25 bp, Mus musculus
tggcctcatcagactgccagggaga

SEQ ID NO: 885748 - DNA, 25 bp, Mus musculus
tggcctcatcagtctgccagggaga

SEQ ID NO: 885749 - DNA, 25 bp, Mus musculus
tggcctcatgttcgcgtgatggatt

SEQ ID NO: 885750 - DNA, 25 bp, Mus musculus
tggcctcatgttggcgtgatggatt

SEQ ID NO: 885751 - DNA, 25 bp, Mus musculus
tggcctcattgccatccaatggaag

SEQ ID NO: 885752 - DNA, 25 bp, Mus musculus
tggcctcattgcgatccaatggaag

SEQ ID NO: 885753 - DNA, 25 bp, Mus musculus
tggcctcatttaacttgtctctaat

SEQ ID NO: 885754 - DNA, 25 bp, Mus musculus
tggcctcatttatcttgtctctaat

SEQ ID NO: 885755 - DNA, 25 bp, Mus musculus
tggcctcatttcaattactacaagg

SEQ ID NO: 885756 - DNA, 25 bp, Mus musculus
tggcctcatttctattactacaagg

SEQ ID NO: 885757 - DNA, 25 bp, Mus musculus
tggcctccacacaaagatgctctta

SEQ ID NO: 885758 - DNA, 25 bp, Mus musculus
tggcctccacacaatacaggtacac

SEQ ID NO: 885759 - DNA, 25 bp, Mus musculus
tggcctccacactaagatgctctta

SEQ ID NO: 885760 - DNA, 25 bp, Mus musculus
tggcctccacactatacaggtacac

SEQ ID NO: 885761 - DNA, 25 bp, Mus musculus
tggcctccacatacaaggtaaccgc

SEQ ID NO: 885762 - DNA, 25 bp, Mus musculus
tggcctccacattcaaggtaaccgc

SEQ ID NO: 885763 - DNA, 25 bp, Mus musculus
tggcctccagaaactcagtggcaaa

SEQ ID NO: 885764 - DNA, 25 bp, Mus musculus
tggcctccagaatctcagtggcaaa

SEQ ID NO: 885765 - DNA, 25 bp, Mus musculus
tggcctccagatcgcttttaatttt

SEQ ID NO: 885766 - DNA, 25 bp, Mus musculus
tggcctccagatggcttttaatttt

SEQ ID NO: 885767 - DNA, 25 bp, Mus musculus
tggcctccagctacaagagacgtag

SEQ ID NO: 885768 - DNA, 25 bp, Mus musculus
tggcctccagcttcaagagacgtag

SEQ ID NO: 885769 - DNA, 25 bp, Mus musculus
tggcctccagtcaaacatcaagata

SEQ ID NO: 885770 - DNA, 25 bp, Mus musculus
tggcctccagtcagatcaggtttgg

SEQ ID NO: 885771 - DNA, 25 bp, Mus musculus
tggcctccagtctaacatcaagata

SEQ ID NO: 885772 - DNA, 25 bp, Mus musculus
tggcctccagtctgatcaggtttgg

SEQ ID NO: 885773 - DNA, 25 bp, Mus musculus
tggcctccatctacagaaacttgga

SEQ ID NO: 885774 - DNA, 25 bp, Mus musculus
tggcctccatcttcagaaacttgga

SEQ ID NO: 885775 - DNA, 25 bp, Mus musculus
tggcctccatggagtaccaggtaca

SEQ ID NO: 885776 - DNA, 25 bp, Mus musculus
tggcctccatggcatctgtacacat

SEQ ID NO: 885777 - DNA, 25 bp, Mus musculus
tggcctccatgggatctgtacacat

SEQ ID NO: 885778 - DNA, 25 bp, Mus musculus
tggcctccatggtgtaccaggtaca

SEQ ID NO: 885779 - DNA, 25 bp, Mus musculus
tggcctccatgtatccttcagacag

SEQ ID NO: 885780 - DNA, 25 bp, Mus musculus
tggcctccatgtctgaagccaacaa

SEQ ID NO: 885781 - DNA, 25 bp, Mus musculus
tggcctccatgtgtgaagccaacaa

SEQ ID NO: 885782 - DNA, 25 bp, Mus musculus
tggcctccatgtttccttcagacag

SEQ ID NO: 885783 - DNA, 25 bp, Mus musculus
tggcctcccaggatgttatacagat

SEQ ID NO: 885784 - DNA, 25 bp, Mus musculus
tggcctcccaggttgttatacagat

SEQ ID NO: 885785 - DNA, 25 bp, Mus musculus
tggcctccccacaggatacaataat

SEQ ID NO: 885786 - DNA, 25 bp, Mus musculus
tggcctccccactggatacaataat

SEQ ID NO: 885787 - DNA, 25 bp, Mus musculus
tggcctccctttcttaggagtagtt

SEQ ID NO: 885788 - DNA, 25 bp, Mus musculus
tggcctccctttgttaggagtagtt

SEQ ID NO: 885789 - DNA, 25 bp, Mus musculus
tggcctccgactatttgttttcctg

SEQ ID NO: 885790 - DNA, 25 bp, Mus musculus
tggcctccgactttttgttttcctg

SEQ ID NO: 885791 - DNA, 25 bp, Mus musculus
tggcctccgggacgctttattagat

SEQ ID NO: 885792 - DNA, 25 bp, Mus musculus
tggcctccgggaggctttattagat

SEQ ID NO: 885793 - DNA, 25 bp, Mus musculus
tggcctccgttaatcagcacgagct

SEQ ID NO: 885794 - DNA, 25 bp, Mus musculus
tggcctccgttattcagcacgagct

SEQ ID NO: 885795 - DNA, 25 bp, Mus musculus
tggcctcctggcaccaaagtgagga

SEQ ID NO: 885796 - DNA, 25 bp, Mus musculus
tggcctcctggctccaaagtgagga

SEQ ID NO: 885797 - DNA, 25 bp, Mus musculus
tggcctcctgtgacttagacttgaa

SEQ ID NO: 885798 - DNA, 25 bp, Mus musculus
tggcctcctgtgtcttagacttgaa

SEQ ID NO: 885799 - DNA, 25 bp, Mus musculus
tggcctcgagaaacagtggtcacgt

SEQ ID NO: 885800 - DNA, 25 bp, Mus musculus
tggcctcgagaatcagtggtcacgt

SEQ ID NO: 885801 - DNA, 25 bp, Mus musculus
tggcctcgagccacagctttatgga

SEQ ID NO: 885802 - DNA, 25 bp, Mus musculus
tggcctcgagcctcagctttatgga

SEQ ID NO: 885803 - DNA, 25 bp, Mus musculus
tggcctcgaggcattagattgatgt

SEQ ID NO: 885804 - DNA, 25 bp, Mus musculus
tggcctcgaggctttagattgatgt

SEQ ID NO: 885805 - DNA, 25 bp, Mus musculus
tggcctcgatctcaatatggaacta

SEQ ID NO: 885806 - DNA, 25 bp, Mus musculus
tggcctcgatctgaatatggaacta

SEQ ID NO: 885807 - DNA, 25 bp, Mus musculus
tggcctcgattcaaggttgctcatt

SEQ ID NO: 885808 - DNA, 25 bp, Mus musculus
tggcctcgattctaggttgctcatt

SEQ ID NO: 885809 - DNA, 25 bp, Mus musculus
tggcctcggaggctcttcatgcagc

SEQ ID NO: 885810 - DNA, 25 bp, Mus musculus
tggcctcggagggtcttcatgcagc

SEQ ID NO: 885811 - DNA, 25 bp, Mus musculus
tggcctcggatgcaaacctgccagt

SEQ ID NO: 885812 - DNA, 25 bp, Mus musculus
tggcctcggatggaaacctgccagt

SEQ ID NO: 885813 - DNA, 25 bp, Mus musculus
tggcctcggcagagtgtcccagtga

SEQ ID NO: 885814 - DNA, 25 bp, Mus musculus
tggcctcggcagtgtgtcccagtga

SEQ ID NO: 885815 - DNA, 25 bp, Mus musculus
tggcctcggcctctggttattgcat

SEQ ID NO: 885816 - DNA, 25 bp, Mus musculus
tggcctcggcctgtggttattgcat

SEQ ID NO: 885817 - DNA, 25 bp, Mus musculus
tggcctctaagcaaacagcagggca

SEQ ID NO: 885818 - DNA, 25 bp, Mus musculus
tggcctctaagctaacagcagggca

SEQ ID NO: 885819 - DNA, 25 bp, Mus musculus
tggcctctaaggacaaaactcccaa

SEQ ID NO: 885820 - DNA, 25 bp, Mus musculus
tggcctctaaggacatgtgtacatg

SEQ ID NO: 885821 - DNA, 25 bp, Mus musculus
tggcctctaaggtcaaaactcccaa

SEQ ID NO: 885822 - DNA, 25 bp, Mus musculus
tggcctctaaggtcatgtgtacatg

SEQ ID NO: 885823 - DNA, 25 bp, Mus musculus
tggcctctactcatagcaaattctt

SEQ ID NO: 885824 - DNA, 25 bp, Mus musculus
tggcctctactcttagcaaattctt

SEQ ID NO: 885825 - DNA, 25 bp, Mus musculus
tggcctctcaaaattggaacttagg

SEQ ID NO: 885826 - DNA, 25 bp, Mus musculus
tggcctctcaaatttggaacttagg

SEQ ID NO: 885827 - DNA, 25 bp, Mus musculus
tggcctctcaggagtctgacagcgc

SEQ ID NO: 885828 - DNA, 25 bp, Mus musculus
tggcctctcaggcattttgaagaca

SEQ ID NO: 885829 - DNA, 25 bp, Mus musculus
tggcctctcagggattttgaagaca

SEQ ID NO: 885830 - DNA, 25 bp, Mus musculus
tggcctctcaggtgtctgacagcgc

SEQ ID NO: 885831 - DNA, 25 bp, Mus musculus
tggcctctccatcaaagtcaagctg

SEQ ID NO: 885832 - DNA, 25 bp, Mus musculus
tggcctctccatcctaagggtagat

SEQ ID NO: 885833 - DNA, 25 bp, Mus musculus
tggcctctccatgaaagtcaagctg

SEQ ID NO: 885834 - DNA, 25 bp, Mus musculus
tggcctctccatgctaagggtagat

SEQ ID NO: 885835 - DNA, 25 bp, Mus musculus
tggcctctccctagtggtcactgaa

SEQ ID NO: 885836 - DNA, 25 bp, Mus musculus
tggcctctcccttgtggtcactgaa

SEQ ID NO: 885837 - DNA, 25 bp, Mus musculus
tggcctctccgaagatgtgggcttt

SEQ ID NO: 885838 - DNA, 25 bp, Mus musculus
tggcctctccgatgatgtgggcttt

SEQ ID NO: 885839 - DNA, 25 bp, Mus musculus
tggcctctcctccatttgttgtgat

SEQ ID NO: 885840 - DNA, 25 bp, Mus musculus
tggcctctcctcgatttgttgtgat

SEQ ID NO: 885841 - DNA, 25 bp, Mus musculus
tggcctctccttattgaggttctac

SEQ ID NO: 885842 - DNA, 25 bp, Mus musculus
tggcctctccttcgagtctgatgaa

SEQ ID NO: 885843 - DNA, 25 bp, Mus musculus
tggcctctccttggagtctgatgaa

SEQ ID NO: 885844 - DNA, 25 bp, Mus musculus
tggcctctcctttttgaggttctac

SEQ ID NO: 885845 - DNA, 25 bp, Mus musculus
tggcctctctgcagaggtggcagac

SEQ ID NO: 885846 - DNA, 25 bp, Mus musculus
tggcctctctgctgaggtggcagac

SEQ ID NO: 885847 - DNA, 25 bp, Mus musculus
tggcctctgaagacggcatgctaca

SEQ ID NO: 885848 - DNA, 25 bp, Mus musculus
tggcctctgaagtcggcatgctaca

SEQ ID NO: 885849 - DNA, 25 bp, Mus musculus
tggcctctgacaatccacacattcg

SEQ ID NO: 885850 - DNA, 25 bp, Mus musculus
tggcctctgacattccacacattcg

SEQ ID NO: 885851 - DNA, 25 bp, Mus musculus
tggcctctgagaaactgggtctgga

SEQ ID NO: 885852 - DNA, 25 bp, Mus musculus
tggcctctgagaatgccagacacac

SEQ ID NO: 885853 - DNA, 25 bp, Mus musculus
tggcctctgagatactgggtctgga

SEQ ID NO: 885854 - DNA, 25 bp, Mus musculus
tggcctctgagattgccagacacac

SEQ ID NO: 885855 - DNA, 25 bp, Mus musculus
tggcctctgagcacagttggatcaa

SEQ ID NO: 885856 - DNA, 25 bp, Mus musculus
tggcctctgagctcagttggatcaa

SEQ ID NO: 885857 - DNA, 25 bp, Mus musculus
tggcctctgattccttccaaggata

SEQ ID NO: 885858 - DNA, 25 bp, Mus musculus
tggcctctgattgcttccaaggata

SEQ ID NO: 885859 - DNA, 25 bp, Mus musculus
tggcctctgcggacacggacacaca

SEQ ID NO: 885860 - DNA, 25 bp, Mus musculus
tggcctctgcggactacattgtctt

SEQ ID NO: 885861 - DNA, 25 bp, Mus musculus
tggcctctgcggtcacggacacaca

SEQ ID NO: 885862 - DNA, 25 bp, Mus musculus
tggcctctgcggtctacattgtctt

SEQ ID NO: 885863 - DNA, 25 bp, Mus musculus
tggcctctgctgcaaagtctgagac

SEQ ID NO: 885864 - DNA, 25 bp, Mus musculus
tggcctctgctggaaagtctgagac

SEQ ID NO: 885865 - DNA, 25 bp, Mus musculus
tggcctctgcttagcctttgtagca

SEQ ID NO: 885866 - DNA, 25 bp, Mus musculus
tggcctctgctttgcctttgtagca

SEQ ID NO: 885867 - DNA, 25 bp, Mus musculus
tggcctctggacatctaggttttgt

SEQ ID NO: 885868 - DNA, 25 bp, Mus musculus
tggcctctggacttctaggttttgt

SEQ ID NO: 885869 - DNA, 25 bp, Mus musculus
tggcctctggagacttaaagcaagt

SEQ ID NO: 885870 - DNA, 25 bp, Mus musculus
tggcctctggagtcttaaagcaagt

SEQ ID NO: 885871 - DNA, 25 bp, Mus musculus
tggcctctggctctgactatttgca

SEQ ID NO: 885872 - DNA, 25 bp, Mus musculus
tggcctctggctgtgactatttgca

SEQ ID NO: 885873 - DNA, 25 bp, Mus musculus
tggcctctgggtagaccaggcacat

SEQ ID NO: 885874 - DNA, 25 bp, Mus musculus
tggcctctgggttgaccaggcacat

SEQ ID NO: 885875 - DNA, 25 bp, Mus musculus
tggcctctggtccttgtgctacaaa

SEQ ID NO: 885876 - DNA, 25 bp, Mus musculus
tggcctctggtcgttgtgctacaaa

SEQ ID NO: 885877 - DNA, 25 bp, Mus musculus
tggcctctggtgcaaggatctcctt

SEQ ID NO: 885878 - DNA, 25 bp, Mus musculus
tggcctctggtggaaggatctcctt

SEQ ID NO: 885879 - DNA, 25 bp, Mus musculus
tggcctctgtcaccctggagcaaag

SEQ ID NO: 885880 - DNA, 25 bp, Mus musculus
tggcctctgtcagcctggagcaaag

SEQ ID NO: 885881 - DNA, 25 bp, Mus musculus
tggcctctgtccagaacaccagcat

SEQ ID NO: 885882 - DNA, 25 bp, Mus musculus
tggcctctgtccatgagtaatatgt

SEQ ID NO: 885883 - DNA, 25 bp, Mus musculus
tggcctctgtcctgaacaccagcat

SEQ ID NO: 885884 - DNA, 25 bp, Mus musculus
tggcctctgtccttgagtaatatgt

SEQ ID NO: 885885 - DNA, 25 bp, Mus musculus
tggcctctgtgaacactcagcatac

SEQ ID NO: 885886 - DNA, 25 bp, Mus musculus
tggcctctgtgaacttttctcgaaa

SEQ ID NO: 885887 - DNA, 25 bp, Mus musculus
tggcctctgtgaccccacatgagaa

SEQ ID NO: 885888 - DNA, 25 bp, Mus musculus
tggcctctgtgactactgcagacat

SEQ ID NO: 885889 - DNA, 25 bp, Mus musculus
tggcctctgtgactgctctagctct

SEQ ID NO: 885890 - DNA, 25 bp, Mus musculus
tggcctctgtgagcccacatgagaa

SEQ ID NO: 885891 - DNA, 25 bp, Mus musculus
tggcctctgtgagtactgcagacat

SEQ ID NO: 885892 - DNA, 25 bp, Mus musculus
tggcctctgtgagtgctctagctct

SEQ ID NO: 885893 - DNA, 25 bp, Mus musculus
tggcctctgtgatcactcagcatac

SEQ ID NO: 885894 - DNA, 25 bp, Mus musculus
tggcctctgtgatcttttctcgaaa

SEQ ID NO: 885895 - DNA, 25 bp, Mus musculus
tggcctctgtgtccataagcatcta

SEQ ID NO: 885896 - DNA, 25 bp, Mus musculus
tggcctctgtgtgcataagcatcta

SEQ ID NO: 885897 - DNA, 25 bp, Mus musculus
tggcctcttccgaatttgctgttat

SEQ ID NO: 885898 - DNA, 25 bp, Mus musculus
tggcctcttccgtatttgctgttat

SEQ ID NO: 885899 - DNA, 25 bp, Mus musculus
tggcctcttctgaagagttcaccct

SEQ ID NO: 885900 - DNA, 25 bp, Mus musculus
tggcctcttctgtagagttcaccct

SEQ ID NO: 885901 - DNA, 25 bp, Mus musculus
tggcctctttcaagggcccgttctc

SEQ ID NO: 885902 - DNA, 25 bp, Mus musculus
tggcctctttcatgggcccgttctc

SEQ ID NO: 885903 - DNA, 25 bp, Mus musculus
tggcctctttctaccacctagaaaa

SEQ ID NO: 885904 - DNA, 25 bp, Mus musculus
tggcctctttcttccacctagaaaa

SEQ ID NO: 885905 - DNA, 25 bp, Mus musculus
tggcctctttgcagctgtagtgaag

SEQ ID NO: 885906 - DNA, 25 bp, Mus musculus
tggcctctttgctgctgtagtgaag

SEQ ID NO: 885907 - DNA, 25 bp, Mus musculus
tggcctgaagaaccttgttaccttt

SEQ ID NO: 885908 - DNA, 25 bp, Mus musculus
tggcctgaagaagcttgttaccttt

SEQ ID NO: 885909 - DNA, 25 bp, Mus musculus
tggcctgaagcacttcttgctgaga

SEQ ID NO: 885910 - DNA, 25 bp, Mus musculus
tggcctgaagcagttcttgctgaga

SEQ ID NO: 885911 - DNA, 25 bp, Mus musculus
tggcctgaaggcaaagctctaccat

SEQ ID NO: 885912 - DNA, 25 bp, Mus musculus
tggcctgaaggccatgccaagcctg

SEQ ID NO: 885913 - DNA, 25 bp, Mus musculus
tggcctgaaggcgatgccaagcctg

SEQ ID NO: 885914 - DNA, 25 bp, Mus musculus
tggcctgaaggctaagctctaccat

SEQ ID NO: 885915 - DNA, 25 bp, Mus musculus
tggcctgactcaccctggaggagca

SEQ ID NO: 885916 - DNA, 25 bp, Mus musculus
tggcctgactcagcctggaggagca

SEQ ID NO: 885917 - DNA, 25 bp, Mus musculus
tggcctgacttactgctcaaggaga

SEQ ID NO: 885918 - DNA, 25 bp, Mus musculus
tggcctgacttagtgctcaaggaga

SEQ ID NO: 885919 - DNA, 25 bp, Mus musculus
tggcctgagaaccaataccaccttc

SEQ ID NO: 885920 - DNA, 25 bp, Mus musculus
tggcctgagaacgaataccaccttc

SEQ ID NO: 885921 - DNA, 25 bp, Mus musculus
tggcctgagagacacctgctgcatg

SEQ ID NO: 885922 - DNA, 25 bp, Mus musculus
tggcctgagagagacctgctgcatg

SEQ ID NO: 885923 - DNA, 25 bp, Mus musculus
tggcctgagcatctttttgggtgct

SEQ ID NO: 885924 - DNA, 25 bp, Mus musculus
tggcctgagcatgtttttgggtgct

SEQ ID NO: 885925 - DNA, 25 bp, Mus musculus
tggcctgagccaaattctctgtaca

SEQ ID NO: 885926 - DNA, 25 bp, Mus musculus
tggcctgagccatattctctgtaca

SEQ ID NO: 885927 - DNA, 25 bp, Mus musculus
tggcctgatacccttctctagggaa

SEQ ID NO: 885928 - DNA, 25 bp, Mus musculus
tggcctgataccgttctctagggaa

SEQ ID NO: 885929 - DNA, 25 bp, Mus musculus
tggcctgatagactgcagcacttca

SEQ ID NO: 885930 - DNA, 25 bp, Mus musculus
tggcctgatagagtgcagcacttca

SEQ ID NO: 885931 - DNA, 25 bp, Mus musculus
tggcctgatgaactttgtggactct

SEQ ID NO: 885932 - DNA, 25 bp, Mus musculus
tggcctgatgaagtttgtggactct

SEQ ID NO: 885933 - DNA, 25 bp, Mus musculus
tggcctgattttagcactagttgct

SEQ ID NO: 885934 - DNA, 25 bp, Mus musculus
tggcctgatttttgcactagttgct

SEQ ID NO: 885935 - DNA, 25 bp, Mus musculus
tggcctgcacagatacataccttac

SEQ ID NO: 885936 - DNA, 25 bp, Mus musculus
tggcctgcacagttacataccttac

SEQ ID NO: 885937 - DNA, 25 bp, Mus musculus
tggcctgcacctcccaaaatatact

SEQ ID NO: 885938 - DNA, 25 bp, Mus musculus
tggcctgcacctgccaaaatatact

SEQ ID NO: 885939 - DNA, 25 bp, Mus musculus
tggcctgcacttctacagtttgggt

SEQ ID NO: 885940 - DNA, 25 bp, Mus musculus
tggcctgcacttgtacagtttgggt

SEQ ID NO: 885941 - DNA, 25 bp, Mus musculus
tggcctgcagcaagggctgctcttc

SEQ ID NO: 885942 - DNA, 25 bp, Mus musculus
tggcctgcagcatgggctgctcttc

SEQ ID NO: 885943 - DNA, 25 bp, Mus musculus
tggcctgcagttagaaccccttttt

SEQ ID NO: 885944 - DNA, 25 bp, Mus musculus
tggcctgcagtttgaaccccttttt

SEQ ID NO: 885945 - DNA, 25 bp, Mus musculus
tggcctgcataaaaggatggagcac

SEQ ID NO: 885946 - DNA, 25 bp, Mus musculus
tggcctgcataataggatggagcac

SEQ ID NO: 885947 - DNA, 25 bp, Mus musculus
tggcctgcatcgaggagcccttctt

SEQ ID NO: 885948 - DNA, 25 bp, Mus musculus
tggcctgcatcgtggagcccttctt

SEQ ID NO: 885949 - DNA, 25 bp, Mus musculus
tggcctgcatgacccacaaaagaag

SEQ ID NO: 885950 - DNA, 25 bp, Mus musculus
tggcctgcatgagccacaaaagaag

SEQ ID NO: 885951 - DNA, 25 bp, Mus musculus
tggcctgcattaaaatggaccccaa

SEQ ID NO: 885952 - DNA, 25 bp, Mus musculus
tggcctgcattataatggaccccaa

SEQ ID NO: 885953 - DNA, 25 bp, Mus musculus
tggcctgcccagatccaaagcaaag

SEQ ID NO: 885954 - DNA, 25 bp, Mus musculus
tggcctgcccagttccaaagcaaag

SEQ ID NO: 885955 - DNA, 25 bp, Mus musculus
tggcctgccctaagtggtataatcc

SEQ ID NO: 885956 - DNA, 25 bp, Mus musculus
tggcctgccctatgtggtataatcc

SEQ ID NO: 885957 - DNA, 25 bp, Mus musculus
tggcctgcccttactctgcagagaa

SEQ ID NO: 885958 - DNA, 25 bp, Mus musculus
tggcctgccctttctctgcagagaa

SEQ ID NO: 885959 - DNA, 25 bp, Mus musculus
tggcctgcctctcagatgatgtcta

SEQ ID NO: 885960 - DNA, 25 bp, Mus musculus
tggcctgcctctgagatgatgtcta

SEQ ID NO: 885961 - DNA, 25 bp, Mus musculus
tggcctgcctgtagctgagactgca

SEQ ID NO: 885962 - DNA, 25 bp, Mus musculus
tggcctgcctgttgctgagactgca

SEQ ID NO: 885963 - DNA, 25 bp, Mus musculus
tggcctgcgagtccaagttttgctt

SEQ ID NO: 885964 - DNA, 25 bp, Mus musculus
tggcctgcgagtgcaagttttgctt

SEQ ID NO: 885965 - DNA, 25 bp, Mus musculus
tggcctgcgcacagactggttcagt

SEQ ID NO: 885966 - DNA, 25 bp, Mus musculus
tggcctgcgcactgactggttcagt

SEQ ID NO: 885967 - DNA, 25 bp, Mus musculus
tggcctgcgtatcgaccatgaccat

SEQ ID NO: 885968 - DNA, 25 bp, Mus musculus
tggcctgcgtatggaccatgaccat

SEQ ID NO: 885969 - DNA, 25 bp, Mus musculus
tggcctgctctaaaaccatggcatt

SEQ ID NO: 885970 - DNA, 25 bp, Mus musculus
tggcctgctctataaccatggcatt

SEQ ID NO: 885971 - DNA, 25 bp, Mus musculus
tggcctgctctgaaacaggagaacc

SEQ ID NO: 885972 - DNA, 25 bp, Mus musculus
tggcctgctctgtaacaggagaacc

SEQ ID NO: 885973 - DNA, 25 bp, Mus musculus
tggcctgctgtgagtagtcgtgaaa

SEQ ID NO: 885974 - DNA, 25 bp, Mus musculus
tggcctgctgtgcttttgacctgca

SEQ ID NO: 885975 - DNA, 25 bp, Mus musculus
tggcctgctgtggttttgacctgca

SEQ ID NO: 885976 - DNA, 25 bp, Mus musculus
tggcctgctgtgtgtagtcgtgaaa

SEQ ID NO: 885977 - DNA, 25 bp, Mus musculus
tggcctgcttctagccttcctggtc

SEQ ID NO: 885978 - DNA, 25 bp, Mus musculus
tggcctgcttcttgccttcctggtc

SEQ ID NO: 885979 - DNA, 25 bp, Mus musculus
tggcctgcttgaacttggtggcaca

SEQ ID NO: 885980 - DNA, 25 bp, Mus musculus
tggcctgcttgatcttggtggcaca

SEQ ID NO: 885981 - DNA, 25 bp, Mus musculus
tggcctgcttgtctgcacatagtgg

SEQ ID NO: 885982 - DNA, 25 bp, Mus musculus
tggcctgcttgtgtgcacatagtgg

SEQ ID NO: 885983 - DNA, 25 bp, Mus musculus
tggcctggaaccaacttgcagacca

SEQ ID NO: 885984 - DNA, 25 bp, Mus musculus
tggcctggaacctacttgcagacca

SEQ ID NO: 885985 - DNA, 25 bp, Mus musculus
tggcctggacctcgagctgctaggt

SEQ ID NO: 885986 - DNA, 25 bp, Mus musculus
tggcctggacctggagctgctaggt

SEQ ID NO: 885987 - DNA, 25 bp, Mus musculus
tggcctggagaaacccgtcagcggc

SEQ ID NO: 885988 - DNA, 25 bp, Mus musculus
tggcctggagaatcccgtcagcggc

SEQ ID NO: 885989 - DNA, 25 bp, Mus musculus
tggcctggatctcacacataaccct

SEQ ID NO: 885990 - DNA, 25 bp, Mus musculus
tggcctggatctgacacataaccct

SEQ ID NO: 885991 - DNA, 25 bp, Mus musculus
tggcctggcaacatacactgaattc

SEQ ID NO: 885992 - DNA, 25 bp, Mus musculus
tggcctggcaacttacactgaattc

SEQ ID NO: 885993 - DNA, 25 bp, Mus musculus
tggcctggccgcagtacgagtgcat

SEQ ID NO: 885994 - DNA, 25 bp, Mus musculus
tggcctggccgctgtacgagtgcat

SEQ ID NO: 885995 - DNA, 25 bp, Mus musculus
tggcctggctacctcgagtgtacag

SEQ ID NO: 885996 - DNA, 25 bp, Mus musculus
tggcctggctacgtcgagtgtacag

SEQ ID NO: 885997 - DNA, 25 bp, Mus musculus
tggcctgggactacgatagccgtga

SEQ ID NO: 885998 - DNA, 25 bp, Mus musculus
tggcctgggactcgtcgtaatcctt

SEQ ID NO: 885999 - DNA, 25 bp, Mus musculus
tggcctgggactggtcgtaatcctt

SEQ ID NO: 886000 - DNA, 25 bp, Mus musculus
tggcctgggacttcgatagccgtga

SEQ ID NO: 886001 - DNA, 25 bp, Mus musculus
tggcctgggcctaggcatagactca

SEQ ID NO: 886002 - DNA, 25 bp, Mus musculus
tggcctgggccttggcatagactca

SEQ ID NO: 886003 - DNA, 25 bp, Mus musculus
tggcctggtagcatatacctctatg

SEQ ID NO: 886004 - DNA, 25 bp, Mus musculus
tggcctggtagcttatacctctatg

SEQ ID NO: 886005 - DNA, 25 bp, Mus musculus
tggcctggtatcagcttgtcagaac

SEQ ID NO: 886006 - DNA, 25 bp, Mus musculus
tggcctggtatctgcttgtcagaac

SEQ ID NO: 886007 - DNA, 25 bp, Mus musculus
tggcctggtgccaaagaatccaaag

SEQ ID NO: 886008 - DNA, 25 bp, Mus musculus
tggcctggtgcctaagaatccaaag

SEQ ID NO: 886009 - DNA, 25 bp, Mus musculus
tggcctggtgtgaaatgggttaaac

SEQ ID NO: 886010 - DNA, 25 bp, Mus musculus
tggcctggtgtgtaatgggttaaac

SEQ ID NO: 886011 - DNA, 25 bp, Mus musculus
tggcctggttgaacactctgaagat

SEQ ID NO: 886012 - DNA, 25 bp, Mus musculus
tggcctggttgatcactctgaagat

SEQ ID NO: 886013 - DNA, 25 bp, Mus musculus
tggcctggtttgatactgacctgta

SEQ ID NO: 886014 - DNA, 25 bp, Mus musculus
tggcctggtttgttactgacctgta

SEQ ID NO: 886015 - DNA, 25 bp, Mus musculus
tggcctgtaatcctagatactctga

SEQ ID NO: 886016 - DNA, 25 bp, Mus musculus
tggcctgtaatcgtagatactctga

SEQ ID NO: 886017 - DNA, 25 bp, Mus musculus
tggcctgtagctactcccaggctta

SEQ ID NO: 886018 - DNA, 25 bp, Mus musculus
tggcctgtagcttctcccaggctta

SEQ ID NO: 886019 - DNA, 25 bp, Mus musculus
tggcctgtatttcagtatggcacaa

SEQ ID NO: 886020 - DNA, 25 bp, Mus musculus
tggcctgtatttgagtatggcacaa

SEQ ID NO: 886021 - DNA, 25 bp, Mus musculus
tggcctgtctgaaacttgaatatag

SEQ ID NO: 886022 - DNA, 25 bp, Mus musculus
tggcctgtctgatacttgaatatag

SEQ ID NO: 886023 - DNA, 25 bp, Mus musculus
tggcctgtctgcacatctgtagaat

SEQ ID NO: 886024 - DNA, 25 bp, Mus musculus
tggcctgtctgctcatctgtagaat

SEQ ID NO: 886025 - DNA, 25 bp, Mus musculus
tggcctgtctgtcttccagagttaa

SEQ ID NO: 886026 - DNA, 25 bp, Mus musculus
tggcctgtctgtgttccagagttaa

SEQ ID NO: 886027 - DNA, 25 bp, Mus musculus
tggcctgtgaacctttaatcttagc

SEQ ID NO: 886028 - DNA, 25 bp, Mus musculus
tggcctgtgaacgtttaatcttagc

SEQ ID NO: 886029 - DNA, 25 bp, Mus musculus
tggcctgtgacaacaacatacccag

SEQ ID NO: 886030 - DNA, 25 bp, Mus musculus
tggcctgtgacatcaacatacccag

SEQ ID NO: 886031 - DNA, 25 bp, Mus musculus
tggcctgtgaccactagacccaagg

SEQ ID NO: 886032 - DNA, 25 bp, Mus musculus
tggcctgtgacctctagacccaagg

SEQ ID NO: 886033 - DNA, 25 bp, Mus musculus
tggcctgtgagcatatatgtgtttc

SEQ ID NO: 886034 - DNA, 25 bp, Mus musculus
tggcctgtgagcttatatgtgtttc

SEQ ID NO: 886035 - DNA, 25 bp, Mus musculus
tggcctgtgctcattggcaatagca

SEQ ID NO: 886036 - DNA, 25 bp, Mus musculus
tggcctgtgctctttggcaatagca

SEQ ID NO: 886037 - DNA, 25 bp, Mus musculus
tggcctgtggatactatcattggat

SEQ ID NO: 886038 - DNA, 25 bp, Mus musculus
tggcctgtggattctatcattggat

SEQ ID NO: 886039 - DNA, 25 bp, Mus musculus
tggcctgtggccacggaaaatcact

SEQ ID NO: 886040 - DNA, 25 bp, Mus musculus
tggcctgtggccagaaccagacagt

SEQ ID NO: 886041 - DNA, 25 bp, Mus musculus
tggcctgtggcctcggaaaatcact

SEQ ID NO: 886042 - DNA, 25 bp, Mus musculus
tggcctgtggcctgaaccagacagt

SEQ ID NO: 886043 - DNA, 25 bp, Mus musculus
tggcctgtggctcacttcttattca

SEQ ID NO: 886044 - DNA, 25 bp, Mus musculus
tggcctgtggctgacttcttattca

SEQ ID NO: 886045 - DNA, 25 bp, Mus musculus
tggcctgtgtcaccgtgtagtgtca

SEQ ID NO: 886046 - DNA, 25 bp, Mus musculus
tggcctgtgtcacgctgacaaaagt

SEQ ID NO: 886047 - DNA, 25 bp, Mus musculus
tggcctgtgtcagcgtgtagtgtca

SEQ ID NO: 886048 - DNA, 25 bp, Mus musculus
tggcctgtgtcaggctgacaaaagt

SEQ ID NO: 886049 - DNA, 25 bp, Mus musculus
tggcctgtgtgcagctatgtcagaa

SEQ ID NO: 886050 - DNA, 25 bp, Mus musculus
tggcctgtgtgctgctatgtcagaa

SEQ ID NO: 886051 - DNA, 25 bp, Mus musculus
tggcctgtgttcaatggcacacatg

SEQ ID NO: 886052 - DNA, 25 bp, Mus musculus
tggcctgtgttctatggcacacatg

SEQ ID NO: 886053 - DNA, 25 bp, Mus musculus
tggcctgttcttcccttgctttggc

SEQ ID NO: 886054 - DNA, 25 bp, Mus musculus
tggcctgttcttgccttgctttggc

SEQ ID NO: 886055 - DNA, 25 bp, Mus musculus
tggcctgtttacaggtcagatagat

SEQ ID NO: 886056 - DNA, 25 bp, Mus musculus
tggcctgtttactggtcagatagat

SEQ ID NO: 886057 - DNA, 25 bp, Mus musculus
tggcctgttttcaattatgttgatc

SEQ ID NO: 886058 - DNA, 25 bp, Mus musculus
tggcctgttttctattatgttgatc

SEQ ID NO: 886059 - DNA, 25 bp, Mus musculus
tggccttaaactagtcatcctgctc

SEQ ID NO: 886060 - DNA, 25 bp, Mus musculus
tggccttaaacttgtcatcctgctc

SEQ ID NO: 886061 - DNA, 25 bp, Mus musculus
tggccttaattcatacctttctgtc

SEQ ID NO: 886062 - DNA, 25 bp, Mus musculus
tggccttaattcttacctttctgtc

SEQ ID NO: 886063 - DNA, 25 bp, Mus musculus
tggccttaatttcggatgctttttc

SEQ ID NO: 886064 - DNA, 25 bp, Mus musculus
tggccttaatttgggatgctttttc

SEQ ID NO: 886065 - DNA, 25 bp, Mus musculus
tggccttacacaaagtcatcatggt

SEQ ID NO: 886066 - DNA, 25 bp, Mus musculus
tggccttacacatagtcatcatggt

SEQ ID NO: 886067 - DNA, 25 bp, Mus musculus
tggccttactcccagaagcagacga

SEQ ID NO: 886068 - DNA, 25 bp, Mus musculus
tggccttactccgagaagcagacga

SEQ ID NO: 886069 - DNA, 25 bp, Mus musculus
tggccttactctactgcatattgca

SEQ ID NO: 886070 - DNA, 25 bp, Mus musculus
tggccttactcttctgcatattgca

SEQ ID NO: 886071 - DNA, 25 bp, Mus musculus
tggccttagccgattcttggagcat

SEQ ID NO: 886072 - DNA, 25 bp, Mus musculus
tggccttagccgtttcttggagcat

SEQ ID NO: 886073 - DNA, 25 bp, Mus musculus
tggccttagctgcacagccagggca

SEQ ID NO: 886074 - DNA, 25 bp, Mus musculus
tggccttagctggacagccagggca

SEQ ID NO: 886075 - DNA, 25 bp, Mus musculus
tggccttaggcaaaagattggaact

SEQ ID NO: 886076 - DNA, 25 bp, Mus musculus
tggccttaggcacagttgttcatta

SEQ ID NO: 886077 - DNA, 25 bp, Mus musculus
tggccttaggcagagttgttcatta

SEQ ID NO: 886078 - DNA, 25 bp, Mus musculus
tggccttaggcataagattggaact

SEQ ID NO: 886079 - DNA, 25 bp, Mus musculus
tggccttagggaacttttttgactt

SEQ ID NO: 886080 - DNA, 25 bp, Mus musculus
tggccttagggatcttttttgactt

SEQ ID NO: 886081 - DNA, 25 bp, Mus musculus
tggccttatctgagactctgacaaa

SEQ ID NO: 886082 - DNA, 25 bp, Mus musculus
tggccttatctgcttgatggaatac

SEQ ID NO: 886083 - DNA, 25 bp, Mus musculus
tggccttatctggttgatggaatac

SEQ ID NO: 886084 - DNA, 25 bp, Mus musculus
tggccttatctgtgactctgacaaa

SEQ ID NO: 886085 - DNA, 25 bp, Mus musculus
tggccttattatagcttccttggtt

SEQ ID NO: 886086 - DNA, 25 bp, Mus musculus
tggccttattattgcttccttggtt

SEQ ID NO: 886087 - DNA, 25 bp, Mus musculus
tggccttcaacgaggattctcagga

SEQ ID NO: 886088 - DNA, 25 bp, Mus musculus
tggccttcaacgtggattctcagga

SEQ ID NO: 886089 - DNA, 25 bp, Mus musculus
tggccttcacagatcatagtttctt

SEQ ID NO: 886090 - DNA, 25 bp, Mus musculus
tggccttcacagttcatagtttctt

SEQ ID NO: 886091 - DNA, 25 bp, Mus musculus
tggccttccaaaatgtttaacttct

SEQ ID NO: 886092 - DNA, 25 bp, Mus musculus
tggccttccaaattgtttaacttct

SEQ ID NO: 886093 - DNA, 25 bp, Mus musculus
tggccttccaggcaaagcatcttgg

SEQ ID NO: 886094 - DNA, 25 bp, Mus musculus
tggccttccagggaaagcatcttgg

SEQ ID NO: 886095 - DNA, 25 bp, Mus musculus
tggccttccattcataatcttcttg

SEQ ID NO: 886096 - DNA, 25 bp, Mus musculus
tggccttccattgataatcttcttg

SEQ ID NO: 886097 - DNA, 25 bp, Mus musculus
tggccttcccaaactgcttttgatc

SEQ ID NO: 886098 - DNA, 25 bp, Mus musculus
tggccttcccaatctgcttttgatc

SEQ ID NO: 886099 - DNA, 25 bp, Mus musculus
tggccttccccaaattacacaccag

SEQ ID NO: 886100 - DNA, 25 bp, Mus musculus
tggccttccccatattacacaccag

SEQ ID NO: 886101 - DNA, 25 bp, Mus musculus
tggccttccccgcagtcagaatttg

SEQ ID NO: 886102 - DNA, 25 bp, Mus musculus
tggccttccccggagtcagaatttg

SEQ ID NO: 886103 - DNA, 25 bp, Mus musculus
tggccttcctgcaagtctatgatga

SEQ ID NO: 886104 - DNA, 25 bp, Mus musculus
tggccttcctgctagtctatgatga

SEQ ID NO: 886105 - DNA, 25 bp, Mus musculus
tggccttcctggaaagcctttcaat

SEQ ID NO: 886106 - DNA, 25 bp, Mus musculus
tggccttcctggctcaaggcatgat

SEQ ID NO: 886107 - DNA, 25 bp, Mus musculus
tggccttcctgggtcaaggcatgat

SEQ ID NO: 886108 - DNA, 25 bp, Mus musculus
tggccttcctggtaagcctttcaat

SEQ ID NO: 886109 - DNA, 25 bp, Mus musculus
tggccttcctttaatcttggtcatc

SEQ ID NO: 886110 - DNA, 25 bp, Mus musculus
tggccttccttttatcttggtcatc

SEQ ID NO: 886111 - DNA, 25 bp, Mus musculus
tggccttcgaaaccctgaacacagc

SEQ ID NO: 886112 - DNA, 25 bp, Mus musculus
tggccttcgaaagcctgaacacagc

SEQ ID NO: 886113 - DNA, 25 bp, Mus musculus
tggccttcgacaccgagctggtaaa

SEQ ID NO: 886114 - DNA, 25 bp, Mus musculus
tggccttcgacagcgagctggtaaa

SEQ ID NO: 886115 - DNA, 25 bp, Mus musculus
tggccttcgggaaaccctgtaagga

SEQ ID NO: 886116 - DNA, 25 bp, Mus musculus
tggccttcgggataccctgtaagga

SEQ ID NO: 886117 - DNA, 25 bp, Mus musculus
tggccttcgtcgagggcctcctcat

SEQ ID NO: 886118 - DNA, 25 bp, Mus musculus
tggccttcgtcgtgggcctcctcat

SEQ ID NO: 886119 - DNA, 25 bp, Mus musculus
tggccttctcaaccagttctgtgac

SEQ ID NO: 886120 - DNA, 25 bp, Mus musculus
tggccttctcaagcagttctgtgac

SEQ ID NO: 886121 - DNA, 25 bp, Mus musculus
tggccttctccactgttagtcattc

SEQ ID NO: 886122 - DNA, 25 bp, Mus musculus
tggccttctccagtgttagtcattc

SEQ ID NO: 886123 - DNA, 25 bp, Mus musculus
tggccttctcccaatttttattcta

SEQ ID NO: 886124 - DNA, 25 bp, Mus musculus
tggccttctccctatttttattcta

SEQ ID NO: 886125 - DNA, 25 bp, Mus musculus
tggccttctctacgaatgcactaca

SEQ ID NO: 886126 - DNA, 25 bp, Mus musculus
tggccttctctaggaatgcactaca

SEQ ID NO: 886127 - DNA, 25 bp, Mus musculus
tggccttctctcattgctgtttcaa

SEQ ID NO: 886128 - DNA, 25 bp, Mus musculus
tggccttctctctttgctgtttcaa

SEQ ID NO: 886129 - DNA, 25 bp, Mus musculus
tggccttctgctcaaactcaggatg

SEQ ID NO: 886130 - DNA, 25 bp, Mus musculus
tggccttctgctgaaactcaggatg

SEQ ID NO: 886131 - DNA, 25 bp, Mus musculus
tggccttcttcaacagcgtggtcaa

SEQ ID NO: 886132 - DNA, 25 bp, Mus musculus
tggccttcttcaccaacaggtatgt

SEQ ID NO: 886133 - DNA, 25 bp, Mus musculus
tggccttcttcagcaacaggtatgt

SEQ ID NO: 886134 - DNA, 25 bp, Mus musculus
tggccttcttcatcagcgtggtcaa

SEQ ID NO: 886135 - DNA, 25 bp, Mus musculus
tggccttcttctagtaacttgtaaa

SEQ ID NO: 886136 - DNA, 25 bp, Mus musculus
tggccttcttcttgtaacttgtaaa

SEQ ID NO: 886137 - DNA, 25 bp, Mus musculus
tggccttcttgtcggatgacagcat

SEQ ID NO: 886138 - DNA, 25 bp, Mus musculus
tggccttcttgtgggatgacagcat

SEQ ID NO: 886139 - DNA, 25 bp, Mus musculus
tggccttctttgaggaatttattga

SEQ ID NO: 886140 - DNA, 25 bp, Mus musculus
tggccttctttgctaccaggcacac

SEQ ID NO: 886141 - DNA, 25 bp, Mus musculus
tggccttctttggtaccaggcacac

SEQ ID NO: 886142 - DNA, 25 bp, Mus musculus
tggccttctttgtggaatttattga

SEQ ID NO: 886143 - DNA, 25 bp, Mus musculus
tggccttgaaagcacaagcctcgtt

SEQ ID NO: 886144 - DNA, 25 bp, Mus musculus
tggccttgaaaggacaagcctcgtt

SEQ ID NO: 886145 - DNA, 25 bp, Mus musculus
tggccttgaaccagtgaccatcttg

SEQ ID NO: 886146 - DNA, 25 bp, Mus musculus
tggccttgaacctgtgaccatcttg

SEQ ID NO: 886147 - DNA, 25 bp, Mus musculus
tggccttgaactatctaacgaaatt

SEQ ID NO: 886148 - DNA, 25 bp, Mus musculus
tggccttgaactcgtggccacctta

SEQ ID NO: 886149 - DNA, 25 bp, Mus musculus
tggccttgaactggtggccacctta

SEQ ID NO: 886150 - DNA, 25 bp, Mus musculus
tggccttgaactttctaacgaaatt

SEQ ID NO: 886151 - DNA, 25 bp, Mus musculus
tggccttgaagcactgagaccagac

SEQ ID NO: 886152 - DNA, 25 bp, Mus musculus
tggccttgaagctctgagaccagac

SEQ ID NO: 886153 - DNA, 25 bp, Mus musculus
tggccttgaattagtcaccttcttg

SEQ ID NO: 886154 - DNA, 25 bp, Mus musculus
tggccttgaattagtgccagtccac

SEQ ID NO: 886155 - DNA, 25 bp, Mus musculus
tggccttgaatttgtcaccttcttg

SEQ ID NO: 886156 - DNA, 25 bp, Mus musculus
tggccttgaatttgtgccagtccac

SEQ ID NO: 886157 - DNA, 25 bp, Mus musculus
tggccttgaccacttgcatgagaga

SEQ ID NO: 886158 - DNA, 25 bp, Mus musculus
tggccttgaccagttgcatgagaga

SEQ ID NO: 886159 - DNA, 25 bp, Mus musculus
tggccttgacccatattgactttgt

SEQ ID NO: 886160 - DNA, 25 bp, Mus musculus
tggccttgacccttattgactttgt

SEQ ID NO: 886161 - DNA, 25 bp, Mus musculus
tggccttgagcacacagctatcttc

SEQ ID NO: 886162 - DNA, 25 bp, Mus musculus
tggccttgagcagacagctatcttc

SEQ ID NO: 886163 - DNA, 25 bp, Mus musculus
tggccttgatgaagatgacgggcat

SEQ ID NO: 886164 - DNA, 25 bp, Mus musculus
tggccttgatgatgatgacgggcat

SEQ ID NO: 886165 - DNA, 25 bp, Mus musculus
tggccttgcacaagaagcgacacat

SEQ ID NO: 886166 - DNA, 25 bp, Mus musculus
tggccttgcacatgaagcgacacat

SEQ ID NO: 886167 - DNA, 25 bp, Mus musculus
tggccttgcactaatgatcgtcctt

SEQ ID NO: 886168 - DNA, 25 bp, Mus musculus
tggccttgcacttatgatcgtcctt

SEQ ID NO: 886169 - DNA, 25 bp, Mus musculus
tggccttgcagactatgccgacgat

SEQ ID NO: 886170 - DNA, 25 bp, Mus musculus
tggccttgcagagtatgccgacgat

SEQ ID NO: 886171 - DNA, 25 bp, Mus musculus
tggccttgcaggagacgctgaccct

SEQ ID NO: 886172 - DNA, 25 bp, Mus musculus
tggccttgcaggtgacgctgaccct

SEQ ID NO: 886173 - DNA, 25 bp, Mus musculus
tggccttgcgagagcttcaaagtaa

SEQ ID NO: 886174 - DNA, 25 bp, Mus musculus
tggccttgcgagtgcttcaaagtaa

SEQ ID NO: 886175 - DNA, 25 bp, Mus musculus
tggccttgcgggaagtacagctact

SEQ ID NO: 886176 - DNA, 25 bp, Mus musculus
tggccttgcgggtagtacagctact

SEQ ID NO: 886177 - DNA, 25 bp, Mus musculus
tggccttggaacacagcaacatgct

SEQ ID NO: 886178 - DNA, 25 bp, Mus musculus
tggccttggaactcagcaacatgct

SEQ ID NO: 886179 - DNA, 25 bp, Mus musculus
tggccttggagcaactgcgccgatg

SEQ ID NO: 886180 - DNA, 25 bp, Mus musculus
tggccttggagcattatctttagtt

SEQ ID NO: 886181 - DNA, 25 bp, Mus musculus
tggccttggagctactgcgccgatg

SEQ ID NO: 886182 - DNA, 25 bp, Mus musculus
tggccttggagctttatctttagtt

SEQ ID NO: 886183 - DNA, 25 bp, Mus musculus
tggccttggaggacacttaccggga

SEQ ID NO: 886184 - DNA, 25 bp, Mus musculus
tggccttggaggtcacttaccggga

SEQ ID NO: 886185 - DNA, 25 bp, Mus musculus
tggccttggagtcacacacctacct

SEQ ID NO: 886186 - DNA, 25 bp, Mus musculus
tggccttggagtgacacacctacct

SEQ ID NO: 886187 - DNA, 25 bp, Mus musculus
tggccttggcaacagaccccaatat

SEQ ID NO: 886188 - DNA, 25 bp, Mus musculus
tggccttggcaagagaccccaatat

SEQ ID NO: 886189 - DNA, 25 bp, Mus musculus
tggccttggcatcctcctctactgg

SEQ ID NO: 886190 - DNA, 25 bp, Mus musculus
tggccttggcatgctcctctactgg

SEQ ID NO: 886191 - DNA, 25 bp, Mus musculus
tggccttggccactggcaccaatat

SEQ ID NO: 886192 - DNA, 25 bp, Mus musculus
tggccttggccagtggcaccaatat

SEQ ID NO: 886193 - DNA, 25 bp, Mus musculus
tggccttggcttaacctaaatcttg

SEQ ID NO: 886194 - DNA, 25 bp, Mus musculus
tggccttggcttcctcggataaaac

SEQ ID NO: 886195 - DNA, 25 bp, Mus musculus
tggccttggcttgctcggataaaac

SEQ ID NO: 886196 - DNA, 25 bp, Mus musculus
tggccttggctttacctaaatcttg

SEQ ID NO: 886197 - DNA, 25 bp, Mus musculus
tggccttgggagaacctgtttgtca

SEQ ID NO: 886198 - DNA, 25 bp, Mus musculus
tggccttgggagagtgcttctttca

SEQ ID NO: 886199 - DNA, 25 bp, Mus musculus
tggccttgggagtacctgtttgtca

SEQ ID NO: 886200 - DNA, 25 bp, Mus musculus
tggccttgggagtgtgcttctttca

SEQ ID NO: 886201 - DNA, 25 bp, Mus musculus
tggccttgggcaaattcctaaacct

SEQ ID NO: 886202 - DNA, 25 bp, Mus musculus
tggccttgggcatattcctaaacct

SEQ ID NO: 886203 - DNA, 25 bp, Mus musculus
tggccttgggtaattggttagttct

SEQ ID NO: 886204 - DNA, 25 bp, Mus musculus
tggccttgggtatttggttagttct

SEQ ID NO: 886205 - DNA, 25 bp, Mus musculus
tggccttgggtcatgagggtataag

SEQ ID NO: 886206 - DNA, 25 bp, Mus musculus
tggccttgggtcttgagggtataag

SEQ ID NO: 886207 - DNA, 25 bp, Mus musculus
tggccttgggtgacaaattcctctt

SEQ ID NO: 886208 - DNA, 25 bp, Mus musculus
tggccttgggtgtcaaattcctctt

SEQ ID NO: 886209 - DNA, 25 bp, Mus musculus
tggccttggtaactccctagcccag

SEQ ID NO: 886210 - DNA, 25 bp, Mus musculus
tggccttggtaagtccctagcccag

SEQ ID NO: 886211 - DNA, 25 bp, Mus musculus
tggccttggtgcagagattatgttg

SEQ ID NO: 886212 - DNA, 25 bp, Mus musculus
tggccttggtgctgagattatgttg

SEQ ID NO: 886213 - DNA, 25 bp, Mus musculus
tggccttggtgtatcttcttagcgg

SEQ ID NO: 886214 - DNA, 25 bp, Mus musculus
tggccttggtgtttcttcttagcgg

SEQ ID NO: 886215 - DNA, 25 bp, Mus musculus
tggccttgtaccatttgccttcatt

SEQ ID NO: 886216 - DNA, 25 bp, Mus musculus
tggccttgtaccttttgccttcatt

SEQ ID NO: 886217 - DNA, 25 bp, Mus musculus
tggccttgtccgacatgctggaggt

SEQ ID NO: 886218 - DNA, 25 bp, Mus musculus
tggccttgtccgtcatgctggaggt

SEQ ID NO: 886219 - DNA, 25 bp, Mus musculus
tggccttgtggtatcccaagtttag

SEQ ID NO: 886220 - DNA, 25 bp, Mus musculus
tggccttgtggtttcccaagtttag

SEQ ID NO: 886221 - DNA, 25 bp, Mus musculus
tggccttgttacattcaatccctga

SEQ ID NO: 886222 - DNA, 25 bp, Mus musculus
tggccttgttactttcaatccctga

SEQ ID NO: 886223 - DNA, 25 bp, Mus musculus
tggccttgttggcactggcacattt

SEQ ID NO: 886224 - DNA, 25 bp, Mus musculus
tggccttgttgggactggcacattt

SEQ ID NO: 886225 - DNA, 25 bp, Mus musculus
tggcctttaaccatgaactcttaag

SEQ ID NO: 886226 - DNA, 25 bp, Mus musculus
tggcctttaaccttgaactcttaag

SEQ ID NO: 886227 - DNA, 25 bp, Mus musculus
tggcctttacagaatgaagcagggc

SEQ ID NO: 886228 - DNA, 25 bp, Mus musculus
tggcctttacagtatgaagcagggc

SEQ ID NO: 886229 - DNA, 25 bp, Mus musculus
tggcctttacctctggtttgaacca

SEQ ID NO: 886230 - DNA, 25 bp, Mus musculus
tggcctttacctgtggtttgaacca

SEQ ID NO: 886231 - DNA, 25 bp, Mus musculus
tggcctttactaatacacccattaa

SEQ ID NO: 886232 - DNA, 25 bp, Mus musculus
tggcctttactattacacccattaa

SEQ ID NO: 886233 - DNA, 25 bp, Mus musculus
tggcctttagcaccacatttaatta

SEQ ID NO: 886234 - DNA, 25 bp, Mus musculus
tggcctttagcagcacatttaatta

SEQ ID NO: 886235 - DNA, 25 bp, Mus musculus
tggcctttagctatcgggattcctg

SEQ ID NO: 886236 - DNA, 25 bp, Mus musculus
tggcctttagctatttctgttctac

SEQ ID NO: 886237 - DNA, 25 bp, Mus musculus
tggcctttagctttcgggattcctg

SEQ ID NO: 886238 - DNA, 25 bp, Mus musculus
tggcctttagctttttctgttctac

SEQ ID NO: 886239 - DNA, 25 bp, Mus musculus
tggcctttatttactacttccttgg

SEQ ID NO: 886240 - DNA, 25 bp, Mus musculus
tggcctttattttctacttccttgg

SEQ ID NO: 886241 - DNA, 25 bp, Mus musculus
tggcctttcaggaaacatggttcac

SEQ ID NO: 886242 - DNA, 25 bp, Mus musculus
tggcctttcaggtaacatggttcac

SEQ ID NO: 886243 - DNA, 25 bp, Mus musculus
tggcctttcattcaccaaacaccag

SEQ ID NO: 886244 - DNA, 25 bp, Mus musculus
tggcctttcattgaccaaacaccag

SEQ ID NO: 886245 - DNA, 25 bp, Mus musculus
tggcctttccagatacttgagtttg

SEQ ID NO: 886246 - DNA, 25 bp, Mus musculus
tggcctttccagttacttgagtttg

SEQ ID NO: 886247 - DNA, 25 bp, Mus musculus
tggcctttcccaatggcaaggattt

SEQ ID NO: 886248 - DNA, 25 bp, Mus musculus
tggcctttcccattggcaaggattt

SEQ ID NO: 886249 - DNA, 25 bp, Mus musculus
tggcctttccttcgcacttcacaga

SEQ ID NO: 886250 - DNA, 25 bp, Mus musculus
tggcctttccttggcacttcacaga

SEQ ID NO: 886251 - DNA, 25 bp, Mus musculus
tggcctttcgacacaaatgcaactg

SEQ ID NO: 886252 - DNA, 25 bp, Mus musculus
tggcctttcgactcaaatgcaactg

SEQ ID NO: 886253 - DNA, 25 bp, Mus musculus
tggcctttctgcataacttatcgtg

SEQ ID NO: 886254 - DNA, 25 bp, Mus musculus
tggcctttctgcttaacttatcgtg

SEQ ID NO: 886255 - DNA, 25 bp, Mus musculus
tggcctttctggctaattgggcgca

SEQ ID NO: 886256 - DNA, 25 bp, Mus musculus
tggcctttctgggtaattgggcgca

SEQ ID NO: 886257 - DNA, 25 bp, Mus musculus
tggcctttcttcagcaagactggag

SEQ ID NO: 886258 - DNA, 25 bp, Mus musculus
tggcctttcttctgcaagactggag

SEQ ID NO: 886259 - DNA, 25 bp, Mus musculus
tggcctttgaccactccaaggtgcc

SEQ ID NO: 886260 - DNA, 25 bp, Mus musculus
tggcctttgacctctccaaggtgcc

SEQ ID NO: 886261 - DNA, 25 bp, Mus musculus
tggcctttgcatagaggtctttctc

SEQ ID NO: 886262 - DNA, 25 bp, Mus musculus
tggcctttgcattgaggtctttctc

SEQ ID NO: 886263 - DNA, 25 bp, Mus musculus
tggcctttgcctaggcatggaatgt

SEQ ID NO: 886264 - DNA, 25 bp, Mus musculus
tggcctttgccttggcatggaatgt

SEQ ID NO: 886265 - DNA, 25 bp, Mus musculus
tggcctttgctcacgtgctctgtta

SEQ ID NO: 886266 - DNA, 25 bp, Mus musculus
tggcctttgctctcgtgctctgtta

SEQ ID NO: 886267 - DNA, 25 bp, Mus musculus
tggcctttggacaccatgccaagtt

SEQ ID NO: 886268 - DNA, 25 bp, Mus musculus
tggcctttggactccatgccaagtt

SEQ ID NO: 886269 - DNA, 25 bp, Mus musculus
tggcctttggctcaatacaggtcca

SEQ ID NO: 886270 - DNA, 25 bp, Mus musculus
tggcctttggctgaatacaggtcca

SEQ ID NO: 886271 - DNA, 25 bp, Mus musculus
tggccttttcaacattgttcacgct

SEQ ID NO: 886272 - DNA, 25 bp, Mus musculus
tggccttttcaagattgttcacgct

SEQ ID NO: 886273 - DNA, 25 bp, Mus musculus
tggccttttcagagctcatgacaag

SEQ ID NO: 886274 - DNA, 25 bp, Mus musculus
tggccttttcagtgctcatgacaag

SEQ ID NO: 886275 - DNA, 25 bp, Mus musculus
tggccttttcctcagatcttataac

SEQ ID NO: 886276 - DNA, 25 bp, Mus musculus
tggccttttcctgagatcttataac

SEQ ID NO: 886277 - DNA, 25 bp, Mus musculus
tggccttttgcacaccggttttgag

SEQ ID NO: 886278 - DNA, 25 bp, Mus musculus
tggccttttgcagaccggttttgag

SEQ ID NO: 886279 - DNA, 25 bp, Mus musculus
tggcctttttcaaaagattggaact

SEQ ID NO: 886280 - DNA, 25 bp, Mus musculus
tggcctttttcataagattggaact

SEQ ID NO: 886281 - DNA, 25 bp, Mus musculus
tggcgaaaagccctattggtgtagc

SEQ ID NO: 886282 - DNA, 25 bp, Mus musculus
tggcgaaaagccgtattggtgtagc

SEQ ID NO: 886283 - DNA, 25 bp, Mus musculus
tggcgaaaccccaccttggcacaaa

SEQ ID NO: 886284 - DNA, 25 bp, Mus musculus
tggcgaaacccctccttggcacaaa

SEQ ID NO: 886285 - DNA, 25 bp, Mus musculus
tggcgaacacgcaggctccgccgag

SEQ ID NO: 886286 - DNA, 25 bp, Mus musculus
tggcgaacacgctggctccgccgag

SEQ ID NO: 886287 - DNA, 25 bp, Mus musculus
tggcgaacgtcgactgctataggca

SEQ ID NO: 886288 - DNA, 25 bp, Mus musculus
tggcgaacgtcgtctgctataggca

SEQ ID NO: 886289 - DNA, 25 bp, Mus musculus
tggcgaactctaactgggtctgcga

SEQ ID NO: 886290 - DNA, 25 bp, Mus musculus
tggcgaactctatctgggtctgcga

SEQ ID NO: 886291 - DNA, 25 bp, Mus musculus
tggcgaaggtctcagcagcccagct

SEQ ID NO: 886292 - DNA, 25 bp, Mus musculus
tggcgaaggtctgagcagcccagct

SEQ ID NO: 886293 - DNA, 25 bp, Mus musculus
tggcgaatactaacgtccattcaaa

SEQ ID NO: 886294 - DNA, 25 bp, Mus musculus
tggcgaatactatcgtccattcaaa

SEQ ID NO: 886295 - DNA, 25 bp, Mus musculus
tggcgacaaaggaccttctactcat

SEQ ID NO: 886296 - DNA, 25 bp, Mus musculus
tggcgacaaaggtccttctactcat

SEQ ID NO: 886297 - DNA, 25 bp, Mus musculus
tggcgacaactcacctagcaatgta

SEQ ID NO: 886298 - DNA, 25 bp, Mus musculus
tggcgacaactctcctagcaatgta

SEQ ID NO: 886299 - DNA, 25 bp, Mus musculus
tggcgacacttaccgagcttatgag

SEQ ID NO: 886300 - DNA, 25 bp, Mus musculus
tggcgacacttagcgagcttatgag

SEQ ID NO: 886301 - DNA, 25 bp, Mus musculus
tggcgacagccacatttcagagcat

SEQ ID NO: 886302 - DNA, 25 bp, Mus musculus
tggcgacagccagatttcagagcat

SEQ ID NO: 886303 - DNA, 25 bp, Mus musculus
tggcgacagctgcaggccgtttgct

SEQ ID NO: 886304 - DNA, 25 bp, Mus musculus
tggcgacagctggaggccgtttgct

SEQ ID NO: 886305 - DNA, 25 bp, Mus musculus
tggcgacagttcacatggtgaggcc

SEQ ID NO: 886306 - DNA, 25 bp, Mus musculus
tggcgacagttctcatggtgaggcc

SEQ ID NO: 886307 - DNA, 25 bp, Mus musculus
tggcgacccattatacacagaccag

SEQ ID NO: 886308 - DNA, 25 bp, Mus musculus
tggcgacccattcaagcacttatgg

SEQ ID NO: 886309 - DNA, 25 bp, Mus musculus
tggcgacccattgaagcacttatgg

SEQ ID NO: 886310 - DNA, 25 bp, Mus musculus
tggcgacccattttacacagaccag

SEQ ID NO: 886311 - DNA, 25 bp, Mus musculus
tggcgaccccttcaattgttgcagc

SEQ ID NO: 886312 - DNA, 25 bp, Mus musculus
tggcgaccccttgaattgttgcagc

SEQ ID NO: 886313 - DNA, 25 bp, Mus musculus
tggcgaccctgcagtgtgccacggc

SEQ ID NO: 886314 - DNA, 25 bp, Mus musculus
tggcgaccctgctgtgtgccacggc

SEQ ID NO: 886315 - DNA, 25 bp, Mus musculus
tggcgaccgggcatgctgaattcaa

SEQ ID NO: 886316 - DNA, 25 bp, Mus musculus
tggcgaccgggcttgctgaattcaa

SEQ ID NO: 886317 - DNA, 25 bp, Mus musculus
tggcgacctactcatagaatttgat

SEQ ID NO: 886318 - DNA, 25 bp, Mus musculus
tggcgacctactgatagaatttgat

SEQ ID NO: 886319 - DNA, 25 bp, Mus musculus
tggcgacctgctctagactgatgca

SEQ ID NO: 886320 - DNA, 25 bp, Mus musculus
tggcgacctgctgtagactgatgca

SEQ ID NO: 886321 - DNA, 25 bp, Mus musculus
tggcgacgaccacggcattgattat

SEQ ID NO: 886322 - DNA, 25 bp, Mus musculus
tggcgacgaccagggcattgattat

SEQ ID NO: 886323 - DNA, 25 bp, Mus musculus
tggcgacggactctgtcattcaaac

SEQ ID NO: 886324 - DNA, 25 bp, Mus musculus
tggcgacggactgtgtcattcaaac

SEQ ID NO: 886325 - DNA, 25 bp, Mus musculus
tggcgactaagcaccctgttaacta

SEQ ID NO: 886326 - DNA, 25 bp, Mus musculus
tggcgactaagctccctgttaacta

SEQ ID NO: 886327 - DNA, 25 bp, Mus musculus
tggcgactccatcagtgagctgtga

SEQ ID NO: 886328 - DNA, 25 bp, Mus musculus
tggcgactccatgagtgagctgtga

SEQ ID NO: 886329 - DNA, 25 bp, Mus musculus
tggcgactcctcagtgagtgtagat

SEQ ID NO: 886330 - DNA, 25 bp, Mus musculus
tggcgactcctctgtgagtgtagat

SEQ ID NO: 886331 - DNA, 25 bp, Mus musculus
tggcgactggccactgtcaaaatcc

SEQ ID NO: 886332 - DNA, 25 bp, Mus musculus
tggcgactggccagcaactgtgtag

SEQ ID NO: 886333 - DNA, 25 bp, Mus musculus
tggcgactggcctctgtcaaaatcc

SEQ ID NO: 886334 - DNA, 25 bp, Mus musculus
tggcgactggcctgcaactgtgtag

SEQ ID NO: 886335 - DNA, 25 bp, Mus musculus
tggcgagaacctctgagcagatgct

SEQ ID NO: 886336 - DNA, 25 bp, Mus musculus
tggcgagaacctgtgagcagatgct

SEQ ID NO: 886337 - DNA, 25 bp, Mus musculus
tggcgagaacttactggacgtcgat

SEQ ID NO: 886338 - DNA, 25 bp, Mus musculus
tggcgagaactttctggacgtcgat

SEQ ID NO: 886339 - DNA, 25 bp, Mus musculus
tggcgagagtcaaggcactatgaac

SEQ ID NO: 886340 - DNA, 25 bp, Mus musculus
tggcgagagtcatggcactatgaac

SEQ ID NO: 886341 - DNA, 25 bp, Mus musculus
tggcgagcagcaccgtaccgaccaa

SEQ ID NO: 886342 - DNA, 25 bp, Mus musculus
tggcgagcagcagcgtaccgaccaa

SEQ ID NO: 886343 - DNA, 25 bp, Mus musculus
tggcgagcccagaactacgaacagc

SEQ ID NO: 886344 - DNA, 25 bp, Mus musculus
tggcgagcccagtactacgaacagc

SEQ ID NO: 886345 - DNA, 25 bp, Mus musculus
tggcgagcccgacttaaaggacaat

SEQ ID NO: 886346 - DNA, 25 bp, Mus musculus
tggcgagcccgagttaaaggacaat

SEQ ID NO: 886347 - DNA, 25 bp, Mus musculus
tggcgagctagtccgcaccgacagc

SEQ ID NO: 886348 - DNA, 25 bp, Mus musculus
tggcgagctagtgcgcaccgacagc

SEQ ID NO: 886349 - DNA, 25 bp, Mus musculus
tggcgaggacgacctgtcccagatt

SEQ ID NO: 886350 - DNA, 25 bp, Mus musculus
tggcgaggacgagctgtcccagatt

SEQ ID NO: 886351 - DNA, 25 bp, Mus musculus
tggcgaggcccaaagtacacaggaa

SEQ ID NO: 886352 - DNA, 25 bp, Mus musculus
tggcgaggcccatagtacacaggaa

SEQ ID NO: 886353 - DNA, 25 bp, Mus musculus
tggcgagggatcattccaaaggccc

SEQ ID NO: 886354 - DNA, 25 bp, Mus musculus
tggcgagggatctttccaaaggccc

SEQ ID NO: 886355 - DNA, 25 bp, Mus musculus
tggcgagtaaatcaagtcacagtaa

SEQ ID NO: 886356 - DNA, 25 bp, Mus musculus
tggcgagtaaatgaagtcacagtaa

SEQ ID NO: 886357 - DNA, 25 bp, Mus musculus
tggcgagtcagccttctggcctctc

SEQ ID NO: 886358 - DNA, 25 bp, Mus musculus
tggcgagtcagcgttctggcctctc

SEQ ID NO: 886359 - DNA, 25 bp, Mus musculus
tggcgagtgcgtcttactctgcacc

SEQ ID NO: 886360 - DNA, 25 bp, Mus musculus
tggcgagtgcgtgttactctgcacc

SEQ ID NO: 886361 - DNA, 25 bp, Mus musculus
tggcgatgcctaaggagccctctta

SEQ ID NO: 886362 - DNA, 25 bp, Mus musculus
tggcgatgcctatggagccctctta

SEQ ID NO: 886363 - DNA, 25 bp, Mus musculus
tggcgatgccttccagcaaagtggt

SEQ ID NO: 886364 - DNA, 25 bp, Mus musculus
tggcgatgccttgcagcaaagtggt

SEQ ID NO: 886365 - DNA, 25 bp, Mus musculus
tggcgatggctgacaccactagaca

SEQ ID NO: 886366 - DNA, 25 bp, Mus musculus
tggcgatggctgtcaccactagaca

SEQ ID NO: 886367 - DNA, 25 bp, Mus musculus
tggcgattccttaggtagacttggc

SEQ ID NO: 886368 - DNA, 25 bp, Mus musculus
tggcgattcctttggtagacttggc

SEQ ID NO: 886369 - DNA, 25 bp, Mus musculus
tggcgattctaaattccatgaagtt

SEQ ID NO: 886370 - DNA, 25 bp, Mus musculus
tggcgattctaatttccatgaagtt

SEQ ID NO: 886371 - DNA, 25 bp, Mus musculus
tggcgattggtgactttcgggccaa

SEQ ID NO: 886372 - DNA, 25 bp, Mus musculus
tggcgattggtgtctttcgggccaa

SEQ ID NO: 886373 - DNA, 25 bp, Mus musculus
tggcgcaagaacagagcaggacctc

SEQ ID NO: 886374 - DNA, 25 bp, Mus musculus
tggcgcaagaactgagcaggacctc

SEQ ID NO: 886375 - DNA, 25 bp, Mus musculus
tggcgcaatgttacccaggatggtc

SEQ ID NO: 886376 - DNA, 25 bp, Mus musculus
tggcgcaatgtttcccaggatggtc

SEQ ID NO: 886377 - DNA, 25 bp, Mus musculus
tggcgcacacgaatggctgtttctg

SEQ ID NO: 886378 - DNA, 25 bp, Mus musculus
tggcgcacacgattggctgtttctg

SEQ ID NO: 886379 - DNA, 25 bp, Mus musculus
tggcgcactcttcaagctcaggaca

SEQ ID NO: 886380 - DNA, 25 bp, Mus musculus
tggcgcactcttgaagctcaggaca

SEQ ID NO: 886381 - DNA, 25 bp, Mus musculus
tggcgcagacccaaccatgaagaac

SEQ ID NO: 886382 - DNA, 25 bp, Mus musculus
tggcgcagaccctaccatgaagaac

SEQ ID NO: 886383 - DNA, 25 bp, Mus musculus
tggcgcagcaaaaagcccgagtctc

SEQ ID NO: 886384 - DNA, 25 bp, Mus musculus
tggcgcagcaaatagcccgagtctc

SEQ ID NO: 886385 - DNA, 25 bp, Mus musculus
tggcgcagcactagagagctgtctg

SEQ ID NO: 886386 - DNA, 25 bp, Mus musculus
tggcgcagcacttgagagctgtctg

SEQ ID NO: 886387 - DNA, 25 bp, Mus musculus
tggcgcagcaggattagatggctat

SEQ ID NO: 886388 - DNA, 25 bp, Mus musculus
tggcgcagcaggtttagatggctat

SEQ ID NO: 886389 - DNA, 25 bp, Mus musculus
tggcgcagcccaaatgttcttacat

SEQ ID NO: 886390 - DNA, 25 bp, Mus musculus
tggcgcagcccatatgttcttacat

SEQ ID NO: 886391 - DNA, 25 bp, Mus musculus
tggcgcagctgcacatcgtgctcat

SEQ ID NO: 886392 - DNA, 25 bp, Mus musculus
tggcgcagctgctcatcgtgctcat

SEQ ID NO: 886393 - DNA, 25 bp, Mus musculus
tggcgcaggcatcattcctcaatga

SEQ ID NO: 886394 - DNA, 25 bp, Mus musculus
tggcgcaggcatgattcctcaatga

SEQ ID NO: 886395 - DNA, 25 bp, Mus musculus
tggcgcagggccctcggcgagccaa

SEQ ID NO: 886396 - DNA, 25 bp, Mus musculus
tggcgcagggccgtcggcgagccaa

SEQ ID NO: 886397 - DNA, 25 bp, Mus musculus
tggcgcataccacgtgcctatggag

SEQ ID NO: 886398 - DNA, 25 bp, Mus musculus
tggcgcataccaggtgcctatggag

SEQ ID NO: 886399 - DNA, 25 bp, Mus musculus
tggcgcatctgacacaggcttctgt

SEQ ID NO: 886400 - DNA, 25 bp, Mus musculus
tggcgcatctgagacaggcttctgt

SEQ ID NO: 886401 - DNA, 25 bp, Mus musculus
tggcgccacagaacttgtctagtat

SEQ ID NO: 886402 - DNA, 25 bp, Mus musculus
tggcgccacagatcttgtctagtat

SEQ ID NO: 886403 - DNA, 25 bp, Mus musculus
tggcgccaggctctgagctgaccac

SEQ ID NO: 886404 - DNA, 25 bp, Mus musculus
tggcgccaggctgtgagctgaccac

SEQ ID NO: 886405 - DNA, 25 bp, Mus musculus
tggcgccaggtcaggatagtttgct

SEQ ID NO: 886406 - DNA, 25 bp, Mus musculus
tggcgccaggtctggatagtttgct

SEQ ID NO: 886407 - DNA, 25 bp, Mus musculus
tggcgccagtggcacctccaagagt

SEQ ID NO: 886408 - DNA, 25 bp, Mus musculus
tggcgccagtgggacctccaagagt

SEQ ID NO: 886409 - DNA, 25 bp, Mus musculus
tggcgccatagactggtcctgaact

SEQ ID NO: 886410 - DNA, 25 bp, Mus musculus
tggcgccatagagtggtcctgaact

SEQ ID NO: 886411 - DNA, 25 bp, Mus musculus
tggcgcccaaccaaaccaataaagt

SEQ ID NO: 886412 - DNA, 25 bp, Mus musculus
tggcgcccaacctaaccaataaagt

SEQ ID NO: 886413 - DNA, 25 bp, Mus musculus
tggcgcccagcgagtataggtatac

SEQ ID NO: 886414 - DNA, 25 bp, Mus musculus
tggcgcccagcgtgtataggtatac

SEQ ID NO: 886415 - DNA, 25 bp, Mus musculus
tggcgccgatcacagtacgagtgct

SEQ ID NO: 886416 - DNA, 25 bp, Mus musculus
tggcgccgatcagagtacgagtgct

SEQ ID NO: 886417 - DNA, 25 bp, Mus musculus
tggcgccgcagtcgtccaccagata

SEQ ID NO: 886418 - DNA, 25 bp, Mus musculus
tggcgccgcagtggtccaccagata

SEQ ID NO: 886419 - DNA, 25 bp, Mus musculus
tggcgccggagcattgcagtgcaca

SEQ ID NO: 886420 - DNA, 25 bp, Mus musculus
tggcgccggagctttgcagtgcaca

SEQ ID NO: 886421 - DNA, 25 bp, Mus musculus
tggcgcctaatacagtgccttgcac

SEQ ID NO: 886422 - DNA, 25 bp, Mus musculus
tggcgcctaatagagtgccttgcac

SEQ ID NO: 886423 - DNA, 25 bp, Mus musculus
tggcgcctgcggaatcagagaactt

SEQ ID NO: 886424 - DNA, 25 bp, Mus musculus
tggcgcctgcggtatcagagaactt

SEQ ID NO: 886425 - DNA, 25 bp, Mus musculus
tggcgcctggataggttatgaacac

SEQ ID NO: 886426 - DNA, 25 bp, Mus musculus
tggcgcctggattggttatgaacac

SEQ ID NO: 886427 - DNA, 25 bp, Mus musculus
tggcgccttacgagaaccaagtgaa

SEQ ID NO: 886428 - DNA, 25 bp, Mus musculus
tggcgccttacgtgaaccaagtgaa

SEQ ID NO: 886429 - DNA, 25 bp, Mus musculus
tggcgcgacccacttcggtttattc

SEQ ID NO: 886430 - DNA, 25 bp, Mus musculus
tggcgcgacccagttcggtttattc

SEQ ID NO: 886431 - DNA, 25 bp, Mus musculus
tggcgcgatccaacttgaagaatct

SEQ ID NO: 886432 - DNA, 25 bp, Mus musculus
tggcgcgatccatcttgaagaatct

SEQ ID NO: 886433 - DNA, 25 bp, Mus musculus
tggcgcgcccatatagaatgttcac

SEQ ID NO: 886434 - DNA, 25 bp, Mus musculus
tggcgcgcccatttagaatgttcac

SEQ ID NO: 886435 - DNA, 25 bp, Mus musculus
tggcgcggaggcacttgaatctcac

SEQ ID NO: 886436 - DNA, 25 bp, Mus musculus
tggcgcggaggctcttgaatctcac

SEQ ID NO: 886437 - DNA, 25 bp, Mus musculus
tggcgcgggtctaggagcacaccca

SEQ ID NO: 886438 - DNA, 25 bp, Mus musculus
tggcgcgggtcttggagcacaccca

SEQ ID NO: 886439 - DNA, 25 bp, Mus musculus
tggcgcgtggccatgtttaaacacc

SEQ ID NO: 886440 - DNA, 25 bp, Mus musculus
tggcgcgtggccttgtttaaacacc

SEQ ID NO: 886441 - DNA, 25 bp, Mus musculus
tggcgcgtttatatgctattttcag

SEQ ID NO: 886442 - DNA, 25 bp, Mus musculus
tggcgcgtttatttgctattttcag

SEQ ID NO: 886443 - DNA, 25 bp, Mus musculus
tggcgctactctccctcgctaagag

SEQ ID NO: 886444 - DNA, 25 bp, Mus musculus
tggcgctactctgcctcgctaagag

SEQ ID NO: 886445 - DNA, 25 bp, Mus musculus
tggcgctagctgacgacgcggcctt

SEQ ID NO: 886446 - DNA, 25 bp, Mus musculus
tggcgctagctgtcgacgcggcctt

SEQ ID NO: 886447 - DNA, 25 bp, Mus musculus
tggcgctcaactactcggttttcta

SEQ ID NO: 886448 - DNA, 25 bp, Mus musculus
tggcgctcaacttctcggttttcta

SEQ ID NO: 886449 - DNA, 25 bp, Mus musculus
tggcgctcagcacttgatgttcttc

SEQ ID NO: 886450 - DNA, 25 bp, Mus musculus
tggcgctcagcagttgatgttcttc

SEQ ID NO: 886451 - DNA, 25 bp, Mus musculus
tggcgctcagtgcagtaaaaaccgt

SEQ ID NO: 886452 - DNA, 25 bp, Mus musculus
tggcgctcagtggagtaaaaaccgt

SEQ ID NO: 886453 - DNA, 25 bp, Mus musculus
tggcgctgacatccattgctcgtag

SEQ ID NO: 886454 - DNA, 25 bp, Mus musculus
tggcgctgacatgcattgctcgtag

SEQ ID NO: 886455 - DNA, 25 bp, Mus musculus
tggcgctgcttccactgaatgctag

SEQ ID NO: 886456 - DNA, 25 bp, Mus musculus
tggcgctgcttcgactgaatgctag

SEQ ID NO: 886457 - DNA, 25 bp, Mus musculus
tggcgctggatcaacaactctgtgt

SEQ ID NO: 886458 - DNA, 25 bp, Mus musculus
tggcgctggatctacaactctgtgt

SEQ ID NO: 886459 - DNA, 25 bp, Mus musculus
tggcgctggtcgaggagttcatcct

SEQ ID NO: 886460 - DNA, 25 bp, Mus musculus
tggcgctggtcgtggagttcatcct

SEQ ID NO: 886461 - DNA, 25 bp, Mus musculus
tggcgcttatgtacttagaggcacc

SEQ ID NO: 886462 - DNA, 25 bp, Mus musculus
tggcgcttatgttcttagaggcacc

SEQ ID NO: 886463 - DNA, 25 bp, Mus musculus
tggcgcttcagcaacatgcggcaat

SEQ ID NO: 886464 - DNA, 25 bp, Mus musculus
tggcgcttcagctacatgcggcaat

SEQ ID NO: 886465 - DNA, 25 bp, Mus musculus
tggcgcttcaggaccactgggtaga

SEQ ID NO: 886466 - DNA, 25 bp, Mus musculus
tggcgcttcaggtccactgggtaga

SEQ ID NO: 886467 - DNA, 25 bp, Mus musculus
tggcgcttcctcatctgaacatgct

SEQ ID NO: 886468 - DNA, 25 bp, Mus musculus
tggcgcttcctcttctgaacatgct

SEQ ID NO: 886469 - DNA, 25 bp, Mus musculus
tggcgcttcgtgaggatcatgctca

SEQ ID NO: 886470 - DNA, 25 bp, Mus musculus
tggcgcttcgtgtggatcatgctca

SEQ ID NO: 886471 - DNA, 25 bp, Mus musculus
tggcgcttgcttcatggacgtcgta

SEQ ID NO: 886472 - DNA, 25 bp, Mus musculus
tggcgcttgcttgatggacgtcgta

SEQ ID NO: 886473 - DNA, 25 bp, Mus musculus
tggcggaaaccacgagactcacaat

SEQ ID NO: 886474 - DNA, 25 bp, Mus musculus
tggcggaaaccaggagactcacaat

SEQ ID NO: 886475 - DNA, 25 bp, Mus musculus
tggcggaaattcaactggaagggct

SEQ ID NO: 886476 - DNA, 25 bp, Mus musculus
tggcggaaattctactggaagggct

SEQ ID NO: 886477 - DNA, 25 bp, Mus musculus
tggcggaatcagctcatttcataat

SEQ ID NO: 886478 - DNA, 25 bp, Mus musculus
tggcggaatcaggtcatttcataat

SEQ ID NO: 886479 - DNA, 25 bp, Mus musculus
tggcggacatccaatctcacatgga

SEQ ID NO: 886480 - DNA, 25 bp, Mus musculus
tggcggacatcctatctcacatgga

SEQ ID NO: 886481 - DNA, 25 bp, Mus musculus
tggcggacatggatgaagcagattt

SEQ ID NO: 886482 - DNA, 25 bp, Mus musculus
tggcggacatggttgaagcagattt

SEQ ID NO: 886483 - DNA, 25 bp, Mus musculus
tggcggagcgcacaggtcgcggtca

SEQ ID NO: 886484 - DNA, 25 bp, Mus musculus
tggcggagcgcagaggtcgcggtca

SEQ ID NO: 886485 - DNA, 25 bp, Mus musculus
tggcggaggagaacaccttccagga

SEQ ID NO: 886486 - DNA, 25 bp, Mus musculus
tggcggaggagatcaccttccagga

SEQ ID NO: 886487 - DNA, 25 bp, Mus musculus
tggcggatattcagtctctcaggga

SEQ ID NO: 886488 - DNA, 25 bp, Mus musculus
tggcggatattctgtctctcaggga

SEQ ID NO: 886489 - DNA, 25 bp, Mus musculus
tggcggatgaacacctgagacacta

SEQ ID NO: 886490 - DNA, 25 bp, Mus musculus
tggcggatgaactcctgagacacta

SEQ ID NO: 886491 - DNA, 25 bp, Mus musculus
tggcggatggcacgcagttctactc

SEQ ID NO: 886492 - DNA, 25 bp, Mus musculus
tggcggatggcaggcagttctactc

SEQ ID NO: 886493 - DNA, 25 bp, Mus musculus
tggcggatgtccacctgggagccac

SEQ ID NO: 886494 - DNA, 25 bp, Mus musculus
tggcggatgtcctcctgggagccac

SEQ ID NO: 886495 - DNA, 25 bp, Mus musculus
tggcggattcggctaccagaaaaca

SEQ ID NO: 886496 - DNA, 25 bp, Mus musculus
tggcggattcgggtaccagaaaaca

SEQ ID NO: 886497 - DNA, 25 bp, Mus musculus
tggcggcaaaaaccctgatcctgtg

SEQ ID NO: 886498 - DNA, 25 bp, Mus musculus
tggcggcaaaaagcctgatcctgtg

SEQ ID NO: 886499 - DNA, 25 bp, Mus musculus
tggcggcacagcactgacgagtgac

SEQ ID NO: 886500 - DNA, 25 bp, Mus musculus
tggcggcacagctctgacgagtgac

SEQ ID NO: 886501 - DNA, 25 bp, Mus musculus
tggcggccaaccaaaccaataaagt

SEQ ID NO: 886502 - DNA, 25 bp, Mus musculus
tggcggccaacctaaccaataaagt

SEQ ID NO: 886503 - DNA, 25 bp, Mus musculus
tggcggccaagaccatgaacctaga

SEQ ID NO: 886504 - DNA, 25 bp, Mus musculus
tggcggccaagagcatgaacctaga

SEQ ID NO: 886505 - DNA, 25 bp, Mus musculus
tggcggccaatgacatctcccaaaa

SEQ ID NO: 886506 - DNA, 25 bp, Mus musculus
tggcggccaatgtcatctcccaaaa

SEQ ID NO: 886507 - DNA, 25 bp, Mus musculus
tggcggccacctcctgtacggcaag

SEQ ID NO: 886508 - DNA, 25 bp, Mus musculus
tggcggccacctgctgtacggcaag

SEQ ID NO: 886509 - DNA, 25 bp, Mus musculus
tggcggccagtacccatcaagtcag

SEQ ID NO: 886510 - DNA, 25 bp, Mus musculus
tggcggccagtagccatcaagtcag

SEQ ID NO: 886511 - DNA, 25 bp, Mus musculus
tggcggccatatagaaattcgtcaa

SEQ ID NO: 886512 - DNA, 25 bp, Mus musculus
tggcggccatattgaaattcgtcaa

SEQ ID NO: 886513 - DNA, 25 bp, Mus musculus
tggcggccatccataatggtgggaa

SEQ ID NO: 886514 - DNA, 25 bp, Mus musculus
tggcggccatccttaatggtgggaa

SEQ ID NO: 886515 - DNA, 25 bp, Mus musculus
tggcggccccttaaaaagcatgact

SEQ ID NO: 886516 - DNA, 25 bp, Mus musculus
tggcggcccctttaaaagcatgact

SEQ ID NO: 886517 - DNA, 25 bp, Mus musculus
tggcggcctgggaggtattttaact

SEQ ID NO: 886518 - DNA, 25 bp, Mus musculus
tggcggcctgggtggtattttaact

SEQ ID NO: 886519 - DNA, 25 bp, Mus musculus
tggcggcggattactcagaattgtt

SEQ ID NO: 886520 - DNA, 25 bp, Mus musculus
tggcggcggatttctcagaattgtt

SEQ ID NO: 886521 - DNA, 25 bp, Mus musculus
tggcggcggcgacaaaccttaatcc

SEQ ID NO: 886522 - DNA, 25 bp, Mus musculus
tggcggcggcgagaaaccttaatcc

SEQ ID NO: 886523 - DNA, 25 bp, Mus musculus
tggcggcggcgtaacctgcggcgag

SEQ ID NO: 886524 - DNA, 25 bp, Mus musculus
tggcggcggcgttacctgcggcgag

SEQ ID NO: 886525 - DNA, 25 bp, Mus musculus
tggcggctacctctcaggtattcag

SEQ ID NO: 886526 - DNA, 25 bp, Mus musculus
tggcggctacctgtcaggtattcag

SEQ ID NO: 886527 - DNA, 25 bp, Mus musculus
tggcggctagatctacagcttgcaa

SEQ ID NO: 886528 - DNA, 25 bp, Mus musculus
tggcggctagatgtacagcttgcaa

SEQ ID NO: 886529 - DNA, 25 bp, Mus musculus
tggcggctatgaagctcagtactat

SEQ ID NO: 886530 - DNA, 25 bp, Mus musculus
tggcggctatgatgctcagtactat

SEQ ID NO: 886531 - DNA, 25 bp, Mus musculus
tggcggctatgtcgcattgtaagct

SEQ ID NO: 886532 - DNA, 25 bp, Mus musculus
tggcggctatgtggcattgtaagct

SEQ ID NO: 886533 - DNA, 25 bp, Mus musculus
tggcggctcaatcggctatagtgta

SEQ ID NO: 886534 - DNA, 25 bp, Mus musculus
tggcggctcaatgggctatagtgta

SEQ ID NO: 886535 - DNA, 25 bp, Mus musculus
tggcggcttgaaccaggaccctcag

SEQ ID NO: 886536 - DNA, 25 bp, Mus musculus
tggcggcttgaagcaggaccctcag

SEQ ID NO: 886537 - DNA, 25 bp, Mus musculus
tggcgggaatttcacctttccattt

SEQ ID NO: 886538 - DNA, 25 bp, Mus musculus
tggcgggaatttgacctttccattt

SEQ ID NO: 886539 - DNA, 25 bp, Mus musculus
tggcgggagtccagtatcttgcatc

SEQ ID NO: 886540 - DNA, 25 bp, Mus musculus
tggcgggagtcctgtatcttgcatc

SEQ ID NO: 886541 - DNA, 25 bp, Mus musculus
tggcgggcaagcaggaaatgacctt

SEQ ID NO: 886542 - DNA, 25 bp, Mus musculus
tggcgggcaagctggaaatgacctt

SEQ ID NO: 886543 - DNA, 25 bp, Mus musculus
tggcgggctagacatgctctgctta

SEQ ID NO: 886544 - DNA, 25 bp, Mus musculus
tggcgggctagagatgctctgctta

SEQ ID NO: 886545 - DNA, 25 bp, Mus musculus
tggcgggcttgcatctaggcttgat

SEQ ID NO: 886546 - DNA, 25 bp, Mus musculus
tggcgggcttgcttctaggcttgat

SEQ ID NO: 886547 - DNA, 25 bp, Mus musculus
tggcgggtgcttaggcctcgggccg

SEQ ID NO: 886548 - DNA, 25 bp, Mus musculus
tggcgggtgctttggcctcgggccg

SEQ ID NO: 886549 - DNA, 25 bp, Mus musculus
tggcgggtttacaccaagtccagag

SEQ ID NO: 886550 - DNA, 25 bp, Mus musculus
tggcgggtttactccaagtccagag

SEQ ID NO: 886551 - DNA, 25 bp, Mus musculus
tggcgggttttacacagtccttaag

SEQ ID NO: 886552 - DNA, 25 bp, Mus musculus
tggcgggttttagacagtccttaag

SEQ ID NO: 886553 - DNA, 25 bp, Mus musculus
tggcggtatattatactggagcaac

SEQ ID NO: 886554 - DNA, 25 bp, Mus musculus
tggcggtatattttactggagcaac

SEQ ID NO: 886555 - DNA, 25 bp, Mus musculus
tggcggtcacttcacgctcatctgc

SEQ ID NO: 886556 - DNA, 25 bp, Mus musculus
tggcggtcacttgacgctcatctgc

SEQ ID NO: 886557 - DNA, 25 bp, Mus musculus
tggcggtcatcaatttgaagcctgt

SEQ ID NO: 886558 - DNA, 25 bp, Mus musculus
tggcggtcatcattttgaagcctgt

SEQ ID NO: 886559 - DNA, 25 bp, Mus musculus
tggcggtctcctctattgatggtgt

SEQ ID NO: 886560 - DNA, 25 bp, Mus musculus
tggcggtctcctgtattgatggtgt

SEQ ID NO: 886561 - DNA, 25 bp, Mus musculus
tggcggtcttcaagagggagcactt

SEQ ID NO: 886562 - DNA, 25 bp, Mus musculus
tggcggtcttcatgagggagcactt

SEQ ID NO: 886563 - DNA, 25 bp, Mus musculus
tggcggtgactcacctgaaagtttc

SEQ ID NO: 886564 - DNA, 25 bp, Mus musculus
tggcggtgactctcctgaaagtttc

SEQ ID NO: 886565 - DNA, 25 bp, Mus musculus
tggcggtggcgcatgtttttaatcc

SEQ ID NO: 886566 - DNA, 25 bp, Mus musculus
tggcggtggcgcttgtttttaatcc

SEQ ID NO: 886567 - DNA, 25 bp, Mus musculus
tggcgtacactcacaccagtaaagt

SEQ ID NO: 886568 - DNA, 25 bp, Mus musculus
tggcgtacactctcaccagtaaagt

SEQ ID NO: 886569 - DNA, 25 bp, Mus musculus
tggcgtaggccacactagttcatga

SEQ ID NO: 886570 - DNA, 25 bp, Mus musculus
tggcgtaggccagactagttcatga

SEQ ID NO: 886571 - DNA, 25 bp, Mus musculus
tggcgtagtatacgccgcttttgct

SEQ ID NO: 886572 - DNA, 25 bp, Mus musculus
tggcgtagtataggccgcttttgct

SEQ ID NO: 886573 - DNA, 25 bp, Mus musculus
tggcgtatgccaactccggttctaa

SEQ ID NO: 886574 - DNA, 25 bp, Mus musculus
tggcgtatgccatctccggttctaa

SEQ ID NO: 886575 - DNA, 25 bp, Mus musculus
tggcgtatgtccaataccctaagtc

SEQ ID NO: 886576 - DNA, 25 bp, Mus musculus
tggcgtatgtcctataccctaagtc

SEQ ID NO: 886577 - DNA, 25 bp, Mus musculus
tggcgtatgtgtctattcagaagac

SEQ ID NO: 886578 - DNA, 25 bp, Mus musculus
tggcgtatgtgtgtattcagaagac

SEQ ID NO: 886579 - DNA, 25 bp, Mus musculus
tggcgtcaagctcacgatcctcctg

SEQ ID NO: 886580 - DNA, 25 bp, Mus musculus
tggcgtcaagctgacgatcctcctg

SEQ ID NO: 886581 - DNA, 25 bp, Mus musculus
tggcgtcaaggtccctaccctggga

SEQ ID NO: 886582 - DNA, 25 bp, Mus musculus
tggcgtcaaggtgcctaccctggga

SEQ ID NO: 886583 - DNA, 25 bp, Mus musculus
tggcgtcagcatcccttagagccaa

SEQ ID NO: 886584 - DNA, 25 bp, Mus musculus
tggcgtcagcatgccttagagccaa

SEQ ID NO: 886585 - DNA, 25 bp, Mus musculus
tggcgtcgaggtccggtttaaaaat

SEQ ID NO: 886586 - DNA, 25 bp, Mus musculus
tggcgtcgaggtgcggtttaaaaat

SEQ ID NO: 886587 - DNA, 25 bp, Mus musculus
tggcgtctagggaactgagtttctt

SEQ ID NO: 886588 - DNA, 25 bp, Mus musculus
tggcgtctagggtactgagtttctt

SEQ ID NO: 886589 - DNA, 25 bp, Mus musculus
tggcgtctatctcactgtgtcaaga

SEQ ID NO: 886590 - DNA, 25 bp, Mus musculus
tggcgtctatctgactgtgtcaaga

SEQ ID NO: 886591 - DNA, 25 bp, Mus musculus
tggcgtctcacaattgctgtgtcag

SEQ ID NO: 886592 - DNA, 25 bp, Mus musculus
tggcgtctcacatttgctgtgtcag

SEQ ID NO: 886593 - DNA, 25 bp, Mus musculus
tggcgtctcatcagtggaaaccttt

SEQ ID NO: 886594 - DNA, 25 bp, Mus musculus
tggcgtctcatctgtggaaaccttt

SEQ ID NO: 886595 - DNA, 25 bp, Mus musculus
tggcgtctccctaatcttggtagtg

SEQ ID NO: 886596 - DNA, 25 bp, Mus musculus
tggcgtctcccttatcttggtagtg

SEQ ID NO: 886597 - DNA, 25 bp, Mus musculus
tggcgtctcttcctgcatgggtgac

SEQ ID NO: 886598 - DNA, 25 bp, Mus musculus
tggcgtctcttcgtgcatgggtgac

SEQ ID NO: 886599 - DNA, 25 bp, Mus musculus
tggcgtctgtcgaccctggacgaac

SEQ ID NO: 886600 - DNA, 25 bp, Mus musculus
tggcgtctgtcgtccctggacgaac

SEQ ID NO: 886601 - DNA, 25 bp, Mus musculus
tggcgtgacaagcacagctgccttt

SEQ ID NO: 886602 - DNA, 25 bp, Mus musculus
tggcgtgacaaggacagctgccttt

SEQ ID NO: 886603 - DNA, 25 bp, Mus musculus
tggcgtgcacaaccagctctctgtg

SEQ ID NO: 886604 - DNA, 25 bp, Mus musculus
tggcgtgcacaagcagctctctgtg

SEQ ID NO: 886605 - DNA, 25 bp, Mus musculus
tggcgtgcacacacatcgtggcaag

SEQ ID NO: 886606 - DNA, 25 bp, Mus musculus
tggcgtgcacactcatcgtggcaag

SEQ ID NO: 886607 - DNA, 25 bp, Mus musculus
tggcgtgcagccctttggagtaccc

SEQ ID NO: 886608 - DNA, 25 bp, Mus musculus
tggcgtgcagccgtttggagtaccc

SEQ ID NO: 886609 - DNA, 25 bp, Mus musculus
tggcgtgccattacactatttccca

SEQ ID NO: 886610 - DNA, 25 bp, Mus musculus
tggcgtgccatttcactatttccca

SEQ ID NO: 886611 - DNA, 25 bp, Mus musculus
tggcgtgcccctattgaagcatgaa

SEQ ID NO: 886612 - DNA, 25 bp, Mus musculus
tggcgtgccccttttgaagcatgaa

SEQ ID NO: 886613 - DNA, 25 bp, Mus musculus
tggcgtgctcaaaatcataaggaag

SEQ ID NO: 886614 - DNA, 25 bp, Mus musculus
tggcgtgctcaatatcataaggaag

SEQ ID NO: 886615 - DNA, 25 bp, Mus musculus
tggcgtggccatacttatctgaggg

SEQ ID NO: 886616 - DNA, 25 bp, Mus musculus
tggcgtggccattcttatctgaggg

SEQ ID NO: 886617 - DNA, 25 bp, Mus musculus
tggcgtggtggcacattactataat

SEQ ID NO: 886618 - DNA, 25 bp, Mus musculus
tggcgtggtggctcattactataat

SEQ ID NO: 886619 - DNA, 25 bp, Mus musculus
tggcgtgtcctaatgaagctatttc

SEQ ID NO: 886620 - DNA, 25 bp, Mus musculus
tggcgtgtcctattgaagctatttc

SEQ ID NO: 886621 - DNA, 25 bp, Mus musculus
tggcgtgtctaaagcattctgtgtt

SEQ ID NO: 886622 - DNA, 25 bp, Mus musculus
tggcgtgtctaatgcattctgtgtt

SEQ ID NO: 886623 - DNA, 25 bp, Mus musculus
tggcgtgtctttaaagggcttgtct

SEQ ID NO: 886624 - DNA, 25 bp, Mus musculus
tggcgtgtcttttaagggcttgtct

SEQ ID NO: 886625 - DNA, 25 bp, Mus musculus
tggcgtgtgcaaacgggctgcccta

SEQ ID NO: 886626 - DNA, 25 bp, Mus musculus
tggcgtgtgcaatcgggctgcccta

SEQ ID NO: 886627 - DNA, 25 bp, Mus musculus
tggcgtgtgcttaatattctcgaaa

SEQ ID NO: 886628 - DNA, 25 bp, Mus musculus
tggcgtgtgctttatattctcgaaa

SEQ ID NO: 886629 - DNA, 25 bp, Mus musculus
tggcgtgtgtttaggtttctgcgca

SEQ ID NO: 886630 - DNA, 25 bp, Mus musculus
tggcgtgtgttttggtttctgcgca

SEQ ID NO: 886631 - DNA, 25 bp, Mus musculus
tggcgttaagttcacatacagacac

SEQ ID NO: 886632 - DNA, 25 bp, Mus musculus
tggcgttaagttgacatacagacac

SEQ ID NO: 886633 - DNA, 25 bp, Mus musculus
tggcgttacagacagttcgctatgc

SEQ ID NO: 886634 - DNA, 25 bp, Mus musculus
tggcgttacagagagttcgctatgc

SEQ ID NO: 886635 - DNA, 25 bp, Mus musculus
tggcgttagctgagtgttgatcttc

SEQ ID NO: 886636 - DNA, 25 bp, Mus musculus
tggcgttagctgtgtgttgatcttc

SEQ ID NO: 886637 - DNA, 25 bp, Mus musculus
tggcgttcaccgacccttggaggaa

SEQ ID NO: 886638 - DNA, 25 bp, Mus musculus
tggcgttcaccgtcccttggaggaa

SEQ ID NO: 886639 - DNA, 25 bp, Mus musculus
tggcgttcacctaaaagccctagaa

SEQ ID NO: 886640 - DNA, 25 bp, Mus musculus
tggcgttcaccttaaagccctagaa

SEQ ID NO: 886641 - DNA, 25 bp, Mus musculus
tggcgttccaatctcttgaccttga

SEQ ID NO: 886642 - DNA, 25 bp, Mus musculus
tggcgttccaatgtcttgaccttga

SEQ ID NO: 886643 - DNA, 25 bp, Mus musculus
tggcgttctggacccatggcatgca

SEQ ID NO: 886644 - DNA, 25 bp, Mus musculus
tggcgttctggagccatggcatgca

SEQ ID NO: 886645 - DNA, 25 bp, Mus musculus
tggcgttgctgaacaggccgctagc

SEQ ID NO: 886646 - DNA, 25 bp, Mus musculus
tggcgttgctgatcaggccgctagc

SEQ ID NO: 886647 - DNA, 25 bp, Mus musculus
tggcgtttactcattgacctggtgt

SEQ ID NO: 886648 - DNA, 25 bp, Mus musculus
tggcgtttactctttgacctggtgt

SEQ ID NO: 886649 - DNA, 25 bp, Mus musculus
tggcgtttccatcgctgcagtgttc

SEQ ID NO: 886650 - DNA, 25 bp, Mus musculus
tggcgtttccatggctgcagtgttc

SEQ ID NO: 886651 - DNA, 25 bp, Mus musculus
tggcgtttcctactcctaatgagag

SEQ ID NO: 886652 - DNA, 25 bp, Mus musculus
tggcgtttcctagtcctaatgagag

SEQ ID NO: 886653 - DNA, 25 bp, Mus musculus
tggcgtttccttatcagagaaattt

SEQ ID NO: 886654 - DNA, 25 bp, Mus musculus
tggcgtttccttttcagagaaattt

SEQ ID NO: 886655 - DNA, 25 bp, Mus musculus
tggcgtttgcatatcctgcagatga

SEQ ID NO: 886656 - DNA, 25 bp, Mus musculus
tggcgtttgcatttcctgcagatga

SEQ ID NO: 886657 - DNA, 25 bp, Mus musculus
tggcgtttgtgtaaaaccccacagc

SEQ ID NO: 886658 - DNA, 25 bp, Mus musculus
tggcgtttgtgttaaaccccacagc

SEQ ID NO: 886659 - DNA, 25 bp, Mus musculus
tggcgttttcccaccggccatttct

SEQ ID NO: 886660 - DNA, 25 bp, Mus musculus
tggcgttttccctccggccatttct

SEQ ID NO: 886661 - DNA, 25 bp, Mus musculus
tggctaaaacgcagctgctcatgga

SEQ ID NO: 886662 - DNA, 25 bp, Mus musculus
tggctaaaacgctgctgctcatgga

SEQ ID NO: 886663 - DNA, 25 bp, Mus musculus
tggctaaaatccatcattcaccttt

SEQ ID NO: 886664 - DNA, 25 bp, Mus musculus
tggctaaaatccttcattcaccttt

SEQ ID NO: 886665 - DNA, 25 bp, Mus musculus
tggctaaacacacagactccttgca

SEQ ID NO: 886666 - DNA, 25 bp, Mus musculus
tggctaaacacagagactccttgca

SEQ ID NO: 886667 - DNA, 25 bp, Mus musculus
tggctaaacactctactgacacttt

SEQ ID NO: 886668 - DNA, 25 bp, Mus musculus
tggctaaacactgtactgacacttt

SEQ ID NO: 886669 - DNA, 25 bp, Mus musculus
tggctaaactcaaacactcaactcg

SEQ ID NO: 886670 - DNA, 25 bp, Mus musculus
tggctaaactcatacactcaactcg

SEQ ID NO: 886671 - DNA, 25 bp, Mus musculus
tggctaaagccgaaggctgggcccc

SEQ ID NO: 886672 - DNA, 25 bp, Mus musculus
tggctaaagccgtaggctgggcccc

SEQ ID NO: 886673 - DNA, 25 bp, Mus musculus
tggctaacaaccacagcaactggtc

SEQ ID NO: 886674 - DNA, 25 bp, Mus musculus
tggctaacaacctcagcaactggtc

SEQ ID NO: 886675 - DNA, 25 bp, Mus musculus
tggctaacaagcactatttctaata

SEQ ID NO: 886676 - DNA, 25 bp, Mus musculus
tggctaacaagctctatttctaata

SEQ ID NO: 886677 - DNA, 25 bp, Mus musculus
tggctaacagcacgtttatctcggc

SEQ ID NO: 886678 - DNA, 25 bp, Mus musculus
tggctaacagcaggtttatctcggc

SEQ ID NO: 886679 - DNA, 25 bp, Mus musculus
tggctaacttccacctgaacaagtg

SEQ ID NO: 886680 - DNA, 25 bp, Mus musculus
tggctaacttcctcctgaacaagtg

SEQ ID NO: 886681 - DNA, 25 bp, Mus musculus
tggctaagcagtctttcaggaaggc

SEQ ID NO: 886682 - DNA, 25 bp, Mus musculus
tggctaagcagtgtttcaggaaggc

SEQ ID NO: 886683 - DNA, 25 bp, Mus musculus
tggctaagcgccaacggcatttgct

SEQ ID NO: 886684 - DNA, 25 bp, Mus musculus
tggctaagcgcctacggcatttgct

SEQ ID NO: 886685 - DNA, 25 bp, Mus musculus
tggctaagtggcagagctgctccta

SEQ ID NO: 886686 - DNA, 25 bp, Mus musculus
tggctaagtggctgagctgctccta

SEQ ID NO: 886687 - DNA, 25 bp, Mus musculus
tggctaagttctcaaggtttaattt

SEQ ID NO: 886688 - DNA, 25 bp, Mus musculus
tggctaagttctgaaggtttaattt

SEQ ID NO: 886689 - DNA, 25 bp, Mus musculus
tggctaagtttcaagtaaccttcat

SEQ ID NO: 886690 - DNA, 25 bp, Mus musculus
tggctaagtttctagtaaccttcat

SEQ ID NO: 886691 - DNA, 25 bp, Mus musculus
tggctaatctcgcacaatctttgtt

SEQ ID NO: 886692 - DNA, 25 bp, Mus musculus
tggctaatctcggacaatctttgtt

SEQ ID NO: 886693 - DNA, 25 bp, Mus musculus
tggctaatgcagcacgacctctctt

SEQ ID NO: 886694 - DNA, 25 bp, Mus musculus
tggctaatgcaggacgacctctctt

SEQ ID NO: 886695 - DNA, 25 bp, Mus musculus
tggctaatgcgcctttcctgtggtt

SEQ ID NO: 886696 - DNA, 25 bp, Mus musculus
tggctaatgcgcgtttcctgtggtt

SEQ ID NO: 886697 - DNA, 25 bp, Mus musculus
tggctacaaccgagtgattcttgct

SEQ ID NO: 886698 - DNA, 25 bp, Mus musculus
tggctacaaccgtgtgattcttgct

SEQ ID NO: 886699 - DNA, 25 bp, Mus musculus
tggctacaaggaactcatcacgtgc

SEQ ID NO: 886700 - DNA, 25 bp, Mus musculus
tggctacaaggatctcatcacgtgc

SEQ ID NO: 886701 - DNA, 25 bp, Mus musculus
tggctacaataccaaagtccctttg

SEQ ID NO: 886702 - DNA, 25 bp, Mus musculus
tggctacaatacgaaagtccctttg

SEQ ID NO: 886703 - DNA, 25 bp, Mus musculus
tggctacaatccataacctagagcg

SEQ ID NO: 886704 - DNA, 25 bp, Mus musculus
tggctacaatccttaacctagagcg

SEQ ID NO: 886705 - DNA, 25 bp, Mus musculus
tggctacaccagcagtacagttcgg

SEQ ID NO: 886706 - DNA, 25 bp, Mus musculus
tggctacaccaggagtacagttcgg

SEQ ID NO: 886707 - DNA, 25 bp, Mus musculus
tggctacacctgagttatcagaggt

SEQ ID NO: 886708 - DNA, 25 bp, Mus musculus
tggctacacctgtgttatcagaggt

SEQ ID NO: 886709 - DNA, 25 bp, Mus musculus
tggctacacgggaggatgggaggac

SEQ ID NO: 886710 - DNA, 25 bp, Mus musculus
tggctacacgggtggatgggaggac

SEQ ID NO: 886711 - DNA, 25 bp, Mus musculus
tggctacagcaaacactaaggaacc

SEQ ID NO: 886712 - DNA, 25 bp, Mus musculus
tggctacagcaatcactaaggaacc

SEQ ID NO: 886713 - DNA, 25 bp, Mus musculus
tggctacagcccaaggtaacacagt

SEQ ID NO: 886714 - DNA, 25 bp, Mus musculus
tggctacagccctaggtaacacagt

SEQ ID NO: 886715 - DNA, 25 bp, Mus musculus
tggctacatactcacatctcactgt

SEQ ID NO: 886716 - DNA, 25 bp, Mus musculus
tggctacatactgacatctcactgt

SEQ ID NO: 886717 - DNA, 25 bp, Mus musculus
tggctacatcctattctatcagtct

SEQ ID NO: 886718 - DNA, 25 bp, Mus musculus
tggctacatccttttctatcagtct

SEQ ID NO: 886719 - DNA, 25 bp, Mus musculus
tggctacatcttcggcaagcggatc

SEQ ID NO: 886720 - DNA, 25 bp, Mus musculus
tggctacatcttgggcaagcggatc

SEQ ID NO: 886721 - DNA, 25 bp, Mus musculus
tggctacattggatgagggactctc

SEQ ID NO: 886722 - DNA, 25 bp, Mus musculus
tggctacattggttgagggactctc

SEQ ID NO: 886723 - DNA, 25 bp, Mus musculus
tggctaccaaaaaggcacgtgtcac

SEQ ID NO: 886724 - DNA, 25 bp, Mus musculus
tggctaccaaaatggcacgtgtcac

SEQ ID NO: 886725 - DNA, 25 bp, Mus musculus
tggctaccaccgatgggactgtcta

SEQ ID NO: 886726 - DNA, 25 bp, Mus musculus
tggctaccaccgttgggactgtcta

SEQ ID NO: 886727 - DNA, 25 bp, Mus musculus
tggctaccagatccagctctgagat

SEQ ID NO: 886728 - DNA, 25 bp, Mus musculus
tggctaccagatgcagctctgagat

SEQ ID NO: 886729 - DNA, 25 bp, Mus musculus
tggctaccagccatgacatagcact

SEQ ID NO: 886730 - DNA, 25 bp, Mus musculus
tggctaccagccttgacatagcact

SEQ ID NO: 886731 - DNA, 25 bp, Mus musculus
tggctaccagtactccttcccagag

SEQ ID NO: 886732 - DNA, 25 bp, Mus musculus
tggctaccagtagtccttcccagag

SEQ ID NO: 886733 - DNA, 25 bp, Mus musculus
tggctaccagttacatcgcctactt

SEQ ID NO: 886734 - DNA, 25 bp, Mus musculus
tggctaccagtttcatcgcctactt

SEQ ID NO: 886735 - DNA, 25 bp, Mus musculus
tggctacccaccaaggcaagggcaa

SEQ ID NO: 886736 - DNA, 25 bp, Mus musculus
tggctacccacctaggcaagggcaa

SEQ ID NO: 886737 - DNA, 25 bp, Mus musculus
tggctacccagactgaaactgatta

SEQ ID NO: 886738 - DNA, 25 bp, Mus musculus
tggctacccagagtgaaactgatta

SEQ ID NO: 886739 - DNA, 25 bp, Mus musculus
tggctacccatgactactatcggcg

SEQ ID NO: 886740 - DNA, 25 bp, Mus musculus
tggctacccatgtctactatcggcg

SEQ ID NO: 886741 - DNA, 25 bp, Mus musculus
tggctaccccgaaggttcgcaataa

SEQ ID NO: 886742 - DNA, 25 bp, Mus musculus
tggctaccccgatggttcgcaataa

SEQ ID NO: 886743 - DNA, 25 bp, Mus musculus
tggctaccccttaggcagcagcgaa

SEQ ID NO: 886744 - DNA, 25 bp, Mus musculus
tggctacccctttggcagcagcgaa

SEQ ID NO: 886745 - DNA, 25 bp, Mus musculus
tggctaccctgaaccagtttgtttg

SEQ ID NO: 886746 - DNA, 25 bp, Mus musculus
tggctaccctgatccagtttgtttg

SEQ ID NO: 886747 - DNA, 25 bp, Mus musculus
tggctaccctggagctcgctgcata

SEQ ID NO: 886748 - DNA, 25 bp, Mus musculus
tggctaccctggcaggtgtctgttc

SEQ ID NO: 886749 - DNA, 25 bp, Mus musculus
tggctaccctgggaggtgtctgttc

SEQ ID NO: 886750 - DNA, 25 bp, Mus musculus
tggctaccctggtgctcgctgcata

SEQ ID NO: 886751 - DNA, 25 bp, Mus musculus
tggctaccgaaaaaatgaaggctat

SEQ ID NO: 886752 - DNA, 25 bp, Mus musculus
tggctaccgaaataatgaaggctat

SEQ ID NO: 886753 - DNA, 25 bp, Mus musculus
tggctaccgcatctccctggtgaag

SEQ ID NO: 886754 - DNA, 25 bp, Mus musculus
tggctaccgcatgtccctggtgaag

SEQ ID NO: 886755 - DNA, 25 bp, Mus musculus
tggctacctcaactgtattctcaag

SEQ ID NO: 886756 - DNA, 25 bp, Mus musculus
tggctacctcaagtgtattctcaag

SEQ ID NO: 886757 - DNA, 25 bp, Mus musculus
tggctacctgctaccacagggctaa

SEQ ID NO: 886758 - DNA, 25 bp, Mus musculus
tggctacctgcttccacagggctaa

SEQ ID NO: 886759 - DNA, 25 bp, Mus musculus
tggctacctggacattctgtctgcc

SEQ ID NO: 886760 - DNA, 25 bp, Mus musculus
tggctacctggagattctgtctgcc

SEQ ID NO: 886761 - DNA, 25 bp, Mus musculus
tggctacctgggctattgtaagcgt

SEQ ID NO: 886762 - DNA, 25 bp, Mus musculus
tggctacctggggtattgtaagcgt

SEQ ID NO: 886763 - DNA, 25 bp, Mus musculus
tggctaccttgacatgtgcctgctc

SEQ ID NO: 886764 - DNA, 25 bp, Mus musculus
tggctaccttgagatgtgcctgctc

SEQ ID NO: 886765 - DNA, 25 bp, Mus musculus
tggctacctttccatgtggctcagc

SEQ ID NO: 886766 - DNA, 25 bp, Mus musculus
tggctacctttcgatgtggctcagc

SEQ ID NO: 886767 - DNA, 25 bp, Mus musculus
tggctacgtgccagggcatcatcaa

SEQ ID NO: 886768 - DNA, 25 bp, Mus musculus
tggctacgtgcctgggcatcatcaa

SEQ ID NO: 886769 - DNA, 25 bp, Mus musculus
tggctactccagcacagatggatac

SEQ ID NO: 886770 - DNA, 25 bp, Mus musculus
tggctactccaggacagatggatac

SEQ ID NO: 886771 - DNA, 25 bp, Mus musculus
tggctactcttaagtcaccttgaca

SEQ ID NO: 886772 - DNA, 25 bp, Mus musculus
tggctactcttatgtcaccttgaca

SEQ ID NO: 886773 - DNA, 25 bp, Mus musculus
tggctactgatgcagcacaagagac

SEQ ID NO: 886774 - DNA, 25 bp, Mus musculus
tggctactgatggagcacaagagac

SEQ ID NO: 886775 - DNA, 25 bp, Mus musculus
tggctactgcctctggtcagggctt

SEQ ID NO: 886776 - DNA, 25 bp, Mus musculus
tggctactgcctgtggtcagggctt

SEQ ID NO: 886777 - DNA, 25 bp, Mus musculus
tggctactgctgcacgtttcacaca

SEQ ID NO: 886778 - DNA, 25 bp, Mus musculus
tggctactgctggacgtttcacaca

SEQ ID NO: 886779 - DNA, 25 bp, Mus musculus
tggctactggtcactaatatatttg

SEQ ID NO: 886780 - DNA, 25 bp, Mus musculus
tggctactggtctctaatatatttg

SEQ ID NO: 886781 - DNA, 25 bp, Mus musculus
tggctacttaaacgaccccgtgtga

SEQ ID NO: 886782 - DNA, 25 bp, Mus musculus
tggctacttaaaggaccccgtgtga

SEQ ID NO: 886783 - DNA, 25 bp, Mus musculus
tggctacttctacctggagtttgca

SEQ ID NO: 886784 - DNA, 25 bp, Mus musculus
tggctacttctagctggagtttgca

SEQ ID NO: 886785 - DNA, 25 bp, Mus musculus
tggctacttgtcactttccacaaag

SEQ ID NO: 886786 - DNA, 25 bp, Mus musculus
tggctacttgtctctttccacaaag

SEQ ID NO: 886787 - DNA, 25 bp, Mus musculus
tggctacttgtgctttgctctgtac

SEQ ID NO: 886788 - DNA, 25 bp, Mus musculus
tggctacttgtggtttgctctgtac

SEQ ID NO: 886789 - DNA, 25 bp, Mus musculus
tggctacttttgcatcttgttgctc

SEQ ID NO: 886790 - DNA, 25 bp, Mus musculus
tggctacttttggatcttgttgctc

SEQ ID NO: 886791 - DNA, 25 bp, Mus musculus
tggctagaaggcaacctgacagctt

SEQ ID NO: 886792 - DNA, 25 bp, Mus musculus
tggctagaaggctacctgacagctt

SEQ ID NO: 886793 - DNA, 25 bp, Mus musculus
tggctagacgaacacacactggtca

SEQ ID NO: 886794 - DNA, 25 bp, Mus musculus
tggctagacgaagacacactggtca

SEQ ID NO: 886795 - DNA, 25 bp, Mus musculus
tggctagagatcagttacacccttc

SEQ ID NO: 886796 - DNA, 25 bp, Mus musculus
tggctagagatctgttacacccttc

SEQ ID NO: 886797 - DNA, 25 bp, Mus musculus
tggctagcaagcctttggtgccctt

SEQ ID NO: 886798 - DNA, 25 bp, Mus musculus
tggctagcaagcgtttggtgccctt

SEQ ID NO: 886799 - DNA, 25 bp, Mus musculus
tggctagccaatacatgcactgtgt

SEQ ID NO: 886800 - DNA, 25 bp, Mus musculus
tggctagccaattcatgcactgtgt

SEQ ID NO: 886801 - DNA, 25 bp, Mus musculus
tggctagcctacactgcatcagtgt

SEQ ID NO: 886802 - DNA, 25 bp, Mus musculus
tggctagcctactctgcatcagtgt

SEQ ID NO: 886803 - DNA, 25 bp, Mus musculus
tggctagccttaatgtctgtctgtc

SEQ ID NO: 886804 - DNA, 25 bp, Mus musculus
tggctagccttattgtctgtctgtc

SEQ ID NO: 886805 - DNA, 25 bp, Mus musculus
tggctagctaataaaccctgtcaaa

SEQ ID NO: 886806 - DNA, 25 bp, Mus musculus
tggctagctaattaaccctgtcaaa

SEQ ID NO: 886807 - DNA, 25 bp, Mus musculus
tggctagctcacagctttgtttaag

SEQ ID NO: 886808 - DNA, 25 bp, Mus musculus
tggctagctcactgctttgtttaag

SEQ ID NO: 886809 - DNA, 25 bp, Mus musculus
tggctagctctcctcgaggatagga

SEQ ID NO: 886810 - DNA, 25 bp, Mus musculus
tggctagctctcgtcgaggatagga

SEQ ID NO: 886811 - DNA, 25 bp, Mus musculus
tggctagcttcaagggagtttcagt

SEQ ID NO: 886812 - DNA, 25 bp, Mus musculus
tggctagcttcatgggagtttcagt

SEQ ID NO: 886813 - DNA, 25 bp, Mus musculus
tggctaggaaatacttcggctctct

SEQ ID NO: 886814 - DNA, 25 bp, Mus musculus
tggctaggaaattcttcggctctct

SEQ ID NO: 886815 - DNA, 25 bp, Mus musculus
tggctaggagcaaaagctgccagtt

SEQ ID NO: 886816 - DNA, 25 bp, Mus musculus
tggctaggagcataagctgccagtt

SEQ ID NO: 886817 - DNA, 25 bp, Mus musculus
tggctaggagccagagcaccagtat

SEQ ID NO: 886818 - DNA, 25 bp, Mus musculus
tggctaggagcccttcaggcctctc

SEQ ID NO: 886819 - DNA, 25 bp, Mus musculus
tggctaggagccgttcaggcctctc

SEQ ID NO: 886820 - DNA, 25 bp, Mus musculus
tggctaggagcctgagcaccagtat

SEQ ID NO: 886821 - DNA, 25 bp, Mus musculus
tggctaggccgcagacatggactcc

SEQ ID NO: 886822 - DNA, 25 bp, Mus musculus
tggctaggccgctgacatggactcc

SEQ ID NO: 886823 - DNA, 25 bp, Mus musculus
tggctaggctagcagagcgctcaac

SEQ ID NO: 886824 - DNA, 25 bp, Mus musculus
tggctaggctaggagagcgctcaac

SEQ ID NO: 886825 - DNA, 25 bp, Mus musculus
tggctagggacacatggcaagaaac

SEQ ID NO: 886826 - DNA, 25 bp, Mus musculus
tggctagggacagatggcaagaaac

SEQ ID NO: 886827 - DNA, 25 bp, Mus musculus
tggctagggtgcacatcagtatgaa

SEQ ID NO: 886828 - DNA, 25 bp, Mus musculus
tggctagggtgctcatcagtatgaa

SEQ ID NO: 886829 - DNA, 25 bp, Mus musculus
tggctagtagcacgactcacactgt

SEQ ID NO: 886830 - DNA, 25 bp, Mus musculus
tggctagtagcaggactcacactgt

SEQ ID NO: 886831 - DNA, 25 bp, Mus musculus
tggctagtctacaccatagctcaaa

SEQ ID NO: 886832 - DNA, 25 bp, Mus musculus
tggctagtctactccatagctcaaa

SEQ ID NO: 886833 - DNA, 25 bp, Mus musculus
tggctagtctctacactttcaatca

SEQ ID NO: 886834 - DNA, 25 bp, Mus musculus
tggctagtctcttcactttcaatca

SEQ ID NO: 886835 - DNA, 25 bp, Mus musculus
tggctagtctgaagctggtcgcaca

SEQ ID NO: 886836 - DNA, 25 bp, Mus musculus
tggctagtctgatgctggtcgcaca

SEQ ID NO: 886837 - DNA, 25 bp, Mus musculus
tggctagtttaaaggcaacaacatc

SEQ ID NO: 886838 - DNA, 25 bp, Mus musculus
tggctagtttaatggcaacaacatc

SEQ ID NO: 886839 - DNA, 25 bp, Mus musculus
tggctagttttcagccaacctcaca

SEQ ID NO: 886840 - DNA, 25 bp, Mus musculus
tggctagttttctgccaacctcaca

SEQ ID NO: 886841 - DNA, 25 bp, Mus musculus
tggctataacttaggacgctacctg

SEQ ID NO: 886842 - DNA, 25 bp, Mus musculus
tggctataactttggacgctacctg

SEQ ID NO: 886843 - DNA, 25 bp, Mus musculus
tggctataccagaggcttttctcct

SEQ ID NO: 886844 - DNA, 25 bp, Mus musculus
tggctataccagtggcttttctcct

SEQ ID NO: 886845 - DNA, 25 bp, Mus musculus
tggctatatcatctacaggactcag

SEQ ID NO: 886846 - DNA, 25 bp, Mus musculus
tggctatatcatgtacaggactcag

SEQ ID NO: 886847 - DNA, 25 bp, Mus musculus
tggctatcaaacaagggtccctcat

SEQ ID NO: 886848 - DNA, 25 bp, Mus musculus
tggctatcaaactagggtccctcat

SEQ ID NO: 886849 - DNA, 25 bp, Mus musculus
tggctatcagatacgacgcttttgg

SEQ ID NO: 886850 - DNA, 25 bp, Mus musculus
tggctatcagattcgacgcttttgg

SEQ ID NO: 886851 - DNA, 25 bp, Mus musculus
tggctatcccacagtttgctatgca

SEQ ID NO: 886852 - DNA, 25 bp, Mus musculus
tggctatcccactgtttgctatgca

SEQ ID NO: 886853 - DNA, 25 bp, Mus musculus
tggctatcccagacttggcagatga

SEQ ID NO: 886854 - DNA, 25 bp, Mus musculus
tggctatcccagtcttggcagatga

SEQ ID NO: 886855 - DNA, 25 bp, Mus musculus
tggctatccctaagttttctatgag

SEQ ID NO: 886856 - DNA, 25 bp, Mus musculus
tggctatccctatgttttctatgag

SEQ ID NO: 886857 - DNA, 25 bp, Mus musculus
tggctatcccttccgaaatcctgag

SEQ ID NO: 886858 - DNA, 25 bp, Mus musculus
tggctatcccttgcgaaatcctgag

SEQ ID NO: 886859 - DNA, 25 bp, Mus musculus
tggctatcctagatgaggcccaggg

SEQ ID NO: 886860 - DNA, 25 bp, Mus musculus
tggctatcctagttgaggcccaggg

SEQ ID NO: 886861 - DNA, 25 bp, Mus musculus
tggctatcctataactcactgcata

SEQ ID NO: 886862 - DNA, 25 bp, Mus musculus
tggctatcctattactcactgcata

SEQ ID NO: 886863 - DNA, 25 bp, Mus musculus
tggctatcctgcaggagcatcgtga

SEQ ID NO: 886864 - DNA, 25 bp, Mus musculus
tggctatcctgctggagcatcgtga

SEQ ID NO: 886865 - DNA, 25 bp, Mus musculus
tggctatctggtaacatgtcaagtg

SEQ ID NO: 886866 - DNA, 25 bp, Mus musculus
tggctatctggtaactcactctata

SEQ ID NO: 886867 - DNA, 25 bp, Mus musculus
tggctatctggttacatgtcaagtg

SEQ ID NO: 886868 - DNA, 25 bp, Mus musculus
tggctatctggttactcactctata

SEQ ID NO: 886869 - DNA, 25 bp, Mus musculus
tggctatctgttaaaaattctgtta

SEQ ID NO: 886870 - DNA, 25 bp, Mus musculus
tggctatctgtttaaaattctgtta

SEQ ID NO: 886871 - DNA, 25 bp, Mus musculus
tggctatctttaattcattagaaat

SEQ ID NO: 886872 - DNA, 25 bp, Mus musculus
tggctatctttatttcattagaaat

SEQ ID NO: 886873 - DNA, 25 bp, Mus musculus
tggctatgactcctcagcagtaaga

SEQ ID NO: 886874 - DNA, 25 bp, Mus musculus
tggctatgactcgtcagcagtaaga

SEQ ID NO: 886875 - DNA, 25 bp, Mus musculus
tggctatgatgcccactgcggcctg

SEQ ID NO: 886876 - DNA, 25 bp, Mus musculus
tggctatgatgcgcactgcggcctg

SEQ ID NO: 886877 - DNA, 25 bp, Mus musculus
tggctatgccttcgcactgacaccg

SEQ ID NO: 886878 - DNA, 25 bp, Mus musculus
tggctatgccttggcactgacaccg

SEQ ID NO: 886879 - DNA, 25 bp, Mus musculus
tggctatgctcgaccttaagccgat

SEQ ID NO: 886880 - DNA, 25 bp, Mus musculus
tggctatgctcgtccttaagccgat

SEQ ID NO: 886881 - DNA, 25 bp, Mus musculus
tggctatggccaattaaggtcgctg

SEQ ID NO: 886882 - DNA, 25 bp, Mus musculus
tggctatggccatttaaggtcgctg

SEQ ID NO: 886883 - DNA, 25 bp, Mus musculus
tggctatggctcagaccaagggctc

SEQ ID NO: 886884 - DNA, 25 bp, Mus musculus
tggctatggctcatcctgaaggttg

SEQ ID NO: 886885 - DNA, 25 bp, Mus musculus
tggctatggctctgaccaagggctc

SEQ ID NO: 886886 - DNA, 25 bp, Mus musculus
tggctatggctcttcctgaaggttg

SEQ ID NO: 886887 - DNA, 25 bp, Mus musculus
tggctatgggacacttgatggcaaa

SEQ ID NO: 886888 - DNA, 25 bp, Mus musculus
tggctatgggactcttgatggcaaa

SEQ ID NO: 886889 - DNA, 25 bp, Mus musculus
tggctatgggctctgtctctttaga

SEQ ID NO: 886890 - DNA, 25 bp, Mus musculus
tggctatgggctgtgtctctttaga

SEQ ID NO: 886891 - DNA, 25 bp, Mus musculus
tggctatgtatgaatggctttctta

SEQ ID NO: 886892 - DNA, 25 bp, Mus musculus
tggctatgtatgtatggctttctta

SEQ ID NO: 886893 - DNA, 25 bp, Mus musculus
tggctatgtctacccatgtggaatt

SEQ ID NO: 886894 - DNA, 25 bp, Mus musculus
tggctatgtctagccatgtggaatt

SEQ ID NO: 886895 - DNA, 25 bp, Mus musculus
tggctatgtgcaatggagacaaact

SEQ ID NO: 886896 - DNA, 25 bp, Mus musculus
tggctatgtgcattggagacaaact

SEQ ID NO: 886897 - DNA, 25 bp, Mus musculus
tggctatgttctaccctgggtaggc

SEQ ID NO: 886898 - DNA, 25 bp, Mus musculus
tggctatgttcttccctgggtaggc

SEQ ID NO: 886899 - DNA, 25 bp, Mus musculus
tggctatgtttgattcccctgagga

SEQ ID NO: 886900 - DNA, 25 bp, Mus musculus
tggctatgtttgtttcccctgagga

SEQ ID NO: 886901 - DNA, 25 bp, Mus musculus
tggctattaactctgcctctctact

SEQ ID NO: 886902 - DNA, 25 bp, Mus musculus
tggctattaactgtgcctctctact

SEQ ID NO: 886903 - DNA, 25 bp, Mus musculus
tggctattagccatcccagaatctc

SEQ ID NO: 886904 - DNA, 25 bp, Mus musculus
tggctattagccttcccagaatctc

SEQ ID NO: 886905 - DNA, 25 bp, Mus musculus
tggctattcttcaactcctgggaga

SEQ ID NO: 886906 - DNA, 25 bp, Mus musculus
tggctattcttctactcctgggaga

SEQ ID NO: 886907 - DNA, 25 bp, Mus musculus
tggctattgatgattctttcagtga

SEQ ID NO: 886908 - DNA, 25 bp, Mus musculus
tggctattgatgctgctttgctttt

SEQ ID NO: 886909 - DNA, 25 bp, Mus musculus
tggctattgatggtgctttgctttt

SEQ ID NO: 886910 - DNA, 25 bp, Mus musculus
tggctattgatgtttctttcagtga

SEQ ID NO: 886911 - DNA, 25 bp, Mus musculus
tggctattgccgattttctttgaaa

SEQ ID NO: 886912 - DNA, 25 bp, Mus musculus
tggctattgccgtttttctttgaaa

SEQ ID NO: 886913 - DNA, 25 bp, Mus musculus
tggctatttctaattcttacctaaa

SEQ ID NO: 886914 - DNA, 25 bp, Mus musculus
tggctatttctatttcttacctaaa

SEQ ID NO: 886915 - DNA, 25 bp, Mus musculus
tggctatttctcaaactagggtcac

SEQ ID NO: 886916 - DNA, 25 bp, Mus musculus
tggctatttctctaactagggtcac

SEQ ID NO: 886917 - DNA, 25 bp, Mus musculus
tggctcaaagaacgacgaccgggct

SEQ ID NO: 886918 - DNA, 25 bp, Mus musculus
tggctcaaagaaggacgaccgggct

SEQ ID NO: 886919 - DNA, 25 bp, Mus musculus
tggctcaaatgactttccttggtga

SEQ ID NO: 886920 - DNA, 25 bp, Mus musculus
tggctcaaatgagtttccttggtga

SEQ ID NO: 886921 - DNA, 25 bp, Mus musculus
tggctcaaattgagggggctgtggc

SEQ ID NO: 886922 - DNA, 25 bp, Mus musculus
tggctcaaattgtgggggctgtggc

SEQ ID NO: 886923 - DNA, 25 bp, Mus musculus
tggctcaattctacacctatttttc

SEQ ID NO: 886924 - DNA, 25 bp, Mus musculus
tggctcaattcttcacctatttttc

SEQ ID NO: 886925 - DNA, 25 bp, Mus musculus
tggctcacaccaaccgacttgagta

SEQ ID NO: 886926 - DNA, 25 bp, Mus musculus
tggctcacaccatccgacttgagta

SEQ ID NO: 886927 - DNA, 25 bp, Mus musculus
tggctcacactcactaattactggg

SEQ ID NO: 886928 - DNA, 25 bp, Mus musculus
tggctcacactctctaattactggg

SEQ ID NO: 886929 - DNA, 25 bp, Mus musculus
tggctcacacttcgacgggtcaaag

SEQ ID NO: 886930 - DNA, 25 bp, Mus musculus
tggctcacacttggacgggtcaaag

SEQ ID NO: 886931 - DNA, 25 bp, Mus musculus
tggctcacagaaccgaatgcacaga

SEQ ID NO: 886932 - DNA, 25 bp, Mus musculus
tggctcacagaagcgaatgcacaga

SEQ ID NO: 886933 - DNA, 25 bp, Mus musculus
tggctcacagagaaagtctcagttt

SEQ ID NO: 886934 - DNA, 25 bp, Mus musculus
tggctcacagagtaagtctcagttt

SEQ ID NO: 886935 - DNA, 25 bp, Mus musculus
tggctcacagccatcattactccag

SEQ ID NO: 886936 - DNA, 25 bp, Mus musculus
tggctcacagccttcattactccag

SEQ ID NO: 886937 - DNA, 25 bp, Mus musculus
tggctcacagtaaaggcctgccatc

SEQ ID NO: 886938 - DNA, 25 bp, Mus musculus
tggctcacagtataggcctgccatc

SEQ ID NO: 886939 - DNA, 25 bp, Mus musculus
tggctcaccaagaaagtccttctca

SEQ ID NO: 886940 - DNA, 25 bp, Mus musculus
tggctcaccaagtaagtccttctca

SEQ ID NO: 886941 - DNA, 25 bp, Mus musculus
tggctcacctcactgtgtttctaaa

SEQ ID NO: 886942 - DNA, 25 bp, Mus musculus
tggctcacctcagtgtgtttctaaa

SEQ ID NO: 886943 - DNA, 25 bp, Mus musculus
tggctcacctgcacagctaaatcag

SEQ ID NO: 886944 - DNA, 25 bp, Mus musculus
tggctcacctgctcagctaaatcag

SEQ ID NO: 886945 - DNA, 25 bp, Mus musculus
tggctcacctttcaagatgttcaac

SEQ ID NO: 886946 - DNA, 25 bp, Mus musculus
tggctcacctttgaagatgttcaac

SEQ ID NO: 886947 - DNA, 25 bp, Mus musculus
tggctcacgtggctggcttcactgt

SEQ ID NO: 886948 - DNA, 25 bp, Mus musculus
tggctcacgtgggtggcttcactgt

SEQ ID NO: 886949 - DNA, 25 bp, Mus musculus
tggctcacttcaccaaggcttattg

SEQ ID NO: 886950 - DNA, 25 bp, Mus musculus
tggctcacttcagcaaggcttattg

SEQ ID NO: 886951 - DNA, 25 bp, Mus musculus
tggctcactttcacattaagatata

SEQ ID NO: 886952 - DNA, 25 bp, Mus musculus
tggctcactttctcattaagatata

SEQ ID NO: 886953 - DNA, 25 bp, Mus musculus
tggctcagaccccaactccagagtc

SEQ ID NO: 886954 - DNA, 25 bp, Mus musculus
tggctcagacccgaactccagagtc

SEQ ID NO: 886955 - DNA, 25 bp, Mus musculus
tggctcagagataacccttggaggt

SEQ ID NO: 886956 - DNA, 25 bp, Mus musculus
tggctcagagattacccttggaggt

SEQ ID NO: 886957 - DNA, 25 bp, Mus musculus
tggctcagaggtaccatgtgttcgc

SEQ ID NO: 886958 - DNA, 25 bp, Mus musculus
tggctcagaggttccatgtgttcgc

SEQ ID NO: 886959 - DNA, 25 bp, Mus musculus
tggctcagcaacatggcctgggcag

SEQ ID NO: 886960 - DNA, 25 bp, Mus musculus
tggctcagcaacttggcctgggcag

SEQ ID NO: 886961 - DNA, 25 bp, Mus musculus
tggctcagccgtacaatcactagat

SEQ ID NO: 886962 - DNA, 25 bp, Mus musculus
tggctcagccgttcaatcactagat

SEQ ID NO: 886963 - DNA, 25 bp, Mus musculus
tggctcagctacagggtcagggact

SEQ ID NO: 886964 - DNA, 25 bp, Mus musculus
tggctcagctactgggtcagggact

SEQ ID NO: 886965 - DNA, 25 bp, Mus musculus
tggctcagctgcctgctacccgatt

SEQ ID NO: 886966 - DNA, 25 bp, Mus musculus
tggctcagctgcgtgctacccgatt

SEQ ID NO: 886967 - DNA, 25 bp, Mus musculus
tggctcaggataactacaggtacat

SEQ ID NO: 886968 - DNA, 25 bp, Mus musculus
tggctcaggatatctacaggtacat

SEQ ID NO: 886969 - DNA, 25 bp, Mus musculus
tggctcaggctcaactactacctct

SEQ ID NO: 886970 - DNA, 25 bp, Mus musculus
tggctcaggctctactactacctct

SEQ ID NO: 886971 - DNA, 25 bp, Mus musculus
tggctcagggacatacaccatcagt

SEQ ID NO: 886972 - DNA, 25 bp, Mus musculus
tggctcagggacttacaccatcagt

SEQ ID NO: 886973 - DNA, 25 bp, Mus musculus
tggctcagggataaactcggcattt

SEQ ID NO: 886974 - DNA, 25 bp, Mus musculus
tggctcagggattaactcggcattt

SEQ ID NO: 886975 - DNA, 25 bp, Mus musculus
tggctcaggtgtcaccttctccttt

SEQ ID NO: 886976 - DNA, 25 bp, Mus musculus
tggctcaggtgtgaccttctccttt

SEQ ID NO: 886977 - DNA, 25 bp, Mus musculus
tggctcagtcagcaacctcagaact

SEQ ID NO: 886978 - DNA, 25 bp, Mus musculus
tggctcagtcaggaacctcagaact

SEQ ID NO: 886979 - DNA, 25 bp, Mus musculus
tggctcagtcctatgccaatggagt

SEQ ID NO: 886980 - DNA, 25 bp, Mus musculus
tggctcagtcctttgccaatggagt

SEQ ID NO: 886981 - DNA, 25 bp, Mus musculus
tggctcagtctcatacttgtcgaag

SEQ ID NO: 886982 - DNA, 25 bp, Mus musculus
tggctcagtctcttacttgtcgaag

SEQ ID NO: 886983 - DNA, 25 bp, Mus musculus
tggctcagtgttacccctgtggtat

SEQ ID NO: 886984 - DNA, 25 bp, Mus musculus
tggctcagtgtttcccctgtggtat

SEQ ID NO: 886985 - DNA, 25 bp, Mus musculus
tggctcatcccacttatgtttgctg

SEQ ID NO: 886986 - DNA, 25 bp, Mus musculus
tggctcatcccagttatgtttgctg

SEQ ID NO: 886987 - DNA, 25 bp, Mus musculus
tggctcatcttaactctgaggatca

SEQ ID NO: 886988 - DNA, 25 bp, Mus musculus
tggctcatcttatctctgaggatca

SEQ ID NO: 886989 - DNA, 25 bp, Mus musculus
tggctcatggtacagcacagtcatg

SEQ ID NO: 886990 - DNA, 25 bp, Mus musculus
tggctcatggtagagcacagtcatg

SEQ ID NO: 886991 - DNA, 25 bp, Mus musculus
tggctcatggtcctcaagatctcac

SEQ ID NO: 886992 - DNA, 25 bp, Mus musculus
tggctcatggtcgtcaagatctcac

SEQ ID NO: 886993 - DNA, 25 bp, Mus musculus
tggctcattataaggcatcaggact

SEQ ID NO: 886994 - DNA, 25 bp, Mus musculus
tggctcattatatggcatcaggact

SEQ ID NO: 886995 - DNA, 25 bp, Mus musculus
tggctcattgatccatgcccattag

SEQ ID NO: 886996 - DNA, 25 bp, Mus musculus
tggctcattgatgcatgcccattag

SEQ ID NO: 886997 - DNA, 25 bp, Mus musculus
tggctcatttcgacttcacttgcaa

SEQ ID NO: 886998 - DNA, 25 bp, Mus musculus
tggctcatttcgtcttcacttgcaa

SEQ ID NO: 886999 - DNA, 25 bp, Mus musculus
tggctcatttttaccgctttcaagt

SEQ ID NO: 887000 - DNA, 25 bp, Mus musculus
tggctcattttttccgctttcaagt

SEQ ID NO: 887001 - DNA, 25 bp, Mus musculus
tggctccaaacgctcgtttttgaaa

SEQ ID NO: 887002 - DNA, 25 bp, Mus musculus
tggctccaaacggtcgtttttgaaa

SEQ ID NO: 887003 - DNA, 25 bp, Mus musculus
tggctccaacacaccaggaggtcac

SEQ ID NO: 887004 - DNA, 25 bp, Mus musculus
tggctccaacactccaggaggtcac

SEQ ID NO: 887005 - DNA, 25 bp, Mus musculus
tggctccaaggaaaccgtgtttcct

SEQ ID NO: 887006 - DNA, 25 bp, Mus musculus
tggctccaaggataccgtgtttcct

SEQ ID NO: 887007 - DNA, 25 bp, Mus musculus
tggctccaatacagctactctgagg

SEQ ID NO: 887008 - DNA, 25 bp, Mus musculus
tggctccaatactgctactctgagg

SEQ ID NO: 887009 - DNA, 25 bp, Mus musculus
tggctccacagcctgaggttcagga

SEQ ID NO: 887010 - DNA, 25 bp, Mus musculus
tggctccacagcgtgaggttcagga

SEQ ID NO: 887011 - DNA, 25 bp, Mus musculus
tggctccacaggcaaactcacttgc

SEQ ID NO: 887012 - DNA, 25 bp, Mus musculus
tggctccacagggaaactcacttgc

SEQ ID NO: 887013 - DNA, 25 bp, Mus musculus
tggctccacagtattgaggtgcctg

SEQ ID NO: 887014 - DNA, 25 bp, Mus musculus
tggctccacagttttgaggtgcctg

SEQ ID NO: 887015 - DNA, 25 bp, Mus musculus
tggctccaccatctacttggtcagg

SEQ ID NO: 887016 - DNA, 25 bp, Mus musculus
tggctccaccatgtacttggtcagg

SEQ ID NO: 887017 - DNA, 25 bp, Mus musculus
tggctccacccaatggaacaggaaa

SEQ ID NO: 887018 - DNA, 25 bp, Mus musculus
tggctccacccattggaacaggaaa

SEQ ID NO: 887019 - DNA, 25 bp, Mus musculus
tggctccacctcaaaggtcaagctg

SEQ ID NO: 887020 - DNA, 25 bp, Mus musculus
tggctccacctctaaggtcaagctg

SEQ ID NO: 887021 - DNA, 25 bp, Mus musculus
tggctccacgagcactttctacttg

SEQ ID NO: 887022 - DNA, 25 bp, Mus musculus
tggctccacgaggactttctacttg

SEQ ID NO: 887023 - DNA, 25 bp, Mus musculus
tggctccactatcgaactgctgggt

SEQ ID NO: 887024 - DNA, 25 bp, Mus musculus
tggctccactatggaactgctgggt

SEQ ID NO: 887025 - DNA, 25 bp, Mus musculus
tggctccactgacttcttaacataa

SEQ ID NO: 887026 - DNA, 25 bp, Mus musculus
tggctccactgagttcttaacataa

SEQ ID NO: 887027 - DNA, 25 bp, Mus musculus
tggctccactgcattccatactgaa

SEQ ID NO: 887028 - DNA, 25 bp, Mus musculus
tggctccactgctttccatactgaa

SEQ ID NO: 887029 - DNA, 25 bp, Mus musculus
tggctccactggagcgttatctgaa

SEQ ID NO: 887030 - DNA, 25 bp, Mus musculus
tggctccactggtgcgttatctgaa

SEQ ID NO: 887031 - DNA, 25 bp, Mus musculus
tggctccagaaaagtccccaaggga

SEQ ID NO: 887032 - DNA, 25 bp, Mus musculus
tggctccagaaatgtccccaaggga

SEQ ID NO: 887033 - DNA, 25 bp, Mus musculus
tggctccagagaccctgctgtcact

SEQ ID NO: 887034 - DNA, 25 bp, Mus musculus
tggctccagagagcctgctgtcact

SEQ ID NO: 887035 - DNA, 25 bp, Mus musculus
tggctccagagtcccgtcgtaggaa

SEQ ID NO: 887036 - DNA, 25 bp, Mus musculus
tggctccagagtgccgtcgtaggaa

SEQ ID NO: 887037 - DNA, 25 bp, Mus musculus
tggctccaggctccaaattgaattg

SEQ ID NO: 887038 - DNA, 25 bp, Mus musculus
tggctccaggctgcaaattgaattg

SEQ ID NO: 887039 - DNA, 25 bp, Mus musculus
tggctccagtggctacatcgggtaa

SEQ ID NO: 887040 - DNA, 25 bp, Mus musculus
tggctccagtgggtacatcgggtaa

SEQ ID NO: 887041 - DNA, 25 bp, Mus musculus
tggctccatgctctcagaacaaaga

SEQ ID NO: 887042 - DNA, 25 bp, Mus musculus
tggctccatgctgtcagaacaaaga

SEQ ID NO: 887043 - DNA, 25 bp, Mus musculus
tggctccatgggatgtccaacagga

SEQ ID NO: 887044 - DNA, 25 bp, Mus musculus
tggctccatgggttgtccaacagga

SEQ ID NO: 887045 - DNA, 25 bp, Mus musculus
tggctccatttgctttggcactgcg

SEQ ID NO: 887046 - DNA, 25 bp, Mus musculus
tggctccatttggtttggcactgcg

SEQ ID NO: 887047 - DNA, 25 bp, Mus musculus
tggctccattttacagggtcacggg

SEQ ID NO: 887048 - DNA, 25 bp, Mus musculus
tggctccatttttcagggtcacggg

SEQ ID NO: 887049 - DNA, 25 bp, Mus musculus
tggctcccaaaccacagagagacat

SEQ ID NO: 887050 - DNA, 25 bp, Mus musculus
tggctcccaaacgacagagagacat

SEQ ID NO: 887051 - DNA, 25 bp, Mus musculus
tggctcccaagaacaaagctctgat

SEQ ID NO: 887052 - DNA, 25 bp, Mus musculus
tggctcccaagatcaaagctctgat

SEQ ID NO: 887053 - DNA, 25 bp, Mus musculus
tggctcccaagtcgctgtaattcca

SEQ ID NO: 887054 - DNA, 25 bp, Mus musculus
tggctcccaagtggctgtaattcca

SEQ ID NO: 887055 - DNA, 25 bp, Mus musculus
tggctcccacatccacagaagactt

SEQ ID NO: 887056 - DNA, 25 bp, Mus musculus
tggctcccacatgcacagaagactt

SEQ ID NO: 887057 - DNA, 25 bp, Mus musculus
tggctcccacctaaagcagcgtgct

SEQ ID NO: 887058 - DNA, 25 bp, Mus musculus
tggctcccaccttaagcagcgtgct

SEQ ID NO: 887059 - DNA, 25 bp, Mus musculus
tggctcccagaaagaagcttcggct

SEQ ID NO: 887060 - DNA, 25 bp, Mus musculus
tggctcccagaatgaagcttcggct

SEQ ID NO: 887061 - DNA, 25 bp, Mus musculus
tggctcccagatctctagggctcca

SEQ ID NO: 887062 - DNA, 25 bp, Mus musculus
tggctcccagatgtctagggctcca

SEQ ID NO: 887063 - DNA, 25 bp, Mus musculus
tggctcccagcgagcattcctggaa

SEQ ID NO: 887064 - DNA, 25 bp, Mus musculus
tggctcccagcgtgcattcctggaa

SEQ ID NO: 887065 - DNA, 25 bp, Mus musculus
tggctcccagctacttaacgataaa

SEQ ID NO: 887066 - DNA, 25 bp, Mus musculus
tggctcccagcttcttaacgataaa

SEQ ID NO: 887067 - DNA, 25 bp, Mus musculus
tggctcccaggacccttgtctctgg

SEQ ID NO: 887068 - DNA, 25 bp, Mus musculus
tggctcccaggagccttgtctctgg

SEQ ID NO: 887069 - DNA, 25 bp, Mus musculus
tggctcccagggaggtactgttgaa

SEQ ID NO: 887070 - DNA, 25 bp, Mus musculus
tggctcccagggtggtactgttgaa

SEQ ID NO: 887071 - DNA, 25 bp, Mus musculus
tggctcccaggtcggtgttttatct

SEQ ID NO: 887072 - DNA, 25 bp, Mus musculus
tggctcccaggtgggtgttttatct

SEQ ID NO: 887073 - DNA, 25 bp, Mus musculus
tggctcccagtcaattctgaagtct

SEQ ID NO: 887074 - DNA, 25 bp, Mus musculus
tggctcccagtctattctgaagtct

SEQ ID NO: 887075 - DNA, 25 bp, Mus musculus
tggctcccatacagcaggatcagtg

SEQ ID NO: 887076 - DNA, 25 bp, Mus musculus
tggctcccatactgcaggatcagtg

SEQ ID NO: 887077 - DNA, 25 bp, Mus musculus
tggctcccatttccatggtgttaat

SEQ ID NO: 887078 - DNA, 25 bp, Mus musculus
tggctcccatttgcatggtgttaat

SEQ ID NO: 887079 - DNA, 25 bp, Mus musculus
tggctcccctccagtttcagtgtaa

SEQ ID NO: 887080 - DNA, 25 bp, Mus musculus
tggctcccctcctgtttcagtgtaa

SEQ ID NO: 887081 - DNA, 25 bp, Mus musculus
tggctcccctgaagtcctgggtgac

SEQ ID NO: 887082 - DNA, 25 bp, Mus musculus
tggctcccctgatgtcctgggtgac

SEQ ID NO: 887083 - DNA, 25 bp, Mus musculus
tggctcccgagtacacacctggcag

SEQ ID NO: 887084 - DNA, 25 bp, Mus musculus
tggctcccgagttcacacctggcag

SEQ ID NO: 887085 - DNA, 25 bp, Mus musculus
tggctcccgtaactccccgtatgtt

SEQ ID NO: 887086 - DNA, 25 bp, Mus musculus
tggctcccgtaagtccccgtatgtt

SEQ ID NO: 887087 - DNA, 25 bp, Mus musculus
tggctccctatcctctggttggcta

SEQ ID NO: 887088 - DNA, 25 bp, Mus musculus
tggctccctatccttcttagcagac

SEQ ID NO: 887089 - DNA, 25 bp, Mus musculus
tggctccctatcgtctggttggcta

SEQ ID NO: 887090 - DNA, 25 bp, Mus musculus
tggctccctatcgttcttagcagac

SEQ ID NO: 887091 - DNA, 25 bp, Mus musculus
tggctccctgctatggcgatatgga

SEQ ID NO: 887092 - DNA, 25 bp, Mus musculus
tggctccctgctttggcgatatgga

SEQ ID NO: 887093 - DNA, 25 bp, Mus musculus
tggctccctgtgaactcaagtggcg

SEQ ID NO: 887094 - DNA, 25 bp, Mus musculus
tggctccctgtgtactcaagtggcg

SEQ ID NO: 887095 - DNA, 25 bp, Mus musculus
tggctccgacacattcagaactgga

SEQ ID NO: 887096 - DNA, 25 bp, Mus musculus
tggctccgacactttcagaactgga

SEQ ID NO: 887097 - DNA, 25 bp, Mus musculus
tggctccgatttatagacaccccta

SEQ ID NO: 887098 - DNA, 25 bp, Mus musculus
tggctccgatttttagacaccccta

SEQ ID NO: 887099 - DNA, 25 bp, Mus musculus
tggctccgcacacgagtacaggaac

SEQ ID NO: 887100 - DNA, 25 bp, Mus musculus
tggctccgcacaggagtacaggaac

SEQ ID NO: 887101 - DNA, 25 bp, Mus musculus
tggctccgcagaagcttgctaacat

SEQ ID NO: 887102 - DNA, 25 bp, Mus musculus
tggctccgcagatgcttgctaacat

SEQ ID NO: 887103 - DNA, 25 bp, Mus musculus
tggctccgcctccaatatttggcgg

SEQ ID NO: 887104 - DNA, 25 bp, Mus musculus
tggctccgcctcgaatatttggcgg

SEQ ID NO: 887105 - DNA, 25 bp, Mus musculus
tggctccgtagcaagttctgacatc

SEQ ID NO: 887106 - DNA, 25 bp, Mus musculus
tggctccgtagctagttctgacatc

SEQ ID NO: 887107 - DNA, 25 bp, Mus musculus
tggctccgtggtaaaggtgctttct

SEQ ID NO: 887108 - DNA, 25 bp, Mus musculus
tggctccgtggttaaggtgctttct

SEQ ID NO: 887109 - DNA, 25 bp, Mus musculus
tggctccgtgttacagattatctta

SEQ ID NO: 887110 - DNA, 25 bp, Mus musculus
tggctccgtgtttcagattatctta

SEQ ID NO: 887111 - DNA, 25 bp, Mus musculus
tggctcctaagcaccagtggtcagg

SEQ ID NO: 887112 - DNA, 25 bp, Mus musculus
tggctcctaagctccagtggtcagg

SEQ ID NO: 887113 - DNA, 25 bp, Mus musculus
tggctcctaaggctccagaagctgg

SEQ ID NO: 887114 - DNA, 25 bp, Mus musculus
tggctcctaagggtccagaagctgg

SEQ ID NO: 887115 - DNA, 25 bp, Mus musculus
tggctcctcaagatttggtgcccca

SEQ ID NO: 887116 - DNA, 25 bp, Mus musculus
tggctcctcaagttttggtgcccca

SEQ ID NO: 887117 - DNA, 25 bp, Mus musculus
tggctcctccacctggtatgagacc

SEQ ID NO: 887118 - DNA, 25 bp, Mus musculus
tggctcctccacgtggtatgagacc

SEQ ID NO: 887119 - DNA, 25 bp, Mus musculus
tggctcctccgcaaggcacatgaga

SEQ ID NO: 887120 - DNA, 25 bp, Mus musculus
tggctcctccgctaggcacatgaga

SEQ ID NO: 887121 - DNA, 25 bp, Mus musculus
tggctcctctcacctagtggagtga

SEQ ID NO: 887122 - DNA, 25 bp, Mus musculus
tggctcctctcagctagtggagtga

SEQ ID NO: 887123 - DNA, 25 bp, Mus musculus
tggctcctctggaattactcagtcc

SEQ ID NO: 887124 - DNA, 25 bp, Mus musculus
tggctcctctggtattactcagtcc

SEQ ID NO: 887125 - DNA, 25 bp, Mus musculus
tggctcctgatgaatttttgttcac

SEQ ID NO: 887126 - DNA, 25 bp, Mus musculus
tggctcctgatgtatttttgttcac

SEQ ID NO: 887127 - DNA, 25 bp, Mus musculus
tggctcctgcctagaagtcaccaag

SEQ ID NO: 887128 - DNA, 25 bp, Mus musculus
tggctcctgccttgaagtcaccaag

SEQ ID NO: 887129 - DNA, 25 bp, Mus musculus
tggctcctggacaacgacatagctt

SEQ ID NO: 887130 - DNA, 25 bp, Mus musculus
tggctcctggactacgacatagctt

SEQ ID NO: 887131 - DNA, 25 bp, Mus musculus
tggctcctgggacaactaactaact

SEQ ID NO: 887132 - DNA, 25 bp, Mus musculus
tggctcctgggacagttttcttaga

SEQ ID NO: 887133 - DNA, 25 bp, Mus musculus
tggctcctgggagaactaactaact

SEQ ID NO: 887134 - DNA, 25 bp, Mus musculus
tggctcctgggagagttttcttaga

SEQ ID NO: 887135 - DNA, 25 bp, Mus musculus
tggctcctgtggaccccattgagat

SEQ ID NO: 887136 - DNA, 25 bp, Mus musculus
tggctcctgtggtccccattgagat

SEQ ID NO: 887137 - DNA, 25 bp, Mus musculus
tggctcctgtttaaacttggctgac

SEQ ID NO: 887138 - DNA, 25 bp, Mus musculus
tggctcctgttttaacttggctgac

SEQ ID NO: 887139 - DNA, 25 bp, Mus musculus
tggctccttcagacatttcctggat

SEQ ID NO: 887140 - DNA, 25 bp, Mus musculus
tggctccttcagtcatttcctggat

SEQ ID NO: 887141 - DNA, 25 bp, Mus musculus
tggctccttcatcggactctgaaaa

SEQ ID NO: 887142 - DNA, 25 bp, Mus musculus
tggctccttcatgggactctgaaaa

SEQ ID NO: 887143 - DNA, 25 bp, Mus musculus
tggctccttgtgcaccaaagctgtt

SEQ ID NO: 887144 - DNA, 25 bp, Mus musculus
tggctccttgtggaccaaagctgtt

SEQ ID NO: 887145 - DNA, 25 bp, Mus musculus
tggctcctttggatgatggtagaac

SEQ ID NO: 887146 - DNA, 25 bp, Mus musculus
tggctcctttggttgatggtagaac

SEQ ID NO: 887147 - DNA, 25 bp, Mus musculus
tggctcctttgtcacctgacacttc

SEQ ID NO: 887148 - DNA, 25 bp, Mus musculus
tggctcctttgtgacctgacacttc

SEQ ID NO: 887149 - DNA, 25 bp, Mus musculus
tggctcctttttctacccttaaatg

SEQ ID NO: 887150 - DNA, 25 bp, Mus musculus
tggctcctttttgtacccttaaatg

SEQ ID NO: 887151 - DNA, 25 bp, Mus musculus
tggctcgagcttagcggagagtccc

SEQ ID NO: 887152 - DNA, 25 bp, Mus musculus
tggctcgagctttgcggagagtccc

SEQ ID NO: 887153 - DNA, 25 bp, Mus musculus
tggctcgattcgatgctggagaatt

SEQ ID NO: 887154 - DNA, 25 bp, Mus musculus
tggctcgattcgttgctggagaatt

SEQ ID NO: 887155 - DNA, 25 bp, Mus musculus
tggctcgcagttcgctttctctggg

SEQ ID NO: 887156 - DNA, 25 bp, Mus musculus
tggctcgcagttggctttctctggg

SEQ ID NO: 887157 - DNA, 25 bp, Mus musculus
tggctcgccagaaggccgaagagtc

SEQ ID NO: 887158 - DNA, 25 bp, Mus musculus
tggctcgccagatggccgaagagtc

SEQ ID NO: 887159 - DNA, 25 bp, Mus musculus
tggctcgctgtcctagaatctgaat

SEQ ID NO: 887160 - DNA, 25 bp, Mus musculus
tggctcgctgtcgtagaatctgaat

SEQ ID NO: 887161 - DNA, 25 bp, Mus musculus
tggctcgctttcagtgtctgttaaa

SEQ ID NO: 887162 - DNA, 25 bp, Mus musculus
tggctcgctttctgtgtctgttaaa

SEQ ID NO: 887163 - DNA, 25 bp, Mus musculus
tggctcggacttaggctgcagcgcc

SEQ ID NO: 887164 - DNA, 25 bp, Mus musculus
tggctcggactttggctgcagcgcc

SEQ ID NO: 887165 - DNA, 25 bp, Mus musculus
tggctcggcgcactgtctgtgttca

SEQ ID NO: 887166 - DNA, 25 bp, Mus musculus
tggctcggcgcagtgtctgtgttca

SEQ ID NO: 887167 - DNA, 25 bp, Mus musculus
tggctcgtaacactttttctgctcc

SEQ ID NO: 887168 - DNA, 25 bp, Mus musculus
tggctcgtaacagtttttctgctcc

SEQ ID NO: 887169 - DNA, 25 bp, Mus musculus
tggctcgtcatcaggtgtctcctta

SEQ ID NO: 887170 - DNA, 25 bp, Mus musculus
tggctcgtcatctggtgtctcctta

SEQ ID NO: 887171 - DNA, 25 bp, Mus musculus
tggctcgtgctgctcgctttggtac

SEQ ID NO: 887172 - DNA, 25 bp, Mus musculus
tggctcgtgctggtcgctttggtac

SEQ ID NO: 887173 - DNA, 25 bp, Mus musculus
tggctcgttcctcggcttcttaaag

SEQ ID NO: 887174 - DNA, 25 bp, Mus musculus
tggctcgttcctgggcttcttaaag

SEQ ID NO: 887175 - DNA, 25 bp, Mus musculus
tggctcgtttttcccagtggttcga

SEQ ID NO: 887176 - DNA, 25 bp, Mus musculus
tggctcgtttttgccagtggttcga

SEQ ID NO: 887177 - DNA, 25 bp, Mus musculus
tggctctaaagcacttagtccttct

SEQ ID NO: 887178 - DNA, 25 bp, Mus musculus
tggctctaaagctcttagtccttct

SEQ ID NO: 887179 - DNA, 25 bp, Mus musculus
tggctctaatccctccaaggtgcag

SEQ ID NO: 887180 - DNA, 25 bp, Mus musculus
tggctctaatccgtccaaggtgcag

SEQ ID NO: 887181 - DNA, 25 bp, Mus musculus
tggctctaatggattgcacaaaatc

SEQ ID NO: 887182 - DNA, 25 bp, Mus musculus
tggctctaatggtttgcacaaaatc

SEQ ID NO: 887183 - DNA, 25 bp, Mus musculus
tggctctacctcagcaactttatag

SEQ ID NO: 887184 - DNA, 25 bp, Mus musculus
tggctctacctctgcaactttatag

SEQ ID NO: 887185 - DNA, 25 bp, Mus musculus
tggctctatgccaagacactgtctg

SEQ ID NO: 887186 - DNA, 25 bp, Mus musculus
tggctctatgcctagacactgtctg

SEQ ID NO: 887187 - DNA, 25 bp, Mus musculus
tggctctcaaatatataccctctca

SEQ ID NO: 887188 - DNA, 25 bp, Mus musculus
tggctctcaaatttataccctctca

SEQ ID NO: 887189 - DNA, 25 bp, Mus musculus
tggctctcaaccacacataactaga

SEQ ID NO: 887190 - DNA, 25 bp, Mus musculus
tggctctcaacctcacataactaga

SEQ ID NO: 887191 - DNA, 25 bp, Mus musculus
tggctctcaagaacaggtttcaggc

SEQ ID NO: 887192 - DNA, 25 bp, Mus musculus
tggctctcaagatcaggtttcaggc

SEQ ID NO: 887193 - DNA, 25 bp, Mus musculus
tggctctcagccacacttagtgaac

SEQ ID NO: 887194 - DNA, 25 bp, Mus musculus
tggctctcagcctcacttagtgaac

SEQ ID NO: 887195 - DNA, 25 bp, Mus musculus
tggctctcatccatttagatttagt

SEQ ID NO: 887196 - DNA, 25 bp, Mus musculus
tggctctcatccttttagatttagt

SEQ ID NO: 887197 - DNA, 25 bp, Mus musculus
tggctctcatctacctggagggtgg

SEQ ID NO: 887198 - DNA, 25 bp, Mus musculus
tggctctcatcttcctggagggtgg

SEQ ID NO: 887199 - DNA, 25 bp, Mus musculus
tggctctcatttccctcctcagaag

SEQ ID NO: 887200 - DNA, 25 bp, Mus musculus
tggctctcatttgcctcctcagaag

SEQ ID NO: 887201 - DNA, 25 bp, Mus musculus
tggctctcccacagtggtggctcta

SEQ ID NO: 887202 - DNA, 25 bp, Mus musculus
tggctctcccactgtggtggctcta

SEQ ID NO: 887203 - DNA, 25 bp, Mus musculus
tggctctcccggaacggactctaaa

SEQ ID NO: 887204 - DNA, 25 bp, Mus musculus
tggctctcccggtacggactctaaa

SEQ ID NO: 887205 - DNA, 25 bp, Mus musculus
tggctctcccgtctgcaaaacagga

SEQ ID NO: 887206 - DNA, 25 bp, Mus musculus
tggctctcccgtgtgcaaaacagga

SEQ ID NO: 887207 - DNA, 25 bp, Mus musculus
tggctctcctaacagtgtcacgtgt

SEQ ID NO: 887208 - DNA, 25 bp, Mus musculus
tggctctcctaagagtgtcacgtgt

SEQ ID NO: 887209 - DNA, 25 bp, Mus musculus
tggctctcctacaggctctttttgg

SEQ ID NO: 887210 - DNA, 25 bp, Mus musculus
tggctctcctactggctctttttgg

SEQ ID NO: 887211 - DNA, 25 bp, Mus musculus
tggctctcctgtaagcatctggaat

SEQ ID NO: 887212 - DNA, 25 bp, Mus musculus
tggctctcctgtcaatcagcaagac

SEQ ID NO: 887213 - DNA, 25 bp, Mus musculus
tggctctcctgtgaatcagcaagac

SEQ ID NO: 887214 - DNA, 25 bp, Mus musculus
tggctctcctgttagcatctggaat

SEQ ID NO: 887215 - DNA, 25 bp, Mus musculus
tggctctcgcagcatttctcctaag

SEQ ID NO: 887216 - DNA, 25 bp, Mus musculus
tggctctcgcaggatttctcctaag

SEQ ID NO: 887217 - DNA, 25 bp, Mus musculus
tggctctcggtaccatctgtttata

SEQ ID NO: 887218 - DNA, 25 bp, Mus musculus
tggctctcggtagcatctgtttata

SEQ ID NO: 887219 - DNA, 25 bp, Mus musculus
tggctctctagacagctcatccaga

SEQ ID NO: 887220 - DNA, 25 bp, Mus musculus
tggctctctagagagctcatccaga

SEQ ID NO: 887221 - DNA, 25 bp, Mus musculus
tggctctctatcagggctcattgtg

SEQ ID NO: 887222 - DNA, 25 bp, Mus musculus
tggctctctatctgggctcattgtg

SEQ ID NO: 887223 - DNA, 25 bp, Mus musculus
tggctctctcaaagaactgctgcag

SEQ ID NO: 887224 - DNA, 25 bp, Mus musculus
tggctctctcaatgaactgctgcag

SEQ ID NO: 887225 - DNA, 25 bp, Mus musculus
tggctctctgtaccgttggttgata

SEQ ID NO: 887226 - DNA, 25 bp, Mus musculus
tggctctctgtagcgttggttgata

SEQ ID NO: 887227 - DNA, 25 bp, Mus musculus
tggctctctgttccagtgagcggcc

SEQ ID NO: 887228 - DNA, 25 bp, Mus musculus
tggctctctgttgcagtgagcggcc

SEQ ID NO: 887229 - DNA, 25 bp, Mus musculus
tggctctgaacccaagatccttttc

SEQ ID NO: 887230 - DNA, 25 bp, Mus musculus
tggctctgaaccgaagatccttttc

SEQ ID NO: 887231 - DNA, 25 bp, Mus musculus
tggctctgacagaactggaggccca

SEQ ID NO: 887232 - DNA, 25 bp, Mus musculus
tggctctgacagtactggaggccca

SEQ ID NO: 887233 - DNA, 25 bp, Mus musculus
tggctctgacatctacttccagtga

SEQ ID NO: 887234 - DNA, 25 bp, Mus musculus
tggctctgacatgtacttccagtga

SEQ ID NO: 887235 - DNA, 25 bp, Mus musculus
tggctctgacctcggcctgctacat

SEQ ID NO: 887236 - DNA, 25 bp, Mus musculus
tggctctgacctgggcctgctacat

SEQ ID NO: 887237 - DNA, 25 bp, Mus musculus
tggctctgacgtacgtggtctctaa

SEQ ID NO: 887238 - DNA, 25 bp, Mus musculus
tggctctgacgttcgtggtctctaa

SEQ ID NO: 887239 - DNA, 25 bp, Mus musculus
tggctctgatacaccactgagtttg

SEQ ID NO: 887240 - DNA, 25 bp, Mus musculus
tggctctgatactccactgagtttg

SEQ ID NO: 887241 - DNA, 25 bp, Mus musculus
tggctctgatatcaccatctccttg

SEQ ID NO: 887242 - DNA, 25 bp, Mus musculus
tggctctgatatgaccatctccttg

SEQ ID NO: 887243 - DNA, 25 bp, Mus musculus
tggctctgattcatgccgtctgcat

SEQ ID NO: 887244 - DNA, 25 bp, Mus musculus
tggctctgattcttgccgtctgcat

SEQ ID NO: 887245 - DNA, 25 bp, Mus musculus
tggctctgcaggctgaattcacctt

SEQ ID NO: 887246 - DNA, 25 bp, Mus musculus
tggctctgcagggtgaattcacctt

SEQ ID NO: 887247 - DNA, 25 bp, Mus musculus
tggctctgccatacacattccagga

SEQ ID NO: 887248 - DNA, 25 bp, Mus musculus
tggctctgccatagattctattagc

SEQ ID NO: 887249 - DNA, 25 bp, Mus musculus
tggctctgccattcacattccagga

SEQ ID NO: 887250 - DNA, 25 bp, Mus musculus
tggctctgccattgattctattagc

SEQ ID NO: 887251 - DNA, 25 bp, Mus musculus
tggctctgccctctgtatcaagtaa

SEQ ID NO: 887252 - DNA, 25 bp, Mus musculus
tggctctgccctgtgtatcaagtaa

SEQ ID NO: 887253 - DNA, 25 bp, Mus musculus
tggctctgcctgatttattgtctca

SEQ ID NO: 887254 - DNA, 25 bp, Mus musculus
tggctctgcctgctactacatggta

SEQ ID NO: 887255 - DNA, 25 bp, Mus musculus
tggctctgcctggtactacatggta

SEQ ID NO: 887256 - DNA, 25 bp, Mus musculus
tggctctgcctgttttattgtctca

SEQ ID NO: 887257 - DNA, 25 bp, Mus musculus
tggctctgctacagtccaaagacaa

SEQ ID NO: 887258 - DNA, 25 bp, Mus musculus
tggctctgctactgtccaaagacaa

SEQ ID NO: 887259 - DNA, 25 bp, Mus musculus
tggctctgctttcctattaggcagc

SEQ ID NO: 887260 - DNA, 25 bp, Mus musculus
tggctctgctttgctattaggcagc

SEQ ID NO: 887261 - DNA, 25 bp, Mus musculus
tggctctggcgaccaccctgagaga

SEQ ID NO: 887262 - DNA, 25 bp, Mus musculus
tggctctggcgagcaccctgagaga

SEQ ID NO: 887263 - DNA, 25 bp, Mus musculus
tggctctggctgcacacattctgaa

SEQ ID NO: 887264 - DNA, 25 bp, Mus musculus
tggctctggctggacacattctgaa

SEQ ID NO: 887265 - DNA, 25 bp, Mus musculus
tggctctggcttcaggaatcttgca

SEQ ID NO: 887266 - DNA, 25 bp, Mus musculus
tggctctggcttgaggaatcttgca

SEQ ID NO: 887267 - DNA, 25 bp, Mus musculus
tggctctgggtacgctctatggcaa

SEQ ID NO: 887268 - DNA, 25 bp, Mus musculus
tggctctgggtaggctctatggcaa

SEQ ID NO: 887269 - DNA, 25 bp, Mus musculus
tggctctgtaggcagtactctgtaa

SEQ ID NO: 887270 - DNA, 25 bp, Mus musculus
tggctctgtagggagtactctgtaa

SEQ ID NO: 887271 - DNA, 25 bp, Mus musculus
tggctctgtcccacattccaataac

SEQ ID NO: 887272 - DNA, 25 bp, Mus musculus
tggctctgtcccagaatttcatctc

SEQ ID NO: 887273 - DNA, 25 bp, Mus musculus
tggctctgtccctcattccaataac

SEQ ID NO: 887274 - DNA, 25 bp, Mus musculus
tggctctgtccctgaatttcatctc

SEQ ID NO: 887275 - DNA, 25 bp, Mus musculus
tggctctgtcctcctattttttaag

SEQ ID NO: 887276 - DNA, 25 bp, Mus musculus
tggctctgtcctgctattttttaag

SEQ ID NO: 887277 - DNA, 25 bp, Mus musculus
tggctctgtgacagtggagtccatt

SEQ ID NO: 887278 - DNA, 25 bp, Mus musculus
tggctctgtgactgtggagtccatt

SEQ ID NO: 887279 - DNA, 25 bp, Mus musculus
tggctctgtgagaaagtggctttga

SEQ ID NO: 887280 - DNA, 25 bp, Mus musculus
tggctctgtgagtaagtggctttga

SEQ ID NO: 887281 - DNA, 25 bp, Mus musculus
tggctctgtgatctgtacaacaccc

SEQ ID NO: 887282 - DNA, 25 bp, Mus musculus
tggctctgtgatgtgtacaacaccc

SEQ ID NO: 887283 - DNA, 25 bp, Mus musculus
tggctctgttaactctgttttgtaa

SEQ ID NO: 887284 - DNA, 25 bp, Mus musculus
tggctctgttaagtctgttttgtaa

SEQ ID NO: 887285 - DNA, 25 bp, Mus musculus
tggctcttagccagaataatgactt

SEQ ID NO: 887286 - DNA, 25 bp, Mus musculus
tggctcttagcctgaataatgactt

SEQ ID NO: 887287 - DNA, 25 bp, Mus musculus
tggctcttccaacaaaagtgcggtt

SEQ ID NO: 887288 - DNA, 25 bp, Mus musculus
tggctcttccaacaaggcaagacag

SEQ ID NO: 887289 - DNA, 25 bp, Mus musculus
tggctcttccaagaaaagtgcggtt

SEQ ID NO: 887290 - DNA, 25 bp, Mus musculus
tggctcttccaagaaggcaagacag

SEQ ID NO: 887291 - DNA, 25 bp, Mus musculus
tggctcttctgcaacatccaagttt

SEQ ID NO: 887292 - DNA, 25 bp, Mus musculus
tggctcttctgctacatccaagttt

SEQ ID NO: 887293 - DNA, 25 bp, Mus musculus
tggctcttgcatatctgttgcatct

SEQ ID NO: 887294 - DNA, 25 bp, Mus musculus
tggctcttgcatttctgttgcatct

SEQ ID NO: 887295 - DNA, 25 bp, Mus musculus
tggctcttgctaagagttcaatcct

SEQ ID NO: 887296 - DNA, 25 bp, Mus musculus
tggctcttgctatgagttcaatcct

SEQ ID NO: 887297 - DNA, 25 bp, Mus musculus
tggctcttggccaagctgagtgtac

SEQ ID NO: 887298 - DNA, 25 bp, Mus musculus
tggctcttggcctagctgagtgtac

SEQ ID NO: 887299 - DNA, 25 bp, Mus musculus
tggctcttgtaccttgggagattgt

SEQ ID NO: 887300 - DNA, 25 bp, Mus musculus
tggctcttgtacgttgggagattgt

SEQ ID NO: 887301 - DNA, 25 bp, Mus musculus
tggctcttgtagacttgaaattagg

SEQ ID NO: 887302 - DNA, 25 bp, Mus musculus
tggctcttgtagtcttgaaattagg

SEQ ID NO: 887303 - DNA, 25 bp, Mus musculus
tggctctttccaatgcatttttaag

SEQ ID NO: 887304 - DNA, 25 bp, Mus musculus
tggctctttccattgcatttttaag

SEQ ID NO: 887305 - DNA, 25 bp, Mus musculus
tggctctttctgaaggaaccctcct

SEQ ID NO: 887306 - DNA, 25 bp, Mus musculus
tggctctttctgactgaacactgtg

SEQ ID NO: 887307 - DNA, 25 bp, Mus musculus
tggctctttctgtaggaaccctcct

SEQ ID NO: 887308 - DNA, 25 bp, Mus musculus
tggctctttctgtctgaacactgtg

SEQ ID NO: 887309 - DNA, 25 bp, Mus musculus
tggctgaacagcacatgcgtgtttt

SEQ ID NO: 887310 - DNA, 25 bp, Mus musculus
tggctgaacagctcatgcgtgtttt

SEQ ID NO: 887311 - DNA, 25 bp, Mus musculus
tggctgaaccccactgaggttgagg

SEQ ID NO: 887312 - DNA, 25 bp, Mus musculus
tggctgaacccctctgaggttgagg

SEQ ID NO: 887313 - DNA, 25 bp, Mus musculus
tggctgaaccttagtctttcctttt

SEQ ID NO: 887314 - DNA, 25 bp, Mus musculus
tggctgaacctttgtctttcctttt

SEQ ID NO: 887315 - DNA, 25 bp, Mus musculus
tggctgaactaacaggtcgtcccat

SEQ ID NO: 887316 - DNA, 25 bp, Mus musculus
tggctgaactaagaggtcgtcccat

SEQ ID NO: 887317 - DNA, 25 bp, Mus musculus
tggctgaactagatccagacggcat

SEQ ID NO: 887318 - DNA, 25 bp, Mus musculus
tggctgaactagttccagacggcat

SEQ ID NO: 887319 - DNA, 25 bp, Mus musculus
tggctgaagacgatcctgagctcca

SEQ ID NO: 887320 - DNA, 25 bp, Mus musculus
tggctgaagacgttcctgagctcca

SEQ ID NO: 887321 - DNA, 25 bp, Mus musculus
tggctgaagcacatgtggctaagct

SEQ ID NO: 887322 - DNA, 25 bp, Mus musculus
tggctgaagcacttgtggctaagct

SEQ ID NO: 887323 - DNA, 25 bp, Mus musculus
tggctgaagtgcactgggagatcat

SEQ ID NO: 887324 - DNA, 25 bp, Mus musculus
tggctgaagtgctctgggagatcat

SEQ ID NO: 887325 - DNA, 25 bp, Mus musculus
tggctgaagttgacgtctgacgacg

SEQ ID NO: 887326 - DNA, 25 bp, Mus musculus
tggctgaagttgtcgtctgacgacg

SEQ ID NO: 887327 - DNA, 25 bp, Mus musculus
tggctgaatgacactcggctctaac

SEQ ID NO: 887328 - DNA, 25 bp, Mus musculus
tggctgaatgactctcggctctaac

SEQ ID NO: 887329 - DNA, 25 bp, Mus musculus
tggctgacacagaaatcacagcact

SEQ ID NO: 887330 - DNA, 25 bp, Mus musculus
tggctgacacagtaatcacagcact

SEQ ID NO: 887331 - DNA, 25 bp, Mus musculus
tggctgacaggcaccgatgcttcta

SEQ ID NO: 887332 - DNA, 25 bp, Mus musculus
tggctgacaggctccgatgcttcta

SEQ ID NO: 887333 - DNA, 25 bp, Mus musculus
tggctgacagtcaccgcagctgctg

SEQ ID NO: 887334 - DNA, 25 bp, Mus musculus
tggctgacagtctccgcagctgctg

SEQ ID NO: 887335 - DNA, 25 bp, Mus musculus
tggctgacatcaacaaccagactca

SEQ ID NO: 887336 - DNA, 25 bp, Mus musculus
tggctgacatcatcaaccagactca

SEQ ID NO: 887337 - DNA, 25 bp, Mus musculus
tggctgaccaggagctccaggattc

SEQ ID NO: 887338 - DNA, 25 bp, Mus musculus
tggctgaccaggtgctccaggattc

SEQ ID NO: 887339 - DNA, 25 bp, Mus musculus
tggctgaccagtcaactccagagat

SEQ ID NO: 887340 - DNA, 25 bp, Mus musculus
tggctgaccagtgaactccagagat

SEQ ID NO: 887341 - DNA, 25 bp, Mus musculus
tggctgacccagctggtgacccaga

SEQ ID NO: 887342 - DNA, 25 bp, Mus musculus
tggctgacccaggtggtgacccaga

SEQ ID NO: 887343 - DNA, 25 bp, Mus musculus
tggctgaccgggagcttcaggccaa

SEQ ID NO: 887344 - DNA, 25 bp, Mus musculus
tggctgaccgggtgcttcaggccaa

SEQ ID NO: 887345 - DNA, 25 bp, Mus musculus
tggctgacctacaacagctgcctga

SEQ ID NO: 887346 - DNA, 25 bp, Mus musculus
tggctgacctactacagctgcctga

SEQ ID NO: 887347 - DNA, 25 bp, Mus musculus
tggctgacctcaacgagtccatgct

SEQ ID NO: 887348 - DNA, 25 bp, Mus musculus
tggctgacctcatcgagtccatgct

SEQ ID NO: 887349 - DNA, 25 bp, Mus musculus
tggctgacctttatcttaactataa

SEQ ID NO: 887350 - DNA, 25 bp, Mus musculus
tggctgacctttttcttaactataa

SEQ ID NO: 887351 - DNA, 25 bp, Mus musculus
tggctgacgacccagagcatccaga

SEQ ID NO: 887352 - DNA, 25 bp, Mus musculus
tggctgacgaccgagagcatccaga

SEQ ID NO: 887353 - DNA, 25 bp, Mus musculus
tggctgactacaacaccgcagcata

SEQ ID NO: 887354 - DNA, 25 bp, Mus musculus
tggctgactacatcaccgcagcata

SEQ ID NO: 887355 - DNA, 25 bp, Mus musculus
tggctgactcacaggcccaggacag

SEQ ID NO: 887356 - DNA, 25 bp, Mus musculus
tggctgactcactggcccaggacag

SEQ ID NO: 887357 - DNA, 25 bp, Mus musculus
tggctgactgtcatcggagtcggac

SEQ ID NO: 887358 - DNA, 25 bp, Mus musculus
tggctgactgtcttcggagtcggac

SEQ ID NO: 887359 - DNA, 25 bp, Mus musculus
tggctgacttctatgatgatcaagc

SEQ ID NO: 887360 - DNA, 25 bp, Mus musculus
tggctgacttctttgatgatcaagc

SEQ ID NO: 887361 - DNA, 25 bp, Mus musculus
tggctgactttcacttaagattgga

SEQ ID NO: 887362 - DNA, 25 bp, Mus musculus
tggctgactttctcttaagattgga

SEQ ID NO: 887363 - DNA, 25 bp, Mus musculus
tggctgagagctcactttcatttat

SEQ ID NO: 887364 - DNA, 25 bp, Mus musculus
tggctgagagctgactttcatttat

SEQ ID NO: 887365 - DNA, 25 bp, Mus musculus
tggctgagaggcaaaggaaactcac

SEQ ID NO: 887366 - DNA, 25 bp, Mus musculus
tggctgagaggctaaggaaactcac

SEQ ID NO: 887367 - DNA, 25 bp, Mus musculus
tggctgagattgagtcccggatcga

SEQ ID NO: 887368 - DNA, 25 bp, Mus musculus
tggctgagattgtgtcccggatcga

SEQ ID NO: 887369 - DNA, 25 bp, Mus musculus
tggctgagcctgcagttaaatagtt

SEQ ID NO: 887370 - DNA, 25 bp, Mus musculus
tggctgagcctggagttaaatagtt

SEQ ID NO: 887371 - DNA, 25 bp, Mus musculus
tggctgagcgagcatctgagctacc

SEQ ID NO: 887372 - DNA, 25 bp, Mus musculus
tggctgagcgaggatctgagctacc

SEQ ID NO: 887373 - DNA, 25 bp, Mus musculus
tggctgagctttctgtgacatgttt

SEQ ID NO: 887374 - DNA, 25 bp, Mus musculus
tggctgagctttgtgtgacatgttt

SEQ ID NO: 887375 - DNA, 25 bp, Mus musculus
tggctgaggacaatctgtatcccga

SEQ ID NO: 887376 - DNA, 25 bp, Mus musculus
tggctgaggacattctgtatcccga

SEQ ID NO: 887377 - DNA, 25 bp, Mus musculus
tggctgaggccgaggctgccctaca

SEQ ID NO: 887378 - DNA, 25 bp, Mus musculus
tggctgaggccgtggctgccctaca

SEQ ID NO: 887379 - DNA, 25 bp, Mus musculus
tggctgaggtctcagtgtttgcttt

SEQ ID NO: 887380 - DNA, 25 bp, Mus musculus
tggctgaggtctgagtgtttgcttt

SEQ ID NO: 887381 - DNA, 25 bp, Mus musculus
tggctgagtcgaaggccaacctggt

SEQ ID NO: 887382 - DNA, 25 bp, Mus musculus
tggctgagtcgatggccaacctggt

SEQ ID NO: 887383 - DNA, 25 bp, Mus musculus
tggctgagttgcaagaccaggactt

SEQ ID NO: 887384 - DNA, 25 bp, Mus musculus
tggctgagttgctagaccaggactt

SEQ ID NO: 887385 - DNA, 25 bp, Mus musculus
tggctgagtttaaggaacccctctt

SEQ ID NO: 887386 - DNA, 25 bp, Mus musculus
tggctgagtttatggaacccctctt

SEQ ID NO: 887387 - DNA, 25 bp, Mus musculus
tggctgatagctacaaccccaggga

SEQ ID NO: 887388 - DNA, 25 bp, Mus musculus
tggctgatagcttcaaccccaggga

SEQ ID NO: 887389 - DNA, 25 bp, Mus musculus
tggctgatatctatggttcttactg

SEQ ID NO: 887390 - DNA, 25 bp, Mus musculus
tggctgatatctttggttcttactg

SEQ ID NO: 887391 - DNA, 25 bp, Mus musculus
tggctgatatgcaggactccccaaa

SEQ ID NO: 887392 - DNA, 25 bp, Mus musculus
tggctgatatgctggactccccaaa

SEQ ID NO: 887393 - DNA, 25 bp, Mus musculus
tggctgatcgccagtgttccaggct

SEQ ID NO: 887394 - DNA, 25 bp, Mus musculus
tggctgatcgcctgtgttccaggct

SEQ ID NO: 887395 - DNA, 25 bp, Mus musculus
tggctgatgcatcctctttggtggc

SEQ ID NO: 887396 - DNA, 25 bp, Mus musculus
tggctgatgcatgctctttggtggc

SEQ ID NO: 887397 - DNA, 25 bp, Mus musculus
tggctgatgcccaggcccatggagc

SEQ ID NO: 887398 - DNA, 25 bp, Mus musculus
tggctgatgccctggcccatggagc

SEQ ID NO: 887399 - DNA, 25 bp, Mus musculus
tggctgatggagagcctttgtaccc

SEQ ID NO: 887400 - DNA, 25 bp, Mus musculus
tggctgatggagtgcctttgtaccc

SEQ ID NO: 887401 - DNA, 25 bp, Mus musculus
tggctgatgggaactttgagacctt

SEQ ID NO: 887402 - DNA, 25 bp, Mus musculus
tggctgatgggatctttgagacctt

SEQ ID NO: 887403 - DNA, 25 bp, Mus musculus
tggctgcaacttcgcagccccaaaa

SEQ ID NO: 887404 - DNA, 25 bp, Mus musculus
tggctgcaacttggcagccccaaaa

SEQ ID NO: 887405 - DNA, 25 bp, Mus musculus
tggctgcaagacagtggcctcccga

SEQ ID NO: 887406 - DNA, 25 bp, Mus musculus
tggctgcaagacattcatgagtaca

SEQ ID NO: 887407 - DNA, 25 bp, Mus musculus
tggctgcaagactgtggcctcccga

SEQ ID NO: 887408 - DNA, 25 bp, Mus musculus
tggctgcaagactttcatgagtaca

SEQ ID NO: 887409 - DNA, 25 bp, Mus musculus
tggctgcacacaatctgaactcacc

SEQ ID NO: 887410 - DNA, 25 bp, Mus musculus
tggctgcacacattctgaactcacc

SEQ ID NO: 887411 - DNA, 25 bp, Mus musculus
tggctgcaccctaggcaagaggtca

SEQ ID NO: 887412 - DNA, 25 bp, Mus musculus
tggctgcacccttggcaagaggtca

SEQ ID NO: 887413 - DNA, 25 bp, Mus musculus
tggctgcaccgtcacattgctggag

SEQ ID NO: 887414 - DNA, 25 bp, Mus musculus
tggctgcaccgtgacattgctggag

SEQ ID NO: 887415 - DNA, 25 bp, Mus musculus
tggctgcacgtgcacatgggtgtct

SEQ ID NO: 887416 - DNA, 25 bp, Mus musculus
tggctgcacgtggacatgggtgtct

SEQ ID NO: 887417 - DNA, 25 bp, Mus musculus
tggctgcactgcaccagtattgagt

SEQ ID NO: 887418 - DNA, 25 bp, Mus musculus
tggctgcactgctccagtattgagt

SEQ ID NO: 887419 - DNA, 25 bp, Mus musculus
tggctgcagacgaatcacatcctag

SEQ ID NO: 887420 - DNA, 25 bp, Mus musculus
tggctgcagacgtatcacatcctag

SEQ ID NO: 887421 - DNA, 25 bp, Mus musculus
tggctgcagcatacctgttgaacat

SEQ ID NO: 887422 - DNA, 25 bp, Mus musculus
tggctgcagcattcctgttgaacat

SEQ ID NO: 887423 - DNA, 25 bp, Mus musculus
tggctgcagccacaactgaacctca

SEQ ID NO: 887424 - DNA, 25 bp, Mus musculus
tggctgcagccagaactgaacctca

SEQ ID NO: 887425 - DNA, 25 bp, Mus musculus
tggctgcagcccatatacagtgctt

SEQ ID NO: 887426 - DNA, 25 bp, Mus musculus
tggctgcagcccttatacagtgctt

SEQ ID NO: 887427 - DNA, 25 bp, Mus musculus
tggctgcagctgaaccacatgcttt

SEQ ID NO: 887428 - DNA, 25 bp, Mus musculus
tggctgcagctgtaccacatgcttt

SEQ ID NO: 887429 - DNA, 25 bp, Mus musculus
tggctgcaggccatatttacctaag

SEQ ID NO: 887430 - DNA, 25 bp, Mus musculus
tggctgcaggccttatttacctaag

SEQ ID NO: 887431 - DNA, 25 bp, Mus musculus
tggctgcagggtaaaccctacacac

SEQ ID NO: 887432 - DNA, 25 bp, Mus musculus
tggctgcagggttaaccctacacac

SEQ ID NO: 887433 - DNA, 25 bp, Mus musculus
tggctgcagtgaaatgtttttatca

SEQ ID NO: 887434 - DNA, 25 bp, Mus musculus
tggctgcagtgatatgtttttatca

SEQ ID NO: 887435 - DNA, 25 bp, Mus musculus
tggctgcagtgccttcctcatgaag

SEQ ID NO: 887436 - DNA, 25 bp, Mus musculus
tggctgcagtgcgttcctcatgaag

SEQ ID NO: 887437 - DNA, 25 bp, Mus musculus
tggctgcagttccatgctcttttgc

SEQ ID NO: 887438 - DNA, 25 bp, Mus musculus
tggctgcagttcgatgctcttttgc

SEQ ID NO: 887439 - DNA, 25 bp, Mus musculus
tggctgcagttgcactccacacatc

SEQ ID NO: 887440 - DNA, 25 bp, Mus musculus
tggctgcagttggactccacacatc

SEQ ID NO: 887441 - DNA, 25 bp, Mus musculus
tggctgcatatacctgtaaccacag

SEQ ID NO: 887442 - DNA, 25 bp, Mus musculus
tggctgcatatagctgtaaccacag

SEQ ID NO: 887443 - DNA, 25 bp, Mus musculus
tggctgcatgcaccagtgattttgt

SEQ ID NO: 887444 - DNA, 25 bp, Mus musculus
tggctgcatgcagcagtgattttgt

SEQ ID NO: 887445 - DNA, 25 bp, Mus musculus
tggctgcatggtactctgtaaattc

SEQ ID NO: 887446 - DNA, 25 bp, Mus musculus
tggctgcatggttctctgtaaattc

SEQ ID NO: 887447 - DNA, 25 bp, Mus musculus
tggctgcattgcagtcggctcccag

SEQ ID NO: 887448 - DNA, 25 bp, Mus musculus
tggctgcattgctgtcggctcccag

SEQ ID NO: 887449 - DNA, 25 bp, Mus musculus
tggctgcatttaatagtctagtctg

SEQ ID NO: 887450 - DNA, 25 bp, Mus musculus
tggctgcatttattagtctagtctg

SEQ ID NO: 887451 - DNA, 25 bp, Mus musculus
tggctgccaaagactctgctgcaag

SEQ ID NO: 887452 - DNA, 25 bp, Mus musculus
tggctgccaaagtctctgctgcaag

SEQ ID NO: 887453 - DNA, 25 bp, Mus musculus
tggctgccatagatttgcccgttct

SEQ ID NO: 887454 - DNA, 25 bp, Mus musculus
tggctgccatagttttgcccgttct

SEQ ID NO: 887455 - DNA, 25 bp, Mus musculus
tggctgccattaatcatagccgctt

SEQ ID NO: 887456 - DNA, 25 bp, Mus musculus
tggctgccattattcatagccgctt

SEQ ID NO: 887457 - DNA, 25 bp, Mus musculus
tggctgccatttactgacaaacctg

SEQ ID NO: 887458 - DNA, 25 bp, Mus musculus
tggctgccattttctgacaaacctg

SEQ ID NO: 887459 - DNA, 25 bp, Mus musculus
tggctgccccatcctattctttagg

SEQ ID NO: 887460 - DNA, 25 bp, Mus musculus
tggctgccccatgctattctttagg

SEQ ID NO: 887461 - DNA, 25 bp, Mus musculus
tggctgcccctacacgaagataaag

SEQ ID NO: 887462 - DNA, 25 bp, Mus musculus
tggctgcccctagacgaagataaag

SEQ ID NO: 887463 - DNA, 25 bp, Mus musculus
tggctgccccttctttctaggtaat

SEQ ID NO: 887464 - DNA, 25 bp, Mus musculus
tggctgccccttgtttctaggtaat

SEQ ID NO: 887465 - DNA, 25 bp, Mus musculus
tggctgcccgctaagaatctcaatt

SEQ ID NO: 887466 - DNA, 25 bp, Mus musculus
tggctgcccgcttagaatctcaatt

SEQ ID NO: 887467 - DNA, 25 bp, Mus musculus
tggctgccctacatgtcatgtggtg

SEQ ID NO: 887468 - DNA, 25 bp, Mus musculus
tggctgccctacttgtcatgtggtg

SEQ ID NO: 887469 - DNA, 25 bp, Mus musculus
tggctgccgattctgttaaacgaac

SEQ ID NO: 887470 - DNA, 25 bp, Mus musculus
tggctgccgattgtgttaaacgaac

SEQ ID NO: 887471 - DNA, 25 bp, Mus musculus
tggctgccggctatgaggaacacaa

SEQ ID NO: 887472 - DNA, 25 bp, Mus musculus
tggctgccggctttgaggaacacaa

SEQ ID NO: 887473 - DNA, 25 bp, Mus musculus
tggctgcctcatcttttatcacgca

SEQ ID NO: 887474 - DNA, 25 bp, Mus musculus
tggctgcctcatgttttatcacgca

SEQ ID NO: 887475 - DNA, 25 bp, Mus musculus
tggctgcctctgctaggactacagg

SEQ ID NO: 887476 - DNA, 25 bp, Mus musculus
tggctgcctctggtaggactacagg

SEQ ID NO: 887477 - DNA, 25 bp, Mus musculus
tggctgcctcttcggatgaagcctg

SEQ ID NO: 887478 - DNA, 25 bp, Mus musculus
tggctgcctcttgggatgaagcctg

SEQ ID NO: 887479 - DNA, 25 bp, Mus musculus
tggctgcctgagacgcacagagtga

SEQ ID NO: 887480 - DNA, 25 bp, Mus musculus
tggctgcctgagtcgcacagagtga

SEQ ID NO: 887481 - DNA, 25 bp, Mus musculus
tggctgcctggaaccgtgttgaaga

SEQ ID NO: 887482 - DNA, 25 bp, Mus musculus
tggctgcctggatccgtgttgaaga

SEQ ID NO: 887483 - DNA, 25 bp, Mus musculus
tggctgcctgggaaatgtcacctta

SEQ ID NO: 887484 - DNA, 25 bp, Mus musculus
tggctgcctgggtaatgtcacctta

SEQ ID NO: 887485 - DNA, 25 bp, Mus musculus
tggctgcctggtcaaacagtctcaa

SEQ ID NO: 887486 - DNA, 25 bp, Mus musculus
tggctgcctggtgaaacagtctcaa

SEQ ID NO: 887487 - DNA, 25 bp, Mus musculus
tggctgcctgttctcaactttttat

SEQ ID NO: 887488 - DNA, 25 bp, Mus musculus
tggctgcctgttgtcaactttttat

SEQ ID NO: 887489 - DNA, 25 bp, Mus musculus
tggctgccttgcaggaagacattca

SEQ ID NO: 887490 - DNA, 25 bp, Mus musculus
tggctgccttgctggaagacattca

SEQ ID NO: 887491 - DNA, 25 bp, Mus musculus
tggctgctagacataggcggctcgc

SEQ ID NO: 887492 - DNA, 25 bp, Mus musculus
tggctgctagacttaggcggctcgc

SEQ ID NO: 887493 - DNA, 25 bp, Mus musculus
tggctgctagccctgtggtgtgggc

SEQ ID NO: 887494 - DNA, 25 bp, Mus musculus
tggctgctagccgtgtggtgtgggc

SEQ ID NO: 887495 - DNA, 25 bp, Mus musculus
tggctgctcacaacaagtgccccag

SEQ ID NO: 887496 - DNA, 25 bp, Mus musculus
tggctgctcacatcaagtgccccag

SEQ ID NO: 887497 - DNA, 25 bp, Mus musculus
tggctgctcaggactaattctaaca

SEQ ID NO: 887498 - DNA, 25 bp, Mus musculus
tggctgctcaggtctaattctaaca

SEQ ID NO: 887499 - DNA, 25 bp, Mus musculus
tggctgctcattctgtcatctacaa

SEQ ID NO: 887500 - DNA, 25 bp, Mus musculus
tggctgctcattgtgtcatctacaa

SEQ ID NO: 887501 - DNA, 25 bp, Mus musculus
tggctgctccatactttcataggca

SEQ ID NO: 887502 - DNA, 25 bp, Mus musculus
tggctgctccattctttcataggca

SEQ ID NO: 887503 - DNA, 25 bp, Mus musculus
tggctgctcccgaacccagcgtaga

SEQ ID NO: 887504 - DNA, 25 bp, Mus musculus
tggctgctcccgtacccagcgtaga

SEQ ID NO: 887505 - DNA, 25 bp, Mus musculus
tggctgctcctaaactggtttccag

SEQ ID NO: 887506 - DNA, 25 bp, Mus musculus
tggctgctcctatactggtttccag

SEQ ID NO: 887507 - DNA, 25 bp, Mus musculus
tggctgctcgtgaagagggctccta

SEQ ID NO: 887508 - DNA, 25 bp, Mus musculus
tggctgctcgtgtagagggctccta

SEQ ID NO: 887509 - DNA, 25 bp, Mus musculus
tggctgctctagaatgctctatgca

SEQ ID NO: 887510 - DNA, 25 bp, Mus musculus
tggctgctctagtatgctctatgca

SEQ ID NO: 887511 - DNA, 25 bp, Mus musculus
tggctgctctcacagtggcttgtaa

SEQ ID NO: 887512 - DNA, 25 bp, Mus musculus
tggctgctctcagagtggcttgtaa

SEQ ID NO: 887513 - DNA, 25 bp, Mus musculus
tggctgctctccaaagaaccgaaaa

SEQ ID NO: 887514 - DNA, 25 bp, Mus musculus
tggctgctctccaatccaagaagag

SEQ ID NO: 887515 - DNA, 25 bp, Mus musculus
tggctgctctcctaagaaccgaaaa

SEQ ID NO: 887516 - DNA, 25 bp, Mus musculus
tggctgctctcctatccaagaagag

SEQ ID NO: 887517 - DNA, 25 bp, Mus musculus
tggctgctctgtcacaattcttgga

SEQ ID NO: 887518 - DNA, 25 bp, Mus musculus
tggctgctctgtgacaattcttgga

SEQ ID NO: 887519 - DNA, 25 bp, Mus musculus
tggctgctgacacctacaaagagtt

SEQ ID NO: 887520 - DNA, 25 bp, Mus musculus
tggctgctgacagctacaaagagtt

SEQ ID NO: 887521 - DNA, 25 bp, Mus musculus
tggctgctgaccagagaccaaactc

SEQ ID NO: 887522 - DNA, 25 bp, Mus musculus
tggctgctgacctgagaccaaactc

SEQ ID NO: 887523 - DNA, 25 bp, Mus musculus
tggctgctgcatccctgtgagagat

SEQ ID NO: 887524 - DNA, 25 bp, Mus musculus
tggctgctgcatgcctgtgagagat

SEQ ID NO: 887525 - DNA, 25 bp, Mus musculus
tggctgctgcgcacttgactttatt

SEQ ID NO: 887526 - DNA, 25 bp, Mus musculus
tggctgctgcgctcttgactttatt

SEQ ID NO: 887527 - DNA, 25 bp, Mus musculus
tggctgctgctgagatttttgaaag

SEQ ID NO: 887528 - DNA, 25 bp, Mus musculus
tggctgctgctgtgatttttgaaag

SEQ ID NO: 887529 - DNA, 25 bp, Mus musculus
tggctgctggcgaaacatatggtac

SEQ ID NO: 887530 - DNA, 25 bp, Mus musculus
tggctgctggcgtaacatatggtac

SEQ ID NO: 887531 - DNA, 25 bp, Mus musculus
tggctgctgggaaaaccatgcttga

SEQ ID NO: 887532 - DNA, 25 bp, Mus musculus
tggctgctgggataaccatgcttga

SEQ ID NO: 887533 - DNA, 25 bp, Mus musculus
tggctgctggtcacctcagtgggca

SEQ ID NO: 887534 - DNA, 25 bp, Mus musculus
tggctgctggtctcctcagtgggca

SEQ ID NO: 887535 - DNA, 25 bp, Mus musculus
tggctgctgtaactcactgtcgctc

SEQ ID NO: 887536 - DNA, 25 bp, Mus musculus
tggctgctgtaagtcactgtcgctc

SEQ ID NO: 887537 - DNA, 25 bp, Mus musculus
tggctgctgtagctggaattccagt

SEQ ID NO: 887538 - DNA, 25 bp, Mus musculus
tggctgctgtaggtggaattccagt

SEQ ID NO: 887539 - DNA, 25 bp, Mus musculus
tggctgctgtgcagatcatcatgac

SEQ ID NO: 887540 - DNA, 25 bp, Mus musculus
tggctgctgtgctgatcatcatgac

SEQ ID NO: 887541 - DNA, 25 bp, Mus musculus
tggctgctgtggctacggaccatct

SEQ ID NO: 887542 - DNA, 25 bp, Mus musculus
tggctgctgtgggtacggaccatct

SEQ ID NO: 887543 - DNA, 25 bp, Mus musculus
tggctgcttaacagtgaactatggc

SEQ ID NO: 887544 - DNA, 25 bp, Mus musculus
tggctgcttaactgtgaactatggc

SEQ ID NO: 887545 - DNA, 25 bp, Mus musculus
tggctgcttatgatgcctgtgccac

SEQ ID NO: 887546 - DNA, 25 bp, Mus musculus
tggctgcttatgttgcctgtgccac

SEQ ID NO: 887547 - DNA, 25 bp, Mus musculus
tggctgcttccaagttgttaggaat

SEQ ID NO: 887548 - DNA, 25 bp, Mus musculus
tggctgcttccatgttgttaggaat

SEQ ID NO: 887549 - DNA, 25 bp, Mus musculus
tggctgcttctaagtagtcctacca

SEQ ID NO: 887550 - DNA, 25 bp, Mus musculus
tggctgcttctatgtagtcctacca

SEQ ID NO: 887551 - DNA, 25 bp, Mus musculus
tggctgcttggtagggttttctctc

SEQ ID NO: 887552 - DNA, 25 bp, Mus musculus
tggctgcttggtattactcccacaa

SEQ ID NO: 887553 - DNA, 25 bp, Mus musculus
tggctgcttggttgggttttctctc

SEQ ID NO: 887554 - DNA, 25 bp, Mus musculus
tggctgcttggttttactcccacaa

SEQ ID NO: 887555 - DNA, 25 bp, Mus musculus
tggctgctttagattcctgccacct

SEQ ID NO: 887556 - DNA, 25 bp, Mus musculus
tggctgctttagtttcctgccacct

SEQ ID NO: 887557 - DNA, 25 bp, Mus musculus
tggctgctttgcaatagcttgctta

SEQ ID NO: 887558 - DNA, 25 bp, Mus musculus
tggctgctttgctatagcttgctta

SEQ ID NO: 887559 - DNA, 25 bp, Mus musculus
tggctgctttttactgttgtctgaa

SEQ ID NO: 887560 - DNA, 25 bp, Mus musculus
tggctgcttttttctgttgtctgaa

SEQ ID NO: 887561 - DNA, 25 bp, Mus musculus
tggctggaaaccaggcagtgatacc

SEQ ID NO: 887562 - DNA, 25 bp, Mus musculus
tggctggaaacctggcagtgatacc

SEQ ID NO: 887563 - DNA, 25 bp, Mus musculus
tggctggaactgattgtttctaagt

SEQ ID NO: 887564 - DNA, 25 bp, Mus musculus
tggctggaactgtttgtttctaagt

SEQ ID NO: 887565 - DNA, 25 bp, Mus musculus
tggctggaattaccacagtacttat

SEQ ID NO: 887566 - DNA, 25 bp, Mus musculus
tggctggaattagcacagtacttat

SEQ ID NO: 887567 - DNA, 25 bp, Mus musculus
tggctggacaagcttttaggaagtt

SEQ ID NO: 887568 - DNA, 25 bp, Mus musculus
tggctggacaaggttttaggaagtt

SEQ ID NO: 887569 - DNA, 25 bp, Mus musculus
tggctggaccctatgatgggctgct

SEQ ID NO: 887570 - DNA, 25 bp, Mus musculus
tggctggaccctttgatgggctgct

SEQ ID NO: 887571 - DNA, 25 bp, Mus musculus
tggctggactcaatggactggctgt

SEQ ID NO: 887572 - DNA, 25 bp, Mus musculus
tggctggactcattggactggctgt

SEQ ID NO: 887573 - DNA, 25 bp, Mus musculus
tggctggactccaattcaaatttat

SEQ ID NO: 887574 - DNA, 25 bp, Mus musculus
tggctggactccaggaaccaccata

SEQ ID NO: 887575 - DNA, 25 bp, Mus musculus
tggctggactcctattcaaatttat

SEQ ID NO: 887576 - DNA, 25 bp, Mus musculus
tggctggactcctggaaccaccata

SEQ ID NO: 887577 - DNA, 25 bp, Mus musculus
tggctggacttcaccgcaaaggtgg

SEQ ID NO: 887578 - DNA, 25 bp, Mus musculus
tggctggacttcatctatgtgccag

SEQ ID NO: 887579 - DNA, 25 bp, Mus musculus
tggctggacttctccgcaaaggtgg

SEQ ID NO: 887580 - DNA, 25 bp, Mus musculus
tggctggacttcttctatgtgccag

SEQ ID NO: 887581 - DNA, 25 bp, Mus musculus
tggctggagcaaccctcctcatctt

SEQ ID NO: 887582 - DNA, 25 bp, Mus musculus
tggctggagcaagcctcctcatctt

SEQ ID NO: 887583 - DNA, 25 bp, Mus musculus
tggctggagtctaggccgtctcccc

SEQ ID NO: 887584 - DNA, 25 bp, Mus musculus
tggctggagtcttggccgtctcccc

SEQ ID NO: 887585 - DNA, 25 bp, Mus musculus
tggctggattatctcccttctcaat

SEQ ID NO: 887586 - DNA, 25 bp, Mus musculus
tggctggattatgtcccttctcaat

SEQ ID NO: 887587 - DNA, 25 bp, Mus musculus
tggctggattttcagggacctccct

SEQ ID NO: 887588 - DNA, 25 bp, Mus musculus
tggctggattttgagggacctccct

SEQ ID NO: 887589 - DNA, 25 bp, Mus musculus
tggctggcaacaacggaggcgctca

SEQ ID NO: 887590 - DNA, 25 bp, Mus musculus
tggctggcaacatcggaggcgctca

SEQ ID NO: 887591 - DNA, 25 bp, Mus musculus
tggctggcactaacccagtgagggt

SEQ ID NO: 887592 - DNA, 25 bp, Mus musculus
tggctggcactatcccagtgagggt

SEQ ID NO: 887593 - DNA, 25 bp, Mus musculus
tggctggcactcaccatagtgttta

SEQ ID NO: 887594 - DNA, 25 bp, Mus musculus
tggctggcactctccatagtgttta

SEQ ID NO: 887595 - DNA, 25 bp, Mus musculus
tggctggcactgaacccagataact

SEQ ID NO: 887596 - DNA, 25 bp, Mus musculus
tggctggcactgtacccagataact

SEQ ID NO: 887597 - DNA, 25 bp, Mus musculus
tggctggcatttccttgttttcttt

SEQ ID NO: 887598 - DNA, 25 bp, Mus musculus
tggctggcatttgcttgttttcttt

SEQ ID NO: 887599 - DNA, 25 bp, Mus musculus
tggctggccataactcttagacagt

SEQ ID NO: 887600 - DNA, 25 bp, Mus musculus
tggctggccatatctcttagacagt

SEQ ID NO: 887601 - DNA, 25 bp, Mus musculus
tggctggccttgagttttccattgc

SEQ ID NO: 887602 - DNA, 25 bp, Mus musculus
tggctggccttgtgttttccattgc

SEQ ID NO: 887603 - DNA, 25 bp, Mus musculus
tggctggcgttgatgccccggccct

SEQ ID NO: 887604 - DNA, 25 bp, Mus musculus
tggctggcgttgttgccccggccct

SEQ ID NO: 887605 - DNA, 25 bp, Mus musculus
tggctggctacacggttctgagtct

SEQ ID NO: 887606 - DNA, 25 bp, Mus musculus
tggctggctacagggttctgagtct

SEQ ID NO: 887607 - DNA, 25 bp, Mus musculus
tggctggctacgagagctcttccac

SEQ ID NO: 887608 - DNA, 25 bp, Mus musculus
tggctggctacgtgagctcttccac

SEQ ID NO: 887609 - DNA, 25 bp, Mus musculus
tggctggctccgactctgtataagc

SEQ ID NO: 887610 - DNA, 25 bp, Mus musculus
tggctggctccgtctctgtataagc

SEQ ID NO: 887611 - DNA, 25 bp, Mus musculus
tggctggctgccattcagaatgtca

SEQ ID NO: 887612 - DNA, 25 bp, Mus musculus
tggctggctgcctttcagaatgtca

SEQ ID NO: 887613 - DNA, 25 bp, Mus musculus
tggctggctgctctaactcactgtc

SEQ ID NO: 887614 - DNA, 25 bp, Mus musculus
tggctggctgctgtaactcactgtc

SEQ ID NO: 887615 - DNA, 25 bp, Mus musculus
tggctggctgtgctgttcaccatgc

SEQ ID NO: 887616 - DNA, 25 bp, Mus musculus
tggctggctgtggtgttcaccatgc

SEQ ID NO: 887617 - DNA, 25 bp, Mus musculus
tggctggcttaaaggctgggcactt

SEQ ID NO: 887618 - DNA, 25 bp, Mus musculus
tggctggcttaatggctgggcactt

SEQ ID NO: 887619 - DNA, 25 bp, Mus musculus
tggctggcttctcaatggaccccgc

SEQ ID NO: 887620 - DNA, 25 bp, Mus musculus
tggctggcttctgaatggaccccgc

SEQ ID NO: 887621 - DNA, 25 bp, Mus musculus
tggctggcttggaagaacgcactct

SEQ ID NO: 887622 - DNA, 25 bp, Mus musculus
tggctggcttggtagaacgcactct

SEQ ID NO: 887623 - DNA, 25 bp, Mus musculus
tggctggctttcattgtaccctgaa

SEQ ID NO: 887624 - DNA, 25 bp, Mus musculus
tggctggctttctttgtaccctgaa

SEQ ID NO: 887625 - DNA, 25 bp, Mus musculus
tggctgggccacactgaggtccttg

SEQ ID NO: 887626 - DNA, 25 bp, Mus musculus
tggctgggccactctgaggtccttg

SEQ ID NO: 887627 - DNA, 25 bp, Mus musculus
tggctgggccagctaaaaaatgtgc

SEQ ID NO: 887628 - DNA, 25 bp, Mus musculus
tggctgggccaggtaaaaaatgtgc

SEQ ID NO: 887629 - DNA, 25 bp, Mus musculus
tggctgggccatctcacaacactgc

SEQ ID NO: 887630 - DNA, 25 bp, Mus musculus
tggctgggccatgtcacaacactgc

SEQ ID NO: 887631 - DNA, 25 bp, Mus musculus
tggctgggtgctagcattttccaaa

SEQ ID NO: 887632 - DNA, 25 bp, Mus musculus
tggctgggtgcttgcattttccaaa

SEQ ID NO: 887633 - DNA, 25 bp, Mus musculus
tggctgggtggcatcctgcattcaa

SEQ ID NO: 887634 - DNA, 25 bp, Mus musculus
tggctgggtggcttcctgcattcaa

SEQ ID NO: 887635 - DNA, 25 bp, Mus musculus
tggctgggtgggaactccaagcact

SEQ ID NO: 887636 - DNA, 25 bp, Mus musculus
tggctgggtgggtactccaagcact

SEQ ID NO: 887637 - DNA, 25 bp, Mus musculus
tggctgggttatatggatcactcgt

SEQ ID NO: 887638 - DNA, 25 bp, Mus musculus
tggctgggttatttggatcactcgt

SEQ ID NO: 887639 - DNA, 25 bp, Mus musculus
tggctgggtttcagtctcagagccc

SEQ ID NO: 887640 - DNA, 25 bp, Mus musculus
tggctgggtttcagttggctgtcat

SEQ ID NO: 887641 - DNA, 25 bp, Mus musculus
tggctgggtttctgtctcagagccc

SEQ ID NO: 887642 - DNA, 25 bp, Mus musculus
tggctgggtttctgttggctgtcat

SEQ ID NO: 887643 - DNA, 25 bp, Mus musculus
tggctggtaacacaacactaacggg

SEQ ID NO: 887644 - DNA, 25 bp, Mus musculus
tggctggtaacagaacactaacggg

SEQ ID NO: 887645 - DNA, 25 bp, Mus musculus
tggctggtacacaccgcccagatga

SEQ ID NO: 887646 - DNA, 25 bp, Mus musculus
tggctggtacactccgcccagatga

SEQ ID NO: 887647 - DNA, 25 bp, Mus musculus
tggctggtagctccctactggacca

SEQ ID NO: 887648 - DNA, 25 bp, Mus musculus
tggctggtagctgcctactggacca

SEQ ID NO: 887649 - DNA, 25 bp, Mus musculus
tggctggtatgcacaggcttcttat

SEQ ID NO: 887650 - DNA, 25 bp, Mus musculus
tggctggtatgctcaggcttcttat

SEQ ID NO: 887651 - DNA, 25 bp, Mus musculus
tggctggtatgtctagatttccttg

SEQ ID NO: 887652 - DNA, 25 bp, Mus musculus
tggctggtatgtgtagatttccttg

SEQ ID NO: 887653 - DNA, 25 bp, Mus musculus
tggctggtcacgacatggacaattc

SEQ ID NO: 887654 - DNA, 25 bp, Mus musculus
tggctggtcacgtcatggacaattc

SEQ ID NO: 887655 - DNA, 25 bp, Mus musculus
tggctggtcagcaaaccccaacaat

SEQ ID NO: 887656 - DNA, 25 bp, Mus musculus
tggctggtcagcacattattaaact

SEQ ID NO: 887657 - DNA, 25 bp, Mus musculus
tggctggtcagctaaccccaacaat

SEQ ID NO: 887658 - DNA, 25 bp, Mus musculus
tggctggtcagctcattattaaact

SEQ ID NO: 887659 - DNA, 25 bp, Mus musculus
tggctggtcccactcagatgaacat

SEQ ID NO: 887660 - DNA, 25 bp, Mus musculus
tggctggtcccagtcagatgaacat

SEQ ID NO: 887661 - DNA, 25 bp, Mus musculus
tggctggtgcccaagaattcataca

SEQ ID NO: 887662 - DNA, 25 bp, Mus musculus
tggctggtgccctagaattcataca

SEQ ID NO: 887663 - DNA, 25 bp, Mus musculus
tggctggtgggtatcctttgagaac

SEQ ID NO: 887664 - DNA, 25 bp, Mus musculus
tggctggtgggtttcctttgagaac

SEQ ID NO: 887665 - DNA, 25 bp, Mus musculus
tggctggtggtgacgtatgtcttct

SEQ ID NO: 887666 - DNA, 25 bp, Mus musculus
tggctggtggtgtcgtatgtcttct

SEQ ID NO: 887667 - DNA, 25 bp, Mus musculus
tggctggttacaagtcttctaagaa

SEQ ID NO: 887668 - DNA, 25 bp, Mus musculus
tggctggttacatgtcttctaagaa

SEQ ID NO: 887669 - DNA, 25 bp, Mus musculus
tggctggttagtatcctgggttact

SEQ ID NO: 887670 - DNA, 25 bp, Mus musculus
tggctggttagtttcctgggttact

SEQ ID NO: 887671 - DNA, 25 bp, Mus musculus
tggctggttctccagcacttctgca

SEQ ID NO: 887672 - DNA, 25 bp, Mus musculus
tggctggttctcgagcacttctgca

SEQ ID NO: 887673 - DNA, 25 bp, Mus musculus
tggctggttggtaagtctttgagac

SEQ ID NO: 887674 - DNA, 25 bp, Mus musculus
tggctggttggttagtctttgagac

SEQ ID NO: 887675 - DNA, 25 bp, Mus musculus
tggctgtaacaaatcatttagctga

SEQ ID NO: 887676 - DNA, 25 bp, Mus musculus
tggctgtaacaattcatttagctga

SEQ ID NO: 887677 - DNA, 25 bp, Mus musculus
tggctgtaatgcactctgttggctc

SEQ ID NO: 887678 - DNA, 25 bp, Mus musculus
tggctgtaatgctctctgttggctc

SEQ ID NO: 887679 - DNA, 25 bp, Mus musculus
tggctgtaattcatgcaactgcttc

SEQ ID NO: 887680 - DNA, 25 bp, Mus musculus
tggctgtaattcttgcaactgcttc

SEQ ID NO: 887681 - DNA, 25 bp, Mus musculus
tggctgtacacaaaccacgtgaggt

SEQ ID NO: 887682 - DNA, 25 bp, Mus musculus
tggctgtacacataccacgtgaggt

SEQ ID NO: 887683 - DNA, 25 bp, Mus musculus
tggctgtacactagctcttgttggc

SEQ ID NO: 887684 - DNA, 25 bp, Mus musculus
tggctgtacacttgctcttgttggc

SEQ ID NO: 887685 - DNA, 25 bp, Mus musculus
tggctgtaccagacagtcaagctga

SEQ ID NO: 887686 - DNA, 25 bp, Mus musculus
tggctgtaccagtcagtcaagctga

SEQ ID NO: 887687 - DNA, 25 bp, Mus musculus
tggctgtacccaataggtcaccaag

SEQ ID NO: 887688 - DNA, 25 bp, Mus musculus
tggctgtacccattaggtcaccaag

SEQ ID NO: 887689 - DNA, 25 bp, Mus musculus
tggctgtagagaagcaaaccttaat

SEQ ID NO: 887690 - DNA, 25 bp, Mus musculus
tggctgtagagatgcaaaccttaat

SEQ ID NO: 887691 - DNA, 25 bp, Mus musculus
tggctgtagatgaggctgcagacat

SEQ ID NO: 887692 - DNA, 25 bp, Mus musculus
tggctgtagatgtggctgcagacat

SEQ ID NO: 887693 - DNA, 25 bp, Mus musculus
tggctgtagcatacaataaagcatc

SEQ ID NO: 887694 - DNA, 25 bp, Mus musculus
tggctgtagcattcaataaagcatc

SEQ ID NO: 887695 - DNA, 25 bp, Mus musculus
tggctgtagtacagtcgtccgtctg

SEQ ID NO: 887696 - DNA, 25 bp, Mus musculus
tggctgtagtactgtcgtccgtctg

SEQ ID NO: 887697 - DNA, 25 bp, Mus musculus
tggctgtagtggatgtccaactttg

SEQ ID NO: 887698 - DNA, 25 bp, Mus musculus
tggctgtagtggttgtccaactttg

SEQ ID NO: 887699 - DNA, 25 bp, Mus musculus
tggctgtcaacacatccatcctgag

SEQ ID NO: 887700 - DNA, 25 bp, Mus musculus
tggctgtcaacagatccatcctgag

SEQ ID NO: 887701 - DNA, 25 bp, Mus musculus
tggctgtcaactcgaacacaccagt

SEQ ID NO: 887702 - DNA, 25 bp, Mus musculus
tggctgtcaactggaacacaccagt

SEQ ID NO: 887703 - DNA, 25 bp, Mus musculus
tggctgtcagccaagtaccacgaag

SEQ ID NO: 887704 - DNA, 25 bp, Mus musculus
tggctgtcagcctagtaccacgaag

SEQ ID NO: 887705 - DNA, 25 bp, Mus musculus
tggctgtcatttacccctgaaaaac

SEQ ID NO: 887706 - DNA, 25 bp, Mus musculus
tggctgtcattttcccctgaaaaac

SEQ ID NO: 887707 - DNA, 25 bp, Mus musculus
tggctgtccagcacctgctctagtg

SEQ ID NO: 887708 - DNA, 25 bp, Mus musculus
tggctgtccagctcctgctctagtg

SEQ ID NO: 887709 - DNA, 25 bp, Mus musculus
tggctgtccccaagttcaggaaggc

SEQ ID NO: 887710 - DNA, 25 bp, Mus musculus
tggctgtccccatgttcaggaaggc

SEQ ID NO: 887711 - DNA, 25 bp, Mus musculus
tggctgtcccttacccgaggatggg

SEQ ID NO: 887712 - DNA, 25 bp, Mus musculus
tggctgtccctttcccgaggatggg

SEQ ID NO: 887713 - DNA, 25 bp, Mus musculus
tggctgtcctacatatgcccaggat

SEQ ID NO: 887714 - DNA, 25 bp, Mus musculus
tggctgtcctacttatgcccaggat

SEQ ID NO: 887715 - DNA, 25 bp, Mus musculus
tggctgtcctcaatatcacctgtgt

SEQ ID NO: 887716 - DNA, 25 bp, Mus musculus
tggctgtcctcattatcacctgtgt

SEQ ID NO: 887717 - DNA, 25 bp, Mus musculus
tggctgtcctgtcacctttcttcaa

SEQ ID NO: 887718 - DNA, 25 bp, Mus musculus
tggctgtcctgtgacctttcttcaa

SEQ ID NO: 887719 - DNA, 25 bp, Mus musculus
tggctgtctaatcctcactgagtac

SEQ ID NO: 887720 - DNA, 25 bp, Mus musculus
tggctgtctaatgctcactgagtac

SEQ ID NO: 887721 - DNA, 25 bp, Mus musculus
tggctgtctaccatgagctgcagaa

SEQ ID NO: 887722 - DNA, 25 bp, Mus musculus
tggctgtctacccagggttgccaag

SEQ ID NO: 887723 - DNA, 25 bp, Mus musculus
tggctgtctaccgagggttgccaag

SEQ ID NO: 887724 - DNA, 25 bp, Mus musculus
tggctgtctaccttgagctgcagaa

SEQ ID NO: 887725 - DNA, 25 bp, Mus musculus
tggctgtctagacatttttggaaca

SEQ ID NO: 887726 - DNA, 25 bp, Mus musculus
tggctgtctagagatttttggaaca

SEQ ID NO: 887727 - DNA, 25 bp, Mus musculus
tggctgtctcagcacaatactcgac

SEQ ID NO: 887728 - DNA, 25 bp, Mus musculus
tggctgtctcaggacaatactcgac

SEQ ID NO: 887729 - DNA, 25 bp, Mus musculus
tggctgtctgcaatttgttaataaa

SEQ ID NO: 887730 - DNA, 25 bp, Mus musculus
tggctgtctgcattttgttaataaa

SEQ ID NO: 887731 - DNA, 25 bp, Mus musculus
tggctgtcttcccttggacaataat

SEQ ID NO: 887732 - DNA, 25 bp, Mus musculus
tggctgtcttccgttggacaataat

SEQ ID NO: 887733 - DNA, 25 bp, Mus musculus
tggctgtgaagacacttctccctga

SEQ ID NO: 887734 - DNA, 25 bp, Mus musculus
tggctgtgaagagacttctccctga

SEQ ID NO: 887735 - DNA, 25 bp, Mus musculus
tggctgtgaccacaactacctcata

SEQ ID NO: 887736 - DNA, 25 bp, Mus musculus
tggctgtgaccagaactacctcata

SEQ ID NO: 887737 - DNA, 25 bp, Mus musculus
tggctgtgacttaaaccactggaga

SEQ ID NO: 887738 - DNA, 25 bp, Mus musculus
tggctgtgactttaaccactggaga

SEQ ID NO: 887739 - DNA, 25 bp, Mus musculus
tggctgtgatggcattcttccctga

SEQ ID NO: 887740 - DNA, 25 bp, Mus musculus
tggctgtgatgggattcttccctga

SEQ ID NO: 887741 - DNA, 25 bp, Mus musculus
tggctgtgcattacaaaaggtatga

SEQ ID NO: 887742 - DNA, 25 bp, Mus musculus
tggctgtgcatttcaaaaggtatga

SEQ ID NO: 887743 - DNA, 25 bp, Mus musculus
tggctgtgccctcgtagttgcagaa

SEQ ID NO: 887744 - DNA, 25 bp, Mus musculus
tggctgtgccctggtagttgcagaa

SEQ ID NO: 887745 - DNA, 25 bp, Mus musculus
tggctgtgcgcacctcgctgaagaa

SEQ ID NO: 887746 - DNA, 25 bp, Mus musculus
tggctgtgcgcagctcgctgaagaa

SEQ ID NO: 887747 - DNA, 25 bp, Mus musculus
tggctgtggaaaacgctcaaggctt

SEQ ID NO: 887748 - DNA, 25 bp, Mus musculus
tggctgtggaaatcgctcaaggctt

SEQ ID NO: 887749 - DNA, 25 bp, Mus musculus
tggctgtggccaaatgagtcctcat

SEQ ID NO: 887750 - DNA, 25 bp, Mus musculus
tggctgtggccatatgagtcctcat

SEQ ID NO: 887751 - DNA, 25 bp, Mus musculus
tggctgtggcccagttttagagcca

SEQ ID NO: 887752 - DNA, 25 bp, Mus musculus
tggctgtggccctgttttagagcca

SEQ ID NO: 887753 - DNA, 25 bp, Mus musculus
tggctgtggcttcggaaacccacta

SEQ ID NO: 887754 - DNA, 25 bp, Mus musculus
tggctgtggcttgggaaacccacta

SEQ ID NO: 887755 - DNA, 25 bp, Mus musculus
tggctgtgggccacaatatcctaga

SEQ ID NO: 887756 - DNA, 25 bp, Mus musculus
tggctgtgggcctcaatatcctaga

SEQ ID NO: 887757 - DNA, 25 bp, Mus musculus
tggctgtgtcacatcaacaccaacc

SEQ ID NO: 887758 - DNA, 25 bp, Mus musculus
tggctgtgtcacttcaacaccaacc

SEQ ID NO: 887759 - DNA, 25 bp, Mus musculus
tggctgtgtgaacagagtcccctaa

SEQ ID NO: 887760 - DNA, 25 bp, Mus musculus
tggctgtgtgaagagagtcccctaa

SEQ ID NO: 887761 - DNA, 25 bp, Mus musculus
tggctgtgtgccctctatggagacc

SEQ ID NO: 887762 - DNA, 25 bp, Mus musculus
tggctgtgtgccgtctatggagacc

SEQ ID NO: 887763 - DNA, 25 bp, Mus musculus
tggctgtgtgctcacctagaatacg

SEQ ID NO: 887764 - DNA, 25 bp, Mus musculus
tggctgtgtgctgacctagaatacg

SEQ ID NO: 887765 - DNA, 25 bp, Mus musculus
tggctgtgtgtgatggcacctatga

SEQ ID NO: 887766 - DNA, 25 bp, Mus musculus
tggctgtgtgtgttggcacctatga

SEQ ID NO: 887767 - DNA, 25 bp, Mus musculus
tggctgtgttcgagtccagcgagca

SEQ ID NO: 887768 - DNA, 25 bp, Mus musculus
tggctgtgttcgtgtccagcgagca

SEQ ID NO: 887769 - DNA, 25 bp, Mus musculus
tggctgttaccactattttcaagtc

SEQ ID NO: 887770 - DNA, 25 bp, Mus musculus
tggctgttaccagtattttcaagtc

SEQ ID NO: 887771 - DNA, 25 bp, Mus musculus
tggctgttagcccaaggttaaaaag

SEQ ID NO: 887772 - DNA, 25 bp, Mus musculus
tggctgttagccgaaggttaaaaag

SEQ ID NO: 887773 - DNA, 25 bp, Mus musculus
tggctgttcatgctgtaccttcttg

SEQ ID NO: 887774 - DNA, 25 bp, Mus musculus
tggctgttcatggtgtaccttcttg

SEQ ID NO: 887775 - DNA, 25 bp, Mus musculus
tggctgttcctgctgtcactggtct

SEQ ID NO: 887776 - DNA, 25 bp, Mus musculus
tggctgttcctggtgtcactggtct

SEQ ID NO: 887777 - DNA, 25 bp, Mus musculus
tggctgttcgcacctttatggagaa

SEQ ID NO: 887778 - DNA, 25 bp, Mus musculus
tggctgttcgcagctttatggagaa

SEQ ID NO: 887779 - DNA, 25 bp, Mus musculus
tggctgttctggaatccacactgta

SEQ ID NO: 887780 - DNA, 25 bp, Mus musculus
tggctgttctggtatccacactgta

SEQ ID NO: 887781 - DNA, 25 bp, Mus musculus
tggctgttggagacagtcccggcct

SEQ ID NO: 887782 - DNA, 25 bp, Mus musculus
tggctgttggagtcagtcccggcct

SEQ ID NO: 887783 - DNA, 25 bp, Mus musculus
tggctgttgtaaatggtgaccctgt

SEQ ID NO: 887784 - DNA, 25 bp, Mus musculus
tggctgttgtaattggtgaccctgt

SEQ ID NO: 887785 - DNA, 25 bp, Mus musculus
tggctgttgtagctttctagaccaa

SEQ ID NO: 887786 - DNA, 25 bp, Mus musculus
tggctgttgtaggtttctagaccaa

SEQ ID NO: 887787 - DNA, 25 bp, Mus musculus
tggctgtttgctcgtgacacttgtc

SEQ ID NO: 887788 - DNA, 25 bp, Mus musculus
tggctgtttgctggtgacacttgtc

SEQ ID NO: 887789 - DNA, 25 bp, Mus musculus
tggctgtttgtgattttaatctgaa

SEQ ID NO: 887790 - DNA, 25 bp, Mus musculus
tggctgtttgtgtttttaatctgaa

SEQ ID NO: 887791 - DNA, 25 bp, Mus musculus
tggcttaaccacatcccaaagcttt

SEQ ID NO: 887792 - DNA, 25 bp, Mus musculus
tggcttaaccacttcccaaagcttt

SEQ ID NO: 887793 - DNA, 25 bp, Mus musculus
tggcttaaccctattggccagtaag

SEQ ID NO: 887794 - DNA, 25 bp, Mus musculus
tggcttaacccttttggccagtaag

SEQ ID NO: 887795 - DNA, 25 bp, Mus musculus
tggcttaacttcacccggagctaag

SEQ ID NO: 887796 - DNA, 25 bp, Mus musculus
tggcttaacttcatctccattgttc

SEQ ID NO: 887797 - DNA, 25 bp, Mus musculus
tggcttaacttctcccggagctaag

SEQ ID NO: 887798 - DNA, 25 bp, Mus musculus
tggcttaacttcttctccattgttc

SEQ ID NO: 887799 - DNA, 25 bp, Mus musculus
tggcttacaatcaagtcacactctt

SEQ ID NO: 887800 - DNA, 25 bp, Mus musculus
tggcttacaatctagtcacactctt

SEQ ID NO: 887801 - DNA, 25 bp, Mus musculus
tggcttacacggcaacacaactatt

SEQ ID NO: 887802 - DNA, 25 bp, Mus musculus
tggcttacacgggaacacaactatt

SEQ ID NO: 887803 - DNA, 25 bp, Mus musculus
tggcttacagagctaacttcagttg

SEQ ID NO: 887804 - DNA, 25 bp, Mus musculus
tggcttacagaggtaacttcagttg

SEQ ID NO: 887805 - DNA, 25 bp, Mus musculus
tggcttacatcccaaggcctgtatc

SEQ ID NO: 887806 - DNA, 25 bp, Mus musculus
tggcttacatccgaaggcctgtatc

SEQ ID NO: 887807 - DNA, 25 bp, Mus musculus
tggcttaccaacaattaaacattct

SEQ ID NO: 887808 - DNA, 25 bp, Mus musculus
tggcttaccaactattaaacattct

SEQ ID NO: 887809 - DNA, 25 bp, Mus musculus
tggcttaccgagcagggcctaagaa

SEQ ID NO: 887810 - DNA, 25 bp, Mus musculus
tggcttaccgaggagggcctaagaa

SEQ ID NO: 887811 - DNA, 25 bp, Mus musculus
tggcttacctggaaagcgtcagcat

SEQ ID NO: 887812 - DNA, 25 bp, Mus musculus
tggcttacctggtaagcgtcagcat

SEQ ID NO: 887813 - DNA, 25 bp, Mus musculus
tggcttacgatcaatggctctgcac

SEQ ID NO: 887814 - DNA, 25 bp, Mus musculus
tggcttacgatctatggctctgcac

SEQ ID NO: 887815 - DNA, 25 bp, Mus musculus
tggcttactacccaaatctgtcctt

SEQ ID NO: 887816 - DNA, 25 bp, Mus musculus
tggcttactaccgaaatctgtcctt

SEQ ID NO: 887817 - DNA, 25 bp, Mus musculus
tggcttagcagtaaacagtacacac

SEQ ID NO: 887818 - DNA, 25 bp, Mus musculus
tggcttagcagttaacagtacacac

SEQ ID NO: 887819 - DNA, 25 bp, Mus musculus
tggcttagcccgatcaaggctcagg

SEQ ID NO: 887820 - DNA, 25 bp, Mus musculus
tggcttagcccgttcaaggctcagg

SEQ ID NO: 887821 - DNA, 25 bp, Mus musculus
tggcttagccgactgactggactgt

SEQ ID NO: 887822 - DNA, 25 bp, Mus musculus
tggcttagccgagtgactggactgt

SEQ ID NO: 887823 - DNA, 25 bp, Mus musculus
tggcttagctttccagcagggtctg

SEQ ID NO: 887824 - DNA, 25 bp, Mus musculus
tggcttagctttgcagcagggtctg

SEQ ID NO: 887825 - DNA, 25 bp, Mus musculus
tggcttaggagcagcttgttctggc

SEQ ID NO: 887826 - DNA, 25 bp, Mus musculus
tggcttaggagctgcttgttctggc

SEQ ID NO: 887827 - DNA, 25 bp, Mus musculus
tggcttaggattaccattgcagatt

SEQ ID NO: 887828 - DNA, 25 bp, Mus musculus
tggcttaggatttccattgcagatt

SEQ ID NO: 887829 - DNA, 25 bp, Mus musculus
tggcttaggcctcttccagaagtag

SEQ ID NO: 887830 - DNA, 25 bp, Mus musculus
tggcttaggcctgttccagaagtag

SEQ ID NO: 887831 - DNA, 25 bp, Mus musculus
tggcttagtataaggtgcctgtcac

SEQ ID NO: 887832 - DNA, 25 bp, Mus musculus
tggcttagtatatggtgcctgtcac

SEQ ID NO: 887833 - DNA, 25 bp, Mus musculus
tggcttagtgagaaaagtgcttgct

SEQ ID NO: 887834 - DNA, 25 bp, Mus musculus
tggcttagtgagtaaagtgcttgct

SEQ ID NO: 887835 - DNA, 25 bp, Mus musculus
tggcttatagccctactagctttaa

SEQ ID NO: 887836 - DNA, 25 bp, Mus musculus
tggcttatagccgtactagctttaa

SEQ ID NO: 887837 - DNA, 25 bp, Mus musculus
tggcttatagttcgtttttagtgtt

SEQ ID NO: 887838 - DNA, 25 bp, Mus musculus
tggcttatagttggtttttagtgtt

SEQ ID NO: 887839 - DNA, 25 bp, Mus musculus
tggcttatcataatcccagtggact

SEQ ID NO: 887840 - DNA, 25 bp, Mus musculus
tggcttatcatattcccagtggact

SEQ ID NO: 887841 - DNA, 25 bp, Mus musculus
tggcttatcctacactgttgtctat

SEQ ID NO: 887842 - DNA, 25 bp, Mus musculus
tggcttatcctagactgttgtctat

SEQ ID NO: 887843 - DNA, 25 bp, Mus musculus
tggcttatgccaatcaacagagaaa

SEQ ID NO: 887844 - DNA, 25 bp, Mus musculus
tggcttatgccattcaacagagaaa

SEQ ID NO: 887845 - DNA, 25 bp, Mus musculus
tggcttatggcgatgccaccaggcc

SEQ ID NO: 887846 - DNA, 25 bp, Mus musculus
tggcttatggcgttgccaccaggcc

SEQ ID NO: 887847 - DNA, 25 bp, Mus musculus
tggcttattttacacccttcctcat

SEQ ID NO: 887848 - DNA, 25 bp, Mus musculus
tggcttattttagacccttcctcat

SEQ ID NO: 887849 - DNA, 25 bp, Mus musculus
tggcttcaaacactccctgagggag

SEQ ID NO: 887850 - DNA, 25 bp, Mus musculus
tggcttcaaacagtccctgagggag

SEQ ID NO: 887851 - DNA, 25 bp, Mus musculus
tggcttcaaagcacaggcaaggcag

SEQ ID NO: 887852 - DNA, 25 bp, Mus musculus
tggcttcaaagcctacaaacctgag

SEQ ID NO: 887853 - DNA, 25 bp, Mus musculus
tggcttcaaagcgtacaaacctgag

SEQ ID NO: 887854 - DNA, 25 bp, Mus musculus
tggcttcaaagctcaggcaaggcag

SEQ ID NO: 887855 - DNA, 25 bp, Mus musculus
tggcttcaaatgaccttcccacaag

SEQ ID NO: 887856 - DNA, 25 bp, Mus musculus
tggcttcaaatgtccttcccacaag

SEQ ID NO: 887857 - DNA, 25 bp, Mus musculus
tggcttcaacagcagccggttccag

SEQ ID NO: 887858 - DNA, 25 bp, Mus musculus
tggcttcaacaggagccggttccag

SEQ ID NO: 887859 - DNA, 25 bp, Mus musculus
tggcttcaaccccttatttgtgaca

SEQ ID NO: 887860 - DNA, 25 bp, Mus musculus
tggcttcaacccgttatttgtgaca

SEQ ID NO: 887861 - DNA, 25 bp, Mus musculus
tggcttcaagttattccaaaaacct

SEQ ID NO: 887862 - DNA, 25 bp, Mus musculus
tggcttcaagtttttccaaaaacct

SEQ ID NO: 887863 - DNA, 25 bp, Mus musculus
tggcttcacaatcggcttccggtct

SEQ ID NO: 887864 - DNA, 25 bp, Mus musculus
tggcttcacaatgggcttccggtct

SEQ ID NO: 887865 - DNA, 25 bp, Mus musculus
tggcttcacccaagtgcggagacaa

SEQ ID NO: 887866 - DNA, 25 bp, Mus musculus
tggcttcacccatgtgcggagacaa

SEQ ID NO: 887867 - DNA, 25 bp, Mus musculus
tggcttcaccttccttatctgtaag

SEQ ID NO: 887868 - DNA, 25 bp, Mus musculus
tggcttcaccttgcttatctgtaag

SEQ ID NO: 887869 - DNA, 25 bp, Mus musculus
tggcttcagccaccaaaatgtcaag

SEQ ID NO: 887870 - DNA, 25 bp, Mus musculus
tggcttcagccagcaaaatgtcaag

SEQ ID NO: 887871 - DNA, 25 bp, Mus musculus
tggcttcagcccagagttggtctag

SEQ ID NO: 887872 - DNA, 25 bp, Mus musculus
tggcttcagccctgagttggtctag

SEQ ID NO: 887873 - DNA, 25 bp, Mus musculus
tggcttcaggtacttgttacccata

SEQ ID NO: 887874 - DNA, 25 bp, Mus musculus
tggcttcaggtagttgttacccata

SEQ ID NO: 887875 - DNA, 25 bp, Mus musculus
tggcttcagtgcaggcagcagtcaa

SEQ ID NO: 887876 - DNA, 25 bp, Mus musculus
tggcttcagtgctggcagcagtcaa

SEQ ID NO: 887877 - DNA, 25 bp, Mus musculus
tggcttcataagactcaccgtgggt

SEQ ID NO: 887878 - DNA, 25 bp, Mus musculus
tggcttcataagtctcaccgtgggt

SEQ ID NO: 887879 - DNA, 25 bp, Mus musculus
tggcttcatagtactttctcatgta

SEQ ID NO: 887880 - DNA, 25 bp, Mus musculus
tggcttcatagttctttctcatgta

SEQ ID NO: 887881 - DNA, 25 bp, Mus musculus
tggcttcatcatctactcggattga

SEQ ID NO: 887882 - DNA, 25 bp, Mus musculus
tggcttcatcatgtactcggattga

SEQ ID NO: 887883 - DNA, 25 bp, Mus musculus
tggcttcatcgacgacaattacatc

SEQ ID NO: 887884 - DNA, 25 bp, Mus musculus
tggcttcatcgaggacaattacatc

SEQ ID NO: 887885 - DNA, 25 bp, Mus musculus
tggcttcattcaattatgtgtgctc

SEQ ID NO: 887886 - DNA, 25 bp, Mus musculus
tggcttcattcactacttcacacag

SEQ ID NO: 887887 - DNA, 25 bp, Mus musculus
tggcttcattcagtacttcacacag

SEQ ID NO: 887888 - DNA, 25 bp, Mus musculus
tggcttcattcatttatgtgtgctc

SEQ ID NO: 887889 - DNA, 25 bp, Mus musculus
tggcttcattctcagtgggctatct

SEQ ID NO: 887890 - DNA, 25 bp, Mus musculus
tggcttcattctgagtgggctatct

SEQ ID NO: 887891 - DNA, 25 bp, Mus musculus
tggcttccaaatccacaaagggtgg

SEQ ID NO: 887892 - DNA, 25 bp, Mus musculus
tggcttccaaatgcacaaagggtgg

SEQ ID NO: 887893 - DNA, 25 bp, Mus musculus
tggcttccaaccactctgaaggaag

SEQ ID NO: 887894 - DNA, 25 bp, Mus musculus
tggcttccaacctctctgaaggaag

SEQ ID NO: 887895 - DNA, 25 bp, Mus musculus
tggcttccaactccatatgtagctg

SEQ ID NO: 887896 - DNA, 25 bp, Mus musculus
tggcttccaactgcatatgtagctg

SEQ ID NO: 887897 - DNA, 25 bp, Mus musculus
tggcttccaagtcacacattcatct

SEQ ID NO: 887898 - DNA, 25 bp, Mus musculus
tggcttccaagtccagctggaatca

SEQ ID NO: 887899 - DNA, 25 bp, Mus musculus
tggcttccaagtgacacattcatct

SEQ ID NO: 887900 - DNA, 25 bp, Mus musculus
tggcttccaagtgcagctggaatca

SEQ ID NO: 887901 - DNA, 25 bp, Mus musculus
tggcttccagagacacttgtcacaa

SEQ ID NO: 887902 - DNA, 25 bp, Mus musculus
tggcttccagagcaacggaacatct

SEQ ID NO: 887903 - DNA, 25 bp, Mus musculus
tggcttccagaggaacggaacatct

SEQ ID NO: 887904 - DNA, 25 bp, Mus musculus
tggcttccagagtcacttgtcacaa

SEQ ID NO: 887905 - DNA, 25 bp, Mus musculus
tggcttccagccaagatcagcacat

SEQ ID NO: 887906 - DNA, 25 bp, Mus musculus
tggcttccagccctcttatagagac

SEQ ID NO: 887907 - DNA, 25 bp, Mus musculus
tggcttccagccgtcttatagagac

SEQ ID NO: 887908 - DNA, 25 bp, Mus musculus
tggcttccagcctagatcagcacat

SEQ ID NO: 887909 - DNA, 25 bp, Mus musculus
tggcttccagtcaaattaccttctt

SEQ ID NO: 887910 - DNA, 25 bp, Mus musculus
tggcttccagtcaggttaatctttg

SEQ ID NO: 887911 - DNA, 25 bp, Mus musculus
tggcttccagtctaattaccttctt

SEQ ID NO: 887912 - DNA, 25 bp, Mus musculus
tggcttccagtctggttaatctttg

SEQ ID NO: 887913 - DNA, 25 bp, Mus musculus
tggcttccagtgctcttcagtctgt

SEQ ID NO: 887914 - DNA, 25 bp, Mus musculus
tggcttccagtggtcttcagtctgt

SEQ ID NO: 887915 - DNA, 25 bp, Mus musculus
tggcttccatggctcattcagaggc

SEQ ID NO: 887916 - DNA, 25 bp, Mus musculus
tggcttccatgggtcattcagaggc

SEQ ID NO: 887917 - DNA, 25 bp, Mus musculus
tggcttcccaggcttcagctgagaa

SEQ ID NO: 887918 - DNA, 25 bp, Mus musculus
tggcttcccagggttcagctgagaa

SEQ ID NO: 887919 - DNA, 25 bp, Mus musculus
tggcttcccatgcaaccttgtgatt

SEQ ID NO: 887920 - DNA, 25 bp, Mus musculus
tggcttcccatggaaccttgtgatt

SEQ ID NO: 887921 - DNA, 25 bp, Mus musculus
tggcttccctggaggtcgaggaaac

SEQ ID NO: 887922 - DNA, 25 bp, Mus musculus
tggcttccctggtggtcgaggaaac

SEQ ID NO: 887923 - DNA, 25 bp, Mus musculus
tggcttccgcagaggctttgttaca

SEQ ID NO: 887924 - DNA, 25 bp, Mus musculus
tggcttccgcagtggctttgttaca

SEQ ID NO: 887925 - DNA, 25 bp, Mus musculus
tggcttccggcgatttgagtcagaa

SEQ ID NO: 887926 - DNA, 25 bp, Mus musculus
tggcttccggcgttttgagtcagaa

SEQ ID NO: 887927 - DNA, 25 bp, Mus musculus
tggcttccgttgctgtggctaacaa

SEQ ID NO: 887928 - DNA, 25 bp, Mus musculus
tggcttccgttggtgtggctaacaa

SEQ ID NO: 887929 - DNA, 25 bp, Mus musculus
tggcttcctataaccgtcctgagga

SEQ ID NO: 887930 - DNA, 25 bp, Mus musculus
tggcttcctatatccgtcctgagga

SEQ ID NO: 887931 - DNA, 25 bp, Mus musculus
tggcttcctatgactcaggtatcgt

SEQ ID NO: 887932 - DNA, 25 bp, Mus musculus
tggcttcctatgtctcaggtatcgt

SEQ ID NO: 887933 - DNA, 25 bp, Mus musculus
tggcttcctcacaatgatttcccaa

SEQ ID NO: 887934 - DNA, 25 bp, Mus musculus
tggcttcctcactatgatttcccaa

SEQ ID NO: 887935 - DNA, 25 bp, Mus musculus
tggcttcctcatcctttaatgtgac

SEQ ID NO: 887936 - DNA, 25 bp, Mus musculus
tggcttcctcatgctttaatgtgac

SEQ ID NO: 887937 - DNA, 25 bp, Mus musculus
tggcttcctcctaaaagtaaacctg

SEQ ID NO: 887938 - DNA, 25 bp, Mus musculus
tggcttcctccttaaagtaaacctg

SEQ ID NO: 887939 - DNA, 25 bp, Mus musculus
tggcttcctctgatgaaacatgatc

SEQ ID NO: 887940 - DNA, 25 bp, Mus musculus
tggcttcctctgttgaaacatgatc

SEQ ID NO: 887941 - DNA, 25 bp, Mus musculus
tggcttcctcttcaaactggattca

SEQ ID NO: 887942 - DNA, 25 bp, Mus musculus
tggcttcctcttgaaactggattca

SEQ ID NO: 887943 - DNA, 25 bp, Mus musculus
tggcttcctgcacagctgtgctcag

SEQ ID NO: 887944 - DNA, 25 bp, Mus musculus
tggcttcctgcagagctgtgctcag

SEQ ID NO: 887945 - DNA, 25 bp, Mus musculus
tggcttcctgtgagatccacatctg

SEQ ID NO: 887946 - DNA, 25 bp, Mus musculus
tggcttcctgtgtgatccacatctg

SEQ ID NO: 887947 - DNA, 25 bp, Mus musculus
tggcttccttcactgtactttttta

SEQ ID NO: 887948 - DNA, 25 bp, Mus musculus
tggcttccttcagtgtactttttta

SEQ ID NO: 887949 - DNA, 25 bp, Mus musculus
tggcttccttgcacatcaaacacag

SEQ ID NO: 887950 - DNA, 25 bp, Mus musculus
tggcttccttgctcatcaaacacag

SEQ ID NO: 887951 - DNA, 25 bp, Mus musculus
tggcttccttggaaacttcacatac

SEQ ID NO: 887952 - DNA, 25 bp, Mus musculus
tggcttccttggtaacttcacatac

SEQ ID NO: 887953 - DNA, 25 bp, Mus musculus
tggcttcctttacgttttgcactga

SEQ ID NO: 887954 - DNA, 25 bp, Mus musculus
tggcttcctttaggttttgcactga

SEQ ID NO: 887955 - DNA, 25 bp, Mus musculus
tggcttcctttgactattatagttg

SEQ ID NO: 887956 - DNA, 25 bp, Mus musculus
tggcttcctttgtctattatagttg

SEQ ID NO: 887957 - DNA, 25 bp, Mus musculus
tggcttcgcattccctgtagcttca

SEQ ID NO: 887958 - DNA, 25 bp, Mus musculus
tggcttcgcattgcctgtagcttca

SEQ ID NO: 887959 - DNA, 25 bp, Mus musculus
tggcttcgccggaaagagcaccgga

SEQ ID NO: 887960 - DNA, 25 bp, Mus musculus
tggcttcgccggtaagagcaccgga

SEQ ID NO: 887961 - DNA, 25 bp, Mus musculus
tggcttcggagcatccagcaggtgc

SEQ ID NO: 887962 - DNA, 25 bp, Mus musculus
tggcttcggagcttccagcaggtgc

SEQ ID NO: 887963 - DNA, 25 bp, Mus musculus
tggcttcggaggaccaagcactgga

SEQ ID NO: 887964 - DNA, 25 bp, Mus musculus
tggcttcggaggtccaagcactgga

SEQ ID NO: 887965 - DNA, 25 bp, Mus musculus
tggcttcggtgaaggttccttagat

SEQ ID NO: 887966 - DNA, 25 bp, Mus musculus
tggcttcggtgatggttccttagat

SEQ ID NO: 887967 - DNA, 25 bp, Mus musculus
tggcttctaagcctctagatcaatt

SEQ ID NO: 887968 - DNA, 25 bp, Mus musculus
tggcttctaagcgtctagatcaatt

SEQ ID NO: 887969 - DNA, 25 bp, Mus musculus
tggcttctaattcacttcacttcag

SEQ ID NO: 887970 - DNA, 25 bp, Mus musculus
tggcttctaattgacttcacttcag

SEQ ID NO: 887971 - DNA, 25 bp, Mus musculus
tggcttctactcaaggaatctgtga

SEQ ID NO: 887972 - DNA, 25 bp, Mus musculus
tggcttctactctaggaatctgtga

SEQ ID NO: 887973 - DNA, 25 bp, Mus musculus
tggcttctactgaggagattcagca

SEQ ID NO: 887974 - DNA, 25 bp, Mus musculus
tggcttctactgagggctttcgaca

SEQ ID NO: 887975 - DNA, 25 bp, Mus musculus
tggcttctactgctgtcttaacaac

SEQ ID NO: 887976 - DNA, 25 bp, Mus musculus
tggcttctactggtgtcttaacaac

SEQ ID NO: 887977 - DNA, 25 bp, Mus musculus
tggcttctactgtggagattcagca

SEQ ID NO: 887978 - DNA, 25 bp, Mus musculus
tggcttctactgtgggctttcgaca

SEQ ID NO: 887979 - DNA, 25 bp, Mus musculus
tggcttctatccaactgacactggg

SEQ ID NO: 887980 - DNA, 25 bp, Mus musculus
tggcttctatcctactgacactggg

SEQ ID NO: 887981 - DNA, 25 bp, Mus musculus
tggcttctcaacagccttggataat

SEQ ID NO: 887982 - DNA, 25 bp, Mus musculus
tggcttctcaactgccttggataat

SEQ ID NO: 887983 - DNA, 25 bp, Mus musculus
tggcttctcactagctgtatagcat

SEQ ID NO: 887984 - DNA, 25 bp, Mus musculus
tggcttctcacttgctgtatagcat

SEQ ID NO: 887985 - DNA, 25 bp, Mus musculus
tggcttctcagacttgctacaacct

SEQ ID NO: 887986 - DNA, 25 bp, Mus musculus
tggcttctcagagttgctacaacct

SEQ ID NO: 887987 - DNA, 25 bp, Mus musculus
tggcttctcagcatcatctagttat

SEQ ID NO: 887988 - DNA, 25 bp, Mus musculus
tggcttctcagcttcatctagttat

SEQ ID NO: 887989 - DNA, 25 bp, Mus musculus
tggcttctgaaacatctgctcagtc

SEQ ID NO: 887990 - DNA, 25 bp, Mus musculus
tggcttctgaaagatctgctcagtc

SEQ ID NO: 887991 - DNA, 25 bp, Mus musculus
tggcttctgaacattaacttaactg

SEQ ID NO: 887992 - DNA, 25 bp, Mus musculus
tggcttctgaactttaacttaactg

SEQ ID NO: 887993 - DNA, 25 bp, Mus musculus
tggcttctgacaagggtgtgcttct

SEQ ID NO: 887994 - DNA, 25 bp, Mus musculus
tggcttctgacaatatacaggcaat

SEQ ID NO: 887995 - DNA, 25 bp, Mus musculus
tggcttctgacatgggtgtgcttct

SEQ ID NO: 887996 - DNA, 25 bp, Mus musculus
tggcttctgacattatacaggcaat

SEQ ID NO: 887997 - DNA, 25 bp, Mus musculus
tggcttctgaccaatcaagtgcttc

SEQ ID NO: 887998 - DNA, 25 bp, Mus musculus
tggcttctgacctatcaagtgcttc

SEQ ID NO: 887999 - DNA, 25 bp, Mus musculus
tggcttctgattaactgccccgtag

SEQ ID NO: 888000 - DNA, 25 bp, Mus musculus
tggcttctgatttactgccccgtag

SEQ ID NO: 888001 - DNA, 25 bp, Mus musculus
tggcttctgcccatataaccggaaa

SEQ ID NO: 888002 - DNA, 25 bp, Mus musculus
tggcttctgcccttataaccggaaa

SEQ ID NO: 888003 - DNA, 25 bp, Mus musculus
tggcttctgctacgtctcagagcat

SEQ ID NO: 888004 - DNA, 25 bp, Mus musculus
tggcttctgctaggtctcagagcat

SEQ ID NO: 888005 - DNA, 25 bp, Mus musculus
tggcttctgctgaatgttgttgtca

SEQ ID NO: 888006 - DNA, 25 bp, Mus musculus
tggcttctgctgtatgttgttgtca

SEQ ID NO: 888007 - DNA, 25 bp, Mus musculus
tggcttctggatacatttgctcttc

SEQ ID NO: 888008 - DNA, 25 bp, Mus musculus
tggcttctggattcatttgctcttc

SEQ ID NO: 888009 - DNA, 25 bp, Mus musculus
tggcttctggcccaatcaggctgtg

SEQ ID NO: 888010 - DNA, 25 bp, Mus musculus
tggcttctggccgaatcaggctgtg

SEQ ID NO: 888011 - DNA, 25 bp, Mus musculus
tggcttctgggcatctaccttaaac

SEQ ID NO: 888012 - DNA, 25 bp, Mus musculus
tggcttctgggcttctaccttaaac

SEQ ID NO: 888013 - DNA, 25 bp, Mus musculus
tggcttctggtaataaactctttct

SEQ ID NO: 888014 - DNA, 25 bp, Mus musculus
tggcttctggtaccccttacaacaa

SEQ ID NO: 888015 - DNA, 25 bp, Mus musculus
tggcttctggtagcccttacaacaa

SEQ ID NO: 888016 - DNA, 25 bp, Mus musculus
tggcttctggtattaaactctttct

SEQ ID NO: 888017 - DNA, 25 bp, Mus musculus
tggcttctggtcaaggacgcagata

SEQ ID NO: 888018 - DNA, 25 bp, Mus musculus
tggcttctggtctaggacgcagata

SEQ ID NO: 888019 - DNA, 25 bp, Mus musculus
tggcttctgtgacaaacggtcccat

SEQ ID NO: 888020 - DNA, 25 bp, Mus musculus
tggcttctgtgagaaacggtcccat

SEQ ID NO: 888021 - DNA, 25 bp, Mus musculus
tggcttctgttaccatccaattcag

SEQ ID NO: 888022 - DNA, 25 bp, Mus musculus
tggcttctgttagcatccaattcag

SEQ ID NO: 888023 - DNA, 25 bp, Mus musculus
tggcttctgtttagtccatagctta

SEQ ID NO: 888024 - DNA, 25 bp, Mus musculus
tggcttctgttttgtccatagctta

SEQ ID NO: 888025 - DNA, 25 bp, Mus musculus
tggcttcttattcgaaccctactac

SEQ ID NO: 888026 - DNA, 25 bp, Mus musculus
tggcttcttattggaaccctactac

SEQ ID NO: 888027 - DNA, 25 bp, Mus musculus
tggcttcttcacattgggcttccca

SEQ ID NO: 888028 - DNA, 25 bp, Mus musculus
tggcttcttcactttgggcttccca

SEQ ID NO: 888029 - DNA, 25 bp, Mus musculus
tggcttcttccaacataagtcgggt

SEQ ID NO: 888030 - DNA, 25 bp, Mus musculus
tggcttcttccatcataagtcgggt

SEQ ID NO: 888031 - DNA, 25 bp, Mus musculus
tggcttcttggtctatgatctggag

SEQ ID NO: 888032 - DNA, 25 bp, Mus musculus
tggcttcttggtgtatgatctggag

SEQ ID NO: 888033 - DNA, 25 bp, Mus musculus
tggcttctttggcaactgtatgcat

SEQ ID NO: 888034 - DNA, 25 bp, Mus musculus
tggcttctttgggaactgtatgcat

SEQ ID NO: 888035 - DNA, 25 bp, Mus musculus
tggcttgaacaacaactcagggatg

SEQ ID NO: 888036 - DNA, 25 bp, Mus musculus
tggcttgaacaagaactcagggatg

SEQ ID NO: 888037 - DNA, 25 bp, Mus musculus
tggcttgacccaacatactcatgat

SEQ ID NO: 888038 - DNA, 25 bp, Mus musculus
tggcttgacccatcatactcatgat

SEQ ID NO: 888039 - DNA, 25 bp, Mus musculus
tggcttgacctgagaatgacttcct

SEQ ID NO: 888040 - DNA, 25 bp, Mus musculus
tggcttgacctgtgaatgacttcct

SEQ ID NO: 888041 - DNA, 25 bp, Mus musculus
tggcttgacggtactccctagctgg

SEQ ID NO: 888042 - DNA, 25 bp, Mus musculus
tggcttgacggttctccctagctgg

SEQ ID NO: 888043 - DNA, 25 bp, Mus musculus
tggcttgactacagctctggtcgac

SEQ ID NO: 888044 - DNA, 25 bp, Mus musculus
tggcttgactactgctctggtcgac

SEQ ID NO: 888045 - DNA, 25 bp, Mus musculus
tggcttgagctaagcccaacatcag

SEQ ID NO: 888046 - DNA, 25 bp, Mus musculus
tggcttgagctatgcccaacatcag

SEQ ID NO: 888047 - DNA, 25 bp, Mus musculus
tggcttgaggctaggtctgtcccaa

SEQ ID NO: 888048 - DNA, 25 bp, Mus musculus
tggcttgaggcttggtctgtcccaa

SEQ ID NO: 888049 - DNA, 25 bp, Mus musculus
tggcttgagtaacgcctaccactgt

SEQ ID NO: 888050 - DNA, 25 bp, Mus musculus
tggcttgagtaaggcctaccactgt

SEQ ID NO: 888051 - DNA, 25 bp, Mus musculus
tggcttgatcttctgtaggcaatca

SEQ ID NO: 888052 - DNA, 25 bp, Mus musculus
tggcttgatcttgtgtaggcaatca

SEQ ID NO: 888053 - DNA, 25 bp, Mus musculus
tggcttgatttacgctcattgttac

SEQ ID NO: 888054 - DNA, 25 bp, Mus musculus
tggcttgatttaggctcattgttac

SEQ ID NO: 888055 - DNA, 25 bp, Mus musculus
tggcttgcaccactgtgtctgacac

SEQ ID NO: 888056 - DNA, 25 bp, Mus musculus
tggcttgcaccagtgtgtctgacac

SEQ ID NO: 888057 - DNA, 25 bp, Mus musculus
tggcttgcacccagtgaatacttgc

SEQ ID NO: 888058 - DNA, 25 bp, Mus musculus
tggcttgcaccctgtgaatacttgc

SEQ ID NO: 888059 - DNA, 25 bp, Mus musculus
tggcttgcagcacattggacttgat

SEQ ID NO: 888060 - DNA, 25 bp, Mus musculus
tggcttgcagcagattggacttgat

SEQ ID NO: 888061 - DNA, 25 bp, Mus musculus
tggcttgcaggccacactggacaag

SEQ ID NO: 888062 - DNA, 25 bp, Mus musculus
tggcttgcaggcgacactggacaag

SEQ ID NO: 888063 - DNA, 25 bp, Mus musculus
tggcttgcatctatctagctctctt

SEQ ID NO: 888064 - DNA, 25 bp, Mus musculus
tggcttgcatctttctagctctctt

SEQ ID NO: 888065 - DNA, 25 bp, Mus musculus
tggcttgcatgtccctatccaaaat

SEQ ID NO: 888066 - DNA, 25 bp, Mus musculus
tggcttgcatgtgcctatccaaaat

SEQ ID NO: 888067 - DNA, 25 bp, Mus musculus
tggcttgcattcctcttcatatcat

SEQ ID NO: 888068 - DNA, 25 bp, Mus musculus
tggcttgcattcgtcttcatatcat

SEQ ID NO: 888069 - DNA, 25 bp, Mus musculus
tggcttgcatttcggctgtccaaaa

SEQ ID NO: 888070 - DNA, 25 bp, Mus musculus
tggcttgcatttgggctgtccaaaa

SEQ ID NO: 888071 - DNA, 25 bp, Mus musculus
tggcttgccaccagcattcataata

SEQ ID NO: 888072 - DNA, 25 bp, Mus musculus
tggcttgccacctgcattcataata

SEQ ID NO: 888073 - DNA, 25 bp, Mus musculus
tggcttgcccttacgcgggtgtgta

SEQ ID NO: 888074 - DNA, 25 bp, Mus musculus
tggcttgccctttcgcgggtgtgta

SEQ ID NO: 888075 - DNA, 25 bp, Mus musculus
tggcttgcctgcagtcccaagtggt

SEQ ID NO: 888076 - DNA, 25 bp, Mus musculus
tggcttgcctgctgtcccaagtggt

SEQ ID NO: 888077 - DNA, 25 bp, Mus musculus
tggcttgcgtttccctcagcggata

SEQ ID NO: 888078 - DNA, 25 bp, Mus musculus
tggcttgcgtttgcctcagcggata

SEQ ID NO: 888079 - DNA, 25 bp, Mus musculus
tggcttgctatcctcaatgtcccag

SEQ ID NO: 888080 - DNA, 25 bp, Mus musculus
tggcttgctatcgtcaatgtcccag

SEQ ID NO: 888081 - DNA, 25 bp, Mus musculus
tggcttgctcctagaccacattgaa

SEQ ID NO: 888082 - DNA, 25 bp, Mus musculus
tggcttgctccttgaccacattgaa

SEQ ID NO: 888083 - DNA, 25 bp, Mus musculus
tggcttgctcgtccgcggcaacaca

SEQ ID NO: 888084 - DNA, 25 bp, Mus musculus
tggcttgctcgtgcgcggcaacaca

SEQ ID NO: 888085 - DNA, 25 bp, Mus musculus
tggcttgctgagacacaaccttgtg

SEQ ID NO: 888086 - DNA, 25 bp, Mus musculus
tggcttgctgagaggaaaatgattc

SEQ ID NO: 888087 - DNA, 25 bp, Mus musculus
tggcttgctgagtcacaaccttgtg

SEQ ID NO: 888088 - DNA, 25 bp, Mus musculus
tggcttgctgagtggaaaatgattc

SEQ ID NO: 888089 - DNA, 25 bp, Mus musculus
tggcttgctgccactggagtacaag

SEQ ID NO: 888090 - DNA, 25 bp, Mus musculus
tggcttgctgcctctggagtacaag

SEQ ID NO: 888091 - DNA, 25 bp, Mus musculus
tggcttgctgtcctttttctgggcc

SEQ ID NO: 888092 - DNA, 25 bp, Mus musculus
tggcttgctgtcgtttttctgggcc

SEQ ID NO: 888093 - DNA, 25 bp, Mus musculus
tggcttgcttctaagctcacagaga

SEQ ID NO: 888094 - DNA, 25 bp, Mus musculus
tggcttgcttcttagctcacagaga

SEQ ID NO: 888095 - DNA, 25 bp, Mus musculus
tggcttgcttggcatgttgctgtcc

SEQ ID NO: 888096 - DNA, 25 bp, Mus musculus
tggcttgcttgggatgttgctgtcc

SEQ ID NO: 888097 - DNA, 25 bp, Mus musculus
tggcttgctttaattacctctggtt

SEQ ID NO: 888098 - DNA, 25 bp, Mus musculus
tggcttgctttatttacctctggtt

SEQ ID NO: 888099 - DNA, 25 bp, Mus musculus
tggcttggacttcataccctttatt

SEQ ID NO: 888100 - DNA, 25 bp, Mus musculus
tggcttggacttgataccctttatt

SEQ ID NO: 888101 - DNA, 25 bp, Mus musculus
tggcttggagggatggtccttcctt

SEQ ID NO: 888102 - DNA, 25 bp, Mus musculus
tggcttggagggttggtccttcctt

SEQ ID NO: 888103 - DNA, 25 bp, Mus musculus
tggcttggatccacactatgggcat

SEQ ID NO: 888104 - DNA, 25 bp, Mus musculus
tggcttggatcctcactatgggcat

SEQ ID NO: 888105 - DNA, 25 bp, Mus musculus
tggcttggatgtctgttcctcactc

SEQ ID NO: 888106 - DNA, 25 bp, Mus musculus
tggcttggatgtgtgttcctcactc

SEQ ID NO: 888107 - DNA, 25 bp, Mus musculus
tggcttggcacccttgaagctagaa

SEQ ID NO: 888108 - DNA, 25 bp, Mus musculus
tggcttggcaccgttgaagctagaa

SEQ ID NO: 888109 - DNA, 25 bp, Mus musculus
tggcttggccatcttcctgtcactg

SEQ ID NO: 888110 - DNA, 25 bp, Mus musculus
tggcttggccatgttcctgtcactg

SEQ ID NO: 888111 - DNA, 25 bp, Mus musculus
tggcttggcttcaggacctccagct

SEQ ID NO: 888112 - DNA, 25 bp, Mus musculus
tggcttggcttctggacctccagct

SEQ ID NO: 888113 - DNA, 25 bp, Mus musculus
tggcttgggcttctttttcacgaaa

SEQ ID NO: 888114 - DNA, 25 bp, Mus musculus
tggcttgggcttgtttttcacgaaa

SEQ ID NO: 888115 - DNA, 25 bp, Mus musculus
tggcttggtactacctagttaggct

SEQ ID NO: 888116 - DNA, 25 bp, Mus musculus
tggcttggtacttcctagttaggct

SEQ ID NO: 888117 - DNA, 25 bp, Mus musculus
tggcttggttggagccttctgaata

SEQ ID NO: 888118 - DNA, 25 bp, Mus musculus
tggcttggttggattctcagtagct

SEQ ID NO: 888119 - DNA, 25 bp, Mus musculus
tggcttggttggtgccttctgaata

SEQ ID NO: 888120 - DNA, 25 bp, Mus musculus
tggcttggttggtttctcagtagct

SEQ ID NO: 888121 - DNA, 25 bp, Mus musculus
tggcttgtatgtcgaagactaaaaa

SEQ ID NO: 888122 - DNA, 25 bp, Mus musculus
tggcttgtatgtggaagactaaaaa

SEQ ID NO: 888123 - DNA, 25 bp, Mus musculus
tggcttgtctctcatgttgttatgt

SEQ ID NO: 888124 - DNA, 25 bp, Mus musculus
tggcttgtctctgatgttgttatgt

SEQ ID NO: 888125 - DNA, 25 bp, Mus musculus
tggcttgtctttcctatttgcacag

SEQ ID NO: 888126 - DNA, 25 bp, Mus musculus
tggcttgtctttgctatttgcacag

SEQ ID NO: 888127 - DNA, 25 bp, Mus musculus
tggcttgtgacaaccaaccaacggc

SEQ ID NO: 888128 - DNA, 25 bp, Mus musculus
tggcttgtgacatccaaccaacggc

SEQ ID NO: 888129 - DNA, 25 bp, Mus musculus
tggcttgtgcaactgactctgtagt

SEQ ID NO: 888130 - DNA, 25 bp, Mus musculus
tggcttgtgcaagtgactctgtagt

SEQ ID NO: 888131 - DNA, 25 bp, Mus musculus
tggcttgtgcttagtattgtcctcc

SEQ ID NO: 888132 - DNA, 25 bp, Mus musculus
tggcttgtgctttgtattgtcctcc

SEQ ID NO: 888133 - DNA, 25 bp, Mus musculus
tggcttgtggttcatggtcactatt

SEQ ID NO: 888134 - DNA, 25 bp, Mus musculus
tggcttgtggttgatggtcactatt

SEQ ID NO: 888135 - DNA, 25 bp, Mus musculus
tggcttgtgtgtcctttgtctcagc

SEQ ID NO: 888136 - DNA, 25 bp, Mus musculus
tggcttgtgtgtgctttgtctcagc

SEQ ID NO: 888137 - DNA, 25 bp, Mus musculus
tggcttgttactcccttttgtcaaa

SEQ ID NO: 888138 - DNA, 25 bp, Mus musculus
tggcttgttactgccttttgtcaaa

SEQ ID NO: 888139 - DNA, 25 bp, Mus musculus
tggcttgttattaccttgaagtcta

SEQ ID NO: 888140 - DNA, 25 bp, Mus musculus
tggcttgttatttccttgaagtcta

SEQ ID NO: 888141 - DNA, 25 bp, Mus musculus
tggcttgttctacaggattccctgg

SEQ ID NO: 888142 - DNA, 25 bp, Mus musculus
tggcttgttctagaggattccctgg

SEQ ID NO: 888143 - DNA, 25 bp, Mus musculus
tggcttgttttcatgggttttgtat

SEQ ID NO: 888144 - DNA, 25 bp, Mus musculus
tggcttgttttccagacctgactgt

SEQ ID NO: 888145 - DNA, 25 bp, Mus musculus
tggcttgttttcgagacctgactgt

SEQ ID NO: 888146 - DNA, 25 bp, Mus musculus
tggcttgttttcttgggttttgtat

SEQ ID NO: 888147 - DNA, 25 bp, Mus musculus
tggctttaacagctgctacctcaag

SEQ ID NO: 888148 - DNA, 25 bp, Mus musculus
tggctttaacaggtgctacctcaag

SEQ ID NO: 888149 - DNA, 25 bp, Mus musculus
tggctttaacttccatttcctccgt

SEQ ID NO: 888150 - DNA, 25 bp, Mus musculus
tggctttaacttgcatttcctccgt

SEQ ID NO: 888151 - DNA, 25 bp, Mus musculus
tggctttaatacatgatcttgtcac

SEQ ID NO: 888152 - DNA, 25 bp, Mus musculus
tggctttaatacttgatcttgtcac

SEQ ID NO: 888153 - DNA, 25 bp, Mus musculus
tggctttaatggctttaccaccacc

SEQ ID NO: 888154 - DNA, 25 bp, Mus musculus
tggctttaatgggtttaccaccacc

SEQ ID NO: 888155 - DNA, 25 bp, Mus musculus
tggctttacacgcatgcagctgaga

SEQ ID NO: 888156 - DNA, 25 bp, Mus musculus
tggctttacacggatgcagctgaga

SEQ ID NO: 888157 - DNA, 25 bp, Mus musculus
tggctttactgcagtacctccacca

SEQ ID NO: 888158 - DNA, 25 bp, Mus musculus
tggctttactgctgtacctccacca

SEQ ID NO: 888159 - DNA, 25 bp, Mus musculus
tggctttacttcacagtccctctct

SEQ ID NO: 888160 - DNA, 25 bp, Mus musculus
tggctttacttctcagtccctctct

SEQ ID NO: 888161 - DNA, 25 bp, Mus musculus
tggctttagaagacacatcaggatt

SEQ ID NO: 888162 - DNA, 25 bp, Mus musculus
tggctttagaagtcacatcaggatt

SEQ ID NO: 888163 - DNA, 25 bp, Mus musculus
tggctttaggccacctgttacagct

SEQ ID NO: 888164 - DNA, 25 bp, Mus musculus
tggctttaggccattctcataagtt

SEQ ID NO: 888165 - DNA, 25 bp, Mus musculus
tggctttaggcctcctgttacagct

SEQ ID NO: 888166 - DNA, 25 bp, Mus musculus
tggctttaggcctttctcataagtt

SEQ ID NO: 888167 - DNA, 25 bp, Mus musculus
tggctttagggaaattctttagggt

SEQ ID NO: 888168 - DNA, 25 bp, Mus musculus
tggctttagggatattctttagggt

SEQ ID NO: 888169 - DNA, 25 bp, Mus musculus
tggctttatcaacgcagactgaatg

SEQ ID NO: 888170 - DNA, 25 bp, Mus musculus
tggctttatcaaggcagactgaatg

SEQ ID NO: 888171 - DNA, 25 bp, Mus musculus
tggctttatggcaagaatacggaaa

SEQ ID NO: 888172 - DNA, 25 bp, Mus musculus
tggctttatggctagaatacggaaa

SEQ ID NO: 888173 - DNA, 25 bp, Mus musculus
tggctttattacagcaccgcattca

SEQ ID NO: 888174 - DNA, 25 bp, Mus musculus
tggctttattactgcaccgcattca

SEQ ID NO: 888175 - DNA, 25 bp, Mus musculus
tggctttcaaagatctcagtgtgtg

SEQ ID NO: 888176 - DNA, 25 bp, Mus musculus
tggctttcaaagttctcagtgtgtg

SEQ ID NO: 888177 - DNA, 25 bp, Mus musculus
tggctttcaacacttatgctacctg

SEQ ID NO: 888178 - DNA, 25 bp, Mus musculus
tggctttcaacagttatgctacctg

SEQ ID NO: 888179 - DNA, 25 bp, Mus musculus
tggctttcaaccatcctaatgttgt

SEQ ID NO: 888180 - DNA, 25 bp, Mus musculus
tggctttcaaccttcctaatgttgt

SEQ ID NO: 888181 - DNA, 25 bp, Mus musculus
tggctttcactacttggatccctag

SEQ ID NO: 888182 - DNA, 25 bp, Mus musculus
tggctttcactagttggatccctag

SEQ ID NO: 888183 - DNA, 25 bp, Mus musculus
tggctttcagacacaactcacatca

SEQ ID NO: 888184 - DNA, 25 bp, Mus musculus
tggctttcagacacttattccagtc

SEQ ID NO: 888185 - DNA, 25 bp, Mus musculus
tggctttcagactcaactcacatca

SEQ ID NO: 888186 - DNA, 25 bp, Mus musculus
tggctttcagactcttattccagtc

SEQ ID NO: 888187 - DNA, 25 bp, Mus musculus
tggctttcagccaaaggtaccctgt

SEQ ID NO: 888188 - DNA, 25 bp, Mus musculus
tggctttcagccattggactagagt

SEQ ID NO: 888189 - DNA, 25 bp, Mus musculus
tggctttcagcctaaggtaccctgt

SEQ ID NO: 888190 - DNA, 25 bp, Mus musculus
tggctttcagcctttggactagagt

SEQ ID NO: 888191 - DNA, 25 bp, Mus musculus
tggctttcataactggatccgcttc

SEQ ID NO: 888192 - DNA, 25 bp, Mus musculus
tggctttcataagtggatccgcttc

SEQ ID NO: 888193 - DNA, 25 bp, Mus musculus
tggctttcatggaggcccaatgtca

SEQ ID NO: 888194 - DNA, 25 bp, Mus musculus
tggctttcatggtggcccaatgtca

SEQ ID NO: 888195 - DNA, 25 bp, Mus musculus
tggctttcattcatggtgactaatg

SEQ ID NO: 888196 - DNA, 25 bp, Mus musculus
tggctttcattcttggtgactaatg

SEQ ID NO: 888197 - DNA, 25 bp, Mus musculus
tggctttccaaacacacgatagatg

SEQ ID NO: 888198 - DNA, 25 bp, Mus musculus
tggctttccaaagacacgatagatg

SEQ ID NO: 888199 - DNA, 25 bp, Mus musculus
tggctttccagcagaacctcttgat

SEQ ID NO: 888200 - DNA, 25 bp, Mus musculus
tggctttccagctgaacctcttgat

SEQ ID NO: 888201 - DNA, 25 bp, Mus musculus
tggctttccaggagaggagtctcca

SEQ ID NO: 888202 - DNA, 25 bp, Mus musculus
tggctttccaggtgaggagtctcca

SEQ ID NO: 888203 - DNA, 25 bp, Mus musculus
tggctttcccacatggactctgtaa

SEQ ID NO: 888204 - DNA, 25 bp, Mus musculus
tggctttcccacttggactctgtaa

SEQ ID NO: 888205 - DNA, 25 bp, Mus musculus
tggctttccccaaagagtggttctc

SEQ ID NO: 888206 - DNA, 25 bp, Mus musculus
tggctttccccatagagtggttctc

SEQ ID NO: 888207 - DNA, 25 bp, Mus musculus
tggctttcctcaacatccaatcaaa

SEQ ID NO: 888208 - DNA, 25 bp, Mus musculus
tggctttcctcatcatccaatcaaa

SEQ ID NO: 888209 - DNA, 25 bp, Mus musculus
tggctttccttacttatactgtcac

SEQ ID NO: 888210 - DNA, 25 bp, Mus musculus
tggctttccttagttatactgtcac

SEQ ID NO: 888211 - DNA, 25 bp, Mus musculus
tggctttcgccacaagagagtccta

SEQ ID NO: 888212 - DNA, 25 bp, Mus musculus
tggctttcgccagaagagagtccta

SEQ ID NO: 888213 - DNA, 25 bp, Mus musculus
tggctttctacactacacatgcttt

SEQ ID NO: 888214 - DNA, 25 bp, Mus musculus
tggctttctacagtacacatgcttt

SEQ ID NO: 888215 - DNA, 25 bp, Mus musculus
tggctttctctgagcctagagtcat

SEQ ID NO: 888216 - DNA, 25 bp, Mus musculus
tggctttctctgtgcctagagtcat

SEQ ID NO: 888217 - DNA, 25 bp, Mus musculus
tggctttctgaacactgagactgaa

SEQ ID NO: 888218 - DNA, 25 bp, Mus musculus
tggctttctgaacattggtacatgc

SEQ ID NO: 888219 - DNA, 25 bp, Mus musculus
tggctttctgaagactgagactgaa

SEQ ID NO: 888220 - DNA, 25 bp, Mus musculus
tggctttctgaagattggtacatgc

SEQ ID NO: 888221 - DNA, 25 bp, Mus musculus
tggctttctgacatgtatccctcaa

SEQ ID NO: 888222 - DNA, 25 bp, Mus musculus
tggctttctgacttgtatccctcaa

SEQ ID NO: 888223 - DNA, 25 bp, Mus musculus
tggctttctgtgaaaatacttaact

SEQ ID NO: 888224 - DNA, 25 bp, Mus musculus
tggctttctgtgtaaatacttaact

SEQ ID NO: 888225 - DNA, 25 bp, Mus musculus
tggctttcttcacttccagcgtcaa

SEQ ID NO: 888226 - DNA, 25 bp, Mus musculus
tggctttcttcagttccagcgtcaa

SEQ ID NO: 888227 - DNA, 25 bp, Mus musculus
tggctttcttcccaagctgtcagaa

SEQ ID NO: 888228 - DNA, 25 bp, Mus musculus
tggctttcttccgaagctgtcagaa

SEQ ID NO: 888229 - DNA, 25 bp, Mus musculus
tggctttctttccatagcctacgtt

SEQ ID NO: 888230 - DNA, 25 bp, Mus musculus
tggctttctttcgatagcctacgtt

SEQ ID NO: 888231 - DNA, 25 bp, Mus musculus
tggctttgaacacaggatccacctg

SEQ ID NO: 888232 - DNA, 25 bp, Mus musculus
tggctttgaacagaggatccacctg

SEQ ID NO: 888233 - DNA, 25 bp, Mus musculus
tggctttgaaccacatcatgtaagt

SEQ ID NO: 888234 - DNA, 25 bp, Mus musculus
tggctttgaacctcatcatgtaagt

SEQ ID NO: 888235 - DNA, 25 bp, Mus musculus
tggctttgaactaactgcacagtga

SEQ ID NO: 888236 - DNA, 25 bp, Mus musculus
tggctttgaactcactaccttggtc

SEQ ID NO: 888237 - DNA, 25 bp, Mus musculus
tggctttgaactcttgcagctgagg

SEQ ID NO: 888238 - DNA, 25 bp, Mus musculus
tggctttgaactgactaccttggtc

SEQ ID NO: 888239 - DNA, 25 bp, Mus musculus
tggctttgaactgttgcagctgagg

SEQ ID NO: 888240 - DNA, 25 bp, Mus musculus
tggctttgaacttactgcacagtga

SEQ ID NO: 888241 - DNA, 25 bp, Mus musculus
tggctttgaagtatcggctccgaat

SEQ ID NO: 888242 - DNA, 25 bp, Mus musculus
tggctttgaagtttcggctccgaat

SEQ ID NO: 888243 - DNA, 25 bp, Mus musculus
tggctttgaatgattactatttggt

SEQ ID NO: 888244 - DNA, 25 bp, Mus musculus
tggctttgaatgtttactatttggt

SEQ ID NO: 888245 - DNA, 25 bp, Mus musculus
tggctttgacacctctgtttcaggg

SEQ ID NO: 888246 - DNA, 25 bp, Mus musculus
tggctttgacacgtctgtttcaggg

SEQ ID NO: 888247 - DNA, 25 bp, Mus musculus
tggctttgaggtctcagcatctggg

SEQ ID NO: 888248 - DNA, 25 bp, Mus musculus
tggctttgaggtgtcagcatctggg

SEQ ID NO: 888249 - DNA, 25 bp, Mus musculus
tggctttgccatcctgggttcccaa

SEQ ID NO: 888250 - DNA, 25 bp, Mus musculus
tggctttgccatgctgggttcccaa

SEQ ID NO: 888251 - DNA, 25 bp, Mus musculus
tggctttgcccacctggcttccttg

SEQ ID NO: 888252 - DNA, 25 bp, Mus musculus
tggctttgcccagctggcttccttg

SEQ ID NO: 888253 - DNA, 25 bp, Mus musculus
tggctttgccgaactcaagacacag

SEQ ID NO: 888254 - DNA, 25 bp, Mus musculus
tggctttgccgatctcaagacacag

SEQ ID NO: 888255 - DNA, 25 bp, Mus musculus
tggctttgctctctgccatgctgtg

SEQ ID NO: 888256 - DNA, 25 bp, Mus musculus
tggctttgctctgtgccatgctgtg

SEQ ID NO: 888257 - DNA, 25 bp, Mus musculus
tggctttgctttctgtaatctctgc

SEQ ID NO: 888258 - DNA, 25 bp, Mus musculus
tggctttgctttgtgtaatctctgc

SEQ ID NO: 888259 - DNA, 25 bp, Mus musculus
tggctttggaagcaccagggagtag

SEQ ID NO: 888260 - DNA, 25 bp, Mus musculus
tggctttggaaggaccagggagtag

SEQ ID NO: 888261 - DNA, 25 bp, Mus musculus
tggctttggcatcatctatgattct

SEQ ID NO: 888262 - DNA, 25 bp, Mus musculus
tggctttggcatgatctatgattct

SEQ ID NO: 888263 - DNA, 25 bp, Mus musculus
tggctttgggcactttttcttcatc

SEQ ID NO: 888264 - DNA, 25 bp, Mus musculus
tggctttgggcagtttttcttcatc

SEQ ID NO: 888265 - DNA, 25 bp, Mus musculus
tggctttggtacaggttttggcaca

SEQ ID NO: 888266 - DNA, 25 bp, Mus musculus
tggctttggtactggttttggcaca

SEQ ID NO: 888267 - DNA, 25 bp, Mus musculus
tggctttgtcctctggcatgaaaca

SEQ ID NO: 888268 - DNA, 25 bp, Mus musculus
tggctttgtcctgtggcatgaaaca

SEQ ID NO: 888269 - DNA, 25 bp, Mus musculus
tggctttgttccaacacgggagaca

SEQ ID NO: 888270 - DNA, 25 bp, Mus musculus
tggctttgttcctacacgggagaca

SEQ ID NO: 888271 - DNA, 25 bp, Mus musculus
tggctttgttctagctctctccctc

SEQ ID NO: 888272 - DNA, 25 bp, Mus musculus
tggctttgttcttgctctctccctc

SEQ ID NO: 888273 - DNA, 25 bp, Mus musculus
tggctttgtttactcatgcatagaa

SEQ ID NO: 888274 - DNA, 25 bp, Mus musculus
tggctttgtttagtcatgcatagaa

SEQ ID NO: 888275 - DNA, 25 bp, Mus musculus
tggcttttaatcacggctgtgaccc

SEQ ID NO: 888276 - DNA, 25 bp, Mus musculus
tggcttttaatctcggctgtgaccc

SEQ ID NO: 888277 - DNA, 25 bp, Mus musculus
tggcttttaatgaacaccataattt

SEQ ID NO: 888278 - DNA, 25 bp, Mus musculus
tggcttttaatgtacaccataattt

SEQ ID NO: 888279 - DNA, 25 bp, Mus musculus
tggcttttaattcgcagtcacttgg

SEQ ID NO: 888280 - DNA, 25 bp, Mus musculus
tggcttttaattggcagtcacttgg

SEQ ID NO: 888281 - DNA, 25 bp, Mus musculus
tggcttttacctcagcgtgtcagat

SEQ ID NO: 888282 - DNA, 25 bp, Mus musculus
tggcttttacctgagcgtgtcagat

SEQ ID NO: 888283 - DNA, 25 bp, Mus musculus
tggcttttactacgcactctcagac

SEQ ID NO: 888284 - DNA, 25 bp, Mus musculus
tggcttttactaggcactctcagac

SEQ ID NO: 888285 - DNA, 25 bp, Mus musculus
tggcttttagagctttttcattatc

SEQ ID NO: 888286 - DNA, 25 bp, Mus musculus
tggcttttagaggtttttcattatc

SEQ ID NO: 888287 - DNA, 25 bp, Mus musculus
tggcttttagccacttgtaattatt

SEQ ID NO: 888288 - DNA, 25 bp, Mus musculus
tggcttttagcctcttgtaattatt

SEQ ID NO: 888289 - DNA, 25 bp, Mus musculus
tggcttttatcaagctaatatttgc

SEQ ID NO: 888290 - DNA, 25 bp, Mus musculus
tggcttttatcatgctaatatttgc

SEQ ID NO: 888291 - DNA, 25 bp, Mus musculus
tggcttttatctcctagtctttcat

SEQ ID NO: 888292 - DNA, 25 bp, Mus musculus
tggcttttatctgctagtctttcat

SEQ ID NO: 888293 - DNA, 25 bp, Mus musculus
tggcttttcaaacgtttattcatac

SEQ ID NO: 888294 - DNA, 25 bp, Mus musculus
tggcttttcaaaggtttattcatac

SEQ ID NO: 888295 - DNA, 25 bp, Mus musculus
tggcttttccagctatgtgtcgtag

SEQ ID NO: 888296 - DNA, 25 bp, Mus musculus
tggcttttccaggtatgtgtcgtag

SEQ ID NO: 888297 - DNA, 25 bp, Mus musculus
tggcttttcccactctgttcacatc

SEQ ID NO: 888298 - DNA, 25 bp, Mus musculus
tggcttttcccagtctgttcacatc

SEQ ID NO: 888299 - DNA, 25 bp, Mus musculus
tggcttttcctgatggccccataag

SEQ ID NO: 888300 - DNA, 25 bp, Mus musculus
tggcttttcctgttggccccataag

SEQ ID NO: 888301 - DNA, 25 bp, Mus musculus
tggcttttcggaacccaggaatcca

SEQ ID NO: 888302 - DNA, 25 bp, Mus musculus
tggcttttcggatcccaggaatcca

SEQ ID NO: 888303 - DNA, 25 bp, Mus musculus
tggcttttcgtcatttctgccctgg

SEQ ID NO: 888304 - DNA, 25 bp, Mus musculus
tggcttttcgtcttttctgccctgg

SEQ ID NO: 888305 - DNA, 25 bp, Mus musculus
tggcttttctaaatgcattgtcgag

SEQ ID NO: 888306 - DNA, 25 bp, Mus musculus
tggcttttctaattgcattgtcgag

SEQ ID NO: 888307 - DNA, 25 bp, Mus musculus
tggcttttctcaattcaactcctgt

SEQ ID NO: 888308 - DNA, 25 bp, Mus musculus
tggcttttctcatttcaactcctgt

SEQ ID NO: 888309 - DNA, 25 bp, Mus musculus
tggcttttctccagtcactactgtg

SEQ ID NO: 888310 - DNA, 25 bp, Mus musculus
tggcttttctcctgtcactactgtg

SEQ ID NO: 888311 - DNA, 25 bp, Mus musculus
tggcttttctggcagctttgtatca

SEQ ID NO: 888312 - DNA, 25 bp, Mus musculus
tggcttttctgggagctttgtatca

SEQ ID NO: 888313 - DNA, 25 bp, Mus musculus
tggcttttcttccaatatgtggaat

SEQ ID NO: 888314 - DNA, 25 bp, Mus musculus
tggcttttcttccaccttagatcag

SEQ ID NO: 888315 - DNA, 25 bp, Mus musculus
tggcttttcttcgaatatgtggaat

SEQ ID NO: 888316 - DNA, 25 bp, Mus musculus
tggcttttcttcgaccttagatcag

SEQ ID NO: 888317 - DNA, 25 bp, Mus musculus
tggcttttctttaaccagcccaaat

SEQ ID NO: 888318 - DNA, 25 bp, Mus musculus
tggcttttcttttaccagcccaaat

SEQ ID NO: 888319 - DNA, 25 bp, Mus musculus
tggcttttgaaacccacttaaggat

SEQ ID NO: 888320 - DNA, 25 bp, Mus musculus
tggcttttgaaagccacttaaggat

SEQ ID NO: 888321 - DNA, 25 bp, Mus musculus
tggcttttgatgcactatctcattc

SEQ ID NO: 888322 - DNA, 25 bp, Mus musculus
tggcttttgatggactatctcattc

SEQ ID NO: 888323 - DNA, 25 bp, Mus musculus
tggcttttgcaaatgagtgaacttc

SEQ ID NO: 888324 - DNA, 25 bp, Mus musculus
tggcttttgcaattgagtgaacttc

SEQ ID NO: 888325 - DNA, 25 bp, Mus musculus
tggcttttgcagatcaggaaattga

SEQ ID NO: 888326 - DNA, 25 bp, Mus musculus
tggcttttgcagttcaggaaattga

SEQ ID NO: 888327 - DNA, 25 bp, Mus musculus
tggcttttgccacttgtcccagtta

SEQ ID NO: 888328 - DNA, 25 bp, Mus musculus
tggcttttgccagttgtcccagtta

SEQ ID NO: 888329 - DNA, 25 bp, Mus musculus
tggcttttgcttatgtcccagtcca

SEQ ID NO: 888330 - DNA, 25 bp, Mus musculus
tggcttttgcttcctcactaaacat

SEQ ID NO: 888331 - DNA, 25 bp, Mus musculus
tggcttttgcttcttatttctcatt

SEQ ID NO: 888332 - DNA, 25 bp, Mus musculus
tggcttttgcttgctcactaaacat

SEQ ID NO: 888333 - DNA, 25 bp, Mus musculus
tggcttttgcttgttatttctcatt

SEQ ID NO: 888334 - DNA, 25 bp, Mus musculus
tggcttttgcttttgtcccagtcca

SEQ ID NO: 888335 - DNA, 25 bp, Mus musculus
tggcttttggtgatgatgtttccac

SEQ ID NO: 888336 - DNA, 25 bp, Mus musculus
tggcttttggtgttgatgtttccac

SEQ ID NO: 888337 - DNA, 25 bp, Mus musculus
tggcttttgtagacagtatattgta

SEQ ID NO: 888338 - DNA, 25 bp, Mus musculus
tggcttttgtagtcagtatattgta

SEQ ID NO: 888339 - DNA, 25 bp, Mus musculus
tggcttttgtttaattggcttgggt

SEQ ID NO: 888340 - DNA, 25 bp, Mus musculus
tggcttttgttttattggcttgggt

SEQ ID NO: 888341 - DNA, 25 bp, Mus musculus
tggctttttccacttatcatcctca

SEQ ID NO: 888342 - DNA, 25 bp, Mus musculus
tggctttttccagttatcatcctca

SEQ ID NO: 888343 - DNA, 25 bp, Mus musculus
tggctttttgagacaccgggataat

SEQ ID NO: 888344 - DNA, 25 bp, Mus musculus
tggctttttgagtcaccgggataat

SEQ ID NO: 888345 - DNA, 25 bp, Mus musculus
tggctttttggaccaaacacagttg

SEQ ID NO: 888346 - DNA, 25 bp, Mus musculus
tggctttttggagcaaacacagttg

SEQ ID NO: 888347 - DNA, 25 bp, Mus musculus
tgggaaaaccaacctttccatgatt

SEQ ID NO: 888348 - DNA, 25 bp, Mus musculus
tgggaaaaccaagctttccatgatt

SEQ ID NO: 888349 - DNA, 25 bp, Mus musculus
tgggaaaacgagctccaagatggat

SEQ ID NO: 888350 - DNA, 25 bp, Mus musculus
tgggaaaacgaggtccaagatggat

SEQ ID NO: 888351 - DNA, 25 bp, Mus musculus
tgggaaaagaccacttctaccctca

SEQ ID NO: 888352 - DNA, 25 bp, Mus musculus
tgggaaaagacctcttctaccctca

SEQ ID NO: 888353 - DNA, 25 bp, Mus musculus
tgggaaaaggccaccctgtgctgac

SEQ ID NO: 888354 - DNA, 25 bp, Mus musculus
tgggaaaaggcctccctgtgctgac

SEQ ID NO: 888355 - DNA, 25 bp, Mus musculus
tgggaaaagtgaaaaggccccacaa

SEQ ID NO: 888356 - DNA, 25 bp, Mus musculus
tgggaaaagtgataaggccccacaa

SEQ ID NO: 888357 - DNA, 25 bp, Mus musculus
tgggaaaatactcttctaggtcatt

SEQ ID NO: 888358 - DNA, 25 bp, Mus musculus
tgggaaaatactgttctaggtcatt

SEQ ID NO: 888359 - DNA, 25 bp, Mus musculus
tgggaaaatgctacttttctccttc

SEQ ID NO: 888360 - DNA, 25 bp, Mus musculus
tgggaaaatgcttcttttctccttc

SEQ ID NO: 888361 - DNA, 25 bp, Mus musculus
tgggaaacaaccaccaacacaggat

SEQ ID NO: 888362 - DNA, 25 bp, Mus musculus
tgggaaacaacctccaacacaggat

SEQ ID NO: 888363 - DNA, 25 bp, Mus musculus
tgggaaacaatgactgcctctgctg

SEQ ID NO: 888364 - DNA, 25 bp, Mus musculus
tgggaaacaatgtctgcctctgctg

SEQ ID NO: 888365 - DNA, 25 bp, Mus musculus
tgggaaacacaaccagcccaaggga

SEQ ID NO: 888366 - DNA, 25 bp, Mus musculus
tgggaaacacaagcagcccaaggga

SEQ ID NO: 888367 - DNA, 25 bp, Mus musculus
tgggaaaccacaagtttgcagagat

SEQ ID NO: 888368 - DNA, 25 bp, Mus musculus
tgggaaaccacatgtttgcagagat

SEQ ID NO: 888369 - DNA, 25 bp, Mus musculus
tgggaaacccaaccttacctggaat

SEQ ID NO: 888370 - DNA, 25 bp, Mus musculus
tgggaaacccaagcttacctggaat

SEQ ID NO: 888371 - DNA, 25 bp, Mus musculus
tgggaaacccctccagaaggctggg

SEQ ID NO: 888372 - DNA, 25 bp, Mus musculus
tgggaaacccctgcagaaggctggg

SEQ ID NO: 888373 - DNA, 25 bp, Mus musculus
tgggaaacccggagttatcatctta

SEQ ID NO: 888374 - DNA, 25 bp, Mus musculus
tgggaaacccggtgttatcatctta

SEQ ID NO: 888375 - DNA, 25 bp, Mus musculus
tgggaaaccctcatgtgcttgtcag

SEQ ID NO: 888376 - DNA, 25 bp, Mus musculus
tgggaaaccctcttgtgcttgtcag

SEQ ID NO: 888377 - DNA, 25 bp, Mus musculus
tgggaaaccgatataatcacctcta

SEQ ID NO: 888378 - DNA, 25 bp, Mus musculus
tgggaaaccgatttaatcacctcta

SEQ ID NO: 888379 - DNA, 25 bp, Mus musculus
tgggaaacctggcacccggacgcct

SEQ ID NO: 888380 - DNA, 25 bp, Mus musculus
tgggaaacctgggacccggacgcct

SEQ ID NO: 888381 - DNA, 25 bp, Mus musculus
tgggaaaccttacatcttatcaatt

SEQ ID NO: 888382 - DNA, 25 bp, Mus musculus
tgggaaaccttagatcttatcaatt

SEQ ID NO: 888383 - DNA, 25 bp, Mus musculus
tgggaaacgacaccaaggccgtgct

SEQ ID NO: 888384 - DNA, 25 bp, Mus musculus
tgggaaacgacagcaaggccgtgct

SEQ ID NO: 888385 - DNA, 25 bp, Mus musculus
tgggaaacgcgcacaccataaaaaa

SEQ ID NO: 888386 - DNA, 25 bp, Mus musculus
tgggaaacgcgctcaccataaaaaa

SEQ ID NO: 888387 - DNA, 25 bp, Mus musculus
tgggaaacgggccttaaagcataga

SEQ ID NO: 888388 - DNA, 25 bp, Mus musculus
tgggaaacgggcgttaaagcataga

SEQ ID NO: 888389 - DNA, 25 bp, Mus musculus
tgggaaacgtgaccaaaccaactgt

SEQ ID NO: 888390 - DNA, 25 bp, Mus musculus
tgggaaacgtgagcaaaccaactgt

SEQ ID NO: 888391 - DNA, 25 bp, Mus musculus
tgggaaactcttctctaaaaccaga

SEQ ID NO: 888392 - DNA, 25 bp, Mus musculus
tgggaaactcttgtctaaaaccaga

SEQ ID NO: 888393 - DNA, 25 bp, Mus musculus
tgggaaactgaacacctggcagctc

SEQ ID NO: 888394 - DNA, 25 bp, Mus musculus
tgggaaactgaagacctggcagctc

SEQ ID NO: 888395 - DNA, 25 bp, Mus musculus
tgggaaactttgcatttctctctcc

SEQ ID NO: 888396 - DNA, 25 bp, Mus musculus
tgggaaactttggatttctctctcc

SEQ ID NO: 888397 - DNA, 25 bp, Mus musculus
tgggaaagaaacctctctgcacacc

SEQ ID NO: 888398 - DNA, 25 bp, Mus musculus
tgggaaagaaacgtctctgcacacc

SEQ ID NO: 888399 - DNA, 25 bp, Mus musculus
tgggaaagacaccagaactccctcc

SEQ ID NO: 888400 - DNA, 25 bp, Mus musculus
tgggaaagacacgagaactccctcc

SEQ ID NO: 888401 - DNA, 25 bp, Mus musculus
tgggaaagacatccagtgtagataa

SEQ ID NO: 888402 - DNA, 25 bp, Mus musculus
tgggaaagacatgcagtgtagataa

SEQ ID NO: 888403 - DNA, 25 bp, Mus musculus
tgggaaagatgtacagcagaaggct

SEQ ID NO: 888404 - DNA, 25 bp, Mus musculus
tgggaaagatgttcagcagaaggct

SEQ ID NO: 888405 - DNA, 25 bp, Mus musculus
tgggaaagccacacttttacttctt

SEQ ID NO: 888406 - DNA, 25 bp, Mus musculus
tgggaaagccactcttttacttctt

SEQ ID NO: 888407 - DNA, 25 bp, Mus musculus
tgggaaagccctcagtgacaattat

SEQ ID NO: 888408 - DNA, 25 bp, Mus musculus
tgggaaagccctgagtgacaattat

SEQ ID NO: 888409 - DNA, 25 bp, Mus musculus
tgggaaagcctgacaccagtgtctg

SEQ ID NO: 888410 - DNA, 25 bp, Mus musculus
tgggaaagcctgcaaccctgggctc

SEQ ID NO: 888411 - DNA, 25 bp, Mus musculus
tgggaaagcctggaaccctgggctc

SEQ ID NO: 888412 - DNA, 25 bp, Mus musculus
tgggaaagcctgtcaccagtgtctg

SEQ ID NO: 888413 - DNA, 25 bp, Mus musculus
tgggaaaggcccaactgcagttcga

SEQ ID NO: 888414 - DNA, 25 bp, Mus musculus
tgggaaaggccctactgcagttcga

SEQ ID NO: 888415 - DNA, 25 bp, Mus musculus
tgggaaatactgcatgctggctaaa

SEQ ID NO: 888416 - DNA, 25 bp, Mus musculus
tgggaaatactggatgctggctaaa

SEQ ID NO: 888417 - DNA, 25 bp, Mus musculus
tgggaaatagacatcctctctggct

SEQ ID NO: 888418 - DNA, 25 bp, Mus musculus
tgggaaatagacttcctctctggct

SEQ ID NO: 888419 - DNA, 25 bp, Mus musculus
tgggaaatagatatccctccctctc

SEQ ID NO: 888420 - DNA, 25 bp, Mus musculus
tgggaaatagatttccctccctctc

SEQ ID NO: 888421 - DNA, 25 bp, Mus musculus
tgggaaatccctcctggcacggaaa

SEQ ID NO: 888422 - DNA, 25 bp, Mus musculus
tgggaaatccctgctggcacggaaa

SEQ ID NO: 888423 - DNA, 25 bp, Mus musculus
tgggaaatctctccaggctgctagt

SEQ ID NO: 888424 - DNA, 25 bp, Mus musculus
tgggaaatctctgcaggctgctagt

SEQ ID NO: 888425 - DNA, 25 bp, Mus musculus
tgggaaatgctacccaacctaccag

SEQ ID NO: 888426 - DNA, 25 bp, Mus musculus
tgggaaatgctagccaacctaccag

SEQ ID NO: 888427 - DNA, 25 bp, Mus musculus
tgggaaatgctcagggctatattga

SEQ ID NO: 888428 - DNA, 25 bp, Mus musculus
tgggaaatgctctgggctatattga

SEQ ID NO: 888429 - DNA, 25 bp, Mus musculus
tgggaaatgcttccttcgaggaaga

SEQ ID NO: 888430 - DNA, 25 bp, Mus musculus
tgggaaatgcttgcttcgaggaaga

SEQ ID NO: 888431 - DNA, 25 bp, Mus musculus
tgggaaatggcacaaatcacctttt

SEQ ID NO: 888432 - DNA, 25 bp, Mus musculus
tgggaaatggcagaaatcacctttt

SEQ ID NO: 888433 - DNA, 25 bp, Mus musculus
tgggaaatgggcactgctcgccttg

SEQ ID NO: 888434 - DNA, 25 bp, Mus musculus
tgggaaatgggctctgctcgccttg

SEQ ID NO: 888435 - DNA, 25 bp, Mus musculus
tgggaaattcatcctttttgtacag

SEQ ID NO: 888436 - DNA, 25 bp, Mus musculus
tgggaaattcatgctttttgtacag

SEQ ID NO: 888437 - DNA, 25 bp, Mus musculus
tgggaaattgccaggaacctcacct

SEQ ID NO: 888438 - DNA, 25 bp, Mus musculus
tgggaaattgcctggaacctcacct

SEQ ID NO: 888439 - DNA, 25 bp, Mus musculus
tgggaaatttctacgtggctcactt

SEQ ID NO: 888440 - DNA, 25 bp, Mus musculus
tgggaaatttcttcgtggctcactt

SEQ ID NO: 888441 - DNA, 25 bp, Mus musculus
tgggaacaaccactctacacacagc

SEQ ID NO: 888442 - DNA, 25 bp, Mus musculus
tgggaacaaccagtctacacacagc

SEQ ID NO: 888443 - DNA, 25 bp, Mus musculus
tgggaacaatacatgggtcacctgc

SEQ ID NO: 888444 - DNA, 25 bp, Mus musculus
tgggaacaatacttgggtcacctgc

SEQ ID NO: 888445 - DNA, 25 bp, Mus musculus
tgggaacaccatctcctacaaggat

SEQ ID NO: 888446 - DNA, 25 bp, Mus musculus
tgggaacaccatgtcctacaaggat

SEQ ID NO: 888447 - DNA, 25 bp, Mus musculus
tgggaacacccaaggttgctcatgt

SEQ ID NO: 888448 - DNA, 25 bp, Mus musculus
tgggaacacccaccattcctatctg

SEQ ID NO: 888449 - DNA, 25 bp, Mus musculus
tgggaacacccagcattcctatctg

SEQ ID NO: 888450 - DNA, 25 bp, Mus musculus
tgggaacacccatggttgctcatgt

SEQ ID NO: 888451 - DNA, 25 bp, Mus musculus
tgggaacagcagaccgggttgctca

SEQ ID NO: 888452 - DNA, 25 bp, Mus musculus
tgggaacagcagtccgggttgctca

SEQ ID NO: 888453 - DNA, 25 bp, Mus musculus
tgggaacagccacaagacaccgaaa

SEQ ID NO: 888454 - DNA, 25 bp, Mus musculus
tgggaacagccagaagacaccgaaa

SEQ ID NO: 888455 - DNA, 25 bp, Mus musculus
tgggaacaggacatctaacagcaag

SEQ ID NO: 888456 - DNA, 25 bp, Mus musculus
tgggaacaggaccacaggcagccct

SEQ ID NO: 888457 - DNA, 25 bp, Mus musculus
tgggaacaggacgacaggcagccct

SEQ ID NO: 888458 - DNA, 25 bp, Mus musculus
tgggaacaggacttctaacagcaag

SEQ ID NO: 888459 - DNA, 25 bp, Mus musculus
tgggaacaggtgcacactggtctct

SEQ ID NO: 888460 - DNA, 25 bp, Mus musculus
tgggaacaggtggacactggtctct

SEQ ID NO: 888461 - DNA, 25 bp, Mus musculus
tgggaacagttcaagaagatcgtca

SEQ ID NO: 888462 - DNA, 25 bp, Mus musculus
tgggaacagttctagaagatcgtca

SEQ ID NO: 888463 - DNA, 25 bp, Mus musculus
tgggaacataatatccagacttttt

SEQ ID NO: 888464 - DNA, 25 bp, Mus musculus
tgggaacataatttccagacttttt

SEQ ID NO: 888465 - DNA, 25 bp, Mus musculus
tgggaacatccacctcaaaacctaa

SEQ ID NO: 888466 - DNA, 25 bp, Mus musculus
tgggaacatccagctcaaaacctaa

SEQ ID NO: 888467 - DNA, 25 bp, Mus musculus
tgggaacatgacaacacacctctgt

SEQ ID NO: 888468 - DNA, 25 bp, Mus musculus
tgggaacatgactacacacctctgt

SEQ ID NO: 888469 - DNA, 25 bp, Mus musculus
tgggaacatgtaagcccgcataccc

SEQ ID NO: 888470 - DNA, 25 bp, Mus musculus
tgggaacatgtatgcccgcataccc

SEQ ID NO: 888471 - DNA, 25 bp, Mus musculus
tgggaaccaaagaatctggcccctc

SEQ ID NO: 888472 - DNA, 25 bp, Mus musculus
tgggaaccaaagtatctggcccctc

SEQ ID NO: 888473 - DNA, 25 bp, Mus musculus
tgggaaccaccactggcattaccca

SEQ ID NO: 888474 - DNA, 25 bp, Mus musculus
tgggaaccaccagtggcattaccca

SEQ ID NO: 888475 - DNA, 25 bp, Mus musculus
tgggaaccaggcactgtaggcacag

SEQ ID NO: 888476 - DNA, 25 bp, Mus musculus
tgggaaccaggccaatcgacattct

SEQ ID NO: 888477 - DNA, 25 bp, Mus musculus
tgggaaccaggcgaatcgacattct

SEQ ID NO: 888478 - DNA, 25 bp, Mus musculus
tgggaaccaggctctgtaggcacag

SEQ ID NO: 888479 - DNA, 25 bp, Mus musculus
tgggaacccaacacaagtgcttttg

SEQ ID NO: 888480 - DNA, 25 bp, Mus musculus
tgggaacccaactcaagtgcttttg

SEQ ID NO: 888481 - DNA, 25 bp, Mus musculus
tgggaacccaccactgagacaaggg

SEQ ID NO: 888482 - DNA, 25 bp, Mus musculus
tgggaacccaccatttaaacatctg

SEQ ID NO: 888483 - DNA, 25 bp, Mus musculus
tgggaacccacctctgagacaaggg

SEQ ID NO: 888484 - DNA, 25 bp, Mus musculus
tgggaacccaccttttaaacatctg

SEQ ID NO: 888485 - DNA, 25 bp, Mus musculus
tgggaacccatcactttaagtcgta

SEQ ID NO: 888486 - DNA, 25 bp, Mus musculus
tgggaacccatctctttaagtcgta

SEQ ID NO: 888487 - DNA, 25 bp, Mus musculus
tgggaaccccagcatagccacactg

SEQ ID NO: 888488 - DNA, 25 bp, Mus musculus
tgggaaccccaggatagccacactg

SEQ ID NO: 888489 - DNA, 25 bp, Mus musculus
tgggaaccccccagataactaatgg

SEQ ID NO: 888490 - DNA, 25 bp, Mus musculus
tgggaacccccctgataactaatgg

SEQ ID NO: 888491 - DNA, 25 bp, Mus musculus
tgggaaccccttctgagcatgctca

SEQ ID NO: 888492 - DNA, 25 bp, Mus musculus
tgggaaccccttgtgagcatgctca

SEQ ID NO: 888493 - DNA, 25 bp, Mus musculus
tgggaacccgagcactgcgcagaac

SEQ ID NO: 888494 - DNA, 25 bp, Mus musculus
tgggaacccgaggactgcgcagaac

SEQ ID NO: 888495 - DNA, 25 bp, Mus musculus
tgggaaccctacagcctagtgattc

SEQ ID NO: 888496 - DNA, 25 bp, Mus musculus
tgggaaccctactgcctagtgattc

SEQ ID NO: 888497 - DNA, 25 bp, Mus musculus
tgggaaccctcaacccaagggtact

SEQ ID NO: 888498 - DNA, 25 bp, Mus musculus
tgggaaccctcaccttcaagagcaa

SEQ ID NO: 888499 - DNA, 25 bp, Mus musculus
tgggaaccctcagcttcaagagcaa

SEQ ID NO: 888500 - DNA, 25 bp, Mus musculus
tgggaaccctcatcccaagggtact

SEQ ID NO: 888501 - DNA, 25 bp, Mus musculus
tgggaaccctgcagcttttagagac

SEQ ID NO: 888502 - DNA, 25 bp, Mus musculus
tgggaaccctgctgcttttagagac

SEQ ID NO: 888503 - DNA, 25 bp, Mus musculus
tgggaaccgagcagtaagatagcag

SEQ ID NO: 888504 - DNA, 25 bp, Mus musculus
tgggaaccgagctgtaagatagcag

SEQ ID NO: 888505 - DNA, 25 bp, Mus musculus
tgggaaccgtctacgtttgcccttg

SEQ ID NO: 888506 - DNA, 25 bp, Mus musculus
tgggaaccgtcttcgtttgcccttg

SEQ ID NO: 888507 - DNA, 25 bp, Mus musculus
tgggaacctacaataaacttacaga

SEQ ID NO: 888508 - DNA, 25 bp, Mus musculus
tgggaacctacattaaacttacaga

SEQ ID NO: 888509 - DNA, 25 bp, Mus musculus
tgggaacctagcattctttccttca

SEQ ID NO: 888510 - DNA, 25 bp, Mus musculus
tgggaacctagctttctttccttca

SEQ ID NO: 888511 - DNA, 25 bp, Mus musculus
tgggaacctcaacctgcatctttaa

SEQ ID NO: 888512 - DNA, 25 bp, Mus musculus
tgggaacctcaagctgcatctttaa

SEQ ID NO: 888513 - DNA, 25 bp, Mus musculus
tgggaacctcccagaggtcccagga

SEQ ID NO: 888514 - DNA, 25 bp, Mus musculus
tgggaacctccctgaggtcccagga

SEQ ID NO: 888515 - DNA, 25 bp, Mus musculus
tgggaacctctaaggtctgcctcat

SEQ ID NO: 888516 - DNA, 25 bp, Mus musculus
tgggaacctctatggtctgcctcat

SEQ ID NO: 888517 - DNA, 25 bp, Mus musculus
tgggaacctgaccactgaggctctt

SEQ ID NO: 888518 - DNA, 25 bp, Mus musculus
tgggaacctgacgactgaggctctt

SEQ ID NO: 888519 - DNA, 25 bp, Mus musculus
tgggaaccttcgcaaaacctctgag

SEQ ID NO: 888520 - DNA, 25 bp, Mus musculus
tgggaaccttcggaaaacctctgag

SEQ ID NO: 888521 - DNA, 25 bp, Mus musculus
tgggaacgcagaaaccttcctcttt

SEQ ID NO: 888522 - DNA, 25 bp, Mus musculus
tgggaacgcagataccttcctcttt

SEQ ID NO: 888523 - DNA, 25 bp, Mus musculus
tgggaacgccagagccaggctactc

SEQ ID NO: 888524 - DNA, 25 bp, Mus musculus
tgggaacgccagtgccaggctactc

SEQ ID NO: 888525 - DNA, 25 bp, Mus musculus
tgggaacgcgtcaaagtggtcataa

SEQ ID NO: 888526 - DNA, 25 bp, Mus musculus
tgggaacgcgtctaagtggtcataa

SEQ ID NO: 888527 - DNA, 25 bp, Mus musculus
tgggaacgtcacattggtcagtctc

SEQ ID NO: 888528 - DNA, 25 bp, Mus musculus
tgggaacgtcactttggtcagtctc

SEQ ID NO: 888529 - DNA, 25 bp, Mus musculus
tgggaacgtctgactgtgagccctc

SEQ ID NO: 888530 - DNA, 25 bp, Mus musculus
tgggaacgtctgtctgtgagccctc

SEQ ID NO: 888531 - DNA, 25 bp, Mus musculus
tgggaacgttttatcacctgtgcag

SEQ ID NO: 888532 - DNA, 25 bp, Mus musculus
tgggaacgttttttcacctgtgcag

SEQ ID NO: 888533 - DNA, 25 bp, Mus musculus
tgggaactaatcaagcagggtatat

SEQ ID NO: 888534 - DNA, 25 bp, Mus musculus
tgggaactaatctagcagggtatat

SEQ ID NO: 888535 - DNA, 25 bp, Mus musculus
tgggaactactcatctcaactcatc

SEQ ID NO: 888536 - DNA, 25 bp, Mus musculus
tgggaactactcttctcaactcatc

SEQ ID NO: 888537 - DNA, 25 bp, Mus musculus
tgggaactatctcgctcaccagcgg

SEQ ID NO: 888538 - DNA, 25 bp, Mus musculus
tgggaactatctggctcaccagcgg

SEQ ID NO: 888539 - DNA, 25 bp, Mus musculus
tgggaactcaacctaagccttctcc

SEQ ID NO: 888540 - DNA, 25 bp, Mus musculus
tgggaactcaacgtaagccttctcc

SEQ ID NO: 888541 - DNA, 25 bp, Mus musculus
tgggaactcctgctactggctgcca

SEQ ID NO: 888542 - DNA, 25 bp, Mus musculus
tgggaactcctggtactggctgcca

SEQ ID NO: 888543 - DNA, 25 bp, Mus musculus
tgggaactgaatccatgcaagccca

SEQ ID NO: 888544 - DNA, 25 bp, Mus musculus
tgggaactgaatgcatgcaagccca

SEQ ID NO: 888545 - DNA, 25 bp, Mus musculus
tgggaactgcaaatcaaacccagta

SEQ ID NO: 888546 - DNA, 25 bp, Mus musculus
tgggaactgcaattcaaacccagta

SEQ ID NO: 888547 - DNA, 25 bp, Mus musculus
tgggaactgcagcttccttaccaca

SEQ ID NO: 888548 - DNA, 25 bp, Mus musculus
tgggaactgcaggttccttaccaca

SEQ ID NO: 888549 - DNA, 25 bp, Mus musculus
tgggaacttctaaaagccagctttt

SEQ ID NO: 888550 - DNA, 25 bp, Mus musculus
tgggaacttctataagccagctttt

SEQ ID NO: 888551 - DNA, 25 bp, Mus musculus
tgggaacttgtaaagttaatcctgt

SEQ ID NO: 888552 - DNA, 25 bp, Mus musculus
tgggaacttgtatagttaatcctgt

SEQ ID NO: 888553 - DNA, 25 bp, Mus musculus
tgggaagaataacgcattgcccctg

SEQ ID NO: 888554 - DNA, 25 bp, Mus musculus
tgggaagaataaggcattgcccctg

SEQ ID NO: 888555 - DNA, 25 bp, Mus musculus
tgggaagacaagcacatcacccacc

SEQ ID NO: 888556 - DNA, 25 bp, Mus musculus
tgggaagacaaggacatcacccacc

SEQ ID NO: 888557 - DNA, 25 bp, Mus musculus
tgggaagaccaacatgacctgcagt

SEQ ID NO: 888558 - DNA, 25 bp, Mus musculus
tgggaagaccaagatgacctgcagt

SEQ ID NO: 888559 - DNA, 25 bp, Mus musculus
tgggaagacccacccatcaggaatg

SEQ ID NO: 888560 - DNA, 25 bp, Mus musculus
tgggaagacccagccatcaggaatg

SEQ ID NO: 888561 - DNA, 25 bp, Mus musculus
tgggaagaccctcgctaggatgaat

SEQ ID NO: 888562 - DNA, 25 bp, Mus musculus
tgggaagaccctggctaggatgaat

SEQ ID NO: 888563 - DNA, 25 bp, Mus musculus
tgggaagaccgaatgtccccattca

SEQ ID NO: 888564 - DNA, 25 bp, Mus musculus
tgggaagaccgattgtccccattca

SEQ ID NO: 888565 - DNA, 25 bp, Mus musculus
tgggaagactgcctccttttttgaa

SEQ ID NO: 888566 - DNA, 25 bp, Mus musculus
tgggaagactgcgtccttttttgaa

SEQ ID NO: 888567 - DNA, 25 bp, Mus musculus
tgggaagacttaagaatgacccttt

SEQ ID NO: 888568 - DNA, 25 bp, Mus musculus
tgggaagacttatgaatgacccttt

SEQ ID NO: 888569 - DNA, 25 bp, Mus musculus
tgggaagacttccacattcgcattc

SEQ ID NO: 888570 - DNA, 25 bp, Mus musculus
tgggaagacttcgacattcgcattc

SEQ ID NO: 888571 - DNA, 25 bp, Mus musculus
tgggaagacttgacttttgtgcccc

SEQ ID NO: 888572 - DNA, 25 bp, Mus musculus
tgggaagacttgtcttttgtgcccc

SEQ ID NO: 888573 - DNA, 25 bp, Mus musculus
tgggaagaggcgcacccttacgact

SEQ ID NO: 888574 - DNA, 25 bp, Mus musculus
tgggaagaggcggacccttacgact

SEQ ID NO: 888575 - DNA, 25 bp, Mus musculus
tgggaagatccaccctggctcagga

SEQ ID NO: 888576 - DNA, 25 bp, Mus musculus
tgggaagatccagcctggctcagga

SEQ ID NO: 888577 - DNA, 25 bp, Mus musculus
tgggaagatccgaattacctattgt

SEQ ID NO: 888578 - DNA, 25 bp, Mus musculus
tgggaagatccgtattacctattgt

SEQ ID NO: 888579 - DNA, 25 bp, Mus musculus
tgggaagcacaaagccgccgcgtga

SEQ ID NO: 888580 - DNA, 25 bp, Mus musculus
tgggaagcacaatgccgccgcgtga

SEQ ID NO: 888581 - DNA, 25 bp, Mus musculus
tgggaagcatttcacctggagcctt

SEQ ID NO: 888582 - DNA, 25 bp, Mus musculus
tgggaagcatttgacctggagcctt

SEQ ID NO: 888583 - DNA, 25 bp, Mus musculus
tgggaagccacgaaggttctcagca

SEQ ID NO: 888584 - DNA, 25 bp, Mus musculus
tgggaagccacgtaggttctcagca

SEQ ID NO: 888585 - DNA, 25 bp, Mus musculus
tgggaagccagacccaccagccatg

SEQ ID NO: 888586 - DNA, 25 bp, Mus musculus
tgggaagccagagccaccagccatg

SEQ ID NO: 888587 - DNA, 25 bp, Mus musculus
tgggaagcccagagttttcgaagat

SEQ ID NO: 888588 - DNA, 25 bp, Mus musculus
tgggaagcccagtgttttcgaagat

SEQ ID NO: 888589 - DNA, 25 bp, Mus musculus
tgggaagccccgaccctgaaagaag

SEQ ID NO: 888590 - DNA, 25 bp, Mus musculus
tgggaagccccgtccctgaaagaag

SEQ ID NO: 888591 - DNA, 25 bp, Mus musculus
tgggaagccgcaagttcagtcagtg

SEQ ID NO: 888592 - DNA, 25 bp, Mus musculus
tgggaagccgcatgttcagtcagtg

SEQ ID NO: 888593 - DNA, 25 bp, Mus musculus
tgggaagccttaactagcccttcag

SEQ ID NO: 888594 - DNA, 25 bp, Mus musculus
tgggaagccttatctagcccttcag

SEQ ID NO: 888595 - DNA, 25 bp, Mus musculus
tgggaagcgttcacctatgggcaga

SEQ ID NO: 888596 - DNA, 25 bp, Mus musculus
tgggaagcgttctcctatgggcaga

SEQ ID NO: 888597 - DNA, 25 bp, Mus musculus
tgggaagctcagactgccggattta

SEQ ID NO: 888598 - DNA, 25 bp, Mus musculus
tgggaagctcagtctgccggattta

SEQ ID NO: 888599 - DNA, 25 bp, Mus musculus
tgggaagctcccaggcagctgtgta

SEQ ID NO: 888600 - DNA, 25 bp, Mus musculus
tgggaagctccctggcagctgtgta

SEQ ID NO: 888601 - DNA, 25 bp, Mus musculus
tgggaagctcctacagccacgtgat

SEQ ID NO: 888602 - DNA, 25 bp, Mus musculus
tgggaagctccttcagccacgtgat

SEQ ID NO: 888603 - DNA, 25 bp, Mus musculus
tgggaagctgacaacagccctctga

SEQ ID NO: 888604 - DNA, 25 bp, Mus musculus
tgggaagctgactacagccctctga

SEQ ID NO: 888605 - DNA, 25 bp, Mus musculus
tgggaagctggtctccgagtcttct

SEQ ID NO: 888606 - DNA, 25 bp, Mus musculus
tgggaagctggtgtccgagtcttct

SEQ ID NO: 888607 - DNA, 25 bp, Mus musculus
tgggaagctgtcaccacccacacaa

SEQ ID NO: 888608 - DNA, 25 bp, Mus musculus
tgggaagctgtccattcctgtgaat

SEQ ID NO: 888609 - DNA, 25 bp, Mus musculus
tgggaagctgtcgattcctgtgaat

SEQ ID NO: 888610 - DNA, 25 bp, Mus musculus
tgggaagctgtctccacccacacaa

SEQ ID NO: 888611 - DNA, 25 bp, Mus musculus
tgggaagcttacaccgtctgctaac

SEQ ID NO: 888612 - DNA, 25 bp, Mus musculus
tgggaagcttactccgtctgctaac

SEQ ID NO: 888613 - DNA, 25 bp, Mus musculus
tgggaagcttccacacaacattgct

SEQ ID NO: 888614 - DNA, 25 bp, Mus musculus
tgggaagcttcctcacaacattgct

SEQ ID NO: 888615 - DNA, 25 bp, Mus musculus
tgggaagcttgaaccccgctcaggg

SEQ ID NO: 888616 - DNA, 25 bp, Mus musculus
tgggaagcttgaactggtactgtga

SEQ ID NO: 888617 - DNA, 25 bp, Mus musculus
tgggaagcttgatccccgctcaggg

SEQ ID NO: 888618 - DNA, 25 bp, Mus musculus
tgggaagcttgatctggtactgtga

SEQ ID NO: 888619 - DNA, 25 bp, Mus musculus
tgggaagcttgcacgagcatctcaa

SEQ ID NO: 888620 - DNA, 25 bp, Mus musculus
tgggaagcttgctcgagcatctcaa

SEQ ID NO: 888621 - DNA, 25 bp, Mus musculus
tgggaagcttgtcatcaacgggaag

SEQ ID NO: 888622 - DNA, 25 bp, Mus musculus
tgggaagcttgtgatcaacgggaag

SEQ ID NO: 888623 - DNA, 25 bp, Mus musculus
tgggaaggacccagaaccaggactc

SEQ ID NO: 888624 - DNA, 25 bp, Mus musculus
tgggaaggaccctgaaccaggactc

SEQ ID NO: 888625 - DNA, 25 bp, Mus musculus
tgggaaggactacgctcacactaat

SEQ ID NO: 888626 - DNA, 25 bp, Mus musculus
tgggaaggactaggctcacactaat

SEQ ID NO: 888627 - DNA, 25 bp, Mus musculus
tgggaaggacttaggctccatgagc

SEQ ID NO: 888628 - DNA, 25 bp, Mus musculus
tgggaaggactttggctccatgagc

SEQ ID NO: 888629 - DNA, 25 bp, Mus musculus
tgggaaggccccaatgtggtccata

SEQ ID NO: 888630 - DNA, 25 bp, Mus musculus
tgggaaggcccctatgtggtccata

SEQ ID NO: 888631 - DNA, 25 bp, Mus musculus
tgggaagggcagcagctccattcat

SEQ ID NO: 888632 - DNA, 25 bp, Mus musculus
tgggaagggcaggagctccattcat

SEQ ID NO: 888633 - DNA, 25 bp, Mus musculus
tgggaagggcctcttcggcctcctc

SEQ ID NO: 888634 - DNA, 25 bp, Mus musculus
tgggaagggcctgttcggcctcctc

SEQ ID NO: 888635 - DNA, 25 bp, Mus musculus
tgggaagggctcattttggcgaata

SEQ ID NO: 888636 - DNA, 25 bp, Mus musculus
tgggaagggctctttttggcgaata

SEQ ID NO: 888637 - DNA, 25 bp, Mus musculus
tgggaaggtggcaatatcacatgat

SEQ ID NO: 888638 - DNA, 25 bp, Mus musculus
tgggaaggtggctatatcacatgat

SEQ ID NO: 888639 - DNA, 25 bp, Mus musculus
tgggaagtaatcagcttttgaaact

SEQ ID NO: 888640 - DNA, 25 bp, Mus musculus
tgggaagtaatctgcttttgaaact

SEQ ID NO: 888641 - DNA, 25 bp, Mus musculus
tgggaagtagccatggcccttggca

SEQ ID NO: 888642 - DNA, 25 bp, Mus musculus
tgggaagtagccttggcccttggca

SEQ ID NO: 888643 - DNA, 25 bp, Mus musculus
tgggaagtagggaagagtctccatt

SEQ ID NO: 888644 - DNA, 25 bp, Mus musculus
tgggaagtagggtagagtctccatt

SEQ ID NO: 888645 - DNA, 25 bp, Mus musculus
tgggaagtataaccctctctgtata

SEQ ID NO: 888646 - DNA, 25 bp, Mus musculus
tgggaagtataagcctctctgtata

SEQ ID NO: 888647 - DNA, 25 bp, Mus musculus
tgggaagtcaaaacttacagcaatt

SEQ ID NO: 888648 - DNA, 25 bp, Mus musculus
tgggaagtcaaatcttacagcaatt

SEQ ID NO: 888649 - DNA, 25 bp, Mus musculus
tgggaagtcctacccagtctccaga

SEQ ID NO: 888650 - DNA, 25 bp, Mus musculus
tgggaagtcctagccagtctccaga

SEQ ID NO: 888651 - DNA, 25 bp, Mus musculus
tgggaagtccttccagtattccatt

SEQ ID NO: 888652 - DNA, 25 bp, Mus musculus
tgggaagtccttctcaaccaactaa

SEQ ID NO: 888653 - DNA, 25 bp, Mus musculus
tgggaagtccttgcagtattccatt

SEQ ID NO: 888654 - DNA, 25 bp, Mus musculus
tgggaagtccttgtcaaccaactaa

SEQ ID NO: 888655 - DNA, 25 bp, Mus musculus
tgggaagtcttcctcttcttagcca

SEQ ID NO: 888656 - DNA, 25 bp, Mus musculus
tgggaagtcttcgtcttcttagcca

SEQ ID NO: 888657 - DNA, 25 bp, Mus musculus
tgggaagtgccaaccagtcaccatc

SEQ ID NO: 888658 - DNA, 25 bp, Mus musculus
tgggaagtgccatccagtcaccatc

SEQ ID NO: 888659 - DNA, 25 bp, Mus musculus
tgggaagtgcctctttccgaggaac

SEQ ID NO: 888660 - DNA, 25 bp, Mus musculus
tgggaagtgcctgtttccgaggaac

SEQ ID NO: 888661 - DNA, 25 bp, Mus musculus
tgggaagttcctacgccaagcagct

SEQ ID NO: 888662 - DNA, 25 bp, Mus musculus
tgggaagttccttcgccaagcagct

SEQ ID NO: 888663 - DNA, 25 bp, Mus musculus
tgggaagttgctcgtttctgctgac

SEQ ID NO: 888664 - DNA, 25 bp, Mus musculus
tgggaagttgctggtttctgctgac

SEQ ID NO: 888665 - DNA, 25 bp, Mus musculus
tgggaataacgtagccagggcacca

SEQ ID NO: 888666 - DNA, 25 bp, Mus musculus
tgggaataacgttgccagggcacca

SEQ ID NO: 888667 - DNA, 25 bp, Mus musculus
tgggaatacagcaatgcgccactat

SEQ ID NO: 888668 - DNA, 25 bp, Mus musculus
tgggaatacagctatgcgccactat

SEQ ID NO: 888669 - DNA, 25 bp, Mus musculus
tgggaatactgtaccatgggttgga

SEQ ID NO: 888670 - DNA, 25 bp, Mus musculus
tgggaatactgttccatgggttgga

SEQ ID NO: 888671 - DNA, 25 bp, Mus musculus
tgggaatacttcatactactcagag

SEQ ID NO: 888672 - DNA, 25 bp, Mus musculus
tgggaatacttcttactactcagag

SEQ ID NO: 888673 - DNA, 25 bp, Mus musculus
tgggaataggttatgccaataaacg

SEQ ID NO: 888674 - DNA, 25 bp, Mus musculus
tgggaataggttttgccaataaacg

SEQ ID NO: 888675 - DNA, 25 bp, Mus musculus
tgggaatatgctactgtcacaggac

SEQ ID NO: 888676 - DNA, 25 bp, Mus musculus
tgggaatatgcttctgtcacaggac

SEQ ID NO: 888677 - DNA, 25 bp, Mus musculus
tgggaatcacatcactcttgggttt

SEQ ID NO: 888678 - DNA, 25 bp, Mus musculus
tgggaatcacatgactcttgggttt

SEQ ID NO: 888679 - DNA, 25 bp, Mus musculus
tgggaatcagtcctataagccatga

SEQ ID NO: 888680 - DNA, 25 bp, Mus musculus
tgggaatcagtcgtataagccatga

SEQ ID NO: 888681 - DNA, 25 bp, Mus musculus
tgggaatcagttatatccctcacag

SEQ ID NO: 888682 - DNA, 25 bp, Mus musculus
tgggaatcagttctgtcatgactct

SEQ ID NO: 888683 - DNA, 25 bp, Mus musculus
tgggaatcagttgtgtcatgactct

SEQ ID NO: 888684 - DNA, 25 bp, Mus musculus
tgggaatcagttttatccctcacag

SEQ ID NO: 888685 - DNA, 25 bp, Mus musculus
tgggaatcatctccaaggctacttc

SEQ ID NO: 888686 - DNA, 25 bp, Mus musculus
tgggaatcatctgcaaggctacttc

SEQ ID NO: 888687 - DNA, 25 bp, Mus musculus
tgggaatcattcctcacatcacaga

SEQ ID NO: 888688 - DNA, 25 bp, Mus musculus
tgggaatcattcgtcacatcacaga

SEQ ID NO: 888689 - DNA, 25 bp, Mus musculus
tgggaatccccaaacagccacgatc

SEQ ID NO: 888690 - DNA, 25 bp, Mus musculus
tgggaatccccacctaaaatagtct

SEQ ID NO: 888691 - DNA, 25 bp, Mus musculus
tgggaatccccagctaaaatagtct

SEQ ID NO: 888692 - DNA, 25 bp, Mus musculus
tgggaatccccatacagccacgatc

SEQ ID NO: 888693 - DNA, 25 bp, Mus musculus
tgggaatcccttacaaatctgcagc

SEQ ID NO: 888694 - DNA, 25 bp, Mus musculus
tgggaatccctttcaaatctgcagc

SEQ ID NO: 888695 - DNA, 25 bp, Mus musculus
tgggaatcctgcatggacgctgagc

SEQ ID NO: 888696 - DNA, 25 bp, Mus musculus
tgggaatcctgcttggacgctgagc

SEQ ID NO: 888697 - DNA, 25 bp, Mus musculus
tgggaatctactctcgtccactgct

SEQ ID NO: 888698 - DNA, 25 bp, Mus musculus
tgggaatctactgtcgtccactgct

SEQ ID NO: 888699 - DNA, 25 bp, Mus musculus
tgggaatctggccagtgttcatcaa

SEQ ID NO: 888700 - DNA, 25 bp, Mus musculus
tgggaatctggcgagtgttcatcaa

SEQ ID NO: 888701 - DNA, 25 bp, Mus musculus
tgggaatctgggagaatccctccct

SEQ ID NO: 888702 - DNA, 25 bp, Mus musculus
tgggaatctgggtgaatccctccct

SEQ ID NO: 888703 - DNA, 25 bp, Mus musculus
tgggaatgaagcatacctctgattt

SEQ ID NO: 888704 - DNA, 25 bp, Mus musculus
tgggaatgaagcttacctctgattt

SEQ ID NO: 888705 - DNA, 25 bp, Mus musculus
tgggaatgccatctgctcttagatt

SEQ ID NO: 888706 - DNA, 25 bp, Mus musculus
tgggaatgccatgtgctcttagatt

SEQ ID NO: 888707 - DNA, 25 bp, Mus musculus
tgggaatgccctacaaaatgtgcag

SEQ ID NO: 888708 - DNA, 25 bp, Mus musculus
tgggaatgcccttcaaaatgtgcag

SEQ ID NO: 888709 - DNA, 25 bp, Mus musculus
tgggaatggaacatggctcctctac

SEQ ID NO: 888710 - DNA, 25 bp, Mus musculus
tgggaatggaacttggctcctctac

SEQ ID NO: 888711 - DNA, 25 bp, Mus musculus
tgggaatggctgatcctgcgctgcc

SEQ ID NO: 888712 - DNA, 25 bp, Mus musculus
tgggaatggctgttcctgcgctgcc

SEQ ID NO: 888713 - DNA, 25 bp, Mus musculus
tgggaatgggttcattcttatctcc

SEQ ID NO: 888714 - DNA, 25 bp, Mus musculus
tgggaatgggttgattcttatctcc

SEQ ID NO: 888715 - DNA, 25 bp, Mus musculus
tgggaatgtaggcttctcgcttcag

SEQ ID NO: 888716 - DNA, 25 bp, Mus musculus
tgggaatgtagggttctcgcttcag

SEQ ID NO: 888717 - DNA, 25 bp, Mus musculus
tgggaatgtattatccgaagcatca

SEQ ID NO: 888718 - DNA, 25 bp, Mus musculus
tgggaatgtattttccgaagcatca

SEQ ID NO: 888719 - DNA, 25 bp, Mus musculus
tgggaatgtgtgccggaatatcagc

SEQ ID NO: 888720 - DNA, 25 bp, Mus musculus
tgggaatgtgtggcggaatatcagc

SEQ ID NO: 888721 - DNA, 25 bp, Mus musculus
tgggaatgttctccattgctgtcat

SEQ ID NO: 888722 - DNA, 25 bp, Mus musculus
tgggaatgttctgcattgctgtcat

SEQ ID NO: 888723 - DNA, 25 bp, Mus musculus
tgggaatgtttgactcctcccacat

SEQ ID NO: 888724 - DNA, 25 bp, Mus musculus
tgggaatgtttgtctcctcccacat

SEQ ID NO: 888725 - DNA, 25 bp, Mus musculus
tgggaattattcctctgctccccac

SEQ ID NO: 888726 - DNA, 25 bp, Mus musculus
tgggaattattcgtctgctccccac

SEQ ID NO: 888727 - DNA, 25 bp, Mus musculus
tgggaattctcgctgctatagcctt

SEQ ID NO: 888728 - DNA, 25 bp, Mus musculus
tgggaattctcggtgctatagcctt

SEQ ID NO: 888729 - DNA, 25 bp, Mus musculus
tgggaattctgtaggacccgaaaca

SEQ ID NO: 888730 - DNA, 25 bp, Mus musculus
tgggaattctgttggacccgaaaca

SEQ ID NO: 888731 - DNA, 25 bp, Mus musculus
tgggaattgactaaattttcacaaa

SEQ ID NO: 888732 - DNA, 25 bp, Mus musculus
tgggaattgacttaattttcacaaa

SEQ ID NO: 888733 - DNA, 25 bp, Mus musculus
tgggaattgcccagatcatgttaat

SEQ ID NO: 888734 - DNA, 25 bp, Mus musculus
tgggaattgccctgatcatgttaat

SEQ ID NO: 888735 - DNA, 25 bp, Mus musculus
tgggaattgggaagcctctgacccg

SEQ ID NO: 888736 - DNA, 25 bp, Mus musculus
tgggaattgggatgcctctgacccg

SEQ ID NO: 888737 - DNA, 25 bp, Mus musculus
tgggaattgtgacctgagtgactct

SEQ ID NO: 888738 - DNA, 25 bp, Mus musculus
tgggaattgtgagctgagtgactct

SEQ ID NO: 888739 - DNA, 25 bp, Mus musculus
tgggaatttcccactcaaccccgtg

SEQ ID NO: 888740 - DNA, 25 bp, Mus musculus
tgggaatttccctctcaaccccgtg

SEQ ID NO: 888741 - DNA, 25 bp, Mus musculus
tgggaatttttcagcggactctgag

SEQ ID NO: 888742 - DNA, 25 bp, Mus musculus
tgggaatttttctgcggactctgag

SEQ ID NO: 888743 - DNA, 25 bp, Mus musculus
tgggacaaaccaccgagtaacctta

SEQ ID NO: 888744 - DNA, 25 bp, Mus musculus
tgggacaaaccagcgagtaacctta

SEQ ID NO: 888745 - DNA, 25 bp, Mus musculus
tgggacaaagcgatccttaattgtg

SEQ ID NO: 888746 - DNA, 25 bp, Mus musculus
tgggacaaagcgttccttaattgtg

SEQ ID NO: 888747 - DNA, 25 bp, Mus musculus
tgggacaaatgtaggccaccagttt

SEQ ID NO: 888748 - DNA, 25 bp, Mus musculus
tgggacaaatgttggccaccagttt

SEQ ID NO: 888749 - DNA, 25 bp, Mus musculus
tgggacaaattgatactgccactgt

SEQ ID NO: 888750 - DNA, 25 bp, Mus musculus
tgggacaaattgttactgccactgt

SEQ ID NO: 888751 - DNA, 25 bp, Mus musculus
tgggacaacatcctagctcctggtc

SEQ ID NO: 888752 - DNA, 25 bp, Mus musculus
tgggacaacatcgtagctcctggtc

SEQ ID NO: 888753 - DNA, 25 bp, Mus musculus
tgggacaacctccttgctgtgattc

SEQ ID NO: 888754 - DNA, 25 bp, Mus musculus
tgggacaacctcgttgctgtgattc

SEQ ID NO: 888755 - DNA, 25 bp, Mus musculus
tgggacaacgtcagggtcagccttc

SEQ ID NO: 888756 - DNA, 25 bp, Mus musculus
tgggacaacgtctgggtcagccttc

SEQ ID NO: 888757 - DNA, 25 bp, Mus musculus
tgggacaaggccacacttggcatgg

SEQ ID NO: 888758 - DNA, 25 bp, Mus musculus
tgggacaaggcctcacttggcatgg

SEQ ID NO: 888759 - DNA, 25 bp, Mus musculus
tgggacaagggcaagcataaaacag

SEQ ID NO: 888760 - DNA, 25 bp, Mus musculus
tgggacaagggctagcataaaacag

SEQ ID NO: 888761 - DNA, 25 bp, Mus musculus
tgggacaatcagaagtatccctgtc

SEQ ID NO: 888762 - DNA, 25 bp, Mus musculus
tgggacaatcagtagtatccctgtc

SEQ ID NO: 888763 - DNA, 25 bp, Mus musculus
tgggacaatccacttcaatctgttt

SEQ ID NO: 888764 - DNA, 25 bp, Mus musculus
tgggacaatccagttcaatctgttt

SEQ ID NO: 888765 - DNA, 25 bp, Mus musculus
tgggacaatctcatccgactagtag

SEQ ID NO: 888766 - DNA, 25 bp, Mus musculus
tgggacaatctcttccgactagtag

SEQ ID NO: 888767 - DNA, 25 bp, Mus musculus
tgggacacacccagggtcacgccat

SEQ ID NO: 888768 - DNA, 25 bp, Mus musculus
tgggacacaccctgggtcacgccat

SEQ ID NO: 888769 - DNA, 25 bp, Mus musculus
tgggacacacggacaggagcttcag

SEQ ID NO: 888770 - DNA, 25 bp, Mus musculus
tgggacacacggtcaggagcttcag

SEQ ID NO: 888771 - DNA, 25 bp, Mus musculus
tgggacacagctacccctataaagt

SEQ ID NO: 888772 - DNA, 25 bp, Mus musculus
tgggacacagcttcccctataaagt

SEQ ID NO: 888773 - DNA, 25 bp, Mus musculus
tgggacacatgtcacagaccacctt

SEQ ID NO: 888774 - DNA, 25 bp, Mus musculus
tgggacacatgtgacagaccacctt

SEQ ID NO: 888775 - DNA, 25 bp, Mus musculus
tgggacaccacacttctactttcac

SEQ ID NO: 888776 - DNA, 25 bp, Mus musculus
tgggacaccacagttctactttcac

SEQ ID NO: 888777 - DNA, 25 bp, Mus musculus
tgggacacccaaatgttcagacatt

SEQ ID NO: 888778 - DNA, 25 bp, Mus musculus
tgggacacccaattgttcagacatt

SEQ ID NO: 888779 - DNA, 25 bp, Mus musculus
tgggacaccccacttctgcagaagt

SEQ ID NO: 888780 - DNA, 25 bp, Mus musculus
tgggacaccccagttctgcagaagt

SEQ ID NO: 888781 - DNA, 25 bp, Mus musculus
tgggacacctatattgttcccttct

SEQ ID NO: 888782 - DNA, 25 bp, Mus musculus
tgggacacctattttgttcccttct

SEQ ID NO: 888783 - DNA, 25 bp, Mus musculus
tgggacacctggctctgtcttccta

SEQ ID NO: 888784 - DNA, 25 bp, Mus musculus
tgggacacctgggtctgtcttccta

SEQ ID NO: 888785 - DNA, 25 bp, Mus musculus
tgggacacgacacccgtctttgtgg

SEQ ID NO: 888786 - DNA, 25 bp, Mus musculus
tgggacacgacagccgtctttgtgg

SEQ ID NO: 888787 - DNA, 25 bp, Mus musculus
tgggacacgatgatcttcagttctc

SEQ ID NO: 888788 - DNA, 25 bp, Mus musculus
tgggacacgatgttcttcagttctc

SEQ ID NO: 888789 - DNA, 25 bp, Mus musculus
tgggacacgggtacttgccaccagt

SEQ ID NO: 888790 - DNA, 25 bp, Mus musculus
tgggacacgggttcttgccaccagt

SEQ ID NO: 888791 - DNA, 25 bp, Mus musculus
tgggacactattaatcatcagaacc

SEQ ID NO: 888792 - DNA, 25 bp, Mus musculus
tgggacactatttatcatcagaacc

SEQ ID NO: 888793 - DNA, 25 bp, Mus musculus
tgggacactgttatcgttaaacttg

SEQ ID NO: 888794 - DNA, 25 bp, Mus musculus
tgggacactgttttcgttaaacttg

SEQ ID NO: 888795 - DNA, 25 bp, Mus musculus
tgggacagaaggataattttctcgg

SEQ ID NO: 888796 - DNA, 25 bp, Mus musculus
tgggacagaaggttaattttctcgg

SEQ ID NO: 888797 - DNA, 25 bp, Mus musculus
tgggacagacccacaattttgcgga

SEQ ID NO: 888798 - DNA, 25 bp, Mus musculus
tgggacagaccctcaattttgcgga

SEQ ID NO: 888799 - DNA, 25 bp, Mus musculus
tgggacagatctacctgccaaaatg

SEQ ID NO: 888800 - DNA, 25 bp, Mus musculus
tgggacagatcttcctgccaaaatg

SEQ ID NO: 888801 - DNA, 25 bp, Mus musculus
tgggacagatgtatcctctaggaag

SEQ ID NO: 888802 - DNA, 25 bp, Mus musculus
tgggacagatgtttcctctaggaag

SEQ ID NO: 888803 - DNA, 25 bp, Mus musculus
tgggacagatttcactctcaccatc

SEQ ID NO: 888804 - DNA, 25 bp, Mus musculus
tgggacagatttgactctcaccatc

SEQ ID NO: 888805 - DNA, 25 bp, Mus musculus
tgggacagcctaactcatttctaaa

SEQ ID NO: 888806 - DNA, 25 bp, Mus musculus
tgggacagcctatctcatttctaaa

SEQ ID NO: 888807 - DNA, 25 bp, Mus musculus
tgggacagccttatactacttgtgc

SEQ ID NO: 888808 - DNA, 25 bp, Mus musculus
tgggacagccttttactacttgtgc

SEQ ID NO: 888809 - DNA, 25 bp, Mus musculus
tgggacagcgagacggttatttttt

SEQ ID NO: 888810 - DNA, 25 bp, Mus musculus
tgggacagcgagtcggttatttttt

SEQ ID NO: 888811 - DNA, 25 bp, Mus musculus
tgggacagcgcaccctaagctgatt

SEQ ID NO: 888812 - DNA, 25 bp, Mus musculus
tgggacagcgcagcctaagctgatt

SEQ ID NO: 888813 - DNA, 25 bp, Mus musculus
tgggacagctgccaggtcttataac

SEQ ID NO: 888814 - DNA, 25 bp, Mus musculus
tgggacagctgcgaggtcttataac

SEQ ID NO: 888815 - DNA, 25 bp, Mus musculus
tgggacaggacacaccagagctaag

SEQ ID NO: 888816 - DNA, 25 bp, Mus musculus
tgggacaggacagaccagagctaag

SEQ ID NO: 888817 - DNA, 25 bp, Mus musculus
tgggacaggactaccgtctgctgtg

SEQ ID NO: 888818 - DNA, 25 bp, Mus musculus
tgggacaggacttccgtctgctgtg

SEQ ID NO: 888819 - DNA, 25 bp, Mus musculus
tgggacaggctacctgaggttccaa

SEQ ID NO: 888820 - DNA, 25 bp, Mus musculus
tgggacaggctagctgaggttccaa

SEQ ID NO: 888821 - DNA, 25 bp, Mus musculus
tgggacagggacatctaaccgactg

SEQ ID NO: 888822 - DNA, 25 bp, Mus musculus
tgggacagggacttctaaccgactg

SEQ ID NO: 888823 - DNA, 25 bp, Mus musculus
tgggacagggcactacaaagcactt

SEQ ID NO: 888824 - DNA, 25 bp, Mus musculus
tgggacagggcagtacaaagcactt

SEQ ID NO: 888825 - DNA, 25 bp, Mus musculus
tgggacagggtcacccagcctccag

SEQ ID NO: 888826 - DNA, 25 bp, Mus musculus
tgggacagggtctcccagcctccag

SEQ ID NO: 888827 - DNA, 25 bp, Mus musculus
tgggacagtaatccctttagagaac

SEQ ID NO: 888828 - DNA, 25 bp, Mus musculus
tgggacagtaatgcctttagagaac

SEQ ID NO: 888829 - DNA, 25 bp, Mus musculus
tgggacagtcttactcaacttgtga

SEQ ID NO: 888830 - DNA, 25 bp, Mus musculus
tgggacagtcttccctggtgttaaa

SEQ ID NO: 888831 - DNA, 25 bp, Mus musculus
tgggacagtcttgcctggtgttaaa

SEQ ID NO: 888832 - DNA, 25 bp, Mus musculus
tgggacagtctttctcaacttgtga

SEQ ID NO: 888833 - DNA, 25 bp, Mus musculus
tgggacagtgttaccccgcgttgga

SEQ ID NO: 888834 - DNA, 25 bp, Mus musculus
tgggacagtgtttccccgcgttgga

SEQ ID NO: 888835 - DNA, 25 bp, Mus musculus
tgggacagttcgaactgtgactaaa

SEQ ID NO: 888836 - DNA, 25 bp, Mus musculus
tgggacagttcgtactgtgactaaa

SEQ ID NO: 888837 - DNA, 25 bp, Mus musculus
tgggacatacaacttctgctttagc

SEQ ID NO: 888838 - DNA, 25 bp, Mus musculus
tgggacatacaagttctgctttagc

SEQ ID NO: 888839 - DNA, 25 bp, Mus musculus
tgggacatagggacacagaacattt

SEQ ID NO: 888840 - DNA, 25 bp, Mus musculus
tgggacatagggtcacagaacattt

SEQ ID NO: 888841 - DNA, 25 bp, Mus musculus
tgggacatatccctttgtatacagt

SEQ ID NO: 888842 - DNA, 25 bp, Mus musculus
tgggacatatccgtttgtatacagt

SEQ ID NO: 888843 - DNA, 25 bp, Mus musculus
tgggacatcaaaatcctctgcctaa

SEQ ID NO: 888844 - DNA, 25 bp, Mus musculus
tgggacatcaaattcctctgcctaa

SEQ ID NO: 888845 - DNA, 25 bp, Mus musculus
tgggacatcaagatttcttccctct

SEQ ID NO: 888846 - DNA, 25 bp, Mus musculus
tgggacatcaagttttcttccctct

SEQ ID NO: 888847 - DNA, 25 bp, Mus musculus
tgggacatccctcattgactgtgtt

SEQ ID NO: 888848 - DNA, 25 bp, Mus musculus
tgggacatccctgattgactgtgtt

SEQ ID NO: 888849 - DNA, 25 bp, Mus musculus
tgggacatcctacaagctcagaact

SEQ ID NO: 888850 - DNA, 25 bp, Mus musculus
tgggacatcctagaagctcagaact

SEQ ID NO: 888851 - DNA, 25 bp, Mus musculus
tgggacatctttaaaatcctggaga

SEQ ID NO: 888852 - DNA, 25 bp, Mus musculus
tgggacatcttttaaatcctggaga

SEQ ID NO: 888853 - DNA, 25 bp, Mus musculus
tgggacattaccacagcagcataga

SEQ ID NO: 888854 - DNA, 25 bp, Mus musculus
tgggacattacctcagcagcataga

SEQ ID NO: 888855 - DNA, 25 bp, Mus musculus
tgggacatttccagggttccctctc

SEQ ID NO: 888856 - DNA, 25 bp, Mus musculus
tgggacatttcctgggttccctctc

SEQ ID NO: 888857 - DNA, 25 bp, Mus musculus
tgggaccaaagtagcctccccacag

SEQ ID NO: 888858 - DNA, 25 bp, Mus musculus
tgggaccaaagttgcctccccacag

SEQ ID NO: 888859 - DNA, 25 bp, Mus musculus
tgggaccaaccacagacatcgtaaa

SEQ ID NO: 888860 - DNA, 25 bp, Mus musculus
tgggaccaaccagagacatcgtaaa

SEQ ID NO: 888861 - DNA, 25 bp, Mus musculus
tgggaccaatacatgcacagcttat

SEQ ID NO: 888862 - DNA, 25 bp, Mus musculus
tgggaccaatacttgcacagcttat

SEQ ID NO: 888863 - DNA, 25 bp, Mus musculus
tgggaccaatggcagatcactttac

SEQ ID NO: 888864 - DNA, 25 bp, Mus musculus
tgggaccaatgggagatcactttac

SEQ ID NO: 888865 - DNA, 25 bp, Mus musculus
tgggaccaccctatggatttcggag

SEQ ID NO: 888866 - DNA, 25 bp, Mus musculus
tgggaccaccctttggatttcggag

SEQ ID NO: 888867 - DNA, 25 bp, Mus musculus
tgggaccaccgcattaatctcaaca

SEQ ID NO: 888868 - DNA, 25 bp, Mus musculus
tgggaccaccgctttaatctcaaca

SEQ ID NO: 888869 - DNA, 25 bp, Mus musculus
tgggaccactttcagcactatgctt

SEQ ID NO: 888870 - DNA, 25 bp, Mus musculus
tgggaccactttgagcactatgctt

SEQ ID NO: 888871 - DNA, 25 bp, Mus musculus
tgggaccagcctaccgtggactgaa

SEQ ID NO: 888872 - DNA, 25 bp, Mus musculus
tgggaccagccttccgtggactgaa

SEQ ID NO: 888873 - DNA, 25 bp, Mus musculus
tgggaccagcgtaaaaaccacactt

SEQ ID NO: 888874 - DNA, 25 bp, Mus musculus
tgggaccagcgttaaaaccacactt

SEQ ID NO: 888875 - DNA, 25 bp, Mus musculus
tgggaccaggcaagtggcacacaca

SEQ ID NO: 888876 - DNA, 25 bp, Mus musculus
tgggaccaggcatgtggcacacaca

SEQ ID NO: 888877 - DNA, 25 bp, Mus musculus
tgggaccatctgctccatacacctt

SEQ ID NO: 888878 - DNA, 25 bp, Mus musculus
tgggaccatctggtccatacacctt

SEQ ID NO: 888879 - DNA, 25 bp, Mus musculus
tgggaccatgtgacacacgaacgtg

SEQ ID NO: 888880 - DNA, 25 bp, Mus musculus
tgggaccatgtgtcacacgaacgtg

SEQ ID NO: 888881 - DNA, 25 bp, Mus musculus
tgggaccatgttagacttcttcacc

SEQ ID NO: 888882 - DNA, 25 bp, Mus musculus
tgggaccatgtttgacttcttcacc

SEQ ID NO: 888883 - DNA, 25 bp, Mus musculus
tgggacccacagctttgcattcaac

SEQ ID NO: 888884 - DNA, 25 bp, Mus musculus
tgggacccacaggtttgcattcaac

SEQ ID NO: 888885 - DNA, 25 bp, Mus musculus
tgggacccagagcacaatgttaaga

SEQ ID NO: 888886 - DNA, 25 bp, Mus musculus
tgggacccagaggacaatgttaaga

SEQ ID NO: 888887 - DNA, 25 bp, Mus musculus
tgggacccagatcaactgctactga

SEQ ID NO: 888888 - DNA, 25 bp, Mus musculus
tgggacccagatgaactgctactga

SEQ ID NO: 888889 - DNA, 25 bp, Mus musculus
tgggacccaggaagtgaaatagaat

SEQ ID NO: 888890 - DNA, 25 bp, Mus musculus
tgggacccaggatgtgaaatagaat

SEQ ID NO: 888891 - DNA, 25 bp, Mus musculus
tgggacccattgaagccacgacttt

SEQ ID NO: 888892 - DNA, 25 bp, Mus musculus
tgggacccattgtagccacgacttt

SEQ ID NO: 888893 - DNA, 25 bp, Mus musculus
tgggaccccagcatgtggaaggtaa

SEQ ID NO: 888894 - DNA, 25 bp, Mus musculus
tgggaccccagcctatgaaacggta

SEQ ID NO: 888895 - DNA, 25 bp, Mus musculus
tgggaccccagcgtatgaaacggta

SEQ ID NO: 888896 - DNA, 25 bp, Mus musculus
tgggaccccagcttgtggaaggtaa

SEQ ID NO: 888897 - DNA, 25 bp, Mus musculus
tgggacccctctctgtgtatctcag

SEQ ID NO: 888898 - DNA, 25 bp, Mus musculus
tgggacccctctgtgtgtatctcag

SEQ ID NO: 888899 - DNA, 25 bp, Mus musculus
tgggacccgatgaatgtgttctgtt

SEQ ID NO: 888900 - DNA, 25 bp, Mus musculus
tgggacccgatgtatgtgttctgtt

SEQ ID NO: 888901 - DNA, 25 bp, Mus musculus
tgggacccgcagaaaccttgactga

SEQ ID NO: 888902 - DNA, 25 bp, Mus musculus
tgggacccgcagtaaccttgactga

SEQ ID NO: 888903 - DNA, 25 bp, Mus musculus
tgggacccggatcaaccttcgtgac

SEQ ID NO: 888904 - DNA, 25 bp, Mus musculus
tgggacccggatccgctaagcatgt

SEQ ID NO: 888905 - DNA, 25 bp, Mus musculus
tgggacccggatgaaccttcgtgac

SEQ ID NO: 888906 - DNA, 25 bp, Mus musculus
tgggacccggatgcgctaagcatgt

SEQ ID NO: 888907 - DNA, 25 bp, Mus musculus
tgggaccctaccagaccagagtcag

SEQ ID NO: 888908 - DNA, 25 bp, Mus musculus
tgggaccctacctgaccagagtcag

SEQ ID NO: 888909 - DNA, 25 bp, Mus musculus
tgggaccctcggattgtggaaaatt

SEQ ID NO: 888910 - DNA, 25 bp, Mus musculus
tgggaccctcggtttgtggaaaatt

SEQ ID NO: 888911 - DNA, 25 bp, Mus musculus
tgggaccctgaaacatgatgcaact

SEQ ID NO: 888912 - DNA, 25 bp, Mus musculus
tgggaccctgaatcatgatgcaact

SEQ ID NO: 888913 - DNA, 25 bp, Mus musculus
tgggaccctgacatcactgggatat

SEQ ID NO: 888914 - DNA, 25 bp, Mus musculus
tgggaccctgacttcactgggatat

SEQ ID NO: 888915 - DNA, 25 bp, Mus musculus
tgggacccttacacttcaatgagtg

SEQ ID NO: 888916 - DNA, 25 bp, Mus musculus
tgggacccttactcttcaatgagtg

SEQ ID NO: 888917 - DNA, 25 bp, Mus musculus
tgggacccttatattacagaccaag

SEQ ID NO: 888918 - DNA, 25 bp, Mus musculus
tgggacccttattttacagaccaag

SEQ ID NO: 888919 - DNA, 25 bp, Mus musculus
tgggacccttcaactattttgacat

SEQ ID NO: 888920 - DNA, 25 bp, Mus musculus
tgggacccttcatctattttgacat

SEQ ID NO: 888921 - DNA, 25 bp, Mus musculus
tgggaccctttcaggatgaacagct

SEQ ID NO: 888922 - DNA, 25 bp, Mus musculus
tgggaccctttctggatgaacagct

SEQ ID NO: 888923 - DNA, 25 bp, Mus musculus
tgggaccgagtcatcctaggacacc

SEQ ID NO: 888924 - DNA, 25 bp, Mus musculus
tgggaccgagtcttcctaggacacc

SEQ ID NO: 888925 - DNA, 25 bp, Mus musculus
tgggaccgcatgatcgagctggccc

SEQ ID NO: 888926 - DNA, 25 bp, Mus musculus
tgggaccgcatgttcgagctggccc

SEQ ID NO: 888927 - DNA, 25 bp, Mus musculus
tgggaccggcctcatgatttgattg

SEQ ID NO: 888928 - DNA, 25 bp, Mus musculus
tgggaccggcctgatgatttgattg

SEQ ID NO: 888929 - DNA, 25 bp, Mus musculus
tgggaccggcttatacagagttgtt

SEQ ID NO: 888930 - DNA, 25 bp, Mus musculus
tgggaccggcttttacagagttgtt

SEQ ID NO: 888931 - DNA, 25 bp, Mus musculus
tgggaccgggaaacgaactgagttc

SEQ ID NO: 888932 - DNA, 25 bp, Mus musculus
tgggaccgggaatcgaactgagttc

SEQ ID NO: 888933 - DNA, 25 bp, Mus musculus
tgggaccgggctatctcaggtaaga

SEQ ID NO: 888934 - DNA, 25 bp, Mus musculus
tgggaccgggctttctcaggtaaga

SEQ ID NO: 888935 - DNA, 25 bp, Mus musculus
tgggaccgtctaaggcaattgccag

SEQ ID NO: 888936 - DNA, 25 bp, Mus musculus
tgggaccgtctatggcaattgccag

SEQ ID NO: 888937 - DNA, 25 bp, Mus musculus
tgggacctacgcagcatgtgtgaat

SEQ ID NO: 888938 - DNA, 25 bp, Mus musculus
tgggacctacgctgcatgtgtgaat

SEQ ID NO: 888939 - DNA, 25 bp, Mus musculus
tgggacctactcaacagcagaagca

SEQ ID NO: 888940 - DNA, 25 bp, Mus musculus
tgggacctactctacagcagaagca

SEQ ID NO: 888941 - DNA, 25 bp, Mus musculus
tgggacctcaacagtcaccgatcag

SEQ ID NO: 888942 - DNA, 25 bp, Mus musculus
tgggacctcaacataaattttatat

SEQ ID NO: 888943 - DNA, 25 bp, Mus musculus
tgggacctcaactgtcaccgatcag

SEQ ID NO: 888944 - DNA, 25 bp, Mus musculus
tgggacctcaacttaaattttatat

SEQ ID NO: 888945 - DNA, 25 bp, Mus musculus
tgggacctcatactttctttcaaac

SEQ ID NO: 888946 - DNA, 25 bp, Mus musculus
tgggacctcatagtttctttcaaac

SEQ ID NO: 888947 - DNA, 25 bp, Mus musculus
tgggacctcattccaatcggaccac

SEQ ID NO: 888948 - DNA, 25 bp, Mus musculus
tgggacctcattgcaatcggaccac

SEQ ID NO: 888949 - DNA, 25 bp, Mus musculus
tgggacctcgtcacaaaaacacaac

SEQ ID NO: 888950 - DNA, 25 bp, Mus musculus
tgggacctcgtctcaaaaacacaac

SEQ ID NO: 888951 - DNA, 25 bp, Mus musculus
tgggacctctgactctggctccatt

SEQ ID NO: 888952 - DNA, 25 bp, Mus musculus
tgggacctctgagtctggctccatt

SEQ ID NO: 888953 - DNA, 25 bp, Mus musculus
tgggacctctgtcggatttgcacaa

SEQ ID NO: 888954 - DNA, 25 bp, Mus musculus
tgggacctctgtgggatttgcacaa

SEQ ID NO: 888955 - DNA, 25 bp, Mus musculus
tgggacctgaggctttcagccgaca

SEQ ID NO: 888956 - DNA, 25 bp, Mus musculus
tgggacctgagggtttcagccgaca

SEQ ID NO: 888957 - DNA, 25 bp, Mus musculus
tgggacctgcctcgccttgtggtta

SEQ ID NO: 888958 - DNA, 25 bp, Mus musculus
tgggacctgcctggccttgtggtta

SEQ ID NO: 888959 - DNA, 25 bp, Mus musculus
tgggacctgcgcaggaccttttttg

SEQ ID NO: 888960 - DNA, 25 bp, Mus musculus
tgggacctgcgctggaccttttttg

SEQ ID NO: 888961 - DNA, 25 bp, Mus musculus
tgggacctgcttcagaactcaaggt

SEQ ID NO: 888962 - DNA, 25 bp, Mus musculus
tgggacctgcttgagaactcaaggt

SEQ ID NO: 888963 - DNA, 25 bp, Mus musculus
tgggacctggagatatcgctcagtg

SEQ ID NO: 888964 - DNA, 25 bp, Mus musculus
tgggacctggagttatcgctcagtg

SEQ ID NO: 888965 - DNA, 25 bp, Mus musculus
tgggacctggccaggcaccctgggc

SEQ ID NO: 888966 - DNA, 25 bp, Mus musculus
tgggacctggcctggcaccctgggc

SEQ ID NO: 888967 - DNA, 25 bp, Mus musculus
tgggacctgtccaggatgctccaga

SEQ ID NO: 888968 - DNA, 25 bp, Mus musculus
tgggacctgtcctggatgctccaga

SEQ ID NO: 888969 - DNA, 25 bp, Mus musculus
tgggaccttagacgtgacctttctt

SEQ ID NO: 888970 - DNA, 25 bp, Mus musculus
tgggaccttagaggtgacctttctt

SEQ ID NO: 888971 - DNA, 25 bp, Mus musculus
tgggaccttgacactacgacagggt

SEQ ID NO: 888972 - DNA, 25 bp, Mus musculus
tgggaccttgactctacgacagggt

SEQ ID NO: 888973 - DNA, 25 bp, Mus musculus
tgggaccttgcaaggaaattatgaa

SEQ ID NO: 888974 - DNA, 25 bp, Mus musculus
tgggaccttgcatggaaattatgaa

SEQ ID NO: 888975 - DNA, 25 bp, Mus musculus
tgggaccttgcgcaactcacaaaga

SEQ ID NO: 888976 - DNA, 25 bp, Mus musculus
tgggaccttgcggaactcacaaaga

SEQ ID NO: 888977 - DNA, 25 bp, Mus musculus
tgggaccttttcctgcgtgatcctg

SEQ ID NO: 888978 - DNA, 25 bp, Mus musculus
tgggaccttttcgtgcgtgatcctg

SEQ ID NO: 888979 - DNA, 25 bp, Mus musculus
tgggacgaatctagcctgggcgatc

SEQ ID NO: 888980 - DNA, 25 bp, Mus musculus
tgggacgaatcttgcctgggcgatc

SEQ ID NO: 888981 - DNA, 25 bp, Mus musculus
tgggacgataccattgactcatctt

SEQ ID NO: 888982 - DNA, 25 bp, Mus musculus
tgggacgatacctttgactcatctt

SEQ ID NO: 888983 - DNA, 25 bp, Mus musculus
tgggacgatggtctctcttctctac

SEQ ID NO: 888984 - DNA, 25 bp, Mus musculus
tgggacgatggtgtctcttctctac

SEQ ID NO: 888985 - DNA, 25 bp, Mus musculus
tgggacgatgttccaaaccccaaga

SEQ ID NO: 888986 - DNA, 25 bp, Mus musculus
tgggacgatgttgcaaaccccaaga

SEQ ID NO: 888987 - DNA, 25 bp, Mus musculus
tgggacgcaaatatcggaggacctg

SEQ ID NO: 888988 - DNA, 25 bp, Mus musculus
tgggacgcaaatttcggaggacctg

SEQ ID NO: 888989 - DNA, 25 bp, Mus musculus
tgggacgcagagcttccagttgtaa

SEQ ID NO: 888990 - DNA, 25 bp, Mus musculus
tgggacgcagaggttccagttgtaa

SEQ ID NO: 888991 - DNA, 25 bp, Mus musculus
tgggacgcatgcacattttcctgtg

SEQ ID NO: 888992 - DNA, 25 bp, Mus musculus
tgggacgcatgctcattttcctgtg

SEQ ID NO: 888993 - DNA, 25 bp, Mus musculus
tgggacgctatcattctggaatttt

SEQ ID NO: 888994 - DNA, 25 bp, Mus musculus
tgggacgctatctttctggaatttt

SEQ ID NO: 888995 - DNA, 25 bp, Mus musculus
tgggacgctatgatcaggccgccac

SEQ ID NO: 888996 - DNA, 25 bp, Mus musculus
tgggacgctatgttcaggccgccac

SEQ ID NO: 888997 - DNA, 25 bp, Mus musculus
tgggacgctccacatgatcatctct

SEQ ID NO: 888998 - DNA, 25 bp, Mus musculus
tgggacgctccagatgatcatctct

SEQ ID NO: 888999 - DNA, 25 bp, Mus musculus
tgggacgcttgtccaaacttaaaca

SEQ ID NO: 889000 - DNA, 25 bp, Mus musculus
tgggacgcttgtgcaaacttaaaca

SEQ ID NO: 889001 - DNA, 25 bp, Mus musculus
tgggacgctttaaccgggctcggaa

SEQ ID NO: 889002 - DNA, 25 bp, Mus musculus
tgggacgctttatccgggctcggaa

SEQ ID NO: 889003 - DNA, 25 bp, Mus musculus
tgggacggcaaaagtgtgcccttcc

SEQ ID NO: 889004 - DNA, 25 bp, Mus musculus
tgggacggcaaatgtgtgcccttcc

SEQ ID NO: 889005 - DNA, 25 bp, Mus musculus
tgggacggcccaagtcaggacttgc

SEQ ID NO: 889006 - DNA, 25 bp, Mus musculus
tgggacggcccatgtcaggacttgc

SEQ ID NO: 889007 - DNA, 25 bp, Mus musculus
tgggacggccgccaccttaggaaat

SEQ ID NO: 889008 - DNA, 25 bp, Mus musculus
tgggacggccgcgaccttaggaaat

SEQ ID NO: 889009 - DNA, 25 bp, Mus musculus
tgggacggtcccattatttcaaaat

SEQ ID NO: 889010 - DNA, 25 bp, Mus musculus
tgggacggtccctttatttcaaaat

SEQ ID NO: 889011 - DNA, 25 bp, Mus musculus
tgggacggttcacctatgaccagga

SEQ ID NO: 889012 - DNA, 25 bp, Mus musculus
tgggacggttcagctatgaccagga

SEQ ID NO: 889013 - DNA, 25 bp, Mus musculus
tgggacgtctctctgaagagccaat

SEQ ID NO: 889014 - DNA, 25 bp, Mus musculus
tgggacgtctctgtgaagagccaat

SEQ ID NO: 889015 - DNA, 25 bp, Mus musculus
tgggacgtctgcacagaagctagct

SEQ ID NO: 889016 - DNA, 25 bp, Mus musculus
tgggacgtctgctcagaagctagct

SEQ ID NO: 889017 - DNA, 25 bp, Mus musculus
tgggacgtggcaccctctcacgtga

SEQ ID NO: 889018 - DNA, 25 bp, Mus musculus
tgggacgtggcagcctctcacgtga

SEQ ID NO: 889019 - DNA, 25 bp, Mus musculus
tgggactaatacatggccctgttta

SEQ ID NO: 889020 - DNA, 25 bp, Mus musculus
tgggactaatacttggccctgttta

SEQ ID NO: 889021 - DNA, 25 bp, Mus musculus
tgggactaccatctggttctgcttc

SEQ ID NO: 889022 - DNA, 25 bp, Mus musculus
tgggactaccatgtggttctgcttc

SEQ ID NO: 889023 - DNA, 25 bp, Mus musculus
tgggactactacacaatcagcgggc

SEQ ID NO: 889024 - DNA, 25 bp, Mus musculus
tgggactactactcaatcagcgggc

SEQ ID NO: 889025 - DNA, 25 bp, Mus musculus
tgggactatggtctttattatgttt

SEQ ID NO: 889026 - DNA, 25 bp, Mus musculus
tgggactatggtgtttattatgttt

SEQ ID NO: 889027 - DNA, 25 bp, Mus musculus
tgggactcaaagaagcatactggct

SEQ ID NO: 889028 - DNA, 25 bp, Mus musculus
tgggactcaaagtagcatactggct

SEQ ID NO: 889029 - DNA, 25 bp, Mus musculus
tgggactcaagcagcatactaaatt

SEQ ID NO: 889030 - DNA, 25 bp, Mus musculus
tgggactcaagctgcatactaaatt

SEQ ID NO: 889031 - DNA, 25 bp, Mus musculus
tgggactcacacatctagacatagt

SEQ ID NO: 889032 - DNA, 25 bp, Mus musculus
tgggactcacacttctagacatagt

SEQ ID NO: 889033 - DNA, 25 bp, Mus musculus
tgggactcaggacataactcaggta

SEQ ID NO: 889034 - DNA, 25 bp, Mus musculus
tgggactcaggagataactcaggta

SEQ ID NO: 889035 - DNA, 25 bp, Mus musculus
tgggactccaagaactttgtgcatt

SEQ ID NO: 889036 - DNA, 25 bp, Mus musculus
tgggactccaagtactttgtgcatt

SEQ ID NO: 889037 - DNA, 25 bp, Mus musculus
tgggactccattccatgtacctgca

SEQ ID NO: 889038 - DNA, 25 bp, Mus musculus
tgggactccattgcatgtacctgca

SEQ ID NO: 889039 - DNA, 25 bp, Mus musculus
tgggactcccaaagttcatacaatc

SEQ ID NO: 889040 - DNA, 25 bp, Mus musculus
tgggactcccaatgttcatacaatc

SEQ ID NO: 889041 - DNA, 25 bp, Mus musculus
tgggactcccaccaagaaagaccaa

SEQ ID NO: 889042 - DNA, 25 bp, Mus musculus
tgggactcccacgaagaaagaccaa

SEQ ID NO: 889043 - DNA, 25 bp, Mus musculus
tgggactcccccatcaggtaccctg

SEQ ID NO: 889044 - DNA, 25 bp, Mus musculus
tgggactcccccttcaggtaccctg

SEQ ID NO: 889045 - DNA, 25 bp, Mus musculus
tgggactccgtcatccatgaaggac

SEQ ID NO: 889046 - DNA, 25 bp, Mus musculus
tgggactccgtcttccatgaaggac

SEQ ID NO: 889047 - DNA, 25 bp, Mus musculus
tgggactccttcaggccacaaggaa

SEQ ID NO: 889048 - DNA, 25 bp, Mus musculus
tgggactccttctggccacaaggaa

SEQ ID NO: 889049 - DNA, 25 bp, Mus musculus
tgggactcgcaccacgattctgaac

SEQ ID NO: 889050 - DNA, 25 bp, Mus musculus
tgggactcgcacgacgattctgaac

SEQ ID NO: 889051 - DNA, 25 bp, Mus musculus
tgggactctctgaaaaccgtgccgg

SEQ ID NO: 889052 - DNA, 25 bp, Mus musculus
tgggactctctgagagctcttcaga

SEQ ID NO: 889053 - DNA, 25 bp, Mus musculus
tgggactctctgtaaaccgtgccgg

SEQ ID NO: 889054 - DNA, 25 bp, Mus musculus
tgggactctctgtgagctcttcaga

SEQ ID NO: 889055 - DNA, 25 bp, Mus musculus
tgggactcttatatcagggcatcag

SEQ ID NO: 889056 - DNA, 25 bp, Mus musculus
tgggactcttatttcagggcatcag

SEQ ID NO: 889057 - DNA, 25 bp, Mus musculus
tgggactctttgaggcattgcctat

SEQ ID NO: 889058 - DNA, 25 bp, Mus musculus
tgggactctttgtggcattgcctat

SEQ ID NO: 889059 - DNA, 25 bp, Mus musculus
tgggactgagagaccccgccgagca

SEQ ID NO: 889060 - DNA, 25 bp, Mus musculus
tgggactgagagtccccgccgagca

SEQ ID NO: 889061 - DNA, 25 bp, Mus musculus
tgggactgagcaactgacagaatct

SEQ ID NO: 889062 - DNA, 25 bp, Mus musculus
tgggactgagcatctgacagaatct

SEQ ID NO: 889063 - DNA, 25 bp, Mus musculus
tgggactgagttctgtacacacttg

SEQ ID NO: 889064 - DNA, 25 bp, Mus musculus
tgggactgagttgtgtacacacttg

SEQ ID NO: 889065 - DNA, 25 bp, Mus musculus
tgggactgcaggcatatctcacacc

SEQ ID NO: 889066 - DNA, 25 bp, Mus musculus
tgggactgcagggatatctcacacc

SEQ ID NO: 889067 - DNA, 25 bp, Mus musculus
tgggactggacgcacttccaaggaa

SEQ ID NO: 889068 - DNA, 25 bp, Mus musculus
tgggactggacggacttccaaggaa

SEQ ID NO: 889069 - DNA, 25 bp, Mus musculus
tgggactggatgaaaaccctccctt

SEQ ID NO: 889070 - DNA, 25 bp, Mus musculus
tgggactggatgctacaaactgttt

SEQ ID NO: 889071 - DNA, 25 bp, Mus musculus
tgggactggatggtacaaactgttt

SEQ ID NO: 889072 - DNA, 25 bp, Mus musculus
tgggactggatgtaaaccctccctt

SEQ ID NO: 889073 - DNA, 25 bp, Mus musculus
tgggactggcacctgaattgttcct

SEQ ID NO: 889074 - DNA, 25 bp, Mus musculus
tgggactggcacgtgaattgttcct

SEQ ID NO: 889075 - DNA, 25 bp, Mus musculus
tgggactggcagagagcaagctcac

SEQ ID NO: 889076 - DNA, 25 bp, Mus musculus
tgggactggcagattgttcaagaag

SEQ ID NO: 889077 - DNA, 25 bp, Mus musculus
tgggactggcagtgagcaagctcac

SEQ ID NO: 889078 - DNA, 25 bp, Mus musculus
tgggactggcagtttgttcaagaag

SEQ ID NO: 889079 - DNA, 25 bp, Mus musculus
tgggactggtggagtttttagtaat

SEQ ID NO: 889080 - DNA, 25 bp, Mus musculus
tgggactggtggtgtttttagtaat

SEQ ID NO: 889081 - DNA, 25 bp, Mus musculus
tgggactggtgtcatcaaagctagt

SEQ ID NO: 889082 - DNA, 25 bp, Mus musculus
tgggactggtgtgatcaaagctagt

SEQ ID NO: 889083 - DNA, 25 bp, Mus musculus
tgggactgtcctctcgacctatctt

SEQ ID NO: 889084 - DNA, 25 bp, Mus musculus
tgggactgtcctgtcgacctatctt

SEQ ID NO: 889085 - DNA, 25 bp, Mus musculus
tgggactgtctgaactgtcgctatt

SEQ ID NO: 889086 - DNA, 25 bp, Mus musculus
tgggactgtctgtactgtcgctatt

SEQ ID NO: 889087 - DNA, 25 bp, Mus musculus
tgggactgtttacatcgttaactta

SEQ ID NO: 889088 - DNA, 25 bp, Mus musculus
tgggactgtttagatcgttaactta

SEQ ID NO: 889089 - DNA, 25 bp, Mus musculus
tgggactgtttgagaaacgccgttt

SEQ ID NO: 889090 - DNA, 25 bp, Mus musculus
tgggactgtttgtgaaacgccgttt

SEQ ID NO: 889091 - DNA, 25 bp, Mus musculus
tgggacttaactctacccagttact

SEQ ID NO: 889092 - DNA, 25 bp, Mus musculus
tgggacttaactgtacccagttact

SEQ ID NO: 889093 - DNA, 25 bp, Mus musculus
tgggacttactgcatagaccaggct

SEQ ID NO: 889094 - DNA, 25 bp, Mus musculus
tgggacttactggatagaccaggct

SEQ ID NO: 889095 - DNA, 25 bp, Mus musculus
tgggacttacttctaaaccttcaca

SEQ ID NO: 889096 - DNA, 25 bp, Mus musculus
tgggacttacttgtaaaccttcaca

SEQ ID NO: 889097 - DNA, 25 bp, Mus musculus
tgggacttagtacatgctcaataaa

SEQ ID NO: 889098 - DNA, 25 bp, Mus musculus
tgggacttagtagatgctcaataaa

SEQ ID NO: 889099 - DNA, 25 bp, Mus musculus
tgggacttcagaacacgctatgggc

SEQ ID NO: 889100 - DNA, 25 bp, Mus musculus
tgggacttcagatcacgctatgggc

SEQ ID NO: 889101 - DNA, 25 bp, Mus musculus
tgggacttcagtacagcatctctga

SEQ ID NO: 889102 - DNA, 25 bp, Mus musculus
tgggacttcagttcagcatctctga

SEQ ID NO: 889103 - DNA, 25 bp, Mus musculus
tgggacttcctgcataagtgcaaaa

SEQ ID NO: 889104 - DNA, 25 bp, Mus musculus
tgggacttcctggataagtgcaaaa

SEQ ID NO: 889105 - DNA, 25 bp, Mus musculus
tgggacttcgatactcaggaggaat

SEQ ID NO: 889106 - DNA, 25 bp, Mus musculus
tgggacttcgattctcaggaggaat

SEQ ID NO: 889107 - DNA, 25 bp, Mus musculus
tgggacttcggaaaactgtgtctta

SEQ ID NO: 889108 - DNA, 25 bp, Mus musculus
tgggacttcggataactgtgtctta

SEQ ID NO: 889109 - DNA, 25 bp, Mus musculus
tgggacttctacaaggccgactggt

SEQ ID NO: 889110 - DNA, 25 bp, Mus musculus
tgggacttctacagactggttgcta

SEQ ID NO: 889111 - DNA, 25 bp, Mus musculus
tgggacttctactaggccgactggt

SEQ ID NO: 889112 - DNA, 25 bp, Mus musculus
tgggacttctactgactggttgcta

SEQ ID NO: 889113 - DNA, 25 bp, Mus musculus
tgggacttggccacaggcatcagca

SEQ ID NO: 889114 - DNA, 25 bp, Mus musculus
tgggacttggcctcaggcatcagca

SEQ ID NO: 889115 - DNA, 25 bp, Mus musculus
tgggacttgtccagggctttccagc

SEQ ID NO: 889116 - DNA, 25 bp, Mus musculus
tgggacttgtcctgggctttccagc

SEQ ID NO: 889117 - DNA, 25 bp, Mus musculus
tgggagaaaaccacacccatgttct

SEQ ID NO: 889118 - DNA, 25 bp, Mus musculus
tgggagaaaacctcacccatgttct

SEQ ID NO: 889119 - DNA, 25 bp, Mus musculus
tgggagaaaccacactgggccagta

SEQ ID NO: 889120 - DNA, 25 bp, Mus musculus
tgggagaaaccagactgggccagta

SEQ ID NO: 889121 - DNA, 25 bp, Mus musculus
tgggagaaagaaagcccagcctgtt

SEQ ID NO: 889122 - DNA, 25 bp, Mus musculus
tgggagaaagaatgcccagcctgtt

SEQ ID NO: 889123 - DNA, 25 bp, Mus musculus
tgggagaaaggccatttccttggaa

SEQ ID NO: 889124 - DNA, 25 bp, Mus musculus
tgggagaaaggcgatttccttggaa

SEQ ID NO: 889125 - DNA, 25 bp, Mus musculus
tgggagaacacacgctagcatagct

SEQ ID NO: 889126 - DNA, 25 bp, Mus musculus
tgggagaacacaggctagcatagct

SEQ ID NO: 889127 - DNA, 25 bp, Mus musculus
tgggagaacattatcgaactcctct

SEQ ID NO: 889128 - DNA, 25 bp, Mus musculus
tgggagaacattttcgaactcctct

SEQ ID NO: 889129 - DNA, 25 bp, Mus musculus
tgggagaacccaattcttctgacct

SEQ ID NO: 889130 - DNA, 25 bp, Mus musculus
tgggagaacccatttcttctgacct

SEQ ID NO: 889131 - DNA, 25 bp, Mus musculus
tgggagaactaacggcatccacatt

SEQ ID NO: 889132 - DNA, 25 bp, Mus musculus
tgggagaactaagggcatccacatt

SEQ ID NO: 889133 - DNA, 25 bp, Mus musculus
tgggagaagatgctcgcttccgcat

SEQ ID NO: 889134 - DNA, 25 bp, Mus musculus
tgggagaagatggtcgcttccgcat

SEQ ID NO: 889135 - DNA, 25 bp, Mus musculus
tgggagaatatactgccctcctctc

SEQ ID NO: 889136 - DNA, 25 bp, Mus musculus
tgggagaatatagtgccctcctctc

SEQ ID NO: 889137 - DNA, 25 bp, Mus musculus
tgggagaatccacaaatggccctct

SEQ ID NO: 889138 - DNA, 25 bp, Mus musculus
tgggagaatccacatgttcctgcac

SEQ ID NO: 889139 - DNA, 25 bp, Mus musculus
tgggagaatccagaaatggccctct

SEQ ID NO: 889140 - DNA, 25 bp, Mus musculus
tgggagaatccagatgttcctgcac

SEQ ID NO: 889141 - DNA, 25 bp, Mus musculus
tgggagacaattcgccaagcctctc

SEQ ID NO: 889142 - DNA, 25 bp, Mus musculus
tgggagacaattggccaagcctctc

SEQ ID NO: 889143 - DNA, 25 bp, Mus musculus
tgggagacagtgagcgctacacacc

SEQ ID NO: 889144 - DNA, 25 bp, Mus musculus
tgggagacagtgtgcgctacacacc

SEQ ID NO: 889145 - DNA, 25 bp, Mus musculus
tgggagaccaaaaccccaagttcac

SEQ ID NO: 889146 - DNA, 25 bp, Mus musculus
tgggagaccaaatccccaagttcac

SEQ ID NO: 889147 - DNA, 25 bp, Mus musculus
tgggagaccagcatcggcgcacccg

SEQ ID NO: 889148 - DNA, 25 bp, Mus musculus
tgggagaccagcttcggcgcacccg

SEQ ID NO: 889149 - DNA, 25 bp, Mus musculus
tgggagacccaaactgcagttgcag

SEQ ID NO: 889150 - DNA, 25 bp, Mus musculus
tgggagacccaatctgcagttgcag

SEQ ID NO: 889151 - DNA, 25 bp, Mus musculus
tgggagaccccacagaagttattga

SEQ ID NO: 889152 - DNA, 25 bp, Mus musculus
tgggagaccccagagaagttattga

SEQ ID NO: 889153 - DNA, 25 bp, Mus musculus
tgggagaccgccaggacacagacat

SEQ ID NO: 889154 - DNA, 25 bp, Mus musculus
tgggagaccgcctggacacagacat

SEQ ID NO: 889155 - DNA, 25 bp, Mus musculus
tgggagaccgtgaccttaagtccta

SEQ ID NO: 889156 - DNA, 25 bp, Mus musculus
tgggagaccgtgtccttaagtccta

SEQ ID NO: 889157 - DNA, 25 bp, Mus musculus
tgggagacgcagccacaactcttta

SEQ ID NO: 889158 - DNA, 25 bp, Mus musculus
tgggagacgcaggcacaactcttta

SEQ ID NO: 889159 - DNA, 25 bp, Mus musculus
tgggagacgtgtcccctgtcccttc

SEQ ID NO: 889160 - DNA, 25 bp, Mus musculus
tgggagacgtgtgccctgtcccttc

SEQ ID NO: 889161 - DNA, 25 bp, Mus musculus
tgggagactaagcactacccctctt

SEQ ID NO: 889162 - DNA, 25 bp, Mus musculus
tgggagactaaggactacccctctt

SEQ ID NO: 889163 - DNA, 25 bp, Mus musculus
tgggagactcttagttctgagggca

SEQ ID NO: 889164 - DNA, 25 bp, Mus musculus
tgggagactctttgttctgagggca

SEQ ID NO: 889165 - DNA, 25 bp, Mus musculus
tgggagactgctatgttcttaagca

SEQ ID NO: 889166 - DNA, 25 bp, Mus musculus
tgggagactgctttgttcttaagca

SEQ ID NO: 889167 - DNA, 25 bp, Mus musculus
tgggagactgtgacaaagccggttc

SEQ ID NO: 889168 - DNA, 25 bp, Mus musculus
tgggagactgtgtcaaagccggttc

SEQ ID NO: 889169 - DNA, 25 bp, Mus musculus
tgggagagaactcccaaggttgacc

SEQ ID NO: 889170 - DNA, 25 bp, Mus musculus
tgggagagaactgccaaggttgacc

SEQ ID NO: 889171 - DNA, 25 bp, Mus musculus
tgggagagaggcaaccatccatcca

SEQ ID NO: 889172 - DNA, 25 bp, Mus musculus
tgggagagaggctaccatccatcca

SEQ ID NO: 889173 - DNA, 25 bp, Mus musculus
tgggagagcaggagtatttttgtat

SEQ ID NO: 889174 - DNA, 25 bp, Mus musculus
tgggagagcaggtgtatttttgtat

SEQ ID NO: 889175 - DNA, 25 bp, Mus musculus
tgggagagccctaccatagcccgat

SEQ ID NO: 889176 - DNA, 25 bp, Mus musculus
tgggagagcccttccatagcccgat

SEQ ID NO: 889177 - DNA, 25 bp, Mus musculus
tgggagaggatccacctagtcactc

SEQ ID NO: 889178 - DNA, 25 bp, Mus musculus
tgggagaggatcgacctagtcactc

SEQ ID NO: 889179 - DNA, 25 bp, Mus musculus
tgggagaggcagaacttcctcctcc

SEQ ID NO: 889180 - DNA, 25 bp, Mus musculus
tgggagaggcagtacttcctcctcc

SEQ ID NO: 889181 - DNA, 25 bp, Mus musculus
tgggagaggctcactgtacctcggc

SEQ ID NO: 889182 - DNA, 25 bp, Mus musculus
tgggagaggctctctgtacctcggc

SEQ ID NO: 889183 - DNA, 25 bp, Mus musculus
tgggagaggtataacataagctgcc

SEQ ID NO: 889184 - DNA, 25 bp, Mus musculus
tgggagaggtattacataagctgcc

SEQ ID NO: 889185 - DNA, 25 bp, Mus musculus
tgggagagtcccaggcccacgttcc

SEQ ID NO: 889186 - DNA, 25 bp, Mus musculus
tgggagagtccctggcccacgttcc

SEQ ID NO: 889187 - DNA, 25 bp, Mus musculus
tgggagagttggacactttccttaa

SEQ ID NO: 889188 - DNA, 25 bp, Mus musculus
tgggagagttggtcactttccttaa

SEQ ID NO: 889189 - DNA, 25 bp, Mus musculus
tgggagagtttgcaaacctggccac

SEQ ID NO: 889190 - DNA, 25 bp, Mus musculus
tgggagagtttggaaacctggccac

SEQ ID NO: 889191 - DNA, 25 bp, Mus musculus
tgggagatacggaacccacgcacca

SEQ ID NO: 889192 - DNA, 25 bp, Mus musculus
tgggagatacggtacccacgcacca

SEQ ID NO: 889193 - DNA, 25 bp, Mus musculus
tgggagatactgacagccctgggcc

SEQ ID NO: 889194 - DNA, 25 bp, Mus musculus
tgggagatactgtcagccctgggcc

SEQ ID NO: 889195 - DNA, 25 bp, Mus musculus
tgggagatcttacagtgtgagctct

SEQ ID NO: 889196 - DNA, 25 bp, Mus musculus
tgggagatcttagagtgtgagctct

SEQ ID NO: 889197 - DNA, 25 bp, Mus musculus
tgggagattcctctctctggacgac

SEQ ID NO: 889198 - DNA, 25 bp, Mus musculus
tgggagattcctgtctctggacgac

SEQ ID NO: 889199 - DNA, 25 bp, Mus musculus
tgggagattgtgcagctacttgaca

SEQ ID NO: 889200 - DNA, 25 bp, Mus musculus
tgggagattgtggagctacttgaca

SEQ ID NO: 889201 - DNA, 25 bp, Mus musculus
tgggagatttaaccaccctgactct

SEQ ID NO: 889202 - DNA, 25 bp, Mus musculus
tgggagatttaagcaccctgactct

SEQ ID NO: 889203 - DNA, 25 bp, Mus musculus
tgggagcaacccagtctggtgccgc

SEQ ID NO: 889204 - DNA, 25 bp, Mus musculus
tgggagcaaccctgtctggtgccgc

SEQ ID NO: 889205 - DNA, 25 bp, Mus musculus
tgggagcaacctcaatgtccaccta

SEQ ID NO: 889206 - DNA, 25 bp, Mus musculus
tgggagcaacctgaatgtccaccta

SEQ ID NO: 889207 - DNA, 25 bp, Mus musculus
tgggagcaagtgcatgtattattac

SEQ ID NO: 889208 - DNA, 25 bp, Mus musculus
tgggagcaagtggatgtattattac

SEQ ID NO: 889209 - DNA, 25 bp, Mus musculus
tgggagcacattcccaccttcaatg

SEQ ID NO: 889210 - DNA, 25 bp, Mus musculus
tgggagcacattgccaccttcaatg

SEQ ID NO: 889211 - DNA, 25 bp, Mus musculus
tgggagcacctcctattgtacgctg

SEQ ID NO: 889212 - DNA, 25 bp, Mus musculus
tgggagcacctcgtattgtacgctg

SEQ ID NO: 889213 - DNA, 25 bp, Mus musculus
tgggagcacgccagcaaacctgcgc

SEQ ID NO: 889214 - DNA, 25 bp, Mus musculus
tgggagcacgcctgcaaacctgcgc

SEQ ID NO: 889215 - DNA, 25 bp, Mus musculus
tgggagcagaccctgaaccttaggc

SEQ ID NO: 889216 - DNA, 25 bp, Mus musculus
tgggagcagaccgtgaaccttaggc

SEQ ID NO: 889217 - DNA, 25 bp, Mus musculus
tgggagcagcaaccttcttggtttt

SEQ ID NO: 889218 - DNA, 25 bp, Mus musculus
tgggagcagcaagcttcttggtttt

SEQ ID NO: 889219 - DNA, 25 bp, Mus musculus
tgggagcaggaacctgtactttcaa

SEQ ID NO: 889220 - DNA, 25 bp, Mus musculus
tgggagcaggaagctgtactttcaa

SEQ ID NO: 889221 - DNA, 25 bp, Mus musculus
tgggagcagtacacccgctctgacc

SEQ ID NO: 889222 - DNA, 25 bp, Mus musculus
tgggagcagtactcccgctctgacc

SEQ ID NO: 889223 - DNA, 25 bp, Mus musculus
tgggagcagtcaagggagcccctct

SEQ ID NO: 889224 - DNA, 25 bp, Mus musculus
tgggagcagtcatgggagcccctct

SEQ ID NO: 889225 - DNA, 25 bp, Mus musculus
tgggagcagtgtattttcacacaac

SEQ ID NO: 889226 - DNA, 25 bp, Mus musculus
tgggagcagtgttttttcacacaac

SEQ ID NO: 889227 - DNA, 25 bp, Mus musculus
tgggagcataggacttccttggagt

SEQ ID NO: 889228 - DNA, 25 bp, Mus musculus
tgggagcataggtcttccttggagt

SEQ ID NO: 889229 - DNA, 25 bp, Mus musculus
tgggagcattggattctctccactg

SEQ ID NO: 889230 - DNA, 25 bp, Mus musculus
tgggagcattggtttctctccactg

SEQ ID NO: 889231 - DNA, 25 bp, Mus musculus
tgggagccaaggcacagcatctttg

SEQ ID NO: 889232 - DNA, 25 bp, Mus musculus
tgggagccaagggacagcatctttg

SEQ ID NO: 889233 - DNA, 25 bp, Mus musculus
tgggagccacacatctttcaggtag

SEQ ID NO: 889234 - DNA, 25 bp, Mus musculus
tgggagccacacttctttcaggtag

SEQ ID NO: 889235 - DNA, 25 bp, Mus musculus
tgggagccacataagccctttatcg

SEQ ID NO: 889236 - DNA, 25 bp, Mus musculus
tgggagccacattagccctttatcg

SEQ ID NO: 889237 - DNA, 25 bp, Mus musculus
tgggagccaccaatgtgttgcagat

SEQ ID NO: 889238 - DNA, 25 bp, Mus musculus
tgggagccaccattgtgttgcagat

SEQ ID NO: 889239 - DNA, 25 bp, Mus musculus
tgggagccagacagtccagggaacc

SEQ ID NO: 889240 - DNA, 25 bp, Mus musculus
tgggagccagactgtccagggaacc

SEQ ID NO: 889241 - DNA, 25 bp, Mus musculus
tgggagccagtacacatgacacatg

SEQ ID NO: 889242 - DNA, 25 bp, Mus musculus
tgggagccagtagacatgacacatg

SEQ ID NO: 889243 - DNA, 25 bp, Mus musculus
tgggagccagtccaagtggtcactt

SEQ ID NO: 889244 - DNA, 25 bp, Mus musculus
tgggagccagtcgaagtggtcactt

SEQ ID NO: 889245 - DNA, 25 bp, Mus musculus
tgggagcccctcagttaattctctg

SEQ ID NO: 889246 - DNA, 25 bp, Mus musculus
tgggagcccctctgttaattctctg

SEQ ID NO: 889247 - DNA, 25 bp, Mus musculus
tgggagccctggatgtaaagtctgt

SEQ ID NO: 889248 - DNA, 25 bp, Mus musculus
tgggagccctggttgtaaagtctgt

SEQ ID NO: 889249 - DNA, 25 bp, Mus musculus
tgggagccgcatagtctggaacctg

SEQ ID NO: 889250 - DNA, 25 bp, Mus musculus
tgggagccgcattgtctggaacctg

SEQ ID NO: 889251 - DNA, 25 bp, Mus musculus
tgggagccgctccatttcaaaggaa

SEQ ID NO: 889252 - DNA, 25 bp, Mus musculus
tgggagccgctcgatttcaaaggaa

SEQ ID NO: 889253 - DNA, 25 bp, Mus musculus
tgggagcctaataccctgccgggtt

SEQ ID NO: 889254 - DNA, 25 bp, Mus musculus
tgggagcctaatagatttcattctt

SEQ ID NO: 889255 - DNA, 25 bp, Mus musculus
tgggagcctaattccctgccgggtt

SEQ ID NO: 889256 - DNA, 25 bp, Mus musculus
tgggagcctaattgatttcattctt

SEQ ID NO: 889257 - DNA, 25 bp, Mus musculus
tgggagcctacgactgacttctctc

SEQ ID NO: 889258 - DNA, 25 bp, Mus musculus
tgggagcctacgtctgacttctctc

SEQ ID NO: 889259 - DNA, 25 bp, Mus musculus
tgggagcctcagagccgtccagaag

SEQ ID NO: 889260 - DNA, 25 bp, Mus musculus
tgggagcctcagtgccgtccagaag

SEQ ID NO: 889261 - DNA, 25 bp, Mus musculus
tgggagcctgagaccttagaacata

SEQ ID NO: 889262 - DNA, 25 bp, Mus musculus
tgggagcctgagtccttagaacata

SEQ ID NO: 889263 - DNA, 25 bp, Mus musculus
tgggagcctgccatcctaacaaggt

SEQ ID NO: 889264 - DNA, 25 bp, Mus musculus
tgggagcctgccttcctaacaaggt

SEQ ID NO: 889265 - DNA, 25 bp, Mus musculus
tgggagcctgctagtatatctatgc

SEQ ID NO: 889266 - DNA, 25 bp, Mus musculus
tgggagcctgcttgtatatctatgc

SEQ ID NO: 889267 - DNA, 25 bp, Mus musculus
tgggagcctggtatatcttgttcaa

SEQ ID NO: 889268 - DNA, 25 bp, Mus musculus
tgggagcctggtttatcttgttcaa

SEQ ID NO: 889269 - DNA, 25 bp, Mus musculus
tgggagccttgaccctcaggtcctc

SEQ ID NO: 889270 - DNA, 25 bp, Mus musculus
tgggagccttgagcctcaggtcctc

SEQ ID NO: 889271 - DNA, 25 bp, Mus musculus
tgggagcctttgatatgaactgcaa

SEQ ID NO: 889272 - DNA, 25 bp, Mus musculus
tgggagcctttgttatgaactgcaa

SEQ ID NO: 889273 - DNA, 25 bp, Mus musculus
tgggagcgtctcacagtagccgatg

SEQ ID NO: 889274 - DNA, 25 bp, Mus musculus
tgggagcgtctctcagtagccgatg

SEQ ID NO: 889275 - DNA, 25 bp, Mus musculus
tgggagctaatacagcttgccagct

SEQ ID NO: 889276 - DNA, 25 bp, Mus musculus
tgggagctaatagagcttgccagct

SEQ ID NO: 889277 - DNA, 25 bp, Mus musculus
tgggagctacctatggcagcaaagc

SEQ ID NO: 889278 - DNA, 25 bp, Mus musculus
tgggagctacctttggcagcaaagc

SEQ ID NO: 889279 - DNA, 25 bp, Mus musculus
tgggagctagtgctcgttaacgcat

SEQ ID NO: 889280 - DNA, 25 bp, Mus musculus
tgggagctagtggtcgttaacgcat

SEQ ID NO: 889281 - DNA, 25 bp, Mus musculus
tgggagctataacccttctggcttc

SEQ ID NO: 889282 - DNA, 25 bp, Mus musculus
tgggagctataagccttctggcttc

SEQ ID NO: 889283 - DNA, 25 bp, Mus musculus
tgggagctcatgactctgggccaga

SEQ ID NO: 889284 - DNA, 25 bp, Mus musculus
tgggagctcatgtctctgggccaga

SEQ ID NO: 889285 - DNA, 25 bp, Mus musculus
tgggagctcccaaccccgggtaggt

SEQ ID NO: 889286 - DNA, 25 bp, Mus musculus
tgggagctcccacactatctatggg

SEQ ID NO: 889287 - DNA, 25 bp, Mus musculus
tgggagctcccactccagtgagcaa

SEQ ID NO: 889288 - DNA, 25 bp, Mus musculus
tgggagctcccagactatctatggg

SEQ ID NO: 889289 - DNA, 25 bp, Mus musculus
tgggagctcccagtccagtgagcaa

SEQ ID NO: 889290 - DNA, 25 bp, Mus musculus
tgggagctcccatccccgggtaggt

SEQ ID NO: 889291 - DNA, 25 bp, Mus musculus
tgggagctccgtacagtgcttttga

SEQ ID NO: 889292 - DNA, 25 bp, Mus musculus
tgggagctccgttcagtgcttttga

SEQ ID NO: 889293 - DNA, 25 bp, Mus musculus
tgggagctccttcttctaccctgtc

SEQ ID NO: 889294 - DNA, 25 bp, Mus musculus
tgggagctccttgttctaccctgtc

SEQ ID NO: 889295 - DNA, 25 bp, Mus musculus
tgggagctctctattgggactgact

SEQ ID NO: 889296 - DNA, 25 bp, Mus musculus
tgggagctctcttttgggactgact

SEQ ID NO: 889297 - DNA, 25 bp, Mus musculus
tgggagctctgacaatcctgaccaa

SEQ ID NO: 889298 - DNA, 25 bp, Mus musculus
tgggagctctgagaatcctgaccaa

SEQ ID NO: 889299 - DNA, 25 bp, Mus musculus
tgggagctcttcattaagtttacta

SEQ ID NO: 889300 - DNA, 25 bp, Mus musculus
tgggagctcttctttaagtttacta

SEQ ID NO: 889301 - DNA, 25 bp, Mus musculus
tgggagctgccgagtcaaagaagac

SEQ ID NO: 889302 - DNA, 25 bp, Mus musculus
tgggagctgccgtgtcaaagaagac

SEQ ID NO: 889303 - DNA, 25 bp, Mus musculus
tgggagctgctaagtcacgttggcc

SEQ ID NO: 889304 - DNA, 25 bp, Mus musculus
tgggagctgctatgtcacgttggcc

SEQ ID NO: 889305 - DNA, 25 bp, Mus musculus
tgggagctgcttcccttactgcata

SEQ ID NO: 889306 - DNA, 25 bp, Mus musculus
tgggagctgcttgccttactgcata

SEQ ID NO: 889307 - DNA, 25 bp, Mus musculus
tgggagctggctcacagtctccgca

SEQ ID NO: 889308 - DNA, 25 bp, Mus musculus
tgggagctggctcgcgcctcttcta

SEQ ID NO: 889309 - DNA, 25 bp, Mus musculus
tgggagctggctgacagtctccgca

SEQ ID NO: 889310 - DNA, 25 bp, Mus musculus
tgggagctggctggcgcctcttcta

SEQ ID NO: 889311 - DNA, 25 bp, Mus musculus
tgggagctgttgcaccttgttgcaa

SEQ ID NO: 889312 - DNA, 25 bp, Mus musculus
tgggagctgttggaccttgttgcaa

SEQ ID NO: 889313 - DNA, 25 bp, Mus musculus
tgggagctgtttcccagagaagaac

SEQ ID NO: 889314 - DNA, 25 bp, Mus musculus
tgggagctgtttgccagagaagaac

SEQ ID NO: 889315 - DNA, 25 bp, Mus musculus
tgggagcttagtccaccttggcaga

SEQ ID NO: 889316 - DNA, 25 bp, Mus musculus
tgggagcttagtgcaccttggcaga

SEQ ID NO: 889317 - DNA, 25 bp, Mus musculus
tgggaggaaaccatcactcttcact

SEQ ID NO: 889318 - DNA, 25 bp, Mus musculus
tgggaggaaaccttcactcttcact

SEQ ID NO: 889319 - DNA, 25 bp, Mus musculus
tgggaggaaagcacgctcttaccct

SEQ ID NO: 889320 - DNA, 25 bp, Mus musculus
tgggaggaaagctcgctcttaccct

SEQ ID NO: 889321 - DNA, 25 bp, Mus musculus
tgggaggacagcacgtcctgcttca

SEQ ID NO: 889322 - DNA, 25 bp, Mus musculus
tgggaggacagctcgtcctgcttca

SEQ ID NO: 889323 - DNA, 25 bp, Mus musculus
tgggaggacccaagacatctgccag

SEQ ID NO: 889324 - DNA, 25 bp, Mus musculus
tgggaggacccatgacatctgccag

SEQ ID NO: 889325 - DNA, 25 bp, Mus musculus
tgggaggaccctacatctaagataa

SEQ ID NO: 889326 - DNA, 25 bp, Mus musculus
tgggaggacccttcatctaagataa

SEQ ID NO: 889327 - DNA, 25 bp, Mus musculus
tgggaggattgtcattctttctgca

SEQ ID NO: 889328 - DNA, 25 bp, Mus musculus
tgggaggattgtgattctttctgca

SEQ ID NO: 889329 - DNA, 25 bp, Mus musculus
tgggaggcacaacagatccttttct

SEQ ID NO: 889330 - DNA, 25 bp, Mus musculus
tgggaggcacaagagatccttttct

SEQ ID NO: 889331 - DNA, 25 bp, Mus musculus
tgggaggcacagcaaacctggcatt

SEQ ID NO: 889332 - DNA, 25 bp, Mus musculus
tgggaggcacaggaaacctggcatt

SEQ ID NO: 889333 - DNA, 25 bp, Mus musculus
tgggaggcacatctgatccatacgt

SEQ ID NO: 889334 - DNA, 25 bp, Mus musculus
tgggaggcacatgtgatccatacgt

SEQ ID NO: 889335 - DNA, 25 bp, Mus musculus
tgggaggcaccaaatcaggacagca

SEQ ID NO: 889336 - DNA, 25 bp, Mus musculus
tgggaggcaccatatcaggacagca

SEQ ID NO: 889337 - DNA, 25 bp, Mus musculus
tgggaggcactaatccctgggctgt

SEQ ID NO: 889338 - DNA, 25 bp, Mus musculus
tgggaggcactattccctgggctgt

SEQ ID NO: 889339 - DNA, 25 bp, Mus musculus
tgggaggcagccagcatacctggaa

SEQ ID NO: 889340 - DNA, 25 bp, Mus musculus
tgggaggcagcctgcatacctggaa

SEQ ID NO: 889341 - DNA, 25 bp, Mus musculus
tgggaggccacaagcccatgatgcc

SEQ ID NO: 889342 - DNA, 25 bp, Mus musculus
tgggaggccacatgcccatgatgcc

SEQ ID NO: 889343 - DNA, 25 bp, Mus musculus
tgggaggcccaaacgaatcctgtca

SEQ ID NO: 889344 - DNA, 25 bp, Mus musculus
tgggaggcccaatcgaatcctgtca

SEQ ID NO: 889345 - DNA, 25 bp, Mus musculus
tgggaggcccacacatggctgtcac

SEQ ID NO: 889346 - DNA, 25 bp, Mus musculus
tgggaggcccactcatggctgtcac

SEQ ID NO: 889347 - DNA, 25 bp, Mus musculus
tgggaggctactactgcccacagtg

SEQ ID NO: 889348 - DNA, 25 bp, Mus musculus
tgggaggctacttctgcccacagtg

SEQ ID NO: 889349 - DNA, 25 bp, Mus musculus
tgggaggctctcaaaatattttttc

SEQ ID NO: 889350 - DNA, 25 bp, Mus musculus
tgggaggctctctaaatattttttc

SEQ ID NO: 889351 - DNA, 25 bp, Mus musculus
tgggaggcttttagcctttcttctt

SEQ ID NO: 889352 - DNA, 25 bp, Mus musculus
tgggaggctttttgcctttcttctt

SEQ ID NO: 889353 - DNA, 25 bp, Mus musculus
tgggagggacaacctaccccaagga

SEQ ID NO: 889354 - DNA, 25 bp, Mus musculus
tgggagggacaagctaccccaagga

SEQ ID NO: 889355 - DNA, 25 bp, Mus musculus
tgggagggaccaacaggattatttc

SEQ ID NO: 889356 - DNA, 25 bp, Mus musculus
tgggagggaccatcaggattatttc

SEQ ID NO: 889357 - DNA, 25 bp, Mus musculus
tgggagggcctcacaagtcacacca

SEQ ID NO: 889358 - DNA, 25 bp, Mus musculus
tgggagggcctctcaagtcacacca

SEQ ID NO: 889359 - DNA, 25 bp, Mus musculus
tgggagggctatacatccttccatc

SEQ ID NO: 889360 - DNA, 25 bp, Mus musculus
tgggagggctattcatccttccatc

SEQ ID NO: 889361 - DNA, 25 bp, Mus musculus
tgggagggctggctccatttcccaa

SEQ ID NO: 889362 - DNA, 25 bp, Mus musculus
tgggagggctgggtccatttcccaa

SEQ ID NO: 889363 - DNA, 25 bp, Mus musculus
tgggagggctttccacctgatgtcc

SEQ ID NO: 889364 - DNA, 25 bp, Mus musculus
tgggagggctttgcacctgatgtcc

SEQ ID NO: 889365 - DNA, 25 bp, Mus musculus
tgggaggggagaaccgactctcaaa

SEQ ID NO: 889366 - DNA, 25 bp, Mus musculus
tgggaggggagatccgactctcaaa

SEQ ID NO: 889367 - DNA, 25 bp, Mus musculus
tgggagggttaacaactcattccaa

SEQ ID NO: 889368 - DNA, 25 bp, Mus musculus
tgggagggttaagaactcattccaa

SEQ ID NO: 889369 - DNA, 25 bp, Mus musculus
tgggaggtatcacaagacacttaac

SEQ ID NO: 889370 - DNA, 25 bp, Mus musculus
tgggaggtatcagaagacacttaac

SEQ ID NO: 889371 - DNA, 25 bp, Mus musculus
tgggaggtccccaacagagggccat

SEQ ID NO: 889372 - DNA, 25 bp, Mus musculus
tgggaggtcccctacagagggccat

SEQ ID NO: 889373 - DNA, 25 bp, Mus musculus
tgggaggtcctactcagttgcttga

SEQ ID NO: 889374 - DNA, 25 bp, Mus musculus
tgggaggtcctagtcagttgcttga

SEQ ID NO: 889375 - DNA, 25 bp, Mus musculus
tgggaggtcggtattctattacagt

SEQ ID NO: 889376 - DNA, 25 bp, Mus musculus
tgggaggtcggttttctattacagt

SEQ ID NO: 889377 - DNA, 25 bp, Mus musculus
tgggaggtgacccaccatcatcctg

SEQ ID NO: 889378 - DNA, 25 bp, Mus musculus
tgggaggtgaccgaccatcatcctg

SEQ ID NO: 889379 - DNA, 25 bp, Mus musculus
tgggaggtggaaccagctttcttac

SEQ ID NO: 889380 - DNA, 25 bp, Mus musculus
tgggaggtggaagcagctttcttac

SEQ ID NO: 889381 - DNA, 25 bp, Mus musculus
tgggagtaaagccacgcccagctta

SEQ ID NO: 889382 - DNA, 25 bp, Mus musculus
tgggagtaaagcgacgcccagctta

SEQ ID NO: 889383 - DNA, 25 bp, Mus musculus
tgggagtaactgaacctacctcata

SEQ ID NO: 889384 - DNA, 25 bp, Mus musculus
tgggagtaactgtacctacctcata

SEQ ID NO: 889385 - DNA, 25 bp, Mus musculus
tgggagtatcatacaacatcggcag

SEQ ID NO: 889386 - DNA, 25 bp, Mus musculus
tgggagtatcattcaacatcggcag

SEQ ID NO: 889387 - DNA, 25 bp, Mus musculus
tgggagtcactgcagcaagaagctc

SEQ ID NO: 889388 - DNA, 25 bp, Mus musculus
tgggagtcactggagcaagaagctc

SEQ ID NO: 889389 - DNA, 25 bp, Mus musculus
tgggagtcctagatctcgcatcgac

SEQ ID NO: 889390 - DNA, 25 bp, Mus musculus
tgggagtcctagttctcgcatcgac

SEQ ID NO: 889391 - DNA, 25 bp, Mus musculus
tgggagtcctctagtgtgcttaaga

SEQ ID NO: 889392 - DNA, 25 bp, Mus musculus
tgggagtcctcttgtgtgcttaaga

SEQ ID NO: 889393 - DNA, 25 bp, Mus musculus
tgggagtcggccaggtcccctgaaa

SEQ ID NO: 889394 - DNA, 25 bp, Mus musculus
tgggagtcggcctggtcccctgaaa

SEQ ID NO: 889395 - DNA, 25 bp, Mus musculus
tgggagtctccaaaagaaacagctt

SEQ ID NO: 889396 - DNA, 25 bp, Mus musculus
tgggagtctccataagaaacagctt

SEQ ID NO: 889397 - DNA, 25 bp, Mus musculus
tgggagtctgtcctacaaactgtag

SEQ ID NO: 889398 - DNA, 25 bp, Mus musculus
tgggagtctgtcgtacaaactgtag

SEQ ID NO: 889399 - DNA, 25 bp, Mus musculus
tgggagtcttatctccaagtcccca

SEQ ID NO: 889400 - DNA, 25 bp, Mus musculus
tgggagtcttatgtccaagtcccca

SEQ ID NO: 889401 - DNA, 25 bp, Mus musculus
tgggagtgaccgatttactaacata

SEQ ID NO: 889402 - DNA, 25 bp, Mus musculus
tgggagtgaccgttttactaacata

SEQ ID NO: 889403 - DNA, 25 bp, Mus musculus
tgggagtgactaccctcctaagtga

SEQ ID NO: 889404 - DNA, 25 bp, Mus musculus
tgggagtgactagcctcctaagtga

SEQ ID NO: 889405 - DNA, 25 bp, Mus musculus
tgggagtgacttaccttgggtcaag

SEQ ID NO: 889406 - DNA, 25 bp, Mus musculus
tgggagtgactttccttgggtcaag

SEQ ID NO: 889407 - DNA, 25 bp, Mus musculus
tgggagtgcccacagtcaagatgac

SEQ ID NO: 889408 - DNA, 25 bp, Mus musculus
tgggagtgcccagagtcaagatgac

SEQ ID NO: 889409 - DNA, 25 bp, Mus musculus
tgggagtgcctacagaattcttgcc

SEQ ID NO: 889410 - DNA, 25 bp, Mus musculus
tgggagtgcctagagaattcttgcc

SEQ ID NO: 889411 - DNA, 25 bp, Mus musculus
tgggagtgctggcaaccgccataac

SEQ ID NO: 889412 - DNA, 25 bp, Mus musculus
tgggagtgctgggaaccgccataac

SEQ ID NO: 889413 - DNA, 25 bp, Mus musculus
tgggagtggcccatttgcattgcac

SEQ ID NO: 889414 - DNA, 25 bp, Mus musculus
tgggagtggcccttttgcattgcac

SEQ ID NO: 889415 - DNA, 25 bp, Mus musculus
tgggagtgtggaattttctaccctt

SEQ ID NO: 889416 - DNA, 25 bp, Mus musculus
tgggagtgtggatttttctaccctt

SEQ ID NO: 889417 - DNA, 25 bp, Mus musculus
tgggagttaaaccttggttctctgt

SEQ ID NO: 889418 - DNA, 25 bp, Mus musculus
tgggagttaaacgttggttctctgt

SEQ ID NO: 889419 - DNA, 25 bp, Mus musculus
tgggagttagcactgcggccaaact

SEQ ID NO: 889420 - DNA, 25 bp, Mus musculus
tgggagttagcagtgcggccaaact

SEQ ID NO: 889421 - DNA, 25 bp, Mus musculus
tgggagttcagtctcctgaaacctc

SEQ ID NO: 889422 - DNA, 25 bp, Mus musculus
tgggagttcagtgtcctgaaacctc

SEQ ID NO: 889423 - DNA, 25 bp, Mus musculus
tgggagttcccaccgcgaaaggtct

SEQ ID NO: 889424 - DNA, 25 bp, Mus musculus
tgggagttcccagcgcgaaaggtct

SEQ ID NO: 889425 - DNA, 25 bp, Mus musculus
tgggagttcctccatgtcacctgga

SEQ ID NO: 889426 - DNA, 25 bp, Mus musculus
tgggagttcctcgatgtcacctgga

SEQ ID NO: 889427 - DNA, 25 bp, Mus musculus
tgggagttcttgagcttcgccgaga

SEQ ID NO: 889428 - DNA, 25 bp, Mus musculus
tgggagttcttgtgcttcgccgaga

SEQ ID NO: 889429 - DNA, 25 bp, Mus musculus
tgggagttgaacaaggccctcatgt

SEQ ID NO: 889430 - DNA, 25 bp, Mus musculus
tgggagttgaactaggccctcatgt

SEQ ID NO: 889431 - DNA, 25 bp, Mus musculus
tgggagttgcctacttcatggctga

SEQ ID NO: 889432 - DNA, 25 bp, Mus musculus
tgggagttgccttcttcatggctga

SEQ ID NO: 889433 - DNA, 25 bp, Mus musculus
tgggagttggaacgcctgggcccaa

SEQ ID NO: 889434 - DNA, 25 bp, Mus musculus
tgggagttggaaggcctgggcccaa

SEQ ID NO: 889435 - DNA, 25 bp, Mus musculus
tgggagttttctaggcgcccaggca

SEQ ID NO: 889436 - DNA, 25 bp, Mus musculus
tgggagttttcttggcgcccaggca

SEQ ID NO: 889437 - DNA, 25 bp, Mus musculus
tgggataaatgccatcaataaaact

SEQ ID NO: 889438 - DNA, 25 bp, Mus musculus
tgggataaatgcgatcaataaaact

SEQ ID NO: 889439 - DNA, 25 bp, Mus musculus
tgggataaccttaggccttacggat

SEQ ID NO: 889440 - DNA, 25 bp, Mus musculus
tgggataacctttggccttacggat

SEQ ID NO: 889441 - DNA, 25 bp, Mus musculus
tgggataactccaggtggcaaagac

SEQ ID NO: 889442 - DNA, 25 bp, Mus musculus
tgggataactcctggtggcaaagac

SEQ ID NO: 889443 - DNA, 25 bp, Mus musculus
tgggataagcgcaactgcctggaca

SEQ ID NO: 889444 - DNA, 25 bp, Mus musculus
tgggataagcgctactgcctggaca

SEQ ID NO: 889445 - DNA, 25 bp, Mus musculus
tgggatacaatgctcttcctgctgc

SEQ ID NO: 889446 - DNA, 25 bp, Mus musculus
tgggatacaatggtcttcctgctgc

SEQ ID NO: 889447 - DNA, 25 bp, Mus musculus
tgggatacaccaatgacttcatttg

SEQ ID NO: 889448 - DNA, 25 bp, Mus musculus
tgggatacaccattgacttcatttg

SEQ ID NO: 889449 - DNA, 25 bp, Mus musculus
tgggatacacccctattctaggcca

SEQ ID NO: 889450 - DNA, 25 bp, Mus musculus
tgggatacacccgtattctaggcca

SEQ ID NO: 889451 - DNA, 25 bp, Mus musculus
tgggatacatgtctgcatggtcttt

SEQ ID NO: 889452 - DNA, 25 bp, Mus musculus
tgggatacatgtgtgcatggtcttt

SEQ ID NO: 889453 - DNA, 25 bp, Mus musculus
tgggatagacctcctggtccagcga

SEQ ID NO: 889454 - DNA, 25 bp, Mus musculus
tgggatagacctgctggtccagcga

SEQ ID NO: 889455 - DNA, 25 bp, Mus musculus
tgggatagatctccaggaaacactt

SEQ ID NO: 889456 - DNA, 25 bp, Mus musculus
tgggatagatctgcaggaaacactt

SEQ ID NO: 889457 - DNA, 25 bp, Mus musculus
tgggataggtggctttccctctcgt

SEQ ID NO: 889458 - DNA, 25 bp, Mus musculus
tgggataggtgggtttccctctcgt

SEQ ID NO: 889459 - DNA, 25 bp, Mus musculus
tgggatatggctccccgggattaca

SEQ ID NO: 889460 - DNA, 25 bp, Mus musculus
tgggatatggctgcccgggattaca

SEQ ID NO: 889461 - DNA, 25 bp, Mus musculus
tgggatattcctccctacgatcctc

SEQ ID NO: 889462 - DNA, 25 bp, Mus musculus
tgggatattcctgcctacgatcctc

SEQ ID NO: 889463 - DNA, 25 bp, Mus musculus
tgggatattggtccctgtctaggaa

SEQ ID NO: 889464 - DNA, 25 bp, Mus musculus
tgggatattggtgcctgtctaggaa

SEQ ID NO: 889465 - DNA, 25 bp, Mus musculus
tgggatattttccacactttagaat

SEQ ID NO: 889466 - DNA, 25 bp, Mus musculus
tgggatattttcgacactttagaat

SEQ ID NO: 889467 - DNA, 25 bp, Mus musculus
tgggatcacacacaccagcggagga

SEQ ID NO: 889468 - DNA, 25 bp, Mus musculus
tgggatcacacacacttgagccaag

SEQ ID NO: 889469 - DNA, 25 bp, Mus musculus
tgggatcacacagaccagcggagga

SEQ ID NO: 889470 - DNA, 25 bp, Mus musculus
tgggatcacacagacttgagccaag

SEQ ID NO: 889471 - DNA, 25 bp, Mus musculus
tgggatcacagcagcacaccactga

SEQ ID NO: 889472 - DNA, 25 bp, Mus musculus
tgggatcacagcagctcatccttaa

SEQ ID NO: 889473 - DNA, 25 bp, Mus musculus
tgggatcacagctgcacaccactga

SEQ ID NO: 889474 - DNA, 25 bp, Mus musculus
tgggatcacagctgctcatccttaa

SEQ ID NO: 889475 - DNA, 25 bp, Mus musculus
tgggatcactacagctcgttttcaa

SEQ ID NO: 889476 - DNA, 25 bp, Mus musculus
tgggatcactactgctcgttttcaa

SEQ ID NO: 889477 - DNA, 25 bp, Mus musculus
tgggatcactagctcattttgttct

SEQ ID NO: 889478 - DNA, 25 bp, Mus musculus
tgggatcactaggtcattttgttct

SEQ ID NO: 889479 - DNA, 25 bp, Mus musculus
tgggatcactatattctgtctgctg

SEQ ID NO: 889480 - DNA, 25 bp, Mus musculus
tgggatcactattttctgtctgctg

SEQ ID NO: 889481 - DNA, 25 bp, Mus musculus
tgggatcagatactacctcatggga

SEQ ID NO: 889482 - DNA, 25 bp, Mus musculus
tgggatcagatagtacctcatggga

SEQ ID NO: 889483 - DNA, 25 bp, Mus musculus
tgggatcaggctacttacttctgta

SEQ ID NO: 889484 - DNA, 25 bp, Mus musculus
tgggatcaggcttcttacttctgta

SEQ ID NO: 889485 - DNA, 25 bp, Mus musculus
tgggatcagtatacctaagccttga

SEQ ID NO: 889486 - DNA, 25 bp, Mus musculus
tgggatcagtattcctaagccttga

SEQ ID NO: 889487 - DNA, 25 bp, Mus musculus
tgggatcatctccatccatatctcg

SEQ ID NO: 889488 - DNA, 25 bp, Mus musculus
tgggatcatctcgatccatatctcg

SEQ ID NO: 889489 - DNA, 25 bp, Mus musculus
tgggatccacccacaggcaccaggg

SEQ ID NO: 889490 - DNA, 25 bp, Mus musculus
tgggatccaccctcaggcaccaggg

SEQ ID NO: 889491 - DNA, 25 bp, Mus musculus
tgggatccactgaccggcagaaaag

SEQ ID NO: 889492 - DNA, 25 bp, Mus musculus
tgggatccactgtccggcagaaaag

SEQ ID NO: 889493 - DNA, 25 bp, Mus musculus
tgggatccacttctatttcaggcat

SEQ ID NO: 889494 - DNA, 25 bp, Mus musculus
tgggatccacttgtatttcaggcat

SEQ ID NO: 889495 - DNA, 25 bp, Mus musculus
tgggatccaggactccatccccagt

SEQ ID NO: 889496 - DNA, 25 bp, Mus musculus
tgggatccaggagtccatccccagt

SEQ ID NO: 889497 - DNA, 25 bp, Mus musculus
tgggatccatccaagctgtttcatg

SEQ ID NO: 889498 - DNA, 25 bp, Mus musculus
tgggatccatccatttcccaggaaa

SEQ ID NO: 889499 - DNA, 25 bp, Mus musculus
tgggatccatcctagctgtttcatg

SEQ ID NO: 889500 - DNA, 25 bp, Mus musculus
tgggatccatccttttcccaggaaa

SEQ ID NO: 889501 - DNA, 25 bp, Mus musculus
tgggatcccaaaatactactacgct

SEQ ID NO: 889502 - DNA, 25 bp, Mus musculus
tgggatcccaaattactactacgct

SEQ ID NO: 889503 - DNA, 25 bp, Mus musculus
tgggatcccagaacaaagcacagta

SEQ ID NO: 889504 - DNA, 25 bp, Mus musculus
tgggatcccagaccccatgaagaac

SEQ ID NO: 889505 - DNA, 25 bp, Mus musculus
tgggatcccagagcccatgaagaac

SEQ ID NO: 889506 - DNA, 25 bp, Mus musculus
tgggatcccagatcaaagcacagta

SEQ ID NO: 889507 - DNA, 25 bp, Mus musculus
tgggatcccagtcgtacatgaccct

SEQ ID NO: 889508 - DNA, 25 bp, Mus musculus
tgggatcccagtggtacatgaccct

SEQ ID NO: 889509 - DNA, 25 bp, Mus musculus
tgggatccccatacctgtgttctaa

SEQ ID NO: 889510 - DNA, 25 bp, Mus musculus
tgggatccccattcctgtgttctaa

SEQ ID NO: 889511 - DNA, 25 bp, Mus musculus
tgggatcccggaagaactcagactg

SEQ ID NO: 889512 - DNA, 25 bp, Mus musculus
tgggatcccggatgaactcagactg

SEQ ID NO: 889513 - DNA, 25 bp, Mus musculus
tgggatccctgactaaacttcttta

SEQ ID NO: 889514 - DNA, 25 bp, Mus musculus
tgggatccctgagtaaacttcttta

SEQ ID NO: 889515 - DNA, 25 bp, Mus musculus
tgggatccctgcacttaggtgctgg

SEQ ID NO: 889516 - DNA, 25 bp, Mus musculus
tgggatccctgctcttaggtgctgg

SEQ ID NO: 889517 - DNA, 25 bp, Mus musculus
tgggatcccttactaacctggcatt

SEQ ID NO: 889518 - DNA, 25 bp, Mus musculus
tgggatcccttagtaacctggcatt

SEQ ID NO: 889519 - DNA, 25 bp, Mus musculus
tgggatccgatgaactcttttgctg

SEQ ID NO: 889520 - DNA, 25 bp, Mus musculus
tgggatccgatgtactcttttgctg

SEQ ID NO: 889521 - DNA, 25 bp, Mus musculus
tgggatccgggcaaagcctgctcac

SEQ ID NO: 889522 - DNA, 25 bp, Mus musculus
tgggatccgggctaagcctgctcac

SEQ ID NO: 889523 - DNA, 25 bp, Mus musculus
tgggatcctaaaagtcccgcctttg

SEQ ID NO: 889524 - DNA, 25 bp, Mus musculus
tgggatcctaaatgtcccgcctttg

SEQ ID NO: 889525 - DNA, 25 bp, Mus musculus
tgggatcctacaccttgcaggccga

SEQ ID NO: 889526 - DNA, 25 bp, Mus musculus
tgggatcctacagcttgcaggccga

SEQ ID NO: 889527 - DNA, 25 bp, Mus musculus
tgggatcctcgtccgctcagtctct

SEQ ID NO: 889528 - DNA, 25 bp, Mus musculus
tgggatcctcgtgcgctcagtctct

SEQ ID NO: 889529 - DNA, 25 bp, Mus musculus
tgggatcctgagcacagttctgtac

SEQ ID NO: 889530 - DNA, 25 bp, Mus musculus
tgggatcctgaggacagttctgtac

SEQ ID NO: 889531 - DNA, 25 bp, Mus musculus
tgggatccttctcatgggtccacgg

SEQ ID NO: 889532 - DNA, 25 bp, Mus musculus
tgggatccttctgatgggtccacgg

SEQ ID NO: 889533 - DNA, 25 bp, Mus musculus
tgggatccttggcaaagggccacat

SEQ ID NO: 889534 - DNA, 25 bp, Mus musculus
tgggatccttgggaaagggccacat

SEQ ID NO: 889535 - DNA, 25 bp, Mus musculus
tgggatcgagccacctgttaagtga

SEQ ID NO: 889536 - DNA, 25 bp, Mus musculus
tgggatcgagcctcctgttaagtga

SEQ ID NO: 889537 - DNA, 25 bp, Mus musculus
tgggatcgcaagcatacgcctagct

SEQ ID NO: 889538 - DNA, 25 bp, Mus musculus
tgggatcgcaaggatacgcctagct

SEQ ID NO: 889539 - DNA, 25 bp, Mus musculus
tgggatcgcactcctgtactggtca

SEQ ID NO: 889540 - DNA, 25 bp, Mus musculus
tgggatcgcactgctgtactggtca

SEQ ID NO: 889541 - DNA, 25 bp, Mus musculus
tgggatcgcatgagtgtatcgtcat

SEQ ID NO: 889542 - DNA, 25 bp, Mus musculus
tgggatcgcatgtgtgtatcgtcat

SEQ ID NO: 889543 - DNA, 25 bp, Mus musculus
tgggatcgcgcgaaccggattttaa

SEQ ID NO: 889544 - DNA, 25 bp, Mus musculus
tgggatcgcgcgtaccggattttaa

SEQ ID NO: 889545 - DNA, 25 bp, Mus musculus
tgggatcgtccaccccttctctgtg

SEQ ID NO: 889546 - DNA, 25 bp, Mus musculus
tgggatcgtccagcccttctctgtg

SEQ ID NO: 889547 - DNA, 25 bp, Mus musculus
tgggatcgttcacatttccatctgt

SEQ ID NO: 889548 - DNA, 25 bp, Mus musculus
tgggatcgttcacccggtcaagaac

SEQ ID NO: 889549 - DNA, 25 bp, Mus musculus
tgggatcgttcagatttccatctgt

SEQ ID NO: 889550 - DNA, 25 bp, Mus musculus
tgggatcgttcagccggtcaagaac

SEQ ID NO: 889551 - DNA, 25 bp, Mus musculus
tgggatctagacagactaagctgca

SEQ ID NO: 889552 - DNA, 25 bp, Mus musculus
tgggatctagactgactaagctgca

SEQ ID NO: 889553 - DNA, 25 bp, Mus musculus
tgggatctcaaacccctgcccaatt

SEQ ID NO: 889554 - DNA, 25 bp, Mus musculus
tgggatctcaaagccctgcccaatt

SEQ ID NO: 889555 - DNA, 25 bp, Mus musculus
tgggatctcagcattgggccttctc

SEQ ID NO: 889556 - DNA, 25 bp, Mus musculus
tgggatctcagctttgggccttctc

SEQ ID NO: 889557 - DNA, 25 bp, Mus musculus
tgggatctcaggcattttttttctc

SEQ ID NO: 889558 - DNA, 25 bp, Mus musculus
tgggatctcagggattttttttctc

SEQ ID NO: 889559 - DNA, 25 bp, Mus musculus
tgggatctcattagggaatattcag

SEQ ID NO: 889560 - DNA, 25 bp, Mus musculus
tgggatctcatttgggaatattcag

SEQ ID NO: 889561 - DNA, 25 bp, Mus musculus
tgggatctccacaatttcccaggga

SEQ ID NO: 889562 - DNA, 25 bp, Mus musculus
tgggatctccactatttcccaggga

SEQ ID NO: 889563 - DNA, 25 bp, Mus musculus
tgggatctctcaccccagcaaggca

SEQ ID NO: 889564 - DNA, 25 bp, Mus musculus
tgggatctctcagcccagcaaggca

SEQ ID NO: 889565 - DNA, 25 bp, Mus musculus
tgggatctcttcatgtagccccgga

SEQ ID NO: 889566 - DNA, 25 bp, Mus musculus
tgggatctcttcttgtagccccgga

SEQ ID NO: 889567 - DNA, 25 bp, Mus musculus
tgggatctgatcacgtgttactgca

SEQ ID NO: 889568 - DNA, 25 bp, Mus musculus
tgggatctgatctcgtgttactgca

SEQ ID NO: 889569 - DNA, 25 bp, Mus musculus
tgggatctgatgctgtcttttgacc

SEQ ID NO: 889570 - DNA, 25 bp, Mus musculus
tgggatctgatggtgtcttttgacc

SEQ ID NO: 889571 - DNA, 25 bp, Mus musculus
tgggatctgcataccagctgggaac

SEQ ID NO: 889572 - DNA, 25 bp, Mus musculus
tgggatctgcattccagctgggaac

SEQ ID NO: 889573 - DNA, 25 bp, Mus musculus
tgggatctggccaatgcattacctc

SEQ ID NO: 889574 - DNA, 25 bp, Mus musculus
tgggatctggcctatgcattacctc

SEQ ID NO: 889575 - DNA, 25 bp, Mus musculus
tgggatctgttcacagtgcagcagg

SEQ ID NO: 889576 - DNA, 25 bp, Mus musculus
tgggatctgttctcagtgcagcagg

SEQ ID NO: 889577 - DNA, 25 bp, Mus musculus
tgggatcttatgaggactctcccta

SEQ ID NO: 889578 - DNA, 25 bp, Mus musculus
tgggatcttatgtggactctcccta

SEQ ID NO: 889579 - DNA, 25 bp, Mus musculus
tgggatcttccaatgtcatacagtg

SEQ ID NO: 889580 - DNA, 25 bp, Mus musculus
tgggatcttccattgtcatacagtg

SEQ ID NO: 889581 - DNA, 25 bp, Mus musculus
tgggatcttcttaccccgttcagaa

SEQ ID NO: 889582 - DNA, 25 bp, Mus musculus
tgggatcttctttccccgttcagaa

SEQ ID NO: 889583 - DNA, 25 bp, Mus musculus
tgggatcttggacgctaagcttgac

SEQ ID NO: 889584 - DNA, 25 bp, Mus musculus
tgggatcttggaggctaagcttgac

SEQ ID NO: 889585 - DNA, 25 bp, Mus musculus
tgggatcttgttcatcatctccggc

SEQ ID NO: 889586 - DNA, 25 bp, Mus musculus
tgggatcttgttgatcatctccggc

SEQ ID NO: 889587 - DNA, 25 bp, Mus musculus
tgggatctttttcctcctgcatact

SEQ ID NO: 889588 - DNA, 25 bp, Mus musculus
tgggatctttttgctcctgcatact

SEQ ID NO: 889589 - DNA, 25 bp, Mus musculus
tgggatgaagatctcacgcccggat

SEQ ID NO: 889590 - DNA, 25 bp, Mus musculus
tgggatgaagatgtcacgcccggat

SEQ ID NO: 889591 - DNA, 25 bp, Mus musculus
tgggatgacactagcctgtttccaa

SEQ ID NO: 889592 - DNA, 25 bp, Mus musculus
tgggatgacacttgcctgtttccaa

SEQ ID NO: 889593 - DNA, 25 bp, Mus musculus
tgggatgacatcctgcagctctctg

SEQ ID NO: 889594 - DNA, 25 bp, Mus musculus
tgggatgacatcgtgcagctctctg

SEQ ID NO: 889595 - DNA, 25 bp, Mus musculus
tgggatgacattcagtttgagctgc

SEQ ID NO: 889596 - DNA, 25 bp, Mus musculus
tgggatgacattgagtttgagctgc

SEQ ID NO: 889597 - DNA, 25 bp, Mus musculus
tgggatgacgtcagatctccatcca

SEQ ID NO: 889598 - DNA, 25 bp, Mus musculus
tgggatgacgtctgatctccatcca

SEQ ID NO: 889599 - DNA, 25 bp, Mus musculus
tgggatgactctcccttgaccatca

SEQ ID NO: 889600 - DNA, 25 bp, Mus musculus
tgggatgactctgccttgaccatca

SEQ ID NO: 889601 - DNA, 25 bp, Mus musculus
tgggatgactgacacagaaatctgt

SEQ ID NO: 889602 - DNA, 25 bp, Mus musculus
tgggatgactgagacagaaatctgt

SEQ ID NO: 889603 - DNA, 25 bp, Mus musculus
tgggatgagccacggtgcagaccta

SEQ ID NO: 889604 - DNA, 25 bp, Mus musculus
tgggatgagccagggtgcagaccta

SEQ ID NO: 889605 - DNA, 25 bp, Mus musculus
tgggatgagtggagtgctttctttc

SEQ ID NO: 889606 - DNA, 25 bp, Mus musculus
tgggatgagtggtgtgctttctttc

SEQ ID NO: 889607 - DNA, 25 bp, Mus musculus
tgggatgcacctagtattaaaattg

SEQ ID NO: 889608 - DNA, 25 bp, Mus musculus
tgggatgcaccttgtattaaaattg

SEQ ID NO: 889609 - DNA, 25 bp, Mus musculus
tgggatgcagtcctgtccagccaga

SEQ ID NO: 889610 - DNA, 25 bp, Mus musculus
tgggatgcagtcgtgtccagccaga

SEQ ID NO: 889611 - DNA, 25 bp, Mus musculus
tgggatgccagaattctagcaactt

SEQ ID NO: 889612 - DNA, 25 bp, Mus musculus
tgggatgccagatttctagcaactt

SEQ ID NO: 889613 - DNA, 25 bp, Mus musculus
tgggatgccatcatcaaaactgagt

SEQ ID NO: 889614 - DNA, 25 bp, Mus musculus
tgggatgccatcttcaaaactgagt

SEQ ID NO: 889615 - DNA, 25 bp, Mus musculus
tgggatgccattcctcataggtcaa

SEQ ID NO: 889616 - DNA, 25 bp, Mus musculus
tgggatgccattgctcataggtcaa

SEQ ID NO: 889617 - DNA, 25 bp, Mus musculus
tgggatgcccacactcaggaaggat

SEQ ID NO: 889618 - DNA, 25 bp, Mus musculus
tgggatgcccactctcaggaaggat

SEQ ID NO: 889619 - DNA, 25 bp, Mus musculus
tgggatgcccagcttgatgtaccgc

SEQ ID NO: 889620 - DNA, 25 bp, Mus musculus
tgggatgcccaggttgatgtaccgc

SEQ ID NO: 889621 - DNA, 25 bp, Mus musculus
tgggatgccctgaggcatgctgtac

SEQ ID NO: 889622 - DNA, 25 bp, Mus musculus
tgggatgccctgtggcatgctgtac

SEQ ID NO: 889623 - DNA, 25 bp, Mus musculus
tgggatgccgctagtcagtgctaac

SEQ ID NO: 889624 - DNA, 25 bp, Mus musculus
tgggatgccgcttgtcagtgctaac

SEQ ID NO: 889625 - DNA, 25 bp, Mus musculus
tgggatgctattacagccaatctgg

SEQ ID NO: 889626 - DNA, 25 bp, Mus musculus
tgggatgctatttcagccaatctgg

SEQ ID NO: 889627 - DNA, 25 bp, Mus musculus
tgggatgcttccctttttgaagact

SEQ ID NO: 889628 - DNA, 25 bp, Mus musculus
tgggatgcttccgtttttgaagact

SEQ ID NO: 889629 - DNA, 25 bp, Mus musculus
tgggatgcttctaacttcactgtgt

SEQ ID NO: 889630 - DNA, 25 bp, Mus musculus
tgggatgcttcttacttcactgtgt

SEQ ID NO: 889631 - DNA, 25 bp, Mus musculus
tgggatgctttgacagggctacaca

SEQ ID NO: 889632 - DNA, 25 bp, Mus musculus
tgggatgctttgtcagggctacaca

SEQ ID NO: 889633 - DNA, 25 bp, Mus musculus
tgggatggaatcaccacactgcgct

SEQ ID NO: 889634 - DNA, 25 bp, Mus musculus
tgggatggaatctccacactgcgct

SEQ ID NO: 889635 - DNA, 25 bp, Mus musculus
tgggatggacttcctcagaactcac

SEQ ID NO: 889636 - DNA, 25 bp, Mus musculus
tgggatggacttgctcagaactcac

SEQ ID NO: 889637 - DNA, 25 bp, Mus musculus
tgggatggcaaacttttcttctttt

SEQ ID NO: 889638 - DNA, 25 bp, Mus musculus
tgggatggcaaagttttcttctttt

SEQ ID NO: 889639 - DNA, 25 bp, Mus musculus
tgggatggccttacgcagtcaggaa

SEQ ID NO: 889640 - DNA, 25 bp, Mus musculus
tgggatggcctttcgcagtcaggaa

SEQ ID NO: 889641 - DNA, 25 bp, Mus musculus
tgggatgggaaacgccctagcttca

SEQ ID NO: 889642 - DNA, 25 bp, Mus musculus
tgggatgggaaaggccctagcttca

SEQ ID NO: 889643 - DNA, 25 bp, Mus musculus
tgggatgggactaacgccccgaaag

SEQ ID NO: 889644 - DNA, 25 bp, Mus musculus
tgggatgggacttacgccccgaaag

SEQ ID NO: 889645 - DNA, 25 bp, Mus musculus
tgggatggtattaacactcctctca

SEQ ID NO: 889646 - DNA, 25 bp, Mus musculus
tgggatggtatttacactcctctca

SEQ ID NO: 889647 - DNA, 25 bp, Mus musculus
tgggatgtactgagccctactggac

SEQ ID NO: 889648 - DNA, 25 bp, Mus musculus
tgggatgtactgtgccctactggac

SEQ ID NO: 889649 - DNA, 25 bp, Mus musculus
tgggatgtacttaagtctcaacctg

SEQ ID NO: 889650 - DNA, 25 bp, Mus musculus
tgggatgtactttagtctcaacctg

SEQ ID NO: 889651 - DNA, 25 bp, Mus musculus
tgggatgtatctctttcacctgcat

SEQ ID NO: 889652 - DNA, 25 bp, Mus musculus
tgggatgtatctgtttcacctgcat

SEQ ID NO: 889653 - DNA, 25 bp, Mus musculus
tgggatgtcgtcaggattggaacta

SEQ ID NO: 889654 - DNA, 25 bp, Mus musculus
tgggatgtcgtctggattggaacta

SEQ ID NO: 889655 - DNA, 25 bp, Mus musculus
tgggatgtcgttccccatcaatgaa

SEQ ID NO: 889656 - DNA, 25 bp, Mus musculus
tgggatgtcgttgcccatcaatgaa

SEQ ID NO: 889657 - DNA, 25 bp, Mus musculus
tgggatgtctctctgcgagcacaaa

SEQ ID NO: 889658 - DNA, 25 bp, Mus musculus
tgggatgtctctgtgcgagcacaaa

SEQ ID NO: 889659 - DNA, 25 bp, Mus musculus
tgggatgtgcatattgtacttagga

SEQ ID NO: 889660 - DNA, 25 bp, Mus musculus
tgggatgtgcattttgtacttagga

SEQ ID NO: 889661 - DNA, 25 bp, Mus musculus
tgggatgttcagactggccagtgcc

SEQ ID NO: 889662 - DNA, 25 bp, Mus musculus
tgggatgttcagtctggccagtgcc

SEQ ID NO: 889663 - DNA, 25 bp, Mus musculus
tgggatgttcatcttttactgtgct

SEQ ID NO: 889664 - DNA, 25 bp, Mus musculus
tgggatgttcatgttttactgtgct

SEQ ID NO: 889665 - DNA, 25 bp, Mus musculus
tgggatgtttcacgccttaaaaaag

SEQ ID NO: 889666 - DNA, 25 bp, Mus musculus
tgggatgtttcaggccttaaaaaag

SEQ ID NO: 889667 - DNA, 25 bp, Mus musculus
tgggatgttttcactcctgactcat

SEQ ID NO: 889668 - DNA, 25 bp, Mus musculus
tgggatgttttctctcctgactcat

SEQ ID NO: 889669 - DNA, 25 bp, Mus musculus
tgggattacaaacacacactgctgt

SEQ ID NO: 889670 - DNA, 25 bp, Mus musculus
tgggattacaaagacacactgctgt

SEQ ID NO: 889671 - DNA, 25 bp, Mus musculus
tgggattacagacagccaatccagc

SEQ ID NO: 889672 - DNA, 25 bp, Mus musculus
tgggattacagagagccaatccagc

SEQ ID NO: 889673 - DNA, 25 bp, Mus musculus
tgggattacctcagcatcctatcaa

SEQ ID NO: 889674 - DNA, 25 bp, Mus musculus
tgggattacctctgcatcctatcaa

SEQ ID NO: 889675 - DNA, 25 bp, Mus musculus
tgggattactctacttgttcaatga

SEQ ID NO: 889676 - DNA, 25 bp, Mus musculus
tgggattactcttcttgttcaatga

SEQ ID NO: 889677 - DNA, 25 bp, Mus musculus
tgggattagagtccggctctgccaa

SEQ ID NO: 889678 - DNA, 25 bp, Mus musculus
tgggattagagtgcggctctgccaa

SEQ ID NO: 889679 - DNA, 25 bp, Mus musculus
tgggattaggccactgcactgaagg

SEQ ID NO: 889680 - DNA, 25 bp, Mus musculus
tgggattaggcctctgcactgaagg

SEQ ID NO: 889681 - DNA, 25 bp, Mus musculus
tgggattatagacacggaccttcgc

SEQ ID NO: 889682 - DNA, 25 bp, Mus musculus
tgggattatagagacggaccttcgc

SEQ ID NO: 889683 - DNA, 25 bp, Mus musculus
tgggattcaagcagagccctttctt

SEQ ID NO: 889684 - DNA, 25 bp, Mus musculus
tgggattcaagctgagccctttctt

SEQ ID NO: 889685 - DNA, 25 bp, Mus musculus
tgggattcacttctccagggatttt

SEQ ID NO: 889686 - DNA, 25 bp, Mus musculus
tgggattcacttgtccagggatttt

SEQ ID NO: 889687 - DNA, 25 bp, Mus musculus
tgggattcagggagccatcaccact

SEQ ID NO: 889688 - DNA, 25 bp, Mus musculus
tgggattcagggtgccatcaccact

SEQ ID NO: 889689 - DNA, 25 bp, Mus musculus
tgggattccaaacctgaccccgagg

SEQ ID NO: 889690 - DNA, 25 bp, Mus musculus
tgggattccaaagctgaccccgagg

SEQ ID NO: 889691 - DNA, 25 bp, Mus musculus
tgggattcccaaagtaaactccccg

SEQ ID NO: 889692 - DNA, 25 bp, Mus musculus
tgggattcccaatgtaaactccccg

SEQ ID NO: 889693 - DNA, 25 bp, Mus musculus
tgggattccccactgagcaggctgc

SEQ ID NO: 889694 - DNA, 25 bp, Mus musculus
tgggattccccagtgagcaggctgc

SEQ ID NO: 889695 - DNA, 25 bp, Mus musculus
tgggattccctgctcttaccttagg

SEQ ID NO: 889696 - DNA, 25 bp, Mus musculus
tgggattccctggtcttaccttagg

SEQ ID NO: 889697 - DNA, 25 bp, Mus musculus
tgggattcccttccaggttgttgct

SEQ ID NO: 889698 - DNA, 25 bp, Mus musculus
tgggattcccttgcaggttgttgct

SEQ ID NO: 889699 - DNA, 25 bp, Mus musculus
tgggattccgttattggtagatcgt

SEQ ID NO: 889700 - DNA, 25 bp, Mus musculus
tgggattccgtttttggtagatcgt

SEQ ID NO: 889701 - DNA, 25 bp, Mus musculus
tgggattcgcttattgggaccagct

SEQ ID NO: 889702 - DNA, 25 bp, Mus musculus
tgggattcgctttttgggaccagct

SEQ ID NO: 889703 - DNA, 25 bp, Mus musculus
tgggattcgtagaccgttcgcgcca

SEQ ID NO: 889704 - DNA, 25 bp, Mus musculus
tgggattcgtagtccgttcgcgcca

SEQ ID NO: 889705 - DNA, 25 bp, Mus musculus
tgggattctaggcacagagcatcat

SEQ ID NO: 889706 - DNA, 25 bp, Mus musculus
tgggattctagggacagagcatcat

SEQ ID NO: 889707 - DNA, 25 bp, Mus musculus
tgggattctattatccactgagcag

SEQ ID NO: 889708 - DNA, 25 bp, Mus musculus
tgggattctattttccactgagcag

SEQ ID NO: 889709 - DNA, 25 bp, Mus musculus
tgggattctccaaaaaccccatcaa

SEQ ID NO: 889710 - DNA, 25 bp, Mus musculus
tgggattctccataaaccccatcaa

SEQ ID NO: 889711 - DNA, 25 bp, Mus musculus
tgggattctcccagagccttctcca

SEQ ID NO: 889712 - DNA, 25 bp, Mus musculus
tgggattctccctgagccttctcca

SEQ ID NO: 889713 - DNA, 25 bp, Mus musculus
tgggattctctgcagctatgttgct

SEQ ID NO: 889714 - DNA, 25 bp, Mus musculus
tgggattctctggagctatgttgct

SEQ ID NO: 889715 - DNA, 25 bp, Mus musculus
tgggattctgggattgcctcatgcc

SEQ ID NO: 889716 - DNA, 25 bp, Mus musculus
tgggattctgggtttgcctcatgcc

SEQ ID NO: 889717 - DNA, 25 bp, Mus musculus
tgggattctgtcattgcaattccac

SEQ ID NO: 889718 - DNA, 25 bp, Mus musculus
tgggattctgtctttgcaattccac

SEQ ID NO: 889719 - DNA, 25 bp, Mus musculus
tgggattctgttccatagacaagca

SEQ ID NO: 889720 - DNA, 25 bp, Mus musculus
tgggattctgttgcatagacaagca

SEQ ID NO: 889721 - DNA, 25 bp, Mus musculus
tgggattgcaggcaagcgccacatt

SEQ ID NO: 889722 - DNA, 25 bp, Mus musculus
tgggattgcagggaagcgccacatt

SEQ ID NO: 889723 - DNA, 25 bp, Mus musculus
tgggattgcccacccctgacctagg

SEQ ID NO: 889724 - DNA, 25 bp, Mus musculus
tgggattgcccagccctgacctagg

SEQ ID NO: 889725 - DNA, 25 bp, Mus musculus
tgggattgcgcactaaacattccct

SEQ ID NO: 889726 - DNA, 25 bp, Mus musculus
tgggattgcgcagtaaacattccct

SEQ ID NO: 889727 - DNA, 25 bp, Mus musculus
tgggattggctgaaggatttccctc

SEQ ID NO: 889728 - DNA, 25 bp, Mus musculus
tgggattggctgtaggatttccctc

SEQ ID NO: 889729 - DNA, 25 bp, Mus musculus
tgggattgggcacaaccccatggca

SEQ ID NO: 889730 - DNA, 25 bp, Mus musculus
tgggattgggcagaaccccatggca

SEQ ID NO: 889731 - DNA, 25 bp, Mus musculus
tgggattgtcttacccttacaattt

SEQ ID NO: 889732 - DNA, 25 bp, Mus musculus
tgggattgtctttcccttacaattt

SEQ ID NO: 889733 - DNA, 25 bp, Mus musculus
tgggattgttcaactgtaccttctg

SEQ ID NO: 889734 - DNA, 25 bp, Mus musculus
tgggattgttcatctgtaccttctg

SEQ ID NO: 889735 - DNA, 25 bp, Mus musculus
tgggatttaactaaggttggcctga

SEQ ID NO: 889736 - DNA, 25 bp, Mus musculus
tgggatttaacttaggttggcctga

SEQ ID NO: 889737 - DNA, 25 bp, Mus musculus
tgggatttaaggctcacactttggg

SEQ ID NO: 889738 - DNA, 25 bp, Mus musculus
tgggatttaagggtcacactttggg

SEQ ID NO: 889739 - DNA, 25 bp, Mus musculus
tgggatttacccaggattttggata

SEQ ID NO: 889740 - DNA, 25 bp, Mus musculus
tgggatttaccctggattttggata

SEQ ID NO: 889741 - DNA, 25 bp, Mus musculus
tgggatttagttctctccttcaggc

SEQ ID NO: 889742 - DNA, 25 bp, Mus musculus
tgggatttagttgtctccttcaggc

SEQ ID NO: 889743 - DNA, 25 bp, Mus musculus
tgggatttcaaacccacctgagagc

SEQ ID NO: 889744 - DNA, 25 bp, Mus musculus
tgggatttcaaagccacctgagagc

SEQ ID NO: 889745 - DNA, 25 bp, Mus musculus
tgggatttcaagaccctagagtctt

SEQ ID NO: 889746 - DNA, 25 bp, Mus musculus
tgggatttcaagtccctagagtctt

SEQ ID NO: 889747 - DNA, 25 bp, Mus musculus
tgggatttcactacttcctgcctaa

SEQ ID NO: 889748 - DNA, 25 bp, Mus musculus
tgggatttcacttcttcctgcctaa

SEQ ID NO: 889749 - DNA, 25 bp, Mus musculus
tgggatttccctacagtctaaccct

SEQ ID NO: 889750 - DNA, 25 bp, Mus musculus
tgggatttcccttcagtctaaccct

SEQ ID NO: 889751 - DNA, 25 bp, Mus musculus
tgggatttcggactgatgcactaat

SEQ ID NO: 889752 - DNA, 25 bp, Mus musculus
tgggatttcggagtgatgcactaat

SEQ ID NO: 889753 - DNA, 25 bp, Mus musculus
tgggatttgacccaggtcctttgaa

SEQ ID NO: 889754 - DNA, 25 bp, Mus musculus
tgggatttgaccgaggtcctttgaa

SEQ ID NO: 889755 - DNA, 25 bp, Mus musculus
tgggatttgcctcttttgactccac

SEQ ID NO: 889756 - DNA, 25 bp, Mus musculus
tgggatttgcctgttttgactccac

SEQ ID NO: 889757 - DNA, 25 bp, Mus musculus
tgggatttgggcagcctacctggca

SEQ ID NO: 889758 - DNA, 25 bp, Mus musculus
tgggatttgggctgcctacctggca

SEQ ID NO: 889759 - DNA, 25 bp, Mus musculus
tgggatttgtcacgcatagtatttc

SEQ ID NO: 889760 - DNA, 25 bp, Mus musculus
tgggatttgtcaggcatagtatttc

SEQ ID NO: 889761 - DNA, 25 bp, Mus musculus
tgggattttacacccatttgctact

SEQ ID NO: 889762 - DNA, 25 bp, Mus musculus
tgggattttacagccatttgctact

SEQ ID NO: 889763 - DNA, 25 bp, Mus musculus
tgggattttactctcatctatgcca

SEQ ID NO: 889764 - DNA, 25 bp, Mus musculus
tgggattttactgtcatctatgcca

SEQ ID NO: 889765 - DNA, 25 bp, Mus musculus
tgggattttctgagacagtgaagtt

SEQ ID NO: 889766 - DNA, 25 bp, Mus musculus
tgggattttctgtgacagtgaagtt

SEQ ID NO: 889767 - DNA, 25 bp, Mus musculus
tgggattttgatatccctagcctcc

SEQ ID NO: 889768 - DNA, 25 bp, Mus musculus
tgggattttgatttccctagcctcc

SEQ ID NO: 889769 - DNA, 25 bp, Mus musculus
tgggatttttcaacaaggcggcctt

SEQ ID NO: 889770 - DNA, 25 bp, Mus musculus
tgggatttttcacaatggacaccgt

SEQ ID NO: 889771 - DNA, 25 bp, Mus musculus
tgggatttttcagaatggacaccgt

SEQ ID NO: 889772 - DNA, 25 bp, Mus musculus
tgggatttttcatcaaggcggcctt

SEQ ID NO: 889773 - DNA, 25 bp, Mus musculus
tgggcaaaaacaccaccttgtccct

SEQ ID NO: 889774 - DNA, 25 bp, Mus musculus
tgggcaaaaacagcaccttgtccct

SEQ ID NO: 889775 - DNA, 25 bp, Mus musculus
tgggcaaaactcagtgctgtcaccc

SEQ ID NO: 889776 - DNA, 25 bp, Mus musculus
tgggcaaaactctgtgctgtcaccc

SEQ ID NO: 889777 - DNA, 25 bp, Mus musculus
tgggcaaaagaaacagctcattgaa

SEQ ID NO: 889778 - DNA, 25 bp, Mus musculus
tgggcaaaagaatcagctcattgaa

SEQ ID NO: 889779 - DNA, 25 bp, Mus musculus
tgggcaaacaggcttccggtcacta

SEQ ID NO: 889780 - DNA, 25 bp, Mus musculus
tgggcaaacagggttccggtcacta

SEQ ID NO: 889781 - DNA, 25 bp, Mus musculus
tgggcaaaccacaccctgaacttca

SEQ ID NO: 889782 - DNA, 25 bp, Mus musculus
tgggcaaaccactccctgaacttca

SEQ ID NO: 889783 - DNA, 25 bp, Mus musculus
tgggcaaacctgctcagtactttag

SEQ ID NO: 889784 - DNA, 25 bp, Mus musculus
tgggcaaacctggtcagtactttag

SEQ ID NO: 889785 - DNA, 25 bp, Mus musculus
tgggcaaacttgatacacataaata

SEQ ID NO: 889786 - DNA, 25 bp, Mus musculus
tgggcaaacttgttacacataaata

SEQ ID NO: 889787 - DNA, 25 bp, Mus musculus
tgggcaaactttctgcctgtgcctt

SEQ ID NO: 889788 - DNA, 25 bp, Mus musculus
tgggcaaactttgtgcctgtgcctt

SEQ ID NO: 889789 - DNA, 25 bp, Mus musculus
tgggcaaagcaactgcacacacctt

SEQ ID NO: 889790 - DNA, 25 bp, Mus musculus
tgggcaaagcaagtgcacacacctt

SEQ ID NO: 889791 - DNA, 25 bp, Mus musculus
tgggcaaatatgacaccaccacact

SEQ ID NO: 889792 - DNA, 25 bp, Mus musculus
tgggcaaatatgtcaccaccacact

SEQ ID NO: 889793 - DNA, 25 bp, Mus musculus
tgggcaaatcacactcttctgagtc

SEQ ID NO: 889794 - DNA, 25 bp, Mus musculus
tgggcaaatcactctcttctgagtc

SEQ ID NO: 889795 - DNA, 25 bp, Mus musculus
tgggcaaatgttaacgtcacagtaa

SEQ ID NO: 889796 - DNA, 25 bp, Mus musculus
tgggcaaatgtttacgtcacagtaa

SEQ ID NO: 889797 - DNA, 25 bp, Mus musculus
tgggcaacaagcaccacagctgata

SEQ ID NO: 889798 - DNA, 25 bp, Mus musculus
tgggcaacaagctccacagctgata

SEQ ID NO: 889799 - DNA, 25 bp, Mus musculus
tgggcaacattcaacttcatctagt

SEQ ID NO: 889800 - DNA, 25 bp, Mus musculus
tgggcaacattctacttcatctagt

SEQ ID NO: 889801 - DNA, 25 bp, Mus musculus
tgggcaaccatgagcgagtgcactc

SEQ ID NO: 889802 - DNA, 25 bp, Mus musculus
tgggcaaccatgtgcgagtgcactc

SEQ ID NO: 889803 - DNA, 25 bp, Mus musculus
tgggcaacccagcacaacctaggac

SEQ ID NO: 889804 - DNA, 25 bp, Mus musculus
tgggcaacccaggacaacctaggac

SEQ ID NO: 889805 - DNA, 25 bp, Mus musculus
tgggcaaccggactttccctaagct

SEQ ID NO: 889806 - DNA, 25 bp, Mus musculus
tgggcaaccggagtttccctaagct

SEQ ID NO: 889807 - DNA, 25 bp, Mus musculus
tgggcaacctggctctgatggactc

SEQ ID NO: 889808 - DNA, 25 bp, Mus musculus
tgggcaacctgggtctgatggactc

SEQ ID NO: 889809 - DNA, 25 bp, Mus musculus
tgggcaacgctaaagctcttctgta

SEQ ID NO: 889810 - DNA, 25 bp, Mus musculus
tgggcaacgctatagctcttctgta

SEQ ID NO: 889811 - DNA, 25 bp, Mus musculus
tgggcaagacatcgaactccccggt

SEQ ID NO: 889812 - DNA, 25 bp, Mus musculus
tgggcaagacatggaactccccggt

SEQ ID NO: 889813 - DNA, 25 bp, Mus musculus
tgggcaagaccaacgatcggctcat

SEQ ID NO: 889814 - DNA, 25 bp, Mus musculus
tgggcaagaccatcgatcggctcat

SEQ ID NO: 889815 - DNA, 25 bp, Mus musculus
tgggcaagaggcatccgtgctcact

SEQ ID NO: 889816 - DNA, 25 bp, Mus musculus
tgggcaagaggcttccgtgctcact

SEQ ID NO: 889817 - DNA, 25 bp, Mus musculus
tgggcaagatctacaactcgcgggt

SEQ ID NO: 889818 - DNA, 25 bp, Mus musculus
tgggcaagatcttcaactcgcgggt

SEQ ID NO: 889819 - DNA, 25 bp, Mus musculus
tgggcaagattactcatgtgtgaac

SEQ ID NO: 889820 - DNA, 25 bp, Mus musculus
tgggcaagattagtcatgtgtgaac

SEQ ID NO: 889821 - DNA, 25 bp, Mus musculus
tgggcaagcatcatgctcttacttc

SEQ ID NO: 889822 - DNA, 25 bp, Mus musculus
tgggcaagcatcttgctcttacttc

SEQ ID NO: 889823 - DNA, 25 bp, Mus musculus
tgggcaagccacacctccgaaagga

SEQ ID NO: 889824 - DNA, 25 bp, Mus musculus
tgggcaagccactcctccgaaagga

SEQ ID NO: 889825 - DNA, 25 bp, Mus musculus
tgggcaagcgcgagcaagcactgca

SEQ ID NO: 889826 - DNA, 25 bp, Mus musculus
tgggcaagcgcgtgcaagcactgca

SEQ ID NO: 889827 - DNA, 25 bp, Mus musculus
tgggcaagcttgatcactgagacct

SEQ ID NO: 889828 - DNA, 25 bp, Mus musculus
tgggcaagcttgttcactgagacct

SEQ ID NO: 889829 - DNA, 25 bp, Mus musculus
tgggcaaggaacctctttttggcca

SEQ ID NO: 889830 - DNA, 25 bp, Mus musculus
tgggcaaggaacgtctttttggcca

SEQ ID NO: 889831 - DNA, 25 bp, Mus musculus
tgggcaaggatgatatatttgaacc

SEQ ID NO: 889832 - DNA, 25 bp, Mus musculus
tgggcaaggatgttatatttgaacc

SEQ ID NO: 889833 - DNA, 25 bp, Mus musculus
tgggcaagggtgagccaagacaggg

SEQ ID NO: 889834 - DNA, 25 bp, Mus musculus
tgggcaagggtgctttccttaaaat

SEQ ID NO: 889835 - DNA, 25 bp, Mus musculus
tgggcaagggtggtttccttaaaat

SEQ ID NO: 889836 - DNA, 25 bp, Mus musculus
tgggcaagggtgtgccaagacaggg

SEQ ID NO: 889837 - DNA, 25 bp, Mus musculus
tgggcaagtatcacttgttgttgct

SEQ ID NO: 889838 - DNA, 25 bp, Mus musculus
tgggcaagtatctcttgttgttgct

SEQ ID NO: 889839 - DNA, 25 bp, Mus musculus
tgggcaagtgtcctggtctccgaac

SEQ ID NO: 889840 - DNA, 25 bp, Mus musculus
tgggcaagtgtcgtggtctccgaac

SEQ ID NO: 889841 - DNA, 25 bp, Mus musculus
tgggcaagttcacctctgttactgt

SEQ ID NO: 889842 - DNA, 25 bp, Mus musculus
tgggcaagttcagctctgttactgt

SEQ ID NO: 889843 - DNA, 25 bp, Mus musculus
tgggcaagttccaaatcccttgatt

SEQ ID NO: 889844 - DNA, 25 bp, Mus musculus
tgggcaagttcctaatcccttgatt

SEQ ID NO: 889845 - DNA, 25 bp, Mus musculus
tgggcaatagtcaggaagcctgact

SEQ ID NO: 889846 - DNA, 25 bp, Mus musculus
tgggcaatagtctggaagcctgact

SEQ ID NO: 889847 - DNA, 25 bp, Mus musculus
tgggcaatagtgaccctctgaatat

SEQ ID NO: 889848 - DNA, 25 bp, Mus musculus
tgggcaatagtgtccctctgaatat

SEQ ID NO: 889849 - DNA, 25 bp, Mus musculus
tgggcaatcagcagctggcgctcag

SEQ ID NO: 889850 - DNA, 25 bp, Mus musculus
tgggcaatcagctgctggcgctcag

SEQ ID NO: 889851 - DNA, 25 bp, Mus musculus
tgggcaatcaggcatctcactgtcc

SEQ ID NO: 889852 - DNA, 25 bp, Mus musculus
tgggcaatcagggatctcactgtcc

SEQ ID NO: 889853 - DNA, 25 bp, Mus musculus
tgggcaatcctacaatcacgagagt

SEQ ID NO: 889854 - DNA, 25 bp, Mus musculus
tgggcaatcctagaatcacgagagt

SEQ ID NO: 889855 - DNA, 25 bp, Mus musculus
tgggcaatcgagattctgctctcca

SEQ ID NO: 889856 - DNA, 25 bp, Mus musculus
tgggcaatcgagtttctgctctcca

SEQ ID NO: 889857 - DNA, 25 bp, Mus musculus
tgggcaatcgtacccctgaattgtt

SEQ ID NO: 889858 - DNA, 25 bp, Mus musculus
tgggcaatcgtagccctgaattgtt

SEQ ID NO: 889859 - DNA, 25 bp, Mus musculus
tgggcaatgaccaggccccggtgct

SEQ ID NO: 889860 - DNA, 25 bp, Mus musculus
tgggcaatgacctggccccggtgct

SEQ ID NO: 889861 - DNA, 25 bp, Mus musculus
tgggcaatgctgactttgcagccat

SEQ ID NO: 889862 - DNA, 25 bp, Mus musculus
tgggcaatgctgtctttgcagccat

SEQ ID NO: 889863 - DNA, 25 bp, Mus musculus
tgggcaatggctcctacgtgcgcct

SEQ ID NO: 889864 - DNA, 25 bp, Mus musculus
tgggcaatggctgctacgtgcgcct

SEQ ID NO: 889865 - DNA, 25 bp, Mus musculus
tgggcaatgggcaggcactgtggca

SEQ ID NO: 889866 - DNA, 25 bp, Mus musculus
tgggcaatgggctggcactgtggca

SEQ ID NO: 889867 - DNA, 25 bp, Mus musculus
tgggcaatgtacatagctagatcct

SEQ ID NO: 889868 - DNA, 25 bp, Mus musculus
tgggcaatgtacttagctagatcct

SEQ ID NO: 889869 - DNA, 25 bp, Mus musculus
tgggcaatttacagaggctgcgcct

SEQ ID NO: 889870 - DNA, 25 bp, Mus musculus
tgggcaatttactgaggctgcgcct

SEQ ID NO: 889871 - DNA, 25 bp, Mus musculus
tgggcacaacggcttacatggcacc

SEQ ID NO: 889872 - DNA, 25 bp, Mus musculus
tgggcacaacgggttacatggcacc

SEQ ID NO: 889873 - DNA, 25 bp, Mus musculus
tgggcacaagccctttccgggacaa

SEQ ID NO: 889874 - DNA, 25 bp, Mus musculus
tgggcacaagccgtttccgggacaa

SEQ ID NO: 889875 - DNA, 25 bp, Mus musculus
tgggcacaagtccactgcacacata

SEQ ID NO: 889876 - DNA, 25 bp, Mus musculus
tgggcacaagtcgactgcacacata

SEQ ID NO: 889877 - DNA, 25 bp, Mus musculus
tgggcacacaacatgcacttagatc

SEQ ID NO: 889878 - DNA, 25 bp, Mus musculus
tgggcacacaacttgcacttagatc

SEQ ID NO: 889879 - DNA, 25 bp, Mus musculus
tgggcacacaccagggactagccca

SEQ ID NO: 889880 - DNA, 25 bp, Mus musculus
tgggcacacacctgggactagccca

SEQ ID NO: 889881 - DNA, 25 bp, Mus musculus
tgggcacacagaagacctgctctta

SEQ ID NO: 889882 - DNA, 25 bp, Mus musculus
tgggcacacagatgacctgctctta

SEQ ID NO: 889883 - DNA, 25 bp, Mus musculus
tgggcacacccacaataatcattaa

SEQ ID NO: 889884 - DNA, 25 bp, Mus musculus
tgggcacacccagaataatcattaa

SEQ ID NO: 889885 - DNA, 25 bp, Mus musculus
tgggcacacctgagaggcatttttt

SEQ ID NO: 889886 - DNA, 25 bp, Mus musculus
tgggcacacctgtgaggcatttttt

SEQ ID NO: 889887 - DNA, 25 bp, Mus musculus
tgggcacacgcaacggctgcaacat

SEQ ID NO: 889888 - DNA, 25 bp, Mus musculus
tgggcacacgcatcggctgcaacat

SEQ ID NO: 889889 - DNA, 25 bp, Mus musculus
tgggcacacggaaatcgcacggctg

SEQ ID NO: 889890 - DNA, 25 bp, Mus musculus
tgggcacacggatatcgcacggctg

SEQ ID NO: 889891 - DNA, 25 bp, Mus musculus
tgggcacagacgaccaagtctcaga

SEQ ID NO: 889892 - DNA, 25 bp, Mus musculus
tgggcacagacgtccaagtctcaga

SEQ ID NO: 889893 - DNA, 25 bp, Mus musculus
tgggcacagaggacctaccaggctg

SEQ ID NO: 889894 - DNA, 25 bp, Mus musculus
tgggcacagaggtcctaccaggctg

SEQ ID NO: 889895 - DNA, 25 bp, Mus musculus
tgggcacagctcagggacacctgtt

SEQ ID NO: 889896 - DNA, 25 bp, Mus musculus
tgggcacagctctgggacacctgtt

SEQ ID NO: 889897 - DNA, 25 bp, Mus musculus
tgggcacagcttctccagtgggcct

SEQ ID NO: 889898 - DNA, 25 bp, Mus musculus
tgggcacagcttgtccagtgggcct

SEQ ID NO: 889899 - DNA, 25 bp, Mus musculus
tgggcacaggcaaggtaccaccagc

SEQ ID NO: 889900 - DNA, 25 bp, Mus musculus
tgggcacaggcatggtaccaccagc

SEQ ID NO: 889901 - DNA, 25 bp, Mus musculus
tgggcacagtgccagtcccctggat

SEQ ID NO: 889902 - DNA, 25 bp, Mus musculus
tgggcacagtgcgagtcccctggat

SEQ ID NO: 889903 - DNA, 25 bp, Mus musculus
tgggcacagttaagactgtagccag

SEQ ID NO: 889904 - DNA, 25 bp, Mus musculus
tgggcacagttatgactgtagccag

SEQ ID NO: 889905 - DNA, 25 bp, Mus musculus
tgggcacagtttcttgcaaccatgt

SEQ ID NO: 889906 - DNA, 25 bp, Mus musculus
tgggcacagtttgttgcaaccatgt

SEQ ID NO: 889907 - DNA, 25 bp, Mus musculus
tgggcacatgcccacatctgaaaag

SEQ ID NO: 889908 - DNA, 25 bp, Mus musculus
tgggcacatgccgacatctgaaaag

SEQ ID NO: 889909 - DNA, 25 bp, Mus musculus
tgggcacatgtcacaggcaaacatt

SEQ ID NO: 889910 - DNA, 25 bp, Mus musculus
tgggcacatgtctcaggcaaacatt

SEQ ID NO: 889911 - DNA, 25 bp, Mus musculus
tgggcaccaaagcaaggacctagct

SEQ ID NO: 889912 - DNA, 25 bp, Mus musculus
tgggcaccaaaggaaggacctagct

SEQ ID NO: 889913 - DNA, 25 bp, Mus musculus
tgggcaccaaatatccatacaattt

SEQ ID NO: 889914 - DNA, 25 bp, Mus musculus
tgggcaccaaatttccatacaattt

SEQ ID NO: 889915 - DNA, 25 bp, Mus musculus
tgggcaccaagtccattttgctgag

SEQ ID NO: 889916 - DNA, 25 bp, Mus musculus
tgggcaccaagtgcattttgctgag

SEQ ID NO: 889917 - DNA, 25 bp, Mus musculus
tgggcaccacaacaatacctgtctg

SEQ ID NO: 889918 - DNA, 25 bp, Mus musculus
tgggcaccacaagaatacctgtctg

SEQ ID NO: 889919 - DNA, 25 bp, Mus musculus
tgggcaccaccaacatggctatcgg

SEQ ID NO: 889920 - DNA, 25 bp, Mus musculus
tgggcaccaccatcatggctatcgg

SEQ ID NO: 889921 - DNA, 25 bp, Mus musculus
tgggcaccacctatagtcaccaaat

SEQ ID NO: 889922 - DNA, 25 bp, Mus musculus
tgggcaccacctttagtcaccaaat

SEQ ID NO: 889923 - DNA, 25 bp, Mus musculus
tgggcaccagcacggctgactgcca

SEQ ID NO: 889924 - DNA, 25 bp, Mus musculus
tgggcaccagcagggctgactgcca

SEQ ID NO: 889925 - DNA, 25 bp, Mus musculus
tgggcaccatcaatctctggtcaaa

SEQ ID NO: 889926 - DNA, 25 bp, Mus musculus
tgggcaccatcattctctggtcaaa

SEQ ID NO: 889927 - DNA, 25 bp, Mus musculus
tgggcaccatgcatcaagaaggctt

SEQ ID NO: 889928 - DNA, 25 bp, Mus musculus
tgggcaccatgcatgcctggtgata

SEQ ID NO: 889929 - DNA, 25 bp, Mus musculus
tgggcaccatgcttcaagaaggctt

SEQ ID NO: 889930 - DNA, 25 bp, Mus musculus
tgggcaccatgcttgcctggtgata

SEQ ID NO: 889931 - DNA, 25 bp, Mus musculus
tgggcaccattaaggctacacagct

SEQ ID NO: 889932 - DNA, 25 bp, Mus musculus
tgggcaccattatggctacacagct

SEQ ID NO: 889933 - DNA, 25 bp, Mus musculus
tgggcacccaagctaactttctaag

SEQ ID NO: 889934 - DNA, 25 bp, Mus musculus
tgggcacccaaggtaactttctaag

SEQ ID NO: 889935 - DNA, 25 bp, Mus musculus
tgggcacccactcgctcagaatgaa

SEQ ID NO: 889936 - DNA, 25 bp, Mus musculus
tgggcacccactggctcagaatgaa

SEQ ID NO: 889937 - DNA, 25 bp, Mus musculus
tgggcacccctaagagtgaaccatg

SEQ ID NO: 889938 - DNA, 25 bp, Mus musculus
tgggcacccctatgagtgaaccatg

SEQ ID NO: 889939 - DNA, 25 bp, Mus musculus
tgggcaccctataaaggagatgtgt

SEQ ID NO: 889940 - DNA, 25 bp, Mus musculus
tgggcaccctattaaggagatgtgt

SEQ ID NO: 889941 - DNA, 25 bp, Mus musculus
tgggcaccctctcagaaaaagcaca

SEQ ID NO: 889942 - DNA, 25 bp, Mus musculus
tgggcaccctctgagaaaaagcaca

SEQ ID NO: 889943 - DNA, 25 bp, Mus musculus
tgggcaccctttagcagcatgaaga

SEQ ID NO: 889944 - DNA, 25 bp, Mus musculus
tgggcaccctttcccataaagcctt

SEQ ID NO: 889945 - DNA, 25 bp, Mus musculus
tgggcaccctttgccataaagcctt

SEQ ID NO: 889946 - DNA, 25 bp, Mus musculus
tgggcacccttttgcagcatgaaga

SEQ ID NO: 889947 - DNA, 25 bp, Mus musculus
tgggcaccgtgcacatgatcacagg

SEQ ID NO: 889948 - DNA, 25 bp, Mus musculus
tgggcaccgtgctcatgatcacagg

SEQ ID NO: 889949 - DNA, 25 bp, Mus musculus
tgggcacctacccagatgaacactt

SEQ ID NO: 889950 - DNA, 25 bp, Mus musculus
tgggcacctaccgagatgaacactt

SEQ ID NO: 889951 - DNA, 25 bp, Mus musculus
tgggcacctcacatggacattagat

SEQ ID NO: 889952 - DNA, 25 bp, Mus musculus
tgggcacctcacttggacattagat

SEQ ID NO: 889953 - DNA, 25 bp, Mus musculus
tgggcacctgggattcttctaaaac

SEQ ID NO: 889954 - DNA, 25 bp, Mus musculus
tgggcacctgggtttcttctaaaac

SEQ ID NO: 889955 - DNA, 25 bp, Mus musculus
tgggcacctggtagtatggaaccct

SEQ ID NO: 889956 - DNA, 25 bp, Mus musculus
tgggcacctggttgtatggaaccct

SEQ ID NO: 889957 - DNA, 25 bp, Mus musculus
tgggcacctgtaccagctcaccaag

SEQ ID NO: 889958 - DNA, 25 bp, Mus musculus
tgggcacctgtagcagctcaccaag

SEQ ID NO: 889959 - DNA, 25 bp, Mus musculus
tgggcacctgtgatagcactctagt

SEQ ID NO: 889960 - DNA, 25 bp, Mus musculus
tgggcacctgtgttagcactctagt

SEQ ID NO: 889961 - DNA, 25 bp, Mus musculus
tgggcaccttccagtgagtggtaat

SEQ ID NO: 889962 - DNA, 25 bp, Mus musculus
tgggcaccttccatgtatgactcca

SEQ ID NO: 889963 - DNA, 25 bp, Mus musculus
tgggcaccttcctgtgagtggtaat

SEQ ID NO: 889964 - DNA, 25 bp, Mus musculus
tgggcaccttccttgtatgactcca

SEQ ID NO: 889965 - DNA, 25 bp, Mus musculus
tgggcaccttgtctgtgacctaatc

SEQ ID NO: 889966 - DNA, 25 bp, Mus musculus
tgggcaccttgtgtgtgacctaatc

SEQ ID NO: 889967 - DNA, 25 bp, Mus musculus
tgggcacctttcatcagtgtccaga

SEQ ID NO: 889968 - DNA, 25 bp, Mus musculus
tgggcacctttcttcagtgtccaga

SEQ ID NO: 889969 - DNA, 25 bp, Mus musculus
tgggcaccttttcaggaccatgagc

SEQ ID NO: 889970 - DNA, 25 bp, Mus musculus
tgggcaccttttgaggaccatgagc

SEQ ID NO: 889971 - DNA, 25 bp, Mus musculus
tgggcacgccttattctacgcaggg

SEQ ID NO: 889972 - DNA, 25 bp, Mus musculus
tgggcacgcctttttctacgcaggg

SEQ ID NO: 889973 - DNA, 25 bp, Mus musculus
tgggcacggcgtaggctttaactct

SEQ ID NO: 889974 - DNA, 25 bp, Mus musculus
tgggcacggcgttggctttaactct

SEQ ID NO: 889975 - DNA, 25 bp, Mus musculus
tgggcacggctaccaccagcaataa

SEQ ID NO: 889976 - DNA, 25 bp, Mus musculus
tgggcacggctagcaccagcaataa

SEQ ID NO: 889977 - DNA, 25 bp, Mus musculus
tgggcacgggtgagctgactcacca

SEQ ID NO: 889978 - DNA, 25 bp, Mus musculus
tgggcacgggtgtgctgactcacca

SEQ ID NO: 889979 - DNA, 25 bp, Mus musculus
tgggcacgtacacacaagacctcaa

SEQ ID NO: 889980 - DNA, 25 bp, Mus musculus
tgggcacgtacagacaagacctcaa

SEQ ID NO: 889981 - DNA, 25 bp, Mus musculus
tgggcacgtcatcagcaactaggga

SEQ ID NO: 889982 - DNA, 25 bp, Mus musculus
tgggcacgtcatgagcaactaggga

SEQ ID NO: 889983 - DNA, 25 bp, Mus musculus
tgggcacgtgtcataatcaaagttt

SEQ ID NO: 889984 - DNA, 25 bp, Mus musculus
tgggcacgtgtcttaatcaaagttt

SEQ ID NO: 889985 - DNA, 25 bp, Mus musculus
tgggcactagcaagctctcaggagt

SEQ ID NO: 889986 - DNA, 25 bp, Mus musculus
tgggcactagcaatatacataacag

SEQ ID NO: 889987 - DNA, 25 bp, Mus musculus
tgggcactagcatgctctcaggagt

SEQ ID NO: 889988 - DNA, 25 bp, Mus musculus
tgggcactagcattatacataacag

SEQ ID NO: 889989 - DNA, 25 bp, Mus musculus
tgggcactcagtactatccaaccag

SEQ ID NO: 889990 - DNA, 25 bp, Mus musculus
tgggcactcagttctatccaaccag

SEQ ID NO: 889991 - DNA, 25 bp, Mus musculus
tgggcactcataaacagcacatagc

SEQ ID NO: 889992 - DNA, 25 bp, Mus musculus
tgggcactcatatacagcacatagc

SEQ ID NO: 889993 - DNA, 25 bp, Mus musculus
tgggcactccagctgttcatgaaca

SEQ ID NO: 889994 - DNA, 25 bp, Mus musculus
tgggcactccaggtgttcatgaaca

SEQ ID NO: 889995 - DNA, 25 bp, Mus musculus
tgggcactctttcgaggtgtccaca

SEQ ID NO: 889996 - DNA, 25 bp, Mus musculus
tgggcactctttggaggtgtccaca

SEQ ID NO: 889997 - DNA, 25 bp, Mus musculus
tgggcactgatgatgcacgccttta

SEQ ID NO: 889998 - DNA, 25 bp, Mus musculus
tgggcactgatgttgcacgccttta

SEQ ID NO: 889999 - DNA, 25 bp, Mus musculus
tgggcactgcacacgtgtacatatg

SEQ ID NO: 890000 - DNA, 25 bp, Mus musculus
tgggcactgcactcgtgtacatatg

SEQ ID NO: 890001 - DNA, 25 bp, Mus musculus
tgggcactgtatcctcagaggatgc

SEQ ID NO: 890002 - DNA, 25 bp, Mus musculus
tgggcactgtatgctcagaggatgc

SEQ ID NO: 890003 - DNA, 25 bp, Mus musculus
tgggcacttattcctgttctttggc

SEQ ID NO: 890004 - DNA, 25 bp, Mus musculus
tgggcacttattgctgttctttggc

SEQ ID NO: 890005 - DNA, 25 bp, Mus musculus
tgggcacttcctaccatgagctgct

SEQ ID NO: 890006 - DNA, 25 bp, Mus musculus
tgggcacttcctcctccaaacaatg

SEQ ID NO: 890007 - DNA, 25 bp, Mus musculus
tgggcacttcctcgctaacagcagt

SEQ ID NO: 890008 - DNA, 25 bp, Mus musculus
tgggcacttcctgctccaaacaatg

SEQ ID NO: 890009 - DNA, 25 bp, Mus musculus
tgggcacttcctggctaacagcagt

SEQ ID NO: 890010 - DNA, 25 bp, Mus musculus
tgggcacttccttccatgagctgct

SEQ ID NO: 890011 - DNA, 25 bp, Mus musculus
tgggcacttctaagactacctgcta

SEQ ID NO: 890012 - DNA, 25 bp, Mus musculus
tgggcacttctatgactacctgcta

SEQ ID NO: 890013 - DNA, 25 bp, Mus musculus
tgggcacttggtcagaccctttctc

SEQ ID NO: 890014 - DNA, 25 bp, Mus musculus
tgggcacttggtgagaccctttctc

SEQ ID NO: 890015 - DNA, 25 bp, Mus musculus
tgggcacttgtgacaatgagatcat

SEQ ID NO: 890016 - DNA, 25 bp, Mus musculus
tgggcacttgtgtcaatgagatcat

SEQ ID NO: 890017 - DNA, 25 bp, Mus musculus
tgggcacttttccaggccaggagaa

SEQ ID NO: 890018 - DNA, 25 bp, Mus musculus
tgggcacttttcgaggccaggagaa

SEQ ID NO: 890019 - DNA, 25 bp, Mus musculus
tgggcagaaattcgcaccgaccctg

SEQ ID NO: 890020 - DNA, 25 bp, Mus musculus
tgggcagaaattggcaccgaccctg

SEQ ID NO: 890021 - DNA, 25 bp, Mus musculus
tgggcagaagggataccaccaccgt

SEQ ID NO: 890022 - DNA, 25 bp, Mus musculus
tgggcagaagggttaccaccaccgt

SEQ ID NO: 890023 - DNA, 25 bp, Mus musculus
tgggcagacagcatgttctctgggt

SEQ ID NO: 890024 - DNA, 25 bp, Mus musculus
tgggcagacagcttgttctctgggt

SEQ ID NO: 890025 - DNA, 25 bp, Mus musculus
tgggcagaccccagttccagaagca

SEQ ID NO: 890026 - DNA, 25 bp, Mus musculus
tgggcagacccctgttccagaagca

SEQ ID NO: 890027 - DNA, 25 bp, Mus musculus
tgggcagacggaacccacgacagta

SEQ ID NO: 890028 - DNA, 25 bp, Mus musculus
tgggcagacggatcccacgacagta

SEQ ID NO: 890029 - DNA, 25 bp, Mus musculus
tgggcagactctctgcatttagatc

SEQ ID NO: 890030 - DNA, 25 bp, Mus musculus
tgggcagactctgtgcatttagatc

SEQ ID NO: 890031 - DNA, 25 bp, Mus musculus
tgggcagaggtcaccttattcctat

SEQ ID NO: 890032 - DNA, 25 bp, Mus musculus
tgggcagaggtctccttattcctat

SEQ ID NO: 890033 - DNA, 25 bp, Mus musculus
tgggcagcaccaacacgtggagaca

SEQ ID NO: 890034 - DNA, 25 bp, Mus musculus
tgggcagcaccactagccaagtgga

SEQ ID NO: 890035 - DNA, 25 bp, Mus musculus
tgggcagcaccagtagccaagtgga

SEQ ID NO: 890036 - DNA, 25 bp, Mus musculus
tgggcagcaccatcacgtggagaca

SEQ ID NO: 890037 - DNA, 25 bp, Mus musculus
tgggcagcacctaggagaccaagca

SEQ ID NO: 890038 - DNA, 25 bp, Mus musculus
tgggcagcaccttggagaccaagca

SEQ ID NO: 890039 - DNA, 25 bp, Mus musculus
tgggcagcacttcatgggtcctcag

SEQ ID NO: 890040 - DNA, 25 bp, Mus musculus
tgggcagcacttgatgggtcctcag

SEQ ID NO: 890041 - DNA, 25 bp, Mus musculus
tgggcagcagcaccgacgatgactc

SEQ ID NO: 890042 - DNA, 25 bp, Mus musculus
tgggcagcagcagcgacgatgactc

SEQ ID NO: 890043 - DNA, 25 bp, Mus musculus
tgggcagcagctctccagctacaga

SEQ ID NO: 890044 - DNA, 25 bp, Mus musculus
tgggcagcagctgtccagctacaga

SEQ ID NO: 890045 - DNA, 25 bp, Mus musculus
tgggcagcaggacacttggcttcaa

SEQ ID NO: 890046 - DNA, 25 bp, Mus musculus
tgggcagcaggacggcacctatcat

SEQ ID NO: 890047 - DNA, 25 bp, Mus musculus
tgggcagcaggagacttggcttcaa

SEQ ID NO: 890048 - DNA, 25 bp, Mus musculus
tgggcagcaggagggcacctatcat

SEQ ID NO: 890049 - DNA, 25 bp, Mus musculus
tgggcagcatccaaggcaacctaaa

SEQ ID NO: 890050 - DNA, 25 bp, Mus musculus
tgggcagcatcctaggcaacctaaa

SEQ ID NO: 890051 - DNA, 25 bp, Mus musculus
tgggcagcatggatatactccagct

SEQ ID NO: 890052 - DNA, 25 bp, Mus musculus
tgggcagcatggttatactccagct

SEQ ID NO: 890053 - DNA, 25 bp, Mus musculus
tgggcagccatgaagccagagtcta

SEQ ID NO: 890054 - DNA, 25 bp, Mus musculus
tgggcagccatgtagccagagtcta

SEQ ID NO: 890055 - DNA, 25 bp, Mus musculus
tgggcagcccataactgcattcatg

SEQ ID NO: 890056 - DNA, 25 bp, Mus musculus
tgggcagcccattactgcattcatg

SEQ ID NO: 890057 - DNA, 25 bp, Mus musculus
tgggcagccctacacgagcagatgc

SEQ ID NO: 890058 - DNA, 25 bp, Mus musculus
tgggcagccctagacgagcagatgc

SEQ ID NO: 890059 - DNA, 25 bp, Mus musculus
tgggcagccgctattcgtgcttggt

SEQ ID NO: 890060 - DNA, 25 bp, Mus musculus
tgggcagccgcttttcgtgcttggt

SEQ ID NO: 890061 - DNA, 25 bp, Mus musculus
tgggcagcctggacgcacacactgt

SEQ ID NO: 890062 - DNA, 25 bp, Mus musculus
tgggcagcctggtcgcacacactgt

SEQ ID NO: 890063 - DNA, 25 bp, Mus musculus
tgggcagccttgaggcataccagga

SEQ ID NO: 890064 - DNA, 25 bp, Mus musculus
tgggcagccttgtggcataccagga

SEQ ID NO: 890065 - DNA, 25 bp, Mus musculus
tgggcagcgtctcttctggaagcac

SEQ ID NO: 890066 - DNA, 25 bp, Mus musculus
tgggcagcgtctgttctggaagcac

SEQ ID NO: 890067 - DNA, 25 bp, Mus musculus
tgggcagctatccttgcccatggat

SEQ ID NO: 890068 - DNA, 25 bp, Mus musculus
tgggcagctatcgttgcccatggat

SEQ ID NO: 890069 - DNA, 25 bp, Mus musculus
tgggcagctcaaaccggttctggat

SEQ ID NO: 890070 - DNA, 25 bp, Mus musculus
tgggcagctcaatccggttctggat

SEQ ID NO: 890071 - DNA, 25 bp, Mus musculus
tgggcagctccccactacacagatg

SEQ ID NO: 890072 - DNA, 25 bp, Mus musculus
tgggcagctcccgactacacagatg

SEQ ID NO: 890073 - DNA, 25 bp, Mus musculus
tgggcagctgccaccttaggtgtta

SEQ ID NO: 890074 - DNA, 25 bp, Mus musculus
tgggcagctgccagtgactggccaa

SEQ ID NO: 890075 - DNA, 25 bp, Mus musculus
tgggcagctgcctccttaggtgtta

SEQ ID NO: 890076 - DNA, 25 bp, Mus musculus
tgggcagctgcctgtgactggccaa

SEQ ID NO: 890077 - DNA, 25 bp, Mus musculus
tgggcagctgctcccttagtatgca

SEQ ID NO: 890078 - DNA, 25 bp, Mus musculus
tgggcagctgctgccttagtatgca

SEQ ID NO: 890079 - DNA, 25 bp, Mus musculus
tgggcaggaaaaccagacctcacct

SEQ ID NO: 890080 - DNA, 25 bp, Mus musculus
tgggcaggaaaagcagacctcacct

SEQ ID NO: 890081 - DNA, 25 bp, Mus musculus
tgggcaggacccacaaagagaagac

SEQ ID NO: 890082 - DNA, 25 bp, Mus musculus
tgggcaggaccctcaaagagaagac

SEQ ID NO: 890083 - DNA, 25 bp, Mus musculus
tgggcaggagaaaggatcaaactac

SEQ ID NO: 890084 - DNA, 25 bp, Mus musculus
tgggcaggagaatggatcaaactac

SEQ ID NO: 890085 - DNA, 25 bp, Mus musculus
tgggcaggagcacacacctctaaag

SEQ ID NO: 890086 - DNA, 25 bp, Mus musculus
tgggcaggagcagacacctctaaag

SEQ ID NO: 890087 - DNA, 25 bp, Mus musculus
tgggcaggaggcaaaacgacgttct

SEQ ID NO: 890088 - DNA, 25 bp, Mus musculus
tgggcaggaggctaaacgacgttct

SEQ ID NO: 890089 - DNA, 25 bp, Mus musculus
tgggcaggaggtactgggcctcatc

SEQ ID NO: 890090 - DNA, 25 bp, Mus musculus
tgggcaggaggttctgggcctcatc

SEQ ID NO: 890091 - DNA, 25 bp, Mus musculus
tgggcaggcagcacagtcactctga

SEQ ID NO: 890092 - DNA, 25 bp, Mus musculus
tgggcaggcagctcagtcactctga

SEQ ID NO: 890093 - DNA, 25 bp, Mus musculus
tgggcaggctgcaggttgtctaccc

SEQ ID NO: 890094 - DNA, 25 bp, Mus musculus
tgggcaggctgctggttgtctaccc

SEQ ID NO: 890095 - DNA, 25 bp, Mus musculus
tgggcagggctcagcgctacttaaa

SEQ ID NO: 890096 - DNA, 25 bp, Mus musculus
tgggcagggctctgcgctacttaaa

SEQ ID NO: 890097 - DNA, 25 bp, Mus musculus
tgggcagggcttctacagctgtcta

SEQ ID NO: 890098 - DNA, 25 bp, Mus musculus
tgggcagggcttgtacagctgtcta

SEQ ID NO: 890099 - DNA, 25 bp, Mus musculus
tgggcaggttaaaagtgagcactaa

SEQ ID NO: 890100 - DNA, 25 bp, Mus musculus
tgggcaggttaatagtgagcactaa

SEQ ID NO: 890101 - DNA, 25 bp, Mus musculus
tgggcaggttcaacgccgaaggcac

SEQ ID NO: 890102 - DNA, 25 bp, Mus musculus
tgggcaggttcatcgccgaaggcac

SEQ ID NO: 890103 - DNA, 25 bp, Mus musculus
tgggcaggttccataacctttctag

SEQ ID NO: 890104 - DNA, 25 bp, Mus musculus
tgggcaggttccttaacctttctag

SEQ ID NO: 890105 - DNA, 25 bp, Mus musculus
tgggcagtaattagattcaactctt

SEQ ID NO: 890106 - DNA, 25 bp, Mus musculus
tgggcagtaatttgattcaactctt

SEQ ID NO: 890107 - DNA, 25 bp, Mus musculus
tgggcagtacccagtcaggttacca

SEQ ID NO: 890108 - DNA, 25 bp, Mus musculus
tgggcagtaccctgtcaggttacca

SEQ ID NO: 890109 - DNA, 25 bp, Mus musculus
tgggcagtaccgcataaggaccttt

SEQ ID NO: 890110 - DNA, 25 bp, Mus musculus
tgggcagtaccggataaggaccttt

SEQ ID NO: 890111 - DNA, 25 bp, Mus musculus
tgggcagtagccaagcaatgctctg

SEQ ID NO: 890112 - DNA, 25 bp, Mus musculus
tgggcagtagcctagcaatgctctg

SEQ ID NO: 890113 - DNA, 25 bp, Mus musculus
tgggcagtcattataaatctctgtt

SEQ ID NO: 890114 - DNA, 25 bp, Mus musculus
tgggcagtcattttaaatctctgtt

SEQ ID NO: 890115 - DNA, 25 bp, Mus musculus
tgggcagtctctaaaacctcatgat

SEQ ID NO: 890116 - DNA, 25 bp, Mus musculus
tgggcagtctctaattccttgctac

SEQ ID NO: 890117 - DNA, 25 bp, Mus musculus
tgggcagtctcttaaacctcatgat

SEQ ID NO: 890118 - DNA, 25 bp, Mus musculus
tgggcagtctcttattccttgctac

SEQ ID NO: 890119 - DNA, 25 bp, Mus musculus
tgggcagtctgtcccacgtctgcag

SEQ ID NO: 890120 - DNA, 25 bp, Mus musculus
tgggcagtctgtgccacgtctgcag

SEQ ID NO: 890121 - DNA, 25 bp, Mus musculus
tgggcagtgatgaagcctgtagcct

SEQ ID NO: 890122 - DNA, 25 bp, Mus musculus
tgggcagtgatgtagcctgtagcct

SEQ ID NO: 890123 - DNA, 25 bp, Mus musculus
tgggcagtgcctagttggtcaaaac

SEQ ID NO: 890124 - DNA, 25 bp, Mus musculus
tgggcagtgcctcgacccctttaca

SEQ ID NO: 890125 - DNA, 25 bp, Mus musculus
tgggcagtgcctggacccctttaca

SEQ ID NO: 890126 - DNA, 25 bp, Mus musculus
tgggcagtgccttgttggtcaaaac

SEQ ID NO: 890127 - DNA, 25 bp, Mus musculus
tgggcagtggtacccacagacacat

SEQ ID NO: 890128 - DNA, 25 bp, Mus musculus
tgggcagtggtagccacagacacat

SEQ ID NO: 890129 - DNA, 25 bp, Mus musculus
tgggcagtggtcagttcaccctgag

SEQ ID NO: 890130 - DNA, 25 bp, Mus musculus
tgggcagtggtctgttcaccctgag

SEQ ID NO: 890131 - DNA, 25 bp, Mus musculus
tgggcagtgtcacatgggagggcat

SEQ ID NO: 890132 - DNA, 25 bp, Mus musculus
tgggcagtgtcacgtccacaaagat

SEQ ID NO: 890133 - DNA, 25 bp, Mus musculus
tgggcagtgtcagatgggagggcat

SEQ ID NO: 890134 - DNA, 25 bp, Mus musculus
tgggcagtgtcaggtccacaaagat

SEQ ID NO: 890135 - DNA, 25 bp, Mus musculus
tgggcagtgtcgagtcagtcactat

SEQ ID NO: 890136 - DNA, 25 bp, Mus musculus
tgggcagtgtcgtgtcagtcactat

SEQ ID NO: 890137 - DNA, 25 bp, Mus musculus
tgggcagttactctttcacctgtat

SEQ ID NO: 890138 - DNA, 25 bp, Mus musculus
tgggcagttactgtttcacctgtat

SEQ ID NO: 890139 - DNA, 25 bp, Mus musculus
tgggcagttctgagtactctaaaat

SEQ ID NO: 890140 - DNA, 25 bp, Mus musculus
tgggcagttctgtgtactctaaaat

SEQ ID NO: 890141 - DNA, 25 bp, Mus musculus
tgggcagtttcacctcctcatcggc

SEQ ID NO: 890142 - DNA, 25 bp, Mus musculus
tgggcagtttcagctcctcatcggc

SEQ ID NO: 890143 - DNA, 25 bp, Mus musculus
tgggcagtttgcacttcttggttac

SEQ ID NO: 890144 - DNA, 25 bp, Mus musculus
tgggcagtttgctcttcttggttac

SEQ ID NO: 890145 - DNA, 25 bp, Mus musculus
tgggcataaagtccatgtgggactc

SEQ ID NO: 890146 - DNA, 25 bp, Mus musculus
tgggcataaagtgcatgtgggactc

SEQ ID NO: 890147 - DNA, 25 bp, Mus musculus
tgggcataagcaaacagccagctgt

SEQ ID NO: 890148 - DNA, 25 bp, Mus musculus
tgggcataagcatacagccagctgt

SEQ ID NO: 890149 - DNA, 25 bp, Mus musculus
tgggcataatttccgagtttactac

SEQ ID NO: 890150 - DNA, 25 bp, Mus musculus
tgggcataatttgcgagtttactac

SEQ ID NO: 890151 - DNA, 25 bp, Mus musculus
tgggcataccacaacagtccttaat

SEQ ID NO: 890152 - DNA, 25 bp, Mus musculus
tgggcataccactacagtccttaat

SEQ ID NO: 890153 - DNA, 25 bp, Mus musculus
tgggcatactatcctagaagcagat

SEQ ID NO: 890154 - DNA, 25 bp, Mus musculus
tgggcatactatgctagaagcagat

SEQ ID NO: 890155 - DNA, 25 bp, Mus musculus
tgggcatacttactctgtctcagaa

SEQ ID NO: 890156 - DNA, 25 bp, Mus musculus
tgggcatacttagtctgtctcagaa

SEQ ID NO: 890157 - DNA, 25 bp, Mus musculus
tgggcatagcagacaacgtttttaa

SEQ ID NO: 890158 - DNA, 25 bp, Mus musculus
tgggcatagcagtcaacgtttttaa

SEQ ID NO: 890159 - DNA, 25 bp, Mus musculus
tgggcatatcccacattccttccag

SEQ ID NO: 890160 - DNA, 25 bp, Mus musculus
tgggcatatccctcattccttccag

SEQ ID NO: 890161 - DNA, 25 bp, Mus musculus
tgggcatatcctatctttgagtcat

SEQ ID NO: 890162 - DNA, 25 bp, Mus musculus
tgggcatatcctttctttgagtcat

SEQ ID NO: 890163 - DNA, 25 bp, Mus musculus
tgggcatcaaaacccacctggagaa

SEQ ID NO: 890164 - DNA, 25 bp, Mus musculus
tgggcatcaaaagccacctggagaa

SEQ ID NO: 890165 - DNA, 25 bp, Mus musculus
tgggcatcaatgcagacttgtcccc

SEQ ID NO: 890166 - DNA, 25 bp, Mus musculus
tgggcatcaatggagacttgtcccc

SEQ ID NO: 890167 - DNA, 25 bp, Mus musculus
tgggcatcagacactttgacccttc

SEQ ID NO: 890168 - DNA, 25 bp, Mus musculus
tgggcatcagactctttgacccttc

SEQ ID NO: 890169 - DNA, 25 bp, Mus musculus
tgggcatcagtacttgagtcatcct

SEQ ID NO: 890170 - DNA, 25 bp, Mus musculus
tgggcatcagtagttgagtcatcct

SEQ ID NO: 890171 - DNA, 25 bp, Mus musculus
tgggcatcagtcctgacctgcttcc

SEQ ID NO: 890172 - DNA, 25 bp, Mus musculus
tgggcatcagtcgtgacctgcttcc

SEQ ID NO: 890173 - DNA, 25 bp, Mus musculus
tgggcatcatcaatactgctaccac

SEQ ID NO: 890174 - DNA, 25 bp, Mus musculus
tgggcatcatcattactgctaccac

SEQ ID NO: 890175 - DNA, 25 bp, Mus musculus
tgggcatcatgcacagtctgcacac

SEQ ID NO: 890176 - DNA, 25 bp, Mus musculus
tgggcatcatgcacttcatcacaga

SEQ ID NO: 890177 - DNA, 25 bp, Mus musculus
tgggcatcatgctcagtctgcacac

SEQ ID NO: 890178 - DNA, 25 bp, Mus musculus
tgggcatcatgctcttcatcacaga

SEQ ID NO: 890179 - DNA, 25 bp, Mus musculus
tgggcatcattcctgggtttcagaa

SEQ ID NO: 890180 - DNA, 25 bp, Mus musculus
tgggcatcattcgtgggtttcagaa

SEQ ID NO: 890181 - DNA, 25 bp, Mus musculus
tgggcatccacccggcacactggag

SEQ ID NO: 890182 - DNA, 25 bp, Mus musculus
tgggcatccaccgggcacactggag

SEQ ID NO: 890183 - DNA, 25 bp, Mus musculus
tgggcatccctccaggtgtacaaag

SEQ ID NO: 890184 - DNA, 25 bp, Mus musculus
tgggcatccctcgaggtgtacaaag

SEQ ID NO: 890185 - DNA, 25 bp, Mus musculus
tgggcatcctagcaagacccttgtc

SEQ ID NO: 890186 - DNA, 25 bp, Mus musculus
tgggcatcctaggaagacccttgtc

SEQ ID NO: 890187 - DNA, 25 bp, Mus musculus
tgggcatcgaacacatgttccccat

SEQ ID NO: 890188 - DNA, 25 bp, Mus musculus
tgggcatcgaactcatgttccccat

SEQ ID NO: 890189 - DNA, 25 bp, Mus musculus
tgggcatcggacctgcctatgccat

SEQ ID NO: 890190 - DNA, 25 bp, Mus musculus
tgggcatcggacgtgcctatgccat

SEQ ID NO: 890191 - DNA, 25 bp, Mus musculus
tgggcatcggcaacttcattttcat

SEQ ID NO: 890192 - DNA, 25 bp, Mus musculus
tgggcatcggcatcttcattttcat

SEQ ID NO: 890193 - DNA, 25 bp, Mus musculus
tgggcatcggttaccatctgcagat

SEQ ID NO: 890194 - DNA, 25 bp, Mus musculus
tgggcatcggtttccatctgcagat

SEQ ID NO: 890195 - DNA, 25 bp, Mus musculus
tgggcatctctgaccttagtacctt

SEQ ID NO: 890196 - DNA, 25 bp, Mus musculus
tgggcatctctgctgcaagtggaca

SEQ ID NO: 890197 - DNA, 25 bp, Mus musculus
tgggcatctctggtgcaagtggaca

SEQ ID NO: 890198 - DNA, 25 bp, Mus musculus
tgggcatctctgtccttagtacctt

SEQ ID NO: 890199 - DNA, 25 bp, Mus musculus
tgggcatcttcaacttcaacattgt

SEQ ID NO: 890200 - DNA, 25 bp, Mus musculus
tgggcatcttcatcttcaacattgt

SEQ ID NO: 890201 - DNA, 25 bp, Mus musculus
tgggcatctttcctttccagcagtg

SEQ ID NO: 890202 - DNA, 25 bp, Mus musculus
tgggcatctttcgtttccagcagtg

SEQ ID NO: 890203 - DNA, 25 bp, Mus musculus
tgggcatgacccaaagttacctctt

SEQ ID NO: 890204 - DNA, 25 bp, Mus musculus
tgggcatgacccatgcagtcagaaa

SEQ ID NO: 890205 - DNA, 25 bp, Mus musculus
tgggcatgaccctaagttacctctt

SEQ ID NO: 890206 - DNA, 25 bp, Mus musculus
tgggcatgacccttgcagtcagaaa

SEQ ID NO: 890207 - DNA, 25 bp, Mus musculus
tgggcatgacctcgtaggagcctct

SEQ ID NO: 890208 - DNA, 25 bp, Mus musculus
tgggcatgacctggtaggagcctct

SEQ ID NO: 890209 - DNA, 25 bp, Mus musculus
tgggcatgatacaatctaatcattg

SEQ ID NO: 890210 - DNA, 25 bp, Mus musculus
tgggcatgatactatctaatcattg

SEQ ID NO: 890211 - DNA, 25 bp, Mus musculus
tgggcatgatctccagtgcttgcaa

SEQ ID NO: 890212 - DNA, 25 bp, Mus musculus
tgggcatgatctgcagtgcttgcaa

SEQ ID NO: 890213 - DNA, 25 bp, Mus musculus
tgggcatgatgcagttcaacgacat

SEQ ID NO: 890214 - DNA, 25 bp, Mus musculus
tgggcatgatgctgttcaacgacat

SEQ ID NO: 890215 - DNA, 25 bp, Mus musculus
tgggcatgatttagggccggccact

SEQ ID NO: 890216 - DNA, 25 bp, Mus musculus
tgggcatgattttgggccggccact

SEQ ID NO: 890217 - DNA, 25 bp, Mus musculus
tgggcatgcagcaaaccaggaagaa

SEQ ID NO: 890218 - DNA, 25 bp, Mus musculus
tgggcatgcagctaaccaggaagaa

SEQ ID NO: 890219 - DNA, 25 bp, Mus musculus
tgggcatgccccagagcgaaccagg

SEQ ID NO: 890220 - DNA, 25 bp, Mus musculus
tgggcatgcccctgagcgaaccagg

SEQ ID NO: 890221 - DNA, 25 bp, Mus musculus
tgggcatgctctccagttcatgtta

SEQ ID NO: 890222 - DNA, 25 bp, Mus musculus
tgggcatgctctgcagttcatgtta

SEQ ID NO: 890223 - DNA, 25 bp, Mus musculus
tgggcatgcttcagatccactacta

SEQ ID NO: 890224 - DNA, 25 bp, Mus musculus
tgggcatgcttctgatccactacta

SEQ ID NO: 890225 - DNA, 25 bp, Mus musculus
tgggcatggaggacactactttcaa

SEQ ID NO: 890226 - DNA, 25 bp, Mus musculus
tgggcatggaggtcactactttcaa

SEQ ID NO: 890227 - DNA, 25 bp, Mus musculus
tgggcatggcctaatctggttgatg

SEQ ID NO: 890228 - DNA, 25 bp, Mus musculus
tgggcatggccttatctggttgatg

SEQ ID NO: 890229 - DNA, 25 bp, Mus musculus
tgggcatgggagaggcccctttaac

SEQ ID NO: 890230 - DNA, 25 bp, Mus musculus
tgggcatgggagtggcccctttaac

SEQ ID NO: 890231 - DNA, 25 bp, Mus musculus
tgggcatgggcaaggtaccagcctc

SEQ ID NO: 890232 - DNA, 25 bp, Mus musculus
tgggcatgggcatggtaccagcctc

SEQ ID NO: 890233 - DNA, 25 bp, Mus musculus
tgggcatggtgacacacacccaatc

SEQ ID NO: 890234 - DNA, 25 bp, Mus musculus
tgggcatggtgagacacacccaatc

SEQ ID NO: 890235 - DNA, 25 bp, Mus musculus
tgggcatggtgccacaagccttgaa

SEQ ID NO: 890236 - DNA, 25 bp, Mus musculus
tgggcatggtgcgacaagccttgaa

SEQ ID NO: 890237 - DNA, 25 bp, Mus musculus
tgggcatggttgaacaccctcttaa

SEQ ID NO: 890238 - DNA, 25 bp, Mus musculus
tgggcatggttgtacaccctcttaa

SEQ ID NO: 890239 - DNA, 25 bp, Mus musculus
tgggcatgtctcagtcatctttcaa

SEQ ID NO: 890240 - DNA, 25 bp, Mus musculus
tgggcatgtctctgtcatctttcaa

SEQ ID NO: 890241 - DNA, 25 bp, Mus musculus
tgggcatgtgttatcctgtgagccc

SEQ ID NO: 890242 - DNA, 25 bp, Mus musculus
tgggcatgtgttttcctgtgagccc

SEQ ID NO: 890243 - DNA, 25 bp, Mus musculus
tgggcatgttcaccctgcaataaaa

SEQ ID NO: 890244 - DNA, 25 bp, Mus musculus
tgggcatgttcagcctgcaataaaa

SEQ ID NO: 890245 - DNA, 25 bp, Mus musculus
tgggcatgttccaagggcaccacgt

SEQ ID NO: 890246 - DNA, 25 bp, Mus musculus
tgggcatgttcctagggcaccacgt

SEQ ID NO: 890247 - DNA, 25 bp, Mus musculus
tgggcattacgtacagtgtcatctg

SEQ ID NO: 890248 - DNA, 25 bp, Mus musculus
tgggcattacgttcagtgtcatctg

SEQ ID NO: 890249 - DNA, 25 bp, Mus musculus
tgggcattagcaaagcacgctggct

SEQ ID NO: 890250 - DNA, 25 bp, Mus musculus
tgggcattagcatagcacgctggct

SEQ ID NO: 890251 - DNA, 25 bp, Mus musculus
tgggcattcactaagctgcaaggct

SEQ ID NO: 890252 - DNA, 25 bp, Mus musculus
tgggcattcacttagctgcaaggct

SEQ ID NO: 890253 - DNA, 25 bp, Mus musculus
tgggcattcagcaccgacgaccttt

SEQ ID NO: 890254 - DNA, 25 bp, Mus musculus
tgggcattcagctccgacgaccttt

SEQ ID NO: 890255 - DNA, 25 bp, Mus musculus
tgggcattctctcgctctccaagaa

SEQ ID NO: 890256 - DNA, 25 bp, Mus musculus
tgggcattctctggctctccaagaa

SEQ ID NO: 890257 - DNA, 25 bp, Mus musculus
tgggcattcttgaatctcctgtgta

SEQ ID NO: 890258 - DNA, 25 bp, Mus musculus
tgggcattcttgtatctcctgtgta

SEQ ID NO: 890259 - DNA, 25 bp, Mus musculus
tgggcattgccaagttcacctctca

SEQ ID NO: 890260 - DNA, 25 bp, Mus musculus
tgggcattgccatgttcacctctca

SEQ ID NO: 890261 - DNA, 25 bp, Mus musculus
tgggcattgcctctgtggcacagta

SEQ ID NO: 890262 - DNA, 25 bp, Mus musculus
tgggcattgcctgtgtggcacagta

SEQ ID NO: 890263 - DNA, 25 bp, Mus musculus
tgggcattgtgaattaacagcttgc

SEQ ID NO: 890264 - DNA, 25 bp, Mus musculus
tgggcattgtgatttaacagcttgc

SEQ ID NO: 890265 - DNA, 25 bp, Mus musculus
tgggcattgtggaaaggacccactt

SEQ ID NO: 890266 - DNA, 25 bp, Mus musculus
tgggcattgtggtaaggacccactt

SEQ ID NO: 890267 - DNA, 25 bp, Mus musculus
tgggcattgtgtactgcactcgctg

SEQ ID NO: 890268 - DNA, 25 bp, Mus musculus
tgggcattgtgttctgcactcgctg

SEQ ID NO: 890269 - DNA, 25 bp, Mus musculus
tgggcattttgacgccacaggaaat

SEQ ID NO: 890270 - DNA, 25 bp, Mus musculus
tgggcattttgaggccacaggaaat

SEQ ID NO: 890271 - DNA, 25 bp, Mus musculus
tgggccaaacccatggtgagactta

SEQ ID NO: 890272 - DNA, 25 bp, Mus musculus
tgggccaaacccttggtgagactta

SEQ ID NO: 890273 - DNA, 25 bp, Mus musculus
tgggccaaacttcgagcgagcatat

SEQ ID NO: 890274 - DNA, 25 bp, Mus musculus
tgggccaaacttggagcgagcatat

SEQ ID NO: 890275 - DNA, 25 bp, Mus musculus
tgggccaaagccctatcctggagat

SEQ ID NO: 890276 - DNA, 25 bp, Mus musculus
tgggccaaagccgtatcctggagat

SEQ ID NO: 890277 - DNA, 25 bp, Mus musculus
tgggccaaaggcacataatgtatat

SEQ ID NO: 890278 - DNA, 25 bp, Mus musculus
tgggccaaaggctcataatgtatat

SEQ ID NO: 890279 - DNA, 25 bp, Mus musculus
tgggccaacaatctgaccatctgtc

SEQ ID NO: 890280 - DNA, 25 bp, Mus musculus
tgggccaacaatgtgaccatctgtc

SEQ ID NO: 890281 - DNA, 25 bp, Mus musculus
tgggccaacccaattatattaattt

SEQ ID NO: 890282 - DNA, 25 bp, Mus musculus
tgggccaacccatttatattaattt

SEQ ID NO: 890283 - DNA, 25 bp, Mus musculus
tgggccaaccctaagcctaagcctt

SEQ ID NO: 890284 - DNA, 25 bp, Mus musculus
tgggccaacccttagcctaagcctt

SEQ ID NO: 890285 - DNA, 25 bp, Mus musculus
tgggccaacctcagacaacgaagag

SEQ ID NO: 890286 - DNA, 25 bp, Mus musculus
tgggccaacctctgacaacgaagag

SEQ ID NO: 890287 - DNA, 25 bp, Mus musculus
tgggccaacctgagtaactcgtgca

SEQ ID NO: 890288 - DNA, 25 bp, Mus musculus
tgggccaacctgtgtaactcgtgca

SEQ ID NO: 890289 - DNA, 25 bp, Mus musculus
tgggccaactctcggtcccaagagg

SEQ ID NO: 890290 - DNA, 25 bp, Mus musculus
tgggccaactctgggtcccaagagg

SEQ ID NO: 890291 - DNA, 25 bp, Mus musculus
tgggccaagaaacacctgctgctgt

SEQ ID NO: 890292 - DNA, 25 bp, Mus musculus
tgggccaagaaagacctgctgctgt

SEQ ID NO: 890293 - DNA, 25 bp, Mus musculus
tgggccaagactcctacacacggat

SEQ ID NO: 890294 - DNA, 25 bp, Mus musculus
tgggccaagactgctacacacggat

SEQ ID NO: 890295 - DNA, 25 bp, Mus musculus
tgggccaagcatatgaacacttttt

SEQ ID NO: 890296 - DNA, 25 bp, Mus musculus
tgggccaagcatttgaacacttttt

SEQ ID NO: 890297 - DNA, 25 bp, Mus musculus
tgggccaagccaacaacgaattaat

SEQ ID NO: 890298 - DNA, 25 bp, Mus musculus
tgggccaagccatcaacgaattaat

SEQ ID NO: 890299 - DNA, 25 bp, Mus musculus
tgggccaaggcaaccgctgttagga

SEQ ID NO: 890300 - DNA, 25 bp, Mus musculus
tgggccaaggcatccgctgttagga

SEQ ID NO: 890301 - DNA, 25 bp, Mus musculus
tgggccaagtgaaagccctgcttgt

SEQ ID NO: 890302 - DNA, 25 bp, Mus musculus
tgggccaagtgatagccctgcttgt

SEQ ID NO: 890303 - DNA, 25 bp, Mus musculus
tgggccaataatctacaagctttgt

SEQ ID NO: 890304 - DNA, 25 bp, Mus musculus
tgggccaataatgtacaagctttgt

SEQ ID NO: 890305 - DNA, 25 bp, Mus musculus
tgggccacaacactacgtcctggtg

SEQ ID NO: 890306 - DNA, 25 bp, Mus musculus
tgggccacaacagtacgtcctggtg

SEQ ID NO: 890307 - DNA, 25 bp, Mus musculus
tgggccacaagacgggtcgtaaact

SEQ ID NO: 890308 - DNA, 25 bp, Mus musculus
tgggccacaagaggggtcgtaaact

SEQ ID NO: 890309 - DNA, 25 bp, Mus musculus
tgggccacaagtacactctgcgatg

SEQ ID NO: 890310 - DNA, 25 bp, Mus musculus
tgggccacaagttcactctgcgatg

SEQ ID NO: 890311 - DNA, 25 bp, Mus musculus
tgggccacacttcctaacaatgtca

SEQ ID NO: 890312 - DNA, 25 bp, Mus musculus
tgggccacacttgctaacaatgtca

SEQ ID NO: 890313 - DNA, 25 bp, Mus musculus
tgggccacagctccagttcggaaaa

SEQ ID NO: 890314 - DNA, 25 bp, Mus musculus
tgggccacagctgcagttcggaaaa

SEQ ID NO: 890315 - DNA, 25 bp, Mus musculus
tgggccacaggaccaggtaccgtct

SEQ ID NO: 890316 - DNA, 25 bp, Mus musculus
tgggccacaggacggtcaatcttgt

SEQ ID NO: 890317 - DNA, 25 bp, Mus musculus
tgggccacaggagcaggtaccgtct

SEQ ID NO: 890318 - DNA, 25 bp, Mus musculus
tgggccacaggagggtcaatcttgt

SEQ ID NO: 890319 - DNA, 25 bp, Mus musculus
tgggccacaggtcaccagggtctct

SEQ ID NO: 890320 - DNA, 25 bp, Mus musculus
tgggccacaggtcctctgggtacaa

SEQ ID NO: 890321 - DNA, 25 bp, Mus musculus
tgggccacaggtgaccagggtctct

SEQ ID NO: 890322 - DNA, 25 bp, Mus musculus
tgggccacaggtgctctgggtacaa

SEQ ID NO: 890323 - DNA, 25 bp, Mus musculus
tgggccacagtacaggacttcagag

SEQ ID NO: 890324 - DNA, 25 bp, Mus musculus
tgggccacagtagaggacttcagag

SEQ ID NO: 890325 - DNA, 25 bp, Mus musculus
tgggccacatgacggtacgtgccat

SEQ ID NO: 890326 - DNA, 25 bp, Mus musculus
tgggccacatgagggtacgtgccat

SEQ ID NO: 890327 - DNA, 25 bp, Mus musculus
tgggccaccaaacaactcgatcttc

SEQ ID NO: 890328 - DNA, 25 bp, Mus musculus
tgggccaccaaagaactcgatcttc

SEQ ID NO: 890329 - DNA, 25 bp, Mus musculus
tgggccaccagcagggttggttcca

SEQ ID NO: 890330 - DNA, 25 bp, Mus musculus
tgggccaccagctgggttggttcca

SEQ ID NO: 890331 - DNA, 25 bp, Mus musculus
tgggccaccccaaggtgtacataaa

SEQ ID NO: 890332 - DNA, 25 bp, Mus musculus
tgggccaccccatggtgtacataaa

SEQ ID NO: 890333 - DNA, 25 bp, Mus musculus
tgggccacctggctaacagcacaca

SEQ ID NO: 890334 - DNA, 25 bp, Mus musculus
tgggccacctgggtaacagcacaca

SEQ ID NO: 890335 - DNA, 25 bp, Mus musculus
tgggccactcagcttgaccgaaggc

SEQ ID NO: 890336 - DNA, 25 bp, Mus musculus
tgggccactcaggttgaccgaaggc

SEQ ID NO: 890337 - DNA, 25 bp, Mus musculus
tgggccactgacagcagagaatacc

SEQ ID NO: 890338 - DNA, 25 bp, Mus musculus
tgggccactgactgcagagaatacc

SEQ ID NO: 890339 - DNA, 25 bp, Mus musculus
tgggccactggcagttaaagatgct

SEQ ID NO: 890340 - DNA, 25 bp, Mus musculus
tgggccactggctgttaaagatgct

SEQ ID NO: 890341 - DNA, 25 bp, Mus musculus
tgggccactgtgctactaactcttg

SEQ ID NO: 890342 - DNA, 25 bp, Mus musculus
tgggccactgtggtactaactcttg

SEQ ID NO: 890343 - DNA, 25 bp, Mus musculus
tgggccactttgacataggcagcca

SEQ ID NO: 890344 - DNA, 25 bp, Mus musculus
tgggccactttgtcataggcagcca

SEQ ID NO: 890345 - DNA, 25 bp, Mus musculus
tgggccagaactacgacatcgcaat

SEQ ID NO: 890346 - DNA, 25 bp, Mus musculus
tgggccagaacttcgacatcgcaat

SEQ ID NO: 890347 - DNA, 25 bp, Mus musculus
tgggccagaccccgcagcactgaat

SEQ ID NO: 890348 - DNA, 25 bp, Mus musculus
tgggccagacccggcagcactgaat

SEQ ID NO: 890349 - DNA, 25 bp, Mus musculus
tgggccagagtaaccggaggttcac

SEQ ID NO: 890350 - DNA, 25 bp, Mus musculus
tgggccagagtatccggaggttcac

SEQ ID NO: 890351 - DNA, 25 bp, Mus musculus
tgggccagatgcaaatgagctctct

SEQ ID NO: 890352 - DNA, 25 bp, Mus musculus
tgggccagatgctaatgagctctct

SEQ ID NO: 890353 - DNA, 25 bp, Mus musculus
tgggccagcagtcccatgctttagg

SEQ ID NO: 890354 - DNA, 25 bp, Mus musculus
tgggccagcagtgccatgctttagg

SEQ ID NO: 890355 - DNA, 25 bp, Mus musculus
tgggccagcatcctacttaaacaac

SEQ ID NO: 890356 - DNA, 25 bp, Mus musculus
tgggccagcatcgtacttaaacaac

SEQ ID NO: 890357 - DNA, 25 bp, Mus musculus
tgggccagccacagacaacaacggt

SEQ ID NO: 890358 - DNA, 25 bp, Mus musculus
tgggccagccactgacaacaacggt

SEQ ID NO: 890359 - DNA, 25 bp, Mus musculus
tgggccagcgctctgagatcactgt

SEQ ID NO: 890360 - DNA, 25 bp, Mus musculus
tgggccagcgctgtgagatcactgt

SEQ ID NO: 890361 - DNA, 25 bp, Mus musculus
tgggccagctccagcaagatgaatc

SEQ ID NO: 890362 - DNA, 25 bp, Mus musculus
tgggccagctcctgcaagatgaatc

SEQ ID NO: 890363 - DNA, 25 bp, Mus musculus
tgggccagctctatgcggcttggaa

SEQ ID NO: 890364 - DNA, 25 bp, Mus musculus
tgggccagctctttgcggcttggaa

SEQ ID NO: 890365 - DNA, 25 bp, Mus musculus
tgggccagctgaacgacctgggctc

SEQ ID NO: 890366 - DNA, 25 bp, Mus musculus
tgggccagctgatcgacctgggctc

SEQ ID NO: 890367 - DNA, 25 bp, Mus musculus
tgggccagcttacgacctggagtcc

SEQ ID NO: 890368 - DNA, 25 bp, Mus musculus
tgggccagcttaggacctggagtcc

SEQ ID NO: 890369 - DNA, 25 bp, Mus musculus
tgggccaggaccaacctctctacaa

SEQ ID NO: 890370 - DNA, 25 bp, Mus musculus
tgggccaggacctacctctctacaa

SEQ ID NO: 890371 - DNA, 25 bp, Mus musculus
tgggccaggagcatcatgggttcaa

SEQ ID NO: 890372 - DNA, 25 bp, Mus musculus
tgggccaggagcttcatgggttcaa

SEQ ID NO: 890373 - DNA, 25 bp, Mus musculus
tgggccaggaggatcccctggatac

SEQ ID NO: 890374 - DNA, 25 bp, Mus musculus
tgggccaggaggttcccctggatac

SEQ ID NO: 890375 - DNA, 25 bp, Mus musculus
tgggccaggatacctctatcaactc

SEQ ID NO: 890376 - DNA, 25 bp, Mus musculus
tgggccaggatagctctatcaactc

SEQ ID NO: 890377 - DNA, 25 bp, Mus musculus
tgggccaggcatactcaatccactg

SEQ ID NO: 890378 - DNA, 25 bp, Mus musculus
tgggccaggcattctcaatccactg

SEQ ID NO: 890379 - DNA, 25 bp, Mus musculus
tgggccaggccaacaccggtcgcac

SEQ ID NO: 890380 - DNA, 25 bp, Mus musculus
tgggccaggccatcaccggtcgcac

SEQ ID NO: 890381 - DNA, 25 bp, Mus musculus
tgggccaggcctcgcaaaaacacaa

SEQ ID NO: 890382 - DNA, 25 bp, Mus musculus
tgggccaggcctggcaaaaacacaa

SEQ ID NO: 890383 - DNA, 25 bp, Mus musculus
tgggccaggcttacttaccacagaa

SEQ ID NO: 890384 - DNA, 25 bp, Mus musculus
tgggccaggctttcttaccacagaa

SEQ ID NO: 890385 - DNA, 25 bp, Mus musculus
tgggccagggaaatgctccctctaa

SEQ ID NO: 890386 - DNA, 25 bp, Mus musculus
tgggccagggaattgctccctctaa

SEQ ID NO: 890387 - DNA, 25 bp, Mus musculus
tgggccagggttatgcactccagac

SEQ ID NO: 890388 - DNA, 25 bp, Mus musculus
tgggccagggttttgcactccagac

SEQ ID NO: 890389 - DNA, 25 bp, Mus musculus
tgggccaggtccctcatccagagtt

SEQ ID NO: 890390 - DNA, 25 bp, Mus musculus
tgggccaggtccgtcatccagagtt

SEQ ID NO: 890391 - DNA, 25 bp, Mus musculus
tgggccagtcatcttcgggttgctc

SEQ ID NO: 890392 - DNA, 25 bp, Mus musculus
tgggccagtcatgttcgggttgctc

SEQ ID NO: 890393 - DNA, 25 bp, Mus musculus
tgggccagtgagatccccggtgact

SEQ ID NO: 890394 - DNA, 25 bp, Mus musculus
tgggccagtgagttccccggtgact

SEQ ID NO: 890395 - DNA, 25 bp, Mus musculus
tgggccagtgccatacccttaaggg

SEQ ID NO: 890396 - DNA, 25 bp, Mus musculus
tgggccagtgccttacccttaaggg

SEQ ID NO: 890397 - DNA, 25 bp, Mus musculus
tgggccagtggaatgccaactacat

SEQ ID NO: 890398 - DNA, 25 bp, Mus musculus
tgggccagtggattgccaactacat

SEQ ID NO: 890399 - DNA, 25 bp, Mus musculus
tgggccagtggcctcaacactgttg

SEQ ID NO: 890400 - DNA, 25 bp, Mus musculus
tgggccagtggcgtcaacactgttg

SEQ ID NO: 890401 - DNA, 25 bp, Mus musculus
tgggccagtgggataacatttcact

SEQ ID NO: 890402 - DNA, 25 bp, Mus musculus
tgggccagtgggttaacatttcact

SEQ ID NO: 890403 - DNA, 25 bp, Mus musculus
tgggccagttcaaagcaaagttgta

SEQ ID NO: 890404 - DNA, 25 bp, Mus musculus
tgggccagttcatagcaaagttgta

SEQ ID NO: 890405 - DNA, 25 bp, Mus musculus
tgggccataaacacatagaaaagaa

SEQ ID NO: 890406 - DNA, 25 bp, Mus musculus
tgggccataaactcatagaaaagaa

SEQ ID NO: 890407 - DNA, 25 bp, Mus musculus
tgggccataacccttattcagtata

SEQ ID NO: 890408 - DNA, 25 bp, Mus musculus
tgggccataaccgttattcagtata

SEQ ID NO: 890409 - DNA, 25 bp, Mus musculus
tgggccataggtcactgtctttctc

SEQ ID NO: 890410 - DNA, 25 bp, Mus musculus
tgggccataggtgactgtctttctc

SEQ ID NO: 890411 - DNA, 25 bp, Mus musculus
tgggccatcatcactctgtgtgtta

SEQ ID NO: 890412 - DNA, 25 bp, Mus musculus
tgggccatcatctctctgtgtgtta

SEQ ID NO: 890413 - DNA, 25 bp, Mus musculus
tgggccatcttaccagatgccacat

SEQ ID NO: 890414 - DNA, 25 bp, Mus musculus
tgggccatcttagcagatgccacat

SEQ ID NO: 890415 - DNA, 25 bp, Mus musculus
tgggccatcttgagatgccatctat

SEQ ID NO: 890416 - DNA, 25 bp, Mus musculus
tgggccatcttgtgatgccatctat

SEQ ID NO: 890417 - DNA, 25 bp, Mus musculus
tgggccatgggtcccagcaagacac

SEQ ID NO: 890418 - DNA, 25 bp, Mus musculus
tgggccatgggtgccagcaagacac

SEQ ID NO: 890419 - DNA, 25 bp, Mus musculus
tgggccatgtctcccaggtagctgc

SEQ ID NO: 890420 - DNA, 25 bp, Mus musculus
tgggccatgtctgccaggtagctgc

SEQ ID NO: 890421 - DNA, 25 bp, Mus musculus
tgggccattcatacctgcaaaagat

SEQ ID NO: 890422 - DNA, 25 bp, Mus musculus
tgggccattcattcctgcaaaagat

SEQ ID NO: 890423 - DNA, 25 bp, Mus musculus
tgggccattcccaatttttggatga

SEQ ID NO: 890424 - DNA, 25 bp, Mus musculus
tgggccattccctatttttggatga

SEQ ID NO: 890425 - DNA, 25 bp, Mus musculus
tgggccattggcaagaacgctgctg

SEQ ID NO: 890426 - DNA, 25 bp, Mus musculus
tgggccattggctagaacgctgctg

SEQ ID NO: 890427 - DNA, 25 bp, Mus musculus
tgggccatttcaatagaggacaact

SEQ ID NO: 890428 - DNA, 25 bp, Mus musculus
tgggccatttcattagaggacaact

SEQ ID NO: 890429 - DNA, 25 bp, Mus musculus
tgggccattttgcttctcttggcaa

SEQ ID NO: 890430 - DNA, 25 bp, Mus musculus
tgggccattttggttctcttggcaa

SEQ ID NO: 890431 - DNA, 25 bp, Mus musculus
tgggcccaagttctttgtctagcat

SEQ ID NO: 890432 - DNA, 25 bp, Mus musculus
tgggcccaagttgtttgtctagcat

SEQ ID NO: 890433 - DNA, 25 bp, Mus musculus
tgggcccaatgtctacctcaagata

SEQ ID NO: 890434 - DNA, 25 bp, Mus musculus
tgggcccaatgtgtacctcaagata

SEQ ID NO: 890435 - DNA, 25 bp, Mus musculus
tgggcccacaaaagaccttgttcgt

SEQ ID NO: 890436 - DNA, 25 bp, Mus musculus
tgggcccacaaatgaccttgttcgt

SEQ ID NO: 890437 - DNA, 25 bp, Mus musculus
tgggcccacacacactagacaagta

SEQ ID NO: 890438 - DNA, 25 bp, Mus musculus
tgggcccacacagactagacaagta

SEQ ID NO: 890439 - DNA, 25 bp, Mus musculus
tgggcccacagtatctatttttcat

SEQ ID NO: 890440 - DNA, 25 bp, Mus musculus
tgggcccacagtttctatttttcat

SEQ ID NO: 890441 - DNA, 25 bp, Mus musculus
tgggcccactatcccctgaagacaa

SEQ ID NO: 890442 - DNA, 25 bp, Mus musculus
tgggcccactatgccctgaagacaa

SEQ ID NO: 890443 - DNA, 25 bp, Mus musculus
tgggcccagaccatatcagttcatt

SEQ ID NO: 890444 - DNA, 25 bp, Mus musculus
tgggcccagaccttatcagttcatt

SEQ ID NO: 890445 - DNA, 25 bp, Mus musculus
tgggcccagacgcagctctaaatga

SEQ ID NO: 890446 - DNA, 25 bp, Mus musculus
tgggcccagacggagctctaaatga

SEQ ID NO: 890447 - DNA, 25 bp, Mus musculus
tgggcccagatcacacatgcaacag

SEQ ID NO: 890448 - DNA, 25 bp, Mus musculus
tgggcccagatctcacatgcaacag

SEQ ID NO: 890449 - DNA, 25 bp, Mus musculus
tgggcccagcatagagctcctgcca

SEQ ID NO: 890450 - DNA, 25 bp, Mus musculus
tgggcccagcatattcaacatcgat

SEQ ID NO: 890451 - DNA, 25 bp, Mus musculus
tgggcccagcattgagctcctgcca

SEQ ID NO: 890452 - DNA, 25 bp, Mus musculus
tgggcccagcattttcaacatcgat

SEQ ID NO: 890453 - DNA, 25 bp, Mus musculus
tgggcccagggcattgcacatgcta

SEQ ID NO: 890454 - DNA, 25 bp, Mus musculus
tgggcccagggctttgcacatgcta

SEQ ID NO: 890455 - DNA, 25 bp, Mus musculus
tgggcccagtcaccaccggcagtgt

SEQ ID NO: 890456 - DNA, 25 bp, Mus musculus
tgggcccagtcagcaccggcagtgt

SEQ ID NO: 890457 - DNA, 25 bp, Mus musculus
tgggcccagtgaccatgcaccttca

SEQ ID NO: 890458 - DNA, 25 bp, Mus musculus
tgggcccagtgagcatgcaccttca

SEQ ID NO: 890459 - DNA, 25 bp, Mus musculus
tgggcccagtgcaaatgtagccagt

SEQ ID NO: 890460 - DNA, 25 bp, Mus musculus
tgggcccagtgctaatgtagccagt

SEQ ID NO: 890461 - DNA, 25 bp, Mus musculus
tgggcccagttaagtattgcatgaa

SEQ ID NO: 890462 - DNA, 25 bp, Mus musculus
tgggcccagttatgtattgcatgaa

SEQ ID NO: 890463 - DNA, 25 bp, Mus musculus
tgggcccatgtactctatatctaaa

SEQ ID NO: 890464 - DNA, 25 bp, Mus musculus
tgggcccatgtagtctatatctaaa

SEQ ID NO: 890465 - DNA, 25 bp, Mus musculus
tgggcccatttgctgtcagtccttc

SEQ ID NO: 890466 - DNA, 25 bp, Mus musculus
tgggcccatttggtgtcagtccttc

SEQ ID NO: 890467 - DNA, 25 bp, Mus musculus
tgggccccactgatcatttcaggga

SEQ ID NO: 890468 - DNA, 25 bp, Mus musculus
tgggccccactgcatggatactcac

SEQ ID NO: 890469 - DNA, 25 bp, Mus musculus
tgggccccactgcattaagtctcta

SEQ ID NO: 890470 - DNA, 25 bp, Mus musculus
tgggccccactggatggatactcac

SEQ ID NO: 890471 - DNA, 25 bp, Mus musculus
tgggccccactggattaagtctcta

SEQ ID NO: 890472 - DNA, 25 bp, Mus musculus
tgggccccactgttcatttcaggga

SEQ ID NO: 890473 - DNA, 25 bp, Mus musculus
tgggccccagcaaatcctaggagtg

SEQ ID NO: 890474 - DNA, 25 bp, Mus musculus
tgggccccagcatatcctaggagtg

SEQ ID NO: 890475 - DNA, 25 bp, Mus musculus
tgggccccaggcacggtgtgcctta

SEQ ID NO: 890476 - DNA, 25 bp, Mus musculus
tgggccccaggctcggtgtgcctta

SEQ ID NO: 890477 - DNA, 25 bp, Mus musculus
tgggccccagttccggtgttgttct

SEQ ID NO: 890478 - DNA, 25 bp, Mus musculus
tgggccccagttgcggtgttgttct

SEQ ID NO: 890479 - DNA, 25 bp, Mus musculus
tgggccccatacctagagttcctga

SEQ ID NO: 890480 - DNA, 25 bp, Mus musculus
tgggccccatacgtagagttcctga

SEQ ID NO: 890481 - DNA, 25 bp, Mus musculus
tgggccccatcaagtaagctcagtc

SEQ ID NO: 890482 - DNA, 25 bp, Mus musculus
tgggccccatcatgtaagctcagtc

SEQ ID NO: 890483 - DNA, 25 bp, Mus musculus
tgggccccatgacagccccaagtgg

SEQ ID NO: 890484 - DNA, 25 bp, Mus musculus
tgggccccatgagagccccaagtgg

SEQ ID NO: 890485 - DNA, 25 bp, Mus musculus
tgggccccattgagttttcttctgt

SEQ ID NO: 890486 - DNA, 25 bp, Mus musculus
tgggccccattgtgttttcttctgt

SEQ ID NO: 890487 - DNA, 25 bp, Mus musculus
tgggccccggaaccatcagggactt

SEQ ID NO: 890488 - DNA, 25 bp, Mus musculus
tgggccccggaactttcttcagctt

SEQ ID NO: 890489 - DNA, 25 bp, Mus musculus
tgggccccggaagcatcagggactt

SEQ ID NO: 890490 - DNA, 25 bp, Mus musculus
tgggccccggaagtttcttcagctt

SEQ ID NO: 890491 - DNA, 25 bp, Mus musculus
tgggccccgttgactgggcctgtcc

SEQ ID NO: 890492 - DNA, 25 bp, Mus musculus
tgggccccgttgtctgggcctgtcc

SEQ ID NO: 890493 - DNA, 25 bp, Mus musculus
tgggcccctaaactatctgtccgta

SEQ ID NO: 890494 - DNA, 25 bp, Mus musculus
tgggcccctaaagtatctgtccgta

SEQ ID NO: 890495 - DNA, 25 bp, Mus musculus
tgggcccctaagctgtatctccagt

SEQ ID NO: 890496 - DNA, 25 bp, Mus musculus
tgggcccctaaggtgtatctccagt

SEQ ID NO: 890497 - DNA, 25 bp, Mus musculus
tgggcccctagcactatgtttaatg

SEQ ID NO: 890498 - DNA, 25 bp, Mus musculus
tgggcccctagctctatgtttaatg

SEQ ID NO: 890499 - DNA, 25 bp, Mus musculus
tgggcccctaggctgacacatagaa

SEQ ID NO: 890500 - DNA, 25 bp, Mus musculus
tgggcccctagggtgacacatagaa

SEQ ID NO: 890501 - DNA, 25 bp, Mus musculus
tgggcccctatcactggttattctt

SEQ ID NO: 890502 - DNA, 25 bp, Mus musculus
tgggcccctatctctggttattctt

SEQ ID NO: 890503 - DNA, 25 bp, Mus musculus
tgggcccctcagagttgtcacctac

SEQ ID NO: 890504 - DNA, 25 bp, Mus musculus
tgggcccctcagtgttgtcacctac

SEQ ID NO: 890505 - DNA, 25 bp, Mus musculus
tgggccccttctcgttccttggagt

SEQ ID NO: 890506 - DNA, 25 bp, Mus musculus
tgggccccttctggttccttggagt

SEQ ID NO: 890507 - DNA, 25 bp, Mus musculus
tgggccccttgtcagccagtgttct

SEQ ID NO: 890508 - DNA, 25 bp, Mus musculus
tgggccccttgtgagccagtgttct

SEQ ID NO: 890509 - DNA, 25 bp, Mus musculus
tgggcccgacagaattctcctaaga

SEQ ID NO: 890510 - DNA, 25 bp, Mus musculus
tgggcccgacagaggacacaggact

SEQ ID NO: 890511 - DNA, 25 bp, Mus musculus
tgggcccgacagtattctcctaaga

SEQ ID NO: 890512 - DNA, 25 bp, Mus musculus
tgggcccgacagtggacacaggact

SEQ ID NO: 890513 - DNA, 25 bp, Mus musculus
tgggcccgttctcttacaggtggtt

SEQ ID NO: 890514 - DNA, 25 bp, Mus musculus
tgggcccgttctgttacaggtggtt

SEQ ID NO: 890515 - DNA, 25 bp, Mus musculus
tgggccctacagcagaagttctctg

SEQ ID NO: 890516 - DNA, 25 bp, Mus musculus
tgggccctacaggagaagttctctg

SEQ ID NO: 890517 - DNA, 25 bp, Mus musculus
tgggccctacttccttgtttataaa

SEQ ID NO: 890518 - DNA, 25 bp, Mus musculus
tgggccctacttgcttgtttataaa

SEQ ID NO: 890519 - DNA, 25 bp, Mus musculus
tgggccctagcaagctaagccacaa

SEQ ID NO: 890520 - DNA, 25 bp, Mus musculus
tgggccctagcatgctaagccacaa

SEQ ID NO: 890521 - DNA, 25 bp, Mus musculus
tgggccctattcagtggcagcttct

SEQ ID NO: 890522 - DNA, 25 bp, Mus musculus
tgggccctattctgtggcagcttct

SEQ ID NO: 890523 - DNA, 25 bp, Mus musculus
tgggccctcaacagagaactgtcct

SEQ ID NO: 890524 - DNA, 25 bp, Mus musculus
tgggccctcaactgagaactgtcct

SEQ ID NO: 890525 - DNA, 25 bp, Mus musculus
tgggccctcagaagaccggattgta

SEQ ID NO: 890526 - DNA, 25 bp, Mus musculus
tgggccctcagatgaccggattgta

SEQ ID NO: 890527 - DNA, 25 bp, Mus musculus
tgggccctcgatcagtgccaaggat

SEQ ID NO: 890528 - DNA, 25 bp, Mus musculus
tgggccctcgatgagtgccaaggat

SEQ ID NO: 890529 - DNA, 25 bp, Mus musculus
tgggccctctgtagtagtcaaatga

SEQ ID NO: 890530 - DNA, 25 bp, Mus musculus
tgggccctctgttgtagtcaaatga

SEQ ID NO: 890531 - DNA, 25 bp, Mus musculus
tgggccctcttcaaagtctttttca

SEQ ID NO: 890532 - DNA, 25 bp, Mus musculus
tgggccctcttctaagtctttttca

SEQ ID NO: 890533 - DNA, 25 bp, Mus musculus
tgggccctgagtatctccttttaaa

SEQ ID NO: 890534 - DNA, 25 bp, Mus musculus
tgggccctgagtttctccttttaaa

SEQ ID NO: 890535 - DNA, 25 bp, Mus musculus
tgggccctgcccatgatgctgaaga

SEQ ID NO: 890536 - DNA, 25 bp, Mus musculus
tgggccctgcccattggatgatgtg

SEQ ID NO: 890537 - DNA, 25 bp, Mus musculus
tgggccctgcccttgatgctgaaga

SEQ ID NO: 890538 - DNA, 25 bp, Mus musculus
tgggccctgccctttggatgatgtg

SEQ ID NO: 890539 - DNA, 25 bp, Mus musculus
tgggccctgcgcatcctttttctaa

SEQ ID NO: 890540 - DNA, 25 bp, Mus musculus
tgggccctgcgcttcctttttctaa

SEQ ID NO: 890541 - DNA, 25 bp, Mus musculus
tgggccctggacactgaggatagta

SEQ ID NO: 890542 - DNA, 25 bp, Mus musculus
tgggccctggactctgaggatagta

SEQ ID NO: 890543 - DNA, 25 bp, Mus musculus
tgggccctggcaactcatagtttgt

SEQ ID NO: 890544 - DNA, 25 bp, Mus musculus
tgggccctggcatctcatagtttgt

SEQ ID NO: 890545 - DNA, 25 bp, Mus musculus
tgggccctggctccattaacctaaa

SEQ ID NO: 890546 - DNA, 25 bp, Mus musculus
tgggccctggctgcattaacctaaa

SEQ ID NO: 890547 - DNA, 25 bp, Mus musculus
tgggccctgtgcactatggttagga

SEQ ID NO: 890548 - DNA, 25 bp, Mus musculus
tgggccctgtgctctatggttagga

SEQ ID NO: 890549 - DNA, 25 bp, Mus musculus
tgggccctgtgtatggcaggcatat

SEQ ID NO: 890550 - DNA, 25 bp, Mus musculus
tgggccctgtgtttggcaggcatat

SEQ ID NO: 890551 - DNA, 25 bp, Mus musculus
tgggccctgttcatgtgaagtccat

SEQ ID NO: 890552 - DNA, 25 bp, Mus musculus
tgggccctgttccacagaaacctgt

SEQ ID NO: 890553 - DNA, 25 bp, Mus musculus
tgggccctgttcgacagaaacctgt

SEQ ID NO: 890554 - DNA, 25 bp, Mus musculus
tgggccctgttcttgtgaagtccat

SEQ ID NO: 890555 - DNA, 25 bp, Mus musculus
tgggcccttagaactatcaccccag

SEQ ID NO: 890556 - DNA, 25 bp, Mus musculus
tgggcccttagatctatcaccccag

SEQ ID NO: 890557 - DNA, 25 bp, Mus musculus
tgggcccttatccagcagtctggac

SEQ ID NO: 890558 - DNA, 25 bp, Mus musculus
tgggcccttatcgagcagtctggac

SEQ ID NO: 890559 - DNA, 25 bp, Mus musculus
tgggcccttcaccatgggtcagaag

SEQ ID NO: 890560 - DNA, 25 bp, Mus musculus
tgggcccttcacgatgggtcagaag

SEQ ID NO: 890561 - DNA, 25 bp, Mus musculus
tgggcccttccacattatttttgag

SEQ ID NO: 890562 - DNA, 25 bp, Mus musculus
tgggcccttccagattatttttgag

SEQ ID NO: 890563 - DNA, 25 bp, Mus musculus
tgggcccttggcagctgtggccacc

SEQ ID NO: 890564 - DNA, 25 bp, Mus musculus
tgggcccttggcaggactcctattc

SEQ ID NO: 890565 - DNA, 25 bp, Mus musculus
tgggcccttggctgctgtggccacc

SEQ ID NO: 890566 - DNA, 25 bp, Mus musculus
tgggcccttggctggactcctattc

SEQ ID NO: 890567 - DNA, 25 bp, Mus musculus
tgggccctttatatatgacgacttt

SEQ ID NO: 890568 - DNA, 25 bp, Mus musculus
tgggccctttatttatgacgacttt

SEQ ID NO: 890569 - DNA, 25 bp, Mus musculus
tgggccctttctactgaaccagcaa

SEQ ID NO: 890570 - DNA, 25 bp, Mus musculus
tgggccctttcttctgaaccagcaa

SEQ ID NO: 890571 - DNA, 25 bp, Mus musculus
tgggccctttgaagtggcacttgcc

SEQ ID NO: 890572 - DNA, 25 bp, Mus musculus
tgggccctttgatgtggcacttgcc

SEQ ID NO: 890573 - DNA, 25 bp, Mus musculus
tgggccgagtataggttgaacgaat

SEQ ID NO: 890574 - DNA, 25 bp, Mus musculus
tgggccgagtattggttgaacgaat

SEQ ID NO: 890575 - DNA, 25 bp, Mus musculus
tgggccgatgtacggtcacagacaa

SEQ ID NO: 890576 - DNA, 25 bp, Mus musculus
tgggccgatgtagggtcacagacaa

SEQ ID NO: 890577 - DNA, 25 bp, Mus musculus
tgggccgcgagtatgggaacctggc

SEQ ID NO: 890578 - DNA, 25 bp, Mus musculus
tgggccgcgagtttgggaacctggc

SEQ ID NO: 890579 - DNA, 25 bp, Mus musculus
tgggccggaagcacatcacaaagta

SEQ ID NO: 890580 - DNA, 25 bp, Mus musculus
tgggccggaagctcatcacaaagta

SEQ ID NO: 890581 - DNA, 25 bp, Mus musculus
tgggccggaccaacatcagtgatga

SEQ ID NO: 890582 - DNA, 25 bp, Mus musculus
tgggccggaccatcatcagtgatga

SEQ ID NO: 890583 - DNA, 25 bp, Mus musculus
tgggccggcctcaacaatggtaatg

SEQ ID NO: 890584 - DNA, 25 bp, Mus musculus
tgggccggcctctacaatggtaatg

SEQ ID NO: 890585 - DNA, 25 bp, Mus musculus
tgggccgggaaacacactgcatcta

SEQ ID NO: 890586 - DNA, 25 bp, Mus musculus
tgggccgggaaagacactgcatcta

SEQ ID NO: 890587 - DNA, 25 bp, Mus musculus
tgggccgggcaacaatttgctcagt

SEQ ID NO: 890588 - DNA, 25 bp, Mus musculus
tgggccgggcaagaatttgctcagt

SEQ ID NO: 890589 - DNA, 25 bp, Mus musculus
tgggccgggctaattttctggagaa

SEQ ID NO: 890590 - DNA, 25 bp, Mus musculus
tgggccgggctatttttctggagaa

SEQ ID NO: 890591 - DNA, 25 bp, Mus musculus
tgggccgggctgacactgtgaaatt

SEQ ID NO: 890592 - DNA, 25 bp, Mus musculus
tgggccgggctgtcactgtgaaatt

SEQ ID NO: 890593 - DNA, 25 bp, Mus musculus
tgggccggtactacatgtctgcgcg

SEQ ID NO: 890594 - DNA, 25 bp, Mus musculus
tgggccggtacttcatgtctgcgcg

SEQ ID NO: 890595 - DNA, 25 bp, Mus musculus
tgggccggtattaccagttcctgtc

SEQ ID NO: 890596 - DNA, 25 bp, Mus musculus
tgggccggtatttccagttcctgtc

SEQ ID NO: 890597 - DNA, 25 bp, Mus musculus
tgggccgtgagcatcctactttggc

SEQ ID NO: 890598 - DNA, 25 bp, Mus musculus
tgggccgtgagcttcctactttggc

SEQ ID NO: 890599 - DNA, 25 bp, Mus musculus
tgggccgtgtatcgctcagcaagct

SEQ ID NO: 890600 - DNA, 25 bp, Mus musculus
tgggccgtgtatggctcagcaagct

SEQ ID NO: 890601 - DNA, 25 bp, Mus musculus
tgggccgtgttccttgtcattgcac

SEQ ID NO: 890602 - DNA, 25 bp, Mus musculus
tgggccgtgttcgttgtcattgcac

SEQ ID NO: 890603 - DNA, 25 bp, Mus musculus
tgggccgttcaaccaaacaggatct

SEQ ID NO: 890604 - DNA, 25 bp, Mus musculus
tgggccgttcaagcaaacaggatct

SEQ ID NO: 890605 - DNA, 25 bp, Mus musculus
tgggcctaagagacagcaagttctt

SEQ ID NO: 890606 - DNA, 25 bp, Mus musculus
tgggcctaagagtcagcaagttctt

SEQ ID NO: 890607 - DNA, 25 bp, Mus musculus
tgggcctaccttaccattgttagga

SEQ ID NO: 890608 - DNA, 25 bp, Mus musculus
tgggcctaccttatcatatgctaga

SEQ ID NO: 890609 - DNA, 25 bp, Mus musculus
tgggcctacctttccattgttagga

SEQ ID NO: 890610 - DNA, 25 bp, Mus musculus
tgggcctaccttttcatatgctaga

SEQ ID NO: 890611 - DNA, 25 bp, Mus musculus
tgggcctacgccagtcaagtcttgt

SEQ ID NO: 890612 - DNA, 25 bp, Mus musculus
tgggcctacgcctgtcaagtcttgt

SEQ ID NO: 890613 - DNA, 25 bp, Mus musculus
tgggcctactgaacctgacagtgac

SEQ ID NO: 890614 - DNA, 25 bp, Mus musculus
tgggcctactgatcctgacagtgac

SEQ ID NO: 890615 - DNA, 25 bp, Mus musculus
tgggcctacttacatttagttctaa

SEQ ID NO: 890616 - DNA, 25 bp, Mus musculus
tgggcctacttagatttagttctaa

SEQ ID NO: 890617 - DNA, 25 bp, Mus musculus
tgggcctagacgcagtcccctgcaa

SEQ ID NO: 890618 - DNA, 25 bp, Mus musculus
tgggcctagacggagtcccctgcaa

SEQ ID NO: 890619 - DNA, 25 bp, Mus musculus
tgggcctagcaacgcagacagcgat

SEQ ID NO: 890620 - DNA, 25 bp, Mus musculus
tgggcctagcaaggcagacagcgat

SEQ ID NO: 890621 - DNA, 25 bp, Mus musculus
tgggcctaggcaaagactcagaatg

SEQ ID NO: 890622 - DNA, 25 bp, Mus musculus
tgggcctaggcatagactcagaatg

SEQ ID NO: 890623 - DNA, 25 bp, Mus musculus
tgggcctatccaagttcggttataa

SEQ ID NO: 890624 - DNA, 25 bp, Mus musculus
tgggcctatccatgttcggttataa

SEQ ID NO: 890625 - DNA, 25 bp, Mus musculus
tgggcctatcttacactgggagaag

SEQ ID NO: 890626 - DNA, 25 bp, Mus musculus
tgggcctatcttctatgtaactggg

SEQ ID NO: 890627 - DNA, 25 bp, Mus musculus
tgggcctatcttgtatgtaactggg

SEQ ID NO: 890628 - DNA, 25 bp, Mus musculus
tgggcctatctttcactgggagaag

SEQ ID NO: 890629 - DNA, 25 bp, Mus musculus
tgggcctatgacatgagtgctcaga

SEQ ID NO: 890630 - DNA, 25 bp, Mus musculus
tgggcctatgacttgagtgctcaga

SEQ ID NO: 890631 - DNA, 25 bp, Mus musculus
tgggcctattccagaccctgaaaga

SEQ ID NO: 890632 - DNA, 25 bp, Mus musculus
tgggcctattcctgaccctgaaaga

SEQ ID NO: 890633 - DNA, 25 bp, Mus musculus
tgggcctatttgctttcaagacaat

SEQ ID NO: 890634 - DNA, 25 bp, Mus musculus
tgggcctatttggtttcaagacaat

SEQ ID NO: 890635 - DNA, 25 bp, Mus musculus
tgggcctcaaatacgcagagctcgt

SEQ ID NO: 890636 - DNA, 25 bp, Mus musculus
tgggcctcaaattcgcagagctcgt

SEQ ID NO: 890637 - DNA, 25 bp, Mus musculus
tgggcctcaagcaccttagccagct

SEQ ID NO: 890638 - DNA, 25 bp, Mus musculus
tgggcctcaagctccttagccagct

SEQ ID NO: 890639 - DNA, 25 bp, Mus musculus
tgggcctcaaggacgacaacatcat

SEQ ID NO: 890640 - DNA, 25 bp, Mus musculus
tgggcctcaaggactcagtcaacgc

SEQ ID NO: 890641 - DNA, 25 bp, Mus musculus
tgggcctcaaggtcgacaacatcat

SEQ ID NO: 890642 - DNA, 25 bp, Mus musculus
tgggcctcaaggtctcagtcaacgc

SEQ ID NO: 890643 - DNA, 25 bp, Mus musculus
tgggcctcacacagtgctataggat

SEQ ID NO: 890644 - DNA, 25 bp, Mus musculus
tgggcctcacactgtgctataggat

SEQ ID NO: 890645 - DNA, 25 bp, Mus musculus
tgggcctcactcactaggcaaacaa

SEQ ID NO: 890646 - DNA, 25 bp, Mus musculus
tgggcctcactctctaggcaaacaa

SEQ ID NO: 890647 - DNA, 25 bp, Mus musculus
tgggcctcagttacttaatgtataa

SEQ ID NO: 890648 - DNA, 25 bp, Mus musculus
tgggcctcagtttcttaatgtataa

SEQ ID NO: 890649 - DNA, 25 bp, Mus musculus
tgggcctcattcagccaaagctgga

SEQ ID NO: 890650 - DNA, 25 bp, Mus musculus
tgggcctcattctgccaaagctgga

SEQ ID NO: 890651 - DNA, 25 bp, Mus musculus
tgggcctccacacttcagagggatc

SEQ ID NO: 890652 - DNA, 25 bp, Mus musculus
tgggcctccacagttcagagggatc

SEQ ID NO: 890653 - DNA, 25 bp, Mus musculus
tgggcctccacgatagtctgtgaat

SEQ ID NO: 890654 - DNA, 25 bp, Mus musculus
tgggcctccacgttagtctgtgaat

SEQ ID NO: 890655 - DNA, 25 bp, Mus musculus
tgggcctccataagacctcgagtag

SEQ ID NO: 890656 - DNA, 25 bp, Mus musculus
tgggcctccatatgacctcgagtag

SEQ ID NO: 890657 - DNA, 25 bp, Mus musculus
tgggcctccatcacagtaacattaa

SEQ ID NO: 890658 - DNA, 25 bp, Mus musculus
tgggcctccatctcagtaacattaa

SEQ ID NO: 890659 - DNA, 25 bp, Mus musculus
tgggcctcccagaaacacagtaaag

SEQ ID NO: 890660 - DNA, 25 bp, Mus musculus
tgggcctcccagtaacacagtaaag

SEQ ID NO: 890661 - DNA, 25 bp, Mus musculus
tgggcctcctagactggaaaacacc

SEQ ID NO: 890662 - DNA, 25 bp, Mus musculus
tgggcctcctagtctggaaaacacc

SEQ ID NO: 890663 - DNA, 25 bp, Mus musculus
tgggcctcctcaacaccaaacagtt

SEQ ID NO: 890664 - DNA, 25 bp, Mus musculus
tgggcctcctcaacattctcagcaa

SEQ ID NO: 890665 - DNA, 25 bp, Mus musculus
tgggcctcctcatcaccaaacagtt

SEQ ID NO: 890666 - DNA, 25 bp, Mus musculus
tgggcctcctcatcattctcagcaa

SEQ ID NO: 890667 - DNA, 25 bp, Mus musculus
tgggcctcgacgcacacatctacaa

SEQ ID NO: 890668 - DNA, 25 bp, Mus musculus
tgggcctcgacggacacatctacaa

SEQ ID NO: 890669 - DNA, 25 bp, Mus musculus
tgggcctcgcagatgcctgtgtaca

SEQ ID NO: 890670 - DNA, 25 bp, Mus musculus
tgggcctcgcagttgcctgtgtaca

SEQ ID NO: 890671 - DNA, 25 bp, Mus musculus
tgggcctctacacgcggtttttcaa

SEQ ID NO: 890672 - DNA, 25 bp, Mus musculus
tgggcctctacaggcggtttttcaa

SEQ ID NO: 890673 - DNA, 25 bp, Mus musculus
tgggcctctaccagtacctgcatag

SEQ ID NO: 890674 - DNA, 25 bp, Mus musculus
tgggcctctaccatgacgtaactaa

SEQ ID NO: 890675 - DNA, 25 bp, Mus musculus
tgggcctctacctgtacctgcatag

SEQ ID NO: 890676 - DNA, 25 bp, Mus musculus
tgggcctctaccttgacgtaactaa

SEQ ID NO: 890677 - DNA, 25 bp, Mus musculus
tgggcctctatcctactggtgctga

SEQ ID NO: 890678 - DNA, 25 bp, Mus musculus
tgggcctctatcgtactggtgctga

SEQ ID NO: 890679 - DNA, 25 bp, Mus musculus
tgggcctctcatagacagctgagtc

SEQ ID NO: 890680 - DNA, 25 bp, Mus musculus
tgggcctctcattgacagctgagtc

SEQ ID NO: 890681 - DNA, 25 bp, Mus musculus
tgggcctctggcaacaatgccaagt

SEQ ID NO: 890682 - DNA, 25 bp, Mus musculus
tgggcctctggctacaatgccaagt

SEQ ID NO: 890683 - DNA, 25 bp, Mus musculus
tgggcctctgggaattgggtaacca

SEQ ID NO: 890684 - DNA, 25 bp, Mus musculus
tgggcctctgggtattgggtaacca

SEQ ID NO: 890685 - DNA, 25 bp, Mus musculus
tgggcctcttctcatgtacatagtg

SEQ ID NO: 890686 - DNA, 25 bp, Mus musculus
tgggcctcttctgatgtacatagtg

SEQ ID NO: 890687 - DNA, 25 bp, Mus musculus
tgggcctgaacccaggaacagtaag

SEQ ID NO: 890688 - DNA, 25 bp, Mus musculus
tgggcctgaaccgaggaacagtaag

SEQ ID NO: 890689 - DNA, 25 bp, Mus musculus
tgggcctgaagacatcagtcagcag

SEQ ID NO: 890690 - DNA, 25 bp, Mus musculus
tgggcctgaagagatcagtcagcag

SEQ ID NO: 890691 - DNA, 25 bp, Mus musculus
tgggcctgaaggagccagcacattg

SEQ ID NO: 890692 - DNA, 25 bp, Mus musculus
tgggcctgaaggtgccagcacattg

SEQ ID NO: 890693 - DNA, 25 bp, Mus musculus
tgggcctgacgccagctgaactagc

SEQ ID NO: 890694 - DNA, 25 bp, Mus musculus
tgggcctgacgcgagctgaactagc

SEQ ID NO: 890695 - DNA, 25 bp, Mus musculus
tgggcctgagcccttgattgtaccc

SEQ ID NO: 890696 - DNA, 25 bp, Mus musculus
tgggcctgagccgttgattgtaccc

SEQ ID NO: 890697 - DNA, 25 bp, Mus musculus
tgggcctgcacacggcaagcccttt

SEQ ID NO: 890698 - DNA, 25 bp, Mus musculus
tgggcctgcacagggcaagcccttt

SEQ ID NO: 890699 - DNA, 25 bp, Mus musculus
tgggcctgcagaccttttcggatgc

SEQ ID NO: 890700 - DNA, 25 bp, Mus musculus
tgggcctgcagagcttttcggatgc

SEQ ID NO: 890701 - DNA, 25 bp, Mus musculus
tgggcctgcagccatattgattcag

SEQ ID NO: 890702 - DNA, 25 bp, Mus musculus
tgggcctgcagcgatattgattcag

SEQ ID NO: 890703 - DNA, 25 bp, Mus musculus
tgggcctgcaggactctaatggacc

SEQ ID NO: 890704 - DNA, 25 bp, Mus musculus
tgggcctgcaggtctctaatggacc

SEQ ID NO: 890705 - DNA, 25 bp, Mus musculus
tgggcctgcatcagactggtgactt

SEQ ID NO: 890706 - DNA, 25 bp, Mus musculus
tgggcctgcatctgactggtgactt

SEQ ID NO: 890707 - DNA, 25 bp, Mus musculus
tgggcctgccctagagcctctacaa

SEQ ID NO: 890708 - DNA, 25 bp, Mus musculus
tgggcctgcccttgagcctctacaa

SEQ ID NO: 890709 - DNA, 25 bp, Mus musculus
tgggcctgctagagccctatagtag

SEQ ID NO: 890710 - DNA, 25 bp, Mus musculus
tgggcctgctagtgccctatagtag

SEQ ID NO: 890711 - DNA, 25 bp, Mus musculus
tgggcctgctcgacctacgttagag

SEQ ID NO: 890712 - DNA, 25 bp, Mus musculus
tgggcctgctcgtcctacgttagag

SEQ ID NO: 890713 - DNA, 25 bp, Mus musculus
tgggcctgctgtacacagttgccgg

SEQ ID NO: 890714 - DNA, 25 bp, Mus musculus
tgggcctgctgttcacagttgccgg

SEQ ID NO: 890715 - DNA, 25 bp, Mus musculus
tgggcctgcttcacatacattctag

SEQ ID NO: 890716 - DNA, 25 bp, Mus musculus
tgggcctgcttctcatacattctag

SEQ ID NO: 890717 - DNA, 25 bp, Mus musculus
tgggcctggaaaagagactcagctt

SEQ ID NO: 890718 - DNA, 25 bp, Mus musculus
tgggcctggaaatgagactcagctt

SEQ ID NO: 890719 - DNA, 25 bp, Mus musculus
tgggcctggcaaatttccacccatc

SEQ ID NO: 890720 - DNA, 25 bp, Mus musculus
tgggcctggcaattttccacccatc

SEQ ID NO: 890721 - DNA, 25 bp, Mus musculus
tgggcctggcacaatgatacgggca

SEQ ID NO: 890722 - DNA, 25 bp, Mus musculus
tgggcctggcactatgatacgggca

SEQ ID NO: 890723 - DNA, 25 bp, Mus musculus
tgggcctggcgaacctgattgttca

SEQ ID NO: 890724 - DNA, 25 bp, Mus musculus
tgggcctggcgatcctgattgttca

SEQ ID NO: 890725 - DNA, 25 bp, Mus musculus
tgggcctggctcagaagtgactctc

SEQ ID NO: 890726 - DNA, 25 bp, Mus musculus
tgggcctggctccaagggtcaccaa

SEQ ID NO: 890727 - DNA, 25 bp, Mus musculus
tgggcctggctcgaagggtcaccaa

SEQ ID NO: 890728 - DNA, 25 bp, Mus musculus
tgggcctggctctgaagtgactctc

SEQ ID NO: 890729 - DNA, 25 bp, Mus musculus
tgggcctggctgcttgctaacttag

SEQ ID NO: 890730 - DNA, 25 bp, Mus musculus
tgggcctggctggttgctaacttag

SEQ ID NO: 890731 - DNA, 25 bp, Mus musculus
tgggcctggcttaccagaccttttg

SEQ ID NO: 890732 - DNA, 25 bp, Mus musculus
tgggcctggctttccagaccttttg

SEQ ID NO: 890733 - DNA, 25 bp, Mus musculus
tgggcctgggaaccactaactgagt

SEQ ID NO: 890734 - DNA, 25 bp, Mus musculus
tgggcctgggaagcactaactgagt

SEQ ID NO: 890735 - DNA, 25 bp, Mus musculus
tgggcctggtccattagacaccatg

SEQ ID NO: 890736 - DNA, 25 bp, Mus musculus
tgggcctggtcctttagacaccatg

SEQ ID NO: 890737 - DNA, 25 bp, Mus musculus
tgggcctgtcacaaagcagcacgct

SEQ ID NO: 890738 - DNA, 25 bp, Mus musculus
tgggcctgtcactaagcagcacgct

SEQ ID NO: 890739 - DNA, 25 bp, Mus musculus
tgggcctgtgagagaacccaggtta

SEQ ID NO: 890740 - DNA, 25 bp, Mus musculus
tgggcctgtgagtgaacccaggtta

SEQ ID NO: 890741 - DNA, 25 bp, Mus musculus
tgggcctgtgtgcaagcacagcact

SEQ ID NO: 890742 - DNA, 25 bp, Mus musculus
tgggcctgtgtggaagcacagcact

SEQ ID NO: 890743 - DNA, 25 bp, Mus musculus
tgggccttaactctatgtccgtggt

SEQ ID NO: 890744 - DNA, 25 bp, Mus musculus
tgggccttaactgtatgtccgtggt

SEQ ID NO: 890745 - DNA, 25 bp, Mus musculus
tgggccttaattagcattgtactct

SEQ ID NO: 890746 - DNA, 25 bp, Mus musculus
tgggccttaatttgcattgtactct

SEQ ID NO: 890747 - DNA, 25 bp, Mus musculus
tgggccttacttcctccagctgcga

SEQ ID NO: 890748 - DNA, 25 bp, Mus musculus
tgggccttacttgctccagctgcga

SEQ ID NO: 890749 - DNA, 25 bp, Mus musculus
tgggccttagacacgggtggtggca

SEQ ID NO: 890750 - DNA, 25 bp, Mus musculus
tgggccttagactcgggtggtggca

SEQ ID NO: 890751 - DNA, 25 bp, Mus musculus
tgggccttagagagatcttgattct

SEQ ID NO: 890752 - DNA, 25 bp, Mus musculus
tgggccttagagtgatcttgattct

SEQ ID NO: 890753 - DNA, 25 bp, Mus musculus
tgggccttaggcacctcaaggactt

SEQ ID NO: 890754 - DNA, 25 bp, Mus musculus
tgggccttaggctcctcaaggactt

SEQ ID NO: 890755 - DNA, 25 bp, Mus musculus
tgggccttatataactcgagtggac

SEQ ID NO: 890756 - DNA, 25 bp, Mus musculus
tgggccttatattactcgagtggac

SEQ ID NO: 890757 - DNA, 25 bp, Mus musculus
tgggccttatccaggacatggtgtg

SEQ ID NO: 890758 - DNA, 25 bp, Mus musculus
tgggccttatcctggacatggtgtg

SEQ ID NO: 890759 - DNA, 25 bp, Mus musculus
tgggccttattaaggccgcggaagc

SEQ ID NO: 890760 - DNA, 25 bp, Mus musculus
tgggccttattatggccgcggaagc

SEQ ID NO: 890761 - DNA, 25 bp, Mus musculus
tgggccttattcaagctgaacttct

SEQ ID NO: 890762 - DNA, 25 bp, Mus musculus
tgggccttattctagctgaacttct

SEQ ID NO: 890763 - DNA, 25 bp, Mus musculus
tgggccttccagagcatgttgctta

SEQ ID NO: 890764 - DNA, 25 bp, Mus musculus
tgggccttccagtgcatgttgctta

SEQ ID NO: 890765 - DNA, 25 bp, Mus musculus
tgggccttctggaggtaaacatgcc

SEQ ID NO: 890766 - DNA, 25 bp, Mus musculus
tgggccttctggtggtaaacatgcc

SEQ ID NO: 890767 - DNA, 25 bp, Mus musculus
tgggccttgaggacccggtccttgc

SEQ ID NO: 890768 - DNA, 25 bp, Mus musculus
tgggccttgaggtcccggtccttgc

SEQ ID NO: 890769 - DNA, 25 bp, Mus musculus
tgggccttgcgaatgctggaaagca

SEQ ID NO: 890770 - DNA, 25 bp, Mus musculus
tgggccttgcgattgctggaaagca

SEQ ID NO: 890771 - DNA, 25 bp, Mus musculus
tgggccttggccacaagatggaacc

SEQ ID NO: 890772 - DNA, 25 bp, Mus musculus
tgggccttggccatcatggctccca

SEQ ID NO: 890773 - DNA, 25 bp, Mus musculus
tgggccttggccctacagagagaaa

SEQ ID NO: 890774 - DNA, 25 bp, Mus musculus
tgggccttggccgtacagagagaaa

SEQ ID NO: 890775 - DNA, 25 bp, Mus musculus
tgggccttggcctcaagatggaacc

SEQ ID NO: 890776 - DNA, 25 bp, Mus musculus
tgggccttggccttcatggctccca

SEQ ID NO: 890777 - DNA, 25 bp, Mus musculus
tgggccttgtccatacagccaaata

SEQ ID NO: 890778 - DNA, 25 bp, Mus musculus
tgggccttgtccttacagccaaata

SEQ ID NO: 890779 - DNA, 25 bp, Mus musculus
tgggcctttctcagctagctgctag

SEQ ID NO: 890780 - DNA, 25 bp, Mus musculus
tgggcctttctctgctagctgctag

SEQ ID NO: 890781 - DNA, 25 bp, Mus musculus
tgggcctttgaaaagctacctcgag

SEQ ID NO: 890782 - DNA, 25 bp, Mus musculus
tgggcctttgaactgcgtgcctgcc

SEQ ID NO: 890783 - DNA, 25 bp, Mus musculus
tgggcctttgaagtgcgtgcctgcc

SEQ ID NO: 890784 - DNA, 25 bp, Mus musculus
tgggcctttgaatagctacctcgag

SEQ ID NO: 890785 - DNA, 25 bp, Mus musculus
tgggcctttggaccttgtcccctaa

SEQ ID NO: 890786 - DNA, 25 bp, Mus musculus
tgggcctttggagcttgtcccctaa

SEQ ID NO: 890787 - DNA, 25 bp, Mus musculus
tgggcctttggcaagactctgtttt

SEQ ID NO: 890788 - DNA, 25 bp, Mus musculus
tgggcctttggctagactctgtttt

SEQ ID NO: 890789 - DNA, 25 bp, Mus musculus
tgggccttttctcttggttacctgt

SEQ ID NO: 890790 - DNA, 25 bp, Mus musculus
tgggccttttctgttggttacctgt

SEQ ID NO: 890791 - DNA, 25 bp, Mus musculus
tgggcgaacacacgagcctcatgtt

SEQ ID NO: 890792 - DNA, 25 bp, Mus musculus
tgggcgaacacaggagcctcatgtt

SEQ ID NO: 890793 - DNA, 25 bp, Mus musculus
tgggcgaaccccacttggcatgtcc

SEQ ID NO: 890794 - DNA, 25 bp, Mus musculus
tgggcgaacccctcttggcatgtcc

SEQ ID NO: 890795 - DNA, 25 bp, Mus musculus
tgggcgaagcttagttgccctacta

SEQ ID NO: 890796 - DNA, 25 bp, Mus musculus
tgggcgaagctttgttgccctacta

SEQ ID NO: 890797 - DNA, 25 bp, Mus musculus
tgggcgaagttcaaataaggtgtaa

SEQ ID NO: 890798 - DNA, 25 bp, Mus musculus
tgggcgaagttctaataaggtgtaa

SEQ ID NO: 890799 - DNA, 25 bp, Mus musculus
tgggcgaccctgaaaactggcacat

SEQ ID NO: 890800 - DNA, 25 bp, Mus musculus
tgggcgaccctgtaaactggcacat

SEQ ID NO: 890801 - DNA, 25 bp, Mus musculus
tgggcgagattcagccttctgggac

SEQ ID NO: 890802 - DNA, 25 bp, Mus musculus
tgggcgagattctgccttctgggac

SEQ ID NO: 890803 - DNA, 25 bp, Mus musculus
tgggcgaggacgagctatttaccct

SEQ ID NO: 890804 - DNA, 25 bp, Mus musculus
tgggcgaggacgtgctatttaccct

SEQ ID NO: 890805 - DNA, 25 bp, Mus musculus
tgggcgaggcgcacttttctacata

SEQ ID NO: 890806 - DNA, 25 bp, Mus musculus
tgggcgaggcgctcttttctacata

SEQ ID NO: 890807 - DNA, 25 bp, Mus musculus
tgggcgagggacatgcaattactat

SEQ ID NO: 890808 - DNA, 25 bp, Mus musculus
tgggcgagggacttgcaattactat

SEQ ID NO: 890809 - DNA, 25 bp, Mus musculus
tgggcgagggccagaccattccttt

SEQ ID NO: 890810 - DNA, 25 bp, Mus musculus
tgggcgagggcctgaccattccttt

SEQ ID NO: 890811 - DNA, 25 bp, Mus musculus
tgggcgaggtcacagactcaacatt

SEQ ID NO: 890812 - DNA, 25 bp, Mus musculus
tgggcgaggtcagagactcaacatt

SEQ ID NO: 890813 - DNA, 25 bp, Mus musculus
tgggcgaggtctattctctggtgac

SEQ ID NO: 890814 - DNA, 25 bp, Mus musculus
tgggcgaggtcttttctctggtgac

SEQ ID NO: 890815 - DNA, 25 bp, Mus musculus
tgggcgatgccaaagactgactcct

SEQ ID NO: 890816 - DNA, 25 bp, Mus musculus
tgggcgatgccatagactgactcct

SEQ ID NO: 890817 - DNA, 25 bp, Mus musculus
tgggcgcaagcgctacagtcatctg

SEQ ID NO: 890818 - DNA, 25 bp, Mus musculus
tgggcgcaagcggtacagtcatctg

SEQ ID NO: 890819 - DNA, 25 bp, Mus musculus
tgggcgcatcacattcagacaacag

SEQ ID NO: 890820 - DNA, 25 bp, Mus musculus
tgggcgcatcactttcagacaacag

SEQ ID NO: 890821 - DNA, 25 bp, Mus musculus
tgggcgcatgttatcatcactgaat

SEQ ID NO: 890822 - DNA, 25 bp, Mus musculus
tgggcgcatgttttcatcactgaat

SEQ ID NO: 890823 - DNA, 25 bp, Mus musculus
tgggcgccaaacagctgttccggga

SEQ ID NO: 890824 - DNA, 25 bp, Mus musculus
tgggcgccaaactgctgttccggga

SEQ ID NO: 890825 - DNA, 25 bp, Mus musculus
tgggcgccagcgaacgttcaccaac

SEQ ID NO: 890826 - DNA, 25 bp, Mus musculus
tgggcgccagcgtacgttcaccaac

SEQ ID NO: 890827 - DNA, 25 bp, Mus musculus
tgggcgccagctcacacaggctaaa

SEQ ID NO: 890828 - DNA, 25 bp, Mus musculus
tgggcgccagctgacacaggctaaa

SEQ ID NO: 890829 - DNA, 25 bp, Mus musculus
tgggcgcctcggatttcatgtggat

SEQ ID NO: 890830 - DNA, 25 bp, Mus musculus
tgggcgcctcggttttcatgtggat

SEQ ID NO: 890831 - DNA, 25 bp, Mus musculus
tgggcgcctgtaatatactttgtac

SEQ ID NO: 890832 - DNA, 25 bp, Mus musculus
tgggcgcctgtattatactttgtac

SEQ ID NO: 890833 - DNA, 25 bp, Mus musculus
tgggcgccttccaggatcatggaaa

SEQ ID NO: 890834 - DNA, 25 bp, Mus musculus
tgggcgccttcctggatcatggaaa

SEQ ID NO: 890835 - DNA, 25 bp, Mus musculus
tgggcgccttgtagtcctcatgggt

SEQ ID NO: 890836 - DNA, 25 bp, Mus musculus
tgggcgccttgttgtcctcatgggt

SEQ ID NO: 890837 - DNA, 25 bp, Mus musculus
tgggcgcgctggccatcatgaacaa

SEQ ID NO: 890838 - DNA, 25 bp, Mus musculus
tgggcgcgctgggcatcatgaacaa

SEQ ID NO: 890839 - DNA, 25 bp, Mus musculus
tgggcgcggcggaactcatacacac

SEQ ID NO: 890840 - DNA, 25 bp, Mus musculus
tgggcgcggcggtactcatacacac

SEQ ID NO: 890841 - DNA, 25 bp, Mus musculus
tgggcgctttggacaggactgtaca

SEQ ID NO: 890842 - DNA, 25 bp, Mus musculus
tgggcgctttggtcaggactgtaca

SEQ ID NO: 890843 - DNA, 25 bp, Mus musculus
tgggcggaaccaaccctagacaggt

SEQ ID NO: 890844 - DNA, 25 bp, Mus musculus
tgggcggaaccatccctagacaggt

SEQ ID NO: 890845 - DNA, 25 bp, Mus musculus
tgggcggaagtcattcgaggcctta

SEQ ID NO: 890846 - DNA, 25 bp, Mus musculus
tgggcggaagtctttcgaggcctta

SEQ ID NO: 890847 - DNA, 25 bp, Mus musculus
tgggcggagacgcttactgctcaaa

SEQ ID NO: 890848 - DNA, 25 bp, Mus musculus
tgggcggagacggttactgctcaaa

SEQ ID NO: 890849 - DNA, 25 bp, Mus musculus
tgggcggagtctaccacctggaaaa

SEQ ID NO: 890850 - DNA, 25 bp, Mus musculus
tgggcggagtcttccacctggaaaa

SEQ ID NO: 890851 - DNA, 25 bp, Mus musculus
tgggcggatgtacgttctcctccaa

SEQ ID NO: 890852 - DNA, 25 bp, Mus musculus
tgggcggatgtaggttctcctccaa

SEQ ID NO: 890853 - DNA, 25 bp, Mus musculus
tgggcggcaccaagatcatagcgct

SEQ ID NO: 890854 - DNA, 25 bp, Mus musculus
tgggcggcaccatgatcatagcgct

SEQ ID NO: 890855 - DNA, 25 bp, Mus musculus
tgggcggtgattctggtcacaccct

SEQ ID NO: 890856 - DNA, 25 bp, Mus musculus
tgggcggtgattgtggtcacaccct

SEQ ID NO: 890857 - DNA, 25 bp, Mus musculus
tgggcgtaggttctgtgctttcaca

SEQ ID NO: 890858 - DNA, 25 bp, Mus musculus
tgggcgtaggttgtgtgctttcaca

SEQ ID NO: 890859 - DNA, 25 bp, Mus musculus
tgggcgtctccacaactcatggtga

SEQ ID NO: 890860 - DNA, 25 bp, Mus musculus
tgggcgtctccagaactcatggtga

SEQ ID NO: 890861 - DNA, 25 bp, Mus musculus
tgggcgtctgccaacttttggaaca

SEQ ID NO: 890862 - DNA, 25 bp, Mus musculus
tgggcgtctgccagtacatgcagga

SEQ ID NO: 890863 - DNA, 25 bp, Mus musculus
tgggcgtctgcctacttttggaaca

SEQ ID NO: 890864 - DNA, 25 bp, Mus musculus
tgggcgtctgcctgtacatgcagga

SEQ ID NO: 890865 - DNA, 25 bp, Mus musculus
tgggcgtcttgaacaggcctgagtc

SEQ ID NO: 890866 - DNA, 25 bp, Mus musculus
tgggcgtcttgatcaggcctgagtc

SEQ ID NO: 890867 - DNA, 25 bp, Mus musculus
tgggcgtgagccactggtacaaaag

SEQ ID NO: 890868 - DNA, 25 bp, Mus musculus
tgggcgtgagcctctggtacaaaag

SEQ ID NO: 890869 - DNA, 25 bp, Mus musculus
tgggcgtggaccagacctccaaggt

SEQ ID NO: 890870 - DNA, 25 bp, Mus musculus
tgggcgtggacctgacctccaaggt

SEQ ID NO: 890871 - DNA, 25 bp, Mus musculus
tgggcgttcaggaaacacaggcatc

SEQ ID NO: 890872 - DNA, 25 bp, Mus musculus
tgggcgttcaggtaacacaggcatc

SEQ ID NO: 890873 - DNA, 25 bp, Mus musculus
tgggcgttcttcacacgagtgttaa

SEQ ID NO: 890874 - DNA, 25 bp, Mus musculus
tgggcgttcttctcacgagtgttaa

SEQ ID NO: 890875 - DNA, 25 bp, Mus musculus
tgggcgttttacagcagggagctaa

SEQ ID NO: 890876 - DNA, 25 bp, Mus musculus
tgggcgttttactgcagggagctaa

SEQ ID NO: 890877 - DNA, 25 bp, Mus musculus
tgggctaagaagactcacacagcac

SEQ ID NO: 890878 - DNA, 25 bp, Mus musculus
tgggctaagaagtctcacacagcac

SEQ ID NO: 890879 - DNA, 25 bp, Mus musculus
tgggctaaggaaaagtttctttcaa

SEQ ID NO: 890880 - DNA, 25 bp, Mus musculus
tgggctaaggaatagtttctttcaa

SEQ ID NO: 890881 - DNA, 25 bp, Mus musculus
tgggctaagtccatcgtagttttct

SEQ ID NO: 890882 - DNA, 25 bp, Mus musculus
tgggctaagtccttcgtagttttct

SEQ ID NO: 890883 - DNA, 25 bp, Mus musculus
tgggctaagtctccttcacagaagt

SEQ ID NO: 890884 - DNA, 25 bp, Mus musculus
tgggctaagtctgcttcacagaagt

SEQ ID NO: 890885 - DNA, 25 bp, Mus musculus
tgggctaataacacacccggcaggt

SEQ ID NO: 890886 - DNA, 25 bp, Mus musculus
tgggctaataactcacccggcaggt

SEQ ID NO: 890887 - DNA, 25 bp, Mus musculus
tgggctaatgtcacttttatccttg

SEQ ID NO: 890888 - DNA, 25 bp, Mus musculus
tgggctaatgtctcttttatccttg

SEQ ID NO: 890889 - DNA, 25 bp, Mus musculus
tgggctacacccaagatgagggcca

SEQ ID NO: 890890 - DNA, 25 bp, Mus musculus
tgggctacaccctagatgagggcca

SEQ ID NO: 890891 - DNA, 25 bp, Mus musculus
tgggctacactgaggaccaggttgt

SEQ ID NO: 890892 - DNA, 25 bp, Mus musculus
tgggctacactgtggaccaggttgt

SEQ ID NO: 890893 - DNA, 25 bp, Mus musculus
tgggctacacttctcagccaggttt

SEQ ID NO: 890894 - DNA, 25 bp, Mus musculus
tgggctacacttctccaggcatgaa

SEQ ID NO: 890895 - DNA, 25 bp, Mus musculus
tgggctacacttgtcagccaggttt

SEQ ID NO: 890896 - DNA, 25 bp, Mus musculus
tgggctacacttgtccaggcatgaa

SEQ ID NO: 890897 - DNA, 25 bp, Mus musculus
tgggctacagctactaagcaccact

SEQ ID NO: 890898 - DNA, 25 bp, Mus musculus
tgggctacagcttctaagcaccact

SEQ ID NO: 890899 - DNA, 25 bp, Mus musculus
tgggctacaggccacaccttaagag

SEQ ID NO: 890900 - DNA, 25 bp, Mus musculus
tgggctacaggcgacaccttaagag

SEQ ID NO: 890901 - DNA, 25 bp, Mus musculus
tgggctacataacaagagctgctag

SEQ ID NO: 890902 - DNA, 25 bp, Mus musculus
tgggctacataagaagagctgctag

SEQ ID NO: 890903 - DNA, 25 bp, Mus musculus
tgggctacatggcactctatcttta

SEQ ID NO: 890904 - DNA, 25 bp, Mus musculus
tgggctacatgggactctatcttta

SEQ ID NO: 890905 - DNA, 25 bp, Mus musculus
tgggctaccaataaacttcttctga

SEQ ID NO: 890906 - DNA, 25 bp, Mus musculus
tgggctaccaattaacttcttctga

SEQ ID NO: 890907 - DNA, 25 bp, Mus musculus
tgggctaccagacacggcggtttct

SEQ ID NO: 890908 - DNA, 25 bp, Mus musculus
tgggctaccagagacggcggtttct

SEQ ID NO: 890909 - DNA, 25 bp, Mus musculus
tgggctaccagcactcttgatcgtg

SEQ ID NO: 890910 - DNA, 25 bp, Mus musculus
tgggctaccagctctcttgatcgtg

SEQ ID NO: 890911 - DNA, 25 bp, Mus musculus
tgggctacctcactagccctaaggg

SEQ ID NO: 890912 - DNA, 25 bp, Mus musculus
tgggctacctcagtagccctaaggg

SEQ ID NO: 890913 - DNA, 25 bp, Mus musculus
tgggctacctcccatgacagaaacg

SEQ ID NO: 890914 - DNA, 25 bp, Mus musculus
tgggctacctccgatgacagaaacg

SEQ ID NO: 890915 - DNA, 25 bp, Mus musculus
tgggctaccttcattctgagcaacc

SEQ ID NO: 890916 - DNA, 25 bp, Mus musculus
tgggctaccttctttctgagcaacc

SEQ ID NO: 890917 - DNA, 25 bp, Mus musculus
tgggctacgagcacattctcatcat

SEQ ID NO: 890918 - DNA, 25 bp, Mus musculus
tgggctacgagctcattctcatcat

SEQ ID NO: 890919 - DNA, 25 bp, Mus musculus
tgggctacgtagaccctatctcaga

SEQ ID NO: 890920 - DNA, 25 bp, Mus musculus
tgggctacgtagtccctatctcaga

SEQ ID NO: 890921 - DNA, 25 bp, Mus musculus
tgggctacgtgcagggcattactat

SEQ ID NO: 890922 - DNA, 25 bp, Mus musculus
tgggctacgtgctgggcattactat

SEQ ID NO: 890923 - DNA, 25 bp, Mus musculus
tgggctactggtccctgtacatcgc

SEQ ID NO: 890924 - DNA, 25 bp, Mus musculus
tgggctactggtgcctgtacatcgc

SEQ ID NO: 890925 - DNA, 25 bp, Mus musculus
tgggctacttccaagtccctaagaa

SEQ ID NO: 890926 - DNA, 25 bp, Mus musculus
tgggctacttcctagtccctaagaa

SEQ ID NO: 890927 - DNA, 25 bp, Mus musculus
tgggctagcaggcaggttcctccat

SEQ ID NO: 890928 - DNA, 25 bp, Mus musculus
tgggctagcagggaggttcctccat

SEQ ID NO: 890929 - DNA, 25 bp, Mus musculus
tgggctagcattaccctttaagcat

SEQ ID NO: 890930 - DNA, 25 bp, Mus musculus
tgggctagcatttccctttaagcat

SEQ ID NO: 890931 - DNA, 25 bp, Mus musculus
tgggctagccgaagaatgttgactc

SEQ ID NO: 890932 - DNA, 25 bp, Mus musculus
tgggctagccgatgaatgttgactc

SEQ ID NO: 890933 - DNA, 25 bp, Mus musculus
tgggctagcctgagtggcctctgca

SEQ ID NO: 890934 - DNA, 25 bp, Mus musculus
tgggctagcctgtgtggcctctgca

SEQ ID NO: 890935 - DNA, 25 bp, Mus musculus
tgggctaggcagctccttaagtgct

SEQ ID NO: 890936 - DNA, 25 bp, Mus musculus
tgggctaggcaggtccttaagtgct

SEQ ID NO: 890937 - DNA, 25 bp, Mus musculus
tgggctagggaaatgtctgcacacc

SEQ ID NO: 890938 - DNA, 25 bp, Mus musculus
tgggctagggaattgtctgcacacc

SEQ ID NO: 890939 - DNA, 25 bp, Mus musculus
tgggctaggtcactccacctctctg

SEQ ID NO: 890940 - DNA, 25 bp, Mus musculus
tgggctaggtcagtccacctctctg

SEQ ID NO: 890941 - DNA, 25 bp, Mus musculus
tgggctagtctacattcagaaggaa

SEQ ID NO: 890942 - DNA, 25 bp, Mus musculus
tgggctagtctagattcagaaggaa

SEQ ID NO: 890943 - DNA, 25 bp, Mus musculus
tgggctagttatcgcttcacactcc

SEQ ID NO: 890944 - DNA, 25 bp, Mus musculus
tgggctagttatggcttcacactcc

SEQ ID NO: 890945 - DNA, 25 bp, Mus musculus
tgggctatatctcctgcagtagcgg

SEQ ID NO: 890946 - DNA, 25 bp, Mus musculus
tgggctatatctgctgcagtagcgg

SEQ ID NO: 890947 - DNA, 25 bp, Mus musculus
tgggctatcaaaattcagacctagt

SEQ ID NO: 890948 - DNA, 25 bp, Mus musculus
tgggctatcaaatttcagacctagt

SEQ ID NO: 890949 - DNA, 25 bp, Mus musculus
tgggctatcagaacggcgccttcgg

SEQ ID NO: 890950 - DNA, 25 bp, Mus musculus
tgggctatcagaaggcctggcatga

SEQ ID NO: 890951 - DNA, 25 bp, Mus musculus
tgggctatcagatcggcgccttcgg

SEQ ID NO: 890952 - DNA, 25 bp, Mus musculus
tgggctatcagatggcctggcatga

SEQ ID NO: 890953 - DNA, 25 bp, Mus musculus
tgggctatgcccagctcagtggcat

SEQ ID NO: 890954 - DNA, 25 bp, Mus musculus
tgggctatgccctgctcagtggcat

SEQ ID NO: 890955 - DNA, 25 bp, Mus musculus
tgggctatggcaaccgctctaacat

SEQ ID NO: 890956 - DNA, 25 bp, Mus musculus
tgggctatggcatccgctctaacat

SEQ ID NO: 890957 - DNA, 25 bp, Mus musculus
tgggctatgggacacgatcaaatca

SEQ ID NO: 890958 - DNA, 25 bp, Mus musculus
tgggctatgggagacgatcaaatca

SEQ ID NO: 890959 - DNA, 25 bp, Mus musculus
tgggctatgtgtcagaccctctcag

SEQ ID NO: 890960 - DNA, 25 bp, Mus musculus
tgggctatgtgtgagaccctctcag

SEQ ID NO: 890961 - DNA, 25 bp, Mus musculus
tgggctcaattcacttccttatttg

SEQ ID NO: 890962 - DNA, 25 bp, Mus musculus
tgggctcaattctcttccttatttg

SEQ ID NO: 890963 - DNA, 25 bp, Mus musculus
tgggctcacagtacagggtactaag

SEQ ID NO: 890964 - DNA, 25 bp, Mus musculus
tgggctcacagttcagggtactaag

SEQ ID NO: 890965 - DNA, 25 bp, Mus musculus
tgggctcacatacaaatgtacacag

SEQ ID NO: 890966 - DNA, 25 bp, Mus musculus
tgggctcacatagaaatgtacacag

SEQ ID NO: 890967 - DNA, 25 bp, Mus musculus
tgggctcaccttaatggatttcata

SEQ ID NO: 890968 - DNA, 25 bp, Mus musculus
tgggctcacctttatggatttcata

SEQ ID NO: 890969 - DNA, 25 bp, Mus musculus
tgggctcactgcacaaatcagcaag

SEQ ID NO: 890970 - DNA, 25 bp, Mus musculus
tgggctcactgctcaaatcagcaag

SEQ ID NO: 890971 - DNA, 25 bp, Mus musculus
tgggctcacttaatacaaagacaga

SEQ ID NO: 890972 - DNA, 25 bp, Mus musculus
tgggctcacttactaggtctatggt

SEQ ID NO: 890973 - DNA, 25 bp, Mus musculus
tgggctcacttagtaggtctatggt

SEQ ID NO: 890974 - DNA, 25 bp, Mus musculus
tgggctcacttattacaaagacaga

SEQ ID NO: 890975 - DNA, 25 bp, Mus musculus
tgggctcagaccaggaggacagcaa

SEQ ID NO: 890976 - DNA, 25 bp, Mus musculus
tgggctcagacctggaggacagcaa

SEQ ID NO: 890977 - DNA, 25 bp, Mus musculus
tgggctcagatacactatgatgtca

SEQ ID NO: 890978 - DNA, 25 bp, Mus musculus
tgggctcagatagactatgatgtca

SEQ ID NO: 890979 - DNA, 25 bp, Mus musculus
tgggctcagcctccagatggtacaa

SEQ ID NO: 890980 - DNA, 25 bp, Mus musculus
tgggctcagcctgcagatggtacaa

SEQ ID NO: 890981 - DNA, 25 bp, Mus musculus
tgggctcagctgaagggcatgtcat

SEQ ID NO: 890982 - DNA, 25 bp, Mus musculus
tgggctcagctgtagggcatgtcat

SEQ ID NO: 890983 - DNA, 25 bp, Mus musculus
tgggctcagtcaatgtttcaagtat

SEQ ID NO: 890984 - DNA, 25 bp, Mus musculus
tgggctcagtcattgtttcaagtat

SEQ ID NO: 890985 - DNA, 25 bp, Mus musculus
tgggctcagttccacacttgatctt

SEQ ID NO: 890986 - DNA, 25 bp, Mus musculus
tgggctcagttcgacacttgatctt

SEQ ID NO: 890987 - DNA, 25 bp, Mus musculus
tgggctcataaactgactactgttt

SEQ ID NO: 890988 - DNA, 25 bp, Mus musculus
tgggctcataaagtgactactgttt

SEQ ID NO: 890989 - DNA, 25 bp, Mus musculus
tgggctcatcctctggaacccagaa

SEQ ID NO: 890990 - DNA, 25 bp, Mus musculus
tgggctcatcctgtggaacccagaa

SEQ ID NO: 890991 - DNA, 25 bp, Mus musculus
tgggctcatggcaccagagatgtat

SEQ ID NO: 890992 - DNA, 25 bp, Mus musculus
tgggctcatggctccagagatgtat

SEQ ID NO: 890993 - DNA, 25 bp, Mus musculus
tgggctcattaaatctactagggtg

SEQ ID NO: 890994 - DNA, 25 bp, Mus musculus
tgggctcattaattctactagggtg

SEQ ID NO: 890995 - DNA, 25 bp, Mus musculus
tgggctcattacacagtgtgaggct

SEQ ID NO: 890996 - DNA, 25 bp, Mus musculus
tgggctcattactcagtgtgaggct

SEQ ID NO: 890997 - DNA, 25 bp, Mus musculus
tgggctccaacccttatgattgtgg

SEQ ID NO: 890998 - DNA, 25 bp, Mus musculus
tgggctccaaccgttatgattgtgg

SEQ ID NO: 890999 - DNA, 25 bp, Mus musculus
tgggctccaagcagatgacgagact

SEQ ID NO: 891000 - DNA, 25 bp, Mus musculus
tgggctccaagctgatgacgagact

SEQ ID NO: 891001 - DNA, 25 bp, Mus musculus
tgggctccacaacagagatctgcag

SEQ ID NO: 891002 - DNA, 25 bp, Mus musculus
tgggctccacaagagagatctgcag

SEQ ID NO: 891003 - DNA, 25 bp, Mus musculus
tgggctccacataccaatgcaagct

SEQ ID NO: 891004 - DNA, 25 bp, Mus musculus
tgggctccacattccaatgcaagct

SEQ ID NO: 891005 - DNA, 25 bp, Mus musculus
tgggctccactcatactgggtcagt

SEQ ID NO: 891006 - DNA, 25 bp, Mus musculus
tgggctccactcttactgggtcagt

SEQ ID NO: 891007 - DNA, 25 bp, Mus musculus
tgggctccactgatacacacactcg

SEQ ID NO: 891008 - DNA, 25 bp, Mus musculus
tgggctccactgttacacacactcg

SEQ ID NO: 891009 - DNA, 25 bp, Mus musculus
tgggctccagcacactttaacacat

SEQ ID NO: 891010 - DNA, 25 bp, Mus musculus
tgggctccagcaccacgagaaaagc

SEQ ID NO: 891011 - DNA, 25 bp, Mus musculus
tgggctccagcagactttaacacat

SEQ ID NO: 891012 - DNA, 25 bp, Mus musculus
tgggctccagcagcacgagaaaagc

SEQ ID NO: 891013 - DNA, 25 bp, Mus musculus
tgggctccaggaatcagtttgtgta

SEQ ID NO: 891014 - DNA, 25 bp, Mus musculus
tgggctccaggattcagtttgtgta

SEQ ID NO: 891015 - DNA, 25 bp, Mus musculus
tgggctccaggcctgaaagtgcttc

SEQ ID NO: 891016 - DNA, 25 bp, Mus musculus
tgggctccaggcgtgaaagtgcttc

SEQ ID NO: 891017 - DNA, 25 bp, Mus musculus
tgggctccagtgaccagccagggcc

SEQ ID NO: 891018 - DNA, 25 bp, Mus musculus
tgggctccagtgtccagccagggcc

SEQ ID NO: 891019 - DNA, 25 bp, Mus musculus
tgggctccataacttgctttactct

SEQ ID NO: 891020 - DNA, 25 bp, Mus musculus
tgggctccataagttgctttactct

SEQ ID NO: 891021 - DNA, 25 bp, Mus musculus
tgggctccatagattgttcctaata

SEQ ID NO: 891022 - DNA, 25 bp, Mus musculus
tgggctccatagtttgttcctaata

SEQ ID NO: 891023 - DNA, 25 bp, Mus musculus
tgggctccatctcacagcagaacat

SEQ ID NO: 891024 - DNA, 25 bp, Mus musculus
tgggctccatctgacagcagaacat

SEQ ID NO: 891025 - DNA, 25 bp, Mus musculus
tgggctccatgtcgtctctgatggt

SEQ ID NO: 891026 - DNA, 25 bp, Mus musculus
tgggctccatgtggtctctgatggt

SEQ ID NO: 891027 - DNA, 25 bp, Mus musculus
tgggctcccactataatttttctct

SEQ ID NO: 891028 - DNA, 25 bp, Mus musculus
tgggctcccactttaatttttctct

SEQ ID NO: 891029 - DNA, 25 bp, Mus musculus
tgggctcccggtaagactagatcct

SEQ ID NO: 891030 - DNA, 25 bp, Mus musculus
tgggctcccggttagactagatcct

SEQ ID NO: 891031 - DNA, 25 bp, Mus musculus
tgggctccctgtatggagtctggca

SEQ ID NO: 891032 - DNA, 25 bp, Mus musculus
tgggctccctgtctagcagatggca

SEQ ID NO: 891033 - DNA, 25 bp, Mus musculus
tgggctccctgtgtagcagatggca

SEQ ID NO: 891034 - DNA, 25 bp, Mus musculus
tgggctccctgtttggagtctggca

SEQ ID NO: 891035 - DNA, 25 bp, Mus musculus
tgggctccgctcactgaagaagaac

SEQ ID NO: 891036 - DNA, 25 bp, Mus musculus
tgggctccgctctctgaagaagaac

SEQ ID NO: 891037 - DNA, 25 bp, Mus musculus
tgggctccggctaccacaaaggcgt

SEQ ID NO: 891038 - DNA, 25 bp, Mus musculus
tgggctccggcttccacaaaggcgt

SEQ ID NO: 891039 - DNA, 25 bp, Mus musculus
tgggctccggttaatggcagccgca

SEQ ID NO: 891040 - DNA, 25 bp, Mus musculus
tgggctccggtttatggcagccgca

SEQ ID NO: 891041 - DNA, 25 bp, Mus musculus
tgggctcctgacaattgtgtgttac

SEQ ID NO: 891042 - DNA, 25 bp, Mus musculus
tgggctcctgactattgtgtgttac

SEQ ID NO: 891043 - DNA, 25 bp, Mus musculus
tgggctcctggtagatggctaatgc

SEQ ID NO: 891044 - DNA, 25 bp, Mus musculus
tgggctcctggttgatggctaatgc

SEQ ID NO: 891045 - DNA, 25 bp, Mus musculus
tgggctcctttcaggctacatatat

SEQ ID NO: 891046 - DNA, 25 bp, Mus musculus
tgggctcctttctggctacatatat

SEQ ID NO: 891047 - DNA, 25 bp, Mus musculus
tgggctccttttaatactgattaca

SEQ ID NO: 891048 - DNA, 25 bp, Mus musculus
tgggctcctttttatactgattaca

SEQ ID NO: 891049 - DNA, 25 bp, Mus musculus
tgggctcgaacaactgccaaggctt

SEQ ID NO: 891050 - DNA, 25 bp, Mus musculus
tgggctcgaacatctgccaaggctt

SEQ ID NO: 891051 - DNA, 25 bp, Mus musculus
tgggctcgagccactttgctgttcc

SEQ ID NO: 891052 - DNA, 25 bp, Mus musculus
tgggctcgagcctctttgctgttcc

SEQ ID NO: 891053 - DNA, 25 bp, Mus musculus
tgggctcgaggtcgcaagtttatcc

SEQ ID NO: 891054 - DNA, 25 bp, Mus musculus
tgggctcgaggtggcaagtttatcc

SEQ ID NO: 891055 - DNA, 25 bp, Mus musculus
tgggctcgatcgctcttggtccttg

SEQ ID NO: 891056 - DNA, 25 bp, Mus musculus
tgggctcgatcggtcttggtccttg

SEQ ID NO: 891057 - DNA, 25 bp, Mus musculus
tgggctcgcaaccttttaagcacta

SEQ ID NO: 891058 - DNA, 25 bp, Mus musculus
tgggctcgcaacgttttaagcacta

SEQ ID NO: 891059 - DNA, 25 bp, Mus musculus
tgggctcgcagacctagctgactca

SEQ ID NO: 891060 - DNA, 25 bp, Mus musculus
tgggctcgcagagctagctgactca

SEQ ID NO: 891061 - DNA, 25 bp, Mus musculus
tgggctcggttgaatactcttcgtt

SEQ ID NO: 891062 - DNA, 25 bp, Mus musculus
tgggctcggttgtatactcttcgtt

SEQ ID NO: 891063 - DNA, 25 bp, Mus musculus
tgggctctaactccacttttggtgt

SEQ ID NO: 891064 - DNA, 25 bp, Mus musculus
tgggctctaactgcacttttggtgt

SEQ ID NO: 891065 - DNA, 25 bp, Mus musculus
tgggctctaaggatttgttgtgttc

SEQ ID NO: 891066 - DNA, 25 bp, Mus musculus
tgggctctaaggttttgttgtgttc

SEQ ID NO: 891067 - DNA, 25 bp, Mus musculus
tgggctctcaagataccaaaatctg

SEQ ID NO: 891068 - DNA, 25 bp, Mus musculus
tgggctctcaagttaccaaaatctg

SEQ ID NO: 891069 - DNA, 25 bp, Mus musculus
tgggctctcctgaggaggacatttt

SEQ ID NO: 891070 - DNA, 25 bp, Mus musculus
tgggctctcctgtggaggacatttt

SEQ ID NO: 891071 - DNA, 25 bp, Mus musculus
tgggctctcgggaacccttctgtaa

SEQ ID NO: 891072 - DNA, 25 bp, Mus musculus
tgggctctcgggtacccttctgtaa

SEQ ID NO: 891073 - DNA, 25 bp, Mus musculus
tgggctctctccatataaacatatg

SEQ ID NO: 891074 - DNA, 25 bp, Mus musculus
tgggctctctccttataaacatatg

SEQ ID NO: 891075 - DNA, 25 bp, Mus musculus
tgggctctctttaacccactaaact

SEQ ID NO: 891076 - DNA, 25 bp, Mus musculus
tgggctctcttttacccactaaact

SEQ ID NO: 891077 - DNA, 25 bp, Mus musculus
tgggctctgaaaccccgtaatcctt

SEQ ID NO: 891078 - DNA, 25 bp, Mus musculus
tgggctctgaaagcccgtaatcctt

SEQ ID NO: 891079 - DNA, 25 bp, Mus musculus
tgggctctgagaaccgagactctgt

SEQ ID NO: 891080 - DNA, 25 bp, Mus musculus
tgggctctgagacccattctgagct

SEQ ID NO: 891081 - DNA, 25 bp, Mus musculus
tgggctctgagagccattctgagct

SEQ ID NO: 891082 - DNA, 25 bp, Mus musculus
tgggctctgagatccgagactctgt

SEQ ID NO: 891083 - DNA, 25 bp, Mus musculus
tgggctctgcccagaaaagtggtta

SEQ ID NO: 891084 - DNA, 25 bp, Mus musculus
tgggctctgccctgaaaagtggtta

SEQ ID NO: 891085 - DNA, 25 bp, Mus musculus
tgggctctgcctaaatctcctggac

SEQ ID NO: 891086 - DNA, 25 bp, Mus musculus
tgggctctgcctagcactatttacc

SEQ ID NO: 891087 - DNA, 25 bp, Mus musculus
tgggctctgccttaatctcctggac

SEQ ID NO: 891088 - DNA, 25 bp, Mus musculus
tgggctctgccttgcactatttacc

SEQ ID NO: 891089 - DNA, 25 bp, Mus musculus
tgggctctgcgcaagagttcctcaa

SEQ ID NO: 891090 - DNA, 25 bp, Mus musculus
tgggctctgcgctagagttcctcaa

SEQ ID NO: 891091 - DNA, 25 bp, Mus musculus
tgggctctggcaccatcaaagtgaa

SEQ ID NO: 891092 - DNA, 25 bp, Mus musculus
tgggctctggcagcatcaaagtgaa

SEQ ID NO: 891093 - DNA, 25 bp, Mus musculus
tgggctctggctccgtgtatgctta

SEQ ID NO: 891094 - DNA, 25 bp, Mus musculus
tgggctctggctgcgtgtatgctta

SEQ ID NO: 891095 - DNA, 25 bp, Mus musculus
tgggctctggtgacaccatctgagg

SEQ ID NO: 891096 - DNA, 25 bp, Mus musculus
tgggctctggtgtcaccatctgagg

SEQ ID NO: 891097 - DNA, 25 bp, Mus musculus
tgggctctgtagctcatgtgctgat

SEQ ID NO: 891098 - DNA, 25 bp, Mus musculus
tgggctctgtaggtcatgtgctgat

SEQ ID NO: 891099 - DNA, 25 bp, Mus musculus
tgggctctgtgaagggttacttaga

SEQ ID NO: 891100 - DNA, 25 bp, Mus musculus
tgggctctgtgatgggttacttaga

SEQ ID NO: 891101 - DNA, 25 bp, Mus musculus
tgggctctgtttcacccctccctac

SEQ ID NO: 891102 - DNA, 25 bp, Mus musculus
tgggctctgtttgacccctccctac

SEQ ID NO: 891103 - DNA, 25 bp, Mus musculus
tgggctcttcataaccaccttggaa

SEQ ID NO: 891104 - DNA, 25 bp, Mus musculus
tgggctcttcattaccaccttggaa

SEQ ID NO: 891105 - DNA, 25 bp, Mus musculus
tgggctcttcctcaatatagaattg

SEQ ID NO: 891106 - DNA, 25 bp, Mus musculus
tgggctcttcctgaatatagaattg

SEQ ID NO: 891107 - DNA, 25 bp, Mus musculus
tgggctcttctgaggattgtttcca

SEQ ID NO: 891108 - DNA, 25 bp, Mus musculus
tgggctcttctgtggattgtttcca

SEQ ID NO: 891109 - DNA, 25 bp, Mus musculus
tgggctcttgccacttagaaaacca

SEQ ID NO: 891110 - DNA, 25 bp, Mus musculus
tgggctcttgcctcttagaaaacca

SEQ ID NO: 891111 - DNA, 25 bp, Mus musculus
tgggctcttggcagatgattgttaa

SEQ ID NO: 891112 - DNA, 25 bp, Mus musculus
tgggctcttggctgatgattgttaa

SEQ ID NO: 891113 - DNA, 25 bp, Mus musculus
tgggctctttcaatgcagccatgga

SEQ ID NO: 891114 - DNA, 25 bp, Mus musculus
tgggctctttcattgcagccatgga

SEQ ID NO: 891115 - DNA, 25 bp, Mus musculus
tgggctctttttccagattagagat

SEQ ID NO: 891116 - DNA, 25 bp, Mus musculus
tgggctctttttgcagattagagat

SEQ ID NO: 891117 - DNA, 25 bp, Mus musculus
tgggctgaaaagcatgccccacctc

SEQ ID NO: 891118 - DNA, 25 bp, Mus musculus
tgggctgaaaaggatgccccacctc

SEQ ID NO: 891119 - DNA, 25 bp, Mus musculus
tgggctgaaaggacagatttatttt

SEQ ID NO: 891120 - DNA, 25 bp, Mus musculus
tgggctgaaaggtcagatttatttt

SEQ ID NO: 891121 - DNA, 25 bp, Mus musculus
tgggctgaacacagctctagtgcat

SEQ ID NO: 891122 - DNA, 25 bp, Mus musculus
tgggctgaacactgctctagtgcat

SEQ ID NO: 891123 - DNA, 25 bp, Mus musculus
tgggctgaccctcacagtccattta

SEQ ID NO: 891124 - DNA, 25 bp, Mus musculus
tgggctgaccctgacagtccattta

SEQ ID NO: 891125 - DNA, 25 bp, Mus musculus
tgggctgactaaactgtggtccacc

SEQ ID NO: 891126 - DNA, 25 bp, Mus musculus
tgggctgactaatctgtggtccacc

SEQ ID NO: 891127 - DNA, 25 bp, Mus musculus
tgggctgacttccttttgatcggca

SEQ ID NO: 891128 - DNA, 25 bp, Mus musculus
tgggctgacttcgttttgatcggca

SEQ ID NO: 891129 - DNA, 25 bp, Mus musculus
tgggctgactttcctcaaacagaaa

SEQ ID NO: 891130 - DNA, 25 bp, Mus musculus
tgggctgactttgctcaaacagaaa

SEQ ID NO: 891131 - DNA, 25 bp, Mus musculus
tgggctgagctgctccctcactaga

SEQ ID NO: 891132 - DNA, 25 bp, Mus musculus
tgggctgagctggtccctcactaga

SEQ ID NO: 891133 - DNA, 25 bp, Mus musculus
tgggctgatggtagcttcaaaaaag

SEQ ID NO: 891134 - DNA, 25 bp, Mus musculus
tgggctgatggtcttgctttctctt

SEQ ID NO: 891135 - DNA, 25 bp, Mus musculus
tgggctgatggtgttgctttctctt

SEQ ID NO: 891136 - DNA, 25 bp, Mus musculus
tgggctgatggttgcttcaaaaaag

SEQ ID NO: 891137 - DNA, 25 bp, Mus musculus
tgggctgcaaaaacccttctctgtt

SEQ ID NO: 891138 - DNA, 25 bp, Mus musculus
tgggctgcaaaatcccttctctgtt

SEQ ID NO: 891139 - DNA, 25 bp, Mus musculus
tgggctgcaatgagtgcacacaccc

SEQ ID NO: 891140 - DNA, 25 bp, Mus musculus
tgggctgcaatgtgtgcacacaccc

SEQ ID NO: 891141 - DNA, 25 bp, Mus musculus
tgggctgcacatccttcctggagag

SEQ ID NO: 891142 - DNA, 25 bp, Mus musculus
tgggctgcacatgcttcctggagag

SEQ ID NO: 891143 - DNA, 25 bp, Mus musculus
tgggctgcactcagactttcagaga

SEQ ID NO: 891144 - DNA, 25 bp, Mus musculus
tgggctgcactctgactttcagaga

SEQ ID NO: 891145 - DNA, 25 bp, Mus musculus
tgggctgcagaacacaatcctttca

SEQ ID NO: 891146 - DNA, 25 bp, Mus musculus
tgggctgcagaagacaatcctttca

SEQ ID NO: 891147 - DNA, 25 bp, Mus musculus
tgggctgcagccaggcaactggatt

SEQ ID NO: 891148 - DNA, 25 bp, Mus musculus
tgggctgcagcctggcaactggatt

SEQ ID NO: 891149 - DNA, 25 bp, Mus musculus
tgggctgcagctaggtttagtgctc

SEQ ID NO: 891150 - DNA, 25 bp, Mus musculus
tgggctgcagcttggtttagtgctc

SEQ ID NO: 891151 - DNA, 25 bp, Mus musculus
tgggctgcagggaaaaggtcttttt

SEQ ID NO: 891152 - DNA, 25 bp, Mus musculus
tgggctgcagggtaaaggtcttttt

SEQ ID NO: 891153 - DNA, 25 bp, Mus musculus
tgggctgcagtcagggagtctctac

SEQ ID NO: 891154 - DNA, 25 bp, Mus musculus
tgggctgcagtctgggagtctctac

SEQ ID NO: 891155 - DNA, 25 bp, Mus musculus
tgggctgcatcgaactcatgacaga

SEQ ID NO: 891156 - DNA, 25 bp, Mus musculus
tgggctgcatcgtactcatgacaga

SEQ ID NO: 891157 - DNA, 25 bp, Mus musculus
tgggctgcatctatagtaccacaga

SEQ ID NO: 891158 - DNA, 25 bp, Mus musculus
tgggctgcatctttagtaccacaga

SEQ ID NO: 891159 - DNA, 25 bp, Mus musculus
tgggctgcatgcaggaacacctaat

SEQ ID NO: 891160 - DNA, 25 bp, Mus musculus
tgggctgcatgctggaacacctaat

SEQ ID NO: 891161 - DNA, 25 bp, Mus musculus
tgggctgcattcatcttatccccat

SEQ ID NO: 891162 - DNA, 25 bp, Mus musculus
tgggctgcattcttcttatccccat

SEQ ID NO: 891163 - DNA, 25 bp, Mus musculus
tgggctgccaacctttacatgtgtg

SEQ ID NO: 891164 - DNA, 25 bp, Mus musculus
tgggctgccaacgtttacatgtgtg

SEQ ID NO: 891165 - DNA, 25 bp, Mus musculus
tgggctgccatgagtattctcttag

SEQ ID NO: 891166 - DNA, 25 bp, Mus musculus
tgggctgccatgtgtattctcttag

SEQ ID NO: 891167 - DNA, 25 bp, Mus musculus
tgggctgcccagaatttattctatg

SEQ ID NO: 891168 - DNA, 25 bp, Mus musculus
tgggctgcccagtatttattctatg

SEQ ID NO: 891169 - DNA, 25 bp, Mus musculus
tgggctgccctcatttccatatgct

SEQ ID NO: 891170 - DNA, 25 bp, Mus musculus
tgggctgccctcttttccatatgct

SEQ ID NO: 891171 - DNA, 25 bp, Mus musculus
tgggctgccgcaagattagactaag

SEQ ID NO: 891172 - DNA, 25 bp, Mus musculus
tgggctgccgcatgattagactaag

SEQ ID NO: 891173 - DNA, 25 bp, Mus musculus
tgggctgctaacatcttaggcctct

SEQ ID NO: 891174 - DNA, 25 bp, Mus musculus
tgggctgctaacttcttaggcctct

SEQ ID NO: 891175 - DNA, 25 bp, Mus musculus
tgggctgctagtctttaattggaaa

SEQ ID NO: 891176 - DNA, 25 bp, Mus musculus
tgggctgctagtgtttaattggaaa

SEQ ID NO: 891177 - DNA, 25 bp, Mus musculus
tgggctgctcagatcaagtgaatca

SEQ ID NO: 891178 - DNA, 25 bp, Mus musculus
tgggctgctcagttcaagtgaatca

SEQ ID NO: 891179 - DNA, 25 bp, Mus musculus
tgggctgctggcataaaggacactt

SEQ ID NO: 891180 - DNA, 25 bp, Mus musculus
tgggctgctggcttaaaggacactt

SEQ ID NO: 891181 - DNA, 25 bp, Mus musculus
tgggctgcttctcccagaagtatta

SEQ ID NO: 891182 - DNA, 25 bp, Mus musculus
tgggctgcttctgccagaagtatta

SEQ ID NO: 891183 - DNA, 25 bp, Mus musculus
tgggctgctttcagattcaccataa

SEQ ID NO: 891184 - DNA, 25 bp, Mus musculus
tgggctgctttcatgaacaaactgt

SEQ ID NO: 891185 - DNA, 25 bp, Mus musculus
tgggctgctttctgattcaccataa

SEQ ID NO: 891186 - DNA, 25 bp, Mus musculus
tgggctgctttcttgaacaaactgt

SEQ ID NO: 891187 - DNA, 25 bp, Mus musculus
tgggctggaaaccttcaaaaagacg

SEQ ID NO: 891188 - DNA, 25 bp, Mus musculus
tgggctggaaacgttcaaaaagacg

SEQ ID NO: 891189 - DNA, 25 bp, Mus musculus
tgggctggaaggattattcttacac

SEQ ID NO: 891190 - DNA, 25 bp, Mus musculus
tgggctggaaggtttattcttacac

SEQ ID NO: 891191 - DNA, 25 bp, Mus musculus
tgggctggaatcaggaactcggctc

SEQ ID NO: 891192 - DNA, 25 bp, Mus musculus
tgggctggaatctggaactcggctc

SEQ ID NO: 891193 - DNA, 25 bp, Mus musculus
tgggctggacccctgaatttgatcc

SEQ ID NO: 891194 - DNA, 25 bp, Mus musculus
tgggctggacccgtgaatttgatcc

SEQ ID NO: 891195 - DNA, 25 bp, Mus musculus
tgggctggactcacaaaatatcatc

SEQ ID NO: 891196 - DNA, 25 bp, Mus musculus
tgggctggactctcaaaatatcatc

SEQ ID NO: 891197 - DNA, 25 bp, Mus musculus
tgggctggactgagaagcctaaatt

SEQ ID NO: 891198 - DNA, 25 bp, Mus musculus
tgggctggactgtgaagcctaaatt

SEQ ID NO: 891199 - DNA, 25 bp, Mus musculus
tgggctggagccactgcaacagaag

SEQ ID NO: 891200 - DNA, 25 bp, Mus musculus
tgggctggagcctctgcaacagaag

SEQ ID NO: 891201 - DNA, 25 bp, Mus musculus
tgggctggagctccaaatccacaac

SEQ ID NO: 891202 - DNA, 25 bp, Mus musculus
tgggctggagctgcaaatccacaac

SEQ ID NO: 891203 - DNA, 25 bp, Mus musculus
tgggctggagtaactgatgagaaac

SEQ ID NO: 891204 - DNA, 25 bp, Mus musculus
tgggctggagtatctgatgagaaac

SEQ ID NO: 891205 - DNA, 25 bp, Mus musculus
tgggctggatacctgtgccgcctct

SEQ ID NO: 891206 - DNA, 25 bp, Mus musculus
tgggctggatacgtgtgccgcctct

SEQ ID NO: 891207 - DNA, 25 bp, Mus musculus
tgggctggattcactggtacaccgg

SEQ ID NO: 891208 - DNA, 25 bp, Mus musculus
tgggctggattctctggtacaccgg

SEQ ID NO: 891209 - DNA, 25 bp, Mus musculus
tgggctggattgacacttgtagtta

SEQ ID NO: 891210 - DNA, 25 bp, Mus musculus
tgggctggattgtcacttgtagtta

SEQ ID NO: 891211 - DNA, 25 bp, Mus musculus
tgggctggcaagctgtacaatgatt

SEQ ID NO: 891212 - DNA, 25 bp, Mus musculus
tgggctggcaaggtgtacaatgatt

SEQ ID NO: 891213 - DNA, 25 bp, Mus musculus
tgggctggccctatgtaggtttcca

SEQ ID NO: 891214 - DNA, 25 bp, Mus musculus
tgggctggccctttgtaggtttcca

SEQ ID NO: 891215 - DNA, 25 bp, Mus musculus
tgggctggctttcctacgctttcct

SEQ ID NO: 891216 - DNA, 25 bp, Mus musculus
tgggctggctttgctacgctttcct

SEQ ID NO: 891217 - DNA, 25 bp, Mus musculus
tgggctgggcagagcaccctactat

SEQ ID NO: 891218 - DNA, 25 bp, Mus musculus
tgggctgggcagtgcaccctactat

SEQ ID NO: 891219 - DNA, 25 bp, Mus musculus
tgggctgggctcactggctctcaat

SEQ ID NO: 891220 - DNA, 25 bp, Mus musculus
tgggctgggctctctggctctcaat

SEQ ID NO: 891221 - DNA, 25 bp, Mus musculus
tgggctgggtccagccctcaggaca

SEQ ID NO: 891222 - DNA, 25 bp, Mus musculus
tgggctgggtcctgccctcaggaca

SEQ ID NO: 891223 - DNA, 25 bp, Mus musculus
tgggctgggttcagaacaccgaccg

SEQ ID NO: 891224 - DNA, 25 bp, Mus musculus
tgggctgggttcagtcctagtatcc

SEQ ID NO: 891225 - DNA, 25 bp, Mus musculus
tgggctgggttcattgtcaatgtta

SEQ ID NO: 891226 - DNA, 25 bp, Mus musculus
tgggctgggttctgaacaccgaccg

SEQ ID NO: 891227 - DNA, 25 bp, Mus musculus
tgggctgggttctgtcctagtatcc

SEQ ID NO: 891228 - DNA, 25 bp, Mus musculus
tgggctgggttctttgtcaatgtta

SEQ ID NO: 891229 - DNA, 25 bp, Mus musculus
tgggctggtcaaaacactgtccaca

SEQ ID NO: 891230 - DNA, 25 bp, Mus musculus
tgggctggtcaatacactgtccaca

SEQ ID NO: 891231 - DNA, 25 bp, Mus musculus
tgggctggtggaaacgcctcttttc

SEQ ID NO: 891232 - DNA, 25 bp, Mus musculus
tgggctggtggatacgcctcttttc

SEQ ID NO: 891233 - DNA, 25 bp, Mus musculus
tgggctggtttcatattcttgggca

SEQ ID NO: 891234 - DNA, 25 bp, Mus musculus
tgggctggtttcttattcttgggca

SEQ ID NO: 891235 - DNA, 25 bp, Mus musculus
tgggctgtatagagcatctcgtgaa

SEQ ID NO: 891236 - DNA, 25 bp, Mus musculus
tgggctgtatagtgcatctcgtgaa

SEQ ID NO: 891237 - DNA, 25 bp, Mus musculus
tgggctgtcaacagcaactgaggct

SEQ ID NO: 891238 - DNA, 25 bp, Mus musculus
tgggctgtcaactgcaactgaggct

SEQ ID NO: 891239 - DNA, 25 bp, Mus musculus
tgggctgtcacgactactcagtgag

SEQ ID NO: 891240 - DNA, 25 bp, Mus musculus
tgggctgtcacgtctactcagtgag

SEQ ID NO: 891241 - DNA, 25 bp, Mus musculus
tgggctgtcactctagaccatgacg

SEQ ID NO: 891242 - DNA, 25 bp, Mus musculus
tgggctgtcactgtagaccatgacg

SEQ ID NO: 891243 - DNA, 25 bp, Mus musculus
tgggctgtcataacatcatcctgat

SEQ ID NO: 891244 - DNA, 25 bp, Mus musculus
tgggctgtcatatcatcatcctgat

SEQ ID NO: 891245 - DNA, 25 bp, Mus musculus
tgggctgtccaaccggtcatggcaa

SEQ ID NO: 891246 - DNA, 25 bp, Mus musculus
tgggctgtccaagcggtcatggcaa

SEQ ID NO: 891247 - DNA, 25 bp, Mus musculus
tgggctgtccctatctcagtagact

SEQ ID NO: 891248 - DNA, 25 bp, Mus musculus
tgggctgtccctttctcagtagact

SEQ ID NO: 891249 - DNA, 25 bp, Mus musculus
tgggctgtcctgaacgaacttttat

SEQ ID NO: 891250 - DNA, 25 bp, Mus musculus
tgggctgtcctgtacgaacttttat

SEQ ID NO: 891251 - DNA, 25 bp, Mus musculus
tgggctgtctctctagtcagtcacc

SEQ ID NO: 891252 - DNA, 25 bp, Mus musculus
tgggctgtctctgtagtcagtcacc

SEQ ID NO: 891253 - DNA, 25 bp, Mus musculus
tgggctgtctgcaggtaatgtgcta

SEQ ID NO: 891254 - DNA, 25 bp, Mus musculus
tgggctgtctgctggtaatgtgcta

SEQ ID NO: 891255 - DNA, 25 bp, Mus musculus
tgggctgtctgtatacagggccagt

SEQ ID NO: 891256 - DNA, 25 bp, Mus musculus
tgggctgtctgtttacagggccagt

SEQ ID NO: 891257 - DNA, 25 bp, Mus musculus
tgggctgtgactcggtaaccccaca

SEQ ID NO: 891258 - DNA, 25 bp, Mus musculus
tgggctgtgactgggtaaccccaca

SEQ ID NO: 891259 - DNA, 25 bp, Mus musculus
tgggctgtgaggaccatttttggca

SEQ ID NO: 891260 - DNA, 25 bp, Mus musculus
tgggctgtgaggtccatttttggca

SEQ ID NO: 891261 - DNA, 25 bp, Mus musculus
tgggctgtgcacattttcaaggtca

SEQ ID NO: 891262 - DNA, 25 bp, Mus musculus
tgggctgtgcactttttcaaggtca

SEQ ID NO: 891263 - DNA, 25 bp, Mus musculus
tgggctgtggagaccccgggcggct

SEQ ID NO: 891264 - DNA, 25 bp, Mus musculus
tgggctgtggagtccccgggcggct

SEQ ID NO: 891265 - DNA, 25 bp, Mus musculus
tgggctgtgtgcacatccggaaaca

SEQ ID NO: 891266 - DNA, 25 bp, Mus musculus
tgggctgtgtgctcatccggaaaca

SEQ ID NO: 891267 - DNA, 25 bp, Mus musculus
tgggctgtgttgactacctgataaa

SEQ ID NO: 891268 - DNA, 25 bp, Mus musculus
tgggctgtgttgtctacctgataaa

SEQ ID NO: 891269 - DNA, 25 bp, Mus musculus
tgggctgttagcaccactcaggtac

SEQ ID NO: 891270 - DNA, 25 bp, Mus musculus
tgggctgttagctccactcaggtac

SEQ ID NO: 891271 - DNA, 25 bp, Mus musculus
tgggctgtttttctccctggaaaca

SEQ ID NO: 891272 - DNA, 25 bp, Mus musculus
tgggctgtttttgtccctggaaaca

SEQ ID NO: 891273 - DNA, 25 bp, Mus musculus
tgggcttaaccccaaggctaagtgt

SEQ ID NO: 891274 - DNA, 25 bp, Mus musculus
tgggcttaacccgaaggctaagtgt

SEQ ID NO: 891275 - DNA, 25 bp, Mus musculus
tgggcttacaaacaggttcaacaaa

SEQ ID NO: 891276 - DNA, 25 bp, Mus musculus
tgggcttacaaagaggttcaacaaa

SEQ ID NO: 891277 - DNA, 25 bp, Mus musculus
tgggcttaccaaagtgttcccaggc

SEQ ID NO: 891278 - DNA, 25 bp, Mus musculus
tgggcttaccaatgtgttcccaggc

SEQ ID NO: 891279 - DNA, 25 bp, Mus musculus
tgggcttacgtgatcatgtggcatt

SEQ ID NO: 891280 - DNA, 25 bp, Mus musculus
tgggcttacgtgttcatgtggcatt

SEQ ID NO: 891281 - DNA, 25 bp, Mus musculus
tgggcttactaactaggttgttttg

SEQ ID NO: 891282 - DNA, 25 bp, Mus musculus
tgggcttactaagtaggttgttttg

SEQ ID NO: 891283 - DNA, 25 bp, Mus musculus
tgggcttacttcaaggtcttcgaaa

SEQ ID NO: 891284 - DNA, 25 bp, Mus musculus
tgggcttacttctaggtcttcgaaa

SEQ ID NO: 891285 - DNA, 25 bp, Mus musculus
tgggcttagctgctccagaaaccag

SEQ ID NO: 891286 - DNA, 25 bp, Mus musculus
tgggcttagctggtccagaaaccag

SEQ ID NO: 891287 - DNA, 25 bp, Mus musculus
tgggcttaggagagatccacactaa

SEQ ID NO: 891288 - DNA, 25 bp, Mus musculus
tgggcttaggagtgatccacactaa

SEQ ID NO: 891289 - DNA, 25 bp, Mus musculus
tgggcttaggcgagacctcacacag

SEQ ID NO: 891290 - DNA, 25 bp, Mus musculus
tgggcttaggcgtgacctcacacag

SEQ ID NO: 891291 - DNA, 25 bp, Mus musculus
tgggcttatcgccaacacttgaaga

SEQ ID NO: 891292 - DNA, 25 bp, Mus musculus
tgggcttatcgcgaacacttgaaga

SEQ ID NO: 891293 - DNA, 25 bp, Mus musculus
tgggcttatgacatcatggctggct

SEQ ID NO: 891294 - DNA, 25 bp, Mus musculus
tgggcttatgaccttggcatcaaat

SEQ ID NO: 891295 - DNA, 25 bp, Mus musculus
tgggcttatgacgttggcatcaaat

SEQ ID NO: 891296 - DNA, 25 bp, Mus musculus
tgggcttatgacttcatggctggct

SEQ ID NO: 891297 - DNA, 25 bp, Mus musculus
tgggcttatttaattgtgcagttgc

SEQ ID NO: 891298 - DNA, 25 bp, Mus musculus
tgggcttatttatttgtgcagttgc

SEQ ID NO: 891299 - DNA, 25 bp, Mus musculus
tgggcttcacccaatctcagaccaa

SEQ ID NO: 891300 - DNA, 25 bp, Mus musculus
tgggcttcacccaatttcagaccaa

SEQ ID NO: 891301 - DNA, 25 bp, Mus musculus
tgggcttcaccctatctcagaccaa

SEQ ID NO: 891302 - DNA, 25 bp, Mus musculus
tgggcttcaccctatttcagaccaa

SEQ ID NO: 891303 - DNA, 25 bp, Mus musculus
tgggcttcactcacttcttgcaaag

SEQ ID NO: 891304 - DNA, 25 bp, Mus musculus
tgggcttcactctcttcttgcaaag

SEQ ID NO: 891305 - DNA, 25 bp, Mus musculus
tgggcttcaggacagtagttctcac

SEQ ID NO: 891306 - DNA, 25 bp, Mus musculus
tgggcttcaggagagtagttctcac

SEQ ID NO: 891307 - DNA, 25 bp, Mus musculus
tgggcttcagtgagccccttcaatg

SEQ ID NO: 891308 - DNA, 25 bp, Mus musculus
tgggcttcagtgtgccccttcaatg

SEQ ID NO: 891309 - DNA, 25 bp, Mus musculus
tgggcttccaaccactggagagcag

SEQ ID NO: 891310 - DNA, 25 bp, Mus musculus
tgggcttccaacgactggagagcag

SEQ ID NO: 891311 - DNA, 25 bp, Mus musculus
tgggcttccactcttcatatttgag

SEQ ID NO: 891312 - DNA, 25 bp, Mus musculus
tgggcttccactgttcatatttgag

SEQ ID NO: 891313 - DNA, 25 bp, Mus musculus
tgggcttccagtagccttaatagaa

SEQ ID NO: 891314 - DNA, 25 bp, Mus musculus
tgggcttccagttgccttaatagaa

SEQ ID NO: 891315 - DNA, 25 bp, Mus musculus
tgggcttccatgagatcttgatcca

SEQ ID NO: 891316 - DNA, 25 bp, Mus musculus
tgggcttccatgtgatcttgatcca

SEQ ID NO: 891317 - DNA, 25 bp, Mus musculus
tgggcttcccaaatcaaggtttagc

SEQ ID NO: 891318 - DNA, 25 bp, Mus musculus
tgggcttcccaattcaaggtttagc

SEQ ID NO: 891319 - DNA, 25 bp, Mus musculus
tgggcttcccagagagcctggtgat

SEQ ID NO: 891320 - DNA, 25 bp, Mus musculus
tgggcttcccagtgagcctggtgat

SEQ ID NO: 891321 - DNA, 25 bp, Mus musculus
tgggcttccctcctggtttatcctg

SEQ ID NO: 891322 - DNA, 25 bp, Mus musculus
tgggcttccctcgtggtttatcctg

SEQ ID NO: 891323 - DNA, 25 bp, Mus musculus
tgggcttcctaacgacttaactgct

SEQ ID NO: 891324 - DNA, 25 bp, Mus musculus
tgggcttcctaaggacttaactgct

SEQ ID NO: 891325 - DNA, 25 bp, Mus musculus
tgggcttcctacagattcctactga

SEQ ID NO: 891326 - DNA, 25 bp, Mus musculus
tgggcttcctactgattcctactga

SEQ ID NO: 891327 - DNA, 25 bp, Mus musculus
tgggcttcctcgactgctgagcttt

SEQ ID NO: 891328 - DNA, 25 bp, Mus musculus
tgggcttcctcgtctgctgagcttt

SEQ ID NO: 891329 - DNA, 25 bp, Mus musculus
tgggcttcctctactgggtgatcat

SEQ ID NO: 891330 - DNA, 25 bp, Mus musculus
tgggcttcctcttctgggtgatcat

SEQ ID NO: 891331 - DNA, 25 bp, Mus musculus
tgggcttcctggacaacatggctgg

SEQ ID NO: 891332 - DNA, 25 bp, Mus musculus
tgggcttcctggtcaacatggctgg

SEQ ID NO: 891333 - DNA, 25 bp, Mus musculus
tgggcttccttaaggttttccagag

SEQ ID NO: 891334 - DNA, 25 bp, Mus musculus
tgggcttccttatggttttccagag

SEQ ID NO: 891335 - DNA, 25 bp, Mus musculus
tgggcttcctttatctgtgtagaaa

SEQ ID NO: 891336 - DNA, 25 bp, Mus musculus
tgggcttcctttttctgtgtagaaa

SEQ ID NO: 891337 - DNA, 25 bp, Mus musculus
tgggcttcgaaaccatagccgcacc

SEQ ID NO: 891338 - DNA, 25 bp, Mus musculus
tgggcttcgaaagcatagccgcacc

SEQ ID NO: 891339 - DNA, 25 bp, Mus musculus
tgggcttcgccacctttgagatatt

SEQ ID NO: 891340 - DNA, 25 bp, Mus musculus
tgggcttcgccagctttgagatatt

SEQ ID NO: 891341 - DNA, 25 bp, Mus musculus
tgggcttctactcgctgggcctctc

SEQ ID NO: 891342 - DNA, 25 bp, Mus musculus
tgggcttctactggctgggcctctc

SEQ ID NO: 891343 - DNA, 25 bp, Mus musculus
tgggcttctagccactgtttgtttc

SEQ ID NO: 891344 - DNA, 25 bp, Mus musculus
tgggcttctagcgactgtttgtttc

SEQ ID NO: 891345 - DNA, 25 bp, Mus musculus
tgggcttctaggatactgtgcagct

SEQ ID NO: 891346 - DNA, 25 bp, Mus musculus
tgggcttctaggttactgtgcagct

SEQ ID NO: 891347 - DNA, 25 bp, Mus musculus
tgggcttctataattgcaacgtcac

SEQ ID NO: 891348 - DNA, 25 bp, Mus musculus
tgggcttctatatttgcaacgtcac

SEQ ID NO: 891349 - DNA, 25 bp, Mus musculus
tgggcttctccacacttgattatcc

SEQ ID NO: 891350 - DNA, 25 bp, Mus musculus
tgggcttctccagacttgattatcc

SEQ ID NO: 891351 - DNA, 25 bp, Mus musculus
tgggcttctcccagaaattttactt

SEQ ID NO: 891352 - DNA, 25 bp, Mus musculus
tgggcttctccctgaaattttactt

SEQ ID NO: 891353 - DNA, 25 bp, Mus musculus
tgggcttctgatccctcctccgaat

SEQ ID NO: 891354 - DNA, 25 bp, Mus musculus
tgggcttctgatgcctcctccgaat

SEQ ID NO: 891355 - DNA, 25 bp, Mus musculus
tgggcttctgctatgaggtgcaccg

SEQ ID NO: 891356 - DNA, 25 bp, Mus musculus
tgggcttctgctttgaggtgcaccg

SEQ ID NO: 891357 - DNA, 25 bp, Mus musculus
tgggcttctgggaaaggaatcactc

SEQ ID NO: 891358 - DNA, 25 bp, Mus musculus
tgggcttctgggtaaggaatcactc

SEQ ID NO: 891359 - DNA, 25 bp, Mus musculus
tgggcttctgtgactacaactgcta

SEQ ID NO: 891360 - DNA, 25 bp, Mus musculus
tgggcttctgtgtctacaactgcta

SEQ ID NO: 891361 - DNA, 25 bp, Mus musculus
tgggcttcttcacgcgacatcagag

SEQ ID NO: 891362 - DNA, 25 bp, Mus musculus
tgggcttcttcaggcgacatcagag

SEQ ID NO: 891363 - DNA, 25 bp, Mus musculus
tgggcttcttccaatgcagggcaga

SEQ ID NO: 891364 - DNA, 25 bp, Mus musculus
tgggcttcttcctatgcagggcaga

SEQ ID NO: 891365 - DNA, 25 bp, Mus musculus
tgggcttgaatacctcatggtgtgt

SEQ ID NO: 891366 - DNA, 25 bp, Mus musculus
tgggcttgaatagctcatggtgtgt

SEQ ID NO: 891367 - DNA, 25 bp, Mus musculus
tgggcttgaattccagctctcattt

SEQ ID NO: 891368 - DNA, 25 bp, Mus musculus
tgggcttgaattgcagctctcattt

SEQ ID NO: 891369 - DNA, 25 bp, Mus musculus
tgggcttgctccagccggttagcaa

SEQ ID NO: 891370 - DNA, 25 bp, Mus musculus
tgggcttgctcctgccggttagcaa

SEQ ID NO: 891371 - DNA, 25 bp, Mus musculus
tgggcttgcttacacttcctcactg

SEQ ID NO: 891372 - DNA, 25 bp, Mus musculus
tgggcttgcttagacttcctcactg

SEQ ID NO: 891373 - DNA, 25 bp, Mus musculus
tgggcttgcttgagggcaccttcag

SEQ ID NO: 891374 - DNA, 25 bp, Mus musculus
tgggcttgcttgtgggcaccttcag

SEQ ID NO: 891375 - DNA, 25 bp, Mus musculus
tgggcttggaccacttggtgtgaca

SEQ ID NO: 891376 - DNA, 25 bp, Mus musculus
tgggcttggacctcttggtgtgaca

SEQ ID NO: 891377 - DNA, 25 bp, Mus musculus
tgggcttggatcagattaaaccact

SEQ ID NO: 891378 - DNA, 25 bp, Mus musculus
tgggcttggatctgattaaaccact

SEQ ID NO: 891379 - DNA, 25 bp, Mus musculus
tgggcttggctcagagaatgccgct

SEQ ID NO: 891380 - DNA, 25 bp, Mus musculus
tgggcttggctctgagaatgccgct

SEQ ID NO: 891381 - DNA, 25 bp, Mus musculus
tgggcttgggaaaatctgggattct

SEQ ID NO: 891382 - DNA, 25 bp, Mus musculus
tgggcttgggaatatctgggattct

SEQ ID NO: 891383 - DNA, 25 bp, Mus musculus
tgggcttgggcaatggccgccatac

SEQ ID NO: 891384 - DNA, 25 bp, Mus musculus
tgggcttgggcattggccgccatac

SEQ ID NO: 891385 - DNA, 25 bp, Mus musculus
tgggcttggtgaccattctgttatt

SEQ ID NO: 891386 - DNA, 25 bp, Mus musculus
tgggcttggtgagcattctgttatt

SEQ ID NO: 891387 - DNA, 25 bp, Mus musculus
tgggcttggttgaagttgctcacac

SEQ ID NO: 891388 - DNA, 25 bp, Mus musculus
tgggcttggttgtagttgctcacac

SEQ ID NO: 891389 - DNA, 25 bp, Mus musculus
tgggcttgtcacctgtgagttttat

SEQ ID NO: 891390 - DNA, 25 bp, Mus musculus
tgggcttgtcacgtgtgagttttat

SEQ ID NO: 891391 - DNA, 25 bp, Mus musculus
tgggcttgtcttcccaagggagatt

SEQ ID NO: 891392 - DNA, 25 bp, Mus musculus
tgggcttgtcttgccaagggagatt

SEQ ID NO: 891393 - DNA, 25 bp, Mus musculus
tgggcttgttatccgttatcaccaa

SEQ ID NO: 891394 - DNA, 25 bp, Mus musculus
tgggcttgttatgcgttatcaccaa

SEQ ID NO: 891395 - DNA, 25 bp, Mus musculus
tgggcttgttctatggatccacagc

SEQ ID NO: 891396 - DNA, 25 bp, Mus musculus
tgggcttgttctttggatccacagc

SEQ ID NO: 891397 - DNA, 25 bp, Mus musculus
tgggctttaactctggtggcagcca

SEQ ID NO: 891398 - DNA, 25 bp, Mus musculus
tgggctttaactgtggtggcagcca

SEQ ID NO: 891399 - DNA, 25 bp, Mus musculus
tgggctttacaaaccctcagggaag

SEQ ID NO: 891400 - DNA, 25 bp, Mus musculus
tgggctttacaatccctcagggaag

SEQ ID NO: 891401 - DNA, 25 bp, Mus musculus
tgggctttacctcaactttgctcta

SEQ ID NO: 891402 - DNA, 25 bp, Mus musculus
tgggctttacctgaactttgctcta

SEQ ID NO: 891403 - DNA, 25 bp, Mus musculus
tgggctttatcccatccatgcagga

SEQ ID NO: 891404 - DNA, 25 bp, Mus musculus
tgggctttatccgatccatgcagga

SEQ ID NO: 891405 - DNA, 25 bp, Mus musculus
tgggctttcaatccagggctttggc

SEQ ID NO: 891406 - DNA, 25 bp, Mus musculus
tgggctttcaatgcagggctttggc

SEQ ID NO: 891407 - DNA, 25 bp, Mus musculus
tgggctttcactcgtctgaactcaa

SEQ ID NO: 891408 - DNA, 25 bp, Mus musculus
tgggctttcactggtctgaactcaa

SEQ ID NO: 891409 - DNA, 25 bp, Mus musculus
tgggctttcagtatgcaaccacatc

SEQ ID NO: 891410 - DNA, 25 bp, Mus musculus
tgggctttcagtttgcaaccacatc

SEQ ID NO: 891411 - DNA, 25 bp, Mus musculus
tgggctttccacatcagaacatcca

SEQ ID NO: 891412 - DNA, 25 bp, Mus musculus
tgggctttccacttcagaacatcca

SEQ ID NO: 891413 - DNA, 25 bp, Mus musculus
tgggctttccctcaatgcaagataa

SEQ ID NO: 891414 - DNA, 25 bp, Mus musculus
tgggctttccctgaatgcaagataa

SEQ ID NO: 891415 - DNA, 25 bp, Mus musculus
tgggctttcggcaatttctgtccct

SEQ ID NO: 891416 - DNA, 25 bp, Mus musculus
tgggctttcggctatttctgtccct

SEQ ID NO: 891417 - DNA, 25 bp, Mus musculus
tgggctttcgttcccgaatcttggt

SEQ ID NO: 891418 - DNA, 25 bp, Mus musculus
tgggctttcgttgccgaatcttggt

SEQ ID NO: 891419 - DNA, 25 bp, Mus musculus
tgggctttctgactgcattccaaag

SEQ ID NO: 891420 - DNA, 25 bp, Mus musculus
tgggctttctgagtgcattccaaag

SEQ ID NO: 891421 - DNA, 25 bp, Mus musculus
tgggctttgaatatggtttgactga

SEQ ID NO: 891422 - DNA, 25 bp, Mus musculus
tgggctttgaatttggtttgactga

SEQ ID NO: 891423 - DNA, 25 bp, Mus musculus
tgggctttgacaagtggcctttcat

SEQ ID NO: 891424 - DNA, 25 bp, Mus musculus
tgggctttgacatgtggcctttcat

SEQ ID NO: 891425 - DNA, 25 bp, Mus musculus
tgggctttgcagatctggcctaacc

SEQ ID NO: 891426 - DNA, 25 bp, Mus musculus
tgggctttgcagttctggcctaacc

SEQ ID NO: 891427 - DNA, 25 bp, Mus musculus
tgggctttgcataaggttttcctgt

SEQ ID NO: 891428 - DNA, 25 bp, Mus musculus
tgggctttgcattaggttttcctgt

SEQ ID NO: 891429 - DNA, 25 bp, Mus musculus
tgggctttggaaccattgttaagta

SEQ ID NO: 891430 - DNA, 25 bp, Mus musculus
tgggctttggaagcattgttaagta

SEQ ID NO: 891431 - DNA, 25 bp, Mus musculus
tgggctttggacacaacggacagaa

SEQ ID NO: 891432 - DNA, 25 bp, Mus musculus
tgggctttggactcaacggacagaa

SEQ ID NO: 891433 - DNA, 25 bp, Mus musculus
tgggctttggatatctctattactt

SEQ ID NO: 891434 - DNA, 25 bp, Mus musculus
tgggctttggatttctctattactt

SEQ ID NO: 891435 - DNA, 25 bp, Mus musculus
tgggctttggtgagttacataacgg

SEQ ID NO: 891436 - DNA, 25 bp, Mus musculus
tgggctttggtgtgttacataacgg

SEQ ID NO: 891437 - DNA, 25 bp, Mus musculus
tgggctttgtatccctgtcgctggt

SEQ ID NO: 891438 - DNA, 25 bp, Mus musculus
tgggctttgtatgcctgtcgctggt

SEQ ID NO: 891439 - DNA, 25 bp, Mus musculus
tgggcttttccaatgctttatataa

SEQ ID NO: 891440 - DNA, 25 bp, Mus musculus
tgggcttttccattgctttatataa

SEQ ID NO: 891441 - DNA, 25 bp, Mus musculus
tgggcttttccgcaaccttttcgtg

SEQ ID NO: 891442 - DNA, 25 bp, Mus musculus
tgggcttttccggaaccttttcgtg

SEQ ID NO: 891443 - DNA, 25 bp, Mus musculus
tgggcttttgtacgcgctgccttgc

SEQ ID NO: 891444 - DNA, 25 bp, Mus musculus
tgggcttttgtaggcgctgccttgc

SEQ ID NO: 891445 - DNA, 25 bp, Mus musculus
tgggctttttaacctcagagtttct

SEQ ID NO: 891446 - DNA, 25 bp, Mus musculus
tgggctttttaagctcagagtttct

SEQ ID NO: 891447 - DNA, 25 bp, Mus musculus
tgggctttttggaaactgtctctta

SEQ ID NO: 891448 - DNA, 25 bp, Mus musculus
tgggctttttggtaactgtctctta

SEQ ID NO: 891449 - DNA, 25 bp, Mus musculus
tggggaacgcttaagcccaattcgg

SEQ ID NO: 891450 - DNA, 25 bp, Mus musculus
tggggaacgctttagcccaattcgg

SEQ ID NO: 891451 - DNA, 25 bp, Mus musculus
tggggacactgactcacatcctgcc

SEQ ID NO: 891452 - DNA, 25 bp, Mus musculus
tggggacactgagtcacatcctgcc

SEQ ID NO: 891453 - DNA, 25 bp, Mus musculus
tggggacccatgaacttcttgagtt

SEQ ID NO: 891454 - DNA, 25 bp, Mus musculus
tggggacccatgtacttcttgagtt

SEQ ID NO: 891455 - DNA, 25 bp, Mus musculus
tggggacgctgtattttggtacctg

SEQ ID NO: 891456 - DNA, 25 bp, Mus musculus
tggggacgctgttttttggtacctg

SEQ ID NO: 891457 - DNA, 25 bp, Mus musculus
tggggagacggtaaccataccctct

SEQ ID NO: 891458 - DNA, 25 bp, Mus musculus
tggggagacggttaccataccctct

SEQ ID NO: 891459 - DNA, 25 bp, Mus musculus
tggggagagacacgctttcacacag

SEQ ID NO: 891460 - DNA, 25 bp, Mus musculus
tggggagagacaggctttcacacag

SEQ ID NO: 891461 - DNA, 25 bp, Mus musculus
tggggagagattacctgttcaacac

SEQ ID NO: 891462 - DNA, 25 bp, Mus musculus
tggggagagatttcctgttcaacac

SEQ ID NO: 891463 - DNA, 25 bp, Mus musculus
tggggatcttggcactttgtaactg

SEQ ID NO: 891464 - DNA, 25 bp, Mus musculus
tggggatcttgggactttgtaactg

SEQ ID NO: 891465 - DNA, 25 bp, Mus musculus
tggggatgaattagcctctcttctc

SEQ ID NO: 891466 - DNA, 25 bp, Mus musculus
tggggatgaatttgcctctcttctc

SEQ ID NO: 891467 - DNA, 25 bp, Mus musculus
tggggatttagcacagtggtagagc

SEQ ID NO: 891468 - DNA, 25 bp, Mus musculus
tggggatttagctcagtggtagagc

SEQ ID NO: 891469 - DNA, 25 bp, Mus musculus
tggggcacagtaaccatgcaaaaga

SEQ ID NO: 891470 - DNA, 25 bp, Mus musculus
tggggcacagtatccatgcaaaaga

SEQ ID NO: 891471 - DNA, 25 bp, Mus musculus
tggggcatccaccagtgactcattt

SEQ ID NO: 891472 - DNA, 25 bp, Mus musculus
tggggcatccacgagtgactcattt

SEQ ID NO: 891473 - DNA, 25 bp, Mus musculus
tggggccaagacagagacttcatct

SEQ ID NO: 891474 - DNA, 25 bp, Mus musculus
tggggccaagactgagacttcatct

SEQ ID NO: 891475 - DNA, 25 bp, Mus musculus
tggggccatgcacagaatatccttc

SEQ ID NO: 891476 - DNA, 25 bp, Mus musculus
tggggccatgcagagaatatccttc

SEQ ID NO: 891477 - DNA, 25 bp, Mus musculus
tggggcccacttacctataggttgt

SEQ ID NO: 891478 - DNA, 25 bp, Mus musculus
tggggcccactttcctataggttgt

SEQ ID NO: 891479 - DNA, 25 bp, Mus musculus
tggggcctcgggcttggcagatgaa

SEQ ID NO: 891480 - DNA, 25 bp, Mus musculus
tggggcctcggggttggcagatgaa

SEQ ID NO: 891481 - DNA, 25 bp, Mus musculus
tggggctgcggtcctttggcctgtg

SEQ ID NO: 891482 - DNA, 25 bp, Mus musculus
tggggctgcggtgctttggcctgtg

SEQ ID NO: 891483 - DNA, 25 bp, Mus musculus
tggggcttctgcagtaataaaggac

SEQ ID NO: 891484 - DNA, 25 bp, Mus musculus
tggggcttctgctgtaataaaggac

SEQ ID NO: 891485 - DNA, 25 bp, Mus musculus
tgggggacacgcactacaaaacttc

SEQ ID NO: 891486 - DNA, 25 bp, Mus musculus
tgggggacacgctctacaaaacttc

SEQ ID NO: 891487 - DNA, 25 bp, Mus musculus
tgggggaccagacattcaattccca

SEQ ID NO: 891488 - DNA, 25 bp, Mus musculus
tgggggaccagagattcaattccca

SEQ ID NO: 891489 - DNA, 25 bp, Mus musculus
tggggggactctactggagctcctc

SEQ ID NO: 891490 - DNA, 25 bp, Mus musculus
tggggggactcttctggagctcctc

SEQ ID NO: 891491 - DNA, 25 bp, Mus musculus
tggggtagggttcagagctcaggct

SEQ ID NO: 891492 - DNA, 25 bp, Mus musculus
tggggtagggttgagagctcaggct

SEQ ID NO: 891493 - DNA, 25 bp, Mus musculus
tggggtccctgcagttaaggacacc

SEQ ID NO: 891494 - DNA, 25 bp, Mus musculus
tggggtccctgctgttaaggacacc

SEQ ID NO: 891495 - DNA, 25 bp, Mus musculus
tggggtcgaaggctcatactctcct

SEQ ID NO: 891496 - DNA, 25 bp, Mus musculus
tggggtcgaagggtcatactctcct

SEQ ID NO: 891497 - DNA, 25 bp, Mus musculus
tgggtaaaaccaaccgtaaggctga

SEQ ID NO: 891498 - DNA, 25 bp, Mus musculus
tgggtaaaaccatccgtaaggctga

SEQ ID NO: 891499 - DNA, 25 bp, Mus musculus
tgggtaaaagccagtaagcctcaag

SEQ ID NO: 891500 - DNA, 25 bp, Mus musculus
tgggtaaaagcctgtaagcctcaag

SEQ ID NO: 891501 - DNA, 25 bp, Mus musculus
tgggtaaacattactgacctcctca

SEQ ID NO: 891502 - DNA, 25 bp, Mus musculus
tgggtaaacatttctgacctcctca

SEQ ID NO: 891503 - DNA, 25 bp, Mus musculus
tgggtaaagtccatcaccttctggt

SEQ ID NO: 891504 - DNA, 25 bp, Mus musculus
tgggtaaagtccttcaccttctggt

SEQ ID NO: 891505 - DNA, 25 bp, Mus musculus
tgggtaaatccaagggccggcctca

SEQ ID NO: 891506 - DNA, 25 bp, Mus musculus
tgggtaaatccatgggccggcctca

SEQ ID NO: 891507 - DNA, 25 bp, Mus musculus
tgggtaacaatgattccaagtcttt

SEQ ID NO: 891508 - DNA, 25 bp, Mus musculus
tgggtaacaatgtttccaagtcttt

SEQ ID NO: 891509 - DNA, 25 bp, Mus musculus
tgggtaacagcgacctccgagcagg

SEQ ID NO: 891510 - DNA, 25 bp, Mus musculus
tgggtaacagcgtcctccgagcagg

SEQ ID NO: 891511 - DNA, 25 bp, Mus musculus
tgggtaacagtgaaccatttatagt

SEQ ID NO: 891512 - DNA, 25 bp, Mus musculus
tgggtaacagtgtaccatttatagt

SEQ ID NO: 891513 - DNA, 25 bp, Mus musculus
tgggtaacatgtccatattattcca

SEQ ID NO: 891514 - DNA, 25 bp, Mus musculus
tgggtaacatgtgcatattattcca

SEQ ID NO: 891515 - DNA, 25 bp, Mus musculus
tgggtaaccctaccctgaaatggag

SEQ ID NO: 891516 - DNA, 25 bp, Mus musculus
tgggtaaccctagcctgaaatggag

SEQ ID NO: 891517 - DNA, 25 bp, Mus musculus
tgggtaaccctgcagatttattacg

SEQ ID NO: 891518 - DNA, 25 bp, Mus musculus
tgggtaaccctggagatttattacg

SEQ ID NO: 891519 - DNA, 25 bp, Mus musculus
tgggtaaccgtgctcctgaaagtcg

SEQ ID NO: 891520 - DNA, 25 bp, Mus musculus
tgggtaaccgtggtcctgaaagtcg

SEQ ID NO: 891521 - DNA, 25 bp, Mus musculus
tgggtaagagcacccgactgctctt

SEQ ID NO: 891522 - DNA, 25 bp, Mus musculus
tgggtaagagcagccgactgctctt

SEQ ID NO: 891523 - DNA, 25 bp, Mus musculus
tgggtaagaggaaccgtgtgaaact

SEQ ID NO: 891524 - DNA, 25 bp, Mus musculus
tgggtaagaggatccgtgtgaaact

SEQ ID NO: 891525 - DNA, 25 bp, Mus musculus
tgggtaagcactcttctaccagatc

SEQ ID NO: 891526 - DNA, 25 bp, Mus musculus
tgggtaagcactgttctaccagatc

SEQ ID NO: 891527 - DNA, 25 bp, Mus musculus
tgggtaagcagtccccactgatgga

SEQ ID NO: 891528 - DNA, 25 bp, Mus musculus
tgggtaagcagtgcccactgatgga

SEQ ID NO: 891529 - DNA, 25 bp, Mus musculus
tgggtaataagtcacccctcctgtt

SEQ ID NO: 891530 - DNA, 25 bp, Mus musculus
tgggtaataagtgacccctcctgtt

SEQ ID NO: 891531 - DNA, 25 bp, Mus musculus
tgggtaatctggctgctgctgctcc

SEQ ID NO: 891532 - DNA, 25 bp, Mus musculus
tgggtaatctgggtgctgctgctcc

SEQ ID NO: 891533 - DNA, 25 bp, Mus musculus
tgggtaatgacaccttgcctctgcc

SEQ ID NO: 891534 - DNA, 25 bp, Mus musculus
tgggtaatgacagcttgcctctgcc

SEQ ID NO: 891535 - DNA, 25 bp, Mus musculus
tgggtaattaccagactgtgacggt

SEQ ID NO: 891536 - DNA, 25 bp, Mus musculus
tgggtaattacctgactgtgacggt

SEQ ID NO: 891537 - DNA, 25 bp, Mus musculus
tgggtaattccgaccatgggcaaat

SEQ ID NO: 891538 - DNA, 25 bp, Mus musculus
tgggtaattccgtccatgggcaaat

SEQ ID NO: 891539 - DNA, 25 bp, Mus musculus
tgggtaatttctctagcttgctaaa

SEQ ID NO: 891540 - DNA, 25 bp, Mus musculus
tgggtaatttctgtagcttgctaaa

SEQ ID NO: 891541 - DNA, 25 bp, Mus musculus
tgggtacaactgcaagtcctttcct

SEQ ID NO: 891542 - DNA, 25 bp, Mus musculus
tgggtacaactggaagtcctttcct

SEQ ID NO: 891543 - DNA, 25 bp, Mus musculus
tgggtacaagtgcttggctctgcaa

SEQ ID NO: 891544 - DNA, 25 bp, Mus musculus
tgggtacaagtggttggctctgcaa

SEQ ID NO: 891545 - DNA, 25 bp, Mus musculus
tgggtacacaagaggccttcagaaa

SEQ ID NO: 891546 - DNA, 25 bp, Mus musculus
tgggtacacaagtggccttcagaaa

SEQ ID NO: 891547 - DNA, 25 bp, Mus musculus
tgggtacacagcaagaattaaactc

SEQ ID NO: 891548 - DNA, 25 bp, Mus musculus
tgggtacacagctagaattaaactc

SEQ ID NO: 891549 - DNA, 25 bp, Mus musculus
tgggtacactaaccagggccagacc

SEQ ID NO: 891550 - DNA, 25 bp, Mus musculus
tgggtacactaagcagggccagacc

SEQ ID NO: 891551 - DNA, 25 bp, Mus musculus
tgggtacactacaccttgagatcct

SEQ ID NO: 891552 - DNA, 25 bp, Mus musculus
tgggtacactactccttgagatcct

SEQ ID NO: 891553 - DNA, 25 bp, Mus musculus
tgggtacacttgacctggcctgtgt

SEQ ID NO: 891554 - DNA, 25 bp, Mus musculus
tgggtacacttgtcctggcctgtgt

SEQ ID NO: 891555 - DNA, 25 bp, Mus musculus
tgggtacagcttacagtctcactga

SEQ ID NO: 891556 - DNA, 25 bp, Mus musculus
tgggtacagctttcagtctcactga

SEQ ID NO: 891557 - DNA, 25 bp, Mus musculus
tgggtacaggagacgccctagttac

SEQ ID NO: 891558 - DNA, 25 bp, Mus musculus
tgggtacaggagtcgccctagttac

SEQ ID NO: 891559 - DNA, 25 bp, Mus musculus
tgggtaccagatagcagtcagagaa

SEQ ID NO: 891560 - DNA, 25 bp, Mus musculus
tgggtaccagattgcagtcagagaa

SEQ ID NO: 891561 - DNA, 25 bp, Mus musculus
tgggtaccgcaaacaccaaggcctc

SEQ ID NO: 891562 - DNA, 25 bp, Mus musculus
tgggtaccgcaatcaccaaggcctc

SEQ ID NO: 891563 - DNA, 25 bp, Mus musculus
tgggtaccggagactgacctacgaa

SEQ ID NO: 891564 - DNA, 25 bp, Mus musculus
tgggtaccggagtctgacctacgaa

SEQ ID NO: 891565 - DNA, 25 bp, Mus musculus
tgggtacctctccacacaagtggtg

SEQ ID NO: 891566 - DNA, 25 bp, Mus musculus
tgggtacctctcgacacaagtggtg

SEQ ID NO: 891567 - DNA, 25 bp, Mus musculus
tgggtacctgtccacctcggaatca

SEQ ID NO: 891568 - DNA, 25 bp, Mus musculus
tgggtacctgtcgacctcggaatca

SEQ ID NO: 891569 - DNA, 25 bp, Mus musculus
tgggtacctttcaacagatgtggat

SEQ ID NO: 891570 - DNA, 25 bp, Mus musculus
tgggtacctttctacagatgtggat

SEQ ID NO: 891571 - DNA, 25 bp, Mus musculus
tgggtacggtagcaactcgacctga

SEQ ID NO: 891572 - DNA, 25 bp, Mus musculus
tgggtacggtaggaactcgacctga

SEQ ID NO: 891573 - DNA, 25 bp, Mus musculus
tgggtacggttgcttttccatatgg

SEQ ID NO: 891574 - DNA, 25 bp, Mus musculus
tgggtacggttggttttccatatgg

SEQ ID NO: 891575 - DNA, 25 bp, Mus musculus
tgggtactagctactcacttgtaga

SEQ ID NO: 891576 - DNA, 25 bp, Mus musculus
tgggtactagcttctcacttgtaga

SEQ ID NO: 891577 - DNA, 25 bp, Mus musculus
tgggtactattccacagtttgattt

SEQ ID NO: 891578 - DNA, 25 bp, Mus musculus
tgggtactattcgacagtttgattt

SEQ ID NO: 891579 - DNA, 25 bp, Mus musculus
tgggtactattgaagcctggtatca

SEQ ID NO: 891580 - DNA, 25 bp, Mus musculus
tgggtactattgtagcctggtatca

SEQ ID NO: 891581 - DNA, 25 bp, Mus musculus
tgggtactgaggaccttgtctaacc

SEQ ID NO: 891582 - DNA, 25 bp, Mus musculus
tgggtactgaggtccttgtctaacc

SEQ ID NO: 891583 - DNA, 25 bp, Mus musculus
tgggtacttccccaagtcactgtgc

SEQ ID NO: 891584 - DNA, 25 bp, Mus musculus
tgggtacttcccgaagtcactgtgc

SEQ ID NO: 891585 - DNA, 25 bp, Mus musculus
tgggtacttgtccttgttgtcacac

SEQ ID NO: 891586 - DNA, 25 bp, Mus musculus
tgggtacttgtcgttgttgtcacac

SEQ ID NO: 891587 - DNA, 25 bp, Mus musculus
tgggtagaaggaactttctgttccc

SEQ ID NO: 891588 - DNA, 25 bp, Mus musculus
tgggtagaaggatctttctgttccc

SEQ ID NO: 891589 - DNA, 25 bp, Mus musculus
tgggtagaagtgagggtctctccct

SEQ ID NO: 891590 - DNA, 25 bp, Mus musculus
tgggtagaagtgtgggtctctccct

SEQ ID NO: 891591 - DNA, 25 bp, Mus musculus
tgggtagaattgcacttcagaaaac

SEQ ID NO: 891592 - DNA, 25 bp, Mus musculus
tgggtagaattggacttcagaaaac

SEQ ID NO: 891593 - DNA, 25 bp, Mus musculus
tgggtagactctactcctaacaggg

SEQ ID NO: 891594 - DNA, 25 bp, Mus musculus
tgggtagactcttctcctaacaggg

SEQ ID NO: 891595 - DNA, 25 bp, Mus musculus
tgggtagagcccagcccagccatca

SEQ ID NO: 891596 - DNA, 25 bp, Mus musculus
tgggtagagccctgcccagccatca

SEQ ID NO: 891597 - DNA, 25 bp, Mus musculus
tgggtagagcgcatgttcttgcaga

SEQ ID NO: 891598 - DNA, 25 bp, Mus musculus
tgggtagagcgcttgttcttgcaga

SEQ ID NO: 891599 - DNA, 25 bp, Mus musculus
tgggtagaggacaattgaggcccca

SEQ ID NO: 891600 - DNA, 25 bp, Mus musculus
tgggtagaggactattgaggcccca

SEQ ID NO: 891601 - DNA, 25 bp, Mus musculus
tgggtagatacactgttccaaacct

SEQ ID NO: 891602 - DNA, 25 bp, Mus musculus
tgggtagatacagtgttccaaacct

SEQ ID NO: 891603 - DNA, 25 bp, Mus musculus
tgggtagatcagctggtcgcatttt

SEQ ID NO: 891604 - DNA, 25 bp, Mus musculus
tgggtagatcaggtggtcgcatttt

SEQ ID NO: 891605 - DNA, 25 bp, Mus musculus
tgggtagatgacaccccactcaaac

SEQ ID NO: 891606 - DNA, 25 bp, Mus musculus
tgggtagatgactccccactcaaac

SEQ ID NO: 891607 - DNA, 25 bp, Mus musculus
tgggtagatgtaagtgcacacctgt

SEQ ID NO: 891608 - DNA, 25 bp, Mus musculus
tgggtagatgtatgtgcacacctgt

SEQ ID NO: 891609 - DNA, 25 bp, Mus musculus
tgggtagattgcagtgctttccgct

SEQ ID NO: 891610 - DNA, 25 bp, Mus musculus
tgggtagattgctgtgctttccgct

SEQ ID NO: 891611 - DNA, 25 bp, Mus musculus
tgggtagcaccactggccactctta

SEQ ID NO: 891612 - DNA, 25 bp, Mus musculus
tgggtagcaccagtggccactctta

SEQ ID NO: 891613 - DNA, 25 bp, Mus musculus
tgggtagcacccatagaacttccac

SEQ ID NO: 891614 - DNA, 25 bp, Mus musculus
tgggtagcacccttagaacttccac

SEQ ID NO: 891615 - DNA, 25 bp, Mus musculus
tgggtagcccttacaagtggcctga

SEQ ID NO: 891616 - DNA, 25 bp, Mus musculus
tgggtagccctttcaagtggcctga

SEQ ID NO: 891617 - DNA, 25 bp, Mus musculus
tgggtaggcagcagctatgatctga

SEQ ID NO: 891618 - DNA, 25 bp, Mus musculus
tgggtaggcagctgctatgatctga

SEQ ID NO: 891619 - DNA, 25 bp, Mus musculus
tgggtagggcacctgttcccttcct

SEQ ID NO: 891620 - DNA, 25 bp, Mus musculus
tgggtagggcacgtgttcccttcct

SEQ ID NO: 891621 - DNA, 25 bp, Mus musculus
tgggtaggtgggactcacttgtctc

SEQ ID NO: 891622 - DNA, 25 bp, Mus musculus
tgggtaggtgggtctcacttgtctc

SEQ ID NO: 891623 - DNA, 25 bp, Mus musculus
tgggtagtaccaagttggctggtct

SEQ ID NO: 891624 - DNA, 25 bp, Mus musculus
tgggtagtaccatgttggctggtct

SEQ ID NO: 891625 - DNA, 25 bp, Mus musculus
tgggtagtccatcctatgatccgag

SEQ ID NO: 891626 - DNA, 25 bp, Mus musculus
tgggtagtccatgctatgatccgag

SEQ ID NO: 891627 - DNA, 25 bp, Mus musculus
tgggtagtgccaatctctcctgtca

SEQ ID NO: 891628 - DNA, 25 bp, Mus musculus
tgggtagtgccattctctcctgtca

SEQ ID NO: 891629 - DNA, 25 bp, Mus musculus
tgggtagtgcccaaaacgcgggcct

SEQ ID NO: 891630 - DNA, 25 bp, Mus musculus
tgggtagtgcccctagggttcataa

SEQ ID NO: 891631 - DNA, 25 bp, Mus musculus
tgggtagtgcccgtagggttcataa

SEQ ID NO: 891632 - DNA, 25 bp, Mus musculus
tgggtagtgccctaaacgcgggcct

SEQ ID NO: 891633 - DNA, 25 bp, Mus musculus
tgggtagtttttacataagccttat

SEQ ID NO: 891634 - DNA, 25 bp, Mus musculus
tgggtagttttttcataagccttat

SEQ ID NO: 891635 - DNA, 25 bp, Mus musculus
tgggtataccttcagtcacttctgc

SEQ ID NO: 891636 - DNA, 25 bp, Mus musculus
tgggtataccttgagtcacttctgc

SEQ ID NO: 891637 - DNA, 25 bp, Mus musculus
tgggtatactctccttaggtttcgc

SEQ ID NO: 891638 - DNA, 25 bp, Mus musculus
tgggtatactctgcttaggtttcgc

SEQ ID NO: 891639 - DNA, 25 bp, Mus musculus
tgggtatcagctacggcaacagatt

SEQ ID NO: 891640 - DNA, 25 bp, Mus musculus
tgggtatcagcttcggcaacagatt

SEQ ID NO: 891641 - DNA, 25 bp, Mus musculus
tgggtatccacacttggttcctctt

SEQ ID NO: 891642 - DNA, 25 bp, Mus musculus
tgggtatccacagttggttcctctt

SEQ ID NO: 891643 - DNA, 25 bp, Mus musculus
tgggtatccagcactagccatctcc

SEQ ID NO: 891644 - DNA, 25 bp, Mus musculus
tgggtatccagctctagccatctcc

SEQ ID NO: 891645 - DNA, 25 bp, Mus musculus
tgggtatccagtcaccagggtccta

SEQ ID NO: 891646 - DNA, 25 bp, Mus musculus
tgggtatccagtgaccagggtccta

SEQ ID NO: 891647 - DNA, 25 bp, Mus musculus
tgggtatcctgtaagctgtgtgcca

SEQ ID NO: 891648 - DNA, 25 bp, Mus musculus
tgggtatcctgttagctgtgtgcca

SEQ ID NO: 891649 - DNA, 25 bp, Mus musculus
tgggtatctaccatggaactatgta

SEQ ID NO: 891650 - DNA, 25 bp, Mus musculus
tgggtatctaccttggaactatgta

SEQ ID NO: 891651 - DNA, 25 bp, Mus musculus
tgggtatgcctgattggctgaagca

SEQ ID NO: 891652 - DNA, 25 bp, Mus musculus
tgggtatgcctgtttggctgaagca

SEQ ID NO: 891653 - DNA, 25 bp, Mus musculus
tgggtatgccttcacttacttacat

SEQ ID NO: 891654 - DNA, 25 bp, Mus musculus
tgggtatgccttgacttacttacat

SEQ ID NO: 891655 - DNA, 25 bp, Mus musculus
tgggtatggcagaacaggagcacta

SEQ ID NO: 891656 - DNA, 25 bp, Mus musculus
tgggtatggcagtacaggagcacta

SEQ ID NO: 891657 - DNA, 25 bp, Mus musculus
tgggtattaattaactttcatctgt

SEQ ID NO: 891658 - DNA, 25 bp, Mus musculus
tgggtattaatttactttcatctgt

SEQ ID NO: 891659 - DNA, 25 bp, Mus musculus
tgggtattaccacctggcactggca

SEQ ID NO: 891660 - DNA, 25 bp, Mus musculus
tgggtattaccagctggcactggca

SEQ ID NO: 891661 - DNA, 25 bp, Mus musculus
tgggtattacttcgccaccaggatt

SEQ ID NO: 891662 - DNA, 25 bp, Mus musculus
tgggtattacttggccaccaggatt

SEQ ID NO: 891663 - DNA, 25 bp, Mus musculus
tgggtattatctccctgtcagacat

SEQ ID NO: 891664 - DNA, 25 bp, Mus musculus
tgggtattatctgcctgtcagacat

SEQ ID NO: 891665 - DNA, 25 bp, Mus musculus
tgggtattctagactcctgttcagc

SEQ ID NO: 891666 - DNA, 25 bp, Mus musculus
tgggtattctagtctcctgttcagc

SEQ ID NO: 891667 - DNA, 25 bp, Mus musculus
tgggtattttagcaataagccaaaa

SEQ ID NO: 891668 - DNA, 25 bp, Mus musculus
tgggtattttaggaataagccaaaa

SEQ ID NO: 891669 - DNA, 25 bp, Mus musculus
tgggtcaacccaatcggaacacgga

SEQ ID NO: 891670 - DNA, 25 bp, Mus musculus
tgggtcaacccattcggaacacgga

SEQ ID NO: 891671 - DNA, 25 bp, Mus musculus
tgggtcaagtgccattgaagcatta

SEQ ID NO: 891672 - DNA, 25 bp, Mus musculus
tgggtcaagtgcgattgaagcatta

SEQ ID NO: 891673 - DNA, 25 bp, Mus musculus
tgggtcaatcccagtgaaataacac

SEQ ID NO: 891674 - DNA, 25 bp, Mus musculus
tgggtcaatccctgtgaaataacac

SEQ ID NO: 891675 - DNA, 25 bp, Mus musculus
tgggtcacacatcctgggaacaaga

SEQ ID NO: 891676 - DNA, 25 bp, Mus musculus
tgggtcacacatgctgggaacaaga

SEQ ID NO: 891677 - DNA, 25 bp, Mus musculus
tgggtcacataacttgctttacact

SEQ ID NO: 891678 - DNA, 25 bp, Mus musculus
tgggtcacataagttgctttacact

SEQ ID NO: 891679 - DNA, 25 bp, Mus musculus
tgggtcaccactacagtgtaccagt

SEQ ID NO: 891680 - DNA, 25 bp, Mus musculus
tgggtcaccacttcagtgtaccagt

SEQ ID NO: 891681 - DNA, 25 bp, Mus musculus
tgggtcaccagtacagtctctattg

SEQ ID NO: 891682 - DNA, 25 bp, Mus musculus
tgggtcaccagttcagtctctattg

SEQ ID NO: 891683 - DNA, 25 bp, Mus musculus
tgggtcaccatgaccgctatagatt

SEQ ID NO: 891684 - DNA, 25 bp, Mus musculus
tgggtcaccatgtccgctatagatt

SEQ ID NO: 891685 - DNA, 25 bp, Mus musculus
tgggtcacctcaccccagagtatag

SEQ ID NO: 891686 - DNA, 25 bp, Mus musculus
tgggtcacctcagcccagagtatag

SEQ ID NO: 891687 - DNA, 25 bp, Mus musculus
tgggtcactcatccttgacatttcc

SEQ ID NO: 891688 - DNA, 25 bp, Mus musculus
tgggtcactcatgcttgacatttcc

SEQ ID NO: 891689 - DNA, 25 bp, Mus musculus
tgggtcactgatattcacctcaaat

SEQ ID NO: 891690 - DNA, 25 bp, Mus musculus
tgggtcactgattttcacctcaaat

SEQ ID NO: 891691 - DNA, 25 bp, Mus musculus
tgggtcactggcatgtcacatgcaa

SEQ ID NO: 891692 - DNA, 25 bp, Mus musculus
tgggtcactggcttgtcacatgcaa

SEQ ID NO: 891693 - DNA, 25 bp, Mus musculus
tgggtcacttcaagcacccagagca

SEQ ID NO: 891694 - DNA, 25 bp, Mus musculus
tgggtcacttcactattgtggaaac

SEQ ID NO: 891695 - DNA, 25 bp, Mus musculus
tgggtcacttcagtattgtggaaac

SEQ ID NO: 891696 - DNA, 25 bp, Mus musculus
tgggtcacttcatgcacccagagca

SEQ ID NO: 891697 - DNA, 25 bp, Mus musculus
tgggtcagacttactagagaacact

SEQ ID NO: 891698 - DNA, 25 bp, Mus musculus
tgggtcagactttctagagaacact

SEQ ID NO: 891699 - DNA, 25 bp, Mus musculus
tgggtcagagccacacagatgcgga

SEQ ID NO: 891700 - DNA, 25 bp, Mus musculus
tgggtcagagcctcacagatgcgga

SEQ ID NO: 891701 - DNA, 25 bp, Mus musculus
tgggtcagaggcatatgctcacgcg

SEQ ID NO: 891702 - DNA, 25 bp, Mus musculus
tgggtcagaggcttatgctcacgcg

SEQ ID NO: 891703 - DNA, 25 bp, Mus musculus
tgggtcagcagaccatgccttactg

SEQ ID NO: 891704 - DNA, 25 bp, Mus musculus
tgggtcagcagagcatgccttactg

SEQ ID NO: 891705 - DNA, 25 bp, Mus musculus
tgggtcagcatgactagctggcact

SEQ ID NO: 891706 - DNA, 25 bp, Mus musculus
tgggtcagcatgtctagctggcact

SEQ ID NO: 891707 - DNA, 25 bp, Mus musculus
tgggtcagccaaacaggccagtgtg

SEQ ID NO: 891708 - DNA, 25 bp, Mus musculus
tgggtcagccaatcaggccagtgtg

SEQ ID NO: 891709 - DNA, 25 bp, Mus musculus
tgggtcagccttcccacagagtggt

SEQ ID NO: 891710 - DNA, 25 bp, Mus musculus
tgggtcagccttgccacagagtggt

SEQ ID NO: 891711 - DNA, 25 bp, Mus musculus
tgggtcagcgctcagcttcggaatt

SEQ ID NO: 891712 - DNA, 25 bp, Mus musculus
tgggtcagcgctgagcttcggaatt

SEQ ID NO: 891713 - DNA, 25 bp, Mus musculus
tgggtcaggagtcctcacataccat

SEQ ID NO: 891714 - DNA, 25 bp, Mus musculus
tgggtcaggagtgctcacataccat

SEQ ID NO: 891715 - DNA, 25 bp, Mus musculus
tgggtcaggccaagctacactaacc

SEQ ID NO: 891716 - DNA, 25 bp, Mus musculus
tgggtcaggccatgctacactaacc

SEQ ID NO: 891717 - DNA, 25 bp, Mus musculus
tgggtcagtccaagcccaaggccct

SEQ ID NO: 891718 - DNA, 25 bp, Mus musculus
tgggtcagtccatgcccaaggccct

SEQ ID NO: 891719 - DNA, 25 bp, Mus musculus
tgggtcagttggacttcttgctaaa

SEQ ID NO: 891720 - DNA, 25 bp, Mus musculus
tgggtcagttggtcttcttgctaaa

SEQ ID NO: 891721 - DNA, 25 bp, Mus musculus
tgggtcagttgtaagcccaacaaat

SEQ ID NO: 891722 - DNA, 25 bp, Mus musculus
tgggtcagttgttagcccaacaaat

SEQ ID NO: 891723 - DNA, 25 bp, Mus musculus
tgggtcagttttatagtgcttgcct

SEQ ID NO: 891724 - DNA, 25 bp, Mus musculus
tgggtcagttttttagtgcttgcct

SEQ ID NO: 891725 - DNA, 25 bp, Mus musculus
tgggtcatagtgaacaactgtgact

SEQ ID NO: 891726 - DNA, 25 bp, Mus musculus
tgggtcatagtgtacaactgtgact

SEQ ID NO: 891727 - DNA, 25 bp, Mus musculus
tgggtcatatgcacctgcacgcagg

SEQ ID NO: 891728 - DNA, 25 bp, Mus musculus
tgggtcatatgctcctgcacgcagg

SEQ ID NO: 891729 - DNA, 25 bp, Mus musculus
tgggtcatcagccagagcttcagaa

SEQ ID NO: 891730 - DNA, 25 bp, Mus musculus
tgggtcatcagcgagagcttcagaa

SEQ ID NO: 891731 - DNA, 25 bp, Mus musculus
tgggtcatccagatatcgctttgtc

SEQ ID NO: 891732 - DNA, 25 bp, Mus musculus
tgggtcatccagttatcgctttgtc

SEQ ID NO: 891733 - DNA, 25 bp, Mus musculus
tgggtcatctatccttcaggactta

SEQ ID NO: 891734 - DNA, 25 bp, Mus musculus
tgggtcatctatgcttcaggactta

SEQ ID NO: 891735 - DNA, 25 bp, Mus musculus
tgggtcatctgtatctaattgtggc

SEQ ID NO: 891736 - DNA, 25 bp, Mus musculus
tgggtcatctgtttctaattgtggc

SEQ ID NO: 891737 - DNA, 25 bp, Mus musculus
tgggtcatgacccttttgggactag

SEQ ID NO: 891738 - DNA, 25 bp, Mus musculus
tgggtcatgaccgttttgggactag

SEQ ID NO: 891739 - DNA, 25 bp, Mus musculus
tgggtcatgaggaccaggtcttcat

SEQ ID NO: 891740 - DNA, 25 bp, Mus musculus
tgggtcatgaggtccaggtcttcat

SEQ ID NO: 891741 - DNA, 25 bp, Mus musculus
tgggtcatgcaccatctgtaaggga

SEQ ID NO: 891742 - DNA, 25 bp, Mus musculus
tgggtcatgcacgatctgtaaggga

SEQ ID NO: 891743 - DNA, 25 bp, Mus musculus
tgggtcattataatcttagctcttc

SEQ ID NO: 891744 - DNA, 25 bp, Mus musculus
tgggtcattatattcttagctcttc

SEQ ID NO: 891745 - DNA, 25 bp, Mus musculus
tgggtcattgggaccagccactgtg

SEQ ID NO: 891746 - DNA, 25 bp, Mus musculus
tgggtcattgggtccagccactgtg

SEQ ID NO: 891747 - DNA, 25 bp, Mus musculus
tgggtccaaaaacattcttattact

SEQ ID NO: 891748 - DNA, 25 bp, Mus musculus
tgggtccaaaaagattcttattact

SEQ ID NO: 891749 - DNA, 25 bp, Mus musculus
tgggtccaaaagacttgattatttt

SEQ ID NO: 891750 - DNA, 25 bp, Mus musculus
tgggtccaaaagtcttgattatttt

SEQ ID NO: 891751 - DNA, 25 bp, Mus musculus
tgggtccaaacccatttgctggaat

SEQ ID NO: 891752 - DNA, 25 bp, Mus musculus
tgggtccaaaccgatttgctggaat

SEQ ID NO: 891753 - DNA, 25 bp, Mus musculus
tgggtccaagaacccggctctgcgt

SEQ ID NO: 891754 - DNA, 25 bp, Mus musculus
tgggtccaagaagccggctctgcgt

SEQ ID NO: 891755 - DNA, 25 bp, Mus musculus
tgggtccacaacagccacctttgct

SEQ ID NO: 891756 - DNA, 25 bp, Mus musculus
tgggtccacaactgccacctttgct

SEQ ID NO: 891757 - DNA, 25 bp, Mus musculus
tgggtccacacaccttgctcctgag

SEQ ID NO: 891758 - DNA, 25 bp, Mus musculus
tgggtccacacagcttgctcctgag

SEQ ID NO: 891759 - DNA, 25 bp, Mus musculus
tgggtccacatgaatcagaaggcag

SEQ ID NO: 891760 - DNA, 25 bp, Mus musculus
tgggtccacatgtatcagaaggcag

SEQ ID NO: 891761 - DNA, 25 bp, Mus musculus
tgggtccacattcaccagagatagt

SEQ ID NO: 891762 - DNA, 25 bp, Mus musculus
tgggtccacattgaccagagatagt

SEQ ID NO: 891763 - DNA, 25 bp, Mus musculus
tgggtccactgacgttcaacacaac

SEQ ID NO: 891764 - DNA, 25 bp, Mus musculus
tgggtccactgaggttcaacacaac

SEQ ID NO: 891765 - DNA, 25 bp, Mus musculus
tgggtccaggatagccgtcagtgcc

SEQ ID NO: 891766 - DNA, 25 bp, Mus musculus
tgggtccaggattgccgtcagtgcc

SEQ ID NO: 891767 - DNA, 25 bp, Mus musculus
tgggtccagtacacaagcatctttt

SEQ ID NO: 891768 - DNA, 25 bp, Mus musculus
tgggtccagtactcaagcatctttt

SEQ ID NO: 891769 - DNA, 25 bp, Mus musculus
tgggtccagttcagacctgcacaac

SEQ ID NO: 891770 - DNA, 25 bp, Mus musculus
tgggtccagttctgacctgcacaac

SEQ ID NO: 891771 - DNA, 25 bp, Mus musculus
tgggtccataggagaagcctcctgg

SEQ ID NO: 891772 - DNA, 25 bp, Mus musculus
tgggtccataggtgaagcctcctgg

SEQ ID NO: 891773 - DNA, 25 bp, Mus musculus
tgggtccatcacatttcatttgggt

SEQ ID NO: 891774 - DNA, 25 bp, Mus musculus
tgggtccatcacttttcatttgggt

SEQ ID NO: 891775 - DNA, 25 bp, Mus musculus
tgggtcccaaagcattgtggcatca

SEQ ID NO: 891776 - DNA, 25 bp, Mus musculus
tgggtcccaaaggattgtggcatca

SEQ ID NO: 891777 - DNA, 25 bp, Mus musculus
tgggtcccagccaaaaggtcacctt

SEQ ID NO: 891778 - DNA, 25 bp, Mus musculus
tgggtcccagcctaaaggtcacctt

SEQ ID NO: 891779 - DNA, 25 bp, Mus musculus
tgggtcccatccctcaagtgggatg

SEQ ID NO: 891780 - DNA, 25 bp, Mus musculus
tgggtcccatccgtcaagtgggatg

SEQ ID NO: 891781 - DNA, 25 bp, Mus musculus
tgggtcccattgattctcatgcatg

SEQ ID NO: 891782 - DNA, 25 bp, Mus musculus
tgggtcccattgtttctcatgcatg

SEQ ID NO: 891783 - DNA, 25 bp, Mus musculus
tgggtcccctccatgttttagtcaa

SEQ ID NO: 891784 - DNA, 25 bp, Mus musculus
tgggtcccctccttgttttagtcaa

SEQ ID NO: 891785 - DNA, 25 bp, Mus musculus
tgggtcccctgaatggctcctgtgt

SEQ ID NO: 891786 - DNA, 25 bp, Mus musculus
tgggtcccctgattggctcctgtgt

SEQ ID NO: 891787 - DNA, 25 bp, Mus musculus
tgggtccccttcactcaaagaaaga

SEQ ID NO: 891788 - DNA, 25 bp, Mus musculus
tgggtccccttctctcaaagaaaga

SEQ ID NO: 891789 - DNA, 25 bp, Mus musculus
tgggtcccgagtcaactagccagga

SEQ ID NO: 891790 - DNA, 25 bp, Mus musculus
tgggtcccgagtgaactagccagga

SEQ ID NO: 891791 - DNA, 25 bp, Mus musculus
tgggtcccgcaaactgcaggtggcc

SEQ ID NO: 891792 - DNA, 25 bp, Mus musculus
tgggtcccgcaatctgcaggtggcc

SEQ ID NO: 891793 - DNA, 25 bp, Mus musculus
tgggtcccgtccacagcatttcata

SEQ ID NO: 891794 - DNA, 25 bp, Mus musculus
tgggtcccgtcctcagcatttcata

SEQ ID NO: 891795 - DNA, 25 bp, Mus musculus
tgggtccctagtaccagatgtcgaa

SEQ ID NO: 891796 - DNA, 25 bp, Mus musculus
tgggtccctagtctctatatgtcct

SEQ ID NO: 891797 - DNA, 25 bp, Mus musculus
tgggtccctagtgtctatatgtcct

SEQ ID NO: 891798 - DNA, 25 bp, Mus musculus
tgggtccctagttccagatgtcgaa

SEQ ID NO: 891799 - DNA, 25 bp, Mus musculus
tgggtccctcagctctggcacaaga

SEQ ID NO: 891800 - DNA, 25 bp, Mus musculus
tgggtccctcaggtctggcacaaga

SEQ ID NO: 891801 - DNA, 25 bp, Mus musculus
tgggtccctcgtctttgatcctggc

SEQ ID NO: 891802 - DNA, 25 bp, Mus musculus
tgggtccctcgtgtttgatcctggc

SEQ ID NO: 891803 - DNA, 25 bp, Mus musculus
tgggtccctgccaacagtgaggtag

SEQ ID NO: 891804 - DNA, 25 bp, Mus musculus
tgggtccctgcctacagtgaggtag

SEQ ID NO: 891805 - DNA, 25 bp, Mus musculus
tgggtcccttaacatttttcattat

SEQ ID NO: 891806 - DNA, 25 bp, Mus musculus
tgggtcccttaagatttttcattat

SEQ ID NO: 891807 - DNA, 25 bp, Mus musculus
tgggtcccttgacttctcaaagctc

SEQ ID NO: 891808 - DNA, 25 bp, Mus musculus
tgggtcccttgagttctcaaagctc

SEQ ID NO: 891809 - DNA, 25 bp, Mus musculus
tgggtcccttgtaaaactcacacca

SEQ ID NO: 891810 - DNA, 25 bp, Mus musculus
tgggtcccttgtacataactccttg

SEQ ID NO: 891811 - DNA, 25 bp, Mus musculus
tgggtcccttgttaaactcacacca

SEQ ID NO: 891812 - DNA, 25 bp, Mus musculus
tgggtcccttgttcataactccttg

SEQ ID NO: 891813 - DNA, 25 bp, Mus musculus
tgggtcccttttcatcatgaccatg

SEQ ID NO: 891814 - DNA, 25 bp, Mus musculus
tgggtcccttttgatcatgaccatg

SEQ ID NO: 891815 - DNA, 25 bp, Mus musculus
tgggtcctcaccagggcctgagacg

SEQ ID NO: 891816 - DNA, 25 bp, Mus musculus
tgggtcctcacctgggcctgagacg

SEQ ID NO: 891817 - DNA, 25 bp, Mus musculus
tgggtcctccacatgtagcagcatc

SEQ ID NO: 891818 - DNA, 25 bp, Mus musculus
tgggtcctccacttgtagcagcatc

SEQ ID NO: 891819 - DNA, 25 bp, Mus musculus
tgggtcctcctcaagcacaagaagt

SEQ ID NO: 891820 - DNA, 25 bp, Mus musculus
tgggtcctcctctagcacaagaagt

SEQ ID NO: 891821 - DNA, 25 bp, Mus musculus
tgggtcctcgaaccctctgttcttg

SEQ ID NO: 891822 - DNA, 25 bp, Mus musculus
tgggtcctcgaagcctctgttcttg

SEQ ID NO: 891823 - DNA, 25 bp, Mus musculus
tgggtcctcgtcactgcccgaagag

SEQ ID NO: 891824 - DNA, 25 bp, Mus musculus
tgggtcctcgtctctgcccgaagag

SEQ ID NO: 891825 - DNA, 25 bp, Mus musculus
tgggtcctctctcaaatcgatagcc

SEQ ID NO: 891826 - DNA, 25 bp, Mus musculus
tgggtcctctctgaaatcgatagcc

SEQ ID NO: 891827 - DNA, 25 bp, Mus musculus
tgggtcctctgacctatgataccaa

SEQ ID NO: 891828 - DNA, 25 bp, Mus musculus
tgggtcctctgagctatgataccaa

SEQ ID NO: 891829 - DNA, 25 bp, Mus musculus
tgggtcctctgcaatggtcttaagc

SEQ ID NO: 891830 - DNA, 25 bp, Mus musculus
tgggtcctctgctatggtcttaagc

SEQ ID NO: 891831 - DNA, 25 bp, Mus musculus
tgggtcctctggcatagctgcagat

SEQ ID NO: 891832 - DNA, 25 bp, Mus musculus
tgggtcctctgggatagctgcagat

SEQ ID NO: 891833 - DNA, 25 bp, Mus musculus
tgggtcctctttagcctgttaactt

SEQ ID NO: 891834 - DNA, 25 bp, Mus musculus
tgggtcctcttttgcctgttaactt

SEQ ID NO: 891835 - DNA, 25 bp, Mus musculus
tgggtcctgacaactcggaactctg

SEQ ID NO: 891836 - DNA, 25 bp, Mus musculus
tgggtcctgacatctcggaactctg

SEQ ID NO: 891837 - DNA, 25 bp, Mus musculus
tgggtcctgcccctgaagaaaaaga

SEQ ID NO: 891838 - DNA, 25 bp, Mus musculus
tgggtcctgcccgtgaagaaaaaga

SEQ ID NO: 891839 - DNA, 25 bp, Mus musculus
tgggtcctggaaaggcctgtctttt

SEQ ID NO: 891840 - DNA, 25 bp, Mus musculus
tgggtcctggaatggcctgtctttt

SEQ ID NO: 891841 - DNA, 25 bp, Mus musculus
tgggtcctggagctcgacgaccatc

SEQ ID NO: 891842 - DNA, 25 bp, Mus musculus
tgggtcctggaggtcgacgaccatc

SEQ ID NO: 891843 - DNA, 25 bp, Mus musculus
tgggtcctgtagagctgcagttatg

SEQ ID NO: 891844 - DNA, 25 bp, Mus musculus
tgggtcctgtagtgctgcagttatg

SEQ ID NO: 891845 - DNA, 25 bp, Mus musculus
tgggtcctgtctcttttgactaata

SEQ ID NO: 891846 - DNA, 25 bp, Mus musculus
tgggtcctgtctgttttgactaata

SEQ ID NO: 891847 - DNA, 25 bp, Mus musculus
tgggtccttctgctgaactactctg

SEQ ID NO: 891848 - DNA, 25 bp, Mus musculus
tgggtccttctggtgaactactctg

SEQ ID NO: 891849 - DNA, 25 bp, Mus musculus
tgggtccttcttcccgaatttcaag

SEQ ID NO: 891850 - DNA, 25 bp, Mus musculus
tgggtccttcttgccgaatttcaag

SEQ ID NO: 891851 - DNA, 25 bp, Mus musculus
tgggtcctttacagaatgttctaca

SEQ ID NO: 891852 - DNA, 25 bp, Mus musculus
tgggtcctttactgaatgttctaca

SEQ ID NO: 891853 - DNA, 25 bp, Mus musculus
tgggtcctttgtagccccagtcttc

SEQ ID NO: 891854 - DNA, 25 bp, Mus musculus
tgggtcctttgtattaaggaggctg

SEQ ID NO: 891855 - DNA, 25 bp, Mus musculus
tgggtcctttgttgccccagtcttc

SEQ ID NO: 891856 - DNA, 25 bp, Mus musculus
tgggtcctttgttttaaggaggctg

SEQ ID NO: 891857 - DNA, 25 bp, Mus musculus
tgggtccttttcatgttctatttag

SEQ ID NO: 891858 - DNA, 25 bp, Mus musculus
tgggtccttttcttgttctatttag

SEQ ID NO: 891859 - DNA, 25 bp, Mus musculus
tgggtcggagtcagcctagccgtgg

SEQ ID NO: 891860 - DNA, 25 bp, Mus musculus
tgggtcggagtctgcctagccgtgg

SEQ ID NO: 891861 - DNA, 25 bp, Mus musculus
tgggtcggcaccagttcagattacc

SEQ ID NO: 891862 - DNA, 25 bp, Mus musculus
tgggtcggcacctgttcagattacc

SEQ ID NO: 891863 - DNA, 25 bp, Mus musculus
tgggtcgtctctatgggtccgcaga

SEQ ID NO: 891864 - DNA, 25 bp, Mus musculus
tgggtcgtctctttgggtccgcaga

SEQ ID NO: 891865 - DNA, 25 bp, Mus musculus
tgggtcgtttttagaacaaatactg

SEQ ID NO: 891866 - DNA, 25 bp, Mus musculus
tgggtcgttttttgaacaaatactg

SEQ ID NO: 891867 - DNA, 25 bp, Mus musculus
tgggtctaaccaaacaccagcattg

SEQ ID NO: 891868 - DNA, 25 bp, Mus musculus
tgggtctaaccatacaccagcattg

SEQ ID NO: 891869 - DNA, 25 bp, Mus musculus
tgggtctaagcgattaccttcagtc

SEQ ID NO: 891870 - DNA, 25 bp, Mus musculus
tgggtctaagcgtttaccttcagtc

SEQ ID NO: 891871 - DNA, 25 bp, Mus musculus
tgggtctacctccacgggctcagat

SEQ ID NO: 891872 - DNA, 25 bp, Mus musculus
tgggtctacctcgacgggctcagat

SEQ ID NO: 891873 - DNA, 25 bp, Mus musculus
tgggtctacgacatgtggcttcaaa

SEQ ID NO: 891874 - DNA, 25 bp, Mus musculus
tgggtctacgacttgtggcttcaaa

SEQ ID NO: 891875 - DNA, 25 bp, Mus musculus
tgggtctacttactacctcacagag

SEQ ID NO: 891876 - DNA, 25 bp, Mus musculus
tgggtctacttagtacctcacagag

SEQ ID NO: 891877 - DNA, 25 bp, Mus musculus
tgggtctacttcagtctgtgtaatt

SEQ ID NO: 891878 - DNA, 25 bp, Mus musculus
tgggtctacttctgtctgtgtaatt

SEQ ID NO: 891879 - DNA, 25 bp, Mus musculus
tgggtctagagaatgcccgaggact

SEQ ID NO: 891880 - DNA, 25 bp, Mus musculus
tgggtctagagattgcccgaggact

SEQ ID NO: 891881 - DNA, 25 bp, Mus musculus
tgggtctagcacataccagccaggt

SEQ ID NO: 891882 - DNA, 25 bp, Mus musculus
tgggtctagcacttaccagccaggt

SEQ ID NO: 891883 - DNA, 25 bp, Mus musculus
tgggtctatgaccatgtccactgta

SEQ ID NO: 891884 - DNA, 25 bp, Mus musculus
tgggtctatgacgatgtccactgta

SEQ ID NO: 891885 - DNA, 25 bp, Mus musculus
tgggtctcacccagtcttgttctcc

SEQ ID NO: 891886 - DNA, 25 bp, Mus musculus
tgggtctcaccctgtcttgttctcc

SEQ ID NO: 891887 - DNA, 25 bp, Mus musculus
tgggtctcagcacccacgtctgtca

SEQ ID NO: 891888 - DNA, 25 bp, Mus musculus
tgggtctcagcagccacgtctgtca

SEQ ID NO: 891889 - DNA, 25 bp, Mus musculus
tgggtctcatgcatccttactgact

SEQ ID NO: 891890 - DNA, 25 bp, Mus musculus
tgggtctcatgcttccttactgact

SEQ ID NO: 891891 - DNA, 25 bp, Mus musculus
tgggtctcattgctgcccgccggac

SEQ ID NO: 891892 - DNA, 25 bp, Mus musculus
tgggtctcattggtgcccgccggac

SEQ ID NO: 891893 - DNA, 25 bp, Mus musculus
tgggtctccatacgcatgtctctga

SEQ ID NO: 891894 - DNA, 25 bp, Mus musculus
tgggtctccataggcatgtctctga

SEQ ID NO: 891895 - DNA, 25 bp, Mus musculus
tgggtctccatgctgtaccccagag

SEQ ID NO: 891896 - DNA, 25 bp, Mus musculus
tgggtctccatggtgtaccccagag

SEQ ID NO: 891897 - DNA, 25 bp, Mus musculus
tgggtctcctatctttatctgtaaa

SEQ ID NO: 891898 - DNA, 25 bp, Mus musculus
tgggtctcctatgtttatctgtaaa

SEQ ID NO: 891899 - DNA, 25 bp, Mus musculus
tgggtctcctccaggaagtaaataa

SEQ ID NO: 891900 - DNA, 25 bp, Mus musculus
tgggtctcctcctggaagtaaataa

SEQ ID NO: 891901 - DNA, 25 bp, Mus musculus
tgggtctcctctaccagaaggcctg

SEQ ID NO: 891902 - DNA, 25 bp, Mus musculus
tgggtctcctctagcttatttggcg

SEQ ID NO: 891903 - DNA, 25 bp, Mus musculus
tgggtctcctcttccagaaggcctg

SEQ ID NO: 891904 - DNA, 25 bp, Mus musculus
tgggtctcctcttgcttatttggcg

SEQ ID NO: 891905 - DNA, 25 bp, Mus musculus
tgggtctcctgtcccgagtcatgaa

SEQ ID NO: 891906 - DNA, 25 bp, Mus musculus
tgggtctcctgtgccgagtcatgaa

SEQ ID NO: 891907 - DNA, 25 bp, Mus musculus
tgggtctcgagcacatctggagaaa

SEQ ID NO: 891908 - DNA, 25 bp, Mus musculus
tgggtctcgagctcatctggagaaa

SEQ ID NO: 891909 - DNA, 25 bp, Mus musculus
tgggtctctataagaacagctttct

SEQ ID NO: 891910 - DNA, 25 bp, Mus musculus
tgggtctctatatgaacagctttct

SEQ ID NO: 891911 - DNA, 25 bp, Mus musculus
tgggtctctcccaagaacgtgtttt

SEQ ID NO: 891912 - DNA, 25 bp, Mus musculus
tgggtctctccctagaacgtgtttt

SEQ ID NO: 891913 - DNA, 25 bp, Mus musculus
tgggtctctgaccttcatttgaacc

SEQ ID NO: 891914 - DNA, 25 bp, Mus musculus
tgggtctctgacgttcatttgaacc

SEQ ID NO: 891915 - DNA, 25 bp, Mus musculus
tgggtctctgcaattgctggcatta

SEQ ID NO: 891916 - DNA, 25 bp, Mus musculus
tgggtctctgcatttgctggcatta

SEQ ID NO: 891917 - DNA, 25 bp, Mus musculus
tgggtctctggcaatacatgaatat

SEQ ID NO: 891918 - DNA, 25 bp, Mus musculus
tgggtctctggctatacatgaatat

SEQ ID NO: 891919 - DNA, 25 bp, Mus musculus
tgggtctgaatgcaatgaaccactt

SEQ ID NO: 891920 - DNA, 25 bp, Mus musculus
tgggtctgaatggaatgaaccactt

SEQ ID NO: 891921 - DNA, 25 bp, Mus musculus
tgggtctgacctacacacagacaca

SEQ ID NO: 891922 - DNA, 25 bp, Mus musculus
tgggtctgaccttcacacagacaca

SEQ ID NO: 891923 - DNA, 25 bp, Mus musculus
tgggtctgcacgactactgtgacat

SEQ ID NO: 891924 - DNA, 25 bp, Mus musculus
tgggtctgcacgtctactgtgacat

SEQ ID NO: 891925 - DNA, 25 bp, Mus musculus
tgggtctgcagacccgcaatttaga

SEQ ID NO: 891926 - DNA, 25 bp, Mus musculus
tgggtctgcagagccgcaatttaga

SEQ ID NO: 891927 - DNA, 25 bp, Mus musculus
tgggtctgcaggcttatgtttccac

SEQ ID NO: 891928 - DNA, 25 bp, Mus musculus
tgggtctgcagggttatgtttccac

SEQ ID NO: 891929 - DNA, 25 bp, Mus musculus
tgggtctgccccatctagggacatg

SEQ ID NO: 891930 - DNA, 25 bp, Mus musculus
tgggtctgccccttctagggacatg

SEQ ID NO: 891931 - DNA, 25 bp, Mus musculus
tgggtctgcctacgatccaagcaac

SEQ ID NO: 891932 - DNA, 25 bp, Mus musculus
tgggtctgcctaggatccaagcaac

SEQ ID NO: 891933 - DNA, 25 bp, Mus musculus
tgggtctgcctcagcccctgaaggt

SEQ ID NO: 891934 - DNA, 25 bp, Mus musculus
tgggtctgcctctgcccctgaaggt

SEQ ID NO: 891935 - DNA, 25 bp, Mus musculus
tgggtctgccttccttactacacaa

SEQ ID NO: 891936 - DNA, 25 bp, Mus musculus
tgggtctgccttgcttactacacaa

SEQ ID NO: 891937 - DNA, 25 bp, Mus musculus
tgggtctgctcgatagcaccacgca

SEQ ID NO: 891938 - DNA, 25 bp, Mus musculus
tgggtctgctcgttagcaccacgca

SEQ ID NO: 891939 - DNA, 25 bp, Mus musculus
tgggtctggtctctgcactggcaca

SEQ ID NO: 891940 - DNA, 25 bp, Mus musculus
tgggtctggtctgtgcactggcaca

SEQ ID NO: 891941 - DNA, 25 bp, Mus musculus
tgggtctggttgagactcgccacct

SEQ ID NO: 891942 - DNA, 25 bp, Mus musculus
tgggtctggttgtgactcgccacct

SEQ ID NO: 891943 - DNA, 25 bp, Mus musculus
tgggtctgtccacaaccttagcctt

SEQ ID NO: 891944 - DNA, 25 bp, Mus musculus
tgggtctgtccagaaccttagcctt

SEQ ID NO: 891945 - DNA, 25 bp, Mus musculus
tgggtctgtgtgcactgcccctata

SEQ ID NO: 891946 - DNA, 25 bp, Mus musculus
tgggtctgtgtggactgcccctata

SEQ ID NO: 891947 - DNA, 25 bp, Mus musculus
tgggtcttaccaccacagtgtttga

SEQ ID NO: 891948 - DNA, 25 bp, Mus musculus
tgggtcttaccagcacagtgtttga

SEQ ID NO: 891949 - DNA, 25 bp, Mus musculus
tgggtcttactgagagagtccttct

SEQ ID NO: 891950 - DNA, 25 bp, Mus musculus
tgggtcttactgtgagagtccttct

SEQ ID NO: 891951 - DNA, 25 bp, Mus musculus
tgggtcttcaaaccgccaggctgat

SEQ ID NO: 891952 - DNA, 25 bp, Mus musculus
tgggtcttcaaagcgccaggctgat

SEQ ID NO: 891953 - DNA, 25 bp, Mus musculus
tgggtcttcaagacgtacaattatt

SEQ ID NO: 891954 - DNA, 25 bp, Mus musculus
tgggtcttcaagtcgtacaattatt

SEQ ID NO: 891955 - DNA, 25 bp, Mus musculus
tgggtcttcagccatttgccacaca

SEQ ID NO: 891956 - DNA, 25 bp, Mus musculus
tgggtcttcagcgatttgccacaca

SEQ ID NO: 891957 - DNA, 25 bp, Mus musculus
tgggtcttccccagtattctgctgc

SEQ ID NO: 891958 - DNA, 25 bp, Mus musculus
tgggtcttcccctgtattctgctgc

SEQ ID NO: 891959 - DNA, 25 bp, Mus musculus
tgggtcttcccgatctaccttaaca

SEQ ID NO: 891960 - DNA, 25 bp, Mus musculus
tgggtcttcccgttctaccttaaca

SEQ ID NO: 891961 - DNA, 25 bp, Mus musculus
tgggtcttcctgctgatctacatca

SEQ ID NO: 891962 - DNA, 25 bp, Mus musculus
tgggtcttcctggtgatctacatca

SEQ ID NO: 891963 - DNA, 25 bp, Mus musculus
tgggtcttgagtaaccaaccttcta

SEQ ID NO: 891964 - DNA, 25 bp, Mus musculus
tgggtcttgagttaccaaccttcta

SEQ ID NO: 891965 - DNA, 25 bp, Mus musculus
tgggtcttgcttccaaccaagtggc

SEQ ID NO: 891966 - DNA, 25 bp, Mus musculus
tgggtcttgcttgcaaccaagtggc

SEQ ID NO: 891967 - DNA, 25 bp, Mus musculus
tgggtcttggacacactgatgtttt

SEQ ID NO: 891968 - DNA, 25 bp, Mus musculus
tgggtcttggactcactgatgtttt

SEQ ID NO: 891969 - DNA, 25 bp, Mus musculus
tgggtcttggtaaacactgtgtcat

SEQ ID NO: 891970 - DNA, 25 bp, Mus musculus
tgggtcttggtatacactgtgtcat

SEQ ID NO: 891971 - DNA, 25 bp, Mus musculus
tgggtctttacacctctgtgaagta

SEQ ID NO: 891972 - DNA, 25 bp, Mus musculus
tgggtctttacagctctgtgaagta

SEQ ID NO: 891973 - DNA, 25 bp, Mus musculus
tgggtctttctgaggcacggaccaa

SEQ ID NO: 891974 - DNA, 25 bp, Mus musculus
tgggtctttctgtggcacggaccaa

SEQ ID NO: 891975 - DNA, 25 bp, Mus musculus
tgggtctttgctactcacaatcttg

SEQ ID NO: 891976 - DNA, 25 bp, Mus musculus
tgggtctttgcttctcacaatcttg

SEQ ID NO: 891977 - DNA, 25 bp, Mus musculus
tgggtgaacaacctctatgtcttct

SEQ ID NO: 891978 - DNA, 25 bp, Mus musculus
tgggtgaacaacgtctatgtcttct

SEQ ID NO: 891979 - DNA, 25 bp, Mus musculus
tgggtgaacaccatcattctggtag

SEQ ID NO: 891980 - DNA, 25 bp, Mus musculus
tgggtgaacaccttcattctggtag

SEQ ID NO: 891981 - DNA, 25 bp, Mus musculus
tgggtgaactgaaggcagttccctc

SEQ ID NO: 891982 - DNA, 25 bp, Mus musculus
tgggtgaactgatggcagttccctc

SEQ ID NO: 891983 - DNA, 25 bp, Mus musculus
tgggtgaataatatgtgcagggaac

SEQ ID NO: 891984 - DNA, 25 bp, Mus musculus
tgggtgaataatttgtgcagggaac

SEQ ID NO: 891985 - DNA, 25 bp, Mus musculus
tgggtgacaagaatcagggaacctg

SEQ ID NO: 891986 - DNA, 25 bp, Mus musculus
tgggtgacaagattcagggaacctg

SEQ ID NO: 891987 - DNA, 25 bp, Mus musculus
tgggtgacaccaagaagatctacat

SEQ ID NO: 891988 - DNA, 25 bp, Mus musculus
tgggtgacaccatgaagatctacat

SEQ ID NO: 891989 - DNA, 25 bp, Mus musculus
tgggtgacagatcttcactccagca

SEQ ID NO: 891990 - DNA, 25 bp, Mus musculus
tgggtgacagatgttcactccagca

SEQ ID NO: 891991 - DNA, 25 bp, Mus musculus
tgggtgacagtgagctcccttggca

SEQ ID NO: 891992 - DNA, 25 bp, Mus musculus
tgggtgacagtgtgctcccttggca

SEQ ID NO: 891993 - DNA, 25 bp, Mus musculus
tgggtgacataaactttgcaactaa

SEQ ID NO: 891994 - DNA, 25 bp, Mus musculus
tgggtgacataatctttgcaactaa

SEQ ID NO: 891995 - DNA, 25 bp, Mus musculus
tgggtgacatcccttttccacagag

SEQ ID NO: 891996 - DNA, 25 bp, Mus musculus
tgggtgacatccgttttccacagag

SEQ ID NO: 891997 - DNA, 25 bp, Mus musculus
tgggtgacccgaattcctgtgttgt

SEQ ID NO: 891998 - DNA, 25 bp, Mus musculus
tgggtgacccgatttcctgtgttgt

SEQ ID NO: 891999 - DNA, 25 bp, Mus musculus
tgggtgaccctgaggccttatctca

SEQ ID NO: 892000 - DNA, 25 bp, Mus musculus
tgggtgaccctgtggccttatctca

SEQ ID NO: 892001 - DNA, 25 bp, Mus musculus
tgggtgaccgacaagtcctcagcca

SEQ ID NO: 892002 - DNA, 25 bp, Mus musculus
tgggtgaccgactagtcctcagcca

SEQ ID NO: 892003 - DNA, 25 bp, Mus musculus
tgggtgaccggcatgtcatgagaca

SEQ ID NO: 892004 - DNA, 25 bp, Mus musculus
tgggtgaccggcttgtcatgagaca

SEQ ID NO: 892005 - DNA, 25 bp, Mus musculus
tgggtgacgaggcccagagcaagag

SEQ ID NO: 892006 - DNA, 25 bp, Mus musculus
tgggtgacgagggccagagcaagag

SEQ ID NO: 892007 - DNA, 25 bp, Mus musculus
tgggtgactccaaaacaatcggtat

SEQ ID NO: 892008 - DNA, 25 bp, Mus musculus
tgggtgactccataacaatcggtat

SEQ ID NO: 892009 - DNA, 25 bp, Mus musculus
tgggtgactcgccataaatcagccg

SEQ ID NO: 892010 - DNA, 25 bp, Mus musculus
tgggtgactcgcgataaatcagccg

SEQ ID NO: 892011 - DNA, 25 bp, Mus musculus
tgggtgagctttctacaatctgtac

SEQ ID NO: 892012 - DNA, 25 bp, Mus musculus
tgggtgagctttgtacaatctgtac

SEQ ID NO: 892013 - DNA, 25 bp, Mus musculus
tgggtgaggctcacctgcccaggac

SEQ ID NO: 892014 - DNA, 25 bp, Mus musculus
tgggtgaggctctcctgcccaggac

SEQ ID NO: 892015 - DNA, 25 bp, Mus musculus
tgggtgatctcaccccattacctga

SEQ ID NO: 892016 - DNA, 25 bp, Mus musculus
tgggtgatctcagcccattacctga

SEQ ID NO: 892017 - DNA, 25 bp, Mus musculus
tgggtgatgaacactcggatccgga

SEQ ID NO: 892018 - DNA, 25 bp, Mus musculus
tgggtgatgaactctcggatccgga

SEQ ID NO: 892019 - DNA, 25 bp, Mus musculus
tgggtgatgcccacggtttcaaccc

SEQ ID NO: 892020 - DNA, 25 bp, Mus musculus
tgggtgatgccctcggtttcaaccc

SEQ ID NO: 892021 - DNA, 25 bp, Mus musculus
tgggtgcaactgcaccaatgggcca

SEQ ID NO: 892022 - DNA, 25 bp, Mus musculus
tgggtgcaactggaccaatgggcca

SEQ ID NO: 892023 - DNA, 25 bp, Mus musculus
tgggtgcacaacagttaggcatgct

SEQ ID NO: 892024 - DNA, 25 bp, Mus musculus
tgggtgcacaactgttaggcatgct

SEQ ID NO: 892025 - DNA, 25 bp, Mus musculus
tgggtgcacatgctcgtttttccgc

SEQ ID NO: 892026 - DNA, 25 bp, Mus musculus
tgggtgcacatggtcgtttttccgc

SEQ ID NO: 892027 - DNA, 25 bp, Mus musculus
tgggtgcagacacaggcatccacgt

SEQ ID NO: 892028 - DNA, 25 bp, Mus musculus
tgggtgcagacagaggcatccacgt

SEQ ID NO: 892029 - DNA, 25 bp, Mus musculus
tgggtgcagcatccggactacagct

SEQ ID NO: 892030 - DNA, 25 bp, Mus musculus
tgggtgcagcatgcggactacagct

SEQ ID NO: 892031 - DNA, 25 bp, Mus musculus
tgggtgcaggcgcacatctacaacc

SEQ ID NO: 892032 - DNA, 25 bp, Mus musculus
tgggtgcaggcggacatctacaacc

SEQ ID NO: 892033 - DNA, 25 bp, Mus musculus
tgggtgcaggtcactctcaagccgc

SEQ ID NO: 892034 - DNA, 25 bp, Mus musculus
tgggtgcaggtctctctcaagccgc

SEQ ID NO: 892035 - DNA, 25 bp, Mus musculus
tgggtgcatgtcataatgctgagaa

SEQ ID NO: 892036 - DNA, 25 bp, Mus musculus
tgggtgcatgtcttaatgctgagaa

SEQ ID NO: 892037 - DNA, 25 bp, Mus musculus
tgggtgcattatcggcttcatcagc

SEQ ID NO: 892038 - DNA, 25 bp, Mus musculus
tgggtgcattatgggcttcatcagc

SEQ ID NO: 892039 - DNA, 25 bp, Mus musculus
tgggtgccacacaaggccaagctgg

SEQ ID NO: 892040 - DNA, 25 bp, Mus musculus
tgggtgccacactaggccaagctgg

SEQ ID NO: 892041 - DNA, 25 bp, Mus musculus
tgggtgccacccctcattggcgaga

SEQ ID NO: 892042 - DNA, 25 bp, Mus musculus
tgggtgccacccgtcattggcgaga

SEQ ID NO: 892043 - DNA, 25 bp, Mus musculus
tgggtgccattgctaaaatgctcaa

SEQ ID NO: 892044 - DNA, 25 bp, Mus musculus
tgggtgccattggtaaaatgctcaa

SEQ ID NO: 892045 - DNA, 25 bp, Mus musculus
tgggtgcccacgagaatacgttctg

SEQ ID NO: 892046 - DNA, 25 bp, Mus musculus
tgggtgcccacgtgaatacgttctg

SEQ ID NO: 892047 - DNA, 25 bp, Mus musculus
tgggtgcccagactgatgctcagaa

SEQ ID NO: 892048 - DNA, 25 bp, Mus musculus
tgggtgcccagagtgatgctcagaa

SEQ ID NO: 892049 - DNA, 25 bp, Mus musculus
tgggtgccgcacaggtcacagctga

SEQ ID NO: 892050 - DNA, 25 bp, Mus musculus
tgggtgccgcactggtcacagctga

SEQ ID NO: 892051 - DNA, 25 bp, Mus musculus
tgggtgccgtctctctcccgtttgt

SEQ ID NO: 892052 - DNA, 25 bp, Mus musculus
tgggtgccgtctgtctcccgtttgt

SEQ ID NO: 892053 - DNA, 25 bp, Mus musculus
tgggtgcctcagctttggattttcc

SEQ ID NO: 892054 - DNA, 25 bp, Mus musculus
tgggtgcctcaggtttggattttcc

SEQ ID NO: 892055 - DNA, 25 bp, Mus musculus
tgggtgcctccaaggcttccttgag

SEQ ID NO: 892056 - DNA, 25 bp, Mus musculus
tgggtgcctccatggcttccttgag

SEQ ID NO: 892057 - DNA, 25 bp, Mus musculus
tgggtgccttacatcaacggcaagt

SEQ ID NO: 892058 - DNA, 25 bp, Mus musculus
tgggtgccttacttcaacggcaagt

SEQ ID NO: 892059 - DNA, 25 bp, Mus musculus
tgggtgcctttgatggactccatac

SEQ ID NO: 892060 - DNA, 25 bp, Mus musculus
tgggtgcctttgttggactccatac

SEQ ID NO: 892061 - DNA, 25 bp, Mus musculus
tgggtgcgcgtcctgaccaaatgaa

SEQ ID NO: 892062 - DNA, 25 bp, Mus musculus
tgggtgcgcgtcgtgaccaaatgaa

SEQ ID NO: 892063 - DNA, 25 bp, Mus musculus
tgggtgctaggccaacctcgaaacc

SEQ ID NO: 892064 - DNA, 25 bp, Mus musculus
tgggtgctaggcgaacctcgaaacc

SEQ ID NO: 892065 - DNA, 25 bp, Mus musculus
tgggtgctatgcatggtattctgga

SEQ ID NO: 892066 - DNA, 25 bp, Mus musculus
tgggtgctatgcttggtattctgga

SEQ ID NO: 892067 - DNA, 25 bp, Mus musculus
tgggtgctcacaaccagctgtccag

SEQ ID NO: 892068 - DNA, 25 bp, Mus musculus
tgggtgctcacatccagctgtccag

SEQ ID NO: 892069 - DNA, 25 bp, Mus musculus
tgggtgctccaccaaccgagagcat

SEQ ID NO: 892070 - DNA, 25 bp, Mus musculus
tgggtgctccacgaaccgagagcat

SEQ ID NO: 892071 - DNA, 25 bp, Mus musculus
tgggtgctcttaatcctggcttgga

SEQ ID NO: 892072 - DNA, 25 bp, Mus musculus
tgggtgctcttattcctggcttgga

SEQ ID NO: 892073 - DNA, 25 bp, Mus musculus
tgggtgctctttctgatcctcatcc

SEQ ID NO: 892074 - DNA, 25 bp, Mus musculus
tgggtgctctttgtgatcctcatcc

SEQ ID NO: 892075 - DNA, 25 bp, Mus musculus
tgggtgctgataaccacgccagatc

SEQ ID NO: 892076 - DNA, 25 bp, Mus musculus
tgggtgctgatatccacgccagatc

SEQ ID NO: 892077 - DNA, 25 bp, Mus musculus
tgggtgctggtcattggctaagatt

SEQ ID NO: 892078 - DNA, 25 bp, Mus musculus
tgggtgctggtctttggctaagatt

SEQ ID NO: 892079 - DNA, 25 bp, Mus musculus
tgggtgctggtgactggccaattat

SEQ ID NO: 892080 - DNA, 25 bp, Mus musculus
tgggtgctggtgtctggccaattat

SEQ ID NO: 892081 - DNA, 25 bp, Mus musculus
tgggtgcttagcattgttggttcaa

SEQ ID NO: 892082 - DNA, 25 bp, Mus musculus
tgggtgcttagctttgttggttcaa

SEQ ID NO: 892083 - DNA, 25 bp, Mus musculus
tgggtgctttctaaggtagtttcct

SEQ ID NO: 892084 - DNA, 25 bp, Mus musculus
tgggtgctttcttaggtagtttcct

SEQ ID NO: 892085 - DNA, 25 bp, Mus musculus
tgggtgcttttgatggttatgtttt

SEQ ID NO: 892086 - DNA, 25 bp, Mus musculus
tgggtgcttttgttggttatgtttt

SEQ ID NO: 892087 - DNA, 25 bp, Mus musculus
tgggtggaaccacatacttctgtcc

SEQ ID NO: 892088 - DNA, 25 bp, Mus musculus
tgggtggaaccagatacttctgtcc

SEQ ID NO: 892089 - DNA, 25 bp, Mus musculus
tgggtggaagaaaacattccctctt

SEQ ID NO: 892090 - DNA, 25 bp, Mus musculus
tgggtggaagaatacattccctctt

SEQ ID NO: 892091 - DNA, 25 bp, Mus musculus
tgggtggagacgctccataccttta

SEQ ID NO: 892092 - DNA, 25 bp, Mus musculus
tgggtggagacggtccataccttta

SEQ ID NO: 892093 - DNA, 25 bp, Mus musculus
tgggtggcaagcacgtgtctacact

SEQ ID NO: 892094 - DNA, 25 bp, Mus musculus
tgggtggcaagctcgtgtctacact

SEQ ID NO: 892095 - DNA, 25 bp, Mus musculus
tgggtggcaccaaccctaggcagat

SEQ ID NO: 892096 - DNA, 25 bp, Mus musculus
tgggtggcaccatccctaggcagat

SEQ ID NO: 892097 - DNA, 25 bp, Mus musculus
tgggtggcagatactcgaacatttg

SEQ ID NO: 892098 - DNA, 25 bp, Mus musculus
tgggtggcagattctcgaacatttg

SEQ ID NO: 892099 - DNA, 25 bp, Mus musculus
tgggtggcatgcaacgctccctctc

SEQ ID NO: 892100 - DNA, 25 bp, Mus musculus
tgggtggcatgctacgctccctctc

SEQ ID NO: 892101 - DNA, 25 bp, Mus musculus
tgggtggccaataatctcctttctc

SEQ ID NO: 892102 - DNA, 25 bp, Mus musculus
tgggtggccaattatctcctttctc

SEQ ID NO: 892103 - DNA, 25 bp, Mus musculus
tgggtggccccgatgactttagtga

SEQ ID NO: 892104 - DNA, 25 bp, Mus musculus
tgggtggccccgttgactttagtga

SEQ ID NO: 892105 - DNA, 25 bp, Mus musculus
tgggtggccctcaacacaatgtggg

SEQ ID NO: 892106 - DNA, 25 bp, Mus musculus
tgggtggccctctacacaatgtggg

SEQ ID NO: 892107 - DNA, 25 bp, Mus musculus
tgggtggcccttacgatatctgaac

SEQ ID NO: 892108 - DNA, 25 bp, Mus musculus
tgggtggccctttcgatatctgaac

SEQ ID NO: 892109 - DNA, 25 bp, Mus musculus
tgggtggccgagaccgccgccatca

SEQ ID NO: 892110 - DNA, 25 bp, Mus musculus
tgggtggccgagtccgccgccatca

SEQ ID NO: 892111 - DNA, 25 bp, Mus musculus
tgggtggcctgtagccttttaaata

SEQ ID NO: 892112 - DNA, 25 bp, Mus musculus
tgggtggcctgtagcttctaaaata

SEQ ID NO: 892113 - DNA, 25 bp, Mus musculus
tgggtggcctgttgccttttaaata

SEQ ID NO: 892114 - DNA, 25 bp, Mus musculus
tgggtggcctgttgcttctaaaata

SEQ ID NO: 892115 - DNA, 25 bp, Mus musculus
tgggtggccttgatccagtgaccat

SEQ ID NO: 892116 - DNA, 25 bp, Mus musculus
tgggtggccttgttccagtgaccat

SEQ ID NO: 892117 - DNA, 25 bp, Mus musculus
tgggtggctgccacagagctcaatg

SEQ ID NO: 892118 - DNA, 25 bp, Mus musculus
tgggtggctgcctcagagctcaatg

SEQ ID NO: 892119 - DNA, 25 bp, Mus musculus
tgggtgggagtccttctgaacaact

SEQ ID NO: 892120 - DNA, 25 bp, Mus musculus
tgggtgggagtcgttctgaacaact

SEQ ID NO: 892121 - DNA, 25 bp, Mus musculus
tgggtgggattcaaatctgcagagc

SEQ ID NO: 892122 - DNA, 25 bp, Mus musculus
tgggtgggattctaatctgcagagc

SEQ ID NO: 892123 - DNA, 25 bp, Mus musculus
tgggtgggcctaccataaactgtaa

SEQ ID NO: 892124 - DNA, 25 bp, Mus musculus
tgggtgggcctagcataaactgtaa

SEQ ID NO: 892125 - DNA, 25 bp, Mus musculus
tgggtgggctccaaatactgtgcat

SEQ ID NO: 892126 - DNA, 25 bp, Mus musculus
tgggtgggctcctaatactgtgcat

SEQ ID NO: 892127 - DNA, 25 bp, Mus musculus
tgggtggggtggatcacataaaaca

SEQ ID NO: 892128 - DNA, 25 bp, Mus musculus
tgggtggggtggttcacataaaaca

SEQ ID NO: 892129 - DNA, 25 bp, Mus musculus
tgggtgggtcttactagtatttcct

SEQ ID NO: 892130 - DNA, 25 bp, Mus musculus
tgggtgggtctttctagtatttcct

SEQ ID NO: 892131 - DNA, 25 bp, Mus musculus
tgggtggtcaacaaccgagaacctt

SEQ ID NO: 892132 - DNA, 25 bp, Mus musculus
tgggtggtcaactaccgagaacctt

SEQ ID NO: 892133 - DNA, 25 bp, Mus musculus
tgggtggtgtcactacatcccggaa

SEQ ID NO: 892134 - DNA, 25 bp, Mus musculus
tgggtggtgtcagtacatcccggaa

SEQ ID NO: 892135 - DNA, 25 bp, Mus musculus
tgggtggttaaaccccaagcatcct

SEQ ID NO: 892136 - DNA, 25 bp, Mus musculus
tgggtggttaaagcccaagcatcct

SEQ ID NO: 892137 - DNA, 25 bp, Mus musculus
tgggtggttcacacacactcattca

SEQ ID NO: 892138 - DNA, 25 bp, Mus musculus
tgggtggttcactcacactcattca

SEQ ID NO: 892139 - DNA, 25 bp, Mus musculus
tgggtggttctcagacactgttaaa

SEQ ID NO: 892140 - DNA, 25 bp, Mus musculus
tgggtggttctctgacactgttaaa

SEQ ID NO: 892141 - DNA, 25 bp, Mus musculus
tgggtggttcttcctttacgatagt

SEQ ID NO: 892142 - DNA, 25 bp, Mus musculus
tgggtggttcttgctttacgatagt

SEQ ID NO: 892143 - DNA, 25 bp, Mus musculus
tgggtggttgccattcccggccaat

SEQ ID NO: 892144 - DNA, 25 bp, Mus musculus
tgggtggttgcctttcccggccaat

SEQ ID NO: 892145 - DNA, 25 bp, Mus musculus
tgggtggttggaaatctctttggat

SEQ ID NO: 892146 - DNA, 25 bp, Mus musculus
tgggtggttggatatctctttggat

SEQ ID NO: 892147 - DNA, 25 bp, Mus musculus
tgggtggttttcattggaagcctgt

SEQ ID NO: 892148 - DNA, 25 bp, Mus musculus
tgggtggttttctttggaagcctgt

SEQ ID NO: 892149 - DNA, 25 bp, Mus musculus
tgggtgtaatcaagtccttcagcaa

SEQ ID NO: 892150 - DNA, 25 bp, Mus musculus
tgggtgtaatcatgtccttcagcaa

SEQ ID NO: 892151 - DNA, 25 bp, Mus musculus
tgggtgtacgctctcttttcagaat

SEQ ID NO: 892152 - DNA, 25 bp, Mus musculus
tgggtgtacgctgtcttttcagaat

SEQ ID NO: 892153 - DNA, 25 bp, Mus musculus
tgggtgtagctcacttatttagtgt

SEQ ID NO: 892154 - DNA, 25 bp, Mus musculus
tgggtgtagctctcttatttagtgt

SEQ ID NO: 892155 - DNA, 25 bp, Mus musculus
tgggtgtatatgacccaggctccaa

SEQ ID NO: 892156 - DNA, 25 bp, Mus musculus
tgggtgtatatgtcccaggctccaa

SEQ ID NO: 892157 - DNA, 25 bp, Mus musculus
tgggtgtcaaccctacaagctgcca

SEQ ID NO: 892158 - DNA, 25 bp, Mus musculus
tgggtgtcaaccgtacaagctgcca

SEQ ID NO: 892159 - DNA, 25 bp, Mus musculus
tgggtgtcacttaacagaagccagc

SEQ ID NO: 892160 - DNA, 25 bp, Mus musculus
tgggtgtcactttacagaagccagc

SEQ ID NO: 892161 - DNA, 25 bp, Mus musculus
tgggtgtcagaccttcctgtgaaaa

SEQ ID NO: 892162 - DNA, 25 bp, Mus musculus
tgggtgtcagacgttcctgtgaaaa

SEQ ID NO: 892163 - DNA, 25 bp, Mus musculus
tgggtgtccactatgcttgaaatga

SEQ ID NO: 892164 - DNA, 25 bp, Mus musculus
tgggtgtccactttgcttgaaatga

SEQ ID NO: 892165 - DNA, 25 bp, Mus musculus
tgggtgtcccagctggctaacctca

SEQ ID NO: 892166 - DNA, 25 bp, Mus musculus
tgggtgtcccaggtggctaacctca

SEQ ID NO: 892167 - DNA, 25 bp, Mus musculus
tgggtgtcccctcgataggagcttt

SEQ ID NO: 892168 - DNA, 25 bp, Mus musculus
tgggtgtcccctggataggagcttt

SEQ ID NO: 892169 - DNA, 25 bp, Mus musculus
tgggtgtccctaccagttactgaga

SEQ ID NO: 892170 - DNA, 25 bp, Mus musculus
tgggtgtccctagcagttactgaga

SEQ ID NO: 892171 - DNA, 25 bp, Mus musculus
tgggtgtcccttcctaggattataa

SEQ ID NO: 892172 - DNA, 25 bp, Mus musculus
tgggtgtcccttgctaggattataa

SEQ ID NO: 892173 - DNA, 25 bp, Mus musculus
tgggtgtcctctccaggtgtcttct

SEQ ID NO: 892174 - DNA, 25 bp, Mus musculus
tgggtgtcctctgcaggtgtcttct

SEQ ID NO: 892175 - DNA, 25 bp, Mus musculus
tgggtgtctaccatttctgtagttt

SEQ ID NO: 892176 - DNA, 25 bp, Mus musculus
tgggtgtctaccttttctgtagttt

SEQ ID NO: 892177 - DNA, 25 bp, Mus musculus
tgggtgtctcagcatttgccctttc

SEQ ID NO: 892178 - DNA, 25 bp, Mus musculus
tgggtgtctcaggatttgccctttc

SEQ ID NO: 892179 - DNA, 25 bp, Mus musculus
tgggtgtgaactcctctgaggtcaa

SEQ ID NO: 892180 - DNA, 25 bp, Mus musculus
tgggtgtgaactgctctgaggtcaa

SEQ ID NO: 892181 - DNA, 25 bp, Mus musculus
tgggtgtgagcgactgtgccaccac

SEQ ID NO: 892182 - DNA, 25 bp, Mus musculus
tgggtgtgagcgtctgtgccaccac

SEQ ID NO: 892183 - DNA, 25 bp, Mus musculus
tgggtgtgaggaacctatctctcaa

SEQ ID NO: 892184 - DNA, 25 bp, Mus musculus
tgggtgtgaggatcctatctctcaa

SEQ ID NO: 892185 - DNA, 25 bp, Mus musculus
tgggtgtgcaccctattcaggtcag

SEQ ID NO: 892186 - DNA, 25 bp, Mus musculus
tgggtgtgcaccgtattcaggtcag

SEQ ID NO: 892187 - DNA, 25 bp, Mus musculus
tgggtgtgccctctgtctgaccatg

SEQ ID NO: 892188 - DNA, 25 bp, Mus musculus
tgggtgtgccctgtgtctgaccatg

SEQ ID NO: 892189 - DNA, 25 bp, Mus musculus
tgggtgtgcgccatcctcatggtgt

SEQ ID NO: 892190 - DNA, 25 bp, Mus musculus
tgggtgtgcgccttcctcatggtgt

SEQ ID NO: 892191 - DNA, 25 bp, Mus musculus
tgggtgtgcttgactccaagtctca

SEQ ID NO: 892192 - DNA, 25 bp, Mus musculus
tgggtgtgcttgtctccaagtctca

SEQ ID NO: 892193 - DNA, 25 bp, Mus musculus
tgggtgtgctttcattcagctggac

SEQ ID NO: 892194 - DNA, 25 bp, Mus musculus
tgggtgtgctttgattcagctggac

SEQ ID NO: 892195 - DNA, 25 bp, Mus musculus
tgggtgtggcacaaagaacttgata

SEQ ID NO: 892196 - DNA, 25 bp, Mus musculus
tgggtgtggcactaagaacttgata

SEQ ID NO: 892197 - DNA, 25 bp, Mus musculus
tgggtgtggcataccatgaccatgt

SEQ ID NO: 892198 - DNA, 25 bp, Mus musculus
tgggtgtggcattccatgaccatgt

SEQ ID NO: 892199 - DNA, 25 bp, Mus musculus
tgggtgtggctcacagctaaagaag

SEQ ID NO: 892200 - DNA, 25 bp, Mus musculus
tgggtgtggctctcagctaaagaag

SEQ ID NO: 892201 - DNA, 25 bp, Mus musculus
tgggtgtgggatcccttcttctcca

SEQ ID NO: 892202 - DNA, 25 bp, Mus musculus
tgggtgtgggatgccttcttctcca

SEQ ID NO: 892203 - DNA, 25 bp, Mus musculus
tgggtgtggtgtccatagctttact

SEQ ID NO: 892204 - DNA, 25 bp, Mus musculus
tgggtgtggtgtgcatagctttact

SEQ ID NO: 892205 - DNA, 25 bp, Mus musculus
tgggtgtgttctaccgcatgcactc

SEQ ID NO: 892206 - DNA, 25 bp, Mus musculus
tgggtgtgttcttccgcatgcactc

SEQ ID NO: 892207 - DNA, 25 bp, Mus musculus
tgggtgttactgcttttgcactgca

SEQ ID NO: 892208 - DNA, 25 bp, Mus musculus
tgggtgttactggttttgcactgca

SEQ ID NO: 892209 - DNA, 25 bp, Mus musculus
tgggtgttcaagacacactcactct

SEQ ID NO: 892210 - DNA, 25 bp, Mus musculus
tgggtgttcaagtcacactcactct

SEQ ID NO: 892211 - DNA, 25 bp, Mus musculus
tgggtgttcagaaccaggctgccta

SEQ ID NO: 892212 - DNA, 25 bp, Mus musculus
tgggtgttcagatccaggctgccta

SEQ ID NO: 892213 - DNA, 25 bp, Mus musculus
tgggtgttccatactgtcagtattg

SEQ ID NO: 892214 - DNA, 25 bp, Mus musculus
tgggtgttccattctgtcagtattg

SEQ ID NO: 892215 - DNA, 25 bp, Mus musculus
tgggtgttccccatactgctggtaa

SEQ ID NO: 892216 - DNA, 25 bp, Mus musculus
tgggtgttccccttactgctggtaa

SEQ ID NO: 892217 - DNA, 25 bp, Mus musculus
tgggtgttccgtatgttggtctgct

SEQ ID NO: 892218 - DNA, 25 bp, Mus musculus
tgggtgttccgtttgttggtctgct

SEQ ID NO: 892219 - DNA, 25 bp, Mus musculus
tgggtgttcctgattaactttctgg

SEQ ID NO: 892220 - DNA, 25 bp, Mus musculus
tgggtgttcctgtttaactttctgg

SEQ ID NO: 892221 - DNA, 25 bp, Mus musculus
tgggtgttcgctctgagcatgcaga

SEQ ID NO: 892222 - DNA, 25 bp, Mus musculus
tgggtgttcgctgtgagcatgcaga

SEQ ID NO: 892223 - DNA, 25 bp, Mus musculus
tgggtgttctcaacgtggtcctgac

SEQ ID NO: 892224 - DNA, 25 bp, Mus musculus
tgggtgttctcatcgtggtcctgac

SEQ ID NO: 892225 - DNA, 25 bp, Mus musculus
tgggtgttctctctgcttcctcaca

SEQ ID NO: 892226 - DNA, 25 bp, Mus musculus
tgggtgttctctgtgcttcctcaca

SEQ ID NO: 892227 - DNA, 25 bp, Mus musculus
tgggtgttgagtatttaggccaaag

SEQ ID NO: 892228 - DNA, 25 bp, Mus musculus
tgggtgttgagtttttaggccaaag

SEQ ID NO: 892229 - DNA, 25 bp, Mus musculus
tgggtgttgccccatcttgatggta

SEQ ID NO: 892230 - DNA, 25 bp, Mus musculus
tgggtgttgcccgatcttgatggta

SEQ ID NO: 892231 - DNA, 25 bp, Mus musculus
tgggtgttgtgactaccactgctct

SEQ ID NO: 892232 - DNA, 25 bp, Mus musculus
tgggtgttgtgagtaccactgctct

SEQ ID NO: 892233 - DNA, 25 bp, Mus musculus
tgggtgtttaagaccttcacatgaa

SEQ ID NO: 892234 - DNA, 25 bp, Mus musculus
tgggtgtttaagtccttcacatgaa

SEQ ID NO: 892235 - DNA, 25 bp, Mus musculus
tgggtgtttagcatcctcacagtca

SEQ ID NO: 892236 - DNA, 25 bp, Mus musculus
tgggtgtttagcttcctcacagtca

SEQ ID NO: 892237 - DNA, 25 bp, Mus musculus
tgggtgtttcttctctcctctcttc

SEQ ID NO: 892238 - DNA, 25 bp, Mus musculus
tgggtgtttcttgtctcctctcttc

SEQ ID NO: 892239 - DNA, 25 bp, Mus musculus
tgggtgtttggaacttctccgtcct

SEQ ID NO: 892240 - DNA, 25 bp, Mus musculus
tgggtgtttggatcttctccgtcct

SEQ ID NO: 892241 - DNA, 25 bp, Mus musculus
tgggtgttttccaagcatgcacaac

SEQ ID NO: 892242 - DNA, 25 bp, Mus musculus
tgggtgttttcctagcatgcacaac

SEQ ID NO: 892243 - DNA, 25 bp, Mus musculus
tgggtgttttgcctggtctttgtct

SEQ ID NO: 892244 - DNA, 25 bp, Mus musculus
tgggtgttttgcgtggtctttgtct

SEQ ID NO: 892245 - DNA, 25 bp, Mus musculus
tgggttaaagcacgtgaccccatgc

SEQ ID NO: 892246 - DNA, 25 bp, Mus musculus
tgggttaaagcaggtgaccccatgc

SEQ ID NO: 892247 - DNA, 25 bp, Mus musculus
tgggttaaaggcatatttcttgata

SEQ ID NO: 892248 - DNA, 25 bp, Mus musculus
tgggttaaaggcttatttcttgata

SEQ ID NO: 892249 - DNA, 25 bp, Mus musculus
tgggttaacactcctccagtccaca

SEQ ID NO: 892250 - DNA, 25 bp, Mus musculus
tgggttaacactgctccagtccaca

SEQ ID NO: 892251 - DNA, 25 bp, Mus musculus
tgggttaacagtcatggcctactaa

SEQ ID NO: 892252 - DNA, 25 bp, Mus musculus
tgggttaacagtgatggcctactaa

SEQ ID NO: 892253 - DNA, 25 bp, Mus musculus
tgggttaacattacactggagatgg

SEQ ID NO: 892254 - DNA, 25 bp, Mus musculus
tgggttaacatttcactggagatgg

SEQ ID NO: 892255 - DNA, 25 bp, Mus musculus
tgggttaacctcactctattaaaag

SEQ ID NO: 892256 - DNA, 25 bp, Mus musculus
tgggttaacctctctctattaaaag

SEQ ID NO: 892257 - DNA, 25 bp, Mus musculus
tgggttaacttcagttgccactcac

SEQ ID NO: 892258 - DNA, 25 bp, Mus musculus
tgggttaacttctgttgccactcac

SEQ ID NO: 892259 - DNA, 25 bp, Mus musculus
tgggttacagcccttttctaggagg

SEQ ID NO: 892260 - DNA, 25 bp, Mus musculus
tgggttacagccgttttctaggagg

SEQ ID NO: 892261 - DNA, 25 bp, Mus musculus
tgggttacagtcaagctttgcttat

SEQ ID NO: 892262 - DNA, 25 bp, Mus musculus
tgggttacagtctagctttgcttat

SEQ ID NO: 892263 - DNA, 25 bp, Mus musculus
tgggttacatgtagtctctccacag

SEQ ID NO: 892264 - DNA, 25 bp, Mus musculus
tgggttacatgttgtctctccacag

SEQ ID NO: 892265 - DNA, 25 bp, Mus musculus
tgggttaccaacctcgacccagtgg

SEQ ID NO: 892266 - DNA, 25 bp, Mus musculus
tgggttaccaacgtcgacccagtgg

SEQ ID NO: 892267 - DNA, 25 bp, Mus musculus
tgggttacctgaattatactttctt

SEQ ID NO: 892268 - DNA, 25 bp, Mus musculus
tgggttacctgatttatactttctt

SEQ ID NO: 892269 - DNA, 25 bp, Mus musculus
tgggttacctggcaaagccacactt

SEQ ID NO: 892270 - DNA, 25 bp, Mus musculus
tgggttacctgggaaagccacactt

SEQ ID NO: 892271 - DNA, 25 bp, Mus musculus
tgggttactacaagacaggctgtgt

SEQ ID NO: 892272 - DNA, 25 bp, Mus musculus
tgggttactacacaagaggccgaac

SEQ ID NO: 892273 - DNA, 25 bp, Mus musculus
tgggttactacagaagaggccgaac

SEQ ID NO: 892274 - DNA, 25 bp, Mus musculus
tgggttactacatgacaggctgtgt

SEQ ID NO: 892275 - DNA, 25 bp, Mus musculus
tgggttactattaagctgcaattct

SEQ ID NO: 892276 - DNA, 25 bp, Mus musculus
tgggttactatttagctgcaattct

SEQ ID NO: 892277 - DNA, 25 bp, Mus musculus
tgggttactttgattcagtacttag

SEQ ID NO: 892278 - DNA, 25 bp, Mus musculus
tgggttactttgtttcagtacttag

SEQ ID NO: 892279 - DNA, 25 bp, Mus musculus
tgggttagaacacctacactcagag

SEQ ID NO: 892280 - DNA, 25 bp, Mus musculus
tgggttagaacagctacactcagag

SEQ ID NO: 892281 - DNA, 25 bp, Mus musculus
tgggttagcagcacacggctatctg

SEQ ID NO: 892282 - DNA, 25 bp, Mus musculus
tgggttagcagctcacggctatctg

SEQ ID NO: 892283 - DNA, 25 bp, Mus musculus
tgggttagccacacggacattcgga

SEQ ID NO: 892284 - DNA, 25 bp, Mus musculus
tgggttagccactcggacattcgga

SEQ ID NO: 892285 - DNA, 25 bp, Mus musculus
tgggttagcccaatatgattacaaa

SEQ ID NO: 892286 - DNA, 25 bp, Mus musculus
tgggttagcccattatgattacaaa

SEQ ID NO: 892287 - DNA, 25 bp, Mus musculus
tgggttagctcaaagacagatggtt

SEQ ID NO: 892288 - DNA, 25 bp, Mus musculus
tgggttagctcatagacagatggtt

SEQ ID NO: 892289 - DNA, 25 bp, Mus musculus
tgggttatcaatacagctaaactgg

SEQ ID NO: 892290 - DNA, 25 bp, Mus musculus
tgggttatcaattcagctaaactgg

SEQ ID NO: 892291 - DNA, 25 bp, Mus musculus
tgggttatcgttcatgccctagtca

SEQ ID NO: 892292 - DNA, 25 bp, Mus musculus
tgggttatcgttgatgccctagtca

SEQ ID NO: 892293 - DNA, 25 bp, Mus musculus
tgggttattcatattccttgggatt

SEQ ID NO: 892294 - DNA, 25 bp, Mus musculus
tgggttattcattttccttgggatt

SEQ ID NO: 892295 - DNA, 25 bp, Mus musculus
tgggttcaaatccaggatctccctt

SEQ ID NO: 892296 - DNA, 25 bp, Mus musculus
tgggttcaaatcgaggatctccctt

SEQ ID NO: 892297 - DNA, 25 bp, Mus musculus
tgggttcaagctcatttcttcacac

SEQ ID NO: 892298 - DNA, 25 bp, Mus musculus
tgggttcaagctgatttcttcacac

SEQ ID NO: 892299 - DNA, 25 bp, Mus musculus
tgggttcaaggccatactggattat

SEQ ID NO: 892300 - DNA, 25 bp, Mus musculus
tgggttcaaggcgatactggattat

SEQ ID NO: 892301 - DNA, 25 bp, Mus musculus
tgggttcaagttatcagctgtggcc

SEQ ID NO: 892302 - DNA, 25 bp, Mus musculus
tgggttcaagttttcagctgtggcc

SEQ ID NO: 892303 - DNA, 25 bp, Mus musculus
tgggttcacactacagacaggcctt

SEQ ID NO: 892304 - DNA, 25 bp, Mus musculus
tgggttcacacttcagacaggcctt

SEQ ID NO: 892305 - DNA, 25 bp, Mus musculus
tgggttcacatgcagctatccattg

SEQ ID NO: 892306 - DNA, 25 bp, Mus musculus
tgggttcacatggagctatccattg

SEQ ID NO: 892307 - DNA, 25 bp, Mus musculus
tgggttcaccccaagactaagttct

SEQ ID NO: 892308 - DNA, 25 bp, Mus musculus
tgggttcacccctagactaagttct

SEQ ID NO: 892309 - DNA, 25 bp, Mus musculus
tgggttcaggggaggctttgccgaa

SEQ ID NO: 892310 - DNA, 25 bp, Mus musculus
tgggttcaggggtggctttgccgaa

SEQ ID NO: 892311 - DNA, 25 bp, Mus musculus
tgggttcagtatccagcacctcgta

SEQ ID NO: 892312 - DNA, 25 bp, Mus musculus
tgggttcagtatgcagcacctcgta

SEQ ID NO: 892313 - DNA, 25 bp, Mus musculus
tgggttcagtttccttaagctaaga

SEQ ID NO: 892314 - DNA, 25 bp, Mus musculus
tgggttcagtttgcttaagctaaga

SEQ ID NO: 892315 - DNA, 25 bp, Mus musculus
tgggttcatatcacttcagtcctgt

SEQ ID NO: 892316 - DNA, 25 bp, Mus musculus
tgggttcatatctcttcagtcctgt

SEQ ID NO: 892317 - DNA, 25 bp, Mus musculus
tgggttcatccacaaatgctttgag

SEQ ID NO: 892318 - DNA, 25 bp, Mus musculus
tgggttcatccagaaatgctttgag

SEQ ID NO: 892319 - DNA, 25 bp, Mus musculus
tgggttcattgccagtactcacatg

SEQ ID NO: 892320 - DNA, 25 bp, Mus musculus
tgggttcattgcgagtactcacatg

SEQ ID NO: 892321 - DNA, 25 bp, Mus musculus
tgggttcattttccccatatttgaa

SEQ ID NO: 892322 - DNA, 25 bp, Mus musculus
tgggttcattttgcccatatttgaa

SEQ ID NO: 892323 - DNA, 25 bp, Mus musculus
tgggttccacgacaggctgcgttcc

SEQ ID NO: 892324 - DNA, 25 bp, Mus musculus
tgggttccacgagaggctgcgttcc

SEQ ID NO: 892325 - DNA, 25 bp, Mus musculus
tgggttccacggaggctttcctctg

SEQ ID NO: 892326 - DNA, 25 bp, Mus musculus
tgggttccacggtggctttcctctg

SEQ ID NO: 892327 - DNA, 25 bp, Mus musculus
tgggttccacgtccatcagtatggg

SEQ ID NO: 892328 - DNA, 25 bp, Mus musculus
tgggttccacgtgcatcagtatggg

SEQ ID NO: 892329 - DNA, 25 bp, Mus musculus
tgggttccagacagtgcccggatca

SEQ ID NO: 892330 - DNA, 25 bp, Mus musculus
tgggttccagactgtgcccggatca

SEQ ID NO: 892331 - DNA, 25 bp, Mus musculus
tgggttccagcacagtggcttcttg

SEQ ID NO: 892332 - DNA, 25 bp, Mus musculus
tgggttccagcagagtggcttcttg

SEQ ID NO: 892333 - DNA, 25 bp, Mus musculus
tgggttccaggaaccttgccaacct

SEQ ID NO: 892334 - DNA, 25 bp, Mus musculus
tgggttccaggatccttgccaacct

SEQ ID NO: 892335 - DNA, 25 bp, Mus musculus
tgggttccaggcaaaccaaggttat

SEQ ID NO: 892336 - DNA, 25 bp, Mus musculus
tgggttccaggctaaccaaggttat

SEQ ID NO: 892337 - DNA, 25 bp, Mus musculus
tgggttccagtaccttctaccttga

SEQ ID NO: 892338 - DNA, 25 bp, Mus musculus
tgggttccagtagcttctaccttga

SEQ ID NO: 892339 - DNA, 25 bp, Mus musculus
tgggttccagttatctcgagctgct

SEQ ID NO: 892340 - DNA, 25 bp, Mus musculus
tgggttccagttttctcgagctgct

SEQ ID NO: 892341 - DNA, 25 bp, Mus musculus
tgggttccataaagacttcccagcc

SEQ ID NO: 892342 - DNA, 25 bp, Mus musculus
tgggttccataatgacttcccagcc

SEQ ID NO: 892343 - DNA, 25 bp, Mus musculus
tgggttccatccaagacttaactcc

SEQ ID NO: 892344 - DNA, 25 bp, Mus musculus
tgggttccatcctagacttaactcc

SEQ ID NO: 892345 - DNA, 25 bp, Mus musculus
tgggttccatttcctctgcgatgaa

SEQ ID NO: 892346 - DNA, 25 bp, Mus musculus
tgggttccatttgctctgcgatgaa

SEQ ID NO: 892347 - DNA, 25 bp, Mus musculus
tgggttcccaagacacactggctga

SEQ ID NO: 892348 - DNA, 25 bp, Mus musculus
tgggttcccaagtcacactggctga

SEQ ID NO: 892349 - DNA, 25 bp, Mus musculus
tgggttcccagaactcaaatcctaa

SEQ ID NO: 892350 - DNA, 25 bp, Mus musculus
tgggttcccagatctcaaatcctaa

SEQ ID NO: 892351 - DNA, 25 bp, Mus musculus
tgggttcccagtaatgcttgtcact

SEQ ID NO: 892352 - DNA, 25 bp, Mus musculus
tgggttcccagttatgcttgtcact

SEQ ID NO: 892353 - DNA, 25 bp, Mus musculus
tgggttcccatcatttcctgtgtca

SEQ ID NO: 892354 - DNA, 25 bp, Mus musculus
tgggttcccatcttttcctgtgtca

SEQ ID NO: 892355 - DNA, 25 bp, Mus musculus
tgggttcccatgaactcagggattt

SEQ ID NO: 892356 - DNA, 25 bp, Mus musculus
tgggttcccatgaagctttggcagc

SEQ ID NO: 892357 - DNA, 25 bp, Mus musculus
tgggttcccatgtactcagggattt

SEQ ID NO: 892358 - DNA, 25 bp, Mus musculus
tgggttcccatgtagctttggcagc

SEQ ID NO: 892359 - DNA, 25 bp, Mus musculus
tgggttcccctcagtagctgagcat

SEQ ID NO: 892360 - DNA, 25 bp, Mus musculus
tgggttcccctctgtagctgagcat

SEQ ID NO: 892361 - DNA, 25 bp, Mus musculus
tgggttcccctgagattcccacgga

SEQ ID NO: 892362 - DNA, 25 bp, Mus musculus
tgggttcccctgtgattcccacgga

SEQ ID NO: 892363 - DNA, 25 bp, Mus musculus
tgggttccctcaattccttccattt

SEQ ID NO: 892364 - DNA, 25 bp, Mus musculus
tgggttccctcatttccttccattt

SEQ ID NO: 892365 - DNA, 25 bp, Mus musculus
tgggttccctctcatgggattagac

SEQ ID NO: 892366 - DNA, 25 bp, Mus musculus
tgggttccctctgatgggattagac

SEQ ID NO: 892367 - DNA, 25 bp, Mus musculus
tgggttccgaagcctgttcataccc

SEQ ID NO: 892368 - DNA, 25 bp, Mus musculus
tgggttccgaaggctgttcataccc

SEQ ID NO: 892369 - DNA, 25 bp, Mus musculus
tgggttccgtctctctgggttctga

SEQ ID NO: 892370 - DNA, 25 bp, Mus musculus
tgggttccgtctgtctgggttctga

SEQ ID NO: 892371 - DNA, 25 bp, Mus musculus
tgggttccgttacagagaccctgtc

SEQ ID NO: 892372 - DNA, 25 bp, Mus musculus
tgggttccgttagagagaccctgtc

SEQ ID NO: 892373 - DNA, 25 bp, Mus musculus
tgggttcctcagcagatccagaaaa

SEQ ID NO: 892374 - DNA, 25 bp, Mus musculus
tgggttcctcaggagatccagaaaa

SEQ ID NO: 892375 - DNA, 25 bp, Mus musculus
tgggttcctcctatggtgtaattat

SEQ ID NO: 892376 - DNA, 25 bp, Mus musculus
tgggttcctcctttggtgtaattat

SEQ ID NO: 892377 - DNA, 25 bp, Mus musculus
tgggttcctgaaagcaccataattg

SEQ ID NO: 892378 - DNA, 25 bp, Mus musculus
tgggttcctgaatgcaccataattg

SEQ ID NO: 892379 - DNA, 25 bp, Mus musculus
tgggttcctgccaatttttgaaaga

SEQ ID NO: 892380 - DNA, 25 bp, Mus musculus
tgggttcctgcctatttttgaaaga

SEQ ID NO: 892381 - DNA, 25 bp, Mus musculus
tgggttcctgggacattggaagctt

SEQ ID NO: 892382 - DNA, 25 bp, Mus musculus
tgggttcctgggtcattggaagctt

SEQ ID NO: 892383 - DNA, 25 bp, Mus musculus
tgggttcctgttccccctaggccat

SEQ ID NO: 892384 - DNA, 25 bp, Mus musculus
tgggttcctgttgcccctaggccat

SEQ ID NO: 892385 - DNA, 25 bp, Mus musculus
tgggttccttgcacctgaatgaagg

SEQ ID NO: 892386 - DNA, 25 bp, Mus musculus
tgggttccttgctcctgaatgaagg

SEQ ID NO: 892387 - DNA, 25 bp, Mus musculus
tgggttcggattatggcttcacagc

SEQ ID NO: 892388 - DNA, 25 bp, Mus musculus
tgggttcggattttggcttcacagc

SEQ ID NO: 892389 - DNA, 25 bp, Mus musculus
tgggttcggccaatctcagaccctt

SEQ ID NO: 892390 - DNA, 25 bp, Mus musculus
tgggttcggccattctcagaccctt

SEQ ID NO: 892391 - DNA, 25 bp, Mus musculus
tgggttcgtttcagcagtgtctgga

SEQ ID NO: 892392 - DNA, 25 bp, Mus musculus
tgggttcgtttctgcagtgtctgga

SEQ ID NO: 892393 - DNA, 25 bp, Mus musculus
tgggttcgttttatgaatgcttgtt

SEQ ID NO: 892394 - DNA, 25 bp, Mus musculus
tgggttcgttttttgaatgcttgtt

SEQ ID NO: 892395 - DNA, 25 bp, Mus musculus
tgggttctagaaatgtcccatttgc

SEQ ID NO: 892396 - DNA, 25 bp, Mus musculus
tgggttctagaattgtcccatttgc

SEQ ID NO: 892397 - DNA, 25 bp, Mus musculus
tgggttctagacctgcttcagctat

SEQ ID NO: 892398 - DNA, 25 bp, Mus musculus
tgggttctagacgtgcttcagctat

SEQ ID NO: 892399 - DNA, 25 bp, Mus musculus
tgggttctattcatggtccagctaa

SEQ ID NO: 892400 - DNA, 25 bp, Mus musculus
tgggttctattcttggtccagctaa

SEQ ID NO: 892401 - DNA, 25 bp, Mus musculus
tgggttctcacacgacctcaggaat

SEQ ID NO: 892402 - DNA, 25 bp, Mus musculus
tgggttctcacaggacctcaggaat

SEQ ID NO: 892403 - DNA, 25 bp, Mus musculus
tgggttctccctcaatatttaaaat

SEQ ID NO: 892404 - DNA, 25 bp, Mus musculus
tgggttctccctgaatatttaaaat

SEQ ID NO: 892405 - DNA, 25 bp, Mus musculus
tgggttctcctcacgggcaggcttc

SEQ ID NO: 892406 - DNA, 25 bp, Mus musculus
tgggttctcctctcgggcaggcttc

SEQ ID NO: 892407 - DNA, 25 bp, Mus musculus
tgggttctcggtaccacatgaccag

SEQ ID NO: 892408 - DNA, 25 bp, Mus musculus
tgggttctcggttccacatgaccag

SEQ ID NO: 892409 - DNA, 25 bp, Mus musculus
tgggttctcttgatgccatggacaa

SEQ ID NO: 892410 - DNA, 25 bp, Mus musculus
tgggttctcttgttgccatggacaa

SEQ ID NO: 892411 - DNA, 25 bp, Mus musculus
tgggttctgataatctctcctcaga

SEQ ID NO: 892412 - DNA, 25 bp, Mus musculus
tgggttctgatattctctcctcaga

SEQ ID NO: 892413 - DNA, 25 bp, Mus musculus
tgggttctggacacctatcatgtga

SEQ ID NO: 892414 - DNA, 25 bp, Mus musculus
tgggttctggactcctatcatgtga

SEQ ID NO: 892415 - DNA, 25 bp, Mus musculus
tgggttctggggacacctgcccgtt

SEQ ID NO: 892416 - DNA, 25 bp, Mus musculus
tgggttctggggtcacctgcccgtt

SEQ ID NO: 892417 - DNA, 25 bp, Mus musculus
tgggttctgtctacaggctttgcag

SEQ ID NO: 892418 - DNA, 25 bp, Mus musculus
tgggttctgtcttcaggctttgcag

SEQ ID NO: 892419 - DNA, 25 bp, Mus musculus
tgggttctgtgacccagcctcttgc

SEQ ID NO: 892420 - DNA, 25 bp, Mus musculus
tgggttctgtgagccagcctcttgc

SEQ ID NO: 892421 - DNA, 25 bp, Mus musculus
tgggttcttcatatgcaaaacgggc

SEQ ID NO: 892422 - DNA, 25 bp, Mus musculus
tgggttcttcatttgcaaaacgggc

SEQ ID NO: 892423 - DNA, 25 bp, Mus musculus
tgggttcttctgctgttagttcagg

SEQ ID NO: 892424 - DNA, 25 bp, Mus musculus
tgggttcttctggtgttagttcagg

SEQ ID NO: 892425 - DNA, 25 bp, Mus musculus
tgggttctttccagttaagtgtctt

SEQ ID NO: 892426 - DNA, 25 bp, Mus musculus
tgggttctttcctgttaagtgtctt

SEQ ID NO: 892427 - DNA, 25 bp, Mus musculus
tgggttctttgcctggttctgaaag

SEQ ID NO: 892428 - DNA, 25 bp, Mus musculus
tgggttctttgcgtggttctgaaag

SEQ ID NO: 892429 - DNA, 25 bp, Mus musculus
tgggttctttgtatattttgcctgt

SEQ ID NO: 892430 - DNA, 25 bp, Mus musculus
tgggttctttgtttattttgcctgt

SEQ ID NO: 892431 - DNA, 25 bp, Mus musculus
tgggttgaacccacattgtcagaat

SEQ ID NO: 892432 - DNA, 25 bp, Mus musculus
tgggttgaaccctcattgtcagaat

SEQ ID NO: 892433 - DNA, 25 bp, Mus musculus
tgggttgaccaaatcctcttcagag

SEQ ID NO: 892434 - DNA, 25 bp, Mus musculus
tgggttgaccaattcctcttcagag

SEQ ID NO: 892435 - DNA, 25 bp, Mus musculus
tgggttgaccatcaagcccgggacc

SEQ ID NO: 892436 - DNA, 25 bp, Mus musculus
tgggttgaccatgaagcccgggacc

SEQ ID NO: 892437 - DNA, 25 bp, Mus musculus
tgggttgacctcacctgagcagcga

SEQ ID NO: 892438 - DNA, 25 bp, Mus musculus
tgggttgacctctcctgagcagcga

SEQ ID NO: 892439 - DNA, 25 bp, Mus musculus
tgggttgagatcacctctctgcctg

SEQ ID NO: 892440 - DNA, 25 bp, Mus musculus
tgggttgagatctcctctctgcctg

SEQ ID NO: 892441 - DNA, 25 bp, Mus musculus
tgggttgagcaaccctacgcagaca

SEQ ID NO: 892442 - DNA, 25 bp, Mus musculus
tgggttgagcaagcctacgcagaca

SEQ ID NO: 892443 - DNA, 25 bp, Mus musculus
tgggttgagcatcctttacccaaat

SEQ ID NO: 892444 - DNA, 25 bp, Mus musculus
tgggttgagcatgctttacccaaat

SEQ ID NO: 892445 - DNA, 25 bp, Mus musculus
tgggttgagcccagaactgtgcatg

SEQ ID NO: 892446 - DNA, 25 bp, Mus musculus
tgggttgagcccaggcagttctgtc

SEQ ID NO: 892447 - DNA, 25 bp, Mus musculus
tgggttgagccctgaactgtgcatg

SEQ ID NO: 892448 - DNA, 25 bp, Mus musculus
tgggttgagccctggcagttctgtc

SEQ ID NO: 892449 - DNA, 25 bp, Mus musculus
tgggttgccatcagttgcccacctc

SEQ ID NO: 892450 - DNA, 25 bp, Mus musculus
tgggttgccatctgttgcccacctc

SEQ ID NO: 892451 - DNA, 25 bp, Mus musculus
tgggttgcccatcaaggatgctctc

SEQ ID NO: 892452 - DNA, 25 bp, Mus musculus
tgggttgcccatgaaggatgctctc

SEQ ID NO: 892453 - DNA, 25 bp, Mus musculus
tgggttgcccgtactcccggcaggc

SEQ ID NO: 892454 - DNA, 25 bp, Mus musculus
tgggttgcccgttctcccggcaggc

SEQ ID NO: 892455 - DNA, 25 bp, Mus musculus
tgggttgctagccacacatcagcag

SEQ ID NO: 892456 - DNA, 25 bp, Mus musculus
tgggttgctagcgacacatcagcag

SEQ ID NO: 892457 - DNA, 25 bp, Mus musculus
tgggttgctttaatctgtgctcatt

SEQ ID NO: 892458 - DNA, 25 bp, Mus musculus
tgggttgctttattctgtgctcatt

SEQ ID NO: 892459 - DNA, 25 bp, Mus musculus
tgggttggatacatctgacggacaa

SEQ ID NO: 892460 - DNA, 25 bp, Mus musculus
tgggttggatacttctgacggacaa

SEQ ID NO: 892461 - DNA, 25 bp, Mus musculus
tgggttggattgagagcccctgccc

SEQ ID NO: 892462 - DNA, 25 bp, Mus musculus
tgggttggattgtgagcccctgccc

SEQ ID NO: 892463 - DNA, 25 bp, Mus musculus
tgggttggtattcgttgaatcctcc

SEQ ID NO: 892464 - DNA, 25 bp, Mus musculus
tgggttggtattggttgaatcctcc

SEQ ID NO: 892465 - DNA, 25 bp, Mus musculus
tgggttggtgtcactaatgttttat

SEQ ID NO: 892466 - DNA, 25 bp, Mus musculus
tgggttggtgtctctaatgttttat

SEQ ID NO: 892467 - DNA, 25 bp, Mus musculus
tgggttgtagagaccaatggatcta

SEQ ID NO: 892468 - DNA, 25 bp, Mus musculus
tgggttgtagagtccaatggatcta

SEQ ID NO: 892469 - DNA, 25 bp, Mus musculus
tgggttgtagttactcagaccagag

SEQ ID NO: 892470 - DNA, 25 bp, Mus musculus
tgggttgtagtttctcagaccagag

SEQ ID NO: 892471 - DNA, 25 bp, Mus musculus
tgggttgtcatcctttttattactt

SEQ ID NO: 892472 - DNA, 25 bp, Mus musculus
tgggttgtcatcgtttttattactt

SEQ ID NO: 892473 - DNA, 25 bp, Mus musculus
tgggttgtcccacattcaggttgac

SEQ ID NO: 892474 - DNA, 25 bp, Mus musculus
tgggttgtcccagattcaggttgac

SEQ ID NO: 892475 - DNA, 25 bp, Mus musculus
tgggttgtgtccatttttctaggat

SEQ ID NO: 892476 - DNA, 25 bp, Mus musculus
tgggttgtgtccttttttctaggat

SEQ ID NO: 892477 - DNA, 25 bp, Mus musculus
tgggttgttaaaatcagccttttga

SEQ ID NO: 892478 - DNA, 25 bp, Mus musculus
tgggttgttaaattcagccttttga

SEQ ID NO: 892479 - DNA, 25 bp, Mus musculus
tgggttgttccactggttagcacct

SEQ ID NO: 892480 - DNA, 25 bp, Mus musculus
tgggttgttccagtggttagcacct

SEQ ID NO: 892481 - DNA, 25 bp, Mus musculus
tgggttgttcctctactttgttaca

SEQ ID NO: 892482 - DNA, 25 bp, Mus musculus
tgggttgttcctgtactttgttaca

SEQ ID NO: 892483 - DNA, 25 bp, Mus musculus
tgggttgttctcagactgtggcaca

SEQ ID NO: 892484 - DNA, 25 bp, Mus musculus
tgggttgttctctgactgtggcaca

SEQ ID NO: 892485 - DNA, 25 bp, Mus musculus
tgggttgttgcgacaaggcccagac

SEQ ID NO: 892486 - DNA, 25 bp, Mus musculus
tgggttgttgcgtcaaggcccagac

SEQ ID NO: 892487 - DNA, 25 bp, Mus musculus
tgggttgttggaactactgtccttt

SEQ ID NO: 892488 - DNA, 25 bp, Mus musculus
tgggttgttggatctactgtccttt

SEQ ID NO: 892489 - DNA, 25 bp, Mus musculus
tgggttgttgtgcatacttcccttt

SEQ ID NO: 892490 - DNA, 25 bp, Mus musculus
tgggttgttgtggatacttcccttt

SEQ ID NO: 892491 - DNA, 25 bp, Mus musculus
tgggttgttgttagtttgaggcagg

SEQ ID NO: 892492 - DNA, 25 bp, Mus musculus
tgggttgttgtttgtttgaggcagg

SEQ ID NO: 892493 - DNA, 25 bp, Mus musculus
tgggttgtttctcgcttttcagggc

SEQ ID NO: 892494 - DNA, 25 bp, Mus musculus
tgggttgtttctcgcttttgaggaa

SEQ ID NO: 892495 - DNA, 25 bp, Mus musculus
tgggttgtttctggcttttcagggc

SEQ ID NO: 892496 - DNA, 25 bp, Mus musculus
tgggttgtttctggcttttgaggaa

SEQ ID NO: 892497 - DNA, 25 bp, Mus musculus
tgggtttaaagcacaggcaatgcct

SEQ ID NO: 892498 - DNA, 25 bp, Mus musculus
tgggtttaaagctcaggcaatgcct

SEQ ID NO: 892499 - DNA, 25 bp, Mus musculus
tgggtttaacggctcagggtcacat

SEQ ID NO: 892500 - DNA, 25 bp, Mus musculus
tgggtttaacgggtcagggtcacat

SEQ ID NO: 892501 - DNA, 25 bp, Mus musculus
tgggtttaataactcactgtgattc

SEQ ID NO: 892502 - DNA, 25 bp, Mus musculus
tgggtttaataagtcactgtgattc

SEQ ID NO: 892503 - DNA, 25 bp, Mus musculus
tgggtttaattcaccccagcatacc

SEQ ID NO: 892504 - DNA, 25 bp, Mus musculus
tgggtttaattctccccagcatacc

SEQ ID NO: 892505 - DNA, 25 bp, Mus musculus
tgggtttacaacagtgcactgcgtc

SEQ ID NO: 892506 - DNA, 25 bp, Mus musculus
tgggtttacaactgtgcactgcgtc

SEQ ID NO: 892507 - DNA, 25 bp, Mus musculus
tgggtttaccacaatacttattcct

SEQ ID NO: 892508 - DNA, 25 bp, Mus musculus
tgggtttaccactatacttattcct

SEQ ID NO: 892509 - DNA, 25 bp, Mus musculus
tgggtttatcagcatccccaggcca

SEQ ID NO: 892510 - DNA, 25 bp, Mus musculus
tgggtttatcaggatccccaggcca

SEQ ID NO: 892511 - DNA, 25 bp, Mus musculus
tgggtttattggacttttctaattg

SEQ ID NO: 892512 - DNA, 25 bp, Mus musculus
tgggtttattggtcttttctaattg

SEQ ID NO: 892513 - DNA, 25 bp, Mus musculus
tgggtttcaccacacagacagccta

SEQ ID NO: 892514 - DNA, 25 bp, Mus musculus
tgggtttcaccagacagacagccta

SEQ ID NO: 892515 - DNA, 25 bp, Mus musculus
tgggtttcacctcaggcaggactgt

SEQ ID NO: 892516 - DNA, 25 bp, Mus musculus
tgggtttcacctgaggcaggactgt

SEQ ID NO: 892517 - DNA, 25 bp, Mus musculus
tgggtttcatccacataacacatac

SEQ ID NO: 892518 - DNA, 25 bp, Mus musculus
tgggtttcatcctcataacacatac

SEQ ID NO: 892519 - DNA, 25 bp, Mus musculus
tgggtttccagaacggcctcaacta

SEQ ID NO: 892520 - DNA, 25 bp, Mus musculus
tgggtttccagatcggcctcaacta

SEQ ID NO: 892521 - DNA, 25 bp, Mus musculus
tgggtttccagcacttgtatttgga

SEQ ID NO: 892522 - DNA, 25 bp, Mus musculus
tgggtttccagctcttgtatttgga

SEQ ID NO: 892523 - DNA, 25 bp, Mus musculus
tgggtttccagtcgcgagcttcaac

SEQ ID NO: 892524 - DNA, 25 bp, Mus musculus
tgggtttccagtggcgagcttcaac

SEQ ID NO: 892525 - DNA, 25 bp, Mus musculus
tgggtttccatcacagtatcctgta

SEQ ID NO: 892526 - DNA, 25 bp, Mus musculus
tgggtttccatctcagtatcctgta

SEQ ID NO: 892527 - DNA, 25 bp, Mus musculus
tgggtttcccacacgtttgaccaca

SEQ ID NO: 892528 - DNA, 25 bp, Mus musculus
tgggtttcccactcgtttgaccaca

SEQ ID NO: 892529 - DNA, 25 bp, Mus musculus
tgggtttcccgacagccagacaaat

SEQ ID NO: 892530 - DNA, 25 bp, Mus musculus
tgggtttcccgagagccagacaaat

SEQ ID NO: 892531 - DNA, 25 bp, Mus musculus
tgggtttcctgtcgttggccccagt

SEQ ID NO: 892532 - DNA, 25 bp, Mus musculus
tgggtttcctgtggttggccccagt

SEQ ID NO: 892533 - DNA, 25 bp, Mus musculus
tgggtttcctttagtgtattcttgc

SEQ ID NO: 892534 - DNA, 25 bp, Mus musculus
tgggtttcctttctctaaagaggag

SEQ ID NO: 892535 - DNA, 25 bp, Mus musculus
tgggtttcctttgtctaaagaggag

SEQ ID NO: 892536 - DNA, 25 bp, Mus musculus
tgggtttccttttgtgtattcttgc

SEQ ID NO: 892537 - DNA, 25 bp, Mus musculus
tgggtttcgagtagcgtctgtacgc

SEQ ID NO: 892538 - DNA, 25 bp, Mus musculus
tgggtttcgagttgcgtctgtacgc

SEQ ID NO: 892539 - DNA, 25 bp, Mus musculus
tgggtttcgttcctagcactacaga

SEQ ID NO: 892540 - DNA, 25 bp, Mus musculus
tgggtttcgttcgtagcactacaga

SEQ ID NO: 892541 - DNA, 25 bp, Mus musculus
tgggtttctcttacgtcttattgtt

SEQ ID NO: 892542 - DNA, 25 bp, Mus musculus
tgggtttctctttcgtcttattgtt

SEQ ID NO: 892543 - DNA, 25 bp, Mus musculus
tgggtttctgccactgacaatagac

SEQ ID NO: 892544 - DNA, 25 bp, Mus musculus
tgggtttctgcccaggactttagaa

SEQ ID NO: 892545 - DNA, 25 bp, Mus musculus
tgggtttctgccgaggactttagaa

SEQ ID NO: 892546 - DNA, 25 bp, Mus musculus
tgggtttctgcctctgacaatagac

SEQ ID NO: 892547 - DNA, 25 bp, Mus musculus
tgggtttctgtgatattggcttcaa

SEQ ID NO: 892548 - DNA, 25 bp, Mus musculus
tgggtttctgtgttattggcttcaa

SEQ ID NO: 892549 - DNA, 25 bp, Mus musculus
tgggtttcttgcattcgtcctcctt

SEQ ID NO: 892550 - DNA, 25 bp, Mus musculus
tgggtttcttgctttcgtcctcctt

SEQ ID NO: 892551 - DNA, 25 bp, Mus musculus
tgggtttcttgtaacgtctcagcac

SEQ ID NO: 892552 - DNA, 25 bp, Mus musculus
tgggtttcttgttacgtctcagcac

SEQ ID NO: 892553 - DNA, 25 bp, Mus musculus
tgggtttctttcatcattctgttca

SEQ ID NO: 892554 - DNA, 25 bp, Mus musculus
tgggtttctttcttcattctgttca

SEQ ID NO: 892555 - DNA, 25 bp, Mus musculus
tgggtttgaacaccatcgtcacata

SEQ ID NO: 892556 - DNA, 25 bp, Mus musculus
tgggtttgaacagcatcgtcacata

SEQ ID NO: 892557 - DNA, 25 bp, Mus musculus
tgggtttgatcaccagccacatatc

SEQ ID NO: 892558 - DNA, 25 bp, Mus musculus
tgggtttgatcagcagccacatatc

SEQ ID NO: 892559 - DNA, 25 bp, Mus musculus
tgggtttgcctcaacaccattatca

SEQ ID NO: 892560 - DNA, 25 bp, Mus musculus
tgggtttgcctctacaccattatca

SEQ ID NO: 892561 - DNA, 25 bp, Mus musculus
tgggtttggagcaccttctctgggc

SEQ ID NO: 892562 - DNA, 25 bp, Mus musculus
tgggtttggagctccttctctgggc

SEQ ID NO: 892563 - DNA, 25 bp, Mus musculus
tgggtttggcacaatctgttcgaat

SEQ ID NO: 892564 - DNA, 25 bp, Mus musculus
tgggtttggcactatctgttcgaat

SEQ ID NO: 892565 - DNA, 25 bp, Mus musculus
tgggtttggtgcaccgcagaagcaa

SEQ ID NO: 892566 - DNA, 25 bp, Mus musculus
tgggtttggtgctccgcagaagcaa

SEQ ID NO: 892567 - DNA, 25 bp, Mus musculus
tgggtttggtttaccagagcctcct

SEQ ID NO: 892568 - DNA, 25 bp, Mus musculus
tgggtttggttttccagagcctcct

SEQ ID NO: 892569 - DNA, 25 bp, Mus musculus
tgggtttgtaccctgctcacattga

SEQ ID NO: 892570 - DNA, 25 bp, Mus musculus
tgggtttgtaccgtgctcacattga

SEQ ID NO: 892571 - DNA, 25 bp, Mus musculus
tgggtttgtatgctactgctgggcc

SEQ ID NO: 892572 - DNA, 25 bp, Mus musculus
tgggtttgtatggtactgctgggcc

SEQ ID NO: 892573 - DNA, 25 bp, Mus musculus
tgggtttgtcataggtgccctgtca

SEQ ID NO: 892574 - DNA, 25 bp, Mus musculus
tgggtttgtcattggtgccctgtca

SEQ ID NO: 892575 - DNA, 25 bp, Mus musculus
tgggtttgtctaactgtcagttagt

SEQ ID NO: 892576 - DNA, 25 bp, Mus musculus
tgggtttgtctaatgtgggccacaa

SEQ ID NO: 892577 - DNA, 25 bp, Mus musculus
tgggtttgtctatctgtcagttagt

SEQ ID NO: 892578 - DNA, 25 bp, Mus musculus
tgggtttgtctattgtgggccacaa

SEQ ID NO: 892579 - DNA, 25 bp, Mus musculus
tgggtttgttctctgtggtatcccc

SEQ ID NO: 892580 - DNA, 25 bp, Mus musculus
tgggtttgttctgtgtggtatcccc

SEQ ID NO: 892581 - DNA, 25 bp, Mus musculus
tgggttttaaaaatcagtctatctg

SEQ ID NO: 892582 - DNA, 25 bp, Mus musculus
tgggttttaaaattcagtctatctg

SEQ ID NO: 892583 - DNA, 25 bp, Mus musculus
tgggttttaggtatgcacacaatta

SEQ ID NO: 892584 - DNA, 25 bp, Mus musculus
tgggttttaggtttgcacacaatta

SEQ ID NO: 892585 - DNA, 25 bp, Mus musculus
tgggttttatccataccatcactaa

SEQ ID NO: 892586 - DNA, 25 bp, Mus musculus
tgggttttatccttaccatcactaa

SEQ ID NO: 892587 - DNA, 25 bp, Mus musculus
tgggttttcagcctcttaagcccag

SEQ ID NO: 892588 - DNA, 25 bp, Mus musculus
tgggttttcagcgtcttaagcccag

SEQ ID NO: 892589 - DNA, 25 bp, Mus musculus
tgggttttcaggatttggagtacat

SEQ ID NO: 892590 - DNA, 25 bp, Mus musculus
tgggttttcaggctacaactcagtt

SEQ ID NO: 892591 - DNA, 25 bp, Mus musculus
tgggttttcagggtacaactcagtt

SEQ ID NO: 892592 - DNA, 25 bp, Mus musculus
tgggttttcaggttttggagtacat

SEQ ID NO: 892593 - DNA, 25 bp, Mus musculus
tgggttttcataagtattcagacac

SEQ ID NO: 892594 - DNA, 25 bp, Mus musculus
tgggttttcatatgtattcagacac

SEQ ID NO: 892595 - DNA, 25 bp, Mus musculus
tgggttttcccaatacctgactata

SEQ ID NO: 892596 - DNA, 25 bp, Mus musculus
tgggttttcccattacctgactata

SEQ ID NO: 892597 - DNA, 25 bp, Mus musculus
tgggttttcctacgcgtcagagcgc

SEQ ID NO: 892598 - DNA, 25 bp, Mus musculus
tgggttttcctaggcgtcagagcgc

SEQ ID NO: 892599 - DNA, 25 bp, Mus musculus
tgggttttctcacgcgttggataca

SEQ ID NO: 892600 - DNA, 25 bp, Mus musculus
tgggttttctcaggcgttggataca

SEQ ID NO: 892601 - DNA, 25 bp, Mus musculus
tgggttttctgaacctcttgctgca

SEQ ID NO: 892602 - DNA, 25 bp, Mus musculus
tgggttttctgatcctcttgctgca

SEQ ID NO: 892603 - DNA, 25 bp, Mus musculus
tgggttttgcagatcccctctaaag

SEQ ID NO: 892604 - DNA, 25 bp, Mus musculus
tgggttttgcagttcccctctaaag

SEQ ID NO: 892605 - DNA, 25 bp, Mus musculus
tgggttttgtcaattcataagctaa

SEQ ID NO: 892606 - DNA, 25 bp, Mus musculus
tgggttttgtcatttcataagctaa

SEQ ID NO: 892607 - DNA, 25 bp, Mus musculus
tgggttttgtccagaaacctctttg

SEQ ID NO: 892608 - DNA, 25 bp, Mus musculus
tgggttttgtcctgaaacctctttg

SEQ ID NO: 892609 - DNA, 25 bp, Mus musculus
tgggttttgtgaatccacatcgctt

SEQ ID NO: 892610 - DNA, 25 bp, Mus musculus
tgggttttgtgattccacatcgctt

SEQ ID NO: 892611 - DNA, 25 bp, Mus musculus
tgggttttgtttagcagaccaaggt

SEQ ID NO: 892612 - DNA, 25 bp, Mus musculus
tgggttttgtttccggccagaagct

SEQ ID NO: 892613 - DNA, 25 bp, Mus musculus
tgggttttgtttgcggccagaagct

SEQ ID NO: 892614 - DNA, 25 bp, Mus musculus
tgggttttgttttgcagaccaaggt

SEQ ID NO: 892615 - DNA, 25 bp, Mus musculus
tgggtttttacacaatgcgtttctt

SEQ ID NO: 892616 - DNA, 25 bp, Mus musculus
tgggtttttacagaatgcgtttctt

SEQ ID NO: 892617 - DNA, 25 bp, Mus musculus
tgggtttttcacctcgacggctctc

SEQ ID NO: 892618 - DNA, 25 bp, Mus musculus
tgggtttttcacgtcgacggctctc

SEQ ID NO: 892619 - DNA, 25 bp, Mus musculus
tgggtttttcatagtttctttctgt

SEQ ID NO: 892620 - DNA, 25 bp, Mus musculus
tgggtttttcattgtttctttctgt

SEQ ID NO: 892621 - DNA, 25 bp, Mus musculus
tgggtttttccactgcattctttgg

SEQ ID NO: 892622 - DNA, 25 bp, Mus musculus
tgggtttttccagtgcattctttgg

SEQ ID NO: 892623 - DNA, 25 bp, Mus musculus
tgggtttttctgcagctttttgtga

SEQ ID NO: 892624 - DNA, 25 bp, Mus musculus
tgggtttttctggagctttttgtga

SEQ ID NO: 892625 - DNA, 25 bp, Mus musculus
tggtaaaacacacctctggtctcag

SEQ ID NO: 892626 - DNA, 25 bp, Mus musculus
tggtaaaacacagctctggtctcag

SEQ ID NO: 892627 - DNA, 25 bp, Mus musculus
tggtaaaacctacaacacacttgtg

SEQ ID NO: 892628 - DNA, 25 bp, Mus musculus
tggtaaaacctagaacacacttgtg

SEQ ID NO: 892629 - DNA, 25 bp, Mus musculus
tggtaaaatcccactcaagcctttc

SEQ ID NO: 892630 - DNA, 25 bp, Mus musculus
tggtaaaatccctctcaagcctttc

SEQ ID NO: 892631 - DNA, 25 bp, Mus musculus
tggtaaaccaacaggcggcagccta

SEQ ID NO: 892632 - DNA, 25 bp, Mus musculus
tggtaaaccaactggcggcagccta

SEQ ID NO: 892633 - DNA, 25 bp, Mus musculus
tggtaaaccaggctccgctcaggat

SEQ ID NO: 892634 - DNA, 25 bp, Mus musculus
tggtaaaccagggtccgctcaggat

SEQ ID NO: 892635 - DNA, 25 bp, Mus musculus
tggtaaacccaaagcgccggccatc

SEQ ID NO: 892636 - DNA, 25 bp, Mus musculus
tggtaaacccaatgcgccggccatc

SEQ ID NO: 892637 - DNA, 25 bp, Mus musculus
tggtaaacgcaccacctgcacatag

SEQ ID NO: 892638 - DNA, 25 bp, Mus musculus
tggtaaacgcacgacctgcacatag

SEQ ID NO: 892639 - DNA, 25 bp, Mus musculus
tggtaaagagcccatagagtcctac

SEQ ID NO: 892640 - DNA, 25 bp, Mus musculus
tggtaaagagccgatagagtcctac

SEQ ID NO: 892641 - DNA, 25 bp, Mus musculus
tggtaaagcaataggaccctgccat

SEQ ID NO: 892642 - DNA, 25 bp, Mus musculus
tggtaaagcaattggaccctgccat

SEQ ID NO: 892643 - DNA, 25 bp, Mus musculus
tggtaaagccggagatggagctcac

SEQ ID NO: 892644 - DNA, 25 bp, Mus musculus
tggtaaagccggtgatggagctcac

SEQ ID NO: 892645 - DNA, 25 bp, Mus musculus
tggtaaagcttgctagatagaatac

SEQ ID NO: 892646 - DNA, 25 bp, Mus musculus
tggtaaagcttggtagatagaatac

SEQ ID NO: 892647 - DNA, 25 bp, Mus musculus
tggtaaatagggacctcgctccggg

SEQ ID NO: 892648 - DNA, 25 bp, Mus musculus
tggtaaatagggtcctcgctccggg

SEQ ID NO: 892649 - DNA, 25 bp, Mus musculus
tggtaaatccacagggaacaatttt

SEQ ID NO: 892650 - DNA, 25 bp, Mus musculus
tggtaaatccactgggaacaatttt

SEQ ID NO: 892651 - DNA, 25 bp, Mus musculus
tggtaaatcctgaccagctaacgtc

SEQ ID NO: 892652 - DNA, 25 bp, Mus musculus
tggtaaatcctgtccagctaacgtc

SEQ ID NO: 892653 - DNA, 25 bp, Mus musculus
tggtaaatctttcctcaagaaaaga

SEQ ID NO: 892654 - DNA, 25 bp, Mus musculus
tggtaaatctttgctcaagaaaaga

SEQ ID NO: 892655 - DNA, 25 bp, Mus musculus
tggtaaatggtcatgtgccctttat

SEQ ID NO: 892656 - DNA, 25 bp, Mus musculus
tggtaaatggtcttgtgccctttat

SEQ ID NO: 892657 - DNA, 25 bp, Mus musculus
tggtaaattctaccccagcctggtg

SEQ ID NO: 892658 - DNA, 25 bp, Mus musculus
tggtaaattctagcccagcctggtg

SEQ ID NO: 892659 - DNA, 25 bp, Mus musculus
tggtaaatttggctcctgcctgggc

SEQ ID NO: 892660 - DNA, 25 bp, Mus musculus
tggtaaatttgggtcctgcctgggc

SEQ ID NO: 892661 - DNA, 25 bp, Mus musculus
tggtaacaactccacacagaattta

SEQ ID NO: 892662 - DNA, 25 bp, Mus musculus
tggtaacaactcgacacagaattta

SEQ ID NO: 892663 - DNA, 25 bp, Mus musculus
tggtaacaatttctgatgcctcaca

SEQ ID NO: 892664 - DNA, 25 bp, Mus musculus
tggtaacaatttgtgatgcctcaca

SEQ ID NO: 892665 - DNA, 25 bp, Mus musculus
tggtaacactggactctaaggagct

SEQ ID NO: 892666 - DNA, 25 bp, Mus musculus
tggtaacactggtctctaaggagct

SEQ ID NO: 892667 - DNA, 25 bp, Mus musculus
tggtaacaggtcaccactgggctgc

SEQ ID NO: 892668 - DNA, 25 bp, Mus musculus
tggtaacaggtctccactgggctgc

SEQ ID NO: 892669 - DNA, 25 bp, Mus musculus
tggtaacagtaaatcaaacccaggt

SEQ ID NO: 892670 - DNA, 25 bp, Mus musculus
tggtaacagtaattcaaacccaggt

SEQ ID NO: 892671 - DNA, 25 bp, Mus musculus
tggtaacataagacaaaagtcggat

SEQ ID NO: 892672 - DNA, 25 bp, Mus musculus
tggtaacataagtcaaaagtcggat

SEQ ID NO: 892673 - DNA, 25 bp, Mus musculus
tggtaacatgtcaccttttaaaggg

SEQ ID NO: 892674 - DNA, 25 bp, Mus musculus
tggtaacatgtctccttttaaaggg

SEQ ID NO: 892675 - DNA, 25 bp, Mus musculus
tggtaacattttcctagctgcatcc

SEQ ID NO: 892676 - DNA, 25 bp, Mus musculus
tggtaacattttgctagctgcatcc

SEQ ID NO: 892677 - DNA, 25 bp, Mus musculus
tggtaaccaagcaaccactctgatc

SEQ ID NO: 892678 - DNA, 25 bp, Mus musculus
tggtaaccaagctaccactctgatc

SEQ ID NO: 892679 - DNA, 25 bp, Mus musculus
tggtaaccatgactgtagggctgcc

SEQ ID NO: 892680 - DNA, 25 bp, Mus musculus
tggtaaccatgagtgtagggctgcc

SEQ ID NO: 892681 - DNA, 25 bp, Mus musculus
tggtaacccatcctcagtggccatt

SEQ ID NO: 892682 - DNA, 25 bp, Mus musculus
tggtaacccatcgtcagtggccatt

SEQ ID NO: 892683 - DNA, 25 bp, Mus musculus
tggtaacccccaacatttgcaaaga

SEQ ID NO: 892684 - DNA, 25 bp, Mus musculus
tggtaacccccatcatttgcaaaga

SEQ ID NO: 892685 - DNA, 25 bp, Mus musculus
tggtaaccgaggctgtatgtgcaca

SEQ ID NO: 892686 - DNA, 25 bp, Mus musculus
tggtaaccgagggtgtatgtgcaca

SEQ ID NO: 892687 - DNA, 25 bp, Mus musculus
tggtaacctaggctccttgtctgac

SEQ ID NO: 892688 - DNA, 25 bp, Mus musculus
tggtaacctagggtccttgtctgac

SEQ ID NO: 892689 - DNA, 25 bp, Mus musculus
tggtaacctctaaccagcattccca

SEQ ID NO: 892690 - DNA, 25 bp, Mus musculus
tggtaacctctatccagcattccca

SEQ ID NO: 892691 - DNA, 25 bp, Mus musculus
tggtaacctttaatccactgtttct

SEQ ID NO: 892692 - DNA, 25 bp, Mus musculus
tggtaacctttattccactgtttct

SEQ ID NO: 892693 - DNA, 25 bp, Mus musculus
tggtaacgcctccaggcccagtatt

SEQ ID NO: 892694 - DNA, 25 bp, Mus musculus
tggtaacgcctcgaggcccagtatt

SEQ ID NO: 892695 - DNA, 25 bp, Mus musculus
tggtaacgttgcatggtcctttctg

SEQ ID NO: 892696 - DNA, 25 bp, Mus musculus
tggtaacgttgcttggtcctttctg

SEQ ID NO: 892697 - DNA, 25 bp, Mus musculus
tggtaactactgagagcaagtcccc

SEQ ID NO: 892698 - DNA, 25 bp, Mus musculus
tggtaactactgtgagcaagtcccc

SEQ ID NO: 892699 - DNA, 25 bp, Mus musculus
tggtaactcatcatgttggcttcga

SEQ ID NO: 892700 - DNA, 25 bp, Mus musculus
tggtaactcatcttgttggcttcga

SEQ ID NO: 892701 - DNA, 25 bp, Mus musculus
tggtaactcctcactgtactgattt

SEQ ID NO: 892702 - DNA, 25 bp, Mus musculus
tggtaactcctctctgtactgattt

SEQ ID NO: 892703 - DNA, 25 bp, Mus musculus
tggtaactcttcagtggaccacaca

SEQ ID NO: 892704 - DNA, 25 bp, Mus musculus
tggtaactcttctgtggaccacaca

SEQ ID NO: 892705 - DNA, 25 bp, Mus musculus
tggtaactgaacataattatggtcc

SEQ ID NO: 892706 - DNA, 25 bp, Mus musculus
tggtaactgaacttaattatggtcc

SEQ ID NO: 892707 - DNA, 25 bp, Mus musculus
tggtaactttcactggtaccagcag

SEQ ID NO: 892708 - DNA, 25 bp, Mus musculus
tggtaactttcagtggtaccagcag

SEQ ID NO: 892709 - DNA, 25 bp, Mus musculus
tggtaactttgcattattcccgtgg

SEQ ID NO: 892710 - DNA, 25 bp, Mus musculus
tggtaactttgctttattcccgtgg

SEQ ID NO: 892711 - DNA, 25 bp, Mus musculus
tggtaactttttccttctcaggaaa

SEQ ID NO: 892712 - DNA, 25 bp, Mus musculus
tggtaactttttgcttctcaggaaa

SEQ ID NO: 892713 - DNA, 25 bp, Mus musculus
tggtaagacgatccttttcctttct

SEQ ID NO: 892714 - DNA, 25 bp, Mus musculus
tggtaagacgatgcttttcctttct

SEQ ID NO: 892715 - DNA, 25 bp, Mus musculus
tggtaagcagggacccacctggact

SEQ ID NO: 892716 - DNA, 25 bp, Mus musculus
tggtaagcagggtcccacctggact

SEQ ID NO: 892717 - DNA, 25 bp, Mus musculus
tggtaagctggcactgccgcctgcc

SEQ ID NO: 892718 - DNA, 25 bp, Mus musculus
tggtaagctggctctgccgcctgcc

SEQ ID NO: 892719 - DNA, 25 bp, Mus musculus
tggtaaggacgtagggagactataa

SEQ ID NO: 892720 - DNA, 25 bp, Mus musculus
tggtaaggacgttgggagactataa

SEQ ID NO: 892721 - DNA, 25 bp, Mus musculus
tggtaaggagccagatgacccaagt

SEQ ID NO: 892722 - DNA, 25 bp, Mus musculus
tggtaaggagcctgatgacccaagt

SEQ ID NO: 892723 - DNA, 25 bp, Mus musculus
tggtaaggccatatatctttcctcc

SEQ ID NO: 892724 - DNA, 25 bp, Mus musculus
tggtaaggccatttatctttcctcc

SEQ ID NO: 892725 - DNA, 25 bp, Mus musculus
tggtaaggcctcatacctgagggat

SEQ ID NO: 892726 - DNA, 25 bp, Mus musculus
tggtaaggcctcttacctgagggat

SEQ ID NO: 892727 - DNA, 25 bp, Mus musculus
tggtaagggactccatgacacagga

SEQ ID NO: 892728 - DNA, 25 bp, Mus musculus
tggtaagggactgcatgacacagga

SEQ ID NO: 892729 - DNA, 25 bp, Mus musculus
tggtaagggcagaaacggttcacat

SEQ ID NO: 892730 - DNA, 25 bp, Mus musculus
tggtaagggcagtaacggttcacat

SEQ ID NO: 892731 - DNA, 25 bp, Mus musculus
tggtaaggttctctttcccctgtca

SEQ ID NO: 892732 - DNA, 25 bp, Mus musculus
tggtaaggttctgtttcccctgtca

SEQ ID NO: 892733 - DNA, 25 bp, Mus musculus
tggtaagtcacccatgctccagtag

SEQ ID NO: 892734 - DNA, 25 bp, Mus musculus
tggtaagtcaccgatgctccagtag

SEQ ID NO: 892735 - DNA, 25 bp, Mus musculus
tggtaagtcagtaatgttgcaacct

SEQ ID NO: 892736 - DNA, 25 bp, Mus musculus
tggtaagtcagttatgttgcaacct

SEQ ID NO: 892737 - DNA, 25 bp, Mus musculus
tggtaagtgccaatgttagacaagt

SEQ ID NO: 892738 - DNA, 25 bp, Mus musculus
tggtaagtgccattgttagacaagt

SEQ ID NO: 892739 - DNA, 25 bp, Mus musculus
tggtaagtggtgctttggactcaaa

SEQ ID NO: 892740 - DNA, 25 bp, Mus musculus
tggtaagtggtggtttggactcaaa

SEQ ID NO: 892741 - DNA, 25 bp, Mus musculus
tggtaagttttacaatcctcttcct

SEQ ID NO: 892742 - DNA, 25 bp, Mus musculus
tggtaagttttagaatcctcttcct

SEQ ID NO: 892743 - DNA, 25 bp, Mus musculus
tggtaatactgcaggaccggctctg

SEQ ID NO: 892744 - DNA, 25 bp, Mus musculus
tggtaatactgctggaccggctctg

SEQ ID NO: 892745 - DNA, 25 bp, Mus musculus
tggtaatatgatcactagtcgttgt

SEQ ID NO: 892746 - DNA, 25 bp, Mus musculus
tggtaatatgatgactagtcgttgt

SEQ ID NO: 892747 - DNA, 25 bp, Mus musculus
tggtaatcttagatgctctcttcct

SEQ ID NO: 892748 - DNA, 25 bp, Mus musculus
tggtaatcttagttgctctcttcct

SEQ ID NO: 892749 - DNA, 25 bp, Mus musculus
tggtaatgcctaccagcacagcaaa

SEQ ID NO: 892750 - DNA, 25 bp, Mus musculus
tggtaatgcctagcagcacagcaaa

SEQ ID NO: 892751 - DNA, 25 bp, Mus musculus
tggtaatgctacacgccccacctgt

SEQ ID NO: 892752 - DNA, 25 bp, Mus musculus
tggtaatgctactcgccccacctgt

SEQ ID NO: 892753 - DNA, 25 bp, Mus musculus
tggtaatggtacctagtcccagccc

SEQ ID NO: 892754 - DNA, 25 bp, Mus musculus
tggtaatggtacgtagtcccagccc

SEQ ID NO: 892755 - DNA, 25 bp, Mus musculus
tggtaatgtaccaagcatgtgcaag

SEQ ID NO: 892756 - DNA, 25 bp, Mus musculus
tggtaatgtacctagcatgtgcaag

SEQ ID NO: 892757 - DNA, 25 bp, Mus musculus
tggtaatgtccaagctcacacaggt

SEQ ID NO: 892758 - DNA, 25 bp, Mus musculus
tggtaatgtccatgctcacacaggt

SEQ ID NO: 892759 - DNA, 25 bp, Mus musculus
tggtaatgttttagactgccttttt

SEQ ID NO: 892760 - DNA, 25 bp, Mus musculus
tggtaatgtttttgactgccttttt

SEQ ID NO: 892761 - DNA, 25 bp, Mus musculus
tggtaattaatcctccccataagtc

SEQ ID NO: 892762 - DNA, 25 bp, Mus musculus
tggtaattaatcgtccccataagtc

SEQ ID NO: 892763 - DNA, 25 bp, Mus musculus
tggtaattactgctcacacattttt

SEQ ID NO: 892764 - DNA, 25 bp, Mus musculus
tggtaattactggtcacacattttt

SEQ ID NO: 892765 - DNA, 25 bp, Mus musculus
tggtaattatctaccaagactggct

SEQ ID NO: 892766 - DNA, 25 bp, Mus musculus
tggtaattatcttccaagactggct

SEQ ID NO: 892767 - DNA, 25 bp, Mus musculus
tggtaattattgctgttctcactgt

SEQ ID NO: 892768 - DNA, 25 bp, Mus musculus
tggtaattattggtgttctcactgt

SEQ ID NO: 892769 - DNA, 25 bp, Mus musculus
tggtaattcctcatcaaaagcatat

SEQ ID NO: 892770 - DNA, 25 bp, Mus musculus
tggtaattcctcttcaaaagcatat

SEQ ID NO: 892771 - DNA, 25 bp, Mus musculus
tggtaattgctcaccataactcccc

SEQ ID NO: 892772 - DNA, 25 bp, Mus musculus
tggtaattgctctccataactcccc

SEQ ID NO: 892773 - DNA, 25 bp, Mus musculus
tggtaattgtccctgagtcctatat

SEQ ID NO: 892774 - DNA, 25 bp, Mus musculus
tggtaattgtccgtgagtcctatat

SEQ ID NO: 892775 - DNA, 25 bp, Mus musculus
tggtaatttgtaataacttcttcca

SEQ ID NO: 892776 - DNA, 25 bp, Mus musculus
tggtaatttgtattaacttcttcca

SEQ ID NO: 892777 - DNA, 25 bp, Mus musculus
tggtaattttggacactttggccgt

SEQ ID NO: 892778 - DNA, 25 bp, Mus musculus
tggtaattttggtcactttggccgt

SEQ ID NO: 892779 - DNA, 25 bp, Mus musculus
tggtacaaacttcatgctttctcct

SEQ ID NO: 892780 - DNA, 25 bp, Mus musculus
tggtacaaacttgatgctttctcct

SEQ ID NO: 892781 - DNA, 25 bp, Mus musculus
tggtacaaaggtctgcttagtactc

SEQ ID NO: 892782 - DNA, 25 bp, Mus musculus
tggtacaaaggtgtgcttagtactc

SEQ ID NO: 892783 - DNA, 25 bp, Mus musculus
tggtacaaccagctgcccattttgt

SEQ ID NO: 892784 - DNA, 25 bp, Mus musculus
tggtacaaccaggtgcccattttgt

SEQ ID NO: 892785 - DNA, 25 bp, Mus musculus
tggtacaaccttaatccttttccag

SEQ ID NO: 892786 - DNA, 25 bp, Mus musculus
tggtacaacctttatccttttccag

SEQ ID NO: 892787 - DNA, 25 bp, Mus musculus
tggtacacaaccatgtctgtcctgg

SEQ ID NO: 892788 - DNA, 25 bp, Mus musculus
tggtacacaaccttgtctgtcctgg

SEQ ID NO: 892789 - DNA, 25 bp, Mus musculus
tggtacacactaacctcggtggaaa

SEQ ID NO: 892790 - DNA, 25 bp, Mus musculus
tggtacacactatcctcggtggaaa

SEQ ID NO: 892791 - DNA, 25 bp, Mus musculus
tggtacacagcacttctttgtccca

SEQ ID NO: 892792 - DNA, 25 bp, Mus musculus
tggtacacagcagttctttgtccca

SEQ ID NO: 892793 - DNA, 25 bp, Mus musculus
tggtacacagccctataaactcgac

SEQ ID NO: 892794 - DNA, 25 bp, Mus musculus
tggtacacagccgtataaactcgac

SEQ ID NO: 892795 - DNA, 25 bp, Mus musculus
tggtacaccccgaacaaacagcagt

SEQ ID NO: 892796 - DNA, 25 bp, Mus musculus
tggtacaccccgtacaaacagcagt

SEQ ID NO: 892797 - DNA, 25 bp, Mus musculus
tggtacaccctgaaaacccagcatt

SEQ ID NO: 892798 - DNA, 25 bp, Mus musculus
tggtacaccctgtaaacccagcatt

SEQ ID NO: 892799 - DNA, 25 bp, Mus musculus
tggtacaccggcaacatcgagatct

SEQ ID NO: 892800 - DNA, 25 bp, Mus musculus
tggtacaccggctacatcgagatct

SEQ ID NO: 892801 - DNA, 25 bp, Mus musculus
tggtacacctcccgaaacctaattg

SEQ ID NO: 892802 - DNA, 25 bp, Mus musculus
tggtacacctccggaaacctaattg

SEQ ID NO: 892803 - DNA, 25 bp, Mus musculus
tggtacacctctatacgtatatgat

SEQ ID NO: 892804 - DNA, 25 bp, Mus musculus
tggtacacctctttacgtatatgat

SEQ ID NO: 892805 - DNA, 25 bp, Mus musculus
tggtacacctgcaagacctggcaaa

SEQ ID NO: 892806 - DNA, 25 bp, Mus musculus
tggtacacctgctagacctggcaaa

SEQ ID NO: 892807 - DNA, 25 bp, Mus musculus
tggtacactaccacactgtgacttg

SEQ ID NO: 892808 - DNA, 25 bp, Mus musculus
tggtacactacctcactgtgacttg

SEQ ID NO: 892809 - DNA, 25 bp, Mus musculus
tggtacagaaaaagctcctgccacc

SEQ ID NO: 892810 - DNA, 25 bp, Mus musculus
tggtacagaaaatgctcctgccacc

SEQ ID NO: 892811 - DNA, 25 bp, Mus musculus
tggtacagaactccagtgaccctct

SEQ ID NO: 892812 - DNA, 25 bp, Mus musculus
tggtacagaactgcagtgaccctct

SEQ ID NO: 892813 - DNA, 25 bp, Mus musculus
tggtacagcattctgcctctttagc

SEQ ID NO: 892814 - DNA, 25 bp, Mus musculus
tggtacagcattgtgcctctttagc

SEQ ID NO: 892815 - DNA, 25 bp, Mus musculus
tggtacagcgacatgtcaccatcaa

SEQ ID NO: 892816 - DNA, 25 bp, Mus musculus
tggtacagcgacttgtcaccatcaa

SEQ ID NO: 892817 - DNA, 25 bp, Mus musculus
tggtacaggagcacggcttctaccg

SEQ ID NO: 892818 - DNA, 25 bp, Mus musculus
tggtacaggagctcggcttctaccg

SEQ ID NO: 892819 - DNA, 25 bp, Mus musculus
tggtacatattgagtgatacttgaa

SEQ ID NO: 892820 - DNA, 25 bp, Mus musculus
tggtacatattgtgtgatacttgaa

SEQ ID NO: 892821 - DNA, 25 bp, Mus musculus
tggtacatctgtccccgaaattcat

SEQ ID NO: 892822 - DNA, 25 bp, Mus musculus
tggtacatctgtgcccgaaattcat

SEQ ID NO: 892823 - DNA, 25 bp, Mus musculus
tggtacattgtcagcttaatcgcca

SEQ ID NO: 892824 - DNA, 25 bp, Mus musculus
tggtacattgtctgcttaatcgcca

SEQ ID NO: 892825 - DNA, 25 bp, Mus musculus
tggtaccacagcaccctgtagtttt

SEQ ID NO: 892826 - DNA, 25 bp, Mus musculus
tggtaccacagctccctgtagtttt

SEQ ID NO: 892827 - DNA, 25 bp, Mus musculus
tggtaccagaaacggctttcctcca

SEQ ID NO: 892828 - DNA, 25 bp, Mus musculus
tggtaccagaaagggctttcctcca

SEQ ID NO: 892829 - DNA, 25 bp, Mus musculus
tggtaccagcatccaagggccatct

SEQ ID NO: 892830 - DNA, 25 bp, Mus musculus
tggtaccagcatcctcatcccaaga

SEQ ID NO: 892831 - DNA, 25 bp, Mus musculus
tggtaccagcatgcaagggccatct

SEQ ID NO: 892832 - DNA, 25 bp, Mus musculus
tggtaccagcatgctcatcccaaga

SEQ ID NO: 892833 - DNA, 25 bp, Mus musculus
tggtaccaggtacctgttgacccct

SEQ ID NO: 892834 - DNA, 25 bp, Mus musculus
tggtaccaggtagctgttgacccct

SEQ ID NO: 892835 - DNA, 25 bp, Mus musculus
tggtaccagtgaattcaagttcttg

SEQ ID NO: 892836 - DNA, 25 bp, Mus musculus
tggtaccagtgatttcaagttcttg

SEQ ID NO: 892837 - DNA, 25 bp, Mus musculus
tggtaccagtgtaagttagtcattg

SEQ ID NO: 892838 - DNA, 25 bp, Mus musculus
tggtaccagtgttagttagtcattg

SEQ ID NO: 892839 - DNA, 25 bp, Mus musculus
tggtaccatagactcgctctgaaaa

SEQ ID NO: 892840 - DNA, 25 bp, Mus musculus
tggtaccatagagtcgctctgaaaa

SEQ ID NO: 892841 - DNA, 25 bp, Mus musculus
tggtaccatccccacttaagagtcc

SEQ ID NO: 892842 - DNA, 25 bp, Mus musculus
tggtaccatcccgacttaagagtcc

SEQ ID NO: 892843 - DNA, 25 bp, Mus musculus
tggtaccattctcacggtgtggtaa

SEQ ID NO: 892844 - DNA, 25 bp, Mus musculus
tggtaccattctgacggtgtggtaa

SEQ ID NO: 892845 - DNA, 25 bp, Mus musculus
tggtaccattggcaagacccccaac

SEQ ID NO: 892846 - DNA, 25 bp, Mus musculus
tggtaccattgggaagacccccaac

SEQ ID NO: 892847 - DNA, 25 bp, Mus musculus
tggtacccacaaacctacagagatg

SEQ ID NO: 892848 - DNA, 25 bp, Mus musculus
tggtacccacaatcctacagagatg

SEQ ID NO: 892849 - DNA, 25 bp, Mus musculus
tggtacccactcatcgggtgaggcc

SEQ ID NO: 892850 - DNA, 25 bp, Mus musculus
tggtacccactcttcgggtgaggcc

SEQ ID NO: 892851 - DNA, 25 bp, Mus musculus
tggtacccatggaacctaaaccaat

SEQ ID NO: 892852 - DNA, 25 bp, Mus musculus
tggtacccatggcaattggcccagc

SEQ ID NO: 892853 - DNA, 25 bp, Mus musculus
tggtacccatgggaattggcccagc

SEQ ID NO: 892854 - DNA, 25 bp, Mus musculus
tggtacccatggtacctaaaccaat

SEQ ID NO: 892855 - DNA, 25 bp, Mus musculus
tggtaccccaaaccgttcgacagga

SEQ ID NO: 892856 - DNA, 25 bp, Mus musculus
tggtaccccaaagcgttcgacagga

SEQ ID NO: 892857 - DNA, 25 bp, Mus musculus
tggtaccccagtaaggattacacct

SEQ ID NO: 892858 - DNA, 25 bp, Mus musculus
tggtaccccagttaggattacacct

SEQ ID NO: 892859 - DNA, 25 bp, Mus musculus
tggtaccccgtgcttctttattgca

SEQ ID NO: 892860 - DNA, 25 bp, Mus musculus
tggtaccccgtggttctttattgca

SEQ ID NO: 892861 - DNA, 25 bp, Mus musculus
tggtacccctttcaatctagacttg

SEQ ID NO: 892862 - DNA, 25 bp, Mus musculus
tggtacccctttgaatctagacttg

SEQ ID NO: 892863 - DNA, 25 bp, Mus musculus
tggtaccctacccagtcacaagata

SEQ ID NO: 892864 - DNA, 25 bp, Mus musculus
tggtaccctaccgagtcacaagata

SEQ ID NO: 892865 - DNA, 25 bp, Mus musculus
tggtaccctagtctgcatctcatag

SEQ ID NO: 892866 - DNA, 25 bp, Mus musculus
tggtaccctagtgtgcatctcatag

SEQ ID NO: 892867 - DNA, 25 bp, Mus musculus
tggtaccctggaatgtgacactctt

SEQ ID NO: 892868 - DNA, 25 bp, Mus musculus
tggtaccctggattgtgacactctt

SEQ ID NO: 892869 - DNA, 25 bp, Mus musculus
tggtacccttggagcacgctttgct

SEQ ID NO: 892870 - DNA, 25 bp, Mus musculus
tggtacccttggtgcacgctttgct

SEQ ID NO: 892871 - DNA, 25 bp, Mus musculus
tggtaccgggtaaattttgtttatg

SEQ ID NO: 892872 - DNA, 25 bp, Mus musculus
tggtaccgggtatattttgtttatg

SEQ ID NO: 892873 - DNA, 25 bp, Mus musculus
tggtacctacaacagcaacttagtt

SEQ ID NO: 892874 - DNA, 25 bp, Mus musculus
tggtacctacaagagcaacttagtt

SEQ ID NO: 892875 - DNA, 25 bp, Mus musculus
tggtacctactcataatttattctt

SEQ ID NO: 892876 - DNA, 25 bp, Mus musculus
tggtacctactcttaatttattctt

SEQ ID NO: 892877 - DNA, 25 bp, Mus musculus
tggtacctaggtaatctttcaaaga

SEQ ID NO: 892878 - DNA, 25 bp, Mus musculus
tggtacctaggttatctttcaaaga

SEQ ID NO: 892879 - DNA, 25 bp, Mus musculus
tggtacctcatacccataattccag

SEQ ID NO: 892880 - DNA, 25 bp, Mus musculus
tggtacctcatagccataattccag

SEQ ID NO: 892881 - DNA, 25 bp, Mus musculus
tggtacctgatacccaagcaagctc

SEQ ID NO: 892882 - DNA, 25 bp, Mus musculus
tggtacctgatagccaagcaagctc

SEQ ID NO: 892883 - DNA, 25 bp, Mus musculus
tggtacctgcagctgagagcaccct

SEQ ID NO: 892884 - DNA, 25 bp, Mus musculus
tggtacctgcaggtgagagcaccct

SEQ ID NO: 892885 - DNA, 25 bp, Mus musculus
tggtacctgccactatgagtgccag

SEQ ID NO: 892886 - DNA, 25 bp, Mus musculus
tggtacctgccagtatgagtgccag

SEQ ID NO: 892887 - DNA, 25 bp, Mus musculus
tggtacctgggcaatcattcctcta

SEQ ID NO: 892888 - DNA, 25 bp, Mus musculus
tggtacctgggctatcattcctcta

SEQ ID NO: 892889 - DNA, 25 bp, Mus musculus
tggtacctgggtcctagctaaggtt

SEQ ID NO: 892890 - DNA, 25 bp, Mus musculus
tggtacctgggtgctagctaaggtt

SEQ ID NO: 892891 - DNA, 25 bp, Mus musculus
tggtaccttatgagccacccgaggc

SEQ ID NO: 892892 - DNA, 25 bp, Mus musculus
tggtaccttatgtgccacccgaggc

SEQ ID NO: 892893 - DNA, 25 bp, Mus musculus
tggtaccttcagacctacaggacat

SEQ ID NO: 892894 - DNA, 25 bp, Mus musculus
tggtaccttcagtcctacaggacat

SEQ ID NO: 892895 - DNA, 25 bp, Mus musculus
tggtaccttggtctcttattcaaac

SEQ ID NO: 892896 - DNA, 25 bp, Mus musculus
tggtaccttggtgtcttattcaaac

SEQ ID NO: 892897 - DNA, 25 bp, Mus musculus
tggtacctttctcccctctggctga

SEQ ID NO: 892898 - DNA, 25 bp, Mus musculus
tggtacctttctgccctctggctga

SEQ ID NO: 892899 - DNA, 25 bp, Mus musculus
tggtacgaggtgctgaactgttcaa

SEQ ID NO: 892900 - DNA, 25 bp, Mus musculus
tggtacgaggtggtgaactgttcaa

SEQ ID NO: 892901 - DNA, 25 bp, Mus musculus
tggtacgatcccataatcctttctg

SEQ ID NO: 892902 - DNA, 25 bp, Mus musculus
tggtacgatcccttaatcctttctg

SEQ ID NO: 892903 - DNA, 25 bp, Mus musculus
tggtacgccttgacggtcctgcagt

SEQ ID NO: 892904 - DNA, 25 bp, Mus musculus
tggtacgccttgtcggtcctgcagt

SEQ ID NO: 892905 - DNA, 25 bp, Mus musculus
tggtacgcttcaaactgtggtcctg

SEQ ID NO: 892906 - DNA, 25 bp, Mus musculus
tggtacgcttcatactgtggtcctg

SEQ ID NO: 892907 - DNA, 25 bp, Mus musculus
tggtacggcagaaccgggctctaga

SEQ ID NO: 892908 - DNA, 25 bp, Mus musculus
tggtacggcagatccgggctctaga

SEQ ID NO: 892909 - DNA, 25 bp, Mus musculus
tggtacggctttccgacacagccac

SEQ ID NO: 892910 - DNA, 25 bp, Mus musculus
tggtacggctttgcgacacagccac

SEQ ID NO: 892911 - DNA, 25 bp, Mus musculus
tggtacgtccagcttcattactatc

SEQ ID NO: 892912 - DNA, 25 bp, Mus musculus
tggtacgtccaggttcattactatc

SEQ ID NO: 892913 - DNA, 25 bp, Mus musculus
tggtacgtgcaactatctgttgttc

SEQ ID NO: 892914 - DNA, 25 bp, Mus musculus
tggtacgtgcaagtatctgttgttc

SEQ ID NO: 892915 - DNA, 25 bp, Mus musculus
tggtacgtggtacctgatgaaaaca

SEQ ID NO: 892916 - DNA, 25 bp, Mus musculus
tggtacgtggtagctgatgaaaaca

SEQ ID NO: 892917 - DNA, 25 bp, Mus musculus
tggtactatagactctgaggctgga

SEQ ID NO: 892918 - DNA, 25 bp, Mus musculus
tggtactatagagtctgaggctgga

SEQ ID NO: 892919 - DNA, 25 bp, Mus musculus
tggtactcaaccactgggctgtatt

SEQ ID NO: 892920 - DNA, 25 bp, Mus musculus
tggtactcaacctctgggctgtatt

SEQ ID NO: 892921 - DNA, 25 bp, Mus musculus
tggtactcacagcagaccccacaag

SEQ ID NO: 892922 - DNA, 25 bp, Mus musculus
tggtactcacaggagaccccacaag

SEQ ID NO: 892923 - DNA, 25 bp, Mus musculus
tggtactccaagagtgctaccattc

SEQ ID NO: 892924 - DNA, 25 bp, Mus musculus
tggtactccaagtgtgctaccattc

SEQ ID NO: 892925 - DNA, 25 bp, Mus musculus
tggtactcccgaactcaggtttaag

SEQ ID NO: 892926 - DNA, 25 bp, Mus musculus
tggtactcccgatctcaggtttaag

SEQ ID NO: 892927 - DNA, 25 bp, Mus musculus
tggtactccctgagcatggaccctt

SEQ ID NO: 892928 - DNA, 25 bp, Mus musculus
tggtactccctgtgcatggaccctt

SEQ ID NO: 892929 - DNA, 25 bp, Mus musculus
tggtactcctcgacaaagctgccag

SEQ ID NO: 892930 - DNA, 25 bp, Mus musculus
tggtactcctcgtcaaagctgccag

SEQ ID NO: 892931 - DNA, 25 bp, Mus musculus
tggtactcgtgcacttgcactcaga

SEQ ID NO: 892932 - DNA, 25 bp, Mus musculus
tggtactcgtgctcttgcactcaga

SEQ ID NO: 892933 - DNA, 25 bp, Mus musculus
tggtactctagtattcgggcggtga

SEQ ID NO: 892934 - DNA, 25 bp, Mus musculus
tggtactctagttttcgggcggtga

SEQ ID NO: 892935 - DNA, 25 bp, Mus musculus
tggtactctgcacctatcacagaat

SEQ ID NO: 892936 - DNA, 25 bp, Mus musculus
tggtactctgcagctatcacagaat

SEQ ID NO: 892937 - DNA, 25 bp, Mus musculus
tggtactgaattagtggcacccctc

SEQ ID NO: 892938 - DNA, 25 bp, Mus musculus
tggtactgaatttgtggcacccctc

SEQ ID NO: 892939 - DNA, 25 bp, Mus musculus
tggtactgctcaaccaaagtggatc

SEQ ID NO: 892940 - DNA, 25 bp, Mus musculus
tggtactgctcatccaaagtggatc

SEQ ID NO: 892941 - DNA, 25 bp, Mus musculus
tggtactgctttaactcactgttta

SEQ ID NO: 892942 - DNA, 25 bp, Mus musculus
tggtactgcttttactcactgttta

SEQ ID NO: 892943 - DNA, 25 bp, Mus musculus
tggtactggaagagtcagaggtctt

SEQ ID NO: 892944 - DNA, 25 bp, Mus musculus
tggtactggaagtgtcagaggtctt

SEQ ID NO: 892945 - DNA, 25 bp, Mus musculus
tggtactgtatgaggaagtttccta

SEQ ID NO: 892946 - DNA, 25 bp, Mus musculus
tggtactgtatgtggaagtttccta

SEQ ID NO: 892947 - DNA, 25 bp, Mus musculus
tggtacttacggcttattgttgttg

SEQ ID NO: 892948 - DNA, 25 bp, Mus musculus
tggtacttacgggttattgttgttg

SEQ ID NO: 892949 - DNA, 25 bp, Mus musculus
tggtacttactgattcagagggtga

SEQ ID NO: 892950 - DNA, 25 bp, Mus musculus
tggtacttactgtttcagagggtga

SEQ ID NO: 892951 - DNA, 25 bp, Mus musculus
tggtacttaggtatcccatccaaat

SEQ ID NO: 892952 - DNA, 25 bp, Mus musculus
tggtacttaggtttcccatccaaat

SEQ ID NO: 892953 - DNA, 25 bp, Mus musculus
tggtacttcctgaggccttctctat

SEQ ID NO: 892954 - DNA, 25 bp, Mus musculus
tggtacttcctgtggccttctctat

SEQ ID NO: 892955 - DNA, 25 bp, Mus musculus
tggtacttctggacccgctacactg

SEQ ID NO: 892956 - DNA, 25 bp, Mus musculus
tggtacttctggtcccgctacactg

SEQ ID NO: 892957 - DNA, 25 bp, Mus musculus
tggtacttggacatcgttcttttaa

SEQ ID NO: 892958 - DNA, 25 bp, Mus musculus
tggtacttggacttcgttcttttaa

SEQ ID NO: 892959 - DNA, 25 bp, Mus musculus
tggtacttgtttacaaatccatagt

SEQ ID NO: 892960 - DNA, 25 bp, Mus musculus
tggtacttgttttcaaatccatagt

SEQ ID NO: 892961 - DNA, 25 bp, Mus musculus
tggtactttgatctttctgtcttta

SEQ ID NO: 892962 - DNA, 25 bp, Mus musculus
tggtactttgatgtttctgtcttta

SEQ ID NO: 892963 - DNA, 25 bp, Mus musculus
tggtacttttcaacgtggcagaggg

SEQ ID NO: 892964 - DNA, 25 bp, Mus musculus
tggtacttttcatcgtggcagaggg

SEQ ID NO: 892965 - DNA, 25 bp, Mus musculus
tggtactttttccttgagcaccgta

SEQ ID NO: 892966 - DNA, 25 bp, Mus musculus
tggtactttttcgttgagcaccgta

SEQ ID NO: 892967 - DNA, 25 bp, Mus musculus
tggtagaaacagcaggtatccccta

SEQ ID NO: 892968 - DNA, 25 bp, Mus musculus
tggtagaaacaggaggtatccccta

SEQ ID NO: 892969 - DNA, 25 bp, Mus musculus
tggtagaaacctcgccaatctttga

SEQ ID NO: 892970 - DNA, 25 bp, Mus musculus
tggtagaaacctggccaatctttga

SEQ ID NO: 892971 - DNA, 25 bp, Mus musculus
tggtagaaccttcagcattgtcctt

SEQ ID NO: 892972 - DNA, 25 bp, Mus musculus
tggtagaaccttgagcattgtcctt

SEQ ID NO: 892973 - DNA, 25 bp, Mus musculus
tggtagaagatcagccgcatggctt

SEQ ID NO: 892974 - DNA, 25 bp, Mus musculus
tggtagaagatctgccgcatggctt

SEQ ID NO: 892975 - DNA, 25 bp, Mus musculus
tggtagaagccactgcgtttttccc

SEQ ID NO: 892976 - DNA, 25 bp, Mus musculus
tggtagaagccagtgcgtttttccc

SEQ ID NO: 892977 - DNA, 25 bp, Mus musculus
tggtagaaggcaattaatcacagaa

SEQ ID NO: 892978 - DNA, 25 bp, Mus musculus
tggtagaaggcactcctggttcagc

SEQ ID NO: 892979 - DNA, 25 bp, Mus musculus
tggtagaaggcagtcctggttcagc

SEQ ID NO: 892980 - DNA, 25 bp, Mus musculus
tggtagaaggcatttaatcacagaa

SEQ ID NO: 892981 - DNA, 25 bp, Mus musculus
tggtagacaacaagcacttctattg

SEQ ID NO: 892982 - DNA, 25 bp, Mus musculus
tggtagacaacatgcacttctattg

SEQ ID NO: 892983 - DNA, 25 bp, Mus musculus
tggtagacaactctagcactcctgc

SEQ ID NO: 892984 - DNA, 25 bp, Mus musculus
tggtagacaactgtagcactcctgc

SEQ ID NO: 892985 - DNA, 25 bp, Mus musculus
tggtagacactaagtaccctctgcg

SEQ ID NO: 892986 - DNA, 25 bp, Mus musculus
tggtagacactatgtaccctctgcg

SEQ ID NO: 892987 - DNA, 25 bp, Mus musculus
tggtagaccaccagcggatgctgcg

SEQ ID NO: 892988 - DNA, 25 bp, Mus musculus
tggtagaccacctgcggatgctgcg

SEQ ID NO: 892989 - DNA, 25 bp, Mus musculus
tggtagactccaacctgcagggctt

SEQ ID NO: 892990 - DNA, 25 bp, Mus musculus
tggtagactccatcctgcagggctt

SEQ ID NO: 892991 - DNA, 25 bp, Mus musculus
tggtagactgaccactacagggact

SEQ ID NO: 892992 - DNA, 25 bp, Mus musculus
tggtagactgacgactacagggact

SEQ ID NO: 892993 - DNA, 25 bp, Mus musculus
tggtagactttacagccggtccacc

SEQ ID NO: 892994 - DNA, 25 bp, Mus musculus
tggtagactttagagccggtccacc

SEQ ID NO: 892995 - DNA, 25 bp, Mus musculus
tggtagagctatatcctgtgaggtt

SEQ ID NO: 892996 - DNA, 25 bp, Mus musculus
tggtagagctatttcctgtgaggtt

SEQ ID NO: 892997 - DNA, 25 bp, Mus musculus
tggtagaggcccctgtcatgtacag

SEQ ID NO: 892998 - DNA, 25 bp, Mus musculus
tggtagaggcccgtgtcatgtacag

SEQ ID NO: 892999 - DNA, 25 bp, Mus musculus
tggtagataagcctccctgacttta

SEQ ID NO: 893000 - DNA, 25 bp, Mus musculus
tggtagataagcgtccctgacttta

SEQ ID NO: 893001 - DNA, 25 bp, Mus musculus
tggtagatgccaaccagacggtgca

SEQ ID NO: 893002 - DNA, 25 bp, Mus musculus
tggtagatgccatccagacggtgca

SEQ ID NO: 893003 - DNA, 25 bp, Mus musculus
tggtagattctcagttgggctgtag

SEQ ID NO: 893004 - DNA, 25 bp, Mus musculus
tggtagattctctgttgggctgtag

SEQ ID NO: 893005 - DNA, 25 bp, Mus musculus
tggtagcaaaccaccgtcttcttac

SEQ ID NO: 893006 - DNA, 25 bp, Mus musculus
tggtagcaaacctccgtcttcttac

SEQ ID NO: 893007 - DNA, 25 bp, Mus musculus
tggtagcaacacctgacctgtcaga

SEQ ID NO: 893008 - DNA, 25 bp, Mus musculus
tggtagcaacacgtgacctgtcaga

SEQ ID NO: 893009 - DNA, 25 bp, Mus musculus
tggtagcaagggaccacccgcgtta

SEQ ID NO: 893010 - DNA, 25 bp, Mus musculus
tggtagcaagggtccacccgcgtta

SEQ ID NO: 893011 - DNA, 25 bp, Mus musculus
tggtagcaagtcagcttcaggtgca

SEQ ID NO: 893012 - DNA, 25 bp, Mus musculus
tggtagcaagtctgcttcaggtgca

SEQ ID NO: 893013 - DNA, 25 bp, Mus musculus
tggtagcaatggatcgttcacgttt

SEQ ID NO: 893014 - DNA, 25 bp, Mus musculus
tggtagcaatggttcgttcacgttt

SEQ ID NO: 893015 - DNA, 25 bp, Mus musculus
tggtagcacagacagcaagctccct

SEQ ID NO: 893016 - DNA, 25 bp, Mus musculus
tggtagcacagagagcaagctccct

SEQ ID NO: 893017 - DNA, 25 bp, Mus musculus
tggtagcacatgactgtcctcagcc

SEQ ID NO: 893018 - DNA, 25 bp, Mus musculus
tggtagcacatgtctgtcctcagcc

SEQ ID NO: 893019 - DNA, 25 bp, Mus musculus
tggtagcagcacacggaatcactcc

SEQ ID NO: 893020 - DNA, 25 bp, Mus musculus
tggtagcagcactcggaatcactcc

SEQ ID NO: 893021 - DNA, 25 bp, Mus musculus
tggtagccaaacataactcctgggt

SEQ ID NO: 893022 - DNA, 25 bp, Mus musculus
tggtagccaaacttaactcctgggt

SEQ ID NO: 893023 - DNA, 25 bp, Mus musculus
tggtagccacacagcgggccacagg

SEQ ID NO: 893024 - DNA, 25 bp, Mus musculus
tggtagccacactgcgggccacagg

SEQ ID NO: 893025 - DNA, 25 bp, Mus musculus
tggtagccacagactagggagcgtc

SEQ ID NO: 893026 - DNA, 25 bp, Mus musculus
tggtagccacagtctagggagcgtc

SEQ ID NO: 893027 - DNA, 25 bp, Mus musculus
tggtagccagagctccacagagaaa

SEQ ID NO: 893028 - DNA, 25 bp, Mus musculus
tggtagccagaggtccacagagaaa

SEQ ID NO: 893029 - DNA, 25 bp, Mus musculus
tggtagccatttatacattgttttg

SEQ ID NO: 893030 - DNA, 25 bp, Mus musculus
tggtagccatttttacattgttttg

SEQ ID NO: 893031 - DNA, 25 bp, Mus musculus
tggtagcccaagcttttctgtgtac

SEQ ID NO: 893032 - DNA, 25 bp, Mus musculus
tggtagcccaaggttttctgtgtac

SEQ ID NO: 893033 - DNA, 25 bp, Mus musculus
tggtagcccattatgtttatggaaa

SEQ ID NO: 893034 - DNA, 25 bp, Mus musculus
tggtagcccattttgtttatggaaa

SEQ ID NO: 893035 - DNA, 25 bp, Mus musculus
tggtagccctgacccagtgcatatt

SEQ ID NO: 893036 - DNA, 25 bp, Mus musculus
tggtagccctgagccagtgcatatt

SEQ ID NO: 893037 - DNA, 25 bp, Mus musculus
tggtagccgaagaagaacacccggt

SEQ ID NO: 893038 - DNA, 25 bp, Mus musculus
tggtagccgaagtagaacacccggt

SEQ ID NO: 893039 - DNA, 25 bp, Mus musculus
tggtagcctcaaccaggctttggat

SEQ ID NO: 893040 - DNA, 25 bp, Mus musculus
tggtagcctcaagcaggctttggat

SEQ ID NO: 893041 - DNA, 25 bp, Mus musculus
tggtagcgagccagccagagacagc

SEQ ID NO: 893042 - DNA, 25 bp, Mus musculus
tggtagcgagcctgccagagacagc

SEQ ID NO: 893043 - DNA, 25 bp, Mus musculus
tggtagctcacaacccatctggaat

SEQ ID NO: 893044 - DNA, 25 bp, Mus musculus
tggtagctcacatcccatctggaat

SEQ ID NO: 893045 - DNA, 25 bp, Mus musculus
tggtagctctctagcactgatccaa

SEQ ID NO: 893046 - DNA, 25 bp, Mus musculus
tggtagctctcttgcactgatccaa

SEQ ID NO: 893047 - DNA, 25 bp, Mus musculus
tggtagctggatctttccctttcaa

SEQ ID NO: 893048 - DNA, 25 bp, Mus musculus
tggtagctggatgtttccctttcaa

SEQ ID NO: 893049 - DNA, 25 bp, Mus musculus
tggtagctggtcatcatttccacca

SEQ ID NO: 893050 - DNA, 25 bp, Mus musculus
tggtagctggtcttcatttccacca

SEQ ID NO: 893051 - DNA, 25 bp, Mus musculus
tggtagcttcaacaaccatctcgta

SEQ ID NO: 893052 - DNA, 25 bp, Mus musculus
tggtagcttcaagaaccatctcgta

SEQ ID NO: 893053 - DNA, 25 bp, Mus musculus
tggtagcttcctatctgagcccaga

SEQ ID NO: 893054 - DNA, 25 bp, Mus musculus
tggtagcttcctttctgagcccaga

SEQ ID NO: 893055 - DNA, 25 bp, Mus musculus
tggtagcttgaacttggaccctcca

SEQ ID NO: 893056 - DNA, 25 bp, Mus musculus
tggtagcttgaagttggaccctcca

SEQ ID NO: 893057 - DNA, 25 bp, Mus musculus
tggtaggagattagccccccattta

SEQ ID NO: 893058 - DNA, 25 bp, Mus musculus
tggtaggagatttgccccccattta

SEQ ID NO: 893059 - DNA, 25 bp, Mus musculus
tggtaggataacagctccaagcagc

SEQ ID NO: 893060 - DNA, 25 bp, Mus musculus
tggtaggataactgctccaagcagc

SEQ ID NO: 893061 - DNA, 25 bp, Mus musculus
tggtaggatcacagcttgttaagca

SEQ ID NO: 893062 - DNA, 25 bp, Mus musculus
tggtaggatcactgcttgttaagca

SEQ ID NO: 893063 - DNA, 25 bp, Mus musculus
tggtaggcaaatactcttcaattga

SEQ ID NO: 893064 - DNA, 25 bp, Mus musculus
tggtaggcaaattctcttcaattga

SEQ ID NO: 893065 - DNA, 25 bp, Mus musculus
tggtaggcaacaaccctgggactgt

SEQ ID NO: 893066 - DNA, 25 bp, Mus musculus
tggtaggcaacaagcgggaccgtca

SEQ ID NO: 893067 - DNA, 25 bp, Mus musculus
tggtaggcaacatccctgggactgt

SEQ ID NO: 893068 - DNA, 25 bp, Mus musculus
tggtaggcaacatgcgggaccgtca

SEQ ID NO: 893069 - DNA, 25 bp, Mus musculus
tggtaggcaagcatacataggactt

SEQ ID NO: 893070 - DNA, 25 bp, Mus musculus
tggtaggcaagcttacataggactt

SEQ ID NO: 893071 - DNA, 25 bp, Mus musculus
tggtagggcataatccccttttaca

SEQ ID NO: 893072 - DNA, 25 bp, Mus musculus
tggtagggcatattccccttttaca

SEQ ID NO: 893073 - DNA, 25 bp, Mus musculus
tggtagggccaactgctagaacctg

SEQ ID NO: 893074 - DNA, 25 bp, Mus musculus
tggtagggccaagtgctagaacctg

SEQ ID NO: 893075 - DNA, 25 bp, Mus musculus
tggtaggtaacgctcgtcagcgcaa

SEQ ID NO: 893076 - DNA, 25 bp, Mus musculus
tggtaggtaacggtcgtcagcgcaa

SEQ ID NO: 893077 - DNA, 25 bp, Mus musculus
tggtaggtaattcgctcttgtggta

SEQ ID NO: 893078 - DNA, 25 bp, Mus musculus
tggtaggtaattggctcttgtggta

SEQ ID NO: 893079 - DNA, 25 bp, Mus musculus
tggtaggtatcaaagccaaggcttt

SEQ ID NO: 893080 - DNA, 25 bp, Mus musculus
tggtaggtatcatagccaaggcttt

SEQ ID NO: 893081 - DNA, 25 bp, Mus musculus
tggtaggtctttatctcaaggagat

SEQ ID NO: 893082 - DNA, 25 bp, Mus musculus
tggtaggtctttttctcaaggagat

SEQ ID NO: 893083 - DNA, 25 bp, Mus musculus
tggtaggtgtcccatcccttgtaac

SEQ ID NO: 893084 - DNA, 25 bp, Mus musculus
tggtaggtgtccgatcccttgtaac

SEQ ID NO: 893085 - DNA, 25 bp, Mus musculus
tggtaggtgtctctcaggcccctgt

SEQ ID NO: 893086 - DNA, 25 bp, Mus musculus
tggtaggtgtctgtcaggcccctgt

SEQ ID NO: 893087 - DNA, 25 bp, Mus musculus
tggtaggttagtacattctcagcat

SEQ ID NO: 893088 - DNA, 25 bp, Mus musculus
tggtaggttagttcattctcagcat

SEQ ID NO: 893089 - DNA, 25 bp, Mus musculus
tggtaggtttctcactccattgaaa

SEQ ID NO: 893090 - DNA, 25 bp, Mus musculus
tggtaggtttctgactccattgaaa

SEQ ID NO: 893091 - DNA, 25 bp, Mus musculus
tggtaggttttcatcacaggcttca

SEQ ID NO: 893092 - DNA, 25 bp, Mus musculus
tggtaggttttcttcacaggcttca

SEQ ID NO: 893093 - DNA, 25 bp, Mus musculus
tggtagtaccagaccctttgactcc

SEQ ID NO: 893094 - DNA, 25 bp, Mus musculus
tggtagtaccagtccctttgactcc

SEQ ID NO: 893095 - DNA, 25 bp, Mus musculus
tggtagtataccactgtgcagtgta

SEQ ID NO: 893096 - DNA, 25 bp, Mus musculus
tggtagtatacctctgtgcagtgta

SEQ ID NO: 893097 - DNA, 25 bp, Mus musculus
tggtagtcagggaagtccccgcgac

SEQ ID NO: 893098 - DNA, 25 bp, Mus musculus
tggtagtcagggtagtccccgcgac

SEQ ID NO: 893099 - DNA, 25 bp, Mus musculus
tggtagtctagacgagccccacact

SEQ ID NO: 893100 - DNA, 25 bp, Mus musculus
tggtagtctagaggagccccacact

SEQ ID NO: 893101 - DNA, 25 bp, Mus musculus
tggtagtctctgcagatcagtcaga

SEQ ID NO: 893102 - DNA, 25 bp, Mus musculus
tggtagtctctggagatcagtcaga

SEQ ID NO: 893103 - DNA, 25 bp, Mus musculus
tggtagtgaacgcttgtcatcccag

SEQ ID NO: 893104 - DNA, 25 bp, Mus musculus
tggtagtgaacggttgtcatcccag

SEQ ID NO: 893105 - DNA, 25 bp, Mus musculus
tggtagtgaatcctttccctggttt

SEQ ID NO: 893106 - DNA, 25 bp, Mus musculus
tggtagtgaatcgtttccctggttt

SEQ ID NO: 893107 - DNA, 25 bp, Mus musculus
tggtagtgcactcctgtagccctag

SEQ ID NO: 893108 - DNA, 25 bp, Mus musculus
tggtagtgcactgctgtagccctag

SEQ ID NO: 893109 - DNA, 25 bp, Mus musculus
tggtagtgccacaatgacaaggccc

SEQ ID NO: 893110 - DNA, 25 bp, Mus musculus
tggtagtgccactatgacaaggccc

SEQ ID NO: 893111 - DNA, 25 bp, Mus musculus
tggtagtgcctcaaaacctgctttt

SEQ ID NO: 893112 - DNA, 25 bp, Mus musculus
tggtagtgcctctaaacctgctttt

SEQ ID NO: 893113 - DNA, 25 bp, Mus musculus
tggtagtggagcaagagacctcttt

SEQ ID NO: 893114 - DNA, 25 bp, Mus musculus
tggtagtggagctagagacctcttt

SEQ ID NO: 893115 - DNA, 25 bp, Mus musculus
tggtagtggtaacgtgcccttatgt

SEQ ID NO: 893116 - DNA, 25 bp, Mus musculus
tggtagtggtaaggtgcccttatgt

SEQ ID NO: 893117 - DNA, 25 bp, Mus musculus
tggtagtgtgggatctcggtcatcc

SEQ ID NO: 893118 - DNA, 25 bp, Mus musculus
tggtagtgtgggttctcggtcatcc

SEQ ID NO: 893119 - DNA, 25 bp, Mus musculus
tggtagttacaacgaagcccacttt

SEQ ID NO: 893120 - DNA, 25 bp, Mus musculus
tggtagttacaaggaagcccacttt

SEQ ID NO: 893121 - DNA, 25 bp, Mus musculus
tggtagttcaagatctcaacccgcc

SEQ ID NO: 893122 - DNA, 25 bp, Mus musculus
tggtagttcaagttctcaacccgcc

SEQ ID NO: 893123 - DNA, 25 bp, Mus musculus
tggtagttcactagctaatgagcac

SEQ ID NO: 893124 - DNA, 25 bp, Mus musculus
tggtagttcacttgctaatgagcac

SEQ ID NO: 893125 - DNA, 25 bp, Mus musculus
tggtagttgtttcttacacacacac

SEQ ID NO: 893126 - DNA, 25 bp, Mus musculus
tggtagttgtttgttacacacacac

SEQ ID NO: 893127 - DNA, 25 bp, Mus musculus
tggtagtttaccacacttcatgaat

SEQ ID NO: 893128 - DNA, 25 bp, Mus musculus
tggtagtttacctcacttcatgaat

SEQ ID NO: 893129 - DNA, 25 bp, Mus musculus
tggtagtttttcaccactggtaatc

SEQ ID NO: 893130 - DNA, 25 bp, Mus musculus
tggtagtttttctccactggtaatc

SEQ ID NO: 893131 - DNA, 25 bp, Mus musculus
tggtataactaccttcaaaacttct

SEQ ID NO: 893132 - DNA, 25 bp, Mus musculus
tggtataactacgttcaaaacttct

SEQ ID NO: 893133 - DNA, 25 bp, Mus musculus
tggtataacttcagcgcatcctcca

SEQ ID NO: 893134 - DNA, 25 bp, Mus musculus
tggtataacttctgcgcatcctcca

SEQ ID NO: 893135 - DNA, 25 bp, Mus musculus
tggtataagatgagactgtgctcct

SEQ ID NO: 893136 - DNA, 25 bp, Mus musculus
tggtataagatgtgactgtgctcct

SEQ ID NO: 893137 - DNA, 25 bp, Mus musculus
tggtatacacctatactctgacggc

SEQ ID NO: 893138 - DNA, 25 bp, Mus musculus
tggtatacacctttactctgacggc

SEQ ID NO: 893139 - DNA, 25 bp, Mus musculus
tggtatacatttatgcagtcctttg

SEQ ID NO: 893140 - DNA, 25 bp, Mus musculus
tggtatacatttttgcagtcctttg

SEQ ID NO: 893141 - DNA, 25 bp, Mus musculus
tggtatacccttaatcccaacactt

SEQ ID NO: 893142 - DNA, 25 bp, Mus musculus
tggtataccctttatcccaacactt

SEQ ID NO: 893143 - DNA, 25 bp, Mus musculus
tggtataccttgaaatcccaggact

SEQ ID NO: 893144 - DNA, 25 bp, Mus musculus
tggtataccttgtaatcccaggact

SEQ ID NO: 893145 - DNA, 25 bp, Mus musculus
tggtatagaaccaacccactacttt

SEQ ID NO: 893146 - DNA, 25 bp, Mus musculus
tggtatagaacctacccactacttt

SEQ ID NO: 893147 - DNA, 25 bp, Mus musculus
tggtatatcatcagggcgctcccag

SEQ ID NO: 893148 - DNA, 25 bp, Mus musculus
tggtatatcatctgggcgctcccag

SEQ ID NO: 893149 - DNA, 25 bp, Mus musculus
tggtatattgctaaggctactccta

SEQ ID NO: 893150 - DNA, 25 bp, Mus musculus
tggtatattgcttaggctactccta

SEQ ID NO: 893151 - DNA, 25 bp, Mus musculus
tggtatcaagaccatcactccagat

SEQ ID NO: 893152 - DNA, 25 bp, Mus musculus
tggtatcaagacgatcactccagat

SEQ ID NO: 893153 - DNA, 25 bp, Mus musculus
tggtatcagaatcgaacgcctcttc

SEQ ID NO: 893154 - DNA, 25 bp, Mus musculus
tggtatcagaatggaacgcctcttc

SEQ ID NO: 893155 - DNA, 25 bp, Mus musculus
tggtatcagtggcatagcctcttcc

SEQ ID NO: 893156 - DNA, 25 bp, Mus musculus
tggtatcagtgggatagcctcttcc

SEQ ID NO: 893157 - DNA, 25 bp, Mus musculus
tggtatccacctaatgttgtcccag

SEQ ID NO: 893158 - DNA, 25 bp, Mus musculus
tggtatccaccttatgttgtcccag

SEQ ID NO: 893159 - DNA, 25 bp, Mus musculus
tggtatccacgcctgagaagtcaca

SEQ ID NO: 893160 - DNA, 25 bp, Mus musculus
tggtatccacgcgtgagaagtcaca

SEQ ID NO: 893161 - DNA, 25 bp, Mus musculus
tggtatcccagacaggagccataaa

SEQ ID NO: 893162 - DNA, 25 bp, Mus musculus
tggtatcccagagaggagccataaa

SEQ ID NO: 893163 - DNA, 25 bp, Mus musculus
tggtatcccattccattgttgaagg

SEQ ID NO: 893164 - DNA, 25 bp, Mus musculus
tggtatcccattcgcaggctgacat

SEQ ID NO: 893165 - DNA, 25 bp, Mus musculus
tggtatcccattgcattgttgaagg

SEQ ID NO: 893166 - DNA, 25 bp, Mus musculus
tggtatcccattggcaggctgacat

SEQ ID NO: 893167 - DNA, 25 bp, Mus musculus
tggtatccctgcatctggagctgaa

SEQ ID NO: 893168 - DNA, 25 bp, Mus musculus
tggtatccctgcttctggagctgaa

SEQ ID NO: 893169 - DNA, 25 bp, Mus musculus
tggtatccgtatactcttctgagca

SEQ ID NO: 893170 - DNA, 25 bp, Mus musculus
tggtatccgtattctcttctgagca

SEQ ID NO: 893171 - DNA, 25 bp, Mus musculus
tggtatcctactcagcatttgcgcc

SEQ ID NO: 893172 - DNA, 25 bp, Mus musculus
tggtatcctactgagcatttgcgcc

SEQ ID NO: 893173 - DNA, 25 bp, Mus musculus
tggtatcctttgattgacgttcctc

SEQ ID NO: 893174 - DNA, 25 bp, Mus musculus
tggtatcctttgtttgacgttcctc

SEQ ID NO: 893175 - DNA, 25 bp, Mus musculus
tggtatctaggacccaggacttcca

SEQ ID NO: 893176 - DNA, 25 bp, Mus musculus
tggtatctaggagccaggacttcca

SEQ ID NO: 893177 - DNA, 25 bp, Mus musculus
tggtatctcattattacttggcccc

SEQ ID NO: 893178 - DNA, 25 bp, Mus musculus
tggtatctcatttttacttggcccc

SEQ ID NO: 893179 - DNA, 25 bp, Mus musculus
tggtatctccacatgtattctctgt

SEQ ID NO: 893180 - DNA, 25 bp, Mus musculus
tggtatctccacttgtattctctgt

SEQ ID NO: 893181 - DNA, 25 bp, Mus musculus
tggtatctgcatctcctgtgtggta

SEQ ID NO: 893182 - DNA, 25 bp, Mus musculus
tggtatctgcatgtcctgtgtggta

SEQ ID NO: 893183 - DNA, 25 bp, Mus musculus
tggtatctgccactttccaactgac

SEQ ID NO: 893184 - DNA, 25 bp, Mus musculus
tggtatctgccagtttccaactgac

SEQ ID NO: 893185 - DNA, 25 bp, Mus musculus
tggtatcttcacaaaatcggcgcgc

SEQ ID NO: 893186 - DNA, 25 bp, Mus musculus
tggtatcttcactaaatcggcgcgc

SEQ ID NO: 893187 - DNA, 25 bp, Mus musculus
tggtatcttccactcaatctatatt

SEQ ID NO: 893188 - DNA, 25 bp, Mus musculus
tggtatcttccagtcaatctatatt

SEQ ID NO: 893189 - DNA, 25 bp, Mus musculus
tggtatctttctcaagtcaccagaa

SEQ ID NO: 893190 - DNA, 25 bp, Mus musculus
tggtatctttctgaagtcaccagaa

SEQ ID NO: 893191 - DNA, 25 bp, Mus musculus
tggtatgaacccacaaactggagat

SEQ ID NO: 893192 - DNA, 25 bp, Mus musculus
tggtatgaaccctcaaactggagat

SEQ ID NO: 893193 - DNA, 25 bp, Mus musculus
tggtatgacattatcaggcaggctt

SEQ ID NO: 893194 - DNA, 25 bp, Mus musculus
tggtatgacattttcaggcaggctt

SEQ ID NO: 893195 - DNA, 25 bp, Mus musculus
tggtatgagagcacgggacctttcc

SEQ ID NO: 893196 - DNA, 25 bp, Mus musculus
tggtatgagagctcgggacctttcc

SEQ ID NO: 893197 - DNA, 25 bp, Mus musculus
tggtatgcacacagcttttgggaat

SEQ ID NO: 893198 - DNA, 25 bp, Mus musculus
tggtatgcacactgcttttgggaat

SEQ ID NO: 893199 - DNA, 25 bp, Mus musculus
tggtatgctattctaacatatctgt

SEQ ID NO: 893200 - DNA, 25 bp, Mus musculus
tggtatgctattgtaacatatctgt

SEQ ID NO: 893201 - DNA, 25 bp, Mus musculus
tggtatgctgcaacatgagccatgg

SEQ ID NO: 893202 - DNA, 25 bp, Mus musculus
tggtatgctgcatcatgagccatgg

SEQ ID NO: 893203 - DNA, 25 bp, Mus musculus
tggtatggaatgacctcacctgcat

SEQ ID NO: 893204 - DNA, 25 bp, Mus musculus
tggtatggaatgtcctcacctgcat

SEQ ID NO: 893205 - DNA, 25 bp, Mus musculus
tggtatggacagactcagaccagct

SEQ ID NO: 893206 - DNA, 25 bp, Mus musculus
tggtatggacagtctcagaccagct

SEQ ID NO: 893207 - DNA, 25 bp, Mus musculus
tggtatggattgattcgcgacgcac

SEQ ID NO: 893208 - DNA, 25 bp, Mus musculus
tggtatggattgtttcgcgacgcac

SEQ ID NO: 893209 - DNA, 25 bp, Mus musculus
tggtatggcaatataactgtgaaac

SEQ ID NO: 893210 - DNA, 25 bp, Mus musculus
tggtatggcaatttaactgtgaaac

SEQ ID NO: 893211 - DNA, 25 bp, Mus musculus
tggtatggccctagtagcatctcag

SEQ ID NO: 893212 - DNA, 25 bp, Mus musculus
tggtatggcccttgtagcatctcag

SEQ ID NO: 893213 - DNA, 25 bp, Mus musculus
tggtatggtcatacccaccattgtt

SEQ ID NO: 893214 - DNA, 25 bp, Mus musculus
tggtatggtcattcccaccattgtt

SEQ ID NO: 893215 - DNA, 25 bp, Mus musculus
tggtatgtaactaccttcctggtgg

SEQ ID NO: 893216 - DNA, 25 bp, Mus musculus
tggtatgtaacttccttcctggtgg

SEQ ID NO: 893217 - DNA, 25 bp, Mus musculus
tggtatgtccaacccacttgtgcta

SEQ ID NO: 893218 - DNA, 25 bp, Mus musculus
tggtatgtccaagccacttgtgcta

SEQ ID NO: 893219 - DNA, 25 bp, Mus musculus
tggtatgtgcacaatctcaatgaat

SEQ ID NO: 893220 - DNA, 25 bp, Mus musculus
tggtatgtgcactatctcaatgaat

SEQ ID NO: 893221 - DNA, 25 bp, Mus musculus
tggtatgtggaacacaccccagggt

SEQ ID NO: 893222 - DNA, 25 bp, Mus musculus
tggtatgtggaagacaccccagggt

SEQ ID NO: 893223 - DNA, 25 bp, Mus musculus
tggtatgttcttcggtcagacatgt

SEQ ID NO: 893224 - DNA, 25 bp, Mus musculus
tggtatgttcttgggtcagacatgt

SEQ ID NO: 893225 - DNA, 25 bp, Mus musculus
tggtatgtttttaaaacttcagatt

SEQ ID NO: 893226 - DNA, 25 bp, Mus musculus
tggtatgttttttaaacttcagatt

SEQ ID NO: 893227 - DNA, 25 bp, Mus musculus
tggtattacagaactgcgccgtcat

SEQ ID NO: 893228 - DNA, 25 bp, Mus musculus
tggtattacagatctgcgccgtcat

SEQ ID NO: 893229 - DNA, 25 bp, Mus musculus
tggtattagcagaggttacaacaat

SEQ ID NO: 893230 - DNA, 25 bp, Mus musculus
tggtattagcagtggttacaacaat

SEQ ID NO: 893231 - DNA, 25 bp, Mus musculus
tggtattaggttagccttgttttgt

SEQ ID NO: 893232 - DNA, 25 bp, Mus musculus
tggtattaggtttgccttgttttgt

SEQ ID NO: 893233 - DNA, 25 bp, Mus musculus
tggtattataggactgtcgccacac

SEQ ID NO: 893234 - DNA, 25 bp, Mus musculus
tggtattataggtctgtcgccacac

SEQ ID NO: 893235 - DNA, 25 bp, Mus musculus
tggtattcatccaactgtcatttga

SEQ ID NO: 893236 - DNA, 25 bp, Mus musculus
tggtattcatcctactgtcatttga

SEQ ID NO: 893237 - DNA, 25 bp, Mus musculus
tggtattcattccagatgacagaat

SEQ ID NO: 893238 - DNA, 25 bp, Mus musculus
tggtattcattcgagatgacagaat

SEQ ID NO: 893239 - DNA, 25 bp, Mus musculus
tggtattccaggaatcatggcccaa

SEQ ID NO: 893240 - DNA, 25 bp, Mus musculus
tggtattccaggtatcatggcccaa

SEQ ID NO: 893241 - DNA, 25 bp, Mus musculus
tggtattccatgctgccacaatgaa

SEQ ID NO: 893242 - DNA, 25 bp, Mus musculus
tggtattccatggtgccacaatgaa

SEQ ID NO: 893243 - DNA, 25 bp, Mus musculus
tggtattcccgtcgatttcatttca

SEQ ID NO: 893244 - DNA, 25 bp, Mus musculus
tggtattcccgtggatttcatttca

SEQ ID NO: 893245 - DNA, 25 bp, Mus musculus
tggtattcctcaagcacccaattat

SEQ ID NO: 893246 - DNA, 25 bp, Mus musculus
tggtattcctcatgcacccaattat

SEQ ID NO: 893247 - DNA, 25 bp, Mus musculus
tggtattctatacacactgttttat

SEQ ID NO: 893248 - DNA, 25 bp, Mus musculus
tggtattctatagacactgttttat

SEQ ID NO: 893249 - DNA, 25 bp, Mus musculus
tggtattctcacacccatgttgaat

SEQ ID NO: 893250 - DNA, 25 bp, Mus musculus
tggtattctcactcccatgttgaat

SEQ ID NO: 893251 - DNA, 25 bp, Mus musculus
tggtattctcagcatcatcagttat

SEQ ID NO: 893252 - DNA, 25 bp, Mus musculus
tggtattctcaggatcatcagttat

SEQ ID NO: 893253 - DNA, 25 bp, Mus musculus
tggtattctctgcttgcaaatcaaa

SEQ ID NO: 893254 - DNA, 25 bp, Mus musculus
tggtattctctggttgcaaatcaaa

SEQ ID NO: 893255 - DNA, 25 bp, Mus musculus
tggtattctggactccttccaagga

SEQ ID NO: 893256 - DNA, 25 bp, Mus musculus
tggtattctggagtccttccaagga

SEQ ID NO: 893257 - DNA, 25 bp, Mus musculus
tggtattcttcacccacacgttaaa

SEQ ID NO: 893258 - DNA, 25 bp, Mus musculus
tggtattcttcagccacacgttaaa

SEQ ID NO: 893259 - DNA, 25 bp, Mus musculus
tggtattgaaccagccatgtgctaa

SEQ ID NO: 893260 - DNA, 25 bp, Mus musculus
tggtattgaacctgccatgtgctaa

SEQ ID NO: 893261 - DNA, 25 bp, Mus musculus
tggtattgagtgactccctcagtca

SEQ ID NO: 893262 - DNA, 25 bp, Mus musculus
tggtattgagtgtctccctcagtca

SEQ ID NO: 893263 - DNA, 25 bp, Mus musculus
tggtattgccacacggaggctggca

SEQ ID NO: 893264 - DNA, 25 bp, Mus musculus
tggtattgccactcggaggctggca

SEQ ID NO: 893265 - DNA, 25 bp, Mus musculus
tggtattgcggtatgccatggaagt

SEQ ID NO: 893266 - DNA, 25 bp, Mus musculus
tggtattgcggtttgccatggaagt

SEQ ID NO: 893267 - DNA, 25 bp, Mus musculus
tggtattggtaaagtgagccactac

SEQ ID NO: 893268 - DNA, 25 bp, Mus musculus
tggtattggtaatgtgagccactac

SEQ ID NO: 893269 - DNA, 25 bp, Mus musculus
tggtattggtacaccatgcccaggt

SEQ ID NO: 893270 - DNA, 25 bp, Mus musculus
tggtattggtactccatgcccaggt

SEQ ID NO: 893271 - DNA, 25 bp, Mus musculus
tggtattggtgaaggccctctttct

SEQ ID NO: 893272 - DNA, 25 bp, Mus musculus
tggtattggtgatggccctctttct

SEQ ID NO: 893273 - DNA, 25 bp, Mus musculus
tggtattgtaacatccctttcgagt

SEQ ID NO: 893274 - DNA, 25 bp, Mus musculus
tggtattgtaacttccctttcgagt

SEQ ID NO: 893275 - DNA, 25 bp, Mus musculus
tggtattgtagcaccagctgctatg

SEQ ID NO: 893276 - DNA, 25 bp, Mus musculus
tggtattgtagctccagctgctatg

SEQ ID NO: 893277 - DNA, 25 bp, Mus musculus
tggtattgtattccccagtgcacac

SEQ ID NO: 893278 - DNA, 25 bp, Mus musculus
tggtattgtattgcccagtgcacac

SEQ ID NO: 893279 - DNA, 25 bp, Mus musculus
tggtatttatatcccgaaagggtca

SEQ ID NO: 893280 - DNA, 25 bp, Mus musculus
tggtatttatatgccgaaagggtca

SEQ ID NO: 893281 - DNA, 25 bp, Mus musculus
tggtatttatccactatgtttgata

SEQ ID NO: 893282 - DNA, 25 bp, Mus musculus
tggtatttatcctctatgtttgata

SEQ ID NO: 893283 - DNA, 25 bp, Mus musculus
tggtatttcataaagcagcaagctc

SEQ ID NO: 893284 - DNA, 25 bp, Mus musculus
tggtatttcatatagcagcaagctc

SEQ ID NO: 893285 - DNA, 25 bp, Mus musculus
tggtatttcgagcaacccatggttt

SEQ ID NO: 893286 - DNA, 25 bp, Mus musculus
tggtatttcgaggaacccatggttt

SEQ ID NO: 893287 - DNA, 25 bp, Mus musculus
tggtatttctaccttagtactactt

SEQ ID NO: 893288 - DNA, 25 bp, Mus musculus
tggtatttctacgttagtactactt

SEQ ID NO: 893289 - DNA, 25 bp, Mus musculus
tggtatttctcaattaatgtgccct

SEQ ID NO: 893290 - DNA, 25 bp, Mus musculus
tggtatttctcaattctgtcttgca

SEQ ID NO: 893291 - DNA, 25 bp, Mus musculus
tggtatttctcatttaatgtgccct

SEQ ID NO: 893292 - DNA, 25 bp, Mus musculus
tggtatttctcatttctgtcttgca

SEQ ID NO: 893293 - DNA, 25 bp, Mus musculus
tggtatttgaacagggtctcgggaa

SEQ ID NO: 893294 - DNA, 25 bp, Mus musculus
tggtatttgaactgggtctcgggaa

SEQ ID NO: 893295 - DNA, 25 bp, Mus musculus
tggtatttgagacccattatttcaa

SEQ ID NO: 893296 - DNA, 25 bp, Mus musculus
tggtatttgagagccattatttcaa

SEQ ID NO: 893297 - DNA, 25 bp, Mus musculus
tggtatttgatgcacagctcgcctt

SEQ ID NO: 893298 - DNA, 25 bp, Mus musculus
tggtatttgatggacagctcgcctt

SEQ ID NO: 893299 - DNA, 25 bp, Mus musculus
tggtattttcatcctgggtttttca

SEQ ID NO: 893300 - DNA, 25 bp, Mus musculus
tggtattttcatgctgggtttttca

SEQ ID NO: 893301 - DNA, 25 bp, Mus musculus
tggtattttccactgagtattttca

SEQ ID NO: 893302 - DNA, 25 bp, Mus musculus
tggtattttccagtgagtattttca

SEQ ID NO: 893303 - DNA, 25 bp, Mus musculus
tggtattttctgaacattaaggata

SEQ ID NO: 893304 - DNA, 25 bp, Mus musculus
tggtattttctgtacattaaggata

SEQ ID NO: 893305 - DNA, 25 bp, Mus musculus
tggtattttgatcgtacatagtggg

SEQ ID NO: 893306 - DNA, 25 bp, Mus musculus
tggtattttgatggtacatagtggg

SEQ ID NO: 893307 - DNA, 25 bp, Mus musculus
tggtattttgtcctcccatctacag

SEQ ID NO: 893308 - DNA, 25 bp, Mus musculus
tggtattttgtcgtcccatctacag

SEQ ID NO: 893309 - DNA, 25 bp, Mus musculus
tggtcaaaacacacgtaaatcattt

SEQ ID NO: 893310 - DNA, 25 bp, Mus musculus
tggtcaaaacactcgtaaatcattt

SEQ ID NO: 893311 - DNA, 25 bp, Mus musculus
tggtcaaaatcaccgtctacggcac

SEQ ID NO: 893312 - DNA, 25 bp, Mus musculus
tggtcaaaatcagcgtctacggcac

SEQ ID NO: 893313 - DNA, 25 bp, Mus musculus
tggtcaaacaacatggctggccgca

SEQ ID NO: 893314 - DNA, 25 bp, Mus musculus
tggtcaaacaacattttctttctct

SEQ ID NO: 893315 - DNA, 25 bp, Mus musculus
tggtcaaacaacttggctggccgca

SEQ ID NO: 893316 - DNA, 25 bp, Mus musculus
tggtcaaacaactttttctttctct

SEQ ID NO: 893317 - DNA, 25 bp, Mus musculus
tggtcaaacactcccaacagtgtct

SEQ ID NO: 893318 - DNA, 25 bp, Mus musculus
tggtcaaacactgccaacagtgtct

SEQ ID NO: 893319 - DNA, 25 bp, Mus musculus
tggtcaaacggaaaccgccatcctt

SEQ ID NO: 893320 - DNA, 25 bp, Mus musculus
tggtcaaacggataccgccatcctt

SEQ ID NO: 893321 - DNA, 25 bp, Mus musculus
tggtcaaactccactgtaacagtct

SEQ ID NO: 893322 - DNA, 25 bp, Mus musculus
tggtcaaactcctctgtaacagtct

SEQ ID NO: 893323 - DNA, 25 bp, Mus musculus
tggtcaaactgccaccggaggagat

SEQ ID NO: 893324 - DNA, 25 bp, Mus musculus
tggtcaaactgcgaccggaggagat

SEQ ID NO: 893325 - DNA, 25 bp, Mus musculus
tggtcaaagcttctagcccagcatc

SEQ ID NO: 893326 - DNA, 25 bp, Mus musculus
tggtcaaagcttgtagcccagcatc

SEQ ID NO: 893327 - DNA, 25 bp, Mus musculus
tggtcaaatggtacagctccgctga

SEQ ID NO: 893328 - DNA, 25 bp, Mus musculus
tggtcaaatggttcagctccgctga

SEQ ID NO: 893329 - DNA, 25 bp, Mus musculus
tggtcaacaggaaggcccagcagct

SEQ ID NO: 893330 - DNA, 25 bp, Mus musculus
tggtcaacaggatggcccagcagct

SEQ ID NO: 893331 - DNA, 25 bp, Mus musculus
tggtcaacaggtacctatgcatctg

SEQ ID NO: 893332 - DNA, 25 bp, Mus musculus
tggtcaacaggttcctatgcatctg

SEQ ID NO: 893333 - DNA, 25 bp, Mus musculus
tggtcaaccagtcggcgctcaggaa

SEQ ID NO: 893334 - DNA, 25 bp, Mus musculus
tggtcaaccagtgggcgctcaggaa

SEQ ID NO: 893335 - DNA, 25 bp, Mus musculus
tggtcaacccctagttcctggaaag

SEQ ID NO: 893336 - DNA, 25 bp, Mus musculus
tggtcaaccccttgttcctggaaag

SEQ ID NO: 893337 - DNA, 25 bp, Mus musculus
tggtcaaccctcctgaacaggcaga

SEQ ID NO: 893338 - DNA, 25 bp, Mus musculus
tggtcaaccctcgtgaacaggcaga

SEQ ID NO: 893339 - DNA, 25 bp, Mus musculus
tggtcaacctctcggtactcactat

SEQ ID NO: 893340 - DNA, 25 bp, Mus musculus
tggtcaacctctgggtactcactat

SEQ ID NO: 893341 - DNA, 25 bp, Mus musculus
tggtcaacctggcttttgccaccct

SEQ ID NO: 893342 - DNA, 25 bp, Mus musculus
tggtcaacctgggttttgccaccct

SEQ ID NO: 893343 - DNA, 25 bp, Mus musculus
tggtcaacgcatctcggcagcagtc

SEQ ID NO: 893344 - DNA, 25 bp, Mus musculus
tggtcaacgcatgtcggcagcagtc

SEQ ID NO: 893345 - DNA, 25 bp, Mus musculus
tggtcaacgcgcagcctaagatact

SEQ ID NO: 893346 - DNA, 25 bp, Mus musculus
tggtcaacgcgctgcctaagatact

SEQ ID NO: 893347 - DNA, 25 bp, Mus musculus
tggtcaactaggaaatcggttcttc

SEQ ID NO: 893348 - DNA, 25 bp, Mus musculus
tggtcaactaggtaatcggttcttc

SEQ ID NO: 893349 - DNA, 25 bp, Mus musculus
tggtcaactcacctataagtcccag

SEQ ID NO: 893350 - DNA, 25 bp, Mus musculus
tggtcaactcacgtataagtcccag

SEQ ID NO: 893351 - DNA, 25 bp, Mus musculus
tggtcaactccaaaggcctcagaaa

SEQ ID NO: 893352 - DNA, 25 bp, Mus musculus
tggtcaactccataggcctcagaaa

SEQ ID NO: 893353 - DNA, 25 bp, Mus musculus
tggtcaactcctacccaaggaaatc

SEQ ID NO: 893354 - DNA, 25 bp, Mus musculus
tggtcaactccttcccaaggaaatc

SEQ ID NO: 893355 - DNA, 25 bp, Mus musculus
tggtcaactctcagctggactgaag

SEQ ID NO: 893356 - DNA, 25 bp, Mus musculus
tggtcaactctctgctggactgaag

SEQ ID NO: 893357 - DNA, 25 bp, Mus musculus
tggtcaactgctattctgcaactac

SEQ ID NO: 893358 - DNA, 25 bp, Mus musculus
tggtcaactgcttttctgcaactac

SEQ ID NO: 893359 - DNA, 25 bp, Mus musculus
tggtcaagacacctatctggaaagc

SEQ ID NO: 893360 - DNA, 25 bp, Mus musculus
tggtcaagacacgtatctggaaagc

SEQ ID NO: 893361 - DNA, 25 bp, Mus musculus
tggtcaagaggtacctgacctcctt

SEQ ID NO: 893362 - DNA, 25 bp, Mus musculus
tggtcaagaggttcctgacctcctt

SEQ ID NO: 893363 - DNA, 25 bp, Mus musculus
tggtcaagcaggacggctccactat

SEQ ID NO: 893364 - DNA, 25 bp, Mus musculus
tggtcaagcaggtcggctccactat

SEQ ID NO: 893365 - DNA, 25 bp, Mus musculus
tggtcaagcatgactagtagcagca

SEQ ID NO: 893366 - DNA, 25 bp, Mus musculus
tggtcaagcatgtctagtagcagca

SEQ ID NO: 893367 - DNA, 25 bp, Mus musculus
tggtcaagcattctggtccgcagtt

SEQ ID NO: 893368 - DNA, 25 bp, Mus musculus
tggtcaagcattgtggtccgcagtt

SEQ ID NO: 893369 - DNA, 25 bp, Mus musculus
tggtcaagcgttcctccaggctcct

SEQ ID NO: 893370 - DNA, 25 bp, Mus musculus
tggtcaagcgttgctccaggctcct

SEQ ID NO: 893371 - DNA, 25 bp, Mus musculus
tggtcaaggcgtactgcgccaagca

SEQ ID NO: 893372 - DNA, 25 bp, Mus musculus
tggtcaaggcgttctgcgccaagca

SEQ ID NO: 893373 - DNA, 25 bp, Mus musculus
tggtcaaggttgactcagctcccaa

SEQ ID NO: 893374 - DNA, 25 bp, Mus musculus
tggtcaaggttgtctcagctcccaa

SEQ ID NO: 893375 - DNA, 25 bp, Mus musculus
tggtcaagtactccaccttaggtgt

SEQ ID NO: 893376 - DNA, 25 bp, Mus musculus
tggtcaagtactgcaccttaggtgt

SEQ ID NO: 893377 - DNA, 25 bp, Mus musculus
tggtcaagtcccagaatgttagcat

SEQ ID NO: 893378 - DNA, 25 bp, Mus musculus
tggtcaagtccctgaatgttagcat

SEQ ID NO: 893379 - DNA, 25 bp, Mus musculus
tggtcaagtgacatggtccccattc

SEQ ID NO: 893380 - DNA, 25 bp, Mus musculus
tggtcaagtgacttggtccccattc

SEQ ID NO: 893381 - DNA, 25 bp, Mus musculus
tggtcaatacacactgtaggtcatg

SEQ ID NO: 893382 - DNA, 25 bp, Mus musculus
tggtcaatacactctgtaggtcatg

SEQ ID NO: 893383 - DNA, 25 bp, Mus musculus
tggtcaatacctcatgggacagcgt

SEQ ID NO: 893384 - DNA, 25 bp, Mus musculus
tggtcaatacctgatgggacagcgt

SEQ ID NO: 893385 - DNA, 25 bp, Mus musculus
tggtcaatacgacccttttcaaggc

SEQ ID NO: 893386 - DNA, 25 bp, Mus musculus
tggtcaatacgagccttttcaaggc

SEQ ID NO: 893387 - DNA, 25 bp, Mus musculus
tggtcaatattgaggtagtcgctaa

SEQ ID NO: 893388 - DNA, 25 bp, Mus musculus
tggtcaatattgtggtagtcgctaa

SEQ ID NO: 893389 - DNA, 25 bp, Mus musculus
tggtcaatcacacaccagtcctctt

SEQ ID NO: 893390 - DNA, 25 bp, Mus musculus
tggtcaatcacacagcagagctatg

SEQ ID NO: 893391 - DNA, 25 bp, Mus musculus
tggtcaatcacactcaacatctata

SEQ ID NO: 893392 - DNA, 25 bp, Mus musculus
tggtcaatcacagaccagtcctctt

SEQ ID NO: 893393 - DNA, 25 bp, Mus musculus
tggtcaatcacagagcagagctatg

SEQ ID NO: 893394 - DNA, 25 bp, Mus musculus
tggtcaatcacagtcaacatctata

SEQ ID NO: 893395 - DNA, 25 bp, Mus musculus
tggtcaatcattcagcatagccttg

SEQ ID NO: 893396 - DNA, 25 bp, Mus musculus
tggtcaatcattgagcatagccttg

SEQ ID NO: 893397 - DNA, 25 bp, Mus musculus
tggtcaatgccactctgcaattttc

SEQ ID NO: 893398 - DNA, 25 bp, Mus musculus
tggtcaatgccagtctgcaattttc

SEQ ID NO: 893399 - DNA, 25 bp, Mus musculus
tggtcaatggccagtccctcgaagg

SEQ ID NO: 893400 - DNA, 25 bp, Mus musculus
tggtcaatggcctgtccctcgaagg

SEQ ID NO: 893401 - DNA, 25 bp, Mus musculus
tggtcaattaacactccccattcat

SEQ ID NO: 893402 - DNA, 25 bp, Mus musculus
tggtcaattaactctccccattcat

SEQ ID NO: 893403 - DNA, 25 bp, Mus musculus
tggtcaattttgattttgtcttatt

SEQ ID NO: 893404 - DNA, 25 bp, Mus musculus
tggtcaattttgtttttgtcttatt

SEQ ID NO: 893405 - DNA, 25 bp, Mus musculus
tggtcacaaaagacaggaaaactag

SEQ ID NO: 893406 - DNA, 25 bp, Mus musculus
tggtcacaaaagtcaggaaaactag

SEQ ID NO: 893407 - DNA, 25 bp, Mus musculus
tggtcacacatacacaagggactgt

SEQ ID NO: 893408 - DNA, 25 bp, Mus musculus
tggtcacacatagacaagggactgt

SEQ ID NO: 893409 - DNA, 25 bp, Mus musculus
tggtcacactgacagctagtacgtt

SEQ ID NO: 893410 - DNA, 25 bp, Mus musculus
tggtcacactgaccccgcatgagga

SEQ ID NO: 893411 - DNA, 25 bp, Mus musculus
tggtcacactgagagctagtacgtt

SEQ ID NO: 893412 - DNA, 25 bp, Mus musculus
tggtcacactgagcccgcatgagga

SEQ ID NO: 893413 - DNA, 25 bp, Mus musculus
tggtcacagacaagacagcctatgt

SEQ ID NO: 893414 - DNA, 25 bp, Mus musculus
tggtcacagacatgacagcctatgt

SEQ ID NO: 893415 - DNA, 25 bp, Mus musculus
tggtcacagctgacgacttccttgt

SEQ ID NO: 893416 - DNA, 25 bp, Mus musculus
tggtcacagctgtcgacttccttgt

SEQ ID NO: 893417 - DNA, 25 bp, Mus musculus
tggtcacagtgcctcggtccttgcc

SEQ ID NO: 893418 - DNA, 25 bp, Mus musculus
tggtcacagtgcgtcggtccttgcc

SEQ ID NO: 893419 - DNA, 25 bp, Mus musculus
tggtcacagtttatctttggctcat

SEQ ID NO: 893420 - DNA, 25 bp, Mus musculus
tggtcacagtttttctttggctcat

SEQ ID NO: 893421 - DNA, 25 bp, Mus musculus
tggtcacatcacctacagtactcgg

SEQ ID NO: 893422 - DNA, 25 bp, Mus musculus
tggtcacatcacgtacagtactcgg

SEQ ID NO: 893423 - DNA, 25 bp, Mus musculus
tggtcacatgctatgctcagtgcaa

SEQ ID NO: 893424 - DNA, 25 bp, Mus musculus
tggtcacatgctttgctcagtgcaa

SEQ ID NO: 893425 - DNA, 25 bp, Mus musculus
tggtcacattataccgttcacattg

SEQ ID NO: 893426 - DNA, 25 bp, Mus musculus
tggtcacattattccgttcacattg

SEQ ID NO: 893427 - DNA, 25 bp, Mus musculus
tggtcaccaagacgactgaggacac

SEQ ID NO: 893428 - DNA, 25 bp, Mus musculus
tggtcaccaagaggactgaggacac

SEQ ID NO: 893429 - DNA, 25 bp, Mus musculus
tggtcaccacttctagcaagacagt

SEQ ID NO: 893430 - DNA, 25 bp, Mus musculus
tggtcaccacttgtagcaagacagt

SEQ ID NO: 893431 - DNA, 25 bp, Mus musculus
tggtcaccagaaagtgtccctgtta

SEQ ID NO: 893432 - DNA, 25 bp, Mus musculus
tggtcaccagaatgtgtccctgtta

SEQ ID NO: 893433 - DNA, 25 bp, Mus musculus
tggtcaccaggcacaaacgttatac

SEQ ID NO: 893434 - DNA, 25 bp, Mus musculus
tggtcaccaggctcaaacgttatac

SEQ ID NO: 893435 - DNA, 25 bp, Mus musculus
tggtcaccagggctgccatttgcag

SEQ ID NO: 893436 - DNA, 25 bp, Mus musculus
tggtcaccaggggtgccatttgcag

SEQ ID NO: 893437 - DNA, 25 bp, Mus musculus
tggtcaccatctcctatgctggaaa

SEQ ID NO: 893438 - DNA, 25 bp, Mus musculus
tggtcaccatctgctatgctggaaa

SEQ ID NO: 893439 - DNA, 25 bp, Mus musculus
tggtcaccattcctctttcatataa

SEQ ID NO: 893440 - DNA, 25 bp, Mus musculus
tggtcaccattcgtctttcatataa

SEQ ID NO: 893441 - DNA, 25 bp, Mus musculus
tggtcaccatttatagtgcgcccaa

SEQ ID NO: 893442 - DNA, 25 bp, Mus musculus
tggtcaccatttatgtctcagcttt

SEQ ID NO: 893443 - DNA, 25 bp, Mus musculus
tggtcaccatttctgtgcgtgcaca

SEQ ID NO: 893444 - DNA, 25 bp, Mus musculus
tggtcaccatttgtgtgcgtgcaca

SEQ ID NO: 893445 - DNA, 25 bp, Mus musculus
tggtcaccatttttagtgcgcccaa

SEQ ID NO: 893446 - DNA, 25 bp, Mus musculus
tggtcaccatttttgtctcagcttt

SEQ ID NO: 893447 - DNA, 25 bp, Mus musculus
tggtcaccccttcatgtggaacgag

SEQ ID NO: 893448 - DNA, 25 bp, Mus musculus
tggtcaccccttgatgtggaacgag

SEQ ID NO: 893449 - DNA, 25 bp, Mus musculus
tggtcacccggcagcggtatggaaa

SEQ ID NO: 893450 - DNA, 25 bp, Mus musculus
tggtcacccggctgcggtatggaaa

SEQ ID NO: 893451 - DNA, 25 bp, Mus musculus
tggtcacccggtatctgcatgcaag

SEQ ID NO: 893452 - DNA, 25 bp, Mus musculus
tggtcacccggtttctgcatgcaag

SEQ ID NO: 893453 - DNA, 25 bp, Mus musculus
tggtcaccctcaacattgtgctaaa

SEQ ID NO: 893454 - DNA, 25 bp, Mus musculus
tggtcaccctcatcattgtgctaaa

SEQ ID NO: 893455 - DNA, 25 bp, Mus musculus
tggtcaccgtccctttgctgagttt

SEQ ID NO: 893456 - DNA, 25 bp, Mus musculus
tggtcaccgtccgtttgctgagttt

SEQ ID NO: 893457 - DNA, 25 bp, Mus musculus
tggtcacctatgatcctttaggttt

SEQ ID NO: 893458 - DNA, 25 bp, Mus musculus
tggtcacctatgttcctttaggttt

SEQ ID NO: 893459 - DNA, 25 bp, Mus musculus
tggtcacctctgagctttgaaggtt

SEQ ID NO: 893460 - DNA, 25 bp, Mus musculus
tggtcacctctgtgctttgaaggtt

SEQ ID NO: 893461 - DNA, 25 bp, Mus musculus
tggtcacctgccacaagtggacagt

SEQ ID NO: 893462 - DNA, 25 bp, Mus musculus
tggtcacctgcccttcagaatgtag

SEQ ID NO: 893463 - DNA, 25 bp, Mus musculus
tggtcacctgccgttcagaatgtag

SEQ ID NO: 893464 - DNA, 25 bp, Mus musculus
tggtcacctgcctcaagtggacagt

SEQ ID NO: 893465 - DNA, 25 bp, Mus musculus
tggtcacctgtgcatctggtttatg

SEQ ID NO: 893466 - DNA, 25 bp, Mus musculus
tggtcacctgtggatctggtttatg

SEQ ID NO: 893467 - DNA, 25 bp, Mus musculus
tggtcaccttggactgagctagcca

SEQ ID NO: 893468 - DNA, 25 bp, Mus musculus
tggtcaccttggtctgagctagcca

SEQ ID NO: 893469 - DNA, 25 bp, Mus musculus
tggtcaccttgtcgccaacaaccaa

SEQ ID NO: 893470 - DNA, 25 bp, Mus musculus
tggtcaccttgtggccaacaaccaa

SEQ ID NO: 893471 - DNA, 25 bp, Mus musculus
tggtcacgagggaatggcatatcac

SEQ ID NO: 893472 - DNA, 25 bp, Mus musculus
tggtcacgagggtatggcatatcac

SEQ ID NO: 893473 - DNA, 25 bp, Mus musculus
tggtcacggtcaacactgtacctga

SEQ ID NO: 893474 - DNA, 25 bp, Mus musculus
tggtcacggtcatcactgtacctga

SEQ ID NO: 893475 - DNA, 25 bp, Mus musculus
tggtcacggtgtcatactctctcta

SEQ ID NO: 893476 - DNA, 25 bp, Mus musculus
tggtcacggtgtgatactctctcta

SEQ ID NO: 893477 - DNA, 25 bp, Mus musculus
tggtcacgtaaccacaccaccaggg

SEQ ID NO: 893478 - DNA, 25 bp, Mus musculus
tggtcacgtaacgacaccaccaggg

SEQ ID NO: 893479 - DNA, 25 bp, Mus musculus
tggtcacgtcatcgacaattccaat

SEQ ID NO: 893480 - DNA, 25 bp, Mus musculus
tggtcacgtcatggacaattccaat

SEQ ID NO: 893481 - DNA, 25 bp, Mus musculus
tggtcacgtgtgatcaatgggagct

SEQ ID NO: 893482 - DNA, 25 bp, Mus musculus
tggtcacgtgtgttcaatgggagct

SEQ ID NO: 893483 - DNA, 25 bp, Mus musculus
tggtcacgttgaacatgtggttcat

SEQ ID NO: 893484 - DNA, 25 bp, Mus musculus
tggtcacgttgatcatgtggttcat

SEQ ID NO: 893485 - DNA, 25 bp, Mus musculus
tggtcactacaaattcaggccgaaa

SEQ ID NO: 893486 - DNA, 25 bp, Mus musculus
tggtcactacaatttcaggccgaaa

SEQ ID NO: 893487 - DNA, 25 bp, Mus musculus
tggtcactacctcgttgcagctaca

SEQ ID NO: 893488 - DNA, 25 bp, Mus musculus
tggtcactacctggttgcagctaca

SEQ ID NO: 893489 - DNA, 25 bp, Mus musculus
tggtcactagtacctccacagactc

SEQ ID NO: 893490 - DNA, 25 bp, Mus musculus
tggtcactagtagctccacagactc

SEQ ID NO: 893491 - DNA, 25 bp, Mus musculus
tggtcactcaagatccattcgtagg

SEQ ID NO: 893492 - DNA, 25 bp, Mus musculus
tggtcactcaagttccattcgtagg

SEQ ID NO: 893493 - DNA, 25 bp, Mus musculus
tggtcactcatgaaacctggccaag

SEQ ID NO: 893494 - DNA, 25 bp, Mus musculus
tggtcactcatgtaacctggccaag

SEQ ID NO: 893495 - DNA, 25 bp, Mus musculus
tggtcactctctcggaacatggcaa

SEQ ID NO: 893496 - DNA, 25 bp, Mus musculus
tggtcactctctgggaacatggcaa

SEQ ID NO: 893497 - DNA, 25 bp, Mus musculus
tggtcactctttccaaggcacactt

SEQ ID NO: 893498 - DNA, 25 bp, Mus musculus
tggtcactctttgcaaggcacactt

SEQ ID NO: 893499 - DNA, 25 bp, Mus musculus
tggtcactgcacacatcacaagagg

SEQ ID NO: 893500 - DNA, 25 bp, Mus musculus
tggtcactgcactcatcacaagagg

SEQ ID NO: 893501 - DNA, 25 bp, Mus musculus
tggtcactgcatccagcttcacagt

SEQ ID NO: 893502 - DNA, 25 bp, Mus musculus
tggtcactgcatgcagcttcacagt

SEQ ID NO: 893503 - DNA, 25 bp, Mus musculus
tggtcactgctgaagcgggtgcctt

SEQ ID NO: 893504 - DNA, 25 bp, Mus musculus
tggtcactgctgtagcgggtgcctt

SEQ ID NO: 893505 - DNA, 25 bp, Mus musculus
tggtcactgtttcgcattgcttgta

SEQ ID NO: 893506 - DNA, 25 bp, Mus musculus
tggtcactgtttggcattgcttgta

SEQ ID NO: 893507 - DNA, 25 bp, Mus musculus
tggtcacttaacaaacctttccagg

SEQ ID NO: 893508 - DNA, 25 bp, Mus musculus
tggtcacttaactaacctttccagg

SEQ ID NO: 893509 - DNA, 25 bp, Mus musculus
tggtcacttgaaccaaccagtgtat

SEQ ID NO: 893510 - DNA, 25 bp, Mus musculus
tggtcacttgaagcaaccagtgtat

SEQ ID NO: 893511 - DNA, 25 bp, Mus musculus
tggtcacttggtcactggcagaatc

SEQ ID NO: 893512 - DNA, 25 bp, Mus musculus
tggtcacttggtgactggcagaatc

SEQ ID NO: 893513 - DNA, 25 bp, Mus musculus
tggtcactttacaccagtgttgtta

SEQ ID NO: 893514 - DNA, 25 bp, Mus musculus
tggtcactttactccagtgttgtta

SEQ ID NO: 893515 - DNA, 25 bp, Mus musculus
tggtcagaaaatacactcataaggg

SEQ ID NO: 893516 - DNA, 25 bp, Mus musculus
tggtcagaaaattcactcataaggg

SEQ ID NO: 893517 - DNA, 25 bp, Mus musculus
tggtcagaaacgctccgtaacctaa

SEQ ID NO: 893518 - DNA, 25 bp, Mus musculus
tggtcagaaacggtccgtaacctaa

SEQ ID NO: 893519 - DNA, 25 bp, Mus musculus
tggtcagaagagctgctcctgcctg

SEQ ID NO: 893520 - DNA, 25 bp, Mus musculus
tggtcagaagaggtgctcctgcctg

SEQ ID NO: 893521 - DNA, 25 bp, Mus musculus
tggtcagacctactttttacatgat

SEQ ID NO: 893522 - DNA, 25 bp, Mus musculus
tggtcagacctagtttttacatgat

SEQ ID NO: 893523 - DNA, 25 bp, Mus musculus
tggtcagagatacctggcctggtct

SEQ ID NO: 893524 - DNA, 25 bp, Mus musculus
tggtcagagatagctggcctggtct

SEQ ID NO: 893525 - DNA, 25 bp, Mus musculus
tggtcagagattattcacagcaaca

SEQ ID NO: 893526 - DNA, 25 bp, Mus musculus
tggtcagagatttttcacagcaaca

SEQ ID NO: 893527 - DNA, 25 bp, Mus musculus
tggtcagagcagatagcgcccattc

SEQ ID NO: 893528 - DNA, 25 bp, Mus musculus
tggtcagagcagttagcgcccattc

SEQ ID NO: 893529 - DNA, 25 bp, Mus musculus
tggtcagagcttagcatcatcgcat

SEQ ID NO: 893530 - DNA, 25 bp, Mus musculus
tggtcagagctttgcatcatcgcat

SEQ ID NO: 893531 - DNA, 25 bp, Mus musculus
tggtcagaggacctgcagcggacat

SEQ ID NO: 893532 - DNA, 25 bp, Mus musculus
tggtcagaggacgtgcagcggacat

SEQ ID NO: 893533 - DNA, 25 bp, Mus musculus
tggtcagaggccagcagtgtacact

SEQ ID NO: 893534 - DNA, 25 bp, Mus musculus
tggtcagaggcctgcagtgtacact

SEQ ID NO: 893535 - DNA, 25 bp, Mus musculus
tggtcagagtatcccagcgctccag

SEQ ID NO: 893536 - DNA, 25 bp, Mus musculus
tggtcagagtatgccagcgctccag

SEQ ID NO: 893537 - DNA, 25 bp, Mus musculus
tggtcagatggtctcaccactgatg

SEQ ID NO: 893538 - DNA, 25 bp, Mus musculus
tggtcagatggtgtcaccactgatg

SEQ ID NO: 893539 - DNA, 25 bp, Mus musculus
tggtcagcaattcagagcccttact

SEQ ID NO: 893540 - DNA, 25 bp, Mus musculus
tggtcagcaattgagagcccttact

SEQ ID NO: 893541 - DNA, 25 bp, Mus musculus
tggtcagcacccacagatctgtgaa

SEQ ID NO: 893542 - DNA, 25 bp, Mus musculus
tggtcagcaccctcagatctgtgaa

SEQ ID NO: 893543 - DNA, 25 bp, Mus musculus
tggtcagcagagacatccggccgaa

SEQ ID NO: 893544 - DNA, 25 bp, Mus musculus
tggtcagcagagtcatccggccgaa

SEQ ID NO: 893545 - DNA, 25 bp, Mus musculus
tggtcagcagcacttttcttcattc

SEQ ID NO: 893546 - DNA, 25 bp, Mus musculus
tggtcagcagcagttttcttcattc

SEQ ID NO: 893547 - DNA, 25 bp, Mus musculus
tggtcagcagctcccacagcgcagg

SEQ ID NO: 893548 - DNA, 25 bp, Mus musculus
tggtcagcagctgccacagcgcagg

SEQ ID NO: 893549 - DNA, 25 bp, Mus musculus
tggtcagcatctccaccaaccagct

SEQ ID NO: 893550 - DNA, 25 bp, Mus musculus
tggtcagcatctgcaccaaccagct

SEQ ID NO: 893551 - DNA, 25 bp, Mus musculus
tggtcagccaaccagagcacactgg

SEQ ID NO: 893552 - DNA, 25 bp, Mus musculus
tggtcagccaacgagagcacactgg

SEQ ID NO: 893553 - DNA, 25 bp, Mus musculus
tggtcagccaagcttcttgagtcat

SEQ ID NO: 893554 - DNA, 25 bp, Mus musculus
tggtcagccaaggttcttgagtcat

SEQ ID NO: 893555 - DNA, 25 bp, Mus musculus
tggtcagccagtagagattcatcga

SEQ ID NO: 893556 - DNA, 25 bp, Mus musculus
tggtcagccagttgagattcatcga

SEQ ID NO: 893557 - DNA, 25 bp, Mus musculus
tggtcagcccgacgtacctgcagaa

SEQ ID NO: 893558 - DNA, 25 bp, Mus musculus
tggtcagcccgaggtacctgcagaa

SEQ ID NO: 893559 - DNA, 25 bp, Mus musculus
tggtcagcccgtccctgatcaagga

SEQ ID NO: 893560 - DNA, 25 bp, Mus musculus
tggtcagcccgtgcctgatcaagga

SEQ ID NO: 893561 - DNA, 25 bp, Mus musculus
tggtcagcccttctgtatgctcatg

SEQ ID NO: 893562 - DNA, 25 bp, Mus musculus
tggtcagcccttgtgtatgctcatg

SEQ ID NO: 893563 - DNA, 25 bp, Mus musculus
tggtcagcctagcttcctcagtgag

SEQ ID NO: 893564 - DNA, 25 bp, Mus musculus
tggtcagcctaggttcctcagtgag

SEQ ID NO: 893565 - DNA, 25 bp, Mus musculus
tggtcagcctctcaaatcgtggtta

SEQ ID NO: 893566 - DNA, 25 bp, Mus musculus
tggtcagcctctcctgaagggctgc

SEQ ID NO: 893567 - DNA, 25 bp, Mus musculus
tggtcagcctctgaaatcgtggtta

SEQ ID NO: 893568 - DNA, 25 bp, Mus musculus
tggtcagcctctgctgaagggctgc

SEQ ID NO: 893569 - DNA, 25 bp, Mus musculus
tggtcagcgccgacttctgcgagaa

SEQ ID NO: 893570 - DNA, 25 bp, Mus musculus
tggtcagcgccgtcttctgcgagaa

SEQ ID NO: 893571 - DNA, 25 bp, Mus musculus
tggtcagcggcaacttgttctacat

SEQ ID NO: 893572 - DNA, 25 bp, Mus musculus
tggtcagcggcatcttgttctacat

SEQ ID NO: 893573 - DNA, 25 bp, Mus musculus
tggtcagctcataacttacaggtgt

SEQ ID NO: 893574 - DNA, 25 bp, Mus musculus
tggtcagctcattacttacaggtgt

SEQ ID NO: 893575 - DNA, 25 bp, Mus musculus
tggtcagctctgcagtactgcctgc

SEQ ID NO: 893576 - DNA, 25 bp, Mus musculus
tggtcagctctggagtactgcctgc

SEQ ID NO: 893577 - DNA, 25 bp, Mus musculus
tggtcagctgtgcaaaggaagcctc

SEQ ID NO: 893578 - DNA, 25 bp, Mus musculus
tggtcagctgtggaaaggaagcctc

SEQ ID NO: 893579 - DNA, 25 bp, Mus musculus
tggtcagcttccagcggaggtcaag

SEQ ID NO: 893580 - DNA, 25 bp, Mus musculus
tggtcagcttccctggatcccatta

SEQ ID NO: 893581 - DNA, 25 bp, Mus musculus
tggtcagcttccgtggatcccatta

SEQ ID NO: 893582 - DNA, 25 bp, Mus musculus
tggtcagcttcctgcggaggtcaag

SEQ ID NO: 893583 - DNA, 25 bp, Mus musculus
tggtcagcttggaagcattcattct

SEQ ID NO: 893584 - DNA, 25 bp, Mus musculus
tggtcagcttggtagcattcattct

SEQ ID NO: 893585 - DNA, 25 bp, Mus musculus
tggtcagctttcaaatgggcatttt

SEQ ID NO: 893586 - DNA, 25 bp, Mus musculus
tggtcagctttctaatgggcatttt

SEQ ID NO: 893587 - DNA, 25 bp, Mus musculus
tggtcagggccgatctggctgctct

SEQ ID NO: 893588 - DNA, 25 bp, Mus musculus
tggtcagggccgttctggctgctct

SEQ ID NO: 893589 - DNA, 25 bp, Mus musculus
tggtcagggcgcacgactgaccctt

SEQ ID NO: 893590 - DNA, 25 bp, Mus musculus
tggtcagggcgctcgactgaccctt

SEQ ID NO: 893591 - DNA, 25 bp, Mus musculus
tggtcagggtatacggtcatccgac

SEQ ID NO: 893592 - DNA, 25 bp, Mus musculus
tggtcagggtattcggtcatccgac

SEQ ID NO: 893593 - DNA, 25 bp, Mus musculus
tggtcaggtagtagtcctggttaac

SEQ ID NO: 893594 - DNA, 25 bp, Mus musculus
tggtcaggtagttgtcctggttaac

SEQ ID NO: 893595 - DNA, 25 bp, Mus musculus
tggtcaggtcgaaaagcgtgtttct

SEQ ID NO: 893596 - DNA, 25 bp, Mus musculus
tggtcaggtcgataagcgtgtttct

SEQ ID NO: 893597 - DNA, 25 bp, Mus musculus
tggtcaggtgctagctggagtacat

SEQ ID NO: 893598 - DNA, 25 bp, Mus musculus
tggtcaggtgcttgctggagtacat

SEQ ID NO: 893599 - DNA, 25 bp, Mus musculus
tggtcaggttagaattgctcaaaaa

SEQ ID NO: 893600 - DNA, 25 bp, Mus musculus
tggtcaggttagtattgctcaaaaa

SEQ ID NO: 893601 - DNA, 25 bp, Mus musculus
tggtcagtaccaaagcgtcgcagtg

SEQ ID NO: 893602 - DNA, 25 bp, Mus musculus
tggtcagtaccatagcgtcgcagtg

SEQ ID NO: 893603 - DNA, 25 bp, Mus musculus
tggtcagtactaacttacttttgtg

SEQ ID NO: 893604 - DNA, 25 bp, Mus musculus
tggtcagtactatcttacttttgtg

SEQ ID NO: 893605 - DNA, 25 bp, Mus musculus
tggtcagtactcatgttctgtaaag

SEQ ID NO: 893606 - DNA, 25 bp, Mus musculus
tggtcagtactcttgttctgtaaag

SEQ ID NO: 893607 - DNA, 25 bp, Mus musculus
tggtcagtatcaaccacagccatgc

SEQ ID NO: 893608 - DNA, 25 bp, Mus musculus
tggtcagtatcatccacagccatgc

SEQ ID NO: 893609 - DNA, 25 bp, Mus musculus
tggtcagtattaatgtctagcccta

SEQ ID NO: 893610 - DNA, 25 bp, Mus musculus
tggtcagtattattgtctagcccta

SEQ ID NO: 893611 - DNA, 25 bp, Mus musculus
tggtcagttgtacagtcgcagctca

SEQ ID NO: 893612 - DNA, 25 bp, Mus musculus
tggtcagttgtagagtcgcagctca

SEQ ID NO: 893613 - DNA, 25 bp, Mus musculus
tggtcagtttatcgtcagcccaccc

SEQ ID NO: 893614 - DNA, 25 bp, Mus musculus
tggtcagtttatggtcagcccaccc

SEQ ID NO: 893615 - DNA, 25 bp, Mus musculus
tggtcagtttgactcgcagctttag

SEQ ID NO: 893616 - DNA, 25 bp, Mus musculus
tggtcagtttgagtcgcagctttag

SEQ ID NO: 893617 - DNA, 25 bp, Mus musculus
tggtcagttttgatgcaggcacctt

SEQ ID NO: 893618 - DNA, 25 bp, Mus musculus
tggtcagttttgttgcaggcacctt

SEQ ID NO: 893619 - DNA, 25 bp, Mus musculus
tggtcatacaacagccctgtaaact

SEQ ID NO: 893620 - DNA, 25 bp, Mus musculus
tggtcatacaactgccctgtaaact

SEQ ID NO: 893621 - DNA, 25 bp, Mus musculus
tggtcatacatgactattccccagc

SEQ ID NO: 893622 - DNA, 25 bp, Mus musculus
tggtcatacatgtctattccccagc

SEQ ID NO: 893623 - DNA, 25 bp, Mus musculus
tggtcatacctgactacctaattat

SEQ ID NO: 893624 - DNA, 25 bp, Mus musculus
tggtcatacctgtctacctaattat

SEQ ID NO: 893625 - DNA, 25 bp, Mus musculus
tggtcatacttgctgcttgagaagc

SEQ ID NO: 893626 - DNA, 25 bp, Mus musculus
tggtcatacttggtgcttgagaagc

SEQ ID NO: 893627 - DNA, 25 bp, Mus musculus
tggtcatagtgacgcctgttccagc

SEQ ID NO: 893628 - DNA, 25 bp, Mus musculus
tggtcatagtgaggcctgttccagc

SEQ ID NO: 893629 - DNA, 25 bp, Mus musculus
tggtcatcaattatcagcatcttcg

SEQ ID NO: 893630 - DNA, 25 bp, Mus musculus
tggtcatcaattttcagcatcttcg

SEQ ID NO: 893631 - DNA, 25 bp, Mus musculus
tggtcatcactgcttcccatgctaa

SEQ ID NO: 893632 - DNA, 25 bp, Mus musculus
tggtcatcactggttcccatgctaa

SEQ ID NO: 893633 - DNA, 25 bp, Mus musculus
tggtcatcagggagtcctgtacgaa

SEQ ID NO: 893634 - DNA, 25 bp, Mus musculus
tggtcatcagggtgtcctgtacgaa

SEQ ID NO: 893635 - DNA, 25 bp, Mus musculus
tggtcatcatcaaggcatgccaggt

SEQ ID NO: 893636 - DNA, 25 bp, Mus musculus
tggtcatcatcatggcatgccaggt

SEQ ID NO: 893637 - DNA, 25 bp, Mus musculus
tggtcatccatactcatatatgtgt

SEQ ID NO: 893638 - DNA, 25 bp, Mus musculus
tggtcatccatagtcatatatgtgt

SEQ ID NO: 893639 - DNA, 25 bp, Mus musculus
tggtcatcctccaggtgatgtacgt

SEQ ID NO: 893640 - DNA, 25 bp, Mus musculus
tggtcatcctcctggtgatgtacgt

SEQ ID NO: 893641 - DNA, 25 bp, Mus musculus
tggtcatcctcgaccataagcacta

SEQ ID NO: 893642 - DNA, 25 bp, Mus musculus
tggtcatcctcgtccataagcacta

SEQ ID NO: 893643 - DNA, 25 bp, Mus musculus
tggtcatcctgcatcttgttgtttg

SEQ ID NO: 893644 - DNA, 25 bp, Mus musculus
tggtcatcctgcttcttgttgtttg

SEQ ID NO: 893645 - DNA, 25 bp, Mus musculus
tggtcatcggccctaaaggcatccg

SEQ ID NO: 893646 - DNA, 25 bp, Mus musculus
tggtcatcggccgtaaaggcatccg

SEQ ID NO: 893647 - DNA, 25 bp, Mus musculus
tggtcatcgtgacttgccctggttg

SEQ ID NO: 893648 - DNA, 25 bp, Mus musculus
tggtcatcgtgagttgccctggttg

SEQ ID NO: 893649 - DNA, 25 bp, Mus musculus
tggtcatcgtgtccggtggcaacaa

SEQ ID NO: 893650 - DNA, 25 bp, Mus musculus
tggtcatcgtgtgcggtggcaacaa

SEQ ID NO: 893651 - DNA, 25 bp, Mus musculus
tggtcatctacgactgggcttgctc

SEQ ID NO: 893652 - DNA, 25 bp, Mus musculus
tggtcatctacgtctgggcttgctc

SEQ ID NO: 893653 - DNA, 25 bp, Mus musculus
tggtcatctgtgagactcccgagca

SEQ ID NO: 893654 - DNA, 25 bp, Mus musculus
tggtcatctgtgtgactcccgagca

SEQ ID NO: 893655 - DNA, 25 bp, Mus musculus
tggtcatcttgaaaaaggccaccga

SEQ ID NO: 893656 - DNA, 25 bp, Mus musculus
tggtcatcttgataaaggccaccga

SEQ ID NO: 893657 - DNA, 25 bp, Mus musculus
tggtcatgaaatacgtgtgccctct

SEQ ID NO: 893658 - DNA, 25 bp, Mus musculus
tggtcatgaaattcgtgtgccctct

SEQ ID NO: 893659 - DNA, 25 bp, Mus musculus
tggtcatgacctctggccagatcca

SEQ ID NO: 893660 - DNA, 25 bp, Mus musculus
tggtcatgacctgtggccagatcca

SEQ ID NO: 893661 - DNA, 25 bp, Mus musculus
tggtcatggcttagactgttctctt

SEQ ID NO: 893662 - DNA, 25 bp, Mus musculus
tggtcatggctttgactgttctctt

SEQ ID NO: 893663 - DNA, 25 bp, Mus musculus
tggtcatgtatccttatggccattc

SEQ ID NO: 893664 - DNA, 25 bp, Mus musculus
tggtcatgtatcgttatggccattc

SEQ ID NO: 893665 - DNA, 25 bp, Mus musculus
tggtcatgtcaaccccagattgcca

SEQ ID NO: 893666 - DNA, 25 bp, Mus musculus
tggtcatgtcaagcccagattgcca

SEQ ID NO: 893667 - DNA, 25 bp, Mus musculus
tggtcatgtcatcctgaggtcacat

SEQ ID NO: 893668 - DNA, 25 bp, Mus musculus
tggtcatgtcatgctgaggtcacat

SEQ ID NO: 893669 - DNA, 25 bp, Mus musculus
tggtcatgtcctcggtagggcctac

SEQ ID NO: 893670 - DNA, 25 bp, Mus musculus
tggtcatgtcctgggtagggcctac

SEQ ID NO: 893671 - DNA, 25 bp, Mus musculus
tggtcatgtgagaggccttcgtgca

SEQ ID NO: 893672 - DNA, 25 bp, Mus musculus
tggtcatgtgagtggccttcgtgca

SEQ ID NO: 893673 - DNA, 25 bp, Mus musculus
tggtcatgttctcccatatatggtt

SEQ ID NO: 893674 - DNA, 25 bp, Mus musculus
tggtcatgttctgccatatatggtt

SEQ ID NO: 893675 - DNA, 25 bp, Mus musculus
tggtcatgtttgaggaagccaccga

SEQ ID NO: 893676 - DNA, 25 bp, Mus musculus
tggtcatgtttgtggaagccaccga

SEQ ID NO: 893677 - DNA, 25 bp, Mus musculus
tggtcattaaccagcttgtcagcaa

SEQ ID NO: 893678 - DNA, 25 bp, Mus musculus
tggtcattaacctgcttgtcagcaa

SEQ ID NO: 893679 - DNA, 25 bp, Mus musculus
tggtcattaccactgtccacaatcg

SEQ ID NO: 893680 - DNA, 25 bp, Mus musculus
tggtcattaccagtgtccacaatcg

SEQ ID NO: 893681 - DNA, 25 bp, Mus musculus
tggtcattagacctgccactctgaa

SEQ ID NO: 893682 - DNA, 25 bp, Mus musculus
tggtcattagacgtgccactctgaa

SEQ ID NO: 893683 - DNA, 25 bp, Mus musculus
tggtcattaggcaacactttggcat

SEQ ID NO: 893684 - DNA, 25 bp, Mus musculus
tggtcattaggctacactttggcat

SEQ ID NO: 893685 - DNA, 25 bp, Mus musculus
tggtcattcataccttctactgctt

SEQ ID NO: 893686 - DNA, 25 bp, Mus musculus
tggtcattcatagcttctactgctt

SEQ ID NO: 893687 - DNA, 25 bp, Mus musculus
tggtcattccatcacaaattgtccc

SEQ ID NO: 893688 - DNA, 25 bp, Mus musculus
tggtcattccatgacaaattgtccc

SEQ ID NO: 893689 - DNA, 25 bp, Mus musculus
tggtcattcttacaactactattta

SEQ ID NO: 893690 - DNA, 25 bp, Mus musculus
tggtcattcttagaactactattta

SEQ ID NO: 893691 - DNA, 25 bp, Mus musculus
tggtcattggctcaggctgctgatg

SEQ ID NO: 893692 - DNA, 25 bp, Mus musculus
tggtcattggctgaggctgctgatg

SEQ ID NO: 893693 - DNA, 25 bp, Mus musculus
tggtcattgtatatggcgtgtacct

SEQ ID NO: 893694 - DNA, 25 bp, Mus musculus
tggtcattgtatcgtctgaaatttt

SEQ ID NO: 893695 - DNA, 25 bp, Mus musculus
tggtcattgtatggtctgaaatttt

SEQ ID NO: 893696 - DNA, 25 bp, Mus musculus
tggtcattgtatttggcgtgtacct

SEQ ID NO: 893697 - DNA, 25 bp, Mus musculus
tggtcattgtccactatggctgtgc

SEQ ID NO: 893698 - DNA, 25 bp, Mus musculus
tggtcattgtcctctatggctgtgc

SEQ ID NO: 893699 - DNA, 25 bp, Mus musculus
tggtcattgtgaccacacacacagc

SEQ ID NO: 893700 - DNA, 25 bp, Mus musculus
tggtcattgtgagcacacacacagc

SEQ ID NO: 893701 - DNA, 25 bp, Mus musculus
tggtcatttgcccactctggatagc

SEQ ID NO: 893702 - DNA, 25 bp, Mus musculus
tggtcatttgccgactctggatagc

SEQ ID NO: 893703 - DNA, 25 bp, Mus musculus
tggtcatttggtatcagagcccgaa

SEQ ID NO: 893704 - DNA, 25 bp, Mus musculus
tggtcatttggtttcagagcccgaa

SEQ ID NO: 893705 - DNA, 25 bp, Mus musculus
tggtcatttgtcaggtgcagttccc

SEQ ID NO: 893706 - DNA, 25 bp, Mus musculus
tggtcatttgtctggtgcagttccc

SEQ ID NO: 893707 - DNA, 25 bp, Mus musculus
tggtcattttccaaatctcaaaggg

SEQ ID NO: 893708 - DNA, 25 bp, Mus musculus
tggtcattttcctaatctcaaaggg

SEQ ID NO: 893709 - DNA, 25 bp, Mus musculus
tggtccaaaagtactctctaagaac

SEQ ID NO: 893710 - DNA, 25 bp, Mus musculus
tggtccaaaagttctctctaagaac

SEQ ID NO: 893711 - DNA, 25 bp, Mus musculus
tggtccaaactcaaagcggtctttg

SEQ ID NO: 893712 - DNA, 25 bp, Mus musculus
tggtccaaactctaagcggtctttg

SEQ ID NO: 893713 - DNA, 25 bp, Mus musculus
tggtccaaagccagggtttcctgaa

SEQ ID NO: 893714 - DNA, 25 bp, Mus musculus
tggtccaaagcctgggtttcctgaa

SEQ ID NO: 893715 - DNA, 25 bp, Mus musculus
tggtccaaatccatggcattccatt

SEQ ID NO: 893716 - DNA, 25 bp, Mus musculus
tggtccaaatccttggcattccatt

SEQ ID NO: 893717 - DNA, 25 bp, Mus musculus
tggtccaaatctcgtttcccttatt

SEQ ID NO: 893718 - DNA, 25 bp, Mus musculus
tggtccaaatctggtttcccttatt

SEQ ID NO: 893719 - DNA, 25 bp, Mus musculus
tggtccaacagtcgtatcctggtga

SEQ ID NO: 893720 - DNA, 25 bp, Mus musculus
tggtccaacagtggtatcctggtga

SEQ ID NO: 893721 - DNA, 25 bp, Mus musculus
tggtccaagaagctgagaagtacaa

SEQ ID NO: 893722 - DNA, 25 bp, Mus musculus
tggtccaagaaggtgagaagtacaa

SEQ ID NO: 893723 - DNA, 25 bp, Mus musculus
tggtccaagcaaatactctaggtat

SEQ ID NO: 893724 - DNA, 25 bp, Mus musculus
tggtccaagcaattactctaggtat

SEQ ID NO: 893725 - DNA, 25 bp, Mus musculus
tggtccaagggcatacctctgaaaa

SEQ ID NO: 893726 - DNA, 25 bp, Mus musculus
tggtccaagggcttacctctgaaaa

SEQ ID NO: 893727 - DNA, 25 bp, Mus musculus
tggtccaagtgaatccattcggtca

SEQ ID NO: 893728 - DNA, 25 bp, Mus musculus
tggtccaagtgattccattcggtca

SEQ ID NO: 893729 - DNA, 25 bp, Mus musculus
tggtccaatccaagaaagcactgct

SEQ ID NO: 893730 - DNA, 25 bp, Mus musculus
tggtccaatccatgaaagcactgct

SEQ ID NO: 893731 - DNA, 25 bp, Mus musculus
tggtccaatcccaccgaggtggtac

SEQ ID NO: 893732 - DNA, 25 bp, Mus musculus
tggtccaatccctccgaggtggtac

SEQ ID NO: 893733 - DNA, 25 bp, Mus musculus
tggtccacatggaaggtgactgaag

SEQ ID NO: 893734 - DNA, 25 bp, Mus musculus
tggtccacatggtaggtgactgaag

SEQ ID NO: 893735 - DNA, 25 bp, Mus musculus
tggtccaccaataagctgaagttct

SEQ ID NO: 893736 - DNA, 25 bp, Mus musculus
tggtccaccaattagctgaagttct

SEQ ID NO: 893737 - DNA, 25 bp, Mus musculus
tggtccacctggaaggagccctcgt

SEQ ID NO: 893738 - DNA, 25 bp, Mus musculus
tggtccacctggctcatgtgtctgc

SEQ ID NO: 893739 - DNA, 25 bp, Mus musculus
tggtccacctgggtcatgtgtctgc

SEQ ID NO: 893740 - DNA, 25 bp, Mus musculus
tggtccacctggtaggagccctcgt

SEQ ID NO: 893741 - DNA, 25 bp, Mus musculus
tggtccaccttgattaacctgtgga

SEQ ID NO: 893742 - DNA, 25 bp, Mus musculus
tggtccaccttgtttaacctgtgga

SEQ ID NO: 893743 - DNA, 25 bp, Mus musculus
tggtccacgtgaaagatgccaacgg

SEQ ID NO: 893744 - DNA, 25 bp, Mus musculus
tggtccacgtgatagatgccaacgg

SEQ ID NO: 893745 - DNA, 25 bp, Mus musculus
tggtccactctgacaaggcccgaga

SEQ ID NO: 893746 - DNA, 25 bp, Mus musculus
tggtccactctgtcaaggcccgaga

SEQ ID NO: 893747 - DNA, 25 bp, Mus musculus
tggtccagaaccacgagcctggtaa

SEQ ID NO: 893748 - DNA, 25 bp, Mus musculus
tggtccagaacctcgagcctggtaa

SEQ ID NO: 893749 - DNA, 25 bp, Mus musculus
tggtccagagctcacatacactgcc

SEQ ID NO: 893750 - DNA, 25 bp, Mus musculus
tggtccagagctgacatacactgcc

SEQ ID NO: 893751 - DNA, 25 bp, Mus musculus
tggtccagatcaaatttccagccct

SEQ ID NO: 893752 - DNA, 25 bp, Mus musculus
tggtccagatcatatttccagccct

SEQ ID NO: 893753 - DNA, 25 bp, Mus musculus
tggtccagatccatcggctcatgag

SEQ ID NO: 893754 - DNA, 25 bp, Mus musculus
tggtccagatccttcggctcatgag

SEQ ID NO: 893755 - DNA, 25 bp, Mus musculus
tggtccagcccaacagtaactgcac

SEQ ID NO: 893756 - DNA, 25 bp, Mus musculus
tggtccagcccatcagtaactgcac

SEQ ID NO: 893757 - DNA, 25 bp, Mus musculus
tggtccagcctcctaactaaacaga

SEQ ID NO: 893758 - DNA, 25 bp, Mus musculus
tggtccagcctcgtaactaaacaga

SEQ ID NO: 893759 - DNA, 25 bp, Mus musculus
tggtccagctccaggcacaggttgt

SEQ ID NO: 893760 - DNA, 25 bp, Mus musculus
tggtccagctcctggcacaggttgt

SEQ ID NO: 893761 - DNA, 25 bp, Mus musculus
tggtccagctctcgcaagcagacac

SEQ ID NO: 893762 - DNA, 25 bp, Mus musculus
tggtccagctctggcaagcagacac

SEQ ID NO: 893763 - DNA, 25 bp, Mus musculus
tggtccaggactacacaattgagcc

SEQ ID NO: 893764 - DNA, 25 bp, Mus musculus
tggtccaggacttcacaattgagcc

SEQ ID NO: 893765 - DNA, 25 bp, Mus musculus
tggtccaggcgccatttggaattac

SEQ ID NO: 893766 - DNA, 25 bp, Mus musculus
tggtccaggcgcgatttggaattac

SEQ ID NO: 893767 - DNA, 25 bp, Mus musculus
tggtccagggacaaggtgctacagt

SEQ ID NO: 893768 - DNA, 25 bp, Mus musculus
tggtccagggactaggtgctacagt

SEQ ID NO: 893769 - DNA, 25 bp, Mus musculus
tggtccagtccgacttttacaaagt

SEQ ID NO: 893770 - DNA, 25 bp, Mus musculus
tggtccagtccgtcttttacaaagt

SEQ ID NO: 893771 - DNA, 25 bp, Mus musculus
tggtccagtctgacagcagcagcag

SEQ ID NO: 893772 - DNA, 25 bp, Mus musculus
tggtccagtctgtcagcagcagcag

SEQ ID NO: 893773 - DNA, 25 bp, Mus musculus
tggtccagtgttatagggatcttgg

SEQ ID NO: 893774 - DNA, 25 bp, Mus musculus
tggtccagtgttttagggatcttgg

SEQ ID NO: 893775 - DNA, 25 bp, Mus musculus
tggtccagttaaacctaacctcatg

SEQ ID NO: 893776 - DNA, 25 bp, Mus musculus
tggtccagttaatcctaacctcatg

SEQ ID NO: 893777 - DNA, 25 bp, Mus musculus
tggtccagttcaatgctcaaagaat

SEQ ID NO: 893778 - DNA, 25 bp, Mus musculus
tggtccagttcattgctcaaagaat

SEQ ID NO: 893779 - DNA, 25 bp, Mus musculus
tggtccagttgacgtctgcaagact

SEQ ID NO: 893780 - DNA, 25 bp, Mus musculus
tggtccagttgaggtctgcaagact

SEQ ID NO: 893781 - DNA, 25 bp, Mus musculus
tggtccagttttcgtttctccacca

SEQ ID NO: 893782 - DNA, 25 bp, Mus musculus
tggtccagttttggtttctccacca

SEQ ID NO: 893783 - DNA, 25 bp, Mus musculus
tggtccataaacaactgtcttccct

SEQ ID NO: 893784 - DNA, 25 bp, Mus musculus
tggtccataaactactgtcttccct

SEQ ID NO: 893785 - DNA, 25 bp, Mus musculus
tggtccatatcactcatcacttaat

SEQ ID NO: 893786 - DNA, 25 bp, Mus musculus
tggtccatatcagtcatcacttaat

SEQ ID NO: 893787 - DNA, 25 bp, Mus musculus
tggtccatcaccagcacaagggagg

SEQ ID NO: 893788 - DNA, 25 bp, Mus musculus
tggtccatcacctgcacaagggagg

SEQ ID NO: 893789 - DNA, 25 bp, Mus musculus
tggtccatccggacaagctctactg

SEQ ID NO: 893790 - DNA, 25 bp, Mus musculus
tggtccatccggtcaagctctactg

SEQ ID NO: 893791 - DNA, 25 bp, Mus musculus
tggtccatccttcaggcacatagga

SEQ ID NO: 893792 - DNA, 25 bp, Mus musculus
tggtccatccttgaggcacatagga

SEQ ID NO: 893793 - DNA, 25 bp, Mus musculus
tggtccatctcacgctgcatataga

SEQ ID NO: 893794 - DNA, 25 bp, Mus musculus
tggtccatctcaggctgcatataga

SEQ ID NO: 893795 - DNA, 25 bp, Mus musculus
tggtccatcttgaaagctgctgctg

SEQ ID NO: 893796 - DNA, 25 bp, Mus musculus
tggtccatcttgtaagctgctgctg

SEQ ID NO: 893797 - DNA, 25 bp, Mus musculus
tggtccatgagaaacaagatgactt

SEQ ID NO: 893798 - DNA, 25 bp, Mus musculus
tggtccatgagatacaagatgactt

SEQ ID NO: 893799 - DNA, 25 bp, Mus musculus
tggtccatgccaactacagtttttg

SEQ ID NO: 893800 - DNA, 25 bp, Mus musculus
tggtccatgccatctacagtttttg

SEQ ID NO: 893801 - DNA, 25 bp, Mus musculus
tggtccatgctgagttttccttaat

SEQ ID NO: 893802 - DNA, 25 bp, Mus musculus
tggtccatgctgtgttttccttaat

SEQ ID NO: 893803 - DNA, 25 bp, Mus musculus
tggtccatggacaggtctagctgat

SEQ ID NO: 893804 - DNA, 25 bp, Mus musculus
tggtccatggactggtctagctgat

SEQ ID NO: 893805 - DNA, 25 bp, Mus musculus
tggtccatggatcaggtgacatttc

SEQ ID NO: 893806 - DNA, 25 bp, Mus musculus
tggtccatggatgaggtgacatttc

SEQ ID NO: 893807 - DNA, 25 bp, Mus musculus
tggtccatggtaccaccacaataac

SEQ ID NO: 893808 - DNA, 25 bp, Mus musculus
tggtccatggtagcaccacaataac

SEQ ID NO: 893809 - DNA, 25 bp, Mus musculus
tggtccatggtcacccttgtgctca

SEQ ID NO: 893810 - DNA, 25 bp, Mus musculus
tggtccatggtctcccttgtgctca

SEQ ID NO: 893811 - DNA, 25 bp, Mus musculus
tggtccattaacattctcattcaga

SEQ ID NO: 893812 - DNA, 25 bp, Mus musculus
tggtccattaactttctcattcaga

SEQ ID NO: 893813 - DNA, 25 bp, Mus musculus
tggtccattagaacctggaatcccc

SEQ ID NO: 893814 - DNA, 25 bp, Mus musculus
tggtccattagatcctggaatcccc

SEQ ID NO: 893815 - DNA, 25 bp, Mus musculus
tggtccattgtaccaggcagcctag

SEQ ID NO: 893816 - DNA, 25 bp, Mus musculus
tggtccattgtagcaggcagcctag

SEQ ID NO: 893817 - DNA, 25 bp, Mus musculus
tggtcccaaaggaggatgtagcaaa

SEQ ID NO: 893818 - DNA, 25 bp, Mus musculus
tggtcccaaaggtggatgtagcaaa

SEQ ID NO: 893819 - DNA, 25 bp, Mus musculus
tggtcccaaagtagcagctctgcct

SEQ ID NO: 893820 - DNA, 25 bp, Mus musculus
tggtcccaaagttgcagctctgcct

SEQ ID NO: 893821 - DNA, 25 bp, Mus musculus
tggtcccaccatatattactaagta

SEQ ID NO: 893822 - DNA, 25 bp, Mus musculus
tggtcccaccatttattactaagta

SEQ ID NO: 893823 - DNA, 25 bp, Mus musculus
tggtcccacctgacatagtatttaa

SEQ ID NO: 893824 - DNA, 25 bp, Mus musculus
tggtcccacctgtcatagtatttaa

SEQ ID NO: 893825 - DNA, 25 bp, Mus musculus
tggtcccacgaacagagtctaatct

SEQ ID NO: 893826 - DNA, 25 bp, Mus musculus
tggtcccacgaagagagtctaatct

SEQ ID NO: 893827 - DNA, 25 bp, Mus musculus
tggtcccacgatatccagtgggtgt

SEQ ID NO: 893828 - DNA, 25 bp, Mus musculus
tggtcccacgatttccagtgggtgt

SEQ ID NO: 893829 - DNA, 25 bp, Mus musculus
tggtcccagagcctgctgctgctgt

SEQ ID NO: 893830 - DNA, 25 bp, Mus musculus
tggtcccagagcgtgctgctgctgt

SEQ ID NO: 893831 - DNA, 25 bp, Mus musculus
tggtcccagcagatgtcagtataca

SEQ ID NO: 893832 - DNA, 25 bp, Mus musculus
tggtcccagcagttgtcagtataca

SEQ ID NO: 893833 - DNA, 25 bp, Mus musculus
tggtcccagcccatgagtgactcag

SEQ ID NO: 893834 - DNA, 25 bp, Mus musculus
tggtcccagcccttgagtgactcag

SEQ ID NO: 893835 - DNA, 25 bp, Mus musculus
tggtcccagctgactagatgtgttc

SEQ ID NO: 893836 - DNA, 25 bp, Mus musculus
tggtcccagctgtctagatgtgttc

SEQ ID NO: 893837 - DNA, 25 bp, Mus musculus
tggtcccaggacagctttggccgct

SEQ ID NO: 893838 - DNA, 25 bp, Mus musculus
tggtcccaggactgctttggccgct

SEQ ID NO: 893839 - DNA, 25 bp, Mus musculus
tggtcccagttgcttcacaaggctg

SEQ ID NO: 893840 - DNA, 25 bp, Mus musculus
tggtcccagttggttcacaaggctg

SEQ ID NO: 893841 - DNA, 25 bp, Mus musculus
tggtcccatggcacctgtactcata

SEQ ID NO: 893842 - DNA, 25 bp, Mus musculus
tggtcccatggctcctgtactcata

SEQ ID NO: 893843 - DNA, 25 bp, Mus musculus
tggtcccatggtcctggtcacaaaa

SEQ ID NO: 893844 - DNA, 25 bp, Mus musculus
tggtcccatggtgctggtcacaaaa

SEQ ID NO: 893845 - DNA, 25 bp, Mus musculus
tggtcccatgtcagtgtgcagattc

SEQ ID NO: 893846 - DNA, 25 bp, Mus musculus
tggtcccatgtctgtgtgcagattc

SEQ ID NO: 893847 - DNA, 25 bp, Mus musculus
tggtccccaaacctatctttgtcaa

SEQ ID NO: 893848 - DNA, 25 bp, Mus musculus
tggtccccaaacgtatctttgtcaa

SEQ ID NO: 893849 - DNA, 25 bp, Mus musculus
tggtccccaaatctacttgcattgt

SEQ ID NO: 893850 - DNA, 25 bp, Mus musculus
tggtccccaaatgtacttgcattgt

SEQ ID NO: 893851 - DNA, 25 bp, Mus musculus
tggtccccaacaaggcctgcagtgt

SEQ ID NO: 893852 - DNA, 25 bp, Mus musculus
tggtccccaacatggcctgcagtgt

SEQ ID NO: 893853 - DNA, 25 bp, Mus musculus
tggtccccaccaagtgacttgggaa

SEQ ID NO: 893854 - DNA, 25 bp, Mus musculus
tggtccccaccatgtgacttgggaa

SEQ ID NO: 893855 - DNA, 25 bp, Mus musculus
tggtccccactgaggcagcatctga

SEQ ID NO: 893856 - DNA, 25 bp, Mus musculus
tggtccccactgtggcagcatctga

SEQ ID NO: 893857 - DNA, 25 bp, Mus musculus
tggtccccatgtcatgagatcctta

SEQ ID NO: 893858 - DNA, 25 bp, Mus musculus
tggtccccatgtgatgagatcctta

SEQ ID NO: 893859 - DNA, 25 bp, Mus musculus
tggtccccgagtatgcaaatgcatc

SEQ ID NO: 893860 - DNA, 25 bp, Mus musculus
tggtccccgagtttgcaaatgcatc

SEQ ID NO: 893861 - DNA, 25 bp, Mus musculus
tggtccccgatcctgcattggagag

SEQ ID NO: 893862 - DNA, 25 bp, Mus musculus
tggtccccgatcgtgcattggagag

SEQ ID NO: 893863 - DNA, 25 bp, Mus musculus
tggtccccggccctgagaatcggta

SEQ ID NO: 893864 - DNA, 25 bp, Mus musculus
tggtccccggccgtgagaatcggta

SEQ ID NO: 893865 - DNA, 25 bp, Mus musculus
tggtcccctgtgcttcatagtgagc

SEQ ID NO: 893866 - DNA, 25 bp, Mus musculus
tggtcccctgtggttcatagtgagc

SEQ ID NO: 893867 - DNA, 25 bp, Mus musculus
tggtccccttgtacactttataaat

SEQ ID NO: 893868 - DNA, 25 bp, Mus musculus
tggtccccttgttcactttataaat

SEQ ID NO: 893869 - DNA, 25 bp, Mus musculus
tggtcccgaaaacccatctgatgtc

SEQ ID NO: 893870 - DNA, 25 bp, Mus musculus
tggtcccgaaaagccatctgatgtc

SEQ ID NO: 893871 - DNA, 25 bp, Mus musculus
tggtcccgctgcactcactgaagtt

SEQ ID NO: 893872 - DNA, 25 bp, Mus musculus
tggtcccgctgctctcactgaagtt

SEQ ID NO: 893873 - DNA, 25 bp, Mus musculus
tggtcccggtctagcaaaggtctgg

SEQ ID NO: 893874 - DNA, 25 bp, Mus musculus
tggtcccggtcttgcaaaggtctgg

SEQ ID NO: 893875 - DNA, 25 bp, Mus musculus
tggtccctaactccagtagctctgt

SEQ ID NO: 893876 - DNA, 25 bp, Mus musculus
tggtccctaactgcagtagctctgt

SEQ ID NO: 893877 - DNA, 25 bp, Mus musculus
tggtccctaataactgcagtgctct

SEQ ID NO: 893878 - DNA, 25 bp, Mus musculus
tggtccctaatatctgcagtgctct

SEQ ID NO: 893879 - DNA, 25 bp, Mus musculus
tggtccctacttatgctgcattaac

SEQ ID NO: 893880 - DNA, 25 bp, Mus musculus
tggtccctacttttgctgcattaac

SEQ ID NO: 893881 - DNA, 25 bp, Mus musculus
tggtccctatatatcttgtcgtttt

SEQ ID NO: 893882 - DNA, 25 bp, Mus musculus
tggtccctatatttcttgtcgtttt

SEQ ID NO: 893883 - DNA, 25 bp, Mus musculus
tggtccctatttctggttattggtc

SEQ ID NO: 893884 - DNA, 25 bp, Mus musculus
tggtccctatttgtggttattggtc

SEQ ID NO: 893885 - DNA, 25 bp, Mus musculus
tggtccctcaggacgaccaggagat

SEQ ID NO: 893886 - DNA, 25 bp, Mus musculus
tggtccctcaggtcgaccaggagat

SEQ ID NO: 893887 - DNA, 25 bp, Mus musculus
tggtccctccatacagtagaccttg

SEQ ID NO: 893888 - DNA, 25 bp, Mus musculus
tggtccctccattcagtagaccttg

SEQ ID NO: 893889 - DNA, 25 bp, Mus musculus
tggtccctccctaggagacgcaggg

SEQ ID NO: 893890 - DNA, 25 bp, Mus musculus
tggtccctcccttggagacgcaggg

SEQ ID NO: 893891 - DNA, 25 bp, Mus musculus
tggtccctcctcaaagactaaggtc

SEQ ID NO: 893892 - DNA, 25 bp, Mus musculus
tggtccctcctctaagactaaggtc

SEQ ID NO: 893893 - DNA, 25 bp, Mus musculus
tggtccctcttaatatagtattgaa

SEQ ID NO: 893894 - DNA, 25 bp, Mus musculus
tggtccctcttattatagtattgaa

SEQ ID NO: 893895 - DNA, 25 bp, Mus musculus
tggtccctgagtctggcatttctgt

SEQ ID NO: 893896 - DNA, 25 bp, Mus musculus
tggtccctgagtgtggcatttctgt

SEQ ID NO: 893897 - DNA, 25 bp, Mus musculus
tggtccctgccaaggaagccaatgt

SEQ ID NO: 893898 - DNA, 25 bp, Mus musculus
tggtccctgccatggaagccaatgt

SEQ ID NO: 893899 - DNA, 25 bp, Mus musculus
tggtccctggcaatgcagagcacct

SEQ ID NO: 893900 - DNA, 25 bp, Mus musculus
tggtccctggcattgcagagcacct

SEQ ID NO: 893901 - DNA, 25 bp, Mus musculus
tggtccctgtctctgatgacaggtc

SEQ ID NO: 893902 - DNA, 25 bp, Mus musculus
tggtccctgtctgtgatgacaggtc

SEQ ID NO: 893903 - DNA, 25 bp, Mus musculus
tggtccctgtggcacttagcagatg

SEQ ID NO: 893904 - DNA, 25 bp, Mus musculus
tggtccctgtgggacttagcagatg

SEQ ID NO: 893905 - DNA, 25 bp, Mus musculus
tggtccctgttgaaagcacactcgc

SEQ ID NO: 893906 - DNA, 25 bp, Mus musculus
tggtccctgttgtaagcacactcgc

SEQ ID NO: 893907 - DNA, 25 bp, Mus musculus
tggtccctgtttcctgtgaacagac

SEQ ID NO: 893908 - DNA, 25 bp, Mus musculus
tggtccctgtttgctgtgaacagac

SEQ ID NO: 893909 - DNA, 25 bp, Mus musculus
tggtcccttgggaacctggccctag

SEQ ID NO: 893910 - DNA, 25 bp, Mus musculus
tggtcccttgggtacctggccctag

SEQ ID NO: 893911 - DNA, 25 bp, Mus musculus
tggtcccttgtcagaagtctgaaac

SEQ ID NO: 893912 - DNA, 25 bp, Mus musculus
tggtcccttgtcctagtccttatat

SEQ ID NO: 893913 - DNA, 25 bp, Mus musculus
tggtcccttgtcgtagtccttatat

SEQ ID NO: 893914 - DNA, 25 bp, Mus musculus
tggtcccttgtctgaagtctgaaac

SEQ ID NO: 893915 - DNA, 25 bp, Mus musculus
tggtcccttgtgattattgctattg

SEQ ID NO: 893916 - DNA, 25 bp, Mus musculus
tggtcccttgtgtttattgctattg

SEQ ID NO: 893917 - DNA, 25 bp, Mus musculus
tggtccctttccatttcctgtaaag

SEQ ID NO: 893918 - DNA, 25 bp, Mus musculus
tggtccctttccttttcctgtaaag

SEQ ID NO: 893919 - DNA, 25 bp, Mus musculus
tggtccctttggaacatttctagct

SEQ ID NO: 893920 - DNA, 25 bp, Mus musculus
tggtccctttggtacatttctagct

SEQ ID NO: 893921 - DNA, 25 bp, Mus musculus
tggtccgaagctacctgaagtcagt

SEQ ID NO: 893922 - DNA, 25 bp, Mus musculus
tggtccgaagcttcctgaagtcagt

SEQ ID NO: 893923 - DNA, 25 bp, Mus musculus
tggtccgagctgcagtttccctgat

SEQ ID NO: 893924 - DNA, 25 bp, Mus musculus
tggtccgagctggagtttccctgat

SEQ ID NO: 893925 - DNA, 25 bp, Mus musculus
tggtccgcaggtactggttacagaa

SEQ ID NO: 893926 - DNA, 25 bp, Mus musculus
tggtccgcaggttctggttacagaa

SEQ ID NO: 893927 - DNA, 25 bp, Mus musculus
tggtccgggtgcagtttgaacttgc

SEQ ID NO: 893928 - DNA, 25 bp, Mus musculus
tggtccgggtgctgtttgaacttgc

SEQ ID NO: 893929 - DNA, 25 bp, Mus musculus
tggtccggtcttatagctcatctac

SEQ ID NO: 893930 - DNA, 25 bp, Mus musculus
tggtccggtcttttagctcatctac

SEQ ID NO: 893931 - DNA, 25 bp, Mus musculus
tggtccggtgatccctggtccttag

SEQ ID NO: 893932 - DNA, 25 bp, Mus musculus
tggtccggtgatgcctggtccttag

SEQ ID NO: 893933 - DNA, 25 bp, Mus musculus
tggtccggtgcaaccgttttgataa

SEQ ID NO: 893934 - DNA, 25 bp, Mus musculus
tggtccggtgcatccgttttgataa

SEQ ID NO: 893935 - DNA, 25 bp, Mus musculus
tggtccgtaaacatctgtgggtgtt

SEQ ID NO: 893936 - DNA, 25 bp, Mus musculus
tggtccgtaaacttctgtgggtgtt

SEQ ID NO: 893937 - DNA, 25 bp, Mus musculus
tggtccgtgtcacagcaaatgcagc

SEQ ID NO: 893938 - DNA, 25 bp, Mus musculus
tggtccgtgtcagagcaaatgcagc

SEQ ID NO: 893939 - DNA, 25 bp, Mus musculus
tggtcctacaacagaagtcccacat

SEQ ID NO: 893940 - DNA, 25 bp, Mus musculus
tggtcctacaactgaagtcccacat

SEQ ID NO: 893941 - DNA, 25 bp, Mus musculus
tggtcctacaggactctgacaccta

SEQ ID NO: 893942 - DNA, 25 bp, Mus musculus
tggtcctacaggtctctgacaccta

SEQ ID NO: 893943 - DNA, 25 bp, Mus musculus
tggtcctaccccaagtcatggtgtg

SEQ ID NO: 893944 - DNA, 25 bp, Mus musculus
tggtcctacccctagtcatggtgtg

SEQ ID NO: 893945 - DNA, 25 bp, Mus musculus
tggtcctacctgagctcactgattt

SEQ ID NO: 893946 - DNA, 25 bp, Mus musculus
tggtcctacctgtgctcactgattt

SEQ ID NO: 893947 - DNA, 25 bp, Mus musculus
tggtcctagattcctgtgtgcagtg

SEQ ID NO: 893948 - DNA, 25 bp, Mus musculus
tggtcctagattgctgtgtgcagtg

SEQ ID NO: 893949 - DNA, 25 bp, Mus musculus
tggtcctagcttctccttaggcagc

SEQ ID NO: 893950 - DNA, 25 bp, Mus musculus
tggtcctagcttgtccttaggcagc

SEQ ID NO: 893951 - DNA, 25 bp, Mus musculus
tggtcctaggctcttgccatttagt

SEQ ID NO: 893952 - DNA, 25 bp, Mus musculus
tggtcctaggctgttgccatttagt

SEQ ID NO: 893953 - DNA, 25 bp, Mus musculus
tggtcctatggacgcttgatgccca

SEQ ID NO: 893954 - DNA, 25 bp, Mus musculus
tggtcctatggaggcttgatgccca

SEQ ID NO: 893955 - DNA, 25 bp, Mus musculus
tggtcctcaaacacatcctacaggg

SEQ ID NO: 893956 - DNA, 25 bp, Mus musculus
tggtcctcaaactcatcctacaggg

SEQ ID NO: 893957 - DNA, 25 bp, Mus musculus
tggtcctcacacaagaaacattggc

SEQ ID NO: 893958 - DNA, 25 bp, Mus musculus
tggtcctcacactagaaacattggc

SEQ ID NO: 893959 - DNA, 25 bp, Mus musculus
tggtcctcaccaccatcagattgta

SEQ ID NO: 893960 - DNA, 25 bp, Mus musculus
tggtcctcaccagcatcagattgta

SEQ ID NO: 893961 - DNA, 25 bp, Mus musculus
tggtcctcacggaggccacgttaac

SEQ ID NO: 893962 - DNA, 25 bp, Mus musculus
tggtcctcacggctttcccgattga

SEQ ID NO: 893963 - DNA, 25 bp, Mus musculus
tggtcctcacgggtttcccgattga

SEQ ID NO: 893964 - DNA, 25 bp, Mus musculus
tggtcctcacggtggccacgttaac

SEQ ID NO: 893965 - DNA, 25 bp, Mus musculus
tggtcctcagctcctaacacaatga

SEQ ID NO: 893966 - DNA, 25 bp, Mus musculus
tggtcctcagctgctaacacaatga

SEQ ID NO: 893967 - DNA, 25 bp, Mus musculus
tggtcctcatgcaggccttcggcag

SEQ ID NO: 893968 - DNA, 25 bp, Mus musculus
tggtcctcatgctggccttcggcag

SEQ ID NO: 893969 - DNA, 25 bp, Mus musculus
tggtcctccccacaagtatctggtg

SEQ ID NO: 893970 - DNA, 25 bp, Mus musculus
tggtcctccccagaagtatctggtg

SEQ ID NO: 893971 - DNA, 25 bp, Mus musculus
tggtcctccctacctaacatgagaa

SEQ ID NO: 893972 - DNA, 25 bp, Mus musculus
tggtcctccctagctaacatgagaa

SEQ ID NO: 893973 - DNA, 25 bp, Mus musculus
tggtcctcccttatagtagctttca

SEQ ID NO: 893974 - DNA, 25 bp, Mus musculus
tggtcctcccttttagtagctttca

SEQ ID NO: 893975 - DNA, 25 bp, Mus musculus
tggtcctccgtgacctatggagcag

SEQ ID NO: 893976 - DNA, 25 bp, Mus musculus
tggtcctccgtgtcctatggagcag

SEQ ID NO: 893977 - DNA, 25 bp, Mus musculus
tggtcctcctggcaaatctattttg

SEQ ID NO: 893978 - DNA, 25 bp, Mus musculus
tggtcctcctgggaaatctattttg

SEQ ID NO: 893979 - DNA, 25 bp, Mus musculus
tggtcctcgtcgagaagatcctcta

SEQ ID NO: 893980 - DNA, 25 bp, Mus musculus
tggtcctcgtcgtgaagatcctcta

SEQ ID NO: 893981 - DNA, 25 bp, Mus musculus
tggtcctcgtggaactctcatgggt

SEQ ID NO: 893982 - DNA, 25 bp, Mus musculus
tggtcctcgtggtactctcatgggt

SEQ ID NO: 893983 - DNA, 25 bp, Mus musculus
tggtcctctagcaatttctttcgtc

SEQ ID NO: 893984 - DNA, 25 bp, Mus musculus
tggtcctctagctatttctttcgtc

SEQ ID NO: 893985 - DNA, 25 bp, Mus musculus
tggtcctctcgacgaacagtgagct

SEQ ID NO: 893986 - DNA, 25 bp, Mus musculus
tggtcctctcgaggaacagtgagct

SEQ ID NO: 893987 - DNA, 25 bp, Mus musculus
tggtcctctgctcaaggtgctgcag

SEQ ID NO: 893988 - DNA, 25 bp, Mus musculus
tggtcctctgctgaaggtgctgcag

SEQ ID NO: 893989 - DNA, 25 bp, Mus musculus
tggtcctctgtaacttgtgaggcct

SEQ ID NO: 893990 - DNA, 25 bp, Mus musculus
tggtcctctgtatcttgtgaggcct

SEQ ID NO: 893991 - DNA, 25 bp, Mus musculus
tggtcctctgttagaacaacggcag

SEQ ID NO: 893992 - DNA, 25 bp, Mus musculus
tggtcctctgtttgaacaacggcag

SEQ ID NO: 893993 - DNA, 25 bp, Mus musculus
tggtcctcttgcatttaacatctac

SEQ ID NO: 893994 - DNA, 25 bp, Mus musculus
tggtcctcttgcttttaacatctac

SEQ ID NO: 893995 - DNA, 25 bp, Mus musculus
tggtcctcttttcacaaacttttag

SEQ ID NO: 893996 - DNA, 25 bp, Mus musculus
tggtcctcttttgacaaacttttag

SEQ ID NO: 893997 - DNA, 25 bp, Mus musculus
tggtcctgaagccagctgagcagac

SEQ ID NO: 893998 - DNA, 25 bp, Mus musculus
tggtcctgaagcgagctgagcagac

SEQ ID NO: 893999 - DNA, 25 bp, Mus musculus
tggtcctgaggactgtggcttcttc

SEQ ID NO: 894000 - DNA, 25 bp, Mus musculus
tggtcctgaggagtgtggcttcttc

SEQ ID NO: 894001 - DNA, 25 bp, Mus musculus
tggtcctgagtaacagcaatcaact

SEQ ID NO: 894002 - DNA, 25 bp, Mus musculus
tggtcctgagtatcagcaatcaact

SEQ ID NO: 894003 - DNA, 25 bp, Mus musculus
tggtcctgatcgactgctccatcaa

SEQ ID NO: 894004 - DNA, 25 bp, Mus musculus
tggtcctgatcgtctgctccatcaa

SEQ ID NO: 894005 - DNA, 25 bp, Mus musculus
tggtcctgatgcagaggcagagtgt

SEQ ID NO: 894006 - DNA, 25 bp, Mus musculus
tggtcctgatgctgaggcagagtgt

SEQ ID NO: 894007 - DNA, 25 bp, Mus musculus
tggtcctgcacccacttgaggctgg

SEQ ID NO: 894008 - DNA, 25 bp, Mus musculus
tggtcctgcaccctctggatgattc

SEQ ID NO: 894009 - DNA, 25 bp, Mus musculus
tggtcctgcaccgacttgaggctgg

SEQ ID NO: 894010 - DNA, 25 bp, Mus musculus
tggtcctgcaccgtctggatgattc

SEQ ID NO: 894011 - DNA, 25 bp, Mus musculus
tggtcctgccaacggatcctggttc

SEQ ID NO: 894012 - DNA, 25 bp, Mus musculus
tggtcctgccaagggatcctggttc

SEQ ID NO: 894013 - DNA, 25 bp, Mus musculus
tggtcctgctctctatagccctgct

SEQ ID NO: 894014 - DNA, 25 bp, Mus musculus
tggtcctgctctctggccgagtaca

SEQ ID NO: 894015 - DNA, 25 bp, Mus musculus
tggtcctgctctgtatagccctgct

SEQ ID NO: 894016 - DNA, 25 bp, Mus musculus
tggtcctgctctgtggccgagtaca

SEQ ID NO: 894017 - DNA, 25 bp, Mus musculus
tggtcctgctgtccagaattttata

SEQ ID NO: 894018 - DNA, 25 bp, Mus musculus
tggtcctgctgtccgctagcaaaga

SEQ ID NO: 894019 - DNA, 25 bp, Mus musculus
tggtcctgctgtcttctcacggtgc

SEQ ID NO: 894020 - DNA, 25 bp, Mus musculus
tggtcctgctgtgcagaattttata

SEQ ID NO: 894021 - DNA, 25 bp, Mus musculus
tggtcctgctgtgcgctagcaaaga

SEQ ID NO: 894022 - DNA, 25 bp, Mus musculus
tggtcctgctgtgttctcacggtgc

SEQ ID NO: 894023 - DNA, 25 bp, Mus musculus
tggtcctggagaagcatctagactt

SEQ ID NO: 894024 - DNA, 25 bp, Mus musculus
tggtcctggagatgcatctagactt

SEQ ID NO: 894025 - DNA, 25 bp, Mus musculus
tggtcctggatgcagattctcaagt

SEQ ID NO: 894026 - DNA, 25 bp, Mus musculus
tggtcctggatggagattctcaagt

SEQ ID NO: 894027 - DNA, 25 bp, Mus musculus
tggtcctgggcaaacccaatggtga

SEQ ID NO: 894028 - DNA, 25 bp, Mus musculus
tggtcctgggcatacccaatggtga

SEQ ID NO: 894029 - DNA, 25 bp, Mus musculus
tggtcctggtacaagtttcaatctc

SEQ ID NO: 894030 - DNA, 25 bp, Mus musculus
tggtcctggtactagtttcaatctc

SEQ ID NO: 894031 - DNA, 25 bp, Mus musculus
tggtcctggtcaagagcacttacac

SEQ ID NO: 894032 - DNA, 25 bp, Mus musculus
tggtcctggtcatgagcacttacac

SEQ ID NO: 894033 - DNA, 25 bp, Mus musculus
tggtcctggtttacacttcttcaat

SEQ ID NO: 894034 - DNA, 25 bp, Mus musculus
tggtcctggttttcacttcttcaat

SEQ ID NO: 894035 - DNA, 25 bp, Mus musculus
tggtcctgtactcaaaatccaaatg

SEQ ID NO: 894036 - DNA, 25 bp, Mus musculus
tggtcctgtactgaaaatccaaatg

SEQ ID NO: 894037 - DNA, 25 bp, Mus musculus
tggtcctgtccaactcacagtcaaa

SEQ ID NO: 894038 - DNA, 25 bp, Mus musculus
tggtcctgtccatctcacagtcaaa

SEQ ID NO: 894039 - DNA, 25 bp, Mus musculus
tggtcctgtgccagtctgagactgt

SEQ ID NO: 894040 - DNA, 25 bp, Mus musculus
tggtcctgtgcctgtctgagactgt

SEQ ID NO: 894041 - DNA, 25 bp, Mus musculus
tggtcctgtggaaattggcaatgca

SEQ ID NO: 894042 - DNA, 25 bp, Mus musculus
tggtcctgtggatattggcaatgca

SEQ ID NO: 894043 - DNA, 25 bp, Mus musculus
tggtccttagatcaaatgtttacat

SEQ ID NO: 894044 - DNA, 25 bp, Mus musculus
tggtccttagatgaaatgtttacat

SEQ ID NO: 894045 - DNA, 25 bp, Mus musculus
tggtccttaggtcgcactcattttt

SEQ ID NO: 894046 - DNA, 25 bp, Mus musculus
tggtccttaggtggcactcattttt

SEQ ID NO: 894047 - DNA, 25 bp, Mus musculus
tggtccttcagtagcccttctgtgg

SEQ ID NO: 894048 - DNA, 25 bp, Mus musculus
tggtccttcagttgcccttctgtgg

SEQ ID NO: 894049 - DNA, 25 bp, Mus musculus
tggtccttccaacgccaacaactaa

SEQ ID NO: 894050 - DNA, 25 bp, Mus musculus
tggtccttccaaggccaacaactaa

SEQ ID NO: 894051 - DNA, 25 bp, Mus musculus
tggtccttgcatctctgatacatag

SEQ ID NO: 894052 - DNA, 25 bp, Mus musculus
tggtccttgcatgtctgatacatag

SEQ ID NO: 894053 - DNA, 25 bp, Mus musculus
tggtccttggttattctgtctccaa

SEQ ID NO: 894054 - DNA, 25 bp, Mus musculus
tggtccttggtttttctgtctccaa

SEQ ID NO: 894055 - DNA, 25 bp, Mus musculus
tggtcctttatgcaacacgtctatg

SEQ ID NO: 894056 - DNA, 25 bp, Mus musculus
tggtcctttatggaacacgtctatg

SEQ ID NO: 894057 - DNA, 25 bp, Mus musculus
tggtcctttctcaatcctcaaaaaa

SEQ ID NO: 894058 - DNA, 25 bp, Mus musculus
tggtcctttctctatcctcaaaaaa

SEQ ID NO: 894059 - DNA, 25 bp, Mus musculus
tggtcctttgagatgcttcgctcag

SEQ ID NO: 894060 - DNA, 25 bp, Mus musculus
tggtcctttgagttgcttcgctcag

SEQ ID NO: 894061 - DNA, 25 bp, Mus musculus
tggtcctttgttcacttgccttaat

SEQ ID NO: 894062 - DNA, 25 bp, Mus musculus
tggtcctttgttgacttgccttaat

SEQ ID NO: 894063 - DNA, 25 bp, Mus musculus
tggtcctttttacatccactggtgg

SEQ ID NO: 894064 - DNA, 25 bp, Mus musculus
tggtcctttttagatccactggtgg

SEQ ID NO: 894065 - DNA, 25 bp, Mus musculus
tggtcgaaaggacttgtctacaata

SEQ ID NO: 894066 - DNA, 25 bp, Mus musculus
tggtcgaaaggagttgtctacaata

SEQ ID NO: 894067 - DNA, 25 bp, Mus musculus
tggtcgaacgctccccagcaagtaa

SEQ ID NO: 894068 - DNA, 25 bp, Mus musculus
tggtcgaacgctgcccagcaagtaa

SEQ ID NO: 894069 - DNA, 25 bp, Mus musculus
tggtcgaccagtagtctgccctgac

SEQ ID NO: 894070 - DNA, 25 bp, Mus musculus
tggtcgaccagttgtctgccctgac

SEQ ID NO: 894071 - DNA, 25 bp, Mus musculus
tggtcgactctgattgcactcctag

SEQ ID NO: 894072 - DNA, 25 bp, Mus musculus
tggtcgactctgtttgcactcctag

SEQ ID NO: 894073 - DNA, 25 bp, Mus musculus
tggtcgagcgatcgatttccgtctc

SEQ ID NO: 894074 - DNA, 25 bp, Mus musculus
tggtcgagcgatggatttccgtctc

SEQ ID NO: 894075 - DNA, 25 bp, Mus musculus
tggtcgatcctgctgtgactctccc

SEQ ID NO: 894076 - DNA, 25 bp, Mus musculus
tggtcgatcctggtgtgactctccc

SEQ ID NO: 894077 - DNA, 25 bp, Mus musculus
tggtcgatggtgctcaaccccaaat

SEQ ID NO: 894078 - DNA, 25 bp, Mus musculus
tggtcgatggtggtcaaccccaaat

SEQ ID NO: 894079 - DNA, 25 bp, Mus musculus
tggtcgcacagcacacaatcagggc

SEQ ID NO: 894080 - DNA, 25 bp, Mus musculus
tggtcgcacagctcacaatcagggc

SEQ ID NO: 894081 - DNA, 25 bp, Mus musculus
tggtcgccaaaaaggatgtccacat

SEQ ID NO: 894082 - DNA, 25 bp, Mus musculus
tggtcgccaaaatggatgtccacat

SEQ ID NO: 894083 - DNA, 25 bp, Mus musculus
tggtcgcgaaagctttctgccaaag

SEQ ID NO: 894084 - DNA, 25 bp, Mus musculus
tggtcgcgaaaggtttctgccaaag

SEQ ID NO: 894085 - DNA, 25 bp, Mus musculus
tggtcgcgagctcctgtctatataa

SEQ ID NO: 894086 - DNA, 25 bp, Mus musculus
tggtcgcgagctgctgtctatataa

SEQ ID NO: 894087 - DNA, 25 bp, Mus musculus
tggtcgcgatgactctacccctcaa

SEQ ID NO: 894088 - DNA, 25 bp, Mus musculus
tggtcgcgatgagtctacccctcaa

SEQ ID NO: 894089 - DNA, 25 bp, Mus musculus
tggtcgctcagtacgggctgtgctc

SEQ ID NO: 894090 - DNA, 25 bp, Mus musculus
tggtcgctcagttcgggctgtgctc

SEQ ID NO: 894091 - DNA, 25 bp, Mus musculus
tggtcgctctctatcacaagaatga

SEQ ID NO: 894092 - DNA, 25 bp, Mus musculus
tggtcgctctctttcacaagaatga

SEQ ID NO: 894093 - DNA, 25 bp, Mus musculus
tggtcggaaacgagaattggagaaa

SEQ ID NO: 894094 - DNA, 25 bp, Mus musculus
tggtcggaaacgtgaattggagaaa

SEQ ID NO: 894095 - DNA, 25 bp, Mus musculus
tggtcggctcctaaaccctgcgcta

SEQ ID NO: 894096 - DNA, 25 bp, Mus musculus
tggtcggctccttaaccctgcgcta

SEQ ID NO: 894097 - DNA, 25 bp, Mus musculus
tggtcggcttgacgcagtgaatcat

SEQ ID NO: 894098 - DNA, 25 bp, Mus musculus
tggtcggcttgaggcagtgaatcat

SEQ ID NO: 894099 - DNA, 25 bp, Mus musculus
tggtcgggaactacactggcagaaa

SEQ ID NO: 894100 - DNA, 25 bp, Mus musculus
tggtcgggaacttcactggcagaaa

SEQ ID NO: 894101 - DNA, 25 bp, Mus musculus
tggtcgggatgaaggaactgcccct

SEQ ID NO: 894102 - DNA, 25 bp, Mus musculus
tggtcgggatgatggaactgcccct

SEQ ID NO: 894103 - DNA, 25 bp, Mus musculus
tggtcggtcctgattcacagccgta

SEQ ID NO: 894104 - DNA, 25 bp, Mus musculus
tggtcggtcctgtttcacagccgta

SEQ ID NO: 894105 - DNA, 25 bp, Mus musculus
tggtcgtagcttagcaggactgttc

SEQ ID NO: 894106 - DNA, 25 bp, Mus musculus
tggtcgtagctttgcaggactgttc

SEQ ID NO: 894107 - DNA, 25 bp, Mus musculus
tggtcgtataatcgagcgcgtaatc

SEQ ID NO: 894108 - DNA, 25 bp, Mus musculus
tggtcgtataatggagcgcgtaatc

SEQ ID NO: 894109 - DNA, 25 bp, Mus musculus
tggtcgtcatttaatccaagcttga

SEQ ID NO: 894110 - DNA, 25 bp, Mus musculus
tggtcgtcattttatccaagcttga

SEQ ID NO: 894111 - DNA, 25 bp, Mus musculus
tggtcgtcgacaacggctccggcat

SEQ ID NO: 894112 - DNA, 25 bp, Mus musculus
tggtcgtcgacatcggctccggcat

SEQ ID NO: 894113 - DNA, 25 bp, Mus musculus
tggtcgtcgcgcaaaggaagttttc

SEQ ID NO: 894114 - DNA, 25 bp, Mus musculus
tggtcgtcgcgctaaggaagttttc

SEQ ID NO: 894115 - DNA, 25 bp, Mus musculus
tggtcgtctgtgatggtacccaata

SEQ ID NO: 894116 - DNA, 25 bp, Mus musculus
tggtcgtctgtgttggtacccaata

SEQ ID NO: 894117 - DNA, 25 bp, Mus musculus
tggtcgtgggctacaaccctggaga

SEQ ID NO: 894118 - DNA, 25 bp, Mus musculus
tggtcgtgggcttcaaccctggaga

SEQ ID NO: 894119 - DNA, 25 bp, Mus musculus
tggtcgttcaatcccagaggatcac

SEQ ID NO: 894120 - DNA, 25 bp, Mus musculus
tggtcgttcaatgccagaggatcac

SEQ ID NO: 894121 - DNA, 25 bp, Mus musculus
tggtcgtttattccattcatggcgt

SEQ ID NO: 894122 - DNA, 25 bp, Mus musculus
tggtcgtttattgcattcatggcgt

SEQ ID NO: 894123 - DNA, 25 bp, Mus musculus
tggtctaaacccatagcattgtagt

SEQ ID NO: 894124 - DNA, 25 bp, Mus musculus
tggtctaaacccttagcattgtagt

SEQ ID NO: 894125 - DNA, 25 bp, Mus musculus
tggtctaaacctaaactttgttcat

SEQ ID NO: 894126 - DNA, 25 bp, Mus musculus
tggtctaaaccttaactttgttcat

SEQ ID NO: 894127 - DNA, 25 bp, Mus musculus
tggtctaaactgcaacacttgctgt

SEQ ID NO: 894128 - DNA, 25 bp, Mus musculus
tggtctaaactggaacacttgctgt

SEQ ID NO: 894129 - DNA, 25 bp, Mus musculus
tggtctaaatcacccagtggcccac

SEQ ID NO: 894130 - DNA, 25 bp, Mus musculus
tggtctaaatcagccagtggcccac

SEQ ID NO: 894131 - DNA, 25 bp, Mus musculus
tggtctaagactatcttcctgcttg

SEQ ID NO: 894132 - DNA, 25 bp, Mus musculus
tggtctaagactttcttcctgcttg

SEQ ID NO: 894133 - DNA, 25 bp, Mus musculus
tggtctaagcatctcactggcccct

SEQ ID NO: 894134 - DNA, 25 bp, Mus musculus
tggtctaagcatgtcactggcccct

SEQ ID NO: 894135 - DNA, 25 bp, Mus musculus
tggtctaagggactgaatcatctct

SEQ ID NO: 894136 - DNA, 25 bp, Mus musculus
tggtctaagggagtgaatcatctct

SEQ ID NO: 894137 - DNA, 25 bp, Mus musculus
tggtctaatagtataaagctttggg

SEQ ID NO: 894138 - DNA, 25 bp, Mus musculus
tggtctaatagtttaaagctttggg

SEQ ID NO: 894139 - DNA, 25 bp, Mus musculus
tggtctaatgttcccttgcttacta

SEQ ID NO: 894140 - DNA, 25 bp, Mus musculus
tggtctaatgttgccttgcttacta

SEQ ID NO: 894141 - DNA, 25 bp, Mus musculus
tggtctacagccagttccaatcctg

SEQ ID NO: 894142 - DNA, 25 bp, Mus musculus
tggtctacagcctgttccaatcctg

SEQ ID NO: 894143 - DNA, 25 bp, Mus musculus
tggtctacatatacctaacacagcc

SEQ ID NO: 894144 - DNA, 25 bp, Mus musculus
tggtctacatattcctaacacagcc

SEQ ID NO: 894145 - DNA, 25 bp, Mus musculus
tggtctacccggctgccatgtttgc

SEQ ID NO: 894146 - DNA, 25 bp, Mus musculus
tggtctacccgggtgccatgtttgc

SEQ ID NO: 894147 - DNA, 25 bp, Mus musculus
tggtctacctaacaagttcccagcc

SEQ ID NO: 894148 - DNA, 25 bp, Mus musculus
tggtctacctaagaagttcccagcc

SEQ ID NO: 894149 - DNA, 25 bp, Mus musculus
tggtctacctgcagaatgccactga

SEQ ID NO: 894150 - DNA, 25 bp, Mus musculus
tggtctacctgctgaatgccactga

SEQ ID NO: 894151 - DNA, 25 bp, Mus musculus
tggtctacgctaacctgcctggtgc

SEQ ID NO: 894152 - DNA, 25 bp, Mus musculus
tggtctacgctatcctgcctggtgc

SEQ ID NO: 894153 - DNA, 25 bp, Mus musculus
tggtctactgggagctggcccgcat

SEQ ID NO: 894154 - DNA, 25 bp, Mus musculus
tggtctactgggtgctggcccgcat

SEQ ID NO: 894155 - DNA, 25 bp, Mus musculus
tggtctactgtaacccagcatcctc

SEQ ID NO: 894156 - DNA, 25 bp, Mus musculus
tggtctactgtatcccagcatcctc

SEQ ID NO: 894157 - DNA, 25 bp, Mus musculus
tggtctagagccaccctaccaacat

SEQ ID NO: 894158 - DNA, 25 bp, Mus musculus
tggtctagagcctccctaccaacat

SEQ ID NO: 894159 - DNA, 25 bp, Mus musculus
tggtctagagctcgccaagaagcac

SEQ ID NO: 894160 - DNA, 25 bp, Mus musculus
tggtctagagctggccaagaagcac

SEQ ID NO: 894161 - DNA, 25 bp, Mus musculus
tggtctagcgttccggaagattctc

SEQ ID NO: 894162 - DNA, 25 bp, Mus musculus
tggtctagcgttgcggaagattctc

SEQ ID NO: 894163 - DNA, 25 bp, Mus musculus
tggtctagctccaacattctttgac

SEQ ID NO: 894164 - DNA, 25 bp, Mus musculus
tggtctagctcctacattctttgac

SEQ ID NO: 894165 - DNA, 25 bp, Mus musculus
tggtctagtccaccagagacaagct

SEQ ID NO: 894166 - DNA, 25 bp, Mus musculus
tggtctagtccagcagagacaagct

SEQ ID NO: 894167 - DNA, 25 bp, Mus musculus
tggtctatcaccaggaatcctcatg

SEQ ID NO: 894168 - DNA, 25 bp, Mus musculus
tggtctatcacctggaatcctcatg

SEQ ID NO: 894169 - DNA, 25 bp, Mus musculus
tggtctatcggtatgtctatgggag

SEQ ID NO: 894170 - DNA, 25 bp, Mus musculus
tggtctatcggtttgtctatgggag

SEQ ID NO: 894171 - DNA, 25 bp, Mus musculus
tggtctatctaccatcccgtttgtt

SEQ ID NO: 894172 - DNA, 25 bp, Mus musculus
tggtctatctacgatcccgtttgtt

SEQ ID NO: 894173 - DNA, 25 bp, Mus musculus
tggtctatgaccattccatccgagg

SEQ ID NO: 894174 - DNA, 25 bp, Mus musculus
tggtctatgacctttccatccgagg

SEQ ID NO: 894175 - DNA, 25 bp, Mus musculus
tggtctatgcttctccaccaggcta

SEQ ID NO: 894176 - DNA, 25 bp, Mus musculus
tggtctatgcttgtccaccaggcta

SEQ ID NO: 894177 - DNA, 25 bp, Mus musculus
tggtctatgggcaccacaacagaga

SEQ ID NO: 894178 - DNA, 25 bp, Mus musculus
tggtctatgggctccacaacagaga

SEQ ID NO: 894179 - DNA, 25 bp, Mus musculus
tggtctatggttcccaaatgttaat

SEQ ID NO: 894180 - DNA, 25 bp, Mus musculus
tggtctatggttgccaaatgttaat

SEQ ID NO: 894181 - DNA, 25 bp, Mus musculus
tggtctattccacagttgccacgga

SEQ ID NO: 894182 - DNA, 25 bp, Mus musculus
tggtctattccagagttgccacgga

SEQ ID NO: 894183 - DNA, 25 bp, Mus musculus
tggtctatttccagctctgactgtg

SEQ ID NO: 894184 - DNA, 25 bp, Mus musculus
tggtctatttcctgctctgactgtg

SEQ ID NO: 894185 - DNA, 25 bp, Mus musculus
tggtctcaaatgaatgtgccttagc

SEQ ID NO: 894186 - DNA, 25 bp, Mus musculus
tggtctcaaatgtatgtgccttagc

SEQ ID NO: 894187 - DNA, 25 bp, Mus musculus
tggtctcaactgacatggctttttc

SEQ ID NO: 894188 - DNA, 25 bp, Mus musculus
tggtctcaactgtcatggctttttc

SEQ ID NO: 894189 - DNA, 25 bp, Mus musculus
tggtctcacatgaactgagccagga

SEQ ID NO: 894190 - DNA, 25 bp, Mus musculus
tggtctcacatgtactgagccagga

SEQ ID NO: 894191 - DNA, 25 bp, Mus musculus
tggtctcaccctccttgttaatcaa

SEQ ID NO: 894192 - DNA, 25 bp, Mus musculus
tggtctcaccctgcttgttaatcaa

SEQ ID NO: 894193 - DNA, 25 bp, Mus musculus
tggtctcaccttcttcagccagaat

SEQ ID NO: 894194 - DNA, 25 bp, Mus musculus
tggtctcaccttgttcagccagaat

SEQ ID NO: 894195 - DNA, 25 bp, Mus musculus
tggtctcacggtctcatggtctcgg

SEQ ID NO: 894196 - DNA, 25 bp, Mus musculus
tggtctcacggtgtcatggtctcgg

SEQ ID NO: 894197 - DNA, 25 bp, Mus musculus
tggtctcactacacactttaaggat

SEQ ID NO: 894198 - DNA, 25 bp, Mus musculus
tggtctcactactcactttaaggat

SEQ ID NO: 894199 - DNA, 25 bp, Mus musculus
tggtctcactgtccttgggaagccc

SEQ ID NO: 894200 - DNA, 25 bp, Mus musculus
tggtctcactgtcgcagccaggttc

SEQ ID NO: 894201 - DNA, 25 bp, Mus musculus
tggtctcactgtgcttgggaagccc

SEQ ID NO: 894202 - DNA, 25 bp, Mus musculus
tggtctcactgtggcagccaggttc

SEQ ID NO: 894203 - DNA, 25 bp, Mus musculus
tggtctcactttacacactgactgg

SEQ ID NO: 894204 - DNA, 25 bp, Mus musculus
tggtctcacttttcacactgactgg

SEQ ID NO: 894205 - DNA, 25 bp, Mus musculus
tggtctcagaagatttgtcagcctg

SEQ ID NO: 894206 - DNA, 25 bp, Mus musculus
tggtctcagaagttttgtcagcctg

SEQ ID NO: 894207 - DNA, 25 bp, Mus musculus
tggtctcagaccatgatgacatgct

SEQ ID NO: 894208 - DNA, 25 bp, Mus musculus
tggtctcagaccttgatgacatgct

SEQ ID NO: 894209 - DNA, 25 bp, Mus musculus
tggtctcagagaattgccctaggtt

SEQ ID NO: 894210 - DNA, 25 bp, Mus musculus
tggtctcagagatttgccctaggtt

SEQ ID NO: 894211 - DNA, 25 bp, Mus musculus
tggtctcagcaaagcacctgtttta

SEQ ID NO: 894212 - DNA, 25 bp, Mus musculus
tggtctcagcaatgcacctgtttta

SEQ ID NO: 894213 - DNA, 25 bp, Mus musculus
tggtctcagcagaaactacccttga

SEQ ID NO: 894214 - DNA, 25 bp, Mus musculus
tggtctcagcagtaactacccttga

SEQ ID NO: 894215 - DNA, 25 bp, Mus musculus
tggtctcagcctagccagagggatc

SEQ ID NO: 894216 - DNA, 25 bp, Mus musculus
tggtctcagccttgccagagggatc

SEQ ID NO: 894217 - DNA, 25 bp, Mus musculus
tggtctcaggctactatggtttgct

SEQ ID NO: 894218 - DNA, 25 bp, Mus musculus
tggtctcaggctaggaggctcccca

SEQ ID NO: 894219 - DNA, 25 bp, Mus musculus
tggtctcaggcttctatggtttgct

SEQ ID NO: 894220 - DNA, 25 bp, Mus musculus
tggtctcaggcttggaggctcccca

SEQ ID NO: 894221 - DNA, 25 bp, Mus musculus
tggtctcagtggattacgaaatttt

SEQ ID NO: 894222 - DNA, 25 bp, Mus musculus
tggtctcagtggtttacgaaatttt

SEQ ID NO: 894223 - DNA, 25 bp, Mus musculus
tggtctcatatactaagatctcact

SEQ ID NO: 894224 - DNA, 25 bp, Mus musculus
tggtctcatatagtaagatctcact

SEQ ID NO: 894225 - DNA, 25 bp, Mus musculus
tggtctcatccgctccttctgtgag

SEQ ID NO: 894226 - DNA, 25 bp, Mus musculus
tggtctcatccggtccttctgtgag

SEQ ID NO: 894227 - DNA, 25 bp, Mus musculus
tggtctcatgtacttttacggacag

SEQ ID NO: 894228 - DNA, 25 bp, Mus musculus
tggtctcatgtagttttacggacag

SEQ ID NO: 894229 - DNA, 25 bp, Mus musculus
tggtctcattcaccccaaatatact

SEQ ID NO: 894230 - DNA, 25 bp, Mus musculus
tggtctcattcagcccaaatatact

SEQ ID NO: 894231 - DNA, 25 bp, Mus musculus
tggtctccacacagaacagtctcag

SEQ ID NO: 894232 - DNA, 25 bp, Mus musculus
tggtctccacactgaacagtctcag

SEQ ID NO: 894233 - DNA, 25 bp, Mus musculus
tggtctccagcaatcacccaatgga

SEQ ID NO: 894234 - DNA, 25 bp, Mus musculus
tggtctccagcattcacccaatgga

SEQ ID NO: 894235 - DNA, 25 bp, Mus musculus
tggtctccagccagaagtccagcag

SEQ ID NO: 894236 - DNA, 25 bp, Mus musculus
tggtctccagcctgaagtccagcag

SEQ ID NO: 894237 - DNA, 25 bp, Mus musculus
tggtctccagttcgttgtagtgttg

SEQ ID NO: 894238 - DNA, 25 bp, Mus musculus
tggtctccagttggttgtagtgttg

SEQ ID NO: 894239 - DNA, 25 bp, Mus musculus
tggtctccatcacgccgatcactat

SEQ ID NO: 894240 - DNA, 25 bp, Mus musculus
tggtctccatcaggccgatcactat

SEQ ID NO: 894241 - DNA, 25 bp, Mus musculus
tggtctccattgctacaaacagctc

SEQ ID NO: 894242 - DNA, 25 bp, Mus musculus
tggtctccattggtacaaacagctc

SEQ ID NO: 894243 - DNA, 25 bp, Mus musculus
tggtctcccatacttgttcctagtt

SEQ ID NO: 894244 - DNA, 25 bp, Mus musculus
tggtctcccatagttgttcctagtt

SEQ ID NO: 894245 - DNA, 25 bp, Mus musculus
tggtctccccaaagtgagcagacaa

SEQ ID NO: 894246 - DNA, 25 bp, Mus musculus
tggtctccccaatgtgagcagacaa

SEQ ID NO: 894247 - DNA, 25 bp, Mus musculus
tggtctccccacaataaggagctga

SEQ ID NO: 894248 - DNA, 25 bp, Mus musculus
tggtctccccactataaggagctga

SEQ ID NO: 894249 - DNA, 25 bp, Mus musculus
tggtctcccgtcctagaagctctac

SEQ ID NO: 894250 - DNA, 25 bp, Mus musculus
tggtctcccgtcgtagaagctctac

SEQ ID NO: 894251 - DNA, 25 bp, Mus musculus
tggtctcccgttcggaaattgacat

SEQ ID NO: 894252 - DNA, 25 bp, Mus musculus
tggtctcccgttgggaaattgacat

SEQ ID NO: 894253 - DNA, 25 bp, Mus musculus
tggtctccctctccgaggagaaaag

SEQ ID NO: 894254 - DNA, 25 bp, Mus musculus
tggtctccctctgcgaggagaaaag

SEQ ID NO: 894255 - DNA, 25 bp, Mus musculus
tggtctccctttattggacaaggct

SEQ ID NO: 894256 - DNA, 25 bp, Mus musculus
tggtctcccttttttggacaaggct

SEQ ID NO: 894257 - DNA, 25 bp, Mus musculus
tggtctccgcaaaagtgaggactct

SEQ ID NO: 894258 - DNA, 25 bp, Mus musculus
tggtctccgcaatagtgaggactct

SEQ ID NO: 894259 - DNA, 25 bp, Mus musculus
tggtctccgtccagtatcctaagcc

SEQ ID NO: 894260 - DNA, 25 bp, Mus musculus
tggtctccgtcctgtatcctaagcc

SEQ ID NO: 894261 - DNA, 25 bp, Mus musculus
tggtctcctgagctcttagctcgct

SEQ ID NO: 894262 - DNA, 25 bp, Mus musculus
tggtctcctgaggtcttagctcgct

SEQ ID NO: 894263 - DNA, 25 bp, Mus musculus
tggtctcctgcaatctgtgattaca

SEQ ID NO: 894264 - DNA, 25 bp, Mus musculus
tggtctcctgcattctgtgattaca

SEQ ID NO: 894265 - DNA, 25 bp, Mus musculus
tggtctcgaacactcaacatatgat

SEQ ID NO: 894266 - DNA, 25 bp, Mus musculus
tggtctcgaacagtcaacatatgat

SEQ ID NO: 894267 - DNA, 25 bp, Mus musculus
tggtctcgccatcgaagtgcacaga

SEQ ID NO: 894268 - DNA, 25 bp, Mus musculus
tggtctcgccatggaagtgcacaga

SEQ ID NO: 894269 - DNA, 25 bp, Mus musculus
tggtctcgctttcgtaaacggttct

SEQ ID NO: 894270 - DNA, 25 bp, Mus musculus
tggtctcgctttggtaaacggttct

SEQ ID NO: 894271 - DNA, 25 bp, Mus musculus
tggtctcggagaacatgctgtgtgc

SEQ ID NO: 894272 - DNA, 25 bp, Mus musculus
tggtctcggagatcatgctgtgtgc

SEQ ID NO: 894273 - DNA, 25 bp, Mus musculus
tggtctcgtcgtcggttaactgtaa

SEQ ID NO: 894274 - DNA, 25 bp, Mus musculus
tggtctcgtcgtgggttaactgtaa

SEQ ID NO: 894275 - DNA, 25 bp, Mus musculus
tggtctctaaacacaccaaacggtt

SEQ ID NO: 894276 - DNA, 25 bp, Mus musculus
tggtctctaaactcaccaaacggtt

SEQ ID NO: 894277 - DNA, 25 bp, Mus musculus
tggtctctaaccagtagtgctacct

SEQ ID NO: 894278 - DNA, 25 bp, Mus musculus
tggtctctaacctgtagtgctacct

SEQ ID NO: 894279 - DNA, 25 bp, Mus musculus
tggtctctatagagcccacctaaga

SEQ ID NO: 894280 - DNA, 25 bp, Mus musculus
tggtctctatagtgcccacctaaga

SEQ ID NO: 894281 - DNA, 25 bp, Mus musculus
tggtctctatccatgccatccggaa

SEQ ID NO: 894282 - DNA, 25 bp, Mus musculus
tggtctctatccttgccatccggaa

SEQ ID NO: 894283 - DNA, 25 bp, Mus musculus
tggtctctcataagtatttttgtac

SEQ ID NO: 894284 - DNA, 25 bp, Mus musculus
tggtctctcatatgtatttttgtac

SEQ ID NO: 894285 - DNA, 25 bp, Mus musculus
tggtctctccacagggacgagtagt

SEQ ID NO: 894286 - DNA, 25 bp, Mus musculus
tggtctctccactgggacgagtagt

SEQ ID NO: 894287 - DNA, 25 bp, Mus musculus
tggtctctccagagtcccagggtgg

SEQ ID NO: 894288 - DNA, 25 bp, Mus musculus
tggtctctccagtgtcccagggtgg

SEQ ID NO: 894289 - DNA, 25 bp, Mus musculus
tggtctctcccaacatatacactgt

SEQ ID NO: 894290 - DNA, 25 bp, Mus musculus
tggtctctcccatcatatacactgt

SEQ ID NO: 894291 - DNA, 25 bp, Mus musculus
tggtctctcctcaagatgctgtgat

SEQ ID NO: 894292 - DNA, 25 bp, Mus musculus
tggtctctcctctagatgctgtgat

SEQ ID NO: 894293 - DNA, 25 bp, Mus musculus
tggtctctcctgacacgtgatcaca

SEQ ID NO: 894294 - DNA, 25 bp, Mus musculus
tggtctctcctgtcacgtgatcaca

SEQ ID NO: 894295 - DNA, 25 bp, Mus musculus
tggtctctcttcactttcacagagc

SEQ ID NO: 894296 - DNA, 25 bp, Mus musculus
tggtctctcttctctttcacagagc

SEQ ID NO: 894297 - DNA, 25 bp, Mus musculus
tggtctctctttcatcactgtgtga

SEQ ID NO: 894298 - DNA, 25 bp, Mus musculus
tggtctctctttgatcactgtgtga

SEQ ID NO: 894299 - DNA, 25 bp, Mus musculus
tggtctctgaatcggcctctttcta

SEQ ID NO: 894300 - DNA, 25 bp, Mus musculus
tggtctctgaatgggcctctttcta

SEQ ID NO: 894301 - DNA, 25 bp, Mus musculus
tggtctctgaccagaacatcacagt

SEQ ID NO: 894302 - DNA, 25 bp, Mus musculus
tggtctctgacctgaacatcacagt

SEQ ID NO: 894303 - DNA, 25 bp, Mus musculus
tggtctctgaggactctgctcgaag

SEQ ID NO: 894304 - DNA, 25 bp, Mus musculus
tggtctctgaggacttggtggccaa

SEQ ID NO: 894305 - DNA, 25 bp, Mus musculus
tggtctctgaggtctctgctcgaag

SEQ ID NO: 894306 - DNA, 25 bp, Mus musculus
tggtctctgaggtcttggtggccaa

SEQ ID NO: 894307 - DNA, 25 bp, Mus musculus
tggtctctggagacctgatggccaa

SEQ ID NO: 894308 - DNA, 25 bp, Mus musculus
tggtctctggagtcctgatggccaa

SEQ ID NO: 894309 - DNA, 25 bp, Mus musculus
tggtctctgtatattcaccccatac

SEQ ID NO: 894310 - DNA, 25 bp, Mus musculus
tggtctctgtattttcaccccatac

SEQ ID NO: 894311 - DNA, 25 bp, Mus musculus
tggtctctgtgcacgggacaacgag

SEQ ID NO: 894312 - DNA, 25 bp, Mus musculus
tggtctctgtgctcgggacaacgag

SEQ ID NO: 894313 - DNA, 25 bp, Mus musculus
tggtctctgtggcttattcaaatag

SEQ ID NO: 894314 - DNA, 25 bp, Mus musculus
tggtctctgtgggttattcaaatag

SEQ ID NO: 894315 - DNA, 25 bp, Mus musculus
tggtctctgttcagtccactgttca

SEQ ID NO: 894316 - DNA, 25 bp, Mus musculus
tggtctctgttctgtccactgttca

SEQ ID NO: 894317 - DNA, 25 bp, Mus musculus
tggtctctgtttaatgttgaaaggg

SEQ ID NO: 894318 - DNA, 25 bp, Mus musculus
tggtctctgtttccgtgtgctgatt

SEQ ID NO: 894319 - DNA, 25 bp, Mus musculus
tggtctctgtttgcgtgtgctgatt

SEQ ID NO: 894320 - DNA, 25 bp, Mus musculus
tggtctctgttttatgttgaaaggg

SEQ ID NO: 894321 - DNA, 25 bp, Mus musculus
tggtctcttaggagctaaggcctct

SEQ ID NO: 894322 - DNA, 25 bp, Mus musculus
tggtctcttaggtgctaaggcctct

SEQ ID NO: 894323 - DNA, 25 bp, Mus musculus
tggtctcttattcctttatctggag

SEQ ID NO: 894324 - DNA, 25 bp, Mus musculus
tggtctcttattgctttatctggag

SEQ ID NO: 894325 - DNA, 25 bp, Mus musculus
tggtctcttgccaagattacaacct

SEQ ID NO: 894326 - DNA, 25 bp, Mus musculus
tggtctcttgcctagattacaacct

SEQ ID NO: 894327 - DNA, 25 bp, Mus musculus
tggtctcttgtcagtttaaccctga

SEQ ID NO: 894328 - DNA, 25 bp, Mus musculus
tggtctcttgtctgtttaaccctga

SEQ ID NO: 894329 - DNA, 25 bp, Mus musculus
tggtctgaagctcaggccacagtgc

SEQ ID NO: 894330 - DNA, 25 bp, Mus musculus
tggtctgaagctgaggccacagtgc

SEQ ID NO: 894331 - DNA, 25 bp, Mus musculus
tggtctgacctcacaactttggtgc

SEQ ID NO: 894332 - DNA, 25 bp, Mus musculus
tggtctgacctctcaactttggtgc

SEQ ID NO: 894333 - DNA, 25 bp, Mus musculus
tggtctgacgcactgagttgcttcc

SEQ ID NO: 894334 - DNA, 25 bp, Mus musculus
tggtctgacgcagtgagttgcttcc

SEQ ID NO: 894335 - DNA, 25 bp, Mus musculus
tggtctgagcataggctgcctggca

SEQ ID NO: 894336 - DNA, 25 bp, Mus musculus
tggtctgagcattggctgcctggca

SEQ ID NO: 894337 - DNA, 25 bp, Mus musculus
tggtctgaggaaatgacactctgta

SEQ ID NO: 894338 - DNA, 25 bp, Mus musculus
tggtctgaggaattgacactctgta

SEQ ID NO: 894339 - DNA, 25 bp, Mus musculus
tggtctgagggcatcagctatgcag

SEQ ID NO: 894340 - DNA, 25 bp, Mus musculus
tggtctgagggcttcagctatgcag

SEQ ID NO: 894341 - DNA, 25 bp, Mus musculus
tggtctgagggtcctgatcactgtc

SEQ ID NO: 894342 - DNA, 25 bp, Mus musculus
tggtctgagggtgctgatcactgtc

SEQ ID NO: 894343 - DNA, 25 bp, Mus musculus
tggtctgagtctagaccctcagcaa

SEQ ID NO: 894344 - DNA, 25 bp, Mus musculus
tggtctgagtcttgaccctcagcaa

SEQ ID NO: 894345 - DNA, 25 bp, Mus musculus
tggtctgattggactgcactcacag

SEQ ID NO: 894346 - DNA, 25 bp, Mus musculus
tggtctgattggtctgcactcacag

SEQ ID NO: 894347 - DNA, 25 bp, Mus musculus
tggtctgcaacgcatctcttcaagg

SEQ ID NO: 894348 - DNA, 25 bp, Mus musculus
tggtctgcaacggatctcttcaagg

SEQ ID NO: 894349 - DNA, 25 bp, Mus musculus
tggtctgcaagcctgtcacctgtag

SEQ ID NO: 894350 - DNA, 25 bp, Mus musculus
tggtctgcaagcgtgtcacctgtag

SEQ ID NO: 894351 - DNA, 25 bp, Mus musculus
tggtctgcaattccgccttataatc

SEQ ID NO: 894352 - DNA, 25 bp, Mus musculus
tggtctgcaattgcgccttataatc

SEQ ID NO: 894353 - DNA, 25 bp, Mus musculus
tggtctgcagagatacatgatgaga

SEQ ID NO: 894354 - DNA, 25 bp, Mus musculus
tggtctgcagagttacatgatgaga

SEQ ID NO: 894355 - DNA, 25 bp, Mus musculus
tggtctgcagccagaactgagtgct

SEQ ID NO: 894356 - DNA, 25 bp, Mus musculus
tggtctgcagcctgaactgagtgct

SEQ ID NO: 894357 - DNA, 25 bp, Mus musculus
tggtctgcatgacagcctatccttc

SEQ ID NO: 894358 - DNA, 25 bp, Mus musculus
tggtctgcatgagagcctatccttc

SEQ ID NO: 894359 - DNA, 25 bp, Mus musculus
tggtctgccaagagagcgctcagga

SEQ ID NO: 894360 - DNA, 25 bp, Mus musculus
tggtctgccaagtgagcgctcagga

SEQ ID NO: 894361 - DNA, 25 bp, Mus musculus
tggtctgccattctcaagtcctgat

SEQ ID NO: 894362 - DNA, 25 bp, Mus musculus
tggtctgccattgtcaagtcctgat

SEQ ID NO: 894363 - DNA, 25 bp, Mus musculus
tggtctgcgaaaccctctgcgaaca

SEQ ID NO: 894364 - DNA, 25 bp, Mus musculus
tggtctgcgaaagcctctgcgaaca

SEQ ID NO: 894365 - DNA, 25 bp, Mus musculus
tggtctgctcacattgctcaggcca

SEQ ID NO: 894366 - DNA, 25 bp, Mus musculus
tggtctgctcactttgctcaggcca

SEQ ID NO: 894367 - DNA, 25 bp, Mus musculus
tggtctgctcccctgagggcctgtt

SEQ ID NO: 894368 - DNA, 25 bp, Mus musculus
tggtctgctcccgtgagggcctgtt

SEQ ID NO: 894369 - DNA, 25 bp, Mus musculus
tggtctgctctgagcctgtcatgtc

SEQ ID NO: 894370 - DNA, 25 bp, Mus musculus
tggtctgctctgtgcctgtcatgtc

SEQ ID NO: 894371 - DNA, 25 bp, Mus musculus
tggtctgctcttcagatggcacatg

SEQ ID NO: 894372 - DNA, 25 bp, Mus musculus
tggtctgctcttgagatggcacatg

SEQ ID NO: 894373 - DNA, 25 bp, Mus musculus
tggtctgctggtccaccttcttgac

SEQ ID NO: 894374 - DNA, 25 bp, Mus musculus
tggtctgctggtgcaccttcttgac

SEQ ID NO: 894375 - DNA, 25 bp, Mus musculus
tggtctgcttccagaatagcttctg

SEQ ID NO: 894376 - DNA, 25 bp, Mus musculus
tggtctgcttcctgaatagcttctg

SEQ ID NO: 894377 - DNA, 25 bp, Mus musculus
tggtctggaactccttaaacttgta

SEQ ID NO: 894378 - DNA, 25 bp, Mus musculus
tggtctggaactgcttaaacttgta

SEQ ID NO: 894379 - DNA, 25 bp, Mus musculus
tggtctggacaactttgggaacttt

SEQ ID NO: 894380 - DNA, 25 bp, Mus musculus
tggtctggacaagtttgggaacttt

SEQ ID NO: 894381 - DNA, 25 bp, Mus musculus
tggtctggccgtaaagtctttgctg

SEQ ID NO: 894382 - DNA, 25 bp, Mus musculus
tggtctggccgttaagtctttgctg

SEQ ID NO: 894383 - DNA, 25 bp, Mus musculus
tggtctgggtaacctctccacgatt

SEQ ID NO: 894384 - DNA, 25 bp, Mus musculus
tggtctgggtaagctctccacgatt

SEQ ID NO: 894385 - DNA, 25 bp, Mus musculus
tggtctggtcagacaggatggaaca

SEQ ID NO: 894386 - DNA, 25 bp, Mus musculus
tggtctggtcagtcaggatggaaca

SEQ ID NO: 894387 - DNA, 25 bp, Mus musculus
tggtctggtccaatcggcatctgca

SEQ ID NO: 894388 - DNA, 25 bp, Mus musculus
tggtctggtccattcggcatctgca

SEQ ID NO: 894389 - DNA, 25 bp, Mus musculus
tggtctggtgatatcttatctcctt

SEQ ID NO: 894390 - DNA, 25 bp, Mus musculus
tggtctggtgatttcttatctcctt

SEQ ID NO: 894391 - DNA, 25 bp, Mus musculus
tggtctggtttcacagttctgggaa

SEQ ID NO: 894392 - DNA, 25 bp, Mus musculus
tggtctggtttctcagttctgggaa

SEQ ID NO: 894393 - DNA, 25 bp, Mus musculus
tggtctgtaagactcaagctgctga

SEQ ID NO: 894394 - DNA, 25 bp, Mus musculus
tggtctgtaagagtcaagctgctga

SEQ ID NO: 894395 - DNA, 25 bp, Mus musculus
tggtctgtaagcaccatcagccctg

SEQ ID NO: 894396 - DNA, 25 bp, Mus musculus
tggtctgtaagctccatcagccctg

SEQ ID NO: 894397 - DNA, 25 bp, Mus musculus
tggtctgtacccagccaattactta

SEQ ID NO: 894398 - DNA, 25 bp, Mus musculus
tggtctgtaccctgccaattactta

SEQ ID NO: 894399 - DNA, 25 bp, Mus musculus
tggtctgtacttcctagtccggcat

SEQ ID NO: 894400 - DNA, 25 bp, Mus musculus
tggtctgtacttgctagtccggcat

SEQ ID NO: 894401 - DNA, 25 bp, Mus musculus
tggtctgtccctaagttgtaactat

SEQ ID NO: 894402 - DNA, 25 bp, Mus musculus
tggtctgtcccttagttgtaactat

SEQ ID NO: 894403 - DNA, 25 bp, Mus musculus
tggtctgtcctcactgtctgttaca

SEQ ID NO: 894404 - DNA, 25 bp, Mus musculus
tggtctgtcctctctgtctgttaca

SEQ ID NO: 894405 - DNA, 25 bp, Mus musculus
tggtctgtctcgctgacccagagag

SEQ ID NO: 894406 - DNA, 25 bp, Mus musculus
tggtctgtctcggtgacccagagag

SEQ ID NO: 894407 - DNA, 25 bp, Mus musculus
tggtctgtctgtaccatagatagac

SEQ ID NO: 894408 - DNA, 25 bp, Mus musculus
tggtctgtctgttccatagatagac

SEQ ID NO: 894409 - DNA, 25 bp, Mus musculus
tggtctgtgacactccgtttgtata

SEQ ID NO: 894410 - DNA, 25 bp, Mus musculus
tggtctgtgacagtccgtttgtata

SEQ ID NO: 894411 - DNA, 25 bp, Mus musculus
tggtctgtggagcttcagcatgccc

SEQ ID NO: 894412 - DNA, 25 bp, Mus musculus
tggtctgtggaggttcagcatgccc

SEQ ID NO: 894413 - DNA, 25 bp, Mus musculus
tggtctgtgggcaagttcctagttt

SEQ ID NO: 894414 - DNA, 25 bp, Mus musculus
tggtctgtgggctagttcctagttt

SEQ ID NO: 894415 - DNA, 25 bp, Mus musculus
tggtctgtggtgagagggctattat

SEQ ID NO: 894416 - DNA, 25 bp, Mus musculus
tggtctgtggtgtgagggctattat

SEQ ID NO: 894417 - DNA, 25 bp, Mus musculus
tggtctgtgtccaaaacggaactta

SEQ ID NO: 894418 - DNA, 25 bp, Mus musculus
tggtctgtgtcctaaacggaactta

SEQ ID NO: 894419 - DNA, 25 bp, Mus musculus
tggtctgtgtttactctatgggatt

SEQ ID NO: 894420 - DNA, 25 bp, Mus musculus
tggtctgtgttttctctatgggatt

SEQ ID NO: 894421 - DNA, 25 bp, Mus musculus
tggtctgttagaaaatgcctttgtt

SEQ ID NO: 894422 - DNA, 25 bp, Mus musculus
tggtctgttagataatgcctttgtt

SEQ ID NO: 894423 - DNA, 25 bp, Mus musculus
tggtctgttcataaaattccctttt

SEQ ID NO: 894424 - DNA, 25 bp, Mus musculus
tggtctgttcattaaattccctttt

SEQ ID NO: 894425 - DNA, 25 bp, Mus musculus
tggtctgttcttagagccgatcttc

SEQ ID NO: 894426 - DNA, 25 bp, Mus musculus
tggtctgttctttgagccgatcttc

SEQ ID NO: 894427 - DNA, 25 bp, Mus musculus
tggtctgttgctccaagtcctaaca

SEQ ID NO: 894428 - DNA, 25 bp, Mus musculus
tggtctgttgctgcaagtcctaaca

SEQ ID NO: 894429 - DNA, 25 bp, Mus musculus
tggtcttaaacactgtgcccttctg

SEQ ID NO: 894430 - DNA, 25 bp, Mus musculus
tggtcttaaacagtgtgcccttctg

SEQ ID NO: 894431 - DNA, 25 bp, Mus musculus
tggtcttaagacaccccagttaacg

SEQ ID NO: 894432 - DNA, 25 bp, Mus musculus
tggtcttaagactccccagttaacg

SEQ ID NO: 894433 - DNA, 25 bp, Mus musculus
tggtcttactggcttttgagaggtt

SEQ ID NO: 894434 - DNA, 25 bp, Mus musculus
tggtcttactgggttttgagaggtt

SEQ ID NO: 894435 - DNA, 25 bp, Mus musculus
tggtcttagcctagtcagtttatag

SEQ ID NO: 894436 - DNA, 25 bp, Mus musculus
tggtcttagccttgtcagtttatag

SEQ ID NO: 894437 - DNA, 25 bp, Mus musculus
tggtcttatccacagtccagtccac

SEQ ID NO: 894438 - DNA, 25 bp, Mus musculus
tggtcttatccagagtccagtccac

SEQ ID NO: 894439 - DNA, 25 bp, Mus musculus
tggtcttcaacaatgctccagagta

SEQ ID NO: 894440 - DNA, 25 bp, Mus musculus
tggtcttcaacattgctccagagta

SEQ ID NO: 894441 - DNA, 25 bp, Mus musculus
tggtcttcacaaacgcctgtacaca

SEQ ID NO: 894442 - DNA, 25 bp, Mus musculus
tggtcttcacaatcgcctgtacaca

SEQ ID NO: 894443 - DNA, 25 bp, Mus musculus
tggtcttcacgtccgcagaaagggt

SEQ ID NO: 894444 - DNA, 25 bp, Mus musculus
tggtcttcacgtgcgcagaaagggt

SEQ ID NO: 894445 - DNA, 25 bp, Mus musculus
tggtcttcaggtatgagcctttggg

SEQ ID NO: 894446 - DNA, 25 bp, Mus musculus
tggtcttcaggtttgagcctttggg

SEQ ID NO: 894447 - DNA, 25 bp, Mus musculus
tggtcttcatgtcgaacttataata

SEQ ID NO: 894448 - DNA, 25 bp, Mus musculus
tggtcttcatgtggaacttataata

SEQ ID NO: 894449 - DNA, 25 bp, Mus musculus
tggtcttccacaagcgtgcgcaaca

SEQ ID NO: 894450 - DNA, 25 bp, Mus musculus
tggtcttccacatgcgtgcgcaaca

SEQ ID NO: 894451 - DNA, 25 bp, Mus musculus
tggtcttccccactctttagaggtt

SEQ ID NO: 894452 - DNA, 25 bp, Mus musculus
tggtcttccccagtctttagaggtt

SEQ ID NO: 894453 - DNA, 25 bp, Mus musculus
tggtcttccctgctgacaggattaa

SEQ ID NO: 894454 - DNA, 25 bp, Mus musculus
tggtcttccctggtgacaggattaa

SEQ ID NO: 894455 - DNA, 25 bp, Mus musculus
tggtcttccgacagcaaattgttgc

SEQ ID NO: 894456 - DNA, 25 bp, Mus musculus
tggtcttccgacatactggagtgat

SEQ ID NO: 894457 - DNA, 25 bp, Mus musculus
tggtcttccgactgcaaattgttgc

SEQ ID NO: 894458 - DNA, 25 bp, Mus musculus
tggtcttccgacttactggagtgat

SEQ ID NO: 894459 - DNA, 25 bp, Mus musculus
tggtcttcctacagcttgtggcaat

SEQ ID NO: 894460 - DNA, 25 bp, Mus musculus
tggtcttcctactgcttgtggcaat

SEQ ID NO: 894461 - DNA, 25 bp, Mus musculus
tggtcttcctggcaatggcatgcac

SEQ ID NO: 894462 - DNA, 25 bp, Mus musculus
tggtcttcctggcagaatcttttag

SEQ ID NO: 894463 - DNA, 25 bp, Mus musculus
tggtcttcctgggaatggcatgcac

SEQ ID NO: 894464 - DNA, 25 bp, Mus musculus
tggtcttcctgggagaatcttttag

SEQ ID NO: 894465 - DNA, 25 bp, Mus musculus
tggtcttccttcagtggtggttgcc

SEQ ID NO: 894466 - DNA, 25 bp, Mus musculus
tggtcttccttctgtggtggttgcc

SEQ ID NO: 894467 - DNA, 25 bp, Mus musculus
tggtcttcgagacgagcgccaagca

SEQ ID NO: 894468 - DNA, 25 bp, Mus musculus
tggtcttcgagaggagcgccaagca

SEQ ID NO: 894469 - DNA, 25 bp, Mus musculus
tggtcttcgggaaagcattgcctct

SEQ ID NO: 894470 - DNA, 25 bp, Mus musculus
tggtcttcgggatagcattgcctct

SEQ ID NO: 894471 - DNA, 25 bp, Mus musculus
tggtcttcgggtctcgacaatccaa

SEQ ID NO: 894472 - DNA, 25 bp, Mus musculus
tggtcttcgggtgtcgacaatccaa

SEQ ID NO: 894473 - DNA, 25 bp, Mus musculus
tggtcttctcgcctgctgtagttgc

SEQ ID NO: 894474 - DNA, 25 bp, Mus musculus
tggtcttctcgcgtgctgtagttgc

SEQ ID NO: 894475 - DNA, 25 bp, Mus musculus
tggtcttctgaacgatgagggtctt

SEQ ID NO: 894476 - DNA, 25 bp, Mus musculus
tggtcttctgaaggatgagggtctt

SEQ ID NO: 894477 - DNA, 25 bp, Mus musculus
tggtcttctgtgagccttgggtgcc

SEQ ID NO: 894478 - DNA, 25 bp, Mus musculus
tggtcttctgtgtgccttgggtgcc

SEQ ID NO: 894479 - DNA, 25 bp, Mus musculus
tggtcttcttagctgattcctgtga

SEQ ID NO: 894480 - DNA, 25 bp, Mus musculus
tggtcttcttaggtgattcctgtga

SEQ ID NO: 894481 - DNA, 25 bp, Mus musculus
tggtcttcttatatcccagaataga

SEQ ID NO: 894482 - DNA, 25 bp, Mus musculus
tggtcttcttatttcccagaataga

SEQ ID NO: 894483 - DNA, 25 bp, Mus musculus
tggtcttgaagcctctctaagtgaa

SEQ ID NO: 894484 - DNA, 25 bp, Mus musculus
tggtcttgaagcgtctctaagtgaa

SEQ ID NO: 894485 - DNA, 25 bp, Mus musculus
tggtcttgacacaccccaaatcaga

SEQ ID NO: 894486 - DNA, 25 bp, Mus musculus
tggtcttgacactccccaaatcaga

SEQ ID NO: 894487 - DNA, 25 bp, Mus musculus
tggtcttgatttattgaccctcccg

SEQ ID NO: 894488 - DNA, 25 bp, Mus musculus
tggtcttgattttttgaccctcccg

SEQ ID NO: 894489 - DNA, 25 bp, Mus musculus
tggtcttgcacactggtagttccca

SEQ ID NO: 894490 - DNA, 25 bp, Mus musculus
tggtcttgcacagtggtagttccca

SEQ ID NO: 894491 - DNA, 25 bp, Mus musculus
tggtcttgctagatccactaaaccc

SEQ ID NO: 894492 - DNA, 25 bp, Mus musculus
tggtcttgctagttccactaaaccc

SEQ ID NO: 894493 - DNA, 25 bp, Mus musculus
tggtcttgcttgagtttgtcatttc

SEQ ID NO: 894494 - DNA, 25 bp, Mus musculus
tggtcttgcttgtgtttgtcatttc

SEQ ID NO: 894495 - DNA, 25 bp, Mus musculus
tggtcttggaccatctgccaaccaa

SEQ ID NO: 894496 - DNA, 25 bp, Mus musculus
tggtcttggaccttctgccaaccaa

SEQ ID NO: 894497 - DNA, 25 bp, Mus musculus
tggtcttggactcacatgcttgatc

SEQ ID NO: 894498 - DNA, 25 bp, Mus musculus
tggtcttggactgacatgcttgatc

SEQ ID NO: 894499 - DNA, 25 bp, Mus musculus
tggtcttggagcacagcacgaaggc

SEQ ID NO: 894500 - DNA, 25 bp, Mus musculus
tggtcttggagcagccagagctaca

SEQ ID NO: 894501 - DNA, 25 bp, Mus musculus
tggtcttggagctcagcacgaaggc

SEQ ID NO: 894502 - DNA, 25 bp, Mus musculus
tggtcttggagctgccagagctaca

SEQ ID NO: 894503 - DNA, 25 bp, Mus musculus
tggtcttggaggacttttccagtgc

SEQ ID NO: 894504 - DNA, 25 bp, Mus musculus
tggtcttggaggcatctcgttccac

SEQ ID NO: 894505 - DNA, 25 bp, Mus musculus
tggtcttggagggatctcgttccac

SEQ ID NO: 894506 - DNA, 25 bp, Mus musculus
tggtcttggaggtcttttccagtgc

SEQ ID NO: 894507 - DNA, 25 bp, Mus musculus
tggtcttggatgaatccctctctgc

SEQ ID NO: 894508 - DNA, 25 bp, Mus musculus
tggtcttggatgtatccctctctgc

SEQ ID NO: 894509 - DNA, 25 bp, Mus musculus
tggtcttgtagccacttttgcagtg

SEQ ID NO: 894510 - DNA, 25 bp, Mus musculus
tggtcttgtagcgacttttgcagtg

SEQ ID NO: 894511 - DNA, 25 bp, Mus musculus
tggtctttaatgagccctgttggga

SEQ ID NO: 894512 - DNA, 25 bp, Mus musculus
tggtctttaatgtgccctgttggga

SEQ ID NO: 894513 - DNA, 25 bp, Mus musculus
tggtctttatttctccctcaagtaa

SEQ ID NO: 894514 - DNA, 25 bp, Mus musculus
tggtctttatttgtccctcaagtaa

SEQ ID NO: 894515 - DNA, 25 bp, Mus musculus
tggtctttcaccatctcttagagat

SEQ ID NO: 894516 - DNA, 25 bp, Mus musculus
tggtctttcaccttctcttagagat

SEQ ID NO: 894517 - DNA, 25 bp, Mus musculus
tggtctttccgtactgtttctttag

SEQ ID NO: 894518 - DNA, 25 bp, Mus musculus
tggtctttccgttctgtttctttag

SEQ ID NO: 894519 - DNA, 25 bp, Mus musculus
tggtctttccttaagagctccgtct

SEQ ID NO: 894520 - DNA, 25 bp, Mus musculus
tggtctttcctttagagctccgtct

SEQ ID NO: 894521 - DNA, 25 bp, Mus musculus
tggtctttcgaaacattggtgctta

SEQ ID NO: 894522 - DNA, 25 bp, Mus musculus
tggtctttcgaatcattggtgctta

SEQ ID NO: 894523 - DNA, 25 bp, Mus musculus
tggtctttcgccagtgcatgtgccg

SEQ ID NO: 894524 - DNA, 25 bp, Mus musculus
tggtctttcgcctgtgcatgtgccg

SEQ ID NO: 894525 - DNA, 25 bp, Mus musculus
tggtctttctgtaacatccaaccca

SEQ ID NO: 894526 - DNA, 25 bp, Mus musculus
tggtctttctgtaaccccagtataa

SEQ ID NO: 894527 - DNA, 25 bp, Mus musculus
tggtctttctgttacatccaaccca

SEQ ID NO: 894528 - DNA, 25 bp, Mus musculus
tggtctttctgttaccccagtataa

SEQ ID NO: 894529 - DNA, 25 bp, Mus musculus
tggtctttggtgatctgggctgaaa

SEQ ID NO: 894530 - DNA, 25 bp, Mus musculus
tggtctttggtgttctgggctgaaa

SEQ ID NO: 894531 - DNA, 25 bp, Mus musculus
tggtctttgtctatggcagtattcc

SEQ ID NO: 894532 - DNA, 25 bp, Mus musculus
tggtctttgtctttggcagtattcc

SEQ ID NO: 894533 - DNA, 25 bp, Mus musculus
tggtcttttgggactcatgcataga

SEQ ID NO: 894534 - DNA, 25 bp, Mus musculus
tggtcttttgggtctcatgcataga

SEQ ID NO: 894535 - DNA, 25 bp, Mus musculus
tggtctttttctctccaacctgtct

SEQ ID NO: 894536 - DNA, 25 bp, Mus musculus
tggtctttttctgtccaacctgtct

SEQ ID NO: 894537 - DNA, 25 bp, Mus musculus
tggtctttttgcactcattgtagga

SEQ ID NO: 894538 - DNA, 25 bp, Mus musculus
tggtctttttgctctcattgtagga

SEQ ID NO: 894539 - DNA, 25 bp, Mus musculus
tggtcttttttgcaccaaagccagt

SEQ ID NO: 894540 - DNA, 25 bp, Mus musculus
tggtcttttttggaccaaagccagt

SEQ ID NO: 894541 - DNA, 25 bp, Mus musculus
tggtgaaaccttagactcacacaaa

SEQ ID NO: 894542 - DNA, 25 bp, Mus musculus
tggtgaaacctttgactcacacaaa

SEQ ID NO: 894543 - DNA, 25 bp, Mus musculus
tggtgaaactggaataacccttttg

SEQ ID NO: 894544 - DNA, 25 bp, Mus musculus
tggtgaaactggtataacccttttg

SEQ ID NO: 894545 - DNA, 25 bp, Mus musculus
tggtgaaagctccagacagcctctg

SEQ ID NO: 894546 - DNA, 25 bp, Mus musculus
tggtgaaagctcgagacagcctctg

SEQ ID NO: 894547 - DNA, 25 bp, Mus musculus
tggtgaaatcctcccgtggcccgga

SEQ ID NO: 894548 - DNA, 25 bp, Mus musculus
tggtgaaatcctgccgtggcccgga

SEQ ID NO: 894549 - DNA, 25 bp, Mus musculus
tggtgaaatgacaccctcccgggtg

SEQ ID NO: 894550 - DNA, 25 bp, Mus musculus
tggtgaaatgactccctcccgggtg

SEQ ID NO: 894551 - DNA, 25 bp, Mus musculus
tggtgaacattgaacgccctccctc

SEQ ID NO: 894552 - DNA, 25 bp, Mus musculus
tggtgaacattgtacgccctccctc

SEQ ID NO: 894553 - DNA, 25 bp, Mus musculus
tggtgaaccagcaccgcgactccta

SEQ ID NO: 894554 - DNA, 25 bp, Mus musculus
tggtgaaccagctccgcgactccta

SEQ ID NO: 894555 - DNA, 25 bp, Mus musculus
tggtgaacccataggcctatctgaa

SEQ ID NO: 894556 - DNA, 25 bp, Mus musculus
tggtgaacccattggcctatctgaa

SEQ ID NO: 894557 - DNA, 25 bp, Mus musculus
tggtgaacgggcagacactgctgtc

SEQ ID NO: 894558 - DNA, 25 bp, Mus musculus
tggtgaacgggctgacactgctgtc

SEQ ID NO: 894559 - DNA, 25 bp, Mus musculus
tggtgaacgtcgagcccaagctcaa

SEQ ID NO: 894560 - DNA, 25 bp, Mus musculus
tggtgaacgtcgtgcccaagctcaa

SEQ ID NO: 894561 - DNA, 25 bp, Mus musculus
tggtgaacgtgcctaaaacccgccg

SEQ ID NO: 894562 - DNA, 25 bp, Mus musculus
tggtgaacgtgcgtaaaacccgccg

SEQ ID NO: 894563 - DNA, 25 bp, Mus musculus
tggtgaactgcacaattgggatcac

SEQ ID NO: 894564 - DNA, 25 bp, Mus musculus
tggtgaactgcagaattgggatcac

SEQ ID NO: 894565 - DNA, 25 bp, Mus musculus
tggtgaacttatctgggtcccagtc

SEQ ID NO: 894566 - DNA, 25 bp, Mus musculus
tggtgaacttatgtgggtcccagtc

SEQ ID NO: 894567 - DNA, 25 bp, Mus musculus
tggtgaacttcaatgtgcccttgac

SEQ ID NO: 894568 - DNA, 25 bp, Mus musculus
tggtgaacttcattgtgcccttgac

SEQ ID NO: 894569 - DNA, 25 bp, Mus musculus
tggtgaagaacacctgtgtcttgta

SEQ ID NO: 894570 - DNA, 25 bp, Mus musculus
tggtgaagaacagctgtgtcttgta

SEQ ID NO: 894571 - DNA, 25 bp, Mus musculus
tggtgaagacctacgctgctctgaa

SEQ ID NO: 894572 - DNA, 25 bp, Mus musculus
tggtgaagaccttcgctgctctgaa

SEQ ID NO: 894573 - DNA, 25 bp, Mus musculus
tggtgaagagcaagggcatccccga

SEQ ID NO: 894574 - DNA, 25 bp, Mus musculus
tggtgaagagcatgggcatccccga

SEQ ID NO: 894575 - DNA, 25 bp, Mus musculus
tggtgaagaggcacaccctaagtgt

SEQ ID NO: 894576 - DNA, 25 bp, Mus musculus
tggtgaagaggctcaccctaagtgt

SEQ ID NO: 894577 - DNA, 25 bp, Mus musculus
tggtgaagatgaatcctgatcctgt

SEQ ID NO: 894578 - DNA, 25 bp, Mus musculus
tggtgaagatgattcctgatcctgt

SEQ ID NO: 894579 - DNA, 25 bp, Mus musculus
tggtgaagcacaccgcgtattacga

SEQ ID NO: 894580 - DNA, 25 bp, Mus musculus
tggtgaagcacagcgcgtattacga

SEQ ID NO: 894581 - DNA, 25 bp, Mus musculus
tggtgaagcaccatctcttcagctg

SEQ ID NO: 894582 - DNA, 25 bp, Mus musculus
tggtgaagcaccttctcttcagctg

SEQ ID NO: 894583 - DNA, 25 bp, Mus musculus
tggtgaagccttactttgcatgttt

SEQ ID NO: 894584 - DNA, 25 bp, Mus musculus
tggtgaagcctttctttgcatgttt

SEQ ID NO: 894585 - DNA, 25 bp, Mus musculus
tggtgaagctcaacaggtccctatc

SEQ ID NO: 894586 - DNA, 25 bp, Mus musculus
tggtgaagctcactcagtacctcaa

SEQ ID NO: 894587 - DNA, 25 bp, Mus musculus
tggtgaagctcagtcagtacctcaa

SEQ ID NO: 894588 - DNA, 25 bp, Mus musculus
tggtgaagctcatcaggtccctatc

SEQ ID NO: 894589 - DNA, 25 bp, Mus musculus
tggtgaagctccagctatccaggac

SEQ ID NO: 894590 - DNA, 25 bp, Mus musculus
tggtgaagctcctgctatccaggac

SEQ ID NO: 894591 - DNA, 25 bp, Mus musculus
tggtgaagcttacccaattatcaaa

SEQ ID NO: 894592 - DNA, 25 bp, Mus musculus
tggtgaagcttagccaattatcaaa

SEQ ID NO: 894593 - DNA, 25 bp, Mus musculus
tggtgaaggatgaccactacctcta

SEQ ID NO: 894594 - DNA, 25 bp, Mus musculus
tggtgaaggatgtccactacctcta

SEQ ID NO: 894595 - DNA, 25 bp, Mus musculus
tggtgaaggtgaaaggcacgccgct

SEQ ID NO: 894596 - DNA, 25 bp, Mus musculus
tggtgaaggtgataggcacgccgct

SEQ ID NO: 894597 - DNA, 25 bp, Mus musculus
tggtgaagtctaatgtggacatttt

SEQ ID NO: 894598 - DNA, 25 bp, Mus musculus
tggtgaagtctattgtggacatttt

SEQ ID NO: 894599 - DNA, 25 bp, Mus musculus
tggtgaagtctcactgcgccaagca

SEQ ID NO: 894600 - DNA, 25 bp, Mus musculus
tggtgaagtctctctgcgccaagca

SEQ ID NO: 894601 - DNA, 25 bp, Mus musculus
tggtgaagtgcactaagctggaaac

SEQ ID NO: 894602 - DNA, 25 bp, Mus musculus
tggtgaagtgcagtaagctggaaac

SEQ ID NO: 894603 - DNA, 25 bp, Mus musculus
tggtgaagttcgacagcagagtgct

SEQ ID NO: 894604 - DNA, 25 bp, Mus musculus
tggtgaagttcgtcagcagagtgct

SEQ ID NO: 894605 - DNA, 25 bp, Mus musculus
tggtgaatatagaagaaacgcctct

SEQ ID NO: 894606 - DNA, 25 bp, Mus musculus
tggtgaatatagtagaaacgcctct

SEQ ID NO: 894607 - DNA, 25 bp, Mus musculus
tggtgaatctttacttgcgtgatca

SEQ ID NO: 894608 - DNA, 25 bp, Mus musculus
tggtgaatcttttcttgcgtgatca

SEQ ID NO: 894609 - DNA, 25 bp, Mus musculus
tggtgaatgcatatgatccctgccc

SEQ ID NO: 894610 - DNA, 25 bp, Mus musculus
tggtgaatgcatccttctgtggtag

SEQ ID NO: 894611 - DNA, 25 bp, Mus musculus
tggtgaatgcatgcttctgtggtag

SEQ ID NO: 894612 - DNA, 25 bp, Mus musculus
tggtgaatgcatttgatccctgccc

SEQ ID NO: 894613 - DNA, 25 bp, Mus musculus
tggtgaatgccgcaattccagccta

SEQ ID NO: 894614 - DNA, 25 bp, Mus musculus
tggtgaatgccggaattccagccta

SEQ ID NO: 894615 - DNA, 25 bp, Mus musculus
tggtgaatgcctacttggccaaccc

SEQ ID NO: 894616 - DNA, 25 bp, Mus musculus
tggtgaatgccttcttggccaaccc

SEQ ID NO: 894617 - DNA, 25 bp, Mus musculus
tggtgaatttccaggctctcctgtg

SEQ ID NO: 894618 - DNA, 25 bp, Mus musculus
tggtgaatttcctggctctcctgtg

SEQ ID NO: 894619 - DNA, 25 bp, Mus musculus
tggtgaatttttcttctcttaacca

SEQ ID NO: 894620 - DNA, 25 bp, Mus musculus
tggtgaatttttgttctcttaacca

SEQ ID NO: 894621 - DNA, 25 bp, Mus musculus
tggtgacaagccaatgacccttttg

SEQ ID NO: 894622 - DNA, 25 bp, Mus musculus
tggtgacaagcctatgacccttttg

SEQ ID NO: 894623 - DNA, 25 bp, Mus musculus
tggtgacacctccttcaattatatt

SEQ ID NO: 894624 - DNA, 25 bp, Mus musculus
tggtgacacctcgttcaattatatt

SEQ ID NO: 894625 - DNA, 25 bp, Mus musculus
tggtgacacctgattcacagcagtt

SEQ ID NO: 894626 - DNA, 25 bp, Mus musculus
tggtgacacctgtttcacagcagtt

SEQ ID NO: 894627 - DNA, 25 bp, Mus musculus
tggtgacaccttcggttctgtttta

SEQ ID NO: 894628 - DNA, 25 bp, Mus musculus
tggtgacaccttgggttctgtttta

SEQ ID NO: 894629 - DNA, 25 bp, Mus musculus
tggtgacagctactgaagtcgcccc

SEQ ID NO: 894630 - DNA, 25 bp, Mus musculus
tggtgacagctagtgaagtcgcccc

SEQ ID NO: 894631 - DNA, 25 bp, Mus musculus
tggtgacatccccaatatggaggat

SEQ ID NO: 894632 - DNA, 25 bp, Mus musculus
tggtgacatcccgaatatggaggat

SEQ ID NO: 894633 - DNA, 25 bp, Mus musculus
tggtgacatcctacccaacgagaca

SEQ ID NO: 894634 - DNA, 25 bp, Mus musculus
tggtgacatccttcccaacgagaca

SEQ ID NO: 894635 - DNA, 25 bp, Mus musculus
tggtgacatggaaacactttgtgtg

SEQ ID NO: 894636 - DNA, 25 bp, Mus musculus
tggtgacatggatacactttgtgtg

SEQ ID NO: 894637 - DNA, 25 bp, Mus musculus
tggtgacattgcacagttcaacctg

SEQ ID NO: 894638 - DNA, 25 bp, Mus musculus
tggtgacattgctcagttcaacctg

SEQ ID NO: 894639 - DNA, 25 bp, Mus musculus
tggtgaccaaaaactacttctagtg

SEQ ID NO: 894640 - DNA, 25 bp, Mus musculus
tggtgaccaaaatctacttctagtg

SEQ ID NO: 894641 - DNA, 25 bp, Mus musculus
tggtgaccaactcctataggatttt

SEQ ID NO: 894642 - DNA, 25 bp, Mus musculus
tggtgaccaactgctataggatttt

SEQ ID NO: 894643 - DNA, 25 bp, Mus musculus
tggtgaccactaccgccatgggtag

SEQ ID NO: 894644 - DNA, 25 bp, Mus musculus
tggtgaccactagcgccatgggtag

SEQ ID NO: 894645 - DNA, 25 bp, Mus musculus
tggtgaccagacattgccggatcat

SEQ ID NO: 894646 - DNA, 25 bp, Mus musculus
tggtgaccagactttgccggatcat

SEQ ID NO: 894647 - DNA, 25 bp, Mus musculus
tggtgaccagatcgttgaaatcaat

SEQ ID NO: 894648 - DNA, 25 bp, Mus musculus
tggtgaccagatggttgaaatcaat

SEQ ID NO: 894649 - DNA, 25 bp, Mus musculus
tggtgaccagccattttttgagaca

SEQ ID NO: 894650 - DNA, 25 bp, Mus musculus
tggtgaccagcctttttttgagaca

SEQ ID NO: 894651 - DNA, 25 bp, Mus musculus
tggtgaccagtcactgagctgtgcg

SEQ ID NO: 894652 - DNA, 25 bp, Mus musculus
tggtgaccagtctctgagctgtgcg

SEQ ID NO: 894653 - DNA, 25 bp, Mus musculus
tggtgaccatgcctttaaccccgaa

SEQ ID NO: 894654 - DNA, 25 bp, Mus musculus
tggtgaccatgcgtttaaccccgaa

SEQ ID NO: 894655 - DNA, 25 bp, Mus musculus
tggtgacccagactacactctaaca

SEQ ID NO: 894656 - DNA, 25 bp, Mus musculus
tggtgacccagagtacactctaaca

SEQ ID NO: 894657 - DNA, 25 bp, Mus musculus
tggtgacccgagaggctgttacaga

SEQ ID NO: 894658 - DNA, 25 bp, Mus musculus
tggtgacccgagtggctgttacaga

SEQ ID NO: 894659 - DNA, 25 bp, Mus musculus
tggtgacccggccaaaccgcgttca

SEQ ID NO: 894660 - DNA, 25 bp, Mus musculus
tggtgacccggcgaaaccgcgttca

SEQ ID NO: 894661 - DNA, 25 bp, Mus musculus
tggtgaccgcaacttcggctttgct

SEQ ID NO: 894662 - DNA, 25 bp, Mus musculus
tggtgaccgcaagttcggctttgct

SEQ ID NO: 894663 - DNA, 25 bp, Mus musculus
tggtgaccgcatctcagctcaggat

SEQ ID NO: 894664 - DNA, 25 bp, Mus musculus
tggtgaccgcatgtcagctcaggat

SEQ ID NO: 894665 - DNA, 25 bp, Mus musculus
tggtgaccggaaccccagaggcctc

SEQ ID NO: 894666 - DNA, 25 bp, Mus musculus
tggtgaccggaagcccagaggcctc

SEQ ID NO: 894667 - DNA, 25 bp, Mus musculus
tggtgaccggccacttcagtctgag

SEQ ID NO: 894668 - DNA, 25 bp, Mus musculus
tggtgaccggcctcttcagtctgag

SEQ ID NO: 894669 - DNA, 25 bp, Mus musculus
tggtgacctccgataattcctggga

SEQ ID NO: 894670 - DNA, 25 bp, Mus musculus
tggtgacctccgttaattcctggga

SEQ ID NO: 894671 - DNA, 25 bp, Mus musculus
tggtgacctgacaagtgcctggcac

SEQ ID NO: 894672 - DNA, 25 bp, Mus musculus
tggtgacctgacacgggacaaggaa

SEQ ID NO: 894673 - DNA, 25 bp, Mus musculus
tggtgacctgactagtgcctggcac

SEQ ID NO: 894674 - DNA, 25 bp, Mus musculus
tggtgacctgactcgggacaaggaa

SEQ ID NO: 894675 - DNA, 25 bp, Mus musculus
tggtgacctgtcacttctgcaagac

SEQ ID NO: 894676 - DNA, 25 bp, Mus musculus
tggtgacctgtctcttctgcaagac

SEQ ID NO: 894677 - DNA, 25 bp, Mus musculus
tggtgaccttacctgtctacctgaa

SEQ ID NO: 894678 - DNA, 25 bp, Mus musculus
tggtgaccttacgtgtctacctgaa

SEQ ID NO: 894679 - DNA, 25 bp, Mus musculus
tggtgaccttcaaacttccttagga

SEQ ID NO: 894680 - DNA, 25 bp, Mus musculus
tggtgaccttcatacttccttagga

SEQ ID NO: 894681 - DNA, 25 bp, Mus musculus
tggtgacctttgctttcagcgagaa

SEQ ID NO: 894682 - DNA, 25 bp, Mus musculus
tggtgacctttggtttcagcgagaa

SEQ ID NO: 894683 - DNA, 25 bp, Mus musculus
tggtgacgactgcatcagtgtgaat

SEQ ID NO: 894684 - DNA, 25 bp, Mus musculus
tggtgacgactggatcagtgtgaat

SEQ ID NO: 894685 - DNA, 25 bp, Mus musculus
tggtgacgatttacccaggatcatt

SEQ ID NO: 894686 - DNA, 25 bp, Mus musculus
tggtgacgattttcccaggatcatt

SEQ ID NO: 894687 - DNA, 25 bp, Mus musculus
tggtgacgctgccttggaatttgca

SEQ ID NO: 894688 - DNA, 25 bp, Mus musculus
tggtgacgctgcgttggaatttgca

SEQ ID NO: 894689 - DNA, 25 bp, Mus musculus
tggtgacgctggacccacgcctgtg

SEQ ID NO: 894690 - DNA, 25 bp, Mus musculus
tggtgacgctggtcccacgcctgtg

SEQ ID NO: 894691 - DNA, 25 bp, Mus musculus
tggtgacggcaccatcacaaccaag

SEQ ID NO: 894692 - DNA, 25 bp, Mus musculus
tggtgacggcacgatcacaaccaag

SEQ ID NO: 894693 - DNA, 25 bp, Mus musculus
tggtgacggtttcctttcggtcgct

SEQ ID NO: 894694 - DNA, 25 bp, Mus musculus
tggtgacggtttgctttcggtcgct

SEQ ID NO: 894695 - DNA, 25 bp, Mus musculus
tggtgactaaggctcacctccaact

SEQ ID NO: 894696 - DNA, 25 bp, Mus musculus
tggtgactaagggtcacctccaact

SEQ ID NO: 894697 - DNA, 25 bp, Mus musculus
tggtgactaccccactgcaagtgtc

SEQ ID NO: 894698 - DNA, 25 bp, Mus musculus
tggtgactacccgactgcaagtgtc

SEQ ID NO: 894699 - DNA, 25 bp, Mus musculus
tggtgactactgcagacttcttccc

SEQ ID NO: 894700 - DNA, 25 bp, Mus musculus
tggtgactactggagacttcttccc

SEQ ID NO: 894701 - DNA, 25 bp, Mus musculus
tggtgactattcaaaatgctgattc

SEQ ID NO: 894702 - DNA, 25 bp, Mus musculus
tggtgactattctaaatgctgattc

SEQ ID NO: 894703 - DNA, 25 bp, Mus musculus
tggtgactcaacagacaggcacact

SEQ ID NO: 894704 - DNA, 25 bp, Mus musculus
tggtgactcaactgacaggcacact

SEQ ID NO: 894705 - DNA, 25 bp, Mus musculus
tggtgactcagtattggccgcacag

SEQ ID NO: 894706 - DNA, 25 bp, Mus musculus
tggtgactcagttttggccgcacag

SEQ ID NO: 894707 - DNA, 25 bp, Mus musculus
tggtgactcataacccatctttgga

SEQ ID NO: 894708 - DNA, 25 bp, Mus musculus
tggtgactcatatcccatctttgga

SEQ ID NO: 894709 - DNA, 25 bp, Mus musculus
tggtgactcccaaccttatctataa

SEQ ID NO: 894710 - DNA, 25 bp, Mus musculus
tggtgactcccatccttatctataa

SEQ ID NO: 894711 - DNA, 25 bp, Mus musculus
tggtgactctgactcgctaaatcta

SEQ ID NO: 894712 - DNA, 25 bp, Mus musculus
tggtgactctgagtcgctaaatcta

SEQ ID NO: 894713 - DNA, 25 bp, Mus musculus
tggtgactcttgacccccagactta

SEQ ID NO: 894714 - DNA, 25 bp, Mus musculus
tggtgactcttgtcccccagactta

SEQ ID NO: 894715 - DNA, 25 bp, Mus musculus
tggtgactgacaagagcgatgctga

SEQ ID NO: 894716 - DNA, 25 bp, Mus musculus
tggtgactgacatgagcgatgctga

SEQ ID NO: 894717 - DNA, 25 bp, Mus musculus
tggtgactgccaagtggactggact

SEQ ID NO: 894718 - DNA, 25 bp, Mus musculus
tggtgactgccatgtggactggact

SEQ ID NO: 894719 - DNA, 25 bp, Mus musculus
tggtgactgcgtacggacagctgcc

SEQ ID NO: 894720 - DNA, 25 bp, Mus musculus
tggtgactgcgttcggacagctgcc

SEQ ID NO: 894721 - DNA, 25 bp, Mus musculus
tggtgactgctgacctaaggctcaa

SEQ ID NO: 894722 - DNA, 25 bp, Mus musculus
tggtgactgctgtcctaaggctcaa

SEQ ID NO: 894723 - DNA, 25 bp, Mus musculus
tggtgactggcaaagcctttcccca

SEQ ID NO: 894724 - DNA, 25 bp, Mus musculus
tggtgactggcatagcctttcccca

SEQ ID NO: 894725 - DNA, 25 bp, Mus musculus
tggtgactgggtccgctacaagctc

SEQ ID NO: 894726 - DNA, 25 bp, Mus musculus
tggtgactgggtgcgctacaagctc

SEQ ID NO: 894727 - DNA, 25 bp, Mus musculus
tggtgactgtgtacagctgtgcacc

SEQ ID NO: 894728 - DNA, 25 bp, Mus musculus
tggtgactgtgttcagctgtgcacc

SEQ ID NO: 894729 - DNA, 25 bp, Mus musculus
tggtgacttcccagataccattcag

SEQ ID NO: 894730 - DNA, 25 bp, Mus musculus
tggtgacttccctgataccattcag

SEQ ID NO: 894731 - DNA, 25 bp, Mus musculus
tggtgacttgtgctgcatgcattat

SEQ ID NO: 894732 - DNA, 25 bp, Mus musculus
tggtgacttgtggtgcatgcattat

SEQ ID NO: 894733 - DNA, 25 bp, Mus musculus
tggtgactttggactgacagacatc

SEQ ID NO: 894734 - DNA, 25 bp, Mus musculus
tggtgactttggtctgacagacatc

SEQ ID NO: 894735 - DNA, 25 bp, Mus musculus
tggtgagaaaggacctcccagaggt

SEQ ID NO: 894736 - DNA, 25 bp, Mus musculus
tggtgagaaaggtcctcccagaggt

SEQ ID NO: 894737 - DNA, 25 bp, Mus musculus
tggtgagaccagagtgctgcgcctt

SEQ ID NO: 894738 - DNA, 25 bp, Mus musculus
tggtgagaccagtgtgctgcgcctt

SEQ ID NO: 894739 - DNA, 25 bp, Mus musculus
tggtgagagcaaagggccctccact

SEQ ID NO: 894740 - DNA, 25 bp, Mus musculus
tggtgagagcaatgggccctccact

SEQ ID NO: 894741 - DNA, 25 bp, Mus musculus
tggtgagagcatcgctttgcccaag

SEQ ID NO: 894742 - DNA, 25 bp, Mus musculus
tggtgagagcatggctttgcccaag

SEQ ID NO: 894743 - DNA, 25 bp, Mus musculus
tggtgagagctcctttgccaacaag

SEQ ID NO: 894744 - DNA, 25 bp, Mus musculus
tggtgagagctcgtttgccaacaag

SEQ ID NO: 894745 - DNA, 25 bp, Mus musculus
tggtgagagcttaccgctttcctgg

SEQ ID NO: 894746 - DNA, 25 bp, Mus musculus
tggtgagagctttccgctttcctgg

SEQ ID NO: 894747 - DNA, 25 bp, Mus musculus
tggtgagaggacacttcagcttcca

SEQ ID NO: 894748 - DNA, 25 bp, Mus musculus
tggtgagaggactcttcagcttcca

SEQ ID NO: 894749 - DNA, 25 bp, Mus musculus
tggtgagatggaccgcccacgcctt

SEQ ID NO: 894750 - DNA, 25 bp, Mus musculus
tggtgagatggagcgcccacgcctt

SEQ ID NO: 894751 - DNA, 25 bp, Mus musculus
tggtgagatggcacagtgggtaaga

SEQ ID NO: 894752 - DNA, 25 bp, Mus musculus
tggtgagatggcactccaggcccag

SEQ ID NO: 894753 - DNA, 25 bp, Mus musculus
tggtgagatggctcagtgggtaaga

SEQ ID NO: 894754 - DNA, 25 bp, Mus musculus
tggtgagatggctctccaggcccag

SEQ ID NO: 894755 - DNA, 25 bp, Mus musculus
tggtgagcacacattctgaaagctg

SEQ ID NO: 894756 - DNA, 25 bp, Mus musculus
tggtgagcacactttctgaaagctg

SEQ ID NO: 894757 - DNA, 25 bp, Mus musculus
tggtgagcccagaatgtccttagtc

SEQ ID NO: 894758 - DNA, 25 bp, Mus musculus
tggtgagcccagtatgtccttagtc

SEQ ID NO: 894759 - DNA, 25 bp, Mus musculus
tggtgagccgacagccggactcctc

SEQ ID NO: 894760 - DNA, 25 bp, Mus musculus
tggtgagccgactgccggactcctc

SEQ ID NO: 894761 - DNA, 25 bp, Mus musculus
tggtgagcgaccataccaatgtccc

SEQ ID NO: 894762 - DNA, 25 bp, Mus musculus
tggtgagcgaccttaccaatgtccc

SEQ ID NO: 894763 - DNA, 25 bp, Mus musculus
tggtgagctagactgtacacagcac

SEQ ID NO: 894764 - DNA, 25 bp, Mus musculus
tggtgagctagagtgtacacagcac

SEQ ID NO: 894765 - DNA, 25 bp, Mus musculus
tggtgagctccacatgacgcacatg

SEQ ID NO: 894766 - DNA, 25 bp, Mus musculus
tggtgagctccagatgacgcacatg

SEQ ID NO: 894767 - DNA, 25 bp, Mus musculus
tggtgagctcggcacgcaggatgcc

SEQ ID NO: 894768 - DNA, 25 bp, Mus musculus
tggtgagctcgggacgcaggatgcc

SEQ ID NO: 894769 - DNA, 25 bp, Mus musculus
tggtgagctgttccatactctggat

SEQ ID NO: 894770 - DNA, 25 bp, Mus musculus
tggtgagctgttgcatactctggat

SEQ ID NO: 894771 - DNA, 25 bp, Mus musculus
tggtgaggccatcttctatgaggta

SEQ ID NO: 894772 - DNA, 25 bp, Mus musculus
tggtgaggccatgttctatgaggta

SEQ ID NO: 894773 - DNA, 25 bp, Mus musculus
tggtgaggccttcacttaaagcttt

SEQ ID NO: 894774 - DNA, 25 bp, Mus musculus
tggtgaggccttgacttaaagcttt

SEQ ID NO: 894775 - DNA, 25 bp, Mus musculus
tggtgaggcgcccaaagtctcaggg

SEQ ID NO: 894776 - DNA, 25 bp, Mus musculus
tggtgaggcgccgaaagtctcaggg

SEQ ID NO: 894777 - DNA, 25 bp, Mus musculus
tggtgagggccacactcttacagtg

SEQ ID NO: 894778 - DNA, 25 bp, Mus musculus
tggtgagggccagactcttacagtg

SEQ ID NO: 894779 - DNA, 25 bp, Mus musculus
tggtgaggttagatagctctcccct

SEQ ID NO: 894780 - DNA, 25 bp, Mus musculus
tggtgaggttagttagctctcccct

SEQ ID NO: 894781 - DNA, 25 bp, Mus musculus
tggtgagtcactacttcagagcttt

SEQ ID NO: 894782 - DNA, 25 bp, Mus musculus
tggtgagtcacttcttcagagcttt

SEQ ID NO: 894783 - DNA, 25 bp, Mus musculus
tggtgagtcagaccatccttggtgt

SEQ ID NO: 894784 - DNA, 25 bp, Mus musculus
tggtgagtcagagcatccttggtgt

SEQ ID NO: 894785 - DNA, 25 bp, Mus musculus
tggtgagtgccactctccagactgc

SEQ ID NO: 894786 - DNA, 25 bp, Mus musculus
tggtgagtgccagtctccagactgc

SEQ ID NO: 894787 - DNA, 25 bp, Mus musculus
tggtgagtgcccagggagcacctca

SEQ ID NO: 894788 - DNA, 25 bp, Mus musculus
tggtgagtgccctgggagcacctca

SEQ ID NO: 894789 - DNA, 25 bp, Mus musculus
tggtgagttcccagccttcatggaa

SEQ ID NO: 894790 - DNA, 25 bp, Mus musculus
tggtgagttccctgccttcatggaa

SEQ ID NO: 894791 - DNA, 25 bp, Mus musculus
tggtgataagcactccctggaacct

SEQ ID NO: 894792 - DNA, 25 bp, Mus musculus
tggtgataagcagtccctggaacct

SEQ ID NO: 894793 - DNA, 25 bp, Mus musculus
tggtgataccaaccatccttgtgct

SEQ ID NO: 894794 - DNA, 25 bp, Mus musculus
tggtgataccaagcatccttgtgct

SEQ ID NO: 894795 - DNA, 25 bp, Mus musculus
tggtgatatacactgcagcagagct

SEQ ID NO: 894796 - DNA, 25 bp, Mus musculus
tggtgatatacagtgcagcagagct

SEQ ID NO: 894797 - DNA, 25 bp, Mus musculus
tggtgatatcctacataattttatg

SEQ ID NO: 894798 - DNA, 25 bp, Mus musculus
tggtgatatccttcataattttatg

SEQ ID NO: 894799 - DNA, 25 bp, Mus musculus
tggtgatcaagaacaagtcctgagt

SEQ ID NO: 894800 - DNA, 25 bp, Mus musculus
tggtgatcaagatcaagtcctgagt

SEQ ID NO: 894801 - DNA, 25 bp, Mus musculus
tggtgatcacacagaaattctctca

SEQ ID NO: 894802 - DNA, 25 bp, Mus musculus
tggtgatcacacctccattaacatc

SEQ ID NO: 894803 - DNA, 25 bp, Mus musculus
tggtgatcacacgtccattaacatc

SEQ ID NO: 894804 - DNA, 25 bp, Mus musculus
tggtgatcacactgaaattctctca

SEQ ID NO: 894805 - DNA, 25 bp, Mus musculus
tggtgatcactgacttctgtggtct

SEQ ID NO: 894806 - DNA, 25 bp, Mus musculus
tggtgatcactgtcttctgtggtct

SEQ ID NO: 894807 - DNA, 25 bp, Mus musculus
tggtgatccatacacacctggcttt

SEQ ID NO: 894808 - DNA, 25 bp, Mus musculus
tggtgatccatagacacctggcttt

SEQ ID NO: 894809 - DNA, 25 bp, Mus musculus
tggtgatccatgaccctcattagaa

SEQ ID NO: 894810 - DNA, 25 bp, Mus musculus
tggtgatccatgtccctcattagaa

SEQ ID NO: 894811 - DNA, 25 bp, Mus musculus
tggtgatcccttactggacacaaga

SEQ ID NO: 894812 - DNA, 25 bp, Mus musculus
tggtgatccctttctggacacaaga

SEQ ID NO: 894813 - DNA, 25 bp, Mus musculus
tggtgatcctaccaaagagcctgag

SEQ ID NO: 894814 - DNA, 25 bp, Mus musculus
tggtgatcctacgaaagagcctgag

SEQ ID NO: 894815 - DNA, 25 bp, Mus musculus
tggtgatcctccacagacacttcct

SEQ ID NO: 894816 - DNA, 25 bp, Mus musculus
tggtgatcctccctcacgcattgtg

SEQ ID NO: 894817 - DNA, 25 bp, Mus musculus
tggtgatcctccgtcacgcattgtg

SEQ ID NO: 894818 - DNA, 25 bp, Mus musculus
tggtgatcctcctcagacacttcct

SEQ ID NO: 894819 - DNA, 25 bp, Mus musculus
tggtgatcgcccacctttggtttta

SEQ ID NO: 894820 - DNA, 25 bp, Mus musculus
tggtgatcgccctcctttggtttta

SEQ ID NO: 894821 - DNA, 25 bp, Mus musculus
tggtgatctaagatcacgcctcctg

SEQ ID NO: 894822 - DNA, 25 bp, Mus musculus
tggtgatctaagttcacgcctcctg

SEQ ID NO: 894823 - DNA, 25 bp, Mus musculus
tggtgatctactccacttccatcaa

SEQ ID NO: 894824 - DNA, 25 bp, Mus musculus
tggtgatctactgcacttccatcaa

SEQ ID NO: 894825 - DNA, 25 bp, Mus musculus
tggtgatgaataaccacttctgtgg

SEQ ID NO: 894826 - DNA, 25 bp, Mus musculus
tggtgatgaatatccacttctgtgg

SEQ ID NO: 894827 - DNA, 25 bp, Mus musculus
tggtgatgaccgaggccaggtttta

SEQ ID NO: 894828 - DNA, 25 bp, Mus musculus
tggtgatgaccgtggccaggtttta

SEQ ID NO: 894829 - DNA, 25 bp, Mus musculus
tggtgatgcaccctactgagcccac

SEQ ID NO: 894830 - DNA, 25 bp, Mus musculus
tggtgatgcaccgtactgagcccac

SEQ ID NO: 894831 - DNA, 25 bp, Mus musculus
tggtgatgctggagacggttcctca

SEQ ID NO: 894832 - DNA, 25 bp, Mus musculus
tggtgatgctggtgacggttcctca

SEQ ID NO: 894833 - DNA, 25 bp, Mus musculus
tggtgatggctgattcacactgcct

SEQ ID NO: 894834 - DNA, 25 bp, Mus musculus
tggtgatggctgtttcacactgcct

SEQ ID NO: 894835 - DNA, 25 bp, Mus musculus
tggtgatgtgtcaagctctgacttt

SEQ ID NO: 894836 - DNA, 25 bp, Mus musculus
tggtgatgtgtctagctctgacttt

SEQ ID NO: 894837 - DNA, 25 bp, Mus musculus
tggtgattaactatgccggtttcct

SEQ ID NO: 894838 - DNA, 25 bp, Mus musculus
tggtgattaactttgccggtttcct

SEQ ID NO: 894839 - DNA, 25 bp, Mus musculus
tggtgattagtaccggcgactgccc

SEQ ID NO: 894840 - DNA, 25 bp, Mus musculus
tggtgattagtactctgataagcct

SEQ ID NO: 894841 - DNA, 25 bp, Mus musculus
tggtgattagtagcggcgactgccc

SEQ ID NO: 894842 - DNA, 25 bp, Mus musculus
tggtgattagtagtctgataagcct

SEQ ID NO: 894843 - DNA, 25 bp, Mus musculus
tggtgattctaacccagatggcatt

SEQ ID NO: 894844 - DNA, 25 bp, Mus musculus
tggtgattctaagccagatggcatt

SEQ ID NO: 894845 - DNA, 25 bp, Mus musculus
tggtgattcttccagatggcgtcca

SEQ ID NO: 894846 - DNA, 25 bp, Mus musculus
tggtgattcttcgagatggcgtcca

SEQ ID NO: 894847 - DNA, 25 bp, Mus musculus
tggtgattgcccacaggctgcacac

SEQ ID NO: 894848 - DNA, 25 bp, Mus musculus
tggtgattgcccagctgaaacctca

SEQ ID NO: 894849 - DNA, 25 bp, Mus musculus
tggtgattgccctcaggctgcacac

SEQ ID NO: 894850 - DNA, 25 bp, Mus musculus
tggtgattgccctgctgaaacctca

SEQ ID NO: 894851 - DNA, 25 bp, Mus musculus
tggtgattggagagcccatgtccac

SEQ ID NO: 894852 - DNA, 25 bp, Mus musculus
tggtgattggagtgcccatgtccac

SEQ ID NO: 894853 - DNA, 25 bp, Mus musculus
tggtgatttagaagtgaaacctcaa

SEQ ID NO: 894854 - DNA, 25 bp, Mus musculus
tggtgatttagatgtgaaacctcaa

SEQ ID NO: 894855 - DNA, 25 bp, Mus musculus
tggtgcaaacagcaaggctgcgact

SEQ ID NO: 894856 - DNA, 25 bp, Mus musculus
tggtgcaaacaggaaggctgcgact

SEQ ID NO: 894857 - DNA, 25 bp, Mus musculus
tggtgcaacgacaaccagagtcatt

SEQ ID NO: 894858 - DNA, 25 bp, Mus musculus
tggtgcaacgactaccagagtcatt

SEQ ID NO: 894859 - DNA, 25 bp, Mus musculus
tggtgcaagagacggctactactag

SEQ ID NO: 894860 - DNA, 25 bp, Mus musculus
tggtgcaagagagggctactactag

SEQ ID NO: 894861 - DNA, 25 bp, Mus musculus
tggtgcaagctgaacttcttctgct

SEQ ID NO: 894862 - DNA, 25 bp, Mus musculus
tggtgcaagctgtacttcttctgct

SEQ ID NO: 894863 - DNA, 25 bp, Mus musculus
tggtgcaagttgaggacttcttgct

SEQ ID NO: 894864 - DNA, 25 bp, Mus musculus
tggtgcaagttgtggacttcttgct

SEQ ID NO: 894865 - DNA, 25 bp, Mus musculus
tggtgcaatccaaacttattccagg

SEQ ID NO: 894866 - DNA, 25 bp, Mus musculus
tggtgcaatccatacttattccagg

SEQ ID NO: 894867 - DNA, 25 bp, Mus musculus
tggtgcacaactaacaacctctcta

SEQ ID NO: 894868 - DNA, 25 bp, Mus musculus
tggtgcacaacttacaacctctcta

SEQ ID NO: 894869 - DNA, 25 bp, Mus musculus
tggtgcacaaggaacattctatttt

SEQ ID NO: 894870 - DNA, 25 bp, Mus musculus
tggtgcacaaggtacattctatttt

SEQ ID NO: 894871 - DNA, 25 bp, Mus musculus
tggtgcacaattacttccctgaggc

SEQ ID NO: 894872 - DNA, 25 bp, Mus musculus
tggtgcacaatttcttccctgaggc

SEQ ID NO: 894873 - DNA, 25 bp, Mus musculus
tggtgcacacataggcctggcaggc

SEQ ID NO: 894874 - DNA, 25 bp, Mus musculus
tggtgcacacattggcctggcaggc

SEQ ID NO: 894875 - DNA, 25 bp, Mus musculus
tggtgcacactcacctttgaaggaa

SEQ ID NO: 894876 - DNA, 25 bp, Mus musculus
tggtgcacactctcctttgaaggaa

SEQ ID NO: 894877 - DNA, 25 bp, Mus musculus
tggtgcacactgaaaccttacttga

SEQ ID NO: 894878 - DNA, 25 bp, Mus musculus
tggtgcacactgtaaccttacttga

SEQ ID NO: 894879 - DNA, 25 bp, Mus musculus
tggtgcacagcaaatgcccctggga

SEQ ID NO: 894880 - DNA, 25 bp, Mus musculus
tggtgcacagcatatgcccctggga

SEQ ID NO: 894881 - DNA, 25 bp, Mus musculus
tggtgcacatcaatcagtctcggga

SEQ ID NO: 894882 - DNA, 25 bp, Mus musculus
tggtgcacatcaccttctgtaaaaa

SEQ ID NO: 894883 - DNA, 25 bp, Mus musculus
tggtgcacatcagcttctgtaaaaa

SEQ ID NO: 894884 - DNA, 25 bp, Mus musculus
tggtgcacatcattcagtctcggga

SEQ ID NO: 894885 - DNA, 25 bp, Mus musculus
tggtgcacattgagtgctctggaca

SEQ ID NO: 894886 - DNA, 25 bp, Mus musculus
tggtgcacattgtgtgctctggaca

SEQ ID NO: 894887 - DNA, 25 bp, Mus musculus
tggtgcaccaccattctgtgaatct

SEQ ID NO: 894888 - DNA, 25 bp, Mus musculus
tggtgcaccaccattgtattctaag

SEQ ID NO: 894889 - DNA, 25 bp, Mus musculus
tggtgcaccacctttctgtgaatct

SEQ ID NO: 894890 - DNA, 25 bp, Mus musculus
tggtgcaccacctttgtattctaag

SEQ ID NO: 894891 - DNA, 25 bp, Mus musculus
tggtgcacccaacagcatccatgac

SEQ ID NO: 894892 - DNA, 25 bp, Mus musculus
tggtgcacccaagagcatccatgac

SEQ ID NO: 894893 - DNA, 25 bp, Mus musculus
tggtgcacccttcttgttgtttgaa

SEQ ID NO: 894894 - DNA, 25 bp, Mus musculus
tggtgcacccttgttgttgtttgaa

SEQ ID NO: 894895 - DNA, 25 bp, Mus musculus
tggtgcaccgtaacctactagagaa

SEQ ID NO: 894896 - DNA, 25 bp, Mus musculus
tggtgcaccgtatcctactagagaa

SEQ ID NO: 894897 - DNA, 25 bp, Mus musculus
tggtgcacctccaatctgaagatgt

SEQ ID NO: 894898 - DNA, 25 bp, Mus musculus
tggtgcacctcctatctgaagatgt

SEQ ID NO: 894899 - DNA, 25 bp, Mus musculus
tggtgcacctgtacccgggatgata

SEQ ID NO: 894900 - DNA, 25 bp, Mus musculus
tggtgcacctgttcccgggatgata

SEQ ID NO: 894901 - DNA, 25 bp, Mus musculus
tggtgcactgacatgccagcgtcca

SEQ ID NO: 894902 - DNA, 25 bp, Mus musculus
tggtgcactgacttgccagcgtcca

SEQ ID NO: 894903 - DNA, 25 bp, Mus musculus
tggtgcactgtcacactggagtgga

SEQ ID NO: 894904 - DNA, 25 bp, Mus musculus
tggtgcactgtctcactggagtgga

SEQ ID NO: 894905 - DNA, 25 bp, Mus musculus
tggtgcactttgaaattcccctgaa

SEQ ID NO: 894906 - DNA, 25 bp, Mus musculus
tggtgcactttgtaattcccctgaa

SEQ ID NO: 894907 - DNA, 25 bp, Mus musculus
tggtgcagacacatggccagtacac

SEQ ID NO: 894908 - DNA, 25 bp, Mus musculus
tggtgcagacacttggccagtacac

SEQ ID NO: 894909 - DNA, 25 bp, Mus musculus
tggtgcagagccacagtccaccctg

SEQ ID NO: 894910 - DNA, 25 bp, Mus musculus
tggtgcagagcctcagtccaccctg

SEQ ID NO: 894911 - DNA, 25 bp, Mus musculus
tggtgcagaggactaacacagacta

SEQ ID NO: 894912 - DNA, 25 bp, Mus musculus
tggtgcagaggagtaacacagacta

SEQ ID NO: 894913 - DNA, 25 bp, Mus musculus
tggtgcagatatctgcccactgtga

SEQ ID NO: 894914 - DNA, 25 bp, Mus musculus
tggtgcagatatgtgcccactgtga

SEQ ID NO: 894915 - DNA, 25 bp, Mus musculus
tggtgcagcactctcagagccgcgt

SEQ ID NO: 894916 - DNA, 25 bp, Mus musculus
tggtgcagcactgtcagagccgcgt

SEQ ID NO: 894917 - DNA, 25 bp, Mus musculus
tggtgcagcagacacggctatcctt

SEQ ID NO: 894918 - DNA, 25 bp, Mus musculus
tggtgcagcagagacggctatcctt

SEQ ID NO: 894919 - DNA, 25 bp, Mus musculus
tggtgcagcccaaaccacgatggct

SEQ ID NO: 894920 - DNA, 25 bp, Mus musculus
tggtgcagcccataccacgatggct

SEQ ID NO: 894921 - DNA, 25 bp, Mus musculus
tggtgcagcggacttcagttctatt

SEQ ID NO: 894922 - DNA, 25 bp, Mus musculus
tggtgcagcggagttcagttctatt

SEQ ID NO: 894923 - DNA, 25 bp, Mus musculus
tggtgcagctttccctgatggaaat

SEQ ID NO: 894924 - DNA, 25 bp, Mus musculus
tggtgcagctttgcctgatggaaat

SEQ ID NO: 894925 - DNA, 25 bp, Mus musculus
tggtgcaggctcacttcggatcgaa

SEQ ID NO: 894926 - DNA, 25 bp, Mus musculus
tggtgcaggctctcttcggatcgaa

SEQ ID NO: 894927 - DNA, 25 bp, Mus musculus
tggtgcagggcgaggccggcgacgt

SEQ ID NO: 894928 - DNA, 25 bp, Mus musculus
tggtgcagggcgtggccggcgacgt

SEQ ID NO: 894929 - DNA, 25 bp, Mus musculus
tggtgcagggtcacaatggccttac

SEQ ID NO: 894930 - DNA, 25 bp, Mus musculus
tggtgcagggtctcaatggccttac

SEQ ID NO: 894931 - DNA, 25 bp, Mus musculus
tggtgcagtgcccacagcagtcata

SEQ ID NO: 894932 - DNA, 25 bp, Mus musculus
tggtgcagtgccgacagcagtcata

SEQ ID NO: 894933 - DNA, 25 bp, Mus musculus
tggtgcagttcactgggccttagtt

SEQ ID NO: 894934 - DNA, 25 bp, Mus musculus
tggtgcagttcagtgggccttagtt

SEQ ID NO: 894935 - DNA, 25 bp, Mus musculus
tggtgcatacctatactcccaccag

SEQ ID NO: 894936 - DNA, 25 bp, Mus musculus
tggtgcatacctttactcccaccag

SEQ ID NO: 894937 - DNA, 25 bp, Mus musculus
tggtgcatgaggaccagcggtacat

SEQ ID NO: 894938 - DNA, 25 bp, Mus musculus
tggtgcatgaggtccagcggtacat

SEQ ID NO: 894939 - DNA, 25 bp, Mus musculus
tggtgcatgctgagtgcacctgctg

SEQ ID NO: 894940 - DNA, 25 bp, Mus musculus
tggtgcatgctgtgtgcacctgctg

SEQ ID NO: 894941 - DNA, 25 bp, Mus musculus
tggtgcatggacagggctgccaaat

SEQ ID NO: 894942 - DNA, 25 bp, Mus musculus
tggtgcatggactgggctgccaaat

SEQ ID NO: 894943 - DNA, 25 bp, Mus musculus
tggtgcatgtacacgactgccgctg

SEQ ID NO: 894944 - DNA, 25 bp, Mus musculus
tggtgcatgtactcgactgccgctg

SEQ ID NO: 894945 - DNA, 25 bp, Mus musculus
tggtgcatgtccataatctcagtcc

SEQ ID NO: 894946 - DNA, 25 bp, Mus musculus
tggtgcatgtccttaatctcagtcc

SEQ ID NO: 894947 - DNA, 25 bp, Mus musculus
tggtgcattactcagggctttcatt

SEQ ID NO: 894948 - DNA, 25 bp, Mus musculus
tggtgcattactgagggctttcatt

SEQ ID NO: 894949 - DNA, 25 bp, Mus musculus
tggtgcattggtactatcggcctga

SEQ ID NO: 894950 - DNA, 25 bp, Mus musculus
tggtgcattggttctatcggcctga

SEQ ID NO: 894951 - DNA, 25 bp, Mus musculus
tggtgcattttacgcaattttcatt

SEQ ID NO: 894952 - DNA, 25 bp, Mus musculus
tggtgcattttaggcaattttcatt

SEQ ID NO: 894953 - DNA, 25 bp, Mus musculus
tggtgccaaaaaaccagctccagtt

SEQ ID NO: 894954 - DNA, 25 bp, Mus musculus
tggtgccaaaaatccagctccagtt

SEQ ID NO: 894955 - DNA, 25 bp, Mus musculus
tggtgccaaactccatgatgctccg

SEQ ID NO: 894956 - DNA, 25 bp, Mus musculus
tggtgccaaactgcatgatgctccg

SEQ ID NO: 894957 - DNA, 25 bp, Mus musculus
tggtgccaaagtccatcaatgctcc

SEQ ID NO: 894958 - DNA, 25 bp, Mus musculus
tggtgccaaagtgcatcaatgctcc

SEQ ID NO: 894959 - DNA, 25 bp, Mus musculus
tggtgccaacagattagaacattaa

SEQ ID NO: 894960 - DNA, 25 bp, Mus musculus
tggtgccaacagtttagaacattaa

SEQ ID NO: 894961 - DNA, 25 bp, Mus musculus
tggtgccaagtcactgagcccgttg

SEQ ID NO: 894962 - DNA, 25 bp, Mus musculus
tggtgccaagtctctgagcccgttg

SEQ ID NO: 894963 - DNA, 25 bp, Mus musculus
tggtgccacaagagggcagggcctc

SEQ ID NO: 894964 - DNA, 25 bp, Mus musculus
tggtgccacaagtgggcagggcctc

SEQ ID NO: 894965 - DNA, 25 bp, Mus musculus
tggtgccaccaaagaagctgcccgg

SEQ ID NO: 894966 - DNA, 25 bp, Mus musculus
tggtgccaccaatgaagctgcccgg

SEQ ID NO: 894967 - DNA, 25 bp, Mus musculus
tggtgccaccccagacttgaggcag

SEQ ID NO: 894968 - DNA, 25 bp, Mus musculus
tggtgccacccctgacttgaggcag

SEQ ID NO: 894969 - DNA, 25 bp, Mus musculus
tggtgccacgagagaagtcccttct

SEQ ID NO: 894970 - DNA, 25 bp, Mus musculus
tggtgccacgagtgaagtcccttct

SEQ ID NO: 894971 - DNA, 25 bp, Mus musculus
tggtgccagaaacgttaccctcgat

SEQ ID NO: 894972 - DNA, 25 bp, Mus musculus
tggtgccagaaaggttaccctcgat

SEQ ID NO: 894973 - DNA, 25 bp, Mus musculus
tggtgccagacgacaacatggagga

SEQ ID NO: 894974 - DNA, 25 bp, Mus musculus
tggtgccagacgtcaacatggagga

SEQ ID NO: 894975 - DNA, 25 bp, Mus musculus
tggtgccagagcagtgaacctcctc

SEQ ID NO: 894976 - DNA, 25 bp, Mus musculus
tggtgccagagctgtgaacctcctc

SEQ ID NO: 894977 - DNA, 25 bp, Mus musculus
tggtgccagaggaccaaaggtctcc

SEQ ID NO: 894978 - DNA, 25 bp, Mus musculus
tggtgccagaggatcgtctcagctg

SEQ ID NO: 894979 - DNA, 25 bp, Mus musculus
tggtgccagaggtccaaaggtctcc

SEQ ID NO: 894980 - DNA, 25 bp, Mus musculus
tggtgccagaggttcgtctcagctg

SEQ ID NO: 894981 - DNA, 25 bp, Mus musculus
tggtgccagagtatccctaatagct

SEQ ID NO: 894982 - DNA, 25 bp, Mus musculus
tggtgccagagtccagtacagctca

SEQ ID NO: 894983 - DNA, 25 bp, Mus musculus
tggtgccagagtgcagtacagctca

SEQ ID NO: 894984 - DNA, 25 bp, Mus musculus
tggtgccagagtttccctaatagct

SEQ ID NO: 894985 - DNA, 25 bp, Mus musculus
tggtgccaggaacccaaagcttact

SEQ ID NO: 894986 - DNA, 25 bp, Mus musculus
tggtgccaggaagccaaagcttact

SEQ ID NO: 894987 - DNA, 25 bp, Mus musculus
tggtgccagggtacgacatagttca

SEQ ID NO: 894988 - DNA, 25 bp, Mus musculus
tggtgccagggttcgacatagttca

SEQ ID NO: 894989 - DNA, 25 bp, Mus musculus
tggtgccagttcctgttgtagttac

SEQ ID NO: 894990 - DNA, 25 bp, Mus musculus
tggtgccagttcgtgttgtagttac

SEQ ID NO: 894991 - DNA, 25 bp, Mus musculus
tggtgccatcttatgtagccagcaa

SEQ ID NO: 894992 - DNA, 25 bp, Mus musculus
tggtgccatcttttgtagccagcaa

SEQ ID NO: 894993 - DNA, 25 bp, Mus musculus
tggtgcccagaaccgcaactacagt

SEQ ID NO: 894994 - DNA, 25 bp, Mus musculus
tggtgcccagaagcgcaactacagt

SEQ ID NO: 894995 - DNA, 25 bp, Mus musculus
tggtgcccagccagcagcatataat

SEQ ID NO: 894996 - DNA, 25 bp, Mus musculus
tggtgcccagcctgcagcatataat

SEQ ID NO: 894997 - DNA, 25 bp, Mus musculus
tggtgcccaggcaccgttctgagca

SEQ ID NO: 894998 - DNA, 25 bp, Mus musculus
tggtgcccaggctccgttctgagca

SEQ ID NO: 894999 - DNA, 25 bp, Mus musculus
tggtgcccagggatctgagccacac

SEQ ID NO: 895000 - DNA, 25 bp, Mus musculus
tggtgcccagggttctgagccacac

SEQ ID NO: 895001 - DNA, 25 bp, Mus musculus
tggtgcccatagctgcgcgtcattc

SEQ ID NO: 895002 - DNA, 25 bp, Mus musculus
tggtgcccataggtgcgcgtcattc

SEQ ID NO: 895003 - DNA, 25 bp, Mus musculus
tggtgcccatggatttcttgactac

SEQ ID NO: 895004 - DNA, 25 bp, Mus musculus
tggtgcccatggttttcttgactac

SEQ ID NO: 895005 - DNA, 25 bp, Mus musculus
tggtgcccgggactgcccatacgtt

SEQ ID NO: 895006 - DNA, 25 bp, Mus musculus
tggtgcccgggagtgcccatacgtt

SEQ ID NO: 895007 - DNA, 25 bp, Mus musculus
tggtgcccgtgcccgataccagaaa

SEQ ID NO: 895008 - DNA, 25 bp, Mus musculus
tggtgcccgtgcgcgataccagaaa

SEQ ID NO: 895009 - DNA, 25 bp, Mus musculus
tggtgccctattacaccgatgcaaa

SEQ ID NO: 895010 - DNA, 25 bp, Mus musculus
tggtgccctatttcaccgatgcaaa

SEQ ID NO: 895011 - DNA, 25 bp, Mus musculus
tggtgccctccacagaacaaaccaa

SEQ ID NO: 895012 - DNA, 25 bp, Mus musculus
tggtgccctccagagaacaaaccaa

SEQ ID NO: 895013 - DNA, 25 bp, Mus musculus
tggtgccctcttcagtatatcttgg

SEQ ID NO: 895014 - DNA, 25 bp, Mus musculus
tggtgccctcttgagtatatcttgg

SEQ ID NO: 895015 - DNA, 25 bp, Mus musculus
tggtgccctgacagtttctttcctc

SEQ ID NO: 895016 - DNA, 25 bp, Mus musculus
tggtgccctgactgtttctttcctc

SEQ ID NO: 895017 - DNA, 25 bp, Mus musculus
tggtgccctgccattcctgagcagg

SEQ ID NO: 895018 - DNA, 25 bp, Mus musculus
tggtgccctgcctttcctgagcagg

SEQ ID NO: 895019 - DNA, 25 bp, Mus musculus
tggtgccctgggaaacagccgccga

SEQ ID NO: 895020 - DNA, 25 bp, Mus musculus
tggtgccctgggaactcaaagatac

SEQ ID NO: 895021 - DNA, 25 bp, Mus musculus
tggtgccctgggtaacagccgccga

SEQ ID NO: 895022 - DNA, 25 bp, Mus musculus
tggtgccctgggtactcaaagatac

SEQ ID NO: 895023 - DNA, 25 bp, Mus musculus
tggtgccgcaagctgcacagttatt

SEQ ID NO: 895024 - DNA, 25 bp, Mus musculus
tggtgccgcaaggtgcacagttatt

SEQ ID NO: 895025 - DNA, 25 bp, Mus musculus
tggtgccgcagcacgtccgtgttca

SEQ ID NO: 895026 - DNA, 25 bp, Mus musculus
tggtgccgcagctcgtccgtgttca

SEQ ID NO: 895027 - DNA, 25 bp, Mus musculus
tggtgccggtggaaggcgtggtgca

SEQ ID NO: 895028 - DNA, 25 bp, Mus musculus
tggtgccggtggtaggcgtggtgca

SEQ ID NO: 895029 - DNA, 25 bp, Mus musculus
tggtgccgtccaccagagaacagtt

SEQ ID NO: 895030 - DNA, 25 bp, Mus musculus
tggtgccgtccagcagagaacagtt

SEQ ID NO: 895031 - DNA, 25 bp, Mus musculus
tggtgccgtgatcatttcccacagt

SEQ ID NO: 895032 - DNA, 25 bp, Mus musculus
tggtgccgtgatgatttcccacagt

SEQ ID NO: 895033 - DNA, 25 bp, Mus musculus
tggtgccgtgtacaccaatctagca

SEQ ID NO: 895034 - DNA, 25 bp, Mus musculus
tggtgccgtgtagaccaatctagca

SEQ ID NO: 895035 - DNA, 25 bp, Mus musculus
tggtgcctaaggatgctcagccctg

SEQ ID NO: 895036 - DNA, 25 bp, Mus musculus
tggtgcctaaggttgctcagccctg

SEQ ID NO: 895037 - DNA, 25 bp, Mus musculus
tggtgcctacaaagcctttcagatc

SEQ ID NO: 895038 - DNA, 25 bp, Mus musculus
tggtgcctacaatgcctttcagatc

SEQ ID NO: 895039 - DNA, 25 bp, Mus musculus
tggtgcctagcccttgttaattcaa

SEQ ID NO: 895040 - DNA, 25 bp, Mus musculus
tggtgcctagccgttgttaattcaa

SEQ ID NO: 895041 - DNA, 25 bp, Mus musculus
tggtgcctatatctggcccttacaa

SEQ ID NO: 895042 - DNA, 25 bp, Mus musculus
tggtgcctatatgtggcccttacaa

SEQ ID NO: 895043 - DNA, 25 bp, Mus musculus
tggtgcctatgaccgtgtggcccaa

SEQ ID NO: 895044 - DNA, 25 bp, Mus musculus
tggtgcctatgagcgtgtggcccaa

SEQ ID NO: 895045 - DNA, 25 bp, Mus musculus
tggtgcctatgtacacaagggccca

SEQ ID NO: 895046 - DNA, 25 bp, Mus musculus
tggtgcctatgttcacaagggccca

SEQ ID NO: 895047 - DNA, 25 bp, Mus musculus
tggtgcctcgttagatcgcgactga

SEQ ID NO: 895048 - DNA, 25 bp, Mus musculus
tggtgcctcgtttgatcgcgactga

SEQ ID NO: 895049 - DNA, 25 bp, Mus musculus
tggtgcctcttccaagctcgaagtg

SEQ ID NO: 895050 - DNA, 25 bp, Mus musculus
tggtgcctcttcgaagctcgaagtg

SEQ ID NO: 895051 - DNA, 25 bp, Mus musculus
tggtgcctcttgaatacctttctct

SEQ ID NO: 895052 - DNA, 25 bp, Mus musculus
tggtgcctcttgtatacctttctct

SEQ ID NO: 895053 - DNA, 25 bp, Mus musculus
tggtgcctggcccacttagaggaca

SEQ ID NO: 895054 - DNA, 25 bp, Mus musculus
tggtgcctggccgacttagaggaca

SEQ ID NO: 895055 - DNA, 25 bp, Mus musculus
tggtgcctgtggacccttgtctcgt

SEQ ID NO: 895056 - DNA, 25 bp, Mus musculus
tggtgcctgtggtcccttgtctcgt

SEQ ID NO: 895057 - DNA, 25 bp, Mus musculus
tggtgcctgttcaaccagggtagct

SEQ ID NO: 895058 - DNA, 25 bp, Mus musculus
tggtgcctgttctaccagggtagct

SEQ ID NO: 895059 - DNA, 25 bp, Mus musculus
tggtgccttcaacagccagagaaga

SEQ ID NO: 895060 - DNA, 25 bp, Mus musculus
tggtgccttcaagagccagagaaga

SEQ ID NO: 895061 - DNA, 25 bp, Mus musculus
tggtgccttcgtcactctgaagagt

SEQ ID NO: 895062 - DNA, 25 bp, Mus musculus
tggtgccttcgtgactctgaagagt

SEQ ID NO: 895063 - DNA, 25 bp, Mus musculus
tggtgccttctcactgagtgagatg

SEQ ID NO: 895064 - DNA, 25 bp, Mus musculus
tggtgccttctctctgagtgagatg

SEQ ID NO: 895065 - DNA, 25 bp, Mus musculus
tggtgcgatcagaaaggattcctgt

SEQ ID NO: 895066 - DNA, 25 bp, Mus musculus
tggtgcgatcagtaaggattcctgt

SEQ ID NO: 895067 - DNA, 25 bp, Mus musculus
tggtgcgctcataactgggcactag

SEQ ID NO: 895068 - DNA, 25 bp, Mus musculus
tggtgcgctcattactgggcactag

SEQ ID NO: 895069 - DNA, 25 bp, Mus musculus
tggtgcgcttacacgtgtacttttg

SEQ ID NO: 895070 - DNA, 25 bp, Mus musculus
tggtgcgcttactcgtgtacttttg

SEQ ID NO: 895071 - DNA, 25 bp, Mus musculus
tggtgcgcttagatcttcagatgac

SEQ ID NO: 895072 - DNA, 25 bp, Mus musculus
tggtgcgcttagttcttcagatgac

SEQ ID NO: 895073 - DNA, 25 bp, Mus musculus
tggtgcgcttctacctggaggagac

SEQ ID NO: 895074 - DNA, 25 bp, Mus musculus
tggtgcgcttcttcctggaggagac

SEQ ID NO: 895075 - DNA, 25 bp, Mus musculus
tggtgcgcttgcctaacacgcgaga

SEQ ID NO: 895076 - DNA, 25 bp, Mus musculus
tggtgcgcttgcgtaacacgcgaga

SEQ ID NO: 895077 - DNA, 25 bp, Mus musculus
tggtgcggatagacggccagaatct

SEQ ID NO: 895078 - DNA, 25 bp, Mus musculus
tggtgcggatagtcggccagaatct

SEQ ID NO: 895079 - DNA, 25 bp, Mus musculus
tggtgcgtgtttctaatgccacact

SEQ ID NO: 895080 - DNA, 25 bp, Mus musculus
tggtgcgtgtttgtaatgccacact

SEQ ID NO: 895081 - DNA, 25 bp, Mus musculus
tggtgcgtttctctcatatctttac

SEQ ID NO: 895082 - DNA, 25 bp, Mus musculus
tggtgcgtttctgtcatatctttac

SEQ ID NO: 895083 - DNA, 25 bp, Mus musculus
tggtgctaagcacgcctcatctcaa

SEQ ID NO: 895084 - DNA, 25 bp, Mus musculus
tggtgctaagcaggcctcatctcaa

SEQ ID NO: 895085 - DNA, 25 bp, Mus musculus
tggtgctacatcctcctaggattta

SEQ ID NO: 895086 - DNA, 25 bp, Mus musculus
tggtgctacatcgtcctaggattta

SEQ ID NO: 895087 - DNA, 25 bp, Mus musculus
tggtgctaccacagcaggcctgaag

SEQ ID NO: 895088 - DNA, 25 bp, Mus musculus
tggtgctaccactgcaggcctgaag

SEQ ID NO: 895089 - DNA, 25 bp, Mus musculus
tggtgctaccatacagactcaatct

SEQ ID NO: 895090 - DNA, 25 bp, Mus musculus
tggtgctaccattcagactcaatct

SEQ ID NO: 895091 - DNA, 25 bp, Mus musculus
tggtgctacctcatacatttttctt

SEQ ID NO: 895092 - DNA, 25 bp, Mus musculus
tggtgctacctcttacatttttctt

SEQ ID NO: 895093 - DNA, 25 bp, Mus musculus
tggtgctactaccagctcccaacat

SEQ ID NO: 895094 - DNA, 25 bp, Mus musculus
tggtgctactacgagctcccaacat

SEQ ID NO: 895095 - DNA, 25 bp, Mus musculus
tggtgctactctcggtcttccacag

SEQ ID NO: 895096 - DNA, 25 bp, Mus musculus
tggtgctactctgggtcttccacag

SEQ ID NO: 895097 - DNA, 25 bp, Mus musculus
tggtgctagacaccgcttggcccgt

SEQ ID NO: 895098 - DNA, 25 bp, Mus musculus
tggtgctagacagcgcttggcccgt

SEQ ID NO: 895099 - DNA, 25 bp, Mus musculus
tggtgctagcacagaacctgatgcc

SEQ ID NO: 895100 - DNA, 25 bp, Mus musculus
tggtgctagcactgaacctgatgcc

SEQ ID NO: 895101 - DNA, 25 bp, Mus musculus
tggtgctagccgaatgagccccaga

SEQ ID NO: 895102 - DNA, 25 bp, Mus musculus
tggtgctagccgtatgagccccaga

SEQ ID NO: 895103 - DNA, 25 bp, Mus musculus
tggtgctagtgaaactggaccttca

SEQ ID NO: 895104 - DNA, 25 bp, Mus musculus
tggtgctagtgatactggaccttca

SEQ ID NO: 895105 - DNA, 25 bp, Mus musculus
tggtgctatctgcttcttggcgatc

SEQ ID NO: 895106 - DNA, 25 bp, Mus musculus
tggtgctatctggttcttggcgatc

SEQ ID NO: 895107 - DNA, 25 bp, Mus musculus
tggtgctatgtgaagactctgctaa

SEQ ID NO: 895108 - DNA, 25 bp, Mus musculus
tggtgctatgtgtagactctgctaa

SEQ ID NO: 895109 - DNA, 25 bp, Mus musculus
tggtgctcaaatactatccattaag

SEQ ID NO: 895110 - DNA, 25 bp, Mus musculus
tggtgctcaaatatccctcctaaag

SEQ ID NO: 895111 - DNA, 25 bp, Mus musculus
tggtgctcaaattctatccattaag

SEQ ID NO: 895112 - DNA, 25 bp, Mus musculus
tggtgctcaaatttccctcctaaag

SEQ ID NO: 895113 - DNA, 25 bp, Mus musculus
tggtgctcaagcattctgacctatt

SEQ ID NO: 895114 - DNA, 25 bp, Mus musculus
tggtgctcaagctttctgacctatt

SEQ ID NO: 895115 - DNA, 25 bp, Mus musculus
tggtgctcagggacacagccctaag

SEQ ID NO: 895116 - DNA, 25 bp, Mus musculus
tggtgctcagggtcacagccctaag

SEQ ID NO: 895117 - DNA, 25 bp, Mus musculus
tggtgctcagttagctgctggaaga

SEQ ID NO: 895118 - DNA, 25 bp, Mus musculus
tggtgctcagtttgctgctggaaga

SEQ ID NO: 895119 - DNA, 25 bp, Mus musculus
tggtgctcatctagttactcttccc

SEQ ID NO: 895120 - DNA, 25 bp, Mus musculus
tggtgctcatcttgttactcttccc

SEQ ID NO: 895121 - DNA, 25 bp, Mus musculus
tggtgctcattacatggaacccatg

SEQ ID NO: 895122 - DNA, 25 bp, Mus musculus
tggtgctcattagatggaacccatg

SEQ ID NO: 895123 - DNA, 25 bp, Mus musculus
tggtgctccagcagaagtctttgac

SEQ ID NO: 895124 - DNA, 25 bp, Mus musculus
tggtgctccagctgaagtctttgac

SEQ ID NO: 895125 - DNA, 25 bp, Mus musculus
tggtgctccataatacctgcgagga

SEQ ID NO: 895126 - DNA, 25 bp, Mus musculus
tggtgctccatattacctgcgagga

SEQ ID NO: 895127 - DNA, 25 bp, Mus musculus
tggtgctcccacaaatctcaggaga

SEQ ID NO: 895128 - DNA, 25 bp, Mus musculus
tggtgctcccactaatctcaggaga

SEQ ID NO: 895129 - DNA, 25 bp, Mus musculus
tggtgctccccgcaaaatggatcac

SEQ ID NO: 895130 - DNA, 25 bp, Mus musculus
tggtgctccccggaaaatggatcac

SEQ ID NO: 895131 - DNA, 25 bp, Mus musculus
tggtgctcctggacctatgggtgat

SEQ ID NO: 895132 - DNA, 25 bp, Mus musculus
tggtgctcctggtcctatgggtgat

SEQ ID NO: 895133 - DNA, 25 bp, Mus musculus
tggtgctccttaacatcctggttaa

SEQ ID NO: 895134 - DNA, 25 bp, Mus musculus
tggtgctccttatcatcctggttaa

SEQ ID NO: 895135 - DNA, 25 bp, Mus musculus
tggtgctctcgactttctacagtca

SEQ ID NO: 895136 - DNA, 25 bp, Mus musculus
tggtgctctcgagtttctacagtca

SEQ ID NO: 895137 - DNA, 25 bp, Mus musculus
tggtgctctcgcatcacagaagctt

SEQ ID NO: 895138 - DNA, 25 bp, Mus musculus
tggtgctctcgcttcacagaagctt

SEQ ID NO: 895139 - DNA, 25 bp, Mus musculus
tggtgctctgaaatgacctacccaa

SEQ ID NO: 895140 - DNA, 25 bp, Mus musculus
tggtgctctgaattgacctacccaa

SEQ ID NO: 895141 - DNA, 25 bp, Mus musculus
tggtgctcttctcaggtgggcataa

SEQ ID NO: 895142 - DNA, 25 bp, Mus musculus
tggtgctcttctgaggtgggcataa

SEQ ID NO: 895143 - DNA, 25 bp, Mus musculus
tggtgctctttcagataacttcctc

SEQ ID NO: 895144 - DNA, 25 bp, Mus musculus
tggtgctctttctgataacttcctc

SEQ ID NO: 895145 - DNA, 25 bp, Mus musculus
tggtgctgaagaaccggccctcgga

SEQ ID NO: 895146 - DNA, 25 bp, Mus musculus
tggtgctgaagaagagttcccaggt

SEQ ID NO: 895147 - DNA, 25 bp, Mus musculus
tggtgctgaagatccggccctcgga

SEQ ID NO: 895148 - DNA, 25 bp, Mus musculus
tggtgctgaagatgagttcccaggt

SEQ ID NO: 895149 - DNA, 25 bp, Mus musculus
tggtgctgaagtccatcctcatcat

SEQ ID NO: 895150 - DNA, 25 bp, Mus musculus
tggtgctgaagtcccttgagctacc

SEQ ID NO: 895151 - DNA, 25 bp, Mus musculus
tggtgctgaagtgcatcctcatcat

SEQ ID NO: 895152 - DNA, 25 bp, Mus musculus
tggtgctgaagtgccttgagctacc

SEQ ID NO: 895153 - DNA, 25 bp, Mus musculus
tggtgctgaataaggagctgaagcc

SEQ ID NO: 895154 - DNA, 25 bp, Mus musculus
tggtgctgaatatggagctgaagcc

SEQ ID NO: 895155 - DNA, 25 bp, Mus musculus
tggtgctgacctcctgactgctctt

SEQ ID NO: 895156 - DNA, 25 bp, Mus musculus
tggtgctgacctgctgactgctctt

SEQ ID NO: 895157 - DNA, 25 bp, Mus musculus
tggtgctgactaatggacccaggat

SEQ ID NO: 895158 - DNA, 25 bp, Mus musculus
tggtgctgactattggacccaggat

SEQ ID NO: 895159 - DNA, 25 bp, Mus musculus
tggtgctgactccacatacggatga

SEQ ID NO: 895160 - DNA, 25 bp, Mus musculus
tggtgctgactcgacatacggatga

SEQ ID NO: 895161 - DNA, 25 bp, Mus musculus
tggtgctgactgctacacccaggac

SEQ ID NO: 895162 - DNA, 25 bp, Mus musculus
tggtgctgactggtacacccaggac

SEQ ID NO: 895163 - DNA, 25 bp, Mus musculus
tggtgctgagacaagtggctccact

SEQ ID NO: 895164 - DNA, 25 bp, Mus musculus
tggtgctgagactagtggctccact

SEQ ID NO: 895165 - DNA, 25 bp, Mus musculus
tggtgctgatatctgcggcttgtcc

SEQ ID NO: 895166 - DNA, 25 bp, Mus musculus
tggtgctgatatgtgcggcttgtcc

SEQ ID NO: 895167 - DNA, 25 bp, Mus musculus
tggtgctgatcactcgactcgtcaa

SEQ ID NO: 895168 - DNA, 25 bp, Mus musculus
tggtgctgatcagtcgactcgtcaa

SEQ ID NO: 895169 - DNA, 25 bp, Mus musculus
tggtgctgcacaaagatgtcaacgt

SEQ ID NO: 895170 - DNA, 25 bp, Mus musculus
tggtgctgcacatagatgtcaacgt

SEQ ID NO: 895171 - DNA, 25 bp, Mus musculus
tggtgctgcactattcaaacccgag

SEQ ID NO: 895172 - DNA, 25 bp, Mus musculus
tggtgctgcacttttcaaacccgag

SEQ ID NO: 895173 - DNA, 25 bp, Mus musculus
tggtgctgcagcatcttgatgcttc

SEQ ID NO: 895174 - DNA, 25 bp, Mus musculus
tggtgctgcagcctattatctcaac

SEQ ID NO: 895175 - DNA, 25 bp, Mus musculus
tggtgctgcagcgtattatctcaac

SEQ ID NO: 895176 - DNA, 25 bp, Mus musculus
tggtgctgcagcttcttgatgcttc

SEQ ID NO: 895177 - DNA, 25 bp, Mus musculus
tggtgctgctgccagaactacaacc

SEQ ID NO: 895178 - DNA, 25 bp, Mus musculus
tggtgctgctgcgagaactacaacc

SEQ ID NO: 895179 - DNA, 25 bp, Mus musculus
tggtgctgctggacctgagaagagg

SEQ ID NO: 895180 - DNA, 25 bp, Mus musculus
tggtgctgctggattcgcggatcac

SEQ ID NO: 895181 - DNA, 25 bp, Mus musculus
tggtgctgctggtcctgagaagagg

SEQ ID NO: 895182 - DNA, 25 bp, Mus musculus
tggtgctgctggtttcgcggatcac

SEQ ID NO: 895183 - DNA, 25 bp, Mus musculus
tggtgctgcttcagatattggcagt

SEQ ID NO: 895184 - DNA, 25 bp, Mus musculus
tggtgctgcttctgatattggcagt

SEQ ID NO: 895185 - DNA, 25 bp, Mus musculus
tggtgctggaccagtttgccatccc

SEQ ID NO: 895186 - DNA, 25 bp, Mus musculus
tggtgctggacctgtttgccatccc

SEQ ID NO: 895187 - DNA, 25 bp, Mus musculus
tggtgctggaggacaagctctctct

SEQ ID NO: 895188 - DNA, 25 bp, Mus musculus
tggtgctggaggtcaagctctctct

SEQ ID NO: 895189 - DNA, 25 bp, Mus musculus
tggtgctggataagtctgcatgtgt

SEQ ID NO: 895190 - DNA, 25 bp, Mus musculus
tggtgctggatatgtctgcatgtgt

SEQ ID NO: 895191 - DNA, 25 bp, Mus musculus
tggtgctggcggcacatgcccttaa

SEQ ID NO: 895192 - DNA, 25 bp, Mus musculus
tggtgctggcgggacatgcccttaa

SEQ ID NO: 895193 - DNA, 25 bp, Mus musculus
tggtgctgggctatgtttactaaac

SEQ ID NO: 895194 - DNA, 25 bp, Mus musculus
tggtgctgggctttgtttactaaac

SEQ ID NO: 895195 - DNA, 25 bp, Mus musculus
tggtgctggtaccattggcaagacc

SEQ ID NO: 895196 - DNA, 25 bp, Mus musculus
tggtgctggtacgattggcaagacc

SEQ ID NO: 895197 - DNA, 25 bp, Mus musculus
tggtgctggtcactgatgctgtccc

SEQ ID NO: 895198 - DNA, 25 bp, Mus musculus
tggtgctggtcagtgatgctgtccc

SEQ ID NO: 895199 - DNA, 25 bp, Mus musculus
tggtgctgtacaactatggagcccc

SEQ ID NO: 895200 - DNA, 25 bp, Mus musculus
tggtgctgtacatctatggagcccc

SEQ ID NO: 895201 - DNA, 25 bp, Mus musculus
tggtgctgtgttcccaaccctagtc

SEQ ID NO: 895202 - DNA, 25 bp, Mus musculus
tggtgctgtgttgccaaccctagtc

SEQ ID NO: 895203 - DNA, 25 bp, Mus musculus
tggtgctgttctcctgactttaaaa

SEQ ID NO: 895204 - DNA, 25 bp, Mus musculus
tggtgctgttctgctgactttaaaa

SEQ ID NO: 895205 - DNA, 25 bp, Mus musculus
tggtgcttacaaaacattgcttcag

SEQ ID NO: 895206 - DNA, 25 bp, Mus musculus
tggtgcttacaaccaagcgagccat

SEQ ID NO: 895207 - DNA, 25 bp, Mus musculus
tggtgcttacaagcaagcgagccat

SEQ ID NO: 895208 - DNA, 25 bp, Mus musculus
tggtgcttacaatacattgcttcag

SEQ ID NO: 895209 - DNA, 25 bp, Mus musculus
tggtgcttaccaaaggctcatgtgc

SEQ ID NO: 895210 - DNA, 25 bp, Mus musculus
tggtgcttaccataggctcatgtgc

SEQ ID NO: 895211 - DNA, 25 bp, Mus musculus
tggtgcttagaaaccctcttcgttt

SEQ ID NO: 895212 - DNA, 25 bp, Mus musculus
tggtgcttagaatccctcttcgttt

SEQ ID NO: 895213 - DNA, 25 bp, Mus musculus
tggtgcttagacctgctttggctgt

SEQ ID NO: 895214 - DNA, 25 bp, Mus musculus
tggtgcttagacgtgctttggctgt

SEQ ID NO: 895215 - DNA, 25 bp, Mus musculus
tggtgcttccaaactgtcctggagc

SEQ ID NO: 895216 - DNA, 25 bp, Mus musculus
tggtgcttccaatctgtcctggagc

SEQ ID NO: 895217 - DNA, 25 bp, Mus musculus
tggtgcttccccctgggtcagtcca

SEQ ID NO: 895218 - DNA, 25 bp, Mus musculus
tggtgcttccccgtgggtcagtcca

SEQ ID NO: 895219 - DNA, 25 bp, Mus musculus
tggtgcttgttgatctgagtcccct

SEQ ID NO: 895220 - DNA, 25 bp, Mus musculus
tggtgcttgttgttctgagtcccct

SEQ ID NO: 895221 - DNA, 25 bp, Mus musculus
tggtgctttgcaatgcaaccctgca

SEQ ID NO: 895222 - DNA, 25 bp, Mus musculus
tggtgctttgcattgcaaccctgca

SEQ ID NO: 895223 - DNA, 25 bp, Mus musculus
tggtgctttgggatggttaagaact

SEQ ID NO: 895224 - DNA, 25 bp, Mus musculus
tggtgctttgggttggttaagaact

SEQ ID NO: 895225 - DNA, 25 bp, Mus musculus
tggtggaaaacacctgcccggcaga

SEQ ID NO: 895226 - DNA, 25 bp, Mus musculus
tggtggaaaacagctgcccggcaga

SEQ ID NO: 895227 - DNA, 25 bp, Mus musculus
tggtggaaaatacccagcactcctt

SEQ ID NO: 895228 - DNA, 25 bp, Mus musculus
tggtggaaaatagccagcactcctt

SEQ ID NO: 895229 - DNA, 25 bp, Mus musculus
tggtggaaatgcaagccctgccgga

SEQ ID NO: 895230 - DNA, 25 bp, Mus musculus
tggtggaaatgctagccctgccgga

SEQ ID NO: 895231 - DNA, 25 bp, Mus musculus
tggtggaacacgctctcctgcgcat

SEQ ID NO: 895232 - DNA, 25 bp, Mus musculus
tggtggaacacggtctcctgcgcat

SEQ ID NO: 895233 - DNA, 25 bp, Mus musculus
tggtggaacgcaacgcgcgcgtcat

SEQ ID NO: 895234 - DNA, 25 bp, Mus musculus
tggtggaacgcatcgcgcgcgtcat

SEQ ID NO: 895235 - DNA, 25 bp, Mus musculus
tggtggaacgtcattgtgccctttt

SEQ ID NO: 895236 - DNA, 25 bp, Mus musculus
tggtggaacgtctttgtgccctttt

SEQ ID NO: 895237 - DNA, 25 bp, Mus musculus
tggtggaagacacattgcgtcaatt

SEQ ID NO: 895238 - DNA, 25 bp, Mus musculus
tggtggaagacagattgcgtcaatt

SEQ ID NO: 895239 - DNA, 25 bp, Mus musculus
tggtggaagccaactattctgatat

SEQ ID NO: 895240 - DNA, 25 bp, Mus musculus
tggtggaagccatctattctgatat

SEQ ID NO: 895241 - DNA, 25 bp, Mus musculus
tggtggaagctcaggacaaggtcct

SEQ ID NO: 895242 - DNA, 25 bp, Mus musculus
tggtggaagctctggacaaggtcct

SEQ ID NO: 895243 - DNA, 25 bp, Mus musculus
tggtggaaggctacaagatcacgct

SEQ ID NO: 895244 - DNA, 25 bp, Mus musculus
tggtggaaggcttcaagatcacgct

SEQ ID NO: 895245 - DNA, 25 bp, Mus musculus
tggtggaagggacccattttcattt

SEQ ID NO: 895246 - DNA, 25 bp, Mus musculus
tggtggaagggagccattttcattt

SEQ ID NO: 895247 - DNA, 25 bp, Mus musculus
tggtggaagggtcggcttcatggcc

SEQ ID NO: 895248 - DNA, 25 bp, Mus musculus
tggtggaagggtgggcttcatggcc

SEQ ID NO: 895249 - DNA, 25 bp, Mus musculus
tggtggaagttaattggatgttgaa

SEQ ID NO: 895250 - DNA, 25 bp, Mus musculus
tggtggaagttatttggatgttgaa

SEQ ID NO: 895251 - DNA, 25 bp, Mus musculus
tggtggaataccagcgggctgtcat

SEQ ID NO: 895252 - DNA, 25 bp, Mus musculus
tggtggaatacctgcgggctgtcat

SEQ ID NO: 895253 - DNA, 25 bp, Mus musculus
tggtggaatgccatccctacttcat

SEQ ID NO: 895254 - DNA, 25 bp, Mus musculus
tggtggaatgccttccctacttcat

SEQ ID NO: 895255 - DNA, 25 bp, Mus musculus
tggtggaattcccttttaaccgatg

SEQ ID NO: 895256 - DNA, 25 bp, Mus musculus
tggtggaattccgttttaaccgatg

SEQ ID NO: 895257 - DNA, 25 bp, Mus musculus
tggtggacaacaacgccctgtggat

SEQ ID NO: 895258 - DNA, 25 bp, Mus musculus
tggtggacaacatcgccctgtggat

SEQ ID NO: 895259 - DNA, 25 bp, Mus musculus
tggtggacaacgagttcccgctgga

SEQ ID NO: 895260 - DNA, 25 bp, Mus musculus
tggtggacaacgtgttcccgctgga

SEQ ID NO: 895261 - DNA, 25 bp, Mus musculus
tggtggacacaaaggccctgagcag

SEQ ID NO: 895262 - DNA, 25 bp, Mus musculus
tggtggacacaatggccctgagcag

SEQ ID NO: 895263 - DNA, 25 bp, Mus musculus
tggtggacagagacttcctttgggt

SEQ ID NO: 895264 - DNA, 25 bp, Mus musculus
tggtggacagagtcttcctttgggt

SEQ ID NO: 895265 - DNA, 25 bp, Mus musculus
tggtggacagcactactcacatgtg

SEQ ID NO: 895266 - DNA, 25 bp, Mus musculus
tggtggacagcagtactcacatgtg

SEQ ID NO: 895267 - DNA, 25 bp, Mus musculus
tggtggacaggtaacagtgcaaaat

SEQ ID NO: 895268 - DNA, 25 bp, Mus musculus
tggtggacaggttacagtgcaaaat

SEQ ID NO: 895269 - DNA, 25 bp, Mus musculus
tggtggaccaccagataactttgca

SEQ ID NO: 895270 - DNA, 25 bp, Mus musculus
tggtggaccacctgataactttgca

SEQ ID NO: 895271 - DNA, 25 bp, Mus musculus
tggtggaccctgcacacttcaacat

SEQ ID NO: 895272 - DNA, 25 bp, Mus musculus
tggtggaccctggacacttcaacat

SEQ ID NO: 895273 - DNA, 25 bp, Mus musculus
tggtggacctataaccctatgggta

SEQ ID NO: 895274 - DNA, 25 bp, Mus musculus
tggtggacctattaccctatgggta

SEQ ID NO: 895275 - DNA, 25 bp, Mus musculus
tggtggacctctaggccaaaatggc

SEQ ID NO: 895276 - DNA, 25 bp, Mus musculus
tggtggacctcttggccaaaatggc

SEQ ID NO: 895277 - DNA, 25 bp, Mus musculus
tggtggacgagcaactagccctgga

SEQ ID NO: 895278 - DNA, 25 bp, Mus musculus
tggtggacgagctactagccctgga

SEQ ID NO: 895279 - DNA, 25 bp, Mus musculus
tggtggacttccctgcagatgccag

SEQ ID NO: 895280 - DNA, 25 bp, Mus musculus
tggtggacttccgtgcagatgccag

SEQ ID NO: 895281 - DNA, 25 bp, Mus musculus
tggtggagaaaaacagccttccccg

SEQ ID NO: 895282 - DNA, 25 bp, Mus musculus
tggtggagaaaatcagccttccccg

SEQ ID NO: 895283 - DNA, 25 bp, Mus musculus
tggtggagactccagtgttcctgca

SEQ ID NO: 895284 - DNA, 25 bp, Mus musculus
tggtggagactcgagtgttcctgca

SEQ ID NO: 895285 - DNA, 25 bp, Mus musculus
tggtggagagctcattcccttctaa

SEQ ID NO: 895286 - DNA, 25 bp, Mus musculus
tggtggagagctgattcccttctaa

SEQ ID NO: 895287 - DNA, 25 bp, Mus musculus
tggtggagatcaccagcctcagcgc

SEQ ID NO: 895288 - DNA, 25 bp, Mus musculus
tggtggagatcagcagcctcagcgc

SEQ ID NO: 895289 - DNA, 25 bp, Mus musculus
tggtggagcaagctcgccagcgcac

SEQ ID NO: 895290 - DNA, 25 bp, Mus musculus
tggtggagcaaggtcgccagcgcac

SEQ ID NO: 895291 - DNA, 25 bp, Mus musculus
tggtggagcagcagttacacccttc

SEQ ID NO: 895292 - DNA, 25 bp, Mus musculus
tggtggagcagctgttacacccttc

SEQ ID NO: 895293 - DNA, 25 bp, Mus musculus
tggtggagccacagagacttggtca

SEQ ID NO: 895294 - DNA, 25 bp, Mus musculus
tggtggagccacaggtgaccagaac

SEQ ID NO: 895295 - DNA, 25 bp, Mus musculus
tggtggagccactgagacttggtca

SEQ ID NO: 895296 - DNA, 25 bp, Mus musculus
tggtggagccactggtgaccagaac

SEQ ID NO: 895297 - DNA, 25 bp, Mus musculus
tggtggagcgatatgtctggttaat

SEQ ID NO: 895298 - DNA, 25 bp, Mus musculus
tggtggagcgatttgtctggttaat

SEQ ID NO: 895299 - DNA, 25 bp, Mus musculus
tggtggagcgtcctatcctagctgc

SEQ ID NO: 895300 - DNA, 25 bp, Mus musculus
tggtggagcgtcgtatcctagctgc

SEQ ID NO: 895301 - DNA, 25 bp, Mus musculus
tggtggagctatctctcatctcatc

SEQ ID NO: 895302 - DNA, 25 bp, Mus musculus
tggtggagctatgtctcatctcatc

SEQ ID NO: 895303 - DNA, 25 bp, Mus musculus
tggtggagctgaagcacagacccgt

SEQ ID NO: 895304 - DNA, 25 bp, Mus musculus
tggtggagctgatgcacagacccgt

SEQ ID NO: 895305 - DNA, 25 bp, Mus musculus
tggtggaggagaacccccggaacca

SEQ ID NO: 895306 - DNA, 25 bp, Mus musculus
tggtggaggagatcccccggaacca

SEQ ID NO: 895307 - DNA, 25 bp, Mus musculus
tggtggaggagtcacccttcttgac

SEQ ID NO: 895308 - DNA, 25 bp, Mus musculus
tggtggaggagtgacccttcttgac

SEQ ID NO: 895309 - DNA, 25 bp, Mus musculus
tggtggaggtctctaggctcatcct

SEQ ID NO: 895310 - DNA, 25 bp, Mus musculus
tggtggaggtctgtaggctcatcct

SEQ ID NO: 895311 - DNA, 25 bp, Mus musculus
tggtggagtcctctgtgtttgcaca

SEQ ID NO: 895312 - DNA, 25 bp, Mus musculus
tggtggagtcctgtgtgtttgcaca

SEQ ID NO: 895313 - DNA, 25 bp, Mus musculus
tggtggagtgctcaccacgcacaca

SEQ ID NO: 895314 - DNA, 25 bp, Mus musculus
tggtggagtgctgaccacgcacaca

SEQ ID NO: 895315 - DNA, 25 bp, Mus musculus
tggtggagttccagatttttccttt

SEQ ID NO: 895316 - DNA, 25 bp, Mus musculus
tggtggagttccattacaccctcag

SEQ ID NO: 895317 - DNA, 25 bp, Mus musculus
tggtggagttcctgatttttccttt

SEQ ID NO: 895318 - DNA, 25 bp, Mus musculus
tggtggagttcctttacaccctcag

SEQ ID NO: 895319 - DNA, 25 bp, Mus musculus
tggtggataagcacaataaaggtca

SEQ ID NO: 895320 - DNA, 25 bp, Mus musculus
tggtggataagctcaataaaggtca

SEQ ID NO: 895321 - DNA, 25 bp, Mus musculus
tggtggatcagacccggaaagcaac

SEQ ID NO: 895322 - DNA, 25 bp, Mus musculus
tggtggatcagagccggaaagcaac

SEQ ID NO: 895323 - DNA, 25 bp, Mus musculus
tggtggatctcaccgggcagcttac

SEQ ID NO: 895324 - DNA, 25 bp, Mus musculus
tggtggatctcagcgggcagcttac

SEQ ID NO: 895325 - DNA, 25 bp, Mus musculus
tggtggatgagaagcccttcctgca

SEQ ID NO: 895326 - DNA, 25 bp, Mus musculus
tggtggatgagatgcccttcctgca

SEQ ID NO: 895327 - DNA, 25 bp, Mus musculus
tggtggatgcctagtttctgaaact

SEQ ID NO: 895328 - DNA, 25 bp, Mus musculus
tggtggatgccttgtttctgaaact

SEQ ID NO: 895329 - DNA, 25 bp, Mus musculus
tggtggattctcagtttccagacaa

SEQ ID NO: 895330 - DNA, 25 bp, Mus musculus
tggtggattctctgtttccagacaa

SEQ ID NO: 895331 - DNA, 25 bp, Mus musculus
tggtggcaacaccttagcaggaagt

SEQ ID NO: 895332 - DNA, 25 bp, Mus musculus
tggtggcaacacgttagcaggaagt

SEQ ID NO: 895333 - DNA, 25 bp, Mus musculus
tggtggcaactaccacttcttctgg

SEQ ID NO: 895334 - DNA, 25 bp, Mus musculus
tggtggcaactagcacttcttctgg

SEQ ID NO: 895335 - DNA, 25 bp, Mus musculus
tggtggcaagccatcattacacaca

SEQ ID NO: 895336 - DNA, 25 bp, Mus musculus
tggtggcaagccttcattacacaca

SEQ ID NO: 895337 - DNA, 25 bp, Mus musculus
tggtggcacataaacgcatttagtc

SEQ ID NO: 895338 - DNA, 25 bp, Mus musculus
tggtggcacatatacgcatttagtc

SEQ ID NO: 895339 - DNA, 25 bp, Mus musculus
tggtggcaccagataaagactattt

SEQ ID NO: 895340 - DNA, 25 bp, Mus musculus
tggtggcaccagttaaagactattt

SEQ ID NO: 895341 - DNA, 25 bp, Mus musculus
tggtggcacccaaccattcataact

SEQ ID NO: 895342 - DNA, 25 bp, Mus musculus
tggtggcacccatccattcataact

SEQ ID NO: 895343 - DNA, 25 bp, Mus musculus
tggtggcacgcaactgtgacctagc

SEQ ID NO: 895344 - DNA, 25 bp, Mus musculus
tggtggcacgcatctgtgacctagc

SEQ ID NO: 895345 - DNA, 25 bp, Mus musculus
tggtggcacgccatgtgctgacgac

SEQ ID NO: 895346 - DNA, 25 bp, Mus musculus
tggtggcacgccttgtgctgacgac

SEQ ID NO: 895347 - DNA, 25 bp, Mus musculus
tggtggcacttcagtcacttacaac

SEQ ID NO: 895348 - DNA, 25 bp, Mus musculus
tggtggcacttctgtcacttacaac

SEQ ID NO: 895349 - DNA, 25 bp, Mus musculus
tggtggcactttatggctgtaagat

SEQ ID NO: 895350 - DNA, 25 bp, Mus musculus
tggtggcactttttggctgtaagat

SEQ ID NO: 895351 - DNA, 25 bp, Mus musculus
tggtggcagaacacagcccatttga

SEQ ID NO: 895352 - DNA, 25 bp, Mus musculus
tggtggcagaactcagcccatttga

SEQ ID NO: 895353 - DNA, 25 bp, Mus musculus
tggtggcagcgtcatgtgaagcttc

SEQ ID NO: 895354 - DNA, 25 bp, Mus musculus
tggtggcagcgtgatgtgaagcttc

SEQ ID NO: 895355 - DNA, 25 bp, Mus musculus
tggtggcagctgaaatctaaatgct

SEQ ID NO: 895356 - DNA, 25 bp, Mus musculus
tggtggcagctgtaatctaaatgct

SEQ ID NO: 895357 - DNA, 25 bp, Mus musculus
tggtggcaggacacaactatttcaa

SEQ ID NO: 895358 - DNA, 25 bp, Mus musculus
tggtggcaggactcaactatttcaa

SEQ ID NO: 895359 - DNA, 25 bp, Mus musculus
tggtggcagtctcctaatagaccgt

SEQ ID NO: 895360 - DNA, 25 bp, Mus musculus
tggtggcagtctgctaatagaccgt

SEQ ID NO: 895361 - DNA, 25 bp, Mus musculus
tggtggcatcagagcctgacatgca

SEQ ID NO: 895362 - DNA, 25 bp, Mus musculus
tggtggcatcagtgcctgacatgca

SEQ ID NO: 895363 - DNA, 25 bp, Mus musculus
tggtggcatcccaaggctcagcacg

SEQ ID NO: 895364 - DNA, 25 bp, Mus musculus
tggtggcatccctaggctcagcacg

SEQ ID NO: 895365 - DNA, 25 bp, Mus musculus
tggtggcatccgcagtatccattct

SEQ ID NO: 895366 - DNA, 25 bp, Mus musculus
tggtggcatccggagtatccattct

SEQ ID NO: 895367 - DNA, 25 bp, Mus musculus
tggtggcatcctctctgtcattgct

SEQ ID NO: 895368 - DNA, 25 bp, Mus musculus
tggtggcatcctgtctgtcattgct

SEQ ID NO: 895369 - DNA, 25 bp, Mus musculus
tggtggcatggaacaaagttacatt

SEQ ID NO: 895370 - DNA, 25 bp, Mus musculus
tggtggcatggatcaaagttacatt

SEQ ID NO: 895371 - DNA, 25 bp, Mus musculus
tggtggccaataaccttctgctaac

SEQ ID NO: 895372 - DNA, 25 bp, Mus musculus
tggtggccaatatccttctgctaac

SEQ ID NO: 895373 - DNA, 25 bp, Mus musculus
tggtggccacaaaacatttttatat

SEQ ID NO: 895374 - DNA, 25 bp, Mus musculus
tggtggccacaatacatttttatat

SEQ ID NO: 895375 - DNA, 25 bp, Mus musculus
tggtggccacatccttatgatatca

SEQ ID NO: 895376 - DNA, 25 bp, Mus musculus
tggtggccacatgcttatgatatca

SEQ ID NO: 895377 - DNA, 25 bp, Mus musculus
tggtggccagacagttccattggtt

SEQ ID NO: 895378 - DNA, 25 bp, Mus musculus
tggtggccagactgttccattggtt

SEQ ID NO: 895379 - DNA, 25 bp, Mus musculus
tggtggccagcgaatgacatcaagc

SEQ ID NO: 895380 - DNA, 25 bp, Mus musculus
tggtggccagcgtatgacatcaagc

SEQ ID NO: 895381 - DNA, 25 bp, Mus musculus
tggtggccatctacttcatgacggg

SEQ ID NO: 895382 - DNA, 25 bp, Mus musculus
tggtggccatcttcttcatgacggg

SEQ ID NO: 895383 - DNA, 25 bp, Mus musculus
tggtggccatttataggctcctaaa

SEQ ID NO: 895384 - DNA, 25 bp, Mus musculus
tggtggccatttttaggctcctaaa

SEQ ID NO: 895385 - DNA, 25 bp, Mus musculus
tggtggcccacaactggaatcctga

SEQ ID NO: 895386 - DNA, 25 bp, Mus musculus
tggtggcccacatctggaatcctga

SEQ ID NO: 895387 - DNA, 25 bp, Mus musculus
tggtggcccatgagcagaattcctg

SEQ ID NO: 895388 - DNA, 25 bp, Mus musculus
tggtggcccatgtgcagaattcctg

SEQ ID NO: 895389 - DNA, 25 bp, Mus musculus
tggtggccccaactgcagaactgac

SEQ ID NO: 895390 - DNA, 25 bp, Mus musculus
tggtggccccaagtgcagaactgac

SEQ ID NO: 895391 - DNA, 25 bp, Mus musculus
tggtggcccctgaagtttctgttta

SEQ ID NO: 895392 - DNA, 25 bp, Mus musculus
tggtggcccctgacttcagtaaaca

SEQ ID NO: 895393 - DNA, 25 bp, Mus musculus
tggtggcccctgtagtttctgttta

SEQ ID NO: 895394 - DNA, 25 bp, Mus musculus
tggtggcccctgtcttcagtaaaca

SEQ ID NO: 895395 - DNA, 25 bp, Mus musculus
tggtggcccgcactattctcaacaa

SEQ ID NO: 895396 - DNA, 25 bp, Mus musculus
tggtggcccgcagtattctcaacaa

SEQ ID NO: 895397 - DNA, 25 bp, Mus musculus
tggtggcccttcaagctctatatac

SEQ ID NO: 895398 - DNA, 25 bp, Mus musculus
tggtggcccttctagctctatatac

SEQ ID NO: 895399 - DNA, 25 bp, Mus musculus
tggtggcccttgcttaggatccctc

SEQ ID NO: 895400 - DNA, 25 bp, Mus musculus
tggtggcccttggttaggatccctc

SEQ ID NO: 895401 - DNA, 25 bp, Mus musculus
tggtggccgctcatgcagaaagcaa

SEQ ID NO: 895402 - DNA, 25 bp, Mus musculus
tggtggccgctcttgcagaaagcaa

SEQ ID NO: 895403 - DNA, 25 bp, Mus musculus
tggtggcctacaccatgctacagat

SEQ ID NO: 895404 - DNA, 25 bp, Mus musculus
tggtggcctacagcatgctacagat

SEQ ID NO: 895405 - DNA, 25 bp, Mus musculus
tggtggcctattagagcagttactc

SEQ ID NO: 895406 - DNA, 25 bp, Mus musculus
tggtggcctatttgagcagttactc

SEQ ID NO: 895407 - DNA, 25 bp, Mus musculus
tggtggcctcggaacagttgtttat

SEQ ID NO: 895408 - DNA, 25 bp, Mus musculus
tggtggcctcggtacagttgtttat

SEQ ID NO: 895409 - DNA, 25 bp, Mus musculus
tggtggcctgtcagagcgttaatga

SEQ ID NO: 895410 - DNA, 25 bp, Mus musculus
tggtggcctgtctgagcgttaatga

SEQ ID NO: 895411 - DNA, 25 bp, Mus musculus
tggtggccttacacatgcattataa

SEQ ID NO: 895412 - DNA, 25 bp, Mus musculus
tggtggccttactcatgcattataa

SEQ ID NO: 895413 - DNA, 25 bp, Mus musculus
tggtggccttccacaagcagtgact

SEQ ID NO: 895414 - DNA, 25 bp, Mus musculus
tggtggccttcctcaagcagtgact

SEQ ID NO: 895415 - DNA, 25 bp, Mus musculus
tggtggccttctacaagctgcgcaa

SEQ ID NO: 895416 - DNA, 25 bp, Mus musculus
tggtggccttcttcaagctgcgcaa

SEQ ID NO: 895417 - DNA, 25 bp, Mus musculus
tggtggccttgaagttcatccccaa

SEQ ID NO: 895418 - DNA, 25 bp, Mus musculus
tggtggccttgatgttcatccccaa

SEQ ID NO: 895419 - DNA, 25 bp, Mus musculus
tggtggccttggcaacagaccccaa

SEQ ID NO: 895420 - DNA, 25 bp, Mus musculus
tggtggccttgggaacagaccccaa

SEQ ID NO: 895421 - DNA, 25 bp, Mus musculus
tggtggcctttacgcttagtgctga

SEQ ID NO: 895422 - DNA, 25 bp, Mus musculus
tggtggcctttaggcttagtgctga

SEQ ID NO: 895423 - DNA, 25 bp, Mus musculus
tggtggcgccacagcttcgcaagat

SEQ ID NO: 895424 - DNA, 25 bp, Mus musculus
tggtggcgccactgcttcgcaagat

SEQ ID NO: 895425 - DNA, 25 bp, Mus musculus
tggtggcgctgcaggctaagacttt

SEQ ID NO: 895426 - DNA, 25 bp, Mus musculus
tggtggcgctgctggctaagacttt

SEQ ID NO: 895427 - DNA, 25 bp, Mus musculus
tggtggcggaccagcgctccctgat

SEQ ID NO: 895428 - DNA, 25 bp, Mus musculus
tggtggcggacctgcgctccctgat

SEQ ID NO: 895429 - DNA, 25 bp, Mus musculus
tggtggcgtgttagaaccagcccca

SEQ ID NO: 895430 - DNA, 25 bp, Mus musculus
tggtggcgtgtttgaaccagcccca

SEQ ID NO: 895431 - DNA, 25 bp, Mus musculus
tggtggcgttcaactcttccagaag

SEQ ID NO: 895432 - DNA, 25 bp, Mus musculus
tggtggcgttcatctcttccagaag

SEQ ID NO: 895433 - DNA, 25 bp, Mus musculus
tggtggcgttgcagctcttggcaca

SEQ ID NO: 895434 - DNA, 25 bp, Mus musculus
tggtggcgttgctgctcttggcaca

SEQ ID NO: 895435 - DNA, 25 bp, Mus musculus
tggtggctaagtctctcagacctga

SEQ ID NO: 895436 - DNA, 25 bp, Mus musculus
tggtggctaagtgtctcagacctga

SEQ ID NO: 895437 - DNA, 25 bp, Mus musculus
tggtggctacctcgcactaatactg

SEQ ID NO: 895438 - DNA, 25 bp, Mus musculus
tggtggctacctggcactaatactg

SEQ ID NO: 895439 - DNA, 25 bp, Mus musculus
tggtggctcaacagggttcagcaga

SEQ ID NO: 895440 - DNA, 25 bp, Mus musculus
tggtggctcaactgggttcagcaga

SEQ ID NO: 895441 - DNA, 25 bp, Mus musculus
tggtggctcaagaccctaattccag

SEQ ID NO: 895442 - DNA, 25 bp, Mus musculus
tggtggctcaagtccctaattccag

SEQ ID NO: 895443 - DNA, 25 bp, Mus musculus
tggtggctcaatctcagcttgtcta

SEQ ID NO: 895444 - DNA, 25 bp, Mus musculus
tggtggctcaatgtcagcttgtcta

SEQ ID NO: 895445 - DNA, 25 bp, Mus musculus
tggtggctcaccagtagtcagcact

SEQ ID NO: 895446 - DNA, 25 bp, Mus musculus
tggtggctcacctgtagtcagcact

SEQ ID NO: 895447 - DNA, 25 bp, Mus musculus
tggtggctcatacacttgtgagcat

SEQ ID NO: 895448 - DNA, 25 bp, Mus musculus
tggtggctcatagacttgtgagcat

SEQ ID NO: 895449 - DNA, 25 bp, Mus musculus
tggtggctcctcagagataaaagtt

SEQ ID NO: 895450 - DNA, 25 bp, Mus musculus
tggtggctcctctgagataaaagtt

SEQ ID NO: 895451 - DNA, 25 bp, Mus musculus
tggtggctctcaagcaattatactg

SEQ ID NO: 895452 - DNA, 25 bp, Mus musculus
tggtggctctcatgcaattatactg

SEQ ID NO: 895453 - DNA, 25 bp, Mus musculus
tggtggctctccaggttggattatc

SEQ ID NO: 895454 - DNA, 25 bp, Mus musculus
tggtggctctcctggttggattatc

SEQ ID NO: 895455 - DNA, 25 bp, Mus musculus
tggtggctctgcaggcgcctactac

SEQ ID NO: 895456 - DNA, 25 bp, Mus musculus
tggtggctctgctggcgcctactac

SEQ ID NO: 895457 - DNA, 25 bp, Mus musculus
tggtggctgagacattcgcccaaaa

SEQ ID NO: 895458 - DNA, 25 bp, Mus musculus
tggtggctgagagattcgcccaaaa

SEQ ID NO: 895459 - DNA, 25 bp, Mus musculus
tggtggctgcctaattcagttccag

SEQ ID NO: 895460 - DNA, 25 bp, Mus musculus
tggtggctgccttattcagttccag

SEQ ID NO: 895461 - DNA, 25 bp, Mus musculus
tggtggctggtgacgtccagaccat

SEQ ID NO: 895462 - DNA, 25 bp, Mus musculus
tggtggctggtgtcgtccagaccat

SEQ ID NO: 895463 - DNA, 25 bp, Mus musculus
tggtggctgtagctttagtcttcgc

SEQ ID NO: 895464 - DNA, 25 bp, Mus musculus
tggtggctgtaggtttagtcttcgc

SEQ ID NO: 895465 - DNA, 25 bp, Mus musculus
tggtggctgtataccccaatgctaa

SEQ ID NO: 895466 - DNA, 25 bp, Mus musculus
tggtggctgtattccccaatgctaa

SEQ ID NO: 895467 - DNA, 25 bp, Mus musculus
tggtggctgttcacacgtggagata

SEQ ID NO: 895468 - DNA, 25 bp, Mus musculus
tggtggctgttctcacgtggagata

SEQ ID NO: 895469 - DNA, 25 bp, Mus musculus
tggtggcttacaacagtaaccctgc

SEQ ID NO: 895470 - DNA, 25 bp, Mus musculus
tggtggcttacacctacccttaata

SEQ ID NO: 895471 - DNA, 25 bp, Mus musculus
tggtggcttacagctacccttaata

SEQ ID NO: 895472 - DNA, 25 bp, Mus musculus
tggtggcttacatcagtaaccctgc

SEQ ID NO: 895473 - DNA, 25 bp, Mus musculus
tggtggcttcctctttaattacggg

SEQ ID NO: 895474 - DNA, 25 bp, Mus musculus
tggtggcttcctgtttaattacggg

SEQ ID NO: 895475 - DNA, 25 bp, Mus musculus
tggtggcttgccagtgagcagagag

SEQ ID NO: 895476 - DNA, 25 bp, Mus musculus
tggtggcttgcctgtgagcagagag

SEQ ID NO: 895477 - DNA, 25 bp, Mus musculus
tggtggcttggtaggaatcgctttt

SEQ ID NO: 895478 - DNA, 25 bp, Mus musculus
tggtggcttggttggaatcgctttt

SEQ ID NO: 895479 - DNA, 25 bp, Mus musculus
tggtgggaaagaatcccttccttct

SEQ ID NO: 895480 - DNA, 25 bp, Mus musculus
tggtgggaaagattcccttccttct

SEQ ID NO: 895481 - DNA, 25 bp, Mus musculus
tggtgggaagccagtcgtacctcct

SEQ ID NO: 895482 - DNA, 25 bp, Mus musculus
tggtgggaagcctgtcgtacctcct

SEQ ID NO: 895483 - DNA, 25 bp, Mus musculus
tggtgggaagtgacagccccgtcac

SEQ ID NO: 895484 - DNA, 25 bp, Mus musculus
tggtgggaagtgtcagccccgtcac

SEQ ID NO: 895485 - DNA, 25 bp, Mus musculus
tggtgggaccctaattacccctgag

SEQ ID NO: 895486 - DNA, 25 bp, Mus musculus
tggtgggacccttattacccctgag

SEQ ID NO: 895487 - DNA, 25 bp, Mus musculus
tggtgggactgcaggcccaaacctg

SEQ ID NO: 895488 - DNA, 25 bp, Mus musculus
tggtgggactgctggcccaaacctg

SEQ ID NO: 895489 - DNA, 25 bp, Mus musculus
tggtgggagactatatttatccagt

SEQ ID NO: 895490 - DNA, 25 bp, Mus musculus
tggtgggagactttatttatccagt

SEQ ID NO: 895491 - DNA, 25 bp, Mus musculus
tggtgggaggccacatgagcaaaat

SEQ ID NO: 895492 - DNA, 25 bp, Mus musculus
tggtgggaggcctcatgagcaaaat

SEQ ID NO: 895493 - DNA, 25 bp, Mus musculus
tggtgggatccaaacctgccgtggc

SEQ ID NO: 895494 - DNA, 25 bp, Mus musculus
tggtgggatccatacctgccgtggc

SEQ ID NO: 895495 - DNA, 25 bp, Mus musculus
tggtgggatgttctcccaacttttt

SEQ ID NO: 895496 - DNA, 25 bp, Mus musculus
tggtgggatgttgtcccaacttttt

SEQ ID NO: 895497 - DNA, 25 bp, Mus musculus
tggtgggcacccagcatctgctgtg

SEQ ID NO: 895498 - DNA, 25 bp, Mus musculus
tggtgggcaccctgcatctgctgtg

SEQ ID NO: 895499 - DNA, 25 bp, Mus musculus
tggtgggcagacatgcttgctgaaa

SEQ ID NO: 895500 - DNA, 25 bp, Mus musculus
tggtgggcagacttgcttgctgaaa

SEQ ID NO: 895501 - DNA, 25 bp, Mus musculus
tggtgggcagccctccagactgctc

SEQ ID NO: 895502 - DNA, 25 bp, Mus musculus
tggtgggcagccgtccagactgctc

SEQ ID NO: 895503 - DNA, 25 bp, Mus musculus
tggtgggccacccttgtgcaaatta

SEQ ID NO: 895504 - DNA, 25 bp, Mus musculus
tggtgggccaccgttgtgcaaatta

SEQ ID NO: 895505 - DNA, 25 bp, Mus musculus
tggtgggccagcaccagaacattgc

SEQ ID NO: 895506 - DNA, 25 bp, Mus musculus
tggtgggccagctccagaacattgc

SEQ ID NO: 895507 - DNA, 25 bp, Mus musculus
tggtgggccgagagatcgacatctt

SEQ ID NO: 895508 - DNA, 25 bp, Mus musculus
tggtgggccgagtgatcgacatctt

SEQ ID NO: 895509 - DNA, 25 bp, Mus musculus
tggtgggcctggaaccaacctgaac

SEQ ID NO: 895510 - DNA, 25 bp, Mus musculus
tggtgggcctggtaccaacctgaac

SEQ ID NO: 895511 - DNA, 25 bp, Mus musculus
tggtgggcctttagggcctcgccca

SEQ ID NO: 895512 - DNA, 25 bp, Mus musculus
tggtgggccttttgggcctcgccca

SEQ ID NO: 895513 - DNA, 25 bp, Mus musculus
tggtgggcgcccacttcgctgcctt

SEQ ID NO: 895514 - DNA, 25 bp, Mus musculus
tggtgggcgccctcttcgctgcctt

SEQ ID NO: 895515 - DNA, 25 bp, Mus musculus
tggtgggcggctacgaccagccaaa

SEQ ID NO: 895516 - DNA, 25 bp, Mus musculus
tggtgggcggcttcgaccagccaaa

SEQ ID NO: 895517 - DNA, 25 bp, Mus musculus
tggtgggctcacaacatctcgaact

SEQ ID NO: 895518 - DNA, 25 bp, Mus musculus
tggtgggctcacaaccactcctaat

SEQ ID NO: 895519 - DNA, 25 bp, Mus musculus
tggtgggctcactacatctcgaact

SEQ ID NO: 895520 - DNA, 25 bp, Mus musculus
tggtgggctcactaccactcctaat

SEQ ID NO: 895521 - DNA, 25 bp, Mus musculus
tggtgggctcccaagcttgcccctt

SEQ ID NO: 895522 - DNA, 25 bp, Mus musculus
tggtgggctccctagcttgcccctt

SEQ ID NO: 895523 - DNA, 25 bp, Mus musculus
tggtgggctttgaaccttcagtcag

SEQ ID NO: 895524 - DNA, 25 bp, Mus musculus
tggtgggctttgtaccttcagtcag

SEQ ID NO: 895525 - DNA, 25 bp, Mus musculus
tggtgggtaacaaccgagccaagat

SEQ ID NO: 895526 - DNA, 25 bp, Mus musculus
tggtgggtaacatccgagccaagat

SEQ ID NO: 895527 - DNA, 25 bp, Mus musculus
tggtgggtacaaacaagcctgccct

SEQ ID NO: 895528 - DNA, 25 bp, Mus musculus
tggtgggtacaatcaagcctgccct

SEQ ID NO: 895529 - DNA, 25 bp, Mus musculus
tggtgggtagccagtgtccccatga

SEQ ID NO: 895530 - DNA, 25 bp, Mus musculus
tggtgggtagcctgtgtccccatga

SEQ ID NO: 895531 - DNA, 25 bp, Mus musculus
tggtgggtagctcactggaaagatc

SEQ ID NO: 895532 - DNA, 25 bp, Mus musculus
tggtgggtagctgactggaaagatc

SEQ ID NO: 895533 - DNA, 25 bp, Mus musculus
tggtgggtcactagaatgtccaggt

SEQ ID NO: 895534 - DNA, 25 bp, Mus musculus
tggtgggtcactctcagacatttag

SEQ ID NO: 895535 - DNA, 25 bp, Mus musculus
tggtgggtcactgtcagacatttag

SEQ ID NO: 895536 - DNA, 25 bp, Mus musculus
tggtgggtcacttgaatgtccaggt

SEQ ID NO: 895537 - DNA, 25 bp, Mus musculus
tggtgggtcccaagtgctccgcaga

SEQ ID NO: 895538 - DNA, 25 bp, Mus musculus
tggtgggtcccatgtgctccgcaga

SEQ ID NO: 895539 - DNA, 25 bp, Mus musculus
tggtgggtcttgagcgaaccctcac

SEQ ID NO: 895540 - DNA, 25 bp, Mus musculus
tggtgggtcttgtgcgaaccctcac

SEQ ID NO: 895541 - DNA, 25 bp, Mus musculus
tggtgggtctttaacaattagggat

SEQ ID NO: 895542 - DNA, 25 bp, Mus musculus
tggtgggtcttttacaattagggat

SEQ ID NO: 895543 - DNA, 25 bp, Mus musculus
tggtgggtgaccagaccttaaaagt

SEQ ID NO: 895544 - DNA, 25 bp, Mus musculus
tggtgggtgacctgaccttaaaagt

SEQ ID NO: 895545 - DNA, 25 bp, Mus musculus
tggtgggtggctctgactactctaa

SEQ ID NO: 895546 - DNA, 25 bp, Mus musculus
tggtgggtggctgtgactactctaa

SEQ ID NO: 895547 - DNA, 25 bp, Mus musculus
tggtgggtggtacctcagtatcctt

SEQ ID NO: 895548 - DNA, 25 bp, Mus musculus
tggtgggtggtagctcagtatcctt

SEQ ID NO: 895549 - DNA, 25 bp, Mus musculus
tggtgggtttttacacttgtaatat

SEQ ID NO: 895550 - DNA, 25 bp, Mus musculus
tggtgggttttttcacttgtaatat

SEQ ID NO: 895551 - DNA, 25 bp, Mus musculus
tggtggtaacccacaatcctaaaca

SEQ ID NO: 895552 - DNA, 25 bp, Mus musculus
tggtggtaaccctcaatcctaaaca

SEQ ID NO: 895553 - DNA, 25 bp, Mus musculus
tggtggtaattgacttcttattctc

SEQ ID NO: 895554 - DNA, 25 bp, Mus musculus
tggtggtaattgtcttcttattctc

SEQ ID NO: 895555 - DNA, 25 bp, Mus musculus
tggtggtacacaccaggcccttgag

SEQ ID NO: 895556 - DNA, 25 bp, Mus musculus
tggtggtacacagcaggcccttgag

SEQ ID NO: 895557 - DNA, 25 bp, Mus musculus
tggtggtaccggctggcaggacctg

SEQ ID NO: 895558 - DNA, 25 bp, Mus musculus
tggtggtaccgggtggcaggacctg

SEQ ID NO: 895559 - DNA, 25 bp, Mus musculus
tggtggtactatagcacgcctttgc

SEQ ID NO: 895560 - DNA, 25 bp, Mus musculus
tggtggtactattgcacgcctttgc

SEQ ID NO: 895561 - DNA, 25 bp, Mus musculus
tggtggtatagccataggtagccat

SEQ ID NO: 895562 - DNA, 25 bp, Mus musculus
tggtggtatagcgataggtagccat

SEQ ID NO: 895563 - DNA, 25 bp, Mus musculus
tggtggtcacatatggcagcccgtc

SEQ ID NO: 895564 - DNA, 25 bp, Mus musculus
tggtggtcacatttggcagcccgtc

SEQ ID NO: 895565 - DNA, 25 bp, Mus musculus
tggtggtcagcaccttcacccttga

SEQ ID NO: 895566 - DNA, 25 bp, Mus musculus
tggtggtcagcagcttcacccttga

SEQ ID NO: 895567 - DNA, 25 bp, Mus musculus
tggtggtccaacctgggaaactcca

SEQ ID NO: 895568 - DNA, 25 bp, Mus musculus
tggtggtccaacgtgggaaactcca

SEQ ID NO: 895569 - DNA, 25 bp, Mus musculus
tggtggtccacaccctggccatggc

SEQ ID NO: 895570 - DNA, 25 bp, Mus musculus
tggtggtccacagcctggccatggc

SEQ ID NO: 895571 - DNA, 25 bp, Mus musculus
tggtggtccataaccatccataact

SEQ ID NO: 895572 - DNA, 25 bp, Mus musculus
tggtggtccatatccatccataact

SEQ ID NO: 895573 - DNA, 25 bp, Mus musculus
tggtggtccattacccaccccagaa

SEQ ID NO: 895574 - DNA, 25 bp, Mus musculus
tggtggtccatttcccaccccagaa

SEQ ID NO: 895575 - DNA, 25 bp, Mus musculus
tggtggtcccagagttcataaggca

SEQ ID NO: 895576 - DNA, 25 bp, Mus musculus
tggtggtcccagtgttcataaggca

SEQ ID NO: 895577 - DNA, 25 bp, Mus musculus
tggtggtccctaattcagagtcgct

SEQ ID NO: 895578 - DNA, 25 bp, Mus musculus
tggtggtccctatttcagagtcgct

SEQ ID NO: 895579 - DNA, 25 bp, Mus musculus
tggtggtcctctccatcacaaggaa

SEQ ID NO: 895580 - DNA, 25 bp, Mus musculus
tggtggtcctctgcatcacaaggaa

SEQ ID NO: 895581 - DNA, 25 bp, Mus musculus
tggtggtcctgcagccagagagcaa

SEQ ID NO: 895582 - DNA, 25 bp, Mus musculus
tggtggtcctgctgccagagagcaa

SEQ ID NO: 895583 - DNA, 25 bp, Mus musculus
tggtggtcctgtacacagcggtctt

SEQ ID NO: 895584 - DNA, 25 bp, Mus musculus
tggtggtcctgttcacagcggtctt

SEQ ID NO: 895585 - DNA, 25 bp, Mus musculus
tggtggtcgcatcaagtctggaact

SEQ ID NO: 895586 - DNA, 25 bp, Mus musculus
tggtggtcgcatgaagtctggaact

SEQ ID NO: 895587 - DNA, 25 bp, Mus musculus
tggtggtctaagagtccactctcat

SEQ ID NO: 895588 - DNA, 25 bp, Mus musculus
tggtggtctaagtgtccactctcat

SEQ ID NO: 895589 - DNA, 25 bp, Mus musculus
tggtggtctcctatgctgctgtgac

SEQ ID NO: 895590 - DNA, 25 bp, Mus musculus
tggtggtctcctttgctgctgtgac

SEQ ID NO: 895591 - DNA, 25 bp, Mus musculus
tggtggtctgttactacccatagag

SEQ ID NO: 895592 - DNA, 25 bp, Mus musculus
tggtggtctgtttctacccatagag

SEQ ID NO: 895593 - DNA, 25 bp, Mus musculus
tggtggtcttacagcatcactggca

SEQ ID NO: 895594 - DNA, 25 bp, Mus musculus
tggtggtcttactgcatcactggca

SEQ ID NO: 895595 - DNA, 25 bp, Mus musculus
tggtggtcttctacttcagttttct

SEQ ID NO: 895596 - DNA, 25 bp, Mus musculus
tggtggtcttcttcttcagttttct

SEQ ID NO: 895597 - DNA, 25 bp, Mus musculus
tggtggtcttttccttcaatcttag

SEQ ID NO: 895598 - DNA, 25 bp, Mus musculus
tggtggtcttttgcttcaatcttag

SEQ ID NO: 895599 - DNA, 25 bp, Mus musculus
tggtggtgagcaagcacccagcgaa

SEQ ID NO: 895600 - DNA, 25 bp, Mus musculus
tggtggtgagcatgcacccagcgaa

SEQ ID NO: 895601 - DNA, 25 bp, Mus musculus
tggtggtgatctatggcagtgctaa

SEQ ID NO: 895602 - DNA, 25 bp, Mus musculus
tggtggtgatctttggcagtgctaa

SEQ ID NO: 895603 - DNA, 25 bp, Mus musculus
tggtggtgattgaccccatttctac

SEQ ID NO: 895604 - DNA, 25 bp, Mus musculus
tggtggtgattgtccccatttctac

SEQ ID NO: 895605 - DNA, 25 bp, Mus musculus
tggtggtgcacaactgtcatcctag

SEQ ID NO: 895606 - DNA, 25 bp, Mus musculus
tggtggtgcacatctgtcatcctag

SEQ ID NO: 895607 - DNA, 25 bp, Mus musculus
tggtggtgcatgactggttccagcc

SEQ ID NO: 895608 - DNA, 25 bp, Mus musculus
tggtggtgcatgtctggttccagcc

SEQ ID NO: 895609 - DNA, 25 bp, Mus musculus
tggtggtgccctcacagcctgggag

SEQ ID NO: 895610 - DNA, 25 bp, Mus musculus
tggtggtgccctgacagcctgggag

SEQ ID NO: 895611 - DNA, 25 bp, Mus musculus
tggtggtgcctcacatagctgaatc

SEQ ID NO: 895612 - DNA, 25 bp, Mus musculus
tggtggtgcctctcatagctgaatc

SEQ ID NO: 895613 - DNA, 25 bp, Mus musculus
tggtggtgctcaacttccgagattc

SEQ ID NO: 895614 - DNA, 25 bp, Mus musculus
tggtggtgctcaatatcctggcctt

SEQ ID NO: 895615 - DNA, 25 bp, Mus musculus
tggtggtgctcatcttccgagattc

SEQ ID NO: 895616 - DNA, 25 bp, Mus musculus
tggtggtgctcattatcctggcctt

SEQ ID NO: 895617 - DNA, 25 bp, Mus musculus
tggtggtgctgtcttcctgatgaaa

SEQ ID NO: 895618 - DNA, 25 bp, Mus musculus
tggtggtgctgtgttcctgatgaaa

SEQ ID NO: 895619 - DNA, 25 bp, Mus musculus
tggtggtggaccctcatcctggtac

SEQ ID NO: 895620 - DNA, 25 bp, Mus musculus
tggtggtggaccgtcatcctggtac

SEQ ID NO: 895621 - DNA, 25 bp, Mus musculus
tggtggtggcttatatctcccgtga

SEQ ID NO: 895622 - DNA, 25 bp, Mus musculus
tggtggtggcttttatctcccgtga

SEQ ID NO: 895623 - DNA, 25 bp, Mus musculus
tggtggtgggacagttacccgtact

SEQ ID NO: 895624 - DNA, 25 bp, Mus musculus
tggtggtgggactgttacccgtact

SEQ ID NO: 895625 - DNA, 25 bp, Mus musculus
tggtggtgggctagcatagctacct

SEQ ID NO: 895626 - DNA, 25 bp, Mus musculus
tggtggtgggcttgcatagctacct

SEQ ID NO: 895627 - DNA, 25 bp, Mus musculus
tggtggtgggttatcattcttaaga

SEQ ID NO: 895628 - DNA, 25 bp, Mus musculus
tggtggtgggttttcattcttaaga

SEQ ID NO: 895629 - DNA, 25 bp, Mus musculus
tggtggtggttaaatacataaatat

SEQ ID NO: 895630 - DNA, 25 bp, Mus musculus
tggtggtggttatatacataaatat

SEQ ID NO: 895631 - DNA, 25 bp, Mus musculus
tggtggtgtcataagcagtcatcgc

SEQ ID NO: 895632 - DNA, 25 bp, Mus musculus
tggtggtgtcattagcagtcatcgc

SEQ ID NO: 895633 - DNA, 25 bp, Mus musculus
tggtggtgtgaactgaacccagata

SEQ ID NO: 895634 - DNA, 25 bp, Mus musculus
tggtggtgtgaagtgaacccagata

SEQ ID NO: 895635 - DNA, 25 bp, Mus musculus
tggtggtgttccatttgagtttcaa

SEQ ID NO: 895636 - DNA, 25 bp, Mus musculus
tggtggtgttccttttgagtttcaa

SEQ ID NO: 895637 - DNA, 25 bp, Mus musculus
tggtggtgttggcactcagtttccc

SEQ ID NO: 895638 - DNA, 25 bp, Mus musculus
tggtggtgttgggactcagtttccc

SEQ ID NO: 895639 - DNA, 25 bp, Mus musculus
tggtggttaccactctcgtgctatg

SEQ ID NO: 895640 - DNA, 25 bp, Mus musculus
tggtggttaccagtctcgtgctatg

SEQ ID NO: 895641 - DNA, 25 bp, Mus musculus
tggtggttacccataatgccctcca

SEQ ID NO: 895642 - DNA, 25 bp, Mus musculus
tggtggttacccttaatgccctcca

SEQ ID NO: 895643 - DNA, 25 bp, Mus musculus
tggtggttagtaacttgaccccaga

SEQ ID NO: 895644 - DNA, 25 bp, Mus musculus
tggtggttagtatcttgaccccaga

SEQ ID NO: 895645 - DNA, 25 bp, Mus musculus
tggtggttcactagcacggcaggcc

SEQ ID NO: 895646 - DNA, 25 bp, Mus musculus
tggtggttcacttgcacggcaggcc

SEQ ID NO: 895647 - DNA, 25 bp, Mus musculus
tggtggttcagccttagtcccagca

SEQ ID NO: 895648 - DNA, 25 bp, Mus musculus
tggtggttcagcgttagtcccagca

SEQ ID NO: 895649 - DNA, 25 bp, Mus musculus
tggtggttcggaaatcgagctcaca

SEQ ID NO: 895650 - DNA, 25 bp, Mus musculus
tggtggttcggatatcgagctcaca

SEQ ID NO: 895651 - DNA, 25 bp, Mus musculus
tggtggttcgttcatcttattctgc

SEQ ID NO: 895652 - DNA, 25 bp, Mus musculus
tggtggttcgttgatcttattctgc

SEQ ID NO: 895653 - DNA, 25 bp, Mus musculus
tggtggttctatatgcctagcaagc

SEQ ID NO: 895654 - DNA, 25 bp, Mus musculus
tggtggttctatttgcctagcaagc

SEQ ID NO: 895655 - DNA, 25 bp, Mus musculus
tggtggttctcaatccaccccaaaa

SEQ ID NO: 895656 - DNA, 25 bp, Mus musculus
tggtggttctcattccaccccaaaa

SEQ ID NO: 895657 - DNA, 25 bp, Mus musculus
tggtggttgccacctgaaacttcaa

SEQ ID NO: 895658 - DNA, 25 bp, Mus musculus
tggtggttgccagctgaaacttcaa

SEQ ID NO: 895659 - DNA, 25 bp, Mus musculus
tggtggttgcccaaccttttttatg

SEQ ID NO: 895660 - DNA, 25 bp, Mus musculus
tggtggttgccctaccttttttatg

SEQ ID NO: 895661 - DNA, 25 bp, Mus musculus
tggtggttgggaccacactcccgac

SEQ ID NO: 895662 - DNA, 25 bp, Mus musculus
tggtggttgggagcacactcccgac

SEQ ID NO: 895663 - DNA, 25 bp, Mus musculus
tggtggttgggcagtctatccctcg

SEQ ID NO: 895664 - DNA, 25 bp, Mus musculus
tggtggttgggctgtctatccctcg

SEQ ID NO: 895665 - DNA, 25 bp, Mus musculus
tggtggttgtctaacttgtttgttt

SEQ ID NO: 895666 - DNA, 25 bp, Mus musculus
tggtggttgtcttacttgtttgttt

SEQ ID NO: 895667 - DNA, 25 bp, Mus musculus
tggtggttgtttacccaagggcagc

SEQ ID NO: 895668 - DNA, 25 bp, Mus musculus
tggtggttgttttcccaagggcagc

SEQ ID NO: 895669 - DNA, 25 bp, Mus musculus
tggtggtttcggattctgcgttgcc

SEQ ID NO: 895670 - DNA, 25 bp, Mus musculus
tggtggtttcggtttctgcgttgcc

SEQ ID NO: 895671 - DNA, 25 bp, Mus musculus
tggtggttttgtaccaacccagatt

SEQ ID NO: 895672 - DNA, 25 bp, Mus musculus
tggtggttttgttccaacccagatt

SEQ ID NO: 895673 - DNA, 25 bp, Mus musculus
tggtgtaactgtctgtttccctcca

SEQ ID NO: 895674 - DNA, 25 bp, Mus musculus
tggtgtaactgtgtgtttccctcca

SEQ ID NO: 895675 - DNA, 25 bp, Mus musculus
tggtgtaagcatcatttattagtct

SEQ ID NO: 895676 - DNA, 25 bp, Mus musculus
tggtgtaagcatgatttattagtct

SEQ ID NO: 895677 - DNA, 25 bp, Mus musculus
tggtgtacacgcatacactcaggca

SEQ ID NO: 895678 - DNA, 25 bp, Mus musculus
tggtgtacacgcttacactcaggca

SEQ ID NO: 895679 - DNA, 25 bp, Mus musculus
tggtgtacatatacagccccggtac

SEQ ID NO: 895680 - DNA, 25 bp, Mus musculus
tggtgtacatattcagccccggtac

SEQ ID NO: 895681 - DNA, 25 bp, Mus musculus
tggtgtaccagccatctacaccaac

SEQ ID NO: 895682 - DNA, 25 bp, Mus musculus
tggtgtaccagcgatctacaccaac

SEQ ID NO: 895683 - DNA, 25 bp, Mus musculus
tggtgtacctatcgaagtcagtgtt

SEQ ID NO: 895684 - DNA, 25 bp, Mus musculus
tggtgtacctatggaagtcagtgtt

SEQ ID NO: 895685 - DNA, 25 bp, Mus musculus
tggtgtacgagcagatccctgcaac

SEQ ID NO: 895686 - DNA, 25 bp, Mus musculus
tggtgtacgagctgatccctgcaac

SEQ ID NO: 895687 - DNA, 25 bp, Mus musculus
tggtgtactaatcaacctacccttt

SEQ ID NO: 895688 - DNA, 25 bp, Mus musculus
tggtgtactaatgaacctacccttt

SEQ ID NO: 895689 - DNA, 25 bp, Mus musculus
tggtgtactttcattactcctgcat

SEQ ID NO: 895690 - DNA, 25 bp, Mus musculus
tggtgtactttctttactcctgcat

SEQ ID NO: 895691 - DNA, 25 bp, Mus musculus
tggtgtagaccgatataagatcaat

SEQ ID NO: 895692 - DNA, 25 bp, Mus musculus
tggtgtagaccgttataagatcaat

SEQ ID NO: 895693 - DNA, 25 bp, Mus musculus
tggtgtagtgagacccaggcaagcc

SEQ ID NO: 895694 - DNA, 25 bp, Mus musculus
tggtgtagtgagtcccaggcaagcc

SEQ ID NO: 895695 - DNA, 25 bp, Mus musculus
tggtgtagttccagcccatcaagga

SEQ ID NO: 895696 - DNA, 25 bp, Mus musculus
tggtgtagttcctgcccatcaagga

SEQ ID NO: 895697 - DNA, 25 bp, Mus musculus
tggtgtataaccacggctcacagtg

SEQ ID NO: 895698 - DNA, 25 bp, Mus musculus
tggtgtataacctcggctcacagtg

SEQ ID NO: 895699 - DNA, 25 bp, Mus musculus
tggtgtatattcatccataattttc

SEQ ID NO: 895700 - DNA, 25 bp, Mus musculus
tggtgtatattcttccataattttc

SEQ ID NO: 895701 - DNA, 25 bp, Mus musculus
tggtgtatccaaccactcggacgta

SEQ ID NO: 895702 - DNA, 25 bp, Mus musculus
tggtgtatccaagcactcggacgta

SEQ ID NO: 895703 - DNA, 25 bp, Mus musculus
tggtgtatcctgctgttatggttct

SEQ ID NO: 895704 - DNA, 25 bp, Mus musculus
tggtgtatcctggtgttatggttct

SEQ ID NO: 895705 - DNA, 25 bp, Mus musculus
tggtgtatgaacagtggtttggttt

SEQ ID NO: 895706 - DNA, 25 bp, Mus musculus
tggtgtatgaactgtggtttggttt

SEQ ID NO: 895707 - DNA, 25 bp, Mus musculus
tggtgtattaaacgcactctgccct

SEQ ID NO: 895708 - DNA, 25 bp, Mus musculus
tggtgtattaaaggcactctgccct

SEQ ID NO: 895709 - DNA, 25 bp, Mus musculus
tggtgtattcatcggactcctgact

SEQ ID NO: 895710 - DNA, 25 bp, Mus musculus
tggtgtattcatgggactcctgact

SEQ ID NO: 895711 - DNA, 25 bp, Mus musculus
tggtgtattgtgctcactgctgctc

SEQ ID NO: 895712 - DNA, 25 bp, Mus musculus
tggtgtattgtggtcactgctgctc

SEQ ID NO: 895713 - DNA, 25 bp, Mus musculus
tggtgtcaaaaaacaagtccgcctt

SEQ ID NO: 895714 - DNA, 25 bp, Mus musculus
tggtgtcaaaaatcaagtccgcctt

SEQ ID NO: 895715 - DNA, 25 bp, Mus musculus
tggtgtcaacatcctgtgcctttct

SEQ ID NO: 895716 - DNA, 25 bp, Mus musculus
tggtgtcaacatgctgtgcctttct

SEQ ID NO: 895717 - DNA, 25 bp, Mus musculus
tggtgtcaaccaaaggcatgtgatt

SEQ ID NO: 895718 - DNA, 25 bp, Mus musculus
tggtgtcaaccataggcatgtgatt

SEQ ID NO: 895719 - DNA, 25 bp, Mus musculus
tggtgtcaatacacagccaggctga

SEQ ID NO: 895720 - DNA, 25 bp, Mus musculus
tggtgtcaatactcagccaggctga

SEQ ID NO: 895721 - DNA, 25 bp, Mus musculus
tggtgtcacagaccccaagcttgag

SEQ ID NO: 895722 - DNA, 25 bp, Mus musculus
tggtgtcacagagcccaagcttgag

SEQ ID NO: 895723 - DNA, 25 bp, Mus musculus
tggtgtcacagcagagtactctcta

SEQ ID NO: 895724 - DNA, 25 bp, Mus musculus
tggtgtcacagctgagtactctcta

SEQ ID NO: 895725 - DNA, 25 bp, Mus musculus
tggtgtcactgcaccgggacaggaa

SEQ ID NO: 895726 - DNA, 25 bp, Mus musculus
tggtgtcactgcactcagttgctgg

SEQ ID NO: 895727 - DNA, 25 bp, Mus musculus
tggtgtcactgcagtttattcttaa

SEQ ID NO: 895728 - DNA, 25 bp, Mus musculus
tggtgtcactgctccgggacaggaa

SEQ ID NO: 895729 - DNA, 25 bp, Mus musculus
tggtgtcactgctctcagttgctgg

SEQ ID NO: 895730 - DNA, 25 bp, Mus musculus
tggtgtcactgctgtttattcttaa

SEQ ID NO: 895731 - DNA, 25 bp, Mus musculus
tggtgtcagcaccttggtcacagtc

SEQ ID NO: 895732 - DNA, 25 bp, Mus musculus
tggtgtcagcacgttggtcacagtc

SEQ ID NO: 895733 - DNA, 25 bp, Mus musculus
tggtgtcagcgtcgaacctttctgg

SEQ ID NO: 895734 - DNA, 25 bp, Mus musculus
tggtgtcagcgtggaacctttctgg

SEQ ID NO: 895735 - DNA, 25 bp, Mus musculus
tggtgtcagttcacagtcaggctga

SEQ ID NO: 895736 - DNA, 25 bp, Mus musculus
tggtgtcagttcaccttgcttctgc

SEQ ID NO: 895737 - DNA, 25 bp, Mus musculus
tggtgtcagttctcagtcaggctga

SEQ ID NO: 895738 - DNA, 25 bp, Mus musculus
tggtgtcagttctccttgcttctgc

SEQ ID NO: 895739 - DNA, 25 bp, Mus musculus
tggtgtcatacaaagttacttggtc

SEQ ID NO: 895740 - DNA, 25 bp, Mus musculus
tggtgtcatacatagttacttggtc

SEQ ID NO: 895741 - DNA, 25 bp, Mus musculus
tggtgtcatccaagctgcctacaac

SEQ ID NO: 895742 - DNA, 25 bp, Mus musculus
tggtgtcatccatgctgcctacaac

SEQ ID NO: 895743 - DNA, 25 bp, Mus musculus
tggtgtcatctccagtgttctcact

SEQ ID NO: 895744 - DNA, 25 bp, Mus musculus
tggtgtcatctcgagtgttctcact

SEQ ID NO: 895745 - DNA, 25 bp, Mus musculus
tggtgtcatgaaaaacctgattgtt

SEQ ID NO: 895746 - DNA, 25 bp, Mus musculus
tggtgtcatgaataacctgattgtt

SEQ ID NO: 895747 - DNA, 25 bp, Mus musculus
tggtgtcatgttactgtggcttgtt

SEQ ID NO: 895748 - DNA, 25 bp, Mus musculus
tggtgtcatgtttctgtggcttgtt

SEQ ID NO: 895749 - DNA, 25 bp, Mus musculus
tggtgtccaaccagtatgtcatctc

SEQ ID NO: 895750 - DNA, 25 bp, Mus musculus
tggtgtccaacctgtatgtcatctc

SEQ ID NO: 895751 - DNA, 25 bp, Mus musculus
tggtgtccaagtatccttgcagagt

SEQ ID NO: 895752 - DNA, 25 bp, Mus musculus
tggtgtccaagtttccttgcagagt

SEQ ID NO: 895753 - DNA, 25 bp, Mus musculus
tggtgtccacaacactactgggagt

SEQ ID NO: 895754 - DNA, 25 bp, Mus musculus
tggtgtccacaagactactgggagt

SEQ ID NO: 895755 - DNA, 25 bp, Mus musculus
tggtgtccagagactcaattgcttt

SEQ ID NO: 895756 - DNA, 25 bp, Mus musculus
tggtgtccagagtctcaattgcttt

SEQ ID NO: 895757 - DNA, 25 bp, Mus musculus
tggtgtccatcacggcatttccaga

SEQ ID NO: 895758 - DNA, 25 bp, Mus musculus
tggtgtccatcagggcatttccaga

SEQ ID NO: 895759 - DNA, 25 bp, Mus musculus
tggtgtcccaagatttatccctaga

SEQ ID NO: 895760 - DNA, 25 bp, Mus musculus
tggtgtcccaagttttatccctaga

SEQ ID NO: 895761 - DNA, 25 bp, Mus musculus
tggtgtcccaccatatttaatgatg

SEQ ID NO: 895762 - DNA, 25 bp, Mus musculus
tggtgtcccaccttatttaatgatg

SEQ ID NO: 895763 - DNA, 25 bp, Mus musculus
tggtgtcccagacagaagagcccgc

SEQ ID NO: 895764 - DNA, 25 bp, Mus musculus
tggtgtcccagagagaagagcccgc

SEQ ID NO: 895765 - DNA, 25 bp, Mus musculus
tggtgtcccagcaaagcatactcag

SEQ ID NO: 895766 - DNA, 25 bp, Mus musculus
tggtgtcccagctaagcatactcag

SEQ ID NO: 895767 - DNA, 25 bp, Mus musculus
tggtgtcccaggctctactcgtgaa

SEQ ID NO: 895768 - DNA, 25 bp, Mus musculus
tggtgtcccagggtctactcgtgaa

SEQ ID NO: 895769 - DNA, 25 bp, Mus musculus
tggtgtccctaacgtaagtcctcga

SEQ ID NO: 895770 - DNA, 25 bp, Mus musculus
tggtgtccctaaggtaagtcctcga

SEQ ID NO: 895771 - DNA, 25 bp, Mus musculus
tggtgtccctgcctttatggatatt

SEQ ID NO: 895772 - DNA, 25 bp, Mus musculus
tggtgtccctgcgtttatggatatt

SEQ ID NO: 895773 - DNA, 25 bp, Mus musculus
tggtgtccctggcagtccaatatcc

SEQ ID NO: 895774 - DNA, 25 bp, Mus musculus
tggtgtccctgggagtccaatatcc

SEQ ID NO: 895775 - DNA, 25 bp, Mus musculus
tggtgtccggagacgccgcaagtct

SEQ ID NO: 895776 - DNA, 25 bp, Mus musculus
tggtgtccggagtcgccgcaagtct

SEQ ID NO: 895777 - DNA, 25 bp, Mus musculus
tggtgtcctaatccctttattttgg

SEQ ID NO: 895778 - DNA, 25 bp, Mus musculus
tggtgtcctaatgcctttattttgg

SEQ ID NO: 895779 - DNA, 25 bp, Mus musculus
tggtgtcctcctaatgatgcacaac

SEQ ID NO: 895780 - DNA, 25 bp, Mus musculus
tggtgtcctccttatgatgcacaac

SEQ ID NO: 895781 - DNA, 25 bp, Mus musculus
tggtgtccttccatgatgacagcga

SEQ ID NO: 895782 - DNA, 25 bp, Mus musculus
tggtgtccttccttgatgacagcga

SEQ ID NO: 895783 - DNA, 25 bp, Mus musculus
tggtgtccttttcaatgcctcacaa

SEQ ID NO: 895784 - DNA, 25 bp, Mus musculus
tggtgtccttttgaatgcctcacaa

SEQ ID NO: 895785 - DNA, 25 bp, Mus musculus
tggtgtcgcttccatcttaaggagc

SEQ ID NO: 895786 - DNA, 25 bp, Mus musculus
tggtgtcgcttcgatcttaaggagc

SEQ ID NO: 895787 - DNA, 25 bp, Mus musculus
tggtgtcgcttgactggttaaggac

SEQ ID NO: 895788 - DNA, 25 bp, Mus musculus
tggtgtcgcttgtctggttaaggac

SEQ ID NO: 895789 - DNA, 25 bp, Mus musculus
tggtgtcggcctagcggatccacaa

SEQ ID NO: 895790 - DNA, 25 bp, Mus musculus
tggtgtcggccttgcggatccacaa

SEQ ID NO: 895791 - DNA, 25 bp, Mus musculus
tggtgtctaaagacttcccttttgc

SEQ ID NO: 895792 - DNA, 25 bp, Mus musculus
tggtgtctaaagtcttcccttttgc

SEQ ID NO: 895793 - DNA, 25 bp, Mus musculus
tggtgtctaactatagagggaccaa

SEQ ID NO: 895794 - DNA, 25 bp, Mus musculus
tggtgtctaactttagagggaccaa

SEQ ID NO: 895795 - DNA, 25 bp, Mus musculus
tggtgtctacaccaaggtgtgcaag

SEQ ID NO: 895796 - DNA, 25 bp, Mus musculus
tggtgtctacacgaaggtgtgcaag

SEQ ID NO: 895797 - DNA, 25 bp, Mus musculus
tggtgtctagtccttccagatgctt

SEQ ID NO: 895798 - DNA, 25 bp, Mus musculus
tggtgtctagtcgttccagatgctt

SEQ ID NO: 895799 - DNA, 25 bp, Mus musculus
tggtgtctcccaactaatcaactct

SEQ ID NO: 895800 - DNA, 25 bp, Mus musculus
tggtgtctcccatctaatcaactct

SEQ ID NO: 895801 - DNA, 25 bp, Mus musculus
tggtgtctccggctgtcactgaaga

SEQ ID NO: 895802 - DNA, 25 bp, Mus musculus
tggtgtctccgggtgtcactgaaga

SEQ ID NO: 895803 - DNA, 25 bp, Mus musculus
tggtgtctcgctaatttcacttatg

SEQ ID NO: 895804 - DNA, 25 bp, Mus musculus
tggtgtctcgcttatttcacttatg

SEQ ID NO: 895805 - DNA, 25 bp, Mus musculus
tggtgtctctctacgatgctaactt

SEQ ID NO: 895806 - DNA, 25 bp, Mus musculus
tggtgtctctcttcgatgctaactt

SEQ ID NO: 895807 - DNA, 25 bp, Mus musculus
tggtgtctctgacgcacaggctact

SEQ ID NO: 895808 - DNA, 25 bp, Mus musculus
tggtgtctctgaggcacaggctact

SEQ ID NO: 895809 - DNA, 25 bp, Mus musculus
tggtgtctctgtaggtgtctcatgc

SEQ ID NO: 895810 - DNA, 25 bp, Mus musculus
tggtgtctctgttggtgtctcatgc

SEQ ID NO: 895811 - DNA, 25 bp, Mus musculus
tggtgtctgaagcaaatttacagga

SEQ ID NO: 895812 - DNA, 25 bp, Mus musculus
tggtgtctgaaggaaatttacagga

SEQ ID NO: 895813 - DNA, 25 bp, Mus musculus
tggtgtctgacaatactcctccaag

SEQ ID NO: 895814 - DNA, 25 bp, Mus musculus
tggtgtctgacattactcctccaag

SEQ ID NO: 895815 - DNA, 25 bp, Mus musculus
tggtgtctgcagagtgaacgaacac

SEQ ID NO: 895816 - DNA, 25 bp, Mus musculus
tggtgtctgcagtgtgaacgaacac

SEQ ID NO: 895817 - DNA, 25 bp, Mus musculus
tggtgtctggtgaaagccctcagca

SEQ ID NO: 895818 - DNA, 25 bp, Mus musculus
tggtgtctggtgtaagccctcagca

SEQ ID NO: 895819 - DNA, 25 bp, Mus musculus
tggtgtctgtgccagatttgcacct

SEQ ID NO: 895820 - DNA, 25 bp, Mus musculus
tggtgtctgtgcgagatttgcacct

SEQ ID NO: 895821 - DNA, 25 bp, Mus musculus
tggtgtctgtttcatcgtcccagga

SEQ ID NO: 895822 - DNA, 25 bp, Mus musculus
tggtgtctgtttgatcgtcccagga

SEQ ID NO: 895823 - DNA, 25 bp, Mus musculus
tggtgtcttcacacgggatatcaac

SEQ ID NO: 895824 - DNA, 25 bp, Mus musculus
tggtgtcttcacctgaatctctgca

SEQ ID NO: 895825 - DNA, 25 bp, Mus musculus
tggtgtcttcacgtgaatctctgca

SEQ ID NO: 895826 - DNA, 25 bp, Mus musculus
tggtgtcttcactcgggatatcaac

SEQ ID NO: 895827 - DNA, 25 bp, Mus musculus
tggtgtcttctcattcctgaggaga

SEQ ID NO: 895828 - DNA, 25 bp, Mus musculus
tggtgtcttctctttcctgaggaga

SEQ ID NO: 895829 - DNA, 25 bp, Mus musculus
tggtgtcttttacctactttgaaca

SEQ ID NO: 895830 - DNA, 25 bp, Mus musculus
tggtgtcttttagctactttgaaca

SEQ ID NO: 895831 - DNA, 25 bp, Mus musculus
tggtgtgaaacccacattgatggaa

SEQ ID NO: 895832 - DNA, 25 bp, Mus musculus
tggtgtgaaaccgacattgatggaa

SEQ ID NO: 895833 - DNA, 25 bp, Mus musculus
tggtgtgaatttcctgacgtgtttt

SEQ ID NO: 895834 - DNA, 25 bp, Mus musculus
tggtgtgaatttgctgacgtgtttt

SEQ ID NO: 895835 - DNA, 25 bp, Mus musculus
tggtgtgacagaaagggcagcctct

SEQ ID NO: 895836 - DNA, 25 bp, Mus musculus
tggtgtgacagatagggcagcctct

SEQ ID NO: 895837 - DNA, 25 bp, Mus musculus
tggtgtgaccagaggcctatgcttc

SEQ ID NO: 895838 - DNA, 25 bp, Mus musculus
tggtgtgaccagtggcctatgcttc

SEQ ID NO: 895839 - DNA, 25 bp, Mus musculus
tggtgtgacctgatcatcgcccaag

SEQ ID NO: 895840 - DNA, 25 bp, Mus musculus
tggtgtgacctgctgtaggttcacc

SEQ ID NO: 895841 - DNA, 25 bp, Mus musculus
tggtgtgacctggtgtaggttcacc

SEQ ID NO: 895842 - DNA, 25 bp, Mus musculus
tggtgtgacctgttcatcgcccaag

SEQ ID NO: 895843 - DNA, 25 bp, Mus musculus
tggtgtgacttgcttggcaatattt

SEQ ID NO: 895844 - DNA, 25 bp, Mus musculus
tggtgtgacttggttggcaatattt

SEQ ID NO: 895845 - DNA, 25 bp, Mus musculus
tggtgtgaggtgattgaatatagta

SEQ ID NO: 895846 - DNA, 25 bp, Mus musculus
tggtgtgaggtgtttgaatatagta

SEQ ID NO: 895847 - DNA, 25 bp, Mus musculus
tggtgtgataatctccctgggactt

SEQ ID NO: 895848 - DNA, 25 bp, Mus musculus
tggtgtgataatgtccctgggactt

SEQ ID NO: 895849 - DNA, 25 bp, Mus musculus
tggtgtgatcttcaggtccttttac

SEQ ID NO: 895850 - DNA, 25 bp, Mus musculus
tggtgtgatcttgaggtccttttac

SEQ ID NO: 895851 - DNA, 25 bp, Mus musculus
tggtgtgatggacgaccttaagtca

SEQ ID NO: 895852 - DNA, 25 bp, Mus musculus
tggtgtgatggaggaccttaagtca

SEQ ID NO: 895853 - DNA, 25 bp, Mus musculus
tggtgtgatggtctccttgttagca

SEQ ID NO: 895854 - DNA, 25 bp, Mus musculus
tggtgtgatggtgtccttgttagca

SEQ ID NO: 895855 - DNA, 25 bp, Mus musculus
tggtgtgattatcttcctctatgag

SEQ ID NO: 895856 - DNA, 25 bp, Mus musculus
tggtgtgattatgttcctctatgag

SEQ ID NO: 895857 - DNA, 25 bp, Mus musculus
tggtgtgattgtctgttttgcctcc

SEQ ID NO: 895858 - DNA, 25 bp, Mus musculus
tggtgtgattgtgtgttttgcctcc

SEQ ID NO: 895859 - DNA, 25 bp, Mus musculus
tggtgtgcaagacgcagttcctaac

SEQ ID NO: 895860 - DNA, 25 bp, Mus musculus
tggtgtgcaagaggcagttcctaac

SEQ ID NO: 895861 - DNA, 25 bp, Mus musculus
tggtgtgcaagcaggcctttaactt

SEQ ID NO: 895862 - DNA, 25 bp, Mus musculus
tggtgtgcaagctggcctttaactt

SEQ ID NO: 895863 - DNA, 25 bp, Mus musculus
tggtgtgcactccaggatgactttg

SEQ ID NO: 895864 - DNA, 25 bp, Mus musculus
tggtgtgcactcgaggatgactttg

SEQ ID NO: 895865 - DNA, 25 bp, Mus musculus
tggtgtgcacttattgcccttttta

SEQ ID NO: 895866 - DNA, 25 bp, Mus musculus
tggtgtgcactttttgcccttttta

SEQ ID NO: 895867 - DNA, 25 bp, Mus musculus
tggtgtgcatagctttactccggca

SEQ ID NO: 895868 - DNA, 25 bp, Mus musculus
tggtgtgcataggtttactccggca

SEQ ID NO: 895869 - DNA, 25 bp, Mus musculus
tggtgtgcccggctccatacgtatc

SEQ ID NO: 895870 - DNA, 25 bp, Mus musculus
tggtgtgcccgggtccatacgtatc

SEQ ID NO: 895871 - DNA, 25 bp, Mus musculus
tggtgtgccggcattccagcagcgc

SEQ ID NO: 895872 - DNA, 25 bp, Mus musculus
tggtgtgccggctttccagcagcgc

SEQ ID NO: 895873 - DNA, 25 bp, Mus musculus
tggtgtgcctgactcattcttttac

SEQ ID NO: 895874 - DNA, 25 bp, Mus musculus
tggtgtgcctgagtcattcttttac

SEQ ID NO: 895875 - DNA, 25 bp, Mus musculus
tggtgtgccttcaagacagcgtgtt

SEQ ID NO: 895876 - DNA, 25 bp, Mus musculus
tggtgtgccttctagacagcgtgtt

SEQ ID NO: 895877 - DNA, 25 bp, Mus musculus
tggtgtgcggtaaaaaccattccta

SEQ ID NO: 895878 - DNA, 25 bp, Mus musculus
tggtgtgcggtataaaccattccta

SEQ ID NO: 895879 - DNA, 25 bp, Mus musculus
tggtgtgcggtcactacctttagga

SEQ ID NO: 895880 - DNA, 25 bp, Mus musculus
tggtgtgcggtctctacctttagga

SEQ ID NO: 895881 - DNA, 25 bp, Mus musculus
tggtgtgctcttagggtttattttt

SEQ ID NO: 895882 - DNA, 25 bp, Mus musculus
tggtgtgctctttgggtttattttt

SEQ ID NO: 895883 - DNA, 25 bp, Mus musculus
tggtgtgctgagagtccttgtcaga

SEQ ID NO: 895884 - DNA, 25 bp, Mus musculus
tggtgtgctgagtgtccttgtcaga

SEQ ID NO: 895885 - DNA, 25 bp, Mus musculus
tggtgtgcttgcaagctgtgcagaa

SEQ ID NO: 895886 - DNA, 25 bp, Mus musculus
tggtgtgcttgctagctgtgcagaa

SEQ ID NO: 895887 - DNA, 25 bp, Mus musculus
tggtgtgctttgcaccctacaacat

SEQ ID NO: 895888 - DNA, 25 bp, Mus musculus
tggtgtgctttggaccctacaacat

SEQ ID NO: 895889 - DNA, 25 bp, Mus musculus
tggtgtggacacatgtgcagtgcca

SEQ ID NO: 895890 - DNA, 25 bp, Mus musculus
tggtgtggacacttgtgcagtgcca

SEQ ID NO: 895891 - DNA, 25 bp, Mus musculus
tggtgtggacatcactgctactatt

SEQ ID NO: 895892 - DNA, 25 bp, Mus musculus
tggtgtggacatgactgctactatt

SEQ ID NO: 895893 - DNA, 25 bp, Mus musculus
tggtgtggatgtaaatggccctgta

SEQ ID NO: 895894 - DNA, 25 bp, Mus musculus
tggtgtggatgttaatggccctgta

SEQ ID NO: 895895 - DNA, 25 bp, Mus musculus
tggtgtggcaacaaccccccaagag

SEQ ID NO: 895896 - DNA, 25 bp, Mus musculus
tggtgtggcaactaccccccaagag

SEQ ID NO: 895897 - DNA, 25 bp, Mus musculus
tggtgtggcaggagcgcacacccat

SEQ ID NO: 895898 - DNA, 25 bp, Mus musculus
tggtgtggcaggtgcgcacacccat

SEQ ID NO: 895899 - DNA, 25 bp, Mus musculus
tggtgtggccatccgtgagatctac

SEQ ID NO: 895900 - DNA, 25 bp, Mus musculus
tggtgtggccatgcgtgagatctac

SEQ ID NO: 895901 - DNA, 25 bp, Mus musculus
tggtgtggccttatccaataccctg

SEQ ID NO: 895902 - DNA, 25 bp, Mus musculus
tggtgtggccttttccaataccctg

SEQ ID NO: 895903 - DNA, 25 bp, Mus musculus
tggtgtgggcaaatctttctgccta

SEQ ID NO: 895904 - DNA, 25 bp, Mus musculus
tggtgtgggcaattctttctgccta

SEQ ID NO: 895905 - DNA, 25 bp, Mus musculus
tggtgtggtagacgttcactgcccc

SEQ ID NO: 895906 - DNA, 25 bp, Mus musculus
tggtgtggtagaggttcactgcccc

SEQ ID NO: 895907 - DNA, 25 bp, Mus musculus
tggtgtggtcacactacacaggaaa

SEQ ID NO: 895908 - DNA, 25 bp, Mus musculus
tggtgtggtcactctacacaggaaa

SEQ ID NO: 895909 - DNA, 25 bp, Mus musculus
tggtgtggtgccacgctcctttaca

SEQ ID NO: 895910 - DNA, 25 bp, Mus musculus
tggtgtggtgcctcgctcctttaca

SEQ ID NO: 895911 - DNA, 25 bp, Mus musculus
tggtgtggtggaaagatcctattat

SEQ ID NO: 895912 - DNA, 25 bp, Mus musculus
tggtgtggtggatagatcctattat

SEQ ID NO: 895913 - DNA, 25 bp, Mus musculus
tggtgtggttgtctctcagttcatc

SEQ ID NO: 895914 - DNA, 25 bp, Mus musculus
tggtgtggttgtgtctcagttcatc

SEQ ID NO: 895915 - DNA, 25 bp, Mus musculus
tggtgtgtaagccatccaagtctgt

SEQ ID NO: 895916 - DNA, 25 bp, Mus musculus
tggtgtgtaagcgatccaagtctgt

SEQ ID NO: 895917 - DNA, 25 bp, Mus musculus
tggtgtgtacaacaagctcacaggc

SEQ ID NO: 895918 - DNA, 25 bp, Mus musculus
tggtgtgtacaagaagctcacaggc

SEQ ID NO: 895919 - DNA, 25 bp, Mus musculus
tggtgtgtacagagttcccatgaca

SEQ ID NO: 895920 - DNA, 25 bp, Mus musculus
tggtgtgtacagtgttcccatgaca

SEQ ID NO: 895921 - DNA, 25 bp, Mus musculus
tggtgtgtagaactgctccaggctt

SEQ ID NO: 895922 - DNA, 25 bp, Mus musculus
tggtgtgtagaagtgctccaggctt

SEQ ID NO: 895923 - DNA, 25 bp, Mus musculus
tggtgtgtataaatctgctagccta

SEQ ID NO: 895924 - DNA, 25 bp, Mus musculus
tggtgtgtataattctgctagccta

SEQ ID NO: 895925 - DNA, 25 bp, Mus musculus
tggtgtgtattgaatggtagctctt

SEQ ID NO: 895926 - DNA, 25 bp, Mus musculus
tggtgtgtattgtatggtagctctt

SEQ ID NO: 895927 - DNA, 25 bp, Mus musculus
tggtgtgtatttccaattactatta

SEQ ID NO: 895928 - DNA, 25 bp, Mus musculus
tggtgtgtatttgcaattactatta

SEQ ID NO: 895929 - DNA, 25 bp, Mus musculus
tggtgtgtcagtcgcagtgttccac

SEQ ID NO: 895930 - DNA, 25 bp, Mus musculus
tggtgtgtcagtggcagtgttccac

SEQ ID NO: 895931 - DNA, 25 bp, Mus musculus
tggtgtgtcttactctttccctgag

SEQ ID NO: 895932 - DNA, 25 bp, Mus musculus
tggtgtgtcttagtctttccctgag

SEQ ID NO: 895933 - DNA, 25 bp, Mus musculus
tggtgtgtcttgagaataactgaag

SEQ ID NO: 895934 - DNA, 25 bp, Mus musculus
tggtgtgtcttgtgaataactgaag

SEQ ID NO: 895935 - DNA, 25 bp, Mus musculus
tggtgtgtgagtctcgaccccagca

SEQ ID NO: 895936 - DNA, 25 bp, Mus musculus
tggtgtgtgagtgtcgaccccagca

SEQ ID NO: 895937 - DNA, 25 bp, Mus musculus
tggtgtgtgcccacaaattaagaac

SEQ ID NO: 895938 - DNA, 25 bp, Mus musculus
tggtgtgtgccctcaaattaagaac

SEQ ID NO: 895939 - DNA, 25 bp, Mus musculus
tggtgtgtggcaaactgtgttcagt

SEQ ID NO: 895940 - DNA, 25 bp, Mus musculus
tggtgtgtggcatactgtgttcagt

SEQ ID NO: 895941 - DNA, 25 bp, Mus musculus
tggtgtgtgtggagcgcacggagga

SEQ ID NO: 895942 - DNA, 25 bp, Mus musculus
tggtgtgtgtggtgcgcacggagga

SEQ ID NO: 895943 - DNA, 25 bp, Mus musculus
tggtgtgtgttactgcccactttgg

SEQ ID NO: 895944 - DNA, 25 bp, Mus musculus
tggtgtgtgttagtgcccactttgg

SEQ ID NO: 895945 - DNA, 25 bp, Mus musculus
tggtgtgttcatctttcctttaatc

SEQ ID NO: 895946 - DNA, 25 bp, Mus musculus
tggtgtgttcatgtttcctttaatc

SEQ ID NO: 895947 - DNA, 25 bp, Mus musculus
tggtgttaactcctctcaaagctca

SEQ ID NO: 895948 - DNA, 25 bp, Mus musculus
tggtgttaactcgtctcaaagctca

SEQ ID NO: 895949 - DNA, 25 bp, Mus musculus
tggtgttacaatacctaagggctct

SEQ ID NO: 895950 - DNA, 25 bp, Mus musculus
tggtgttacaattcctaagggctct

SEQ ID NO: 895951 - DNA, 25 bp, Mus musculus
tggtgttacacactcacagctttct

SEQ ID NO: 895952 - DNA, 25 bp, Mus musculus
tggtgttacacagtcacagctttct

SEQ ID NO: 895953 - DNA, 25 bp, Mus musculus
tggtgttacagcagtggcctttaat

SEQ ID NO: 895954 - DNA, 25 bp, Mus musculus
tggtgttacagctgtggcctttaat

SEQ ID NO: 895955 - DNA, 25 bp, Mus musculus
tggtgttacattagtattacgctgg

SEQ ID NO: 895956 - DNA, 25 bp, Mus musculus
tggtgttacatttgtattacgctgg

SEQ ID NO: 895957 - DNA, 25 bp, Mus musculus
tggtgttaccagaaggcctccttat

SEQ ID NO: 895958 - DNA, 25 bp, Mus musculus
tggtgttaccagtaggcctccttat

SEQ ID NO: 895959 - DNA, 25 bp, Mus musculus
tggtgttacctcaactcccagtact

SEQ ID NO: 895960 - DNA, 25 bp, Mus musculus
tggtgttacctctactcccagtact

SEQ ID NO: 895961 - DNA, 25 bp, Mus musculus
tggtgttagcgtcgtttgcctagca

SEQ ID NO: 895962 - DNA, 25 bp, Mus musculus
tggtgttagcgtggtttgcctagca

SEQ ID NO: 895963 - DNA, 25 bp, Mus musculus
tggtgttcaagaatgcttcaagaaa

SEQ ID NO: 895964 - DNA, 25 bp, Mus musculus
tggtgttcaagattgcttcaagaaa

SEQ ID NO: 895965 - DNA, 25 bp, Mus musculus
tggtgttcagccactgggaggtcat

SEQ ID NO: 895966 - DNA, 25 bp, Mus musculus
tggtgttcagcctctgggaggtcat

SEQ ID NO: 895967 - DNA, 25 bp, Mus musculus
tggtgttcagtgagttcccaagctc

SEQ ID NO: 895968 - DNA, 25 bp, Mus musculus
tggtgttcagtgtgttcccaagctc

SEQ ID NO: 895969 - DNA, 25 bp, Mus musculus
tggtgttcccaacccagcaatccag

SEQ ID NO: 895970 - DNA, 25 bp, Mus musculus
tggtgttcccaagccagcaatccag

SEQ ID NO: 895971 - DNA, 25 bp, Mus musculus
tggtgttcccgcagccatattgtat

SEQ ID NO: 895972 - DNA, 25 bp, Mus musculus
tggtgttcccgctgccatattgtat

SEQ ID NO: 895973 - DNA, 25 bp, Mus musculus
tggtgttccctcactgattgtggac

SEQ ID NO: 895974 - DNA, 25 bp, Mus musculus
tggtgttccctctctgattgtggac

SEQ ID NO: 895975 - DNA, 25 bp, Mus musculus
tggtgttcctccatgagttcatcga

SEQ ID NO: 895976 - DNA, 25 bp, Mus musculus
tggtgttcctccttgagttcatcga

SEQ ID NO: 895977 - DNA, 25 bp, Mus musculus
tggtgttcgacactccactgcacta

SEQ ID NO: 895978 - DNA, 25 bp, Mus musculus
tggtgttcgacagtccactgcacta

SEQ ID NO: 895979 - DNA, 25 bp, Mus musculus
tggtgttcgtggaccgctctggcaa

SEQ ID NO: 895980 - DNA, 25 bp, Mus musculus
tggtgttcgtggtccgctctggcaa

SEQ ID NO: 895981 - DNA, 25 bp, Mus musculus
tggtgttcgtgtacaaaggctcatg

SEQ ID NO: 895982 - DNA, 25 bp, Mus musculus
tggtgttcgtgttcaaaggctcatg

SEQ ID NO: 895983 - DNA, 25 bp, Mus musculus
tggtgttctacaatatccagcaacg

SEQ ID NO: 895984 - DNA, 25 bp, Mus musculus
tggtgttctacattatccagcaacg

SEQ ID NO: 895985 - DNA, 25 bp, Mus musculus
tggtgttcttgtaccacagttttta

SEQ ID NO: 895986 - DNA, 25 bp, Mus musculus
tggtgttcttgttccacagttttta

SEQ ID NO: 895987 - DNA, 25 bp, Mus musculus
tggtgttgaactcccaatcacctgg

SEQ ID NO: 895988 - DNA, 25 bp, Mus musculus
tggtgttgaactgccaatcacctgg

SEQ ID NO: 895989 - DNA, 25 bp, Mus musculus
tggtgttgaccaccccggaacgaat

SEQ ID NO: 895990 - DNA, 25 bp, Mus musculus
tggtgttgaccagcccggaacgaat

SEQ ID NO: 895991 - DNA, 25 bp, Mus musculus
tggtgttgccctaggtgctcctcag

SEQ ID NO: 895992 - DNA, 25 bp, Mus musculus
tggtgttgcccttggtgctcctcag

SEQ ID NO: 895993 - DNA, 25 bp, Mus musculus
tggtgttgcctgaggtcttggtccc

SEQ ID NO: 895994 - DNA, 25 bp, Mus musculus
tggtgttgcctgtggtcttggtccc

SEQ ID NO: 895995 - DNA, 25 bp, Mus musculus
tggtgttgccttccttctccagatt

SEQ ID NO: 895996 - DNA, 25 bp, Mus musculus
tggtgttgccttgcttctccagatt

SEQ ID NO: 895997 - DNA, 25 bp, Mus musculus
tggtgttggccccttgtgagaaaac

SEQ ID NO: 895998 - DNA, 25 bp, Mus musculus
tggtgttggcccgttgtgagaaaac

SEQ ID NO: 895999 - DNA, 25 bp, Mus musculus
tggtgttggctcagtcacttggtcc

SEQ ID NO: 896000 - DNA, 25 bp, Mus musculus
tggtgttggctctgtcacttggtcc

SEQ ID NO: 896001 - DNA, 25 bp, Mus musculus
tggtgttgggccagttccttatgca

SEQ ID NO: 896002 - DNA, 25 bp, Mus musculus
tggtgttgggcctgttccttatgca

SEQ ID NO: 896003 - DNA, 25 bp, Mus musculus
tggtgttggtttagatagctgttga

SEQ ID NO: 896004 - DNA, 25 bp, Mus musculus
tggtgttggttttgatagctgttga

SEQ ID NO: 896005 - DNA, 25 bp, Mus musculus
tggtgttgtactagagtttctggta

SEQ ID NO: 896006 - DNA, 25 bp, Mus musculus
tggtgttgtacttgagtttctggta

SEQ ID NO: 896007 - DNA, 25 bp, Mus musculus
tggtgttgtgcgagttcactgttta

SEQ ID NO: 896008 - DNA, 25 bp, Mus musculus
tggtgttgtgcgtgttcactgttta

SEQ ID NO: 896009 - DNA, 25 bp, Mus musculus
tggtgttgtgtgctacacctggcat

SEQ ID NO: 896010 - DNA, 25 bp, Mus musculus
tggtgttgtgtggtacacctggcat

SEQ ID NO: 896011 - DNA, 25 bp, Mus musculus
tggtgtttcacgatattatattttt

SEQ ID NO: 896012 - DNA, 25 bp, Mus musculus
tggtgtttcacgttattatattttt

SEQ ID NO: 896013 - DNA, 25 bp, Mus musculus
tggtgtttcagaatcctttgtgcag

SEQ ID NO: 896014 - DNA, 25 bp, Mus musculus
tggtgtttcagattcctttgtgcag

SEQ ID NO: 896015 - DNA, 25 bp, Mus musculus
tggtgtttcataaaggctacctcaa

SEQ ID NO: 896016 - DNA, 25 bp, Mus musculus
tggtgtttcatacgtatgctttgct

SEQ ID NO: 896017 - DNA, 25 bp, Mus musculus
tggtgtttcataggtatgctttgct

SEQ ID NO: 896018 - DNA, 25 bp, Mus musculus
tggtgtttcatataggctacctcaa

SEQ ID NO: 896019 - DNA, 25 bp, Mus musculus
tggtgtttccagagactactgaccc

SEQ ID NO: 896020 - DNA, 25 bp, Mus musculus
tggtgtttccagtgactactgaccc

SEQ ID NO: 896021 - DNA, 25 bp, Mus musculus
tggtgtttccctctttgtgagaagg

SEQ ID NO: 896022 - DNA, 25 bp, Mus musculus
tggtgtttccctgtttgtgagaagg

SEQ ID NO: 896023 - DNA, 25 bp, Mus musculus
tggtgtttcctcaaaatttgcacgg

SEQ ID NO: 896024 - DNA, 25 bp, Mus musculus
tggtgtttcctctaaatttgcacgg

SEQ ID NO: 896025 - DNA, 25 bp, Mus musculus
tggtgtttctgtacttgctcacctg

SEQ ID NO: 896026 - DNA, 25 bp, Mus musculus
tggtgtttctgttcttgctcacctg

SEQ ID NO: 896027 - DNA, 25 bp, Mus musculus
tggtgtttcttgcagccacttggaa

SEQ ID NO: 896028 - DNA, 25 bp, Mus musculus
tggtgtttcttggagccacttggaa

SEQ ID NO: 896029 - DNA, 25 bp, Mus musculus
tggtgtttgccgattggattggact

SEQ ID NO: 896030 - DNA, 25 bp, Mus musculus
tggtgtttgccgtttggattggact

SEQ ID NO: 896031 - DNA, 25 bp, Mus musculus
tggtgtttgcctctaatcccggcag

SEQ ID NO: 896032 - DNA, 25 bp, Mus musculus
tggtgtttgcctctgacatctgtca

SEQ ID NO: 896033 - DNA, 25 bp, Mus musculus
tggtgtttgcctgtaatcccggcag

SEQ ID NO: 896034 - DNA, 25 bp, Mus musculus
tggtgtttgcctgtgacatctgtca

SEQ ID NO: 896035 - DNA, 25 bp, Mus musculus
tggtgtttgcttcctctgtcagcta

SEQ ID NO: 896036 - DNA, 25 bp, Mus musculus
tggtgtttgcttctgggccacaaaa

SEQ ID NO: 896037 - DNA, 25 bp, Mus musculus
tggtgtttgcttgctctgtcagcta

SEQ ID NO: 896038 - DNA, 25 bp, Mus musculus
tggtgtttgcttgtgggccacaaaa

SEQ ID NO: 896039 - DNA, 25 bp, Mus musculus
tggtgttttagccttcaggtgtttg

SEQ ID NO: 896040 - DNA, 25 bp, Mus musculus
tggtgttttagcgttcaggtgtttg

SEQ ID NO: 896041 - DNA, 25 bp, Mus musculus
tggtgttttataccatcctacccac

SEQ ID NO: 896042 - DNA, 25 bp, Mus musculus
tggtgttttatagcatcctacccac

SEQ ID NO: 896043 - DNA, 25 bp, Mus musculus
tggtgttttcaactccataattgct

SEQ ID NO: 896044 - DNA, 25 bp, Mus musculus
tggtgttttcaagtccataattgct

SEQ ID NO: 896045 - DNA, 25 bp, Mus musculus
tggtgttttcctactggtcactcat

SEQ ID NO: 896046 - DNA, 25 bp, Mus musculus
tggtgttttcctatgcattggcaga

SEQ ID NO: 896047 - DNA, 25 bp, Mus musculus
tggtgttttccttctggtcactcat

SEQ ID NO: 896048 - DNA, 25 bp, Mus musculus
tggtgttttcctttgcattggcaga

SEQ ID NO: 896049 - DNA, 25 bp, Mus musculus
tggtgttttgatctgctacacctcc

SEQ ID NO: 896050 - DNA, 25 bp, Mus musculus
tggtgttttgatgtgctacacctcc

SEQ ID NO: 896051 - DNA, 25 bp, Mus musculus
tggtgttttgcacaacatcctcctt

SEQ ID NO: 896052 - DNA, 25 bp, Mus musculus
tggtgttttgcagaacatcctcctt

SEQ ID NO: 896053 - DNA, 25 bp, Mus musculus
tggtgttttgtgattctctaaggcc

SEQ ID NO: 896054 - DNA, 25 bp, Mus musculus
tggtgttttgtgtttctctaaggcc

SEQ ID NO: 896055 - DNA, 25 bp, Mus musculus
tggtgtttttaactggtcagaagac

SEQ ID NO: 896056 - DNA, 25 bp, Mus musculus
tggtgtttttaagtggtcagaagac

SEQ ID NO: 896057 - DNA, 25 bp, Mus musculus
tggttaaaagccagcccatagtaag

SEQ ID NO: 896058 - DNA, 25 bp, Mus musculus
tggttaaaagcctgcccatagtaag

SEQ ID NO: 896059 - DNA, 25 bp, Mus musculus
tggttaaaccaccactcctggaggg

SEQ ID NO: 896060 - DNA, 25 bp, Mus musculus
tggttaaaccacgactcctggaggg

SEQ ID NO: 896061 - DNA, 25 bp, Mus musculus
tggttaaaccccatgcaattttgtg

SEQ ID NO: 896062 - DNA, 25 bp, Mus musculus
tggttaaaccccttgcaattttgtg

SEQ ID NO: 896063 - DNA, 25 bp, Mus musculus
tggttaaatcagactgccctgtggc

SEQ ID NO: 896064 - DNA, 25 bp, Mus musculus
tggttaaatcagtctgccctgtggc

SEQ ID NO: 896065 - DNA, 25 bp, Mus musculus
tggttaacaaataccttcccctcat

SEQ ID NO: 896066 - DNA, 25 bp, Mus musculus
tggttaacaaattccttcccctcat

SEQ ID NO: 896067 - DNA, 25 bp, Mus musculus
tggttaacaatgactccggagctgc

SEQ ID NO: 896068 - DNA, 25 bp, Mus musculus
tggttaacaatgtctccggagctgc

SEQ ID NO: 896069 - DNA, 25 bp, Mus musculus
tggttaacactaaccttagccaggt

SEQ ID NO: 896070 - DNA, 25 bp, Mus musculus
tggttaacactatccttagccaggt

SEQ ID NO: 896071 - DNA, 25 bp, Mus musculus
tggttaagcctcaccagtggaccca

SEQ ID NO: 896072 - DNA, 25 bp, Mus musculus
tggttaagcctctccagtggaccca

SEQ ID NO: 896073 - DNA, 25 bp, Mus musculus
tggttaatagttactgtcttcaaga

SEQ ID NO: 896074 - DNA, 25 bp, Mus musculus
tggttaatagtttctgtcttcaaga

SEQ ID NO: 896075 - DNA, 25 bp, Mus musculus
tggttaatatttatgctggcgttgc

SEQ ID NO: 896076 - DNA, 25 bp, Mus musculus
tggttaatatttttgctggcgttgc

SEQ ID NO: 896077 - DNA, 25 bp, Mus musculus
tggttaatcaacacacaggactata

SEQ ID NO: 896078 - DNA, 25 bp, Mus musculus
tggttaatcaactcacaggactata

SEQ ID NO: 896079 - DNA, 25 bp, Mus musculus
tggttaatctcacgatttgtcccac

SEQ ID NO: 896080 - DNA, 25 bp, Mus musculus
tggttaatctcaggatttgtcccac

SEQ ID NO: 896081 - DNA, 25 bp, Mus musculus
tggttaatgtaaactgccagctaat

SEQ ID NO: 896082 - DNA, 25 bp, Mus musculus
tggttaatgtaatctgccagctaat

SEQ ID NO: 896083 - DNA, 25 bp, Mus musculus
tggttaattaaaacctcagactggt

SEQ ID NO: 896084 - DNA, 25 bp, Mus musculus
tggttaattaaatcctcagactggt

SEQ ID NO: 896085 - DNA, 25 bp, Mus musculus
tggttaattgccagtctcaaagaca

SEQ ID NO: 896086 - DNA, 25 bp, Mus musculus
tggttaattgcctgtctcaaagaca

SEQ ID NO: 896087 - DNA, 25 bp, Mus musculus
tggttacaatcacttccagtccatg

SEQ ID NO: 896088 - DNA, 25 bp, Mus musculus
tggttacaatcagttccagtccatg

SEQ ID NO: 896089 - DNA, 25 bp, Mus musculus
tggttacacagtattgccccacttg

SEQ ID NO: 896090 - DNA, 25 bp, Mus musculus
tggttacacagttttgccccacttg

SEQ ID NO: 896091 - DNA, 25 bp, Mus musculus
tggttacagccacacatatcacgtt

SEQ ID NO: 896092 - DNA, 25 bp, Mus musculus
tggttacagccagacatatcacgtt

SEQ ID NO: 896093 - DNA, 25 bp, Mus musculus
tggttacagcctcttgcacatgtta

SEQ ID NO: 896094 - DNA, 25 bp, Mus musculus
tggttacagcctgttgcacatgtta

SEQ ID NO: 896095 - DNA, 25 bp, Mus musculus
tggttacagctacgagttcacctca

SEQ ID NO: 896096 - DNA, 25 bp, Mus musculus
tggttacagctaggagttcacctca

SEQ ID NO: 896097 - DNA, 25 bp, Mus musculus
tggttacaggagacgtgggtcccct

SEQ ID NO: 896098 - DNA, 25 bp, Mus musculus
tggttacaggagtcgtgggtcccct

SEQ ID NO: 896099 - DNA, 25 bp, Mus musculus
tggttaccaaggataccatagcaga

SEQ ID NO: 896100 - DNA, 25 bp, Mus musculus
tggttaccaaggctgattccaatgt

SEQ ID NO: 896101 - DNA, 25 bp, Mus musculus
tggttaccaagggtgattccaatgt

SEQ ID NO: 896102 - DNA, 25 bp, Mus musculus
tggttaccaaggttaccatagcaga

SEQ ID NO: 896103 - DNA, 25 bp, Mus musculus
tggttaccaggtagttcagcttccc

SEQ ID NO: 896104 - DNA, 25 bp, Mus musculus
tggttaccaggttgttcagcttccc

SEQ ID NO: 896105 - DNA, 25 bp, Mus musculus
tggttaccagtgcacggtcaggctt

SEQ ID NO: 896106 - DNA, 25 bp, Mus musculus
tggttaccagtggacggtcaggctt

SEQ ID NO: 896107 - DNA, 25 bp, Mus musculus
tggttacccaagacactgcctaaaa

SEQ ID NO: 896108 - DNA, 25 bp, Mus musculus
tggttacccaagtcactgcctaaaa

SEQ ID NO: 896109 - DNA, 25 bp, Mus musculus
tggttacctagtattagcctgtgga

SEQ ID NO: 896110 - DNA, 25 bp, Mus musculus
tggttacctagttttagcctgtgga

SEQ ID NO: 896111 - DNA, 25 bp, Mus musculus
tggttacctccacatgctttcacaa

SEQ ID NO: 896112 - DNA, 25 bp, Mus musculus
tggttacctccagatgctttcacaa

SEQ ID NO: 896113 - DNA, 25 bp, Mus musculus
tggttacctctgaagctcccaagag

SEQ ID NO: 896114 - DNA, 25 bp, Mus musculus
tggttacctctgtagctcccaagag

SEQ ID NO: 896115 - DNA, 25 bp, Mus musculus
tggttacctgttcaagacttaggca

SEQ ID NO: 896116 - DNA, 25 bp, Mus musculus
tggttacctgttgaagacttaggca

SEQ ID NO: 896117 - DNA, 25 bp, Mus musculus
tggttacctttaactctccatggca

SEQ ID NO: 896118 - DNA, 25 bp, Mus musculus
tggttacctttatctctccatggca

SEQ ID NO: 896119 - DNA, 25 bp, Mus musculus
tggttacgtcagacccaaagttgaa

SEQ ID NO: 896120 - DNA, 25 bp, Mus musculus
tggttacgtcagtcccaaagttgaa

SEQ ID NO: 896121 - DNA, 25 bp, Mus musculus
tggttacgtgagaaacttggatttt

SEQ ID NO: 896122 - DNA, 25 bp, Mus musculus
tggttacgtgagtaacttggatttt

SEQ ID NO: 896123 - DNA, 25 bp, Mus musculus
tggttacgtgctcaaagcggttccc

SEQ ID NO: 896124 - DNA, 25 bp, Mus musculus
tggttacgtgctgaaagcggttccc

SEQ ID NO: 896125 - DNA, 25 bp, Mus musculus
tggttactaaaaaccaactctcagt

SEQ ID NO: 896126 - DNA, 25 bp, Mus musculus
tggttactaaaatccaactctcagt

SEQ ID NO: 896127 - DNA, 25 bp, Mus musculus
tggttactaaggactttctccagcc

SEQ ID NO: 896128 - DNA, 25 bp, Mus musculus
tggttactaaggtctttctccagcc

SEQ ID NO: 896129 - DNA, 25 bp, Mus musculus
tggttactacccctctacaggttca

SEQ ID NO: 896130 - DNA, 25 bp, Mus musculus
tggttactacccgtctacaggttca

SEQ ID NO: 896131 - DNA, 25 bp, Mus musculus
tggttactacggctacttcgatgtc

SEQ ID NO: 896132 - DNA, 25 bp, Mus musculus
tggttactacgggtacttcgatgtc

SEQ ID NO: 896133 - DNA, 25 bp, Mus musculus
tggttactccacctacctttggcaa

SEQ ID NO: 896134 - DNA, 25 bp, Mus musculus
tggttactccacgtacctttggcaa

SEQ ID NO: 896135 - DNA, 25 bp, Mus musculus
tggttactctgcagagccctcccga

SEQ ID NO: 896136 - DNA, 25 bp, Mus musculus
tggttactctgctgagccctcccga

SEQ ID NO: 896137 - DNA, 25 bp, Mus musculus
tggttactgcacagctgaggagtga

SEQ ID NO: 896138 - DNA, 25 bp, Mus musculus
tggttactgcactgctgaggagtga

SEQ ID NO: 896139 - DNA, 25 bp, Mus musculus
tggttactggatcggattctctgct

SEQ ID NO: 896140 - DNA, 25 bp, Mus musculus
tggttactggatgggattctctgct

SEQ ID NO: 896141 - DNA, 25 bp, Mus musculus
tggttactgtcccacccttcagaag

SEQ ID NO: 896142 - DNA, 25 bp, Mus musculus
tggttactgtccgacccttcagaag

SEQ ID NO: 896143 - DNA, 25 bp, Mus musculus
tggttacttaaaatcctatctccct

SEQ ID NO: 896144 - DNA, 25 bp, Mus musculus
tggttacttaaattcctatctccct

SEQ ID NO: 896145 - DNA, 25 bp, Mus musculus
tggttactttgtcctttactttgtg

SEQ ID NO: 896146 - DNA, 25 bp, Mus musculus
tggttactttgtgctttactttgtg

SEQ ID NO: 896147 - DNA, 25 bp, Mus musculus
tggttacttttccagaggctgccac

SEQ ID NO: 896148 - DNA, 25 bp, Mus musculus
tggttacttttcctaagatatacct

SEQ ID NO: 896149 - DNA, 25 bp, Mus musculus
tggttacttttcgagaggctgccac

SEQ ID NO: 896150 - DNA, 25 bp, Mus musculus
tggttacttttcgtaagatatacct

SEQ ID NO: 896151 - DNA, 25 bp, Mus musculus
tggttagaacccagcgcttccaaca

SEQ ID NO: 896152 - DNA, 25 bp, Mus musculus
tggttagaaccctgcgcttccaaca

SEQ ID NO: 896153 - DNA, 25 bp, Mus musculus
tggttagaccaacccgagtgaccta

SEQ ID NO: 896154 - DNA, 25 bp, Mus musculus
tggttagaccaagccgagtgaccta

SEQ ID NO: 896155 - DNA, 25 bp, Mus musculus
tggttagacttcagaggcaggccag

SEQ ID NO: 896156 - DNA, 25 bp, Mus musculus
tggttagacttctgaggcaggccag

SEQ ID NO: 896157 - DNA, 25 bp, Mus musculus
tggttagagccaaattatttatgcc

SEQ ID NO: 896158 - DNA, 25 bp, Mus musculus
tggttagagccatattatttatgcc

SEQ ID NO: 896159 - DNA, 25 bp, Mus musculus
tggttagagtacatatccctccttc

SEQ ID NO: 896160 - DNA, 25 bp, Mus musculus
tggttagagtacttatccctccttc

SEQ ID NO: 896161 - DNA, 25 bp, Mus musculus
tggttagcaaccattaatccgccct

SEQ ID NO: 896162 - DNA, 25 bp, Mus musculus
tggttagcaacctttaatccgccct

SEQ ID NO: 896163 - DNA, 25 bp, Mus musculus
tggttagccccaaagctttcgggca

SEQ ID NO: 896164 - DNA, 25 bp, Mus musculus
tggttagccccatagctttcgggca

SEQ ID NO: 896165 - DNA, 25 bp, Mus musculus
tggttagctaggcagttttattttt

SEQ ID NO: 896166 - DNA, 25 bp, Mus musculus
tggttagctagggagttttattttt

SEQ ID NO: 896167 - DNA, 25 bp, Mus musculus
tggttagctcctacccttttgtgga

SEQ ID NO: 896168 - DNA, 25 bp, Mus musculus
tggttagctccttcccttttgtgga

SEQ ID NO: 896169 - DNA, 25 bp, Mus musculus
tggttagctctccttctttggtagt

SEQ ID NO: 896170 - DNA, 25 bp, Mus musculus
tggttagctctcgttctttggtagt

SEQ ID NO: 896171 - DNA, 25 bp, Mus musculus
tggttagcttacagcatgcttccct

SEQ ID NO: 896172 - DNA, 25 bp, Mus musculus
tggttagcttactgcatgcttccct

SEQ ID NO: 896173 - DNA, 25 bp, Mus musculus
tggttagctttcattgtgctggaag

SEQ ID NO: 896174 - DNA, 25 bp, Mus musculus
tggttagctttctttgtgctggaag

SEQ ID NO: 896175 - DNA, 25 bp, Mus musculus
tggttaggcgcaagcaaagctgccg

SEQ ID NO: 896176 - DNA, 25 bp, Mus musculus
tggttaggcgcatgcaaagctgccg

SEQ ID NO: 896177 - DNA, 25 bp, Mus musculus
tggttaggctatcttaactccctca

SEQ ID NO: 896178 - DNA, 25 bp, Mus musculus
tggttaggctatgttaactccctca

SEQ ID NO: 896179 - DNA, 25 bp, Mus musculus
tggttaggctggctggtccacaaac

SEQ ID NO: 896180 - DNA, 25 bp, Mus musculus
tggttaggctgggtggtccacaaac

SEQ ID NO: 896181 - DNA, 25 bp, Mus musculus
tggttagtagaacccgacggacctc

SEQ ID NO: 896182 - DNA, 25 bp, Mus musculus
tggttagtagaagccgacggacctc

SEQ ID NO: 896183 - DNA, 25 bp, Mus musculus
tggttagtcaccagcttgatcatgt

SEQ ID NO: 896184 - DNA, 25 bp, Mus musculus
tggttagtcacctgcttgatcatgt

SEQ ID NO: 896185 - DNA, 25 bp, Mus musculus
tggttagtctgtataccttgtccca

SEQ ID NO: 896186 - DNA, 25 bp, Mus musculus
tggttagtctgtttaccttgtccca

SEQ ID NO: 896187 - DNA, 25 bp, Mus musculus
tggttagtgagcagccgagttccac

SEQ ID NO: 896188 - DNA, 25 bp, Mus musculus
tggttagtgagctgccgagttccac

SEQ ID NO: 896189 - DNA, 25 bp, Mus musculus
tggttatatgctcctgttctccaag

SEQ ID NO: 896190 - DNA, 25 bp, Mus musculus
tggttatatgctgctgttctccaag

SEQ ID NO: 896191 - DNA, 25 bp, Mus musculus
tggttatcaattaagtccctatcaa

SEQ ID NO: 896192 - DNA, 25 bp, Mus musculus
tggttatcaatttagtccctatcaa

SEQ ID NO: 896193 - DNA, 25 bp, Mus musculus
tggttatcaggaccagatggtcaca

SEQ ID NO: 896194 - DNA, 25 bp, Mus musculus
tggttatcaggagcagatggtcaca

SEQ ID NO: 896195 - DNA, 25 bp, Mus musculus
tggttatccaccacccggcggagga

SEQ ID NO: 896196 - DNA, 25 bp, Mus musculus
tggttatccacctcccggcggagga

SEQ ID NO: 896197 - DNA, 25 bp, Mus musculus
tggttatccagtatgtatttccttg

SEQ ID NO: 896198 - DNA, 25 bp, Mus musculus
tggttatccagtttgtatttccttg

SEQ ID NO: 896199 - DNA, 25 bp, Mus musculus
tggttatccgaaccttacaatttct

SEQ ID NO: 896200 - DNA, 25 bp, Mus musculus
tggttatccgaagcttacaatttct

SEQ ID NO: 896201 - DNA, 25 bp, Mus musculus
tggttatcctggcagtttcctactt

SEQ ID NO: 896202 - DNA, 25 bp, Mus musculus
tggttatcctgggagtttcctactt

SEQ ID NO: 896203 - DNA, 25 bp, Mus musculus
tggttatccttacgcagccagcact

SEQ ID NO: 896204 - DNA, 25 bp, Mus musculus
tggttatccttaggcagccagcact

SEQ ID NO: 896205 - DNA, 25 bp, Mus musculus
tggttatcgcccagcacagttatga

SEQ ID NO: 896206 - DNA, 25 bp, Mus musculus
tggttatcgccctgcacagttatga

SEQ ID NO: 896207 - DNA, 25 bp, Mus musculus
tggttatcgtatagtccagcacctc

SEQ ID NO: 896208 - DNA, 25 bp, Mus musculus
tggttatcgtattgtccagcacctc

SEQ ID NO: 896209 - DNA, 25 bp, Mus musculus
tggttatctactaatacagcccctc

SEQ ID NO: 896210 - DNA, 25 bp, Mus musculus
tggttatctacttatacagcccctc

SEQ ID NO: 896211 - DNA, 25 bp, Mus musculus
tggttatctataacagtgctgctag

SEQ ID NO: 896212 - DNA, 25 bp, Mus musculus
tggttatctatatcagtgctgctag

SEQ ID NO: 896213 - DNA, 25 bp, Mus musculus
tggttatctcgccactctggatcta

SEQ ID NO: 896214 - DNA, 25 bp, Mus musculus
tggttatctcgcgactctggatcta

SEQ ID NO: 896215 - DNA, 25 bp, Mus musculus
tggttatctctcaatcatgcattgc

SEQ ID NO: 896216 - DNA, 25 bp, Mus musculus
tggttatctctctatcatgcattgc

SEQ ID NO: 896217 - DNA, 25 bp, Mus musculus
tggttatcttttatcctcagcttga

SEQ ID NO: 896218 - DNA, 25 bp, Mus musculus
tggttatcttttttcctcagcttga

SEQ ID NO: 896219 - DNA, 25 bp, Mus musculus
tggttatgacccctgttacctccta

SEQ ID NO: 896220 - DNA, 25 bp, Mus musculus
tggttatgacccgtgttacctccta

SEQ ID NO: 896221 - DNA, 25 bp, Mus musculus
tggttatgattcacgatcccgcagc

SEQ ID NO: 896222 - DNA, 25 bp, Mus musculus
tggttatgattctcgatcccgcagc

SEQ ID NO: 896223 - DNA, 25 bp, Mus musculus
tggttatggccccttctgagccttt

SEQ ID NO: 896224 - DNA, 25 bp, Mus musculus
tggttatggcccgttctgagccttt

SEQ ID NO: 896225 - DNA, 25 bp, Mus musculus
tggttatgtaaaactccccttctgg

SEQ ID NO: 896226 - DNA, 25 bp, Mus musculus
tggttatgtaaatctccccttctgg

SEQ ID NO: 896227 - DNA, 25 bp, Mus musculus
tggttattagatccctgcgtgcgcc

SEQ ID NO: 896228 - DNA, 25 bp, Mus musculus
tggttattagatgcctgcgtgcgcc

SEQ ID NO: 896229 - DNA, 25 bp, Mus musculus
tggttattcaacatagccagtggtt

SEQ ID NO: 896230 - DNA, 25 bp, Mus musculus
tggttattcaacttagccagtggtt

SEQ ID NO: 896231 - DNA, 25 bp, Mus musculus
tggttattcaccacctggaggactg

SEQ ID NO: 896232 - DNA, 25 bp, Mus musculus
tggttattcacctcctggaggactg

SEQ ID NO: 896233 - DNA, 25 bp, Mus musculus
tggttattcagacccctaatcccaa

SEQ ID NO: 896234 - DNA, 25 bp, Mus musculus
tggttattcagaccctgatcgcaat

SEQ ID NO: 896235 - DNA, 25 bp, Mus musculus
tggttattcagagccctaatcccaa

SEQ ID NO: 896236 - DNA, 25 bp, Mus musculus
tggttattcagagcctgatcgcaat

SEQ ID NO: 896237 - DNA, 25 bp, Mus musculus
tggttattctttctcccactaaaag

SEQ ID NO: 896238 - DNA, 25 bp, Mus musculus
tggttattctttgtcccactaaaag

SEQ ID NO: 896239 - DNA, 25 bp, Mus musculus
tggttattgttaccccatttcatat

SEQ ID NO: 896240 - DNA, 25 bp, Mus musculus
tggttattgttagcccatttcatat

SEQ ID NO: 896241 - DNA, 25 bp, Mus musculus
tggttatttggacagcctcgggcca

SEQ ID NO: 896242 - DNA, 25 bp, Mus musculus
tggttatttggagagcctcgggcca

SEQ ID NO: 896243 - DNA, 25 bp, Mus musculus
tggttattttgcactatactccctg

SEQ ID NO: 896244 - DNA, 25 bp, Mus musculus
tggttattttgctctatactccctg

SEQ ID NO: 896245 - DNA, 25 bp, Mus musculus
tggttatttttcatacttgggactg

SEQ ID NO: 896246 - DNA, 25 bp, Mus musculus
tggttatttttcttacttgggactg

SEQ ID NO: 896247 - DNA, 25 bp, Mus musculus
tggttcaaaccaaagaggctcataa

SEQ ID NO: 896248 - DNA, 25 bp, Mus musculus
tggttcaaaccatagaggctcataa

SEQ ID NO: 896249 - DNA, 25 bp, Mus musculus
tggttcaacccactgatggtttcaa

SEQ ID NO: 896250 - DNA, 25 bp, Mus musculus
tggttcaacccagtgatggtttcaa

SEQ ID NO: 896251 - DNA, 25 bp, Mus musculus
tggttcaatactcccagaatgagca

SEQ ID NO: 896252 - DNA, 25 bp, Mus musculus
tggttcaatactgccagaatgagca

SEQ ID NO: 896253 - DNA, 25 bp, Mus musculus
tggttcacaaccctattgattcaac

SEQ ID NO: 896254 - DNA, 25 bp, Mus musculus
tggttcacaaccgtattgattcaac

SEQ ID NO: 896255 - DNA, 25 bp, Mus musculus
tggttcacacacagaggcctcccgg

SEQ ID NO: 896256 - DNA, 25 bp, Mus musculus
tggttcacacactgaggcctcccgg

SEQ ID NO: 896257 - DNA, 25 bp, Mus musculus
tggttcacagaacggccacagcaga

SEQ ID NO: 896258 - DNA, 25 bp, Mus musculus
tggttcacagaagggccacagcaga

SEQ ID NO: 896259 - DNA, 25 bp, Mus musculus
tggttcacataaaacagctctgcag

SEQ ID NO: 896260 - DNA, 25 bp, Mus musculus
tggttcacataatacagctctgcag

SEQ ID NO: 896261 - DNA, 25 bp, Mus musculus
tggttcaccttaaattgcattgctg

SEQ ID NO: 896262 - DNA, 25 bp, Mus musculus
tggttcaccttatattgcattgctg

SEQ ID NO: 896263 - DNA, 25 bp, Mus musculus
tggttcacgacaagccaggctgact

SEQ ID NO: 896264 - DNA, 25 bp, Mus musculus
tggttcacgacatgccaggctgact

SEQ ID NO: 896265 - DNA, 25 bp, Mus musculus
tggttcactcagatcataggcattc

SEQ ID NO: 896266 - DNA, 25 bp, Mus musculus
tggttcactcagttcataggcattc

SEQ ID NO: 896267 - DNA, 25 bp, Mus musculus
tggttcacttcccagattttcattc

SEQ ID NO: 896268 - DNA, 25 bp, Mus musculus
tggttcacttccgagattttcattc

SEQ ID NO: 896269 - DNA, 25 bp, Mus musculus
tggttcacttggaccttgtctatac

SEQ ID NO: 896270 - DNA, 25 bp, Mus musculus
tggttcacttggtccttgtctatac

SEQ ID NO: 896271 - DNA, 25 bp, Mus musculus
tggttcactttcacctattgaagag

SEQ ID NO: 896272 - DNA, 25 bp, Mus musculus
tggttcactttctcctattgaagag

SEQ ID NO: 896273 - DNA, 25 bp, Mus musculus
tggttcagagcccaaattcttactt

SEQ ID NO: 896274 - DNA, 25 bp, Mus musculus
tggttcagagccgaaattcttactt

SEQ ID NO: 896275 - DNA, 25 bp, Mus musculus
tggttcagcacaccgggacctctga

SEQ ID NO: 896276 - DNA, 25 bp, Mus musculus
tggttcagcacagcgggacctctga

SEQ ID NO: 896277 - DNA, 25 bp, Mus musculus
tggttcagccttacttgcagcggtg

SEQ ID NO: 896278 - DNA, 25 bp, Mus musculus
tggttcagcctttcttgcagcggtg

SEQ ID NO: 896279 - DNA, 25 bp, Mus musculus
tggttcagcgttcactgtcatgggc

SEQ ID NO: 896280 - DNA, 25 bp, Mus musculus
tggttcagcgttgactgtcatgggc

SEQ ID NO: 896281 - DNA, 25 bp, Mus musculus
tggttcagctacctccctagcagag

SEQ ID NO: 896282 - DNA, 25 bp, Mus musculus
tggttcagctacgtccctagcagag

SEQ ID NO: 896283 - DNA, 25 bp, Mus musculus
tggttcagctggcttccccaatttc

SEQ ID NO: 896284 - DNA, 25 bp, Mus musculus
tggttcagctgggttccccaatttc

SEQ ID NO: 896285 - DNA, 25 bp, Mus musculus
tggttcaggcacacaagacatcaag

SEQ ID NO: 896286 - DNA, 25 bp, Mus musculus
tggttcaggcactcaagacatcaag

SEQ ID NO: 896287 - DNA, 25 bp, Mus musculus
tggttcaggctaaacttgaactccc

SEQ ID NO: 896288 - DNA, 25 bp, Mus musculus
tggttcaggctatacttgaactccc

SEQ ID NO: 896289 - DNA, 25 bp, Mus musculus
tggttcagggacaccgctcgctctg

SEQ ID NO: 896290 - DNA, 25 bp, Mus musculus
tggttcagggactccgctcgctctg

SEQ ID NO: 896291 - DNA, 25 bp, Mus musculus
tggttcagtagtaaagatggttatc

SEQ ID NO: 896292 - DNA, 25 bp, Mus musculus
tggttcagtagttaagatggttatc

SEQ ID NO: 896293 - DNA, 25 bp, Mus musculus
tggttcagttcacctatgtctcaac

SEQ ID NO: 896294 - DNA, 25 bp, Mus musculus
tggttcagttcagctatgtctcaac

SEQ ID NO: 896295 - DNA, 25 bp, Mus musculus
tggttcatacacctccttttcatca

SEQ ID NO: 896296 - DNA, 25 bp, Mus musculus
tggttcatacacgtccttttcatca

SEQ ID NO: 896297 - DNA, 25 bp, Mus musculus
tggttcatacatccagacctgaaaa

SEQ ID NO: 896298 - DNA, 25 bp, Mus musculus
tggttcatacatgcagacctgaaaa

SEQ ID NO: 896299 - DNA, 25 bp, Mus musculus
tggttcatacccagcttggtcacca

SEQ ID NO: 896300 - DNA, 25 bp, Mus musculus
tggttcataccctgcttggtcacca

SEQ ID NO: 896301 - DNA, 25 bp, Mus musculus
tggttcatcacacaggccaacttcc

SEQ ID NO: 896302 - DNA, 25 bp, Mus musculus
tggttcatcacagaggccaacttcc

SEQ ID NO: 896303 - DNA, 25 bp, Mus musculus
tggttcatcactcagcgtcacagaa

SEQ ID NO: 896304 - DNA, 25 bp, Mus musculus
tggttcatcactgagcgtcacagaa

SEQ ID NO: 896305 - DNA, 25 bp, Mus musculus
tggttcatcatcacagtacagcagc

SEQ ID NO: 896306 - DNA, 25 bp, Mus musculus
tggttcatcatctcagtacagcagc

SEQ ID NO: 896307 - DNA, 25 bp, Mus musculus
tggttcatcgccactaatggtggcc

SEQ ID NO: 896308 - DNA, 25 bp, Mus musculus
tggttcatcgcctctaatggtggcc

SEQ ID NO: 896309 - DNA, 25 bp, Mus musculus
tggttcatctttaatttccctgtaa

SEQ ID NO: 896310 - DNA, 25 bp, Mus musculus
tggttcatcttttatttccctgtaa

SEQ ID NO: 896311 - DNA, 25 bp, Mus musculus
tggttcatgaacctttgtgcaccct

SEQ ID NO: 896312 - DNA, 25 bp, Mus musculus
tggttcatgaacgtttgtgcaccct

SEQ ID NO: 896313 - DNA, 25 bp, Mus musculus
tggttcatggaacacctcctaggtt

SEQ ID NO: 896314 - DNA, 25 bp, Mus musculus
tggttcatggaagacctcctaggtt

SEQ ID NO: 896315 - DNA, 25 bp, Mus musculus
tggttcatggctatcactcggcagg

SEQ ID NO: 896316 - DNA, 25 bp, Mus musculus
tggttcatggctttcactcggcagg

SEQ ID NO: 896317 - DNA, 25 bp, Mus musculus
tggttcatggttaagttcctgggaa

SEQ ID NO: 896318 - DNA, 25 bp, Mus musculus
tggttcatggtttagttcctgggaa

SEQ ID NO: 896319 - DNA, 25 bp, Mus musculus
tggttcattaaacccttgctctacc

SEQ ID NO: 896320 - DNA, 25 bp, Mus musculus
tggttcattaaagccttgctctacc

SEQ ID NO: 896321 - DNA, 25 bp, Mus musculus
tggttcattagaccagtctggccac

SEQ ID NO: 896322 - DNA, 25 bp, Mus musculus
tggttcattagagcagtctggccac

SEQ ID NO: 896323 - DNA, 25 bp, Mus musculus
tggttcattgttcttggtgtggttt

SEQ ID NO: 896324 - DNA, 25 bp, Mus musculus
tggttcattgttgttggtgtggttt

SEQ ID NO: 896325 - DNA, 25 bp, Mus musculus
tggttccaaaacattcctagctgct

SEQ ID NO: 896326 - DNA, 25 bp, Mus musculus
tggttccaaaactttcctagctgct

SEQ ID NO: 896327 - DNA, 25 bp, Mus musculus
tggttccaaagccaaaagccaagaa

SEQ ID NO: 896328 - DNA, 25 bp, Mus musculus
tggttccaaagcgaaaagccaagaa

SEQ ID NO: 896329 - DNA, 25 bp, Mus musculus
tggttccaaaggcaagagtccctcc

SEQ ID NO: 896330 - DNA, 25 bp, Mus musculus
tggttccaaagggaagagtccctcc

SEQ ID NO: 896331 - DNA, 25 bp, Mus musculus
tggttccacaccatcaggattcaga

SEQ ID NO: 896332 - DNA, 25 bp, Mus musculus
tggttccacaccttcaggattcaga

SEQ ID NO: 896333 - DNA, 25 bp, Mus musculus
tggttccacagcactcttaggatgc

SEQ ID NO: 896334 - DNA, 25 bp, Mus musculus
tggttccacagctctcttaggatgc

SEQ ID NO: 896335 - DNA, 25 bp, Mus musculus
tggttccacgccactagatttggaa

SEQ ID NO: 896336 - DNA, 25 bp, Mus musculus
tggttccacgcctctagatttggaa

SEQ ID NO: 896337 - DNA, 25 bp, Mus musculus
tggttccactatcggtgtgttggct

SEQ ID NO: 896338 - DNA, 25 bp, Mus musculus
tggttccactatgggtgtgttggct

SEQ ID NO: 896339 - DNA, 25 bp, Mus musculus
tggttccactttatagccacctttt

SEQ ID NO: 896340 - DNA, 25 bp, Mus musculus
tggttccactttttagccacctttt

SEQ ID NO: 896341 - DNA, 25 bp, Mus musculus
tggttccaggctagaactcctgctg

SEQ ID NO: 896342 - DNA, 25 bp, Mus musculus
tggttccaggcttgaactcctgctg

SEQ ID NO: 896343 - DNA, 25 bp, Mus musculus
tggttccagggaattgaggcatgct

SEQ ID NO: 896344 - DNA, 25 bp, Mus musculus
tggttccagggatttgaggcatgct

SEQ ID NO: 896345 - DNA, 25 bp, Mus musculus
tggttccataacacgactatggcaa

SEQ ID NO: 896346 - DNA, 25 bp, Mus musculus
tggttccataactcgactatggcaa

SEQ ID NO: 896347 - DNA, 25 bp, Mus musculus
tggttccatccactttgtgattggg

SEQ ID NO: 896348 - DNA, 25 bp, Mus musculus
tggttccatccagtttgtgattggg

SEQ ID NO: 896349 - DNA, 25 bp, Mus musculus
tggttccatcgcactgtgaagattg

SEQ ID NO: 896350 - DNA, 25 bp, Mus musculus
tggttccatcgctctgtgaagattg

SEQ ID NO: 896351 - DNA, 25 bp, Mus musculus
tggttccatctgacatgcttgtcta

SEQ ID NO: 896352 - DNA, 25 bp, Mus musculus
tggttccatctgtcatgcttgtcta

SEQ ID NO: 896353 - DNA, 25 bp, Mus musculus
tggttccatgaaacagcacaggctg

SEQ ID NO: 896354 - DNA, 25 bp, Mus musculus
tggttccatgaatcagcacaggctg

SEQ ID NO: 896355 - DNA, 25 bp, Mus musculus
tggttccatttaaggccctcagaga

SEQ ID NO: 896356 - DNA, 25 bp, Mus musculus
tggttccatttacaaagtacccaag

SEQ ID NO: 896357 - DNA, 25 bp, Mus musculus
tggttccatttagaaagtacccaag

SEQ ID NO: 896358 - DNA, 25 bp, Mus musculus
tggttccatttatggccctcagaga

SEQ ID NO: 896359 - DNA, 25 bp, Mus musculus
tggttccattttaccaaggccgcca

SEQ ID NO: 896360 - DNA, 25 bp, Mus musculus
tggttccatttttccaaggccgcca

SEQ ID NO: 896361 - DNA, 25 bp, Mus musculus
tggttcccagacactgggtaccaaa

SEQ ID NO: 896362 - DNA, 25 bp, Mus musculus
tggttcccagactctgggtaccaaa

SEQ ID NO: 896363 - DNA, 25 bp, Mus musculus
tggttcccagcaccttctaattaaa

SEQ ID NO: 896364 - DNA, 25 bp, Mus musculus
tggttcccagcagcttctaattaaa

SEQ ID NO: 896365 - DNA, 25 bp, Mus musculus
tggttcccagctctcacaaggcagc

SEQ ID NO: 896366 - DNA, 25 bp, Mus musculus
tggttcccagctgtcacaaggcagc

SEQ ID NO: 896367 - DNA, 25 bp, Mus musculus
tggttcccaggacatgctgccagcg

SEQ ID NO: 896368 - DNA, 25 bp, Mus musculus
tggttcccaggagatgctgccagcg

SEQ ID NO: 896369 - DNA, 25 bp, Mus musculus
tggttccccacccagaggtcctgag

SEQ ID NO: 896370 - DNA, 25 bp, Mus musculus
tggttccccaccgagaggtcctgag

SEQ ID NO: 896371 - DNA, 25 bp, Mus musculus
tggttccccgtcagtgagcacagaa

SEQ ID NO: 896372 - DNA, 25 bp, Mus musculus
tggttccccgtctgtgagcacagaa

SEQ ID NO: 896373 - DNA, 25 bp, Mus musculus
tggttcccctagagatgcagttgca

SEQ ID NO: 896374 - DNA, 25 bp, Mus musculus
tggttcccctagtgatgcagttgca

SEQ ID NO: 896375 - DNA, 25 bp, Mus musculus
tggttccccttcacagaagtctgtg

SEQ ID NO: 896376 - DNA, 25 bp, Mus musculus
tggttccccttctcagaagtctgtg

SEQ ID NO: 896377 - DNA, 25 bp, Mus musculus
tggttcccgtgtatgggaccaggag

SEQ ID NO: 896378 - DNA, 25 bp, Mus musculus
tggttcccgtgtttgggaccaggag

SEQ ID NO: 896379 - DNA, 25 bp, Mus musculus
tggttccctgctaacctggtaggta

SEQ ID NO: 896380 - DNA, 25 bp, Mus musculus
tggttccctgcttacctggtaggta

SEQ ID NO: 896381 - DNA, 25 bp, Mus musculus
tggttccctgtaacgtttgtgggcg

SEQ ID NO: 896382 - DNA, 25 bp, Mus musculus
tggttccctgtatcgtttgtgggcg

SEQ ID NO: 896383 - DNA, 25 bp, Mus musculus
tggttcccttacagccgcaaaacaa

SEQ ID NO: 896384 - DNA, 25 bp, Mus musculus
tggttcccttactgccgcaaaacaa

SEQ ID NO: 896385 - DNA, 25 bp, Mus musculus
tggttcccttcaatagcagcatgag

SEQ ID NO: 896386 - DNA, 25 bp, Mus musculus
tggttcccttcattagcagcatgag

SEQ ID NO: 896387 - DNA, 25 bp, Mus musculus
tggttccctttcatcgtcacagagc

SEQ ID NO: 896388 - DNA, 25 bp, Mus musculus
tggttccctttcttcgtcacagagc

SEQ ID NO: 896389 - DNA, 25 bp, Mus musculus
tggttccctttgctcacatgagttg

SEQ ID NO: 896390 - DNA, 25 bp, Mus musculus
tggttccctttggtcacatgagttg

SEQ ID NO: 896391 - DNA, 25 bp, Mus musculus
tggttccgaggtcacacaatgctgc

SEQ ID NO: 896392 - DNA, 25 bp, Mus musculus
tggttccgaggtgacacaatgctgc

SEQ ID NO: 896393 - DNA, 25 bp, Mus musculus
tggttccgctgaaaactccagcctg

SEQ ID NO: 896394 - DNA, 25 bp, Mus musculus
tggttccgctgataactccagcctg

SEQ ID NO: 896395 - DNA, 25 bp, Mus musculus
tggttccggattatggagtgtccct

SEQ ID NO: 896396 - DNA, 25 bp, Mus musculus
tggttccggattttggagtgtccct

SEQ ID NO: 896397 - DNA, 25 bp, Mus musculus
tggttccgggaacgctcatcaaaaa

SEQ ID NO: 896398 - DNA, 25 bp, Mus musculus
tggttccgggaaggctcatcaaaaa

SEQ ID NO: 896399 - DNA, 25 bp, Mus musculus
tggttccggtggaggaggctccgga

SEQ ID NO: 896400 - DNA, 25 bp, Mus musculus
tggttccggtggtggaggctccgga

SEQ ID NO: 896401 - DNA, 25 bp, Mus musculus
tggttcctacaaatccttccttgtg

SEQ ID NO: 896402 - DNA, 25 bp, Mus musculus
tggttcctacaattccttccttgtg

SEQ ID NO: 896403 - DNA, 25 bp, Mus musculus
tggttcctacagaaactcccctgaa

SEQ ID NO: 896404 - DNA, 25 bp, Mus musculus
tggttcctacagtaactcccctgaa

SEQ ID NO: 896405 - DNA, 25 bp, Mus musculus
tggttcctacctcagtggctacagg

SEQ ID NO: 896406 - DNA, 25 bp, Mus musculus
tggttcctacctgagtggctacagg

SEQ ID NO: 896407 - DNA, 25 bp, Mus musculus
tggttcctacgtaatatcgggtctt

SEQ ID NO: 896408 - DNA, 25 bp, Mus musculus
tggttcctacgttatatcgggtctt

SEQ ID NO: 896409 - DNA, 25 bp, Mus musculus
tggttcctacttacatgatttcata

SEQ ID NO: 896410 - DNA, 25 bp, Mus musculus
tggttcctactttcatgatttcata

SEQ ID NO: 896411 - DNA, 25 bp, Mus musculus
tggttcctaggtatttagctcctct

SEQ ID NO: 896412 - DNA, 25 bp, Mus musculus
tggttcctaggtttttagctcctct

SEQ ID NO: 896413 - DNA, 25 bp, Mus musculus
tggttcctccagaatcgggcatctg

SEQ ID NO: 896414 - DNA, 25 bp, Mus musculus
tggttcctccagtatcgggcatctg

SEQ ID NO: 896415 - DNA, 25 bp, Mus musculus
tggttcctgatgaacactggttctt

SEQ ID NO: 896416 - DNA, 25 bp, Mus musculus
tggttcctgatgtacactggttctt

SEQ ID NO: 896417 - DNA, 25 bp, Mus musculus
tggttcctgcacctgctcggacaaa

SEQ ID NO: 896418 - DNA, 25 bp, Mus musculus
tggttcctgcacgtgctcggacaaa

SEQ ID NO: 896419 - DNA, 25 bp, Mus musculus
tggttcctgcagacttgtagacact

SEQ ID NO: 896420 - DNA, 25 bp, Mus musculus
tggttcctgcagagctggtagccac

SEQ ID NO: 896421 - DNA, 25 bp, Mus musculus
tggttcctgcagtcttgtagacact

SEQ ID NO: 896422 - DNA, 25 bp, Mus musculus
tggttcctgcagtgctggtagccac

SEQ ID NO: 896423 - DNA, 25 bp, Mus musculus
tggttcctgcatcaaaacagtggcc

SEQ ID NO: 896424 - DNA, 25 bp, Mus musculus
tggttcctgcatgaaaacagtggcc

SEQ ID NO: 896425 - DNA, 25 bp, Mus musculus
tggttcctgccaagagctgctgcag

SEQ ID NO: 896426 - DNA, 25 bp, Mus musculus
tggttcctgccatgagctgctgcag

SEQ ID NO: 896427 - DNA, 25 bp, Mus musculus
tggttcctggaccaaggcagctgcc

SEQ ID NO: 896428 - DNA, 25 bp, Mus musculus
tggttcctggacgaaggcagctgcc

SEQ ID NO: 896429 - DNA, 25 bp, Mus musculus
tggttccttaacacagacacaaata

SEQ ID NO: 896430 - DNA, 25 bp, Mus musculus
tggttccttaactcagacacaaata

SEQ ID NO: 896431 - DNA, 25 bp, Mus musculus
tggttccttccaaggtttcaagtgt

SEQ ID NO: 896432 - DNA, 25 bp, Mus musculus
tggttccttccatggtttcaagtgt

SEQ ID NO: 896433 - DNA, 25 bp, Mus musculus
tggttccttcccctgagagtttgga

SEQ ID NO: 896434 - DNA, 25 bp, Mus musculus
tggttccttcccgtgagagtttgga

SEQ ID NO: 896435 - DNA, 25 bp, Mus musculus
tggttccttggccacctgttcatgt

SEQ ID NO: 896436 - DNA, 25 bp, Mus musculus
tggttccttggcgacctgttcatgt

SEQ ID NO: 896437 - DNA, 25 bp, Mus musculus
tggttccttggtatactgagtttgt

SEQ ID NO: 896438 - DNA, 25 bp, Mus musculus
tggttccttggtttactgagtttgt

SEQ ID NO: 896439 - DNA, 25 bp, Mus musculus
tggttcctttttaaggtcagcagca

SEQ ID NO: 896440 - DNA, 25 bp, Mus musculus
tggttccttttttaggtcagcagca

SEQ ID NO: 896441 - DNA, 25 bp, Mus musculus
tggttcgatccacagcaataaatgc

SEQ ID NO: 896442 - DNA, 25 bp, Mus musculus
tggttcgatccagagcaataaatgc

SEQ ID NO: 896443 - DNA, 25 bp, Mus musculus
tggttcgccggtattgtgttttcag

SEQ ID NO: 896444 - DNA, 25 bp, Mus musculus
tggttcgccggttttgtgttttcag

SEQ ID NO: 896445 - DNA, 25 bp, Mus musculus
tggttcgcctctcctacaattctaa

SEQ ID NO: 896446 - DNA, 25 bp, Mus musculus
tggttcgcctctgctacaattctaa

SEQ ID NO: 896447 - DNA, 25 bp, Mus musculus
tggttcggcacaagaggaagctgca

SEQ ID NO: 896448 - DNA, 25 bp, Mus musculus
tggttcggcacatgaggaagctgca

SEQ ID NO: 896449 - DNA, 25 bp, Mus musculus
tggttcgtccctacactttaggcca

SEQ ID NO: 896450 - DNA, 25 bp, Mus musculus
tggttcgtcccttcactttaggcca

SEQ ID NO: 896451 - DNA, 25 bp, Mus musculus
tggttcgtctctagatattttgtga

SEQ ID NO: 896452 - DNA, 25 bp, Mus musculus
tggttcgtctcttgatattttgtga

SEQ ID NO: 896453 - DNA, 25 bp, Mus musculus
tggttctaaactctaaactttatat

SEQ ID NO: 896454 - DNA, 25 bp, Mus musculus
tggttctaaactgtaaactttatat

SEQ ID NO: 896455 - DNA, 25 bp, Mus musculus
tggttctacactctgttatcattgg

SEQ ID NO: 896456 - DNA, 25 bp, Mus musculus
tggttctacactgtgttatcattgg

SEQ ID NO: 896457 - DNA, 25 bp, Mus musculus
tggttctactgaagctatgaggagc

SEQ ID NO: 896458 - DNA, 25 bp, Mus musculus
tggttctactgatgctatgaggagc

SEQ ID NO: 896459 - DNA, 25 bp, Mus musculus
tggttctagcacaatcagggcaatt

SEQ ID NO: 896460 - DNA, 25 bp, Mus musculus
tggttctagcactatcagggcaatt

SEQ ID NO: 896461 - DNA, 25 bp, Mus musculus
tggttctagcctcatgttcagctca

SEQ ID NO: 896462 - DNA, 25 bp, Mus musculus
tggttctagcctgatgttcagctca

SEQ ID NO: 896463 - DNA, 25 bp, Mus musculus
tggttctaggaaatgttttgtaata

SEQ ID NO: 896464 - DNA, 25 bp, Mus musculus
tggttctaggaattgttttgtaata

SEQ ID NO: 896465 - DNA, 25 bp, Mus musculus
tggttctaggccacttcttaaaaat

SEQ ID NO: 896466 - DNA, 25 bp, Mus musculus
tggttctaggcctcttcttaaaaat

SEQ ID NO: 896467 - DNA, 25 bp, Mus musculus
tggttctaggctatcgtgtttccga

SEQ ID NO: 896468 - DNA, 25 bp, Mus musculus
tggttctaggctttcgtgtttccga

SEQ ID NO: 896469 - DNA, 25 bp, Mus musculus
tggttctcaatccaccccaaaaggg

SEQ ID NO: 896470 - DNA, 25 bp, Mus musculus
tggttctcaatcgaccccaaaaggg

SEQ ID NO: 896471 - DNA, 25 bp, Mus musculus
tggttctcacgtaaccctggcagca

SEQ ID NO: 896472 - DNA, 25 bp, Mus musculus
tggttctcacgttaccctggcagca

SEQ ID NO: 896473 - DNA, 25 bp, Mus musculus
tggttctcagacacaaatgcctgtc

SEQ ID NO: 896474 - DNA, 25 bp, Mus musculus
tggttctcagactcaaatgcctgtc

SEQ ID NO: 896475 - DNA, 25 bp, Mus musculus
tggttctccacaagccttggatgaa

SEQ ID NO: 896476 - DNA, 25 bp, Mus musculus
tggttctccacatgccttggatgaa

SEQ ID NO: 896477 - DNA, 25 bp, Mus musculus
tggttctccaggcttctgtgggacc

SEQ ID NO: 896478 - DNA, 25 bp, Mus musculus
tggttctccagggttctgtgggacc

SEQ ID NO: 896479 - DNA, 25 bp, Mus musculus
tggttctccccgaaatctatttagg

SEQ ID NO: 896480 - DNA, 25 bp, Mus musculus
tggttctccccgtaatctatttagg

SEQ ID NO: 896481 - DNA, 25 bp, Mus musculus
tggttctccgaaacatggtggaccc

SEQ ID NO: 896482 - DNA, 25 bp, Mus musculus
tggttctccgaatcatggtggaccc

SEQ ID NO: 896483 - DNA, 25 bp, Mus musculus
tggttctcctaaagggtctgttagt

SEQ ID NO: 896484 - DNA, 25 bp, Mus musculus
tggttctcctaatgggtctgttagt

SEQ ID NO: 896485 - DNA, 25 bp, Mus musculus
tggttctcctccagtaggttatggg

SEQ ID NO: 896486 - DNA, 25 bp, Mus musculus
tggttctcctcctgtaggttatggg

SEQ ID NO: 896487 - DNA, 25 bp, Mus musculus
tggttctccttgagggtctggcgat

SEQ ID NO: 896488 - DNA, 25 bp, Mus musculus
tggttctccttgtgggtctggcgat

SEQ ID NO: 896489 - DNA, 25 bp, Mus musculus
tggttctcctttcggttctcagtaa

SEQ ID NO: 896490 - DNA, 25 bp, Mus musculus
tggttctcctttgggttctcagtaa

SEQ ID NO: 896491 - DNA, 25 bp, Mus musculus
tggttctcgggcctatggtcctgac

SEQ ID NO: 896492 - DNA, 25 bp, Mus musculus
tggttctcgggcgtatggtcctgac

SEQ ID NO: 896493 - DNA, 25 bp, Mus musculus
tggttctctcagctttgtgtatctt

SEQ ID NO: 896494 - DNA, 25 bp, Mus musculus
tggttctctcaggtttgtgtatctt

SEQ ID NO: 896495 - DNA, 25 bp, Mus musculus
tggttctctcttcccagaaagcaag

SEQ ID NO: 896496 - DNA, 25 bp, Mus musculus
tggttctctcttgccagaaagcaag

SEQ ID NO: 896497 - DNA, 25 bp, Mus musculus
tggttctcttccactaccatagaga

SEQ ID NO: 896498 - DNA, 25 bp, Mus musculus
tggttctcttcctctaccatagaga

SEQ ID NO: 896499 - DNA, 25 bp, Mus musculus
tggttctcttgtcccttaatactcc

SEQ ID NO: 896500 - DNA, 25 bp, Mus musculus
tggttctcttgtgccttaatactcc

SEQ ID NO: 896501 - DNA, 25 bp, Mus musculus
tggttctctttgactacagaacatt

SEQ ID NO: 896502 - DNA, 25 bp, Mus musculus
tggttctctttgtctacagaacatt

SEQ ID NO: 896503 - DNA, 25 bp, Mus musculus
tggttctgactgagggctctgcgtc

SEQ ID NO: 896504 - DNA, 25 bp, Mus musculus
tggttctgactgtgggctctgcgtc

SEQ ID NO: 896505 - DNA, 25 bp, Mus musculus
tggttctgcactccttctgtctgtc

SEQ ID NO: 896506 - DNA, 25 bp, Mus musculus
tggttctgcactgcttctgtctgtc

SEQ ID NO: 896507 - DNA, 25 bp, Mus musculus
tggttctgcaggctacctcaggctc

SEQ ID NO: 896508 - DNA, 25 bp, Mus musculus
tggttctgcagggtacctcaggctc

SEQ ID NO: 896509 - DNA, 25 bp, Mus musculus
tggttctgcctcaagtgcatcgaag

SEQ ID NO: 896510 - DNA, 25 bp, Mus musculus
tggttctgcctctagtgcatcgaag

SEQ ID NO: 896511 - DNA, 25 bp, Mus musculus
tggttctgccttagcttccagcgtg

SEQ ID NO: 896512 - DNA, 25 bp, Mus musculus
tggttctgcctttgcttccagcgtg

SEQ ID NO: 896513 - DNA, 25 bp, Mus musculus
tggttctgcttgacttcctgtgact

SEQ ID NO: 896514 - DNA, 25 bp, Mus musculus
tggttctgcttgtcttcctgtgact

SEQ ID NO: 896515 - DNA, 25 bp, Mus musculus
tggttctggaatagacgccacagat

SEQ ID NO: 896516 - DNA, 25 bp, Mus musculus
tggttctggaattgacgccacagat

SEQ ID NO: 896517 - DNA, 25 bp, Mus musculus
tggttctggaggaatttgctgttct

SEQ ID NO: 896518 - DNA, 25 bp, Mus musculus
tggttctggaggaggaggatccggt

SEQ ID NO: 896519 - DNA, 25 bp, Mus musculus
tggttctggaggtatttgctgttct

SEQ ID NO: 896520 - DNA, 25 bp, Mus musculus
tggttctggaggtggaggatccggt

SEQ ID NO: 896521 - DNA, 25 bp, Mus musculus
tggttctggataacttctttgaagc

SEQ ID NO: 896522 - DNA, 25 bp, Mus musculus
tggttctggatatcttctttgaagc

SEQ ID NO: 896523 - DNA, 25 bp, Mus musculus
tggttctggccaaactcctctgcag

SEQ ID NO: 896524 - DNA, 25 bp, Mus musculus
tggttctggccatactcctctgcag

SEQ ID NO: 896525 - DNA, 25 bp, Mus musculus
tggttctgtgcaacccagtctataa

SEQ ID NO: 896526 - DNA, 25 bp, Mus musculus
tggttctgtgcatcccagtctataa

SEQ ID NO: 896527 - DNA, 25 bp, Mus musculus
tggttctgtgccacagcacgcaaga

SEQ ID NO: 896528 - DNA, 25 bp, Mus musculus
tggttctgtgcctcagcacgcaaga

SEQ ID NO: 896529 - DNA, 25 bp, Mus musculus
tggttctgtgctaccagggtttcaa

SEQ ID NO: 896530 - DNA, 25 bp, Mus musculus
tggttctgtgcttccagggtttcaa

SEQ ID NO: 896531 - DNA, 25 bp, Mus musculus
tggttctgttacaggccctataaaa

SEQ ID NO: 896532 - DNA, 25 bp, Mus musculus
tggttctgttactggccctataaaa

SEQ ID NO: 896533 - DNA, 25 bp, Mus musculus
tggttctgttccattgacactacgc

SEQ ID NO: 896534 - DNA, 25 bp, Mus musculus
tggttctgttcctttgacactacgc

SEQ ID NO: 896535 - DNA, 25 bp, Mus musculus
tggttcttacacattgcgctcggtg

SEQ ID NO: 896536 - DNA, 25 bp, Mus musculus
tggttcttacactttgcgctcggtg

SEQ ID NO: 896537 - DNA, 25 bp, Mus musculus
tggttcttcagcacagacatgagtt

SEQ ID NO: 896538 - DNA, 25 bp, Mus musculus
tggttcttcagccactctcaagtgg

SEQ ID NO: 896539 - DNA, 25 bp, Mus musculus
tggttcttcagcgactctcaagtgg

SEQ ID NO: 896540 - DNA, 25 bp, Mus musculus
tggttcttcagctcagacatgagtt

SEQ ID NO: 896541 - DNA, 25 bp, Mus musculus
tggttcttcctcctgtatcctgtga

SEQ ID NO: 896542 - DNA, 25 bp, Mus musculus
tggttcttcctcgtgtatcctgtga

SEQ ID NO: 896543 - DNA, 25 bp, Mus musculus
tggttcttcctgacttggtttattt

SEQ ID NO: 896544 - DNA, 25 bp, Mus musculus
tggttcttcctgtcttggtttattt

SEQ ID NO: 896545 - DNA, 25 bp, Mus musculus
tggttcttcgctcttctatgtatat

SEQ ID NO: 896546 - DNA, 25 bp, Mus musculus
tggttcttcgctgttctatgtatat

SEQ ID NO: 896547 - DNA, 25 bp, Mus musculus
tggttcttcgttaacgaggtcacct

SEQ ID NO: 896548 - DNA, 25 bp, Mus musculus
tggttcttcgtttacgaggtcacct

SEQ ID NO: 896549 - DNA, 25 bp, Mus musculus
tggttcttctgccagatcgtgacat

SEQ ID NO: 896550 - DNA, 25 bp, Mus musculus
tggttcttctgcgagatcgtgacat

SEQ ID NO: 896551 - DNA, 25 bp, Mus musculus
tggttcttgatgctcacccaaagcc

SEQ ID NO: 896552 - DNA, 25 bp, Mus musculus
tggttcttgatggtcacccaaagcc

SEQ ID NO: 896553 - DNA, 25 bp, Mus musculus
tggttcttggcaagtccctgagagt

SEQ ID NO: 896554 - DNA, 25 bp, Mus musculus
tggttcttggcatgtccctgagagt

SEQ ID NO: 896555 - DNA, 25 bp, Mus musculus
tggttcttgtctctaatccccatac

SEQ ID NO: 896556 - DNA, 25 bp, Mus musculus
tggttcttgtctgtaatccccatac

SEQ ID NO: 896557 - DNA, 25 bp, Mus musculus
tggttcttgttgaaagtctcctggt

SEQ ID NO: 896558 - DNA, 25 bp, Mus musculus
tggttcttgttgtaagtctcctggt

SEQ ID NO: 896559 - DNA, 25 bp, Mus musculus
tggttctttaatcctctcagcttga

SEQ ID NO: 896560 - DNA, 25 bp, Mus musculus
tggttctttaatgctctcagcttga

SEQ ID NO: 896561 - DNA, 25 bp, Mus musculus
tggttctttcttattactgatttat

SEQ ID NO: 896562 - DNA, 25 bp, Mus musculus
tggttctttctttttactgatttat

SEQ ID NO: 896563 - DNA, 25 bp, Mus musculus
tggttcttttcactgctctttccta

SEQ ID NO: 896564 - DNA, 25 bp, Mus musculus
tggttcttttcagtgctctttccta

SEQ ID NO: 896565 - DNA, 25 bp, Mus musculus
tggttgaaatttccagcatacctgg

SEQ ID NO: 896566 - DNA, 25 bp, Mus musculus
tggttgaaatttgcagcatacctgg

SEQ ID NO: 896567 - DNA, 25 bp, Mus musculus
tggttgaaccccctacattatggga

SEQ ID NO: 896568 - DNA, 25 bp, Mus musculus
tggttgaaccccgtacattatggga

SEQ ID NO: 896569 - DNA, 25 bp, Mus musculus
tggttgaaccctatctgcgcatcga

SEQ ID NO: 896570 - DNA, 25 bp, Mus musculus
tggttgaaccctttctgcgcatcga

SEQ ID NO: 896571 - DNA, 25 bp, Mus musculus
tggttgaactatcctgaagagggaa

SEQ ID NO: 896572 - DNA, 25 bp, Mus musculus
tggttgaactatgctgaagagggaa

SEQ ID NO: 896573 - DNA, 25 bp, Mus musculus
tggttgacacatcctccagagggaa

SEQ ID NO: 896574 - DNA, 25 bp, Mus musculus
tggttgacacatgctccagagggaa

SEQ ID NO: 896575 - DNA, 25 bp, Mus musculus
tggttgacaggtcccagcttcctcg

SEQ ID NO: 896576 - DNA, 25 bp, Mus musculus
tggttgacaggtgccagcttcctcg

SEQ ID NO: 896577 - DNA, 25 bp, Mus musculus
tggttgacatctacagacatcctgt

SEQ ID NO: 896578 - DNA, 25 bp, Mus musculus
tggttgacatcttcagacatcctgt

SEQ ID NO: 896579 - DNA, 25 bp, Mus musculus
tggttgacctagatcctcaattttt

SEQ ID NO: 896580 - DNA, 25 bp, Mus musculus
tggttgacctagttcctcaattttt

SEQ ID NO: 896581 - DNA, 25 bp, Mus musculus
tggttgacctccatccctaataaag

SEQ ID NO: 896582 - DNA, 25 bp, Mus musculus
tggttgacctccttccctaataaag

SEQ ID NO: 896583 - DNA, 25 bp, Mus musculus
tggttgacgcctcccagcagagaat

SEQ ID NO: 896584 - DNA, 25 bp, Mus musculus
tggttgacgcctgccagcagagaat

SEQ ID NO: 896585 - DNA, 25 bp, Mus musculus
tggttgacgtggattttcttcacaa

SEQ ID NO: 896586 - DNA, 25 bp, Mus musculus
tggttgacgtggtttttcttcacaa

SEQ ID NO: 896587 - DNA, 25 bp, Mus musculus
tggttgactctaaacctgcccgttt

SEQ ID NO: 896588 - DNA, 25 bp, Mus musculus
tggttgactctatacctgcccgttt

SEQ ID NO: 896589 - DNA, 25 bp, Mus musculus
tggttgagaaatagccaccctccaa

SEQ ID NO: 896590 - DNA, 25 bp, Mus musculus
tggttgagaaattgccaccctccaa

SEQ ID NO: 896591 - DNA, 25 bp, Mus musculus
tggttgagagataagcacaccccaa

SEQ ID NO: 896592 - DNA, 25 bp, Mus musculus
tggttgagagattagcacaccccaa

SEQ ID NO: 896593 - DNA, 25 bp, Mus musculus
tggttgagcacccacatacagcagc

SEQ ID NO: 896594 - DNA, 25 bp, Mus musculus
tggttgagcaccgacatacagcagc

SEQ ID NO: 896595 - DNA, 25 bp, Mus musculus
tggttgagcgaaaccgcaggtctga

SEQ ID NO: 896596 - DNA, 25 bp, Mus musculus
tggttgagcgaatccgcaggtctga

SEQ ID NO: 896597 - DNA, 25 bp, Mus musculus
tggttgaggacccaagtcccactta

SEQ ID NO: 896598 - DNA, 25 bp, Mus musculus
tggttgaggaccgaagtcccactta

SEQ ID NO: 896599 - DNA, 25 bp, Mus musculus
tggttgagtctgcagccatgtatat

SEQ ID NO: 896600 - DNA, 25 bp, Mus musculus
tggttgagtctggagccatgtatat

SEQ ID NO: 896601 - DNA, 25 bp, Mus musculus
tggttgatagagatcctgactctca

SEQ ID NO: 896602 - DNA, 25 bp, Mus musculus
tggttgatagagttcctgactctca

SEQ ID NO: 896603 - DNA, 25 bp, Mus musculus
tggttgatagccatgggatgtctcc

SEQ ID NO: 896604 - DNA, 25 bp, Mus musculus
tggttgatagccttgggatgtctcc

SEQ ID NO: 896605 - DNA, 25 bp, Mus musculus
tggttgatattaactgcttccattt

SEQ ID NO: 896606 - DNA, 25 bp, Mus musculus
tggttgatattatctgcttccattt

SEQ ID NO: 896607 - DNA, 25 bp, Mus musculus
tggttgatcatgacctggtgccgca

SEQ ID NO: 896608 - DNA, 25 bp, Mus musculus
tggttgatcatgtcctggtgccgca

SEQ ID NO: 896609 - DNA, 25 bp, Mus musculus
tggttgatggccactttctgttccc

SEQ ID NO: 896610 - DNA, 25 bp, Mus musculus
tggttgatggcctctttctgttccc

SEQ ID NO: 896611 - DNA, 25 bp, Mus musculus
tggttgatggtcactattagtgggt

SEQ ID NO: 896612 - DNA, 25 bp, Mus musculus
tggttgatggtctctattagtgggt

SEQ ID NO: 896613 - DNA, 25 bp, Mus musculus
tggttgattcttcactgcttttgag

SEQ ID NO: 896614 - DNA, 25 bp, Mus musculus
tggttgattcttgactgcttttgag

SEQ ID NO: 896615 - DNA, 25 bp, Mus musculus
tggttgattgctatatctctcgaat

SEQ ID NO: 896616 - DNA, 25 bp, Mus musculus
tggttgattgctttatctctcgaat

SEQ ID NO: 896617 - DNA, 25 bp, Mus musculus
tggttgcaaagtactggcccctctt

SEQ ID NO: 896618 - DNA, 25 bp, Mus musculus
tggttgcaaagttctggcccctctt

SEQ ID NO: 896619 - DNA, 25 bp, Mus musculus
tggttgcacctgagcttctcaaaga

SEQ ID NO: 896620 - DNA, 25 bp, Mus musculus
tggttgcacctgtgcttctcaaaga

SEQ ID NO: 896621 - DNA, 25 bp, Mus musculus
tggttgcacggcagccctttgatga

SEQ ID NO: 896622 - DNA, 25 bp, Mus musculus
tggttgcacggctgccctttgatga

SEQ ID NO: 896623 - DNA, 25 bp, Mus musculus
tggttgcacgggatctgttttcatt

SEQ ID NO: 896624 - DNA, 25 bp, Mus musculus
tggttgcacgggttctgttttcatt

SEQ ID NO: 896625 - DNA, 25 bp, Mus musculus
tggttgcaggaaagaccggagcccc

SEQ ID NO: 896626 - DNA, 25 bp, Mus musculus
tggttgcaggaatgaccggagcccc

SEQ ID NO: 896627 - DNA, 25 bp, Mus musculus
tggttgcaggcacgttcattcgatc

SEQ ID NO: 896628 - DNA, 25 bp, Mus musculus
tggttgcaggcaggttcattcgatc

SEQ ID NO: 896629 - DNA, 25 bp, Mus musculus
tggttgcagtctcaagtgtgttctg

SEQ ID NO: 896630 - DNA, 25 bp, Mus musculus
tggttgcagtctgaagtgtgttctg

SEQ ID NO: 896631 - DNA, 25 bp, Mus musculus
tggttgcatggacggccctaaaagc

SEQ ID NO: 896632 - DNA, 25 bp, Mus musculus
tggttgcatggagggccctaaaagc

SEQ ID NO: 896633 - DNA, 25 bp, Mus musculus
tggttgcatgtcagtcttagtgtac

SEQ ID NO: 896634 - DNA, 25 bp, Mus musculus
tggttgcatgtctgtcttagtgtac

SEQ ID NO: 896635 - DNA, 25 bp, Mus musculus
tggttgccaccgatataaaagagat

SEQ ID NO: 896636 - DNA, 25 bp, Mus musculus
tggttgccaccgttataaaagagat

SEQ ID NO: 896637 - DNA, 25 bp, Mus musculus
tggttgccacgaaaacagacttttt

SEQ ID NO: 896638 - DNA, 25 bp, Mus musculus
tggttgccacgataacagacttttt

SEQ ID NO: 896639 - DNA, 25 bp, Mus musculus
tggttgccagaaaatgttgttgcta

SEQ ID NO: 896640 - DNA, 25 bp, Mus musculus
tggttgccagaatatgttgttgcta

SEQ ID NO: 896641 - DNA, 25 bp, Mus musculus
tggttgcccctcatgccagtaagag

SEQ ID NO: 896642 - DNA, 25 bp, Mus musculus
tggttgcccctcttgccagtaagag

SEQ ID NO: 896643 - DNA, 25 bp, Mus musculus
tggttgccctctacaccatgaactg

SEQ ID NO: 896644 - DNA, 25 bp, Mus musculus
tggttgccctctatacaaatcgttt

SEQ ID NO: 896645 - DNA, 25 bp, Mus musculus
tggttgccctctcttagaggcctgc

SEQ ID NO: 896646 - DNA, 25 bp, Mus musculus
tggttgccctctgttagaggcctgc

SEQ ID NO: 896647 - DNA, 25 bp, Mus musculus
tggttgccctcttcaccatgaactg

SEQ ID NO: 896648 - DNA, 25 bp, Mus musculus
tggttgccctctttacaaatcgttt

SEQ ID NO: 896649 - DNA, 25 bp, Mus musculus
tggttgcctatgattcaggcctgta

SEQ ID NO: 896650 - DNA, 25 bp, Mus musculus
tggttgcctatgtttcaggcctgta

SEQ ID NO: 896651 - DNA, 25 bp, Mus musculus
tggttgcctggaaggcactccagtt

SEQ ID NO: 896652 - DNA, 25 bp, Mus musculus
tggttgcctggatggcactccagtt

SEQ ID NO: 896653 - DNA, 25 bp, Mus musculus
tggttgcctgtgagaacactgggaa

SEQ ID NO: 896654 - DNA, 25 bp, Mus musculus
tggttgcctgtgtgaacactgggaa

SEQ ID NO: 896655 - DNA, 25 bp, Mus musculus
tggttgccttaaacgagttctgcta

SEQ ID NO: 896656 - DNA, 25 bp, Mus musculus
tggttgccttaatcgagttctgcta

SEQ ID NO: 896657 - DNA, 25 bp, Mus musculus
tggttgccttccctgtctctaagat

SEQ ID NO: 896658 - DNA, 25 bp, Mus musculus
tggttgccttccgtgtctctaagat

SEQ ID NO: 896659 - DNA, 25 bp, Mus musculus
tggttgcctttaacctctcctctgg

SEQ ID NO: 896660 - DNA, 25 bp, Mus musculus
tggttgcctttatcctctcctctgg

SEQ ID NO: 896661 - DNA, 25 bp, Mus musculus
tggttgcgcgcaagcgtgcaaacgc

SEQ ID NO: 896662 - DNA, 25 bp, Mus musculus
tggttgcgcgcatgcgtgcaaacgc

SEQ ID NO: 896663 - DNA, 25 bp, Mus musculus
tggttgcgcttgatggatcccaaac

SEQ ID NO: 896664 - DNA, 25 bp, Mus musculus
tggttgcgcttgttggatcccaaac

SEQ ID NO: 896665 - DNA, 25 bp, Mus musculus
tggttgcggtcacggcaactgtctc

SEQ ID NO: 896666 - DNA, 25 bp, Mus musculus
tggttgcggtcagggcaactgtctc

SEQ ID NO: 896667 - DNA, 25 bp, Mus musculus
tggttgctaattagacacgtcactt

SEQ ID NO: 896668 - DNA, 25 bp, Mus musculus
tggttgctaatttgacacgtcactt

SEQ ID NO: 896669 - DNA, 25 bp, Mus musculus
tggttgctcaccctttaatgccagc

SEQ ID NO: 896670 - DNA, 25 bp, Mus musculus
tggttgctcaccgtttaatgccagc

SEQ ID NO: 896671 - DNA, 25 bp, Mus musculus
tggttgctcggtacactaaactgtt

SEQ ID NO: 896672 - DNA, 25 bp, Mus musculus
tggttgctcggttcactaaactgtt

SEQ ID NO: 896673 - DNA, 25 bp, Mus musculus
tggttgctctgccttcattagtgac

SEQ ID NO: 896674 - DNA, 25 bp, Mus musculus
tggttgctctgcgttcattagtgac

SEQ ID NO: 896675 - DNA, 25 bp, Mus musculus
tggttgctgcatataaagtattaca

SEQ ID NO: 896676 - DNA, 25 bp, Mus musculus
tggttgctgcatttaaagtattaca

SEQ ID NO: 896677 - DNA, 25 bp, Mus musculus
tggttgctggaaaagccattacaat

SEQ ID NO: 896678 - DNA, 25 bp, Mus musculus
tggttgctggaatagccattacaat

SEQ ID NO: 896679 - DNA, 25 bp, Mus musculus
tggttgctggacataacactgggcc

SEQ ID NO: 896680 - DNA, 25 bp, Mus musculus
tggttgctggacttaacactgggcc

SEQ ID NO: 896681 - DNA, 25 bp, Mus musculus
tggttgctgtgtcactgtgcgttaa

SEQ ID NO: 896682 - DNA, 25 bp, Mus musculus
tggttgctgtgtgactgtgcgttaa

SEQ ID NO: 896683 - DNA, 25 bp, Mus musculus
tggttgcttctgaatttttgcattt

SEQ ID NO: 896684 - DNA, 25 bp, Mus musculus
tggttgcttctgtatttttgcattt

SEQ ID NO: 896685 - DNA, 25 bp, Mus musculus
tggttgcttcttactaatacagaca

SEQ ID NO: 896686 - DNA, 25 bp, Mus musculus
tggttgcttctttctaatacagaca

SEQ ID NO: 896687 - DNA, 25 bp, Mus musculus
tggttgctttcaaccctttggaact

SEQ ID NO: 896688 - DNA, 25 bp, Mus musculus
tggttgctttcatccctttggaact

SEQ ID NO: 896689 - DNA, 25 bp, Mus musculus
tggttggaacacagtctggactctt

SEQ ID NO: 896690 - DNA, 25 bp, Mus musculus
tggttggaacactgtctggactctt

SEQ ID NO: 896691 - DNA, 25 bp, Mus musculus
tggttggacattcttttaactcgtt

SEQ ID NO: 896692 - DNA, 25 bp, Mus musculus
tggttggacattgttttaactcgtt

SEQ ID NO: 896693 - DNA, 25 bp, Mus musculus
tggttggacgagacaacacccacca

SEQ ID NO: 896694 - DNA, 25 bp, Mus musculus
tggttggacgagtcaacacccacca

SEQ ID NO: 896695 - DNA, 25 bp, Mus musculus
tggttggactgcatttcatcttggt

SEQ ID NO: 896696 - DNA, 25 bp, Mus musculus
tggttggactgcttttcatcttggt

SEQ ID NO: 896697 - DNA, 25 bp, Mus musculus
tggttggagaccacgtttagtaatt

SEQ ID NO: 896698 - DNA, 25 bp, Mus musculus
tggttggagacctcgtttagtaatt

SEQ ID NO: 896699 - DNA, 25 bp, Mus musculus
tggttggagggaaacctttcatctt

SEQ ID NO: 896700 - DNA, 25 bp, Mus musculus
tggttggagggatacctttcatctt

SEQ ID NO: 896701 - DNA, 25 bp, Mus musculus
tggttggatgttcagcatgacttca

SEQ ID NO: 896702 - DNA, 25 bp, Mus musculus
tggttggatgttgagcatgacttca

SEQ ID NO: 896703 - DNA, 25 bp, Mus musculus
tggttggcagaacctcagcgcccta

SEQ ID NO: 896704 - DNA, 25 bp, Mus musculus
tggttggcagaagctcagcgcccta

SEQ ID NO: 896705 - DNA, 25 bp, Mus musculus
tggttggccaaaacttttcaggccc

SEQ ID NO: 896706 - DNA, 25 bp, Mus musculus
tggttggccaaatcttttcaggccc

SEQ ID NO: 896707 - DNA, 25 bp, Mus musculus
tggttggccacgcaagagcagtaac

SEQ ID NO: 896708 - DNA, 25 bp, Mus musculus
tggttggccacggaagagcagtaac

SEQ ID NO: 896709 - DNA, 25 bp, Mus musculus
tggttggccccacataagcatatca

SEQ ID NO: 896710 - DNA, 25 bp, Mus musculus
tggttggccccagataagcatatca

SEQ ID NO: 896711 - DNA, 25 bp, Mus musculus
tggttggccgacctcaagatttcag

SEQ ID NO: 896712 - DNA, 25 bp, Mus musculus
tggttggccgacgtcaagatttcag

SEQ ID NO: 896713 - DNA, 25 bp, Mus musculus
tggttgggaacacttgctactcgca

SEQ ID NO: 896714 - DNA, 25 bp, Mus musculus
tggttgggaacagttgctactcgca

SEQ ID NO: 896715 - DNA, 25 bp, Mus musculus
tggttgggacaaaggcaataggata

SEQ ID NO: 896716 - DNA, 25 bp, Mus musculus
tggttgggacaatggcaataggata

SEQ ID NO: 896717 - DNA, 25 bp, Mus musculus
tggttgggcagaaccatcagctcgc

SEQ ID NO: 896718 - DNA, 25 bp, Mus musculus
tggttgggcagatccatcagctcgc

SEQ ID NO: 896719 - DNA, 25 bp, Mus musculus
tggttgggccctacaaactgaggtc

SEQ ID NO: 896720 - DNA, 25 bp, Mus musculus
tggttgggcccttcaaactgaggtc

SEQ ID NO: 896721 - DNA, 25 bp, Mus musculus
tggttgggtctaacactaactgtac

SEQ ID NO: 896722 - DNA, 25 bp, Mus musculus
tggttgggtctatcactaactgtac

SEQ ID NO: 896723 - DNA, 25 bp, Mus musculus
tggttgggtgtgctactttcagtat

SEQ ID NO: 896724 - DNA, 25 bp, Mus musculus
tggttgggtgtggtactttcagtat

SEQ ID NO: 896725 - DNA, 25 bp, Mus musculus
tggttgggtttactaatctccttag

SEQ ID NO: 896726 - DNA, 25 bp, Mus musculus
tggttgggtttagtaatctccttag

SEQ ID NO: 896727 - DNA, 25 bp, Mus musculus
tggttggtaaagacttgccatacaa

SEQ ID NO: 896728 - DNA, 25 bp, Mus musculus
tggttggtaaagtcttgccatacaa

SEQ ID NO: 896729 - DNA, 25 bp, Mus musculus
tggttggtacctcctacaaagccat

SEQ ID NO: 896730 - DNA, 25 bp, Mus musculus
tggttggtacctgctacaaagccat

SEQ ID NO: 896731 - DNA, 25 bp, Mus musculus
tggttggtattgaactggctatcaa

SEQ ID NO: 896732 - DNA, 25 bp, Mus musculus
tggttggtattgtactggctatcaa

SEQ ID NO: 896733 - DNA, 25 bp, Mus musculus
tggttggtggatagagtttgctctc

SEQ ID NO: 896734 - DNA, 25 bp, Mus musculus
tggttggtggattgagtttgctctc

SEQ ID NO: 896735 - DNA, 25 bp, Mus musculus
tggttggttctcctttccagccttc

SEQ ID NO: 896736 - DNA, 25 bp, Mus musculus
tggttggttctcgtttccagccttc

SEQ ID NO: 896737 - DNA, 25 bp, Mus musculus
tggttggttgctaatcttcaaacaa

SEQ ID NO: 896738 - DNA, 25 bp, Mus musculus
tggttggttgcttatcttcaaacaa

SEQ ID NO: 896739 - DNA, 25 bp, Mus musculus
tggttgtaatctatgcttttcccca

SEQ ID NO: 896740 - DNA, 25 bp, Mus musculus
tggttgtaatctttgcttttcccca

SEQ ID NO: 896741 - DNA, 25 bp, Mus musculus
tggttgtacacaaccccagggagag

SEQ ID NO: 896742 - DNA, 25 bp, Mus musculus
tggttgtacacatccccagggagag

SEQ ID NO: 896743 - DNA, 25 bp, Mus musculus
tggttgtacaccatgcttttcaaac

SEQ ID NO: 896744 - DNA, 25 bp, Mus musculus
tggttgtacaccttgcttttcaaac

SEQ ID NO: 896745 - DNA, 25 bp, Mus musculus
tggttgtaccaacacgtggcattga

SEQ ID NO: 896746 - DNA, 25 bp, Mus musculus
tggttgtaccaagacgtggcattga

SEQ ID NO: 896747 - DNA, 25 bp, Mus musculus
tggttgtacccgagcctgaggcatg

SEQ ID NO: 896748 - DNA, 25 bp, Mus musculus
tggttgtacccgtgcctgaggcatg

SEQ ID NO: 896749 - DNA, 25 bp, Mus musculus
tggttgtagttgctcacacctgtaa

SEQ ID NO: 896750 - DNA, 25 bp, Mus musculus
tggttgtagttggtcacacctgtaa

SEQ ID NO: 896751 - DNA, 25 bp, Mus musculus
tggttgtatagccattttgaggcca

SEQ ID NO: 896752 - DNA, 25 bp, Mus musculus
tggttgtatagcgattttgaggcca

SEQ ID NO: 896753 - DNA, 25 bp, Mus musculus
tggttgtatataaggagtgtctgtc

SEQ ID NO: 896754 - DNA, 25 bp, Mus musculus
tggttgtatatatggagtgtctgtc

SEQ ID NO: 896755 - DNA, 25 bp, Mus musculus
tggttgtatttcctacatatagtag

SEQ ID NO: 896756 - DNA, 25 bp, Mus musculus
tggttgtatttcgtacatatagtag

SEQ ID NO: 896757 - DNA, 25 bp, Mus musculus
tggttgtcacaacgagcgctgcaca

SEQ ID NO: 896758 - DNA, 25 bp, Mus musculus
tggttgtcacaaggagcgctgcaca

SEQ ID NO: 896759 - DNA, 25 bp, Mus musculus
tggttgtcccgaccaaatggcccca

SEQ ID NO: 896760 - DNA, 25 bp, Mus musculus
tggttgtcccgagcaaatggcccca

SEQ ID NO: 896761 - DNA, 25 bp, Mus musculus
tggttgtcctagaaccccatctctg

SEQ ID NO: 896762 - DNA, 25 bp, Mus musculus
tggttgtcctagtaccccatctctg

SEQ ID NO: 896763 - DNA, 25 bp, Mus musculus
tggttgtcgcctatgttcggagaaa

SEQ ID NO: 896764 - DNA, 25 bp, Mus musculus
tggttgtcgcctttgttcggagaaa

SEQ ID NO: 896765 - DNA, 25 bp, Mus musculus
tggttgtcgcttcctaaaccttcct

SEQ ID NO: 896766 - DNA, 25 bp, Mus musculus
tggttgtcgcttgctaaaccttcct

SEQ ID NO: 896767 - DNA, 25 bp, Mus musculus
tggttgtctctaccctgatcagata

SEQ ID NO: 896768 - DNA, 25 bp, Mus musculus
tggttgtctctagcctgatcagata

SEQ ID NO: 896769 - DNA, 25 bp, Mus musculus
tggttgtgactcactttccacagta

SEQ ID NO: 896770 - DNA, 25 bp, Mus musculus
tggttgtgactctctttccacagta

SEQ ID NO: 896771 - DNA, 25 bp, Mus musculus
tggttgtgacttccccaatgtgggt

SEQ ID NO: 896772 - DNA, 25 bp, Mus musculus
tggttgtgacttgcccaatgtgggt

SEQ ID NO: 896773 - DNA, 25 bp, Mus musculus
tggttgtgcagtcggctgacctcat

SEQ ID NO: 896774 - DNA, 25 bp, Mus musculus
tggttgtgcagtgggctgacctcat

SEQ ID NO: 896775 - DNA, 25 bp, Mus musculus
tggttgtgctctatgtgcctaagat

SEQ ID NO: 896776 - DNA, 25 bp, Mus musculus
tggttgtgctctttgtgcctaagat

SEQ ID NO: 896777 - DNA, 25 bp, Mus musculus
tggttgtgtctacggcacccagatg

SEQ ID NO: 896778 - DNA, 25 bp, Mus musculus
tggttgtgtctagggcacccagatg

SEQ ID NO: 896779 - DNA, 25 bp, Mus musculus
tggttgtgtggccatgccctgctca

SEQ ID NO: 896780 - DNA, 25 bp, Mus musculus
tggttgtgtggcgatgccctgctca

SEQ ID NO: 896781 - DNA, 25 bp, Mus musculus
tggttgttactaacctcttgactac

SEQ ID NO: 896782 - DNA, 25 bp, Mus musculus
tggttgttactatcctcttgactac

SEQ ID NO: 896783 - DNA, 25 bp, Mus musculus
tggttgttccacaccactaggtgga

SEQ ID NO: 896784 - DNA, 25 bp, Mus musculus
tggttgttccactccactaggtgga

SEQ ID NO: 896785 - DNA, 25 bp, Mus musculus
tggttgttcgagaaattcctgttcc

SEQ ID NO: 896786 - DNA, 25 bp, Mus musculus
tggttgttcgagtaattcctgttcc

SEQ ID NO: 896787 - DNA, 25 bp, Mus musculus
tggttgttctcactggcttagggca

SEQ ID NO: 896788 - DNA, 25 bp, Mus musculus
tggttgttctcagtggcttagggca

SEQ ID NO: 896789 - DNA, 25 bp, Mus musculus
tggtttaaatacacccagcagcatt

SEQ ID NO: 896790 - DNA, 25 bp, Mus musculus
tggtttaaatactcccagcagcatt

SEQ ID NO: 896791 - DNA, 25 bp, Mus musculus
tggtttaaatgcaccctcattctcc

SEQ ID NO: 896792 - DNA, 25 bp, Mus musculus
tggtttaaatgctccctcattctcc

SEQ ID NO: 896793 - DNA, 25 bp, Mus musculus
tggtttaacaccctgcacgaccgag

SEQ ID NO: 896794 - DNA, 25 bp, Mus musculus
tggtttaacaccgtgcacgaccgag

SEQ ID NO: 896795 - DNA, 25 bp, Mus musculus
tggtttacaaagagactcgtcccct

SEQ ID NO: 896796 - DNA, 25 bp, Mus musculus
tggtttacaaagtgactcgtcccct

SEQ ID NO: 896797 - DNA, 25 bp, Mus musculus
tggtttacatctcgaatggtcaggt

SEQ ID NO: 896798 - DNA, 25 bp, Mus musculus
tggtttacatctggaatggtcaggt

SEQ ID NO: 896799 - DNA, 25 bp, Mus musculus
tggtttaccaatcgcgttaggaaag

SEQ ID NO: 896800 - DNA, 25 bp, Mus musculus
tggtttaccaatggcgttaggaaag

SEQ ID NO: 896801 - DNA, 25 bp, Mus musculus
tggtttaccaccacctgtaagggat

SEQ ID NO: 896802 - DNA, 25 bp, Mus musculus
tggtttaccacctcctgtaagggat

SEQ ID NO: 896803 - DNA, 25 bp, Mus musculus
tggtttacccagcatcattcctttg

SEQ ID NO: 896804 - DNA, 25 bp, Mus musculus
tggtttacccaggatcattcctttg

SEQ ID NO: 896805 - DNA, 25 bp, Mus musculus
tggtttaccggcacatttggtaact

SEQ ID NO: 896806 - DNA, 25 bp, Mus musculus
tggtttaccggctcatttggtaact

SEQ ID NO: 896807 - DNA, 25 bp, Mus musculus
tggtttacctgtagtgtttctaaag

SEQ ID NO: 896808 - DNA, 25 bp, Mus musculus
tggtttacctgttgtgtttctaaag

SEQ ID NO: 896809 - DNA, 25 bp, Mus musculus
tggtttaccttcaagagccttagtt

SEQ ID NO: 896810 - DNA, 25 bp, Mus musculus
tggtttaccttctagagccttagtt

SEQ ID NO: 896811 - DNA, 25 bp, Mus musculus
tggtttacttacaccattatatttt

SEQ ID NO: 896812 - DNA, 25 bp, Mus musculus
tggtttacttactccattatatttt

SEQ ID NO: 896813 - DNA, 25 bp, Mus musculus
tggtttaggattccttcggttgccc

SEQ ID NO: 896814 - DNA, 25 bp, Mus musculus
tggtttaggattgcttcggttgccc

SEQ ID NO: 896815 - DNA, 25 bp, Mus musculus
tggtttaggcccacttggaatccca

SEQ ID NO: 896816 - DNA, 25 bp, Mus musculus
tggtttaggccctcttggaatccca

SEQ ID NO: 896817 - DNA, 25 bp, Mus musculus
tggtttatcatactgcacacctgct

SEQ ID NO: 896818 - DNA, 25 bp, Mus musculus
tggtttatcatagtgcacacctgct

SEQ ID NO: 896819 - DNA, 25 bp, Mus musculus
tggtttatctcactgacacatcggg

SEQ ID NO: 896820 - DNA, 25 bp, Mus musculus
tggtttatctcagtgacacatcggg

SEQ ID NO: 896821 - DNA, 25 bp, Mus musculus
tggtttatgaatattctactgtgac

SEQ ID NO: 896822 - DNA, 25 bp, Mus musculus
tggtttatgaattttctactgtgac

SEQ ID NO: 896823 - DNA, 25 bp, Mus musculus
tggtttatggttcacatcttggttt

SEQ ID NO: 896824 - DNA, 25 bp, Mus musculus
tggtttatggttgacatcttggttt

SEQ ID NO: 896825 - DNA, 25 bp, Mus musculus
tggtttattttcacactgtttatac

SEQ ID NO: 896826 - DNA, 25 bp, Mus musculus
tggtttattttctcactgtttatac

SEQ ID NO: 896827 - DNA, 25 bp, Mus musculus
tggtttcaaaagacggcaggtgcct

SEQ ID NO: 896828 - DNA, 25 bp, Mus musculus
tggtttcaaaagtcggcaggtgcct

SEQ ID NO: 896829 - DNA, 25 bp, Mus musculus
tggtttcaacaactgacgcccatga

SEQ ID NO: 896830 - DNA, 25 bp, Mus musculus
tggtttcaacaagtgacgcccatga

SEQ ID NO: 896831 - DNA, 25 bp, Mus musculus
tggtttcaacgacttcatttccaaa

SEQ ID NO: 896832 - DNA, 25 bp, Mus musculus
tggtttcaacgagttcatttccaaa

SEQ ID NO: 896833 - DNA, 25 bp, Mus musculus
tggtttcaactaatctcttcccaaa

SEQ ID NO: 896834 - DNA, 25 bp, Mus musculus
tggtttcaactattctcttcccaaa

SEQ ID NO: 896835 - DNA, 25 bp, Mus musculus
tggtttcacaggctcagccggccct

SEQ ID NO: 896836 - DNA, 25 bp, Mus musculus
tggtttcacagggtcagccggccct

SEQ ID NO: 896837 - DNA, 25 bp, Mus musculus
tggtttcacgttcaagtctcacctc

SEQ ID NO: 896838 - DNA, 25 bp, Mus musculus
tggtttcacgttgaagtctcacctc

SEQ ID NO: 896839 - DNA, 25 bp, Mus musculus
tggtttcactttccctgcgtggatc

SEQ ID NO: 896840 - DNA, 25 bp, Mus musculus
tggtttcactttgcctgcgtggatc

SEQ ID NO: 896841 - DNA, 25 bp, Mus musculus
tggtttcagaagcttatacccagaa

SEQ ID NO: 896842 - DNA, 25 bp, Mus musculus
tggtttcagaaggttatacccagaa

SEQ ID NO: 896843 - DNA, 25 bp, Mus musculus
tggtttcaggaaatcaagaagtttg

SEQ ID NO: 896844 - DNA, 25 bp, Mus musculus
tggtttcaggaattcaagaagtttg

SEQ ID NO: 896845 - DNA, 25 bp, Mus musculus
tggtttcaggagagatcccagccaa

SEQ ID NO: 896846 - DNA, 25 bp, Mus musculus
tggtttcaggagtgatcccagccaa

SEQ ID NO: 896847 - DNA, 25 bp, Mus musculus
tggtttcatctaccctcagcaagcc

SEQ ID NO: 896848 - DNA, 25 bp, Mus musculus
tggtttcatctagcctcagcaagcc

SEQ ID NO: 896849 - DNA, 25 bp, Mus musculus
tggtttccacacaaagaactcggta

SEQ ID NO: 896850 - DNA, 25 bp, Mus musculus
tggtttccacactaagaactcggta

SEQ ID NO: 896851 - DNA, 25 bp, Mus musculus
tggtttccacagaagttgtacaagt

SEQ ID NO: 896852 - DNA, 25 bp, Mus musculus
tggtttccacagtagttgtacaagt

SEQ ID NO: 896853 - DNA, 25 bp, Mus musculus
tggtttccacatccaaactgaagac

SEQ ID NO: 896854 - DNA, 25 bp, Mus musculus
tggtttccacatgcaaactgaagac

SEQ ID NO: 896855 - DNA, 25 bp, Mus musculus
tggtttccaggccacctaaaactat

SEQ ID NO: 896856 - DNA, 25 bp, Mus musculus
tggtttccaggcgacctaaaactat

SEQ ID NO: 896857 - DNA, 25 bp, Mus musculus
tggtttccagttcggttcaaccaat

SEQ ID NO: 896858 - DNA, 25 bp, Mus musculus
tggtttccagttgggttcaaccaat

SEQ ID NO: 896859 - DNA, 25 bp, Mus musculus
tggtttcccaaaccgcctaagattg

SEQ ID NO: 896860 - DNA, 25 bp, Mus musculus
tggtttcccaaagcgcctaagattg

SEQ ID NO: 896861 - DNA, 25 bp, Mus musculus
tggtttcccactaacttaccaggca

SEQ ID NO: 896862 - DNA, 25 bp, Mus musculus
tggtttcccacttacttaccaggca

SEQ ID NO: 896863 - DNA, 25 bp, Mus musculus
tggtttcccagtccattgagtgatg

SEQ ID NO: 896864 - DNA, 25 bp, Mus musculus
tggtttcccagtgcattgagtgatg

SEQ ID NO: 896865 - DNA, 25 bp, Mus musculus
tggtttccctcaagatgcactgatt

SEQ ID NO: 896866 - DNA, 25 bp, Mus musculus
tggtttccctcatgatgcactgatt

SEQ ID NO: 896867 - DNA, 25 bp, Mus musculus
tggtttccgttgattacggctcttc

SEQ ID NO: 896868 - DNA, 25 bp, Mus musculus
tggtttccgttgtttacggctcttc

SEQ ID NO: 896869 - DNA, 25 bp, Mus musculus
tggtttcctggccaccaatggaatt

SEQ ID NO: 896870 - DNA, 25 bp, Mus musculus
tggtttcctggcgaccaatggaatt

SEQ ID NO: 896871 - DNA, 25 bp, Mus musculus
tggtttcctggtcatatttacgctg

SEQ ID NO: 896872 - DNA, 25 bp, Mus musculus
tggtttcctggtgatatttacgctg

SEQ ID NO: 896873 - DNA, 25 bp, Mus musculus
tggtttccttcgacgtacgtggaag

SEQ ID NO: 896874 - DNA, 25 bp, Mus musculus
tggtttccttcgtcgtacgtggaag

SEQ ID NO: 896875 - DNA, 25 bp, Mus musculus
tggtttcctttacacaatccaagag

SEQ ID NO: 896876 - DNA, 25 bp, Mus musculus
tggtttcctttagacaatccaagag

SEQ ID NO: 896877 - DNA, 25 bp, Mus musculus
tggtttcctttcactccaatacaga

SEQ ID NO: 896878 - DNA, 25 bp, Mus musculus
tggtttcctttccagagtcatccta

SEQ ID NO: 896879 - DNA, 25 bp, Mus musculus
tggtttcctttcgagagtcatccta

SEQ ID NO: 896880 - DNA, 25 bp, Mus musculus
tggtttcctttctctccaatacaga

SEQ ID NO: 896881 - DNA, 25 bp, Mus musculus
tggtttcctttgctcaactctctta

SEQ ID NO: 896882 - DNA, 25 bp, Mus musculus
tggtttcctttggtcaactctctta

SEQ ID NO: 896883 - DNA, 25 bp, Mus musculus
tggtttcggccacccttctcatatt

SEQ ID NO: 896884 - DNA, 25 bp, Mus musculus
tggtttcggccagccttctcatatt

SEQ ID NO: 896885 - DNA, 25 bp, Mus musculus
tggtttcggcccatttacaaggcct

SEQ ID NO: 896886 - DNA, 25 bp, Mus musculus
tggtttcggcccttttacaaggcct

SEQ ID NO: 896887 - DNA, 25 bp, Mus musculus
tggtttcgttacatgcctcagtttc

SEQ ID NO: 896888 - DNA, 25 bp, Mus musculus
tggtttcgttacttgcctcagtttc

SEQ ID NO: 896889 - DNA, 25 bp, Mus musculus
tggtttctaataaggccccacatta

SEQ ID NO: 896890 - DNA, 25 bp, Mus musculus
tggtttctaatatggccccacatta

SEQ ID NO: 896891 - DNA, 25 bp, Mus musculus
tggtttctacagaggagctcagcct

SEQ ID NO: 896892 - DNA, 25 bp, Mus musculus
tggtttctacagtggagctcagcct

SEQ ID NO: 896893 - DNA, 25 bp, Mus musculus
tggtttctacccagtacatggtgct

SEQ ID NO: 896894 - DNA, 25 bp, Mus musculus
tggtttctaccctgtacatggtgct

SEQ ID NO: 896895 - DNA, 25 bp, Mus musculus
tggtttctagcaaccacgtccagtt

SEQ ID NO: 896896 - DNA, 25 bp, Mus musculus
tggtttctagcatccacgtccagtt

SEQ ID NO: 896897 - DNA, 25 bp, Mus musculus
tggtttctatctacccgaattctta

SEQ ID NO: 896898 - DNA, 25 bp, Mus musculus
tggtttctatcttcccgaattctta

SEQ ID NO: 896899 - DNA, 25 bp, Mus musculus
tggtttctatgaccctataaagctg

SEQ ID NO: 896900 - DNA, 25 bp, Mus musculus
tggtttctatgagcctataaagctg

SEQ ID NO: 896901 - DNA, 25 bp, Mus musculus
tggtttctattaatccacgtcttcc

SEQ ID NO: 896902 - DNA, 25 bp, Mus musculus
tggtttctattattccacgtcttcc

SEQ ID NO: 896903 - DNA, 25 bp, Mus musculus
tggtttctattccttgtctctatgt

SEQ ID NO: 896904 - DNA, 25 bp, Mus musculus
tggtttctattcgttgtctctatgt

SEQ ID NO: 896905 - DNA, 25 bp, Mus musculus
tggtttctcaacagctactcattct

SEQ ID NO: 896906 - DNA, 25 bp, Mus musculus
tggtttctcaactgctactcattct

SEQ ID NO: 896907 - DNA, 25 bp, Mus musculus
tggtttctcaataccccaggagtac

SEQ ID NO: 896908 - DNA, 25 bp, Mus musculus
tggtttctcaattccccaggagtac

SEQ ID NO: 896909 - DNA, 25 bp, Mus musculus
tggtttctcagaacgacgggtcttt

SEQ ID NO: 896910 - DNA, 25 bp, Mus musculus
tggtttctcagatcgacgggtcttt

SEQ ID NO: 896911 - DNA, 25 bp, Mus musculus
tggtttctcatgaagatggctccgt

SEQ ID NO: 896912 - DNA, 25 bp, Mus musculus
tggtttctcatgtagatggctccgt

SEQ ID NO: 896913 - DNA, 25 bp, Mus musculus
tggtttctccaaagcctcaaagttt

SEQ ID NO: 896914 - DNA, 25 bp, Mus musculus
tggtttctccaatgcctcaaagttt

SEQ ID NO: 896915 - DNA, 25 bp, Mus musculus
tggtttctcctgataatatgctctg

SEQ ID NO: 896916 - DNA, 25 bp, Mus musculus
tggtttctcctgttaatatgctctg

SEQ ID NO: 896917 - DNA, 25 bp, Mus musculus
tggtttctcttcctgagacatgatg

SEQ ID NO: 896918 - DNA, 25 bp, Mus musculus
tggtttctcttcgtgagacatgatg

SEQ ID NO: 896919 - DNA, 25 bp, Mus musculus
tggtttctcttgcatcccaaaccct

SEQ ID NO: 896920 - DNA, 25 bp, Mus musculus
tggtttctcttggatcccaaaccct

SEQ ID NO: 896921 - DNA, 25 bp, Mus musculus
tggtttctctttaacgtttgcctct

SEQ ID NO: 896922 - DNA, 25 bp, Mus musculus
tggtttctcttttacgtttgcctct

SEQ ID NO: 896923 - DNA, 25 bp, Mus musculus
tggtttctgagacctacgaggtaca

SEQ ID NO: 896924 - DNA, 25 bp, Mus musculus
tggtttctgagagctacgaggtaca

SEQ ID NO: 896925 - DNA, 25 bp, Mus musculus
tggtttctgagccttacagctagag

SEQ ID NO: 896926 - DNA, 25 bp, Mus musculus
tggtttctgagcgttacagctagag

SEQ ID NO: 896927 - DNA, 25 bp, Mus musculus
tggtttctgccactccttttgtatg

SEQ ID NO: 896928 - DNA, 25 bp, Mus musculus
tggtttctgccagtccttttgtatg

SEQ ID NO: 896929 - DNA, 25 bp, Mus musculus
tggtttctgcgcagctacacgtggg

SEQ ID NO: 896930 - DNA, 25 bp, Mus musculus
tggtttctgcgctgctacacgtggg

SEQ ID NO: 896931 - DNA, 25 bp, Mus musculus
tggtttctggttatgctttgtttga

SEQ ID NO: 896932 - DNA, 25 bp, Mus musculus
tggtttctggttttgctttgtttga

SEQ ID NO: 896933 - DNA, 25 bp, Mus musculus
tggtttctgtagagtcctgcattaa

SEQ ID NO: 896934 - DNA, 25 bp, Mus musculus
tggtttctgtagtgtcctgcattaa

SEQ ID NO: 896935 - DNA, 25 bp, Mus musculus
tggtttcttaacaggtatcacacaa

SEQ ID NO: 896936 - DNA, 25 bp, Mus musculus
tggtttcttaactggtatcacacaa

SEQ ID NO: 896937 - DNA, 25 bp, Mus musculus
tggtttcttaccaacagtgtgtcga

SEQ ID NO: 896938 - DNA, 25 bp, Mus musculus
tggtttcttacctacagtgtgtcga

SEQ ID NO: 896939 - DNA, 25 bp, Mus musculus
tggtttcttcgacacatctggtaaa

SEQ ID NO: 896940 - DNA, 25 bp, Mus musculus
tggtttcttcgagacatctggtaaa

SEQ ID NO: 896941 - DNA, 25 bp, Mus musculus
tggtttcttcgtcgtttccccatca

SEQ ID NO: 896942 - DNA, 25 bp, Mus musculus
tggtttcttcgtggtttccccatca

SEQ ID NO: 896943 - DNA, 25 bp, Mus musculus
tggtttcttgaaatggtaaagtcac

SEQ ID NO: 896944 - DNA, 25 bp, Mus musculus
tggtttcttgaattggtaaagtcac

SEQ ID NO: 896945 - DNA, 25 bp, Mus musculus
tggtttcttgtcacacgctgtaaga

SEQ ID NO: 896946 - DNA, 25 bp, Mus musculus
tggtttcttgtctcacgctgtaaga

SEQ ID NO: 896947 - DNA, 25 bp, Mus musculus
tggtttctttcccagtacagcagcc

SEQ ID NO: 896948 - DNA, 25 bp, Mus musculus
tggtttctttccgagtacagcagcc

SEQ ID NO: 896949 - DNA, 25 bp, Mus musculus
tggtttgaacttatgtcatttttgt

SEQ ID NO: 896950 - DNA, 25 bp, Mus musculus
tggtttgaacttttgtcatttttgt

SEQ ID NO: 896951 - DNA, 25 bp, Mus musculus
tggtttgaagacctttcttttagtg

SEQ ID NO: 896952 - DNA, 25 bp, Mus musculus
tggtttgaagacgtttcttttagtg

SEQ ID NO: 896953 - DNA, 25 bp, Mus musculus
tggtttgaagctatttggcctcttc

SEQ ID NO: 896954 - DNA, 25 bp, Mus musculus
tggtttgaagctcgactttctttct

SEQ ID NO: 896955 - DNA, 25 bp, Mus musculus
tggtttgaagctggactttctttct

SEQ ID NO: 896956 - DNA, 25 bp, Mus musculus
tggtttgaagctttttggcctcttc

SEQ ID NO: 896957 - DNA, 25 bp, Mus musculus
tggtttgaagggattacctgttgag

SEQ ID NO: 896958 - DNA, 25 bp, Mus musculus
tggtttgaagggtttacctgttgag

SEQ ID NO: 896959 - DNA, 25 bp, Mus musculus
tggtttgaattcactcctcatcatg

SEQ ID NO: 896960 - DNA, 25 bp, Mus musculus
tggtttgaattctctcctcatcatg

SEQ ID NO: 896961 - DNA, 25 bp, Mus musculus
tggtttgacaaccttgctgacccca

SEQ ID NO: 896962 - DNA, 25 bp, Mus musculus
tggtttgacaacgttgctgacccca

SEQ ID NO: 896963 - DNA, 25 bp, Mus musculus
tggtttgacccaccgggcatatgca

SEQ ID NO: 896964 - DNA, 25 bp, Mus musculus
tggtttgacccactctgtatcccag

SEQ ID NO: 896965 - DNA, 25 bp, Mus musculus
tggtttgacccagcgggcatatgca

SEQ ID NO: 896966 - DNA, 25 bp, Mus musculus
tggtttgacccagtctgtatcccag

SEQ ID NO: 896967 - DNA, 25 bp, Mus musculus
tggtttgagaccacatggcattaca

SEQ ID NO: 896968 - DNA, 25 bp, Mus musculus
tggtttgagacctcatggcattaca

SEQ ID NO: 896969 - DNA, 25 bp, Mus musculus
tggtttgaggagagccaccggccat

SEQ ID NO: 896970 - DNA, 25 bp, Mus musculus
tggtttgaggagtgccaccggccat

SEQ ID NO: 896971 - DNA, 25 bp, Mus musculus
tggtttgataaacttcatgtgacaa

SEQ ID NO: 896972 - DNA, 25 bp, Mus musculus
tggtttgataaagttcatgtgacaa

SEQ ID NO: 896973 - DNA, 25 bp, Mus musculus
tggtttgatcccacagtctttatga

SEQ ID NO: 896974 - DNA, 25 bp, Mus musculus
tggtttgatccctcagtctttatga

SEQ ID NO: 896975 - DNA, 25 bp, Mus musculus
tggtttgatctgacccagtgtcaac

SEQ ID NO: 896976 - DNA, 25 bp, Mus musculus
tggtttgatctgtcccagtgtcaac

SEQ ID NO: 896977 - DNA, 25 bp, Mus musculus
tggtttgcaacgaccgtctcggaaa

SEQ ID NO: 896978 - DNA, 25 bp, Mus musculus
tggtttgcaacgtccgtctcggaaa

SEQ ID NO: 896979 - DNA, 25 bp, Mus musculus
tggtttgcacaaacatctgaaactt

SEQ ID NO: 896980 - DNA, 25 bp, Mus musculus
tggtttgcacaatcatctgaaactt

SEQ ID NO: 896981 - DNA, 25 bp, Mus musculus
tggtttgcacctcttttacggcctg

SEQ ID NO: 896982 - DNA, 25 bp, Mus musculus
tggtttgcacctgttttacggcctg

SEQ ID NO: 896983 - DNA, 25 bp, Mus musculus
tggtttgccagccataggcgctgaa

SEQ ID NO: 896984 - DNA, 25 bp, Mus musculus
tggtttgccagcgataggcgctgaa

SEQ ID NO: 896985 - DNA, 25 bp, Mus musculus
tggtttgccccaatttacattaatg

SEQ ID NO: 896986 - DNA, 25 bp, Mus musculus
tggtttgccccacatagtaggcggt

SEQ ID NO: 896987 - DNA, 25 bp, Mus musculus
tggtttgccccagatagtaggcggt

SEQ ID NO: 896988 - DNA, 25 bp, Mus musculus
tggtttgccccattttacattaatg

SEQ ID NO: 896989 - DNA, 25 bp, Mus musculus
tggtttgcccctattgggtgctgac

SEQ ID NO: 896990 - DNA, 25 bp, Mus musculus
tggtttgccccttttgggtgctgac

SEQ ID NO: 896991 - DNA, 25 bp, Mus musculus
tggtttgcccggaacttcacattct

SEQ ID NO: 896992 - DNA, 25 bp, Mus musculus
tggtttgcccggtacttcacattct

SEQ ID NO: 896993 - DNA, 25 bp, Mus musculus
tggtttgccctaacattgttggtgc

SEQ ID NO: 896994 - DNA, 25 bp, Mus musculus
tggtttgccctatcattgttggtgc

SEQ ID NO: 896995 - DNA, 25 bp, Mus musculus
tggtttgctcataagatctcattta

SEQ ID NO: 896996 - DNA, 25 bp, Mus musculus
tggtttgctcattagatctcattta

SEQ ID NO: 896997 - DNA, 25 bp, Mus musculus
tggtttgctccccaaggtttcttca

SEQ ID NO: 896998 - DNA, 25 bp, Mus musculus
tggtttgctcccgaaggtttcttca

SEQ ID NO: 896999 - DNA, 25 bp, Mus musculus
tggtttgctgctacgaaggccctgt

SEQ ID NO: 897000 - DNA, 25 bp, Mus musculus
tggtttgctgcttcgaaggccctgt

SEQ ID NO: 897001 - DNA, 25 bp, Mus musculus
tggtttgctggccatcagcctagct

SEQ ID NO: 897002 - DNA, 25 bp, Mus musculus
tggtttgctggcgatcagcctagct

SEQ ID NO: 897003 - DNA, 25 bp, Mus musculus
tggtttggaacaccatccgtcttct

SEQ ID NO: 897004 - DNA, 25 bp, Mus musculus
tggtttggaacagcatccgtcttct

SEQ ID NO: 897005 - DNA, 25 bp, Mus musculus
tggtttggaatcaagggacaatcct

SEQ ID NO: 897006 - DNA, 25 bp, Mus musculus
tggtttggaatctagggacaatcct

SEQ ID NO: 897007 - DNA, 25 bp, Mus musculus
tggtttggacacatggcttgacatt

SEQ ID NO: 897008 - DNA, 25 bp, Mus musculus
tggtttggacacttggcttgacatt

SEQ ID NO: 897009 - DNA, 25 bp, Mus musculus
tggtttggagtcactccattctcag

SEQ ID NO: 897010 - DNA, 25 bp, Mus musculus
tggtttggagtctctccattctcag

SEQ ID NO: 897011 - DNA, 25 bp, Mus musculus
tggtttggatcaaccacggcttctc

SEQ ID NO: 897012 - DNA, 25 bp, Mus musculus
tggtttggatcacccattttacccc

SEQ ID NO: 897013 - DNA, 25 bp, Mus musculus
tggtttggatcagccattttacccc

SEQ ID NO: 897014 - DNA, 25 bp, Mus musculus
tggtttggatcatccacggcttctc

SEQ ID NO: 897015 - DNA, 25 bp, Mus musculus
tggtttggatgcatctatattgccc

SEQ ID NO: 897016 - DNA, 25 bp, Mus musculus
tggtttggatgcttctatattgccc

SEQ ID NO: 897017 - DNA, 25 bp, Mus musculus
tggtttggcctcagagcattgtgga

SEQ ID NO: 897018 - DNA, 25 bp, Mus musculus
tggtttggcctctgagcattgtgga

SEQ ID NO: 897019 - DNA, 25 bp, Mus musculus
tggtttggctatactgtgtcttttt

SEQ ID NO: 897020 - DNA, 25 bp, Mus musculus
tggtttggctattctgtgtcttttt

SEQ ID NO: 897021 - DNA, 25 bp, Mus musculus
tggtttgggtagagcacacctgctt

SEQ ID NO: 897022 - DNA, 25 bp, Mus musculus
tggtttgggtagtgcacacctgctt

SEQ ID NO: 897023 - DNA, 25 bp, Mus musculus
tggtttggtctacacgaggagttcc

SEQ ID NO: 897024 - DNA, 25 bp, Mus musculus
tggtttggtctagacgaggagttcc

SEQ ID NO: 897025 - DNA, 25 bp, Mus musculus
tggtttggtgcccttttgcagaccc

SEQ ID NO: 897026 - DNA, 25 bp, Mus musculus
tggtttggtgccgttttgcagaccc

SEQ ID NO: 897027 - DNA, 25 bp, Mus musculus
tggtttggtgctccctaagtgatta

SEQ ID NO: 897028 - DNA, 25 bp, Mus musculus
tggtttggtgctgcctaagtgatta

SEQ ID NO: 897029 - DNA, 25 bp, Mus musculus
tggtttggtttacttcggcttgatt

SEQ ID NO: 897030 - DNA, 25 bp, Mus musculus
tggtttggtttagttcggcttgatt

SEQ ID NO: 897031 - DNA, 25 bp, Mus musculus
tggtttgtaaccatccagccggcag

SEQ ID NO: 897032 - DNA, 25 bp, Mus musculus
tggtttgtaaccttccagccggcag

SEQ ID NO: 897033 - DNA, 25 bp, Mus musculus
tggtttgtaactatccttgtactca

SEQ ID NO: 897034 - DNA, 25 bp, Mus musculus
tggtttgtaactttccttgtactca

SEQ ID NO: 897035 - DNA, 25 bp, Mus musculus
tggtttgtacatacaagtttgaggt

SEQ ID NO: 897036 - DNA, 25 bp, Mus musculus
tggtttgtacattcaagtttgaggt

SEQ ID NO: 897037 - DNA, 25 bp, Mus musculus
tggtttgtaccaattctttccttct

SEQ ID NO: 897038 - DNA, 25 bp, Mus musculus
tggtttgtaccatttctttccttct

SEQ ID NO: 897039 - DNA, 25 bp, Mus musculus
tggtttgtagctacctaacttcata

SEQ ID NO: 897040 - DNA, 25 bp, Mus musculus
tggtttgtagctattaccccagagt

SEQ ID NO: 897041 - DNA, 25 bp, Mus musculus
tggtttgtagcttcctaacttcata

SEQ ID NO: 897042 - DNA, 25 bp, Mus musculus
tggtttgtagcttttaccccagagt

SEQ ID NO: 897043 - DNA, 25 bp, Mus musculus
tggtttgtattgattctaatatatt

SEQ ID NO: 897044 - DNA, 25 bp, Mus musculus
tggtttgtattgtttctaatatatt

SEQ ID NO: 897045 - DNA, 25 bp, Mus musculus
tggtttgtcaaaaacacaacactca

SEQ ID NO: 897046 - DNA, 25 bp, Mus musculus
tggtttgtcaaatacacaacactca

SEQ ID NO: 897047 - DNA, 25 bp, Mus musculus
tggtttgtcaacattcagatctgaa

SEQ ID NO: 897048 - DNA, 25 bp, Mus musculus
tggtttgtcaactttcagatctgaa

SEQ ID NO: 897049 - DNA, 25 bp, Mus musculus
tggtttgtcaccattggttgaccaa

SEQ ID NO: 897050 - DNA, 25 bp, Mus musculus
tggtttgtcacctttggttgaccaa

SEQ ID NO: 897051 - DNA, 25 bp, Mus musculus
tggtttgtcaggaagacacttgata

SEQ ID NO: 897052 - DNA, 25 bp, Mus musculus
tggtttgtcaggtagacacttgata

SEQ ID NO: 897053 - DNA, 25 bp, Mus musculus
tggtttgtcccaactgtgcctcgat

SEQ ID NO: 897054 - DNA, 25 bp, Mus musculus
tggtttgtcccatctgtgcctcgat

SEQ ID NO: 897055 - DNA, 25 bp, Mus musculus
tggtttgtcgtccagaatctgcccc

SEQ ID NO: 897056 - DNA, 25 bp, Mus musculus
tggtttgtcgtcgagaatctgcccc

SEQ ID NO: 897057 - DNA, 25 bp, Mus musculus
tggtttgtcttcagacccaacagac

SEQ ID NO: 897058 - DNA, 25 bp, Mus musculus
tggtttgtcttctgacccaacagac

SEQ ID NO: 897059 - DNA, 25 bp, Mus musculus
tggtttgtgactctgcttgttgtat

SEQ ID NO: 897060 - DNA, 25 bp, Mus musculus
tggtttgtgactgtgcttgttgtat

SEQ ID NO: 897061 - DNA, 25 bp, Mus musculus
tggtttgtgtgaaccaagcctctac

SEQ ID NO: 897062 - DNA, 25 bp, Mus musculus
tggtttgtgtgatccaagcctctac

SEQ ID NO: 897063 - DNA, 25 bp, Mus musculus
tggtttgtgtgcaaggtgccttatt

SEQ ID NO: 897064 - DNA, 25 bp, Mus musculus
tggtttgtgtgctaggtgccttatt

SEQ ID NO: 897065 - DNA, 25 bp, Mus musculus
tggtttgttaaacgaagtgtgtcac

SEQ ID NO: 897066 - DNA, 25 bp, Mus musculus
tggtttgttaaaggaagtgtgtcac

SEQ ID NO: 897067 - DNA, 25 bp, Mus musculus
tggtttgtttaaaagcagccacatt

SEQ ID NO: 897068 - DNA, 25 bp, Mus musculus
tggtttgtttaatagcagccacatt

SEQ ID NO: 897069 - DNA, 25 bp, Mus musculus
tggtttgtttccagttaacctctgt

SEQ ID NO: 897070 - DNA, 25 bp, Mus musculus
tggtttgtttcctgttaacctctgt

SEQ ID NO: 897071 - DNA, 25 bp, Mus musculus
tggtttgtttctcctaggaaatgaa

SEQ ID NO: 897072 - DNA, 25 bp, Mus musculus
tggtttgtttctgctaggaaatgaa

SEQ ID NO: 897073 - DNA, 25 bp, Mus musculus
tggtttgtttgtaacactggcttcc

SEQ ID NO: 897074 - DNA, 25 bp, Mus musculus
tggtttgtttgttacactggcttcc

SEQ ID NO: 897075 - DNA, 25 bp, Mus musculus
tggttttaaaagcacaccttctaag

SEQ ID NO: 897076 - DNA, 25 bp, Mus musculus
tggttttaaaaggacaccttctaag

SEQ ID NO: 897077 - DNA, 25 bp, Mus musculus
tggttttaccagagtccatgccaaa

SEQ ID NO: 897078 - DNA, 25 bp, Mus musculus
tggttttaccagtgtccatgccaaa

SEQ ID NO: 897079 - DNA, 25 bp, Mus musculus
tggttttagcccataacacttggtg

SEQ ID NO: 897080 - DNA, 25 bp, Mus musculus
tggttttagcccttaacacttggtg

SEQ ID NO: 897081 - DNA, 25 bp, Mus musculus
tggttttatactacagccctgattc

SEQ ID NO: 897082 - DNA, 25 bp, Mus musculus
tggttttatacttcagccctgattc

SEQ ID NO: 897083 - DNA, 25 bp, Mus musculus
tggttttatgaaattacctctaggg

SEQ ID NO: 897084 - DNA, 25 bp, Mus musculus
tggttttatgaatttacctctaggg

SEQ ID NO: 897085 - DNA, 25 bp, Mus musculus
tggttttattatattctccttcaag

SEQ ID NO: 897086 - DNA, 25 bp, Mus musculus
tggttttattattttctccttcaag

SEQ ID NO: 897087 - DNA, 25 bp, Mus musculus
tggttttattcaacctacaggcctt

SEQ ID NO: 897088 - DNA, 25 bp, Mus musculus
tggttttattcatcctacaggcctt

SEQ ID NO: 897089 - DNA, 25 bp, Mus musculus
tggttttcaaagaatcctgcaagga

SEQ ID NO: 897090 - DNA, 25 bp, Mus musculus
tggttttcaaagtatcctgcaagga

SEQ ID NO: 897091 - DNA, 25 bp, Mus musculus
tggttttcacttactcggtggagac

SEQ ID NO: 897092 - DNA, 25 bp, Mus musculus
tggttttcactttctcggtggagac

SEQ ID NO: 897093 - DNA, 25 bp, Mus musculus
tggttttcagggattgggttctcaa

SEQ ID NO: 897094 - DNA, 25 bp, Mus musculus
tggttttcagggtttgggttctcaa

SEQ ID NO: 897095 - DNA, 25 bp, Mus musculus
tggttttcagttcctacctggaggt

SEQ ID NO: 897096 - DNA, 25 bp, Mus musculus
tggttttcagttgctacctggaggt

SEQ ID NO: 897097 - DNA, 25 bp, Mus musculus
tggttttcatttcacaccacagtac

SEQ ID NO: 897098 - DNA, 25 bp, Mus musculus
tggttttcatttgacaccacagtac

SEQ ID NO: 897099 - DNA, 25 bp, Mus musculus
tggttttccacccagccaaagagaa

SEQ ID NO: 897100 - DNA, 25 bp, Mus musculus
tggttttccaccgagccaaagagaa

SEQ ID NO: 897101 - DNA, 25 bp, Mus musculus
tggttttccagcattatctcacaaa

SEQ ID NO: 897102 - DNA, 25 bp, Mus musculus
tggttttccagctttatctcacaaa

SEQ ID NO: 897103 - DNA, 25 bp, Mus musculus
tggttttccatgcttcctaggaaga

SEQ ID NO: 897104 - DNA, 25 bp, Mus musculus
tggttttccatggttcctaggaaga

SEQ ID NO: 897105 - DNA, 25 bp, Mus musculus
tggttttccattatatccacaagaa

SEQ ID NO: 897106 - DNA, 25 bp, Mus musculus
tggttttccattccagagaactgga

SEQ ID NO: 897107 - DNA, 25 bp, Mus musculus
tggttttccattgcagagaactgga

SEQ ID NO: 897108 - DNA, 25 bp, Mus musculus
tggttttccattttatccacaagaa

SEQ ID NO: 897109 - DNA, 25 bp, Mus musculus
tggttttcccgcagaagtacttaga

SEQ ID NO: 897110 - DNA, 25 bp, Mus musculus
tggttttcccgctgaagtacttaga

SEQ ID NO: 897111 - DNA, 25 bp, Mus musculus
tggttttccgtgaggtctaaacaat

SEQ ID NO: 897112 - DNA, 25 bp, Mus musculus
tggttttccgtgtggtctaaacaat

SEQ ID NO: 897113 - DNA, 25 bp, Mus musculus
tggttttcctagataccaactgttg

SEQ ID NO: 897114 - DNA, 25 bp, Mus musculus
tggttttcctagctacttccacagg

SEQ ID NO: 897115 - DNA, 25 bp, Mus musculus
tggttttcctaggtacttccacagg

SEQ ID NO: 897116 - DNA, 25 bp, Mus musculus
tggttttcctagttaccaactgttg

SEQ ID NO: 897117 - DNA, 25 bp, Mus musculus
tggttttcctctcagatgcctaaaa

SEQ ID NO: 897118 - DNA, 25 bp, Mus musculus
tggttttcctctgagatgcctaaaa

SEQ ID NO: 897119 - DNA, 25 bp, Mus musculus
tggttttccttgattctacccagag

SEQ ID NO: 897120 - DNA, 25 bp, Mus musculus
tggttttccttgtttctacccagag

SEQ ID NO: 897121 - DNA, 25 bp, Mus musculus
tggttttctaatcgaagggccaaat

SEQ ID NO: 897122 - DNA, 25 bp, Mus musculus
tggttttctaatggaagggccaaat

SEQ ID NO: 897123 - DNA, 25 bp, Mus musculus
tggttttctatcactgtgtcacaat

SEQ ID NO: 897124 - DNA, 25 bp, Mus musculus
tggttttctatctctgtgtcacaat

SEQ ID NO: 897125 - DNA, 25 bp, Mus musculus
tggttttctattcctcattattatg

SEQ ID NO: 897126 - DNA, 25 bp, Mus musculus
tggttttctattgctcattattatg

SEQ ID NO: 897127 - DNA, 25 bp, Mus musculus
tggttttctcatattcatattcact

SEQ ID NO: 897128 - DNA, 25 bp, Mus musculus
tggttttctcattttcatattcact

SEQ ID NO: 897129 - DNA, 25 bp, Mus musculus
tggttttctctaacttacgctttaa

SEQ ID NO: 897130 - DNA, 25 bp, Mus musculus
tggttttctctatcttacgctttaa

SEQ ID NO: 897131 - DNA, 25 bp, Mus musculus
tggttttctgtgaacgccaccaaga

SEQ ID NO: 897132 - DNA, 25 bp, Mus musculus
tggttttctgtgatatctccgctga

SEQ ID NO: 897133 - DNA, 25 bp, Mus musculus
tggttttctgtgtacgccaccaaga

SEQ ID NO: 897134 - DNA, 25 bp, Mus musculus
tggttttctgtgttatctccgctga

SEQ ID NO: 897135 - DNA, 25 bp, Mus musculus
tggttttctgttcctgaggctttca

SEQ ID NO: 897136 - DNA, 25 bp, Mus musculus
tggttttctgttgctgaggctttca

SEQ ID NO: 897137 - DNA, 25 bp, Mus musculus
tggttttgaagcatccctatccaag

SEQ ID NO: 897138 - DNA, 25 bp, Mus musculus
tggttttgaagcttccctatccaag

SEQ ID NO: 897139 - DNA, 25 bp, Mus musculus
tggttttgacatcacccatttccaa

SEQ ID NO: 897140 - DNA, 25 bp, Mus musculus
tggttttgacatgacccatttccaa

SEQ ID NO: 897141 - DNA, 25 bp, Mus musculus
tggttttgaggacataacccaggtt

SEQ ID NO: 897142 - DNA, 25 bp, Mus musculus
tggttttgaggagataacccaggtt

SEQ ID NO: 897143 - DNA, 25 bp, Mus musculus
tggttttgattgactacgctcaggc

SEQ ID NO: 897144 - DNA, 25 bp, Mus musculus
tggttttgattgtctacgctcaggc

SEQ ID NO: 897145 - DNA, 25 bp, Mus musculus
tggttttggctgcacaaaggcgaga

SEQ ID NO: 897146 - DNA, 25 bp, Mus musculus
tggttttggctggacaaaggcgaga

SEQ ID NO: 897147 - DNA, 25 bp, Mus musculus
tggttttggtttcgctggatttcag

SEQ ID NO: 897148 - DNA, 25 bp, Mus musculus
tggttttggtttggctggatttcag

SEQ ID NO: 897149 - DNA, 25 bp, Mus musculus
tggttttgtaaacatcttgttccta

SEQ ID NO: 897150 - DNA, 25 bp, Mus musculus
tggttttgtaaagatcttgttccta

SEQ ID NO: 897151 - DNA, 25 bp, Mus musculus
tggttttgtacacacattgtttcca

SEQ ID NO: 897152 - DNA, 25 bp, Mus musculus
tggttttgtacagacattgtttcca

SEQ ID NO: 897153 - DNA, 25 bp, Mus musculus
tggttttgtagtacctcctttggtg

SEQ ID NO: 897154 - DNA, 25 bp, Mus musculus
tggttttgtagttcctcctttggtg

SEQ ID NO: 897155 - DNA, 25 bp, Mus musculus
tggttttgtcagcagtttggtctct

SEQ ID NO: 897156 - DNA, 25 bp, Mus musculus
tggttttgtcaggagtttggtctct

SEQ ID NO: 897157 - DNA, 25 bp, Mus musculus
tggtttttactcagcctatttggtt

SEQ ID NO: 897158 - DNA, 25 bp, Mus musculus
tggtttttactctgcctatttggtt

SEQ ID NO: 897159 - DNA, 25 bp, Mus musculus
tggtttttagctaattctcaggaga

SEQ ID NO: 897160 - DNA, 25 bp, Mus musculus
tggtttttagcttattctcaggaga

SEQ ID NO: 897161 - DNA, 25 bp, Mus musculus
tggtttttagtgattattcagaatt

SEQ ID NO: 897162 - DNA, 25 bp, Mus musculus
tggtttttagtgtttattcagaatt

SEQ ID NO: 897163 - DNA, 25 bp, Mus musculus
tggtttttatcacccacattcttct

SEQ ID NO: 897164 - DNA, 25 bp, Mus musculus
tggtttttatcagccacattcttct

SEQ ID NO: 897165 - DNA, 25 bp, Mus musculus
tggtttttcagaccctgccgtccaa

SEQ ID NO: 897166 - DNA, 25 bp, Mus musculus
tggtttttcagagcctgccgtccaa

SEQ ID NO: 897167 - DNA, 25 bp, Mus musculus
tggtttttcagtagtaaaatctaag

SEQ ID NO: 897168 - DNA, 25 bp, Mus musculus
tggtttttcagttgtaaaatctaag

SEQ ID NO: 897169 - DNA, 25 bp, Mus musculus
tggtttttgatcagtgtccaagtat

SEQ ID NO: 897170 - DNA, 25 bp, Mus musculus
tggtttttgatctgtgtccaagtat

SEQ ID NO: 897171 - DNA, 25 bp, Mus musculus
tggtttttggtcagatcctccagaa

SEQ ID NO: 897172 - DNA, 25 bp, Mus musculus
tggtttttggtctgatcctccagaa

SEQ ID NO: 897173 - DNA, 25 bp, Mus musculus
tggtttttggttaatggccgtgctg

SEQ ID NO: 897174 - DNA, 25 bp, Mus musculus
tggtttttggtttatggccgtgctg

SEQ ID NO: 897175 - DNA, 25 bp, Mus musculus
tggtttttgtccaagcactttgctc

SEQ ID NO: 897176 - DNA, 25 bp, Mus musculus
tggtttttgtcctagcactttgctc

SEQ ID NO: 897177 - DNA, 25 bp, Mus musculus
tggttttttaagcacgcatttctga

SEQ ID NO: 897178 - DNA, 25 bp, Mus musculus
tggttttttaaggacgcatttctga

SEQ ID NO: 897179 - DNA, 25 bp, Mus musculus
tggttttttaccaagtggcctctga

SEQ ID NO: 897180 - DNA, 25 bp, Mus musculus
tggttttttacctagtggcctctga

SEQ ID NO: 897181 - DNA, 25 bp, Mus musculus
tggttttttgtcatcctcctaagct

SEQ ID NO: 897182 - DNA, 25 bp, Mus musculus
tggttttttgtcttcctcctaagct

SEQ ID NO: 897183 - DNA, 25 bp, Mus musculus
tgtaaaaacaaaacccctgcaccag

SEQ ID NO: 897184 - DNA, 25 bp, Mus musculus
tgtaaaaacaaatcccctgcaccag

SEQ ID NO: 897185 - DNA, 25 bp, Mus musculus
tgtaaaaacattcaacttgtccagt

SEQ ID NO: 897186 - DNA, 25 bp, Mus musculus
tgtaaaaacattgaacttgtccagt

SEQ ID NO: 897187 - DNA, 25 bp, Mus musculus
tgtaaaaacctcaatttccggcata

SEQ ID NO: 897188 - DNA, 25 bp, Mus musculus
tgtaaaaacctctatttccggcata

SEQ ID NO: 897189 - DNA, 25 bp, Mus musculus
tgtaaaaagcccatgctgtctcagc

SEQ ID NO: 897190 - DNA, 25 bp, Mus musculus
tgtaaaaagcccttgctgtctcagc

SEQ ID NO: 897191 - DNA, 25 bp, Mus musculus
tgtaaaaaggcccaccaccatcttc

SEQ ID NO: 897192 - DNA, 25 bp, Mus musculus
tgtaaaaaggccgaccaccatcttc

SEQ ID NO: 897193 - DNA, 25 bp, Mus musculus
tgtaaaaatattcccgttctctttg

SEQ ID NO: 897194 - DNA, 25 bp, Mus musculus
tgtaaaaatattgccgttctctttg

SEQ ID NO: 897195 - DNA, 25 bp, Mus musculus
tgtaaaaattccatccatggttgtt

SEQ ID NO: 897196 - DNA, 25 bp, Mus musculus
tgtaaaaattccttccatggttgtt

SEQ ID NO: 897197 - DNA, 25 bp, Mus musculus
tgtaaaacagccatcttgccatcag

SEQ ID NO: 897198 - DNA, 25 bp, Mus musculus
tgtaaaacagccttcttgccatcag

SEQ ID NO: 897199 - DNA, 25 bp, Mus musculus
tgtaaaaccgttatggacatcaagt

SEQ ID NO: 897200 - DNA, 25 bp, Mus musculus
tgtaaaaccgttttggacatcaagt

SEQ ID NO: 897201 - DNA, 25 bp, Mus musculus
tgtaaaacctcacctccttaacatt

SEQ ID NO: 897202 - DNA, 25 bp, Mus musculus
tgtaaaacctcagctccttaacatt

SEQ ID NO: 897203 - DNA, 25 bp, Mus musculus
tgtaaaaccttacctcgctctgaaa

SEQ ID NO: 897204 - DNA, 25 bp, Mus musculus
tgtaaaaccttagctcgctctgaaa

SEQ ID NO: 897205 - DNA, 25 bp, Mus musculus
tgtaaaacctttccattgcttccca

SEQ ID NO: 897206 - DNA, 25 bp, Mus musculus
tgtaaaacctttgcattgcttccca

SEQ ID NO: 897207 - DNA, 25 bp, Mus musculus
tgtaaaacggatagctcgccaccga

SEQ ID NO: 897208 - DNA, 25 bp, Mus musculus
tgtaaaacggattgctcgccaccga

SEQ ID NO: 897209 - DNA, 25 bp, Mus musculus
tgtaaaactatgactgataccagaa

SEQ ID NO: 897210 - DNA, 25 bp, Mus musculus
tgtaaaactatgtctgataccagaa

SEQ ID NO: 897211 - DNA, 25 bp, Mus musculus
tgtaaaactcctactaacccaactg

SEQ ID NO: 897212 - DNA, 25 bp, Mus musculus
tgtaaaactccttctaacccaactg

SEQ ID NO: 897213 - DNA, 25 bp, Mus musculus
tgtaaaacttatatcccagtacctg

SEQ ID NO: 897214 - DNA, 25 bp, Mus musculus
tgtaaaacttatttcccagtacctg

SEQ ID NO: 897215 - DNA, 25 bp, Mus musculus
tgtaaaacttctaggccctctctta

SEQ ID NO: 897216 - DNA, 25 bp, Mus musculus
tgtaaaacttcttggccctctctta

SEQ ID NO: 897217 - DNA, 25 bp, Mus musculus
tgtaaaactttgacaggtgcccaat

SEQ ID NO: 897218 - DNA, 25 bp, Mus musculus
tgtaaaactttgtcaggtgcccaat

SEQ ID NO: 897219 - DNA, 25 bp, Mus musculus
tgtaaaagcttactgtactgctgaa

SEQ ID NO: 897220 - DNA, 25 bp, Mus musculus
tgtaaaagcttagtgtactgctgaa

SEQ ID NO: 897221 - DNA, 25 bp, Mus musculus
tgtaaaagtcagaccctcaacctag

SEQ ID NO: 897222 - DNA, 25 bp, Mus musculus
tgtaaaagtcagtccctcaacctag

SEQ ID NO: 897223 - DNA, 25 bp, Mus musculus
tgtaaaagtcccaatggcccagcac

SEQ ID NO: 897224 - DNA, 25 bp, Mus musculus
tgtaaaagtccctatggcccagcac

SEQ ID NO: 897225 - DNA, 25 bp, Mus musculus
tgtaaaatcagcaagcttcccgctt

SEQ ID NO: 897226 - DNA, 25 bp, Mus musculus
tgtaaaatcagctagcttcccgctt

SEQ ID NO: 897227 - DNA, 25 bp, Mus musculus
tgtaaaatccaacaccaacagtatt

SEQ ID NO: 897228 - DNA, 25 bp, Mus musculus
tgtaaaatccaagaccaacagtatt

SEQ ID NO: 897229 - DNA, 25 bp, Mus musculus
tgtaaaatccacatgtctcacctgc

SEQ ID NO: 897230 - DNA, 25 bp, Mus musculus
tgtaaaatccacttgtctcacctgc

SEQ ID NO: 897231 - DNA, 25 bp, Mus musculus
tgtaaaatgggtccaccttcctagc

SEQ ID NO: 897232 - DNA, 25 bp, Mus musculus
tgtaaaatgggtgcaccttcctagc

SEQ ID NO: 897233 - DNA, 25 bp, Mus musculus
tgtaaaatgtttatagacccaaagg

SEQ ID NO: 897234 - DNA, 25 bp, Mus musculus
tgtaaaatgtttttagacccaaagg

SEQ ID NO: 897235 - DNA, 25 bp, Mus musculus
tgtaaacaacttcctttctgtgtat

SEQ ID NO: 897236 - DNA, 25 bp, Mus musculus
tgtaaacaacttgctttctgtgtat

SEQ ID NO: 897237 - DNA, 25 bp, Mus musculus
tgtaaacacccgacatgcaggacac

SEQ ID NO: 897238 - DNA, 25 bp, Mus musculus
tgtaaacacccgtcatgcaggacac

SEQ ID NO: 897239 - DNA, 25 bp, Mus musculus
tgtaaacagaagaaaccgggcattt

SEQ ID NO: 897240 - DNA, 25 bp, Mus musculus
tgtaaacagaagtaaccgggcattt

SEQ ID NO: 897241 - DNA, 25 bp, Mus musculus
tgtaaacagggcctcttatttttat

SEQ ID NO: 897242 - DNA, 25 bp, Mus musculus
tgtaaacagggcgtcttatttttat

SEQ ID NO: 897243 - DNA, 25 bp, Mus musculus
tgtaaacagtgtctttctaaaatcc

SEQ ID NO: 897244 - DNA, 25 bp, Mus musculus
tgtaaacagtgtgtttctaaaatcc

SEQ ID NO: 897245 - DNA, 25 bp, Mus musculus
tgtaaacagttcatgctttccttcc

SEQ ID NO: 897246 - DNA, 25 bp, Mus musculus
tgtaaacagttcttgctttccttcc

SEQ ID NO: 897247 - DNA, 25 bp, Mus musculus
tgtaaacattggaatcggaataaat

SEQ ID NO: 897248 - DNA, 25 bp, Mus musculus
tgtaaacattggtatcggaataaat

SEQ ID NO: 897249 - DNA, 25 bp, Mus musculus
tgtaaaccagaacatgtcacacctt

SEQ ID NO: 897250 - DNA, 25 bp, Mus musculus
tgtaaaccagaagatgtcacacctt

SEQ ID NO: 897251 - DNA, 25 bp, Mus musculus
tgtaaaccagtcactgtgtcaggaa

SEQ ID NO: 897252 - DNA, 25 bp, Mus musculus
tgtaaaccagtctctgtgtcaggaa

SEQ ID NO: 897253 - DNA, 25 bp, Mus musculus
tgtaaaccatgcaagcttccttttg

SEQ ID NO: 897254 - DNA, 25 bp, Mus musculus
tgtaaaccatgctagcttccttttg

SEQ ID NO: 897255 - DNA, 25 bp, Mus musculus
tgtaaacccaggacattttcctcct

SEQ ID NO: 897256 - DNA, 25 bp, Mus musculus
tgtaaacccaggtcattttcctcct

SEQ ID NO: 897257 - DNA, 25 bp, Mus musculus
tgtaaacccatacctatgaagtgat

SEQ ID NO: 897258 - DNA, 25 bp, Mus musculus
tgtaaacccatagctatgaagtgat

SEQ ID NO: 897259 - DNA, 25 bp, Mus musculus
tgtaaaccccaaactgcaagctaaa

SEQ ID NO: 897260 - DNA, 25 bp, Mus musculus
tgtaaaccccaatctgcaagctaaa

SEQ ID NO: 897261 - DNA, 25 bp, Mus musculus
tgtaaacccttgatgctcggcctta

SEQ ID NO: 897262 - DNA, 25 bp, Mus musculus
tgtaaacccttgttgctcggcctta

SEQ ID NO: 897263 - DNA, 25 bp, Mus musculus
tgtaaaccctttcaagactgccttg

SEQ ID NO: 897264 - DNA, 25 bp, Mus musculus
tgtaaaccctttgaagactgccttg

SEQ ID NO: 897265 - DNA, 25 bp, Mus musculus
tgtaaaccgggaacattcagtttct

SEQ ID NO: 897266 - DNA, 25 bp, Mus musculus
tgtaaaccgggatcattcagtttct

SEQ ID NO: 897267 - DNA, 25 bp, Mus musculus
tgtaaacctatcatgcctattgtgt

SEQ ID NO: 897268 - DNA, 25 bp, Mus musculus
tgtaaacctatcttgcctattgtgt

SEQ ID NO: 897269 - DNA, 25 bp, Mus musculus
tgtaaacctcaacaaacgtgcctga

SEQ ID NO: 897270 - DNA, 25 bp, Mus musculus
tgtaaacctcaagaaacgtgcctga

SEQ ID NO: 897271 - DNA, 25 bp, Mus musculus
tgtaaacctcatatcatctcataag

SEQ ID NO: 897272 - DNA, 25 bp, Mus musculus
tgtaaacctcatttcatctcataag

SEQ ID NO: 897273 - DNA, 25 bp, Mus musculus
tgtaaacctcttaggcaatgctgcc

SEQ ID NO: 897274 - DNA, 25 bp, Mus musculus
tgtaaacctctttggcaatgctgcc

SEQ ID NO: 897275 - DNA, 25 bp, Mus musculus
tgtaaaccttacaggcaggtgccac

SEQ ID NO: 897276 - DNA, 25 bp, Mus musculus
tgtaaaccttactggcaggtgccac

SEQ ID NO: 897277 - DNA, 25 bp, Mus musculus
tgtaaacgtgagcttttctacccag

SEQ ID NO: 897278 - DNA, 25 bp, Mus musculus
tgtaaacgtgaggttttctacccag

SEQ ID NO: 897279 - DNA, 25 bp, Mus musculus
tgtaaacgtgcaacacactcgtgcg

SEQ ID NO: 897280 - DNA, 25 bp, Mus musculus
tgtaaacgtgcatcacactcgtgcg

SEQ ID NO: 897281 - DNA, 25 bp, Mus musculus
tgtaaactaagtcccgtttcaacgt

SEQ ID NO: 897282 - DNA, 25 bp, Mus musculus
tgtaaactaagtgccgtttcaacgt

SEQ ID NO: 897283 - DNA, 25 bp, Mus musculus
tgtaaactcacaaaacgggcaagga

SEQ ID NO: 897284 - DNA, 25 bp, Mus musculus
tgtaaactcacataacgggcaagga

SEQ ID NO: 897285 - DNA, 25 bp, Mus musculus
tgtaaactcactctaggtcctttgc

SEQ ID NO: 897286 - DNA, 25 bp, Mus musculus
tgtaaactcactgtaggtcctttgc

SEQ ID NO: 897287 - DNA, 25 bp, Mus musculus
tgtaaactccaacggcagcagacat

SEQ ID NO: 897288 - DNA, 25 bp, Mus musculus
tgtaaactccaagggcagcagacat

SEQ ID NO: 897289 - DNA, 25 bp, Mus musculus
tgtaaactctgtcttgttgcccact

SEQ ID NO: 897290 - DNA, 25 bp, Mus musculus
tgtaaactctgtgttgttgcccact

SEQ ID NO: 897291 - DNA, 25 bp, Mus musculus
tgtaaactgaagagtggtccccttt

SEQ ID NO: 897292 - DNA, 25 bp, Mus musculus
tgtaaactgaagtgtggtccccttt

SEQ ID NO: 897293 - DNA, 25 bp, Mus musculus
tgtaaactgctaaccataccagatg

SEQ ID NO: 897294 - DNA, 25 bp, Mus musculus
tgtaaactgctatccataccagatg

SEQ ID NO: 897295 - DNA, 25 bp, Mus musculus
tgtaaactggccattcgtgaatcta

SEQ ID NO: 897296 - DNA, 25 bp, Mus musculus
tgtaaactggcctttcgtgaatcta

SEQ ID NO: 897297 - DNA, 25 bp, Mus musculus
tgtaaactgttgaacccggaatcca

SEQ ID NO: 897298 - DNA, 25 bp, Mus musculus
tgtaaactgttgtacccggaatcca

SEQ ID NO: 897299 - DNA, 25 bp, Mus musculus
tgtaaagaaccaatatgcatctcga

SEQ ID NO: 897300 - DNA, 25 bp, Mus musculus
tgtaaagaaccattatgcatctcga

SEQ ID NO: 897301 - DNA, 25 bp, Mus musculus
tgtaaagaagaacggccgcctggat

SEQ ID NO: 897302 - DNA, 25 bp, Mus musculus
tgtaaagaagaagggccgcctggat

SEQ ID NO: 897303 - DNA, 25 bp, Mus musculus
tgtaaagaagctatcggccgggcgt

SEQ ID NO: 897304 - DNA, 25 bp, Mus musculus
tgtaaagaagctttcggccgggcgt

SEQ ID NO: 897305 - DNA, 25 bp, Mus musculus
tgtaaagacatcatctcctgcctga

SEQ ID NO: 897306 - DNA, 25 bp, Mus musculus
tgtaaagacatcttctcctgcctga

SEQ ID NO: 897307 - DNA, 25 bp, Mus musculus
tgtaaagagatacccacatcaactt

SEQ ID NO: 897308 - DNA, 25 bp, Mus musculus
tgtaaagagatagccacatcaactt

SEQ ID NO: 897309 - DNA, 25 bp, Mus musculus
tgtaaagattctctgagtttctggg

SEQ ID NO: 897310 - DNA, 25 bp, Mus musculus
tgtaaagattctgtgagtttctggg

SEQ ID NO: 897311 - DNA, 25 bp, Mus musculus
tgtaaagcaagcaacttccctctac

SEQ ID NO: 897312 - DNA, 25 bp, Mus musculus
tgtaaagcaagctacttccctctac

SEQ ID NO: 897313 - DNA, 25 bp, Mus musculus
tgtaaagcagcacccaatattcaag

SEQ ID NO: 897314 - DNA, 25 bp, Mus musculus
tgtaaagcagcagccaatattcaag

SEQ ID NO: 897315 - DNA, 25 bp, Mus musculus
tgtaaagccccaacctgactcaagc

SEQ ID NO: 897316 - DNA, 25 bp, Mus musculus
tgtaaagccccatcctgactcaagc

SEQ ID NO: 897317 - DNA, 25 bp, Mus musculus
tgtaaagcggacctcttcttgtcgc

SEQ ID NO: 897318 - DNA, 25 bp, Mus musculus
tgtaaagcggacgtcttcttgtcgc

SEQ ID NO: 897319 - DNA, 25 bp, Mus musculus
tgtaaagctaaacctcagtctctgg

SEQ ID NO: 897320 - DNA, 25 bp, Mus musculus
tgtaaagctaaagctcagtctctgg

SEQ ID NO: 897321 - DNA, 25 bp, Mus musculus
tgtaaagctataatagccataccta

SEQ ID NO: 897322 - DNA, 25 bp, Mus musculus
tgtaaagctatattagccataccta

SEQ ID NO: 897323 - DNA, 25 bp, Mus musculus
tgtaaagctgctacccaattggctt

SEQ ID NO: 897324 - DNA, 25 bp, Mus musculus
tgtaaagctgcttcccaattggctt

SEQ ID NO: 897325 - DNA, 25 bp, Mus musculus
tgtaaagctgggaggtcacggcctc

SEQ ID NO: 897326 - DNA, 25 bp, Mus musculus
tgtaaagctgggtggtcacggcctc

SEQ ID NO: 897327 - DNA, 25 bp, Mus musculus
tgtaaagcttggaacctggcacgca

SEQ ID NO: 897328 - DNA, 25 bp, Mus musculus
tgtaaagcttggtacctggcacgca

SEQ ID NO: 897329 - DNA, 25 bp, Mus musculus
tgtaaaggaggtcgcaccagaagcc

SEQ ID NO: 897330 - DNA, 25 bp, Mus musculus
tgtaaaggaggtggcaccagaagcc

SEQ ID NO: 897331 - DNA, 25 bp, Mus musculus
tgtaaaggatttatcccaccaccag

SEQ ID NO: 897332 - DNA, 25 bp, Mus musculus
tgtaaaggatttttcccaccaccag

SEQ ID NO: 897333 - DNA, 25 bp, Mus musculus
tgtaaaggctcacaggtcctcttcc

SEQ ID NO: 897334 - DNA, 25 bp, Mus musculus
tgtaaaggctcagaggtcctcttcc

SEQ ID NO: 897335 - DNA, 25 bp, Mus musculus
tgtaaagggcacatcccactttcca

SEQ ID NO: 897336 - DNA, 25 bp, Mus musculus
tgtaaagggcacttcccactttcca

SEQ ID NO: 897337 - DNA, 25 bp, Mus musculus
tgtaaagtcactagcttattccctt

SEQ ID NO: 897338 - DNA, 25 bp, Mus musculus
tgtaaagtcacttgcttattccctt

SEQ ID NO: 897339 - DNA, 25 bp, Mus musculus
tgtaaagtcatgaaaggccagcaac

SEQ ID NO: 897340 - DNA, 25 bp, Mus musculus
tgtaaagtcatgtaaggccagcaac

SEQ ID NO: 897341 - DNA, 25 bp, Mus musculus
tgtaaagtccacacattcttttccc

SEQ ID NO: 897342 - DNA, 25 bp, Mus musculus
tgtaaagtccactcattcttttccc

SEQ ID NO: 897343 - DNA, 25 bp, Mus musculus
tgtaaagtccttaaccacgtctcac

SEQ ID NO: 897344 - DNA, 25 bp, Mus musculus
tgtaaagtcctttaccacgtctcac

SEQ ID NO: 897345 - DNA, 25 bp, Mus musculus
tgtaaagtgatgcttgatgacccac

SEQ ID NO: 897346 - DNA, 25 bp, Mus musculus
tgtaaagtgatggttgatgacccac

SEQ ID NO: 897347 - DNA, 25 bp, Mus musculus
tgtaaagtgcagagtcttgggttag

SEQ ID NO: 897348 - DNA, 25 bp, Mus musculus
tgtaaagtgcagtgtcttgggttag

SEQ ID NO: 897349 - DNA, 25 bp, Mus musculus
tgtaaagtttttacccatagtggct

SEQ ID NO: 897350 - DNA, 25 bp, Mus musculus
tgtaaagttttttcccatagtggct

SEQ ID NO: 897351 - DNA, 25 bp, Mus musculus
tgtaaataaacgatgcccctggcag

SEQ ID NO: 897352 - DNA, 25 bp, Mus musculus
tgtaaataaacgttgcccctggcag

SEQ ID NO: 897353 - DNA, 25 bp, Mus musculus
tgtaaataacacatccccagaccta

SEQ ID NO: 897354 - DNA, 25 bp, Mus musculus
tgtaaataacacttccccagaccta

SEQ ID NO: 897355 - DNA, 25 bp, Mus musculus
tgtaaataatctctcttagctgtga

SEQ ID NO: 897356 - DNA, 25 bp, Mus musculus
tgtaaataatctgtcttagctgtga

SEQ ID NO: 897357 - DNA, 25 bp, Mus musculus
tgtaaatacaccaacaaactcctgt

SEQ ID NO: 897358 - DNA, 25 bp, Mus musculus
tgtaaatacacctacaaactcctgt

SEQ ID NO: 897359 - DNA, 25 bp, Mus musculus
tgtaaatacctcagtgtgcacaccc

SEQ ID NO: 897360 - DNA, 25 bp, Mus musculus
tgtaaatacctctgtgtgcacaccc

SEQ ID NO: 897361 - DNA, 25 bp, Mus musculus
tgtaaatactagacttttttggaag

SEQ ID NO: 897362 - DNA, 25 bp, Mus musculus
tgtaaatactagtcttttttggaag

SEQ ID NO: 897363 - DNA, 25 bp, Mus musculus
tgtaaatactgcactggtgtctcca

SEQ ID NO: 897364 - DNA, 25 bp, Mus musculus
tgtaaatactgctctggtgtctcca

SEQ ID NO: 897365 - DNA, 25 bp, Mus musculus
tgtaaatactggaggagctttgacc

SEQ ID NO: 897366 - DNA, 25 bp, Mus musculus
tgtaaatactggtggagctttgacc

SEQ ID NO: 897367 - DNA, 25 bp, Mus musculus
tgtaaatactttccactgagccagg

SEQ ID NO: 897368 - DNA, 25 bp, Mus musculus
tgtaaatactttgcactgagccagg

SEQ ID NO: 897369 - DNA, 25 bp, Mus musculus
tgtaaatagaagcaacaactgctgc

SEQ ID NO: 897370 - DNA, 25 bp, Mus musculus
tgtaaatagaaggaacaactgctgc

SEQ ID NO: 897371 - DNA, 25 bp, Mus musculus
tgtaaatagcccatcacccatattc

SEQ ID NO: 897372 - DNA, 25 bp, Mus musculus
tgtaaatagcccttcacccatattc

SEQ ID NO: 897373 - DNA, 25 bp, Mus musculus
tgtaaataggaccagctcttcgaac

SEQ ID NO: 897374 - DNA, 25 bp, Mus musculus
tgtaaataggacgagctcttcgaac

SEQ ID NO: 897375 - DNA, 25 bp, Mus musculus
tgtaaataggatattctagactcgg

SEQ ID NO: 897376 - DNA, 25 bp, Mus musculus
tgtaaataggattttctagactcgg

SEQ ID NO: 897377 - DNA, 25 bp, Mus musculus
tgtaaatagttcaccactgtgcccc

SEQ ID NO: 897378 - DNA, 25 bp, Mus musculus
tgtaaatagttctccactgtgcccc

SEQ ID NO: 897379 - DNA, 25 bp, Mus musculus
tgtaaatatcccaacgcaggctgcc

SEQ ID NO: 897380 - DNA, 25 bp, Mus musculus
tgtaaatatccctacgcaggctgcc

SEQ ID NO: 897381 - DNA, 25 bp, Mus musculus
tgtaaatatgtcatctacctccggg

SEQ ID NO: 897382 - DNA, 25 bp, Mus musculus
tgtaaatatgtcttctacctccggg

SEQ ID NO: 897383 - DNA, 25 bp, Mus musculus
tgtaaatattgactgtacctccaca

SEQ ID NO: 897384 - DNA, 25 bp, Mus musculus
tgtaaatattgagtgtacctccaca

SEQ ID NO: 897385 - DNA, 25 bp, Mus musculus
tgtaaatatttcaattgggcccacc

SEQ ID NO: 897386 - DNA, 25 bp, Mus musculus
tgtaaatatttctattgggcccacc

SEQ ID NO: 897387 - DNA, 25 bp, Mus musculus
tgtaaatcagttctgcgccctgcag

SEQ ID NO: 897388 - DNA, 25 bp, Mus musculus
tgtaaatcagttgtgcgccctgcag

SEQ ID NO: 897389 - DNA, 25 bp, Mus musculus
tgtaaatcggtcaaatttcaaccta

SEQ ID NO: 897390 - DNA, 25 bp, Mus musculus
tgtaaatcggtctaatttcaaccta

SEQ ID NO: 897391 - DNA, 25 bp, Mus musculus
tgtaaatctattccccagtcataac

SEQ ID NO: 897392 - DNA, 25 bp, Mus musculus
tgtaaatctattgcccagtcataac

SEQ ID NO: 897393 - DNA, 25 bp, Mus musculus
tgtaaatgacaacttttcattccat

SEQ ID NO: 897394 - DNA, 25 bp, Mus musculus
tgtaaatgacaagttttcattccat

SEQ ID NO: 897395 - DNA, 25 bp, Mus musculus
tgtaaatgcacaactgccatctcca

SEQ ID NO: 897396 - DNA, 25 bp, Mus musculus
tgtaaatgcacatctgccatctcca

SEQ ID NO: 897397 - DNA, 25 bp, Mus musculus
tgtaaatgccacatcagttgccctc

SEQ ID NO: 897398 - DNA, 25 bp, Mus musculus
tgtaaatgccacttcagttgccctc

SEQ ID NO: 897399 - DNA, 25 bp, Mus musculus
tgtaaatgcccgatatcccaaaagc

SEQ ID NO: 897400 - DNA, 25 bp, Mus musculus
tgtaaatgcccgttatcccaaaagc

SEQ ID NO: 897401 - DNA, 25 bp, Mus musculus
tgtaaatgcctaagccatcaacgtg

SEQ ID NO: 897402 - DNA, 25 bp, Mus musculus
tgtaaatgcctatgccatcaacgtg

SEQ ID NO: 897403 - DNA, 25 bp, Mus musculus
tgtaaatgctaactctacctcctac

SEQ ID NO: 897404 - DNA, 25 bp, Mus musculus
tgtaaatgctaagtctacctcctac

SEQ ID NO: 897405 - DNA, 25 bp, Mus musculus
tgtaaatggcatagcttagcaaatc

SEQ ID NO: 897406 - DNA, 25 bp, Mus musculus
tgtaaatggcattgcttagcaaatc

SEQ ID NO: 897407 - DNA, 25 bp, Mus musculus
tgtaaatggcttagtaagcattcct

SEQ ID NO: 897408 - DNA, 25 bp, Mus musculus
tgtaaatggctttgtaagcattcct

SEQ ID NO: 897409 - DNA, 25 bp, Mus musculus
tgtaaatgttacctatgccccagca

SEQ ID NO: 897410 - DNA, 25 bp, Mus musculus
tgtaaatgttacgtatgccccagca

SEQ ID NO: 897411 - DNA, 25 bp, Mus musculus
tgtaaatgttccattttccatgtaa

SEQ ID NO: 897412 - DNA, 25 bp, Mus musculus
tgtaaatgttcccctaacttctgtt

SEQ ID NO: 897413 - DNA, 25 bp, Mus musculus
tgtaaatgttccgctaacttctgtt

SEQ ID NO: 897414 - DNA, 25 bp, Mus musculus
tgtaaatgttcctttttccatgtaa

SEQ ID NO: 897415 - DNA, 25 bp, Mus musculus
tgtaaattaagtaatatgctgttcc

SEQ ID NO: 897416 - DNA, 25 bp, Mus musculus
tgtaaattaagttatatgctgttcc

SEQ ID NO: 897417 - DNA, 25 bp, Mus musculus
tgtaaattatcaaacctccatggtg

SEQ ID NO: 897418 - DNA, 25 bp, Mus musculus
tgtaaattatcatacctccatggtg

SEQ ID NO: 897419 - DNA, 25 bp, Mus musculus
tgtaaattcaacaaccttggtggga

SEQ ID NO: 897420 - DNA, 25 bp, Mus musculus
tgtaaattcaactaccttggtggga

SEQ ID NO: 897421 - DNA, 25 bp, Mus musculus
tgtaaattctcaacagctgttgtag

SEQ ID NO: 897422 - DNA, 25 bp, Mus musculus
tgtaaattctcactccagctatgga

SEQ ID NO: 897423 - DNA, 25 bp, Mus musculus
tgtaaattctcagtccagctatgga

SEQ ID NO: 897424 - DNA, 25 bp, Mus musculus
tgtaaattctcatcagctgttgtag

SEQ ID NO: 897425 - DNA, 25 bp, Mus musculus
tgtaaattgcagagagccctctcct

SEQ ID NO: 897426 - DNA, 25 bp, Mus musculus
tgtaaattgcagtgagccctctcct

SEQ ID NO: 897427 - DNA, 25 bp, Mus musculus
tgtaaatttgctaagccaccccatg

SEQ ID NO: 897428 - DNA, 25 bp, Mus musculus
tgtaaatttgcttagccaccccatg

SEQ ID NO: 897429 - DNA, 25 bp, Mus musculus
tgtaacaaaatacccgagcctgcga

SEQ ID NO: 897430 - DNA, 25 bp, Mus musculus
tgtaacaaaatagccgagcctgcga

SEQ ID NO: 897431 - DNA, 25 bp, Mus musculus
tgtaacaaacgtcctccaggagacc

SEQ ID NO: 897432 - DNA, 25 bp, Mus musculus
tgtaacaaacgtgctccaggagacc

SEQ ID NO: 897433 - DNA, 25 bp, Mus musculus
tgtaacaaccacacttttaagcaaa

SEQ ID NO: 897434 - DNA, 25 bp, Mus musculus
tgtaacaaccactcttttaagcaaa

SEQ ID NO: 897435 - DNA, 25 bp, Mus musculus
tgtaacaacgatcacaactgcatgt

SEQ ID NO: 897436 - DNA, 25 bp, Mus musculus
tgtaacaacgatgacaactgcatgt

SEQ ID NO: 897437 - DNA, 25 bp, Mus musculus
tgtaacaatcacaatttcccttctc

SEQ ID NO: 897438 - DNA, 25 bp, Mus musculus
tgtaacaatcactatttcccttctc

SEQ ID NO: 897439 - DNA, 25 bp, Mus musculus
tgtaacaattggcttttttcatggg

SEQ ID NO: 897440 - DNA, 25 bp, Mus musculus
tgtaacaattgggttttttcatggg

SEQ ID NO: 897441 - DNA, 25 bp, Mus musculus
tgtaacaattttctcacccccagag

SEQ ID NO: 897442 - DNA, 25 bp, Mus musculus
tgtaacaattttgtcacccccagag

SEQ ID NO: 897443 - DNA, 25 bp, Mus musculus
tgtaacaccaaacgcgacctggcga

SEQ ID NO: 897444 - DNA, 25 bp, Mus musculus
tgtaacaccaaaggcgacctggcga

SEQ ID NO: 897445 - DNA, 25 bp, Mus musculus
tgtaacaccagaactcccaggcaga

SEQ ID NO: 897446 - DNA, 25 bp, Mus musculus
tgtaacaccagatctcccaggcaga

SEQ ID NO: 897447 - DNA, 25 bp, Mus musculus
tgtaacaccagtcaaggtggccgct

SEQ ID NO: 897448 - DNA, 25 bp, Mus musculus
tgtaacaccagtgaaggtggccgct

SEQ ID NO: 897449 - DNA, 25 bp, Mus musculus
tgtaacacctcaattttcacttctg

SEQ ID NO: 897450 - DNA, 25 bp, Mus musculus
tgtaacacctcatttttcacttctg

SEQ ID NO: 897451 - DNA, 25 bp, Mus musculus
tgtaacagacaaaggtcccctccaa

SEQ ID NO: 897452 - DNA, 25 bp, Mus musculus
tgtaacagacaatggtcccctccaa

SEQ ID NO: 897453 - DNA, 25 bp, Mus musculus
tgtaacagcacaagcttttcttctt

SEQ ID NO: 897454 - DNA, 25 bp, Mus musculus
tgtaacagcacatgcttttcttctt

SEQ ID NO: 897455 - DNA, 25 bp, Mus musculus
tgtaacagcctgcagcaagcccaag

SEQ ID NO: 897456 - DNA, 25 bp, Mus musculus
tgtaacagcctggagcaagcccaag

SEQ ID NO: 897457 - DNA, 25 bp, Mus musculus
tgtaacagctgtatgccgagtggag

SEQ ID NO: 897458 - DNA, 25 bp, Mus musculus
tgtaacagctgtttgccgagtggag

SEQ ID NO: 897459 - DNA, 25 bp, Mus musculus
tgtaacagtctgaccagtgtcctgg

SEQ ID NO: 897460 - DNA, 25 bp, Mus musculus
tgtaacagtctgtccagtgtcctgg

SEQ ID NO: 897461 - DNA, 25 bp, Mus musculus
tgtaacagtgccaacccccatttac

SEQ ID NO: 897462 - DNA, 25 bp, Mus musculus
tgtaacagtgcctacccccatttac

SEQ ID NO: 897463 - DNA, 25 bp, Mus musculus
tgtaacagttacaggccatcagagg

SEQ ID NO: 897464 - DNA, 25 bp, Mus musculus
tgtaacagttactggccatcagagg

SEQ ID NO: 897465 - DNA, 25 bp, Mus musculus
tgtaacatacaactctttacaacgg

SEQ ID NO: 897466 - DNA, 25 bp, Mus musculus
tgtaacatacaagtctttacaacgg

SEQ ID NO: 897467 - DNA, 25 bp, Mus musculus
tgtaacatcacacctccaaatgcaa

SEQ ID NO: 897468 - DNA, 25 bp, Mus musculus
tgtaacatcacagctccaaatgcaa

SEQ ID NO: 897469 - DNA, 25 bp, Mus musculus
tgtaacatctctcatgctcagactt

SEQ ID NO: 897470 - DNA, 25 bp, Mus musculus
tgtaacatctctgatgctcagactt

SEQ ID NO: 897471 - DNA, 25 bp, Mus musculus
tgtaacatgtgaccttccatcttgt

SEQ ID NO: 897472 - DNA, 25 bp, Mus musculus
tgtaacatgtgagcttccatcttgt

SEQ ID NO: 897473 - DNA, 25 bp, Mus musculus
tgtaacattaacatgcacagcagaa

SEQ ID NO: 897474 - DNA, 25 bp, Mus musculus
tgtaacattaacttgcacagcagaa

SEQ ID NO: 897475 - DNA, 25 bp, Mus musculus
tgtaacattaccagctttatttttg

SEQ ID NO: 897476 - DNA, 25 bp, Mus musculus
tgtaacattacctgctttatttttg

SEQ ID NO: 897477 - DNA, 25 bp, Mus musculus
tgtaacattatcacctctaagcttt

SEQ ID NO: 897478 - DNA, 25 bp, Mus musculus
tgtaacattatccaggtcaagctaa

SEQ ID NO: 897479 - DNA, 25 bp, Mus musculus
tgtaacattatcgaggtcaagctaa

SEQ ID NO: 897480 - DNA, 25 bp, Mus musculus
tgtaacattatctcctctaagcttt

SEQ ID NO: 897481 - DNA, 25 bp, Mus musculus
tgtaaccaccataaataccctgcac

SEQ ID NO: 897482 - DNA, 25 bp, Mus musculus
tgtaaccaccattaataccctgcac

SEQ ID NO: 897483 - DNA, 25 bp, Mus musculus
tgtaaccacctccatgacctaaaat

SEQ ID NO: 897484 - DNA, 25 bp, Mus musculus
tgtaaccacctcgatgacctaaaat

SEQ ID NO: 897485 - DNA, 25 bp, Mus musculus
tgtaaccacggcaaaacagaagagt

SEQ ID NO: 897486 - DNA, 25 bp, Mus musculus
tgtaaccacggctaaacagaagagt

SEQ ID NO: 897487 - DNA, 25 bp, Mus musculus
tgtaaccactggcacctttccactt

SEQ ID NO: 897488 - DNA, 25 bp, Mus musculus
tgtaaccactgggacctttccactt

SEQ ID NO: 897489 - DNA, 25 bp, Mus musculus
tgtaaccagcagaaactccatgcac

SEQ ID NO: 897490 - DNA, 25 bp, Mus musculus
tgtaaccagcagtaactccatgcac

SEQ ID NO: 897491 - DNA, 25 bp, Mus musculus
tgtaaccagctcactcggaggcata

SEQ ID NO: 897492 - DNA, 25 bp, Mus musculus
tgtaaccagctctctcggaggcata

SEQ ID NO: 897493 - DNA, 25 bp, Mus musculus
tgtaaccatcaaagcgtacgctgct

SEQ ID NO: 897494 - DNA, 25 bp, Mus musculus
tgtaaccatcaatgcgtacgctgct

SEQ ID NO: 897495 - DNA, 25 bp, Mus musculus
tgtaaccatctgactttcgaagttc

SEQ ID NO: 897496 - DNA, 25 bp, Mus musculus
tgtaaccatctgtctttcgaagttc

SEQ ID NO: 897497 - DNA, 25 bp, Mus musculus
tgtaaccatgagagggccccactga

SEQ ID NO: 897498 - DNA, 25 bp, Mus musculus
tgtaaccatgagtgggccccactga

SEQ ID NO: 897499 - DNA, 25 bp, Mus musculus
tgtaaccatgccacagcagggtggt

SEQ ID NO: 897500 - DNA, 25 bp, Mus musculus
tgtaaccatgcctcagcagggtggt

SEQ ID NO: 897501 - DNA, 25 bp, Mus musculus
tgtaaccatgtcaatgccccatttt

SEQ ID NO: 897502 - DNA, 25 bp, Mus musculus
tgtaaccatgtctatgccccatttt

SEQ ID NO: 897503 - DNA, 25 bp, Mus musculus
tgtaacccaaggaaggcgtggcttt

SEQ ID NO: 897504 - DNA, 25 bp, Mus musculus
tgtaacccaaggtaggcgtggcttt

SEQ ID NO: 897505 - DNA, 25 bp, Mus musculus
tgtaacccactgcttatcacatgtc

SEQ ID NO: 897506 - DNA, 25 bp, Mus musculus
tgtaacccactggttatcacatgtc

SEQ ID NO: 897507 - DNA, 25 bp, Mus musculus
tgtaacccaggacactgatacaggt

SEQ ID NO: 897508 - DNA, 25 bp, Mus musculus
tgtaacccaggagactgatacaggt

SEQ ID NO: 897509 - DNA, 25 bp, Mus musculus
tgtaacccagtaaattttgttctcc

SEQ ID NO: 897510 - DNA, 25 bp, Mus musculus
tgtaacccagtatattttgttctcc

SEQ ID NO: 897511 - DNA, 25 bp, Mus musculus
tgtaacccagttctacagaatctga

SEQ ID NO: 897512 - DNA, 25 bp, Mus musculus
tgtaacccagttctaggtgatttga

SEQ ID NO: 897513 - DNA, 25 bp, Mus musculus
tgtaacccagttgtacagaatctga

SEQ ID NO: 897514 - DNA, 25 bp, Mus musculus
tgtaacccagttgtaggtgatttga

SEQ ID NO: 897515 - DNA, 25 bp, Mus musculus
tgtaaccccagactacgagagatgg

SEQ ID NO: 897516 - DNA, 25 bp, Mus musculus
tgtaaccccagagtacgagagatgg

SEQ ID NO: 897517 - DNA, 25 bp, Mus musculus
tgtaaccccatcctttataagccca

SEQ ID NO: 897518 - DNA, 25 bp, Mus musculus
tgtaaccccatcgtttataagccca

SEQ ID NO: 897519 - DNA, 25 bp, Mus musculus
tgtaacccctgtcaacaaccttgaa

SEQ ID NO: 897520 - DNA, 25 bp, Mus musculus
tgtaacccctgtgaacaaccttgaa

SEQ ID NO: 897521 - DNA, 25 bp, Mus musculus
tgtaaccctcacacgttatcgtgta

SEQ ID NO: 897522 - DNA, 25 bp, Mus musculus
tgtaaccctcactcgttatcgtgta

SEQ ID NO: 897523 - DNA, 25 bp, Mus musculus
tgtaaccctggcacttaagaagctg

SEQ ID NO: 897524 - DNA, 25 bp, Mus musculus
tgtaaccctggctcttaagaagctg

SEQ ID NO: 897525 - DNA, 25 bp, Mus musculus
tgtaacccttcacaaaaccactttg

SEQ ID NO: 897526 - DNA, 25 bp, Mus musculus
tgtaacccttcagaaaaccactttg

SEQ ID NO: 897527 - DNA, 25 bp, Mus musculus
tgtaaccggagcaggccccgtaggt

SEQ ID NO: 897528 - DNA, 25 bp, Mus musculus
tgtaaccggagctggccccgtaggt

SEQ ID NO: 897529 - DNA, 25 bp, Mus musculus
tgtaaccgtgagcttttccacccgg

SEQ ID NO: 897530 - DNA, 25 bp, Mus musculus
tgtaaccgtgaggttttccacccgg

SEQ ID NO: 897531 - DNA, 25 bp, Mus musculus
tgtaacctaaccagactcccggaag

SEQ ID NO: 897532 - DNA, 25 bp, Mus musculus
tgtaacctaacctgactcccggaag

SEQ ID NO: 897533 - DNA, 25 bp, Mus musculus
tgtaacctaggcaaggcctggactt

SEQ ID NO: 897534 - DNA, 25 bp, Mus musculus
tgtaacctaggctaggcctggactt

SEQ ID NO: 897535 - DNA, 25 bp, Mus musculus
tgtaacctagtaactccttccactt

SEQ ID NO: 897536 - DNA, 25 bp, Mus musculus
tgtaacctagtatctccttccactt

SEQ ID NO: 897537 - DNA, 25 bp, Mus musculus
tgtaacctattcaaacctcaaactc

SEQ ID NO: 897538 - DNA, 25 bp, Mus musculus
tgtaacctattctaacctcaaactc

SEQ ID NO: 897539 - DNA, 25 bp, Mus musculus
tgtaacctcagcaccggaggatgga

SEQ ID NO: 897540 - DNA, 25 bp, Mus musculus
tgtaacctcagctccggaggatgga

SEQ ID NO: 897541 - DNA, 25 bp, Mus musculus
tgtaacctcgcaaattccttcggct

SEQ ID NO: 897542 - DNA, 25 bp, Mus musculus
tgtaacctcgcatattccttcggct

SEQ ID NO: 897543 - DNA, 25 bp, Mus musculus
tgtaaccttactaaatgctgcctct

SEQ ID NO: 897544 - DNA, 25 bp, Mus musculus
tgtaaccttacttaatgctgcctct

SEQ ID NO: 897545 - DNA, 25 bp, Mus musculus
tgtaaccttattcactccagctgta

SEQ ID NO: 897546 - DNA, 25 bp, Mus musculus
tgtaaccttattgactccagctgta

SEQ ID NO: 897547 - DNA, 25 bp, Mus musculus
tgtaacctttacaaacatcttaggg

SEQ ID NO: 897548 - DNA, 25 bp, Mus musculus
tgtaacctttactaacatcttaggg

SEQ ID NO: 897549 - DNA, 25 bp, Mus musculus
tgtaaccttttcataagagatgagt

SEQ ID NO: 897550 - DNA, 25 bp, Mus musculus
tgtaaccttttcttaagagatgagt

SEQ ID NO: 897551 - DNA, 25 bp, Mus musculus
tgtaacgaccggagtgcttcagttt

SEQ ID NO: 897552 - DNA, 25 bp, Mus musculus
tgtaacgaccggtgtgcttcagttt

SEQ ID NO: 897553 - DNA, 25 bp, Mus musculus
tgtaacgcctccactatatacagtt

SEQ ID NO: 897554 - DNA, 25 bp, Mus musculus
tgtaacgcctccctgaagagacaat

SEQ ID NO: 897555 - DNA, 25 bp, Mus musculus
tgtaacgcctccgtgaagagacaat

SEQ ID NO: 897556 - DNA, 25 bp, Mus musculus
tgtaacgcctcctctatatacagtt

SEQ ID NO: 897557 - DNA, 25 bp, Mus musculus
tgtaacgctaccatccagagacagt

SEQ ID NO: 897558 - DNA, 25 bp, Mus musculus
tgtaacgctaccttccagagacagt

SEQ ID NO: 897559 - DNA, 25 bp, Mus musculus
tgtaacggattccacagggcatgtg

SEQ ID NO: 897560 - DNA, 25 bp, Mus musculus
tgtaacggattcgacagggcatgtg

SEQ ID NO: 897561 - DNA, 25 bp, Mus musculus
tgtaacggccatacactttgttcgc

SEQ ID NO: 897562 - DNA, 25 bp, Mus musculus
tgtaacggccattcactttgttcgc

SEQ ID NO: 897563 - DNA, 25 bp, Mus musculus
tgtaacggcgcaaagtgcactgtga

SEQ ID NO: 897564 - DNA, 25 bp, Mus musculus
tgtaacggcgcatagtgcactgtga

SEQ ID NO: 897565 - DNA, 25 bp, Mus musculus
tgtaactaaatgaccctccaggtaa

SEQ ID NO: 897566 - DNA, 25 bp, Mus musculus
tgtaactaaatgtccctccaggtaa

SEQ ID NO: 897567 - DNA, 25 bp, Mus musculus
tgtaactaagaactccctacaacct

SEQ ID NO: 897568 - DNA, 25 bp, Mus musculus
tgtaactaagaagtccctacaacct

SEQ ID NO: 897569 - DNA, 25 bp, Mus musculus
tgtaactaatatatctcataaccat

SEQ ID NO: 897570 - DNA, 25 bp, Mus musculus
tgtaactaatatttctcataaccat

SEQ ID NO: 897571 - DNA, 25 bp, Mus musculus
tgtaactaatgaagggcagcccctt

SEQ ID NO: 897572 - DNA, 25 bp, Mus musculus
tgtaactaatgatgggcagcccctt

SEQ ID NO: 897573 - DNA, 25 bp, Mus musculus
tgtaactacactacctagcacacag

SEQ ID NO: 897574 - DNA, 25 bp, Mus musculus
tgtaactacacttcctagcacacag

SEQ ID NO: 897575 - DNA, 25 bp, Mus musculus
tgtaactacagtcccacacgatggt

SEQ ID NO: 897576 - DNA, 25 bp, Mus musculus
tgtaactacagtgccacacgatggt

SEQ ID NO: 897577 - DNA, 25 bp, Mus musculus
tgtaactatggaactggaacaatgt

SEQ ID NO: 897578 - DNA, 25 bp, Mus musculus
tgtaactatggatctggaacaatgt

SEQ ID NO: 897579 - DNA, 25 bp, Mus musculus
tgtaactattacacagaactgaggt

SEQ ID NO: 897580 - DNA, 25 bp, Mus musculus
tgtaactattactcagaactgaggt

SEQ ID NO: 897581 - DNA, 25 bp, Mus musculus
tgtaactattcaagctccactttct

SEQ ID NO: 897582 - DNA, 25 bp, Mus musculus
tgtaactattcatgctccactttct

SEQ ID NO: 897583 - DNA, 25 bp, Mus musculus
tgtaactcaacccttggcttgtaga

SEQ ID NO: 897584 - DNA, 25 bp, Mus musculus
tgtaactcaaccgttggcttgtaga

SEQ ID NO: 897585 - DNA, 25 bp, Mus musculus
tgtaactcaatcacatcccaggttc

SEQ ID NO: 897586 - DNA, 25 bp, Mus musculus
tgtaactcaatctcatcccaggttc

SEQ ID NO: 897587 - DNA, 25 bp, Mus musculus
tgtaactcaccacatagaccagact

SEQ ID NO: 897588 - DNA, 25 bp, Mus musculus
tgtaactcaccagatagaccagact

SEQ ID NO: 897589 - DNA, 25 bp, Mus musculus
tgtaactcactgacgctctgctttc

SEQ ID NO: 897590 - DNA, 25 bp, Mus musculus
tgtaactcactgtcgctctgctttc

SEQ ID NO: 897591 - DNA, 25 bp, Mus musculus
tgtaactcccacacgagagatctga

SEQ ID NO: 897592 - DNA, 25 bp, Mus musculus
tgtaactcccactcgagagatctga

SEQ ID NO: 897593 - DNA, 25 bp, Mus musculus
tgtaactccttaagctccttggtga

SEQ ID NO: 897594 - DNA, 25 bp, Mus musculus
tgtaactccttatgctccttggtga

SEQ ID NO: 897595 - DNA, 25 bp, Mus musculus
tgtaactctaccacatttctagtcc

SEQ ID NO: 897596 - DNA, 25 bp, Mus musculus
tgtaactctacctcatttctagtcc

SEQ ID NO: 897597 - DNA, 25 bp, Mus musculus
tgtaactgacgccttagctacacat

SEQ ID NO: 897598 - DNA, 25 bp, Mus musculus
tgtaactgacgcgttagctacacat

SEQ ID NO: 897599 - DNA, 25 bp, Mus musculus
tgtaactgagccagctgcacttggg

SEQ ID NO: 897600 - DNA, 25 bp, Mus musculus
tgtaactgagcctgctgcacttggg

SEQ ID NO: 897601 - DNA, 25 bp, Mus musculus
tgtaactgagttccttgggccatgg

SEQ ID NO: 897602 - DNA, 25 bp, Mus musculus
tgtaactgagttgcttgggccatgg

SEQ ID NO: 897603 - DNA, 25 bp, Mus musculus
tgtaactgccaacagtttatgatcc

SEQ ID NO: 897604 - DNA, 25 bp, Mus musculus
tgtaactgccaagagtttatgatcc

SEQ ID NO: 897605 - DNA, 25 bp, Mus musculus
tgtaactgggccatttgtgttctcc

SEQ ID NO: 897606 - DNA, 25 bp, Mus musculus
tgtaactgggccttttgtgttctcc

SEQ ID NO: 897607 - DNA, 25 bp, Mus musculus
tgtaacttatgaagcacctgcctct

SEQ ID NO: 897608 - DNA, 25 bp, Mus musculus
tgtaacttatgatgcacctgcctct

SEQ ID NO: 897609 - DNA, 25 bp, Mus musculus
tgtaacttcaacctccttaaaacat

SEQ ID NO: 897610 - DNA, 25 bp, Mus musculus
tgtaacttcaacgtccttaaaacat

SEQ ID NO: 897611 - DNA, 25 bp, Mus musculus
tgtaacttcccacaagttcactgag

SEQ ID NO: 897612 - DNA, 25 bp, Mus musculus
tgtaacttcccagaagttcactgag

SEQ ID NO: 897613 - DNA, 25 bp, Mus musculus
tgtaacttgtgtaagagccccagcc

SEQ ID NO: 897614 - DNA, 25 bp, Mus musculus
tgtaacttgtgttagagccccagcc

SEQ ID NO: 897615 - DNA, 25 bp, Mus musculus
tgtaacttgttgcactgtcattaac

SEQ ID NO: 897616 - DNA, 25 bp, Mus musculus
tgtaacttgttggactgtcattaac

SEQ ID NO: 897617 - DNA, 25 bp, Mus musculus
tgtaactttccactactctacctgg

SEQ ID NO: 897618 - DNA, 25 bp, Mus musculus
tgtaactttccagtactctacctgg

SEQ ID NO: 897619 - DNA, 25 bp, Mus musculus
tgtaactttcctctctctatcacgt

SEQ ID NO: 897620 - DNA, 25 bp, Mus musculus
tgtaactttcctgtctctatcacgt

SEQ ID NO: 897621 - DNA, 25 bp, Mus musculus
tgtaagaaagccagcatcctcattt

SEQ ID NO: 897622 - DNA, 25 bp, Mus musculus
tgtaagaaagcctgcatcctcattt

SEQ ID NO: 897623 - DNA, 25 bp, Mus musculus
tgtaagaacgacaatccaggctgta

SEQ ID NO: 897624 - DNA, 25 bp, Mus musculus
tgtaagaacgactatccaggctgta

SEQ ID NO: 897625 - DNA, 25 bp, Mus musculus
tgtaagaacggaatgccccatctac

SEQ ID NO: 897626 - DNA, 25 bp, Mus musculus
tgtaagaacggattgccccatctac

SEQ ID NO: 897627 - DNA, 25 bp, Mus musculus
tgtaagaagcgccttgatgcctcac

SEQ ID NO: 897628 - DNA, 25 bp, Mus musculus
tgtaagaagcgcgttgatgcctcac

SEQ ID NO: 897629 - DNA, 25 bp, Mus musculus
tgtaagacacataggccttgggctg

SEQ ID NO: 897630 - DNA, 25 bp, Mus musculus
tgtaagacacattggccttgggctg

SEQ ID NO: 897631 - DNA, 25 bp, Mus musculus
tgtaagaccttgacgagcccagaac

SEQ ID NO: 897632 - DNA, 25 bp, Mus musculus
tgtaagaccttgtcgagcccagaac

SEQ ID NO: 897633 - DNA, 25 bp, Mus musculus
tgtaagactcggcacaggttttaga

SEQ ID NO: 897634 - DNA, 25 bp, Mus musculus
tgtaagactcgggacaggttttaga

SEQ ID NO: 897635 - DNA, 25 bp, Mus musculus
tgtaagactgtgcaccccaataccc

SEQ ID NO: 897636 - DNA, 25 bp, Mus musculus
tgtaagactgtggaccccaataccc

SEQ ID NO: 897637 - DNA, 25 bp, Mus musculus
tgtaagagacaaaccattttcccag

SEQ ID NO: 897638 - DNA, 25 bp, Mus musculus
tgtaagagacaatccattttcccag

SEQ ID NO: 897639 - DNA, 25 bp, Mus musculus
tgtaagagacgaacccatttcccca

SEQ ID NO: 897640 - DNA, 25 bp, Mus musculus
tgtaagagacgatcccatttcccca

SEQ ID NO: 897641 - DNA, 25 bp, Mus musculus
tgtaagagactcactgccttcaggc

SEQ ID NO: 897642 - DNA, 25 bp, Mus musculus
tgtaagagactctctgccttcaggc

SEQ ID NO: 897643 - DNA, 25 bp, Mus musculus
tgtaagagccttccctgtaatttag

SEQ ID NO: 897644 - DNA, 25 bp, Mus musculus
tgtaagagccttgcctgtaatttag

SEQ ID NO: 897645 - DNA, 25 bp, Mus musculus
tgtaagagcttcaacccaagtcctc

SEQ ID NO: 897646 - DNA, 25 bp, Mus musculus
tgtaagagcttctacccaagtcctc

SEQ ID NO: 897647 - DNA, 25 bp, Mus musculus
tgtaagagtccaaatttcccagtca

SEQ ID NO: 897648 - DNA, 25 bp, Mus musculus
tgtaagagtccatatttcccagtca

SEQ ID NO: 897649 - DNA, 25 bp, Mus musculus
tgtaagagtgttcccagacccctgg

SEQ ID NO: 897650 - DNA, 25 bp, Mus musculus
tgtaagagtgttgccagacccctgg

SEQ ID NO: 897651 - DNA, 25 bp, Mus musculus
tgtaagataaatctctgcctctgtt

SEQ ID NO: 897652 - DNA, 25 bp, Mus musculus
tgtaagataaatgtctgcctctgtt

SEQ ID NO: 897653 - DNA, 25 bp, Mus musculus
tgtaagataaccctgctctgttctc

SEQ ID NO: 897654 - DNA, 25 bp, Mus musculus
tgtaagataaccgtgctctgttctc

SEQ ID NO: 897655 - DNA, 25 bp, Mus musculus
tgtaagatccataagccgtttgcta

SEQ ID NO: 897656 - DNA, 25 bp, Mus musculus
tgtaagatccattagccgtttgcta

SEQ ID NO: 897657 - DNA, 25 bp, Mus musculus
tgtaagatccgactattcattggtg

SEQ ID NO: 897658 - DNA, 25 bp, Mus musculus
tgtaagatccgagtattcattggtg

SEQ ID NO: 897659 - DNA, 25 bp, Mus musculus
tgtaagatcttgaagctgctcctac

SEQ ID NO: 897660 - DNA, 25 bp, Mus musculus
tgtaagatcttgtagctgctcctac

SEQ ID NO: 897661 - DNA, 25 bp, Mus musculus
tgtaagatgtttcccaatcagatat

SEQ ID NO: 897662 - DNA, 25 bp, Mus musculus
tgtaagatgtttgccaatcagatat

SEQ ID NO: 897663 - DNA, 25 bp, Mus musculus
tgtaagattgctagttcaaaccaaa

SEQ ID NO: 897664 - DNA, 25 bp, Mus musculus
tgtaagattgcttgttcaaaccaaa

SEQ ID NO: 897665 - DNA, 25 bp, Mus musculus
tgtaagatttttcccatgtttccat

SEQ ID NO: 897666 - DNA, 25 bp, Mus musculus
tgtaagatttttgccatgtttccat

SEQ ID NO: 897667 - DNA, 25 bp, Mus musculus
tgtaagcaagagctcccacttgtca

SEQ ID NO: 897668 - DNA, 25 bp, Mus musculus
tgtaagcaagaggtcccacttgtca

SEQ ID NO: 897669 - DNA, 25 bp, Mus musculus
tgtaagcacagaaaggaccacccct

SEQ ID NO: 897670 - DNA, 25 bp, Mus musculus
tgtaagcacagataggaccacccct

SEQ ID NO: 897671 - DNA, 25 bp, Mus musculus
tgtaagcacatccttctgttccttg

SEQ ID NO: 897672 - DNA, 25 bp, Mus musculus
tgtaagcacatcgttctgttccttg

SEQ ID NO: 897673 - DNA, 25 bp, Mus musculus
tgtaagcactctactgcctgagtcc

SEQ ID NO: 897674 - DNA, 25 bp, Mus musculus
tgtaagcactcttctgcctgagtcc

SEQ ID NO: 897675 - DNA, 25 bp, Mus musculus
tgtaagcagagccaacctgcctatt

SEQ ID NO: 897676 - DNA, 25 bp, Mus musculus
tgtaagcagagcgaacctgcctatt

SEQ ID NO: 897677 - DNA, 25 bp, Mus musculus
tgtaagcatgcaccattccacaggc

SEQ ID NO: 897678 - DNA, 25 bp, Mus musculus
tgtaagcatgcagcattccacaggc

SEQ ID NO: 897679 - DNA, 25 bp, Mus musculus
tgtaagccacacagaaacttctctt

SEQ ID NO: 897680 - DNA, 25 bp, Mus musculus
tgtaagccacactgaaacttctctt

SEQ ID NO: 897681 - DNA, 25 bp, Mus musculus
tgtaagccacccactttttgcagtg

SEQ ID NO: 897682 - DNA, 25 bp, Mus musculus
tgtaagccaccctctttttgcagtg

SEQ ID NO: 897683 - DNA, 25 bp, Mus musculus
tgtaagccactgcacaaagacgttt

SEQ ID NO: 897684 - DNA, 25 bp, Mus musculus
tgtaagccactggacaaagacgttt

SEQ ID NO: 897685 - DNA, 25 bp, Mus musculus
tgtaagccagccagttgaacgtttg

SEQ ID NO: 897686 - DNA, 25 bp, Mus musculus
tgtaagccagcctgttgaacgtttg

SEQ ID NO: 897687 - DNA, 25 bp, Mus musculus
tgtaagcccagaaagcctgtaagcc

SEQ ID NO: 897688 - DNA, 25 bp, Mus musculus
tgtaagcccagatagcctgtaagcc

SEQ ID NO: 897689 - DNA, 25 bp, Mus musculus
tgtaagcccgcaaaccctgaccagc

SEQ ID NO: 897690 - DNA, 25 bp, Mus musculus
tgtaagcccgcataccctgaccagc

SEQ ID NO: 897691 - DNA, 25 bp, Mus musculus
tgtaagcctcaacagctaatcctgt

SEQ ID NO: 897692 - DNA, 25 bp, Mus musculus
tgtaagcctcaagagctaatcctgt

SEQ ID NO: 897693 - DNA, 25 bp, Mus musculus
tgtaagcctgtacggtgtccacacc

SEQ ID NO: 897694 - DNA, 25 bp, Mus musculus
tgtaagcctgtagggtgtccacacc

SEQ ID NO: 897695 - DNA, 25 bp, Mus musculus
tgtaagccttacatctcaactcatc

SEQ ID NO: 897696 - DNA, 25 bp, Mus musculus
tgtaagccttacttctcaactcatc

SEQ ID NO: 897697 - DNA, 25 bp, Mus musculus
tgtaagccttgtaaaccctttccat

SEQ ID NO: 897698 - DNA, 25 bp, Mus musculus
tgtaagccttgtagctttgccccaa

SEQ ID NO: 897699 - DNA, 25 bp, Mus musculus
tgtaagccttgtcgctgtgctgtca

SEQ ID NO: 897700 - DNA, 25 bp, Mus musculus
tgtaagccttgtggctgtgctgtca

SEQ ID NO: 897701 - DNA, 25 bp, Mus musculus
tgtaagccttgttaaccctttccat

SEQ ID NO: 897702 - DNA, 25 bp, Mus musculus
tgtaagccttgttgctttgccccaa

SEQ ID NO: 897703 - DNA, 25 bp, Mus musculus
tgtaagcggaacaagtcacagacta

SEQ ID NO: 897704 - DNA, 25 bp, Mus musculus
tgtaagcggaactagtcacagacta

SEQ ID NO: 897705 - DNA, 25 bp, Mus musculus
tgtaagcggactatttacaccttgt

SEQ ID NO: 897706 - DNA, 25 bp, Mus musculus
tgtaagcggactttttacaccttgt

SEQ ID NO: 897707 - DNA, 25 bp, Mus musculus
tgtaagcgtatcacgtatctcgtct

SEQ ID NO: 897708 - DNA, 25 bp, Mus musculus
tgtaagcgtatctcgtatctcgtct

SEQ ID NO: 897709 - DNA, 25 bp, Mus musculus
tgtaagcgtgcaactggtggagtct

SEQ ID NO: 897710 - DNA, 25 bp, Mus musculus
tgtaagcgtgcatctggtggagtct

SEQ ID NO: 897711 - DNA, 25 bp, Mus musculus
tgtaagctaccaatctgactcttcc

SEQ ID NO: 897712 - DNA, 25 bp, Mus musculus
tgtaagctaccattctgactcttcc

SEQ ID NO: 897713 - DNA, 25 bp, Mus musculus
tgtaagctgcctatgcccttaatga

SEQ ID NO: 897714 - DNA, 25 bp, Mus musculus
tgtaagctgcctttgcccttaatga

SEQ ID NO: 897715 - DNA, 25 bp, Mus musculus
tgtaagcttattattgcctctctgc

SEQ ID NO: 897716 - DNA, 25 bp, Mus musculus
tgtaagcttatttttgcctctctgc

SEQ ID NO: 897717 - DNA, 25 bp, Mus musculus
tgtaaggaaaagaccctaattcaca

SEQ ID NO: 897718 - DNA, 25 bp, Mus musculus
tgtaaggaaaagtccctaattcaca

SEQ ID NO: 897719 - DNA, 25 bp, Mus musculus
tgtaaggaaataaggcccagcctct

SEQ ID NO: 897720 - DNA, 25 bp, Mus musculus
tgtaaggaaatatggcccagcctct

SEQ ID NO: 897721 - DNA, 25 bp, Mus musculus
tgtaaggaattacctctgctgccgc

SEQ ID NO: 897722 - DNA, 25 bp, Mus musculus
tgtaaggaattagctctgctgccgc

SEQ ID NO: 897723 - DNA, 25 bp, Mus musculus
tgtaaggaccggaggacaatggcct

SEQ ID NO: 897724 - DNA, 25 bp, Mus musculus
tgtaaggaccggtggacaatggcct

SEQ ID NO: 897725 - DNA, 25 bp, Mus musculus
tgtaaggacctacccttggctctca

SEQ ID NO: 897726 - DNA, 25 bp, Mus musculus
tgtaaggacctagccttggctctca

SEQ ID NO: 897727 - DNA, 25 bp, Mus musculus
tgtaaggagggtatggtatagtaaa

SEQ ID NO: 897728 - DNA, 25 bp, Mus musculus
tgtaaggagggtttggtatagtaaa

SEQ ID NO: 897729 - DNA, 25 bp, Mus musculus
tgtaaggatggcaggccgtacaaca

SEQ ID NO: 897730 - DNA, 25 bp, Mus musculus
tgtaaggatggctggccgtacaaca

SEQ ID NO: 897731 - DNA, 25 bp, Mus musculus
tgtaaggattgtcggcaacgcttct

SEQ ID NO: 897732 - DNA, 25 bp, Mus musculus
tgtaaggattgtgggcaacgcttct

SEQ ID NO: 897733 - DNA, 25 bp, Mus musculus
tgtaaggcaaaacaggacccagaaa

SEQ ID NO: 897734 - DNA, 25 bp, Mus musculus
tgtaaggcaaaagaggacccagaaa

SEQ ID NO: 897735 - DNA, 25 bp, Mus musculus
tgtaaggccccgagttcaattgctg

SEQ ID NO: 897736 - DNA, 25 bp, Mus musculus
tgtaaggccccgtgttcaattgctg

SEQ ID NO: 897737 - DNA, 25 bp, Mus musculus
tgtaaggcgcccctgttgcagacac

SEQ ID NO: 897738 - DNA, 25 bp, Mus musculus
tgtaaggcgcccgtgttgcagacac

SEQ ID NO: 897739 - DNA, 25 bp, Mus musculus
tgtaaggctgcgaaccatggtgtgt

SEQ ID NO: 897740 - DNA, 25 bp, Mus musculus
tgtaaggctgcgtaccatggtgtgt

SEQ ID NO: 897741 - DNA, 25 bp, Mus musculus
tgtaaggctgtgaccattccctgag

SEQ ID NO: 897742 - DNA, 25 bp, Mus musculus
tgtaaggctgtgtccattccctgag

SEQ ID NO: 897743 - DNA, 25 bp, Mus musculus
tgtaagggaaacagcctgagcctcc

SEQ ID NO: 897744 - DNA, 25 bp, Mus musculus
tgtaagggaaactgcctgagcctcc

SEQ ID NO: 897745 - DNA, 25 bp, Mus musculus
tgtaagggaagcagaagtttttgtt

SEQ ID NO: 897746 - DNA, 25 bp, Mus musculus
tgtaagggaagctgaagtttttgtt

SEQ ID NO: 897747 - DNA, 25 bp, Mus musculus
tgtaagggattgctgcccactgtac

SEQ ID NO: 897748 - DNA, 25 bp, Mus musculus
tgtaagggattggtgcccactgtac

SEQ ID NO: 897749 - DNA, 25 bp, Mus musculus
tgtaagggccttattcggtcttcaa

SEQ ID NO: 897750 - DNA, 25 bp, Mus musculus
tgtaagggcctttttcggtcttcaa

SEQ ID NO: 897751 - DNA, 25 bp, Mus musculus
tgtaaggtggagcaaccctggcctt

SEQ ID NO: 897752 - DNA, 25 bp, Mus musculus
tgtaaggtggaggaaccctggcctt

SEQ ID NO: 897753 - DNA, 25 bp, Mus musculus
tgtaaggtgtgactccccagagcca

SEQ ID NO: 897754 - DNA, 25 bp, Mus musculus
tgtaaggtgtgagtccccagagcca

SEQ ID NO: 897755 - DNA, 25 bp, Mus musculus
tgtaagtaactcagaaccacccatg

SEQ ID NO: 897756 - DNA, 25 bp, Mus musculus
tgtaagtaactctgaaccacccatg

SEQ ID NO: 897757 - DNA, 25 bp, Mus musculus
tgtaagtaatatatccatgtctctc

SEQ ID NO: 897758 - DNA, 25 bp, Mus musculus
tgtaagtaatatttccatgtctctc

SEQ ID NO: 897759 - DNA, 25 bp, Mus musculus
tgtaagtactctcagccactgagcc

SEQ ID NO: 897760 - DNA, 25 bp, Mus musculus
tgtaagtactctgagccactgagcc

SEQ ID NO: 897761 - DNA, 25 bp, Mus musculus
tgtaagtcaagtatcagtcatcatt

SEQ ID NO: 897762 - DNA, 25 bp, Mus musculus
tgtaagtcaagtttcagtcatcatt

SEQ ID NO: 897763 - DNA, 25 bp, Mus musculus
tgtaagtcagcacgagttttctctc

SEQ ID NO: 897764 - DNA, 25 bp, Mus musculus
tgtaagtcagcaggagttttctctc

SEQ ID NO: 897765 - DNA, 25 bp, Mus musculus
tgtaagtcaggcaggacctccattg

SEQ ID NO: 897766 - DNA, 25 bp, Mus musculus
tgtaagtcaggctggacctccattg

SEQ ID NO: 897767 - DNA, 25 bp, Mus musculus
tgtaagtctagtagtgaggcacctg

SEQ ID NO: 897768 - DNA, 25 bp, Mus musculus
tgtaagtctagttgtgaggcacctg

SEQ ID NO: 897769 - DNA, 25 bp, Mus musculus
tgtaagtctctgatttccctttgga

SEQ ID NO: 897770 - DNA, 25 bp, Mus musculus
tgtaagtctctgttttccctttgga

SEQ ID NO: 897771 - DNA, 25 bp, Mus musculus
tgtaagtgacccagacagcaaggct

SEQ ID NO: 897772 - DNA, 25 bp, Mus musculus
tgtaagtgaccctgacagcaaggct

SEQ ID NO: 897773 - DNA, 25 bp, Mus musculus
tgtaagtgacttcaggcctataata

SEQ ID NO: 897774 - DNA, 25 bp, Mus musculus
tgtaagtgacttgaggcctataata

SEQ ID NO: 897775 - DNA, 25 bp, Mus musculus
tgtaagtgtgcaatggccatctcct

SEQ ID NO: 897776 - DNA, 25 bp, Mus musculus
tgtaagtgtgcattggccatctcct

SEQ ID NO: 897777 - DNA, 25 bp, Mus musculus
tgtaagttattaacaggtttttcct

SEQ ID NO: 897778 - DNA, 25 bp, Mus musculus
tgtaagttattatcaggtttttcct

SEQ ID NO: 897779 - DNA, 25 bp, Mus musculus
tgtaagttcagaaaagcacgctctt

SEQ ID NO: 897780 - DNA, 25 bp, Mus musculus
tgtaagttcagataagcacgctctt

SEQ ID NO: 897781 - DNA, 25 bp, Mus musculus
tgtaagttgggcatgctattctgtc

SEQ ID NO: 897782 - DNA, 25 bp, Mus musculus
tgtaagttgggcttgctattctgtc

SEQ ID NO: 897783 - DNA, 25 bp, Mus musculus
tgtaataaataacctgatacccggg

SEQ ID NO: 897784 - DNA, 25 bp, Mus musculus
tgtaataaataagctgatacccggg

SEQ ID NO: 897785 - DNA, 25 bp, Mus musculus
tgtaataagcttacttgacttgctc

SEQ ID NO: 897786 - DNA, 25 bp, Mus musculus
tgtaataagctttcttgacttgctc

SEQ ID NO: 897787 - DNA, 25 bp, Mus musculus
tgtaataattccaacttctgcattt

SEQ ID NO: 897788 - DNA, 25 bp, Mus musculus
tgtaataattcctacttctgcattt

SEQ ID NO: 897789 - DNA, 25 bp, Mus musculus
tgtaatacaaacatggaccaccagg

SEQ ID NO: 897790 - DNA, 25 bp, Mus musculus
tgtaatacaaacttggaccaccagg

SEQ ID NO: 897791 - DNA, 25 bp, Mus musculus
tgtaatacgtgaaccaggctggtct

SEQ ID NO: 897792 - DNA, 25 bp, Mus musculus
tgtaatacgtgatccaggctggtct

SEQ ID NO: 897793 - DNA, 25 bp, Mus musculus
tgtaatactgacctgtctgcctgtc

SEQ ID NO: 897794 - DNA, 25 bp, Mus musculus
tgtaatactgacgtgtctgcctgtc

SEQ ID NO: 897795 - DNA, 25 bp, Mus musculus
tgtaatactgccacacccataagag

SEQ ID NO: 897796 - DNA, 25 bp, Mus musculus
tgtaatactgcctcacccataagag

SEQ ID NO: 897797 - DNA, 25 bp, Mus musculus
tgtaatagacccctgcatgcagcct

SEQ ID NO: 897798 - DNA, 25 bp, Mus musculus
tgtaatagacccgtgcatgcagcct

SEQ ID NO: 897799 - DNA, 25 bp, Mus musculus
tgtaatagccgtcttctgtactgcc

SEQ ID NO: 897800 - DNA, 25 bp, Mus musculus
tgtaatagccgtgttctgtactgcc

SEQ ID NO: 897801 - DNA, 25 bp, Mus musculus
tgtaatagcgcacaagatccagaag

SEQ ID NO: 897802 - DNA, 25 bp, Mus musculus
tgtaatagcgcagaagatccagaag

SEQ ID NO: 897803 - DNA, 25 bp, Mus musculus
tgtaatagtacccagcgtgcttcca

SEQ ID NO: 897804 - DNA, 25 bp, Mus musculus
tgtaatagtaccgagcgtgcttcca

SEQ ID NO: 897805 - DNA, 25 bp, Mus musculus
tgtaatagtgaccatcctggcctcc

SEQ ID NO: 897806 - DNA, 25 bp, Mus musculus
tgtaatagtgacgatcctggcctcc

SEQ ID NO: 897807 - DNA, 25 bp, Mus musculus
tgtaatatccccatgctcctaacat

SEQ ID NO: 897808 - DNA, 25 bp, Mus musculus
tgtaatatccccttgctcctaacat

SEQ ID NO: 897809 - DNA, 25 bp, Mus musculus
tgtaatattagtctcttaagagaac

SEQ ID NO: 897810 - DNA, 25 bp, Mus musculus
tgtaatattagtgtcttaagagaac

SEQ ID NO: 897811 - DNA, 25 bp, Mus musculus
tgtaatcaaaaaccctgcacctgtt

SEQ ID NO: 897812 - DNA, 25 bp, Mus musculus
tgtaatcaaaaagcctgcacctgtt

SEQ ID NO: 897813 - DNA, 25 bp, Mus musculus
tgtaatcacatgactcccagctctg

SEQ ID NO: 897814 - DNA, 25 bp, Mus musculus
tgtaatcacatgtctcccagctctg

SEQ ID NO: 897815 - DNA, 25 bp, Mus musculus
tgtaatcaccctcgtggccttcaca

SEQ ID NO: 897816 - DNA, 25 bp, Mus musculus
tgtaatcaccctggtggccttcaca

SEQ ID NO: 897817 - DNA, 25 bp, Mus musculus
tgtaatcacgtccttaacttccttc

SEQ ID NO: 897818 - DNA, 25 bp, Mus musculus
tgtaatcacgtcgttaacttccttc

SEQ ID NO: 897819 - DNA, 25 bp, Mus musculus
tgtaatcactccagtactgccatgc

SEQ ID NO: 897820 - DNA, 25 bp, Mus musculus
tgtaatcactcctgtactgccatgc

SEQ ID NO: 897821 - DNA, 25 bp, Mus musculus
tgtaatcagaacatgcttccctgtt

SEQ ID NO: 897822 - DNA, 25 bp, Mus musculus
tgtaatcagaacttgcttccctgtt

SEQ ID NO: 897823 - DNA, 25 bp, Mus musculus
tgtaatcatgcaaccaactgggctg

SEQ ID NO: 897824 - DNA, 25 bp, Mus musculus
tgtaatcatgcatccaactgggctg

SEQ ID NO: 897825 - DNA, 25 bp, Mus musculus
tgtaatcatgggacagcctgtcttt

SEQ ID NO: 897826 - DNA, 25 bp, Mus musculus
tgtaatcatgggtcagcctgtcttt

SEQ ID NO: 897827 - DNA, 25 bp, Mus musculus
tgtaatcatttcatttccgtactta

SEQ ID NO: 897828 - DNA, 25 bp, Mus musculus
tgtaatcatttcttttccgtactta

SEQ ID NO: 897829 - DNA, 25 bp, Mus musculus
tgtaatccacatcaaagctgagctg

SEQ ID NO: 897830 - DNA, 25 bp, Mus musculus
tgtaatccacatgaaagctgagctg

SEQ ID NO: 897831 - DNA, 25 bp, Mus musculus
tgtaatccacctattcagctataag

SEQ ID NO: 897832 - DNA, 25 bp, Mus musculus
tgtaatccaccttttcagctataag

SEQ ID NO: 897833 - DNA, 25 bp, Mus musculus
tgtaatccacgcatccgagtctggt

SEQ ID NO: 897834 - DNA, 25 bp, Mus musculus
tgtaatccacgcttccgagtctggt

SEQ ID NO: 897835 - DNA, 25 bp, Mus musculus
tgtaatccatcaacagccctgctaa

SEQ ID NO: 897836 - DNA, 25 bp, Mus musculus
tgtaatccatcatcagccctgctaa

SEQ ID NO: 897837 - DNA, 25 bp, Mus musculus
tgtaatccatctccaatgcggaaaa

SEQ ID NO: 897838 - DNA, 25 bp, Mus musculus
tgtaatccatctgcaatgcggaaaa

SEQ ID NO: 897839 - DNA, 25 bp, Mus musculus
tgtaatcccagaagagacaggtgga

SEQ ID NO: 897840 - DNA, 25 bp, Mus musculus
tgtaatcccagatgagacaggtgga

SEQ ID NO: 897841 - DNA, 25 bp, Mus musculus
tgtaatcccatcctttcatggctaa

SEQ ID NO: 897842 - DNA, 25 bp, Mus musculus
tgtaatcccatcgtttcatggctaa

SEQ ID NO: 897843 - DNA, 25 bp, Mus musculus
tgtaatccccaaccggcaggccaag

SEQ ID NO: 897844 - DNA, 25 bp, Mus musculus
tgtaatccccaagcggcaggccaag

SEQ ID NO: 897845 - DNA, 25 bp, Mus musculus
tgtaatcccggcaagcactgtttat

SEQ ID NO: 897846 - DNA, 25 bp, Mus musculus
tgtaatcccggctagcactgtttat

SEQ ID NO: 897847 - DNA, 25 bp, Mus musculus
tgtaatcctcatcaatcctagctgg

SEQ ID NO: 897848 - DNA, 25 bp, Mus musculus
tgtaatcctcatgaatcctagctgg

SEQ ID NO: 897849 - DNA, 25 bp, Mus musculus
tgtaatcctcctcccgttctgttct

SEQ ID NO: 897850 - DNA, 25 bp, Mus musculus
tgtaatcctcctgccgttctgttct

SEQ ID NO: 897851 - DNA, 25 bp, Mus musculus
tgtaatcctgaacctagcattccac

SEQ ID NO: 897852 - DNA, 25 bp, Mus musculus
tgtaatcctgaagctagcattccac

SEQ ID NO: 897853 - DNA, 25 bp, Mus musculus
tgtaatcctggtcctcctggagagg

SEQ ID NO: 897854 - DNA, 25 bp, Mus musculus
tgtaatcctggtgctcctggagagg

SEQ ID NO: 897855 - DNA, 25 bp, Mus musculus
tgtaatccttgaacatttactaaga

SEQ ID NO: 897856 - DNA, 25 bp, Mus musculus
tgtaatccttgatcatttactaaga

SEQ ID NO: 897857 - DNA, 25 bp, Mus musculus
tgtaatcctttgacagctaatgcct

SEQ ID NO: 897858 - DNA, 25 bp, Mus musculus
tgtaatcctttgtcagctaatgcct

SEQ ID NO: 897859 - DNA, 25 bp, Mus musculus
tgtaatcgactacatcagggacctg

SEQ ID NO: 897860 - DNA, 25 bp, Mus musculus
tgtaatcgactagatcagggacctg

SEQ ID NO: 897861 - DNA, 25 bp, Mus musculus
tgtaatcgcagtaatgccttgctga

SEQ ID NO: 897862 - DNA, 25 bp, Mus musculus
tgtaatcgcagttatgccttgctga

SEQ ID NO: 897863 - DNA, 25 bp, Mus musculus
tgtaatcggattagcccagagccct

SEQ ID NO: 897864 - DNA, 25 bp, Mus musculus
tgtaatcggatttgcccagagccct

SEQ ID NO: 897865 - DNA, 25 bp, Mus musculus
tgtaatctccggcaacttgcatgcc

SEQ ID NO: 897866 - DNA, 25 bp, Mus musculus
tgtaatctccgggaacttgcatgcc

SEQ ID NO: 897867 - DNA, 25 bp, Mus musculus
tgtaatctgaaccacctggcaactg

SEQ ID NO: 897868 - DNA, 25 bp, Mus musculus
tgtaatctgaacgacctggcaactg

SEQ ID NO: 897869 - DNA, 25 bp, Mus musculus
tgtaatctgtgtcgccaggttccca

SEQ ID NO: 897870 - DNA, 25 bp, Mus musculus
tgtaatctgtgtggccaggttccca

SEQ ID NO: 897871 - DNA, 25 bp, Mus musculus
tgtaatcttcctcaaaccagttctg

SEQ ID NO: 897872 - DNA, 25 bp, Mus musculus
tgtaatcttcctgaaaccagttctg

SEQ ID NO: 897873 - DNA, 25 bp, Mus musculus
tgtaatcttgttacttttgttatgt

SEQ ID NO: 897874 - DNA, 25 bp, Mus musculus
tgtaatcttgtttcttttgttatgt

SEQ ID NO: 897875 - DNA, 25 bp, Mus musculus
tgtaatgaagctactgcctaatggg

SEQ ID NO: 897876 - DNA, 25 bp, Mus musculus
tgtaatgaagcttctgcctaatggg

SEQ ID NO: 897877 - DNA, 25 bp, Mus musculus
tgtaatgacattcaggcccactgct

SEQ ID NO: 897878 - DNA, 25 bp, Mus musculus
tgtaatgacattgaggcccactgct

SEQ ID NO: 897879 - DNA, 25 bp, Mus musculus
tgtaatgaccacacccataagggct

SEQ ID NO: 897880 - DNA, 25 bp, Mus musculus
tgtaatgaccactcccataagggct

SEQ ID NO: 897881 - DNA, 25 bp, Mus musculus
tgtaatgagcatcctccttggtccc

SEQ ID NO: 897882 - DNA, 25 bp, Mus musculus
tgtaatgagcatgctccttggtccc

SEQ ID NO: 897883 - DNA, 25 bp, Mus musculus
tgtaatgagtaaagaccccacccgg

SEQ ID NO: 897884 - DNA, 25 bp, Mus musculus
tgtaatgagtaatgaccccacccgg

SEQ ID NO: 897885 - DNA, 25 bp, Mus musculus
tgtaatgcaccacgtactggccctg

SEQ ID NO: 897886 - DNA, 25 bp, Mus musculus
tgtaatgcaccaggtactggccctg

SEQ ID NO: 897887 - DNA, 25 bp, Mus musculus
tgtaatgcatatcctcacccacatg

SEQ ID NO: 897888 - DNA, 25 bp, Mus musculus
tgtaatgcatatgctcacccacatg

SEQ ID NO: 897889 - DNA, 25 bp, Mus musculus
tgtaatgccggcacctgagagtggt

SEQ ID NO: 897890 - DNA, 25 bp, Mus musculus
tgtaatgccggctcctgagagtggt

SEQ ID NO: 897891 - DNA, 25 bp, Mus musculus
tgtaatgcgatcagctgccctttct

SEQ ID NO: 897892 - DNA, 25 bp, Mus musculus
tgtaatgcgatctgctgccctttct

SEQ ID NO: 897893 - DNA, 25 bp, Mus musculus
tgtaatgcgattattggctcaggtt

SEQ ID NO: 897894 - DNA, 25 bp, Mus musculus
tgtaatgcgatttttggctcaggtt

SEQ ID NO: 897895 - DNA, 25 bp, Mus musculus
tgtaatgcgcgtacttttcactggt

SEQ ID NO: 897896 - DNA, 25 bp, Mus musculus
tgtaatgcgcgttcttttcactggt

SEQ ID NO: 897897 - DNA, 25 bp, Mus musculus
tgtaatgctcacctccatcctgtaa

SEQ ID NO: 897898 - DNA, 25 bp, Mus musculus
tgtaatgctcacgtccatcctgtaa

SEQ ID NO: 897899 - DNA, 25 bp, Mus musculus
tgtaatgctgctccgtgatcagacc

SEQ ID NO: 897900 - DNA, 25 bp, Mus musculus
tgtaatgctgctgcgtgatcagacc

SEQ ID NO: 897901 - DNA, 25 bp, Mus musculus
tgtaatggatacctaggactgtggt

SEQ ID NO: 897902 - DNA, 25 bp, Mus musculus
tgtaatggatacgtaggactgtggt

SEQ ID NO: 897903 - DNA, 25 bp, Mus musculus
tgtaatggattccaaaaccctcagg

SEQ ID NO: 897904 - DNA, 25 bp, Mus musculus
tgtaatggattcgaaaaccctcagg

SEQ ID NO: 897905 - DNA, 25 bp, Mus musculus
tgtaatggccatactgtgcgacgag

SEQ ID NO: 897906 - DNA, 25 bp, Mus musculus
tgtaatggccattctgtgcgacgag

SEQ ID NO: 897907 - DNA, 25 bp, Mus musculus
tgtaatgggactcctaagccacgga

SEQ ID NO: 897908 - DNA, 25 bp, Mus musculus
tgtaatgggactgctaagccacgga

SEQ ID NO: 897909 - DNA, 25 bp, Mus musculus
tgtaatgggatgactttctaaactc

SEQ ID NO: 897910 - DNA, 25 bp, Mus musculus
tgtaatgggatgtctttctaaactc

SEQ ID NO: 897911 - DNA, 25 bp, Mus musculus
tgtaatgggcacactatccacgtta

SEQ ID NO: 897912 - DNA, 25 bp, Mus musculus
tgtaatgggcactctatccacgtta

SEQ ID NO: 897913 - DNA, 25 bp, Mus musculus
tgtaatggtcacatggctctgctgt

SEQ ID NO: 897914 - DNA, 25 bp, Mus musculus
tgtaatggtcacttggctctgctgt

SEQ ID NO: 897915 - DNA, 25 bp, Mus musculus
tgtaatgtaaccagattccagtatt

SEQ ID NO: 897916 - DNA, 25 bp, Mus musculus
tgtaatgtaacctgattccagtatt

SEQ ID NO: 897917 - DNA, 25 bp, Mus musculus
tgtaatgtacagatcccttctcaag

SEQ ID NO: 897918 - DNA, 25 bp, Mus musculus
tgtaatgtacagttcccttctcaag

SEQ ID NO: 897919 - DNA, 25 bp, Mus musculus
tgtaatgtaccccagatttctccaa

SEQ ID NO: 897920 - DNA, 25 bp, Mus musculus
tgtaatgtacccgagatttctccaa

SEQ ID NO: 897921 - DNA, 25 bp, Mus musculus
tgtaatgtacctcctacttccacac

SEQ ID NO: 897922 - DNA, 25 bp, Mus musculus
tgtaatgtacctgctacttccacac

SEQ ID NO: 897923 - DNA, 25 bp, Mus musculus
tgtaatgtgtctcgtcacgtggcct

SEQ ID NO: 897924 - DNA, 25 bp, Mus musculus
tgtaatgtgtctggtcacgtggcct

SEQ ID NO: 897925 - DNA, 25 bp, Mus musculus
tgtaatgttccacgctgtgattgaa

SEQ ID NO: 897926 - DNA, 25 bp, Mus musculus
tgtaatgttccaggctgtgattgaa

SEQ ID NO: 897927 - DNA, 25 bp, Mus musculus
tgtaatgttggtcctgtccagccac

SEQ ID NO: 897928 - DNA, 25 bp, Mus musculus
tgtaatgttggtgctgtccagccac

SEQ ID NO: 897929 - DNA, 25 bp, Mus musculus
tgtaattaaagtagctgctgcttct

SEQ ID NO: 897930 - DNA, 25 bp, Mus musculus
tgtaattaaagttgctgctgcttct

SEQ ID NO: 897931 - DNA, 25 bp, Mus musculus
tgtaattactaccaaaatcctaggg

SEQ ID NO: 897932 - DNA, 25 bp, Mus musculus
tgtaattactacgaaaatcctaggg

SEQ ID NO: 897933 - DNA, 25 bp, Mus musculus
tgtaattagagtcacccaacagatg

SEQ ID NO: 897934 - DNA, 25 bp, Mus musculus
tgtaattagagtgacccaacagatg

SEQ ID NO: 897935 - DNA, 25 bp, Mus musculus
tgtaattaggaacccgcctgcctgt

SEQ ID NO: 897936 - DNA, 25 bp, Mus musculus
tgtaattaggaagccgcctgcctgt

SEQ ID NO: 897937 - DNA, 25 bp, Mus musculus
tgtaattatgcacgcaccttccttc

SEQ ID NO: 897938 - DNA, 25 bp, Mus musculus
tgtaattatgcaggcaccttccttc

SEQ ID NO: 897939 - DNA, 25 bp, Mus musculus
tgtaattcacatatgcccaagcacg

SEQ ID NO: 897940 - DNA, 25 bp, Mus musculus
tgtaattcacatttgcccaagcacg

SEQ ID NO: 897941 - DNA, 25 bp, Mus musculus
tgtaattcagagatccctagtcagg

SEQ ID NO: 897942 - DNA, 25 bp, Mus musculus
tgtaattcagagttccctagtcagg

SEQ ID NO: 897943 - DNA, 25 bp, Mus musculus
tgtaattcatttaaaccggttgtag

SEQ ID NO: 897944 - DNA, 25 bp, Mus musculus
tgtaattcattttaaccggttgtag

SEQ ID NO: 897945 - DNA, 25 bp, Mus musculus
tgtaattccaccattccatgtctgt

SEQ ID NO: 897946 - DNA, 25 bp, Mus musculus
tgtaattccacctttccatgtctgt

SEQ ID NO: 897947 - DNA, 25 bp, Mus musculus
tgtaattcccaacagccatagtgat

SEQ ID NO: 897948 - DNA, 25 bp, Mus musculus
tgtaattcccaagagccatagtgat

SEQ ID NO: 897949 - DNA, 25 bp, Mus musculus
tgtaattcctaccagtaccgcctgg

SEQ ID NO: 897950 - DNA, 25 bp, Mus musculus
tgtaattcctacgagtaccgcctgg

SEQ ID NO: 897951 - DNA, 25 bp, Mus musculus
tgtaattctgtaacttctctgatgt

SEQ ID NO: 897952 - DNA, 25 bp, Mus musculus
tgtaattctgtatcttctctgatgt

SEQ ID NO: 897953 - DNA, 25 bp, Mus musculus
tgtaattgactactgtgacctgaac

SEQ ID NO: 897954 - DNA, 25 bp, Mus musculus
tgtaattgactagtgtgacctgaac

SEQ ID NO: 897955 - DNA, 25 bp, Mus musculus
tgtaattgcattccggccagttaat

SEQ ID NO: 897956 - DNA, 25 bp, Mus musculus
tgtaattgcattgcggccagttaat

SEQ ID NO: 897957 - DNA, 25 bp, Mus musculus
tgtaattgccatcaaccaagacccc

SEQ ID NO: 897958 - DNA, 25 bp, Mus musculus
tgtaattgccatgaaccaagacccc

SEQ ID NO: 897959 - DNA, 25 bp, Mus musculus
tgtaattggtttatacctcagttca

SEQ ID NO: 897960 - DNA, 25 bp, Mus musculus
tgtaattggtttttacctcagttca

SEQ ID NO: 897961 - DNA, 25 bp, Mus musculus
tgtaatttaaccactgcttccactg

SEQ ID NO: 897962 - DNA, 25 bp, Mus musculus
tgtaatttaacctctgcttccactg

SEQ ID NO: 897963 - DNA, 25 bp, Mus musculus
tgtaatttactcacctttaaggatt

SEQ ID NO: 897964 - DNA, 25 bp, Mus musculus
tgtaatttactctcctttaaggatt

SEQ ID NO: 897965 - DNA, 25 bp, Mus musculus
tgtaatttactgctgcccagggcct

SEQ ID NO: 897966 - DNA, 25 bp, Mus musculus
tgtaatttactggtgcccagggcct

SEQ ID NO: 897967 - DNA, 25 bp, Mus musculus
tgtaatttagctacccggcttcatg

SEQ ID NO: 897968 - DNA, 25 bp, Mus musculus
tgtaatttagcttcccggcttcatg

SEQ ID NO: 897969 - DNA, 25 bp, Mus musculus
tgtaatttatctacctgcacttttg

SEQ ID NO: 897970 - DNA, 25 bp, Mus musculus
tgtaatttatcttcctgcacttttg

SEQ ID NO: 897971 - DNA, 25 bp, Mus musculus
tgtaatttatgcacctatcctctgg

SEQ ID NO: 897972 - DNA, 25 bp, Mus musculus
tgtaatttatgctcctatcctctgg

SEQ ID NO: 897973 - DNA, 25 bp, Mus musculus
tgtaatttcaccatttccatgccag

SEQ ID NO: 897974 - DNA, 25 bp, Mus musculus
tgtaatttcaccttttccatgccag

SEQ ID NO: 897975 - DNA, 25 bp, Mus musculus
tgtaatttctaactactcccttggg

SEQ ID NO: 897976 - DNA, 25 bp, Mus musculus
tgtaatttctaagtactcccttggg

SEQ ID NO: 897977 - DNA, 25 bp, Mus musculus
tgtaatttctagcttccctcacaaa

SEQ ID NO: 897978 - DNA, 25 bp, Mus musculus
tgtaatttctaggttccctcacaaa

SEQ ID NO: 897979 - DNA, 25 bp, Mus musculus
tgtaatttctcaacaggacactggg

SEQ ID NO: 897980 - DNA, 25 bp, Mus musculus
tgtaatttctcatcaggacactggg

SEQ ID NO: 897981 - DNA, 25 bp, Mus musculus
tgtaatttgaaactggctcacccca

SEQ ID NO: 897982 - DNA, 25 bp, Mus musculus
tgtaatttgaaagtggctcacccca

SEQ ID NO: 897983 - DNA, 25 bp, Mus musculus
tgtaattttagccttagcgtgtggg

SEQ ID NO: 897984 - DNA, 25 bp, Mus musculus
tgtaattttagcgttagcgtgtggg

SEQ ID NO: 897985 - DNA, 25 bp, Mus musculus
tgtaattttagtagggctggaactc

SEQ ID NO: 897986 - DNA, 25 bp, Mus musculus
tgtaattttagttgggctggaactc

SEQ ID NO: 897987 - DNA, 25 bp, Mus musculus
tgtaattttatactgcttgaaaggt

SEQ ID NO: 897988 - DNA, 25 bp, Mus musculus
tgtaattttatagtgcttgaaaggt

SEQ ID NO: 897989 - DNA, 25 bp, Mus musculus
tgtaattttctaaaggactccgtga

SEQ ID NO: 897990 - DNA, 25 bp, Mus musculus
tgtaattttctataggactccgtga

SEQ ID NO: 897991 - DNA, 25 bp, Mus musculus
tgtaattttcttaccgggagaccat

SEQ ID NO: 897992 - DNA, 25 bp, Mus musculus
tgtaattttcttcgatttcacttaa

SEQ ID NO: 897993 - DNA, 25 bp, Mus musculus
tgtaattttcttggatttcacttaa

SEQ ID NO: 897994 - DNA, 25 bp, Mus musculus
tgtaattttctttccgggagaccat

SEQ ID NO: 897995 - DNA, 25 bp, Mus musculus
tgtaatttttagcttcacttagaat

SEQ ID NO: 897996 - DNA, 25 bp, Mus musculus
tgtaatttttaggttcacttagaat

SEQ ID NO: 897997 - DNA, 25 bp, Mus musculus
tgtacaaaagtgacctggcggccca

SEQ ID NO: 897998 - DNA, 25 bp, Mus musculus
tgtacaaaagtgtcctggcggccca

SEQ ID NO: 897999 - DNA, 25 bp, Mus musculus
tgtacaaaccgtacagctcagctga

SEQ ID NO: 898000 - DNA, 25 bp, Mus musculus
tgtacaaaccgttcagctcagctga

SEQ ID NO: 898001 - DNA, 25 bp, Mus musculus
tgtacaaactgtcctggtcaccacc

SEQ ID NO: 898002 - DNA, 25 bp, Mus musculus
tgtacaaactgtgctggtcaccacc

SEQ ID NO: 898003 - DNA, 25 bp, Mus musculus
tgtacaaagccacaacagcgccggg

SEQ ID NO: 898004 - DNA, 25 bp, Mus musculus
tgtacaaagccagaacagcgccggg

SEQ ID NO: 898005 - DNA, 25 bp, Mus musculus
tgtacaaagctaccgcgcagcctgg

SEQ ID NO: 898006 - DNA, 25 bp, Mus musculus
tgtacaaagctagcgcgcagcctgg

SEQ ID NO: 898007 - DNA, 25 bp, Mus musculus
tgtacaaagtagacctcagcctcgt

SEQ ID NO: 898008 - DNA, 25 bp, Mus musculus
tgtacaaagtagtcctcagcctcgt

SEQ ID NO: 898009 - DNA, 25 bp, Mus musculus
tgtacaaatgggagaaccaaggccc

SEQ ID NO: 898010 - DNA, 25 bp, Mus musculus
tgtacaaatgggtgaaccaaggccc

SEQ ID NO: 898011 - DNA, 25 bp, Mus musculus
tgtacaaatgttcccttagaccatt

SEQ ID NO: 898012 - DNA, 25 bp, Mus musculus
tgtacaaatgttgccttagaccatt

SEQ ID NO: 898013 - DNA, 25 bp, Mus musculus
tgtacaacaattaggctactgcctc

SEQ ID NO: 898014 - DNA, 25 bp, Mus musculus
tgtacaacaatttggctactgcctc

SEQ ID NO: 898015 - DNA, 25 bp, Mus musculus
tgtacaacagagagcttggtgcgat

SEQ ID NO: 898016 - DNA, 25 bp, Mus musculus
tgtacaacagagtgcttggtgcgat

SEQ ID NO: 898017 - DNA, 25 bp, Mus musculus
tgtacaacagccctagctgcctcag

SEQ ID NO: 898018 - DNA, 25 bp, Mus musculus
tgtacaacagccgtagctgcctcag

SEQ ID NO: 898019 - DNA, 25 bp, Mus musculus
tgtacaacccctcgaggagctggga

SEQ ID NO: 898020 - DNA, 25 bp, Mus musculus
tgtacaacccctggaggagctggga

SEQ ID NO: 898021 - DNA, 25 bp, Mus musculus
tgtacaacgggcagcagggctatta

SEQ ID NO: 898022 - DNA, 25 bp, Mus musculus
tgtacaacgggctgcagggctatta

SEQ ID NO: 898023 - DNA, 25 bp, Mus musculus
tgtacaacgtcaccgagagcaacgc

SEQ ID NO: 898024 - DNA, 25 bp, Mus musculus
tgtacaacgtcagcgagagcaacgc

SEQ ID NO: 898025 - DNA, 25 bp, Mus musculus
tgtacaactgtgctctcccaagtct

SEQ ID NO: 898026 - DNA, 25 bp, Mus musculus
tgtacaactgtggtctcccaagtct

SEQ ID NO: 898027 - DNA, 25 bp, Mus musculus
tgtacaagaagcacacaggcaagga

SEQ ID NO: 898028 - DNA, 25 bp, Mus musculus
tgtacaagaagctcacaggcaagga

SEQ ID NO: 898029 - DNA, 25 bp, Mus musculus
tgtacaagaattaccagcccactca

SEQ ID NO: 898030 - DNA, 25 bp, Mus musculus
tgtacaagaatttccagcccactca

SEQ ID NO: 898031 - DNA, 25 bp, Mus musculus
tgtacaagaccccatccagaagctg

SEQ ID NO: 898032 - DNA, 25 bp, Mus musculus
tgtacaagacccgatccagaagctg

SEQ ID NO: 898033 - DNA, 25 bp, Mus musculus
tgtacaagggtaaaggtgcctccta

SEQ ID NO: 898034 - DNA, 25 bp, Mus musculus
tgtacaagggtataggtgcctccta

SEQ ID NO: 898035 - DNA, 25 bp, Mus musculus
tgtacaagtgcgaacactgccgcgt

SEQ ID NO: 898036 - DNA, 25 bp, Mus musculus
tgtacaagtgcgtacactgccgcgt

SEQ ID NO: 898037 - DNA, 25 bp, Mus musculus
tgtacaatcaccatgccaatgcggg

SEQ ID NO: 898038 - DNA, 25 bp, Mus musculus
tgtacaatcaccttgccaatgcggg

SEQ ID NO: 898039 - DNA, 25 bp, Mus musculus
tgtacaatgattcctgatggtccgg

SEQ ID NO: 898040 - DNA, 25 bp, Mus musculus
tgtacaatgattgctgatggtccgg

SEQ ID NO: 898041 - DNA, 25 bp, Mus musculus
tgtacaattcctactcaagttcgtt

SEQ ID NO: 898042 - DNA, 25 bp, Mus musculus
tgtacaattccttctcaagttcgtt

SEQ ID NO: 898043 - DNA, 25 bp, Mus musculus
tgtacaatttcactgcacacagaat

SEQ ID NO: 898044 - DNA, 25 bp, Mus musculus
tgtacaatttcagtgcacacagaat

SEQ ID NO: 898045 - DNA, 25 bp, Mus musculus
tgtacaattttaattcagtcagaaa

SEQ ID NO: 898046 - DNA, 25 bp, Mus musculus
tgtacaattttatttcagtcagaaa

SEQ ID NO: 898047 - DNA, 25 bp, Mus musculus
tgtacacaagtcatctgtcttcaga

SEQ ID NO: 898048 - DNA, 25 bp, Mus musculus
tgtacacaagtcttctgtcttcaga

SEQ ID NO: 898049 - DNA, 25 bp, Mus musculus
tgtacacactgtaagcacacctgct

SEQ ID NO: 898050 - DNA, 25 bp, Mus musculus
tgtacacactgttagcacacctgct

SEQ ID NO: 898051 - DNA, 25 bp, Mus musculus
tgtacacaggcacgcttgactgctg

SEQ ID NO: 898052 - DNA, 25 bp, Mus musculus
tgtacacaggcaggcttgactgctg

SEQ ID NO: 898053 - DNA, 25 bp, Mus musculus
tgtacacaggcgattgtggcccggc

SEQ ID NO: 898054 - DNA, 25 bp, Mus musculus
tgtacacaggcgtttgtggcccggc

SEQ ID NO: 898055 - DNA, 25 bp, Mus musculus
tgtacacatgtcagggctcagccat

SEQ ID NO: 898056 - DNA, 25 bp, Mus musculus
tgtacacatgtctgggctcagccat

SEQ ID NO: 898057 - DNA, 25 bp, Mus musculus
tgtacacatgtgactctatgagcat

SEQ ID NO: 898058 - DNA, 25 bp, Mus musculus
tgtacacatgtgtctctatgagcat

SEQ ID NO: 898059 - DNA, 25 bp, Mus musculus
tgtacacatttgattcctgtcttga

SEQ ID NO: 898060 - DNA, 25 bp, Mus musculus
tgtacacatttgtttcctgtcttga

SEQ ID NO: 898061 - DNA, 25 bp, Mus musculus
tgtacaccaagtctgaggccttctt

SEQ ID NO: 898062 - DNA, 25 bp, Mus musculus
tgtacaccaagtgtgaggccttctt

SEQ ID NO: 898063 - DNA, 25 bp, Mus musculus
tgtacaccacgtccatcatttggtt

SEQ ID NO: 898064 - DNA, 25 bp, Mus musculus
tgtacaccacgtgcatcatttggtt

SEQ ID NO: 898065 - DNA, 25 bp, Mus musculus
tgtacaccatcaagaatcccatcgg

SEQ ID NO: 898066 - DNA, 25 bp, Mus musculus
tgtacaccatcatgaatcccatcgg

SEQ ID NO: 898067 - DNA, 25 bp, Mus musculus
tgtacaccgtcaccgacgtgccgga

SEQ ID NO: 898068 - DNA, 25 bp, Mus musculus
tgtacaccgtcagcgacgtgccgga

SEQ ID NO: 898069 - DNA, 25 bp, Mus musculus
tgtacacctcttagcagttcagaca

SEQ ID NO: 898070 - DNA, 25 bp, Mus musculus
tgtacacctctttgcagttcagaca

SEQ ID NO: 898071 - DNA, 25 bp, Mus musculus
tgtacaccttggctaatctgacagg

SEQ ID NO: 898072 - DNA, 25 bp, Mus musculus
tgtacaccttgggtaatctgacagg

SEQ ID NO: 898073 - DNA, 25 bp, Mus musculus
tgtacacgctagcaatcaccaactt

SEQ ID NO: 898074 - DNA, 25 bp, Mus musculus
tgtacacgctaggaatcaccaactt

SEQ ID NO: 898075 - DNA, 25 bp, Mus musculus
tgtacacggttgatcagtgtcgtcc

SEQ ID NO: 898076 - DNA, 25 bp, Mus musculus
tgtacacggttgttcagtgtcgtcc

SEQ ID NO: 898077 - DNA, 25 bp, Mus musculus
tgtacacgtccgcatagcttctgtc

SEQ ID NO: 898078 - DNA, 25 bp, Mus musculus
tgtacacgtccggatagcttctgtc

SEQ ID NO: 898079 - DNA, 25 bp, Mus musculus
tgtacactaatgcctgcacttgctg

SEQ ID NO: 898080 - DNA, 25 bp, Mus musculus
tgtacactaatggctgcacttgctg

SEQ ID NO: 898081 - DNA, 25 bp, Mus musculus
tgtacactcttcaggagaaatcggt

SEQ ID NO: 898082 - DNA, 25 bp, Mus musculus
tgtacactcttctggagaaatcggt

SEQ ID NO: 898083 - DNA, 25 bp, Mus musculus
tgtacactgcacctatcagccgaga

SEQ ID NO: 898084 - DNA, 25 bp, Mus musculus
tgtacactgcacgtatcagccgaga

SEQ ID NO: 898085 - DNA, 25 bp, Mus musculus
tgtacactgccacatacccatttgt

SEQ ID NO: 898086 - DNA, 25 bp, Mus musculus
tgtacactgccagatacccatttgt

SEQ ID NO: 898087 - DNA, 25 bp, Mus musculus
tgtacactgtgaccagtcagctgat

SEQ ID NO: 898088 - DNA, 25 bp, Mus musculus
tgtacactgtgagcagtcagctgat

SEQ ID NO: 898089 - DNA, 25 bp, Mus musculus
tgtacactgtgcacctactcggagt

SEQ ID NO: 898090 - DNA, 25 bp, Mus musculus
tgtacactgtgctcctactcggagt

SEQ ID NO: 898091 - DNA, 25 bp, Mus musculus
tgtacacttagactcatctcatcca

SEQ ID NO: 898092 - DNA, 25 bp, Mus musculus
tgtacacttagagtcatctcatcca

SEQ ID NO: 898093 - DNA, 25 bp, Mus musculus
tgtacacttgaaccggtagaatccc

SEQ ID NO: 898094 - DNA, 25 bp, Mus musculus
tgtacacttgaagcggtagaatccc

SEQ ID NO: 898095 - DNA, 25 bp, Mus musculus
tgtacagaatgactgggattccacc

SEQ ID NO: 898096 - DNA, 25 bp, Mus musculus
tgtacagaatgagtgggattccacc

SEQ ID NO: 898097 - DNA, 25 bp, Mus musculus
tgtacagacagaacacagaccccac

SEQ ID NO: 898098 - DNA, 25 bp, Mus musculus
tgtacagacagatcacagaccccac

SEQ ID NO: 898099 - DNA, 25 bp, Mus musculus
tgtacagagtcacgcatgttctcct

SEQ ID NO: 898100 - DNA, 25 bp, Mus musculus
tgtacagagtcaggcatgttctcct

SEQ ID NO: 898101 - DNA, 25 bp, Mus musculus
tgtacagatcggagacattgtcaca

SEQ ID NO: 898102 - DNA, 25 bp, Mus musculus
tgtacagatcggtgacattgtcaca

SEQ ID NO: 898103 - DNA, 25 bp, Mus musculus
tgtacagattccacatgtcttaggg

SEQ ID NO: 898104 - DNA, 25 bp, Mus musculus
tgtacagattcctcatgtcttaggg

SEQ ID NO: 898105 - DNA, 25 bp, Mus musculus
tgtacagattgcagcccattcagtc

SEQ ID NO: 898106 - DNA, 25 bp, Mus musculus
tgtacagattgcctgcataatgcag

SEQ ID NO: 898107 - DNA, 25 bp, Mus musculus
tgtacagattgcgtgcataatgcag

SEQ ID NO: 898108 - DNA, 25 bp, Mus musculus
tgtacagattgctgcccattcagtc

SEQ ID NO: 898109 - DNA, 25 bp, Mus musculus
tgtacagcagtcactcatgcatctg

SEQ ID NO: 898110 - DNA, 25 bp, Mus musculus
tgtacagcagtctctcatgcatctg

SEQ ID NO: 898111 - DNA, 25 bp, Mus musculus
tgtacagcagtgagtggttccatat

SEQ ID NO: 898112 - DNA, 25 bp, Mus musculus
tgtacagcagtgtgtggttccatat

SEQ ID NO: 898113 - DNA, 25 bp, Mus musculus
tgtacagcattcatgtgctctgggc

SEQ ID NO: 898114 - DNA, 25 bp, Mus musculus
tgtacagcattcttgtgctctgggc

SEQ ID NO: 898115 - DNA, 25 bp, Mus musculus
tgtacagccagaaagcctttcattt

SEQ ID NO: 898116 - DNA, 25 bp, Mus musculus
tgtacagccagatagcctttcattt

SEQ ID NO: 898117 - DNA, 25 bp, Mus musculus
tgtacagccctgattatattagaaa

SEQ ID NO: 898118 - DNA, 25 bp, Mus musculus
tgtacagccctgtttatattagaaa

SEQ ID NO: 898119 - DNA, 25 bp, Mus musculus
tgtacagcctgtacgaagatcattg

SEQ ID NO: 898120 - DNA, 25 bp, Mus musculus
tgtacagcctgttcgaagatcattg

SEQ ID NO: 898121 - DNA, 25 bp, Mus musculus
tgtacagcgcggcagatgaacacag

SEQ ID NO: 898122 - DNA, 25 bp, Mus musculus
tgtacagcgcgggagatgaacacag

SEQ ID NO: 898123 - DNA, 25 bp, Mus musculus
tgtacagctcctatgacagcagctt

SEQ ID NO: 898124 - DNA, 25 bp, Mus musculus
tgtacagctcctttgacagcagctt

SEQ ID NO: 898125 - DNA, 25 bp, Mus musculus
tgtacagctgacagcactacaggtc

SEQ ID NO: 898126 - DNA, 25 bp, Mus musculus
tgtacagctgactgcactacaggtc

SEQ ID NO: 898127 - DNA, 25 bp, Mus musculus
tgtacagctgtccaaaatcatccca

SEQ ID NO: 898128 - DNA, 25 bp, Mus musculus
tgtacagctgtcgaaaatcatccca

SEQ ID NO: 898129 - DNA, 25 bp, Mus musculus
tgtacaggcaagagtgcttctggtt

SEQ ID NO: 898130 - DNA, 25 bp, Mus musculus
tgtacaggcaagtgtgcttctggtt

SEQ ID NO: 898131 - DNA, 25 bp, Mus musculus
tgtacaggccccaaatgcagtcacg

SEQ ID NO: 898132 - DNA, 25 bp, Mus musculus
tgtacaggcccctaatgcagtcacg

SEQ ID NO: 898133 - DNA, 25 bp, Mus musculus
tgtacagggttacgatacctcgact

SEQ ID NO: 898134 - DNA, 25 bp, Mus musculus
tgtacagggttaggatacctcgact

SEQ ID NO: 898135 - DNA, 25 bp, Mus musculus
tgtacagggtttcgttgtgtagccc

SEQ ID NO: 898136 - DNA, 25 bp, Mus musculus
tgtacagggtttggttgtgtagccc

SEQ ID NO: 898137 - DNA, 25 bp, Mus musculus
tgtacaggtcagctctctccattac

SEQ ID NO: 898138 - DNA, 25 bp, Mus musculus
tgtacaggtcaggtctctccattac

SEQ ID NO: 898139 - DNA, 25 bp, Mus musculus
tgtacaggtctgattcttcctcgca

SEQ ID NO: 898140 - DNA, 25 bp, Mus musculus
tgtacaggtctgtttcttcctcgca

SEQ ID NO: 898141 - DNA, 25 bp, Mus musculus
tgtacagtagctatccccattcatt

SEQ ID NO: 898142 - DNA, 25 bp, Mus musculus
tgtacagtagctttccccattcatt

SEQ ID NO: 898143 - DNA, 25 bp, Mus musculus
tgtacagtagtcctgtggcacccta

SEQ ID NO: 898144 - DNA, 25 bp, Mus musculus
tgtacagtagtcgtgtggcacccta

SEQ ID NO: 898145 - DNA, 25 bp, Mus musculus
tgtacagtcaccatcacctgctgat

SEQ ID NO: 898146 - DNA, 25 bp, Mus musculus
tgtacagtcaccttcacctgctgat

SEQ ID NO: 898147 - DNA, 25 bp, Mus musculus
tgtacagtccatcctggtggcaggt

SEQ ID NO: 898148 - DNA, 25 bp, Mus musculus
tgtacagtccatgctggtggcaggt

SEQ ID NO: 898149 - DNA, 25 bp, Mus musculus
tgtacagtctgcagtttgtcattca

SEQ ID NO: 898150 - DNA, 25 bp, Mus musculus
tgtacagtctgctgtttgtcattca

SEQ ID NO: 898151 - DNA, 25 bp, Mus musculus
tgtacagtgagtattccccttttct

SEQ ID NO: 898152 - DNA, 25 bp, Mus musculus
tgtacagtgagttttccccttttct

SEQ ID NO: 898153 - DNA, 25 bp, Mus musculus
tgtacagtggaccttgctatctacc

SEQ ID NO: 898154 - DNA, 25 bp, Mus musculus
tgtacagtggacgttgctatctacc

SEQ ID NO: 898155 - DNA, 25 bp, Mus musculus
tgtacagtggcaatacagcgcctga

SEQ ID NO: 898156 - DNA, 25 bp, Mus musculus
tgtacagtggcattacagcgcctga

SEQ ID NO: 898157 - DNA, 25 bp, Mus musculus
tgtacagtgggcaacctcgggcaga

SEQ ID NO: 898158 - DNA, 25 bp, Mus musculus
tgtacagtgggctacctcgggcaga

SEQ ID NO: 898159 - DNA, 25 bp, Mus musculus
tgtacagttcatctatattgattgt

SEQ ID NO: 898160 - DNA, 25 bp, Mus musculus
tgtacagttcatgtatattgattgt

SEQ ID NO: 898161 - DNA, 25 bp, Mus musculus
tgtacagtttttacaatccctgttt

SEQ ID NO: 898162 - DNA, 25 bp, Mus musculus
tgtacagttttttcaatccctgttt

SEQ ID NO: 898163 - DNA, 25 bp, Mus musculus
tgtacataaactaccaacctgcatt

SEQ ID NO: 898164 - DNA, 25 bp, Mus musculus
tgtacataaactacctgtccttagc

SEQ ID NO: 898165 - DNA, 25 bp, Mus musculus
tgtacataaacttccaacctgcatt

SEQ ID NO: 898166 - DNA, 25 bp, Mus musculus
tgtacataaacttcctgtccttagc

SEQ ID NO: 898167 - DNA, 25 bp, Mus musculus
tgtacataaggtcttgcccaacagc

SEQ ID NO: 898168 - DNA, 25 bp, Mus musculus
tgtacataaggtgttgcccaacagc

SEQ ID NO: 898169 - DNA, 25 bp, Mus musculus
tgtacatacaagcagtgcaggcaac

SEQ ID NO: 898170 - DNA, 25 bp, Mus musculus
tgtacatacaaggagtgcaggcaac

SEQ ID NO: 898171 - DNA, 25 bp, Mus musculus
tgtacatacctgatccctcgggttt

SEQ ID NO: 898172 - DNA, 25 bp, Mus musculus
tgtacatacctgttccctcgggttt

SEQ ID NO: 898173 - DNA, 25 bp, Mus musculus
tgtacatactcacacatgcgccatg

SEQ ID NO: 898174 - DNA, 25 bp, Mus musculus
tgtacatactcagacatgcgccatg

SEQ ID NO: 898175 - DNA, 25 bp, Mus musculus
tgtacatactctctgttagactccc

SEQ ID NO: 898176 - DNA, 25 bp, Mus musculus
tgtacatactctgtgttagactccc

SEQ ID NO: 898177 - DNA, 25 bp, Mus musculus
tgtacatactgaacggaccttcttt

SEQ ID NO: 898178 - DNA, 25 bp, Mus musculus
tgtacatactgatcggaccttcttt

SEQ ID NO: 898179 - DNA, 25 bp, Mus musculus
tgtacatactgcatgtccagctgga

SEQ ID NO: 898180 - DNA, 25 bp, Mus musculus
tgtacatactgcttgtccagctgga

SEQ ID NO: 898181 - DNA, 25 bp, Mus musculus
tgtacatagcggacgccttcctttt

SEQ ID NO: 898182 - DNA, 25 bp, Mus musculus
tgtacatagcggtcgccttcctttt

SEQ ID NO: 898183 - DNA, 25 bp, Mus musculus
tgtacataggacagcgaccctcggg

SEQ ID NO: 898184 - DNA, 25 bp, Mus musculus
tgtacataggactgcgaccctcggg

SEQ ID NO: 898185 - DNA, 25 bp, Mus musculus
tgtacatatacaacacacttggtgg

SEQ ID NO: 898186 - DNA, 25 bp, Mus musculus
tgtacatatacatcacacttggtgg

SEQ ID NO: 898187 - DNA, 25 bp, Mus musculus
tgtacatatgtacccaccagaaact

SEQ ID NO: 898188 - DNA, 25 bp, Mus musculus
tgtacatatgtagccaccagaaact

SEQ ID NO: 898189 - DNA, 25 bp, Mus musculus
tgtacatattgccttcagtacccct

SEQ ID NO: 898190 - DNA, 25 bp, Mus musculus
tgtacatattgcgttcagtacccct

SEQ ID NO: 898191 - DNA, 25 bp, Mus musculus
tgtacatcccttatactaactcata

SEQ ID NO: 898192 - DNA, 25 bp, Mus musculus
tgtacatcccttttactaactcata

SEQ ID NO: 898193 - DNA, 25 bp, Mus musculus
tgtacatcctcacctcacagtgact

SEQ ID NO: 898194 - DNA, 25 bp, Mus musculus
tgtacatcctcagctcacagtgact

SEQ ID NO: 898195 - DNA, 25 bp, Mus musculus
tgtacatcctgactcatcacagctt

SEQ ID NO: 898196 - DNA, 25 bp, Mus musculus
tgtacatcctgagtcatcacagctt

SEQ ID NO: 898197 - DNA, 25 bp, Mus musculus
tgtacatcgatgaccagggctttgg

SEQ ID NO: 898198 - DNA, 25 bp, Mus musculus
tgtacatcgatgtccagggctttgg

SEQ ID NO: 898199 - DNA, 25 bp, Mus musculus
tgtacatcgggaacctcagcgacca

SEQ ID NO: 898200 - DNA, 25 bp, Mus musculus
tgtacatcgggatcctcagcgacca

SEQ ID NO: 898201 - DNA, 25 bp, Mus musculus
tgtacatcgtgtacatgctgggctc

SEQ ID NO: 898202 - DNA, 25 bp, Mus musculus
tgtacatcgtgttcatgctgggctc

SEQ ID NO: 898203 - DNA, 25 bp, Mus musculus
tgtacatctagtctgtgcctggctc

SEQ ID NO: 898204 - DNA, 25 bp, Mus musculus
tgtacatctagtgtgtgcctggctc

SEQ ID NO: 898205 - DNA, 25 bp, Mus musculus
tgtacatctatcatctctggactcg

SEQ ID NO: 898206 - DNA, 25 bp, Mus musculus
tgtacatctatcttctctggactcg

SEQ ID NO: 898207 - DNA, 25 bp, Mus musculus
tgtacatctccaagaggtgtcctca

SEQ ID NO: 898208 - DNA, 25 bp, Mus musculus
tgtacatctccatgaggtgtcctca

SEQ ID NO: 898209 - DNA, 25 bp, Mus musculus
tgtacatgatttatgtatgtttcct

SEQ ID NO: 898210 - DNA, 25 bp, Mus musculus
tgtacatgatttttgtatgtttcct

SEQ ID NO: 898211 - DNA, 25 bp, Mus musculus
tgtacatggcatatggacgagagta

SEQ ID NO: 898212 - DNA, 25 bp, Mus musculus
tgtacatggcatttggacgagagta

SEQ ID NO: 898213 - DNA, 25 bp, Mus musculus
tgtacatggctcctttacctacaca

SEQ ID NO: 898214 - DNA, 25 bp, Mus musculus
tgtacatggctcgtttacctacaca

SEQ ID NO: 898215 - DNA, 25 bp, Mus musculus
tgtacatgtaggatcaatcccagca

SEQ ID NO: 898216 - DNA, 25 bp, Mus musculus
tgtacatgtaggttcaatcccagca

SEQ ID NO: 898217 - DNA, 25 bp, Mus musculus
tgtacattactcaagcagctgggct

SEQ ID NO: 898218 - DNA, 25 bp, Mus musculus
tgtacattactctagcagctgggct

SEQ ID NO: 898219 - DNA, 25 bp, Mus musculus
tgtacattcacaactgtccatcttg

SEQ ID NO: 898220 - DNA, 25 bp, Mus musculus
tgtacattcacatctgtccatcttg

SEQ ID NO: 898221 - DNA, 25 bp, Mus musculus
tgtacattcttaagccggcttcaaa

SEQ ID NO: 898222 - DNA, 25 bp, Mus musculus
tgtacattcttatgccggcttcaaa

SEQ ID NO: 898223 - DNA, 25 bp, Mus musculus
tgtacattggatcctggtggtgcat

SEQ ID NO: 898224 - DNA, 25 bp, Mus musculus
tgtacattggatgctggtggtgcat

SEQ ID NO: 898225 - DNA, 25 bp, Mus musculus
tgtacattgggcatacctttcttca

SEQ ID NO: 898226 - DNA, 25 bp, Mus musculus
tgtacattgggcttacctttcttca

SEQ ID NO: 898227 - DNA, 25 bp, Mus musculus
tgtacattgttcacaggcggtcttg

SEQ ID NO: 898228 - DNA, 25 bp, Mus musculus
tgtacattgttctcaggcggtcttg

SEQ ID NO: 898229 - DNA, 25 bp, Mus musculus
tgtacattttagctactaccttgag

SEQ ID NO: 898230 - DNA, 25 bp, Mus musculus
tgtacattttaggtactaccttgag

SEQ ID NO: 898231 - DNA, 25 bp, Mus musculus
tgtacattttcgctctatgaagagt

SEQ ID NO: 898232 - DNA, 25 bp, Mus musculus
tgtacattttcggtctatgaagagt

SEQ ID NO: 898233 - DNA, 25 bp, Mus musculus
tgtaccaaaagacaaattcagttta

SEQ ID NO: 898234 - DNA, 25 bp, Mus musculus
tgtaccaaaagagaaattcagttta

SEQ ID NO: 898235 - DNA, 25 bp, Mus musculus
tgtaccaaaatgatggcagccttat

SEQ ID NO: 898236 - DNA, 25 bp, Mus musculus
tgtaccaaaatgttggcagccttat

SEQ ID NO: 898237 - DNA, 25 bp, Mus musculus
tgtaccaaacccacagaaagcagac

SEQ ID NO: 898238 - DNA, 25 bp, Mus musculus
tgtaccaaaccctcagaaagcagac

SEQ ID NO: 898239 - DNA, 25 bp, Mus musculus
tgtaccaagctgactgaatttctca

SEQ ID NO: 898240 - DNA, 25 bp, Mus musculus
tgtaccaagctgtctgaatttctca

SEQ ID NO: 898241 - DNA, 25 bp, Mus musculus
tgtaccaaggcaagtgtgagaatca

SEQ ID NO: 898242 - DNA, 25 bp, Mus musculus
tgtaccaaggcatgtgtgagaatca

SEQ ID NO: 898243 - DNA, 25 bp, Mus musculus
tgtaccacagctagtcttgaaggcc

SEQ ID NO: 898244 - DNA, 25 bp, Mus musculus
tgtaccacagcttgtcttgaaggcc

SEQ ID NO: 898245 - DNA, 25 bp, Mus musculus
tgtaccactacaagactatgaggcc

SEQ ID NO: 898246 - DNA, 25 bp, Mus musculus
tgtaccactacatgactatgaggcc

SEQ ID NO: 898247 - DNA, 25 bp, Mus musculus
tgtaccactatgactttatccatgt

SEQ ID NO: 898248 - DNA, 25 bp, Mus musculus
tgtaccactatgtctttatccatgt

SEQ ID NO: 898249 - DNA, 25 bp, Mus musculus
tgtaccactgttccctttaaacctt

SEQ ID NO: 898250 - DNA, 25 bp, Mus musculus
tgtaccactgttgcctttaaacctt

SEQ ID NO: 898251 - DNA, 25 bp, Mus musculus
tgtaccacttttccagacactgctg

SEQ ID NO: 898252 - DNA, 25 bp, Mus musculus
tgtaccacttttgcagacactgctg

SEQ ID NO: 898253 - DNA, 25 bp, Mus musculus
tgtaccagaattactacgcgcacct

SEQ ID NO: 898254 - DNA, 25 bp, Mus musculus
tgtaccagaatttctacgcgcacct

SEQ ID NO: 898255 - DNA, 25 bp, Mus musculus
tgtaccagcagaccagcgggcacaa

SEQ ID NO: 898256 - DNA, 25 bp, Mus musculus
tgtaccagcagagcagcgggcacaa

SEQ ID NO: 898257 - DNA, 25 bp, Mus musculus
tgtaccagcgcaagccttggaaaga

SEQ ID NO: 898258 - DNA, 25 bp, Mus musculus
tgtaccagcgcatgccttggaaaga

SEQ ID NO: 898259 - DNA, 25 bp, Mus musculus
tgtaccagctaaatcagcggtccca

SEQ ID NO: 898260 - DNA, 25 bp, Mus musculus
tgtaccagctaattcagcggtccca

SEQ ID NO: 898261 - DNA, 25 bp, Mus musculus
tgtaccagctcaccaagggctctgc

SEQ ID NO: 898262 - DNA, 25 bp, Mus musculus
tgtaccagctcagcaagggctctgc

SEQ ID NO: 898263 - DNA, 25 bp, Mus musculus
tgtaccagcttgaggacacatgtcc

SEQ ID NO: 898264 - DNA, 25 bp, Mus musculus
tgtaccagcttgtggacacatgtcc

SEQ ID NO: 898265 - DNA, 25 bp, Mus musculus
tgtaccaggagccatatccacggat

SEQ ID NO: 898266 - DNA, 25 bp, Mus musculus
tgtaccaggagcgatatccacggat

SEQ ID NO: 898267 - DNA, 25 bp, Mus musculus
tgtaccaggcaacagctccagttct

SEQ ID NO: 898268 - DNA, 25 bp, Mus musculus
tgtaccaggcaagagctccagttct

SEQ ID NO: 898269 - DNA, 25 bp, Mus musculus
tgtaccaggctgcaagacacctcca

SEQ ID NO: 898270 - DNA, 25 bp, Mus musculus
tgtaccaggctggaagacacctcca

SEQ ID NO: 898271 - DNA, 25 bp, Mus musculus
tgtaccagtcccagctgtttcctgt

SEQ ID NO: 898272 - DNA, 25 bp, Mus musculus
tgtaccagtccctgctgtttcctgt

SEQ ID NO: 898273 - DNA, 25 bp, Mus musculus
tgtaccagttgcctccacacgataa

SEQ ID NO: 898274 - DNA, 25 bp, Mus musculus
tgtaccagttgcgtccacacgataa

SEQ ID NO: 898275 - DNA, 25 bp, Mus musculus
tgtaccatatataagccaaggaatg

SEQ ID NO: 898276 - DNA, 25 bp, Mus musculus
tgtaccatatattagccaaggaatg

SEQ ID NO: 898277 - DNA, 25 bp, Mus musculus
tgtaccatatcccagctgctttctg

SEQ ID NO: 898278 - DNA, 25 bp, Mus musculus
tgtaccatatccgagctgctttctg

SEQ ID NO: 898279 - DNA, 25 bp, Mus musculus
tgtaccatatgcactacactggtat

SEQ ID NO: 898280 - DNA, 25 bp, Mus musculus
tgtaccatatgctctacactggtat

SEQ ID NO: 898281 - DNA, 25 bp, Mus musculus
tgtaccatcgcacaaaacatctcgg

SEQ ID NO: 898282 - DNA, 25 bp, Mus musculus
tgtaccatcgcagaaaacatctcgg

SEQ ID NO: 898283 - DNA, 25 bp, Mus musculus
tgtaccatctttacacctcgagatc

SEQ ID NO: 898284 - DNA, 25 bp, Mus musculus
tgtaccatcttttcacctcgagatc

SEQ ID NO: 898285 - DNA, 25 bp, Mus musculus
tgtaccatgaagaagagcacagaag

SEQ ID NO: 898286 - DNA, 25 bp, Mus musculus
tgtaccatgaagtagagcacagaag

SEQ ID NO: 898287 - DNA, 25 bp, Mus musculus
tgtaccatgccaactgtgccagtgt

SEQ ID NO: 898288 - DNA, 25 bp, Mus musculus
tgtaccatgccatctgtgccagtgt

SEQ ID NO: 898289 - DNA, 25 bp, Mus musculus
tgtaccattataccccatttaattg

SEQ ID NO: 898290 - DNA, 25 bp, Mus musculus
tgtaccattatagcccatttaattg

SEQ ID NO: 898291 - DNA, 25 bp, Mus musculus
tgtaccattcaaccttttcttgcag

SEQ ID NO: 898292 - DNA, 25 bp, Mus musculus
tgtaccattcaagcttttcttgcag

SEQ ID NO: 898293 - DNA, 25 bp, Mus musculus
tgtaccattggcagacagcttccgg

SEQ ID NO: 898294 - DNA, 25 bp, Mus musculus
tgtaccattggctgacagcttccgg

SEQ ID NO: 898295 - DNA, 25 bp, Mus musculus
tgtacccaaccaatcagctttaaac

SEQ ID NO: 898296 - DNA, 25 bp, Mus musculus
tgtacccaaccattcagctttaaac

SEQ ID NO: 898297 - DNA, 25 bp, Mus musculus
tgtacccaaggaaacaggcttccct

SEQ ID NO: 898298 - DNA, 25 bp, Mus musculus
tgtacccaaggatacaggcttccct

SEQ ID NO: 898299 - DNA, 25 bp, Mus musculus
tgtacccacagtagttgcatccaat

SEQ ID NO: 898300 - DNA, 25 bp, Mus musculus
tgtacccacagttgttgcatccaat

SEQ ID NO: 898301 - DNA, 25 bp, Mus musculus
tgtacccaccagacactggcaagag

SEQ ID NO: 898302 - DNA, 25 bp, Mus musculus
tgtacccaccagtcactggcaagag

SEQ ID NO: 898303 - DNA, 25 bp, Mus musculus
tgtacccagagactgccaagaacct

SEQ ID NO: 898304 - DNA, 25 bp, Mus musculus
tgtacccagagagtgccaagaacct

SEQ ID NO: 898305 - DNA, 25 bp, Mus musculus
tgtacccagcggagttagcgcctgc

SEQ ID NO: 898306 - DNA, 25 bp, Mus musculus
tgtacccagcggtgttagcgcctgc

SEQ ID NO: 898307 - DNA, 25 bp, Mus musculus
tgtacccagctgaacaccagagtgg

SEQ ID NO: 898308 - DNA, 25 bp, Mus musculus
tgtacccagctgtacaccagagtgg

SEQ ID NO: 898309 - DNA, 25 bp, Mus musculus
tgtacccaggccctaaagacccaga

SEQ ID NO: 898310 - DNA, 25 bp, Mus musculus
tgtacccaggccgtaaagacccaga

SEQ ID NO: 898311 - DNA, 25 bp, Mus musculus
tgtacccagtccataatgggcgagt

SEQ ID NO: 898312 - DNA, 25 bp, Mus musculus
tgtacccagtccttaatgggcgagt

SEQ ID NO: 898313 - DNA, 25 bp, Mus musculus
tgtacccagtgcattgtactgagtg

SEQ ID NO: 898314 - DNA, 25 bp, Mus musculus
tgtacccagtgctttgtactgagtg

SEQ ID NO: 898315 - DNA, 25 bp, Mus musculus
tgtacccatacacccggcaaaagga

SEQ ID NO: 898316 - DNA, 25 bp, Mus musculus
tgtacccatacagccggcaaaagga

SEQ ID NO: 898317 - DNA, 25 bp, Mus musculus
tgtacccatggacactagcaaaata

SEQ ID NO: 898318 - DNA, 25 bp, Mus musculus
tgtacccatggagactagcaaaata

SEQ ID NO: 898319 - DNA, 25 bp, Mus musculus
tgtacccatgggaaccgtttgtgaa

SEQ ID NO: 898320 - DNA, 25 bp, Mus musculus
tgtacccatgggtaccgtttgtgaa

SEQ ID NO: 898321 - DNA, 25 bp, Mus musculus
tgtaccccaaggaacagacactcag

SEQ ID NO: 898322 - DNA, 25 bp, Mus musculus
tgtaccccaaggtacagacactcag

SEQ ID NO: 898323 - DNA, 25 bp, Mus musculus
tgtaccccagagcagatgagaactt

SEQ ID NO: 898324 - DNA, 25 bp, Mus musculus
tgtaccccagaggagatgagaactt

SEQ ID NO: 898325 - DNA, 25 bp, Mus musculus
tgtaccccaggtcagcataaccttg

SEQ ID NO: 898326 - DNA, 25 bp, Mus musculus
tgtaccccaggtgagcataaccttg

SEQ ID NO: 898327 - DNA, 25 bp, Mus musculus
tgtaccccatccataaggttttctg

SEQ ID NO: 898328 - DNA, 25 bp, Mus musculus
tgtaccccatccttaaggttttctg

SEQ ID NO: 898329 - DNA, 25 bp, Mus musculus
tgtaccccattgagacggagcactt

SEQ ID NO: 898330 - DNA, 25 bp, Mus musculus
tgtaccccattgtgacggagcactt

SEQ ID NO: 898331 - DNA, 25 bp, Mus musculus
tgtacccctgttcaaggtctacgta

SEQ ID NO: 898332 - DNA, 25 bp, Mus musculus
tgtacccctgttgaaggtctacgta

SEQ ID NO: 898333 - DNA, 25 bp, Mus musculus
tgtaccccttcactgcaactgagaa

SEQ ID NO: 898334 - DNA, 25 bp, Mus musculus
tgtaccccttcagtgcaactgagaa

SEQ ID NO: 898335 - DNA, 25 bp, Mus musculus
tgtacccgcctgcagagcagaccat

SEQ ID NO: 898336 - DNA, 25 bp, Mus musculus
tgtacccgcctggagagcagaccat

SEQ ID NO: 898337 - DNA, 25 bp, Mus musculus
tgtacccggaatatacactctgtat

SEQ ID NO: 898338 - DNA, 25 bp, Mus musculus
tgtacccggaatttacactctgtat

SEQ ID NO: 898339 - DNA, 25 bp, Mus musculus
tgtaccctaaagcaggctgctgtga

SEQ ID NO: 898340 - DNA, 25 bp, Mus musculus
tgtaccctaaaggaggctgctgtga

SEQ ID NO: 898341 - DNA, 25 bp, Mus musculus
tgtaccctaaatcccaaggtcaggt

SEQ ID NO: 898342 - DNA, 25 bp, Mus musculus
tgtaccctaaatgccaaggtcaggt

SEQ ID NO: 898343 - DNA, 25 bp, Mus musculus
tgtaccctaacccttgtcaaggctg

SEQ ID NO: 898344 - DNA, 25 bp, Mus musculus
tgtaccctaaccgttgtcaaggctg

SEQ ID NO: 898345 - DNA, 25 bp, Mus musculus
tgtaccctaggtaaccaagctgact

SEQ ID NO: 898346 - DNA, 25 bp, Mus musculus
tgtaccctaggttaccaagctgact

SEQ ID NO: 898347 - DNA, 25 bp, Mus musculus
tgtaccctcatcactgctcaggtta

SEQ ID NO: 898348 - DNA, 25 bp, Mus musculus
tgtaccctcatctctgctcaggtta

SEQ ID NO: 898349 - DNA, 25 bp, Mus musculus
tgtaccctccgaaagcgttttgtaa

SEQ ID NO: 898350 - DNA, 25 bp, Mus musculus
tgtaccctccgatagcgttttgtaa

SEQ ID NO: 898351 - DNA, 25 bp, Mus musculus
tgtaccctctatcctggtcaggatg

SEQ ID NO: 898352 - DNA, 25 bp, Mus musculus
tgtaccctctatgctggtcaggatg

SEQ ID NO: 898353 - DNA, 25 bp, Mus musculus
tgtaccctctccattaggaatggct

SEQ ID NO: 898354 - DNA, 25 bp, Mus musculus
tgtaccctctcctttaggaatggct

SEQ ID NO: 898355 - DNA, 25 bp, Mus musculus
tgtaccctctggatagcttcgtcac

SEQ ID NO: 898356 - DNA, 25 bp, Mus musculus
tgtaccctctggttagcttcgtcac

SEQ ID NO: 898357 - DNA, 25 bp, Mus musculus
tgtaccctgaagatgccattggcca

SEQ ID NO: 898358 - DNA, 25 bp, Mus musculus
tgtaccctgaagttgccattggcca

SEQ ID NO: 898359 - DNA, 25 bp, Mus musculus
tgtaccctgactagattatctgcta

SEQ ID NO: 898360 - DNA, 25 bp, Mus musculus
tgtaccctgacttgattatctgcta

SEQ ID NO: 898361 - DNA, 25 bp, Mus musculus
tgtaccctgaggctgtttgctgaac

SEQ ID NO: 898362 - DNA, 25 bp, Mus musculus
tgtaccctgagggtgtttgctgaac

SEQ ID NO: 898363 - DNA, 25 bp, Mus musculus
tgtaccctggtcaggcctgaggatc

SEQ ID NO: 898364 - DNA, 25 bp, Mus musculus
tgtaccctggtctggcctgaggatc

SEQ ID NO: 898365 - DNA, 25 bp, Mus musculus
tgtacccttccaaagcagctagtgt

SEQ ID NO: 898366 - DNA, 25 bp, Mus musculus
tgtacccttccatagcagctagtgt

SEQ ID NO: 898367 - DNA, 25 bp, Mus musculus
tgtacccttgcaaactgttccacac

SEQ ID NO: 898368 - DNA, 25 bp, Mus musculus
tgtacccttgcatactgttccacac

SEQ ID NO: 898369 - DNA, 25 bp, Mus musculus
tgtacccttggactggctcctacct

SEQ ID NO: 898370 - DNA, 25 bp, Mus musculus
tgtacccttggagtggctcctacct

SEQ ID NO: 898371 - DNA, 25 bp, Mus musculus
tgtacccttgtcagtgggagcacag

SEQ ID NO: 898372 - DNA, 25 bp, Mus musculus
tgtacccttgtcctggttgaaacca

SEQ ID NO: 898373 - DNA, 25 bp, Mus musculus
tgtacccttgtcgtggttgaaacca

SEQ ID NO: 898374 - DNA, 25 bp, Mus musculus
tgtacccttgtctgtgggagcacag

SEQ ID NO: 898375 - DNA, 25 bp, Mus musculus
tgtacccttgtgacaagaccccaaa

SEQ ID NO: 898376 - DNA, 25 bp, Mus musculus
tgtacccttgtgtcaagaccccaaa

SEQ ID NO: 898377 - DNA, 25 bp, Mus musculus
tgtacccttgttaatggtgtgcccg

SEQ ID NO: 898378 - DNA, 25 bp, Mus musculus
tgtacccttgtttatggtgtgcccg

SEQ ID NO: 898379 - DNA, 25 bp, Mus musculus
tgtaccctttatctggctttcccca

SEQ ID NO: 898380 - DNA, 25 bp, Mus musculus
tgtaccctttatgtggctttcccca

SEQ ID NO: 898381 - DNA, 25 bp, Mus musculus
tgtaccgaaaagcacaaagtctctt

SEQ ID NO: 898382 - DNA, 25 bp, Mus musculus
tgtaccgaaaaggacaaagtctctt

SEQ ID NO: 898383 - DNA, 25 bp, Mus musculus
tgtaccgagaaccatccttgcatga

SEQ ID NO: 898384 - DNA, 25 bp, Mus musculus
tgtaccgagaacgatccttgcatga

SEQ ID NO: 898385 - DNA, 25 bp, Mus musculus
tgtaccgatctccagagaccatgat

SEQ ID NO: 898386 - DNA, 25 bp, Mus musculus
tgtaccgatctcgagagaccatgat

SEQ ID NO: 898387 - DNA, 25 bp, Mus musculus
tgtaccgatgatccagaccatccta

SEQ ID NO: 898388 - DNA, 25 bp, Mus musculus
tgtaccgatgatgcagaccatccta

SEQ ID NO: 898389 - DNA, 25 bp, Mus musculus
tgtaccgcaagacgatccagccatg

SEQ ID NO: 898390 - DNA, 25 bp, Mus musculus
tgtaccgcaagaggatccagccatg

SEQ ID NO: 898391 - DNA, 25 bp, Mus musculus
tgtaccgcaagcatatgcctcatga

SEQ ID NO: 898392 - DNA, 25 bp, Mus musculus
tgtaccgcaagcttatgcctcatga

SEQ ID NO: 898393 - DNA, 25 bp, Mus musculus
tgtaccgcaagtatcaacctcagag

SEQ ID NO: 898394 - DNA, 25 bp, Mus musculus
tgtaccgcaagtttcaacctcagag

SEQ ID NO: 898395 - DNA, 25 bp, Mus musculus
tgtaccgcctgacatccagtgccag

SEQ ID NO: 898396 - DNA, 25 bp, Mus musculus
tgtaccgcctgagatccagtgccag

SEQ ID NO: 898397 - DNA, 25 bp, Mus musculus
tgtaccgcgaggcacccattgataa

SEQ ID NO: 898398 - DNA, 25 bp, Mus musculus
tgtaccgcgagggacccattgataa

SEQ ID NO: 898399 - DNA, 25 bp, Mus musculus
tgtaccgcggcacggagtcagacat

SEQ ID NO: 898400 - DNA, 25 bp, Mus musculus
tgtaccgcggcagggagtcagacat

SEQ ID NO: 898401 - DNA, 25 bp, Mus musculus
tgtaccgctgtgcccgtgtcagctc

SEQ ID NO: 898402 - DNA, 25 bp, Mus musculus
tgtaccgctgtggccgtgtcagctc

SEQ ID NO: 898403 - DNA, 25 bp, Mus musculus
tgtaccgggaaaaagtggacatatt

SEQ ID NO: 898404 - DNA, 25 bp, Mus musculus
tgtaccgggaaatagtggacatatt

SEQ ID NO: 898405 - DNA, 25 bp, Mus musculus
tgtaccgtcacgactgcagcagagg

SEQ ID NO: 898406 - DNA, 25 bp, Mus musculus
tgtaccgtcacgtctgcagcagagg

SEQ ID NO: 898407 - DNA, 25 bp, Mus musculus
tgtaccgtctaccaaggccagaaca

SEQ ID NO: 898408 - DNA, 25 bp, Mus musculus
tgtaccgtctacgaaggccagaaca

SEQ ID NO: 898409 - DNA, 25 bp, Mus musculus
tgtaccgtggtcaccctgaagtata

SEQ ID NO: 898410 - DNA, 25 bp, Mus musculus
tgtaccgtggtctccctgaagtata

SEQ ID NO: 898411 - DNA, 25 bp, Mus musculus
tgtaccgtgtacatcaacttgagag

SEQ ID NO: 898412 - DNA, 25 bp, Mus musculus
tgtaccgtgtacttcaacttgagag

SEQ ID NO: 898413 - DNA, 25 bp, Mus musculus
tgtaccgtgtgcaggcagagatcag

SEQ ID NO: 898414 - DNA, 25 bp, Mus musculus
tgtaccgtgtgctggcagagatcag

SEQ ID NO: 898415 - DNA, 25 bp, Mus musculus
tgtaccgtgtggcagccttgcactt

SEQ ID NO: 898416 - DNA, 25 bp, Mus musculus
tgtaccgtgtgggagccttgcactt

SEQ ID NO: 898417 - DNA, 25 bp, Mus musculus
tgtaccgttcatacccatgacatgc

SEQ ID NO: 898418 - DNA, 25 bp, Mus musculus
tgtaccgttcattcccatgacatgc

SEQ ID NO: 898419 - DNA, 25 bp, Mus musculus
tgtaccgttgcgaccacagtgtgca

SEQ ID NO: 898420 - DNA, 25 bp, Mus musculus
tgtaccgttgcgtccacagtgtgca

SEQ ID NO: 898421 - DNA, 25 bp, Mus musculus
tgtaccgttggtaatggcgcctgat

SEQ ID NO: 898422 - DNA, 25 bp, Mus musculus
tgtaccgttggttatggcgcctgat

SEQ ID NO: 898423 - DNA, 25 bp, Mus musculus
tgtaccgttttcattcattgtcacc

SEQ ID NO: 898424 - DNA, 25 bp, Mus musculus
tgtaccgttttctttcattgtcacc

SEQ ID NO: 898425 - DNA, 25 bp, Mus musculus
tgtacctaagcccagcatggtagtt

SEQ ID NO: 898426 - DNA, 25 bp, Mus musculus
tgtacctaagccgagcatggtagtt

SEQ ID NO: 898427 - DNA, 25 bp, Mus musculus
tgtacctaagttctcactatcacca

SEQ ID NO: 898428 - DNA, 25 bp, Mus musculus
tgtacctaagttgtcactatcacca

SEQ ID NO: 898429 - DNA, 25 bp, Mus musculus
tgtacctaccagagagaggtcgtga

SEQ ID NO: 898430 - DNA, 25 bp, Mus musculus
tgtacctaccagtgagaggtcgtga

SEQ ID NO: 898431 - DNA, 25 bp, Mus musculus
tgtacctactcacgatgtttctccc

SEQ ID NO: 898432 - DNA, 25 bp, Mus musculus
tgtacctactcaggatgtttctccc

SEQ ID NO: 898433 - DNA, 25 bp, Mus musculus
tgtacctagcaacctattggtaaac

SEQ ID NO: 898434 - DNA, 25 bp, Mus musculus
tgtacctagcaagctattggtaaac

SEQ ID NO: 898435 - DNA, 25 bp, Mus musculus
tgtacctagggaattcgccagtttc

SEQ ID NO: 898436 - DNA, 25 bp, Mus musculus
tgtacctagggatttcgccagtttc

SEQ ID NO: 898437 - DNA, 25 bp, Mus musculus
tgtacctaggttctcaatccagttc

SEQ ID NO: 898438 - DNA, 25 bp, Mus musculus
tgtacctaggttgtcaatccagttc

SEQ ID NO: 898439 - DNA, 25 bp, Mus musculus
tgtacctcaccacagggtattcgga

SEQ ID NO: 898440 - DNA, 25 bp, Mus musculus
tgtacctcaccagagggtattcgga

SEQ ID NO: 898441 - DNA, 25 bp, Mus musculus
tgtacctcagacaagcaggctttat

SEQ ID NO: 898442 - DNA, 25 bp, Mus musculus
tgtacctcagactagcaggctttat

SEQ ID NO: 898443 - DNA, 25 bp, Mus musculus
tgtacctcagcactttcaaagccat

SEQ ID NO: 898444 - DNA, 25 bp, Mus musculus
tgtacctcagcagtttcaaagccat

SEQ ID NO: 898445 - DNA, 25 bp, Mus musculus
tgtacctcatgtataagtttctgtg

SEQ ID NO: 898446 - DNA, 25 bp, Mus musculus
tgtacctcatgtttaagtttctgtg

SEQ ID NO: 898447 - DNA, 25 bp, Mus musculus
tgtacctccacactgttccttttaa

SEQ ID NO: 898448 - DNA, 25 bp, Mus musculus
tgtacctccacagtgttccttttaa

SEQ ID NO: 898449 - DNA, 25 bp, Mus musculus
tgtacctccagacccatcagcatgg

SEQ ID NO: 898450 - DNA, 25 bp, Mus musculus
tgtacctccagagccatcagcatgg

SEQ ID NO: 898451 - DNA, 25 bp, Mus musculus
tgtacctccgcccacttatatgggc

SEQ ID NO: 898452 - DNA, 25 bp, Mus musculus
tgtacctccgccgacttatatgggc

SEQ ID NO: 898453 - DNA, 25 bp, Mus musculus
tgtacctcctgcatacaacacataa

SEQ ID NO: 898454 - DNA, 25 bp, Mus musculus
tgtacctcctgcttacaacacataa

SEQ ID NO: 898455 - DNA, 25 bp, Mus musculus
tgtacctccttcaagggacttaacg

SEQ ID NO: 898456 - DNA, 25 bp, Mus musculus
tgtacctccttcatcttgttgctat

SEQ ID NO: 898457 - DNA, 25 bp, Mus musculus
tgtacctccttctagggacttaacg

SEQ ID NO: 898458 - DNA, 25 bp, Mus musculus
tgtacctccttcttcttgttgctat

SEQ ID NO: 898459 - DNA, 25 bp, Mus musculus
tgtacctcctttaaagcctcaagta

SEQ ID NO: 898460 - DNA, 25 bp, Mus musculus
tgtacctccttttaagcctcaagta

SEQ ID NO: 898461 - DNA, 25 bp, Mus musculus
tgtacctcggtaagatcagcctcca

SEQ ID NO: 898462 - DNA, 25 bp, Mus musculus
tgtacctcggtatgatcagcctcca

SEQ ID NO: 898463 - DNA, 25 bp, Mus musculus
tgtacctctcatagatcctaaccaa

SEQ ID NO: 898464 - DNA, 25 bp, Mus musculus
tgtacctctcattgatcctaaccaa

SEQ ID NO: 898465 - DNA, 25 bp, Mus musculus
tgtacctctgtaactgttgttgtgg

SEQ ID NO: 898466 - DNA, 25 bp, Mus musculus
tgtacctctgtatctgttgttgtgg

SEQ ID NO: 898467 - DNA, 25 bp, Mus musculus
tgtacctgaaggcaacctctgtctc

SEQ ID NO: 898468 - DNA, 25 bp, Mus musculus
tgtacctgaagggaacctctgtctc

SEQ ID NO: 898469 - DNA, 25 bp, Mus musculus
tgtacctgagctatcttatttctgt

SEQ ID NO: 898470 - DNA, 25 bp, Mus musculus
tgtacctgagctttcttatttctgt

SEQ ID NO: 898471 - DNA, 25 bp, Mus musculus
tgtacctgaggtataggatttgtta

SEQ ID NO: 898472 - DNA, 25 bp, Mus musculus
tgtacctgaggtccaccggaggcga

SEQ ID NO: 898473 - DNA, 25 bp, Mus musculus
tgtacctgaggtgcaccggaggcga

SEQ ID NO: 898474 - DNA, 25 bp, Mus musculus
tgtacctgaggtttaggatttgtta

SEQ ID NO: 898475 - DNA, 25 bp, Mus musculus
tgtacctgcaacacctggcaatgag

SEQ ID NO: 898476 - DNA, 25 bp, Mus musculus
tgtacctgcaactcctggcaatgag

SEQ ID NO: 898477 - DNA, 25 bp, Mus musculus
tgtacctgccgcagtcattggatga

SEQ ID NO: 898478 - DNA, 25 bp, Mus musculus
tgtacctgccgctgtcattggatga

SEQ ID NO: 898479 - DNA, 25 bp, Mus musculus
tgtacctgctgacacttatcctatc

SEQ ID NO: 898480 - DNA, 25 bp, Mus musculus
tgtacctgctgagacttatcctatc

SEQ ID NO: 898481 - DNA, 25 bp, Mus musculus
tgtacctgctgtcccgggagtcgct

SEQ ID NO: 898482 - DNA, 25 bp, Mus musculus
tgtacctgctgtgccgggagtcgct

SEQ ID NO: 898483 - DNA, 25 bp, Mus musculus
tgtacctgcttcattactagtctgc

SEQ ID NO: 898484 - DNA, 25 bp, Mus musculus
tgtacctgcttctttactagtctgc

SEQ ID NO: 898485 - DNA, 25 bp, Mus musculus
tgtacctgcttgcaggagctatgtg

SEQ ID NO: 898486 - DNA, 25 bp, Mus musculus
tgtacctgcttggaggagctatgtg

SEQ ID NO: 898487 - DNA, 25 bp, Mus musculus
tgtacctggagcatgctgatcctct

SEQ ID NO: 898488 - DNA, 25 bp, Mus musculus
tgtacctggagcttgctgatcctct

SEQ ID NO: 898489 - DNA, 25 bp, Mus musculus
tgtacctgggtcacgctttactaga

SEQ ID NO: 898490 - DNA, 25 bp, Mus musculus
tgtacctgggtctcgctttactaga

SEQ ID NO: 898491 - DNA, 25 bp, Mus musculus
tgtacctgtcacatgctggctatgc

SEQ ID NO: 898492 - DNA, 25 bp, Mus musculus
tgtacctgtcacttgctggctatgc

SEQ ID NO: 898493 - DNA, 25 bp, Mus musculus
tgtacctgtgtgagtccagcccaac

SEQ ID NO: 898494 - DNA, 25 bp, Mus musculus
tgtacctgtgtgtgtccagcccaac

SEQ ID NO: 898495 - DNA, 25 bp, Mus musculus
tgtacctgttacagcaccgagagat

SEQ ID NO: 898496 - DNA, 25 bp, Mus musculus
tgtacctgttactgcaccgagagat

SEQ ID NO: 898497 - DNA, 25 bp, Mus musculus
tgtaccttacgtagggtgtcctgca

SEQ ID NO: 898498 - DNA, 25 bp, Mus musculus
tgtaccttacgttgggtgtcctgca

SEQ ID NO: 898499 - DNA, 25 bp, Mus musculus
tgtaccttaggcagcatagcacctg

SEQ ID NO: 898500 - DNA, 25 bp, Mus musculus
tgtaccttaggctgcatagcacctg

SEQ ID NO: 898501 - DNA, 25 bp, Mus musculus
tgtaccttaggtcggagctcaaaac

SEQ ID NO: 898502 - DNA, 25 bp, Mus musculus
tgtaccttaggtgggagctcaaaac

SEQ ID NO: 898503 - DNA, 25 bp, Mus musculus
tgtaccttatacacatcatgtgcaa

SEQ ID NO: 898504 - DNA, 25 bp, Mus musculus
tgtaccttatactcatcatgtgcaa

SEQ ID NO: 898505 - DNA, 25 bp, Mus musculus
tgtaccttatttaagacccaatgtt

SEQ ID NO: 898506 - DNA, 25 bp, Mus musculus
tgtaccttattttagacccaatgtt

SEQ ID NO: 898507 - DNA, 25 bp, Mus musculus
tgtaccttctgaaccatcggttgaa

SEQ ID NO: 898508 - DNA, 25 bp, Mus musculus
tgtaccttctgatccatcggttgaa

SEQ ID NO: 898509 - DNA, 25 bp, Mus musculus
tgtaccttcttcattctggaggtcc

SEQ ID NO: 898510 - DNA, 25 bp, Mus musculus
tgtaccttcttctttctggaggtcc

SEQ ID NO: 898511 - DNA, 25 bp, Mus musculus
tgtaccttgacaaatgaaatctgtg

SEQ ID NO: 898512 - DNA, 25 bp, Mus musculus
tgtaccttgacatatgaaatctgtg

SEQ ID NO: 898513 - DNA, 25 bp, Mus musculus
tgtaccttgcctcagccatagagta

SEQ ID NO: 898514 - DNA, 25 bp, Mus musculus
tgtaccttgcctgagccatagagta

SEQ ID NO: 898515 - DNA, 25 bp, Mus musculus
tgtaccttgtctatgttgtttcttg

SEQ ID NO: 898516 - DNA, 25 bp, Mus musculus
tgtaccttgtctttgttgtttcttg

SEQ ID NO: 898517 - DNA, 25 bp, Mus musculus
tgtaccttgttgctgtcttgtttat

SEQ ID NO: 898518 - DNA, 25 bp, Mus musculus
tgtaccttgttggtgtcttgtttat

SEQ ID NO: 898519 - DNA, 25 bp, Mus musculus
tgtacctttaatagcaccactggag

SEQ ID NO: 898520 - DNA, 25 bp, Mus musculus
tgtacctttaattgcaccactggag

SEQ ID NO: 898521 - DNA, 25 bp, Mus musculus
tgtacctttattctcttatcttttg

SEQ ID NO: 898522 - DNA, 25 bp, Mus musculus
tgtacctttattgtcttatcttttg

SEQ ID NO: 898523 - DNA, 25 bp, Mus musculus
tgtacctttcccacttatttctgga

SEQ ID NO: 898524 - DNA, 25 bp, Mus musculus
tgtacctttccctcttatttctgga

SEQ ID NO: 898525 - DNA, 25 bp, Mus musculus
tgtacctttgtcaattatcgatcca

SEQ ID NO: 898526 - DNA, 25 bp, Mus musculus
tgtacctttgtctattatcgatcca

SEQ ID NO: 898527 - DNA, 25 bp, Mus musculus
tgtaccttttgtagctgaccccatt

SEQ ID NO: 898528 - DNA, 25 bp, Mus musculus
tgtaccttttgttgctgaccccatt

SEQ ID NO: 898529 - DNA, 25 bp, Mus musculus
tgtacgaatagcaggctccaaccct

SEQ ID NO: 898530 - DNA, 25 bp, Mus musculus
tgtacgaatagctggctccaaccct

SEQ ID NO: 898531 - DNA, 25 bp, Mus musculus
tgtacgacctggaagaaagcctagt

SEQ ID NO: 898532 - DNA, 25 bp, Mus musculus
tgtacgacctggtagaaagcctagt

SEQ ID NO: 898533 - DNA, 25 bp, Mus musculus
tgtacgagcacaacaggacacccaa

SEQ ID NO: 898534 - DNA, 25 bp, Mus musculus
tgtacgagcacatcaggacacccaa

SEQ ID NO: 898535 - DNA, 25 bp, Mus musculus
tgtacgagtgcaaccgtcctgcagc

SEQ ID NO: 898536 - DNA, 25 bp, Mus musculus
tgtacgagtgcatccgtcctgcagc

SEQ ID NO: 898537 - DNA, 25 bp, Mus musculus
tgtacgatacatcatccgctgatct

SEQ ID NO: 898538 - DNA, 25 bp, Mus musculus
tgtacgatacatgatccgctgatct

SEQ ID NO: 898539 - DNA, 25 bp, Mus musculus
tgtacgatcccaagtactgcctgaa

SEQ ID NO: 898540 - DNA, 25 bp, Mus musculus
tgtacgatcccatgtactgcctgaa

SEQ ID NO: 898541 - DNA, 25 bp, Mus musculus
tgtacgatgtcaaactgcagactta

SEQ ID NO: 898542 - DNA, 25 bp, Mus musculus
tgtacgatgtcatactgcagactta

SEQ ID NO: 898543 - DNA, 25 bp, Mus musculus
tgtacgcaaaccaatgcagccctta

SEQ ID NO: 898544 - DNA, 25 bp, Mus musculus
tgtacgcaaacctatgcagccctta

SEQ ID NO: 898545 - DNA, 25 bp, Mus musculus
tgtacgcaacggctggtgaagctaa

SEQ ID NO: 898546 - DNA, 25 bp, Mus musculus
tgtacgcaacgggtggtgaagctaa

SEQ ID NO: 898547 - DNA, 25 bp, Mus musculus
tgtacgcattcgacacgtgcaagct

SEQ ID NO: 898548 - DNA, 25 bp, Mus musculus
tgtacgcattcgtcacgtgcaagct

SEQ ID NO: 898549 - DNA, 25 bp, Mus musculus
tgtacgccaccaacaagatctaacg

SEQ ID NO: 898550 - DNA, 25 bp, Mus musculus
tgtacgccaccatcaagatctaacg

SEQ ID NO: 898551 - DNA, 25 bp, Mus musculus
tgtacgccaccccaaattataaagt

SEQ ID NO: 898552 - DNA, 25 bp, Mus musculus
tgtacgccacccgaaattataaagt

SEQ ID NO: 898553 - DNA, 25 bp, Mus musculus
tgtacgccagggaatactcccggca

SEQ ID NO: 898554 - DNA, 25 bp, Mus musculus
tgtacgccagggtatactcccggca

SEQ ID NO: 898555 - DNA, 25 bp, Mus musculus
tgtacgccagtcactctcagttcat

SEQ ID NO: 898556 - DNA, 25 bp, Mus musculus
tgtacgccagtctctctcagttcat

SEQ ID NO: 898557 - DNA, 25 bp, Mus musculus
tgtacgcccaaactagtgacgcttt

SEQ ID NO: 898558 - DNA, 25 bp, Mus musculus
tgtacgcccaaagtagtgacgcttt

SEQ ID NO: 898559 - DNA, 25 bp, Mus musculus
tgtacgccttctagtctgacaactt

SEQ ID NO: 898560 - DNA, 25 bp, Mus musculus
tgtacgccttcttgtctgacaactt

SEQ ID NO: 898561 - DNA, 25 bp, Mus musculus
tgtacgctccaacagggcagggctc

SEQ ID NO: 898562 - DNA, 25 bp, Mus musculus
tgtacgctccaagagggcagggctc

SEQ ID NO: 898563 - DNA, 25 bp, Mus musculus
tgtacgctctctcctttggctttaa

SEQ ID NO: 898564 - DNA, 25 bp, Mus musculus
tgtacgctctctgctttggctttaa

SEQ ID NO: 898565 - DNA, 25 bp, Mus musculus
tgtacgctgcctcaatgcttcgtcg

SEQ ID NO: 898566 - DNA, 25 bp, Mus musculus
tgtacgctgcctgaatgcttcgtcg

SEQ ID NO: 898567 - DNA, 25 bp, Mus musculus
tgtacggcaagcatttcagcgccta

SEQ ID NO: 898568 - DNA, 25 bp, Mus musculus
tgtacggcaagcttttcagcgccta

SEQ ID NO: 898569 - DNA, 25 bp, Mus musculus
tgtacggcacggaccgcatcagctg

SEQ ID NO: 898570 - DNA, 25 bp, Mus musculus
tgtacggcacggtccgcatcagctg

SEQ ID NO: 898571 - DNA, 25 bp, Mus musculus
tgtacggccagaatgacaccagcgc

SEQ ID NO: 898572 - DNA, 25 bp, Mus musculus
tgtacggccagattgacaccagcgc

SEQ ID NO: 898573 - DNA, 25 bp, Mus musculus
tgtacggcttcaaccattcgatcag

SEQ ID NO: 898574 - DNA, 25 bp, Mus musculus
tgtacggcttcatccattcgatcag

SEQ ID NO: 898575 - DNA, 25 bp, Mus musculus
tgtacggttcctataacttttctat

SEQ ID NO: 898576 - DNA, 25 bp, Mus musculus
tgtacggttcctttaacttttctat

SEQ ID NO: 898577 - DNA, 25 bp, Mus musculus
tgtacgtaagtaaagctcctcaaag

SEQ ID NO: 898578 - DNA, 25 bp, Mus musculus
tgtacgtaagtatagctcctcaaag

SEQ ID NO: 898579 - DNA, 25 bp, Mus musculus
tgtacgtctaccagcgtggtttgac

SEQ ID NO: 898580 - DNA, 25 bp, Mus musculus
tgtacgtctacctgcgtggtttgac

SEQ ID NO: 898581 - DNA, 25 bp, Mus musculus
tgtacgtctgtgaatattttaatac

SEQ ID NO: 898582 - DNA, 25 bp, Mus musculus
tgtacgtctgtgtatattttaatac

SEQ ID NO: 898583 - DNA, 25 bp, Mus musculus
tgtacgtgcagaactctctcggcaa

SEQ ID NO: 898584 - DNA, 25 bp, Mus musculus
tgtacgtgcagatctctctcggcaa

SEQ ID NO: 898585 - DNA, 25 bp, Mus musculus
tgtacgtgccagagccaaagccatc

SEQ ID NO: 898586 - DNA, 25 bp, Mus musculus
tgtacgtgccagtgccaaagccatc

SEQ ID NO: 898587 - DNA, 25 bp, Mus musculus
tgtacgtgtcctcgaagcggtaccc

SEQ ID NO: 898588 - DNA, 25 bp, Mus musculus
tgtacgtgtcctggaagcggtaccc

SEQ ID NO: 898589 - DNA, 25 bp, Mus musculus
tgtacgtgttccacagtggaggctc

SEQ ID NO: 898590 - DNA, 25 bp, Mus musculus
tgtacgtgttcctcagtggaggctc

SEQ ID NO: 898591 - DNA, 25 bp, Mus musculus
tgtacgttagggacctgaggatcca

SEQ ID NO: 898592 - DNA, 25 bp, Mus musculus
tgtacgttagggtcctgaggatcca

SEQ ID NO: 898593 - DNA, 25 bp, Mus musculus
tgtactaaaataaccctgagctcta

SEQ ID NO: 898594 - DNA, 25 bp, Mus musculus
tgtactaaaatatccctgagctcta

SEQ ID NO: 898595 - DNA, 25 bp, Mus musculus
tgtactaaaatcaagtatctgcaaa

SEQ ID NO: 898596 - DNA, 25 bp, Mus musculus
tgtactaaaatctagtatctgcaaa

SEQ ID NO: 898597 - DNA, 25 bp, Mus musculus
tgtactaaaggacctctgctgcctg

SEQ ID NO: 898598 - DNA, 25 bp, Mus musculus
tgtactaaaggagctctgctgcctg

SEQ ID NO: 898599 - DNA, 25 bp, Mus musculus
tgtactaactgcatcacccatgttc

SEQ ID NO: 898600 - DNA, 25 bp, Mus musculus
tgtactaactgcttcacccatgttc

SEQ ID NO: 898601 - DNA, 25 bp, Mus musculus
tgtactaagcacctcccaggattta

SEQ ID NO: 898602 - DNA, 25 bp, Mus musculus
tgtactaagcacgtcccaggattta

SEQ ID NO: 898603 - DNA, 25 bp, Mus musculus
tgtactaatcgtctagacttagcat

SEQ ID NO: 898604 - DNA, 25 bp, Mus musculus
tgtactaatcgtgtagacttagcat

SEQ ID NO: 898605 - DNA, 25 bp, Mus musculus
tgtactaattttccatgagttgatt

SEQ ID NO: 898606 - DNA, 25 bp, Mus musculus
tgtactaattttgcatgagttgatt

SEQ ID NO: 898607 - DNA, 25 bp, Mus musculus
tgtactacagaaacagtgctccctc

SEQ ID NO: 898608 - DNA, 25 bp, Mus musculus
tgtactacagaatcagtgctccctc

SEQ ID NO: 898609 - DNA, 25 bp, Mus musculus
tgtactaccactctgtaccagaagg

SEQ ID NO: 898610 - DNA, 25 bp, Mus musculus
tgtactaccactgtgtaccagaagg

SEQ ID NO: 898611 - DNA, 25 bp, Mus musculus
tgtactacgcatatcctctgcacgc

SEQ ID NO: 898612 - DNA, 25 bp, Mus musculus
tgtactacgcatttcctctgcacgc

SEQ ID NO: 898613 - DNA, 25 bp, Mus musculus
tgtactactactctctggcaggagt

SEQ ID NO: 898614 - DNA, 25 bp, Mus musculus
tgtactactactgtctggcaggagt

SEQ ID NO: 898615 - DNA, 25 bp, Mus musculus
tgtactacttgcaagctttgtggcc

SEQ ID NO: 898616 - DNA, 25 bp, Mus musculus
tgtactacttgctagctttgtggcc

SEQ ID NO: 898617 - DNA, 25 bp, Mus musculus
tgtactagctgacatcgagtgcctg

SEQ ID NO: 898618 - DNA, 25 bp, Mus musculus
tgtactagctgagatcgagtgcctg

SEQ ID NO: 898619 - DNA, 25 bp, Mus musculus
tgtactatatgcatccttaaaacgt

SEQ ID NO: 898620 - DNA, 25 bp, Mus musculus
tgtactatatgcttccttaaaacgt

SEQ ID NO: 898621 - DNA, 25 bp, Mus musculus
tgtactatattcatacctcccaaag

SEQ ID NO: 898622 - DNA, 25 bp, Mus musculus
tgtactatattcttacctcccaaag

SEQ ID NO: 898623 - DNA, 25 bp, Mus musculus
tgtactatcgagaccatacacggct

SEQ ID NO: 898624 - DNA, 25 bp, Mus musculus
tgtactatcgagtccatacacggct

SEQ ID NO: 898625 - DNA, 25 bp, Mus musculus
tgtactatctctcggtgtcctctga

SEQ ID NO: 898626 - DNA, 25 bp, Mus musculus
tgtactatctctgggtgtcctctga

SEQ ID NO: 898627 - DNA, 25 bp, Mus musculus
tgtactatgtgcatgttctgttctt

SEQ ID NO: 898628 - DNA, 25 bp, Mus musculus
tgtactatgtgcttgttctgttctt

SEQ ID NO: 898629 - DNA, 25 bp, Mus musculus
tgtactatgtttccactgccccaca

SEQ ID NO: 898630 - DNA, 25 bp, Mus musculus
tgtactatgtttgcactgccccaca

SEQ ID NO: 898631 - DNA, 25 bp, Mus musculus
tgtactattggtcctttgtgtctaa

SEQ ID NO: 898632 - DNA, 25 bp, Mus musculus
tgtactattggtgctttgtgtctaa

SEQ ID NO: 898633 - DNA, 25 bp, Mus musculus
tgtactatttaccttctgtgtcctg

SEQ ID NO: 898634 - DNA, 25 bp, Mus musculus
tgtactatttacgttctgtgtcctg

SEQ ID NO: 898635 - DNA, 25 bp, Mus musculus
tgtactcaaaccattaccagcgtga

SEQ ID NO: 898636 - DNA, 25 bp, Mus musculus
tgtactcaaacctttaccagcgtga

SEQ ID NO: 898637 - DNA, 25 bp, Mus musculus
tgtactcaaagtcacaaagcctttc

SEQ ID NO: 898638 - DNA, 25 bp, Mus musculus
tgtactcaaagtgacaaagcctttc

SEQ ID NO: 898639 - DNA, 25 bp, Mus musculus
tgtactcaaatgatgcctctcttct

SEQ ID NO: 898640 - DNA, 25 bp, Mus musculus
tgtactcaaatgttgcctctcttct

SEQ ID NO: 898641 - DNA, 25 bp, Mus musculus
tgtactcactctcgcgggactatat

SEQ ID NO: 898642 - DNA, 25 bp, Mus musculus
tgtactcactctggcgggactatat

SEQ ID NO: 898643 - DNA, 25 bp, Mus musculus
tgtactcaggtaccatgcatctgtc

SEQ ID NO: 898644 - DNA, 25 bp, Mus musculus
tgtactcaggtagcatgcatctgtc

SEQ ID NO: 898645 - DNA, 25 bp, Mus musculus
tgtactcagtccacttttatgtccc

SEQ ID NO: 898646 - DNA, 25 bp, Mus musculus
tgtactcagtcctcttttatgtccc

SEQ ID NO: 898647 - DNA, 25 bp, Mus musculus
tgtactcagtgaactccaggtgcta

SEQ ID NO: 898648 - DNA, 25 bp, Mus musculus
tgtactcagtgatctccaggtgcta

SEQ ID NO: 898649 - DNA, 25 bp, Mus musculus
tgtactcagtggcactcggaacgcc

SEQ ID NO: 898650 - DNA, 25 bp, Mus musculus
tgtactcagtgggactcggaacgcc

SEQ ID NO: 898651 - DNA, 25 bp, Mus musculus
tgtactcatcagaggtgaccaggca

SEQ ID NO: 898652 - DNA, 25 bp, Mus musculus
tgtactcatcagtggtgaccaggca

SEQ ID NO: 898653 - DNA, 25 bp, Mus musculus
tgtactcatctcaatgtgcccagtg

SEQ ID NO: 898654 - DNA, 25 bp, Mus musculus
tgtactcatctctatgtgcccagtg

SEQ ID NO: 898655 - DNA, 25 bp, Mus musculus
tgtactcatgcaataattccaccta

SEQ ID NO: 898656 - DNA, 25 bp, Mus musculus
tgtactcatgcattaattccaccta

SEQ ID NO: 898657 - DNA, 25 bp, Mus musculus
tgtactcatggcatcctctcttgat

SEQ ID NO: 898658 - DNA, 25 bp, Mus musculus
tgtactcatggcttcctctcttgat

SEQ ID NO: 898659 - DNA, 25 bp, Mus musculus
tgtactccacgtccatcgacatgtg

SEQ ID NO: 898660 - DNA, 25 bp, Mus musculus
tgtactccacgtgcatcgacatgtg

SEQ ID NO: 898661 - DNA, 25 bp, Mus musculus
tgtactccactcactgccatgcagt

SEQ ID NO: 898662 - DNA, 25 bp, Mus musculus
tgtactccactctctgccatgcagt

SEQ ID NO: 898663 - DNA, 25 bp, Mus musculus
tgtactccacttattatgccttcca

SEQ ID NO: 898664 - DNA, 25 bp, Mus musculus
tgtactccactttttatgccttcca

SEQ ID NO: 898665 - DNA, 25 bp, Mus musculus
tgtactccatggcagacaaacccgg

SEQ ID NO: 898666 - DNA, 25 bp, Mus musculus
tgtactccatgggagacaaacccgg

SEQ ID NO: 898667 - DNA, 25 bp, Mus musculus
tgtactccatttactatttagttgc

SEQ ID NO: 898668 - DNA, 25 bp, Mus musculus
tgtactccattttctatttagttgc

SEQ ID NO: 898669 - DNA, 25 bp, Mus musculus
tgtactcccaatcccctaaatgcat

SEQ ID NO: 898670 - DNA, 25 bp, Mus musculus
tgtactcccaatgccctaaatgcat

SEQ ID NO: 898671 - DNA, 25 bp, Mus musculus
tgtactcccacgattttgtactcct

SEQ ID NO: 898672 - DNA, 25 bp, Mus musculus
tgtactcccacgtttttgtactcct

SEQ ID NO: 898673 - DNA, 25 bp, Mus musculus
tgtactccgacgagcggctgaatgt

SEQ ID NO: 898674 - DNA, 25 bp, Mus musculus
tgtactccgacgtgcggctgaatgt

SEQ ID NO: 898675 - DNA, 25 bp, Mus musculus
tgtactccgtccagaaatgtccaag

SEQ ID NO: 898676 - DNA, 25 bp, Mus musculus
tgtactccgtcctgaaatgtccaag

SEQ ID NO: 898677 - DNA, 25 bp, Mus musculus
tgtactcctcggaaagactccatag

SEQ ID NO: 898678 - DNA, 25 bp, Mus musculus
tgtactcctcggtaagactccatag

SEQ ID NO: 898679 - DNA, 25 bp, Mus musculus
tgtactcctctcatggtgtagggtc

SEQ ID NO: 898680 - DNA, 25 bp, Mus musculus
tgtactcctctcttggtgtagggtc

SEQ ID NO: 898681 - DNA, 25 bp, Mus musculus
tgtactcctgctccctgagacgaag

SEQ ID NO: 898682 - DNA, 25 bp, Mus musculus
tgtactcctgctgcctgagacgaag

SEQ ID NO: 898683 - DNA, 25 bp, Mus musculus
tgtactcctggcatgtgaactgggc

SEQ ID NO: 898684 - DNA, 25 bp, Mus musculus
tgtactcctggcttgtgaactgggc

SEQ ID NO: 898685 - DNA, 25 bp, Mus musculus
tgtactccttgcagttccgcagaac

SEQ ID NO: 898686 - DNA, 25 bp, Mus musculus
tgtactccttgctgttccgcagaac

SEQ ID NO: 898687 - DNA, 25 bp, Mus musculus
tgtactcgaagaatgtggccctctc

SEQ ID NO: 898688 - DNA, 25 bp, Mus musculus
tgtactcgaagattgtggccctctc

SEQ ID NO: 898689 - DNA, 25 bp, Mus musculus
tgtactcgcaaccacccagtgggag

SEQ ID NO: 898690 - DNA, 25 bp, Mus musculus
tgtactcgcaacgacccagtgggag

SEQ ID NO: 898691 - DNA, 25 bp, Mus musculus
tgtactcgcaatcttccccgggaga

SEQ ID NO: 898692 - DNA, 25 bp, Mus musculus
tgtactcgcaatgttccccgggaga

SEQ ID NO: 898693 - DNA, 25 bp, Mus musculus
tgtactcgctcaaagtaggagctga

SEQ ID NO: 898694 - DNA, 25 bp, Mus musculus
tgtactcgctcatagtaggagctga

SEQ ID NO: 898695 - DNA, 25 bp, Mus musculus
tgtactcggaagaagtcgccctcca

SEQ ID NO: 898696 - DNA, 25 bp, Mus musculus
tgtactcggaagtagtcgccctcca

SEQ ID NO: 898697 - DNA, 25 bp, Mus musculus
tgtactcggttaaagtaggagctga

SEQ ID NO: 898698 - DNA, 25 bp, Mus musculus
tgtactcggttatagtaggagctga

SEQ ID NO: 898699 - DNA, 25 bp, Mus musculus
tgtactctactgcttcctgaatggg

SEQ ID NO: 898700 - DNA, 25 bp, Mus musculus
tgtactctactggttcctgaatggg

SEQ ID NO: 898701 - DNA, 25 bp, Mus musculus
tgtactctccacacaattttctttg

SEQ ID NO: 898702 - DNA, 25 bp, Mus musculus
tgtactctccactcaattttctttg

SEQ ID NO: 898703 - DNA, 25 bp, Mus musculus
tgtactctcccgcatagaggctttc

SEQ ID NO: 898704 - DNA, 25 bp, Mus musculus
tgtactctcccggatagaggctttc

SEQ ID NO: 898705 - DNA, 25 bp, Mus musculus
tgtactctcctaactatcttgacag

SEQ ID NO: 898706 - DNA, 25 bp, Mus musculus
tgtactctcctatctatcttgacag

SEQ ID NO: 898707 - DNA, 25 bp, Mus musculus
tgtactctctctactctgaggtctc

SEQ ID NO: 898708 - DNA, 25 bp, Mus musculus
tgtactctctcttctctgaggtctc

SEQ ID NO: 898709 - DNA, 25 bp, Mus musculus
tgtactctgactacacatgacccaa

SEQ ID NO: 898710 - DNA, 25 bp, Mus musculus
tgtactctgacttcacatgacccaa

SEQ ID NO: 898711 - DNA, 25 bp, Mus musculus
tgtactctgcacagctcatctctag

SEQ ID NO: 898712 - DNA, 25 bp, Mus musculus
tgtactctgcactgctcatctctag

SEQ ID NO: 898713 - DNA, 25 bp, Mus musculus
tgtactctgcgcaggcacattgtca

SEQ ID NO: 898714 - DNA, 25 bp, Mus musculus
tgtactctgcgctggcacattgtca

SEQ ID NO: 898715 - DNA, 25 bp, Mus musculus
tgtactctggagctcggatggtcac

SEQ ID NO: 898716 - DNA, 25 bp, Mus musculus
tgtactctggaggtcggatggtcac

SEQ ID NO: 898717 - DNA, 25 bp, Mus musculus
tgtactctgtaaatgtatcttctgt

SEQ ID NO: 898718 - DNA, 25 bp, Mus musculus
tgtactctgtaattgtatcttctgt

SEQ ID NO: 898719 - DNA, 25 bp, Mus musculus
tgtactctgtatatcacctctctct

SEQ ID NO: 898720 - DNA, 25 bp, Mus musculus
tgtactctgtatttcacctctctct

SEQ ID NO: 898721 - DNA, 25 bp, Mus musculus
tgtactctgttaagcccagggtagc

SEQ ID NO: 898722 - DNA, 25 bp, Mus musculus
tgtactctgttaattgcttgtgttt

SEQ ID NO: 898723 - DNA, 25 bp, Mus musculus
tgtactctgttatgcccagggtagc

SEQ ID NO: 898724 - DNA, 25 bp, Mus musculus
tgtactctgttatttgcttgtgttt

SEQ ID NO: 898725 - DNA, 25 bp, Mus musculus
tgtactcttattatctggcccacaa

SEQ ID NO: 898726 - DNA, 25 bp, Mus musculus
tgtactcttattttctggcccacaa

SEQ ID NO: 898727 - DNA, 25 bp, Mus musculus
tgtactctttcaaattggaaactct

SEQ ID NO: 898728 - DNA, 25 bp, Mus musculus
tgtactctttcatattggaaactct

SEQ ID NO: 898729 - DNA, 25 bp, Mus musculus
tgtactgaaaccaggcttgacccca

SEQ ID NO: 898730 - DNA, 25 bp, Mus musculus
tgtactgaaacctggcttgacccca

SEQ ID NO: 898731 - DNA, 25 bp, Mus musculus
tgtactgaagtgattatcttcccat

SEQ ID NO: 898732 - DNA, 25 bp, Mus musculus
tgtactgaagtgtttatcttcccat

SEQ ID NO: 898733 - DNA, 25 bp, Mus musculus
tgtactgacatgcaaaggcaacaca

SEQ ID NO: 898734 - DNA, 25 bp, Mus musculus
tgtactgacatggaaaggcaacaca

SEQ ID NO: 898735 - DNA, 25 bp, Mus musculus
tgtactgactccataaaagccacct

SEQ ID NO: 898736 - DNA, 25 bp, Mus musculus
tgtactgactccttaaaagccacct

SEQ ID NO: 898737 - DNA, 25 bp, Mus musculus
tgtactgagagcaggttgtcacccc

SEQ ID NO: 898738 - DNA, 25 bp, Mus musculus
tgtactgagagctggttgtcacccc

SEQ ID NO: 898739 - DNA, 25 bp, Mus musculus
tgtactgagcgcctcgtgcacgtgc

SEQ ID NO: 898740 - DNA, 25 bp, Mus musculus
tgtactgagcgcgtcgtgcacgtgc

SEQ ID NO: 898741 - DNA, 25 bp, Mus musculus
tgtactgagctaccttttacagatg

SEQ ID NO: 898742 - DNA, 25 bp, Mus musculus
tgtactgagctagcttttacagatg

SEQ ID NO: 898743 - DNA, 25 bp, Mus musculus
tgtactgagtaccactggctgggcc

SEQ ID NO: 898744 - DNA, 25 bp, Mus musculus
tgtactgagtacgactggctgggcc

SEQ ID NO: 898745 - DNA, 25 bp, Mus musculus
tgtactgagtagaaaacctttaggc

SEQ ID NO: 898746 - DNA, 25 bp, Mus musculus
tgtactgagtagtaaacctttaggc

SEQ ID NO: 898747 - DNA, 25 bp, Mus musculus
tgtactgagtggcttctgtccgcag

SEQ ID NO: 898748 - DNA, 25 bp, Mus musculus
tgtactgagtgggttctgtccgcag

SEQ ID NO: 898749 - DNA, 25 bp, Mus musculus
tgtactgatcatctgttcgccagtg

SEQ ID NO: 898750 - DNA, 25 bp, Mus musculus
tgtactgatcatgtgttcgccagtg

SEQ ID NO: 898751 - DNA, 25 bp, Mus musculus
tgtactgatgtaattctaaggaact

SEQ ID NO: 898752 - DNA, 25 bp, Mus musculus
tgtactgatgtatttctaaggaact

SEQ ID NO: 898753 - DNA, 25 bp, Mus musculus
tgtactgattgaacgccatttccca

SEQ ID NO: 898754 - DNA, 25 bp, Mus musculus
tgtactgattgatcgccatttccca

SEQ ID NO: 898755 - DNA, 25 bp, Mus musculus
tgtactgcaaacctcacaaatggag

SEQ ID NO: 898756 - DNA, 25 bp, Mus musculus
tgtactgcaaacgtcacaaatggag

SEQ ID NO: 898757 - DNA, 25 bp, Mus musculus
tgtactgcattgagtttatctcctg

SEQ ID NO: 898758 - DNA, 25 bp, Mus musculus
tgtactgcattgtgtttatctcctg

SEQ ID NO: 898759 - DNA, 25 bp, Mus musculus
tgtactgcccttatcagagccagcc

SEQ ID NO: 898760 - DNA, 25 bp, Mus musculus
tgtactgcccttttcagagccagcc

SEQ ID NO: 898761 - DNA, 25 bp, Mus musculus
tgtactgcctggaatgtctgtgtaa

SEQ ID NO: 898762 - DNA, 25 bp, Mus musculus
tgtactgcctggctcctgtcgcagg

SEQ ID NO: 898763 - DNA, 25 bp, Mus musculus
tgtactgcctgggtcctgtcgcagg

SEQ ID NO: 898764 - DNA, 25 bp, Mus musculus
tgtactgcctggtatgtctgtgtaa

SEQ ID NO: 898765 - DNA, 25 bp, Mus musculus
tgtactgcctgtcatccaccaagag

SEQ ID NO: 898766 - DNA, 25 bp, Mus musculus
tgtactgcctgtgatccaccaagag

SEQ ID NO: 898767 - DNA, 25 bp, Mus musculus
tgtactgcgtttacattcttgtatt

SEQ ID NO: 898768 - DNA, 25 bp, Mus musculus
tgtactgcgttttcattcttgtatt

SEQ ID NO: 898769 - DNA, 25 bp, Mus musculus
tgtactgctaacatttcactgtggt

SEQ ID NO: 898770 - DNA, 25 bp, Mus musculus
tgtactgctaacttttcactgtggt

SEQ ID NO: 898771 - DNA, 25 bp, Mus musculus
tgtactgctccacggtgttatttag

SEQ ID NO: 898772 - DNA, 25 bp, Mus musculus
tgtactgctccagggtgttatttag

SEQ ID NO: 898773 - DNA, 25 bp, Mus musculus
tgtactgctcccagaacaacgtacg

SEQ ID NO: 898774 - DNA, 25 bp, Mus musculus
tgtactgctccctgaacaacgtacg

SEQ ID NO: 898775 - DNA, 25 bp, Mus musculus
tgtactgctcttatgtggtcatttc

SEQ ID NO: 898776 - DNA, 25 bp, Mus musculus
tgtactgctcttttgtggtcatttc

SEQ ID NO: 898777 - DNA, 25 bp, Mus musculus
tgtactgcttttagtatcctttgtc

SEQ ID NO: 898778 - DNA, 25 bp, Mus musculus
tgtactgctttttgtatcctttgtc

SEQ ID NO: 898779 - DNA, 25 bp, Mus musculus
tgtactggaagccacctctggtttt

SEQ ID NO: 898780 - DNA, 25 bp, Mus musculus
tgtactggaagcgacctctggtttt

SEQ ID NO: 898781 - DNA, 25 bp, Mus musculus
tgtactggaattaaccttgatgtgt

SEQ ID NO: 898782 - DNA, 25 bp, Mus musculus
tgtactggaattcctgaccatcctg

SEQ ID NO: 898783 - DNA, 25 bp, Mus musculus
tgtactggaattgctgaccatcctg

SEQ ID NO: 898784 - DNA, 25 bp, Mus musculus
tgtactggaatttaccttgatgtgt

SEQ ID NO: 898785 - DNA, 25 bp, Mus musculus
tgtactggagaccatgacggccttc

SEQ ID NO: 898786 - DNA, 25 bp, Mus musculus
tgtactggagacgatgacggccttc

SEQ ID NO: 898787 - DNA, 25 bp, Mus musculus
tgtactggccctatctagctgtggg

SEQ ID NO: 898788 - DNA, 25 bp, Mus musculus
tgtactggccctttctagctgtggg

SEQ ID NO: 898789 - DNA, 25 bp, Mus musculus
tgtactggccgcaggagaacttctc

SEQ ID NO: 898790 - DNA, 25 bp, Mus musculus
tgtactggccgctggagaacttctc

SEQ ID NO: 898791 - DNA, 25 bp, Mus musculus
tgtactggcctacagggttctgcag

SEQ ID NO: 898792 - DNA, 25 bp, Mus musculus
tgtactggcctagagggttctgcag

SEQ ID NO: 898793 - DNA, 25 bp, Mus musculus
tgtactgggagcagtaatggttacc

SEQ ID NO: 898794 - DNA, 25 bp, Mus musculus
tgtactgggagctgtaatggttacc

SEQ ID NO: 898795 - DNA, 25 bp, Mus musculus
tgtactgggaggaaggcagccctat

SEQ ID NO: 898796 - DNA, 25 bp, Mus musculus
tgtactgggaggtaggcagccctat

SEQ ID NO: 898797 - DNA, 25 bp, Mus musculus
tgtactgggtagataagatcacccc

SEQ ID NO: 898798 - DNA, 25 bp, Mus musculus
tgtactgggtagttaagatcacccc

SEQ ID NO: 898799 - DNA, 25 bp, Mus musculus
tgtactgggtctattttggttttag

SEQ ID NO: 898800 - DNA, 25 bp, Mus musculus
tgtactgggtcttttttggttttag

SEQ ID NO: 898801 - DNA, 25 bp, Mus musculus
tgtactggtattatgaaaggtaacg

SEQ ID NO: 898802 - DNA, 25 bp, Mus musculus
tgtactggtattttgaaaggtaacg

SEQ ID NO: 898803 - DNA, 25 bp, Mus musculus
tgtactggtgcaccctttgtgaata

SEQ ID NO: 898804 - DNA, 25 bp, Mus musculus
tgtactggtgcagcctttgtgaata

SEQ ID NO: 898805 - DNA, 25 bp, Mus musculus
tgtactggttttctgtacaccccgc

SEQ ID NO: 898806 - DNA, 25 bp, Mus musculus
tgtactggttttgtgtacaccccgc

SEQ ID NO: 898807 - DNA, 25 bp, Mus musculus
tgtactgtacatctttttactttag

SEQ ID NO: 898808 - DNA, 25 bp, Mus musculus
tgtactgtacatgtttttactttag

SEQ ID NO: 898809 - DNA, 25 bp, Mus musculus
tgtactgtactgacacggacacctg

SEQ ID NO: 898810 - DNA, 25 bp, Mus musculus
tgtactgtactgtcacggacacctg

SEQ ID NO: 898811 - DNA, 25 bp, Mus musculus
tgtactgtcacaccacctgggcaag

SEQ ID NO: 898812 - DNA, 25 bp, Mus musculus
tgtactgtcacagcacctgggcaag

SEQ ID NO: 898813 - DNA, 25 bp, Mus musculus
tgtactgtcagtatccttggttgga

SEQ ID NO: 898814 - DNA, 25 bp, Mus musculus
tgtactgtcagtttccttggttgga

SEQ ID NO: 898815 - DNA, 25 bp, Mus musculus
tgtactgtccctaaggccgaagagt

SEQ ID NO: 898816 - DNA, 25 bp, Mus musculus
tgtactgtcccttaggccgaagagt

SEQ ID NO: 898817 - DNA, 25 bp, Mus musculus
tgtactgtcgcgctggaagcctcat

SEQ ID NO: 898818 - DNA, 25 bp, Mus musculus
tgtactgtcgcggtggaagcctcat

SEQ ID NO: 898819 - DNA, 25 bp, Mus musculus
tgtactgtgagtatagacaacccca

SEQ ID NO: 898820 - DNA, 25 bp, Mus musculus
tgtactgtgagtttagacaacccca

SEQ ID NO: 898821 - DNA, 25 bp, Mus musculus
tgtactgtgatgaagctttcttctg

SEQ ID NO: 898822 - DNA, 25 bp, Mus musculus
tgtactgtgatgtagctttcttctg

SEQ ID NO: 898823 - DNA, 25 bp, Mus musculus
tgtactgtgcctagtgcaactccag

SEQ ID NO: 898824 - DNA, 25 bp, Mus musculus
tgtactgtgccttgtgcaactccag

SEQ ID NO: 898825 - DNA, 25 bp, Mus musculus
tgtactgtgggcacaatggttgttt

SEQ ID NO: 898826 - DNA, 25 bp, Mus musculus
tgtactgtgggctcaatggttgttt

SEQ ID NO: 898827 - DNA, 25 bp, Mus musculus
tgtactgtgtacaagtctgtgaaca

SEQ ID NO: 898828 - DNA, 25 bp, Mus musculus
tgtactgtgtactagtctgtgaaca

SEQ ID NO: 898829 - DNA, 25 bp, Mus musculus
tgtactgtgtttactgtccatctgt

SEQ ID NO: 898830 - DNA, 25 bp, Mus musculus
tgtactgtgtttcactcccaaatcc

SEQ ID NO: 898831 - DNA, 25 bp, Mus musculus
tgtactgtgtttgactcccaaatcc

SEQ ID NO: 898832 - DNA, 25 bp, Mus musculus
tgtactgtgttttctgtccatctgt

SEQ ID NO: 898833 - DNA, 25 bp, Mus musculus
tgtactgttcaaatccagtctcctc

SEQ ID NO: 898834 - DNA, 25 bp, Mus musculus
tgtactgttcaattccagtctcctc

SEQ ID NO: 898835 - DNA, 25 bp, Mus musculus
tgtactgttcagatatctaaggaac

SEQ ID NO: 898836 - DNA, 25 bp, Mus musculus
tgtactgttcagttatctaaggaac

SEQ ID NO: 898837 - DNA, 25 bp, Mus musculus
tgtactgtttggactaaagtgaaga

SEQ ID NO: 898838 - DNA, 25 bp, Mus musculus
tgtactgtttggtctaaagtgaaga

SEQ ID NO: 898839 - DNA, 25 bp, Mus musculus
tgtactgttttgagcttgggttaaa

SEQ ID NO: 898840 - DNA, 25 bp, Mus musculus
tgtactgttttgtgcttgggttaaa

SEQ ID NO: 898841 - DNA, 25 bp, Mus musculus
tgtacttaagagctggtggcaggag

SEQ ID NO: 898842 - DNA, 25 bp, Mus musculus
tgtacttaagaggtggtggcaggag

SEQ ID NO: 898843 - DNA, 25 bp, Mus musculus
tgtacttaagtcattccatctttca

SEQ ID NO: 898844 - DNA, 25 bp, Mus musculus
tgtacttaagtctttccatctttca

SEQ ID NO: 898845 - DNA, 25 bp, Mus musculus
tgtacttacatgcacataccccaca

SEQ ID NO: 898846 - DNA, 25 bp, Mus musculus
tgtacttacatggacataccccaca

SEQ ID NO: 898847 - DNA, 25 bp, Mus musculus
tgtacttaccacagggagtcaggct

SEQ ID NO: 898848 - DNA, 25 bp, Mus musculus
tgtacttaccactgggagtcaggct

SEQ ID NO: 898849 - DNA, 25 bp, Mus musculus
tgtacttagaggctaagccccagtt

SEQ ID NO: 898850 - DNA, 25 bp, Mus musculus
tgtacttagagggtaagccccagtt

SEQ ID NO: 898851 - DNA, 25 bp, Mus musculus
tgtacttaggatccacccacacttt

SEQ ID NO: 898852 - DNA, 25 bp, Mus musculus
tgtacttaggatgcacccacacttt

SEQ ID NO: 898853 - DNA, 25 bp, Mus musculus
tgtacttagtaccaccactattagg

SEQ ID NO: 898854 - DNA, 25 bp, Mus musculus
tgtacttagtacgaccactattagg

SEQ ID NO: 898855 - DNA, 25 bp, Mus musculus
tgtacttataatcttcccattaaag

SEQ ID NO: 898856 - DNA, 25 bp, Mus musculus
tgtacttataatgttcccattaaag

SEQ ID NO: 898857 - DNA, 25 bp, Mus musculus
tgtacttatctcctcccttaataaa

SEQ ID NO: 898858 - DNA, 25 bp, Mus musculus
tgtacttatctcgtcccttaataaa

SEQ ID NO: 898859 - DNA, 25 bp, Mus musculus
tgtacttcaaccaccgtaggtcact

SEQ ID NO: 898860 - DNA, 25 bp, Mus musculus
tgtacttcaacctccgtaggtcact

SEQ ID NO: 898861 - DNA, 25 bp, Mus musculus
tgtacttcaatgaccctcacatcac

SEQ ID NO: 898862 - DNA, 25 bp, Mus musculus
tgtacttcaatgtccctcacatcac

SEQ ID NO: 898863 - DNA, 25 bp, Mus musculus
tgtacttcactacggaatccatttt

SEQ ID NO: 898864 - DNA, 25 bp, Mus musculus
tgtacttcactagggaatccatttt

SEQ ID NO: 898865 - DNA, 25 bp, Mus musculus
tgtacttcagacatctattgattgt

SEQ ID NO: 898866 - DNA, 25 bp, Mus musculus
tgtacttcagacttctattgattgt

SEQ ID NO: 898867 - DNA, 25 bp, Mus musculus
tgtacttcagttctgtcgtgccagt

SEQ ID NO: 898868 - DNA, 25 bp, Mus musculus
tgtacttcagttgtgtcgtgccagt

SEQ ID NO: 898869 - DNA, 25 bp, Mus musculus
tgtacttcatcgacctggtgaaggt

SEQ ID NO: 898870 - DNA, 25 bp, Mus musculus
tgtacttcatcgtcctggtgaaggt

SEQ ID NO: 898871 - DNA, 25 bp, Mus musculus
tgtacttcccagaaaggtagccctt

SEQ ID NO: 898872 - DNA, 25 bp, Mus musculus
tgtacttcccagtaaggtagccctt

SEQ ID NO: 898873 - DNA, 25 bp, Mus musculus
tgtacttccctaccttgtcagtgtt

SEQ ID NO: 898874 - DNA, 25 bp, Mus musculus
tgtacttccctagcttgtcagtgtt

SEQ ID NO: 898875 - DNA, 25 bp, Mus musculus
tgtacttccctcaccagaatgttgg

SEQ ID NO: 898876 - DNA, 25 bp, Mus musculus
tgtacttccctctccagaatgttgg

SEQ ID NO: 898877 - DNA, 25 bp, Mus musculus
tgtacttccgttccctgcagaagtc

SEQ ID NO: 898878 - DNA, 25 bp, Mus musculus
tgtacttccgttgcctgcagaagtc

SEQ ID NO: 898879 - DNA, 25 bp, Mus musculus
tgtacttcctatacagaggcacctt

SEQ ID NO: 898880 - DNA, 25 bp, Mus musculus
tgtacttcctattcagaggcacctt

SEQ ID NO: 898881 - DNA, 25 bp, Mus musculus
tgtacttcctgaaggttctcctgta

SEQ ID NO: 898882 - DNA, 25 bp, Mus musculus
tgtacttcctgaccggatgcaacgt

SEQ ID NO: 898883 - DNA, 25 bp, Mus musculus
tgtacttcctgagcggatgcaacgt

SEQ ID NO: 898884 - DNA, 25 bp, Mus musculus
tgtacttcctgatggttctcctgta

SEQ ID NO: 898885 - DNA, 25 bp, Mus musculus
tgtacttcgctgaccggctgtacga

SEQ ID NO: 898886 - DNA, 25 bp, Mus musculus
tgtacttcgctgtccggctgtacga

SEQ ID NO: 898887 - DNA, 25 bp, Mus musculus
tgtacttctcagctgccatagtgga

SEQ ID NO: 898888 - DNA, 25 bp, Mus musculus
tgtacttctcaggtgccatagtgga

SEQ ID NO: 898889 - DNA, 25 bp, Mus musculus
tgtacttctcttagcattacacaaa

SEQ ID NO: 898890 - DNA, 25 bp, Mus musculus
tgtacttctctttgcattacacaaa

SEQ ID NO: 898891 - DNA, 25 bp, Mus musculus
tgtacttctgaacggtgacccatcc

SEQ ID NO: 898892 - DNA, 25 bp, Mus musculus
tgtacttctgaagggtgacccatcc

SEQ ID NO: 898893 - DNA, 25 bp, Mus musculus
tgtacttctgagcatgtcctgctgc

SEQ ID NO: 898894 - DNA, 25 bp, Mus musculus
tgtacttctgaggatgtcctgctgc

SEQ ID NO: 898895 - DNA, 25 bp, Mus musculus
tgtacttcttccaggacttgtggac

SEQ ID NO: 898896 - DNA, 25 bp, Mus musculus
tgtacttcttcctggacttgtggac

SEQ ID NO: 898897 - DNA, 25 bp, Mus musculus
tgtacttctttacctgttaactcag

SEQ ID NO: 898898 - DNA, 25 bp, Mus musculus
tgtacttctttagctgttaactcag

SEQ ID NO: 898899 - DNA, 25 bp, Mus musculus
tgtacttgacttctgcgatttaata

SEQ ID NO: 898900 - DNA, 25 bp, Mus musculus
tgtacttgacttgtgcgatttaata

SEQ ID NO: 898901 - DNA, 25 bp, Mus musculus
tgtacttgatctaaggctgaccttt

SEQ ID NO: 898902 - DNA, 25 bp, Mus musculus
tgtacttgatctatgctttcttctg

SEQ ID NO: 898903 - DNA, 25 bp, Mus musculus
tgtacttgatcttaggctgaccttt

SEQ ID NO: 898904 - DNA, 25 bp, Mus musculus
tgtacttgatctttgctttcttctg

SEQ ID NO: 898905 - DNA, 25 bp, Mus musculus
tgtacttgattgcacagtaatctgt

SEQ ID NO: 898906 - DNA, 25 bp, Mus musculus
tgtacttgattggacagtaatctgt

SEQ ID NO: 898907 - DNA, 25 bp, Mus musculus
tgtacttggcacacctcttctgagg

SEQ ID NO: 898908 - DNA, 25 bp, Mus musculus
tgtacttggcactcctcttctgagg

SEQ ID NO: 898909 - DNA, 25 bp, Mus musculus
tgtacttggctacatggcatgctat

SEQ ID NO: 898910 - DNA, 25 bp, Mus musculus
tgtacttggctactcgcttctaggg

SEQ ID NO: 898911 - DNA, 25 bp, Mus musculus
tgtacttggctagatggcatgctat

SEQ ID NO: 898912 - DNA, 25 bp, Mus musculus
tgtacttggctagtcgcttctaggg

SEQ ID NO: 898913 - DNA, 25 bp, Mus musculus
tgtacttgggcaacaggccacagca

SEQ ID NO: 898914 - DNA, 25 bp, Mus musculus
tgtacttgggcatcaggccacagca

SEQ ID NO: 898915 - DNA, 25 bp, Mus musculus
tgtacttgtcctcaaatggtgccac

SEQ ID NO: 898916 - DNA, 25 bp, Mus musculus
tgtacttgtcctgaaatggtgccac

SEQ ID NO: 898917 - DNA, 25 bp, Mus musculus
tgtactttaatactaagcagtccat

SEQ ID NO: 898918 - DNA, 25 bp, Mus musculus
tgtactttaatagtaagcagtccat

SEQ ID NO: 898919 - DNA, 25 bp, Mus musculus
tgtactttacacacataggtatgag

SEQ ID NO: 898920 - DNA, 25 bp, Mus musculus
tgtactttacactcataggtatgag

SEQ ID NO: 898921 - DNA, 25 bp, Mus musculus
tgtactttacccaatcctaaggcag

SEQ ID NO: 898922 - DNA, 25 bp, Mus musculus
tgtactttaccctatcctaaggcag

SEQ ID NO: 898923 - DNA, 25 bp, Mus musculus
tgtactttagtaccatattctcatg

SEQ ID NO: 898924 - DNA, 25 bp, Mus musculus
tgtactttagtagcatattctcatg

SEQ ID NO: 898925 - DNA, 25 bp, Mus musculus
tgtactttcaggactctcagcagtg

SEQ ID NO: 898926 - DNA, 25 bp, Mus musculus
tgtactttcaggtctctcagcagtg

SEQ ID NO: 898927 - DNA, 25 bp, Mus musculus
tgtactttcctcacagggacatttg

SEQ ID NO: 898928 - DNA, 25 bp, Mus musculus
tgtactttcctctcagggacatttg

SEQ ID NO: 898929 - DNA, 25 bp, Mus musculus
tgtactttctacactagcttggccc

SEQ ID NO: 898930 - DNA, 25 bp, Mus musculus
tgtactttctactctagcttggccc

SEQ ID NO: 898931 - DNA, 25 bp, Mus musculus
tgtactttgacactgtggccgacaa

SEQ ID NO: 898932 - DNA, 25 bp, Mus musculus
tgtactttgacagtgtggccgacaa

SEQ ID NO: 898933 - DNA, 25 bp, Mus musculus
tgtactttgcaacccctaagcttca

SEQ ID NO: 898934 - DNA, 25 bp, Mus musculus
tgtactttgcaagccctaagcttca

SEQ ID NO: 898935 - DNA, 25 bp, Mus musculus
tgtactttgcacaacacacaccgag

SEQ ID NO: 898936 - DNA, 25 bp, Mus musculus
tgtactttgcactacacacaccgag

SEQ ID NO: 898937 - DNA, 25 bp, Mus musculus
tgtactttgctcagtatacctgtat

SEQ ID NO: 898938 - DNA, 25 bp, Mus musculus
tgtactttgctctgtatacctgtat

SEQ ID NO: 898939 - DNA, 25 bp, Mus musculus
tgtactttggatacacagtggcctc

SEQ ID NO: 898940 - DNA, 25 bp, Mus musculus
tgtactttggattcacagtggcctc

SEQ ID NO: 898941 - DNA, 25 bp, Mus musculus
tgtactttgtccagcagaatgccca

SEQ ID NO: 898942 - DNA, 25 bp, Mus musculus
tgtactttgtcctgcagaatgccca

SEQ ID NO: 898943 - DNA, 25 bp, Mus musculus
tgtacttttgagagggccggtaact

SEQ ID NO: 898944 - DNA, 25 bp, Mus musculus
tgtacttttgagtgggccggtaact

SEQ ID NO: 898945 - DNA, 25 bp, Mus musculus
tgtacttttgcccaaacgtgtaaat

SEQ ID NO: 898946 - DNA, 25 bp, Mus musculus
tgtacttttgccgaaacgtgtaaat

SEQ ID NO: 898947 - DNA, 25 bp, Mus musculus
tgtacttttgtaccgttagccttct

SEQ ID NO: 898948 - DNA, 25 bp, Mus musculus
tgtacttttgtagcgttagccttct

SEQ ID NO: 898949 - DNA, 25 bp, Mus musculus
tgtacttttgttatcataacttcgt

SEQ ID NO: 898950 - DNA, 25 bp, Mus musculus
tgtacttttgttttcataacttcgt

SEQ ID NO: 898951 - DNA, 25 bp, Mus musculus
tgtactttttacctccaataatggg

SEQ ID NO: 898952 - DNA, 25 bp, Mus musculus
tgtactttttacgtccaataatggg

SEQ ID NO: 898953 - DNA, 25 bp, Mus musculus
tgtactttttccctctaatcaaggg

SEQ ID NO: 898954 - DNA, 25 bp, Mus musculus
tgtactttttccgtctaatcaaggg

SEQ ID NO: 898955 - DNA, 25 bp, Mus musculus
tgtactttttctcttttgtgggttg

SEQ ID NO: 898956 - DNA, 25 bp, Mus musculus
tgtactttttctgttttgtgggttg

SEQ ID NO: 898957 - DNA, 25 bp, Mus musculus
tgtagaaaacccaaactccttgttg

SEQ ID NO: 898958 - DNA, 25 bp, Mus musculus
tgtagaaaaccctaactccttgttg

SEQ ID NO: 898959 - DNA, 25 bp, Mus musculus
tgtagaaaacgcatcctggacacat

SEQ ID NO: 898960 - DNA, 25 bp, Mus musculus
tgtagaaaacgcttcctggacacat

SEQ ID NO: 898961 - DNA, 25 bp, Mus musculus
tgtagaaacatcacatcccgtgctg

SEQ ID NO: 898962 - DNA, 25 bp, Mus musculus
tgtagaaacatctcatcccgtgctg

SEQ ID NO: 898963 - DNA, 25 bp, Mus musculus
tgtagaaatcctatcccttcctgaa

SEQ ID NO: 898964 - DNA, 25 bp, Mus musculus
tgtagaaatcctttcccttcctgaa

SEQ ID NO: 898965 - DNA, 25 bp, Mus musculus
tgtagaacaagtcttcctttccatc

SEQ ID NO: 898966 - DNA, 25 bp, Mus musculus
tgtagaacaagtgttcctttccatc

SEQ ID NO: 898967 - DNA, 25 bp, Mus musculus
tgtagaacacctcggtatttctttt

SEQ ID NO: 898968 - DNA, 25 bp, Mus musculus
tgtagaacacctgggtatttctttt

SEQ ID NO: 898969 - DNA, 25 bp, Mus musculus
tgtagaacacgcaaaccttgaattc

SEQ ID NO: 898970 - DNA, 25 bp, Mus musculus
tgtagaacacgctaaccttgaattc

SEQ ID NO: 898971 - DNA, 25 bp, Mus musculus
tgtagaaccgctccagaaaccctgg

SEQ ID NO: 898972 - DNA, 25 bp, Mus musculus
tgtagaaccgctgcagaaaccctgg

SEQ ID NO: 898973 - DNA, 25 bp, Mus musculus
tgtagaacctgcagtggcggcccac

SEQ ID NO: 898974 - DNA, 25 bp, Mus musculus
tgtagaacctgctgtggcggcccac

SEQ ID NO: 898975 - DNA, 25 bp, Mus musculus
tgtagaacctggagggccaccgttg

SEQ ID NO: 898976 - DNA, 25 bp, Mus musculus
tgtagaacctggtgggccaccgttg

SEQ ID NO: 898977 - DNA, 25 bp, Mus musculus
tgtagaacggagactgcacctgcat

SEQ ID NO: 898978 - DNA, 25 bp, Mus musculus
tgtagaacggagtctgcacctgcat

SEQ ID NO: 898979 - DNA, 25 bp, Mus musculus
tgtagaacgtatagactttcctgtc

SEQ ID NO: 898980 - DNA, 25 bp, Mus musculus
tgtagaacgtattgactttcctgtc

SEQ ID NO: 898981 - DNA, 25 bp, Mus musculus
tgtagaactcttatgatgcccttag

SEQ ID NO: 898982 - DNA, 25 bp, Mus musculus
tgtagaactcttttgatgcccttag

SEQ ID NO: 898983 - DNA, 25 bp, Mus musculus
tgtagaactgctctaacaaccctca

SEQ ID NO: 898984 - DNA, 25 bp, Mus musculus
tgtagaactgctgtaacaaccctca

SEQ ID NO: 898985 - DNA, 25 bp, Mus musculus
tgtagaagcgatccgtatgtcaaga

SEQ ID NO: 898986 - DNA, 25 bp, Mus musculus
tgtagaagcgatgcgtatgtcaaga

SEQ ID NO: 898987 - DNA, 25 bp, Mus musculus
tgtagaagctttcggcattctctgt

SEQ ID NO: 898988 - DNA, 25 bp, Mus musculus
tgtagaagctttgggcattctctgt

SEQ ID NO: 898989 - DNA, 25 bp, Mus musculus
tgtagaaggagcaccaatcggccag

SEQ ID NO: 898990 - DNA, 25 bp, Mus musculus
tgtagaaggagctccaatcggccag

SEQ ID NO: 898991 - DNA, 25 bp, Mus musculus
tgtagaagggctcaatcctgtctcc

SEQ ID NO: 898992 - DNA, 25 bp, Mus musculus
tgtagaagggctgaatcctgtctcc

SEQ ID NO: 898993 - DNA, 25 bp, Mus musculus
tgtagaatatgtcctcagatctgag

SEQ ID NO: 898994 - DNA, 25 bp, Mus musculus
tgtagaatatgtgctcagatctgag

SEQ ID NO: 898995 - DNA, 25 bp, Mus musculus
tgtagaatgaatcgcccttcccacg

SEQ ID NO: 898996 - DNA, 25 bp, Mus musculus
tgtagaatgaatggcccttcccacg

SEQ ID NO: 898997 - DNA, 25 bp, Mus musculus
tgtagacacaacaatttttccaatg

SEQ ID NO: 898998 - DNA, 25 bp, Mus musculus
tgtagacacaactatttttccaatg

SEQ ID NO: 898999 - DNA, 25 bp, Mus musculus
tgtagacacacaaggcggtatgcat

SEQ ID NO: 899000 - DNA, 25 bp, Mus musculus
tgtagacacacatggcggtatgcat

SEQ ID NO: 899001 - DNA, 25 bp, Mus musculus
tgtagacactgcaggctgccagata

SEQ ID NO: 899002 - DNA, 25 bp, Mus musculus
tgtagacactgctggctgccagata

SEQ ID NO: 899003 - DNA, 25 bp, Mus musculus
tgtagacagatcaccaatgcatata

SEQ ID NO: 899004 - DNA, 25 bp, Mus musculus
tgtagacagatctccaatgcatata

SEQ ID NO: 899005 - DNA, 25 bp, Mus musculus
tgtagacagtctatcaccggacaca

SEQ ID NO: 899006 - DNA, 25 bp, Mus musculus
tgtagacagtctttcaccggacaca

SEQ ID NO: 899007 - DNA, 25 bp, Mus musculus
tgtagacattgtcctgtacacctgt

SEQ ID NO: 899008 - DNA, 25 bp, Mus musculus
tgtagacattgtgctgtacacctgt

SEQ ID NO: 899009 - DNA, 25 bp, Mus musculus
tgtagaccacgaactcccagagatc

SEQ ID NO: 899010 - DNA, 25 bp, Mus musculus
tgtagaccacgatctcccagagatc

SEQ ID NO: 899011 - DNA, 25 bp, Mus musculus
tgtagaccactaaaaaaccaggagt

SEQ ID NO: 899012 - DNA, 25 bp, Mus musculus
tgtagaccactataaaaccaggagt

SEQ ID NO: 899013 - DNA, 25 bp, Mus musculus
tgtagaccaggtaatcctccagctg

SEQ ID NO: 899014 - DNA, 25 bp, Mus musculus
tgtagaccaggttatcctccagctg

SEQ ID NO: 899015 - DNA, 25 bp, Mus musculus
tgtagaccagtgctgtcaagccctt

SEQ ID NO: 899016 - DNA, 25 bp, Mus musculus
tgtagaccagtggtgtcaagccctt

SEQ ID NO: 899017 - DNA, 25 bp, Mus musculus
tgtagaccatttaaacctgcctttt

SEQ ID NO: 899018 - DNA, 25 bp, Mus musculus
tgtagaccattttaacctgcctttt

SEQ ID NO: 899019 - DNA, 25 bp, Mus musculus
tgtagacccaacactcagcaagtta

SEQ ID NO: 899020 - DNA, 25 bp, Mus musculus
tgtagacccaactctcagcaagtta

SEQ ID NO: 899021 - DNA, 25 bp, Mus musculus
tgtagacctatcagagtcgcagcca

SEQ ID NO: 899022 - DNA, 25 bp, Mus musculus
tgtagacctatctgagtcgcagcca

SEQ ID NO: 899023 - DNA, 25 bp, Mus musculus
tgtagacctccaagacgaaacccca

SEQ ID NO: 899024 - DNA, 25 bp, Mus musculus
tgtagacctccatgacgaaacccca

SEQ ID NO: 899025 - DNA, 25 bp, Mus musculus
tgtagacctgacaagcccggaacta

SEQ ID NO: 899026 - DNA, 25 bp, Mus musculus
tgtagacctgactagcccggaacta

SEQ ID NO: 899027 - DNA, 25 bp, Mus musculus
tgtagacctgccaagtgtaccttat

SEQ ID NO: 899028 - DNA, 25 bp, Mus musculus
tgtagacctgcctagtgtaccttat

SEQ ID NO: 899029 - DNA, 25 bp, Mus musculus
tgtagaccttccaaagagccccaca

SEQ ID NO: 899030 - DNA, 25 bp, Mus musculus
tgtagaccttcctaagagccccaca

SEQ ID NO: 899031 - DNA, 25 bp, Mus musculus
tgtagacgaggcactccgcctagtc

SEQ ID NO: 899032 - DNA, 25 bp, Mus musculus
tgtagacgaggctctccgcctagtc

SEQ ID NO: 899033 - DNA, 25 bp, Mus musculus
tgtagacgctacatccaagagcaag

SEQ ID NO: 899034 - DNA, 25 bp, Mus musculus
tgtagacgctacttccaagagcaag

SEQ ID NO: 899035 - DNA, 25 bp, Mus musculus
tgtagacgtgctctgttcacctgct

SEQ ID NO: 899036 - DNA, 25 bp, Mus musculus
tgtagacgtgctgtgttcacctgct

SEQ ID NO: 899037 - DNA, 25 bp, Mus musculus
tgtagacgttttcgtcccctggcag

SEQ ID NO: 899038 - DNA, 25 bp, Mus musculus
tgtagacgttttggtcccctggcag

SEQ ID NO: 899039 - DNA, 25 bp, Mus musculus
tgtagactaccaacaccaggctaga

SEQ ID NO: 899040 - DNA, 25 bp, Mus musculus
tgtagactaccatcaccaggctaga

SEQ ID NO: 899041 - DNA, 25 bp, Mus musculus
tgtagactacccagagcgttgtgtg

SEQ ID NO: 899042 - DNA, 25 bp, Mus musculus
tgtagactaccctgagcgttgtgtg

SEQ ID NO: 899043 - DNA, 25 bp, Mus musculus
tgtagactcaatactgtgtttaaga

SEQ ID NO: 899044 - DNA, 25 bp, Mus musculus
tgtagactcaattctgtgtttaaga

SEQ ID NO: 899045 - DNA, 25 bp, Mus musculus
tgtagactcagcacagacacgcttc

SEQ ID NO: 899046 - DNA, 25 bp, Mus musculus
tgtagactcagctcagacacgcttc

SEQ ID NO: 899047 - DNA, 25 bp, Mus musculus
tgtagactcaggcaaaggattccaa

SEQ ID NO: 899048 - DNA, 25 bp, Mus musculus
tgtagactcagggaaaggattccaa

SEQ ID NO: 899049 - DNA, 25 bp, Mus musculus
tgtagactccaacgaggttcacccc

SEQ ID NO: 899050 - DNA, 25 bp, Mus musculus
tgtagactccaaggaggttcacccc

SEQ ID NO: 899051 - DNA, 25 bp, Mus musculus
tgtagactgcataacctcctgtcat

SEQ ID NO: 899052 - DNA, 25 bp, Mus musculus
tgtagactgcattacctcctgtcat

SEQ ID NO: 899053 - DNA, 25 bp, Mus musculus
tgtagactgctacaatactccctgg

SEQ ID NO: 899054 - DNA, 25 bp, Mus musculus
tgtagactgctagaatactccctgg

SEQ ID NO: 899055 - DNA, 25 bp, Mus musculus
tgtagactgtcaaggcatggacccc

SEQ ID NO: 899056 - DNA, 25 bp, Mus musculus
tgtagactgtcaccaaaacccttta

SEQ ID NO: 899057 - DNA, 25 bp, Mus musculus
tgtagactgtcagcaaaacccttta

SEQ ID NO: 899058 - DNA, 25 bp, Mus musculus
tgtagactgtcatggcatggacccc

SEQ ID NO: 899059 - DNA, 25 bp, Mus musculus
tgtagactgtgcagacttccaaagc

SEQ ID NO: 899060 - DNA, 25 bp, Mus musculus
tgtagactgtgctgacttccaaagc

SEQ ID NO: 899061 - DNA, 25 bp, Mus musculus
tgtagacttaaacgcagaaccccgt

SEQ ID NO: 899062 - DNA, 25 bp, Mus musculus
tgtagacttaaaggcagaaccccgt

SEQ ID NO: 899063 - DNA, 25 bp, Mus musculus
tgtagacttagtacattgccattat

SEQ ID NO: 899064 - DNA, 25 bp, Mus musculus
tgtagacttagttcattgccattat

SEQ ID NO: 899065 - DNA, 25 bp, Mus musculus
tgtagacttctcctgggaccagtgg

SEQ ID NO: 899066 - DNA, 25 bp, Mus musculus
tgtagacttctcgtgggaccagtgg

SEQ ID NO: 899067 - DNA, 25 bp, Mus musculus
tgtagactttaaaagtgaggaagat

SEQ ID NO: 899068 - DNA, 25 bp, Mus musculus
tgtagactttaatagtgaggaagat

SEQ ID NO: 899069 - DNA, 25 bp, Mus musculus
tgtagagaagagcatttgacacccc

SEQ ID NO: 899070 - DNA, 25 bp, Mus musculus
tgtagagaagaggatttgacacccc

SEQ ID NO: 899071 - DNA, 25 bp, Mus musculus
tgtagagaagttacaatttgtacct

SEQ ID NO: 899072 - DNA, 25 bp, Mus musculus
tgtagagaagtttcaatttgtacct

SEQ ID NO: 899073 - DNA, 25 bp, Mus musculus
tgtagagaatgaccccaatggcgca

SEQ ID NO: 899074 - DNA, 25 bp, Mus musculus
tgtagagaatgagcccaatggcgca

SEQ ID NO: 899075 - DNA, 25 bp, Mus musculus
tgtagagaatgtcccctgcattgtc

SEQ ID NO: 899076 - DNA, 25 bp, Mus musculus
tgtagagaatgtgccctgcattgtc

SEQ ID NO: 899077 - DNA, 25 bp, Mus musculus
tgtagagaccaccagtatgttccaa

SEQ ID NO: 899078 - DNA, 25 bp, Mus musculus
tgtagagaccacgagtatgttccaa

SEQ ID NO: 899079 - DNA, 25 bp, Mus musculus
tgtagagaggttagccttcctgtca

SEQ ID NO: 899080 - DNA, 25 bp, Mus musculus
tgtagagaggtttgccttcctgtca

SEQ ID NO: 899081 - DNA, 25 bp, Mus musculus
tgtagagatagcaggaccctaggac

SEQ ID NO: 899082 - DNA, 25 bp, Mus musculus
tgtagagatagctggaccctaggac

SEQ ID NO: 899083 - DNA, 25 bp, Mus musculus
tgtagagatcgccacagtctctggg

SEQ ID NO: 899084 - DNA, 25 bp, Mus musculus
tgtagagatcgcgacagtctctggg

SEQ ID NO: 899085 - DNA, 25 bp, Mus musculus
tgtagagatctaccacctctctgaa

SEQ ID NO: 899086 - DNA, 25 bp, Mus musculus
tgtagagatctagcacctctctgaa

SEQ ID NO: 899087 - DNA, 25 bp, Mus musculus
tgtagagcaagacgctgcaaaggaa

SEQ ID NO: 899088 - DNA, 25 bp, Mus musculus
tgtagagcaagaggctgcaaaggaa

SEQ ID NO: 899089 - DNA, 25 bp, Mus musculus
tgtagagcaagcacaactgtaacct

SEQ ID NO: 899090 - DNA, 25 bp, Mus musculus
tgtagagcaagctcaactgtaacct

SEQ ID NO: 899091 - DNA, 25 bp, Mus musculus
tgtagagcacagaaaccttcagcct

SEQ ID NO: 899092 - DNA, 25 bp, Mus musculus
tgtagagcacagtaaccttcagcct

SEQ ID NO: 899093 - DNA, 25 bp, Mus musculus
tgtagagcaccaacacccaggtttt

SEQ ID NO: 899094 - DNA, 25 bp, Mus musculus
tgtagagcaccatcacccaggtttt

SEQ ID NO: 899095 - DNA, 25 bp, Mus musculus
tgtagagcactcacccgagggagga

SEQ ID NO: 899096 - DNA, 25 bp, Mus musculus
tgtagagcactcactaactggtccc

SEQ ID NO: 899097 - DNA, 25 bp, Mus musculus
tgtagagcactctcccgagggagga

SEQ ID NO: 899098 - DNA, 25 bp, Mus musculus
tgtagagcactctctaactggtccc

SEQ ID NO: 899099 - DNA, 25 bp, Mus musculus
tgtagagcagccatggcctttatca

SEQ ID NO: 899100 - DNA, 25 bp, Mus musculus
tgtagagcagccttggcctttatca

SEQ ID NO: 899101 - DNA, 25 bp, Mus musculus
tgtagagccacaccagcatgtcact

SEQ ID NO: 899102 - DNA, 25 bp, Mus musculus
tgtagagccacagcagcatgtcact

SEQ ID NO: 899103 - DNA, 25 bp, Mus musculus
tgtagagcccatagctgccaagagt

SEQ ID NO: 899104 - DNA, 25 bp, Mus musculus
tgtagagcccattgctgccaagagt

SEQ ID NO: 899105 - DNA, 25 bp, Mus musculus
tgtagagccctgagatggtgtcttc

SEQ ID NO: 899106 - DNA, 25 bp, Mus musculus
tgtagagccctgtgatggtgtcttc

SEQ ID NO: 899107 - DNA, 25 bp, Mus musculus
tgtagagcggagactctttgtcgga

SEQ ID NO: 899108 - DNA, 25 bp, Mus musculus
tgtagagcggagtctctttgtcgga

SEQ ID NO: 899109 - DNA, 25 bp, Mus musculus
tgtagagcgtggatctccagtggat

SEQ ID NO: 899110 - DNA, 25 bp, Mus musculus
tgtagagcgtggttctccagtggat

SEQ ID NO: 899111 - DNA, 25 bp, Mus musculus
tgtagagctaagaccgtggttccct

SEQ ID NO: 899112 - DNA, 25 bp, Mus musculus
tgtagagctaagtccgtggttccct

SEQ ID NO: 899113 - DNA, 25 bp, Mus musculus
tgtagagctcgcatacgcattctag

SEQ ID NO: 899114 - DNA, 25 bp, Mus musculus
tgtagagctcgcttacgcattctag

SEQ ID NO: 899115 - DNA, 25 bp, Mus musculus
tgtagagctgttcactgcatcctga

SEQ ID NO: 899116 - DNA, 25 bp, Mus musculus
tgtagagctgttgactgcatcctga

SEQ ID NO: 899117 - DNA, 25 bp, Mus musculus
tgtagaggagaaacgacgacgagcc

SEQ ID NO: 899118 - DNA, 25 bp, Mus musculus
tgtagaggagaacccctaggcttga

SEQ ID NO: 899119 - DNA, 25 bp, Mus musculus
tgtagaggagaagccctaggcttga

SEQ ID NO: 899120 - DNA, 25 bp, Mus musculus
tgtagaggagaatcgacgacgagcc

SEQ ID NO: 899121 - DNA, 25 bp, Mus musculus
tgtagaggagagcaccacccattga

SEQ ID NO: 899122 - DNA, 25 bp, Mus musculus
tgtagaggagaggaccacccattga

SEQ ID NO: 899123 - DNA, 25 bp, Mus musculus
tgtagaggatgcacaccgtggcgtc

SEQ ID NO: 899124 - DNA, 25 bp, Mus musculus
tgtagaggatgctcaccgtggcgtc

SEQ ID NO: 899125 - DNA, 25 bp, Mus musculus
tgtagaggcagtcagagcgctcact

SEQ ID NO: 899126 - DNA, 25 bp, Mus musculus
tgtagaggcagtgagagcgctcact

SEQ ID NO: 899127 - DNA, 25 bp, Mus musculus
tgtagaggcccaaacctggaatcct

SEQ ID NO: 899128 - DNA, 25 bp, Mus musculus
tgtagaggcccatacctggaatcct

SEQ ID NO: 899129 - DNA, 25 bp, Mus musculus
tgtagagtagctcctgggaggaggc

SEQ ID NO: 899130 - DNA, 25 bp, Mus musculus
tgtagagtagctgctgggaggaggc

SEQ ID NO: 899131 - DNA, 25 bp, Mus musculus
tgtagagtccaccaaatcattatgt

SEQ ID NO: 899132 - DNA, 25 bp, Mus musculus
tgtagagtccacgaaatcattatgt

SEQ ID NO: 899133 - DNA, 25 bp, Mus musculus
tgtagagtcgtcacattgcagactg

SEQ ID NO: 899134 - DNA, 25 bp, Mus musculus
tgtagagtcgtctcattgcagactg

SEQ ID NO: 899135 - DNA, 25 bp, Mus musculus
tgtagagtgcaacctggaccaccct

SEQ ID NO: 899136 - DNA, 25 bp, Mus musculus
tgtagagtgcaagctggaccaccct

SEQ ID NO: 899137 - DNA, 25 bp, Mus musculus
tgtagagtgttccagggtttcctat

SEQ ID NO: 899138 - DNA, 25 bp, Mus musculus
tgtagagtgttcgagggtttcctat

SEQ ID NO: 899139 - DNA, 25 bp, Mus musculus
tgtagagtttacaaccctcctcaat

SEQ ID NO: 899140 - DNA, 25 bp, Mus musculus
tgtagagtttactaccctcctcaat

SEQ ID NO: 899141 - DNA, 25 bp, Mus musculus
tgtagagtttcaactttagtgaccc

SEQ ID NO: 899142 - DNA, 25 bp, Mus musculus
tgtagagtttcatctttagtgaccc

SEQ ID NO: 899143 - DNA, 25 bp, Mus musculus
tgtagataaacaattccttcctctc

SEQ ID NO: 899144 - DNA, 25 bp, Mus musculus
tgtagataaacatttccttcctctc

SEQ ID NO: 899145 - DNA, 25 bp, Mus musculus
tgtagatactcaccgttcacaccta

SEQ ID NO: 899146 - DNA, 25 bp, Mus musculus
tgtagatactcagcgttcacaccta

SEQ ID NO: 899147 - DNA, 25 bp, Mus musculus
tgtagatacttccatgggtccagcc

SEQ ID NO: 899148 - DNA, 25 bp, Mus musculus
tgtagatacttcgatgggtccagcc

SEQ ID NO: 899149 - DNA, 25 bp, Mus musculus
tgtagatattttactccaccccttc

SEQ ID NO: 899150 - DNA, 25 bp, Mus musculus
tgtagatatttttctccaccccttc

SEQ ID NO: 899151 - DNA, 25 bp, Mus musculus
tgtagatcaacactcctaacctagt

SEQ ID NO: 899152 - DNA, 25 bp, Mus musculus
tgtagatcaacagtcctaacctagt

SEQ ID NO: 899153 - DNA, 25 bp, Mus musculus
tgtagatcaagaataacagttcctc

SEQ ID NO: 899154 - DNA, 25 bp, Mus musculus
tgtagatcaagattaacagttcctc

SEQ ID NO: 899155 - DNA, 25 bp, Mus musculus
tgtagatcagcaccggaatttacct

SEQ ID NO: 899156 - DNA, 25 bp, Mus musculus
tgtagatcagcagcggaatttacct

SEQ ID NO: 899157 - DNA, 25 bp, Mus musculus
tgtagatccagaattccatccccac

SEQ ID NO: 899158 - DNA, 25 bp, Mus musculus
tgtagatccagatttccatccccac

SEQ ID NO: 899159 - DNA, 25 bp, Mus musculus
tgtagatccagccactatccaaacg

SEQ ID NO: 899160 - DNA, 25 bp, Mus musculus
tgtagatccagcgactatccaaacg

SEQ ID NO: 899161 - DNA, 25 bp, Mus musculus
tgtagatcccacactgctgtgattc

SEQ ID NO: 899162 - DNA, 25 bp, Mus musculus
tgtagatcccactctgctgtgattc

SEQ ID NO: 899163 - DNA, 25 bp, Mus musculus
tgtagatccccaaagctgtgctgtg

SEQ ID NO: 899164 - DNA, 25 bp, Mus musculus
tgtagatccccatagctgtgctgtg

SEQ ID NO: 899165 - DNA, 25 bp, Mus musculus
tgtagatcccgacctcagactttaa

SEQ ID NO: 899166 - DNA, 25 bp, Mus musculus
tgtagatcccgagctcagactttaa

SEQ ID NO: 899167 - DNA, 25 bp, Mus musculus
tgtagatgaatccattcctgcccta

SEQ ID NO: 899168 - DNA, 25 bp, Mus musculus
tgtagatgaatcctccagacacgcc

SEQ ID NO: 899169 - DNA, 25 bp, Mus musculus
tgtagatgaatcgattcctgcccta

SEQ ID NO: 899170 - DNA, 25 bp, Mus musculus
tgtagatgaatcgtccagacacgcc

SEQ ID NO: 899171 - DNA, 25 bp, Mus musculus
tgtagatgagtgctttggcccctct

SEQ ID NO: 899172 - DNA, 25 bp, Mus musculus
tgtagatgagtggtttggcccctct

SEQ ID NO: 899173 - DNA, 25 bp, Mus musculus
tgtagatgccttaaagtttctttcc

SEQ ID NO: 899174 - DNA, 25 bp, Mus musculus
tgtagatgcctttaagtttctttcc

SEQ ID NO: 899175 - DNA, 25 bp, Mus musculus
tgtagatgggtcagtatattggctc

SEQ ID NO: 899176 - DNA, 25 bp, Mus musculus
tgtagatgggtctgtatattggctc

SEQ ID NO: 899177 - DNA, 25 bp, Mus musculus
tgtagatgtgtgattgcctgccaga

SEQ ID NO: 899178 - DNA, 25 bp, Mus musculus
tgtagatgtgtgtttgcctgccaga

SEQ ID NO: 899179 - DNA, 25 bp, Mus musculus
tgtagatgttctatcctttcacgtc

SEQ ID NO: 899180 - DNA, 25 bp, Mus musculus
tgtagatgttctttcctttcacgtc

SEQ ID NO: 899181 - DNA, 25 bp, Mus musculus
tgtagattctcaaacatgtcacata

SEQ ID NO: 899182 - DNA, 25 bp, Mus musculus
tgtagattctcatacatgtcacata

SEQ ID NO: 899183 - DNA, 25 bp, Mus musculus
tgtagattgatcactgctagttaga

SEQ ID NO: 899184 - DNA, 25 bp, Mus musculus
tgtagattgatctctgctagttaga

SEQ ID NO: 899185 - DNA, 25 bp, Mus musculus
tgtagatttcctatcatgtatattg

SEQ ID NO: 899186 - DNA, 25 bp, Mus musculus
tgtagatttcctttcatgtatattg

SEQ ID NO: 899187 - DNA, 25 bp, Mus musculus
tgtagatttgtgctgtcattcccca

SEQ ID NO: 899188 - DNA, 25 bp, Mus musculus
tgtagatttgtggtgtcattcccca

SEQ ID NO: 899189 - DNA, 25 bp, Mus musculus
tgtagattttctccacttatgcttt

SEQ ID NO: 899190 - DNA, 25 bp, Mus musculus
tgtagattttctgcacttatgcttt

SEQ ID NO: 899191 - DNA, 25 bp, Mus musculus
tgtagatttttcacccgctgcagga

SEQ ID NO: 899192 - DNA, 25 bp, Mus musculus
tgtagatttttctcccgctgcagga

SEQ ID NO: 899193 - DNA, 25 bp, Mus musculus
tgtagcaacacacgcctcaggtctc

SEQ ID NO: 899194 - DNA, 25 bp, Mus musculus
tgtagcaacacaggcctcaggtctc

SEQ ID NO: 899195 - DNA, 25 bp, Mus musculus
tgtagcaaccaacccaagtgtcttt

SEQ ID NO: 899196 - DNA, 25 bp, Mus musculus
tgtagcaaccaagccaagtgtcttt

SEQ ID NO: 899197 - DNA, 25 bp, Mus musculus
tgtagcaaccccacttgctgttgat

SEQ ID NO: 899198 - DNA, 25 bp, Mus musculus
tgtagcaacccctcttgctgttgat

SEQ ID NO: 899199 - DNA, 25 bp, Mus musculus
tgtagcaacctgacggtgcaccgga

SEQ ID NO: 899200 - DNA, 25 bp, Mus musculus
tgtagcaacctgtcggtgcaccgga

SEQ ID NO: 899201 - DNA, 25 bp, Mus musculus
tgtagcaactacatttggcttctat

SEQ ID NO: 899202 - DNA, 25 bp, Mus musculus
tgtagcaactacttttggcttctat

SEQ ID NO: 899203 - DNA, 25 bp, Mus musculus
tgtagcaagattctgctcaacccct

SEQ ID NO: 899204 - DNA, 25 bp, Mus musculus
tgtagcaagattgtgctcaacccct

SEQ ID NO: 899205 - DNA, 25 bp, Mus musculus
tgtagcacagccctgtctgttacac

SEQ ID NO: 899206 - DNA, 25 bp, Mus musculus
tgtagcacagccgtgtctgttacac

SEQ ID NO: 899207 - DNA, 25 bp, Mus musculus
tgtagcacagctcataaggcccatg

SEQ ID NO: 899208 - DNA, 25 bp, Mus musculus
tgtagcacagctgataaggcccatg

SEQ ID NO: 899209 - DNA, 25 bp, Mus musculus
tgtagcacagggatagccaagcccc

SEQ ID NO: 899210 - DNA, 25 bp, Mus musculus
tgtagcacagggttagccaagcccc

SEQ ID NO: 899211 - DNA, 25 bp, Mus musculus
tgtagcaccactacctttttcaaaa

SEQ ID NO: 899212 - DNA, 25 bp, Mus musculus
tgtagcaccacttcctttttcaaaa

SEQ ID NO: 899213 - DNA, 25 bp, Mus musculus
tgtagcaccctgaatctatgtttcc

SEQ ID NO: 899214 - DNA, 25 bp, Mus musculus
tgtagcaccctgtatctatgtttcc

SEQ ID NO: 899215 - DNA, 25 bp, Mus musculus
tgtagcacctcaagggtttgcaccc

SEQ ID NO: 899216 - DNA, 25 bp, Mus musculus
tgtagcacctcatgggtttgcaccc

SEQ ID NO: 899217 - DNA, 25 bp, Mus musculus
tgtagcaccttcatttcagagtaga

SEQ ID NO: 899218 - DNA, 25 bp, Mus musculus
tgtagcaccttcttttcagagtaga

SEQ ID NO: 899219 - DNA, 25 bp, Mus musculus
tgtagcacgtgtaacacccagggat

SEQ ID NO: 899220 - DNA, 25 bp, Mus musculus
tgtagcacgtgttacacccagggat

SEQ ID NO: 899221 - DNA, 25 bp, Mus musculus
tgtagcactggcataaagtagacac

SEQ ID NO: 899222 - DNA, 25 bp, Mus musculus
tgtagcactggcttaaagtagacac

SEQ ID NO: 899223 - DNA, 25 bp, Mus musculus
tgtagcactgggaaatgtggcccgt

SEQ ID NO: 899224 - DNA, 25 bp, Mus musculus
tgtagcactgggtaatgtggcccgt

SEQ ID NO: 899225 - DNA, 25 bp, Mus musculus
tgtagcagcaaaagatcccaaacta

SEQ ID NO: 899226 - DNA, 25 bp, Mus musculus
tgtagcagcaaatgatcccaaacta

SEQ ID NO: 899227 - DNA, 25 bp, Mus musculus
tgtagcagcaacactgtgcatgaag

SEQ ID NO: 899228 - DNA, 25 bp, Mus musculus
tgtagcagcaactctgtgcatgaag

SEQ ID NO: 899229 - DNA, 25 bp, Mus musculus
tgtagcagcaagaacctcgaccatg

SEQ ID NO: 899230 - DNA, 25 bp, Mus musculus
tgtagcagcaagtacctcgaccatg

SEQ ID NO: 899231 - DNA, 25 bp, Mus musculus
tgtagcagcccgaggaccagcagtg

SEQ ID NO: 899232 - DNA, 25 bp, Mus musculus
tgtagcagcccgtggaccagcagtg

SEQ ID NO: 899233 - DNA, 25 bp, Mus musculus
tgtagcagctacaccattggtaaac

SEQ ID NO: 899234 - DNA, 25 bp, Mus musculus
tgtagcagctactccattggtaaac

SEQ ID NO: 899235 - DNA, 25 bp, Mus musculus
tgtagcagctgaacttcttttccac

SEQ ID NO: 899236 - DNA, 25 bp, Mus musculus
tgtagcagctgatcttcttttccac

SEQ ID NO: 899237 - DNA, 25 bp, Mus musculus
tgtagcaggctacttggtgttcctc

SEQ ID NO: 899238 - DNA, 25 bp, Mus musculus
tgtagcaggctagttggtgttcctc

SEQ ID NO: 899239 - DNA, 25 bp, Mus musculus
tgtagcagggccacacagaccactg

SEQ ID NO: 899240 - DNA, 25 bp, Mus musculus
tgtagcagggcctcacagaccactg

SEQ ID NO: 899241 - DNA, 25 bp, Mus musculus
tgtagcaggttgacctagtgtctgt

SEQ ID NO: 899242 - DNA, 25 bp, Mus musculus
tgtagcaggttgtcctagtgtctgt

SEQ ID NO: 899243 - DNA, 25 bp, Mus musculus
tgtagcagtctgactgccatagctg

SEQ ID NO: 899244 - DNA, 25 bp, Mus musculus
tgtagcagtctgtctgccatagctg

SEQ ID NO: 899245 - DNA, 25 bp, Mus musculus
tgtagcagtggccaggaagaaaact

SEQ ID NO: 899246 - DNA, 25 bp, Mus musculus
tgtagcagtggcgaggaagaaaact

SEQ ID NO: 899247 - DNA, 25 bp, Mus musculus
tgtagcagttccctttctcagaaac

SEQ ID NO: 899248 - DNA, 25 bp, Mus musculus
tgtagcagttccgtttctcagaaac

SEQ ID NO: 899249 - DNA, 25 bp, Mus musculus
tgtagcagtttcctttgaattgaaa

SEQ ID NO: 899250 - DNA, 25 bp, Mus musculus
tgtagcagtttcgtttgaattgaaa

SEQ ID NO: 899251 - DNA, 25 bp, Mus musculus
tgtagcataaacacgcactgtatac

SEQ ID NO: 899252 - DNA, 25 bp, Mus musculus
tgtagcataaactcgcactgtatac

SEQ ID NO: 899253 - DNA, 25 bp, Mus musculus
tgtagcatacttaacggcccagcag

SEQ ID NO: 899254 - DNA, 25 bp, Mus musculus
tgtagcatactttacggcccagcag

SEQ ID NO: 899255 - DNA, 25 bp, Mus musculus
tgtagcatagctactgtctcagatg

SEQ ID NO: 899256 - DNA, 25 bp, Mus musculus
tgtagcatagcttctgtctcagatg

SEQ ID NO: 899257 - DNA, 25 bp, Mus musculus
tgtagcatccagatgtttccagttg

SEQ ID NO: 899258 - DNA, 25 bp, Mus musculus
tgtagcatccagttgtttccagttg

SEQ ID NO: 899259 - DNA, 25 bp, Mus musculus
tgtagcatccttactttttcttctt

SEQ ID NO: 899260 - DNA, 25 bp, Mus musculus
tgtagcatcctttctttttcttctt

SEQ ID NO: 899261 - DNA, 25 bp, Mus musculus
tgtagcatcgagagtcttctttgtc

SEQ ID NO: 899262 - DNA, 25 bp, Mus musculus
tgtagcatcgagtgtcttctttgtc

SEQ ID NO: 899263 - DNA, 25 bp, Mus musculus
tgtagcatgcataacctcagtcata

SEQ ID NO: 899264 - DNA, 25 bp, Mus musculus
tgtagcatgcattacctcagtcata

SEQ ID NO: 899265 - DNA, 25 bp, Mus musculus
tgtagcattcctaatttctttcatt

SEQ ID NO: 899266 - DNA, 25 bp, Mus musculus
tgtagcattccttatttctttcatt

SEQ ID NO: 899267 - DNA, 25 bp, Mus musculus
tgtagcattgaaagcctcctgtgct

SEQ ID NO: 899268 - DNA, 25 bp, Mus musculus
tgtagcattgaaagcttcctgtgct

SEQ ID NO: 899269 - DNA, 25 bp, Mus musculus
tgtagcattgaatgcctcctgtgct

SEQ ID NO: 899270 - DNA, 25 bp, Mus musculus
tgtagcattgaatgcttcctgtgct

SEQ ID NO: 899271 - DNA, 25 bp, Mus musculus
tgtagccaactcacagttacaaagt

SEQ ID NO: 899272 - DNA, 25 bp, Mus musculus
tgtagccaactctcagttacaaagt

SEQ ID NO: 899273 - DNA, 25 bp, Mus musculus
tgtagccaagagcagtgtcaggact

SEQ ID NO: 899274 - DNA, 25 bp, Mus musculus
tgtagccaagaggagtgtcaggact

SEQ ID NO: 899275 - DNA, 25 bp, Mus musculus
tgtagccaataacccacccgcagat

SEQ ID NO: 899276 - DNA, 25 bp, Mus musculus
tgtagccaataagccacccgcagat

SEQ ID NO: 899277 - DNA, 25 bp, Mus musculus
tgtagccacaaccatgttttgaaga

SEQ ID NO: 899278 - DNA, 25 bp, Mus musculus
tgtagccacaacgatgttttgaaga

SEQ ID NO: 899279 - DNA, 25 bp, Mus musculus
tgtagccacctacagaggcaagccg

SEQ ID NO: 899280 - DNA, 25 bp, Mus musculus
tgtagccacctagagaggcaagccg

SEQ ID NO: 899281 - DNA, 25 bp, Mus musculus
tgtagccactgtccactgccactgt

SEQ ID NO: 899282 - DNA, 25 bp, Mus musculus
tgtagccactgtgcactgccactgt

SEQ ID NO: 899283 - DNA, 25 bp, Mus musculus
tgtagccagaacctcattactgctt

SEQ ID NO: 899284 - DNA, 25 bp, Mus musculus
tgtagccagaacgtcattactgctt

SEQ ID NO: 899285 - DNA, 25 bp, Mus musculus
tgtagccatatgaaactttattgtt

SEQ ID NO: 899286 - DNA, 25 bp, Mus musculus
tgtagccatatgtaactttattgtt

SEQ ID NO: 899287 - DNA, 25 bp, Mus musculus
tgtagccatcccaagtatttaacat

SEQ ID NO: 899288 - DNA, 25 bp, Mus musculus
tgtagccatccctagtatttaacat

SEQ ID NO: 899289 - DNA, 25 bp, Mus musculus
tgtagccatctaatttcccagggag

SEQ ID NO: 899290 - DNA, 25 bp, Mus musculus
tgtagccatctattttcccagggag

SEQ ID NO: 899291 - DNA, 25 bp, Mus musculus
tgtagccatggcaaaggtccttgga

SEQ ID NO: 899292 - DNA, 25 bp, Mus musculus
tgtagccatggctaaggtccttgga

SEQ ID NO: 899293 - DNA, 25 bp, Mus musculus
tgtagccatgtgaagcttgctagcc

SEQ ID NO: 899294 - DNA, 25 bp, Mus musculus
tgtagccatgtgtagcttgctagcc

SEQ ID NO: 899295 - DNA, 25 bp, Mus musculus
tgtagcccacagatcctcaataaaa

SEQ ID NO: 899296 - DNA, 25 bp, Mus musculus
tgtagcccacagttcctcaataaaa

SEQ ID NO: 899297 - DNA, 25 bp, Mus musculus
tgtagcccacctctactggaattca

SEQ ID NO: 899298 - DNA, 25 bp, Mus musculus
tgtagcccacctgtactggaattca

SEQ ID NO: 899299 - DNA, 25 bp, Mus musculus
tgtagcccaggaatgatttaggtat

SEQ ID NO: 899300 - DNA, 25 bp, Mus musculus
tgtagcccaggaccagacaggagat

SEQ ID NO: 899301 - DNA, 25 bp, Mus musculus
tgtagcccaggagcagacaggagat

SEQ ID NO: 899302 - DNA, 25 bp, Mus musculus
tgtagcccaggattgatttaggtat

SEQ ID NO: 899303 - DNA, 25 bp, Mus musculus
tgtagcccatcaattttgctttctg

SEQ ID NO: 899304 - DNA, 25 bp, Mus musculus
tgtagcccatcatttttgctttctg

SEQ ID NO: 899305 - DNA, 25 bp, Mus musculus
tgtagcccatgaaagtcttaaactt

SEQ ID NO: 899306 - DNA, 25 bp, Mus musculus
tgtagcccatgatagtcttaaactt

SEQ ID NO: 899307 - DNA, 25 bp, Mus musculus
tgtagccccagaatcacaaatccct

SEQ ID NO: 899308 - DNA, 25 bp, Mus musculus
tgtagccccagattcacaaatccct

SEQ ID NO: 899309 - DNA, 25 bp, Mus musculus
tgtagccccaggcacaaacacgcag

SEQ ID NO: 899310 - DNA, 25 bp, Mus musculus
tgtagccccagggacaaacacgcag

SEQ ID NO: 899311 - DNA, 25 bp, Mus musculus
tgtagccccgaaatcccaagtgtga

SEQ ID NO: 899312 - DNA, 25 bp, Mus musculus
tgtagccccgaattcccaagtgtga

SEQ ID NO: 899313 - DNA, 25 bp, Mus musculus
tgtagcccctctagcttttatgcga

SEQ ID NO: 899314 - DNA, 25 bp, Mus musculus
tgtagcccctcttgcttttatgcga

SEQ ID NO: 899315 - DNA, 25 bp, Mus musculus
tgtagccccttgcagacaatcagct

SEQ ID NO: 899316 - DNA, 25 bp, Mus musculus
tgtagccccttggagacaatcagct

SEQ ID NO: 899317 - DNA, 25 bp, Mus musculus
tgtagccctcagaaccattagtgtt

SEQ ID NO: 899318 - DNA, 25 bp, Mus musculus
tgtagccctcagtaccattagtgtt

SEQ ID NO: 899319 - DNA, 25 bp, Mus musculus
tgtagcccttataatctgcagcttc

SEQ ID NO: 899320 - DNA, 25 bp, Mus musculus
tgtagcccttattatctgcagcttc

SEQ ID NO: 899321 - DNA, 25 bp, Mus musculus
tgtagccgagtgacggttagccttc

SEQ ID NO: 899322 - DNA, 25 bp, Mus musculus
tgtagccgagtgtcggttagccttc

SEQ ID NO: 899323 - DNA, 25 bp, Mus musculus
tgtagccggaagatctcgctcccag

SEQ ID NO: 899324 - DNA, 25 bp, Mus musculus
tgtagccggaagttctcgctcccag

SEQ ID NO: 899325 - DNA, 25 bp, Mus musculus
tgtagccgtggtatttccttctgtc

SEQ ID NO: 899326 - DNA, 25 bp, Mus musculus
tgtagccgtggtttttccttctgtc

SEQ ID NO: 899327 - DNA, 25 bp, Mus musculus
tgtagcctacagcatgatagcatgt

SEQ ID NO: 899328 - DNA, 25 bp, Mus musculus
tgtagcctacaggatgatagcatgt

SEQ ID NO: 899329 - DNA, 25 bp, Mus musculus
tgtagcctaccactcatgtctgctg

SEQ ID NO: 899330 - DNA, 25 bp, Mus musculus
tgtagcctaccagtcatgtctgctg

SEQ ID NO: 899331 - DNA, 25 bp, Mus musculus
tgtagcctacctctggcagcatact

SEQ ID NO: 899332 - DNA, 25 bp, Mus musculus
tgtagcctacctgtggcagcatact

SEQ ID NO: 899333 - DNA, 25 bp, Mus musculus
tgtagcctagctagagggccatgcc

SEQ ID NO: 899334 - DNA, 25 bp, Mus musculus
tgtagcctagcttgagggccatgcc

SEQ ID NO: 899335 - DNA, 25 bp, Mus musculus
tgtagcctctgtcacttgggaggct

SEQ ID NO: 899336 - DNA, 25 bp, Mus musculus
tgtagcctctgtgacttgggaggct

SEQ ID NO: 899337 - DNA, 25 bp, Mus musculus
tgtagcctgaagactatcctgaccc

SEQ ID NO: 899338 - DNA, 25 bp, Mus musculus
tgtagcctgaagtctatcctgaccc

SEQ ID NO: 899339 - DNA, 25 bp, Mus musculus
tgtagcctgatcaatcctatgccaa

SEQ ID NO: 899340 - DNA, 25 bp, Mus musculus
tgtagcctgatctatcctatgccaa

SEQ ID NO: 899341 - DNA, 25 bp, Mus musculus
tgtagcctgcccaagcttctcaggg

SEQ ID NO: 899342 - DNA, 25 bp, Mus musculus
tgtagcctgcccctgtatcatacac

SEQ ID NO: 899343 - DNA, 25 bp, Mus musculus
tgtagcctgcccgtgtatcatacac

SEQ ID NO: 899344 - DNA, 25 bp, Mus musculus
tgtagcctgccctagcttctcaggg

SEQ ID NO: 899345 - DNA, 25 bp, Mus musculus
tgtagcctgggcagcttaaccagag

SEQ ID NO: 899346 - DNA, 25 bp, Mus musculus
tgtagcctgggctgcttaaccagag

SEQ ID NO: 899347 - DNA, 25 bp, Mus musculus
tgtagccttcagaactagtgaggtt

SEQ ID NO: 899348 - DNA, 25 bp, Mus musculus
tgtagccttcagtactagtgaggtt

SEQ ID NO: 899349 - DNA, 25 bp, Mus musculus
tgtagccttcctctagtgtgtctga

SEQ ID NO: 899350 - DNA, 25 bp, Mus musculus
tgtagccttcctgtagtgtgtctga

SEQ ID NO: 899351 - DNA, 25 bp, Mus musculus
tgtagccttgcacgccctttaggag

SEQ ID NO: 899352 - DNA, 25 bp, Mus musculus
tgtagccttgcaggccctttaggag

SEQ ID NO: 899353 - DNA, 25 bp, Mus musculus
tgtagccttggaagttatgaacgat

SEQ ID NO: 899354 - DNA, 25 bp, Mus musculus
tgtagccttggatgttatgaacgat

SEQ ID NO: 899355 - DNA, 25 bp, Mus musculus
tgtagcctttggagctgtgaagcct

SEQ ID NO: 899356 - DNA, 25 bp, Mus musculus
tgtagcctttggctgtagtcccagt

SEQ ID NO: 899357 - DNA, 25 bp, Mus musculus
tgtagcctttgggtgtagtcccagt

SEQ ID NO: 899358 - DNA, 25 bp, Mus musculus
tgtagcctttggtgctgtgaagcct

SEQ ID NO: 899359 - DNA, 25 bp, Mus musculus
tgtagcctttgtcgtccctgatcaa

SEQ ID NO: 899360 - DNA, 25 bp, Mus musculus
tgtagcctttgtggtccctgatcaa

SEQ ID NO: 899361 - DNA, 25 bp, Mus musculus
tgtagccttttcagctgctgtggaa

SEQ ID NO: 899362 - DNA, 25 bp, Mus musculus
tgtagccttttctgctgctgtggaa

SEQ ID NO: 899363 - DNA, 25 bp, Mus musculus
tgtagcgagatcacgtcccgagagc

SEQ ID NO: 899364 - DNA, 25 bp, Mus musculus
tgtagcgagatctcgtcccgagagc

SEQ ID NO: 899365 - DNA, 25 bp, Mus musculus
tgtagcgatttccttctttgtctgt

SEQ ID NO: 899366 - DNA, 25 bp, Mus musculus
tgtagcgatttcgttctttgtctgt

SEQ ID NO: 899367 - DNA, 25 bp, Mus musculus
tgtagcgcacacagtgccttgtgat

SEQ ID NO: 899368 - DNA, 25 bp, Mus musculus
tgtagcgcacactgtgccttgtgat

SEQ ID NO: 899369 - DNA, 25 bp, Mus musculus
tgtagcggcagcagtggttgccaca

SEQ ID NO: 899370 - DNA, 25 bp, Mus musculus
tgtagcggcagctgtggttgccaca

SEQ ID NO: 899371 - DNA, 25 bp, Mus musculus
tgtagcggcctgatgtgcatgccac

SEQ ID NO: 899372 - DNA, 25 bp, Mus musculus
tgtagcggcctgttgtgcatgccac

SEQ ID NO: 899373 - DNA, 25 bp, Mus musculus
tgtagcggcgctccctgagctatca

SEQ ID NO: 899374 - DNA, 25 bp, Mus musculus
tgtagcggcgctgcctgagctatca

SEQ ID NO: 899375 - DNA, 25 bp, Mus musculus
tgtagcggctggagtctagaagcac

SEQ ID NO: 899376 - DNA, 25 bp, Mus musculus
tgtagcggctggtgtctagaagcac

SEQ ID NO: 899377 - DNA, 25 bp, Mus musculus
tgtagcgggcagctcctcaccctaa

SEQ ID NO: 899378 - DNA, 25 bp, Mus musculus
tgtagcgggcaggtcctcaccctaa

SEQ ID NO: 899379 - DNA, 25 bp, Mus musculus
tgtagcggtagtatgcagttctagc

SEQ ID NO: 899380 - DNA, 25 bp, Mus musculus
tgtagcggtagtttgcagttctagc

SEQ ID NO: 899381 - DNA, 25 bp, Mus musculus
tgtagcgtaggcagcagggtccctt

SEQ ID NO: 899382 - DNA, 25 bp, Mus musculus
tgtagcgtaggctgcagggtccctt

SEQ ID NO: 899383 - DNA, 25 bp, Mus musculus
tgtagcgtatcacccgattgcttga

SEQ ID NO: 899384 - DNA, 25 bp, Mus musculus
tgtagcgtatcagccgattgcttga

SEQ ID NO: 899385 - DNA, 25 bp, Mus musculus
tgtagcgtctttctcctgagcaata

SEQ ID NO: 899386 - DNA, 25 bp, Mus musculus
tgtagcgtctttgtcctgagcaata

SEQ ID NO: 899387 - DNA, 25 bp, Mus musculus
tgtagctacacacgtgcagccttct

SEQ ID NO: 899388 - DNA, 25 bp, Mus musculus
tgtagctacacaggtgcagccttct

SEQ ID NO: 899389 - DNA, 25 bp, Mus musculus
tgtagctactacagcaaggcttctg

SEQ ID NO: 899390 - DNA, 25 bp, Mus musculus
tgtagctactactgcaaggcttctg

SEQ ID NO: 899391 - DNA, 25 bp, Mus musculus
tgtagctagactacgggtgaggctc

SEQ ID NO: 899392 - DNA, 25 bp, Mus musculus
tgtagctagacttcgggtgaggctc

SEQ ID NO: 899393 - DNA, 25 bp, Mus musculus
tgtagctagccaagaaaatcacaag

SEQ ID NO: 899394 - DNA, 25 bp, Mus musculus
tgtagctagccatgaaaatcacaag

SEQ ID NO: 899395 - DNA, 25 bp, Mus musculus
tgtagctagctgactgagagtgcca

SEQ ID NO: 899396 - DNA, 25 bp, Mus musculus
tgtagctagctgtctgagagtgcca

SEQ ID NO: 899397 - DNA, 25 bp, Mus musculus
tgtagctaggttcctgggcttccta

SEQ ID NO: 899398 - DNA, 25 bp, Mus musculus
tgtagctaggttgctgggcttccta

SEQ ID NO: 899399 - DNA, 25 bp, Mus musculus
tgtagctatctactcaagtgaatga

SEQ ID NO: 899400 - DNA, 25 bp, Mus musculus
tgtagctatctagtcaagtgaatga

SEQ ID NO: 899401 - DNA, 25 bp, Mus musculus
tgtagctattcaacgtcaaacggat

SEQ ID NO: 899402 - DNA, 25 bp, Mus musculus
tgtagctattcatcgtcaaacggat

SEQ ID NO: 899403 - DNA, 25 bp, Mus musculus
tgtagctattccctcgactttagag

SEQ ID NO: 899404 - DNA, 25 bp, Mus musculus
tgtagctattccgtcgactttagag

SEQ ID NO: 899405 - DNA, 25 bp, Mus musculus
tgtagctcaacaccccatacttatt

SEQ ID NO: 899406 - DNA, 25 bp, Mus musculus
tgtagctcaacagcccatacttatt

SEQ ID NO: 899407 - DNA, 25 bp, Mus musculus
tgtagctcaactccatgcatggtgg

SEQ ID NO: 899408 - DNA, 25 bp, Mus musculus
tgtagctcaactgcatgcatggtgg

SEQ ID NO: 899409 - DNA, 25 bp, Mus musculus
tgtagctcactcctaggtctcaaaa

SEQ ID NO: 899410 - DNA, 25 bp, Mus musculus
tgtagctcactcgtaggtctcaaaa

SEQ ID NO: 899411 - DNA, 25 bp, Mus musculus
tgtagctcagatcatgacctcacca

SEQ ID NO: 899412 - DNA, 25 bp, Mus musculus
tgtagctcagatgatgacctcacca

SEQ ID NO: 899413 - DNA, 25 bp, Mus musculus
tgtagctcagctaacccaaggactt

SEQ ID NO: 899414 - DNA, 25 bp, Mus musculus
tgtagctcagctctaaggccccgtg

SEQ ID NO: 899415 - DNA, 25 bp, Mus musculus
tgtagctcagctgtaaggccccgtg

SEQ ID NO: 899416 - DNA, 25 bp, Mus musculus
tgtagctcagcttacccaaggactt

SEQ ID NO: 899417 - DNA, 25 bp, Mus musculus
tgtagctcaggccaacctcagattt

SEQ ID NO: 899418 - DNA, 25 bp, Mus musculus
tgtagctcaggcgaacctcagattt

SEQ ID NO: 899419 - DNA, 25 bp, Mus musculus
tgtagctcagtgcatgcatgcgcgt

SEQ ID NO: 899420 - DNA, 25 bp, Mus musculus
tgtagctcagtggatgcatgcgcgt

SEQ ID NO: 899421 - DNA, 25 bp, Mus musculus
tgtagctccaaaatgcaatcagtca

SEQ ID NO: 899422 - DNA, 25 bp, Mus musculus
tgtagctccaaattgcaatcagtca

SEQ ID NO: 899423 - DNA, 25 bp, Mus musculus
tgtagctccaagagccaggaggcaa

SEQ ID NO: 899424 - DNA, 25 bp, Mus musculus
tgtagctccaagtgccaggaggcaa

SEQ ID NO: 899425 - DNA, 25 bp, Mus musculus
tgtagctccagcaactctagaggct

SEQ ID NO: 899426 - DNA, 25 bp, Mus musculus
tgtagctccagctactctagaggct

SEQ ID NO: 899427 - DNA, 25 bp, Mus musculus
tgtagctcctggctccagagcaggc

SEQ ID NO: 899428 - DNA, 25 bp, Mus musculus
tgtagctcctgggtccagagcaggc

SEQ ID NO: 899429 - DNA, 25 bp, Mus musculus
tgtagctccttaagctgggaaggct

SEQ ID NO: 899430 - DNA, 25 bp, Mus musculus
tgtagctccttatgctgggaaggct

SEQ ID NO: 899431 - DNA, 25 bp, Mus musculus
tgtagctcctttcagccctcaggga

SEQ ID NO: 899432 - DNA, 25 bp, Mus musculus
tgtagctcctttgagccctcaggga

SEQ ID NO: 899433 - DNA, 25 bp, Mus musculus
tgtagctctgccaccgagagagata

SEQ ID NO: 899434 - DNA, 25 bp, Mus musculus
tgtagctctgcctccgagagagata

SEQ ID NO: 899435 - DNA, 25 bp, Mus musculus
tgtagctctgctatgtgaaacctca

SEQ ID NO: 899436 - DNA, 25 bp, Mus musculus
tgtagctctgctttgtgaaacctca

SEQ ID NO: 899437 - DNA, 25 bp, Mus musculus
tgtagctctttcactggagccaagc

SEQ ID NO: 899438 - DNA, 25 bp, Mus musculus
tgtagctctttctctggagccaagc

SEQ ID NO: 899439 - DNA, 25 bp, Mus musculus
tgtagctgaatgagccagagccctt

SEQ ID NO: 899440 - DNA, 25 bp, Mus musculus
tgtagctgaatgtgccagagccctt

SEQ ID NO: 899441 - DNA, 25 bp, Mus musculus
tgtagctgatgaaccgaataactac

SEQ ID NO: 899442 - DNA, 25 bp, Mus musculus
tgtagctgatgatccgaataactac

SEQ ID NO: 899443 - DNA, 25 bp, Mus musculus
tgtagctgcagaatagagctctctc

SEQ ID NO: 899444 - DNA, 25 bp, Mus musculus
tgtagctgcagattagagctctctc

SEQ ID NO: 899445 - DNA, 25 bp, Mus musculus
tgtagctgccgtcgccgtgagaacc

SEQ ID NO: 899446 - DNA, 25 bp, Mus musculus
tgtagctgccgtggccgtgagaacc

SEQ ID NO: 899447 - DNA, 25 bp, Mus musculus
tgtagctgcgaactcccgggctcga

SEQ ID NO: 899448 - DNA, 25 bp, Mus musculus
tgtagctgcgaagtcccgggctcga

SEQ ID NO: 899449 - DNA, 25 bp, Mus musculus
tgtagctggaacctaccttcttttt

SEQ ID NO: 899450 - DNA, 25 bp, Mus musculus
tgtagctggaacgtaccttcttttt

SEQ ID NO: 899451 - DNA, 25 bp, Mus musculus
tgtagctggcagctcattgatctct

SEQ ID NO: 899452 - DNA, 25 bp, Mus musculus
tgtagctggcaggtcattgatctct

SEQ ID NO: 899453 - DNA, 25 bp, Mus musculus
tgtagctggttccaggttaacccct

SEQ ID NO: 899454 - DNA, 25 bp, Mus musculus
tgtagctggttcgaggttaacccct

SEQ ID NO: 899455 - DNA, 25 bp, Mus musculus
tgtagctgtctgagtgtgttaaatt

SEQ ID NO: 899456 - DNA, 25 bp, Mus musculus
tgtagctgtctgtgtgtgttaaatt

SEQ ID NO: 899457 - DNA, 25 bp, Mus musculus
tgtagctgtggtaaccccatgtggg

SEQ ID NO: 899458 - DNA, 25 bp, Mus musculus
tgtagctgtggttaccccatgtggg

SEQ ID NO: 899459 - DNA, 25 bp, Mus musculus
tgtagctgttctccatgtgaatgct

SEQ ID NO: 899460 - DNA, 25 bp, Mus musculus
tgtagctgttctgcatgtgaatgct

SEQ ID NO: 899461 - DNA, 25 bp, Mus musculus
tgtagcttagtcatccgtttccgta

SEQ ID NO: 899462 - DNA, 25 bp, Mus musculus
tgtagcttagtcttccgtttccgta

SEQ ID NO: 899463 - DNA, 25 bp, Mus musculus
tgtagcttcaagctcgcatgtgcct

SEQ ID NO: 899464 - DNA, 25 bp, Mus musculus
tgtagcttcaaggtcgcatgtgcct

SEQ ID NO: 899465 - DNA, 25 bp, Mus musculus
tgtagcttcatcctaggactcagga

SEQ ID NO: 899466 - DNA, 25 bp, Mus musculus
tgtagcttcatcgtaggactcagga

SEQ ID NO: 899467 - DNA, 25 bp, Mus musculus
tgtagcttccataccataaccagtt

SEQ ID NO: 899468 - DNA, 25 bp, Mus musculus
tgtagcttccattccataaccagtt

SEQ ID NO: 899469 - DNA, 25 bp, Mus musculus
tgtagcttccctcccatctgagcat

SEQ ID NO: 899470 - DNA, 25 bp, Mus musculus
tgtagcttccctgccatctgagcat

SEQ ID NO: 899471 - DNA, 25 bp, Mus musculus
tgtagcttcctcagtgtaagcagcc

SEQ ID NO: 899472 - DNA, 25 bp, Mus musculus
tgtagcttcctctgtgtaagcagcc

SEQ ID NO: 899473 - DNA, 25 bp, Mus musculus
tgtagcttcctgatcacttctgagt

SEQ ID NO: 899474 - DNA, 25 bp, Mus musculus
tgtagcttcctgttcacttctgagt

SEQ ID NO: 899475 - DNA, 25 bp, Mus musculus
tgtagcttctggctcttccggaaga

SEQ ID NO: 899476 - DNA, 25 bp, Mus musculus
tgtagcttctgggtcttccggaaga

SEQ ID NO: 899477 - DNA, 25 bp, Mus musculus
tgtagcttggtacctcagcgttgac

SEQ ID NO: 899478 - DNA, 25 bp, Mus musculus
tgtagcttggtagctcagcgttgac

SEQ ID NO: 899479 - DNA, 25 bp, Mus musculus
tgtagcttgtacagtctttctgccc

SEQ ID NO: 899480 - DNA, 25 bp, Mus musculus
tgtagcttgtacattggcagaatgg

SEQ ID NO: 899481 - DNA, 25 bp, Mus musculus
tgtagcttgtactgtctttctgccc

SEQ ID NO: 899482 - DNA, 25 bp, Mus musculus
tgtagcttgtactttggcagaatgg

SEQ ID NO: 899483 - DNA, 25 bp, Mus musculus
tgtagctttacaacagtgctttgct

SEQ ID NO: 899484 - DNA, 25 bp, Mus musculus
tgtagctttacatcagtgctttgct

SEQ ID NO: 899485 - DNA, 25 bp, Mus musculus
tgtagctttagccatatcagtttaa

SEQ ID NO: 899486 - DNA, 25 bp, Mus musculus
tgtagctttagcgatatcagtttaa

SEQ ID NO: 899487 - DNA, 25 bp, Mus musculus
tgtagctttgcccaaacaggttgag

SEQ ID NO: 899488 - DNA, 25 bp, Mus musculus
tgtagctttgccgaaacaggttgag

SEQ ID NO: 899489 - DNA, 25 bp, Mus musculus
tgtagctttgctcaaccttgagttt

SEQ ID NO: 899490 - DNA, 25 bp, Mus musculus
tgtagctttgctgaaccttgagttt

SEQ ID NO: 899491 - DNA, 25 bp, Mus musculus
tgtagctttgttcctcaagacttgc

SEQ ID NO: 899492 - DNA, 25 bp, Mus musculus
tgtagctttgttgctcaagacttgc

SEQ ID NO: 899493 - DNA, 25 bp, Mus musculus
tgtagcttttggatagcttcgtcac

SEQ ID NO: 899494 - DNA, 25 bp, Mus musculus
tgtagcttttggttagcttcgtcac

SEQ ID NO: 899495 - DNA, 25 bp, Mus musculus
tgtagctttttcatcagtggtgatg

SEQ ID NO: 899496 - DNA, 25 bp, Mus musculus
tgtagctttttcttcagtggtgatg

SEQ ID NO: 899497 - DNA, 25 bp, Mus musculus
tgtaggaaagcaccctgactgtcac

SEQ ID NO: 899498 - DNA, 25 bp, Mus musculus
tgtaggaaagcagcctgactgtcac

SEQ ID NO: 899499 - DNA, 25 bp, Mus musculus
tgtaggaaattcacctgtgacccct

SEQ ID NO: 899500 - DNA, 25 bp, Mus musculus
tgtaggaaattctcctgtgacccct

SEQ ID NO: 899501 - DNA, 25 bp, Mus musculus
tgtaggacacaaaccaccataaatg

SEQ ID NO: 899502 - DNA, 25 bp, Mus musculus
tgtaggacacaatccaccataaatg

SEQ ID NO: 899503 - DNA, 25 bp, Mus musculus
tgtaggacagcacaacctcctggac

SEQ ID NO: 899504 - DNA, 25 bp, Mus musculus
tgtaggacagcagaacctcctggac

SEQ ID NO: 899505 - DNA, 25 bp, Mus musculus
tgtaggacaggtaccattctcactt

SEQ ID NO: 899506 - DNA, 25 bp, Mus musculus
tgtaggacaggttccattctcactt

SEQ ID NO: 899507 - DNA, 25 bp, Mus musculus
tgtaggacatttccgaacccgtggc

SEQ ID NO: 899508 - DNA, 25 bp, Mus musculus
tgtaggacatttgcgaacccgtggc

SEQ ID NO: 899509 - DNA, 25 bp, Mus musculus
tgtaggaccccaaagcaacatgttg

SEQ ID NO: 899510 - DNA, 25 bp, Mus musculus
tgtaggaccccatagcaacatgttg

SEQ ID NO: 899511 - DNA, 25 bp, Mus musculus
tgtaggactctcagcgccttcttca

SEQ ID NO: 899512 - DNA, 25 bp, Mus musculus
tgtaggactctcatctcactttagc

SEQ ID NO: 899513 - DNA, 25 bp, Mus musculus
tgtaggactctctgcgccttcttca

SEQ ID NO: 899514 - DNA, 25 bp, Mus musculus
tgtaggactctcttctcactttagc

SEQ ID NO: 899515 - DNA, 25 bp, Mus musculus
tgtaggactgctccttgtgttggat

SEQ ID NO: 899516 - DNA, 25 bp, Mus musculus
tgtaggactgctgcttgtgttggat

SEQ ID NO: 899517 - DNA, 25 bp, Mus musculus
tgtaggacttgtctaacatgcacaa

SEQ ID NO: 899518 - DNA, 25 bp, Mus musculus
tgtaggacttgtgtaacatgcacaa

SEQ ID NO: 899519 - DNA, 25 bp, Mus musculus
tgtaggagacccagcaggctcaact

SEQ ID NO: 899520 - DNA, 25 bp, Mus musculus
tgtaggagaccctgcaggctcaact

SEQ ID NO: 899521 - DNA, 25 bp, Mus musculus
tgtaggagacttctgcttctgagtg

SEQ ID NO: 899522 - DNA, 25 bp, Mus musculus
tgtaggagacttgtgcttctgagtg

SEQ ID NO: 899523 - DNA, 25 bp, Mus musculus
tgtaggataacacataaccataata

SEQ ID NO: 899524 - DNA, 25 bp, Mus musculus
tgtaggataacagataaccataata

SEQ ID NO: 899525 - DNA, 25 bp, Mus musculus
tgtaggatattcagtcctcccaact

SEQ ID NO: 899526 - DNA, 25 bp, Mus musculus
tgtaggatattctgtcctcccaact

SEQ ID NO: 899527 - DNA, 25 bp, Mus musculus
tgtaggatcctcagttttgaatagt

SEQ ID NO: 899528 - DNA, 25 bp, Mus musculus
tgtaggatcctctgttttgaatagt

SEQ ID NO: 899529 - DNA, 25 bp, Mus musculus
tgtaggatctatatgtccccactgt

SEQ ID NO: 899530 - DNA, 25 bp, Mus musculus
tgtaggatctatttgtccccactgt

SEQ ID NO: 899531 - DNA, 25 bp, Mus musculus
tgtaggatgcttacagaatctgggt

SEQ ID NO: 899532 - DNA, 25 bp, Mus musculus
tgtaggatgctttcagaatctgggt

SEQ ID NO: 899533 - DNA, 25 bp, Mus musculus
tgtaggattcttagacctttaactt

SEQ ID NO: 899534 - DNA, 25 bp, Mus musculus
tgtaggattctttgacctttaactt

SEQ ID NO: 899535 - DNA, 25 bp, Mus musculus
tgtaggattgaacccagaccagaga

SEQ ID NO: 899536 - DNA, 25 bp, Mus musculus
tgtaggattgaagccagaccagaga

SEQ ID NO: 899537 - DNA, 25 bp, Mus musculus
tgtaggcaaccaactccaagcttag

SEQ ID NO: 899538 - DNA, 25 bp, Mus musculus
tgtaggcaaccatctccaagcttag

SEQ ID NO: 899539 - DNA, 25 bp, Mus musculus
tgtaggcaagccacacaagccgagg

SEQ ID NO: 899540 - DNA, 25 bp, Mus musculus
tgtaggcaagcctcacaagccgagg

SEQ ID NO: 899541 - DNA, 25 bp, Mus musculus
tgtaggcacctcaaactggtcagaa

SEQ ID NO: 899542 - DNA, 25 bp, Mus musculus
tgtaggcacctctaactggtcagaa

SEQ ID NO: 899543 - DNA, 25 bp, Mus musculus
tgtaggcactgtactcaccccagaa

SEQ ID NO: 899544 - DNA, 25 bp, Mus musculus
tgtaggcactgttctcaccccagaa

SEQ ID NO: 899545 - DNA, 25 bp, Mus musculus
tgtaggcagagcaaccccacctcca

SEQ ID NO: 899546 - DNA, 25 bp, Mus musculus
tgtaggcagagctaccccacctcca

SEQ ID NO: 899547 - DNA, 25 bp, Mus musculus
tgtaggcagagtaaccccagcgtaa

SEQ ID NO: 899548 - DNA, 25 bp, Mus musculus
tgtaggcagagttaccccagcgtaa

SEQ ID NO: 899549 - DNA, 25 bp, Mus musculus
tgtaggcagggtctgtgactcccta

SEQ ID NO: 899550 - DNA, 25 bp, Mus musculus
tgtaggcagggtgtgtgactcccta

SEQ ID NO: 899551 - DNA, 25 bp, Mus musculus
tgtaggcattccaggaccacagggt

SEQ ID NO: 899552 - DNA, 25 bp, Mus musculus
tgtaggcattcctggaccacagggt

SEQ ID NO: 899553 - DNA, 25 bp, Mus musculus
tgtaggccagtgcttcctgctaaga

SEQ ID NO: 899554 - DNA, 25 bp, Mus musculus
tgtaggccagtggttcctgctaaga

SEQ ID NO: 899555 - DNA, 25 bp, Mus musculus
tgtaggccatttctgtttgaggcca

SEQ ID NO: 899556 - DNA, 25 bp, Mus musculus
tgtaggccatttgtgtttgaggcca

SEQ ID NO: 899557 - DNA, 25 bp, Mus musculus
tgtaggcccagcatccaactcaagt

SEQ ID NO: 899558 - DNA, 25 bp, Mus musculus
tgtaggcccagcttccaactcaagt

SEQ ID NO: 899559 - DNA, 25 bp, Mus musculus
tgtaggcccaggaagcgctgcagca

SEQ ID NO: 899560 - DNA, 25 bp, Mus musculus
tgtaggcccaggtagcgctgcagca

SEQ ID NO: 899561 - DNA, 25 bp, Mus musculus
tgtaggccctaacgtggtcaggctt

SEQ ID NO: 899562 - DNA, 25 bp, Mus musculus
tgtaggccctaaggtggtcaggctt

SEQ ID NO: 899563 - DNA, 25 bp, Mus musculus
tgtaggccgtgacgtttctgtctcc

SEQ ID NO: 899564 - DNA, 25 bp, Mus musculus
tgtaggccgtgaggtttctgtctcc

SEQ ID NO: 899565 - DNA, 25 bp, Mus musculus
tgtaggcctcaaccctagtggccaa

SEQ ID NO: 899566 - DNA, 25 bp, Mus musculus
tgtaggcctcaagcctagtggccaa

SEQ ID NO: 899567 - DNA, 25 bp, Mus musculus
tgtaggcctcagatcaaaccagaaa

SEQ ID NO: 899568 - DNA, 25 bp, Mus musculus
tgtaggcctcagttcaaaccagaaa

SEQ ID NO: 899569 - DNA, 25 bp, Mus musculus
tgtaggcctgcactatgtggagttt

SEQ ID NO: 899570 - DNA, 25 bp, Mus musculus
tgtaggcctgcagtatgtggagttt

SEQ ID NO: 899571 - DNA, 25 bp, Mus musculus
tgtaggcgctggactaatcctgctg

SEQ ID NO: 899572 - DNA, 25 bp, Mus musculus
tgtaggcgctggtctaatcctgctg

SEQ ID NO: 899573 - DNA, 25 bp, Mus musculus
tgtaggcgtacccataagcccagtt

SEQ ID NO: 899574 - DNA, 25 bp, Mus musculus
tgtaggcgtaccgataagcccagtt

SEQ ID NO: 899575 - DNA, 25 bp, Mus musculus
tgtaggctacgcaactatgctcaga

SEQ ID NO: 899576 - DNA, 25 bp, Mus musculus
tgtaggctacgctactatgctcaga

SEQ ID NO: 899577 - DNA, 25 bp, Mus musculus
tgtaggctatctcattttctcgctt

SEQ ID NO: 899578 - DNA, 25 bp, Mus musculus
tgtaggctatctgattttctcgctt

SEQ ID NO: 899579 - DNA, 25 bp, Mus musculus
tgtaggctccagagcttaccaagca

SEQ ID NO: 899580 - DNA, 25 bp, Mus musculus
tgtaggctccagtgcttaccaagca

SEQ ID NO: 899581 - DNA, 25 bp, Mus musculus
tgtaggctgagaatgcaacagaaaa

SEQ ID NO: 899582 - DNA, 25 bp, Mus musculus
tgtaggctgagattgcaacagaaaa

SEQ ID NO: 899583 - DNA, 25 bp, Mus musculus
tgtaggctgtttcccttcttactcc

SEQ ID NO: 899584 - DNA, 25 bp, Mus musculus
tgtaggctgtttgccttcttactcc

SEQ ID NO: 899585 - DNA, 25 bp, Mus musculus
tgtaggctttgtcttccactagcag

SEQ ID NO: 899586 - DNA, 25 bp, Mus musculus
tgtaggctttgtgttccactagcag

SEQ ID NO: 899587 - DNA, 25 bp, Mus musculus
tgtagggactctccctgtggtaatt

SEQ ID NO: 899588 - DNA, 25 bp, Mus musculus
tgtagggactctgcctgtggtaatt

SEQ ID NO: 899589 - DNA, 25 bp, Mus musculus
tgtagggagcaaccactgtgtagcc

SEQ ID NO: 899590 - DNA, 25 bp, Mus musculus
tgtagggagcaagcactgtgtagcc

SEQ ID NO: 899591 - DNA, 25 bp, Mus musculus
tgtagggcacacacaaaagcagaag

SEQ ID NO: 899592 - DNA, 25 bp, Mus musculus
tgtagggcacactcaaaagcagaag

SEQ ID NO: 899593 - DNA, 25 bp, Mus musculus
tgtagggccctactatggtgaatta

SEQ ID NO: 899594 - DNA, 25 bp, Mus musculus
tgtagggccctagtatggtgaatta

SEQ ID NO: 899595 - DNA, 25 bp, Mus musculus
tgtagggcgagtagtttttcaagtc

SEQ ID NO: 899596 - DNA, 25 bp, Mus musculus
tgtagggcgagttgtttttcaagtc

SEQ ID NO: 899597 - DNA, 25 bp, Mus musculus
tgtagggcttttcacactgctgctg

SEQ ID NO: 899598 - DNA, 25 bp, Mus musculus
tgtagggcttttgacactgctgctg

SEQ ID NO: 899599 - DNA, 25 bp, Mus musculus
tgtagggtaacccaatgctcgctcg

SEQ ID NO: 899600 - DNA, 25 bp, Mus musculus
tgtagggtaaccgaatgctcgctcg

SEQ ID NO: 899601 - DNA, 25 bp, Mus musculus
tgtagggtgacaattgcgcagcaga

SEQ ID NO: 899602 - DNA, 25 bp, Mus musculus
tgtagggtgacatttgcgcagcaga

SEQ ID NO: 899603 - DNA, 25 bp, Mus musculus
tgtagggttttgcacaagcatagcc

SEQ ID NO: 899604 - DNA, 25 bp, Mus musculus
tgtagggttttggacaagcatagcc

SEQ ID NO: 899605 - DNA, 25 bp, Mus musculus
tgtaggtaacccaaatcagcattca

SEQ ID NO: 899606 - DNA, 25 bp, Mus musculus
tgtaggtaaccctaatcagcattca

SEQ ID NO: 899607 - DNA, 25 bp, Mus musculus
tgtaggtacattcttgccgtggcac

SEQ ID NO: 899608 - DNA, 25 bp, Mus musculus
tgtaggtacattgttgccgtggcac

SEQ ID NO: 899609 - DNA, 25 bp, Mus musculus
tgtaggtaccctccttttgattaag

SEQ ID NO: 899610 - DNA, 25 bp, Mus musculus
tgtaggtaccctgcttttgattaag

SEQ ID NO: 899611 - DNA, 25 bp, Mus musculus
tgtaggtagcctaaacttttagcca

SEQ ID NO: 899612 - DNA, 25 bp, Mus musculus
tgtaggtagccttaacttttagcca

SEQ ID NO: 899613 - DNA, 25 bp, Mus musculus
tgtaggtagctcactctgtggagct

SEQ ID NO: 899614 - DNA, 25 bp, Mus musculus
tgtaggtagctctctctgtggagct

SEQ ID NO: 899615 - DNA, 25 bp, Mus musculus
tgtaggtaggccagtgccgcaaaca

SEQ ID NO: 899616 - DNA, 25 bp, Mus musculus
tgtaggtaggcctgtgccgcaaaca

SEQ ID NO: 899617 - DNA, 25 bp, Mus musculus
tgtaggtagggcattatacccttct

SEQ ID NO: 899618 - DNA, 25 bp, Mus musculus
tgtaggtagggctttatacccttct

SEQ ID NO: 899619 - DNA, 25 bp, Mus musculus
tgtaggtcagttccacaggcttgct

SEQ ID NO: 899620 - DNA, 25 bp, Mus musculus
tgtaggtcagttgcacaggcttgct

SEQ ID NO: 899621 - DNA, 25 bp, Mus musculus
tgtaggtcatctctatcacgtctgc

SEQ ID NO: 899622 - DNA, 25 bp, Mus musculus
tgtaggtcatctgtatcacgtctgc

SEQ ID NO: 899623 - DNA, 25 bp, Mus musculus
tgtaggtcattgagagccacctgat

SEQ ID NO: 899624 - DNA, 25 bp, Mus musculus
tgtaggtcattgtgagccacctgat

SEQ ID NO: 899625 - DNA, 25 bp, Mus musculus
tgtaggtccatgctagactgcttgc

SEQ ID NO: 899626 - DNA, 25 bp, Mus musculus
tgtaggtccatggtagactgcttgc

SEQ ID NO: 899627 - DNA, 25 bp, Mus musculus
tgtaggtcctagaatcctccgaagc

SEQ ID NO: 899628 - DNA, 25 bp, Mus musculus
tgtaggtcctagtatcctccgaagc

SEQ ID NO: 899629 - DNA, 25 bp, Mus musculus
tgtaggtcggttctattccttttcg

SEQ ID NO: 899630 - DNA, 25 bp, Mus musculus
tgtaggtcggttgtattccttttcg

SEQ ID NO: 899631 - DNA, 25 bp, Mus musculus
tgtaggtgaccacggcaccgagcat

SEQ ID NO: 899632 - DNA, 25 bp, Mus musculus
tgtaggtgaccagggcaccgagcat

SEQ ID NO: 899633 - DNA, 25 bp, Mus musculus
tgtaggtggagtcaccacctcccag

SEQ ID NO: 899634 - DNA, 25 bp, Mus musculus
tgtaggtggagtgaccacctcccag

SEQ ID NO: 899635 - DNA, 25 bp, Mus musculus
tgtaggttcactccatctggcagac

SEQ ID NO: 899636 - DNA, 25 bp, Mus musculus
tgtaggttcactgcatctggcagac

SEQ ID NO: 899637 - DNA, 25 bp, Mus musculus
tgtaggttcctgcatgcatttggat

SEQ ID NO: 899638 - DNA, 25 bp, Mus musculus
tgtaggttcctggatgcatttggat

SEQ ID NO: 899639 - DNA, 25 bp, Mus musculus
tgtaggttgtgaccagccaggccct

SEQ ID NO: 899640 - DNA, 25 bp, Mus musculus
tgtaggttgtgagcagccaggccct

SEQ ID NO: 899641 - DNA, 25 bp, Mus musculus
tgtaggtttattaacaacccagtgg

SEQ ID NO: 899642 - DNA, 25 bp, Mus musculus
tgtaggtttatttacaacccagtgg

SEQ ID NO: 899643 - DNA, 25 bp, Mus musculus
tgtaggtttccaatctgggagccag

SEQ ID NO: 899644 - DNA, 25 bp, Mus musculus
tgtaggtttccattctgggagccag

SEQ ID NO: 899645 - DNA, 25 bp, Mus musculus
tgtaggtttgacaccatatgaatat

SEQ ID NO: 899646 - DNA, 25 bp, Mus musculus
tgtaggtttgactccatatgaatat

SEQ ID NO: 899647 - DNA, 25 bp, Mus musculus
tgtaggttttctacggttactgcta

SEQ ID NO: 899648 - DNA, 25 bp, Mus musculus
tgtaggttttcttcggttactgcta

SEQ ID NO: 899649 - DNA, 25 bp, Mus musculus
tgtagtaaacttataactgctttag

SEQ ID NO: 899650 - DNA, 25 bp, Mus musculus
tgtagtaaacttttaactgctttag

SEQ ID NO: 899651 - DNA, 25 bp, Mus musculus
tgtagtaaagccatgcgcttccttt

SEQ ID NO: 899652 - DNA, 25 bp, Mus musculus
tgtagtaaagccttgcgcttccttt

SEQ ID NO: 899653 - DNA, 25 bp, Mus musculus
tgtagtaaaggtccccaaggaatta

SEQ ID NO: 899654 - DNA, 25 bp, Mus musculus
tgtagtaaaggtgcccaaggaatta

SEQ ID NO: 899655 - DNA, 25 bp, Mus musculus
tgtagtaacttcctactaagcccca

SEQ ID NO: 899656 - DNA, 25 bp, Mus musculus
tgtagtaacttcgtactaagcccca

SEQ ID NO: 899657 - DNA, 25 bp, Mus musculus
tgtagtaaggagacccacgtttcct

SEQ ID NO: 899658 - DNA, 25 bp, Mus musculus
tgtagtaaggagtcccacgtttcct

SEQ ID NO: 899659 - DNA, 25 bp, Mus musculus
tgtagtaaggcacagaccgtccact

SEQ ID NO: 899660 - DNA, 25 bp, Mus musculus
tgtagtaaggcagagaccgtccact

SEQ ID NO: 899661 - DNA, 25 bp, Mus musculus
tgtagtaatgcaatcaggccaagga

SEQ ID NO: 899662 - DNA, 25 bp, Mus musculus
tgtagtaatgcattcaggccaagga

SEQ ID NO: 899663 - DNA, 25 bp, Mus musculus
tgtagtaatgcccttggccacacta

SEQ ID NO: 899664 - DNA, 25 bp, Mus musculus
tgtagtaatgccgttggccacacta

SEQ ID NO: 899665 - DNA, 25 bp, Mus musculus
tgtagtaattataccttgtttccca

SEQ ID NO: 899666 - DNA, 25 bp, Mus musculus
tgtagtaattattccttgtttccca

SEQ ID NO: 899667 - DNA, 25 bp, Mus musculus
tgtagtaccaacacgtccctgtatg

SEQ ID NO: 899668 - DNA, 25 bp, Mus musculus
tgtagtaccaacagaagtgccgact

SEQ ID NO: 899669 - DNA, 25 bp, Mus musculus
tgtagtaccaactcgtccctgtatg

SEQ ID NO: 899670 - DNA, 25 bp, Mus musculus
tgtagtaccaactgaagtgccgact

SEQ ID NO: 899671 - DNA, 25 bp, Mus musculus
tgtagtaccacccacaagttcttac

SEQ ID NO: 899672 - DNA, 25 bp, Mus musculus
tgtagtaccaccgacaagttcttac

SEQ ID NO: 899673 - DNA, 25 bp, Mus musculus
tgtagtaccttgctccaaatggatc

SEQ ID NO: 899674 - DNA, 25 bp, Mus musculus
tgtagtaccttggtccaaatggatc

SEQ ID NO: 899675 - DNA, 25 bp, Mus musculus
tgtagtagacacatggagcccagga

SEQ ID NO: 899676 - DNA, 25 bp, Mus musculus
tgtagtagacacttggagcccagga

SEQ ID NO: 899677 - DNA, 25 bp, Mus musculus
tgtagtagtcatctgctttgtctct

SEQ ID NO: 899678 - DNA, 25 bp, Mus musculus
tgtagtagtcatgtgctttgtctct

SEQ ID NO: 899679 - DNA, 25 bp, Mus musculus
tgtagtagtcttcctgccaggagag

SEQ ID NO: 899680 - DNA, 25 bp, Mus musculus
tgtagtagtcttgctgccaggagag

SEQ ID NO: 899681 - DNA, 25 bp, Mus musculus
tgtagtatagatacaaacctcctgt

SEQ ID NO: 899682 - DNA, 25 bp, Mus musculus
tgtagtatagattcaaacctcctgt

SEQ ID NO: 899683 - DNA, 25 bp, Mus musculus
tgtagtatctggaccattcccaaac

SEQ ID NO: 899684 - DNA, 25 bp, Mus musculus
tgtagtatctggtccattcccaaac

SEQ ID NO: 899685 - DNA, 25 bp, Mus musculus
tgtagtatgtagaaagcatttgact

SEQ ID NO: 899686 - DNA, 25 bp, Mus musculus
tgtagtatgtagtaagcatttgact

SEQ ID NO: 899687 - DNA, 25 bp, Mus musculus
tgtagtatttatcctttctctccct

SEQ ID NO: 899688 - DNA, 25 bp, Mus musculus
tgtagtatttatgctttctctccct

SEQ ID NO: 899689 - DNA, 25 bp, Mus musculus
tgtagtcaaatcagctcccggagca

SEQ ID NO: 899690 - DNA, 25 bp, Mus musculus
tgtagtcaaatctgctcccggagca

SEQ ID NO: 899691 - DNA, 25 bp, Mus musculus
tgtagtcacagcagcccatgagttg

SEQ ID NO: 899692 - DNA, 25 bp, Mus musculus
tgtagtcacagctgcccatgagttg

SEQ ID NO: 899693 - DNA, 25 bp, Mus musculus
tgtagtcacatacctgggcccacag

SEQ ID NO: 899694 - DNA, 25 bp, Mus musculus
tgtagtcacatagctgggcccacag

SEQ ID NO: 899695 - DNA, 25 bp, Mus musculus
tgtagtcactgactcctctcttcat

SEQ ID NO: 899696 - DNA, 25 bp, Mus musculus
tgtagtcactgagtcctctcttcat

SEQ ID NO: 899697 - DNA, 25 bp, Mus musculus
tgtagtcactgcaagcggcccatga

SEQ ID NO: 899698 - DNA, 25 bp, Mus musculus
tgtagtcactgctagcggcccatga

SEQ ID NO: 899699 - DNA, 25 bp, Mus musculus
tgtagtcagcccaccctaaaagtgg

SEQ ID NO: 899700 - DNA, 25 bp, Mus musculus
tgtagtcagccctccctaaaagtgg

SEQ ID NO: 899701 - DNA, 25 bp, Mus musculus
tgtagtccaaagataccttacttgt

SEQ ID NO: 899702 - DNA, 25 bp, Mus musculus
tgtagtccaaagttaccttacttgt

SEQ ID NO: 899703 - DNA, 25 bp, Mus musculus
tgtagtccactgctaagtcctcaat

SEQ ID NO: 899704 - DNA, 25 bp, Mus musculus
tgtagtccactggtaagtcctcaat

SEQ ID NO: 899705 - DNA, 25 bp, Mus musculus
tgtagtccagacagctcacaaacct

SEQ ID NO: 899706 - DNA, 25 bp, Mus musculus
tgtagtccagactgctcacaaacct

SEQ ID NO: 899707 - DNA, 25 bp, Mus musculus
tgtagtcccaaaactcaagcaggta

SEQ ID NO: 899708 - DNA, 25 bp, Mus musculus
tgtagtcccaaacctcatcaacaag

SEQ ID NO: 899709 - DNA, 25 bp, Mus musculus
tgtagtcccaaagctcatcaacaag

SEQ ID NO: 899710 - DNA, 25 bp, Mus musculus
tgtagtcccaaatctcaagcaggta

SEQ ID NO: 899711 - DNA, 25 bp, Mus musculus
tgtagtcccagtatcccccgactag

SEQ ID NO: 899712 - DNA, 25 bp, Mus musculus
tgtagtcccagtttcccccgactag

SEQ ID NO: 899713 - DNA, 25 bp, Mus musculus
tgtagtccccaccgttatttgtaat

SEQ ID NO: 899714 - DNA, 25 bp, Mus musculus
tgtagtccccacggttatttgtaat

SEQ ID NO: 899715 - DNA, 25 bp, Mus musculus
tgtagtcccctgacacaggaggata

SEQ ID NO: 899716 - DNA, 25 bp, Mus musculus
tgtagtcccctgtcacaggaggata

SEQ ID NO: 899717 - DNA, 25 bp, Mus musculus
tgtagtccctccaaaattacttata

SEQ ID NO: 899718 - DNA, 25 bp, Mus musculus
tgtagtccctcctaaattacttata

SEQ ID NO: 899719 - DNA, 25 bp, Mus musculus
tgtagtcccttgatttattgggtaa

SEQ ID NO: 899720 - DNA, 25 bp, Mus musculus
tgtagtcccttgttttattgggtaa

SEQ ID NO: 899721 - DNA, 25 bp, Mus musculus
tgtagtccttaacaccttgcacgga

SEQ ID NO: 899722 - DNA, 25 bp, Mus musculus
tgtagtccttaagaccttgcacgga

SEQ ID NO: 899723 - DNA, 25 bp, Mus musculus
tgtagtcgtctcaagcctttaagga

SEQ ID NO: 899724 - DNA, 25 bp, Mus musculus
tgtagtcgtctctagcctttaagga

SEQ ID NO: 899725 - DNA, 25 bp, Mus musculus
tgtagtctacagatcccacaaagtt

SEQ ID NO: 899726 - DNA, 25 bp, Mus musculus
tgtagtctacagttcccacaaagtt

SEQ ID NO: 899727 - DNA, 25 bp, Mus musculus
tgtagtctagccaactcctcgagaa

SEQ ID NO: 899728 - DNA, 25 bp, Mus musculus
tgtagtctagcctactcctcgagaa

SEQ ID NO: 899729 - DNA, 25 bp, Mus musculus
tgtagtctcaacacttgggctcaag

SEQ ID NO: 899730 - DNA, 25 bp, Mus musculus
tgtagtctcaactcttgggctcaag

SEQ ID NO: 899731 - DNA, 25 bp, Mus musculus
tgtagtctcataattttgtattctc

SEQ ID NO: 899732 - DNA, 25 bp, Mus musculus
tgtagtctcatatttttgtattctc

SEQ ID NO: 899733 - DNA, 25 bp, Mus musculus
tgtagtctgaaactgcctttgtccc

SEQ ID NO: 899734 - DNA, 25 bp, Mus musculus
tgtagtctgaaagtgcctttgtccc

SEQ ID NO: 899735 - DNA, 25 bp, Mus musculus
tgtagtctgaacaggtttaccctgc

SEQ ID NO: 899736 - DNA, 25 bp, Mus musculus
tgtagtctgaactggtttaccctgc

SEQ ID NO: 899737 - DNA, 25 bp, Mus musculus
tgtagtctgctaaacctggtaacgt

SEQ ID NO: 899738 - DNA, 25 bp, Mus musculus
tgtagtctgctatacctggtaacgt

SEQ ID NO: 899739 - DNA, 25 bp, Mus musculus
tgtagtctgctcatttcagccacag

SEQ ID NO: 899740 - DNA, 25 bp, Mus musculus
tgtagtctgctcttttcagccacag

SEQ ID NO: 899741 - DNA, 25 bp, Mus musculus
tgtagtcttaagacccttaccctag

SEQ ID NO: 899742 - DNA, 25 bp, Mus musculus
tgtagtcttaagtcccttaccctag

SEQ ID NO: 899743 - DNA, 25 bp, Mus musculus
tgtagtcttgtgagatgtccccttt

SEQ ID NO: 899744 - DNA, 25 bp, Mus musculus
tgtagtcttgtgtgatgtccccttt

SEQ ID NO: 899745 - DNA, 25 bp, Mus musculus
tgtagtgaatcacccttctatccaa

SEQ ID NO: 899746 - DNA, 25 bp, Mus musculus
tgtagtgaatcagccttctatccaa

SEQ ID NO: 899747 - DNA, 25 bp, Mus musculus
tgtagtgacccgaggcaccgctgac

SEQ ID NO: 899748 - DNA, 25 bp, Mus musculus
tgtagtgacccgtggcaccgctgac

SEQ ID NO: 899749 - DNA, 25 bp, Mus musculus
tgtagtgagagtccccacaacttgc

SEQ ID NO: 899750 - DNA, 25 bp, Mus musculus
tgtagtgagagtgcccacaacttgc

SEQ ID NO: 899751 - DNA, 25 bp, Mus musculus
tgtagtgaggccctttctcatagcc

SEQ ID NO: 899752 - DNA, 25 bp, Mus musculus
tgtagtgaggccgtttctcatagcc

SEQ ID NO: 899753 - DNA, 25 bp, Mus musculus
tgtagtgcccacactggcgggtact

SEQ ID NO: 899754 - DNA, 25 bp, Mus musculus
tgtagtgcccactctggcgggtact

SEQ ID NO: 899755 - DNA, 25 bp, Mus musculus
tgtagtgccctacctggaggacctg

SEQ ID NO: 899756 - DNA, 25 bp, Mus musculus
tgtagtgccctagctggaggacctg

SEQ ID NO: 899757 - DNA, 25 bp, Mus musculus
tgtagtgccgagacccgcaggcaca

SEQ ID NO: 899758 - DNA, 25 bp, Mus musculus
tgtagtgccgagtcccgcaggcaca

SEQ ID NO: 899759 - DNA, 25 bp, Mus musculus
tgtagtgccgtcagcattctttttt

SEQ ID NO: 899760 - DNA, 25 bp, Mus musculus
tgtagtgccgtctgcattctttttt

SEQ ID NO: 899761 - DNA, 25 bp, Mus musculus
tgtagtgcctttattgtgttctgag

SEQ ID NO: 899762 - DNA, 25 bp, Mus musculus
tgtagtgccttttttgtgttctgag

SEQ ID NO: 899763 - DNA, 25 bp, Mus musculus
tgtagtgctagaagccccaaccaag

SEQ ID NO: 899764 - DNA, 25 bp, Mus musculus
tgtagtgctagatgccccaaccaag

SEQ ID NO: 899765 - DNA, 25 bp, Mus musculus
tgtagtgctcacactgggccatagt

SEQ ID NO: 899766 - DNA, 25 bp, Mus musculus
tgtagtgctcacaggtcccagcacc

SEQ ID NO: 899767 - DNA, 25 bp, Mus musculus
tgtagtgctcactctgggccatagt

SEQ ID NO: 899768 - DNA, 25 bp, Mus musculus
tgtagtgctcactggtcccagcacc

SEQ ID NO: 899769 - DNA, 25 bp, Mus musculus
tgtagtgctggtactcaaactccgc

SEQ ID NO: 899770 - DNA, 25 bp, Mus musculus
tgtagtgctggttctcaaactccgc

SEQ ID NO: 899771 - DNA, 25 bp, Mus musculus
tgtagtgctttaaagctcccgagaa

SEQ ID NO: 899772 - DNA, 25 bp, Mus musculus
tgtagtgctttatagctcccgagaa

SEQ ID NO: 899773 - DNA, 25 bp, Mus musculus
tgtagtggaagacctgccatccctg

SEQ ID NO: 899774 - DNA, 25 bp, Mus musculus
tgtagtggaagagctgccatccctg

SEQ ID NO: 899775 - DNA, 25 bp, Mus musculus
tgtagtggaggccatggacttcaat

SEQ ID NO: 899776 - DNA, 25 bp, Mus musculus
tgtagtggaggcgatggacttcaat

SEQ ID NO: 899777 - DNA, 25 bp, Mus musculus
tgtagtggattgctttgacacctgc

SEQ ID NO: 899778 - DNA, 25 bp, Mus musculus
tgtagtggattggtttgacacctgc

SEQ ID NO: 899779 - DNA, 25 bp, Mus musculus
tgtagtggcctgaacactctgtcct

SEQ ID NO: 899780 - DNA, 25 bp, Mus musculus
tgtagtggcctgtacactctgtcct

SEQ ID NO: 899781 - DNA, 25 bp, Mus musculus
tgtagtggctcacttgtaattccag

SEQ ID NO: 899782 - DNA, 25 bp, Mus musculus
tgtagtggctcagttgtaattccag

SEQ ID NO: 899783 - DNA, 25 bp, Mus musculus
tgtagtggtgagctgacacatccag

SEQ ID NO: 899784 - DNA, 25 bp, Mus musculus
tgtagtggtgaggtgacacatccag

SEQ ID NO: 899785 - DNA, 25 bp, Mus musculus
tgtagtgtcacaacctcatcagctt

SEQ ID NO: 899786 - DNA, 25 bp, Mus musculus
tgtagtgtcacatcctcatcagctt

SEQ ID NO: 899787 - DNA, 25 bp, Mus musculus
tgtagtgtcataattccctcaaccc

SEQ ID NO: 899788 - DNA, 25 bp, Mus musculus
tgtagtgtcatatttccctcaaccc

SEQ ID NO: 899789 - DNA, 25 bp, Mus musculus
tgtagtgtcggcacctaatgcagga

SEQ ID NO: 899790 - DNA, 25 bp, Mus musculus
tgtagtgtcggctcctaatgcagga

SEQ ID NO: 899791 - DNA, 25 bp, Mus musculus
tgtagtgtctgtacactcattgctt

SEQ ID NO: 899792 - DNA, 25 bp, Mus musculus
tgtagtgtctgttcactcattgctt

SEQ ID NO: 899793 - DNA, 25 bp, Mus musculus
tgtagtgtgactacagccttcatgt

SEQ ID NO: 899794 - DNA, 25 bp, Mus musculus
tgtagtgtgacttcagccttcatgt

SEQ ID NO: 899795 - DNA, 25 bp, Mus musculus
tgtagtgtgctgacgaccctgaaat

SEQ ID NO: 899796 - DNA, 25 bp, Mus musculus
tgtagtgtgctgtcgaccctgaaat

SEQ ID NO: 899797 - DNA, 25 bp, Mus musculus
tgtagtgtggtgctttttctttgac

SEQ ID NO: 899798 - DNA, 25 bp, Mus musculus
tgtagtgtggtggtttttctttgac

SEQ ID NO: 899799 - DNA, 25 bp, Mus musculus
tgtagtgtgtctacaccgttcccaa

SEQ ID NO: 899800 - DNA, 25 bp, Mus musculus
tgtagtgtgtcttcaccgttcccaa

SEQ ID NO: 899801 - DNA, 25 bp, Mus musculus
tgtagtgttccaagcaccacatcaa

SEQ ID NO: 899802 - DNA, 25 bp, Mus musculus
tgtagtgttccatgcaccacatcaa

SEQ ID NO: 899803 - DNA, 25 bp, Mus musculus
tgtagtgttgtaactgtttcctgtt

SEQ ID NO: 899804 - DNA, 25 bp, Mus musculus
tgtagtgttgtatctgtttcctgtt

SEQ ID NO: 899805 - DNA, 25 bp, Mus musculus
tgtagtgtttatcccagaagtctct

SEQ ID NO: 899806 - DNA, 25 bp, Mus musculus
tgtagtgtttatgccagaagtctct

SEQ ID NO: 899807 - DNA, 25 bp, Mus musculus
tgtagtgtttctaagagtgcacatt

SEQ ID NO: 899808 - DNA, 25 bp, Mus musculus
tgtagtgtttcttagagtgcacatt

SEQ ID NO: 899809 - DNA, 25 bp, Mus musculus
tgtagttaacatccatgttcagcat

SEQ ID NO: 899810 - DNA, 25 bp, Mus musculus
tgtagttaacatgcatgttcagcat

SEQ ID NO: 899811 - DNA, 25 bp, Mus musculus
tgtagttacaataccagcacactgg

SEQ ID NO: 899812 - DNA, 25 bp, Mus musculus
tgtagttacaattccagcacactgg

SEQ ID NO: 899813 - DNA, 25 bp, Mus musculus
tgtagttaccctatgtggacggaat

SEQ ID NO: 899814 - DNA, 25 bp, Mus musculus
tgtagttaccctttgtggacggaat

SEQ ID NO: 899815 - DNA, 25 bp, Mus musculus
tgtagttaccgacccagcgcttgaa

SEQ ID NO: 899816 - DNA, 25 bp, Mus musculus
tgtagttaccgagccagcgcttgaa

SEQ ID NO: 899817 - DNA, 25 bp, Mus musculus
tgtagttactcaagcagtcactccc

SEQ ID NO: 899818 - DNA, 25 bp, Mus musculus
tgtagttactcatgcagtcactccc

SEQ ID NO: 899819 - DNA, 25 bp, Mus musculus
tgtagttagcacacttccaagtctg

SEQ ID NO: 899820 - DNA, 25 bp, Mus musculus
tgtagttagcactcttccaagtctg

SEQ ID NO: 899821 - DNA, 25 bp, Mus musculus
tgtagttatctgagacctgtgtcct

SEQ ID NO: 899822 - DNA, 25 bp, Mus musculus
tgtagttatctgtgacctgtgtcct

SEQ ID NO: 899823 - DNA, 25 bp, Mus musculus
tgtagttatttcactctgggccatt

SEQ ID NO: 899824 - DNA, 25 bp, Mus musculus
tgtagttatttctctctgggccatt

SEQ ID NO: 899825 - DNA, 25 bp, Mus musculus
tgtagttcaaagaagaccctatttt

SEQ ID NO: 899826 - DNA, 25 bp, Mus musculus
tgtagttcaaagtagaccctatttt

SEQ ID NO: 899827 - DNA, 25 bp, Mus musculus
tgtagttcactactctttttactcc

SEQ ID NO: 899828 - DNA, 25 bp, Mus musculus
tgtagttcactagtctttttactcc

SEQ ID NO: 899829 - DNA, 25 bp, Mus musculus
tgtagttccatacccctagtatcct

SEQ ID NO: 899830 - DNA, 25 bp, Mus musculus
tgtagttccatagccctagtatcct

SEQ ID NO: 899831 - DNA, 25 bp, Mus musculus
tgtagttcccagcttgtgccccagt

SEQ ID NO: 899832 - DNA, 25 bp, Mus musculus
tgtagttcccaggttgtgccccagt

SEQ ID NO: 899833 - DNA, 25 bp, Mus musculus
tgtagttcccctatcatctgaataa

SEQ ID NO: 899834 - DNA, 25 bp, Mus musculus
tgtagttcccctttcatctgaataa

SEQ ID NO: 899835 - DNA, 25 bp, Mus musculus
tgtagttcggatagcttagttttaa

SEQ ID NO: 899836 - DNA, 25 bp, Mus musculus
tgtagttcggattgcttagttttaa

SEQ ID NO: 899837 - DNA, 25 bp, Mus musculus
tgtagttctagaaaccgaacctagg

SEQ ID NO: 899838 - DNA, 25 bp, Mus musculus
tgtagttctagataccgaacctagg

SEQ ID NO: 899839 - DNA, 25 bp, Mus musculus
tgtagttctattacagttcaccaaa

SEQ ID NO: 899840 - DNA, 25 bp, Mus musculus
tgtagttctatttcagttcaccaaa

SEQ ID NO: 899841 - DNA, 25 bp, Mus musculus
tgtagttctccacccctgtttttct

SEQ ID NO: 899842 - DNA, 25 bp, Mus musculus
tgtagttctccagccctgtttttct

SEQ ID NO: 899843 - DNA, 25 bp, Mus musculus
tgtagttctccgacaacacaggtct

SEQ ID NO: 899844 - DNA, 25 bp, Mus musculus
tgtagttctccgtcaacacaggtct

SEQ ID NO: 899845 - DNA, 25 bp, Mus musculus
tgtagttctctcagtaaatggcggg

SEQ ID NO: 899846 - DNA, 25 bp, Mus musculus
tgtagttctctctgtaaatggcggg

SEQ ID NO: 899847 - DNA, 25 bp, Mus musculus
tgtagttctgtgagcctgttccctt

SEQ ID NO: 899848 - DNA, 25 bp, Mus musculus
tgtagttctgtgtgcctgttccctt

SEQ ID NO: 899849 - DNA, 25 bp, Mus musculus
tgtagttcttagagacatcctctca

SEQ ID NO: 899850 - DNA, 25 bp, Mus musculus
tgtagttcttagtgacatcctctca

SEQ ID NO: 899851 - DNA, 25 bp, Mus musculus
tgtagttgacataagatcccagtaa

SEQ ID NO: 899852 - DNA, 25 bp, Mus musculus
tgtagttgacattagatcccagtaa

SEQ ID NO: 899853 - DNA, 25 bp, Mus musculus
tgtagttgccctacagttctatgaa

SEQ ID NO: 899854 - DNA, 25 bp, Mus musculus
tgtagttgcccttcagttctatgaa

SEQ ID NO: 899855 - DNA, 25 bp, Mus musculus
tgtagttggagactcactctcatcc

SEQ ID NO: 899856 - DNA, 25 bp, Mus musculus
tgtagttggagagtcactctcatcc

SEQ ID NO: 899857 - DNA, 25 bp, Mus musculus
tgtagttggttgacagccacgtgga

SEQ ID NO: 899858 - DNA, 25 bp, Mus musculus
tgtagttggttgtcagccacgtgga

SEQ ID NO: 899859 - DNA, 25 bp, Mus musculus
tgtagttgtaaccttttctaattca

SEQ ID NO: 899860 - DNA, 25 bp, Mus musculus
tgtagttgtaacgttttctaattca

SEQ ID NO: 899861 - DNA, 25 bp, Mus musculus
tgtagttgttttcccattagcactg

SEQ ID NO: 899862 - DNA, 25 bp, Mus musculus
tgtagttgttttgccattagcactg

SEQ ID NO: 899863 - DNA, 25 bp, Mus musculus
tgtagtttaaccagggcaacactat

SEQ ID NO: 899864 - DNA, 25 bp, Mus musculus
tgtagtttaacctgggcaacactat

SEQ ID NO: 899865 - DNA, 25 bp, Mus musculus
tgtagtttacatcacccacatgcta

SEQ ID NO: 899866 - DNA, 25 bp, Mus musculus
tgtagtttacatgacccacatgcta

SEQ ID NO: 899867 - DNA, 25 bp, Mus musculus
tgtagtttctctacgctctacctac

SEQ ID NO: 899868 - DNA, 25 bp, Mus musculus
tgtagtttctcttcgctctacctac

SEQ ID NO: 899869 - DNA, 25 bp, Mus musculus
tgtagtttcttgagctttacctcaa

SEQ ID NO: 899870 - DNA, 25 bp, Mus musculus
tgtagtttcttgtgctttacctcaa

SEQ ID NO: 899871 - DNA, 25 bp, Mus musculus
tgtagtttgtcgatccatcttttga

SEQ ID NO: 899872 - DNA, 25 bp, Mus musculus
tgtagtttgtcgttccatcttttga

SEQ ID NO: 899873 - DNA, 25 bp, Mus musculus
tgtagttttcaacgcccagtctcag

SEQ ID NO: 899874 - DNA, 25 bp, Mus musculus
tgtagttttcaacttctgagcattc

SEQ ID NO: 899875 - DNA, 25 bp, Mus musculus
tgtagttttcaaggcccagtctcag

SEQ ID NO: 899876 - DNA, 25 bp, Mus musculus
tgtagttttcaagttctgagcattc

SEQ ID NO: 899877 - DNA, 25 bp, Mus musculus
tgtataaaaaccagcctccaacctg

SEQ ID NO: 899878 - DNA, 25 bp, Mus musculus
tgtataaaaacctgcctccaacctg

SEQ ID NO: 899879 - DNA, 25 bp, Mus musculus
tgtataaaacatcgcaacaatctct

SEQ ID NO: 899880 - DNA, 25 bp, Mus musculus
tgtataaaacatggcaacaatctct

SEQ ID NO: 899881 - DNA, 25 bp, Mus musculus
tgtataaaggaaagccttcttcctg

SEQ ID NO: 899882 - DNA, 25 bp, Mus musculus
tgtataaaggaatgccttcttcctg

SEQ ID NO: 899883 - DNA, 25 bp, Mus musculus
tgtataaagggtaccggactagttg

SEQ ID NO: 899884 - DNA, 25 bp, Mus musculus
tgtataaagggttccggactagttg

SEQ ID NO: 899885 - DNA, 25 bp, Mus musculus
tgtataaatctcactcttcttgcca

SEQ ID NO: 899886 - DNA, 25 bp, Mus musculus
tgtataaatctctctcttcttgcca

SEQ ID NO: 899887 - DNA, 25 bp, Mus musculus
tgtataaccctcattccagtgacct

SEQ ID NO: 899888 - DNA, 25 bp, Mus musculus
tgtataaccctctttccagtgacct

SEQ ID NO: 899889 - DNA, 25 bp, Mus musculus
tgtataactatcatctactcagaat

SEQ ID NO: 899890 - DNA, 25 bp, Mus musculus
tgtataactatcttctactcagaat

SEQ ID NO: 899891 - DNA, 25 bp, Mus musculus
tgtataactcaactgtctatagctt

SEQ ID NO: 899892 - DNA, 25 bp, Mus musculus
tgtataactcaagtgtctatagctt

SEQ ID NO: 899893 - DNA, 25 bp, Mus musculus
tgtataactcttccacttaatgccc

SEQ ID NO: 899894 - DNA, 25 bp, Mus musculus
tgtataactcttgcacttaatgccc

SEQ ID NO: 899895 - DNA, 25 bp, Mus musculus
tgtataagaacccagctcaccttgc

SEQ ID NO: 899896 - DNA, 25 bp, Mus musculus
tgtataagaaccgagctcaccttgc

SEQ ID NO: 899897 - DNA, 25 bp, Mus musculus
tgtataaggtacacagcccagagct

SEQ ID NO: 899898 - DNA, 25 bp, Mus musculus
tgtataaggtactcagcccagagct

SEQ ID NO: 899899 - DNA, 25 bp, Mus musculus
tgtataagtttgaccttgtatgtaa

SEQ ID NO: 899900 - DNA, 25 bp, Mus musculus
tgtataagtttgtccttgtatgtaa

SEQ ID NO: 899901 - DNA, 25 bp, Mus musculus
tgtataatcagcactcttgccagat

SEQ ID NO: 899902 - DNA, 25 bp, Mus musculus
tgtataatcagctctcttgccagat

SEQ ID NO: 899903 - DNA, 25 bp, Mus musculus
tgtataatcctcctcaggctaaacc

SEQ ID NO: 899904 - DNA, 25 bp, Mus musculus
tgtataatcctcgtcaggctaaacc

SEQ ID NO: 899905 - DNA, 25 bp, Mus musculus
tgtataatctctcggctctttgcaa

SEQ ID NO: 899906 - DNA, 25 bp, Mus musculus
tgtataatctctgggctctttgcaa

SEQ ID NO: 899907 - DNA, 25 bp, Mus musculus
tgtataatcttgacttggcaccacc

SEQ ID NO: 899908 - DNA, 25 bp, Mus musculus
tgtataatcttgtcttggcaccacc

SEQ ID NO: 899909 - DNA, 25 bp, Mus musculus
tgtataatggtgattcctgagctct

SEQ ID NO: 899910 - DNA, 25 bp, Mus musculus
tgtataatggtgtttcctgagctct

SEQ ID NO: 899911 - DNA, 25 bp, Mus musculus
tgtatacaacttactccatctttca

SEQ ID NO: 899912 - DNA, 25 bp, Mus musculus
tgtatacaactttctccatctttca

SEQ ID NO: 899913 - DNA, 25 bp, Mus musculus
tgtatacagcctaaaatagccctct

SEQ ID NO: 899914 - DNA, 25 bp, Mus musculus
tgtatacagccttaaatagccctct

SEQ ID NO: 899915 - DNA, 25 bp, Mus musculus
tgtataccacaacccatgtcttctg

SEQ ID NO: 899916 - DNA, 25 bp, Mus musculus
tgtataccacaagccatgtcttctg

SEQ ID NO: 899917 - DNA, 25 bp, Mus musculus
tgtataccccgtcctcctgtgactg

SEQ ID NO: 899918 - DNA, 25 bp, Mus musculus
tgtataccccgtgctcctgtgactg

SEQ ID NO: 899919 - DNA, 25 bp, Mus musculus
tgtataccctgacctcttccaaagc

SEQ ID NO: 899920 - DNA, 25 bp, Mus musculus
tgtataccctgagctcttccaaagc

SEQ ID NO: 899921 - DNA, 25 bp, Mus musculus
tgtatacgataccactgcagcagaa

SEQ ID NO: 899922 - DNA, 25 bp, Mus musculus
tgtatacgatacgactgcagcagaa

SEQ ID NO: 899923 - DNA, 25 bp, Mus musculus
tgtatacgggaccatatctattgga

SEQ ID NO: 899924 - DNA, 25 bp, Mus musculus
tgtatacgggacgatatctattgga

SEQ ID NO: 899925 - DNA, 25 bp, Mus musculus
tgtatacggtcacgagtctttctca

SEQ ID NO: 899926 - DNA, 25 bp, Mus musculus
tgtatacggtcaggagtctttctca

SEQ ID NO: 899927 - DNA, 25 bp, Mus musculus
tgtatactcacaactccggccagtc

SEQ ID NO: 899928 - DNA, 25 bp, Mus musculus
tgtatactcacatctccggccagtc

SEQ ID NO: 899929 - DNA, 25 bp, Mus musculus
tgtatactcggcattgtcattgttt

SEQ ID NO: 899930 - DNA, 25 bp, Mus musculus
tgtatactcggctttgtcattgttt

SEQ ID NO: 899931 - DNA, 25 bp, Mus musculus
tgtatactctgtaatgactcctctc

SEQ ID NO: 899932 - DNA, 25 bp, Mus musculus
tgtatactctgttatgactcctctc

SEQ ID NO: 899933 - DNA, 25 bp, Mus musculus
tgtatacttgagagacctgacttgt

SEQ ID NO: 899934 - DNA, 25 bp, Mus musculus
tgtatacttgagtgacctgacttgt

SEQ ID NO: 899935 - DNA, 25 bp, Mus musculus
tgtatagaaaatctgcttccctccc

SEQ ID NO: 899936 - DNA, 25 bp, Mus musculus
tgtatagaaaatgtgcttccctccc

SEQ ID NO: 899937 - DNA, 25 bp, Mus musculus
tgtatagaaacacccttagcaggat

SEQ ID NO: 899938 - DNA, 25 bp, Mus musculus
tgtatagaaacagccttagcaggat

SEQ ID NO: 899939 - DNA, 25 bp, Mus musculus
tgtatagaccgtcgtggatgctgta

SEQ ID NO: 899940 - DNA, 25 bp, Mus musculus
tgtatagaccgtggtggatgctgta

SEQ ID NO: 899941 - DNA, 25 bp, Mus musculus
tgtatagacgctagtaccgatccat

SEQ ID NO: 899942 - DNA, 25 bp, Mus musculus
tgtatagacgcttgtaccgatccat

SEQ ID NO: 899943 - DNA, 25 bp, Mus musculus
tgtatagattatctttttctcgtgt

SEQ ID NO: 899944 - DNA, 25 bp, Mus musculus
tgtatagattatgtttttctcgtgt

SEQ ID NO: 899945 - DNA, 25 bp, Mus musculus
tgtatagcacccaagctagcctgac

SEQ ID NO: 899946 - DNA, 25 bp, Mus musculus
tgtatagcaccctagctagcctgac

SEQ ID NO: 899947 - DNA, 25 bp, Mus musculus
tgtatagcctataccagattcttgt

SEQ ID NO: 899948 - DNA, 25 bp, Mus musculus
tgtatagcctattccagattcttgt

SEQ ID NO: 899949 - DNA, 25 bp, Mus musculus
tgtatagcgactcagttcccaacta

SEQ ID NO: 899950 - DNA, 25 bp, Mus musculus
tgtatagcgactgagttcccaacta

SEQ ID NO: 899951 - DNA, 25 bp, Mus musculus
tgtatagctcctctgcctgctgata

SEQ ID NO: 899952 - DNA, 25 bp, Mus musculus
tgtatagctcctgtgcctgctgata

SEQ ID NO: 899953 - DNA, 25 bp, Mus musculus
tgtatagctctaacctggttgtggg

SEQ ID NO: 899954 - DNA, 25 bp, Mus musculus
tgtatagctctatcctggttgtggg

SEQ ID NO: 899955 - DNA, 25 bp, Mus musculus
tgtatagctgagctctaagccaagc

SEQ ID NO: 899956 - DNA, 25 bp, Mus musculus
tgtatagctgaggtctaagccaagc

SEQ ID NO: 899957 - DNA, 25 bp, Mus musculus
tgtatagcttggctctcagcaccca

SEQ ID NO: 899958 - DNA, 25 bp, Mus musculus
tgtatagcttgggtctcagcaccca

SEQ ID NO: 899959 - DNA, 25 bp, Mus musculus
tgtataggcagaagactccaggtca

SEQ ID NO: 899960 - DNA, 25 bp, Mus musculus
tgtataggcagatgactccaggtca

SEQ ID NO: 899961 - DNA, 25 bp, Mus musculus
tgtataggctgaatcaccttctgct

SEQ ID NO: 899962 - DNA, 25 bp, Mus musculus
tgtataggctgattcaccttctgct

SEQ ID NO: 899963 - DNA, 25 bp, Mus musculus
tgtatagggcacacaggtactggct

SEQ ID NO: 899964 - DNA, 25 bp, Mus musculus
tgtatagggcactcaggtactggct

SEQ ID NO: 899965 - DNA, 25 bp, Mus musculus
tgtataggtctccaattcctactta

SEQ ID NO: 899966 - DNA, 25 bp, Mus musculus
tgtataggtctcgaattcctactta

SEQ ID NO: 899967 - DNA, 25 bp, Mus musculus
tgtatagtctcccatgatccgttgc

SEQ ID NO: 899968 - DNA, 25 bp, Mus musculus
tgtatagtctccgatgatccgttgc

SEQ ID NO: 899969 - DNA, 25 bp, Mus musculus
tgtatagtctctcctggctttgtct

SEQ ID NO: 899970 - DNA, 25 bp, Mus musculus
tgtatagtctctgctggctttgtct

SEQ ID NO: 899971 - DNA, 25 bp, Mus musculus
tgtatagtgccaagagtcaactctt

SEQ ID NO: 899972 - DNA, 25 bp, Mus musculus
tgtatagtgccatgagtcaactctt

SEQ ID NO: 899973 - DNA, 25 bp, Mus musculus
tgtatagtgcttcacatgcaggagc

SEQ ID NO: 899974 - DNA, 25 bp, Mus musculus
tgtatagtgcttgacatgcaggagc

SEQ ID NO: 899975 - DNA, 25 bp, Mus musculus
tgtatagttcctattttaaacacat

SEQ ID NO: 899976 - DNA, 25 bp, Mus musculus
tgtatagttccttttttaaacacat

SEQ ID NO: 899977 - DNA, 25 bp, Mus musculus
tgtatataactgaacactcatccat

SEQ ID NO: 899978 - DNA, 25 bp, Mus musculus
tgtatataactgtacactcatccat

SEQ ID NO: 899979 - DNA, 25 bp, Mus musculus
tgtatataagcaatcctccctgggt

SEQ ID NO: 899980 - DNA, 25 bp, Mus musculus
tgtatataagcattcctccctgggt

SEQ ID NO: 899981 - DNA, 25 bp, Mus musculus
tgtatatacacaagttcctcctggc

SEQ ID NO: 899982 - DNA, 25 bp, Mus musculus
tgtatatacacatgttcctcctggc

SEQ ID NO: 899983 - DNA, 25 bp, Mus musculus
tgtatatagaagacctcaccctgtc

SEQ ID NO: 899984 - DNA, 25 bp, Mus musculus
tgtatatagaagtcctcaccctgtc

SEQ ID NO: 899985 - DNA, 25 bp, Mus musculus
tgtatatatcacacagcaggcctgt

SEQ ID NO: 899986 - DNA, 25 bp, Mus musculus
tgtatatatcactcagcaggcctgt

SEQ ID NO: 899987 - DNA, 25 bp, Mus musculus
tgtatatccatcctcgtatatcacc

SEQ ID NO: 899988 - DNA, 25 bp, Mus musculus
tgtatatccatcgtcgtatatcacc

SEQ ID NO: 899989 - DNA, 25 bp, Mus musculus
tgtatatcttcacttgaacccaagt

SEQ ID NO: 899990 - DNA, 25 bp, Mus musculus
tgtatatcttcagttgaacccaagt

SEQ ID NO: 899991 - DNA, 25 bp, Mus musculus
tgtatatgatgaaaccctattctga

SEQ ID NO: 899992 - DNA, 25 bp, Mus musculus
tgtatatgatgataccctattctga

SEQ ID NO: 899993 - DNA, 25 bp, Mus musculus
tgtatatgcgcaaagactgctgagc

SEQ ID NO: 899994 - DNA, 25 bp, Mus musculus
tgtatatgcgcatagactgctgagc

SEQ ID NO: 899995 - DNA, 25 bp, Mus musculus
tgtatatggatacccgcaagtgcct

SEQ ID NO: 899996 - DNA, 25 bp, Mus musculus
tgtatatggatagccgcaagtgcct

SEQ ID NO: 899997 - DNA, 25 bp, Mus musculus
tgtatatgggctactcactaaaata

SEQ ID NO: 899998 - DNA, 25 bp, Mus musculus
tgtatatgggcttctcactaaaata

SEQ ID NO: 899999 - DNA, 25 bp, Mus musculus
tgtatatgtcccctcactgaattac

SEQ ID NO: 900000 - DNA, 25 bp, Mus musculus
tgtatatgtcccgtcactgaattac

SEQ ID NO: 900001 - DNA, 25 bp, Mus musculus
tgtatatgttaaccacgggagactt

SEQ ID NO: 900002 - DNA, 25 bp, Mus musculus
tgtatatgttaagcacgggagactt

SEQ ID NO: 900003 - DNA, 25 bp, Mus musculus
tgtatattatacatcttccgcaaat

SEQ ID NO: 900004 - DNA, 25 bp, Mus musculus
tgtatattatacttcttccgcaaat

SEQ ID NO: 900005 - DNA, 25 bp, Mus musculus
tgtatattccaccttttaaagctga

SEQ ID NO: 900006 - DNA, 25 bp, Mus musculus
tgtatattccacgttttaaagctga

SEQ ID NO: 900007 - DNA, 25 bp, Mus musculus
tgtatattctctcaagccacactat

SEQ ID NO: 900008 - DNA, 25 bp, Mus musculus
tgtatattctctgaagccacactat

SEQ ID NO: 900009 - DNA, 25 bp, Mus musculus
tgtatattcttaacagcactcagga

SEQ ID NO: 900010 - DNA, 25 bp, Mus musculus
tgtatattcttatcagcactcagga

SEQ ID NO: 900011 - DNA, 25 bp, Mus musculus
tgtatattgaaccatccagggatga

SEQ ID NO: 900012 - DNA, 25 bp, Mus musculus
tgtatattgaacgatccagggatga

SEQ ID NO: 900013 - DNA, 25 bp, Mus musculus
tgtatatttcatattccacccacca

SEQ ID NO: 900014 - DNA, 25 bp, Mus musculus
tgtatatttcattttccacccacca

SEQ ID NO: 900015 - DNA, 25 bp, Mus musculus
tgtatatttggcctcatcacaaccc

SEQ ID NO: 900016 - DNA, 25 bp, Mus musculus
tgtatatttggcgtcatcacaaccc

SEQ ID NO: 900017 - DNA, 25 bp, Mus musculus
tgtatatttgtaattcagatgcaga

SEQ ID NO: 900018 - DNA, 25 bp, Mus musculus
tgtatatttgtatttcagatgcaga

SEQ ID NO: 900019 - DNA, 25 bp, Mus musculus
tgtatatttgtcctgtgttaccaag

SEQ ID NO: 900020 - DNA, 25 bp, Mus musculus
tgtatatttgtcgtgtgttaccaag

SEQ ID NO: 900021 - DNA, 25 bp, Mus musculus
tgtatattttcaaagcagcgtttct

SEQ ID NO: 900022 - DNA, 25 bp, Mus musculus
tgtatattttcatagcagcgtttct

SEQ ID NO: 900023 - DNA, 25 bp, Mus musculus
tgtatattttgacaaccttttccgt

SEQ ID NO: 900024 - DNA, 25 bp, Mus musculus
tgtatattttgagaaccttttccgt

SEQ ID NO: 900025 - DNA, 25 bp, Mus musculus
tgtatatttttcaggcagccaagcc

SEQ ID NO: 900026 - DNA, 25 bp, Mus musculus
tgtatatttttctggcagccaagcc

SEQ ID NO: 900027 - DNA, 25 bp, Mus musculus
tgtatcaaacacactcaagagcctc

SEQ ID NO: 900028 - DNA, 25 bp, Mus musculus
tgtatcaaacactctcaagagcctc

SEQ ID NO: 900029 - DNA, 25 bp, Mus musculus
tgtatcaaccgtactccagggctgg

SEQ ID NO: 900030 - DNA, 25 bp, Mus musculus
tgtatcaaccgttctccagggctgg

SEQ ID NO: 900031 - DNA, 25 bp, Mus musculus
tgtatcaacgtcaccctacagtgag

SEQ ID NO: 900032 - DNA, 25 bp, Mus musculus
tgtatcaacgtctccctacagtgag

SEQ ID NO: 900033 - DNA, 25 bp, Mus musculus
tgtatcacaacacacttcccagtag

SEQ ID NO: 900034 - DNA, 25 bp, Mus musculus
tgtatcacaacagacttcccagtag

SEQ ID NO: 900035 - DNA, 25 bp, Mus musculus
tgtatcacaaggcacaaagttctct

SEQ ID NO: 900036 - DNA, 25 bp, Mus musculus
tgtatcacaagggacaaagttctct

SEQ ID NO: 900037 - DNA, 25 bp, Mus musculus
tgtatcacagatatgcgtgtcacat

SEQ ID NO: 900038 - DNA, 25 bp, Mus musculus
tgtatcacagatttgcgtgtcacat

SEQ ID NO: 900039 - DNA, 25 bp, Mus musculus
tgtatcacagctaccccaaatagaa

SEQ ID NO: 900040 - DNA, 25 bp, Mus musculus
tgtatcacagcttccccaaatagaa

SEQ ID NO: 900041 - DNA, 25 bp, Mus musculus
tgtatcacccagcaccaatgtggtg

SEQ ID NO: 900042 - DNA, 25 bp, Mus musculus
tgtatcacccaggaccaatgtggtg

SEQ ID NO: 900043 - DNA, 25 bp, Mus musculus
tgtatcaccttgacccaggtagaga

SEQ ID NO: 900044 - DNA, 25 bp, Mus musculus
tgtatcaccttgtcccaggtagaga

SEQ ID NO: 900045 - DNA, 25 bp, Mus musculus
tgtatcactaatcttcctggtaccc

SEQ ID NO: 900046 - DNA, 25 bp, Mus musculus
tgtatcactaatgttcctggtaccc

SEQ ID NO: 900047 - DNA, 25 bp, Mus musculus
tgtatcagacaccaaccagtgtgtt

SEQ ID NO: 900048 - DNA, 25 bp, Mus musculus
tgtatcagacacgaaccagtgtgtt

SEQ ID NO: 900049 - DNA, 25 bp, Mus musculus
tgtatcaggtaacgcccaagagtta

SEQ ID NO: 900050 - DNA, 25 bp, Mus musculus
tgtatcaggtaaggcccaagagtta

SEQ ID NO: 900051 - DNA, 25 bp, Mus musculus
tgtatcaggtgccaggtggtcatca

SEQ ID NO: 900052 - DNA, 25 bp, Mus musculus
tgtatcaggtgcgaggtggtcatca

SEQ ID NO: 900053 - DNA, 25 bp, Mus musculus
tgtatcagtcccaacttctcaggct

SEQ ID NO: 900054 - DNA, 25 bp, Mus musculus
tgtatcagtccctacttctcaggct

SEQ ID NO: 900055 - DNA, 25 bp, Mus musculus
tgtatcatggctactaaggttcctt

SEQ ID NO: 900056 - DNA, 25 bp, Mus musculus
tgtatcatggcttctaaggttcctt

SEQ ID NO: 900057 - DNA, 25 bp, Mus musculus
tgtatcattcagagttccttaaaaa

SEQ ID NO: 900058 - DNA, 25 bp, Mus musculus
tgtatcattcagtgttccttaaaaa

SEQ ID NO: 900059 - DNA, 25 bp, Mus musculus
tgtatcattggcacttcttcctttc

SEQ ID NO: 900060 - DNA, 25 bp, Mus musculus
tgtatcattggctcttcttcctttc

SEQ ID NO: 900061 - DNA, 25 bp, Mus musculus
tgtatccaaacaagactgcagtgct

SEQ ID NO: 900062 - DNA, 25 bp, Mus musculus
tgtatccaaacatgactgcagtgct

SEQ ID NO: 900063 - DNA, 25 bp, Mus musculus
tgtatccaacatagcacctgcagca

SEQ ID NO: 900064 - DNA, 25 bp, Mus musculus
tgtatccaacattgcacctgcagca

SEQ ID NO: 900065 - DNA, 25 bp, Mus musculus
tgtatccaccagcagttgatgaagc

SEQ ID NO: 900066 - DNA, 25 bp, Mus musculus
tgtatccaccaggagttgatgaagc

SEQ ID NO: 900067 - DNA, 25 bp, Mus musculus
tgtatccacggaaaaccagcaactc

SEQ ID NO: 900068 - DNA, 25 bp, Mus musculus
tgtatccacggataaccagcaactc

SEQ ID NO: 900069 - DNA, 25 bp, Mus musculus
tgtatccagcagacacaggcccttt

SEQ ID NO: 900070 - DNA, 25 bp, Mus musculus
tgtatccagcagtcacaggcccttt

SEQ ID NO: 900071 - DNA, 25 bp, Mus musculus
tgtatccagccaaatgcctttagtc

SEQ ID NO: 900072 - DNA, 25 bp, Mus musculus
tgtatccagccatatgcctttagtc

SEQ ID NO: 900073 - DNA, 25 bp, Mus musculus
tgtatccagctgcagctctaggtct

SEQ ID NO: 900074 - DNA, 25 bp, Mus musculus
tgtatccagctggagctctaggtct

SEQ ID NO: 900075 - DNA, 25 bp, Mus musculus
tgtatccaggcacagtacacctttg

SEQ ID NO: 900076 - DNA, 25 bp, Mus musculus
tgtatccaggcagagtacacctttg

SEQ ID NO: 900077 - DNA, 25 bp, Mus musculus
tgtatccagtgccaggtgctgactc

SEQ ID NO: 900078 - DNA, 25 bp, Mus musculus
tgtatccagtgcgaggtgctgactc

SEQ ID NO: 900079 - DNA, 25 bp, Mus musculus
tgtatccatcctcttgctgctgcat

SEQ ID NO: 900080 - DNA, 25 bp, Mus musculus
tgtatccatcctgttgctgctgcat

SEQ ID NO: 900081 - DNA, 25 bp, Mus musculus
tgtatccatggcctcagcaatgtga

SEQ ID NO: 900082 - DNA, 25 bp, Mus musculus
tgtatccatggcgtcagcaatgtga

SEQ ID NO: 900083 - DNA, 25 bp, Mus musculus
tgtatccattgtcccacttgaagtt

SEQ ID NO: 900084 - DNA, 25 bp, Mus musculus
tgtatccattgtgccacttgaagtt

SEQ ID NO: 900085 - DNA, 25 bp, Mus musculus
tgtatcccaatactccgatcttatt

SEQ ID NO: 900086 - DNA, 25 bp, Mus musculus
tgtatcccaatagtccgatcttatt

SEQ ID NO: 900087 - DNA, 25 bp, Mus musculus
tgtatcccacttatccgcttgtgag

SEQ ID NO: 900088 - DNA, 25 bp, Mus musculus
tgtatcccacttttccgcttgtgag

SEQ ID NO: 900089 - DNA, 25 bp, Mus musculus
tgtatcccagatcaaacccatgact

SEQ ID NO: 900090 - DNA, 25 bp, Mus musculus
tgtatcccagatctgtctccctttg

SEQ ID NO: 900091 - DNA, 25 bp, Mus musculus
tgtatcccagatgaaacccatgact

SEQ ID NO: 900092 - DNA, 25 bp, Mus musculus
tgtatcccagatgtgtctccctttg

SEQ ID NO: 900093 - DNA, 25 bp, Mus musculus
tgtatcccaggcctagcacacagta

SEQ ID NO: 900094 - DNA, 25 bp, Mus musculus
tgtatcccaggcgtagcacacagta

SEQ ID NO: 900095 - DNA, 25 bp, Mus musculus
tgtatcccatctaaagaccctagct

SEQ ID NO: 900096 - DNA, 25 bp, Mus musculus
tgtatcccatcttaagaccctagct

SEQ ID NO: 900097 - DNA, 25 bp, Mus musculus
tgtatcccatggagacacagctctg

SEQ ID NO: 900098 - DNA, 25 bp, Mus musculus
tgtatcccatggtgacacagctctg

SEQ ID NO: 900099 - DNA, 25 bp, Mus musculus
tgtatccccagaccttctaactaaa

SEQ ID NO: 900100 - DNA, 25 bp, Mus musculus
tgtatccccagagcttctaactaaa

SEQ ID NO: 900101 - DNA, 25 bp, Mus musculus
tgtatccccatacggcttggtagta

SEQ ID NO: 900102 - DNA, 25 bp, Mus musculus
tgtatccccatagggcttggtagta

SEQ ID NO: 900103 - DNA, 25 bp, Mus musculus
tgtatccccttgctcattgtcatcc

SEQ ID NO: 900104 - DNA, 25 bp, Mus musculus
tgtatccccttggtcattgtcatcc

SEQ ID NO: 900105 - DNA, 25 bp, Mus musculus
tgtatcccgagacctgcacacactg

SEQ ID NO: 900106 - DNA, 25 bp, Mus musculus
tgtatcccgagagctgcacacactg

SEQ ID NO: 900107 - DNA, 25 bp, Mus musculus
tgtatcccgctgatgccacaatggc

SEQ ID NO: 900108 - DNA, 25 bp, Mus musculus
tgtatcccgctgttgccacaatggc

SEQ ID NO: 900109 - DNA, 25 bp, Mus musculus
tgtatcccggccctcttgagtgcta

SEQ ID NO: 900110 - DNA, 25 bp, Mus musculus
tgtatcccggccgtcttgagtgcta

SEQ ID NO: 900111 - DNA, 25 bp, Mus musculus
tgtatccctgggaggacaacgactc

SEQ ID NO: 900112 - DNA, 25 bp, Mus musculus
tgtatccctgggtggacaacgactc

SEQ ID NO: 900113 - DNA, 25 bp, Mus musculus
tgtatcctaaaaatccagcacatgg

SEQ ID NO: 900114 - DNA, 25 bp, Mus musculus
tgtatcctaaaattccagcacatgg

SEQ ID NO: 900115 - DNA, 25 bp, Mus musculus
tgtatcctgaaccaacccatcagga

SEQ ID NO: 900116 - DNA, 25 bp, Mus musculus
tgtatcctgaacgaacccatcagga

SEQ ID NO: 900117 - DNA, 25 bp, Mus musculus
tgtatcctgcttcgctgctctgtgt

SEQ ID NO: 900118 - DNA, 25 bp, Mus musculus
tgtatcctgcttggctgctctgtgt

SEQ ID NO: 900119 - DNA, 25 bp, Mus musculus
tgtatcctggaaaatggctttcaaa

SEQ ID NO: 900120 - DNA, 25 bp, Mus musculus
tgtatcctggaatatggctttcaaa

SEQ ID NO: 900121 - DNA, 25 bp, Mus musculus
tgtatcctgtttattgctttcgtat

SEQ ID NO: 900122 - DNA, 25 bp, Mus musculus
tgtatcctgttttttgctttcgtat

SEQ ID NO: 900123 - DNA, 25 bp, Mus musculus
tgtatccttattcccttttaacaag

SEQ ID NO: 900124 - DNA, 25 bp, Mus musculus
tgtatccttattgccttttaacaag

SEQ ID NO: 900125 - DNA, 25 bp, Mus musculus
tgtatccttgacagcagagccgaac

SEQ ID NO: 900126 - DNA, 25 bp, Mus musculus
tgtatccttgactgcagagccgaac

SEQ ID NO: 900127 - DNA, 25 bp, Mus musculus
tgtatccttggaagtctgttttcta

SEQ ID NO: 900128 - DNA, 25 bp, Mus musculus
tgtatccttggatgtctgttttcta

SEQ ID NO: 900129 - DNA, 25 bp, Mus musculus
tgtatccttttcaggctcttgcgta

SEQ ID NO: 900130 - DNA, 25 bp, Mus musculus
tgtatccttttctggctcttgcgta

SEQ ID NO: 900131 - DNA, 25 bp, Mus musculus
tgtatcctttttccattcatcagag

SEQ ID NO: 900132 - DNA, 25 bp, Mus musculus
tgtatcctttttgcattcatcagag

SEQ ID NO: 900133 - DNA, 25 bp, Mus musculus
tgtatcgacccaaggaagcccagtt

SEQ ID NO: 900134 - DNA, 25 bp, Mus musculus
tgtatcgacccatggaagcccagtt

SEQ ID NO: 900135 - DNA, 25 bp, Mus musculus
tgtatcgctcacagttgccaatggt

SEQ ID NO: 900136 - DNA, 25 bp, Mus musculus
tgtatcgctcactgttgccaatggt

SEQ ID NO: 900137 - DNA, 25 bp, Mus musculus
tgtatcgggagtacagggacctgac

SEQ ID NO: 900138 - DNA, 25 bp, Mus musculus
tgtatcgggagttcagggacctgac

SEQ ID NO: 900139 - DNA, 25 bp, Mus musculus
tgtatcgggctgcagtagccttctt

SEQ ID NO: 900140 - DNA, 25 bp, Mus musculus
tgtatcgggctggagtagccttctt

SEQ ID NO: 900141 - DNA, 25 bp, Mus musculus
tgtatcggtgtgatcacagtgcccc

SEQ ID NO: 900142 - DNA, 25 bp, Mus musculus
tgtatcggtgtgttcacagtgcccc

SEQ ID NO: 900143 - DNA, 25 bp, Mus musculus
tgtatcgtaagtcaggtaacctagt

SEQ ID NO: 900144 - DNA, 25 bp, Mus musculus
tgtatcgtaagtgaggtaacctagt

SEQ ID NO: 900145 - DNA, 25 bp, Mus musculus
tgtatcgtcaatcccagtcagtaag

SEQ ID NO: 900146 - DNA, 25 bp, Mus musculus
tgtatcgtcaatgccagtcagtaag

SEQ ID NO: 900147 - DNA, 25 bp, Mus musculus
tgtatcgtgtctacagtgtctgaga

SEQ ID NO: 900148 - DNA, 25 bp, Mus musculus
tgtatcgtgtcttcagtgtctgaga

SEQ ID NO: 900149 - DNA, 25 bp, Mus musculus
tgtatctaaactccgcagatgggca

SEQ ID NO: 900150 - DNA, 25 bp, Mus musculus
tgtatctaaactgcgcagatgggca

SEQ ID NO: 900151 - DNA, 25 bp, Mus musculus
tgtatctaaagcagcttctccacca

SEQ ID NO: 900152 - DNA, 25 bp, Mus musculus
tgtatctaaagctgcttctccacca

SEQ ID NO: 900153 - DNA, 25 bp, Mus musculus
tgtatctaacaacagatgtttccct

SEQ ID NO: 900154 - DNA, 25 bp, Mus musculus
tgtatctaacaagagatgtttccct

SEQ ID NO: 900155 - DNA, 25 bp, Mus musculus
tgtatctaagacaccgaggcaccgg

SEQ ID NO: 900156 - DNA, 25 bp, Mus musculus
tgtatctaagactccgaggcaccgg

SEQ ID NO: 900157 - DNA, 25 bp, Mus musculus
tgtatctaatgaccccgacaatcca

SEQ ID NO: 900158 - DNA, 25 bp, Mus musculus
tgtatctaatgagcccgacaatcca

SEQ ID NO: 900159 - DNA, 25 bp, Mus musculus
tgtatctacctcacacggttactaa

SEQ ID NO: 900160 - DNA, 25 bp, Mus musculus
tgtatctacctctcacggttactaa

SEQ ID NO: 900161 - DNA, 25 bp, Mus musculus
tgtatctactctcaggcattccttt

SEQ ID NO: 900162 - DNA, 25 bp, Mus musculus
tgtatctactctgaggcattccttt

SEQ ID NO: 900163 - DNA, 25 bp, Mus musculus
tgtatctatatgacagtgcccaccc

SEQ ID NO: 900164 - DNA, 25 bp, Mus musculus
tgtatctatatgtcagtgcccaccc

SEQ ID NO: 900165 - DNA, 25 bp, Mus musculus
tgtatctatattccacatgtggaca

SEQ ID NO: 900166 - DNA, 25 bp, Mus musculus
tgtatctatattgcacatgtggaca

SEQ ID NO: 900167 - DNA, 25 bp, Mus musculus
tgtatctatgtgcacatttgggagc

SEQ ID NO: 900168 - DNA, 25 bp, Mus musculus
tgtatctatgtggacatttgggagc

SEQ ID NO: 900169 - DNA, 25 bp, Mus musculus
tgtatctcaaaacctgctcatcatc

SEQ ID NO: 900170 - DNA, 25 bp, Mus musculus
tgtatctcaaaagctgctcatcatc

SEQ ID NO: 900171 - DNA, 25 bp, Mus musculus
tgtatctcaataaagcacgcagtta

SEQ ID NO: 900172 - DNA, 25 bp, Mus musculus
tgtatctcaatatagcacgcagtta

SEQ ID NO: 900173 - DNA, 25 bp, Mus musculus
tgtatctcagaacgtcaggactcag

SEQ ID NO: 900174 - DNA, 25 bp, Mus musculus
tgtatctcagaaggtcaggactcag

SEQ ID NO: 900175 - DNA, 25 bp, Mus musculus
tgtatctcatttcatgcccgtcatg

SEQ ID NO: 900176 - DNA, 25 bp, Mus musculus
tgtatctcatttgatgcccgtcatg

SEQ ID NO: 900177 - DNA, 25 bp, Mus musculus
tgtatctccagcaagagtcatccac

SEQ ID NO: 900178 - DNA, 25 bp, Mus musculus
tgtatctccagctagagtcatccac

SEQ ID NO: 900179 - DNA, 25 bp, Mus musculus
tgtatctcccctatccaagaaatgt

SEQ ID NO: 900180 - DNA, 25 bp, Mus musculus
tgtatctcccctttccaagaaatgt

SEQ ID NO: 900181 - DNA, 25 bp, Mus musculus
tgtatctctaatcacaccttgcata

SEQ ID NO: 900182 - DNA, 25 bp, Mus musculus
tgtatctctaatgacaccttgcata

SEQ ID NO: 900183 - DNA, 25 bp, Mus musculus
tgtatctctacgaagctaccctgat

SEQ ID NO: 900184 - DNA, 25 bp, Mus musculus
tgtatctctacgtagctaccctgat

SEQ ID NO: 900185 - DNA, 25 bp, Mus musculus
tgtatctctactctgtagtccattt

SEQ ID NO: 900186 - DNA, 25 bp, Mus musculus
tgtatctctactgtgtagtccattt

SEQ ID NO: 900187 - DNA, 25 bp, Mus musculus
tgtatctctgttaatcatggcccca

SEQ ID NO: 900188 - DNA, 25 bp, Mus musculus
tgtatctctgtttatcatggcccca

SEQ ID NO: 900189 - DNA, 25 bp, Mus musculus
tgtatctcttgcacactgtttccag

SEQ ID NO: 900190 - DNA, 25 bp, Mus musculus
tgtatctcttgctcactgtttccag

SEQ ID NO: 900191 - DNA, 25 bp, Mus musculus
tgtatctgcattcccatccttgaag

SEQ ID NO: 900192 - DNA, 25 bp, Mus musculus
tgtatctgcattgccatccttgaag

SEQ ID NO: 900193 - DNA, 25 bp, Mus musculus
tgtatctgccaaaccaaacaagttg

SEQ ID NO: 900194 - DNA, 25 bp, Mus musculus
tgtatctgccaatccaaacaagttg

SEQ ID NO: 900195 - DNA, 25 bp, Mus musculus
tgtatctggaggagttgcaagtaac

SEQ ID NO: 900196 - DNA, 25 bp, Mus musculus
tgtatctggaggtgttgcaagtaac

SEQ ID NO: 900197 - DNA, 25 bp, Mus musculus
tgtatctgtgatctgggaaactctc

SEQ ID NO: 900198 - DNA, 25 bp, Mus musculus
tgtatctgtgatgtgggaaactctc

SEQ ID NO: 900199 - DNA, 25 bp, Mus musculus
tgtatcttaatgattgtgcgctagc

SEQ ID NO: 900200 - DNA, 25 bp, Mus musculus
tgtatcttaatgtttgtgcgctagc

SEQ ID NO: 900201 - DNA, 25 bp, Mus musculus
tgtatcttacatatctgccacagaa

SEQ ID NO: 900202 - DNA, 25 bp, Mus musculus
tgtatcttacatttctgccacagaa

SEQ ID NO: 900203 - DNA, 25 bp, Mus musculus
tgtatcttacgcagcgactcattct

SEQ ID NO: 900204 - DNA, 25 bp, Mus musculus
tgtatcttacgctgcgactcattct

SEQ ID NO: 900205 - DNA, 25 bp, Mus musculus
tgtatcttactcatatcaccgcatt

SEQ ID NO: 900206 - DNA, 25 bp, Mus musculus
tgtatcttactcttatcaccgcatt

SEQ ID NO: 900207 - DNA, 25 bp, Mus musculus
tgtatcttataaacactcaggtgct

SEQ ID NO: 900208 - DNA, 25 bp, Mus musculus
tgtatcttataatcactcaggtgct

SEQ ID NO: 900209 - DNA, 25 bp, Mus musculus
tgtatcttccttcttacctgttcat

SEQ ID NO: 900210 - DNA, 25 bp, Mus musculus
tgtatcttccttgttacctgttcat

SEQ ID NO: 900211 - DNA, 25 bp, Mus musculus
tgtatcttcggaaagcctccctgct

SEQ ID NO: 900212 - DNA, 25 bp, Mus musculus
tgtatcttcggatagcctccctgct

SEQ ID NO: 900213 - DNA, 25 bp, Mus musculus
tgtatcttgacacactacgttctgt

SEQ ID NO: 900214 - DNA, 25 bp, Mus musculus
tgtatcttgacagactacgttctgt

SEQ ID NO: 900215 - DNA, 25 bp, Mus musculus
tgtatcttgtgcctcagcatttcta

SEQ ID NO: 900216 - DNA, 25 bp, Mus musculus
tgtatcttgtgcgtcagcatttcta

SEQ ID NO: 900217 - DNA, 25 bp, Mus musculus
tgtatctttagtataccacggagtt

SEQ ID NO: 900218 - DNA, 25 bp, Mus musculus
tgtatctttagtttaccacggagtt

SEQ ID NO: 900219 - DNA, 25 bp, Mus musculus
tgtatctttatcattcttcccccct

SEQ ID NO: 900220 - DNA, 25 bp, Mus musculus
tgtatctttatctttcttcccccct

SEQ ID NO: 900221 - DNA, 25 bp, Mus musculus
tgtatcttttctcaggttatgcctt

SEQ ID NO: 900222 - DNA, 25 bp, Mus musculus
tgtatcttttctgaggttatgcctt

SEQ ID NO: 900223 - DNA, 25 bp, Mus musculus
tgtatgaaaaccatactgcttctct

SEQ ID NO: 900224 - DNA, 25 bp, Mus musculus
tgtatgaaaaccttactgcttctct

SEQ ID NO: 900225 - DNA, 25 bp, Mus musculus
tgtatgaaattcagagcccttgatt

SEQ ID NO: 900226 - DNA, 25 bp, Mus musculus
tgtatgaaattctgagcccttgatt

SEQ ID NO: 900227 - DNA, 25 bp, Mus musculus
tgtatgaaccaaatcctcttgctca

SEQ ID NO: 900228 - DNA, 25 bp, Mus musculus
tgtatgaaccaattcctcttgctca

SEQ ID NO: 900229 - DNA, 25 bp, Mus musculus
tgtatgaagacacccagctcagcaa

SEQ ID NO: 900230 - DNA, 25 bp, Mus musculus
tgtatgaagacagccagctcagcaa

SEQ ID NO: 900231 - DNA, 25 bp, Mus musculus
tgtatgaagccgaccgatcgttccg

SEQ ID NO: 900232 - DNA, 25 bp, Mus musculus
tgtatgaagccgtccgatcgttccg

SEQ ID NO: 900233 - DNA, 25 bp, Mus musculus
tgtatgaatacacccctttcacatg

SEQ ID NO: 900234 - DNA, 25 bp, Mus musculus
tgtatgaatacagccctttcacatg

SEQ ID NO: 900235 - DNA, 25 bp, Mus musculus
tgtatgaattcaatgttgggcccaa

SEQ ID NO: 900236 - DNA, 25 bp, Mus musculus
tgtatgaattcattgttgggcccaa

SEQ ID NO: 900237 - DNA, 25 bp, Mus musculus
tgtatgacagtgatgtgcccgccac

SEQ ID NO: 900238 - DNA, 25 bp, Mus musculus
tgtatgacagtgttgtgcccgccac

SEQ ID NO: 900239 - DNA, 25 bp, Mus musculus
tgtatgacccatctctcaactgcta

SEQ ID NO: 900240 - DNA, 25 bp, Mus musculus
tgtatgacccatgtctcaactgcta

SEQ ID NO: 900241 - DNA, 25 bp, Mus musculus
tgtatgacgctgcgcacgttgagtg

SEQ ID NO: 900242 - DNA, 25 bp, Mus musculus
tgtatgacgctgggcacgttgagtg

SEQ ID NO: 900243 - DNA, 25 bp, Mus musculus
tgtatgactcccacgctttcagaca

SEQ ID NO: 900244 - DNA, 25 bp, Mus musculus
tgtatgactccctcgctttcagaca

SEQ ID NO: 900245 - DNA, 25 bp, Mus musculus
tgtatgacttcaaatcacgctccac

SEQ ID NO: 900246 - DNA, 25 bp, Mus musculus
tgtatgacttcatatcacgctccac

SEQ ID NO: 900247 - DNA, 25 bp, Mus musculus
tgtatgagcaatctcttccttcttc

SEQ ID NO: 900248 - DNA, 25 bp, Mus musculus
tgtatgagcaatgtcttccttcttc

SEQ ID NO: 900249 - DNA, 25 bp, Mus musculus
tgtatgagtcctatcttctgccatc

SEQ ID NO: 900250 - DNA, 25 bp, Mus musculus
tgtatgagtcctttcttctgccatc

SEQ ID NO: 900251 - DNA, 25 bp, Mus musculus
tgtatgatatcaaggtgcactttat

SEQ ID NO: 900252 - DNA, 25 bp, Mus musculus
tgtatgatatcatggtgcactttat

SEQ ID NO: 900253 - DNA, 25 bp, Mus musculus
tgtatgatgctgaaccatcctgcga

SEQ ID NO: 900254 - DNA, 25 bp, Mus musculus
tgtatgatgctgtaccatcctgcga

SEQ ID NO: 900255 - DNA, 25 bp, Mus musculus
tgtatgattcttagccctgacgtta

SEQ ID NO: 900256 - DNA, 25 bp, Mus musculus
tgtatgattctttgccctgacgtta

SEQ ID NO: 900257 - DNA, 25 bp, Mus musculus
tgtatgattttacccatgtgcaatt

SEQ ID NO: 900258 - DNA, 25 bp, Mus musculus
tgtatgattttagccatgtgcaatt

SEQ ID NO: 900259 - DNA, 25 bp, Mus musculus
tgtatgattttgaccgcttctccaa

SEQ ID NO: 900260 - DNA, 25 bp, Mus musculus
tgtatgattttgtccgcttctccaa

SEQ ID NO: 900261 - DNA, 25 bp, Mus musculus
tgtatgcaaccccaccataaataaa

SEQ ID NO: 900262 - DNA, 25 bp, Mus musculus
tgtatgcaacccgaccataaataaa

SEQ ID NO: 900263 - DNA, 25 bp, Mus musculus
tgtatgcacgctcacgtgcatgtgt

SEQ ID NO: 900264 - DNA, 25 bp, Mus musculus
tgtatgcacgctgacgtgcatgtgt

SEQ ID NO: 900265 - DNA, 25 bp, Mus musculus
tgtatgcagcagaaccagatcccag

SEQ ID NO: 900266 - DNA, 25 bp, Mus musculus
tgtatgcagcagtaccagatcccag

SEQ ID NO: 900267 - DNA, 25 bp, Mus musculus
tgtatgcagtgccgtatggttcctc

SEQ ID NO: 900268 - DNA, 25 bp, Mus musculus
tgtatgcagtgcggtatggttcctc

SEQ ID NO: 900269 - DNA, 25 bp, Mus musculus
tgtatgcatagtaacctctgtgtgt

SEQ ID NO: 900270 - DNA, 25 bp, Mus musculus
tgtatgcatagttacctctgtgtgt

SEQ ID NO: 900271 - DNA, 25 bp, Mus musculus
tgtatgcatccactattccgagatg

SEQ ID NO: 900272 - DNA, 25 bp, Mus musculus
tgtatgcatccagtattccgagatg

SEQ ID NO: 900273 - DNA, 25 bp, Mus musculus
tgtatgcatctcactttctgttgac

SEQ ID NO: 900274 - DNA, 25 bp, Mus musculus
tgtatgcatctctctttctgttgac

SEQ ID NO: 900275 - DNA, 25 bp, Mus musculus
tgtatgcatggtccctgtgaagacc

SEQ ID NO: 900276 - DNA, 25 bp, Mus musculus
tgtatgcatggtgcctgtgaagacc

SEQ ID NO: 900277 - DNA, 25 bp, Mus musculus
tgtatgccaaacagatgagacgtct

SEQ ID NO: 900278 - DNA, 25 bp, Mus musculus
tgtatgccaaactgatgagacgtct

SEQ ID NO: 900279 - DNA, 25 bp, Mus musculus
tgtatgccaacacattctcccggaa

SEQ ID NO: 900280 - DNA, 25 bp, Mus musculus
tgtatgccaacagattctcccggaa

SEQ ID NO: 900281 - DNA, 25 bp, Mus musculus
tgtatgccacatcctgtgccaataa

SEQ ID NO: 900282 - DNA, 25 bp, Mus musculus
tgtatgccacatgctgtgccaataa

SEQ ID NO: 900283 - DNA, 25 bp, Mus musculus
tgtatgccaccaagtaggtgaggag

SEQ ID NO: 900284 - DNA, 25 bp, Mus musculus
tgtatgccaccatgtaggtgaggag

SEQ ID NO: 900285 - DNA, 25 bp, Mus musculus
tgtatgccaggcctgacacgtttga

SEQ ID NO: 900286 - DNA, 25 bp, Mus musculus
tgtatgccaggcgtgacacgtttga

SEQ ID NO: 900287 - DNA, 25 bp, Mus musculus
tgtatgccccttctgtgcatgtgca

SEQ ID NO: 900288 - DNA, 25 bp, Mus musculus
tgtatgccccttgtgtgcatgtgca

SEQ ID NO: 900289 - DNA, 25 bp, Mus musculus
tgtatgcccgacaaaaccgaaaaag

SEQ ID NO: 900290 - DNA, 25 bp, Mus musculus
tgtatgcccgactaaaccgaaaaag

SEQ ID NO: 900291 - DNA, 25 bp, Mus musculus
tgtatgcccgtaccacaagcaagct

SEQ ID NO: 900292 - DNA, 25 bp, Mus musculus
tgtatgcccgtagcacaagcaagct

SEQ ID NO: 900293 - DNA, 25 bp, Mus musculus
tgtatgccctccatccatggaaggg

SEQ ID NO: 900294 - DNA, 25 bp, Mus musculus
tgtatgccctccttccatggaaggg

SEQ ID NO: 900295 - DNA, 25 bp, Mus musculus
tgtatgccggatagttgctctgcct

SEQ ID NO: 900296 - DNA, 25 bp, Mus musculus
tgtatgccggattgttgctctgcct

SEQ ID NO: 900297 - DNA, 25 bp, Mus musculus
tgtatgcctcctacgtctatctgtc

SEQ ID NO: 900298 - DNA, 25 bp, Mus musculus
tgtatgcctccttcgtctatctgtc

SEQ ID NO: 900299 - DNA, 25 bp, Mus musculus
tgtatgcctctcaggctcaagaccc

SEQ ID NO: 900300 - DNA, 25 bp, Mus musculus
tgtatgcctctctggctcaagaccc

SEQ ID NO: 900301 - DNA, 25 bp, Mus musculus
tgtatgcctgaacgaagccttgctt

SEQ ID NO: 900302 - DNA, 25 bp, Mus musculus
tgtatgcctgaaggaagccttgctt

SEQ ID NO: 900303 - DNA, 25 bp, Mus musculus
tgtatgcctgcaaatatgtctgcct

SEQ ID NO: 900304 - DNA, 25 bp, Mus musculus
tgtatgcctgcatatatgtctgcct

SEQ ID NO: 900305 - DNA, 25 bp, Mus musculus
tgtatgcctgttcaccacatggtca

SEQ ID NO: 900306 - DNA, 25 bp, Mus musculus
tgtatgcctgttgaccacatggtca

SEQ ID NO: 900307 - DNA, 25 bp, Mus musculus
tgtatgcgacccctgtcctcagttt

SEQ ID NO: 900308 - DNA, 25 bp, Mus musculus
tgtatgcgacccgtgtcctcagttt

SEQ ID NO: 900309 - DNA, 25 bp, Mus musculus
tgtatgctacatacatccgtgcagc

SEQ ID NO: 900310 - DNA, 25 bp, Mus musculus
tgtatgctacattcatccgtgcagc

SEQ ID NO: 900311 - DNA, 25 bp, Mus musculus
tgtatgctaggtaatatccataact

SEQ ID NO: 900312 - DNA, 25 bp, Mus musculus
tgtatgctaggttatatccataact

SEQ ID NO: 900313 - DNA, 25 bp, Mus musculus
tgtatgctccatactatagtctcct

SEQ ID NO: 900314 - DNA, 25 bp, Mus musculus
tgtatgctccattctatagtctcct

SEQ ID NO: 900315 - DNA, 25 bp, Mus musculus
tgtatgctccctcctcaataaacct

SEQ ID NO: 900316 - DNA, 25 bp, Mus musculus
tgtatgctccctgctcaataaacct

SEQ ID NO: 900317 - DNA, 25 bp, Mus musculus
tgtatgctcctcatgtcctctatga

SEQ ID NO: 900318 - DNA, 25 bp, Mus musculus
tgtatgctcctcttgtcctctatga

SEQ ID NO: 900319 - DNA, 25 bp, Mus musculus
tgtatgctgactctatgatcctgat

SEQ ID NO: 900320 - DNA, 25 bp, Mus musculus
tgtatgctgactgtatgatcctgat

SEQ ID NO: 900321 - DNA, 25 bp, Mus musculus
tgtatgctgatgagctaggtctctt

SEQ ID NO: 900322 - DNA, 25 bp, Mus musculus
tgtatgctgatgtgctaggtctctt

SEQ ID NO: 900323 - DNA, 25 bp, Mus musculus
tgtatgctgtatcagaaaccatctg

SEQ ID NO: 900324 - DNA, 25 bp, Mus musculus
tgtatgctgtatgagaaaccatctg

SEQ ID NO: 900325 - DNA, 25 bp, Mus musculus
tgtatgctgtgtcgctaggagactc

SEQ ID NO: 900326 - DNA, 25 bp, Mus musculus
tgtatgctgtgtggctaggagactc

SEQ ID NO: 900327 - DNA, 25 bp, Mus musculus
tgtatgctgtttctcaagtcacctc

SEQ ID NO: 900328 - DNA, 25 bp, Mus musculus
tgtatgctgtttgtcaagtcacctc

SEQ ID NO: 900329 - DNA, 25 bp, Mus musculus
tgtatgcttacaatttaaattccac

SEQ ID NO: 900330 - DNA, 25 bp, Mus musculus
tgtatgcttacattttaaattccac

SEQ ID NO: 900331 - DNA, 25 bp, Mus musculus
tgtatgcttccacggtgtgaccatt

SEQ ID NO: 900332 - DNA, 25 bp, Mus musculus
tgtatgcttccagggtgtgaccatt

SEQ ID NO: 900333 - DNA, 25 bp, Mus musculus
tgtatgctttccaaagtgtttccct

SEQ ID NO: 900334 - DNA, 25 bp, Mus musculus
tgtatgctttcctaagtgtttccct

SEQ ID NO: 900335 - DNA, 25 bp, Mus musculus
tgtatggaacatcgcgtttgacttt

SEQ ID NO: 900336 - DNA, 25 bp, Mus musculus
tgtatggaacatggcgtttgacttt

SEQ ID NO: 900337 - DNA, 25 bp, Mus musculus
tgtatggaatttagtctgcccgctc

SEQ ID NO: 900338 - DNA, 25 bp, Mus musculus
tgtatggaattttgtctgcccgctc

SEQ ID NO: 900339 - DNA, 25 bp, Mus musculus
tgtatggactagagtttgtggcgct

SEQ ID NO: 900340 - DNA, 25 bp, Mus musculus
tgtatggactagtgtttgtggcgct

SEQ ID NO: 900341 - DNA, 25 bp, Mus musculus
tgtatggatctgaggtcatttcctc

SEQ ID NO: 900342 - DNA, 25 bp, Mus musculus
tgtatggatctgtggtcatttcctc

SEQ ID NO: 900343 - DNA, 25 bp, Mus musculus
tgtatggcaaggactggcatgcaga

SEQ ID NO: 900344 - DNA, 25 bp, Mus musculus
tgtatggcaaggtctggcatgcaga

SEQ ID NO: 900345 - DNA, 25 bp, Mus musculus
tgtatggcacatactgaccagacgt

SEQ ID NO: 900346 - DNA, 25 bp, Mus musculus
tgtatggcacattctgaccagacgt

SEQ ID NO: 900347 - DNA, 25 bp, Mus musculus
tgtatggcatccctcggccaacaat

SEQ ID NO: 900348 - DNA, 25 bp, Mus musculus
tgtatggcatccgtcggccaacaat

SEQ ID NO: 900349 - DNA, 25 bp, Mus musculus
tgtatggcatctcccgtgaggcctg

SEQ ID NO: 900350 - DNA, 25 bp, Mus musculus
tgtatggcatctgccgtgaggcctg

SEQ ID NO: 900351 - DNA, 25 bp, Mus musculus
tgtatggccagcaaacccagaaggt

SEQ ID NO: 900352 - DNA, 25 bp, Mus musculus
tgtatggccagctaacccagaaggt

SEQ ID NO: 900353 - DNA, 25 bp, Mus musculus
tgtatggccccacagggagccccag

SEQ ID NO: 900354 - DNA, 25 bp, Mus musculus
tgtatggccccagagggagccccag

SEQ ID NO: 900355 - DNA, 25 bp, Mus musculus
tgtatggcgcccagtgatgctgtaa

SEQ ID NO: 900356 - DNA, 25 bp, Mus musculus
tgtatggcgccctgtgatgctgtaa

SEQ ID NO: 900357 - DNA, 25 bp, Mus musculus
tgtatggctgcacatcataagcgtg

SEQ ID NO: 900358 - DNA, 25 bp, Mus musculus
tgtatggctgcagatcataagcgtg

SEQ ID NO: 900359 - DNA, 25 bp, Mus musculus
tgtatggctggcagtcactttctga

SEQ ID NO: 900360 - DNA, 25 bp, Mus musculus
tgtatggctggctgtcactttctga

SEQ ID NO: 900361 - DNA, 25 bp, Mus musculus
tgtatggctgttcgttagctccctc

SEQ ID NO: 900362 - DNA, 25 bp, Mus musculus
tgtatggctgttggttagctccctc

SEQ ID NO: 900363 - DNA, 25 bp, Mus musculus
tgtatggcttcaagcaggatccctc

SEQ ID NO: 900364 - DNA, 25 bp, Mus musculus
tgtatggcttcatgcaggatccctc

SEQ ID NO: 900365 - DNA, 25 bp, Mus musculus
tgtatgggaacacctcactttgcta

SEQ ID NO: 900366 - DNA, 25 bp, Mus musculus
tgtatgggaacagctcactttgcta

SEQ ID NO: 900367 - DNA, 25 bp, Mus musculus
tgtatgggactgatgatctgtatcg

SEQ ID NO: 900368 - DNA, 25 bp, Mus musculus
tgtatgggactgttgatctgtatcg

SEQ ID NO: 900369 - DNA, 25 bp, Mus musculus
tgtatgggccctctgactgatcagg

SEQ ID NO: 900370 - DNA, 25 bp, Mus musculus
tgtatgggccctgtgactgatcagg

SEQ ID NO: 900371 - DNA, 25 bp, Mus musculus
tgtatgggcttcagagttcacactc

SEQ ID NO: 900372 - DNA, 25 bp, Mus musculus
tgtatgggcttctgagttcacactc

SEQ ID NO: 900373 - DNA, 25 bp, Mus musculus
tgtatggtcagactcctaggagccc

SEQ ID NO: 900374 - DNA, 25 bp, Mus musculus
tgtatggtcagagtcctaggagccc

SEQ ID NO: 900375 - DNA, 25 bp, Mus musculus
tgtatggtccatccccagtgctggt

SEQ ID NO: 900376 - DNA, 25 bp, Mus musculus
tgtatggtccatgcccagtgctggt

SEQ ID NO: 900377 - DNA, 25 bp, Mus musculus
tgtatggtccttaagcttctgggtc

SEQ ID NO: 900378 - DNA, 25 bp, Mus musculus
tgtatggtcctttagcttctgggtc

SEQ ID NO: 900379 - DNA, 25 bp, Mus musculus
tgtatggtcggtaggtaggcaatct

SEQ ID NO: 900380 - DNA, 25 bp, Mus musculus
tgtatggtcggttggtaggcaatct

SEQ ID NO: 900381 - DNA, 25 bp, Mus musculus
tgtatggtgactcgaggtgctaact

SEQ ID NO: 900382 - DNA, 25 bp, Mus musculus
tgtatggtgactggaggtgctaact

SEQ ID NO: 900383 - DNA, 25 bp, Mus musculus
tgtatggtgctgaactccactttca

SEQ ID NO: 900384 - DNA, 25 bp, Mus musculus
tgtatggtgctgtactccactttca

SEQ ID NO: 900385 - DNA, 25 bp, Mus musculus
tgtatggtgggacctagctcccctg

SEQ ID NO: 900386 - DNA, 25 bp, Mus musculus
tgtatggtgggagctagctcccctg

SEQ ID NO: 900387 - DNA, 25 bp, Mus musculus
tgtatgtaactcatctgtctcaatg

SEQ ID NO: 900388 - DNA, 25 bp, Mus musculus
tgtatgtaactcttctgtctcaatg

SEQ ID NO: 900389 - DNA, 25 bp, Mus musculus
tgtatgtaagacctcgttcaccacg

SEQ ID NO: 900390 - DNA, 25 bp, Mus musculus
tgtatgtaagacgtcgttcaccacg

SEQ ID NO: 900391 - DNA, 25 bp, Mus musculus
tgtatgtaaggtcactaccccttcc

SEQ ID NO: 900392 - DNA, 25 bp, Mus musculus
tgtatgtaaggtgactaccccttcc

SEQ ID NO: 900393 - DNA, 25 bp, Mus musculus
tgtatgtaattaatcgccagcagga

SEQ ID NO: 900394 - DNA, 25 bp, Mus musculus
tgtatgtaattattcgccagcagga

SEQ ID NO: 900395 - DNA, 25 bp, Mus musculus
tgtatgtaattcacttgtcaagtga

SEQ ID NO: 900396 - DNA, 25 bp, Mus musculus
tgtatgtaattctcttgtcaagtga

SEQ ID NO: 900397 - DNA, 25 bp, Mus musculus
tgtatgtatactcttaccatcccca

SEQ ID NO: 900398 - DNA, 25 bp, Mus musculus
tgtatgtatactgttaccatcccca

SEQ ID NO: 900399 - DNA, 25 bp, Mus musculus
tgtatgtatatacttagcaacttca

SEQ ID NO: 900400 - DNA, 25 bp, Mus musculus
tgtatgtatatagttagcaacttca

SEQ ID NO: 900401 - DNA, 25 bp, Mus musculus
tgtatgtatttgacatctcccgctg

SEQ ID NO: 900402 - DNA, 25 bp, Mus musculus
tgtatgtatttgtcatctcccgctg

SEQ ID NO: 900403 - DNA, 25 bp, Mus musculus
tgtatgtcactgcacccggttctct

SEQ ID NO: 900404 - DNA, 25 bp, Mus musculus
tgtatgtcactggacccggttctct

SEQ ID NO: 900405 - DNA, 25 bp, Mus musculus
tgtatgtcccagctctaactacaga

SEQ ID NO: 900406 - DNA, 25 bp, Mus musculus
tgtatgtcccaggtctaactacaga

SEQ ID NO: 900407 - DNA, 25 bp, Mus musculus
tgtatgtctgcactgttctgagctt

SEQ ID NO: 900408 - DNA, 25 bp, Mus musculus
tgtatgtctgcagtgttctgagctt

SEQ ID NO: 900409 - DNA, 25 bp, Mus musculus
tgtatgtctgttactatctctgtgt

SEQ ID NO: 900410 - DNA, 25 bp, Mus musculus
tgtatgtctgttccccacagagtct

SEQ ID NO: 900411 - DNA, 25 bp, Mus musculus
tgtatgtctgttgcccacagagtct

SEQ ID NO: 900412 - DNA, 25 bp, Mus musculus
tgtatgtctgtttctatctctgtgt

SEQ ID NO: 900413 - DNA, 25 bp, Mus musculus
tgtatgtgacccagactggttttct

SEQ ID NO: 900414 - DNA, 25 bp, Mus musculus
tgtatgtgaccctgactggttttct

SEQ ID NO: 900415 - DNA, 25 bp, Mus musculus
tgtatgtgcacaagcccttgtatgt

SEQ ID NO: 900416 - DNA, 25 bp, Mus musculus
tgtatgtgcacatgcccttgtatgt

SEQ ID NO: 900417 - DNA, 25 bp, Mus musculus
tgtatgtgccagatacctgctgtta

SEQ ID NO: 900418 - DNA, 25 bp, Mus musculus
tgtatgtgccagttacctgctgtta

SEQ ID NO: 900419 - DNA, 25 bp, Mus musculus
tgtatgtgccctctgtgctggagaa

SEQ ID NO: 900420 - DNA, 25 bp, Mus musculus
tgtatgtgccctgtgtgctggagaa

SEQ ID NO: 900421 - DNA, 25 bp, Mus musculus
tgtatgtgcctgctatgtacctcac

SEQ ID NO: 900422 - DNA, 25 bp, Mus musculus
tgtatgtgcctggtatgtacctcac

SEQ ID NO: 900423 - DNA, 25 bp, Mus musculus
tgtatgtgctccctcattttaaaca

SEQ ID NO: 900424 - DNA, 25 bp, Mus musculus
tgtatgtgctccgtcattttaaaca

SEQ ID NO: 900425 - DNA, 25 bp, Mus musculus
tgtatgtgctgtaatcgaagcctat

SEQ ID NO: 900426 - DNA, 25 bp, Mus musculus
tgtatgtgctgttatcgaagcctat

SEQ ID NO: 900427 - DNA, 25 bp, Mus musculus
tgtatgtggctcatttagaatcact

SEQ ID NO: 900428 - DNA, 25 bp, Mus musculus
tgtatgtggctcttttagaatcact

SEQ ID NO: 900429 - DNA, 25 bp, Mus musculus
tgtatgtgtgggaatctgtgcctgt

SEQ ID NO: 900430 - DNA, 25 bp, Mus musculus
tgtatgtgtgggtatctgtgcctgt

SEQ ID NO: 900431 - DNA, 25 bp, Mus musculus
tgtatgtgtgtccctgtactctgtg

SEQ ID NO: 900432 - DNA, 25 bp, Mus musculus
tgtatgtgtgtcgctgtactctgtg

SEQ ID NO: 900433 - DNA, 25 bp, Mus musculus
tgtatgtgtgttactattcttacac

SEQ ID NO: 900434 - DNA, 25 bp, Mus musculus
tgtatgtgtgttcatttacctgtga

SEQ ID NO: 900435 - DNA, 25 bp, Mus musculus
tgtatgtgtgttgatttacctgtga

SEQ ID NO: 900436 - DNA, 25 bp, Mus musculus
tgtatgtgtgtttctattcttacac

SEQ ID NO: 900437 - DNA, 25 bp, Mus musculus
tgtatgtgttctacaattggccctc

SEQ ID NO: 900438 - DNA, 25 bp, Mus musculus
tgtatgtgttcttcaattggccctc

SEQ ID NO: 900439 - DNA, 25 bp, Mus musculus
tgtatgtgtttcatgagcttttcct

SEQ ID NO: 900440 - DNA, 25 bp, Mus musculus
tgtatgtgtttcttgagcttttcct

SEQ ID NO: 900441 - DNA, 25 bp, Mus musculus
tgtatgttagagaccattcttttct

SEQ ID NO: 900442 - DNA, 25 bp, Mus musculus
tgtatgttagagtccattcttttct

SEQ ID NO: 900443 - DNA, 25 bp, Mus musculus
tgtatgttgcagatgatctgttaaa

SEQ ID NO: 900444 - DNA, 25 bp, Mus musculus
tgtatgttgcagttgatctgttaaa

SEQ ID NO: 900445 - DNA, 25 bp, Mus musculus
tgtatgttgcatctttgaggccagc

SEQ ID NO: 900446 - DNA, 25 bp, Mus musculus
tgtatgttgcatgtttgaggccagc

SEQ ID NO: 900447 - DNA, 25 bp, Mus musculus
tgtatgtttctaccctgcctgggat

SEQ ID NO: 900448 - DNA, 25 bp, Mus musculus
tgtatgtttctagcctgcctgggat

SEQ ID NO: 900449 - DNA, 25 bp, Mus musculus
tgtatgtttgtcacccatgccaaga

SEQ ID NO: 900450 - DNA, 25 bp, Mus musculus
tgtatgtttgtctcccatgccaaga

SEQ ID NO: 900451 - DNA, 25 bp, Mus musculus
tgtatgtttgttataagtcagttat

SEQ ID NO: 900452 - DNA, 25 bp, Mus musculus
tgtatgtttgttttaagtcagttat

SEQ ID NO: 900453 - DNA, 25 bp, Mus musculus
tgtatgttttaaacctttatcctgg

SEQ ID NO: 900454 - DNA, 25 bp, Mus musculus
tgtatgttttaatcctttatcctgg

SEQ ID NO: 900455 - DNA, 25 bp, Mus musculus
tgtattaaataactgcctgccgctc

SEQ ID NO: 900456 - DNA, 25 bp, Mus musculus
tgtattaaataagtgcctgccgctc

SEQ ID NO: 900457 - DNA, 25 bp, Mus musculus
tgtattaacatcatatggtctgaaa

SEQ ID NO: 900458 - DNA, 25 bp, Mus musculus
tgtattaacatcttatggtctgaaa

SEQ ID NO: 900459 - DNA, 25 bp, Mus musculus
tgtattaaggtccactccagggctc

SEQ ID NO: 900460 - DNA, 25 bp, Mus musculus
tgtattaaggtcgactccagggctc

SEQ ID NO: 900461 - DNA, 25 bp, Mus musculus
tgtattaagtgcccttgaatggaat

SEQ ID NO: 900462 - DNA, 25 bp, Mus musculus
tgtattaagtgcgcttgaatggaat

SEQ ID NO: 900463 - DNA, 25 bp, Mus musculus
tgtattaattctcccaggcatgtta

SEQ ID NO: 900464 - DNA, 25 bp, Mus musculus
tgtattaattctgccaggcatgtta

SEQ ID NO: 900465 - DNA, 25 bp, Mus musculus
tgtattacccaaatgccgaaaatta

SEQ ID NO: 900466 - DNA, 25 bp, Mus musculus
tgtattacccaattgccgaaaatta

SEQ ID NO: 900467 - DNA, 25 bp, Mus musculus
tgtattaccgaaactgattccaagg

SEQ ID NO: 900468 - DNA, 25 bp, Mus musculus
tgtattaccgaatctgattccaagg

SEQ ID NO: 900469 - DNA, 25 bp, Mus musculus
tgtattacggtcaacagtggctgcc

SEQ ID NO: 900470 - DNA, 25 bp, Mus musculus
tgtattacggtctacagtggctgcc

SEQ ID NO: 900471 - DNA, 25 bp, Mus musculus
tgtattacttgtctcatcacctcct

SEQ ID NO: 900472 - DNA, 25 bp, Mus musculus
tgtattacttgtgtcatcacctcct

SEQ ID NO: 900473 - DNA, 25 bp, Mus musculus
tgtattagaaccatgcaacttgctt

SEQ ID NO: 900474 - DNA, 25 bp, Mus musculus
tgtattagaaccttgcaacttgctt

SEQ ID NO: 900475 - DNA, 25 bp, Mus musculus
tgtattagcgcaattctttctgcct

SEQ ID NO: 900476 - DNA, 25 bp, Mus musculus
tgtattagcgcatttctttctgcct

SEQ ID NO: 900477 - DNA, 25 bp, Mus musculus
tgtattatacccaagacccagctac

SEQ ID NO: 900478 - DNA, 25 bp, Mus musculus
tgtattataccctagacccagctac

SEQ ID NO: 900479 - DNA, 25 bp, Mus musculus
tgtattatccttcacagcttcctgc

SEQ ID NO: 900480 - DNA, 25 bp, Mus musculus
tgtattatccttgacagcttcctgc

SEQ ID NO: 900481 - DNA, 25 bp, Mus musculus
tgtattatttggactttggattcag

SEQ ID NO: 900482 - DNA, 25 bp, Mus musculus
tgtattatttggtctttggattcag

SEQ ID NO: 900483 - DNA, 25 bp, Mus musculus
tgtattattttgagtccatgactca

SEQ ID NO: 900484 - DNA, 25 bp, Mus musculus
tgtattattttgtgtccatgactca

SEQ ID NO: 900485 - DNA, 25 bp, Mus musculus
tgtattcaagtacccgtggaagcct

SEQ ID NO: 900486 - DNA, 25 bp, Mus musculus
tgtattcaagtagccgtggaagcct

SEQ ID NO: 900487 - DNA, 25 bp, Mus musculus
tgtattcacactaggacatacctgc

SEQ ID NO: 900488 - DNA, 25 bp, Mus musculus
tgtattcacacttggacatacctgc

SEQ ID NO: 900489 - DNA, 25 bp, Mus musculus
tgtattcacatcacagtgacagagg

SEQ ID NO: 900490 - DNA, 25 bp, Mus musculus
tgtattcacatctcagtgacagagg

SEQ ID NO: 900491 - DNA, 25 bp, Mus musculus
tgtattcactggctactcgtgcctc

SEQ ID NO: 900492 - DNA, 25 bp, Mus musculus
tgtattcactgggtactcgtgcctc

SEQ ID NO: 900493 - DNA, 25 bp, Mus musculus
tgtattcagggtactggtccttgtt

SEQ ID NO: 900494 - DNA, 25 bp, Mus musculus
tgtattcagggttctggtccttgtt

SEQ ID NO: 900495 - DNA, 25 bp, Mus musculus
tgtattcatcccattctgttcagat

SEQ ID NO: 900496 - DNA, 25 bp, Mus musculus
tgtattcatccctttctgttcagat

SEQ ID NO: 900497 - DNA, 25 bp, Mus musculus
tgtattcatcttcctcaccggagaa

SEQ ID NO: 900498 - DNA, 25 bp, Mus musculus
tgtattcatcttgctcaccggagaa

SEQ ID NO: 900499 - DNA, 25 bp, Mus musculus
tgtattcatgtcacacagatgtgta

SEQ ID NO: 900500 - DNA, 25 bp, Mus musculus
tgtattcatgtctcacagatgtgta

SEQ ID NO: 900501 - DNA, 25 bp, Mus musculus
tgtattcattcacttgcaactgttt

SEQ ID NO: 900502 - DNA, 25 bp, Mus musculus
tgtattcattcagttgcaactgttt

SEQ ID NO: 900503 - DNA, 25 bp, Mus musculus
tgtattcattgaagctcgtggacca

SEQ ID NO: 900504 - DNA, 25 bp, Mus musculus
tgtattcattgatgctcgtggacca

SEQ ID NO: 900505 - DNA, 25 bp, Mus musculus
tgtattcattgtacttgaagacccc

SEQ ID NO: 900506 - DNA, 25 bp, Mus musculus
tgtattcattgttcttgaagacccc

SEQ ID NO: 900507 - DNA, 25 bp, Mus musculus
tgtattccagacaagcctcaacgtt

SEQ ID NO: 900508 - DNA, 25 bp, Mus musculus
tgtattccagactagcctcaacgtt

SEQ ID NO: 900509 - DNA, 25 bp, Mus musculus
tgtattccatgtacagcccagagtg

SEQ ID NO: 900510 - DNA, 25 bp, Mus musculus
tgtattccatgttcagcccagagtg

SEQ ID NO: 900511 - DNA, 25 bp, Mus musculus
tgtattccatttctgttacccaatc

SEQ ID NO: 900512 - DNA, 25 bp, Mus musculus
tgtattccatttgtgttacccaatc

SEQ ID NO: 900513 - DNA, 25 bp, Mus musculus
tgtattccgactctgcagcgagaga

SEQ ID NO: 900514 - DNA, 25 bp, Mus musculus
tgtattccgactgtgcagcgagaga

SEQ ID NO: 900515 - DNA, 25 bp, Mus musculus
tgtattcctaatagtccaaagcata

SEQ ID NO: 900516 - DNA, 25 bp, Mus musculus
tgtattcctaattgtccaaagcata

SEQ ID NO: 900517 - DNA, 25 bp, Mus musculus
tgtattcctacaaggcttctgcctt

SEQ ID NO: 900518 - DNA, 25 bp, Mus musculus
tgtattcctacaaggcttttgcctt

SEQ ID NO: 900519 - DNA, 25 bp, Mus musculus
tgtattcctacatggcttctgcctt

SEQ ID NO: 900520 - DNA, 25 bp, Mus musculus
tgtattcctacatggcttttgcctt

SEQ ID NO: 900521 - DNA, 25 bp, Mus musculus
tgtattcctaccagccttttttagg

SEQ ID NO: 900522 - DNA, 25 bp, Mus musculus
tgtattcctacctgccttttttagg

SEQ ID NO: 900523 - DNA, 25 bp, Mus musculus
tgtattcctctcagtctgttttcct

SEQ ID NO: 900524 - DNA, 25 bp, Mus musculus
tgtattcctctctgtctgttttcct

SEQ ID NO: 900525 - DNA, 25 bp, Mus musculus
tgtattcctgccattgagctcgtga

SEQ ID NO: 900526 - DNA, 25 bp, Mus musculus
tgtattcctgcctttgagctcgtga

SEQ ID NO: 900527 - DNA, 25 bp, Mus musculus
tgtattcctggaatggtctccactt

SEQ ID NO: 900528 - DNA, 25 bp, Mus musculus
tgtattcctggattggtctccactt

SEQ ID NO: 900529 - DNA, 25 bp, Mus musculus
tgtattcgttccacatggcagcctc

SEQ ID NO: 900530 - DNA, 25 bp, Mus musculus
tgtattcgttcctcatggcagcctc

SEQ ID NO: 900531 - DNA, 25 bp, Mus musculus
tgtattctatcacatctgccactgt

SEQ ID NO: 900532 - DNA, 25 bp, Mus musculus
tgtattctatcagatctgccactgt

SEQ ID NO: 900533 - DNA, 25 bp, Mus musculus
tgtattctcaacctagctgtcctaa

SEQ ID NO: 900534 - DNA, 25 bp, Mus musculus
tgtattctcaacgtagctgtcctaa

SEQ ID NO: 900535 - DNA, 25 bp, Mus musculus
tgtattctcagaaagacacgggcgt

SEQ ID NO: 900536 - DNA, 25 bp, Mus musculus
tgtattctcagatagacacgggcgt

SEQ ID NO: 900537 - DNA, 25 bp, Mus musculus
tgtattctgctaacccatcaggcaa

SEQ ID NO: 900538 - DNA, 25 bp, Mus musculus
tgtattctgctatcccatcaggcaa

SEQ ID NO: 900539 - DNA, 25 bp, Mus musculus
tgtattctgcttagaaactgtaact

SEQ ID NO: 900540 - DNA, 25 bp, Mus musculus
tgtattctgcttcgcctggtcatgg

SEQ ID NO: 900541 - DNA, 25 bp, Mus musculus
tgtattctgcttggcctggtcatgg

SEQ ID NO: 900542 - DNA, 25 bp, Mus musculus
tgtattctgctttgaaactgtaact

SEQ ID NO: 900543 - DNA, 25 bp, Mus musculus
tgtattctggaaccgtaaattgatt

SEQ ID NO: 900544 - DNA, 25 bp, Mus musculus
tgtattctggaagcgtaaattgatt

SEQ ID NO: 900545 - DNA, 25 bp, Mus musculus
tgtattctttatattcagggtgtga

SEQ ID NO: 900546 - DNA, 25 bp, Mus musculus
tgtattctttattttcagggtgtga

SEQ ID NO: 900547 - DNA, 25 bp, Mus musculus
tgtattctttcacatctgccactgt

SEQ ID NO: 900548 - DNA, 25 bp, Mus musculus
tgtattctttcagatctgccactgt

SEQ ID NO: 900549 - DNA, 25 bp, Mus musculus
tgtattgaagacacagacgccatat

SEQ ID NO: 900550 - DNA, 25 bp, Mus musculus
tgtattgaagactcagacgccatat

SEQ ID NO: 900551 - DNA, 25 bp, Mus musculus
tgtattgaagcacccacacacctac

SEQ ID NO: 900552 - DNA, 25 bp, Mus musculus
tgtattgaagcagccacacacctac

SEQ ID NO: 900553 - DNA, 25 bp, Mus musculus
tgtattgaatacagctcgtctcctg

SEQ ID NO: 900554 - DNA, 25 bp, Mus musculus
tgtattgaatactgctcgtctcctg

SEQ ID NO: 900555 - DNA, 25 bp, Mus musculus
tgtattgacagtcaagtcccgcttc

SEQ ID NO: 900556 - DNA, 25 bp, Mus musculus
tgtattgacagtgaagtcccgcttc

SEQ ID NO: 900557 - DNA, 25 bp, Mus musculus
tgtattgaccctcggtcgggccact

SEQ ID NO: 900558 - DNA, 25 bp, Mus musculus
tgtattgaccctgggtcgggccact

SEQ ID NO: 900559 - DNA, 25 bp, Mus musculus
tgtattgactatccccagtgctgga

SEQ ID NO: 900560 - DNA, 25 bp, Mus musculus
tgtattgactatgcccagtgctgga

SEQ ID NO: 900561 - DNA, 25 bp, Mus musculus
tgtattgagctgctcttctgctttt

SEQ ID NO: 900562 - DNA, 25 bp, Mus musculus
tgtattgagctggtcttctgctttt

SEQ ID NO: 900563 - DNA, 25 bp, Mus musculus
tgtattgatttcagtttgacgtttc

SEQ ID NO: 900564 - DNA, 25 bp, Mus musculus
tgtattgatttctgtttgacgtttc

SEQ ID NO: 900565 - DNA, 25 bp, Mus musculus
tgtattgcacgtcggctttatcttc

SEQ ID NO: 900566 - DNA, 25 bp, Mus musculus
tgtattgcacgtgggctttatcttc

SEQ ID NO: 900567 - DNA, 25 bp, Mus musculus
tgtattgcagcccatactggacagg

SEQ ID NO: 900568 - DNA, 25 bp, Mus musculus
tgtattgcagccgatactggacagg

SEQ ID NO: 900569 - DNA, 25 bp, Mus musculus
tgtattgccaatattcacctcctgt

SEQ ID NO: 900570 - DNA, 25 bp, Mus musculus
tgtattgccaattttcacctcctgt

SEQ ID NO: 900571 - DNA, 25 bp, Mus musculus
tgtattgcccttccagacatcgtgg

SEQ ID NO: 900572 - DNA, 25 bp, Mus musculus
tgtattgcccttgcagacatcgtgg

SEQ ID NO: 900573 - DNA, 25 bp, Mus musculus
tgtattgccgaaactggccccatgt

SEQ ID NO: 900574 - DNA, 25 bp, Mus musculus
tgtattgccgaatctggccccatgt

SEQ ID NO: 900575 - DNA, 25 bp, Mus musculus
tgtattgccggtatttctgtttggg

SEQ ID NO: 900576 - DNA, 25 bp, Mus musculus
tgtattgccggtttttctgtttggg

SEQ ID NO: 900577 - DNA, 25 bp, Mus musculus
tgtattgcctcacgaccaggccagt

SEQ ID NO: 900578 - DNA, 25 bp, Mus musculus
tgtattgcctcaggaccaggccagt

SEQ ID NO: 900579 - DNA, 25 bp, Mus musculus
tgtattgctagtaacatctactcct

SEQ ID NO: 900580 - DNA, 25 bp, Mus musculus
tgtattgctagttacatctactcct

SEQ ID NO: 900581 - DNA, 25 bp, Mus musculus
tgtattgctatacccttactgtgta

SEQ ID NO: 900582 - DNA, 25 bp, Mus musculus
tgtattgctatagccttactgtgta

SEQ ID NO: 900583 - DNA, 25 bp, Mus musculus
tgtattgctcgcacttacagcattg

SEQ ID NO: 900584 - DNA, 25 bp, Mus musculus
tgtattgctcgctcttacagcattg

SEQ ID NO: 900585 - DNA, 25 bp, Mus musculus
tgtattgcttaaattgccttgctta

SEQ ID NO: 900586 - DNA, 25 bp, Mus musculus
tgtattgcttaatttgccttgctta

SEQ ID NO: 900587 - DNA, 25 bp, Mus musculus
tgtattggtgttatgttctgcctgg

SEQ ID NO: 900588 - DNA, 25 bp, Mus musculus
tgtattggtgttttgttctgcctgg

SEQ ID NO: 900589 - DNA, 25 bp, Mus musculus
tgtattgtatcaccaccccaacaag

SEQ ID NO: 900590 - DNA, 25 bp, Mus musculus
tgtattgtatcagcaccccaacaag

SEQ ID NO: 900591 - DNA, 25 bp, Mus musculus
tgtattgtatccatgctcccagggc

SEQ ID NO: 900592 - DNA, 25 bp, Mus musculus
tgtattgtatccttgctcccagggc

SEQ ID NO: 900593 - DNA, 25 bp, Mus musculus
tgtattgtcaagctgcatgctctct

SEQ ID NO: 900594 - DNA, 25 bp, Mus musculus
tgtattgtcaaggtgcatgctctct

SEQ ID NO: 900595 - DNA, 25 bp, Mus musculus
tgtattgtcagcctgagcctgtcag

SEQ ID NO: 900596 - DNA, 25 bp, Mus musculus
tgtattgtcagcgtgagcctgtcag

SEQ ID NO: 900597 - DNA, 25 bp, Mus musculus
tgtattgtggacagtctttgcctca

SEQ ID NO: 900598 - DNA, 25 bp, Mus musculus
tgtattgtggactgtctttgcctca

SEQ ID NO: 900599 - DNA, 25 bp, Mus musculus
tgtattgtgtgcatacctgaacgca

SEQ ID NO: 900600 - DNA, 25 bp, Mus musculus
tgtattgtgtgcttacctgaacgca

SEQ ID NO: 900601 - DNA, 25 bp, Mus musculus
tgtattgtgttcatcggctgtcaaa

SEQ ID NO: 900602 - DNA, 25 bp, Mus musculus
tgtattgtgttcttcggctgtcaaa

SEQ ID NO: 900603 - DNA, 25 bp, Mus musculus
tgtattgttgtaaccctgctttctg

SEQ ID NO: 900604 - DNA, 25 bp, Mus musculus
tgtattgttgtatccctgctttctg

SEQ ID NO: 900605 - DNA, 25 bp, Mus musculus
tgtattgtttagagctcatgaaagc

SEQ ID NO: 900606 - DNA, 25 bp, Mus musculus
tgtattgtttagtgctcatgaaagc

SEQ ID NO: 900607 - DNA, 25 bp, Mus musculus
tgtattgttttaaccccacagtgtt

SEQ ID NO: 900608 - DNA, 25 bp, Mus musculus
tgtattgttttatccccacagtgtt

SEQ ID NO: 900609 - DNA, 25 bp, Mus musculus
tgtattgttttcaatggcactaggg

SEQ ID NO: 900610 - DNA, 25 bp, Mus musculus
tgtattgttttctatggcactaggg

SEQ ID NO: 900611 - DNA, 25 bp, Mus musculus
tgtatttaaaccactgtactggcaa

SEQ ID NO: 900612 - DNA, 25 bp, Mus musculus
tgtatttaaacctctgtactggcaa

SEQ ID NO: 900613 - DNA, 25 bp, Mus musculus
tgtatttaaatgatttaggcaatct

SEQ ID NO: 900614 - DNA, 25 bp, Mus musculus
tgtatttaaatgttttaggcaatct

SEQ ID NO: 900615 - DNA, 25 bp, Mus musculus
tgtatttaatgcagacccagcccag

SEQ ID NO: 900616 - DNA, 25 bp, Mus musculus
tgtatttaatgcctctgactgcctt

SEQ ID NO: 900617 - DNA, 25 bp, Mus musculus
tgtatttaatgcgtctgactgcctt

SEQ ID NO: 900618 - DNA, 25 bp, Mus musculus
tgtatttaatgctgacccagcccag

SEQ ID NO: 900619 - DNA, 25 bp, Mus musculus
tgtatttacaccactgctttgactc

SEQ ID NO: 900620 - DNA, 25 bp, Mus musculus
tgtatttacacctctgctttgactc

SEQ ID NO: 900621 - DNA, 25 bp, Mus musculus
tgtatttacctaagagttctcaact

SEQ ID NO: 900622 - DNA, 25 bp, Mus musculus
tgtatttacctatgagttctcaact

SEQ ID NO: 900623 - DNA, 25 bp, Mus musculus
tgtatttaggttacgggtaacaatg

SEQ ID NO: 900624 - DNA, 25 bp, Mus musculus
tgtatttaggtttcgggtaacaatg

SEQ ID NO: 900625 - DNA, 25 bp, Mus musculus
tgtatttatacgactctctgtgtgt

SEQ ID NO: 900626 - DNA, 25 bp, Mus musculus
tgtatttatacgtctctctgtgtgt

SEQ ID NO: 900627 - DNA, 25 bp, Mus musculus
tgtatttatatcaacccgagcctcc

SEQ ID NO: 900628 - DNA, 25 bp, Mus musculus
tgtatttatatctacccgagcctcc

SEQ ID NO: 900629 - DNA, 25 bp, Mus musculus
tgtatttatgccatccagtatctgg

SEQ ID NO: 900630 - DNA, 25 bp, Mus musculus
tgtatttatgccttccagtatctgg

SEQ ID NO: 900631 - DNA, 25 bp, Mus musculus
tgtatttatggaactcagtcactaa

SEQ ID NO: 900632 - DNA, 25 bp, Mus musculus
tgtatttatggatctcagtcactaa

SEQ ID NO: 900633 - DNA, 25 bp, Mus musculus
tgtatttatgtaaatcctcctaggt

SEQ ID NO: 900634 - DNA, 25 bp, Mus musculus
tgtatttatgtatatcctcctaggt

SEQ ID NO: 900635 - DNA, 25 bp, Mus musculus
tgtatttcacctaagtccacagcca

SEQ ID NO: 900636 - DNA, 25 bp, Mus musculus
tgtatttcaccttagtccacagcca

SEQ ID NO: 900637 - DNA, 25 bp, Mus musculus
tgtatttcactcagtatcctgccag

SEQ ID NO: 900638 - DNA, 25 bp, Mus musculus
tgtatttcactctgtatcctgccag

SEQ ID NO: 900639 - DNA, 25 bp, Mus musculus
tgtatttcagagattgtccctatga

SEQ ID NO: 900640 - DNA, 25 bp, Mus musculus
tgtatttcagagtttgtccctatga

SEQ ID NO: 900641 - DNA, 25 bp, Mus musculus
tgtatttcagatcatcctctcacag

SEQ ID NO: 900642 - DNA, 25 bp, Mus musculus
tgtatttcagatgatcctctcacag

SEQ ID NO: 900643 - DNA, 25 bp, Mus musculus
tgtatttcagcacttttcagtccca

SEQ ID NO: 900644 - DNA, 25 bp, Mus musculus
tgtatttcagcagttttcagtccca

SEQ ID NO: 900645 - DNA, 25 bp, Mus musculus
tgtatttcaggcagggcccaaactc

SEQ ID NO: 900646 - DNA, 25 bp, Mus musculus
tgtatttcaggcctctctccctgga

SEQ ID NO: 900647 - DNA, 25 bp, Mus musculus
tgtatttcaggcgtctctccctgga

SEQ ID NO: 900648 - DNA, 25 bp, Mus musculus
tgtatttcaggctgggcccaaactc

SEQ ID NO: 900649 - DNA, 25 bp, Mus musculus
tgtatttcatgcctgtctgcacagt

SEQ ID NO: 900650 - DNA, 25 bp, Mus musculus
tgtatttcatgcgtgtctgcacagt

SEQ ID NO: 900651 - DNA, 25 bp, Mus musculus
tgtatttccaatatcttgttcatgt

SEQ ID NO: 900652 - DNA, 25 bp, Mus musculus
tgtatttccaatttcttgttcatgt

SEQ ID NO: 900653 - DNA, 25 bp, Mus musculus
tgtatttccacacttttgcctcatg

SEQ ID NO: 900654 - DNA, 25 bp, Mus musculus
tgtatttccacagttttgcctcatg

SEQ ID NO: 900655 - DNA, 25 bp, Mus musculus
tgtatttcccttacacctgagtgaa

SEQ ID NO: 900656 - DNA, 25 bp, Mus musculus
tgtatttccctttcacctgagtgaa

SEQ ID NO: 900657 - DNA, 25 bp, Mus musculus
tgtatttcctcaacacctttggcga

SEQ ID NO: 900658 - DNA, 25 bp, Mus musculus
tgtatttcctcatcacctttggcga

SEQ ID NO: 900659 - DNA, 25 bp, Mus musculus
tgtatttccttgagaatcttatttg

SEQ ID NO: 900660 - DNA, 25 bp, Mus musculus
tgtatttccttgtgaatcttatttg

SEQ ID NO: 900661 - DNA, 25 bp, Mus musculus
tgtatttcgcttattcctggacaaa

SEQ ID NO: 900662 - DNA, 25 bp, Mus musculus
tgtatttcgctttttcctggacaaa

SEQ ID NO: 900663 - DNA, 25 bp, Mus musculus
tgtatttcggtactcctagcactta

SEQ ID NO: 900664 - DNA, 25 bp, Mus musculus
tgtatttcggtagtcctagcactta

SEQ ID NO: 900665 - DNA, 25 bp, Mus musculus
tgtatttctacaccactctctgagg

SEQ ID NO: 900666 - DNA, 25 bp, Mus musculus
tgtatttctacagcactctctgagg

SEQ ID NO: 900667 - DNA, 25 bp, Mus musculus
tgtatttctctgatgctgcaagttt

SEQ ID NO: 900668 - DNA, 25 bp, Mus musculus
tgtatttctctgttgctgcaagttt

SEQ ID NO: 900669 - DNA, 25 bp, Mus musculus
tgtatttctgccaaacaagtagctt

SEQ ID NO: 900670 - DNA, 25 bp, Mus musculus
tgtatttctgcctaacaagtagctt

SEQ ID NO: 900671 - DNA, 25 bp, Mus musculus
tgtatttcttaacggctggctacca

SEQ ID NO: 900672 - DNA, 25 bp, Mus musculus
tgtatttcttaagggctggctacca

SEQ ID NO: 900673 - DNA, 25 bp, Mus musculus
tgtatttgactgcaaaccctggttt

SEQ ID NO: 900674 - DNA, 25 bp, Mus musculus
tgtatttgactggaaaccctggttt

SEQ ID NO: 900675 - DNA, 25 bp, Mus musculus
tgtatttgagccaccctactgtcat

SEQ ID NO: 900676 - DNA, 25 bp, Mus musculus
tgtatttgagcctccctactgtcat

SEQ ID NO: 900677 - DNA, 25 bp, Mus musculus
tgtatttgatgtacacggtccgctc

SEQ ID NO: 900678 - DNA, 25 bp, Mus musculus
tgtatttgatgttcacggtccgctc

SEQ ID NO: 900679 - DNA, 25 bp, Mus musculus
tgtatttgattacttagggatagaa

SEQ ID NO: 900680 - DNA, 25 bp, Mus musculus
tgtatttgattagttagggatagaa

SEQ ID NO: 900681 - DNA, 25 bp, Mus musculus
tgtatttgctacatgtgagactttg

SEQ ID NO: 900682 - DNA, 25 bp, Mus musculus
tgtatttgctacttgtgagactttg

SEQ ID NO: 900683 - DNA, 25 bp, Mus musculus
tgtatttgctcacttctagatccaa

SEQ ID NO: 900684 - DNA, 25 bp, Mus musculus
tgtatttgctcagttctagatccaa

SEQ ID NO: 900685 - DNA, 25 bp, Mus musculus
tgtatttgctcccttctgacttcat

SEQ ID NO: 900686 - DNA, 25 bp, Mus musculus
tgtatttgctccgttctgacttcat

SEQ ID NO: 900687 - DNA, 25 bp, Mus musculus
tgtatttgctgcatgacatgggctc

SEQ ID NO: 900688 - DNA, 25 bp, Mus musculus
tgtatttgctgcttgacatgggctc

SEQ ID NO: 900689 - DNA, 25 bp, Mus musculus
tgtatttggctcatggttcagcaaa

SEQ ID NO: 900690 - DNA, 25 bp, Mus musculus
tgtatttggctcttggttcagcaaa

SEQ ID NO: 900691 - DNA, 25 bp, Mus musculus
tgtatttgtttcacaaacttgttaa

SEQ ID NO: 900692 - DNA, 25 bp, Mus musculus
tgtatttgtttcactgtcccacact

SEQ ID NO: 900693 - DNA, 25 bp, Mus musculus
tgtatttgtttctcaaacttgttaa

SEQ ID NO: 900694 - DNA, 25 bp, Mus musculus
tgtatttgtttctctgtcccacact

SEQ ID NO: 900695 - DNA, 25 bp, Mus musculus
tgtattttaattcccgatcacaagg

SEQ ID NO: 900696 - DNA, 25 bp, Mus musculus
tgtattttaattgccgatcacaagg

SEQ ID NO: 900697 - DNA, 25 bp, Mus musculus
tgtattttaggtccttcggtaaagc

SEQ ID NO: 900698 - DNA, 25 bp, Mus musculus
tgtattttaggtgcttcggtaaagc

SEQ ID NO: 900699 - DNA, 25 bp, Mus musculus
tgtattttcaataatttccttggaa

SEQ ID NO: 900700 - DNA, 25 bp, Mus musculus
tgtattttcaattatttccttggaa

SEQ ID NO: 900701 - DNA, 25 bp, Mus musculus
tgtattttcaccctgacagtgaccc

SEQ ID NO: 900702 - DNA, 25 bp, Mus musculus
tgtattttcaccgtgacagtgaccc

SEQ ID NO: 900703 - DNA, 25 bp, Mus musculus
tgtattttcagaactagttagtcct

SEQ ID NO: 900704 - DNA, 25 bp, Mus musculus
tgtattttcagatctagttagtcct

SEQ ID NO: 900705 - DNA, 25 bp, Mus musculus
tgtattttccaaaccatctctcaga

SEQ ID NO: 900706 - DNA, 25 bp, Mus musculus
tgtattttccaactgtgcatattgt

SEQ ID NO: 900707 - DNA, 25 bp, Mus musculus
tgtattttccaagtgtgcatattgt

SEQ ID NO: 900708 - DNA, 25 bp, Mus musculus
tgtattttccaatccatctctcaga

SEQ ID NO: 900709 - DNA, 25 bp, Mus musculus
tgtattttcccaaccctaagagtag

SEQ ID NO: 900710 - DNA, 25 bp, Mus musculus
tgtattttcccatccctaagagtag

SEQ ID NO: 900711 - DNA, 25 bp, Mus musculus
tgtattttgacacccatgttcaacc

SEQ ID NO: 900712 - DNA, 25 bp, Mus musculus
tgtattttgacagccatgttcaacc

SEQ ID NO: 900713 - DNA, 25 bp, Mus musculus
tgtattttgatcatagccaccattc

SEQ ID NO: 900714 - DNA, 25 bp, Mus musculus
tgtattttgatcttagccaccattc

SEQ ID NO: 900715 - DNA, 25 bp, Mus musculus
tgtattttgcctaacaggaaacctt

SEQ ID NO: 900716 - DNA, 25 bp, Mus musculus
tgtattttgccttacaggaaacctt

SEQ ID NO: 900717 - DNA, 25 bp, Mus musculus
tgtattttggatatccggtttgcgg

SEQ ID NO: 900718 - DNA, 25 bp, Mus musculus
tgtattttggatttccggtttgcgg

SEQ ID NO: 900719 - DNA, 25 bp, Mus musculus
tgtattttgtctcgtggcactcact

SEQ ID NO: 900720 - DNA, 25 bp, Mus musculus
tgtattttgtctggtggcactcact

SEQ ID NO: 900721 - DNA, 25 bp, Mus musculus
tgtatttttacaacaacggaattta

SEQ ID NO: 900722 - DNA, 25 bp, Mus musculus
tgtatttttacatcaacggaattta

SEQ ID NO: 900723 - DNA, 25 bp, Mus musculus
tgtatttttcctatgaccccactct

SEQ ID NO: 900724 - DNA, 25 bp, Mus musculus
tgtatttttcctttgaccccactct

SEQ ID NO: 900725 - DNA, 25 bp, Mus musculus
tgtatttttgatctgcactgctctc

SEQ ID NO: 900726 - DNA, 25 bp, Mus musculus
tgtatttttgatgtgcactgctctc

SEQ ID NO: 900727 - DNA, 25 bp, Mus musculus
tgtattttttgacaccagccacaat

SEQ ID NO: 900728 - DNA, 25 bp, Mus musculus
tgtattttttgagaccagccacaat

SEQ ID NO: 900729 - DNA, 25 bp, Mus musculus
tgtcaaaaatatccgcccagctggg

SEQ ID NO: 900730 - DNA, 25 bp, Mus musculus
tgtcaaaaatatgcgcccagctggg

SEQ ID NO: 900731 - DNA, 25 bp, Mus musculus
tgtcaaaactgacgcttgctaattt

SEQ ID NO: 900732 - DNA, 25 bp, Mus musculus
tgtcaaaactgaggcttgctaattt

SEQ ID NO: 900733 - DNA, 25 bp, Mus musculus
tgtcaaaagcaacaaactccccagt

SEQ ID NO: 900734 - DNA, 25 bp, Mus musculus
tgtcaaaagcaagaaactccccagt

SEQ ID NO: 900735 - DNA, 25 bp, Mus musculus
tgtcaaaagcataccagagctggtt

SEQ ID NO: 900736 - DNA, 25 bp, Mus musculus
tgtcaaaagcattccagagctggtt

SEQ ID NO: 900737 - DNA, 25 bp, Mus musculus
tgtcaaaagttgacacggtacaagc

SEQ ID NO: 900738 - DNA, 25 bp, Mus musculus
tgtcaaaagttgtcacggtacaagc

SEQ ID NO: 900739 - DNA, 25 bp, Mus musculus
tgtcaaacacatccagtcactactg

SEQ ID NO: 900740 - DNA, 25 bp, Mus musculus
tgtcaaacacatgcagtcactactg

SEQ ID NO: 900741 - DNA, 25 bp, Mus musculus
tgtcaaacacctcaataactcattc

SEQ ID NO: 900742 - DNA, 25 bp, Mus musculus
tgtcaaacacctgaataactcattc

SEQ ID NO: 900743 - DNA, 25 bp, Mus musculus
tgtcaaacaggaatacatttcagta

SEQ ID NO: 900744 - DNA, 25 bp, Mus musculus
tgtcaaacaggattacatttcagta

SEQ ID NO: 900745 - DNA, 25 bp, Mus musculus
tgtcaaacctctatagccttaacgc

SEQ ID NO: 900746 - DNA, 25 bp, Mus musculus
tgtcaaacctctttagccttaacgc

SEQ ID NO: 900747 - DNA, 25 bp, Mus musculus
tgtcaaactttgcttatcggtagat

SEQ ID NO: 900748 - DNA, 25 bp, Mus musculus
tgtcaaactttggttatcggtagat

SEQ ID NO: 900749 - DNA, 25 bp, Mus musculus
tgtcaaagactgaagcaaccaggct

SEQ ID NO: 900750 - DNA, 25 bp, Mus musculus
tgtcaaagactgtagcaaccaggct

SEQ ID NO: 900751 - DNA, 25 bp, Mus musculus
tgtcaaagacttcacagtcccagag

SEQ ID NO: 900752 - DNA, 25 bp, Mus musculus
tgtcaaagacttgacagtcccagag

SEQ ID NO: 900753 - DNA, 25 bp, Mus musculus
tgtcaaagcacaccctatgtgtact

SEQ ID NO: 900754 - DNA, 25 bp, Mus musculus
tgtcaaagcacagcctatgtgtact

SEQ ID NO: 900755 - DNA, 25 bp, Mus musculus
tgtcaaaggccaaacctctgttcag

SEQ ID NO: 900756 - DNA, 25 bp, Mus musculus
tgtcaaaggccatacctctgttcag

SEQ ID NO: 900757 - DNA, 25 bp, Mus musculus
tgtcaaagtcatatcatcccgggaa

SEQ ID NO: 900758 - DNA, 25 bp, Mus musculus
tgtcaaagtcatttcatcccgggaa

SEQ ID NO: 900759 - DNA, 25 bp, Mus musculus
tgtcaaagtcggactgggagtggcc

SEQ ID NO: 900760 - DNA, 25 bp, Mus musculus
tgtcaaagtcggtctgggagtggcc

SEQ ID NO: 900761 - DNA, 25 bp, Mus musculus
tgtcaaatctttatccaactaacta

SEQ ID NO: 900762 - DNA, 25 bp, Mus musculus
tgtcaaatctttttccaactaacta

SEQ ID NO: 900763 - DNA, 25 bp, Mus musculus
tgtcaaatgaagcatccgtccgtgg

SEQ ID NO: 900764 - DNA, 25 bp, Mus musculus
tgtcaaatgaaggatccgtccgtgg

SEQ ID NO: 900765 - DNA, 25 bp, Mus musculus
tgtcaaattggcaggtgctacccac

SEQ ID NO: 900766 - DNA, 25 bp, Mus musculus
tgtcaaattggctggtgctacccac

SEQ ID NO: 900767 - DNA, 25 bp, Mus musculus
tgtcaacaaagtaaggaggttccgt

SEQ ID NO: 900768 - DNA, 25 bp, Mus musculus
tgtcaacaaagttaggaggttccgt

SEQ ID NO: 900769 - DNA, 25 bp, Mus musculus
tgtcaacactggctactggtggccc

SEQ ID NO: 900770 - DNA, 25 bp, Mus musculus
tgtcaacactgggtactggtggccc

SEQ ID NO: 900771 - DNA, 25 bp, Mus musculus
tgtcaacacttaacttagctactat

SEQ ID NO: 900772 - DNA, 25 bp, Mus musculus
tgtcaacacttatcttagctactat

SEQ ID NO: 900773 - DNA, 25 bp, Mus musculus
tgtcaacagttgactcaatcccatt

SEQ ID NO: 900774 - DNA, 25 bp, Mus musculus
tgtcaacagttgtctcaatcccatt

SEQ ID NO: 900775 - DNA, 25 bp, Mus musculus
tgtcaacataggacaagcccctttg

SEQ ID NO: 900776 - DNA, 25 bp, Mus musculus
tgtcaacataggtcaagcccctttg

SEQ ID NO: 900777 - DNA, 25 bp, Mus musculus
tgtcaaccaaagatactcttcccgt

SEQ ID NO: 900778 - DNA, 25 bp, Mus musculus
tgtcaaccaaagttactcttcccgt

SEQ ID NO: 900779 - DNA, 25 bp, Mus musculus
tgtcaaccagccacttaagctagtt

SEQ ID NO: 900780 - DNA, 25 bp, Mus musculus
tgtcaaccagccagacctataacag

SEQ ID NO: 900781 - DNA, 25 bp, Mus musculus
tgtcaaccagccatgaggtgttctc

SEQ ID NO: 900782 - DNA, 25 bp, Mus musculus
tgtcaaccagcctcttaagctagtt

SEQ ID NO: 900783 - DNA, 25 bp, Mus musculus
tgtcaaccagcctgacctataacag

SEQ ID NO: 900784 - DNA, 25 bp, Mus musculus
tgtcaaccagccttgaggtgttctc

SEQ ID NO: 900785 - DNA, 25 bp, Mus musculus
tgtcaacctcagcaagccttgggaa

SEQ ID NO: 900786 - DNA, 25 bp, Mus musculus
tgtcaacctcaggaagccttgggaa

SEQ ID NO: 900787 - DNA, 25 bp, Mus musculus
tgtcaacctctacaaggacttgctg

SEQ ID NO: 900788 - DNA, 25 bp, Mus musculus
tgtcaacctctacctgatatcagca

SEQ ID NO: 900789 - DNA, 25 bp, Mus musculus
tgtcaacctctagaaggacttgctg

SEQ ID NO: 900790 - DNA, 25 bp, Mus musculus
tgtcaacctctagctgatatcagca

SEQ ID NO: 900791 - DNA, 25 bp, Mus musculus
tgtcaacgtggccttatcatcaaac

SEQ ID NO: 900792 - DNA, 25 bp, Mus musculus
tgtcaacgtggcgttatcatcaaac

SEQ ID NO: 900793 - DNA, 25 bp, Mus musculus
tgtcaactccggatcctagatttag

SEQ ID NO: 900794 - DNA, 25 bp, Mus musculus
tgtcaactccggttcctagatttag

SEQ ID NO: 900795 - DNA, 25 bp, Mus musculus
tgtcaactctcacagtctgattttt

SEQ ID NO: 900796 - DNA, 25 bp, Mus musculus
tgtcaactctcagagtctgattttt

SEQ ID NO: 900797 - DNA, 25 bp, Mus musculus
tgtcaactgagtcacagctgtgcac

SEQ ID NO: 900798 - DNA, 25 bp, Mus musculus
tgtcaactgagtgacagctgtgcac

SEQ ID NO: 900799 - DNA, 25 bp, Mus musculus
tgtcaactgccgaaagaggaagtgt

SEQ ID NO: 900800 - DNA, 25 bp, Mus musculus
tgtcaactgccgtaagaggaagtgt

SEQ ID NO: 900801 - DNA, 25 bp, Mus musculus
tgtcaactgcctattgggtcacaga

SEQ ID NO: 900802 - DNA, 25 bp, Mus musculus
tgtcaactgccttttgggtcacaga

SEQ ID NO: 900803 - DNA, 25 bp, Mus musculus
tgtcaactgtgtcgcttggaatccc

SEQ ID NO: 900804 - DNA, 25 bp, Mus musculus
tgtcaactgtgtggcttggaatccc

SEQ ID NO: 900805 - DNA, 25 bp, Mus musculus
tgtcaacttcttcaccaactggcag

SEQ ID NO: 900806 - DNA, 25 bp, Mus musculus
tgtcaacttcttgaccaactggcag

SEQ ID NO: 900807 - DNA, 25 bp, Mus musculus
tgtcaacttgacacccgagctggct

SEQ ID NO: 900808 - DNA, 25 bp, Mus musculus
tgtcaacttgacaggttctacactt

SEQ ID NO: 900809 - DNA, 25 bp, Mus musculus
tgtcaacttgactcccgagctggct

SEQ ID NO: 900810 - DNA, 25 bp, Mus musculus
tgtcaacttgactggttctacactt

SEQ ID NO: 900811 - DNA, 25 bp, Mus musculus
tgtcaactttagaccttgacccctt

SEQ ID NO: 900812 - DNA, 25 bp, Mus musculus
tgtcaactttagtccttgacccctt

SEQ ID NO: 900813 - DNA, 25 bp, Mus musculus
tgtcaagaatgtcagctgtcagtca

SEQ ID NO: 900814 - DNA, 25 bp, Mus musculus
tgtcaagaatgtgagctgtcagtca

SEQ ID NO: 900815 - DNA, 25 bp, Mus musculus
tgtcaagacctccaaatacttccgt

SEQ ID NO: 900816 - DNA, 25 bp, Mus musculus
tgtcaagacctcgaaatacttccgt

SEQ ID NO: 900817 - DNA, 25 bp, Mus musculus
tgtcaagagctcctataggcgcatc

SEQ ID NO: 900818 - DNA, 25 bp, Mus musculus
tgtcaagagctcgtataggcgcatc

SEQ ID NO: 900819 - DNA, 25 bp, Mus musculus
tgtcaagatgtcctacgtgtcctaa

SEQ ID NO: 900820 - DNA, 25 bp, Mus musculus
tgtcaagatgtcgtacgtgtcctaa

SEQ ID NO: 900821 - DNA, 25 bp, Mus musculus
tgtcaagcacatcacttctttctga

SEQ ID NO: 900822 - DNA, 25 bp, Mus musculus
tgtcaagcacatgacttctttctga

SEQ ID NO: 900823 - DNA, 25 bp, Mus musculus
tgtcaagcacctctgaccagtctta

SEQ ID NO: 900824 - DNA, 25 bp, Mus musculus
tgtcaagcacctgtgaccagtctta

SEQ ID NO: 900825 - DNA, 25 bp, Mus musculus
tgtcaagcacgcacacagtcaatgc

SEQ ID NO: 900826 - DNA, 25 bp, Mus musculus
tgtcaagcacgctcacagtcaatgc

SEQ ID NO: 900827 - DNA, 25 bp, Mus musculus
tgtcaagcagcacctttgtggttcc

SEQ ID NO: 900828 - DNA, 25 bp, Mus musculus
tgtcaagcagcacttacctaccgtg

SEQ ID NO: 900829 - DNA, 25 bp, Mus musculus
tgtcaagcagcagctttgtggttcc

SEQ ID NO: 900830 - DNA, 25 bp, Mus musculus
tgtcaagcagcagttacctaccgtg

SEQ ID NO: 900831 - DNA, 25 bp, Mus musculus
tgtcaagcatttcttccaccagact

SEQ ID NO: 900832 - DNA, 25 bp, Mus musculus
tgtcaagcatttgttccaccagact

SEQ ID NO: 900833 - DNA, 25 bp, Mus musculus
tgtcaagccaacagggcacaactta

SEQ ID NO: 900834 - DNA, 25 bp, Mus musculus
tgtcaagccaactgggcacaactta

SEQ ID NO: 900835 - DNA, 25 bp, Mus musculus
tgtcaagccccacgtggtgattgat

SEQ ID NO: 900836 - DNA, 25 bp, Mus musculus
tgtcaagccccaggtggtgattgat

SEQ ID NO: 900837 - DNA, 25 bp, Mus musculus
tgtcaagcccgtaacctggaggaaa

SEQ ID NO: 900838 - DNA, 25 bp, Mus musculus
tgtcaagcccgttacctggaggaaa

SEQ ID NO: 900839 - DNA, 25 bp, Mus musculus
tgtcaaggacacactcaggcagaaa

SEQ ID NO: 900840 - DNA, 25 bp, Mus musculus
tgtcaaggacactctcaggcagaaa

SEQ ID NO: 900841 - DNA, 25 bp, Mus musculus
tgtcaaggacagataaagcccaccg

SEQ ID NO: 900842 - DNA, 25 bp, Mus musculus
tgtcaaggacagttaaagcccaccg

SEQ ID NO: 900843 - DNA, 25 bp, Mus musculus
tgtcaaggacccacgtcaagtctcg

SEQ ID NO: 900844 - DNA, 25 bp, Mus musculus
tgtcaaggaccctcgtcaagtctcg

SEQ ID NO: 900845 - DNA, 25 bp, Mus musculus
tgtcaaggccctacttaaagcaaag

SEQ ID NO: 900846 - DNA, 25 bp, Mus musculus
tgtcaaggcccttcttaaagcaaag

SEQ ID NO: 900847 - DNA, 25 bp, Mus musculus
tgtcaagggcacatggctctagggc

SEQ ID NO: 900848 - DNA, 25 bp, Mus musculus
tgtcaagggcacttggctctagggc

SEQ ID NO: 900849 - DNA, 25 bp, Mus musculus
tgtcaagggcctacatgtccacgtt

SEQ ID NO: 900850 - DNA, 25 bp, Mus musculus
tgtcaagggccttcatgtccacgtt

SEQ ID NO: 900851 - DNA, 25 bp, Mus musculus
tgtcaaggtcttaattaccacccac

SEQ ID NO: 900852 - DNA, 25 bp, Mus musculus
tgtcaaggtctttattaccacccac

SEQ ID NO: 900853 - DNA, 25 bp, Mus musculus
tgtcaaggttatccagggccccgag

SEQ ID NO: 900854 - DNA, 25 bp, Mus musculus
tgtcaaggttatgcagggccccgag

SEQ ID NO: 900855 - DNA, 25 bp, Mus musculus
tgtcaagtaccaaagcatccagaag

SEQ ID NO: 900856 - DNA, 25 bp, Mus musculus
tgtcaagtaccatagcatccagaag

SEQ ID NO: 900857 - DNA, 25 bp, Mus musculus
tgtcaagtacttagcccaggaggct

SEQ ID NO: 900858 - DNA, 25 bp, Mus musculus
tgtcaagtactttgcccaggaggct

SEQ ID NO: 900859 - DNA, 25 bp, Mus musculus
tgtcaagtcacaatccaggaaggaa

SEQ ID NO: 900860 - DNA, 25 bp, Mus musculus
tgtcaagtcacattccaggaaggaa

SEQ ID NO: 900861 - DNA, 25 bp, Mus musculus
tgtcaagttattagccattgtacct

SEQ ID NO: 900862 - DNA, 25 bp, Mus musculus
tgtcaagttatttgccattgtacct

SEQ ID NO: 900863 - DNA, 25 bp, Mus musculus
tgtcaataaacaccttcctgccttt

SEQ ID NO: 900864 - DNA, 25 bp, Mus musculus
tgtcaataaacagcttcctgccttt

SEQ ID NO: 900865 - DNA, 25 bp, Mus musculus
tgtcaataacaacacctccttttct

SEQ ID NO: 900866 - DNA, 25 bp, Mus musculus
tgtcaataacaagacctccttttct

SEQ ID NO: 900867 - DNA, 25 bp, Mus musculus
tgtcaataacaccagccagtagagt

SEQ ID NO: 900868 - DNA, 25 bp, Mus musculus
tgtcaataacacgagccagtagagt

SEQ ID NO: 900869 - DNA, 25 bp, Mus musculus
tgtcaatacaataccatgcatccct

SEQ ID NO: 900870 - DNA, 25 bp, Mus musculus
tgtcaatacaattccatgcatccct

SEQ ID NO: 900871 - DNA, 25 bp, Mus musculus
tgtcaatagctcctccatcaaaaac

SEQ ID NO: 900872 - DNA, 25 bp, Mus musculus
tgtcaatagctcgtccatcaaaaac

SEQ ID NO: 900873 - DNA, 25 bp, Mus musculus
tgtcaatatagtatccttccctagt

SEQ ID NO: 900874 - DNA, 25 bp, Mus musculus
tgtcaatatagtttccttccctagt

SEQ ID NO: 900875 - DNA, 25 bp, Mus musculus
tgtcaatatgatctggctcttccta

SEQ ID NO: 900876 - DNA, 25 bp, Mus musculus
tgtcaatatgatgtggctcttccta

SEQ ID NO: 900877 - DNA, 25 bp, Mus musculus
tgtcaatcccttctctggtattcat

SEQ ID NO: 900878 - DNA, 25 bp, Mus musculus
tgtcaatcccttgtctggtattcat

SEQ ID NO: 900879 - DNA, 25 bp, Mus musculus
tgtcaatccgtcagtctgttgttcc

SEQ ID NO: 900880 - DNA, 25 bp, Mus musculus
tgtcaatccgtctgtctgttgttcc

SEQ ID NO: 900881 - DNA, 25 bp, Mus musculus
tgtcaatcgtgtccatgatcttcgc

SEQ ID NO: 900882 - DNA, 25 bp, Mus musculus
tgtcaatcgtgtgcatgatcttcgc

SEQ ID NO: 900883 - DNA, 25 bp, Mus musculus
tgtcaatgaattagttcccctgtgt

SEQ ID NO: 900884 - DNA, 25 bp, Mus musculus
tgtcaatgaatttgttcccctgtgt

SEQ ID NO: 900885 - DNA, 25 bp, Mus musculus
tgtcaatgtcaactgcaaaggcctt

SEQ ID NO: 900886 - DNA, 25 bp, Mus musculus
tgtcaatgtcaagtgcaaaggcctt

SEQ ID NO: 900887 - DNA, 25 bp, Mus musculus
tgtcaatgtcacctaatgcagcaac

SEQ ID NO: 900888 - DNA, 25 bp, Mus musculus
tgtcaatgtcacgtaatgcagcaac

SEQ ID NO: 900889 - DNA, 25 bp, Mus musculus
tgtcaatgtctgacccctattcctt

SEQ ID NO: 900890 - DNA, 25 bp, Mus musculus
tgtcaatgtctgtcccctattcctt

SEQ ID NO: 900891 - DNA, 25 bp, Mus musculus
tgtcaatgtgcactttcctcatttc

SEQ ID NO: 900892 - DNA, 25 bp, Mus musculus
tgtcaatgtgcagtttcctcatttc

SEQ ID NO: 900893 - DNA, 25 bp, Mus musculus
tgtcaattacatcccttcttttaaa

SEQ ID NO: 900894 - DNA, 25 bp, Mus musculus
tgtcaattacatgccttcttttaaa

SEQ ID NO: 900895 - DNA, 25 bp, Mus musculus
tgtcaattccaacttcctgttgtct

SEQ ID NO: 900896 - DNA, 25 bp, Mus musculus
tgtcaattccaagttcctgttgtct

SEQ ID NO: 900897 - DNA, 25 bp, Mus musculus
tgtcaattcttgagtgtcctttcct

SEQ ID NO: 900898 - DNA, 25 bp, Mus musculus
tgtcaattcttgtgtgtcctttcct

SEQ ID NO: 900899 - DNA, 25 bp, Mus musculus
tgtcaattgcctatgtctttactcc

SEQ ID NO: 900900 - DNA, 25 bp, Mus musculus
tgtcaattgcctttgtctttactcc

SEQ ID NO: 900901 - DNA, 25 bp, Mus musculus
tgtcacaaatcacacacgcgatctg

SEQ ID NO: 900902 - DNA, 25 bp, Mus musculus
tgtcacaaatcagacacgcgatctg

SEQ ID NO: 900903 - DNA, 25 bp, Mus musculus
tgtcacacacatcggaagtgcctga

SEQ ID NO: 900904 - DNA, 25 bp, Mus musculus
tgtcacacacatgggaagtgcctga

SEQ ID NO: 900905 - DNA, 25 bp, Mus musculus
tgtcacacacgaacctcactgagaa

SEQ ID NO: 900906 - DNA, 25 bp, Mus musculus
tgtcacacacgatcctcactgagaa

SEQ ID NO: 900907 - DNA, 25 bp, Mus musculus
tgtcacacactactgttaactctgt

SEQ ID NO: 900908 - DNA, 25 bp, Mus musculus
tgtcacacactagtgttaactctgt

SEQ ID NO: 900909 - DNA, 25 bp, Mus musculus
tgtcacacagaacatcagtgcagag

SEQ ID NO: 900910 - DNA, 25 bp, Mus musculus
tgtcacacagaagatcagtgcagag

SEQ ID NO: 900911 - DNA, 25 bp, Mus musculus
tgtcacacagcccctagggacctta

SEQ ID NO: 900912 - DNA, 25 bp, Mus musculus
tgtcacacagccgctagggacctta

SEQ ID NO: 900913 - DNA, 25 bp, Mus musculus
tgtcacacatagcaccgcagataaa

SEQ ID NO: 900914 - DNA, 25 bp, Mus musculus
tgtcacacataggaccgcagataaa

SEQ ID NO: 900915 - DNA, 25 bp, Mus musculus
tgtcacaccagtcccaatagaatct

SEQ ID NO: 900916 - DNA, 25 bp, Mus musculus
tgtcacaccagtgccaatagaatct

SEQ ID NO: 900917 - DNA, 25 bp, Mus musculus
tgtcacacctttacgcatgcgaaag

SEQ ID NO: 900918 - DNA, 25 bp, Mus musculus
tgtcacaccttttcgcatgcgaaag

SEQ ID NO: 900919 - DNA, 25 bp, Mus musculus
tgtcacacgatcaggaacagcttat

SEQ ID NO: 900920 - DNA, 25 bp, Mus musculus
tgtcacacgatctggaacagcttat

SEQ ID NO: 900921 - DNA, 25 bp, Mus musculus
tgtcacacggcacctgttgcacaac

SEQ ID NO: 900922 - DNA, 25 bp, Mus musculus
tgtcacacggcagctgttgcacaac

SEQ ID NO: 900923 - DNA, 25 bp, Mus musculus
tgtcacactagaaatgcaaaccatt

SEQ ID NO: 900924 - DNA, 25 bp, Mus musculus
tgtcacactagatatgcaaaccatt

SEQ ID NO: 900925 - DNA, 25 bp, Mus musculus
tgtcacactctcacttcaaaaggca

SEQ ID NO: 900926 - DNA, 25 bp, Mus musculus
tgtcacactctctcttcaaaaggca

SEQ ID NO: 900927 - DNA, 25 bp, Mus musculus
tgtcacactgaccttgctatatttg

SEQ ID NO: 900928 - DNA, 25 bp, Mus musculus
tgtcacactgacgttgctatatttg

SEQ ID NO: 900929 - DNA, 25 bp, Mus musculus
tgtcacactgatagacatcccacac

SEQ ID NO: 900930 - DNA, 25 bp, Mus musculus
tgtcacactgattgacatcccacac

SEQ ID NO: 900931 - DNA, 25 bp, Mus musculus
tgtcacactgcacagtttatgatac

SEQ ID NO: 900932 - DNA, 25 bp, Mus musculus
tgtcacactgcagagtttatgatac

SEQ ID NO: 900933 - DNA, 25 bp, Mus musculus
tgtcacactgccatgttcttcaaac

SEQ ID NO: 900934 - DNA, 25 bp, Mus musculus
tgtcacactgccttgttcttcaaac

SEQ ID NO: 900935 - DNA, 25 bp, Mus musculus
tgtcacactggtacaatggctctca

SEQ ID NO: 900936 - DNA, 25 bp, Mus musculus
tgtcacactggttcaatggctctca

SEQ ID NO: 900937 - DNA, 25 bp, Mus musculus
tgtcacagacagatactcagagctt

SEQ ID NO: 900938 - DNA, 25 bp, Mus musculus
tgtcacagacagcacagctggacca

SEQ ID NO: 900939 - DNA, 25 bp, Mus musculus
tgtcacagacaggacagctggacca

SEQ ID NO: 900940 - DNA, 25 bp, Mus musculus
tgtcacagacagttactcagagctt

SEQ ID NO: 900941 - DNA, 25 bp, Mus musculus
tgtcacagagcaagcctgcaaactg

SEQ ID NO: 900942 - DNA, 25 bp, Mus musculus
tgtcacagagcatgcctgcaaactg

SEQ ID NO: 900943 - DNA, 25 bp, Mus musculus
tgtcacagaggaccgggttctttct

SEQ ID NO: 900944 - DNA, 25 bp, Mus musculus
tgtcacagaggagcgggttctttct

SEQ ID NO: 900945 - DNA, 25 bp, Mus musculus
tgtcacagagtcatgctaccccaaa

SEQ ID NO: 900946 - DNA, 25 bp, Mus musculus
tgtcacagagtcttgctaccccaaa

SEQ ID NO: 900947 - DNA, 25 bp, Mus musculus
tgtcacagatgcatggctccagctc

SEQ ID NO: 900948 - DNA, 25 bp, Mus musculus
tgtcacagatgcttggctccagctc

SEQ ID NO: 900949 - DNA, 25 bp, Mus musculus
tgtcacagatggatttgcagggagc

SEQ ID NO: 900950 - DNA, 25 bp, Mus musculus
tgtcacagatggttttgcagggagc

SEQ ID NO: 900951 - DNA, 25 bp, Mus musculus
tgtcacagcccactcctcagtgaga

SEQ ID NO: 900952 - DNA, 25 bp, Mus musculus
tgtcacagcccagtcctcagtgaga

SEQ ID NO: 900953 - DNA, 25 bp, Mus musculus
tgtcacagcccgacgtgaatgatgt

SEQ ID NO: 900954 - DNA, 25 bp, Mus musculus
tgtcacagcccgtcgtgaatgatgt

SEQ ID NO: 900955 - DNA, 25 bp, Mus musculus
tgtcacagcgcccaggcagtggaaa

SEQ ID NO: 900956 - DNA, 25 bp, Mus musculus
tgtcacagcgccgaggcagtggaaa

SEQ ID NO: 900957 - DNA, 25 bp, Mus musculus
tgtcacagctaaccttttgccccat

SEQ ID NO: 900958 - DNA, 25 bp, Mus musculus
tgtcacagctaagcttttgccccat

SEQ ID NO: 900959 - DNA, 25 bp, Mus musculus
tgtcacagctcacagtatggtcgga

SEQ ID NO: 900960 - DNA, 25 bp, Mus musculus
tgtcacagctcagagtatggtcgga

SEQ ID NO: 900961 - DNA, 25 bp, Mus musculus
tgtcacaggacacgctaatgggttt

SEQ ID NO: 900962 - DNA, 25 bp, Mus musculus
tgtcacaggacaggctaatgggttt

SEQ ID NO: 900963 - DNA, 25 bp, Mus musculus
tgtcacaggatgagtttgcaaacct

SEQ ID NO: 900964 - DNA, 25 bp, Mus musculus
tgtcacaggatgtgtttgcaaacct

SEQ ID NO: 900965 - DNA, 25 bp, Mus musculus
tgtcacaggcctctagccccagtat

SEQ ID NO: 900966 - DNA, 25 bp, Mus musculus
tgtcacaggcctgtagccccagtat

SEQ ID NO: 900967 - DNA, 25 bp, Mus musculus
tgtcacaggtcaaccagaactcatg

SEQ ID NO: 900968 - DNA, 25 bp, Mus musculus
tgtcacaggtcatccagaactcatg

SEQ ID NO: 900969 - DNA, 25 bp, Mus musculus
tgtcacaggtgaagcccattgagag

SEQ ID NO: 900970 - DNA, 25 bp, Mus musculus
tgtcacaggtgatgcccattgagag

SEQ ID NO: 900971 - DNA, 25 bp, Mus musculus
tgtcacagtgcacaacttccaacct

SEQ ID NO: 900972 - DNA, 25 bp, Mus musculus
tgtcacagtgcagaacttccaacct

SEQ ID NO: 900973 - DNA, 25 bp, Mus musculus
tgtcacagttacctggagaggctcc

SEQ ID NO: 900974 - DNA, 25 bp, Mus musculus
tgtcacagttacgtggagaggctcc

SEQ ID NO: 900975 - DNA, 25 bp, Mus musculus
tgtcacatacatatttactcttaaa

SEQ ID NO: 900976 - DNA, 25 bp, Mus musculus
tgtcacatacatttttactcttaaa

SEQ ID NO: 900977 - DNA, 25 bp, Mus musculus
tgtcacatctctcctctcaaatgca

SEQ ID NO: 900978 - DNA, 25 bp, Mus musculus
tgtcacatctctgctctcaaatgca

SEQ ID NO: 900979 - DNA, 25 bp, Mus musculus
tgtcacatgcacacagtcttctgga

SEQ ID NO: 900980 - DNA, 25 bp, Mus musculus
tgtcacatgcactcagtcttctgga

SEQ ID NO: 900981 - DNA, 25 bp, Mus musculus
tgtcacatgcatccctgacacagga

SEQ ID NO: 900982 - DNA, 25 bp, Mus musculus
tgtcacatgcatgcctgacacagga

SEQ ID NO: 900983 - DNA, 25 bp, Mus musculus
tgtcacatggccctctagtggaagg

SEQ ID NO: 900984 - DNA, 25 bp, Mus musculus
tgtcacatggccgtctagtggaagg

SEQ ID NO: 900985 - DNA, 25 bp, Mus musculus
tgtcacattctcagacagggacacc

SEQ ID NO: 900986 - DNA, 25 bp, Mus musculus
tgtcacattctctgacagggacacc

SEQ ID NO: 900987 - DNA, 25 bp, Mus musculus
tgtcacattgacagatgccatgaag

SEQ ID NO: 900988 - DNA, 25 bp, Mus musculus
tgtcacattgactgatgccatgaag

SEQ ID NO: 900989 - DNA, 25 bp, Mus musculus
tgtcacatttcacacaggttaatga

SEQ ID NO: 900990 - DNA, 25 bp, Mus musculus
tgtcacatttcagacaggttaatga

SEQ ID NO: 900991 - DNA, 25 bp, Mus musculus
tgtcaccaaagtctaccgtgtcctt

SEQ ID NO: 900992 - DNA, 25 bp, Mus musculus
tgtcaccaaagtgtaccgtgtcctt

SEQ ID NO: 900993 - DNA, 25 bp, Mus musculus
tgtcaccaacctacagagtcactaa

SEQ ID NO: 900994 - DNA, 25 bp, Mus musculus
tgtcaccaaccttcagagtcactaa

SEQ ID NO: 900995 - DNA, 25 bp, Mus musculus
tgtcaccaaggtcgctcctagtgag

SEQ ID NO: 900996 - DNA, 25 bp, Mus musculus
tgtcaccaaggtggctcctagtgag

SEQ ID NO: 900997 - DNA, 25 bp, Mus musculus
tgtcaccaagtaatagagtaggaaa

SEQ ID NO: 900998 - DNA, 25 bp, Mus musculus
tgtcaccaagtattagagtaggaaa

SEQ ID NO: 900999 - DNA, 25 bp, Mus musculus
tgtcaccaagttagacagacccctt

SEQ ID NO: 901000 - DNA, 25 bp, Mus musculus
tgtcaccaagtttgacagacccctt

SEQ ID NO: 901001 - DNA, 25 bp, Mus musculus
tgtcaccacaatcactccaaagaaa

SEQ ID NO: 901002 - DNA, 25 bp, Mus musculus
tgtcaccacaatgactccaaagaaa

SEQ ID NO: 901003 - DNA, 25 bp, Mus musculus
tgtcaccacctacatcagggagcga

SEQ ID NO: 901004 - DNA, 25 bp, Mus musculus
tgtcaccacctagatcagggagcga

SEQ ID NO: 901005 - DNA, 25 bp, Mus musculus
tgtcaccactgtcatctgtggtgga

SEQ ID NO: 901006 - DNA, 25 bp, Mus musculus
tgtcaccactgtgatctgtggtgga

SEQ ID NO: 901007 - DNA, 25 bp, Mus musculus
tgtcaccacttaaacctgtctttgg

SEQ ID NO: 901008 - DNA, 25 bp, Mus musculus
tgtcaccacttatacctgtctttgg

SEQ ID NO: 901009 - DNA, 25 bp, Mus musculus
tgtcaccagagtaccctccagagtg

SEQ ID NO: 901010 - DNA, 25 bp, Mus musculus
tgtcaccagagttccctccagagtg

SEQ ID NO: 901011 - DNA, 25 bp, Mus musculus
tgtcaccagcacaacgggcgtcata

SEQ ID NO: 901012 - DNA, 25 bp, Mus musculus
tgtcaccagcactacgggcgtcata

SEQ ID NO: 901013 - DNA, 25 bp, Mus musculus
tgtcaccaggcccttcagagttgga

SEQ ID NO: 901014 - DNA, 25 bp, Mus musculus
tgtcaccaggccgttcagagttgga

SEQ ID NO: 901015 - DNA, 25 bp, Mus musculus
tgtcaccagtgacctcaaatgatta

SEQ ID NO: 901016 - DNA, 25 bp, Mus musculus
tgtcaccagtgagctcaaatgatta

SEQ ID NO: 901017 - DNA, 25 bp, Mus musculus
tgtcaccatcctaaccaagtactta

SEQ ID NO: 901018 - DNA, 25 bp, Mus musculus
tgtcaccatccttaccaagtactta

SEQ ID NO: 901019 - DNA, 25 bp, Mus musculus
tgtcaccatgtgagagcaccggagt

SEQ ID NO: 901020 - DNA, 25 bp, Mus musculus
tgtcaccatgtgtgagcaccggagt

SEQ ID NO: 901021 - DNA, 25 bp, Mus musculus
tgtcacccagatccagcatgccagt

SEQ ID NO: 901022 - DNA, 25 bp, Mus musculus
tgtcacccagatgcagcatgccagt

SEQ ID NO: 901023 - DNA, 25 bp, Mus musculus
tgtcacccaggcacatggaaactgt

SEQ ID NO: 901024 - DNA, 25 bp, Mus musculus
tgtcacccaggctcatggaaactgt

SEQ ID NO: 901025 - DNA, 25 bp, Mus musculus
tgtcacccagtcctctgaactcaga

SEQ ID NO: 901026 - DNA, 25 bp, Mus musculus
tgtcacccagtcgtctgaactcaga

SEQ ID NO: 901027 - DNA, 25 bp, Mus musculus
tgtcacccagttctcatgtcttttg

SEQ ID NO: 901028 - DNA, 25 bp, Mus musculus
tgtcacccagttgtcatgtcttttg

SEQ ID NO: 901029 - DNA, 25 bp, Mus musculus
tgtcacccctcaaatacaacttttt

SEQ ID NO: 901030 - DNA, 25 bp, Mus musculus
tgtcacccctcatatacaacttttt

SEQ ID NO: 901031 - DNA, 25 bp, Mus musculus
tgtcacccctcgataaagaaagtat

SEQ ID NO: 901032 - DNA, 25 bp, Mus musculus
tgtcacccctcgttaaagaaagtat

SEQ ID NO: 901033 - DNA, 25 bp, Mus musculus
tgtcaccccttgattactcattggt

SEQ ID NO: 901034 - DNA, 25 bp, Mus musculus
tgtcaccccttgtttactcattggt

SEQ ID NO: 901035 - DNA, 25 bp, Mus musculus
tgtcacccctttaaaatcgccaaat

SEQ ID NO: 901036 - DNA, 25 bp, Mus musculus
tgtcaccccttttaaatcgccaaat

SEQ ID NO: 901037 - DNA, 25 bp, Mus musculus
tgtcacccgtctaatagctgctggc

SEQ ID NO: 901038 - DNA, 25 bp, Mus musculus
tgtcacccgtcttatagctgctggc

SEQ ID NO: 901039 - DNA, 25 bp, Mus musculus
tgtcaccctgctcaacacaatttat

SEQ ID NO: 901040 - DNA, 25 bp, Mus musculus
tgtcaccctgctgaacacaatttat

SEQ ID NO: 901041 - DNA, 25 bp, Mus musculus
tgtcaccgagagatagaaaatcttt

SEQ ID NO: 901042 - DNA, 25 bp, Mus musculus
tgtcaccgagagttagaaaatcttt

SEQ ID NO: 901043 - DNA, 25 bp, Mus musculus
tgtcaccgcacaacaaatttttata

SEQ ID NO: 901044 - DNA, 25 bp, Mus musculus
tgtcaccgcacatcaaatttttata

SEQ ID NO: 901045 - DNA, 25 bp, Mus musculus
tgtcaccggctcagctactgttaca

SEQ ID NO: 901046 - DNA, 25 bp, Mus musculus
tgtcaccggctctgctactgttaca

SEQ ID NO: 901047 - DNA, 25 bp, Mus musculus
tgtcaccgttaacttccgcagaggt

SEQ ID NO: 901048 - DNA, 25 bp, Mus musculus
tgtcaccgttaagttccgcagaggt

SEQ ID NO: 901049 - DNA, 25 bp, Mus musculus
tgtcacctacaaacctagttccagg

SEQ ID NO: 901050 - DNA, 25 bp, Mus musculus
tgtcacctacaatcctagttccagg

SEQ ID NO: 901051 - DNA, 25 bp, Mus musculus
tgtcacctagacatttcctctttgg

SEQ ID NO: 901052 - DNA, 25 bp, Mus musculus
tgtcacctagacttttcctctttgg

SEQ ID NO: 901053 - DNA, 25 bp, Mus musculus
tgtcacctccccagatgaaatcagt

SEQ ID NO: 901054 - DNA, 25 bp, Mus musculus
tgtcacctcccctgatgaaatcagt

SEQ ID NO: 901055 - DNA, 25 bp, Mus musculus
tgtcacctccgcagtcatgtctgta

SEQ ID NO: 901056 - DNA, 25 bp, Mus musculus
tgtcacctccgctgtcatgtctgta

SEQ ID NO: 901057 - DNA, 25 bp, Mus musculus
tgtcacctcctgattgcggaagaaa

SEQ ID NO: 901058 - DNA, 25 bp, Mus musculus
tgtcacctcctgtttgcggaagaaa

SEQ ID NO: 901059 - DNA, 25 bp, Mus musculus
tgtcacctctctcgatggttgctag

SEQ ID NO: 901060 - DNA, 25 bp, Mus musculus
tgtcacctctctggatggttgctag

SEQ ID NO: 901061 - DNA, 25 bp, Mus musculus
tgtcacctctggcacttgagcaagc

SEQ ID NO: 901062 - DNA, 25 bp, Mus musculus
tgtcacctctgggacttgagcaagc

SEQ ID NO: 901063 - DNA, 25 bp, Mus musculus
tgtcacctgtctaagcttttccaag

SEQ ID NO: 901064 - DNA, 25 bp, Mus musculus
tgtcacctgtcttagcttttccaag

SEQ ID NO: 901065 - DNA, 25 bp, Mus musculus
tgtcacctgtgcatggagcgggaat

SEQ ID NO: 901066 - DNA, 25 bp, Mus musculus
tgtcacctgtgcttggagcgggaat

SEQ ID NO: 901067 - DNA, 25 bp, Mus musculus
tgtcaccttcacaacatctggaatt

SEQ ID NO: 901068 - DNA, 25 bp, Mus musculus
tgtcaccttcactacatctggaatt

SEQ ID NO: 901069 - DNA, 25 bp, Mus musculus
tgtcaccttcttactgtcaacctac

SEQ ID NO: 901070 - DNA, 25 bp, Mus musculus
tgtcaccttctttctgtcaacctac

SEQ ID NO: 901071 - DNA, 25 bp, Mus musculus
tgtcaccttgctagcccaataataa

SEQ ID NO: 901072 - DNA, 25 bp, Mus musculus
tgtcaccttgcttgcccaataataa

SEQ ID NO: 901073 - DNA, 25 bp, Mus musculus
tgtcacctttctacaagtgtcctgt

SEQ ID NO: 901074 - DNA, 25 bp, Mus musculus
tgtcacctttcttcaagtgtcctgt

SEQ ID NO: 901075 - DNA, 25 bp, Mus musculus
tgtcacctttgaatgcatggaaact

SEQ ID NO: 901076 - DNA, 25 bp, Mus musculus
tgtcacctttgattgcatggaaact

SEQ ID NO: 901077 - DNA, 25 bp, Mus musculus
tgtcacgccagtctctatgtcagag

SEQ ID NO: 901078 - DNA, 25 bp, Mus musculus
tgtcacgccagtgtctatgtcagag

SEQ ID NO: 901079 - DNA, 25 bp, Mus musculus
tgtcacggaatcattccctgcagaa

SEQ ID NO: 901080 - DNA, 25 bp, Mus musculus
tgtcacggaatctttccctgcagaa

SEQ ID NO: 901081 - DNA, 25 bp, Mus musculus
tgtcacggcgagaggagctccttaa

SEQ ID NO: 901082 - DNA, 25 bp, Mus musculus
tgtcacggcgagtggagctccttaa

SEQ ID NO: 901083 - DNA, 25 bp, Mus musculus
tgtcacggctgacggatcattccag

SEQ ID NO: 901084 - DNA, 25 bp, Mus musculus
tgtcacggctgagggatcattccag

SEQ ID NO: 901085 - DNA, 25 bp, Mus musculus
tgtcacgtgaccaggtggaacactt

SEQ ID NO: 901086 - DNA, 25 bp, Mus musculus
tgtcacgtgacctggtggaacactt

SEQ ID NO: 901087 - DNA, 25 bp, Mus musculus
tgtcacgtgccaacatctggtgtca

SEQ ID NO: 901088 - DNA, 25 bp, Mus musculus
tgtcacgtgccatcatctggtgtca

SEQ ID NO: 901089 - DNA, 25 bp, Mus musculus
tgtcacgtgcgtctgatagccttgc

SEQ ID NO: 901090 - DNA, 25 bp, Mus musculus
tgtcacgtgcgtgtgatagccttgc

SEQ ID NO: 901091 - DNA, 25 bp, Mus musculus
tgtcacgttgagctcacaaccttcc

SEQ ID NO: 901092 - DNA, 25 bp, Mus musculus
tgtcacgttgaggtcacaaccttcc

SEQ ID NO: 901093 - DNA, 25 bp, Mus musculus
tgtcacgtttggatcaattttttat

SEQ ID NO: 901094 - DNA, 25 bp, Mus musculus
tgtcacgtttggttcaattttttat

SEQ ID NO: 901095 - DNA, 25 bp, Mus musculus
tgtcactaaataaacccctgctggt

SEQ ID NO: 901096 - DNA, 25 bp, Mus musculus
tgtcactaaatatacccctgctggt

SEQ ID NO: 901097 - DNA, 25 bp, Mus musculus
tgtcactacagcagatacataccca

SEQ ID NO: 901098 - DNA, 25 bp, Mus musculus
tgtcactacagctgatacataccca

SEQ ID NO: 901099 - DNA, 25 bp, Mus musculus
tgtcactatgccactctgtttgata

SEQ ID NO: 901100 - DNA, 25 bp, Mus musculus
tgtcactatgcctctctgtttgata

SEQ ID NO: 901101 - DNA, 25 bp, Mus musculus
tgtcactatgtcacagtacacctct

SEQ ID NO: 901102 - DNA, 25 bp, Mus musculus
tgtcactatgtctcagtacacctct

SEQ ID NO: 901103 - DNA, 25 bp, Mus musculus
tgtcactcagaacactgtcccgagt

SEQ ID NO: 901104 - DNA, 25 bp, Mus musculus
tgtcactcagaagactgtcccgagt

SEQ ID NO: 901105 - DNA, 25 bp, Mus musculus
tgtcactccaagcagtttgtctggg

SEQ ID NO: 901106 - DNA, 25 bp, Mus musculus
tgtcactccaaggagtttgtctggg

SEQ ID NO: 901107 - DNA, 25 bp, Mus musculus
tgtcactccagcatctcagaataga

SEQ ID NO: 901108 - DNA, 25 bp, Mus musculus
tgtcactccagcttctcagaataga

SEQ ID NO: 901109 - DNA, 25 bp, Mus musculus
tgtcactccagtcactaccaaagac

SEQ ID NO: 901110 - DNA, 25 bp, Mus musculus
tgtcactccagtgactaccaaagac

SEQ ID NO: 901111 - DNA, 25 bp, Mus musculus
tgtcactctagaccatgacgtcagc

SEQ ID NO: 901112 - DNA, 25 bp, Mus musculus
tgtcactctagagcatgacgtcagc

SEQ ID NO: 901113 - DNA, 25 bp, Mus musculus
tgtcactctggcccttagctgatgg

SEQ ID NO: 901114 - DNA, 25 bp, Mus musculus
tgtcactctggcgcttagctgatgg

SEQ ID NO: 901115 - DNA, 25 bp, Mus musculus
tgtcactcttccatctgcatagaac

SEQ ID NO: 901116 - DNA, 25 bp, Mus musculus
tgtcactcttccttctgcatagaac

SEQ ID NO: 901117 - DNA, 25 bp, Mus musculus
tgtcactcttctccgatgatggaga

SEQ ID NO: 901118 - DNA, 25 bp, Mus musculus
tgtcactcttctgcgatgatggaga

SEQ ID NO: 901119 - DNA, 25 bp, Mus musculus
tgtcactgacagactggcttgtcaa

SEQ ID NO: 901120 - DNA, 25 bp, Mus musculus
tgtcactgacagtctggcttgtcaa

SEQ ID NO: 901121 - DNA, 25 bp, Mus musculus
tgtcactgaggaaaacctaaagcca

SEQ ID NO: 901122 - DNA, 25 bp, Mus musculus
tgtcactgaggataacctaaagcca

SEQ ID NO: 901123 - DNA, 25 bp, Mus musculus
tgtcactgatctacagcgttcctat

SEQ ID NO: 901124 - DNA, 25 bp, Mus musculus
tgtcactgatcttcagcgttcctat

SEQ ID NO: 901125 - DNA, 25 bp, Mus musculus
tgtcactgccaaatggcccacattt

SEQ ID NO: 901126 - DNA, 25 bp, Mus musculus
tgtcactgccaattggcccacattt

SEQ ID NO: 901127 - DNA, 25 bp, Mus musculus
tgtcactgctgtatattcttaattg

SEQ ID NO: 901128 - DNA, 25 bp, Mus musculus
tgtcactgctgtttattcttaattg

SEQ ID NO: 901129 - DNA, 25 bp, Mus musculus
tgtcactggagcacgggtaggcttt

SEQ ID NO: 901130 - DNA, 25 bp, Mus musculus
tgtcactggagctcgggtaggcttt

SEQ ID NO: 901131 - DNA, 25 bp, Mus musculus
tgtcactggcagacacatgcacctg

SEQ ID NO: 901132 - DNA, 25 bp, Mus musculus
tgtcactggcagtcacatgcacctg

SEQ ID NO: 901133 - DNA, 25 bp, Mus musculus
tgtcactggctaagcagagccctga

SEQ ID NO: 901134 - DNA, 25 bp, Mus musculus
tgtcactggctatgcagagccctga

SEQ ID NO: 901135 - DNA, 25 bp, Mus musculus
tgtcactgggttctcccctacagag

SEQ ID NO: 901136 - DNA, 25 bp, Mus musculus
tgtcactgggttgtcccctacagag

SEQ ID NO: 901137 - DNA, 25 bp, Mus musculus
tgtcactggtggaactttaacccct

SEQ ID NO: 901138 - DNA, 25 bp, Mus musculus
tgtcactggtggtactttaacccct

SEQ ID NO: 901139 - DNA, 25 bp, Mus musculus
tgtcactgtcttcatccccaaataa

SEQ ID NO: 901140 - DNA, 25 bp, Mus musculus
tgtcactgtcttgatccccaaataa

SEQ ID NO: 901141 - DNA, 25 bp, Mus musculus
tgtcacttacacacagtcttctatg

SEQ ID NO: 901142 - DNA, 25 bp, Mus musculus
tgtcacttacactcagtcttctatg

SEQ ID NO: 901143 - DNA, 25 bp, Mus musculus
tgtcacttacgcagatcagggttcc

SEQ ID NO: 901144 - DNA, 25 bp, Mus musculus
tgtcacttacgctgatcagggttcc

SEQ ID NO: 901145 - DNA, 25 bp, Mus musculus
tgtcacttacttcctatcttaggga

SEQ ID NO: 901146 - DNA, 25 bp, Mus musculus
tgtcacttacttgctatcttaggga

SEQ ID NO: 901147 - DNA, 25 bp, Mus musculus
tgtcacttaggtacagtcatcctgt

SEQ ID NO: 901148 - DNA, 25 bp, Mus musculus
tgtcacttaggttcagtcatcctgt

SEQ ID NO: 901149 - DNA, 25 bp, Mus musculus
tgtcacttatctcacttagctcctc

SEQ ID NO: 901150 - DNA, 25 bp, Mus musculus
tgtcacttatctgacttagctcctc

SEQ ID NO: 901151 - DNA, 25 bp, Mus musculus
tgtcacttatggacactttcatcat

SEQ ID NO: 901152 - DNA, 25 bp, Mus musculus
tgtcacttatggtcactttcatcat

SEQ ID NO: 901153 - DNA, 25 bp, Mus musculus
tgtcacttcaagatgttttactcga

SEQ ID NO: 901154 - DNA, 25 bp, Mus musculus
tgtcacttcaagttgttttactcga

SEQ ID NO: 901155 - DNA, 25 bp, Mus musculus
tgtcacttggccctgacaaatcagg

SEQ ID NO: 901156 - DNA, 25 bp, Mus musculus
tgtcacttggccgtgacaaatcagg

SEQ ID NO: 901157 - DNA, 25 bp, Mus musculus
tgtcacttggctattcaccagtgtg

SEQ ID NO: 901158 - DNA, 25 bp, Mus musculus
tgtcacttggcttttcaccagtgtg

SEQ ID NO: 901159 - DNA, 25 bp, Mus musculus
tgtcactttgcaacttctccgagga

SEQ ID NO: 901160 - DNA, 25 bp, Mus musculus
tgtcactttgcatcttctccgagga

SEQ ID NO: 901161 - DNA, 25 bp, Mus musculus
tgtcactttgtgcattaggtctatg

SEQ ID NO: 901162 - DNA, 25 bp, Mus musculus
tgtcactttgtgctgttcgaaggtt

SEQ ID NO: 901163 - DNA, 25 bp, Mus musculus
tgtcactttgtggattaggtctatg

SEQ ID NO: 901164 - DNA, 25 bp, Mus musculus
tgtcactttgtggtgttcgaaggtt

SEQ ID NO: 901165 - DNA, 25 bp, Mus musculus
tgtcacttttgcaagtacacaggca

SEQ ID NO: 901166 - DNA, 25 bp, Mus musculus
tgtcacttttgctagtacacaggca

SEQ ID NO: 901167 - DNA, 25 bp, Mus musculus
tgtcacttttggcaatattctctaa

SEQ ID NO: 901168 - DNA, 25 bp, Mus musculus
tgtcacttttgggaatattctctaa

SEQ ID NO: 901169 - DNA, 25 bp, Mus musculus
tgtcagaacccacgcacattagtta

SEQ ID NO: 901170 - DNA, 25 bp, Mus musculus
tgtcagaacccaggcacattagtta

SEQ ID NO: 901171 - DNA, 25 bp, Mus musculus
tgtcagaagtctcttctaccccatt

SEQ ID NO: 901172 - DNA, 25 bp, Mus musculus
tgtcagaagtctgttctaccccatt

SEQ ID NO: 901173 - DNA, 25 bp, Mus musculus
tgtcagaattctcccatggtcaatc

SEQ ID NO: 901174 - DNA, 25 bp, Mus musculus
tgtcagaattctgccatggtcaatc

SEQ ID NO: 901175 - DNA, 25 bp, Mus musculus
tgtcagacagtaaacagctttgtat

SEQ ID NO: 901176 - DNA, 25 bp, Mus musculus
tgtcagacagtatacagctttgtat

SEQ ID NO: 901177 - DNA, 25 bp, Mus musculus
tgtcagaccagaacatcggaaggat

SEQ ID NO: 901178 - DNA, 25 bp, Mus musculus
tgtcagaccagatcatcggaaggat

SEQ ID NO: 901179 - DNA, 25 bp, Mus musculus
tgtcagactcacagcacaaactatg

SEQ ID NO: 901180 - DNA, 25 bp, Mus musculus
tgtcagactcactgcacaaactatg

SEQ ID NO: 901181 - DNA, 25 bp, Mus musculus
tgtcagacttaaaggcctatcgaat

SEQ ID NO: 901182 - DNA, 25 bp, Mus musculus
tgtcagacttaatggcctatcgaat

SEQ ID NO: 901183 - DNA, 25 bp, Mus musculus
tgtcagagaatgacgccctgtggga

SEQ ID NO: 901184 - DNA, 25 bp, Mus musculus
tgtcagagaatgtcgccctgtggga

SEQ ID NO: 901185 - DNA, 25 bp, Mus musculus
tgtcagagagccatccacacagttg

SEQ ID NO: 901186 - DNA, 25 bp, Mus musculus
tgtcagagagccttccacacagttg

SEQ ID NO: 901187 - DNA, 25 bp, Mus musculus
tgtcagagagctacagtgatgccaa

SEQ ID NO: 901188 - DNA, 25 bp, Mus musculus
tgtcagagagcttcagtgatgccaa

SEQ ID NO: 901189 - DNA, 25 bp, Mus musculus
tgtcagagatcaataagggtgccct

SEQ ID NO: 901190 - DNA, 25 bp, Mus musculus
tgtcagagatcacagacgattgtct

SEQ ID NO: 901191 - DNA, 25 bp, Mus musculus
tgtcagagatcagagacgattgtct

SEQ ID NO: 901192 - DNA, 25 bp, Mus musculus
tgtcagagatcattaagggtgccct

SEQ ID NO: 901193 - DNA, 25 bp, Mus musculus
tgtcagagatccacagtgcaggtct

SEQ ID NO: 901194 - DNA, 25 bp, Mus musculus
tgtcagagatcctcagtgcaggtct

SEQ ID NO: 901195 - DNA, 25 bp, Mus musculus
tgtcagagcctcaccaaaaagtaaa

SEQ ID NO: 901196 - DNA, 25 bp, Mus musculus
tgtcagagcctctccaaaaagtaaa

SEQ ID NO: 901197 - DNA, 25 bp, Mus musculus
tgtcagaggacccagagttctccat

SEQ ID NO: 901198 - DNA, 25 bp, Mus musculus
tgtcagaggaccgagagttctccat

SEQ ID NO: 901199 - DNA, 25 bp, Mus musculus
tgtcagaggagtagccagtcccttc

SEQ ID NO: 901200 - DNA, 25 bp, Mus musculus
tgtcagaggagttgccagtcccttc

SEQ ID NO: 901201 - DNA, 25 bp, Mus musculus
tgtcagaggcaacgctcacattcct

SEQ ID NO: 901202 - DNA, 25 bp, Mus musculus
tgtcagaggcaaggctcacattcct

SEQ ID NO: 901203 - DNA, 25 bp, Mus musculus
tgtcagaggcacatgccaacattta

SEQ ID NO: 901204 - DNA, 25 bp, Mus musculus
tgtcagaggcacttgccaacattta

SEQ ID NO: 901205 - DNA, 25 bp, Mus musculus
tgtcagatggctatgtggcccactt

SEQ ID NO: 901206 - DNA, 25 bp, Mus musculus
tgtcagatggctttgtggcccactt

SEQ ID NO: 901207 - DNA, 25 bp, Mus musculus
tgtcagatgtacacaacttccttaa

SEQ ID NO: 901208 - DNA, 25 bp, Mus musculus
tgtcagatgtactcaacttccttaa

SEQ ID NO: 901209 - DNA, 25 bp, Mus musculus
tgtcagcaagttactctctgtccag

SEQ ID NO: 901210 - DNA, 25 bp, Mus musculus
tgtcagcaagtttctctctgtccag

SEQ ID NO: 901211 - DNA, 25 bp, Mus musculus
tgtcagcaatacaccgcgcaaagca

SEQ ID NO: 901212 - DNA, 25 bp, Mus musculus
tgtcagcaatactccgcgcaaagca

SEQ ID NO: 901213 - DNA, 25 bp, Mus musculus
tgtcagcaattacgcaggtcaagtt

SEQ ID NO: 901214 - DNA, 25 bp, Mus musculus
tgtcagcaattaggcaggtcaagtt

SEQ ID NO: 901215 - DNA, 25 bp, Mus musculus
tgtcagcacagcatacaaacgcact

SEQ ID NO: 901216 - DNA, 25 bp, Mus musculus
tgtcagcacagcttacaaacgcact

SEQ ID NO: 901217 - DNA, 25 bp, Mus musculus
tgtcagcaccttccgaaagctagat

SEQ ID NO: 901218 - DNA, 25 bp, Mus musculus
tgtcagcaccttgcgaaagctagat

SEQ ID NO: 901219 - DNA, 25 bp, Mus musculus
tgtcagcagatacacggaaccccaa

SEQ ID NO: 901220 - DNA, 25 bp, Mus musculus
tgtcagcagatagacggaaccccaa

SEQ ID NO: 901221 - DNA, 25 bp, Mus musculus
tgtcagcagatcctcggtctgtgta

SEQ ID NO: 901222 - DNA, 25 bp, Mus musculus
tgtcagcagatcgtcggtctgtgta

SEQ ID NO: 901223 - DNA, 25 bp, Mus musculus
tgtcagcagatgaagttaccacttt

SEQ ID NO: 901224 - DNA, 25 bp, Mus musculus
tgtcagcagatgtagttaccacttt

SEQ ID NO: 901225 - DNA, 25 bp, Mus musculus
tgtcagcagcagacgcccagagcag

SEQ ID NO: 901226 - DNA, 25 bp, Mus musculus
tgtcagcagcagtcgcccagagcag

SEQ ID NO: 901227 - DNA, 25 bp, Mus musculus
tgtcagcagcgcctttctgagcaga

SEQ ID NO: 901228 - DNA, 25 bp, Mus musculus
tgtcagcagcgcgtttctgagcaga

SEQ ID NO: 901229 - DNA, 25 bp, Mus musculus
tgtcagcagctcactattctggtct

SEQ ID NO: 901230 - DNA, 25 bp, Mus musculus
tgtcagcagctctctattctggtct

SEQ ID NO: 901231 - DNA, 25 bp, Mus musculus
tgtcagcatatgaagcaagttttct

SEQ ID NO: 901232 - DNA, 25 bp, Mus musculus
tgtcagcatatgtagcaagttttct

SEQ ID NO: 901233 - DNA, 25 bp, Mus musculus
tgtcagcatctgcgttggagctggg

SEQ ID NO: 901234 - DNA, 25 bp, Mus musculus
tgtcagcatctgggttggagctggg

SEQ ID NO: 901235 - DNA, 25 bp, Mus musculus
tgtcagcatgcccttactaacgagt

SEQ ID NO: 901236 - DNA, 25 bp, Mus musculus
tgtcagcatgccgttactaacgagt

SEQ ID NO: 901237 - DNA, 25 bp, Mus musculus
tgtcagcatgggacacatctctatg

SEQ ID NO: 901238 - DNA, 25 bp, Mus musculus
tgtcagcatgggtcacatctctatg

SEQ ID NO: 901239 - DNA, 25 bp, Mus musculus
tgtcagccacatatgcaaagccaaa

SEQ ID NO: 901240 - DNA, 25 bp, Mus musculus
tgtcagccacatttgcaaagccaaa

SEQ ID NO: 901241 - DNA, 25 bp, Mus musculus
tgtcagccatttctagatcctccac

SEQ ID NO: 901242 - DNA, 25 bp, Mus musculus
tgtcagccatttgtagatcctccac

SEQ ID NO: 901243 - DNA, 25 bp, Mus musculus
tgtcagcccactcaattgtgactgt

SEQ ID NO: 901244 - DNA, 25 bp, Mus musculus
tgtcagcccactgaattgtgactgt

SEQ ID NO: 901245 - DNA, 25 bp, Mus musculus
tgtcagcccagtcaaattctctcct

SEQ ID NO: 901246 - DNA, 25 bp, Mus musculus
tgtcagcccagtgaaattctctcct

SEQ ID NO: 901247 - DNA, 25 bp, Mus musculus
tgtcagcccatcaggagtgcccaac

SEQ ID NO: 901248 - DNA, 25 bp, Mus musculus
tgtcagcccatctggagtgcccaac

SEQ ID NO: 901249 - DNA, 25 bp, Mus musculus
tgtcagcccgaaatcccagtcagga

SEQ ID NO: 901250 - DNA, 25 bp, Mus musculus
tgtcagcccgaattcccagtcagga

SEQ ID NO: 901251 - DNA, 25 bp, Mus musculus
tgtcagccctagctacatactcgaa

SEQ ID NO: 901252 - DNA, 25 bp, Mus musculus
tgtcagccctaggtacatactcgaa

SEQ ID NO: 901253 - DNA, 25 bp, Mus musculus
tgtcagccggatccttgggcccatt

SEQ ID NO: 901254 - DNA, 25 bp, Mus musculus
tgtcagccggatgcttgggcccatt

SEQ ID NO: 901255 - DNA, 25 bp, Mus musculus
tgtcagccgttcaggtgaccctgtt

SEQ ID NO: 901256 - DNA, 25 bp, Mus musculus
tgtcagccgttctggtgaccctgtt

SEQ ID NO: 901257 - DNA, 25 bp, Mus musculus
tgtcagcctgacatctcgagagata

SEQ ID NO: 901258 - DNA, 25 bp, Mus musculus
tgtcagcctgacttctcgagagata

SEQ ID NO: 901259 - DNA, 25 bp, Mus musculus
tgtcagccttacagtgatccaagcg

SEQ ID NO: 901260 - DNA, 25 bp, Mus musculus
tgtcagccttactgtgatccaagcg

SEQ ID NO: 901261 - DNA, 25 bp, Mus musculus
tgtcagccttcaaatgtgccgccag

SEQ ID NO: 901262 - DNA, 25 bp, Mus musculus
tgtcagccttcatatgtgccgccag

SEQ ID NO: 901263 - DNA, 25 bp, Mus musculus
tgtcagccttttcagatgttcagta

SEQ ID NO: 901264 - DNA, 25 bp, Mus musculus
tgtcagccttttgagatgttcagta

SEQ ID NO: 901265 - DNA, 25 bp, Mus musculus
tgtcagcgcaggactgtcaagggac

SEQ ID NO: 901266 - DNA, 25 bp, Mus musculus
tgtcagcgcaggtctgtcaagggac

SEQ ID NO: 901267 - DNA, 25 bp, Mus musculus
tgtcagcggcctagctgaaggcccg

SEQ ID NO: 901268 - DNA, 25 bp, Mus musculus
tgtcagcggccttgctgaaggcccg

SEQ ID NO: 901269 - DNA, 25 bp, Mus musculus
tgtcagcggttgaaggtacacagtg

SEQ ID NO: 901270 - DNA, 25 bp, Mus musculus
tgtcagcggttgtaggtacacagtg

SEQ ID NO: 901271 - DNA, 25 bp, Mus musculus
tgtcagctagccattggagagggct

SEQ ID NO: 901272 - DNA, 25 bp, Mus musculus
tgtcagctagcctttggagagggct

SEQ ID NO: 901273 - DNA, 25 bp, Mus musculus
tgtcagctcataaggctcttctcat

SEQ ID NO: 901274 - DNA, 25 bp, Mus musculus
tgtcagctcatatggctcttctcat

SEQ ID NO: 901275 - DNA, 25 bp, Mus musculus
tgtcagctccttaggcacttcggag

SEQ ID NO: 901276 - DNA, 25 bp, Mus musculus
tgtcagctcctttggcacttcggag

SEQ ID NO: 901277 - DNA, 25 bp, Mus musculus
tgtcagctcgaactcctagggtata

SEQ ID NO: 901278 - DNA, 25 bp, Mus musculus
tgtcagctcgaagtcctagggtata

SEQ ID NO: 901279 - DNA, 25 bp, Mus musculus
tgtcagctctctcaaacgatacact

SEQ ID NO: 901280 - DNA, 25 bp, Mus musculus
tgtcagctctctgaaacgatacact

SEQ ID NO: 901281 - DNA, 25 bp, Mus musculus
tgtcagctcttcagccaggcggtga

SEQ ID NO: 901282 - DNA, 25 bp, Mus musculus
tgtcagctcttctgccaggcggtga

SEQ ID NO: 901283 - DNA, 25 bp, Mus musculus
tgtcagctgatcacagcagcaatgg

SEQ ID NO: 901284 - DNA, 25 bp, Mus musculus
tgtcagctgatctcagcagcaatgg

SEQ ID NO: 901285 - DNA, 25 bp, Mus musculus
tgtcagctgccacggagccttagga

SEQ ID NO: 901286 - DNA, 25 bp, Mus musculus
tgtcagctgccagggagccttagga

SEQ ID NO: 901287 - DNA, 25 bp, Mus musculus
tgtcagctgctcactgaggaactta

SEQ ID NO: 901288 - DNA, 25 bp, Mus musculus
tgtcagctgctctctgaggaactta

SEQ ID NO: 901289 - DNA, 25 bp, Mus musculus
tgtcagctggagaccgacctctccg

SEQ ID NO: 901290 - DNA, 25 bp, Mus musculus
tgtcagctggagtccgacctctccg

SEQ ID NO: 901291 - DNA, 25 bp, Mus musculus
tgtcagctgtcaaaccctcctggtt

SEQ ID NO: 901292 - DNA, 25 bp, Mus musculus
tgtcagctgtcataccctcctggtt

SEQ ID NO: 901293 - DNA, 25 bp, Mus musculus
tgtcaggaaagcacagtgcctctgt

SEQ ID NO: 901294 - DNA, 25 bp, Mus musculus
tgtcaggaaagcagcaggttacttt

SEQ ID NO: 901295 - DNA, 25 bp, Mus musculus
tgtcaggaaagctcagtgcctctgt

SEQ ID NO: 901296 - DNA, 25 bp, Mus musculus
tgtcaggaaagctgcaggttacttt

SEQ ID NO: 901297 - DNA, 25 bp, Mus musculus
tgtcaggaatccatgtcttggcctt

SEQ ID NO: 901298 - DNA, 25 bp, Mus musculus
tgtcaggaatccttgtcttggcctt

SEQ ID NO: 901299 - DNA, 25 bp, Mus musculus
tgtcaggacttcactcactaggtta

SEQ ID NO: 901300 - DNA, 25 bp, Mus musculus
tgtcaggacttctctcactaggtta

SEQ ID NO: 901301 - DNA, 25 bp, Mus musculus
tgtcaggacttgagtagccatcgcc

SEQ ID NO: 901302 - DNA, 25 bp, Mus musculus
tgtcaggacttgtgtagccatcgcc

SEQ ID NO: 901303 - DNA, 25 bp, Mus musculus
tgtcaggagctcattacaaggctgt

SEQ ID NO: 901304 - DNA, 25 bp, Mus musculus
tgtcaggagctctttacaaggctgt

SEQ ID NO: 901305 - DNA, 25 bp, Mus musculus
tgtcaggaggttccaaagcctactt

SEQ ID NO: 901306 - DNA, 25 bp, Mus musculus
tgtcaggaggttgcaaagcctactt

SEQ ID NO: 901307 - DNA, 25 bp, Mus musculus
tgtcaggatgacattcttgccctta

SEQ ID NO: 901308 - DNA, 25 bp, Mus musculus
tgtcaggatgactttcttgccctta

SEQ ID NO: 901309 - DNA, 25 bp, Mus musculus
tgtcaggcaatcatttcttccccac

SEQ ID NO: 901310 - DNA, 25 bp, Mus musculus
tgtcaggcaatcttttcttccccac

SEQ ID NO: 901311 - DNA, 25 bp, Mus musculus
tgtcaggcacacaacaaagagtatc

SEQ ID NO: 901312 - DNA, 25 bp, Mus musculus
tgtcaggcacactacaaagagtatc

SEQ ID NO: 901313 - DNA, 25 bp, Mus musculus
tgtcaggcatatactggcctcccag

SEQ ID NO: 901314 - DNA, 25 bp, Mus musculus
tgtcaggcatattctggcctcccag

SEQ ID NO: 901315 - DNA, 25 bp, Mus musculus
tgtcaggcatcaatcatttctccag

SEQ ID NO: 901316 - DNA, 25 bp, Mus musculus
tgtcaggcatcattcatttctccag

SEQ ID NO: 901317 - DNA, 25 bp, Mus musculus
tgtcaggccactaggtctacatcaa

SEQ ID NO: 901318 - DNA, 25 bp, Mus musculus
tgtcaggccacttggtctacatcaa

SEQ ID NO: 901319 - DNA, 25 bp, Mus musculus
tgtcaggcccgtctggtagccacag

SEQ ID NO: 901320 - DNA, 25 bp, Mus musculus
tgtcaggcccgtgtggtagccacag

SEQ ID NO: 901321 - DNA, 25 bp, Mus musculus
tgtcaggccctgaatcatttgcagt

SEQ ID NO: 901322 - DNA, 25 bp, Mus musculus
tgtcaggccctgtatcatttgcagt

SEQ ID NO: 901323 - DNA, 25 bp, Mus musculus
tgtcaggccttccagacatgcacag

SEQ ID NO: 901324 - DNA, 25 bp, Mus musculus
tgtcaggccttcgagacatgcacag

SEQ ID NO: 901325 - DNA, 25 bp, Mus musculus
tgtcaggcgcagacgacaccgtgta

SEQ ID NO: 901326 - DNA, 25 bp, Mus musculus
tgtcaggcgcagtcgacaccgtgta

SEQ ID NO: 901327 - DNA, 25 bp, Mus musculus
tgtcaggctacaaggtcactactac

SEQ ID NO: 901328 - DNA, 25 bp, Mus musculus
tgtcaggctacatggtcactactac

SEQ ID NO: 901329 - DNA, 25 bp, Mus musculus
tgtcaggctgccaagcctggcccag

SEQ ID NO: 901330 - DNA, 25 bp, Mus musculus
tgtcaggctgcctagcctggcccag

SEQ ID NO: 901331 - DNA, 25 bp, Mus musculus
tgtcaggctgttccaggtgtctgca

SEQ ID NO: 901332 - DNA, 25 bp, Mus musculus
tgtcaggctgttgcaggtgtctgca

SEQ ID NO: 901333 - DNA, 25 bp, Mus musculus
tgtcagggaatacagagccttccgc

SEQ ID NO: 901334 - DNA, 25 bp, Mus musculus
tgtcagggaatagagagccttccgc

SEQ ID NO: 901335 - DNA, 25 bp, Mus musculus
tgtcagggccccatcatgggagtta

SEQ ID NO: 901336 - DNA, 25 bp, Mus musculus
tgtcagggccccttcatgggagtta

SEQ ID NO: 901337 - DNA, 25 bp, Mus musculus
tgtcagggctttcccgacaagggta

SEQ ID NO: 901338 - DNA, 25 bp, Mus musculus
tgtcagggctttgccgacaagggta

SEQ ID NO: 901339 - DNA, 25 bp, Mus musculus
tgtcagggtgacagacgactgccac

SEQ ID NO: 901340 - DNA, 25 bp, Mus musculus
tgtcagggtgactgacgactgccac

SEQ ID NO: 901341 - DNA, 25 bp, Mus musculus
tgtcagggtggtccttcccagataa

SEQ ID NO: 901342 - DNA, 25 bp, Mus musculus
tgtcagggtggtgcttcccagataa

SEQ ID NO: 901343 - DNA, 25 bp, Mus musculus
tgtcaggtacagctcaagttcttgg

SEQ ID NO: 901344 - DNA, 25 bp, Mus musculus
tgtcaggtacaggtcaagttcttgg

SEQ ID NO: 901345 - DNA, 25 bp, Mus musculus
tgtcaggtagtaacaggctgtccct

SEQ ID NO: 901346 - DNA, 25 bp, Mus musculus
tgtcaggtagtatcaggctgtccct

SEQ ID NO: 901347 - DNA, 25 bp, Mus musculus
tgtcaggtccttagcatttccccgt

SEQ ID NO: 901348 - DNA, 25 bp, Mus musculus
tgtcaggtcctttgcatttccccgt

SEQ ID NO: 901349 - DNA, 25 bp, Mus musculus
tgtcaggtgccgaagatgtcttgtt

SEQ ID NO: 901350 - DNA, 25 bp, Mus musculus
tgtcaggtgccgtagatgtcttgtt

SEQ ID NO: 901351 - DNA, 25 bp, Mus musculus
tgtcaggttccgatcccgcccggga

SEQ ID NO: 901352 - DNA, 25 bp, Mus musculus
tgtcaggttccgttcccgcccggga

SEQ ID NO: 901353 - DNA, 25 bp, Mus musculus
tgtcaggttcgtcggatgaccagat

SEQ ID NO: 901354 - DNA, 25 bp, Mus musculus
tgtcaggttcgtgggatgaccagat

SEQ ID NO: 901355 - DNA, 25 bp, Mus musculus
tgtcaggttgtaagcttcaagcatc

SEQ ID NO: 901356 - DNA, 25 bp, Mus musculus
tgtcaggttgtatgcttcaagcatc

SEQ ID NO: 901357 - DNA, 25 bp, Mus musculus
tgtcaggtttaccagttgcccctgt

SEQ ID NO: 901358 - DNA, 25 bp, Mus musculus
tgtcaggtttacgagttgcccctgt

SEQ ID NO: 901359 - DNA, 25 bp, Mus musculus
tgtcaggtttggattagtcttagtt

SEQ ID NO: 901360 - DNA, 25 bp, Mus musculus
tgtcaggtttggtttagtcttagtt

SEQ ID NO: 901361 - DNA, 25 bp, Mus musculus
tgtcagtacagtacagccaccttca

SEQ ID NO: 901362 - DNA, 25 bp, Mus musculus
tgtcagtacagttcagccaccttca

SEQ ID NO: 901363 - DNA, 25 bp, Mus musculus
tgtcagtagcagctgcagggcccct

SEQ ID NO: 901364 - DNA, 25 bp, Mus musculus
tgtcagtagcaggtgcagggcccct

SEQ ID NO: 901365 - DNA, 25 bp, Mus musculus
tgtcagtagcatctctctgggccaa

SEQ ID NO: 901366 - DNA, 25 bp, Mus musculus
tgtcagtagcatgtctctgggccaa

SEQ ID NO: 901367 - DNA, 25 bp, Mus musculus
tgtcagtatcaccacactgggagtt

SEQ ID NO: 901368 - DNA, 25 bp, Mus musculus
tgtcagtatcacgacactgggagtt

SEQ ID NO: 901369 - DNA, 25 bp, Mus musculus
tgtcagtattacaccaaactttttt

SEQ ID NO: 901370 - DNA, 25 bp, Mus musculus
tgtcagtattactccaaactttttt

SEQ ID NO: 901371 - DNA, 25 bp, Mus musculus
tgtcagtatttgactgtgacagcct

SEQ ID NO: 901372 - DNA, 25 bp, Mus musculus
tgtcagtatttgtctgtgacagcct

SEQ ID NO: 901373 - DNA, 25 bp, Mus musculus
tgtcagtcaactcagttcccgccta

SEQ ID NO: 901374 - DNA, 25 bp, Mus musculus
tgtcagtcaactgagttcccgccta

SEQ ID NO: 901375 - DNA, 25 bp, Mus musculus
tgtcagtcacaactaccaactcctg

SEQ ID NO: 901376 - DNA, 25 bp, Mus musculus
tgtcagtcacaagtaccaactcctg

SEQ ID NO: 901377 - DNA, 25 bp, Mus musculus
tgtcagtcactcctgttctgcgtca

SEQ ID NO: 901378 - DNA, 25 bp, Mus musculus
tgtcagtcactcgtgttctgcgtca

SEQ ID NO: 901379 - DNA, 25 bp, Mus musculus
tgtcagtcattactccaagtcggaa

SEQ ID NO: 901380 - DNA, 25 bp, Mus musculus
tgtcagtcattagtccaagtcggaa

SEQ ID NO: 901381 - DNA, 25 bp, Mus musculus
tgtcagtcccttatacccacagagg

SEQ ID NO: 901382 - DNA, 25 bp, Mus musculus
tgtcagtcccttttacccacagagg

SEQ ID NO: 901383 - DNA, 25 bp, Mus musculus
tgtcagtcgtgacgtttcctgcaga

SEQ ID NO: 901384 - DNA, 25 bp, Mus musculus
tgtcagtcgtgaggtttcctgcaga

SEQ ID NO: 901385 - DNA, 25 bp, Mus musculus
tgtcagtctcgtctatagagcaaat

SEQ ID NO: 901386 - DNA, 25 bp, Mus musculus
tgtcagtctcgtgtatagagcaaat

SEQ ID NO: 901387 - DNA, 25 bp, Mus musculus
tgtcagtcttaccttcttggtgttt

SEQ ID NO: 901388 - DNA, 25 bp, Mus musculus
tgtcagtcttacgttcttggtgttt

SEQ ID NO: 901389 - DNA, 25 bp, Mus musculus
tgtcagtcttccatgcgatatgagt

SEQ ID NO: 901390 - DNA, 25 bp, Mus musculus
tgtcagtcttccttgcgatatgagt

SEQ ID NO: 901391 - DNA, 25 bp, Mus musculus
tgtcagtgaaggagtgtccccgtct

SEQ ID NO: 901392 - DNA, 25 bp, Mus musculus
tgtcagtgaaggtgtgtccccgtct

SEQ ID NO: 901393 - DNA, 25 bp, Mus musculus
tgtcagtgaagtaacatcggccgtt

SEQ ID NO: 901394 - DNA, 25 bp, Mus musculus
tgtcagtgaagttacatcggccgtt

SEQ ID NO: 901395 - DNA, 25 bp, Mus musculus
tgtcagtgacagagtgaaggttgct

SEQ ID NO: 901396 - DNA, 25 bp, Mus musculus
tgtcagtgacagtgtgaaggttgct

SEQ ID NO: 901397 - DNA, 25 bp, Mus musculus
tgtcagtgacctacatgcatcttgg

SEQ ID NO: 901398 - DNA, 25 bp, Mus musculus
tgtcagtgaccttcatgcatcttgg

SEQ ID NO: 901399 - DNA, 25 bp, Mus musculus
tgtcagtgacgtatctgtgtggctg

SEQ ID NO: 901400 - DNA, 25 bp, Mus musculus
tgtcagtgacgtttctgtgtggctg

SEQ ID NO: 901401 - DNA, 25 bp, Mus musculus
tgtcagtgaggtactggctgcagtc

SEQ ID NO: 901402 - DNA, 25 bp, Mus musculus
tgtcagtgaggttctggctgcagtc

SEQ ID NO: 901403 - DNA, 25 bp, Mus musculus
tgtcagtgccacatgctctctagag

SEQ ID NO: 901404 - DNA, 25 bp, Mus musculus
tgtcagtgccacttgctctctagag

SEQ ID NO: 901405 - DNA, 25 bp, Mus musculus
tgtcagtgctgacaccccaaacaga

SEQ ID NO: 901406 - DNA, 25 bp, Mus musculus
tgtcagtgctgagaccccaaacaga

SEQ ID NO: 901407 - DNA, 25 bp, Mus musculus
tgtcagtgctgtcctttaagggcgc

SEQ ID NO: 901408 - DNA, 25 bp, Mus musculus
tgtcagtgctgtgctttaagggcgc

SEQ ID NO: 901409 - DNA, 25 bp, Mus musculus
tgtcagtgcttgacccatgccaaag

SEQ ID NO: 901410 - DNA, 25 bp, Mus musculus
tgtcagtgcttgtcccatgccaaag

SEQ ID NO: 901411 - DNA, 25 bp, Mus musculus
tgtcagtgtccaaccacacggtggc

SEQ ID NO: 901412 - DNA, 25 bp, Mus musculus
tgtcagtgtccatccacacggtggc

SEQ ID NO: 901413 - DNA, 25 bp, Mus musculus
tgtcagtgtgcaagtcagtgagtcc

SEQ ID NO: 901414 - DNA, 25 bp, Mus musculus
tgtcagtgtgcatgtcagtgagtcc

SEQ ID NO: 901415 - DNA, 25 bp, Mus musculus
tgtcagttcacacttctcatttctt

SEQ ID NO: 901416 - DNA, 25 bp, Mus musculus
tgtcagttcacagttctcatttctt

SEQ ID NO: 901417 - DNA, 25 bp, Mus musculus
tgtcagttcctcaccaggccttggg

SEQ ID NO: 901418 - DNA, 25 bp, Mus musculus
tgtcagttcctctccaggccttggg

SEQ ID NO: 901419 - DNA, 25 bp, Mus musculus
tgtcagttcctgctgccggaggcaa

SEQ ID NO: 901420 - DNA, 25 bp, Mus musculus
tgtcagttcctggtgccggaggcaa

SEQ ID NO: 901421 - DNA, 25 bp, Mus musculus
tgtcagttgcagaatgaagactcct

SEQ ID NO: 901422 - DNA, 25 bp, Mus musculus
tgtcagttgcagtatgaagactcct

SEQ ID NO: 901423 - DNA, 25 bp, Mus musculus
tgtcagttgctgagaatgctccatc

SEQ ID NO: 901424 - DNA, 25 bp, Mus musculus
tgtcagttgctgtgaatgctccatc

SEQ ID NO: 901425 - DNA, 25 bp, Mus musculus
tgtcagtttaatctccactgtgttt

SEQ ID NO: 901426 - DNA, 25 bp, Mus musculus
tgtcagtttaatgtccactgtgttt

SEQ ID NO: 901427 - DNA, 25 bp, Mus musculus
tgtcagtttcttcccgagtggatat

SEQ ID NO: 901428 - DNA, 25 bp, Mus musculus
tgtcagtttcttgccgagtggatat

SEQ ID NO: 901429 - DNA, 25 bp, Mus musculus
tgtcagttttcgatcttgtactagt

SEQ ID NO: 901430 - DNA, 25 bp, Mus musculus
tgtcagttttcgttcttgtactagt

SEQ ID NO: 901431 - DNA, 25 bp, Mus musculus
tgtcataatagtacatctcgggtac

SEQ ID NO: 901432 - DNA, 25 bp, Mus musculus
tgtcataatagttcatctcgggtac

SEQ ID NO: 901433 - DNA, 25 bp, Mus musculus
tgtcatacacatactcacctttaat

SEQ ID NO: 901434 - DNA, 25 bp, Mus musculus
tgtcatacacatcgacttcctggga

SEQ ID NO: 901435 - DNA, 25 bp, Mus musculus
tgtcatacacatggacttcctggga

SEQ ID NO: 901436 - DNA, 25 bp, Mus musculus
tgtcatacacattctcacctttaat

SEQ ID NO: 901437 - DNA, 25 bp, Mus musculus
tgtcatacagctacttgtcagtccc

SEQ ID NO: 901438 - DNA, 25 bp, Mus musculus
tgtcatacagcttcttgtcagtccc

SEQ ID NO: 901439 - DNA, 25 bp, Mus musculus
tgtcatacctccatgccatgaggga

SEQ ID NO: 901440 - DNA, 25 bp, Mus musculus
tgtcatacctccttgccatgaggga

SEQ ID NO: 901441 - DNA, 25 bp, Mus musculus
tgtcatacgtatcggacctacactt

SEQ ID NO: 901442 - DNA, 25 bp, Mus musculus
tgtcatacgtatgggacctacactt

SEQ ID NO: 901443 - DNA, 25 bp, Mus musculus
tgtcatagctgtcctctcagtgtgt

SEQ ID NO: 901444 - DNA, 25 bp, Mus musculus
tgtcatagctgtgctctcagtgtgt

SEQ ID NO: 901445 - DNA, 25 bp, Mus musculus
tgtcatagtttgcaggttctttaac

SEQ ID NO: 901446 - DNA, 25 bp, Mus musculus
tgtcatagtttggaggttctttaac

SEQ ID NO: 901447 - DNA, 25 bp, Mus musculus
tgtcatatctcaccttgcccatcaa

SEQ ID NO: 901448 - DNA, 25 bp, Mus musculus
tgtcatatctcagcttgcccatcaa

SEQ ID NO: 901449 - DNA, 25 bp, Mus musculus
tgtcatatgaagctgtctctgcctt

SEQ ID NO: 901450 - DNA, 25 bp, Mus musculus
tgtcatatgaaggtgtctctgcctt

SEQ ID NO: 901451 - DNA, 25 bp, Mus musculus
tgtcatatttttcccatttcctctt

SEQ ID NO: 901452 - DNA, 25 bp, Mus musculus
tgtcatatttttgccatttcctctt

SEQ ID NO: 901453 - DNA, 25 bp, Mus musculus
tgtcatcaacatctacgctgaaaga

SEQ ID NO: 901454 - DNA, 25 bp, Mus musculus
tgtcatcaacatgtacgctgaaaga

SEQ ID NO: 901455 - DNA, 25 bp, Mus musculus
tgtcatcaatgcatccgggtatcgc

SEQ ID NO: 901456 - DNA, 25 bp, Mus musculus
tgtcatcaatgcttccgggtatcgc

SEQ ID NO: 901457 - DNA, 25 bp, Mus musculus
tgtcatcaccagcaagtgccatgtt

SEQ ID NO: 901458 - DNA, 25 bp, Mus musculus
tgtcatcaccaggaagtgccatgtt

SEQ ID NO: 901459 - DNA, 25 bp, Mus musculus
tgtcatcacctccagagagcatgga

SEQ ID NO: 901460 - DNA, 25 bp, Mus musculus
tgtcatcacctcgagagagcatgga

SEQ ID NO: 901461 - DNA, 25 bp, Mus musculus
tgtcatcaggatactcatcgccaga

SEQ ID NO: 901462 - DNA, 25 bp, Mus musculus
tgtcatcaggattctcatcgccaga

SEQ ID NO: 901463 - DNA, 25 bp, Mus musculus
tgtcatcaggtgaagatgtccattc

SEQ ID NO: 901464 - DNA, 25 bp, Mus musculus
tgtcatcaggtgtagatgtccattc

SEQ ID NO: 901465 - DNA, 25 bp, Mus musculus
tgtcatcagtgaattgcccaaggct

SEQ ID NO: 901466 - DNA, 25 bp, Mus musculus
tgtcatcagtgatttgcccaaggct

SEQ ID NO: 901467 - DNA, 25 bp, Mus musculus
tgtcatcagtggctgcgtagttatg

SEQ ID NO: 901468 - DNA, 25 bp, Mus musculus
tgtcatcagtgggtgcgtagttatg

SEQ ID NO: 901469 - DNA, 25 bp, Mus musculus
tgtcatcattgcactttggaaattg

SEQ ID NO: 901470 - DNA, 25 bp, Mus musculus
tgtcatcattgctctttggaaattg

SEQ ID NO: 901471 - DNA, 25 bp, Mus musculus
tgtcatccaccacccttttgaaaaa

SEQ ID NO: 901472 - DNA, 25 bp, Mus musculus
tgtcatccaccagccttttgaaaaa

SEQ ID NO: 901473 - DNA, 25 bp, Mus musculus
tgtcatccacccagtgttagcaaaa

SEQ ID NO: 901474 - DNA, 25 bp, Mus musculus
tgtcatccaccctgtgttagcaaaa

SEQ ID NO: 901475 - DNA, 25 bp, Mus musculus
tgtcatccagctcactcatcaatgg

SEQ ID NO: 901476 - DNA, 25 bp, Mus musculus
tgtcatccagctgactcatcaatgg

SEQ ID NO: 901477 - DNA, 25 bp, Mus musculus
tgtcatccaggcatgggtggttttt

SEQ ID NO: 901478 - DNA, 25 bp, Mus musculus
tgtcatccaggcttgggtggttttt

SEQ ID NO: 901479 - DNA, 25 bp, Mus musculus
tgtcatccattaagtgttcccactt

SEQ ID NO: 901480 - DNA, 25 bp, Mus musculus
tgtcatccattatgtgttcccactt

SEQ ID NO: 901481 - DNA, 25 bp, Mus musculus
tgtcatccattgaacatcctgaaag

SEQ ID NO: 901482 - DNA, 25 bp, Mus musculus
tgtcatccattgtacatcctgaaag

SEQ ID NO: 901483 - DNA, 25 bp, Mus musculus
tgtcatcccagcactgagaagtctg

SEQ ID NO: 901484 - DNA, 25 bp, Mus musculus
tgtcatcccagctctgagaagtctg

SEQ ID NO: 901485 - DNA, 25 bp, Mus musculus
tgtcatccctctaacattgtcaaat

SEQ ID NO: 901486 - DNA, 25 bp, Mus musculus
tgtcatccctcttacattgtcaaat

SEQ ID NO: 901487 - DNA, 25 bp, Mus musculus
tgtcatcctgaacttgagtcaccat

SEQ ID NO: 901488 - DNA, 25 bp, Mus musculus
tgtcatcctgaagttgagtcaccat

SEQ ID NO: 901489 - DNA, 25 bp, Mus musculus
tgtcatcctttcatcatgtaatcag

SEQ ID NO: 901490 - DNA, 25 bp, Mus musculus
tgtcatcctttcttcatgtaatcag

SEQ ID NO: 901491 - DNA, 25 bp, Mus musculus
tgtcatcgatgacctgcccttcaag

SEQ ID NO: 901492 - DNA, 25 bp, Mus musculus
tgtcatcgatgagctgcccttcaag

SEQ ID NO: 901493 - DNA, 25 bp, Mus musculus
tgtcatcgccgtaaagcagggagat

SEQ ID NO: 901494 - DNA, 25 bp, Mus musculus
tgtcatcgccgttaagcagggagat

SEQ ID NO: 901495 - DNA, 25 bp, Mus musculus
tgtcatcgctggagggatccggcac

SEQ ID NO: 901496 - DNA, 25 bp, Mus musculus
tgtcatcgctggtgggatccggcac

SEQ ID NO: 901497 - DNA, 25 bp, Mus musculus
tgtcatcgtcccacacagtaagtga

SEQ ID NO: 901498 - DNA, 25 bp, Mus musculus
tgtcatcgtccctcacagtaagtga

SEQ ID NO: 901499 - DNA, 25 bp, Mus musculus
tgtcatcgtcgcatctgttctggtc

SEQ ID NO: 901500 - DNA, 25 bp, Mus musculus
tgtcatcgtcgcttctgttctggtc

SEQ ID NO: 901501 - DNA, 25 bp, Mus musculus
tgtcatctacttcaacatccaggtt

SEQ ID NO: 901502 - DNA, 25 bp, Mus musculus
tgtcatctacttgaacatccaggtt

SEQ ID NO: 901503 - DNA, 25 bp, Mus musculus
tgtcatctcaagacaagtcactggt

SEQ ID NO: 901504 - DNA, 25 bp, Mus musculus
tgtcatctcaagtcaagtcactggt

SEQ ID NO: 901505 - DNA, 25 bp, Mus musculus
tgtcatctccagctgaggaacaggt

SEQ ID NO: 901506 - DNA, 25 bp, Mus musculus
tgtcatctccaggtgaggaacaggt

SEQ ID NO: 901507 - DNA, 25 bp, Mus musculus
tgtcatctccatagagtcctggtag

SEQ ID NO: 901508 - DNA, 25 bp, Mus musculus
tgtcatctccatccctaacagttct

SEQ ID NO: 901509 - DNA, 25 bp, Mus musculus
tgtcatctccatgcctaacagttct

SEQ ID NO: 901510 - DNA, 25 bp, Mus musculus
tgtcatctccattgagtcctggtag

SEQ ID NO: 901511 - DNA, 25 bp, Mus musculus
tgtcatctccgacaccgagctgaaa

SEQ ID NO: 901512 - DNA, 25 bp, Mus musculus
tgtcatctccgacccgccaattgga

SEQ ID NO: 901513 - DNA, 25 bp, Mus musculus
tgtcatctccgagaccgagctgaaa

SEQ ID NO: 901514 - DNA, 25 bp, Mus musculus
tgtcatctccgagccgccaattgga

SEQ ID NO: 901515 - DNA, 25 bp, Mus musculus
tgtcatctctgcaggaatccatgtt

SEQ ID NO: 901516 - DNA, 25 bp, Mus musculus
tgtcatctctgctggaatccatgtt

SEQ ID NO: 901517 - DNA, 25 bp, Mus musculus
tgtcatctcttcaagcattgtaaat

SEQ ID NO: 901518 - DNA, 25 bp, Mus musculus
tgtcatctcttctagcattgtaaat

SEQ ID NO: 901519 - DNA, 25 bp, Mus musculus
tgtcatctgagacttgaaggtcatt

SEQ ID NO: 901520 - DNA, 25 bp, Mus musculus
tgtcatctgagagttgaaggtcatt

SEQ ID NO: 901521 - DNA, 25 bp, Mus musculus
tgtcatctgcatagtggtctccaaa

SEQ ID NO: 901522 - DNA, 25 bp, Mus musculus
tgtcatctgcattgtggtctccaaa

SEQ ID NO: 901523 - DNA, 25 bp, Mus musculus
tgtcatctgtaccttgccactgtaa

SEQ ID NO: 901524 - DNA, 25 bp, Mus musculus
tgtcatctgtacgttgccactgtaa

SEQ ID NO: 901525 - DNA, 25 bp, Mus musculus
tgtcatctgtttaagcaagcacgtc

SEQ ID NO: 901526 - DNA, 25 bp, Mus musculus
tgtcatctgttttagcaagcacgtc

SEQ ID NO: 901527 - DNA, 25 bp, Mus musculus
tgtcatcttaccactgatcagcaag

SEQ ID NO: 901528 - DNA, 25 bp, Mus musculus
tgtcatcttacctctgatcagcaag

SEQ ID NO: 901529 - DNA, 25 bp, Mus musculus
tgtcatcttcacaaactcctgttct

SEQ ID NO: 901530 - DNA, 25 bp, Mus musculus
tgtcatcttcactaactcctgttct

SEQ ID NO: 901531 - DNA, 25 bp, Mus musculus
tgtcatcttcatcactctcatagcc

SEQ ID NO: 901532 - DNA, 25 bp, Mus musculus
tgtcatcttcatgactctcatagcc

SEQ ID NO: 901533 - DNA, 25 bp, Mus musculus
tgtcatcttctcatcctcacaaagt

SEQ ID NO: 901534 - DNA, 25 bp, Mus musculus
tgtcatcttctccatacatcagtgt

SEQ ID NO: 901535 - DNA, 25 bp, Mus musculus
tgtcatcttctcctgcacaaagcag

SEQ ID NO: 901536 - DNA, 25 bp, Mus musculus
tgtcatcttctcgatacatcagtgt

SEQ ID NO: 901537 - DNA, 25 bp, Mus musculus
tgtcatcttctcgtgcacaaagcag

SEQ ID NO: 901538 - DNA, 25 bp, Mus musculus
tgtcatcttctcttcctcacaaagt

SEQ ID NO: 901539 - DNA, 25 bp, Mus musculus
tgtcatcttgacactgttaaagtat

SEQ ID NO: 901540 - DNA, 25 bp, Mus musculus
tgtcatcttgactctgttaaagtat

SEQ ID NO: 901541 - DNA, 25 bp, Mus musculus
tgtcatctttcaagaaggttcagtg

SEQ ID NO: 901542 - DNA, 25 bp, Mus musculus
tgtcatctttcatgaaggttcagtg

SEQ ID NO: 901543 - DNA, 25 bp, Mus musculus
tgtcatgaacgcataaccacaggat

SEQ ID NO: 901544 - DNA, 25 bp, Mus musculus
tgtcatgaacgcttaaccacaggat

SEQ ID NO: 901545 - DNA, 25 bp, Mus musculus
tgtcatgacaggataggaaaacaca

SEQ ID NO: 901546 - DNA, 25 bp, Mus musculus
tgtcatgacaggttaggaaaacaca

SEQ ID NO: 901547 - DNA, 25 bp, Mus musculus
tgtcatgaccatcctcacattggat

SEQ ID NO: 901548 - DNA, 25 bp, Mus musculus
tgtcatgaccatgctcacattggat

SEQ ID NO: 901549 - DNA, 25 bp, Mus musculus
tgtcatgactcaagctcaccagcag

SEQ ID NO: 901550 - DNA, 25 bp, Mus musculus
tgtcatgactcatgctcaccagcag

SEQ ID NO: 901551 - DNA, 25 bp, Mus musculus
tgtcatgatcagcaactccagttca

SEQ ID NO: 901552 - DNA, 25 bp, Mus musculus
tgtcatgatcaggaactccagttca

SEQ ID NO: 901553 - DNA, 25 bp, Mus musculus
tgtcatgcagtaaacttggcccaga

SEQ ID NO: 901554 - DNA, 25 bp, Mus musculus
tgtcatgcagtatacttggcccaga

SEQ ID NO: 901555 - DNA, 25 bp, Mus musculus
tgtcatgcagtgctcctatcaggaa

SEQ ID NO: 901556 - DNA, 25 bp, Mus musculus
tgtcatgcagtggtcctatcaggaa

SEQ ID NO: 901557 - DNA, 25 bp, Mus musculus
tgtcatgcccagaagatgtgagttt

SEQ ID NO: 901558 - DNA, 25 bp, Mus musculus
tgtcatgcccagaagttagtttgtt

SEQ ID NO: 901559 - DNA, 25 bp, Mus musculus
tgtcatgcccagtagatgtgagttt

SEQ ID NO: 901560 - DNA, 25 bp, Mus musculus
tgtcatgcccagtagttagtttgtt

SEQ ID NO: 901561 - DNA, 25 bp, Mus musculus
tgtcatgccctactgggtgccccag

SEQ ID NO: 901562 - DNA, 25 bp, Mus musculus
tgtcatgccctagtgggtgccccag

SEQ ID NO: 901563 - DNA, 25 bp, Mus musculus
tgtcatgccctcagccagctacatg

SEQ ID NO: 901564 - DNA, 25 bp, Mus musculus
tgtcatgccctctgccagctacatg

SEQ ID NO: 901565 - DNA, 25 bp, Mus musculus
tgtcatgccttgagccagaagtcac

SEQ ID NO: 901566 - DNA, 25 bp, Mus musculus
tgtcatgccttgtgccagaagtcac

SEQ ID NO: 901567 - DNA, 25 bp, Mus musculus
tgtcatgcgcacctgtgaaacccat

SEQ ID NO: 901568 - DNA, 25 bp, Mus musculus
tgtcatgcgcacgtgtgaaacccat

SEQ ID NO: 901569 - DNA, 25 bp, Mus musculus
tgtcatgctaggcacagtggcacag

SEQ ID NO: 901570 - DNA, 25 bp, Mus musculus
tgtcatgctagggacagtggcacag

SEQ ID NO: 901571 - DNA, 25 bp, Mus musculus
tgtcatgctagtacatttcaggtat

SEQ ID NO: 901572 - DNA, 25 bp, Mus musculus
tgtcatgctagttcatttcaggtat

SEQ ID NO: 901573 - DNA, 25 bp, Mus musculus
tgtcatggagtcagcctaaccttct

SEQ ID NO: 901574 - DNA, 25 bp, Mus musculus
tgtcatggagtctgcctaaccttct

SEQ ID NO: 901575 - DNA, 25 bp, Mus musculus
tgtcatggcaacagcaggagaaaca

SEQ ID NO: 901576 - DNA, 25 bp, Mus musculus
tgtcatggcaactgcaggagaaaca

SEQ ID NO: 901577 - DNA, 25 bp, Mus musculus
tgtcatggccaccttggtgatatgt

SEQ ID NO: 901578 - DNA, 25 bp, Mus musculus
tgtcatggccacgttggtgatatgt

SEQ ID NO: 901579 - DNA, 25 bp, Mus musculus
tgtcatggctgtcctcttcccattt

SEQ ID NO: 901580 - DNA, 25 bp, Mus musculus
tgtcatggctgtgctcttcccattt

SEQ ID NO: 901581 - DNA, 25 bp, Mus musculus
tgtcatgggcatagcttctacagat

SEQ ID NO: 901582 - DNA, 25 bp, Mus musculus
tgtcatgggcattgcttctacagat

SEQ ID NO: 901583 - DNA, 25 bp, Mus musculus
tgtcatgggttacaagcccgggcat

SEQ ID NO: 901584 - DNA, 25 bp, Mus musculus
tgtcatgggttagaagcccgggcat

SEQ ID NO: 901585 - DNA, 25 bp, Mus musculus
tgtcatggttgtctcaaggacaaac

SEQ ID NO: 901586 - DNA, 25 bp, Mus musculus
tgtcatggttgtgtcaaggacaaac

SEQ ID NO: 901587 - DNA, 25 bp, Mus musculus
tgtcatgtccgcaagttgcagaaca

SEQ ID NO: 901588 - DNA, 25 bp, Mus musculus
tgtcatgtccgctagttgcagaaca

SEQ ID NO: 901589 - DNA, 25 bp, Mus musculus
tgtcatgtcctaacatttggttaca

SEQ ID NO: 901590 - DNA, 25 bp, Mus musculus
tgtcatgtcctacaacacctggatt

SEQ ID NO: 901591 - DNA, 25 bp, Mus musculus
tgtcatgtcctagaacacctggatt

SEQ ID NO: 901592 - DNA, 25 bp, Mus musculus
tgtcatgtcctatcatttggttaca

SEQ ID NO: 901593 - DNA, 25 bp, Mus musculus
tgtcatgtgcttagagccttgtctt

SEQ ID NO: 901594 - DNA, 25 bp, Mus musculus
tgtcatgtgctttgagccttgtctt

SEQ ID NO: 901595 - DNA, 25 bp, Mus musculus
tgtcatgtggacaaacccaggtttc

SEQ ID NO: 901596 - DNA, 25 bp, Mus musculus
tgtcatgtggactaacccaggtttc

SEQ ID NO: 901597 - DNA, 25 bp, Mus musculus
tgtcatgtgtgcaatggccctagtc

SEQ ID NO: 901598 - DNA, 25 bp, Mus musculus
tgtcatgtgtgctatggccctagtc

SEQ ID NO: 901599 - DNA, 25 bp, Mus musculus
tgtcatgttcaccatgctgggtatt

SEQ ID NO: 901600 - DNA, 25 bp, Mus musculus
tgtcatgttcacgatgctgggtatt

SEQ ID NO: 901601 - DNA, 25 bp, Mus musculus
tgtcattaaaaaagcaccccgaggg

SEQ ID NO: 901602 - DNA, 25 bp, Mus musculus
tgtcattaaaaatgcaccccgaggg

SEQ ID NO: 901603 - DNA, 25 bp, Mus musculus
tgtcattaaaatcggcacaggttgg

SEQ ID NO: 901604 - DNA, 25 bp, Mus musculus
tgtcattaaaatgggcacaggttgg

SEQ ID NO: 901605 - DNA, 25 bp, Mus musculus
tgtcattacgtcattgtccaaggtg

SEQ ID NO: 901606 - DNA, 25 bp, Mus musculus
tgtcattacgtctttgtccaaggtg

SEQ ID NO: 901607 - DNA, 25 bp, Mus musculus
tgtcattactatcccgctgtcttta

SEQ ID NO: 901608 - DNA, 25 bp, Mus musculus
tgtcattactatgccgctgtcttta

SEQ ID NO: 901609 - DNA, 25 bp, Mus musculus
tgtcattactcgcttttcttttcta

SEQ ID NO: 901610 - DNA, 25 bp, Mus musculus
tgtcattactcggttttcttttcta

SEQ ID NO: 901611 - DNA, 25 bp, Mus musculus
tgtcattagcttaggctgcacgggc

SEQ ID NO: 901612 - DNA, 25 bp, Mus musculus
tgtcattagctttggctgcacgggc

SEQ ID NO: 901613 - DNA, 25 bp, Mus musculus
tgtcattagggcaagcgtctcactt

SEQ ID NO: 901614 - DNA, 25 bp, Mus musculus
tgtcattagggctagcgtctcactt

SEQ ID NO: 901615 - DNA, 25 bp, Mus musculus
tgtcattagttacccaaggccaggc

SEQ ID NO: 901616 - DNA, 25 bp, Mus musculus
tgtcattagttagccaaggccaggc

SEQ ID NO: 901617 - DNA, 25 bp, Mus musculus
tgtcattatcacattggaggccaag

SEQ ID NO: 901618 - DNA, 25 bp, Mus musculus
tgtcattatcactttggaggccaag

SEQ ID NO: 901619 - DNA, 25 bp, Mus musculus
tgtcattatggaatctaaacttctg

SEQ ID NO: 901620 - DNA, 25 bp, Mus musculus
tgtcattatggattctaaacttctg

SEQ ID NO: 901621 - DNA, 25 bp, Mus musculus
tgtcattatgtcaagcagctgcctc

SEQ ID NO: 901622 - DNA, 25 bp, Mus musculus
tgtcattatgtctagcagctgcctc

SEQ ID NO: 901623 - DNA, 25 bp, Mus musculus
tgtcattcaaacagtgcatcgtttg

SEQ ID NO: 901624 - DNA, 25 bp, Mus musculus
tgtcattcaaactgtgcatcgtttg

SEQ ID NO: 901625 - DNA, 25 bp, Mus musculus
tgtcattcagacatcaggtccatct

SEQ ID NO: 901626 - DNA, 25 bp, Mus musculus
tgtcattcagacttcaggtccatct

SEQ ID NO: 901627 - DNA, 25 bp, Mus musculus
tgtcattcatgtaaaactcccgttg

SEQ ID NO: 901628 - DNA, 25 bp, Mus musculus
tgtcattcatgttaaactcccgttg

SEQ ID NO: 901629 - DNA, 25 bp, Mus musculus
tgtcattccagtcctgccatcagga

SEQ ID NO: 901630 - DNA, 25 bp, Mus musculus
tgtcattccagtgctgccatcagga

SEQ ID NO: 901631 - DNA, 25 bp, Mus musculus
tgtcattccgttagttcccgagttg

SEQ ID NO: 901632 - DNA, 25 bp, Mus musculus
tgtcattccgtttgttcccgagttg

SEQ ID NO: 901633 - DNA, 25 bp, Mus musculus
tgtcattccttacgcatcttatctt

SEQ ID NO: 901634 - DNA, 25 bp, Mus musculus
tgtcattccttaggcatcttatctt

SEQ ID NO: 901635 - DNA, 25 bp, Mus musculus
tgtcattcctttatatgaagtgctg

SEQ ID NO: 901636 - DNA, 25 bp, Mus musculus
tgtcattcctttttatgaagtgctg

SEQ ID NO: 901637 - DNA, 25 bp, Mus musculus
tgtcattctaggcttcatctgttac

SEQ ID NO: 901638 - DNA, 25 bp, Mus musculus
tgtcattctagggttcatctgttac

SEQ ID NO: 901639 - DNA, 25 bp, Mus musculus
tgtcattctctcaaaagcttaccca

SEQ ID NO: 901640 - DNA, 25 bp, Mus musculus
tgtcattctctctaaagcttaccca

SEQ ID NO: 901641 - DNA, 25 bp, Mus musculus
tgtcattcttgccacacatgcagga

SEQ ID NO: 901642 - DNA, 25 bp, Mus musculus
tgtcattcttgcgacacatgcagga

SEQ ID NO: 901643 - DNA, 25 bp, Mus musculus
tgtcattgatttctctttccctctt

SEQ ID NO: 901644 - DNA, 25 bp, Mus musculus
tgtcattgatttgtctttccctctt

SEQ ID NO: 901645 - DNA, 25 bp, Mus musculus
tgtcattgcaataccacagatggcc

SEQ ID NO: 901646 - DNA, 25 bp, Mus musculus
tgtcattgcaattccacagatggcc

SEQ ID NO: 901647 - DNA, 25 bp, Mus musculus
tgtcattgccaaatgagctgctgat

SEQ ID NO: 901648 - DNA, 25 bp, Mus musculus
tgtcattgccaattgagctgctgat

SEQ ID NO: 901649 - DNA, 25 bp, Mus musculus
tgtcattgccacagccaaggctaaa

SEQ ID NO: 901650 - DNA, 25 bp, Mus musculus
tgtcattgccactgccaaggctaaa

SEQ ID NO: 901651 - DNA, 25 bp, Mus musculus
tgtcattgcctgcatgcatacatgt

SEQ ID NO: 901652 - DNA, 25 bp, Mus musculus
tgtcattgcctggatgcatacatgt

SEQ ID NO: 901653 - DNA, 25 bp, Mus musculus
tgtcattggcctcacactgtggaaa

SEQ ID NO: 901654 - DNA, 25 bp, Mus musculus
tgtcattggcctgacactgtggaaa

SEQ ID NO: 901655 - DNA, 25 bp, Mus musculus
tgtcattgtcacaggcggcaacact

SEQ ID NO: 901656 - DNA, 25 bp, Mus musculus
tgtcattgtcactggcggcaacact

SEQ ID NO: 901657 - DNA, 25 bp, Mus musculus
tgtcattgtcatctgtggctgtcct

SEQ ID NO: 901658 - DNA, 25 bp, Mus musculus
tgtcattgtcatgtgtggctgtcct

SEQ ID NO: 901659 - DNA, 25 bp, Mus musculus
tgtcattgtccaagcctacagataa

SEQ ID NO: 901660 - DNA, 25 bp, Mus musculus
tgtcattgtccatgcctacagataa

SEQ ID NO: 901661 - DNA, 25 bp, Mus musculus
tgtcattgtgaacccattattcagc

SEQ ID NO: 901662 - DNA, 25 bp, Mus musculus
tgtcattgtgaagccattattcagc

SEQ ID NO: 901663 - DNA, 25 bp, Mus musculus
tgtcattgtgtgactgttgtgtgct

SEQ ID NO: 901664 - DNA, 25 bp, Mus musculus
tgtcattgtgtgtctgttgtgtgct

SEQ ID NO: 901665 - DNA, 25 bp, Mus musculus
tgtcatttacacacgtggcaagtga

SEQ ID NO: 901666 - DNA, 25 bp, Mus musculus
tgtcatttacactcgtggcaagtga

SEQ ID NO: 901667 - DNA, 25 bp, Mus musculus
tgtcatttccatagtcctcaggcag

SEQ ID NO: 901668 - DNA, 25 bp, Mus musculus
tgtcatttccattgtcctcaggcag

SEQ ID NO: 901669 - DNA, 25 bp, Mus musculus
tgtcatttcccgaggagacagtcca

SEQ ID NO: 901670 - DNA, 25 bp, Mus musculus
tgtcatttcccgtggagacagtcca

SEQ ID NO: 901671 - DNA, 25 bp, Mus musculus
tgtcatttcgccacgctctttgctg

SEQ ID NO: 901672 - DNA, 25 bp, Mus musculus
tgtcatttcgcctcgctctttgctg

SEQ ID NO: 901673 - DNA, 25 bp, Mus musculus
tgtcatttctccatacctcatattg

SEQ ID NO: 901674 - DNA, 25 bp, Mus musculus
tgtcatttctccttacctcatattg

SEQ ID NO: 901675 - DNA, 25 bp, Mus musculus
tgtcatttgcttcaataaccccttg

SEQ ID NO: 901676 - DNA, 25 bp, Mus musculus
tgtcatttgcttgaataaccccttg

SEQ ID NO: 901677 - DNA, 25 bp, Mus musculus
tgtcatttggaactctggctcccca

SEQ ID NO: 901678 - DNA, 25 bp, Mus musculus
tgtcatttggaagtctggctcccca

SEQ ID NO: 901679 - DNA, 25 bp, Mus musculus
tgtcatttggtgagaagttacgtgg

SEQ ID NO: 901680 - DNA, 25 bp, Mus musculus
tgtcatttggtgtgaagttacgtgg

SEQ ID NO: 901681 - DNA, 25 bp, Mus musculus
tgtcatttgtctcggagtcacgttt

SEQ ID NO: 901682 - DNA, 25 bp, Mus musculus
tgtcatttgtctgggagtcacgttt

SEQ ID NO: 901683 - DNA, 25 bp, Mus musculus
tgtcattttcatctgacccagaccc

SEQ ID NO: 901684 - DNA, 25 bp, Mus musculus
tgtcattttcatgtgacccagaccc

SEQ ID NO: 901685 - DNA, 25 bp, Mus musculus
tgtcattttccaagttacatttact

SEQ ID NO: 901686 - DNA, 25 bp, Mus musculus
tgtcattttccatgttacatttact

SEQ ID NO: 901687 - DNA, 25 bp, Mus musculus
tgtcattttccgagtgctttaaaaa

SEQ ID NO: 901688 - DNA, 25 bp, Mus musculus
tgtcattttccgtgtgctttaaaaa

SEQ ID NO: 901689 - DNA, 25 bp, Mus musculus
tgtcattttctcaataagcccagct

SEQ ID NO: 901690 - DNA, 25 bp, Mus musculus
tgtcattttctctataagcccagct

SEQ ID NO: 901691 - DNA, 25 bp, Mus musculus
tgtcattttggtaggaagcctccag

SEQ ID NO: 901692 - DNA, 25 bp, Mus musculus
tgtcattttggttggaagcctccag

SEQ ID NO: 901693 - DNA, 25 bp, Mus musculus
tgtcattttgtaagacgaccctgca

SEQ ID NO: 901694 - DNA, 25 bp, Mus musculus
tgtcattttgtatgacgaccctgca

SEQ ID NO: 901695 - DNA, 25 bp, Mus musculus
tgtccaaaatgccaacatccccgtg

SEQ ID NO: 901696 - DNA, 25 bp, Mus musculus
tgtccaaaatgcgaacatccccgtg

SEQ ID NO: 901697 - DNA, 25 bp, Mus musculus
tgtccaaaatggagtcagcctcaag

SEQ ID NO: 901698 - DNA, 25 bp, Mus musculus
tgtccaaaatggtgtcagcctcaag

SEQ ID NO: 901699 - DNA, 25 bp, Mus musculus
tgtccaaacaagatcccaagtctaa

SEQ ID NO: 901700 - DNA, 25 bp, Mus musculus
tgtccaaacaagttcccaagtctaa

SEQ ID NO: 901701 - DNA, 25 bp, Mus musculus
tgtccaaacccaacggtgtggtgaa

SEQ ID NO: 901702 - DNA, 25 bp, Mus musculus
tgtccaaacccatcggtgtggtgaa

SEQ ID NO: 901703 - DNA, 25 bp, Mus musculus
tgtccaaactggctcttcgacaggt

SEQ ID NO: 901704 - DNA, 25 bp, Mus musculus
tgtccaaactgggtcttcgacaggt

SEQ ID NO: 901705 - DNA, 25 bp, Mus musculus
tgtccaaagaggccgcggcgtccaa

SEQ ID NO: 901706 - DNA, 25 bp, Mus musculus
tgtccaaagagggcgcggcgtccaa

SEQ ID NO: 901707 - DNA, 25 bp, Mus musculus
tgtccaaaggccaagtccctacttt

SEQ ID NO: 901708 - DNA, 25 bp, Mus musculus
tgtccaaaggcctagtccctacttt

SEQ ID NO: 901709 - DNA, 25 bp, Mus musculus
tgtccaaatactaggcaggatttaa

SEQ ID NO: 901710 - DNA, 25 bp, Mus musculus
tgtccaaatacttggcaggatttaa

SEQ ID NO: 901711 - DNA, 25 bp, Mus musculus
tgtccaaataggcagacaggtggtt

SEQ ID NO: 901712 - DNA, 25 bp, Mus musculus
tgtccaaatagggagacaggtggtt

SEQ ID NO: 901713 - DNA, 25 bp, Mus musculus
tgtccaacacagcataagcactggc

SEQ ID NO: 901714 - DNA, 25 bp, Mus musculus
tgtccaacacaggataagcactggc

SEQ ID NO: 901715 - DNA, 25 bp, Mus musculus
tgtccaacactcaactttcatctga

SEQ ID NO: 901716 - DNA, 25 bp, Mus musculus
tgtccaacactctactttcatctga

SEQ ID NO: 901717 - DNA, 25 bp, Mus musculus
tgtccaacagacagcaacctggcag

SEQ ID NO: 901718 - DNA, 25 bp, Mus musculus
tgtccaacagactgcaacctggcag

SEQ ID NO: 901719 - DNA, 25 bp, Mus musculus
tgtccaacagccaggcgggctccaa

SEQ ID NO: 901720 - DNA, 25 bp, Mus musculus
tgtccaacagcctggcgggctccaa

SEQ ID NO: 901721 - DNA, 25 bp, Mus musculus
tgtccaacaggtaaccacaccaatg

SEQ ID NO: 901722 - DNA, 25 bp, Mus musculus
tgtccaacaggttaccacaccaatg

SEQ ID NO: 901723 - DNA, 25 bp, Mus musculus
tgtccaacagttatatttccacggt

SEQ ID NO: 901724 - DNA, 25 bp, Mus musculus
tgtccaacagttttatttccacggt

SEQ ID NO: 901725 - DNA, 25 bp, Mus musculus
tgtccaacatttcatctgtgtatga

SEQ ID NO: 901726 - DNA, 25 bp, Mus musculus
tgtccaacatttgatctgtgtatga

SEQ ID NO: 901727 - DNA, 25 bp, Mus musculus
tgtccaaccaggaaagtgtttttct

SEQ ID NO: 901728 - DNA, 25 bp, Mus musculus
tgtccaaccaggtaagtgtttttct

SEQ ID NO: 901729 - DNA, 25 bp, Mus musculus
tgtccaacccacagcgtcataagga

SEQ ID NO: 901730 - DNA, 25 bp, Mus musculus
tgtccaacccactgcgtcataagga

SEQ ID NO: 901731 - DNA, 25 bp, Mus musculus
tgtccaacctttacaccagtgtgat

SEQ ID NO: 901732 - DNA, 25 bp, Mus musculus
tgtccaaccttttcaccagtgtgat

SEQ ID NO: 901733 - DNA, 25 bp, Mus musculus
tgtccaacgaggagccgcttagtat

SEQ ID NO: 901734 - DNA, 25 bp, Mus musculus
tgtccaacgaggtgccgcttagtat

SEQ ID NO: 901735 - DNA, 25 bp, Mus musculus
tgtccaactcataattactatacga

SEQ ID NO: 901736 - DNA, 25 bp, Mus musculus
tgtccaactcattattactatacga

SEQ ID NO: 901737 - DNA, 25 bp, Mus musculus
tgtccaactgagcacgtccatgata

SEQ ID NO: 901738 - DNA, 25 bp, Mus musculus
tgtccaactgaggacgtccatgata

SEQ ID NO: 901739 - DNA, 25 bp, Mus musculus
tgtccaagaactactgttgcttctg

SEQ ID NO: 901740 - DNA, 25 bp, Mus musculus
tgtccaagaacttctgttgcttctg

SEQ ID NO: 901741 - DNA, 25 bp, Mus musculus
tgtccaagacctactgcagtaccta

SEQ ID NO: 901742 - DNA, 25 bp, Mus musculus
tgtccaagaccttctgcagtaccta

SEQ ID NO: 901743 - DNA, 25 bp, Mus musculus
tgtccaagagacactgttgtagtag

SEQ ID NO: 901744 - DNA, 25 bp, Mus musculus
tgtccaagagactctgttgtagtag

SEQ ID NO: 901745 - DNA, 25 bp, Mus musculus
tgtccaagataacccttaccacttt

SEQ ID NO: 901746 - DNA, 25 bp, Mus musculus
tgtccaagataagccttaccacttt

SEQ ID NO: 901747 - DNA, 25 bp, Mus musculus
tgtccaagccccatgtagtgcaaac

SEQ ID NO: 901748 - DNA, 25 bp, Mus musculus
tgtccaagccccttgtagtgcaaac

SEQ ID NO: 901749 - DNA, 25 bp, Mus musculus
tgtccaagccgcaaacatgttcatg

SEQ ID NO: 901750 - DNA, 25 bp, Mus musculus
tgtccaagccgctaacatgttcatg

SEQ ID NO: 901751 - DNA, 25 bp, Mus musculus
tgtccaagcttcaagtgatttggaa

SEQ ID NO: 901752 - DNA, 25 bp, Mus musculus
tgtccaagcttcacggtctgaggta

SEQ ID NO: 901753 - DNA, 25 bp, Mus musculus
tgtccaagcttccactgactgttgc

SEQ ID NO: 901754 - DNA, 25 bp, Mus musculus
tgtccaagcttcgactgactgttgc

SEQ ID NO: 901755 - DNA, 25 bp, Mus musculus
tgtccaagcttctagtgatttggaa

SEQ ID NO: 901756 - DNA, 25 bp, Mus musculus
tgtccaagcttctcggtctgaggta

SEQ ID NO: 901757 - DNA, 25 bp, Mus musculus
tgtccaaggacacggccaacatgca

SEQ ID NO: 901758 - DNA, 25 bp, Mus musculus
tgtccaaggacagggccaacatgca

SEQ ID NO: 901759 - DNA, 25 bp, Mus musculus
tgtccaaggactccagtagctgctc

SEQ ID NO: 901760 - DNA, 25 bp, Mus musculus
tgtccaaggactgcagtagctgctc

SEQ ID NO: 901761 - DNA, 25 bp, Mus musculus
tgtccaaggaggatgccatggtaga

SEQ ID NO: 901762 - DNA, 25 bp, Mus musculus
tgtccaaggaggttgccatggtaga

SEQ ID NO: 901763 - DNA, 25 bp, Mus musculus
tgtccaagtcacctgccacatactg

SEQ ID NO: 901764 - DNA, 25 bp, Mus musculus
tgtccaagtcacgtgccacatactg

SEQ ID NO: 901765 - DNA, 25 bp, Mus musculus
tgtccaatgtccacagcccgaggca

SEQ ID NO: 901766 - DNA, 25 bp, Mus musculus
tgtccaatgtcctcagcccgaggca

SEQ ID NO: 901767 - DNA, 25 bp, Mus musculus
tgtccaatgtggccttctctctgta

SEQ ID NO: 901768 - DNA, 25 bp, Mus musculus
tgtccaatgtgggcttctctctgta

SEQ ID NO: 901769 - DNA, 25 bp, Mus musculus
tgtccaattcagacatggtccataa

SEQ ID NO: 901770 - DNA, 25 bp, Mus musculus
tgtccaattcagtcatggtccataa

SEQ ID NO: 901771 - DNA, 25 bp, Mus musculus
tgtccaattgatatcacccttgcac

SEQ ID NO: 901772 - DNA, 25 bp, Mus musculus
tgtccaattgatttcacccttgcac

SEQ ID NO: 901773 - DNA, 25 bp, Mus musculus
tgtccaatttgcaggcagatgcccg

SEQ ID NO: 901774 - DNA, 25 bp, Mus musculus
tgtccaatttgctggcagatgcccg

SEQ ID NO: 901775 - DNA, 25 bp, Mus musculus
tgtccacaagacaaccagctgctgt

SEQ ID NO: 901776 - DNA, 25 bp, Mus musculus
tgtccacaagactaccagctgctgt

SEQ ID NO: 901777 - DNA, 25 bp, Mus musculus
tgtccacacacacagatagcgccaa

SEQ ID NO: 901778 - DNA, 25 bp, Mus musculus
tgtccacacacagagatagcgccaa

SEQ ID NO: 901779 - DNA, 25 bp, Mus musculus
tgtccacacacgagcagatcgttcg

SEQ ID NO: 901780 - DNA, 25 bp, Mus musculus
tgtccacacacgtgcagatcgttcg

SEQ ID NO: 901781 - DNA, 25 bp, Mus musculus
tgtccacaccctactctggaaggtc

SEQ ID NO: 901782 - DNA, 25 bp, Mus musculus
tgtccacacccttctctggaaggtc

SEQ ID NO: 901783 - DNA, 25 bp, Mus musculus
tgtccacacgtgacgctaaatcggc

SEQ ID NO: 901784 - DNA, 25 bp, Mus musculus
tgtccacacgtgtcgctaaatcggc

SEQ ID NO: 901785 - DNA, 25 bp, Mus musculus
tgtccacagagtccatgcctgttcc

SEQ ID NO: 901786 - DNA, 25 bp, Mus musculus
tgtccacagagtgcatgcctgttcc

SEQ ID NO: 901787 - DNA, 25 bp, Mus musculus
tgtccacaggaaccctaaccgtagt

SEQ ID NO: 901788 - DNA, 25 bp, Mus musculus
tgtccacaggaaccctttctctaga

SEQ ID NO: 901789 - DNA, 25 bp, Mus musculus
tgtccacaggaagcctaaccgtagt

SEQ ID NO: 901790 - DNA, 25 bp, Mus musculus
tgtccacaggaagcctttctctaga

SEQ ID NO: 901791 - DNA, 25 bp, Mus musculus
tgtccacaggatacctcttctctat

SEQ ID NO: 901792 - DNA, 25 bp, Mus musculus
tgtccacaggattcctcttctctat

SEQ ID NO: 901793 - DNA, 25 bp, Mus musculus
tgtccacagtgtcctgatgcccagg

SEQ ID NO: 901794 - DNA, 25 bp, Mus musculus
tgtccacagtgtgctgatgcccagg

SEQ ID NO: 901795 - DNA, 25 bp, Mus musculus
tgtccacatcctatgaccttttggc

SEQ ID NO: 901796 - DNA, 25 bp, Mus musculus
tgtccacatcctttgaccttttggc

SEQ ID NO: 901797 - DNA, 25 bp, Mus musculus
tgtccacatgccaaagcacccggag

SEQ ID NO: 901798 - DNA, 25 bp, Mus musculus
tgtccacatgcctaagcacccggag

SEQ ID NO: 901799 - DNA, 25 bp, Mus musculus
tgtccacatgtgaatgggctccgca

SEQ ID NO: 901800 - DNA, 25 bp, Mus musculus
tgtccacatgtgtatgggctccgca

SEQ ID NO: 901801 - DNA, 25 bp, Mus musculus
tgtccaccagatctctccagaagaa

SEQ ID NO: 901802 - DNA, 25 bp, Mus musculus
tgtccaccagatgtctccagaagaa

SEQ ID NO: 901803 - DNA, 25 bp, Mus musculus
tgtccaccagctccttttgcatcag

SEQ ID NO: 901804 - DNA, 25 bp, Mus musculus
tgtccaccagctgcttttgcatcag

SEQ ID NO: 901805 - DNA, 25 bp, Mus musculus
tgtccaccatcgatacttcagcaag

SEQ ID NO: 901806 - DNA, 25 bp, Mus musculus
tgtccaccatcgttacttcagcaag

SEQ ID NO: 901807 - DNA, 25 bp, Mus musculus
tgtccaccatggactccagttatgg

SEQ ID NO: 901808 - DNA, 25 bp, Mus musculus
tgtccaccatggtctccagttatgg

SEQ ID NO: 901809 - DNA, 25 bp, Mus musculus
tgtccacccagacttaagtcgcagt

SEQ ID NO: 901810 - DNA, 25 bp, Mus musculus
tgtccacccagagttaagtcgcagt

SEQ ID NO: 901811 - DNA, 25 bp, Mus musculus
tgtccacccaggaaattacacgtgt

SEQ ID NO: 901812 - DNA, 25 bp, Mus musculus
tgtccacccaggtaattacacgtgt

SEQ ID NO: 901813 - DNA, 25 bp, Mus musculus
tgtccacccataaaccaagctatta

SEQ ID NO: 901814 - DNA, 25 bp, Mus musculus
tgtccacccatataccaagctatta

SEQ ID NO: 901815 - DNA, 25 bp, Mus musculus
tgtccacccttacgaagccgagcat

SEQ ID NO: 901816 - DNA, 25 bp, Mus musculus
tgtccacccttaggaagccgagcat

SEQ ID NO: 901817 - DNA, 25 bp, Mus musculus
tgtccaccgtcgctgtttaagaggg

SEQ ID NO: 901818 - DNA, 25 bp, Mus musculus
tgtccaccgtcggtgtttaagaggg

SEQ ID NO: 901819 - DNA, 25 bp, Mus musculus
tgtccacctgccatgacttagaaga

SEQ ID NO: 901820 - DNA, 25 bp, Mus musculus
tgtccacctgccttgacttagaaga

SEQ ID NO: 901821 - DNA, 25 bp, Mus musculus
tgtccaccttaaacagcatcacttg

SEQ ID NO: 901822 - DNA, 25 bp, Mus musculus
tgtccaccttaatcagcatcacttg

SEQ ID NO: 901823 - DNA, 25 bp, Mus musculus
tgtccacctttcagttgccaataaa

SEQ ID NO: 901824 - DNA, 25 bp, Mus musculus
tgtccacctttctgttgccaataaa

SEQ ID NO: 901825 - DNA, 25 bp, Mus musculus
tgtccacctttgatatcgcttcaga

SEQ ID NO: 901826 - DNA, 25 bp, Mus musculus
tgtccacctttgttatcgcttcaga

SEQ ID NO: 901827 - DNA, 25 bp, Mus musculus
tgtccacgacagattattctatata

SEQ ID NO: 901828 - DNA, 25 bp, Mus musculus
tgtccacgacagtttattctatata

SEQ ID NO: 901829 - DNA, 25 bp, Mus musculus
tgtccacgagctatgctggtgcata

SEQ ID NO: 901830 - DNA, 25 bp, Mus musculus
tgtccacgagctttgctggtgcata

SEQ ID NO: 901831 - DNA, 25 bp, Mus musculus
tgtccacgcttcctcgaaaaaacat

SEQ ID NO: 901832 - DNA, 25 bp, Mus musculus
tgtccacgcttcgtcgaaaaaacat

SEQ ID NO: 901833 - DNA, 25 bp, Mus musculus
tgtccacgggaaaacagcgccaagt

SEQ ID NO: 901834 - DNA, 25 bp, Mus musculus
tgtccacgggaatacagcgccaagt

SEQ ID NO: 901835 - DNA, 25 bp, Mus musculus
tgtccacgggacacctgctgtgtga

SEQ ID NO: 901836 - DNA, 25 bp, Mus musculus
tgtccacgggactcctgctgtgtga

SEQ ID NO: 901837 - DNA, 25 bp, Mus musculus
tgtccacggtgcagcagaggcagct

SEQ ID NO: 901838 - DNA, 25 bp, Mus musculus
tgtccacggtgctgcagaggcagct

SEQ ID NO: 901839 - DNA, 25 bp, Mus musculus
tgtccacggttcctttgttctaggc

SEQ ID NO: 901840 - DNA, 25 bp, Mus musculus
tgtccacggttcgtttgttctaggc

SEQ ID NO: 901841 - DNA, 25 bp, Mus musculus
tgtccacgtggaccattcaatcaaa

SEQ ID NO: 901842 - DNA, 25 bp, Mus musculus
tgtccacgtggagcattcaatcaaa

SEQ ID NO: 901843 - DNA, 25 bp, Mus musculus
tgtccacgtgggaatcagccggtga

SEQ ID NO: 901844 - DNA, 25 bp, Mus musculus
tgtccacgtgggtatcagccggtga

SEQ ID NO: 901845 - DNA, 25 bp, Mus musculus
tgtccactcactatgttcacagaaa

SEQ ID NO: 901846 - DNA, 25 bp, Mus musculus
tgtccactcactttgttcacagaaa

SEQ ID NO: 901847 - DNA, 25 bp, Mus musculus
tgtccactcatacccttatccagtg

SEQ ID NO: 901848 - DNA, 25 bp, Mus musculus
tgtccactcatagccttatccagtg

SEQ ID NO: 901849 - DNA, 25 bp, Mus musculus
tgtccactcctcattctggaagagc

SEQ ID NO: 901850 - DNA, 25 bp, Mus musculus
tgtccactcctctttctggaagagc

SEQ ID NO: 901851 - DNA, 25 bp, Mus musculus
tgtccactctctcatagcagaaggg

SEQ ID NO: 901852 - DNA, 25 bp, Mus musculus
tgtccactctctgatagcagaaggg

SEQ ID NO: 901853 - DNA, 25 bp, Mus musculus
tgtccactgcgtacatccacaaatt

SEQ ID NO: 901854 - DNA, 25 bp, Mus musculus
tgtccactgcgttcatccacaaatt

SEQ ID NO: 901855 - DNA, 25 bp, Mus musculus
tgtccactgtggcaatcagaccata

SEQ ID NO: 901856 - DNA, 25 bp, Mus musculus
tgtccactgtgggaatcagaccata

SEQ ID NO: 901857 - DNA, 25 bp, Mus musculus
tgtccactgttgattaatcacatac

SEQ ID NO: 901858 - DNA, 25 bp, Mus musculus
tgtccactgttgctgacctcattct

SEQ ID NO: 901859 - DNA, 25 bp, Mus musculus
tgtccactgttggtgacctcattct

SEQ ID NO: 901860 - DNA, 25 bp, Mus musculus
tgtccactgttgtttaatcacatac

SEQ ID NO: 901861 - DNA, 25 bp, Mus musculus
tgtccacttcacacctctttagttc

SEQ ID NO: 901862 - DNA, 25 bp, Mus musculus
tgtccacttcactcctctttagttc

SEQ ID NO: 901863 - DNA, 25 bp, Mus musculus
tgtccacttccccattgaaagaatt

SEQ ID NO: 901864 - DNA, 25 bp, Mus musculus
tgtccacttcccgattgaaagaatt

SEQ ID NO: 901865 - DNA, 25 bp, Mus musculus
tgtccacttcgcaaagtactcagct

SEQ ID NO: 901866 - DNA, 25 bp, Mus musculus
tgtccacttcgctaagtactcagct

SEQ ID NO: 901867 - DNA, 25 bp, Mus musculus
tgtccacttgtcatttgtcattcct

SEQ ID NO: 901868 - DNA, 25 bp, Mus musculus
tgtccacttgtcttttgtcattcct

SEQ ID NO: 901869 - DNA, 25 bp, Mus musculus
tgtccactttcaacgcgcacaagaa

SEQ ID NO: 901870 - DNA, 25 bp, Mus musculus
tgtccactttcatcgcgcacaagaa

SEQ ID NO: 901871 - DNA, 25 bp, Mus musculus
tgtccagaaaagcttccttgtcttc

SEQ ID NO: 901872 - DNA, 25 bp, Mus musculus
tgtccagaaaaggttccttgtcttc

SEQ ID NO: 901873 - DNA, 25 bp, Mus musculus
tgtccagaaaatcccaagcagctgt

SEQ ID NO: 901874 - DNA, 25 bp, Mus musculus
tgtccagaaaatgccaagcagctgt

SEQ ID NO: 901875 - DNA, 25 bp, Mus musculus
tgtccagaaacactttaaccctctt

SEQ ID NO: 901876 - DNA, 25 bp, Mus musculus
tgtccagaaacagtttaaccctctt

SEQ ID NO: 901877 - DNA, 25 bp, Mus musculus
tgtccagaatatacagtactacatg

SEQ ID NO: 901878 - DNA, 25 bp, Mus musculus
tgtccagaatattcagtactacatg

SEQ ID NO: 901879 - DNA, 25 bp, Mus musculus
tgtccagaatctaccaaccagaaag

SEQ ID NO: 901880 - DNA, 25 bp, Mus musculus
tgtccagaatcttccaaccagaaag

SEQ ID NO: 901881 - DNA, 25 bp, Mus musculus
tgtccagacagacccttgacgctgg

SEQ ID NO: 901882 - DNA, 25 bp, Mus musculus
tgtccagacagagccttgacgctgg

SEQ ID NO: 901883 - DNA, 25 bp, Mus musculus
tgtccagacagcactcttaagcttg

SEQ ID NO: 901884 - DNA, 25 bp, Mus musculus
tgtccagacagctctcttaagcttg

SEQ ID NO: 901885 - DNA, 25 bp, Mus musculus
tgtccagaccccagctagaagcgtt

SEQ ID NO: 901886 - DNA, 25 bp, Mus musculus
tgtccagacccctgctagaagcgtt

SEQ ID NO: 901887 - DNA, 25 bp, Mus musculus
tgtccagaccggcttttcaaaagca

SEQ ID NO: 901888 - DNA, 25 bp, Mus musculus
tgtccagaccgggttttcaaaagca

SEQ ID NO: 901889 - DNA, 25 bp, Mus musculus
tgtccagacgccatgtacgaagtga

SEQ ID NO: 901890 - DNA, 25 bp, Mus musculus
tgtccagacgccttgtacgaagtga

SEQ ID NO: 901891 - DNA, 25 bp, Mus musculus
tgtccagactctccatcgattgtgg

SEQ ID NO: 901892 - DNA, 25 bp, Mus musculus
tgtccagactctgcatcgattgtgg

SEQ ID NO: 901893 - DNA, 25 bp, Mus musculus
tgtccagactgaaatttaggcccgt

SEQ ID NO: 901894 - DNA, 25 bp, Mus musculus
tgtccagactgatatttaggcccgt

SEQ ID NO: 901895 - DNA, 25 bp, Mus musculus
tgtccagactgtcaccgaagcttct

SEQ ID NO: 901896 - DNA, 25 bp, Mus musculus
tgtccagactgtgaccgaagcttct

SEQ ID NO: 901897 - DNA, 25 bp, Mus musculus
tgtccagagaaccaggctgagcagt

SEQ ID NO: 901898 - DNA, 25 bp, Mus musculus
tgtccagagaacgaggctgagcagt

SEQ ID NO: 901899 - DNA, 25 bp, Mus musculus
tgtccagagaagcagcgcagtataa

SEQ ID NO: 901900 - DNA, 25 bp, Mus musculus
tgtccagagaaggagcgcagtataa

SEQ ID NO: 901901 - DNA, 25 bp, Mus musculus
tgtccagagactacccatttccggg

SEQ ID NO: 901902 - DNA, 25 bp, Mus musculus
tgtccagagacttcccatttccggg

SEQ ID NO: 901903 - DNA, 25 bp, Mus musculus
tgtccagagatgatatcggttgttt

SEQ ID NO: 901904 - DNA, 25 bp, Mus musculus
tgtccagagatgttatcggttgttt

SEQ ID NO: 901905 - DNA, 25 bp, Mus musculus
tgtccagagctcagtacagggctgt

SEQ ID NO: 901906 - DNA, 25 bp, Mus musculus
tgtccagagctctgtacagggctgt

SEQ ID NO: 901907 - DNA, 25 bp, Mus musculus
tgtccagagggcaccactgattctc

SEQ ID NO: 901908 - DNA, 25 bp, Mus musculus
tgtccagagggctccactgattctc

SEQ ID NO: 901909 - DNA, 25 bp, Mus musculus
tgtccagatgccctcatgaaccagt

SEQ ID NO: 901910 - DNA, 25 bp, Mus musculus
tgtccagatgccgtcatgaaccagt

SEQ ID NO: 901911 - DNA, 25 bp, Mus musculus
tgtccagcacagcaagcagcacgag

SEQ ID NO: 901912 - DNA, 25 bp, Mus musculus
tgtccagcacaggaagcagcacgag

SEQ ID NO: 901913 - DNA, 25 bp, Mus musculus
tgtccagcatctccagagtcagata

SEQ ID NO: 901914 - DNA, 25 bp, Mus musculus
tgtccagcatctgcagagtcagata

SEQ ID NO: 901915 - DNA, 25 bp, Mus musculus
tgtccagcatttccactcagatcct

SEQ ID NO: 901916 - DNA, 25 bp, Mus musculus
tgtccagcatttgcactcagatcct

SEQ ID NO: 901917 - DNA, 25 bp, Mus musculus
tgtccagccaccatgataagcgcca

SEQ ID NO: 901918 - DNA, 25 bp, Mus musculus
tgtccagccaccttgataagcgcca

SEQ ID NO: 901919 - DNA, 25 bp, Mus musculus
tgtccagccacgacatcgaacagtg

SEQ ID NO: 901920 - DNA, 25 bp, Mus musculus
tgtccagccacgtcatcgaacagtg

SEQ ID NO: 901921 - DNA, 25 bp, Mus musculus
tgtccagcccagagactgaggacca

SEQ ID NO: 901922 - DNA, 25 bp, Mus musculus
tgtccagcccagtgactgaggacca

SEQ ID NO: 901923 - DNA, 25 bp, Mus musculus
tgtccagccccaactgatttgcaaa

SEQ ID NO: 901924 - DNA, 25 bp, Mus musculus
tgtccagccccatctgatttgcaaa

SEQ ID NO: 901925 - DNA, 25 bp, Mus musculus
tgtccagccgagctttgccattcat

SEQ ID NO: 901926 - DNA, 25 bp, Mus musculus
tgtccagccgaggtttgccattcat

SEQ ID NO: 901927 - DNA, 25 bp, Mus musculus
tgtccagccttgaacagatgaggta

SEQ ID NO: 901928 - DNA, 25 bp, Mus musculus
tgtccagccttgtacagatgaggta

SEQ ID NO: 901929 - DNA, 25 bp, Mus musculus
tgtccagcgagcacacagctatggg

SEQ ID NO: 901930 - DNA, 25 bp, Mus musculus
tgtccagcgagctcacagctatggg

SEQ ID NO: 901931 - DNA, 25 bp, Mus musculus
tgtccagcgctgactcggagagcca

SEQ ID NO: 901932 - DNA, 25 bp, Mus musculus
tgtccagcgctgtctcggagagcca

SEQ ID NO: 901933 - DNA, 25 bp, Mus musculus
tgtccagcgtcccttttcaaagtgc

SEQ ID NO: 901934 - DNA, 25 bp, Mus musculus
tgtccagcgtccgttttcaaagtgc

SEQ ID NO: 901935 - DNA, 25 bp, Mus musculus
tgtccagctcatccgtaacaggctt

SEQ ID NO: 901936 - DNA, 25 bp, Mus musculus
tgtccagctcatgcgtaacaggctt

SEQ ID NO: 901937 - DNA, 25 bp, Mus musculus
tgtccagctccaaggtacctgatgc

SEQ ID NO: 901938 - DNA, 25 bp, Mus musculus
tgtccagctccatggtacctgatgc

SEQ ID NO: 901939 - DNA, 25 bp, Mus musculus
tgtccagctcccaatagtcatccat

SEQ ID NO: 901940 - DNA, 25 bp, Mus musculus
tgtccagctccctatagtcatccat

SEQ ID NO: 901941 - DNA, 25 bp, Mus musculus
tgtccagctgacatcattttaggat

SEQ ID NO: 901942 - DNA, 25 bp, Mus musculus
tgtccagctgacttcattttaggat

SEQ ID NO: 901943 - DNA, 25 bp, Mus musculus
tgtccagctgccaacaggtctgatc

SEQ ID NO: 901944 - DNA, 25 bp, Mus musculus
tgtccagctgcctacaggtctgatc

SEQ ID NO: 901945 - DNA, 25 bp, Mus musculus
tgtccagctgggaaaacctctgaac

SEQ ID NO: 901946 - DNA, 25 bp, Mus musculus
tgtccagctgggtaaacctctgaac

SEQ ID NO: 901947 - DNA, 25 bp, Mus musculus
tgtccagctgtacctgccagggaag

SEQ ID NO: 901948 - DNA, 25 bp, Mus musculus
tgtccagctgtagctgccagggaag

SEQ ID NO: 901949 - DNA, 25 bp, Mus musculus
tgtccagcttcgatacttgcacact

SEQ ID NO: 901950 - DNA, 25 bp, Mus musculus
tgtccagcttcgttacttgcacact

SEQ ID NO: 901951 - DNA, 25 bp, Mus musculus
tgtccaggaaacaccgtgcttattt

SEQ ID NO: 901952 - DNA, 25 bp, Mus musculus
tgtccaggaaactccgtgcttattt

SEQ ID NO: 901953 - DNA, 25 bp, Mus musculus
tgtccaggaacgcttgacaccccat

SEQ ID NO: 901954 - DNA, 25 bp, Mus musculus
tgtccaggaacggttgacaccccat

SEQ ID NO: 901955 - DNA, 25 bp, Mus musculus
tgtccaggaatcacccatcaaagcc

SEQ ID NO: 901956 - DNA, 25 bp, Mus musculus
tgtccaggaatctcccatcaaagcc

SEQ ID NO: 901957 - DNA, 25 bp, Mus musculus
tgtccaggacacagttagagcatgt

SEQ ID NO: 901958 - DNA, 25 bp, Mus musculus
tgtccaggacactgttagagcatgt

SEQ ID NO: 901959 - DNA, 25 bp, Mus musculus
tgtccaggaccccttgttcagatgt

SEQ ID NO: 901960 - DNA, 25 bp, Mus musculus
tgtccaggacccgttgttcagatgt

SEQ ID NO: 901961 - DNA, 25 bp, Mus musculus
tgtccaggactgaatctagctgttt

SEQ ID NO: 901962 - DNA, 25 bp, Mus musculus
tgtccaggactgtatctagctgttt

SEQ ID NO: 901963 - DNA, 25 bp, Mus musculus
tgtccaggcaggagccatgacacag

SEQ ID NO: 901964 - DNA, 25 bp, Mus musculus
tgtccaggcaggtgccatgacacag

SEQ ID NO: 901965 - DNA, 25 bp, Mus musculus
tgtccaggccccagaagggcaattt

SEQ ID NO: 901966 - DNA, 25 bp, Mus musculus
tgtccaggcccctgaagggcaattt

SEQ ID NO: 901967 - DNA, 25 bp, Mus musculus
tgtccaggctaacctataccaccat

SEQ ID NO: 901968 - DNA, 25 bp, Mus musculus
tgtccaggctaagctataccaccat

SEQ ID NO: 901969 - DNA, 25 bp, Mus musculus
tgtccaggtcccatccggttatggt

SEQ ID NO: 901970 - DNA, 25 bp, Mus musculus
tgtccaggtcccttccggttatggt

SEQ ID NO: 901971 - DNA, 25 bp, Mus musculus
tgtccaggtcctcaaaatcgctcag

SEQ ID NO: 901972 - DNA, 25 bp, Mus musculus
tgtccaggtcctgaaaatcgctcag

SEQ ID NO: 901973 - DNA, 25 bp, Mus musculus
tgtccaggtcttcactgtgccagta

SEQ ID NO: 901974 - DNA, 25 bp, Mus musculus
tgtccaggtcttgactgtgccagta

SEQ ID NO: 901975 - DNA, 25 bp, Mus musculus
tgtccaggtggacacgccggctgca

SEQ ID NO: 901976 - DNA, 25 bp, Mus musculus
tgtccaggtggagacgccggctgca

SEQ ID NO: 901977 - DNA, 25 bp, Mus musculus
tgtccaggttagctcagagcagaga

SEQ ID NO: 901978 - DNA, 25 bp, Mus musculus
tgtccaggttaggtcagagcagaga

SEQ ID NO: 901979 - DNA, 25 bp, Mus musculus
tgtccaggttgcactagaatcttat

SEQ ID NO: 901980 - DNA, 25 bp, Mus musculus
tgtccaggttgctctagaatcttat

SEQ ID NO: 901981 - DNA, 25 bp, Mus musculus
tgtccaggttgtacagtgccaccag

SEQ ID NO: 901982 - DNA, 25 bp, Mus musculus
tgtccaggttgttcagtgccaccag

SEQ ID NO: 901983 - DNA, 25 bp, Mus musculus
tgtccagtaaccacccatgtaatgt

SEQ ID NO: 901984 - DNA, 25 bp, Mus musculus
tgtccagtaacctcccatgtaatgt

SEQ ID NO: 901985 - DNA, 25 bp, Mus musculus
tgtccagtacttagtcttcttccag

SEQ ID NO: 901986 - DNA, 25 bp, Mus musculus
tgtccagtactttgtcttcttccag

SEQ ID NO: 901987 - DNA, 25 bp, Mus musculus
tgtccagtagagagattttgctttc

SEQ ID NO: 901988 - DNA, 25 bp, Mus musculus
tgtccagtagagtgattttgctttc

SEQ ID NO: 901989 - DNA, 25 bp, Mus musculus
tgtccagtagatagcacgctagcgt

SEQ ID NO: 901990 - DNA, 25 bp, Mus musculus
tgtccagtagattgcacgctagcgt

SEQ ID NO: 901991 - DNA, 25 bp, Mus musculus
tgtccagtagtactgccaagccctt

SEQ ID NO: 901992 - DNA, 25 bp, Mus musculus
tgtccagtagtagtgccaagccctt

SEQ ID NO: 901993 - DNA, 25 bp, Mus musculus
tgtccagtcactctagggttgtaca

SEQ ID NO: 901994 - DNA, 25 bp, Mus musculus
tgtccagtcactgtagggttgtaca

SEQ ID NO: 901995 - DNA, 25 bp, Mus musculus
tgtccagtccatctggccttcaaaa

SEQ ID NO: 901996 - DNA, 25 bp, Mus musculus
tgtccagtccatgtggccttcaaaa

SEQ ID NO: 901997 - DNA, 25 bp, Mus musculus
tgtccagtcgtcacaagctcttctc

SEQ ID NO: 901998 - DNA, 25 bp, Mus musculus
tgtccagtcgtctcaagctcttctc

SEQ ID NO: 901999 - DNA, 25 bp, Mus musculus
tgtccagtcttgctagctgtccctg

SEQ ID NO: 902000 - DNA, 25 bp, Mus musculus
tgtccagtcttggtagctgtccctg

SEQ ID NO: 902001 - DNA, 25 bp, Mus musculus
tgtccagtgcctaacactctgtgga

SEQ ID NO: 902002 - DNA, 25 bp, Mus musculus
tgtccagtgccttacactctgtgga

SEQ ID NO: 902003 - DNA, 25 bp, Mus musculus
tgtccagtggagaaggtacgcagtt

SEQ ID NO: 902004 - DNA, 25 bp, Mus musculus
tgtccagtggagtaggtacgcagtt

SEQ ID NO: 902005 - DNA, 25 bp, Mus musculus
tgtccagtggctcttccgacagttt

SEQ ID NO: 902006 - DNA, 25 bp, Mus musculus
tgtccagtggctgttccgacagttt

SEQ ID NO: 902007 - DNA, 25 bp, Mus musculus
tgtccagtgtggattgagtgctgct

SEQ ID NO: 902008 - DNA, 25 bp, Mus musculus
tgtccagtgtggtttgagtgctgct

SEQ ID NO: 902009 - DNA, 25 bp, Mus musculus
tgtccagttagacatgccagcaaat

SEQ ID NO: 902010 - DNA, 25 bp, Mus musculus
tgtccagttagagatgccagcaaat

SEQ ID NO: 902011 - DNA, 25 bp, Mus musculus
tgtccagttgatacaattccccttt

SEQ ID NO: 902012 - DNA, 25 bp, Mus musculus
tgtccagttgattcaattccccttt

SEQ ID NO: 902013 - DNA, 25 bp, Mus musculus
tgtccagtttgtccccttcagggac

SEQ ID NO: 902014 - DNA, 25 bp, Mus musculus
tgtccagtttgtgcccttcagggac

SEQ ID NO: 902015 - DNA, 25 bp, Mus musculus
tgtccatagaggaggctggctttct

SEQ ID NO: 902016 - DNA, 25 bp, Mus musculus
tgtccatagaggtggctggctttct

SEQ ID NO: 902017 - DNA, 25 bp, Mus musculus
tgtccatagcagagcgggccgagtt

SEQ ID NO: 902018 - DNA, 25 bp, Mus musculus
tgtccatagcagtgcgggccgagtt

SEQ ID NO: 902019 - DNA, 25 bp, Mus musculus
tgtccatagtttagtgcccacacag

SEQ ID NO: 902020 - DNA, 25 bp, Mus musculus
tgtccatagttttgtgcccacacag

SEQ ID NO: 902021 - DNA, 25 bp, Mus musculus
tgtccatatggaaatagacttctgt

SEQ ID NO: 902022 - DNA, 25 bp, Mus musculus
tgtccatatggatatagacttctgt

SEQ ID NO: 902023 - DNA, 25 bp, Mus musculus
tgtccatcacctacagctgtgagct

SEQ ID NO: 902024 - DNA, 25 bp, Mus musculus
tgtccatcacctagatcttaactgc

SEQ ID NO: 902025 - DNA, 25 bp, Mus musculus
tgtccatcaccttcagctgtgagct

SEQ ID NO: 902026 - DNA, 25 bp, Mus musculus
tgtccatcaccttgatcttaactgc

SEQ ID NO: 902027 - DNA, 25 bp, Mus musculus
tgtccatcaggtcgcagtacttctt

SEQ ID NO: 902028 - DNA, 25 bp, Mus musculus
tgtccatcaggtggcagtacttctt

SEQ ID NO: 902029 - DNA, 25 bp, Mus musculus
tgtccatcagtaatactccttgctc

SEQ ID NO: 902030 - DNA, 25 bp, Mus musculus
tgtccatcagtattactccttgctc

SEQ ID NO: 902031 - DNA, 25 bp, Mus musculus
tgtccatcatagcttgttctccgtg

SEQ ID NO: 902032 - DNA, 25 bp, Mus musculus
tgtccatcataggttgttctccgtg

SEQ ID NO: 902033 - DNA, 25 bp, Mus musculus
tgtccatccaaaagtggcagttctc

SEQ ID NO: 902034 - DNA, 25 bp, Mus musculus
tgtccatccaaatgtggcagttctc

SEQ ID NO: 902035 - DNA, 25 bp, Mus musculus
tgtccatcccataacataacagttt

SEQ ID NO: 902036 - DNA, 25 bp, Mus musculus
tgtccatcccattacataacagttt

SEQ ID NO: 902037 - DNA, 25 bp, Mus musculus
tgtccatccccactgttcatgtttg

SEQ ID NO: 902038 - DNA, 25 bp, Mus musculus
tgtccatccccagtgttcatgtttg

SEQ ID NO: 902039 - DNA, 25 bp, Mus musculus
tgtccatcctaactaccacaaagag

SEQ ID NO: 902040 - DNA, 25 bp, Mus musculus
tgtccatcctaagtaccacaaagag

SEQ ID NO: 902041 - DNA, 25 bp, Mus musculus
tgtccatcctgaattggtgggcttg

SEQ ID NO: 902042 - DNA, 25 bp, Mus musculus
tgtccatcctgatttggtgggcttg

SEQ ID NO: 902043 - DNA, 25 bp, Mus musculus
tgtccatcggcaatctacacgggaa

SEQ ID NO: 902044 - DNA, 25 bp, Mus musculus
tgtccatcggcattctacacgggaa

SEQ ID NO: 902045 - DNA, 25 bp, Mus musculus
tgtccatcgtgtccctgatgatcac

SEQ ID NO: 902046 - DNA, 25 bp, Mus musculus
tgtccatcgtgtgcctgatgatcac

SEQ ID NO: 902047 - DNA, 25 bp, Mus musculus
tgtccatctctgcttttggatgtaa

SEQ ID NO: 902048 - DNA, 25 bp, Mus musculus
tgtccatctctggttttggatgtaa

SEQ ID NO: 902049 - DNA, 25 bp, Mus musculus
tgtccatctggtacgctaaccatgt

SEQ ID NO: 902050 - DNA, 25 bp, Mus musculus
tgtccatctggttcgctaaccatgt

SEQ ID NO: 902051 - DNA, 25 bp, Mus musculus
tgtccatctgtacgcttgtcagaca

SEQ ID NO: 902052 - DNA, 25 bp, Mus musculus
tgtccatctgtaggcttgtcagaca

SEQ ID NO: 902053 - DNA, 25 bp, Mus musculus
tgtccatgacaacttacaaactgta

SEQ ID NO: 902054 - DNA, 25 bp, Mus musculus
tgtccatgacaagttacaaactgta

SEQ ID NO: 902055 - DNA, 25 bp, Mus musculus
tgtccatgagagaggagtcaggcat

SEQ ID NO: 902056 - DNA, 25 bp, Mus musculus
tgtccatgagagtggagtcaggcat

SEQ ID NO: 902057 - DNA, 25 bp, Mus musculus
tgtccatgattgaccttagaaggtc

SEQ ID NO: 902058 - DNA, 25 bp, Mus musculus
tgtccatgattgtccttagaaggtc

SEQ ID NO: 902059 - DNA, 25 bp, Mus musculus
tgtccatgcggtcgtgtacatcgtg

SEQ ID NO: 902060 - DNA, 25 bp, Mus musculus
tgtccatgcggtggtgtacatcgtg

SEQ ID NO: 902061 - DNA, 25 bp, Mus musculus
tgtccatgcttaaggaaccgcctct

SEQ ID NO: 902062 - DNA, 25 bp, Mus musculus
tgtccatgcttatggaaccgcctct

SEQ ID NO: 902063 - DNA, 25 bp, Mus musculus
tgtccatggacacagcacctagctt

SEQ ID NO: 902064 - DNA, 25 bp, Mus musculus
tgtccatggacagagcacctagctt

SEQ ID NO: 902065 - DNA, 25 bp, Mus musculus
tgtccatggcacagtatcacatctg

SEQ ID NO: 902066 - DNA, 25 bp, Mus musculus
tgtccatggcactgtatcacatctg

SEQ ID NO: 902067 - DNA, 25 bp, Mus musculus
tgtccatggtttctgagtgtctgtt

SEQ ID NO: 902068 - DNA, 25 bp, Mus musculus
tgtccatggtttgtgagtgtctgtt

SEQ ID NO: 902069 - DNA, 25 bp, Mus musculus
tgtccatgtagcactgccattggca

SEQ ID NO: 902070 - DNA, 25 bp, Mus musculus
tgtccatgtagctctgccattggca

SEQ ID NO: 902071 - DNA, 25 bp, Mus musculus
tgtccattcaaaccctacagtgcca

SEQ ID NO: 902072 - DNA, 25 bp, Mus musculus
tgtccattcaaagcctacagtgcca

SEQ ID NO: 902073 - DNA, 25 bp, Mus musculus
tgtccattcaataccaaatattggt

SEQ ID NO: 902074 - DNA, 25 bp, Mus musculus
tgtccattcaattccaaatattggt

SEQ ID NO: 902075 - DNA, 25 bp, Mus musculus
tgtccattcacaaccattctgttaa

SEQ ID NO: 902076 - DNA, 25 bp, Mus musculus
tgtccattcacatccattctgttaa

SEQ ID NO: 902077 - DNA, 25 bp, Mus musculus
tgtccattcatcacatttctatctc

SEQ ID NO: 902078 - DNA, 25 bp, Mus musculus
tgtccattcatctcatttctatctc

SEQ ID NO: 902079 - DNA, 25 bp, Mus musculus
tgtccattcccaaactcttcaagat

SEQ ID NO: 902080 - DNA, 25 bp, Mus musculus
tgtccattcccaaagaccggccccg

SEQ ID NO: 902081 - DNA, 25 bp, Mus musculus
tgtccattcccatactcttcaagat

SEQ ID NO: 902082 - DNA, 25 bp, Mus musculus
tgtccattcccatagaccggccccg

SEQ ID NO: 902083 - DNA, 25 bp, Mus musculus
tgtccattcgttctcaagtcacaga

SEQ ID NO: 902084 - DNA, 25 bp, Mus musculus
tgtccattcgttgtcaagtcacaga

SEQ ID NO: 902085 - DNA, 25 bp, Mus musculus
tgtccattctgacggagccgttctc

SEQ ID NO: 902086 - DNA, 25 bp, Mus musculus
tgtccattctgagggagccgttctc

SEQ ID NO: 902087 - DNA, 25 bp, Mus musculus
tgtccattgatccttgtgtgaccaa

SEQ ID NO: 902088 - DNA, 25 bp, Mus musculus
tgtccattgatcgttgtgtgaccaa

SEQ ID NO: 902089 - DNA, 25 bp, Mus musculus
tgtccattgctgatggcacagggat

SEQ ID NO: 902090 - DNA, 25 bp, Mus musculus
tgtccattgctgttggcacagggat

SEQ ID NO: 902091 - DNA, 25 bp, Mus musculus
tgtccattggccctgtgcaaatatg

SEQ ID NO: 902092 - DNA, 25 bp, Mus musculus
tgtccattggccgtgtgcaaatatg

SEQ ID NO: 902093 - DNA, 25 bp, Mus musculus
tgtccatttctcaaactgtccattt

SEQ ID NO: 902094 - DNA, 25 bp, Mus musculus
tgtccatttctctaactgtccattt

SEQ ID NO: 902095 - DNA, 25 bp, Mus musculus
tgtccatttcttcttgctcctaaag

SEQ ID NO: 902096 - DNA, 25 bp, Mus musculus
tgtccatttcttgttgctcctaaag

SEQ ID NO: 902097 - DNA, 25 bp, Mus musculus
tgtccatttttaaatcacaatactc

SEQ ID NO: 902098 - DNA, 25 bp, Mus musculus
tgtccatttttatatcacaatactc

SEQ ID NO: 902099 - DNA, 25 bp, Mus musculus
tgtcccaaaataacgctgagccaag

SEQ ID NO: 902100 - DNA, 25 bp, Mus musculus
tgtcccaaaatatcgctgagccaag

SEQ ID NO: 902101 - DNA, 25 bp, Mus musculus
tgtcccaaacctcagatggaattta

SEQ ID NO: 902102 - DNA, 25 bp, Mus musculus
tgtcccaaacctgagatggaattta

SEQ ID NO: 902103 - DNA, 25 bp, Mus musculus
tgtcccaaagcacccaagttagagg

SEQ ID NO: 902104 - DNA, 25 bp, Mus musculus
tgtcccaaagcagccaagttagagg

SEQ ID NO: 902105 - DNA, 25 bp, Mus musculus
tgtcccaaccttagtagtcctgctg

SEQ ID NO: 902106 - DNA, 25 bp, Mus musculus
tgtcccaacctttgtagtcctgctg

SEQ ID NO: 902107 - DNA, 25 bp, Mus musculus
tgtcccaagagtcacgggcttcctt

SEQ ID NO: 902108 - DNA, 25 bp, Mus musculus
tgtcccaagagtgacgggcttcctt

SEQ ID NO: 902109 - DNA, 25 bp, Mus musculus
tgtcccaagccgactgcgcacgaga

SEQ ID NO: 902110 - DNA, 25 bp, Mus musculus
tgtcccaagccgtctgcgcacgaga

SEQ ID NO: 902111 - DNA, 25 bp, Mus musculus
tgtcccaagtgtaaagaaatcctgt

SEQ ID NO: 902112 - DNA, 25 bp, Mus musculus
tgtcccaagtgttaagaaatcctgt

SEQ ID NO: 902113 - DNA, 25 bp, Mus musculus
tgtcccaatagcatctagctctggg

SEQ ID NO: 902114 - DNA, 25 bp, Mus musculus
tgtcccaatagcttctagctctggg

SEQ ID NO: 902115 - DNA, 25 bp, Mus musculus
tgtcccaatcctccctagaagttat

SEQ ID NO: 902116 - DNA, 25 bp, Mus musculus
tgtcccaatcctgcctagaagttat

SEQ ID NO: 902117 - DNA, 25 bp, Mus musculus
tgtcccacagagagcaccacggaac

SEQ ID NO: 902118 - DNA, 25 bp, Mus musculus
tgtcccacagagtgcaccacggaac

SEQ ID NO: 902119 - DNA, 25 bp, Mus musculus
tgtcccacagttcctatctgggttt

SEQ ID NO: 902120 - DNA, 25 bp, Mus musculus
tgtcccacagttgctatctgggttt

SEQ ID NO: 902121 - DNA, 25 bp, Mus musculus
tgtcccacatgcatcaccgtgaagg

SEQ ID NO: 902122 - DNA, 25 bp, Mus musculus
tgtcccacatgcttcaccgtgaagg

SEQ ID NO: 902123 - DNA, 25 bp, Mus musculus
tgtcccaccctaaatggcctagaat

SEQ ID NO: 902124 - DNA, 25 bp, Mus musculus
tgtcccaccctatatggcctagaat

SEQ ID NO: 902125 - DNA, 25 bp, Mus musculus
tgtcccacccttcagaagctaaaaa

SEQ ID NO: 902126 - DNA, 25 bp, Mus musculus
tgtcccacccttgagaagctaaaaa

SEQ ID NO: 902127 - DNA, 25 bp, Mus musculus
tgtcccacctagaaggaacgctcag

SEQ ID NO: 902128 - DNA, 25 bp, Mus musculus
tgtcccacctagtaggaacgctcag

SEQ ID NO: 902129 - DNA, 25 bp, Mus musculus
tgtcccacgagcagtcaaagcgcta

SEQ ID NO: 902130 - DNA, 25 bp, Mus musculus
tgtcccacgagctgtcaaagcgcta

SEQ ID NO: 902131 - DNA, 25 bp, Mus musculus
tgtcccacggaaaggatcccaatct

SEQ ID NO: 902132 - DNA, 25 bp, Mus musculus
tgtcccacggaatggatcccaatct

SEQ ID NO: 902133 - DNA, 25 bp, Mus musculus
tgtcccacggacagacgcagaagtt

SEQ ID NO: 902134 - DNA, 25 bp, Mus musculus
tgtcccacggactgacgcagaagtt

SEQ ID NO: 902135 - DNA, 25 bp, Mus musculus
tgtcccacggtgcagacctctgaga

SEQ ID NO: 902136 - DNA, 25 bp, Mus musculus
tgtcccacggtggagacctctgaga

SEQ ID NO: 902137 - DNA, 25 bp, Mus musculus
tgtcccacgtaaccatgagcagcgc

SEQ ID NO: 902138 - DNA, 25 bp, Mus musculus
tgtcccacgtaagcatgagcagcgc

SEQ ID NO: 902139 - DNA, 25 bp, Mus musculus
tgtcccacgtggacatatagcacaa

SEQ ID NO: 902140 - DNA, 25 bp, Mus musculus
tgtcccacgtggcagaagtatttat

SEQ ID NO: 902141 - DNA, 25 bp, Mus musculus
tgtcccacgtgggagaagtatttat

SEQ ID NO: 902142 - DNA, 25 bp, Mus musculus
tgtcccacgtggtcatatagcacaa

SEQ ID NO: 902143 - DNA, 25 bp, Mus musculus
tgtcccactaacaaccatagctttc

SEQ ID NO: 902144 - DNA, 25 bp, Mus musculus
tgtcccactaactaccatagctttc

SEQ ID NO: 902145 - DNA, 25 bp, Mus musculus
tgtcccactaggaaacagcctgtga

SEQ ID NO: 902146 - DNA, 25 bp, Mus musculus
tgtcccactaggtaacagcctgtga

SEQ ID NO: 902147 - DNA, 25 bp, Mus musculus
tgtcccactcaacatgctcagtatg

SEQ ID NO: 902148 - DNA, 25 bp, Mus musculus
tgtcccactcaagatgctcagtatg

SEQ ID NO: 902149 - DNA, 25 bp, Mus musculus
tgtcccactcctctctgaggataaa

SEQ ID NO: 902150 - DNA, 25 bp, Mus musculus
tgtcccactcctgtctgaggataaa

SEQ ID NO: 902151 - DNA, 25 bp, Mus musculus
tgtcccactggaccgtcagtgtgga

SEQ ID NO: 902152 - DNA, 25 bp, Mus musculus
tgtcccactggagcgtcagtgtgga

SEQ ID NO: 902153 - DNA, 25 bp, Mus musculus
tgtcccactgggactcaaatgaagc

SEQ ID NO: 902154 - DNA, 25 bp, Mus musculus
tgtcccactgggactgagaaattga

SEQ ID NO: 902155 - DNA, 25 bp, Mus musculus
tgtcccactgggtctcaaatgaagc

SEQ ID NO: 902156 - DNA, 25 bp, Mus musculus
tgtcccactgggtctgagaaattga

SEQ ID NO: 902157 - DNA, 25 bp, Mus musculus
tgtcccacttaaaaccgtccgatgt

SEQ ID NO: 902158 - DNA, 25 bp, Mus musculus
tgtcccacttaataccgtccgatgt

SEQ ID NO: 902159 - DNA, 25 bp, Mus musculus
tgtcccacttccctgtgtgtagcat

SEQ ID NO: 902160 - DNA, 25 bp, Mus musculus
tgtcccacttccgtgtgtgtagcat

SEQ ID NO: 902161 - DNA, 25 bp, Mus musculus
tgtcccacttgccttatgtcaaata

SEQ ID NO: 902162 - DNA, 25 bp, Mus musculus
tgtcccacttgcgttatgtcaaata

SEQ ID NO: 902163 - DNA, 25 bp, Mus musculus
tgtcccactttcctagcgaagcttg

SEQ ID NO: 902164 - DNA, 25 bp, Mus musculus
tgtcccactttcgtagcgaagcttg

SEQ ID NO: 902165 - DNA, 25 bp, Mus musculus
tgtcccacttttaacacgggtgttg

SEQ ID NO: 902166 - DNA, 25 bp, Mus musculus
tgtcccactttttacacgggtgttg

SEQ ID NO: 902167 - DNA, 25 bp, Mus musculus
tgtcccagactgacttcgattccaa

SEQ ID NO: 902168 - DNA, 25 bp, Mus musculus
tgtcccagactgtcttcgattccaa

SEQ ID NO: 902169 - DNA, 25 bp, Mus musculus
tgtcccagatggacacttgagtttt

SEQ ID NO: 902170 - DNA, 25 bp, Mus musculus
tgtcccagatggtcacttgagtttt

SEQ ID NO: 902171 - DNA, 25 bp, Mus musculus
tgtcccagccagctacctttttagt

SEQ ID NO: 902172 - DNA, 25 bp, Mus musculus
tgtcccagccaggtacctttttagt

SEQ ID NO: 902173 - DNA, 25 bp, Mus musculus
tgtcccagccttaaaacccaacagg

SEQ ID NO: 902174 - DNA, 25 bp, Mus musculus
tgtcccagcctttaaacccaacagg

SEQ ID NO: 902175 - DNA, 25 bp, Mus musculus
tgtcccaggatactgccagcagtgg

SEQ ID NO: 902176 - DNA, 25 bp, Mus musculus
tgtcccaggatagtgccagcagtgg

SEQ ID NO: 902177 - DNA, 25 bp, Mus musculus
tgtcccaggcatagacctctgtgat

SEQ ID NO: 902178 - DNA, 25 bp, Mus musculus
tgtcccaggcattgacctctgtgat

SEQ ID NO: 902179 - DNA, 25 bp, Mus musculus
tgtcccaggccaaactgtctgtctg

SEQ ID NO: 902180 - DNA, 25 bp, Mus musculus
tgtcccaggccatactgtctgtctg

SEQ ID NO: 902181 - DNA, 25 bp, Mus musculus
tgtcccaggctaaggccatgcagta

SEQ ID NO: 902182 - DNA, 25 bp, Mus musculus
tgtcccaggctatggccatgcagta

SEQ ID NO: 902183 - DNA, 25 bp, Mus musculus
tgtcccagggacagcgctgctaatg

SEQ ID NO: 902184 - DNA, 25 bp, Mus musculus
tgtcccagggactgcgctgctaatg

SEQ ID NO: 902185 - DNA, 25 bp, Mus musculus
tgtcccaggtaaagcaaaactctgt

SEQ ID NO: 902186 - DNA, 25 bp, Mus musculus
tgtcccaggtaatgcaaaactctgt

SEQ ID NO: 902187 - DNA, 25 bp, Mus musculus
tgtcccagtccacctcagtgaagtg

SEQ ID NO: 902188 - DNA, 25 bp, Mus musculus
tgtcccagtccagctcagtgaagtg

SEQ ID NO: 902189 - DNA, 25 bp, Mus musculus
tgtcccagtgacacgtctgatgggt

SEQ ID NO: 902190 - DNA, 25 bp, Mus musculus
tgtcccagtgacagcatgcttaata

SEQ ID NO: 902191 - DNA, 25 bp, Mus musculus
tgtcccagtgactcgtctgatgggt

SEQ ID NO: 902192 - DNA, 25 bp, Mus musculus
tgtcccagtgactgcatgcttaata

SEQ ID NO: 902193 - DNA, 25 bp, Mus musculus
tgtcccagtgcccacctctttgcat

SEQ ID NO: 902194 - DNA, 25 bp, Mus musculus
tgtcccagtgccgacctctttgcat

SEQ ID NO: 902195 - DNA, 25 bp, Mus musculus
tgtcccagtggcctacggtggctcc

SEQ ID NO: 902196 - DNA, 25 bp, Mus musculus
tgtcccagtggcgtacggtggctcc

SEQ ID NO: 902197 - DNA, 25 bp, Mus musculus
tgtcccagtgtcagtaccaatgcgt

SEQ ID NO: 902198 - DNA, 25 bp, Mus musculus
tgtcccagtgtctgtaccaatgcgt

SEQ ID NO: 902199 - DNA, 25 bp, Mus musculus
tgtcccataccgcttctaggaagag

SEQ ID NO: 902200 - DNA, 25 bp, Mus musculus
tgtcccataccggttctaggaagag

SEQ ID NO: 902201 - DNA, 25 bp, Mus musculus
tgtcccatagccaggtgacctagct

SEQ ID NO: 902202 - DNA, 25 bp, Mus musculus
tgtcccatagcctggtgacctagct

SEQ ID NO: 902203 - DNA, 25 bp, Mus musculus
tgtcccatcacacagcttttaacac

SEQ ID NO: 902204 - DNA, 25 bp, Mus musculus
tgtcccatcacagagcttttaacac

SEQ ID NO: 902205 - DNA, 25 bp, Mus musculus
tgtcccatcctgagtactactttag

SEQ ID NO: 902206 - DNA, 25 bp, Mus musculus
tgtcccatcctgtgtactactttag

SEQ ID NO: 902207 - DNA, 25 bp, Mus musculus
tgtcccatcggacgcagctatatat

SEQ ID NO: 902208 - DNA, 25 bp, Mus musculus
tgtcccatcggaggcagctatatat

SEQ ID NO: 902209 - DNA, 25 bp, Mus musculus
tgtcccatctacatctttgtgcagc

SEQ ID NO: 902210 - DNA, 25 bp, Mus musculus
tgtcccatctacctggtcaatgtgt

SEQ ID NO: 902211 - DNA, 25 bp, Mus musculus
tgtcccatctacgtggtcaatgtgt

SEQ ID NO: 902212 - DNA, 25 bp, Mus musculus
tgtcccatctacttctttgtgcagc

SEQ ID NO: 902213 - DNA, 25 bp, Mus musculus
tgtcccatctcactttgcaaaaagc

SEQ ID NO: 902214 - DNA, 25 bp, Mus musculus
tgtcccatctcagtttgcaaaaagc

SEQ ID NO: 902215 - DNA, 25 bp, Mus musculus
tgtcccatctctccgtaggcatctt

SEQ ID NO: 902216 - DNA, 25 bp, Mus musculus
tgtcccatctctgcgtaggcatctt

SEQ ID NO: 902217 - DNA, 25 bp, Mus musculus
tgtcccatctgtaacagcatctttg

SEQ ID NO: 902218 - DNA, 25 bp, Mus musculus
tgtcccatctgttacagcatctttg

SEQ ID NO: 902219 - DNA, 25 bp, Mus musculus
tgtcccatcttcagagagggcttct

SEQ ID NO: 902220 - DNA, 25 bp, Mus musculus
tgtcccatcttctgagagggcttct

SEQ ID NO: 902221 - DNA, 25 bp, Mus musculus
tgtcccatgggaaatgggctccttt

SEQ ID NO: 902222 - DNA, 25 bp, Mus musculus
tgtcccatgggatatgggctccttt

SEQ ID NO: 902223 - DNA, 25 bp, Mus musculus
tgtcccatgtcccaccaagagaaag

SEQ ID NO: 902224 - DNA, 25 bp, Mus musculus
tgtcccatgtccgaccaagagaaag

SEQ ID NO: 902225 - DNA, 25 bp, Mus musculus
tgtcccatgtggaaaacccaatgcg

SEQ ID NO: 902226 - DNA, 25 bp, Mus musculus
tgtcccatgtggacctcactgactg

SEQ ID NO: 902227 - DNA, 25 bp, Mus musculus
tgtcccatgtggtaaacccaatgcg

SEQ ID NO: 902228 - DNA, 25 bp, Mus musculus
tgtcccatgtggtcctcactgactg

SEQ ID NO: 902229 - DNA, 25 bp, Mus musculus
tgtcccatgttcatatagttccttg

SEQ ID NO: 902230 - DNA, 25 bp, Mus musculus
tgtcccatgttcttatagttccttg

SEQ ID NO: 902231 - DNA, 25 bp, Mus musculus
tgtcccattacaatagtgcagagta

SEQ ID NO: 902232 - DNA, 25 bp, Mus musculus
tgtcccattacattagtgcagagta

SEQ ID NO: 902233 - DNA, 25 bp, Mus musculus
tgtcccattagtacttttcaggcat

SEQ ID NO: 902234 - DNA, 25 bp, Mus musculus
tgtcccattagttcttttcaggcat

SEQ ID NO: 902235 - DNA, 25 bp, Mus musculus
tgtccccaaacaaatggcaatctcc

SEQ ID NO: 902236 - DNA, 25 bp, Mus musculus
tgtccccaaacatatggcaatctcc

SEQ ID NO: 902237 - DNA, 25 bp, Mus musculus
tgtccccaaagaactgagcaactgt

SEQ ID NO: 902238 - DNA, 25 bp, Mus musculus
tgtccccaaagatctgagcaactgt

SEQ ID NO: 902239 - DNA, 25 bp, Mus musculus
tgtccccaacagcagaattttagat

SEQ ID NO: 902240 - DNA, 25 bp, Mus musculus
tgtccccaacaggagaattttagat

SEQ ID NO: 902241 - DNA, 25 bp, Mus musculus
tgtccccaaccccatatacaagttt

SEQ ID NO: 902242 - DNA, 25 bp, Mus musculus
tgtccccaacccgatatacaagttt

SEQ ID NO: 902243 - DNA, 25 bp, Mus musculus
tgtccccaacgaagtcagggcgcag

SEQ ID NO: 902244 - DNA, 25 bp, Mus musculus
tgtccccaacgatgtcagggcgcag

SEQ ID NO: 902245 - DNA, 25 bp, Mus musculus
tgtccccagaacagaatgacgctgt

SEQ ID NO: 902246 - DNA, 25 bp, Mus musculus
tgtccccagaacagagaggtggctt

SEQ ID NO: 902247 - DNA, 25 bp, Mus musculus
tgtccccagaactgaatgacgctgt

SEQ ID NO: 902248 - DNA, 25 bp, Mus musculus
tgtccccagaactgagaggtggctt

SEQ ID NO: 902249 - DNA, 25 bp, Mus musculus
tgtccccagccaagcgccgtggtag

SEQ ID NO: 902250 - DNA, 25 bp, Mus musculus
tgtccccagccatgcgccgtggtag

SEQ ID NO: 902251 - DNA, 25 bp, Mus musculus
tgtccccagctaccttgtcactatg

SEQ ID NO: 902252 - DNA, 25 bp, Mus musculus
tgtccccagctagcttgtcactatg

SEQ ID NO: 902253 - DNA, 25 bp, Mus musculus
tgtccccagctgacaagttaacgat

SEQ ID NO: 902254 - DNA, 25 bp, Mus musculus
tgtccccagctgtcaagttaacgat

SEQ ID NO: 902255 - DNA, 25 bp, Mus musculus
tgtccccagtgcatcttgatgaaga

SEQ ID NO: 902256 - DNA, 25 bp, Mus musculus
tgtccccagtgcttcttgatgaaga

SEQ ID NO: 902257 - DNA, 25 bp, Mus musculus
tgtccccagtttatcagtgctaatg

SEQ ID NO: 902258 - DNA, 25 bp, Mus musculus
tgtccccagtttttcagtgctaatg

SEQ ID NO: 902259 - DNA, 25 bp, Mus musculus
tgtccccatacaaaaggcctttgct

SEQ ID NO: 902260 - DNA, 25 bp, Mus musculus
tgtccccatacataaggcctttgct

SEQ ID NO: 902261 - DNA, 25 bp, Mus musculus
tgtccccataccaactgctaaatac

SEQ ID NO: 902262 - DNA, 25 bp, Mus musculus
tgtccccatacctactgctaaatac

SEQ ID NO: 902263 - DNA, 25 bp, Mus musculus
tgtccccatccacagacaggaatgg

SEQ ID NO: 902264 - DNA, 25 bp, Mus musculus
tgtccccatccagagacaggaatgg

SEQ ID NO: 902265 - DNA, 25 bp, Mus musculus
tgtccccgaagcacctatctgagga

SEQ ID NO: 902266 - DNA, 25 bp, Mus musculus
tgtccccgaagctcctatctgagga

SEQ ID NO: 902267 - DNA, 25 bp, Mus musculus
tgtccccgagccagggtctataaac

SEQ ID NO: 902268 - DNA, 25 bp, Mus musculus
tgtccccgagcctgggtctataaac

SEQ ID NO: 902269 - DNA, 25 bp, Mus musculus
tgtccccggagcacttgagaaagat

SEQ ID NO: 902270 - DNA, 25 bp, Mus musculus
tgtccccggagctcttgagaaagat

SEQ ID NO: 902271 - DNA, 25 bp, Mus musculus
tgtccccggtagctttcactaagga

SEQ ID NO: 902272 - DNA, 25 bp, Mus musculus
tgtccccggtaggtttcactaagga

SEQ ID NO: 902273 - DNA, 25 bp, Mus musculus
tgtcccctaattcgaaatgcagctg

SEQ ID NO: 902274 - DNA, 25 bp, Mus musculus
tgtcccctaattggaaatgcagctg

SEQ ID NO: 902275 - DNA, 25 bp, Mus musculus
tgtcccctacacatgtccagtgaga

SEQ ID NO: 902276 - DNA, 25 bp, Mus musculus
tgtcccctacacttgtccagtgaga

SEQ ID NO: 902277 - DNA, 25 bp, Mus musculus
tgtcccctcagcatgagtgtggcaa

SEQ ID NO: 902278 - DNA, 25 bp, Mus musculus
tgtcccctcagcttgagtgtggcaa

SEQ ID NO: 902279 - DNA, 25 bp, Mus musculus
tgtcccctcataccagagtagtatt

SEQ ID NO: 902280 - DNA, 25 bp, Mus musculus
tgtcccctcatagcagagtagtatt

SEQ ID NO: 902281 - DNA, 25 bp, Mus musculus
tgtcccctccttagagactagatac

SEQ ID NO: 902282 - DNA, 25 bp, Mus musculus
tgtcccctcctttgagactagatac

SEQ ID NO: 902283 - DNA, 25 bp, Mus musculus
tgtcccctcttgacagaacggtgca

SEQ ID NO: 902284 - DNA, 25 bp, Mus musculus
tgtcccctcttgtcagaacggtgca

SEQ ID NO: 902285 - DNA, 25 bp, Mus musculus
tgtcccctctttattgtgatggttt

SEQ ID NO: 902286 - DNA, 25 bp, Mus musculus
tgtcccctcttttttgtgatggttt

SEQ ID NO: 902287 - DNA, 25 bp, Mus musculus
tgtcccctgaagagaactgtggcat

SEQ ID NO: 902288 - DNA, 25 bp, Mus musculus
tgtcccctgaagtgaactgtggcat

SEQ ID NO: 902289 - DNA, 25 bp, Mus musculus
tgtcccctgcaaaggctctcttggc

SEQ ID NO: 902290 - DNA, 25 bp, Mus musculus
tgtcccctgcaatggctctcttggc

SEQ ID NO: 902291 - DNA, 25 bp, Mus musculus
tgtcccctgcctaagctcagagctt

SEQ ID NO: 902292 - DNA, 25 bp, Mus musculus
tgtcccctgccttagctcagagctt

SEQ ID NO: 902293 - DNA, 25 bp, Mus musculus
tgtcccctgcttaggtggaaagtga

SEQ ID NO: 902294 - DNA, 25 bp, Mus musculus
tgtcccctgctttggtggaaagtga

SEQ ID NO: 902295 - DNA, 25 bp, Mus musculus
tgtcccctgggtcaccggcatgtca

SEQ ID NO: 902296 - DNA, 25 bp, Mus musculus
tgtcccctgggtgaccggcatgtca

SEQ ID NO: 902297 - DNA, 25 bp, Mus musculus
tgtcccctgtacatcaaggcttgcc

SEQ ID NO: 902298 - DNA, 25 bp, Mus musculus
tgtcccctgtacttcaaggcttgcc

SEQ ID NO: 902299 - DNA, 25 bp, Mus musculus
tgtcccctgtgacgagcctggttaa

SEQ ID NO: 902300 - DNA, 25 bp, Mus musculus
tgtcccctgtgaggagcctggttaa

SEQ ID NO: 902301 - DNA, 25 bp, Mus musculus
tgtcccctgtggctgaggaatttcg

SEQ ID NO: 902302 - DNA, 25 bp, Mus musculus
tgtcccctgtgggtgaggaatttcg

SEQ ID NO: 902303 - DNA, 25 bp, Mus musculus
tgtcccctgttcattaatatattgt

SEQ ID NO: 902304 - DNA, 25 bp, Mus musculus
tgtcccctgttctttaatatattgt

SEQ ID NO: 902305 - DNA, 25 bp, Mus musculus
tgtccccttccaattatccttacat

SEQ ID NO: 902306 - DNA, 25 bp, Mus musculus
tgtccccttccatttatccttacat

SEQ ID NO: 902307 - DNA, 25 bp, Mus musculus
tgtccccttcctcgtgacagcaaga

SEQ ID NO: 902308 - DNA, 25 bp, Mus musculus
tgtccccttcctggtgacagcaaga

SEQ ID NO: 902309 - DNA, 25 bp, Mus musculus
tgtccccttgctcacagtgtagaag

SEQ ID NO: 902310 - DNA, 25 bp, Mus musculus
tgtccccttgctgacagtgtagaag

SEQ ID NO: 902311 - DNA, 25 bp, Mus musculus
tgtcccctttgtcgtgagtcctaat

SEQ ID NO: 902312 - DNA, 25 bp, Mus musculus
tgtcccctttgtggtgagtcctaat

SEQ ID NO: 902313 - DNA, 25 bp, Mus musculus
tgtcccgaaggaacctgtgaccttt

SEQ ID NO: 902314 - DNA, 25 bp, Mus musculus
tgtcccgaaggatcctgtgaccttt

SEQ ID NO: 902315 - DNA, 25 bp, Mus musculus
tgtcccgacaaaccctacatgatgt

SEQ ID NO: 902316 - DNA, 25 bp, Mus musculus
tgtcccgacaaagcctacatgatgt

SEQ ID NO: 902317 - DNA, 25 bp, Mus musculus
tgtcccgaccccaggtgcggatgga

SEQ ID NO: 902318 - DNA, 25 bp, Mus musculus
tgtcccgacccctggtgcggatgga

SEQ ID NO: 902319 - DNA, 25 bp, Mus musculus
tgtcccgactaacgaggatgcttag

SEQ ID NO: 902320 - DNA, 25 bp, Mus musculus
tgtcccgactaaggaggatgcttag

SEQ ID NO: 902321 - DNA, 25 bp, Mus musculus
tgtcccgagtctattgctgtaacca

SEQ ID NO: 902322 - DNA, 25 bp, Mus musculus
tgtcccgagtcttttgctgtaacca

SEQ ID NO: 902323 - DNA, 25 bp, Mus musculus
tgtcccgatgatctcgaagcttcct

SEQ ID NO: 902324 - DNA, 25 bp, Mus musculus
tgtcccgatgatgtcgaagcttcct

SEQ ID NO: 902325 - DNA, 25 bp, Mus musculus
tgtcccgcaagtccagctccagtgt

SEQ ID NO: 902326 - DNA, 25 bp, Mus musculus
tgtcccgcaagtgcagctccagtgt

SEQ ID NO: 902327 - DNA, 25 bp, Mus musculus
tgtcccgcacttcagcagtgtcaga

SEQ ID NO: 902328 - DNA, 25 bp, Mus musculus
tgtcccgcacttgagcagtgtcaga

SEQ ID NO: 902329 - DNA, 25 bp, Mus musculus
tgtcccgctcctcaatacatgtaaa

SEQ ID NO: 902330 - DNA, 25 bp, Mus musculus
tgtcccgctcctgaatacatgtaaa

SEQ ID NO: 902331 - DNA, 25 bp, Mus musculus
tgtcccgcttcaaaactttgctctg

SEQ ID NO: 902332 - DNA, 25 bp, Mus musculus
tgtcccgcttcataactttgctctg

SEQ ID NO: 902333 - DNA, 25 bp, Mus musculus
tgtcccggaaaaccatggtgccatc

SEQ ID NO: 902334 - DNA, 25 bp, Mus musculus
tgtcccggaaaagcatggtgccatc

SEQ ID NO: 902335 - DNA, 25 bp, Mus musculus
tgtcccggaagccttacattgtaag

SEQ ID NO: 902336 - DNA, 25 bp, Mus musculus
tgtcccggaagcgttacattgtaag

SEQ ID NO: 902337 - DNA, 25 bp, Mus musculus
tgtcccgggagcactggttcaaggc

SEQ ID NO: 902338 - DNA, 25 bp, Mus musculus
tgtcccgggagctctggttcaaggc

SEQ ID NO: 902339 - DNA, 25 bp, Mus musculus
tgtcccgggattctgtttaggtaat

SEQ ID NO: 902340 - DNA, 25 bp, Mus musculus
tgtcccgggattgtgtttaggtaat

SEQ ID NO: 902341 - DNA, 25 bp, Mus musculus
tgtcccgtaaacagttccagctaag

SEQ ID NO: 902342 - DNA, 25 bp, Mus musculus
tgtcccgtaaactgttccagctaag

SEQ ID NO: 902343 - DNA, 25 bp, Mus musculus
tgtcccgtctttactagaatcctga

SEQ ID NO: 902344 - DNA, 25 bp, Mus musculus
tgtcccgtcttttctagaatcctga

SEQ ID NO: 902345 - DNA, 25 bp, Mus musculus
tgtcccgtggcgacatctgggctga

SEQ ID NO: 902346 - DNA, 25 bp, Mus musculus
tgtcccgtggcgtcatctgggctga

SEQ ID NO: 902347 - DNA, 25 bp, Mus musculus
tgtcccgtgggacaagacttttcct

SEQ ID NO: 902348 - DNA, 25 bp, Mus musculus
tgtcccgtgggagaagacttttcct

SEQ ID NO: 902349 - DNA, 25 bp, Mus musculus
tgtccctaaaagatatctccaagag

SEQ ID NO: 902350 - DNA, 25 bp, Mus musculus
tgtccctaaaagttatctccaagag

SEQ ID NO: 902351 - DNA, 25 bp, Mus musculus
tgtccctaaagtcgagttcctcgtc

SEQ ID NO: 902352 - DNA, 25 bp, Mus musculus
tgtccctaaagtggagttcctcgtc

SEQ ID NO: 902353 - DNA, 25 bp, Mus musculus
tgtccctaagacagaattacactat

SEQ ID NO: 902354 - DNA, 25 bp, Mus musculus
tgtccctaagactgaattacactat

SEQ ID NO: 902355 - DNA, 25 bp, Mus musculus
tgtccctaagatcctttcaagtgta

SEQ ID NO: 902356 - DNA, 25 bp, Mus musculus
tgtccctaagatgctttcaagtgta

SEQ ID NO: 902357 - DNA, 25 bp, Mus musculus
tgtccctaagcgcataccagatgat

SEQ ID NO: 902358 - DNA, 25 bp, Mus musculus
tgtccctaagcggataccagatgat

SEQ ID NO: 902359 - DNA, 25 bp, Mus musculus
tgtccctacccaacgaagtcttttt

SEQ ID NO: 902360 - DNA, 25 bp, Mus musculus
tgtccctacccatcgaagtcttttt

SEQ ID NO: 902361 - DNA, 25 bp, Mus musculus
tgtccctaccccaggcaatgctgag

SEQ ID NO: 902362 - DNA, 25 bp, Mus musculus
tgtccctacccctggcaatgctgag

SEQ ID NO: 902363 - DNA, 25 bp, Mus musculus
tgtccctactgtatcctggaatgga

SEQ ID NO: 902364 - DNA, 25 bp, Mus musculus
tgtccctactgtttcctggaatgga

SEQ ID NO: 902365 - DNA, 25 bp, Mus musculus
tgtccctagagaccttttatcctcc

SEQ ID NO: 902366 - DNA, 25 bp, Mus musculus
tgtccctagagagcttttatcctcc

SEQ ID NO: 902367 - DNA, 25 bp, Mus musculus
tgtccctagccacatccagcaggaa

SEQ ID NO: 902368 - DNA, 25 bp, Mus musculus
tgtccctagccagatccagcaggaa

SEQ ID NO: 902369 - DNA, 25 bp, Mus musculus
tgtccctaggctcctgtttgagaat

SEQ ID NO: 902370 - DNA, 25 bp, Mus musculus
tgtccctaggctgctgtttgagaat

SEQ ID NO: 902371 - DNA, 25 bp, Mus musculus
tgtccctagggaatcatcaggcccg

SEQ ID NO: 902372 - DNA, 25 bp, Mus musculus
tgtccctagggattcatcaggcccg

SEQ ID NO: 902373 - DNA, 25 bp, Mus musculus
tgtccctagggtatgttccacctgt

SEQ ID NO: 902374 - DNA, 25 bp, Mus musculus
tgtccctagggtttgttccacctgt

SEQ ID NO: 902375 - DNA, 25 bp, Mus musculus
tgtccctatcttcagccattacctt

SEQ ID NO: 902376 - DNA, 25 bp, Mus musculus
tgtccctatcttgagccattacctt

SEQ ID NO: 902377 - DNA, 25 bp, Mus musculus
tgtccctatgcgatacatctgagag

SEQ ID NO: 902378 - DNA, 25 bp, Mus musculus
tgtccctatgcgttacatctgagag

SEQ ID NO: 902379 - DNA, 25 bp, Mus musculus
tgtccctatggaccgtcttgttaca

SEQ ID NO: 902380 - DNA, 25 bp, Mus musculus
tgtccctatggagcgtcttgttaca

SEQ ID NO: 902381 - DNA, 25 bp, Mus musculus
tgtccctatggtaaagttctccctg

SEQ ID NO: 902382 - DNA, 25 bp, Mus musculus
tgtccctatggttaagttctccctg

SEQ ID NO: 902383 - DNA, 25 bp, Mus musculus
tgtccctattatcggttgcaggata

SEQ ID NO: 902384 - DNA, 25 bp, Mus musculus
tgtccctattatgggttgcaggata

SEQ ID NO: 902385 - DNA, 25 bp, Mus musculus
tgtccctcaaggcttcatatttaca

SEQ ID NO: 902386 - DNA, 25 bp, Mus musculus
tgtccctcaagggttcatatttaca

SEQ ID NO: 902387 - DNA, 25 bp, Mus musculus
tgtccctcaagtacgcctattgtgg

SEQ ID NO: 902388 - DNA, 25 bp, Mus musculus
tgtccctcaagttcgcctattgtgg

SEQ ID NO: 902389 - DNA, 25 bp, Mus musculus
tgtccctcagatatcgaggccttag

SEQ ID NO: 902390 - DNA, 25 bp, Mus musculus
tgtccctcagatttcgaggccttag

SEQ ID NO: 902391 - DNA, 25 bp, Mus musculus
tgtccctcaggcaatgagtgccata

SEQ ID NO: 902392 - DNA, 25 bp, Mus musculus
tgtccctcaggctatgagtgccata

SEQ ID NO: 902393 - DNA, 25 bp, Mus musculus
tgtccctcagtgacatgccagcaga

SEQ ID NO: 902394 - DNA, 25 bp, Mus musculus
tgtccctcagtgactccttgaagta

SEQ ID NO: 902395 - DNA, 25 bp, Mus musculus
tgtccctcagtgaggtttcagatcc

SEQ ID NO: 902396 - DNA, 25 bp, Mus musculus
tgtccctcagtgtcatgccagcaga

SEQ ID NO: 902397 - DNA, 25 bp, Mus musculus
tgtccctcagtgtctccttgaagta

SEQ ID NO: 902398 - DNA, 25 bp, Mus musculus
tgtccctcagtgtggtttcagatcc

SEQ ID NO: 902399 - DNA, 25 bp, Mus musculus
tgtccctcatgacgatgcgacttca

SEQ ID NO: 902400 - DNA, 25 bp, Mus musculus
tgtccctcatgaggatgcgacttca

SEQ ID NO: 902401 - DNA, 25 bp, Mus musculus
tgtccctccagcaaaaatagcagcc

SEQ ID NO: 902402 - DNA, 25 bp, Mus musculus
tgtccctccagctaaaatagcagcc

SEQ ID NO: 902403 - DNA, 25 bp, Mus musculus
tgtccctccaggaaaccatactaaa

SEQ ID NO: 902404 - DNA, 25 bp, Mus musculus
tgtccctccaggtaaccatactaaa

SEQ ID NO: 902405 - DNA, 25 bp, Mus musculus
tgtccctcccacatttcaatttatg

SEQ ID NO: 902406 - DNA, 25 bp, Mus musculus
tgtccctcccacttttcaatttatg

SEQ ID NO: 902407 - DNA, 25 bp, Mus musculus
tgtccctccctcaagattagtatat

SEQ ID NO: 902408 - DNA, 25 bp, Mus musculus
tgtccctccctctagattagtatat

SEQ ID NO: 902409 - DNA, 25 bp, Mus musculus
tgtccctcccttaagagccacagaa

SEQ ID NO: 902410 - DNA, 25 bp, Mus musculus
tgtccctccctttagagccacagaa

SEQ ID NO: 902411 - DNA, 25 bp, Mus musculus
tgtccctcctttaatggagaattaa

SEQ ID NO: 902412 - DNA, 25 bp, Mus musculus
tgtccctccttttatggagaattaa

SEQ ID NO: 902413 - DNA, 25 bp, Mus musculus
tgtccctcggagagtgttcataata

SEQ ID NO: 902414 - DNA, 25 bp, Mus musculus
tgtccctcggagtgtgttcataata

SEQ ID NO: 902415 - DNA, 25 bp, Mus musculus
tgtccctcgggcaagcactataagg

SEQ ID NO: 902416 - DNA, 25 bp, Mus musculus
tgtccctcgggctagcactataagg

SEQ ID NO: 902417 - DNA, 25 bp, Mus musculus
tgtccctctgaacggaattgggccc

SEQ ID NO: 902418 - DNA, 25 bp, Mus musculus
tgtccctctgaagggaattgggccc

SEQ ID NO: 902419 - DNA, 25 bp, Mus musculus
tgtccctcttgcactggccctgtgt

SEQ ID NO: 902420 - DNA, 25 bp, Mus musculus
tgtccctcttgctctggccctgtgt

SEQ ID NO: 902421 - DNA, 25 bp, Mus musculus
tgtccctgaagaagtcacctgaact

SEQ ID NO: 902422 - DNA, 25 bp, Mus musculus
tgtccctgaagatgtcacctgaact

SEQ ID NO: 902423 - DNA, 25 bp, Mus musculus
tgtccctgacccacaatgaggatgt

SEQ ID NO: 902424 - DNA, 25 bp, Mus musculus
tgtccctgacccagatatgcacaga

SEQ ID NO: 902425 - DNA, 25 bp, Mus musculus
tgtccctgaccctcaatgaggatgt

SEQ ID NO: 902426 - DNA, 25 bp, Mus musculus
tgtccctgaccctgatatgcacaga

SEQ ID NO: 902427 - DNA, 25 bp, Mus musculus
tgtccctgacgactctgctgctagc

SEQ ID NO: 902428 - DNA, 25 bp, Mus musculus
tgtccctgacgagtctgctgctagc

SEQ ID NO: 902429 - DNA, 25 bp, Mus musculus
tgtccctgaggaaagtggtgatgta

SEQ ID NO: 902430 - DNA, 25 bp, Mus musculus
tgtccctgaggatagtggtgatgta

SEQ ID NO: 902431 - DNA, 25 bp, Mus musculus
tgtccctgaggcagttcgtacagaa

SEQ ID NO: 902432 - DNA, 25 bp, Mus musculus
tgtccctgaggctgttcgtacagaa

SEQ ID NO: 902433 - DNA, 25 bp, Mus musculus
tgtccctgaggtcagcatcgcgcca

SEQ ID NO: 902434 - DNA, 25 bp, Mus musculus
tgtccctgaggtgagcatcgcgcca

SEQ ID NO: 902435 - DNA, 25 bp, Mus musculus
tgtccctgatagctctccaaggtga

SEQ ID NO: 902436 - DNA, 25 bp, Mus musculus
tgtccctgataggtctccaaggtga

SEQ ID NO: 902437 - DNA, 25 bp, Mus musculus
tgtccctgcaggatgtgtgccccgg

SEQ ID NO: 902438 - DNA, 25 bp, Mus musculus
tgtccctgcaggttgtgtgccccgg

SEQ ID NO: 902439 - DNA, 25 bp, Mus musculus
tgtccctgcatcctatgaagtcata

SEQ ID NO: 902440 - DNA, 25 bp, Mus musculus
tgtccctgcatcgtatgaagtcata

SEQ ID NO: 902441 - DNA, 25 bp, Mus musculus
tgtccctgccctagtgtgagataac

SEQ ID NO: 902442 - DNA, 25 bp, Mus musculus
tgtccctgcccttgtgtgagataac

SEQ ID NO: 902443 - DNA, 25 bp, Mus musculus
tgtccctgctctatgggcataaagt

SEQ ID NO: 902444 - DNA, 25 bp, Mus musculus
tgtccctgctctttgggcataaagt

SEQ ID NO: 902445 - DNA, 25 bp, Mus musculus
tgtccctggacacgagcaatgttag

SEQ ID NO: 902446 - DNA, 25 bp, Mus musculus
tgtccctggacaggagcaatgttag

SEQ ID NO: 902447 - DNA, 25 bp, Mus musculus
tgtccctggatcctcactggcagca

SEQ ID NO: 902448 - DNA, 25 bp, Mus musculus
tgtccctggatcgtcactggcagca

SEQ ID NO: 902449 - DNA, 25 bp, Mus musculus
tgtccctgggagctgacctacaaat

SEQ ID NO: 902450 - DNA, 25 bp, Mus musculus
tgtccctgggaggtgacctacaaat

SEQ ID NO: 902451 - DNA, 25 bp, Mus musculus
tgtccctgggctctcaaatttgaaa

SEQ ID NO: 902452 - DNA, 25 bp, Mus musculus
tgtccctgggctgtcaaatttgaaa

SEQ ID NO: 902453 - DNA, 25 bp, Mus musculus
tgtccctgggtcactgtagatttgc

SEQ ID NO: 902454 - DNA, 25 bp, Mus musculus
tgtccctgggtctctgtagatttgc

SEQ ID NO: 902455 - DNA, 25 bp, Mus musculus
tgtccctggtggaacaggtgcttct

SEQ ID NO: 902456 - DNA, 25 bp, Mus musculus
tgtccctggtggtacaggtgcttct

SEQ ID NO: 902457 - DNA, 25 bp, Mus musculus
tgtccctgtcctctctgctgtcggg

SEQ ID NO: 902458 - DNA, 25 bp, Mus musculus
tgtccctgtcctgtctgctgtcggg

SEQ ID NO: 902459 - DNA, 25 bp, Mus musculus
tgtccctgtcgcacgtataggaagg

SEQ ID NO: 902460 - DNA, 25 bp, Mus musculus
tgtccctgtcgctcgtataggaagg

SEQ ID NO: 902461 - DNA, 25 bp, Mus musculus
tgtccctgtgacagctgcttccatc

SEQ ID NO: 902462 - DNA, 25 bp, Mus musculus
tgtccctgtgactgctgcttccatc

SEQ ID NO: 902463 - DNA, 25 bp, Mus musculus
tgtccctgtgccagtgtagctgtgc

SEQ ID NO: 902464 - DNA, 25 bp, Mus musculus
tgtccctgtgcctgtgtagctgtgc

SEQ ID NO: 902465 - DNA, 25 bp, Mus musculus
tgtcccttacatccacagtgaccaa

SEQ ID NO: 902466 - DNA, 25 bp, Mus musculus
tgtcccttacatgcacagtgaccaa

SEQ ID NO: 902467 - DNA, 25 bp, Mus musculus
tgtcccttcagacctacctaagtac

SEQ ID NO: 902468 - DNA, 25 bp, Mus musculus
tgtcccttcagagctacctaagtac

SEQ ID NO: 902469 - DNA, 25 bp, Mus musculus
tgtcccttccttcactctaggcaga

SEQ ID NO: 902470 - DNA, 25 bp, Mus musculus
tgtcccttccttgactctaggcaga

SEQ ID NO: 902471 - DNA, 25 bp, Mus musculus
tgtcccttcgaacagtaaatgcttt

SEQ ID NO: 902472 - DNA, 25 bp, Mus musculus
tgtcccttcgaagagtaaatgcttt

SEQ ID NO: 902473 - DNA, 25 bp, Mus musculus
tgtcccttcgtgacttcgcttttta

SEQ ID NO: 902474 - DNA, 25 bp, Mus musculus
tgtcccttcgtgtcttcgcttttta

SEQ ID NO: 902475 - DNA, 25 bp, Mus musculus
tgtcccttctagacgcagtaggaac

SEQ ID NO: 902476 - DNA, 25 bp, Mus musculus
tgtcccttctagatcaactgaggaa

SEQ ID NO: 902477 - DNA, 25 bp, Mus musculus
tgtcccttctagtcgcagtaggaac

SEQ ID NO: 902478 - DNA, 25 bp, Mus musculus
tgtcccttctagttcaactgaggaa

SEQ ID NO: 902479 - DNA, 25 bp, Mus musculus
tgtcccttctctcaaatggtaggtg

SEQ ID NO: 902480 - DNA, 25 bp, Mus musculus
tgtcccttctctgaaatggtaggtg

SEQ ID NO: 902481 - DNA, 25 bp, Mus musculus
tgtcccttctttactctttgtcaat

SEQ ID NO: 902482 - DNA, 25 bp, Mus musculus
tgtcccttctttaggagcagcgcaa

SEQ ID NO: 902483 - DNA, 25 bp, Mus musculus
tgtcccttcttttctctttgtcaat

SEQ ID NO: 902484 - DNA, 25 bp, Mus musculus
tgtcccttcttttggagcagcgcaa

SEQ ID NO: 902485 - DNA, 25 bp, Mus musculus
tgtcccttgaccatcagtgtacatt

SEQ ID NO: 902486 - DNA, 25 bp, Mus musculus
tgtcccttgaccttcagtgtacatt

SEQ ID NO: 902487 - DNA, 25 bp, Mus musculus
tgtcccttggctccagtatttgaag

SEQ ID NO: 902488 - DNA, 25 bp, Mus musculus
tgtcccttggctgcagtatttgaag

SEQ ID NO: 902489 - DNA, 25 bp, Mus musculus
tgtcccttggtactactgtgtttat

SEQ ID NO: 902490 - DNA, 25 bp, Mus musculus
tgtcccttggtagtactgtgtttat

SEQ ID NO: 902491 - DNA, 25 bp, Mus musculus
tgtcccttggtcaggagacttttaa

SEQ ID NO: 902492 - DNA, 25 bp, Mus musculus
tgtcccttggtctggagacttttaa

SEQ ID NO: 902493 - DNA, 25 bp, Mus musculus
tgtcccttggtgatgctgtttcagt

SEQ ID NO: 902494 - DNA, 25 bp, Mus musculus
tgtcccttggtgttgctgtttcagt

SEQ ID NO: 902495 - DNA, 25 bp, Mus musculus
tgtccctttattaaacttgtctcaa

SEQ ID NO: 902496 - DNA, 25 bp, Mus musculus
tgtccctttatttaacttgtctcaa

SEQ ID NO: 902497 - DNA, 25 bp, Mus musculus
tgtccctttcttctggttgcttgcc

SEQ ID NO: 902498 - DNA, 25 bp, Mus musculus
tgtccctttcttgtggttgcttgcc

SEQ ID NO: 902499 - DNA, 25 bp, Mus musculus
tgtccctttgaaatgcctccgattt

SEQ ID NO: 902500 - DNA, 25 bp, Mus musculus
tgtccctttgaattgcctccgattt

SEQ ID NO: 902501 - DNA, 25 bp, Mus musculus
tgtccctttgtcagttctgcatgta

SEQ ID NO: 902502 - DNA, 25 bp, Mus musculus
tgtccctttgtctgttctgcatgta

SEQ ID NO: 902503 - DNA, 25 bp, Mus musculus
tgtcccttttctccaagcatgtgaa

SEQ ID NO: 902504 - DNA, 25 bp, Mus musculus
tgtcccttttctgcaagcatgtgaa

SEQ ID NO: 902505 - DNA, 25 bp, Mus musculus
tgtcccttttggacagtgtggcact

SEQ ID NO: 902506 - DNA, 25 bp, Mus musculus
tgtcccttttggtcagtgtggcact

SEQ ID NO: 902507 - DNA, 25 bp, Mus musculus
tgtccctttttacctcactttgatt

SEQ ID NO: 902508 - DNA, 25 bp, Mus musculus
tgtccctttttagctcactttgatt

SEQ ID NO: 902509 - DNA, 25 bp, Mus musculus
tgtccctttttcaagcaatggaaga

SEQ ID NO: 902510 - DNA, 25 bp, Mus musculus
tgtccctttttctagcaatggaaga

SEQ ID NO: 902511 - DNA, 25 bp, Mus musculus
tgtccctttttgatggctgtacgaa

SEQ ID NO: 902512 - DNA, 25 bp, Mus musculus
tgtccctttttgttggctgtacgaa

SEQ ID NO: 902513 - DNA, 25 bp, Mus musculus
tgtccgaaaattaatctgccacgtg

SEQ ID NO: 902514 - DNA, 25 bp, Mus musculus
tgtccgaaaatttatctgccacgtg

SEQ ID NO: 902515 - DNA, 25 bp, Mus musculus
tgtccgaaacgaacacaccagggtc

SEQ ID NO: 902516 - DNA, 25 bp, Mus musculus
tgtccgaaacgatcacaccagggtc

SEQ ID NO: 902517 - DNA, 25 bp, Mus musculus
tgtccgaagggccactcagaaacta

SEQ ID NO: 902518 - DNA, 25 bp, Mus musculus
tgtccgaagggcgactcagaaacta

SEQ ID NO: 902519 - DNA, 25 bp, Mus musculus
tgtccgacagcaacctttaaaactt

SEQ ID NO: 902520 - DNA, 25 bp, Mus musculus
tgtccgacagcatcctttaaaactt

SEQ ID NO: 902521 - DNA, 25 bp, Mus musculus
tgtccgacagttcctgatgcaaggc

SEQ ID NO: 902522 - DNA, 25 bp, Mus musculus
tgtccgacagttgctgatgcaaggc

SEQ ID NO: 902523 - DNA, 25 bp, Mus musculus
tgtccgacctcacgacatccaagga

SEQ ID NO: 902524 - DNA, 25 bp, Mus musculus
tgtccgacctcaggacatccaagga

SEQ ID NO: 902525 - DNA, 25 bp, Mus musculus
tgtccgacgggaacttcttagagcg

SEQ ID NO: 902526 - DNA, 25 bp, Mus musculus
tgtccgacgggatcttcttagagcg

SEQ ID NO: 902527 - DNA, 25 bp, Mus musculus
tgtccgagccataagcaacacgagc

SEQ ID NO: 902528 - DNA, 25 bp, Mus musculus
tgtccgagccattagcaacacgagc

SEQ ID NO: 902529 - DNA, 25 bp, Mus musculus
tgtccgagtacaacgtgatggcaac

SEQ ID NO: 902530 - DNA, 25 bp, Mus musculus
tgtccgagtacatcgtgatggcaac

SEQ ID NO: 902531 - DNA, 25 bp, Mus musculus
tgtccgatagacaccaagaaagcca

SEQ ID NO: 902532 - DNA, 25 bp, Mus musculus
tgtccgatagactccaagaaagcca

SEQ ID NO: 902533 - DNA, 25 bp, Mus musculus
tgtccgcaaactccctgggtgacaa

SEQ ID NO: 902534 - DNA, 25 bp, Mus musculus
tgtccgcaaactgcctgggtgacaa

SEQ ID NO: 902535 - DNA, 25 bp, Mus musculus
tgtccgcaccttctgagagatgatt

SEQ ID NO: 902536 - DNA, 25 bp, Mus musculus
tgtccgcaccttgtgagagatgatt

SEQ ID NO: 902537 - DNA, 25 bp, Mus musculus
tgtccgcactctaatctataacaac

SEQ ID NO: 902538 - DNA, 25 bp, Mus musculus
tgtccgcactcttatctataacaac

SEQ ID NO: 902539 - DNA, 25 bp, Mus musculus
tgtccgcagctacgagaaagcactt

SEQ ID NO: 902540 - DNA, 25 bp, Mus musculus
tgtccgcagctaggagaaagcactt

SEQ ID NO: 902541 - DNA, 25 bp, Mus musculus
tgtccgccacagcatccgggtgtac

SEQ ID NO: 902542 - DNA, 25 bp, Mus musculus
tgtccgccacaggatccgggtgtac

SEQ ID NO: 902543 - DNA, 25 bp, Mus musculus
tgtccgccggcgatcaagccaacag

SEQ ID NO: 902544 - DNA, 25 bp, Mus musculus
tgtccgccggcgttcaagccaacag

SEQ ID NO: 902545 - DNA, 25 bp, Mus musculus
tgtccgcgcatcagcagtggatggt

SEQ ID NO: 902546 - DNA, 25 bp, Mus musculus
tgtccgcgcatctgcagtggatggt

SEQ ID NO: 902547 - DNA, 25 bp, Mus musculus
tgtccgcgttgcagatgtcctgtcc

SEQ ID NO: 902548 - DNA, 25 bp, Mus musculus
tgtccgcgttgctgatgtcctgtcc

SEQ ID NO: 902549 - DNA, 25 bp, Mus musculus
tgtccgctggagatgcaaatcctat

SEQ ID NO: 902550 - DNA, 25 bp, Mus musculus
tgtccgctggagttgcaaatcctat

SEQ ID NO: 902551 - DNA, 25 bp, Mus musculus
tgtccgctggtcagagggctaaagt

SEQ ID NO: 902552 - DNA, 25 bp, Mus musculus
tgtccgctggtctgagggctaaagt

SEQ ID NO: 902553 - DNA, 25 bp, Mus musculus
tgtccgcttcagacacagggaccat

SEQ ID NO: 902554 - DNA, 25 bp, Mus musculus
tgtccgcttcagtcacagggaccat

SEQ ID NO: 902555 - DNA, 25 bp, Mus musculus
tgtccgcttgtactctatcctttat

SEQ ID NO: 902556 - DNA, 25 bp, Mus musculus
tgtccgcttgtagtctatcctttat

SEQ ID NO: 902557 - DNA, 25 bp, Mus musculus
tgtccggagaatacagtacttgcct

SEQ ID NO: 902558 - DNA, 25 bp, Mus musculus
tgtccggagaattcagtacttgcct

SEQ ID NO: 902559 - DNA, 25 bp, Mus musculus
tgtccggagctcagaaggcccatca

SEQ ID NO: 902560 - DNA, 25 bp, Mus musculus
tgtccggagctctgaaggcccatca

SEQ ID NO: 902561 - DNA, 25 bp, Mus musculus
tgtccggaggatctacttggcaagc

SEQ ID NO: 902562 - DNA, 25 bp, Mus musculus
tgtccggaggatgtacttggcaagc

SEQ ID NO: 902563 - DNA, 25 bp, Mus musculus
tgtccggatgtgagtcttgcctaat

SEQ ID NO: 902564 - DNA, 25 bp, Mus musculus
tgtccggatgtgtgtcttgcctaat

SEQ ID NO: 902565 - DNA, 25 bp, Mus musculus
tgtccggcaggtcctgttcccgctg

SEQ ID NO: 902566 - DNA, 25 bp, Mus musculus
tgtccggcaggtgctgttcccgctg

SEQ ID NO: 902567 - DNA, 25 bp, Mus musculus
tgtccggcatctaccagtacatcat

SEQ ID NO: 902568 - DNA, 25 bp, Mus musculus
tgtccggcatcttccagtacatcat

SEQ ID NO: 902569 - DNA, 25 bp, Mus musculus
tgtccggccagtctctgttcaggcc

SEQ ID NO: 902570 - DNA, 25 bp, Mus musculus
tgtccggccagtgtctgttcaggcc

SEQ ID NO: 902571 - DNA, 25 bp, Mus musculus
tgtccggcccagaaggtggctagct

SEQ ID NO: 902572 - DNA, 25 bp, Mus musculus
tgtccggcccagtaggtggctagct

SEQ ID NO: 902573 - DNA, 25 bp, Mus musculus
tgtccggcccttatccttaacattt

SEQ ID NO: 902574 - DNA, 25 bp, Mus musculus
tgtccggcccttttccttaacattt

SEQ ID NO: 902575 - DNA, 25 bp, Mus musculus
tgtccggctgttatccttgtcatga

SEQ ID NO: 902576 - DNA, 25 bp, Mus musculus
tgtccggctgttttccttgtcatga

SEQ ID NO: 902577 - DNA, 25 bp, Mus musculus
tgtccggcttccactgttagcacaa

SEQ ID NO: 902578 - DNA, 25 bp, Mus musculus
tgtccggcttcctctgttagcacaa

SEQ ID NO: 902579 - DNA, 25 bp, Mus musculus
tgtccggtgagcctcgaacgactga

SEQ ID NO: 902580 - DNA, 25 bp, Mus musculus
tgtccggtgagcgtcgaacgactga

SEQ ID NO: 902581 - DNA, 25 bp, Mus musculus
tgtccggtgccaagtgactggatca

SEQ ID NO: 902582 - DNA, 25 bp, Mus musculus
tgtccggtgccatgtgactggatca

SEQ ID NO: 902583 - DNA, 25 bp, Mus musculus
tgtccggtggcaaatgatatcacat

SEQ ID NO: 902584 - DNA, 25 bp, Mus musculus
tgtccggtggcatatgatatcacat

SEQ ID NO: 902585 - DNA, 25 bp, Mus musculus
tgtccggtgtttaagcctctccctt

SEQ ID NO: 902586 - DNA, 25 bp, Mus musculus
tgtccggtgttttagcctctccctt

SEQ ID NO: 902587 - DNA, 25 bp, Mus musculus
tgtccggtttatataggtggctaat

SEQ ID NO: 902588 - DNA, 25 bp, Mus musculus
tgtccggtttatttaggtggctaat

SEQ ID NO: 902589 - DNA, 25 bp, Mus musculus
tgtccgtaaagtctgccggtgtagt

SEQ ID NO: 902590 - DNA, 25 bp, Mus musculus
tgtccgtaaagtgtgccggtgtagt

SEQ ID NO: 902591 - DNA, 25 bp, Mus musculus
tgtccgtaaccaccagaccattggg

SEQ ID NO: 902592 - DNA, 25 bp, Mus musculus
tgtccgtaaccagcagaccattggg

SEQ ID NO: 902593 - DNA, 25 bp, Mus musculus
tgtccgtagtgtatcaatgctgtcc

SEQ ID NO: 902594 - DNA, 25 bp, Mus musculus
tgtccgtagtgtccaaaggccaagg

SEQ ID NO: 902595 - DNA, 25 bp, Mus musculus
tgtccgtagtgtgcaaaggccaagg

SEQ ID NO: 902596 - DNA, 25 bp, Mus musculus
tgtccgtagtgtttcaatgctgtcc

SEQ ID NO: 902597 - DNA, 25 bp, Mus musculus
tgtccgtcaacaaaatgtccttcct

SEQ ID NO: 902598 - DNA, 25 bp, Mus musculus
tgtccgtcaacataatgtccttcct

SEQ ID NO: 902599 - DNA, 25 bp, Mus musculus
tgtccgtcactgatacactggtaga

SEQ ID NO: 902600 - DNA, 25 bp, Mus musculus
tgtccgtcactgttacactggtaga

SEQ ID NO: 902601 - DNA, 25 bp, Mus musculus
tgtccgtccctgcaggccagctgga

SEQ ID NO: 902602 - DNA, 25 bp, Mus musculus
tgtccgtccctggaggccagctgga

SEQ ID NO: 902603 - DNA, 25 bp, Mus musculus
tgtccgtcctgaaccagcggtaatg

SEQ ID NO: 902604 - DNA, 25 bp, Mus musculus
tgtccgtcctgatccagcggtaatg

SEQ ID NO: 902605 - DNA, 25 bp, Mus musculus
tgtccgtgaccactgatactcaaaa

SEQ ID NO: 902606 - DNA, 25 bp, Mus musculus
tgtccgtgaccagtgatactcaaaa

SEQ ID NO: 902607 - DNA, 25 bp, Mus musculus
tgtccgtgcgttataatgccatgtt

SEQ ID NO: 902608 - DNA, 25 bp, Mus musculus
tgtccgtgcgttttaatgccatgtt

SEQ ID NO: 902609 - DNA, 25 bp, Mus musculus
tgtccgtgtgcgaacatgtatgtct

SEQ ID NO: 902610 - DNA, 25 bp, Mus musculus
tgtccgtgtgcgtacatgtatgtct

SEQ ID NO: 902611 - DNA, 25 bp, Mus musculus
tgtccgttcactcgcgtgtgattta

SEQ ID NO: 902612 - DNA, 25 bp, Mus musculus
tgtccgttcactggcgtgtgattta

SEQ ID NO: 902613 - DNA, 25 bp, Mus musculus
tgtccgttccacaacttgcttccaa

SEQ ID NO: 902614 - DNA, 25 bp, Mus musculus
tgtccgttccactacttgcttccaa

SEQ ID NO: 902615 - DNA, 25 bp, Mus musculus
tgtccgttgcatctaaggcgccacg

SEQ ID NO: 902616 - DNA, 25 bp, Mus musculus
tgtccgttgcatgtaaggcgccacg

SEQ ID NO: 902617 - DNA, 25 bp, Mus musculus
tgtccgttgtggatatgatgtgcca

SEQ ID NO: 902618 - DNA, 25 bp, Mus musculus
tgtccgttgtggttatgatgtgcca

SEQ ID NO: 902619 - DNA, 25 bp, Mus musculus
tgtccgtttgtcagtccgtgaaggt

SEQ ID NO: 902620 - DNA, 25 bp, Mus musculus
tgtccgtttgtctgtccgtgaaggt

SEQ ID NO: 902621 - DNA, 25 bp, Mus musculus
tgtccgtttgtgacctcagctctgt

SEQ ID NO: 902622 - DNA, 25 bp, Mus musculus
tgtccgtttgtgtcctcagctctgt

SEQ ID NO: 902623 - DNA, 25 bp, Mus musculus
tgtcctaaacccagattaccggcag

SEQ ID NO: 902624 - DNA, 25 bp, Mus musculus
tgtcctaaaccctgattaccggcag

SEQ ID NO: 902625 - DNA, 25 bp, Mus musculus
tgtcctaaatgtacagccagctcat

SEQ ID NO: 902626 - DNA, 25 bp, Mus musculus
tgtcctaaatgttcagccagctcat

SEQ ID NO: 902627 - DNA, 25 bp, Mus musculus
tgtcctaaccatcagaaaccccaaa

SEQ ID NO: 902628 - DNA, 25 bp, Mus musculus
tgtcctaaccatgagaaaccccaaa

SEQ ID NO: 902629 - DNA, 25 bp, Mus musculus
tgtcctaacgcccaaggtgtcctgg

SEQ ID NO: 902630 - DNA, 25 bp, Mus musculus
tgtcctaacgccgaaggtgtcctgg

SEQ ID NO: 902631 - DNA, 25 bp, Mus musculus
tgtcctaagcacctaactctagttt

SEQ ID NO: 902632 - DNA, 25 bp, Mus musculus
tgtcctaagcacgtaactctagttt

SEQ ID NO: 902633 - DNA, 25 bp, Mus musculus
tgtcctaatgatatggcagtggtgc

SEQ ID NO: 902634 - DNA, 25 bp, Mus musculus
tgtcctaatgatttggcagtggtgc

SEQ ID NO: 902635 - DNA, 25 bp, Mus musculus
tgtcctaatgcaacttctcacatag

SEQ ID NO: 902636 - DNA, 25 bp, Mus musculus
tgtcctaatgcatcttctcacatag

SEQ ID NO: 902637 - DNA, 25 bp, Mus musculus
tgtcctaattcccttgcagctatga

SEQ ID NO: 902638 - DNA, 25 bp, Mus musculus
tgtcctaattccgttgcagctatga

SEQ ID NO: 902639 - DNA, 25 bp, Mus musculus
tgtcctacagatccctaaagtcaaa

SEQ ID NO: 902640 - DNA, 25 bp, Mus musculus
tgtcctacagatgcctaaagtcaaa

SEQ ID NO: 902641 - DNA, 25 bp, Mus musculus
tgtcctaccatcaggagttaactcc

SEQ ID NO: 902642 - DNA, 25 bp, Mus musculus
tgtcctaccatctggagttaactcc

SEQ ID NO: 902643 - DNA, 25 bp, Mus musculus
tgtcctacctcaaaagtcagagatg

SEQ ID NO: 902644 - DNA, 25 bp, Mus musculus
tgtcctacctcataagtcagagatg

SEQ ID NO: 902645 - DNA, 25 bp, Mus musculus
tgtcctacctccatcctgttaagga

SEQ ID NO: 902646 - DNA, 25 bp, Mus musculus
tgtcctacctccttcctgttaagga

SEQ ID NO: 902647 - DNA, 25 bp, Mus musculus
tgtcctacctgaagccaactgtaca

SEQ ID NO: 902648 - DNA, 25 bp, Mus musculus
tgtcctacctgatgccaactgtaca

SEQ ID NO: 902649 - DNA, 25 bp, Mus musculus
tgtcctaccttacagagcttattct

SEQ ID NO: 902650 - DNA, 25 bp, Mus musculus
tgtcctaccttagagagcttattct

SEQ ID NO: 902651 - DNA, 25 bp, Mus musculus
tgtcctactcggagctgttgagtag

SEQ ID NO: 902652 - DNA, 25 bp, Mus musculus
tgtcctactcggtgctgttgagtag

SEQ ID NO: 902653 - DNA, 25 bp, Mus musculus
tgtcctactgctcggaacactgtta

SEQ ID NO: 902654 - DNA, 25 bp, Mus musculus
tgtcctactgctgggaacactgtta

SEQ ID NO: 902655 - DNA, 25 bp, Mus musculus
tgtcctactggtcgttcctgcacct

SEQ ID NO: 902656 - DNA, 25 bp, Mus musculus
tgtcctactggtggttcctgcacct

SEQ ID NO: 902657 - DNA, 25 bp, Mus musculus
tgtcctagaactcgtggatcgccgt

SEQ ID NO: 902658 - DNA, 25 bp, Mus musculus
tgtcctagaactggtggatcgccgt

SEQ ID NO: 902659 - DNA, 25 bp, Mus musculus
tgtcctagatatccaaattgggact

SEQ ID NO: 902660 - DNA, 25 bp, Mus musculus
tgtcctagatatgcaaattgggact

SEQ ID NO: 902661 - DNA, 25 bp, Mus musculus
tgtcctagatccagccccaaagaaa

SEQ ID NO: 902662 - DNA, 25 bp, Mus musculus
tgtcctagatcctgccccaaagaaa

SEQ ID NO: 902663 - DNA, 25 bp, Mus musculus
tgtcctagcaggagtcttttgtctt

SEQ ID NO: 902664 - DNA, 25 bp, Mus musculus
tgtcctagcaggtgtcttttgtctt

SEQ ID NO: 902665 - DNA, 25 bp, Mus musculus
tgtcctagccatatgcactacagta

SEQ ID NO: 902666 - DNA, 25 bp, Mus musculus
tgtcctagccatttgcactacagta

SEQ ID NO: 902667 - DNA, 25 bp, Mus musculus
tgtcctagcgacactcaggaatcat

SEQ ID NO: 902668 - DNA, 25 bp, Mus musculus
tgtcctagcgactctcaggaatcat

SEQ ID NO: 902669 - DNA, 25 bp, Mus musculus
tgtcctagctccagagcctgaaaag

SEQ ID NO: 902670 - DNA, 25 bp, Mus musculus
tgtcctagctcctgagcctgaaaag

SEQ ID NO: 902671 - DNA, 25 bp, Mus musculus
tgtcctaggcccatcaggttccgtt

SEQ ID NO: 902672 - DNA, 25 bp, Mus musculus
tgtcctaggcccttcaggttccgtt

SEQ ID NO: 902673 - DNA, 25 bp, Mus musculus
tgtcctagtggccaacgggagctta

SEQ ID NO: 902674 - DNA, 25 bp, Mus musculus
tgtcctagtggcgaacgggagctta

SEQ ID NO: 902675 - DNA, 25 bp, Mus musculus
tgtcctagtgtaaaagctctgtgca

SEQ ID NO: 902676 - DNA, 25 bp, Mus musculus
tgtcctagtgtataagctctgtgca

SEQ ID NO: 902677 - DNA, 25 bp, Mus musculus
tgtcctatatacacaagcagttggg

SEQ ID NO: 902678 - DNA, 25 bp, Mus musculus
tgtcctatatactcaagcagttggg

SEQ ID NO: 902679 - DNA, 25 bp, Mus musculus
tgtcctatcccaaaccctagatttt

SEQ ID NO: 902680 - DNA, 25 bp, Mus musculus
tgtcctatcccataccctagatttt

SEQ ID NO: 902681 - DNA, 25 bp, Mus musculus
tgtcctatcctcaggcccatgaaac

SEQ ID NO: 902682 - DNA, 25 bp, Mus musculus
tgtcctatcctctggcccatgaaac

SEQ ID NO: 902683 - DNA, 25 bp, Mus musculus
tgtcctatcctgatcggtctcaatc

SEQ ID NO: 902684 - DNA, 25 bp, Mus musculus
tgtcctatcctgttcggtctcaatc

SEQ ID NO: 902685 - DNA, 25 bp, Mus musculus
tgtcctatccttagtgcttcatctt

SEQ ID NO: 902686 - DNA, 25 bp, Mus musculus
tgtcctatcctttgtgcttcatctt

SEQ ID NO: 902687 - DNA, 25 bp, Mus musculus
tgtcctatctggatgctttctgcat

SEQ ID NO: 902688 - DNA, 25 bp, Mus musculus
tgtcctatctggttgctttctgcat

SEQ ID NO: 902689 - DNA, 25 bp, Mus musculus
tgtcctatgaagaccaaagccagaa

SEQ ID NO: 902690 - DNA, 25 bp, Mus musculus
tgtcctatgaagtccaaagccagaa

SEQ ID NO: 902691 - DNA, 25 bp, Mus musculus
tgtcctattagcaataccacgtggg

SEQ ID NO: 902692 - DNA, 25 bp, Mus musculus
tgtcctattagctataccacgtggg

SEQ ID NO: 902693 - DNA, 25 bp, Mus musculus
tgtcctcaaaagaacctttttctag

SEQ ID NO: 902694 - DNA, 25 bp, Mus musculus
tgtcctcaaaagtacctttttctag

SEQ ID NO: 902695 - DNA, 25 bp, Mus musculus
tgtcctcaaaggacgccaaaatgct

SEQ ID NO: 902696 - DNA, 25 bp, Mus musculus
tgtcctcaaaggtcgccaaaatgct

SEQ ID NO: 902697 - DNA, 25 bp, Mus musculus
tgtcctcaacatcatggctgccaga

SEQ ID NO: 902698 - DNA, 25 bp, Mus musculus
tgtcctcaacatgatggctgccaga

SEQ ID NO: 902699 - DNA, 25 bp, Mus musculus
tgtcctcaacctaacttctagcaag

SEQ ID NO: 902700 - DNA, 25 bp, Mus musculus
tgtcctcaaccttacttctagcaag

SEQ ID NO: 902701 - DNA, 25 bp, Mus musculus
tgtcctcaagacacatccaagtaag

SEQ ID NO: 902702 - DNA, 25 bp, Mus musculus
tgtcctcaagactcatccaagtaag

SEQ ID NO: 902703 - DNA, 25 bp, Mus musculus
tgtcctcaatttagtttcagtttta

SEQ ID NO: 902704 - DNA, 25 bp, Mus musculus
tgtcctcaattttgtttcagtttta

SEQ ID NO: 902705 - DNA, 25 bp, Mus musculus
tgtcctcacacaccatctgaatgtc

SEQ ID NO: 902706 - DNA, 25 bp, Mus musculus
tgtcctcacacagcatctgaatgtc

SEQ ID NO: 902707 - DNA, 25 bp, Mus musculus
tgtcctcacaggaacgaagtcccta

SEQ ID NO: 902708 - DNA, 25 bp, Mus musculus
tgtcctcacaggtacgaagtcccta

SEQ ID NO: 902709 - DNA, 25 bp, Mus musculus
tgtcctcactctccatttaaagcga

SEQ ID NO: 902710 - DNA, 25 bp, Mus musculus
tgtcctcactctgcatttaaagcga

SEQ ID NO: 902711 - DNA, 25 bp, Mus musculus
tgtcctcagaataccacaagtgaaa

SEQ ID NO: 902712 - DNA, 25 bp, Mus musculus
tgtcctcagaattccacaagtgaaa

SEQ ID NO: 902713 - DNA, 25 bp, Mus musculus
tgtcctcagcctatctggtgcccag

SEQ ID NO: 902714 - DNA, 25 bp, Mus musculus
tgtcctcagcctttctggtgcccag

SEQ ID NO: 902715 - DNA, 25 bp, Mus musculus
tgtcctcagctgcttcacaaagggt

SEQ ID NO: 902716 - DNA, 25 bp, Mus musculus
tgtcctcagctggttcacaaagggt

SEQ ID NO: 902717 - DNA, 25 bp, Mus musculus
tgtcctcagtacaacatacatctaa

SEQ ID NO: 902718 - DNA, 25 bp, Mus musculus
tgtcctcagtactacatacatctaa

SEQ ID NO: 902719 - DNA, 25 bp, Mus musculus
tgtcctcagttaatcagtatcccag

SEQ ID NO: 902720 - DNA, 25 bp, Mus musculus
tgtcctcagttattcagtatcccag

SEQ ID NO: 902721 - DNA, 25 bp, Mus musculus
tgtcctcatcccataactagtattg

SEQ ID NO: 902722 - DNA, 25 bp, Mus musculus
tgtcctcatcccttaactagtattg

SEQ ID NO: 902723 - DNA, 25 bp, Mus musculus
tgtcctcatgagactcgtgtcctct

SEQ ID NO: 902724 - DNA, 25 bp, Mus musculus
tgtcctcatgagtctcgtgtcctct

SEQ ID NO: 902725 - DNA, 25 bp, Mus musculus
tgtcctcattttacagattccattt

SEQ ID NO: 902726 - DNA, 25 bp, Mus musculus
tgtcctcatttttcagattccattt

SEQ ID NO: 902727 - DNA, 25 bp, Mus musculus
tgtcctccaactacaacttttttct

SEQ ID NO: 902728 - DNA, 25 bp, Mus musculus
tgtcctccaacttcaacttttttct

SEQ ID NO: 902729 - DNA, 25 bp, Mus musculus
tgtcctccagccattcagatgagat

SEQ ID NO: 902730 - DNA, 25 bp, Mus musculus
tgtcctccagcctttcagatgagat

SEQ ID NO: 902731 - DNA, 25 bp, Mus musculus
tgtcctccattgaaacataggcatt

SEQ ID NO: 902732 - DNA, 25 bp, Mus musculus
tgtcctccattgtaacataggcatt

SEQ ID NO: 902733 - DNA, 25 bp, Mus musculus
tgtcctcccaatagaacacatttct

SEQ ID NO: 902734 - DNA, 25 bp, Mus musculus
tgtcctcccaattgaacacatttct

SEQ ID NO: 902735 - DNA, 25 bp, Mus musculus
tgtcctcccagacaggaaagtctaa

SEQ ID NO: 902736 - DNA, 25 bp, Mus musculus
tgtcctcccagagaggaaagtctaa

SEQ ID NO: 902737 - DNA, 25 bp, Mus musculus
tgtcctcccagcacaaggtatgatt

SEQ ID NO: 902738 - DNA, 25 bp, Mus musculus
tgtcctcccagctcaaggtatgatt

SEQ ID NO: 902739 - DNA, 25 bp, Mus musculus
tgtcctccccggaacatgtgaaccg

SEQ ID NO: 902740 - DNA, 25 bp, Mus musculus
tgtcctccccggtacatgtgaaccg

SEQ ID NO: 902741 - DNA, 25 bp, Mus musculus
tgtcctcccgaacaattggcatgtg

SEQ ID NO: 902742 - DNA, 25 bp, Mus musculus
tgtcctcccgaagaattggcatgtg

SEQ ID NO: 902743 - DNA, 25 bp, Mus musculus
tgtcctcccgttctgaactgtgcag

SEQ ID NO: 902744 - DNA, 25 bp, Mus musculus
tgtcctcccgttgtgaactgtgcag

SEQ ID NO: 902745 - DNA, 25 bp, Mus musculus
tgtcctccctttaaccagtgctgct

SEQ ID NO: 902746 - DNA, 25 bp, Mus musculus
tgtcctcccttttaccagtgctgct

SEQ ID NO: 902747 - DNA, 25 bp, Mus musculus
tgtcctccgacccgttaagctttct

SEQ ID NO: 902748 - DNA, 25 bp, Mus musculus
tgtcctccgaccggttaagctttct

SEQ ID NO: 902749 - DNA, 25 bp, Mus musculus
tgtcctccgctgacagtgagtcagg

SEQ ID NO: 902750 - DNA, 25 bp, Mus musculus
tgtcctccgctgtcagtgagtcagg

SEQ ID NO: 902751 - DNA, 25 bp, Mus musculus
tgtcctccgtccacatatgagatgg

SEQ ID NO: 902752 - DNA, 25 bp, Mus musculus
tgtcctccgtcctcatatgagatgg

SEQ ID NO: 902753 - DNA, 25 bp, Mus musculus
tgtcctccgtgcagacagattgagt

SEQ ID NO: 902754 - DNA, 25 bp, Mus musculus
tgtcctccgtgctgacagattgagt

SEQ ID NO: 902755 - DNA, 25 bp, Mus musculus
tgtcctccgttccagtggagcaaat

SEQ ID NO: 902756 - DNA, 25 bp, Mus musculus
tgtcctccgttcgagtggagcaaat

SEQ ID NO: 902757 - DNA, 25 bp, Mus musculus
tgtcctcctctcagtcagtgaagaa

SEQ ID NO: 902758 - DNA, 25 bp, Mus musculus
tgtcctcctctctgtcagtgaagaa

SEQ ID NO: 902759 - DNA, 25 bp, Mus musculus
tgtcctcctgaacactctgagggat

SEQ ID NO: 902760 - DNA, 25 bp, Mus musculus
tgtcctcctgaagactctgagggat

SEQ ID NO: 902761 - DNA, 25 bp, Mus musculus
tgtcctcctgggagagaatgggcct

SEQ ID NO: 902762 - DNA, 25 bp, Mus musculus
tgtcctcctgggtgagaatgggcct

SEQ ID NO: 902763 - DNA, 25 bp, Mus musculus
tgtcctcgcagtcgtcacgcttaac

SEQ ID NO: 902764 - DNA, 25 bp, Mus musculus
tgtcctcgcagtggtcacgcttaac

SEQ ID NO: 902765 - DNA, 25 bp, Mus musculus
tgtcctcgctatacctgactggagc

SEQ ID NO: 902766 - DNA, 25 bp, Mus musculus
tgtcctcgctattcctgactggagc

SEQ ID NO: 902767 - DNA, 25 bp, Mus musculus
tgtcctcggaagatgaagtcacctg

SEQ ID NO: 902768 - DNA, 25 bp, Mus musculus
tgtcctcggaagttgaagtcacctg

SEQ ID NO: 902769 - DNA, 25 bp, Mus musculus
tgtcctcgtgtaactattaaaccgt

SEQ ID NO: 902770 - DNA, 25 bp, Mus musculus
tgtcctcgtgtatctattaaaccgt

SEQ ID NO: 902771 - DNA, 25 bp, Mus musculus
tgtcctctacagagaagtttctctt

SEQ ID NO: 902772 - DNA, 25 bp, Mus musculus
tgtcctctacagtgaagtttctctt

SEQ ID NO: 902773 - DNA, 25 bp, Mus musculus
tgtcctctacctccaagctgtcagg

SEQ ID NO: 902774 - DNA, 25 bp, Mus musculus
tgtcctctacctgcaagctgtcagg

SEQ ID NO: 902775 - DNA, 25 bp, Mus musculus
tgtcctctatgaactggcactgtgg

SEQ ID NO: 902776 - DNA, 25 bp, Mus musculus
tgtcctctatgatctggcactgtgg

SEQ ID NO: 902777 - DNA, 25 bp, Mus musculus
tgtcctctcactaaactcagacttc

SEQ ID NO: 902778 - DNA, 25 bp, Mus musculus
tgtcctctcactcgcatgtgcaaat

SEQ ID NO: 902779 - DNA, 25 bp, Mus musculus
tgtcctctcactggcatgtgcaaat

SEQ ID NO: 902780 - DNA, 25 bp, Mus musculus
tgtcctctcacttaactcagacttc

SEQ ID NO: 902781 - DNA, 25 bp, Mus musculus
tgtcctctcagccagatttacctgg

SEQ ID NO: 902782 - DNA, 25 bp, Mus musculus
tgtcctctcagccatgtggcactgt

SEQ ID NO: 902783 - DNA, 25 bp, Mus musculus
tgtcctctcagcgagatttacctgg

SEQ ID NO: 902784 - DNA, 25 bp, Mus musculus
tgtcctctcagcgatgtggcactgt

SEQ ID NO: 902785 - DNA, 25 bp, Mus musculus
tgtcctctcagtaaacacaccaaca

SEQ ID NO: 902786 - DNA, 25 bp, Mus musculus
tgtcctctcagttaacacaccaaca

SEQ ID NO: 902787 - DNA, 25 bp, Mus musculus
tgtcctctcctcattgtaacaggtt

SEQ ID NO: 902788 - DNA, 25 bp, Mus musculus
tgtcctctcctctttgtaacaggtt

SEQ ID NO: 902789 - DNA, 25 bp, Mus musculus
tgtcctctcctgatacagccagaga

SEQ ID NO: 902790 - DNA, 25 bp, Mus musculus
tgtcctctcctgttacagccagaga

SEQ ID NO: 902791 - DNA, 25 bp, Mus musculus
tgtcctctcgacctatcttgacaga

SEQ ID NO: 902792 - DNA, 25 bp, Mus musculus
tgtcctctcgacgtatcttgacaga

SEQ ID NO: 902793 - DNA, 25 bp, Mus musculus
tgtcctctcgtaaccctgtccaaaa

SEQ ID NO: 902794 - DNA, 25 bp, Mus musculus
tgtcctctcgtatccctgtccaaaa

SEQ ID NO: 902795 - DNA, 25 bp, Mus musculus
tgtcctctctgtcatctgtcacgat

SEQ ID NO: 902796 - DNA, 25 bp, Mus musculus
tgtcctctctgtgatctgtcacgat

SEQ ID NO: 902797 - DNA, 25 bp, Mus musculus
tgtcctctgaacagaaccttgccag

SEQ ID NO: 902798 - DNA, 25 bp, Mus musculus
tgtcctctgaactgaaccttgccag

SEQ ID NO: 902799 - DNA, 25 bp, Mus musculus
tgtcctctgaagaaccctacatttc

SEQ ID NO: 902800 - DNA, 25 bp, Mus musculus
tgtcctctgaagtaccctacatttc

SEQ ID NO: 902801 - DNA, 25 bp, Mus musculus
tgtcctctgacaattctccttaaga

SEQ ID NO: 902802 - DNA, 25 bp, Mus musculus
tgtcctctgacatttctccttaaga

SEQ ID NO: 902803 - DNA, 25 bp, Mus musculus
tgtcctctgactagccctcaaagtt

SEQ ID NO: 902804 - DNA, 25 bp, Mus musculus
tgtcctctgacttgccctcaaagtt

SEQ ID NO: 902805 - DNA, 25 bp, Mus musculus
tgtcctctgagtatctgagtctcca

SEQ ID NO: 902806 - DNA, 25 bp, Mus musculus
tgtcctctgagtttctgagtctcca

SEQ ID NO: 902807 - DNA, 25 bp, Mus musculus
tgtcctctgatgctcaaagtcctgg

SEQ ID NO: 902808 - DNA, 25 bp, Mus musculus
tgtcctctgatggtcaaagtcctgg

SEQ ID NO: 902809 - DNA, 25 bp, Mus musculus
tgtcctctgcacatactcgggagat

SEQ ID NO: 902810 - DNA, 25 bp, Mus musculus
tgtcctctgcacttactcgggagat

SEQ ID NO: 902811 - DNA, 25 bp, Mus musculus
tgtcctctgcccagtgtaaggttgt

SEQ ID NO: 902812 - DNA, 25 bp, Mus musculus
tgtcctctgccctgtgtaaggttgt

SEQ ID NO: 902813 - DNA, 25 bp, Mus musculus
tgtcctctgcgtactgagactagat

SEQ ID NO: 902814 - DNA, 25 bp, Mus musculus
tgtcctctgcgttctgagactagat

SEQ ID NO: 902815 - DNA, 25 bp, Mus musculus
tgtcctctgcttctgccataatggg

SEQ ID NO: 902816 - DNA, 25 bp, Mus musculus
tgtcctctgcttgtgccataatggg

SEQ ID NO: 902817 - DNA, 25 bp, Mus musculus
tgtcctctggacacattccaaggga

SEQ ID NO: 902818 - DNA, 25 bp, Mus musculus
tgtcctctggactcattccaaggga

SEQ ID NO: 902819 - DNA, 25 bp, Mus musculus
tgtcctctgggaactaggcaacatg

SEQ ID NO: 902820 - DNA, 25 bp, Mus musculus
tgtcctctgggaattcttcacttct

SEQ ID NO: 902821 - DNA, 25 bp, Mus musculus
tgtcctctgggatctaggcaacatg

SEQ ID NO: 902822 - DNA, 25 bp, Mus musculus
tgtcctctgggatttcttcacttct

SEQ ID NO: 902823 - DNA, 25 bp, Mus musculus
tgtcctctgggtacttataggatgt

SEQ ID NO: 902824 - DNA, 25 bp, Mus musculus
tgtcctctgggttcttataggatgt

SEQ ID NO: 902825 - DNA, 25 bp, Mus musculus
tgtcctctggtcatgctatcaagca

SEQ ID NO: 902826 - DNA, 25 bp, Mus musculus
tgtcctctggtcttgctatcaagca

SEQ ID NO: 902827 - DNA, 25 bp, Mus musculus
tgtcctctgttgcacaaagttctgt

SEQ ID NO: 902828 - DNA, 25 bp, Mus musculus
tgtcctctgttggacaaagttctgt

SEQ ID NO: 902829 - DNA, 25 bp, Mus musculus
tgtcctctgtttccccgggtttgat

SEQ ID NO: 902830 - DNA, 25 bp, Mus musculus
tgtcctctgtttgcccgggtttgat

SEQ ID NO: 902831 - DNA, 25 bp, Mus musculus
tgtcctcttcaacgtgggcatcaat

SEQ ID NO: 902832 - DNA, 25 bp, Mus musculus
tgtcctcttcaaggtgggcatcaat

SEQ ID NO: 902833 - DNA, 25 bp, Mus musculus
tgtcctcttgaactgcctgcataag

SEQ ID NO: 902834 - DNA, 25 bp, Mus musculus
tgtcctcttgaagtgcctgcataag

SEQ ID NO: 902835 - DNA, 25 bp, Mus musculus
tgtcctcttgcaaggtactcagggt

SEQ ID NO: 902836 - DNA, 25 bp, Mus musculus
tgtcctcttgcatggtactcagggt

SEQ ID NO: 902837 - DNA, 25 bp, Mus musculus
tgtcctcttgctactgggacctagt

SEQ ID NO: 902838 - DNA, 25 bp, Mus musculus
tgtcctcttgcttctgggacctagt

SEQ ID NO: 902839 - DNA, 25 bp, Mus musculus
tgtcctcttgtactatagtcctgcc

SEQ ID NO: 902840 - DNA, 25 bp, Mus musculus
tgtcctcttgtagtatagtcctgcc

SEQ ID NO: 902841 - DNA, 25 bp, Mus musculus
tgtcctcttgtccatggtgatactg

SEQ ID NO: 902842 - DNA, 25 bp, Mus musculus
tgtcctcttgtcgatggtgatactg

SEQ ID NO: 902843 - DNA, 25 bp, Mus musculus
tgtcctctttcacaatctactgttt

SEQ ID NO: 902844 - DNA, 25 bp, Mus musculus
tgtcctctttcagaatctactgttt

SEQ ID NO: 902845 - DNA, 25 bp, Mus musculus
tgtcctcttttcatccatcgcgtca

SEQ ID NO: 902846 - DNA, 25 bp, Mus musculus
tgtcctcttttcttccatcgcgtca

SEQ ID NO: 902847 - DNA, 25 bp, Mus musculus
tgtcctcttttgacctcttgtcaca

SEQ ID NO: 902848 - DNA, 25 bp, Mus musculus
tgtcctcttttgtcctcttgtcaca

SEQ ID NO: 902849 - DNA, 25 bp, Mus musculus
tgtcctgaaatgaagtcacagcttc

SEQ ID NO: 902850 - DNA, 25 bp, Mus musculus
tgtcctgaaatgtagtcacagcttc

SEQ ID NO: 902851 - DNA, 25 bp, Mus musculus
tgtcctgaacaccagcatatgccca

SEQ ID NO: 902852 - DNA, 25 bp, Mus musculus
tgtcctgaacacgagcatatgccca

SEQ ID NO: 902853 - DNA, 25 bp, Mus musculus
tgtcctgaacctcgagcttcacaat

SEQ ID NO: 902854 - DNA, 25 bp, Mus musculus
tgtcctgaacctggagcttcacaat

SEQ ID NO: 902855 - DNA, 25 bp, Mus musculus
tgtcctgaactactgcttcctagaa

SEQ ID NO: 902856 - DNA, 25 bp, Mus musculus
tgtcctgaactagtgcttcctagaa

SEQ ID NO: 902857 - DNA, 25 bp, Mus musculus
tgtcctgaactcacgcttcctagaa

SEQ ID NO: 902858 - DNA, 25 bp, Mus musculus
tgtcctgaactcatctctcaaagct

SEQ ID NO: 902859 - DNA, 25 bp, Mus musculus
tgtcctgaactctcgcttcctagaa

SEQ ID NO: 902860 - DNA, 25 bp, Mus musculus
tgtcctgaactcttctctcaaagct

SEQ ID NO: 902861 - DNA, 25 bp, Mus musculus
tgtcctgaagatcttgaccaccctg

SEQ ID NO: 902862 - DNA, 25 bp, Mus musculus
tgtcctgaagatgttgaccaccctg

SEQ ID NO: 902863 - DNA, 25 bp, Mus musculus
tgtcctgaccacagagtctccagaa

SEQ ID NO: 902864 - DNA, 25 bp, Mus musculus
tgtcctgaccacattgctgctatag

SEQ ID NO: 902865 - DNA, 25 bp, Mus musculus
tgtcctgaccactgagtctccagaa

SEQ ID NO: 902866 - DNA, 25 bp, Mus musculus
tgtcctgaccactttgctgctatag

SEQ ID NO: 902867 - DNA, 25 bp, Mus musculus
tgtcctgactcaaacactgttattt

SEQ ID NO: 902868 - DNA, 25 bp, Mus musculus
tgtcctgactcaacttcaggctgaa

SEQ ID NO: 902869 - DNA, 25 bp, Mus musculus
tgtcctgactcatacactgttattt

SEQ ID NO: 902870 - DNA, 25 bp, Mus musculus
tgtcctgactcatcttcaggctgaa

SEQ ID NO: 902871 - DNA, 25 bp, Mus musculus
tgtcctgagacacctcacatcgggt

SEQ ID NO: 902872 - DNA, 25 bp, Mus musculus
tgtcctgagacagctcacatcgggt

SEQ ID NO: 902873 - DNA, 25 bp, Mus musculus
tgtcctgagaggctgtttatttcaa

SEQ ID NO: 902874 - DNA, 25 bp, Mus musculus
tgtcctgagagggtgtttatttcaa

SEQ ID NO: 902875 - DNA, 25 bp, Mus musculus
tgtcctgagcagcactcagagctat

SEQ ID NO: 902876 - DNA, 25 bp, Mus musculus
tgtcctgagcaggactcagagctat

SEQ ID NO: 902877 - DNA, 25 bp, Mus musculus
tgtcctgagcatcgcagtcttggtt

SEQ ID NO: 902878 - DNA, 25 bp, Mus musculus
tgtcctgagcatggcagtcttggtt

SEQ ID NO: 902879 - DNA, 25 bp, Mus musculus
tgtcctgagccaaatctgccattgg

SEQ ID NO: 902880 - DNA, 25 bp, Mus musculus
tgtcctgagccatatctgccattgg

SEQ ID NO: 902881 - DNA, 25 bp, Mus musculus
tgtcctgagcctctcatggtatcca

SEQ ID NO: 902882 - DNA, 25 bp, Mus musculus
tgtcctgagcctgtcatggtatcca

SEQ ID NO: 902883 - DNA, 25 bp, Mus musculus
tgtcctgagctcaacagtcacacat

SEQ ID NO: 902884 - DNA, 25 bp, Mus musculus
tgtcctgagctcagtaatgtcctga

SEQ ID NO: 902885 - DNA, 25 bp, Mus musculus
tgtcctgagctctacagtcacacat

SEQ ID NO: 902886 - DNA, 25 bp, Mus musculus
tgtcctgagctctgtaatgtcctga

SEQ ID NO: 902887 - DNA, 25 bp, Mus musculus
tgtcctgaggagcaaccagatgacc

SEQ ID NO: 902888 - DNA, 25 bp, Mus musculus
tgtcctgaggaggaaccagatgacc

SEQ ID NO: 902889 - DNA, 25 bp, Mus musculus
tgtcctgaggatctagttctatcaa

SEQ ID NO: 902890 - DNA, 25 bp, Mus musculus
tgtcctgaggatgtagttctatcaa

SEQ ID NO: 902891 - DNA, 25 bp, Mus musculus
tgtcctgatagaaattccgggctcc

SEQ ID NO: 902892 - DNA, 25 bp, Mus musculus
tgtcctgatagatattccgggctcc

SEQ ID NO: 902893 - DNA, 25 bp, Mus musculus
tgtcctgatgcaacttttgcctaat

SEQ ID NO: 902894 - DNA, 25 bp, Mus musculus
tgtcctgatgcatcttttgcctaat

SEQ ID NO: 902895 - DNA, 25 bp, Mus musculus
tgtcctgatgccagtgtccatgtag

SEQ ID NO: 902896 - DNA, 25 bp, Mus musculus
tgtcctgatgccagttgtcgtctaa

SEQ ID NO: 902897 - DNA, 25 bp, Mus musculus
tgtcctgatgcctgtgtccatgtag

SEQ ID NO: 902898 - DNA, 25 bp, Mus musculus
tgtcctgatgcctgttgtcgtctaa

SEQ ID NO: 902899 - DNA, 25 bp, Mus musculus
tgtcctgattgtcgtcgtagccatg

SEQ ID NO: 902900 - DNA, 25 bp, Mus musculus
tgtcctgattgtggtcgtagccatg

SEQ ID NO: 902901 - DNA, 25 bp, Mus musculus
tgtcctgcaatgaatcgtttagcca

SEQ ID NO: 902902 - DNA, 25 bp, Mus musculus
tgtcctgcaatgtatcgtttagcca

SEQ ID NO: 902903 - DNA, 25 bp, Mus musculus
tgtcctgcacatattgaagagttca

SEQ ID NO: 902904 - DNA, 25 bp, Mus musculus
tgtcctgcacattttgaagagttca

SEQ ID NO: 902905 - DNA, 25 bp, Mus musculus
tgtcctgcactcagaggtcgtggta

SEQ ID NO: 902906 - DNA, 25 bp, Mus musculus
tgtcctgcactctgaggtcgtggta

SEQ ID NO: 902907 - DNA, 25 bp, Mus musculus
tgtcctgcagaaccttgggccacta

SEQ ID NO: 902908 - DNA, 25 bp, Mus musculus
tgtcctgcagaagcttgggccacta

SEQ ID NO: 902909 - DNA, 25 bp, Mus musculus
tgtcctgcagataaaatgtgtcact

SEQ ID NO: 902910 - DNA, 25 bp, Mus musculus
tgtcctgcagatcgattaccacctt

SEQ ID NO: 902911 - DNA, 25 bp, Mus musculus
tgtcctgcagatcgtccaagccatg

SEQ ID NO: 902912 - DNA, 25 bp, Mus musculus
tgtcctgcagatggattaccacctt

SEQ ID NO: 902913 - DNA, 25 bp, Mus musculus
tgtcctgcagatggtccaagccatg

SEQ ID NO: 902914 - DNA, 25 bp, Mus musculus
tgtcctgcagattaaatgtgtcact

SEQ ID NO: 902915 - DNA, 25 bp, Mus musculus
tgtcctgcagtgagatagtgatcca

SEQ ID NO: 902916 - DNA, 25 bp, Mus musculus
tgtcctgcagtgtgatagtgatcca

SEQ ID NO: 902917 - DNA, 25 bp, Mus musculus
tgtcctgccatcattctgatttgac

SEQ ID NO: 902918 - DNA, 25 bp, Mus musculus
tgtcctgccatctttctgatttgac

SEQ ID NO: 902919 - DNA, 25 bp, Mus musculus
tgtcctgcccatatacctgtgaact

SEQ ID NO: 902920 - DNA, 25 bp, Mus musculus
tgtcctgcccatttacctgtgaact

SEQ ID NO: 902921 - DNA, 25 bp, Mus musculus
tgtcctgcccctagagatgctgaaa

SEQ ID NO: 902922 - DNA, 25 bp, Mus musculus
tgtcctgccccttgagatgctgaaa

SEQ ID NO: 902923 - DNA, 25 bp, Mus musculus
tgtcctgccctcatacatataacat

SEQ ID NO: 902924 - DNA, 25 bp, Mus musculus
tgtcctgccctcttacatataacat

SEQ ID NO: 902925 - DNA, 25 bp, Mus musculus
tgtcctgcccttctaagccatggct

SEQ ID NO: 902926 - DNA, 25 bp, Mus musculus
tgtcctgcccttgtaagccatggct

SEQ ID NO: 902927 - DNA, 25 bp, Mus musculus
tgtcctgcctatctctgttgtcttg

SEQ ID NO: 902928 - DNA, 25 bp, Mus musculus
tgtcctgcctatgtctgttgtcttg

SEQ ID NO: 902929 - DNA, 25 bp, Mus musculus
tgtcctgccttactgtatttcatga

SEQ ID NO: 902930 - DNA, 25 bp, Mus musculus
tgtcctgccttagtgtatttcatga

SEQ ID NO: 902931 - DNA, 25 bp, Mus musculus
tgtcctgccttgagcctattaaaca

SEQ ID NO: 902932 - DNA, 25 bp, Mus musculus
tgtcctgccttgtgcctattaaaca

SEQ ID NO: 902933 - DNA, 25 bp, Mus musculus
tgtcctgcggcaccgtgttgaagct

SEQ ID NO: 902934 - DNA, 25 bp, Mus musculus
tgtcctgcggcagcgtgttgaagct

SEQ ID NO: 902935 - DNA, 25 bp, Mus musculus
tgtcctgcggccacccgtgggattc

SEQ ID NO: 902936 - DNA, 25 bp, Mus musculus
tgtcctgcggcctcccgtgggattc

SEQ ID NO: 902937 - DNA, 25 bp, Mus musculus
tgtcctgctaaacccaaaggttctt

SEQ ID NO: 902938 - DNA, 25 bp, Mus musculus
tgtcctgctaaagccaaaggttctt

SEQ ID NO: 902939 - DNA, 25 bp, Mus musculus
tgtcctgctaatctgctcttggata

SEQ ID NO: 902940 - DNA, 25 bp, Mus musculus
tgtcctgctaatgtgctcttggata

SEQ ID NO: 902941 - DNA, 25 bp, Mus musculus
tgtcctgctgaaatgtggaaccaga

SEQ ID NO: 902942 - DNA, 25 bp, Mus musculus
tgtcctgctgaattgtggaaccaga

SEQ ID NO: 902943 - DNA, 25 bp, Mus musculus
tgtcctgctggcagcaccagtgatg

SEQ ID NO: 902944 - DNA, 25 bp, Mus musculus
tgtcctgctggctgcaccagtgatg

SEQ ID NO: 902945 - DNA, 25 bp, Mus musculus
tgtcctgctggtcctgattgtggtc

SEQ ID NO: 902946 - DNA, 25 bp, Mus musculus
tgtcctgctggtgctgattgtggtc

SEQ ID NO: 902947 - DNA, 25 bp, Mus musculus
tgtcctgctgttattacaggccttt

SEQ ID NO: 902948 - DNA, 25 bp, Mus musculus
tgtcctgctgtttttacaggccttt

SEQ ID NO: 902949 - DNA, 25 bp, Mus musculus
tgtcctgcttggagtccacagggag

SEQ ID NO: 902950 - DNA, 25 bp, Mus musculus
tgtcctgcttggtgtccacagggag

SEQ ID NO: 902951 - DNA, 25 bp, Mus musculus
tgtcctggaactctggcctcgaact

SEQ ID NO: 902952 - DNA, 25 bp, Mus musculus
tgtcctggaactgtggcctcgaact

SEQ ID NO: 902953 - DNA, 25 bp, Mus musculus
tgtcctggagctcacagtagctagg

SEQ ID NO: 902954 - DNA, 25 bp, Mus musculus
tgtcctggagctgacagtagctagg

SEQ ID NO: 902955 - DNA, 25 bp, Mus musculus
tgtcctggaggcaccatgccagcag

SEQ ID NO: 902956 - DNA, 25 bp, Mus musculus
tgtcctggaggctccatgccagcag

SEQ ID NO: 902957 - DNA, 25 bp, Mus musculus
tgtcctggatccacggcaagcacag

SEQ ID NO: 902958 - DNA, 25 bp, Mus musculus
tgtcctggatcctcggcaagcacag

SEQ ID NO: 902959 - DNA, 25 bp, Mus musculus
tgtcctggcccgacgacatgtgctg

SEQ ID NO: 902960 - DNA, 25 bp, Mus musculus
tgtcctggcccgtcgacatgtgctg

SEQ ID NO: 902961 - DNA, 25 bp, Mus musculus
tgtcctggccgaagactacagcatc

SEQ ID NO: 902962 - DNA, 25 bp, Mus musculus
tgtcctggccgatgactacagcatc

SEQ ID NO: 902963 - DNA, 25 bp, Mus musculus
tgtcctggcgccaggtatacagtag

SEQ ID NO: 902964 - DNA, 25 bp, Mus musculus
tgtcctggcgcctggtatacagtag

SEQ ID NO: 902965 - DNA, 25 bp, Mus musculus
tgtcctggcgtgaaaatcttggaga

SEQ ID NO: 902966 - DNA, 25 bp, Mus musculus
tgtcctggcgtgtaaatcttggaga

SEQ ID NO: 902967 - DNA, 25 bp, Mus musculus
tgtcctggctttctcagtgatagag

SEQ ID NO: 902968 - DNA, 25 bp, Mus musculus
tgtcctggctttgtcagtgatagag

SEQ ID NO: 902969 - DNA, 25 bp, Mus musculus
tgtcctgggaagatctgaggcctaa

SEQ ID NO: 902970 - DNA, 25 bp, Mus musculus
tgtcctgggaagttctgaggcctaa

SEQ ID NO: 902971 - DNA, 25 bp, Mus musculus
tgtcctgggttgatttgcaccttgc

SEQ ID NO: 902972 - DNA, 25 bp, Mus musculus
tgtcctgggttgttttgcaccttgc

SEQ ID NO: 902973 - DNA, 25 bp, Mus musculus
tgtcctggtacacggtctgttgagt

SEQ ID NO: 902974 - DNA, 25 bp, Mus musculus
tgtcctggtacagggtctgttgagt

SEQ ID NO: 902975 - DNA, 25 bp, Mus musculus
tgtcctggtcagcatctgcaccaac

SEQ ID NO: 902976 - DNA, 25 bp, Mus musculus
tgtcctggtcaggatctgcaccaac

SEQ ID NO: 902977 - DNA, 25 bp, Mus musculus
tgtcctggtcatagctgtgtaagat

SEQ ID NO: 902978 - DNA, 25 bp, Mus musculus
tgtcctggtcattgctgtgtaagat

SEQ ID NO: 902979 - DNA, 25 bp, Mus musculus
tgtcctggtcctacatgtatgtagt

SEQ ID NO: 902980 - DNA, 25 bp, Mus musculus
tgtcctggtccttcatgtatgtagt

SEQ ID NO: 902981 - DNA, 25 bp, Mus musculus
tgtcctggtggcactagccaaggga

SEQ ID NO: 902982 - DNA, 25 bp, Mus musculus
tgtcctggtggctctagccaaggga

SEQ ID NO: 902983 - DNA, 25 bp, Mus musculus
tgtcctggtgggacctagcctatgg

SEQ ID NO: 902984 - DNA, 25 bp, Mus musculus
tgtcctggtgggtcctagcctatgg

SEQ ID NO: 902985 - DNA, 25 bp, Mus musculus
tgtcctgtaagaatttccctcgtgt

SEQ ID NO: 902986 - DNA, 25 bp, Mus musculus
tgtcctgtaagattttccctcgtgt

SEQ ID NO: 902987 - DNA, 25 bp, Mus musculus
tgtcctgtaagcatgtcaaacgtat

SEQ ID NO: 902988 - DNA, 25 bp, Mus musculus
tgtcctgtaagcttgtcaaacgtat

SEQ ID NO: 902989 - DNA, 25 bp, Mus musculus
tgtcctgtacacactgcttgttata

SEQ ID NO: 902990 - DNA, 25 bp, Mus musculus
tgtcctgtacactctgcttgttata

SEQ ID NO: 902991 - DNA, 25 bp, Mus musculus
tgtcctgtagtgcattcagagctgc

SEQ ID NO: 902992 - DNA, 25 bp, Mus musculus
tgtcctgtagtggattcagagctgc

SEQ ID NO: 902993 - DNA, 25 bp, Mus musculus
tgtcctgtatctccgtttccaagta

SEQ ID NO: 902994 - DNA, 25 bp, Mus musculus
tgtcctgtatctgcgtttccaagta

SEQ ID NO: 902995 - DNA, 25 bp, Mus musculus
tgtcctgtcaacacaagcatctatg

SEQ ID NO: 902996 - DNA, 25 bp, Mus musculus
tgtcctgtcaactcaagcatctatg

SEQ ID NO: 902997 - DNA, 25 bp, Mus musculus
tgtcctgtcgaaagcttgctcaagt

SEQ ID NO: 902998 - DNA, 25 bp, Mus musculus
tgtcctgtcgaatgcttgctcaagt

SEQ ID NO: 902999 - DNA, 25 bp, Mus musculus
tgtcctgtctctacctttgtctgta

SEQ ID NO: 903000 - DNA, 25 bp, Mus musculus
tgtcctgtctcttcctttgtctgta

SEQ ID NO: 903001 - DNA, 25 bp, Mus musculus
tgtcctgtgagaatggctgacccga

SEQ ID NO: 903002 - DNA, 25 bp, Mus musculus
tgtcctgtgagattggctgacccga

SEQ ID NO: 903003 - DNA, 25 bp, Mus musculus
tgtcctgtgaggatggcatgctcca

SEQ ID NO: 903004 - DNA, 25 bp, Mus musculus
tgtcctgtgaggttggcatgctcca

SEQ ID NO: 903005 - DNA, 25 bp, Mus musculus
tgtcctgtgatcatttgcccgtcct

SEQ ID NO: 903006 - DNA, 25 bp, Mus musculus
tgtcctgtgatcttttgcccgtcct

SEQ ID NO: 903007 - DNA, 25 bp, Mus musculus
tgtcctgtgatgcatctctacacca

SEQ ID NO: 903008 - DNA, 25 bp, Mus musculus
tgtcctgtgatggatctctacacca

SEQ ID NO: 903009 - DNA, 25 bp, Mus musculus
tgtcctgtgcacatctgttccacaa

SEQ ID NO: 903010 - DNA, 25 bp, Mus musculus
tgtcctgtgcacttctgttccacaa

SEQ ID NO: 903011 - DNA, 25 bp, Mus musculus
tgtcctgtgcagagtgccacctgta

SEQ ID NO: 903012 - DNA, 25 bp, Mus musculus
tgtcctgtgcagtgtgccacctgta

SEQ ID NO: 903013 - DNA, 25 bp, Mus musculus
tgtcctgtgcccatcggaggaacga

SEQ ID NO: 903014 - DNA, 25 bp, Mus musculus
tgtcctgtgcccttcggaggaacga

SEQ ID NO: 903015 - DNA, 25 bp, Mus musculus
tgtcctgtgcttaagcctatgagag

SEQ ID NO: 903016 - DNA, 25 bp, Mus musculus
tgtcctgtgcttagttccacagtgg

SEQ ID NO: 903017 - DNA, 25 bp, Mus musculus
tgtcctgtgctttagcctatgagag

SEQ ID NO: 903018 - DNA, 25 bp, Mus musculus
tgtcctgtgctttgttccacagtgg

SEQ ID NO: 903019 - DNA, 25 bp, Mus musculus
tgtcctgtggatcagccttctccgg

SEQ ID NO: 903020 - DNA, 25 bp, Mus musculus
tgtcctgtggatgagccttctccgg

SEQ ID NO: 903021 - DNA, 25 bp, Mus musculus
tgtcctgtggcacgtgtacactcga

SEQ ID NO: 903022 - DNA, 25 bp, Mus musculus
tgtcctgtggcaggtgtacactcga

SEQ ID NO: 903023 - DNA, 25 bp, Mus musculus
tgtcctgtgggcactggacgagtcc

SEQ ID NO: 903024 - DNA, 25 bp, Mus musculus
tgtcctgtgggcatccagtgaagaa

SEQ ID NO: 903025 - DNA, 25 bp, Mus musculus
tgtcctgtgggcatgggcttcaaga

SEQ ID NO: 903026 - DNA, 25 bp, Mus musculus
tgtcctgtgggctctggacgagtcc

SEQ ID NO: 903027 - DNA, 25 bp, Mus musculus
tgtcctgtgggcttccagtgaagaa

SEQ ID NO: 903028 - DNA, 25 bp, Mus musculus
tgtcctgtgggcttgggcttcaaga

SEQ ID NO: 903029 - DNA, 25 bp, Mus musculus
tgtcctgtgtccagtctccccgaat

SEQ ID NO: 903030 - DNA, 25 bp, Mus musculus
tgtcctgtgtcctgtctccccgaat

SEQ ID NO: 903031 - DNA, 25 bp, Mus musculus
tgtcctgtgtctaagcagtcctagt

SEQ ID NO: 903032 - DNA, 25 bp, Mus musculus
tgtcctgtgtcttagcagtcctagt

SEQ ID NO: 903033 - DNA, 25 bp, Mus musculus
tgtcctgtgtgtacattagccatta

SEQ ID NO: 903034 - DNA, 25 bp, Mus musculus
tgtcctgtgtgtctatgtacttctc

SEQ ID NO: 903035 - DNA, 25 bp, Mus musculus
tgtcctgtgtgtgtatgtacttctc

SEQ ID NO: 903036 - DNA, 25 bp, Mus musculus
tgtcctgtgtgttcattagccatta

SEQ ID NO: 903037 - DNA, 25 bp, Mus musculus
tgtcctgtgttgacagggagccaaa

SEQ ID NO: 903038 - DNA, 25 bp, Mus musculus
tgtcctgtgttgtcagggagccaaa

SEQ ID NO: 903039 - DNA, 25 bp, Mus musculus
tgtcctgtgtttcactacgtgcccc

SEQ ID NO: 903040 - DNA, 25 bp, Mus musculus
tgtcctgtgtttctctcactagcat

SEQ ID NO: 903041 - DNA, 25 bp, Mus musculus
tgtcctgtgtttgactacgtgcccc

SEQ ID NO: 903042 - DNA, 25 bp, Mus musculus
tgtcctgtgtttgtctcactagcat

SEQ ID NO: 903043 - DNA, 25 bp, Mus musculus
tgtcctgttaaaagaaaagagtcct

SEQ ID NO: 903044 - DNA, 25 bp, Mus musculus
tgtcctgttaaatgaaaagagtcct

SEQ ID NO: 903045 - DNA, 25 bp, Mus musculus
tgtcctgttcagagtggccttgagc

SEQ ID NO: 903046 - DNA, 25 bp, Mus musculus
tgtcctgttcagtgtggccttgagc

SEQ ID NO: 903047 - DNA, 25 bp, Mus musculus
tgtcctgttcatcactgtccctgct

SEQ ID NO: 903048 - DNA, 25 bp, Mus musculus
tgtcctgttcatgactgtccctgct

SEQ ID NO: 903049 - DNA, 25 bp, Mus musculus
tgtcctgttctgaccatgttcaaaa

SEQ ID NO: 903050 - DNA, 25 bp, Mus musculus
tgtcctgttctgatgagcagtggcg

SEQ ID NO: 903051 - DNA, 25 bp, Mus musculus
tgtcctgttctgtccatgttcaaaa

SEQ ID NO: 903052 - DNA, 25 bp, Mus musculus
tgtcctgttctgttgagcagtggcg

SEQ ID NO: 903053 - DNA, 25 bp, Mus musculus
tgtcctgttgggacgctgaaatagc

SEQ ID NO: 903054 - DNA, 25 bp, Mus musculus
tgtcctgttgggtcgctgaaatagc

SEQ ID NO: 903055 - DNA, 25 bp, Mus musculus
tgtcctgtttggagcctgaatctaa

SEQ ID NO: 903056 - DNA, 25 bp, Mus musculus
tgtcctgtttggtgcctgaatctaa

SEQ ID NO: 903057 - DNA, 25 bp, Mus musculus
tgtcctgtttgtcagataggctccc

SEQ ID NO: 903058 - DNA, 25 bp, Mus musculus
tgtcctgtttgtgagataggctccc

SEQ ID NO: 903059 - DNA, 25 bp, Mus musculus
tgtccttaaacaatagtccactcct

SEQ ID NO: 903060 - DNA, 25 bp, Mus musculus
tgtccttaaacattagtccactcct

SEQ ID NO: 903061 - DNA, 25 bp, Mus musculus
tgtccttaactgatgtgctcctacc

SEQ ID NO: 903062 - DNA, 25 bp, Mus musculus
tgtccttaactgttgtgctcctacc

SEQ ID NO: 903063 - DNA, 25 bp, Mus musculus
tgtccttaatttatatttctgtttg

SEQ ID NO: 903064 - DNA, 25 bp, Mus musculus
tgtccttaatttttatttctgtttg

SEQ ID NO: 903065 - DNA, 25 bp, Mus musculus
tgtccttacaaaagttgggtgccac

SEQ ID NO: 903066 - DNA, 25 bp, Mus musculus
tgtccttacaaatgttgggtgccac

SEQ ID NO: 903067 - DNA, 25 bp, Mus musculus
tgtccttacactcaacctgtgctat

SEQ ID NO: 903068 - DNA, 25 bp, Mus musculus
tgtccttacactgaacctgtgctat

SEQ ID NO: 903069 - DNA, 25 bp, Mus musculus
tgtccttacaggagtgtcagtgtga

SEQ ID NO: 903070 - DNA, 25 bp, Mus musculus
tgtccttacaggtgtgtcagtgtga

SEQ ID NO: 903071 - DNA, 25 bp, Mus musculus
tgtccttaccttcctttatgtgcaa

SEQ ID NO: 903072 - DNA, 25 bp, Mus musculus
tgtccttaccttgctttatgtgcaa

SEQ ID NO: 903073 - DNA, 25 bp, Mus musculus
tgtccttactttactgcaagctttt

SEQ ID NO: 903074 - DNA, 25 bp, Mus musculus
tgtccttacttttctgcaagctttt

SEQ ID NO: 903075 - DNA, 25 bp, Mus musculus
tgtccttagagacttacttccaaag

SEQ ID NO: 903076 - DNA, 25 bp, Mus musculus
tgtccttagagagttacttccaaag

SEQ ID NO: 903077 - DNA, 25 bp, Mus musculus
tgtccttagcttctcactatacagg

SEQ ID NO: 903078 - DNA, 25 bp, Mus musculus
tgtccttagcttgtcactatacagg

SEQ ID NO: 903079 - DNA, 25 bp, Mus musculus
tgtccttaggtgagtgtttgtagtc

SEQ ID NO: 903080 - DNA, 25 bp, Mus musculus
tgtccttaggtgtgtgtttgtagtc

SEQ ID NO: 903081 - DNA, 25 bp, Mus musculus
tgtccttagtccagtctgtgtagaa

SEQ ID NO: 903082 - DNA, 25 bp, Mus musculus
tgtccttagtcctgtctgtgtagaa

SEQ ID NO: 903083 - DNA, 25 bp, Mus musculus
tgtccttatctaaaatgttcctggg

SEQ ID NO: 903084 - DNA, 25 bp, Mus musculus
tgtccttatctataatgttcctggg

SEQ ID NO: 903085 - DNA, 25 bp, Mus musculus
tgtccttatgtgagcaattctccag

SEQ ID NO: 903086 - DNA, 25 bp, Mus musculus
tgtccttatgtgtgcaattctccag

SEQ ID NO: 903087 - DNA, 25 bp, Mus musculus
tgtccttattacctttgtactccag

SEQ ID NO: 903088 - DNA, 25 bp, Mus musculus
tgtccttattacgtttgtactccag

SEQ ID NO: 903089 - DNA, 25 bp, Mus musculus
tgtccttcaagtatggaatctggcc

SEQ ID NO: 903090 - DNA, 25 bp, Mus musculus
tgtccttcaagtttggaatctggcc

SEQ ID NO: 903091 - DNA, 25 bp, Mus musculus
tgtccttcaatactgtaccctaaaa

SEQ ID NO: 903092 - DNA, 25 bp, Mus musculus
tgtccttcaatagtgtaccctaaaa

SEQ ID NO: 903093 - DNA, 25 bp, Mus musculus
tgtccttcactcattcctagctgca

SEQ ID NO: 903094 - DNA, 25 bp, Mus musculus
tgtccttcactctttcctagctgca

SEQ ID NO: 903095 - DNA, 25 bp, Mus musculus
tgtccttcaggacagcacggtgtta

SEQ ID NO: 903096 - DNA, 25 bp, Mus musculus
tgtccttcaggagagcacggtgtta

SEQ ID NO: 903097 - DNA, 25 bp, Mus musculus
tgtccttcaggcagcagagcatgta

SEQ ID NO: 903098 - DNA, 25 bp, Mus musculus
tgtccttcaggctgcagagcatgta

SEQ ID NO: 903099 - DNA, 25 bp, Mus musculus
tgtccttcagtacctaatgctcggt

SEQ ID NO: 903100 - DNA, 25 bp, Mus musculus
tgtccttcagtagctaatgctcggt

SEQ ID NO: 903101 - DNA, 25 bp, Mus musculus
tgtccttcattacaataccagcatc

SEQ ID NO: 903102 - DNA, 25 bp, Mus musculus
tgtccttcattagaataccagcatc

SEQ ID NO: 903103 - DNA, 25 bp, Mus musculus
tgtccttccaccagaatctggttta

SEQ ID NO: 903104 - DNA, 25 bp, Mus musculus
tgtccttccacctgaatctggttta

SEQ ID NO: 903105 - DNA, 25 bp, Mus musculus
tgtccttccaggacagatgacatag

SEQ ID NO: 903106 - DNA, 25 bp, Mus musculus
tgtccttccaggtcagatgacatag

SEQ ID NO: 903107 - DNA, 25 bp, Mus musculus
tgtccttcccatacgagcagacaag

SEQ ID NO: 903108 - DNA, 25 bp, Mus musculus
tgtccttcccattcgagcagacaag

SEQ ID NO: 903109 - DNA, 25 bp, Mus musculus
tgtccttcccggcagcagtcgagag

SEQ ID NO: 903110 - DNA, 25 bp, Mus musculus
tgtccttcccgggagcagtcgagag

SEQ ID NO: 903111 - DNA, 25 bp, Mus musculus
tgtccttccctgacttttaaaatgc

SEQ ID NO: 903112 - DNA, 25 bp, Mus musculus
tgtccttccctgtcttttaaaatgc

SEQ ID NO: 903113 - DNA, 25 bp, Mus musculus
tgtccttccgtaacttggtttctgt

SEQ ID NO: 903114 - DNA, 25 bp, Mus musculus
tgtccttccgtatcttggtttctgt

SEQ ID NO: 903115 - DNA, 25 bp, Mus musculus
tgtccttcctccactaatgttaaaa

SEQ ID NO: 903116 - DNA, 25 bp, Mus musculus
tgtccttcctcctctaatgttaaaa

SEQ ID NO: 903117 - DNA, 25 bp, Mus musculus
tgtccttcctgtctttgtccgtgga

SEQ ID NO: 903118 - DNA, 25 bp, Mus musculus
tgtccttcctgtgtttgtccgtgga

SEQ ID NO: 903119 - DNA, 25 bp, Mus musculus
tgtccttccttccttatgcttaacg

SEQ ID NO: 903120 - DNA, 25 bp, Mus musculus
tgtccttccttcgttatgcttaacg

SEQ ID NO: 903121 - DNA, 25 bp, Mus musculus
tgtccttccttgacagagtttctct

SEQ ID NO: 903122 - DNA, 25 bp, Mus musculus
tgtccttccttgtcagagtttctct

SEQ ID NO: 903123 - DNA, 25 bp, Mus musculus
tgtccttcgccacatcacagtcaat

SEQ ID NO: 903124 - DNA, 25 bp, Mus musculus
tgtccttcgccagatcacagtcaat

SEQ ID NO: 903125 - DNA, 25 bp, Mus musculus
tgtccttcgtccagtttacagagta

SEQ ID NO: 903126 - DNA, 25 bp, Mus musculus
tgtccttcgtcctgtttacagagta

SEQ ID NO: 903127 - DNA, 25 bp, Mus musculus
tgtccttctcatcgactccattcat

SEQ ID NO: 903128 - DNA, 25 bp, Mus musculus
tgtccttctcatggactccattcat

SEQ ID NO: 903129 - DNA, 25 bp, Mus musculus
tgtccttctgtccaaaggcagcagt

SEQ ID NO: 903130 - DNA, 25 bp, Mus musculus
tgtccttctgtcgaaaggcagcagt

SEQ ID NO: 903131 - DNA, 25 bp, Mus musculus
tgtccttgacatcagggctttgtta

SEQ ID NO: 903132 - DNA, 25 bp, Mus musculus
tgtccttgacatgagggctttgtta

SEQ ID NO: 903133 - DNA, 25 bp, Mus musculus
tgtccttgacctatcctggaataag

SEQ ID NO: 903134 - DNA, 25 bp, Mus musculus
tgtccttgacctttcctggaataag

SEQ ID NO: 903135 - DNA, 25 bp, Mus musculus
tgtccttgagatatgctactgatag

SEQ ID NO: 903136 - DNA, 25 bp, Mus musculus
tgtccttgagatttgctactgatag

SEQ ID NO: 903137 - DNA, 25 bp, Mus musculus
tgtccttgatccagagtcacagagt

SEQ ID NO: 903138 - DNA, 25 bp, Mus musculus
tgtccttgatcctgagtcacagagt

SEQ ID NO: 903139 - DNA, 25 bp, Mus musculus
tgtccttgccacctaggtgttaatg

SEQ ID NO: 903140 - DNA, 25 bp, Mus musculus
tgtccttgccacgtaggtgttaatg

SEQ ID NO: 903141 - DNA, 25 bp, Mus musculus
tgtccttgcctacgcgttggagctc

SEQ ID NO: 903142 - DNA, 25 bp, Mus musculus
tgtccttgcctaggcgttggagctc

SEQ ID NO: 903143 - DNA, 25 bp, Mus musculus
tgtccttgcgttctccagaaagact

SEQ ID NO: 903144 - DNA, 25 bp, Mus musculus
tgtccttgcgttgtccagaaagact

SEQ ID NO: 903145 - DNA, 25 bp, Mus musculus
tgtccttgctccactaagtaagatt

SEQ ID NO: 903146 - DNA, 25 bp, Mus musculus
tgtccttgctccatcttgtatgaga

SEQ ID NO: 903147 - DNA, 25 bp, Mus musculus
tgtccttgctcctctaagtaagatt

SEQ ID NO: 903148 - DNA, 25 bp, Mus musculus
tgtccttgctccttcttgtatgaga

SEQ ID NO: 903149 - DNA, 25 bp, Mus musculus
tgtccttggacacaaacctgcagat

SEQ ID NO: 903150 - DNA, 25 bp, Mus musculus
tgtccttggacagaaacctgcagat

SEQ ID NO: 903151 - DNA, 25 bp, Mus musculus
tgtccttggagcaatggccattatt

SEQ ID NO: 903152 - DNA, 25 bp, Mus musculus
tgtccttggagctatggccattatt

SEQ ID NO: 903153 - DNA, 25 bp, Mus musculus
tgtccttgggcgattccaggtgcaa

SEQ ID NO: 903154 - DNA, 25 bp, Mus musculus
tgtccttgggcgtttccaggtgcaa

SEQ ID NO: 903155 - DNA, 25 bp, Mus musculus
tgtccttggtgcagccggatccttg

SEQ ID NO: 903156 - DNA, 25 bp, Mus musculus
tgtccttggtgccatcctctcagac

SEQ ID NO: 903157 - DNA, 25 bp, Mus musculus
tgtccttggtgcgatcctctcagac

SEQ ID NO: 903158 - DNA, 25 bp, Mus musculus
tgtccttggtgctgccggatccttg

SEQ ID NO: 903159 - DNA, 25 bp, Mus musculus
tgtccttgtacccaggccctaaaga

SEQ ID NO: 903160 - DNA, 25 bp, Mus musculus
tgtccttgtaccgaggccctaaaga

SEQ ID NO: 903161 - DNA, 25 bp, Mus musculus
tgtccttgtagacgagtccccgact

SEQ ID NO: 903162 - DNA, 25 bp, Mus musculus
tgtccttgtagaggagtccccgact

SEQ ID NO: 903163 - DNA, 25 bp, Mus musculus
tgtccttgtagtcccttgcttaaag

SEQ ID NO: 903164 - DNA, 25 bp, Mus musculus
tgtccttgtagtgccttgcttaaag

SEQ ID NO: 903165 - DNA, 25 bp, Mus musculus
tgtccttgtctcaagcagggcggta

SEQ ID NO: 903166 - DNA, 25 bp, Mus musculus
tgtccttgtctctagcagggcggta

SEQ ID NO: 903167 - DNA, 25 bp, Mus musculus
tgtccttgtcttcgctatggccaca

SEQ ID NO: 903168 - DNA, 25 bp, Mus musculus
tgtccttgtcttggctatggccaca

SEQ ID NO: 903169 - DNA, 25 bp, Mus musculus
tgtccttgtgttctggtgaagtcca

SEQ ID NO: 903170 - DNA, 25 bp, Mus musculus
tgtccttgtgttgtggtgaagtcca

SEQ ID NO: 903171 - DNA, 25 bp, Mus musculus
tgtcctttaccacttctactcataa

SEQ ID NO: 903172 - DNA, 25 bp, Mus musculus
tgtcctttaccagttctactcataa

SEQ ID NO: 903173 - DNA, 25 bp, Mus musculus
tgtcctttcaaccttttgtttctga

SEQ ID NO: 903174 - DNA, 25 bp, Mus musculus
tgtcctttcaacgttttgtttctga

SEQ ID NO: 903175 - DNA, 25 bp, Mus musculus
tgtcctttcacaagtctgctttaac

SEQ ID NO: 903176 - DNA, 25 bp, Mus musculus
tgtcctttcacatgtctgctttaac

SEQ ID NO: 903177 - DNA, 25 bp, Mus musculus
tgtcctttcagcagtcagtctgtgg

SEQ ID NO: 903178 - DNA, 25 bp, Mus musculus
tgtcctttcagctgtcagtctgtgg

SEQ ID NO: 903179 - DNA, 25 bp, Mus musculus
tgtcctttcatccatggcctcagaa

SEQ ID NO: 903180 - DNA, 25 bp, Mus musculus
tgtcctttcatcgatggcctcagaa

SEQ ID NO: 903181 - DNA, 25 bp, Mus musculus
tgtcctttccatactagaccactaa

SEQ ID NO: 903182 - DNA, 25 bp, Mus musculus
tgtcctttccattctagaccactaa

SEQ ID NO: 903183 - DNA, 25 bp, Mus musculus
tgtcctttcccacctaagagggtgt

SEQ ID NO: 903184 - DNA, 25 bp, Mus musculus
tgtcctttcccagctaagagggtgt

SEQ ID NO: 903185 - DNA, 25 bp, Mus musculus
tgtcctttccctagcacacttaaaa

SEQ ID NO: 903186 - DNA, 25 bp, Mus musculus
tgtcctttcccttgcacacttaaaa

SEQ ID NO: 903187 - DNA, 25 bp, Mus musculus
tgtcctttccttaagcagattgctg

SEQ ID NO: 903188 - DNA, 25 bp, Mus musculus
tgtcctttcctttagcagattgctg

SEQ ID NO: 903189 - DNA, 25 bp, Mus musculus
tgtcctttctctatgcagtagctta

SEQ ID NO: 903190 - DNA, 25 bp, Mus musculus
tgtcctttctctttgcagtagctta

SEQ ID NO: 903191 - DNA, 25 bp, Mus musculus
tgtcctttgacccagcctctcattt

SEQ ID NO: 903192 - DNA, 25 bp, Mus musculus
tgtcctttgaccgagcctctcattt

SEQ ID NO: 903193 - DNA, 25 bp, Mus musculus
tgtcctttgagcactggtataattc

SEQ ID NO: 903194 - DNA, 25 bp, Mus musculus
tgtcctttgagctctggtataattc

SEQ ID NO: 903195 - DNA, 25 bp, Mus musculus
tgtcctttgatgctttatttgctaa

SEQ ID NO: 903196 - DNA, 25 bp, Mus musculus
tgtcctttgatggtttatttgctaa

SEQ ID NO: 903197 - DNA, 25 bp, Mus musculus
tgtcctttgcaacctgatcacagag

SEQ ID NO: 903198 - DNA, 25 bp, Mus musculus
tgtcctttgcaagctgatcacagag

SEQ ID NO: 903199 - DNA, 25 bp, Mus musculus
tgtcctttgcagcttgcttctggag

SEQ ID NO: 903200 - DNA, 25 bp, Mus musculus
tgtcctttgcaggttgcttctggag

SEQ ID NO: 903201 - DNA, 25 bp, Mus musculus
tgtcctttgccaaaatgttaacctt

SEQ ID NO: 903202 - DNA, 25 bp, Mus musculus
tgtcctttgccataatgttaacctt

SEQ ID NO: 903203 - DNA, 25 bp, Mus musculus
tgtcctttgcccctgtactgcatca

SEQ ID NO: 903204 - DNA, 25 bp, Mus musculus
tgtcctttgcccgtgtactgcatca

SEQ ID NO: 903205 - DNA, 25 bp, Mus musculus
tgtcctttggttaaattcactgtgg

SEQ ID NO: 903206 - DNA, 25 bp, Mus musculus
tgtcctttggtttaattcactgtgg

SEQ ID NO: 903207 - DNA, 25 bp, Mus musculus
tgtcctttgtacatcctctctgtgt

SEQ ID NO: 903208 - DNA, 25 bp, Mus musculus
tgtcctttgtacttcctctctgtgt

SEQ ID NO: 903209 - DNA, 25 bp, Mus musculus
tgtcctttgtcaccacaggtgcagg

SEQ ID NO: 903210 - DNA, 25 bp, Mus musculus
tgtcctttgtcagcacaggtgcagg

SEQ ID NO: 903211 - DNA, 25 bp, Mus musculus
tgtcctttgtgtacctgaagctaga

SEQ ID NO: 903212 - DNA, 25 bp, Mus musculus
tgtcctttgtgttcctgaagctaga

SEQ ID NO: 903213 - DNA, 25 bp, Mus musculus
tgtcctttgttaacacgtcttgttc

SEQ ID NO: 903214 - DNA, 25 bp, Mus musculus
tgtcctttgttatcacgtcttgttc

SEQ ID NO: 903215 - DNA, 25 bp, Mus musculus
tgtccttttaatacctgagaccctg

SEQ ID NO: 903216 - DNA, 25 bp, Mus musculus
tgtccttttaattcctgagaccctg

SEQ ID NO: 903217 - DNA, 25 bp, Mus musculus
tgtcgaagaaccagcctgagaccct

SEQ ID NO: 903218 - DNA, 25 bp, Mus musculus
tgtcgaagaacctgcctgagaccct

SEQ ID NO: 903219 - DNA, 25 bp, Mus musculus
tgtcgaagtgcaccccaaagtcagt

SEQ ID NO: 903220 - DNA, 25 bp, Mus musculus
tgtcgaagtgcagcccaaagtcagt

SEQ ID NO: 903221 - DNA, 25 bp, Mus musculus
tgtcgaatgctgaactttaatacta

SEQ ID NO: 903222 - DNA, 25 bp, Mus musculus
tgtcgaatgctgtactttaatacta

SEQ ID NO: 903223 - DNA, 25 bp, Mus musculus
tgtcgacaagcacgttttccaccag

SEQ ID NO: 903224 - DNA, 25 bp, Mus musculus
tgtcgacaagcaggttttccaccag

SEQ ID NO: 903225 - DNA, 25 bp, Mus musculus
tgtcgacaattcagcatcctgggat

SEQ ID NO: 903226 - DNA, 25 bp, Mus musculus
tgtcgacaattctgcatcctgggat

SEQ ID NO: 903227 - DNA, 25 bp, Mus musculus
tgtcgacacatccttctcatgggaa

SEQ ID NO: 903228 - DNA, 25 bp, Mus musculus
tgtcgacacatcgttctcatgggaa

SEQ ID NO: 903229 - DNA, 25 bp, Mus musculus
tgtcgacactgaacaccgtctggtc

SEQ ID NO: 903230 - DNA, 25 bp, Mus musculus
tgtcgacactgatcaccgtctggtc

SEQ ID NO: 903231 - DNA, 25 bp, Mus musculus
tgtcgaccatatacttggtacccca

SEQ ID NO: 903232 - DNA, 25 bp, Mus musculus
tgtcgaccatattcttggtacccca

SEQ ID NO: 903233 - DNA, 25 bp, Mus musculus
tgtcgacccgacaaaacttacctgg

SEQ ID NO: 903234 - DNA, 25 bp, Mus musculus
tgtcgacccgactaaacttacctgg

SEQ ID NO: 903235 - DNA, 25 bp, Mus musculus
tgtcgacctagccaagatcctgagt

SEQ ID NO: 903236 - DNA, 25 bp, Mus musculus
tgtcgacctagcgaagatcctgagt

SEQ ID NO: 903237 - DNA, 25 bp, Mus musculus
tgtcgactctgaaccttgctgaaac

SEQ ID NO: 903238 - DNA, 25 bp, Mus musculus
tgtcgactctgatccttgctgaaac

SEQ ID NO: 903239 - DNA, 25 bp, Mus musculus
tgtcgagaccctcaggcccaagaac

SEQ ID NO: 903240 - DNA, 25 bp, Mus musculus
tgtcgagaccctgaggcccaagaac

SEQ ID NO: 903241 - DNA, 25 bp, Mus musculus
tgtcgagatctaattgtcatggctt

SEQ ID NO: 903242 - DNA, 25 bp, Mus musculus
tgtcgagatctatttgtcatggctt

SEQ ID NO: 903243 - DNA, 25 bp, Mus musculus
tgtcgagatgccctgcagtgcagat

SEQ ID NO: 903244 - DNA, 25 bp, Mus musculus
tgtcgagatgccgtgcagtgcagat

SEQ ID NO: 903245 - DNA, 25 bp, Mus musculus
tgtcgagcatacagaaagccctggt

SEQ ID NO: 903246 - DNA, 25 bp, Mus musculus
tgtcgagcatactgaaagccctggt

SEQ ID NO: 903247 - DNA, 25 bp, Mus musculus
tgtcgaggtagcctggtgtccacat

SEQ ID NO: 903248 - DNA, 25 bp, Mus musculus
tgtcgaggtagcgtggtgtccacat

SEQ ID NO: 903249 - DNA, 25 bp, Mus musculus
tgtcgagtcctgatccatgtcttgc

SEQ ID NO: 903250 - DNA, 25 bp, Mus musculus
tgtcgagtcctgttccatgtcttgc

SEQ ID NO: 903251 - DNA, 25 bp, Mus musculus
tgtcgagtctcaattcgtccatgtc

SEQ ID NO: 903252 - DNA, 25 bp, Mus musculus
tgtcgagtctcatttcgtccatgtc

SEQ ID NO: 903253 - DNA, 25 bp, Mus musculus
tgtcgagtggttaccaccttaggtt

SEQ ID NO: 903254 - DNA, 25 bp, Mus musculus
tgtcgagtggtttccaccttaggtt

SEQ ID NO: 903255 - DNA, 25 bp, Mus musculus
tgtcgatctctgacacatccgatga

SEQ ID NO: 903256 - DNA, 25 bp, Mus musculus
tgtcgatctctgtcacatccgatga

SEQ ID NO: 903257 - DNA, 25 bp, Mus musculus
tgtcgatggtccaacatgcctgagg

SEQ ID NO: 903258 - DNA, 25 bp, Mus musculus
tgtcgatggtcctacatgcctgagg

SEQ ID NO: 903259 - DNA, 25 bp, Mus musculus
tgtcgattcaaactgaccccaactt

SEQ ID NO: 903260 - DNA, 25 bp, Mus musculus
tgtcgattcaaagtgaccccaactt

SEQ ID NO: 903261 - DNA, 25 bp, Mus musculus
tgtcgattgactacaaaccttcaga

SEQ ID NO: 903262 - DNA, 25 bp, Mus musculus
tgtcgattgacttcaaaccttcaga

SEQ ID NO: 903263 - DNA, 25 bp, Mus musculus
tgtcgattggccagttgggagcatt

SEQ ID NO: 903264 - DNA, 25 bp, Mus musculus
tgtcgattggcctgttgggagcatt

SEQ ID NO: 903265 - DNA, 25 bp, Mus musculus
tgtcgcagaaggatgctgcagccat

SEQ ID NO: 903266 - DNA, 25 bp, Mus musculus
tgtcgcagaaggttgctgcagccat

SEQ ID NO: 903267 - DNA, 25 bp, Mus musculus
tgtcgcagcaggctactccagggaa

SEQ ID NO: 903268 - DNA, 25 bp, Mus musculus
tgtcgcagcagggtactccagggaa

SEQ ID NO: 903269 - DNA, 25 bp, Mus musculus
tgtcgcagctatagcatacctgaag

SEQ ID NO: 903270 - DNA, 25 bp, Mus musculus
tgtcgcagctattgcatacctgaag

SEQ ID NO: 903271 - DNA, 25 bp, Mus musculus
tgtcgcagtgctactgttgctaggt

SEQ ID NO: 903272 - DNA, 25 bp, Mus musculus
tgtcgcagtgcttctgttgctaggt

SEQ ID NO: 903273 - DNA, 25 bp, Mus musculus
tgtcgcatagtgatcattggtgttc

SEQ ID NO: 903274 - DNA, 25 bp, Mus musculus
tgtcgcatagtgttcattggtgttc

SEQ ID NO: 903275 - DNA, 25 bp, Mus musculus
tgtcgcatcctacgtctgtgagata

SEQ ID NO: 903276 - DNA, 25 bp, Mus musculus
tgtcgcatcctaggtctgtgagata

SEQ ID NO: 903277 - DNA, 25 bp, Mus musculus
tgtcgcatggctacagaaggaccac

SEQ ID NO: 903278 - DNA, 25 bp, Mus musculus
tgtcgcatggcttcagaaggaccac

SEQ ID NO: 903279 - DNA, 25 bp, Mus musculus
tgtcgcattgcaatatacttttgta

SEQ ID NO: 903280 - DNA, 25 bp, Mus musculus
tgtcgcattgcattatacttttgta

SEQ ID NO: 903281 - DNA, 25 bp, Mus musculus
tgtcgccacttacagggttggagaa

SEQ ID NO: 903282 - DNA, 25 bp, Mus musculus
tgtcgccacttagagggttggagaa

SEQ ID NO: 903283 - DNA, 25 bp, Mus musculus
tgtcgccagagcctacttgagggcc

SEQ ID NO: 903284 - DNA, 25 bp, Mus musculus
tgtcgccagagcgtacttgagggcc

SEQ ID NO: 903285 - DNA, 25 bp, Mus musculus
tgtcgccagggcctcttggctctct

SEQ ID NO: 903286 - DNA, 25 bp, Mus musculus
tgtcgccagggcgtcttggctctct

SEQ ID NO: 903287 - DNA, 25 bp, Mus musculus
tgtcgccagggtaacagtgcgcata

SEQ ID NO: 903288 - DNA, 25 bp, Mus musculus
tgtcgccagggttacagtgcgcata

SEQ ID NO: 903289 - DNA, 25 bp, Mus musculus
tgtcgccatgcgaccaggttcaagg

SEQ ID NO: 903290 - DNA, 25 bp, Mus musculus
tgtcgccatgcgtccaggttcaagg

SEQ ID NO: 903291 - DNA, 25 bp, Mus musculus
tgtcgccattcgaaggccagtgtgg

SEQ ID NO: 903292 - DNA, 25 bp, Mus musculus
tgtcgccattcgtaggccagtgtgg

SEQ ID NO: 903293 - DNA, 25 bp, Mus musculus
tgtcgcccacggaatcagctgttgg

SEQ ID NO: 903294 - DNA, 25 bp, Mus musculus
tgtcgcccacggtatcagctgttgg

SEQ ID NO: 903295 - DNA, 25 bp, Mus musculus
tgtcgcccggcaccgtaggacaaat

SEQ ID NO: 903296 - DNA, 25 bp, Mus musculus
tgtcgcccggcagcgtaggacaaat

SEQ ID NO: 903297 - DNA, 25 bp, Mus musculus
tgtcgccctatgaatctccaagaga

SEQ ID NO: 903298 - DNA, 25 bp, Mus musculus
tgtcgccctatgtatctccaagaga

SEQ ID NO: 903299 - DNA, 25 bp, Mus musculus
tgtcgcctggtgaaagcatcttgca

SEQ ID NO: 903300 - DNA, 25 bp, Mus musculus
tgtcgcctggtgtaagcatcttgca

SEQ ID NO: 903301 - DNA, 25 bp, Mus musculus
tgtcgcctgtggagccaaactacga

SEQ ID NO: 903302 - DNA, 25 bp, Mus musculus
tgtcgcctgtggtgccaaactacga

SEQ ID NO: 903303 - DNA, 25 bp, Mus musculus
tgtcgctactgcactcgtgtggtca

SEQ ID NO: 903304 - DNA, 25 bp, Mus musculus
tgtcgctactgctctcgtgtggtca

SEQ ID NO: 903305 - DNA, 25 bp, Mus musculus
tgtcgctcaagaccacagtacactt

SEQ ID NO: 903306 - DNA, 25 bp, Mus musculus
tgtcgctcaagagcacagtacactt

SEQ ID NO: 903307 - DNA, 25 bp, Mus musculus
tgtcgctcaccacgcattcgttgga

SEQ ID NO: 903308 - DNA, 25 bp, Mus musculus
tgtcgctcaccaggcattcgttgga

SEQ ID NO: 903309 - DNA, 25 bp, Mus musculus
tgtcgctcagccacacggagacgca

SEQ ID NO: 903310 - DNA, 25 bp, Mus musculus
tgtcgctcagcctcacggagacgca

SEQ ID NO: 903311 - DNA, 25 bp, Mus musculus
tgtcgctcatttcatcttaatcacc

SEQ ID NO: 903312 - DNA, 25 bp, Mus musculus
tgtcgctcatttgatcttaatcacc

SEQ ID NO: 903313 - DNA, 25 bp, Mus musculus
tgtcgctccagcagctgtagtgcct

SEQ ID NO: 903314 - DNA, 25 bp, Mus musculus
tgtcgctccagctgctgtagtgcct

SEQ ID NO: 903315 - DNA, 25 bp, Mus musculus
tgtcgctccctaatgactaagcttt

SEQ ID NO: 903316 - DNA, 25 bp, Mus musculus
tgtcgctccctattgactaagcttt

SEQ ID NO: 903317 - DNA, 25 bp, Mus musculus
tgtcgctcctgcaaccaaaagaaaa

SEQ ID NO: 903318 - DNA, 25 bp, Mus musculus
tgtcgctcctgctaccaaaagaaaa

SEQ ID NO: 903319 - DNA, 25 bp, Mus musculus
tgtcgctcctggatctctttcattt

SEQ ID NO: 903320 - DNA, 25 bp, Mus musculus
tgtcgctcctggttctctttcattt

SEQ ID NO: 903321 - DNA, 25 bp, Mus musculus
tgtcgctcgcagctcccaaagaaac

SEQ ID NO: 903322 - DNA, 25 bp, Mus musculus
tgtcgctcgcaggtcccaaagaaac

SEQ ID NO: 903323 - DNA, 25 bp, Mus musculus
tgtcgctcggctctgtgtctctcta

SEQ ID NO: 903324 - DNA, 25 bp, Mus musculus
tgtcgctcggctgtgtgtctctcta

SEQ ID NO: 903325 - DNA, 25 bp, Mus musculus
tgtcgctctctgcttacactttcag

SEQ ID NO: 903326 - DNA, 25 bp, Mus musculus
tgtcgctctctggttacactttcag

SEQ ID NO: 903327 - DNA, 25 bp, Mus musculus
tgtcgctctttgattacccgtatgc

SEQ ID NO: 903328 - DNA, 25 bp, Mus musculus
tgtcgctctttgtttacccgtatgc

SEQ ID NO: 903329 - DNA, 25 bp, Mus musculus
tgtcgctgaatcacgtacctcacag

SEQ ID NO: 903330 - DNA, 25 bp, Mus musculus
tgtcgctgaatctcgtacctcacag

SEQ ID NO: 903331 - DNA, 25 bp, Mus musculus
tgtcgctgcccaagcaggaaactta

SEQ ID NO: 903332 - DNA, 25 bp, Mus musculus
tgtcgctgcccatgcaggaaactta

SEQ ID NO: 903333 - DNA, 25 bp, Mus musculus
tgtcgctggcgtctcatgtgatgta

SEQ ID NO: 903334 - DNA, 25 bp, Mus musculus
tgtcgctggcgtgtcatgtgatgta

SEQ ID NO: 903335 - DNA, 25 bp, Mus musculus
tgtcgcttctccacggaaacttgag

SEQ ID NO: 903336 - DNA, 25 bp, Mus musculus
tgtcgcttctcctcggaaacttgag

SEQ ID NO: 903337 - DNA, 25 bp, Mus musculus
tgtcggaaaccccttcctcgatgtg

SEQ ID NO: 903338 - DNA, 25 bp, Mus musculus
tgtcggaaacccgttcctcgatgtg

SEQ ID NO: 903339 - DNA, 25 bp, Mus musculus
tgtcggaagtgccactccgctagag

SEQ ID NO: 903340 - DNA, 25 bp, Mus musculus
tgtcggaagtgcgactccgctagag

SEQ ID NO: 903341 - DNA, 25 bp, Mus musculus
tgtcggaatagcaccagccgctcag

SEQ ID NO: 903342 - DNA, 25 bp, Mus musculus
tgtcggaatagctccagccgctcag

SEQ ID NO: 903343 - DNA, 25 bp, Mus musculus
tgtcggaatgacatcttttcttgta

SEQ ID NO: 903344 - DNA, 25 bp, Mus musculus
tgtcggaatgacttcttttcttgta

SEQ ID NO: 903345 - DNA, 25 bp, Mus musculus
tgtcggacaactacaagcgctcttt

SEQ ID NO: 903346 - DNA, 25 bp, Mus musculus
tgtcggacaacttcaagcgctcttt

SEQ ID NO: 903347 - DNA, 25 bp, Mus musculus
tgtcggaccctactcagggtccctt

SEQ ID NO: 903348 - DNA, 25 bp, Mus musculus
tgtcggaccctagtcagggtccctt

SEQ ID NO: 903349 - DNA, 25 bp, Mus musculus
tgtcggacgtacatcaacccttttg

SEQ ID NO: 903350 - DNA, 25 bp, Mus musculus
tgtcggacgtacttcaacccttttg

SEQ ID NO: 903351 - DNA, 25 bp, Mus musculus
tgtcggacttttctataggctatga

SEQ ID NO: 903352 - DNA, 25 bp, Mus musculus
tgtcggacttttgtataggctatga

SEQ ID NO: 903353 - DNA, 25 bp, Mus musculus
tgtcggaggccgaccataggcgcca

SEQ ID NO: 903354 - DNA, 25 bp, Mus musculus
tgtcggaggccgtccataggcgcca

SEQ ID NO: 903355 - DNA, 25 bp, Mus musculus
tgtcggatccccaggcattatagaa

SEQ ID NO: 903356 - DNA, 25 bp, Mus musculus
tgtcggatcccctggcattatagaa

SEQ ID NO: 903357 - DNA, 25 bp, Mus musculus
tgtcggcaccagagggcaggctctt

SEQ ID NO: 903358 - DNA, 25 bp, Mus musculus
tgtcggcaccagtgggcaggctctt

SEQ ID NO: 903359 - DNA, 25 bp, Mus musculus
tgtcggcaccggacctgtcagactt

SEQ ID NO: 903360 - DNA, 25 bp, Mus musculus
tgtcggcaccggtcctgtcagactt

SEQ ID NO: 903361 - DNA, 25 bp, Mus musculus
tgtcggccctgtctcaaagctggtg

SEQ ID NO: 903362 - DNA, 25 bp, Mus musculus
tgtcggccctgtgtcaaagctggtg

SEQ ID NO: 903363 - DNA, 25 bp, Mus musculus
tgtcggccgggcataagtcgcatct

SEQ ID NO: 903364 - DNA, 25 bp, Mus musculus
tgtcggccgggcttaagtcgcatct

SEQ ID NO: 903365 - DNA, 25 bp, Mus musculus
tgtcggcctctgacgagctggatga

SEQ ID NO: 903366 - DNA, 25 bp, Mus musculus
tgtcggcctctgtcgagctggatga

SEQ ID NO: 903367 - DNA, 25 bp, Mus musculus
tgtcggcgtacacaacagatcattg

SEQ ID NO: 903368 - DNA, 25 bp, Mus musculus
tgtcggcgtacagaacagatcattg

SEQ ID NO: 903369 - DNA, 25 bp, Mus musculus
tgtcggctcaatcatggcttctaag

SEQ ID NO: 903370 - DNA, 25 bp, Mus musculus
tgtcggctcaatgatggcttctaag

SEQ ID NO: 903371 - DNA, 25 bp, Mus musculus
tgtcggctctgcacaacccagggag

SEQ ID NO: 903372 - DNA, 25 bp, Mus musculus
tgtcggctctgctcaacccagggag

SEQ ID NO: 903373 - DNA, 25 bp, Mus musculus
tgtcggcttattcacgtctccaaat

SEQ ID NO: 903374 - DNA, 25 bp, Mus musculus
tgtcggcttattgacgtctccaaat

SEQ ID NO: 903375 - DNA, 25 bp, Mus musculus
tgtcgggacacacactaatccaggc

SEQ ID NO: 903376 - DNA, 25 bp, Mus musculus
tgtcgggacacagactaatccaggc

SEQ ID NO: 903377 - DNA, 25 bp, Mus musculus
tgtcgggacagcactgcagtccatt

SEQ ID NO: 903378 - DNA, 25 bp, Mus musculus
tgtcgggacagctctgcagtccatt

SEQ ID NO: 903379 - DNA, 25 bp, Mus musculus
tgtcgggagtgtctttccccttata

SEQ ID NO: 903380 - DNA, 25 bp, Mus musculus
tgtcgggagtgtgtttccccttata

SEQ ID NO: 903381 - DNA, 25 bp, Mus musculus
tgtcgggagttcctactgaggtcaa

SEQ ID NO: 903382 - DNA, 25 bp, Mus musculus
tgtcgggagttcgtactgaggtcaa

SEQ ID NO: 903383 - DNA, 25 bp, Mus musculus
tgtcgggcattgctagcacacacat

SEQ ID NO: 903384 - DNA, 25 bp, Mus musculus
tgtcgggcattggtagcacacacat

SEQ ID NO: 903385 - DNA, 25 bp, Mus musculus
tgtcgggcgagcacatctctatgcg

SEQ ID NO: 903386 - DNA, 25 bp, Mus musculus
tgtcgggcgagctcatctctatgcg

SEQ ID NO: 903387 - DNA, 25 bp, Mus musculus
tgtcgggctcccaaatgttgaagtc

SEQ ID NO: 903388 - DNA, 25 bp, Mus musculus
tgtcgggctccctaatgttgaagtc

SEQ ID NO: 903389 - DNA, 25 bp, Mus musculus
tgtcgggctcctccgaggtaaagac

SEQ ID NO: 903390 - DNA, 25 bp, Mus musculus
tgtcgggctcctgcgaggtaaagac

SEQ ID NO: 903391 - DNA, 25 bp, Mus musculus
tgtcgggctggtctacatgtttaac

SEQ ID NO: 903392 - DNA, 25 bp, Mus musculus
tgtcgggctggtgtacatgtttaac

SEQ ID NO: 903393 - DNA, 25 bp, Mus musculus
tgtcgggcttttactcatcctgaga

SEQ ID NO: 903394 - DNA, 25 bp, Mus musculus
tgtcgggcttttcatcacagtaagg

SEQ ID NO: 903395 - DNA, 25 bp, Mus musculus
tgtcgggcttttgatcacagtaagg

SEQ ID NO: 903396 - DNA, 25 bp, Mus musculus
tgtcgggctttttctcatcctgaga

SEQ ID NO: 903397 - DNA, 25 bp, Mus musculus
tgtcgggtcataaggcttcgcgcat

SEQ ID NO: 903398 - DNA, 25 bp, Mus musculus
tgtcgggtcatatggcttcgcgcat

SEQ ID NO: 903399 - DNA, 25 bp, Mus musculus
tgtcgggtgcaacacagccccagat

SEQ ID NO: 903400 - DNA, 25 bp, Mus musculus
tgtcgggtgcaagacagccccagat

SEQ ID NO: 903401 - DNA, 25 bp, Mus musculus
tgtcgggttgcaccgcatcctattt

SEQ ID NO: 903402 - DNA, 25 bp, Mus musculus
tgtcgggttgcagcgcatcctattt

SEQ ID NO: 903403 - DNA, 25 bp, Mus musculus
tgtcgggttggtacacgtgcaaaac

SEQ ID NO: 903404 - DNA, 25 bp, Mus musculus
tgtcgggttggttcacgtgcaaaac

SEQ ID NO: 903405 - DNA, 25 bp, Mus musculus
tgtcgggttgtaagagggactcact

SEQ ID NO: 903406 - DNA, 25 bp, Mus musculus
tgtcgggttgtatgagggactcact

SEQ ID NO: 903407 - DNA, 25 bp, Mus musculus
tgtcggtacccacgttctatttcta

SEQ ID NO: 903408 - DNA, 25 bp, Mus musculus
tgtcggtacccaggttctatttcta

SEQ ID NO: 903409 - DNA, 25 bp, Mus musculus
tgtcggtcacttcgcccaaaggcag

SEQ ID NO: 903410 - DNA, 25 bp, Mus musculus
tgtcggtcacttggcccaaaggcag

SEQ ID NO: 903411 - DNA, 25 bp, Mus musculus
tgtcggtgaacccaagtccatagca

SEQ ID NO: 903412 - DNA, 25 bp, Mus musculus
tgtcggtgaaccgaagtccatagca

SEQ ID NO: 903413 - DNA, 25 bp, Mus musculus
tgtcggtgacttctctttctgtgct

SEQ ID NO: 903414 - DNA, 25 bp, Mus musculus
tgtcggtgacttgtctttctgtgct

SEQ ID NO: 903415 - DNA, 25 bp, Mus musculus
tgtcggtgatcaagaaactgttccc

SEQ ID NO: 903416 - DNA, 25 bp, Mus musculus
tgtcggtgatcatgaaactgttccc

SEQ ID NO: 903417 - DNA, 25 bp, Mus musculus
tgtcggtgccagagccagagaagcc

SEQ ID NO: 903418 - DNA, 25 bp, Mus musculus
tgtcggtgccagagtgggccttcaa

SEQ ID NO: 903419 - DNA, 25 bp, Mus musculus
tgtcggtgccagtgccagagaagcc

SEQ ID NO: 903420 - DNA, 25 bp, Mus musculus
tgtcggtgccagtgtgggccttcaa

SEQ ID NO: 903421 - DNA, 25 bp, Mus musculus
tgtcggtggcgaagttcttgtcaga

SEQ ID NO: 903422 - DNA, 25 bp, Mus musculus
tgtcggtggcgatgttcttgtcaga

SEQ ID NO: 903423 - DNA, 25 bp, Mus musculus
tgtcggtttcacactgtttactggc

SEQ ID NO: 903424 - DNA, 25 bp, Mus musculus
tgtcggtttcactctgtttactggc

SEQ ID NO: 903425 - DNA, 25 bp, Mus musculus
tgtcgtaatcaaaggcgccacggtc

SEQ ID NO: 903426 - DNA, 25 bp, Mus musculus
tgtcgtaatcaatggcgccacggtc

SEQ ID NO: 903427 - DNA, 25 bp, Mus musculus
tgtcgtagccgtagccgggccagac

SEQ ID NO: 903428 - DNA, 25 bp, Mus musculus
tgtcgtagccgttgccgggccagac

SEQ ID NO: 903429 - DNA, 25 bp, Mus musculus
tgtcgtaggccaatccagaaaagct

SEQ ID NO: 903430 - DNA, 25 bp, Mus musculus
tgtcgtaggccattccagaaaagct

SEQ ID NO: 903431 - DNA, 25 bp, Mus musculus
tgtcgtagtcacacacggaggcggc

SEQ ID NO: 903432 - DNA, 25 bp, Mus musculus
tgtcgtagtcactcacggaggcggc

SEQ ID NO: 903433 - DNA, 25 bp, Mus musculus
tgtcgtagtccactaagccatactg

SEQ ID NO: 903434 - DNA, 25 bp, Mus musculus
tgtcgtagtccagtaagccatactg

SEQ ID NO: 903435 - DNA, 25 bp, Mus musculus
tgtcgtcaggatcttggaggtgtac

SEQ ID NO: 903436 - DNA, 25 bp, Mus musculus
tgtcgtcaggatgttggaggtgtac

SEQ ID NO: 903437 - DNA, 25 bp, Mus musculus
tgtcgtcagggcagcatgtccgatg

SEQ ID NO: 903438 - DNA, 25 bp, Mus musculus
tgtcgtcagggctgcatgtccgatg

SEQ ID NO: 903439 - DNA, 25 bp, Mus musculus
tgtcgtcccaatacactggcagagt

SEQ ID NO: 903440 - DNA, 25 bp, Mus musculus
tgtcgtcccaattcactggcagagt

SEQ ID NO: 903441 - DNA, 25 bp, Mus musculus
tgtcgtccctatcacagtcatgcta

SEQ ID NO: 903442 - DNA, 25 bp, Mus musculus
tgtcgtccctatgacagtcatgcta

SEQ ID NO: 903443 - DNA, 25 bp, Mus musculus
tgtcgtctgagtacaccgggtgtga

SEQ ID NO: 903444 - DNA, 25 bp, Mus musculus
tgtcgtctgagttcaccgggtgtga

SEQ ID NO: 903445 - DNA, 25 bp, Mus musculus
tgtcgtgaagacaatgcaaaccttg

SEQ ID NO: 903446 - DNA, 25 bp, Mus musculus
tgtcgtgaagactatgcaaaccttg

SEQ ID NO: 903447 - DNA, 25 bp, Mus musculus
tgtcgtgacaagcagggcatctcta

SEQ ID NO: 903448 - DNA, 25 bp, Mus musculus
tgtcgtgacaaggagggcatctcta

SEQ ID NO: 903449 - DNA, 25 bp, Mus musculus
tgtcgtgacatcatttcaaggcggt

SEQ ID NO: 903450 - DNA, 25 bp, Mus musculus
tgtcgtgacatcttttcaaggcggt

SEQ ID NO: 903451 - DNA, 25 bp, Mus musculus
tgtcgtgatcccctgtataatgaga

SEQ ID NO: 903452 - DNA, 25 bp, Mus musculus
tgtcgtgatcccgtgtataatgaga

SEQ ID NO: 903453 - DNA, 25 bp, Mus musculus
tgtcgtgcacgacgtgacccaggcc

SEQ ID NO: 903454 - DNA, 25 bp, Mus musculus
tgtcgtgcacgaggtgacccaggcc

SEQ ID NO: 903455 - DNA, 25 bp, Mus musculus
tgtcgtgcggaaagttcaccggcca

SEQ ID NO: 903456 - DNA, 25 bp, Mus musculus
tgtcgtgcggaatgttcaccggcca

SEQ ID NO: 903457 - DNA, 25 bp, Mus musculus
tgtcgtggaagcactgcaaagccct

SEQ ID NO: 903458 - DNA, 25 bp, Mus musculus
tgtcgtggaagctctgcaaagccct

SEQ ID NO: 903459 - DNA, 25 bp, Mus musculus
tgtcgtggagtcaactggtgtcttc

SEQ ID NO: 903460 - DNA, 25 bp, Mus musculus
tgtcgtggagtctactggtgtcttc

SEQ ID NO: 903461 - DNA, 25 bp, Mus musculus
tgtcgtgggacaatctgggcgcctc

SEQ ID NO: 903462 - DNA, 25 bp, Mus musculus
tgtcgtgggacattctgggcgcctc

SEQ ID NO: 903463 - DNA, 25 bp, Mus musculus
tgtcgtgtcctcagggatcccaagc

SEQ ID NO: 903464 - DNA, 25 bp, Mus musculus
tgtcgtgtcctctgggatcccaagc

SEQ ID NO: 903465 - DNA, 25 bp, Mus musculus
tgtcgtgtcggccaaggttttcata

SEQ ID NO: 903466 - DNA, 25 bp, Mus musculus
tgtcgtgtcggcgaaggttttcata

SEQ ID NO: 903467 - DNA, 25 bp, Mus musculus
tgtcgtgtctctagctgtcactggg

SEQ ID NO: 903468 - DNA, 25 bp, Mus musculus
tgtcgtgtctcttgctgtcactggg

SEQ ID NO: 903469 - DNA, 25 bp, Mus musculus
tgtcgtgtgctaacatggatgtctt

SEQ ID NO: 903470 - DNA, 25 bp, Mus musculus
tgtcgtgtgctatcatggatgtctt

SEQ ID NO: 903471 - DNA, 25 bp, Mus musculus
tgtcgtgtgtgcacttgggttgttt

SEQ ID NO: 903472 - DNA, 25 bp, Mus musculus
tgtcgtgtgtgctcttgggttgttt

SEQ ID NO: 903473 - DNA, 25 bp, Mus musculus
tgtcgttaatatcacttggtccatg

SEQ ID NO: 903474 - DNA, 25 bp, Mus musculus
tgtcgttaatatgacttggtccatg

SEQ ID NO: 903475 - DNA, 25 bp, Mus musculus
tgtcgttcagaactttgcccgggat

SEQ ID NO: 903476 - DNA, 25 bp, Mus musculus
tgtcgttcagaagtttgcccgggat

SEQ ID NO: 903477 - DNA, 25 bp, Mus musculus
tgtcgttcagttaaatcttttcctt

SEQ ID NO: 903478 - DNA, 25 bp, Mus musculus
tgtcgttcagtttaatcttttcctt

SEQ ID NO: 903479 - DNA, 25 bp, Mus musculus
tgtcgttctctgattaggttttcct

SEQ ID NO: 903480 - DNA, 25 bp, Mus musculus
tgtcgttctctgtttaggttttcct

SEQ ID NO: 903481 - DNA, 25 bp, Mus musculus
tgtcgttggtgcagctgacctctat

SEQ ID NO: 903482 - DNA, 25 bp, Mus musculus
tgtcgttggtgctgctgacctctat

SEQ ID NO: 903483 - DNA, 25 bp, Mus musculus
tgtcgtttctaaccccaaattgggg

SEQ ID NO: 903484 - DNA, 25 bp, Mus musculus
tgtcgtttctaagcccaaattgggg

SEQ ID NO: 903485 - DNA, 25 bp, Mus musculus
tgtcgtttgattacctccacaataa

SEQ ID NO: 903486 - DNA, 25 bp, Mus musculus
tgtcgtttgatttcctccacaataa

SEQ ID NO: 903487 - DNA, 25 bp, Mus musculus
tgtcgtttttacaacatccaatgtt

SEQ ID NO: 903488 - DNA, 25 bp, Mus musculus
tgtcgtttttactacatccaatgtt

SEQ ID NO: 903489 - DNA, 25 bp, Mus musculus
tgtctaaaacatatctgctaacagt

SEQ ID NO: 903490 - DNA, 25 bp, Mus musculus
tgtctaaaacatttctgctaacagt

SEQ ID NO: 903491 - DNA, 25 bp, Mus musculus
tgtctaaacatcaagcctaagcccg

SEQ ID NO: 903492 - DNA, 25 bp, Mus musculus
tgtctaaacatctagcctaagcccg

SEQ ID NO: 903493 - DNA, 25 bp, Mus musculus
tgtctaaccctcctgtaaataccta

SEQ ID NO: 903494 - DNA, 25 bp, Mus musculus
tgtctaaccctcgtgtaaataccta

SEQ ID NO: 903495 - DNA, 25 bp, Mus musculus
tgtctaacctcactgtgtggtctct

SEQ ID NO: 903496 - DNA, 25 bp, Mus musculus
tgtctaacctcagtgtgtggtctct

SEQ ID NO: 903497 - DNA, 25 bp, Mus musculus
tgtctaacgctgcaggtgtcaaatc

SEQ ID NO: 903498 - DNA, 25 bp, Mus musculus
tgtctaacgctggaggtgtcaaatc

SEQ ID NO: 903499 - DNA, 25 bp, Mus musculus
tgtctaactaacactgaccttcctg

SEQ ID NO: 903500 - DNA, 25 bp, Mus musculus
tgtctaactaactctgaccttcctg

SEQ ID NO: 903501 - DNA, 25 bp, Mus musculus
tgtctaactcacactttaaggctac

SEQ ID NO: 903502 - DNA, 25 bp, Mus musculus
tgtctaactcactctttaaggctac

SEQ ID NO: 903503 - DNA, 25 bp, Mus musculus
tgtctaactcctacctatattctag

SEQ ID NO: 903504 - DNA, 25 bp, Mus musculus
tgtctaactccttcctatattctag

SEQ ID NO: 903505 - DNA, 25 bp, Mus musculus
tgtctaactctgcttgctaacctga

SEQ ID NO: 903506 - DNA, 25 bp, Mus musculus
tgtctaactctggttgctaacctga

SEQ ID NO: 903507 - DNA, 25 bp, Mus musculus
tgtctaagacccaccttgaacttca

SEQ ID NO: 903508 - DNA, 25 bp, Mus musculus
tgtctaagaccctccttgaacttca

SEQ ID NO: 903509 - DNA, 25 bp, Mus musculus
tgtctaagagatcaaagtcctccaa

SEQ ID NO: 903510 - DNA, 25 bp, Mus musculus
tgtctaagagatgaaagtcctccaa

SEQ ID NO: 903511 - DNA, 25 bp, Mus musculus
tgtctaagctgcaggccaaagccgc

SEQ ID NO: 903512 - DNA, 25 bp, Mus musculus
tgtctaagctgctggccaaagccgc

SEQ ID NO: 903513 - DNA, 25 bp, Mus musculus
tgtctaagggctccttctatcctga

SEQ ID NO: 903514 - DNA, 25 bp, Mus musculus
tgtctaagggctgcttctatcctga

SEQ ID NO: 903515 - DNA, 25 bp, Mus musculus
tgtctaagtcacagagggaactctt

SEQ ID NO: 903516 - DNA, 25 bp, Mus musculus
tgtctaagtcactgagggaactctt

SEQ ID NO: 903517 - DNA, 25 bp, Mus musculus
tgtctaagtgttattcttcgtggtc

SEQ ID NO: 903518 - DNA, 25 bp, Mus musculus
tgtctaagtgtttttcttcgtggtc

SEQ ID NO: 903519 - DNA, 25 bp, Mus musculus
tgtctaataacaccaccaccagcat

SEQ ID NO: 903520 - DNA, 25 bp, Mus musculus
tgtctaataacagcaccaccagcat

SEQ ID NO: 903521 - DNA, 25 bp, Mus musculus
tgtctaataataaacctggtccctt

SEQ ID NO: 903522 - DNA, 25 bp, Mus musculus
tgtctaataatatacctggtccctt

SEQ ID NO: 903523 - DNA, 25 bp, Mus musculus
tgtctaatatgcaccaggtccggat

SEQ ID NO: 903524 - DNA, 25 bp, Mus musculus
tgtctaatatgctccaggtccggat

SEQ ID NO: 903525 - DNA, 25 bp, Mus musculus
tgtctaatcagaattatttcagctt

SEQ ID NO: 903526 - DNA, 25 bp, Mus musculus
tgtctaatcagatttatttcagctt

SEQ ID NO: 903527 - DNA, 25 bp, Mus musculus
tgtctaatcagcagctctgtgctta

SEQ ID NO: 903528 - DNA, 25 bp, Mus musculus
tgtctaatcagctgctctgtgctta

SEQ ID NO: 903529 - DNA, 25 bp, Mus musculus
tgtctaatgctgatcgcctacctct

SEQ ID NO: 903530 - DNA, 25 bp, Mus musculus
tgtctaatgctgttcgcctacctct

SEQ ID NO: 903531 - DNA, 25 bp, Mus musculus
tgtctaatggtgatcgcccaccttt

SEQ ID NO: 903532 - DNA, 25 bp, Mus musculus
tgtctaatggtgttcgcccaccttt

SEQ ID NO: 903533 - DNA, 25 bp, Mus musculus
tgtctaatgtttagtgtggcaccta

SEQ ID NO: 903534 - DNA, 25 bp, Mus musculus
tgtctaatgttttgtgtggcaccta

SEQ ID NO: 903535 - DNA, 25 bp, Mus musculus
tgtctaatttcacaatctccctcca

SEQ ID NO: 903536 - DNA, 25 bp, Mus musculus
tgtctaatttcagaatctccctcca

SEQ ID NO: 903537 - DNA, 25 bp, Mus musculus
tgtctacaaccacggattgatttta

SEQ ID NO: 903538 - DNA, 25 bp, Mus musculus
tgtctacaaccagggattgatttta

SEQ ID NO: 903539 - DNA, 25 bp, Mus musculus
tgtctacacacacagatgcagtctt

SEQ ID NO: 903540 - DNA, 25 bp, Mus musculus
tgtctacacacagagatgcagtctt

SEQ ID NO: 903541 - DNA, 25 bp, Mus musculus
tgtctacactttcgcagctcagagg

SEQ ID NO: 903542 - DNA, 25 bp, Mus musculus
tgtctacactttggcagctcagagg

SEQ ID NO: 903543 - DNA, 25 bp, Mus musculus
tgtctacagcatcaggtctcccaaa

SEQ ID NO: 903544 - DNA, 25 bp, Mus musculus
tgtctacagcatgaggtctcccaaa

SEQ ID NO: 903545 - DNA, 25 bp, Mus musculus
tgtctacaggctcctcccaggataa

SEQ ID NO: 903546 - DNA, 25 bp, Mus musculus
tgtctacaggctgctcccaggataa

SEQ ID NO: 903547 - DNA, 25 bp, Mus musculus
tgtctacagtccattgcggtcccca

SEQ ID NO: 903548 - DNA, 25 bp, Mus musculus
tgtctacagtcctttgcggtcccca

SEQ ID NO: 903549 - DNA, 25 bp, Mus musculus
tgtctacatagtaatggccggattt

SEQ ID NO: 903550 - DNA, 25 bp, Mus musculus
tgtctacatagttatggccggattt

SEQ ID NO: 903551 - DNA, 25 bp, Mus musculus
tgtctacatttcactcccattctaa

SEQ ID NO: 903552 - DNA, 25 bp, Mus musculus
tgtctacatttctctcccattctaa

SEQ ID NO: 903553 - DNA, 25 bp, Mus musculus
tgtctaccaacgcagcttcaggatg

SEQ ID NO: 903554 - DNA, 25 bp, Mus musculus
tgtctaccaacggagcttcaggatg

SEQ ID NO: 903555 - DNA, 25 bp, Mus musculus
tgtctaccagcccttgaagaagtga

SEQ ID NO: 903556 - DNA, 25 bp, Mus musculus
tgtctaccagccgttgaagaagtga

SEQ ID NO: 903557 - DNA, 25 bp, Mus musculus
tgtctacccttaacgaacaccagag

SEQ ID NO: 903558 - DNA, 25 bp, Mus musculus
tgtctacccttatcgaacaccagag

SEQ ID NO: 903559 - DNA, 25 bp, Mus musculus
tgtctacccttcaggaaatttcctt

SEQ ID NO: 903560 - DNA, 25 bp, Mus musculus
tgtctacccttctggaaatttcctt

SEQ ID NO: 903561 - DNA, 25 bp, Mus musculus
tgtctacctacaagccaatgagctc

SEQ ID NO: 903562 - DNA, 25 bp, Mus musculus
tgtctacctacatgccaatgagctc

SEQ ID NO: 903563 - DNA, 25 bp, Mus musculus
tgtctacctcacagactcgaggata

SEQ ID NO: 903564 - DNA, 25 bp, Mus musculus
tgtctacctcactgactcgaggata

SEQ ID NO: 903565 - DNA, 25 bp, Mus musculus
tgtctacctcgaactcggagtcaga

SEQ ID NO: 903566 - DNA, 25 bp, Mus musculus
tgtctacctcgatctcggagtcaga

SEQ ID NO: 903567 - DNA, 25 bp, Mus musculus
tgtctacctggtcttatgtctgtca

SEQ ID NO: 903568 - DNA, 25 bp, Mus musculus
tgtctacctggtgttatgtctgtca

SEQ ID NO: 903569 - DNA, 25 bp, Mus musculus
tgtctacctgtgagttctctgacta

SEQ ID NO: 903570 - DNA, 25 bp, Mus musculus
tgtctacctgtgtgttctctgacta

SEQ ID NO: 903571 - DNA, 25 bp, Mus musculus
tgtctacggctaccgcacagaggaa

SEQ ID NO: 903572 - DNA, 25 bp, Mus musculus
tgtctacggctagcgcacagaggaa

SEQ ID NO: 903573 - DNA, 25 bp, Mus musculus
tgtctacgttaacttccggcgggag

SEQ ID NO: 903574 - DNA, 25 bp, Mus musculus
tgtctacgttaagttccggcgggag

SEQ ID NO: 903575 - DNA, 25 bp, Mus musculus
tgtctactaagacagggaccagtcc

SEQ ID NO: 903576 - DNA, 25 bp, Mus musculus
tgtctactaagagagggaccagtcc

SEQ ID NO: 903577 - DNA, 25 bp, Mus musculus
tgtctactgactaagctgagctaag

SEQ ID NO: 903578 - DNA, 25 bp, Mus musculus
tgtctactgacttagctgagctaag

SEQ ID NO: 903579 - DNA, 25 bp, Mus musculus
tgtctactgctcatgaagccactta

SEQ ID NO: 903580 - DNA, 25 bp, Mus musculus
tgtctactgctcttgaagccactta

SEQ ID NO: 903581 - DNA, 25 bp, Mus musculus
tgtctactgtctccgaaacctgcta

SEQ ID NO: 903582 - DNA, 25 bp, Mus musculus
tgtctactgtctgcgaaacctgcta

SEQ ID NO: 903583 - DNA, 25 bp, Mus musculus
tgtctactgtggcatcttggtgtct

SEQ ID NO: 903584 - DNA, 25 bp, Mus musculus
tgtctactgtgggatcttggtgtct

SEQ ID NO: 903585 - DNA, 25 bp, Mus musculus
tgtctacttaacaatcgccctcttt

SEQ ID NO: 903586 - DNA, 25 bp, Mus musculus
tgtctacttaactatcgccctcttt

SEQ ID NO: 903587 - DNA, 25 bp, Mus musculus
tgtctacttagacctgcttgttctt

SEQ ID NO: 903588 - DNA, 25 bp, Mus musculus
tgtctacttagagctgcttgttctt

SEQ ID NO: 903589 - DNA, 25 bp, Mus musculus
tgtctacttgacatggctggagtta

SEQ ID NO: 903590 - DNA, 25 bp, Mus musculus
tgtctacttgacttggctggagtta

SEQ ID NO: 903591 - DNA, 25 bp, Mus musculus
tgtctacttggccagccagcaagag

SEQ ID NO: 903592 - DNA, 25 bp, Mus musculus
tgtctacttggcgagccagcaagag

SEQ ID NO: 903593 - DNA, 25 bp, Mus musculus
tgtctacttttccttagcccacaga

SEQ ID NO: 903594 - DNA, 25 bp, Mus musculus
tgtctacttttcgttagcccacaga

SEQ ID NO: 903595 - DNA, 25 bp, Mus musculus
tgtctactttttacaagtagccttt

SEQ ID NO: 903596 - DNA, 25 bp, Mus musculus
tgtctacttttttcaagtagccttt

SEQ ID NO: 903597 - DNA, 25 bp, Mus musculus
tgtctagaactcatggtctcaactg

SEQ ID NO: 903598 - DNA, 25 bp, Mus musculus
tgtctagaactcttggtctcaactg

SEQ ID NO: 903599 - DNA, 25 bp, Mus musculus
tgtctagaaggtaccaacatgagcc

SEQ ID NO: 903600 - DNA, 25 bp, Mus musculus
tgtctagaaggttccaacatgagcc

SEQ ID NO: 903601 - DNA, 25 bp, Mus musculus
tgtctagatttgacctgctcttcat

SEQ ID NO: 903602 - DNA, 25 bp, Mus musculus
tgtctagatttgtcctgctcttcat

SEQ ID NO: 903603 - DNA, 25 bp, Mus musculus
tgtctagcaatgaagccccgtgctc

SEQ ID NO: 903604 - DNA, 25 bp, Mus musculus
tgtctagcaatgtagccccgtgctc

SEQ ID NO: 903605 - DNA, 25 bp, Mus musculus
tgtctagcacagcacggttcccata

SEQ ID NO: 903606 - DNA, 25 bp, Mus musculus
tgtctagcacaggacggttcccata

SEQ ID NO: 903607 - DNA, 25 bp, Mus musculus
tgtctagcagggactcaagggctcg

SEQ ID NO: 903608 - DNA, 25 bp, Mus musculus
tgtctagcagggtctcaagggctcg

SEQ ID NO: 903609 - DNA, 25 bp, Mus musculus
tgtctagcagtcacaggaggcccat

SEQ ID NO: 903610 - DNA, 25 bp, Mus musculus
tgtctagcagtctcaggaggcccat

SEQ ID NO: 903611 - DNA, 25 bp, Mus musculus
tgtctagcataaacgccttccggaa

SEQ ID NO: 903612 - DNA, 25 bp, Mus musculus
tgtctagcataatcgccttccggaa

SEQ ID NO: 903613 - DNA, 25 bp, Mus musculus
tgtctagcatagagccctgttgagc

SEQ ID NO: 903614 - DNA, 25 bp, Mus musculus
tgtctagcatagtgccctgttgagc

SEQ ID NO: 903615 - DNA, 25 bp, Mus musculus
tgtctagccacgaatggccctattc

SEQ ID NO: 903616 - DNA, 25 bp, Mus musculus
tgtctagccacgtatggccctattc

SEQ ID NO: 903617 - DNA, 25 bp, Mus musculus
tgtctagccgacaggtgagtccagg

SEQ ID NO: 903618 - DNA, 25 bp, Mus musculus
tgtctagccgactggtgagtccagg

SEQ ID NO: 903619 - DNA, 25 bp, Mus musculus
tgtctagccttcactgtgcacatgc

SEQ ID NO: 903620 - DNA, 25 bp, Mus musculus
tgtctagccttctctgtgcacatgc

SEQ ID NO: 903621 - DNA, 25 bp, Mus musculus
tgtctagcgaatcttaaccctctac

SEQ ID NO: 903622 - DNA, 25 bp, Mus musculus
tgtctagcgaatgttaaccctctac

SEQ ID NO: 903623 - DNA, 25 bp, Mus musculus
tgtctagcgcatccatcctatgttc

SEQ ID NO: 903624 - DNA, 25 bp, Mus musculus
tgtctagcgcatgcatcctatgttc

SEQ ID NO: 903625 - DNA, 25 bp, Mus musculus
tgtctagcttgtcttgtatcaacca

SEQ ID NO: 903626 - DNA, 25 bp, Mus musculus
tgtctagcttgtgttgtatcaacca

SEQ ID NO: 903627 - DNA, 25 bp, Mus musculus
tgtctaggacaacagtgcccggcct

SEQ ID NO: 903628 - DNA, 25 bp, Mus musculus
tgtctaggacaagagtgcccggcct

SEQ ID NO: 903629 - DNA, 25 bp, Mus musculus
tgtctaggattcactacgctgcggg

SEQ ID NO: 903630 - DNA, 25 bp, Mus musculus
tgtctaggattctctacgctgcggg

SEQ ID NO: 903631 - DNA, 25 bp, Mus musculus
tgtctaggcaccattctgagttcga

SEQ ID NO: 903632 - DNA, 25 bp, Mus musculus
tgtctaggcacctttctgagttcga

SEQ ID NO: 903633 - DNA, 25 bp, Mus musculus
tgtctaggccacaccccaggaactt

SEQ ID NO: 903634 - DNA, 25 bp, Mus musculus
tgtctaggccactccccaggaactt

SEQ ID NO: 903635 - DNA, 25 bp, Mus musculus
tgtctaggtcaccatgcctcgttcc

SEQ ID NO: 903636 - DNA, 25 bp, Mus musculus
tgtctaggtcacgatgcctcgttcc

SEQ ID NO: 903637 - DNA, 25 bp, Mus musculus
tgtctagtaatgaaatgtgatcttg

SEQ ID NO: 903638 - DNA, 25 bp, Mus musculus
tgtctagtaatgtaatgtgatcttg

SEQ ID NO: 903639 - DNA, 25 bp, Mus musculus
tgtctagtataaacccacatccaga

SEQ ID NO: 903640 - DNA, 25 bp, Mus musculus
tgtctagtataatcccacatccaga

SEQ ID NO: 903641 - DNA, 25 bp, Mus musculus
tgtctagtctcactcctctgattat

SEQ ID NO: 903642 - DNA, 25 bp, Mus musculus
tgtctagtctcagtcctctgattat

SEQ ID NO: 903643 - DNA, 25 bp, Mus musculus
tgtctagtctgtcaggcctgagcca

SEQ ID NO: 903644 - DNA, 25 bp, Mus musculus
tgtctagtctgtgaggcctgagcca

SEQ ID NO: 903645 - DNA, 25 bp, Mus musculus
tgtctagtgaatacggctccattat

SEQ ID NO: 903646 - DNA, 25 bp, Mus musculus
tgtctagtgaattcggctccattat

SEQ ID NO: 903647 - DNA, 25 bp, Mus musculus
tgtctagttatacagcccatgggct

SEQ ID NO: 903648 - DNA, 25 bp, Mus musculus
tgtctagttatagagcccatgggct

SEQ ID NO: 903649 - DNA, 25 bp, Mus musculus
tgtctagttcagaatctatctatct

SEQ ID NO: 903650 - DNA, 25 bp, Mus musculus
tgtctagttcagtatctatctatct

SEQ ID NO: 903651 - DNA, 25 bp, Mus musculus
tgtctagttccccagtgaagaagat

SEQ ID NO: 903652 - DNA, 25 bp, Mus musculus
tgtctagttcccgagtgaagaagat

SEQ ID NO: 903653 - DNA, 25 bp, Mus musculus
tgtctataactccaaccttctggga

SEQ ID NO: 903654 - DNA, 25 bp, Mus musculus
tgtctataactcgaaccttctggga

SEQ ID NO: 903655 - DNA, 25 bp, Mus musculus
tgtctataccgacctgctactgcag

SEQ ID NO: 903656 - DNA, 25 bp, Mus musculus
tgtctataccgagctgctactgcag

SEQ ID NO: 903657 - DNA, 25 bp, Mus musculus
tgtctatacctccatactgctggaa

SEQ ID NO: 903658 - DNA, 25 bp, Mus musculus
tgtctatacctcgatactgctggaa

SEQ ID NO: 903659 - DNA, 25 bp, Mus musculus
tgtctatacctgaggccttcagtga

SEQ ID NO: 903660 - DNA, 25 bp, Mus musculus
tgtctatacctgtggccttcagtga

SEQ ID NO: 903661 - DNA, 25 bp, Mus musculus
tgtctatagcagcttcctcagctta

SEQ ID NO: 903662 - DNA, 25 bp, Mus musculus
tgtctatagcaggttcctcagctta

SEQ ID NO: 903663 - DNA, 25 bp, Mus musculus
tgtctatagggaacaggattctcaa

SEQ ID NO: 903664 - DNA, 25 bp, Mus musculus
tgtctatagggatcaggattctcaa

SEQ ID NO: 903665 - DNA, 25 bp, Mus musculus
tgtctatattagacacccccagcca

SEQ ID NO: 903666 - DNA, 25 bp, Mus musculus
tgtctatattagtcacccccagcca

SEQ ID NO: 903667 - DNA, 25 bp, Mus musculus
tgtctatcacttatcatgtcccaaa

SEQ ID NO: 903668 - DNA, 25 bp, Mus musculus
tgtctatcacttttcatgtcccaaa

SEQ ID NO: 903669 - DNA, 25 bp, Mus musculus
tgtctatcattcaccattttacctc

SEQ ID NO: 903670 - DNA, 25 bp, Mus musculus
tgtctatcattctccattttacctc

SEQ ID NO: 903671 - DNA, 25 bp, Mus musculus
tgtctatccagtccttacttcaacc

SEQ ID NO: 903672 - DNA, 25 bp, Mus musculus
tgtctatccagtgcttacttcaacc

SEQ ID NO: 903673 - DNA, 25 bp, Mus musculus
tgtctatcctgcatatgagtcccat

SEQ ID NO: 903674 - DNA, 25 bp, Mus musculus
tgtctatcctgcttatgagtcccat

SEQ ID NO: 903675 - DNA, 25 bp, Mus musculus
tgtctatctgtcagagtgcctcatt

SEQ ID NO: 903676 - DNA, 25 bp, Mus musculus
tgtctatctgtctgagtgcctcatt

SEQ ID NO: 903677 - DNA, 25 bp, Mus musculus
tgtctatgagttagctcctctcgca

SEQ ID NO: 903678 - DNA, 25 bp, Mus musculus
tgtctatgagtttgctcctctcgca

SEQ ID NO: 903679 - DNA, 25 bp, Mus musculus
tgtctatgccgcctgtgatggcagc

SEQ ID NO: 903680 - DNA, 25 bp, Mus musculus
tgtctatgccgcgtgtgatggcagc

SEQ ID NO: 903681 - DNA, 25 bp, Mus musculus
tgtctatgcttcagtctatgtcaac

SEQ ID NO: 903682 - DNA, 25 bp, Mus musculus
tgtctatgcttctgtctatgtcaac

SEQ ID NO: 903683 - DNA, 25 bp, Mus musculus
tgtctatgtaaactctagttccagg

SEQ ID NO: 903684 - DNA, 25 bp, Mus musculus
tgtctatgtaaagtctagttccagg

SEQ ID NO: 903685 - DNA, 25 bp, Mus musculus
tgtctatgtagcatgttccacaaca

SEQ ID NO: 903686 - DNA, 25 bp, Mus musculus
tgtctatgtagcttgttccacaaca

SEQ ID NO: 903687 - DNA, 25 bp, Mus musculus
tgtctatgtctgcagggccaccaac

SEQ ID NO: 903688 - DNA, 25 bp, Mus musculus
tgtctatgtctggagggccaccaac

SEQ ID NO: 903689 - DNA, 25 bp, Mus musculus
tgtctattacatcatctctgacttg

SEQ ID NO: 903690 - DNA, 25 bp, Mus musculus
tgtctattacatgatctctgacttg

SEQ ID NO: 903691 - DNA, 25 bp, Mus musculus
tgtctattacccacaacaagccatc

SEQ ID NO: 903692 - DNA, 25 bp, Mus musculus
tgtctattaccctcaacaagccatc

SEQ ID NO: 903693 - DNA, 25 bp, Mus musculus
tgtctattctttagctctggagttt

SEQ ID NO: 903694 - DNA, 25 bp, Mus musculus
tgtctattcttttgctctggagttt

SEQ ID NO: 903695 - DNA, 25 bp, Mus musculus
tgtctattgattcttggtccccaac

SEQ ID NO: 903696 - DNA, 25 bp, Mus musculus
tgtctattgattgttggtccccaac

SEQ ID NO: 903697 - DNA, 25 bp, Mus musculus
tgtctattgtgcagtccactgttgc

SEQ ID NO: 903698 - DNA, 25 bp, Mus musculus
tgtctattgtgctgtccactgttgc

SEQ ID NO: 903699 - DNA, 25 bp, Mus musculus
tgtctatttagcattcctttttgga

SEQ ID NO: 903700 - DNA, 25 bp, Mus musculus
tgtctatttagctttcctttttgga

SEQ ID NO: 903701 - DNA, 25 bp, Mus musculus
tgtctcaaaaaacgcttcccaaagc

SEQ ID NO: 903702 - DNA, 25 bp, Mus musculus
tgtctcaaaaaaggcttcccaaagc

SEQ ID NO: 903703 - DNA, 25 bp, Mus musculus
tgtctcaaacaactcggccgatcat

SEQ ID NO: 903704 - DNA, 25 bp, Mus musculus
tgtctcaaacaagtcggccgatcat

SEQ ID NO: 903705 - DNA, 25 bp, Mus musculus
tgtctcaaacttagttgcctgcctt

SEQ ID NO: 903706 - DNA, 25 bp, Mus musculus
tgtctcaaactttgttgcctgcctt

SEQ ID NO: 903707 - DNA, 25 bp, Mus musculus
tgtctcaacggtaccggtctcaggc

SEQ ID NO: 903708 - DNA, 25 bp, Mus musculus
tgtctcaacggttccggtctcaggc

SEQ ID NO: 903709 - DNA, 25 bp, Mus musculus
tgtctcaagagacatatccctggag

SEQ ID NO: 903710 - DNA, 25 bp, Mus musculus
tgtctcaagagagatatccctggag

SEQ ID NO: 903711 - DNA, 25 bp, Mus musculus
tgtctcaagataatctacatgcagg

SEQ ID NO: 903712 - DNA, 25 bp, Mus musculus
tgtctcaagatattctacatgcagg

SEQ ID NO: 903713 - DNA, 25 bp, Mus musculus
tgtctcaaggttccacttgtgtctt

SEQ ID NO: 903714 - DNA, 25 bp, Mus musculus
tgtctcaaggttgcacttgtgtctt

SEQ ID NO: 903715 - DNA, 25 bp, Mus musculus
tgtctcaagtgcagagtttccaagc

SEQ ID NO: 903716 - DNA, 25 bp, Mus musculus
tgtctcaagtgctgagtttccaagc

SEQ ID NO: 903717 - DNA, 25 bp, Mus musculus
tgtctcaatctcaacttgcttgctt

SEQ ID NO: 903718 - DNA, 25 bp, Mus musculus
tgtctcaatctctacttgcttgctt

SEQ ID NO: 903719 - DNA, 25 bp, Mus musculus
tgtctcaattgaagttaactcacta

SEQ ID NO: 903720 - DNA, 25 bp, Mus musculus
tgtctcaattgatgttaactcacta

SEQ ID NO: 903721 - DNA, 25 bp, Mus musculus
tgtctcacaccaacagtctgaaggc

SEQ ID NO: 903722 - DNA, 25 bp, Mus musculus
tgtctcacaccatcagtctgaaggc

SEQ ID NO: 903723 - DNA, 25 bp, Mus musculus
tgtctcacagccaccataattccag

SEQ ID NO: 903724 - DNA, 25 bp, Mus musculus
tgtctcacagcccaacaattgtaca

SEQ ID NO: 903725 - DNA, 25 bp, Mus musculus
tgtctcacagccgaacaattgtaca

SEQ ID NO: 903726 - DNA, 25 bp, Mus musculus
tgtctcacagcctccataattccag

SEQ ID NO: 903727 - DNA, 25 bp, Mus musculus
tgtctcaccaaacgactcagggctg

SEQ ID NO: 903728 - DNA, 25 bp, Mus musculus
tgtctcaccaaaggactcagggctg

SEQ ID NO: 903729 - DNA, 25 bp, Mus musculus
tgtctcaccatcaggcctgttactc

SEQ ID NO: 903730 - DNA, 25 bp, Mus musculus
tgtctcaccatctggcctgttactc

SEQ ID NO: 903731 - DNA, 25 bp, Mus musculus
tgtctcaccctcctgaaatgaacga

SEQ ID NO: 903732 - DNA, 25 bp, Mus musculus
tgtctcaccctcgtgaaatgaacga

SEQ ID NO: 903733 - DNA, 25 bp, Mus musculus
tgtctcaccctgaatatcagtggtt

SEQ ID NO: 903734 - DNA, 25 bp, Mus musculus
tgtctcaccctgtatatcagtggtt

SEQ ID NO: 903735 - DNA, 25 bp, Mus musculus
tgtctcacctcaacaattattctgt

SEQ ID NO: 903736 - DNA, 25 bp, Mus musculus
tgtctcacctcatcaattattctgt

SEQ ID NO: 903737 - DNA, 25 bp, Mus musculus
tgtctcacttcccaaagcttttcat

SEQ ID NO: 903738 - DNA, 25 bp, Mus musculus
tgtctcacttccgaaagcttttcat

SEQ ID NO: 903739 - DNA, 25 bp, Mus musculus
tgtctcactttacttgttcaccata

SEQ ID NO: 903740 - DNA, 25 bp, Mus musculus
tgtctcactttagttgttcaccata

SEQ ID NO: 903741 - DNA, 25 bp, Mus musculus
tgtctcagacagcactactaataaa

SEQ ID NO: 903742 - DNA, 25 bp, Mus musculus
tgtctcagacaggactactaataaa

SEQ ID NO: 903743 - DNA, 25 bp, Mus musculus
tgtctcagactacgcaaaggctttg

SEQ ID NO: 903744 - DNA, 25 bp, Mus musculus
tgtctcagactaggcaaaggctttg

SEQ ID NO: 903745 - DNA, 25 bp, Mus musculus
tgtctcagattacacttgcccattg

SEQ ID NO: 903746 - DNA, 25 bp, Mus musculus
tgtctcagattagacttgcccattg

SEQ ID NO: 903747 - DNA, 25 bp, Mus musculus
tgtctcagcattagccctttcctgt

SEQ ID NO: 903748 - DNA, 25 bp, Mus musculus
tgtctcagcatttgccctttcctgt

SEQ ID NO: 903749 - DNA, 25 bp, Mus musculus
tgtctcagcctccagtagctatagt

SEQ ID NO: 903750 - DNA, 25 bp, Mus musculus
tgtctcagcctcgagtagctatagt

SEQ ID NO: 903751 - DNA, 25 bp, Mus musculus
tgtctcagcgtcagggtgtcccaac

SEQ ID NO: 903752 - DNA, 25 bp, Mus musculus
tgtctcagcgtctgggtgtcccaac

SEQ ID NO: 903753 - DNA, 25 bp, Mus musculus
tgtctcagctcaagctgccatccag

SEQ ID NO: 903754 - DNA, 25 bp, Mus musculus
tgtctcagctcatgctgccatccag

SEQ ID NO: 903755 - DNA, 25 bp, Mus musculus
tgtctcagctggactccaacaagcc

SEQ ID NO: 903756 - DNA, 25 bp, Mus musculus
tgtctcagctggtctccaacaagcc

SEQ ID NO: 903757 - DNA, 25 bp, Mus musculus
tgtctcaggctcacttaagccatca

SEQ ID NO: 903758 - DNA, 25 bp, Mus musculus
tgtctcaggctctcttaagccatca

SEQ ID NO: 903759 - DNA, 25 bp, Mus musculus
tgtctcatcagtatcctcaaagcag

SEQ ID NO: 903760 - DNA, 25 bp, Mus musculus
tgtctcatcagtttcctcaaagcag

SEQ ID NO: 903761 - DNA, 25 bp, Mus musculus
tgtctcatccgaaacagcaacgttt

SEQ ID NO: 903762 - DNA, 25 bp, Mus musculus
tgtctcatccgatacagcaacgttt

SEQ ID NO: 903763 - DNA, 25 bp, Mus musculus
tgtctcatctcgaaaagtccatctc

SEQ ID NO: 903764 - DNA, 25 bp, Mus musculus
tgtctcatctcgtaaagtccatctc

SEQ ID NO: 903765 - DNA, 25 bp, Mus musculus
tgtctcatgattctttggcttgctc

SEQ ID NO: 903766 - DNA, 25 bp, Mus musculus
tgtctcatgattgtttggcttgctc

SEQ ID NO: 903767 - DNA, 25 bp, Mus musculus
tgtctcatgcaacccatagtagctc

SEQ ID NO: 903768 - DNA, 25 bp, Mus musculus
tgtctcatgcaagccatagtagctc

SEQ ID NO: 903769 - DNA, 25 bp, Mus musculus
tgtctcatgccgaccctgatatcat

SEQ ID NO: 903770 - DNA, 25 bp, Mus musculus
tgtctcatgccgtccctgatatcat

SEQ ID NO: 903771 - DNA, 25 bp, Mus musculus
tgtctcatgtggactggcctggatc

SEQ ID NO: 903772 - DNA, 25 bp, Mus musculus
tgtctcatgtggtctggcctggatc

SEQ ID NO: 903773 - DNA, 25 bp, Mus musculus
tgtctcatgtgtcttcttgttggaa

SEQ ID NO: 903774 - DNA, 25 bp, Mus musculus
tgtctcatgtgtgttcttgttggaa

SEQ ID NO: 903775 - DNA, 25 bp, Mus musculus
tgtctcattaaacggaactgattcc

SEQ ID NO: 903776 - DNA, 25 bp, Mus musculus
tgtctcattaaagggaactgattcc

SEQ ID NO: 903777 - DNA, 25 bp, Mus musculus
tgtctcattgataagcagtagaatt

SEQ ID NO: 903778 - DNA, 25 bp, Mus musculus
tgtctcattgattagcagtagaatt

SEQ ID NO: 903779 - DNA, 25 bp, Mus musculus
tgtctcattgcgcattttcttttcc

SEQ ID NO: 903780 - DNA, 25 bp, Mus musculus
tgtctcattgcggattttcttttcc

SEQ ID NO: 903781 - DNA, 25 bp, Mus musculus
tgtctcattgctagcgccagcagcc

SEQ ID NO: 903782 - DNA, 25 bp, Mus musculus
tgtctcattgcttgcgccagcagcc

SEQ ID NO: 903783 - DNA, 25 bp, Mus musculus
tgtctcattgggctttttcttagcc

SEQ ID NO: 903784 - DNA, 25 bp, Mus musculus
tgtctcattggggtttttcttagcc

SEQ ID NO: 903785 - DNA, 25 bp, Mus musculus
tgtctccaaaggctgagctccagag

SEQ ID NO: 903786 - DNA, 25 bp, Mus musculus
tgtctccaaagggtgagctccagag

SEQ ID NO: 903787 - DNA, 25 bp, Mus musculus
tgtctccaacatattcattagggct

SEQ ID NO: 903788 - DNA, 25 bp, Mus musculus
tgtctccaacattttcattagggct

SEQ ID NO: 903789 - DNA, 25 bp, Mus musculus
tgtctccaagtcattctctttttat

SEQ ID NO: 903790 - DNA, 25 bp, Mus musculus
tgtctccaagtctttctctttttat

SEQ ID NO: 903791 - DNA, 25 bp, Mus musculus
tgtctccacacaaggacgggtatct

SEQ ID NO: 903792 - DNA, 25 bp, Mus musculus
tgtctccacacatggacgggtatct

SEQ ID NO: 903793 - DNA, 25 bp, Mus musculus
tgtctccacagcactgatacctttg

SEQ ID NO: 903794 - DNA, 25 bp, Mus musculus
tgtctccacagctctgatacctttg

SEQ ID NO: 903795 - DNA, 25 bp, Mus musculus
tgtctccaccttagggtagcactgt

SEQ ID NO: 903796 - DNA, 25 bp, Mus musculus
tgtctccacctttgggtagcactgt

SEQ ID NO: 903797 - DNA, 25 bp, Mus musculus
tgtctccacgttcttaccatatttg

SEQ ID NO: 903798 - DNA, 25 bp, Mus musculus
tgtctccacgttgttaccatatttg

SEQ ID NO: 903799 - DNA, 25 bp, Mus musculus
tgtctccactatcccaacaggtaaa

SEQ ID NO: 903800 - DNA, 25 bp, Mus musculus
tgtctccactatgccaacaggtaaa

SEQ ID NO: 903801 - DNA, 25 bp, Mus musculus
tgtctccagaaaacgctcttcaacg

SEQ ID NO: 903802 - DNA, 25 bp, Mus musculus
tgtctccagaaatcgctcttcaacg

SEQ ID NO: 903803 - DNA, 25 bp, Mus musculus
tgtctccagaagagcgcagggcccg

SEQ ID NO: 903804 - DNA, 25 bp, Mus musculus
tgtctccagaagtgcgcagggcccg

SEQ ID NO: 903805 - DNA, 25 bp, Mus musculus
tgtctccagagtccttgccttaaag

SEQ ID NO: 903806 - DNA, 25 bp, Mus musculus
tgtctccagagtgcttgccttaaag

SEQ ID NO: 903807 - DNA, 25 bp, Mus musculus
tgtctccagctaagtgggatgccct

SEQ ID NO: 903808 - DNA, 25 bp, Mus musculus
tgtctccagctatgtgggatgccct

SEQ ID NO: 903809 - DNA, 25 bp, Mus musculus
tgtctccaggtaatgcaagtgataa

SEQ ID NO: 903810 - DNA, 25 bp, Mus musculus
tgtctccaggtattgcaagtgataa

SEQ ID NO: 903811 - DNA, 25 bp, Mus musculus
tgtctccaggtcatcatctgtgcaa

SEQ ID NO: 903812 - DNA, 25 bp, Mus musculus
tgtctccaggtcttcatctgtgcaa

SEQ ID NO: 903813 - DNA, 25 bp, Mus musculus
tgtctccagtgcaaaatgtgtcttt

SEQ ID NO: 903814 - DNA, 25 bp, Mus musculus
tgtctccagtgctaaatgtgtcttt

SEQ ID NO: 903815 - DNA, 25 bp, Mus musculus
tgtctccagttcacatgatctagat

SEQ ID NO: 903816 - DNA, 25 bp, Mus musculus
tgtctccagttctcatgatctagat

SEQ ID NO: 903817 - DNA, 25 bp, Mus musculus
tgtctccatcacatacaaccaattg

SEQ ID NO: 903818 - DNA, 25 bp, Mus musculus
tgtctccatcacttacaaccaattg

SEQ ID NO: 903819 - DNA, 25 bp, Mus musculus
tgtctccatcccatatgtcagcagc

SEQ ID NO: 903820 - DNA, 25 bp, Mus musculus
tgtctccatcccttatgtcagcagc

SEQ ID NO: 903821 - DNA, 25 bp, Mus musculus
tgtctccatctaccttgtgtcagtc

SEQ ID NO: 903822 - DNA, 25 bp, Mus musculus
tgtctccatctagcttgtgtcagtc

SEQ ID NO: 903823 - DNA, 25 bp, Mus musculus
tgtctccatcttaggaggcctggaa

SEQ ID NO: 903824 - DNA, 25 bp, Mus musculus
tgtctccatctttggaggcctggaa

SEQ ID NO: 903825 - DNA, 25 bp, Mus musculus
tgtctccatgaacctctgaaggcct

SEQ ID NO: 903826 - DNA, 25 bp, Mus musculus
tgtctccatgaagctctgaaggcct

SEQ ID NO: 903827 - DNA, 25 bp, Mus musculus
tgtctccatgcacggatggtgtaag

SEQ ID NO: 903828 - DNA, 25 bp, Mus musculus
tgtctccatgcagggatggtgtaag

SEQ ID NO: 903829 - DNA, 25 bp, Mus musculus
tgtctccattgtagcacattcttac

SEQ ID NO: 903830 - DNA, 25 bp, Mus musculus
tgtctccattgttgcacattcttac

SEQ ID NO: 903831 - DNA, 25 bp, Mus musculus
tgtctcccaaagagtcaggcaaggt

SEQ ID NO: 903832 - DNA, 25 bp, Mus musculus
tgtctcccaaagtgtcaggcaaggt

SEQ ID NO: 903833 - DNA, 25 bp, Mus musculus
tgtctcccagaacgcttcacttagc

SEQ ID NO: 903834 - DNA, 25 bp, Mus musculus
tgtctcccagaaggcttcacttagc

SEQ ID NO: 903835 - DNA, 25 bp, Mus musculus
tgtctcccatgaatctcctgctaat

SEQ ID NO: 903836 - DNA, 25 bp, Mus musculus
tgtctcccatgattctcctgctaat

SEQ ID NO: 903837 - DNA, 25 bp, Mus musculus
tgtctccccaaaaataccaactttt

SEQ ID NO: 903838 - DNA, 25 bp, Mus musculus
tgtctccccaaatataccaactttt

SEQ ID NO: 903839 - DNA, 25 bp, Mus musculus
tgtctccccactcttgctgttgtgt

SEQ ID NO: 903840 - DNA, 25 bp, Mus musculus
tgtctccccactgttgctgttgtgt

SEQ ID NO: 903841 - DNA, 25 bp, Mus musculus
tgtctcccccacatatagttacttt

SEQ ID NO: 903842 - DNA, 25 bp, Mus musculus
tgtctcccccacttatagttacttt

SEQ ID NO: 903843 - DNA, 25 bp, Mus musculus
tgtctcccctggagtggtggtacat

SEQ ID NO: 903844 - DNA, 25 bp, Mus musculus
tgtctcccctggtgtggtggtacat

SEQ ID NO: 903845 - DNA, 25 bp, Mus musculus
tgtctcccggtacctgtgcttctga

SEQ ID NO: 903846 - DNA, 25 bp, Mus musculus
tgtctcccggtagctgtgcttctga

SEQ ID NO: 903847 - DNA, 25 bp, Mus musculus
tgtctccctagaacggtcagcacct

SEQ ID NO: 903848 - DNA, 25 bp, Mus musculus
tgtctccctagatcggtcagcacct

SEQ ID NO: 903849 - DNA, 25 bp, Mus musculus
tgtctccctctcaggatatgtgcgt

SEQ ID NO: 903850 - DNA, 25 bp, Mus musculus
tgtctccctctctggatatgtgcgt

SEQ ID NO: 903851 - DNA, 25 bp, Mus musculus
tgtctccctgagaatcatgtgctgt

SEQ ID NO: 903852 - DNA, 25 bp, Mus musculus
tgtctccctgagtatcatgtgctgt

SEQ ID NO: 903853 - DNA, 25 bp, Mus musculus
tgtctccctgtgatccatatgggta

SEQ ID NO: 903854 - DNA, 25 bp, Mus musculus
tgtctccctgtgttccatatgggta

SEQ ID NO: 903855 - DNA, 25 bp, Mus musculus
tgtctcccttaaaccgcggcagaag

SEQ ID NO: 903856 - DNA, 25 bp, Mus musculus
tgtctcccttaatccgcggcagaag

SEQ ID NO: 903857 - DNA, 25 bp, Mus musculus
tgtctcccttgcaaggctttgggaa

SEQ ID NO: 903858 - DNA, 25 bp, Mus musculus
tgtctcccttgctaggctttgggaa

SEQ ID NO: 903859 - DNA, 25 bp, Mus musculus
tgtctccctttcagtcgttgaataa

SEQ ID NO: 903860 - DNA, 25 bp, Mus musculus
tgtctccctttctgtcgttgaataa

SEQ ID NO: 903861 - DNA, 25 bp, Mus musculus
tgtctccgaagtctcaggctccagt

SEQ ID NO: 903862 - DNA, 25 bp, Mus musculus
tgtctccgaagtgtcaggctccagt

SEQ ID NO: 903863 - DNA, 25 bp, Mus musculus
tgtctccgggagcatgagcctctgt

SEQ ID NO: 903864 - DNA, 25 bp, Mus musculus
tgtctccgggaggatgagcctctgt

SEQ ID NO: 903865 - DNA, 25 bp, Mus musculus
tgtctccgggctagatgagccagta

SEQ ID NO: 903866 - DNA, 25 bp, Mus musculus
tgtctccgggcttgatgagccagta

SEQ ID NO: 903867 - DNA, 25 bp, Mus musculus
tgtctccgggtacctcggctcacag

SEQ ID NO: 903868 - DNA, 25 bp, Mus musculus
tgtctccgggtagctcggctcacag

SEQ ID NO: 903869 - DNA, 25 bp, Mus musculus
tgtctccggtttatctacattactt

SEQ ID NO: 903870 - DNA, 25 bp, Mus musculus
tgtctccggtttttctacattactt

SEQ ID NO: 903871 - DNA, 25 bp, Mus musculus
tgtctcctaacccaagtgagtcggg

SEQ ID NO: 903872 - DNA, 25 bp, Mus musculus
tgtctcctaaccgaagtgagtcggg

SEQ ID NO: 903873 - DNA, 25 bp, Mus musculus
tgtctcctaagtctttattttcctt

SEQ ID NO: 903874 - DNA, 25 bp, Mus musculus
tgtctcctaagtgtttattttcctt

SEQ ID NO: 903875 - DNA, 25 bp, Mus musculus
tgtctcctacaaagctgagcgctcc

SEQ ID NO: 903876 - DNA, 25 bp, Mus musculus
tgtctcctacaatgctgagcgctcc

SEQ ID NO: 903877 - DNA, 25 bp, Mus musculus
tgtctcctactgcacagcgcagaga

SEQ ID NO: 903878 - DNA, 25 bp, Mus musculus
tgtctcctactggacagcgcagaga

SEQ ID NO: 903879 - DNA, 25 bp, Mus musculus
tgtctcctagttactgcctatagca

SEQ ID NO: 903880 - DNA, 25 bp, Mus musculus
tgtctcctagtttctgcctatagca

SEQ ID NO: 903881 - DNA, 25 bp, Mus musculus
tgtctcctatgaattggccattcct

SEQ ID NO: 903882 - DNA, 25 bp, Mus musculus
tgtctcctatgatttggccattcct

SEQ ID NO: 903883 - DNA, 25 bp, Mus musculus
tgtctcctcatacatgggcatggtg

SEQ ID NO: 903884 - DNA, 25 bp, Mus musculus
tgtctcctcatagatgggcatggtg

SEQ ID NO: 903885 - DNA, 25 bp, Mus musculus
tgtctcctcctgacgaaacctggct

SEQ ID NO: 903886 - DNA, 25 bp, Mus musculus
tgtctcctcctgtcgaaacctggct

SEQ ID NO: 903887 - DNA, 25 bp, Mus musculus
tgtctcctcggcagttttataaaag

SEQ ID NO: 903888 - DNA, 25 bp, Mus musculus
tgtctcctcggctgttttataaaag

SEQ ID NO: 903889 - DNA, 25 bp, Mus musculus
tgtctcctctttaaaagcaggttgt

SEQ ID NO: 903890 - DNA, 25 bp, Mus musculus
tgtctcctctttccatagtcagggc

SEQ ID NO: 903891 - DNA, 25 bp, Mus musculus
tgtctcctctttgcatagtcagggc

SEQ ID NO: 903892 - DNA, 25 bp, Mus musculus
tgtctcctcttttaaagcaggttgt

SEQ ID NO: 903893 - DNA, 25 bp, Mus musculus
tgtctcctgactctggcatcatgtt

SEQ ID NO: 903894 - DNA, 25 bp, Mus musculus
tgtctcctgactgtggcatcatgtt

SEQ ID NO: 903895 - DNA, 25 bp, Mus musculus
tgtctcctggctccagagtggacga

SEQ ID NO: 903896 - DNA, 25 bp, Mus musculus
tgtctcctggctgcagagtggacga

SEQ ID NO: 903897 - DNA, 25 bp, Mus musculus
tgtctcctgtcgacttctcagctag

SEQ ID NO: 903898 - DNA, 25 bp, Mus musculus
tgtctcctgtcgtcttctcagctag

SEQ ID NO: 903899 - DNA, 25 bp, Mus musculus
tgtctccttagtcttccggtataaa

SEQ ID NO: 903900 - DNA, 25 bp, Mus musculus
tgtctccttagtgttccggtataaa

SEQ ID NO: 903901 - DNA, 25 bp, Mus musculus
tgtctccttccgctagatgaacatg

SEQ ID NO: 903902 - DNA, 25 bp, Mus musculus
tgtctccttccggtagatgaacatg

SEQ ID NO: 903903 - DNA, 25 bp, Mus musculus
tgtctccttcctcgagaggctatta

SEQ ID NO: 903904 - DNA, 25 bp, Mus musculus
tgtctccttcctggagaggctatta

SEQ ID NO: 903905 - DNA, 25 bp, Mus musculus
tgtctcctttcaattgtccaacaat

SEQ ID NO: 903906 - DNA, 25 bp, Mus musculus
tgtctcctttcatttgtccaacaat

SEQ ID NO: 903907 - DNA, 25 bp, Mus musculus
tgtctcctttctatgtgctgccctg

SEQ ID NO: 903908 - DNA, 25 bp, Mus musculus
tgtctcctttctttgtgctgccctg

SEQ ID NO: 903909 - DNA, 25 bp, Mus musculus
tgtctccttttgaggactgcttgag

SEQ ID NO: 903910 - DNA, 25 bp, Mus musculus
tgtctccttttgtggactgcttgag

SEQ ID NO: 903911 - DNA, 25 bp, Mus musculus
tgtctcgaaatccacgcaagctgtg

SEQ ID NO: 903912 - DNA, 25 bp, Mus musculus
tgtctcgaaatcgacgcaagctgtg

SEQ ID NO: 903913 - DNA, 25 bp, Mus musculus
tgtctcgaagtcaccagttgccata

SEQ ID NO: 903914 - DNA, 25 bp, Mus musculus
tgtctcgaagtctccagttgccata

SEQ ID NO: 903915 - DNA, 25 bp, Mus musculus
tgtctcgactacaccataaacttcc

SEQ ID NO: 903916 - DNA, 25 bp, Mus musculus
tgtctcgactactccataaacttcc

SEQ ID NO: 903917 - DNA, 25 bp, Mus musculus
tgtctcgagtttaacagccagcaga

SEQ ID NO: 903918 - DNA, 25 bp, Mus musculus
tgtctcgagttttacagccagcaga

SEQ ID NO: 903919 - DNA, 25 bp, Mus musculus
tgtctcgctctcattacaaggataa

SEQ ID NO: 903920 - DNA, 25 bp, Mus musculus
tgtctcgctctctttacaaggataa

SEQ ID NO: 903921 - DNA, 25 bp, Mus musculus
tgtctcgcttgtctccttattggtc

SEQ ID NO: 903922 - DNA, 25 bp, Mus musculus
tgtctcgcttgtgtccttattggtc

SEQ ID NO: 903923 - DNA, 25 bp, Mus musculus
tgtctcggcatccattaggctcggg

SEQ ID NO: 903924 - DNA, 25 bp, Mus musculus
tgtctcggcatcgattaggctcggg

SEQ ID NO: 903925 - DNA, 25 bp, Mus musculus
tgtctcggctctcctcagcgtggag

SEQ ID NO: 903926 - DNA, 25 bp, Mus musculus
tgtctcggctctgctcagcgtggag

SEQ ID NO: 903927 - DNA, 25 bp, Mus musculus
tgtctcgggccgatactgtgggatt

SEQ ID NO: 903928 - DNA, 25 bp, Mus musculus
tgtctcgggccgttactgtgggatt

SEQ ID NO: 903929 - DNA, 25 bp, Mus musculus
tgtctcgggttaaactcctccatta

SEQ ID NO: 903930 - DNA, 25 bp, Mus musculus
tgtctcgggttatactcctccatta

SEQ ID NO: 903931 - DNA, 25 bp, Mus musculus
tgtctcgtcttgcttcacattgggt

SEQ ID NO: 903932 - DNA, 25 bp, Mus musculus
tgtctcgtcttggttcacattgggt

SEQ ID NO: 903933 - DNA, 25 bp, Mus musculus
tgtctctagccaattgtaccttctt

SEQ ID NO: 903934 - DNA, 25 bp, Mus musculus
tgtctctagccacgcttgtcagttg

SEQ ID NO: 903935 - DNA, 25 bp, Mus musculus
tgtctctagccaggcttgtcagttg

SEQ ID NO: 903936 - DNA, 25 bp, Mus musculus
tgtctctagccatttgtaccttctt

SEQ ID NO: 903937 - DNA, 25 bp, Mus musculus
tgtctctagcttcagcaacccactt

SEQ ID NO: 903938 - DNA, 25 bp, Mus musculus
tgtctctagcttgagcaacccactt

SEQ ID NO: 903939 - DNA, 25 bp, Mus musculus
tgtctctagggtccagggccaaagt

SEQ ID NO: 903940 - DNA, 25 bp, Mus musculus
tgtctctagggtgcagggccaaagt

SEQ ID NO: 903941 - DNA, 25 bp, Mus musculus
tgtctctatactctctatccctgaa

SEQ ID NO: 903942 - DNA, 25 bp, Mus musculus
tgtctctatactgtctatccctgaa

SEQ ID NO: 903943 - DNA, 25 bp, Mus musculus
tgtctctatgctctgttggccaaca

SEQ ID NO: 903944 - DNA, 25 bp, Mus musculus
tgtctctatgctgtgttggccaaca

SEQ ID NO: 903945 - DNA, 25 bp, Mus musculus
tgtctctattccatatgtgcttctc

SEQ ID NO: 903946 - DNA, 25 bp, Mus musculus
tgtctctattccttatgtgcttctc

SEQ ID NO: 903947 - DNA, 25 bp, Mus musculus
tgtctctattttattcatacctgga

SEQ ID NO: 903948 - DNA, 25 bp, Mus musculus
tgtctctatttttttcatacctgga

SEQ ID NO: 903949 - DNA, 25 bp, Mus musculus
tgtctctcaacaactaactgcagca

SEQ ID NO: 903950 - DNA, 25 bp, Mus musculus
tgtctctcaacatctaactgcagca

SEQ ID NO: 903951 - DNA, 25 bp, Mus musculus
tgtctctcaacgctgttcggtttaa

SEQ ID NO: 903952 - DNA, 25 bp, Mus musculus
tgtctctcaacggtgttcggtttaa

SEQ ID NO: 903953 - DNA, 25 bp, Mus musculus
tgtctctcatttcgaaggctggccg

SEQ ID NO: 903954 - DNA, 25 bp, Mus musculus
tgtctctcatttggaaggctggccg

SEQ ID NO: 903955 - DNA, 25 bp, Mus musculus
tgtctctccaagagagccctaggct

SEQ ID NO: 903956 - DNA, 25 bp, Mus musculus
tgtctctccaagtgagccctaggct

SEQ ID NO: 903957 - DNA, 25 bp, Mus musculus
tgtctctccatcattctcgtaagaa

SEQ ID NO: 903958 - DNA, 25 bp, Mus musculus
tgtctctccatctttctcgtaagaa

SEQ ID NO: 903959 - DNA, 25 bp, Mus musculus
tgtctctcccagactttctgctggt

SEQ ID NO: 903960 - DNA, 25 bp, Mus musculus
tgtctctcccagtctttctgctggt

SEQ ID NO: 903961 - DNA, 25 bp, Mus musculus
tgtctctcccgtattgcagtagcta

SEQ ID NO: 903962 - DNA, 25 bp, Mus musculus
tgtctctcccgttttgcagtagcta

SEQ ID NO: 903963 - DNA, 25 bp, Mus musculus
tgtctctcccttctcttggaggaga

SEQ ID NO: 903964 - DNA, 25 bp, Mus musculus
tgtctctcccttgtcttggaggaga

SEQ ID NO: 903965 - DNA, 25 bp, Mus musculus
tgtctctcctacagcagatgtgtcc

SEQ ID NO: 903966 - DNA, 25 bp, Mus musculus
tgtctctcctactgcagatgtgtcc

SEQ ID NO: 903967 - DNA, 25 bp, Mus musculus
tgtctctcctgcaggctcagggaag

SEQ ID NO: 903968 - DNA, 25 bp, Mus musculus
tgtctctcctgctggctcagggaag

SEQ ID NO: 903969 - DNA, 25 bp, Mus musculus
tgtctctcctggatgacatccccga

SEQ ID NO: 903970 - DNA, 25 bp, Mus musculus
tgtctctcctggttgacatccccga

SEQ ID NO: 903971 - DNA, 25 bp, Mus musculus
tgtctctccttgctgtggtaagcgt

SEQ ID NO: 903972 - DNA, 25 bp, Mus musculus
tgtctctccttggtgtggtaagcgt

SEQ ID NO: 903973 - DNA, 25 bp, Mus musculus
tgtctctcgttcatcgtagccagaa

SEQ ID NO: 903974 - DNA, 25 bp, Mus musculus
tgtctctcgttcttcgtagccagaa

SEQ ID NO: 903975 - DNA, 25 bp, Mus musculus
tgtctctctaccactgttttttaag

SEQ ID NO: 903976 - DNA, 25 bp, Mus musculus
tgtctctctacctctgttttttaag

SEQ ID NO: 903977 - DNA, 25 bp, Mus musculus
tgtctctctcacaggtctcaaatga

SEQ ID NO: 903978 - DNA, 25 bp, Mus musculus
tgtctctctcactggtctcaaatga

SEQ ID NO: 903979 - DNA, 25 bp, Mus musculus
tgtctctctcatccctgaggacaca

SEQ ID NO: 903980 - DNA, 25 bp, Mus musculus
tgtctctctcatgcctgaggacaca

SEQ ID NO: 903981 - DNA, 25 bp, Mus musculus
tgtctctctctcatcactgtgaaga

SEQ ID NO: 903982 - DNA, 25 bp, Mus musculus
tgtctctctctcttcactgtgaaga

SEQ ID NO: 903983 - DNA, 25 bp, Mus musculus
tgtctctctgcaccaatgcggccga

SEQ ID NO: 903984 - DNA, 25 bp, Mus musculus
tgtctctctgcagcaatgcggccga

SEQ ID NO: 903985 - DNA, 25 bp, Mus musculus
tgtctctctggaaggattgctgaaa

SEQ ID NO: 903986 - DNA, 25 bp, Mus musculus
tgtctctctggatggattgctgaaa

SEQ ID NO: 903987 - DNA, 25 bp, Mus musculus
tgtctctctgggacactggattgcc

SEQ ID NO: 903988 - DNA, 25 bp, Mus musculus
tgtctctctgggtcactggattgcc

SEQ ID NO: 903989 - DNA, 25 bp, Mus musculus
tgtctctctggtcggagtctttaat

SEQ ID NO: 903990 - DNA, 25 bp, Mus musculus
tgtctctctggtgggagtctttaat

SEQ ID NO: 903991 - DNA, 25 bp, Mus musculus
tgtctctgacatcgctttgaaatct

SEQ ID NO: 903992 - DNA, 25 bp, Mus musculus
tgtctctgacatggctttgaaatct

SEQ ID NO: 903993 - DNA, 25 bp, Mus musculus
tgtctctgacgcagtcaaccaaaac

SEQ ID NO: 903994 - DNA, 25 bp, Mus musculus
tgtctctgacgctgtcaaccaaaac

SEQ ID NO: 903995 - DNA, 25 bp, Mus musculus
tgtctctgactgcacagccttgatt

SEQ ID NO: 903996 - DNA, 25 bp, Mus musculus
tgtctctgactggacagccttgatt

SEQ ID NO: 903997 - DNA, 25 bp, Mus musculus
tgtctctgagacacactgccaactg

SEQ ID NO: 903998 - DNA, 25 bp, Mus musculus
tgtctctgagacatggtatgcatag

SEQ ID NO: 903999 - DNA, 25 bp, Mus musculus
tgtctctgagactcactgccaactg

SEQ ID NO: 904000 - DNA, 25 bp, Mus musculus
tgtctctgagacttggtatgcatag

SEQ ID NO: 904001 - DNA, 25 bp, Mus musculus
tgtctctgaggccaagaccaccatt

SEQ ID NO: 904002 - DNA, 25 bp, Mus musculus
tgtctctgaggcgaagaccaccatt

SEQ ID NO: 904003 - DNA, 25 bp, Mus musculus
tgtctctgataaccctggtccatta

SEQ ID NO: 904004 - DNA, 25 bp, Mus musculus
tgtctctgataagcctggtccatta

SEQ ID NO: 904005 - DNA, 25 bp, Mus musculus
tgtctctgcacacactgaaggatgt

SEQ ID NO: 904006 - DNA, 25 bp, Mus musculus
tgtctctgcacagactgaaggatgt

SEQ ID NO: 904007 - DNA, 25 bp, Mus musculus
tgtctctgcactaggtggcaccttg

SEQ ID NO: 904008 - DNA, 25 bp, Mus musculus
tgtctctgcacttggtggcaccttg

SEQ ID NO: 904009 - DNA, 25 bp, Mus musculus
tgtctctgcataacacctttcaaca

SEQ ID NO: 904010 - DNA, 25 bp, Mus musculus
tgtctctgcatatcacctttcaaca

SEQ ID NO: 904011 - DNA, 25 bp, Mus musculus
tgtctctgccctacaatgaatgcgg

SEQ ID NO: 904012 - DNA, 25 bp, Mus musculus
tgtctctgcccttcaatgaatgcgg

SEQ ID NO: 904013 - DNA, 25 bp, Mus musculus
tgtctctgccgccagatatgagaat

SEQ ID NO: 904014 - DNA, 25 bp, Mus musculus
tgtctctgccgcgagatatgagaat

SEQ ID NO: 904015 - DNA, 25 bp, Mus musculus
tgtctctgccttctggatgtaggaa

SEQ ID NO: 904016 - DNA, 25 bp, Mus musculus
tgtctctgccttgtggatgtaggaa

SEQ ID NO: 904017 - DNA, 25 bp, Mus musculus
tgtctctgcgatacttggctgggag

SEQ ID NO: 904018 - DNA, 25 bp, Mus musculus
tgtctctgcgattcttggctgggag

SEQ ID NO: 904019 - DNA, 25 bp, Mus musculus
tgtctctggaatatgttcttctagc

SEQ ID NO: 904020 - DNA, 25 bp, Mus musculus
tgtctctggaatcccgtcattagta

SEQ ID NO: 904021 - DNA, 25 bp, Mus musculus
tgtctctggaatgccgtcattagta

SEQ ID NO: 904022 - DNA, 25 bp, Mus musculus
tgtctctggaatttgttcttctagc

SEQ ID NO: 904023 - DNA, 25 bp, Mus musculus
tgtctctggaggagttggtttatgt

SEQ ID NO: 904024 - DNA, 25 bp, Mus musculus
tgtctctggaggtgttggtttatgt

SEQ ID NO: 904025 - DNA, 25 bp, Mus musculus
tgtctctgggatacaggagaactct

SEQ ID NO: 904026 - DNA, 25 bp, Mus musculus
tgtctctgggattcaggagaactct

SEQ ID NO: 904027 - DNA, 25 bp, Mus musculus
tgtctctgggcaatgcagcttggag

SEQ ID NO: 904028 - DNA, 25 bp, Mus musculus
tgtctctgggcattgcagcttggag

SEQ ID NO: 904029 - DNA, 25 bp, Mus musculus
tgtctctggtacaggcagatcctga

SEQ ID NO: 904030 - DNA, 25 bp, Mus musculus
tgtctctggtactggcagatcctga

SEQ ID NO: 904031 - DNA, 25 bp, Mus musculus
tgtctctggtcccagatgtcatggc

SEQ ID NO: 904032 - DNA, 25 bp, Mus musculus
tgtctctggtccgagatgtcatggc

SEQ ID NO: 904033 - DNA, 25 bp, Mus musculus
tgtctctgtagcctcgtgcggcaat

SEQ ID NO: 904034 - DNA, 25 bp, Mus musculus
tgtctctgtagcgtcgtgcggcaat

SEQ ID NO: 904035 - DNA, 25 bp, Mus musculus
tgtctctgtatcaccttctagaaga

SEQ ID NO: 904036 - DNA, 25 bp, Mus musculus
tgtctctgtatctccttctagaaga

SEQ ID NO: 904037 - DNA, 25 bp, Mus musculus
tgtctctgtccaaccagactcctga

SEQ ID NO: 904038 - DNA, 25 bp, Mus musculus
tgtctctgtccatccagactcctga

SEQ ID NO: 904039 - DNA, 25 bp, Mus musculus
tgtctctgtctcagttgtactttct

SEQ ID NO: 904040 - DNA, 25 bp, Mus musculus
tgtctctgtctctgttgtactttct

SEQ ID NO: 904041 - DNA, 25 bp, Mus musculus
tgtctctgtgctaagtgtccacaca

SEQ ID NO: 904042 - DNA, 25 bp, Mus musculus
tgtctctgtgcttagtgtccacaca

SEQ ID NO: 904043 - DNA, 25 bp, Mus musculus
tgtctctgtggaacgtgtgggaaac

SEQ ID NO: 904044 - DNA, 25 bp, Mus musculus
tgtctctgtggatcgtgtgggaaac

SEQ ID NO: 904045 - DNA, 25 bp, Mus musculus
tgtctctgttccaatgtgggaggct

SEQ ID NO: 904046 - DNA, 25 bp, Mus musculus
tgtctctgttcctatgtgggaggct

SEQ ID NO: 904047 - DNA, 25 bp, Mus musculus
tgtctctgtttactgtcctcttcta

SEQ ID NO: 904048 - DNA, 25 bp, Mus musculus
tgtctctgtttagtgtcctcttcta

SEQ ID NO: 904049 - DNA, 25 bp, Mus musculus
tgtctcttacagctgggtcttatat

SEQ ID NO: 904050 - DNA, 25 bp, Mus musculus
tgtctcttacaggtgggtcttatat

SEQ ID NO: 904051 - DNA, 25 bp, Mus musculus
tgtctcttacctcctcaaggacaaa

SEQ ID NO: 904052 - DNA, 25 bp, Mus musculus
tgtctcttacctgctcaaggacaaa

SEQ ID NO: 904053 - DNA, 25 bp, Mus musculus
tgtctcttagagacattgtgaattt

SEQ ID NO: 904054 - DNA, 25 bp, Mus musculus
tgtctcttagagtcattgtgaattt

SEQ ID NO: 904055 - DNA, 25 bp, Mus musculus
tgtctcttcacacgtaccgtagtaa

SEQ ID NO: 904056 - DNA, 25 bp, Mus musculus
tgtctcttcacaggtaccgtagtaa

SEQ ID NO: 904057 - DNA, 25 bp, Mus musculus
tgtctcttcactcctaaactgatac

SEQ ID NO: 904058 - DNA, 25 bp, Mus musculus
tgtctcttcactgctaaactgatac

SEQ ID NO: 904059 - DNA, 25 bp, Mus musculus
tgtctcttcagccaaaacaacggtt

SEQ ID NO: 904060 - DNA, 25 bp, Mus musculus
tgtctcttcagcgaaaacaacggtt

SEQ ID NO: 904061 - DNA, 25 bp, Mus musculus
tgtctcttccatatatgcggcaatt

SEQ ID NO: 904062 - DNA, 25 bp, Mus musculus
tgtctcttccatttatgcggcaatt

SEQ ID NO: 904063 - DNA, 25 bp, Mus musculus
tgtctcttcctcagtccaaagttct

SEQ ID NO: 904064 - DNA, 25 bp, Mus musculus
tgtctcttcctctgtccaaagttct

SEQ ID NO: 904065 - DNA, 25 bp, Mus musculus
tgtctcttccttaggaggcacgatt

SEQ ID NO: 904066 - DNA, 25 bp, Mus musculus
tgtctcttcctttggaggcacgatt

SEQ ID NO: 904067 - DNA, 25 bp, Mus musculus
tgtctcttctctcttgcaggctgcc

SEQ ID NO: 904068 - DNA, 25 bp, Mus musculus
tgtctcttctctgttgcaggctgcc

SEQ ID NO: 904069 - DNA, 25 bp, Mus musculus
tgtctcttctggaacttttgataca

SEQ ID NO: 904070 - DNA, 25 bp, Mus musculus
tgtctcttctggtacttttgataca

SEQ ID NO: 904071 - DNA, 25 bp, Mus musculus
tgtctcttcttcaaggctcattgaa

SEQ ID NO: 904072 - DNA, 25 bp, Mus musculus
tgtctcttcttctaggctcattgaa

SEQ ID NO: 904073 - DNA, 25 bp, Mus musculus
tgtctcttgcttatctaggccagaa

SEQ ID NO: 904074 - DNA, 25 bp, Mus musculus
tgtctcttgcttttctaggccagaa

SEQ ID NO: 904075 - DNA, 25 bp, Mus musculus
tgtctcttgttccttattgttgcag

SEQ ID NO: 904076 - DNA, 25 bp, Mus musculus
tgtctcttgttcgttattgttgcag

SEQ ID NO: 904077 - DNA, 25 bp, Mus musculus
tgtctctttaccactaacctgtgag

SEQ ID NO: 904078 - DNA, 25 bp, Mus musculus
tgtctctttacctctaacctgtgag

SEQ ID NO: 904079 - DNA, 25 bp, Mus musculus
tgtctctttatccaatcccaaacta

SEQ ID NO: 904080 - DNA, 25 bp, Mus musculus
tgtctctttatcgaatcccaaacta

SEQ ID NO: 904081 - DNA, 25 bp, Mus musculus
tgtctctttcgtaaaaagccaaagt

SEQ ID NO: 904082 - DNA, 25 bp, Mus musculus
tgtctctttcgttaaaagccaaagt

SEQ ID NO: 904083 - DNA, 25 bp, Mus musculus
tgtctctttctaccaaccaggatgt

SEQ ID NO: 904084 - DNA, 25 bp, Mus musculus
tgtctctttctagcaaccaggatgt

SEQ ID NO: 904085 - DNA, 25 bp, Mus musculus
tgtctctttcttcactgtcaaatgg

SEQ ID NO: 904086 - DNA, 25 bp, Mus musculus
tgtctctttcttgactgtcaaatgg

SEQ ID NO: 904087 - DNA, 25 bp, Mus musculus
tgtctctttgaaagctcacaccatc

SEQ ID NO: 904088 - DNA, 25 bp, Mus musculus
tgtctctttgaatgctcacaccatc

SEQ ID NO: 904089 - DNA, 25 bp, Mus musculus
tgtctctttgctaatggccagactg

SEQ ID NO: 904090 - DNA, 25 bp, Mus musculus
tgtctctttgcttatggccagactg

SEQ ID NO: 904091 - DNA, 25 bp, Mus musculus
tgtctcttttgaagatggcccttca

SEQ ID NO: 904092 - DNA, 25 bp, Mus musculus
tgtctcttttgatgatggcccttca

SEQ ID NO: 904093 - DNA, 25 bp, Mus musculus
tgtctcttttgtaggtaggtcactc

SEQ ID NO: 904094 - DNA, 25 bp, Mus musculus
tgtctcttttgttggtaggtcactc

SEQ ID NO: 904095 - DNA, 25 bp, Mus musculus
tgtctgaaagcacttggtctccact

SEQ ID NO: 904096 - DNA, 25 bp, Mus musculus
tgtctgaaagcagttggtctccact

SEQ ID NO: 904097 - DNA, 25 bp, Mus musculus
tgtctgaaatagctgcaggcagcct

SEQ ID NO: 904098 - DNA, 25 bp, Mus musculus
tgtctgaaataggtgcaggcagcct

SEQ ID NO: 904099 - DNA, 25 bp, Mus musculus
tgtctgaagacacctacagtgtact

SEQ ID NO: 904100 - DNA, 25 bp, Mus musculus
tgtctgaagacagctacagtgtact

SEQ ID NO: 904101 - DNA, 25 bp, Mus musculus
tgtctgaaggctcggaccgtgtact

SEQ ID NO: 904102 - DNA, 25 bp, Mus musculus
tgtctgaaggctgggaccgtgtact

SEQ ID NO: 904103 - DNA, 25 bp, Mus musculus
tgtctgaaggtacacgcgacccctg

SEQ ID NO: 904104 - DNA, 25 bp, Mus musculus
tgtctgaaggtagacgcgacccctg

SEQ ID NO: 904105 - DNA, 25 bp, Mus musculus
tgtctgacaaatcggtttaccctct

SEQ ID NO: 904106 - DNA, 25 bp, Mus musculus
tgtctgacaaatgggtttaccctct

SEQ ID NO: 904107 - DNA, 25 bp, Mus musculus
tgtctgacaatcactgcttctggag

SEQ ID NO: 904108 - DNA, 25 bp, Mus musculus
tgtctgacaatctctgcttctggag

SEQ ID NO: 904109 - DNA, 25 bp, Mus musculus
tgtctgacatgcagggatctgctac

SEQ ID NO: 904110 - DNA, 25 bp, Mus musculus
tgtctgacatgctgggatctgctac

SEQ ID NO: 904111 - DNA, 25 bp, Mus musculus
tgtctgaccaagagtctgggacctt

SEQ ID NO: 904112 - DNA, 25 bp, Mus musculus
tgtctgaccaagtgtctgggacctt

SEQ ID NO: 904113 - DNA, 25 bp, Mus musculus
tgtctgacccaaattcctttcgttt

SEQ ID NO: 904114 - DNA, 25 bp, Mus musculus
tgtctgacccaatttcctttcgttt

SEQ ID NO: 904115 - DNA, 25 bp, Mus musculus
tgtctgaccggaaggcagtgatcaa

SEQ ID NO: 904116 - DNA, 25 bp, Mus musculus
tgtctgaccggatggcagtgatcaa

SEQ ID NO: 904117 - DNA, 25 bp, Mus musculus
tgtctgacctagaacagcgcctgga

SEQ ID NO: 904118 - DNA, 25 bp, Mus musculus
tgtctgacctagtacagcgcctgga

SEQ ID NO: 904119 - DNA, 25 bp, Mus musculus
tgtctgacctgtcctggatgtctta

SEQ ID NO: 904120 - DNA, 25 bp, Mus musculus
tgtctgacctgtgctggatgtctta

SEQ ID NO: 904121 - DNA, 25 bp, Mus musculus
tgtctgactcgcatactgccagcca

SEQ ID NO: 904122 - DNA, 25 bp, Mus musculus
tgtctgactcgcttactgccagcca

SEQ ID NO: 904123 - DNA, 25 bp, Mus musculus
tgtctgactctgagcaccgtgccta

SEQ ID NO: 904124 - DNA, 25 bp, Mus musculus
tgtctgactctgtgcaccgtgccta

SEQ ID NO: 904125 - DNA, 25 bp, Mus musculus
tgtctgactgacattatttttctct

SEQ ID NO: 904126 - DNA, 25 bp, Mus musculus
tgtctgactgactttatttttctct

SEQ ID NO: 904127 - DNA, 25 bp, Mus musculus
tgtctgactgagcactctgggacct

SEQ ID NO: 904128 - DNA, 25 bp, Mus musculus
tgtctgactgaggactctgggacct

SEQ ID NO: 904129 - DNA, 25 bp, Mus musculus
tgtctgactgtcctgtgtgcccgcc

SEQ ID NO: 904130 - DNA, 25 bp, Mus musculus
tgtctgactgtcgtgtgtgcccgcc

SEQ ID NO: 904131 - DNA, 25 bp, Mus musculus
tgtctgactttacccgggtccttag

SEQ ID NO: 904132 - DNA, 25 bp, Mus musculus
tgtctgactttagccgggtccttag

SEQ ID NO: 904133 - DNA, 25 bp, Mus musculus
tgtctgactttcagtctcttcacca

SEQ ID NO: 904134 - DNA, 25 bp, Mus musculus
tgtctgactttctgtctcttcacca

SEQ ID NO: 904135 - DNA, 25 bp, Mus musculus
tgtctgagaaccatccttacctttc

SEQ ID NO: 904136 - DNA, 25 bp, Mus musculus
tgtctgagaaccttccttacctttc

SEQ ID NO: 904137 - DNA, 25 bp, Mus musculus
tgtctgagtaagcattccatatggc

SEQ ID NO: 904138 - DNA, 25 bp, Mus musculus
tgtctgagtaaggattccatatggc

SEQ ID NO: 904139 - DNA, 25 bp, Mus musculus
tgtctgagtaccacagcatttccca

SEQ ID NO: 904140 - DNA, 25 bp, Mus musculus
tgtctgagtacctcagcatttccca

SEQ ID NO: 904141 - DNA, 25 bp, Mus musculus
tgtctgagtagtcttccgaggtctt

SEQ ID NO: 904142 - DNA, 25 bp, Mus musculus
tgtctgagtagtgttccgaggtctt

SEQ ID NO: 904143 - DNA, 25 bp, Mus musculus
tgtctgagtccaagattcgagaggt

SEQ ID NO: 904144 - DNA, 25 bp, Mus musculus
tgtctgagtccatgattcgagaggt

SEQ ID NO: 904145 - DNA, 25 bp, Mus musculus
tgtctgagtcctcgcgggaagccat

SEQ ID NO: 904146 - DNA, 25 bp, Mus musculus
tgtctgagtcctggcgggaagccat

SEQ ID NO: 904147 - DNA, 25 bp, Mus musculus
tgtctgagtctgctgtaaggtgttc

SEQ ID NO: 904148 - DNA, 25 bp, Mus musculus
tgtctgagtctggtgtaaggtgttc

SEQ ID NO: 904149 - DNA, 25 bp, Mus musculus
tgtctgatagtccagcactgggcgt

SEQ ID NO: 904150 - DNA, 25 bp, Mus musculus
tgtctgatagtcgagcactgggcgt

SEQ ID NO: 904151 - DNA, 25 bp, Mus musculus
tgtctgatccaaaagatgtccctcc

SEQ ID NO: 904152 - DNA, 25 bp, Mus musculus
tgtctgatccaatagatgtccctcc

SEQ ID NO: 904153 - DNA, 25 bp, Mus musculus
tgtctgatccccatctcagctagtc

SEQ ID NO: 904154 - DNA, 25 bp, Mus musculus
tgtctgatccccttctcagctagtc

SEQ ID NO: 904155 - DNA, 25 bp, Mus musculus
tgtctgatcctaccttggcgtctct

SEQ ID NO: 904156 - DNA, 25 bp, Mus musculus
tgtctgatcctagcttggcgtctct

SEQ ID NO: 904157 - DNA, 25 bp, Mus musculus
tgtctgatcttgcttgtccctgcgt

SEQ ID NO: 904158 - DNA, 25 bp, Mus musculus
tgtctgatcttggttgtccctgcgt

SEQ ID NO: 904159 - DNA, 25 bp, Mus musculus
tgtctgatgctgattcctcttgtta

SEQ ID NO: 904160 - DNA, 25 bp, Mus musculus
tgtctgatgctgtttcctcttgtta

SEQ ID NO: 904161 - DNA, 25 bp, Mus musculus
tgtctgatggatcccaacccttggg

SEQ ID NO: 904162 - DNA, 25 bp, Mus musculus
tgtctgatggatgccaacccttggg

SEQ ID NO: 904163 - DNA, 25 bp, Mus musculus
tgtctgatttccaacttttccccga

SEQ ID NO: 904164 - DNA, 25 bp, Mus musculus
tgtctgatttcctacttttccccga

SEQ ID NO: 904165 - DNA, 25 bp, Mus musculus
tgtctgcaaagtaccttctgtctac

SEQ ID NO: 904166 - DNA, 25 bp, Mus musculus
tgtctgcaaagttccttctgtctac

SEQ ID NO: 904167 - DNA, 25 bp, Mus musculus
tgtctgcacacactgacaccgatgg

SEQ ID NO: 904168 - DNA, 25 bp, Mus musculus
tgtctgcacacagtgacaccgatgg

SEQ ID NO: 904169 - DNA, 25 bp, Mus musculus
tgtctgcaccgcagggccatatact

SEQ ID NO: 904170 - DNA, 25 bp, Mus musculus
tgtctgcaccgctgggccatatact

SEQ ID NO: 904171 - DNA, 25 bp, Mus musculus
tgtctgcacctaatttcagcaggcc

SEQ ID NO: 904172 - DNA, 25 bp, Mus musculus
tgtctgcacctattttcagcaggcc

SEQ ID NO: 904173 - DNA, 25 bp, Mus musculus
tgtctgcacgagattcacattcact

SEQ ID NO: 904174 - DNA, 25 bp, Mus musculus
tgtctgcacgagtttcacattcact

SEQ ID NO: 904175 - DNA, 25 bp, Mus musculus
tgtctgcactaacaagggttgattt

SEQ ID NO: 904176 - DNA, 25 bp, Mus musculus
tgtctgcactaagaagggttgattt

SEQ ID NO: 904177 - DNA, 25 bp, Mus musculus
tgtctgcagacaaccttttcaaggg

SEQ ID NO: 904178 - DNA, 25 bp, Mus musculus
tgtctgcagacatccttttcaaggg

SEQ ID NO: 904179 - DNA, 25 bp, Mus musculus
tgtctgcagctgaattggcccagaa

SEQ ID NO: 904180 - DNA, 25 bp, Mus musculus
tgtctgcagctgtattggcccagaa

SEQ ID NO: 904181 - DNA, 25 bp, Mus musculus
tgtctgcagtgaccctgactgtgaa

SEQ ID NO: 904182 - DNA, 25 bp, Mus musculus
tgtctgcagtgagcctgactgtgaa

SEQ ID NO: 904183 - DNA, 25 bp, Mus musculus
tgtctgcatctcagttgccaacaat

SEQ ID NO: 904184 - DNA, 25 bp, Mus musculus
tgtctgcatctctgttgccaacaat

SEQ ID NO: 904185 - DNA, 25 bp, Mus musculus
tgtctgcatcttcataaccacacct

SEQ ID NO: 904186 - DNA, 25 bp, Mus musculus
tgtctgcatcttgataaccacacct

SEQ ID NO: 904187 - DNA, 25 bp, Mus musculus
tgtctgcatgtaaggatcccctgga

SEQ ID NO: 904188 - DNA, 25 bp, Mus musculus
tgtctgcatgtatggatcccctgga

SEQ ID NO: 904189 - DNA, 25 bp, Mus musculus
tgtctgcatttaactttcttccaag

SEQ ID NO: 904190 - DNA, 25 bp, Mus musculus
tgtctgcatttatctttcttccaag

SEQ ID NO: 904191 - DNA, 25 bp, Mus musculus
tgtctgcatttcctattttgtttct

SEQ ID NO: 904192 - DNA, 25 bp, Mus musculus
tgtctgcatttcgtattttgtttct

SEQ ID NO: 904193 - DNA, 25 bp, Mus musculus
tgtctgcatttgattctgagtctat

SEQ ID NO: 904194 - DNA, 25 bp, Mus musculus
tgtctgcatttgctatatgggtaca

SEQ ID NO: 904195 - DNA, 25 bp, Mus musculus
tgtctgcatttggtatatgggtaca

SEQ ID NO: 904196 - DNA, 25 bp, Mus musculus
tgtctgcatttgtttctgagtctat

SEQ ID NO: 904197 - DNA, 25 bp, Mus musculus
tgtctgccaaagatcatgtcatcga

SEQ ID NO: 904198 - DNA, 25 bp, Mus musculus
tgtctgccaaagttcatgtcatcga

SEQ ID NO: 904199 - DNA, 25 bp, Mus musculus
tgtctgccaacaacccttggaaagg

SEQ ID NO: 904200 - DNA, 25 bp, Mus musculus
tgtctgccaacatcccttggaaagg

SEQ ID NO: 904201 - DNA, 25 bp, Mus musculus
tgtctgcccaaaacttcgcacacag

SEQ ID NO: 904202 - DNA, 25 bp, Mus musculus
tgtctgcccaaatcttcgcacacag

SEQ ID NO: 904203 - DNA, 25 bp, Mus musculus
tgtctgcccagtaacctgttctgag

SEQ ID NO: 904204 - DNA, 25 bp, Mus musculus
tgtctgcccagttacctgttctgag

SEQ ID NO: 904205 - DNA, 25 bp, Mus musculus
tgtctgcccggcactcagaagatga

SEQ ID NO: 904206 - DNA, 25 bp, Mus musculus
tgtctgcccggctctcagaagatga

SEQ ID NO: 904207 - DNA, 25 bp, Mus musculus
tgtctgccctacagaatacatcctt

SEQ ID NO: 904208 - DNA, 25 bp, Mus musculus
tgtctgccctactgaatacatcctt

SEQ ID NO: 904209 - DNA, 25 bp, Mus musculus
tgtctgccctgaagttctgcgctgt

SEQ ID NO: 904210 - DNA, 25 bp, Mus musculus
tgtctgccctgatgttctgcgctgt

SEQ ID NO: 904211 - DNA, 25 bp, Mus musculus
tgtctgccggagactaggataccaa

SEQ ID NO: 904212 - DNA, 25 bp, Mus musculus
tgtctgccggagtctaggataccaa

SEQ ID NO: 904213 - DNA, 25 bp, Mus musculus
tgtctgcctatcctagagttcacga

SEQ ID NO: 904214 - DNA, 25 bp, Mus musculus
tgtctgcctatcgtagagttcacga

SEQ ID NO: 904215 - DNA, 25 bp, Mus musculus
tgtctgcctgaactgccagtgtcat

SEQ ID NO: 904216 - DNA, 25 bp, Mus musculus
tgtctgcctgaagtgccagtgtcat

SEQ ID NO: 904217 - DNA, 25 bp, Mus musculus
tgtctgcctgacagttgaggccaga

SEQ ID NO: 904218 - DNA, 25 bp, Mus musculus
tgtctgcctgactgttgaggccaga

SEQ ID NO: 904219 - DNA, 25 bp, Mus musculus
tgtctgcctgctcggtgctgaaatt

SEQ ID NO: 904220 - DNA, 25 bp, Mus musculus
tgtctgcctgctgggtgctgaaatt

SEQ ID NO: 904221 - DNA, 25 bp, Mus musculus
tgtctgcctggtatctaaagtctca

SEQ ID NO: 904222 - DNA, 25 bp, Mus musculus
tgtctgcctggtttctaaagtctca

SEQ ID NO: 904223 - DNA, 25 bp, Mus musculus
tgtctgccttccaccctgaaaagaa

SEQ ID NO: 904224 - DNA, 25 bp, Mus musculus
tgtctgccttcccatattcggaatt

SEQ ID NO: 904225 - DNA, 25 bp, Mus musculus
tgtctgccttccgatattcggaatt

SEQ ID NO: 904226 - DNA, 25 bp, Mus musculus
tgtctgccttcctccctgaaaagaa

SEQ ID NO: 904227 - DNA, 25 bp, Mus musculus
tgtctgccttgacccacctacagag

SEQ ID NO: 904228 - DNA, 25 bp, Mus musculus
tgtctgccttgagccacctacagag

SEQ ID NO: 904229 - DNA, 25 bp, Mus musculus
tgtctgccttgtaggctctgagaca

SEQ ID NO: 904230 - DNA, 25 bp, Mus musculus
tgtctgccttgttggctctgagaca

SEQ ID NO: 904231 - DNA, 25 bp, Mus musculus
tgtctgcgctccatatagcacatgt

SEQ ID NO: 904232 - DNA, 25 bp, Mus musculus
tgtctgcgctccttatagcacatgt

SEQ ID NO: 904233 - DNA, 25 bp, Mus musculus
tgtctgctagacaacatagctcata

SEQ ID NO: 904234 - DNA, 25 bp, Mus musculus
tgtctgctagactacatagctcata

SEQ ID NO: 904235 - DNA, 25 bp, Mus musculus
tgtctgctatggataggtggcccac

SEQ ID NO: 904236 - DNA, 25 bp, Mus musculus
tgtctgctatggttaggtggcccac

SEQ ID NO: 904237 - DNA, 25 bp, Mus musculus
tgtctgctcaatcggctctgtaagt

SEQ ID NO: 904238 - DNA, 25 bp, Mus musculus
tgtctgctcaatgggctctgtaagt

SEQ ID NO: 904239 - DNA, 25 bp, Mus musculus
tgtctgctcaccctagagtttaaaa

SEQ ID NO: 904240 - DNA, 25 bp, Mus musculus
tgtctgctcaccgtagagtttaaaa

SEQ ID NO: 904241 - DNA, 25 bp, Mus musculus
tgtctgctcctgaactttgttttaa

SEQ ID NO: 904242 - DNA, 25 bp, Mus musculus
tgtctgctcctgtactttgttttaa

SEQ ID NO: 904243 - DNA, 25 bp, Mus musculus
tgtctgctgacaacacggtgggccg

SEQ ID NO: 904244 - DNA, 25 bp, Mus musculus
tgtctgctgacacttttgtgcggca

SEQ ID NO: 904245 - DNA, 25 bp, Mus musculus
tgtctgctgacagttttgtgcggca

SEQ ID NO: 904246 - DNA, 25 bp, Mus musculus
tgtctgctgacatcacggtgggccg

SEQ ID NO: 904247 - DNA, 25 bp, Mus musculus
tgtctgctgcacagtgtgactgatt

SEQ ID NO: 904248 - DNA, 25 bp, Mus musculus
tgtctgctgcactgtgtgactgatt

SEQ ID NO: 904249 - DNA, 25 bp, Mus musculus
tgtctgctggacctgttccaaaaag

SEQ ID NO: 904250 - DNA, 25 bp, Mus musculus
tgtctgctggacgtgttccaaaaag

SEQ ID NO: 904251 - DNA, 25 bp, Mus musculus
tgtctgctggagatgatgggtcaca

SEQ ID NO: 904252 - DNA, 25 bp, Mus musculus
tgtctgctggagcataccctgcacg

SEQ ID NO: 904253 - DNA, 25 bp, Mus musculus
tgtctgctggaggataccctgcacg

SEQ ID NO: 904254 - DNA, 25 bp, Mus musculus
tgtctgctggagttgatgggtcaca

SEQ ID NO: 904255 - DNA, 25 bp, Mus musculus
tgtctgctgtagcaccatgagatgt

SEQ ID NO: 904256 - DNA, 25 bp, Mus musculus
tgtctgctgtaggaccatgagatgt

SEQ ID NO: 904257 - DNA, 25 bp, Mus musculus
tgtctgcttcatcggctaggcctgt

SEQ ID NO: 904258 - DNA, 25 bp, Mus musculus
tgtctgcttcatgggctaggcctgt

SEQ ID NO: 904259 - DNA, 25 bp, Mus musculus
tgtctgcttcggctggagcccaatg

SEQ ID NO: 904260 - DNA, 25 bp, Mus musculus
tgtctgcttcgggtggagcccaatg

SEQ ID NO: 904261 - DNA, 25 bp, Mus musculus
tgtctgcttgctcttctggtttcta

SEQ ID NO: 904262 - DNA, 25 bp, Mus musculus
tgtctgcttgctgttctggtttcta

SEQ ID NO: 904263 - DNA, 25 bp, Mus musculus
tgtctgcttggaacatggcttgcta

SEQ ID NO: 904264 - DNA, 25 bp, Mus musculus
tgtctgcttggatcatggcttgcta

SEQ ID NO: 904265 - DNA, 25 bp, Mus musculus
tgtctgcttggtaatcctgacatct

SEQ ID NO: 904266 - DNA, 25 bp, Mus musculus
tgtctgcttggtcgctctaacccct

SEQ ID NO: 904267 - DNA, 25 bp, Mus musculus
tgtctgcttggtggctctaacccct

SEQ ID NO: 904268 - DNA, 25 bp, Mus musculus
tgtctgcttggttatcctgacatct

SEQ ID NO: 904269 - DNA, 25 bp, Mus musculus
tgtctgctttccaggaacacttgtc

SEQ ID NO: 904270 - DNA, 25 bp, Mus musculus
tgtctgctttcctggaacacttgtc

SEQ ID NO: 904271 - DNA, 25 bp, Mus musculus
tgtctggaagatcccatgctcccac

SEQ ID NO: 904272 - DNA, 25 bp, Mus musculus
tgtctggaagatgccatgctcccac

SEQ ID NO: 904273 - DNA, 25 bp, Mus musculus
tgtctggaagggaccttggtaccca

SEQ ID NO: 904274 - DNA, 25 bp, Mus musculus
tgtctggaagggtccttggtaccca

SEQ ID NO: 904275 - DNA, 25 bp, Mus musculus
tgtctggaatccagcattactgatg

SEQ ID NO: 904276 - DNA, 25 bp, Mus musculus
tgtctggaatcctgcattactgatg

SEQ ID NO: 904277 - DNA, 25 bp, Mus musculus
tgtctggagacgcaaaaccctgttc

SEQ ID NO: 904278 - DNA, 25 bp, Mus musculus
tgtctggagacggaaaaccctgttc

SEQ ID NO: 904279 - DNA, 25 bp, Mus musculus
tgtctggagctcaggcgtcttcaca

SEQ ID NO: 904280 - DNA, 25 bp, Mus musculus
tgtctggagctctggcgtcttcaca

SEQ ID NO: 904281 - DNA, 25 bp, Mus musculus
tgtctggagctgacaatggcaccat

SEQ ID NO: 904282 - DNA, 25 bp, Mus musculus
tgtctggagctgtcaatggcaccat

SEQ ID NO: 904283 - DNA, 25 bp, Mus musculus
tgtctggagtctctcgggacacgac

SEQ ID NO: 904284 - DNA, 25 bp, Mus musculus
tgtctggagtctgtcgggacacgac

SEQ ID NO: 904285 - DNA, 25 bp, Mus musculus
tgtctggatacaacaactacctgga

SEQ ID NO: 904286 - DNA, 25 bp, Mus musculus
tgtctggatacatcaactacctgga

SEQ ID NO: 904287 - DNA, 25 bp, Mus musculus
tgtctggatcagagactatcagtca

SEQ ID NO: 904288 - DNA, 25 bp, Mus musculus
tgtctggatcagtgactatcagtca

SEQ ID NO: 904289 - DNA, 25 bp, Mus musculus
tgtctggcacagaacatacctgctc

SEQ ID NO: 904290 - DNA, 25 bp, Mus musculus
tgtctggcacagtacatacctgctc

SEQ ID NO: 904291 - DNA, 25 bp, Mus musculus
tgtctggccacaacaagctgcagca

SEQ ID NO: 904292 - DNA, 25 bp, Mus musculus
tgtctggccacatcaagctgcagca

SEQ ID NO: 904293 - DNA, 25 bp, Mus musculus
tgtctggcccacaggacatgttggg

SEQ ID NO: 904294 - DNA, 25 bp, Mus musculus
tgtctggcccactggacatgttggg

SEQ ID NO: 904295 - DNA, 25 bp, Mus musculus
tgtctggcctttaaaattcccgtgt

SEQ ID NO: 904296 - DNA, 25 bp, Mus musculus
tgtctggccttttaaattcccgtgt

SEQ ID NO: 904297 - DNA, 25 bp, Mus musculus
tgtctggctcacacaggacactgaa

SEQ ID NO: 904298 - DNA, 25 bp, Mus musculus
tgtctggctcactcaggacactgaa

SEQ ID NO: 904299 - DNA, 25 bp, Mus musculus
tgtctggctcagaaaagggcatgat

SEQ ID NO: 904300 - DNA, 25 bp, Mus musculus
tgtctggctcagtaaagggcatgat

SEQ ID NO: 904301 - DNA, 25 bp, Mus musculus
tgtctggctcccatgagagttatgc

SEQ ID NO: 904302 - DNA, 25 bp, Mus musculus
tgtctggctcccttgagagttatgc

SEQ ID NO: 904303 - DNA, 25 bp, Mus musculus
tgtctggctgaaaaaggtgacctta

SEQ ID NO: 904304 - DNA, 25 bp, Mus musculus
tgtctggctgaataaggtgacctta

SEQ ID NO: 904305 - DNA, 25 bp, Mus musculus
tgtctggcttcacagtgcacacagg

SEQ ID NO: 904306 - DNA, 25 bp, Mus musculus
tgtctggcttcagagtgcacacagg

SEQ ID NO: 904307 - DNA, 25 bp, Mus musculus
tgtctgggacatacccaaggctggc

SEQ ID NO: 904308 - DNA, 25 bp, Mus musculus
tgtctgggacattcccaaggctggc

SEQ ID NO: 904309 - DNA, 25 bp, Mus musculus
tgtctgggagaccaacctatttcta

SEQ ID NO: 904310 - DNA, 25 bp, Mus musculus
tgtctgggagacgaacctatttcta

SEQ ID NO: 904311 - DNA, 25 bp, Mus musculus
tgtctgggcattatgcttttttctc

SEQ ID NO: 904312 - DNA, 25 bp, Mus musculus
tgtctgggcattttgcttttttctc

SEQ ID NO: 904313 - DNA, 25 bp, Mus musculus
tgtctgggccaaaggaataaggaat

SEQ ID NO: 904314 - DNA, 25 bp, Mus musculus
tgtctgggccaatggaataaggaat

SEQ ID NO: 904315 - DNA, 25 bp, Mus musculus
tgtctgggcgcaagtgcaagaaagt

SEQ ID NO: 904316 - DNA, 25 bp, Mus musculus
tgtctgggcgcatgtgcaagaaagt

SEQ ID NO: 904317 - DNA, 25 bp, Mus musculus
tgtctgggctcaacactgtgtaggc

SEQ ID NO: 904318 - DNA, 25 bp, Mus musculus
tgtctgggctcatcactgtgtaggc

SEQ ID NO: 904319 - DNA, 25 bp, Mus musculus
tgtctgggctccaatgctggcatga

SEQ ID NO: 904320 - DNA, 25 bp, Mus musculus
tgtctgggctcctatgctggcatga

SEQ ID NO: 904321 - DNA, 25 bp, Mus musculus
tgtctgggcttcataggcctttagt

SEQ ID NO: 904322 - DNA, 25 bp, Mus musculus
tgtctgggcttcttaggcctttagt

SEQ ID NO: 904323 - DNA, 25 bp, Mus musculus
tgtctgggtgcgagtcccttgtgaa

SEQ ID NO: 904324 - DNA, 25 bp, Mus musculus
tgtctgggtgcgtgtcccttgtgaa

SEQ ID NO: 904325 - DNA, 25 bp, Mus musculus
tgtctgggtggcctatgcttagcac

SEQ ID NO: 904326 - DNA, 25 bp, Mus musculus
tgtctgggtggcgtatgcttagcac

SEQ ID NO: 904327 - DNA, 25 bp, Mus musculus
tgtctgggtgtcagactggtcagcc

SEQ ID NO: 904328 - DNA, 25 bp, Mus musculus
tgtctgggtgtctgactggtcagcc

SEQ ID NO: 904329 - DNA, 25 bp, Mus musculus
tgtctgggttaactatcactggtca

SEQ ID NO: 904330 - DNA, 25 bp, Mus musculus
tgtctgggttaagtatcactggtca

SEQ ID NO: 904331 - DNA, 25 bp, Mus musculus
tgtctggtaataacacttctgtgtt

SEQ ID NO: 904332 - DNA, 25 bp, Mus musculus
tgtctggtaatatcacttctgtgtt

SEQ ID NO: 904333 - DNA, 25 bp, Mus musculus
tgtctggtaggaactctcggtcctc

SEQ ID NO: 904334 - DNA, 25 bp, Mus musculus
tgtctggtaggatctctcggtcctc

SEQ ID NO: 904335 - DNA, 25 bp, Mus musculus
tgtctggtatccaattgtcccaacg

SEQ ID NO: 904336 - DNA, 25 bp, Mus musculus
tgtctggtatcctattgtcccaacg

SEQ ID NO: 904337 - DNA, 25 bp, Mus musculus
tgtctggtcaggaacctgtctgcaa

SEQ ID NO: 904338 - DNA, 25 bp, Mus musculus
tgtctggtcaggtacctgtctgcaa

SEQ ID NO: 904339 - DNA, 25 bp, Mus musculus
tgtctggtcatgaagtgagggcctt

SEQ ID NO: 904340 - DNA, 25 bp, Mus musculus
tgtctggtcatgtagtgagggcctt

SEQ ID NO: 904341 - DNA, 25 bp, Mus musculus
tgtctggtccgtagagtgtagagct

SEQ ID NO: 904342 - DNA, 25 bp, Mus musculus
tgtctggtccgttgagtgtagagct

SEQ ID NO: 904343 - DNA, 25 bp, Mus musculus
tgtctggtcctcagcaatggcatag

SEQ ID NO: 904344 - DNA, 25 bp, Mus musculus
tgtctggtcctctgcaatggcatag

SEQ ID NO: 904345 - DNA, 25 bp, Mus musculus
tgtctggtctatcgcccctgacaca

SEQ ID NO: 904346 - DNA, 25 bp, Mus musculus
tgtctggtctatggcccctgacaca

SEQ ID NO: 904347 - DNA, 25 bp, Mus musculus
tgtctggtctctactttgtccctgg

SEQ ID NO: 904348 - DNA, 25 bp, Mus musculus
tgtctggtctcttctttgtccctgg

SEQ ID NO: 904349 - DNA, 25 bp, Mus musculus
tgtctggtgatcaagtggtgcctgc

SEQ ID NO: 904350 - DNA, 25 bp, Mus musculus
tgtctggtgatctagtggtgcctgc

SEQ ID NO: 904351 - DNA, 25 bp, Mus musculus
tgtctggtgcctactatcttaaaaa

SEQ ID NO: 904352 - DNA, 25 bp, Mus musculus
tgtctggtgccttctatcttaaaaa

SEQ ID NO: 904353 - DNA, 25 bp, Mus musculus
tgtctggtggaaaccctctgaagtt

SEQ ID NO: 904354 - DNA, 25 bp, Mus musculus
tgtctggtggaatccctctgaagtt

SEQ ID NO: 904355 - DNA, 25 bp, Mus musculus
tgtctggtgtctacgaacctgtgca

SEQ ID NO: 904356 - DNA, 25 bp, Mus musculus
tgtctggtgtcttcgaacctgtgca

SEQ ID NO: 904357 - DNA, 25 bp, Mus musculus
tgtctggttaggacaatggccctta

SEQ ID NO: 904358 - DNA, 25 bp, Mus musculus
tgtctggttaggtcaatggccctta

SEQ ID NO: 904359 - DNA, 25 bp, Mus musculus
tgtctggttatgatgtctgcacttt

SEQ ID NO: 904360 - DNA, 25 bp, Mus musculus
tgtctggttatgttgtctgcacttt

SEQ ID NO: 904361 - DNA, 25 bp, Mus musculus
tgtctggttccaaccccttagcact

SEQ ID NO: 904362 - DNA, 25 bp, Mus musculus
tgtctggttccatccccttagcact

SEQ ID NO: 904363 - DNA, 25 bp, Mus musculus
tgtctggttgccagcggtgtgccac

SEQ ID NO: 904364 - DNA, 25 bp, Mus musculus
tgtctggttgcctgcggtgtgccac

SEQ ID NO: 904365 - DNA, 25 bp, Mus musculus
tgtctggtttgacgtggcagctttt

SEQ ID NO: 904366 - DNA, 25 bp, Mus musculus
tgtctggtttgaggtggcagctttt

SEQ ID NO: 904367 - DNA, 25 bp, Mus musculus
tgtctgtaaagcaaccaccttccaa

SEQ ID NO: 904368 - DNA, 25 bp, Mus musculus
tgtctgtaaagctaccaccttccaa

SEQ ID NO: 904369 - DNA, 25 bp, Mus musculus
tgtctgtacaaaccatattctatta

SEQ ID NO: 904370 - DNA, 25 bp, Mus musculus
tgtctgtacaaagcatattctatta

SEQ ID NO: 904371 - DNA, 25 bp, Mus musculus
tgtctgtacaccattcgcatgccta

SEQ ID NO: 904372 - DNA, 25 bp, Mus musculus
tgtctgtacacctttcgcatgccta

SEQ ID NO: 904373 - DNA, 25 bp, Mus musculus
tgtctgtacgcacttgggttccacc

SEQ ID NO: 904374 - DNA, 25 bp, Mus musculus
tgtctgtacgcactttggtttatca

SEQ ID NO: 904375 - DNA, 25 bp, Mus musculus
tgtctgtacgcagttgggttccacc

SEQ ID NO: 904376 - DNA, 25 bp, Mus musculus
tgtctgtacgcagtttggtttatca

SEQ ID NO: 904377 - DNA, 25 bp, Mus musculus
tgtctgtagggcctttcccagaaac

SEQ ID NO: 904378 - DNA, 25 bp, Mus musculus
tgtctgtagggcgtttcccagaaac

SEQ ID NO: 904379 - DNA, 25 bp, Mus musculus
tgtctgtatgtgcaaggtcctagta

SEQ ID NO: 904380 - DNA, 25 bp, Mus musculus
tgtctgtatgtggaaggtcctagta

SEQ ID NO: 904381 - DNA, 25 bp, Mus musculus
tgtctgtattatatctgtgcccctt

SEQ ID NO: 904382 - DNA, 25 bp, Mus musculus
tgtctgtattatttctgtgcccctt

SEQ ID NO: 904383 - DNA, 25 bp, Mus musculus
tgtctgtattgcagcccatactgga

SEQ ID NO: 904384 - DNA, 25 bp, Mus musculus
tgtctgtattgcagtgttctatccc

SEQ ID NO: 904385 - DNA, 25 bp, Mus musculus
tgtctgtattgctgcccatactgga

SEQ ID NO: 904386 - DNA, 25 bp, Mus musculus
tgtctgtattgctgtgttctatccc

SEQ ID NO: 904387 - DNA, 25 bp, Mus musculus
tgtctgtcacttacctaaatgacat

SEQ ID NO: 904388 - DNA, 25 bp, Mus musculus
tgtctgtcactttcctaaatgacat

SEQ ID NO: 904389 - DNA, 25 bp, Mus musculus
tgtctgtcagaaaagccaagctcta

SEQ ID NO: 904390 - DNA, 25 bp, Mus musculus
tgtctgtcagaatagccaagctcta

SEQ ID NO: 904391 - DNA, 25 bp, Mus musculus
tgtctgtcagatcttgtccttttac

SEQ ID NO: 904392 - DNA, 25 bp, Mus musculus
tgtctgtcagatgttgtccttttac

SEQ ID NO: 904393 - DNA, 25 bp, Mus musculus
tgtctgtcaggcattgtccagtaag

SEQ ID NO: 904394 - DNA, 25 bp, Mus musculus
tgtctgtcaggctttgtccagtaag

SEQ ID NO: 904395 - DNA, 25 bp, Mus musculus
tgtctgtcagttaccacgcataaag

SEQ ID NO: 904396 - DNA, 25 bp, Mus musculus
tgtctgtcagtttccacgcataaag

SEQ ID NO: 904397 - DNA, 25 bp, Mus musculus
tgtctgtcatcacggctccaggaag

SEQ ID NO: 904398 - DNA, 25 bp, Mus musculus
tgtctgtcatcagggctccaggaag

SEQ ID NO: 904399 - DNA, 25 bp, Mus musculus
tgtctgtcattcacagccgctaggg

SEQ ID NO: 904400 - DNA, 25 bp, Mus musculus
tgtctgtcattctcagccgctaggg

SEQ ID NO: 904401 - DNA, 25 bp, Mus musculus
tgtctgtccaagaacagtgtgtccc

SEQ ID NO: 904402 - DNA, 25 bp, Mus musculus
tgtctgtccaagtacagtgtgtccc

SEQ ID NO: 904403 - DNA, 25 bp, Mus musculus
tgtctgtcccataagcctaacaaga

SEQ ID NO: 904404 - DNA, 25 bp, Mus musculus
tgtctgtcccatagcattttaccgt

SEQ ID NO: 904405 - DNA, 25 bp, Mus musculus
tgtctgtcccattagcctaacaaga

SEQ ID NO: 904406 - DNA, 25 bp, Mus musculus
tgtctgtcccattgcattttaccgt

SEQ ID NO: 904407 - DNA, 25 bp, Mus musculus
tgtctgtcccgcacataatcatgca

SEQ ID NO: 904408 - DNA, 25 bp, Mus musculus
tgtctgtcccgctcataatcatgca

SEQ ID NO: 904409 - DNA, 25 bp, Mus musculus
tgtctgtccggtcatgtattgtatc

SEQ ID NO: 904410 - DNA, 25 bp, Mus musculus
tgtctgtccggtgatgtattgtatc

SEQ ID NO: 904411 - DNA, 25 bp, Mus musculus
tgtctgtcctggagccccagtgctt

SEQ ID NO: 904412 - DNA, 25 bp, Mus musculus
tgtctgtcctggtgccccagtgctt

SEQ ID NO: 904413 - DNA, 25 bp, Mus musculus
tgtctgtcgggcacccaggttgtag

SEQ ID NO: 904414 - DNA, 25 bp, Mus musculus
tgtctgtcgggctcccaggttgtag

SEQ ID NO: 904415 - DNA, 25 bp, Mus musculus
tgtctgtctacccaggctatatgtc

SEQ ID NO: 904416 - DNA, 25 bp, Mus musculus
tgtctgtctaccgaggctatatgtc

SEQ ID NO: 904417 - DNA, 25 bp, Mus musculus
tgtctgtctcagctacatggtatag

SEQ ID NO: 904418 - DNA, 25 bp, Mus musculus
tgtctgtctcaggtacatggtatag

SEQ ID NO: 904419 - DNA, 25 bp, Mus musculus
tgtctgtctctgctgtaccgaggtg

SEQ ID NO: 904420 - DNA, 25 bp, Mus musculus
tgtctgtctctggtgtaccgaggtg

SEQ ID NO: 904421 - DNA, 25 bp, Mus musculus
tgtctgtctcttaccaagctaaaaa

SEQ ID NO: 904422 - DNA, 25 bp, Mus musculus
tgtctgtctctttccaagctaaaaa

SEQ ID NO: 904423 - DNA, 25 bp, Mus musculus
tgtctgtctgtaatgcagcccatac

SEQ ID NO: 904424 - DNA, 25 bp, Mus musculus
tgtctgtctgtattgcagcccatac

SEQ ID NO: 904425 - DNA, 25 bp, Mus musculus
tgtctgtcttctacttggtatctaa

SEQ ID NO: 904426 - DNA, 25 bp, Mus musculus
tgtctgtcttcttcttggtatctaa

SEQ ID NO: 904427 - DNA, 25 bp, Mus musculus
tgtctgtctttcctttagtgattat

SEQ ID NO: 904428 - DNA, 25 bp, Mus musculus
tgtctgtctttcgtttagtgattat

SEQ ID NO: 904429 - DNA, 25 bp, Mus musculus
tgtctgtgaccaatgataaccttga

SEQ ID NO: 904430 - DNA, 25 bp, Mus musculus
tgtctgtgaccattgataaccttga

SEQ ID NO: 904431 - DNA, 25 bp, Mus musculus
tgtctgtgactgcttcagtaggccg

SEQ ID NO: 904432 - DNA, 25 bp, Mus musculus
tgtctgtgactggttcagtaggccg

SEQ ID NO: 904433 - DNA, 25 bp, Mus musculus
tgtctgtgagacatgttctgatgag

SEQ ID NO: 904434 - DNA, 25 bp, Mus musculus
tgtctgtgagacttgttctgatgag

SEQ ID NO: 904435 - DNA, 25 bp, Mus musculus
tgtctgtgagtgacctgggccccgt

SEQ ID NO: 904436 - DNA, 25 bp, Mus musculus
tgtctgtgagtgtcctgggccccgt

SEQ ID NO: 904437 - DNA, 25 bp, Mus musculus
tgtctgtgcactcccactcatttct

SEQ ID NO: 904438 - DNA, 25 bp, Mus musculus
tgtctgtgcactgccactcatttct

SEQ ID NO: 904439 - DNA, 25 bp, Mus musculus
tgtctgtgccagagagcgccaagga

SEQ ID NO: 904440 - DNA, 25 bp, Mus musculus
tgtctgtgccagtgagcgccaagga

SEQ ID NO: 904441 - DNA, 25 bp, Mus musculus
tgtctgtgcctgactctgaatccag

SEQ ID NO: 904442 - DNA, 25 bp, Mus musculus
tgtctgtgcctgtctctgaatccag

SEQ ID NO: 904443 - DNA, 25 bp, Mus musculus
tgtctgtgctgcactgtgcggacta

SEQ ID NO: 904444 - DNA, 25 bp, Mus musculus
tgtctgtgctgctctgtgcggacta

SEQ ID NO: 904445 - DNA, 25 bp, Mus musculus
tgtctgtggcaaagtctccccacat

SEQ ID NO: 904446 - DNA, 25 bp, Mus musculus
tgtctgtggcaatgtctccccacat

SEQ ID NO: 904447 - DNA, 25 bp, Mus musculus
tgtctgtggctcagcaattttccag

SEQ ID NO: 904448 - DNA, 25 bp, Mus musculus
tgtctgtggctctgcaattttccag

SEQ ID NO: 904449 - DNA, 25 bp, Mus musculus
tgtctgtgggcccatcaccattaaa

SEQ ID NO: 904450 - DNA, 25 bp, Mus musculus
tgtctgtgggccgatcaccattaaa

SEQ ID NO: 904451 - DNA, 25 bp, Mus musculus
tgtctgtgtatcatgctcaactcct

SEQ ID NO: 904452 - DNA, 25 bp, Mus musculus
tgtctgtgtatcttgctcaactcct

SEQ ID NO: 904453 - DNA, 25 bp, Mus musculus
tgtctgtgtcagacgtacagccaga

SEQ ID NO: 904454 - DNA, 25 bp, Mus musculus
tgtctgtgtcagtcgtacagccaga

SEQ ID NO: 904455 - DNA, 25 bp, Mus musculus
tgtctgtgtctactccaggccaagg

SEQ ID NO: 904456 - DNA, 25 bp, Mus musculus
tgtctgtgtctagtccaggccaagg

SEQ ID NO: 904457 - DNA, 25 bp, Mus musculus
tgtctgtgtctgcaggacctcagat

SEQ ID NO: 904458 - DNA, 25 bp, Mus musculus
tgtctgtgtctggaggacctcagat

SEQ ID NO: 904459 - DNA, 25 bp, Mus musculus
tgtctgtgtgcaatgctgttttgac

SEQ ID NO: 904460 - DNA, 25 bp, Mus musculus
tgtctgtgtgcattgctgttttgac

SEQ ID NO: 904461 - DNA, 25 bp, Mus musculus
tgtctgtgtgctctggtgaagccca

SEQ ID NO: 904462 - DNA, 25 bp, Mus musculus
tgtctgtgtgctgtggtgaagccca

SEQ ID NO: 904463 - DNA, 25 bp, Mus musculus
tgtctgtgtgtcattccgatggtga

SEQ ID NO: 904464 - DNA, 25 bp, Mus musculus
tgtctgtgtgtctttccgatggtga

SEQ ID NO: 904465 - DNA, 25 bp, Mus musculus
tgtctgtgtgttatggagggcaaat

SEQ ID NO: 904466 - DNA, 25 bp, Mus musculus
tgtctgtgtgttttggagggcaaat

SEQ ID NO: 904467 - DNA, 25 bp, Mus musculus
tgtctgttccatacgctgctattct

SEQ ID NO: 904468 - DNA, 25 bp, Mus musculus
tgtctgttccattcgctgctattct

SEQ ID NO: 904469 - DNA, 25 bp, Mus musculus
tgtctgttctcactcatcaacggag

SEQ ID NO: 904470 - DNA, 25 bp, Mus musculus
tgtctgttctcagtcatcaacggag

SEQ ID NO: 904471 - DNA, 25 bp, Mus musculus
tgtctgttctggagcaccttctgcg

SEQ ID NO: 904472 - DNA, 25 bp, Mus musculus
tgtctgttctggtgcaccttctgcg

SEQ ID NO: 904473 - DNA, 25 bp, Mus musculus
tgtctgttcttactgaccagtgccg

SEQ ID NO: 904474 - DNA, 25 bp, Mus musculus
tgtctgttcttagtgaccagtgccg

SEQ ID NO: 904475 - DNA, 25 bp, Mus musculus
tgtctgttgatgctgggacctccca

SEQ ID NO: 904476 - DNA, 25 bp, Mus musculus
tgtctgttgatggtgggacctccca

SEQ ID NO: 904477 - DNA, 25 bp, Mus musculus
tgtctgtttactcttttcgtttcta

SEQ ID NO: 904478 - DNA, 25 bp, Mus musculus
tgtctgtttactgttttcgtttcta

SEQ ID NO: 904479 - DNA, 25 bp, Mus musculus
tgtctgtttgatcctatgctacgtt

SEQ ID NO: 904480 - DNA, 25 bp, Mus musculus
tgtctgtttgatgctatgctacgtt

SEQ ID NO: 904481 - DNA, 25 bp, Mus musculus
tgtctgtttgccaaacacctgtctt

SEQ ID NO: 904482 - DNA, 25 bp, Mus musculus
tgtctgtttgcctaacacctgtctt

SEQ ID NO: 904483 - DNA, 25 bp, Mus musculus
tgtctgtttggtacgttgtcttcaa

SEQ ID NO: 904484 - DNA, 25 bp, Mus musculus
tgtctgtttggttcgttgtcttcaa

SEQ ID NO: 904485 - DNA, 25 bp, Mus musculus
tgtctgtttgtgaggctgaatatgc

SEQ ID NO: 904486 - DNA, 25 bp, Mus musculus
tgtctgtttgtgtggctgaatatgc

SEQ ID NO: 904487 - DNA, 25 bp, Mus musculus
tgtctgtttttaaactctctaccct

SEQ ID NO: 904488 - DNA, 25 bp, Mus musculus
tgtctgtttttatactctctaccct

SEQ ID NO: 904489 - DNA, 25 bp, Mus musculus
tgtctgtttttccaacggtcctgtg

SEQ ID NO: 904490 - DNA, 25 bp, Mus musculus
tgtctgtttttcgaacggtcctgtg

SEQ ID NO: 904491 - DNA, 25 bp, Mus musculus
tgtctgttttttcagggcctagcag

SEQ ID NO: 904492 - DNA, 25 bp, Mus musculus
tgtctgttttttgagggcctagcag

SEQ ID NO: 904493 - DNA, 25 bp, Mus musculus
tgtcttaaaagtaataccccaatct

SEQ ID NO: 904494 - DNA, 25 bp, Mus musculus
tgtcttaaaagttataccccaatct

SEQ ID NO: 904495 - DNA, 25 bp, Mus musculus
tgtcttaaagccagggttttatatg

SEQ ID NO: 904496 - DNA, 25 bp, Mus musculus
tgtcttaaagccaggtcacttgctg

SEQ ID NO: 904497 - DNA, 25 bp, Mus musculus
tgtcttaaagcctgggttttatatg

SEQ ID NO: 904498 - DNA, 25 bp, Mus musculus
tgtcttaaagcctggtcacttgctg

SEQ ID NO: 904499 - DNA, 25 bp, Mus musculus
tgtcttaacctgacctactttgaga

SEQ ID NO: 904500 - DNA, 25 bp, Mus musculus
tgtcttaacctgtcctactttgaga

SEQ ID NO: 904501 - DNA, 25 bp, Mus musculus
tgtcttaaccttactcctggaatga

SEQ ID NO: 904502 - DNA, 25 bp, Mus musculus
tgtcttaacctttctcctggaatga

SEQ ID NO: 904503 - DNA, 25 bp, Mus musculus
tgtcttaagacaacagctcactatg

SEQ ID NO: 904504 - DNA, 25 bp, Mus musculus
tgtcttaagacatcagctcactatg

SEQ ID NO: 904505 - DNA, 25 bp, Mus musculus
tgtcttaagcccagacgatggctgt

SEQ ID NO: 904506 - DNA, 25 bp, Mus musculus
tgtcttaagccctgacgatggctgt

SEQ ID NO: 904507 - DNA, 25 bp, Mus musculus
tgtcttaagtctcctcaaagcccag

SEQ ID NO: 904508 - DNA, 25 bp, Mus musculus
tgtcttaagtctgctcaaagcccag

SEQ ID NO: 904509 - DNA, 25 bp, Mus musculus
tgtcttaattgtcaaaccttgctct

SEQ ID NO: 904510 - DNA, 25 bp, Mus musculus
tgtcttaattgtgaaaccttgctct

SEQ ID NO: 904511 - DNA, 25 bp, Mus musculus
tgtcttacatttccagagcctccag

SEQ ID NO: 904512 - DNA, 25 bp, Mus musculus
tgtcttacatttgcagagcctccag

SEQ ID NO: 904513 - DNA, 25 bp, Mus musculus
tgtcttaccacaagcaaccctgtct

SEQ ID NO: 904514 - DNA, 25 bp, Mus musculus
tgtcttaccacatgcaaccctgtct

SEQ ID NO: 904515 - DNA, 25 bp, Mus musculus
tgtcttaccatccagtttctacttt

SEQ ID NO: 904516 - DNA, 25 bp, Mus musculus
tgtcttaccatcgagtttctacttt

SEQ ID NO: 904517 - DNA, 25 bp, Mus musculus
tgtcttacctgcagcctgaagagta

SEQ ID NO: 904518 - DNA, 25 bp, Mus musculus
tgtcttacctgctgcctgaagagta

SEQ ID NO: 904519 - DNA, 25 bp, Mus musculus
tgtcttacctgtacattgttgtcac

SEQ ID NO: 904520 - DNA, 25 bp, Mus musculus
tgtcttacctgttcattgttgtcac

SEQ ID NO: 904521 - DNA, 25 bp, Mus musculus
tgtcttaccttgctgtcaggtgact

SEQ ID NO: 904522 - DNA, 25 bp, Mus musculus
tgtcttaccttggtgtcaggtgact

SEQ ID NO: 904523 - DNA, 25 bp, Mus musculus
tgtcttacgtacaggatactccgag

SEQ ID NO: 904524 - DNA, 25 bp, Mus musculus
tgtcttacgtactggatactccgag

SEQ ID NO: 904525 - DNA, 25 bp, Mus musculus
tgtcttactggcagcacccagcaag

SEQ ID NO: 904526 - DNA, 25 bp, Mus musculus
tgtcttactggctgcacccagcaag

SEQ ID NO: 904527 - DNA, 25 bp, Mus musculus
tgtcttacttgcctttgtcatcagt

SEQ ID NO: 904528 - DNA, 25 bp, Mus musculus
tgtcttacttgcgtttgtcatcagt

SEQ ID NO: 904529 - DNA, 25 bp, Mus musculus
tgtcttagaaaccagtccctacgct

SEQ ID NO: 904530 - DNA, 25 bp, Mus musculus
tgtcttagaaacgagtccctacgct

SEQ ID NO: 904531 - DNA, 25 bp, Mus musculus
tgtcttagagcaccagcaacgctgt

SEQ ID NO: 904532 - DNA, 25 bp, Mus musculus
tgtcttagagcagcagcaacgctgt

SEQ ID NO: 904533 - DNA, 25 bp, Mus musculus
tgtcttagttacacctgatgccggg

SEQ ID NO: 904534 - DNA, 25 bp, Mus musculus
tgtcttagttactcctgatgccggg

SEQ ID NO: 904535 - DNA, 25 bp, Mus musculus
tgtcttataatcctgcatcacttcc

SEQ ID NO: 904536 - DNA, 25 bp, Mus musculus
tgtcttataatcgtgcatcacttcc

SEQ ID NO: 904537 - DNA, 25 bp, Mus musculus
tgtcttatctagaatccaccactca

SEQ ID NO: 904538 - DNA, 25 bp, Mus musculus
tgtcttatctagtatccaccactca

SEQ ID NO: 904539 - DNA, 25 bp, Mus musculus
tgtcttatctgcatcctgtttcaca

SEQ ID NO: 904540 - DNA, 25 bp, Mus musculus
tgtcttatctgcttcctgtttcaca

SEQ ID NO: 904541 - DNA, 25 bp, Mus musculus
tgtcttattttactactgtttagta

SEQ ID NO: 904542 - DNA, 25 bp, Mus musculus
tgtcttattttagtactgtttagta

SEQ ID NO: 904543 - DNA, 25 bp, Mus musculus
tgtcttattttccttgctgcattta

SEQ ID NO: 904544 - DNA, 25 bp, Mus musculus
tgtcttattttcgttgctgcattta

SEQ ID NO: 904545 - DNA, 25 bp, Mus musculus
tgtcttcaaaacacctccatgttca

SEQ ID NO: 904546 - DNA, 25 bp, Mus musculus
tgtcttcaaaactcctccatgttca

SEQ ID NO: 904547 - DNA, 25 bp, Mus musculus
tgtcttcaactgactatgtctccac

SEQ ID NO: 904548 - DNA, 25 bp, Mus musculus
tgtcttcaactgtctatgtctccac

SEQ ID NO: 904549 - DNA, 25 bp, Mus musculus
tgtcttcaagtccttttcccaccag

SEQ ID NO: 904550 - DNA, 25 bp, Mus musculus
tgtcttcaagtcgttttcccaccag

SEQ ID NO: 904551 - DNA, 25 bp, Mus musculus
tgtcttcaataacctcttgtcacag

SEQ ID NO: 904552 - DNA, 25 bp, Mus musculus
tgtcttcaataagctcttgtcacag

SEQ ID NO: 904553 - DNA, 25 bp, Mus musculus
tgtcttcacaagcagcctgttccag

SEQ ID NO: 904554 - DNA, 25 bp, Mus musculus
tgtcttcacaaggagcctgttccag

SEQ ID NO: 904555 - DNA, 25 bp, Mus musculus
tgtcttcacaccataaactagtaag

SEQ ID NO: 904556 - DNA, 25 bp, Mus musculus
tgtcttcacaccttaaactagtaag

SEQ ID NO: 904557 - DNA, 25 bp, Mus musculus
tgtcttcacctgatttctgtaatct

SEQ ID NO: 904558 - DNA, 25 bp, Mus musculus
tgtcttcacctgttttctgtaatct

SEQ ID NO: 904559 - DNA, 25 bp, Mus musculus
tgtcttcactagactctggtcctag

SEQ ID NO: 904560 - DNA, 25 bp, Mus musculus
tgtcttcactagtctctggtcctag

SEQ ID NO: 904561 - DNA, 25 bp, Mus musculus
tgtcttcactcaccacactgaggga

SEQ ID NO: 904562 - DNA, 25 bp, Mus musculus
tgtcttcactcagcacactgaggga

SEQ ID NO: 904563 - DNA, 25 bp, Mus musculus
tgtcttcacttgactcaactattct

SEQ ID NO: 904564 - DNA, 25 bp, Mus musculus
tgtcttcacttgtctcaactattct

SEQ ID NO: 904565 - DNA, 25 bp, Mus musculus
tgtcttcagacccaacactagaaga

SEQ ID NO: 904566 - DNA, 25 bp, Mus musculus
tgtcttcagaccgaacactagaaga

SEQ ID NO: 904567 - DNA, 25 bp, Mus musculus
tgtcttcagatgcaggttcctctta

SEQ ID NO: 904568 - DNA, 25 bp, Mus musculus
tgtcttcagatggaggttcctctta

SEQ ID NO: 904569 - DNA, 25 bp, Mus musculus
tgtcttcagccactagtctccattt

SEQ ID NO: 904570 - DNA, 25 bp, Mus musculus
tgtcttcagccagtagtctccattt

SEQ ID NO: 904571 - DNA, 25 bp, Mus musculus
tgtcttcagtttctgtctctgatct

SEQ ID NO: 904572 - DNA, 25 bp, Mus musculus
tgtcttcagtttgtgtctctgatct

SEQ ID NO: 904573 - DNA, 25 bp, Mus musculus
tgtcttcatatcaagctcaaggcca

SEQ ID NO: 904574 - DNA, 25 bp, Mus musculus
tgtcttcatatctagctcaaggcca

SEQ ID NO: 904575 - DNA, 25 bp, Mus musculus
tgtcttcatccccagctgtgatgaa

SEQ ID NO: 904576 - DNA, 25 bp, Mus musculus
tgtcttcatcccgagctgtgatgaa

SEQ ID NO: 904577 - DNA, 25 bp, Mus musculus
tgtcttcatcctcaatcctcacaag

SEQ ID NO: 904578 - DNA, 25 bp, Mus musculus
tgtcttcatcctgaatcctcacaag

SEQ ID NO: 904579 - DNA, 25 bp, Mus musculus
tgtcttcatctacatggcatctttc

SEQ ID NO: 904580 - DNA, 25 bp, Mus musculus
tgtcttcatctagatggcatctttc

SEQ ID NO: 904581 - DNA, 25 bp, Mus musculus
tgtcttcatctcagcagggtttttc

SEQ ID NO: 904582 - DNA, 25 bp, Mus musculus
tgtcttcatctctgcagggtttttc

SEQ ID NO: 904583 - DNA, 25 bp, Mus musculus
tgtcttcatgacctactgctcttgc

SEQ ID NO: 904584 - DNA, 25 bp, Mus musculus
tgtcttcatgacgtactgctcttgc

SEQ ID NO: 904585 - DNA, 25 bp, Mus musculus
tgtcttccacaaaagcaattctctc

SEQ ID NO: 904586 - DNA, 25 bp, Mus musculus
tgtcttccacaatagcaattctctc

SEQ ID NO: 904587 - DNA, 25 bp, Mus musculus
tgtcttccacagctgcaggtgcctt

SEQ ID NO: 904588 - DNA, 25 bp, Mus musculus
tgtcttccacaggtgcaggtgcctt

SEQ ID NO: 904589 - DNA, 25 bp, Mus musculus
tgtcttccaccgactgcttcaatac

SEQ ID NO: 904590 - DNA, 25 bp, Mus musculus
tgtcttccaccgtctgcttcaatac

SEQ ID NO: 904591 - DNA, 25 bp, Mus musculus
tgtcttccagagctagggctacttc

SEQ ID NO: 904592 - DNA, 25 bp, Mus musculus
tgtcttccagaggtagggctacttc

SEQ ID NO: 904593 - DNA, 25 bp, Mus musculus
tgtcttccaggaagggtggcatata

SEQ ID NO: 904594 - DNA, 25 bp, Mus musculus
tgtcttccaggatgggtggcatata

SEQ ID NO: 904595 - DNA, 25 bp, Mus musculus
tgtcttccagtcaccggccggtgga

SEQ ID NO: 904596 - DNA, 25 bp, Mus musculus
tgtcttccagtctccggccggtgga

SEQ ID NO: 904597 - DNA, 25 bp, Mus musculus
tgtcttccatgtccagtacttagct

SEQ ID NO: 904598 - DNA, 25 bp, Mus musculus
tgtcttccatgtgcagtacttagct

SEQ ID NO: 904599 - DNA, 25 bp, Mus musculus
tgtcttcccaaacgcaaaggcagca

SEQ ID NO: 904600 - DNA, 25 bp, Mus musculus
tgtcttcccaaaggcaaaggcagca

SEQ ID NO: 904601 - DNA, 25 bp, Mus musculus
tgtcttcccatacgagcattaccct

SEQ ID NO: 904602 - DNA, 25 bp, Mus musculus
tgtcttcccataggagcattaccct

SEQ ID NO: 904603 - DNA, 25 bp, Mus musculus
tgtcttcccatcactttagcgatta

SEQ ID NO: 904604 - DNA, 25 bp, Mus musculus
tgtcttcccatctctttagcgatta

SEQ ID NO: 904605 - DNA, 25 bp, Mus musculus
tgtcttccccaacaagtaaatgtgc

SEQ ID NO: 904606 - DNA, 25 bp, Mus musculus
tgtcttccccaagaagtaaatgtgc

SEQ ID NO: 904607 - DNA, 25 bp, Mus musculus
tgtcttccccaccagaaggtaggag

SEQ ID NO: 904608 - DNA, 25 bp, Mus musculus
tgtcttccccacgagaaggtaggag

SEQ ID NO: 904609 - DNA, 25 bp, Mus musculus
tgtcttcccctacacatgggtccag

SEQ ID NO: 904610 - DNA, 25 bp, Mus musculus
tgtcttcccctagacatgggtccag

SEQ ID NO: 904611 - DNA, 25 bp, Mus musculus
tgtcttcccgtcagatgtccctaag

SEQ ID NO: 904612 - DNA, 25 bp, Mus musculus
tgtcttcccgtctgatgtccctaag

SEQ ID NO: 904613 - DNA, 25 bp, Mus musculus
tgtcttccctctctgcaagtgtgtg

SEQ ID NO: 904614 - DNA, 25 bp, Mus musculus
tgtcttccctctgtgcaagtgtgtg

SEQ ID NO: 904615 - DNA, 25 bp, Mus musculus
tgtcttccctgaattccaaggagtg

SEQ ID NO: 904616 - DNA, 25 bp, Mus musculus
tgtcttccctgatttccaaggagtg

SEQ ID NO: 904617 - DNA, 25 bp, Mus musculus
tgtcttccctgcaacaagtccaagt

SEQ ID NO: 904618 - DNA, 25 bp, Mus musculus
tgtcttccctgctacaagtccaagt

SEQ ID NO: 904619 - DNA, 25 bp, Mus musculus
tgtcttccgaccataaacgtgctct

SEQ ID NO: 904620 - DNA, 25 bp, Mus musculus
tgtcttccgaccttaaacgtgctct

SEQ ID NO: 904621 - DNA, 25 bp, Mus musculus
tgtcttccgagtagcccatgagtct

SEQ ID NO: 904622 - DNA, 25 bp, Mus musculus
tgtcttccgagttgcccatgagtct

SEQ ID NO: 904623 - DNA, 25 bp, Mus musculus
tgtcttccggagaccctgttcgctt

SEQ ID NO: 904624 - DNA, 25 bp, Mus musculus
tgtcttccggagtccctgttcgctt

SEQ ID NO: 904625 - DNA, 25 bp, Mus musculus
tgtcttcctagcacaagtctcccaa

SEQ ID NO: 904626 - DNA, 25 bp, Mus musculus
tgtcttcctagctcaagtctcccaa

SEQ ID NO: 904627 - DNA, 25 bp, Mus musculus
tgtcttcctcctagcaataatttaa

SEQ ID NO: 904628 - DNA, 25 bp, Mus musculus
tgtcttcctccttgcaataatttaa

SEQ ID NO: 904629 - DNA, 25 bp, Mus musculus
tgtcttcctcttaagactgcagcaa

SEQ ID NO: 904630 - DNA, 25 bp, Mus musculus
tgtcttcctctttagactgcagcaa

SEQ ID NO: 904631 - DNA, 25 bp, Mus musculus
tgtcttcctgacctaacagtttcct

SEQ ID NO: 904632 - DNA, 25 bp, Mus musculus
tgtcttcctgacgtaacagtttcct

SEQ ID NO: 904633 - DNA, 25 bp, Mus musculus
tgtcttcctgccaaatggcccagaa

SEQ ID NO: 904634 - DNA, 25 bp, Mus musculus
tgtcttcctgcctaatggcccagaa

SEQ ID NO: 904635 - DNA, 25 bp, Mus musculus
tgtcttcctgctacgaatcttgttc

SEQ ID NO: 904636 - DNA, 25 bp, Mus musculus
tgtcttcctgcttcgaatcttgttc

SEQ ID NO: 904637 - DNA, 25 bp, Mus musculus
tgtcttcctggaaccattatttgga

SEQ ID NO: 904638 - DNA, 25 bp, Mus musculus
tgtcttcctggatccattatttgga

SEQ ID NO: 904639 - DNA, 25 bp, Mus musculus
tgtcttcctgtcagtgagctaccac

SEQ ID NO: 904640 - DNA, 25 bp, Mus musculus
tgtcttcctgtctgtgagctaccac

SEQ ID NO: 904641 - DNA, 25 bp, Mus musculus
tgtcttccttaccatatcagcaagc

SEQ ID NO: 904642 - DNA, 25 bp, Mus musculus
tgtcttccttacgatatcagcaagc

SEQ ID NO: 904643 - DNA, 25 bp, Mus musculus
tgtcttccttcactgtggcctgggc

SEQ ID NO: 904644 - DNA, 25 bp, Mus musculus
tgtcttccttcagtgtggcctgggc

SEQ ID NO: 904645 - DNA, 25 bp, Mus musculus
tgtcttccttctccccgaatgatgg

SEQ ID NO: 904646 - DNA, 25 bp, Mus musculus
tgtcttccttctgcccgaatgatgg

SEQ ID NO: 904647 - DNA, 25 bp, Mus musculus
tgtcttcgaaccagtgcacctttgg

SEQ ID NO: 904648 - DNA, 25 bp, Mus musculus
tgtcttcgaacctgtgcacctttgg

SEQ ID NO: 904649 - DNA, 25 bp, Mus musculus
tgtcttcgagacaagcttcctagag

SEQ ID NO: 904650 - DNA, 25 bp, Mus musculus
tgtcttcgagactagcttcctagag

SEQ ID NO: 904651 - DNA, 25 bp, Mus musculus
tgtcttcgcaagagccatgatgcat

SEQ ID NO: 904652 - DNA, 25 bp, Mus musculus
tgtcttcgcaagtgccatgatgcat

SEQ ID NO: 904653 - DNA, 25 bp, Mus musculus
tgtcttctaacacccattcatttca

SEQ ID NO: 904654 - DNA, 25 bp, Mus musculus
tgtcttctaacagccattcatttca

SEQ ID NO: 904655 - DNA, 25 bp, Mus musculus
tgtcttctaacgattttttgtctct

SEQ ID NO: 904656 - DNA, 25 bp, Mus musculus
tgtcttctaacgtttttttgtctct

SEQ ID NO: 904657 - DNA, 25 bp, Mus musculus
tgtcttctacacacacatctctgta

SEQ ID NO: 904658 - DNA, 25 bp, Mus musculus
tgtcttctacactcacatctctgta

SEQ ID NO: 904659 - DNA, 25 bp, Mus musculus
tgtcttctacctaagttgcccaggc

SEQ ID NO: 904660 - DNA, 25 bp, Mus musculus
tgtcttctaccttagttgcccaggc

SEQ ID NO: 904661 - DNA, 25 bp, Mus musculus
tgtcttctaggcagtgtctgtcgaa

SEQ ID NO: 904662 - DNA, 25 bp, Mus musculus
tgtcttctaggctgtgtctgtcgaa

SEQ ID NO: 904663 - DNA, 25 bp, Mus musculus
tgtcttctcaaaccttgacttgcca

SEQ ID NO: 904664 - DNA, 25 bp, Mus musculus
tgtcttctcaaagcttgacttgcca

SEQ ID NO: 904665 - DNA, 25 bp, Mus musculus
tgtcttctcactcccaagagagtgt

SEQ ID NO: 904666 - DNA, 25 bp, Mus musculus
tgtcttctcactgccaagagagtgt

SEQ ID NO: 904667 - DNA, 25 bp, Mus musculus
tgtcttctcagcaacgaagcccatg

SEQ ID NO: 904668 - DNA, 25 bp, Mus musculus
tgtcttctcagctacgaagcccatg

SEQ ID NO: 904669 - DNA, 25 bp, Mus musculus
tgtcttctcagtacacgcagtgcca

SEQ ID NO: 904670 - DNA, 25 bp, Mus musculus
tgtcttctcagttcacgcagtgcca

SEQ ID NO: 904671 - DNA, 25 bp, Mus musculus
tgtcttctcctgctacttccaacta

SEQ ID NO: 904672 - DNA, 25 bp, Mus musculus
tgtcttctcctggtacttccaacta

SEQ ID NO: 904673 - DNA, 25 bp, Mus musculus
tgtcttctcttgactgacagatgat

SEQ ID NO: 904674 - DNA, 25 bp, Mus musculus
tgtcttctcttgtctgacagatgat

SEQ ID NO: 904675 - DNA, 25 bp, Mus musculus
tgtcttctgaccctctttagtttca

SEQ ID NO: 904676 - DNA, 25 bp, Mus musculus
tgtcttctgaccgtctttagtttca

SEQ ID NO: 904677 - DNA, 25 bp, Mus musculus
tgtcttctgaggacactagcatgga

SEQ ID NO: 904678 - DNA, 25 bp, Mus musculus
tgtcttctgaggtcactagcatgga

SEQ ID NO: 904679 - DNA, 25 bp, Mus musculus
tgtcttctggatcagtggcttcttc

SEQ ID NO: 904680 - DNA, 25 bp, Mus musculus
tgtcttctggatgagtggcttcttc

SEQ ID NO: 904681 - DNA, 25 bp, Mus musculus
tgtcttcttccactagagccgtgaa

SEQ ID NO: 904682 - DNA, 25 bp, Mus musculus
tgtcttcttccagtagagccgtgaa

SEQ ID NO: 904683 - DNA, 25 bp, Mus musculus
tgtcttcttcctatgtgtctcctga

SEQ ID NO: 904684 - DNA, 25 bp, Mus musculus
tgtcttcttcctttgtgtctcctga

SEQ ID NO: 904685 - DNA, 25 bp, Mus musculus
tgtcttcttgagacgtcatcctttc

SEQ ID NO: 904686 - DNA, 25 bp, Mus musculus
tgtcttcttgagtcgtcatcctttc

SEQ ID NO: 904687 - DNA, 25 bp, Mus musculus
tgtcttcttggtagcatccctagct

SEQ ID NO: 904688 - DNA, 25 bp, Mus musculus
tgtcttcttggtatgatagctgatc

SEQ ID NO: 904689 - DNA, 25 bp, Mus musculus
tgtcttcttggtccctctgtttcct

SEQ ID NO: 904690 - DNA, 25 bp, Mus musculus
tgtcttcttggtgcctctgtttcct

SEQ ID NO: 904691 - DNA, 25 bp, Mus musculus
tgtcttcttggttgcatccctagct

SEQ ID NO: 904692 - DNA, 25 bp, Mus musculus
tgtcttcttggtttgatagctgatc

SEQ ID NO: 904693 - DNA, 25 bp, Mus musculus
tgtcttcttgttaatccctcacact

SEQ ID NO: 904694 - DNA, 25 bp, Mus musculus
tgtcttcttgtttatccctcacact

SEQ ID NO: 904695 - DNA, 25 bp, Mus musculus
tgtcttgaaggcagctttgctccaa

SEQ ID NO: 904696 - DNA, 25 bp, Mus musculus
tgtcttgaaggctgctttgctccaa

SEQ ID NO: 904697 - DNA, 25 bp, Mus musculus
tgtcttgacaagcaacttacatcag

SEQ ID NO: 904698 - DNA, 25 bp, Mus musculus
tgtcttgacaaggaacttacatcag

SEQ ID NO: 904699 - DNA, 25 bp, Mus musculus
tgtcttgactccctccatgatggct

SEQ ID NO: 904700 - DNA, 25 bp, Mus musculus
tgtcttgactccgtccatgatggct

SEQ ID NO: 904701 - DNA, 25 bp, Mus musculus
tgtcttgatccaatccagtctataa

SEQ ID NO: 904702 - DNA, 25 bp, Mus musculus
tgtcttgatccattccagtctataa

SEQ ID NO: 904703 - DNA, 25 bp, Mus musculus
tgtcttgatcctaggcccaatccat

SEQ ID NO: 904704 - DNA, 25 bp, Mus musculus
tgtcttgatccttggcccaatccat

SEQ ID NO: 904705 - DNA, 25 bp, Mus musculus
tgtcttgatgctcactgctcctaaa

SEQ ID NO: 904706 - DNA, 25 bp, Mus musculus
tgtcttgatgctgactgctcctaaa

SEQ ID NO: 904707 - DNA, 25 bp, Mus musculus
tgtcttgatggtatgttcttgggtc

SEQ ID NO: 904708 - DNA, 25 bp, Mus musculus
tgtcttgatggtttgttcttgggtc

SEQ ID NO: 904709 - DNA, 25 bp, Mus musculus
tgtcttgcactacagccactctagt

SEQ ID NO: 904710 - DNA, 25 bp, Mus musculus
tgtcttgcactagagccactctagt

SEQ ID NO: 904711 - DNA, 25 bp, Mus musculus
tgtcttgcatatctacgccggtcaa

SEQ ID NO: 904712 - DNA, 25 bp, Mus musculus
tgtcttgcatatgtacgccggtcaa

SEQ ID NO: 904713 - DNA, 25 bp, Mus musculus
tgtcttgccatgagaaacccctcca

SEQ ID NO: 904714 - DNA, 25 bp, Mus musculus
tgtcttgccatgctgggatcgaacc

SEQ ID NO: 904715 - DNA, 25 bp, Mus musculus
tgtcttgccatggtgggatcgaacc

SEQ ID NO: 904716 - DNA, 25 bp, Mus musculus
tgtcttgccatgtgaaacccctcca

SEQ ID NO: 904717 - DNA, 25 bp, Mus musculus
tgtcttgcctctcctaacaaattca

SEQ ID NO: 904718 - DNA, 25 bp, Mus musculus
tgtcttgcctctgctaacaaattca

SEQ ID NO: 904719 - DNA, 25 bp, Mus musculus
tgtcttgcctgtcccatagataagg

SEQ ID NO: 904720 - DNA, 25 bp, Mus musculus
tgtcttgcctgtgccatagataagg

SEQ ID NO: 904721 - DNA, 25 bp, Mus musculus
tgtcttgcggcacatcgaggctcag

SEQ ID NO: 904722 - DNA, 25 bp, Mus musculus
tgtcttgcggcagatcgaggctcag

SEQ ID NO: 904723 - DNA, 25 bp, Mus musculus
tgtcttgctcttattctcgaaatga

SEQ ID NO: 904724 - DNA, 25 bp, Mus musculus
tgtcttgctctttttctcgaaatga

SEQ ID NO: 904725 - DNA, 25 bp, Mus musculus
tgtcttgcttcaacccagagggata

SEQ ID NO: 904726 - DNA, 25 bp, Mus musculus
tgtcttgcttcatcccagagggata

SEQ ID NO: 904727 - DNA, 25 bp, Mus musculus
tgtcttggaacaaatctgccagcca

SEQ ID NO: 904728 - DNA, 25 bp, Mus musculus
tgtcttggaacatatctgccagcca

SEQ ID NO: 904729 - DNA, 25 bp, Mus musculus
tgtcttggagagaggccgttgataa

SEQ ID NO: 904730 - DNA, 25 bp, Mus musculus
tgtcttggagagtggccgttgataa

SEQ ID NO: 904731 - DNA, 25 bp, Mus musculus
tgtcttggcatcagtgtttcttagt

SEQ ID NO: 904732 - DNA, 25 bp, Mus musculus
tgtcttggcatcagttgttttctat

SEQ ID NO: 904733 - DNA, 25 bp, Mus musculus
tgtcttggcatctgtgtttcttagt

SEQ ID NO: 904734 - DNA, 25 bp, Mus musculus
tgtcttggcatctgttgttttctat

SEQ ID NO: 904735 - DNA, 25 bp, Mus musculus
tgtcttggcctcagtacttgcacac

SEQ ID NO: 904736 - DNA, 25 bp, Mus musculus
tgtcttggcctctgtacttgcacac

SEQ ID NO: 904737 - DNA, 25 bp, Mus musculus
tgtcttggctatcatggtattcccc

SEQ ID NO: 904738 - DNA, 25 bp, Mus musculus
tgtcttggctatgatggtattcccc

SEQ ID NO: 904739 - DNA, 25 bp, Mus musculus
tgtcttgggccaaaggcctagatcc

SEQ ID NO: 904740 - DNA, 25 bp, Mus musculus
tgtcttgggccataggcctagatcc

SEQ ID NO: 904741 - DNA, 25 bp, Mus musculus
tgtcttgggcctattattttaatga

SEQ ID NO: 904742 - DNA, 25 bp, Mus musculus
tgtcttgggccttttattttaatga

SEQ ID NO: 904743 - DNA, 25 bp, Mus musculus
tgtcttgggtctccacttctgtaca

SEQ ID NO: 904744 - DNA, 25 bp, Mus musculus
tgtcttgggtctgcacttctgtaca

SEQ ID NO: 904745 - DNA, 25 bp, Mus musculus
tgtcttgggttccacacgagttcat

SEQ ID NO: 904746 - DNA, 25 bp, Mus musculus
tgtcttgggttcgacacgagttcat

SEQ ID NO: 904747 - DNA, 25 bp, Mus musculus
tgtcttggtctaagtactattgctg

SEQ ID NO: 904748 - DNA, 25 bp, Mus musculus
tgtcttggtctatgtactattgctg

SEQ ID NO: 904749 - DNA, 25 bp, Mus musculus
tgtcttggtgacaatcctgccttaa

SEQ ID NO: 904750 - DNA, 25 bp, Mus musculus
tgtcttggtgactatcctgccttaa

SEQ ID NO: 904751 - DNA, 25 bp, Mus musculus
tgtcttggttttcattatgtaggaa

SEQ ID NO: 904752 - DNA, 25 bp, Mus musculus
tgtcttggttttgattatgtaggaa

SEQ ID NO: 904753 - DNA, 25 bp, Mus musculus
tgtcttgtacagatcccgtcacgta

SEQ ID NO: 904754 - DNA, 25 bp, Mus musculus
tgtcttgtacagttcccgtcacgta

SEQ ID NO: 904755 - DNA, 25 bp, Mus musculus
tgtcttgtagcccttccagatgggt

SEQ ID NO: 904756 - DNA, 25 bp, Mus musculus
tgtcttgtagccgttccagatgggt

SEQ ID NO: 904757 - DNA, 25 bp, Mus musculus
tgtcttgtatagacagtcatgtcag

SEQ ID NO: 904758 - DNA, 25 bp, Mus musculus
tgtcttgtatagtcagtcatgtcag

SEQ ID NO: 904759 - DNA, 25 bp, Mus musculus
tgtcttgtcaccaatggatggctac

SEQ ID NO: 904760 - DNA, 25 bp, Mus musculus
tgtcttgtcacctatggatggctac

SEQ ID NO: 904761 - DNA, 25 bp, Mus musculus
tgtcttgtcagtcctgtttgtgtct

SEQ ID NO: 904762 - DNA, 25 bp, Mus musculus
tgtcttgtcagtgctgtttgtgtct

SEQ ID NO: 904763 - DNA, 25 bp, Mus musculus
tgtcttgtccacacatgggtgaaga

SEQ ID NO: 904764 - DNA, 25 bp, Mus musculus
tgtcttgtccactcatgggtgaaga

SEQ ID NO: 904765 - DNA, 25 bp, Mus musculus
tgtcttgtcccaacttcatttttag

SEQ ID NO: 904766 - DNA, 25 bp, Mus musculus
tgtcttgtcccaattgagcttcgaa

SEQ ID NO: 904767 - DNA, 25 bp, Mus musculus
tgtcttgtcccaccctcttaagaaa

SEQ ID NO: 904768 - DNA, 25 bp, Mus musculus
tgtcttgtcccagcctcttaagaaa

SEQ ID NO: 904769 - DNA, 25 bp, Mus musculus
tgtcttgtcccatcttcatttttag

SEQ ID NO: 904770 - DNA, 25 bp, Mus musculus
tgtcttgtcccatttgagcttcgaa

SEQ ID NO: 904771 - DNA, 25 bp, Mus musculus
tgtcttgtccttaactctgagtggc

SEQ ID NO: 904772 - DNA, 25 bp, Mus musculus
tgtcttgtcctttactctgagtggc

SEQ ID NO: 904773 - DNA, 25 bp, Mus musculus
tgtcttgtctatacccagtgagatc

SEQ ID NO: 904774 - DNA, 25 bp, Mus musculus
tgtcttgtctattcccagtgagatc

SEQ ID NO: 904775 - DNA, 25 bp, Mus musculus
tgtcttgtgagtccagcacctggtc

SEQ ID NO: 904776 - DNA, 25 bp, Mus musculus
tgtcttgtgagtgcagcacctggtc

SEQ ID NO: 904777 - DNA, 25 bp, Mus musculus
tgtcttgttactactactgcaggca

SEQ ID NO: 904778 - DNA, 25 bp, Mus musculus
tgtcttgttacttctactgcaggca

SEQ ID NO: 904779 - DNA, 25 bp, Mus musculus
tgtcttgttgtgacagcacctgaga

SEQ ID NO: 904780 - DNA, 25 bp, Mus musculus
tgtcttgttgtgtcagcacctgaga

SEQ ID NO: 904781 - DNA, 25 bp, Mus musculus
tgtcttgttttactgtatgctgtgc

SEQ ID NO: 904782 - DNA, 25 bp, Mus musculus
tgtcttgttttagtgtatgctgtgc

SEQ ID NO: 904783 - DNA, 25 bp, Mus musculus
tgtctttaaatgatgtgcctatggc

SEQ ID NO: 904784 - DNA, 25 bp, Mus musculus
tgtctttaaatgttgtgcctatggc

SEQ ID NO: 904785 - DNA, 25 bp, Mus musculus
tgtctttaagcccttctcgtgctgc

SEQ ID NO: 904786 - DNA, 25 bp, Mus musculus
tgtctttaagccgttctcgtgctgc

SEQ ID NO: 904787 - DNA, 25 bp, Mus musculus
tgtctttaccagaatctcccattac

SEQ ID NO: 904788 - DNA, 25 bp, Mus musculus
tgtctttaccagtatctcccattac

SEQ ID NO: 904789 - DNA, 25 bp, Mus musculus
tgtctttaccggactccgggaatgt

SEQ ID NO: 904790 - DNA, 25 bp, Mus musculus
tgtctttaccggtctccgggaatgt

SEQ ID NO: 904791 - DNA, 25 bp, Mus musculus
tgtctttagcctcccagcacagagc

SEQ ID NO: 904792 - DNA, 25 bp, Mus musculus
tgtctttagcctgccagcacagagc

SEQ ID NO: 904793 - DNA, 25 bp, Mus musculus
tgtctttagcttatcagaatacaag

SEQ ID NO: 904794 - DNA, 25 bp, Mus musculus
tgtctttagcttttcagaatacaag

SEQ ID NO: 904795 - DNA, 25 bp, Mus musculus
tgtctttagtccatttggtataagt

SEQ ID NO: 904796 - DNA, 25 bp, Mus musculus
tgtctttagtccttttggtataagt

SEQ ID NO: 904797 - DNA, 25 bp, Mus musculus
tgtctttataagatctgcagtgctt

SEQ ID NO: 904798 - DNA, 25 bp, Mus musculus
tgtctttataagttctgcagtgctt

SEQ ID NO: 904799 - DNA, 25 bp, Mus musculus
tgtctttatgtgcttgctcagtctc

SEQ ID NO: 904800 - DNA, 25 bp, Mus musculus
tgtctttatgtggttgctcagtctc

SEQ ID NO: 904801 - DNA, 25 bp, Mus musculus
tgtctttattaacccttgcaacctg

SEQ ID NO: 904802 - DNA, 25 bp, Mus musculus
tgtctttattaagccttgcaacctg

SEQ ID NO: 904803 - DNA, 25 bp, Mus musculus
tgtctttatttgatctcaagtctca

SEQ ID NO: 904804 - DNA, 25 bp, Mus musculus
tgtctttatttgttctcaagtctca

SEQ ID NO: 904805 - DNA, 25 bp, Mus musculus
tgtctttcaataaggcacttagtgg

SEQ ID NO: 904806 - DNA, 25 bp, Mus musculus
tgtctttcaatatggcacttagtgg

SEQ ID NO: 904807 - DNA, 25 bp, Mus musculus
tgtctttcatccaacatcctgtatt

SEQ ID NO: 904808 - DNA, 25 bp, Mus musculus
tgtctttcatcctacatcctgtatt

SEQ ID NO: 904809 - DNA, 25 bp, Mus musculus
tgtctttcattaatctggcaattgt

SEQ ID NO: 904810 - DNA, 25 bp, Mus musculus
tgtctttcattattctggcaattgt

SEQ ID NO: 904811 - DNA, 25 bp, Mus musculus
tgtctttcccgtattatatagcatt

SEQ ID NO: 904812 - DNA, 25 bp, Mus musculus
tgtctttcccgttttatatagcatt

SEQ ID NO: 904813 - DNA, 25 bp, Mus musculus
tgtctttccctaaaacaactcgcta

SEQ ID NO: 904814 - DNA, 25 bp, Mus musculus
tgtctttccctataacaactcgcta

SEQ ID NO: 904815 - DNA, 25 bp, Mus musculus
tgtctttccctccatagcaatatat

SEQ ID NO: 904816 - DNA, 25 bp, Mus musculus
tgtctttccctcgatagcaatatat

SEQ ID NO: 904817 - DNA, 25 bp, Mus musculus
tgtctttccctgagaggcgacagta

SEQ ID NO: 904818 - DNA, 25 bp, Mus musculus
tgtctttccctgctggccgagagct

SEQ ID NO: 904819 - DNA, 25 bp, Mus musculus
tgtctttccctggtggccgagagct

SEQ ID NO: 904820 - DNA, 25 bp, Mus musculus
tgtctttccctgtgaggcgacagta

SEQ ID NO: 904821 - DNA, 25 bp, Mus musculus
tgtctttcctgtcaacctgtgagcc

SEQ ID NO: 904822 - DNA, 25 bp, Mus musculus
tgtctttcctgtgaacctgtgagcc

SEQ ID NO: 904823 - DNA, 25 bp, Mus musculus
tgtctttcgggcctggctccacagc

SEQ ID NO: 904824 - DNA, 25 bp, Mus musculus
tgtctttcgggcgtggctccacagc

SEQ ID NO: 904825 - DNA, 25 bp, Mus musculus
tgtctttctccaagtaccagagctt

SEQ ID NO: 904826 - DNA, 25 bp, Mus musculus
tgtctttctccatgtaccagagctt

SEQ ID NO: 904827 - DNA, 25 bp, Mus musculus
tgtctttctcctaactttgcccaga

SEQ ID NO: 904828 - DNA, 25 bp, Mus musculus
tgtctttctccttactttgcccaga

SEQ ID NO: 904829 - DNA, 25 bp, Mus musculus
tgtctttctctccctagctccactc

SEQ ID NO: 904830 - DNA, 25 bp, Mus musculus
tgtctttctctcgctagctccactc

SEQ ID NO: 904831 - DNA, 25 bp, Mus musculus
tgtctttctggaacatgctgtcctg

SEQ ID NO: 904832 - DNA, 25 bp, Mus musculus
tgtctttctggatcatgctgtcctg

SEQ ID NO: 904833 - DNA, 25 bp, Mus musculus
tgtctttctggtaggcagctttata

SEQ ID NO: 904834 - DNA, 25 bp, Mus musculus
tgtctttctggttggcagctttata

SEQ ID NO: 904835 - DNA, 25 bp, Mus musculus
tgtctttctgtcacttactcttttc

SEQ ID NO: 904836 - DNA, 25 bp, Mus musculus
tgtctttctgtctcttactcttttc

SEQ ID NO: 904837 - DNA, 25 bp, Mus musculus
tgtctttctttaaccttcctagttg

SEQ ID NO: 904838 - DNA, 25 bp, Mus musculus
tgtctttctttatccttcctagttg

SEQ ID NO: 904839 - DNA, 25 bp, Mus musculus
tgtctttctttcacgtattcttttt

SEQ ID NO: 904840 - DNA, 25 bp, Mus musculus
tgtctttctttctcgtattcttttt

SEQ ID NO: 904841 - DNA, 25 bp, Mus musculus
tgtctttgaagcctcagaaccctgc

SEQ ID NO: 904842 - DNA, 25 bp, Mus musculus
tgtctttgaagcgtcagaaccctgc

SEQ ID NO: 904843 - DNA, 25 bp, Mus musculus
tgtctttgagacatttcttctgcct

SEQ ID NO: 904844 - DNA, 25 bp, Mus musculus
tgtctttgagacttttcttctgcct

SEQ ID NO: 904845 - DNA, 25 bp, Mus musculus
tgtctttgagatcttgctgtgccag

SEQ ID NO: 904846 - DNA, 25 bp, Mus musculus
tgtctttgagatgttgctgtgccag

SEQ ID NO: 904847 - DNA, 25 bp, Mus musculus
tgtctttgagccagtgccatctgtc

SEQ ID NO: 904848 - DNA, 25 bp, Mus musculus
tgtctttgagcctgtgccatctgtc

SEQ ID NO: 904849 - DNA, 25 bp, Mus musculus
tgtctttgatttcgtggcttccaag

SEQ ID NO: 904850 - DNA, 25 bp, Mus musculus
tgtctttgatttggtggcttccaag

SEQ ID NO: 904851 - DNA, 25 bp, Mus musculus
tgtctttgcggacatctgggttttg

SEQ ID NO: 904852 - DNA, 25 bp, Mus musculus
tgtctttgcggagatctgggttttg

SEQ ID NO: 904853 - DNA, 25 bp, Mus musculus
tgtctttgctcacaggattgctccc

SEQ ID NO: 904854 - DNA, 25 bp, Mus musculus
tgtctttgctcagaggattgctccc

SEQ ID NO: 904855 - DNA, 25 bp, Mus musculus
tgtctttgctgtactcgtgctgaag

SEQ ID NO: 904856 - DNA, 25 bp, Mus musculus
tgtctttgctgttctcgtgctgaag

SEQ ID NO: 904857 - DNA, 25 bp, Mus musculus
tgtctttggcttccacatctactat

SEQ ID NO: 904858 - DNA, 25 bp, Mus musculus
tgtctttggcttgcacatctactat

SEQ ID NO: 904859 - DNA, 25 bp, Mus musculus
tgtctttgggtcactagcaaccttg

SEQ ID NO: 904860 - DNA, 25 bp, Mus musculus
tgtctttgggtctctagcaaccttg

SEQ ID NO: 904861 - DNA, 25 bp, Mus musculus
tgtctttgtaacatccctggctaga

SEQ ID NO: 904862 - DNA, 25 bp, Mus musculus
tgtctttgtaacttccctggctaga

SEQ ID NO: 904863 - DNA, 25 bp, Mus musculus
tgtctttgtagcaatggctgttctg

SEQ ID NO: 904864 - DNA, 25 bp, Mus musculus
tgtctttgtagctatggctgttctg

SEQ ID NO: 904865 - DNA, 25 bp, Mus musculus
tgtcttttaagtcctccatgcctgg

SEQ ID NO: 904866 - DNA, 25 bp, Mus musculus
tgtcttttaagtgctccatgcctgg

SEQ ID NO: 904867 - DNA, 25 bp, Mus musculus
tgtcttttacagacttagctatgag

SEQ ID NO: 904868 - DNA, 25 bp, Mus musculus
tgtcttttacagtcttagctatgag

SEQ ID NO: 904869 - DNA, 25 bp, Mus musculus
tgtcttttatagcagaggccccagc

SEQ ID NO: 904870 - DNA, 25 bp, Mus musculus
tgtcttttataggagaggccccagc

SEQ ID NO: 904871 - DNA, 25 bp, Mus musculus
tgtcttttcaaaatgtctgtcactg

SEQ ID NO: 904872 - DNA, 25 bp, Mus musculus
tgtcttttcaaattgtctgtcactg

SEQ ID NO: 904873 - DNA, 25 bp, Mus musculus
tgtcttttcaagctcatctgctaat

SEQ ID NO: 904874 - DNA, 25 bp, Mus musculus
tgtcttttcaaggtcatctgctaat

SEQ ID NO: 904875 - DNA, 25 bp, Mus musculus
tgtcttttccaaagccttttagtag

SEQ ID NO: 904876 - DNA, 25 bp, Mus musculus
tgtcttttccaatgccttttagtag

SEQ ID NO: 904877 - DNA, 25 bp, Mus musculus
tgtcttttccaccaagtgcctaaag

SEQ ID NO: 904878 - DNA, 25 bp, Mus musculus
tgtcttttccacgaagtgcctaaag

SEQ ID NO: 904879 - DNA, 25 bp, Mus musculus
tgtcttttcggtaggcatgctaatt

SEQ ID NO: 904880 - DNA, 25 bp, Mus musculus
tgtcttttcggttggcatgctaatt

SEQ ID NO: 904881 - DNA, 25 bp, Mus musculus
tgtcttttcgttacccagttgagct

SEQ ID NO: 904882 - DNA, 25 bp, Mus musculus
tgtcttttcgtttcccagttgagct

SEQ ID NO: 904883 - DNA, 25 bp, Mus musculus
tgtcttttcttccaagattcccatg

SEQ ID NO: 904884 - DNA, 25 bp, Mus musculus
tgtcttttcttcgaagattcccatg

SEQ ID NO: 904885 - DNA, 25 bp, Mus musculus
tgtcttttcttgattagataccact

SEQ ID NO: 904886 - DNA, 25 bp, Mus musculus
tgtcttttcttgtttagataccact

SEQ ID NO: 904887 - DNA, 25 bp, Mus musculus
tgtcttttgtctactttcaccatca

SEQ ID NO: 904888 - DNA, 25 bp, Mus musculus
tgtcttttgtcttctttcaccatca

SEQ ID NO: 904889 - DNA, 25 bp, Mus musculus
tgtctttttactctatttttcggat

SEQ ID NO: 904890 - DNA, 25 bp, Mus musculus
tgtctttttactgtatttttcggat

SEQ ID NO: 904891 - DNA, 25 bp, Mus musculus
tgtctttttcttacaggagcctcaa

SEQ ID NO: 904892 - DNA, 25 bp, Mus musculus
tgtctttttctttcaggagcctcaa

SEQ ID NO: 904893 - DNA, 25 bp, Mus musculus
tgtctttttgacatccatatgtgtg

SEQ ID NO: 904894 - DNA, 25 bp, Mus musculus
tgtctttttgacttccatatgtgtg

SEQ ID NO: 904895 - DNA, 25 bp, Mus musculus
tgtcttttttccatcagggacctgg

SEQ ID NO: 904896 - DNA, 25 bp, Mus musculus
tgtcttttttccttcagggacctgg

SEQ ID NO: 904897 - DNA, 25 bp, Mus musculus
tgtcttttttttcatcctctgccca

SEQ ID NO: 904898 - DNA, 25 bp, Mus musculus
tgtcttttttttgatcctctgccca

SEQ ID NO: 904899 - DNA, 25 bp, Mus musculus
tgtgaaaaagccatccagtgtcact

SEQ ID NO: 904900 - DNA, 25 bp, Mus musculus
tgtgaaaaagccttccagtgtcact

SEQ ID NO: 904901 - DNA, 25 bp, Mus musculus
tgtgaaaacatgctctcgcgtctgt

SEQ ID NO: 904902 - DNA, 25 bp, Mus musculus
tgtgaaaacatggtctcgcgtctgt

SEQ ID NO: 904903 - DNA, 25 bp, Mus musculus
tgtgaaaagcccaaattcctgtctt

SEQ ID NO: 904904 - DNA, 25 bp, Mus musculus
tgtgaaaagccctaattcctgtctt

SEQ ID NO: 904905 - DNA, 25 bp, Mus musculus
tgtgaaaataccatggcagttgaag

SEQ ID NO: 904906 - DNA, 25 bp, Mus musculus
tgtgaaaataccttggcagttgaag

SEQ ID NO: 904907 - DNA, 25 bp, Mus musculus
tgtgaaaatggtctctctctagccc

SEQ ID NO: 904908 - DNA, 25 bp, Mus musculus
tgtgaaaatggtgtctctctagccc

SEQ ID NO: 904909 - DNA, 25 bp, Mus musculus
tgtgaaacaagcatttaaccctgaa

SEQ ID NO: 904910 - DNA, 25 bp, Mus musculus
tgtgaaacaagcttttaaccctgaa

SEQ ID NO: 904911 - DNA, 25 bp, Mus musculus
tgtgaaacacgtacttcctgggaaa

SEQ ID NO: 904912 - DNA, 25 bp, Mus musculus
tgtgaaacacgttcttcctgggaaa

SEQ ID NO: 904913 - DNA, 25 bp, Mus musculus
tgtgaaacagctataagacaggacc

SEQ ID NO: 904914 - DNA, 25 bp, Mus musculus
tgtgaaacagctttaagacaggacc

SEQ ID NO: 904915 - DNA, 25 bp, Mus musculus
tgtgaaacaggcaaccagtcctctg

SEQ ID NO: 904916 - DNA, 25 bp, Mus musculus
tgtgaaacaggcaggttctcctagc

SEQ ID NO: 904917 - DNA, 25 bp, Mus musculus
tgtgaaacaggctaccagtcctctg

SEQ ID NO: 904918 - DNA, 25 bp, Mus musculus
tgtgaaacaggctggttctcctagc

SEQ ID NO: 904919 - DNA, 25 bp, Mus musculus
tgtgaaacatgccacgtcctgcagg

SEQ ID NO: 904920 - DNA, 25 bp, Mus musculus
tgtgaaacatgcgacgtcctgcagg

SEQ ID NO: 904921 - DNA, 25 bp, Mus musculus
tgtgaaaccactcggttctgggtcc

SEQ ID NO: 904922 - DNA, 25 bp, Mus musculus
tgtgaaaccactgggttctgggtcc

SEQ ID NO: 904923 - DNA, 25 bp, Mus musculus
tgtgaaaccccaacttctggacaag

SEQ ID NO: 904924 - DNA, 25 bp, Mus musculus
tgtgaaaccccatcttctggacaag

SEQ ID NO: 904925 - DNA, 25 bp, Mus musculus
tgtgaaacgacactttttgctctcc

SEQ ID NO: 904926 - DNA, 25 bp, Mus musculus
tgtgaaacgacagtttttgctctcc

SEQ ID NO: 904927 - DNA, 25 bp, Mus musculus
tgtgaaactgacagcggtcctggtc

SEQ ID NO: 904928 - DNA, 25 bp, Mus musculus
tgtgaaactgactgcggtcctggtc

SEQ ID NO: 904929 - DNA, 25 bp, Mus musculus
tgtgaaactttgatcagccgagtct

SEQ ID NO: 904930 - DNA, 25 bp, Mus musculus
tgtgaaactttgttcagccgagtct

SEQ ID NO: 904931 - DNA, 25 bp, Mus musculus
tgtgaaagaattcatccttcccctg

SEQ ID NO: 904932 - DNA, 25 bp, Mus musculus
tgtgaaagaattgatccttcccctg

SEQ ID NO: 904933 - DNA, 25 bp, Mus musculus
tgtgaaagagctacactcaccccag

SEQ ID NO: 904934 - DNA, 25 bp, Mus musculus
tgtgaaagagcttcactcaccccag

SEQ ID NO: 904935 - DNA, 25 bp, Mus musculus
tgtgaaagcaccattccaccttttc

SEQ ID NO: 904936 - DNA, 25 bp, Mus musculus
tgtgaaagcacctttccaccttttc

SEQ ID NO: 904937 - DNA, 25 bp, Mus musculus
tgtgaaagccaaagagatccctcct

SEQ ID NO: 904938 - DNA, 25 bp, Mus musculus
tgtgaaagccaatgagatccctcct

SEQ ID NO: 904939 - DNA, 25 bp, Mus musculus
tgtgaaagccagaatccagaaaatc

SEQ ID NO: 904940 - DNA, 25 bp, Mus musculus
tgtgaaagccagtatccagaaaatc

SEQ ID NO: 904941 - DNA, 25 bp, Mus musculus
tgtgaaagcgtgaccactcgcgccg

SEQ ID NO: 904942 - DNA, 25 bp, Mus musculus
tgtgaaagcgtgtccactcgcgccg

SEQ ID NO: 904943 - DNA, 25 bp, Mus musculus
tgtgaaaggtcgcacttggctccct

SEQ ID NO: 904944 - DNA, 25 bp, Mus musculus
tgtgaaaggtcggacttggctccct

SEQ ID NO: 904945 - DNA, 25 bp, Mus musculus
tgtgaaagtctcaacatgtttgttt

SEQ ID NO: 904946 - DNA, 25 bp, Mus musculus
tgtgaaagtctctacatgtttgttt

SEQ ID NO: 904947 - DNA, 25 bp, Mus musculus
tgtgaaagttagctcagctcattct

SEQ ID NO: 904948 - DNA, 25 bp, Mus musculus
tgtgaaagttaggtcagctcattct

SEQ ID NO: 904949 - DNA, 25 bp, Mus musculus
tgtgaaatacagatcagggcctggg

SEQ ID NO: 904950 - DNA, 25 bp, Mus musculus
tgtgaaatacagttcagggcctggg

SEQ ID NO: 904951 - DNA, 25 bp, Mus musculus
tgtgaaatacatccctcaaaatagc

SEQ ID NO: 904952 - DNA, 25 bp, Mus musculus
tgtgaaatacatgcctcaaaatagc

SEQ ID NO: 904953 - DNA, 25 bp, Mus musculus
tgtgaaatatcaaactgcttggcag

SEQ ID NO: 904954 - DNA, 25 bp, Mus musculus
tgtgaaatatcatactgcttggcag

SEQ ID NO: 904955 - DNA, 25 bp, Mus musculus
tgtgaaatattgcaactgtttctct

SEQ ID NO: 904956 - DNA, 25 bp, Mus musculus
tgtgaaatattggaactgtttctct

SEQ ID NO: 904957 - DNA, 25 bp, Mus musculus
tgtgaaatcctcctccgtccaacat

SEQ ID NO: 904958 - DNA, 25 bp, Mus musculus
tgtgaaatcctcctttgtccaacat

SEQ ID NO: 904959 - DNA, 25 bp, Mus musculus
tgtgaaatcctcgtccgtccaacat

SEQ ID NO: 904960 - DNA, 25 bp, Mus musculus
tgtgaaatcctcgtttgtccaacat

SEQ ID NO: 904961 - DNA, 25 bp, Mus musculus
tgtgaaatctacctcagagtcctcc

SEQ ID NO: 904962 - DNA, 25 bp, Mus musculus
tgtgaaatctacgtcagagtcctcc

SEQ ID NO: 904963 - DNA, 25 bp, Mus musculus
tgtgaaatgccaagacaagtctctg

SEQ ID NO: 904964 - DNA, 25 bp, Mus musculus
tgtgaaatgccatgacaagtctctg

SEQ ID NO: 904965 - DNA, 25 bp, Mus musculus
tgtgaaatgcctactgccagcagtt

SEQ ID NO: 904966 - DNA, 25 bp, Mus musculus
tgtgaaatgccttctgccagcagtt

SEQ ID NO: 904967 - DNA, 25 bp, Mus musculus
tgtgaaatggccaacccctttggga

SEQ ID NO: 904968 - DNA, 25 bp, Mus musculus
tgtgaaatggcctacccctttggga

SEQ ID NO: 904969 - DNA, 25 bp, Mus musculus
tgtgaaatggtcctgtttttgggta

SEQ ID NO: 904970 - DNA, 25 bp, Mus musculus
tgtgaaatggtcgtgtttttgggta

SEQ ID NO: 904971 - DNA, 25 bp, Mus musculus
tgtgaaatgttaaaggctggcccta

SEQ ID NO: 904972 - DNA, 25 bp, Mus musculus
tgtgaaatgttataggctggcccta

SEQ ID NO: 904973 - DNA, 25 bp, Mus musculus
tgtgaaattgctatcccatctgctt

SEQ ID NO: 904974 - DNA, 25 bp, Mus musculus
tgtgaaattgctttcccatctgctt

SEQ ID NO: 904975 - DNA, 25 bp, Mus musculus
tgtgaaatttatcctgtccctgctt

SEQ ID NO: 904976 - DNA, 25 bp, Mus musculus
tgtgaaatttatgctgtccctgctt

SEQ ID NO: 904977 - DNA, 25 bp, Mus musculus
tgtgaaatttccagtatagcctttg

SEQ ID NO: 904978 - DNA, 25 bp, Mus musculus
tgtgaaatttcctgtatagcctttg

SEQ ID NO: 904979 - DNA, 25 bp, Mus musculus
tgtgaacaacttacaagccaccgga

SEQ ID NO: 904980 - DNA, 25 bp, Mus musculus
tgtgaacaactttcaagccaccgga

SEQ ID NO: 904981 - DNA, 25 bp, Mus musculus
tgtgaacaagtcctacctggtctac

SEQ ID NO: 904982 - DNA, 25 bp, Mus musculus
tgtgaacaagtcgtacctggtctac

SEQ ID NO: 904983 - DNA, 25 bp, Mus musculus
tgtgaacacctaaatttgttacaaa

SEQ ID NO: 904984 - DNA, 25 bp, Mus musculus
tgtgaacacctatatttgttacaaa

SEQ ID NO: 904985 - DNA, 25 bp, Mus musculus
tgtgaacacgctatcattactcctt

SEQ ID NO: 904986 - DNA, 25 bp, Mus musculus
tgtgaacacgctttcattactcctt

SEQ ID NO: 904987 - DNA, 25 bp, Mus musculus
tgtgaacagaaaatttaccccctgc

SEQ ID NO: 904988 - DNA, 25 bp, Mus musculus
tgtgaacagaaattttaccccctgc

SEQ ID NO: 904989 - DNA, 25 bp, Mus musculus
tgtgaacagaagactgtgttcctgt

SEQ ID NO: 904990 - DNA, 25 bp, Mus musculus
tgtgaacagaagtctgtgttcctgt

SEQ ID NO: 904991 - DNA, 25 bp, Mus musculus
tgtgaacagcatccaccacgcgttc

SEQ ID NO: 904992 - DNA, 25 bp, Mus musculus
tgtgaacagcatgcaccacgcgttc

SEQ ID NO: 904993 - DNA, 25 bp, Mus musculus
tgtgaacagcggcatgtgcatgcat

SEQ ID NO: 904994 - DNA, 25 bp, Mus musculus
tgtgaacagcgggatgtgcatgcat

SEQ ID NO: 904995 - DNA, 25 bp, Mus musculus
tgtgaacagtagaggtgaggcctat

SEQ ID NO: 904996 - DNA, 25 bp, Mus musculus
tgtgaacagtagtggtgaggcctat

SEQ ID NO: 904997 - DNA, 25 bp, Mus musculus
tgtgaacatgtcatccctttccaga

SEQ ID NO: 904998 - DNA, 25 bp, Mus musculus
tgtgaacatgtcttccctttccaga

SEQ ID NO: 904999 - DNA, 25 bp, Mus musculus
tgtgaaccaacacctgtgcggctca

SEQ ID NO: 905000 - DNA, 25 bp, Mus musculus
tgtgaaccaacactgacttctgagt

SEQ ID NO: 905001 - DNA, 25 bp, Mus musculus
tgtgaaccaacagctgtgcggctca

SEQ ID NO: 905002 - DNA, 25 bp, Mus musculus
tgtgaaccaacagtgacttctgagt

SEQ ID NO: 905003 - DNA, 25 bp, Mus musculus
tgtgaaccaattacgctatcagtgt

SEQ ID NO: 905004 - DNA, 25 bp, Mus musculus
tgtgaaccaatttcgctatcagtgt

SEQ ID NO: 905005 - DNA, 25 bp, Mus musculus
tgtgaaccagctattccggtgtcat

SEQ ID NO: 905006 - DNA, 25 bp, Mus musculus
tgtgaaccagcttttccggtgtcat

SEQ ID NO: 905007 - DNA, 25 bp, Mus musculus
tgtgaaccatcacctcttaacctac

SEQ ID NO: 905008 - DNA, 25 bp, Mus musculus
tgtgaaccatcagctcttaacctac

SEQ ID NO: 905009 - DNA, 25 bp, Mus musculus
tgtgaacccaaacctgttttaaata

SEQ ID NO: 905010 - DNA, 25 bp, Mus musculus
tgtgaacccaaagctgttttaaata

SEQ ID NO: 905011 - DNA, 25 bp, Mus musculus
tgtgaacccaaccttttattttcag

SEQ ID NO: 905012 - DNA, 25 bp, Mus musculus
tgtgaacccaacgttttattttcag

SEQ ID NO: 905013 - DNA, 25 bp, Mus musculus
tgtgaaccccagagctcttattata

SEQ ID NO: 905014 - DNA, 25 bp, Mus musculus
tgtgaaccccagtgctcttattata

SEQ ID NO: 905015 - DNA, 25 bp, Mus musculus
tgtgaacccgaaaagcttctctatg

SEQ ID NO: 905016 - DNA, 25 bp, Mus musculus
tgtgaacccgaatagcttctctatg

SEQ ID NO: 905017 - DNA, 25 bp, Mus musculus
tgtgaacccggacagctctcaggaa

SEQ ID NO: 905018 - DNA, 25 bp, Mus musculus
tgtgaacccggagagctctcaggaa

SEQ ID NO: 905019 - DNA, 25 bp, Mus musculus
tgtgaacccggcctagggtgtcaaa

SEQ ID NO: 905020 - DNA, 25 bp, Mus musculus
tgtgaacccggcgtagggtgtcaaa

SEQ ID NO: 905021 - DNA, 25 bp, Mus musculus
tgtgaacccgtgaacattagaccct

SEQ ID NO: 905022 - DNA, 25 bp, Mus musculus
tgtgaacccgtgtacattagaccct

SEQ ID NO: 905023 - DNA, 25 bp, Mus musculus
tgtgaaccggaaagccctagcctat

SEQ ID NO: 905024 - DNA, 25 bp, Mus musculus
tgtgaaccggaatgccctagcctat

SEQ ID NO: 905025 - DNA, 25 bp, Mus musculus
tgtgaaccgtgcagcctccaggcaa

SEQ ID NO: 905026 - DNA, 25 bp, Mus musculus
tgtgaaccgtgctgcctccaggcaa

SEQ ID NO: 905027 - DNA, 25 bp, Mus musculus
tgtgaacctatgcacactccatgta

SEQ ID NO: 905028 - DNA, 25 bp, Mus musculus
tgtgaacctatggacactccatgta

SEQ ID NO: 905029 - DNA, 25 bp, Mus musculus
tgtgaacctctcaccttggtggctt

SEQ ID NO: 905030 - DNA, 25 bp, Mus musculus
tgtgaacctctctccttggtggctt

SEQ ID NO: 905031 - DNA, 25 bp, Mus musculus
tgtgaacctctgatgaccctaaagt

SEQ ID NO: 905032 - DNA, 25 bp, Mus musculus
tgtgaacctctgttgaccctaaagt

SEQ ID NO: 905033 - DNA, 25 bp, Mus musculus
tgtgaacctgtgatgggaaccccgc

SEQ ID NO: 905034 - DNA, 25 bp, Mus musculus
tgtgaacctgtgttgggaaccccgc

SEQ ID NO: 905035 - DNA, 25 bp, Mus musculus
tgtgaaccttaaattcgtttgcttt

SEQ ID NO: 905036 - DNA, 25 bp, Mus musculus
tgtgaaccttaatttcgtttgcttt

SEQ ID NO: 905037 - DNA, 25 bp, Mus musculus
tgtgaacggcacattgtggctttgg

SEQ ID NO: 905038 - DNA, 25 bp, Mus musculus
tgtgaacggcactttgtggctttgg

SEQ ID NO: 905039 - DNA, 25 bp, Mus musculus
tgtgaacgtgtgatggctagctgta

SEQ ID NO: 905040 - DNA, 25 bp, Mus musculus
tgtgaacgtgtgttggctagctgta

SEQ ID NO: 905041 - DNA, 25 bp, Mus musculus
tgtgaactaattagggctcagccct

SEQ ID NO: 905042 - DNA, 25 bp, Mus musculus
tgtgaactaatttgggctcagccct

SEQ ID NO: 905043 - DNA, 25 bp, Mus musculus
tgtgaactatttagcggcagcccgt

SEQ ID NO: 905044 - DNA, 25 bp, Mus musculus
tgtgaactattttgcggcagcccgt

SEQ ID NO: 905045 - DNA, 25 bp, Mus musculus
tgtgaactcacaatggatatccagg

SEQ ID NO: 905046 - DNA, 25 bp, Mus musculus
tgtgaactcacattggatatccagg

SEQ ID NO: 905047 - DNA, 25 bp, Mus musculus
tgtgaactcatcataacttcctgtt

SEQ ID NO: 905048 - DNA, 25 bp, Mus musculus
tgtgaactcatcttaacttcctgtt

SEQ ID NO: 905049 - DNA, 25 bp, Mus musculus
tgtgaactcgcccaactgaacccaa

SEQ ID NO: 905050 - DNA, 25 bp, Mus musculus
tgtgaactcgccgaactgaacccaa

SEQ ID NO: 905051 - DNA, 25 bp, Mus musculus
tgtgaactctccaagcattcacttc

SEQ ID NO: 905052 - DNA, 25 bp, Mus musculus
tgtgaactctcctagcattcacttc

SEQ ID NO: 905053 - DNA, 25 bp, Mus musculus
tgtgaactctcgcaataacaaacta

SEQ ID NO: 905054 - DNA, 25 bp, Mus musculus
tgtgaactctcggaataacaaacta

SEQ ID NO: 905055 - DNA, 25 bp, Mus musculus
tgtgaactctggctgacagtgtcat

SEQ ID NO: 905056 - DNA, 25 bp, Mus musculus
tgtgaactctgggtgacagtgtcat

SEQ ID NO: 905057 - DNA, 25 bp, Mus musculus
tgtgaacttacaaacccagcggctg

SEQ ID NO: 905058 - DNA, 25 bp, Mus musculus
tgtgaacttacatacccagcggctg

SEQ ID NO: 905059 - DNA, 25 bp, Mus musculus
tgtgaacttctgagtttctaaagta

SEQ ID NO: 905060 - DNA, 25 bp, Mus musculus
tgtgaacttctgtgtttctaaagta

SEQ ID NO: 905061 - DNA, 25 bp, Mus musculus
tgtgaacttgaaactatgctgaata

SEQ ID NO: 905062 - DNA, 25 bp, Mus musculus
tgtgaacttgaatctatgctgaata

SEQ ID NO: 905063 - DNA, 25 bp, Mus musculus
tgtgaacttgctataatcctgcctc

SEQ ID NO: 905064 - DNA, 25 bp, Mus musculus
tgtgaacttgctttaatcctgcctc

SEQ ID NO: 905065 - DNA, 25 bp, Mus musculus
tgtgaacttggcagtaatctggtat

SEQ ID NO: 905066 - DNA, 25 bp, Mus musculus
tgtgaacttggctgtaatctggtat

SEQ ID NO: 905067 - DNA, 25 bp, Mus musculus
tgtgaacttgtcaatctacagaacc

SEQ ID NO: 905068 - DNA, 25 bp, Mus musculus
tgtgaacttgtctatctacagaacc

SEQ ID NO: 905069 - DNA, 25 bp, Mus musculus
tgtgaagaagacacccataccgcag

SEQ ID NO: 905070 - DNA, 25 bp, Mus musculus
tgtgaagaagactcccataccgcag

SEQ ID NO: 905071 - DNA, 25 bp, Mus musculus
tgtgaagacaacacgtcgcgtttac

SEQ ID NO: 905072 - DNA, 25 bp, Mus musculus
tgtgaagacaactcgtcgcgtttac

SEQ ID NO: 905073 - DNA, 25 bp, Mus musculus
tgtgaagacatcacttcccctcgga

SEQ ID NO: 905074 - DNA, 25 bp, Mus musculus
tgtgaagacatctcttcccctcgga

SEQ ID NO: 905075 - DNA, 25 bp, Mus musculus
tgtgaagaccaacatttttgtgttc

SEQ ID NO: 905076 - DNA, 25 bp, Mus musculus
tgtgaagaccaagatttttgtgttc

SEQ ID NO: 905077 - DNA, 25 bp, Mus musculus
tgtgaagaccatctcctctgggatc

SEQ ID NO: 905078 - DNA, 25 bp, Mus musculus
tgtgaagaccatgtcctctgggatc

SEQ ID NO: 905079 - DNA, 25 bp, Mus musculus
tgtgaagaccctcaaacccaaaaga

SEQ ID NO: 905080 - DNA, 25 bp, Mus musculus
tgtgaagaccctgaaacccaaaaga

SEQ ID NO: 905081 - DNA, 25 bp, Mus musculus
tgtgaagaccgacaaccatcctgcc

SEQ ID NO: 905082 - DNA, 25 bp, Mus musculus
tgtgaagaccgagaaccatcctgcc

SEQ ID NO: 905083 - DNA, 25 bp, Mus musculus
tgtgaagagcacaaggccctttgtt

SEQ ID NO: 905084 - DNA, 25 bp, Mus musculus
tgtgaagagcactaggccctttgtt

SEQ ID NO: 905085 - DNA, 25 bp, Mus musculus
tgtgaagaggctcctggattacctg

SEQ ID NO: 905086 - DNA, 25 bp, Mus musculus
tgtgaagaggctgctggattacctg

SEQ ID NO: 905087 - DNA, 25 bp, Mus musculus
tgtgaagagggtcagtgccctttat

SEQ ID NO: 905088 - DNA, 25 bp, Mus musculus
tgtgaagagggtgagtgccctttat

SEQ ID NO: 905089 - DNA, 25 bp, Mus musculus
tgtgaagatcgcatactctcagtat

SEQ ID NO: 905090 - DNA, 25 bp, Mus musculus
tgtgaagatcgcttactctcagtat

SEQ ID NO: 905091 - DNA, 25 bp, Mus musculus
tgtgaagatcttagtcactctgttt

SEQ ID NO: 905092 - DNA, 25 bp, Mus musculus
tgtgaagatctttgtcactctgttt

SEQ ID NO: 905093 - DNA, 25 bp, Mus musculus
tgtgaagatgcccactctctgaact

SEQ ID NO: 905094 - DNA, 25 bp, Mus musculus
tgtgaagatgccgactctctgaact

SEQ ID NO: 905095 - DNA, 25 bp, Mus musculus
tgtgaagatgcgatgtagtttaccc

SEQ ID NO: 905096 - DNA, 25 bp, Mus musculus
tgtgaagatgcgttgtagtttaccc

SEQ ID NO: 905097 - DNA, 25 bp, Mus musculus
tgtgaagatttcactatgtgaacta

SEQ ID NO: 905098 - DNA, 25 bp, Mus musculus
tgtgaagatttctctatgtgaacta

SEQ ID NO: 905099 - DNA, 25 bp, Mus musculus
tgtgaagcaaacagaaactgccgca

SEQ ID NO: 905100 - DNA, 25 bp, Mus musculus
tgtgaagcaaactgaaactgccgca

SEQ ID NO: 905101 - DNA, 25 bp, Mus musculus
tgtgaagcagctattgactttgaaa

SEQ ID NO: 905102 - DNA, 25 bp, Mus musculus
tgtgaagcagcttttgactttgaaa

SEQ ID NO: 905103 - DNA, 25 bp, Mus musculus
tgtgaagcatatcatggcgagctga

SEQ ID NO: 905104 - DNA, 25 bp, Mus musculus
tgtgaagcatatgatggcgagctga

SEQ ID NO: 905105 - DNA, 25 bp, Mus musculus
tgtgaagccacacatgtgtgcactt

SEQ ID NO: 905106 - DNA, 25 bp, Mus musculus
tgtgaagccacagatgtgtgcactt

SEQ ID NO: 905107 - DNA, 25 bp, Mus musculus
tgtgaagccctgctgtctgtacagg

SEQ ID NO: 905108 - DNA, 25 bp, Mus musculus
tgtgaagccctggtgtctgtacagg

SEQ ID NO: 905109 - DNA, 25 bp, Mus musculus
tgtgaagccgcaacctctgcgcttt

SEQ ID NO: 905110 - DNA, 25 bp, Mus musculus
tgtgaagccgcatcctctgcgcttt

SEQ ID NO: 905111 - DNA, 25 bp, Mus musculus
tgtgaagccggaccctacctgagag

SEQ ID NO: 905112 - DNA, 25 bp, Mus musculus
tgtgaagccggagcctacctgagag

SEQ ID NO: 905113 - DNA, 25 bp, Mus musculus
tgtgaagcctgcacccattgaccag

SEQ ID NO: 905114 - DNA, 25 bp, Mus musculus
tgtgaagcctgctcccattgaccag

SEQ ID NO: 905115 - DNA, 25 bp, Mus musculus
tgtgaagctgctactttcttacttg

SEQ ID NO: 905116 - DNA, 25 bp, Mus musculus
tgtgaagctgctccccgaagtttcc

SEQ ID NO: 905117 - DNA, 25 bp, Mus musculus
tgtgaagctgctgcccgaagtttcc

SEQ ID NO: 905118 - DNA, 25 bp, Mus musculus
tgtgaagctgcttctttcttacttg

SEQ ID NO: 905119 - DNA, 25 bp, Mus musculus
tgtgaagctgttaccctctcagaca

SEQ ID NO: 905120 - DNA, 25 bp, Mus musculus
tgtgaagctgtttccctctcagaca

SEQ ID NO: 905121 - DNA, 25 bp, Mus musculus
tgtgaagcttcaactatgaccaaga

SEQ ID NO: 905122 - DNA, 25 bp, Mus musculus
tgtgaagcttcatctatgaccaaga

SEQ ID NO: 905123 - DNA, 25 bp, Mus musculus
tgtgaaggaagtaccctcggtcctt

SEQ ID NO: 905124 - DNA, 25 bp, Mus musculus
tgtgaaggaagttccctcggtcctt

SEQ ID NO: 905125 - DNA, 25 bp, Mus musculus
tgtgaaggacttatagccctcggga

SEQ ID NO: 905126 - DNA, 25 bp, Mus musculus
tgtgaaggacttttagccctcggga

SEQ ID NO: 905127 - DNA, 25 bp, Mus musculus
tgtgaaggccttcttaacccagtgc

SEQ ID NO: 905128 - DNA, 25 bp, Mus musculus
tgtgaaggccttgttaacccagtgc

SEQ ID NO: 905129 - DNA, 25 bp, Mus musculus
tgtgaaggcgagatccatgaaggac

SEQ ID NO: 905130 - DNA, 25 bp, Mus musculus
tgtgaaggcgagttccatgaaggac

SEQ ID NO: 905131 - DNA, 25 bp, Mus musculus
tgtgaagggatgagctgcacctcca

SEQ ID NO: 905132 - DNA, 25 bp, Mus musculus
tgtgaagggatgtgctgcacctcca

SEQ ID NO: 905133 - DNA, 25 bp, Mus musculus
tgtgaaggtcacagaactctcggcc

SEQ ID NO: 905134 - DNA, 25 bp, Mus musculus
tgtgaaggtcactgaactctcggcc

SEQ ID NO: 905135 - DNA, 25 bp, Mus musculus
tgtgaaggtctacttcaggctccct

SEQ ID NO: 905136 - DNA, 25 bp, Mus musculus
tgtgaaggtctagttcaggctccct

SEQ ID NO: 905137 - DNA, 25 bp, Mus musculus
tgtgaagtacacagtaggtgcacaa

SEQ ID NO: 905138 - DNA, 25 bp, Mus musculus
tgtgaagtacactgtaggtgcacaa

SEQ ID NO: 905139 - DNA, 25 bp, Mus musculus
tgtgaagtacggagccaggctctca

SEQ ID NO: 905140 - DNA, 25 bp, Mus musculus
tgtgaagtacggtgccaggctctca

SEQ ID NO: 905141 - DNA, 25 bp, Mus musculus
tgtgaagtcagacgtgcccttcctg

SEQ ID NO: 905142 - DNA, 25 bp, Mus musculus
tgtgaagtcagaggtgcccttcctg

SEQ ID NO: 905143 - DNA, 25 bp, Mus musculus
tgtgaagtcagtcacggcaccatac

SEQ ID NO: 905144 - DNA, 25 bp, Mus musculus
tgtgaagtcagtgacggcaccatac

SEQ ID NO: 905145 - DNA, 25 bp, Mus musculus
tgtgaagtccatccaggtcactcta

SEQ ID NO: 905146 - DNA, 25 bp, Mus musculus
tgtgaagtccatgcaggtcactcta

SEQ ID NO: 905147 - DNA, 25 bp, Mus musculus
tgtgaagtctaaaactggcccaggg

SEQ ID NO: 905148 - DNA, 25 bp, Mus musculus
tgtgaagtctaatactggcccaggg

SEQ ID NO: 905149 - DNA, 25 bp, Mus musculus
tgtgaagtgctgaactgtctgcccg

SEQ ID NO: 905150 - DNA, 25 bp, Mus musculus
tgtgaagtgctgtactgtctgcccg

SEQ ID NO: 905151 - DNA, 25 bp, Mus musculus
tgtgaagttccgagcctccccttga

SEQ ID NO: 905152 - DNA, 25 bp, Mus musculus
tgtgaagttccgtgcctccccttga

SEQ ID NO: 905153 - DNA, 25 bp, Mus musculus
tgtgaagttcctacctgatgaccca

SEQ ID NO: 905154 - DNA, 25 bp, Mus musculus
tgtgaagttccttcctgatgaccca

SEQ ID NO: 905155 - DNA, 25 bp, Mus musculus
tgtgaagttctaaaaggttctagtt

SEQ ID NO: 905156 - DNA, 25 bp, Mus musculus
tgtgaagttctataaggttctagtt

SEQ ID NO: 905157 - DNA, 25 bp, Mus musculus
tgtgaagttcttcccctatggagat

SEQ ID NO: 905158 - DNA, 25 bp, Mus musculus
tgtgaagttcttgccctatggagat

SEQ ID NO: 905159 - DNA, 25 bp, Mus musculus
tgtgaagtttatccctagtcacctt

SEQ ID NO: 905160 - DNA, 25 bp, Mus musculus
tgtgaagtttatgcctagtcacctt

SEQ ID NO: 905161 - DNA, 25 bp, Mus musculus
tgtgaatactttagctcaggccggt

SEQ ID NO: 905162 - DNA, 25 bp, Mus musculus
tgtgaatacttttgctcaggccggt

SEQ ID NO: 905163 - DNA, 25 bp, Mus musculus
tgtgaatagactagctaggccaggc

SEQ ID NO: 905164 - DNA, 25 bp, Mus musculus
tgtgaatagacttgctaggccaggc

SEQ ID NO: 905165 - DNA, 25 bp, Mus musculus
tgtgaataggtcagagcttgcgctc

SEQ ID NO: 905166 - DNA, 25 bp, Mus musculus
tgtgaataggtctgagcttgcgctc

SEQ ID NO: 905167 - DNA, 25 bp, Mus musculus
tgtgaatatgcaatgggagtcccgg

SEQ ID NO: 905168 - DNA, 25 bp, Mus musculus
tgtgaatatgcattgggagtcccgg

SEQ ID NO: 905169 - DNA, 25 bp, Mus musculus
tgtgaatatgtaactgcctctccaa

SEQ ID NO: 905170 - DNA, 25 bp, Mus musculus
tgtgaatatgtatctgcctctccaa

SEQ ID NO: 905171 - DNA, 25 bp, Mus musculus
tgtgaatcagtgctcgtgaatgact

SEQ ID NO: 905172 - DNA, 25 bp, Mus musculus
tgtgaatcagtggtcgtgaatgact

SEQ ID NO: 905173 - DNA, 25 bp, Mus musculus
tgtgaatcagttagcaccgacccat

SEQ ID NO: 905174 - DNA, 25 bp, Mus musculus
tgtgaatcagtttgcaccgacccat

SEQ ID NO: 905175 - DNA, 25 bp, Mus musculus
tgtgaatccattacctcaagctcta

SEQ ID NO: 905176 - DNA, 25 bp, Mus musculus
tgtgaatccatttcctcaagctcta

SEQ ID NO: 905177 - DNA, 25 bp, Mus musculus
tgtgaatcccctacaaaacaccagg

SEQ ID NO: 905178 - DNA, 25 bp, Mus musculus
tgtgaatccccttcaaaacaccagg

SEQ ID NO: 905179 - DNA, 25 bp, Mus musculus
tgtgaatccggaacacgtggaacac

SEQ ID NO: 905180 - DNA, 25 bp, Mus musculus
tgtgaatccggatcacgtggaacac

SEQ ID NO: 905181 - DNA, 25 bp, Mus musculus
tgtgaatcctccctacccacgctcc

SEQ ID NO: 905182 - DNA, 25 bp, Mus musculus
tgtgaatcctccgtacccacgctcc

SEQ ID NO: 905183 - DNA, 25 bp, Mus musculus
tgtgaatccttgcagctggtagact

SEQ ID NO: 905184 - DNA, 25 bp, Mus musculus
tgtgaatccttggagctggtagact

SEQ ID NO: 905185 - DNA, 25 bp, Mus musculus
tgtgaatctaggctgcttatggccc

SEQ ID NO: 905186 - DNA, 25 bp, Mus musculus
tgtgaatctagggtgcttatggccc

SEQ ID NO: 905187 - DNA, 25 bp, Mus musculus
tgtgaatctctgacgggaaagcatc

SEQ ID NO: 905188 - DNA, 25 bp, Mus musculus
tgtgaatctctgtcgggaaagcatc

SEQ ID NO: 905189 - DNA, 25 bp, Mus musculus
tgtgaatctgctcttggctggcttt

SEQ ID NO: 905190 - DNA, 25 bp, Mus musculus
tgtgaatctgctgttggctggcttt

SEQ ID NO: 905191 - DNA, 25 bp, Mus musculus
tgtgaatctgtacagcattttccct

SEQ ID NO: 905192 - DNA, 25 bp, Mus musculus
tgtgaatctgtagagcattttccct

SEQ ID NO: 905193 - DNA, 25 bp, Mus musculus
tgtgaatcttgacatcgccacctca

SEQ ID NO: 905194 - DNA, 25 bp, Mus musculus
tgtgaatcttgagatcgccacctca

SEQ ID NO: 905195 - DNA, 25 bp, Mus musculus
tgtgaatgatgaccccaggcactgc

SEQ ID NO: 905196 - DNA, 25 bp, Mus musculus
tgtgaatgatgagcccaggcactgc

SEQ ID NO: 905197 - DNA, 25 bp, Mus musculus
tgtgaatgcaaacctctgccaggct

SEQ ID NO: 905198 - DNA, 25 bp, Mus musculus
tgtgaatgcaaagctctgccaggct

SEQ ID NO: 905199 - DNA, 25 bp, Mus musculus
tgtgaatgccaccttgactcctctc

SEQ ID NO: 905200 - DNA, 25 bp, Mus musculus
tgtgaatgccacgttgactcctctc

SEQ ID NO: 905201 - DNA, 25 bp, Mus musculus
tgtgaatgccagctgaggaaaccct

SEQ ID NO: 905202 - DNA, 25 bp, Mus musculus
tgtgaatgccaggtgaggaaaccct

SEQ ID NO: 905203 - DNA, 25 bp, Mus musculus
tgtgaatgcgctagtctgacccttg

SEQ ID NO: 905204 - DNA, 25 bp, Mus musculus
tgtgaatgcgcttgtctgacccttg

SEQ ID NO: 905205 - DNA, 25 bp, Mus musculus
tgtgaatgctgcagagaacgtcccc

SEQ ID NO: 905206 - DNA, 25 bp, Mus musculus
tgtgaatgctgctgagaacgtcccc

SEQ ID NO: 905207 - DNA, 25 bp, Mus musculus
tgtgaatgggacctcacacagcctg

SEQ ID NO: 905208 - DNA, 25 bp, Mus musculus
tgtgaatgggacgtcacacagcctg

SEQ ID NO: 905209 - DNA, 25 bp, Mus musculus
tgtgaatgggagactctgtcagcct

SEQ ID NO: 905210 - DNA, 25 bp, Mus musculus
tgtgaatgggagtctctgtcagcct

SEQ ID NO: 905211 - DNA, 25 bp, Mus musculus
tgtgaatgtaacatgcctgtgccgt

SEQ ID NO: 905212 - DNA, 25 bp, Mus musculus
tgtgaatgtaacttgcctgtgccgt

SEQ ID NO: 905213 - DNA, 25 bp, Mus musculus
tgtgaatgtataatcgccctgcttt

SEQ ID NO: 905214 - DNA, 25 bp, Mus musculus
tgtgaatgtatattcgccctgcttt

SEQ ID NO: 905215 - DNA, 25 bp, Mus musculus
tgtgaatgtgctcgagccctgtgat

SEQ ID NO: 905216 - DNA, 25 bp, Mus musculus
tgtgaatgtgctggagccctgtgat

SEQ ID NO: 905217 - DNA, 25 bp, Mus musculus
tgtgaatgtggacccagtgtcccca

SEQ ID NO: 905218 - DNA, 25 bp, Mus musculus
tgtgaatgtggagccagtgtcccca

SEQ ID NO: 905219 - DNA, 25 bp, Mus musculus
tgtgaattcccaccatgtcccagaa

SEQ ID NO: 905220 - DNA, 25 bp, Mus musculus
tgtgaattcccagcatgtcccagaa

SEQ ID NO: 905221 - DNA, 25 bp, Mus musculus
tgtgaattgcccacaagggtccata

SEQ ID NO: 905222 - DNA, 25 bp, Mus musculus
tgtgaattgccctcaagggtccata

SEQ ID NO: 905223 - DNA, 25 bp, Mus musculus
tgtgaattggccatcctactaggac

SEQ ID NO: 905224 - DNA, 25 bp, Mus musculus
tgtgaattggccttcctactaggac

SEQ ID NO: 905225 - DNA, 25 bp, Mus musculus
tgtgaattgggcaccaaccaccttg

SEQ ID NO: 905226 - DNA, 25 bp, Mus musculus
tgtgaattgggctccaaccaccttg

SEQ ID NO: 905227 - DNA, 25 bp, Mus musculus
tgtgaattgtcgagagctggcagaa

SEQ ID NO: 905228 - DNA, 25 bp, Mus musculus
tgtgaattgtcgtgagctggcagaa

SEQ ID NO: 905229 - DNA, 25 bp, Mus musculus
tgtgaattgtgtcctttcaccaaca

SEQ ID NO: 905230 - DNA, 25 bp, Mus musculus
tgtgaattgtgtgctttcaccaaca

SEQ ID NO: 905231 - DNA, 25 bp, Mus musculus
tgtgaatttcacagcttataaccca

SEQ ID NO: 905232 - DNA, 25 bp, Mus musculus
tgtgaatttcactgcttataaccca

SEQ ID NO: 905233 - DNA, 25 bp, Mus musculus
tgtgaatttcatactgggacaggct

SEQ ID NO: 905234 - DNA, 25 bp, Mus musculus
tgtgaatttcattctgggacaggct

SEQ ID NO: 905235 - DNA, 25 bp, Mus musculus
tgtgaattttctccccccagagttg

SEQ ID NO: 905236 - DNA, 25 bp, Mus musculus
tgtgaattttctgcccccagagttg

SEQ ID NO: 905237 - DNA, 25 bp, Mus musculus
tgtgacaacacaaagcccagtaaac

SEQ ID NO: 905238 - DNA, 25 bp, Mus musculus
tgtgacaacacatagcccagtaaac

SEQ ID NO: 905239 - DNA, 25 bp, Mus musculus
tgtgacaacgttcaggtgtgtgctt

SEQ ID NO: 905240 - DNA, 25 bp, Mus musculus
tgtgacaacgttgaggtgtgtgctt

SEQ ID NO: 905241 - DNA, 25 bp, Mus musculus
tgtgacaacttaacagcccacatca

SEQ ID NO: 905242 - DNA, 25 bp, Mus musculus
tgtgacaacttatcagcccacatca

SEQ ID NO: 905243 - DNA, 25 bp, Mus musculus
tgtgacaagaacctggcggaccttt

SEQ ID NO: 905244 - DNA, 25 bp, Mus musculus
tgtgacaagaacgtggcggaccttt

SEQ ID NO: 905245 - DNA, 25 bp, Mus musculus
tgtgacaagaatctggtgccaccaa

SEQ ID NO: 905246 - DNA, 25 bp, Mus musculus
tgtgacaagaatgtggtgccaccaa

SEQ ID NO: 905247 - DNA, 25 bp, Mus musculus
tgtgacaatcttaaacctggtcctc

SEQ ID NO: 905248 - DNA, 25 bp, Mus musculus
tgtgacaatctttaacctggtcctc

SEQ ID NO: 905249 - DNA, 25 bp, Mus musculus
tgtgacaatgaccttcctatggaca

SEQ ID NO: 905250 - DNA, 25 bp, Mus musculus
tgtgacaatgacgttcctatggaca

SEQ ID NO: 905251 - DNA, 25 bp, Mus musculus
tgtgacacacacctcagcattgcat

SEQ ID NO: 905252 - DNA, 25 bp, Mus musculus
tgtgacacacacgtcagcattgcat

SEQ ID NO: 905253 - DNA, 25 bp, Mus musculus
tgtgacacacagaggacctggagac

SEQ ID NO: 905254 - DNA, 25 bp, Mus musculus
tgtgacacacagtggacctggagac

SEQ ID NO: 905255 - DNA, 25 bp, Mus musculus
tgtgacacagacaatgcactccttc

SEQ ID NO: 905256 - DNA, 25 bp, Mus musculus
tgtgacacagactatgcactccttc

SEQ ID NO: 905257 - DNA, 25 bp, Mus musculus
tgtgacacaggccttatcaataact

SEQ ID NO: 905258 - DNA, 25 bp, Mus musculus
tgtgacacaggcgttatcaataact

SEQ ID NO: 905259 - DNA, 25 bp, Mus musculus
tgtgacaccaaaagcccctttacat

SEQ ID NO: 905260 - DNA, 25 bp, Mus musculus
tgtgacaccaaatgcccctttacat

SEQ ID NO: 905261 - DNA, 25 bp, Mus musculus
tgtgacaccagcatccgaagagaga

SEQ ID NO: 905262 - DNA, 25 bp, Mus musculus
tgtgacaccagcttccgaagagaga

SEQ ID NO: 905263 - DNA, 25 bp, Mus musculus
tgtgacaccgtgcaatcgtttctgc

SEQ ID NO: 905264 - DNA, 25 bp, Mus musculus
tgtgacaccgtggaatcgtttctgc

SEQ ID NO: 905265 - DNA, 25 bp, Mus musculus
tgtgacacctacctttcctttttct

SEQ ID NO: 905266 - DNA, 25 bp, Mus musculus
tgtgacacctacgtttcctttttct

SEQ ID NO: 905267 - DNA, 25 bp, Mus musculus
tgtgacaccttcacgaatacaggag

SEQ ID NO: 905268 - DNA, 25 bp, Mus musculus
tgtgacaccttctcgaatacaggag

SEQ ID NO: 905269 - DNA, 25 bp, Mus musculus
tgtgacacgcctccacttgtatata

SEQ ID NO: 905270 - DNA, 25 bp, Mus musculus
tgtgacacgcctgcacttgtatata

SEQ ID NO: 905271 - DNA, 25 bp, Mus musculus
tgtgacacgctcagcactccaggaa

SEQ ID NO: 905272 - DNA, 25 bp, Mus musculus
tgtgacacgctctgcactccaggaa

SEQ ID NO: 905273 - DNA, 25 bp, Mus musculus
tgtgacactctcaaggtcagactct

SEQ ID NO: 905274 - DNA, 25 bp, Mus musculus
tgtgacactctctaggtcagactct

SEQ ID NO: 905275 - DNA, 25 bp, Mus musculus
tgtgacactcttcttggtcctatgt

SEQ ID NO: 905276 - DNA, 25 bp, Mus musculus
tgtgacactcttgttggtcctatgt

SEQ ID NO: 905277 - DNA, 25 bp, Mus musculus
tgtgacactgtaaccaactcctaat

SEQ ID NO: 905278 - DNA, 25 bp, Mus musculus
tgtgacactgtatccaactcctaat

SEQ ID NO: 905279 - DNA, 25 bp, Mus musculus
tgtgacactgtcctctgggcgaaga

SEQ ID NO: 905280 - DNA, 25 bp, Mus musculus
tgtgacactgtcgtctgggcgaaga

SEQ ID NO: 905281 - DNA, 25 bp, Mus musculus
tgtgacagaagacccggcaagtgcc

SEQ ID NO: 905282 - DNA, 25 bp, Mus musculus
tgtgacagaagagccggcaagtgcc

SEQ ID NO: 905283 - DNA, 25 bp, Mus musculus
tgtgacagaagcctcatgtttcctc

SEQ ID NO: 905284 - DNA, 25 bp, Mus musculus
tgtgacagaagcgtcatgtttcctc

SEQ ID NO: 905285 - DNA, 25 bp, Mus musculus
tgtgacagcacacgccttctatctg

SEQ ID NO: 905286 - DNA, 25 bp, Mus musculus
tgtgacagcacaggccttctatctg

SEQ ID NO: 905287 - DNA, 25 bp, Mus musculus
tgtgacagccacactcctgtttgat

SEQ ID NO: 905288 - DNA, 25 bp, Mus musculus
tgtgacagccactctcctgtttgat

SEQ ID NO: 905289 - DNA, 25 bp, Mus musculus
tgtgacagccagagttagcatcttt

SEQ ID NO: 905290 - DNA, 25 bp, Mus musculus
tgtgacagccagtgttagcatcttt

SEQ ID NO: 905291 - DNA, 25 bp, Mus musculus
tgtgacagccggcacatgccaacct

SEQ ID NO: 905292 - DNA, 25 bp, Mus musculus
tgtgacagccgggacatgccaacct

SEQ ID NO: 905293 - DNA, 25 bp, Mus musculus
tgtgacagctacagccatgatgatt

SEQ ID NO: 905294 - DNA, 25 bp, Mus musculus
tgtgacagctactgccatgatgatt

SEQ ID NO: 905295 - DNA, 25 bp, Mus musculus
tgtgacagctatcaccggaggttct

SEQ ID NO: 905296 - DNA, 25 bp, Mus musculus
tgtgacagctatgaccggaggttct

SEQ ID NO: 905297 - DNA, 25 bp, Mus musculus
tgtgacagctcacacaggacgcact

SEQ ID NO: 905298 - DNA, 25 bp, Mus musculus
tgtgacagctcagacaggacgcact

SEQ ID NO: 905299 - DNA, 25 bp, Mus musculus
tgtgacaggctacccagtatttacc

SEQ ID NO: 905300 - DNA, 25 bp, Mus musculus
tgtgacaggctagccagtatttacc

SEQ ID NO: 905301 - DNA, 25 bp, Mus musculus
tgtgacaggctgacattagatgact

SEQ ID NO: 905302 - DNA, 25 bp, Mus musculus
tgtgacaggctgtcattagatgact

SEQ ID NO: 905303 - DNA, 25 bp, Mus musculus
tgtgacagggaacatccccatgtga

SEQ ID NO: 905304 - DNA, 25 bp, Mus musculus
tgtgacagggaagatccccatgtga

SEQ ID NO: 905305 - DNA, 25 bp, Mus musculus
tgtgacaggtcacttggccccatct

SEQ ID NO: 905306 - DNA, 25 bp, Mus musculus
tgtgacaggtcagttggccccatct

SEQ ID NO: 905307 - DNA, 25 bp, Mus musculus
tgtgacaggtccaatttcagcagct

SEQ ID NO: 905308 - DNA, 25 bp, Mus musculus
tgtgacaggtcctatttcagcagct

SEQ ID NO: 905309 - DNA, 25 bp, Mus musculus
tgtgacaggtgacgccatcttctca

SEQ ID NO: 905310 - DNA, 25 bp, Mus musculus
tgtgacaggtgaggccatcttctca

SEQ ID NO: 905311 - DNA, 25 bp, Mus musculus
tgtgacagtctcacatgcctaaaga

SEQ ID NO: 905312 - DNA, 25 bp, Mus musculus
tgtgacagtctctcatgcctaaaga

SEQ ID NO: 905313 - DNA, 25 bp, Mus musculus
tgtgacatcatccactgtcatcttt

SEQ ID NO: 905314 - DNA, 25 bp, Mus musculus
tgtgacatcatcgactgtcatcttt

SEQ ID NO: 905315 - DNA, 25 bp, Mus musculus
tgtgacatccatccatctgtggtga

SEQ ID NO: 905316 - DNA, 25 bp, Mus musculus
tgtgacatccatgcatctgtggtga

SEQ ID NO: 905317 - DNA, 25 bp, Mus musculus
tgtgacatcccaaaccatggacttt

SEQ ID NO: 905318 - DNA, 25 bp, Mus musculus
tgtgacatcccataccatggacttt

SEQ ID NO: 905319 - DNA, 25 bp, Mus musculus
tgtgacatccctctgtatgacatct

SEQ ID NO: 905320 - DNA, 25 bp, Mus musculus
tgtgacatccctgtgtatgacatct

SEQ ID NO: 905321 - DNA, 25 bp, Mus musculus
tgtgacatcctcagatgacccttgg

SEQ ID NO: 905322 - DNA, 25 bp, Mus musculus
tgtgacatcctctgatgacccttgg

SEQ ID NO: 905323 - DNA, 25 bp, Mus musculus
tgtgacatggctagtctcccaccaa

SEQ ID NO: 905324 - DNA, 25 bp, Mus musculus
tgtgacatggcttgtctcccaccaa

SEQ ID NO: 905325 - DNA, 25 bp, Mus musculus
tgtgacatgtgcagcaaaggatttc

SEQ ID NO: 905326 - DNA, 25 bp, Mus musculus
tgtgacatgtgctgcaaaggatttc

SEQ ID NO: 905327 - DNA, 25 bp, Mus musculus
tgtgacatgtttccttcacccacat

SEQ ID NO: 905328 - DNA, 25 bp, Mus musculus
tgtgacatgtttgcttcacccacat

SEQ ID NO: 905329 - DNA, 25 bp, Mus musculus
tgtgacattccacccggaaggacat

SEQ ID NO: 905330 - DNA, 25 bp, Mus musculus
tgtgacattccagccggaaggacat

SEQ ID NO: 905331 - DNA, 25 bp, Mus musculus
tgtgacattcctcagccagcttcag

SEQ ID NO: 905332 - DNA, 25 bp, Mus musculus
tgtgacattcctgagccagcttcag

SEQ ID NO: 905333 - DNA, 25 bp, Mus musculus
tgtgacattgacatccgcaaagatt

SEQ ID NO: 905334 - DNA, 25 bp, Mus musculus
tgtgacattgacttccgcaaagatt

SEQ ID NO: 905335 - DNA, 25 bp, Mus musculus
tgtgacatttaacagtttccctggg

SEQ ID NO: 905336 - DNA, 25 bp, Mus musculus
tgtgacatttaagagtttccctggg

SEQ ID NO: 905337 - DNA, 25 bp, Mus musculus
tgtgacatttccagcagaacttggg

SEQ ID NO: 905338 - DNA, 25 bp, Mus musculus
tgtgacatttccatcgctggtattg

SEQ ID NO: 905339 - DNA, 25 bp, Mus musculus
tgtgacatttcctgcagaacttggg

SEQ ID NO: 905340 - DNA, 25 bp, Mus musculus
tgtgacatttccttcgctggtattg

SEQ ID NO: 905341 - DNA, 25 bp, Mus musculus
tgtgaccaaactctctatcctgcat

SEQ ID NO: 905342 - DNA, 25 bp, Mus musculus
tgtgaccaaactgtctatcctgcat

SEQ ID NO: 905343 - DNA, 25 bp, Mus musculus
tgtgaccaacacagcatgccgccga

SEQ ID NO: 905344 - DNA, 25 bp, Mus musculus
tgtgaccaacactgcatgccgccga

SEQ ID NO: 905345 - DNA, 25 bp, Mus musculus
tgtgaccaacatcatgctcgctctt

SEQ ID NO: 905346 - DNA, 25 bp, Mus musculus
tgtgaccaacatgatgctcgctctt

SEQ ID NO: 905347 - DNA, 25 bp, Mus musculus
tgtgaccaacctactggaaggctgc

SEQ ID NO: 905348 - DNA, 25 bp, Mus musculus
tgtgaccaaccttctggaaggctgc

SEQ ID NO: 905349 - DNA, 25 bp, Mus musculus
tgtgaccaactcaactcagcaaaga

SEQ ID NO: 905350 - DNA, 25 bp, Mus musculus
tgtgaccaactctactcagcaaaga

SEQ ID NO: 905351 - DNA, 25 bp, Mus musculus
tgtgaccacaagatcctacctgagt

SEQ ID NO: 905352 - DNA, 25 bp, Mus musculus
tgtgaccacaagttcctacctgagt

SEQ ID NO: 905353 - DNA, 25 bp, Mus musculus
tgtgaccacaggacctacacccaat

SEQ ID NO: 905354 - DNA, 25 bp, Mus musculus
tgtgaccacaggtcctacacccaat

SEQ ID NO: 905355 - DNA, 25 bp, Mus musculus
tgtgaccacattatcacactagtgg

SEQ ID NO: 905356 - DNA, 25 bp, Mus musculus
tgtgaccacattttcacactagtgg

SEQ ID NO: 905357 - DNA, 25 bp, Mus musculus
tgtgaccaccagagccactaggcac

SEQ ID NO: 905358 - DNA, 25 bp, Mus musculus
tgtgaccaccagtgccactaggcac

SEQ ID NO: 905359 - DNA, 25 bp, Mus musculus
tgtgaccaccccactgagtactaga

SEQ ID NO: 905360 - DNA, 25 bp, Mus musculus
tgtgaccacccctctgagtactaga

SEQ ID NO: 905361 - DNA, 25 bp, Mus musculus
tgtgaccacttcattcttatctttg

SEQ ID NO: 905362 - DNA, 25 bp, Mus musculus
tgtgaccacttctttcttatctttg

SEQ ID NO: 905363 - DNA, 25 bp, Mus musculus
tgtgaccacttgcagatttccatag

SEQ ID NO: 905364 - DNA, 25 bp, Mus musculus
tgtgaccacttggagatttccatag

SEQ ID NO: 905365 - DNA, 25 bp, Mus musculus
tgtgaccagaccacgggaacggccc

SEQ ID NO: 905366 - DNA, 25 bp, Mus musculus
tgtgaccagacctcgggaacggccc

SEQ ID NO: 905367 - DNA, 25 bp, Mus musculus
tgtgaccagcatagtaagaccttac

SEQ ID NO: 905368 - DNA, 25 bp, Mus musculus
tgtgaccagcattgtaagaccttac

SEQ ID NO: 905369 - DNA, 25 bp, Mus musculus
tgtgaccagcgtaccatttgcactg

SEQ ID NO: 905370 - DNA, 25 bp, Mus musculus
tgtgaccagcgttccatttgcactg

SEQ ID NO: 905371 - DNA, 25 bp, Mus musculus
tgtgaccaggaacacctagagtagt

SEQ ID NO: 905372 - DNA, 25 bp, Mus musculus
tgtgaccaggaagacctagagtagt

SEQ ID NO: 905373 - DNA, 25 bp, Mus musculus
tgtgaccaggcaattcatgttccat

SEQ ID NO: 905374 - DNA, 25 bp, Mus musculus
tgtgaccaggcatttcatgttccat

SEQ ID NO: 905375 - DNA, 25 bp, Mus musculus
tgtgaccaggttctgcgatcatgtt

SEQ ID NO: 905376 - DNA, 25 bp, Mus musculus
tgtgaccaggttgtgcgatcatgtt

SEQ ID NO: 905377 - DNA, 25 bp, Mus musculus
tgtgaccagttccattgcctttcct

SEQ ID NO: 905378 - DNA, 25 bp, Mus musculus
tgtgaccagttcgattgcctttcct

SEQ ID NO: 905379 - DNA, 25 bp, Mus musculus
tgtgaccatctacccagtattaatt

SEQ ID NO: 905380 - DNA, 25 bp, Mus musculus
tgtgaccatctagccagtattaatt

SEQ ID NO: 905381 - DNA, 25 bp, Mus musculus
tgtgaccatgaccaatccctctatc

SEQ ID NO: 905382 - DNA, 25 bp, Mus musculus
tgtgaccatgacgaatccctctatc

SEQ ID NO: 905383 - DNA, 25 bp, Mus musculus
tgtgaccatgtacgtcctgggaact

SEQ ID NO: 905384 - DNA, 25 bp, Mus musculus
tgtgaccatgtaggtcctgggaact

SEQ ID NO: 905385 - DNA, 25 bp, Mus musculus
tgtgacccaaacagagtgccgctgt

SEQ ID NO: 905386 - DNA, 25 bp, Mus musculus
tgtgacccaaactgagtgccgctgt

SEQ ID NO: 905387 - DNA, 25 bp, Mus musculus
tgtgacccaatactgcatgagcata

SEQ ID NO: 905388 - DNA, 25 bp, Mus musculus
tgtgacccaatagtgcatgagcata

SEQ ID NO: 905389 - DNA, 25 bp, Mus musculus
tgtgacccacagctaggccaccagg

SEQ ID NO: 905390 - DNA, 25 bp, Mus musculus
tgtgacccacaggtaggccaccagg

SEQ ID NO: 905391 - DNA, 25 bp, Mus musculus
tgtgaccccaaaaggtctctgccca

SEQ ID NO: 905392 - DNA, 25 bp, Mus musculus
tgtgaccccaaatggtctctgccca

SEQ ID NO: 905393 - DNA, 25 bp, Mus musculus
tgtgaccccagcactacgggtggga

SEQ ID NO: 905394 - DNA, 25 bp, Mus musculus
tgtgaccccagctctacgggtggga

SEQ ID NO: 905395 - DNA, 25 bp, Mus musculus
tgtgacccctcgctgtgtacggaac

SEQ ID NO: 905396 - DNA, 25 bp, Mus musculus
tgtgacccctcggtgtgtacggaac

SEQ ID NO: 905397 - DNA, 25 bp, Mus musculus
tgtgaccctcagagtacactgcaca

SEQ ID NO: 905398 - DNA, 25 bp, Mus musculus
tgtgaccctcagagtggccaggtgt

SEQ ID NO: 905399 - DNA, 25 bp, Mus musculus
tgtgaccctcagtgtacactgcaca

SEQ ID NO: 905400 - DNA, 25 bp, Mus musculus
tgtgaccctcagtgtggccaggtgt

SEQ ID NO: 905401 - DNA, 25 bp, Mus musculus
tgtgaccctccgcatacagagcaaa

SEQ ID NO: 905402 - DNA, 25 bp, Mus musculus
tgtgaccctccggatacagagcaaa

SEQ ID NO: 905403 - DNA, 25 bp, Mus musculus
tgtgaccctctcagtgaaggatagt

SEQ ID NO: 905404 - DNA, 25 bp, Mus musculus
tgtgaccctctctgtgaaggatagt

SEQ ID NO: 905405 - DNA, 25 bp, Mus musculus
tgtgaccctgacaccaaagaagctg

SEQ ID NO: 905406 - DNA, 25 bp, Mus musculus
tgtgaccctgaccattggcactgca

SEQ ID NO: 905407 - DNA, 25 bp, Mus musculus
tgtgaccctgacgattggcactgca

SEQ ID NO: 905408 - DNA, 25 bp, Mus musculus
tgtgaccctgactccaaagaagctg

SEQ ID NO: 905409 - DNA, 25 bp, Mus musculus
tgtgaccctggtctgactaagcatc

SEQ ID NO: 905410 - DNA, 25 bp, Mus musculus
tgtgaccctggtgtgactaagcatc

SEQ ID NO: 905411 - DNA, 25 bp, Mus musculus
tgtgaccctgtaacagtagggtctg

SEQ ID NO: 905412 - DNA, 25 bp, Mus musculus
tgtgaccctgtatcagtagggtctg

SEQ ID NO: 905413 - DNA, 25 bp, Mus musculus
tgtgaccctgtcattgggctcatac

SEQ ID NO: 905414 - DNA, 25 bp, Mus musculus
tgtgaccctgtctttgggctcatac

SEQ ID NO: 905415 - DNA, 25 bp, Mus musculus
tgtgacccttggaagaactttttag

SEQ ID NO: 905416 - DNA, 25 bp, Mus musculus
tgtgacccttggtagaactttttag

SEQ ID NO: 905417 - DNA, 25 bp, Mus musculus
tgtgacccttgtcctttgacccagc

SEQ ID NO: 905418 - DNA, 25 bp, Mus musculus
tgtgacccttgtgctttgacccagc

SEQ ID NO: 905419 - DNA, 25 bp, Mus musculus
tgtgaccgtcccacttttcattctg

SEQ ID NO: 905420 - DNA, 25 bp, Mus musculus
tgtgaccgtccctcttttcattctg

SEQ ID NO: 905421 - DNA, 25 bp, Mus musculus
tgtgaccgtgtcaggaagtcaagcc

SEQ ID NO: 905422 - DNA, 25 bp, Mus musculus
tgtgaccgtgtctggaagtcaagcc

SEQ ID NO: 905423 - DNA, 25 bp, Mus musculus
tgtgacctaaccctgactttattca

SEQ ID NO: 905424 - DNA, 25 bp, Mus musculus
tgtgacctaaccgtgactttattca

SEQ ID NO: 905425 - DNA, 25 bp, Mus musculus
tgtgacctactgcttcttggcaacc

SEQ ID NO: 905426 - DNA, 25 bp, Mus musculus
tgtgacctactggttcttggcaacc

SEQ ID NO: 905427 - DNA, 25 bp, Mus musculus
tgtgacctagaaatagctgctgccc

SEQ ID NO: 905428 - DNA, 25 bp, Mus musculus
tgtgacctagaattagctgctgccc

SEQ ID NO: 905429 - DNA, 25 bp, Mus musculus
tgtgacctaggtcggatcttcaccc

SEQ ID NO: 905430 - DNA, 25 bp, Mus musculus
tgtgacctaggtgggatcttcaccc

SEQ ID NO: 905431 - DNA, 25 bp, Mus musculus
tgtgacctagttaggttcttctcta

SEQ ID NO: 905432 - DNA, 25 bp, Mus musculus
tgtgacctagtttggttcttctcta

SEQ ID NO: 905433 - DNA, 25 bp, Mus musculus
tgtgacctatgaacagagtaaaatg

SEQ ID NO: 905434 - DNA, 25 bp, Mus musculus
tgtgacctatgaccgcgtaagcaag

SEQ ID NO: 905435 - DNA, 25 bp, Mus musculus
tgtgacctatgagcgcgtaagcaag

SEQ ID NO: 905436 - DNA, 25 bp, Mus musculus
tgtgacctatgatcagagtaaaatg

SEQ ID NO: 905437 - DNA, 25 bp, Mus musculus
tgtgacctcacacctctcagagttc

SEQ ID NO: 905438 - DNA, 25 bp, Mus musculus
tgtgacctcacagctctcagagttc

SEQ ID NO: 905439 - DNA, 25 bp, Mus musculus
tgtgacctcataaagcccctggcag

SEQ ID NO: 905440 - DNA, 25 bp, Mus musculus
tgtgacctcatatagcccctggcag

SEQ ID NO: 905441 - DNA, 25 bp, Mus musculus
tgtgacctctgcatcttgaaggcta

SEQ ID NO: 905442 - DNA, 25 bp, Mus musculus
tgtgacctctgcatttcatcacaaa

SEQ ID NO: 905443 - DNA, 25 bp, Mus musculus
tgtgacctctgcttcttgaaggcta

SEQ ID NO: 905444 - DNA, 25 bp, Mus musculus
tgtgacctctgcttttcatcacaaa

SEQ ID NO: 905445 - DNA, 25 bp, Mus musculus
tgtgacctctgtctgtactgccgat

SEQ ID NO: 905446 - DNA, 25 bp, Mus musculus
tgtgacctctgtgtgtactgccgat

SEQ ID NO: 905447 - DNA, 25 bp, Mus musculus
tgtgacctgaatccttggctgttgg

SEQ ID NO: 905448 - DNA, 25 bp, Mus musculus
tgtgacctgaatgcttggctgttgg

SEQ ID NO: 905449 - DNA, 25 bp, Mus musculus
tgtgacctgactagttttggccatc

SEQ ID NO: 905450 - DNA, 25 bp, Mus musculus
tgtgacctgacttgttttggccatc

SEQ ID NO: 905451 - DNA, 25 bp, Mus musculus
tgtgacctgagcctttgcatacata

SEQ ID NO: 905452 - DNA, 25 bp, Mus musculus
tgtgacctgagcgtttgcatacata

SEQ ID NO: 905453 - DNA, 25 bp, Mus musculus
tgtgacctgagtaggcacaagccac

SEQ ID NO: 905454 - DNA, 25 bp, Mus musculus
tgtgacctgagttggcacaagccac

SEQ ID NO: 905455 - DNA, 25 bp, Mus musculus
tgtgacctgggccattgactcgacc

SEQ ID NO: 905456 - DNA, 25 bp, Mus musculus
tgtgacctgggcgattgactcgacc

SEQ ID NO: 905457 - DNA, 25 bp, Mus musculus
tgtgacctgtcaccctgcagaatca

SEQ ID NO: 905458 - DNA, 25 bp, Mus musculus
tgtgacctgtcagcctgcagaatca

SEQ ID NO: 905459 - DNA, 25 bp, Mus musculus
tgtgaccttaggctcttcatttcac

SEQ ID NO: 905460 - DNA, 25 bp, Mus musculus
tgtgaccttagggtcttcatttcac

SEQ ID NO: 905461 - DNA, 25 bp, Mus musculus
tgtgaccttcctagatgatcagcac

SEQ ID NO: 905462 - DNA, 25 bp, Mus musculus
tgtgaccttccttgatgatcagcac

SEQ ID NO: 905463 - DNA, 25 bp, Mus musculus
tgtgaccttgaaccccatgcactgt

SEQ ID NO: 905464 - DNA, 25 bp, Mus musculus
tgtgaccttgaagcccatgcactgt

SEQ ID NO: 905465 - DNA, 25 bp, Mus musculus
tgtgacctttcccattctgtagcag

SEQ ID NO: 905466 - DNA, 25 bp, Mus musculus
tgtgacctttccgattctgtagcag

SEQ ID NO: 905467 - DNA, 25 bp, Mus musculus
tgtgacctttctaatttccctgtta

SEQ ID NO: 905468 - DNA, 25 bp, Mus musculus
tgtgacctttcttatttccctgtta

SEQ ID NO: 905469 - DNA, 25 bp, Mus musculus
tgtgacgagagcctcagatagcgct

SEQ ID NO: 905470 - DNA, 25 bp, Mus musculus
tgtgacgagagcgtcagatagcgct

SEQ ID NO: 905471 - DNA, 25 bp, Mus musculus
tgtgacgagctccttgtgagccgaa

SEQ ID NO: 905472 - DNA, 25 bp, Mus musculus
tgtgacgagctcgttgtgagccgaa

SEQ ID NO: 905473 - DNA, 25 bp, Mus musculus
tgtgacgatgacatttctttgcttc

SEQ ID NO: 905474 - DNA, 25 bp, Mus musculus
tgtgacgatgacttttctttgcttc

SEQ ID NO: 905475 - DNA, 25 bp, Mus musculus
tgtgacgctattatgcaggtgtgca

SEQ ID NO: 905476 - DNA, 25 bp, Mus musculus
tgtgacgctattttgcaggtgtgca

SEQ ID NO: 905477 - DNA, 25 bp, Mus musculus
tgtgacgctgctcctatattctaag

SEQ ID NO: 905478 - DNA, 25 bp, Mus musculus
tgtgacgctgctgctatattctaag

SEQ ID NO: 905479 - DNA, 25 bp, Mus musculus
tgtgacgcttaccagtgcagctgag

SEQ ID NO: 905480 - DNA, 25 bp, Mus musculus
tgtgacgcttacgagtgcagctgag

SEQ ID NO: 905481 - DNA, 25 bp, Mus musculus
tgtgacgggcctaaaaccaaacaga

SEQ ID NO: 905482 - DNA, 25 bp, Mus musculus
tgtgacgggccttaaaccaaacaga

SEQ ID NO: 905483 - DNA, 25 bp, Mus musculus
tgtgacggtacaccaggcactttca

SEQ ID NO: 905484 - DNA, 25 bp, Mus musculus
tgtgacggtacagcaggcactttca

SEQ ID NO: 905485 - DNA, 25 bp, Mus musculus
tgtgacggttctactcccagtggtt

SEQ ID NO: 905486 - DNA, 25 bp, Mus musculus
tgtgacggttcttctcccagtggtt

SEQ ID NO: 905487 - DNA, 25 bp, Mus musculus
tgtgacgtcacaacccgaagataat

SEQ ID NO: 905488 - DNA, 25 bp, Mus musculus
tgtgacgtcacatcccgaagataat

SEQ ID NO: 905489 - DNA, 25 bp, Mus musculus
tgtgacgtcatgctctgtggcttct

SEQ ID NO: 905490 - DNA, 25 bp, Mus musculus
tgtgacgtcatggtctgtggcttct

SEQ ID NO: 905491 - DNA, 25 bp, Mus musculus
tgtgacgtttgtccctttttaggag

SEQ ID NO: 905492 - DNA, 25 bp, Mus musculus
tgtgacgtttgtgcctttttaggag

SEQ ID NO: 905493 - DNA, 25 bp, Mus musculus
tgtgactaccacacagtcatggatt

SEQ ID NO: 905494 - DNA, 25 bp, Mus musculus
tgtgactaccactcagtcatggatt

SEQ ID NO: 905495 - DNA, 25 bp, Mus musculus
tgtgactaccttcgcccagtggtct

SEQ ID NO: 905496 - DNA, 25 bp, Mus musculus
tgtgactaccttggcccagtggtct

SEQ ID NO: 905497 - DNA, 25 bp, Mus musculus
tgtgactagaccatcaagtgaactt

SEQ ID NO: 905498 - DNA, 25 bp, Mus musculus
tgtgactagaccttcaagtgaactt

SEQ ID NO: 905499 - DNA, 25 bp, Mus musculus
tgtgactagggaaggtaaccccatt

SEQ ID NO: 905500 - DNA, 25 bp, Mus musculus
tgtgactagggatggtaaccccatt

SEQ ID NO: 905501 - DNA, 25 bp, Mus musculus
tgtgactataacatatgatgctgta

SEQ ID NO: 905502 - DNA, 25 bp, Mus musculus
tgtgactataacttatgatgctgta

SEQ ID NO: 905503 - DNA, 25 bp, Mus musculus
tgtgactcaaaaaagatcatacaag

SEQ ID NO: 905504 - DNA, 25 bp, Mus musculus
tgtgactcaaaatagatcatacaag

SEQ ID NO: 905505 - DNA, 25 bp, Mus musculus
tgtgactcaatgagtggtgtcttca

SEQ ID NO: 905506 - DNA, 25 bp, Mus musculus
tgtgactcaatgtgtggtgtcttca

SEQ ID NO: 905507 - DNA, 25 bp, Mus musculus
tgtgactcacacatgatagcccagc

SEQ ID NO: 905508 - DNA, 25 bp, Mus musculus
tgtgactcacacttgatagcccagc

SEQ ID NO: 905509 - DNA, 25 bp, Mus musculus
tgtgactcagacaccactgtgtctg

SEQ ID NO: 905510 - DNA, 25 bp, Mus musculus
tgtgactcagacctctcctgttaca

SEQ ID NO: 905511 - DNA, 25 bp, Mus musculus
tgtgactcagacgtctcctgttaca

SEQ ID NO: 905512 - DNA, 25 bp, Mus musculus
tgtgactcagactccactgtgtctg

SEQ ID NO: 905513 - DNA, 25 bp, Mus musculus
tgtgactcaggacctacggattcat

SEQ ID NO: 905514 - DNA, 25 bp, Mus musculus
tgtgactcaggagctacggattcat

SEQ ID NO: 905515 - DNA, 25 bp, Mus musculus
tgtgactcaggccattctgcatctt

SEQ ID NO: 905516 - DNA, 25 bp, Mus musculus
tgtgactcaggcgattctgcatctt

SEQ ID NO: 905517 - DNA, 25 bp, Mus musculus
tgtgactcatcaccatgtggaagat

SEQ ID NO: 905518 - DNA, 25 bp, Mus musculus
tgtgactcatcagcatgtggaagat

SEQ ID NO: 905519 - DNA, 25 bp, Mus musculus
tgtgactcatttctttttctggctc

SEQ ID NO: 905520 - DNA, 25 bp, Mus musculus
tgtgactcatttgtttttctggctc

SEQ ID NO: 905521 - DNA, 25 bp, Mus musculus
tgtgactccagcatgctttagttga

SEQ ID NO: 905522 - DNA, 25 bp, Mus musculus
tgtgactccagcttgctttagttga

SEQ ID NO: 905523 - DNA, 25 bp, Mus musculus
tgtgactcccagatggcaggtgccc

SEQ ID NO: 905524 - DNA, 25 bp, Mus musculus
tgtgactcccagttggcaggtgccc

SEQ ID NO: 905525 - DNA, 25 bp, Mus musculus
tgtgactcccgtcggtcgtgatcca

SEQ ID NO: 905526 - DNA, 25 bp, Mus musculus
tgtgactcccgtgggtcgtgatcca

SEQ ID NO: 905527 - DNA, 25 bp, Mus musculus
tgtgactctagcctttggaccaaag

SEQ ID NO: 905528 - DNA, 25 bp, Mus musculus
tgtgactctagcgtttggaccaaag

SEQ ID NO: 905529 - DNA, 25 bp, Mus musculus
tgtgactctaggctacctcagtgtc

SEQ ID NO: 905530 - DNA, 25 bp, Mus musculus
tgtgactctagggtacctcagtgtc

SEQ ID NO: 905531 - DNA, 25 bp, Mus musculus
tgtgactctgttcatctgtttttaa

SEQ ID NO: 905532 - DNA, 25 bp, Mus musculus
tgtgactctgttgatctgtttttaa

SEQ ID NO: 905533 - DNA, 25 bp, Mus musculus
tgtgactcttagctttcccaacctt

SEQ ID NO: 905534 - DNA, 25 bp, Mus musculus
tgtgactcttaggtttcccaacctt

SEQ ID NO: 905535 - DNA, 25 bp, Mus musculus
tgtgactcttctctatcttcttcat

SEQ ID NO: 905536 - DNA, 25 bp, Mus musculus
tgtgactcttctgtatcttcttcat

SEQ ID NO: 905537 - DNA, 25 bp, Mus musculus
tgtgactgaacgaccttgcccatgg

SEQ ID NO: 905538 - DNA, 25 bp, Mus musculus
tgtgactgaacgtccttgcccatgg

SEQ ID NO: 905539 - DNA, 25 bp, Mus musculus
tgtgactgaggaaacacctgaaggt

SEQ ID NO: 905540 - DNA, 25 bp, Mus musculus
tgtgactgaggatacacctgaaggt

SEQ ID NO: 905541 - DNA, 25 bp, Mus musculus
tgtgactgattgcacaagtggcttt

SEQ ID NO: 905542 - DNA, 25 bp, Mus musculus
tgtgactgattggacaagtggcttt

SEQ ID NO: 905543 - DNA, 25 bp, Mus musculus
tgtgactgcaggcccaacaaacctc

SEQ ID NO: 905544 - DNA, 25 bp, Mus musculus
tgtgactgcagggccaacaaacctc

SEQ ID NO: 905545 - DNA, 25 bp, Mus musculus
tgtgactgcagtaccctagggcaag

SEQ ID NO: 905546 - DNA, 25 bp, Mus musculus
tgtgactgcagttccctagggcaag

SEQ ID NO: 905547 - DNA, 25 bp, Mus musculus
tgtgactgctccactcgggaaccca

SEQ ID NO: 905548 - DNA, 25 bp, Mus musculus
tgtgactgctcctctcgggaaccca

SEQ ID NO: 905549 - DNA, 25 bp, Mus musculus
tgtgactgctttcacctccacgata

SEQ ID NO: 905550 - DNA, 25 bp, Mus musculus
tgtgactgctttgacctccacgata

SEQ ID NO: 905551 - DNA, 25 bp, Mus musculus
tgtgactggaatcccagacgtttcc

SEQ ID NO: 905552 - DNA, 25 bp, Mus musculus
tgtgactggaatcgctgcctccttg

SEQ ID NO: 905553 - DNA, 25 bp, Mus musculus
tgtgactggaatgccagacgtttcc

SEQ ID NO: 905554 - DNA, 25 bp, Mus musculus
tgtgactggaatggctgcctccttg

SEQ ID NO: 905555 - DNA, 25 bp, Mus musculus
tgtgactggagcctgcctcctaaaa

SEQ ID NO: 905556 - DNA, 25 bp, Mus musculus
tgtgactggagcgtgcctcctaaaa

SEQ ID NO: 905557 - DNA, 25 bp, Mus musculus
tgtgactggagtctcttctagggta

SEQ ID NO: 905558 - DNA, 25 bp, Mus musculus
tgtgactggagtgtcttctagggta

SEQ ID NO: 905559 - DNA, 25 bp, Mus musculus
tgtgactggattagccactggcaga

SEQ ID NO: 905560 - DNA, 25 bp, Mus musculus
tgtgactggatttgccactggcaga

SEQ ID NO: 905561 - DNA, 25 bp, Mus musculus
tgtgactggcgcactggactgcaaa

SEQ ID NO: 905562 - DNA, 25 bp, Mus musculus
tgtgactggcgctctggactgcaaa

SEQ ID NO: 905563 - DNA, 25 bp, Mus musculus
tgtgactgtctgatgtgccacctca

SEQ ID NO: 905564 - DNA, 25 bp, Mus musculus
tgtgactgtctgttgtgccacctca

SEQ ID NO: 905565 - DNA, 25 bp, Mus musculus
tgtgactgtgtgaggaccgtgttca

SEQ ID NO: 905566 - DNA, 25 bp, Mus musculus
tgtgactgtgtgtggaccgtgttca

SEQ ID NO: 905567 - DNA, 25 bp, Mus musculus
tgtgactgttcactcctgggagaga

SEQ ID NO: 905568 - DNA, 25 bp, Mus musculus
tgtgactgttcagtcctgggagaga

SEQ ID NO: 905569 - DNA, 25 bp, Mus musculus
tgtgactgttgcctgggccaatcca

SEQ ID NO: 905570 - DNA, 25 bp, Mus musculus
tgtgactgttgcgtgggccaatcca

SEQ ID NO: 905571 - DNA, 25 bp, Mus musculus
tgtgactgttggacgtgtcctgaaa

SEQ ID NO: 905572 - DNA, 25 bp, Mus musculus
tgtgactgttggtcgtgtcctgaaa

SEQ ID NO: 905573 - DNA, 25 bp, Mus musculus
tgtgacttaatacgtttttctaact

SEQ ID NO: 905574 - DNA, 25 bp, Mus musculus
tgtgacttaataggtttttctaact

SEQ ID NO: 905575 - DNA, 25 bp, Mus musculus
tgtgacttacaaatgtctttccttt

SEQ ID NO: 905576 - DNA, 25 bp, Mus musculus
tgtgacttacaattgtctttccttt

SEQ ID NO: 905577 - DNA, 25 bp, Mus musculus
tgtgacttacttcaagcctcgagtg

SEQ ID NO: 905578 - DNA, 25 bp, Mus musculus
tgtgacttacttgaagcctcgagtg

SEQ ID NO: 905579 - DNA, 25 bp, Mus musculus
tgtgacttcacacagcttctctaag

SEQ ID NO: 905580 - DNA, 25 bp, Mus musculus
tgtgacttcacagagcttctctaag

SEQ ID NO: 905581 - DNA, 25 bp, Mus musculus
tgtgacttcactatcatcttgctta

SEQ ID NO: 905582 - DNA, 25 bp, Mus musculus
tgtgacttcactttcatcttgctta

SEQ ID NO: 905583 - DNA, 25 bp, Mus musculus
tgtgacttcagccttcatgtcccca

SEQ ID NO: 905584 - DNA, 25 bp, Mus musculus
tgtgacttcagcgttcatgtcccca

SEQ ID NO: 905585 - DNA, 25 bp, Mus musculus
tgtgacttccaccttgggtttagta

SEQ ID NO: 905586 - DNA, 25 bp, Mus musculus
tgtgacttccacgttgggtttagta

SEQ ID NO: 905587 - DNA, 25 bp, Mus musculus
tgtgacttctgcacttgctatttga

SEQ ID NO: 905588 - DNA, 25 bp, Mus musculus
tgtgacttctgctcttgctatttga

SEQ ID NO: 905589 - DNA, 25 bp, Mus musculus
tgtgacttgactcatcccagcagga

SEQ ID NO: 905590 - DNA, 25 bp, Mus musculus
tgtgacttgactgatcccagcagga

SEQ ID NO: 905591 - DNA, 25 bp, Mus musculus
tgtgacttgaggaggcgccagcctc

SEQ ID NO: 905592 - DNA, 25 bp, Mus musculus
tgtgacttgaggtggcgccagcctc

SEQ ID NO: 905593 - DNA, 25 bp, Mus musculus
tgtgacttgggacacctggtgactc

SEQ ID NO: 905594 - DNA, 25 bp, Mus musculus
tgtgacttgggagacctggtgactc

SEQ ID NO: 905595 - DNA, 25 bp, Mus musculus
tgtgacttgtcacggtgctgtatta

SEQ ID NO: 905596 - DNA, 25 bp, Mus musculus
tgtgacttgtcagggtgctgtatta

SEQ ID NO: 905597 - DNA, 25 bp, Mus musculus
tgtgacttgtctagaggccacctga

SEQ ID NO: 905598 - DNA, 25 bp, Mus musculus
tgtgacttgtcttgaggccacctga

SEQ ID NO: 905599 - DNA, 25 bp, Mus musculus
tgtgactttacacttcaaatttttt

SEQ ID NO: 905600 - DNA, 25 bp, Mus musculus
tgtgactttacagttcaaatttttt

SEQ ID NO: 905601 - DNA, 25 bp, Mus musculus
tgtgactttcccctaaaatgacaaa

SEQ ID NO: 905602 - DNA, 25 bp, Mus musculus
tgtgactttcccgtaaaatgacaaa

SEQ ID NO: 905603 - DNA, 25 bp, Mus musculus
tgtgactttcctatgctcaaccgac

SEQ ID NO: 905604 - DNA, 25 bp, Mus musculus
tgtgactttcctttgctcaaccgac

SEQ ID NO: 905605 - DNA, 25 bp, Mus musculus
tgtgactttgacaagccactcgcat

SEQ ID NO: 905606 - DNA, 25 bp, Mus musculus
tgtgactttgactagccactcgcat

SEQ ID NO: 905607 - DNA, 25 bp, Mus musculus
tgtgactttgctcgcggaactttgg

SEQ ID NO: 905608 - DNA, 25 bp, Mus musculus
tgtgactttgctggcggaactttgg

SEQ ID NO: 905609 - DNA, 25 bp, Mus musculus
tgtgactttgtccttttgccttctt

SEQ ID NO: 905610 - DNA, 25 bp, Mus musculus
tgtgactttgtcgttttgccttctt

SEQ ID NO: 905611 - DNA, 25 bp, Mus musculus
tgtgagaaaaaacccactcgttcaa

SEQ ID NO: 905612 - DNA, 25 bp, Mus musculus
tgtgagaaaaaagccactcgttcaa

SEQ ID NO: 905613 - DNA, 25 bp, Mus musculus
tgtgagaaagtcagctctccctggc

SEQ ID NO: 905614 - DNA, 25 bp, Mus musculus
tgtgagaaagtctgctctccctggc

SEQ ID NO: 905615 - DNA, 25 bp, Mus musculus
tgtgagaaagttagggctccctcgt

SEQ ID NO: 905616 - DNA, 25 bp, Mus musculus
tgtgagaaagtttgggctccctcgt

SEQ ID NO: 905617 - DNA, 25 bp, Mus musculus
tgtgagaaatcaccgattgcccttg

SEQ ID NO: 905618 - DNA, 25 bp, Mus musculus
tgtgagaaatcagcgattgcccttg

SEQ ID NO: 905619 - DNA, 25 bp, Mus musculus
tgtgagaatgtacgtcccaggagct

SEQ ID NO: 905620 - DNA, 25 bp, Mus musculus
tgtgagaatgtaggtcccaggagct

SEQ ID NO: 905621 - DNA, 25 bp, Mus musculus
tgtgagaatgttagcagcagacatt

SEQ ID NO: 905622 - DNA, 25 bp, Mus musculus
tgtgagaatgtttgcagcagacatt

SEQ ID NO: 905623 - DNA, 25 bp, Mus musculus
tgtgagaattgcctcctgcgcttcc

SEQ ID NO: 905624 - DNA, 25 bp, Mus musculus
tgtgagaattgcgtcctgcgcttcc

SEQ ID NO: 905625 - DNA, 25 bp, Mus musculus
tgtgagaatttgataacacacaatg

SEQ ID NO: 905626 - DNA, 25 bp, Mus musculus
tgtgagaatttgttaacacacaatg

SEQ ID NO: 905627 - DNA, 25 bp, Mus musculus
tgtgagacagaccagctccaagcac

SEQ ID NO: 905628 - DNA, 25 bp, Mus musculus
tgtgagacagacgagctccaagcac

SEQ ID NO: 905629 - DNA, 25 bp, Mus musculus
tgtgagacagcacccgccaaactga

SEQ ID NO: 905630 - DNA, 25 bp, Mus musculus
tgtgagacagcagccgccaaactga

SEQ ID NO: 905631 - DNA, 25 bp, Mus musculus
tgtgagaccagacctcaggctccta

SEQ ID NO: 905632 - DNA, 25 bp, Mus musculus
tgtgagaccagagctcaggctccta

SEQ ID NO: 905633 - DNA, 25 bp, Mus musculus
tgtgagacccataccggtacccatg

SEQ ID NO: 905634 - DNA, 25 bp, Mus musculus
tgtgagacccatcgcacgagtcagt

SEQ ID NO: 905635 - DNA, 25 bp, Mus musculus
tgtgagacccatggcacgagtcagt

SEQ ID NO: 905636 - DNA, 25 bp, Mus musculus
tgtgagacccattccggtacccatg

SEQ ID NO: 905637 - DNA, 25 bp, Mus musculus
tgtgagacccctagttctgacgtca

SEQ ID NO: 905638 - DNA, 25 bp, Mus musculus
tgtgagaccccttgttctgacgtca

SEQ ID NO: 905639 - DNA, 25 bp, Mus musculus
tgtgagacccgtacttggctctggt

SEQ ID NO: 905640 - DNA, 25 bp, Mus musculus
tgtgagacccgttcttggctctggt

SEQ ID NO: 905641 - DNA, 25 bp, Mus musculus
tgtgagaccctcagacatgatttga

SEQ ID NO: 905642 - DNA, 25 bp, Mus musculus
tgtgagaccctctgacatgatttga

SEQ ID NO: 905643 - DNA, 25 bp, Mus musculus
tgtgagaccttaagaccccgtacct

SEQ ID NO: 905644 - DNA, 25 bp, Mus musculus
tgtgagaccttatgaccccgtacct

SEQ ID NO: 905645 - DNA, 25 bp, Mus musculus
tgtgagacttgtacattccatagct

SEQ ID NO: 905646 - DNA, 25 bp, Mus musculus
tgtgagacttgttcattccatagct

SEQ ID NO: 905647 - DNA, 25 bp, Mus musculus
tgtgagagaagtccccgtgtacgat

SEQ ID NO: 905648 - DNA, 25 bp, Mus musculus
tgtgagagaagtgcccgtgtacgat

SEQ ID NO: 905649 - DNA, 25 bp, Mus musculus
tgtgagagaatccagggttccccag

SEQ ID NO: 905650 - DNA, 25 bp, Mus musculus
tgtgagagaatcgagggttccccag

SEQ ID NO: 905651 - DNA, 25 bp, Mus musculus
tgtgagagacgtatgccaaatgatt

SEQ ID NO: 905652 - DNA, 25 bp, Mus musculus
tgtgagagacgtttgccaaatgatt

SEQ ID NO: 905653 - DNA, 25 bp, Mus musculus
tgtgagaggctaccactagggatcc

SEQ ID NO: 905654 - DNA, 25 bp, Mus musculus
tgtgagaggctagcactagggatcc

SEQ ID NO: 905655 - DNA, 25 bp, Mus musculus
tgtgagagggtccttccatactcca

SEQ ID NO: 905656 - DNA, 25 bp, Mus musculus
tgtgagagggtcgttccatactcca

SEQ ID NO: 905657 - DNA, 25 bp, Mus musculus
tgtgagaggtatcatccctgcaggt

SEQ ID NO: 905658 - DNA, 25 bp, Mus musculus
tgtgagaggtatgatccctgcaggt

SEQ ID NO: 905659 - DNA, 25 bp, Mus musculus
tgtgagaggtcaccatgttccggcc

SEQ ID NO: 905660 - DNA, 25 bp, Mus musculus
tgtgagaggtcagcatgttccggcc

SEQ ID NO: 905661 - DNA, 25 bp, Mus musculus
tgtgagagtcacataggccctgcca

SEQ ID NO: 905662 - DNA, 25 bp, Mus musculus
tgtgagagtcacttaggccctgcca

SEQ ID NO: 905663 - DNA, 25 bp, Mus musculus
tgtgagagttcccagtctctatctc

SEQ ID NO: 905664 - DNA, 25 bp, Mus musculus
tgtgagagttccgagtctctatctc

SEQ ID NO: 905665 - DNA, 25 bp, Mus musculus
tgtgagatcaagagcagggacaact

SEQ ID NO: 905666 - DNA, 25 bp, Mus musculus
tgtgagatcaagtgcagggacaact

SEQ ID NO: 905667 - DNA, 25 bp, Mus musculus
tgtgagatcactctgtggtctctcc

SEQ ID NO: 905668 - DNA, 25 bp, Mus musculus
tgtgagatcactgtgtggtctctcc

SEQ ID NO: 905669 - DNA, 25 bp, Mus musculus
tgtgagatccctacgggtagttctc

SEQ ID NO: 905670 - DNA, 25 bp, Mus musculus
tgtgagatcccttcgggtagttctc

SEQ ID NO: 905671 - DNA, 25 bp, Mus musculus
tgtgagatgtcactggattcctcct

SEQ ID NO: 905672 - DNA, 25 bp, Mus musculus
tgtgagatgtcagtggattcctcct

SEQ ID NO: 905673 - DNA, 25 bp, Mus musculus
tgtgagattgtcatttacaccaaaa

SEQ ID NO: 905674 - DNA, 25 bp, Mus musculus
tgtgagattgtcttttacaccaaaa

SEQ ID NO: 905675 - DNA, 25 bp, Mus musculus
tgtgagattgttcttgcttatgtca

SEQ ID NO: 905676 - DNA, 25 bp, Mus musculus
tgtgagattgttgttgcttatgtca

SEQ ID NO: 905677 - DNA, 25 bp, Mus musculus
tgtgagcaaaagctactgtgagttc

SEQ ID NO: 905678 - DNA, 25 bp, Mus musculus
tgtgagcaaaaggtactgtgagttc

SEQ ID NO: 905679 - DNA, 25 bp, Mus musculus
tgtgagcaactgcatgtactacttg

SEQ ID NO: 905680 - DNA, 25 bp, Mus musculus
tgtgagcaactggatgtactacttg

SEQ ID NO: 905681 - DNA, 25 bp, Mus musculus
tgtgagcacagaaagccagggtgaa

SEQ ID NO: 905682 - DNA, 25 bp, Mus musculus
tgtgagcacagatagccagggtgaa

SEQ ID NO: 905683 - DNA, 25 bp, Mus musculus
tgtgagcacccaaagcatctgccaa

SEQ ID NO: 905684 - DNA, 25 bp, Mus musculus
tgtgagcacccatagcatctgccaa

SEQ ID NO: 905685 - DNA, 25 bp, Mus musculus
tgtgagcacctaagtgtgaaacttg

SEQ ID NO: 905686 - DNA, 25 bp, Mus musculus
tgtgagcacctatgtgtgaaacttg

SEQ ID NO: 905687 - DNA, 25 bp, Mus musculus
tgtgagcacggacagtatctcccct

SEQ ID NO: 905688 - DNA, 25 bp, Mus musculus
tgtgagcacggagagtatctcccct

SEQ ID NO: 905689 - DNA, 25 bp, Mus musculus
tgtgagcactacactgtccaagtct

SEQ ID NO: 905690 - DNA, 25 bp, Mus musculus
tgtgagcactacaggcaccaggagt

SEQ ID NO: 905691 - DNA, 25 bp, Mus musculus
tgtgagcactactctgtccaagtct

SEQ ID NO: 905692 - DNA, 25 bp, Mus musculus
tgtgagcactactggcaccaggagt

SEQ ID NO: 905693 - DNA, 25 bp, Mus musculus
tgtgagcactatactcttcttctca

SEQ ID NO: 905694 - DNA, 25 bp, Mus musculus
tgtgagcactattctcttcttctca

SEQ ID NO: 905695 - DNA, 25 bp, Mus musculus
tgtgagcactttctttgtcgttcag

SEQ ID NO: 905696 - DNA, 25 bp, Mus musculus
tgtgagcactttgtttgtcgttcag

SEQ ID NO: 905697 - DNA, 25 bp, Mus musculus
tgtgagcagaagattccttttcccc

SEQ ID NO: 905698 - DNA, 25 bp, Mus musculus
tgtgagcagaagtttccttttcccc

SEQ ID NO: 905699 - DNA, 25 bp, Mus musculus
tgtgagcagcccaatgtaggtgctg

SEQ ID NO: 905700 - DNA, 25 bp, Mus musculus
tgtgagcagccctatgtaggtgctg

SEQ ID NO: 905701 - DNA, 25 bp, Mus musculus
tgtgagcaggcaaaggagtcccatt

SEQ ID NO: 905702 - DNA, 25 bp, Mus musculus
tgtgagcaggcataggagtcccatt

SEQ ID NO: 905703 - DNA, 25 bp, Mus musculus
tgtgagcaggctctaaccagtcaga

SEQ ID NO: 905704 - DNA, 25 bp, Mus musculus
tgtgagcaggctgtaaccagtcaga

SEQ ID NO: 905705 - DNA, 25 bp, Mus musculus
tgtgagcatctgagcacccactctt

SEQ ID NO: 905706 - DNA, 25 bp, Mus musculus
tgtgagcatctgtgcacccactctt

SEQ ID NO: 905707 - DNA, 25 bp, Mus musculus
tgtgagcatgacatgagggcagact

SEQ ID NO: 905708 - DNA, 25 bp, Mus musculus
tgtgagcatgacttgagggcagact

SEQ ID NO: 905709 - DNA, 25 bp, Mus musculus
tgtgagcattgaccagcctttacct

SEQ ID NO: 905710 - DNA, 25 bp, Mus musculus
tgtgagcattgagcagcctttacct

SEQ ID NO: 905711 - DNA, 25 bp, Mus musculus
tgtgagccaaccactgtgagcagtt

SEQ ID NO: 905712 - DNA, 25 bp, Mus musculus
tgtgagccaacctctgtgagcagtt

SEQ ID NO: 905713 - DNA, 25 bp, Mus musculus
tgtgagccacccagtctataatcta

SEQ ID NO: 905714 - DNA, 25 bp, Mus musculus
tgtgagccaccctgtctataatcta

SEQ ID NO: 905715 - DNA, 25 bp, Mus musculus
tgtgagccacggaacaggtctgtct

SEQ ID NO: 905716 - DNA, 25 bp, Mus musculus
tgtgagccacggtacaggtctgtct

SEQ ID NO: 905717 - DNA, 25 bp, Mus musculus
tgtgagccactacgtttatttacca

SEQ ID NO: 905718 - DNA, 25 bp, Mus musculus
tgtgagccactaggtttatttacca

SEQ ID NO: 905719 - DNA, 25 bp, Mus musculus
tgtgagccaggacagttgcccaccc

SEQ ID NO: 905720 - DNA, 25 bp, Mus musculus
tgtgagccaggagagttgcccaccc

SEQ ID NO: 905721 - DNA, 25 bp, Mus musculus
tgtgagccaggtcatgggctctatt

SEQ ID NO: 905722 - DNA, 25 bp, Mus musculus
tgtgagccaggtgatgggctctatt

SEQ ID NO: 905723 - DNA, 25 bp, Mus musculus
tgtgagccagttcaggacccaccaa

SEQ ID NO: 905724 - DNA, 25 bp, Mus musculus
tgtgagccagttgaggacccaccaa

SEQ ID NO: 905725 - DNA, 25 bp, Mus musculus
tgtgagccatgcatgacactcctgg

SEQ ID NO: 905726 - DNA, 25 bp, Mus musculus
tgtgagccatgcttgacactcctgg

SEQ ID NO: 905727 - DNA, 25 bp, Mus musculus
tgtgagccatgtccttgtgtgtgtc

SEQ ID NO: 905728 - DNA, 25 bp, Mus musculus
tgtgagccatgtgcttgtgtgtgtc

SEQ ID NO: 905729 - DNA, 25 bp, Mus musculus
tgtgagcccaagatacagactgtat

SEQ ID NO: 905730 - DNA, 25 bp, Mus musculus
tgtgagcccaagttacagactgtat

SEQ ID NO: 905731 - DNA, 25 bp, Mus musculus
tgtgagcccagtatgggcccctggc

SEQ ID NO: 905732 - DNA, 25 bp, Mus musculus
tgtgagcccagtttgggcccctggc

SEQ ID NO: 905733 - DNA, 25 bp, Mus musculus
tgtgagcccatcacaacatctggaa

SEQ ID NO: 905734 - DNA, 25 bp, Mus musculus
tgtgagcccatctcaacatctggaa

SEQ ID NO: 905735 - DNA, 25 bp, Mus musculus
tgtgagccccaaaacagtatttcca

SEQ ID NO: 905736 - DNA, 25 bp, Mus musculus
tgtgagccccaatacagtatttcca

SEQ ID NO: 905737 - DNA, 25 bp, Mus musculus
tgtgagcccctaactcaacacagaa

SEQ ID NO: 905738 - DNA, 25 bp, Mus musculus
tgtgagcccctatctcaacacagaa

SEQ ID NO: 905739 - DNA, 25 bp, Mus musculus
tgtgagccgattctcctatctccag

SEQ ID NO: 905740 - DNA, 25 bp, Mus musculus
tgtgagccgattgtcctatctccag

SEQ ID NO: 905741 - DNA, 25 bp, Mus musculus
tgtgagccgcaactgtgccatcaac

SEQ ID NO: 905742 - DNA, 25 bp, Mus musculus
tgtgagccgcaagtgtgccatcaac

SEQ ID NO: 905743 - DNA, 25 bp, Mus musculus
tgtgagccgtggaagacaagcccat

SEQ ID NO: 905744 - DNA, 25 bp, Mus musculus
tgtgagccgtggtagacaagcccat

SEQ ID NO: 905745 - DNA, 25 bp, Mus musculus
tgtgagcctacgatgttctggagat

SEQ ID NO: 905746 - DNA, 25 bp, Mus musculus
tgtgagcctacgttgttctggagat

SEQ ID NO: 905747 - DNA, 25 bp, Mus musculus
tgtgagcctctaccaaacccaaaac

SEQ ID NO: 905748 - DNA, 25 bp, Mus musculus
tgtgagcctctagcaaacccaaaac

SEQ ID NO: 905749 - DNA, 25 bp, Mus musculus
tgtgagccttgcagcccttgtatgg

SEQ ID NO: 905750 - DNA, 25 bp, Mus musculus
tgtgagccttgctgcccttgtatgg

SEQ ID NO: 905751 - DNA, 25 bp, Mus musculus
tgtgagcctttaagggtcacctcgc

SEQ ID NO: 905752 - DNA, 25 bp, Mus musculus
tgtgagcctttatgggtcacctcgc

SEQ ID NO: 905753 - DNA, 25 bp, Mus musculus
tgtgagccttttatacccttgtgaa

SEQ ID NO: 905754 - DNA, 25 bp, Mus musculus
tgtgagccttttttacccttgtgaa

SEQ ID NO: 905755 - DNA, 25 bp, Mus musculus
tgtgagcgaggcctttggttccatc

SEQ ID NO: 905756 - DNA, 25 bp, Mus musculus
tgtgagcgaggcgtttggttccatc

SEQ ID NO: 905757 - DNA, 25 bp, Mus musculus
tgtgagcggctaagactcagcacgt

SEQ ID NO: 905758 - DNA, 25 bp, Mus musculus
tgtgagcggctatgactcagcacgt

SEQ ID NO: 905759 - DNA, 25 bp, Mus musculus
tgtgagcgtagcaccccggacggct

SEQ ID NO: 905760 - DNA, 25 bp, Mus musculus
tgtgagcgtagctccccggacggct

SEQ ID NO: 905761 - DNA, 25 bp, Mus musculus
tgtgagctacaacccattcgtcttt

SEQ ID NO: 905762 - DNA, 25 bp, Mus musculus
tgtgagctacaagccattcgtcttt

SEQ ID NO: 905763 - DNA, 25 bp, Mus musculus
tgtgagctactgagctttacagcca

SEQ ID NO: 905764 - DNA, 25 bp, Mus musculus
tgtgagctactgtgctttacagcca

SEQ ID NO: 905765 - DNA, 25 bp, Mus musculus
tgtgagctagagaagatccagatct

SEQ ID NO: 905766 - DNA, 25 bp, Mus musculus
tgtgagctagagtagatccagatct

SEQ ID NO: 905767 - DNA, 25 bp, Mus musculus
tgtgagctcagcctttcctctggct

SEQ ID NO: 905768 - DNA, 25 bp, Mus musculus
tgtgagctcagcgtttcctctggct

SEQ ID NO: 905769 - DNA, 25 bp, Mus musculus
tgtgagctcaggagagtcccggctt

SEQ ID NO: 905770 - DNA, 25 bp, Mus musculus
tgtgagctcaggcttccaaccttgg

SEQ ID NO: 905771 - DNA, 25 bp, Mus musculus
tgtgagctcagggttccaaccttgg

SEQ ID NO: 905772 - DNA, 25 bp, Mus musculus
tgtgagctcaggtgagtcccggctt

SEQ ID NO: 905773 - DNA, 25 bp, Mus musculus
tgtgagctcgagacagcgctacata

SEQ ID NO: 905774 - DNA, 25 bp, Mus musculus
tgtgagctcgagtcagcgctacata

SEQ ID NO: 905775 - DNA, 25 bp, Mus musculus
tgtgagctcttcatcctaagcagaa

SEQ ID NO: 905776 - DNA, 25 bp, Mus musculus
tgtgagctcttcttcctaagcagaa

SEQ ID NO: 905777 - DNA, 25 bp, Mus musculus
tgtgagctcttgaaacaactctagt

SEQ ID NO: 905778 - DNA, 25 bp, Mus musculus
tgtgagctcttgtaacaactctagt

SEQ ID NO: 905779 - DNA, 25 bp, Mus musculus
tgtgagctgaacctctccgtgactg

SEQ ID NO: 905780 - DNA, 25 bp, Mus musculus
tgtgagctgaacgtctccgtgactg

SEQ ID NO: 905781 - DNA, 25 bp, Mus musculus
tgtgagctgatgagagcccttggca

SEQ ID NO: 905782 - DNA, 25 bp, Mus musculus
tgtgagctgatgtgagcccttggca

SEQ ID NO: 905783 - DNA, 25 bp, Mus musculus
tgtgagctggctcgacctggtccca

SEQ ID NO: 905784 - DNA, 25 bp, Mus musculus
tgtgagctggctggacctggtccca

SEQ ID NO: 905785 - DNA, 25 bp, Mus musculus
tgtgagctgggaagacctcatctta

SEQ ID NO: 905786 - DNA, 25 bp, Mus musculus
tgtgagctgggatgacctcatctta

SEQ ID NO: 905787 - DNA, 25 bp, Mus musculus
tgtgagctgtacagctgatgtcctg

SEQ ID NO: 905788 - DNA, 25 bp, Mus musculus
tgtgagctgtactgctgatgtcctg

SEQ ID NO: 905789 - DNA, 25 bp, Mus musculus
tgtgagctgtggcatgcacacatgc

SEQ ID NO: 905790 - DNA, 25 bp, Mus musculus
tgtgagctgtgggatgcacacatgc

SEQ ID NO: 905791 - DNA, 25 bp, Mus musculus
tgtgagcttgcccagttgacccgaa

SEQ ID NO: 905792 - DNA, 25 bp, Mus musculus
tgtgagcttgccgagttgacccgaa

SEQ ID NO: 905793 - DNA, 25 bp, Mus musculus
tgtgagctttctatcatgtctgacc

SEQ ID NO: 905794 - DNA, 25 bp, Mus musculus
tgtgagctttctttcatgtctgacc

SEQ ID NO: 905795 - DNA, 25 bp, Mus musculus
tgtgaggaagccattcgggcggcaa

SEQ ID NO: 905796 - DNA, 25 bp, Mus musculus
tgtgaggaagcctttcgggcggcaa

SEQ ID NO: 905797 - DNA, 25 bp, Mus musculus
tgtgaggaagttaccctgacctctc

SEQ ID NO: 905798 - DNA, 25 bp, Mus musculus
tgtgaggaagtttccctgacctctc

SEQ ID NO: 905799 - DNA, 25 bp, Mus musculus
tgtgaggacagtaggacctacaccc

SEQ ID NO: 905800 - DNA, 25 bp, Mus musculus
tgtgaggacagttggacctacaccc

SEQ ID NO: 905801 - DNA, 25 bp, Mus musculus
tgtgaggacatcacctttagcccca

SEQ ID NO: 905802 - DNA, 25 bp, Mus musculus
tgtgaggacatctcctttagcccca

SEQ ID NO: 905803 - DNA, 25 bp, Mus musculus
tgtgaggaccatatttggcattccg

SEQ ID NO: 905804 - DNA, 25 bp, Mus musculus
tgtgaggaccatttttggcattccg

SEQ ID NO: 905805 - DNA, 25 bp, Mus musculus
tgtgaggactaccttatgatctctt

SEQ ID NO: 905806 - DNA, 25 bp, Mus musculus
tgtgaggactacgttatgatctctt

SEQ ID NO: 905807 - DNA, 25 bp, Mus musculus
tgtgaggagcctcactgtcgtctga

SEQ ID NO: 905808 - DNA, 25 bp, Mus musculus
tgtgaggagcctctctctatgccta

SEQ ID NO: 905809 - DNA, 25 bp, Mus musculus
tgtgaggagcctgactgtcgtctga

SEQ ID NO: 905810 - DNA, 25 bp, Mus musculus
tgtgaggagcctgtctctatgccta

SEQ ID NO: 905811 - DNA, 25 bp, Mus musculus
tgtgaggaggtcacaggcctcgctt

SEQ ID NO: 905812 - DNA, 25 bp, Mus musculus
tgtgaggaggtctcaggcctcgctt

SEQ ID NO: 905813 - DNA, 25 bp, Mus musculus
tgtgaggatgctcccaaaaggcccc

SEQ ID NO: 905814 - DNA, 25 bp, Mus musculus
tgtgaggatgctgccaaaaggcccc

SEQ ID NO: 905815 - DNA, 25 bp, Mus musculus
tgtgaggattcgagtgcactggcct

SEQ ID NO: 905816 - DNA, 25 bp, Mus musculus
tgtgaggattcgtgtgcactggcct

SEQ ID NO: 905817 - DNA, 25 bp, Mus musculus
tgtgaggcaccaaatccgattgaca

SEQ ID NO: 905818 - DNA, 25 bp, Mus musculus
tgtgaggcaccatatccgattgaca

SEQ ID NO: 905819 - DNA, 25 bp, Mus musculus
tgtgaggcacccacttgaggtctcc

SEQ ID NO: 905820 - DNA, 25 bp, Mus musculus
tgtgaggcaccctcttgaggtctcc

SEQ ID NO: 905821 - DNA, 25 bp, Mus musculus
tgtgaggcaggcaccctttgttagc

SEQ ID NO: 905822 - DNA, 25 bp, Mus musculus
tgtgaggcaggctccctttgttagc

SEQ ID NO: 905823 - DNA, 25 bp, Mus musculus
tgtgaggcatgcagtctaaactctc

SEQ ID NO: 905824 - DNA, 25 bp, Mus musculus
tgtgaggcatgctgtctaaactctc

SEQ ID NO: 905825 - DNA, 25 bp, Mus musculus
tgtgaggccataaatgcagttccgg

SEQ ID NO: 905826 - DNA, 25 bp, Mus musculus
tgtgaggccatatatgcagttccgg

SEQ ID NO: 905827 - DNA, 25 bp, Mus musculus
tgtgaggccgccaggttactgcatc

SEQ ID NO: 905828 - DNA, 25 bp, Mus musculus
tgtgaggccgcctggttactgcatc

SEQ ID NO: 905829 - DNA, 25 bp, Mus musculus
tgtgaggcctccagtaggcaaccga

SEQ ID NO: 905830 - DNA, 25 bp, Mus musculus
tgtgaggcctcctgtaggcaaccga

SEQ ID NO: 905831 - DNA, 25 bp, Mus musculus
tgtgaggcctctcagaaccagtttt

SEQ ID NO: 905832 - DNA, 25 bp, Mus musculus
tgtgaggcctctgagaaccagtttt

SEQ ID NO: 905833 - DNA, 25 bp, Mus musculus
tgtgaggcctgtagtctaggatctt

SEQ ID NO: 905834 - DNA, 25 bp, Mus musculus
tgtgaggcctgttgtctaggatctt

SEQ ID NO: 905835 - DNA, 25 bp, Mus musculus
tgtgaggctgtaaatgaagctctga

SEQ ID NO: 905836 - DNA, 25 bp, Mus musculus
tgtgaggctgtatatgaagctctga

SEQ ID NO: 905837 - DNA, 25 bp, Mus musculus
tgtgaggctgtcctgcgtctctgat

SEQ ID NO: 905838 - DNA, 25 bp, Mus musculus
tgtgaggctgtcgtgcgtctctgat

SEQ ID NO: 905839 - DNA, 25 bp, Mus musculus
tgtgaggctttgcttccgcatcctt

SEQ ID NO: 905840 - DNA, 25 bp, Mus musculus
tgtgaggctttggttccgcatcctt

SEQ ID NO: 905841 - DNA, 25 bp, Mus musculus
tgtgagggacatagccctttaccct

SEQ ID NO: 905842 - DNA, 25 bp, Mus musculus
tgtgagggacattgccctttaccct

SEQ ID NO: 905843 - DNA, 25 bp, Mus musculus
tgtgagggaccactcccctgaacga

SEQ ID NO: 905844 - DNA, 25 bp, Mus musculus
tgtgagggaccagtcccctgaacga

SEQ ID NO: 905845 - DNA, 25 bp, Mus musculus
tgtgagggacccatagctacagctg

SEQ ID NO: 905846 - DNA, 25 bp, Mus musculus
tgtgagggacccttagctacagctg

SEQ ID NO: 905847 - DNA, 25 bp, Mus musculus
tgtgagggcatgaagaagtctgtac

SEQ ID NO: 905848 - DNA, 25 bp, Mus musculus
tgtgagggcatgtagaagtctgtac

SEQ ID NO: 905849 - DNA, 25 bp, Mus musculus
tgtgagggccccaaaaatgccaggt

SEQ ID NO: 905850 - DNA, 25 bp, Mus musculus
tgtgagggcccctaaaatgccaggt

SEQ ID NO: 905851 - DNA, 25 bp, Mus musculus
tgtgagggtcaccagagcaggcttc

SEQ ID NO: 905852 - DNA, 25 bp, Mus musculus
tgtgagggtcacgagagcaggcttc

SEQ ID NO: 905853 - DNA, 25 bp, Mus musculus
tgtgagggtctcagtatgcatatat

SEQ ID NO: 905854 - DNA, 25 bp, Mus musculus
tgtgagggtctctgtatgcatatat

SEQ ID NO: 905855 - DNA, 25 bp, Mus musculus
tgtgagggttatcagttttctcccc

SEQ ID NO: 905856 - DNA, 25 bp, Mus musculus
tgtgagggttatgagttttctcccc

SEQ ID NO: 905857 - DNA, 25 bp, Mus musculus
tgtgaggtatggaagctccctgtaa

SEQ ID NO: 905858 - DNA, 25 bp, Mus musculus
tgtgaggtatggtagctccctgtaa

SEQ ID NO: 905859 - DNA, 25 bp, Mus musculus
tgtgaggtcttgattctttcccagt

SEQ ID NO: 905860 - DNA, 25 bp, Mus musculus
tgtgaggtcttgtttctttcccagt

SEQ ID NO: 905861 - DNA, 25 bp, Mus musculus
tgtgaggtgcaaagagtctctccat

SEQ ID NO: 905862 - DNA, 25 bp, Mus musculus
tgtgaggtgcaatgagtctctccat

SEQ ID NO: 905863 - DNA, 25 bp, Mus musculus
tgtgaggttcccacccacctttaag

SEQ ID NO: 905864 - DNA, 25 bp, Mus musculus
tgtgaggttccctcccacctttaag

SEQ ID NO: 905865 - DNA, 25 bp, Mus musculus
tgtgaggttgaaatccctggttcct

SEQ ID NO: 905866 - DNA, 25 bp, Mus musculus
tgtgaggttgaattccctggttcct

SEQ ID NO: 905867 - DNA, 25 bp, Mus musculus
tgtgagtaaagcattgcaggagttt

SEQ ID NO: 905868 - DNA, 25 bp, Mus musculus
tgtgagtaaagctttgcaggagttt

SEQ ID NO: 905869 - DNA, 25 bp, Mus musculus
tgtgagtaccacagctctgggacca

SEQ ID NO: 905870 - DNA, 25 bp, Mus musculus
tgtgagtaccactgctctgggacca

SEQ ID NO: 905871 - DNA, 25 bp, Mus musculus
tgtgagtagtagacatgccctcctc

SEQ ID NO: 905872 - DNA, 25 bp, Mus musculus
tgtgagtagtagtcatgccctcctc

SEQ ID NO: 905873 - DNA, 25 bp, Mus musculus
tgtgagtattttcctcccctttcta

SEQ ID NO: 905874 - DNA, 25 bp, Mus musculus
tgtgagtattttgctcccctttcta

SEQ ID NO: 905875 - DNA, 25 bp, Mus musculus
tgtgagtcaaagcttcccagtggct

SEQ ID NO: 905876 - DNA, 25 bp, Mus musculus
tgtgagtcaaaggttcccagtggct

SEQ ID NO: 905877 - DNA, 25 bp, Mus musculus
tgtgagtcacccattgcctgctgtt

SEQ ID NO: 905878 - DNA, 25 bp, Mus musculus
tgtgagtcaccccagatcctgacag

SEQ ID NO: 905879 - DNA, 25 bp, Mus musculus
tgtgagtcacccgagatcctgacag

SEQ ID NO: 905880 - DNA, 25 bp, Mus musculus
tgtgagtcaccctttgcctgctgtt

SEQ ID NO: 905881 - DNA, 25 bp, Mus musculus
tgtgagtcaggtctttctcataatg

SEQ ID NO: 905882 - DNA, 25 bp, Mus musculus
tgtgagtcaggtgtttctcataatg

SEQ ID NO: 905883 - DNA, 25 bp, Mus musculus
tgtgagtcagtcagcgacaaggctc

SEQ ID NO: 905884 - DNA, 25 bp, Mus musculus
tgtgagtcagtctgcgacaaggctc

SEQ ID NO: 905885 - DNA, 25 bp, Mus musculus
tgtgagtccatgaaccttgtgctga

SEQ ID NO: 905886 - DNA, 25 bp, Mus musculus
tgtgagtccatgtaccttgtgctga

SEQ ID NO: 905887 - DNA, 25 bp, Mus musculus
tgtgagtcccacatccggaagaagt

SEQ ID NO: 905888 - DNA, 25 bp, Mus musculus
tgtgagtcccacatgatgggcagac

SEQ ID NO: 905889 - DNA, 25 bp, Mus musculus
tgtgagtcccacatgcactttatgc

SEQ ID NO: 905890 - DNA, 25 bp, Mus musculus
tgtgagtcccacttccggaagaagt

SEQ ID NO: 905891 - DNA, 25 bp, Mus musculus
tgtgagtcccacttgatgggcagac

SEQ ID NO: 905892 - DNA, 25 bp, Mus musculus
tgtgagtcccacttgcactttatgc

SEQ ID NO: 905893 - DNA, 25 bp, Mus musculus
tgtgagtccgtcaactggtcggtcc

SEQ ID NO: 905894 - DNA, 25 bp, Mus musculus
tgtgagtccgtctactggtcggtcc

SEQ ID NO: 905895 - DNA, 25 bp, Mus musculus
tgtgagtcctttcggcttttaccta

SEQ ID NO: 905896 - DNA, 25 bp, Mus musculus
tgtgagtcctttgggcttttaccta

SEQ ID NO: 905897 - DNA, 25 bp, Mus musculus
tgtgagtcgggaaaaaccccttctt

SEQ ID NO: 905898 - DNA, 25 bp, Mus musculus
tgtgagtcgggataaaccccttctt

SEQ ID NO: 905899 - DNA, 25 bp, Mus musculus
tgtgagtctgtgatgcttctccatc

SEQ ID NO: 905900 - DNA, 25 bp, Mus musculus
tgtgagtctgtgttgcttctccatc

SEQ ID NO: 905901 - DNA, 25 bp, Mus musculus
tgtgagtcttgcctaatctgtggag

SEQ ID NO: 905902 - DNA, 25 bp, Mus musculus
tgtgagtcttgcgtaatctgtggag

SEQ ID NO: 905903 - DNA, 25 bp, Mus musculus
tgtgagtgaacaatgagccaccttc

SEQ ID NO: 905904 - DNA, 25 bp, Mus musculus
tgtgagtgaacacacccatggcttt

SEQ ID NO: 905905 - DNA, 25 bp, Mus musculus
tgtgagtgaacagacccatggcttt

SEQ ID NO: 905906 - DNA, 25 bp, Mus musculus
tgtgagtgaacattgagccaccttc

SEQ ID NO: 905907 - DNA, 25 bp, Mus musculus
tgtgagtgaaccattctcctgagaa

SEQ ID NO: 905908 - DNA, 25 bp, Mus musculus
tgtgagtgaacctttctcctgagaa

SEQ ID NO: 905909 - DNA, 25 bp, Mus musculus
tgtgagtgaggcaacccaacctttt

SEQ ID NO: 905910 - DNA, 25 bp, Mus musculus
tgtgagtgaggctacccaacctttt

SEQ ID NO: 905911 - DNA, 25 bp, Mus musculus
tgtgagtgatctccagcctgctgaa

SEQ ID NO: 905912 - DNA, 25 bp, Mus musculus
tgtgagtgatctgcagcctgctgaa

SEQ ID NO: 905913 - DNA, 25 bp, Mus musculus
tgtgagtgcagaaagtggccatctt

SEQ ID NO: 905914 - DNA, 25 bp, Mus musculus
tgtgagtgcagatagtggccatctt

SEQ ID NO: 905915 - DNA, 25 bp, Mus musculus
tgtgagtgccgtacacgcggactgt

SEQ ID NO: 905916 - DNA, 25 bp, Mus musculus
tgtgagtgccgttcacgcggactgt

SEQ ID NO: 905917 - DNA, 25 bp, Mus musculus
tgtgagtgccttcgccgagtattca

SEQ ID NO: 905918 - DNA, 25 bp, Mus musculus
tgtgagtgccttggccgagtattca

SEQ ID NO: 905919 - DNA, 25 bp, Mus musculus
tgtgagtgctgacagccagtgctcc

SEQ ID NO: 905920 - DNA, 25 bp, Mus musculus
tgtgagtgctgagagccagtgctcc

SEQ ID NO: 905921 - DNA, 25 bp, Mus musculus
tgtgagtggttacaccccacgccct

SEQ ID NO: 905922 - DNA, 25 bp, Mus musculus
tgtgagtggttagaccccacgccct

SEQ ID NO: 905923 - DNA, 25 bp, Mus musculus
tgtgagtgtcctcaacatctgtgta

SEQ ID NO: 905924 - DNA, 25 bp, Mus musculus
tgtgagtgtcctgaacatctgtgta

SEQ ID NO: 905925 - DNA, 25 bp, Mus musculus
tgtgagttaactagtagagattttc

SEQ ID NO: 905926 - DNA, 25 bp, Mus musculus
tgtgagttaacttgtagagattttc

SEQ ID NO: 905927 - DNA, 25 bp, Mus musculus
tgtgagttagctccctcagccaggc

SEQ ID NO: 905928 - DNA, 25 bp, Mus musculus
tgtgagttagctgcctcagccaggc

SEQ ID NO: 905929 - DNA, 25 bp, Mus musculus
tgtgagttatagacttacagctggg

SEQ ID NO: 905930 - DNA, 25 bp, Mus musculus
tgtgagttatagtcttacagctggg

SEQ ID NO: 905931 - DNA, 25 bp, Mus musculus
tgtgagttcaaacccctgtagttca

SEQ ID NO: 905932 - DNA, 25 bp, Mus musculus
tgtgagttcaaagccctgtagttca

SEQ ID NO: 905933 - DNA, 25 bp, Mus musculus
tgtgagttccaaattggattgtctc

SEQ ID NO: 905934 - DNA, 25 bp, Mus musculus
tgtgagttccaatttggattgtctc

SEQ ID NO: 905935 - DNA, 25 bp, Mus musculus
tgtgagttccacagcatgcacccta

SEQ ID NO: 905936 - DNA, 25 bp, Mus musculus
tgtgagttccactgcatgcacccta

SEQ ID NO: 905937 - DNA, 25 bp, Mus musculus
tgtgagttctcccagagtcacctct

SEQ ID NO: 905938 - DNA, 25 bp, Mus musculus
tgtgagttctccgagagtcacctct

SEQ ID NO: 905939 - DNA, 25 bp, Mus musculus
tgtgagtttcacattatgtagccca

SEQ ID NO: 905940 - DNA, 25 bp, Mus musculus
tgtgagtttcactttatgtagccca

SEQ ID NO: 905941 - DNA, 25 bp, Mus musculus
tgtgagtttcttacttaaactagga

SEQ ID NO: 905942 - DNA, 25 bp, Mus musculus
tgtgagtttctttcttaaactagga

SEQ ID NO: 905943 - DNA, 25 bp, Mus musculus
tgtgagtttgcaacccaggtggccc

SEQ ID NO: 905944 - DNA, 25 bp, Mus musculus
tgtgagtttgcatcccaggtggccc

SEQ ID NO: 905945 - DNA, 25 bp, Mus musculus
tgtgagtttgccacggctagccttg

SEQ ID NO: 905946 - DNA, 25 bp, Mus musculus
tgtgagtttgcctcggctagccttg

SEQ ID NO: 905947 - DNA, 25 bp, Mus musculus
tgtgagtttgcgagtccagttttca

SEQ ID NO: 905948 - DNA, 25 bp, Mus musculus
tgtgagtttgcgtgtccagttttca

SEQ ID NO: 905949 - DNA, 25 bp, Mus musculus
tgtgagtttgtactgagacccctgc

SEQ ID NO: 905950 - DNA, 25 bp, Mus musculus
tgtgagtttgtagtgagacccctgc

SEQ ID NO: 905951 - DNA, 25 bp, Mus musculus
tgtgagtttttactgaaccttcctt

SEQ ID NO: 905952 - DNA, 25 bp, Mus musculus
tgtgagtttttagtgaaccttcctt

SEQ ID NO: 905953 - DNA, 25 bp, Mus musculus
tgtgataaatcgaacacccacccaa

SEQ ID NO: 905954 - DNA, 25 bp, Mus musculus
tgtgataaatcgtacacccacccaa

SEQ ID NO: 905955 - DNA, 25 bp, Mus musculus
tgtgataacgtcagcaaagtgggtc

SEQ ID NO: 905956 - DNA, 25 bp, Mus musculus
tgtgataacgtctgcaaagtgggtc

SEQ ID NO: 905957 - DNA, 25 bp, Mus musculus
tgtgataattagaatgcatcttacc

SEQ ID NO: 905958 - DNA, 25 bp, Mus musculus
tgtgataattagtatgcatcttacc

SEQ ID NO: 905959 - DNA, 25 bp, Mus musculus
tgtgatacattacggccagcgttaa

SEQ ID NO: 905960 - DNA, 25 bp, Mus musculus
tgtgatacattagggccagcgttaa

SEQ ID NO: 905961 - DNA, 25 bp, Mus musculus
tgtgataccaaactcatctctttcc

SEQ ID NO: 905962 - DNA, 25 bp, Mus musculus
tgtgataccaaagtcatctctttcc

SEQ ID NO: 905963 - DNA, 25 bp, Mus musculus
tgtgataccattcctgttatgccgg

SEQ ID NO: 905964 - DNA, 25 bp, Mus musculus
tgtgataccattgctgttatgccgg

SEQ ID NO: 905965 - DNA, 25 bp, Mus musculus
tgtgatacttaccacctgacttacc

SEQ ID NO: 905966 - DNA, 25 bp, Mus musculus
tgtgatacttacgacctgacttacc

SEQ ID NO: 905967 - DNA, 25 bp, Mus musculus
tgtgatagaacaaacccaaggccat

SEQ ID NO: 905968 - DNA, 25 bp, Mus musculus
tgtgatagaacatacccaaggccat

SEQ ID NO: 905969 - DNA, 25 bp, Mus musculus
tgtgatagacagaccaaagagcctc

SEQ ID NO: 905970 - DNA, 25 bp, Mus musculus
tgtgatagacagtccaaagagcctc

SEQ ID NO: 905971 - DNA, 25 bp, Mus musculus
tgtgataggatcatcaaccaaagtg

SEQ ID NO: 905972 - DNA, 25 bp, Mus musculus
tgtgataggatcttcaaccaaagtg

SEQ ID NO: 905973 - DNA, 25 bp, Mus musculus
tgtgatagtcttagcagggctgtga

SEQ ID NO: 905974 - DNA, 25 bp, Mus musculus
tgtgatagtctttgcagggctgtga

SEQ ID NO: 905975 - DNA, 25 bp, Mus musculus
tgtgatatggttcgcatacccctgc

SEQ ID NO: 905976 - DNA, 25 bp, Mus musculus
tgtgatatggttggcatacccctgc

SEQ ID NO: 905977 - DNA, 25 bp, Mus musculus
tgtgatcaacctcggttatcccaga

SEQ ID NO: 905978 - DNA, 25 bp, Mus musculus
tgtgatcaacctgggttatcccaga

SEQ ID NO: 905979 - DNA, 25 bp, Mus musculus
tgtgatcaacgtagagcttcctcct

SEQ ID NO: 905980 - DNA, 25 bp, Mus musculus
tgtgatcaacgttgagcttcctcct

SEQ ID NO: 905981 - DNA, 25 bp, Mus musculus
tgtgatcaaggcactgttagaggtg

SEQ ID NO: 905982 - DNA, 25 bp, Mus musculus
tgtgatcaaggctctgttagaggtg

SEQ ID NO: 905983 - DNA, 25 bp, Mus musculus
tgtgatcacacgcagagacgcggaa

SEQ ID NO: 905984 - DNA, 25 bp, Mus musculus
tgtgatcacacggagagacgcggaa

SEQ ID NO: 905985 - DNA, 25 bp, Mus musculus
tgtgatcactgtcgtcgtgggacct

SEQ ID NO: 905986 - DNA, 25 bp, Mus musculus
tgtgatcactgtggtcgtgggacct

SEQ ID NO: 905987 - DNA, 25 bp, Mus musculus
tgtgatcagaagcaccccaggaatt

SEQ ID NO: 905988 - DNA, 25 bp, Mus musculus
tgtgatcagaaggaccccaggaatt

SEQ ID NO: 905989 - DNA, 25 bp, Mus musculus
tgtgatcatattcattctcctccta

SEQ ID NO: 905990 - DNA, 25 bp, Mus musculus
tgtgatcatattgattctcctccta

SEQ ID NO: 905991 - DNA, 25 bp, Mus musculus
tgtgatcatctgatggccacaccgc

SEQ ID NO: 905992 - DNA, 25 bp, Mus musculus
tgtgatcatctgttggccacaccgc

SEQ ID NO: 905993 - DNA, 25 bp, Mus musculus
tgtgatcatgatccgccttcagaaa

SEQ ID NO: 905994 - DNA, 25 bp, Mus musculus
tgtgatcatgatgcgccttcagaaa

SEQ ID NO: 905995 - DNA, 25 bp, Mus musculus
tgtgatccacacctgaaatgctaaa

SEQ ID NO: 905996 - DNA, 25 bp, Mus musculus
tgtgatccacacgtgaaatgctaaa

SEQ ID NO: 905997 - DNA, 25 bp, Mus musculus
tgtgatccagcacttgaatgtgcag

SEQ ID NO: 905998 - DNA, 25 bp, Mus musculus
tgtgatccagcagttgaatgtgcag

SEQ ID NO: 905999 - DNA, 25 bp, Mus musculus
tgtgatccccacatggtagaaagga

SEQ ID NO: 906000 - DNA, 25 bp, Mus musculus
tgtgatccccacttggtagaaagga

SEQ ID NO: 906001 - DNA, 25 bp, Mus musculus
tgtgatcccgctcagtcagagccag

SEQ ID NO: 906002 - DNA, 25 bp, Mus musculus
tgtgatcccgctgagtcagagccag

SEQ ID NO: 906003 - DNA, 25 bp, Mus musculus
tgtgatcctcacaacctacataaag

SEQ ID NO: 906004 - DNA, 25 bp, Mus musculus
tgtgatcctcactacctacataaag

SEQ ID NO: 906005 - DNA, 25 bp, Mus musculus
tgtgatcctctccatcaggactgag

SEQ ID NO: 906006 - DNA, 25 bp, Mus musculus
tgtgatcctctcgatcaggactgag

SEQ ID NO: 906007 - DNA, 25 bp, Mus musculus
tgtgatccttctcgcgcaatgttac

SEQ ID NO: 906008 - DNA, 25 bp, Mus musculus
tgtgatccttctggcgcaatgttac

SEQ ID NO: 906009 - DNA, 25 bp, Mus musculus
tgtgatcgatttccttgagcctcag

SEQ ID NO: 906010 - DNA, 25 bp, Mus musculus
tgtgatcgatttgcttgagcctcag

SEQ ID NO: 906011 - DNA, 25 bp, Mus musculus
tgtgatcggtgaatagctgccacct

SEQ ID NO: 906012 - DNA, 25 bp, Mus musculus
tgtgatcggtgattagctgccacct

SEQ ID NO: 906013 - DNA, 25 bp, Mus musculus
tgtgatctacttcgccatcatcagc

SEQ ID NO: 906014 - DNA, 25 bp, Mus musculus
tgtgatctacttggccatcatcagc

SEQ ID NO: 906015 - DNA, 25 bp, Mus musculus
tgtgatctcacgaaagcgcttggga

SEQ ID NO: 906016 - DNA, 25 bp, Mus musculus
tgtgatctcacgtaagcgcttggga

SEQ ID NO: 906017 - DNA, 25 bp, Mus musculus
tgtgatctcagcaatcaggaagact

SEQ ID NO: 906018 - DNA, 25 bp, Mus musculus
tgtgatctcagctatcaggaagact

SEQ ID NO: 906019 - DNA, 25 bp, Mus musculus
tgtgatctccgtaactccagtaact

SEQ ID NO: 906020 - DNA, 25 bp, Mus musculus
tgtgatctccgttactccagtaact

SEQ ID NO: 906021 - DNA, 25 bp, Mus musculus
tgtgatctcctaacctgaagtgcag

SEQ ID NO: 906022 - DNA, 25 bp, Mus musculus
tgtgatctcctatcctgaagtgcag

SEQ ID NO: 906023 - DNA, 25 bp, Mus musculus
tgtgatctcttaatgctccacatcc

SEQ ID NO: 906024 - DNA, 25 bp, Mus musculus
tgtgatctcttattgctccacatcc

SEQ ID NO: 906025 - DNA, 25 bp, Mus musculus
tgtgatctctttcatcccgagtttc

SEQ ID NO: 906026 - DNA, 25 bp, Mus musculus
tgtgatctctttgatcccgagtttc

SEQ ID NO: 906027 - DNA, 25 bp, Mus musculus
tgtgatctgcacaggccacttggca

SEQ ID NO: 906028 - DNA, 25 bp, Mus musculus
tgtgatctgcactggccacttggca

SEQ ID NO: 906029 - DNA, 25 bp, Mus musculus
tgtgatctgcccaacatgtgggtgc

SEQ ID NO: 906030 - DNA, 25 bp, Mus musculus
tgtgatctgccctacatgtgggtgc

SEQ ID NO: 906031 - DNA, 25 bp, Mus musculus
tgtgatctgcttactcaggactctc

SEQ ID NO: 906032 - DNA, 25 bp, Mus musculus
tgtgatctgcttccatcatgtctca

SEQ ID NO: 906033 - DNA, 25 bp, Mus musculus
tgtgatctgcttgcatcatgtctca

SEQ ID NO: 906034 - DNA, 25 bp, Mus musculus
tgtgatctgctttctcaggactctc

SEQ ID NO: 906035 - DNA, 25 bp, Mus musculus
tgtgatctgtaactgactcctgcct

SEQ ID NO: 906036 - DNA, 25 bp, Mus musculus
tgtgatctgtaagtgactcctgcct

SEQ ID NO: 906037 - DNA, 25 bp, Mus musculus
tgtgatcttagaactcaggagtctg

SEQ ID NO: 906038 - DNA, 25 bp, Mus musculus
tgtgatcttagatctcaggagtctg

SEQ ID NO: 906039 - DNA, 25 bp, Mus musculus
tgtgatcttcagcaccatactggat

SEQ ID NO: 906040 - DNA, 25 bp, Mus musculus
tgtgatcttcaggaccatactggat

SEQ ID NO: 906041 - DNA, 25 bp, Mus musculus
tgtgatcttgccagggacgtgtccc

SEQ ID NO: 906042 - DNA, 25 bp, Mus musculus
tgtgatcttgcctgggacgtgtccc

SEQ ID NO: 906043 - DNA, 25 bp, Mus musculus
tgtgatctttctctgggttagccca

SEQ ID NO: 906044 - DNA, 25 bp, Mus musculus
tgtgatctttctgtgggttagccca

SEQ ID NO: 906045 - DNA, 25 bp, Mus musculus
tgtgatgaagtcaccttgcggtctg

SEQ ID NO: 906046 - DNA, 25 bp, Mus musculus
tgtgatgaagtcagcctggcaggct

SEQ ID NO: 906047 - DNA, 25 bp, Mus musculus
tgtgatgaagtctccttgcggtctg

SEQ ID NO: 906048 - DNA, 25 bp, Mus musculus
tgtgatgaagtctgcctggcaggct

SEQ ID NO: 906049 - DNA, 25 bp, Mus musculus
tgtgatgaccacatcacaggtgaaa

SEQ ID NO: 906050 - DNA, 25 bp, Mus musculus
tgtgatgaccacttcacaggtgaaa

SEQ ID NO: 906051 - DNA, 25 bp, Mus musculus
tgtgatgatacgatttggcccttaa

SEQ ID NO: 906052 - DNA, 25 bp, Mus musculus
tgtgatgatacgttttggcccttaa

SEQ ID NO: 906053 - DNA, 25 bp, Mus musculus
tgtgatgattgtcattctcagggac

SEQ ID NO: 906054 - DNA, 25 bp, Mus musculus
tgtgatgattgtgattctcagggac

SEQ ID NO: 906055 - DNA, 25 bp, Mus musculus
tgtgatgcactgaaccgctggttgg

SEQ ID NO: 906056 - DNA, 25 bp, Mus musculus
tgtgatgcactgtaccgctggttgg

SEQ ID NO: 906057 - DNA, 25 bp, Mus musculus
tgtgatgcacttctgccagcaaggc

SEQ ID NO: 906058 - DNA, 25 bp, Mus musculus
tgtgatgcacttgtgccagcaaggc

SEQ ID NO: 906059 - DNA, 25 bp, Mus musculus
tgtgatgcagatccatcagccctag

SEQ ID NO: 906060 - DNA, 25 bp, Mus musculus
tgtgatgcagatgcatcagccctag

SEQ ID NO: 906061 - DNA, 25 bp, Mus musculus
tgtgatgcaggtacactttacaaaa

SEQ ID NO: 906062 - DNA, 25 bp, Mus musculus
tgtgatgcaggttcactttacaaaa

SEQ ID NO: 906063 - DNA, 25 bp, Mus musculus
tgtgatgcatctccctgaacctgag

SEQ ID NO: 906064 - DNA, 25 bp, Mus musculus
tgtgatgcatctgcctgaacctgag

SEQ ID NO: 906065 - DNA, 25 bp, Mus musculus
tgtgatgccagcatctctacccttc

SEQ ID NO: 906066 - DNA, 25 bp, Mus musculus
tgtgatgccagcttctctacccttc

SEQ ID NO: 906067 - DNA, 25 bp, Mus musculus
tgtgatgcccttcaagcctacgcta

SEQ ID NO: 906068 - DNA, 25 bp, Mus musculus
tgtgatgcccttgaagcctacgcta

SEQ ID NO: 906069 - DNA, 25 bp, Mus musculus
tgtgatgcctagcttttgccaagat

SEQ ID NO: 906070 - DNA, 25 bp, Mus musculus
tgtgatgcctaggttttgccaagat

SEQ ID NO: 906071 - DNA, 25 bp, Mus musculus
tgtgatgctaccatacagtcagaat

SEQ ID NO: 906072 - DNA, 25 bp, Mus musculus
tgtgatgctaccttacagtcagaat

SEQ ID NO: 906073 - DNA, 25 bp, Mus musculus
tgtgatgctcacaatggccacggtg

SEQ ID NO: 906074 - DNA, 25 bp, Mus musculus
tgtgatgctcactatggccacggtg

SEQ ID NO: 906075 - DNA, 25 bp, Mus musculus
tgtgatgctggaacttactaaacgc

SEQ ID NO: 906076 - DNA, 25 bp, Mus musculus
tgtgatgctggatcttactaaacgc

SEQ ID NO: 906077 - DNA, 25 bp, Mus musculus
tgtgatggacagagatttgacttcc

SEQ ID NO: 906078 - DNA, 25 bp, Mus musculus
tgtgatggacagtgatttgacttcc

SEQ ID NO: 906079 - DNA, 25 bp, Mus musculus
tgtgatggcccaacccctgatgtgg

SEQ ID NO: 906080 - DNA, 25 bp, Mus musculus
tgtgatggcccatcccctgatgtgg

SEQ ID NO: 906081 - DNA, 25 bp, Mus musculus
tgtgatggctccagccatacactgc

SEQ ID NO: 906082 - DNA, 25 bp, Mus musculus
tgtgatggctcctgccatacactgc

SEQ ID NO: 906083 - DNA, 25 bp, Mus musculus
tgtgatggctgactacgggctctac

SEQ ID NO: 906084 - DNA, 25 bp, Mus musculus
tgtgatggctgagtacgggctctac

SEQ ID NO: 906085 - DNA, 25 bp, Mus musculus
tgtgatggtagcacctgtagcccca

SEQ ID NO: 906086 - DNA, 25 bp, Mus musculus
tgtgatggtagctcctgtagcccca

SEQ ID NO: 906087 - DNA, 25 bp, Mus musculus
tgtgatggtgaacaactaccgcccg

SEQ ID NO: 906088 - DNA, 25 bp, Mus musculus
tgtgatggtgaagaactaccgcccg

SEQ ID NO: 906089 - DNA, 25 bp, Mus musculus
tgtgatggtgttagtccctgtctta

SEQ ID NO: 906090 - DNA, 25 bp, Mus musculus
tgtgatggtgtttgtccctgtctta

SEQ ID NO: 906091 - DNA, 25 bp, Mus musculus
tgtgatgtcactacctgcccctgca

SEQ ID NO: 906092 - DNA, 25 bp, Mus musculus
tgtgatgtcacttcctgcccctgca

SEQ ID NO: 906093 - DNA, 25 bp, Mus musculus
tgtgatgtccatctttagagttctg

SEQ ID NO: 906094 - DNA, 25 bp, Mus musculus
tgtgatgtccatgtttagagttctg

SEQ ID NO: 906095 - DNA, 25 bp, Mus musculus
tgtgatgtccctcagtctgctgtgg

SEQ ID NO: 906096 - DNA, 25 bp, Mus musculus
tgtgatgtccctgagtctgctgtgg

SEQ ID NO: 906097 - DNA, 25 bp, Mus musculus
tgtgatgtctcactgccgttcaaag

SEQ ID NO: 906098 - DNA, 25 bp, Mus musculus
tgtgatgtctcagtgccgttcaaag

SEQ ID NO: 906099 - DNA, 25 bp, Mus musculus
tgtgatgtgatcagctgatttctga

SEQ ID NO: 906100 - DNA, 25 bp, Mus musculus
tgtgatgtgatctgctgatttctga

SEQ ID NO: 906101 - DNA, 25 bp, Mus musculus
tgtgatgtgcacactcagtattgct

SEQ ID NO: 906102 - DNA, 25 bp, Mus musculus
tgtgatgtgcactctcagtattgct

SEQ ID NO: 906103 - DNA, 25 bp, Mus musculus
tgtgatgtgcagaattggtttcgga

SEQ ID NO: 906104 - DNA, 25 bp, Mus musculus
tgtgatgtgcagtattggtttcgga

SEQ ID NO: 906105 - DNA, 25 bp, Mus musculus
tgtgatgtgcttatccagtatcttc

SEQ ID NO: 906106 - DNA, 25 bp, Mus musculus
tgtgatgtgcttttccagtatcttc

SEQ ID NO: 906107 - DNA, 25 bp, Mus musculus
tgtgatgtggctccgtgattgccta

SEQ ID NO: 906108 - DNA, 25 bp, Mus musculus
tgtgatgtggctgcgtgattgccta

SEQ ID NO: 906109 - DNA, 25 bp, Mus musculus
tgtgatgtgtcacatgtgctgacct

SEQ ID NO: 906110 - DNA, 25 bp, Mus musculus
tgtgatgtgtcagatgtgctgacct

SEQ ID NO: 906111 - DNA, 25 bp, Mus musculus
tgtgatgtgttccaggtttagccta

SEQ ID NO: 906112 - DNA, 25 bp, Mus musculus
tgtgatgtgttcgaggtttagccta

SEQ ID NO: 906113 - DNA, 25 bp, Mus musculus
tgtgatgtgttgacttctcacctca

SEQ ID NO: 906114 - DNA, 25 bp, Mus musculus
tgtgatgtgttgtcttctcacctca

SEQ ID NO: 906115 - DNA, 25 bp, Mus musculus
tgtgatgttcacaagaccctagtga

SEQ ID NO: 906116 - DNA, 25 bp, Mus musculus
tgtgatgttcactagaccctagtga

SEQ ID NO: 906117 - DNA, 25 bp, Mus musculus
tgtgatgttcttcccagttgtgtta

SEQ ID NO: 906118 - DNA, 25 bp, Mus musculus
tgtgatgttcttgccagttgtgtta

SEQ ID NO: 906119 - DNA, 25 bp, Mus musculus
tgtgatgttgatagccatgtatttc

SEQ ID NO: 906120 - DNA, 25 bp, Mus musculus
tgtgatgttgattgccatgtatttc

SEQ ID NO: 906121 - DNA, 25 bp, Mus musculus
tgtgattaaggcaccccttctatat

SEQ ID NO: 906122 - DNA, 25 bp, Mus musculus
tgtgattaaggctccccttctatat

SEQ ID NO: 906123 - DNA, 25 bp, Mus musculus
tgtgattacaaaccttttcccaaag

SEQ ID NO: 906124 - DNA, 25 bp, Mus musculus
tgtgattacaaagcttttcccaaag

SEQ ID NO: 906125 - DNA, 25 bp, Mus musculus
tgtgattacagaccatctggccctc

SEQ ID NO: 906126 - DNA, 25 bp, Mus musculus
tgtgattacagagcatctggccctc

SEQ ID NO: 906127 - DNA, 25 bp, Mus musculus
tgtgattacctgagcatccgcgggt

SEQ ID NO: 906128 - DNA, 25 bp, Mus musculus
tgtgattacctgtgcatccgcgggt

SEQ ID NO: 906129 - DNA, 25 bp, Mus musculus
tgtgattaccttaccccaaagcaga

SEQ ID NO: 906130 - DNA, 25 bp, Mus musculus
tgtgattacctttccccaaagcaga

SEQ ID NO: 906131 - DNA, 25 bp, Mus musculus
tgtgattagcaaccgtgctcacgtg

SEQ ID NO: 906132 - DNA, 25 bp, Mus musculus
tgtgattagcaagcgtgctcacgtg

SEQ ID NO: 906133 - DNA, 25 bp, Mus musculus
tgtgattatcaaaggccacccacct

SEQ ID NO: 906134 - DNA, 25 bp, Mus musculus
tgtgattatcaatggccacccacct

SEQ ID NO: 906135 - DNA, 25 bp, Mus musculus
tgtgattcactgaacccatctttac

SEQ ID NO: 906136 - DNA, 25 bp, Mus musculus
tgtgattcactgtacccatctttac

SEQ ID NO: 906137 - DNA, 25 bp, Mus musculus
tgtgattcagttattcaagcctttt

SEQ ID NO: 906138 - DNA, 25 bp, Mus musculus
tgtgattcagtttttcaagcctttt

SEQ ID NO: 906139 - DNA, 25 bp, Mus musculus
tgtgattcatcaacgctacagggaa

SEQ ID NO: 906140 - DNA, 25 bp, Mus musculus
tgtgattcatcatcgctacagggaa

SEQ ID NO: 906141 - DNA, 25 bp, Mus musculus
tgtgattccagaaaagcctttccta

SEQ ID NO: 906142 - DNA, 25 bp, Mus musculus
tgtgattccagataagcctttccta

SEQ ID NO: 906143 - DNA, 25 bp, Mus musculus
tgtgattcccaacatgacatgttga

SEQ ID NO: 906144 - DNA, 25 bp, Mus musculus
tgtgattcccaagatgacatgttga

SEQ ID NO: 906145 - DNA, 25 bp, Mus musculus
tgtgattccctacttccagaacaga

SEQ ID NO: 906146 - DNA, 25 bp, Mus musculus
tgtgattccctagttccagaacaga

SEQ ID NO: 906147 - DNA, 25 bp, Mus musculus
tgtgattcctatctgtgccctttga

SEQ ID NO: 906148 - DNA, 25 bp, Mus musculus
tgtgattcctatgtgtgccctttga

SEQ ID NO: 906149 - DNA, 25 bp, Mus musculus
tgtgattcctgccatgcaatgctca

SEQ ID NO: 906150 - DNA, 25 bp, Mus musculus
tgtgattcctgcgatgcaatgctca

SEQ ID NO: 906151 - DNA, 25 bp, Mus musculus
tgtgattcctggaggctcatctact

SEQ ID NO: 906152 - DNA, 25 bp, Mus musculus
tgtgattcctggtggctcatctact

SEQ ID NO: 906153 - DNA, 25 bp, Mus musculus
tgtgattccttcatgtttgctttcg

SEQ ID NO: 906154 - DNA, 25 bp, Mus musculus
tgtgattccttcttgtttgctttcg

SEQ ID NO: 906155 - DNA, 25 bp, Mus musculus
tgtgattcttatacctcagtacccc

SEQ ID NO: 906156 - DNA, 25 bp, Mus musculus
tgtgattcttattcctcagtacccc

SEQ ID NO: 906157 - DNA, 25 bp, Mus musculus
tgtgattctttaacccgatcctcga

SEQ ID NO: 906158 - DNA, 25 bp, Mus musculus
tgtgattctttatcccgatcctcga

SEQ ID NO: 906159 - DNA, 25 bp, Mus musculus
tgtgattgacatagaccgtggagaa

SEQ ID NO: 906160 - DNA, 25 bp, Mus musculus
tgtgattgacattgaccgtggagaa

SEQ ID NO: 906161 - DNA, 25 bp, Mus musculus
tgtgattgatcactgcagccccaaa

SEQ ID NO: 906162 - DNA, 25 bp, Mus musculus
tgtgattgatcagtgcagccccaaa

SEQ ID NO: 906163 - DNA, 25 bp, Mus musculus
tgtgattgcaggctcaaatgtcatt

SEQ ID NO: 906164 - DNA, 25 bp, Mus musculus
tgtgattgcagggtcaaatgtcatt

SEQ ID NO: 906165 - DNA, 25 bp, Mus musculus
tgtgattgcttgagtttcgtatttc

SEQ ID NO: 906166 - DNA, 25 bp, Mus musculus
tgtgattgcttgtgtttcgtatttc

SEQ ID NO: 906167 - DNA, 25 bp, Mus musculus
tgtgattgggctctcgggaaccctt

SEQ ID NO: 906168 - DNA, 25 bp, Mus musculus
tgtgattgggctgtcgggaaccctt

SEQ ID NO: 906169 - DNA, 25 bp, Mus musculus
tgtgattgtacaaagccagctctct

SEQ ID NO: 906170 - DNA, 25 bp, Mus musculus
tgtgattgtacatagccagctctct

SEQ ID NO: 906171 - DNA, 25 bp, Mus musculus
tgtgattgtcgacacggcccgctct

SEQ ID NO: 906172 - DNA, 25 bp, Mus musculus
tgtgattgtcgagacggcccgctct

SEQ ID NO: 906173 - DNA, 25 bp, Mus musculus
tgtgattgtcttacattcattcccc

SEQ ID NO: 906174 - DNA, 25 bp, Mus musculus
tgtgattgtctttcattcattcccc

SEQ ID NO: 906175 - DNA, 25 bp, Mus musculus
tgtgattgttggattccgagaagct

SEQ ID NO: 906176 - DNA, 25 bp, Mus musculus
tgtgattgttggtttccgagaagct

SEQ ID NO: 906177 - DNA, 25 bp, Mus musculus
tgtgatttaaatacactctcagtca

SEQ ID NO: 906178 - DNA, 25 bp, Mus musculus
tgtgatttaaattcactctcagtca

SEQ ID NO: 906179 - DNA, 25 bp, Mus musculus
tgtgatttagttaatcctccctcta

SEQ ID NO: 906180 - DNA, 25 bp, Mus musculus
tgtgatttagttaattgctcgtaaa

SEQ ID NO: 906181 - DNA, 25 bp, Mus musculus
tgtgatttagtttatcctccctcta

SEQ ID NO: 906182 - DNA, 25 bp, Mus musculus
tgtgatttagtttattgctcgtaaa

SEQ ID NO: 906183 - DNA, 25 bp, Mus musculus
tgtgatttcacaatctgtgaacacc

SEQ ID NO: 906184 - DNA, 25 bp, Mus musculus
tgtgatttcacattctgtgaacacc

SEQ ID NO: 906185 - DNA, 25 bp, Mus musculus
tgtgatttcatacgcgggaaggcat

SEQ ID NO: 906186 - DNA, 25 bp, Mus musculus
tgtgatttcataggcgggaaggcat

SEQ ID NO: 906187 - DNA, 25 bp, Mus musculus
tgtgatttccaactagttaaggttt

SEQ ID NO: 906188 - DNA, 25 bp, Mus musculus
tgtgatttccaagtagttaaggttt

SEQ ID NO: 906189 - DNA, 25 bp, Mus musculus
tgtgatttccttagtccttccaagc

SEQ ID NO: 906190 - DNA, 25 bp, Mus musculus
tgtgatttcctttgtccttccaagc

SEQ ID NO: 906191 - DNA, 25 bp, Mus musculus
tgtgatttctagacttgcaaagctg

SEQ ID NO: 906192 - DNA, 25 bp, Mus musculus
tgtgatttctagtcttgcaaagctg

SEQ ID NO: 906193 - DNA, 25 bp, Mus musculus
tgtgatttctctctcaggccttcca

SEQ ID NO: 906194 - DNA, 25 bp, Mus musculus
tgtgatttctctgtcaggccttcca

SEQ ID NO: 906195 - DNA, 25 bp, Mus musculus
tgtgattttcctctctcagaactca

SEQ ID NO: 906196 - DNA, 25 bp, Mus musculus
tgtgattttcctgtctcagaactca

SEQ ID NO: 906197 - DNA, 25 bp, Mus musculus
tgtgatttttagaggctccggcaac

SEQ ID NO: 906198 - DNA, 25 bp, Mus musculus
tgtgatttttagtggctccggcaac

SEQ ID NO: 906199 - DNA, 25 bp, Mus musculus
tgtgcaaagctcctagttaccccat

SEQ ID NO: 906200 - DNA, 25 bp, Mus musculus
tgtgcaaagctcgtagttaccccat

SEQ ID NO: 906201 - DNA, 25 bp, Mus musculus
tgtgcaaagtataatccccagggct

SEQ ID NO: 906202 - DNA, 25 bp, Mus musculus
tgtgcaaagtattatccccagggct

SEQ ID NO: 906203 - DNA, 25 bp, Mus musculus
tgtgcaaatgtgaagagctggacca

SEQ ID NO: 906204 - DNA, 25 bp, Mus musculus
tgtgcaaatgtgtagagctggacca

SEQ ID NO: 906205 - DNA, 25 bp, Mus musculus
tgtgcaacaaacatagtgaagctgt

SEQ ID NO: 906206 - DNA, 25 bp, Mus musculus
tgtgcaacaaacttagtgaagctgt

SEQ ID NO: 906207 - DNA, 25 bp, Mus musculus
tgtgcaacaagtaccgtgtgggcca

SEQ ID NO: 906208 - DNA, 25 bp, Mus musculus
tgtgcaacaagttccgtgtgggcca

SEQ ID NO: 906209 - DNA, 25 bp, Mus musculus
tgtgcaacatcacgttcagcagcct

SEQ ID NO: 906210 - DNA, 25 bp, Mus musculus
tgtgcaacatcaggttcagcagcct

SEQ ID NO: 906211 - DNA, 25 bp, Mus musculus
tgtgcaacatctcatcttccttaag

SEQ ID NO: 906212 - DNA, 25 bp, Mus musculus
tgtgcaacatctgatcttccttaag

SEQ ID NO: 906213 - DNA, 25 bp, Mus musculus
tgtgcaaccaagcagaaggttttct

SEQ ID NO: 906214 - DNA, 25 bp, Mus musculus
tgtgcaaccaaggagaaggttttct

SEQ ID NO: 906215 - DNA, 25 bp, Mus musculus
tgtgcaacccctagatggacagctt

SEQ ID NO: 906216 - DNA, 25 bp, Mus musculus
tgtgcaaccccttgatggacagctt

SEQ ID NO: 906217 - DNA, 25 bp, Mus musculus
tgtgcaaccgcaagctggccgacat

SEQ ID NO: 906218 - DNA, 25 bp, Mus musculus
tgtgcaaccgcatgctggccgacat

SEQ ID NO: 906219 - DNA, 25 bp, Mus musculus
tgtgcaaccgcgacgagtatctgaa

SEQ ID NO: 906220 - DNA, 25 bp, Mus musculus
tgtgcaaccgcgtcgagtatctgaa

SEQ ID NO: 906221 - DNA, 25 bp, Mus musculus
tgtgcaacgttgaagtaggtattta

SEQ ID NO: 906222 - DNA, 25 bp, Mus musculus
tgtgcaacgttgtagtaggtattta

SEQ ID NO: 906223 - DNA, 25 bp, Mus musculus
tgtgcaactcctctgttcttttatt

SEQ ID NO: 906224 - DNA, 25 bp, Mus musculus
tgtgcaactcctgtgttcttttatt

SEQ ID NO: 906225 - DNA, 25 bp, Mus musculus
tgtgcaactcttatgtctcttaggg

SEQ ID NO: 906226 - DNA, 25 bp, Mus musculus
tgtgcaactcttttgtctcttaggg

SEQ ID NO: 906227 - DNA, 25 bp, Mus musculus
tgtgcaactgaaacccttccagact

SEQ ID NO: 906228 - DNA, 25 bp, Mus musculus
tgtgcaactgaatcccttccagact

SEQ ID NO: 906229 - DNA, 25 bp, Mus musculus
tgtgcaactgacctacagacactct

SEQ ID NO: 906230 - DNA, 25 bp, Mus musculus
tgtgcaactgacgtacagacactct

SEQ ID NO: 906231 - DNA, 25 bp, Mus musculus
tgtgcaactttcatagtcctactgg

SEQ ID NO: 906232 - DNA, 25 bp, Mus musculus
tgtgcaactttcttagtcctactgg

SEQ ID NO: 906233 - DNA, 25 bp, Mus musculus
tgtgcaacttttactgtaactgctt

SEQ ID NO: 906234 - DNA, 25 bp, Mus musculus
tgtgcaactttttctgtaactgctt

SEQ ID NO: 906235 - DNA, 25 bp, Mus musculus
tgtgcaagaggtactcactcagctc

SEQ ID NO: 906236 - DNA, 25 bp, Mus musculus
tgtgcaagaggttctcactcagctc

SEQ ID NO: 906237 - DNA, 25 bp, Mus musculus
tgtgcaagatatcccttcggctctt

SEQ ID NO: 906238 - DNA, 25 bp, Mus musculus
tgtgcaagatatgccttcggctctt

SEQ ID NO: 906239 - DNA, 25 bp, Mus musculus
tgtgcaagatttaaccacccaacta

SEQ ID NO: 906240 - DNA, 25 bp, Mus musculus
tgtgcaagattttaccacccaacta

SEQ ID NO: 906241 - DNA, 25 bp, Mus musculus
tgtgcaagccgcctgcatggttcag

SEQ ID NO: 906242 - DNA, 25 bp, Mus musculus
tgtgcaagccgcgtgcatggttcag

SEQ ID NO: 906243 - DNA, 25 bp, Mus musculus
tgtgcaagcctgcttcaacagatcc

SEQ ID NO: 906244 - DNA, 25 bp, Mus musculus
tgtgcaagcctggttcaacagatcc

SEQ ID NO: 906245 - DNA, 25 bp, Mus musculus
tgtgcaaggacaatgctgtgggcct

SEQ ID NO: 906246 - DNA, 25 bp, Mus musculus
tgtgcaaggacattgctgtgggcct

SEQ ID NO: 906247 - DNA, 25 bp, Mus musculus
tgtgcaaggccaaaatgaccagttt

SEQ ID NO: 906248 - DNA, 25 bp, Mus musculus
tgtgcaaggccataatgaccagttt

SEQ ID NO: 906249 - DNA, 25 bp, Mus musculus
tgtgcaagggcacgaaccatcattt

SEQ ID NO: 906250 - DNA, 25 bp, Mus musculus
tgtgcaagggcaggaaccatcattt

SEQ ID NO: 906251 - DNA, 25 bp, Mus musculus
tgtgcaagtcgaagtgaacaagctt

SEQ ID NO: 906252 - DNA, 25 bp, Mus musculus
tgtgcaagtcgatgtgaacaagctt

SEQ ID NO: 906253 - DNA, 25 bp, Mus musculus
tgtgcaagttggagtcacacacaca

SEQ ID NO: 906254 - DNA, 25 bp, Mus musculus
tgtgcaagttggtgtcacacacaca

SEQ ID NO: 906255 - DNA, 25 bp, Mus musculus
tgtgcaatattccaccctggcagaa

SEQ ID NO: 906256 - DNA, 25 bp, Mus musculus
tgtgcaatattcgaccctggcagaa

SEQ ID NO: 906257 - DNA, 25 bp, Mus musculus
tgtgcaatcttgagtaacctacttt

SEQ ID NO: 906258 - DNA, 25 bp, Mus musculus
tgtgcaatcttgtgtaacctacttt

SEQ ID NO: 906259 - DNA, 25 bp, Mus musculus
tgtgcaatgcggagagctccagtca

SEQ ID NO: 906260 - DNA, 25 bp, Mus musculus
tgtgcaatgcggtgagctccagtca

SEQ ID NO: 906261 - DNA, 25 bp, Mus musculus
tgtgcaatgctcatgtagactgaac

SEQ ID NO: 906262 - DNA, 25 bp, Mus musculus
tgtgcaatgctcttgtagactgaac

SEQ ID NO: 906263 - DNA, 25 bp, Mus musculus
tgtgcaatgctgagtgcaggccacc

SEQ ID NO: 906264 - DNA, 25 bp, Mus musculus
tgtgcaatgctgtgtgcaggccacc

SEQ ID NO: 906265 - DNA, 25 bp, Mus musculus
tgtgcaattactctgctacactctg

SEQ ID NO: 906266 - DNA, 25 bp, Mus musculus
tgtgcaattactgtgctacactctg

SEQ ID NO: 906267 - DNA, 25 bp, Mus musculus
tgtgcaattcctaggctgtgatgtt

SEQ ID NO: 906268 - DNA, 25 bp, Mus musculus
tgtgcaattccttggctgtgatgtt

SEQ ID NO: 906269 - DNA, 25 bp, Mus musculus
tgtgcaattgcaaataccgacgtaa

SEQ ID NO: 906270 - DNA, 25 bp, Mus musculus
tgtgcaattgcatataccgacgtaa

SEQ ID NO: 906271 - DNA, 25 bp, Mus musculus
tgtgcaattgtaataggctcctgat

SEQ ID NO: 906272 - DNA, 25 bp, Mus musculus
tgtgcaattgtattaggctcctgat

SEQ ID NO: 906273 - DNA, 25 bp, Mus musculus
tgtgcaattgtgaggctaatcagct

SEQ ID NO: 906274 - DNA, 25 bp, Mus musculus
tgtgcaattgtgatccctttacctt

SEQ ID NO: 906275 - DNA, 25 bp, Mus musculus
tgtgcaattgtgtggctaatcagct

SEQ ID NO: 906276 - DNA, 25 bp, Mus musculus
tgtgcaattgtgttccctttacctt

SEQ ID NO: 906277 - DNA, 25 bp, Mus musculus
tgtgcaattttcacatggccctaag

SEQ ID NO: 906278 - DNA, 25 bp, Mus musculus
tgtgcaattttctcatggccctaag

SEQ ID NO: 906279 - DNA, 25 bp, Mus musculus
tgtgcacaacgtatctgagttttgg

SEQ ID NO: 906280 - DNA, 25 bp, Mus musculus
tgtgcacaacgtttctgagttttgg

SEQ ID NO: 906281 - DNA, 25 bp, Mus musculus
tgtgcacaagagagcccactgtctg

SEQ ID NO: 906282 - DNA, 25 bp, Mus musculus
tgtgcacaagagtgcccactgtctg

SEQ ID NO: 906283 - DNA, 25 bp, Mus musculus
tgtgcacaagcactgttaacccaac

SEQ ID NO: 906284 - DNA, 25 bp, Mus musculus
tgtgcacaagcagtgttaacccaac

SEQ ID NO: 906285 - DNA, 25 bp, Mus musculus
tgtgcacacacgaacaaaagcatgt

SEQ ID NO: 906286 - DNA, 25 bp, Mus musculus
tgtgcacacacgtacaaaagcatgt

SEQ ID NO: 906287 - DNA, 25 bp, Mus musculus
tgtgcacacagtactcatcactcct

SEQ ID NO: 906288 - DNA, 25 bp, Mus musculus
tgtgcacacagttctcatcactcct

SEQ ID NO: 906289 - DNA, 25 bp, Mus musculus
tgtgcacacattactccatcttttt

SEQ ID NO: 906290 - DNA, 25 bp, Mus musculus
tgtgcacacatttctccatcttttt

SEQ ID NO: 906291 - DNA, 25 bp, Mus musculus
tgtgcacaccacaatgcccaggatg

SEQ ID NO: 906292 - DNA, 25 bp, Mus musculus
tgtgcacaccactatgcccaggatg

SEQ ID NO: 906293 - DNA, 25 bp, Mus musculus
tgtgcacacgggatcggtgggaccc

SEQ ID NO: 906294 - DNA, 25 bp, Mus musculus
tgtgcacacgggttcggtgggaccc

SEQ ID NO: 906295 - DNA, 25 bp, Mus musculus
tgtgcacacgttaatttacatagac

SEQ ID NO: 906296 - DNA, 25 bp, Mus musculus
tgtgcacacgtttatttacatagac

SEQ ID NO: 906297 - DNA, 25 bp, Mus musculus
tgtgcacactaacccagactcctgg

SEQ ID NO: 906298 - DNA, 25 bp, Mus musculus
tgtgcacactaagccagactcctgg

SEQ ID NO: 906299 - DNA, 25 bp, Mus musculus
tgtgcacactatatcaggctccact

SEQ ID NO: 906300 - DNA, 25 bp, Mus musculus
tgtgcacactatttcaggctccact

SEQ ID NO: 906301 - DNA, 25 bp, Mus musculus
tgtgcacacttacgacctaggcgta

SEQ ID NO: 906302 - DNA, 25 bp, Mus musculus
tgtgcacacttaggacctaggcgta

SEQ ID NO: 906303 - DNA, 25 bp, Mus musculus
tgtgcacagaccctcttagactaca

SEQ ID NO: 906304 - DNA, 25 bp, Mus musculus
tgtgcacagaccgtcttagactaca

SEQ ID NO: 906305 - DNA, 25 bp, Mus musculus
tgtgcacagatactggcagccctgc

SEQ ID NO: 906306 - DNA, 25 bp, Mus musculus
tgtgcacagatagtggcagccctgc

SEQ ID NO: 906307 - DNA, 25 bp, Mus musculus
tgtgcacagcaaacttctacaccct

SEQ ID NO: 906308 - DNA, 25 bp, Mus musculus
tgtgcacagcaatcttctacaccct

SEQ ID NO: 906309 - DNA, 25 bp, Mus musculus
tgtgcacaggtccttgaggctcctc

SEQ ID NO: 906310 - DNA, 25 bp, Mus musculus
tgtgcacaggtcgttgaggctcctc

SEQ ID NO: 906311 - DNA, 25 bp, Mus musculus
tgtgcacagtgcaaagcttcataca

SEQ ID NO: 906312 - DNA, 25 bp, Mus musculus
tgtgcacagtgctaagcttcataca

SEQ ID NO: 906313 - DNA, 25 bp, Mus musculus
tgtgcacagtgtatccacccagggt

SEQ ID NO: 906314 - DNA, 25 bp, Mus musculus
tgtgcacagtgtttccacccagggt

SEQ ID NO: 906315 - DNA, 25 bp, Mus musculus
tgtgcacatatcctacagacttaca

SEQ ID NO: 906316 - DNA, 25 bp, Mus musculus
tgtgcacatatcgtacagacttaca

SEQ ID NO: 906317 - DNA, 25 bp, Mus musculus
tgtgcacatcaacttatagccaagc

SEQ ID NO: 906318 - DNA, 25 bp, Mus musculus
tgtgcacatcaagttatagccaagc

SEQ ID NO: 906319 - DNA, 25 bp, Mus musculus
tgtgcacatcacagtcacatgcatg

SEQ ID NO: 906320 - DNA, 25 bp, Mus musculus
tgtgcacatcactgtcacatgcatg

SEQ ID NO: 906321 - DNA, 25 bp, Mus musculus
tgtgcacatctcattccaattgtgt

SEQ ID NO: 906322 - DNA, 25 bp, Mus musculus
tgtgcacatctctttccaattgtgt

SEQ ID NO: 906323 - DNA, 25 bp, Mus musculus
tgtgcacatgcaaacagaggcggag

SEQ ID NO: 906324 - DNA, 25 bp, Mus musculus
tgtgcacatgcatacagaggcggag

SEQ ID NO: 906325 - DNA, 25 bp, Mus musculus
tgtgcacattctcaggcgccttcag

SEQ ID NO: 906326 - DNA, 25 bp, Mus musculus
tgtgcacattctgaggcgccttcag

SEQ ID NO: 906327 - DNA, 25 bp, Mus musculus
tgtgcacattgcctgatgccccatg

SEQ ID NO: 906328 - DNA, 25 bp, Mus musculus
tgtgcacattgcgtgatgccccatg

SEQ ID NO: 906329 - DNA, 25 bp, Mus musculus
tgtgcacattgtcagcagctgcccc

SEQ ID NO: 906330 - DNA, 25 bp, Mus musculus
tgtgcacattgtgagcagctgcccc

SEQ ID NO: 906331 - DNA, 25 bp, Mus musculus
tgtgcaccaacacgccttgatatat

SEQ ID NO: 906332 - DNA, 25 bp, Mus musculus
tgtgcaccaacaggccttgatatat

SEQ ID NO: 906333 - DNA, 25 bp, Mus musculus
tgtgcaccaagtacattccatcaaa

SEQ ID NO: 906334 - DNA, 25 bp, Mus musculus
tgtgcaccaagttcattccatcaaa

SEQ ID NO: 906335 - DNA, 25 bp, Mus musculus
tgtgcaccacagactaacggtgagt

SEQ ID NO: 906336 - DNA, 25 bp, Mus musculus
tgtgcaccacagtctaacggtgagt

SEQ ID NO: 906337 - DNA, 25 bp, Mus musculus
tgtgcaccaccaagtacatacacct

SEQ ID NO: 906338 - DNA, 25 bp, Mus musculus
tgtgcaccaccatgtacatacacct

SEQ ID NO: 906339 - DNA, 25 bp, Mus musculus
tgtgcaccaccgaactcagttcaaa

SEQ ID NO: 906340 - DNA, 25 bp, Mus musculus
tgtgcaccaccgtactcagttcaaa

SEQ ID NO: 906341 - DNA, 25 bp, Mus musculus
tgtgcaccagaacagccatgagagg

SEQ ID NO: 906342 - DNA, 25 bp, Mus musculus
tgtgcaccagaagagccatgagagg

SEQ ID NO: 906343 - DNA, 25 bp, Mus musculus
tgtgcaccaggtcatggctgtacac

SEQ ID NO: 906344 - DNA, 25 bp, Mus musculus
tgtgcaccaggtgatggctgtacac

SEQ ID NO: 906345 - DNA, 25 bp, Mus musculus
tgtgcaccatggctcacacgtaaat

SEQ ID NO: 906346 - DNA, 25 bp, Mus musculus
tgtgcaccatgggtcacacgtaaat

SEQ ID NO: 906347 - DNA, 25 bp, Mus musculus
tgtgcaccccatcttgtaaatctgt

SEQ ID NO: 906348 - DNA, 25 bp, Mus musculus
tgtgcaccccatgttgtaaatctgt

SEQ ID NO: 906349 - DNA, 25 bp, Mus musculus
tgtgcaccccgcatctctagatgga

SEQ ID NO: 906350 - DNA, 25 bp, Mus musculus
tgtgcaccccgcttctctagatgga

SEQ ID NO: 906351 - DNA, 25 bp, Mus musculus
tgtgcaccggcacatactgacactg

SEQ ID NO: 906352 - DNA, 25 bp, Mus musculus
tgtgcaccggcagatactgacactg

SEQ ID NO: 906353 - DNA, 25 bp, Mus musculus
tgtgcacctcagatggcaagctctg

SEQ ID NO: 906354 - DNA, 25 bp, Mus musculus
tgtgcacctcagttggcaagctctg

SEQ ID NO: 906355 - DNA, 25 bp, Mus musculus
tgtgcacctgctaatgccgaagaaa

SEQ ID NO: 906356 - DNA, 25 bp, Mus musculus
tgtgcacctgcttatgccgaagaaa

SEQ ID NO: 906357 - DNA, 25 bp, Mus musculus
tgtgcacctgtgaaagccctgcagt

SEQ ID NO: 906358 - DNA, 25 bp, Mus musculus
tgtgcacctgtgtaagccctgcagt

SEQ ID NO: 906359 - DNA, 25 bp, Mus musculus
tgtgcacctgttctgtgtggtcccg

SEQ ID NO: 906360 - DNA, 25 bp, Mus musculus
tgtgcacctgttgtgtgtggtcccg

SEQ ID NO: 906361 - DNA, 25 bp, Mus musculus
tgtgcaccttggctctcagactcag

SEQ ID NO: 906362 - DNA, 25 bp, Mus musculus
tgtgcaccttgggtctcagactcag

SEQ ID NO: 906363 - DNA, 25 bp, Mus musculus
tgtgcacctttacttcttcagcaac

SEQ ID NO: 906364 - DNA, 25 bp, Mus musculus
tgtgcacctttagttcttcagcaac

SEQ ID NO: 906365 - DNA, 25 bp, Mus musculus
tgtgcacctttccaaacctcagctt

SEQ ID NO: 906366 - DNA, 25 bp, Mus musculus
tgtgcacctttcgaaacctcagctt

SEQ ID NO: 906367 - DNA, 25 bp, Mus musculus
tgtgcacgcgcaccgggaatatgct

SEQ ID NO: 906368 - DNA, 25 bp, Mus musculus
tgtgcacgcgcagcgggaatatgct

SEQ ID NO: 906369 - DNA, 25 bp, Mus musculus
tgtgcacgcttcactctaatagcat

SEQ ID NO: 906370 - DNA, 25 bp, Mus musculus
tgtgcacgcttctctctaatagcat

SEQ ID NO: 906371 - DNA, 25 bp, Mus musculus
tgtgcacgtctacgtgacccttcca

SEQ ID NO: 906372 - DNA, 25 bp, Mus musculus
tgtgcacgtctaggtgacccttcca

SEQ ID NO: 906373 - DNA, 25 bp, Mus musculus
tgtgcacgtggtacatgggactcaa

SEQ ID NO: 906374 - DNA, 25 bp, Mus musculus
tgtgcacgtggttcatgggactcaa

SEQ ID NO: 906375 - DNA, 25 bp, Mus musculus
tgtgcactactcagtcatatgattc

SEQ ID NO: 906376 - DNA, 25 bp, Mus musculus
tgtgcactactctgtcatatgattc

SEQ ID NO: 906377 - DNA, 25 bp, Mus musculus
tgtgcactatggacagatgtactgt

SEQ ID NO: 906378 - DNA, 25 bp, Mus musculus
tgtgcactatggtcagatgtactgt

SEQ ID NO: 906379 - DNA, 25 bp, Mus musculus
tgtgcactccaccttagattcatca

SEQ ID NO: 906380 - DNA, 25 bp, Mus musculus
tgtgcactccacgttagattcatca

SEQ ID NO: 906381 - DNA, 25 bp, Mus musculus
tgtgcactcccacggtgtcactaga

SEQ ID NO: 906382 - DNA, 25 bp, Mus musculus
tgtgcactcccagggtgtcactaga

SEQ ID NO: 906383 - DNA, 25 bp, Mus musculus
tgtgcactgaagcagcctattttta

SEQ ID NO: 906384 - DNA, 25 bp, Mus musculus
tgtgcactgaaggagcctattttta

SEQ ID NO: 906385 - DNA, 25 bp, Mus musculus
tgtgcactgaatcaggtcctgggtt

SEQ ID NO: 906386 - DNA, 25 bp, Mus musculus
tgtgcactgaatgaggtcctgggtt

SEQ ID NO: 906387 - DNA, 25 bp, Mus musculus
tgtgcactgagccacccatgcgtta

SEQ ID NO: 906388 - DNA, 25 bp, Mus musculus
tgtgcactgagcgacccatgcgtta

SEQ ID NO: 906389 - DNA, 25 bp, Mus musculus
tgtgcactgcgacttccaccaaggc

SEQ ID NO: 906390 - DNA, 25 bp, Mus musculus
tgtgcactgcgacttttcagcaggt

SEQ ID NO: 906391 - DNA, 25 bp, Mus musculus
tgtgcactgcgagttccaccaaggc

SEQ ID NO: 906392 - DNA, 25 bp, Mus musculus
tgtgcactgcgagttttcagcaggt

SEQ ID NO: 906393 - DNA, 25 bp, Mus musculus
tgtgcactgtagacttttaataatc

SEQ ID NO: 906394 - DNA, 25 bp, Mus musculus
tgtgcactgtagtcttttaataatc

SEQ ID NO: 906395 - DNA, 25 bp, Mus musculus
tgtgcactgttcaaagggaaggaca

SEQ ID NO: 906396 - DNA, 25 bp, Mus musculus
tgtgcactgttctaagggaaggaca

SEQ ID NO: 906397 - DNA, 25 bp, Mus musculus
tgtgcagaacccagcggctgaagca

SEQ ID NO: 906398 - DNA, 25 bp, Mus musculus
tgtgcagaaccctgcggctgaagca

SEQ ID NO: 906399 - DNA, 25 bp, Mus musculus
tgtgcagaatgaactcagcatccca

SEQ ID NO: 906400 - DNA, 25 bp, Mus musculus
tgtgcagaatgatctcagcatccca

SEQ ID NO: 906401 - DNA, 25 bp, Mus musculus
tgtgcagaccacagagcaagacctt

SEQ ID NO: 906402 - DNA, 25 bp, Mus musculus
tgtgcagaccactgagcaagacctt

SEQ ID NO: 906403 - DNA, 25 bp, Mus musculus
tgtgcagacgaacgcagatggctat

SEQ ID NO: 906404 - DNA, 25 bp, Mus musculus
tgtgcagacgaaggcagatggctat

SEQ ID NO: 906405 - DNA, 25 bp, Mus musculus
tgtgcagactcccaaaaccactttg

SEQ ID NO: 906406 - DNA, 25 bp, Mus musculus
tgtgcagactccgaaaaccactttg

SEQ ID NO: 906407 - DNA, 25 bp, Mus musculus
tgtgcagactctacctgcagtccaa

SEQ ID NO: 906408 - DNA, 25 bp, Mus musculus
tgtgcagactcttcctgcagtccaa

SEQ ID NO: 906409 - DNA, 25 bp, Mus musculus
tgtgcagactggagcaactcttgct

SEQ ID NO: 906410 - DNA, 25 bp, Mus musculus
tgtgcagactggtgcaactcttgct

SEQ ID NO: 906411 - DNA, 25 bp, Mus musculus
tgtgcagacttgacagcctgttgcc

SEQ ID NO: 906412 - DNA, 25 bp, Mus musculus
tgtgcagacttgtcagcctgttgcc

SEQ ID NO: 906413 - DNA, 25 bp, Mus musculus
tgtgcagagcacagacgctgacaat

SEQ ID NO: 906414 - DNA, 25 bp, Mus musculus
tgtgcagagcactgacgctgacaat

SEQ ID NO: 906415 - DNA, 25 bp, Mus musculus
tgtgcagagctgacccgaggatgcc

SEQ ID NO: 906416 - DNA, 25 bp, Mus musculus
tgtgcagagctgtcccgaggatgcc

SEQ ID NO: 906417 - DNA, 25 bp, Mus musculus
tgtgcagaggatatcgaacggtaaa

SEQ ID NO: 906418 - DNA, 25 bp, Mus musculus
tgtgcagaggatttcgaacggtaaa

SEQ ID NO: 906419 - DNA, 25 bp, Mus musculus
tgtgcagatggtcctcaacaacctg

SEQ ID NO: 906420 - DNA, 25 bp, Mus musculus
tgtgcagatggtgctcaacaacctg

SEQ ID NO: 906421 - DNA, 25 bp, Mus musculus
tgtgcagattatcctcattcactac

SEQ ID NO: 906422 - DNA, 25 bp, Mus musculus
tgtgcagattatgctcattcactac

SEQ ID NO: 906423 - DNA, 25 bp, Mus musculus
tgtgcagcaaggactatcccacttc

SEQ ID NO: 906424 - DNA, 25 bp, Mus musculus
tgtgcagcaaggtctatcccacttc

SEQ ID NO: 906425 - DNA, 25 bp, Mus musculus
tgtgcagcacataccgaagacgtcc

SEQ ID NO: 906426 - DNA, 25 bp, Mus musculus
tgtgcagcacattccgaagacgtcc

SEQ ID NO: 906427 - DNA, 25 bp, Mus musculus
tgtgcagcacctcagccgcagtttg

SEQ ID NO: 906428 - DNA, 25 bp, Mus musculus
tgtgcagcacctccaaaatgcttct

SEQ ID NO: 906429 - DNA, 25 bp, Mus musculus
tgtgcagcacctgagccgcagtttg

SEQ ID NO: 906430 - DNA, 25 bp, Mus musculus
tgtgcagcacctgcaaaatgcttct

SEQ ID NO: 906431 - DNA, 25 bp, Mus musculus
tgtgcagcagacacacctgattgat

SEQ ID NO: 906432 - DNA, 25 bp, Mus musculus
tgtgcagcagactcacctgattgat

SEQ ID NO: 906433 - DNA, 25 bp, Mus musculus
tgtgcagcaggaaagccttggccac

SEQ ID NO: 906434 - DNA, 25 bp, Mus musculus
tgtgcagcaggatagccttggccac

SEQ ID NO: 906435 - DNA, 25 bp, Mus musculus
tgtgcagcaggtctgcgtgcagcaa

SEQ ID NO: 906436 - DNA, 25 bp, Mus musculus
tgtgcagcaggtgtgcgtgcagcaa

SEQ ID NO: 906437 - DNA, 25 bp, Mus musculus
tgtgcagcagtcctcactgatggaa

SEQ ID NO: 906438 - DNA, 25 bp, Mus musculus
tgtgcagcagtcctctttcaacaca

SEQ ID NO: 906439 - DNA, 25 bp, Mus musculus
tgtgcagcagtcgtcactgatggaa

SEQ ID NO: 906440 - DNA, 25 bp, Mus musculus
tgtgcagcagtcgtctttcaacaca

SEQ ID NO: 906441 - DNA, 25 bp, Mus musculus
tgtgcagcagttcgtgtctgagtcc

SEQ ID NO: 906442 - DNA, 25 bp, Mus musculus
tgtgcagcagttggtgtctgagtcc

SEQ ID NO: 906443 - DNA, 25 bp, Mus musculus
tgtgcagccatacacattgttctct

SEQ ID NO: 906444 - DNA, 25 bp, Mus musculus
tgtgcagccatagacattgttctct

SEQ ID NO: 906445 - DNA, 25 bp, Mus musculus
tgtgcagccatcaggttgccttgat

SEQ ID NO: 906446 - DNA, 25 bp, Mus musculus
tgtgcagccatctggttgccttgat

SEQ ID NO: 906447 - DNA, 25 bp, Mus musculus
tgtgcagccctgcttggttggaact

SEQ ID NO: 906448 - DNA, 25 bp, Mus musculus
tgtgcagccctggttggttggaact

SEQ ID NO: 906449 - DNA, 25 bp, Mus musculus
tgtgcagcctctcatctggatccta

SEQ ID NO: 906450 - DNA, 25 bp, Mus musculus
tgtgcagcctctgatctggatccta

SEQ ID NO: 906451 - DNA, 25 bp, Mus musculus
tgtgcagcgaccaatgcgcatgggc

SEQ ID NO: 906452 - DNA, 25 bp, Mus musculus
tgtgcagcgacctatgcgcatgggc

SEQ ID NO: 906453 - DNA, 25 bp, Mus musculus
tgtgcagcgcatatgaccgggaaac

SEQ ID NO: 906454 - DNA, 25 bp, Mus musculus
tgtgcagcgcatttgaccgggaaac

SEQ ID NO: 906455 - DNA, 25 bp, Mus musculus
tgtgcagcggttacggccctgcaga

SEQ ID NO: 906456 - DNA, 25 bp, Mus musculus
tgtgcagcggtttcggccctgcaga

SEQ ID NO: 906457 - DNA, 25 bp, Mus musculus
tgtgcagctacaccggattcctact

SEQ ID NO: 906458 - DNA, 25 bp, Mus musculus
tgtgcagctacagcggattcctact

SEQ ID NO: 906459 - DNA, 25 bp, Mus musculus
tgtgcagctcagacatctccattgg

SEQ ID NO: 906460 - DNA, 25 bp, Mus musculus
tgtgcagctcagtcatctccattgg

SEQ ID NO: 906461 - DNA, 25 bp, Mus musculus
tgtgcagctctaagattagctcggt

SEQ ID NO: 906462 - DNA, 25 bp, Mus musculus
tgtgcagctctatgattagctcggt

SEQ ID NO: 906463 - DNA, 25 bp, Mus musculus
tgtgcagctgcacctaagggaacaa

SEQ ID NO: 906464 - DNA, 25 bp, Mus musculus
tgtgcagctgcagctaagggaacaa

SEQ ID NO: 906465 - DNA, 25 bp, Mus musculus
tgtgcagctgctcggtccttaggac

SEQ ID NO: 906466 - DNA, 25 bp, Mus musculus
tgtgcagctgctgggtccttaggac

SEQ ID NO: 906467 - DNA, 25 bp, Mus musculus
tgtgcagctggaaaggagagcccca

SEQ ID NO: 906468 - DNA, 25 bp, Mus musculus
tgtgcagctggaactaaccaccaat

SEQ ID NO: 906469 - DNA, 25 bp, Mus musculus
tgtgcagctggataggagagcccca

SEQ ID NO: 906470 - DNA, 25 bp, Mus musculus
tgtgcagctggatctaaccaccaat

SEQ ID NO: 906471 - DNA, 25 bp, Mus musculus
tgtgcaggacagcattcgggccctc

SEQ ID NO: 906472 - DNA, 25 bp, Mus musculus
tgtgcaggacaggattcgggccctc

SEQ ID NO: 906473 - DNA, 25 bp, Mus musculus
tgtgcaggacgaagggctattccct

SEQ ID NO: 906474 - DNA, 25 bp, Mus musculus
tgtgcaggacgatgggctattccct

SEQ ID NO: 906475 - DNA, 25 bp, Mus musculus
tgtgcaggatgaccagcctctccac

SEQ ID NO: 906476 - DNA, 25 bp, Mus musculus
tgtgcaggatgagcagcctctccac

SEQ ID NO: 906477 - DNA, 25 bp, Mus musculus
tgtgcaggcacaacaactgaaactg

SEQ ID NO: 906478 - DNA, 25 bp, Mus musculus
tgtgcaggcacatcaactgaaactg

SEQ ID NO: 906479 - DNA, 25 bp, Mus musculus
tgtgcaggccaactttagtcgtgag

SEQ ID NO: 906480 - DNA, 25 bp, Mus musculus
tgtgcaggccaagtttagtcgtgag

SEQ ID NO: 906481 - DNA, 25 bp, Mus musculus
tgtgcaggccctcattaggtgtgct

SEQ ID NO: 906482 - DNA, 25 bp, Mus musculus
tgtgcaggccctgattaggtgtgct

SEQ ID NO: 906483 - DNA, 25 bp, Mus musculus
tgtgcaggcgtgacgagtactccta

SEQ ID NO: 906484 - DNA, 25 bp, Mus musculus
tgtgcaggcgtgtcgagtactccta

SEQ ID NO: 906485 - DNA, 25 bp, Mus musculus
tgtgcagggcgtacattgggtaaaa

SEQ ID NO: 906486 - DNA, 25 bp, Mus musculus
tgtgcagggcgttcattgggtaaaa

SEQ ID NO: 906487 - DNA, 25 bp, Mus musculus
tgtgcagggttgagaaagtcaaaca

SEQ ID NO: 906488 - DNA, 25 bp, Mus musculus
tgtgcagggttgtgaaagtcaaaca

SEQ ID NO: 906489 - DNA, 25 bp, Mus musculus
tgtgcaggtaacaatcagatttctc

SEQ ID NO: 906490 - DNA, 25 bp, Mus musculus
tgtgcaggtaactatcagatttctc

SEQ ID NO: 906491 - DNA, 25 bp, Mus musculus
tgtgcaggtattccctgaggccact

SEQ ID NO: 906492 - DNA, 25 bp, Mus musculus
tgtgcaggtattgcctgaggccact

SEQ ID NO: 906493 - DNA, 25 bp, Mus musculus
tgtgcaggtcatccgacagaacact

SEQ ID NO: 906494 - DNA, 25 bp, Mus musculus
tgtgcaggtcatgcgacagaacact

SEQ ID NO: 906495 - DNA, 25 bp, Mus musculus
tgtgcaggtcttagtcctggttcaa

SEQ ID NO: 906496 - DNA, 25 bp, Mus musculus
tgtgcaggtctttgtcctggttcaa

SEQ ID NO: 906497 - DNA, 25 bp, Mus musculus
tgtgcaggtgctaagattaaacact

SEQ ID NO: 906498 - DNA, 25 bp, Mus musculus
tgtgcaggtgcttagattaaacact

SEQ ID NO: 906499 - DNA, 25 bp, Mus musculus
tgtgcagtactcagctccagagatc

SEQ ID NO: 906500 - DNA, 25 bp, Mus musculus
tgtgcagtactctgctccagagatc

SEQ ID NO: 906501 - DNA, 25 bp, Mus musculus
tgtgcagtactgacagctattctag

SEQ ID NO: 906502 - DNA, 25 bp, Mus musculus
tgtgcagtactgtcagctattctag

SEQ ID NO: 906503 - DNA, 25 bp, Mus musculus
tgtgcagtatgacgtggaagacctt

SEQ ID NO: 906504 - DNA, 25 bp, Mus musculus
tgtgcagtatgaggtggaagacctt

SEQ ID NO: 906505 - DNA, 25 bp, Mus musculus
tgtgcagtattcatacagagtcaaa

SEQ ID NO: 906506 - DNA, 25 bp, Mus musculus
tgtgcagtattcttacagagtcaaa

SEQ ID NO: 906507 - DNA, 25 bp, Mus musculus
tgtgcagtcaaacccgtgcatggca

SEQ ID NO: 906508 - DNA, 25 bp, Mus musculus
tgtgcagtcaaagccgtgcatggca

SEQ ID NO: 906509 - DNA, 25 bp, Mus musculus
tgtgcagtcagcaacgatccagcca

SEQ ID NO: 906510 - DNA, 25 bp, Mus musculus
tgtgcagtcagctacgatccagcca

SEQ ID NO: 906511 - DNA, 25 bp, Mus musculus
tgtgcagtcagtaggagagcagaaa

SEQ ID NO: 906512 - DNA, 25 bp, Mus musculus
tgtgcagtcagtcctttgaagcgaa

SEQ ID NO: 906513 - DNA, 25 bp, Mus musculus
tgtgcagtcagtgctttgaagcgaa

SEQ ID NO: 906514 - DNA, 25 bp, Mus musculus
tgtgcagtcagttggagagcagaaa

SEQ ID NO: 906515 - DNA, 25 bp, Mus musculus
tgtgcagtcattagaggccccagat

SEQ ID NO: 906516 - DNA, 25 bp, Mus musculus
tgtgcagtcatttgaggccccagat

SEQ ID NO: 906517 - DNA, 25 bp, Mus musculus
tgtgcagtccagcaccacttagaca

SEQ ID NO: 906518 - DNA, 25 bp, Mus musculus
tgtgcagtccaggaccacttagaca

SEQ ID NO: 906519 - DNA, 25 bp, Mus musculus
tgtgcagtgatgatcttccttggat

SEQ ID NO: 906520 - DNA, 25 bp, Mus musculus
tgtgcagtgatgttcttccttggat

SEQ ID NO: 906521 - DNA, 25 bp, Mus musculus
tgtgcagtggagcttcctagtgtct

SEQ ID NO: 906522 - DNA, 25 bp, Mus musculus
tgtgcagtggaggttcctagtgtct

SEQ ID NO: 906523 - DNA, 25 bp, Mus musculus
tgtgcagtggttcaacctgaccaaa

SEQ ID NO: 906524 - DNA, 25 bp, Mus musculus
tgtgcagtggttcacaaccctccta

SEQ ID NO: 906525 - DNA, 25 bp, Mus musculus
tgtgcagtggttgaacctgaccaaa

SEQ ID NO: 906526 - DNA, 25 bp, Mus musculus
tgtgcagtggttgacaaccctccta

SEQ ID NO: 906527 - DNA, 25 bp, Mus musculus
tgtgcagtgtgcattgttcccatat

SEQ ID NO: 906528 - DNA, 25 bp, Mus musculus
tgtgcagtgtgctttgttcccatat

SEQ ID NO: 906529 - DNA, 25 bp, Mus musculus
tgtgcagtgtgtacccatgaagcca

SEQ ID NO: 906530 - DNA, 25 bp, Mus musculus
tgtgcagtgtgttcccatgaagcca

SEQ ID NO: 906531 - DNA, 25 bp, Mus musculus
tgtgcagtgttaattgatcagccaa

SEQ ID NO: 906532 - DNA, 25 bp, Mus musculus
tgtgcagtgttacgtgccactgtta

SEQ ID NO: 906533 - DNA, 25 bp, Mus musculus
tgtgcagtgttaggtgccactgtta

SEQ ID NO: 906534 - DNA, 25 bp, Mus musculus
tgtgcagtgttatttgatcagccaa

SEQ ID NO: 906535 - DNA, 25 bp, Mus musculus
tgtgcagttgcacttagcgcagccc

SEQ ID NO: 906536 - DNA, 25 bp, Mus musculus
tgtgcagttgcagttagcgcagccc

SEQ ID NO: 906537 - DNA, 25 bp, Mus musculus
tgtgcagtttctagtagcagctgaa

SEQ ID NO: 906538 - DNA, 25 bp, Mus musculus
tgtgcagtttcttgtagcagctgaa

SEQ ID NO: 906539 - DNA, 25 bp, Mus musculus
tgtgcataaacacaagccagttccc

SEQ ID NO: 906540 - DNA, 25 bp, Mus musculus
tgtgcataaacagaagccagttccc

SEQ ID NO: 906541 - DNA, 25 bp, Mus musculus
tgtgcatagaacatcctctgcccta

SEQ ID NO: 906542 - DNA, 25 bp, Mus musculus
tgtgcatagaacttcctctgcccta

SEQ ID NO: 906543 - DNA, 25 bp, Mus musculus
tgtgcatagagacatggaaagcgct

SEQ ID NO: 906544 - DNA, 25 bp, Mus musculus
tgtgcatagagagatggaaagcgct

SEQ ID NO: 906545 - DNA, 25 bp, Mus musculus
tgtgcatataaacctacagttaaca

SEQ ID NO: 906546 - DNA, 25 bp, Mus musculus
tgtgcatataaagctacagttaaca

SEQ ID NO: 906547 - DNA, 25 bp, Mus musculus
tgtgcatatattcctggccatctat

SEQ ID NO: 906548 - DNA, 25 bp, Mus musculus
tgtgcatatattgctggccatctat

SEQ ID NO: 906549 - DNA, 25 bp, Mus musculus
tgtgcatatcctaacacgtgtgtgc

SEQ ID NO: 906550 - DNA, 25 bp, Mus musculus
tgtgcatatccttacacgtgtgtgc

SEQ ID NO: 906551 - DNA, 25 bp, Mus musculus
tgtgcatatctgaccatcaccaagg

SEQ ID NO: 906552 - DNA, 25 bp, Mus musculus
tgtgcatatctgtccatcaccaagg

SEQ ID NO: 906553 - DNA, 25 bp, Mus musculus
tgtgcatattgtctcatgagcaaaa

SEQ ID NO: 906554 - DNA, 25 bp, Mus musculus
tgtgcatattgtgtcatgagcaaaa

SEQ ID NO: 906555 - DNA, 25 bp, Mus musculus
tgtgcatcacacatacgtgccagcg

SEQ ID NO: 906556 - DNA, 25 bp, Mus musculus
tgtgcatcacacttacgtgccagcg

SEQ ID NO: 906557 - DNA, 25 bp, Mus musculus
tgtgcatcaccacttcctagctgct

SEQ ID NO: 906558 - DNA, 25 bp, Mus musculus
tgtgcatcaccagttcctagctgct

SEQ ID NO: 906559 - DNA, 25 bp, Mus musculus
tgtgcatcacctatgaccaggctga

SEQ ID NO: 906560 - DNA, 25 bp, Mus musculus
tgtgcatcacctttgaccaggctga

SEQ ID NO: 906561 - DNA, 25 bp, Mus musculus
tgtgcatcacgaaatctgccactgg

SEQ ID NO: 906562 - DNA, 25 bp, Mus musculus
tgtgcatcacgatatctgccactgg

SEQ ID NO: 906563 - DNA, 25 bp, Mus musculus
tgtgcatcactacgccaccaggata

SEQ ID NO: 906564 - DNA, 25 bp, Mus musculus
tgtgcatcactaggccaccaggata

SEQ ID NO: 906565 - DNA, 25 bp, Mus musculus
tgtgcatcatagagcccggtgaggt

SEQ ID NO: 906566 - DNA, 25 bp, Mus musculus
tgtgcatcatagtgcccggtgaggt

SEQ ID NO: 906567 - DNA, 25 bp, Mus musculus
tgtgcatccgcaaccagggaaaata

SEQ ID NO: 906568 - DNA, 25 bp, Mus musculus
tgtgcatccgcatccagggaaaata

SEQ ID NO: 906569 - DNA, 25 bp, Mus musculus
tgtgcatcctcacacctttggagaa

SEQ ID NO: 906570 - DNA, 25 bp, Mus musculus
tgtgcatcctcagacctttggagaa

SEQ ID NO: 906571 - DNA, 25 bp, Mus musculus
tgtgcatcctgacccatcctttata

SEQ ID NO: 906572 - DNA, 25 bp, Mus musculus
tgtgcatcctgagccatcctttata

SEQ ID NO: 906573 - DNA, 25 bp, Mus musculus
tgtgcatcctgcagcagcctgcttt

SEQ ID NO: 906574 - DNA, 25 bp, Mus musculus
tgtgcatcctgcctgccacgagaca

SEQ ID NO: 906575 - DNA, 25 bp, Mus musculus
tgtgcatcctgcgtgccacgagaca

SEQ ID NO: 906576 - DNA, 25 bp, Mus musculus
tgtgcatcctgctgcagcctgcttt

SEQ ID NO: 906577 - DNA, 25 bp, Mus musculus
tgtgcatcgtttccagagctgcaaa

SEQ ID NO: 906578 - DNA, 25 bp, Mus musculus
tgtgcatcgtttgcagagctgcaaa

SEQ ID NO: 906579 - DNA, 25 bp, Mus musculus
tgtgcatctatgcaccacatgcatg

SEQ ID NO: 906580 - DNA, 25 bp, Mus musculus
tgtgcatctatggaccacatgcatg

SEQ ID NO: 906581 - DNA, 25 bp, Mus musculus
tgtgcatctcatagttgctgtcatt

SEQ ID NO: 906582 - DNA, 25 bp, Mus musculus
tgtgcatctcattgttgctgtcatt

SEQ ID NO: 906583 - DNA, 25 bp, Mus musculus
tgtgcatctccaagactcagtcagt

SEQ ID NO: 906584 - DNA, 25 bp, Mus musculus
tgtgcatctccatgactcagtcagt

SEQ ID NO: 906585 - DNA, 25 bp, Mus musculus
tgtgcatctctaaaggtgccactgt

SEQ ID NO: 906586 - DNA, 25 bp, Mus musculus
tgtgcatctctataggtgccactgt

SEQ ID NO: 906587 - DNA, 25 bp, Mus musculus
tgtgcatctcttctggattcttttt

SEQ ID NO: 906588 - DNA, 25 bp, Mus musculus
tgtgcatctcttgtggattcttttt

SEQ ID NO: 906589 - DNA, 25 bp, Mus musculus
tgtgcatgacagctccacctacctg

SEQ ID NO: 906590 - DNA, 25 bp, Mus musculus
tgtgcatgacaggtccacctacctg

SEQ ID NO: 906591 - DNA, 25 bp, Mus musculus
tgtgcatgactcagctgcgcagtga

SEQ ID NO: 906592 - DNA, 25 bp, Mus musculus
tgtgcatgactctgctgcgcagtga

SEQ ID NO: 906593 - DNA, 25 bp, Mus musculus
tgtgcatgagcactccacacacaaa

SEQ ID NO: 906594 - DNA, 25 bp, Mus musculus
tgtgcatgagcagtccacacacaaa

SEQ ID NO: 906595 - DNA, 25 bp, Mus musculus
tgtgcatgcctgagcttttcaactt

SEQ ID NO: 906596 - DNA, 25 bp, Mus musculus
tgtgcatgcctgatgtgacattcat

SEQ ID NO: 906597 - DNA, 25 bp, Mus musculus
tgtgcatgcctgattctttttgcca

SEQ ID NO: 906598 - DNA, 25 bp, Mus musculus
tgtgcatgcctgtgcttttcaactt

SEQ ID NO: 906599 - DNA, 25 bp, Mus musculus
tgtgcatgcctgttgtgacattcat

SEQ ID NO: 906600 - DNA, 25 bp, Mus musculus
tgtgcatgcctgtttctttttgcca

SEQ ID NO: 906601 - DNA, 25 bp, Mus musculus
tgtgcatgcgctctattcttcacag

SEQ ID NO: 906602 - DNA, 25 bp, Mus musculus
tgtgcatgcgctgtattcttcacag

SEQ ID NO: 906603 - DNA, 25 bp, Mus musculus
tgtgcatgctttcggtttcaccgtc

SEQ ID NO: 906604 - DNA, 25 bp, Mus musculus
tgtgcatgctttgggtttcaccgtc

SEQ ID NO: 906605 - DNA, 25 bp, Mus musculus
tgtgcatggagcagtatgcctgagc

SEQ ID NO: 906606 - DNA, 25 bp, Mus musculus
tgtgcatggagctgtatgcctgagc

SEQ ID NO: 906607 - DNA, 25 bp, Mus musculus
tgtgcatggagtattactgagccct

SEQ ID NO: 906608 - DNA, 25 bp, Mus musculus
tgtgcatggagttttactgagccct

SEQ ID NO: 906609 - DNA, 25 bp, Mus musculus
tgtgcatggcctctttgtgtgcaag

SEQ ID NO: 906610 - DNA, 25 bp, Mus musculus
tgtgcatggcctgtttgtgtgcaag

SEQ ID NO: 906611 - DNA, 25 bp, Mus musculus
tgtgcatgggcacttcaaaggacct

SEQ ID NO: 906612 - DNA, 25 bp, Mus musculus
tgtgcatgggcagttcaaaggacct

SEQ ID NO: 906613 - DNA, 25 bp, Mus musculus
tgtgcatggtccctgatgctgcttc

SEQ ID NO: 906614 - DNA, 25 bp, Mus musculus
tgtgcatggtccgtgatgctgcttc

SEQ ID NO: 906615 - DNA, 25 bp, Mus musculus
tgtgcatgtcatagttccccaagaa

SEQ ID NO: 906616 - DNA, 25 bp, Mus musculus
tgtgcatgtcattgttccccaagaa

SEQ ID NO: 906617 - DNA, 25 bp, Mus musculus
tgtgcatgtcttcattgctgtcatt

SEQ ID NO: 906618 - DNA, 25 bp, Mus musculus
tgtgcatgtcttgattgctgtcatt

SEQ ID NO: 906619 - DNA, 25 bp, Mus musculus
tgtgcatgtgcacgcattctctttc

SEQ ID NO: 906620 - DNA, 25 bp, Mus musculus
tgtgcatgtgcaggcattctctttc

SEQ ID NO: 906621 - DNA, 25 bp, Mus musculus
tgtgcattaaggagagcctacggct

SEQ ID NO: 906622 - DNA, 25 bp, Mus musculus
tgtgcattaaggtgagcctacggct

SEQ ID NO: 906623 - DNA, 25 bp, Mus musculus
tgtgcattaagtattgacccctcaa

SEQ ID NO: 906624 - DNA, 25 bp, Mus musculus
tgtgcattaagttttgacccctcaa

SEQ ID NO: 906625 - DNA, 25 bp, Mus musculus
tgtgcattacacacatgcctgcaga

SEQ ID NO: 906626 - DNA, 25 bp, Mus musculus
tgtgcattacactcatgcctgcaga

SEQ ID NO: 906627 - DNA, 25 bp, Mus musculus
tgtgcattacccacccacacatatg

SEQ ID NO: 906628 - DNA, 25 bp, Mus musculus
tgtgcattaccctcccacacatatg

SEQ ID NO: 906629 - DNA, 25 bp, Mus musculus
tgtgcattatggctaagcttccctt

SEQ ID NO: 906630 - DNA, 25 bp, Mus musculus
tgtgcattatgggtaagcttccctt

SEQ ID NO: 906631 - DNA, 25 bp, Mus musculus
tgtgcattcgggattaccaggaggt

SEQ ID NO: 906632 - DNA, 25 bp, Mus musculus
tgtgcattcgggtttaccaggaggt

SEQ ID NO: 906633 - DNA, 25 bp, Mus musculus
tgtgcattctccattcacgagggaa

SEQ ID NO: 906634 - DNA, 25 bp, Mus musculus
tgtgcattctcctttcacgagggaa

SEQ ID NO: 906635 - DNA, 25 bp, Mus musculus
tgtgcattctgaccatgtgctctac

SEQ ID NO: 906636 - DNA, 25 bp, Mus musculus
tgtgcattctgagcatgtgctctac

SEQ ID NO: 906637 - DNA, 25 bp, Mus musculus
tgtgcattgattacccaggacccac

SEQ ID NO: 906638 - DNA, 25 bp, Mus musculus
tgtgcattgatttcccaggacccac

SEQ ID NO: 906639 - DNA, 25 bp, Mus musculus
tgtgcattgcacacatggccgtcat

SEQ ID NO: 906640 - DNA, 25 bp, Mus musculus
tgtgcattgcactcatggccgtcat

SEQ ID NO: 906641 - DNA, 25 bp, Mus musculus
tgtgcattggatcgacctgtttggt

SEQ ID NO: 906642 - DNA, 25 bp, Mus musculus
tgtgcattggatggacctgtttggt

SEQ ID NO: 906643 - DNA, 25 bp, Mus musculus
tgtgcattggtgatcttgttttctt

SEQ ID NO: 906644 - DNA, 25 bp, Mus musculus
tgtgcattggtgttcttgttttctt

SEQ ID NO: 906645 - DNA, 25 bp, Mus musculus
tgtgcattgtggcagtggactttta

SEQ ID NO: 906646 - DNA, 25 bp, Mus musculus
tgtgcattgtgggagtggactttta

SEQ ID NO: 906647 - DNA, 25 bp, Mus musculus
tgtgcatttacaccgacaactctgt

SEQ ID NO: 906648 - DNA, 25 bp, Mus musculus
tgtgcatttacagcgacaactctgt

SEQ ID NO: 906649 - DNA, 25 bp, Mus musculus
tgtgcatttcacataataagctgtt

SEQ ID NO: 906650 - DNA, 25 bp, Mus musculus
tgtgcatttcacttaataagctgtt

SEQ ID NO: 906651 - DNA, 25 bp, Mus musculus
tgtgcatttgccataccatttgtac

SEQ ID NO: 906652 - DNA, 25 bp, Mus musculus
tgtgcatttgccttaccatttgtac

SEQ ID NO: 906653 - DNA, 25 bp, Mus musculus
tgtgcattttgtagtgacttcaagt

SEQ ID NO: 906654 - DNA, 25 bp, Mus musculus
tgtgcattttgttgtgacttcaagt

SEQ ID NO: 906655 - DNA, 25 bp, Mus musculus
tgtgcattttttcccatgctgaacc

SEQ ID NO: 906656 - DNA, 25 bp, Mus musculus
tgtgcattttttgccatgctgaacc

SEQ ID NO: 906657 - DNA, 25 bp, Mus musculus
tgtgccaaacacaaggattacccct

SEQ ID NO: 906658 - DNA, 25 bp, Mus musculus
tgtgccaaacacattttcaagagta

SEQ ID NO: 906659 - DNA, 25 bp, Mus musculus
tgtgccaaacactaggattacccct

SEQ ID NO: 906660 - DNA, 25 bp, Mus musculus
tgtgccaaacactttttcaagagta

SEQ ID NO: 906661 - DNA, 25 bp, Mus musculus
tgtgccaaagtgactcgccgagctt

SEQ ID NO: 906662 - DNA, 25 bp, Mus musculus
tgtgccaaagtgtctcgccgagctt

SEQ ID NO: 906663 - DNA, 25 bp, Mus musculus
tgtgccaaattacttacctgccctt

SEQ ID NO: 906664 - DNA, 25 bp, Mus musculus
tgtgccaaattagttacctgccctt

SEQ ID NO: 906665 - DNA, 25 bp, Mus musculus
tgtgccaacaggctcagtttttcat

SEQ ID NO: 906666 - DNA, 25 bp, Mus musculus
tgtgccaacagggtcagtttttcat

SEQ ID NO: 906667 - DNA, 25 bp, Mus musculus
tgtgccaactggaaacatgctactt

SEQ ID NO: 906668 - DNA, 25 bp, Mus musculus
tgtgccaactggtaacatgctactt

SEQ ID NO: 906669 - DNA, 25 bp, Mus musculus
tgtgccaagaccctggaacatgtca

SEQ ID NO: 906670 - DNA, 25 bp, Mus musculus
tgtgccaagaccgtggaacatgtca

SEQ ID NO: 906671 - DNA, 25 bp, Mus musculus
tgtgccaagcccagctgacagtgga

SEQ ID NO: 906672 - DNA, 25 bp, Mus musculus
tgtgccaagccctgctgacagtgga

SEQ ID NO: 906673 - DNA, 25 bp, Mus musculus
tgtgccaagcctcaaggatgcccat

SEQ ID NO: 906674 - DNA, 25 bp, Mus musculus
tgtgccaagcctgaaggatgcccat

SEQ ID NO: 906675 - DNA, 25 bp, Mus musculus
tgtgccaagctcatctccagaacag

SEQ ID NO: 906676 - DNA, 25 bp, Mus musculus
tgtgccaagctcttctccagaacag

SEQ ID NO: 906677 - DNA, 25 bp, Mus musculus
tgtgccaaggcactcagacctggag

SEQ ID NO: 906678 - DNA, 25 bp, Mus musculus
tgtgccaaggcagtcagacctggag

SEQ ID NO: 906679 - DNA, 25 bp, Mus musculus
tgtgccaaggtcatctggacttact

SEQ ID NO: 906680 - DNA, 25 bp, Mus musculus
tgtgccaaggtcttctggacttact

SEQ ID NO: 906681 - DNA, 25 bp, Mus musculus
tgtgccaagtacctctgctgcttct

SEQ ID NO: 906682 - DNA, 25 bp, Mus musculus
tgtgccaagtacgtctgctgcttct

SEQ ID NO: 906683 - DNA, 25 bp, Mus musculus
tgtgccaatatcagggtgtctgccc

SEQ ID NO: 906684 - DNA, 25 bp, Mus musculus
tgtgccaatatctgggtgtctgccc

SEQ ID NO: 906685 - DNA, 25 bp, Mus musculus
tgtgccaatcgtactcttcagagaa

SEQ ID NO: 906686 - DNA, 25 bp, Mus musculus
tgtgccaatcgttctcttcagagaa

SEQ ID NO: 906687 - DNA, 25 bp, Mus musculus
tgtgccaatgtgaaacatgtgacct

SEQ ID NO: 906688 - DNA, 25 bp, Mus musculus
tgtgccaatgtgtaacatgtgacct

SEQ ID NO: 906689 - DNA, 25 bp, Mus musculus
tgtgccacagcaagagctacaacaa

SEQ ID NO: 906690 - DNA, 25 bp, Mus musculus
tgtgccacagcaagttcaactttac

SEQ ID NO: 906691 - DNA, 25 bp, Mus musculus
tgtgccacagcatgagctacaacaa

SEQ ID NO: 906692 - DNA, 25 bp, Mus musculus
tgtgccacagcatgttcaactttac

SEQ ID NO: 906693 - DNA, 25 bp, Mus musculus
tgtgccacagccctttgcaacttac

SEQ ID NO: 906694 - DNA, 25 bp, Mus musculus
tgtgccacagccgtttgcaacttac

SEQ ID NO: 906695 - DNA, 25 bp, Mus musculus
tgtgccacaggaagtcccaccagaa

SEQ ID NO: 906696 - DNA, 25 bp, Mus musculus
tgtgccacaggatgtcccaccagaa

SEQ ID NO: 906697 - DNA, 25 bp, Mus musculus
tgtgccacagtgaagtccggcctca

SEQ ID NO: 906698 - DNA, 25 bp, Mus musculus
tgtgccacagtgtagtccggcctca

SEQ ID NO: 906699 - DNA, 25 bp, Mus musculus
tgtgccaccaaaccatctgtctagt

SEQ ID NO: 906700 - DNA, 25 bp, Mus musculus
tgtgccaccaaagcatctgtctagt

SEQ ID NO: 906701 - DNA, 25 bp, Mus musculus
tgtgccaccacactcagattttgtg

SEQ ID NO: 906702 - DNA, 25 bp, Mus musculus
tgtgccaccacagtcagattttgtg

SEQ ID NO: 906703 - DNA, 25 bp, Mus musculus
tgtgccaccataactgacttttctg

SEQ ID NO: 906704 - DNA, 25 bp, Mus musculus
tgtgccaccatatctgacttttctg

SEQ ID NO: 906705 - DNA, 25 bp, Mus musculus
tgtgccacccaacttccagatatgc

SEQ ID NO: 906706 - DNA, 25 bp, Mus musculus
tgtgccacccaagttccagatatgc

SEQ ID NO: 906707 - DNA, 25 bp, Mus musculus
tgtgccacccagagcaattgtcctc

SEQ ID NO: 906708 - DNA, 25 bp, Mus musculus
tgtgccacccagtgcaattgtcctc

SEQ ID NO: 906709 - DNA, 25 bp, Mus musculus
tgtgccacctgtcaagcaagttttt

SEQ ID NO: 906710 - DNA, 25 bp, Mus musculus
tgtgccacctgtgaagcaagttttt

SEQ ID NO: 906711 - DNA, 25 bp, Mus musculus
tgtgccaccttcacaataaactata

SEQ ID NO: 906712 - DNA, 25 bp, Mus musculus
tgtgccaccttctcaataaactata

SEQ ID NO: 906713 - DNA, 25 bp, Mus musculus
tgtgccacggcgaccaaggtgccca

SEQ ID NO: 906714 - DNA, 25 bp, Mus musculus
tgtgccacggcgtccaaggtgccca

SEQ ID NO: 906715 - DNA, 25 bp, Mus musculus
tgtgccacgtctcatgtgttgtaga

SEQ ID NO: 906716 - DNA, 25 bp, Mus musculus
tgtgccacgtctgatgtgttgtaga

SEQ ID NO: 906717 - DNA, 25 bp, Mus musculus
tgtgccacgtttccctaacttagag

SEQ ID NO: 906718 - DNA, 25 bp, Mus musculus
tgtgccacgtttgcctaacttagag

SEQ ID NO: 906719 - DNA, 25 bp, Mus musculus
tgtgccactaatctccagagcatgg

SEQ ID NO: 906720 - DNA, 25 bp, Mus musculus
tgtgccactaatgtccagagcatgg

SEQ ID NO: 906721 - DNA, 25 bp, Mus musculus
tgtgccactgaacgactggtggttt

SEQ ID NO: 906722 - DNA, 25 bp, Mus musculus
tgtgccactgaactgatgtcttttt

SEQ ID NO: 906723 - DNA, 25 bp, Mus musculus
tgtgccactgaaggactggtggttt

SEQ ID NO: 906724 - DNA, 25 bp, Mus musculus
tgtgccactgaagtgatgtcttttt

SEQ ID NO: 906725 - DNA, 25 bp, Mus musculus
tgtgccactgaccaagctaaccttg

SEQ ID NO: 906726 - DNA, 25 bp, Mus musculus
tgtgccactgacgaagctaaccttg

SEQ ID NO: 906727 - DNA, 25 bp, Mus musculus
tgtgccactggtctgagtcacccca

SEQ ID NO: 906728 - DNA, 25 bp, Mus musculus
tgtgccactggtgtgagtcacccca

SEQ ID NO: 906729 - DNA, 25 bp, Mus musculus
tgtgccacttccaggacaccgggat

SEQ ID NO: 906730 - DNA, 25 bp, Mus musculus
tgtgccacttcctggacaccgggat

SEQ ID NO: 906731 - DNA, 25 bp, Mus musculus
tgtgccagaagtcccctgtgtgccc

SEQ ID NO: 906732 - DNA, 25 bp, Mus musculus
tgtgccagaagtgccctgtgtgccc

SEQ ID NO: 906733 - DNA, 25 bp, Mus musculus
tgtgccagacacatacccattgtaa

SEQ ID NO: 906734 - DNA, 25 bp, Mus musculus
tgtgccagacacttacccattgtaa

SEQ ID NO: 906735 - DNA, 25 bp, Mus musculus
tgtgccagactgaggaaggtccctg

SEQ ID NO: 906736 - DNA, 25 bp, Mus musculus
tgtgccagactgtggaaggtccctg

SEQ ID NO: 906737 - DNA, 25 bp, Mus musculus
tgtgccagagggacaagccagcctg

SEQ ID NO: 906738 - DNA, 25 bp, Mus musculus
tgtgccagagggtcaagccagcctg

SEQ ID NO: 906739 - DNA, 25 bp, Mus musculus
tgtgccagatttccacctgcggctc

SEQ ID NO: 906740 - DNA, 25 bp, Mus musculus
tgtgccagatttgcacctgcggctc

SEQ ID NO: 906741 - DNA, 25 bp, Mus musculus
tgtgccagcaaactcaagcccactt

SEQ ID NO: 906742 - DNA, 25 bp, Mus musculus
tgtgccagcaaagtcaagcccactt

SEQ ID NO: 906743 - DNA, 25 bp, Mus musculus
tgtgccagcaagcatgctcttcggg

SEQ ID NO: 906744 - DNA, 25 bp, Mus musculus
tgtgccagcaaggatgctcttcggg

SEQ ID NO: 906745 - DNA, 25 bp, Mus musculus
tgtgccagcaatcacacgggtgtcc

SEQ ID NO: 906746 - DNA, 25 bp, Mus musculus
tgtgccagcaatgacacgggtgtcc

SEQ ID NO: 906747 - DNA, 25 bp, Mus musculus
tgtgccagcatgaatccctgacaag

SEQ ID NO: 906748 - DNA, 25 bp, Mus musculus
tgtgccagcatgtatccctgacaag

SEQ ID NO: 906749 - DNA, 25 bp, Mus musculus
tgtgccagccatctttcttatatgt

SEQ ID NO: 906750 - DNA, 25 bp, Mus musculus
tgtgccagccatgtttcttatatgt

SEQ ID NO: 906751 - DNA, 25 bp, Mus musculus
tgtgccagcgagaatggacgccttg

SEQ ID NO: 906752 - DNA, 25 bp, Mus musculus
tgtgccagcgagtatggacgccttg

SEQ ID NO: 906753 - DNA, 25 bp, Mus musculus
tgtgccaggaggagtcttagcagca

SEQ ID NO: 906754 - DNA, 25 bp, Mus musculus
tgtgccaggaggtgtcttagcagca

SEQ ID NO: 906755 - DNA, 25 bp, Mus musculus
tgtgccaggcacagactcaagcaag

SEQ ID NO: 906756 - DNA, 25 bp, Mus musculus
tgtgccaggcactgactcaagcaag

SEQ ID NO: 906757 - DNA, 25 bp, Mus musculus
tgtgccaggccgataccaggagcaa

SEQ ID NO: 906758 - DNA, 25 bp, Mus musculus
tgtgccaggccgttaccaggagcaa

SEQ ID NO: 906759 - DNA, 25 bp, Mus musculus
tgtgccaggcggacgttgagctcac

SEQ ID NO: 906760 - DNA, 25 bp, Mus musculus
tgtgccaggcggtcgttgagctcac

SEQ ID NO: 906761 - DNA, 25 bp, Mus musculus
tgtgccaggtctacccaaactctaa

SEQ ID NO: 906762 - DNA, 25 bp, Mus musculus
tgtgccaggtcttcccaaactctaa

SEQ ID NO: 906763 - DNA, 25 bp, Mus musculus
tgtgccagtacaagatgccagatga

SEQ ID NO: 906764 - DNA, 25 bp, Mus musculus
tgtgccagtacatgatgccagatga

SEQ ID NO: 906765 - DNA, 25 bp, Mus musculus
tgtgccagtccacgagactcagtac

SEQ ID NO: 906766 - DNA, 25 bp, Mus musculus
tgtgccagtccaggagactcagtac

SEQ ID NO: 906767 - DNA, 25 bp, Mus musculus
tgtgccagtttccaggagctgttta

SEQ ID NO: 906768 - DNA, 25 bp, Mus musculus
tgtgccagtttcgaggagctgttta

SEQ ID NO: 906769 - DNA, 25 bp, Mus musculus
tgtgccataaagatacattgtacgt

SEQ ID NO: 906770 - DNA, 25 bp, Mus musculus
tgtgccataaagttacattgtacgt

SEQ ID NO: 906771 - DNA, 25 bp, Mus musculus
tgtgccatacgcctgctcttggaac

SEQ ID NO: 906772 - DNA, 25 bp, Mus musculus
tgtgccatacgcgtgctcttggaac

SEQ ID NO: 906773 - DNA, 25 bp, Mus musculus
tgtgccatcaatatagtattcctag

SEQ ID NO: 906774 - DNA, 25 bp, Mus musculus
tgtgccatcaatttagtattcctag

SEQ ID NO: 906775 - DNA, 25 bp, Mus musculus
tgtgccatccatagcaaggttgtta

SEQ ID NO: 906776 - DNA, 25 bp, Mus musculus
tgtgccatccattgcaaggttgtta

SEQ ID NO: 906777 - DNA, 25 bp, Mus musculus
tgtgccatcctcacggaattatgat

SEQ ID NO: 906778 - DNA, 25 bp, Mus musculus
tgtgccatcctctcggaattatgat

SEQ ID NO: 906779 - DNA, 25 bp, Mus musculus
tgtgccatccttacaagggccacag

SEQ ID NO: 906780 - DNA, 25 bp, Mus musculus
tgtgccatcctttcaagggccacag

SEQ ID NO: 906781 - DNA, 25 bp, Mus musculus
tgtgccatcgctcgtgtgctgacaa

SEQ ID NO: 906782 - DNA, 25 bp, Mus musculus
tgtgccatcgctggtgtgctgacaa

SEQ ID NO: 906783 - DNA, 25 bp, Mus musculus
tgtgccatctgcagggtccaggtga

SEQ ID NO: 906784 - DNA, 25 bp, Mus musculus
tgtgccatctgctgggtccaggtga

SEQ ID NO: 906785 - DNA, 25 bp, Mus musculus
tgtgccatgaatactgccagcctga

SEQ ID NO: 906786 - DNA, 25 bp, Mus musculus
tgtgccatgaattctgccagcctga

SEQ ID NO: 906787 - DNA, 25 bp, Mus musculus
tgtgccatgcaaactgagggtcaga

SEQ ID NO: 906788 - DNA, 25 bp, Mus musculus
tgtgccatgcaatctgagggtcaga

SEQ ID NO: 906789 - DNA, 25 bp, Mus musculus
tgtgccatggtgagttatcacacat

SEQ ID NO: 906790 - DNA, 25 bp, Mus musculus
tgtgccatggtgtgttatcacacat

SEQ ID NO: 906791 - DNA, 25 bp, Mus musculus
tgtgccatgtgacccagatctttgg

SEQ ID NO: 906792 - DNA, 25 bp, Mus musculus
tgtgccatgtgagccagatctttgg

SEQ ID NO: 906793 - DNA, 25 bp, Mus musculus
tgtgccatgtggagccctacagaaa

SEQ ID NO: 906794 - DNA, 25 bp, Mus musculus
tgtgccatgtggtgccctacagaaa

SEQ ID NO: 906795 - DNA, 25 bp, Mus musculus
tgtgccattcagagtcgggtcacca

SEQ ID NO: 906796 - DNA, 25 bp, Mus musculus
tgtgccattcagtgtcgggtcacca

SEQ ID NO: 906797 - DNA, 25 bp, Mus musculus
tgtgccattgctatctacatctgaa

SEQ ID NO: 906798 - DNA, 25 bp, Mus musculus
tgtgccattgctttctacatctgaa

SEQ ID NO: 906799 - DNA, 25 bp, Mus musculus
tgtgccatttaaagtcccctgtgcc

SEQ ID NO: 906800 - DNA, 25 bp, Mus musculus
tgtgccatttaatgtcccctgtgcc

SEQ ID NO: 906801 - DNA, 25 bp, Mus musculus
tgtgccatttcaatcagccaggatt

SEQ ID NO: 906802 - DNA, 25 bp, Mus musculus
tgtgccatttcattcagccaggatt

SEQ ID NO: 906803 - DNA, 25 bp, Mus musculus
tgtgccatttctccttgtgactttg

SEQ ID NO: 906804 - DNA, 25 bp, Mus musculus
tgtgccatttctgcttgtgactttg

SEQ ID NO: 906805 - DNA, 25 bp, Mus musculus
tgtgcccaaaccaactctcaaagtg

SEQ ID NO: 906806 - DNA, 25 bp, Mus musculus
tgtgcccaaacctactctcaaagtg

SEQ ID NO: 906807 - DNA, 25 bp, Mus musculus
tgtgcccaaactctgccgcatcaag

SEQ ID NO: 906808 - DNA, 25 bp, Mus musculus
tgtgcccaaactgtgccgcatcaag

SEQ ID NO: 906809 - DNA, 25 bp, Mus musculus
tgtgcccaacctacatgtaatgaag

SEQ ID NO: 906810 - DNA, 25 bp, Mus musculus
tgtgcccaaccttcatgtaatgaag

SEQ ID NO: 906811 - DNA, 25 bp, Mus musculus
tgtgcccaagcaaaagctgctagtg

SEQ ID NO: 906812 - DNA, 25 bp, Mus musculus
tgtgcccaagcataagctgctagtg

SEQ ID NO: 906813 - DNA, 25 bp, Mus musculus
tgtgcccaatgacgtctagctagct

SEQ ID NO: 906814 - DNA, 25 bp, Mus musculus
tgtgcccaatgaggtctagctagct

SEQ ID NO: 906815 - DNA, 25 bp, Mus musculus
tgtgcccacacgcacacgttaacat

SEQ ID NO: 906816 - DNA, 25 bp, Mus musculus
tgtgcccacacggacacgttaacat

SEQ ID NO: 906817 - DNA, 25 bp, Mus musculus
tgtgcccacatgaagctgctttttc

SEQ ID NO: 906818 - DNA, 25 bp, Mus musculus
tgtgcccacatgtagctgctttttc

SEQ ID NO: 906819 - DNA, 25 bp, Mus musculus
tgtgcccaccatactggttatgtaa

SEQ ID NO: 906820 - DNA, 25 bp, Mus musculus
tgtgcccaccattctggttatgtaa

SEQ ID NO: 906821 - DNA, 25 bp, Mus musculus
tgtgcccaccgtacttaggcatcag

SEQ ID NO: 906822 - DNA, 25 bp, Mus musculus
tgtgcccaccgttcttaggcatcag

SEQ ID NO: 906823 - DNA, 25 bp, Mus musculus
tgtgcccacgaactaggacaccaga

SEQ ID NO: 906824 - DNA, 25 bp, Mus musculus
tgtgcccacgaagtaggacaccaga

SEQ ID NO: 906825 - DNA, 25 bp, Mus musculus
tgtgcccacgtacccatgtgtgtgt

SEQ ID NO: 906826 - DNA, 25 bp, Mus musculus
tgtgcccacgtagccatgtgtgtgt

SEQ ID NO: 906827 - DNA, 25 bp, Mus musculus
tgtgcccactaaccgcctggagcag

SEQ ID NO: 906828 - DNA, 25 bp, Mus musculus
tgtgcccactaagcgcctggagcag

SEQ ID NO: 906829 - DNA, 25 bp, Mus musculus
tgtgcccactacagcttttgtaact

SEQ ID NO: 906830 - DNA, 25 bp, Mus musculus
tgtgcccactactgcttttgtaact

SEQ ID NO: 906831 - DNA, 25 bp, Mus musculus
tgtgcccactcaatttaactgctgt

SEQ ID NO: 906832 - DNA, 25 bp, Mus musculus
tgtgcccactcattttaactgctgt

SEQ ID NO: 906833 - DNA, 25 bp, Mus musculus
tgtgcccactctaacctcaatggag

SEQ ID NO: 906834 - DNA, 25 bp, Mus musculus
tgtgcccactcttacctcaatggag

SEQ ID NO: 906835 - DNA, 25 bp, Mus musculus
tgtgcccactgcaaaagtccactgc

SEQ ID NO: 906836 - DNA, 25 bp, Mus musculus
tgtgcccactgctaaagtccactgc

SEQ ID NO: 906837 - DNA, 25 bp, Mus musculus
tgtgcccactggagccaacaacggt

SEQ ID NO: 906838 - DNA, 25 bp, Mus musculus
tgtgcccactggtgccaacaacggt

SEQ ID NO: 906839 - DNA, 25 bp, Mus musculus
tgtgcccactttacttacgatggtc

SEQ ID NO: 906840 - DNA, 25 bp, Mus musculus
tgtgcccactttcaggacatcacca

SEQ ID NO: 906841 - DNA, 25 bp, Mus musculus
tgtgcccactttgaggacatcacca

SEQ ID NO: 906842 - DNA, 25 bp, Mus musculus
tgtgcccacttttcttacgatggtc

SEQ ID NO: 906843 - DNA, 25 bp, Mus musculus
tgtgcccagaaccagatgacgtaga

SEQ ID NO: 906844 - DNA, 25 bp, Mus musculus
tgtgcccagaacgagatgacgtaga

SEQ ID NO: 906845 - DNA, 25 bp, Mus musculus
tgtgcccagattactggtgtgccaa

SEQ ID NO: 906846 - DNA, 25 bp, Mus musculus
tgtgcccagatttctggtgtgccaa

SEQ ID NO: 906847 - DNA, 25 bp, Mus musculus
tgtgcccagcagatagttttggttt

SEQ ID NO: 906848 - DNA, 25 bp, Mus musculus
tgtgcccagcagttagttttggttt

SEQ ID NO: 906849 - DNA, 25 bp, Mus musculus
tgtgcccagctcatacaggtgtgca

SEQ ID NO: 906850 - DNA, 25 bp, Mus musculus
tgtgcccagctcttacaggtgtgca

SEQ ID NO: 906851 - DNA, 25 bp, Mus musculus
tgtgcccagtttctctgatagcgat

SEQ ID NO: 906852 - DNA, 25 bp, Mus musculus
tgtgcccagtttgtctgatagcgat

SEQ ID NO: 906853 - DNA, 25 bp, Mus musculus
tgtgcccatcaacccagagtgaact

SEQ ID NO: 906854 - DNA, 25 bp, Mus musculus
tgtgcccatcaagccagagtgaact

SEQ ID NO: 906855 - DNA, 25 bp, Mus musculus
tgtgcccatcacaggtaggactacc

SEQ ID NO: 906856 - DNA, 25 bp, Mus musculus
tgtgcccatcactggtaggactacc

SEQ ID NO: 906857 - DNA, 25 bp, Mus musculus
tgtgcccatcgtcaacctgaaggac

SEQ ID NO: 906858 - DNA, 25 bp, Mus musculus
tgtgcccatcgtgaacctgaaggac

SEQ ID NO: 906859 - DNA, 25 bp, Mus musculus
tgtgcccatcttagatccatgggat

SEQ ID NO: 906860 - DNA, 25 bp, Mus musculus
tgtgcccatctttgatccatgggat

SEQ ID NO: 906861 - DNA, 25 bp, Mus musculus
tgtgcccatgataatcccatttcat

SEQ ID NO: 906862 - DNA, 25 bp, Mus musculus
tgtgcccatgattatcccatttcat

SEQ ID NO: 906863 - DNA, 25 bp, Mus musculus
tgtgcccatgcacgaaagctccctt

SEQ ID NO: 906864 - DNA, 25 bp, Mus musculus
tgtgcccatgcaggaaagctccctt

SEQ ID NO: 906865 - DNA, 25 bp, Mus musculus
tgtgcccatgggagctgtcttagcc

SEQ ID NO: 906866 - DNA, 25 bp, Mus musculus
tgtgcccatgggtgctgtcttagcc

SEQ ID NO: 906867 - DNA, 25 bp, Mus musculus
tgtgcccatgtgacacgtctgacag

SEQ ID NO: 906868 - DNA, 25 bp, Mus musculus
tgtgcccatgtgtcacgtctgacag

SEQ ID NO: 906869 - DNA, 25 bp, Mus musculus
tgtgcccattctaagcctatggagt

SEQ ID NO: 906870 - DNA, 25 bp, Mus musculus
tgtgcccattcttagcctatggagt

SEQ ID NO: 906871 - DNA, 25 bp, Mus musculus
tgtgcccattgccaagcgtgagcta

SEQ ID NO: 906872 - DNA, 25 bp, Mus musculus
tgtgcccattgcgaagcgtgagcta

SEQ ID NO: 906873 - DNA, 25 bp, Mus musculus
tgtgcccatttcattatatgtgagt

SEQ ID NO: 906874 - DNA, 25 bp, Mus musculus
tgtgcccatttctttatatgtgagt

SEQ ID NO: 906875 - DNA, 25 bp, Mus musculus
tgtgcccattttataatacctcgcc

SEQ ID NO: 906876 - DNA, 25 bp, Mus musculus
tgtgcccattttttaatacctcgcc

SEQ ID NO: 906877 - DNA, 25 bp, Mus musculus
tgtgccccaatacatgaggccctta

SEQ ID NO: 906878 - DNA, 25 bp, Mus musculus
tgtgccccaatagatgaggccctta

SEQ ID NO: 906879 - DNA, 25 bp, Mus musculus
tgtgccccacatcattttgttttcc

SEQ ID NO: 906880 - DNA, 25 bp, Mus musculus
tgtgccccacatgattttgttttcc

SEQ ID NO: 906881 - DNA, 25 bp, Mus musculus
tgtgccccaggtctaatacgagaaa

SEQ ID NO: 906882 - DNA, 25 bp, Mus musculus
tgtgccccaggtgtaatacgagaaa

SEQ ID NO: 906883 - DNA, 25 bp, Mus musculus
tgtgccccatagatatagcctcaaa

SEQ ID NO: 906884 - DNA, 25 bp, Mus musculus
tgtgccccatagttatagcctcaaa

SEQ ID NO: 906885 - DNA, 25 bp, Mus musculus
tgtgccccattgcttctcagcagga

SEQ ID NO: 906886 - DNA, 25 bp, Mus musculus
tgtgccccattggttctcagcagga

SEQ ID NO: 906887 - DNA, 25 bp, Mus musculus
tgtgccccgaaaaaacaatggtgct

SEQ ID NO: 906888 - DNA, 25 bp, Mus musculus
tgtgccccgaaataacaatggtgct

SEQ ID NO: 906889 - DNA, 25 bp, Mus musculus
tgtgccccgggcatgccagttacca

SEQ ID NO: 906890 - DNA, 25 bp, Mus musculus
tgtgccccgggcttgccagttacca

SEQ ID NO: 906891 - DNA, 25 bp, Mus musculus
tgtgccccgttgattagtcctacat

SEQ ID NO: 906892 - DNA, 25 bp, Mus musculus
tgtgccccgttgtttagtcctacat

SEQ ID NO: 906893 - DNA, 25 bp, Mus musculus
tgtgcccctcacattttatgttatt

SEQ ID NO: 906894 - DNA, 25 bp, Mus musculus
tgtgcccctcactttttatgttatt

SEQ ID NO: 906895 - DNA, 25 bp, Mus musculus
tgtgcccctcagacgactatagatg

SEQ ID NO: 906896 - DNA, 25 bp, Mus musculus
tgtgcccctcagtcgactatagatg

SEQ ID NO: 906897 - DNA, 25 bp, Mus musculus
tgtgcccctgaaacttctatagaga

SEQ ID NO: 906898 - DNA, 25 bp, Mus musculus
tgtgcccctgaatcttctatagaga

SEQ ID NO: 906899 - DNA, 25 bp, Mus musculus
tgtgcccctgatacatagcggattc

SEQ ID NO: 906900 - DNA, 25 bp, Mus musculus
tgtgcccctgattcatagcggattc

SEQ ID NO: 906901 - DNA, 25 bp, Mus musculus
tgtgcccctgctaccagtagaagaa

SEQ ID NO: 906902 - DNA, 25 bp, Mus musculus
tgtgcccctgcttccagtagaagaa

SEQ ID NO: 906903 - DNA, 25 bp, Mus musculus
tgtgcccctgtcactcaagtactgg

SEQ ID NO: 906904 - DNA, 25 bp, Mus musculus
tgtgcccctgtctctcaagtactgg

SEQ ID NO: 906905 - DNA, 25 bp, Mus musculus
tgtgccccttagatacaactgtgat

SEQ ID NO: 906906 - DNA, 25 bp, Mus musculus
tgtgccccttagttacaactgtgat

SEQ ID NO: 906907 - DNA, 25 bp, Mus musculus
tgtgccccttataaacccagctgga

SEQ ID NO: 906908 - DNA, 25 bp, Mus musculus
tgtgccccttattaacccagctgga

SEQ ID NO: 906909 - DNA, 25 bp, Mus musculus
tgtgcccgcttacctttgtggagtg

SEQ ID NO: 906910 - DNA, 25 bp, Mus musculus
tgtgcccgcttagctttgtggagtg

SEQ ID NO: 906911 - DNA, 25 bp, Mus musculus
tgtgcccggatgagtggcccctgct

SEQ ID NO: 906912 - DNA, 25 bp, Mus musculus
tgtgcccggatgtgtggcccctgct

SEQ ID NO: 906913 - DNA, 25 bp, Mus musculus
tgtgcccggctccatacgtatcaag

SEQ ID NO: 906914 - DNA, 25 bp, Mus musculus
tgtgcccggctcgatacgtatcaag

SEQ ID NO: 906915 - DNA, 25 bp, Mus musculus
tgtgcccgggttaactcggaaagct

SEQ ID NO: 906916 - DNA, 25 bp, Mus musculus
tgtgcccgggtttactcggaaagct

SEQ ID NO: 906917 - DNA, 25 bp, Mus musculus
tgtgcccgtactaacatctactgaa

SEQ ID NO: 906918 - DNA, 25 bp, Mus musculus
tgtgcccgtacttacatctactgaa

SEQ ID NO: 906919 - DNA, 25 bp, Mus musculus
tgtgcccgtgcaccgttctgttaca

SEQ ID NO: 906920 - DNA, 25 bp, Mus musculus
tgtgcccgtgcagcgttctgttaca

SEQ ID NO: 906921 - DNA, 25 bp, Mus musculus
tgtgcccgtggtactgtgaatgatg

SEQ ID NO: 906922 - DNA, 25 bp, Mus musculus
tgtgcccgtggttctgtgaatgatg

SEQ ID NO: 906923 - DNA, 25 bp, Mus musculus
tgtgccctaaggcttggtcgcatag

SEQ ID NO: 906924 - DNA, 25 bp, Mus musculus
tgtgccctaagggttggtcgcatag

SEQ ID NO: 906925 - DNA, 25 bp, Mus musculus
tgtgccctagccagacgcataaata

SEQ ID NO: 906926 - DNA, 25 bp, Mus musculus
tgtgccctagcctgacgcataaata

SEQ ID NO: 906927 - DNA, 25 bp, Mus musculus
tgtgccctagctcggtgtcacggcc

SEQ ID NO: 906928 - DNA, 25 bp, Mus musculus
tgtgccctagctgggtgtcacggcc

SEQ ID NO: 906929 - DNA, 25 bp, Mus musculus
tgtgccctcaggagatgttgccaaa

SEQ ID NO: 906930 - DNA, 25 bp, Mus musculus
tgtgccctcaggtgatgttgccaaa

SEQ ID NO: 906931 - DNA, 25 bp, Mus musculus
tgtgccctcgacaaccacagtaagg

SEQ ID NO: 906932 - DNA, 25 bp, Mus musculus
tgtgccctcgactaccacagtaagg

SEQ ID NO: 906933 - DNA, 25 bp, Mus musculus
tgtgccctctatctcaggcaggaat

SEQ ID NO: 906934 - DNA, 25 bp, Mus musculus
tgtgccctctatgtcaggcaggaat

SEQ ID NO: 906935 - DNA, 25 bp, Mus musculus
tgtgccctctctagtatttgcttga

SEQ ID NO: 906936 - DNA, 25 bp, Mus musculus
tgtgccctctctctacagcatcagt

SEQ ID NO: 906937 - DNA, 25 bp, Mus musculus
tgtgccctctctgtacagcatcagt

SEQ ID NO: 906938 - DNA, 25 bp, Mus musculus
tgtgccctctcttgtatttgcttga

SEQ ID NO: 906939 - DNA, 25 bp, Mus musculus
tgtgccctctttacaatcttcacca

SEQ ID NO: 906940 - DNA, 25 bp, Mus musculus
tgtgccctcttttcaatcttcacca

SEQ ID NO: 906941 - DNA, 25 bp, Mus musculus
tgtgccctgactcagacttcagtaa

SEQ ID NO: 906942 - DNA, 25 bp, Mus musculus
tgtgccctgactgagacttcagtaa

SEQ ID NO: 906943 - DNA, 25 bp, Mus musculus
tgtgccctgcacatgcgaagacgtg

SEQ ID NO: 906944 - DNA, 25 bp, Mus musculus
tgtgccctgcacttgcgaagacgtg

SEQ ID NO: 906945 - DNA, 25 bp, Mus musculus
tgtgccctgcagatgagatgatttc

SEQ ID NO: 906946 - DNA, 25 bp, Mus musculus
tgtgccctgcagttgagatgatttc

SEQ ID NO: 906947 - DNA, 25 bp, Mus musculus
tgtgccctgctgcttgggtttcagt

SEQ ID NO: 906948 - DNA, 25 bp, Mus musculus
tgtgccctgctggttgggtttcagt

SEQ ID NO: 906949 - DNA, 25 bp, Mus musculus
tgtgccctggctaataactgtgaaa

SEQ ID NO: 906950 - DNA, 25 bp, Mus musculus
tgtgccctggcttataactgtgaaa

SEQ ID NO: 906951 - DNA, 25 bp, Mus musculus
tgtgccctgggaatcataagcttga

SEQ ID NO: 906952 - DNA, 25 bp, Mus musculus
tgtgccctgggattcataagcttga

SEQ ID NO: 906953 - DNA, 25 bp, Mus musculus
tgtgccctgggtatcaggagcctat

SEQ ID NO: 906954 - DNA, 25 bp, Mus musculus
tgtgccctgggtcaaaggctgccta

SEQ ID NO: 906955 - DNA, 25 bp, Mus musculus
tgtgccctgggtgaaaggctgccta

SEQ ID NO: 906956 - DNA, 25 bp, Mus musculus
tgtgccctgggtttcaggagcctat

SEQ ID NO: 906957 - DNA, 25 bp, Mus musculus
tgtgccctgtatcgctgtaaatata

SEQ ID NO: 906958 - DNA, 25 bp, Mus musculus
tgtgccctgtatggctgtaaatata

SEQ ID NO: 906959 - DNA, 25 bp, Mus musculus
tgtgccctgtccagtacagacatgg

SEQ ID NO: 906960 - DNA, 25 bp, Mus musculus
tgtgccctgtcctgtacagacatgg

SEQ ID NO: 906961 - DNA, 25 bp, Mus musculus
tgtgccctgtgtcaagtgagctaga

SEQ ID NO: 906962 - DNA, 25 bp, Mus musculus
tgtgccctgtgtgaagtgagctaga

SEQ ID NO: 906963 - DNA, 25 bp, Mus musculus
tgtgcccttatgagccagaaacttc

SEQ ID NO: 906964 - DNA, 25 bp, Mus musculus
tgtgcccttatgtgccagaaacttc

SEQ ID NO: 906965 - DNA, 25 bp, Mus musculus
tgtgcccttcatctggttggaaact

SEQ ID NO: 906966 - DNA, 25 bp, Mus musculus
tgtgcccttcatgtggttggaaact

SEQ ID NO: 906967 - DNA, 25 bp, Mus musculus
tgtgccctttgccatacgtaggaat

SEQ ID NO: 906968 - DNA, 25 bp, Mus musculus
tgtgccctttgcgatacgtaggaat

SEQ ID NO: 906969 - DNA, 25 bp, Mus musculus
tgtgccctttggcaagccagagttg

SEQ ID NO: 906970 - DNA, 25 bp, Mus musculus
tgtgccctttgggaagccagagttg

SEQ ID NO: 906971 - DNA, 25 bp, Mus musculus
tgtgccctttgtcgtcagatacttc

SEQ ID NO: 906972 - DNA, 25 bp, Mus musculus
tgtgccctttgtggtcagatacttc

SEQ ID NO: 906973 - DNA, 25 bp, Mus musculus
tgtgccgagggtatgcctttgatat

SEQ ID NO: 906974 - DNA, 25 bp, Mus musculus
tgtgccgagggtttgcctttgatat

SEQ ID NO: 906975 - DNA, 25 bp, Mus musculus
tgtgccgatcacctacagacttcca

SEQ ID NO: 906976 - DNA, 25 bp, Mus musculus
tgtgccgatcacgtacagacttcca

SEQ ID NO: 906977 - DNA, 25 bp, Mus musculus
tgtgccgcagccatcattgtgctga

SEQ ID NO: 906978 - DNA, 25 bp, Mus musculus
tgtgccgcagccttcattgtgctga

SEQ ID NO: 906979 - DNA, 25 bp, Mus musculus
tgtgccgcagtgactttgccatcgt

SEQ ID NO: 906980 - DNA, 25 bp, Mus musculus
tgtgccgcagtgtctttgccatcgt

SEQ ID NO: 906981 - DNA, 25 bp, Mus musculus
tgtgccgcctcgatttatgggtggg

SEQ ID NO: 906982 - DNA, 25 bp, Mus musculus
tgtgccgcctcgttttatgggtggg

SEQ ID NO: 906983 - DNA, 25 bp, Mus musculus
tgtgccgcgtcactcatgccgaagc

SEQ ID NO: 906984 - DNA, 25 bp, Mus musculus
tgtgccgcgtcagtcatgccgaagc

SEQ ID NO: 906985 - DNA, 25 bp, Mus musculus
tgtgccggacaccacctagctgcag

SEQ ID NO: 906986 - DNA, 25 bp, Mus musculus
tgtgccggacacgacctagctgcag

SEQ ID NO: 906987 - DNA, 25 bp, Mus musculus
tgtgccggataaaatcaatctcatc

SEQ ID NO: 906988 - DNA, 25 bp, Mus musculus
tgtgccggataatatcaatctcatc

SEQ ID NO: 906989 - DNA, 25 bp, Mus musculus
tgtgccggccctacgaggagagcgg

SEQ ID NO: 906990 - DNA, 25 bp, Mus musculus
tgtgccggcccttcgaggagagcgg

SEQ ID NO: 906991 - DNA, 25 bp, Mus musculus
tgtgccggctacagtcctagcatgg

SEQ ID NO: 906992 - DNA, 25 bp, Mus musculus
tgtgccggctacatcgactgcaagt

SEQ ID NO: 906993 - DNA, 25 bp, Mus musculus
tgtgccggctactgtcctagcatgg

SEQ ID NO: 906994 - DNA, 25 bp, Mus musculus
tgtgccggctacttcgactgcaagt

SEQ ID NO: 906995 - DNA, 25 bp, Mus musculus
tgtgccgggcaccattaccaagaat

SEQ ID NO: 906996 - DNA, 25 bp, Mus musculus
tgtgccgggcacgattaccaagaat

SEQ ID NO: 906997 - DNA, 25 bp, Mus musculus
tgtgccgggcccacagaaagtcatg

SEQ ID NO: 906998 - DNA, 25 bp, Mus musculus
tgtgccgggccctcagaaagtcatg

SEQ ID NO: 906999 - DNA, 25 bp, Mus musculus
tgtgccggtattctggaccagcctg

SEQ ID NO: 907000 - DNA, 25 bp, Mus musculus
tgtgccggtattgtggaccagcctg

SEQ ID NO: 907001 - DNA, 25 bp, Mus musculus
tgtgccggtgaactcggagacccac

SEQ ID NO: 907002 - DNA, 25 bp, Mus musculus
tgtgccggtgaagtcggagacccac

SEQ ID NO: 907003 - DNA, 25 bp, Mus musculus
tgtgccggtgtgactggaagctcca

SEQ ID NO: 907004 - DNA, 25 bp, Mus musculus
tgtgccggtgtgtctggaagctcca

SEQ ID NO: 907005 - DNA, 25 bp, Mus musculus
tgtgccgtatgtcttccggtacttt

SEQ ID NO: 907006 - DNA, 25 bp, Mus musculus
tgtgccgtatgtgttccggtacttt

SEQ ID NO: 907007 - DNA, 25 bp, Mus musculus
tgtgccgtatttctgtgtcttgata

SEQ ID NO: 907008 - DNA, 25 bp, Mus musculus
tgtgccgtatttgtgtgtcttgata

SEQ ID NO: 907009 - DNA, 25 bp, Mus musculus
tgtgccgtgagtaaagccagcgccc

SEQ ID NO: 907010 - DNA, 25 bp, Mus musculus
tgtgccgtgagttaagccagcgccc

SEQ ID NO: 907011 - DNA, 25 bp, Mus musculus
tgtgcctaacttactctgggccata

SEQ ID NO: 907012 - DNA, 25 bp, Mus musculus
tgtgcctaactttctctgggccata

SEQ ID NO: 907013 - DNA, 25 bp, Mus musculus
tgtgcctaagttaacttactataga

SEQ ID NO: 907014 - DNA, 25 bp, Mus musculus
tgtgcctaagtttacttactataga

SEQ ID NO: 907015 - DNA, 25 bp, Mus musculus
tgtgcctacaaactctcgcaagcag

SEQ ID NO: 907016 - DNA, 25 bp, Mus musculus
tgtgcctacaaagtctcgcaagcag

SEQ ID NO: 907017 - DNA, 25 bp, Mus musculus
tgtgcctacctaaccaggaggattc

SEQ ID NO: 907018 - DNA, 25 bp, Mus musculus
tgtgcctacctatccaggaggattc

SEQ ID NO: 907019 - DNA, 25 bp, Mus musculus
tgtgcctactcacacttacagaaca

SEQ ID NO: 907020 - DNA, 25 bp, Mus musculus
tgtgcctactcagacttacagaaca

SEQ ID NO: 907021 - DNA, 25 bp, Mus musculus
tgtgcctagcttcgtgtccattcaa

SEQ ID NO: 907022 - DNA, 25 bp, Mus musculus
tgtgcctagcttggtgtccattcaa

SEQ ID NO: 907023 - DNA, 25 bp, Mus musculus
tgtgcctaggtgctcaataaagttg

SEQ ID NO: 907024 - DNA, 25 bp, Mus musculus
tgtgcctaggtggtcaataaagttg

SEQ ID NO: 907025 - DNA, 25 bp, Mus musculus
tgtgcctatgtgagatcagagtgtc

SEQ ID NO: 907026 - DNA, 25 bp, Mus musculus
tgtgcctatgtgtgatcagagtgtc

SEQ ID NO: 907027 - DNA, 25 bp, Mus musculus
tgtgcctatttgagcactgtgtgca

SEQ ID NO: 907028 - DNA, 25 bp, Mus musculus
tgtgcctatttgtgcactgtgtgca

SEQ ID NO: 907029 - DNA, 25 bp, Mus musculus
tgtgcctcaattcctccatttgtga

SEQ ID NO: 907030 - DNA, 25 bp, Mus musculus
tgtgcctcaattgctccatttgtga

SEQ ID NO: 907031 - DNA, 25 bp, Mus musculus
tgtgcctcagaacagctgccagggt

SEQ ID NO: 907032 - DNA, 25 bp, Mus musculus
tgtgcctcagaagagctgccagggt

SEQ ID NO: 907033 - DNA, 25 bp, Mus musculus
tgtgcctcagttagcactctcctgg

SEQ ID NO: 907034 - DNA, 25 bp, Mus musculus
tgtgcctcagtttgcactctcctgg

SEQ ID NO: 907035 - DNA, 25 bp, Mus musculus
tgtgcctccaatcagcgttaattta

SEQ ID NO: 907036 - DNA, 25 bp, Mus musculus
tgtgcctccaatcctggacacagag

SEQ ID NO: 907037 - DNA, 25 bp, Mus musculus
tgtgcctccaatgagcgttaattta

SEQ ID NO: 907038 - DNA, 25 bp, Mus musculus
tgtgcctccaatgctggacacagag

SEQ ID NO: 907039 - DNA, 25 bp, Mus musculus
tgtgcctccactcaggatgtcttgc

SEQ ID NO: 907040 - DNA, 25 bp, Mus musculus
tgtgcctccactgaggatgtcttgc

SEQ ID NO: 907041 - DNA, 25 bp, Mus musculus
tgtgcctccctgaacaggatttccc

SEQ ID NO: 907042 - DNA, 25 bp, Mus musculus
tgtgcctccctgtacaggatttccc

SEQ ID NO: 907043 - DNA, 25 bp, Mus musculus
tgtgcctcctaaattaccagaaagt

SEQ ID NO: 907044 - DNA, 25 bp, Mus musculus
tgtgcctcctaatttaccagaaagt

SEQ ID NO: 907045 - DNA, 25 bp, Mus musculus
tgtgcctcctctcttaagtcctttc

SEQ ID NO: 907046 - DNA, 25 bp, Mus musculus
tgtgcctcctctgttaagtcctttc

SEQ ID NO: 907047 - DNA, 25 bp, Mus musculus
tgtgcctcctgccacaaaaatttgc

SEQ ID NO: 907048 - DNA, 25 bp, Mus musculus
tgtgcctcctgcgacaaaaatttgc

SEQ ID NO: 907049 - DNA, 25 bp, Mus musculus
tgtgcctccttcactaaatatgtat

SEQ ID NO: 907050 - DNA, 25 bp, Mus musculus
tgtgcctccttctctaaatatgtat

SEQ ID NO: 907051 - DNA, 25 bp, Mus musculus
tgtgcctcgcagaaaggccactcat

SEQ ID NO: 907052 - DNA, 25 bp, Mus musculus
tgtgcctcgcagtaaggccactcat

SEQ ID NO: 907053 - DNA, 25 bp, Mus musculus
tgtgcctcgctgaaagcacggacag

SEQ ID NO: 907054 - DNA, 25 bp, Mus musculus
tgtgcctcgctgtaagcacggacag

SEQ ID NO: 907055 - DNA, 25 bp, Mus musculus
tgtgcctcggcaaagacgtggacac

SEQ ID NO: 907056 - DNA, 25 bp, Mus musculus
tgtgcctcggcatagacgtggacac

SEQ ID NO: 907057 - DNA, 25 bp, Mus musculus
tgtgcctcgtcgcttgggacctaaa

SEQ ID NO: 907058 - DNA, 25 bp, Mus musculus
tgtgcctcgtcggttgggacctaaa

SEQ ID NO: 907059 - DNA, 25 bp, Mus musculus
tgtgcctctcaactggtgcaggctg

SEQ ID NO: 907060 - DNA, 25 bp, Mus musculus
tgtgcctctcaagtggtgcaggctg

SEQ ID NO: 907061 - DNA, 25 bp, Mus musculus
tgtgcctctgtgactcgtttaaaaa

SEQ ID NO: 907062 - DNA, 25 bp, Mus musculus
tgtgcctctgtgtctcgtttaaaaa

SEQ ID NO: 907063 - DNA, 25 bp, Mus musculus
tgtgcctctgttacccaagaggttt

SEQ ID NO: 907064 - DNA, 25 bp, Mus musculus
tgtgcctctgtttcccaagaggttt

SEQ ID NO: 907065 - DNA, 25 bp, Mus musculus
tgtgcctcttagctacttctcggat

SEQ ID NO: 907066 - DNA, 25 bp, Mus musculus
tgtgcctcttaggtacttctcggat

SEQ ID NO: 907067 - DNA, 25 bp, Mus musculus
tgtgcctcttccatttgacctagga

SEQ ID NO: 907068 - DNA, 25 bp, Mus musculus
tgtgcctcttccttttgacctagga

SEQ ID NO: 907069 - DNA, 25 bp, Mus musculus
tgtgcctcttgcacaccataaataa

SEQ ID NO: 907070 - DNA, 25 bp, Mus musculus
tgtgcctcttgctcaccataaataa

SEQ ID NO: 907071 - DNA, 25 bp, Mus musculus
tgtgcctgaccccagatggaaaata

SEQ ID NO: 907072 - DNA, 25 bp, Mus musculus
tgtgcctgacccgagatggaaaata

SEQ ID NO: 907073 - DNA, 25 bp, Mus musculus
tgtgcctgcaaaaacccttacacgg

SEQ ID NO: 907074 - DNA, 25 bp, Mus musculus
tgtgcctgcaaatacccttacacgg

SEQ ID NO: 907075 - DNA, 25 bp, Mus musculus
tgtgcctgcagaattcgacctacaa

SEQ ID NO: 907076 - DNA, 25 bp, Mus musculus
tgtgcctgcagatttcgacctacaa

SEQ ID NO: 907077 - DNA, 25 bp, Mus musculus
tgtgcctgctcccaaaatctagatg

SEQ ID NO: 907078 - DNA, 25 bp, Mus musculus
tgtgcctgctccgaaaatctagatg

SEQ ID NO: 907079 - DNA, 25 bp, Mus musculus
tgtgcctgctgtatgaactaacaag

SEQ ID NO: 907080 - DNA, 25 bp, Mus musculus
tgtgcctgctgtcattcctgtgatg

SEQ ID NO: 907081 - DNA, 25 bp, Mus musculus
tgtgcctgctgtgattcctgtgatg

SEQ ID NO: 907082 - DNA, 25 bp, Mus musculus
tgtgcctgctgtttgaactaacaag

SEQ ID NO: 907083 - DNA, 25 bp, Mus musculus
tgtgcctggagcagggagattcatc

SEQ ID NO: 907084 - DNA, 25 bp, Mus musculus
tgtgcctggagcctacagaggtcaa

SEQ ID NO: 907085 - DNA, 25 bp, Mus musculus
tgtgcctggagcgtacagaggtcaa

SEQ ID NO: 907086 - DNA, 25 bp, Mus musculus
tgtgcctggagctgggagattcatc

SEQ ID NO: 907087 - DNA, 25 bp, Mus musculus
tgtgcctgtaatacattccttgacg

SEQ ID NO: 907088 - DNA, 25 bp, Mus musculus
tgtgcctgtaattcattccttgacg

SEQ ID NO: 907089 - DNA, 25 bp, Mus musculus
tgtgcctgtagaccttgctctttgc

SEQ ID NO: 907090 - DNA, 25 bp, Mus musculus
tgtgcctgtagagcttgctctttgc

SEQ ID NO: 907091 - DNA, 25 bp, Mus musculus
tgtgcctgtagcagaatcctttcca

SEQ ID NO: 907092 - DNA, 25 bp, Mus musculus
tgtgcctgtagctgaatcctttcca

SEQ ID NO: 907093 - DNA, 25 bp, Mus musculus
tgtgcctgtctgaagctagagctgc

SEQ ID NO: 907094 - DNA, 25 bp, Mus musculus
tgtgcctgtctgtagctagagctgc

SEQ ID NO: 907095 - DNA, 25 bp, Mus musculus
tgtgcctgtgccactagaatgtttg

SEQ ID NO: 907096 - DNA, 25 bp, Mus musculus
tgtgcctgtgcctctagaatgtttg

SEQ ID NO: 907097 - DNA, 25 bp, Mus musculus
tgtgcctgttcccagtctctagaaa

SEQ ID NO: 907098 - DNA, 25 bp, Mus musculus
tgtgcctgttccgagtctctagaaa

SEQ ID NO: 907099 - DNA, 25 bp, Mus musculus
tgtgcctgttgaacctcacccctgt

SEQ ID NO: 907100 - DNA, 25 bp, Mus musculus
tgtgcctgttgatcctcacccctgt

SEQ ID NO: 907101 - DNA, 25 bp, Mus musculus
tgtgcctgttggcagggaaaatgtt

SEQ ID NO: 907102 - DNA, 25 bp, Mus musculus
tgtgcctgttgggagggaaaatgtt

SEQ ID NO: 907103 - DNA, 25 bp, Mus musculus
tgtgcctgttgtaccatccctgatc

SEQ ID NO: 907104 - DNA, 25 bp, Mus musculus
tgtgcctgttgttccatccctgatc

SEQ ID NO: 907105 - DNA, 25 bp, Mus musculus
tgtgccttaacccagtactcatttc

SEQ ID NO: 907106 - DNA, 25 bp, Mus musculus
tgtgccttaaccgagtactcatttc

SEQ ID NO: 907107 - DNA, 25 bp, Mus musculus
tgtgccttacaaagccacactgggc

SEQ ID NO: 907108 - DNA, 25 bp, Mus musculus
tgtgccttacaatgccacactgggc

SEQ ID NO: 907109 - DNA, 25 bp, Mus musculus
tgtgccttaccgaatcataccctat

SEQ ID NO: 907110 - DNA, 25 bp, Mus musculus
tgtgccttaccgtatcataccctat

SEQ ID NO: 907111 - DNA, 25 bp, Mus musculus
tgtgccttactaaccagcaactcta

SEQ ID NO: 907112 - DNA, 25 bp, Mus musculus
tgtgccttactatccagcaactcta

SEQ ID NO: 907113 - DNA, 25 bp, Mus musculus
tgtgccttactgacattgcttctta

SEQ ID NO: 907114 - DNA, 25 bp, Mus musculus
tgtgccttactgtcattgcttctta

SEQ ID NO: 907115 - DNA, 25 bp, Mus musculus
tgtgccttagagagacctgtacttc

SEQ ID NO: 907116 - DNA, 25 bp, Mus musculus
tgtgccttagagtgacctgtacttc

SEQ ID NO: 907117 - DNA, 25 bp, Mus musculus
tgtgccttatacaggattctttcaa

SEQ ID NO: 907118 - DNA, 25 bp, Mus musculus
tgtgccttatactggattctttcaa

SEQ ID NO: 907119 - DNA, 25 bp, Mus musculus
tgtgccttatatactttcagtctcc

SEQ ID NO: 907120 - DNA, 25 bp, Mus musculus
tgtgccttatattctttcagtctcc

SEQ ID NO: 907121 - DNA, 25 bp, Mus musculus
tgtgccttcaggaggacgccaccga

SEQ ID NO: 907122 - DNA, 25 bp, Mus musculus
tgtgccttcaggtggacgccaccga

SEQ ID NO: 907123 - DNA, 25 bp, Mus musculus
tgtgccttcattactttgccataga

SEQ ID NO: 907124 - DNA, 25 bp, Mus musculus
tgtgccttcatttctttgccataga

SEQ ID NO: 907125 - DNA, 25 bp, Mus musculus
tgtgccttccacatggagatgctga

SEQ ID NO: 907126 - DNA, 25 bp, Mus musculus
tgtgccttccacttggagatgctga

SEQ ID NO: 907127 - DNA, 25 bp, Mus musculus
tgtgccttcttcaaactcaatctaa

SEQ ID NO: 907128 - DNA, 25 bp, Mus musculus
tgtgccttcttctaactcaatctaa

SEQ ID NO: 907129 - DNA, 25 bp, Mus musculus
tgtgccttgaagcttcgatgggttt

SEQ ID NO: 907130 - DNA, 25 bp, Mus musculus
tgtgccttgaaggttcgatgggttt

SEQ ID NO: 907131 - DNA, 25 bp, Mus musculus
tgtgccttgagtcctgtcttgactc

SEQ ID NO: 907132 - DNA, 25 bp, Mus musculus
tgtgccttgagtgctgtcttgactc

SEQ ID NO: 907133 - DNA, 25 bp, Mus musculus
tgtgccttgatgatggagctatttc

SEQ ID NO: 907134 - DNA, 25 bp, Mus musculus
tgtgccttgatgttggagctatttc

SEQ ID NO: 907135 - DNA, 25 bp, Mus musculus
tgtgccttgcaaacgaaccagtttt

SEQ ID NO: 907136 - DNA, 25 bp, Mus musculus
tgtgccttgcaatcgaaccagtttt

SEQ ID NO: 907137 - DNA, 25 bp, Mus musculus
tgtgccttgcttactactgccaata

SEQ ID NO: 907138 - DNA, 25 bp, Mus musculus
tgtgccttgctttctactgccaata

SEQ ID NO: 907139 - DNA, 25 bp, Mus musculus
tgtgccttggagagtctcaccgaga

SEQ ID NO: 907140 - DNA, 25 bp, Mus musculus
tgtgccttggagtgtctcaccgaga

SEQ ID NO: 907141 - DNA, 25 bp, Mus musculus
tgtgccttggtgatccttttattgt

SEQ ID NO: 907142 - DNA, 25 bp, Mus musculus
tgtgccttggtgttccttttattgt

SEQ ID NO: 907143 - DNA, 25 bp, Mus musculus
tgtgccttgtcaccctttgaaagtc

SEQ ID NO: 907144 - DNA, 25 bp, Mus musculus
tgtgccttgtcagcctttgaaagtc

SEQ ID NO: 907145 - DNA, 25 bp, Mus musculus
tgtgccttgttcaccgaggaaagtt

SEQ ID NO: 907146 - DNA, 25 bp, Mus musculus
tgtgccttgttctccgaggaaagtt

SEQ ID NO: 907147 - DNA, 25 bp, Mus musculus
tgtgcctttaatcggcatcctggag

SEQ ID NO: 907148 - DNA, 25 bp, Mus musculus
tgtgcctttaatgggcatcctggag

SEQ ID NO: 907149 - DNA, 25 bp, Mus musculus
tgtgcctttattaacagcactgggt

SEQ ID NO: 907150 - DNA, 25 bp, Mus musculus
tgtgcctttatttacagcactgggt

SEQ ID NO: 907151 - DNA, 25 bp, Mus musculus
tgtgcctttcacagtttcattgttg

SEQ ID NO: 907152 - DNA, 25 bp, Mus musculus
tgtgcctttcactgtttcattgttg

SEQ ID NO: 907153 - DNA, 25 bp, Mus musculus
tgtgcctttcagcaagtcagcctgc

SEQ ID NO: 907154 - DNA, 25 bp, Mus musculus
tgtgcctttcaggaagtcagcctgc

SEQ ID NO: 907155 - DNA, 25 bp, Mus musculus
tgtgcctttctgacttgtgcttgag

SEQ ID NO: 907156 - DNA, 25 bp, Mus musculus
tgtgcctttctgtcttgtgcttgag

SEQ ID NO: 907157 - DNA, 25 bp, Mus musculus
tgtgcctttgcaaatcagtgttttt

SEQ ID NO: 907158 - DNA, 25 bp, Mus musculus
tgtgcctttgcatatcagtgttttt

SEQ ID NO: 907159 - DNA, 25 bp, Mus musculus
tgtgcctttgtgagacagctgagcg

SEQ ID NO: 907160 - DNA, 25 bp, Mus musculus
tgtgcctttgtgtgacagctgagcg

SEQ ID NO: 907161 - DNA, 25 bp, Mus musculus
tgtgcctttttgcacttttgtggaa

SEQ ID NO: 907162 - DNA, 25 bp, Mus musculus
tgtgcctttttggacttttgtggaa

SEQ ID NO: 907163 - DNA, 25 bp, Mus musculus
tgtgccttttttcatcattgtgaaa

SEQ ID NO: 907164 - DNA, 25 bp, Mus musculus
tgtgccttttttgatcattgtgaaa

SEQ ID NO: 907165 - DNA, 25 bp, Mus musculus
tgtgcgaaacacctcacggttctca

SEQ ID NO: 907166 - DNA, 25 bp, Mus musculus
tgtgcgaaacacgtcacggttctca

SEQ ID NO: 907167 - DNA, 25 bp, Mus musculus
tgtgcgaagtgcacccagggctgca

SEQ ID NO: 907168 - DNA, 25 bp, Mus musculus
tgtgcgaagtgctcccagggctgca

SEQ ID NO: 907169 - DNA, 25 bp, Mus musculus
tgtgcgacactcaaaaccagctctc

SEQ ID NO: 907170 - DNA, 25 bp, Mus musculus
tgtgcgacactctaaaccagctctc

SEQ ID NO: 907171 - DNA, 25 bp, Mus musculus
tgtgcgactcagaagagccagtgct

SEQ ID NO: 907172 - DNA, 25 bp, Mus musculus
tgtgcgactcagtagagccagtgct

SEQ ID NO: 907173 - DNA, 25 bp, Mus musculus
tgtgcgatgaaaatacccttggacc

SEQ ID NO: 907174 - DNA, 25 bp, Mus musculus
tgtgcgatgaaattacccttggacc

SEQ ID NO: 907175 - DNA, 25 bp, Mus musculus
tgtgcgatgatgattcgtgaccctt

SEQ ID NO: 907176 - DNA, 25 bp, Mus musculus
tgtgcgatgatgtttcgtgaccctt

SEQ ID NO: 907177 - DNA, 25 bp, Mus musculus
tgtgcgatttttcctacctagttta

SEQ ID NO: 907178 - DNA, 25 bp, Mus musculus
tgtgcgatttttgctacctagttta

SEQ ID NO: 907179 - DNA, 25 bp, Mus musculus
tgtgcgcacagtcctgaagatcccc

SEQ ID NO: 907180 - DNA, 25 bp, Mus musculus
tgtgcgcacagtgctgaagatcccc

SEQ ID NO: 907181 - DNA, 25 bp, Mus musculus
tgtgcgcacgggaaacagaactgtt

SEQ ID NO: 907182 - DNA, 25 bp, Mus musculus
tgtgcgcacgggtaacagaactgtt

SEQ ID NO: 907183 - DNA, 25 bp, Mus musculus
tgtgcgcactcacaggatcttgcta

SEQ ID NO: 907184 - DNA, 25 bp, Mus musculus
tgtgcgcactcagaggatcttgcta

SEQ ID NO: 907185 - DNA, 25 bp, Mus musculus
tgtgcgcagcacaggtcagtttgac

SEQ ID NO: 907186 - DNA, 25 bp, Mus musculus
tgtgcgcagcactggtcagtttgac

SEQ ID NO: 907187 - DNA, 25 bp, Mus musculus
tgtgcgccactgagacatcatcggg

SEQ ID NO: 907188 - DNA, 25 bp, Mus musculus
tgtgcgccactgtgacatcatcggg

SEQ ID NO: 907189 - DNA, 25 bp, Mus musculus
tgtgcgcccagcagtctctgtggaa

SEQ ID NO: 907190 - DNA, 25 bp, Mus musculus
tgtgcgcccagctgtctctgtggaa

SEQ ID NO: 907191 - DNA, 25 bp, Mus musculus
tgtgcgcccctaaatggatgcagtc

SEQ ID NO: 907192 - DNA, 25 bp, Mus musculus
tgtgcgcccctatatggatgcagtc

SEQ ID NO: 907193 - DNA, 25 bp, Mus musculus
tgtgcgccctgtagtctcagcatgc

SEQ ID NO: 907194 - DNA, 25 bp, Mus musculus
tgtgcgccctgtcgaagcggccctt

SEQ ID NO: 907195 - DNA, 25 bp, Mus musculus
tgtgcgccctgtggaagcggccctt

SEQ ID NO: 907196 - DNA, 25 bp, Mus musculus
tgtgcgccctgttgtctcagcatgc

SEQ ID NO: 907197 - DNA, 25 bp, Mus musculus
tgtgcgcctccacgttgaaaattga

SEQ ID NO: 907198 - DNA, 25 bp, Mus musculus
tgtgcgcctccaggttgaaaattga

SEQ ID NO: 907199 - DNA, 25 bp, Mus musculus
tgtgcgcctggaaaggacccagcgt

SEQ ID NO: 907200 - DNA, 25 bp, Mus musculus
tgtgcgcctggataggacccagcgt

SEQ ID NO: 907201 - DNA, 25 bp, Mus musculus
tgtgcgccttcactgtagcaggatc

SEQ ID NO: 907202 - DNA, 25 bp, Mus musculus
tgtgcgccttcagtgtagcaggatc

SEQ ID NO: 907203 - DNA, 25 bp, Mus musculus
tgtgcgccttgaagagctgtgccaa

SEQ ID NO: 907204 - DNA, 25 bp, Mus musculus
tgtgcgccttgatgagctgtgccaa

SEQ ID NO: 907205 - DNA, 25 bp, Mus musculus
tgtgcgccttgtacagagccctgtt

SEQ ID NO: 907206 - DNA, 25 bp, Mus musculus
tgtgcgccttgttcagagccctgtt

SEQ ID NO: 907207 - DNA, 25 bp, Mus musculus
tgtgcgcctttgcttcagaggttga

SEQ ID NO: 907208 - DNA, 25 bp, Mus musculus
tgtgcgcctttggttcagaggttga

SEQ ID NO: 907209 - DNA, 25 bp, Mus musculus
tgtgcgcggcacagttggctccccg

SEQ ID NO: 907210 - DNA, 25 bp, Mus musculus
tgtgcgcggcactgttggctccccg

SEQ ID NO: 907211 - DNA, 25 bp, Mus musculus
tgtgcgcgtgctactcaacaagaaa

SEQ ID NO: 907212 - DNA, 25 bp, Mus musculus
tgtgcgcgtgcttctcaacaagaaa

SEQ ID NO: 907213 - DNA, 25 bp, Mus musculus
tgtgcgctaattagctttagctggt

SEQ ID NO: 907214 - DNA, 25 bp, Mus musculus
tgtgcgctaatttgctttagctggt

SEQ ID NO: 907215 - DNA, 25 bp, Mus musculus
tgtgcgctaccgacttcaagtttgc

SEQ ID NO: 907216 - DNA, 25 bp, Mus musculus
tgtgcgctaccgtcttcaagtttgc

SEQ ID NO: 907217 - DNA, 25 bp, Mus musculus
tgtgcgctatgacagctccctgaag

SEQ ID NO: 907218 - DNA, 25 bp, Mus musculus
tgtgcgctatgacgaatgattattt

SEQ ID NO: 907219 - DNA, 25 bp, Mus musculus
tgtgcgctatgagagctccctgaag

SEQ ID NO: 907220 - DNA, 25 bp, Mus musculus
tgtgcgctatgaggaatgattattt

SEQ ID NO: 907221 - DNA, 25 bp, Mus musculus
tgtgcgctccgtcttagtgtagccc

SEQ ID NO: 907222 - DNA, 25 bp, Mus musculus
tgtgcgctccgtgttagtgtagccc

SEQ ID NO: 907223 - DNA, 25 bp, Mus musculus
tgtgcgctctgcagaattccggtgg

SEQ ID NO: 907224 - DNA, 25 bp, Mus musculus
tgtgcgctctgctgaattccggtgg

SEQ ID NO: 907225 - DNA, 25 bp, Mus musculus
tgtgcgctggacacttttgaatgaa

SEQ ID NO: 907226 - DNA, 25 bp, Mus musculus
tgtgcgctggactcttttgaatgaa

SEQ ID NO: 907227 - DNA, 25 bp, Mus musculus
tgtgcgctgtgcaccaagcggcaag

SEQ ID NO: 907228 - DNA, 25 bp, Mus musculus
tgtgcgctgtgctccaagcggcaag

SEQ ID NO: 907229 - DNA, 25 bp, Mus musculus
tgtgcgcttgcactgcatgactgtg

SEQ ID NO: 907230 - DNA, 25 bp, Mus musculus
tgtgcgcttgcagtgcatgactgtg

SEQ ID NO: 907231 - DNA, 25 bp, Mus musculus
tgtgcggcaacgatggcaagctcca

SEQ ID NO: 907232 - DNA, 25 bp, Mus musculus
tgtgcggcaacgttggcaagctcca

SEQ ID NO: 907233 - DNA, 25 bp, Mus musculus
tgtgcggctcacacctggtggaagc

SEQ ID NO: 907234 - DNA, 25 bp, Mus musculus
tgtgcggctcactcctggtggaagc

SEQ ID NO: 907235 - DNA, 25 bp, Mus musculus
tgtgcggctgtcaagtcaagggcaa

SEQ ID NO: 907236 - DNA, 25 bp, Mus musculus
tgtgcggctgtctagtcaagggcaa

SEQ ID NO: 907237 - DNA, 25 bp, Mus musculus
tgtgcgggatggagaagagcggctc

SEQ ID NO: 907238 - DNA, 25 bp, Mus musculus
tgtgcgggatggtgaagagcggctc

SEQ ID NO: 907239 - DNA, 25 bp, Mus musculus
tgtgcgggatgtacaaaggaatgaa

SEQ ID NO: 907240 - DNA, 25 bp, Mus musculus
tgtgcgggatgttcaaaggaatgaa

SEQ ID NO: 907241 - DNA, 25 bp, Mus musculus
tgtgcgggcaaaccttcgtttgcta

SEQ ID NO: 907242 - DNA, 25 bp, Mus musculus
tgtgcgggcaaagcttcgtttgcta

SEQ ID NO: 907243 - DNA, 25 bp, Mus musculus
tgtgcggtaaaaaccattcctaatc

SEQ ID NO: 907244 - DNA, 25 bp, Mus musculus
tgtgcggtaaaatccattcctaatc

SEQ ID NO: 907245 - DNA, 25 bp, Mus musculus
tgtgcggtcagcacctttctgggct

SEQ ID NO: 907246 - DNA, 25 bp, Mus musculus
tgtgcggtcagctcctttctgggct

SEQ ID NO: 907247 - DNA, 25 bp, Mus musculus
tgtgcggttcttctccggcgtcatg

SEQ ID NO: 907248 - DNA, 25 bp, Mus musculus
tgtgcggttcttgtccggcgtcatg

SEQ ID NO: 907249 - DNA, 25 bp, Mus musculus
tgtgcggtttgtattgttccagtaa

SEQ ID NO: 907250 - DNA, 25 bp, Mus musculus
tgtgcggtttgttttgttccagtaa

SEQ ID NO: 907251 - DNA, 25 bp, Mus musculus
tgtgcgtaccttagcatcatgtaag

SEQ ID NO: 907252 - DNA, 25 bp, Mus musculus
tgtgcgtacctttgcatcatgtaag

SEQ ID NO: 907253 - DNA, 25 bp, Mus musculus
tgtgcgtcactgctcatgctcagac

SEQ ID NO: 907254 - DNA, 25 bp, Mus musculus
tgtgcgtcactggtcatgctcagac

SEQ ID NO: 907255 - DNA, 25 bp, Mus musculus
tgtgcgtcagctcagatactttggg

SEQ ID NO: 907256 - DNA, 25 bp, Mus musculus
tgtgcgtcagctgagatactttggg

SEQ ID NO: 907257 - DNA, 25 bp, Mus musculus
tgtgcgtccgtgattctagaagcag

SEQ ID NO: 907258 - DNA, 25 bp, Mus musculus
tgtgcgtccgtgtttctagaagcag

SEQ ID NO: 907259 - DNA, 25 bp, Mus musculus
tgtgcgtcctttctgtccattgatt

SEQ ID NO: 907260 - DNA, 25 bp, Mus musculus
tgtgcgtcctttgtgtccattgatt

SEQ ID NO: 907261 - DNA, 25 bp, Mus musculus
tgtgcgtctctaattcctgtcaagc

SEQ ID NO: 907262 - DNA, 25 bp, Mus musculus
tgtgcgtctctatttcctgtcaagc

SEQ ID NO: 907263 - DNA, 25 bp, Mus musculus
tgtgcgtctgcgagagagcattgtc

SEQ ID NO: 907264 - DNA, 25 bp, Mus musculus
tgtgcgtctgcgtgagagcattgtc

SEQ ID NO: 907265 - DNA, 25 bp, Mus musculus
tgtgcgtcttcgcagctggtgactt

SEQ ID NO: 907266 - DNA, 25 bp, Mus musculus
tgtgcgtcttcggagctggtgactt

SEQ ID NO: 907267 - DNA, 25 bp, Mus musculus
tgtgcgtgactacattccttggcta

SEQ ID NO: 907268 - DNA, 25 bp, Mus musculus
tgtgcgtgactagattccttggcta

SEQ ID NO: 907269 - DNA, 25 bp, Mus musculus
tgtgcgtgactccagtcctaaggaa

SEQ ID NO: 907270 - DNA, 25 bp, Mus musculus
tgtgcgtgactcgagtcctaaggaa

SEQ ID NO: 907271 - DNA, 25 bp, Mus musculus
tgtgcgtgcatacaaacttgggttt

SEQ ID NO: 907272 - DNA, 25 bp, Mus musculus
tgtgcgtgcatagaaacttgggttt

SEQ ID NO: 907273 - DNA, 25 bp, Mus musculus
tgtgcgtgcccaactgctgtataca

SEQ ID NO: 907274 - DNA, 25 bp, Mus musculus
tgtgcgtgcccatctgctgtataca

SEQ ID NO: 907275 - DNA, 25 bp, Mus musculus
tgtgcgtgccccatcagtgtgtatc

SEQ ID NO: 907276 - DNA, 25 bp, Mus musculus
tgtgcgtgccccttcagtgtgtatc

SEQ ID NO: 907277 - DNA, 25 bp, Mus musculus
tgtgcgtgtacaaatgtgtgactac

SEQ ID NO: 907278 - DNA, 25 bp, Mus musculus
tgtgcgtgtacatatgtgtgactac

SEQ ID NO: 907279 - DNA, 25 bp, Mus musculus
tgtgcgtgtctcactgtgatcctgt

SEQ ID NO: 907280 - DNA, 25 bp, Mus musculus
tgtgcgtgtctctctgtgatcctgt

SEQ ID NO: 907281 - DNA, 25 bp, Mus musculus
tgtgcgtgtgttcctccaataaagt

SEQ ID NO: 907282 - DNA, 25 bp, Mus musculus
tgtgcgtgtgttgctccaataaagt

SEQ ID NO: 907283 - DNA, 25 bp, Mus musculus
tgtgcgttaagtatcttaccctctg

SEQ ID NO: 907284 - DNA, 25 bp, Mus musculus
tgtgcgttaagtttcttaccctctg

SEQ ID NO: 907285 - DNA, 25 bp, Mus musculus
tgtgcgttgtttatcccataggata

SEQ ID NO: 907286 - DNA, 25 bp, Mus musculus
tgtgcgttgtttttcccataggata

SEQ ID NO: 907287 - DNA, 25 bp, Mus musculus
tgtgctaaacaacatctgtgtgtgt

SEQ ID NO: 907288 - DNA, 25 bp, Mus musculus
tgtgctaaacaagatctgtgtgtgt

SEQ ID NO: 907289 - DNA, 25 bp, Mus musculus
tgtgctaacagactggctatcccag

SEQ ID NO: 907290 - DNA, 25 bp, Mus musculus
tgtgctaacagagtggctatcccag

SEQ ID NO: 907291 - DNA, 25 bp, Mus musculus
tgtgctaacccaccctgcatagtgc

SEQ ID NO: 907292 - DNA, 25 bp, Mus musculus
tgtgctaacccagcctgcatagtgc

SEQ ID NO: 907293 - DNA, 25 bp, Mus musculus
tgtgctaacctcctcctgatgcaag

SEQ ID NO: 907294 - DNA, 25 bp, Mus musculus
tgtgctaacctcgtcctgatgcaag

SEQ ID NO: 907295 - DNA, 25 bp, Mus musculus
tgtgctaagtagcttgtaacctaag

SEQ ID NO: 907296 - DNA, 25 bp, Mus musculus
tgtgctaagtaggttgtaacctaag

SEQ ID NO: 907297 - DNA, 25 bp, Mus musculus
tgtgctacacaacgaactggtctgt

SEQ ID NO: 907298 - DNA, 25 bp, Mus musculus
tgtgctacacaaggaactggtctgt

SEQ ID NO: 907299 - DNA, 25 bp, Mus musculus
tgtgctacaccgacattacgttcaa

SEQ ID NO: 907300 - DNA, 25 bp, Mus musculus
tgtgctacaccgtcattacgttcaa

SEQ ID NO: 907301 - DNA, 25 bp, Mus musculus
tgtgctacacctcagtggtcttatt

SEQ ID NO: 907302 - DNA, 25 bp, Mus musculus
tgtgctacacctgagtggtcttatt

SEQ ID NO: 907303 - DNA, 25 bp, Mus musculus
tgtgctacagcaacccgagagattt

SEQ ID NO: 907304 - DNA, 25 bp, Mus musculus
tgtgctacagcatcccgagagattt

SEQ ID NO: 907305 - DNA, 25 bp, Mus musculus
tgtgctacaggcagtattcccagaa

SEQ ID NO: 907306 - DNA, 25 bp, Mus musculus
tgtgctacaggctgtattcccagaa

SEQ ID NO: 907307 - DNA, 25 bp, Mus musculus
tgtgctaccactctctgtcatcttt

SEQ ID NO: 907308 - DNA, 25 bp, Mus musculus
tgtgctaccactgtctgtcatcttt

SEQ ID NO: 907309 - DNA, 25 bp, Mus musculus
tgtgctaccatcagctggccacgtg

SEQ ID NO: 907310 - DNA, 25 bp, Mus musculus
tgtgctaccatctgctggccacgtg

SEQ ID NO: 907311 - DNA, 25 bp, Mus musculus
tgtgctacctccctagaatacctgt

SEQ ID NO: 907312 - DNA, 25 bp, Mus musculus
tgtgctacctccgtagaatacctgt

SEQ ID NO: 907313 - DNA, 25 bp, Mus musculus
tgtgctacctgtagcgtggtctgta

SEQ ID NO: 907314 - DNA, 25 bp, Mus musculus
tgtgctacctgttgcgtggtctgta

SEQ ID NO: 907315 - DNA, 25 bp, Mus musculus
tgtgctaccttaccccttttgaatt

SEQ ID NO: 907316 - DNA, 25 bp, Mus musculus
tgtgctaccttagcccttttgaatt

SEQ ID NO: 907317 - DNA, 25 bp, Mus musculus
tgtgctaccttgatgcaactttgga

SEQ ID NO: 907318 - DNA, 25 bp, Mus musculus
tgtgctaccttgttgcaactttgga

SEQ ID NO: 907319 - DNA, 25 bp, Mus musculus
tgtgctacctttcatgttcgctttc

SEQ ID NO: 907320 - DNA, 25 bp, Mus musculus
tgtgctacctttgatgttcgctttc

SEQ ID NO: 907321 - DNA, 25 bp, Mus musculus
tgtgctacgcttctcctttttaaaa

SEQ ID NO: 907322 - DNA, 25 bp, Mus musculus
tgtgctacgcttgtcctttttaaaa

SEQ ID NO: 907323 - DNA, 25 bp, Mus musculus
tgtgctactactaccactactttaa

SEQ ID NO: 907324 - DNA, 25 bp, Mus musculus
tgtgctactacttccactactttaa

SEQ ID NO: 907325 - DNA, 25 bp, Mus musculus
tgtgctactgggactcaaaggtcat

SEQ ID NO: 907326 - DNA, 25 bp, Mus musculus
tgtgctactgggtctcaaaggtcat

SEQ ID NO: 907327 - DNA, 25 bp, Mus musculus
tgtgctacttcaaggtcttcttgct

SEQ ID NO: 907328 - DNA, 25 bp, Mus musculus
tgtgctacttcatggtcttcttgct

SEQ ID NO: 907329 - DNA, 25 bp, Mus musculus
tgtgctacttgaactgttttggttt

SEQ ID NO: 907330 - DNA, 25 bp, Mus musculus
tgtgctacttgatctgttttggttt

SEQ ID NO: 907331 - DNA, 25 bp, Mus musculus
tgtgctagaagtcgaccgcggctct

SEQ ID NO: 907332 - DNA, 25 bp, Mus musculus
tgtgctagaagtggaccgcggctct

SEQ ID NO: 907333 - DNA, 25 bp, Mus musculus
tgtgctagcaacaggctgctgtgtg

SEQ ID NO: 907334 - DNA, 25 bp, Mus musculus
tgtgctagcaactggctgctgtgtg

SEQ ID NO: 907335 - DNA, 25 bp, Mus musculus
tgtgctagctccaaaggactaggtt

SEQ ID NO: 907336 - DNA, 25 bp, Mus musculus
tgtgctagctcctaaggactaggtt

SEQ ID NO: 907337 - DNA, 25 bp, Mus musculus
tgtgctaggatgcaggaatgacctt

SEQ ID NO: 907338 - DNA, 25 bp, Mus musculus
tgtgctaggatggaggaatgacctt

SEQ ID NO: 907339 - DNA, 25 bp, Mus musculus
tgtgctaggctacgcactgcaggct

SEQ ID NO: 907340 - DNA, 25 bp, Mus musculus
tgtgctaggctaggcactgcaggct

SEQ ID NO: 907341 - DNA, 25 bp, Mus musculus
tgtgctagttgaacttactgaccac

SEQ ID NO: 907342 - DNA, 25 bp, Mus musculus
tgtgctagttgatcttactgaccac

SEQ ID NO: 907343 - DNA, 25 bp, Mus musculus
tgtgctatagcacaggtcgcccctg

SEQ ID NO: 907344 - DNA, 25 bp, Mus musculus
tgtgctatagcagaggtcgcccctg

SEQ ID NO: 907345 - DNA, 25 bp, Mus musculus
tgtgctataggcattccctgttgac

SEQ ID NO: 907346 - DNA, 25 bp, Mus musculus
tgtgctataggctttccctgttgac

SEQ ID NO: 907347 - DNA, 25 bp, Mus musculus
tgtgctatcaacacagtaccctctg

SEQ ID NO: 907348 - DNA, 25 bp, Mus musculus
tgtgctatcaactcagtaccctctg

SEQ ID NO: 907349 - DNA, 25 bp, Mus musculus
tgtgctatctctaaggtcccatctg

SEQ ID NO: 907350 - DNA, 25 bp, Mus musculus
tgtgctatctcttaggtcccatctg

SEQ ID NO: 907351 - DNA, 25 bp, Mus musculus
tgtgctatctttcatttctgcctgc

SEQ ID NO: 907352 - DNA, 25 bp, Mus musculus
tgtgctatctttgatttctgcctgc

SEQ ID NO: 907353 - DNA, 25 bp, Mus musculus
tgtgctatgagcaatgcccacctca

SEQ ID NO: 907354 - DNA, 25 bp, Mus musculus
tgtgctatgagctatgcccacctca

SEQ ID NO: 907355 - DNA, 25 bp, Mus musculus
tgtgctatgcacagcatgtgggata

SEQ ID NO: 907356 - DNA, 25 bp, Mus musculus
tgtgctatgcactgcatgtgggata

SEQ ID NO: 907357 - DNA, 25 bp, Mus musculus
tgtgctatgcataatcctttctcta

SEQ ID NO: 907358 - DNA, 25 bp, Mus musculus
tgtgctatgcatcctatgttgtctt

SEQ ID NO: 907359 - DNA, 25 bp, Mus musculus
tgtgctatgcatgctatgttgtctt

SEQ ID NO: 907360 - DNA, 25 bp, Mus musculus
tgtgctatgcattatcctttctcta

SEQ ID NO: 907361 - DNA, 25 bp, Mus musculus
tgtgctatgctaagggatatcacta

SEQ ID NO: 907362 - DNA, 25 bp, Mus musculus
tgtgctatgctatgggatatcacta

SEQ ID NO: 907363 - DNA, 25 bp, Mus musculus
tgtgctattgttagagaaatctctg

SEQ ID NO: 907364 - DNA, 25 bp, Mus musculus
tgtgctattgtttgagaaatctctg

SEQ ID NO: 907365 - DNA, 25 bp, Mus musculus
tgtgctcaagccaggatatcgtccc

SEQ ID NO: 907366 - DNA, 25 bp, Mus musculus
tgtgctcaagcctggatatcgtccc

SEQ ID NO: 907367 - DNA, 25 bp, Mus musculus
tgtgctcaagtcagggtatcatcaa

SEQ ID NO: 907368 - DNA, 25 bp, Mus musculus
tgtgctcaagtctgggtatcatcaa

SEQ ID NO: 907369 - DNA, 25 bp, Mus musculus
tgtgctcacacacctggtggcacct

SEQ ID NO: 907370 - DNA, 25 bp, Mus musculus
tgtgctcacacagctggtggcacct

SEQ ID NO: 907371 - DNA, 25 bp, Mus musculus
tgtgctcacagcagattcttgcagt

SEQ ID NO: 907372 - DNA, 25 bp, Mus musculus
tgtgctcacagctgattcttgcagt

SEQ ID NO: 907373 - DNA, 25 bp, Mus musculus
tgtgctcacaggactccatgaaaag

SEQ ID NO: 907374 - DNA, 25 bp, Mus musculus
tgtgctcacaggcatgtccgaactc

SEQ ID NO: 907375 - DNA, 25 bp, Mus musculus
tgtgctcacagggatgtccgaactc

SEQ ID NO: 907376 - DNA, 25 bp, Mus musculus
tgtgctcacaggtctccatgaaaag

SEQ ID NO: 907377 - DNA, 25 bp, Mus musculus
tgtgctcagaaaagcctgtgacctt

SEQ ID NO: 907378 - DNA, 25 bp, Mus musculus
tgtgctcagaaatgcctgtgacctt

SEQ ID NO: 907379 - DNA, 25 bp, Mus musculus
tgtgctcagaacagcacctcgggat

SEQ ID NO: 907380 - DNA, 25 bp, Mus musculus
tgtgctcagaactgcacctcgggat

SEQ ID NO: 907381 - DNA, 25 bp, Mus musculus
tgtgctcagaccatggcctgcctgt

SEQ ID NO: 907382 - DNA, 25 bp, Mus musculus
tgtgctcagaccttggcctgcctgt

SEQ ID NO: 907383 - DNA, 25 bp, Mus musculus
tgtgctcagattctttccccaaagg

SEQ ID NO: 907384 - DNA, 25 bp, Mus musculus
tgtgctcagattgtttccccaaagg

SEQ ID NO: 907385 - DNA, 25 bp, Mus musculus
tgtgctcagcagaggatgtattgta

SEQ ID NO: 907386 - DNA, 25 bp, Mus musculus
tgtgctcagcagtggatgtattgta

SEQ ID NO: 907387 - DNA, 25 bp, Mus musculus
tgtgctcagggtacatgcttggaga

SEQ ID NO: 907388 - DNA, 25 bp, Mus musculus
tgtgctcagggttcatgcttggaga

SEQ ID NO: 907389 - DNA, 25 bp, Mus musculus
tgtgctcagtccatcttttttattg

SEQ ID NO: 907390 - DNA, 25 bp, Mus musculus
tgtgctcagtccttcttttttattg

SEQ ID NO: 907391 - DNA, 25 bp, Mus musculus
tgtgctcatacaaagacagtagtgt

SEQ ID NO: 907392 - DNA, 25 bp, Mus musculus
tgtgctcatacatagacagtagtgt

SEQ ID NO: 907393 - DNA, 25 bp, Mus musculus
tgtgctcatcttccttttagatttg

SEQ ID NO: 907394 - DNA, 25 bp, Mus musculus
tgtgctcatcttgcttttagatttg

SEQ ID NO: 907395 - DNA, 25 bp, Mus musculus
tgtgctcatgcacttcggaagtaga

SEQ ID NO: 907396 - DNA, 25 bp, Mus musculus
tgtgctcatgcagttcggaagtaga

SEQ ID NO: 907397 - DNA, 25 bp, Mus musculus
tgtgctcatgctaatcacagtcgct

SEQ ID NO: 907398 - DNA, 25 bp, Mus musculus
tgtgctcatgcttatcacagtcgct

SEQ ID NO: 907399 - DNA, 25 bp, Mus musculus
tgtgctcatgtaagtgctgtgtctc

SEQ ID NO: 907400 - DNA, 25 bp, Mus musculus
tgtgctcatgtatgtgctgtgtctc

SEQ ID NO: 907401 - DNA, 25 bp, Mus musculus
tgtgctcatgtgatcacggctttca

SEQ ID NO: 907402 - DNA, 25 bp, Mus musculus
tgtgctcatgtgttcacggctttca

SEQ ID NO: 907403 - DNA, 25 bp, Mus musculus
tgtgctcattcacgtagccctgtgc

SEQ ID NO: 907404 - DNA, 25 bp, Mus musculus
tgtgctcattcaggtagccctgtgc

SEQ ID NO: 907405 - DNA, 25 bp, Mus musculus
tgtgctcattttataaactacgttt

SEQ ID NO: 907406 - DNA, 25 bp, Mus musculus
tgtgctcattttttaaactacgttt

SEQ ID NO: 907407 - DNA, 25 bp, Mus musculus
tgtgctccacagctctatgtactgt

SEQ ID NO: 907408 - DNA, 25 bp, Mus musculus
tgtgctccacaggtctatgtactgt

SEQ ID NO: 907409 - DNA, 25 bp, Mus musculus
tgtgctccacctacaagtcggagaa

SEQ ID NO: 907410 - DNA, 25 bp, Mus musculus
tgtgctccaccttcaagtcggagaa

SEQ ID NO: 907411 - DNA, 25 bp, Mus musculus
tgtgctccagggatctcagcaccaa

SEQ ID NO: 907412 - DNA, 25 bp, Mus musculus
tgtgctccagggttctcagcaccaa

SEQ ID NO: 907413 - DNA, 25 bp, Mus musculus
tgtgctccatctctaacactgcaag

SEQ ID NO: 907414 - DNA, 25 bp, Mus musculus
tgtgctccatctgtaacactgcaag

SEQ ID NO: 907415 - DNA, 25 bp, Mus musculus
tgtgctcccaagaggacttctcaag

SEQ ID NO: 907416 - DNA, 25 bp, Mus musculus
tgtgctcccaagtggacttctcaag

SEQ ID NO: 907417 - DNA, 25 bp, Mus musculus
tgtgctcccacaacagtagcgtgaa

SEQ ID NO: 907418 - DNA, 25 bp, Mus musculus
tgtgctcccacatcagtagcgtgaa

SEQ ID NO: 907419 - DNA, 25 bp, Mus musculus
tgtgctcccagcaaggtgcaatcag

SEQ ID NO: 907420 - DNA, 25 bp, Mus musculus
tgtgctcccagctaggtgcaatcag

SEQ ID NO: 907421 - DNA, 25 bp, Mus musculus
tgtgctccccaaatgttggttctaa

SEQ ID NO: 907422 - DNA, 25 bp, Mus musculus
tgtgctccccaattgttggttctaa

SEQ ID NO: 907423 - DNA, 25 bp, Mus musculus
tgtgctccccgaagcctggagtggt

SEQ ID NO: 907424 - DNA, 25 bp, Mus musculus
tgtgctccccgatgcctggagtggt

SEQ ID NO: 907425 - DNA, 25 bp, Mus musculus
tgtgctcccgtgatgagaaaagaga

SEQ ID NO: 907426 - DNA, 25 bp, Mus musculus
tgtgctcccgtgttgagaaaagaga

SEQ ID NO: 907427 - DNA, 25 bp, Mus musculus
tgtgctccctctcccaatctgagat

SEQ ID NO: 907428 - DNA, 25 bp, Mus musculus
tgtgctccctctgccaatctgagat

SEQ ID NO: 907429 - DNA, 25 bp, Mus musculus
tgtgctccctgacaaaacatctgtc

SEQ ID NO: 907430 - DNA, 25 bp, Mus musculus
tgtgctccctgagaaaacatctgtc

SEQ ID NO: 907431 - DNA, 25 bp, Mus musculus
tgtgctcccttcacaaagggctgag

SEQ ID NO: 907432 - DNA, 25 bp, Mus musculus
tgtgctcccttctcaaagggctgag

SEQ ID NO: 907433 - DNA, 25 bp, Mus musculus
tgtgctccgctcagtctccagcgat

SEQ ID NO: 907434 - DNA, 25 bp, Mus musculus
tgtgctccgctctgtctccagcgat

SEQ ID NO: 907435 - DNA, 25 bp, Mus musculus
tgtgctccgggcacaggtggtctcc

SEQ ID NO: 907436 - DNA, 25 bp, Mus musculus
tgtgctccgggctcaggtggtctcc

SEQ ID NO: 907437 - DNA, 25 bp, Mus musculus
tgtgctcctcggctagattctgatc

SEQ ID NO: 907438 - DNA, 25 bp, Mus musculus
tgtgctcctcgggtagattctgatc

SEQ ID NO: 907439 - DNA, 25 bp, Mus musculus
tgtgctcctgagattgcttccaaga

SEQ ID NO: 907440 - DNA, 25 bp, Mus musculus
tgtgctcctgagtttgcttccaaga

SEQ ID NO: 907441 - DNA, 25 bp, Mus musculus
tgtgctcctgcccaatgatgtttag

SEQ ID NO: 907442 - DNA, 25 bp, Mus musculus
tgtgctcctgccgaatgatgtttag

SEQ ID NO: 907443 - DNA, 25 bp, Mus musculus
tgtgctcctggaagttactgcgtaa

SEQ ID NO: 907444 - DNA, 25 bp, Mus musculus
tgtgctcctggatgttactgcgtaa

SEQ ID NO: 907445 - DNA, 25 bp, Mus musculus
tgtgctcctggtccctcatgactgg

SEQ ID NO: 907446 - DNA, 25 bp, Mus musculus
tgtgctcctggtgcctcatgactgg

SEQ ID NO: 907447 - DNA, 25 bp, Mus musculus
tgtgctcctgtcagacttggagagt

SEQ ID NO: 907448 - DNA, 25 bp, Mus musculus
tgtgctcctgtctgacttggagagt

SEQ ID NO: 907449 - DNA, 25 bp, Mus musculus
tgtgctccttagagtgtgtgcaaag

SEQ ID NO: 907450 - DNA, 25 bp, Mus musculus
tgtgctccttagtgtgtgtgcaaag

SEQ ID NO: 907451 - DNA, 25 bp, Mus musculus
tgtgctcgcagaccgctcaggagac

SEQ ID NO: 907452 - DNA, 25 bp, Mus musculus
tgtgctcgcagagcgctcaggagac

SEQ ID NO: 907453 - DNA, 25 bp, Mus musculus
tgtgctcgccagagagactgcctga

SEQ ID NO: 907454 - DNA, 25 bp, Mus musculus
tgtgctcgccagtgagactgcctga

SEQ ID NO: 907455 - DNA, 25 bp, Mus musculus
tgtgctcggaccaggtcaaggcata

SEQ ID NO: 907456 - DNA, 25 bp, Mus musculus
tgtgctcggacctggtcaaggcata

SEQ ID NO: 907457 - DNA, 25 bp, Mus musculus
tgtgctcggagcaggcattgctaat

SEQ ID NO: 907458 - DNA, 25 bp, Mus musculus
tgtgctcggagctggcattgctaat

SEQ ID NO: 907459 - DNA, 25 bp, Mus musculus
tgtgctcggctcagacgctggtcaa

SEQ ID NO: 907460 - DNA, 25 bp, Mus musculus
tgtgctcggctctgacgctggtcaa

SEQ ID NO: 907461 - DNA, 25 bp, Mus musculus
tgtgctcgggcacacatgactgtcc

SEQ ID NO: 907462 - DNA, 25 bp, Mus musculus
tgtgctcgggcagacatgactgtcc

SEQ ID NO: 907463 - DNA, 25 bp, Mus musculus
tgtgctcgggctactacagcctcaa

SEQ ID NO: 907464 - DNA, 25 bp, Mus musculus
tgtgctcgggcttctacagcctcaa

SEQ ID NO: 907465 - DNA, 25 bp, Mus musculus
tgtgctctaactcaggcctcctcta

SEQ ID NO: 907466 - DNA, 25 bp, Mus musculus
tgtgctctaactgaggcctcctcta

SEQ ID NO: 907467 - DNA, 25 bp, Mus musculus
tgtgctctacatacactagctccta

SEQ ID NO: 907468 - DNA, 25 bp, Mus musculus
tgtgctctacattcactagctccta

SEQ ID NO: 907469 - DNA, 25 bp, Mus musculus
tgtgctctcaggaaacaaggcccca

SEQ ID NO: 907470 - DNA, 25 bp, Mus musculus
tgtgctctcaggtaacaaggcccca

SEQ ID NO: 907471 - DNA, 25 bp, Mus musculus
tgtgctctcatacagacgtgggatt

SEQ ID NO: 907472 - DNA, 25 bp, Mus musculus
tgtgctctcatagagacgtgggatt

SEQ ID NO: 907473 - DNA, 25 bp, Mus musculus
tgtgctctcctgacttgcactggca

SEQ ID NO: 907474 - DNA, 25 bp, Mus musculus
tgtgctctcctgtcttgcactggca

SEQ ID NO: 907475 - DNA, 25 bp, Mus musculus
tgtgctctcttactgtttccttgtg

SEQ ID NO: 907476 - DNA, 25 bp, Mus musculus
tgtgctctcttagtgtttccttgtg

SEQ ID NO: 907477 - DNA, 25 bp, Mus musculus
tgtgctctgactcatgttacaatga

SEQ ID NO: 907478 - DNA, 25 bp, Mus musculus
tgtgctctgactgatgttacaatga

SEQ ID NO: 907479 - DNA, 25 bp, Mus musculus
tgtgctctgataaaaaccctcccct

SEQ ID NO: 907480 - DNA, 25 bp, Mus musculus
tgtgctctgatataaaccctcccct

SEQ ID NO: 907481 - DNA, 25 bp, Mus musculus
tgtgctctgattcgtttttcttaac

SEQ ID NO: 907482 - DNA, 25 bp, Mus musculus
tgtgctctgattggtttttcttaac

SEQ ID NO: 907483 - DNA, 25 bp, Mus musculus
tgtgctctgctgatgacattggtga

SEQ ID NO: 907484 - DNA, 25 bp, Mus musculus
tgtgctctgctgttgacattggtga

SEQ ID NO: 907485 - DNA, 25 bp, Mus musculus
tgtgctctgcttcacatgaggtcct

SEQ ID NO: 907486 - DNA, 25 bp, Mus musculus
tgtgctctgcttcctggtgaatgac

SEQ ID NO: 907487 - DNA, 25 bp, Mus musculus
tgtgctctgcttgacatgaggtcct

SEQ ID NO: 907488 - DNA, 25 bp, Mus musculus
tgtgctctgcttgctggtgaatgac

SEQ ID NO: 907489 - DNA, 25 bp, Mus musculus
tgtgctctgggtcccaagcctagaa

SEQ ID NO: 907490 - DNA, 25 bp, Mus musculus
tgtgctctgggtgccaagcctagaa

SEQ ID NO: 907491 - DNA, 25 bp, Mus musculus
tgtgctctggttatgggcacagtta

SEQ ID NO: 907492 - DNA, 25 bp, Mus musculus
tgtgctctggttttgggcacagtta

SEQ ID NO: 907493 - DNA, 25 bp, Mus musculus
tgtgctctgtctagtgcagcagctg

SEQ ID NO: 907494 - DNA, 25 bp, Mus musculus
tgtgctctgtcttgtgcagcagctg

SEQ ID NO: 907495 - DNA, 25 bp, Mus musculus
tgtgctctgtggctttcacaagatt

SEQ ID NO: 907496 - DNA, 25 bp, Mus musculus
tgtgctctgtgggtttcacaagatt

SEQ ID NO: 907497 - DNA, 25 bp, Mus musculus
tgtgctcttctaaatggcctgtgag

SEQ ID NO: 907498 - DNA, 25 bp, Mus musculus
tgtgctcttctatatggcctgtgag

SEQ ID NO: 907499 - DNA, 25 bp, Mus musculus
tgtgctcttgatacttatgcccaga

SEQ ID NO: 907500 - DNA, 25 bp, Mus musculus
tgtgctcttgattcttatgcccaga

SEQ ID NO: 907501 - DNA, 25 bp, Mus musculus
tgtgctcttttaactggtccatctt

SEQ ID NO: 907502 - DNA, 25 bp, Mus musculus
tgtgctcttttatctggtccatctt

SEQ ID NO: 907503 - DNA, 25 bp, Mus musculus
tgtgctgaaaccagtcccgtgttca

SEQ ID NO: 907504 - DNA, 25 bp, Mus musculus
tgtgctgaaacctgtcccgtgttca

SEQ ID NO: 907505 - DNA, 25 bp, Mus musculus
tgtgctgaagctcacctgtggtgac

SEQ ID NO: 907506 - DNA, 25 bp, Mus musculus
tgtgctgaagctgacctgtggtgac

SEQ ID NO: 907507 - DNA, 25 bp, Mus musculus
tgtgctgaattcaatgagcctgatt

SEQ ID NO: 907508 - DNA, 25 bp, Mus musculus
tgtgctgaattctatgagcctgatt

SEQ ID NO: 907509 - DNA, 25 bp, Mus musculus
tgtgctgacaatagccctgcccgta

SEQ ID NO: 907510 - DNA, 25 bp, Mus musculus
tgtgctgacaattgccctgcccgta

SEQ ID NO: 907511 - DNA, 25 bp, Mus musculus
tgtgctgacagccagctttaatgaa

SEQ ID NO: 907512 - DNA, 25 bp, Mus musculus
tgtgctgacagcgagctttaatgaa

SEQ ID NO: 907513 - DNA, 25 bp, Mus musculus
tgtgctgacatcacctcaatagttg

SEQ ID NO: 907514 - DNA, 25 bp, Mus musculus
tgtgctgacatctcctcaatagttg

SEQ ID NO: 907515 - DNA, 25 bp, Mus musculus
tgtgctgaccacaactgtactggag

SEQ ID NO: 907516 - DNA, 25 bp, Mus musculus
tgtgctgaccactactgtactggag

SEQ ID NO: 907517 - DNA, 25 bp, Mus musculus
tgtgctgaccagagatcagtcctcc

SEQ ID NO: 907518 - DNA, 25 bp, Mus musculus
tgtgctgaccagtgatcagtcctcc

SEQ ID NO: 907519 - DNA, 25 bp, Mus musculus
tgtgctgaccccagagatcatggct

SEQ ID NO: 907520 - DNA, 25 bp, Mus musculus
tgtgctgacccctgagatcatggct

SEQ ID NO: 907521 - DNA, 25 bp, Mus musculus
tgtgctgacgaacattccttcttcc

SEQ ID NO: 907522 - DNA, 25 bp, Mus musculus
tgtgctgacgaagattccttcttcc

SEQ ID NO: 907523 - DNA, 25 bp, Mus musculus
tgtgctgagagcaacctggagacca

SEQ ID NO: 907524 - DNA, 25 bp, Mus musculus
tgtgctgagagctacctggagacca

SEQ ID NO: 907525 - DNA, 25 bp, Mus musculus
tgtgctgagcacatcagaatccaga

SEQ ID NO: 907526 - DNA, 25 bp, Mus musculus
tgtgctgagcacttcagaatccaga

SEQ ID NO: 907527 - DNA, 25 bp, Mus musculus
tgtgctgaggatccacgtgtgttca

SEQ ID NO: 907528 - DNA, 25 bp, Mus musculus
tgtgctgaggatgcacgtgtgttca

SEQ ID NO: 907529 - DNA, 25 bp, Mus musculus
tgtgctgagggtaaatgcgaaagta

SEQ ID NO: 907530 - DNA, 25 bp, Mus musculus
tgtgctgagggttaatgcgaaagta

SEQ ID NO: 907531 - DNA, 25 bp, Mus musculus
tgtgctgataataccaggacttctg

SEQ ID NO: 907532 - DNA, 25 bp, Mus musculus
tgtgctgataattccaggacttctg

SEQ ID NO: 907533 - DNA, 25 bp, Mus musculus
tgtgctgatagccagcatcccagtg

SEQ ID NO: 907534 - DNA, 25 bp, Mus musculus
tgtgctgatagcgagcatcccagtg

SEQ ID NO: 907535 - DNA, 25 bp, Mus musculus
tgtgctgatcctagcgttccacgaa

SEQ ID NO: 907536 - DNA, 25 bp, Mus musculus
tgtgctgatccttgcgttccacgaa

SEQ ID NO: 907537 - DNA, 25 bp, Mus musculus
tgtgctgattgtctgattcactcct

SEQ ID NO: 907538 - DNA, 25 bp, Mus musculus
tgtgctgattgtgtgattcactcct

SEQ ID NO: 907539 - DNA, 25 bp, Mus musculus
tgtgctgatttgagcctgcttggaa

SEQ ID NO: 907540 - DNA, 25 bp, Mus musculus
tgtgctgatttgtgcctgcttggaa

SEQ ID NO: 907541 - DNA, 25 bp, Mus musculus
tgtgctgcaaacacccctagaagtt

SEQ ID NO: 907542 - DNA, 25 bp, Mus musculus
tgtgctgcaaacaggctcgctctgt

SEQ ID NO: 907543 - DNA, 25 bp, Mus musculus
tgtgctgcaaactcccctagaagtt

SEQ ID NO: 907544 - DNA, 25 bp, Mus musculus
tgtgctgcaaactggctcgctctgt

SEQ ID NO: 907545 - DNA, 25 bp, Mus musculus
tgtgctgcaagcaccagactggtaa

SEQ ID NO: 907546 - DNA, 25 bp, Mus musculus
tgtgctgcaagctccagactggtaa

SEQ ID NO: 907547 - DNA, 25 bp, Mus musculus
tgtgctgcacacccatctgctctgg

SEQ ID NO: 907548 - DNA, 25 bp, Mus musculus
tgtgctgcacacgcatctgctctgg

SEQ ID NO: 907549 - DNA, 25 bp, Mus musculus
tgtgctgcacatcccttcaaatgag

SEQ ID NO: 907550 - DNA, 25 bp, Mus musculus
tgtgctgcacatgccttcaaatgag

SEQ ID NO: 907551 - DNA, 25 bp, Mus musculus
tgtgctgcacctcgctcacaaggat

SEQ ID NO: 907552 - DNA, 25 bp, Mus musculus
tgtgctgcacctggctcacaaggat

SEQ ID NO: 907553 - DNA, 25 bp, Mus musculus
tgtgctgcactaatgccgggcaaag

SEQ ID NO: 907554 - DNA, 25 bp, Mus musculus
tgtgctgcactattgccgggcaaag

SEQ ID NO: 907555 - DNA, 25 bp, Mus musculus
tgtgctgcactcctactgtgaggtt

SEQ ID NO: 907556 - DNA, 25 bp, Mus musculus
tgtgctgcactcgtactgtgaggtt

SEQ ID NO: 907557 - DNA, 25 bp, Mus musculus
tgtgctgcacttatgaattcccctg

SEQ ID NO: 907558 - DNA, 25 bp, Mus musculus
tgtgctgcacttttgaattcccctg

SEQ ID NO: 907559 - DNA, 25 bp, Mus musculus
tgtgctgcagatctctctcatcgag

SEQ ID NO: 907560 - DNA, 25 bp, Mus musculus
tgtgctgcagatgtctctcatcgag

SEQ ID NO: 907561 - DNA, 25 bp, Mus musculus
tgtgctgcagtgcttctgcactcgc

SEQ ID NO: 907562 - DNA, 25 bp, Mus musculus
tgtgctgcagtggttctgcactcgc

SEQ ID NO: 907563 - DNA, 25 bp, Mus musculus
tgtgctgcatctactcgctcttcaa

SEQ ID NO: 907564 - DNA, 25 bp, Mus musculus
tgtgctgcatcttctcgctcttcaa

SEQ ID NO: 907565 - DNA, 25 bp, Mus musculus
tgtgctgccaagcatttgctaagat

SEQ ID NO: 907566 - DNA, 25 bp, Mus musculus
tgtgctgccaaggatttgctaagat

SEQ ID NO: 907567 - DNA, 25 bp, Mus musculus
tgtgctgcctaccaatgtggagccc

SEQ ID NO: 907568 - DNA, 25 bp, Mus musculus
tgtgctgcctacgaatgtggagccc

SEQ ID NO: 907569 - DNA, 25 bp, Mus musculus
tgtgctgcctagagcctatgatggt

SEQ ID NO: 907570 - DNA, 25 bp, Mus musculus
tgtgctgcctagtgcctatgatggt

SEQ ID NO: 907571 - DNA, 25 bp, Mus musculus
tgtgctgcctgcaaaacgccaattc

SEQ ID NO: 907572 - DNA, 25 bp, Mus musculus
tgtgctgcctgctaaacgccaattc

SEQ ID NO: 907573 - DNA, 25 bp, Mus musculus
tgtgctgcgcatccgaagccgcaag

SEQ ID NO: 907574 - DNA, 25 bp, Mus musculus
tgtgctgcgcatgcgaagccgcaag

SEQ ID NO: 907575 - DNA, 25 bp, Mus musculus
tgtgctgcgcccagtcggcgctcaa

SEQ ID NO: 907576 - DNA, 25 bp, Mus musculus
tgtgctgcgccctgtcggcgctcaa

SEQ ID NO: 907577 - DNA, 25 bp, Mus musculus
tgtgctgcggaccacaaaccgagaa

SEQ ID NO: 907578 - DNA, 25 bp, Mus musculus
tgtgctgcggacgacaaaccgagaa

SEQ ID NO: 907579 - DNA, 25 bp, Mus musculus
tgtgctgcggatctggaccaaacca

SEQ ID NO: 907580 - DNA, 25 bp, Mus musculus
tgtgctgcggatgtggaccaaacca

SEQ ID NO: 907581 - DNA, 25 bp, Mus musculus
tgtgctgcgtctccaggttgcgcat

SEQ ID NO: 907582 - DNA, 25 bp, Mus musculus
tgtgctgcgtctgcaggttgcgcat

SEQ ID NO: 907583 - DNA, 25 bp, Mus musculus
tgtgctgctaacatgtggctggaaa

SEQ ID NO: 907584 - DNA, 25 bp, Mus musculus
tgtgctgctaacttgtggctggaaa

SEQ ID NO: 907585 - DNA, 25 bp, Mus musculus
tgtgctgctggcctgccttaagttc

SEQ ID NO: 907586 - DNA, 25 bp, Mus musculus
tgtgctgctggcgtgccttaagttc

SEQ ID NO: 907587 - DNA, 25 bp, Mus musculus
tgtgctgctgggacttctgactctt

SEQ ID NO: 907588 - DNA, 25 bp, Mus musculus
tgtgctgctgggtcttctgactctt

SEQ ID NO: 907589 - DNA, 25 bp, Mus musculus
tgtgctggaacccagggccaattta

SEQ ID NO: 907590 - DNA, 25 bp, Mus musculus
tgtgctggaaccgagggccaattta

SEQ ID NO: 907591 - DNA, 25 bp, Mus musculus
tgtgctggacagaataagaaagcca

SEQ ID NO: 907592 - DNA, 25 bp, Mus musculus
tgtgctggacagcttccggatgtca

SEQ ID NO: 907593 - DNA, 25 bp, Mus musculus
tgtgctggacaggttccggatgtca

SEQ ID NO: 907594 - DNA, 25 bp, Mus musculus
tgtgctggacagtataagaaagcca

SEQ ID NO: 907595 - DNA, 25 bp, Mus musculus
tgtgctggacccaaccaggagtcga

SEQ ID NO: 907596 - DNA, 25 bp, Mus musculus
tgtgctggaccctaccaggagtcga

SEQ ID NO: 907597 - DNA, 25 bp, Mus musculus
tgtgctggagcaaacatgtttggaa

SEQ ID NO: 907598 - DNA, 25 bp, Mus musculus
tgtgctggagcatacatgtttggaa

SEQ ID NO: 907599 - DNA, 25 bp, Mus musculus
tgtgctggaggaattgtctgaagtc

SEQ ID NO: 907600 - DNA, 25 bp, Mus musculus
tgtgctggaggatttgtctgaagtc

SEQ ID NO: 907601 - DNA, 25 bp, Mus musculus
tgtgctggataacacctggaaacct

SEQ ID NO: 907602 - DNA, 25 bp, Mus musculus
tgtgctggataagacctggaaacct

SEQ ID NO: 907603 - DNA, 25 bp, Mus musculus
tgtgctggatcacagcgacttgtca

SEQ ID NO: 907604 - DNA, 25 bp, Mus musculus
tgtgctggatcagagcgacttgtca

SEQ ID NO: 907605 - DNA, 25 bp, Mus musculus
tgtgctggcagcatcataagggaat

SEQ ID NO: 907606 - DNA, 25 bp, Mus musculus
tgtgctggcagcttcataagggaat

SEQ ID NO: 907607 - DNA, 25 bp, Mus musculus
tgtgctggcattcctgactctaaga

SEQ ID NO: 907608 - DNA, 25 bp, Mus musculus
tgtgctggcattgctgactctaaga

SEQ ID NO: 907609 - DNA, 25 bp, Mus musculus
tgtgctggccagctttcactggaga

SEQ ID NO: 907610 - DNA, 25 bp, Mus musculus
tgtgctggccaggtttcactggaga

SEQ ID NO: 907611 - DNA, 25 bp, Mus musculus
tgtgctggcgccaggacggaccaaa

SEQ ID NO: 907612 - DNA, 25 bp, Mus musculus
tgtgctggcgcctggacggaccaaa

SEQ ID NO: 907613 - DNA, 25 bp, Mus musculus
tgtgctggcggccaatgtcatctcc

SEQ ID NO: 907614 - DNA, 25 bp, Mus musculus
tgtgctggcggcgaatgtcatctcc

SEQ ID NO: 907615 - DNA, 25 bp, Mus musculus
tgtgctggctcaagcataaaatcca

SEQ ID NO: 907616 - DNA, 25 bp, Mus musculus
tgtgctggctcatgcataaaatcca

SEQ ID NO: 907617 - DNA, 25 bp, Mus musculus
tgtgctggctttcagatagactgta

SEQ ID NO: 907618 - DNA, 25 bp, Mus musculus
tgtgctggctttgagatagactgta

SEQ ID NO: 907619 - DNA, 25 bp, Mus musculus
tgtgctgggaccagcaacctggctg

SEQ ID NO: 907620 - DNA, 25 bp, Mus musculus
tgtgctgggacctgcaacctggctg

SEQ ID NO: 907621 - DNA, 25 bp, Mus musculus
tgtgctgggactcacctggagcatg

SEQ ID NO: 907622 - DNA, 25 bp, Mus musculus
tgtgctgggactgacctggagcatg

SEQ ID NO: 907623 - DNA, 25 bp, Mus musculus
tgtgctgggattccaaacatttcta

SEQ ID NO: 907624 - DNA, 25 bp, Mus musculus
tgtgctgggattgcaaacatttcta

SEQ ID NO: 907625 - DNA, 25 bp, Mus musculus
tgtgctgggctcatcggaacagtaa

SEQ ID NO: 907626 - DNA, 25 bp, Mus musculus
tgtgctgggctcttcggaacagtaa

SEQ ID NO: 907627 - DNA, 25 bp, Mus musculus
tgtgctggtaggcaagccgtactcc

SEQ ID NO: 907628 - DNA, 25 bp, Mus musculus
tgtgctggtagggaagccgtactcc

SEQ ID NO: 907629 - DNA, 25 bp, Mus musculus
tgtgctggtgcgactcatccctgcc

SEQ ID NO: 907630 - DNA, 25 bp, Mus musculus
tgtgctggtgcgtctcatccctgcc

SEQ ID NO: 907631 - DNA, 25 bp, Mus musculus
tgtgctggtgtgctttgcgccttac

SEQ ID NO: 907632 - DNA, 25 bp, Mus musculus
tgtgctggtgtggtttgcgccttac

SEQ ID NO: 907633 - DNA, 25 bp, Mus musculus
tgtgctggttaacccattgctggca

SEQ ID NO: 907634 - DNA, 25 bp, Mus musculus
tgtgctggttaagccattgctggca

SEQ ID NO: 907635 - DNA, 25 bp, Mus musculus
tgtgctggttgcaggtaatgattca

SEQ ID NO: 907636 - DNA, 25 bp, Mus musculus
tgtgctggttgcagtaagacacctt

SEQ ID NO: 907637 - DNA, 25 bp, Mus musculus
tgtgctggttgctggtaatgattca

SEQ ID NO: 907638 - DNA, 25 bp, Mus musculus
tgtgctggttgctgtaagacacctt

SEQ ID NO: 907639 - DNA, 25 bp, Mus musculus
tgtgctggtttcagcgtgcctggaa

SEQ ID NO: 907640 - DNA, 25 bp, Mus musculus
tgtgctggtttctgcgtgcctggaa

SEQ ID NO: 907641 - DNA, 25 bp, Mus musculus
tgtgctgtaacaacttatatataac

SEQ ID NO: 907642 - DNA, 25 bp, Mus musculus
tgtgctgtaacatcttatatataac

SEQ ID NO: 907643 - DNA, 25 bp, Mus musculus
tgtgctgtaatcagccttacttgca

SEQ ID NO: 907644 - DNA, 25 bp, Mus musculus
tgtgctgtaatctgccttacttgca

SEQ ID NO: 907645 - DNA, 25 bp, Mus musculus
tgtgctgtacacaaaggctttgcaa

SEQ ID NO: 907646 - DNA, 25 bp, Mus musculus
tgtgctgtacactaaggctttgcaa

SEQ ID NO: 907647 - DNA, 25 bp, Mus musculus
tgtgctgtactgaagagccaccctt

SEQ ID NO: 907648 - DNA, 25 bp, Mus musculus
tgtgctgtactgtagagccaccctt

SEQ ID NO: 907649 - DNA, 25 bp, Mus musculus
tgtgctgtatttctgtttccggatt

SEQ ID NO: 907650 - DNA, 25 bp, Mus musculus
tgtgctgtatttgtgtttccggatt

SEQ ID NO: 907651 - DNA, 25 bp, Mus musculus
tgtgctgtcaccagacttacaagat

SEQ ID NO: 907652 - DNA, 25 bp, Mus musculus
tgtgctgtcacctgacttacaagat

SEQ ID NO: 907653 - DNA, 25 bp, Mus musculus
tgtgctgtcatgctacccttatgta

SEQ ID NO: 907654 - DNA, 25 bp, Mus musculus
tgtgctgtcatggtacccttatgta

SEQ ID NO: 907655 - DNA, 25 bp, Mus musculus
tgtgctgtccacagttgcctccatt

SEQ ID NO: 907656 - DNA, 25 bp, Mus musculus
tgtgctgtccactgttgcctccatt

SEQ ID NO: 907657 - DNA, 25 bp, Mus musculus
tgtgctgtccatacccatgataagt

SEQ ID NO: 907658 - DNA, 25 bp, Mus musculus
tgtgctgtccattcccatgataagt

SEQ ID NO: 907659 - DNA, 25 bp, Mus musculus
tgtgctgtccgtagtgtccaaaggc

SEQ ID NO: 907660 - DNA, 25 bp, Mus musculus
tgtgctgtccgttgtgtccaaaggc

SEQ ID NO: 907661 - DNA, 25 bp, Mus musculus
tgtgctgtctacaagtctggttact

SEQ ID NO: 907662 - DNA, 25 bp, Mus musculus
tgtgctgtctactagtctggttact

SEQ ID NO: 907663 - DNA, 25 bp, Mus musculus
tgtgctgtgacaagggcatacatta

SEQ ID NO: 907664 - DNA, 25 bp, Mus musculus
tgtgctgtgacatgggcatacatta

SEQ ID NO: 907665 - DNA, 25 bp, Mus musculus
tgtgctgtgataatccccaataccg

SEQ ID NO: 907666 - DNA, 25 bp, Mus musculus
tgtgctgtgatattccccaataccg

SEQ ID NO: 907667 - DNA, 25 bp, Mus musculus
tgtgctgtgcccagctgaagctagg

SEQ ID NO: 907668 - DNA, 25 bp, Mus musculus
tgtgctgtgccctgctgaagctagg

SEQ ID NO: 907669 - DNA, 25 bp, Mus musculus
tgtgctgtgctacatgtacacacac

SEQ ID NO: 907670 - DNA, 25 bp, Mus musculus
tgtgctgtgctagatgtacacacac

SEQ ID NO: 907671 - DNA, 25 bp, Mus musculus
tgtgctgtgggcatgacttcatttc

SEQ ID NO: 907672 - DNA, 25 bp, Mus musculus
tgtgctgtgggcttgacttcatttc

SEQ ID NO: 907673 - DNA, 25 bp, Mus musculus
tgtgctgtgtacctgcttacgtggc

SEQ ID NO: 907674 - DNA, 25 bp, Mus musculus
tgtgctgtgtacgtgcttacgtggc

SEQ ID NO: 907675 - DNA, 25 bp, Mus musculus
tgtgctgtgtgactcactgcctacg

SEQ ID NO: 907676 - DNA, 25 bp, Mus musculus
tgtgctgtgtgagtcactgcctacg

SEQ ID NO: 907677 - DNA, 25 bp, Mus musculus
tgtgctgtgtgcactccacgtgcgg

SEQ ID NO: 907678 - DNA, 25 bp, Mus musculus
tgtgctgtgtgcagctatcctcaca

SEQ ID NO: 907679 - DNA, 25 bp, Mus musculus
tgtgctgtgtgctctccacgtgcgg

SEQ ID NO: 907680 - DNA, 25 bp, Mus musculus
tgtgctgtgtgctgctatcctcaca

SEQ ID NO: 907681 - DNA, 25 bp, Mus musculus
tgtgctgttaagatgtgctatattt

SEQ ID NO: 907682 - DNA, 25 bp, Mus musculus
tgtgctgttaagttgtgctatattt

SEQ ID NO: 907683 - DNA, 25 bp, Mus musculus
tgtgctgttactagaggtccctttc

SEQ ID NO: 907684 - DNA, 25 bp, Mus musculus
tgtgctgttacttgaggtccctttc

SEQ ID NO: 907685 - DNA, 25 bp, Mus musculus
tgtgctgttcctctaagtttgctat

SEQ ID NO: 907686 - DNA, 25 bp, Mus musculus
tgtgctgttcctgtaagtttgctat

SEQ ID NO: 907687 - DNA, 25 bp, Mus musculus
tgtgctgttgagctagctgctccag

SEQ ID NO: 907688 - DNA, 25 bp, Mus musculus
tgtgctgttgaggtagctgctccag

SEQ ID NO: 907689 - DNA, 25 bp, Mus musculus
tgtgctgttgctcttcattgtgtat

SEQ ID NO: 907690 - DNA, 25 bp, Mus musculus
tgtgctgttgctgttcattgtgtat

SEQ ID NO: 907691 - DNA, 25 bp, Mus musculus
tgtgctgttggcacttgattaggac

SEQ ID NO: 907692 - DNA, 25 bp, Mus musculus
tgtgctgttggctcttgattaggac

SEQ ID NO: 907693 - DNA, 25 bp, Mus musculus
tgtgctgttgtgatcctgtctgttc

SEQ ID NO: 907694 - DNA, 25 bp, Mus musculus
tgtgctgttgtgttcctgtctgttc

SEQ ID NO: 907695 - DNA, 25 bp, Mus musculus
tgtgctgtttgaaggctccggtaaa

SEQ ID NO: 907696 - DNA, 25 bp, Mus musculus
tgtgctgtttgatggctccggtaaa

SEQ ID NO: 907697 - DNA, 25 bp, Mus musculus
tgtgcttaaaagatctccctggtta

SEQ ID NO: 907698 - DNA, 25 bp, Mus musculus
tgtgcttaaaagttctccctggtta

SEQ ID NO: 907699 - DNA, 25 bp, Mus musculus
tgtgcttaacccagcccagagatac

SEQ ID NO: 907700 - DNA, 25 bp, Mus musculus
tgtgcttaaccctgcccagagatac

SEQ ID NO: 907701 - DNA, 25 bp, Mus musculus
tgtgcttaagaacctggagtcaaag

SEQ ID NO: 907702 - DNA, 25 bp, Mus musculus
tgtgcttaagaagctggagtcaaag

SEQ ID NO: 907703 - DNA, 25 bp, Mus musculus
tgtgcttaagagcagctggcttcca

SEQ ID NO: 907704 - DNA, 25 bp, Mus musculus
tgtgcttaagaggagctggcttcca

SEQ ID NO: 907705 - DNA, 25 bp, Mus musculus
tgtgcttaagccatctcagattgac

SEQ ID NO: 907706 - DNA, 25 bp, Mus musculus
tgtgcttaagccttctcagattgac

SEQ ID NO: 907707 - DNA, 25 bp, Mus musculus
tgtgcttaatttactgctgcctcga

SEQ ID NO: 907708 - DNA, 25 bp, Mus musculus
tgtgcttaattttctgctgcctcga

SEQ ID NO: 907709 - DNA, 25 bp, Mus musculus
tgtgcttacaaacttagggaaccaa

SEQ ID NO: 907710 - DNA, 25 bp, Mus musculus
tgtgcttacaaagttagggaaccaa

SEQ ID NO: 907711 - DNA, 25 bp, Mus musculus
tgtgcttacacgctcggacacccat

SEQ ID NO: 907712 - DNA, 25 bp, Mus musculus
tgtgcttacacggtcggacacccat

SEQ ID NO: 907713 - DNA, 25 bp, Mus musculus
tgtgcttacatgacaagccccttac

SEQ ID NO: 907714 - DNA, 25 bp, Mus musculus
tgtgcttacatgatgctcttactca

SEQ ID NO: 907715 - DNA, 25 bp, Mus musculus
tgtgcttacatgtcaagccccttac

SEQ ID NO: 907716 - DNA, 25 bp, Mus musculus
tgtgcttacatgttgctcttactca

SEQ ID NO: 907717 - DNA, 25 bp, Mus musculus
tgtgcttacattctctctgtgccca

SEQ ID NO: 907718 - DNA, 25 bp, Mus musculus
tgtgcttacattgtctctgtgccca

SEQ ID NO: 907719 - DNA, 25 bp, Mus musculus
tgtgcttactgtagtagtaataaac

SEQ ID NO: 907720 - DNA, 25 bp, Mus musculus
tgtgcttactgttgtagtaataaac

SEQ ID NO: 907721 - DNA, 25 bp, Mus musculus
tgtgcttacttgcttcatgcttctt

SEQ ID NO: 907722 - DNA, 25 bp, Mus musculus
tgtgcttacttggttcatgcttctt

SEQ ID NO: 907723 - DNA, 25 bp, Mus musculus
tgtgcttagagccagtacaccctga

SEQ ID NO: 907724 - DNA, 25 bp, Mus musculus
tgtgcttagagcgagtacaccctga

SEQ ID NO: 907725 - DNA, 25 bp, Mus musculus
tgtgcttatagaatggagaaaccgt

SEQ ID NO: 907726 - DNA, 25 bp, Mus musculus
tgtgcttatagattggagaaaccgt

SEQ ID NO: 907727 - DNA, 25 bp, Mus musculus
tgtgcttatgtaattgcattccggc

SEQ ID NO: 907728 - DNA, 25 bp, Mus musculus
tgtgcttatgtatttgcattccggc

SEQ ID NO: 907729 - DNA, 25 bp, Mus musculus
tgtgcttcaaagacttatcccactc

SEQ ID NO: 907730 - DNA, 25 bp, Mus musculus
tgtgcttcaaagattctgtttcatt

SEQ ID NO: 907731 - DNA, 25 bp, Mus musculus
tgtgcttcaaagtcttatcccactc

SEQ ID NO: 907732 - DNA, 25 bp, Mus musculus
tgtgcttcaaagtttctgtttcatt

SEQ ID NO: 907733 - DNA, 25 bp, Mus musculus
tgtgcttcaaatactcacggtggaa

SEQ ID NO: 907734 - DNA, 25 bp, Mus musculus
tgtgcttcaaattctcacggtggaa

SEQ ID NO: 907735 - DNA, 25 bp, Mus musculus
tgtgcttcactcaagtatgtggcat

SEQ ID NO: 907736 - DNA, 25 bp, Mus musculus
tgtgcttcactctagtatgtggcat

SEQ ID NO: 907737 - DNA, 25 bp, Mus musculus
tgtgcttcaggtaggttcaaaccaa

SEQ ID NO: 907738 - DNA, 25 bp, Mus musculus
tgtgcttcaggttggttcaaaccaa

SEQ ID NO: 907739 - DNA, 25 bp, Mus musculus
tgtgcttccacccagggagacacta

SEQ ID NO: 907740 - DNA, 25 bp, Mus musculus
tgtgcttccaccgagggagacacta

SEQ ID NO: 907741 - DNA, 25 bp, Mus musculus
tgtgcttccactaacaggccatgcc

SEQ ID NO: 907742 - DNA, 25 bp, Mus musculus
tgtgcttccacttacaggccatgcc

SEQ ID NO: 907743 - DNA, 25 bp, Mus musculus
tgtgcttccccaacagaactgtcat

SEQ ID NO: 907744 - DNA, 25 bp, Mus musculus
tgtgcttccccatcagaactgtcat

SEQ ID NO: 907745 - DNA, 25 bp, Mus musculus
tgtgcttccgctctgctcaaaggtt

SEQ ID NO: 907746 - DNA, 25 bp, Mus musculus
tgtgcttccgctgtgctcaaaggtt

SEQ ID NO: 907747 - DNA, 25 bp, Mus musculus
tgtgcttccggtatctcatgacgga

SEQ ID NO: 907748 - DNA, 25 bp, Mus musculus
tgtgcttccggtttctcatgacgga

SEQ ID NO: 907749 - DNA, 25 bp, Mus musculus
tgtgcttcctacagttcactagctt

SEQ ID NO: 907750 - DNA, 25 bp, Mus musculus
tgtgcttcctactgttcactagctt

SEQ ID NO: 907751 - DNA, 25 bp, Mus musculus
tgtgcttcgcagaattccagccttc

SEQ ID NO: 907752 - DNA, 25 bp, Mus musculus
tgtgcttcgcagtattccagccttc

SEQ ID NO: 907753 - DNA, 25 bp, Mus musculus
tgtgcttctacacctacaacttcat

SEQ ID NO: 907754 - DNA, 25 bp, Mus musculus
tgtgcttctacagctacaacttcat

SEQ ID NO: 907755 - DNA, 25 bp, Mus musculus
tgtgcttctagtcctgacggtgtat

SEQ ID NO: 907756 - DNA, 25 bp, Mus musculus
tgtgcttctagtgctgacggtgtat

SEQ ID NO: 907757 - DNA, 25 bp, Mus musculus
tgtgcttctctgaatttgctcttgt

SEQ ID NO: 907758 - DNA, 25 bp, Mus musculus
tgtgcttctctgtatttgctcttgt

SEQ ID NO: 907759 - DNA, 25 bp, Mus musculus
tgtgcttctgcaccaaaagcctcag

SEQ ID NO: 907760 - DNA, 25 bp, Mus musculus
tgtgcttctgcagcaaaagcctcag

SEQ ID NO: 907761 - DNA, 25 bp, Mus musculus
tgtgcttcttgacgctctcatgaaa

SEQ ID NO: 907762 - DNA, 25 bp, Mus musculus
tgtgcttcttgaggctctcatgaaa

SEQ ID NO: 907763 - DNA, 25 bp, Mus musculus
tgtgcttgacatcttcacccatctt

SEQ ID NO: 907764 - DNA, 25 bp, Mus musculus
tgtgcttgacatgttcacccatctt

SEQ ID NO: 907765 - DNA, 25 bp, Mus musculus
tgtgcttgaccaccggtgaccaaaa

SEQ ID NO: 907766 - DNA, 25 bp, Mus musculus
tgtgcttgaccagcggtgaccaaaa

SEQ ID NO: 907767 - DNA, 25 bp, Mus musculus
tgtgcttgacccacctatataattt

SEQ ID NO: 907768 - DNA, 25 bp, Mus musculus
tgtgcttgaccctcctatataattt

SEQ ID NO: 907769 - DNA, 25 bp, Mus musculus
tgtgcttgacttaccagccaatcta

SEQ ID NO: 907770 - DNA, 25 bp, Mus musculus
tgtgcttgactttccagccaatcta

SEQ ID NO: 907771 - DNA, 25 bp, Mus musculus
tgtgcttgatgactgtgtgtgtaaa

SEQ ID NO: 907772 - DNA, 25 bp, Mus musculus
tgtgcttgatgagtgtgtgtgtaaa

SEQ ID NO: 907773 - DNA, 25 bp, Mus musculus
tgtgcttgatttactttcacttgat

SEQ ID NO: 907774 - DNA, 25 bp, Mus musculus
tgtgcttgattttctttcacttgat

SEQ ID NO: 907775 - DNA, 25 bp, Mus musculus
tgtgcttgcaccaactgaacaatct

SEQ ID NO: 907776 - DNA, 25 bp, Mus musculus
tgtgcttgcacctactgaacaatct

SEQ ID NO: 907777 - DNA, 25 bp, Mus musculus
tgtgcttgcattcctgtatggtagt

SEQ ID NO: 907778 - DNA, 25 bp, Mus musculus
tgtgcttgcattgctgtatggtagt

SEQ ID NO: 907779 - DNA, 25 bp, Mus musculus
tgtgcttgccagagatccgatacat

SEQ ID NO: 907780 - DNA, 25 bp, Mus musculus
tgtgcttgccagtgatccgatacat

SEQ ID NO: 907781 - DNA, 25 bp, Mus musculus
tgtgcttgccccatggatcttgtcc

SEQ ID NO: 907782 - DNA, 25 bp, Mus musculus
tgtgcttgccccttggatcttgtcc

SEQ ID NO: 907783 - DNA, 25 bp, Mus musculus
tgtgcttgccctagccctagcggag

SEQ ID NO: 907784 - DNA, 25 bp, Mus musculus
tgtgcttgcccttgccctagcggag

SEQ ID NO: 907785 - DNA, 25 bp, Mus musculus
tgtgcttgctgtatacggtcaccaa

SEQ ID NO: 907786 - DNA, 25 bp, Mus musculus
tgtgcttgctgtttacggtcaccaa

SEQ ID NO: 907787 - DNA, 25 bp, Mus musculus
tgtgcttgcttccaaaggcttctgc

SEQ ID NO: 907788 - DNA, 25 bp, Mus musculus
tgtgcttgcttcgaaaggcttctgc

SEQ ID NO: 907789 - DNA, 25 bp, Mus musculus
tgtgcttgctttccattagagtcag

SEQ ID NO: 907790 - DNA, 25 bp, Mus musculus
tgtgcttgctttgcattagagtcag

SEQ ID NO: 907791 - DNA, 25 bp, Mus musculus
tgtgcttggaccacagatgctctgc

SEQ ID NO: 907792 - DNA, 25 bp, Mus musculus
tgtgcttggacctcagatgctctgc

SEQ ID NO: 907793 - DNA, 25 bp, Mus musculus
tgtgcttggctcaggtctctaggtc

SEQ ID NO: 907794 - DNA, 25 bp, Mus musculus
tgtgcttggctctggtctctaggtc

SEQ ID NO: 907795 - DNA, 25 bp, Mus musculus
tgtgcttggcttaattgctttgtat

SEQ ID NO: 907796 - DNA, 25 bp, Mus musculus
tgtgcttggctttattgctttgtat

SEQ ID NO: 907797 - DNA, 25 bp, Mus musculus
tgtgcttgggacaacgggtgattca

SEQ ID NO: 907798 - DNA, 25 bp, Mus musculus
tgtgcttgggactacgggtgattca

SEQ ID NO: 907799 - DNA, 25 bp, Mus musculus
tgtgcttgggatcctcttgctgcag

SEQ ID NO: 907800 - DNA, 25 bp, Mus musculus
tgtgcttgggatgctcttgctgcag

SEQ ID NO: 907801 - DNA, 25 bp, Mus musculus
tgtgcttgggcactcacgtgacaga

SEQ ID NO: 907802 - DNA, 25 bp, Mus musculus
tgtgcttgggcagtcacgtgacaga

SEQ ID NO: 907803 - DNA, 25 bp, Mus musculus
tgtgcttggtaaaattccttcctat

SEQ ID NO: 907804 - DNA, 25 bp, Mus musculus
tgtgcttggtaatattccttcctat

SEQ ID NO: 907805 - DNA, 25 bp, Mus musculus
tgtgcttgtcacactctagagccat

SEQ ID NO: 907806 - DNA, 25 bp, Mus musculus
tgtgcttgtcactctctagagccat

SEQ ID NO: 907807 - DNA, 25 bp, Mus musculus
tgtgcttgtgctagatgactgtgtg

SEQ ID NO: 907808 - DNA, 25 bp, Mus musculus
tgtgcttgtgcttgatgactgtgtg

SEQ ID NO: 907809 - DNA, 25 bp, Mus musculus
tgtgcttgtgtacgcatgactgcat

SEQ ID NO: 907810 - DNA, 25 bp, Mus musculus
tgtgcttgtgtaggcatgactgcat

SEQ ID NO: 907811 - DNA, 25 bp, Mus musculus
tgtgcttgtttaatgggtatggccc

SEQ ID NO: 907812 - DNA, 25 bp, Mus musculus
tgtgcttgtttattgggtatggccc

SEQ ID NO: 907813 - DNA, 25 bp, Mus musculus
tgtgctttacacagttgcctataaa

SEQ ID NO: 907814 - DNA, 25 bp, Mus musculus
tgtgctttacactgttgcctataaa

SEQ ID NO: 907815 - DNA, 25 bp, Mus musculus
tgtgctttatggcaaattcccagta

SEQ ID NO: 907816 - DNA, 25 bp, Mus musculus
tgtgctttatgggaaattcccagta

SEQ ID NO: 907817 - DNA, 25 bp, Mus musculus
tgtgctttcacaagctgatctctgc

SEQ ID NO: 907818 - DNA, 25 bp, Mus musculus
tgtgctttcacatgctgatctctgc

SEQ ID NO: 907819 - DNA, 25 bp, Mus musculus
tgtgctttccaactctagttccagg

SEQ ID NO: 907820 - DNA, 25 bp, Mus musculus
tgtgctttccaagtctagttccagg

SEQ ID NO: 907821 - DNA, 25 bp, Mus musculus
tgtgctttcctcacaggacaaattg

SEQ ID NO: 907822 - DNA, 25 bp, Mus musculus
tgtgctttcctctcaggacaaattg

SEQ ID NO: 907823 - DNA, 25 bp, Mus musculus
tgtgctttctagacacccaaggtta

SEQ ID NO: 907824 - DNA, 25 bp, Mus musculus
tgtgctttctagtcacccaaggtta

SEQ ID NO: 907825 - DNA, 25 bp, Mus musculus
tgtgctttcttactgcagctcttaa

SEQ ID NO: 907826 - DNA, 25 bp, Mus musculus
tgtgctttcttagtgcagctcttaa

SEQ ID NO: 907827 - DNA, 25 bp, Mus musculus
tgtgctttcttgacatgttatgcag

SEQ ID NO: 907828 - DNA, 25 bp, Mus musculus
tgtgctttcttgctctggactgcga

SEQ ID NO: 907829 - DNA, 25 bp, Mus musculus
tgtgctttcttggtctggactgcga

SEQ ID NO: 907830 - DNA, 25 bp, Mus musculus
tgtgctttcttgtcatgttatgcag

SEQ ID NO: 907831 - DNA, 25 bp, Mus musculus
tgtgctttgaagagtaacagtgtaa

SEQ ID NO: 907832 - DNA, 25 bp, Mus musculus
tgtgctttgaagtgtaacagtgtaa

SEQ ID NO: 907833 - DNA, 25 bp, Mus musculus
tgtgctttgaatactgacagccaga

SEQ ID NO: 907834 - DNA, 25 bp, Mus musculus
tgtgctttgaattctgacagccaga

SEQ ID NO: 907835 - DNA, 25 bp, Mus musculus
tgtgctttgagcagcgtgcagcccg

SEQ ID NO: 907836 - DNA, 25 bp, Mus musculus
tgtgctttgagctgcgtgcagcccg

SEQ ID NO: 907837 - DNA, 25 bp, Mus musculus
tgtgctttgcacagtctatttgaaa

SEQ ID NO: 907838 - DNA, 25 bp, Mus musculus
tgtgctttgcactgtctatttgaaa

SEQ ID NO: 907839 - DNA, 25 bp, Mus musculus
tgtgctttgccccactaacttcatt

SEQ ID NO: 907840 - DNA, 25 bp, Mus musculus
tgtgctttgcccgactaacttcatt

SEQ ID NO: 907841 - DNA, 25 bp, Mus musculus
tgtgctttggaaagcttcattgctc

SEQ ID NO: 907842 - DNA, 25 bp, Mus musculus
tgtgctttggaatgcttcattgctc

SEQ ID NO: 907843 - DNA, 25 bp, Mus musculus
tgtgctttggccaagggatttccag

SEQ ID NO: 907844 - DNA, 25 bp, Mus musculus
tgtgctttggcctagggatttccag

SEQ ID NO: 907845 - DNA, 25 bp, Mus musculus
tgtgctttggttaccctatttactt

SEQ ID NO: 907846 - DNA, 25 bp, Mus musculus
tgtgctttggttcggccgtgttctc

SEQ ID NO: 907847 - DNA, 25 bp, Mus musculus
tgtgctttggttgggccgtgttctc

SEQ ID NO: 907848 - DNA, 25 bp, Mus musculus
tgtgctttggtttccctatttactt

SEQ ID NO: 907849 - DNA, 25 bp, Mus musculus
tgtgctttgtaacccttcgggcatt

SEQ ID NO: 907850 - DNA, 25 bp, Mus musculus
tgtgctttgtaagccttcgggcatt

SEQ ID NO: 907851 - DNA, 25 bp, Mus musculus
tgtgctttgtatcagagttcttaac

SEQ ID NO: 907852 - DNA, 25 bp, Mus musculus
tgtgctttgtatgagagttcttaac

SEQ ID NO: 907853 - DNA, 25 bp, Mus musculus
tgtgctttgtgaagtccagactgaa

SEQ ID NO: 907854 - DNA, 25 bp, Mus musculus
tgtgctttgtgatgtccagactgaa

SEQ ID NO: 907855 - DNA, 25 bp, Mus musculus
tgtgctttgtgcacatgtgtaggtg

SEQ ID NO: 907856 - DNA, 25 bp, Mus musculus
tgtgctttgtgctcatgtgtaggtg

SEQ ID NO: 907857 - DNA, 25 bp, Mus musculus
tgtgcttttatcaccaaactaaggc

SEQ ID NO: 907858 - DNA, 25 bp, Mus musculus
tgtgcttttatctccaaactaaggc

SEQ ID NO: 907859 - DNA, 25 bp, Mus musculus
tgtgcttttcaaaattgcagtgcta

SEQ ID NO: 907860 - DNA, 25 bp, Mus musculus
tgtgcttttcaatattgcagtgcta

SEQ ID NO: 907861 - DNA, 25 bp, Mus musculus
tgtgcttttcacatggttgttcatg

SEQ ID NO: 907862 - DNA, 25 bp, Mus musculus
tgtgcttttcacttggttgttcatg

SEQ ID NO: 907863 - DNA, 25 bp, Mus musculus
tgtgcttttcagaactacttgtaaa

SEQ ID NO: 907864 - DNA, 25 bp, Mus musculus
tgtgcttttcagtactacttgtaaa

SEQ ID NO: 907865 - DNA, 25 bp, Mus musculus
tgtgcttttccactatcttcagtct

SEQ ID NO: 907866 - DNA, 25 bp, Mus musculus
tgtgcttttccagtatcttcagtct

SEQ ID NO: 907867 - DNA, 25 bp, Mus musculus
tgtgcttttcctcaatggtcgaagt

SEQ ID NO: 907868 - DNA, 25 bp, Mus musculus
tgtgcttttcctgaatggtcgaagt

SEQ ID NO: 907869 - DNA, 25 bp, Mus musculus
tgtgcttttctgagcggttacagaa

SEQ ID NO: 907870 - DNA, 25 bp, Mus musculus
tgtgcttttctgtgcggttacagaa

SEQ ID NO: 907871 - DNA, 25 bp, Mus musculus
tgtgcttttcttaattcttcctgtg

SEQ ID NO: 907872 - DNA, 25 bp, Mus musculus
tgtgcttttctttattcttcctgtg

SEQ ID NO: 907873 - DNA, 25 bp, Mus musculus
tgtgcttttgacagtcgctccattc

SEQ ID NO: 907874 - DNA, 25 bp, Mus musculus
tgtgcttttgactgtcgctccattc

SEQ ID NO: 907875 - DNA, 25 bp, Mus musculus
tgtgcttttgataaccagtctttgt

SEQ ID NO: 907876 - DNA, 25 bp, Mus musculus
tgtgcttttgattaccagtctttgt

SEQ ID NO: 907877 - DNA, 25 bp, Mus musculus
tgtgcttttgctctttcactagaaa

SEQ ID NO: 907878 - DNA, 25 bp, Mus musculus
tgtgcttttgctgtttcactagaaa

SEQ ID NO: 907879 - DNA, 25 bp, Mus musculus
tgtgcttttggaagatctggctttc

SEQ ID NO: 907880 - DNA, 25 bp, Mus musculus
tgtgcttttggaatgctctgactat

SEQ ID NO: 907881 - DNA, 25 bp, Mus musculus
tgtgcttttggatgatctggctttc

SEQ ID NO: 907882 - DNA, 25 bp, Mus musculus
tgtgcttttggattgctctgactat

SEQ ID NO: 907883 - DNA, 25 bp, Mus musculus
tgtgcttttgtactttgggtccctg

SEQ ID NO: 907884 - DNA, 25 bp, Mus musculus
tgtgcttttgtagtttgggtccctg

SEQ ID NO: 907885 - DNA, 25 bp, Mus musculus
tgtgctttttctctgggaccattcc

SEQ ID NO: 907886 - DNA, 25 bp, Mus musculus
tgtgctttttctgtgggaccattcc

SEQ ID NO: 907887 - DNA, 25 bp, Mus musculus
tgtggaaaagacacagcatgttggt

SEQ ID NO: 907888 - DNA, 25 bp, Mus musculus
tgtggaaaagactcagcatgttggt

SEQ ID NO: 907889 - DNA, 25 bp, Mus musculus
tgtggaaaaggcaccattcctctgt

SEQ ID NO: 907890 - DNA, 25 bp, Mus musculus
tgtggaaaaggctccattcctctgt

SEQ ID NO: 907891 - DNA, 25 bp, Mus musculus
tgtggaaaccaacccgggagagcca

SEQ ID NO: 907892 - DNA, 25 bp, Mus musculus
tgtggaaaccaagccgggagagcca

SEQ ID NO: 907893 - DNA, 25 bp, Mus musculus
tgtggaaaccgaatcactggatgct

SEQ ID NO: 907894 - DNA, 25 bp, Mus musculus
tgtggaaaccgattcactggatgct

SEQ ID NO: 907895 - DNA, 25 bp, Mus musculus
tgtggaaaccggagaaggaattgtt

SEQ ID NO: 907896 - DNA, 25 bp, Mus musculus
tgtggaaaccggtgaaggaattgtt

SEQ ID NO: 907897 - DNA, 25 bp, Mus musculus
tgtggaaactaaacagctgctcagt

SEQ ID NO: 907898 - DNA, 25 bp, Mus musculus
tgtggaaactaatcagctgctcagt

SEQ ID NO: 907899 - DNA, 25 bp, Mus musculus
tgtggaaactcacggtctttacaga

SEQ ID NO: 907900 - DNA, 25 bp, Mus musculus
tgtggaaactcagggtctttacaga

SEQ ID NO: 907901 - DNA, 25 bp, Mus musculus
tgtggaaagaccagcacaggctctg

SEQ ID NO: 907902 - DNA, 25 bp, Mus musculus
tgtggaaagacctgcacaggctctg

SEQ ID NO: 907903 - DNA, 25 bp, Mus musculus
tgtggaaaggctcccatctcattca

SEQ ID NO: 907904 - DNA, 25 bp, Mus musculus
tgtggaaaggctgccatctcattca

SEQ ID NO: 907905 - DNA, 25 bp, Mus musculus
tgtggaaataaactcctggttcctt

SEQ ID NO: 907906 - DNA, 25 bp, Mus musculus
tgtggaaataaagtcctggttcctt

SEQ ID NO: 907907 - DNA, 25 bp, Mus musculus
tgtggaaatagacgctgccagccag

SEQ ID NO: 907908 - DNA, 25 bp, Mus musculus
tgtggaaatagaggctgccagccag

SEQ ID NO: 907909 - DNA, 25 bp, Mus musculus
tgtggaaatctgactgcttgtttac

SEQ ID NO: 907910 - DNA, 25 bp, Mus musculus
tgtggaaatctgtctgcttgtttac

SEQ ID NO: 907911 - DNA, 25 bp, Mus musculus
tgtggaacaacactgcagcagatga

SEQ ID NO: 907912 - DNA, 25 bp, Mus musculus
tgtggaacaacagtgcagcagatga

SEQ ID NO: 907913 - DNA, 25 bp, Mus musculus
tgtggaaccacacccggcagatgag

SEQ ID NO: 907914 - DNA, 25 bp, Mus musculus
tgtggaaccacagccggcagatgag

SEQ ID NO: 907915 - DNA, 25 bp, Mus musculus
tgtggaaccaggctcggaactgccc

SEQ ID NO: 907916 - DNA, 25 bp, Mus musculus
tgtggaaccagggtcggaactgccc

SEQ ID NO: 907917 - DNA, 25 bp, Mus musculus
tgtggaaccataataactgtattgt

SEQ ID NO: 907918 - DNA, 25 bp, Mus musculus
tgtggaaccatacatacgctgcccc

SEQ ID NO: 907919 - DNA, 25 bp, Mus musculus
tgtggaaccatagatacgctgcccc

SEQ ID NO: 907920 - DNA, 25 bp, Mus musculus
tgtggaaccatattaactgtattgt

SEQ ID NO: 907921 - DNA, 25 bp, Mus musculus
tgtggaacccctattacggatcaat

SEQ ID NO: 907922 - DNA, 25 bp, Mus musculus
tgtggaaccccttttacggatcaat

SEQ ID NO: 907923 - DNA, 25 bp, Mus musculus
tgtggaacccttatccaagagcccg

SEQ ID NO: 907924 - DNA, 25 bp, Mus musculus
tgtggaacccttttccaagagcccg

SEQ ID NO: 907925 - DNA, 25 bp, Mus musculus
tgtggaacctgtcctcagttcaatg

SEQ ID NO: 907926 - DNA, 25 bp, Mus musculus
tgtggaacctgtgctcagttcaatg

SEQ ID NO: 907927 - DNA, 25 bp, Mus musculus
tgtggaacgagcacctgggctacgt

SEQ ID NO: 907928 - DNA, 25 bp, Mus musculus
tgtggaacgagctcctgggctacgt

SEQ ID NO: 907929 - DNA, 25 bp, Mus musculus
tgtggaactagcaccgaaggtctta

SEQ ID NO: 907930 - DNA, 25 bp, Mus musculus
tgtggaactagctccgaaggtctta

SEQ ID NO: 907931 - DNA, 25 bp, Mus musculus
tgtggaactcacaggaccttcgctt

SEQ ID NO: 907932 - DNA, 25 bp, Mus musculus
tgtggaactcactggaccttcgctt

SEQ ID NO: 907933 - DNA, 25 bp, Mus musculus
tgtggaactcttactgtcattctga

SEQ ID NO: 907934 - DNA, 25 bp, Mus musculus
tgtggaactctttctgtcattctga

SEQ ID NO: 907935 - DNA, 25 bp, Mus musculus
tgtggaactgtgcatatgctttgaa

SEQ ID NO: 907936 - DNA, 25 bp, Mus musculus
tgtggaactgtggatatgctttgaa

SEQ ID NO: 907937 - DNA, 25 bp, Mus musculus
tgtggaacttttcgcctcttgactc

SEQ ID NO: 907938 - DNA, 25 bp, Mus musculus
tgtggaacttttggcctcttgactc

SEQ ID NO: 907939 - DNA, 25 bp, Mus musculus
tgtggaagaacaccttcacccgtac

SEQ ID NO: 907940 - DNA, 25 bp, Mus musculus
tgtggaagaacagcttcacccgtac

SEQ ID NO: 907941 - DNA, 25 bp, Mus musculus
tgtggaagatgaccacatccccttc

SEQ ID NO: 907942 - DNA, 25 bp, Mus musculus
tgtggaagatgagcacatccccttc

SEQ ID NO: 907943 - DNA, 25 bp, Mus musculus
tgtggaagccatactggagaccatt

SEQ ID NO: 907944 - DNA, 25 bp, Mus musculus
tgtggaagccattctggagaccatt

SEQ ID NO: 907945 - DNA, 25 bp, Mus musculus
tgtggaagcccaagcttttaatgcc

SEQ ID NO: 907946 - DNA, 25 bp, Mus musculus
tgtggaagcccatgcttttaatgcc

SEQ ID NO: 907947 - DNA, 25 bp, Mus musculus
tgtggaagcctcaggaaaatcactc

SEQ ID NO: 907948 - DNA, 25 bp, Mus musculus
tgtggaagcctcattgtggcccagc

SEQ ID NO: 907949 - DNA, 25 bp, Mus musculus
tgtggaagcctctggaaaatcactc

SEQ ID NO: 907950 - DNA, 25 bp, Mus musculus
tgtggaagcctctttgtggcccagc

SEQ ID NO: 907951 - DNA, 25 bp, Mus musculus
tgtggaagctaacaattgaacctga

SEQ ID NO: 907952 - DNA, 25 bp, Mus musculus
tgtggaagctaagaattgaacctga

SEQ ID NO: 907953 - DNA, 25 bp, Mus musculus
tgtggaagctctagtgtcctggcca

SEQ ID NO: 907954 - DNA, 25 bp, Mus musculus
tgtggaagctcttgtgtcctggcca

SEQ ID NO: 907955 - DNA, 25 bp, Mus musculus
tgtggaaggaatctggtgactccca

SEQ ID NO: 907956 - DNA, 25 bp, Mus musculus
tgtggaaggaatgtggtgactccca

SEQ ID NO: 907957 - DNA, 25 bp, Mus musculus
tgtggaaggacaacttcaccgtctc

SEQ ID NO: 907958 - DNA, 25 bp, Mus musculus
tgtggaaggacatcttcaccgtctc

SEQ ID NO: 907959 - DNA, 25 bp, Mus musculus
tgtggaagtgtaaccggccacccca

SEQ ID NO: 907960 - DNA, 25 bp, Mus musculus
tgtggaagtgtatccggccacccca

SEQ ID NO: 907961 - DNA, 25 bp, Mus musculus
tgtggaagttccatgtggctctttc

SEQ ID NO: 907962 - DNA, 25 bp, Mus musculus
tgtggaagttccttgtggctctttc

SEQ ID NO: 907963 - DNA, 25 bp, Mus musculus
tgtggaataaaccttgggtcagcaa

SEQ ID NO: 907964 - DNA, 25 bp, Mus musculus
tgtggaataaacgttgggtcagcaa

SEQ ID NO: 907965 - DNA, 25 bp, Mus musculus
tgtggaatatcaaacaggagtacct

SEQ ID NO: 907966 - DNA, 25 bp, Mus musculus
tgtggaatatcatacaggagtacct

SEQ ID NO: 907967 - DNA, 25 bp, Mus musculus
tgtggaatatctagtcctgcacctc

SEQ ID NO: 907968 - DNA, 25 bp, Mus musculus
tgtggaatatcttgtcctgcacctc

SEQ ID NO: 907969 - DNA, 25 bp, Mus musculus
tgtggaatatgaaggcacgcctgtt

SEQ ID NO: 907970 - DNA, 25 bp, Mus musculus
tgtggaatatgatggcacgcctgtt

SEQ ID NO: 907971 - DNA, 25 bp, Mus musculus
tgtggaatctagcttctccctgaat

SEQ ID NO: 907972 - DNA, 25 bp, Mus musculus
tgtggaatctaggttctccctgaat

SEQ ID NO: 907973 - DNA, 25 bp, Mus musculus
tgtggaatctatcctgagcctgcca

SEQ ID NO: 907974 - DNA, 25 bp, Mus musculus
tgtggaatctatgctgagcctgcca

SEQ ID NO: 907975 - DNA, 25 bp, Mus musculus
tgtggaatctctagagccagcccaa

SEQ ID NO: 907976 - DNA, 25 bp, Mus musculus
tgtggaatctcttgagccagcccaa

SEQ ID NO: 907977 - DNA, 25 bp, Mus musculus
tgtggaatgctaattccccccaacg

SEQ ID NO: 907978 - DNA, 25 bp, Mus musculus
tgtggaatgctatttccccccaacg

SEQ ID NO: 907979 - DNA, 25 bp, Mus musculus
tgtggaatgcttaggccttgtggta

SEQ ID NO: 907980 - DNA, 25 bp, Mus musculus
tgtggaatgctttggccttgtggta

SEQ ID NO: 907981 - DNA, 25 bp, Mus musculus
tgtggaatgttcacctaactggcct

SEQ ID NO: 907982 - DNA, 25 bp, Mus musculus
tgtggaatgttctcctaactggcct

SEQ ID NO: 907983 - DNA, 25 bp, Mus musculus
tgtggaattactccttccctccgac

SEQ ID NO: 907984 - DNA, 25 bp, Mus musculus
tgtggaattactgcttccctccgac

SEQ ID NO: 907985 - DNA, 25 bp, Mus musculus
tgtggacaaaggaaagcctaggtct

SEQ ID NO: 907986 - DNA, 25 bp, Mus musculus
tgtggacaaaggtaagcctaggtct

SEQ ID NO: 907987 - DNA, 25 bp, Mus musculus
tgtggacaacatcctgtatatcgcc

SEQ ID NO: 907988 - DNA, 25 bp, Mus musculus
tgtggacaacatgctgtatatcgcc

SEQ ID NO: 907989 - DNA, 25 bp, Mus musculus
tgtggacaatacaggctgccggacg

SEQ ID NO: 907990 - DNA, 25 bp, Mus musculus
tgtggacaatactggctgccggacg

SEQ ID NO: 907991 - DNA, 25 bp, Mus musculus
tgtggacaatatcatctcataactt

SEQ ID NO: 907992 - DNA, 25 bp, Mus musculus
tgtggacaatatgatctcataactt

SEQ ID NO: 907993 - DNA, 25 bp, Mus musculus
tgtggacacaaacatgacgggccat

SEQ ID NO: 907994 - DNA, 25 bp, Mus musculus
tgtggacacaaagatgacgggccat

SEQ ID NO: 907995 - DNA, 25 bp, Mus musculus
tgtggacacactaagctgagcggtt

SEQ ID NO: 907996 - DNA, 25 bp, Mus musculus
tgtggacacacttagctgagcggtt

SEQ ID NO: 907997 - DNA, 25 bp, Mus musculus
tgtggacagtgacggcacagccacc

SEQ ID NO: 907998 - DNA, 25 bp, Mus musculus
tgtggacagtgagggcacagccacc

SEQ ID NO: 907999 - DNA, 25 bp, Mus musculus
tgtggacatctgacagcctcttctg

SEQ ID NO: 908000 - DNA, 25 bp, Mus musculus
tgtggacatctgtcagcctcttctg

SEQ ID NO: 908001 - DNA, 25 bp, Mus musculus
tgtggacattccacactgcacaggc

SEQ ID NO: 908002 - DNA, 25 bp, Mus musculus
tgtggacattcctcactgcacaggc

SEQ ID NO: 908003 - DNA, 25 bp, Mus musculus
tgtggacattgtcggcaccctgtct

SEQ ID NO: 908004 - DNA, 25 bp, Mus musculus
tgtggacattgtgggcaccctgtct

SEQ ID NO: 908005 - DNA, 25 bp, Mus musculus
tgtggaccacacatctgactcccgc

SEQ ID NO: 908006 - DNA, 25 bp, Mus musculus
tgtggaccacacctgtctctaaggt

SEQ ID NO: 908007 - DNA, 25 bp, Mus musculus
tgtggaccacacgtgtctctaaggt

SEQ ID NO: 908008 - DNA, 25 bp, Mus musculus
tgtggaccacacttctgactcccgc

SEQ ID NO: 908009 - DNA, 25 bp, Mus musculus
tgtggacccacacctgcctgagtgt

SEQ ID NO: 908010 - DNA, 25 bp, Mus musculus
tgtggacccacagctgcctgagtgt

SEQ ID NO: 908011 - DNA, 25 bp, Mus musculus
tgtggacccggtcttctttgaactg

SEQ ID NO: 908012 - DNA, 25 bp, Mus musculus
tgtggacccggtgttctttgaactg

SEQ ID NO: 908013 - DNA, 25 bp, Mus musculus
tgtggaccctataaatcacccttgg

SEQ ID NO: 908014 - DNA, 25 bp, Mus musculus
tgtggaccctattaatcacccttgg

SEQ ID NO: 908015 - DNA, 25 bp, Mus musculus
tgtggacctaacaggactctagcca

SEQ ID NO: 908016 - DNA, 25 bp, Mus musculus
tgtggacctaactggactctagcca

SEQ ID NO: 908017 - DNA, 25 bp, Mus musculus
tgtggacctatcagtgaaataaaag

SEQ ID NO: 908018 - DNA, 25 bp, Mus musculus
tgtggacctatctgtgaaataaaag

SEQ ID NO: 908019 - DNA, 25 bp, Mus musculus
tgtggacctcaaaggtaaaagggta

SEQ ID NO: 908020 - DNA, 25 bp, Mus musculus
tgtggacctcaacacagctcaggcc

SEQ ID NO: 908021 - DNA, 25 bp, Mus musculus
tgtggacctcaagacagctcaggcc

SEQ ID NO: 908022 - DNA, 25 bp, Mus musculus
tgtggacctcaatggtaaaagggta

SEQ ID NO: 908023 - DNA, 25 bp, Mus musculus
tgtggacctcttacaggactctgat

SEQ ID NO: 908024 - DNA, 25 bp, Mus musculus
tgtggacctctttcaggactctgat

SEQ ID NO: 908025 - DNA, 25 bp, Mus musculus
tgtggacctgaacaacgtctgctgc

SEQ ID NO: 908026 - DNA, 25 bp, Mus musculus
tgtggacctgaagaacgtctgctgc

SEQ ID NO: 908027 - DNA, 25 bp, Mus musculus
tgtggacgacatctttggctagagt

SEQ ID NO: 908028 - DNA, 25 bp, Mus musculus
tgtggacgacatgtttggctagagt

SEQ ID NO: 908029 - DNA, 25 bp, Mus musculus
tgtggacgccagagtatgctgctca

SEQ ID NO: 908030 - DNA, 25 bp, Mus musculus
tgtggacgccagtgtatgctgctca

SEQ ID NO: 908031 - DNA, 25 bp, Mus musculus
tgtggacggtccagactgtgtcata

SEQ ID NO: 908032 - DNA, 25 bp, Mus musculus
tgtggacggtcctgactgtgtcata

SEQ ID NO: 908033 - DNA, 25 bp, Mus musculus
tgtggactacgacctcccagatggg

SEQ ID NO: 908034 - DNA, 25 bp, Mus musculus
tgtggactacgagctcccagatggg

SEQ ID NO: 908035 - DNA, 25 bp, Mus musculus
tgtggactatccagagccgtaactg

SEQ ID NO: 908036 - DNA, 25 bp, Mus musculus
tgtggactatcctgagccgtaactg

SEQ ID NO: 908037 - DNA, 25 bp, Mus musculus
tgtggactatggcttgcttctggac

SEQ ID NO: 908038 - DNA, 25 bp, Mus musculus
tgtggactatgggttgcttctggac

SEQ ID NO: 908039 - DNA, 25 bp, Mus musculus
tgtggactcctgcaactgcccagat

SEQ ID NO: 908040 - DNA, 25 bp, Mus musculus
tgtggactcctggaactgcccagat

SEQ ID NO: 908041 - DNA, 25 bp, Mus musculus
tgtggactctgtaggttggactctg

SEQ ID NO: 908042 - DNA, 25 bp, Mus musculus
tgtggactctgtcacccttgtctaa

SEQ ID NO: 908043 - DNA, 25 bp, Mus musculus
tgtggactctgtgacccttgtctaa

SEQ ID NO: 908044 - DNA, 25 bp, Mus musculus
tgtggactctgttggttggactctg

SEQ ID NO: 908045 - DNA, 25 bp, Mus musculus
tgtggactggctaagctcagaacca

SEQ ID NO: 908046 - DNA, 25 bp, Mus musculus
tgtggactggcttagctcagaacca

SEQ ID NO: 908047 - DNA, 25 bp, Mus musculus
tgtggactgggaactgctgcttccg

SEQ ID NO: 908048 - DNA, 25 bp, Mus musculus
tgtggactgggatctgctgcttccg

SEQ ID NO: 908049 - DNA, 25 bp, Mus musculus
tgtggactgtggacgccggtttacc

SEQ ID NO: 908050 - DNA, 25 bp, Mus musculus
tgtggactgtggtcgccggtttacc

SEQ ID NO: 908051 - DNA, 25 bp, Mus musculus
tgtggacttgggacccagaacccta

SEQ ID NO: 908052 - DNA, 25 bp, Mus musculus
tgtggacttgggtcccagaacccta

SEQ ID NO: 908053 - DNA, 25 bp, Mus musculus
tgtggactttttagcctggttgttc

SEQ ID NO: 908054 - DNA, 25 bp, Mus musculus
tgtggacttttttgcctggttgttc

SEQ ID NO: 908055 - DNA, 25 bp, Mus musculus
tgtggagaacctacacccacacgtc

SEQ ID NO: 908056 - DNA, 25 bp, Mus musculus
tgtggagaaccttcacccacacgtc

SEQ ID NO: 908057 - DNA, 25 bp, Mus musculus
tgtggagaaggactaccccaatcgg

SEQ ID NO: 908058 - DNA, 25 bp, Mus musculus
tgtggagaaggagtaccccaatcgg

SEQ ID NO: 908059 - DNA, 25 bp, Mus musculus
tgtggagacaccagacattcttgga

SEQ ID NO: 908060 - DNA, 25 bp, Mus musculus
tgtggagacacctgacattcttgga

SEQ ID NO: 908061 - DNA, 25 bp, Mus musculus
tgtggagacagaattcattgctttc

SEQ ID NO: 908062 - DNA, 25 bp, Mus musculus
tgtggagacagatttcattgctttc

SEQ ID NO: 908063 - DNA, 25 bp, Mus musculus
tgtggagaccagaccgaggaaccat

SEQ ID NO: 908064 - DNA, 25 bp, Mus musculus
tgtggagaccagtccgaggaaccat

SEQ ID NO: 908065 - DNA, 25 bp, Mus musculus
tgtggagacccaatgcttgacccta

SEQ ID NO: 908066 - DNA, 25 bp, Mus musculus
tgtggagacccattgcttgacccta

SEQ ID NO: 908067 - DNA, 25 bp, Mus musculus
tgtggagaccctcaacgtcatcatc

SEQ ID NO: 908068 - DNA, 25 bp, Mus musculus
tgtggagaccctgaacgtcatcatc

SEQ ID NO: 908069 - DNA, 25 bp, Mus musculus
tgtggagactatcacccaagacctc

SEQ ID NO: 908070 - DNA, 25 bp, Mus musculus
tgtggagactatgacccaagacctc

SEQ ID NO: 908071 - DNA, 25 bp, Mus musculus
tgtggagactcgatagcaatgctgt

SEQ ID NO: 908072 - DNA, 25 bp, Mus musculus
tgtggagactcgttagcaatgctgt

SEQ ID NO: 908073 - DNA, 25 bp, Mus musculus
tgtggagagcatcctgcagaccgat

SEQ ID NO: 908074 - DNA, 25 bp, Mus musculus
tgtggagagcatgctgcagaccgat

SEQ ID NO: 908075 - DNA, 25 bp, Mus musculus
tgtggagagcgccagccttgcttat

SEQ ID NO: 908076 - DNA, 25 bp, Mus musculus
tgtggagagcgcgagccttgcttat

SEQ ID NO: 908077 - DNA, 25 bp, Mus musculus
tgtggagagcttctcacagtaccca

SEQ ID NO: 908078 - DNA, 25 bp, Mus musculus
tgtggagagcttgtcacagtaccca

SEQ ID NO: 908079 - DNA, 25 bp, Mus musculus
tgtggagaggtcaaggcttccctaa

SEQ ID NO: 908080 - DNA, 25 bp, Mus musculus
tgtggagaggtctaggcttccctaa

SEQ ID NO: 908081 - DNA, 25 bp, Mus musculus
tgtggagaggttcttcaactactgc

SEQ ID NO: 908082 - DNA, 25 bp, Mus musculus
tgtggagaggttgttcaactactgc

SEQ ID NO: 908083 - DNA, 25 bp, Mus musculus
tgtggagatcacaagtcaacgttgc

SEQ ID NO: 908084 - DNA, 25 bp, Mus musculus
tgtggagatcactagtcaacgttgc

SEQ ID NO: 908085 - DNA, 25 bp, Mus musculus
tgtggagcaacaatccagggctgaa

SEQ ID NO: 908086 - DNA, 25 bp, Mus musculus
tgtggagcaacattccagggctgaa

SEQ ID NO: 908087 - DNA, 25 bp, Mus musculus
tgtggagcacagcttctggcctata

SEQ ID NO: 908088 - DNA, 25 bp, Mus musculus
tgtggagcacaggttctggcctata

SEQ ID NO: 908089 - DNA, 25 bp, Mus musculus
tgtggagcagctagtgacgtccgac

SEQ ID NO: 908090 - DNA, 25 bp, Mus musculus
tgtggagcagcttgtgacgtccgac

SEQ ID NO: 908091 - DNA, 25 bp, Mus musculus
tgtggagcagttcaccctcagtgca

SEQ ID NO: 908092 - DNA, 25 bp, Mus musculus
tgtggagcagttgaccctcagtgca

SEQ ID NO: 908093 - DNA, 25 bp, Mus musculus
tgtggagcatgcacgtagtgccctt

SEQ ID NO: 908094 - DNA, 25 bp, Mus musculus
tgtggagcatgctcgtagtgccctt

SEQ ID NO: 908095 - DNA, 25 bp, Mus musculus
tgtggagcccacctgagcctttaac

SEQ ID NO: 908096 - DNA, 25 bp, Mus musculus
tgtggagcccacgtgagcctttaac

SEQ ID NO: 908097 - DNA, 25 bp, Mus musculus
tgtggagcctaacacagacctctgc

SEQ ID NO: 908098 - DNA, 25 bp, Mus musculus
tgtggagcctaagacagacctctgc

SEQ ID NO: 908099 - DNA, 25 bp, Mus musculus
tgtggagcctgaacagaacattcca

SEQ ID NO: 908100 - DNA, 25 bp, Mus musculus
tgtggagcctgatcagaacattcca

SEQ ID NO: 908101 - DNA, 25 bp, Mus musculus
tgtggagcctttcagcatggtacgt

SEQ ID NO: 908102 - DNA, 25 bp, Mus musculus
tgtggagcctttgagcatggtacgt

SEQ ID NO: 908103 - DNA, 25 bp, Mus musculus
tgtggagctcaacattcagcttttt

SEQ ID NO: 908104 - DNA, 25 bp, Mus musculus
tgtggagctcaagattcagcttttt

SEQ ID NO: 908105 - DNA, 25 bp, Mus musculus
tgtggagctccaatccagaggaatt

SEQ ID NO: 908106 - DNA, 25 bp, Mus musculus
tgtggagctccattccagaggaatt

SEQ ID NO: 908107 - DNA, 25 bp, Mus musculus
tgtggagctcccaagaacttttgga

SEQ ID NO: 908108 - DNA, 25 bp, Mus musculus
tgtggagctccctagaacttttgga

SEQ ID NO: 908109 - DNA, 25 bp, Mus musculus
tgtggagctgctaacaggcttctgc

SEQ ID NO: 908110 - DNA, 25 bp, Mus musculus
tgtggagctgcttacaggcttctgc

SEQ ID NO: 908111 - DNA, 25 bp, Mus musculus
tgtggagcttcacgcctagcactgt

SEQ ID NO: 908112 - DNA, 25 bp, Mus musculus
tgtggagcttcaggcctagcactgt

SEQ ID NO: 908113 - DNA, 25 bp, Mus musculus
tgtggagcttccatgttcgaaagct

SEQ ID NO: 908114 - DNA, 25 bp, Mus musculus
tgtggagcttccttgttcgaaagct

SEQ ID NO: 908115 - DNA, 25 bp, Mus musculus
tgtggagcttcgagaactgtggaca

SEQ ID NO: 908116 - DNA, 25 bp, Mus musculus
tgtggagcttcgtgaactgtggaca

SEQ ID NO: 908117 - DNA, 25 bp, Mus musculus
tgtggaggacagagatcaaccctgg

SEQ ID NO: 908118 - DNA, 25 bp, Mus musculus
tgtggaggacagtgatcaaccctgg

SEQ ID NO: 908119 - DNA, 25 bp, Mus musculus
tgtggaggacataaaacttttcagt

SEQ ID NO: 908120 - DNA, 25 bp, Mus musculus
tgtggaggacattaaacttttcagt

SEQ ID NO: 908121 - DNA, 25 bp, Mus musculus
tgtggaggcgctagccctatcccat

SEQ ID NO: 908122 - DNA, 25 bp, Mus musculus
tgtggaggcgcttgccctatcccat

SEQ ID NO: 908123 - DNA, 25 bp, Mus musculus
tgtggaggtccaagtccgtctacta

SEQ ID NO: 908124 - DNA, 25 bp, Mus musculus
tgtggaggtccatgtccgtctacta

SEQ ID NO: 908125 - DNA, 25 bp, Mus musculus
tgtggaggtccgagcatgtgaatca

SEQ ID NO: 908126 - DNA, 25 bp, Mus musculus
tgtggaggtccgtgcatgtgaatca

SEQ ID NO: 908127 - DNA, 25 bp, Mus musculus
tgtggagtacgtcgcccagaacact

SEQ ID NO: 908128 - DNA, 25 bp, Mus musculus
tgtggagtacgtggcccagaacact

SEQ ID NO: 908129 - DNA, 25 bp, Mus musculus
tgtggagtcaccaagtatcccttca

SEQ ID NO: 908130 - DNA, 25 bp, Mus musculus
tgtggagtcacctagtatcccttca

SEQ ID NO: 908131 - DNA, 25 bp, Mus musculus
tgtggagtcccaccaaaagccgttc

SEQ ID NO: 908132 - DNA, 25 bp, Mus musculus
tgtggagtcccagcaaaagccgttc

SEQ ID NO: 908133 - DNA, 25 bp, Mus musculus
tgtggagtcctgctgcttcaagtgc

SEQ ID NO: 908134 - DNA, 25 bp, Mus musculus
tgtggagtcctggtgcttcaagtgc

SEQ ID NO: 908135 - DNA, 25 bp, Mus musculus
tgtggagtcgtaactggacggacac

SEQ ID NO: 908136 - DNA, 25 bp, Mus musculus
tgtggagtcgtatctggacggacac

SEQ ID NO: 908137 - DNA, 25 bp, Mus musculus
tgtggagtctacagtcctagctctc

SEQ ID NO: 908138 - DNA, 25 bp, Mus musculus
tgtggagtctactgtcctagctctc

SEQ ID NO: 908139 - DNA, 25 bp, Mus musculus
tgtggagtctgactgctgtcaatcc

SEQ ID NO: 908140 - DNA, 25 bp, Mus musculus
tgtggagtctgagtgctgtcaatcc

SEQ ID NO: 908141 - DNA, 25 bp, Mus musculus
tgtggagtcttaaactgtcaaccag

SEQ ID NO: 908142 - DNA, 25 bp, Mus musculus
tgtggagtcttatactgtcaaccag

SEQ ID NO: 908143 - DNA, 25 bp, Mus musculus
tgtggagtgcatcagcccggtcaca

SEQ ID NO: 908144 - DNA, 25 bp, Mus musculus
tgtggagtgcatgagcccggtcaca

SEQ ID NO: 908145 - DNA, 25 bp, Mus musculus
tgtggagtggccaagcacccgtcaa

SEQ ID NO: 908146 - DNA, 25 bp, Mus musculus
tgtggagtggcctagcacccgtcaa

SEQ ID NO: 908147 - DNA, 25 bp, Mus musculus
tgtggagtgtgtccccacacacagg

SEQ ID NO: 908148 - DNA, 25 bp, Mus musculus
tgtggagtgtgtgcccacacacagg

SEQ ID NO: 908149 - DNA, 25 bp, Mus musculus
tgtggagttcggagcgtgcttccct

SEQ ID NO: 908150 - DNA, 25 bp, Mus musculus
tgtggagttcggtgcgtgcttccct

SEQ ID NO: 908151 - DNA, 25 bp, Mus musculus
tgtggagttctgacctactctcacg

SEQ ID NO: 908152 - DNA, 25 bp, Mus musculus
tgtggagttctgtcctactctcacg

SEQ ID NO: 908153 - DNA, 25 bp, Mus musculus
tgtggagtttccattctatccagtc

SEQ ID NO: 908154 - DNA, 25 bp, Mus musculus
tgtggagtttcctttctatccagtc

SEQ ID NO: 908155 - DNA, 25 bp, Mus musculus
tgtggagtttctcttggccaacttc

SEQ ID NO: 908156 - DNA, 25 bp, Mus musculus
tgtggagtttctgttggccaacttc

SEQ ID NO: 908157 - DNA, 25 bp, Mus musculus
tgtggataaacactactggaggtat

SEQ ID NO: 908158 - DNA, 25 bp, Mus musculus
tgtggataaacagtactggaggtat

SEQ ID NO: 908159 - DNA, 25 bp, Mus musculus
tgtggataaagcagtatttctgtca

SEQ ID NO: 908160 - DNA, 25 bp, Mus musculus
tgtggataaagctgtatttctgtca

SEQ ID NO: 908161 - DNA, 25 bp, Mus musculus
tgtggataaatcatgcctgtgggta

SEQ ID NO: 908162 - DNA, 25 bp, Mus musculus
tgtggataaatcttgcctgtgggta

SEQ ID NO: 908163 - DNA, 25 bp, Mus musculus
tgtggataatatccccagcctgttg

SEQ ID NO: 908164 - DNA, 25 bp, Mus musculus
tgtggataatatgcccagcctgttg

SEQ ID NO: 908165 - DNA, 25 bp, Mus musculus
tgtggatacaccaaggcagcaggaa

SEQ ID NO: 908166 - DNA, 25 bp, Mus musculus
tgtggatacacctaggcagcaggaa

SEQ ID NO: 908167 - DNA, 25 bp, Mus musculus
tgtggatacactatagatggctcat

SEQ ID NO: 908168 - DNA, 25 bp, Mus musculus
tgtggatacactttagatggctcat

SEQ ID NO: 908169 - DNA, 25 bp, Mus musculus
tgtggatacagtctgcctcatagtt

SEQ ID NO: 908170 - DNA, 25 bp, Mus musculus
tgtggatacagtgtgcctcatagtt

SEQ ID NO: 908171 - DNA, 25 bp, Mus musculus
tgtggataccaaccacactccaagg

SEQ ID NO: 908172 - DNA, 25 bp, Mus musculus
tgtggataccaagcacactccaagg

SEQ ID NO: 908173 - DNA, 25 bp, Mus musculus
tgtggatactgaccaattctgcatc

SEQ ID NO: 908174 - DNA, 25 bp, Mus musculus
tgtggatactgagcaattctgcatc

SEQ ID NO: 908175 - DNA, 25 bp, Mus musculus
tgtggatcaagaagttgccctctct

SEQ ID NO: 908176 - DNA, 25 bp, Mus musculus
tgtggatcaagatgttgccctctct

SEQ ID NO: 908177 - DNA, 25 bp, Mus musculus
tgtggatcactaaggtcccatgaat

SEQ ID NO: 908178 - DNA, 25 bp, Mus musculus
tgtggatcactatggtcccatgaat

SEQ ID NO: 908179 - DNA, 25 bp, Mus musculus
tgtggatcccagaggttcccgtgag

SEQ ID NO: 908180 - DNA, 25 bp, Mus musculus
tgtggatcccagtggttcccgtgag

SEQ ID NO: 908181 - DNA, 25 bp, Mus musculus
tgtggatcctcgaaattgaacctag

SEQ ID NO: 908182 - DNA, 25 bp, Mus musculus
tgtggatcctcgtaattgaacctag

SEQ ID NO: 908183 - DNA, 25 bp, Mus musculus
tgtggatcctctacccctaattgag

SEQ ID NO: 908184 - DNA, 25 bp, Mus musculus
tgtggatcctcttcccctaattgag

SEQ ID NO: 908185 - DNA, 25 bp, Mus musculus
tgtggatctaaaaccttgtgggttt

SEQ ID NO: 908186 - DNA, 25 bp, Mus musculus
tgtggatctaaatccttgtgggttt

SEQ ID NO: 908187 - DNA, 25 bp, Mus musculus
tgtggatctaccattgctggccttt

SEQ ID NO: 908188 - DNA, 25 bp, Mus musculus
tgtggatctacctttgctggccttt

SEQ ID NO: 908189 - DNA, 25 bp, Mus musculus
tgtggatctcccatcttacgtgacc

SEQ ID NO: 908190 - DNA, 25 bp, Mus musculus
tgtggatctcccttcttacgtgacc

SEQ ID NO: 908191 - DNA, 25 bp, Mus musculus
tgtggatctctcagcactactgatg

SEQ ID NO: 908192 - DNA, 25 bp, Mus musculus
tgtggatctctctgcactactgatg

SEQ ID NO: 908193 - DNA, 25 bp, Mus musculus
tgtggatctgccagcatagacacgc

SEQ ID NO: 908194 - DNA, 25 bp, Mus musculus
tgtggatctgcctgcatagacacgc

SEQ ID NO: 908195 - DNA, 25 bp, Mus musculus
tgtggatctgggacagggtcaccca

SEQ ID NO: 908196 - DNA, 25 bp, Mus musculus
tgtggatctgggtcagggtcaccca

SEQ ID NO: 908197 - DNA, 25 bp, Mus musculus
tgtggatcttacctggaggcagctt

SEQ ID NO: 908198 - DNA, 25 bp, Mus musculus
tgtggatcttacgtggaggcagctt

SEQ ID NO: 908199 - DNA, 25 bp, Mus musculus
tgtggatgaatgagcttgcccaccc

SEQ ID NO: 908200 - DNA, 25 bp, Mus musculus
tgtggatgaatgtgcttgcccaccc

SEQ ID NO: 908201 - DNA, 25 bp, Mus musculus
tgtggatgacagcaaggaatacttc

SEQ ID NO: 908202 - DNA, 25 bp, Mus musculus
tgtggatgacaggaaggaatacttc

SEQ ID NO: 908203 - DNA, 25 bp, Mus musculus
tgtggatgacccctgttccttttgc

SEQ ID NO: 908204 - DNA, 25 bp, Mus musculus
tgtggatgacccgtgttccttttgc

SEQ ID NO: 908205 - DNA, 25 bp, Mus musculus
tgtggatgacgcatacgtgagaaga

SEQ ID NO: 908206 - DNA, 25 bp, Mus musculus
tgtggatgacgcttacgtgagaaga

SEQ ID NO: 908207 - DNA, 25 bp, Mus musculus
tgtggatgccagcttcactgtggtc

SEQ ID NO: 908208 - DNA, 25 bp, Mus musculus
tgtggatgccaggttcactgtggtc

SEQ ID NO: 908209 - DNA, 25 bp, Mus musculus
tgtggatgcgctacctgcccctgct

SEQ ID NO: 908210 - DNA, 25 bp, Mus musculus
tgtggatgcgcttcctgcccctgct

SEQ ID NO: 908211 - DNA, 25 bp, Mus musculus
tgtggatgctgaaaggtttcaccat

SEQ ID NO: 908212 - DNA, 25 bp, Mus musculus
tgtggatgctgataggtttcaccat

SEQ ID NO: 908213 - DNA, 25 bp, Mus musculus
tgtggatgctgccagtttcacctat

SEQ ID NO: 908214 - DNA, 25 bp, Mus musculus
tgtggatgctgcgagtttcacctat

SEQ ID NO: 908215 - DNA, 25 bp, Mus musculus
tgtggatgctgtagacacacatcgt

SEQ ID NO: 908216 - DNA, 25 bp, Mus musculus
tgtggatgctgttgacacacatcgt

SEQ ID NO: 908217 - DNA, 25 bp, Mus musculus
tgtggatgtccactcatccctgcag

SEQ ID NO: 908218 - DNA, 25 bp, Mus musculus
tgtggatgtccagtcatccctgcag

SEQ ID NO: 908219 - DNA, 25 bp, Mus musculus
tgtggatgttcaacaacagtagctt

SEQ ID NO: 908220 - DNA, 25 bp, Mus musculus
tgtggatgttcatcaacagtagctt

SEQ ID NO: 908221 - DNA, 25 bp, Mus musculus
tgtggatgttggcactttagtaagc

SEQ ID NO: 908222 - DNA, 25 bp, Mus musculus
tgtggatgttgggactttagtaagc

SEQ ID NO: 908223 - DNA, 25 bp, Mus musculus
tgtggatgtttaccaacttgttctg

SEQ ID NO: 908224 - DNA, 25 bp, Mus musculus
tgtggatgtttagcaacttgttctg

SEQ ID NO: 908225 - DNA, 25 bp, Mus musculus
tgtggatgtttgagtgcagctcagc

SEQ ID NO: 908226 - DNA, 25 bp, Mus musculus
tgtggatgtttgtgtgcagctcagc

SEQ ID NO: 908227 - DNA, 25 bp, Mus musculus
tgtggattacatcgacctgccttat

SEQ ID NO: 908228 - DNA, 25 bp, Mus musculus
tgtggattacatggacctgccttat

SEQ ID NO: 908229 - DNA, 25 bp, Mus musculus
tgtggattattgctggctgtcaccc

SEQ ID NO: 908230 - DNA, 25 bp, Mus musculus
tgtggattattggtggctgtcaccc

SEQ ID NO: 908231 - DNA, 25 bp, Mus musculus
tgtggattcgctcaaccagaagatg

SEQ ID NO: 908232 - DNA, 25 bp, Mus musculus
tgtggattcgctgaaccagaagatg

SEQ ID NO: 908233 - DNA, 25 bp, Mus musculus
tgtggattctgcacaccccatctca

SEQ ID NO: 908234 - DNA, 25 bp, Mus musculus
tgtggattctgctcaccccatctca

SEQ ID NO: 908235 - DNA, 25 bp, Mus musculus
tgtggattcttcagagaccccttta

SEQ ID NO: 908236 - DNA, 25 bp, Mus musculus
tgtggattcttctgagaccccttta

SEQ ID NO: 908237 - DNA, 25 bp, Mus musculus
tgtggattgcttatctatgtgacgc

SEQ ID NO: 908238 - DNA, 25 bp, Mus musculus
tgtggattgcttttctatgtgacgc

SEQ ID NO: 908239 - DNA, 25 bp, Mus musculus
tgtggatttctgactgtgactgaaa

SEQ ID NO: 908240 - DNA, 25 bp, Mus musculus
tgtggatttctgtctgtgactgaaa

SEQ ID NO: 908241 - DNA, 25 bp, Mus musculus
tgtggatttgcaagcgggacaaccc

SEQ ID NO: 908242 - DNA, 25 bp, Mus musculus
tgtggatttgcatgcgggacaaccc

SEQ ID NO: 908243 - DNA, 25 bp, Mus musculus
tgtggcaaactcacaatctgtctgt

SEQ ID NO: 908244 - DNA, 25 bp, Mus musculus
tgtggcaaactctcaatctgtctgt

SEQ ID NO: 908245 - DNA, 25 bp, Mus musculus
tgtggcaaaggccttgagtcgacca

SEQ ID NO: 908246 - DNA, 25 bp, Mus musculus
tgtggcaaaggcgttgagtcgacca

SEQ ID NO: 908247 - DNA, 25 bp, Mus musculus
tgtggcaaatctattcgtgaaggca

SEQ ID NO: 908248 - DNA, 25 bp, Mus musculus
tgtggcaaatcttttcgtgaaggca

SEQ ID NO: 908249 - DNA, 25 bp, Mus musculus
tgtggcaacaccctatctcaaggaa

SEQ ID NO: 908250 - DNA, 25 bp, Mus musculus
tgtggcaacaccgtatctcaaggaa

SEQ ID NO: 908251 - DNA, 25 bp, Mus musculus
tgtggcaacatcactagactcctcg

SEQ ID NO: 908252 - DNA, 25 bp, Mus musculus
tgtggcaacatctctagactcctcg

SEQ ID NO: 908253 - DNA, 25 bp, Mus musculus
tgtggcaacttgcatcccagtctgc

SEQ ID NO: 908254 - DNA, 25 bp, Mus musculus
tgtggcaacttggatcccagtctgc

SEQ ID NO: 908255 - DNA, 25 bp, Mus musculus
tgtggcaagccgaaacaactgagac

SEQ ID NO: 908256 - DNA, 25 bp, Mus musculus
tgtggcaagccgtaacaactgagac

SEQ ID NO: 908257 - DNA, 25 bp, Mus musculus
tgtggcaaggccattcgccagcggc

SEQ ID NO: 908258 - DNA, 25 bp, Mus musculus
tgtggcaaggcctttcgccagcggc

SEQ ID NO: 908259 - DNA, 25 bp, Mus musculus
tgtggcaaggtcatccgcgatgctt

SEQ ID NO: 908260 - DNA, 25 bp, Mus musculus
tgtggcaaggtcttccgcgatgctt

SEQ ID NO: 908261 - DNA, 25 bp, Mus musculus
tgtggcacaagtatgttttattaaa

SEQ ID NO: 908262 - DNA, 25 bp, Mus musculus
tgtggcacaagtttgttttattaaa

SEQ ID NO: 908263 - DNA, 25 bp, Mus musculus
tgtggcacaatacatcaaccaaccc

SEQ ID NO: 908264 - DNA, 25 bp, Mus musculus
tgtggcacaatagatcaaccaaccc

SEQ ID NO: 908265 - DNA, 25 bp, Mus musculus
tgtggcacacagatgggtgatgtgg

SEQ ID NO: 908266 - DNA, 25 bp, Mus musculus
tgtggcacacagttgggtgatgtgg

SEQ ID NO: 908267 - DNA, 25 bp, Mus musculus
tgtggcacacatcacagactcccag

SEQ ID NO: 908268 - DNA, 25 bp, Mus musculus
tgtggcacacatgacagactcccag

SEQ ID NO: 908269 - DNA, 25 bp, Mus musculus
tgtggcacagaaccgggttctccag

SEQ ID NO: 908270 - DNA, 25 bp, Mus musculus
tgtggcacagaacctgatgtatcct

SEQ ID NO: 908271 - DNA, 25 bp, Mus musculus
tgtggcacagaagcgggttctccag

SEQ ID NO: 908272 - DNA, 25 bp, Mus musculus
tgtggcacagaagctgatgtatcct

SEQ ID NO: 908273 - DNA, 25 bp, Mus musculus
tgtggcacagcacacttgacacctg

SEQ ID NO: 908274 - DNA, 25 bp, Mus musculus
tgtggcacagcagacttgacacctg

SEQ ID NO: 908275 - DNA, 25 bp, Mus musculus
tgtggcacatcgcaagcccttgctg

SEQ ID NO: 908276 - DNA, 25 bp, Mus musculus
tgtggcacatcggaagcccttgctg

SEQ ID NO: 908277 - DNA, 25 bp, Mus musculus
tgtggcacatgcaggtagttcccaa

SEQ ID NO: 908278 - DNA, 25 bp, Mus musculus
tgtggcacatgctggtagttcccaa

SEQ ID NO: 908279 - DNA, 25 bp, Mus musculus
tgtggcacatttagctatacccagc

SEQ ID NO: 908280 - DNA, 25 bp, Mus musculus
tgtggcacattttgctatacccagc

SEQ ID NO: 908281 - DNA, 25 bp, Mus musculus
tgtggcaccatcaggactcagtgga

SEQ ID NO: 908282 - DNA, 25 bp, Mus musculus
tgtggcaccatctggactcagtgga

SEQ ID NO: 908283 - DNA, 25 bp, Mus musculus
tgtggcacccacacgaacaagtaca

SEQ ID NO: 908284 - DNA, 25 bp, Mus musculus
tgtggcacccactcgaacaagtaca

SEQ ID NO: 908285 - DNA, 25 bp, Mus musculus
tgtggcaccctgatgaatgtttaaa

SEQ ID NO: 908286 - DNA, 25 bp, Mus musculus
tgtggcaccctgttgaatgtttaaa

SEQ ID NO: 908287 - DNA, 25 bp, Mus musculus
tgtggcacgaagatggttcctggtt

SEQ ID NO: 908288 - DNA, 25 bp, Mus musculus
tgtggcacgaagttggttcctggtt

SEQ ID NO: 908289 - DNA, 25 bp, Mus musculus
tgtggcactgtgagcttgaccagct

SEQ ID NO: 908290 - DNA, 25 bp, Mus musculus
tgtggcactgtgtgcttgaccagct

SEQ ID NO: 908291 - DNA, 25 bp, Mus musculus
tgtggcactttgacagtaaccgtct

SEQ ID NO: 908292 - DNA, 25 bp, Mus musculus
tgtggcactttgtcagtaaccgtct

SEQ ID NO: 908293 - DNA, 25 bp, Mus musculus
tgtggcagaggcatagtctgtctcc

SEQ ID NO: 908294 - DNA, 25 bp, Mus musculus
tgtggcagaggcttagtctgtctcc

SEQ ID NO: 908295 - DNA, 25 bp, Mus musculus
tgtggcagagtaatcacaacctgga

SEQ ID NO: 908296 - DNA, 25 bp, Mus musculus
tgtggcagagtattcacaacctgga

SEQ ID NO: 908297 - DNA, 25 bp, Mus musculus
tgtggcagcaggacgcagtctcatg

SEQ ID NO: 908298 - DNA, 25 bp, Mus musculus
tgtggcagcaggtcgcagtctcatg

SEQ ID NO: 908299 - DNA, 25 bp, Mus musculus
tgtggcagccatcctggcctgtgca

SEQ ID NO: 908300 - DNA, 25 bp, Mus musculus
tgtggcagccatgctggcctgtgca

SEQ ID NO: 908301 - DNA, 25 bp, Mus musculus
tgtggcagcgagctcaaggatcctc

SEQ ID NO: 908302 - DNA, 25 bp, Mus musculus
tgtggcagcgaggtcaaggatcctc

SEQ ID NO: 908303 - DNA, 25 bp, Mus musculus
tgtggcagctttacggaccctttgg

SEQ ID NO: 908304 - DNA, 25 bp, Mus musculus
tgtggcagcttttcggaccctttgg

SEQ ID NO: 908305 - DNA, 25 bp, Mus musculus
tgtggcaggcacatcacctaagcag

SEQ ID NO: 908306 - DNA, 25 bp, Mus musculus
tgtggcaggcacttcacctaagcag

SEQ ID NO: 908307 - DNA, 25 bp, Mus musculus
tgtggcaggcatcaaactccaaccc

SEQ ID NO: 908308 - DNA, 25 bp, Mus musculus
tgtggcaggcatgaaactccaaccc

SEQ ID NO: 908309 - DNA, 25 bp, Mus musculus
tgtggcaggcttactcagcagccta

SEQ ID NO: 908310 - DNA, 25 bp, Mus musculus
tgtggcaggctttctcagcagccta

SEQ ID NO: 908311 - DNA, 25 bp, Mus musculus
tgtggcagggacagactgctgatac

SEQ ID NO: 908312 - DNA, 25 bp, Mus musculus
tgtggcagggactgactgctgatac

SEQ ID NO: 908313 - DNA, 25 bp, Mus musculus
tgtggcagtcatacattcagttata

SEQ ID NO: 908314 - DNA, 25 bp, Mus musculus
tgtggcagtcattcattcagttata

SEQ ID NO: 908315 - DNA, 25 bp, Mus musculus
tgtggcagtggacctaacccaggca

SEQ ID NO: 908316 - DNA, 25 bp, Mus musculus
tgtggcagtggagctaacccaggca

SEQ ID NO: 908317 - DNA, 25 bp, Mus musculus
tgtggcatagttctggctctgatac

SEQ ID NO: 908318 - DNA, 25 bp, Mus musculus
tgtggcatagttgtggctctgatac

SEQ ID NO: 908319 - DNA, 25 bp, Mus musculus
tgtggcatatatcgtacccattttc

SEQ ID NO: 908320 - DNA, 25 bp, Mus musculus
tgtggcatatatcgtcatgtgacac

SEQ ID NO: 908321 - DNA, 25 bp, Mus musculus
tgtggcatatatggtacccattttc

SEQ ID NO: 908322 - DNA, 25 bp, Mus musculus
tgtggcatatatggtcatgtgacac

SEQ ID NO: 908323 - DNA, 25 bp, Mus musculus
tgtggcatccgcatcaaggctgtct

SEQ ID NO: 908324 - DNA, 25 bp, Mus musculus
tgtggcatccgcttcaaggctgtct

SEQ ID NO: 908325 - DNA, 25 bp, Mus musculus
tgtggcatctgactcgtattgcagt

SEQ ID NO: 908326 - DNA, 25 bp, Mus musculus
tgtggcatctgagtcgtattgcagt

SEQ ID NO: 908327 - DNA, 25 bp, Mus musculus
tgtggcatcttcagagacgtgtgtg

SEQ ID NO: 908328 - DNA, 25 bp, Mus musculus
tgtggcatcttctgagacgtgtgtg

SEQ ID NO: 908329 - DNA, 25 bp, Mus musculus
tgtggcatgatcaaccagccctaag

SEQ ID NO: 908330 - DNA, 25 bp, Mus musculus
tgtggcatgatctaccagccctaag

SEQ ID NO: 908331 - DNA, 25 bp, Mus musculus
tgtggcatgcatacaactaacctgt

SEQ ID NO: 908332 - DNA, 25 bp, Mus musculus
tgtggcatgcattcaactaacctgt

SEQ ID NO: 908333 - DNA, 25 bp, Mus musculus
tgtggcatgcctccataatagtatt

SEQ ID NO: 908334 - DNA, 25 bp, Mus musculus
tgtggcatgcctgcataatagtatt

SEQ ID NO: 908335 - DNA, 25 bp, Mus musculus
tgtggcatgggtcctcattctactc

SEQ ID NO: 908336 - DNA, 25 bp, Mus musculus
tgtggcatgggtgctcattctactc

SEQ ID NO: 908337 - DNA, 25 bp, Mus musculus
tgtggcattcacagaacgcagcgtt

SEQ ID NO: 908338 - DNA, 25 bp, Mus musculus
tgtggcattcactgaacgcagcgtt

SEQ ID NO: 908339 - DNA, 25 bp, Mus musculus
tgtggcattctaacccataaattca

SEQ ID NO: 908340 - DNA, 25 bp, Mus musculus
tgtggcattctatcccataaattca

SEQ ID NO: 908341 - DNA, 25 bp, Mus musculus
tgtggcattggtctacaacgtgttg

SEQ ID NO: 908342 - DNA, 25 bp, Mus musculus
tgtggcattggtgtacaacgtgttg

SEQ ID NO: 908343 - DNA, 25 bp, Mus musculus
tgtggccaagatcctgggcaccaac

SEQ ID NO: 908344 - DNA, 25 bp, Mus musculus
tgtggccaagatgctgggcaccaac

SEQ ID NO: 908345 - DNA, 25 bp, Mus musculus
tgtggccaaggtctccaagtttaca

SEQ ID NO: 908346 - DNA, 25 bp, Mus musculus
tgtggccaaggtgtccaagtttaca

SEQ ID NO: 908347 - DNA, 25 bp, Mus musculus
tgtggccaagttcttagtagctgtt

SEQ ID NO: 908348 - DNA, 25 bp, Mus musculus
tgtggccaagttgttagtagctgtt

SEQ ID NO: 908349 - DNA, 25 bp, Mus musculus
tgtggccacaaaaacttcaaagtac

SEQ ID NO: 908350 - DNA, 25 bp, Mus musculus
tgtggccacaaatacttcaaagtac

SEQ ID NO: 908351 - DNA, 25 bp, Mus musculus
tgtggccacaatcagcctccgaatc

SEQ ID NO: 908352 - DNA, 25 bp, Mus musculus
tgtggccacaatgagcctccgaatc

SEQ ID NO: 908353 - DNA, 25 bp, Mus musculus
tgtggccacacaccctggatatggg

SEQ ID NO: 908354 - DNA, 25 bp, Mus musculus
tgtggccacacagcctggatatggg

SEQ ID NO: 908355 - DNA, 25 bp, Mus musculus
tgtggccacagacattcctgcctaa

SEQ ID NO: 908356 - DNA, 25 bp, Mus musculus
tgtggccacagagattcctgcctaa

SEQ ID NO: 908357 - DNA, 25 bp, Mus musculus
tgtggccaccggacgtgtgaagact

SEQ ID NO: 908358 - DNA, 25 bp, Mus musculus
tgtggccaccggtcgtgtgaagact

SEQ ID NO: 908359 - DNA, 25 bp, Mus musculus
tgtggccacctaactctctggatgc

SEQ ID NO: 908360 - DNA, 25 bp, Mus musculus
tgtggccacctatctctctggatgc

SEQ ID NO: 908361 - DNA, 25 bp, Mus musculus
tgtggccacggaaaccatcacgagt

SEQ ID NO: 908362 - DNA, 25 bp, Mus musculus
tgtggccacggataccatcacgagt

SEQ ID NO: 908363 - DNA, 25 bp, Mus musculus
tgtggccacgggaaacgctgcagaa

SEQ ID NO: 908364 - DNA, 25 bp, Mus musculus
tgtggccacgggtaacgctgcagaa

SEQ ID NO: 908365 - DNA, 25 bp, Mus musculus
tgtggccacgtcatctccagagatg

SEQ ID NO: 908366 - DNA, 25 bp, Mus musculus
tgtggccacgtcttctccagagatg

SEQ ID NO: 908367 - DNA, 25 bp, Mus musculus
tgtggccactccatcaggccatcac

SEQ ID NO: 908368 - DNA, 25 bp, Mus musculus
tgtggccactccttcaggccatcac

SEQ ID NO: 908369 - DNA, 25 bp, Mus musculus
tgtggccactgccttcatcttagaa

SEQ ID NO: 908370 - DNA, 25 bp, Mus musculus
tgtggccactgcgttcatcttagaa

SEQ ID NO: 908371 - DNA, 25 bp, Mus musculus
tgtggccactggagcattgtccatg

SEQ ID NO: 908372 - DNA, 25 bp, Mus musculus
tgtggccactggtgcattgtccatg

SEQ ID NO: 908373 - DNA, 25 bp, Mus musculus
tgtggccacttcagcatggtacact

SEQ ID NO: 908374 - DNA, 25 bp, Mus musculus
tgtggccacttctgcatggtacact

SEQ ID NO: 908375 - DNA, 25 bp, Mus musculus
tgtggccagattacggaggagacct

SEQ ID NO: 908376 - DNA, 25 bp, Mus musculus
tgtggccagatttcggaggagacct

SEQ ID NO: 908377 - DNA, 25 bp, Mus musculus
tgtggccagcacaagctgtggttat

SEQ ID NO: 908378 - DNA, 25 bp, Mus musculus
tgtggccagcactagctgtggttat

SEQ ID NO: 908379 - DNA, 25 bp, Mus musculus
tgtggccagcatcattatctcggta

SEQ ID NO: 908380 - DNA, 25 bp, Mus musculus
tgtggccagcatgattatctcggta

SEQ ID NO: 908381 - DNA, 25 bp, Mus musculus
tgtggccagccgacagacagcagtt

SEQ ID NO: 908382 - DNA, 25 bp, Mus musculus
tgtggccagccgtcagacagcagtt

SEQ ID NO: 908383 - DNA, 25 bp, Mus musculus
tgtggccagcgaccttgggctcact

SEQ ID NO: 908384 - DNA, 25 bp, Mus musculus
tgtggccagcgagcttgggctcact

SEQ ID NO: 908385 - DNA, 25 bp, Mus musculus
tgtggccagctacaatatgggcagc

SEQ ID NO: 908386 - DNA, 25 bp, Mus musculus
tgtggccagctagaatatgggcagc

SEQ ID NO: 908387 - DNA, 25 bp, Mus musculus
tgtggccaggagctgtcaccatgtc

SEQ ID NO: 908388 - DNA, 25 bp, Mus musculus
tgtggccaggaggtgtcaccatgtc

SEQ ID NO: 908389 - DNA, 25 bp, Mus musculus
tgtggccagggcatcagacacagga

SEQ ID NO: 908390 - DNA, 25 bp, Mus musculus
tgtggccagggcttcagacacagga

SEQ ID NO: 908391 - DNA, 25 bp, Mus musculus
tgtggccagtgacccctgttggcaa

SEQ ID NO: 908392 - DNA, 25 bp, Mus musculus
tgtggccagtgagccctgttggcaa

SEQ ID NO: 908393 - DNA, 25 bp, Mus musculus
tgtggccagtggctcatacacctgc

SEQ ID NO: 908394 - DNA, 25 bp, Mus musculus
tgtggccagtgggtcatacacctgc

SEQ ID NO: 908395 - DNA, 25 bp, Mus musculus
tgtggccatcgtcactaaattaacc

SEQ ID NO: 908396 - DNA, 25 bp, Mus musculus
tgtggccatcgtgactaaattaacc

SEQ ID NO: 908397 - DNA, 25 bp, Mus musculus
tgtggccatcttcaaacagaccaaa

SEQ ID NO: 908398 - DNA, 25 bp, Mus musculus
tgtggccatcttgaaacagaccaaa

SEQ ID NO: 908399 - DNA, 25 bp, Mus musculus
tgtggccatggtcacagttgtgctt

SEQ ID NO: 908400 - DNA, 25 bp, Mus musculus
tgtggccatggtgacagttgtgctt

SEQ ID NO: 908401 - DNA, 25 bp, Mus musculus
tgtggccatttgaaaccctttgcgt

SEQ ID NO: 908402 - DNA, 25 bp, Mus musculus
tgtggccatttgtaaccctttgcgt

SEQ ID NO: 908403 - DNA, 25 bp, Mus musculus
tgtggcccaaccatgtcattctttt

SEQ ID NO: 908404 - DNA, 25 bp, Mus musculus
tgtggcccaaccttgtcattctttt

SEQ ID NO: 908405 - DNA, 25 bp, Mus musculus
tgtggcccacagcaaagccagggca

SEQ ID NO: 908406 - DNA, 25 bp, Mus musculus
tgtggcccacaggaaagccagggca

SEQ ID NO: 908407 - DNA, 25 bp, Mus musculus
tgtggcccacttcccgatagaggac

SEQ ID NO: 908408 - DNA, 25 bp, Mus musculus
tgtggcccacttgccgatagaggac

SEQ ID NO: 908409 - DNA, 25 bp, Mus musculus
tgtggcccagctctatattcagtct

SEQ ID NO: 908410 - DNA, 25 bp, Mus musculus
tgtggcccagctgtatattcagtct

SEQ ID NO: 908411 - DNA, 25 bp, Mus musculus
tgtggcccaggcctacatgaaccag

SEQ ID NO: 908412 - DNA, 25 bp, Mus musculus
tgtggcccaggcgtacatgaaccag

SEQ ID NO: 908413 - DNA, 25 bp, Mus musculus
tgtggcccagtgacaattgtgcttg

SEQ ID NO: 908414 - DNA, 25 bp, Mus musculus
tgtggcccagtgtcaattgtgcttg

SEQ ID NO: 908415 - DNA, 25 bp, Mus musculus
tgtggcccatccagtgatctagaag

SEQ ID NO: 908416 - DNA, 25 bp, Mus musculus
tgtggcccatcctgtgatctagaag

SEQ ID NO: 908417 - DNA, 25 bp, Mus musculus
tgtggcccatggacatgaaccccat

SEQ ID NO: 908418 - DNA, 25 bp, Mus musculus
tgtggcccatggtcatgaaccccat

SEQ ID NO: 908419 - DNA, 25 bp, Mus musculus
tgtggcccattcaggtctcaaacat

SEQ ID NO: 908420 - DNA, 25 bp, Mus musculus
tgtggcccattctggtctcaaacat

SEQ ID NO: 908421 - DNA, 25 bp, Mus musculus
tgtggccccagcacagtgggctgct

SEQ ID NO: 908422 - DNA, 25 bp, Mus musculus
tgtggccccagctcagtgggctgct

SEQ ID NO: 908423 - DNA, 25 bp, Mus musculus
tgtggccccaggacacaagaggttc

SEQ ID NO: 908424 - DNA, 25 bp, Mus musculus
tgtggccccaggtcacaagaggttc

SEQ ID NO: 908425 - DNA, 25 bp, Mus musculus
tgtggccccatacgcagtacatctt

SEQ ID NO: 908426 - DNA, 25 bp, Mus musculus
tgtggccccataggcagtacatctt

SEQ ID NO: 908427 - DNA, 25 bp, Mus musculus
tgtggcccctgtctccaaggctgag

SEQ ID NO: 908428 - DNA, 25 bp, Mus musculus
tgtggcccctgtgtccaaggctgag

SEQ ID NO: 908429 - DNA, 25 bp, Mus musculus
tgtggcccctttagcccataaagaa

SEQ ID NO: 908430 - DNA, 25 bp, Mus musculus
tgtggccccttttgcccataaagaa

SEQ ID NO: 908431 - DNA, 25 bp, Mus musculus
tgtggcccgtaacaatttgaggagg

SEQ ID NO: 908432 - DNA, 25 bp, Mus musculus
tgtggcccgtaagaatttgaggagg

SEQ ID NO: 908433 - DNA, 25 bp, Mus musculus
tgtggcccgtttaaattccattcct

SEQ ID NO: 908434 - DNA, 25 bp, Mus musculus
tgtggcccgttttaattccattcct

SEQ ID NO: 908435 - DNA, 25 bp, Mus musculus
tgtggccctctacatggctttcttc

SEQ ID NO: 908436 - DNA, 25 bp, Mus musculus
tgtggccctctagatggctttcttc

SEQ ID NO: 908437 - DNA, 25 bp, Mus musculus
tgtggccctctcaaaccaagggctg

SEQ ID NO: 908438 - DNA, 25 bp, Mus musculus
tgtggccctctctaaccaagggctg

SEQ ID NO: 908439 - DNA, 25 bp, Mus musculus
tgtggccctgagagactatgacctg

SEQ ID NO: 908440 - DNA, 25 bp, Mus musculus
tgtggccctgagtgactatgacctg

SEQ ID NO: 908441 - DNA, 25 bp, Mus musculus
tgtggccctgctaccttgtgtgtga

SEQ ID NO: 908442 - DNA, 25 bp, Mus musculus
tgtggccctgcttccttgtgtgtga

SEQ ID NO: 908443 - DNA, 25 bp, Mus musculus
tgtggcccttcgctcactctttggg

SEQ ID NO: 908444 - DNA, 25 bp, Mus musculus
tgtggcccttcggtcactctttggg

SEQ ID NO: 908445 - DNA, 25 bp, Mus musculus
tgtggcccttgcctgaattctaata

SEQ ID NO: 908446 - DNA, 25 bp, Mus musculus
tgtggcccttgcgtgaattctaata

SEQ ID NO: 908447 - DNA, 25 bp, Mus musculus
tgtggccctttgagtctgaccctgc

SEQ ID NO: 908448 - DNA, 25 bp, Mus musculus
tgtggccctttgtgtctgaccctgc

SEQ ID NO: 908449 - DNA, 25 bp, Mus musculus
tgtggccgacatccctactgctttc

SEQ ID NO: 908450 - DNA, 25 bp, Mus musculus
tgtggccgacatgcctactgctttc

SEQ ID NO: 908451 - DNA, 25 bp, Mus musculus
tgtggccgacccagcacagcgtgga

SEQ ID NO: 908452 - DNA, 25 bp, Mus musculus
tgtggccgaccctgcacagcgtgga

SEQ ID NO: 908453 - DNA, 25 bp, Mus musculus
tgtggccgagctacaagcacgcttg

SEQ ID NO: 908454 - DNA, 25 bp, Mus musculus
tgtggccgagcttcaagcacgcttg

SEQ ID NO: 908455 - DNA, 25 bp, Mus musculus
tgtggccgcagcagagaacatctag

SEQ ID NO: 908456 - DNA, 25 bp, Mus musculus
tgtggccgcagctgagaacatctag

SEQ ID NO: 908457 - DNA, 25 bp, Mus musculus
tgtggccgccaccaaagttaatcag

SEQ ID NO: 908458 - DNA, 25 bp, Mus musculus
tgtggccgccacgaaagttaatcag

SEQ ID NO: 908459 - DNA, 25 bp, Mus musculus
tgtggccggcaacagaaattgctaa

SEQ ID NO: 908460 - DNA, 25 bp, Mus musculus
tgtggccggcaagagaaattgctaa

SEQ ID NO: 908461 - DNA, 25 bp, Mus musculus
tgtggccggccaatactagaataac

SEQ ID NO: 908462 - DNA, 25 bp, Mus musculus
tgtggccggccattactagaataac

SEQ ID NO: 908463 - DNA, 25 bp, Mus musculus
tgtggccggccgagaacaagcaact

SEQ ID NO: 908464 - DNA, 25 bp, Mus musculus
tgtggccggccgtgaacaagcaact

SEQ ID NO: 908465 - DNA, 25 bp, Mus musculus
tgtggccggggtcattctaatagca

SEQ ID NO: 908466 - DNA, 25 bp, Mus musculus
tgtggccggggtgattctaatagca

SEQ ID NO: 908467 - DNA, 25 bp, Mus musculus
tgtggccgggtgcttttcactcttt

SEQ ID NO: 908468 - DNA, 25 bp, Mus musculus
tgtggccgggtggttttcactcttt

SEQ ID NO: 908469 - DNA, 25 bp, Mus musculus
tgtggccggtgtctgtgtcaactct

SEQ ID NO: 908470 - DNA, 25 bp, Mus musculus
tgtggccggtgtgtgtgtcaactct

SEQ ID NO: 908471 - DNA, 25 bp, Mus musculus
tgtggcctaaggacttgtcagcatt

SEQ ID NO: 908472 - DNA, 25 bp, Mus musculus
tgtggcctaaggtcttgtcagcatt

SEQ ID NO: 908473 - DNA, 25 bp, Mus musculus
tgtggcctaccaacagcccgggtag

SEQ ID NO: 908474 - DNA, 25 bp, Mus musculus
tgtggcctaccatcagcccgggtag

SEQ ID NO: 908475 - DNA, 25 bp, Mus musculus
tgtggcctacctcggctgtttagtg

SEQ ID NO: 908476 - DNA, 25 bp, Mus musculus
tgtggcctacctgggctgtttagtg

SEQ ID NO: 908477 - DNA, 25 bp, Mus musculus
tgtggcctagaaaccaaaaccctgg

SEQ ID NO: 908478 - DNA, 25 bp, Mus musculus
tgtggcctagaatccaaaaccctgg

SEQ ID NO: 908479 - DNA, 25 bp, Mus musculus
tgtggcctattgaaaactctgtcat

SEQ ID NO: 908480 - DNA, 25 bp, Mus musculus
tgtggcctattgtaaactctgtcat

SEQ ID NO: 908481 - DNA, 25 bp, Mus musculus
tgtggcctcactaagaccattggta

SEQ ID NO: 908482 - DNA, 25 bp, Mus musculus
tgtggcctcacttagaccattggta

SEQ ID NO: 908483 - DNA, 25 bp, Mus musculus
tgtggcctcctgacttaataaggaa

SEQ ID NO: 908484 - DNA, 25 bp, Mus musculus
tgtggcctcctgtcttaataaggaa

SEQ ID NO: 908485 - DNA, 25 bp, Mus musculus
tgtggcctcggcaagactggctgca

SEQ ID NO: 908486 - DNA, 25 bp, Mus musculus
tgtggcctcggcagagtgtcccagt

SEQ ID NO: 908487 - DNA, 25 bp, Mus musculus
tgtggcctcggctagactggctgca

SEQ ID NO: 908488 - DNA, 25 bp, Mus musculus
tgtggcctcggctgagtgtcccagt

SEQ ID NO: 908489 - DNA, 25 bp, Mus musculus
tgtggcctcttaacctttgtaccat

SEQ ID NO: 908490 - DNA, 25 bp, Mus musculus
tgtggcctcttatcctttgtaccat

SEQ ID NO: 908491 - DNA, 25 bp, Mus musculus
tgtggcctgagtcgccacctggaaa

SEQ ID NO: 908492 - DNA, 25 bp, Mus musculus
tgtggcctgagtggccacctggaaa

SEQ ID NO: 908493 - DNA, 25 bp, Mus musculus
tgtggcctgcgaacccatattggtg

SEQ ID NO: 908494 - DNA, 25 bp, Mus musculus
tgtggcctgcgaccggcgctgggaa

SEQ ID NO: 908495 - DNA, 25 bp, Mus musculus
tgtggcctgcgagcggcgctgggaa

SEQ ID NO: 908496 - DNA, 25 bp, Mus musculus
tgtggcctgcgatcccatattggtg

SEQ ID NO: 908497 - DNA, 25 bp, Mus musculus
tgtggcctggtgagtcccatagttc

SEQ ID NO: 908498 - DNA, 25 bp, Mus musculus
tgtggcctggtgtgtcccatagttc

SEQ ID NO: 908499 - DNA, 25 bp, Mus musculus
tgtggcctgtgcagagctcagagca

SEQ ID NO: 908500 - DNA, 25 bp, Mus musculus
tgtggcctgtgctgagctcagagca

SEQ ID NO: 908501 - DNA, 25 bp, Mus musculus
tgtggccttcctccagcggcccagg

SEQ ID NO: 908502 - DNA, 25 bp, Mus musculus
tgtggccttcctgcagcggcccagg

SEQ ID NO: 908503 - DNA, 25 bp, Mus musculus
tgtggccttcttcaactttgctcag

SEQ ID NO: 908504 - DNA, 25 bp, Mus musculus
tgtggccttcttgaactttgctcag

SEQ ID NO: 908505 - DNA, 25 bp, Mus musculus
tgtggccttgctctgagtttcagtc

SEQ ID NO: 908506 - DNA, 25 bp, Mus musculus
tgtggccttgctgtgagtttcagtc

SEQ ID NO: 908507 - DNA, 25 bp, Mus musculus
tgtggccttgtaaacccacagtggg

SEQ ID NO: 908508 - DNA, 25 bp, Mus musculus
tgtggccttgtatacccacagtggg

SEQ ID NO: 908509 - DNA, 25 bp, Mus musculus
tgtggcctttaccttgctgtggaag

SEQ ID NO: 908510 - DNA, 25 bp, Mus musculus
tgtggcctttacgttgctgtggaag

SEQ ID NO: 908511 - DNA, 25 bp, Mus musculus
tgtggccttttccaataccctggag

SEQ ID NO: 908512 - DNA, 25 bp, Mus musculus
tgtggccttttcgaataccctggag

SEQ ID NO: 908513 - DNA, 25 bp, Mus musculus
tgtggcgacattataacatgcgtgg

SEQ ID NO: 908514 - DNA, 25 bp, Mus musculus
tgtggcgacattttaacatgcgtgg

SEQ ID NO: 908515 - DNA, 25 bp, Mus musculus
tgtggcgatctcagcgtctctggta

SEQ ID NO: 908516 - DNA, 25 bp, Mus musculus
tgtggcgatctctgcgtctctggta

SEQ ID NO: 908517 - DNA, 25 bp, Mus musculus
tgtggcgctacgatcagactggaaa

SEQ ID NO: 908518 - DNA, 25 bp, Mus musculus
tgtggcgctacgttcagactggaaa

SEQ ID NO: 908519 - DNA, 25 bp, Mus musculus
tgtggcgcttgtcacattggaaagt

SEQ ID NO: 908520 - DNA, 25 bp, Mus musculus
tgtggcgcttgtgacattggaaagt

SEQ ID NO: 908521 - DNA, 25 bp, Mus musculus
tgtggcggccgcaaatttaatggga

SEQ ID NO: 908522 - DNA, 25 bp, Mus musculus
tgtggcggccgctaatttaatggga

SEQ ID NO: 908523 - DNA, 25 bp, Mus musculus
tgtggcggcgcgcacctttaagccc

SEQ ID NO: 908524 - DNA, 25 bp, Mus musculus
tgtggcggcgcggacctttaagccc

SEQ ID NO: 908525 - DNA, 25 bp, Mus musculus
tgtggcggctctatctacagctgaa

SEQ ID NO: 908526 - DNA, 25 bp, Mus musculus
tgtggcggctctttctacagctgaa

SEQ ID NO: 908527 - DNA, 25 bp, Mus musculus
tgtggcgtgcagaactacaccaact

SEQ ID NO: 908528 - DNA, 25 bp, Mus musculus
tgtggcgtgcagtactacaccaact

SEQ ID NO: 908529 - DNA, 25 bp, Mus musculus
tgtggcgtggtcaaaagggcttaat

SEQ ID NO: 908530 - DNA, 25 bp, Mus musculus
tgtggcgtggtctaaagggcttaat

SEQ ID NO: 908531 - DNA, 25 bp, Mus musculus
tgtggcgtttgtcctgtctcatctc

SEQ ID NO: 908532 - DNA, 25 bp, Mus musculus
tgtggcgtttgtgctgtctcatctc

SEQ ID NO: 908533 - DNA, 25 bp, Mus musculus
tgtggctaaaatcattacagcttca

SEQ ID NO: 908534 - DNA, 25 bp, Mus musculus
tgtggctaaaatgattacagcttca

SEQ ID NO: 908535 - DNA, 25 bp, Mus musculus
tgtggctaacccaagccagttcaaa

SEQ ID NO: 908536 - DNA, 25 bp, Mus musculus
tgtggctaaccctagccagttcaaa

SEQ ID NO: 908537 - DNA, 25 bp, Mus musculus
tgtggctacagactagtgctgccgc

SEQ ID NO: 908538 - DNA, 25 bp, Mus musculus
tgtggctacagagtagtgctgccgc

SEQ ID NO: 908539 - DNA, 25 bp, Mus musculus
tgtggctacagcagcgccttggctt

SEQ ID NO: 908540 - DNA, 25 bp, Mus musculus
tgtggctacagctgcgccttggctt

SEQ ID NO: 908541 - DNA, 25 bp, Mus musculus
tgtggctacggaccatcttgctaca

SEQ ID NO: 908542 - DNA, 25 bp, Mus musculus
tgtggctacggagcatcttgctaca

SEQ ID NO: 908543 - DNA, 25 bp, Mus musculus
tgtggctactgtactttctgcaacc

SEQ ID NO: 908544 - DNA, 25 bp, Mus musculus
tgtggctactgttctttctgcaacc

SEQ ID NO: 908545 - DNA, 25 bp, Mus musculus
tgtggctacttcctggtcagagtga

SEQ ID NO: 908546 - DNA, 25 bp, Mus musculus
tgtggctacttcgtggtcagagtga

SEQ ID NO: 908547 - DNA, 25 bp, Mus musculus
tgtggctagaagaggaatcattcct

SEQ ID NO: 908548 - DNA, 25 bp, Mus musculus
tgtggctagaagtggaatcattcct

SEQ ID NO: 908549 - DNA, 25 bp, Mus musculus
tgtggctagcctcggtcagtttaca

SEQ ID NO: 908550 - DNA, 25 bp, Mus musculus
tgtggctagcctgggtcagtttaca

SEQ ID NO: 908551 - DNA, 25 bp, Mus musculus
tgtggctagcgacgaagctcttctc

SEQ ID NO: 908552 - DNA, 25 bp, Mus musculus
tgtggctagcgaggaagctcttctc

SEQ ID NO: 908553 - DNA, 25 bp, Mus musculus
tgtggctatcagacacttaggctat

SEQ ID NO: 908554 - DNA, 25 bp, Mus musculus
tgtggctatcagtcacttaggctat

SEQ ID NO: 908555 - DNA, 25 bp, Mus musculus
tgtggctatcctacttttggttatg

SEQ ID NO: 908556 - DNA, 25 bp, Mus musculus
tgtggctatccttcttttggttatg

SEQ ID NO: 908557 - DNA, 25 bp, Mus musculus
tgtggctatgccaaacgtactgtgc

SEQ ID NO: 908558 - DNA, 25 bp, Mus musculus
tgtggctatgcctaacgtactgtgc

SEQ ID NO: 908559 - DNA, 25 bp, Mus musculus
tgtggctattacattctagcgaggg

SEQ ID NO: 908560 - DNA, 25 bp, Mus musculus
tgtggctattactttctagcgaggg

SEQ ID NO: 908561 - DNA, 25 bp, Mus musculus
tgtggctcacctagatgctgtcatc

SEQ ID NO: 908562 - DNA, 25 bp, Mus musculus
tgtggctcaccttgatgctgtcatc

SEQ ID NO: 908563 - DNA, 25 bp, Mus musculus
tgtggctcagaacctgccagtctga

SEQ ID NO: 908564 - DNA, 25 bp, Mus musculus
tgtggctcagaagctgccagtctga

SEQ ID NO: 908565 - DNA, 25 bp, Mus musculus
tgtggctcagccaccacgggacaaa

SEQ ID NO: 908566 - DNA, 25 bp, Mus musculus
tgtggctcagccaggagtgtacccc

SEQ ID NO: 908567 - DNA, 25 bp, Mus musculus
tgtggctcagcctccacgggacaaa

SEQ ID NO: 908568 - DNA, 25 bp, Mus musculus
tgtggctcagcctggagtgtacccc

SEQ ID NO: 908569 - DNA, 25 bp, Mus musculus
tgtggctcagttacgatcagacctc

SEQ ID NO: 908570 - DNA, 25 bp, Mus musculus
tgtggctcagtttcgatcagacctc

SEQ ID NO: 908571 - DNA, 25 bp, Mus musculus
tgtggctccagcacttactgtgcag

SEQ ID NO: 908572 - DNA, 25 bp, Mus musculus
tgtggctccagctcttactgtgcag

SEQ ID NO: 908573 - DNA, 25 bp, Mus musculus
tgtggctcccaaaacctcaggtcat

SEQ ID NO: 908574 - DNA, 25 bp, Mus musculus
tgtggctcccaatacctcaggtcat

SEQ ID NO: 908575 - DNA, 25 bp, Mus musculus
tgtggctccccacttcttgtgatct

SEQ ID NO: 908576 - DNA, 25 bp, Mus musculus
tgtggctccccagttcttgtgatct

SEQ ID NO: 908577 - DNA, 25 bp, Mus musculus
tgtggctccgaaacagtgccagtgt

SEQ ID NO: 908578 - DNA, 25 bp, Mus musculus
tgtggctccgaatcagtgccagtgt

SEQ ID NO: 908579 - DNA, 25 bp, Mus musculus
tgtggctccgtaatagagggctcgc

SEQ ID NO: 908580 - DNA, 25 bp, Mus musculus
tgtggctccgtattagagggctcgc

SEQ ID NO: 908581 - DNA, 25 bp, Mus musculus
tgtggctctagcacagtggtcgaac

SEQ ID NO: 908582 - DNA, 25 bp, Mus musculus
tgtggctctagctcagtggtcgaac

SEQ ID NO: 908583 - DNA, 25 bp, Mus musculus
tgtggctctcaaaaaccagctacca

SEQ ID NO: 908584 - DNA, 25 bp, Mus musculus
tgtggctctcaataaccagctacca

SEQ ID NO: 908585 - DNA, 25 bp, Mus musculus
tgtggctctcatatgcctcctcaga

SEQ ID NO: 908586 - DNA, 25 bp, Mus musculus
tgtggctctcatttgcctcctcaga

SEQ ID NO: 908587 - DNA, 25 bp, Mus musculus
tgtggctctcccactgtggtggctc

SEQ ID NO: 908588 - DNA, 25 bp, Mus musculus
tgtggctctccctctgtggtggctc

SEQ ID NO: 908589 - DNA, 25 bp, Mus musculus
tgtggctctgaccaacctggaagat

SEQ ID NO: 908590 - DNA, 25 bp, Mus musculus
tgtggctctgacgaacctggaagat

SEQ ID NO: 908591 - DNA, 25 bp, Mus musculus
tgtggctctgagaccctgaaactat

SEQ ID NO: 908592 - DNA, 25 bp, Mus musculus
tgtggctctgagtccctgaaactat

SEQ ID NO: 908593 - DNA, 25 bp, Mus musculus
tgtggctctgtgcaagactgtgacc

SEQ ID NO: 908594 - DNA, 25 bp, Mus musculus
tgtggctctgtggaagactgtgacc

SEQ ID NO: 908595 - DNA, 25 bp, Mus musculus
tgtggctcttatcctacctgctgag

SEQ ID NO: 908596 - DNA, 25 bp, Mus musculus
tgtggctcttatgctacctgctgag

SEQ ID NO: 908597 - DNA, 25 bp, Mus musculus
tgtggctgaccactaaatcaaaaca

SEQ ID NO: 908598 - DNA, 25 bp, Mus musculus
tgtggctgaccagtaaatcaaaaca

SEQ ID NO: 908599 - DNA, 25 bp, Mus musculus
tgtggctgacccaagacaactgtaa

SEQ ID NO: 908600 - DNA, 25 bp, Mus musculus
tgtggctgacccatagctgtacctg

SEQ ID NO: 908601 - DNA, 25 bp, Mus musculus
tgtggctgaccctagacaactgtaa

SEQ ID NO: 908602 - DNA, 25 bp, Mus musculus
tgtggctgacccttagctgtacctg

SEQ ID NO: 908603 - DNA, 25 bp, Mus musculus
tgtggctgactcagctgttgatcac

SEQ ID NO: 908604 - DNA, 25 bp, Mus musculus
tgtggctgactccagttgcttttca

SEQ ID NO: 908605 - DNA, 25 bp, Mus musculus
tgtggctgactcgagttgcttttca

SEQ ID NO: 908606 - DNA, 25 bp, Mus musculus
tgtggctgactctgctgttgatcac

SEQ ID NO: 908607 - DNA, 25 bp, Mus musculus
tgtggctgagccagtatgagttgaa

SEQ ID NO: 908608 - DNA, 25 bp, Mus musculus
tgtggctgagcctgtatgagttgaa

SEQ ID NO: 908609 - DNA, 25 bp, Mus musculus
tgtggctgcaggcacttaatttata

SEQ ID NO: 908610 - DNA, 25 bp, Mus musculus
tgtggctgcagggacttaatttata

SEQ ID NO: 908611 - DNA, 25 bp, Mus musculus
tgtggctgcatgcaacttctgtcat

SEQ ID NO: 908612 - DNA, 25 bp, Mus musculus
tgtggctgcatggaacttctgtcat

SEQ ID NO: 908613 - DNA, 25 bp, Mus musculus
tgtggctgccatccaccgcggatgc

SEQ ID NO: 908614 - DNA, 25 bp, Mus musculus
tgtggctgccatgcaccgcggatgc

SEQ ID NO: 908615 - DNA, 25 bp, Mus musculus
tgtggctgcccacgagctggtaaaa

SEQ ID NO: 908616 - DNA, 25 bp, Mus musculus
tgtggctgcccaggagctggtaaaa

SEQ ID NO: 908617 - DNA, 25 bp, Mus musculus
tgtggctgcctaaacacctgctggg

SEQ ID NO: 908618 - DNA, 25 bp, Mus musculus
tgtggctgcctatacacctgctggg

SEQ ID NO: 908619 - DNA, 25 bp, Mus musculus
tgtggctgccttccctgtaactcaa

SEQ ID NO: 908620 - DNA, 25 bp, Mus musculus
tgtggctgccttgcctgtaactcaa

SEQ ID NO: 908621 - DNA, 25 bp, Mus musculus
tgtggctgctacatgcctgctctga

SEQ ID NO: 908622 - DNA, 25 bp, Mus musculus
tgtggctgctacttgcctgctctga

SEQ ID NO: 908623 - DNA, 25 bp, Mus musculus
tgtggctgctccaagcacatgtaac

SEQ ID NO: 908624 - DNA, 25 bp, Mus musculus
tgtggctgctcctagcacatgtaac

SEQ ID NO: 908625 - DNA, 25 bp, Mus musculus
tgtggctgctttcagtttggttttc

SEQ ID NO: 908626 - DNA, 25 bp, Mus musculus
tgtggctgctttgagtttggttttc

SEQ ID NO: 908627 - DNA, 25 bp, Mus musculus
tgtggctggaataggtgaaaccttt

SEQ ID NO: 908628 - DNA, 25 bp, Mus musculus
tgtggctggaatccacatgccttta

SEQ ID NO: 908629 - DNA, 25 bp, Mus musculus
tgtggctggaatgcacatgccttta

SEQ ID NO: 908630 - DNA, 25 bp, Mus musculus
tgtggctggaattggtgaaaccttt

SEQ ID NO: 908631 - DNA, 25 bp, Mus musculus
tgtggctggactctctctgtttctc

SEQ ID NO: 908632 - DNA, 25 bp, Mus musculus
tgtggctggactgtctctgtttctc

SEQ ID NO: 908633 - DNA, 25 bp, Mus musculus
tgtggctggcccagttctcttgact

SEQ ID NO: 908634 - DNA, 25 bp, Mus musculus
tgtggctggccctgttctcttgact

SEQ ID NO: 908635 - DNA, 25 bp, Mus musculus
tgtggctggccgatagcttcaccca

SEQ ID NO: 908636 - DNA, 25 bp, Mus musculus
tgtggctggccgttagcttcaccca

SEQ ID NO: 908637 - DNA, 25 bp, Mus musculus
tgtggctgggctatgcaaactctct

SEQ ID NO: 908638 - DNA, 25 bp, Mus musculus
tgtggctgggctttgcaaactctct

SEQ ID NO: 908639 - DNA, 25 bp, Mus musculus
tgtggctggtcaccctgaccttggt

SEQ ID NO: 908640 - DNA, 25 bp, Mus musculus
tgtggctggtcagcctgaccttggt

SEQ ID NO: 908641 - DNA, 25 bp, Mus musculus
tgtggctggtttccctaaacatttg

SEQ ID NO: 908642 - DNA, 25 bp, Mus musculus
tgtggctggtttgcctaaacatttg

SEQ ID NO: 908643 - DNA, 25 bp, Mus musculus
tgtggctgtataccgatgttgctgt

SEQ ID NO: 908644 - DNA, 25 bp, Mus musculus
tgtggctgtatagcgatgttgctgt

SEQ ID NO: 908645 - DNA, 25 bp, Mus musculus
tgtggctgtcaaagggcagtcccca

SEQ ID NO: 908646 - DNA, 25 bp, Mus musculus
tgtggctgtcaatgggcagtcccca

SEQ ID NO: 908647 - DNA, 25 bp, Mus musculus
tgtggctgtcctctgagcctagcaa

SEQ ID NO: 908648 - DNA, 25 bp, Mus musculus
tgtggctgtcctgtgagcctagcaa

SEQ ID NO: 908649 - DNA, 25 bp, Mus musculus
tgtggctgtcttcatgctcaaaatc

SEQ ID NO: 908650 - DNA, 25 bp, Mus musculus
tgtggctgtcttgatgctcaaaatc

SEQ ID NO: 908651 - DNA, 25 bp, Mus musculus
tgtggctgtgaaagattttcttgtt

SEQ ID NO: 908652 - DNA, 25 bp, Mus musculus
tgtggctgtgaatgattttcttgtt

SEQ ID NO: 908653 - DNA, 25 bp, Mus musculus
tgtggctgtggaccctattaatcac

SEQ ID NO: 908654 - DNA, 25 bp, Mus musculus
tgtggctgtggagcctattaatcac

SEQ ID NO: 908655 - DNA, 25 bp, Mus musculus
tgtggctgtgggaactcacatcttc

SEQ ID NO: 908656 - DNA, 25 bp, Mus musculus
tgtggctgtgggtactcacatcttc

SEQ ID NO: 908657 - DNA, 25 bp, Mus musculus
tgtggctgtggtagtcccctgcaca

SEQ ID NO: 908658 - DNA, 25 bp, Mus musculus
tgtggctgtggttgtcccctgcaca

SEQ ID NO: 908659 - DNA, 25 bp, Mus musculus
tgtggctgttgcactagagacttta

SEQ ID NO: 908660 - DNA, 25 bp, Mus musculus
tgtggctgttgctctagagacttta

SEQ ID NO: 908661 - DNA, 25 bp, Mus musculus
tgtggcttacataggttatctgcat

SEQ ID NO: 908662 - DNA, 25 bp, Mus musculus
tgtggcttacattggttatctgcat

SEQ ID NO: 908663 - DNA, 25 bp, Mus musculus
tgtggcttagagcaactggatgtta

SEQ ID NO: 908664 - DNA, 25 bp, Mus musculus
tgtggcttagaggaactggatgtta

SEQ ID NO: 908665 - DNA, 25 bp, Mus musculus
tgtggcttatttacctgttccctaa

SEQ ID NO: 908666 - DNA, 25 bp, Mus musculus
tgtggcttattttcctgttccctaa

SEQ ID NO: 908667 - DNA, 25 bp, Mus musculus
tgtggcttcaaacaagctattgatt

SEQ ID NO: 908668 - DNA, 25 bp, Mus musculus
tgtggcttcaaagaagctattgatt

SEQ ID NO: 908669 - DNA, 25 bp, Mus musculus
tgtggcttccctaacggctagtgaa

SEQ ID NO: 908670 - DNA, 25 bp, Mus musculus
tgtggcttcccttacggctagtgaa

SEQ ID NO: 908671 - DNA, 25 bp, Mus musculus
tgtggcttcctcctcatatgtggaa

SEQ ID NO: 908672 - DNA, 25 bp, Mus musculus
tgtggcttcctcgtcatatgtggaa

SEQ ID NO: 908673 - DNA, 25 bp, Mus musculus
tgtggcttctgcctagggtcctcgt

SEQ ID NO: 908674 - DNA, 25 bp, Mus musculus
tgtggcttctgcgtagggtcctcgt

SEQ ID NO: 908675 - DNA, 25 bp, Mus musculus
tgtggcttgactcatgggctttcag

SEQ ID NO: 908676 - DNA, 25 bp, Mus musculus
tgtggcttgactgatgggctttcag

SEQ ID NO: 908677 - DNA, 25 bp, Mus musculus
tgtggcttgaggatgctgctatcag

SEQ ID NO: 908678 - DNA, 25 bp, Mus musculus
tgtggcttgaggttgctgctatcag

SEQ ID NO: 908679 - DNA, 25 bp, Mus musculus
tgtggcttgatcctgtcttcccaaa

SEQ ID NO: 908680 - DNA, 25 bp, Mus musculus
tgtggcttgatcgtgtcttcccaaa

SEQ ID NO: 908681 - DNA, 25 bp, Mus musculus
tgtggcttgattccagatgctcttc

SEQ ID NO: 908682 - DNA, 25 bp, Mus musculus
tgtggcttgattgcagatgctcttc

SEQ ID NO: 908683 - DNA, 25 bp, Mus musculus
tgtggcttgcttatcacctctgcag

SEQ ID NO: 908684 - DNA, 25 bp, Mus musculus
tgtggcttgcttttcacctctgcag

SEQ ID NO: 908685 - DNA, 25 bp, Mus musculus
tgtggcttggctatgacctgacaga

SEQ ID NO: 908686 - DNA, 25 bp, Mus musculus
tgtggcttggctttgacctgacaga

SEQ ID NO: 908687 - DNA, 25 bp, Mus musculus
tgtggctttcacactgtatcatgtg

SEQ ID NO: 908688 - DNA, 25 bp, Mus musculus
tgtggctttcactctgtatcatgtg

SEQ ID NO: 908689 - DNA, 25 bp, Mus musculus
tgtggctttctcacccaatatgaag

SEQ ID NO: 908690 - DNA, 25 bp, Mus musculus
tgtggctttctctcccaatatgaag

SEQ ID NO: 908691 - DNA, 25 bp, Mus musculus
tgtggctttgtgaacgtctctctga

SEQ ID NO: 908692 - DNA, 25 bp, Mus musculus
tgtggctttgtgtacgtctctctga

SEQ ID NO: 908693 - DNA, 25 bp, Mus musculus
tgtggcttttgcattgcacctggct

SEQ ID NO: 908694 - DNA, 25 bp, Mus musculus
tgtggcttttgctttgcacctggct

SEQ ID NO: 908695 - DNA, 25 bp, Mus musculus
tgtgggaaactgagtgcacttctct

SEQ ID NO: 908696 - DNA, 25 bp, Mus musculus
tgtgggaaactgtgtgcacttctct

SEQ ID NO: 908697 - DNA, 25 bp, Mus musculus
tgtgggaaagccaacaggcacgact

SEQ ID NO: 908698 - DNA, 25 bp, Mus musculus
tgtgggaaagcctacaggcacgact

SEQ ID NO: 908699 - DNA, 25 bp, Mus musculus
tgtgggaaagcgcttctcaccccag

SEQ ID NO: 908700 - DNA, 25 bp, Mus musculus
tgtgggaaagcggttctcaccccag

SEQ ID NO: 908701 - DNA, 25 bp, Mus musculus
tgtgggaaagtcatccatgcttcct

SEQ ID NO: 908702 - DNA, 25 bp, Mus musculus
tgtgggaaagtcttccatgcttcct

SEQ ID NO: 908703 - DNA, 25 bp, Mus musculus
tgtgggaaagttcatttgctgcagc

SEQ ID NO: 908704 - DNA, 25 bp, Mus musculus
tgtgggaaagttgatttgctgcagc

SEQ ID NO: 908705 - DNA, 25 bp, Mus musculus
tgtgggaaatgcagcttctacctgc

SEQ ID NO: 908706 - DNA, 25 bp, Mus musculus
tgtgggaaatgctgcttctacctgc

SEQ ID NO: 908707 - DNA, 25 bp, Mus musculus
tgtgggaacatcatgggcaactgag

SEQ ID NO: 908708 - DNA, 25 bp, Mus musculus
tgtgggaacatcttgggcaactgag

SEQ ID NO: 908709 - DNA, 25 bp, Mus musculus
tgtgggaacattacacctgctgagt

SEQ ID NO: 908710 - DNA, 25 bp, Mus musculus
tgtgggaacatttcacctgctgagt

SEQ ID NO: 908711 - DNA, 25 bp, Mus musculus
tgtgggaacccactgcctttcgtgc

SEQ ID NO: 908712 - DNA, 25 bp, Mus musculus
tgtgggaacccagtgcctttcgtgc

SEQ ID NO: 908713 - DNA, 25 bp, Mus musculus
tgtgggaactacacctaccgagggc

SEQ ID NO: 908714 - DNA, 25 bp, Mus musculus
tgtgggaactactcctaccgagggc

SEQ ID NO: 908715 - DNA, 25 bp, Mus musculus
tgtgggaactgacaagggcaatata

SEQ ID NO: 908716 - DNA, 25 bp, Mus musculus
tgtgggaactgagaagggcaatata

SEQ ID NO: 908717 - DNA, 25 bp, Mus musculus
tgtgggaagtacacgccactttcca

SEQ ID NO: 908718 - DNA, 25 bp, Mus musculus
tgtgggaagtactcgccactttcca

SEQ ID NO: 908719 - DNA, 25 bp, Mus musculus
tgtgggaagtcaacgcaagcctctc

SEQ ID NO: 908720 - DNA, 25 bp, Mus musculus
tgtgggaagtcatcgcaagcctctc

SEQ ID NO: 908721 - DNA, 25 bp, Mus musculus
tgtgggaagttccagtttctctgat

SEQ ID NO: 908722 - DNA, 25 bp, Mus musculus
tgtgggaagttcgagtttctctgat

SEQ ID NO: 908723 - DNA, 25 bp, Mus musculus
tgtgggaatcccagatccctttttg

SEQ ID NO: 908724 - DNA, 25 bp, Mus musculus
tgtgggaatccctgatccctttttg

SEQ ID NO: 908725 - DNA, 25 bp, Mus musculus
tgtgggaatcgcagtcaccatcctg

SEQ ID NO: 908726 - DNA, 25 bp, Mus musculus
tgtgggaatcgctgtcaccatcctg

SEQ ID NO: 908727 - DNA, 25 bp, Mus musculus
tgtgggaatgtcatctgttttgcat

SEQ ID NO: 908728 - DNA, 25 bp, Mus musculus
tgtgggaatgtcttctgttttgcat

SEQ ID NO: 908729 - DNA, 25 bp, Mus musculus
tgtgggacaccgcgctttcgtcccg

SEQ ID NO: 908730 - DNA, 25 bp, Mus musculus
tgtgggacaccgggctttcgtcccg

SEQ ID NO: 908731 - DNA, 25 bp, Mus musculus
tgtgggacacttctgaccttgacac

SEQ ID NO: 908732 - DNA, 25 bp, Mus musculus
tgtgggacacttgtgaccttgacac

SEQ ID NO: 908733 - DNA, 25 bp, Mus musculus
tgtgggacagaacccatcggctcgt

SEQ ID NO: 908734 - DNA, 25 bp, Mus musculus
tgtgggacagaagccatcggctcgt

SEQ ID NO: 908735 - DNA, 25 bp, Mus musculus
tgtgggaccatgattgacttcttca

SEQ ID NO: 908736 - DNA, 25 bp, Mus musculus
tgtgggaccatgtttgacttcttca

SEQ ID NO: 908737 - DNA, 25 bp, Mus musculus
tgtgggactctcatctgcaagcaca

SEQ ID NO: 908738 - DNA, 25 bp, Mus musculus
tgtgggactctcttctgcaagcaca

SEQ ID NO: 908739 - DNA, 25 bp, Mus musculus
tgtgggagaccccaaacactgtcct

SEQ ID NO: 908740 - DNA, 25 bp, Mus musculus
tgtgggagacccgaaacactgtcct

SEQ ID NO: 908741 - DNA, 25 bp, Mus musculus
tgtgggagcagcaatttcctcccat

SEQ ID NO: 908742 - DNA, 25 bp, Mus musculus
tgtgggagcagctatttcctcccat

SEQ ID NO: 908743 - DNA, 25 bp, Mus musculus
tgtgggagctcgactctcggtgcaa

SEQ ID NO: 908744 - DNA, 25 bp, Mus musculus
tgtgggagctcgtctctcggtgcaa

SEQ ID NO: 908745 - DNA, 25 bp, Mus musculus
tgtgggagcttgcatcaatgctgaa

SEQ ID NO: 908746 - DNA, 25 bp, Mus musculus
tgtgggagcttggatcaatgctgaa

SEQ ID NO: 908747 - DNA, 25 bp, Mus musculus
tgtgggaggcacatacctcatccag

SEQ ID NO: 908748 - DNA, 25 bp, Mus musculus
tgtgggaggcacttacctcatccag

SEQ ID NO: 908749 - DNA, 25 bp, Mus musculus
tgtgggagtggccttccattcttca

SEQ ID NO: 908750 - DNA, 25 bp, Mus musculus
tgtgggagtggcgttccattcttca

SEQ ID NO: 908751 - DNA, 25 bp, Mus musculus
tgtgggatacccatctcggatacat

SEQ ID NO: 908752 - DNA, 25 bp, Mus musculus
tgtgggatacccttctcggatacat

SEQ ID NO: 908753 - DNA, 25 bp, Mus musculus
tgtgggatattcctccctacgatcc

SEQ ID NO: 908754 - DNA, 25 bp, Mus musculus
tgtgggatattcgtccctacgatcc

SEQ ID NO: 908755 - DNA, 25 bp, Mus musculus
tgtgggatcaccagcaacagttact

SEQ ID NO: 908756 - DNA, 25 bp, Mus musculus
tgtgggatcacccagcctggctgaa

SEQ ID NO: 908757 - DNA, 25 bp, Mus musculus
tgtgggatcaccgagcctggctgaa

SEQ ID NO: 908758 - DNA, 25 bp, Mus musculus
tgtgggatcacctgcaacagttact

SEQ ID NO: 908759 - DNA, 25 bp, Mus musculus
tgtgggatccacagtccggcagaaa

SEQ ID NO: 908760 - DNA, 25 bp, Mus musculus
tgtgggatccactgtccggcagaaa

SEQ ID NO: 908761 - DNA, 25 bp, Mus musculus
tgtgggatccatccatttcccagga

SEQ ID NO: 908762 - DNA, 25 bp, Mus musculus
tgtgggatccatgcatttcccagga

SEQ ID NO: 908763 - DNA, 25 bp, Mus musculus
tgtgggatctcacagccagttctgt

SEQ ID NO: 908764 - DNA, 25 bp, Mus musculus
tgtgggatctcagagccagttctgt

SEQ ID NO: 908765 - DNA, 25 bp, Mus musculus
tgtgggatctgaccctactaaatgt

SEQ ID NO: 908766 - DNA, 25 bp, Mus musculus
tgtgggatctgagcctactaaatgt

SEQ ID NO: 908767 - DNA, 25 bp, Mus musculus
tgtgggatcttacggcatgctacta

SEQ ID NO: 908768 - DNA, 25 bp, Mus musculus
tgtgggatcttagggcatgctacta

SEQ ID NO: 908769 - DNA, 25 bp, Mus musculus
tgtgggatcttgaacagcgcaggca

SEQ ID NO: 908770 - DNA, 25 bp, Mus musculus
tgtgggatcttgtacagcgcaggca

SEQ ID NO: 908771 - DNA, 25 bp, Mus musculus
tgtgggatgcagcaccccagcttcc

SEQ ID NO: 908772 - DNA, 25 bp, Mus musculus
tgtgggatgcaggaccccagcttcc

SEQ ID NO: 908773 - DNA, 25 bp, Mus musculus
tgtgggatgctcaagcagttaatta

SEQ ID NO: 908774 - DNA, 25 bp, Mus musculus
tgtgggatgctctagcagttaatta

SEQ ID NO: 908775 - DNA, 25 bp, Mus musculus
tgtgggatgcttccctttttgaaga

SEQ ID NO: 908776 - DNA, 25 bp, Mus musculus
tgtgggatgcttgcctttttgaaga

SEQ ID NO: 908777 - DNA, 25 bp, Mus musculus
tgtgggatgtgacctacttactgct

SEQ ID NO: 908778 - DNA, 25 bp, Mus musculus
tgtgggatgtgagctacttactgct

SEQ ID NO: 908779 - DNA, 25 bp, Mus musculus
tgtgggcaaagcactggcattgtca

SEQ ID NO: 908780 - DNA, 25 bp, Mus musculus
tgtgggcaaagctctggcattgtca

SEQ ID NO: 908781 - DNA, 25 bp, Mus musculus
tgtgggcaacctccacattggagat

SEQ ID NO: 908782 - DNA, 25 bp, Mus musculus
tgtgggcaacctgcacattggagat

SEQ ID NO: 908783 - DNA, 25 bp, Mus musculus
tgtgggcaagggagtgccaagacag

SEQ ID NO: 908784 - DNA, 25 bp, Mus musculus
tgtgggcaagggtgtgccaagacag

SEQ ID NO: 908785 - DNA, 25 bp, Mus musculus
tgtgggcaattgactccaggacttg

SEQ ID NO: 908786 - DNA, 25 bp, Mus musculus
tgtgggcaattgtctccaggacttg

SEQ ID NO: 908787 - DNA, 25 bp, Mus musculus
tgtgggcacagaagtaccttgggct

SEQ ID NO: 908788 - DNA, 25 bp, Mus musculus
tgtgggcacagatgtaccttgggct

SEQ ID NO: 908789 - DNA, 25 bp, Mus musculus
tgtgggcacagtctcatcccactgg

SEQ ID NO: 908790 - DNA, 25 bp, Mus musculus
tgtgggcacagtgtcatcccactgg

SEQ ID NO: 908791 - DNA, 25 bp, Mus musculus
tgtgggcacatgacctggatgttgt

SEQ ID NO: 908792 - DNA, 25 bp, Mus musculus
tgtgggcacatgtcctggatgttgt

SEQ ID NO: 908793 - DNA, 25 bp, Mus musculus
tgtgggcacccacacttacctgctg

SEQ ID NO: 908794 - DNA, 25 bp, Mus musculus
tgtgggcacccagacttacctgctg

SEQ ID NO: 908795 - DNA, 25 bp, Mus musculus
tgtgggcactgcagatggctttcat

SEQ ID NO: 908796 - DNA, 25 bp, Mus musculus
tgtgggcactgctgatggctttcat

SEQ ID NO: 908797 - DNA, 25 bp, Mus musculus
tgtgggcaggccattatccgtggct

SEQ ID NO: 908798 - DNA, 25 bp, Mus musculus
tgtgggcaggcctttatccgtggct

SEQ ID NO: 908799 - DNA, 25 bp, Mus musculus
tgtgggcagggaactttattccttt

SEQ ID NO: 908800 - DNA, 25 bp, Mus musculus
tgtgggcagggatctttattccttt

SEQ ID NO: 908801 - DNA, 25 bp, Mus musculus
tgtgggcagtatatctccaggagga

SEQ ID NO: 908802 - DNA, 25 bp, Mus musculus
tgtgggcagtatttctccaggagga

SEQ ID NO: 908803 - DNA, 25 bp, Mus musculus
tgtgggcataataaccgaacctcat

SEQ ID NO: 908804 - DNA, 25 bp, Mus musculus
tgtgggcataattaccgaacctcat

SEQ ID NO: 908805 - DNA, 25 bp, Mus musculus
tgtgggcatctccaagtattacccc

SEQ ID NO: 908806 - DNA, 25 bp, Mus musculus
tgtgggcatctcgaagtattacccc

SEQ ID NO: 908807 - DNA, 25 bp, Mus musculus
tgtgggcattgcagctcttgcttct

SEQ ID NO: 908808 - DNA, 25 bp, Mus musculus
tgtgggcattgctgctcttgcttct

SEQ ID NO: 908809 - DNA, 25 bp, Mus musculus
tgtgggccaagtacggacacacctt

SEQ ID NO: 908810 - DNA, 25 bp, Mus musculus
tgtgggccaagttcggacacacctt

SEQ ID NO: 908811 - DNA, 25 bp, Mus musculus
tgtgggccacatcgcagccttctga

SEQ ID NO: 908812 - DNA, 25 bp, Mus musculus
tgtgggccacatggcagccttctga

SEQ ID NO: 908813 - DNA, 25 bp, Mus musculus
tgtgggccagagcaacaatgtgtca

SEQ ID NO: 908814 - DNA, 25 bp, Mus musculus
tgtgggccagaggaacaatgtgtca

SEQ ID NO: 908815 - DNA, 25 bp, Mus musculus
tgtgggccagccatggttttaccaa

SEQ ID NO: 908816 - DNA, 25 bp, Mus musculus
tgtgggccagccttggttttaccaa

SEQ ID NO: 908817 - DNA, 25 bp, Mus musculus
tgtgggcccaatcttaggactgctg

SEQ ID NO: 908818 - DNA, 25 bp, Mus musculus
tgtgggcccaatgttaggactgctg

SEQ ID NO: 908819 - DNA, 25 bp, Mus musculus
tgtgggcccagaaaggttagtgtct

SEQ ID NO: 908820 - DNA, 25 bp, Mus musculus
tgtgggcccagataggttagtgtct

SEQ ID NO: 908821 - DNA, 25 bp, Mus musculus
tgtgggccccagagctcagaacccc

SEQ ID NO: 908822 - DNA, 25 bp, Mus musculus
tgtgggccccagtgctcagaacccc

SEQ ID NO: 908823 - DNA, 25 bp, Mus musculus
tgtgggcccgttaggccaatccgga

SEQ ID NO: 908824 - DNA, 25 bp, Mus musculus
tgtgggcccgtttggccaatccgga

SEQ ID NO: 908825 - DNA, 25 bp, Mus musculus
tgtgggccctaaaaagtacgtctga

SEQ ID NO: 908826 - DNA, 25 bp, Mus musculus
tgtgggccctaataagtacgtctga

SEQ ID NO: 908827 - DNA, 25 bp, Mus musculus
tgtgggccgccaagttccagaagca

SEQ ID NO: 908828 - DNA, 25 bp, Mus musculus
tgtgggccgccatgttccagaagca

SEQ ID NO: 908829 - DNA, 25 bp, Mus musculus
tgtgggccgttgacctttcctcaga

SEQ ID NO: 908830 - DNA, 25 bp, Mus musculus
tgtgggccgttgtcctttcctcaga

SEQ ID NO: 908831 - DNA, 25 bp, Mus musculus
tgtgggcctattacctgggtgtgtc

SEQ ID NO: 908832 - DNA, 25 bp, Mus musculus
tgtgggcctatttcctgggtgtgtc

SEQ ID NO: 908833 - DNA, 25 bp, Mus musculus
tgtgggcctcttagctacaagatgg

SEQ ID NO: 908834 - DNA, 25 bp, Mus musculus
tgtgggcctctttgctacaagatgg

SEQ ID NO: 908835 - DNA, 25 bp, Mus musculus
tgtgggcctgccaacggaggatatc

SEQ ID NO: 908836 - DNA, 25 bp, Mus musculus
tgtgggcctgcctacggaggatatc

SEQ ID NO: 908837 - DNA, 25 bp, Mus musculus
tgtgggcctgggacatgatgatcat

SEQ ID NO: 908838 - DNA, 25 bp, Mus musculus
tgtgggcctgggtcatgatgatcat

SEQ ID NO: 908839 - DNA, 25 bp, Mus musculus
tgtgggcctgtcacaaagcagcacg

SEQ ID NO: 908840 - DNA, 25 bp, Mus musculus
tgtgggcctgtctcaaagcagcacg

SEQ ID NO: 908841 - DNA, 25 bp, Mus musculus
tgtgggcctgtgaaccacccgctgt

SEQ ID NO: 908842 - DNA, 25 bp, Mus musculus
tgtgggcctgtgtaccacccgctgt

SEQ ID NO: 908843 - DNA, 25 bp, Mus musculus
tgtgggcgctcaacatcatggtctt

SEQ ID NO: 908844 - DNA, 25 bp, Mus musculus
tgtgggcgctcatcatcatggtctt

SEQ ID NO: 908845 - DNA, 25 bp, Mus musculus
tgtgggcgtctcctacacactcgat

SEQ ID NO: 908846 - DNA, 25 bp, Mus musculus
tgtgggcgtctcgtacacactcgat

SEQ ID NO: 908847 - DNA, 25 bp, Mus musculus
tgtgggcgtgtcacctgataaatac

SEQ ID NO: 908848 - DNA, 25 bp, Mus musculus
tgtgggcgtgtctcctgataaatac

SEQ ID NO: 908849 - DNA, 25 bp, Mus musculus
tgtgggctagctctcctgccgtcct

SEQ ID NO: 908850 - DNA, 25 bp, Mus musculus
tgtgggctagctgtcctgccgtcct

SEQ ID NO: 908851 - DNA, 25 bp, Mus musculus
tgtgggctatagacaggcattaact

SEQ ID NO: 908852 - DNA, 25 bp, Mus musculus
tgtgggctatagtcaggcattaact

SEQ ID NO: 908853 - DNA, 25 bp, Mus musculus
tgtgggctatcaaaacgagcaccat

SEQ ID NO: 908854 - DNA, 25 bp, Mus musculus
tgtgggctatcataacgagcaccat

SEQ ID NO: 908855 - DNA, 25 bp, Mus musculus
tgtgggctcacaacgcaacttaata

SEQ ID NO: 908856 - DNA, 25 bp, Mus musculus
tgtgggctcacatcgcaacttaata

SEQ ID NO: 908857 - DNA, 25 bp, Mus musculus
tgtgggctcctgaacccagtgtcaa

SEQ ID NO: 908858 - DNA, 25 bp, Mus musculus
tgtgggctcctgtacccagtgtcaa

SEQ ID NO: 908859 - DNA, 25 bp, Mus musculus
tgtgggctccttacagggaacctgt

SEQ ID NO: 908860 - DNA, 25 bp, Mus musculus
tgtgggctcctttcagggaacctgt

SEQ ID NO: 908861 - DNA, 25 bp, Mus musculus
tgtgggctcttgactttcctaagca

SEQ ID NO: 908862 - DNA, 25 bp, Mus musculus
tgtgggctcttgtctttcctaagca

SEQ ID NO: 908863 - DNA, 25 bp, Mus musculus
tgtgggctgactcaaactgggtatt

SEQ ID NO: 908864 - DNA, 25 bp, Mus musculus
tgtgggctgactgaaactgggtatt

SEQ ID NO: 908865 - DNA, 25 bp, Mus musculus
tgtgggctgccccaaagggtcattt

SEQ ID NO: 908866 - DNA, 25 bp, Mus musculus
tgtgggctgcccgaaagggtcattt

SEQ ID NO: 908867 - DNA, 25 bp, Mus musculus
tgtgggctgctccatgcactacagt

SEQ ID NO: 908868 - DNA, 25 bp, Mus musculus
tgtgggctgctcgatgcactacagt

SEQ ID NO: 908869 - DNA, 25 bp, Mus musculus
tgtgggctggacacaagaaacaata

SEQ ID NO: 908870 - DNA, 25 bp, Mus musculus
tgtgggctggactcaagaaacaata

SEQ ID NO: 908871 - DNA, 25 bp, Mus musculus
tgtgggctgggaaatgttaaacttt

SEQ ID NO: 908872 - DNA, 25 bp, Mus musculus
tgtgggctgggatatgttaaacttt

SEQ ID NO: 908873 - DNA, 25 bp, Mus musculus
tgtgggctgtgtctcccagtctcag

SEQ ID NO: 908874 - DNA, 25 bp, Mus musculus
tgtgggctgtgtgtcccagtctcag

SEQ ID NO: 908875 - DNA, 25 bp, Mus musculus
tgtgggcttaagaaggtacagtttt

SEQ ID NO: 908876 - DNA, 25 bp, Mus musculus
tgtgggcttaagtaggtacagtttt

SEQ ID NO: 908877 - DNA, 25 bp, Mus musculus
tgtgggcttactcgtttgttgaacc

SEQ ID NO: 908878 - DNA, 25 bp, Mus musculus
tgtgggcttactggtttgttgaacc

SEQ ID NO: 908879 - DNA, 25 bp, Mus musculus
tgtgggcttcacaggaactcaaggg

SEQ ID NO: 908880 - DNA, 25 bp, Mus musculus
tgtgggcttcactggaactcaaggg

SEQ ID NO: 908881 - DNA, 25 bp, Mus musculus
tgtgggcttccaacattatccagag

SEQ ID NO: 908882 - DNA, 25 bp, Mus musculus
tgtgggcttccatcattatccagag

SEQ ID NO: 908883 - DNA, 25 bp, Mus musculus
tgtgggcttctcacttgtcttagct

SEQ ID NO: 908884 - DNA, 25 bp, Mus musculus
tgtgggcttctctcttgtcttagct

SEQ ID NO: 908885 - DNA, 25 bp, Mus musculus
tgtgggcttttccaacaaccatgga

SEQ ID NO: 908886 - DNA, 25 bp, Mus musculus
tgtgggcttttcgaacaaccatgga

SEQ ID NO: 908887 - DNA, 25 bp, Mus musculus
tgtggggagcagacctccagactct

SEQ ID NO: 908888 - DNA, 25 bp, Mus musculus
tgtggggagcagtcctccagactct

SEQ ID NO: 908889 - DNA, 25 bp, Mus musculus
tgtggggcctggctttttcattgtc

SEQ ID NO: 908890 - DNA, 25 bp, Mus musculus
tgtggggcctgggtttttcattgtc

SEQ ID NO: 908891 - DNA, 25 bp, Mus musculus
tgtgggtaaaataagctgcatgctg

SEQ ID NO: 908892 - DNA, 25 bp, Mus musculus
tgtgggtaaaattagctgcatgctg

SEQ ID NO: 908893 - DNA, 25 bp, Mus musculus
tgtgggtaaactacgttcctagtga

SEQ ID NO: 908894 - DNA, 25 bp, Mus musculus
tgtgggtaaacttcgttcctagtga

SEQ ID NO: 908895 - DNA, 25 bp, Mus musculus
tgtgggtaagccactcagtgctgac

SEQ ID NO: 908896 - DNA, 25 bp, Mus musculus
tgtgggtaagcctctcagtgctgac

SEQ ID NO: 908897 - DNA, 25 bp, Mus musculus
tgtgggtaatcaccttatccctcag

SEQ ID NO: 908898 - DNA, 25 bp, Mus musculus
tgtgggtaatcagcttatccctcag

SEQ ID NO: 908899 - DNA, 25 bp, Mus musculus
tgtgggtacatcaagtccctctgac

SEQ ID NO: 908900 - DNA, 25 bp, Mus musculus
tgtgggtacatctagtccctctgac

SEQ ID NO: 908901 - DNA, 25 bp, Mus musculus
tgtgggtaccttctcttctggactg

SEQ ID NO: 908902 - DNA, 25 bp, Mus musculus
tgtgggtaccttgtcttctggactg

SEQ ID NO: 908903 - DNA, 25 bp, Mus musculus
tgtgggtagcaccaagccagtcagt

SEQ ID NO: 908904 - DNA, 25 bp, Mus musculus
tgtgggtagcacgaagccagtcagt

SEQ ID NO: 908905 - DNA, 25 bp, Mus musculus
tgtgggtaggccattgtacttaaat

SEQ ID NO: 908906 - DNA, 25 bp, Mus musculus
tgtgggtaggcctttgtacttaaat

SEQ ID NO: 908907 - DNA, 25 bp, Mus musculus
tgtgggtatgtcatccgctaacaac

SEQ ID NO: 908908 - DNA, 25 bp, Mus musculus
tgtgggtatgtcttccgctaacaac

SEQ ID NO: 908909 - DNA, 25 bp, Mus musculus
tgtgggtatgtgatggagcttattc

SEQ ID NO: 908910 - DNA, 25 bp, Mus musculus
tgtgggtatgtgttggagcttattc

SEQ ID NO: 908911 - DNA, 25 bp, Mus musculus
tgtgggtattagatcctttggagct

SEQ ID NO: 908912 - DNA, 25 bp, Mus musculus
tgtgggtattagttcctttggagct

SEQ ID NO: 908913 - DNA, 25 bp, Mus musculus
tgtgggtcacaaaccctttggaggt

SEQ ID NO: 908914 - DNA, 25 bp, Mus musculus
tgtgggtcacaatccctttggaggt

SEQ ID NO: 908915 - DNA, 25 bp, Mus musculus
tgtgggtcactgcaaactgaagact

SEQ ID NO: 908916 - DNA, 25 bp, Mus musculus
tgtgggtcactggaaactgaagact

SEQ ID NO: 908917 - DNA, 25 bp, Mus musculus
tgtgggtcaggcatgcttgtttagc

SEQ ID NO: 908918 - DNA, 25 bp, Mus musculus
tgtgggtcaggcttgcttgtttagc

SEQ ID NO: 908919 - DNA, 25 bp, Mus musculus
tgtgggtcccaactcccttgagggt

SEQ ID NO: 908920 - DNA, 25 bp, Mus musculus
tgtgggtcccaagtcccttgagggt

SEQ ID NO: 908921 - DNA, 25 bp, Mus musculus
tgtgggtcccacacatttgaatgta

SEQ ID NO: 908922 - DNA, 25 bp, Mus musculus
tgtgggtcccacaggtctaccaggg

SEQ ID NO: 908923 - DNA, 25 bp, Mus musculus
tgtgggtcccactcatttgaatgta

SEQ ID NO: 908924 - DNA, 25 bp, Mus musculus
tgtgggtcccactggtctaccaggg

SEQ ID NO: 908925 - DNA, 25 bp, Mus musculus
tgtgggtccctgaaaaatatcttcg

SEQ ID NO: 908926 - DNA, 25 bp, Mus musculus
tgtgggtccctgtaaaatatcttcg

SEQ ID NO: 908927 - DNA, 25 bp, Mus musculus
tgtgggtccttcacaatggctcttc

SEQ ID NO: 908928 - DNA, 25 bp, Mus musculus
tgtgggtccttcataccaagggagg

SEQ ID NO: 908929 - DNA, 25 bp, Mus musculus
tgtgggtccttctcaatggctcttc

SEQ ID NO: 908930 - DNA, 25 bp, Mus musculus
tgtgggtccttcttaccaagggagg

SEQ ID NO: 908931 - DNA, 25 bp, Mus musculus
tgtgggtcgcagagttcatgtcaaa

SEQ ID NO: 908932 - DNA, 25 bp, Mus musculus
tgtgggtcgcagtgttcatgtcaaa

SEQ ID NO: 908933 - DNA, 25 bp, Mus musculus
tgtgggtctccacaatatgaactgt

SEQ ID NO: 908934 - DNA, 25 bp, Mus musculus
tgtgggtctccagaatatgaactgt

SEQ ID NO: 908935 - DNA, 25 bp, Mus musculus
tgtgggtctcctacaggagcaacac

SEQ ID NO: 908936 - DNA, 25 bp, Mus musculus
tgtgggtctccttcaggagcaacac

SEQ ID NO: 908937 - DNA, 25 bp, Mus musculus
tgtgggtcttctacctcccttcaaa

SEQ ID NO: 908938 - DNA, 25 bp, Mus musculus
tgtgggtcttcttcctcccttcaaa

SEQ ID NO: 908939 - DNA, 25 bp, Mus musculus
tgtgggtgagaacccccgcatcaag

SEQ ID NO: 908940 - DNA, 25 bp, Mus musculus
tgtgggtgagaagccccgcatcaag

SEQ ID NO: 908941 - DNA, 25 bp, Mus musculus
tgtgggtgcagactctgctccttca

SEQ ID NO: 908942 - DNA, 25 bp, Mus musculus
tgtgggtgcagagtctgctccttca

SEQ ID NO: 908943 - DNA, 25 bp, Mus musculus
tgtgggtgccgacctgccttacaga

SEQ ID NO: 908944 - DNA, 25 bp, Mus musculus
tgtgggtgccgagctgccttacaga

SEQ ID NO: 908945 - DNA, 25 bp, Mus musculus
tgtgggtgctaacaaccaaatccag

SEQ ID NO: 908946 - DNA, 25 bp, Mus musculus
tgtgggtgctaagaaccaaatccag

SEQ ID NO: 908947 - DNA, 25 bp, Mus musculus
tgtgggtgggccactcattgacagc

SEQ ID NO: 908948 - DNA, 25 bp, Mus musculus
tgtgggtgggcctctcattgacagc

SEQ ID NO: 908949 - DNA, 25 bp, Mus musculus
tgtgggtggtgtacagacacctcca

SEQ ID NO: 908950 - DNA, 25 bp, Mus musculus
tgtgggtggtgttcagacacctcca

SEQ ID NO: 908951 - DNA, 25 bp, Mus musculus
tgtgggtgtcgtcgcacatgccttt

SEQ ID NO: 908952 - DNA, 25 bp, Mus musculus
tgtgggtgtcgtggcacatgccttt

SEQ ID NO: 908953 - DNA, 25 bp, Mus musculus
tgtgggtgtcttatctattctttct

SEQ ID NO: 908954 - DNA, 25 bp, Mus musculus
tgtgggtgtcttttctattctttct

SEQ ID NO: 908955 - DNA, 25 bp, Mus musculus
tgtgggttacatcgcccctgggcta

SEQ ID NO: 908956 - DNA, 25 bp, Mus musculus
tgtgggttacatggcccctgggcta

SEQ ID NO: 908957 - DNA, 25 bp, Mus musculus
tgtgggttcaacacctctataacac

SEQ ID NO: 908958 - DNA, 25 bp, Mus musculus
tgtgggttcaactcctctataacac

SEQ ID NO: 908959 - DNA, 25 bp, Mus musculus
tgtgggttcatgcatggcatcgtct

SEQ ID NO: 908960 - DNA, 25 bp, Mus musculus
tgtgggttcatggatggcatcgtct

SEQ ID NO: 908961 - DNA, 25 bp, Mus musculus
tgtgggttccttacaatgttgttat

SEQ ID NO: 908962 - DNA, 25 bp, Mus musculus
tgtgggttcctttcaatgttgttat

SEQ ID NO: 908963 - DNA, 25 bp, Mus musculus
tgtgggttgcccctgggcttcttct

SEQ ID NO: 908964 - DNA, 25 bp, Mus musculus
tgtgggttgcccgtgggcttcttct

SEQ ID NO: 908965 - DNA, 25 bp, Mus musculus
tgtgggttggatccagctgttccta

SEQ ID NO: 908966 - DNA, 25 bp, Mus musculus
tgtgggttggatgcagctgttccta

SEQ ID NO: 908967 - DNA, 25 bp, Mus musculus
tgtgggttggttacctgtgcataga

SEQ ID NO: 908968 - DNA, 25 bp, Mus musculus
tgtgggttggtttcctgtgcataga

SEQ ID NO: 908969 - DNA, 25 bp, Mus musculus
tgtgggtttacaactgcttccctgc

SEQ ID NO: 908970 - DNA, 25 bp, Mus musculus
tgtgggtttacatctgcttccctgc

SEQ ID NO: 908971 - DNA, 25 bp, Mus musculus
tgtgggtttgcgacaattcattggt

SEQ ID NO: 908972 - DNA, 25 bp, Mus musculus
tgtgggtttgcgtcaattcattggt

SEQ ID NO: 908973 - DNA, 25 bp, Mus musculus
tgtggtaaaattctttctgttgtaa

SEQ ID NO: 908974 - DNA, 25 bp, Mus musculus
tgtggtaaaattgtttctgttgtaa

SEQ ID NO: 908975 - DNA, 25 bp, Mus musculus
tgtggtaaagatcccgcctgtgtcg

SEQ ID NO: 908976 - DNA, 25 bp, Mus musculus
tgtggtaaagatgccgcctgtgtcg

SEQ ID NO: 908977 - DNA, 25 bp, Mus musculus
tgtggtaaaggacggccgcacccta

SEQ ID NO: 908978 - DNA, 25 bp, Mus musculus
tgtggtaaaggagggccgcacccta

SEQ ID NO: 908979 - DNA, 25 bp, Mus musculus
tgtggtaacagcagggtctcctgga

SEQ ID NO: 908980 - DNA, 25 bp, Mus musculus
tgtggtaacagctgggtctcctgga

SEQ ID NO: 908981 - DNA, 25 bp, Mus musculus
tgtggtaacattaatcagccctcct

SEQ ID NO: 908982 - DNA, 25 bp, Mus musculus
tgtggtaacatttatcagccctcct

SEQ ID NO: 908983 - DNA, 25 bp, Mus musculus
tgtggtaatgaacattttcccctaa

SEQ ID NO: 908984 - DNA, 25 bp, Mus musculus
tgtggtaatgaagattttcccctaa

SEQ ID NO: 908985 - DNA, 25 bp, Mus musculus
tgtggtacacacaaatagcatgaat

SEQ ID NO: 908986 - DNA, 25 bp, Mus musculus
tgtggtacacactaatagcatgaat

SEQ ID NO: 908987 - DNA, 25 bp, Mus musculus
tgtggtacacagctagtcccagtga

SEQ ID NO: 908988 - DNA, 25 bp, Mus musculus
tgtggtacacaggtagtcccagtga

SEQ ID NO: 908989 - DNA, 25 bp, Mus musculus
tgtggtacagaaagccctccaagcc

SEQ ID NO: 908990 - DNA, 25 bp, Mus musculus
tgtggtacagaatgccctccaagcc

SEQ ID NO: 908991 - DNA, 25 bp, Mus musculus
tgtggtacagtaacctttcagtgca

SEQ ID NO: 908992 - DNA, 25 bp, Mus musculus
tgtggtacagtatcctttcagtgca

SEQ ID NO: 908993 - DNA, 25 bp, Mus musculus
tgtggtacagttatgcttgcctata

SEQ ID NO: 908994 - DNA, 25 bp, Mus musculus
tgtggtacagttttgcttgcctata

SEQ ID NO: 908995 - DNA, 25 bp, Mus musculus
tgtggtaccagcatgcaagggccat

SEQ ID NO: 908996 - DNA, 25 bp, Mus musculus
tgtggtaccagcttgcaagggccat

SEQ ID NO: 908997 - DNA, 25 bp, Mus musculus
tgtggtacctaccatgccatcttaa

SEQ ID NO: 908998 - DNA, 25 bp, Mus musculus
tgtggtacctacgatgccatcttaa

SEQ ID NO: 908999 - DNA, 25 bp, Mus musculus
tgtggtacctgtcgcaccgagtgtc

SEQ ID NO: 909000 - DNA, 25 bp, Mus musculus
tgtggtacctgtggcaccgagtgtc

SEQ ID NO: 909001 - DNA, 25 bp, Mus musculus
tgtggtactcagctctctaaagata

SEQ ID NO: 909002 - DNA, 25 bp, Mus musculus
tgtggtactcaggtctctaaagata

SEQ ID NO: 909003 - DNA, 25 bp, Mus musculus
tgtggtactccgcaggctacctgag

SEQ ID NO: 909004 - DNA, 25 bp, Mus musculus
tgtggtactccggaggctacctgag

SEQ ID NO: 909005 - DNA, 25 bp, Mus musculus
tgtggtactgtcagttcccaccatg

SEQ ID NO: 909006 - DNA, 25 bp, Mus musculus
tgtggtactgtctgttcccaccatg

SEQ ID NO: 909007 - DNA, 25 bp, Mus musculus
tgtggtagacggcagcccagatcat

SEQ ID NO: 909008 - DNA, 25 bp, Mus musculus
tgtggtagacgggagcccagatcat

SEQ ID NO: 909009 - DNA, 25 bp, Mus musculus
tgtggtagccacagcccatgagaag

SEQ ID NO: 909010 - DNA, 25 bp, Mus musculus
tgtggtagccactgcccatgagaag

SEQ ID NO: 909011 - DNA, 25 bp, Mus musculus
tgtggtagtaagacatcagacctgg

SEQ ID NO: 909012 - DNA, 25 bp, Mus musculus
tgtggtagtaagtcatcagacctgg

SEQ ID NO: 909013 - DNA, 25 bp, Mus musculus
tgtggtagtaccagcttttgatccc

SEQ ID NO: 909014 - DNA, 25 bp, Mus musculus
tgtggtagtacctgcttttgatccc

SEQ ID NO: 909015 - DNA, 25 bp, Mus musculus
tgtggtataactactctagaggctg

SEQ ID NO: 909016 - DNA, 25 bp, Mus musculus
tgtggtataacttctctagaggctg

SEQ ID NO: 909017 - DNA, 25 bp, Mus musculus
tgtggtatcaatatgctctcttaaa

SEQ ID NO: 909018 - DNA, 25 bp, Mus musculus
tgtggtatcaatttgctctcttaaa

SEQ ID NO: 909019 - DNA, 25 bp, Mus musculus
tgtggtatcaccaggttggctttat

SEQ ID NO: 909020 - DNA, 25 bp, Mus musculus
tgtggtatcacctggttggctttat

SEQ ID NO: 909021 - DNA, 25 bp, Mus musculus
tgtggtatcatcatggaagcagaga

SEQ ID NO: 909022 - DNA, 25 bp, Mus musculus
tgtggtatcatcttggaagcagaga

SEQ ID NO: 909023 - DNA, 25 bp, Mus musculus
tgtggtatccgtctctgcagggcac

SEQ ID NO: 909024 - DNA, 25 bp, Mus musculus
tgtggtatccgtgtctgcagggcac

SEQ ID NO: 909025 - DNA, 25 bp, Mus musculus
tgtggtatcctcagagtggtactgt

SEQ ID NO: 909026 - DNA, 25 bp, Mus musculus
tgtggtatcctctgagtggtactgt

SEQ ID NO: 909027 - DNA, 25 bp, Mus musculus
tgtggtatctgtcctaaaaatagtt

SEQ ID NO: 909028 - DNA, 25 bp, Mus musculus
tgtggtatctgtcgtgacagctcat

SEQ ID NO: 909029 - DNA, 25 bp, Mus musculus
tgtggtatctgtgctaaaaatagtt

SEQ ID NO: 909030 - DNA, 25 bp, Mus musculus
tgtggtatctgtggtgacagctcat

SEQ ID NO: 909031 - DNA, 25 bp, Mus musculus
tgtggtatgcacacatttcgtaggg

SEQ ID NO: 909032 - DNA, 25 bp, Mus musculus
tgtggtatgcactcatttcgtaggg

SEQ ID NO: 909033 - DNA, 25 bp, Mus musculus
tgtggtatgctaactggccctctcc

SEQ ID NO: 909034 - DNA, 25 bp, Mus musculus
tgtggtatgctatctggccctctcc

SEQ ID NO: 909035 - DNA, 25 bp, Mus musculus
tgtggtatttccaatccagccagaa

SEQ ID NO: 909036 - DNA, 25 bp, Mus musculus
tgtggtatttcctatccagccagaa

SEQ ID NO: 909037 - DNA, 25 bp, Mus musculus
tgtggtcaacttcttcgtcacagac

SEQ ID NO: 909038 - DNA, 25 bp, Mus musculus
tgtggtcaacttgttcgtcacagac

SEQ ID NO: 909039 - DNA, 25 bp, Mus musculus
tgtggtcacagactctgcttccata

SEQ ID NO: 909040 - DNA, 25 bp, Mus musculus
tgtggtcacagactttcctgccagg

SEQ ID NO: 909041 - DNA, 25 bp, Mus musculus
tgtggtcacagagtctgcttccata

SEQ ID NO: 909042 - DNA, 25 bp, Mus musculus
tgtggtcacagagtttcctgccagg

SEQ ID NO: 909043 - DNA, 25 bp, Mus musculus
tgtggtcacagtcagtacctgctca

SEQ ID NO: 909044 - DNA, 25 bp, Mus musculus
tgtggtcacagtgagtacctgctca

SEQ ID NO: 909045 - DNA, 25 bp, Mus musculus
tgtggtcacctgactcggttcgaca

SEQ ID NO: 909046 - DNA, 25 bp, Mus musculus
tgtggtcacctgtctcggttcgaca

SEQ ID NO: 909047 - DNA, 25 bp, Mus musculus
tgtggtcacgagagcctgtaattcc

SEQ ID NO: 909048 - DNA, 25 bp, Mus musculus
tgtggtcacgagtgcctgtaattcc

SEQ ID NO: 909049 - DNA, 25 bp, Mus musculus
tgtggtcactccagaagactctgtc

SEQ ID NO: 909050 - DNA, 25 bp, Mus musculus
tgtggtcactcctgaagactctgtc

SEQ ID NO: 909051 - DNA, 25 bp, Mus musculus
tgtggtcagcacctttcccatgggc

SEQ ID NO: 909052 - DNA, 25 bp, Mus musculus
tgtggtcagcacgtttcccatgggc

SEQ ID NO: 909053 - DNA, 25 bp, Mus musculus
tgtggtcagcgcctaattactgcta

SEQ ID NO: 909054 - DNA, 25 bp, Mus musculus
tgtggtcagcgcgtaattactgcta

SEQ ID NO: 909055 - DNA, 25 bp, Mus musculus
tgtggtcagtcacttagctttgcct

SEQ ID NO: 909056 - DNA, 25 bp, Mus musculus
tgtggtcagtcagttagctttgcct

SEQ ID NO: 909057 - DNA, 25 bp, Mus musculus
tgtggtcataccaggcatgtgaccc

SEQ ID NO: 909058 - DNA, 25 bp, Mus musculus
tgtggtcatacctggcatgtgaccc

SEQ ID NO: 909059 - DNA, 25 bp, Mus musculus
tgtggtcatagtcccttttgtctac

SEQ ID NO: 909060 - DNA, 25 bp, Mus musculus
tgtggtcatagtgccttttgtctac

SEQ ID NO: 909061 - DNA, 25 bp, Mus musculus
tgtggtcatcacaggctatttccat

SEQ ID NO: 909062 - DNA, 25 bp, Mus musculus
tgtggtcatcactggctatttccat

SEQ ID NO: 909063 - DNA, 25 bp, Mus musculus
tgtggtcatctgattctttatcttc

SEQ ID NO: 909064 - DNA, 25 bp, Mus musculus
tgtggtcatctgtttctttatcttc

SEQ ID NO: 909065 - DNA, 25 bp, Mus musculus
tgtggtcattggaaactctgtttcg

SEQ ID NO: 909066 - DNA, 25 bp, Mus musculus
tgtggtcattggtaactctgtttcg

SEQ ID NO: 909067 - DNA, 25 bp, Mus musculus
tgtggtccaaccaagggaacgctgt

SEQ ID NO: 909068 - DNA, 25 bp, Mus musculus
tgtggtccaacctagggaacgctgt

SEQ ID NO: 909069 - DNA, 25 bp, Mus musculus
tgtggtccacagatatccatgctgg

SEQ ID NO: 909070 - DNA, 25 bp, Mus musculus
tgtggtccacagttatccatgctgg

SEQ ID NO: 909071 - DNA, 25 bp, Mus musculus
tgtggtccagttagcttttgtcaga

SEQ ID NO: 909072 - DNA, 25 bp, Mus musculus
tgtggtccagtttgcttttgtcaga

SEQ ID NO: 909073 - DNA, 25 bp, Mus musculus
tgtggtcccatacagggacacccac

SEQ ID NO: 909074 - DNA, 25 bp, Mus musculus
tgtggtcccatagagggacacccac

SEQ ID NO: 909075 - DNA, 25 bp, Mus musculus
tgtggtccccagcatatacatggta

SEQ ID NO: 909076 - DNA, 25 bp, Mus musculus
tgtggtccccaggatatacatggta

SEQ ID NO: 909077 - DNA, 25 bp, Mus musculus
tgtggtcccgcacacttgaaaacct

SEQ ID NO: 909078 - DNA, 25 bp, Mus musculus
tgtggtcccgcagacttgaaaacct

SEQ ID NO: 909079 - DNA, 25 bp, Mus musculus
tgtggtcccggaacagcaagcccgt

SEQ ID NO: 909080 - DNA, 25 bp, Mus musculus
tgtggtcccggatcagcaagcccgt

SEQ ID NO: 909081 - DNA, 25 bp, Mus musculus
tgtggtccctatatttcttgtcgtt

SEQ ID NO: 909082 - DNA, 25 bp, Mus musculus
tgtggtccctatttttcttgtcgtt

SEQ ID NO: 909083 - DNA, 25 bp, Mus musculus
tgtggtccctgcatagtaggcagca

SEQ ID NO: 909084 - DNA, 25 bp, Mus musculus
tgtggtccctgcttagtaggcagca

SEQ ID NO: 909085 - DNA, 25 bp, Mus musculus
tgtggtccctgtctgaaccacagca

SEQ ID NO: 909086 - DNA, 25 bp, Mus musculus
tgtggtccctgtgtgaaccacagca

SEQ ID NO: 909087 - DNA, 25 bp, Mus musculus
tgtggtccgactacttttatctaaa

SEQ ID NO: 909088 - DNA, 25 bp, Mus musculus
tgtggtccgacttcttttatctaaa

SEQ ID NO: 909089 - DNA, 25 bp, Mus musculus
tgtggtccgttccatcattggctct

SEQ ID NO: 909090 - DNA, 25 bp, Mus musculus
tgtggtccgttcgatcattggctct

SEQ ID NO: 909091 - DNA, 25 bp, Mus musculus
tgtggtcctaatcttttttctgttc

SEQ ID NO: 909092 - DNA, 25 bp, Mus musculus
tgtggtcctaatgttttttctgttc

SEQ ID NO: 909093 - DNA, 25 bp, Mus musculus
tgtggtcctcgccttttttaaatgg

SEQ ID NO: 909094 - DNA, 25 bp, Mus musculus
tgtggtcctcgcgttttttaaatgg

SEQ ID NO: 909095 - DNA, 25 bp, Mus musculus
tgtggtcctgaacggctacagtact

SEQ ID NO: 909096 - DNA, 25 bp, Mus musculus
tgtggtcctgaagggctacagtact

SEQ ID NO: 909097 - DNA, 25 bp, Mus musculus
tgtggtcctgtcagtgggagattat

SEQ ID NO: 909098 - DNA, 25 bp, Mus musculus
tgtggtcctgtctgtgggagattat

SEQ ID NO: 909099 - DNA, 25 bp, Mus musculus
tgtggtccttcacctggaaccagga

SEQ ID NO: 909100 - DNA, 25 bp, Mus musculus
tgtggtccttcagctggaaccagga

SEQ ID NO: 909101 - DNA, 25 bp, Mus musculus
tgtggtcgatccagctgtgactctc

SEQ ID NO: 909102 - DNA, 25 bp, Mus musculus
tgtggtcgatcctgctgtgactctc

SEQ ID NO: 909103 - DNA, 25 bp, Mus musculus
tgtggtcggccaattcccaagtatt

SEQ ID NO: 909104 - DNA, 25 bp, Mus musculus
tgtggtcggccatttcccaagtatt

SEQ ID NO: 909105 - DNA, 25 bp, Mus musculus
tgtggtctaaggcttcttttccccg

SEQ ID NO: 909106 - DNA, 25 bp, Mus musculus
tgtggtctaagggttcttttccccg

SEQ ID NO: 909107 - DNA, 25 bp, Mus musculus
tgtggtctacagctacaagtacgtg

SEQ ID NO: 909108 - DNA, 25 bp, Mus musculus
tgtggtctacaggtacaagtacgtg

SEQ ID NO: 909109 - DNA, 25 bp, Mus musculus
tgtggtctcatgatagttaccttat

SEQ ID NO: 909110 - DNA, 25 bp, Mus musculus
tgtggtctcatgttagttaccttat

SEQ ID NO: 909111 - DNA, 25 bp, Mus musculus
tgtggtctccacaaaaatactttct

SEQ ID NO: 909112 - DNA, 25 bp, Mus musculus
tgtggtctccactaaaatactttct

SEQ ID NO: 909113 - DNA, 25 bp, Mus musculus
tgtggtctccagcaactgtttcctt

SEQ ID NO: 909114 - DNA, 25 bp, Mus musculus
tgtggtctccaggaactgtttcctt

SEQ ID NO: 909115 - DNA, 25 bp, Mus musculus
tgtggtctccatcgtagcttcttaa

SEQ ID NO: 909116 - DNA, 25 bp, Mus musculus
tgtggtctccatggtagcttcttaa

SEQ ID NO: 909117 - DNA, 25 bp, Mus musculus
tgtggtctcgagcaatcccggccct

SEQ ID NO: 909118 - DNA, 25 bp, Mus musculus
tgtggtctcgaggaatcccggccct

SEQ ID NO: 909119 - DNA, 25 bp, Mus musculus
tgtggtctctgtccgctttcaggag

SEQ ID NO: 909120 - DNA, 25 bp, Mus musculus
tgtggtctctgtccgttccaggtca

SEQ ID NO: 909121 - DNA, 25 bp, Mus musculus
tgtggtctctgtgcgctttcaggag

SEQ ID NO: 909122 - DNA, 25 bp, Mus musculus
tgtggtctctgtgcgttccaggtca

SEQ ID NO: 909123 - DNA, 25 bp, Mus musculus
tgtggtctgcaaattgcccatcatc

SEQ ID NO: 909124 - DNA, 25 bp, Mus musculus
tgtggtctgcaatttgcccatcatc

SEQ ID NO: 909125 - DNA, 25 bp, Mus musculus
tgtggtctgctgaaacccaatcgtt

SEQ ID NO: 909126 - DNA, 25 bp, Mus musculus
tgtggtctgctgtaacccaatcgtt

SEQ ID NO: 909127 - DNA, 25 bp, Mus musculus
tgtggtctggagaagctacttgcca

SEQ ID NO: 909128 - DNA, 25 bp, Mus musculus
tgtggtctggagtagctacttgcca

SEQ ID NO: 909129 - DNA, 25 bp, Mus musculus
tgtggtctggttacatatcctcatc

SEQ ID NO: 909130 - DNA, 25 bp, Mus musculus
tgtggtctggtttcatatcctcatc

SEQ ID NO: 909131 - DNA, 25 bp, Mus musculus
tgtggtcttcctcgtgatgacagtg

SEQ ID NO: 909132 - DNA, 25 bp, Mus musculus
tgtggtcttcctggtgatgacagtg

SEQ ID NO: 909133 - DNA, 25 bp, Mus musculus
tgtggtcttgttactcaggttgttt

SEQ ID NO: 909134 - DNA, 25 bp, Mus musculus
tgtggtcttgtttctcaggttgttt

SEQ ID NO: 909135 - DNA, 25 bp, Mus musculus
tgtggtctttctcggcacggtcagt

SEQ ID NO: 909136 - DNA, 25 bp, Mus musculus
tgtggtctttctgggcacggtcagt

SEQ ID NO: 909137 - DNA, 25 bp, Mus musculus
tgtggtgaacaccatgcctcacaca

SEQ ID NO: 909138 - DNA, 25 bp, Mus musculus
tgtggtgaacacctcactctccggg

SEQ ID NO: 909139 - DNA, 25 bp, Mus musculus
tgtggtgaacacgatgcctcacaca

SEQ ID NO: 909140 - DNA, 25 bp, Mus musculus
tgtggtgaacacgtcactctccggg

SEQ ID NO: 909141 - DNA, 25 bp, Mus musculus
tgtggtgaatcccaagcatgcccag

SEQ ID NO: 909142 - DNA, 25 bp, Mus musculus
tgtggtgaatccgaagcatgcccag

SEQ ID NO: 909143 - DNA, 25 bp, Mus musculus
tgtggtgaatctattcttgcgtgat

SEQ ID NO: 909144 - DNA, 25 bp, Mus musculus
tgtggtgaatcttttcttgcgtgat

SEQ ID NO: 909145 - DNA, 25 bp, Mus musculus
tgtggtgaatgtagccccttctgga

SEQ ID NO: 909146 - DNA, 25 bp, Mus musculus
tgtggtgaatgttgccccttctgga

SEQ ID NO: 909147 - DNA, 25 bp, Mus musculus
tgtggtgacaccacagtcagcgatg

SEQ ID NO: 909148 - DNA, 25 bp, Mus musculus
tgtggtgacaccctggtcatgactc

SEQ ID NO: 909149 - DNA, 25 bp, Mus musculus
tgtggtgacaccgtggtcatgactc

SEQ ID NO: 909150 - DNA, 25 bp, Mus musculus
tgtggtgacacctcagtcagcgatg

SEQ ID NO: 909151 - DNA, 25 bp, Mus musculus
tgtggtgacagcatcctaacgtgtt

SEQ ID NO: 909152 - DNA, 25 bp, Mus musculus
tgtggtgacagcttcctaacgtgtt

SEQ ID NO: 909153 - DNA, 25 bp, Mus musculus
tgtggtgacatcacgcatataaggt

SEQ ID NO: 909154 - DNA, 25 bp, Mus musculus
tgtggtgacatctcgcatataaggt

SEQ ID NO: 909155 - DNA, 25 bp, Mus musculus
tgtggtgaccgtcttcgtgctgaac

SEQ ID NO: 909156 - DNA, 25 bp, Mus musculus
tgtggtgaccgtgttcgtgctgaac

SEQ ID NO: 909157 - DNA, 25 bp, Mus musculus
tgtggtgactttagcctgtaattcc

SEQ ID NO: 909158 - DNA, 25 bp, Mus musculus
tgtggtgacttttgcctgtaattcc

SEQ ID NO: 909159 - DNA, 25 bp, Mus musculus
tgtggtgagccaaccgtcaagttat

SEQ ID NO: 909160 - DNA, 25 bp, Mus musculus
tgtggtgagccatccgtcaagttat

SEQ ID NO: 909161 - DNA, 25 bp, Mus musculus
tgtggtgagcccaccagtcaaaggt

SEQ ID NO: 909162 - DNA, 25 bp, Mus musculus
tgtggtgagccctccagtcaaaggt

SEQ ID NO: 909163 - DNA, 25 bp, Mus musculus
tgtggtgatatgaacctgatcccaa

SEQ ID NO: 909164 - DNA, 25 bp, Mus musculus
tgtggtgatatgtacctgatcccaa

SEQ ID NO: 909165 - DNA, 25 bp, Mus musculus
tgtggtgatccgaccccaagggaaa

SEQ ID NO: 909166 - DNA, 25 bp, Mus musculus
tgtggtgatccgtccccaagggaaa

SEQ ID NO: 909167 - DNA, 25 bp, Mus musculus
tgtggtgatctcacagagagactag

SEQ ID NO: 909168 - DNA, 25 bp, Mus musculus
tgtggtgatctctcagagagactag

SEQ ID NO: 909169 - DNA, 25 bp, Mus musculus
tgtggtgatggtccttttatgcctt

SEQ ID NO: 909170 - DNA, 25 bp, Mus musculus
tgtggtgatggtgcttttatgcctt

SEQ ID NO: 909171 - DNA, 25 bp, Mus musculus
tgtggtgcacataaccatgagctat

SEQ ID NO: 909172 - DNA, 25 bp, Mus musculus
tgtggtgcacattaccatgagctat

SEQ ID NO: 909173 - DNA, 25 bp, Mus musculus
tgtggtgcagctcgtcctccaatga

SEQ ID NO: 909174 - DNA, 25 bp, Mus musculus
tgtggtgcagctggtcctccaatga

SEQ ID NO: 909175 - DNA, 25 bp, Mus musculus
tgtggtgcatgtcttaggacctgcc

SEQ ID NO: 909176 - DNA, 25 bp, Mus musculus
tgtggtgcatgtgttaggacctgcc

SEQ ID NO: 909177 - DNA, 25 bp, Mus musculus
tgtggtgccatgatactttcggtac

SEQ ID NO: 909178 - DNA, 25 bp, Mus musculus
tgtggtgccatgttactttcggtac

SEQ ID NO: 909179 - DNA, 25 bp, Mus musculus
tgtggtgcccatccctgtaatgcca

SEQ ID NO: 909180 - DNA, 25 bp, Mus musculus
tgtggtgcccatgcctgtaatgcca

SEQ ID NO: 909181 - DNA, 25 bp, Mus musculus
tgtggtgccgcaagcctagaatcaa

SEQ ID NO: 909182 - DNA, 25 bp, Mus musculus
tgtggtgccgcatgcctagaatcaa

SEQ ID NO: 909183 - DNA, 25 bp, Mus musculus
tgtggtgctgagactcgaacccatg

SEQ ID NO: 909184 - DNA, 25 bp, Mus musculus
tgtggtgctgagtctcgaacccatg

SEQ ID NO: 909185 - DNA, 25 bp, Mus musculus
tgtggtgctgtgcacttgtacttca

SEQ ID NO: 909186 - DNA, 25 bp, Mus musculus
tgtggtgctgtggacttgtacttca

SEQ ID NO: 909187 - DNA, 25 bp, Mus musculus
tgtggtgcttcaattaatttctcat

SEQ ID NO: 909188 - DNA, 25 bp, Mus musculus
tgtggtgcttcatttaatttctcat

SEQ ID NO: 909189 - DNA, 25 bp, Mus musculus
tgtggtggacacatcctggcaggtc

SEQ ID NO: 909190 - DNA, 25 bp, Mus musculus
tgtggtggacacttcctggcaggtc

SEQ ID NO: 909191 - DNA, 25 bp, Mus musculus
tgtggtggactgagcttctcagacc

SEQ ID NO: 909192 - DNA, 25 bp, Mus musculus
tgtggtggactgtgcttctcagacc

SEQ ID NO: 909193 - DNA, 25 bp, Mus musculus
tgtggtggaggcacttattgcccta

SEQ ID NO: 909194 - DNA, 25 bp, Mus musculus
tgtggtggaggcatctgtgaaacca

SEQ ID NO: 909195 - DNA, 25 bp, Mus musculus
tgtggtggaggctcttattgcccta

SEQ ID NO: 909196 - DNA, 25 bp, Mus musculus
tgtggtggaggcttctgtgaaacca

SEQ ID NO: 909197 - DNA, 25 bp, Mus musculus
tgtggtggcacaactgtacgcacgg

SEQ ID NO: 909198 - DNA, 25 bp, Mus musculus
tgtggtggcacatctgtacgcacgg

SEQ ID NO: 909199 - DNA, 25 bp, Mus musculus
tgtggtggcactaggcttcaatccc

SEQ ID NO: 909200 - DNA, 25 bp, Mus musculus
tgtggtggcacttggcttcaatccc

SEQ ID NO: 909201 - DNA, 25 bp, Mus musculus
tgtggtggcatcagactggtattcc

SEQ ID NO: 909202 - DNA, 25 bp, Mus musculus
tgtggtggcatctgactggtattcc

SEQ ID NO: 909203 - DNA, 25 bp, Mus musculus
tgtggtggctcaagtatgctatctg

SEQ ID NO: 909204 - DNA, 25 bp, Mus musculus
tgtggtggctcatgtatgctatctg

SEQ ID NO: 909205 - DNA, 25 bp, Mus musculus
tgtggtggctggagcccacctgtaa

SEQ ID NO: 909206 - DNA, 25 bp, Mus musculus
tgtggtggctggtgcccacctgtaa

SEQ ID NO: 909207 - DNA, 25 bp, Mus musculus
tgtggtgggattctgcttgccacct

SEQ ID NO: 909208 - DNA, 25 bp, Mus musculus
tgtggtgggattgtgcttgccacct

SEQ ID NO: 909209 - DNA, 25 bp, Mus musculus
tgtggtgggcacctgttcgcaatcc

SEQ ID NO: 909210 - DNA, 25 bp, Mus musculus
tgtggtgggcacgtgttcgcaatcc

SEQ ID NO: 909211 - DNA, 25 bp, Mus musculus
tgtggtgggtgtacttcttgactta

SEQ ID NO: 909212 - DNA, 25 bp, Mus musculus
tgtggtgggtgttcttcttgactta

SEQ ID NO: 909213 - DNA, 25 bp, Mus musculus
tgtggtggtcaaatctgctccctac

SEQ ID NO: 909214 - DNA, 25 bp, Mus musculus
tgtggtggtcaattctgctccctac

SEQ ID NO: 909215 - DNA, 25 bp, Mus musculus
tgtggtgtaactagcctcctctgta

SEQ ID NO: 909216 - DNA, 25 bp, Mus musculus
tgtggtgtaacttgcctcctctgta

SEQ ID NO: 909217 - DNA, 25 bp, Mus musculus
tgtggtgtacaacacacacattgtt

SEQ ID NO: 909218 - DNA, 25 bp, Mus musculus
tgtggtgtacaagacacacattgtt

SEQ ID NO: 909219 - DNA, 25 bp, Mus musculus
tgtggtgtactgatacctgccagcc

SEQ ID NO: 909220 - DNA, 25 bp, Mus musculus
tgtggtgtactgttacctgccagcc

SEQ ID NO: 909221 - DNA, 25 bp, Mus musculus
tgtggtgtcacgaggtcatttcagc

SEQ ID NO: 909222 - DNA, 25 bp, Mus musculus
tgtggtgtcacgtggtcatttcagc

SEQ ID NO: 909223 - DNA, 25 bp, Mus musculus
tgtggtgtcactaggagatagcttt

SEQ ID NO: 909224 - DNA, 25 bp, Mus musculus
tgtggtgtcactcttctatggtaca

SEQ ID NO: 909225 - DNA, 25 bp, Mus musculus
tgtggtgtcactgttctatggtaca

SEQ ID NO: 909226 - DNA, 25 bp, Mus musculus
tgtggtgtcacttggagatagcttt

SEQ ID NO: 909227 - DNA, 25 bp, Mus musculus
tgtggtgtccacacgtggcagcctg

SEQ ID NO: 909228 - DNA, 25 bp, Mus musculus
tgtggtgtccactcgtggcagcctg

SEQ ID NO: 909229 - DNA, 25 bp, Mus musculus
tgtggtgtcctaaaggctgcagcat

SEQ ID NO: 909230 - DNA, 25 bp, Mus musculus
tgtggtgtcctataggctgcagcat

SEQ ID NO: 909231 - DNA, 25 bp, Mus musculus
tgtggtgtctgtctcaagctgctgc

SEQ ID NO: 909232 - DNA, 25 bp, Mus musculus
tgtggtgtctgtgtcaagctgctgc

SEQ ID NO: 909233 - DNA, 25 bp, Mus musculus
tgtggtgtgacacctttggtgacaa

SEQ ID NO: 909234 - DNA, 25 bp, Mus musculus
tgtggtgtgacagctttggtgacaa

SEQ ID NO: 909235 - DNA, 25 bp, Mus musculus
tgtggtgtgactaacctgcttgctc

SEQ ID NO: 909236 - DNA, 25 bp, Mus musculus
tgtggtgtgactacaccttagccat

SEQ ID NO: 909237 - DNA, 25 bp, Mus musculus
tgtggtgtgacttacctgcttgctc

SEQ ID NO: 909238 - DNA, 25 bp, Mus musculus
tgtggtgtgacttcaccttagccat

SEQ ID NO: 909239 - DNA, 25 bp, Mus musculus
tgtggtgtgatcacatccagtcccc

SEQ ID NO: 909240 - DNA, 25 bp, Mus musculus
tgtggtgtgatctcatccagtcccc

SEQ ID NO: 909241 - DNA, 25 bp, Mus musculus
tgtggtgtgcaaacatatacccaaa

SEQ ID NO: 909242 - DNA, 25 bp, Mus musculus
tgtggtgtgcaatcatatacccaaa

SEQ ID NO: 909243 - DNA, 25 bp, Mus musculus
tgtggtgtgcatagctttactccgg

SEQ ID NO: 909244 - DNA, 25 bp, Mus musculus
tgtggtgtgcattgctttactccgg

SEQ ID NO: 909245 - DNA, 25 bp, Mus musculus
tgtggtgtgtctattctagtctaac

SEQ ID NO: 909246 - DNA, 25 bp, Mus musculus
tgtggtgtgtcttttctagtctaac

SEQ ID NO: 909247 - DNA, 25 bp, Mus musculus
tgtggtgtgtgcatccatgtaccca

SEQ ID NO: 909248 - DNA, 25 bp, Mus musculus
tgtggtgtgtgcttccatgtaccca

SEQ ID NO: 909249 - DNA, 25 bp, Mus musculus
tgtggtgttcctaagagagctcagt

SEQ ID NO: 909250 - DNA, 25 bp, Mus musculus
tgtggtgttccttagagagctcagt

SEQ ID NO: 909251 - DNA, 25 bp, Mus musculus
tgtggtgttgacaactgcatccggg

SEQ ID NO: 909252 - DNA, 25 bp, Mus musculus
tgtggtgttgactactgcatccggg

SEQ ID NO: 909253 - DNA, 25 bp, Mus musculus
tgtggtgttggtctccctctttcct

SEQ ID NO: 909254 - DNA, 25 bp, Mus musculus
tgtggtgttggtgtccctctttcct

SEQ ID NO: 909255 - DNA, 25 bp, Mus musculus
tgtggtgtttccagtcttgagtaaa

SEQ ID NO: 909256 - DNA, 25 bp, Mus musculus
tgtggtgtttccctaccaacccagc

SEQ ID NO: 909257 - DNA, 25 bp, Mus musculus
tgtggtgtttccgtaccaacccagc

SEQ ID NO: 909258 - DNA, 25 bp, Mus musculus
tgtggtgtttcctgtcttgagtaaa

SEQ ID NO: 909259 - DNA, 25 bp, Mus musculus
tgtggtgttttcatctcacggcaat

SEQ ID NO: 909260 - DNA, 25 bp, Mus musculus
tgtggtgttttcttctcacggcaat

SEQ ID NO: 909261 - DNA, 25 bp, Mus musculus
tgtggttaatatacacaacagtcct

SEQ ID NO: 909262 - DNA, 25 bp, Mus musculus
tgtggttaatattcacaacagtcct

SEQ ID NO: 909263 - DNA, 25 bp, Mus musculus
tgtggttaatgaacttggcttgcca

SEQ ID NO: 909264 - DNA, 25 bp, Mus musculus
tgtggttaatgatcttggcttgcca

SEQ ID NO: 909265 - DNA, 25 bp, Mus musculus
tgtggttaatttctcatcttggtac

SEQ ID NO: 909266 - DNA, 25 bp, Mus musculus
tgtggttaatttgtcatcttggtac

SEQ ID NO: 909267 - DNA, 25 bp, Mus musculus
tgtggttacattcggtaccctcact

SEQ ID NO: 909268 - DNA, 25 bp, Mus musculus
tgtggttacattgggtaccctcact

SEQ ID NO: 909269 - DNA, 25 bp, Mus musculus
tgtggttacccaagctgactctgca

SEQ ID NO: 909270 - DNA, 25 bp, Mus musculus
tgtggttacccatgctgactctgca

SEQ ID NO: 909271 - DNA, 25 bp, Mus musculus
tgtggttaccgactgcccagagaga

SEQ ID NO: 909272 - DNA, 25 bp, Mus musculus
tgtggttaccgagtgcccagagaga

SEQ ID NO: 909273 - DNA, 25 bp, Mus musculus
tgtggttacctcaacatctgtcaat

SEQ ID NO: 909274 - DNA, 25 bp, Mus musculus
tgtggttacctctacatctgtcaat

SEQ ID NO: 909275 - DNA, 25 bp, Mus musculus
tgtggttagaacagctcctgccgaa

SEQ ID NO: 909276 - DNA, 25 bp, Mus musculus
tgtggttagaactgctcctgccgaa

SEQ ID NO: 909277 - DNA, 25 bp, Mus musculus
tgtggttagctaattcttttgtgcc

SEQ ID NO: 909278 - DNA, 25 bp, Mus musculus
tgtggttagctatttcttttgtgcc

SEQ ID NO: 909279 - DNA, 25 bp, Mus musculus
tgtggttagctcacgttctttggta

SEQ ID NO: 909280 - DNA, 25 bp, Mus musculus
tgtggttagctctcgttctttggta

SEQ ID NO: 909281 - DNA, 25 bp, Mus musculus
tgtggttatagtcctcactgttcac

SEQ ID NO: 909282 - DNA, 25 bp, Mus musculus
tgtggttatagtgctcactgttcac

SEQ ID NO: 909283 - DNA, 25 bp, Mus musculus
tgtggttatatgagtttgtgctgat

SEQ ID NO: 909284 - DNA, 25 bp, Mus musculus
tgtggttatatgtgtttgtgctgat

SEQ ID NO: 909285 - DNA, 25 bp, Mus musculus
tgtggttatggaactcagcgccgat

SEQ ID NO: 909286 - DNA, 25 bp, Mus musculus
tgtggttatggatctcagcgccgat

SEQ ID NO: 909287 - DNA, 25 bp, Mus musculus
tgtggttatttcatcctggtgtttt

SEQ ID NO: 909288 - DNA, 25 bp, Mus musculus
tgtggttatttcttcctggtgtttt

SEQ ID NO: 909289 - DNA, 25 bp, Mus musculus
tgtggttcaaggcagatatttttat

SEQ ID NO: 909290 - DNA, 25 bp, Mus musculus
tgtggttcaagggagatatttttat

SEQ ID NO: 909291 - DNA, 25 bp, Mus musculus
tgtggttcacatatgtcttcctgtt

SEQ ID NO: 909292 - DNA, 25 bp, Mus musculus
tgtggttcacatttgtcttcctgtt

SEQ ID NO: 909293 - DNA, 25 bp, Mus musculus
tgtggttcagcccttggcatataca

SEQ ID NO: 909294 - DNA, 25 bp, Mus musculus
tgtggttcagccgttggcatataca

SEQ ID NO: 909295 - DNA, 25 bp, Mus musculus
tgtggttccaaccataaacttattt

SEQ ID NO: 909296 - DNA, 25 bp, Mus musculus
tgtggttccaacgataaacttattt

SEQ ID NO: 909297 - DNA, 25 bp, Mus musculus
tgtggttccaccatgtccagcagtc

SEQ ID NO: 909298 - DNA, 25 bp, Mus musculus
tgtggttccaccttgtccagcagtc

SEQ ID NO: 909299 - DNA, 25 bp, Mus musculus
tgtggttccactcgtttgctgccta

SEQ ID NO: 909300 - DNA, 25 bp, Mus musculus
tgtggttccactggtttgctgccta

SEQ ID NO: 909301 - DNA, 25 bp, Mus musculus
tgtggttccagacgctaacactatc

SEQ ID NO: 909302 - DNA, 25 bp, Mus musculus
tgtggttccagaggctaacactatc

SEQ ID NO: 909303 - DNA, 25 bp, Mus musculus
tgtggttccaggctcgtttacccat

SEQ ID NO: 909304 - DNA, 25 bp, Mus musculus
tgtggttccagggtcgtttacccat

SEQ ID NO: 909305 - DNA, 25 bp, Mus musculus
tgtggttcccatattacccaataac

SEQ ID NO: 909306 - DNA, 25 bp, Mus musculus
tgtggttcccattttacccaataac

SEQ ID NO: 909307 - DNA, 25 bp, Mus musculus
tgtggttcccccagaggaacatcca

SEQ ID NO: 909308 - DNA, 25 bp, Mus musculus
tgtggttccccctgaggaacatcca

SEQ ID NO: 909309 - DNA, 25 bp, Mus musculus
tgtggttcctcaccgatgtaatctt

SEQ ID NO: 909310 - DNA, 25 bp, Mus musculus
tgtggttcctcagcgatgtaatctt

SEQ ID NO: 909311 - DNA, 25 bp, Mus musculus
tgtggttcctgtccatcccgactgg

SEQ ID NO: 909312 - DNA, 25 bp, Mus musculus
tgtggttcctgtgcatcccgactgg

SEQ ID NO: 909313 - DNA, 25 bp, Mus musculus
tgtggttccttcacgacaacagtgg

SEQ ID NO: 909314 - DNA, 25 bp, Mus musculus
tgtggttccttctcgacaacagtgg

SEQ ID NO: 909315 - DNA, 25 bp, Mus musculus
tgtggttccttgctctggccttgaa

SEQ ID NO: 909316 - DNA, 25 bp, Mus musculus
tgtggttccttggtctggccttgaa

SEQ ID NO: 909317 - DNA, 25 bp, Mus musculus
tgtggttctacacaggacagcagat

SEQ ID NO: 909318 - DNA, 25 bp, Mus musculus
tgtggttctacagaggacagcagat

SEQ ID NO: 909319 - DNA, 25 bp, Mus musculus
tgtggttctcttatcaggacttata

SEQ ID NO: 909320 - DNA, 25 bp, Mus musculus
tgtggttctcttttcaggacttata

SEQ ID NO: 909321 - DNA, 25 bp, Mus musculus
tgtggttctgccctttttaattaag

SEQ ID NO: 909322 - DNA, 25 bp, Mus musculus
tgtggttctgccgtttttaattaag

SEQ ID NO: 909323 - DNA, 25 bp, Mus musculus
tgtggttgacacatttccctttcaa

SEQ ID NO: 909324 - DNA, 25 bp, Mus musculus
tgtggttgacacttttccctttcaa

SEQ ID NO: 909325 - DNA, 25 bp, Mus musculus
tgtggttgacatccatcatgcccct

SEQ ID NO: 909326 - DNA, 25 bp, Mus musculus
tgtggttgacatgcatcatgcccct

SEQ ID NO: 909327 - DNA, 25 bp, Mus musculus
tgtggttgagccatttctcctgcgc

SEQ ID NO: 909328 - DNA, 25 bp, Mus musculus
tgtggttgagccttttctcctgcgc

SEQ ID NO: 909329 - DNA, 25 bp, Mus musculus
tgtggttgataactgtgccatctgc

SEQ ID NO: 909330 - DNA, 25 bp, Mus musculus
tgtggttgataagtgtgccatctgc

SEQ ID NO: 909331 - DNA, 25 bp, Mus musculus
tgtggttgcatgagtgtgtccgctc

SEQ ID NO: 909332 - DNA, 25 bp, Mus musculus
tgtggttgcatgtgtgtgtccgctc

SEQ ID NO: 909333 - DNA, 25 bp, Mus musculus
tgtggttgccctccacggatgtgct

SEQ ID NO: 909334 - DNA, 25 bp, Mus musculus
tgtggttgccctgcacggatgtgct

SEQ ID NO: 909335 - DNA, 25 bp, Mus musculus
tgtggttgcctcaatttaactttaa

SEQ ID NO: 909336 - DNA, 25 bp, Mus musculus
tgtggttgcctctatttaactttaa

SEQ ID NO: 909337 - DNA, 25 bp, Mus musculus
tgtggttgcgtgagcacttgtgacc

SEQ ID NO: 909338 - DNA, 25 bp, Mus musculus
tgtggttgcgtgtgcacttgtgacc

SEQ ID NO: 909339 - DNA, 25 bp, Mus musculus
tgtggttgctgaccctggacaaaga

SEQ ID NO: 909340 - DNA, 25 bp, Mus musculus
tgtggttgctgagcctggacaaaga

SEQ ID NO: 909341 - DNA, 25 bp, Mus musculus
tgtggttggcaaacctgagctggcc

SEQ ID NO: 909342 - DNA, 25 bp, Mus musculus
tgtggttggcaatcctgagctggcc

SEQ ID NO: 909343 - DNA, 25 bp, Mus musculus
tgtggttgggctataactttcgaat

SEQ ID NO: 909344 - DNA, 25 bp, Mus musculus
tgtggttgggctttaactttcgaat

SEQ ID NO: 909345 - DNA, 25 bp, Mus musculus
tgtggttgtgtgaatctctagaaaa

SEQ ID NO: 909346 - DNA, 25 bp, Mus musculus
tgtggttgtgtgtatctctagaaaa

SEQ ID NO: 909347 - DNA, 25 bp, Mus musculus
tgtggttgttagcaccagccagctc

SEQ ID NO: 909348 - DNA, 25 bp, Mus musculus
tgtggttgttaggaccagccagctc

SEQ ID NO: 909349 - DNA, 25 bp, Mus musculus
tgtggtttacctatcatcatggctc

SEQ ID NO: 909350 - DNA, 25 bp, Mus musculus
tgtggtttacctttcatcatggctc

SEQ ID NO: 909351 - DNA, 25 bp, Mus musculus
tgtggtttattgctgttgatttctt

SEQ ID NO: 909352 - DNA, 25 bp, Mus musculus
tgtggtttattggtgttgatttctt

SEQ ID NO: 909353 - DNA, 25 bp, Mus musculus
tgtggtttccacctctatggtgtat

SEQ ID NO: 909354 - DNA, 25 bp, Mus musculus
tgtggtttccacgtctatggtgtat

SEQ ID NO: 909355 - DNA, 25 bp, Mus musculus
tgtggtttccagagcttggcaatac

SEQ ID NO: 909356 - DNA, 25 bp, Mus musculus
tgtggtttccagtgcttggcaatac

SEQ ID NO: 909357 - DNA, 25 bp, Mus musculus
tgtggtttcccaaagaccttcataa

SEQ ID NO: 909358 - DNA, 25 bp, Mus musculus
tgtggtttcccacttggttgaccat

SEQ ID NO: 909359 - DNA, 25 bp, Mus musculus
tgtggtttcccagttggttgaccat

SEQ ID NO: 909360 - DNA, 25 bp, Mus musculus
tgtggtttcccatagaccttcataa

SEQ ID NO: 909361 - DNA, 25 bp, Mus musculus
tgtggtttccccaggttctcagagg

SEQ ID NO: 909362 - DNA, 25 bp, Mus musculus
tgtggtttcccctggttctcagagg

SEQ ID NO: 909363 - DNA, 25 bp, Mus musculus
tgtggtttccgtctggtcagccctt

SEQ ID NO: 909364 - DNA, 25 bp, Mus musculus
tgtggtttccgtgtggtcagccctt

SEQ ID NO: 909365 - DNA, 25 bp, Mus musculus
tgtggtttctccaaacgtgtgtgtg

SEQ ID NO: 909366 - DNA, 25 bp, Mus musculus
tgtggtttctcctaacgtgtgtgtg

SEQ ID NO: 909367 - DNA, 25 bp, Mus musculus
tgtggtttcttgattgctggcctgc

SEQ ID NO: 909368 - DNA, 25 bp, Mus musculus
tgtggtttcttgtttgctggcctgc

SEQ ID NO: 909369 - DNA, 25 bp, Mus musculus
tgtggtttgacccagctctgtaaat

SEQ ID NO: 909370 - DNA, 25 bp, Mus musculus
tgtggtttgaccgagctctgtaaat

SEQ ID NO: 909371 - DNA, 25 bp, Mus musculus
tgtggtttggcgcagctgtgatcgc

SEQ ID NO: 909372 - DNA, 25 bp, Mus musculus
tgtggtttggcggagctgtgatcgc

SEQ ID NO: 909373 - DNA, 25 bp, Mus musculus
tgtggtttggtccttcagaggcata

SEQ ID NO: 909374 - DNA, 25 bp, Mus musculus
tgtggtttggtcgttcagaggcata

SEQ ID NO: 909375 - DNA, 25 bp, Mus musculus
tgtggtttggttacagaatggctgt

SEQ ID NO: 909376 - DNA, 25 bp, Mus musculus
tgtggtttggttactgcacagctga

SEQ ID NO: 909377 - DNA, 25 bp, Mus musculus
tgtggtttggtttcagaatggctgt

SEQ ID NO: 909378 - DNA, 25 bp, Mus musculus
tgtggtttggtttctgcacagctga

SEQ ID NO: 909379 - DNA, 25 bp, Mus musculus
tgtggtttgtgccagtccccttata

SEQ ID NO: 909380 - DNA, 25 bp, Mus musculus
tgtggtttgtgcgagtccccttata

SEQ ID NO: 909381 - DNA, 25 bp, Mus musculus
tgtggtttgttcactattatgtcaa

SEQ ID NO: 909382 - DNA, 25 bp, Mus musculus
tgtggtttgttctctattatgtcaa

SEQ ID NO: 909383 - DNA, 25 bp, Mus musculus
tgtggttttacaatccacgggattt

SEQ ID NO: 909384 - DNA, 25 bp, Mus musculus
tgtggttttacattccacgggattt

SEQ ID NO: 909385 - DNA, 25 bp, Mus musculus
tgtggttttcaaaaatcaggactat

SEQ ID NO: 909386 - DNA, 25 bp, Mus musculus
tgtggttttcaataatcaggactat

SEQ ID NO: 909387 - DNA, 25 bp, Mus musculus
tgtggttttcctcgcgaatggcata

SEQ ID NO: 909388 - DNA, 25 bp, Mus musculus
tgtggttttcctggcgaatggcata

SEQ ID NO: 909389 - DNA, 25 bp, Mus musculus
tgtggttttctcctttgcggtaaag

SEQ ID NO: 909390 - DNA, 25 bp, Mus musculus
tgtggttttctcgtttgcggtaaag

SEQ ID NO: 909391 - DNA, 25 bp, Mus musculus
tgtgtaaacccaatttacccactca

SEQ ID NO: 909392 - DNA, 25 bp, Mus musculus
tgtgtaaacccattttacccactca

SEQ ID NO: 909393 - DNA, 25 bp, Mus musculus
tgtgtaaactccatcctagtgcagc

SEQ ID NO: 909394 - DNA, 25 bp, Mus musculus
tgtgtaaactccttcctagtgcagc

SEQ ID NO: 909395 - DNA, 25 bp, Mus musculus
tgtgtaaatatcctctcatccatca

SEQ ID NO: 909396 - DNA, 25 bp, Mus musculus
tgtgtaaatatcgtctcatccatca

SEQ ID NO: 909397 - DNA, 25 bp, Mus musculus
tgtgtaaatgtaaaccctgaagatt

SEQ ID NO: 909398 - DNA, 25 bp, Mus musculus
tgtgtaaatgtataccctgaagatt

SEQ ID NO: 909399 - DNA, 25 bp, Mus musculus
tgtgtaaattacacctaccctgtac

SEQ ID NO: 909400 - DNA, 25 bp, Mus musculus
tgtgtaaattactcctaccctgtac

SEQ ID NO: 909401 - DNA, 25 bp, Mus musculus
tgtgtaacacttcctctgaaatgga

SEQ ID NO: 909402 - DNA, 25 bp, Mus musculus
tgtgtaacacttgctctgaaatgga

SEQ ID NO: 909403 - DNA, 25 bp, Mus musculus
tgtgtaacatgtcaccttccatctt

SEQ ID NO: 909404 - DNA, 25 bp, Mus musculus
tgtgtaacatgtgaccttccatctt

SEQ ID NO: 909405 - DNA, 25 bp, Mus musculus
tgtgtaacattaccataacaccctg

SEQ ID NO: 909406 - DNA, 25 bp, Mus musculus
tgtgtaacattagcataacaccctg

SEQ ID NO: 909407 - DNA, 25 bp, Mus musculus
tgtgtaaccaaaaacacctagtact

SEQ ID NO: 909408 - DNA, 25 bp, Mus musculus
tgtgtaaccaaaccaacctcaatgc

SEQ ID NO: 909409 - DNA, 25 bp, Mus musculus
tgtgtaaccaaagcaacctcaatgc

SEQ ID NO: 909410 - DNA, 25 bp, Mus musculus
tgtgtaaccaaatacacctagtact

SEQ ID NO: 909411 - DNA, 25 bp, Mus musculus
tgtgtaacgctcaggactctcttga

SEQ ID NO: 909412 - DNA, 25 bp, Mus musculus
tgtgtaacgctctggactctcttga

SEQ ID NO: 909413 - DNA, 25 bp, Mus musculus
tgtgtaactcggagggaaagcattt

SEQ ID NO: 909414 - DNA, 25 bp, Mus musculus
tgtgtaactcggtgggaaagcattt

SEQ ID NO: 909415 - DNA, 25 bp, Mus musculus
tgtgtaactgcacataacttgatca

SEQ ID NO: 909416 - DNA, 25 bp, Mus musculus
tgtgtaactgcagataacttgatca

SEQ ID NO: 909417 - DNA, 25 bp, Mus musculus
tgtgtaactgttagcctttcctgac

SEQ ID NO: 909418 - DNA, 25 bp, Mus musculus
tgtgtaactgtttgcctttcctgac

SEQ ID NO: 909419 - DNA, 25 bp, Mus musculus
tgtgtaacttttctggctttgggac

SEQ ID NO: 909420 - DNA, 25 bp, Mus musculus
tgtgtaacttttgtggctttgggac

SEQ ID NO: 909421 - DNA, 25 bp, Mus musculus
tgtgtaagacttaatggttccattg

SEQ ID NO: 909422 - DNA, 25 bp, Mus musculus
tgtgtaagactttatggttccattg

SEQ ID NO: 909423 - DNA, 25 bp, Mus musculus
tgtgtaagatgtcgcctatgtgcct

SEQ ID NO: 909424 - DNA, 25 bp, Mus musculus
tgtgtaagatgtggcctatgtgcct

SEQ ID NO: 909425 - DNA, 25 bp, Mus musculus
tgtgtaagcagtcccgtttttggtt

SEQ ID NO: 909426 - DNA, 25 bp, Mus musculus
tgtgtaagcagtgccgtttttggtt

SEQ ID NO: 909427 - DNA, 25 bp, Mus musculus
tgtgtaagccaccaaggagcgcctc

SEQ ID NO: 909428 - DNA, 25 bp, Mus musculus
tgtgtaagccacgaaggagcgcctc

SEQ ID NO: 909429 - DNA, 25 bp, Mus musculus
tgtgtaaggagacggctcctcattc

SEQ ID NO: 909430 - DNA, 25 bp, Mus musculus
tgtgtaaggagagggctcctcattc

SEQ ID NO: 909431 - DNA, 25 bp, Mus musculus
tgtgtaaggtggattggctccgttc

SEQ ID NO: 909432 - DNA, 25 bp, Mus musculus
tgtgtaaggtggtttggctccgttc

SEQ ID NO: 909433 - DNA, 25 bp, Mus musculus
tgtgtaagtctgagggccttggcct

SEQ ID NO: 909434 - DNA, 25 bp, Mus musculus
tgtgtaagtctgtgggccttggcct

SEQ ID NO: 909435 - DNA, 25 bp, Mus musculus
tgtgtaatcacgatccagggcccaa

SEQ ID NO: 909436 - DNA, 25 bp, Mus musculus
tgtgtaatcacgttccagggcccaa

SEQ ID NO: 909437 - DNA, 25 bp, Mus musculus
tgtgtaatgcgccttcttttcactg

SEQ ID NO: 909438 - DNA, 25 bp, Mus musculus
tgtgtaatgcgcgttcttttcactg

SEQ ID NO: 909439 - DNA, 25 bp, Mus musculus
tgtgtaattgtgacccctttccttt

SEQ ID NO: 909440 - DNA, 25 bp, Mus musculus
tgtgtaattgtgtcccctttccttt

SEQ ID NO: 909441 - DNA, 25 bp, Mus musculus
tgtgtaattgttattccactgtatt

SEQ ID NO: 909442 - DNA, 25 bp, Mus musculus
tgtgtaattgtttttccactgtatt

SEQ ID NO: 909443 - DNA, 25 bp, Mus musculus
tgtgtacaaagcaagcgcgcagcct

SEQ ID NO: 909444 - DNA, 25 bp, Mus musculus
tgtgtacaaagctagcgcgcagcct

SEQ ID NO: 909445 - DNA, 25 bp, Mus musculus
tgtgtacaagatatcacccccttgt

SEQ ID NO: 909446 - DNA, 25 bp, Mus musculus
tgtgtacaagatttcacccccttgt

SEQ ID NO: 909447 - DNA, 25 bp, Mus musculus
tgtgtacaataccactggccttaaa

SEQ ID NO: 909448 - DNA, 25 bp, Mus musculus
tgtgtacaatacgactggccttaaa

SEQ ID NO: 909449 - DNA, 25 bp, Mus musculus
tgtgtacaatcacctatcccagtct

SEQ ID NO: 909450 - DNA, 25 bp, Mus musculus
tgtgtacaatcagctatcccagtct

SEQ ID NO: 909451 - DNA, 25 bp, Mus musculus
tgtgtacaatcccactctttccaaa

SEQ ID NO: 909452 - DNA, 25 bp, Mus musculus
tgtgtacaatccgactctttccaaa

SEQ ID NO: 909453 - DNA, 25 bp, Mus musculus
tgtgtacacaccaaaagttttggga

SEQ ID NO: 909454 - DNA, 25 bp, Mus musculus
tgtgtacacaccagtggagtcacac

SEQ ID NO: 909455 - DNA, 25 bp, Mus musculus
tgtgtacacacctaaagttttggga

SEQ ID NO: 909456 - DNA, 25 bp, Mus musculus
tgtgtacacacctgtggagtcacac

SEQ ID NO: 909457 - DNA, 25 bp, Mus musculus
tgtgtacacagtaggaccagcattc

SEQ ID NO: 909458 - DNA, 25 bp, Mus musculus
tgtgtacacagttggaccagcattc

SEQ ID NO: 909459 - DNA, 25 bp, Mus musculus
tgtgtacacatacccaagcgcacat

SEQ ID NO: 909460 - DNA, 25 bp, Mus musculus
tgtgtacacatagccaagcgcacat

SEQ ID NO: 909461 - DNA, 25 bp, Mus musculus
tgtgtacacattatccaaggctctg

SEQ ID NO: 909462 - DNA, 25 bp, Mus musculus
tgtgtacacattttccaaggctctg

SEQ ID NO: 909463 - DNA, 25 bp, Mus musculus
tgtgtacagcagctcccggcagcag

SEQ ID NO: 909464 - DNA, 25 bp, Mus musculus
tgtgtacagcaggtcccggcagcag

SEQ ID NO: 909465 - DNA, 25 bp, Mus musculus
tgtgtacagcatccccatgcataga

SEQ ID NO: 909466 - DNA, 25 bp, Mus musculus
tgtgtacagcatgcccatgcataga

SEQ ID NO: 909467 - DNA, 25 bp, Mus musculus
tgtgtacagctgagcgcccatgccc

SEQ ID NO: 909468 - DNA, 25 bp, Mus musculus
tgtgtacagctgtgcgcccatgccc

SEQ ID NO: 909469 - DNA, 25 bp, Mus musculus
tgtgtacagtcaacttcctgaccta

SEQ ID NO: 909470 - DNA, 25 bp, Mus musculus
tgtgtacagtcatcttcctgaccta

SEQ ID NO: 909471 - DNA, 25 bp, Mus musculus
tgtgtacataccacatcctgtttat

SEQ ID NO: 909472 - DNA, 25 bp, Mus musculus
tgtgtacatacctcatcctgtttat

SEQ ID NO: 909473 - DNA, 25 bp, Mus musculus
tgtgtacatactctgtgttagactc

SEQ ID NO: 909474 - DNA, 25 bp, Mus musculus
tgtgtacatactgtgtgttagactc

SEQ ID NO: 909475 - DNA, 25 bp, Mus musculus
tgtgtacatcgccagctttatcagg

SEQ ID NO: 909476 - DNA, 25 bp, Mus musculus
tgtgtacatcgcgagctttatcagg

SEQ ID NO: 909477 - DNA, 25 bp, Mus musculus
tgtgtacatctaaacctcctatcta

SEQ ID NO: 909478 - DNA, 25 bp, Mus musculus
tgtgtacatctatacctcctatcta

SEQ ID NO: 909479 - DNA, 25 bp, Mus musculus
tgtgtaccacatccctgcttggtgc

SEQ ID NO: 909480 - DNA, 25 bp, Mus musculus
tgtgtaccacatgcctgcttggtgc

SEQ ID NO: 909481 - DNA, 25 bp, Mus musculus
tgtgtaccacgcagccatggcagtt

SEQ ID NO: 909482 - DNA, 25 bp, Mus musculus
tgtgtaccacgctgccatggcagtt

SEQ ID NO: 909483 - DNA, 25 bp, Mus musculus
tgtgtaccactaaaccaaccctaag

SEQ ID NO: 909484 - DNA, 25 bp, Mus musculus
tgtgtaccactataccaaccctaag

SEQ ID NO: 909485 - DNA, 25 bp, Mus musculus
tgtgtaccagtcagaagcccatggc

SEQ ID NO: 909486 - DNA, 25 bp, Mus musculus
tgtgtaccagtctgaagcccatggc

SEQ ID NO: 909487 - DNA, 25 bp, Mus musculus
tgtgtacccaggcagggcattcttg

SEQ ID NO: 909488 - DNA, 25 bp, Mus musculus
tgtgtacccagggagggcattcttg

SEQ ID NO: 909489 - DNA, 25 bp, Mus musculus
tgtgtaccccacattctaagatgga

SEQ ID NO: 909490 - DNA, 25 bp, Mus musculus
tgtgtaccccactttctaagatgga

SEQ ID NO: 909491 - DNA, 25 bp, Mus musculus
tgtgtacccctcacattcatggagt

SEQ ID NO: 909492 - DNA, 25 bp, Mus musculus
tgtgtacccctctcattcatggagt

SEQ ID NO: 909493 - DNA, 25 bp, Mus musculus
tgtgtacccgaacccatgcagaagg

SEQ ID NO: 909494 - DNA, 25 bp, Mus musculus
tgtgtacccgaagccatgcagaagg

SEQ ID NO: 909495 - DNA, 25 bp, Mus musculus
tgtgtaccctttcgatccctgttct

SEQ ID NO: 909496 - DNA, 25 bp, Mus musculus
tgtgtaccctttggatccctgttct

SEQ ID NO: 909497 - DNA, 25 bp, Mus musculus
tgtgtaccgacaaatcacttgcctt

SEQ ID NO: 909498 - DNA, 25 bp, Mus musculus
tgtgtaccgacatatcacttgcctt

SEQ ID NO: 909499 - DNA, 25 bp, Mus musculus
tgtgtaccgtccaagagcaaaatgc

SEQ ID NO: 909500 - DNA, 25 bp, Mus musculus
tgtgtaccgtcctagagcaaaatgc

SEQ ID NO: 909501 - DNA, 25 bp, Mus musculus
tgtgtacctagtactacttctgggc

SEQ ID NO: 909502 - DNA, 25 bp, Mus musculus
tgtgtacctagttctacttctgggc

SEQ ID NO: 909503 - DNA, 25 bp, Mus musculus
tgtgtacctccaaacctggcttatg

SEQ ID NO: 909504 - DNA, 25 bp, Mus musculus
tgtgtacctccacagcatcattgtg

SEQ ID NO: 909505 - DNA, 25 bp, Mus musculus
tgtgtacctccagagcatcattgtg

SEQ ID NO: 909506 - DNA, 25 bp, Mus musculus
tgtgtacctccatacctggcttatg

SEQ ID NO: 909507 - DNA, 25 bp, Mus musculus
tgtgtacctgcaagctttttgaccc

SEQ ID NO: 909508 - DNA, 25 bp, Mus musculus
tgtgtacctgcatgctttttgaccc

SEQ ID NO: 909509 - DNA, 25 bp, Mus musculus
tgtgtacctgttcctaatttttttg

SEQ ID NO: 909510 - DNA, 25 bp, Mus musculus
tgtgtacctgttgctaatttttttg

SEQ ID NO: 909511 - DNA, 25 bp, Mus musculus
tgtgtaccttcacccgatggacaga

SEQ ID NO: 909512 - DNA, 25 bp, Mus musculus
tgtgtaccttcagccgatggacaga

SEQ ID NO: 909513 - DNA, 25 bp, Mus musculus
tgtgtacgcaggctacagccaaatg

SEQ ID NO: 909514 - DNA, 25 bp, Mus musculus
tgtgtacgcagggtacagccaaatg

SEQ ID NO: 909515 - DNA, 25 bp, Mus musculus
tgtgtacgcgtgcatgttcatgtgt

SEQ ID NO: 909516 - DNA, 25 bp, Mus musculus
tgtgtacgcgtggatgttcatgtgt

SEQ ID NO: 909517 - DNA, 25 bp, Mus musculus
tgtgtacgtggacaccactggctcc

SEQ ID NO: 909518 - DNA, 25 bp, Mus musculus
tgtgtacgtggagaccactggctcc

SEQ ID NO: 909519 - DNA, 25 bp, Mus musculus
tgtgtactaataatgatccttgttc

SEQ ID NO: 909520 - DNA, 25 bp, Mus musculus
tgtgtactaatattgatccttgttc

SEQ ID NO: 909521 - DNA, 25 bp, Mus musculus
tgtgtactacacaagcagccagcag

SEQ ID NO: 909522 - DNA, 25 bp, Mus musculus
tgtgtactacactagcagccagcag

SEQ ID NO: 909523 - DNA, 25 bp, Mus musculus
tgtgtactacccattttaacaggag

SEQ ID NO: 909524 - DNA, 25 bp, Mus musculus
tgtgtactaccctttttaacaggag

SEQ ID NO: 909525 - DNA, 25 bp, Mus musculus
tgtgtactacgcagaagaccccaaa

SEQ ID NO: 909526 - DNA, 25 bp, Mus musculus
tgtgtactacgctgaagaccccaaa

SEQ ID NO: 909527 - DNA, 25 bp, Mus musculus
tgtgtactatttatccatgtggcat

SEQ ID NO: 909528 - DNA, 25 bp, Mus musculus
tgtgtactatttttccatgtggcat

SEQ ID NO: 909529 - DNA, 25 bp, Mus musculus
tgtgtactctagactgtctcagcca

SEQ ID NO: 909530 - DNA, 25 bp, Mus musculus
tgtgtactctagtctgtctcagcca

SEQ ID NO: 909531 - DNA, 25 bp, Mus musculus
tgtgtactgagtccctgggtctgca

SEQ ID NO: 909532 - DNA, 25 bp, Mus musculus
tgtgtactgagtgcctgggtctgca

SEQ ID NO: 909533 - DNA, 25 bp, Mus musculus
tgtgtactgatgacaccatgccctg

SEQ ID NO: 909534 - DNA, 25 bp, Mus musculus
tgtgtactgatgtcaccatgccctg

SEQ ID NO: 909535 - DNA, 25 bp, Mus musculus
tgtgtactgtatattgctacctgta

SEQ ID NO: 909536 - DNA, 25 bp, Mus musculus
tgtgtactgtattttgctacctgta

SEQ ID NO: 909537 - DNA, 25 bp, Mus musculus
tgtgtactgttgctctcttttcatt

SEQ ID NO: 909538 - DNA, 25 bp, Mus musculus
tgtgtactgttggtctcttttcatt

SEQ ID NO: 909539 - DNA, 25 bp, Mus musculus
tgtgtagaaaaaccctaatctttag

SEQ ID NO: 909540 - DNA, 25 bp, Mus musculus
tgtgtagaaaaagcctaatctttag

SEQ ID NO: 909541 - DNA, 25 bp, Mus musculus
tgtgtagaacctcgtgggccaccgt

SEQ ID NO: 909542 - DNA, 25 bp, Mus musculus
tgtgtagaacctggtgggccaccgt

SEQ ID NO: 909543 - DNA, 25 bp, Mus musculus
tgtgtagacactaacttcccatctg

SEQ ID NO: 909544 - DNA, 25 bp, Mus musculus
tgtgtagacacttacttcccatctg

SEQ ID NO: 909545 - DNA, 25 bp, Mus musculus
tgtgtagacatcctcttgcctgaat

SEQ ID NO: 909546 - DNA, 25 bp, Mus musculus
tgtgtagacatcgtcttgcctgaat

SEQ ID NO: 909547 - DNA, 25 bp, Mus musculus
tgtgtagaccacaggcaggcgtttt

SEQ ID NO: 909548 - DNA, 25 bp, Mus musculus
tgtgtagaccactggcaggcgtttt

SEQ ID NO: 909549 - DNA, 25 bp, Mus musculus
tgtgtagacgccagcatctgtgctg

SEQ ID NO: 909550 - DNA, 25 bp, Mus musculus
tgtgtagacgcctgcatctgtgctg

SEQ ID NO: 909551 - DNA, 25 bp, Mus musculus
tgtgtagcagcaccctttcagaggc

SEQ ID NO: 909552 - DNA, 25 bp, Mus musculus
tgtgtagcagcagcctttcagaggc

SEQ ID NO: 909553 - DNA, 25 bp, Mus musculus
tgtgtagcatagaatctgactcatt

SEQ ID NO: 909554 - DNA, 25 bp, Mus musculus
tgtgtagcatagtatctgactcatt

SEQ ID NO: 909555 - DNA, 25 bp, Mus musculus
tgtgtagccatgacctgctaagcca

SEQ ID NO: 909556 - DNA, 25 bp, Mus musculus
tgtgtagccatgtcctgctaagcca

SEQ ID NO: 909557 - DNA, 25 bp, Mus musculus
tgtgtagcccataaggaacggtttt

SEQ ID NO: 909558 - DNA, 25 bp, Mus musculus
tgtgtagcccattaggaacggtttt

SEQ ID NO: 909559 - DNA, 25 bp, Mus musculus
tgtgtagcccctatttaacctggtg

SEQ ID NO: 909560 - DNA, 25 bp, Mus musculus
tgtgtagcccctttttaacctggtg

SEQ ID NO: 909561 - DNA, 25 bp, Mus musculus
tgtgtagcccgtagtggcctggagc

SEQ ID NO: 909562 - DNA, 25 bp, Mus musculus
tgtgtagcccgttgtggcctggagc

SEQ ID NO: 909563 - DNA, 25 bp, Mus musculus
tgtgtagctctacagcattaacata

SEQ ID NO: 909564 - DNA, 25 bp, Mus musculus
tgtgtagctctagagcattaacata

SEQ ID NO: 909565 - DNA, 25 bp, Mus musculus
tgtgtagctgttctgcatgtgaatg

SEQ ID NO: 909566 - DNA, 25 bp, Mus musculus
tgtgtagctgttgtgcatgtgaatg

SEQ ID NO: 909567 - DNA, 25 bp, Mus musculus
tgtgtagctttaatgtctctctccg

SEQ ID NO: 909568 - DNA, 25 bp, Mus musculus
tgtgtagctttattgtctctctccg

SEQ ID NO: 909569 - DNA, 25 bp, Mus musculus
tgtgtaggaggccttccctttcttt

SEQ ID NO: 909570 - DNA, 25 bp, Mus musculus
tgtgtaggaggcgttccctttcttt

SEQ ID NO: 909571 - DNA, 25 bp, Mus musculus
tgtgtaggtatgctgactcgtgtct

SEQ ID NO: 909572 - DNA, 25 bp, Mus musculus
tgtgtaggtatggtgactcgtgtct

SEQ ID NO: 909573 - DNA, 25 bp, Mus musculus
tgtgtaggtccccatgctttgtact

SEQ ID NO: 909574 - DNA, 25 bp, Mus musculus
tgtgtaggtcccgatgctttgtact

SEQ ID NO: 909575 - DNA, 25 bp, Mus musculus
tgtgtaggtgttctatatcccgcca

SEQ ID NO: 909576 - DNA, 25 bp, Mus musculus
tgtgtaggtgttgtatatcccgcca

SEQ ID NO: 909577 - DNA, 25 bp, Mus musculus
tgtgtagtaaatcctcactccccaa

SEQ ID NO: 909578 - DNA, 25 bp, Mus musculus
tgtgtagtaaatgctcactccccaa

SEQ ID NO: 909579 - DNA, 25 bp, Mus musculus
tgtgtagtaactaggcatctgtatt

SEQ ID NO: 909580 - DNA, 25 bp, Mus musculus
tgtgtagtaactctccattctgcta

SEQ ID NO: 909581 - DNA, 25 bp, Mus musculus
tgtgtagtaactgtccattctgcta

SEQ ID NO: 909582 - DNA, 25 bp, Mus musculus
tgtgtagtaacttggcatctgtatt

SEQ ID NO: 909583 - DNA, 25 bp, Mus musculus
tgtgtagtaggtcgcatttaattta

SEQ ID NO: 909584 - DNA, 25 bp, Mus musculus
tgtgtagtaggtggcatttaattta

SEQ ID NO: 909585 - DNA, 25 bp, Mus musculus
tgtgtagtcaccaaaagaaaaattt

SEQ ID NO: 909586 - DNA, 25 bp, Mus musculus
tgtgtagtcacctaaagaaaaattt

SEQ ID NO: 909587 - DNA, 25 bp, Mus musculus
tgtgtagtgagtcttaggcctcctt

SEQ ID NO: 909588 - DNA, 25 bp, Mus musculus
tgtgtagtgagtgttaggcctcctt

SEQ ID NO: 909589 - DNA, 25 bp, Mus musculus
tgtgtagtgtaacgccacccgcgtt

SEQ ID NO: 909590 - DNA, 25 bp, Mus musculus
tgtgtagtgtaaggccacccgcgtt

SEQ ID NO: 909591 - DNA, 25 bp, Mus musculus
tgtgtataacgcaccacacccagga

SEQ ID NO: 909592 - DNA, 25 bp, Mus musculus
tgtgtataacgctccacacccagga

SEQ ID NO: 909593 - DNA, 25 bp, Mus musculus
tgtgtatacaaccacgtactacccc

SEQ ID NO: 909594 - DNA, 25 bp, Mus musculus
tgtgtatacaacgacgtactacccc

SEQ ID NO: 909595 - DNA, 25 bp, Mus musculus
tgtgtatacaccagctggggctgcg

SEQ ID NO: 909596 - DNA, 25 bp, Mus musculus
tgtgtatacacccagtgccgcagaa

SEQ ID NO: 909597 - DNA, 25 bp, Mus musculus
tgtgtatacaccgagtgccgcagaa

SEQ ID NO: 909598 - DNA, 25 bp, Mus musculus
tgtgtatacacctgctggggctgcg

SEQ ID NO: 909599 - DNA, 25 bp, Mus musculus
tgtgtatacccaccacaacgctatg

SEQ ID NO: 909600 - DNA, 25 bp, Mus musculus
tgtgtatacccagcacaacgctatg

SEQ ID NO: 909601 - DNA, 25 bp, Mus musculus
tgtgtatatcccatgcagatgcatc

SEQ ID NO: 909602 - DNA, 25 bp, Mus musculus
tgtgtatatcccttgcagatgcatc

SEQ ID NO: 909603 - DNA, 25 bp, Mus musculus
tgtgtatatcttaagggtacctcat

SEQ ID NO: 909604 - DNA, 25 bp, Mus musculus
tgtgtatatctttagggtacctcat

SEQ ID NO: 909605 - DNA, 25 bp, Mus musculus
tgtgtatattctccaatttcctttt

SEQ ID NO: 909606 - DNA, 25 bp, Mus musculus
tgtgtatattctgcaatttcctttt

SEQ ID NO: 909607 - DNA, 25 bp, Mus musculus
tgtgtatattttccttcacccacgc

SEQ ID NO: 909608 - DNA, 25 bp, Mus musculus
tgtgtatattttgcttcacccacgc

SEQ ID NO: 909609 - DNA, 25 bp, Mus musculus
tgtgtatcacctccacattcacgta

SEQ ID NO: 909610 - DNA, 25 bp, Mus musculus
tgtgtatcacctgcacattcacgta

SEQ ID NO: 909611 - DNA, 25 bp, Mus musculus
tgtgtatccaagcagccggtgctca

SEQ ID NO: 909612 - DNA, 25 bp, Mus musculus
tgtgtatccaaggagccggtgctca

SEQ ID NO: 909613 - DNA, 25 bp, Mus musculus
tgtgtatcccagatatgagcatgac

SEQ ID NO: 909614 - DNA, 25 bp, Mus musculus
tgtgtatcccagttatgagcatgac

SEQ ID NO: 909615 - DNA, 25 bp, Mus musculus
tgtgtatccccaccaggtatgcacc

SEQ ID NO: 909616 - DNA, 25 bp, Mus musculus
tgtgtatccccagcaggtatgcacc

SEQ ID NO: 909617 - DNA, 25 bp, Mus musculus
tgtgtatcctttccgcatccttatc

SEQ ID NO: 909618 - DNA, 25 bp, Mus musculus
tgtgtatcctttgcgcatccttatc

SEQ ID NO: 909619 - DNA, 25 bp, Mus musculus
tgtgtatctaatatgcccaggttca

SEQ ID NO: 909620 - DNA, 25 bp, Mus musculus
tgtgtatctaatttgcccaggttca

SEQ ID NO: 909621 - DNA, 25 bp, Mus musculus
tgtgtatctcagctgtagtggcctg

SEQ ID NO: 909622 - DNA, 25 bp, Mus musculus
tgtgtatctcaggtgtagtggcctg

SEQ ID NO: 909623 - DNA, 25 bp, Mus musculus
tgtgtatctgaactttgcctttgag

SEQ ID NO: 909624 - DNA, 25 bp, Mus musculus
tgtgtatctgaagtttgcctttgag

SEQ ID NO: 909625 - DNA, 25 bp, Mus musculus
tgtgtatcttctcgtctgaaaggac

SEQ ID NO: 909626 - DNA, 25 bp, Mus musculus
tgtgtatcttctcgtgactccagct

SEQ ID NO: 909627 - DNA, 25 bp, Mus musculus
tgtgtatcttctggtctgaaaggac

SEQ ID NO: 909628 - DNA, 25 bp, Mus musculus
tgtgtatcttctggtgactccagct

SEQ ID NO: 909629 - DNA, 25 bp, Mus musculus
tgtgtatctttcatgggtcccagca

SEQ ID NO: 909630 - DNA, 25 bp, Mus musculus
tgtgtatctttcttgggtcccagca

SEQ ID NO: 909631 - DNA, 25 bp, Mus musculus
tgtgtatcttttaaaccccagcctc

SEQ ID NO: 909632 - DNA, 25 bp, Mus musculus
tgtgtatctttttaaccccagcctc

SEQ ID NO: 909633 - DNA, 25 bp, Mus musculus
tgtgtatgattgagtgtgcccatgc

SEQ ID NO: 909634 - DNA, 25 bp, Mus musculus
tgtgtatgattgtgtgtgcccatgc

SEQ ID NO: 909635 - DNA, 25 bp, Mus musculus
tgtgtatgcaccagaagacgatcca

SEQ ID NO: 909636 - DNA, 25 bp, Mus musculus
tgtgtatgcacctgaagacgatcca

SEQ ID NO: 909637 - DNA, 25 bp, Mus musculus
tgtgtatgcgtcacactgcggtgct

SEQ ID NO: 909638 - DNA, 25 bp, Mus musculus
tgtgtatgcgtctcactgcggtgct

SEQ ID NO: 909639 - DNA, 25 bp, Mus musculus
tgtgtatgctacaaaccagccttcc

SEQ ID NO: 909640 - DNA, 25 bp, Mus musculus
tgtgtatgctactaaccagccttcc

SEQ ID NO: 909641 - DNA, 25 bp, Mus musculus
tgtgtatgctggaacaaccctgctc

SEQ ID NO: 909642 - DNA, 25 bp, Mus musculus
tgtgtatgctggtacaaccctgctc

SEQ ID NO: 909643 - DNA, 25 bp, Mus musculus
tgtgtatgcttgatgcacagggccc

SEQ ID NO: 909644 - DNA, 25 bp, Mus musculus
tgtgtatgcttgttgcacagggccc

SEQ ID NO: 909645 - DNA, 25 bp, Mus musculus
tgtgtatggagcctcaatggcagcc

SEQ ID NO: 909646 - DNA, 25 bp, Mus musculus
tgtgtatggagcgtcaatggcagcc

SEQ ID NO: 909647 - DNA, 25 bp, Mus musculus
tgtgtatggctacgaagcttcccct

SEQ ID NO: 909648 - DNA, 25 bp, Mus musculus
tgtgtatggctaggaagcttcccct

SEQ ID NO: 909649 - DNA, 25 bp, Mus musculus
tgtgtatgtatcaccttgtgggcgt

SEQ ID NO: 909650 - DNA, 25 bp, Mus musculus
tgtgtatgtatctccttgtgggcgt

SEQ ID NO: 909651 - DNA, 25 bp, Mus musculus
tgtgtatgtattccttaagcaaaca

SEQ ID NO: 909652 - DNA, 25 bp, Mus musculus
tgtgtatgtattgcttaagcaaaca

SEQ ID NO: 909653 - DNA, 25 bp, Mus musculus
tgtgtatgtctaagtgcgtgcacat

SEQ ID NO: 909654 - DNA, 25 bp, Mus musculus
tgtgtatgtctatgtgcgtgcacat

SEQ ID NO: 909655 - DNA, 25 bp, Mus musculus
tgtgtatgtgtgatccccgtttctc

SEQ ID NO: 909656 - DNA, 25 bp, Mus musculus
tgtgtatgtgtgttccccgtttctc

SEQ ID NO: 909657 - DNA, 25 bp, Mus musculus
tgtgtattatatctggcctcgttat

SEQ ID NO: 909658 - DNA, 25 bp, Mus musculus
tgtgtattatatgtggcctcgttat

SEQ ID NO: 909659 - DNA, 25 bp, Mus musculus
tgtgtattatgtcgccaatgtcttc

SEQ ID NO: 909660 - DNA, 25 bp, Mus musculus
tgtgtattatgtggccaatgtcttc

SEQ ID NO: 909661 - DNA, 25 bp, Mus musculus
tgtgtattcagccagtgccctggac

SEQ ID NO: 909662 - DNA, 25 bp, Mus musculus
tgtgtattcagcgagtgccctggac

SEQ ID NO: 909663 - DNA, 25 bp, Mus musculus
tgtgtattctgaccttctatgtccc

SEQ ID NO: 909664 - DNA, 25 bp, Mus musculus
tgtgtattctgagcttctatgtccc

SEQ ID NO: 909665 - DNA, 25 bp, Mus musculus
tgtgtattggcaatggaggtgaccc

SEQ ID NO: 909666 - DNA, 25 bp, Mus musculus
tgtgtattggcattggaggtgaccc

SEQ ID NO: 909667 - DNA, 25 bp, Mus musculus
tgtgtattgtttaccagagaacctg

SEQ ID NO: 909668 - DNA, 25 bp, Mus musculus
tgtgtattgttttccagagaacctg

SEQ ID NO: 909669 - DNA, 25 bp, Mus musculus
tgtgtatttgtaatatacccctggg

SEQ ID NO: 909670 - DNA, 25 bp, Mus musculus
tgtgtatttgtattatacccctggg

SEQ ID NO: 909671 - DNA, 25 bp, Mus musculus
tgtgtatttgtgaatctgccatatg

SEQ ID NO: 909672 - DNA, 25 bp, Mus musculus
tgtgtatttgtgtatctgccatatg

SEQ ID NO: 909673 - DNA, 25 bp, Mus musculus
tgtgtattttggcacgtgtttctac

SEQ ID NO: 909674 - DNA, 25 bp, Mus musculus
tgtgtattttgggacgtgtttctac

SEQ ID NO: 909675 - DNA, 25 bp, Mus musculus
tgtgtatttttaaccactcaatgta

SEQ ID NO: 909676 - DNA, 25 bp, Mus musculus
tgtgtatttttatccactcaatgta

SEQ ID NO: 909677 - DNA, 25 bp, Mus musculus
tgtgtatttttgctagttcctatct

SEQ ID NO: 909678 - DNA, 25 bp, Mus musculus
tgtgtatttttggtagttcctatct

SEQ ID NO: 909679 - DNA, 25 bp, Mus musculus
tgtgtcaaacaccatacctcctgct

SEQ ID NO: 909680 - DNA, 25 bp, Mus musculus
tgtgtcaaacacgatacctcctgct

SEQ ID NO: 909681 - DNA, 25 bp, Mus musculus
tgtgtcaaatccatccctcatggct

SEQ ID NO: 909682 - DNA, 25 bp, Mus musculus
tgtgtcaaatccttccctcatggct

SEQ ID NO: 909683 - DNA, 25 bp, Mus musculus
tgtgtcaacagtactcagcggcttg

SEQ ID NO: 909684 - DNA, 25 bp, Mus musculus
tgtgtcaacagttctcagcggcttg

SEQ ID NO: 909685 - DNA, 25 bp, Mus musculus
tgtgtcaactctacagtcacccatg

SEQ ID NO: 909686 - DNA, 25 bp, Mus musculus
tgtgtcaactcttcagtcacccatg

SEQ ID NO: 909687 - DNA, 25 bp, Mus musculus
tgtgtcaatattctacgtctgtctt

SEQ ID NO: 909688 - DNA, 25 bp, Mus musculus
tgtgtcaatattgtacgtctgtctt

SEQ ID NO: 909689 - DNA, 25 bp, Mus musculus
tgtgtcaatgttactttctgtgtcc

SEQ ID NO: 909690 - DNA, 25 bp, Mus musculus
tgtgtcaatgtttctttctgtgtcc

SEQ ID NO: 909691 - DNA, 25 bp, Mus musculus
tgtgtcacacccctatggcatgcag

SEQ ID NO: 909692 - DNA, 25 bp, Mus musculus
tgtgtcacacccgtatggcatgcag

SEQ ID NO: 909693 - DNA, 25 bp, Mus musculus
tgtgtcacacgcacccgatgtggac

SEQ ID NO: 909694 - DNA, 25 bp, Mus musculus
tgtgtcacacgctcccgatgtggac

SEQ ID NO: 909695 - DNA, 25 bp, Mus musculus
tgtgtcaccatgaccgtcctgtatg

SEQ ID NO: 909696 - DNA, 25 bp, Mus musculus
tgtgtcaccatgtccgtcctgtatg

SEQ ID NO: 909697 - DNA, 25 bp, Mus musculus
tgtgtcaccctgaccacgtctatct

SEQ ID NO: 909698 - DNA, 25 bp, Mus musculus
tgtgtcaccctgtccacgtctatct

SEQ ID NO: 909699 - DNA, 25 bp, Mus musculus
tgtgtcaccgtcaggtgtctgatgc

SEQ ID NO: 909700 - DNA, 25 bp, Mus musculus
tgtgtcaccgtctggtgtctgatgc

SEQ ID NO: 909701 - DNA, 25 bp, Mus musculus
tgtgtcactccactggaatttaatt

SEQ ID NO: 909702 - DNA, 25 bp, Mus musculus
tgtgtcactccagtggaatttaatt

SEQ ID NO: 909703 - DNA, 25 bp, Mus musculus
tgtgtcactcttcgagtagatgtgt

SEQ ID NO: 909704 - DNA, 25 bp, Mus musculus
tgtgtcactcttggagtagatgtgt

SEQ ID NO: 909705 - DNA, 25 bp, Mus musculus
tgtgtcactgcacgctttctctcga

SEQ ID NO: 909706 - DNA, 25 bp, Mus musculus
tgtgtcactgcaggctttctctcga

SEQ ID NO: 909707 - DNA, 25 bp, Mus musculus
tgtgtcactgtgaacagactcctgt

SEQ ID NO: 909708 - DNA, 25 bp, Mus musculus
tgtgtcactgtgtacagactcctgt

SEQ ID NO: 909709 - DNA, 25 bp, Mus musculus
tgtgtcagaaggctttccacttgaa

SEQ ID NO: 909710 - DNA, 25 bp, Mus musculus
tgtgtcagaagggtttccacttgaa

SEQ ID NO: 909711 - DNA, 25 bp, Mus musculus
tgtgtcagacagagaaaatcagtat

SEQ ID NO: 909712 - DNA, 25 bp, Mus musculus
tgtgtcagacagtgaaaatcagtat

SEQ ID NO: 909713 - DNA, 25 bp, Mus musculus
tgtgtcagaccgaacaagtgcctct

SEQ ID NO: 909714 - DNA, 25 bp, Mus musculus
tgtgtcagaccgtacaagtgcctct

SEQ ID NO: 909715 - DNA, 25 bp, Mus musculus
tgtgtcagagccatttgtcctcctt

SEQ ID NO: 909716 - DNA, 25 bp, Mus musculus
tgtgtcagagccttttgtcctcctt

SEQ ID NO: 909717 - DNA, 25 bp, Mus musculus
tgtgtcagcaccattctcctaaggc

SEQ ID NO: 909718 - DNA, 25 bp, Mus musculus
tgtgtcagcacctttctcctaaggc

SEQ ID NO: 909719 - DNA, 25 bp, Mus musculus
tgtgtcagcaggctagaaactccgc

SEQ ID NO: 909720 - DNA, 25 bp, Mus musculus
tgtgtcagcagggtagaaactccgc

SEQ ID NO: 909721 - DNA, 25 bp, Mus musculus
tgtgtcagccatataatcatcccca

SEQ ID NO: 909722 - DNA, 25 bp, Mus musculus
tgtgtcagccatttaatcatcccca

SEQ ID NO: 909723 - DNA, 25 bp, Mus musculus
tgtgtcagcctcatcctgtgtgccc

SEQ ID NO: 909724 - DNA, 25 bp, Mus musculus
tgtgtcagcctcctattctctggag

SEQ ID NO: 909725 - DNA, 25 bp, Mus musculus
tgtgtcagcctcgtattctctggag

SEQ ID NO: 909726 - DNA, 25 bp, Mus musculus
tgtgtcagcctcttcctgtgtgccc

SEQ ID NO: 909727 - DNA, 25 bp, Mus musculus
tgtgtcaggcagctttaccaagtcc

SEQ ID NO: 909728 - DNA, 25 bp, Mus musculus
tgtgtcaggcaggtttaccaagtcc

SEQ ID NO: 909729 - DNA, 25 bp, Mus musculus
tgtgtcagggaaagtcccaccggag

SEQ ID NO: 909730 - DNA, 25 bp, Mus musculus
tgtgtcagggaatgtcccaccggag

SEQ ID NO: 909731 - DNA, 25 bp, Mus musculus
tgtgtcaggttccaggccagtgatc

SEQ ID NO: 909732 - DNA, 25 bp, Mus musculus
tgtgtcaggttcgaggccagtgatc

SEQ ID NO: 909733 - DNA, 25 bp, Mus musculus
tgtgtcagtctgaaacatttttctg

SEQ ID NO: 909734 - DNA, 25 bp, Mus musculus
tgtgtcagtctgtaacatttttctg

SEQ ID NO: 909735 - DNA, 25 bp, Mus musculus
tgtgtcagtggaactcttccgggtc

SEQ ID NO: 909736 - DNA, 25 bp, Mus musculus
tgtgtcagtggatctcttccgggtc

SEQ ID NO: 909737 - DNA, 25 bp, Mus musculus
tgtgtcagtttcatctagccatcag

SEQ ID NO: 909738 - DNA, 25 bp, Mus musculus
tgtgtcagtttcttctagccatcag

SEQ ID NO: 909739 - DNA, 25 bp, Mus musculus
tgtgtcataatacaacaatttctgt

SEQ ID NO: 909740 - DNA, 25 bp, Mus musculus
tgtgtcataatagaacaatttctgt

SEQ ID NO: 909741 - DNA, 25 bp, Mus musculus
tgtgtcatactgcttccatccatac

SEQ ID NO: 909742 - DNA, 25 bp, Mus musculus
tgtgtcatactggttccatccatac

SEQ ID NO: 909743 - DNA, 25 bp, Mus musculus
tgtgtcatcaagaacggaaacagga

SEQ ID NO: 909744 - DNA, 25 bp, Mus musculus
tgtgtcatcaagtacggaaacagga

SEQ ID NO: 909745 - DNA, 25 bp, Mus musculus
tgtgtcatcacactcctccaaagag

SEQ ID NO: 909746 - DNA, 25 bp, Mus musculus
tgtgtcatcacagtcctccaaagag

SEQ ID NO: 909747 - DNA, 25 bp, Mus musculus
tgtgtcatcactagtttggcctgga

SEQ ID NO: 909748 - DNA, 25 bp, Mus musculus
tgtgtcatcacttgtttggcctgga

SEQ ID NO: 909749 - DNA, 25 bp, Mus musculus
tgtgtcatcagcattttcggggttc

SEQ ID NO: 909750 - DNA, 25 bp, Mus musculus
tgtgtcatcagctttttcggggttc

SEQ ID NO: 909751 - DNA, 25 bp, Mus musculus
tgtgtcatcctcagttgggactgaa

SEQ ID NO: 909752 - DNA, 25 bp, Mus musculus
tgtgtcatcctctgttgggactgaa

SEQ ID NO: 909753 - DNA, 25 bp, Mus musculus
tgtgtcatcctgcttggtctgggac

SEQ ID NO: 909754 - DNA, 25 bp, Mus musculus
tgtgtcatcctggttggtctgggac

SEQ ID NO: 909755 - DNA, 25 bp, Mus musculus
tgtgtcatctctccttagcttgttt

SEQ ID NO: 909756 - DNA, 25 bp, Mus musculus
tgtgtcatctctgcttagcttgttt

SEQ ID NO: 909757 - DNA, 25 bp, Mus musculus
tgtgtcatcttcagttttcagtctc

SEQ ID NO: 909758 - DNA, 25 bp, Mus musculus
tgtgtcatcttctgttttcagtctc

SEQ ID NO: 909759 - DNA, 25 bp, Mus musculus
tgtgtcatgaacaaagcctgctgct

SEQ ID NO: 909760 - DNA, 25 bp, Mus musculus
tgtgtcatgaactaagcctgctgct

SEQ ID NO: 909761 - DNA, 25 bp, Mus musculus
tgtgtcatgatcctgagttgtcgca

SEQ ID NO: 909762 - DNA, 25 bp, Mus musculus
tgtgtcatgatcgtgagttgtcgca

SEQ ID NO: 909763 - DNA, 25 bp, Mus musculus
tgtgtcatgctacggacagtggcac

SEQ ID NO: 909764 - DNA, 25 bp, Mus musculus
tgtgtcatgctagggacagtggcac

SEQ ID NO: 909765 - DNA, 25 bp, Mus musculus
tgtgtcatgctgagatttctgtctt

SEQ ID NO: 909766 - DNA, 25 bp, Mus musculus
tgtgtcatgctgaggctcaaacaca

SEQ ID NO: 909767 - DNA, 25 bp, Mus musculus
tgtgtcatgctgtgatttctgtctt

SEQ ID NO: 909768 - DNA, 25 bp, Mus musculus
tgtgtcatgctgtggctcaaacaca

SEQ ID NO: 909769 - DNA, 25 bp, Mus musculus
tgtgtcatgtcacttgctgctgcct

SEQ ID NO: 909770 - DNA, 25 bp, Mus musculus
tgtgtcatgtcagttgctgctgcct

SEQ ID NO: 909771 - DNA, 25 bp, Mus musculus
tgtgtcattaaactgcctgtaccca

SEQ ID NO: 909772 - DNA, 25 bp, Mus musculus
tgtgtcattaaagtgcctgtaccca

SEQ ID NO: 909773 - DNA, 25 bp, Mus musculus
tgtgtcattgtaactgtcctgtttc

SEQ ID NO: 909774 - DNA, 25 bp, Mus musculus
tgtgtcattgtatctgtcctgtttc

SEQ ID NO: 909775 - DNA, 25 bp, Mus musculus
tgtgtcattgtcatccgtgtcctaa

SEQ ID NO: 909776 - DNA, 25 bp, Mus musculus
tgtgtcattgtcttccgtgtcctaa

SEQ ID NO: 909777 - DNA, 25 bp, Mus musculus
tgtgtcatttccatcgcattactgt

SEQ ID NO: 909778 - DNA, 25 bp, Mus musculus
tgtgtcatttccttcgcattactgt

SEQ ID NO: 909779 - DNA, 25 bp, Mus musculus
tgtgtccaaccaagtagatgaataa

SEQ ID NO: 909780 - DNA, 25 bp, Mus musculus
tgtgtccaaccatgtagatgaataa

SEQ ID NO: 909781 - DNA, 25 bp, Mus musculus
tgtgtccaagttagtatgtatattt

SEQ ID NO: 909782 - DNA, 25 bp, Mus musculus
tgtgtccaagtttgtatgtatattt

SEQ ID NO: 909783 - DNA, 25 bp, Mus musculus
tgtgtccaatatactagttatattt

SEQ ID NO: 909784 - DNA, 25 bp, Mus musculus
tgtgtccaatattctagttatattt

SEQ ID NO: 909785 - DNA, 25 bp, Mus musculus
tgtgtccacacacggattggtttca

SEQ ID NO: 909786 - DNA, 25 bp, Mus musculus
tgtgtccacacagggattggtttca

SEQ ID NO: 909787 - DNA, 25 bp, Mus musculus
tgtgtccactcaactcagattacaa

SEQ ID NO: 909788 - DNA, 25 bp, Mus musculus
tgtgtccactcatctcagattacaa

SEQ ID NO: 909789 - DNA, 25 bp, Mus musculus
tgtgtccagcgtcctgcctggctgt

SEQ ID NO: 909790 - DNA, 25 bp, Mus musculus
tgtgtccagcgtgctgcctggctgt

SEQ ID NO: 909791 - DNA, 25 bp, Mus musculus
tgtgtccaggccaggtcaaccttgc

SEQ ID NO: 909792 - DNA, 25 bp, Mus musculus
tgtgtccaggcctggtcaaccttgc

SEQ ID NO: 909793 - DNA, 25 bp, Mus musculus
tgtgtccagtccatcctgagaagaa

SEQ ID NO: 909794 - DNA, 25 bp, Mus musculus
tgtgtccagtccttcctgagaagaa

SEQ ID NO: 909795 - DNA, 25 bp, Mus musculus
tgtgtccatcctctgatgatgactt

SEQ ID NO: 909796 - DNA, 25 bp, Mus musculus
tgtgtccatcctgtgatgatgactt

SEQ ID NO: 909797 - DNA, 25 bp, Mus musculus
tgtgtccattagcactcccagtgac

SEQ ID NO: 909798 - DNA, 25 bp, Mus musculus
tgtgtccattaggactcccagtgac

SEQ ID NO: 909799 - DNA, 25 bp, Mus musculus
tgtgtccattggagtgagcttcccc

SEQ ID NO: 909800 - DNA, 25 bp, Mus musculus
tgtgtccattggtgtgagcttcccc

SEQ ID NO: 909801 - DNA, 25 bp, Mus musculus
tgtgtccattttactgctcatcaat

SEQ ID NO: 909802 - DNA, 25 bp, Mus musculus
tgtgtccatttttctgctcatcaat

SEQ ID NO: 909803 - DNA, 25 bp, Mus musculus
tgtgtcccaaagaagggcatgtgtt

SEQ ID NO: 909804 - DNA, 25 bp, Mus musculus
tgtgtcccaaagtagggcatgtgtt

SEQ ID NO: 909805 - DNA, 25 bp, Mus musculus
tgtgtcccaacacctctcagagtgt

SEQ ID NO: 909806 - DNA, 25 bp, Mus musculus
tgtgtcccaacacttgtgctatgat

SEQ ID NO: 909807 - DNA, 25 bp, Mus musculus
tgtgtcccaacagctctcagagtgt

SEQ ID NO: 909808 - DNA, 25 bp, Mus musculus
tgtgtcccaacagttgtgctatgat

SEQ ID NO: 909809 - DNA, 25 bp, Mus musculus
tgtgtcccacagaccgggctggcag

SEQ ID NO: 909810 - DNA, 25 bp, Mus musculus
tgtgtcccacagtccgggctggcag

SEQ ID NO: 909811 - DNA, 25 bp, Mus musculus
tgtgtcccagacagctctgcaaaga

SEQ ID NO: 909812 - DNA, 25 bp, Mus musculus
tgtgtcccagactgctctgcaaaga

SEQ ID NO: 909813 - DNA, 25 bp, Mus musculus
tgtgtcccagcgctgccttgtgcaa

SEQ ID NO: 909814 - DNA, 25 bp, Mus musculus
tgtgtcccagcggtgccttgtgcaa

SEQ ID NO: 909815 - DNA, 25 bp, Mus musculus
tgtgtcccaggcaggcttcagactc

SEQ ID NO: 909816 - DNA, 25 bp, Mus musculus
tgtgtcccaggctggcttcagactc

SEQ ID NO: 909817 - DNA, 25 bp, Mus musculus
tgtgtcccattgatgggccctggta

SEQ ID NO: 909818 - DNA, 25 bp, Mus musculus
tgtgtcccattgttgggccctggta

SEQ ID NO: 909819 - DNA, 25 bp, Mus musculus
tgtgtccccaatacatatgcataat

SEQ ID NO: 909820 - DNA, 25 bp, Mus musculus
tgtgtccccaattcatatgcataat

SEQ ID NO: 909821 - DNA, 25 bp, Mus musculus
tgtgtccccacacacaggtcagttc

SEQ ID NO: 909822 - DNA, 25 bp, Mus musculus
tgtgtccccacagacaggtcagttc

SEQ ID NO: 909823 - DNA, 25 bp, Mus musculus
tgtgtccccattaccaccagtaagg

SEQ ID NO: 909824 - DNA, 25 bp, Mus musculus
tgtgtccccattctacggtggtcag

SEQ ID NO: 909825 - DNA, 25 bp, Mus musculus
tgtgtccccattgtacggtggtcag

SEQ ID NO: 909826 - DNA, 25 bp, Mus musculus
tgtgtccccatttccaccagtaagg

SEQ ID NO: 909827 - DNA, 25 bp, Mus musculus
tgtgtcccccaaaacttagatttca

SEQ ID NO: 909828 - DNA, 25 bp, Mus musculus
tgtgtcccccaatacttagatttca

SEQ ID NO: 909829 - DNA, 25 bp, Mus musculus
tgtgtcccctgcaaaagcagtcaat

SEQ ID NO: 909830 - DNA, 25 bp, Mus musculus
tgtgtcccctgctaaagcagtcaat

SEQ ID NO: 909831 - DNA, 25 bp, Mus musculus
tgtgtccccttcagtgagctgtagt

SEQ ID NO: 909832 - DNA, 25 bp, Mus musculus
tgtgtccccttctgtgagctgtagt

SEQ ID NO: 909833 - DNA, 25 bp, Mus musculus
tgtgtcccgcagatgatgtcatttt

SEQ ID NO: 909834 - DNA, 25 bp, Mus musculus
tgtgtcccgcagttgatgtcatttt

SEQ ID NO: 909835 - DNA, 25 bp, Mus musculus
tgtgtcccgctacaaaactctattt

SEQ ID NO: 909836 - DNA, 25 bp, Mus musculus
tgtgtcccgctacatggcaggagca

SEQ ID NO: 909837 - DNA, 25 bp, Mus musculus
tgtgtcccgctagaaaactctattt

SEQ ID NO: 909838 - DNA, 25 bp, Mus musculus
tgtgtcccgctagatggcaggagca

SEQ ID NO: 909839 - DNA, 25 bp, Mus musculus
tgtgtcccgtgaccctcacagagat

SEQ ID NO: 909840 - DNA, 25 bp, Mus musculus
tgtgtcccgtgagcctcacagagat

SEQ ID NO: 909841 - DNA, 25 bp, Mus musculus
tgtgtccctaacatacctcttttct

SEQ ID NO: 909842 - DNA, 25 bp, Mus musculus
tgtgtccctaacttacctcttttct

SEQ ID NO: 909843 - DNA, 25 bp, Mus musculus
tgtgtccctgacatcttaaacagcc

SEQ ID NO: 909844 - DNA, 25 bp, Mus musculus
tgtgtccctgacttcttaaacagcc

SEQ ID NO: 909845 - DNA, 25 bp, Mus musculus
tgtgtccctgctaccaccaaggagg

SEQ ID NO: 909846 - DNA, 25 bp, Mus musculus
tgtgtccctgcttccaccaaggagg

SEQ ID NO: 909847 - DNA, 25 bp, Mus musculus
tgtgtccctgtcagcatagtgattt

SEQ ID NO: 909848 - DNA, 25 bp, Mus musculus
tgtgtccctgtctgcatagtgattt

SEQ ID NO: 909849 - DNA, 25 bp, Mus musculus
tgtgtccctgtgaccaggcaagaag

SEQ ID NO: 909850 - DNA, 25 bp, Mus musculus
tgtgtccctgtgtccaggcaagaag

SEQ ID NO: 909851 - DNA, 25 bp, Mus musculus
tgtgtcccttcgcagtgagcagaaa

SEQ ID NO: 909852 - DNA, 25 bp, Mus musculus
tgtgtcccttcggagtgagcagaaa

SEQ ID NO: 909853 - DNA, 25 bp, Mus musculus
tgtgtccgactcataccttgtacta

SEQ ID NO: 909854 - DNA, 25 bp, Mus musculus
tgtgtccgactcttaccttgtacta

SEQ ID NO: 909855 - DNA, 25 bp, Mus musculus
tgtgtccgcactccttattgttggc

SEQ ID NO: 909856 - DNA, 25 bp, Mus musculus
tgtgtccgcactgcttattgttggc

SEQ ID NO: 909857 - DNA, 25 bp, Mus musculus
tgtgtccggaagaggcagcgaccca

SEQ ID NO: 909858 - DNA, 25 bp, Mus musculus
tgtgtccggaagtggcagcgaccca

SEQ ID NO: 909859 - DNA, 25 bp, Mus musculus
tgtgtccgggatctcgctgtgtttc

SEQ ID NO: 909860 - DNA, 25 bp, Mus musculus
tgtgtccgggatgtcgctgtgtttc

SEQ ID NO: 909861 - DNA, 25 bp, Mus musculus
tgtgtccgtctgactttctgcgtct

SEQ ID NO: 909862 - DNA, 25 bp, Mus musculus
tgtgtccgtctgtctttctgcgtct

SEQ ID NO: 909863 - DNA, 25 bp, Mus musculus
tgtgtcctacagctgccatgagcag

SEQ ID NO: 909864 - DNA, 25 bp, Mus musculus
tgtgtcctacaggtgccatgagcag

SEQ ID NO: 909865 - DNA, 25 bp, Mus musculus
tgtgtcctactccatttactggtta

SEQ ID NO: 909866 - DNA, 25 bp, Mus musculus
tgtgtcctactcgatttactggtta

SEQ ID NO: 909867 - DNA, 25 bp, Mus musculus
tgtgtcctacttaggctatacttct

SEQ ID NO: 909868 - DNA, 25 bp, Mus musculus
tgtgtcctactttggctatacttct

SEQ ID NO: 909869 - DNA, 25 bp, Mus musculus
tgtgtcctaggaattgactgcccct

SEQ ID NO: 909870 - DNA, 25 bp, Mus musculus
tgtgtcctaggatttgactgcccct

SEQ ID NO: 909871 - DNA, 25 bp, Mus musculus
tgtgtcctcaagagcagtcgggcag

SEQ ID NO: 909872 - DNA, 25 bp, Mus musculus
tgtgtcctcaagattttgggatgta

SEQ ID NO: 909873 - DNA, 25 bp, Mus musculus
tgtgtcctcaagtgcagtcgggcag

SEQ ID NO: 909874 - DNA, 25 bp, Mus musculus
tgtgtcctcaagtttttgggatgta

SEQ ID NO: 909875 - DNA, 25 bp, Mus musculus
tgtgtcctcactccgcaggaagtct

SEQ ID NO: 909876 - DNA, 25 bp, Mus musculus
tgtgtcctcactgcgcaggaagtct

SEQ ID NO: 909877 - DNA, 25 bp, Mus musculus
tgtgtcctcaggacaatttgtatct

SEQ ID NO: 909878 - DNA, 25 bp, Mus musculus
tgtgtcctcaggtcaatttgtatct

SEQ ID NO: 909879 - DNA, 25 bp, Mus musculus
tgtgtcctcctgaagctataggtgg

SEQ ID NO: 909880 - DNA, 25 bp, Mus musculus
tgtgtcctcctgtagctataggtgg

SEQ ID NO: 909881 - DNA, 25 bp, Mus musculus
tgtgtcctcggaaaccaatcagaat

SEQ ID NO: 909882 - DNA, 25 bp, Mus musculus
tgtgtcctcggataccaatcagaat

SEQ ID NO: 909883 - DNA, 25 bp, Mus musculus
tgtgtcctctggattctaaatctat

SEQ ID NO: 909884 - DNA, 25 bp, Mus musculus
tgtgtcctctggtttctaaatctat

SEQ ID NO: 909885 - DNA, 25 bp, Mus musculus
tgtgtcctgatccagccttgaactt

SEQ ID NO: 909886 - DNA, 25 bp, Mus musculus
tgtgtcctgatcgagccttgaactt

SEQ ID NO: 909887 - DNA, 25 bp, Mus musculus
tgtgtcctgggaagtcagctctctg

SEQ ID NO: 909888 - DNA, 25 bp, Mus musculus
tgtgtcctgggatgtcagctctctg

SEQ ID NO: 909889 - DNA, 25 bp, Mus musculus
tgtgtcctgggcaggccagcacctg

SEQ ID NO: 909890 - DNA, 25 bp, Mus musculus
tgtgtcctgggctggccagcacctg

SEQ ID NO: 909891 - DNA, 25 bp, Mus musculus
tgtgtcctgtggcttcccaagggta

SEQ ID NO: 909892 - DNA, 25 bp, Mus musculus
tgtgtcctgtgggttcccaagggta

SEQ ID NO: 909893 - DNA, 25 bp, Mus musculus
tgtgtccttcctaaagccttagacg

SEQ ID NO: 909894 - DNA, 25 bp, Mus musculus
tgtgtccttccttaagccttagacg

SEQ ID NO: 909895 - DNA, 25 bp, Mus musculus
tgtgtccttcttacagacaaactag

SEQ ID NO: 909896 - DNA, 25 bp, Mus musculus
tgtgtccttctttcagacaaactag

SEQ ID NO: 909897 - DNA, 25 bp, Mus musculus
tgtgtcctttttctcgttctttctt

SEQ ID NO: 909898 - DNA, 25 bp, Mus musculus
tgtgtcctttttgtcgttctttctt

SEQ ID NO: 909899 - DNA, 25 bp, Mus musculus
tgtgtcgccttcatgtaaatgttgt

SEQ ID NO: 909900 - DNA, 25 bp, Mus musculus
tgtgtcgccttcttgtaaatgttgt

SEQ ID NO: 909901 - DNA, 25 bp, Mus musculus
tgtgtcgcgcgtcgtttgttgacaa

SEQ ID NO: 909902 - DNA, 25 bp, Mus musculus
tgtgtcgcgcgtggtttgttgacaa

SEQ ID NO: 909903 - DNA, 25 bp, Mus musculus
tgtgtcgcttctctttgtctgctgt

SEQ ID NO: 909904 - DNA, 25 bp, Mus musculus
tgtgtcgcttctgtttgtctgctgt

SEQ ID NO: 909905 - DNA, 25 bp, Mus musculus
tgtgtcgggttgcagcgcatcctat

SEQ ID NO: 909906 - DNA, 25 bp, Mus musculus
tgtgtcgggttggagcgcatcctat

SEQ ID NO: 909907 - DNA, 25 bp, Mus musculus
tgtgtcggtattatgctgcaatgtc

SEQ ID NO: 909908 - DNA, 25 bp, Mus musculus
tgtgtcggtattttgctgcaatgtc

SEQ ID NO: 909909 - DNA, 25 bp, Mus musculus
tgtgtcggtttgaaatgtgggtctt

SEQ ID NO: 909910 - DNA, 25 bp, Mus musculus
tgtgtcggtttgtaatgtgggtctt

SEQ ID NO: 909911 - DNA, 25 bp, Mus musculus
tgtgtcgtgtaacccagggactaca

SEQ ID NO: 909912 - DNA, 25 bp, Mus musculus
tgtgtcgtgtaagccagggactaca

SEQ ID NO: 909913 - DNA, 25 bp, Mus musculus
tgtgtcgtgtgtctggctcaaagct

SEQ ID NO: 909914 - DNA, 25 bp, Mus musculus
tgtgtcgtgtgtgtggctcaaagct

SEQ ID NO: 909915 - DNA, 25 bp, Mus musculus
tgtgtcgttgccagcctaaaggatg

SEQ ID NO: 909916 - DNA, 25 bp, Mus musculus
tgtgtcgttgcccaggtgacaaaca

SEQ ID NO: 909917 - DNA, 25 bp, Mus musculus
tgtgtcgttgccgaggtgacaaaca

SEQ ID NO: 909918 - DNA, 25 bp, Mus musculus
tgtgtcgttgcctgcctaaaggatg

SEQ ID NO: 909919 - DNA, 25 bp, Mus musculus
tgtgtctaaaacacctgctccgagg

SEQ ID NO: 909920 - DNA, 25 bp, Mus musculus
tgtgtctaaaactcctgctccgagg

SEQ ID NO: 909921 - DNA, 25 bp, Mus musculus
tgtgtctaaacaagtcctccgtgga

SEQ ID NO: 909922 - DNA, 25 bp, Mus musculus
tgtgtctaaacatgtcctccgtgga

SEQ ID NO: 909923 - DNA, 25 bp, Mus musculus
tgtgtctaactcagcagggtcctca

SEQ ID NO: 909924 - DNA, 25 bp, Mus musculus
tgtgtctaactctgcagggtcctca

SEQ ID NO: 909925 - DNA, 25 bp, Mus musculus
tgtgtctaatctatgcaactgccca

SEQ ID NO: 909926 - DNA, 25 bp, Mus musculus
tgtgtctaatctttgcaactgccca

SEQ ID NO: 909927 - DNA, 25 bp, Mus musculus
tgtgtctacacaaccttatcatgat

SEQ ID NO: 909928 - DNA, 25 bp, Mus musculus
tgtgtctacacatccttatcatgat

SEQ ID NO: 909929 - DNA, 25 bp, Mus musculus
tgtgtctacagcagttccctgacat

SEQ ID NO: 909930 - DNA, 25 bp, Mus musculus
tgtgtctacagctgttccctgacat

SEQ ID NO: 909931 - DNA, 25 bp, Mus musculus
tgtgtctacatcaggaaaagatttt

SEQ ID NO: 909932 - DNA, 25 bp, Mus musculus
tgtgtctacatctggaaaagatttt

SEQ ID NO: 909933 - DNA, 25 bp, Mus musculus
tgtgtctacattcctctttgcaata

SEQ ID NO: 909934 - DNA, 25 bp, Mus musculus
tgtgtctacattgctctttgcaata

SEQ ID NO: 909935 - DNA, 25 bp, Mus musculus
tgtgtctactttacctcgagactca

SEQ ID NO: 909936 - DNA, 25 bp, Mus musculus
tgtgtctacttttcctcgagactca

SEQ ID NO: 909937 - DNA, 25 bp, Mus musculus
tgtgtctagccacacttgcgcgccg

SEQ ID NO: 909938 - DNA, 25 bp, Mus musculus
tgtgtctagccagacttgcgcgccg

SEQ ID NO: 909939 - DNA, 25 bp, Mus musculus
tgtgtctagtccctgccaggcatcc

SEQ ID NO: 909940 - DNA, 25 bp, Mus musculus
tgtgtctagtccgtgccaggcatcc

SEQ ID NO: 909941 - DNA, 25 bp, Mus musculus
tgtgtctagttaacgaagtatttcc

SEQ ID NO: 909942 - DNA, 25 bp, Mus musculus
tgtgtctagttatcgaagtatttcc

SEQ ID NO: 909943 - DNA, 25 bp, Mus musculus
tgtgtctatatgactgtgtctgtct

SEQ ID NO: 909944 - DNA, 25 bp, Mus musculus
tgtgtctatatgtctgtgtctgtct

SEQ ID NO: 909945 - DNA, 25 bp, Mus musculus
tgtgtctatcccagcttcctgggtg

SEQ ID NO: 909946 - DNA, 25 bp, Mus musculus
tgtgtctatccctgcttcctgggtg

SEQ ID NO: 909947 - DNA, 25 bp, Mus musculus
tgtgtctatgcaaccttccaagtgt

SEQ ID NO: 909948 - DNA, 25 bp, Mus musculus
tgtgtctatgcatccttccaagtgt

SEQ ID NO: 909949 - DNA, 25 bp, Mus musculus
tgtgtctattgaatcttggtcccca

SEQ ID NO: 909950 - DNA, 25 bp, Mus musculus
tgtgtctattgattcttggtcccca

SEQ ID NO: 909951 - DNA, 25 bp, Mus musculus
tgtgtctcaaatacccaggtgcctt

SEQ ID NO: 909952 - DNA, 25 bp, Mus musculus
tgtgtctcaaattcccaggtgcctt

SEQ ID NO: 909953 - DNA, 25 bp, Mus musculus
tgtgtctcaagcctttcataccaga

SEQ ID NO: 909954 - DNA, 25 bp, Mus musculus
tgtgtctcaagcgtttcataccaga

SEQ ID NO: 909955 - DNA, 25 bp, Mus musculus
tgtgtctcacataggatgatattcc

SEQ ID NO: 909956 - DNA, 25 bp, Mus musculus
tgtgtctcacattggatgatattcc

SEQ ID NO: 909957 - DNA, 25 bp, Mus musculus
tgtgtctcaggcaggtagctcagag

SEQ ID NO: 909958 - DNA, 25 bp, Mus musculus
tgtgtctcaggctggtagctcagag

SEQ ID NO: 909959 - DNA, 25 bp, Mus musculus
tgtgtctccaggacagttcccaaac

SEQ ID NO: 909960 - DNA, 25 bp, Mus musculus
tgtgtctccaggtcagttcccaaac

SEQ ID NO: 909961 - DNA, 25 bp, Mus musculus
tgtgtctccgtcacctacaggaagt

SEQ ID NO: 909962 - DNA, 25 bp, Mus musculus
tgtgtctccgtctcctacaggaagt

SEQ ID NO: 909963 - DNA, 25 bp, Mus musculus
tgtgtctccgttcaggaccttcaga

SEQ ID NO: 909964 - DNA, 25 bp, Mus musculus
tgtgtctccgttgaggaccttcaga

SEQ ID NO: 909965 - DNA, 25 bp, Mus musculus
tgtgtctcctaacccaacggtgcca

SEQ ID NO: 909966 - DNA, 25 bp, Mus musculus
tgtgtctcctaagccaacggtgcca

SEQ ID NO: 909967 - DNA, 25 bp, Mus musculus
tgtgtctcctgcactactcgctcag

SEQ ID NO: 909968 - DNA, 25 bp, Mus musculus
tgtgtctcctgctctactcgctcag

SEQ ID NO: 909969 - DNA, 25 bp, Mus musculus
tgtgtctcctgtcagtgggaacagt

SEQ ID NO: 909970 - DNA, 25 bp, Mus musculus
tgtgtctcctgtgagtgggaacagt

SEQ ID NO: 909971 - DNA, 25 bp, Mus musculus
tgtgtctctatcacgcgtctacctg

SEQ ID NO: 909972 - DNA, 25 bp, Mus musculus
tgtgtctctatctcgcgtctacctg

SEQ ID NO: 909973 - DNA, 25 bp, Mus musculus
tgtgtctctcataatttggcctcca

SEQ ID NO: 909974 - DNA, 25 bp, Mus musculus
tgtgtctctcattatttggcctcca

SEQ ID NO: 909975 - DNA, 25 bp, Mus musculus
tgtgtctctgcaacatggcatgtga

SEQ ID NO: 909976 - DNA, 25 bp, Mus musculus
tgtgtctctgcatcatggcatgtga

SEQ ID NO: 909977 - DNA, 25 bp, Mus musculus
tgtgtctctggaaacatcccgggac

SEQ ID NO: 909978 - DNA, 25 bp, Mus musculus
tgtgtctctggatacatcccgggac

SEQ ID NO: 909979 - DNA, 25 bp, Mus musculus
tgtgtctctgtaccattgcatgtgg

SEQ ID NO: 909980 - DNA, 25 bp, Mus musculus
tgtgtctctgtagcattgcatgtgg

SEQ ID NO: 909981 - DNA, 25 bp, Mus musculus
tgtgtctcttttctatgctcttgct

SEQ ID NO: 909982 - DNA, 25 bp, Mus musculus
tgtgtctcttttgtatgctcttgct

SEQ ID NO: 909983 - DNA, 25 bp, Mus musculus
tgtgtctgaagaatggacactcttt

SEQ ID NO: 909984 - DNA, 25 bp, Mus musculus
tgtgtctgaagattggacactcttt

SEQ ID NO: 909985 - DNA, 25 bp, Mus musculus
tgtgtctgacttagaggcaccggga

SEQ ID NO: 909986 - DNA, 25 bp, Mus musculus
tgtgtctgactttgaggcaccggga

SEQ ID NO: 909987 - DNA, 25 bp, Mus musculus
tgtgtctgagtcatagagaaggcca

SEQ ID NO: 909988 - DNA, 25 bp, Mus musculus
tgtgtctgagtcttagagaaggcca

SEQ ID NO: 909989 - DNA, 25 bp, Mus musculus
tgtgtctgcaaaacaggaccttagt

SEQ ID NO: 909990 - DNA, 25 bp, Mus musculus
tgtgtctgcaaatcaggaccttagt

SEQ ID NO: 909991 - DNA, 25 bp, Mus musculus
tgtgtctgcagtctgagtaggcctt

SEQ ID NO: 909992 - DNA, 25 bp, Mus musculus
tgtgtctgcagtgtgagtaggcctt

SEQ ID NO: 909993 - DNA, 25 bp, Mus musculus
tgtgtctgccacatcccaggtggag

SEQ ID NO: 909994 - DNA, 25 bp, Mus musculus
tgtgtctgccacttcccaggtggag

SEQ ID NO: 909995 - DNA, 25 bp, Mus musculus
tgtgtctgcctaacaattctgcgta

SEQ ID NO: 909996 - DNA, 25 bp, Mus musculus
tgtgtctgcctatcaattctgcgta

SEQ ID NO: 909997 - DNA, 25 bp, Mus musculus
tgtgtctgctgaaccctcatgcaga

SEQ ID NO: 909998 - DNA, 25 bp, Mus musculus
tgtgtctgctgatccctcatgcaga

SEQ ID NO: 909999 - DNA, 25 bp, Mus musculus
tgtgtctgcttaccctcatgttaga

SEQ ID NO: 910000 - DNA, 25 bp, Mus musculus
tgtgtctgcttagcctcatgttaga

SEQ ID NO: 910001 - DNA, 25 bp, Mus musculus
tgtgtctggatccagctctctagat

SEQ ID NO: 910002 - DNA, 25 bp, Mus musculus
tgtgtctggatcgagctctctagat

SEQ ID NO: 910003 - DNA, 25 bp, Mus musculus
tgtgtctgtcacctgagtcaggcta

SEQ ID NO: 910004 - DNA, 25 bp, Mus musculus
tgtgtctgtcacgtgagtcaggcta

SEQ ID NO: 910005 - DNA, 25 bp, Mus musculus
tgtgtctgtctcaccatgggcagag

SEQ ID NO: 910006 - DNA, 25 bp, Mus musculus
tgtgtctgtctctccatgggcagag

SEQ ID NO: 910007 - DNA, 25 bp, Mus musculus
tgtgtctgtgaacctctcggtctgt

SEQ ID NO: 910008 - DNA, 25 bp, Mus musculus
tgtgtctgtgaacttacgggcgcac

SEQ ID NO: 910009 - DNA, 25 bp, Mus musculus
tgtgtctgtgaagctctcggtctgt

SEQ ID NO: 910010 - DNA, 25 bp, Mus musculus
tgtgtctgtgaagttacgggcgcac

SEQ ID NO: 910011 - DNA, 25 bp, Mus musculus
tgtgtctgtgcacgcatgcgtgcac

SEQ ID NO: 910012 - DNA, 25 bp, Mus musculus
tgtgtctgtgcaggcatgcgtgcac

SEQ ID NO: 910013 - DNA, 25 bp, Mus musculus
tgtgtctgtggcattggcatcgtga

SEQ ID NO: 910014 - DNA, 25 bp, Mus musculus
tgtgtctgtggctttggcatcgtga

SEQ ID NO: 910015 - DNA, 25 bp, Mus musculus
tgtgtctgtgtaatcctttgctaag

SEQ ID NO: 910016 - DNA, 25 bp, Mus musculus
tgtgtctgtgtaatggtgtaatccc

SEQ ID NO: 910017 - DNA, 25 bp, Mus musculus
tgtgtctgtgtattcctttgctaag

SEQ ID NO: 910018 - DNA, 25 bp, Mus musculus
tgtgtctgtgtattggtgtaatccc

SEQ ID NO: 910019 - DNA, 25 bp, Mus musculus
tgtgtctgttaacattagttctatg

SEQ ID NO: 910020 - DNA, 25 bp, Mus musculus
tgtgtctgttaagattagttctatg

SEQ ID NO: 910021 - DNA, 25 bp, Mus musculus
tgtgtctgttgtatgctagtcctat

SEQ ID NO: 910022 - DNA, 25 bp, Mus musculus
tgtgtctgttgtttgctagtcctat

SEQ ID NO: 910023 - DNA, 25 bp, Mus musculus
tgtgtctgtttaccatgtccactgc

SEQ ID NO: 910024 - DNA, 25 bp, Mus musculus
tgtgtctgtttagcatgtccactgc

SEQ ID NO: 910025 - DNA, 25 bp, Mus musculus
tgtgtcttaaacagactgcattgtc

SEQ ID NO: 910026 - DNA, 25 bp, Mus musculus
tgtgtcttaaactgactgcattgtc

SEQ ID NO: 910027 - DNA, 25 bp, Mus musculus
tgtgtcttaagactgccagagcccc

SEQ ID NO: 910028 - DNA, 25 bp, Mus musculus
tgtgtcttaagagtgccagagcccc

SEQ ID NO: 910029 - DNA, 25 bp, Mus musculus
tgtgtcttacacacctgcctgtcat

SEQ ID NO: 910030 - DNA, 25 bp, Mus musculus
tgtgtcttacactcctgcctgtcat

SEQ ID NO: 910031 - DNA, 25 bp, Mus musculus
tgtgtcttacagatttgggtccttc

SEQ ID NO: 910032 - DNA, 25 bp, Mus musculus
tgtgtcttacagttttgggtccttc

SEQ ID NO: 910033 - DNA, 25 bp, Mus musculus
tgtgtcttacccagtgtgtctcagt

SEQ ID NO: 910034 - DNA, 25 bp, Mus musculus
tgtgtcttaccctgtgtgtctcagt

SEQ ID NO: 910035 - DNA, 25 bp, Mus musculus
tgtgtcttagttatctggtctcctt

SEQ ID NO: 910036 - DNA, 25 bp, Mus musculus
tgtgtcttagttttctggtctcctt

SEQ ID NO: 910037 - DNA, 25 bp, Mus musculus
tgtgtcttcacaagcgctttgtttt

SEQ ID NO: 910038 - DNA, 25 bp, Mus musculus
tgtgtcttcacatgcgctttgtttt

SEQ ID NO: 910039 - DNA, 25 bp, Mus musculus
tgtgtcttcactcacctgggagaac

SEQ ID NO: 910040 - DNA, 25 bp, Mus musculus
tgtgtcttcactcttgagtctacat

SEQ ID NO: 910041 - DNA, 25 bp, Mus musculus
tgtgtcttcactgacctgggagaac

SEQ ID NO: 910042 - DNA, 25 bp, Mus musculus
tgtgtcttcactgttgagtctacat

SEQ ID NO: 910043 - DNA, 25 bp, Mus musculus
tgtgtcttcagccatctggatgttg

SEQ ID NO: 910044 - DNA, 25 bp, Mus musculus
tgtgtcttcagcgatctggatgttg

SEQ ID NO: 910045 - DNA, 25 bp, Mus musculus
tgtgtcttcaggattcagcagtcct

SEQ ID NO: 910046 - DNA, 25 bp, Mus musculus
tgtgtcttcaggtttcagcagtcct

SEQ ID NO: 910047 - DNA, 25 bp, Mus musculus
tgtgtcttcattatgcagctacttg

SEQ ID NO: 910048 - DNA, 25 bp, Mus musculus
tgtgtcttcattttgcagctacttg

SEQ ID NO: 910049 - DNA, 25 bp, Mus musculus
tgtgtcttccccagagaactgtgga

SEQ ID NO: 910050 - DNA, 25 bp, Mus musculus
tgtgtcttcccctgagaactgtgga

SEQ ID NO: 910051 - DNA, 25 bp, Mus musculus
tgtgtcttcctccacggatgctagg

SEQ ID NO: 910052 - DNA, 25 bp, Mus musculus
tgtgtcttcctcgacggatgctagg

SEQ ID NO: 910053 - DNA, 25 bp, Mus musculus
tgtgtcttctccaaggtgcttcacc

SEQ ID NO: 910054 - DNA, 25 bp, Mus musculus
tgtgtcttctcctaggtgcttcacc

SEQ ID NO: 910055 - DNA, 25 bp, Mus musculus
tgtgtcttctctaagcacggcaaat

SEQ ID NO: 910056 - DNA, 25 bp, Mus musculus
tgtgtcttctcttagcacggcaaat

SEQ ID NO: 910057 - DNA, 25 bp, Mus musculus
tgtgtcttcttccatgcatatctag

SEQ ID NO: 910058 - DNA, 25 bp, Mus musculus
tgtgtcttcttcgatgcatatctag

SEQ ID NO: 910059 - DNA, 25 bp, Mus musculus
tgtgtcttgacacctgacatcctca

SEQ ID NO: 910060 - DNA, 25 bp, Mus musculus
tgtgtcttgacagctgacatcctca

SEQ ID NO: 910061 - DNA, 25 bp, Mus musculus
tgtgtcttgcaccatgagttctggt

SEQ ID NO: 910062 - DNA, 25 bp, Mus musculus
tgtgtcttgcacgatgagttctggt

SEQ ID NO: 910063 - DNA, 25 bp, Mus musculus
tgtgtcttgtagaggccccagtgct

SEQ ID NO: 910064 - DNA, 25 bp, Mus musculus
tgtgtcttgtagtggccccagtgct

SEQ ID NO: 910065 - DNA, 25 bp, Mus musculus
tgtgtctttcacatcaccatcaaag

SEQ ID NO: 910066 - DNA, 25 bp, Mus musculus
tgtgtctttcacttcaccatcaaag

SEQ ID NO: 910067 - DNA, 25 bp, Mus musculus
tgtgtctttctaccgaagtccacgg

SEQ ID NO: 910068 - DNA, 25 bp, Mus musculus
tgtgtctttctaccgctaactaatc

SEQ ID NO: 910069 - DNA, 25 bp, Mus musculus
tgtgtctttctagcgaagtccacgg

SEQ ID NO: 910070 - DNA, 25 bp, Mus musculus
tgtgtctttctagcgctaactaatc

SEQ ID NO: 910071 - DNA, 25 bp, Mus musculus
tgtgtcttttatccatgaattgaat

SEQ ID NO: 910072 - DNA, 25 bp, Mus musculus
tgtgtcttttatgcatgaattgaat

SEQ ID NO: 910073 - DNA, 25 bp, Mus musculus
tgtgtcttttcccatctcatttagc

SEQ ID NO: 910074 - DNA, 25 bp, Mus musculus
tgtgtcttttccgatctcatttagc

SEQ ID NO: 910075 - DNA, 25 bp, Mus musculus
tgtgtcttttcgattcccagttgag

SEQ ID NO: 910076 - DNA, 25 bp, Mus musculus
tgtgtcttttcgtttcccagttgag

SEQ ID NO: 910077 - DNA, 25 bp, Mus musculus
tgtgtctttttgcttgtggcagatt

SEQ ID NO: 910078 - DNA, 25 bp, Mus musculus
tgtgtctttttggttgtggcagatt

SEQ ID NO: 910079 - DNA, 25 bp, Mus musculus
tgtgtgaaagctctccttgcatctt

SEQ ID NO: 910080 - DNA, 25 bp, Mus musculus
tgtgtgaaagctgtccttgcatctt

SEQ ID NO: 910081 - DNA, 25 bp, Mus musculus
tgtgtgaaatatcgccactcaggct

SEQ ID NO: 910082 - DNA, 25 bp, Mus musculus
tgtgtgaaatatggccactcaggct

SEQ ID NO: 910083 - DNA, 25 bp, Mus musculus
tgtgtgaacaaccttttgtaaccta

SEQ ID NO: 910084 - DNA, 25 bp, Mus musculus
tgtgtgaacaacgttttgtaaccta

SEQ ID NO: 910085 - DNA, 25 bp, Mus musculus
tgtgtgaacacaaccacatccacgg

SEQ ID NO: 910086 - DNA, 25 bp, Mus musculus
tgtgtgaacacatccacatccacgg

SEQ ID NO: 910087 - DNA, 25 bp, Mus musculus
tgtgtgaacaggctggcttctctga

SEQ ID NO: 910088 - DNA, 25 bp, Mus musculus
tgtgtgaacagggtggcttctctga

SEQ ID NO: 910089 - DNA, 25 bp, Mus musculus
tgtgtgaactctcacaatagcggct

SEQ ID NO: 910090 - DNA, 25 bp, Mus musculus
tgtgtgaactctgacaatagcggct

SEQ ID NO: 910091 - DNA, 25 bp, Mus musculus
tgtgtgaagctgagactaccaatca

SEQ ID NO: 910092 - DNA, 25 bp, Mus musculus
tgtgtgaagctgtgactaccaatca

SEQ ID NO: 910093 - DNA, 25 bp, Mus musculus
tgtgtgaaggagacgttttagttgt

SEQ ID NO: 910094 - DNA, 25 bp, Mus musculus
tgtgtgaaggagtcgttttagttgt

SEQ ID NO: 910095 - DNA, 25 bp, Mus musculus
tgtgtgaaggtcctctaccagtgag

SEQ ID NO: 910096 - DNA, 25 bp, Mus musculus
tgtgtgaaggtcgtctaccagtgag

SEQ ID NO: 910097 - DNA, 25 bp, Mus musculus
tgtgtgaagtggacccggagctaaa

SEQ ID NO: 910098 - DNA, 25 bp, Mus musculus
tgtgtgaagtggtcccggagctaaa

SEQ ID NO: 910099 - DNA, 25 bp, Mus musculus
tgtgtgaatactattgtggttccac

SEQ ID NO: 910100 - DNA, 25 bp, Mus musculus
tgtgtgaatacttttgtggttccac

SEQ ID NO: 910101 - DNA, 25 bp, Mus musculus
tgtgtgaatctaccctttctctggt

SEQ ID NO: 910102 - DNA, 25 bp, Mus musculus
tgtgtgaatctagcctttctctggt

SEQ ID NO: 910103 - DNA, 25 bp, Mus musculus
tgtgtgacaagcctgcagcctatga

SEQ ID NO: 910104 - DNA, 25 bp, Mus musculus
tgtgtgacaagcgtgcagcctatga

SEQ ID NO: 910105 - DNA, 25 bp, Mus musculus
tgtgtgacaatgaccttcctatgga

SEQ ID NO: 910106 - DNA, 25 bp, Mus musculus
tgtgtgacaatgtccttcctatgga

SEQ ID NO: 910107 - DNA, 25 bp, Mus musculus
tgtgtgacaccaacatgccatttgt

SEQ ID NO: 910108 - DNA, 25 bp, Mus musculus
tgtgtgacaccatcatgccatttgt

SEQ ID NO: 910109 - DNA, 25 bp, Mus musculus
tgtgtgacacccactgagctgttat

SEQ ID NO: 910110 - DNA, 25 bp, Mus musculus
tgtgtgacaccctctgagctgttat

SEQ ID NO: 910111 - DNA, 25 bp, Mus musculus
tgtgtgacagtccagccctgtggaa

SEQ ID NO: 910112 - DNA, 25 bp, Mus musculus
tgtgtgacagtcgagccctgtggaa

SEQ ID NO: 910113 - DNA, 25 bp, Mus musculus
tgtgtgacattgacattcgcccggg

SEQ ID NO: 910114 - DNA, 25 bp, Mus musculus
tgtgtgacattgatgccccattgct

SEQ ID NO: 910115 - DNA, 25 bp, Mus musculus
tgtgtgacattgtcattcgcccggg

SEQ ID NO: 910116 - DNA, 25 bp, Mus musculus
tgtgtgacattgttgccccattgct

SEQ ID NO: 910117 - DNA, 25 bp, Mus musculus
tgtgtgacccacagagctactgtcc

SEQ ID NO: 910118 - DNA, 25 bp, Mus musculus
tgtgtgacccactgagctactgtcc

SEQ ID NO: 910119 - DNA, 25 bp, Mus musculus
tgtgtgaccctgacctaactaaaag

SEQ ID NO: 910120 - DNA, 25 bp, Mus musculus
tgtgtgaccctgtcctaactaaaag

SEQ ID NO: 910121 - DNA, 25 bp, Mus musculus
tgtgtgaccggtcatcgatgatcgt

SEQ ID NO: 910122 - DNA, 25 bp, Mus musculus
tgtgtgaccggtgatcgatgatcgt

SEQ ID NO: 910123 - DNA, 25 bp, Mus musculus
tgtgtgacctccagcgtggcattgt

SEQ ID NO: 910124 - DNA, 25 bp, Mus musculus
tgtgtgacctcctgcgtggcattgt

SEQ ID NO: 910125 - DNA, 25 bp, Mus musculus
tgtgtgactgtgactgtgtctctgt

SEQ ID NO: 910126 - DNA, 25 bp, Mus musculus
tgtgtgactgtgtctgtgtctctgt

SEQ ID NO: 910127 - DNA, 25 bp, Mus musculus
tgtgtgacttccatagacttgcagt

SEQ ID NO: 910128 - DNA, 25 bp, Mus musculus
tgtgtgacttccttagacttgcagt

SEQ ID NO: 910129 - DNA, 25 bp, Mus musculus
tgtgtgagaagcaccagcgctggca

SEQ ID NO: 910130 - DNA, 25 bp, Mus musculus
tgtgtgagaagctccagcgctggca

SEQ ID NO: 910131 - DNA, 25 bp, Mus musculus
tgtgtgagacatagcttcttccact

SEQ ID NO: 910132 - DNA, 25 bp, Mus musculus
tgtgtgagacattgcttcttccact

SEQ ID NO: 910133 - DNA, 25 bp, Mus musculus
tgtgtgagccctagacagctactgc

SEQ ID NO: 910134 - DNA, 25 bp, Mus musculus
tgtgtgagcccttgacagctactgc

SEQ ID NO: 910135 - DNA, 25 bp, Mus musculus
tgtgtgaggaccaacaaggccctgc

SEQ ID NO: 910136 - DNA, 25 bp, Mus musculus
tgtgtgaggaccagctgagattaaa

SEQ ID NO: 910137 - DNA, 25 bp, Mus musculus
tgtgtgaggacctacaaggccctgc

SEQ ID NO: 910138 - DNA, 25 bp, Mus musculus
tgtgtgaggacctgctgagattaaa

SEQ ID NO: 910139 - DNA, 25 bp, Mus musculus
tgtgtgagggagcaattccatttag

SEQ ID NO: 910140 - DNA, 25 bp, Mus musculus
tgtgtgagggaggaattccatttag

SEQ ID NO: 910141 - DNA, 25 bp, Mus musculus
tgtgtgagtatgagtgccactgctt

SEQ ID NO: 910142 - DNA, 25 bp, Mus musculus
tgtgtgagtatgtgtgccactgctt

SEQ ID NO: 910143 - DNA, 25 bp, Mus musculus
tgtgtgagtcataccagccatggtc

SEQ ID NO: 910144 - DNA, 25 bp, Mus musculus
tgtgtgagtcattccagccatggtc

SEQ ID NO: 910145 - DNA, 25 bp, Mus musculus
tgtgtgatcacccactcttcctgga

SEQ ID NO: 910146 - DNA, 25 bp, Mus musculus
tgtgtgatcaccgactcttcctgga

SEQ ID NO: 910147 - DNA, 25 bp, Mus musculus
tgtgtgatctagcagccatgtagta

SEQ ID NO: 910148 - DNA, 25 bp, Mus musculus
tgtgtgatctaggagccatgtagta

SEQ ID NO: 910149 - DNA, 25 bp, Mus musculus
tgtgtgatgacaccctgcatggcgt

SEQ ID NO: 910150 - DNA, 25 bp, Mus musculus
tgtgtgatgacagcctgcatggcgt

SEQ ID NO: 910151 - DNA, 25 bp, Mus musculus
tgtgtgatgattattcctccatgtt

SEQ ID NO: 910152 - DNA, 25 bp, Mus musculus
tgtgtgatgatttttcctccatgtt

SEQ ID NO: 910153 - DNA, 25 bp, Mus musculus
tgtgtgatgcacaggcatgcggcct

SEQ ID NO: 910154 - DNA, 25 bp, Mus musculus
tgtgtgatgcactggcatgcggcct

SEQ ID NO: 910155 - DNA, 25 bp, Mus musculus
tgtgtgatgccaagcccagctacca

SEQ ID NO: 910156 - DNA, 25 bp, Mus musculus
tgtgtgatgccatgcccagctacca

SEQ ID NO: 910157 - DNA, 25 bp, Mus musculus
tgtgtgatggctatccccgttcggc

SEQ ID NO: 910158 - DNA, 25 bp, Mus musculus
tgtgtgatggctatggtcttggcat

SEQ ID NO: 910159 - DNA, 25 bp, Mus musculus
tgtgtgatggctttccccgttcggc

SEQ ID NO: 910160 - DNA, 25 bp, Mus musculus
tgtgtgatggctttggtcttggcat

SEQ ID NO: 910161 - DNA, 25 bp, Mus musculus
tgtgtgatgtgtactggtggatacc

SEQ ID NO: 910162 - DNA, 25 bp, Mus musculus
tgtgtgatgtgttctggtggatacc

SEQ ID NO: 910163 - DNA, 25 bp, Mus musculus
tgtgtgattataatttttaccgaaa

SEQ ID NO: 910164 - DNA, 25 bp, Mus musculus
tgtgtgattatattttttaccgaaa

SEQ ID NO: 910165 - DNA, 25 bp, Mus musculus
tgtgtgcaagccctgctatgtgaag

SEQ ID NO: 910166 - DNA, 25 bp, Mus musculus
tgtgtgcaagccgtgctatgtgaag

SEQ ID NO: 910167 - DNA, 25 bp, Mus musculus
tgtgtgcaatgcagttttgactttc

SEQ ID NO: 910168 - DNA, 25 bp, Mus musculus
tgtgtgcaatgctgttttgactttc

SEQ ID NO: 910169 - DNA, 25 bp, Mus musculus
tgtgtgcaattactctagcggcttc

SEQ ID NO: 910170 - DNA, 25 bp, Mus musculus
tgtgtgcaattagtctagcggcttc

SEQ ID NO: 910171 - DNA, 25 bp, Mus musculus
tgtgtgcacaatacgagtggactgt

SEQ ID NO: 910172 - DNA, 25 bp, Mus musculus
tgtgtgcacaattcgagtggactgt

SEQ ID NO: 910173 - DNA, 25 bp, Mus musculus
tgtgtgcacaccctatcagtttcca

SEQ ID NO: 910174 - DNA, 25 bp, Mus musculus
tgtgtgcacaccgtatcagtttcca

SEQ ID NO: 910175 - DNA, 25 bp, Mus musculus
tgtgtgcacagcctccagtttcccg

SEQ ID NO: 910176 - DNA, 25 bp, Mus musculus
tgtgtgcacagcgtccagtttcccg

SEQ ID NO: 910177 - DNA, 25 bp, Mus musculus
tgtgtgcacctcctacttgaatatt

SEQ ID NO: 910178 - DNA, 25 bp, Mus musculus
tgtgtgcacctcgtacttgaatatt

SEQ ID NO: 910179 - DNA, 25 bp, Mus musculus
tgtgtgcacgacaaactccatgcgg

SEQ ID NO: 910180 - DNA, 25 bp, Mus musculus
tgtgtgcacgactaactccatgcgg

SEQ ID NO: 910181 - DNA, 25 bp, Mus musculus
tgtgtgcacgcacttactgacatgc

SEQ ID NO: 910182 - DNA, 25 bp, Mus musculus
tgtgtgcacgcagttactgacatgc

SEQ ID NO: 910183 - DNA, 25 bp, Mus musculus
tgtgtgcactcaacgcgggagcagc

SEQ ID NO: 910184 - DNA, 25 bp, Mus musculus
tgtgtgcactcactcgcacacatat

SEQ ID NO: 910185 - DNA, 25 bp, Mus musculus
tgtgtgcactcagtcgcacacatat

SEQ ID NO: 910186 - DNA, 25 bp, Mus musculus
tgtgtgcactcatcgcgggagcagc

SEQ ID NO: 910187 - DNA, 25 bp, Mus musculus
tgtgtgcactttcaagctcttcacc

SEQ ID NO: 910188 - DNA, 25 bp, Mus musculus
tgtgtgcactttgaagctcttcacc

SEQ ID NO: 910189 - DNA, 25 bp, Mus musculus
tgtgtgcagcacacctaggtgcttg

SEQ ID NO: 910190 - DNA, 25 bp, Mus musculus
tgtgtgcagcactcctaggtgcttg

SEQ ID NO: 910191 - DNA, 25 bp, Mus musculus
tgtgtgcataccaacgtaagacagg

SEQ ID NO: 910192 - DNA, 25 bp, Mus musculus
tgtgtgcatacctacgtaagacagg

SEQ ID NO: 910193 - DNA, 25 bp, Mus musculus
tgtgtgcatcgaaccattgtctatt

SEQ ID NO: 910194 - DNA, 25 bp, Mus musculus
tgtgtgcatcgatccattgtctatt

SEQ ID NO: 910195 - DNA, 25 bp, Mus musculus
tgtgtgcatctgatttcttcccttc

SEQ ID NO: 910196 - DNA, 25 bp, Mus musculus
tgtgtgcatctgttttcttcccttc

SEQ ID NO: 910197 - DNA, 25 bp, Mus musculus
tgtgtgcatgcacactcgtaagtgc

SEQ ID NO: 910198 - DNA, 25 bp, Mus musculus
tgtgtgcatgcagactcgtaagtgc

SEQ ID NO: 910199 - DNA, 25 bp, Mus musculus
tgtgtgcatgtccacttggacttaa

SEQ ID NO: 910200 - DNA, 25 bp, Mus musculus
tgtgtgcatgtcgacttggacttaa

SEQ ID NO: 910201 - DNA, 25 bp, Mus musculus
tgtgtgccaaggaatcatcgacttc

SEQ ID NO: 910202 - DNA, 25 bp, Mus musculus
tgtgtgccaaggtatcatcgacttc

SEQ ID NO: 910203 - DNA, 25 bp, Mus musculus
tgtgtgccaccgaacactggtggta

SEQ ID NO: 910204 - DNA, 25 bp, Mus musculus
tgtgtgccaccgtacactggtggta

SEQ ID NO: 910205 - DNA, 25 bp, Mus musculus
tgtgtgccacttaagatagaaccag

SEQ ID NO: 910206 - DNA, 25 bp, Mus musculus
tgtgtgccactttagatagaaccag

SEQ ID NO: 910207 - DNA, 25 bp, Mus musculus
tgtgtgccagctataactcctttag

SEQ ID NO: 910208 - DNA, 25 bp, Mus musculus
tgtgtgccagctctggaccaccagc

SEQ ID NO: 910209 - DNA, 25 bp, Mus musculus
tgtgtgccagctgtggaccaccagc

SEQ ID NO: 910210 - DNA, 25 bp, Mus musculus
tgtgtgccagctttaactcctttag

SEQ ID NO: 910211 - DNA, 25 bp, Mus musculus
tgtgtgccatccacgccaagagagt

SEQ ID NO: 910212 - DNA, 25 bp, Mus musculus
tgtgtgccatcctcgccaagagagt

SEQ ID NO: 910213 - DNA, 25 bp, Mus musculus
tgtgtgcccaccaagctgagaccca

SEQ ID NO: 910214 - DNA, 25 bp, Mus musculus
tgtgtgcccacctagctgagaccca

SEQ ID NO: 910215 - DNA, 25 bp, Mus musculus
tgtgtgcccagcctttccaagaaac

SEQ ID NO: 910216 - DNA, 25 bp, Mus musculus
tgtgtgcccagcgtttccaagaaac

SEQ ID NO: 910217 - DNA, 25 bp, Mus musculus
tgtgtgccccaacatttcaaagagg

SEQ ID NO: 910218 - DNA, 25 bp, Mus musculus
tgtgtgccccaagatttcaaagagg

SEQ ID NO: 910219 - DNA, 25 bp, Mus musculus
tgtgtgccccatcccttagaagaag

SEQ ID NO: 910220 - DNA, 25 bp, Mus musculus
tgtgtgccccatgccttagaagaag

SEQ ID NO: 910221 - DNA, 25 bp, Mus musculus
tgtgtgccccggaagtggacatacc

SEQ ID NO: 910222 - DNA, 25 bp, Mus musculus
tgtgtgccccggtagtggacatacc

SEQ ID NO: 910223 - DNA, 25 bp, Mus musculus
tgtgtgcccgcccacactgagggct

SEQ ID NO: 910224 - DNA, 25 bp, Mus musculus
tgtgtgcccgccgacactgagggct

SEQ ID NO: 910225 - DNA, 25 bp, Mus musculus
tgtgtgcccggcagactgcaggttc

SEQ ID NO: 910226 - DNA, 25 bp, Mus musculus
tgtgtgcccggctgactgcaggttc

SEQ ID NO: 910227 - DNA, 25 bp, Mus musculus
tgtgtgccctcaacccaaggctgga

SEQ ID NO: 910228 - DNA, 25 bp, Mus musculus
tgtgtgccctcatcccaaggctgga

SEQ ID NO: 910229 - DNA, 25 bp, Mus musculus
tgtgtgccctgtcgctcctcatgtt

SEQ ID NO: 910230 - DNA, 25 bp, Mus musculus
tgtgtgccctgtggctcctcatgtt

SEQ ID NO: 910231 - DNA, 25 bp, Mus musculus
tgtgtgccctttctggaccacatat

SEQ ID NO: 910232 - DNA, 25 bp, Mus musculus
tgtgtgccctttgtggaccacatat

SEQ ID NO: 910233 - DNA, 25 bp, Mus musculus
tgtgtgccgccaagtttgactaaaa

SEQ ID NO: 910234 - DNA, 25 bp, Mus musculus
tgtgtgccgccatgtttgactaaaa

SEQ ID NO: 910235 - DNA, 25 bp, Mus musculus
tgtgtgccgcgtcagtcatgccgaa

SEQ ID NO: 910236 - DNA, 25 bp, Mus musculus
tgtgtgccgcgtgagtcatgccgaa

SEQ ID NO: 910237 - DNA, 25 bp, Mus musculus
tgtgtgccgttaattcacctgcaga

SEQ ID NO: 910238 - DNA, 25 bp, Mus musculus
tgtgtgccgttatttcacctgcaga

SEQ ID NO: 910239 - DNA, 25 bp, Mus musculus
tgtgtgcctacaaacccagctttta

SEQ ID NO: 910240 - DNA, 25 bp, Mus musculus
tgtgtgcctacatacccagctttta

SEQ ID NO: 910241 - DNA, 25 bp, Mus musculus
tgtgtgcctggcaatacagaagcag

SEQ ID NO: 910242 - DNA, 25 bp, Mus musculus
tgtgtgcctggcactgtaaagcccc

SEQ ID NO: 910243 - DNA, 25 bp, Mus musculus
tgtgtgcctggctatacagaagcag

SEQ ID NO: 910244 - DNA, 25 bp, Mus musculus
tgtgtgcctggctctgtaaagcccc

SEQ ID NO: 910245 - DNA, 25 bp, Mus musculus
tgtgtgcctgtcacagtctgacaga

SEQ ID NO: 910246 - DNA, 25 bp, Mus musculus
tgtgtgcctgtcatcactctgtctt

SEQ ID NO: 910247 - DNA, 25 bp, Mus musculus
tgtgtgcctgtctcagtctgacaga

SEQ ID NO: 910248 - DNA, 25 bp, Mus musculus
tgtgtgcctgtcttcactctgtctt

SEQ ID NO: 910249 - DNA, 25 bp, Mus musculus
tgtgtgcctgtgattctggagctga

SEQ ID NO: 910250 - DNA, 25 bp, Mus musculus
tgtgtgcctgtgcagtcgctgtcat

SEQ ID NO: 910251 - DNA, 25 bp, Mus musculus
tgtgtgcctgtggagtcgctgtcat

SEQ ID NO: 910252 - DNA, 25 bp, Mus musculus
tgtgtgcctgtgtttctggagctga

SEQ ID NO: 910253 - DNA, 25 bp, Mus musculus
tgtgtgcctttgaaaccagattcca

SEQ ID NO: 910254 - DNA, 25 bp, Mus musculus
tgtgtgcctttgtaaccagattcca

SEQ ID NO: 910255 - DNA, 25 bp, Mus musculus
tgtgtgcgaactacccttgtttaac

SEQ ID NO: 910256 - DNA, 25 bp, Mus musculus
tgtgtgcgaacttcccttgtttaac

SEQ ID NO: 910257 - DNA, 25 bp, Mus musculus
tgtgtgcgaccgatgccctgcggct

SEQ ID NO: 910258 - DNA, 25 bp, Mus musculus
tgtgtgcgaccgttgccctgcggct

SEQ ID NO: 910259 - DNA, 25 bp, Mus musculus
tgtgtgcgacgtcgagagatttaat

SEQ ID NO: 910260 - DNA, 25 bp, Mus musculus
tgtgtgcgacgtggagagatttaat

SEQ ID NO: 910261 - DNA, 25 bp, Mus musculus
tgtgtgcgagcgacatgatgctgct

SEQ ID NO: 910262 - DNA, 25 bp, Mus musculus
tgtgtgcgagcgtcatgatgctgct

SEQ ID NO: 910263 - DNA, 25 bp, Mus musculus
tgtgtgcgcatgagtttacgcatgt

SEQ ID NO: 910264 - DNA, 25 bp, Mus musculus
tgtgtgcgcatgtgtttacgcatgt

SEQ ID NO: 910265 - DNA, 25 bp, Mus musculus
tgtgtgcgcattaatcattggatct

SEQ ID NO: 910266 - DNA, 25 bp, Mus musculus
tgtgtgcgcatttatcattggatct

SEQ ID NO: 910267 - DNA, 25 bp, Mus musculus
tgtgtgcgcgcaaggctctacagaa

SEQ ID NO: 910268 - DNA, 25 bp, Mus musculus
tgtgtgcgcgcatggctctacagaa

SEQ ID NO: 910269 - DNA, 25 bp, Mus musculus
tgtgtgcggccaacagattaaatct

SEQ ID NO: 910270 - DNA, 25 bp, Mus musculus
tgtgtgcggccatcagattaaatct

SEQ ID NO: 910271 - DNA, 25 bp, Mus musculus
tgtgtgcgtctgacttgggcctcca

SEQ ID NO: 910272 - DNA, 25 bp, Mus musculus
tgtgtgcgtctgtcttgggcctcca

SEQ ID NO: 910273 - DNA, 25 bp, Mus musculus
tgtgtgcgtgtcactgaacttggaa

SEQ ID NO: 910274 - DNA, 25 bp, Mus musculus
tgtgtgcgtgtctctgaacttggaa

SEQ ID NO: 910275 - DNA, 25 bp, Mus musculus
tgtgtgctaccacccggaccatctg

SEQ ID NO: 910276 - DNA, 25 bp, Mus musculus
tgtgtgctaccagccggaccatctg

SEQ ID NO: 910277 - DNA, 25 bp, Mus musculus
tgtgtgctaggcaacacgctgagca

SEQ ID NO: 910278 - DNA, 25 bp, Mus musculus
tgtgtgctaggctacacgctgagca

SEQ ID NO: 910279 - DNA, 25 bp, Mus musculus
tgtgtgctcacgactgggttcttgc

SEQ ID NO: 910280 - DNA, 25 bp, Mus musculus
tgtgtgctcacgtctgggttcttgc

SEQ ID NO: 910281 - DNA, 25 bp, Mus musculus
tgtgtgctcactcggtaagcagtcc

SEQ ID NO: 910282 - DNA, 25 bp, Mus musculus
tgtgtgctcactgggtaagcagtcc

SEQ ID NO: 910283 - DNA, 25 bp, Mus musculus
tgtgtgctctcacccagaatctcta

SEQ ID NO: 910284 - DNA, 25 bp, Mus musculus
tgtgtgctctcagccagaatctcta

SEQ ID NO: 910285 - DNA, 25 bp, Mus musculus
tgtgtgctctgtcaaaatacccaaa

SEQ ID NO: 910286 - DNA, 25 bp, Mus musculus
tgtgtgctctgtgaaaatacccaaa

SEQ ID NO: 910287 - DNA, 25 bp, Mus musculus
tgtgtgctcttaagacttgtgtcaa

SEQ ID NO: 910288 - DNA, 25 bp, Mus musculus
tgtgtgctcttatgacttgtgtcaa

SEQ ID NO: 910289 - DNA, 25 bp, Mus musculus
tgtgtgctgatgacctttttcccca

SEQ ID NO: 910290 - DNA, 25 bp, Mus musculus
tgtgtgctgatgtcctttttcccca

SEQ ID NO: 910291 - DNA, 25 bp, Mus musculus
tgtgtgctgcacatttgaattcccc

SEQ ID NO: 910292 - DNA, 25 bp, Mus musculus
tgtgtgctgcacttttgaattcccc

SEQ ID NO: 910293 - DNA, 25 bp, Mus musculus
tgtgtgctgcagaaagtccctcttt

SEQ ID NO: 910294 - DNA, 25 bp, Mus musculus
tgtgtgctgcagtaagtccctcttt

SEQ ID NO: 910295 - DNA, 25 bp, Mus musculus
tgtgtgctgcgcaggctatgaagtt

SEQ ID NO: 910296 - DNA, 25 bp, Mus musculus
tgtgtgctgcgctggctatgaagtt

SEQ ID NO: 910297 - DNA, 25 bp, Mus musculus
tgtgtgctggctcagtttataattc

SEQ ID NO: 910298 - DNA, 25 bp, Mus musculus
tgtgtgctggctgagtttataattc

SEQ ID NO: 910299 - DNA, 25 bp, Mus musculus
tgtgtgctggtgagcttgatcatgc

SEQ ID NO: 910300 - DNA, 25 bp, Mus musculus
tgtgtgctggtgtgcttgatcatgc

SEQ ID NO: 910301 - DNA, 25 bp, Mus musculus
tgtgtgctgtaaaccacaaggtaga

SEQ ID NO: 910302 - DNA, 25 bp, Mus musculus
tgtgtgctgtaatccacaaggtaga

SEQ ID NO: 910303 - DNA, 25 bp, Mus musculus
tgtgtgctgtccagacaccaggtga

SEQ ID NO: 910304 - DNA, 25 bp, Mus musculus
tgtgtgctgtcctgacaccaggtga

SEQ ID NO: 910305 - DNA, 25 bp, Mus musculus
tgtgtgctgttactgtggtagccct

SEQ ID NO: 910306 - DNA, 25 bp, Mus musculus
tgtgtgctgttagtgtggtagccct

SEQ ID NO: 910307 - DNA, 25 bp, Mus musculus
tgtgtgcttgtaatgtctctgcaat

SEQ ID NO: 910308 - DNA, 25 bp, Mus musculus
tgtgtgcttgtattgtctctgcaat

SEQ ID NO: 910309 - DNA, 25 bp, Mus musculus
tgtgtgcttgtgatctcctcagcaa

SEQ ID NO: 910310 - DNA, 25 bp, Mus musculus
tgtgtgcttgtgttctcctcagcaa

SEQ ID NO: 910311 - DNA, 25 bp, Mus musculus
tgtgtgctttggacttgctttagga

SEQ ID NO: 910312 - DNA, 25 bp, Mus musculus
tgtgtgctttggtcttgctttagga

SEQ ID NO: 910313 - DNA, 25 bp, Mus musculus
tgtgtgcttttacctatgacccttg

SEQ ID NO: 910314 - DNA, 25 bp, Mus musculus
tgtgtgcttttagctatgacccttg

SEQ ID NO: 910315 - DNA, 25 bp, Mus musculus
tgtgtggaaatccacccagaggccc

SEQ ID NO: 910316 - DNA, 25 bp, Mus musculus
tgtgtggaaatcgacccagaggccc

SEQ ID NO: 910317 - DNA, 25 bp, Mus musculus
tgtgtggaagcaactgcaccttgca

SEQ ID NO: 910318 - DNA, 25 bp, Mus musculus
tgtgtggaagcatctgcaccttgca

SEQ ID NO: 910319 - DNA, 25 bp, Mus musculus
tgtgtggaatgtacccccagaggaa

SEQ ID NO: 910320 - DNA, 25 bp, Mus musculus
tgtgtggaatgttcccccagaggaa

SEQ ID NO: 910321 - DNA, 25 bp, Mus musculus
tgtgtggacactatacagcatgccc

SEQ ID NO: 910322 - DNA, 25 bp, Mus musculus
tgtgtggacactttacagcatgccc

SEQ ID NO: 910323 - DNA, 25 bp, Mus musculus
tgtgtggacagtccctttcccaagg

SEQ ID NO: 910324 - DNA, 25 bp, Mus musculus
tgtgtggacagtgcctttcccaagg

SEQ ID NO: 910325 - DNA, 25 bp, Mus musculus
tgtgtggactgaagccgacgcctac

SEQ ID NO: 910326 - DNA, 25 bp, Mus musculus
tgtgtggactgaccctcgctctatc

SEQ ID NO: 910327 - DNA, 25 bp, Mus musculus
tgtgtggactgagcctcgctctatc

SEQ ID NO: 910328 - DNA, 25 bp, Mus musculus
tgtgtggactgatgccgacgcctac

SEQ ID NO: 910329 - DNA, 25 bp, Mus musculus
tgtgtggagaatcccatccgtaccc

SEQ ID NO: 910330 - DNA, 25 bp, Mus musculus
tgtgtggagaatgccatccgtaccc

SEQ ID NO: 910331 - DNA, 25 bp, Mus musculus
tgtgtggaggccaagccagacctga

SEQ ID NO: 910332 - DNA, 25 bp, Mus musculus
tgtgtggaggcctagccagacctga

SEQ ID NO: 910333 - DNA, 25 bp, Mus musculus
tgtgtggatcacctggcagtagcat

SEQ ID NO: 910334 - DNA, 25 bp, Mus musculus
tgtgtggatcacgtggcagtagcat

SEQ ID NO: 910335 - DNA, 25 bp, Mus musculus
tgtgtggatcatagtggccgttctc

SEQ ID NO: 910336 - DNA, 25 bp, Mus musculus
tgtgtggatcattgtggccgttctc

SEQ ID NO: 910337 - DNA, 25 bp, Mus musculus
tgtgtggatctcagtcataacaagc

SEQ ID NO: 910338 - DNA, 25 bp, Mus musculus
tgtgtggatctctgtcataacaagc

SEQ ID NO: 910339 - DNA, 25 bp, Mus musculus
tgtgtggatgccagtaacctcatgg

SEQ ID NO: 910340 - DNA, 25 bp, Mus musculus
tgtgtggatgcctgtaacctcatgg

SEQ ID NO: 910341 - DNA, 25 bp, Mus musculus
tgtgtggatttcagtggttttaacc

SEQ ID NO: 910342 - DNA, 25 bp, Mus musculus
tgtgtggatttctgtggttttaacc

SEQ ID NO: 910343 - DNA, 25 bp, Mus musculus
tgtgtggcaagaatagctttgagct

SEQ ID NO: 910344 - DNA, 25 bp, Mus musculus
tgtgtggcaagattagctttgagct

SEQ ID NO: 910345 - DNA, 25 bp, Mus musculus
tgtgtggcaatcagggctggtaata

SEQ ID NO: 910346 - DNA, 25 bp, Mus musculus
tgtgtggcaatctgggctggtaata

SEQ ID NO: 910347 - DNA, 25 bp, Mus musculus
tgtgtggcactaagagtgacctgct

SEQ ID NO: 910348 - DNA, 25 bp, Mus musculus
tgtgtggcactatgagtgacctgct

SEQ ID NO: 910349 - DNA, 25 bp, Mus musculus
tgtgtggcagcacctgagtctcctg

SEQ ID NO: 910350 - DNA, 25 bp, Mus musculus
tgtgtggcagcagctgagtctcctg

SEQ ID NO: 910351 - DNA, 25 bp, Mus musculus
tgtgtggcagctagaatgattccgg

SEQ ID NO: 910352 - DNA, 25 bp, Mus musculus
tgtgtggcagcttgaatgattccgg

SEQ ID NO: 910353 - DNA, 25 bp, Mus musculus
tgtgtggcatacatggatacctcat

SEQ ID NO: 910354 - DNA, 25 bp, Mus musculus
tgtgtggcatacttggatacctcat

SEQ ID NO: 910355 - DNA, 25 bp, Mus musculus
tgtgtggcatcactagtgctgggta

SEQ ID NO: 910356 - DNA, 25 bp, Mus musculus
tgtgtggcatcagtagtgctgggta

SEQ ID NO: 910357 - DNA, 25 bp, Mus musculus
tgtgtggccagtcagcgtctgtcac

SEQ ID NO: 910358 - DNA, 25 bp, Mus musculus
tgtgtggccagtgagcgtctgtcac

SEQ ID NO: 910359 - DNA, 25 bp, Mus musculus
tgtgtggcccagaactattctgtta

SEQ ID NO: 910360 - DNA, 25 bp, Mus musculus
tgtgtggcccagtactattctgtta

SEQ ID NO: 910361 - DNA, 25 bp, Mus musculus
tgtgtggccccaagtatcttgtcaa

SEQ ID NO: 910362 - DNA, 25 bp, Mus musculus
tgtgtggccccatgtatcttgtcaa

SEQ ID NO: 910363 - DNA, 25 bp, Mus musculus
tgtgtggcccgaaatcttgatactc

SEQ ID NO: 910364 - DNA, 25 bp, Mus musculus
tgtgtggcccgatatcttgatactc

SEQ ID NO: 910365 - DNA, 25 bp, Mus musculus
tgtgtggcctcaagcttaagctgaa

SEQ ID NO: 910366 - DNA, 25 bp, Mus musculus
tgtgtggcctcatgcttaagctgaa

SEQ ID NO: 910367 - DNA, 25 bp, Mus musculus
tgtgtggcctccattggtaagtagg

SEQ ID NO: 910368 - DNA, 25 bp, Mus musculus
tgtgtggcctcctttggtaagtagg

SEQ ID NO: 910369 - DNA, 25 bp, Mus musculus
tgtgtggccttaacaatccctgtca

SEQ ID NO: 910370 - DNA, 25 bp, Mus musculus
tgtgtggccttatcaatccctgtca

SEQ ID NO: 910371 - DNA, 25 bp, Mus musculus
tgtgtggcgcacatgtatgcacgcc

SEQ ID NO: 910372 - DNA, 25 bp, Mus musculus
tgtgtggcgcacttgtatgcacgcc

SEQ ID NO: 910373 - DNA, 25 bp, Mus musculus
tgtgtggcgcccagacatctacttt

SEQ ID NO: 910374 - DNA, 25 bp, Mus musculus
tgtgtggcgccctgacatctacttt

SEQ ID NO: 910375 - DNA, 25 bp, Mus musculus
tgtgtggctagcaaagtccatccct

SEQ ID NO: 910376 - DNA, 25 bp, Mus musculus
tgtgtggctagctaagtccatccct

SEQ ID NO: 910377 - DNA, 25 bp, Mus musculus
tgtgtggctcatccttttgttgtat

SEQ ID NO: 910378 - DNA, 25 bp, Mus musculus
tgtgtggctcatgcttttgttgtat

SEQ ID NO: 910379 - DNA, 25 bp, Mus musculus
tgtgtggctccgaatcagtgccagt

SEQ ID NO: 910380 - DNA, 25 bp, Mus musculus
tgtgtggctccgtatcagtgccagt

SEQ ID NO: 910381 - DNA, 25 bp, Mus musculus
tgtgtggctgccctattttacctca

SEQ ID NO: 910382 - DNA, 25 bp, Mus musculus
tgtgtggctgccgtattttacctca

SEQ ID NO: 910383 - DNA, 25 bp, Mus musculus
tgtgtggctggaaattcttagattc

SEQ ID NO: 910384 - DNA, 25 bp, Mus musculus
tgtgtggctggatattcttagattc

SEQ ID NO: 910385 - DNA, 25 bp, Mus musculus
tgtgtggctggtacccatggagacc

SEQ ID NO: 910386 - DNA, 25 bp, Mus musculus
tgtgtggctggttcccatggagacc

SEQ ID NO: 910387 - DNA, 25 bp, Mus musculus
tgtgtggcttttcaaacctcagaag

SEQ ID NO: 910388 - DNA, 25 bp, Mus musculus
tgtgtggcttttgaaacctcagaag

SEQ ID NO: 910389 - DNA, 25 bp, Mus musculus
tgtgtgggaactcaggcacccttac

SEQ ID NO: 910390 - DNA, 25 bp, Mus musculus
tgtgtgggaactgaggcacccttac

SEQ ID NO: 910391 - DNA, 25 bp, Mus musculus
tgtgtgggaggacctaccccatgaa

SEQ ID NO: 910392 - DNA, 25 bp, Mus musculus
tgtgtgggaggagctaccccatgaa

SEQ ID NO: 910393 - DNA, 25 bp, Mus musculus
tgtgtgggcactcccacgtggttct

SEQ ID NO: 910394 - DNA, 25 bp, Mus musculus
tgtgtgggcactgccacgtggttct

SEQ ID NO: 910395 - DNA, 25 bp, Mus musculus
tgtgtgggctcccacatatacatac

SEQ ID NO: 910396 - DNA, 25 bp, Mus musculus
tgtgtgggctccgacatatacatac

SEQ ID NO: 910397 - DNA, 25 bp, Mus musculus
tgtgtgggtagcattacccgagcca

SEQ ID NO: 910398 - DNA, 25 bp, Mus musculus
tgtgtgggtagctttacccgagcca

SEQ ID NO: 910399 - DNA, 25 bp, Mus musculus
tgtgtgggtatcagtgcctgtgcca

SEQ ID NO: 910400 - DNA, 25 bp, Mus musculus
tgtgtgggtatctgtgcctgtgcca

SEQ ID NO: 910401 - DNA, 25 bp, Mus musculus
tgtgtgggtctcagacagcaatttt

SEQ ID NO: 910402 - DNA, 25 bp, Mus musculus
tgtgtgggtctctgacagcaatttt

SEQ ID NO: 910403 - DNA, 25 bp, Mus musculus
tgtgtgggtgcccagtctctagatc

SEQ ID NO: 910404 - DNA, 25 bp, Mus musculus
tgtgtgggtgccgagtctctagatc

SEQ ID NO: 910405 - DNA, 25 bp, Mus musculus
tgtgtgggtgttaatgtgcatttgc

SEQ ID NO: 910406 - DNA, 25 bp, Mus musculus
tgtgtgggtgtttatgtgcatttgc

SEQ ID NO: 910407 - DNA, 25 bp, Mus musculus
tgtgtgggttccaagaaggccctac

SEQ ID NO: 910408 - DNA, 25 bp, Mus musculus
tgtgtgggttcctagaaggccctac

SEQ ID NO: 910409 - DNA, 25 bp, Mus musculus
tgtgtggtaatgctgttttccctta

SEQ ID NO: 910410 - DNA, 25 bp, Mus musculus
tgtgtggtaatggtgttttccctta

SEQ ID NO: 910411 - DNA, 25 bp, Mus musculus
tgtgtggtacacatctaagcaaaca

SEQ ID NO: 910412 - DNA, 25 bp, Mus musculus
tgtgtggtacacttctaagcaaaca

SEQ ID NO: 910413 - DNA, 25 bp, Mus musculus
tgtgtggtactcatgaaggccagaa

SEQ ID NO: 910414 - DNA, 25 bp, Mus musculus
tgtgtggtactcttgaaggccagaa

SEQ ID NO: 910415 - DNA, 25 bp, Mus musculus
tgtgtggtatgccatctctctctct

SEQ ID NO: 910416 - DNA, 25 bp, Mus musculus
tgtgtggtatgcgatctctctctct

SEQ ID NO: 910417 - DNA, 25 bp, Mus musculus
tgtgtggtatttatgcctttagaaa

SEQ ID NO: 910418 - DNA, 25 bp, Mus musculus
tgtgtggtatttttgcctttagaaa

SEQ ID NO: 910419 - DNA, 25 bp, Mus musculus
tgtgtggtccagaatcctcagtaag

SEQ ID NO: 910420 - DNA, 25 bp, Mus musculus
tgtgtggtccagtatcctcagtaag

SEQ ID NO: 910421 - DNA, 25 bp, Mus musculus
tgtgtggtctggctcgttgcttttc

SEQ ID NO: 910422 - DNA, 25 bp, Mus musculus
tgtgtggtctgggtcgttgcttttc

SEQ ID NO: 910423 - DNA, 25 bp, Mus musculus
tgtgtggtctgtatattgttcctga

SEQ ID NO: 910424 - DNA, 25 bp, Mus musculus
tgtgtggtctgtttattgttcctga

SEQ ID NO: 910425 - DNA, 25 bp, Mus musculus
tgtgtggtgatgaccatttgtcgga

SEQ ID NO: 910426 - DNA, 25 bp, Mus musculus
tgtgtggtgatgtccatttgtcgga

SEQ ID NO: 910427 - DNA, 25 bp, Mus musculus
tgtgtggtgcacaagctcccacatg

SEQ ID NO: 910428 - DNA, 25 bp, Mus musculus
tgtgtggtgcactagctcccacatg

SEQ ID NO: 910429 - DNA, 25 bp, Mus musculus
tgtgtggtggtgctaacatctttat

SEQ ID NO: 910430 - DNA, 25 bp, Mus musculus
tgtgtggtggtggtaacatctttat

SEQ ID NO: 910431 - DNA, 25 bp, Mus musculus
tgtgtggtgttcatggtttttcaga

SEQ ID NO: 910432 - DNA, 25 bp, Mus musculus
tgtgtggtgttcttggtttttcaga

SEQ ID NO: 910433 - DNA, 25 bp, Mus musculus
tgtgtggtttcaacttcctaaatca

SEQ ID NO: 910434 - DNA, 25 bp, Mus musculus
tgtgtggtttcatcttcctaaatca

SEQ ID NO: 910435 - DNA, 25 bp, Mus musculus
tgtgtggtttggatactgcacagct

SEQ ID NO: 910436 - DNA, 25 bp, Mus musculus
tgtgtggtttggttactgcacagct

SEQ ID NO: 910437 - DNA, 25 bp, Mus musculus
tgtgtgtaaaagacccaggtcccct

SEQ ID NO: 910438 - DNA, 25 bp, Mus musculus
tgtgtgtaaaagtcccaggtcccct

SEQ ID NO: 910439 - DNA, 25 bp, Mus musculus
tgtgtgtaaataccctgatcatcag

SEQ ID NO: 910440 - DNA, 25 bp, Mus musculus
tgtgtgtaaatagcctgatcatcag

SEQ ID NO: 910441 - DNA, 25 bp, Mus musculus
tgtgtgtaacatatttctcctcact

SEQ ID NO: 910442 - DNA, 25 bp, Mus musculus
tgtgtgtaacatttttctcctcact

SEQ ID NO: 910443 - DNA, 25 bp, Mus musculus
tgtgtgtaactaacaggtgggaaga

SEQ ID NO: 910444 - DNA, 25 bp, Mus musculus
tgtgtgtaactaccctctggcggag

SEQ ID NO: 910445 - DNA, 25 bp, Mus musculus
tgtgtgtaactagcctctggcggag

SEQ ID NO: 910446 - DNA, 25 bp, Mus musculus
tgtgtgtaactatcaggtgggaaga

SEQ ID NO: 910447 - DNA, 25 bp, Mus musculus
tgtgtgtacaaacctagcgcgcagc

SEQ ID NO: 910448 - DNA, 25 bp, Mus musculus
tgtgtgtacaaagctagcgcgcagc

SEQ ID NO: 910449 - DNA, 25 bp, Mus musculus
tgtgtgtacacaaatctgtgcctgt

SEQ ID NO: 910450 - DNA, 25 bp, Mus musculus
tgtgtgtacacatatctgtgcctgt

SEQ ID NO: 910451 - DNA, 25 bp, Mus musculus
tgtgtgtacaccctttctcagagtg

SEQ ID NO: 910452 - DNA, 25 bp, Mus musculus
tgtgtgtacaccgtttctcagagtg

SEQ ID NO: 910453 - DNA, 25 bp, Mus musculus
tgtgtgtacatgagcgacctcagca

SEQ ID NO: 910454 - DNA, 25 bp, Mus musculus
tgtgtgtacatgtgcgacctcagca

SEQ ID NO: 910455 - DNA, 25 bp, Mus musculus
tgtgtgtagatcatttccctctttc

SEQ ID NO: 910456 - DNA, 25 bp, Mus musculus
tgtgtgtagatcttttccctctttc

SEQ ID NO: 910457 - DNA, 25 bp, Mus musculus
tgtgtgtagccaatttgtagagttt

SEQ ID NO: 910458 - DNA, 25 bp, Mus musculus
tgtgtgtagccattttgtagagttt

SEQ ID NO: 910459 - DNA, 25 bp, Mus musculus
tgtgtgtagtgtactgcccatctga

SEQ ID NO: 910460 - DNA, 25 bp, Mus musculus
tgtgtgtagtgttctgcccatctga

SEQ ID NO: 910461 - DNA, 25 bp, Mus musculus
tgtgtgtatatccacctgcctataa

SEQ ID NO: 910462 - DNA, 25 bp, Mus musculus
tgtgtgtatatcgacctgcctataa

SEQ ID NO: 910463 - DNA, 25 bp, Mus musculus
tgtgtgtatcacatacttgtaaata

SEQ ID NO: 910464 - DNA, 25 bp, Mus musculus
tgtgtgtatcacttacttgtaaata

SEQ ID NO: 910465 - DNA, 25 bp, Mus musculus
tgtgtgtatccacacgtacccatag

SEQ ID NO: 910466 - DNA, 25 bp, Mus musculus
tgtgtgtatccagacgtacccatag

SEQ ID NO: 910467 - DNA, 25 bp, Mus musculus
tgtgtgtatgcacgcacctgagtat

SEQ ID NO: 910468 - DNA, 25 bp, Mus musculus
tgtgtgtatgcaggcacctgagtat

SEQ ID NO: 910469 - DNA, 25 bp, Mus musculus
tgtgtgtcaatgagcatctctgatc

SEQ ID NO: 910470 - DNA, 25 bp, Mus musculus
tgtgtgtcaatgtgcatctctgatc

SEQ ID NO: 910471 - DNA, 25 bp, Mus musculus
tgtgtgtcacacacatagctggtgt

SEQ ID NO: 910472 - DNA, 25 bp, Mus musculus
tgtgtgtcacactcatagctggtgt

SEQ ID NO: 910473 - DNA, 25 bp, Mus musculus
tgtgtgtcacagcacccgtcaggac

SEQ ID NO: 910474 - DNA, 25 bp, Mus musculus
tgtgtgtcacagcagccgatgatgt

SEQ ID NO: 910475 - DNA, 25 bp, Mus musculus
tgtgtgtcacaggacccgtcaggac

SEQ ID NO: 910476 - DNA, 25 bp, Mus musculus
tgtgtgtcacaggagccgatgatgt

SEQ ID NO: 910477 - DNA, 25 bp, Mus musculus
tgtgtgtcacatcctcaccattgag

SEQ ID NO: 910478 - DNA, 25 bp, Mus musculus
tgtgtgtcacatgctcaccattgag

SEQ ID NO: 910479 - DNA, 25 bp, Mus musculus
tgtgtgtcactcatggagtagatgt

SEQ ID NO: 910480 - DNA, 25 bp, Mus musculus
tgtgtgtcactcttggagtagatgt

SEQ ID NO: 910481 - DNA, 25 bp, Mus musculus
tgtgtgtcagaaaacagcctcagat

SEQ ID NO: 910482 - DNA, 25 bp, Mus musculus
tgtgtgtcagaatacagcctcagat

SEQ ID NO: 910483 - DNA, 25 bp, Mus musculus
tgtgtgtcagcaacttgcagtagga

SEQ ID NO: 910484 - DNA, 25 bp, Mus musculus
tgtgtgtcagcatcttgcagtagga

SEQ ID NO: 910485 - DNA, 25 bp, Mus musculus
tgtgtgtcagtgaccaagctgcaag

SEQ ID NO: 910486 - DNA, 25 bp, Mus musculus
tgtgtgtcagtgtccaagctgcaag

SEQ ID NO: 910487 - DNA, 25 bp, Mus musculus
tgtgtgtcagttacggccgtgacgt

SEQ ID NO: 910488 - DNA, 25 bp, Mus musculus
tgtgtgtcagtttcggccgtgacgt

SEQ ID NO: 910489 - DNA, 25 bp, Mus musculus
tgtgtgtcatctagctacctaacta

SEQ ID NO: 910490 - DNA, 25 bp, Mus musculus
tgtgtgtcatcttgctacctaacta

SEQ ID NO: 910491 - DNA, 25 bp, Mus musculus
tgtgtgtccacccatggctgagacg

SEQ ID NO: 910492 - DNA, 25 bp, Mus musculus
tgtgtgtccaccgatggctgagacg

SEQ ID NO: 910493 - DNA, 25 bp, Mus musculus
tgtgtgtccagcatcctgcaaaggc

SEQ ID NO: 910494 - DNA, 25 bp, Mus musculus
tgtgtgtccagcttcctgcaaaggc

SEQ ID NO: 910495 - DNA, 25 bp, Mus musculus
tgtgtgtcccgacccattcactggt

SEQ ID NO: 910496 - DNA, 25 bp, Mus musculus
tgtgtgtcccgagccattcactggt

SEQ ID NO: 910497 - DNA, 25 bp, Mus musculus
tgtgtgtcgctgagcaggcctgcct

SEQ ID NO: 910498 - DNA, 25 bp, Mus musculus
tgtgtgtcgctgtgcaggcctgcct

SEQ ID NO: 910499 - DNA, 25 bp, Mus musculus
tgtgtgtctactcaccatcactctc

SEQ ID NO: 910500 - DNA, 25 bp, Mus musculus
tgtgtgtctactgaccatcactctc

SEQ ID NO: 910501 - DNA, 25 bp, Mus musculus
tgtgtgtctggcagccgccctcctg

SEQ ID NO: 910502 - DNA, 25 bp, Mus musculus
tgtgtgtctggctgccgccctcctg

SEQ ID NO: 910503 - DNA, 25 bp, Mus musculus
tgtgtgtctgtgattttaaacttac

SEQ ID NO: 910504 - DNA, 25 bp, Mus musculus
tgtgtgtctgtgtttttaaacttac

SEQ ID NO: 910505 - DNA, 25 bp, Mus musculus
tgtgtgtcttcccttgtgtccatat

SEQ ID NO: 910506 - DNA, 25 bp, Mus musculus
tgtgtgtcttccgttgtgtccatat

SEQ ID NO: 910507 - DNA, 25 bp, Mus musculus
tgtgtgtgacaactggaataaagca

SEQ ID NO: 910508 - DNA, 25 bp, Mus musculus
tgtgtgtgacaagtggaataaagca

SEQ ID NO: 910509 - DNA, 25 bp, Mus musculus
tgtgtgtgaccacctgctagactgg

SEQ ID NO: 910510 - DNA, 25 bp, Mus musculus
tgtgtgtgaccagctgctagactgg

SEQ ID NO: 910511 - DNA, 25 bp, Mus musculus
tgtgtgtgacccagttccaccttct

SEQ ID NO: 910512 - DNA, 25 bp, Mus musculus
tgtgtgtgaccctgttccaccttct

SEQ ID NO: 910513 - DNA, 25 bp, Mus musculus
tgtgtgtgacctcatgtgtccccac

SEQ ID NO: 910514 - DNA, 25 bp, Mus musculus
tgtgtgtgacctgatgtgtccccac

SEQ ID NO: 910515 - DNA, 25 bp, Mus musculus
tgtgtgtgagcacacgtcgcacttc

SEQ ID NO: 910516 - DNA, 25 bp, Mus musculus
tgtgtgtgagcacttacagagttca

SEQ ID NO: 910517 - DNA, 25 bp, Mus musculus
tgtgtgtgagcagacgtcgcacttc

SEQ ID NO: 910518 - DNA, 25 bp, Mus musculus
tgtgtgtgagcagttacagagttca

SEQ ID NO: 910519 - DNA, 25 bp, Mus musculus
tgtgtgtgcccactgctaaagtcca

SEQ ID NO: 910520 - DNA, 25 bp, Mus musculus
tgtgtgtgcccagtgctaaagtcca

SEQ ID NO: 910521 - DNA, 25 bp, Mus musculus
tgtgtgtgcgtaataaaagaatgtt

SEQ ID NO: 910522 - DNA, 25 bp, Mus musculus
tgtgtgtgcgtattaaaagaatgtt

SEQ ID NO: 910523 - DNA, 25 bp, Mus musculus
tgtgtgtgctgtagccttgggaatt

SEQ ID NO: 910524 - DNA, 25 bp, Mus musculus
tgtgtgtgctgttgccttgggaatt

SEQ ID NO: 910525 - DNA, 25 bp, Mus musculus
tgtgtgtggcaaaccagatctgagc

SEQ ID NO: 910526 - DNA, 25 bp, Mus musculus
tgtgtgtggcaatccagatctgagc

SEQ ID NO: 910527 - DNA, 25 bp, Mus musculus
tgtgtgtggcagacagacagataag

SEQ ID NO: 910528 - DNA, 25 bp, Mus musculus
tgtgtgtggcagtcagacagataag

SEQ ID NO: 910529 - DNA, 25 bp, Mus musculus
tgtgtgtggccaacagagcccagga

SEQ ID NO: 910530 - DNA, 25 bp, Mus musculus
tgtgtgtggccatcagagcccagga

SEQ ID NO: 910531 - DNA, 25 bp, Mus musculus
tgtgtgtgggtaaccaccagaccac

SEQ ID NO: 910532 - DNA, 25 bp, Mus musculus
tgtgtgtgggtatccaccagaccac

SEQ ID NO: 910533 - DNA, 25 bp, Mus musculus
tgtgtgtggtagactttcctagccc

SEQ ID NO: 910534 - DNA, 25 bp, Mus musculus
tgtgtgtggtagtctttcctagccc

SEQ ID NO: 910535 - DNA, 25 bp, Mus musculus
tgtgtgtgtaccaaccctatttggg

SEQ ID NO: 910536 - DNA, 25 bp, Mus musculus
tgtgtgtgtaccaatcctggctgta

SEQ ID NO: 910537 - DNA, 25 bp, Mus musculus
tgtgtgtgtacctaccctatttggg

SEQ ID NO: 910538 - DNA, 25 bp, Mus musculus
tgtgtgtgtacctatcctggctgta

SEQ ID NO: 910539 - DNA, 25 bp, Mus musculus
tgtgtgtgtcatcttgtatctgcgc

SEQ ID NO: 910540 - DNA, 25 bp, Mus musculus
tgtgtgtgtcatgttgtatctgcgc

SEQ ID NO: 910541 - DNA, 25 bp, Mus musculus
tgtgtgtgtgcacggatgcactcac

SEQ ID NO: 910542 - DNA, 25 bp, Mus musculus
tgtgtgtgtgcagggatgcactcac

SEQ ID NO: 910543 - DNA, 25 bp, Mus musculus
tgtgtgtgtttcaaccatcggagcc

SEQ ID NO: 910544 - DNA, 25 bp, Mus musculus
tgtgtgtgtttctaccatcggagcc

SEQ ID NO: 910545 - DNA, 25 bp, Mus musculus
tgtgtgttaataagctgcgaaggtc

SEQ ID NO: 910546 - DNA, 25 bp, Mus musculus
tgtgtgttaatatgctgcgaaggtc

SEQ ID NO: 910547 - DNA, 25 bp, Mus musculus
tgtgtgttatcccagcaatggaggc

SEQ ID NO: 910548 - DNA, 25 bp, Mus musculus
tgtgtgttatccgagcaatggaggc

SEQ ID NO: 910549 - DNA, 25 bp, Mus musculus
tgtgtgttcagcaatctcagcccca

SEQ ID NO: 910550 - DNA, 25 bp, Mus musculus
tgtgtgttcagctatctcagcccca

SEQ ID NO: 910551 - DNA, 25 bp, Mus musculus
tgtgtgttcatacttaccctttccc

SEQ ID NO: 910552 - DNA, 25 bp, Mus musculus
tgtgtgttcatagttaccctttccc

SEQ ID NO: 910553 - DNA, 25 bp, Mus musculus
tgtgtgttcccactgttgatgcaag

SEQ ID NO: 910554 - DNA, 25 bp, Mus musculus
tgtgtgttcccagtgttgatgcaag

SEQ ID NO: 910555 - DNA, 25 bp, Mus musculus
tgtgtgttccctataacggttcatc

SEQ ID NO: 910556 - DNA, 25 bp, Mus musculus
tgtgtgttccctttaacggttcatc

SEQ ID NO: 910557 - DNA, 25 bp, Mus musculus
tgtgtgttctacctttctaccatat

SEQ ID NO: 910558 - DNA, 25 bp, Mus musculus
tgtgtgttctacgtttctaccatat

SEQ ID NO: 910559 - DNA, 25 bp, Mus musculus
tgtgtgttctgactcccaagaggct

SEQ ID NO: 910560 - DNA, 25 bp, Mus musculus
tgtgtgttctgagtcccaagaggct

SEQ ID NO: 910561 - DNA, 25 bp, Mus musculus
tgtgtgttcttacggttttccatcc

SEQ ID NO: 910562 - DNA, 25 bp, Mus musculus
tgtgtgttcttagggttttccatcc

SEQ ID NO: 910563 - DNA, 25 bp, Mus musculus
tgtgtgttctttctcatcgactgaa

SEQ ID NO: 910564 - DNA, 25 bp, Mus musculus
tgtgtgttctttgtcatcgactgaa

SEQ ID NO: 910565 - DNA, 25 bp, Mus musculus
tgtgtgttgactaagccctcaccat

SEQ ID NO: 910566 - DNA, 25 bp, Mus musculus
tgtgtgttgacttagccctcaccat

SEQ ID NO: 910567 - DNA, 25 bp, Mus musculus
tgtgtgttgcctagaatgcttgcca

SEQ ID NO: 910568 - DNA, 25 bp, Mus musculus
tgtgtgttgccttgaatgcttgcca

SEQ ID NO: 910569 - DNA, 25 bp, Mus musculus
tgtgtgttgctcatcttaagaagca

SEQ ID NO: 910570 - DNA, 25 bp, Mus musculus
tgtgtgttgctcttcttaagaagca

SEQ ID NO: 910571 - DNA, 25 bp, Mus musculus
tgtgtgttgctgactctcgttcttc

SEQ ID NO: 910572 - DNA, 25 bp, Mus musculus
tgtgtgttgctgtctctcgttcttc

SEQ ID NO: 910573 - DNA, 25 bp, Mus musculus
tgtgtgttgtatattcttcagtctt

SEQ ID NO: 910574 - DNA, 25 bp, Mus musculus
tgtgtgttgtattttcttcagtctt

SEQ ID NO: 910575 - DNA, 25 bp, Mus musculus
tgtgtgtttaggattctgtccccat

SEQ ID NO: 910576 - DNA, 25 bp, Mus musculus
tgtgtgtttaggtttctgtccccat

SEQ ID NO: 910577 - DNA, 25 bp, Mus musculus
tgtgtgtttcctccactcccttgta

SEQ ID NO: 910578 - DNA, 25 bp, Mus musculus
tgtgtgtttcctgcactcccttgta

SEQ ID NO: 910579 - DNA, 25 bp, Mus musculus
tgtgtgtttctacatgcagcctata

SEQ ID NO: 910580 - DNA, 25 bp, Mus musculus
tgtgtgtttctagatgcagcctata

SEQ ID NO: 910581 - DNA, 25 bp, Mus musculus
tgtgtgtttgaaccgccgacagaaa

SEQ ID NO: 910582 - DNA, 25 bp, Mus musculus
tgtgtgtttgaagcgccgacagaaa

SEQ ID NO: 910583 - DNA, 25 bp, Mus musculus
tgtgtgtttgtaatagagctctctt

SEQ ID NO: 910584 - DNA, 25 bp, Mus musculus
tgtgtgtttgtattagagctctctt

SEQ ID NO: 910585 - DNA, 25 bp, Mus musculus
tgtgtgtttgtgacctgtaatgata

SEQ ID NO: 910586 - DNA, 25 bp, Mus musculus
tgtgtgtttgtgtcctgtaatgata

SEQ ID NO: 910587 - DNA, 25 bp, Mus musculus
tgtgtgtttgttacctgggttttat

SEQ ID NO: 910588 - DNA, 25 bp, Mus musculus
tgtgtgtttgtttcctgggttttat

SEQ ID NO: 910589 - DNA, 25 bp, Mus musculus
tgtgtgttttctatccaggtgacaa

SEQ ID NO: 910590 - DNA, 25 bp, Mus musculus
tgtgtgttttctttccaggtgacaa

SEQ ID NO: 910591 - DNA, 25 bp, Mus musculus
tgtgttaacactagtcacactgcag

SEQ ID NO: 910592 - DNA, 25 bp, Mus musculus
tgtgttaacacttgtcacactgcag

SEQ ID NO: 910593 - DNA, 25 bp, Mus musculus
tgtgttaacctaccaggtgccaact

SEQ ID NO: 910594 - DNA, 25 bp, Mus musculus
tgtgttaacctagcaggtgccaact

SEQ ID NO: 910595 - DNA, 25 bp, Mus musculus
tgtgttaactagagtccttttccct

SEQ ID NO: 910596 - DNA, 25 bp, Mus musculus
tgtgttaactagtgtccttttccct

SEQ ID NO: 910597 - DNA, 25 bp, Mus musculus
tgtgttaagattcttcccagaggcc

SEQ ID NO: 910598 - DNA, 25 bp, Mus musculus
tgtgttaagattgttcccagaggcc

SEQ ID NO: 910599 - DNA, 25 bp, Mus musculus
tgtgttaagtgcctcatccttcaac

SEQ ID NO: 910600 - DNA, 25 bp, Mus musculus
tgtgttaagtgcgtcatccttcaac

SEQ ID NO: 910601 - DNA, 25 bp, Mus musculus
tgtgttaatagcattcatcatggaa

SEQ ID NO: 910602 - DNA, 25 bp, Mus musculus
tgtgttaatagctttcatcatggaa

SEQ ID NO: 910603 - DNA, 25 bp, Mus musculus
tgtgttaatgcgctgcagccagtgt

SEQ ID NO: 910604 - DNA, 25 bp, Mus musculus
tgtgttaatgcggtgcagccagtgt

SEQ ID NO: 910605 - DNA, 25 bp, Mus musculus
tgtgttacaaggacccagctgagct

SEQ ID NO: 910606 - DNA, 25 bp, Mus musculus
tgtgttacaaggtcccagctgagct

SEQ ID NO: 910607 - DNA, 25 bp, Mus musculus
tgtgttacagcccttcgaatgtgta

SEQ ID NO: 910608 - DNA, 25 bp, Mus musculus
tgtgttacagccgttcgaatgtgta

SEQ ID NO: 910609 - DNA, 25 bp, Mus musculus
tgtgttacatgacggcctgcacaac

SEQ ID NO: 910610 - DNA, 25 bp, Mus musculus
tgtgttacatgagggcctgcacaac

SEQ ID NO: 910611 - DNA, 25 bp, Mus musculus
tgtgttaccactccctcatcaggag

SEQ ID NO: 910612 - DNA, 25 bp, Mus musculus
tgtgttaccactgcctcatcaggag

SEQ ID NO: 910613 - DNA, 25 bp, Mus musculus
tgtgttaccctgctcttttctattt

SEQ ID NO: 910614 - DNA, 25 bp, Mus musculus
tgtgttaccctggtcttttctattt

SEQ ID NO: 910615 - DNA, 25 bp, Mus musculus
tgtgttagagttcaccgaccgtggt

SEQ ID NO: 910616 - DNA, 25 bp, Mus musculus
tgtgttagagttgaccgaccgtggt

SEQ ID NO: 910617 - DNA, 25 bp, Mus musculus
tgtgttagcagtacttggcctcctt

SEQ ID NO: 910618 - DNA, 25 bp, Mus musculus
tgtgttagcagttcttggcctcctt

SEQ ID NO: 910619 - DNA, 25 bp, Mus musculus
tgtgttagcctaaagcagcggtgtg

SEQ ID NO: 910620 - DNA, 25 bp, Mus musculus
tgtgttagcctatagcagcggtgtg

SEQ ID NO: 910621 - DNA, 25 bp, Mus musculus
tgtgttagctctaccttttccttag

SEQ ID NO: 910622 - DNA, 25 bp, Mus musculus
tgtgttagctcttccttttccttag

SEQ ID NO: 910623 - DNA, 25 bp, Mus musculus
tgtgttaggtggacttaaatcccaa

SEQ ID NO: 910624 - DNA, 25 bp, Mus musculus
tgtgttaggtggtcttaaatcccaa

SEQ ID NO: 910625 - DNA, 25 bp, Mus musculus
tgtgttagtacactgttctattgct

SEQ ID NO: 910626 - DNA, 25 bp, Mus musculus
tgtgttagtacagtgttctattgct

SEQ ID NO: 910627 - DNA, 25 bp, Mus musculus
tgtgttatacttacgctctctgcaa

SEQ ID NO: 910628 - DNA, 25 bp, Mus musculus
tgtgttatactttcgctctctgcaa

SEQ ID NO: 910629 - DNA, 25 bp, Mus musculus
tgtgttatatcacgactcttacttc

SEQ ID NO: 910630 - DNA, 25 bp, Mus musculus
tgtgttatatcaggactcttacttc

SEQ ID NO: 910631 - DNA, 25 bp, Mus musculus
tgtgttatcagtcgttggtgtgaca

SEQ ID NO: 910632 - DNA, 25 bp, Mus musculus
tgtgttatcagtggttggtgtgaca

SEQ ID NO: 910633 - DNA, 25 bp, Mus musculus
tgtgttatctatcatgtttgcttta

SEQ ID NO: 910634 - DNA, 25 bp, Mus musculus
tgtgttatctatgatgtttgcttta

SEQ ID NO: 910635 - DNA, 25 bp, Mus musculus
tgtgttatgaaacgcgtgacttcca

SEQ ID NO: 910636 - DNA, 25 bp, Mus musculus
tgtgttatgaaaggcgtgacttcca

SEQ ID NO: 910637 - DNA, 25 bp, Mus musculus
tgtgttatgcctactggtctctgta

SEQ ID NO: 910638 - DNA, 25 bp, Mus musculus
tgtgttatgccttctggtctctgta

SEQ ID NO: 910639 - DNA, 25 bp, Mus musculus
tgtgttatgtctagtgaacctcaaa

SEQ ID NO: 910640 - DNA, 25 bp, Mus musculus
tgtgttatgtcttgtgaacctcaaa

SEQ ID NO: 910641 - DNA, 25 bp, Mus musculus
tgtgttcaaatgatcttcttctgtt

SEQ ID NO: 910642 - DNA, 25 bp, Mus musculus
tgtgttcaaatgttcttcttctgtt

SEQ ID NO: 910643 - DNA, 25 bp, Mus musculus
tgtgttcaacctcatccacgtggta

SEQ ID NO: 910644 - DNA, 25 bp, Mus musculus
tgtgttcaacctgatccacgtggta

SEQ ID NO: 910645 - DNA, 25 bp, Mus musculus
tgtgttcaacttactatccccagga

SEQ ID NO: 910646 - DNA, 25 bp, Mus musculus
tgtgttcaactttctatccccagga

SEQ ID NO: 910647 - DNA, 25 bp, Mus musculus
tgtgttcaagccatttaattccctt

SEQ ID NO: 910648 - DNA, 25 bp, Mus musculus
tgtgttcaagccttttaattccctt

SEQ ID NO: 910649 - DNA, 25 bp, Mus musculus
tgtgttcaatccctactatcgtggg

SEQ ID NO: 910650 - DNA, 25 bp, Mus musculus
tgtgttcaatccgtactatcgtggg

SEQ ID NO: 910651 - DNA, 25 bp, Mus musculus
tgtgttcacaccagagggagatggt

SEQ ID NO: 910652 - DNA, 25 bp, Mus musculus
tgtgttcacacctgagggagatggt

SEQ ID NO: 910653 - DNA, 25 bp, Mus musculus
tgtgttcacagcatttgacctaacc

SEQ ID NO: 910654 - DNA, 25 bp, Mus musculus
tgtgttcacagccagtttcctcatc

SEQ ID NO: 910655 - DNA, 25 bp, Mus musculus
tgtgttcacagcgagtttcctcatc

SEQ ID NO: 910656 - DNA, 25 bp, Mus musculus
tgtgttcacagcttttgacctaacc

SEQ ID NO: 910657 - DNA, 25 bp, Mus musculus
tgtgttcacatgcacatagcaaggt

SEQ ID NO: 910658 - DNA, 25 bp, Mus musculus
tgtgttcacatggacatagcaaggt

SEQ ID NO: 910659 - DNA, 25 bp, Mus musculus
tgtgttcaccctaaaatcctcttga

SEQ ID NO: 910660 - DNA, 25 bp, Mus musculus
tgtgttcacccttaaatcctcttga

SEQ ID NO: 910661 - DNA, 25 bp, Mus musculus
tgtgttcaccttcctcccatggatg

SEQ ID NO: 910662 - DNA, 25 bp, Mus musculus
tgtgttcaccttgctcccatggatg

SEQ ID NO: 910663 - DNA, 25 bp, Mus musculus
tgtgttcacgtcagtttgtttcata

SEQ ID NO: 910664 - DNA, 25 bp, Mus musculus
tgtgttcacgtctgtttgtttcata

SEQ ID NO: 910665 - DNA, 25 bp, Mus musculus
tgtgttcacgtgacaacagctgtga

SEQ ID NO: 910666 - DNA, 25 bp, Mus musculus
tgtgttcacgtgtcaacagctgtga

SEQ ID NO: 910667 - DNA, 25 bp, Mus musculus
tgtgttcactgccagctgacaaaag

SEQ ID NO: 910668 - DNA, 25 bp, Mus musculus
tgtgttcactgcgagctgacaaaag

SEQ ID NO: 910669 - DNA, 25 bp, Mus musculus
tgtgttcaggagagggcccaccgaa

SEQ ID NO: 910670 - DNA, 25 bp, Mus musculus
tgtgttcaggagtgggcccaccgaa

SEQ ID NO: 910671 - DNA, 25 bp, Mus musculus
tgtgttcagggtaagcgcccatgaa

SEQ ID NO: 910672 - DNA, 25 bp, Mus musculus
tgtgttcagggttagcgcccatgaa

SEQ ID NO: 910673 - DNA, 25 bp, Mus musculus
tgtgttcatattccccatttaccct

SEQ ID NO: 910674 - DNA, 25 bp, Mus musculus
tgtgttcatattgcccatttaccct

SEQ ID NO: 910675 - DNA, 25 bp, Mus musculus
tgtgttcatcaaactcctcagtgat

SEQ ID NO: 910676 - DNA, 25 bp, Mus musculus
tgtgttcatcaatctcctcagtgat

SEQ ID NO: 910677 - DNA, 25 bp, Mus musculus
tgtgttcatggaaaggactccctta

SEQ ID NO: 910678 - DNA, 25 bp, Mus musculus
tgtgttcatggataggactccctta

SEQ ID NO: 910679 - DNA, 25 bp, Mus musculus
tgtgttccaactcaatttattttgg

SEQ ID NO: 910680 - DNA, 25 bp, Mus musculus
tgtgttccaactgaatttattttgg

SEQ ID NO: 910681 - DNA, 25 bp, Mus musculus
tgtgttccaccgcttgggctgctgc

SEQ ID NO: 910682 - DNA, 25 bp, Mus musculus
tgtgttccaccggttgggctgctgc

SEQ ID NO: 910683 - DNA, 25 bp, Mus musculus
tgtgttccactaagagcaactctca

SEQ ID NO: 910684 - DNA, 25 bp, Mus musculus
tgtgttccactatgagcaactctca

SEQ ID NO: 910685 - DNA, 25 bp, Mus musculus
tgtgttccagacagacttccaggac

SEQ ID NO: 910686 - DNA, 25 bp, Mus musculus
tgtgttccagactgacttccaggac

SEQ ID NO: 910687 - DNA, 25 bp, Mus musculus
tgtgttccagcaattctgtgctctg

SEQ ID NO: 910688 - DNA, 25 bp, Mus musculus
tgtgttccagcatttctgtgctctg

SEQ ID NO: 910689 - DNA, 25 bp, Mus musculus
tgtgttcccacacacgggcagcatg

SEQ ID NO: 910690 - DNA, 25 bp, Mus musculus
tgtgttcccacagacgggcagcatg

SEQ ID NO: 910691 - DNA, 25 bp, Mus musculus
tgtgttccccacaaaatacggcaga

SEQ ID NO: 910692 - DNA, 25 bp, Mus musculus
tgtgttccccactaaatacggcaga

SEQ ID NO: 910693 - DNA, 25 bp, Mus musculus
tgtgttcccctcaggctgacagtga

SEQ ID NO: 910694 - DNA, 25 bp, Mus musculus
tgtgttcccctctggctgacagtga

SEQ ID NO: 910695 - DNA, 25 bp, Mus musculus
tgtgttccccttaaattggccttat

SEQ ID NO: 910696 - DNA, 25 bp, Mus musculus
tgtgttcccctttaattggccttat

SEQ ID NO: 910697 - DNA, 25 bp, Mus musculus
tgtgttccctcaccggaaaacagtt

SEQ ID NO: 910698 - DNA, 25 bp, Mus musculus
tgtgttccctcagcggaaaacagtt

SEQ ID NO: 910699 - DNA, 25 bp, Mus musculus
tgtgttccctgtactgcgtcagagt

SEQ ID NO: 910700 - DNA, 25 bp, Mus musculus
tgtgttccctgttctgcgtcagagt

SEQ ID NO: 910701 - DNA, 25 bp, Mus musculus
tgtgttccgacaatccaaaatgcaa

SEQ ID NO: 910702 - DNA, 25 bp, Mus musculus
tgtgttccgacattccaaaatgcaa

SEQ ID NO: 910703 - DNA, 25 bp, Mus musculus
tgtgttcctaagatcctagagctgg

SEQ ID NO: 910704 - DNA, 25 bp, Mus musculus
tgtgttcctaagttcctagagctgg

SEQ ID NO: 910705 - DNA, 25 bp, Mus musculus
tgtgttcctccacggcaagtctcag

SEQ ID NO: 910706 - DNA, 25 bp, Mus musculus
tgtgttcctccagggcaagtctcag

SEQ ID NO: 910707 - DNA, 25 bp, Mus musculus
tgtgttcctgaccacgctgtgcatg

SEQ ID NO: 910708 - DNA, 25 bp, Mus musculus
tgtgttcctgacgacgctgtgcatg

SEQ ID NO: 910709 - DNA, 25 bp, Mus musculus
tgtgttcctgctcattctgtgccag

SEQ ID NO: 910710 - DNA, 25 bp, Mus musculus
tgtgttcctgctgattctgtgccag

SEQ ID NO: 910711 - DNA, 25 bp, Mus musculus
tgtgttcctgttactaccgtttgga

SEQ ID NO: 910712 - DNA, 25 bp, Mus musculus
tgtgttcctgtttctaccgtttgga

SEQ ID NO: 910713 - DNA, 25 bp, Mus musculus
tgtgttccttctagctgttcccata

SEQ ID NO: 910714 - DNA, 25 bp, Mus musculus
tgtgttccttcttgctgttcccata

SEQ ID NO: 910715 - DNA, 25 bp, Mus musculus
tgtgttcgccctatgttccggcgcg

SEQ ID NO: 910716 - DNA, 25 bp, Mus musculus
tgtgttcgccctttgttccggcgcg

SEQ ID NO: 910717 - DNA, 25 bp, Mus musculus
tgtgttcgtgtccagcgagcagccc

SEQ ID NO: 910718 - DNA, 25 bp, Mus musculus
tgtgttcgtgtcgagcgagcagccc

SEQ ID NO: 910719 - DNA, 25 bp, Mus musculus
tgtgttctacacactgcacacgtgc

SEQ ID NO: 910720 - DNA, 25 bp, Mus musculus
tgtgttctacactctgcacacgtgc

SEQ ID NO: 910721 - DNA, 25 bp, Mus musculus
tgtgttctatcgcatgtaaagtacc

SEQ ID NO: 910722 - DNA, 25 bp, Mus musculus
tgtgttctatcggatgtaaagtacc

SEQ ID NO: 910723 - DNA, 25 bp, Mus musculus
tgtgttctatggctgtctgatcata

SEQ ID NO: 910724 - DNA, 25 bp, Mus musculus
tgtgttctatgggtgtctgatcata

SEQ ID NO: 910725 - DNA, 25 bp, Mus musculus
tgtgttctcaccctttatcgttagc

SEQ ID NO: 910726 - DNA, 25 bp, Mus musculus
tgtgttctcaccgtttatcgttagc

SEQ ID NO: 910727 - DNA, 25 bp, Mus musculus
tgtgttctcccgctgggccaagaag

SEQ ID NO: 910728 - DNA, 25 bp, Mus musculus
tgtgttctcccggtgggccaagaag

SEQ ID NO: 910729 - DNA, 25 bp, Mus musculus
tgtgttctcgctaaaggacctctag

SEQ ID NO: 910730 - DNA, 25 bp, Mus musculus
tgtgttctcgcttaaggacctctag

SEQ ID NO: 910731 - DNA, 25 bp, Mus musculus
tgtgttctctgacggtcttaggcag

SEQ ID NO: 910732 - DNA, 25 bp, Mus musculus
tgtgttctctgagggtcttaggcag

SEQ ID NO: 910733 - DNA, 25 bp, Mus musculus
tgtgttctctgtattcctaacctca

SEQ ID NO: 910734 - DNA, 25 bp, Mus musculus
tgtgttctctgttttcctaacctca

SEQ ID NO: 910735 - DNA, 25 bp, Mus musculus
tgtgttctgaaacaccttttcttca

SEQ ID NO: 910736 - DNA, 25 bp, Mus musculus
tgtgttctgaaagaccttttcttca

SEQ ID NO: 910737 - DNA, 25 bp, Mus musculus
tgtgttctggtcctcgtgttctcct

SEQ ID NO: 910738 - DNA, 25 bp, Mus musculus
tgtgttctggtcgtcgtgttctcct

SEQ ID NO: 910739 - DNA, 25 bp, Mus musculus
tgtgttctgtatagctctgtgtcca

SEQ ID NO: 910740 - DNA, 25 bp, Mus musculus
tgtgttctgtattgctctgtgtcca

SEQ ID NO: 910741 - DNA, 25 bp, Mus musculus
tgtgttctgtctcacttgtgctttt

SEQ ID NO: 910742 - DNA, 25 bp, Mus musculus
tgtgttctgtctgacttgtgctttt

SEQ ID NO: 910743 - DNA, 25 bp, Mus musculus
tgtgttctgtgcactgtactattaa

SEQ ID NO: 910744 - DNA, 25 bp, Mus musculus
tgtgttctgtgcctatcttgttcag

SEQ ID NO: 910745 - DNA, 25 bp, Mus musculus
tgtgttctgtgcgtatcttgttcag

SEQ ID NO: 910746 - DNA, 25 bp, Mus musculus
tgtgttctgtgctctgtactattaa

SEQ ID NO: 910747 - DNA, 25 bp, Mus musculus
tgtgttcttaagagcctctgtttga

SEQ ID NO: 910748 - DNA, 25 bp, Mus musculus
tgtgttcttaagtgcctctgtttga

SEQ ID NO: 910749 - DNA, 25 bp, Mus musculus
tgtgttcttatacaacatggcatct

SEQ ID NO: 910750 - DNA, 25 bp, Mus musculus
tgtgttcttatagaacatggcatct

SEQ ID NO: 910751 - DNA, 25 bp, Mus musculus
tgtgttcttcctcctatggagtcat

SEQ ID NO: 910752 - DNA, 25 bp, Mus musculus
tgtgttcttcctgctatggagtcat

SEQ ID NO: 910753 - DNA, 25 bp, Mus musculus
tgtgttcttgggagaactcagtcct

SEQ ID NO: 910754 - DNA, 25 bp, Mus musculus
tgtgttcttgggtgaactcagtcct

SEQ ID NO: 910755 - DNA, 25 bp, Mus musculus
tgtgttcttttcctaatttaatgtg

SEQ ID NO: 910756 - DNA, 25 bp, Mus musculus
tgtgttcttttcgtaatttaatgtg

SEQ ID NO: 910757 - DNA, 25 bp, Mus musculus
tgtgttgaacaaacaggactgcgtt

SEQ ID NO: 910758 - DNA, 25 bp, Mus musculus
tgtgttgaacaatcaggactgcgtt

SEQ ID NO: 910759 - DNA, 25 bp, Mus musculus
tgtgttgaactcatgcaatctcctt

SEQ ID NO: 910760 - DNA, 25 bp, Mus musculus
tgtgttgaactcttgcaatctcctt

SEQ ID NO: 910761 - DNA, 25 bp, Mus musculus
tgtgttgaacttcctgtccgtccat

SEQ ID NO: 910762 - DNA, 25 bp, Mus musculus
tgtgttgaacttgctgtccgtccat

SEQ ID NO: 910763 - DNA, 25 bp, Mus musculus
tgtgttgaagcccatggatgctccc

SEQ ID NO: 910764 - DNA, 25 bp, Mus musculus
tgtgttgaagccgatggatgctccc

SEQ ID NO: 910765 - DNA, 25 bp, Mus musculus
tgtgttgaatataccccttactgct

SEQ ID NO: 910766 - DNA, 25 bp, Mus musculus
tgtgttgaatattccccttactgct

SEQ ID NO: 910767 - DNA, 25 bp, Mus musculus
tgtgttgaatcaagccagtggcctc

SEQ ID NO: 910768 - DNA, 25 bp, Mus musculus
tgtgttgaatcatgccagtggcctc

SEQ ID NO: 910769 - DNA, 25 bp, Mus musculus
tgtgttgacactcttttcctcatgg

SEQ ID NO: 910770 - DNA, 25 bp, Mus musculus
tgtgttgacactgttttcctcatgg

SEQ ID NO: 910771 - DNA, 25 bp, Mus musculus
tgtgttgacagacatccagaccagc

SEQ ID NO: 910772 - DNA, 25 bp, Mus musculus
tgtgttgacagagatccagaccagc

SEQ ID NO: 910773 - DNA, 25 bp, Mus musculus
tgtgttgacagtagccggtggaaat

SEQ ID NO: 910774 - DNA, 25 bp, Mus musculus
tgtgttgacagttgccggtggaaat

SEQ ID NO: 910775 - DNA, 25 bp, Mus musculus
tgtgttgacgatatgctcctaccaa

SEQ ID NO: 910776 - DNA, 25 bp, Mus musculus
tgtgttgacgatttgctcctaccaa

SEQ ID NO: 910777 - DNA, 25 bp, Mus musculus
tgtgttgacgccatctgctgtaagc

SEQ ID NO: 910778 - DNA, 25 bp, Mus musculus
tgtgttgacgccttctgctgtaagc

SEQ ID NO: 910779 - DNA, 25 bp, Mus musculus
tgtgttgacttcattattcccatgg

SEQ ID NO: 910780 - DNA, 25 bp, Mus musculus
tgtgttgacttctttattcccatgg

SEQ ID NO: 910781 - DNA, 25 bp, Mus musculus
tgtgttgcacatagaaaaaattctg

SEQ ID NO: 910782 - DNA, 25 bp, Mus musculus
tgtgttgcacattgaaaaaattctg

SEQ ID NO: 910783 - DNA, 25 bp, Mus musculus
tgtgttgcaccgcaagcttcgtgcc

SEQ ID NO: 910784 - DNA, 25 bp, Mus musculus
tgtgttgcaccggaagcttcgtgcc

SEQ ID NO: 910785 - DNA, 25 bp, Mus musculus
tgtgttgcagatctgcctgttcctc

SEQ ID NO: 910786 - DNA, 25 bp, Mus musculus
tgtgttgcagatgtgcctgttcctc

SEQ ID NO: 910787 - DNA, 25 bp, Mus musculus
tgtgttgcagctatcattctgtcaa

SEQ ID NO: 910788 - DNA, 25 bp, Mus musculus
tgtgttgcagctttcattctgtcaa

SEQ ID NO: 910789 - DNA, 25 bp, Mus musculus
tgtgttgcatgcctctcagtagtac

SEQ ID NO: 910790 - DNA, 25 bp, Mus musculus
tgtgttgcatgcgtctcagtagtac

SEQ ID NO: 910791 - DNA, 25 bp, Mus musculus
tgtgttgccaagacagacatgactg

SEQ ID NO: 910792 - DNA, 25 bp, Mus musculus
tgtgttgccaagtcagacatgactg

SEQ ID NO: 910793 - DNA, 25 bp, Mus musculus
tgtgttgcccagattgagccagatt

SEQ ID NO: 910794 - DNA, 25 bp, Mus musculus
tgtgttgcccagtttgagccagatt

SEQ ID NO: 910795 - DNA, 25 bp, Mus musculus
tgtgttgcctgcattaagtctctgc

SEQ ID NO: 910796 - DNA, 25 bp, Mus musculus
tgtgttgcctgctttaagtctctgc

SEQ ID NO: 910797 - DNA, 25 bp, Mus musculus
tgtgttgctcctcgcatcacaaaaa

SEQ ID NO: 910798 - DNA, 25 bp, Mus musculus
tgtgttgctcctggcatcacaaaaa

SEQ ID NO: 910799 - DNA, 25 bp, Mus musculus
tgtgttgctggccatggatcctaag

SEQ ID NO: 910800 - DNA, 25 bp, Mus musculus
tgtgttgctggcgatggatcctaag

SEQ ID NO: 910801 - DNA, 25 bp, Mus musculus
tgtgttgctggtacctattcagtat

SEQ ID NO: 910802 - DNA, 25 bp, Mus musculus
tgtgttgctggttcctattcagtat

SEQ ID NO: 910803 - DNA, 25 bp, Mus musculus
tgtgttgctgtaattcaggtccttc

SEQ ID NO: 910804 - DNA, 25 bp, Mus musculus
tgtgttgctgtatttcaggtccttc

SEQ ID NO: 910805 - DNA, 25 bp, Mus musculus
tgtgttgctgttactcttgtcaagt

SEQ ID NO: 910806 - DNA, 25 bp, Mus musculus
tgtgttgctgtttctcttgtcaagt

SEQ ID NO: 910807 - DNA, 25 bp, Mus musculus
tgtgttgcttagacttacctggagt

SEQ ID NO: 910808 - DNA, 25 bp, Mus musculus
tgtgttgcttagtcttacctggagt

SEQ ID NO: 910809 - DNA, 25 bp, Mus musculus
tgtgttgcttttcttgtcttctctc

SEQ ID NO: 910810 - DNA, 25 bp, Mus musculus
tgtgttgcttttgttgtcttctctc

SEQ ID NO: 910811 - DNA, 25 bp, Mus musculus
tgtgttggaagcctccagcccctct

SEQ ID NO: 910812 - DNA, 25 bp, Mus musculus
tgtgttggaagcgtccagcccctct

SEQ ID NO: 910813 - DNA, 25 bp, Mus musculus
tgtgttggaagtacgtgagccccgc

SEQ ID NO: 910814 - DNA, 25 bp, Mus musculus
tgtgttggaagttcgtgagccccgc

SEQ ID NO: 910815 - DNA, 25 bp, Mus musculus
tgtgttggagatctagaccctttaa

SEQ ID NO: 910816 - DNA, 25 bp, Mus musculus
tgtgttggagatgtagaccctttaa

SEQ ID NO: 910817 - DNA, 25 bp, Mus musculus
tgtgttggagtaccttctgctcttc

SEQ ID NO: 910818 - DNA, 25 bp, Mus musculus
tgtgttggagtagcttctgctcttc

SEQ ID NO: 910819 - DNA, 25 bp, Mus musculus
tgtgttggatttacacgtttccttt

SEQ ID NO: 910820 - DNA, 25 bp, Mus musculus
tgtgttggattttcacgtttccttt

SEQ ID NO: 910821 - DNA, 25 bp, Mus musculus
tgtgttggcagtattgcgtcaccca

SEQ ID NO: 910822 - DNA, 25 bp, Mus musculus
tgtgttggcagttttgcgtcaccca

SEQ ID NO: 910823 - DNA, 25 bp, Mus musculus
tgtgttggccttccctttgaccaga

SEQ ID NO: 910824 - DNA, 25 bp, Mus musculus
tgtgttggccttgcctttgaccaga

SEQ ID NO: 910825 - DNA, 25 bp, Mus musculus
tgtgttggcttcagtgttctttctg

SEQ ID NO: 910826 - DNA, 25 bp, Mus musculus
tgtgttggcttctgtgttctttctg

SEQ ID NO: 910827 - DNA, 25 bp, Mus musculus
tgtgttggcttgaccgaagcgccga

SEQ ID NO: 910828 - DNA, 25 bp, Mus musculus
tgtgttggcttgtccgaagcgccga

SEQ ID NO: 910829 - DNA, 25 bp, Mus musculus
tgtgttggctttacatttctattaa

SEQ ID NO: 910830 - DNA, 25 bp, Mus musculus
tgtgttggcttttcatttctattaa

SEQ ID NO: 910831 - DNA, 25 bp, Mus musculus
tgtgttgggccacggtgattatctt

SEQ ID NO: 910832 - DNA, 25 bp, Mus musculus
tgtgttgggccagggtgattatctt

SEQ ID NO: 910833 - DNA, 25 bp, Mus musculus
tgtgttgggttgattgactttcctt

SEQ ID NO: 910834 - DNA, 25 bp, Mus musculus
tgtgttgggttgtttgactttcctt

SEQ ID NO: 910835 - DNA, 25 bp, Mus musculus
tgtgttggtaaacgagtgagcacct

SEQ ID NO: 910836 - DNA, 25 bp, Mus musculus
tgtgttggtaaaggagtgagcacct

SEQ ID NO: 910837 - DNA, 25 bp, Mus musculus
tgtgttggtggccttttcaagcacg

SEQ ID NO: 910838 - DNA, 25 bp, Mus musculus
tgtgttggtggcgttttcaagcacg

SEQ ID NO: 910839 - DNA, 25 bp, Mus musculus
tgtgttgtaattatccttccaggat

SEQ ID NO: 910840 - DNA, 25 bp, Mus musculus
tgtgttgtaattttccttccaggat

SEQ ID NO: 910841 - DNA, 25 bp, Mus musculus
tgtgttgtacttcttaccctctggg

SEQ ID NO: 910842 - DNA, 25 bp, Mus musculus
tgtgttgtacttgttaccctctggg

SEQ ID NO: 910843 - DNA, 25 bp, Mus musculus
tgtgttgtatctcctacagttgcaa

SEQ ID NO: 910844 - DNA, 25 bp, Mus musculus
tgtgttgtatctgctacagttgcaa

SEQ ID NO: 910845 - DNA, 25 bp, Mus musculus
tgtgttgtcaccagacccacacata

SEQ ID NO: 910846 - DNA, 25 bp, Mus musculus
tgtgttgtcacctgacccacacata

SEQ ID NO: 910847 - DNA, 25 bp, Mus musculus
tgtgttgtcagcacctttttcttat

SEQ ID NO: 910848 - DNA, 25 bp, Mus musculus
tgtgttgtcagctcctttttcttat

SEQ ID NO: 910849 - DNA, 25 bp, Mus musculus
tgtgttgtccacatagatgttcccc

SEQ ID NO: 910850 - DNA, 25 bp, Mus musculus
tgtgttgtccacttagatgttcccc

SEQ ID NO: 910851 - DNA, 25 bp, Mus musculus
tgtgttgtgcacatgcttgcctgca

SEQ ID NO: 910852 - DNA, 25 bp, Mus musculus
tgtgttgtgcacttgcttgcctgca

SEQ ID NO: 910853 - DNA, 25 bp, Mus musculus
tgtgttgtgtatattgtctcgtggc

SEQ ID NO: 910854 - DNA, 25 bp, Mus musculus
tgtgttgtgtattttgtctcgtggc

SEQ ID NO: 910855 - DNA, 25 bp, Mus musculus
tgtgttgttcctcttttaccatgta

SEQ ID NO: 910856 - DNA, 25 bp, Mus musculus
tgtgttgttcctgttttaccatgta

SEQ ID NO: 910857 - DNA, 25 bp, Mus musculus
tgtgttgtttccagttatgagcatt

SEQ ID NO: 910858 - DNA, 25 bp, Mus musculus
tgtgttgtttcctgttatgagcatt

SEQ ID NO: 910859 - DNA, 25 bp, Mus musculus
tgtgttgtttctcttgctgttgctc

SEQ ID NO: 910860 - DNA, 25 bp, Mus musculus
tgtgttgtttctgttgctgttgctc

SEQ ID NO: 910861 - DNA, 25 bp, Mus musculus
tgtgtttaagccatgcacttaatta

SEQ ID NO: 910862 - DNA, 25 bp, Mus musculus
tgtgtttaagccttgcacttaatta

SEQ ID NO: 910863 - DNA, 25 bp, Mus musculus
tgtgtttaagttaccattttacctg

SEQ ID NO: 910864 - DNA, 25 bp, Mus musculus
tgtgtttaagtttccattttacctg

SEQ ID NO: 910865 - DNA, 25 bp, Mus musculus
tgtgtttaattgctggcccaaccta

SEQ ID NO: 910866 - DNA, 25 bp, Mus musculus
tgtgtttaattggtggcccaaccta

SEQ ID NO: 910867 - DNA, 25 bp, Mus musculus
tgtgtttacagccaacgcatcagaa

SEQ ID NO: 910868 - DNA, 25 bp, Mus musculus
tgtgtttacagcgaacgcatcagaa

SEQ ID NO: 910869 - DNA, 25 bp, Mus musculus
tgtgtttaccccactagactgtgag

SEQ ID NO: 910870 - DNA, 25 bp, Mus musculus
tgtgtttacccctctagactgtgag

SEQ ID NO: 910871 - DNA, 25 bp, Mus musculus
tgtgtttactcacgcatcacgtatt

SEQ ID NO: 910872 - DNA, 25 bp, Mus musculus
tgtgtttactcaggcatcacgtatt

SEQ ID NO: 910873 - DNA, 25 bp, Mus musculus
tgtgtttactcgaatttttcttcct

SEQ ID NO: 910874 - DNA, 25 bp, Mus musculus
tgtgtttactcgtatttttcttcct

SEQ ID NO: 910875 - DNA, 25 bp, Mus musculus
tgtgtttactgcacatggctttccc

SEQ ID NO: 910876 - DNA, 25 bp, Mus musculus
tgtgtttactgctcatggctttccc

SEQ ID NO: 910877 - DNA, 25 bp, Mus musculus
tgtgtttactgtcagcccatcacaa

SEQ ID NO: 910878 - DNA, 25 bp, Mus musculus
tgtgtttactgtgagcccatcacaa

SEQ ID NO: 910879 - DNA, 25 bp, Mus musculus
tgtgtttaggtgacacgtgtgagat

SEQ ID NO: 910880 - DNA, 25 bp, Mus musculus
tgtgtttaggtgtcacgtgtgagat

SEQ ID NO: 910881 - DNA, 25 bp, Mus musculus
tgtgtttagtagctctgcacccctg

SEQ ID NO: 910882 - DNA, 25 bp, Mus musculus
tgtgtttagtaggtctgcacccctg

SEQ ID NO: 910883 - DNA, 25 bp, Mus musculus
tgtgtttataatctcctttctccct

SEQ ID NO: 910884 - DNA, 25 bp, Mus musculus
tgtgtttataatgtcctttctccct

SEQ ID NO: 910885 - DNA, 25 bp, Mus musculus
tgtgtttatcacaagacctttgtaa

SEQ ID NO: 910886 - DNA, 25 bp, Mus musculus
tgtgtttatcactagacctttgtaa

SEQ ID NO: 910887 - DNA, 25 bp, Mus musculus
tgtgtttatgcccatctttctactc

SEQ ID NO: 910888 - DNA, 25 bp, Mus musculus
tgtgtttatgccgatctttctactc

SEQ ID NO: 910889 - DNA, 25 bp, Mus musculus
tgtgtttatggtatccgttttgaca

SEQ ID NO: 910890 - DNA, 25 bp, Mus musculus
tgtgtttatggtttccgttttgaca

SEQ ID NO: 910891 - DNA, 25 bp, Mus musculus
tgtgtttcaactatcctgcagctaa

SEQ ID NO: 910892 - DNA, 25 bp, Mus musculus
tgtgtttcaactatttacaactacg

SEQ ID NO: 910893 - DNA, 25 bp, Mus musculus
tgtgtttcaactttcctgcagctaa

SEQ ID NO: 910894 - DNA, 25 bp, Mus musculus
tgtgtttcaactttttacaactacg

SEQ ID NO: 910895 - DNA, 25 bp, Mus musculus
tgtgtttcaataccgccaggatact

SEQ ID NO: 910896 - DNA, 25 bp, Mus musculus
tgtgtttcaatagcgccaggatact

SEQ ID NO: 910897 - DNA, 25 bp, Mus musculus
tgtgtttcacagctactcccacatt

SEQ ID NO: 910898 - DNA, 25 bp, Mus musculus
tgtgtttcacaggtactcccacatt

SEQ ID NO: 910899 - DNA, 25 bp, Mus musculus
tgtgtttcactcctgggaacatcag

SEQ ID NO: 910900 - DNA, 25 bp, Mus musculus
tgtgtttcactcgtgggaacatcag

SEQ ID NO: 910901 - DNA, 25 bp, Mus musculus
tgtgtttcattgattcctatagagt

SEQ ID NO: 910902 - DNA, 25 bp, Mus musculus
tgtgtttcattgtttcctatagagt

SEQ ID NO: 910903 - DNA, 25 bp, Mus musculus
tgtgtttcatttcctgtaatcagtt

SEQ ID NO: 910904 - DNA, 25 bp, Mus musculus
tgtgtttcatttgctgtaatcagtt

SEQ ID NO: 910905 - DNA, 25 bp, Mus musculus
tgtgtttccaggagtgcccggcaac

SEQ ID NO: 910906 - DNA, 25 bp, Mus musculus
tgtgtttccaggtgtgcccggcaac

SEQ ID NO: 910907 - DNA, 25 bp, Mus musculus
tgtgtttccataaagggctccgcaa

SEQ ID NO: 910908 - DNA, 25 bp, Mus musculus
tgtgtttccatatagggctccgcaa

SEQ ID NO: 910909 - DNA, 25 bp, Mus musculus
tgtgtttccattaaggcaacccgtc

SEQ ID NO: 910910 - DNA, 25 bp, Mus musculus
tgtgtttccatttaggcaacccgtc

SEQ ID NO: 910911 - DNA, 25 bp, Mus musculus
tgtgtttcccatccaagttctgcat

SEQ ID NO: 910912 - DNA, 25 bp, Mus musculus
tgtgtttcccatgcaagttctgcat

SEQ ID NO: 910913 - DNA, 25 bp, Mus musculus
tgtgtttccccaagggcagcgatag

SEQ ID NO: 910914 - DNA, 25 bp, Mus musculus
tgtgtttccccatgggcagcgatag

SEQ ID NO: 910915 - DNA, 25 bp, Mus musculus
tgtgtttcctcaacaatggttctaa

SEQ ID NO: 910916 - DNA, 25 bp, Mus musculus
tgtgtttcctcatcaatggttctaa

SEQ ID NO: 910917 - DNA, 25 bp, Mus musculus
tgtgtttcctccaactccgtatttt

SEQ ID NO: 910918 - DNA, 25 bp, Mus musculus
tgtgtttcctcctactccgtatttt

SEQ ID NO: 910919 - DNA, 25 bp, Mus musculus
tgtgtttcctggactctaggtggta

SEQ ID NO: 910920 - DNA, 25 bp, Mus musculus
tgtgtttcctggcttgggcactctc

SEQ ID NO: 910921 - DNA, 25 bp, Mus musculus
tgtgtttcctgggttgggcactctc

SEQ ID NO: 910922 - DNA, 25 bp, Mus musculus
tgtgtttcctggtctctaggtggta

SEQ ID NO: 910923 - DNA, 25 bp, Mus musculus
tgtgtttccttgagtgtctgcccct

SEQ ID NO: 910924 - DNA, 25 bp, Mus musculus
tgtgtttccttgtgtgtctgcccct

SEQ ID NO: 910925 - DNA, 25 bp, Mus musculus
tgtgtttcgttcatctattccatac

SEQ ID NO: 910926 - DNA, 25 bp, Mus musculus
tgtgtttcgttcttctattccatac

SEQ ID NO: 910927 - DNA, 25 bp, Mus musculus
tgtgtttctacaactgtctcttcat

SEQ ID NO: 910928 - DNA, 25 bp, Mus musculus
tgtgtttctacatctgtctcttcat

SEQ ID NO: 910929 - DNA, 25 bp, Mus musculus
tgtgtttctagcactgcacagctag

SEQ ID NO: 910930 - DNA, 25 bp, Mus musculus
tgtgtttctagctctgcacagctag

SEQ ID NO: 910931 - DNA, 25 bp, Mus musculus
tgtgtttctcaacgattcctcccca

SEQ ID NO: 910932 - DNA, 25 bp, Mus musculus
tgtgtttctcaaggattcctcccca

SEQ ID NO: 910933 - DNA, 25 bp, Mus musculus
tgtgtttctcatcaccccacacaag

SEQ ID NO: 910934 - DNA, 25 bp, Mus musculus
tgtgtttctcatgaccccacacaag

SEQ ID NO: 910935 - DNA, 25 bp, Mus musculus
tgtgtttctcttcatatgtttgtat

SEQ ID NO: 910936 - DNA, 25 bp, Mus musculus
tgtgtttctcttgatatgtttgtat

SEQ ID NO: 910937 - DNA, 25 bp, Mus musculus
tgtgtttctgacagcactcaacctg

SEQ ID NO: 910938 - DNA, 25 bp, Mus musculus
tgtgtttctgactgcactcaacctg

SEQ ID NO: 910939 - DNA, 25 bp, Mus musculus
tgtgtttctgtgaccctggtgtgac

SEQ ID NO: 910940 - DNA, 25 bp, Mus musculus
tgtgtttctgtgtccctggtgtgac

SEQ ID NO: 910941 - DNA, 25 bp, Mus musculus
tgtgtttcttacagaagcagaccgt

SEQ ID NO: 910942 - DNA, 25 bp, Mus musculus
tgtgtttcttactgaagcagaccgt

SEQ ID NO: 910943 - DNA, 25 bp, Mus musculus
tgtgtttcttataatctctcccacc

SEQ ID NO: 910944 - DNA, 25 bp, Mus musculus
tgtgtttcttattatctctcccacc

SEQ ID NO: 910945 - DNA, 25 bp, Mus musculus
tgtgtttcttttcatttagctgtag

SEQ ID NO: 910946 - DNA, 25 bp, Mus musculus
tgtgtttcttttcggctgtttactc

SEQ ID NO: 910947 - DNA, 25 bp, Mus musculus
tgtgtttcttttgatttagctgtag

SEQ ID NO: 910948 - DNA, 25 bp, Mus musculus
tgtgtttcttttgggctgtttactc

SEQ ID NO: 910949 - DNA, 25 bp, Mus musculus
tgtgtttgacaacgaaggaaatggc

SEQ ID NO: 910950 - DNA, 25 bp, Mus musculus
tgtgtttgacaaggaaggaaatggc

SEQ ID NO: 910951 - DNA, 25 bp, Mus musculus
tgtgtttgactacgtgccccccgac

SEQ ID NO: 910952 - DNA, 25 bp, Mus musculus
tgtgtttgactaggtgccccccgac

SEQ ID NO: 910953 - DNA, 25 bp, Mus musculus
tgtgtttgatctagcactgctccaa

SEQ ID NO: 910954 - DNA, 25 bp, Mus musculus
tgtgtttgatcttgcactgctccaa

SEQ ID NO: 910955 - DNA, 25 bp, Mus musculus
tgtgtttgatttaaccttccatccc

SEQ ID NO: 910956 - DNA, 25 bp, Mus musculus
tgtgtttgattttaccttccatccc

SEQ ID NO: 910957 - DNA, 25 bp, Mus musculus
tgtgtttgcaggacagcaagcccca

SEQ ID NO: 910958 - DNA, 25 bp, Mus musculus
tgtgtttgcaggtcagcaagcccca

SEQ ID NO: 910959 - DNA, 25 bp, Mus musculus
tgtgtttgccacagttctgataaga

SEQ ID NO: 910960 - DNA, 25 bp, Mus musculus
tgtgtttgccactgttctgataaga

SEQ ID NO: 910961 - DNA, 25 bp, Mus musculus
tgtgtttgcctcaaattccttcgga

SEQ ID NO: 910962 - DNA, 25 bp, Mus musculus
tgtgtttgcctctaattccttcgga

SEQ ID NO: 910963 - DNA, 25 bp, Mus musculus
tgtgtttgctgcctgtcagtttaag

SEQ ID NO: 910964 - DNA, 25 bp, Mus musculus
tgtgtttgctgcgtgtcagtttaag

SEQ ID NO: 910965 - DNA, 25 bp, Mus musculus
tgtgtttgctggctaggtgtcatca

SEQ ID NO: 910966 - DNA, 25 bp, Mus musculus
tgtgtttgctgggtaggtgtcatca

SEQ ID NO: 910967 - DNA, 25 bp, Mus musculus
tgtgtttgggttattatggtttttg

SEQ ID NO: 910968 - DNA, 25 bp, Mus musculus
tgtgtttgggtttttatggtttttg

SEQ ID NO: 910969 - DNA, 25 bp, Mus musculus
tgtgtttggttgactactggtagct

SEQ ID NO: 910970 - DNA, 25 bp, Mus musculus
tgtgtttggttgtctactggtagct

SEQ ID NO: 910971 - DNA, 25 bp, Mus musculus
tgtgtttgtcacatatcaacctact

SEQ ID NO: 910972 - DNA, 25 bp, Mus musculus
tgtgtttgtcacttatcaacctact

SEQ ID NO: 910973 - DNA, 25 bp, Mus musculus
tgtgtttgtgtgaaaagcagcatta

SEQ ID NO: 910974 - DNA, 25 bp, Mus musculus
tgtgtttgtgtgtaaagcagcatta

SEQ ID NO: 910975 - DNA, 25 bp, Mus musculus
tgtgtttgtgttcctattctctatg

SEQ ID NO: 910976 - DNA, 25 bp, Mus musculus
tgtgtttgtgttgctattctctatg

SEQ ID NO: 910977 - DNA, 25 bp, Mus musculus
tgtgtttgtttgacatttgcctccc

SEQ ID NO: 910978 - DNA, 25 bp, Mus musculus
tgtgtttgtttgtcatttgcctccc

SEQ ID NO: 910979 - DNA, 25 bp, Mus musculus
tgtgttttacagcatcctagaatcc

SEQ ID NO: 910980 - DNA, 25 bp, Mus musculus
tgtgttttacaggatcctagaatcc

SEQ ID NO: 910981 - DNA, 25 bp, Mus musculus
tgtgttttacctagccaatctcctg

SEQ ID NO: 910982 - DNA, 25 bp, Mus musculus
tgtgttttaccttgccaatctcctg

SEQ ID NO: 910983 - DNA, 25 bp, Mus musculus
tgtgttttagtcaccgagtaagtct

SEQ ID NO: 910984 - DNA, 25 bp, Mus musculus
tgtgttttagtctccgagtaagtct

SEQ ID NO: 910985 - DNA, 25 bp, Mus musculus
tgtgttttcaatcccaggcaagcca

SEQ ID NO: 910986 - DNA, 25 bp, Mus musculus
tgtgttttcaatgccaggcaagcca

SEQ ID NO: 910987 - DNA, 25 bp, Mus musculus
tgtgttttcaggctcaattatttca

SEQ ID NO: 910988 - DNA, 25 bp, Mus musculus
tgtgttttcagggtcaattatttca

SEQ ID NO: 910989 - DNA, 25 bp, Mus musculus
tgtgttttcatcaaactgctggaat

SEQ ID NO: 910990 - DNA, 25 bp, Mus musculus
tgtgttttcatctaactgctggaat

SEQ ID NO: 910991 - DNA, 25 bp, Mus musculus
tgtgttttccagctactggagctcc

SEQ ID NO: 910992 - DNA, 25 bp, Mus musculus
tgtgttttccaggtactggagctcc

SEQ ID NO: 910993 - DNA, 25 bp, Mus musculus
tgtgttttcctgaacagctgctttc

SEQ ID NO: 910994 - DNA, 25 bp, Mus musculus
tgtgttttcctgtacagctgctttc

SEQ ID NO: 910995 - DNA, 25 bp, Mus musculus
tgtgttttctcgagaccccaatggc

SEQ ID NO: 910996 - DNA, 25 bp, Mus musculus
tgtgttttctcgtgaccccaatggc

SEQ ID NO: 910997 - DNA, 25 bp, Mus musculus
tgtgttttgacaagctgcttcccca

SEQ ID NO: 910998 - DNA, 25 bp, Mus musculus
tgtgttttgacatgctgcttcccca

SEQ ID NO: 910999 - DNA, 25 bp, Mus musculus
tgtgttttgcataacctactctttt

SEQ ID NO: 911000 - DNA, 25 bp, Mus musculus
tgtgttttgcatcctcagaacagca

SEQ ID NO: 911001 - DNA, 25 bp, Mus musculus
tgtgttttgcatgctcagaacagca

SEQ ID NO: 911002 - DNA, 25 bp, Mus musculus
tgtgttttgcattacctactctttt

SEQ ID NO: 911003 - DNA, 25 bp, Mus musculus
tgtgttttgtatcctctggattcat

SEQ ID NO: 911004 - DNA, 25 bp, Mus musculus
tgtgttttgtatgctctggattcat

SEQ ID NO: 911005 - DNA, 25 bp, Mus musculus
tgtgttttgtcccaccttagtccca

SEQ ID NO: 911006 - DNA, 25 bp, Mus musculus
tgtgttttgtccgaccttagtccca

SEQ ID NO: 911007 - DNA, 25 bp, Mus musculus
tgtgttttgtctcttaccctaggaa

SEQ ID NO: 911008 - DNA, 25 bp, Mus musculus
tgtgttttgtctgttaccctaggaa

SEQ ID NO: 911009 - DNA, 25 bp, Mus musculus
tgtgttttgtttctggtccggaagc

SEQ ID NO: 911010 - DNA, 25 bp, Mus musculus
tgtgttttgtttgtggtccggaagc

SEQ ID NO: 911011 - DNA, 25 bp, Mus musculus
tgtgtttttagcaccctattttatt

SEQ ID NO: 911012 - DNA, 25 bp, Mus musculus
tgtgtttttagctccctattttatt

SEQ ID NO: 911013 - DNA, 25 bp, Mus musculus
tgtgtttttatcatagctggcctgg

SEQ ID NO: 911014 - DNA, 25 bp, Mus musculus
tgtgtttttatcttagctggcctgg

SEQ ID NO: 911015 - DNA, 25 bp, Mus musculus
tgtgtttttcaacatccctcagatc

SEQ ID NO: 911016 - DNA, 25 bp, Mus musculus
tgtgtttttcaagatccctcagatc

SEQ ID NO: 911017 - DNA, 25 bp, Mus musculus
tgtgtttttcacagctgttacccct

SEQ ID NO: 911018 - DNA, 25 bp, Mus musculus
tgtgtttttcactgctgttacccct

SEQ ID NO: 911019 - DNA, 25 bp, Mus musculus
tgtgtttttcatctgctgttagcta

SEQ ID NO: 911020 - DNA, 25 bp, Mus musculus
tgtgtttttcatgtgctgttagcta

SEQ ID NO: 911021 - DNA, 25 bp, Mus musculus
tgtgtttttcccagttctctagcct

SEQ ID NO: 911022 - DNA, 25 bp, Mus musculus
tgtgtttttcccatatagacgcaga

SEQ ID NO: 911023 - DNA, 25 bp, Mus musculus
tgtgtttttccctgttctctagcct

SEQ ID NO: 911024 - DNA, 25 bp, Mus musculus
tgtgtttttcccttatagacgcaga

SEQ ID NO: 911025 - DNA, 25 bp, Mus musculus
tgtgtttttctcctccaaccctaag

SEQ ID NO: 911026 - DNA, 25 bp, Mus musculus
tgtgtttttctcgtccaaccctaag

SEQ ID NO: 911027 - DNA, 25 bp, Mus musculus
tgtgttttttacacggcctataatt

SEQ ID NO: 911028 - DNA, 25 bp, Mus musculus
tgtgttttttactcggcctataatt

SEQ ID NO: 911029 - DNA, 25 bp, Mus musculus
tgttaaaaatggaccagggcggcca

SEQ ID NO: 911030 - DNA, 25 bp, Mus musculus
tgttaaaaatggtccagggcggcca

SEQ ID NO: 911031 - DNA, 25 bp, Mus musculus
tgttaaaacaggcacccatcccaaa

SEQ ID NO: 911032 - DNA, 25 bp, Mus musculus
tgttaaaacagggacccatcccaaa

SEQ ID NO: 911033 - DNA, 25 bp, Mus musculus
tgttaaaacatacgcagcagctcag

SEQ ID NO: 911034 - DNA, 25 bp, Mus musculus
tgttaaaacataggcagcagctcag

SEQ ID NO: 911035 - DNA, 25 bp, Mus musculus
tgttaaaaccttactctctatcaga

SEQ ID NO: 911036 - DNA, 25 bp, Mus musculus
tgttaaaacctttctctctatcaga

SEQ ID NO: 911037 - DNA, 25 bp, Mus musculus
tgttaaaacggcctcccttgggctg

SEQ ID NO: 911038 - DNA, 25 bp, Mus musculus
tgttaaaacggcgtcccttgggctg

SEQ ID NO: 911039 - DNA, 25 bp, Mus musculus
tgttaaaagaccacgacccttctgt

SEQ ID NO: 911040 - DNA, 25 bp, Mus musculus
tgttaaaagacctcgacccttctgt

SEQ ID NO: 911041 - DNA, 25 bp, Mus musculus
tgttaaaagcttacacgagatgtaa

SEQ ID NO: 911042 - DNA, 25 bp, Mus musculus
tgttaaaagctttcacgagatgtaa

SEQ ID NO: 911043 - DNA, 25 bp, Mus musculus
tgttaaaagggcaccgtccatccag

SEQ ID NO: 911044 - DNA, 25 bp, Mus musculus
tgttaaaagggctccgtccatccag

SEQ ID NO: 911045 - DNA, 25 bp, Mus musculus
tgttaaaatgcacgttgtagccagg

SEQ ID NO: 911046 - DNA, 25 bp, Mus musculus
tgttaaaatgcaggttgtagccagg

SEQ ID NO: 911047 - DNA, 25 bp, Mus musculus
tgttaaaatgtcagaccccgcactc

SEQ ID NO: 911048 - DNA, 25 bp, Mus musculus
tgttaaaatgtctgaccccgcactc

SEQ ID NO: 911049 - DNA, 25 bp, Mus musculus
tgttaaacacatacaggcgtcctga

SEQ ID NO: 911050 - DNA, 25 bp, Mus musculus
tgttaaacacattcaggcgtcctga

SEQ ID NO: 911051 - DNA, 25 bp, Mus musculus
tgttaaacattgatcagttccctgg

SEQ ID NO: 911052 - DNA, 25 bp, Mus musculus
tgttaaacattgttcagttccctgg

SEQ ID NO: 911053 - DNA, 25 bp, Mus musculus
tgttaaaccagtccttcccagactt

SEQ ID NO: 911054 - DNA, 25 bp, Mus musculus
tgttaaaccagtgcttcccagactt

SEQ ID NO: 911055 - DNA, 25 bp, Mus musculus
tgttaaacccggagccctttgcgag

SEQ ID NO: 911056 - DNA, 25 bp, Mus musculus
tgttaaacccggtgccctttgcgag

SEQ ID NO: 911057 - DNA, 25 bp, Mus musculus
tgttaaacgacaacagtgctggtgc

SEQ ID NO: 911058 - DNA, 25 bp, Mus musculus
tgttaaacgacatcagtgctggtgc

SEQ ID NO: 911059 - DNA, 25 bp, Mus musculus
tgttaaactatgctctcttctttcc

SEQ ID NO: 911060 - DNA, 25 bp, Mus musculus
tgttaaactatggtctcttctttcc

SEQ ID NO: 911061 - DNA, 25 bp, Mus musculus
tgttaaactctaaactctcccaggg

SEQ ID NO: 911062 - DNA, 25 bp, Mus musculus
tgttaaactctatactctcccaggg

SEQ ID NO: 911063 - DNA, 25 bp, Mus musculus
tgttaaacttgcatccctgacaggg

SEQ ID NO: 911064 - DNA, 25 bp, Mus musculus
tgttaaacttgcttccctgacaggg

SEQ ID NO: 911065 - DNA, 25 bp, Mus musculus
tgttaaagcacaatcccatggcacc

SEQ ID NO: 911066 - DNA, 25 bp, Mus musculus
tgttaaagcacattcccatggcacc

SEQ ID NO: 911067 - DNA, 25 bp, Mus musculus
tgttaaaggtcacatcacctctggc

SEQ ID NO: 911068 - DNA, 25 bp, Mus musculus
tgttaaaggtcagatcacctctggc

SEQ ID NO: 911069 - DNA, 25 bp, Mus musculus
tgttaaaggtgtctcttctcccttc

SEQ ID NO: 911070 - DNA, 25 bp, Mus musculus
tgttaaaggtgtgtcttctcccttc

SEQ ID NO: 911071 - DNA, 25 bp, Mus musculus
tgttaaaggttaatcatgtcattga

SEQ ID NO: 911072 - DNA, 25 bp, Mus musculus
tgttaaaggttattcatgtcattga

SEQ ID NO: 911073 - DNA, 25 bp, Mus musculus
tgttaaagtgccaaatacccaccca

SEQ ID NO: 911074 - DNA, 25 bp, Mus musculus
tgttaaagtgcctaatacccaccca

SEQ ID NO: 911075 - DNA, 25 bp, Mus musculus
tgttaaatccagcttgtgctgccca

SEQ ID NO: 911076 - DNA, 25 bp, Mus musculus
tgttaaatccaggttgtgctgccca

SEQ ID NO: 911077 - DNA, 25 bp, Mus musculus
tgttaaatgccaaatgtttacggta

SEQ ID NO: 911078 - DNA, 25 bp, Mus musculus
tgttaaatgccatatgtttacggta

SEQ ID NO: 911079 - DNA, 25 bp, Mus musculus
tgttaaatgtcaaccgtcaactctt

SEQ ID NO: 911080 - DNA, 25 bp, Mus musculus
tgttaaatgtcatccgtcaactctt

SEQ ID NO: 911081 - DNA, 25 bp, Mus musculus
tgttaaatgttgcttccctgaagtg

SEQ ID NO: 911082 - DNA, 25 bp, Mus musculus
tgttaaatgttggttccctgaagtg

SEQ ID NO: 911083 - DNA, 25 bp, Mus musculus
tgttaaatttacaccctccaagtcg

SEQ ID NO: 911084 - DNA, 25 bp, Mus musculus
tgttaaatttactccctccaagtcg

SEQ ID NO: 911085 - DNA, 25 bp, Mus musculus
tgttaaatttccacacctttctatc

SEQ ID NO: 911086 - DNA, 25 bp, Mus musculus
tgttaaatttcctcacctttctatc

SEQ ID NO: 911087 - DNA, 25 bp, Mus musculus
tgttaaatttgtcttggattcagct

SEQ ID NO: 911088 - DNA, 25 bp, Mus musculus
tgttaaatttgtgttggattcagct

SEQ ID NO: 911089 - DNA, 25 bp, Mus musculus
tgttaacactttccctggtaattgt

SEQ ID NO: 911090 - DNA, 25 bp, Mus musculus
tgttaacactttgcctggtaattgt

SEQ ID NO: 911091 - DNA, 25 bp, Mus musculus
tgttaacagatgaaaactccctcta

SEQ ID NO: 911092 - DNA, 25 bp, Mus musculus
tgttaacagatgtaaactccctcta

SEQ ID NO: 911093 - DNA, 25 bp, Mus musculus
tgttaacagttaagctcagtgacct

SEQ ID NO: 911094 - DNA, 25 bp, Mus musculus
tgttaacagttatgctcagtgacct

SEQ ID NO: 911095 - DNA, 25 bp, Mus musculus
tgttaacagttgcttaccccagagt

SEQ ID NO: 911096 - DNA, 25 bp, Mus musculus
tgttaacagttggttaccccagagt

SEQ ID NO: 911097 - DNA, 25 bp, Mus musculus
tgttaacatgagaactttgctgcag

SEQ ID NO: 911098 - DNA, 25 bp, Mus musculus
tgttaacatgagtactttgctgcag

SEQ ID NO: 911099 - DNA, 25 bp, Mus musculus
tgttaaccaaccaagagagcctctc

SEQ ID NO: 911100 - DNA, 25 bp, Mus musculus
tgttaaccaacctagagagcctctc

SEQ ID NO: 911101 - DNA, 25 bp, Mus musculus
tgttaaccactgacactctgaacaa

SEQ ID NO: 911102 - DNA, 25 bp, Mus musculus
tgttaaccactgtcactctgaacaa

SEQ ID NO: 911103 - DNA, 25 bp, Mus musculus
tgttaaccagtccagcctgtctctg

SEQ ID NO: 911104 - DNA, 25 bp, Mus musculus
tgttaaccagtcgagcctgtctctg

SEQ ID NO: 911105 - DNA, 25 bp, Mus musculus
tgttaaccattaagtgaagccccag

SEQ ID NO: 911106 - DNA, 25 bp, Mus musculus
tgttaaccattatgtgaagccccag

SEQ ID NO: 911107 - DNA, 25 bp, Mus musculus
tgttaaccattcactctactggagt

SEQ ID NO: 911108 - DNA, 25 bp, Mus musculus
tgttaaccattctctctactggagt

SEQ ID NO: 911109 - DNA, 25 bp, Mus musculus
tgttaacccaagaagcacttagtaa

SEQ ID NO: 911110 - DNA, 25 bp, Mus musculus
tgttaacccaagtagcacttagtaa

SEQ ID NO: 911111 - DNA, 25 bp, Mus musculus
tgttaaccctagctggctgcttgcc

SEQ ID NO: 911112 - DNA, 25 bp, Mus musculus
tgttaaccctaggtggctgcttgcc

SEQ ID NO: 911113 - DNA, 25 bp, Mus musculus
tgttaaccctgtacttgtgagtccc

SEQ ID NO: 911114 - DNA, 25 bp, Mus musculus
tgttaaccctgttcttgtgagtccc

SEQ ID NO: 911115 - DNA, 25 bp, Mus musculus
tgttaaccctttacatcatgtactt

SEQ ID NO: 911116 - DNA, 25 bp, Mus musculus
tgttaaccctttatgacccgtatga

SEQ ID NO: 911117 - DNA, 25 bp, Mus musculus
tgttaacccttttcatcatgtactt

SEQ ID NO: 911118 - DNA, 25 bp, Mus musculus
tgttaaccctttttgacccgtatga

SEQ ID NO: 911119 - DNA, 25 bp, Mus musculus
tgttaacctaatcctcaactgcagc

SEQ ID NO: 911120 - DNA, 25 bp, Mus musculus
tgttaacctaatgctcaactgcagc

SEQ ID NO: 911121 - DNA, 25 bp, Mus musculus
tgttaacctcagaaagccgggtaag

SEQ ID NO: 911122 - DNA, 25 bp, Mus musculus
tgttaacctcagtaagccgggtaag

SEQ ID NO: 911123 - DNA, 25 bp, Mus musculus
tgttaacctgtaacaatttatagct

SEQ ID NO: 911124 - DNA, 25 bp, Mus musculus
tgttaacctgtatcaatttatagct

SEQ ID NO: 911125 - DNA, 25 bp, Mus musculus
tgttaaccttggaacagccttgcct

SEQ ID NO: 911126 - DNA, 25 bp, Mus musculus
tgttaaccttggtacagccttgcct

SEQ ID NO: 911127 - DNA, 25 bp, Mus musculus
tgttaacgctctcgcatcatgtcta

SEQ ID NO: 911128 - DNA, 25 bp, Mus musculus
tgttaacgctctggcatcatgtcta

SEQ ID NO: 911129 - DNA, 25 bp, Mus musculus
tgttaactatcactgaccacactgc

SEQ ID NO: 911130 - DNA, 25 bp, Mus musculus
tgttaactatcagtgaccacactgc

SEQ ID NO: 911131 - DNA, 25 bp, Mus musculus
tgttaactccatcacggctttgcgg

SEQ ID NO: 911132 - DNA, 25 bp, Mus musculus
tgttaactccatgacggctttgcgg

SEQ ID NO: 911133 - DNA, 25 bp, Mus musculus
tgttaactgggtactgtcagtcctt

SEQ ID NO: 911134 - DNA, 25 bp, Mus musculus
tgttaactgggttctgtcagtcctt

SEQ ID NO: 911135 - DNA, 25 bp, Mus musculus
tgttaacttattacttttccgtcag

SEQ ID NO: 911136 - DNA, 25 bp, Mus musculus
tgttaacttatttcttttccgtcag

SEQ ID NO: 911137 - DNA, 25 bp, Mus musculus
tgttaactttttctattgttgtatt

SEQ ID NO: 911138 - DNA, 25 bp, Mus musculus
tgttaactttttgtattgttgtatt

SEQ ID NO: 911139 - DNA, 25 bp, Mus musculus
tgttaagaaagtatacctgctggga

SEQ ID NO: 911140 - DNA, 25 bp, Mus musculus
tgttaagaaagtttacctgctggga

SEQ ID NO: 911141 - DNA, 25 bp, Mus musculus
tgttaagaagccctactctcgtgcc

SEQ ID NO: 911142 - DNA, 25 bp, Mus musculus
tgttaagaagccgtactctcgtgcc

SEQ ID NO: 911143 - DNA, 25 bp, Mus musculus
tgttaagaatcaatcctagtgctca

SEQ ID NO: 911144 - DNA, 25 bp, Mus musculus
tgttaagaatcattcctagtgctca

SEQ ID NO: 911145 - DNA, 25 bp, Mus musculus
tgttaagaatctctcctggctagtt

SEQ ID NO: 911146 - DNA, 25 bp, Mus musculus
tgttaagaatctgtcctggctagtt

SEQ ID NO: 911147 - DNA, 25 bp, Mus musculus
tgttaagattcacaccacctgcttt

SEQ ID NO: 911148 - DNA, 25 bp, Mus musculus
tgttaagattcagaccacctgcttt

SEQ ID NO: 911149 - DNA, 25 bp, Mus musculus
tgttaagattttagcttgcttccac

SEQ ID NO: 911150 - DNA, 25 bp, Mus musculus
tgttaagatttttgcttgcttccac

SEQ ID NO: 911151 - DNA, 25 bp, Mus musculus
tgttaagcagataacttccatcagt

SEQ ID NO: 911152 - DNA, 25 bp, Mus musculus
tgttaagcagattacttccatcagt

SEQ ID NO: 911153 - DNA, 25 bp, Mus musculus
tgttaagccggtcttgccctgggcc

SEQ ID NO: 911154 - DNA, 25 bp, Mus musculus
tgttaagccggtgttgccctgggcc

SEQ ID NO: 911155 - DNA, 25 bp, Mus musculus
tgttaagctctaactgacccacttc

SEQ ID NO: 911156 - DNA, 25 bp, Mus musculus
tgttaagctctatctgacccacttc

SEQ ID NO: 911157 - DNA, 25 bp, Mus musculus
tgttaagctttcatgcctcaggctg

SEQ ID NO: 911158 - DNA, 25 bp, Mus musculus
tgttaagctttcttgcctcaggctg

SEQ ID NO: 911159 - DNA, 25 bp, Mus musculus
tgttaagggaagattccactcagca

SEQ ID NO: 911160 - DNA, 25 bp, Mus musculus
tgttaagggaagtttccactcagca

SEQ ID NO: 911161 - DNA, 25 bp, Mus musculus
tgttaagggtttactcccagaacag

SEQ ID NO: 911162 - DNA, 25 bp, Mus musculus
tgttaagggttttctcccagaacag

SEQ ID NO: 911163 - DNA, 25 bp, Mus musculus
tgttaaggtatactgctccttcctt

SEQ ID NO: 911164 - DNA, 25 bp, Mus musculus
tgttaaggtatagtgctccttcctt

SEQ ID NO: 911165 - DNA, 25 bp, Mus musculus
tgttaagtaatcaacccacctaaag

SEQ ID NO: 911166 - DNA, 25 bp, Mus musculus
tgttaagtaatctacccacctaaag

SEQ ID NO: 911167 - DNA, 25 bp, Mus musculus
tgttaagtaccacctattccaatgt

SEQ ID NO: 911168 - DNA, 25 bp, Mus musculus
tgttaagtaccagctattccaatgt

SEQ ID NO: 911169 - DNA, 25 bp, Mus musculus
tgttaagtatagctacacgccttta

SEQ ID NO: 911170 - DNA, 25 bp, Mus musculus
tgttaagtataggtacacgccttta

SEQ ID NO: 911171 - DNA, 25 bp, Mus musculus
tgttaagtcaaacaggccagccact

SEQ ID NO: 911172 - DNA, 25 bp, Mus musculus
tgttaagtcaaagaggccagccact

SEQ ID NO: 911173 - DNA, 25 bp, Mus musculus
tgttaagtccccagttactacacac

SEQ ID NO: 911174 - DNA, 25 bp, Mus musculus
tgttaagtcccctgttactacacac

SEQ ID NO: 911175 - DNA, 25 bp, Mus musculus
tgttaagtctgtcacccgatgcttc

SEQ ID NO: 911176 - DNA, 25 bp, Mus musculus
tgttaagtctgtgacccgatgcttc

SEQ ID NO: 911177 - DNA, 25 bp, Mus musculus
tgttaagtgaacctccagatctcca

SEQ ID NO: 911178 - DNA, 25 bp, Mus musculus
tgttaagtgaacgtccagatctcca

SEQ ID NO: 911179 - DNA, 25 bp, Mus musculus
tgttaagtgattattcctgccagag

SEQ ID NO: 911180 - DNA, 25 bp, Mus musculus
tgttaagtgatttttcctgccagag

SEQ ID NO: 911181 - DNA, 25 bp, Mus musculus
tgttaagtgttgagggactctgact

SEQ ID NO: 911182 - DNA, 25 bp, Mus musculus
tgttaagtgttgtgggactctgact

SEQ ID NO: 911183 - DNA, 25 bp, Mus musculus
tgttaagttgtgctatatttgccac

SEQ ID NO: 911184 - DNA, 25 bp, Mus musculus
tgttaagttgtggtatatttgccac

SEQ ID NO: 911185 - DNA, 25 bp, Mus musculus
tgttaagttttcctatctgtacttt

SEQ ID NO: 911186 - DNA, 25 bp, Mus musculus
tgttaagttttcgtatctgtacttt

SEQ ID NO: 911187 - DNA, 25 bp, Mus musculus
tgttaatagacacgccccagggcaa

SEQ ID NO: 911188 - DNA, 25 bp, Mus musculus
tgttaatagacaggccccagggcaa

SEQ ID NO: 911189 - DNA, 25 bp, Mus musculus
tgttaatatattccccaatcgggac

SEQ ID NO: 911190 - DNA, 25 bp, Mus musculus
tgttaatatattgcccaatcgggac

SEQ ID NO: 911191 - DNA, 25 bp, Mus musculus
tgttaatcaagtccgggctctcatt

SEQ ID NO: 911192 - DNA, 25 bp, Mus musculus
tgttaatcaagtgcgggctctcatt

SEQ ID NO: 911193 - DNA, 25 bp, Mus musculus
tgttaatcaccaaagtgcagatttt

SEQ ID NO: 911194 - DNA, 25 bp, Mus musculus
tgttaatcaccaaggcgtcacttga

SEQ ID NO: 911195 - DNA, 25 bp, Mus musculus
tgttaatcaccatagtgcagatttt

SEQ ID NO: 911196 - DNA, 25 bp, Mus musculus
tgttaatcaccatggcgtcacttga

SEQ ID NO: 911197 - DNA, 25 bp, Mus musculus
tgttaatcagtgattatccgcccgc

SEQ ID NO: 911198 - DNA, 25 bp, Mus musculus
tgttaatcagtgtttatccgcccgc

SEQ ID NO: 911199 - DNA, 25 bp, Mus musculus
tgttaatcccacatcagagtttggg

SEQ ID NO: 911200 - DNA, 25 bp, Mus musculus
tgttaatcccacttcagagtttggg

SEQ ID NO: 911201 - DNA, 25 bp, Mus musculus
tgttaatctccacgatcatttcctt

SEQ ID NO: 911202 - DNA, 25 bp, Mus musculus
tgttaatctccaggatcatttcctt

SEQ ID NO: 911203 - DNA, 25 bp, Mus musculus
tgttaatctgcacttctcatcatct

SEQ ID NO: 911204 - DNA, 25 bp, Mus musculus
tgttaatctgcagttctcatcatct

SEQ ID NO: 911205 - DNA, 25 bp, Mus musculus
tgttaatgcagtattcctcacccac

SEQ ID NO: 911206 - DNA, 25 bp, Mus musculus
tgttaatgcagttttcctcacccac

SEQ ID NO: 911207 - DNA, 25 bp, Mus musculus
tgttaatggaccagtctcatgctcc

SEQ ID NO: 911208 - DNA, 25 bp, Mus musculus
tgttaatggacctgtctcatgctcc

SEQ ID NO: 911209 - DNA, 25 bp, Mus musculus
tgttaatggccccacctctactcct

SEQ ID NO: 911210 - DNA, 25 bp, Mus musculus
tgttaatggcccgacctctactcct

SEQ ID NO: 911211 - DNA, 25 bp, Mus musculus
tgttaatggtaactttgagtgtttt

SEQ ID NO: 911212 - DNA, 25 bp, Mus musculus
tgttaatggtaagtttgagtgtttt

SEQ ID NO: 911213 - DNA, 25 bp, Mus musculus
tgttaatgtgtcatcacccctgtga

SEQ ID NO: 911214 - DNA, 25 bp, Mus musculus
tgttaatgtgtcttcacccctgtga

SEQ ID NO: 911215 - DNA, 25 bp, Mus musculus
tgttaatgttttatgggccagtctc

SEQ ID NO: 911216 - DNA, 25 bp, Mus musculus
tgttaatgttttttgggccagtctc

SEQ ID NO: 911217 - DNA, 25 bp, Mus musculus
tgttaattacccctgtacatggagc

SEQ ID NO: 911218 - DNA, 25 bp, Mus musculus
tgttaattacccgtgtacatggagc

SEQ ID NO: 911219 - DNA, 25 bp, Mus musculus
tgttaattagatcagcacaggcgct

SEQ ID NO: 911220 - DNA, 25 bp, Mus musculus
tgttaattagatgagcacaggcgct

SEQ ID NO: 911221 - DNA, 25 bp, Mus musculus
tgttaattcccaacaggccacagga

SEQ ID NO: 911222 - DNA, 25 bp, Mus musculus
tgttaattcccatcaggccacagga

SEQ ID NO: 911223 - DNA, 25 bp, Mus musculus
tgttaattctacaggcgaagccatg

SEQ ID NO: 911224 - DNA, 25 bp, Mus musculus
tgttaattctactggcgaagccatg

SEQ ID NO: 911225 - DNA, 25 bp, Mus musculus
tgttaatttacccagattttcagtt

SEQ ID NO: 911226 - DNA, 25 bp, Mus musculus
tgttaatttaccgagattttcagtt

SEQ ID NO: 911227 - DNA, 25 bp, Mus musculus
tgttaatttactactgaccggtcct

SEQ ID NO: 911228 - DNA, 25 bp, Mus musculus
tgttaatttacttctgaccggtcct

SEQ ID NO: 911229 - DNA, 25 bp, Mus musculus
tgttacaaaatcagtgtgccacccc

SEQ ID NO: 911230 - DNA, 25 bp, Mus musculus
tgttacaaaatctgtgtgccacccc

SEQ ID NO: 911231 - DNA, 25 bp, Mus musculus
tgttacaacacgctggcaatctgtt

SEQ ID NO: 911232 - DNA, 25 bp, Mus musculus
tgttacaacacggtggcaatctgtt

SEQ ID NO: 911233 - DNA, 25 bp, Mus musculus
tgttacaactatcctttggtgccct

SEQ ID NO: 911234 - DNA, 25 bp, Mus musculus
tgttacaactatgctttggtgccct

SEQ ID NO: 911235 - DNA, 25 bp, Mus musculus
tgttacaatacaccctttgtctacg

SEQ ID NO: 911236 - DNA, 25 bp, Mus musculus
tgttacaatacagcctttgtctacg

SEQ ID NO: 911237 - DNA, 25 bp, Mus musculus
tgttacaatggccaactcctgcacc

SEQ ID NO: 911238 - DNA, 25 bp, Mus musculus
tgttacaatggcgaactcctgcacc

SEQ ID NO: 911239 - DNA, 25 bp, Mus musculus
tgttacaattccatgtgtcctcctc

SEQ ID NO: 911240 - DNA, 25 bp, Mus musculus
tgttacaattccttgtgtcctcctc

SEQ ID NO: 911241 - DNA, 25 bp, Mus musculus
tgttacacacaaaagggcaggatac

SEQ ID NO: 911242 - DNA, 25 bp, Mus musculus
tgttacacacaatagggcaggatac

SEQ ID NO: 911243 - DNA, 25 bp, Mus musculus
tgttacacacccatgatcacagaag

SEQ ID NO: 911244 - DNA, 25 bp, Mus musculus
tgttacacacccttgatcacagaag

SEQ ID NO: 911245 - DNA, 25 bp, Mus musculus
tgttacacacgtcaacagacagctt

SEQ ID NO: 911246 - DNA, 25 bp, Mus musculus
tgttacacacgtgaacagacagctt

SEQ ID NO: 911247 - DNA, 25 bp, Mus musculus
tgttacacagccatcctgtccttgt

SEQ ID NO: 911248 - DNA, 25 bp, Mus musculus
tgttacacagccttcctgtccttgt

SEQ ID NO: 911249 - DNA, 25 bp, Mus musculus
tgttacacaggtccagaaggcctag

SEQ ID NO: 911250 - DNA, 25 bp, Mus musculus
tgttacacaggtgcagaaggcctag

SEQ ID NO: 911251 - DNA, 25 bp, Mus musculus
tgttacacccagcccctggatgaag

SEQ ID NO: 911252 - DNA, 25 bp, Mus musculus
tgttacacccaggccctggatgaag

SEQ ID NO: 911253 - DNA, 25 bp, Mus musculus
tgttacacctccattcgctattcct

SEQ ID NO: 911254 - DNA, 25 bp, Mus musculus
tgttacacctcctttcgctattcct

SEQ ID NO: 911255 - DNA, 25 bp, Mus musculus
tgttacactcaaaatactccttccc

SEQ ID NO: 911256 - DNA, 25 bp, Mus musculus
tgttacactcaatatactccttccc

SEQ ID NO: 911257 - DNA, 25 bp, Mus musculus
tgttacactctaattttaaactgga

SEQ ID NO: 911258 - DNA, 25 bp, Mus musculus
tgttacactctatttttaaactgga

SEQ ID NO: 911259 - DNA, 25 bp, Mus musculus
tgttacagaacgaatgggtcaataa

SEQ ID NO: 911260 - DNA, 25 bp, Mus musculus
tgttacagaacgtatgggtcaataa

SEQ ID NO: 911261 - DNA, 25 bp, Mus musculus
tgttacagcttccacactcagccgg

SEQ ID NO: 911262 - DNA, 25 bp, Mus musculus
tgttacagcttcgacactcagccgg

SEQ ID NO: 911263 - DNA, 25 bp, Mus musculus
tgttacaggtgacccttgttaaagg

SEQ ID NO: 911264 - DNA, 25 bp, Mus musculus
tgttacaggtgagccttgttaaagg

SEQ ID NO: 911265 - DNA, 25 bp, Mus musculus
tgttacaggtttacagggtcaaagc

SEQ ID NO: 911266 - DNA, 25 bp, Mus musculus
tgttacaggttttcagggtcaaagc

SEQ ID NO: 911267 - DNA, 25 bp, Mus musculus
tgttacagtcaacccgggagctcca

SEQ ID NO: 911268 - DNA, 25 bp, Mus musculus
tgttacagtcaagccgggagctcca

SEQ ID NO: 911269 - DNA, 25 bp, Mus musculus
tgttacagtttaccgtcttcatgac

SEQ ID NO: 911270 - DNA, 25 bp, Mus musculus
tgttacagtttagcgtcttcatgac

SEQ ID NO: 911271 - DNA, 25 bp, Mus musculus
tgttacagtttcagatgaatgctga

SEQ ID NO: 911272 - DNA, 25 bp, Mus musculus
tgttacagtttctgatgaatgctga

SEQ ID NO: 911273 - DNA, 25 bp, Mus musculus
tgttacatataaatagtttccctat

SEQ ID NO: 911274 - DNA, 25 bp, Mus musculus
tgttacatataattagtttccctat

SEQ ID NO: 911275 - DNA, 25 bp, Mus musculus
tgttacatccagaactacctgccca

SEQ ID NO: 911276 - DNA, 25 bp, Mus musculus
tgttacatccagtactacctgccca

SEQ ID NO: 911277 - DNA, 25 bp, Mus musculus
tgttacatccctcctgaatgaacct

SEQ ID NO: 911278 - DNA, 25 bp, Mus musculus
tgttacatccctgctgaatgaacct

SEQ ID NO: 911279 - DNA, 25 bp, Mus musculus
tgttacatgtaaagtgccattgtga

SEQ ID NO: 911280 - DNA, 25 bp, Mus musculus
tgttacatgtaatgtgccattgtga

SEQ ID NO: 911281 - DNA, 25 bp, Mus musculus
tgttacattactcggttcacagaag

SEQ ID NO: 911282 - DNA, 25 bp, Mus musculus
tgttacattactgggttcacagaag

SEQ ID NO: 911283 - DNA, 25 bp, Mus musculus
tgttacattcacagtgtctcctctc

SEQ ID NO: 911284 - DNA, 25 bp, Mus musculus
tgttacattcactgtgtctcctctc

SEQ ID NO: 911285 - DNA, 25 bp, Mus musculus
tgttacattcttcgtacttcagtac

SEQ ID NO: 911286 - DNA, 25 bp, Mus musculus
tgttacattcttggtacttcagtac

SEQ ID NO: 911287 - DNA, 25 bp, Mus musculus
tgttacatttttcaccaccccacct

SEQ ID NO: 911288 - DNA, 25 bp, Mus musculus
tgttacatttttgaccaccccacct

SEQ ID NO: 911289 - DNA, 25 bp, Mus musculus
tgttaccaacaacttgaaatccctg

SEQ ID NO: 911290 - DNA, 25 bp, Mus musculus
tgttaccaacaagttgaaatccctg

SEQ ID NO: 911291 - DNA, 25 bp, Mus musculus
tgttaccaactgcgacgacatggag

SEQ ID NO: 911292 - DNA, 25 bp, Mus musculus
tgttaccaactgggacgacatggag

SEQ ID NO: 911293 - DNA, 25 bp, Mus musculus
tgttaccaacttactaggagggctt

SEQ ID NO: 911294 - DNA, 25 bp, Mus musculus
tgttaccaactttctaggagggctt

SEQ ID NO: 911295 - DNA, 25 bp, Mus musculus
tgttaccaaggaaacctcctggctt

SEQ ID NO: 911296 - DNA, 25 bp, Mus musculus
tgttaccaaggatacctcctggctt

SEQ ID NO: 911297 - DNA, 25 bp, Mus musculus
tgttaccaattccagtcttccagga

SEQ ID NO: 911298 - DNA, 25 bp, Mus musculus
tgttaccaattcgagtcttccagga

SEQ ID NO: 911299 - DNA, 25 bp, Mus musculus
tgttaccacaagctccatcaggaca

SEQ ID NO: 911300 - DNA, 25 bp, Mus musculus
tgttaccacaaggtccatcaggaca

SEQ ID NO: 911301 - DNA, 25 bp, Mus musculus
tgttaccacaatatgctccacggca

SEQ ID NO: 911302 - DNA, 25 bp, Mus musculus
tgttaccacaatttgctccacggca

SEQ ID NO: 911303 - DNA, 25 bp, Mus musculus
tgttaccacagtatatcgaccggcc

SEQ ID NO: 911304 - DNA, 25 bp, Mus musculus
tgttaccacagtttatcgaccggcc

SEQ ID NO: 911305 - DNA, 25 bp, Mus musculus
tgttaccactgccaggacaaatagt

SEQ ID NO: 911306 - DNA, 25 bp, Mus musculus
tgttaccactgcgaggacaaatagt

SEQ ID NO: 911307 - DNA, 25 bp, Mus musculus
tgttaccacttgattttaccttaca

SEQ ID NO: 911308 - DNA, 25 bp, Mus musculus
tgttaccacttgtttttaccttaca

SEQ ID NO: 911309 - DNA, 25 bp, Mus musculus
tgttaccagctaccgagacctacaa

SEQ ID NO: 911310 - DNA, 25 bp, Mus musculus
tgttaccagctagcgagacctacaa

SEQ ID NO: 911311 - DNA, 25 bp, Mus musculus
tgttaccaggaaacctcgacttact

SEQ ID NO: 911312 - DNA, 25 bp, Mus musculus
tgttaccaggaatcctcgacttact

SEQ ID NO: 911313 - DNA, 25 bp, Mus musculus
tgttaccaggtcagtcattcaccta

SEQ ID NO: 911314 - DNA, 25 bp, Mus musculus
tgttaccaggtctgtcattcaccta

SEQ ID NO: 911315 - DNA, 25 bp, Mus musculus
tgttaccagtaaaccattcacgctt

SEQ ID NO: 911316 - DNA, 25 bp, Mus musculus
tgttaccagtaatccattcacgctt

SEQ ID NO: 911317 - DNA, 25 bp, Mus musculus
tgttaccattctcgagggcccttac

SEQ ID NO: 911318 - DNA, 25 bp, Mus musculus
tgttaccattctggagggcccttac

SEQ ID NO: 911319 - DNA, 25 bp, Mus musculus
tgttaccattgtacttacataggac

SEQ ID NO: 911320 - DNA, 25 bp, Mus musculus
tgttaccattgttcttacataggac

SEQ ID NO: 911321 - DNA, 25 bp, Mus musculus
tgttacccaataagcgaccgcagga

SEQ ID NO: 911322 - DNA, 25 bp, Mus musculus
tgttacccaatatgcgaccgcagga

SEQ ID NO: 911323 - DNA, 25 bp, Mus musculus
tgttacccaccacaagaggacttgc

SEQ ID NO: 911324 - DNA, 25 bp, Mus musculus
tgttacccaccagaagaggacttgc

SEQ ID NO: 911325 - DNA, 25 bp, Mus musculus
tgttacccatgtatgccactataga

SEQ ID NO: 911326 - DNA, 25 bp, Mus musculus
tgttacccatgtttgccactataga

SEQ ID NO: 911327 - DNA, 25 bp, Mus musculus
tgttaccccaaacgtcatgaaactt

SEQ ID NO: 911328 - DNA, 25 bp, Mus musculus
tgttaccccaaaggtcatgaaactt

SEQ ID NO: 911329 - DNA, 25 bp, Mus musculus
tgttaccccaacactagtattactg

SEQ ID NO: 911330 - DNA, 25 bp, Mus musculus
tgttaccccaactctagtattactg

SEQ ID NO: 911331 - DNA, 25 bp, Mus musculus
tgttacccctctcgatattggctga

SEQ ID NO: 911332 - DNA, 25 bp, Mus musculus
tgttacccctctggatattggctga

SEQ ID NO: 911333 - DNA, 25 bp, Mus musculus
tgttacccctggagaatgtttactt

SEQ ID NO: 911334 - DNA, 25 bp, Mus musculus
tgttacccctggtgaatgtttactt

SEQ ID NO: 911335 - DNA, 25 bp, Mus musculus
tgttacccgaccaggcatcaaaact

SEQ ID NO: 911336 - DNA, 25 bp, Mus musculus
tgttacccgacctggcatcaaaact

SEQ ID NO: 911337 - DNA, 25 bp, Mus musculus
tgttacccgcctattctaattgaat

SEQ ID NO: 911338 - DNA, 25 bp, Mus musculus
tgttacccgccttttctaattgaat

SEQ ID NO: 911339 - DNA, 25 bp, Mus musculus
tgttaccctcccctgggattttcag

SEQ ID NO: 911340 - DNA, 25 bp, Mus musculus
tgttaccctcccgtgggattttcag

SEQ ID NO: 911341 - DNA, 25 bp, Mus musculus
tgttaccctgagctggcccaatgga

SEQ ID NO: 911342 - DNA, 25 bp, Mus musculus
tgttaccctgaggtggcccaatgga

SEQ ID NO: 911343 - DNA, 25 bp, Mus musculus
tgttaccctgtaatactggcattta

SEQ ID NO: 911344 - DNA, 25 bp, Mus musculus
tgttaccctgtattactggcattta

SEQ ID NO: 911345 - DNA, 25 bp, Mus musculus
tgttacccttttacaatgaactttg

SEQ ID NO: 911346 - DNA, 25 bp, Mus musculus
tgttacccttttctgggcatcaggc

SEQ ID NO: 911347 - DNA, 25 bp, Mus musculus
tgttacccttttgtgggcatcaggc

SEQ ID NO: 911348 - DNA, 25 bp, Mus musculus
tgttaccctttttcaatgaactttg

SEQ ID NO: 911349 - DNA, 25 bp, Mus musculus
tgttaccgactcacactccagcaga

SEQ ID NO: 911350 - DNA, 25 bp, Mus musculus
tgttaccgactctcactccagcaga

SEQ ID NO: 911351 - DNA, 25 bp, Mus musculus
tgttaccgtcagaacacccagcaga

SEQ ID NO: 911352 - DNA, 25 bp, Mus musculus
tgttaccgtcagtacacccagcaga

SEQ ID NO: 911353 - DNA, 25 bp, Mus musculus
tgttacctaaagctacttcccacat

SEQ ID NO: 911354 - DNA, 25 bp, Mus musculus
tgttacctaaaggtacttcccacat

SEQ ID NO: 911355 - DNA, 25 bp, Mus musculus
tgttacctaatgctatttgggcctt

SEQ ID NO: 911356 - DNA, 25 bp, Mus musculus
tgttacctaatggtatttgggcctt

SEQ ID NO: 911357 - DNA, 25 bp, Mus musculus
tgttacctcagaatttcattaaaat

SEQ ID NO: 911358 - DNA, 25 bp, Mus musculus
tgttacctcagattttcattaaaat

SEQ ID NO: 911359 - DNA, 25 bp, Mus musculus
tgttacctccaacagtccttgcaag

SEQ ID NO: 911360 - DNA, 25 bp, Mus musculus
tgttacctccaagagtccttgcaag

SEQ ID NO: 911361 - DNA, 25 bp, Mus musculus
tgttacctccacataaatgtcttaa

SEQ ID NO: 911362 - DNA, 25 bp, Mus musculus
tgttacctccacttaaatgtcttaa

SEQ ID NO: 911363 - DNA, 25 bp, Mus musculus
tgttacctcctgaaaataagcttac

SEQ ID NO: 911364 - DNA, 25 bp, Mus musculus
tgttacctcctgtaaataagcttac

SEQ ID NO: 911365 - DNA, 25 bp, Mus musculus
tgttacctcgtgacaaggctctaga

SEQ ID NO: 911366 - DNA, 25 bp, Mus musculus
tgttacctcgtgtcaaggctctaga

SEQ ID NO: 911367 - DNA, 25 bp, Mus musculus
tgttacctgctgattacaccagctg

SEQ ID NO: 911368 - DNA, 25 bp, Mus musculus
tgttacctgctgtttacaccagctg

SEQ ID NO: 911369 - DNA, 25 bp, Mus musculus
tgttacctgggtcattgtgcaataa

SEQ ID NO: 911370 - DNA, 25 bp, Mus musculus
tgttacctgggtgattgtgcaataa

SEQ ID NO: 911371 - DNA, 25 bp, Mus musculus
tgttacctgtgtcgcaagaaaatgc

SEQ ID NO: 911372 - DNA, 25 bp, Mus musculus
tgttacctgtgtggcaagaaaatgc

SEQ ID NO: 911373 - DNA, 25 bp, Mus musculus
tgttacctgtttagtttctgattgt

SEQ ID NO: 911374 - DNA, 25 bp, Mus musculus
tgttacctgttttgtttctgattgt

SEQ ID NO: 911375 - DNA, 25 bp, Mus musculus
tgttaccttcctagtaactctcgaa

SEQ ID NO: 911376 - DNA, 25 bp, Mus musculus
tgttaccttccttgtaactctcgaa

SEQ ID NO: 911377 - DNA, 25 bp, Mus musculus
tgttacctttgtcttcaaacggtgg

SEQ ID NO: 911378 - DNA, 25 bp, Mus musculus
tgttacctttgtgttcaaacggtgg

SEQ ID NO: 911379 - DNA, 25 bp, Mus musculus
tgttaccttttccaagcatttcttc

SEQ ID NO: 911380 - DNA, 25 bp, Mus musculus
tgttaccttttcgaagcatttcttc

SEQ ID NO: 911381 - DNA, 25 bp, Mus musculus
tgttaccttttgcagtcggtcttaa

SEQ ID NO: 911382 - DNA, 25 bp, Mus musculus
tgttaccttttggagtcggtcttaa

SEQ ID NO: 911383 - DNA, 25 bp, Mus musculus
tgttacgatgcacatatttaaactt

SEQ ID NO: 911384 - DNA, 25 bp, Mus musculus
tgttacgatgcagatatttaaactt

SEQ ID NO: 911385 - DNA, 25 bp, Mus musculus
tgttacgatttgaaatacacagaga

SEQ ID NO: 911386 - DNA, 25 bp, Mus musculus
tgttacgatttgtaatacacagaga

SEQ ID NO: 911387 - DNA, 25 bp, Mus musculus
tgttacgctttacggcacagaatgc

SEQ ID NO: 911388 - DNA, 25 bp, Mus musculus
tgttacgctttagggcacagaatgc

SEQ ID NO: 911389 - DNA, 25 bp, Mus musculus
tgttacggactacggagccaggccc

SEQ ID NO: 911390 - DNA, 25 bp, Mus musculus
tgttacggactagggagccaggccc

SEQ ID NO: 911391 - DNA, 25 bp, Mus musculus
tgttacgtctaacggaactgaagtt

SEQ ID NO: 911392 - DNA, 25 bp, Mus musculus
tgttacgtctaagggaactgaagtt

SEQ ID NO: 911393 - DNA, 25 bp, Mus musculus
tgttacgtgggcactgatcttcaaa

SEQ ID NO: 911394 - DNA, 25 bp, Mus musculus
tgttacgtgggctctgatcttcaaa

SEQ ID NO: 911395 - DNA, 25 bp, Mus musculus
tgttactacaatctacggtgtgata

SEQ ID NO: 911396 - DNA, 25 bp, Mus musculus
tgttactacaatgtacggtgtgata

SEQ ID NO: 911397 - DNA, 25 bp, Mus musculus
tgttactaggtactttttcttgtgg

SEQ ID NO: 911398 - DNA, 25 bp, Mus musculus
tgttactaggtagtttttcttgtgg

SEQ ID NO: 911399 - DNA, 25 bp, Mus musculus
tgttactatccacagccacgtttgc

SEQ ID NO: 911400 - DNA, 25 bp, Mus musculus
tgttactatccagagccacgtttgc

SEQ ID NO: 911401 - DNA, 25 bp, Mus musculus
tgttactcactgaggttcatcaaat

SEQ ID NO: 911402 - DNA, 25 bp, Mus musculus
tgttactcactgtggttcatcaaat

SEQ ID NO: 911403 - DNA, 25 bp, Mus musculus
tgttactcagacacaaccacggttt

SEQ ID NO: 911404 - DNA, 25 bp, Mus musculus
tgttactcagactcaaccacggttt

SEQ ID NO: 911405 - DNA, 25 bp, Mus musculus
tgttactcagtgcaaggcctggtgt

SEQ ID NO: 911406 - DNA, 25 bp, Mus musculus
tgttactcagtggaaggcctggtgt

SEQ ID NO: 911407 - DNA, 25 bp, Mus musculus
tgttactcattaatgctaagcagtg

SEQ ID NO: 911408 - DNA, 25 bp, Mus musculus
tgttactcattattgctaagcagtg

SEQ ID NO: 911409 - DNA, 25 bp, Mus musculus
tgttactcctgtccaccgctcagtg

SEQ ID NO: 911410 - DNA, 25 bp, Mus musculus
tgttactcctgtgcaccgctcagtg

SEQ ID NO: 911411 - DNA, 25 bp, Mus musculus
tgttactccttacagctccttggaa

SEQ ID NO: 911412 - DNA, 25 bp, Mus musculus
tgttactccttagagctccttggaa

SEQ ID NO: 911413 - DNA, 25 bp, Mus musculus
tgttactctcaaatgtgctgtctga

SEQ ID NO: 911414 - DNA, 25 bp, Mus musculus
tgttactctcaattgtgctgtctga

SEQ ID NO: 911415 - DNA, 25 bp, Mus musculus
tgttactctccaaatgtgacctaag

SEQ ID NO: 911416 - DNA, 25 bp, Mus musculus
tgttactctccatatgtgacctaag

SEQ ID NO: 911417 - DNA, 25 bp, Mus musculus
tgttactctgacaggattactccta

SEQ ID NO: 911418 - DNA, 25 bp, Mus musculus
tgttactctgactggattactccta

SEQ ID NO: 911419 - DNA, 25 bp, Mus musculus
tgttactgaccactaggccttggca

SEQ ID NO: 911420 - DNA, 25 bp, Mus musculus
tgttactgaccagtaggccttggca

SEQ ID NO: 911421 - DNA, 25 bp, Mus musculus
tgttactgagagagaccagcccacc

SEQ ID NO: 911422 - DNA, 25 bp, Mus musculus
tgttactgagagtgaccagcccacc

SEQ ID NO: 911423 - DNA, 25 bp, Mus musculus
tgttactgcactcagcgactggagt

SEQ ID NO: 911424 - DNA, 25 bp, Mus musculus
tgttactgcactgagcgactggagt

SEQ ID NO: 911425 - DNA, 25 bp, Mus musculus
tgttactgcagaagaggcgacaggt

SEQ ID NO: 911426 - DNA, 25 bp, Mus musculus
tgttactgcagatgaggcgacaggt

SEQ ID NO: 911427 - DNA, 25 bp, Mus musculus
tgttactgccaacaagcaccctgat

SEQ ID NO: 911428 - DNA, 25 bp, Mus musculus
tgttactgccaagaagcaccctgat

SEQ ID NO: 911429 - DNA, 25 bp, Mus musculus
tgttactgccatacatgactttctg

SEQ ID NO: 911430 - DNA, 25 bp, Mus musculus
tgttactgccattcatgactttctg

SEQ ID NO: 911431 - DNA, 25 bp, Mus musculus
tgttactgccccagagaagaacctc

SEQ ID NO: 911432 - DNA, 25 bp, Mus musculus
tgttactgcccctgagaagaacctc

SEQ ID NO: 911433 - DNA, 25 bp, Mus musculus
tgttactgccggatgaaagccatga

SEQ ID NO: 911434 - DNA, 25 bp, Mus musculus
tgttactgccggttgaaagccatga

SEQ ID NO: 911435 - DNA, 25 bp, Mus musculus
tgttactggtaaattgcattttctt

SEQ ID NO: 911436 - DNA, 25 bp, Mus musculus
tgttactggtaacactccctaactg

SEQ ID NO: 911437 - DNA, 25 bp, Mus musculus
tgttactggtaagactccctaactg

SEQ ID NO: 911438 - DNA, 25 bp, Mus musculus
tgttactggtaatttgcattttctt

SEQ ID NO: 911439 - DNA, 25 bp, Mus musculus
tgttactgtgctctgcctatcttag

SEQ ID NO: 911440 - DNA, 25 bp, Mus musculus
tgttactgtgctgtgcctatcttag

SEQ ID NO: 911441 - DNA, 25 bp, Mus musculus
tgttactgtgttcccttagagcatg

SEQ ID NO: 911442 - DNA, 25 bp, Mus musculus
tgttactgtgttgccttagagcatg

SEQ ID NO: 911443 - DNA, 25 bp, Mus musculus
tgttactgttaacaccagcctcctc

SEQ ID NO: 911444 - DNA, 25 bp, Mus musculus
tgttactgttaactgtgcctggagt

SEQ ID NO: 911445 - DNA, 25 bp, Mus musculus
tgttactgttaagaccagcctcctc

SEQ ID NO: 911446 - DNA, 25 bp, Mus musculus
tgttactgttaagtgtgcctggagt

SEQ ID NO: 911447 - DNA, 25 bp, Mus musculus
tgttactgtttacgtctagtcttcc

SEQ ID NO: 911448 - DNA, 25 bp, Mus musculus
tgttactgtttaggtctagtcttcc

SEQ ID NO: 911449 - DNA, 25 bp, Mus musculus
tgttacttaaacacaaaactgccaa

SEQ ID NO: 911450 - DNA, 25 bp, Mus musculus
tgttacttaaactcaaaactgccaa

SEQ ID NO: 911451 - DNA, 25 bp, Mus musculus
tgttacttctcgctttcttaccata

SEQ ID NO: 911452 - DNA, 25 bp, Mus musculus
tgttacttctcggtttcttaccata

SEQ ID NO: 911453 - DNA, 25 bp, Mus musculus
tgttacttcttacagctgcgttcac

SEQ ID NO: 911454 - DNA, 25 bp, Mus musculus
tgttacttcttagagctgcgttcac

SEQ ID NO: 911455 - DNA, 25 bp, Mus musculus
tgttacttgaatcagtcatgaccaa

SEQ ID NO: 911456 - DNA, 25 bp, Mus musculus
tgttacttgaatgagtcatgaccaa

SEQ ID NO: 911457 - DNA, 25 bp, Mus musculus
tgttacttgctacagacatggatga

SEQ ID NO: 911458 - DNA, 25 bp, Mus musculus
tgttacttgctagagacatggatga

SEQ ID NO: 911459 - DNA, 25 bp, Mus musculus
tgttacttgcttacatatgccatgc

SEQ ID NO: 911460 - DNA, 25 bp, Mus musculus
tgttacttgctttcatatgccatgc

SEQ ID NO: 911461 - DNA, 25 bp, Mus musculus
tgttactttccacttctcaataaat

SEQ ID NO: 911462 - DNA, 25 bp, Mus musculus
tgttactttccagttctcaataaat

SEQ ID NO: 911463 - DNA, 25 bp, Mus musculus
tgttactttgaaaaccattaagaag

SEQ ID NO: 911464 - DNA, 25 bp, Mus musculus
tgttactttgaataccattaagaag

SEQ ID NO: 911465 - DNA, 25 bp, Mus musculus
tgttagaaacacaagccatgccttc

SEQ ID NO: 911466 - DNA, 25 bp, Mus musculus
tgttagaaacactagccatgccttc

SEQ ID NO: 911467 - DNA, 25 bp, Mus musculus
tgttagaactctagacttgccctgt

SEQ ID NO: 911468 - DNA, 25 bp, Mus musculus
tgttagaactcttgacttgccctgt

SEQ ID NO: 911469 - DNA, 25 bp, Mus musculus
tgttagaattcacacacagggcttc

SEQ ID NO: 911470 - DNA, 25 bp, Mus musculus
tgttagaattcagacacagggcttc

SEQ ID NO: 911471 - DNA, 25 bp, Mus musculus
tgttagacagttccctagaaagaaa

SEQ ID NO: 911472 - DNA, 25 bp, Mus musculus
tgttagacagttgcctagaaagaaa

SEQ ID NO: 911473 - DNA, 25 bp, Mus musculus
tgttagaccctcagtgcccatgaca

SEQ ID NO: 911474 - DNA, 25 bp, Mus musculus
tgttagaccctctgtgcccatgaca

SEQ ID NO: 911475 - DNA, 25 bp, Mus musculus
tgttagacctaaccatgtgtaattg

SEQ ID NO: 911476 - DNA, 25 bp, Mus musculus
tgttagacctaagcatgtgtaattg

SEQ ID NO: 911477 - DNA, 25 bp, Mus musculus
tgttagagccccaacaggcattgtt

SEQ ID NO: 911478 - DNA, 25 bp, Mus musculus
tgttagagcccctacaggcattgtt

SEQ ID NO: 911479 - DNA, 25 bp, Mus musculus
tgttagagctggaaccgcctgccgg

SEQ ID NO: 911480 - DNA, 25 bp, Mus musculus
tgttagagctggtaccgcctgccgg

SEQ ID NO: 911481 - DNA, 25 bp, Mus musculus
tgttagaggcccaccgttctttgca

SEQ ID NO: 911482 - DNA, 25 bp, Mus musculus
tgttagaggccctccgttctttgca

SEQ ID NO: 911483 - DNA, 25 bp, Mus musculus
tgttagaggtgtcgtcgtccagcac

SEQ ID NO: 911484 - DNA, 25 bp, Mus musculus
tgttagaggtgtggtcgtccagcac

SEQ ID NO: 911485 - DNA, 25 bp, Mus musculus
tgttagatagcgacttagccaccct

SEQ ID NO: 911486 - DNA, 25 bp, Mus musculus
tgttagatagcgctttacccttgcc

SEQ ID NO: 911487 - DNA, 25 bp, Mus musculus
tgttagatagcggtttacccttgcc

SEQ ID NO: 911488 - DNA, 25 bp, Mus musculus
tgttagatagcgtcttagccaccct

SEQ ID NO: 911489 - DNA, 25 bp, Mus musculus
tgttagatggaacaccatgagcctt

SEQ ID NO: 911490 - DNA, 25 bp, Mus musculus
tgttagatggaagaccatgagcctt

SEQ ID NO: 911491 - DNA, 25 bp, Mus musculus
tgttagcaacacatctaccagccct

SEQ ID NO: 911492 - DNA, 25 bp, Mus musculus
tgttagcaacacttctaccagccct

SEQ ID NO: 911493 - DNA, 25 bp, Mus musculus
tgttagcaatgcctcatacccagaa

SEQ ID NO: 911494 - DNA, 25 bp, Mus musculus
tgttagcaatgcgtcatacccagaa

SEQ ID NO: 911495 - DNA, 25 bp, Mus musculus
tgttagcacaaaagactatacggtc

SEQ ID NO: 911496 - DNA, 25 bp, Mus musculus
tgttagcacaaatgactatacggtc

SEQ ID NO: 911497 - DNA, 25 bp, Mus musculus
tgttagcatgcaatggacattttgc

SEQ ID NO: 911498 - DNA, 25 bp, Mus musculus
tgttagcatgcattggacattttgc

SEQ ID NO: 911499 - DNA, 25 bp, Mus musculus
tgttagcatggcctgcggcagcatc

SEQ ID NO: 911500 - DNA, 25 bp, Mus musculus
tgttagcatggcgtgcggcagcatc

SEQ ID NO: 911501 - DNA, 25 bp, Mus musculus
tgttagccagacagaaagcccacct

SEQ ID NO: 911502 - DNA, 25 bp, Mus musculus
tgttagccagactgaaagcccacct

SEQ ID NO: 911503 - DNA, 25 bp, Mus musculus
tgttagccagttaccgtcagctagc

SEQ ID NO: 911504 - DNA, 25 bp, Mus musculus
tgttagccagtttccgtcagctagc

SEQ ID NO: 911505 - DNA, 25 bp, Mus musculus
tgttagcccatgagccctctttatg

SEQ ID NO: 911506 - DNA, 25 bp, Mus musculus
tgttagcccatgtgccctctttatg

SEQ ID NO: 911507 - DNA, 25 bp, Mus musculus
tgttagccctgcacataagagacga

SEQ ID NO: 911508 - DNA, 25 bp, Mus musculus
tgttagccctgcatagatacttgcc

SEQ ID NO: 911509 - DNA, 25 bp, Mus musculus
tgttagccctgctcataagagacga

SEQ ID NO: 911510 - DNA, 25 bp, Mus musculus
tgttagccctgcttagatacttgcc

SEQ ID NO: 911511 - DNA, 25 bp, Mus musculus
tgttagccgctcaccagtgggtcag

SEQ ID NO: 911512 - DNA, 25 bp, Mus musculus
tgttagccgctctccagtgggtcag

SEQ ID NO: 911513 - DNA, 25 bp, Mus musculus
tgttagccggcacagttatcacgac

SEQ ID NO: 911514 - DNA, 25 bp, Mus musculus
tgttagccggcagagttatcacgac

SEQ ID NO: 911515 - DNA, 25 bp, Mus musculus
tgttagccggctatgacgacttcaa

SEQ ID NO: 911516 - DNA, 25 bp, Mus musculus
tgttagccggctattttgggaaatg

SEQ ID NO: 911517 - DNA, 25 bp, Mus musculus
tgttagccggctttgacgacttcaa

SEQ ID NO: 911518 - DNA, 25 bp, Mus musculus
tgttagccggcttttttgggaaatg

SEQ ID NO: 911519 - DNA, 25 bp, Mus musculus
tgttagcctcagactttggtacttt

SEQ ID NO: 911520 - DNA, 25 bp, Mus musculus
tgttagcctcagtctttggtacttt

SEQ ID NO: 911521 - DNA, 25 bp, Mus musculus
tgttagcctgtcacctcacttcctg

SEQ ID NO: 911522 - DNA, 25 bp, Mus musculus
tgttagcctgtctcctcacttcctg

SEQ ID NO: 911523 - DNA, 25 bp, Mus musculus
tgttagccttgtccctgtcttatgt

SEQ ID NO: 911524 - DNA, 25 bp, Mus musculus
tgttagccttgtgcctgtcttatgt

SEQ ID NO: 911525 - DNA, 25 bp, Mus musculus
tgttagcgtgtgatcagtctccttc

SEQ ID NO: 911526 - DNA, 25 bp, Mus musculus
tgttagcgtgtgttcagtctccttc

SEQ ID NO: 911527 - DNA, 25 bp, Mus musculus
tgttagctatcaagttgaactccat

SEQ ID NO: 911528 - DNA, 25 bp, Mus musculus
tgttagctatcatgttgaactccat

SEQ ID NO: 911529 - DNA, 25 bp, Mus musculus
tgttagctctcaaaccgtccaagtg

SEQ ID NO: 911530 - DNA, 25 bp, Mus musculus
tgttagctctcacaaatgatttttc

SEQ ID NO: 911531 - DNA, 25 bp, Mus musculus
tgttagctctcagaaatgatttttc

SEQ ID NO: 911532 - DNA, 25 bp, Mus musculus
tgttagctctcataccgtccaagtg

SEQ ID NO: 911533 - DNA, 25 bp, Mus musculus
tgttagctggaaaggttaccttttt

SEQ ID NO: 911534 - DNA, 25 bp, Mus musculus
tgttagctggaatggttaccttttt

SEQ ID NO: 911535 - DNA, 25 bp, Mus musculus
tgttagctgtatacaatcacagtgg

SEQ ID NO: 911536 - DNA, 25 bp, Mus musculus
tgttagctgtattcaatcacagtgg

SEQ ID NO: 911537 - DNA, 25 bp, Mus musculus
tgttagcttaaactccctaagttct

SEQ ID NO: 911538 - DNA, 25 bp, Mus musculus
tgttagcttaaagtccctaagttct

SEQ ID NO: 911539 - DNA, 25 bp, Mus musculus
tgttagcttacccaactgtttgagg

SEQ ID NO: 911540 - DNA, 25 bp, Mus musculus
tgttagcttaccgaactgtttgagg

SEQ ID NO: 911541 - DNA, 25 bp, Mus musculus
tgttagcttcctcggttcccatgaa

SEQ ID NO: 911542 - DNA, 25 bp, Mus musculus
tgttagcttcctgggttcccatgaa

SEQ ID NO: 911543 - DNA, 25 bp, Mus musculus
tgttagctttttcgcgtgttctgaa

SEQ ID NO: 911544 - DNA, 25 bp, Mus musculus
tgttagctttttggcgtgttctgaa

SEQ ID NO: 911545 - DNA, 25 bp, Mus musculus
tgttaggaaataaaacctttcagat

SEQ ID NO: 911546 - DNA, 25 bp, Mus musculus
tgttaggaaatataacctttcagat

SEQ ID NO: 911547 - DNA, 25 bp, Mus musculus
tgttaggaccctcccaggaaaagca

SEQ ID NO: 911548 - DNA, 25 bp, Mus musculus
tgttaggaccctgccaggaaaagca

SEQ ID NO: 911549 - DNA, 25 bp, Mus musculus
tgttaggaggtgctgtctcccacca

SEQ ID NO: 911550 - DNA, 25 bp, Mus musculus
tgttaggaggtggtgtctcccacca

SEQ ID NO: 911551 - DNA, 25 bp, Mus musculus
tgttaggataacaagtgactctgat

SEQ ID NO: 911552 - DNA, 25 bp, Mus musculus
tgttaggataactagtgactctgat

SEQ ID NO: 911553 - DNA, 25 bp, Mus musculus
tgttaggccattacttttaggaact

SEQ ID NO: 911554 - DNA, 25 bp, Mus musculus
tgttaggccatttcttttaggaact

SEQ ID NO: 911555 - DNA, 25 bp, Mus musculus
tgttaggcctgactcttagaagagt

SEQ ID NO: 911556 - DNA, 25 bp, Mus musculus
tgttaggcctgagtcttagaagagt

SEQ ID NO: 911557 - DNA, 25 bp, Mus musculus
tgttaggctggaatgcaacctccct

SEQ ID NO: 911558 - DNA, 25 bp, Mus musculus
tgttaggctggattgcaacctccct

SEQ ID NO: 911559 - DNA, 25 bp, Mus musculus
tgttagggacccagcggaagatgtc

SEQ ID NO: 911560 - DNA, 25 bp, Mus musculus
tgttagggaccctgcggaagatgtc

SEQ ID NO: 911561 - DNA, 25 bp, Mus musculus
tgttagggactcatatccctccaga

SEQ ID NO: 911562 - DNA, 25 bp, Mus musculus
tgttagggactcttatccctccaga

SEQ ID NO: 911563 - DNA, 25 bp, Mus musculus
tgttaggtccccagtgctgaggcgt

SEQ ID NO: 911564 - DNA, 25 bp, Mus musculus
tgttaggtcccctgtgctgaggcgt

SEQ ID NO: 911565 - DNA, 25 bp, Mus musculus
tgttaggtccgcactcaggtgcttt

SEQ ID NO: 911566 - DNA, 25 bp, Mus musculus
tgttaggtccgctctcaggtgcttt

SEQ ID NO: 911567 - DNA, 25 bp, Mus musculus
tgttaggtcttcagctaagcacgaa

SEQ ID NO: 911568 - DNA, 25 bp, Mus musculus
tgttaggtcttctgctaagcacgaa

SEQ ID NO: 911569 - DNA, 25 bp, Mus musculus
tgttaggtgcatagtccattgtaga

SEQ ID NO: 911570 - DNA, 25 bp, Mus musculus
tgttaggtgcattgtccattgtaga

SEQ ID NO: 911571 - DNA, 25 bp, Mus musculus
tgttaggttgaactgatttctgtcc

SEQ ID NO: 911572 - DNA, 25 bp, Mus musculus
tgttaggttgaagtgatttctgtcc

SEQ ID NO: 911573 - DNA, 25 bp, Mus musculus
tgttagtaaaccagttccaccttga

SEQ ID NO: 911574 - DNA, 25 bp, Mus musculus
tgttagtaaacctgttccaccttga

SEQ ID NO: 911575 - DNA, 25 bp, Mus musculus
tgttagtacagcaacagtttactca

SEQ ID NO: 911576 - DNA, 25 bp, Mus musculus
tgttagtacagctacagtttactca

SEQ ID NO: 911577 - DNA, 25 bp, Mus musculus
tgttagtacagtatgggaagtcctt

SEQ ID NO: 911578 - DNA, 25 bp, Mus musculus
tgttagtacagtttgggaagtcctt

SEQ ID NO: 911579 - DNA, 25 bp, Mus musculus
tgttagtagcatcggttccatatcc

SEQ ID NO: 911580 - DNA, 25 bp, Mus musculus
tgttagtagcatgggttccatatcc

SEQ ID NO: 911581 - DNA, 25 bp, Mus musculus
tgttagtcccatacaggttctcgta

SEQ ID NO: 911582 - DNA, 25 bp, Mus musculus
tgttagtcccattcaggttctcgta

SEQ ID NO: 911583 - DNA, 25 bp, Mus musculus
tgttagtccctcaactctttcctga

SEQ ID NO: 911584 - DNA, 25 bp, Mus musculus
tgttagtccctctactctttcctga

SEQ ID NO: 911585 - DNA, 25 bp, Mus musculus
tgttagtctataaggcttccaggca

SEQ ID NO: 911586 - DNA, 25 bp, Mus musculus
tgttagtctatatggcttccaggca

SEQ ID NO: 911587 - DNA, 25 bp, Mus musculus
tgttagtctgtcacattttgctcga

SEQ ID NO: 911588 - DNA, 25 bp, Mus musculus
tgttagtctgtctcattttgctcga

SEQ ID NO: 911589 - DNA, 25 bp, Mus musculus
tgttagtctgtgcattaggtctctg

SEQ ID NO: 911590 - DNA, 25 bp, Mus musculus
tgttagtctgtggattaggtctctg

SEQ ID NO: 911591 - DNA, 25 bp, Mus musculus
tgttagtgaaggactctcatcttac

SEQ ID NO: 911592 - DNA, 25 bp, Mus musculus
tgttagtgaaggtctctcatcttac

SEQ ID NO: 911593 - DNA, 25 bp, Mus musculus
tgttagtgatatagtctctctctct

SEQ ID NO: 911594 - DNA, 25 bp, Mus musculus
tgttagtgatattgtctctctctct

SEQ ID NO: 911595 - DNA, 25 bp, Mus musculus
tgttagtgggaaatgttctcacctc

SEQ ID NO: 911596 - DNA, 25 bp, Mus musculus
tgttagtgggaattgttctcacctc

SEQ ID NO: 911597 - DNA, 25 bp, Mus musculus
tgttagtggtatcatttaccccacc

SEQ ID NO: 911598 - DNA, 25 bp, Mus musculus
tgttagtggtatgatttaccccacc

SEQ ID NO: 911599 - DNA, 25 bp, Mus musculus
tgttagttaatcctgtttgtgtaaa

SEQ ID NO: 911600 - DNA, 25 bp, Mus musculus
tgttagttaatcgtgtttgtgtaaa

SEQ ID NO: 911601 - DNA, 25 bp, Mus musculus
tgttagttagttacacgcaggccgt

SEQ ID NO: 911602 - DNA, 25 bp, Mus musculus
tgttagttagtttcacgcaggccgt

SEQ ID NO: 911603 - DNA, 25 bp, Mus musculus
tgttagttcacaccgctgtgtgtgt

SEQ ID NO: 911604 - DNA, 25 bp, Mus musculus
tgttagttcacagcgctgtgtgtgt

SEQ ID NO: 911605 - DNA, 25 bp, Mus musculus
tgttagttcagaagactcttctaga

SEQ ID NO: 911606 - DNA, 25 bp, Mus musculus
tgttagttcagatgactcttctaga

SEQ ID NO: 911607 - DNA, 25 bp, Mus musculus
tgttagttcctaaagttattctgtt

SEQ ID NO: 911608 - DNA, 25 bp, Mus musculus
tgttagttcctatagttattctgtt

SEQ ID NO: 911609 - DNA, 25 bp, Mus musculus
tgttataaccacacctttttgaaat

SEQ ID NO: 911610 - DNA, 25 bp, Mus musculus
tgttataaccactcctttttgaaat

SEQ ID NO: 911611 - DNA, 25 bp, Mus musculus
tgttataagccccatccttgaggat

SEQ ID NO: 911612 - DNA, 25 bp, Mus musculus
tgttataagcccgatccttgaggat

SEQ ID NO: 911613 - DNA, 25 bp, Mus musculus
tgttataatataaggtcctcagttg

SEQ ID NO: 911614 - DNA, 25 bp, Mus musculus
tgttataatatatggtcctcagttg

SEQ ID NO: 911615 - DNA, 25 bp, Mus musculus
tgttatacacttcacaaccacacgt

SEQ ID NO: 911616 - DNA, 25 bp, Mus musculus
tgttatacacttgacaaccacacgt

SEQ ID NO: 911617 - DNA, 25 bp, Mus musculus
tgttatacagatccctcccctttcg

SEQ ID NO: 911618 - DNA, 25 bp, Mus musculus
tgttatacagatgcctcccctttcg

SEQ ID NO: 911619 - DNA, 25 bp, Mus musculus
tgttatacagccattgagttgcaaa

SEQ ID NO: 911620 - DNA, 25 bp, Mus musculus
tgttatacagcctttgagttgcaaa

SEQ ID NO: 911621 - DNA, 25 bp, Mus musculus
tgttataccagaagccaaaggctaa

SEQ ID NO: 911622 - DNA, 25 bp, Mus musculus
tgttataccagatgccaaaggctaa

SEQ ID NO: 911623 - DNA, 25 bp, Mus musculus
tgttataccctcaaagtgttccttt

SEQ ID NO: 911624 - DNA, 25 bp, Mus musculus
tgttataccctctaagtgttccttt

SEQ ID NO: 911625 - DNA, 25 bp, Mus musculus
tgttatacctcaatgtccagcagcc

SEQ ID NO: 911626 - DNA, 25 bp, Mus musculus
tgttatacctcattgtccagcagcc

SEQ ID NO: 911627 - DNA, 25 bp, Mus musculus
tgttatagactaccgagtccatagt

SEQ ID NO: 911628 - DNA, 25 bp, Mus musculus
tgttatagactagcgagtccatagt

SEQ ID NO: 911629 - DNA, 25 bp, Mus musculus
tgttatagctgtagcaacctgggtc

SEQ ID NO: 911630 - DNA, 25 bp, Mus musculus
tgttatagctgttgcaacctgggtc

SEQ ID NO: 911631 - DNA, 25 bp, Mus musculus
tgttataggcagactttgtgagtga

SEQ ID NO: 911632 - DNA, 25 bp, Mus musculus
tgttataggcagtctttgtgagtga

SEQ ID NO: 911633 - DNA, 25 bp, Mus musculus
tgttatatagccagtgagccccagc

SEQ ID NO: 911634 - DNA, 25 bp, Mus musculus
tgttatatagcctgtgagccccagc

SEQ ID NO: 911635 - DNA, 25 bp, Mus musculus
tgttatatgttgatttgcacaaggg

SEQ ID NO: 911636 - DNA, 25 bp, Mus musculus
tgttatatgttgttttgcacaaggg

SEQ ID NO: 911637 - DNA, 25 bp, Mus musculus
tgttatattcttactccaacagtga

SEQ ID NO: 911638 - DNA, 25 bp, Mus musculus
tgttatattcttatgctcattctac

SEQ ID NO: 911639 - DNA, 25 bp, Mus musculus
tgttatattctttctccaacagtga

SEQ ID NO: 911640 - DNA, 25 bp, Mus musculus
tgttatattcttttgctcattctac

SEQ ID NO: 911641 - DNA, 25 bp, Mus musculus
tgttatcacacaaattttccccttt

SEQ ID NO: 911642 - DNA, 25 bp, Mus musculus
tgttatcacacatattttccccttt

SEQ ID NO: 911643 - DNA, 25 bp, Mus musculus
tgttatcactatatgccattttgca

SEQ ID NO: 911644 - DNA, 25 bp, Mus musculus
tgttatcactatttgccattttgca

SEQ ID NO: 911645 - DNA, 25 bp, Mus musculus
tgttatcatcatctactaagtacta

SEQ ID NO: 911646 - DNA, 25 bp, Mus musculus
tgttatcatcatgtactaagtacta

SEQ ID NO: 911647 - DNA, 25 bp, Mus musculus
tgttatccaagtagccaggcttgat

SEQ ID NO: 911648 - DNA, 25 bp, Mus musculus
tgttatccaagttgccaggcttgat

SEQ ID NO: 911649 - DNA, 25 bp, Mus musculus
tgttatcccaaaccatacatcctga

SEQ ID NO: 911650 - DNA, 25 bp, Mus musculus
tgttatcccaaagcatacatcctga

SEQ ID NO: 911651 - DNA, 25 bp, Mus musculus
tgttatcccaaccttaccactggga

SEQ ID NO: 911652 - DNA, 25 bp, Mus musculus
tgttatcccaacgttaccactggga

SEQ ID NO: 911653 - DNA, 25 bp, Mus musculus
tgttatcccagcatttgcctttcag

SEQ ID NO: 911654 - DNA, 25 bp, Mus musculus
tgttatcccagcttttgcctttcag

SEQ ID NO: 911655 - DNA, 25 bp, Mus musculus
tgttatccctctcaaatgtctatat

SEQ ID NO: 911656 - DNA, 25 bp, Mus musculus
tgttatccctctgaaatgtctatat

SEQ ID NO: 911657 - DNA, 25 bp, Mus musculus
tgttatccgcaaagcagatacctcc

SEQ ID NO: 911658 - DNA, 25 bp, Mus musculus
tgttatccgcaatgcagatacctcc

SEQ ID NO: 911659 - DNA, 25 bp, Mus musculus
tgttatcctcacctgattccaggga

SEQ ID NO: 911660 - DNA, 25 bp, Mus musculus
tgttatcctcacgtgattccaggga

SEQ ID NO: 911661 - DNA, 25 bp, Mus musculus
tgttatcctcagctccatagcaagt

SEQ ID NO: 911662 - DNA, 25 bp, Mus musculus
tgttatcctcaggtccatagcaagt

SEQ ID NO: 911663 - DNA, 25 bp, Mus musculus
tgttatcctcatacctgggatgcaa

SEQ ID NO: 911664 - DNA, 25 bp, Mus musculus
tgttatcctcattcctgggatgcaa

SEQ ID NO: 911665 - DNA, 25 bp, Mus musculus
tgttatcctcttagccctactgtgt

SEQ ID NO: 911666 - DNA, 25 bp, Mus musculus
tgttatcctctttgccctactgtgt

SEQ ID NO: 911667 - DNA, 25 bp, Mus musculus
tgttatccttcacaaggcctgggac

SEQ ID NO: 911668 - DNA, 25 bp, Mus musculus
tgttatccttcagaaggcctgggac

SEQ ID NO: 911669 - DNA, 25 bp, Mus musculus
tgttatctatcacacaagtgctcag

SEQ ID NO: 911670 - DNA, 25 bp, Mus musculus
tgttatctatcagacaagtgctcag

SEQ ID NO: 911671 - DNA, 25 bp, Mus musculus
tgttatctatggaatcgcctccttt

SEQ ID NO: 911672 - DNA, 25 bp, Mus musculus
tgttatctatggtatcgcctccttt

SEQ ID NO: 911673 - DNA, 25 bp, Mus musculus
tgttatctgattcgatccgagcctg

SEQ ID NO: 911674 - DNA, 25 bp, Mus musculus
tgttatctgattggatccgagcctg

SEQ ID NO: 911675 - DNA, 25 bp, Mus musculus
tgttatcttacaagcctttgcctct

SEQ ID NO: 911676 - DNA, 25 bp, Mus musculus
tgttatcttacatgcctttgcctct

SEQ ID NO: 911677 - DNA, 25 bp, Mus musculus
tgttatcttccacggtactttagct

SEQ ID NO: 911678 - DNA, 25 bp, Mus musculus
tgttatcttccagggtactttagct

SEQ ID NO: 911679 - DNA, 25 bp, Mus musculus
tgttatgacatcactttcttcctgg

SEQ ID NO: 911680 - DNA, 25 bp, Mus musculus
tgttatgacatctctttcttcctgg

SEQ ID NO: 911681 - DNA, 25 bp, Mus musculus
tgttatgactgtaggcactgccagc

SEQ ID NO: 911682 - DNA, 25 bp, Mus musculus
tgttatgactgttggcactgccagc

SEQ ID NO: 911683 - DNA, 25 bp, Mus musculus
tgttatgatcacctcttagcagtat

SEQ ID NO: 911684 - DNA, 25 bp, Mus musculus
tgttatgatcacgtcttagcagtat

SEQ ID NO: 911685 - DNA, 25 bp, Mus musculus
tgttatgatcagagcctggcactat

SEQ ID NO: 911686 - DNA, 25 bp, Mus musculus
tgttatgatcagtgcctggcactat

SEQ ID NO: 911687 - DNA, 25 bp, Mus musculus
tgttatgatctacagtcttcctggt

SEQ ID NO: 911688 - DNA, 25 bp, Mus musculus
tgttatgatctagagtcttcctggt

SEQ ID NO: 911689 - DNA, 25 bp, Mus musculus
tgttatgcatttacaactccatttt

SEQ ID NO: 911690 - DNA, 25 bp, Mus musculus
tgttatgcattttcaactccatttt

SEQ ID NO: 911691 - DNA, 25 bp, Mus musculus
tgttatgccctaagtaacagcagag

SEQ ID NO: 911692 - DNA, 25 bp, Mus musculus
tgttatgccctatgtaacagcagag

SEQ ID NO: 911693 - DNA, 25 bp, Mus musculus
tgttatgcggccagtacatgagaaa

SEQ ID NO: 911694 - DNA, 25 bp, Mus musculus
tgttatgcggcctgtacatgagaaa

SEQ ID NO: 911695 - DNA, 25 bp, Mus musculus
tgttatgctcgcatgcctagcttta

SEQ ID NO: 911696 - DNA, 25 bp, Mus musculus
tgttatgctcgcttgcctagcttta

SEQ ID NO: 911697 - DNA, 25 bp, Mus musculus
tgttatggacatccacccaccagtt

SEQ ID NO: 911698 - DNA, 25 bp, Mus musculus
tgttatggacatgcacccaccagtt

SEQ ID NO: 911699 - DNA, 25 bp, Mus musculus
tgttatggtaacattaacctttcaa

SEQ ID NO: 911700 - DNA, 25 bp, Mus musculus
tgttatggtaactttaacctttcaa

SEQ ID NO: 911701 - DNA, 25 bp, Mus musculus
tgttatggtacacgagtttaatccc

SEQ ID NO: 911702 - DNA, 25 bp, Mus musculus
tgttatggtacaggagtttaatccc

SEQ ID NO: 911703 - DNA, 25 bp, Mus musculus
tgttatgtagttcggatagcttagt

SEQ ID NO: 911704 - DNA, 25 bp, Mus musculus
tgttatgtagttgggatagcttagt

SEQ ID NO: 911705 - DNA, 25 bp, Mus musculus
tgttatgtgcctatatccaagcaaa

SEQ ID NO: 911706 - DNA, 25 bp, Mus musculus
tgttatgtgcctttatccaagcaaa

SEQ ID NO: 911707 - DNA, 25 bp, Mus musculus
tgttatgttaaccactccatttatt

SEQ ID NO: 911708 - DNA, 25 bp, Mus musculus
tgttatgttaacgactccatttatt

SEQ ID NO: 911709 - DNA, 25 bp, Mus musculus
tgttatgttcatacgagatgttatg

SEQ ID NO: 911710 - DNA, 25 bp, Mus musculus
tgttatgttcattcgagatgttatg

SEQ ID NO: 911711 - DNA, 25 bp, Mus musculus
tgttattaaattcctttcagtgtgg

SEQ ID NO: 911712 - DNA, 25 bp, Mus musculus
tgttattaaattgctttcagtgtgg

SEQ ID NO: 911713 - DNA, 25 bp, Mus musculus
tgttattaagagaccactggcacag

SEQ ID NO: 911714 - DNA, 25 bp, Mus musculus
tgttattaagagtccactggcacag

SEQ ID NO: 911715 - DNA, 25 bp, Mus musculus
tgttattaaggtacctccacctgct

SEQ ID NO: 911716 - DNA, 25 bp, Mus musculus
tgttattaaggttcctccacctgct

SEQ ID NO: 911717 - DNA, 25 bp, Mus musculus
tgttattaatgacactactttcagt

SEQ ID NO: 911718 - DNA, 25 bp, Mus musculus
tgttattaatgagactactttcagt

SEQ ID NO: 911719 - DNA, 25 bp, Mus musculus
tgttattacagccacactctcagga

SEQ ID NO: 911720 - DNA, 25 bp, Mus musculus
tgttattacagcgacactctcagga

SEQ ID NO: 911721 - DNA, 25 bp, Mus musculus
tgttattagggcatcttggcagtaa

SEQ ID NO: 911722 - DNA, 25 bp, Mus musculus
tgttattagggcttcttggcagtaa

SEQ ID NO: 911723 - DNA, 25 bp, Mus musculus
tgttattatgatcatagtccttgag

SEQ ID NO: 911724 - DNA, 25 bp, Mus musculus
tgttattatgatgatagtccttgag

SEQ ID NO: 911725 - DNA, 25 bp, Mus musculus
tgttattattatatcctccaaggat

SEQ ID NO: 911726 - DNA, 25 bp, Mus musculus
tgttattattatttcctccaaggat

SEQ ID NO: 911727 - DNA, 25 bp, Mus musculus
tgttattcaactccagggcctcatg

SEQ ID NO: 911728 - DNA, 25 bp, Mus musculus
tgttattcaactgcagggcctcatg

SEQ ID NO: 911729 - DNA, 25 bp, Mus musculus
tgttattccgtcaaccctgttcttt

SEQ ID NO: 911730 - DNA, 25 bp, Mus musculus
tgttattccgtctaccctgttcttt

SEQ ID NO: 911731 - DNA, 25 bp, Mus musculus
tgttattcctccagatgattttctc

SEQ ID NO: 911732 - DNA, 25 bp, Mus musculus
tgttattcctcctgatgattttctc

SEQ ID NO: 911733 - DNA, 25 bp, Mus musculus
tgttattctcaaatgcaagcctttg

SEQ ID NO: 911734 - DNA, 25 bp, Mus musculus
tgttattctcaattgcaagcctttg

SEQ ID NO: 911735 - DNA, 25 bp, Mus musculus
tgttattctctgagaagcccgacac

SEQ ID NO: 911736 - DNA, 25 bp, Mus musculus
tgttattctctgtgaagcccgacac

SEQ ID NO: 911737 - DNA, 25 bp, Mus musculus
tgttattgccaaattcagcctcctg

SEQ ID NO: 911738 - DNA, 25 bp, Mus musculus
tgttattgccaatttcagcctcctg

SEQ ID NO: 911739 - DNA, 25 bp, Mus musculus
tgttattgccttatctgctacgaac

SEQ ID NO: 911740 - DNA, 25 bp, Mus musculus
tgttattgccttttctgctacgaac

SEQ ID NO: 911741 - DNA, 25 bp, Mus musculus
tgttattgctatagcttggctgcct

SEQ ID NO: 911742 - DNA, 25 bp, Mus musculus
tgttattgctattgcttggctgcct

SEQ ID NO: 911743 - DNA, 25 bp, Mus musculus
tgttattgctggatgtgtgctgccc

SEQ ID NO: 911744 - DNA, 25 bp, Mus musculus
tgttattgctggttgtgtgctgccc

SEQ ID NO: 911745 - DNA, 25 bp, Mus musculus
tgttattggcttctaccagttagtc

SEQ ID NO: 911746 - DNA, 25 bp, Mus musculus
tgttattggcttgtaccagttagtc

SEQ ID NO: 911747 - DNA, 25 bp, Mus musculus
tgttattgtgggatgcttggtttgc

SEQ ID NO: 911748 - DNA, 25 bp, Mus musculus
tgttattgtgggttgcttggtttgc

SEQ ID NO: 911749 - DNA, 25 bp, Mus musculus
tgttattgttagaaccacatgatgt

SEQ ID NO: 911750 - DNA, 25 bp, Mus musculus
tgttattgttagtaccacatgatgt

SEQ ID NO: 911751 - DNA, 25 bp, Mus musculus
tgttatttattcagcacttgtcaat

SEQ ID NO: 911752 - DNA, 25 bp, Mus musculus
tgttatttattctgcacttgtcaat

SEQ ID NO: 911753 - DNA, 25 bp, Mus musculus
tgttatttatttccagtttgttcct

SEQ ID NO: 911754 - DNA, 25 bp, Mus musculus
tgttatttatttgcagtttgttcct

SEQ ID NO: 911755 - DNA, 25 bp, Mus musculus
tgttatttccatcgctactagtttg

SEQ ID NO: 911756 - DNA, 25 bp, Mus musculus
tgttatttccatggctactagtttg

SEQ ID NO: 911757 - DNA, 25 bp, Mus musculus
tgttatttctacactcaccctgaga

SEQ ID NO: 911758 - DNA, 25 bp, Mus musculus
tgttatttctactctcaccctgaga

SEQ ID NO: 911759 - DNA, 25 bp, Mus musculus
tgttattttactcccaatcatcctg

SEQ ID NO: 911760 - DNA, 25 bp, Mus musculus
tgttattttactgccaatcatcctg

SEQ ID NO: 911761 - DNA, 25 bp, Mus musculus
tgttattttgtgagacccgtttaat

SEQ ID NO: 911762 - DNA, 25 bp, Mus musculus
tgttattttgtgtgacccgtttaat

SEQ ID NO: 911763 - DNA, 25 bp, Mus musculus
tgttatttttatacccagagccagt

SEQ ID NO: 911764 - DNA, 25 bp, Mus musculus
tgttatttttattcccagagccagt

SEQ ID NO: 911765 - DNA, 25 bp, Mus musculus
tgttcaaaagacaaacaccctgttg

SEQ ID NO: 911766 - DNA, 25 bp, Mus musculus
tgttcaaaagactaacaccctgttg

SEQ ID NO: 911767 - DNA, 25 bp, Mus musculus
tgttcaaagaccagctagcgctcat

SEQ ID NO: 911768 - DNA, 25 bp, Mus musculus
tgttcaaagacctgctagcgctcat

SEQ ID NO: 911769 - DNA, 25 bp, Mus musculus
tgttcaaagagcctgctgtgcttag

SEQ ID NO: 911770 - DNA, 25 bp, Mus musculus
tgttcaaagagcgtgctgtgcttag

SEQ ID NO: 911771 - DNA, 25 bp, Mus musculus
tgttcaaagtccattttcttctggc

SEQ ID NO: 911772 - DNA, 25 bp, Mus musculus
tgttcaaagtcctttttcttctggc

SEQ ID NO: 911773 - DNA, 25 bp, Mus musculus
tgttcaaatcaactcctccagtcag

SEQ ID NO: 911774 - DNA, 25 bp, Mus musculus
tgttcaaatcaagtcctccagtcag

SEQ ID NO: 911775 - DNA, 25 bp, Mus musculus
tgttcaacacacacacgggagcccg

SEQ ID NO: 911776 - DNA, 25 bp, Mus musculus
tgttcaacacactcacgggagcccg

SEQ ID NO: 911777 - DNA, 25 bp, Mus musculus
tgttcaacaggcatgcatggcttag

SEQ ID NO: 911778 - DNA, 25 bp, Mus musculus
tgttcaacaggcttgcatggcttag

SEQ ID NO: 911779 - DNA, 25 bp, Mus musculus
tgttcaacatgtcccaatttcttcc

SEQ ID NO: 911780 - DNA, 25 bp, Mus musculus
tgttcaacatgtgccaatttcttcc

SEQ ID NO: 911781 - DNA, 25 bp, Mus musculus
tgttcaaccaccagtacgctttgta

SEQ ID NO: 911782 - DNA, 25 bp, Mus musculus
tgttcaaccacctgtacgctttgta

SEQ ID NO: 911783 - DNA, 25 bp, Mus musculus
tgttcaaccggtcgtgccttcagcc

SEQ ID NO: 911784 - DNA, 25 bp, Mus musculus
tgttcaaccggtggtgccttcagcc

SEQ ID NO: 911785 - DNA, 25 bp, Mus musculus
tgttcaacctcaacccagtgggact

SEQ ID NO: 911786 - DNA, 25 bp, Mus musculus
tgttcaacctcatcccagtgggact

SEQ ID NO: 911787 - DNA, 25 bp, Mus musculus
tgttcaactgagacctgtagatgag

SEQ ID NO: 911788 - DNA, 25 bp, Mus musculus
tgttcaactgagtcctgtagatgag

SEQ ID NO: 911789 - DNA, 25 bp, Mus musculus
tgttcaagaccccagcaaattttac

SEQ ID NO: 911790 - DNA, 25 bp, Mus musculus
tgttcaagacccgagcaaattttac

SEQ ID NO: 911791 - DNA, 25 bp, Mus musculus
tgttcaagagaaaagtccgttcccg

SEQ ID NO: 911792 - DNA, 25 bp, Mus musculus
tgttcaagagaatagtccgttcccg

SEQ ID NO: 911793 - DNA, 25 bp, Mus musculus
tgttcaagatcactgctctagaagc

SEQ ID NO: 911794 - DNA, 25 bp, Mus musculus
tgttcaagatcagtgctctagaagc

SEQ ID NO: 911795 - DNA, 25 bp, Mus musculus
tgttcaagatgcagtatcctcctgc

SEQ ID NO: 911796 - DNA, 25 bp, Mus musculus
tgttcaagatgctgtatcctcctgc

SEQ ID NO: 911797 - DNA, 25 bp, Mus musculus
tgttcaagcagcagcccgagccgct

SEQ ID NO: 911798 - DNA, 25 bp, Mus musculus
tgttcaagcagctgcccgagccgct

SEQ ID NO: 911799 - DNA, 25 bp, Mus musculus
tgttcaagccacctgtacaattgga

SEQ ID NO: 911800 - DNA, 25 bp, Mus musculus
tgttcaagccacgtgtacaattgga

SEQ ID NO: 911801 - DNA, 25 bp, Mus musculus
tgttcaagctacattccctagtttc

SEQ ID NO: 911802 - DNA, 25 bp, Mus musculus
tgttcaagctactttccctagtttc

SEQ ID NO: 911803 - DNA, 25 bp, Mus musculus
tgttcaagtaaaaccaacagtgatt

SEQ ID NO: 911804 - DNA, 25 bp, Mus musculus
tgttcaagtaaatccaacagtgatt

SEQ ID NO: 911805 - DNA, 25 bp, Mus musculus
tgttcaagtccaaacagcgcggagt

SEQ ID NO: 911806 - DNA, 25 bp, Mus musculus
tgttcaagtccatacagcgcggagt

SEQ ID NO: 911807 - DNA, 25 bp, Mus musculus
tgttcaataagcaggaaggatgcat

SEQ ID NO: 911808 - DNA, 25 bp, Mus musculus
tgttcaataagctggaaggatgcat

SEQ ID NO: 911809 - DNA, 25 bp, Mus musculus
tgttcaatcacaagctctcctttgc

SEQ ID NO: 911810 - DNA, 25 bp, Mus musculus
tgttcaatcacatgctctcctttgc

SEQ ID NO: 911811 - DNA, 25 bp, Mus musculus
tgttcaatctgtatcggactcccac

SEQ ID NO: 911812 - DNA, 25 bp, Mus musculus
tgttcaatctgtttcggactcccac

SEQ ID NO: 911813 - DNA, 25 bp, Mus musculus
tgttcaatgagtagcggagcgacct

SEQ ID NO: 911814 - DNA, 25 bp, Mus musculus
tgttcaatgagttgcggagcgacct

SEQ ID NO: 911815 - DNA, 25 bp, Mus musculus
tgttcaatggacatcacaacccaga

SEQ ID NO: 911816 - DNA, 25 bp, Mus musculus
tgttcaatggacttcacaacccaga

SEQ ID NO: 911817 - DNA, 25 bp, Mus musculus
tgttcaatgttgagagcttgggaca

SEQ ID NO: 911818 - DNA, 25 bp, Mus musculus
tgttcaatgttgtgagcttgggaca

SEQ ID NO: 911819 - DNA, 25 bp, Mus musculus
tgttcaattttaccatggccaataa

SEQ ID NO: 911820 - DNA, 25 bp, Mus musculus
tgttcaattttagcatggccaataa

SEQ ID NO: 911821 - DNA, 25 bp, Mus musculus
tgttcacaacaaccatcctcctttg

SEQ ID NO: 911822 - DNA, 25 bp, Mus musculus
tgttcacaacaagcatcctcctttg

SEQ ID NO: 911823 - DNA, 25 bp, Mus musculus
tgttcacacactcaacactttaatc

SEQ ID NO: 911824 - DNA, 25 bp, Mus musculus
tgttcacacactgaacactttaatc

SEQ ID NO: 911825 - DNA, 25 bp, Mus musculus
tgttcacacagtaagcacgttgcca

SEQ ID NO: 911826 - DNA, 25 bp, Mus musculus
tgttcacacagttagcacgttgcca

SEQ ID NO: 911827 - DNA, 25 bp, Mus musculus
tgttcacacccacggatcagctgat

SEQ ID NO: 911828 - DNA, 25 bp, Mus musculus
tgttcacacccagggatcagctgat

SEQ ID NO: 911829 - DNA, 25 bp, Mus musculus
tgttcacaccctaccactgagtctt

SEQ ID NO: 911830 - DNA, 25 bp, Mus musculus
tgttcacacccttccactgagtctt

SEQ ID NO: 911831 - DNA, 25 bp, Mus musculus
tgttcacacttcacggttcagtctt

SEQ ID NO: 911832 - DNA, 25 bp, Mus musculus
tgttcacacttctcggttcagtctt

SEQ ID NO: 911833 - DNA, 25 bp, Mus musculus
tgttcacagatgcagcgagcttgca

SEQ ID NO: 911834 - DNA, 25 bp, Mus musculus
tgttcacagatggagcgagcttgca

SEQ ID NO: 911835 - DNA, 25 bp, Mus musculus
tgttcacagcccatgttcccaccct

SEQ ID NO: 911836 - DNA, 25 bp, Mus musculus
tgttcacagcccttgttcccaccct

SEQ ID NO: 911837 - DNA, 25 bp, Mus musculus
tgttcacaggaacctttggccagtg

SEQ ID NO: 911838 - DNA, 25 bp, Mus musculus
tgttcacaggaagctttggccagtg

SEQ ID NO: 911839 - DNA, 25 bp, Mus musculus
tgttcacaggccctgacatatggct

SEQ ID NO: 911840 - DNA, 25 bp, Mus musculus
tgttcacaggccgtgacatatggct

SEQ ID NO: 911841 - DNA, 25 bp, Mus musculus
tgttcacagggaccttctcaacttt

SEQ ID NO: 911842 - DNA, 25 bp, Mus musculus
tgttcacagggagcttctcaacttt

SEQ ID NO: 911843 - DNA, 25 bp, Mus musculus
tgttcacagtttattgctccgctct

SEQ ID NO: 911844 - DNA, 25 bp, Mus musculus
tgttcacagttttttgctccgctct

SEQ ID NO: 911845 - DNA, 25 bp, Mus musculus
tgttcacatctaccttacctttata

SEQ ID NO: 911846 - DNA, 25 bp, Mus musculus
tgttcacatctagcttacctttata

SEQ ID NO: 911847 - DNA, 25 bp, Mus musculus
tgttcacatggacatctcaagctgg

SEQ ID NO: 911848 - DNA, 25 bp, Mus musculus
tgttcacatggaccgagcacactta

SEQ ID NO: 911849 - DNA, 25 bp, Mus musculus
tgttcacatggagatctcaagctgg

SEQ ID NO: 911850 - DNA, 25 bp, Mus musculus
tgttcacatggagcgagcacactta

SEQ ID NO: 911851 - DNA, 25 bp, Mus musculus
tgttcacattacagtacctcctagg

SEQ ID NO: 911852 - DNA, 25 bp, Mus musculus
tgttcacattactgtacctcctagg

SEQ ID NO: 911853 - DNA, 25 bp, Mus musculus
tgttcacattctagaagtttgcaga

SEQ ID NO: 911854 - DNA, 25 bp, Mus musculus
tgttcacattcttgaagtttgcaga

SEQ ID NO: 911855 - DNA, 25 bp, Mus musculus
tgttcaccaaccaatctgatttcgc

SEQ ID NO: 911856 - DNA, 25 bp, Mus musculus
tgttcaccaacctatctgatttcgc

SEQ ID NO: 911857 - DNA, 25 bp, Mus musculus
tgttcaccacatcgtcagactccat

SEQ ID NO: 911858 - DNA, 25 bp, Mus musculus
tgttcaccacatggtcagactccat

SEQ ID NO: 911859 - DNA, 25 bp, Mus musculus
tgttcaccattcacctgatagacgc

SEQ ID NO: 911860 - DNA, 25 bp, Mus musculus
tgttcaccattctcctgatagacgc

SEQ ID NO: 911861 - DNA, 25 bp, Mus musculus
tgttcaccctctacgatgaccaggt

SEQ ID NO: 911862 - DNA, 25 bp, Mus musculus
tgttcaccctctaggatgctggaga

SEQ ID NO: 911863 - DNA, 25 bp, Mus musculus
tgttcaccctcttcgatgaccaggt

SEQ ID NO: 911864 - DNA, 25 bp, Mus musculus
tgttcaccctcttggatgctggaga

SEQ ID NO: 911865 - DNA, 25 bp, Mus musculus
tgttcaccctgaagacgatggctgt

SEQ ID NO: 911866 - DNA, 25 bp, Mus musculus
tgttcaccctgatgacgatggctgt

SEQ ID NO: 911867 - DNA, 25 bp, Mus musculus
tgttcacctcatacacagagtgaat

SEQ ID NO: 911868 - DNA, 25 bp, Mus musculus
tgttcacctcattcacagagtgaat

SEQ ID NO: 911869 - DNA, 25 bp, Mus musculus
tgttcacctcttacgggcattttat

SEQ ID NO: 911870 - DNA, 25 bp, Mus musculus
tgttcacctctttcgggcattttat

SEQ ID NO: 911871 - DNA, 25 bp, Mus musculus
tgttcacctgcactactgtggactt

SEQ ID NO: 911872 - DNA, 25 bp, Mus musculus
tgttcacctgcagtactgtggactt

SEQ ID NO: 911873 - DNA, 25 bp, Mus musculus
tgttcaccttgaagacaggccttag

SEQ ID NO: 911874 - DNA, 25 bp, Mus musculus
tgttcaccttgatgacaggccttag

SEQ ID NO: 911875 - DNA, 25 bp, Mus musculus
tgttcaccttgccagagcctagcga

SEQ ID NO: 911876 - DNA, 25 bp, Mus musculus
tgttcaccttgcgagagcctagcga

SEQ ID NO: 911877 - DNA, 25 bp, Mus musculus
tgttcacgacacaaggcgaggagga

SEQ ID NO: 911878 - DNA, 25 bp, Mus musculus
tgttcacgacactaggcgaggagga

SEQ ID NO: 911879 - DNA, 25 bp, Mus musculus
tgttcacgagtaccccatggtgtgg

SEQ ID NO: 911880 - DNA, 25 bp, Mus musculus
tgttcacgagtagcccatggtgtgg

SEQ ID NO: 911881 - DNA, 25 bp, Mus musculus
tgttcacgtaataggattaattatg

SEQ ID NO: 911882 - DNA, 25 bp, Mus musculus
tgttcacgtaattggattaattatg

SEQ ID NO: 911883 - DNA, 25 bp, Mus musculus
tgttcacgtgtgaacataggatctt

SEQ ID NO: 911884 - DNA, 25 bp, Mus musculus
tgttcacgtgtgtacataggatctt

SEQ ID NO: 911885 - DNA, 25 bp, Mus musculus
tgttcacgttttcggaaagtcctct

SEQ ID NO: 911886 - DNA, 25 bp, Mus musculus
tgttcacgttttgggaaagtcctct

SEQ ID NO: 911887 - DNA, 25 bp, Mus musculus
tgttcactaagtctaagaccctggt

SEQ ID NO: 911888 - DNA, 25 bp, Mus musculus
tgttcactaagtgtaagaccctggt

SEQ ID NO: 911889 - DNA, 25 bp, Mus musculus
tgttcactacaccatctgggcttaa

SEQ ID NO: 911890 - DNA, 25 bp, Mus musculus
tgttcactacacgatctgggcttaa

SEQ ID NO: 911891 - DNA, 25 bp, Mus musculus
tgttcactagcaaatattccataat

SEQ ID NO: 911892 - DNA, 25 bp, Mus musculus
tgttcactagcatatattccataat

SEQ ID NO: 911893 - DNA, 25 bp, Mus musculus
tgttcactattcaggctccactggg

SEQ ID NO: 911894 - DNA, 25 bp, Mus musculus
tgttcactattctggctccactggg

SEQ ID NO: 911895 - DNA, 25 bp, Mus musculus
tgttcactcaacagacctgacagag

SEQ ID NO: 911896 - DNA, 25 bp, Mus musculus
tgttcactcaactgacctgacagag

SEQ ID NO: 911897 - DNA, 25 bp, Mus musculus
tgttcactcagtcgtgccggtggaa

SEQ ID NO: 911898 - DNA, 25 bp, Mus musculus
tgttcactcagtggtgccggtggaa

SEQ ID NO: 911899 - DNA, 25 bp, Mus musculus
tgttcactcgtgattggctccagag

SEQ ID NO: 911900 - DNA, 25 bp, Mus musculus
tgttcactcgtgtttggctccagag

SEQ ID NO: 911901 - DNA, 25 bp, Mus musculus
tgttcactctctcgtcttggtttgg

SEQ ID NO: 911902 - DNA, 25 bp, Mus musculus
tgttcactctctggtcttggtttgg

SEQ ID NO: 911903 - DNA, 25 bp, Mus musculus
tgttcactgagtcgctctgggcaaa

SEQ ID NO: 911904 - DNA, 25 bp, Mus musculus
tgttcactgagtggctctgggcaaa

SEQ ID NO: 911905 - DNA, 25 bp, Mus musculus
tgttcactgatgattgcctgtgtgt

SEQ ID NO: 911906 - DNA, 25 bp, Mus musculus
tgttcactgatgtttgcctgtgtgt

SEQ ID NO: 911907 - DNA, 25 bp, Mus musculus
tgttcactgccaattctcacctggg

SEQ ID NO: 911908 - DNA, 25 bp, Mus musculus
tgttcactgccatttctcacctggg

SEQ ID NO: 911909 - DNA, 25 bp, Mus musculus
tgttcactgggtatgcagcaggacg

SEQ ID NO: 911910 - DNA, 25 bp, Mus musculus
tgttcactgggtttgcagcaggacg

SEQ ID NO: 911911 - DNA, 25 bp, Mus musculus
tgttcactgtaactaatggcagatt

SEQ ID NO: 911912 - DNA, 25 bp, Mus musculus
tgttcactgtaagtaatggcagatt

SEQ ID NO: 911913 - DNA, 25 bp, Mus musculus
tgttcactgtcgagtgagtgttcct

SEQ ID NO: 911914 - DNA, 25 bp, Mus musculus
tgttcactgtcgtgtgagtgttcct

SEQ ID NO: 911915 - DNA, 25 bp, Mus musculus
tgttcactgtgcatcaaattcccag

SEQ ID NO: 911916 - DNA, 25 bp, Mus musculus
tgttcactgtgcttcaaattcccag

SEQ ID NO: 911917 - DNA, 25 bp, Mus musculus
tgttcacttcatctggtgcccaagc

SEQ ID NO: 911918 - DNA, 25 bp, Mus musculus
tgttcacttcatgtggtgcccaagc

SEQ ID NO: 911919 - DNA, 25 bp, Mus musculus
tgttcacttctaagggccctgtttt

SEQ ID NO: 911920 - DNA, 25 bp, Mus musculus
tgttcacttctatgggccctgtttt

SEQ ID NO: 911921 - DNA, 25 bp, Mus musculus
tgttcacttgttcatataaggccaa

SEQ ID NO: 911922 - DNA, 25 bp, Mus musculus
tgttcacttgttgatataaggccaa

SEQ ID NO: 911923 - DNA, 25 bp, Mus musculus
tgttcagaaaacactggccttcatt

SEQ ID NO: 911924 - DNA, 25 bp, Mus musculus
tgttcagaaaactctggccttcatt

SEQ ID NO: 911925 - DNA, 25 bp, Mus musculus
tgttcagaaacacagcagttgggat

SEQ ID NO: 911926 - DNA, 25 bp, Mus musculus
tgttcagaaacagagcagttgggat

SEQ ID NO: 911927 - DNA, 25 bp, Mus musculus
tgttcagaaacgcatcagcaataat

SEQ ID NO: 911928 - DNA, 25 bp, Mus musculus
tgttcagaaacggatcagcaataat

SEQ ID NO: 911929 - DNA, 25 bp, Mus musculus
tgttcagaaccaagcagtctcctta

SEQ ID NO: 911930 - DNA, 25 bp, Mus musculus
tgttcagaaccatgcagtctcctta

SEQ ID NO: 911931 - DNA, 25 bp, Mus musculus
tgttcagaaccgacgtggtctgttt

SEQ ID NO: 911932 - DNA, 25 bp, Mus musculus
tgttcagaaccgtcgtggtctgttt

SEQ ID NO: 911933 - DNA, 25 bp, Mus musculus
tgttcagaagaaagcaaggtccgga

SEQ ID NO: 911934 - DNA, 25 bp, Mus musculus
tgttcagaagaatgcaaggtccgga

SEQ ID NO: 911935 - DNA, 25 bp, Mus musculus
tgttcagaatcaaagcagcccttcc

SEQ ID NO: 911936 - DNA, 25 bp, Mus musculus
tgttcagaatcatagcagcccttcc

SEQ ID NO: 911937 - DNA, 25 bp, Mus musculus
tgttcagaatttcccgcaatctcta

SEQ ID NO: 911938 - DNA, 25 bp, Mus musculus
tgttcagaatttgccgcaatctcta

SEQ ID NO: 911939 - DNA, 25 bp, Mus musculus
tgttcagacacaacgaccctggatg

SEQ ID NO: 911940 - DNA, 25 bp, Mus musculus
tgttcagacacatcgaccctggatg

SEQ ID NO: 911941 - DNA, 25 bp, Mus musculus
tgttcagacagaccttctctcagaa

SEQ ID NO: 911942 - DNA, 25 bp, Mus musculus
tgttcagacagagcttctctcagaa

SEQ ID NO: 911943 - DNA, 25 bp, Mus musculus
tgttcagaccgaccacagtgatctt

SEQ ID NO: 911944 - DNA, 25 bp, Mus musculus
tgttcagaccgagcacagtgatctt

SEQ ID NO: 911945 - DNA, 25 bp, Mus musculus
tgttcagaccttctctcttctctcg

SEQ ID NO: 911946 - DNA, 25 bp, Mus musculus
tgttcagaccttgtctcttctctcg

SEQ ID NO: 911947 - DNA, 25 bp, Mus musculus
tgttcagagactatagcctggacca

SEQ ID NO: 911948 - DNA, 25 bp, Mus musculus
tgttcagagactttagcctggacca

SEQ ID NO: 911949 - DNA, 25 bp, Mus musculus
tgttcagaggaccagccacaggcac

SEQ ID NO: 911950 - DNA, 25 bp, Mus musculus
tgttcagaggacgagccacaggcac

SEQ ID NO: 911951 - DNA, 25 bp, Mus musculus
tgttcagatggcatcactagtgttt

SEQ ID NO: 911952 - DNA, 25 bp, Mus musculus
tgttcagatggcttcactagtgttt

SEQ ID NO: 911953 - DNA, 25 bp, Mus musculus
tgttcagcacgaacctagagctgcc

SEQ ID NO: 911954 - DNA, 25 bp, Mus musculus
tgttcagcacgatcctagagctgcc

SEQ ID NO: 911955 - DNA, 25 bp, Mus musculus
tgttcagcactcatgcttgttgtga

SEQ ID NO: 911956 - DNA, 25 bp, Mus musculus
tgttcagcactcttgcttgttgtga

SEQ ID NO: 911957 - DNA, 25 bp, Mus musculus
tgttcagcatctattgcaccagcat

SEQ ID NO: 911958 - DNA, 25 bp, Mus musculus
tgttcagcatcttttgcaccagcat

SEQ ID NO: 911959 - DNA, 25 bp, Mus musculus
tgttcagcattgcagtgcccatcct

SEQ ID NO: 911960 - DNA, 25 bp, Mus musculus
tgttcagcattggagtgcccatcct

SEQ ID NO: 911961 - DNA, 25 bp, Mus musculus
tgttcagcccaaactggccattttt

SEQ ID NO: 911962 - DNA, 25 bp, Mus musculus
tgttcagcccaatctggccattttt

SEQ ID NO: 911963 - DNA, 25 bp, Mus musculus
tgttcagccccacaggattacagac

SEQ ID NO: 911964 - DNA, 25 bp, Mus musculus
tgttcagccccagaggattacagac

SEQ ID NO: 911965 - DNA, 25 bp, Mus musculus
tgttcagcctgcaaggccgatgtat

SEQ ID NO: 911966 - DNA, 25 bp, Mus musculus
tgttcagcctgctaggccgatgtat

SEQ ID NO: 911967 - DNA, 25 bp, Mus musculus
tgttcagcctggactagagccatgg

SEQ ID NO: 911968 - DNA, 25 bp, Mus musculus
tgttcagcctggtctagagccatgg

SEQ ID NO: 911969 - DNA, 25 bp, Mus musculus
tgttcagcggcgactggtcagatgt

SEQ ID NO: 911970 - DNA, 25 bp, Mus musculus
tgttcagcggcgtctggtcagatgt

SEQ ID NO: 911971 - DNA, 25 bp, Mus musculus
tgttcagctcctatgcccataggtg

SEQ ID NO: 911972 - DNA, 25 bp, Mus musculus
tgttcagctcctttgcccataggtg

SEQ ID NO: 911973 - DNA, 25 bp, Mus musculus
tgttcagctcgaccgccaagatcgt

SEQ ID NO: 911974 - DNA, 25 bp, Mus musculus
tgttcagctcgagcgccaagatcgt

SEQ ID NO: 911975 - DNA, 25 bp, Mus musculus
tgttcagctctcagactggagccac

SEQ ID NO: 911976 - DNA, 25 bp, Mus musculus
tgttcagctctctgactggagccac

SEQ ID NO: 911977 - DNA, 25 bp, Mus musculus
tgttcagcttcaatgcatgtaatgt

SEQ ID NO: 911978 - DNA, 25 bp, Mus musculus
tgttcagcttcattgcatgtaatgt

SEQ ID NO: 911979 - DNA, 25 bp, Mus musculus
tgttcaggactaagccgataatatc

SEQ ID NO: 911980 - DNA, 25 bp, Mus musculus
tgttcaggactatgccgataatatc

SEQ ID NO: 911981 - DNA, 25 bp, Mus musculus
tgttcaggcacgccagaaggatgcc

SEQ ID NO: 911982 - DNA, 25 bp, Mus musculus
tgttcaggcacggcagaaggatgcc

SEQ ID NO: 911983 - DNA, 25 bp, Mus musculus
tgttcaggcctgcattactcttgca

SEQ ID NO: 911984 - DNA, 25 bp, Mus musculus
tgttcaggcctggattactcttgca

SEQ ID NO: 911985 - DNA, 25 bp, Mus musculus
tgttcagggaacacgtgggtctact

SEQ ID NO: 911986 - DNA, 25 bp, Mus musculus
tgttcagggaactcgtgggtctact

SEQ ID NO: 911987 - DNA, 25 bp, Mus musculus
tgttcaggtcctaagaaagagctgt

SEQ ID NO: 911988 - DNA, 25 bp, Mus musculus
tgttcaggtccttagaaagagctgt

SEQ ID NO: 911989 - DNA, 25 bp, Mus musculus
tgttcaggtgttacgttcccatttc

SEQ ID NO: 911990 - DNA, 25 bp, Mus musculus
tgttcaggtgtttcgttcccatttc

SEQ ID NO: 911991 - DNA, 25 bp, Mus musculus
tgttcagtacttatctcccatgtta

SEQ ID NO: 911992 - DNA, 25 bp, Mus musculus
tgttcagtacttttctcccatgtta

SEQ ID NO: 911993 - DNA, 25 bp, Mus musculus
tgttcagtagcacgaaagcccgccc

SEQ ID NO: 911994 - DNA, 25 bp, Mus musculus
tgttcagtagcaggaaagcccgccc

SEQ ID NO: 911995 - DNA, 25 bp, Mus musculus
tgttcagtccagaggttagctgtga

SEQ ID NO: 911996 - DNA, 25 bp, Mus musculus
tgttcagtccagtggttagctgtga

SEQ ID NO: 911997 - DNA, 25 bp, Mus musculus
tgttcagtggctaccaggcgatgaa

SEQ ID NO: 911998 - DNA, 25 bp, Mus musculus
tgttcagtggcttccaggcgatgaa

SEQ ID NO: 911999 - DNA, 25 bp, Mus musculus
tgttcagtgggcacgtcccctgtaa

SEQ ID NO: 912000 - DNA, 25 bp, Mus musculus
tgttcagtgggctcgtcccctgtaa

SEQ ID NO: 912001 - DNA, 25 bp, Mus musculus
tgttcagtgttgaccgtggtcaata

SEQ ID NO: 912002 - DNA, 25 bp, Mus musculus
tgttcagtgttgtccgtggtcaata

SEQ ID NO: 912003 - DNA, 25 bp, Mus musculus
tgttcagttatgaggagtccaaccc

SEQ ID NO: 912004 - DNA, 25 bp, Mus musculus
tgttcagttatgtggagtccaaccc

SEQ ID NO: 912005 - DNA, 25 bp, Mus musculus
tgttcagttcataagcccatttgtt

SEQ ID NO: 912006 - DNA, 25 bp, Mus musculus
tgttcagttcattagcccatttgtt

SEQ ID NO: 912007 - DNA, 25 bp, Mus musculus
tgttcagttctcactttagttggta

SEQ ID NO: 912008 - DNA, 25 bp, Mus musculus
tgttcagttctctctttagttggta

SEQ ID NO: 912009 - DNA, 25 bp, Mus musculus
tgttcagttcttacatggtcagaga

SEQ ID NO: 912010 - DNA, 25 bp, Mus musculus
tgttcagttctttcatggtcagaga

SEQ ID NO: 912011 - DNA, 25 bp, Mus musculus
tgttcagtttgtccctttcagacag

SEQ ID NO: 912012 - DNA, 25 bp, Mus musculus
tgttcagtttgtgcctttcagacag

SEQ ID NO: 912013 - DNA, 25 bp, Mus musculus
tgttcagttttactagaactagtga

SEQ ID NO: 912014 - DNA, 25 bp, Mus musculus
tgttcagttttagtagaactagtga

SEQ ID NO: 912015 - DNA, 25 bp, Mus musculus
tgttcataaaacatctgcctgcatt

SEQ ID NO: 912016 - DNA, 25 bp, Mus musculus
tgttcataaaacttctgcctgcatt

SEQ ID NO: 912017 - DNA, 25 bp, Mus musculus
tgttcataaaagacccgactgctgg

SEQ ID NO: 912018 - DNA, 25 bp, Mus musculus
tgttcataaaagtcccgactgctgg

SEQ ID NO: 912019 - DNA, 25 bp, Mus musculus
tgttcatactcaccctttttagcta

SEQ ID NO: 912020 - DNA, 25 bp, Mus musculus
tgttcatactcagcctttttagcta

SEQ ID NO: 912021 - DNA, 25 bp, Mus musculus
tgttcatagaaaagccccatagttc

SEQ ID NO: 912022 - DNA, 25 bp, Mus musculus
tgttcatagaaatgccccatagttc

SEQ ID NO: 912023 - DNA, 25 bp, Mus musculus
tgttcatagagcctttcccctcttg

SEQ ID NO: 912024 - DNA, 25 bp, Mus musculus
tgttcatagagcgtttcccctcttg

SEQ ID NO: 912025 - DNA, 25 bp, Mus musculus
tgttcatagtccactttgtacatga

SEQ ID NO: 912026 - DNA, 25 bp, Mus musculus
tgttcatagtcctctttgtacatga

SEQ ID NO: 912027 - DNA, 25 bp, Mus musculus
tgttcatatgtgatctttctcttct

SEQ ID NO: 912028 - DNA, 25 bp, Mus musculus
tgttcatatgtgttctttctcttct

SEQ ID NO: 912029 - DNA, 25 bp, Mus musculus
tgttcatattacatccttggacaag

SEQ ID NO: 912030 - DNA, 25 bp, Mus musculus
tgttcatattacttccttggacaag

SEQ ID NO: 912031 - DNA, 25 bp, Mus musculus
tgttcatattcacaccatgtgcctc

SEQ ID NO: 912032 - DNA, 25 bp, Mus musculus
tgttcatattcagaccatgtgcctc

SEQ ID NO: 912033 - DNA, 25 bp, Mus musculus
tgttcatcaaacacctcagtgatcc

SEQ ID NO: 912034 - DNA, 25 bp, Mus musculus
tgttcatcaaactcctcagtgatcc

SEQ ID NO: 912035 - DNA, 25 bp, Mus musculus
tgttcatcaactaccaggacctggg

SEQ ID NO: 912036 - DNA, 25 bp, Mus musculus
tgttcatcaacttccaggacctggg

SEQ ID NO: 912037 - DNA, 25 bp, Mus musculus
tgttcatcagaaagctcctccagct

SEQ ID NO: 912038 - DNA, 25 bp, Mus musculus
tgttcatcagaatgctcctccagct

SEQ ID NO: 912039 - DNA, 25 bp, Mus musculus
tgttcatcaggcagcgggtcttcct

SEQ ID NO: 912040 - DNA, 25 bp, Mus musculus
tgttcatcaggctgcgggtcttcct

SEQ ID NO: 912041 - DNA, 25 bp, Mus musculus
tgttcatcatctactccgagagcaa

SEQ ID NO: 912042 - DNA, 25 bp, Mus musculus
tgttcatcatcttctccgagagcaa

SEQ ID NO: 912043 - DNA, 25 bp, Mus musculus
tgttcatcatgaacgggtgctacgt

SEQ ID NO: 912044 - DNA, 25 bp, Mus musculus
tgttcatcatgatcgggtgctacgt

SEQ ID NO: 912045 - DNA, 25 bp, Mus musculus
tgttcatcatttcccctcaggttat

SEQ ID NO: 912046 - DNA, 25 bp, Mus musculus
tgttcatcatttgccctcaggttat

SEQ ID NO: 912047 - DNA, 25 bp, Mus musculus
tgttcatccaacctcacttgagtgt

SEQ ID NO: 912048 - DNA, 25 bp, Mus musculus
tgttcatccaacgtcacttgagtgt

SEQ ID NO: 912049 - DNA, 25 bp, Mus musculus
tgttcatcccggctccagggagcag

SEQ ID NO: 912050 - DNA, 25 bp, Mus musculus
tgttcatcccgggtccagggagcag

SEQ ID NO: 912051 - DNA, 25 bp, Mus musculus
tgttcatccgtaaacctggtggcag

SEQ ID NO: 912052 - DNA, 25 bp, Mus musculus
tgttcatccgtatacctggtggcag

SEQ ID NO: 912053 - DNA, 25 bp, Mus musculus
tgttcatccttcagacaccagagaa

SEQ ID NO: 912054 - DNA, 25 bp, Mus musculus
tgttcatccttctgacaccagagaa

SEQ ID NO: 912055 - DNA, 25 bp, Mus musculus
tgttcatccttgagattgtccttaa

SEQ ID NO: 912056 - DNA, 25 bp, Mus musculus
tgttcatccttgtgattgtccttaa

SEQ ID NO: 912057 - DNA, 25 bp, Mus musculus
tgttcatcgaataccagtgtcctca

SEQ ID NO: 912058 - DNA, 25 bp, Mus musculus
tgttcatcgaattccagtgtcctca

SEQ ID NO: 912059 - DNA, 25 bp, Mus musculus
tgttcatcgtccagctgcgattcct

SEQ ID NO: 912060 - DNA, 25 bp, Mus musculus
tgttcatcgtcctgctgcgattcct

SEQ ID NO: 912061 - DNA, 25 bp, Mus musculus
tgttcatcgtctcacacactacgat

SEQ ID NO: 912062 - DNA, 25 bp, Mus musculus
tgttcatcgtctgacacactacgat

SEQ ID NO: 912063 - DNA, 25 bp, Mus musculus
tgttcatcgtggatcacagggcaag

SEQ ID NO: 912064 - DNA, 25 bp, Mus musculus
tgttcatcgtggttcacagggcaag

SEQ ID NO: 912065 - DNA, 25 bp, Mus musculus
tgttcatctattcgcatgcgttcct

SEQ ID NO: 912066 - DNA, 25 bp, Mus musculus
tgttcatctattggcatgcgttcct

SEQ ID NO: 912067 - DNA, 25 bp, Mus musculus
tgttcatctgttagtcctattttaa

SEQ ID NO: 912068 - DNA, 25 bp, Mus musculus
tgttcatctgtttgtcctattttaa

SEQ ID NO: 912069 - DNA, 25 bp, Mus musculus
tgttcatcttcacgttgatcttcag

SEQ ID NO: 912070 - DNA, 25 bp, Mus musculus
tgttcatcttcaggttgatcttcag

SEQ ID NO: 912071 - DNA, 25 bp, Mus musculus
tgttcatctttcaaaccttcacagt

SEQ ID NO: 912072 - DNA, 25 bp, Mus musculus
tgttcatctttctaaccttcacagt

SEQ ID NO: 912073 - DNA, 25 bp, Mus musculus
tgttcatgaactatgtcagccctgc

SEQ ID NO: 912074 - DNA, 25 bp, Mus musculus
tgttcatgaactttgtcagccctgc

SEQ ID NO: 912075 - DNA, 25 bp, Mus musculus
tgttcatgaggtaaggatggccctt

SEQ ID NO: 912076 - DNA, 25 bp, Mus musculus
tgttcatgaggttaggatggccctt

SEQ ID NO: 912077 - DNA, 25 bp, Mus musculus
tgttcatgatctagtgtgtctccca

SEQ ID NO: 912078 - DNA, 25 bp, Mus musculus
tgttcatgatcttgtgtgtctccca

SEQ ID NO: 912079 - DNA, 25 bp, Mus musculus
tgttcatggcccatagcggcaagta

SEQ ID NO: 912080 - DNA, 25 bp, Mus musculus
tgttcatggcccatcaggctgttga

SEQ ID NO: 912081 - DNA, 25 bp, Mus musculus
tgttcatggcccttagcggcaagta

SEQ ID NO: 912082 - DNA, 25 bp, Mus musculus
tgttcatggcccttcaggctgttga

SEQ ID NO: 912083 - DNA, 25 bp, Mus musculus
tgttcatggcctctaagtgtacccc

SEQ ID NO: 912084 - DNA, 25 bp, Mus musculus
tgttcatggcctgtaagtgtacccc

SEQ ID NO: 912085 - DNA, 25 bp, Mus musculus
tgttcatggtccagtagctgtccgt

SEQ ID NO: 912086 - DNA, 25 bp, Mus musculus
tgttcatggtcctgtagctgtccgt

SEQ ID NO: 912087 - DNA, 25 bp, Mus musculus
tgttcatgtttcatcctctcataga

SEQ ID NO: 912088 - DNA, 25 bp, Mus musculus
tgttcatgtttcttcctctcataga

SEQ ID NO: 912089 - DNA, 25 bp, Mus musculus
tgttcattcactccccaatattcca

SEQ ID NO: 912090 - DNA, 25 bp, Mus musculus
tgttcattcactgcccaatattcca

SEQ ID NO: 912091 - DNA, 25 bp, Mus musculus
tgttcattcagtcgccacatccaga

SEQ ID NO: 912092 - DNA, 25 bp, Mus musculus
tgttcattcagtggccacatccaga

SEQ ID NO: 912093 - DNA, 25 bp, Mus musculus
tgttcattctggaaccacaggtagt

SEQ ID NO: 912094 - DNA, 25 bp, Mus musculus
tgttcattctggtaccacaggtagt

SEQ ID NO: 912095 - DNA, 25 bp, Mus musculus
tgttcattgaagactgcccgtgtgg

SEQ ID NO: 912096 - DNA, 25 bp, Mus musculus
tgttcattgaagtctgcccgtgtgg

SEQ ID NO: 912097 - DNA, 25 bp, Mus musculus
tgttcattgggtctttactggagac

SEQ ID NO: 912098 - DNA, 25 bp, Mus musculus
tgttcattgggtgtttactggagac

SEQ ID NO: 912099 - DNA, 25 bp, Mus musculus
tgttcatttactaagaccctcttgg

SEQ ID NO: 912100 - DNA, 25 bp, Mus musculus
tgttcatttacttagaccctcttgg

SEQ ID NO: 912101 - DNA, 25 bp, Mus musculus
tgttcatttctgaatgctacggaag

SEQ ID NO: 912102 - DNA, 25 bp, Mus musculus
tgttcatttctgtatgctacggaag

SEQ ID NO: 912103 - DNA, 25 bp, Mus musculus
tgttcattttcactgcggattcctc

SEQ ID NO: 912104 - DNA, 25 bp, Mus musculus
tgttcattttcagtgcggattcctc

SEQ ID NO: 912105 - DNA, 25 bp, Mus musculus
tgttccaaacccatctttagtgtct

SEQ ID NO: 912106 - DNA, 25 bp, Mus musculus
tgttccaaacccttctttagtgtct

SEQ ID NO: 912107 - DNA, 25 bp, Mus musculus
tgttccaaactgctacacagacgga

SEQ ID NO: 912108 - DNA, 25 bp, Mus musculus
tgttccaaactggtacacagacgga

SEQ ID NO: 912109 - DNA, 25 bp, Mus musculus
tgttccaaaggactatctcaccacc

SEQ ID NO: 912110 - DNA, 25 bp, Mus musculus
tgttccaaaggagtatctcaccacc

SEQ ID NO: 912111 - DNA, 25 bp, Mus musculus
tgttccaacacacttactcaaaggg

SEQ ID NO: 912112 - DNA, 25 bp, Mus musculus
tgttccaacacagttactcaaaggg

SEQ ID NO: 912113 - DNA, 25 bp, Mus musculus
tgttccaaccaaagcgaagggccaa

SEQ ID NO: 912114 - DNA, 25 bp, Mus musculus
tgttccaaccaatgcgaagggccaa

SEQ ID NO: 912115 - DNA, 25 bp, Mus musculus
tgttccaactgcagcgcaaggagct

SEQ ID NO: 912116 - DNA, 25 bp, Mus musculus
tgttccaactgctgcgcaaggagct

SEQ ID NO: 912117 - DNA, 25 bp, Mus musculus
tgttccaagacactctcgaggatat

SEQ ID NO: 912118 - DNA, 25 bp, Mus musculus
tgttccaagacagtctcgaggatat

SEQ ID NO: 912119 - DNA, 25 bp, Mus musculus
tgttccaagaccctcactagatgac

SEQ ID NO: 912120 - DNA, 25 bp, Mus musculus
tgttccaagaccgtcactagatgac

SEQ ID NO: 912121 - DNA, 25 bp, Mus musculus
tgttccaagcagaaaaggcggctgt

SEQ ID NO: 912122 - DNA, 25 bp, Mus musculus
tgttccaagcagtaaaggcggctgt

SEQ ID NO: 912123 - DNA, 25 bp, Mus musculus
tgttccaagggcactccaacatcgc

SEQ ID NO: 912124 - DNA, 25 bp, Mus musculus
tgttccaagggctctccaacatcgc

SEQ ID NO: 912125 - DNA, 25 bp, Mus musculus
tgttccaatggtagagggctcgcct

SEQ ID NO: 912126 - DNA, 25 bp, Mus musculus
tgttccaatggttgagggctcgcct

SEQ ID NO: 912127 - DNA, 25 bp, Mus musculus
tgttccacaactacccatcaaaaga

SEQ ID NO: 912128 - DNA, 25 bp, Mus musculus
tgttccacaacttcccatcaaaaga

SEQ ID NO: 912129 - DNA, 25 bp, Mus musculus
tgttccacactacaatatgcccgct

SEQ ID NO: 912130 - DNA, 25 bp, Mus musculus
tgttccacactagaatatgcccgct

SEQ ID NO: 912131 - DNA, 25 bp, Mus musculus
tgttccacagctcttagcctcacat

SEQ ID NO: 912132 - DNA, 25 bp, Mus musculus
tgttccacagctgttagcctcacat

SEQ ID NO: 912133 - DNA, 25 bp, Mus musculus
tgttccacagggacccaaaacaagt

SEQ ID NO: 912134 - DNA, 25 bp, Mus musculus
tgttccacagggtcccaaaacaagt

SEQ ID NO: 912135 - DNA, 25 bp, Mus musculus
tgttccaccgttatctgcatatgtt

SEQ ID NO: 912136 - DNA, 25 bp, Mus musculus
tgttccaccgttttctgcatatgtt

SEQ ID NO: 912137 - DNA, 25 bp, Mus musculus
tgttccacctggatccagttgcaaa

SEQ ID NO: 912138 - DNA, 25 bp, Mus musculus
tgttccacctggttccagttgcaaa

SEQ ID NO: 912139 - DNA, 25 bp, Mus musculus
tgttccacctgtcatgtgtatgtga

SEQ ID NO: 912140 - DNA, 25 bp, Mus musculus
tgttccacctgtgatgtgtatgtga

SEQ ID NO: 912141 - DNA, 25 bp, Mus musculus
tgttccacgccaattctggagaggc

SEQ ID NO: 912142 - DNA, 25 bp, Mus musculus
tgttccacgccatttctggagaggc

SEQ ID NO: 912143 - DNA, 25 bp, Mus musculus
tgttccacgtagctcttgcattgga

SEQ ID NO: 912144 - DNA, 25 bp, Mus musculus
tgttccacgtaggtcttgcattgga

SEQ ID NO: 912145 - DNA, 25 bp, Mus musculus
tgttccactgaaatgccctgtcatt

SEQ ID NO: 912146 - DNA, 25 bp, Mus musculus
tgttccactgaactatactcccaac

SEQ ID NO: 912147 - DNA, 25 bp, Mus musculus
tgttccactgaagtatactcccaac

SEQ ID NO: 912148 - DNA, 25 bp, Mus musculus
tgttccactgaattgccctgtcatt

SEQ ID NO: 912149 - DNA, 25 bp, Mus musculus
tgttccacttttcgctcggaaagtt

SEQ ID NO: 912150 - DNA, 25 bp, Mus musculus
tgttccacttttggctcggaaagtt

SEQ ID NO: 912151 - DNA, 25 bp, Mus musculus
tgttccagaaacacacgcagatagg

SEQ ID NO: 912152 - DNA, 25 bp, Mus musculus
tgttccagaaactcacgcagatagg

SEQ ID NO: 912153 - DNA, 25 bp, Mus musculus
tgttccagaatgagtgcttcccact

SEQ ID NO: 912154 - DNA, 25 bp, Mus musculus
tgttccagaatgtgtgcttcccact

SEQ ID NO: 912155 - DNA, 25 bp, Mus musculus
tgttccagacatccatattcaccag

SEQ ID NO: 912156 - DNA, 25 bp, Mus musculus
tgttccagacatgcatattcaccag

SEQ ID NO: 912157 - DNA, 25 bp, Mus musculus
tgttccagatctacatggtggctca

SEQ ID NO: 912158 - DNA, 25 bp, Mus musculus
tgttccagatcttcatggtggctca

SEQ ID NO: 912159 - DNA, 25 bp, Mus musculus
tgttccagcagtatggtccttccaa

SEQ ID NO: 912160 - DNA, 25 bp, Mus musculus
tgttccagcagtttggtccttccaa

SEQ ID NO: 912161 - DNA, 25 bp, Mus musculus
tgttccagccttccagcaggtggaa

SEQ ID NO: 912162 - DNA, 25 bp, Mus musculus
tgttccagccttgcagcaggtggaa

SEQ ID NO: 912163 - DNA, 25 bp, Mus musculus
tgttccagctatactgcagcctgag

SEQ ID NO: 912164 - DNA, 25 bp, Mus musculus
tgttccagctattctgcagcctgag

SEQ ID NO: 912165 - DNA, 25 bp, Mus musculus
tgttccaggatcatctccatgcctt

SEQ ID NO: 912166 - DNA, 25 bp, Mus musculus
tgttccaggatcttctccatgcctt

SEQ ID NO: 912167 - DNA, 25 bp, Mus musculus
tgttccaggcttactattcgactta

SEQ ID NO: 912168 - DNA, 25 bp, Mus musculus
tgttccaggctttctattcgactta

SEQ ID NO: 912169 - DNA, 25 bp, Mus musculus
tgttccagggctaaatccactgctc

SEQ ID NO: 912170 - DNA, 25 bp, Mus musculus
tgttccagggcttaatccactgctc

SEQ ID NO: 912171 - DNA, 25 bp, Mus musculus
tgttccagggtcatgtggccaccgc

SEQ ID NO: 912172 - DNA, 25 bp, Mus musculus
tgttccagggtcttgtggccaccgc

SEQ ID NO: 912173 - DNA, 25 bp, Mus musculus
tgttccaggtgtctgatctgtggca

SEQ ID NO: 912174 - DNA, 25 bp, Mus musculus
tgttccaggtgtgtgatctgtggca

SEQ ID NO: 912175 - DNA, 25 bp, Mus musculus
tgttccagtagtactctgagacagg

SEQ ID NO: 912176 - DNA, 25 bp, Mus musculus
tgttccagtagttctctgagacagg

SEQ ID NO: 912177 - DNA, 25 bp, Mus musculus
tgttccagtcccagatcatgagcct

SEQ ID NO: 912178 - DNA, 25 bp, Mus musculus
tgttccagtccctgatcatgagcct

SEQ ID NO: 912179 - DNA, 25 bp, Mus musculus
tgttccagtggcagtcgacccattt

SEQ ID NO: 912180 - DNA, 25 bp, Mus musculus
tgttccagtggctgtcgacccattt

SEQ ID NO: 912181 - DNA, 25 bp, Mus musculus
tgttccagtgttcttttcatttcta

SEQ ID NO: 912182 - DNA, 25 bp, Mus musculus
tgttccagtgttgttttcatttcta

SEQ ID NO: 912183 - DNA, 25 bp, Mus musculus
tgttccagttccaaacctattttca

SEQ ID NO: 912184 - DNA, 25 bp, Mus musculus
tgttccagttcctaacctattttca

SEQ ID NO: 912185 - DNA, 25 bp, Mus musculus
tgttccagttggacacaccagacac

SEQ ID NO: 912186 - DNA, 25 bp, Mus musculus
tgttccagttggtcacaccagacac

SEQ ID NO: 912187 - DNA, 25 bp, Mus musculus
tgttccataaggctcctgtgatcaa

SEQ ID NO: 912188 - DNA, 25 bp, Mus musculus
tgttccataagggtcctgtgatcaa

SEQ ID NO: 912189 - DNA, 25 bp, Mus musculus
tgttccatacagactccaccgactg

SEQ ID NO: 912190 - DNA, 25 bp, Mus musculus
tgttccatacagtctccaccgactg

SEQ ID NO: 912191 - DNA, 25 bp, Mus musculus
tgttccatagacagttcctcacctc

SEQ ID NO: 912192 - DNA, 25 bp, Mus musculus
tgttccatagactgttcctcacctc

SEQ ID NO: 912193 - DNA, 25 bp, Mus musculus
tgttccatgcttcaggttcctgagg

SEQ ID NO: 912194 - DNA, 25 bp, Mus musculus
tgttccatgcttgaggttcctgagg

SEQ ID NO: 912195 - DNA, 25 bp, Mus musculus
tgttccatggataccgctgccagac

SEQ ID NO: 912196 - DNA, 25 bp, Mus musculus
tgttccatggattccgctgccagac

SEQ ID NO: 912197 - DNA, 25 bp, Mus musculus
tgttccatgtgcacgcaattccagc

SEQ ID NO: 912198 - DNA, 25 bp, Mus musculus
tgttccatgtgctcgcaattccagc

SEQ ID NO: 912199 - DNA, 25 bp, Mus musculus
tgttccattaaccactcactagagt

SEQ ID NO: 912200 - DNA, 25 bp, Mus musculus
tgttccattaacgactcactagagt

SEQ ID NO: 912201 - DNA, 25 bp, Mus musculus
tgttccatttgtaccaagcagctat

SEQ ID NO: 912202 - DNA, 25 bp, Mus musculus
tgttccatttgttccaagcagctat

SEQ ID NO: 912203 - DNA, 25 bp, Mus musculus
tgttcccaaagcacggctctaagca

SEQ ID NO: 912204 - DNA, 25 bp, Mus musculus
tgttcccaaagctcggctctaagca

SEQ ID NO: 912205 - DNA, 25 bp, Mus musculus
tgttcccaagtaacgatcccgatca

SEQ ID NO: 912206 - DNA, 25 bp, Mus musculus
tgttcccaagtaagcatgtgcctgt

SEQ ID NO: 912207 - DNA, 25 bp, Mus musculus
tgttcccaagtatcgatcccgatca

SEQ ID NO: 912208 - DNA, 25 bp, Mus musculus
tgttcccaagtatgcatgtgcctgt

SEQ ID NO: 912209 - DNA, 25 bp, Mus musculus
tgttcccaagtcaccaaggacgcaa

SEQ ID NO: 912210 - DNA, 25 bp, Mus musculus
tgttcccaagtctccaaggacgcaa

SEQ ID NO: 912211 - DNA, 25 bp, Mus musculus
tgttcccaagttcagcagaatcctt

SEQ ID NO: 912212 - DNA, 25 bp, Mus musculus
tgttcccaagttgagcagaatcctt

SEQ ID NO: 912213 - DNA, 25 bp, Mus musculus
tgttcccacaacaacatgaaccacc

SEQ ID NO: 912214 - DNA, 25 bp, Mus musculus
tgttcccacaactacatgaaccacc

SEQ ID NO: 912215 - DNA, 25 bp, Mus musculus
tgttcccacagtataccttcacttt

SEQ ID NO: 912216 - DNA, 25 bp, Mus musculus
tgttcccacagtttaccttcacttt

SEQ ID NO: 912217 - DNA, 25 bp, Mus musculus
tgttcccacataccatcttagttct

SEQ ID NO: 912218 - DNA, 25 bp, Mus musculus
tgttcccacatagcatcttagttct

SEQ ID NO: 912219 - DNA, 25 bp, Mus musculus
tgttcccaccagcatgggcaggttc

SEQ ID NO: 912220 - DNA, 25 bp, Mus musculus
tgttcccaccaggatgggcaggttc

SEQ ID NO: 912221 - DNA, 25 bp, Mus musculus
tgttcccacccacctaactgctggc

SEQ ID NO: 912222 - DNA, 25 bp, Mus musculus
tgttcccacccagctaactgctggc

SEQ ID NO: 912223 - DNA, 25 bp, Mus musculus
tgttcccacctgcaagacttgtgga

SEQ ID NO: 912224 - DNA, 25 bp, Mus musculus
tgttcccacctggaagacttgtgga

SEQ ID NO: 912225 - DNA, 25 bp, Mus musculus
tgttcccacggaacttccgtaagga

SEQ ID NO: 912226 - DNA, 25 bp, Mus musculus
tgttcccacggatcttccgtaagga

SEQ ID NO: 912227 - DNA, 25 bp, Mus musculus
tgttcccactgcagtttctcacata

SEQ ID NO: 912228 - DNA, 25 bp, Mus musculus
tgttcccactgcatggagatccgca

SEQ ID NO: 912229 - DNA, 25 bp, Mus musculus
tgttcccactgctgtttctcacata

SEQ ID NO: 912230 - DNA, 25 bp, Mus musculus
tgttcccactgcttggagatccgca

SEQ ID NO: 912231 - DNA, 25 bp, Mus musculus
tgttcccagaacactcctgaactct

SEQ ID NO: 912232 - DNA, 25 bp, Mus musculus
tgttcccagaactctcctgaactct

SEQ ID NO: 912233 - DNA, 25 bp, Mus musculus
tgttcccagacgctccagttttgag

SEQ ID NO: 912234 - DNA, 25 bp, Mus musculus
tgttcccagacggtccagttttgag

SEQ ID NO: 912235 - DNA, 25 bp, Mus musculus
tgttcccagcacagagcaaaacaaa

SEQ ID NO: 912236 - DNA, 25 bp, Mus musculus
tgttcccagcactgagcaaaacaaa

SEQ ID NO: 912237 - DNA, 25 bp, Mus musculus
tgttcccagccacacgaccgaggtg

SEQ ID NO: 912238 - DNA, 25 bp, Mus musculus
tgttcccagccagacgaccgaggtg

SEQ ID NO: 912239 - DNA, 25 bp, Mus musculus
tgttcccaggaaaattttaactacg

SEQ ID NO: 912240 - DNA, 25 bp, Mus musculus
tgttcccaggaatattttaactacg

SEQ ID NO: 912241 - DNA, 25 bp, Mus musculus
tgttcccaggacactagcttgcttg

SEQ ID NO: 912242 - DNA, 25 bp, Mus musculus
tgttcccaggactctagcttgcttg

SEQ ID NO: 912243 - DNA, 25 bp, Mus musculus
tgttcccaggagatatggacaatga

SEQ ID NO: 912244 - DNA, 25 bp, Mus musculus
tgttcccaggagttatggacaatga

SEQ ID NO: 912245 - DNA, 25 bp, Mus musculus
tgttcccaggatcagtgaagtcacc

SEQ ID NO: 912246 - DNA, 25 bp, Mus musculus
tgttcccaggatgagtgaagtcacc

SEQ ID NO: 912247 - DNA, 25 bp, Mus musculus
tgttcccaggctagacttccaaaat

SEQ ID NO: 912248 - DNA, 25 bp, Mus musculus
tgttcccaggcttgacttccaaaat

SEQ ID NO: 912249 - DNA, 25 bp, Mus musculus
tgttcccagtgcaaattcccacagg

SEQ ID NO: 912250 - DNA, 25 bp, Mus musculus
tgttcccagtgctaattcccacagg

SEQ ID NO: 912251 - DNA, 25 bp, Mus musculus
tgttcccagtggcactaacagccca

SEQ ID NO: 912252 - DNA, 25 bp, Mus musculus
tgttcccagtgggactaacagccca

SEQ ID NO: 912253 - DNA, 25 bp, Mus musculus
tgttcccagtgtacataaggcaccc

SEQ ID NO: 912254 - DNA, 25 bp, Mus musculus
tgttcccagtgttcataaggcaccc

SEQ ID NO: 912255 - DNA, 25 bp, Mus musculus
tgttcccatggactatgtcggcata

SEQ ID NO: 912256 - DNA, 25 bp, Mus musculus
tgttcccatggagtatgtcggcata

SEQ ID NO: 912257 - DNA, 25 bp, Mus musculus
tgttcccatgtcctgaagggctgaa

SEQ ID NO: 912258 - DNA, 25 bp, Mus musculus
tgttcccatgtcgtgaagggctgaa

SEQ ID NO: 912259 - DNA, 25 bp, Mus musculus
tgttcccatgttaccatttgtgtgt

SEQ ID NO: 912260 - DNA, 25 bp, Mus musculus
tgttcccatgtttccatttgtgtgt

SEQ ID NO: 912261 - DNA, 25 bp, Mus musculus
tgttcccattgtcctcatcaggtca

SEQ ID NO: 912262 - DNA, 25 bp, Mus musculus
tgttcccattgtgctcatcaggtca

SEQ ID NO: 912263 - DNA, 25 bp, Mus musculus
tgttccccaaaacgtcactcagcta

SEQ ID NO: 912264 - DNA, 25 bp, Mus musculus
tgttccccaaaaggtcactcagcta

SEQ ID NO: 912265 - DNA, 25 bp, Mus musculus
tgttccccaaataccacattacatc

SEQ ID NO: 912266 - DNA, 25 bp, Mus musculus
tgttccccaaattccacattacatc

SEQ ID NO: 912267 - DNA, 25 bp, Mus musculus
tgttccccaagacagctcatgtgag

SEQ ID NO: 912268 - DNA, 25 bp, Mus musculus
tgttccccaagagagctcatgtgag

SEQ ID NO: 912269 - DNA, 25 bp, Mus musculus
tgttccccaagcatggctgagcaga

SEQ ID NO: 912270 - DNA, 25 bp, Mus musculus
tgttccccaagcttggctgagcaga

SEQ ID NO: 912271 - DNA, 25 bp, Mus musculus
tgttccccacagcatgatacctatg

SEQ ID NO: 912272 - DNA, 25 bp, Mus musculus
tgttccccacaggatgatacctatg

SEQ ID NO: 912273 - DNA, 25 bp, Mus musculus
tgttccccacctactttaaagacag

SEQ ID NO: 912274 - DNA, 25 bp, Mus musculus
tgttccccaccttctttaaagacag

SEQ ID NO: 912275 - DNA, 25 bp, Mus musculus
tgttccccagaacttattgagcctc

SEQ ID NO: 912276 - DNA, 25 bp, Mus musculus
tgttccccagaagttattgagcctc

SEQ ID NO: 912277 - DNA, 25 bp, Mus musculus
tgttccccagagaagtgtaggtctt

SEQ ID NO: 912278 - DNA, 25 bp, Mus musculus
tgttccccagagaattgagctcctg

SEQ ID NO: 912279 - DNA, 25 bp, Mus musculus
tgttccccagagtagtgtaggtctt

SEQ ID NO: 912280 - DNA, 25 bp, Mus musculus
tgttccccagagtattgagctcctg

SEQ ID NO: 912281 - DNA, 25 bp, Mus musculus
tgttccccagcacaggattttgttc

SEQ ID NO: 912282 - DNA, 25 bp, Mus musculus
tgttccccagcagaggattttgttc

SEQ ID NO: 912283 - DNA, 25 bp, Mus musculus
tgttccccaggaagacttgtaagat

SEQ ID NO: 912284 - DNA, 25 bp, Mus musculus
tgttccccaggatgacttgtaagat

SEQ ID NO: 912285 - DNA, 25 bp, Mus musculus
tgttccccagtcagagcacttaaga

SEQ ID NO: 912286 - DNA, 25 bp, Mus musculus
tgttccccagtctgagcacttaaga

SEQ ID NO: 912287 - DNA, 25 bp, Mus musculus
tgttccccctggatacacggctctc

SEQ ID NO: 912288 - DNA, 25 bp, Mus musculus
tgttccccctggttacacggctctc

SEQ ID NO: 912289 - DNA, 25 bp, Mus musculus
tgttccccgcttacaaattttacat

SEQ ID NO: 912290 - DNA, 25 bp, Mus musculus
tgttccccgctttcaaattttacat

SEQ ID NO: 912291 - DNA, 25 bp, Mus musculus
tgttccccgggtagaaatccttgca

SEQ ID NO: 912292 - DNA, 25 bp, Mus musculus
tgttccccgggttgaaatccttgca

SEQ ID NO: 912293 - DNA, 25 bp, Mus musculus
tgttcccctaggcaaccaacttttg

SEQ ID NO: 912294 - DNA, 25 bp, Mus musculus
tgttcccctagggaaccaacttttg

SEQ ID NO: 912295 - DNA, 25 bp, Mus musculus
tgttcccctctaaccaaagccatta

SEQ ID NO: 912296 - DNA, 25 bp, Mus musculus
tgttcccctctatccaaagccatta

SEQ ID NO: 912297 - DNA, 25 bp, Mus musculus
tgttcccctctcacaagtattagga

SEQ ID NO: 912298 - DNA, 25 bp, Mus musculus
tgttcccctctctcaagtattagga

SEQ ID NO: 912299 - DNA, 25 bp, Mus musculus
tgttcccctgagcatcaacagtgag

SEQ ID NO: 912300 - DNA, 25 bp, Mus musculus
tgttcccctgaggatcaacagtgag

SEQ ID NO: 912301 - DNA, 25 bp, Mus musculus
tgttcccctgtccatgtttaacatg

SEQ ID NO: 912302 - DNA, 25 bp, Mus musculus
tgttcccctgtcgatgtttaacatg

SEQ ID NO: 912303 - DNA, 25 bp, Mus musculus
tgttccccttacatggccatgctga

SEQ ID NO: 912304 - DNA, 25 bp, Mus musculus
tgttccccttacttggccatgctga

SEQ ID NO: 912305 - DNA, 25 bp, Mus musculus
tgttccccttgacaaactgggttat

SEQ ID NO: 912306 - DNA, 25 bp, Mus musculus
tgttccccttgagaaactgggttat

SEQ ID NO: 912307 - DNA, 25 bp, Mus musculus
tgttcccctttcagtgttcttggct

SEQ ID NO: 912308 - DNA, 25 bp, Mus musculus
tgttcccctttctgtgttcttggct

SEQ ID NO: 912309 - DNA, 25 bp, Mus musculus
tgttcccgagatacctcgccctgaa

SEQ ID NO: 912310 - DNA, 25 bp, Mus musculus
tgttcccgagattcctcgccctgaa

SEQ ID NO: 912311 - DNA, 25 bp, Mus musculus
tgttcccgcagccatattgtatttt

SEQ ID NO: 912312 - DNA, 25 bp, Mus musculus
tgttcccgcagcgatattgtatttt

SEQ ID NO: 912313 - DNA, 25 bp, Mus musculus
tgttcccgctgacctcaatatggat

SEQ ID NO: 912314 - DNA, 25 bp, Mus musculus
tgttcccgctgagctcaatatggat

SEQ ID NO: 912315 - DNA, 25 bp, Mus musculus
tgttcccgtgtgaaactacctgaca

SEQ ID NO: 912316 - DNA, 25 bp, Mus musculus
tgttcccgtgtgtaactacctgaca

SEQ ID NO: 912317 - DNA, 25 bp, Mus musculus
tgttcccgttgcacagatggagtta

SEQ ID NO: 912318 - DNA, 25 bp, Mus musculus
tgttcccgttgctcagatggagtta

SEQ ID NO: 912319 - DNA, 25 bp, Mus musculus
tgttccctaagacctgcagtcatag

SEQ ID NO: 912320 - DNA, 25 bp, Mus musculus
tgttccctaagactgtagtccccgg

SEQ ID NO: 912321 - DNA, 25 bp, Mus musculus
tgttccctaagagctgcagtcatag

SEQ ID NO: 912322 - DNA, 25 bp, Mus musculus
tgttccctaagagtgtagtccccgg

SEQ ID NO: 912323 - DNA, 25 bp, Mus musculus
tgttccctacccatggacacagggt

SEQ ID NO: 912324 - DNA, 25 bp, Mus musculus
tgttccctacccttggacacagggt

SEQ ID NO: 912325 - DNA, 25 bp, Mus musculus
tgttccctagacactgcatggcagc

SEQ ID NO: 912326 - DNA, 25 bp, Mus musculus
tgttccctagactctgcatggcagc

SEQ ID NO: 912327 - DNA, 25 bp, Mus musculus
tgttccctagctcagttctctggac

SEQ ID NO: 912328 - DNA, 25 bp, Mus musculus
tgttccctagctgagttctctggac

SEQ ID NO: 912329 - DNA, 25 bp, Mus musculus
tgttccctcagtcgccagcgtcatg

SEQ ID NO: 912330 - DNA, 25 bp, Mus musculus
tgttccctcagtggccagcgtcatg

SEQ ID NO: 912331 - DNA, 25 bp, Mus musculus
tgttccctccacaagtaaactgata

SEQ ID NO: 912332 - DNA, 25 bp, Mus musculus
tgttccctccactagtaaactgata

SEQ ID NO: 912333 - DNA, 25 bp, Mus musculus
tgttccctctccaagtatttcatag

SEQ ID NO: 912334 - DNA, 25 bp, Mus musculus
tgttccctctcctagtatttcatag

SEQ ID NO: 912335 - DNA, 25 bp, Mus musculus
tgttccctgacacgatttggttgca

SEQ ID NO: 912336 - DNA, 25 bp, Mus musculus
tgttccctgacaggatttggttgca

SEQ ID NO: 912337 - DNA, 25 bp, Mus musculus
tgttccctgaccaagcagtgtgcaa

SEQ ID NO: 912338 - DNA, 25 bp, Mus musculus
tgttccctgacctagcagtgtgcaa

SEQ ID NO: 912339 - DNA, 25 bp, Mus musculus
tgttccctgagaccaattgtagata

SEQ ID NO: 912340 - DNA, 25 bp, Mus musculus
tgttccctgagagcaattgtagata

SEQ ID NO: 912341 - DNA, 25 bp, Mus musculus
tgttccctgcctataatttatcgtg

SEQ ID NO: 912342 - DNA, 25 bp, Mus musculus
tgttccctgcctttaatttatcgtg

SEQ ID NO: 912343 - DNA, 25 bp, Mus musculus
tgttccctggaaaaaaccgcaaagt

SEQ ID NO: 912344 - DNA, 25 bp, Mus musculus
tgttccctggaataaaccgcaaagt

SEQ ID NO: 912345 - DNA, 25 bp, Mus musculus
tgttccctgggactacatgttatgg

SEQ ID NO: 912346 - DNA, 25 bp, Mus musculus
tgttccctgggagtacatgttatgg

SEQ ID NO: 912347 - DNA, 25 bp, Mus musculus
tgttccctggtgatccacgaaggag

SEQ ID NO: 912348 - DNA, 25 bp, Mus musculus
tgttccctggtgttccacgaaggag

SEQ ID NO: 912349 - DNA, 25 bp, Mus musculus
tgttccctggttataagccccaaca

SEQ ID NO: 912350 - DNA, 25 bp, Mus musculus
tgttccctggttttaagccccaaca

SEQ ID NO: 912351 - DNA, 25 bp, Mus musculus
tgttccctgtgactctgcgggctca

SEQ ID NO: 912352 - DNA, 25 bp, Mus musculus
tgttccctgtgagtctgcgggctca

SEQ ID NO: 912353 - DNA, 25 bp, Mus musculus
tgttccctgtgcatcccaggaagcc

SEQ ID NO: 912354 - DNA, 25 bp, Mus musculus
tgttccctgtgcttcccaggaagcc

SEQ ID NO: 912355 - DNA, 25 bp, Mus musculus
tgttcccttagaccattaaatgaag

SEQ ID NO: 912356 - DNA, 25 bp, Mus musculus
tgttcccttagagcattaaatgaag

SEQ ID NO: 912357 - DNA, 25 bp, Mus musculus
tgttcccttcatccctgagtcagga

SEQ ID NO: 912358 - DNA, 25 bp, Mus musculus
tgttcccttcatgcctgagtcagga

SEQ ID NO: 912359 - DNA, 25 bp, Mus musculus
tgttcccttggcactatacatctaa

SEQ ID NO: 912360 - DNA, 25 bp, Mus musculus
tgttcccttggctctatacatctaa

SEQ ID NO: 912361 - DNA, 25 bp, Mus musculus
tgttcccttgtcagtctagtcttta

SEQ ID NO: 912362 - DNA, 25 bp, Mus musculus
tgttcccttgtccagtgtggctgac

SEQ ID NO: 912363 - DNA, 25 bp, Mus musculus
tgttcccttgtcgagtgtggctgac

SEQ ID NO: 912364 - DNA, 25 bp, Mus musculus
tgttcccttgtctgtctagtcttta

SEQ ID NO: 912365 - DNA, 25 bp, Mus musculus
tgttcccttgttagtgtcttgagat

SEQ ID NO: 912366 - DNA, 25 bp, Mus musculus
tgttcccttgtttgtgtcttgagat

SEQ ID NO: 912367 - DNA, 25 bp, Mus musculus
tgttccctttgaagccgtttcgttt

SEQ ID NO: 912368 - DNA, 25 bp, Mus musculus
tgttccctttgatgccgtttcgttt

SEQ ID NO: 912369 - DNA, 25 bp, Mus musculus
tgttccctttggattgtagtgtgtt

SEQ ID NO: 912370 - DNA, 25 bp, Mus musculus
tgttccctttggtttgtagtgtgtt

SEQ ID NO: 912371 - DNA, 25 bp, Mus musculus
tgttcccttttcaatggcagcatgt

SEQ ID NO: 912372 - DNA, 25 bp, Mus musculus
tgttcccttttctatggcagcatgt

SEQ ID NO: 912373 - DNA, 25 bp, Mus musculus
tgttccgaagtcagcaatcacgtct

SEQ ID NO: 912374 - DNA, 25 bp, Mus musculus
tgttccgaagtctgcaatcacgtct

SEQ ID NO: 912375 - DNA, 25 bp, Mus musculus
tgttccgaatgtcaagtgtcctaat

SEQ ID NO: 912376 - DNA, 25 bp, Mus musculus
tgttccgaatgtgaagtgtcctaat

SEQ ID NO: 912377 - DNA, 25 bp, Mus musculus
tgttccgacgtcaggccgaggccaa

SEQ ID NO: 912378 - DNA, 25 bp, Mus musculus
tgttccgacgtctggccgaggccaa

SEQ ID NO: 912379 - DNA, 25 bp, Mus musculus
tgttccgagggtacccactactcag

SEQ ID NO: 912380 - DNA, 25 bp, Mus musculus
tgttccgagggttcccactactcag

SEQ ID NO: 912381 - DNA, 25 bp, Mus musculus
tgttccgatgcactcattaaacgac

SEQ ID NO: 912382 - DNA, 25 bp, Mus musculus
tgttccgatgcagtcattaaacgac

SEQ ID NO: 912383 - DNA, 25 bp, Mus musculus
tgttccgcagaacttccacctttgc

SEQ ID NO: 912384 - DNA, 25 bp, Mus musculus
tgttccgcagaagttccacctttgc

SEQ ID NO: 912385 - DNA, 25 bp, Mus musculus
tgttccgctactccgcaggcgcgtg

SEQ ID NO: 912386 - DNA, 25 bp, Mus musculus
tgttccgctactgcgcaggcgcgtg

SEQ ID NO: 912387 - DNA, 25 bp, Mus musculus
tgttccggcttcaacggttgtcctt

SEQ ID NO: 912388 - DNA, 25 bp, Mus musculus
tgttccggcttctacggttgtcctt

SEQ ID NO: 912389 - DNA, 25 bp, Mus musculus
tgttccgggtgcaggatattaggta

SEQ ID NO: 912390 - DNA, 25 bp, Mus musculus
tgttccgggtgctggatattaggta

SEQ ID NO: 912391 - DNA, 25 bp, Mus musculus
tgttccggtggtcttgtgttctttc

SEQ ID NO: 912392 - DNA, 25 bp, Mus musculus
tgttccggtggtgttgtgttctttc

SEQ ID NO: 912393 - DNA, 25 bp, Mus musculus
tgttccggttgtcacaccagctgaa

SEQ ID NO: 912394 - DNA, 25 bp, Mus musculus
tgttccggttgtgacaccagctgaa

SEQ ID NO: 912395 - DNA, 25 bp, Mus musculus
tgttccgtaatccttggttcgccgg

SEQ ID NO: 912396 - DNA, 25 bp, Mus musculus
tgttccgtaatcgttggttcgccgg

SEQ ID NO: 912397 - DNA, 25 bp, Mus musculus
tgttccgtgttcagtctggtgctcc

SEQ ID NO: 912398 - DNA, 25 bp, Mus musculus
tgttccgtgttctgtctggtgctcc

SEQ ID NO: 912399 - DNA, 25 bp, Mus musculus
tgttccgttaaaaatggcttcctca

SEQ ID NO: 912400 - DNA, 25 bp, Mus musculus
tgttccgttaaatatggcttcctca

SEQ ID NO: 912401 - DNA, 25 bp, Mus musculus
tgttccgttgtgatctttaatttaa

SEQ ID NO: 912402 - DNA, 25 bp, Mus musculus
tgttccgttgtgttctttaatttaa

SEQ ID NO: 912403 - DNA, 25 bp, Mus musculus
tgttcctaagtacccagttgccatg

SEQ ID NO: 912404 - DNA, 25 bp, Mus musculus
tgttcctaagtagccagttgccatg

SEQ ID NO: 912405 - DNA, 25 bp, Mus musculus
tgttcctaatccagctatcaattcc

SEQ ID NO: 912406 - DNA, 25 bp, Mus musculus
tgttcctaatcctgctatcaattcc

SEQ ID NO: 912407 - DNA, 25 bp, Mus musculus
tgttcctaattgattctggcttttt

SEQ ID NO: 912408 - DNA, 25 bp, Mus musculus
tgttcctaattgtttctggcttttt

SEQ ID NO: 912409 - DNA, 25 bp, Mus musculus
tgttcctacatcatctcgcttatat

SEQ ID NO: 912410 - DNA, 25 bp, Mus musculus
tgttcctacatcttctcgcttatat

SEQ ID NO: 912411 - DNA, 25 bp, Mus musculus
tgttcctacctgagagtcctgtctg

SEQ ID NO: 912412 - DNA, 25 bp, Mus musculus
tgttcctacctgtgagtcctgtctg

SEQ ID NO: 912413 - DNA, 25 bp, Mus musculus
tgttcctacgcacagggttcacggt

SEQ ID NO: 912414 - DNA, 25 bp, Mus musculus
tgttcctacgcagagggttcacggt

SEQ ID NO: 912415 - DNA, 25 bp, Mus musculus
tgttcctaggaactgcttggtttgt

SEQ ID NO: 912416 - DNA, 25 bp, Mus musculus
tgttcctaggaagtgcttggtttgt

SEQ ID NO: 912417 - DNA, 25 bp, Mus musculus
tgttcctagtatcctggcgtccaca

SEQ ID NO: 912418 - DNA, 25 bp, Mus musculus
tgttcctagtatgctggcgtccaca

SEQ ID NO: 912419 - DNA, 25 bp, Mus musculus
tgttcctatatcatcgagacctgcc

SEQ ID NO: 912420 - DNA, 25 bp, Mus musculus
tgttcctatatcttcgagacctgcc

SEQ ID NO: 912421 - DNA, 25 bp, Mus musculus
tgttcctatgaaagccaagagtgtg

SEQ ID NO: 912422 - DNA, 25 bp, Mus musculus
tgttcctatgaatgccaagagtgtg

SEQ ID NO: 912423 - DNA, 25 bp, Mus musculus
tgttcctatgggaattccccaccta

SEQ ID NO: 912424 - DNA, 25 bp, Mus musculus
tgttcctatgggtattccccaccta

SEQ ID NO: 912425 - DNA, 25 bp, Mus musculus
tgttcctcaaggcttttgtttagaa

SEQ ID NO: 912426 - DNA, 25 bp, Mus musculus
tgttcctcaagggttttgtttagaa

SEQ ID NO: 912427 - DNA, 25 bp, Mus musculus
tgttcctcattgaaccctgggagct

SEQ ID NO: 912428 - DNA, 25 bp, Mus musculus
tgttcctcattgtaccctgggagct

SEQ ID NO: 912429 - DNA, 25 bp, Mus musculus
tgttcctccaccaccaggattataa

SEQ ID NO: 912430 - DNA, 25 bp, Mus musculus
tgttcctccacctccaggattataa

SEQ ID NO: 912431 - DNA, 25 bp, Mus musculus
tgttcctccatacttgattccataa

SEQ ID NO: 912432 - DNA, 25 bp, Mus musculus
tgttcctccatagttgattccataa

SEQ ID NO: 912433 - DNA, 25 bp, Mus musculus
tgttcctcccctcttgctatctgat

SEQ ID NO: 912434 - DNA, 25 bp, Mus musculus
tgttcctcccctgttgctatctgat

SEQ ID NO: 912435 - DNA, 25 bp, Mus musculus
tgttcctcctggctcattgagtaga

SEQ ID NO: 912436 - DNA, 25 bp, Mus musculus
tgttcctcctgggtcattgagtaga

SEQ ID NO: 912437 - DNA, 25 bp, Mus musculus
tgttcctctaacagtgcctgattat

SEQ ID NO: 912438 - DNA, 25 bp, Mus musculus
tgttcctctaactgtgcctgattat

SEQ ID NO: 912439 - DNA, 25 bp, Mus musculus
tgttcctctatcagcgaagactgga

SEQ ID NO: 912440 - DNA, 25 bp, Mus musculus
tgttcctctatctgcgaagactgga

SEQ ID NO: 912441 - DNA, 25 bp, Mus musculus
tgttcctctcatactcaatttctta

SEQ ID NO: 912442 - DNA, 25 bp, Mus musculus
tgttcctctcattctcaatttctta

SEQ ID NO: 912443 - DNA, 25 bp, Mus musculus
tgttcctctctgcatcattgtttgt

SEQ ID NO: 912444 - DNA, 25 bp, Mus musculus
tgttcctctctggatcattgtttgt

SEQ ID NO: 912445 - DNA, 25 bp, Mus musculus
tgttcctctgaaacttccttgattg

SEQ ID NO: 912446 - DNA, 25 bp, Mus musculus
tgttcctctgaatcttccttgattg

SEQ ID NO: 912447 - DNA, 25 bp, Mus musculus
tgttcctctgaccaaccaaagggtt

SEQ ID NO: 912448 - DNA, 25 bp, Mus musculus
tgttcctctgacgaaccaaagggtt

SEQ ID NO: 912449 - DNA, 25 bp, Mus musculus
tgttcctctggaactatttccccat

SEQ ID NO: 912450 - DNA, 25 bp, Mus musculus
tgttcctctggatctatttccccat

SEQ ID NO: 912451 - DNA, 25 bp, Mus musculus
tgttcctctgggattgcttgtttcc

SEQ ID NO: 912452 - DNA, 25 bp, Mus musculus
tgttcctctgggtttgcttgtttcc

SEQ ID NO: 912453 - DNA, 25 bp, Mus musculus
tgttcctctttaaaccatgttccaa

SEQ ID NO: 912454 - DNA, 25 bp, Mus musculus
tgttcctctttataccatgttccaa

SEQ ID NO: 912455 - DNA, 25 bp, Mus musculus
tgttcctgaacacagtgcacccatc

SEQ ID NO: 912456 - DNA, 25 bp, Mus musculus
tgttcctgaacagagtgcacccatc

SEQ ID NO: 912457 - DNA, 25 bp, Mus musculus
tgttcctgaagaacatggccgtcct

SEQ ID NO: 912458 - DNA, 25 bp, Mus musculus
tgttcctgaagatcatggccgtcct

SEQ ID NO: 912459 - DNA, 25 bp, Mus musculus
tgttcctgacctctacagtgttcac

SEQ ID NO: 912460 - DNA, 25 bp, Mus musculus
tgttcctgacctgtacagtgttcac

SEQ ID NO: 912461 - DNA, 25 bp, Mus musculus
tgttcctgaggtactgggtccaaaa

SEQ ID NO: 912462 - DNA, 25 bp, Mus musculus
tgttcctgaggttctgggtccaaaa

SEQ ID NO: 912463 - DNA, 25 bp, Mus musculus
tgttcctgatccagctgagcctggg

SEQ ID NO: 912464 - DNA, 25 bp, Mus musculus
tgttcctgatcctgctgagcctggg

SEQ ID NO: 912465 - DNA, 25 bp, Mus musculus
tgttcctgatttacctggcgctcta

SEQ ID NO: 912466 - DNA, 25 bp, Mus musculus
tgttcctgattttcctggcgctcta

SEQ ID NO: 912467 - DNA, 25 bp, Mus musculus
tgttcctgcagtatcttcctgctat

SEQ ID NO: 912468 - DNA, 25 bp, Mus musculus
tgttcctgcagtttcttcctgctat

SEQ ID NO: 912469 - DNA, 25 bp, Mus musculus
tgttcctggagacgtcagccctcga

SEQ ID NO: 912470 - DNA, 25 bp, Mus musculus
tgttcctggagaggtcagccctcga

SEQ ID NO: 912471 - DNA, 25 bp, Mus musculus
tgttcctggcaaatcataatgtcat

SEQ ID NO: 912472 - DNA, 25 bp, Mus musculus
tgttcctggcaattcataatgtcat

SEQ ID NO: 912473 - DNA, 25 bp, Mus musculus
tgttcctggcagcagagatccgaga

SEQ ID NO: 912474 - DNA, 25 bp, Mus musculus
tgttcctggcagctgagcttgtaaa

SEQ ID NO: 912475 - DNA, 25 bp, Mus musculus
tgttcctggcaggagagatccgaga

SEQ ID NO: 912476 - DNA, 25 bp, Mus musculus
tgttcctggcaggtgagcttgtaaa

SEQ ID NO: 912477 - DNA, 25 bp, Mus musculus
tgttcctggccaacgacagtggcaa

SEQ ID NO: 912478 - DNA, 25 bp, Mus musculus
tgttcctggccatcgacagtggcaa

SEQ ID NO: 912479 - DNA, 25 bp, Mus musculus
tgttcctgggaccttgatctccaag

SEQ ID NO: 912480 - DNA, 25 bp, Mus musculus
tgttcctgggacgttgatctccaag

SEQ ID NO: 912481 - DNA, 25 bp, Mus musculus
tgttcctggtggatctcatctgctg

SEQ ID NO: 912482 - DNA, 25 bp, Mus musculus
tgttcctggtggttctcatctgctg

SEQ ID NO: 912483 - DNA, 25 bp, Mus musculus
tgttcctggttcctgatggacgtga

SEQ ID NO: 912484 - DNA, 25 bp, Mus musculus
tgttcctggttcgtgatggacgtga

SEQ ID NO: 912485 - DNA, 25 bp, Mus musculus
tgttcctgtaccaccgagagaggga

SEQ ID NO: 912486 - DNA, 25 bp, Mus musculus
tgttcctgtacctccgagagaggga

SEQ ID NO: 912487 - DNA, 25 bp, Mus musculus
tgttcctgtatacatttctaccctc

SEQ ID NO: 912488 - DNA, 25 bp, Mus musculus
tgttcctgtatagatttctaccctc

SEQ ID NO: 912489 - DNA, 25 bp, Mus musculus
tgttcctgtattaccaagctctgcg

SEQ ID NO: 912490 - DNA, 25 bp, Mus musculus
tgttcctgtatttccaagctctgcg

SEQ ID NO: 912491 - DNA, 25 bp, Mus musculus
tgttcctgtcggacactggtgaaca

SEQ ID NO: 912492 - DNA, 25 bp, Mus musculus
tgttcctgtcggtcactggtgaaca

SEQ ID NO: 912493 - DNA, 25 bp, Mus musculus
tgttcctgtctaaacatttaacatt

SEQ ID NO: 912494 - DNA, 25 bp, Mus musculus
tgttcctgtctatacatttaacatt

SEQ ID NO: 912495 - DNA, 25 bp, Mus musculus
tgttcctgtgacctgcctgtcacct

SEQ ID NO: 912496 - DNA, 25 bp, Mus musculus
tgttcctgtgacgtgcctgtcacct

SEQ ID NO: 912497 - DNA, 25 bp, Mus musculus
tgttcctgtgatcgtgtgtgtatgt

SEQ ID NO: 912498 - DNA, 25 bp, Mus musculus
tgttcctgtgatggtgtgtgtatgt

SEQ ID NO: 912499 - DNA, 25 bp, Mus musculus
tgttccttaatccacttatattcag

SEQ ID NO: 912500 - DNA, 25 bp, Mus musculus
tgttccttaatcgacttatattcag

SEQ ID NO: 912501 - DNA, 25 bp, Mus musculus
tgttccttacaaagctgggccccga

SEQ ID NO: 912502 - DNA, 25 bp, Mus musculus
tgttccttacaatgctgggccccga

SEQ ID NO: 912503 - DNA, 25 bp, Mus musculus
tgttccttacacagtggactctgac

SEQ ID NO: 912504 - DNA, 25 bp, Mus musculus
tgttccttacactgtggactctgac

SEQ ID NO: 912505 - DNA, 25 bp, Mus musculus
tgttccttaccaatcaaactaggaa

SEQ ID NO: 912506 - DNA, 25 bp, Mus musculus
tgttccttaccattcaaactaggaa

SEQ ID NO: 912507 - DNA, 25 bp, Mus musculus
tgttccttacccatgactatagttg

SEQ ID NO: 912508 - DNA, 25 bp, Mus musculus
tgttccttacccttgactatagttg

SEQ ID NO: 912509 - DNA, 25 bp, Mus musculus
tgttccttattcaggaggttttcaa

SEQ ID NO: 912510 - DNA, 25 bp, Mus musculus
tgttccttattctggaggttttcaa

SEQ ID NO: 912511 - DNA, 25 bp, Mus musculus
tgttccttcaaaagccagcagtgcc

SEQ ID NO: 912512 - DNA, 25 bp, Mus musculus
tgttccttcaaatgccagcagtgcc

SEQ ID NO: 912513 - DNA, 25 bp, Mus musculus
tgttccttcaggaaatcattacaac

SEQ ID NO: 912514 - DNA, 25 bp, Mus musculus
tgttccttcaggtaatcattacaac

SEQ ID NO: 912515 - DNA, 25 bp, Mus musculus
tgttccttccaacatctcttgagat

SEQ ID NO: 912516 - DNA, 25 bp, Mus musculus
tgttccttccaagatctcttgagat

SEQ ID NO: 912517 - DNA, 25 bp, Mus musculus
tgttccttccacaatgaggctctga

SEQ ID NO: 912518 - DNA, 25 bp, Mus musculus
tgttccttccacagtacaccattag

SEQ ID NO: 912519 - DNA, 25 bp, Mus musculus
tgttccttccactatgaggctctga

SEQ ID NO: 912520 - DNA, 25 bp, Mus musculus
tgttccttccactgtacaccattag

SEQ ID NO: 912521 - DNA, 25 bp, Mus musculus
tgttccttccctctgtagattggac

SEQ ID NO: 912522 - DNA, 25 bp, Mus musculus
tgttccttccctgtgtagattggac

SEQ ID NO: 912523 - DNA, 25 bp, Mus musculus
tgttccttcgccagaattcattgca

SEQ ID NO: 912524 - DNA, 25 bp, Mus musculus
tgttccttcgcctgaattcattgca

SEQ ID NO: 912525 - DNA, 25 bp, Mus musculus
tgttccttgaaaccacatcatgttt

SEQ ID NO: 912526 - DNA, 25 bp, Mus musculus
tgttccttgaaagcacatcatgttt

SEQ ID NO: 912527 - DNA, 25 bp, Mus musculus
tgttccttgcagaaccttgacctcc

SEQ ID NO: 912528 - DNA, 25 bp, Mus musculus
tgttccttgcagtaccttgacctcc

SEQ ID NO: 912529 - DNA, 25 bp, Mus musculus
tgttccttgcccagtgtgatttctg

SEQ ID NO: 912530 - DNA, 25 bp, Mus musculus
tgttccttgccctgtgtgatttctg

SEQ ID NO: 912531 - DNA, 25 bp, Mus musculus
tgttccttgctgctatacctcagaa

SEQ ID NO: 912532 - DNA, 25 bp, Mus musculus
tgttccttgctggtatacctcagaa

SEQ ID NO: 912533 - DNA, 25 bp, Mus musculus
tgttccttggctccttcaaatgaga

SEQ ID NO: 912534 - DNA, 25 bp, Mus musculus
tgttccttggctgcttcaaatgaga

SEQ ID NO: 912535 - DNA, 25 bp, Mus musculus
tgttccttggtcaatgttcactgca

SEQ ID NO: 912536 - DNA, 25 bp, Mus musculus
tgttccttggtctatgttcactgca

SEQ ID NO: 912537 - DNA, 25 bp, Mus musculus
tgttccttgtccaggcatttctgtg

SEQ ID NO: 912538 - DNA, 25 bp, Mus musculus
tgttccttgtcctggcatttctgtg

SEQ ID NO: 912539 - DNA, 25 bp, Mus musculus
tgttccttgtttacgttttcattgg

SEQ ID NO: 912540 - DNA, 25 bp, Mus musculus
tgttccttgtttccaacacagcttt

SEQ ID NO: 912541 - DNA, 25 bp, Mus musculus
tgttccttgtttgcaacacagcttt

SEQ ID NO: 912542 - DNA, 25 bp, Mus musculus
tgttccttgttttcgttttcattgg

SEQ ID NO: 912543 - DNA, 25 bp, Mus musculus
tgttcctttactccccaaacaatag

SEQ ID NO: 912544 - DNA, 25 bp, Mus musculus
tgttcctttactgcccaaacaatag

SEQ ID NO: 912545 - DNA, 25 bp, Mus musculus
tgttcctttctaccaggtgtgtgtg

SEQ ID NO: 912546 - DNA, 25 bp, Mus musculus
tgttcctttctagcaggtgtgtgtg

SEQ ID NO: 912547 - DNA, 25 bp, Mus musculus
tgttcctttgctcgctattgagagt

SEQ ID NO: 912548 - DNA, 25 bp, Mus musculus
tgttcctttgctggctattgagagt

SEQ ID NO: 912549 - DNA, 25 bp, Mus musculus
tgttcctttggaagttgagcaagct

SEQ ID NO: 912550 - DNA, 25 bp, Mus musculus
tgttcctttggatgttgagcaagct

SEQ ID NO: 912551 - DNA, 25 bp, Mus musculus
tgttcctttgtgctagtttgtctct

SEQ ID NO: 912552 - DNA, 25 bp, Mus musculus
tgttcctttgtggtagtttgtctct

SEQ ID NO: 912553 - DNA, 25 bp, Mus musculus
tgttccttttccagtgtgctaatgt

SEQ ID NO: 912554 - DNA, 25 bp, Mus musculus
tgttccttttcctgtgtgctaatgt

SEQ ID NO: 912555 - DNA, 25 bp, Mus musculus
tgttccttttcgactcttgtggtaa

SEQ ID NO: 912556 - DNA, 25 bp, Mus musculus
tgttccttttcgtctcttgtggtaa

SEQ ID NO: 912557 - DNA, 25 bp, Mus musculus
tgttccttttgcattcacacggaat

SEQ ID NO: 912558 - DNA, 25 bp, Mus musculus
tgttccttttgctttcacacggaat

SEQ ID NO: 912559 - DNA, 25 bp, Mus musculus
tgttcgaaaacccaaatatcccaag

SEQ ID NO: 912560 - DNA, 25 bp, Mus musculus
tgttcgaaaaccgaaatatcccaag

SEQ ID NO: 912561 - DNA, 25 bp, Mus musculus
tgttcgaagatcattgccagctcct

SEQ ID NO: 912562 - DNA, 25 bp, Mus musculus
tgttcgaagatctttgccagctcct

SEQ ID NO: 912563 - DNA, 25 bp, Mus musculus
tgttcgaatagcagccctcgtctgc

SEQ ID NO: 912564 - DNA, 25 bp, Mus musculus
tgttcgaatagctgccctcgtctgc

SEQ ID NO: 912565 - DNA, 25 bp, Mus musculus
tgttcgaccattcctaactaagtct

SEQ ID NO: 912566 - DNA, 25 bp, Mus musculus
tgttcgaccattgctaactaagtct

SEQ ID NO: 912567 - DNA, 25 bp, Mus musculus
tgttcgacctcacacataatcctgg

SEQ ID NO: 912568 - DNA, 25 bp, Mus musculus
tgttcgacctcagacataatcctgg

SEQ ID NO: 912569 - DNA, 25 bp, Mus musculus
tgttcgacctccctcagaattggag

SEQ ID NO: 912570 - DNA, 25 bp, Mus musculus
tgttcgacctccgtcagaattggag

SEQ ID NO: 912571 - DNA, 25 bp, Mus musculus
tgttcgagagcacactttcaccaga

SEQ ID NO: 912572 - DNA, 25 bp, Mus musculus
tgttcgagagcagactttcaccaga

SEQ ID NO: 912573 - DNA, 25 bp, Mus musculus
tgttcgaggcagctatcttacagac

SEQ ID NO: 912574 - DNA, 25 bp, Mus musculus
tgttcgaggcaggtatcttacagac

SEQ ID NO: 912575 - DNA, 25 bp, Mus musculus
tgttcgatccgacattcgcctcagt

SEQ ID NO: 912576 - DNA, 25 bp, Mus musculus
tgttcgatccgagattcgcctcagt

SEQ ID NO: 912577 - DNA, 25 bp, Mus musculus
tgttcgatttttctgcaagcgtttt

SEQ ID NO: 912578 - DNA, 25 bp, Mus musculus
tgttcgatttttgtgcaagcgtttt

SEQ ID NO: 912579 - DNA, 25 bp, Mus musculus
tgttcgcaccccagggttccctcct

SEQ ID NO: 912580 - DNA, 25 bp, Mus musculus
tgttcgcacccctgggttccctcct

SEQ ID NO: 912581 - DNA, 25 bp, Mus musculus
tgttcgccaacaagcagcaaggtta

SEQ ID NO: 912582 - DNA, 25 bp, Mus musculus
tgttcgccaacatgcagcaaggtta

SEQ ID NO: 912583 - DNA, 25 bp, Mus musculus
tgttcgccaggcaccagggtgcagc

SEQ ID NO: 912584 - DNA, 25 bp, Mus musculus
tgttcgccaggctccagggtgcagc

SEQ ID NO: 912585 - DNA, 25 bp, Mus musculus
tgttcgccagtgagctacatcccta

SEQ ID NO: 912586 - DNA, 25 bp, Mus musculus
tgttcgccagtgtgctacatcccta

SEQ ID NO: 912587 - DNA, 25 bp, Mus musculus
tgttcgccctacagctgcagcgcat

SEQ ID NO: 912588 - DNA, 25 bp, Mus musculus
tgttcgccctactgctgcagcgcat

SEQ ID NO: 912589 - DNA, 25 bp, Mus musculus
tgttcgccctgtcccatatttggaa

SEQ ID NO: 912590 - DNA, 25 bp, Mus musculus
tgttcgccctgtgccatatttggaa

SEQ ID NO: 912591 - DNA, 25 bp, Mus musculus
tgttcgctatgcctggaccacatgg

SEQ ID NO: 912592 - DNA, 25 bp, Mus musculus
tgttcgctatgcgtggaccacatgg

SEQ ID NO: 912593 - DNA, 25 bp, Mus musculus
tgttcgctcaatcaagtcctctgtg

SEQ ID NO: 912594 - DNA, 25 bp, Mus musculus
tgttcgctcaatgaagtcctctgtg

SEQ ID NO: 912595 - DNA, 25 bp, Mus musculus
tgttcgctcttcatgttggtaccaa

SEQ ID NO: 912596 - DNA, 25 bp, Mus musculus
tgttcgctcttcttgttggtaccaa

SEQ ID NO: 912597 - DNA, 25 bp, Mus musculus
tgttcgctgaagcatttttattgtc

SEQ ID NO: 912598 - DNA, 25 bp, Mus musculus
tgttcgctgaaggatttttattgtc

SEQ ID NO: 912599 - DNA, 25 bp, Mus musculus
tgttcgctgtaaattccctgcaaaa

SEQ ID NO: 912600 - DNA, 25 bp, Mus musculus
tgttcgctgtaatttccctgcaaaa

SEQ ID NO: 912601 - DNA, 25 bp, Mus musculus
tgttcgctgtgcaagggctcgcacg

SEQ ID NO: 912602 - DNA, 25 bp, Mus musculus
tgttcgctgtgctagggctcgcacg

SEQ ID NO: 912603 - DNA, 25 bp, Mus musculus
tgttcgctgttaatttctttgtggg

SEQ ID NO: 912604 - DNA, 25 bp, Mus musculus
tgttcgctgttattttctttgtggg

SEQ ID NO: 912605 - DNA, 25 bp, Mus musculus
tgttcgcttgacagtgtgtagcttc

SEQ ID NO: 912606 - DNA, 25 bp, Mus musculus
tgttcgcttgactgtgtgtagcttc

SEQ ID NO: 912607 - DNA, 25 bp, Mus musculus
tgttcgcttttcactcaattactta

SEQ ID NO: 912608 - DNA, 25 bp, Mus musculus
tgttcgcttttctctcaattactta

SEQ ID NO: 912609 - DNA, 25 bp, Mus musculus
tgttcggaactacttgtcaatgtgt

SEQ ID NO: 912610 - DNA, 25 bp, Mus musculus
tgttcggaactagttgtcaatgtgt

SEQ ID NO: 912611 - DNA, 25 bp, Mus musculus
tgttcggaagccacctggacatcca

SEQ ID NO: 912612 - DNA, 25 bp, Mus musculus
tgttcggaagcctcctggacatcca

SEQ ID NO: 912613 - DNA, 25 bp, Mus musculus
tgttcggacaataccgtgcgtgctg

SEQ ID NO: 912614 - DNA, 25 bp, Mus musculus
tgttcggacaattccgtgcgtgctg

SEQ ID NO: 912615 - DNA, 25 bp, Mus musculus
tgttcggagttccagcgattttcca

SEQ ID NO: 912616 - DNA, 25 bp, Mus musculus
tgttcggagttcgagcgattttcca

SEQ ID NO: 912617 - DNA, 25 bp, Mus musculus
tgttcggccccgagagaagcctcta

SEQ ID NO: 912618 - DNA, 25 bp, Mus musculus
tgttcggccccgtgagaagcctcta

SEQ ID NO: 912619 - DNA, 25 bp, Mus musculus
tgttcgggagccaaaaggaagactg

SEQ ID NO: 912620 - DNA, 25 bp, Mus musculus
tgttcgggagcctaaaggaagactg

SEQ ID NO: 912621 - DNA, 25 bp, Mus musculus
tgttcgggtgggaactcttgcctaa

SEQ ID NO: 912622 - DNA, 25 bp, Mus musculus
tgttcgggtgggtactcttgcctaa

SEQ ID NO: 912623 - DNA, 25 bp, Mus musculus
tgttcggtctgacgcttatctcacg

SEQ ID NO: 912624 - DNA, 25 bp, Mus musculus
tgttcggtctgaggcttatctcacg

SEQ ID NO: 912625 - DNA, 25 bp, Mus musculus
tgttcggtgggaccagtataccttt

SEQ ID NO: 912626 - DNA, 25 bp, Mus musculus
tgttcggtgggagcagtataccttt

SEQ ID NO: 912627 - DNA, 25 bp, Mus musculus
tgttcggttcctatactgctttttg

SEQ ID NO: 912628 - DNA, 25 bp, Mus musculus
tgttcggttcctttactgctttttg

SEQ ID NO: 912629 - DNA, 25 bp, Mus musculus
tgttcggtttccagataaaaatttg

SEQ ID NO: 912630 - DNA, 25 bp, Mus musculus
tgttcggtttcctgataaaaatttg

SEQ ID NO: 912631 - DNA, 25 bp, Mus musculus
tgttcggtttgacccagggaagcct

SEQ ID NO: 912632 - DNA, 25 bp, Mus musculus
tgttcggtttgagccagggaagcct

SEQ ID NO: 912633 - DNA, 25 bp, Mus musculus
tgttcgtactgtcctggttcccctt

SEQ ID NO: 912634 - DNA, 25 bp, Mus musculus
tgttcgtactgtgctggttcccctt

SEQ ID NO: 912635 - DNA, 25 bp, Mus musculus
tgttcgtcagagctatgtccccatc

SEQ ID NO: 912636 - DNA, 25 bp, Mus musculus
tgttcgtcagaggtatgtccccatc

SEQ ID NO: 912637 - DNA, 25 bp, Mus musculus
tgttcgtcaggccagcattttgcat

SEQ ID NO: 912638 - DNA, 25 bp, Mus musculus
tgttcgtcaggcgagcattttgcat

SEQ ID NO: 912639 - DNA, 25 bp, Mus musculus
tgttcgtcctacacaactattcttg

SEQ ID NO: 912640 - DNA, 25 bp, Mus musculus
tgttcgtcctactcaactattcttg

SEQ ID NO: 912641 - DNA, 25 bp, Mus musculus
tgttcgtgaaccaggctacatgaat

SEQ ID NO: 912642 - DNA, 25 bp, Mus musculus
tgttcgtgaacctggctacatgaat

SEQ ID NO: 912643 - DNA, 25 bp, Mus musculus
tgttcgtgaaggatcctagccttgt

SEQ ID NO: 912644 - DNA, 25 bp, Mus musculus
tgttcgtgaaggttcctagccttgt

SEQ ID NO: 912645 - DNA, 25 bp, Mus musculus
tgttcgtgatcaattttctcttccc

SEQ ID NO: 912646 - DNA, 25 bp, Mus musculus
tgttcgtgatcatttttctcttccc

SEQ ID NO: 912647 - DNA, 25 bp, Mus musculus
tgttcgtgccatagaaacaaaatca

SEQ ID NO: 912648 - DNA, 25 bp, Mus musculus
tgttcgtgccattgaaacaaaatca

SEQ ID NO: 912649 - DNA, 25 bp, Mus musculus
tgttcgtggtcgacagtttaaccga

SEQ ID NO: 912650 - DNA, 25 bp, Mus musculus
tgttcgtggtcgtcagtttaaccga

SEQ ID NO: 912651 - DNA, 25 bp, Mus musculus
tgttcgtgtcggacttcaaagtgca

SEQ ID NO: 912652 - DNA, 25 bp, Mus musculus
tgttcgtgtcggtcttcaaagtgca

SEQ ID NO: 912653 - DNA, 25 bp, Mus musculus
tgttcgtgtctcagttccaggttct

SEQ ID NO: 912654 - DNA, 25 bp, Mus musculus
tgttcgtgtctctgttccaggttct

SEQ ID NO: 912655 - DNA, 25 bp, Mus musculus
tgttcgtgtgacctttacaccagga

SEQ ID NO: 912656 - DNA, 25 bp, Mus musculus
tgttcgtgtgacgtttacaccagga

SEQ ID NO: 912657 - DNA, 25 bp, Mus musculus
tgttcgttcagaattctccacatga

SEQ ID NO: 912658 - DNA, 25 bp, Mus musculus
tgttcgttcagatttctccacatga

SEQ ID NO: 912659 - DNA, 25 bp, Mus musculus
tgttcgttcttcagagggcattctc

SEQ ID NO: 912660 - DNA, 25 bp, Mus musculus
tgttcgttcttctgagggcattctc

SEQ ID NO: 912661 - DNA, 25 bp, Mus musculus
tgttcgttggctactgtctttaaag

SEQ ID NO: 912662 - DNA, 25 bp, Mus musculus
tgttcgttggcttctgtctttaaag

SEQ ID NO: 912663 - DNA, 25 bp, Mus musculus
tgttcgtttctcagttgatttctct

SEQ ID NO: 912664 - DNA, 25 bp, Mus musculus
tgttcgtttctctgttgatttctct

SEQ ID NO: 912665 - DNA, 25 bp, Mus musculus
tgttctaaactgaacatattcatag

SEQ ID NO: 912666 - DNA, 25 bp, Mus musculus
tgttctaaactgtacatattcatag

SEQ ID NO: 912667 - DNA, 25 bp, Mus musculus
tgttctaacctgatcagatgctccc

SEQ ID NO: 912668 - DNA, 25 bp, Mus musculus
tgttctaacctgttcagatgctccc

SEQ ID NO: 912669 - DNA, 25 bp, Mus musculus
tgttctaaccttccctatgtgtata

SEQ ID NO: 912670 - DNA, 25 bp, Mus musculus
tgttctaaccttgcctatgtgtata

SEQ ID NO: 912671 - DNA, 25 bp, Mus musculus
tgttctaagattagggtcccctgca

SEQ ID NO: 912672 - DNA, 25 bp, Mus musculus
tgttctaagatttgggtcccctgca

SEQ ID NO: 912673 - DNA, 25 bp, Mus musculus
tgttctaaggagatcagctccaact

SEQ ID NO: 912674 - DNA, 25 bp, Mus musculus
tgttctaaggagttcagctccaact

SEQ ID NO: 912675 - DNA, 25 bp, Mus musculus
tgttctaagtttatcgtggccaatg

SEQ ID NO: 912676 - DNA, 25 bp, Mus musculus
tgttctaagtttttcgtggccaatg

SEQ ID NO: 912677 - DNA, 25 bp, Mus musculus
tgttctaatcggctttcttgtcagc

SEQ ID NO: 912678 - DNA, 25 bp, Mus musculus
tgttctaatcgggtttcttgtcagc

SEQ ID NO: 912679 - DNA, 25 bp, Mus musculus
tgttctaatcttcttcaaaggtgta

SEQ ID NO: 912680 - DNA, 25 bp, Mus musculus
tgttctaatcttgttcaaaggtgta

SEQ ID NO: 912681 - DNA, 25 bp, Mus musculus
tgttctaatgtactgctgcagggca

SEQ ID NO: 912682 - DNA, 25 bp, Mus musculus
tgttctaatgtagtgctgcagggca

SEQ ID NO: 912683 - DNA, 25 bp, Mus musculus
tgttctacaaatcagtgtcctccgc

SEQ ID NO: 912684 - DNA, 25 bp, Mus musculus
tgttctacaaatgagtgtcctccgc

SEQ ID NO: 912685 - DNA, 25 bp, Mus musculus
tgttctacatcacagcaccgcctgg

SEQ ID NO: 912686 - DNA, 25 bp, Mus musculus
tgttctacatcagagcaccgcctgg

SEQ ID NO: 912687 - DNA, 25 bp, Mus musculus
tgttctacatccagattggagggct

SEQ ID NO: 912688 - DNA, 25 bp, Mus musculus
tgttctacatcctgattggagggct

SEQ ID NO: 912689 - DNA, 25 bp, Mus musculus
tgttctaccaataacctacatccct

SEQ ID NO: 912690 - DNA, 25 bp, Mus musculus
tgttctaccaattacctacatccct

SEQ ID NO: 912691 - DNA, 25 bp, Mus musculus
tgttctaccacaaaaggagctaagt

SEQ ID NO: 912692 - DNA, 25 bp, Mus musculus
tgttctaccacataaggagctaagt

SEQ ID NO: 912693 - DNA, 25 bp, Mus musculus
tgttctaccccaacaattcttgtgc

SEQ ID NO: 912694 - DNA, 25 bp, Mus musculus
tgttctaccccatcaattcttgtgc

SEQ ID NO: 912695 - DNA, 25 bp, Mus musculus
tgttctacctagatctttccagttt

SEQ ID NO: 912696 - DNA, 25 bp, Mus musculus
tgttctacctagttctttccagttt

SEQ ID NO: 912697 - DNA, 25 bp, Mus musculus
tgttctacctatcccacactttaaa

SEQ ID NO: 912698 - DNA, 25 bp, Mus musculus
tgttctacctatgccacactttaaa

SEQ ID NO: 912699 - DNA, 25 bp, Mus musculus
tgttctactgcacagatgagcatct

SEQ ID NO: 912700 - DNA, 25 bp, Mus musculus
tgttctactgcagagatgagcatct

SEQ ID NO: 912701 - DNA, 25 bp, Mus musculus
tgttctacttgaaggctagctgccc

SEQ ID NO: 912702 - DNA, 25 bp, Mus musculus
tgttctacttgatggctagctgccc

SEQ ID NO: 912703 - DNA, 25 bp, Mus musculus
tgttctagacccaccacgggctggc

SEQ ID NO: 912704 - DNA, 25 bp, Mus musculus
tgttctagaccctccacgggctggc

SEQ ID NO: 912705 - DNA, 25 bp, Mus musculus
tgttctagactcaacagcctatgag

SEQ ID NO: 912706 - DNA, 25 bp, Mus musculus
tgttctagactctacagcctatgag

SEQ ID NO: 912707 - DNA, 25 bp, Mus musculus
tgttctagatccaagtccccaataa

SEQ ID NO: 912708 - DNA, 25 bp, Mus musculus
tgttctagatcctagtccccaataa

SEQ ID NO: 912709 - DNA, 25 bp, Mus musculus
tgttctagccacatagccaatagcc

SEQ ID NO: 912710 - DNA, 25 bp, Mus musculus
tgttctagccacttagccaatagcc

SEQ ID NO: 912711 - DNA, 25 bp, Mus musculus
tgttctagccccaggaatcttgttt

SEQ ID NO: 912712 - DNA, 25 bp, Mus musculus
tgttctagcccctggaatcttgttt

SEQ ID NO: 912713 - DNA, 25 bp, Mus musculus
tgttctagtctcattttctcagggc

SEQ ID NO: 912714 - DNA, 25 bp, Mus musculus
tgttctagtctctttttctcagggc

SEQ ID NO: 912715 - DNA, 25 bp, Mus musculus
tgttctagtctgaagctatgctctg

SEQ ID NO: 912716 - DNA, 25 bp, Mus musculus
tgttctagtctgtagctatgctctg

SEQ ID NO: 912717 - DNA, 25 bp, Mus musculus
tgttctagtgaacctgctacagcaa

SEQ ID NO: 912718 - DNA, 25 bp, Mus musculus
tgttctagtgaagctgctacagcaa

SEQ ID NO: 912719 - DNA, 25 bp, Mus musculus
tgttctagtgtaaagttcagcccga

SEQ ID NO: 912720 - DNA, 25 bp, Mus musculus
tgttctagtgtatagttcagcccga

SEQ ID NO: 912721 - DNA, 25 bp, Mus musculus
tgttctagttctacagatagccctg

SEQ ID NO: 912722 - DNA, 25 bp, Mus musculus
tgttctagttcttcagatagccctg

SEQ ID NO: 912723 - DNA, 25 bp, Mus musculus
tgttctagttgcagttagcatcccc

SEQ ID NO: 912724 - DNA, 25 bp, Mus musculus
tgttctagttgctgttagcatcccc

SEQ ID NO: 912725 - DNA, 25 bp, Mus musculus
tgttctatgctcaaccattctactg

SEQ ID NO: 912726 - DNA, 25 bp, Mus musculus
tgttctatgctctaccattctactg

SEQ ID NO: 912727 - DNA, 25 bp, Mus musculus
tgttctatgctgattgcttggtttg

SEQ ID NO: 912728 - DNA, 25 bp, Mus musculus
tgttctatgctgtttgcttggtttg

SEQ ID NO: 912729 - DNA, 25 bp, Mus musculus
tgttctatgttcatgcctttccctt

SEQ ID NO: 912730 - DNA, 25 bp, Mus musculus
tgttctatgttcttgcctttccctt

SEQ ID NO: 912731 - DNA, 25 bp, Mus musculus
tgttctattgcgatcaaccctcttt

SEQ ID NO: 912732 - DNA, 25 bp, Mus musculus
tgttctattgcgttcaaccctcttt

SEQ ID NO: 912733 - DNA, 25 bp, Mus musculus
tgttctattgtcatgagagcacaga

SEQ ID NO: 912734 - DNA, 25 bp, Mus musculus
tgttctattgtcttgagagcacaga

SEQ ID NO: 912735 - DNA, 25 bp, Mus musculus
tgttctatttagaacctcctgggtt

SEQ ID NO: 912736 - DNA, 25 bp, Mus musculus
tgttctatttagtacctcctgggtt

SEQ ID NO: 912737 - DNA, 25 bp, Mus musculus
tgttctcaaacaacaggtagacact

SEQ ID NO: 912738 - DNA, 25 bp, Mus musculus
tgttctcaaacatcaggtagacact

SEQ ID NO: 912739 - DNA, 25 bp, Mus musculus
tgttctcaaaccacacctagagcat

SEQ ID NO: 912740 - DNA, 25 bp, Mus musculus
tgttctcaaacccacaacatgcaca

SEQ ID NO: 912741 - DNA, 25 bp, Mus musculus
tgttctcaaaccgacaacatgcaca

SEQ ID NO: 912742 - DNA, 25 bp, Mus musculus
tgttctcaaacctcacctagagcat

SEQ ID NO: 912743 - DNA, 25 bp, Mus musculus
tgttctcaaactctctcactattat

SEQ ID NO: 912744 - DNA, 25 bp, Mus musculus
tgttctcaaactgtctcactattat

SEQ ID NO: 912745 - DNA, 25 bp, Mus musculus
tgttctcaaagtctagccccttact

SEQ ID NO: 912746 - DNA, 25 bp, Mus musculus
tgttctcaaagtgtagccccttact

SEQ ID NO: 912747 - DNA, 25 bp, Mus musculus
tgttctcaacagaacccatctattt

SEQ ID NO: 912748 - DNA, 25 bp, Mus musculus
tgttctcaacagtacccatctattt

SEQ ID NO: 912749 - DNA, 25 bp, Mus musculus
tgttctcaaggcaaatcactacgga

SEQ ID NO: 912750 - DNA, 25 bp, Mus musculus
tgttctcaaggctaatcactacgga

SEQ ID NO: 912751 - DNA, 25 bp, Mus musculus
tgttctcacagaacgacacgcgctg

SEQ ID NO: 912752 - DNA, 25 bp, Mus musculus
tgttctcacagatcgacacgcgctg

SEQ ID NO: 912753 - DNA, 25 bp, Mus musculus
tgttctcaccaacttcaccattagc

SEQ ID NO: 912754 - DNA, 25 bp, Mus musculus
tgttctcaccaagttcaccattagc

SEQ ID NO: 912755 - DNA, 25 bp, Mus musculus
tgttctcaccatctgtagtggttga

SEQ ID NO: 912756 - DNA, 25 bp, Mus musculus
tgttctcaccatgtgtagtggttga

SEQ ID NO: 912757 - DNA, 25 bp, Mus musculus
tgttctcaccggactctaaccagtg

SEQ ID NO: 912758 - DNA, 25 bp, Mus musculus
tgttctcaccggtctctaaccagtg

SEQ ID NO: 912759 - DNA, 25 bp, Mus musculus
tgttctcacgttagcaaggatccgt

SEQ ID NO: 912760 - DNA, 25 bp, Mus musculus
tgttctcacgtttgcaaggatccgt

SEQ ID NO: 912761 - DNA, 25 bp, Mus musculus
tgttctcagagtctcaacacaggaa

SEQ ID NO: 912762 - DNA, 25 bp, Mus musculus
tgttctcagagtgtcaacacaggaa

SEQ ID NO: 912763 - DNA, 25 bp, Mus musculus
tgttctcagcaaaacattctcccgt

SEQ ID NO: 912764 - DNA, 25 bp, Mus musculus
tgttctcagcaatacattctcccgt

SEQ ID NO: 912765 - DNA, 25 bp, Mus musculus
tgttctcaggatagccagcttgtca

SEQ ID NO: 912766 - DNA, 25 bp, Mus musculus
tgttctcaggattgccagcttgtca

SEQ ID NO: 912767 - DNA, 25 bp, Mus musculus
tgttctcagggactttgcctcagtt

SEQ ID NO: 912768 - DNA, 25 bp, Mus musculus
tgttctcagggagtttgcctcagtt

SEQ ID NO: 912769 - DNA, 25 bp, Mus musculus
tgttctcatagaaacactgtcctct

SEQ ID NO: 912770 - DNA, 25 bp, Mus musculus
tgttctcatagatacactgtcctct

SEQ ID NO: 912771 - DNA, 25 bp, Mus musculus
tgttctcatgttctcatgccactgc

SEQ ID NO: 912772 - DNA, 25 bp, Mus musculus
tgttctcatgttgtcatgccactgc

SEQ ID NO: 912773 - DNA, 25 bp, Mus musculus
tgttctcattacaccattctggcaa

SEQ ID NO: 912774 - DNA, 25 bp, Mus musculus
tgttctcattactccattctggcaa

SEQ ID NO: 912775 - DNA, 25 bp, Mus musculus
tgttctccacagcactattgtgaga

SEQ ID NO: 912776 - DNA, 25 bp, Mus musculus
tgttctccacaggactattgtgaga

SEQ ID NO: 912777 - DNA, 25 bp, Mus musculus
tgttctccatctcctatctgtataa

SEQ ID NO: 912778 - DNA, 25 bp, Mus musculus
tgttctccatctgctatctgtataa

SEQ ID NO: 912779 - DNA, 25 bp, Mus musculus
tgttctccatgtcctgcgtgtatat

SEQ ID NO: 912780 - DNA, 25 bp, Mus musculus
tgttctccatgtctgtatctctcca

SEQ ID NO: 912781 - DNA, 25 bp, Mus musculus
tgttctccatgtgctgcgtgtatat

SEQ ID NO: 912782 - DNA, 25 bp, Mus musculus
tgttctccatgtgtgtatctctcca

SEQ ID NO: 912783 - DNA, 25 bp, Mus musculus
tgttctcccaccaaactagtattta

SEQ ID NO: 912784 - DNA, 25 bp, Mus musculus
tgttctcccacctaactagtattta

SEQ ID NO: 912785 - DNA, 25 bp, Mus musculus
tgttctcccagcacatgagagactg

SEQ ID NO: 912786 - DNA, 25 bp, Mus musculus
tgttctcccagctcatgagagactg

SEQ ID NO: 912787 - DNA, 25 bp, Mus musculus
tgttctcccggaagcgagctctggt

SEQ ID NO: 912788 - DNA, 25 bp, Mus musculus
tgttctcccggatgcgagctctggt

SEQ ID NO: 912789 - DNA, 25 bp, Mus musculus
tgttctcccgttatctctgtgagtt

SEQ ID NO: 912790 - DNA, 25 bp, Mus musculus
tgttctcccgttttctctgtgagtt

SEQ ID NO: 912791 - DNA, 25 bp, Mus musculus
tgttctccctagagtttcaagtgta

SEQ ID NO: 912792 - DNA, 25 bp, Mus musculus
tgttctccctagtgtttcaagtgta

SEQ ID NO: 912793 - DNA, 25 bp, Mus musculus
tgttctcctagcctgttgatcaaag

SEQ ID NO: 912794 - DNA, 25 bp, Mus musculus
tgttctcctagcgtgttgatcaaag

SEQ ID NO: 912795 - DNA, 25 bp, Mus musculus
tgttctcctcaaccacaagcagtaa

SEQ ID NO: 912796 - DNA, 25 bp, Mus musculus
tgttctcctcaagcacaagcagtaa

SEQ ID NO: 912797 - DNA, 25 bp, Mus musculus
tgttctcctctcagcagattggtta

SEQ ID NO: 912798 - DNA, 25 bp, Mus musculus
tgttctcctctctgcagattggtta

SEQ ID NO: 912799 - DNA, 25 bp, Mus musculus
tgttctcctctgacaagttacgctt

SEQ ID NO: 912800 - DNA, 25 bp, Mus musculus
tgttctcctctgctgttctgatatc

SEQ ID NO: 912801 - DNA, 25 bp, Mus musculus
tgttctcctctggtgttctgatatc

SEQ ID NO: 912802 - DNA, 25 bp, Mus musculus
tgttctcctctgtcaagttacgctt

SEQ ID NO: 912803 - DNA, 25 bp, Mus musculus
tgttctcctgagactcatccaagag

SEQ ID NO: 912804 - DNA, 25 bp, Mus musculus
tgttctcctgagtctcatccaagag

SEQ ID NO: 912805 - DNA, 25 bp, Mus musculus
tgttctcctgataggtcatctgtaa

SEQ ID NO: 912806 - DNA, 25 bp, Mus musculus
tgttctcctgattggtcatctgtaa

SEQ ID NO: 912807 - DNA, 25 bp, Mus musculus
tgttctcctgcaccagtatttgagg

SEQ ID NO: 912808 - DNA, 25 bp, Mus musculus
tgttctcctgcagcagtatttgagg

SEQ ID NO: 912809 - DNA, 25 bp, Mus musculus
tgttctcctggacagtccttctctt

SEQ ID NO: 912810 - DNA, 25 bp, Mus musculus
tgttctcctggagagtccttctctt

SEQ ID NO: 912811 - DNA, 25 bp, Mus musculus
tgttctccttaaacctatagacatt

SEQ ID NO: 912812 - DNA, 25 bp, Mus musculus
tgttctccttaatcctatagacatt

SEQ ID NO: 912813 - DNA, 25 bp, Mus musculus
tgttctccttttcgaccttggtcaa

SEQ ID NO: 912814 - DNA, 25 bp, Mus musculus
tgttctccttttggaccttggtcaa

SEQ ID NO: 912815 - DNA, 25 bp, Mus musculus
tgttctcgaagcctggccacccagg

SEQ ID NO: 912816 - DNA, 25 bp, Mus musculus
tgttctcgaagcgtggccacccagg

SEQ ID NO: 912817 - DNA, 25 bp, Mus musculus
tgttctcgctgaaatgcacacatct

SEQ ID NO: 912818 - DNA, 25 bp, Mus musculus
tgttctcgctgatatgcacacatct

SEQ ID NO: 912819 - DNA, 25 bp, Mus musculus
tgttctcggcctcctgggaatgagt

SEQ ID NO: 912820 - DNA, 25 bp, Mus musculus
tgttctcggcctgctgggaatgagt

SEQ ID NO: 912821 - DNA, 25 bp, Mus musculus
tgttctctaactacccagtgattct

SEQ ID NO: 912822 - DNA, 25 bp, Mus musculus
tgttctctaacttcccagtgattct

SEQ ID NO: 912823 - DNA, 25 bp, Mus musculus
tgttctctaatgacaccaagcgcct

SEQ ID NO: 912824 - DNA, 25 bp, Mus musculus
tgttctctaatgtcaccaagcgcct

SEQ ID NO: 912825 - DNA, 25 bp, Mus musculus
tgttctctaccacatttgtcaactg

SEQ ID NO: 912826 - DNA, 25 bp, Mus musculus
tgttctctaccacttggtgcactga

SEQ ID NO: 912827 - DNA, 25 bp, Mus musculus
tgttctctaccagatttgtcaactg

SEQ ID NO: 912828 - DNA, 25 bp, Mus musculus
tgttctctaccagttggtgcactga

SEQ ID NO: 912829 - DNA, 25 bp, Mus musculus
tgttctctagctctctttctagaac

SEQ ID NO: 912830 - DNA, 25 bp, Mus musculus
tgttctctagctgtctttctagaac

SEQ ID NO: 912831 - DNA, 25 bp, Mus musculus
tgttctctatcaccctttatttgat

SEQ ID NO: 912832 - DNA, 25 bp, Mus musculus
tgttctctatcagcctttatttgat

SEQ ID NO: 912833 - DNA, 25 bp, Mus musculus
tgttctctattgctgttgttgcaga

SEQ ID NO: 912834 - DNA, 25 bp, Mus musculus
tgttctctattggtgttgttgcaga

SEQ ID NO: 912835 - DNA, 25 bp, Mus musculus
tgttctctcgctattgatgctgaaa

SEQ ID NO: 912836 - DNA, 25 bp, Mus musculus
tgttctctcgcttttgatgctgaaa

SEQ ID NO: 912837 - DNA, 25 bp, Mus musculus
tgttctctctctcaagcctgtcttt

SEQ ID NO: 912838 - DNA, 25 bp, Mus musculus
tgttctctctctgaagcctgtcttt

SEQ ID NO: 912839 - DNA, 25 bp, Mus musculus
tgttctctctttaccaaagacttga

SEQ ID NO: 912840 - DNA, 25 bp, Mus musculus
tgttctctcttttccaaagacttga

SEQ ID NO: 912841 - DNA, 25 bp, Mus musculus
tgttctctgcacaggagctacctgc

SEQ ID NO: 912842 - DNA, 25 bp, Mus musculus
tgttctctgcactggagctacctgc

SEQ ID NO: 912843 - DNA, 25 bp, Mus musculus
tgttctctgcctcaatgcagcagat

SEQ ID NO: 912844 - DNA, 25 bp, Mus musculus
tgttctctgcctgaatgcagcagat

SEQ ID NO: 912845 - DNA, 25 bp, Mus musculus
tgttctctgctcagatctgatggta

SEQ ID NO: 912846 - DNA, 25 bp, Mus musculus
tgttctctgctctgatctgatggta

SEQ ID NO: 912847 - DNA, 25 bp, Mus musculus
tgttctctgggcattgtttggctac

SEQ ID NO: 912848 - DNA, 25 bp, Mus musculus
tgttctctgggctttgtttggctac

SEQ ID NO: 912849 - DNA, 25 bp, Mus musculus
tgttctctgggtaccttatggtggt

SEQ ID NO: 912850 - DNA, 25 bp, Mus musculus
tgttctctgggttccttatggtggt

SEQ ID NO: 912851 - DNA, 25 bp, Mus musculus
tgttctctggtcaatccacagactc

SEQ ID NO: 912852 - DNA, 25 bp, Mus musculus
tgttctctggtctatccacagactc

SEQ ID NO: 912853 - DNA, 25 bp, Mus musculus
tgttctctgtggaggttttggattt

SEQ ID NO: 912854 - DNA, 25 bp, Mus musculus
tgttctctgtggtggttttggattt

SEQ ID NO: 912855 - DNA, 25 bp, Mus musculus
tgttctcttaatcttaccagttggg

SEQ ID NO: 912856 - DNA, 25 bp, Mus musculus
tgttctcttaatgttaccagttggg

SEQ ID NO: 912857 - DNA, 25 bp, Mus musculus
tgttctcttaccagggctttatgaa

SEQ ID NO: 912858 - DNA, 25 bp, Mus musculus
tgttctcttacctgggctttatgaa

SEQ ID NO: 912859 - DNA, 25 bp, Mus musculus
tgttctcttctaatatttaccatga

SEQ ID NO: 912860 - DNA, 25 bp, Mus musculus
tgttctcttctattatttaccatga

SEQ ID NO: 912861 - DNA, 25 bp, Mus musculus
tgttctcttcttaatcatacatcaa

SEQ ID NO: 912862 - DNA, 25 bp, Mus musculus
tgttctcttctttatcatacatcaa

SEQ ID NO: 912863 - DNA, 25 bp, Mus musculus
tgttctcttgctcggccgagaggca

SEQ ID NO: 912864 - DNA, 25 bp, Mus musculus
tgttctcttgctgggccgagaggca

SEQ ID NO: 912865 - DNA, 25 bp, Mus musculus
tgttctcttgttcaggtacctggag

SEQ ID NO: 912866 - DNA, 25 bp, Mus musculus
tgttctcttgttgaggtacctggag

SEQ ID NO: 912867 - DNA, 25 bp, Mus musculus
tgttctctttcaatccatatgcatg

SEQ ID NO: 912868 - DNA, 25 bp, Mus musculus
tgttctctttcattccatatgcatg

SEQ ID NO: 912869 - DNA, 25 bp, Mus musculus
tgttctcttttaacaatgctcgggt

SEQ ID NO: 912870 - DNA, 25 bp, Mus musculus
tgttctcttttatcaatgctcgggt

SEQ ID NO: 912871 - DNA, 25 bp, Mus musculus
tgttctcttttcatggctagaattg

SEQ ID NO: 912872 - DNA, 25 bp, Mus musculus
tgttctcttttcttggctagaattg

SEQ ID NO: 912873 - DNA, 25 bp, Mus musculus
tgttctgaacagaccctcaatcctt

SEQ ID NO: 912874 - DNA, 25 bp, Mus musculus
tgttctgaacagataaccgccgccc

SEQ ID NO: 912875 - DNA, 25 bp, Mus musculus
tgttctgaacagtccctcaatcctt

SEQ ID NO: 912876 - DNA, 25 bp, Mus musculus
tgttctgaacagttaaccgccgccc

SEQ ID NO: 912877 - DNA, 25 bp, Mus musculus
tgttctgaactgattgcgcttctga

SEQ ID NO: 912878 - DNA, 25 bp, Mus musculus
tgttctgaactgtttgcgcttctga

SEQ ID NO: 912879 - DNA, 25 bp, Mus musculus
tgttctgaagtgatccctgagtact

SEQ ID NO: 912880 - DNA, 25 bp, Mus musculus
tgttctgaagtgttccctgagtact

SEQ ID NO: 912881 - DNA, 25 bp, Mus musculus
tgttctgaatacatccacatcttat

SEQ ID NO: 912882 - DNA, 25 bp, Mus musculus
tgttctgaatacttccacatcttat

SEQ ID NO: 912883 - DNA, 25 bp, Mus musculus
tgttctgacattaatcacaaaaata

SEQ ID NO: 912884 - DNA, 25 bp, Mus musculus
tgttctgacatttatcacaaaaata

SEQ ID NO: 912885 - DNA, 25 bp, Mus musculus
tgttctgacctacaggagatcccag

SEQ ID NO: 912886 - DNA, 25 bp, Mus musculus
tgttctgacctagaggagatcccag

SEQ ID NO: 912887 - DNA, 25 bp, Mus musculus
tgttctgactctcggaatacccagg

SEQ ID NO: 912888 - DNA, 25 bp, Mus musculus
tgttctgactctgggaatacccagg

SEQ ID NO: 912889 - DNA, 25 bp, Mus musculus
tgttctgagacacgccttacactgc

SEQ ID NO: 912890 - DNA, 25 bp, Mus musculus
tgttctgagacaggccttacactgc

SEQ ID NO: 912891 - DNA, 25 bp, Mus musculus
tgttctgagctgagagattccactg

SEQ ID NO: 912892 - DNA, 25 bp, Mus musculus
tgttctgagctgtgagattccactg

SEQ ID NO: 912893 - DNA, 25 bp, Mus musculus
tgttctgaggcgatccactgctggt

SEQ ID NO: 912894 - DNA, 25 bp, Mus musculus
tgttctgaggcgttccactgctggt

SEQ ID NO: 912895 - DNA, 25 bp, Mus musculus
tgttctgataaacctagaggcccaa

SEQ ID NO: 912896 - DNA, 25 bp, Mus musculus
tgttctgataaagctagaggcccaa

SEQ ID NO: 912897 - DNA, 25 bp, Mus musculus
tgttctgatataaggactctgttac

SEQ ID NO: 912898 - DNA, 25 bp, Mus musculus
tgttctgatatatggactctgttac

SEQ ID NO: 912899 - DNA, 25 bp, Mus musculus
tgttctgatcagattctgcatggtt

SEQ ID NO: 912900 - DNA, 25 bp, Mus musculus
tgttctgatcagtttctgcatggtt

SEQ ID NO: 912901 - DNA, 25 bp, Mus musculus
tgttctgatgatcatgtatacctga

SEQ ID NO: 912902 - DNA, 25 bp, Mus musculus
tgttctgatgatgatgtatacctga

SEQ ID NO: 912903 - DNA, 25 bp, Mus musculus
tgttctgcaaaaactatcgctggat

SEQ ID NO: 912904 - DNA, 25 bp, Mus musculus
tgttctgcaaaatctatcgctggat

SEQ ID NO: 912905 - DNA, 25 bp, Mus musculus
tgttctgcacttaacctggagggaa

SEQ ID NO: 912906 - DNA, 25 bp, Mus musculus
tgttctgcacttcgctttttctgag

SEQ ID NO: 912907 - DNA, 25 bp, Mus musculus
tgttctgcacttggctttttctgag

SEQ ID NO: 912908 - DNA, 25 bp, Mus musculus
tgttctgcactttacctggagggaa

SEQ ID NO: 912909 - DNA, 25 bp, Mus musculus
tgttctgcagacacgtgacttctgt

SEQ ID NO: 912910 - DNA, 25 bp, Mus musculus
tgttctgcagactcgtgacttctgt

SEQ ID NO: 912911 - DNA, 25 bp, Mus musculus
tgttctgcagctctgtctgagactg

SEQ ID NO: 912912 - DNA, 25 bp, Mus musculus
tgttctgcagctgtgtctgagactg

SEQ ID NO: 912913 - DNA, 25 bp, Mus musculus
tgttctgcatgtcgcctgatgtctg

SEQ ID NO: 912914 - DNA, 25 bp, Mus musculus
tgttctgcatgtggcctgatgtctg

SEQ ID NO: 912915 - DNA, 25 bp, Mus musculus
tgttctgcccaaccttctacaaaga

SEQ ID NO: 912916 - DNA, 25 bp, Mus musculus
tgttctgcccaagcttctacaaaga

SEQ ID NO: 912917 - DNA, 25 bp, Mus musculus
tgttctgccctcagatttgctgaaa

SEQ ID NO: 912918 - DNA, 25 bp, Mus musculus
tgttctgccctctgatttgctgaaa

SEQ ID NO: 912919 - DNA, 25 bp, Mus musculus
tgttctgcctcccacaatgtagaga

SEQ ID NO: 912920 - DNA, 25 bp, Mus musculus
tgttctgcctccgacaatgtagaga

SEQ ID NO: 912921 - DNA, 25 bp, Mus musculus
tgttctgcctggcaaacgggacctg

SEQ ID NO: 912922 - DNA, 25 bp, Mus musculus
tgttctgcctgggaaacgggacctg

SEQ ID NO: 912923 - DNA, 25 bp, Mus musculus
tgttctgcgaggcacttccgctgtt

SEQ ID NO: 912924 - DNA, 25 bp, Mus musculus
tgttctgcgagggacttccgctgtt

SEQ ID NO: 912925 - DNA, 25 bp, Mus musculus
tgttctgcgcccagctccagtgttt

SEQ ID NO: 912926 - DNA, 25 bp, Mus musculus
tgttctgcgccctgctccagtgttt

SEQ ID NO: 912927 - DNA, 25 bp, Mus musculus
tgttctgcgggcaatcgacacattc

SEQ ID NO: 912928 - DNA, 25 bp, Mus musculus
tgttctgcgggctatcgacacattc

SEQ ID NO: 912929 - DNA, 25 bp, Mus musculus
tgttctgctatgacaggatcctgca

SEQ ID NO: 912930 - DNA, 25 bp, Mus musculus
tgttctgctatgtcaggatcctgca

SEQ ID NO: 912931 - DNA, 25 bp, Mus musculus
tgttctgctcaaatgcgatggccaa

SEQ ID NO: 912932 - DNA, 25 bp, Mus musculus
tgttctgctcaattgcgatggccaa

SEQ ID NO: 912933 - DNA, 25 bp, Mus musculus
tgttctgctcatcgtctgaggctat

SEQ ID NO: 912934 - DNA, 25 bp, Mus musculus
tgttctgctcatggtctgaggctat

SEQ ID NO: 912935 - DNA, 25 bp, Mus musculus
tgttctgctgcacttttccttaaag

SEQ ID NO: 912936 - DNA, 25 bp, Mus musculus
tgttctgctgcagttttccttaaag

SEQ ID NO: 912937 - DNA, 25 bp, Mus musculus
tgttctgctgctactatgggcacaa

SEQ ID NO: 912938 - DNA, 25 bp, Mus musculus
tgttctgctgcttctatgggcacaa

SEQ ID NO: 912939 - DNA, 25 bp, Mus musculus
tgttctgcttggatttcctacgccc

SEQ ID NO: 912940 - DNA, 25 bp, Mus musculus
tgttctgcttggttttcctacgccc

SEQ ID NO: 912941 - DNA, 25 bp, Mus musculus
tgttctggacagcagcttagacact

SEQ ID NO: 912942 - DNA, 25 bp, Mus musculus
tgttctggacaggagcttagacact

SEQ ID NO: 912943 - DNA, 25 bp, Mus musculus
tgttctggacccattagggaagtag

SEQ ID NO: 912944 - DNA, 25 bp, Mus musculus
tgttctggaccctttagggaagtag

SEQ ID NO: 912945 - DNA, 25 bp, Mus musculus
tgttctggaccgagcctattcggaa

SEQ ID NO: 912946 - DNA, 25 bp, Mus musculus
tgttctggaccgtgcctattcggaa

SEQ ID NO: 912947 - DNA, 25 bp, Mus musculus
tgttctggagttagcctcaccctaa

SEQ ID NO: 912948 - DNA, 25 bp, Mus musculus
tgttctggagtttgcctcaccctaa

SEQ ID NO: 912949 - DNA, 25 bp, Mus musculus
tgttctggatacacaggaagctgtc

SEQ ID NO: 912950 - DNA, 25 bp, Mus musculus
tgttctggatactcaggaagctgtc

SEQ ID NO: 912951 - DNA, 25 bp, Mus musculus
tgttctggattgacacacagcccac

SEQ ID NO: 912952 - DNA, 25 bp, Mus musculus
tgttctggattgtcacacagcccac

SEQ ID NO: 912953 - DNA, 25 bp, Mus musculus
tgttctggcaccatcctggtagagg

SEQ ID NO: 912954 - DNA, 25 bp, Mus musculus
tgttctggcaccttcctggtagagg

SEQ ID NO: 912955 - DNA, 25 bp, Mus musculus
tgttctggcgtgaacaggcactata

SEQ ID NO: 912956 - DNA, 25 bp, Mus musculus
tgttctggcgtgtacaggcactata

SEQ ID NO: 912957 - DNA, 25 bp, Mus musculus
tgttctgggaccactgtgcaataag

SEQ ID NO: 912958 - DNA, 25 bp, Mus musculus
tgttctgggacctctgtgcaataag

SEQ ID NO: 912959 - DNA, 25 bp, Mus musculus
tgttctgggcatcctgattggccct

SEQ ID NO: 912960 - DNA, 25 bp, Mus musculus
tgttctgggcatgctgattggccct

SEQ ID NO: 912961 - DNA, 25 bp, Mus musculus
tgttctggtactatgaaatcctcat

SEQ ID NO: 912962 - DNA, 25 bp, Mus musculus
tgttctggtactttgaaatcctcat

SEQ ID NO: 912963 - DNA, 25 bp, Mus musculus
tgttctggtaggaacggctccttac

SEQ ID NO: 912964 - DNA, 25 bp, Mus musculus
tgttctggtaggtacggctccttac

SEQ ID NO: 912965 - DNA, 25 bp, Mus musculus
tgttctggtcctatttggtcgagga

SEQ ID NO: 912966 - DNA, 25 bp, Mus musculus
tgttctggtcctttttggtcgagga

SEQ ID NO: 912967 - DNA, 25 bp, Mus musculus
tgttctggtcttcatcttcgtgctg

SEQ ID NO: 912968 - DNA, 25 bp, Mus musculus
tgttctggtcttgatcttcgtgctg

SEQ ID NO: 912969 - DNA, 25 bp, Mus musculus
tgttctggtggcatcatagtgttca

SEQ ID NO: 912970 - DNA, 25 bp, Mus musculus
tgttctggtggcttcatagtgttca

SEQ ID NO: 912971 - DNA, 25 bp, Mus musculus
tgttctgtaagtcaggctggcccta

SEQ ID NO: 912972 - DNA, 25 bp, Mus musculus
tgttctgtaagtgaggctggcccta

SEQ ID NO: 912973 - DNA, 25 bp, Mus musculus
tgttctgtacagatgttcagtttgt

SEQ ID NO: 912974 - DNA, 25 bp, Mus musculus
tgttctgtacagttgttcagtttgt

SEQ ID NO: 912975 - DNA, 25 bp, Mus musculus
tgttctgtatctagttctttgtatg

SEQ ID NO: 912976 - DNA, 25 bp, Mus musculus
tgttctgtatcttgttctttgtatg

SEQ ID NO: 912977 - DNA, 25 bp, Mus musculus
tgttctgtcagcagaggccgttgaa

SEQ ID NO: 912978 - DNA, 25 bp, Mus musculus
tgttctgtcagcctcaactactaaa

SEQ ID NO: 912979 - DNA, 25 bp, Mus musculus
tgttctgtcagcgtcaactactaaa

SEQ ID NO: 912980 - DNA, 25 bp, Mus musculus
tgttctgtcagctgaggccgttgaa

SEQ ID NO: 912981 - DNA, 25 bp, Mus musculus
tgttctgtcataacatgtaattgga

SEQ ID NO: 912982 - DNA, 25 bp, Mus musculus
tgttctgtcatatcatgtaattgga

SEQ ID NO: 912983 - DNA, 25 bp, Mus musculus
tgttctgtcctgctcggaagtcccg

SEQ ID NO: 912984 - DNA, 25 bp, Mus musculus
tgttctgtcctggtcggaagtcccg

SEQ ID NO: 912985 - DNA, 25 bp, Mus musculus
tgttctgtccttccatcatttttag

SEQ ID NO: 912986 - DNA, 25 bp, Mus musculus
tgttctgtccttgcatcatttttag

SEQ ID NO: 912987 - DNA, 25 bp, Mus musculus
tgttctgtgactctactttccagga

SEQ ID NO: 912988 - DNA, 25 bp, Mus musculus
tgttctgtgactgtactttccagga

SEQ ID NO: 912989 - DNA, 25 bp, Mus musculus
tgttctgtgaggcacttccgctgtt

SEQ ID NO: 912990 - DNA, 25 bp, Mus musculus
tgttctgtgagggacttccgctgtt

SEQ ID NO: 912991 - DNA, 25 bp, Mus musculus
tgttctgtgcaactgcgagcaatgt

SEQ ID NO: 912992 - DNA, 25 bp, Mus musculus
tgttctgtgcaagtgcgagcaatgt

SEQ ID NO: 912993 - DNA, 25 bp, Mus musculus
tgttctgtgcatatttagcaacttc

SEQ ID NO: 912994 - DNA, 25 bp, Mus musculus
tgttctgtgcatttttagcaacttc

SEQ ID NO: 912995 - DNA, 25 bp, Mus musculus
tgttctgtggcacgtgaaaacacac

SEQ ID NO: 912996 - DNA, 25 bp, Mus musculus
tgttctgtggcaggtgaaaacacac

SEQ ID NO: 912997 - DNA, 25 bp, Mus musculus
tgttctgtgtctactgtgtgcagct

SEQ ID NO: 912998 - DNA, 25 bp, Mus musculus
tgttctgtgtcttctgtgtgcagct

SEQ ID NO: 912999 - DNA, 25 bp, Mus musculus
tgttctgtgttcatcgctattgccg

SEQ ID NO: 913000 - DNA, 25 bp, Mus musculus
tgttctgtgttcttcgctattgccg

SEQ ID NO: 913001 - DNA, 25 bp, Mus musculus
tgttctgttacacccagttagcaaa

SEQ ID NO: 913002 - DNA, 25 bp, Mus musculus
tgttctgttacagccagttagcaaa

SEQ ID NO: 913003 - DNA, 25 bp, Mus musculus
tgttctgttcccagactgttaatag

SEQ ID NO: 913004 - DNA, 25 bp, Mus musculus
tgttctgttccctgactgttaatag

SEQ ID NO: 913005 - DNA, 25 bp, Mus musculus
tgttctgttctaaaggtcatttctc

SEQ ID NO: 913006 - DNA, 25 bp, Mus musculus
tgttctgttctataggtcatttctc

SEQ ID NO: 913007 - DNA, 25 bp, Mus musculus
tgttctgttggacctctgtgtataa

SEQ ID NO: 913008 - DNA, 25 bp, Mus musculus
tgttctgttggagctctgtgtataa

SEQ ID NO: 913009 - DNA, 25 bp, Mus musculus
tgttctgttgtgatcaaccctcttt

SEQ ID NO: 913010 - DNA, 25 bp, Mus musculus
tgttctgttgtgatccactgaacac

SEQ ID NO: 913011 - DNA, 25 bp, Mus musculus
tgttctgttgtgttcaaccctcttt

SEQ ID NO: 913012 - DNA, 25 bp, Mus musculus
tgttctgttgtgttccactgaacac

SEQ ID NO: 913013 - DNA, 25 bp, Mus musculus
tgttctgtttacagtatccacaagt

SEQ ID NO: 913014 - DNA, 25 bp, Mus musculus
tgttctgtttactgtatccacaagt

SEQ ID NO: 913015 - DNA, 25 bp, Mus musculus
tgttctgtttagaccacactggaca

SEQ ID NO: 913016 - DNA, 25 bp, Mus musculus
tgttctgtttagtccacactggaca

SEQ ID NO: 913017 - DNA, 25 bp, Mus musculus
tgttctgtttatcccaaagtaggct

SEQ ID NO: 913018 - DNA, 25 bp, Mus musculus
tgttctgtttatgccaaagtaggct

SEQ ID NO: 913019 - DNA, 25 bp, Mus musculus
tgttctgtttgcaagcgaggaccaa

SEQ ID NO: 913020 - DNA, 25 bp, Mus musculus
tgttctgtttgcacccattttgtag

SEQ ID NO: 913021 - DNA, 25 bp, Mus musculus
tgttctgtttgctagcgaggaccaa

SEQ ID NO: 913022 - DNA, 25 bp, Mus musculus
tgttctgtttgctcccattttgtag

SEQ ID NO: 913023 - DNA, 25 bp, Mus musculus
tgttctgtttggacaacatggtcaa

SEQ ID NO: 913024 - DNA, 25 bp, Mus musculus
tgttctgtttggtcaacatggtcaa

SEQ ID NO: 913025 - DNA, 25 bp, Mus musculus
tgttcttaaaaaactgcccagttcg

SEQ ID NO: 913026 - DNA, 25 bp, Mus musculus
tgttcttaaaaatctgcccagttcg

SEQ ID NO: 913027 - DNA, 25 bp, Mus musculus
tgttcttaaaacagccctaaccctg

SEQ ID NO: 913028 - DNA, 25 bp, Mus musculus
tgttcttaaaactgccctaaccctg

SEQ ID NO: 913029 - DNA, 25 bp, Mus musculus
tgttcttaaaccagcccttttgttg

SEQ ID NO: 913030 - DNA, 25 bp, Mus musculus
tgttcttaaacctgcccttttgttg

SEQ ID NO: 913031 - DNA, 25 bp, Mus musculus
tgttcttacatcactgacccagtga

SEQ ID NO: 913032 - DNA, 25 bp, Mus musculus
tgttcttacatctctgacccagtga

SEQ ID NO: 913033 - DNA, 25 bp, Mus musculus
tgttcttacctaccttctttgagtc

SEQ ID NO: 913034 - DNA, 25 bp, Mus musculus
tgttcttacctagcttctttgagtc

SEQ ID NO: 913035 - DNA, 25 bp, Mus musculus
tgttcttacgtcagagcctgggctg

SEQ ID NO: 913036 - DNA, 25 bp, Mus musculus
tgttcttacgtctgagcctgggctg

SEQ ID NO: 913037 - DNA, 25 bp, Mus musculus
tgttcttagacacttcttcacagcc

SEQ ID NO: 913038 - DNA, 25 bp, Mus musculus
tgttcttagacagttcttcacagcc

SEQ ID NO: 913039 - DNA, 25 bp, Mus musculus
tgttcttagccccagatcagaagct

SEQ ID NO: 913040 - DNA, 25 bp, Mus musculus
tgttcttagcccgagatcagaagct

SEQ ID NO: 913041 - DNA, 25 bp, Mus musculus
tgttcttaggccactgtcagagtca

SEQ ID NO: 913042 - DNA, 25 bp, Mus musculus
tgttcttaggcctctgtcagagtca

SEQ ID NO: 913043 - DNA, 25 bp, Mus musculus
tgttcttatggaatccacctgccat

SEQ ID NO: 913044 - DNA, 25 bp, Mus musculus
tgttcttatggattccacctgccat

SEQ ID NO: 913045 - DNA, 25 bp, Mus musculus
tgttcttatttaacccgtgtacgcg

SEQ ID NO: 913046 - DNA, 25 bp, Mus musculus
tgttcttatttatcccgtgtacgcg

SEQ ID NO: 913047 - DNA, 25 bp, Mus musculus
tgttcttatttcattccacagctaa

SEQ ID NO: 913048 - DNA, 25 bp, Mus musculus
tgttcttatttctttccacagctaa

SEQ ID NO: 913049 - DNA, 25 bp, Mus musculus
tgttcttcaaccagcacctatagac

SEQ ID NO: 913050 - DNA, 25 bp, Mus musculus
tgttcttcaacctgcacctatagac

SEQ ID NO: 913051 - DNA, 25 bp, Mus musculus
tgttcttcaagaccatggtccactt

SEQ ID NO: 913052 - DNA, 25 bp, Mus musculus
tgttcttcaagagcatggtccactt

SEQ ID NO: 913053 - DNA, 25 bp, Mus musculus
tgttcttcaagccatctctaatcaa

SEQ ID NO: 913054 - DNA, 25 bp, Mus musculus
tgttcttcaagcgatctctaatcaa

SEQ ID NO: 913055 - DNA, 25 bp, Mus musculus
tgttcttcacgacttgcttggctca

SEQ ID NO: 913056 - DNA, 25 bp, Mus musculus
tgttcttcacgagttgcttggctca

SEQ ID NO: 913057 - DNA, 25 bp, Mus musculus
tgttcttcagcaatcaggtttctaa

SEQ ID NO: 913058 - DNA, 25 bp, Mus musculus
tgttcttcagcattcaggtttctaa

SEQ ID NO: 913059 - DNA, 25 bp, Mus musculus
tgttcttcatagacgggaagcttcc

SEQ ID NO: 913060 - DNA, 25 bp, Mus musculus
tgttcttcatagtcgggaagcttcc

SEQ ID NO: 913061 - DNA, 25 bp, Mus musculus
tgttcttcatccagagctgagtcgg

SEQ ID NO: 913062 - DNA, 25 bp, Mus musculus
tgttcttcatcctgagctgagtcgg

SEQ ID NO: 913063 - DNA, 25 bp, Mus musculus
tgttcttccacaactccagcaaata

SEQ ID NO: 913064 - DNA, 25 bp, Mus musculus
tgttcttccacatctccagcaaata

SEQ ID NO: 913065 - DNA, 25 bp, Mus musculus
tgttcttcccacaagcacagtcagt

SEQ ID NO: 913066 - DNA, 25 bp, Mus musculus
tgttcttcccacaagttcctggagg

SEQ ID NO: 913067 - DNA, 25 bp, Mus musculus
tgttcttcccactagcacagtcagt

SEQ ID NO: 913068 - DNA, 25 bp, Mus musculus
tgttcttcccactagttcctggagg

SEQ ID NO: 913069 - DNA, 25 bp, Mus musculus
tgttcttcccagctcacaactttaa

SEQ ID NO: 913070 - DNA, 25 bp, Mus musculus
tgttcttcccaggtcacaactttaa

SEQ ID NO: 913071 - DNA, 25 bp, Mus musculus
tgttcttcccatataccaggattgt

SEQ ID NO: 913072 - DNA, 25 bp, Mus musculus
tgttcttcccatttaccaggattgt

SEQ ID NO: 913073 - DNA, 25 bp, Mus musculus
tgttcttccccacgttgaagggcat

SEQ ID NO: 913074 - DNA, 25 bp, Mus musculus
tgttcttccccaggttgaagggcat

SEQ ID NO: 913075 - DNA, 25 bp, Mus musculus
tgttcttcctaccaggtaaccagag

SEQ ID NO: 913076 - DNA, 25 bp, Mus musculus
tgttcttcctacgaggtaaccagag

SEQ ID NO: 913077 - DNA, 25 bp, Mus musculus
tgttcttcctcacgagccattcatt

SEQ ID NO: 913078 - DNA, 25 bp, Mus musculus
tgttcttcctcaggagccattcatt

SEQ ID NO: 913079 - DNA, 25 bp, Mus musculus
tgttcttcctgaatttagttacaga

SEQ ID NO: 913080 - DNA, 25 bp, Mus musculus
tgttcttcctgattttagttacaga

SEQ ID NO: 913081 - DNA, 25 bp, Mus musculus
tgttcttcctgcagcagaccagcgg

SEQ ID NO: 913082 - DNA, 25 bp, Mus musculus
tgttcttcctgctgcagaccagcgg

SEQ ID NO: 913083 - DNA, 25 bp, Mus musculus
tgttcttccttaccacctatattat

SEQ ID NO: 913084 - DNA, 25 bp, Mus musculus
tgttcttccttagcacctatattat

SEQ ID NO: 913085 - DNA, 25 bp, Mus musculus
tgttcttccttcaaggagtatgagg

SEQ ID NO: 913086 - DNA, 25 bp, Mus musculus
tgttcttccttctaggagtatgagg

SEQ ID NO: 913087 - DNA, 25 bp, Mus musculus
tgttcttccttgactaagtgatcag

SEQ ID NO: 913088 - DNA, 25 bp, Mus musculus
tgttcttccttgtctaagtgatcag

SEQ ID NO: 913089 - DNA, 25 bp, Mus musculus
tgttcttctcagctcagaagatgcc

SEQ ID NO: 913090 - DNA, 25 bp, Mus musculus
tgttcttctcaggtcagaagatgcc

SEQ ID NO: 913091 - DNA, 25 bp, Mus musculus
tgttcttctcatacaactttaccca

SEQ ID NO: 913092 - DNA, 25 bp, Mus musculus
tgttcttctcattcaactttaccca

SEQ ID NO: 913093 - DNA, 25 bp, Mus musculus
tgttcttctcgcagttgtcctgttt

SEQ ID NO: 913094 - DNA, 25 bp, Mus musculus
tgttcttctcgctgttgtcctgttt

SEQ ID NO: 913095 - DNA, 25 bp, Mus musculus
tgttcttctctacaaggctttatga

SEQ ID NO: 913096 - DNA, 25 bp, Mus musculus
tgttcttctctagaaggctttatga

SEQ ID NO: 913097 - DNA, 25 bp, Mus musculus
tgttcttctctcagccttcgttctg

SEQ ID NO: 913098 - DNA, 25 bp, Mus musculus
tgttcttctctctgccttcgttctg

SEQ ID NO: 913099 - DNA, 25 bp, Mus musculus
tgttcttctgaccaggcgctctaac

SEQ ID NO: 913100 - DNA, 25 bp, Mus musculus
tgttcttctgacgaggcgctctaac

SEQ ID NO: 913101 - DNA, 25 bp, Mus musculus
tgttcttctgtaagttcatgccctc

SEQ ID NO: 913102 - DNA, 25 bp, Mus musculus
tgttcttctgtatgttcatgccctc

SEQ ID NO: 913103 - DNA, 25 bp, Mus musculus
tgttcttcttatagcattatgccca

SEQ ID NO: 913104 - DNA, 25 bp, Mus musculus
tgttcttcttattgcattatgccca

SEQ ID NO: 913105 - DNA, 25 bp, Mus musculus
tgttcttgcaaaccttggcagttga

SEQ ID NO: 913106 - DNA, 25 bp, Mus musculus
tgttcttgcaaagcttggcagttga

SEQ ID NO: 913107 - DNA, 25 bp, Mus musculus
tgttcttgccaccattgagctgatg

SEQ ID NO: 913108 - DNA, 25 bp, Mus musculus
tgttcttgccacgattgagctgatg

SEQ ID NO: 913109 - DNA, 25 bp, Mus musculus
tgttcttgcttgactagacctggac

SEQ ID NO: 913110 - DNA, 25 bp, Mus musculus
tgttcttgcttgtctagacctggac

SEQ ID NO: 913111 - DNA, 25 bp, Mus musculus
tgttcttggactagatacctctgcg

SEQ ID NO: 913112 - DNA, 25 bp, Mus musculus
tgttcttggacttgatacctctgcg

SEQ ID NO: 913113 - DNA, 25 bp, Mus musculus
tgttcttggagcatacgcccctgtt

SEQ ID NO: 913114 - DNA, 25 bp, Mus musculus
tgttcttggagcttacgcccctgtt

SEQ ID NO: 913115 - DNA, 25 bp, Mus musculus
tgttcttgggtgaattgcatgggct

SEQ ID NO: 913116 - DNA, 25 bp, Mus musculus
tgttcttgggtgtattgcatgggct

SEQ ID NO: 913117 - DNA, 25 bp, Mus musculus
tgttcttggttactcactacacaga

SEQ ID NO: 913118 - DNA, 25 bp, Mus musculus
tgttcttggttagtcactacacaga

SEQ ID NO: 913119 - DNA, 25 bp, Mus musculus
tgttcttgtagtataaccagggcaa

SEQ ID NO: 913120 - DNA, 25 bp, Mus musculus
tgttcttgtagtttaaccagggcaa

SEQ ID NO: 913121 - DNA, 25 bp, Mus musculus
tgttcttgtgaacttgcatgcttga

SEQ ID NO: 913122 - DNA, 25 bp, Mus musculus
tgttcttgtgaagttgcatgcttga

SEQ ID NO: 913123 - DNA, 25 bp, Mus musculus
tgttcttgtgtaccctgacagcatc

SEQ ID NO: 913124 - DNA, 25 bp, Mus musculus
tgttcttgtgtagcctgacagcatc

SEQ ID NO: 913125 - DNA, 25 bp, Mus musculus
tgttcttgttaccagttccttctaa

SEQ ID NO: 913126 - DNA, 25 bp, Mus musculus
tgttcttgttacgagttccttctaa

SEQ ID NO: 913127 - DNA, 25 bp, Mus musculus
tgttctttaaacatcctaccttctg

SEQ ID NO: 913128 - DNA, 25 bp, Mus musculus
tgttctttaaacttcctaccttctg

SEQ ID NO: 913129 - DNA, 25 bp, Mus musculus
tgttctttaagaacgctccagtgga

SEQ ID NO: 913130 - DNA, 25 bp, Mus musculus
tgttctttaagatcgctccagtgga

SEQ ID NO: 913131 - DNA, 25 bp, Mus musculus
tgttctttaatgacccatatattga

SEQ ID NO: 913132 - DNA, 25 bp, Mus musculus
tgttctttaatgtcccatatattga

SEQ ID NO: 913133 - DNA, 25 bp, Mus musculus
tgttctttagaaagagttccacttt

SEQ ID NO: 913134 - DNA, 25 bp, Mus musculus
tgttctttagaatgagttccacttt

SEQ ID NO: 913135 - DNA, 25 bp, Mus musculus
tgttctttcccacagatcagtgggt

SEQ ID NO: 913136 - DNA, 25 bp, Mus musculus
tgttctttcccagagatcagtgggt

SEQ ID NO: 913137 - DNA, 25 bp, Mus musculus
tgttctttctcaccagtgtaagttt

SEQ ID NO: 913138 - DNA, 25 bp, Mus musculus
tgttctttctcagcagtgtaagttt

SEQ ID NO: 913139 - DNA, 25 bp, Mus musculus
tgttctttctctaccgacatcggga

SEQ ID NO: 913140 - DNA, 25 bp, Mus musculus
tgttctttctctcgctttcttgttc

SEQ ID NO: 913141 - DNA, 25 bp, Mus musculus
tgttctttctctggctttcttgttc

SEQ ID NO: 913142 - DNA, 25 bp, Mus musculus
tgttctttctcttccgacatcggga

SEQ ID NO: 913143 - DNA, 25 bp, Mus musculus
tgttctttgaagcacacgccctcag

SEQ ID NO: 913144 - DNA, 25 bp, Mus musculus
tgttctttgaaggacacgccctcag

SEQ ID NO: 913145 - DNA, 25 bp, Mus musculus
tgttctttgaccatgaacgcccaac

SEQ ID NO: 913146 - DNA, 25 bp, Mus musculus
tgttctttgaccttgaacgcccaac

SEQ ID NO: 913147 - DNA, 25 bp, Mus musculus
tgttctttgagtaattgttatgtta

SEQ ID NO: 913148 - DNA, 25 bp, Mus musculus
tgttctttgagttattgttatgtta

SEQ ID NO: 913149 - DNA, 25 bp, Mus musculus
tgttctttgcagaatttcattttcc

SEQ ID NO: 913150 - DNA, 25 bp, Mus musculus
tgttctttgcagtatttcattttcc

SEQ ID NO: 913151 - DNA, 25 bp, Mus musculus
tgttctttggagcattgttctaaaa

SEQ ID NO: 913152 - DNA, 25 bp, Mus musculus
tgttctttggaggattgttctaaaa

SEQ ID NO: 913153 - DNA, 25 bp, Mus musculus
tgttctttgtatcggactgatgatc

SEQ ID NO: 913154 - DNA, 25 bp, Mus musculus
tgttctttgtatctgtgccactgaa

SEQ ID NO: 913155 - DNA, 25 bp, Mus musculus
tgttctttgtatgggactgatgatc

SEQ ID NO: 913156 - DNA, 25 bp, Mus musculus
tgttctttgtatgtgtgccactgaa

SEQ ID NO: 913157 - DNA, 25 bp, Mus musculus
tgttcttttgacaccttgattgcat

SEQ ID NO: 913158 - DNA, 25 bp, Mus musculus
tgttcttttgactccttgattgcat

SEQ ID NO: 913159 - DNA, 25 bp, Mus musculus
tgttcttttgttcgttcctgaaata

SEQ ID NO: 913160 - DNA, 25 bp, Mus musculus
tgttcttttgttggttcctgaaata

SEQ ID NO: 913161 - DNA, 25 bp, Mus musculus
tgttctttttcactaagccctcaga

SEQ ID NO: 913162 - DNA, 25 bp, Mus musculus
tgttctttttcagtaagccctcaga

SEQ ID NO: 913163 - DNA, 25 bp, Mus musculus
tgttctttttgtatccggtctctgt

SEQ ID NO: 913164 - DNA, 25 bp, Mus musculus
tgttctttttgtcctcaagacccac

SEQ ID NO: 913165 - DNA, 25 bp, Mus musculus
tgttctttttgtgctcaagacccac

SEQ ID NO: 913166 - DNA, 25 bp, Mus musculus
tgttctttttgtttccggtctctgt

SEQ ID NO: 913167 - DNA, 25 bp, Mus musculus
tgttgaaacaacaggacgatctgaa

SEQ ID NO: 913168 - DNA, 25 bp, Mus musculus
tgttgaaacaactggacgatctgaa

SEQ ID NO: 913169 - DNA, 25 bp, Mus musculus
tgttgaaacggcacctgcggagatt

SEQ ID NO: 913170 - DNA, 25 bp, Mus musculus
tgttgaaacggctcctgcggagatt

SEQ ID NO: 913171 - DNA, 25 bp, Mus musculus
tgttgaaacggtacctcctaaaatg

SEQ ID NO: 913172 - DNA, 25 bp, Mus musculus
tgttgaaacggttcctcctaaaatg

SEQ ID NO: 913173 - DNA, 25 bp, Mus musculus
tgttgaaactttcctgaccagaatg

SEQ ID NO: 913174 - DNA, 25 bp, Mus musculus
tgttgaaactttgctgaccagaatg

SEQ ID NO: 913175 - DNA, 25 bp, Mus musculus
tgttgaaagcaaccgccgtcagaat

SEQ ID NO: 913176 - DNA, 25 bp, Mus musculus
tgttgaaagcaagcgccgtcagaat

SEQ ID NO: 913177 - DNA, 25 bp, Mus musculus
tgttgaaaggtgctccacacgcagt

SEQ ID NO: 913178 - DNA, 25 bp, Mus musculus
tgttgaaaggtggtccacacgcagt

SEQ ID NO: 913179 - DNA, 25 bp, Mus musculus
tgttgaaattctcatctttctcctt

SEQ ID NO: 913180 - DNA, 25 bp, Mus musculus
tgttgaaattctgatctttctcctt

SEQ ID NO: 913181 - DNA, 25 bp, Mus musculus
tgttgaaattgtacacctcccattg

SEQ ID NO: 913182 - DNA, 25 bp, Mus musculus
tgttgaaattgttcacctcccattg

SEQ ID NO: 913183 - DNA, 25 bp, Mus musculus
tgttgaacatctattaatgggcatt

SEQ ID NO: 913184 - DNA, 25 bp, Mus musculus
tgttgaacatctcctacaggccagc

SEQ ID NO: 913185 - DNA, 25 bp, Mus musculus
tgttgaacatctgctacaggccagc

SEQ ID NO: 913186 - DNA, 25 bp, Mus musculus
tgttgaacatcttttaatgggcatt

SEQ ID NO: 913187 - DNA, 25 bp, Mus musculus
tgttgaaccaagaccctagcgccta

SEQ ID NO: 913188 - DNA, 25 bp, Mus musculus
tgttgaaccaagtccctagcgccta

SEQ ID NO: 913189 - DNA, 25 bp, Mus musculus
tgttgaaccagacttgtaatgcttt

SEQ ID NO: 913190 - DNA, 25 bp, Mus musculus
tgttgaaccagagttgtaatgcttt

SEQ ID NO: 913191 - DNA, 25 bp, Mus musculus
tgttgaactcttacgtacattccaa

SEQ ID NO: 913192 - DNA, 25 bp, Mus musculus
tgttgaactctttcgtacattccaa

SEQ ID NO: 913193 - DNA, 25 bp, Mus musculus
tgttgaagaaaccaacttaccatgt

SEQ ID NO: 913194 - DNA, 25 bp, Mus musculus
tgttgaagaaacgaacttaccatgt

SEQ ID NO: 913195 - DNA, 25 bp, Mus musculus
tgttgaagactcagcattgccaccc

SEQ ID NO: 913196 - DNA, 25 bp, Mus musculus
tgttgaagactctgcattgccaccc

SEQ ID NO: 913197 - DNA, 25 bp, Mus musculus
tgttgaagatctacacccacagcac

SEQ ID NO: 913198 - DNA, 25 bp, Mus musculus
tgttgaagatcttcacccacagcac

SEQ ID NO: 913199 - DNA, 25 bp, Mus musculus
tgttgaagcgatcactgctcttcca

SEQ ID NO: 913200 - DNA, 25 bp, Mus musculus
tgttgaagcgatgactgctcttcca

SEQ ID NO: 913201 - DNA, 25 bp, Mus musculus
tgttgaaggcttatcaccaaaacca

SEQ ID NO: 913202 - DNA, 25 bp, Mus musculus
tgttgaaggcttttcaccaaaacca

SEQ ID NO: 913203 - DNA, 25 bp, Mus musculus
tgttgaagggttccatgacgccatc

SEQ ID NO: 913204 - DNA, 25 bp, Mus musculus
tgttgaagggttgcatgacgccatc

SEQ ID NO: 913205 - DNA, 25 bp, Mus musculus
tgttgaataaaaccctgatcatgtt

SEQ ID NO: 913206 - DNA, 25 bp, Mus musculus
tgttgaataaaagcctgatcatgtt

SEQ ID NO: 913207 - DNA, 25 bp, Mus musculus
tgttgaatcagactcagcagcccta

SEQ ID NO: 913208 - DNA, 25 bp, Mus musculus
tgttgaatcagagtcagcagcccta

SEQ ID NO: 913209 - DNA, 25 bp, Mus musculus
tgttgaatcttcactacccaaatcc

SEQ ID NO: 913210 - DNA, 25 bp, Mus musculus
tgttgaatcttctctacccaaatcc

SEQ ID NO: 913211 - DNA, 25 bp, Mus musculus
tgttgaatcttgctttgagacccta

SEQ ID NO: 913212 - DNA, 25 bp, Mus musculus
tgttgaatcttggtttgagacccta

SEQ ID NO: 913213 - DNA, 25 bp, Mus musculus
tgttgaattataaccctagttcttt

SEQ ID NO: 913214 - DNA, 25 bp, Mus musculus
tgttgaattatatccctagttcttt

SEQ ID NO: 913215 - DNA, 25 bp, Mus musculus
tgttgacaacagcatttattaccca

SEQ ID NO: 913216 - DNA, 25 bp, Mus musculus
tgttgacaacaggatttattaccca

SEQ ID NO: 913217 - DNA, 25 bp, Mus musculus
tgttgacagcccaccgtgcaggcaa

SEQ ID NO: 913218 - DNA, 25 bp, Mus musculus
tgttgacagccctccgtgcaggcaa

SEQ ID NO: 913219 - DNA, 25 bp, Mus musculus
tgttgacagctcagcccatccctgg

SEQ ID NO: 913220 - DNA, 25 bp, Mus musculus
tgttgacagctctgcccatccctgg

SEQ ID NO: 913221 - DNA, 25 bp, Mus musculus
tgttgacaggtaacctatgggatac

SEQ ID NO: 913222 - DNA, 25 bp, Mus musculus
tgttgacaggtatcctatgggatac

SEQ ID NO: 913223 - DNA, 25 bp, Mus musculus
tgttgacagttcacgggctggtttc

SEQ ID NO: 913224 - DNA, 25 bp, Mus musculus
tgttgacagttctcgggctggtttc

SEQ ID NO: 913225 - DNA, 25 bp, Mus musculus
tgttgacatcctagctgtgagggtt

SEQ ID NO: 913226 - DNA, 25 bp, Mus musculus
tgttgacatcctagtctcctgtaga

SEQ ID NO: 913227 - DNA, 25 bp, Mus musculus
tgttgacatccttgctgtgagggtt

SEQ ID NO: 913228 - DNA, 25 bp, Mus musculus
tgttgacatccttgtctcctgtaga

SEQ ID NO: 913229 - DNA, 25 bp, Mus musculus
tgttgacatctgactgggctgttca

SEQ ID NO: 913230 - DNA, 25 bp, Mus musculus
tgttgacatctgtctgggctgttca

SEQ ID NO: 913231 - DNA, 25 bp, Mus musculus
tgttgacatgccaggctttcatgtg

SEQ ID NO: 913232 - DNA, 25 bp, Mus musculus
tgttgacatgcctggctttcatgtg

SEQ ID NO: 913233 - DNA, 25 bp, Mus musculus
tgttgacatgttaccacacgtgcat

SEQ ID NO: 913234 - DNA, 25 bp, Mus musculus
tgttgacatgtttccacacgtgcat

SEQ ID NO: 913235 - DNA, 25 bp, Mus musculus
tgttgaccagaacgcttcggattta

SEQ ID NO: 913236 - DNA, 25 bp, Mus musculus
tgttgaccagaaggcttcggattta

SEQ ID NO: 913237 - DNA, 25 bp, Mus musculus
tgttgacccggaagcaattcaggaa

SEQ ID NO: 913238 - DNA, 25 bp, Mus musculus
tgttgacccggatgcaattcaggaa

SEQ ID NO: 913239 - DNA, 25 bp, Mus musculus
tgttgaccctatccaggcagagtat

SEQ ID NO: 913240 - DNA, 25 bp, Mus musculus
tgttgaccctatgcaggcagagtat

SEQ ID NO: 913241 - DNA, 25 bp, Mus musculus
tgttgacccttcagtaatttcctaa

SEQ ID NO: 913242 - DNA, 25 bp, Mus musculus
tgttgacccttctgtaatttcctaa

SEQ ID NO: 913243 - DNA, 25 bp, Mus musculus
tgttgaccggccctgactgaagaag

SEQ ID NO: 913244 - DNA, 25 bp, Mus musculus
tgttgaccggccgtgactgaagaag

SEQ ID NO: 913245 - DNA, 25 bp, Mus musculus
tgttgacctggacaatctgtccctg

SEQ ID NO: 913246 - DNA, 25 bp, Mus musculus
tgttgacctggagaatctgtccctg

SEQ ID NO: 913247 - DNA, 25 bp, Mus musculus
tgttgaccttagcagttttgacttc

SEQ ID NO: 913248 - DNA, 25 bp, Mus musculus
tgttgaccttaggagttttgacttc

SEQ ID NO: 913249 - DNA, 25 bp, Mus musculus
tgttgacgctgccttccgggaagac

SEQ ID NO: 913250 - DNA, 25 bp, Mus musculus
tgttgacgctgcgttccgggaagac

SEQ ID NO: 913251 - DNA, 25 bp, Mus musculus
tgttgacgttaacctgctacagatc

SEQ ID NO: 913252 - DNA, 25 bp, Mus musculus
tgttgacgttaagctgctacagatc

SEQ ID NO: 913253 - DNA, 25 bp, Mus musculus
tgttgactcatcatcattactgtag

SEQ ID NO: 913254 - DNA, 25 bp, Mus musculus
tgttgactcatcttcattactgtag

SEQ ID NO: 913255 - DNA, 25 bp, Mus musculus
tgttgactccacacccatatgagta

SEQ ID NO: 913256 - DNA, 25 bp, Mus musculus
tgttgactccacctgtgaggaccgt

SEQ ID NO: 913257 - DNA, 25 bp, Mus musculus
tgttgactccacgtgtgaggaccgt

SEQ ID NO: 913258 - DNA, 25 bp, Mus musculus
tgttgactccactcccatatgagta

SEQ ID NO: 913259 - DNA, 25 bp, Mus musculus
tgttgactcccacgaccatgtgaga

SEQ ID NO: 913260 - DNA, 25 bp, Mus musculus
tgttgactcccaggaccatgtgaga

SEQ ID NO: 913261 - DNA, 25 bp, Mus musculus
tgttgactcctcaggctataggcaa

SEQ ID NO: 913262 - DNA, 25 bp, Mus musculus
tgttgactcctctggctataggcaa

SEQ ID NO: 913263 - DNA, 25 bp, Mus musculus
tgttgactctcaacatggttcctga

SEQ ID NO: 913264 - DNA, 25 bp, Mus musculus
tgttgactctcactttacccacttg

SEQ ID NO: 913265 - DNA, 25 bp, Mus musculus
tgttgactctcagtttacccacttg

SEQ ID NO: 913266 - DNA, 25 bp, Mus musculus
tgttgactctcatcatggttcctga

SEQ ID NO: 913267 - DNA, 25 bp, Mus musculus
tgttgactgacacgaggatttacct

SEQ ID NO: 913268 - DNA, 25 bp, Mus musculus
tgttgactgacaggaggatttacct

SEQ ID NO: 913269 - DNA, 25 bp, Mus musculus
tgttgactgccaaccactttggatt

SEQ ID NO: 913270 - DNA, 25 bp, Mus musculus
tgttgactgccatccactttggatt

SEQ ID NO: 913271 - DNA, 25 bp, Mus musculus
tgttgactgggacgcagcaaatgct

SEQ ID NO: 913272 - DNA, 25 bp, Mus musculus
tgttgactgggaggcagcaaatgct

SEQ ID NO: 913273 - DNA, 25 bp, Mus musculus
tgttgactgtcaagtctggctttcc

SEQ ID NO: 913274 - DNA, 25 bp, Mus musculus
tgttgactgtcatgtctggctttcc

SEQ ID NO: 913275 - DNA, 25 bp, Mus musculus
tgttgacttatcagttaaaccacca

SEQ ID NO: 913276 - DNA, 25 bp, Mus musculus
tgttgacttatctgttaaaccacca

SEQ ID NO: 913277 - DNA, 25 bp, Mus musculus
tgttgacttcataattcccatggta

SEQ ID NO: 913278 - DNA, 25 bp, Mus musculus
tgttgacttcatatgcaggtgacat

SEQ ID NO: 913279 - DNA, 25 bp, Mus musculus
tgttgacttcattattcccatggta

SEQ ID NO: 913280 - DNA, 25 bp, Mus musculus
tgttgacttcatttgcaggtgacat

SEQ ID NO: 913281 - DNA, 25 bp, Mus musculus
tgttgacttccacttgtaccggcca

SEQ ID NO: 913282 - DNA, 25 bp, Mus musculus
tgttgacttccagttgtaccggcca

SEQ ID NO: 913283 - DNA, 25 bp, Mus musculus
tgttgacttctgcacaatctgccca

SEQ ID NO: 913284 - DNA, 25 bp, Mus musculus
tgttgacttctggacaatctgccca

SEQ ID NO: 913285 - DNA, 25 bp, Mus musculus
tgttgacttcttagactcctcctga

SEQ ID NO: 913286 - DNA, 25 bp, Mus musculus
tgttgacttcttatgagccatccat

SEQ ID NO: 913287 - DNA, 25 bp, Mus musculus
tgttgacttctttgactcctcctga

SEQ ID NO: 913288 - DNA, 25 bp, Mus musculus
tgttgacttcttttgagccatccat

SEQ ID NO: 913289 - DNA, 25 bp, Mus musculus
tgttgacttgtgatcggctgtacca

SEQ ID NO: 913290 - DNA, 25 bp, Mus musculus
tgttgacttgtgttcggctgtacca

SEQ ID NO: 913291 - DNA, 25 bp, Mus musculus
tgttgactttaaatcctacaaacct

SEQ ID NO: 913292 - DNA, 25 bp, Mus musculus
tgttgactttaattcctacaaacct

SEQ ID NO: 913293 - DNA, 25 bp, Mus musculus
tgttgagaacgactaatttatgata

SEQ ID NO: 913294 - DNA, 25 bp, Mus musculus
tgttgagaacgagtaatttatgata

SEQ ID NO: 913295 - DNA, 25 bp, Mus musculus
tgttgagaacttcccttcttacagg

SEQ ID NO: 913296 - DNA, 25 bp, Mus musculus
tgttgagaacttgccttcttacagg

SEQ ID NO: 913297 - DNA, 25 bp, Mus musculus
tgttgagaagtgagcctgcctctga

SEQ ID NO: 913298 - DNA, 25 bp, Mus musculus
tgttgagaagtgtgcctgcctctga

SEQ ID NO: 913299 - DNA, 25 bp, Mus musculus
tgttgagaatctacggcggcaggcc

SEQ ID NO: 913300 - DNA, 25 bp, Mus musculus
tgttgagaatcttcggcggcaggcc

SEQ ID NO: 913301 - DNA, 25 bp, Mus musculus
tgttgagacaggagttcacgggcct

SEQ ID NO: 913302 - DNA, 25 bp, Mus musculus
tgttgagacaggtgttcacgggcct

SEQ ID NO: 913303 - DNA, 25 bp, Mus musculus
tgttgagagcccagccaggcagagt

SEQ ID NO: 913304 - DNA, 25 bp, Mus musculus
tgttgagagccctgccaggcagagt

SEQ ID NO: 913305 - DNA, 25 bp, Mus musculus
tgttgagatgagaggcgccaccaca

SEQ ID NO: 913306 - DNA, 25 bp, Mus musculus
tgttgagatgagtggcgccaccaca

SEQ ID NO: 913307 - DNA, 25 bp, Mus musculus
tgttgagatggcaccaggcacctgg

SEQ ID NO: 913308 - DNA, 25 bp, Mus musculus
tgttgagatggctccaggcacctgg

SEQ ID NO: 913309 - DNA, 25 bp, Mus musculus
tgttgagattcaaggtatgcaccac

SEQ ID NO: 913310 - DNA, 25 bp, Mus musculus
tgttgagattcatggtatgcaccac

SEQ ID NO: 913311 - DNA, 25 bp, Mus musculus
tgttgagcaccaaaacacggagcag

SEQ ID NO: 913312 - DNA, 25 bp, Mus musculus
tgttgagcaccataacacggagcag

SEQ ID NO: 913313 - DNA, 25 bp, Mus musculus
tgttgagcctcacccagtgtgggtc

SEQ ID NO: 913314 - DNA, 25 bp, Mus musculus
tgttgagcctcagccagtgtgggtc

SEQ ID NO: 913315 - DNA, 25 bp, Mus musculus
tgttgagccttccagcctagggaac

SEQ ID NO: 913316 - DNA, 25 bp, Mus musculus
tgttgagccttcgagcctagggaac

SEQ ID NO: 913317 - DNA, 25 bp, Mus musculus
tgttgagcctttacatatgaagaac

SEQ ID NO: 913318 - DNA, 25 bp, Mus musculus
tgttgagcctttcgcagctcacaaa

SEQ ID NO: 913319 - DNA, 25 bp, Mus musculus
tgttgagcctttggcagctcacaaa

SEQ ID NO: 913320 - DNA, 25 bp, Mus musculus
tgttgagccttttcatatgaagaac

SEQ ID NO: 913321 - DNA, 25 bp, Mus musculus
tgttgagcgcatcatccgccaggaa

SEQ ID NO: 913322 - DNA, 25 bp, Mus musculus
tgttgagcgcatgatccgccaggaa

SEQ ID NO: 913323 - DNA, 25 bp, Mus musculus
tgttgagctaaacaagccggtgact

SEQ ID NO: 913324 - DNA, 25 bp, Mus musculus
tgttgagctaaagaagccggtgact

SEQ ID NO: 913325 - DNA, 25 bp, Mus musculus
tgttgagctccaagattgccttagg

SEQ ID NO: 913326 - DNA, 25 bp, Mus musculus
tgttgagctccatgattgccttagg

SEQ ID NO: 913327 - DNA, 25 bp, Mus musculus
tgttgagctgtcagcaagttgtaca

SEQ ID NO: 913328 - DNA, 25 bp, Mus musculus
tgttgagctgtcctccattttagac

SEQ ID NO: 913329 - DNA, 25 bp, Mus musculus
tgttgagctgtcgtccattttagac

SEQ ID NO: 913330 - DNA, 25 bp, Mus musculus
tgttgagctgtctgcaagttgtaca

SEQ ID NO: 913331 - DNA, 25 bp, Mus musculus
tgttgagctgtgagatgtccctgag

SEQ ID NO: 913332 - DNA, 25 bp, Mus musculus
tgttgagctgtgtgatgtccctgag

SEQ ID NO: 913333 - DNA, 25 bp, Mus musculus
tgttgagcttctccgtggaaagact

SEQ ID NO: 913334 - DNA, 25 bp, Mus musculus
tgttgagcttctgcgtggaaagact

SEQ ID NO: 913335 - DNA, 25 bp, Mus musculus
tgttgagctttgatcatctccgagc

SEQ ID NO: 913336 - DNA, 25 bp, Mus musculus
tgttgagctttgttcatctccgagc

SEQ ID NO: 913337 - DNA, 25 bp, Mus musculus
tgttgaggcagtccctgaaaccaca

SEQ ID NO: 913338 - DNA, 25 bp, Mus musculus
tgttgaggcagtgcctgaaaccaca

SEQ ID NO: 913339 - DNA, 25 bp, Mus musculus
tgttgagggccaatcaccaaggtca

SEQ ID NO: 913340 - DNA, 25 bp, Mus musculus
tgttgagggccattcaccaaggtca

SEQ ID NO: 913341 - DNA, 25 bp, Mus musculus
tgttgaggtatgcacacagacatgt

SEQ ID NO: 913342 - DNA, 25 bp, Mus musculus
tgttgaggtatggacacagacatgt

SEQ ID NO: 913343 - DNA, 25 bp, Mus musculus
tgttgagtactaaactcgcctaggg

SEQ ID NO: 913344 - DNA, 25 bp, Mus musculus
tgttgagtactatactcgcctaggg

SEQ ID NO: 913345 - DNA, 25 bp, Mus musculus
tgttgagtatcaagcctaactcccc

SEQ ID NO: 913346 - DNA, 25 bp, Mus musculus
tgttgagtatcatgcctaactcccc

SEQ ID NO: 913347 - DNA, 25 bp, Mus musculus
tgttgagtcagtatcctctggagtc

SEQ ID NO: 913348 - DNA, 25 bp, Mus musculus
tgttgagtcagtttcctctggagtc

SEQ ID NO: 913349 - DNA, 25 bp, Mus musculus
tgttgagtctagaccacattctcgc

SEQ ID NO: 913350 - DNA, 25 bp, Mus musculus
tgttgagtctagtccacattctcgc

SEQ ID NO: 913351 - DNA, 25 bp, Mus musculus
tgttgagtgctccagtttgccttgc

SEQ ID NO: 913352 - DNA, 25 bp, Mus musculus
tgttgagtgctcgagtttgccttgc

SEQ ID NO: 913353 - DNA, 25 bp, Mus musculus
tgttgagtgctgataactgttctaa

SEQ ID NO: 913354 - DNA, 25 bp, Mus musculus
tgttgagtgctgttaactgttctaa

SEQ ID NO: 913355 - DNA, 25 bp, Mus musculus
tgttgagtgggcaaagttctgctgt

SEQ ID NO: 913356 - DNA, 25 bp, Mus musculus
tgttgagtgggctaagttctgctgt

SEQ ID NO: 913357 - DNA, 25 bp, Mus musculus
tgttgagttactctgctgagaattc

SEQ ID NO: 913358 - DNA, 25 bp, Mus musculus
tgttgagttactgtgctgagaattc

SEQ ID NO: 913359 - DNA, 25 bp, Mus musculus
tgttgagttcacctcatccgtaaca

SEQ ID NO: 913360 - DNA, 25 bp, Mus musculus
tgttgagttcacgtcatccgtaaca

SEQ ID NO: 913361 - DNA, 25 bp, Mus musculus
tgttgataactcaatctcctgccac

SEQ ID NO: 913362 - DNA, 25 bp, Mus musculus
tgttgataactctatctcctgccac

SEQ ID NO: 913363 - DNA, 25 bp, Mus musculus
tgttgataatgtcctagaccctaga

SEQ ID NO: 913364 - DNA, 25 bp, Mus musculus
tgttgataatgtgctagaccctaga

SEQ ID NO: 913365 - DNA, 25 bp, Mus musculus
tgttgatactgcatgactccactag

SEQ ID NO: 913366 - DNA, 25 bp, Mus musculus
tgttgatactgcttgactccactag

SEQ ID NO: 913367 - DNA, 25 bp, Mus musculus
tgttgatagtatacaaaaacgtttt

SEQ ID NO: 913368 - DNA, 25 bp, Mus musculus
tgttgatagtattcaaaaacgtttt

SEQ ID NO: 913369 - DNA, 25 bp, Mus musculus
tgttgatatcctaggacaccagcct

SEQ ID NO: 913370 - DNA, 25 bp, Mus musculus
tgttgatatccttggacaccagcct

SEQ ID NO: 913371 - DNA, 25 bp, Mus musculus
tgttgatattctcggtttgcctgcc

SEQ ID NO: 913372 - DNA, 25 bp, Mus musculus
tgttgatattctgggtttgcctgcc

SEQ ID NO: 913373 - DNA, 25 bp, Mus musculus
tgttgatcaagactgttaccagaaa

SEQ ID NO: 913374 - DNA, 25 bp, Mus musculus
tgttgatcaagagtgttaccagaaa

SEQ ID NO: 913375 - DNA, 25 bp, Mus musculus
tgttgatcccctcggaagtgagaca

SEQ ID NO: 913376 - DNA, 25 bp, Mus musculus
tgttgatcccctgggaagtgagaca

SEQ ID NO: 913377 - DNA, 25 bp, Mus musculus
tgttgatcggctcggtcttcctaca

SEQ ID NO: 913378 - DNA, 25 bp, Mus musculus
tgttgatcggctgggtcttcctaca

SEQ ID NO: 913379 - DNA, 25 bp, Mus musculus
tgttgatcgtgtcactggccaggac

SEQ ID NO: 913380 - DNA, 25 bp, Mus musculus
tgttgatcgtgtgactggccaggac

SEQ ID NO: 913381 - DNA, 25 bp, Mus musculus
tgttgatctgaacctctgatttttt

SEQ ID NO: 913382 - DNA, 25 bp, Mus musculus
tgttgatctgaagctctgatttttt

SEQ ID NO: 913383 - DNA, 25 bp, Mus musculus
tgttgatgatatcctgccctgtgga

SEQ ID NO: 913384 - DNA, 25 bp, Mus musculus
tgttgatgatatgctgccctgtgga

SEQ ID NO: 913385 - DNA, 25 bp, Mus musculus
tgttgatgccacctgactcttagat

SEQ ID NO: 913386 - DNA, 25 bp, Mus musculus
tgttgatgccacgtgactcttagat

SEQ ID NO: 913387 - DNA, 25 bp, Mus musculus
tgttgatgccatcatgaccactgct

SEQ ID NO: 913388 - DNA, 25 bp, Mus musculus
tgttgatgccatgatgaccactgct

SEQ ID NO: 913389 - DNA, 25 bp, Mus musculus
tgttgatgccccagtgctgcctcag

SEQ ID NO: 913390 - DNA, 25 bp, Mus musculus
tgttgatgcccctgtgctgcctcag

SEQ ID NO: 913391 - DNA, 25 bp, Mus musculus
tgttgatgcggacatgcacctggac

SEQ ID NO: 913392 - DNA, 25 bp, Mus musculus
tgttgatgcggagatgcacctggac

SEQ ID NO: 913393 - DNA, 25 bp, Mus musculus
tgttgatgtttgacagtgacccact

SEQ ID NO: 913394 - DNA, 25 bp, Mus musculus
tgttgatgtttgtcagtgacccact

SEQ ID NO: 913395 - DNA, 25 bp, Mus musculus
tgttgattccacactttcacataat

SEQ ID NO: 913396 - DNA, 25 bp, Mus musculus
tgttgattccactctttcacataat

SEQ ID NO: 913397 - DNA, 25 bp, Mus musculus
tgttgattcccaaagaataacacct

SEQ ID NO: 913398 - DNA, 25 bp, Mus musculus
tgttgattcccatagaataacacct

SEQ ID NO: 913399 - DNA, 25 bp, Mus musculus
tgttgattctccacacatgtcactc

SEQ ID NO: 913400 - DNA, 25 bp, Mus musculus
tgttgattctcctcacatgtcactc

SEQ ID NO: 913401 - DNA, 25 bp, Mus musculus
tgttgattctgacacccagggctca

SEQ ID NO: 913402 - DNA, 25 bp, Mus musculus
tgttgattctgagacccagggctca

SEQ ID NO: 913403 - DNA, 25 bp, Mus musculus
tgttgattctttcccttaggtgcat

SEQ ID NO: 913404 - DNA, 25 bp, Mus musculus
tgttgattctttgccttaggtgcat

SEQ ID NO: 913405 - DNA, 25 bp, Mus musculus
tgttgattgcaactagcctgtagct

SEQ ID NO: 913406 - DNA, 25 bp, Mus musculus
tgttgattgcaagtagcctgtagct

SEQ ID NO: 913407 - DNA, 25 bp, Mus musculus
tgttgattgtttattctacttactg

SEQ ID NO: 913408 - DNA, 25 bp, Mus musculus
tgttgattgttttttctacttactg

SEQ ID NO: 913409 - DNA, 25 bp, Mus musculus
tgttgatttctacctgtagcctcta

SEQ ID NO: 913410 - DNA, 25 bp, Mus musculus
tgttgatttctagctgtagcctcta

SEQ ID NO: 913411 - DNA, 25 bp, Mus musculus
tgttgatttcttcagtgtgtgtgtt

SEQ ID NO: 913412 - DNA, 25 bp, Mus musculus
tgttgatttcttgagtgtgtgtgtt

SEQ ID NO: 913413 - DNA, 25 bp, Mus musculus
tgttgattttacctctttcctggaa

SEQ ID NO: 913414 - DNA, 25 bp, Mus musculus
tgttgattttacgtctttcctggaa

SEQ ID NO: 913415 - DNA, 25 bp, Mus musculus
tgttgattttccagtttcctgttat

SEQ ID NO: 913416 - DNA, 25 bp, Mus musculus
tgttgattttcctgtttcctgttat

SEQ ID NO: 913417 - DNA, 25 bp, Mus musculus
tgttgcaaacggaagtacttttact

SEQ ID NO: 913418 - DNA, 25 bp, Mus musculus
tgttgcaaacggtagtacttttact

SEQ ID NO: 913419 - DNA, 25 bp, Mus musculus
tgttgcaaattacaccctaagctgt

SEQ ID NO: 913420 - DNA, 25 bp, Mus musculus
tgttgcaaattagaccctaagctgt

SEQ ID NO: 913421 - DNA, 25 bp, Mus musculus
tgttgcaagagaaccatccttccgt

SEQ ID NO: 913422 - DNA, 25 bp, Mus musculus
tgttgcaagagatccatccttccgt

SEQ ID NO: 913423 - DNA, 25 bp, Mus musculus
tgttgcacaatgaagatggcctctt

SEQ ID NO: 913424 - DNA, 25 bp, Mus musculus
tgttgcacaatgtagatggcctctt

SEQ ID NO: 913425 - DNA, 25 bp, Mus musculus
tgttgcacagcaattaccctaatgc

SEQ ID NO: 913426 - DNA, 25 bp, Mus musculus
tgttgcacagcatttaccctaatgc

SEQ ID NO: 913427 - DNA, 25 bp, Mus musculus
tgttgcacagtcctaatttcataag

SEQ ID NO: 913428 - DNA, 25 bp, Mus musculus
tgttgcacagtcgtaatttcataag

SEQ ID NO: 913429 - DNA, 25 bp, Mus musculus
tgttgcacatccagcagccagcaag

SEQ ID NO: 913430 - DNA, 25 bp, Mus musculus
tgttgcacatcctgcagccagcaag

SEQ ID NO: 913431 - DNA, 25 bp, Mus musculus
tgttgcacatttatgtacttcagtg

SEQ ID NO: 913432 - DNA, 25 bp, Mus musculus
tgttgcacatttttgtacttcagtg

SEQ ID NO: 913433 - DNA, 25 bp, Mus musculus
tgttgcaccacaatgagctcacaaa

SEQ ID NO: 913434 - DNA, 25 bp, Mus musculus
tgttgcaccacattgagctcacaaa

SEQ ID NO: 913435 - DNA, 25 bp, Mus musculus
tgttgcaccaggatctagggtttct

SEQ ID NO: 913436 - DNA, 25 bp, Mus musculus
tgttgcaccaggttctagggtttct

SEQ ID NO: 913437 - DNA, 25 bp, Mus musculus
tgttgcactgacatagcccatgcat

SEQ ID NO: 913438 - DNA, 25 bp, Mus musculus
tgttgcactgacttagcccatgcat

SEQ ID NO: 913439 - DNA, 25 bp, Mus musculus
tgttgcactggtcgcaattcatcat

SEQ ID NO: 913440 - DNA, 25 bp, Mus musculus
tgttgcactggtggcaattcatcat

SEQ ID NO: 913441 - DNA, 25 bp, Mus musculus
tgttgcagacgcacctggaacggca

SEQ ID NO: 913442 - DNA, 25 bp, Mus musculus
tgttgcagacgctcctggaacggca

SEQ ID NO: 913443 - DNA, 25 bp, Mus musculus
tgttgcagactgagccccagaacaa

SEQ ID NO: 913444 - DNA, 25 bp, Mus musculus
tgttgcagactgtgccccagaacaa

SEQ ID NO: 913445 - DNA, 25 bp, Mus musculus
tgttgcagccaaactgttccagtga

SEQ ID NO: 913446 - DNA, 25 bp, Mus musculus
tgttgcagccaatctgttccagtga

SEQ ID NO: 913447 - DNA, 25 bp, Mus musculus
tgttgcagcctcaagattcttttct

SEQ ID NO: 913448 - DNA, 25 bp, Mus musculus
tgttgcagcctctagattcttttct

SEQ ID NO: 913449 - DNA, 25 bp, Mus musculus
tgttgcagtcacaatagttcttact

SEQ ID NO: 913450 - DNA, 25 bp, Mus musculus
tgttgcagtcactatagttcttact

SEQ ID NO: 913451 - DNA, 25 bp, Mus musculus
tgttgcagtgtcacgcaggtgagat

SEQ ID NO: 913452 - DNA, 25 bp, Mus musculus
tgttgcagtgtctcgcaggtgagat

SEQ ID NO: 913453 - DNA, 25 bp, Mus musculus
tgttgcataaataacccagccagga

SEQ ID NO: 913454 - DNA, 25 bp, Mus musculus
tgttgcataaattacccagccagga

SEQ ID NO: 913455 - DNA, 25 bp, Mus musculus
tgttgcataatgacagttttattca

SEQ ID NO: 913456 - DNA, 25 bp, Mus musculus
tgttgcataatgtcagttttattca

SEQ ID NO: 913457 - DNA, 25 bp, Mus musculus
tgttgcatatgtaggataggctcac

SEQ ID NO: 913458 - DNA, 25 bp, Mus musculus
tgttgcatatgttggataggctcac

SEQ ID NO: 913459 - DNA, 25 bp, Mus musculus
tgttgcatatttcgccccggtgtta

SEQ ID NO: 913460 - DNA, 25 bp, Mus musculus
tgttgcatatttggccccggtgtta

SEQ ID NO: 913461 - DNA, 25 bp, Mus musculus
tgttgcatccccaggagtggtagtt

SEQ ID NO: 913462 - DNA, 25 bp, Mus musculus
tgttgcatcccctggagtggtagtt

SEQ ID NO: 913463 - DNA, 25 bp, Mus musculus
tgttgcatcgaacccctctgaaaaa

SEQ ID NO: 913464 - DNA, 25 bp, Mus musculus
tgttgcatcgaagccctctgaaaaa

SEQ ID NO: 913465 - DNA, 25 bp, Mus musculus
tgttgcatctatacagttccacctt

SEQ ID NO: 913466 - DNA, 25 bp, Mus musculus
tgttgcatctattcagttccacctt

SEQ ID NO: 913467 - DNA, 25 bp, Mus musculus
tgttgcatctgaatccttccattgt

SEQ ID NO: 913468 - DNA, 25 bp, Mus musculus
tgttgcatctgattccttccattgt

SEQ ID NO: 913469 - DNA, 25 bp, Mus musculus
tgttgcatgctgatggtagtcctac

SEQ ID NO: 913470 - DNA, 25 bp, Mus musculus
tgttgcatgctgttggtagtcctac

SEQ ID NO: 913471 - DNA, 25 bp, Mus musculus
tgttgcattggcagccgctccgtaa

SEQ ID NO: 913472 - DNA, 25 bp, Mus musculus
tgttgcattggctgccgctccgtaa

SEQ ID NO: 913473 - DNA, 25 bp, Mus musculus
tgttgcatttctagctgctgccgcc

SEQ ID NO: 913474 - DNA, 25 bp, Mus musculus
tgttgcatttcttgctgctgccgcc

SEQ ID NO: 913475 - DNA, 25 bp, Mus musculus
tgttgccaactcactgaccaaggtt

SEQ ID NO: 913476 - DNA, 25 bp, Mus musculus
tgttgccaactctctgaccaaggtt

SEQ ID NO: 913477 - DNA, 25 bp, Mus musculus
tgttgccaacttacgtttgtgcatt

SEQ ID NO: 913478 - DNA, 25 bp, Mus musculus
tgttgccaactttcgtttgtgcatt

SEQ ID NO: 913479 - DNA, 25 bp, Mus musculus
tgttgccaagcaagtccacctgagg

SEQ ID NO: 913480 - DNA, 25 bp, Mus musculus
tgttgccaagcatgtccacctgagg

SEQ ID NO: 913481 - DNA, 25 bp, Mus musculus
tgttgccaatgacagctacctccta

SEQ ID NO: 913482 - DNA, 25 bp, Mus musculus
tgttgccaatgagagctacctccta

SEQ ID NO: 913483 - DNA, 25 bp, Mus musculus
tgttgccacattagcactgtctatg

SEQ ID NO: 913484 - DNA, 25 bp, Mus musculus
tgttgccacatttgcactgtctatg

SEQ ID NO: 913485 - DNA, 25 bp, Mus musculus
tgttgccaccatccattgcatagat

SEQ ID NO: 913486 - DNA, 25 bp, Mus musculus
tgttgccaccatgcattgcatagat

SEQ ID NO: 913487 - DNA, 25 bp, Mus musculus
tgttgccacttaccctattgtgtgt

SEQ ID NO: 913488 - DNA, 25 bp, Mus musculus
tgttgccacttagcctattgtgtgt

SEQ ID NO: 913489 - DNA, 25 bp, Mus musculus
tgttgccagggcatgctaggacaga

SEQ ID NO: 913490 - DNA, 25 bp, Mus musculus
tgttgccagggcttgctaggacaga

SEQ ID NO: 913491 - DNA, 25 bp, Mus musculus
tgttgccagggtaaccccacttgca

SEQ ID NO: 913492 - DNA, 25 bp, Mus musculus
tgttgccagggttaccccacttgca

SEQ ID NO: 913493 - DNA, 25 bp, Mus musculus
tgttgccagtccaaccagtgaagaa

SEQ ID NO: 913494 - DNA, 25 bp, Mus musculus
tgttgccagtcctaccagtgaagaa

SEQ ID NO: 913495 - DNA, 25 bp, Mus musculus
tgttgccagttaactgaacatgaga

SEQ ID NO: 913496 - DNA, 25 bp, Mus musculus
tgttgccagttatctgaacatgaga

SEQ ID NO: 913497 - DNA, 25 bp, Mus musculus
tgttgccatcacctctgtgatccta

SEQ ID NO: 913498 - DNA, 25 bp, Mus musculus
tgttgccatcacgtctgtgatccta

SEQ ID NO: 913499 - DNA, 25 bp, Mus musculus
tgttgccattgtaaggccgtcgatc

SEQ ID NO: 913500 - DNA, 25 bp, Mus musculus
tgttgccattgtcgagcccaagtgg

SEQ ID NO: 913501 - DNA, 25 bp, Mus musculus
tgttgccattgtggagcccaagtgg

SEQ ID NO: 913502 - DNA, 25 bp, Mus musculus
tgttgccattgttaggccgtcgatc

SEQ ID NO: 913503 - DNA, 25 bp, Mus musculus
tgttgcccaaggccccaatttgagc

SEQ ID NO: 913504 - DNA, 25 bp, Mus musculus
tgttgcccaagggcccaatttgagc

SEQ ID NO: 913505 - DNA, 25 bp, Mus musculus
tgttgcccaccaaccccgaggagag

SEQ ID NO: 913506 - DNA, 25 bp, Mus musculus
tgttgcccaccatccccgaggagag

SEQ ID NO: 913507 - DNA, 25 bp, Mus musculus
tgttgcccactgaacctaatgccaa

SEQ ID NO: 913508 - DNA, 25 bp, Mus musculus
tgttgcccactgtacctaatgccaa

SEQ ID NO: 913509 - DNA, 25 bp, Mus musculus
tgttgccccaagacagcctttcaaa

SEQ ID NO: 913510 - DNA, 25 bp, Mus musculus
tgttgccccaagtcagcctttcaaa

SEQ ID NO: 913511 - DNA, 25 bp, Mus musculus
tgttgccccaggctggaagaagcca

SEQ ID NO: 913512 - DNA, 25 bp, Mus musculus
tgttgccccagggtggaagaagcca

SEQ ID NO: 913513 - DNA, 25 bp, Mus musculus
tgttgccccggacatcgaggacaaa

SEQ ID NO: 913514 - DNA, 25 bp, Mus musculus
tgttgccccggagatcgaggacaaa

SEQ ID NO: 913515 - DNA, 25 bp, Mus musculus
tgttgccccgtgaatagatttggag

SEQ ID NO: 913516 - DNA, 25 bp, Mus musculus
tgttgccccgtgtatagatttggag

SEQ ID NO: 913517 - DNA, 25 bp, Mus musculus
tgttgcccggtcactagtgaatagc

SEQ ID NO: 913518 - DNA, 25 bp, Mus musculus
tgttgcccggtctctagtgaatagc

SEQ ID NO: 913519 - DNA, 25 bp, Mus musculus
tgttgccctaagagatctaccttcc

SEQ ID NO: 913520 - DNA, 25 bp, Mus musculus
tgttgccctaagtgatctaccttcc

SEQ ID NO: 913521 - DNA, 25 bp, Mus musculus
tgttgccctccgatgtgcgtgtgtg

SEQ ID NO: 913522 - DNA, 25 bp, Mus musculus
tgttgccctccgttgtgcgtgtgtg

SEQ ID NO: 913523 - DNA, 25 bp, Mus musculus
tgttgccctcggaaggtggacacta

SEQ ID NO: 913524 - DNA, 25 bp, Mus musculus
tgttgccctcggtaggtggacacta

SEQ ID NO: 913525 - DNA, 25 bp, Mus musculus
tgttgccctgaccacaagtgcaatt

SEQ ID NO: 913526 - DNA, 25 bp, Mus musculus
tgttgccctgacgacaagtgcaatt

SEQ ID NO: 913527 - DNA, 25 bp, Mus musculus
tgttgccctgtccaatgtgaggact

SEQ ID NO: 913528 - DNA, 25 bp, Mus musculus
tgttgccctgtccttggtgaacgag

SEQ ID NO: 913529 - DNA, 25 bp, Mus musculus
tgttgccctgtcgaatgtgaggact

SEQ ID NO: 913530 - DNA, 25 bp, Mus musculus
tgttgccctgtcgttggtgaacgag

SEQ ID NO: 913531 - DNA, 25 bp, Mus musculus
tgttgcccttcgatgcccaaatgga

SEQ ID NO: 913532 - DNA, 25 bp, Mus musculus
tgttgcccttcgttgcccaaatgga

SEQ ID NO: 913533 - DNA, 25 bp, Mus musculus
tgttgccgaagtatggaatctccat

SEQ ID NO: 913534 - DNA, 25 bp, Mus musculus
tgttgccgaagtttggaatctccat

SEQ ID NO: 913535 - DNA, 25 bp, Mus musculus
tgttgccgggctaccgtagatgaat

SEQ ID NO: 913536 - DNA, 25 bp, Mus musculus
tgttgccgggcttccgtagatgaat

SEQ ID NO: 913537 - DNA, 25 bp, Mus musculus
tgttgccgtgcccaaagtaccggat

SEQ ID NO: 913538 - DNA, 25 bp, Mus musculus
tgttgccgtgccgaaagtaccggat

SEQ ID NO: 913539 - DNA, 25 bp, Mus musculus
tgttgccgttcaatacctcctgatc

SEQ ID NO: 913540 - DNA, 25 bp, Mus musculus
tgttgccgttcattacctcctgatc

SEQ ID NO: 913541 - DNA, 25 bp, Mus musculus
tgttgcctatcccaggaagtgctgc

SEQ ID NO: 913542 - DNA, 25 bp, Mus musculus
tgttgcctatccgaggaagtgctgc

SEQ ID NO: 913543 - DNA, 25 bp, Mus musculus
tgttgcctcagcacttgaatccaat

SEQ ID NO: 913544 - DNA, 25 bp, Mus musculus
tgttgcctcagctcttgaatccaat

SEQ ID NO: 913545 - DNA, 25 bp, Mus musculus
tgttgcctccataatgtcttgtgtt

SEQ ID NO: 913546 - DNA, 25 bp, Mus musculus
tgttgcctccattatgtcttgtgtt

SEQ ID NO: 913547 - DNA, 25 bp, Mus musculus
tgttgcctctccaatgctactggct

SEQ ID NO: 913548 - DNA, 25 bp, Mus musculus
tgttgcctctcctatgctactggct

SEQ ID NO: 913549 - DNA, 25 bp, Mus musculus
tgttgcctctgtagattggccagta

SEQ ID NO: 913550 - DNA, 25 bp, Mus musculus
tgttgcctctgttgattggccagta

SEQ ID NO: 913551 - DNA, 25 bp, Mus musculus
tgttgcctgagtacacaatgcaccc

SEQ ID NO: 913552 - DNA, 25 bp, Mus musculus
tgttgcctgagtatgctaagcagtt

SEQ ID NO: 913553 - DNA, 25 bp, Mus musculus
tgttgcctgagttcacaatgcaccc

SEQ ID NO: 913554 - DNA, 25 bp, Mus musculus
tgttgcctgagtttgctaagcagtt

SEQ ID NO: 913555 - DNA, 25 bp, Mus musculus
tgttgcctgcagaaccattgggatc

SEQ ID NO: 913556 - DNA, 25 bp, Mus musculus
tgttgcctgcagtaccattgggatc

SEQ ID NO: 913557 - DNA, 25 bp, Mus musculus
tgttgcctgcctaggaggacattta

SEQ ID NO: 913558 - DNA, 25 bp, Mus musculus
tgttgcctgccttggaggacattta

SEQ ID NO: 913559 - DNA, 25 bp, Mus musculus
tgttgcctgtttcagcactcagagt

SEQ ID NO: 913560 - DNA, 25 bp, Mus musculus
tgttgcctgtttgagcactcagagt

SEQ ID NO: 913561 - DNA, 25 bp, Mus musculus
tgttgccttcatagctacccaagga

SEQ ID NO: 913562 - DNA, 25 bp, Mus musculus
tgttgccttcatccctgttaaaatt

SEQ ID NO: 913563 - DNA, 25 bp, Mus musculus
tgttgccttcatgcctgttaaaatt

SEQ ID NO: 913564 - DNA, 25 bp, Mus musculus
tgttgccttcattgctacccaagga

SEQ ID NO: 913565 - DNA, 25 bp, Mus musculus
tgttgcctttcaaacgagttcccta

SEQ ID NO: 913566 - DNA, 25 bp, Mus musculus
tgttgcctttcatacgagttcccta

SEQ ID NO: 913567 - DNA, 25 bp, Mus musculus
tgttgcgcacttaacgccctgcggg

SEQ ID NO: 913568 - DNA, 25 bp, Mus musculus
tgttgcgcactttacgccctgcggg

SEQ ID NO: 913569 - DNA, 25 bp, Mus musculus
tgttgcgccagcagaaccaggacgc

SEQ ID NO: 913570 - DNA, 25 bp, Mus musculus
tgttgcgccagctgaaccaggacgc

SEQ ID NO: 913571 - DNA, 25 bp, Mus musculus
tgttgcgccttgagccggcagcctg

SEQ ID NO: 913572 - DNA, 25 bp, Mus musculus
tgttgcgccttgtgccggcagcctg

SEQ ID NO: 913573 - DNA, 25 bp, Mus musculus
tgttgcgcggccacagtcaactgcg

SEQ ID NO: 913574 - DNA, 25 bp, Mus musculus
tgttgcgcggcctcagtcaactgcg

SEQ ID NO: 913575 - DNA, 25 bp, Mus musculus
tgttgcgctttcacaggacatgggt

SEQ ID NO: 913576 - DNA, 25 bp, Mus musculus
tgttgcgctttctcaggacatgggt

SEQ ID NO: 913577 - DNA, 25 bp, Mus musculus
tgttgcgtctgtagtctcagtgttc

SEQ ID NO: 913578 - DNA, 25 bp, Mus musculus
tgttgcgtctgttgtctcagtgttc

SEQ ID NO: 913579 - DNA, 25 bp, Mus musculus
tgttgcgtgcacacgggactcttaa

SEQ ID NO: 913580 - DNA, 25 bp, Mus musculus
tgttgcgtgcactcgggactcttaa

SEQ ID NO: 913581 - DNA, 25 bp, Mus musculus
tgttgcgttcttctttttgatgtaa

SEQ ID NO: 913582 - DNA, 25 bp, Mus musculus
tgttgcgttcttgtttttgatgtaa

SEQ ID NO: 913583 - DNA, 25 bp, Mus musculus
tgttgcgtttacacatatcatctaa

SEQ ID NO: 913584 - DNA, 25 bp, Mus musculus
tgttgcgtttactcatatcatctaa

SEQ ID NO: 913585 - DNA, 25 bp, Mus musculus
tgttgcgttttactgatttctcacc

SEQ ID NO: 913586 - DNA, 25 bp, Mus musculus
tgttgcgttttagtgatttctcacc

SEQ ID NO: 913587 - DNA, 25 bp, Mus musculus
tgttgctaacctcaccctaccaaag

SEQ ID NO: 913588 - DNA, 25 bp, Mus musculus
tgttgctaacctgaccctaccaaag

SEQ ID NO: 913589 - DNA, 25 bp, Mus musculus
tgttgctacgacagcctctgacaga

SEQ ID NO: 913590 - DNA, 25 bp, Mus musculus
tgttgctacgactgcctctgacaga

SEQ ID NO: 913591 - DNA, 25 bp, Mus musculus
tgttgctactttagtgttactatac

SEQ ID NO: 913592 - DNA, 25 bp, Mus musculus
tgttgctacttttgtgttactatac

SEQ ID NO: 913593 - DNA, 25 bp, Mus musculus
tgttgctatctgatgtgttcccatc

SEQ ID NO: 913594 - DNA, 25 bp, Mus musculus
tgttgctatctgttgtgttcccatc

SEQ ID NO: 913595 - DNA, 25 bp, Mus musculus
tgttgctatggacgcaagccatccg

SEQ ID NO: 913596 - DNA, 25 bp, Mus musculus
tgttgctatggaggcaagccatccg

SEQ ID NO: 913597 - DNA, 25 bp, Mus musculus
tgttgctcaaagactcacatggtgc

SEQ ID NO: 913598 - DNA, 25 bp, Mus musculus
tgttgctcaaagtctcacatggtgc

SEQ ID NO: 913599 - DNA, 25 bp, Mus musculus
tgttgctcaacaatctggacgccag

SEQ ID NO: 913600 - DNA, 25 bp, Mus musculus
tgttgctcaacattctggacgccag

SEQ ID NO: 913601 - DNA, 25 bp, Mus musculus
tgttgctcaagaaggcctcatgggc

SEQ ID NO: 913602 - DNA, 25 bp, Mus musculus
tgttgctcaagatggcctcatgggc

SEQ ID NO: 913603 - DNA, 25 bp, Mus musculus
tgttgctcacacagatgaacctaaa

SEQ ID NO: 913604 - DNA, 25 bp, Mus musculus
tgttgctcacactgatgaacctaaa

SEQ ID NO: 913605 - DNA, 25 bp, Mus musculus
tgttgctcagacctggcgtcaagct

SEQ ID NO: 913606 - DNA, 25 bp, Mus musculus
tgttgctcagacgtggcgtcaagct

SEQ ID NO: 913607 - DNA, 25 bp, Mus musculus
tgttgctcagagacagggtgatcgt

SEQ ID NO: 913608 - DNA, 25 bp, Mus musculus
tgttgctcagagtcagggtgatcgt

SEQ ID NO: 913609 - DNA, 25 bp, Mus musculus
tgttgctcatgtcttcacattgctt

SEQ ID NO: 913610 - DNA, 25 bp, Mus musculus
tgttgctcatgtgttcacattgctt

SEQ ID NO: 913611 - DNA, 25 bp, Mus musculus
tgttgctccaaaccattgaatggct

SEQ ID NO: 913612 - DNA, 25 bp, Mus musculus
tgttgctccaaagcattgaatggct

SEQ ID NO: 913613 - DNA, 25 bp, Mus musculus
tgttgctccaacagctgatttcctc

SEQ ID NO: 913614 - DNA, 25 bp, Mus musculus
tgttgctccaactgctgatttcctc

SEQ ID NO: 913615 - DNA, 25 bp, Mus musculus
tgttgctcccacacttattttcaaa

SEQ ID NO: 913616 - DNA, 25 bp, Mus musculus
tgttgctcccactcttattttcaaa

SEQ ID NO: 913617 - DNA, 25 bp, Mus musculus
tgttgctcccggctgagtaatcaag

SEQ ID NO: 913618 - DNA, 25 bp, Mus musculus
tgttgctcccgggtgagtaatcaag

SEQ ID NO: 913619 - DNA, 25 bp, Mus musculus
tgttgctccggaaagtttttatagg

SEQ ID NO: 913620 - DNA, 25 bp, Mus musculus
tgttgctccggatagtttttatagg

SEQ ID NO: 913621 - DNA, 25 bp, Mus musculus
tgttgctctagcaagatgtgtctcc

SEQ ID NO: 913622 - DNA, 25 bp, Mus musculus
tgttgctctagctagatgtgtctcc

SEQ ID NO: 913623 - DNA, 25 bp, Mus musculus
tgttgctgaaacaattatgacttaa

SEQ ID NO: 913624 - DNA, 25 bp, Mus musculus
tgttgctgaaactattatgacttaa

SEQ ID NO: 913625 - DNA, 25 bp, Mus musculus
tgttgctgaagcactaacatgcaga

SEQ ID NO: 913626 - DNA, 25 bp, Mus musculus
tgttgctgaagctctaacatgcaga

SEQ ID NO: 913627 - DNA, 25 bp, Mus musculus
tgttgctgatgcattcaccatgtcc

SEQ ID NO: 913628 - DNA, 25 bp, Mus musculus
tgttgctgatgctttcaccatgtcc

SEQ ID NO: 913629 - DNA, 25 bp, Mus musculus
tgttgctgcattaagatgcacctgt

SEQ ID NO: 913630 - DNA, 25 bp, Mus musculus
tgttgctgcattcccattcaggcta

SEQ ID NO: 913631 - DNA, 25 bp, Mus musculus
tgttgctgcattgccattcaggcta

SEQ ID NO: 913632 - DNA, 25 bp, Mus musculus
tgttgctgcatttagatgcacctgt

SEQ ID NO: 913633 - DNA, 25 bp, Mus musculus
tgttgctgccctatcatgactttac

SEQ ID NO: 913634 - DNA, 25 bp, Mus musculus
tgttgctgccctttcatgactttac

SEQ ID NO: 913635 - DNA, 25 bp, Mus musculus
tgttgctgcctcctggacagcttgg

SEQ ID NO: 913636 - DNA, 25 bp, Mus musculus
tgttgctgcctcgtggacagcttgg

SEQ ID NO: 913637 - DNA, 25 bp, Mus musculus
tgttgctgctaccatgctttgctct

SEQ ID NO: 913638 - DNA, 25 bp, Mus musculus
tgttgctgctacgatgctttgctct

SEQ ID NO: 913639 - DNA, 25 bp, Mus musculus
tgttgctgctggctctagtgcccca

SEQ ID NO: 913640 - DNA, 25 bp, Mus musculus
tgttgctgctgggtctagtgcccca

SEQ ID NO: 913641 - DNA, 25 bp, Mus musculus
tgttgctgctgtcggctaacagttc

SEQ ID NO: 913642 - DNA, 25 bp, Mus musculus
tgttgctgctgtgggctaacagttc

SEQ ID NO: 913643 - DNA, 25 bp, Mus musculus
tgttgctgcttacatctcactcata

SEQ ID NO: 913644 - DNA, 25 bp, Mus musculus
tgttgctgcttagatctcactcata

SEQ ID NO: 913645 - DNA, 25 bp, Mus musculus
tgttgctgcttcattcactaagaaa

SEQ ID NO: 913646 - DNA, 25 bp, Mus musculus
tgttgctgcttctttcactaagaaa

SEQ ID NO: 913647 - DNA, 25 bp, Mus musculus
tgttgctggaatccgcagcacggat

SEQ ID NO: 913648 - DNA, 25 bp, Mus musculus
tgttgctggaatgcgcagcacggat

SEQ ID NO: 913649 - DNA, 25 bp, Mus musculus
tgttgctggagccttcttttatggg

SEQ ID NO: 913650 - DNA, 25 bp, Mus musculus
tgttgctggagcgttcttttatggg

SEQ ID NO: 913651 - DNA, 25 bp, Mus musculus
tgttgctgtgacaggcctgtgagac

SEQ ID NO: 913652 - DNA, 25 bp, Mus musculus
tgttgctgtgactggcctgtgagac

SEQ ID NO: 913653 - DNA, 25 bp, Mus musculus
tgttgctgtggcatgttggccctga

SEQ ID NO: 913654 - DNA, 25 bp, Mus musculus
tgttgctgtggcttgttggccctga

SEQ ID NO: 913655 - DNA, 25 bp, Mus musculus
tgttgctgtggtatactgttgtatc

SEQ ID NO: 913656 - DNA, 25 bp, Mus musculus
tgttgctgtggtttactgttgtatc

SEQ ID NO: 913657 - DNA, 25 bp, Mus musculus
tgttgctgtgtaacccgggcatcca

SEQ ID NO: 913658 - DNA, 25 bp, Mus musculus
tgttgctgtgtatcccgggcatcca

SEQ ID NO: 913659 - DNA, 25 bp, Mus musculus
tgttgcttaagaaatttgacccctt

SEQ ID NO: 913660 - DNA, 25 bp, Mus musculus
tgttgcttaagatatttgacccctt

SEQ ID NO: 913661 - DNA, 25 bp, Mus musculus
tgttgcttaccaagtactgcccctg

SEQ ID NO: 913662 - DNA, 25 bp, Mus musculus
tgttgcttaccatgtactgcccctg

SEQ ID NO: 913663 - DNA, 25 bp, Mus musculus
tgttgcttatcaacggctactattc

SEQ ID NO: 913664 - DNA, 25 bp, Mus musculus
tgttgcttatcatcggctactattc

SEQ ID NO: 913665 - DNA, 25 bp, Mus musculus
tgttgcttcagactacccactcatt

SEQ ID NO: 913666 - DNA, 25 bp, Mus musculus
tgttgcttcagagtacccactcatt

SEQ ID NO: 913667 - DNA, 25 bp, Mus musculus
tgttgcttccatcagccagagctct

SEQ ID NO: 913668 - DNA, 25 bp, Mus musculus
tgttgcttccatgagccagagctct

SEQ ID NO: 913669 - DNA, 25 bp, Mus musculus
tgttgcttccctcaagtgatgcttt

SEQ ID NO: 913670 - DNA, 25 bp, Mus musculus
tgttgcttccctgaagtgatgcttt

SEQ ID NO: 913671 - DNA, 25 bp, Mus musculus
tgttgcttctccagggcatatccca

SEQ ID NO: 913672 - DNA, 25 bp, Mus musculus
tgttgcttctcctgggcatatccca

SEQ ID NO: 913673 - DNA, 25 bp, Mus musculus
tgttgcttgatcatctcctactgaa

SEQ ID NO: 913674 - DNA, 25 bp, Mus musculus
tgttgcttgatcttctcctactgaa

SEQ ID NO: 913675 - DNA, 25 bp, Mus musculus
tgttgcttgctcactgacagtccag

SEQ ID NO: 913676 - DNA, 25 bp, Mus musculus
tgttgcttgctctctgacagtccag

SEQ ID NO: 913677 - DNA, 25 bp, Mus musculus
tgttgcttggctcatagacccatca

SEQ ID NO: 913678 - DNA, 25 bp, Mus musculus
tgttgcttggctgatagacccatca

SEQ ID NO: 913679 - DNA, 25 bp, Mus musculus
tgttgcttggtgatgacagtggcta

SEQ ID NO: 913680 - DNA, 25 bp, Mus musculus
tgttgcttggtgttgacagtggcta

SEQ ID NO: 913681 - DNA, 25 bp, Mus musculus
tgttgctttaaactgtgcccctccc

SEQ ID NO: 913682 - DNA, 25 bp, Mus musculus
tgttgctttaaagtgtgcccctccc

SEQ ID NO: 913683 - DNA, 25 bp, Mus musculus
tgttgctttacaactgccatggaag

SEQ ID NO: 913684 - DNA, 25 bp, Mus musculus
tgttgctttacatctgccatggaag

SEQ ID NO: 913685 - DNA, 25 bp, Mus musculus
tgttgctttcgtattgtcagtgtca

SEQ ID NO: 913686 - DNA, 25 bp, Mus musculus
tgttgctttcgttttgtcagtgtca

SEQ ID NO: 913687 - DNA, 25 bp, Mus musculus
tgttgctttcttcatggactcattg

SEQ ID NO: 913688 - DNA, 25 bp, Mus musculus
tgttgctttcttgatggactcattg

SEQ ID NO: 913689 - DNA, 25 bp, Mus musculus
tgttgctttgtcactgggctgctaa

SEQ ID NO: 913690 - DNA, 25 bp, Mus musculus
tgttgctttgtctctgggctgctaa

SEQ ID NO: 913691 - DNA, 25 bp, Mus musculus
tgttgcttttaccatctgattttct

SEQ ID NO: 913692 - DNA, 25 bp, Mus musculus
tgttgcttttacgatctgattttct

SEQ ID NO: 913693 - DNA, 25 bp, Mus musculus
tgttgcttttttcccagagtctgat

SEQ ID NO: 913694 - DNA, 25 bp, Mus musculus
tgttgcttttttgccagagtctgat

SEQ ID NO: 913695 - DNA, 25 bp, Mus musculus
tgttggaaagctatcctccccagga

SEQ ID NO: 913696 - DNA, 25 bp, Mus musculus
tgttggaaagctttcctccccagga

SEQ ID NO: 913697 - DNA, 25 bp, Mus musculus
tgttggaacccacagaagtcgccat

SEQ ID NO: 913698 - DNA, 25 bp, Mus musculus
tgttggaacccagagaagtcgccat

SEQ ID NO: 913699 - DNA, 25 bp, Mus musculus
tgttggaaccttcttgctcacaaag

SEQ ID NO: 913700 - DNA, 25 bp, Mus musculus
tgttggaaccttgttgctcacaaag

SEQ ID NO: 913701 - DNA, 25 bp, Mus musculus
tgttggaagacaactctcagtttct

SEQ ID NO: 913702 - DNA, 25 bp, Mus musculus
tgttggaagacatctctcagtttct

SEQ ID NO: 913703 - DNA, 25 bp, Mus musculus
tgttggaagagtctcctgctgattg

SEQ ID NO: 913704 - DNA, 25 bp, Mus musculus
tgttggaagagtgtcctgctgattg

SEQ ID NO: 913705 - DNA, 25 bp, Mus musculus
tgttggaagcatagccttttgctgc

SEQ ID NO: 913706 - DNA, 25 bp, Mus musculus
tgttggaagcattgccttttgctgc

SEQ ID NO: 913707 - DNA, 25 bp, Mus musculus
tgttggaagcgacgaaaccacggaa

SEQ ID NO: 913708 - DNA, 25 bp, Mus musculus
tgttggaagcgaggaaaccacggaa

SEQ ID NO: 913709 - DNA, 25 bp, Mus musculus
tgttggaataccaggctacagccgt

SEQ ID NO: 913710 - DNA, 25 bp, Mus musculus
tgttggaatacctggctacagccgt

SEQ ID NO: 913711 - DNA, 25 bp, Mus musculus
tgttggaattctccctcttctttct

SEQ ID NO: 913712 - DNA, 25 bp, Mus musculus
tgttggaattctgcctcttctttct

SEQ ID NO: 913713 - DNA, 25 bp, Mus musculus
tgttggacagaaagcgtgatttcga

SEQ ID NO: 913714 - DNA, 25 bp, Mus musculus
tgttggacagaatgcgtgatttcga

SEQ ID NO: 913715 - DNA, 25 bp, Mus musculus
tgttggacatcaatgctttgttcac

SEQ ID NO: 913716 - DNA, 25 bp, Mus musculus
tgttggacatcattgctttgttcac

SEQ ID NO: 913717 - DNA, 25 bp, Mus musculus
tgttggaccagactacagccttgct

SEQ ID NO: 913718 - DNA, 25 bp, Mus musculus
tgttggaccagagtacagccttgct

SEQ ID NO: 913719 - DNA, 25 bp, Mus musculus
tgttggaccattatcggtatccttt

SEQ ID NO: 913720 - DNA, 25 bp, Mus musculus
tgttggaccattttcggtatccttt

SEQ ID NO: 913721 - DNA, 25 bp, Mus musculus
tgttggaccttcatagccggacgtg

SEQ ID NO: 913722 - DNA, 25 bp, Mus musculus
tgttggaccttcttagccggacgtg

SEQ ID NO: 913723 - DNA, 25 bp, Mus musculus
tgttggacgttgaacagaggacatg

SEQ ID NO: 913724 - DNA, 25 bp, Mus musculus
tgttggacgttgtacagaggacatg

SEQ ID NO: 913725 - DNA, 25 bp, Mus musculus
tgttggactctactgagcttgcctc

SEQ ID NO: 913726 - DNA, 25 bp, Mus musculus
tgttggactctagtgagcttgcctc

SEQ ID NO: 913727 - DNA, 25 bp, Mus musculus
tgttggagaattcccatctcatggg

SEQ ID NO: 913728 - DNA, 25 bp, Mus musculus
tgttggagaattgccatctcatggg

SEQ ID NO: 913729 - DNA, 25 bp, Mus musculus
tgttggagcatcattgcacctcaga

SEQ ID NO: 913730 - DNA, 25 bp, Mus musculus
tgttggagcatctttgcacctcaga

SEQ ID NO: 913731 - DNA, 25 bp, Mus musculus
tgttggagcctgagcttcagggtat

SEQ ID NO: 913732 - DNA, 25 bp, Mus musculus
tgttggagcctgtgcttcagggtat

SEQ ID NO: 913733 - DNA, 25 bp, Mus musculus
tgttggagcttaaaccccttgtata

SEQ ID NO: 913734 - DNA, 25 bp, Mus musculus
tgttggagcttataccccttgtata

SEQ ID NO: 913735 - DNA, 25 bp, Mus musculus
tgttggaggaacacttccgtttgtt

SEQ ID NO: 913736 - DNA, 25 bp, Mus musculus
tgttggaggaactcttccgtttgtt

SEQ ID NO: 913737 - DNA, 25 bp, Mus musculus
tgttggaggagcactgcagctcttc

SEQ ID NO: 913738 - DNA, 25 bp, Mus musculus
tgttggaggagctctgcagctcttc

SEQ ID NO: 913739 - DNA, 25 bp, Mus musculus
tgttggaggcatatggaccatgttt

SEQ ID NO: 913740 - DNA, 25 bp, Mus musculus
tgttggaggcatttggaccatgttt

SEQ ID NO: 913741 - DNA, 25 bp, Mus musculus
tgttggaggcttcgctcaccgaaaa

SEQ ID NO: 913742 - DNA, 25 bp, Mus musculus
tgttggaggcttggctcaccgaaaa

SEQ ID NO: 913743 - DNA, 25 bp, Mus musculus
tgttggaggtgcagatgctgcacac

SEQ ID NO: 913744 - DNA, 25 bp, Mus musculus
tgttggaggtgctgatgctgcacac

SEQ ID NO: 913745 - DNA, 25 bp, Mus musculus
tgttggagtaaactaggcgctgatc

SEQ ID NO: 913746 - DNA, 25 bp, Mus musculus
tgttggagtaaagtaggcgctgatc

SEQ ID NO: 913747 - DNA, 25 bp, Mus musculus
tgttggagtccaatccctttaaagt

SEQ ID NO: 913748 - DNA, 25 bp, Mus musculus
tgttggagtccattccctttaaagt

SEQ ID NO: 913749 - DNA, 25 bp, Mus musculus
tgttggagtgatcctctccactatc

SEQ ID NO: 913750 - DNA, 25 bp, Mus musculus
tgttggagtgatgctctccactatc

SEQ ID NO: 913751 - DNA, 25 bp, Mus musculus
tgttggagtggaagtggccctgtta

SEQ ID NO: 913752 - DNA, 25 bp, Mus musculus
tgttggagtggatgtggccctgtta

SEQ ID NO: 913753 - DNA, 25 bp, Mus musculus
tgttggagttttcagacatttttgt

SEQ ID NO: 913754 - DNA, 25 bp, Mus musculus
tgttggagttttgagacatttttgt

SEQ ID NO: 913755 - DNA, 25 bp, Mus musculus
tgttggatcagtcgtacaaggtgct

SEQ ID NO: 913756 - DNA, 25 bp, Mus musculus
tgttggatcagtggtacaaggtgct

SEQ ID NO: 913757 - DNA, 25 bp, Mus musculus
tgttggatggcaactcccatctcat

SEQ ID NO: 913758 - DNA, 25 bp, Mus musculus
tgttggatggcaagcccattggcgc

SEQ ID NO: 913759 - DNA, 25 bp, Mus musculus
tgttggatggcatctcccatctcat

SEQ ID NO: 913760 - DNA, 25 bp, Mus musculus
tgttggatggcatgcccattggcgc

SEQ ID NO: 913761 - DNA, 25 bp, Mus musculus
tgttggattcacactgcagggactt

SEQ ID NO: 913762 - DNA, 25 bp, Mus musculus
tgttggattcactctgcagggactt

SEQ ID NO: 913763 - DNA, 25 bp, Mus musculus
tgttggcaagcgcagtgtttttact

SEQ ID NO: 913764 - DNA, 25 bp, Mus musculus
tgttggcaagcggagtgtttttact

SEQ ID NO: 913765 - DNA, 25 bp, Mus musculus
tgttggcaatgcagaccgcgcaatt

SEQ ID NO: 913766 - DNA, 25 bp, Mus musculus
tgttggcaatgccttccttgttaca

SEQ ID NO: 913767 - DNA, 25 bp, Mus musculus
tgttggcaatgcgttccttgttaca

SEQ ID NO: 913768 - DNA, 25 bp, Mus musculus
tgttggcaatgctgaccgcgcaatt

SEQ ID NO: 913769 - DNA, 25 bp, Mus musculus
tgttggcacagaccactcaggagtt

SEQ ID NO: 913770 - DNA, 25 bp, Mus musculus
tgttggcacagagcactcaggagtt

SEQ ID NO: 913771 - DNA, 25 bp, Mus musculus
tgttggcacagtatccgctaacgga

SEQ ID NO: 913772 - DNA, 25 bp, Mus musculus
tgttggcacagtttccgctaacgga

SEQ ID NO: 913773 - DNA, 25 bp, Mus musculus
tgttggcactccctagagattcttg

SEQ ID NO: 913774 - DNA, 25 bp, Mus musculus
tgttggcactccgtagagattcttg

SEQ ID NO: 913775 - DNA, 25 bp, Mus musculus
tgttggcacttgctttctgtggagc

SEQ ID NO: 913776 - DNA, 25 bp, Mus musculus
tgttggcacttggtttctgtggagc

SEQ ID NO: 913777 - DNA, 25 bp, Mus musculus
tgttggcagaacaacctggacttcc

SEQ ID NO: 913778 - DNA, 25 bp, Mus musculus
tgttggcagaactacctggacttcc

SEQ ID NO: 913779 - DNA, 25 bp, Mus musculus
tgttggcagcacaacaaaccctcag

SEQ ID NO: 913780 - DNA, 25 bp, Mus musculus
tgttggcagcactacaaaccctcag

SEQ ID NO: 913781 - DNA, 25 bp, Mus musculus
tgttggcagtctatctcagttaccc

SEQ ID NO: 913782 - DNA, 25 bp, Mus musculus
tgttggcagtctttctcagttaccc

SEQ ID NO: 913783 - DNA, 25 bp, Mus musculus
tgttggcatgagcacagtcccagaa

SEQ ID NO: 913784 - DNA, 25 bp, Mus musculus
tgttggcatgaggacagtcccagaa

SEQ ID NO: 913785 - DNA, 25 bp, Mus musculus
tgttggcatgttaaggaagcctcct

SEQ ID NO: 913786 - DNA, 25 bp, Mus musculus
tgttggcatgtttaggaagcctcct

SEQ ID NO: 913787 - DNA, 25 bp, Mus musculus
tgttggccaaatatcctagaatacc

SEQ ID NO: 913788 - DNA, 25 bp, Mus musculus
tgttggccaaatttcctagaatacc

SEQ ID NO: 913789 - DNA, 25 bp, Mus musculus
tgttggccacacagcagggcgagcc

SEQ ID NO: 913790 - DNA, 25 bp, Mus musculus
tgttggccacactgcagggcgagcc

SEQ ID NO: 913791 - DNA, 25 bp, Mus musculus
tgttggccattcaacatgacagtga

SEQ ID NO: 913792 - DNA, 25 bp, Mus musculus
tgttggccattcactcgaagcactt

SEQ ID NO: 913793 - DNA, 25 bp, Mus musculus
tgttggccattctacatgacagtga

SEQ ID NO: 913794 - DNA, 25 bp, Mus musculus
tgttggccattctctcgaagcactt

SEQ ID NO: 913795 - DNA, 25 bp, Mus musculus
tgttggcccaggaggcaccggatcc

SEQ ID NO: 913796 - DNA, 25 bp, Mus musculus
tgttggcccaggtggcaccggatcc

SEQ ID NO: 913797 - DNA, 25 bp, Mus musculus
tgttggcccatcatttcactggtat

SEQ ID NO: 913798 - DNA, 25 bp, Mus musculus
tgttggcccatcttttcactggtat

SEQ ID NO: 913799 - DNA, 25 bp, Mus musculus
tgttggccctgcaggtactagtcca

SEQ ID NO: 913800 - DNA, 25 bp, Mus musculus
tgttggccctgctggtactagtcca

SEQ ID NO: 913801 - DNA, 25 bp, Mus musculus
tgttggccgagcatcactcatgact

SEQ ID NO: 913802 - DNA, 25 bp, Mus musculus
tgttggccgagcttcactcatgact

SEQ ID NO: 913803 - DNA, 25 bp, Mus musculus
tgttggccggctatgtgtctctctt

SEQ ID NO: 913804 - DNA, 25 bp, Mus musculus
tgttggccggctttgtgtctctctt

SEQ ID NO: 913805 - DNA, 25 bp, Mus musculus
tgttggcctcacattgcaatcagaa

SEQ ID NO: 913806 - DNA, 25 bp, Mus musculus
tgttggcctcactttgcaatcagaa

SEQ ID NO: 913807 - DNA, 25 bp, Mus musculus
tgttggcctcagaggaataggatgt

SEQ ID NO: 913808 - DNA, 25 bp, Mus musculus
tgttggcctcagtggaataggatgt

SEQ ID NO: 913809 - DNA, 25 bp, Mus musculus
tgttggcctcccaaaagatcatcgg

SEQ ID NO: 913810 - DNA, 25 bp, Mus musculus
tgttggcctccctaaagatcatcgg

SEQ ID NO: 913811 - DNA, 25 bp, Mus musculus
tgttggcctctcagactccagaagc

SEQ ID NO: 913812 - DNA, 25 bp, Mus musculus
tgttggcctctctgactccagaagc

SEQ ID NO: 913813 - DNA, 25 bp, Mus musculus
tgttggccttccacatatgactcaa

SEQ ID NO: 913814 - DNA, 25 bp, Mus musculus
tgttggccttcctcatatgactcaa

SEQ ID NO: 913815 - DNA, 25 bp, Mus musculus
tgttggcggaagattgcccctaaag

SEQ ID NO: 913816 - DNA, 25 bp, Mus musculus
tgttggcggaagtttgcccctaaag

SEQ ID NO: 913817 - DNA, 25 bp, Mus musculus
tgttggctaaatcagcagggactct

SEQ ID NO: 913818 - DNA, 25 bp, Mus musculus
tgttggctaaatgagcagggactct

SEQ ID NO: 913819 - DNA, 25 bp, Mus musculus
tgttggctcagcctttgatcctagt

SEQ ID NO: 913820 - DNA, 25 bp, Mus musculus
tgttggctcagcgtttgatcctagt

SEQ ID NO: 913821 - DNA, 25 bp, Mus musculus
tgttggctcggcagtgtcgaatcta

SEQ ID NO: 913822 - DNA, 25 bp, Mus musculus
tgttggctcggctgtgtcgaatcta

SEQ ID NO: 913823 - DNA, 25 bp, Mus musculus
tgttggctctggactttgtctttct

SEQ ID NO: 913824 - DNA, 25 bp, Mus musculus
tgttggctctggtctttgtctttct

SEQ ID NO: 913825 - DNA, 25 bp, Mus musculus
tgttggctgctcactttaagcactg

SEQ ID NO: 913826 - DNA, 25 bp, Mus musculus
tgttggctgctctctttaagcactg

SEQ ID NO: 913827 - DNA, 25 bp, Mus musculus
tgttggctggccaatttatgtaata

SEQ ID NO: 913828 - DNA, 25 bp, Mus musculus
tgttggctggcctatttatgtaata

SEQ ID NO: 913829 - DNA, 25 bp, Mus musculus
tgttggcttagcatcacctgaggca

SEQ ID NO: 913830 - DNA, 25 bp, Mus musculus
tgttggcttagcttcacctgaggca

SEQ ID NO: 913831 - DNA, 25 bp, Mus musculus
tgttggcttcagactgttgtgggta

SEQ ID NO: 913832 - DNA, 25 bp, Mus musculus
tgttggcttcagtctgttgtgggta

SEQ ID NO: 913833 - DNA, 25 bp, Mus musculus
tgttggcttgccactgaacctctgt

SEQ ID NO: 913834 - DNA, 25 bp, Mus musculus
tgttggcttgcctctgaacctctgt

SEQ ID NO: 913835 - DNA, 25 bp, Mus musculus
tgttggcttttgattccaatgtctt

SEQ ID NO: 913836 - DNA, 25 bp, Mus musculus
tgttggcttttgtttccaatgtctt

SEQ ID NO: 913837 - DNA, 25 bp, Mus musculus
tgttgggaccacaaaataggacctt

SEQ ID NO: 913838 - DNA, 25 bp, Mus musculus
tgttgggaccactaaataggacctt

SEQ ID NO: 913839 - DNA, 25 bp, Mus musculus
tgttgggacttgaaggccagcccat

SEQ ID NO: 913840 - DNA, 25 bp, Mus musculus
tgttgggacttgtaggccagcccat

SEQ ID NO: 913841 - DNA, 25 bp, Mus musculus
tgttgggaggatcggcttcatgcct

SEQ ID NO: 913842 - DNA, 25 bp, Mus musculus
tgttgggaggatgggcttcatgcct

SEQ ID NO: 913843 - DNA, 25 bp, Mus musculus
tgttgggataatcggccccactcag

SEQ ID NO: 913844 - DNA, 25 bp, Mus musculus
tgttgggataatgggccccactcag

SEQ ID NO: 913845 - DNA, 25 bp, Mus musculus
tgttgggcagccatcctactgctca

SEQ ID NO: 913846 - DNA, 25 bp, Mus musculus
tgttgggcagccttcctactgctca

SEQ ID NO: 913847 - DNA, 25 bp, Mus musculus
tgttgggcatatcaccctttatttt

SEQ ID NO: 913848 - DNA, 25 bp, Mus musculus
tgttgggcatatgaccctttatttt

SEQ ID NO: 913849 - DNA, 25 bp, Mus musculus
tgttgggcatctagctacaccctta

SEQ ID NO: 913850 - DNA, 25 bp, Mus musculus
tgttgggcatcttgctacaccctta

SEQ ID NO: 913851 - DNA, 25 bp, Mus musculus
tgttgggcccaaatccgcataggag

SEQ ID NO: 913852 - DNA, 25 bp, Mus musculus
tgttgggcccaattccgcataggag

SEQ ID NO: 913853 - DNA, 25 bp, Mus musculus
tgttgggctactactagcacagcaa

SEQ ID NO: 913854 - DNA, 25 bp, Mus musculus
tgttgggctacttctagcacagcaa

SEQ ID NO: 913855 - DNA, 25 bp, Mus musculus
tgttgggctagtatctgtaggctct

SEQ ID NO: 913856 - DNA, 25 bp, Mus musculus
tgttgggctagtttctgtaggctct

SEQ ID NO: 913857 - DNA, 25 bp, Mus musculus
tgttgggcttgaatcggttactgct

SEQ ID NO: 913858 - DNA, 25 bp, Mus musculus
tgttgggcttgattcggttactgct

SEQ ID NO: 913859 - DNA, 25 bp, Mus musculus
tgttgggcttgcagcctgagccgcc

SEQ ID NO: 913860 - DNA, 25 bp, Mus musculus
tgttgggcttgctgcctgagccgcc

SEQ ID NO: 913861 - DNA, 25 bp, Mus musculus
tgttgggtaaggcagtcactctcta

SEQ ID NO: 913862 - DNA, 25 bp, Mus musculus
tgttgggtaagggagtcactctcta

SEQ ID NO: 913863 - DNA, 25 bp, Mus musculus
tgttgggtacgccttcttcttctct

SEQ ID NO: 913864 - DNA, 25 bp, Mus musculus
tgttgggtacgcgttcttcttctct

SEQ ID NO: 913865 - DNA, 25 bp, Mus musculus
tgttgggtcacaactgagctatcag

SEQ ID NO: 913866 - DNA, 25 bp, Mus musculus
tgttgggtcacatctgagctatcag

SEQ ID NO: 913867 - DNA, 25 bp, Mus musculus
tgttgggtctgtacaggaggtctcc

SEQ ID NO: 913868 - DNA, 25 bp, Mus musculus
tgttgggtctgttcaggaggtctcc

SEQ ID NO: 913869 - DNA, 25 bp, Mus musculus
tgttgggtgaaacccaggtcccttg

SEQ ID NO: 913870 - DNA, 25 bp, Mus musculus
tgttgggtgaaagccaggtcccttg

SEQ ID NO: 913871 - DNA, 25 bp, Mus musculus
tgttgggtggagacatcttcttgca

SEQ ID NO: 913872 - DNA, 25 bp, Mus musculus
tgttgggtggagtcatcttcttgca

SEQ ID NO: 913873 - DNA, 25 bp, Mus musculus
tgttgggttgtactctctctgtaga

SEQ ID NO: 913874 - DNA, 25 bp, Mus musculus
tgttgggttgtagtctctctgtaga

SEQ ID NO: 913875 - DNA, 25 bp, Mus musculus
tgttgggtttctctcgttcactcgg

SEQ ID NO: 913876 - DNA, 25 bp, Mus musculus
tgttgggtttctgtcgttcactcgg

SEQ ID NO: 913877 - DNA, 25 bp, Mus musculus
tgttggtactgtctggttgttcttg

SEQ ID NO: 913878 - DNA, 25 bp, Mus musculus
tgttggtactgtgtggttgttcttg

SEQ ID NO: 913879 - DNA, 25 bp, Mus musculus
tgttggtagagactggattcgaatc

SEQ ID NO: 913880 - DNA, 25 bp, Mus musculus
tgttggtagagagtggattcgaatc

SEQ ID NO: 913881 - DNA, 25 bp, Mus musculus
tgttggtagccaagtcggagcccca

SEQ ID NO: 913882 - DNA, 25 bp, Mus musculus
tgttggtagccatgtcggagcccca

SEQ ID NO: 913883 - DNA, 25 bp, Mus musculus
tgttggtagtttatcctaatgccct

SEQ ID NO: 913884 - DNA, 25 bp, Mus musculus
tgttggtagtttttcctaatgccct

SEQ ID NO: 913885 - DNA, 25 bp, Mus musculus
tgttggtataccattgccgacccct

SEQ ID NO: 913886 - DNA, 25 bp, Mus musculus
tgttggtatacctttgccgacccct

SEQ ID NO: 913887 - DNA, 25 bp, Mus musculus
tgttggtatagacaggacccagctc

SEQ ID NO: 913888 - DNA, 25 bp, Mus musculus
tgttggtatagagaggacccagctc

SEQ ID NO: 913889 - DNA, 25 bp, Mus musculus
tgttggtatcccatttaaaatctga

SEQ ID NO: 913890 - DNA, 25 bp, Mus musculus
tgttggtatcccttttaaaatctga

SEQ ID NO: 913891 - DNA, 25 bp, Mus musculus
tgttggtatctgaggcacttcactg

SEQ ID NO: 913892 - DNA, 25 bp, Mus musculus
tgttggtatctgtggcacttcactg

SEQ ID NO: 913893 - DNA, 25 bp, Mus musculus
tgttggtattttactacttgtcctt

SEQ ID NO: 913894 - DNA, 25 bp, Mus musculus
tgttggtattttatagcacctgata

SEQ ID NO: 913895 - DNA, 25 bp, Mus musculus
tgttggtatttttctacttgtcctt

SEQ ID NO: 913896 - DNA, 25 bp, Mus musculus
tgttggtattttttagcacctgata

SEQ ID NO: 913897 - DNA, 25 bp, Mus musculus
tgttggtcacataatcagctacatg

SEQ ID NO: 913898 - DNA, 25 bp, Mus musculus
tgttggtcacattatcagctacatg

SEQ ID NO: 913899 - DNA, 25 bp, Mus musculus
tgttggtcagtcaattgcagagagc

SEQ ID NO: 913900 - DNA, 25 bp, Mus musculus
tgttggtcagtctattgcagagagc

SEQ ID NO: 913901 - DNA, 25 bp, Mus musculus
tgttggtctctgatgtgcttactgc

SEQ ID NO: 913902 - DNA, 25 bp, Mus musculus
tgttggtctctgttgtgcttactgc

SEQ ID NO: 913903 - DNA, 25 bp, Mus musculus
tgttggtctgaaatctcctaactcc

SEQ ID NO: 913904 - DNA, 25 bp, Mus musculus
tgttggtctgaattctcctaactcc

SEQ ID NO: 913905 - DNA, 25 bp, Mus musculus
tgttggtgatccagcgtccggatgc

SEQ ID NO: 913906 - DNA, 25 bp, Mus musculus
tgttggtgatcctgcgtccggatgc

SEQ ID NO: 913907 - DNA, 25 bp, Mus musculus
tgttggtgatgcctgtccctagcca

SEQ ID NO: 913908 - DNA, 25 bp, Mus musculus
tgttggtgatgcgtgtccctagcca

SEQ ID NO: 913909 - DNA, 25 bp, Mus musculus
tgttggtgcaacctcgaacatccag

SEQ ID NO: 913910 - DNA, 25 bp, Mus musculus
tgttggtgcaacgtcgaacatccag

SEQ ID NO: 913911 - DNA, 25 bp, Mus musculus
tgttggtggaccctgttaccatggc

SEQ ID NO: 913912 - DNA, 25 bp, Mus musculus
tgttggtggaccgtgttaccatggc

SEQ ID NO: 913913 - DNA, 25 bp, Mus musculus
tgttggtggtgtcaactgaacccag

SEQ ID NO: 913914 - DNA, 25 bp, Mus musculus
tgttggtggtgtgaactgaacccag

SEQ ID NO: 913915 - DNA, 25 bp, Mus musculus
tgttggtgtcctctcccaactacac

SEQ ID NO: 913916 - DNA, 25 bp, Mus musculus
tgttggtgtcctgtcccaactacac

SEQ ID NO: 913917 - DNA, 25 bp, Mus musculus
tgttggttagacacaggtagctctg

SEQ ID NO: 913918 - DNA, 25 bp, Mus musculus
tgttggttagactcaggtagctctg

SEQ ID NO: 913919 - DNA, 25 bp, Mus musculus
tgttggttccaactgcctgagggca

SEQ ID NO: 913920 - DNA, 25 bp, Mus musculus
tgttggttccaagtgcctgagggca

SEQ ID NO: 913921 - DNA, 25 bp, Mus musculus
tgttggttccgaatgtgtagtctgg

SEQ ID NO: 913922 - DNA, 25 bp, Mus musculus
tgttggttccgattgtgtagtctgg

SEQ ID NO: 913923 - DNA, 25 bp, Mus musculus
tgttggttcttgattgcctcctgag

SEQ ID NO: 913924 - DNA, 25 bp, Mus musculus
tgttggttcttgtttgcctcctgag

SEQ ID NO: 913925 - DNA, 25 bp, Mus musculus
tgttggttgcatcattcctgtcagg

SEQ ID NO: 913926 - DNA, 25 bp, Mus musculus
tgttggttgcatgattcctgtcagg

SEQ ID NO: 913927 - DNA, 25 bp, Mus musculus
tgttggttggagagtctccgttccc

SEQ ID NO: 913928 - DNA, 25 bp, Mus musculus
tgttggttggagtgtctccgttccc

SEQ ID NO: 913929 - DNA, 25 bp, Mus musculus
tgttggttggttatattcatggata

SEQ ID NO: 913930 - DNA, 25 bp, Mus musculus
tgttggttggttatttcctgctttg

SEQ ID NO: 913931 - DNA, 25 bp, Mus musculus
tgttggttggttttattcatggata

SEQ ID NO: 913932 - DNA, 25 bp, Mus musculus
tgttggttggttttttcctgctttg

SEQ ID NO: 913933 - DNA, 25 bp, Mus musculus
tgttggtttcatagtagcggactac

SEQ ID NO: 913934 - DNA, 25 bp, Mus musculus
tgttggtttcattgtagcggactac

SEQ ID NO: 913935 - DNA, 25 bp, Mus musculus
tgttggtttccaaggcagcaagaag

SEQ ID NO: 913936 - DNA, 25 bp, Mus musculus
tgttggtttccatggcagcaagaag

SEQ ID NO: 913937 - DNA, 25 bp, Mus musculus
tgttggtttcccatgtcctgatgac

SEQ ID NO: 913938 - DNA, 25 bp, Mus musculus
tgttggtttcccttgtcctgatgac

SEQ ID NO: 913939 - DNA, 25 bp, Mus musculus
tgttggtttcctccctgtaagatac

SEQ ID NO: 913940 - DNA, 25 bp, Mus musculus
tgttggtttcctgcctgtaagatac

SEQ ID NO: 913941 - DNA, 25 bp, Mus musculus
tgttggtttgggaatttccctctca

SEQ ID NO: 913942 - DNA, 25 bp, Mus musculus
tgttggtttgggtatttccctctca

SEQ ID NO: 913943 - DNA, 25 bp, Mus musculus
tgttggttttgtatcacgtgtcttc

SEQ ID NO: 913944 - DNA, 25 bp, Mus musculus
tgttggttttgtttcacgtgtcttc

SEQ ID NO: 913945 - DNA, 25 bp, Mus musculus
tgttgtaaatacatggacagaggtt

SEQ ID NO: 913946 - DNA, 25 bp, Mus musculus
tgttgtaaatacttggacagaggtt

SEQ ID NO: 913947 - DNA, 25 bp, Mus musculus
tgttgtaaatgtcggagcccctcgt

SEQ ID NO: 913948 - DNA, 25 bp, Mus musculus
tgttgtaaatgtgggagcccctcgt

SEQ ID NO: 913949 - DNA, 25 bp, Mus musculus
tgttgtaactggagttgtccgctct

SEQ ID NO: 913950 - DNA, 25 bp, Mus musculus
tgttgtaactggtgttgtccgctct

SEQ ID NO: 913951 - DNA, 25 bp, Mus musculus
tgttgtaagattccttgttcaaacc

SEQ ID NO: 913952 - DNA, 25 bp, Mus musculus
tgttgtaagattgcttgttcaaacc

SEQ ID NO: 913953 - DNA, 25 bp, Mus musculus
tgttgtaagggaccacatgctgact

SEQ ID NO: 913954 - DNA, 25 bp, Mus musculus
tgttgtaagggagcacatgctgact

SEQ ID NO: 913955 - DNA, 25 bp, Mus musculus
tgttgtacacaaacctagaaaaata

SEQ ID NO: 913956 - DNA, 25 bp, Mus musculus
tgttgtacacaacggcataatatgt

SEQ ID NO: 913957 - DNA, 25 bp, Mus musculus
tgttgtacacaagggcataatatgt

SEQ ID NO: 913958 - DNA, 25 bp, Mus musculus
tgttgtacacaatcctagaaaaata

SEQ ID NO: 913959 - DNA, 25 bp, Mus musculus
tgttgtacagaaatggttgactaaa

SEQ ID NO: 913960 - DNA, 25 bp, Mus musculus
tgttgtacagaattggttgactaaa

SEQ ID NO: 913961 - DNA, 25 bp, Mus musculus
tgttgtaccaaaagctacctcctgg

SEQ ID NO: 913962 - DNA, 25 bp, Mus musculus
tgttgtaccaaatgctacctcctgg

SEQ ID NO: 913963 - DNA, 25 bp, Mus musculus
tgttgtaccacaaactatcctccaa

SEQ ID NO: 913964 - DNA, 25 bp, Mus musculus
tgttgtaccacatactatcctccaa

SEQ ID NO: 913965 - DNA, 25 bp, Mus musculus
tgttgtacctacactgcagagtatt

SEQ ID NO: 913966 - DNA, 25 bp, Mus musculus
tgttgtacctactctgcagagtatt

SEQ ID NO: 913967 - DNA, 25 bp, Mus musculus
tgttgtacgagcacttcacctactg

SEQ ID NO: 913968 - DNA, 25 bp, Mus musculus
tgttgtacgagctcttcacctactg

SEQ ID NO: 913969 - DNA, 25 bp, Mus musculus
tgttgtacttgtctggctgtgtaac

SEQ ID NO: 913970 - DNA, 25 bp, Mus musculus
tgttgtacttgtgtggctgtgtaac

SEQ ID NO: 913971 - DNA, 25 bp, Mus musculus
tgttgtagaagcatcctctcccttt

SEQ ID NO: 913972 - DNA, 25 bp, Mus musculus
tgttgtagaagcttcctctcccttt

SEQ ID NO: 913973 - DNA, 25 bp, Mus musculus
tgttgtagaagtacctctgcctgga

SEQ ID NO: 913974 - DNA, 25 bp, Mus musculus
tgttgtagaagttcctctgcctgga

SEQ ID NO: 913975 - DNA, 25 bp, Mus musculus
tgttgtagactacgatggctttgaa

SEQ ID NO: 913976 - DNA, 25 bp, Mus musculus
tgttgtagactaggatggctttgaa

SEQ ID NO: 913977 - DNA, 25 bp, Mus musculus
tgttgtagcatcagtactgggattt

SEQ ID NO: 913978 - DNA, 25 bp, Mus musculus
tgttgtagcatctgtactgggattt

SEQ ID NO: 913979 - DNA, 25 bp, Mus musculus
tgttgtagcccgagtctactccagg

SEQ ID NO: 913980 - DNA, 25 bp, Mus musculus
tgttgtagcccgtgtctactccagg

SEQ ID NO: 913981 - DNA, 25 bp, Mus musculus
tgttgtagctggaaatggctccaga

SEQ ID NO: 913982 - DNA, 25 bp, Mus musculus
tgttgtagctggtaatggctccaga

SEQ ID NO: 913983 - DNA, 25 bp, Mus musculus
tgttgtaggaccctgcagatacaaa

SEQ ID NO: 913984 - DNA, 25 bp, Mus musculus
tgttgtaggaccgtgcagatacaaa

SEQ ID NO: 913985 - DNA, 25 bp, Mus musculus
tgttgtagtatgcagggccccttca

SEQ ID NO: 913986 - DNA, 25 bp, Mus musculus
tgttgtagtatggagggccccttca

SEQ ID NO: 913987 - DNA, 25 bp, Mus musculus
tgttgtataggaattccctccctca

SEQ ID NO: 913988 - DNA, 25 bp, Mus musculus
tgttgtataggatttccctccctca

SEQ ID NO: 913989 - DNA, 25 bp, Mus musculus
tgttgtatctgtatcctgttttcat

SEQ ID NO: 913990 - DNA, 25 bp, Mus musculus
tgttgtatctgtttcctgttttcat

SEQ ID NO: 913991 - DNA, 25 bp, Mus musculus
tgttgtattaacaccaccctctgca

SEQ ID NO: 913992 - DNA, 25 bp, Mus musculus
tgttgtattaacatctttgatgctc

SEQ ID NO: 913993 - DNA, 25 bp, Mus musculus
tgttgtattaactccaccctctgca

SEQ ID NO: 913994 - DNA, 25 bp, Mus musculus
tgttgtattaacttctttgatgctc

SEQ ID NO: 913995 - DNA, 25 bp, Mus musculus
tgttgtattttccactcttttccca

SEQ ID NO: 913996 - DNA, 25 bp, Mus musculus
tgttgtattttcgactcttttccca

SEQ ID NO: 913997 - DNA, 25 bp, Mus musculus
tgttgtcaaattcaggcctccatgt

SEQ ID NO: 913998 - DNA, 25 bp, Mus musculus
tgttgtcaaattgaggcctccatgt

SEQ ID NO: 913999 - DNA, 25 bp, Mus musculus
tgttgtcaacaacttcttgctcata

SEQ ID NO: 914000 - DNA, 25 bp, Mus musculus
tgttgtcaacaagttcttgctcata

SEQ ID NO: 914001 - DNA, 25 bp, Mus musculus
tgttgtcaactaccagtcaatttgg

SEQ ID NO: 914002 - DNA, 25 bp, Mus musculus
tgttgtcaactagcagtcaatttgg

SEQ ID NO: 914003 - DNA, 25 bp, Mus musculus
tgttgtcaacttcaagacccctggt

SEQ ID NO: 914004 - DNA, 25 bp, Mus musculus
tgttgtcaacttgaagacccctggt

SEQ ID NO: 914005 - DNA, 25 bp, Mus musculus
tgttgtcacacactcctttagagga

SEQ ID NO: 914006 - DNA, 25 bp, Mus musculus
tgttgtcacacagtcctttagagga

SEQ ID NO: 914007 - DNA, 25 bp, Mus musculus
tgttgtcacatcacttcatgggtca

SEQ ID NO: 914008 - DNA, 25 bp, Mus musculus
tgttgtcacatctcttcatgggtca

SEQ ID NO: 914009 - DNA, 25 bp, Mus musculus
tgttgtcaccataaatagttctcag

SEQ ID NO: 914010 - DNA, 25 bp, Mus musculus
tgttgtcaccattaatagttctcag

SEQ ID NO: 914011 - DNA, 25 bp, Mus musculus
tgttgtcaccccatcttaatgtgga

SEQ ID NO: 914012 - DNA, 25 bp, Mus musculus
tgttgtcaccccttcttaatgtgga

SEQ ID NO: 914013 - DNA, 25 bp, Mus musculus
tgttgtcacttccacctgtacactg

SEQ ID NO: 914014 - DNA, 25 bp, Mus musculus
tgttgtcacttcgacctgtacactg

SEQ ID NO: 914015 - DNA, 25 bp, Mus musculus
tgttgtcagcctctttccattttca

SEQ ID NO: 914016 - DNA, 25 bp, Mus musculus
tgttgtcagcctgtttccattttca

SEQ ID NO: 914017 - DNA, 25 bp, Mus musculus
tgttgtcagtaaatcctacccttct

SEQ ID NO: 914018 - DNA, 25 bp, Mus musculus
tgttgtcagtaattcctacccttct

SEQ ID NO: 914019 - DNA, 25 bp, Mus musculus
tgttgtcagtcacaggcttctgccg

SEQ ID NO: 914020 - DNA, 25 bp, Mus musculus
tgttgtcagtcagaggcttctgccg

SEQ ID NO: 914021 - DNA, 25 bp, Mus musculus
tgttgtcagtcgagtgcagttttct

SEQ ID NO: 914022 - DNA, 25 bp, Mus musculus
tgttgtcagtcgtgtgcagttttct

SEQ ID NO: 914023 - DNA, 25 bp, Mus musculus
tgttgtcatcacagagtcaccactc

SEQ ID NO: 914024 - DNA, 25 bp, Mus musculus
tgttgtcatcactgagtcaccactc

SEQ ID NO: 914025 - DNA, 25 bp, Mus musculus
tgttgtcatgccagtcaggtgcaaa

SEQ ID NO: 914026 - DNA, 25 bp, Mus musculus
tgttgtcatgcctgtcaggtgcaaa

SEQ ID NO: 914027 - DNA, 25 bp, Mus musculus
tgttgtcattgaaagaagcctgttg

SEQ ID NO: 914028 - DNA, 25 bp, Mus musculus
tgttgtcattgatagaagcctgttg

SEQ ID NO: 914029 - DNA, 25 bp, Mus musculus
tgttgtcatttcatcgctgtcattc

SEQ ID NO: 914030 - DNA, 25 bp, Mus musculus
tgttgtcatttcttcgctgtcattc

SEQ ID NO: 914031 - DNA, 25 bp, Mus musculus
tgttgtccaaatctctccttgcctg

SEQ ID NO: 914032 - DNA, 25 bp, Mus musculus
tgttgtccaaatgtctccttgcctg

SEQ ID NO: 914033 - DNA, 25 bp, Mus musculus
tgttgtccacatctagtgtgccatt

SEQ ID NO: 914034 - DNA, 25 bp, Mus musculus
tgttgtccacatgtagtgtgccatt

SEQ ID NO: 914035 - DNA, 25 bp, Mus musculus
tgttgtccactgaaggtgccattcc

SEQ ID NO: 914036 - DNA, 25 bp, Mus musculus
tgttgtccactgtaggtgccattcc

SEQ ID NO: 914037 - DNA, 25 bp, Mus musculus
tgttgtccacttcagtatattcaga

SEQ ID NO: 914038 - DNA, 25 bp, Mus musculus
tgttgtccacttgagtatattcaga

SEQ ID NO: 914039 - DNA, 25 bp, Mus musculus
tgttgtccattacaaaggcattgtg

SEQ ID NO: 914040 - DNA, 25 bp, Mus musculus
tgttgtccattagaaaggcattgtg

SEQ ID NO: 914041 - DNA, 25 bp, Mus musculus
tgttgtccgccaccagcacgtgaag

SEQ ID NO: 914042 - DNA, 25 bp, Mus musculus
tgttgtccgccagcagcacgtgaag

SEQ ID NO: 914043 - DNA, 25 bp, Mus musculus
tgttgtccgcccagaagagattcct

SEQ ID NO: 914044 - DNA, 25 bp, Mus musculus
tgttgtccgccctgaagagattcct

SEQ ID NO: 914045 - DNA, 25 bp, Mus musculus
tgttgtcctcaaatgggtatctccc

SEQ ID NO: 914046 - DNA, 25 bp, Mus musculus
tgttgtcctcaattgggtatctccc

SEQ ID NO: 914047 - DNA, 25 bp, Mus musculus
tgttgtcctctgctcattgtcacta

SEQ ID NO: 914048 - DNA, 25 bp, Mus musculus
tgttgtcctctggtcattgtcacta

SEQ ID NO: 914049 - DNA, 25 bp, Mus musculus
tgttgtccttgacaccagcgccttg

SEQ ID NO: 914050 - DNA, 25 bp, Mus musculus
tgttgtccttgagaccagcgccttg

SEQ ID NO: 914051 - DNA, 25 bp, Mus musculus
tgttgtccttttcaatggtgggcag

SEQ ID NO: 914052 - DNA, 25 bp, Mus musculus
tgttgtccttttgaatggtgggcag

SEQ ID NO: 914053 - DNA, 25 bp, Mus musculus
tgttgtcgcccgacggcctatgagg

SEQ ID NO: 914054 - DNA, 25 bp, Mus musculus
tgttgtcgcccgtcggcctatgagg

SEQ ID NO: 914055 - DNA, 25 bp, Mus musculus
tgttgtcggtgcagaaagaccctat

SEQ ID NO: 914056 - DNA, 25 bp, Mus musculus
tgttgtcggtgctgaaagaccctat

SEQ ID NO: 914057 - DNA, 25 bp, Mus musculus
tgttgtcggtttataaaagcattgc

SEQ ID NO: 914058 - DNA, 25 bp, Mus musculus
tgttgtcggtttttaaaagcattgc

SEQ ID NO: 914059 - DNA, 25 bp, Mus musculus
tgttgtctaccactgagttctagga

SEQ ID NO: 914060 - DNA, 25 bp, Mus musculus
tgttgtctaccagtgagttctagga

SEQ ID NO: 914061 - DNA, 25 bp, Mus musculus
tgttgtctagcaagtactccaccat

SEQ ID NO: 914062 - DNA, 25 bp, Mus musculus
tgttgtctagcatgtactccaccat

SEQ ID NO: 914063 - DNA, 25 bp, Mus musculus
tgttgtctccacattgcctaagcaa

SEQ ID NO: 914064 - DNA, 25 bp, Mus musculus
tgttgtctccactttgcctaagcaa

SEQ ID NO: 914065 - DNA, 25 bp, Mus musculus
tgttgtctcccacaaggcttcactt

SEQ ID NO: 914066 - DNA, 25 bp, Mus musculus
tgttgtctcccagaaggcttcactt

SEQ ID NO: 914067 - DNA, 25 bp, Mus musculus
tgttgtctccgtagcaacccggtga

SEQ ID NO: 914068 - DNA, 25 bp, Mus musculus
tgttgtctccgttgcaacccggtga

SEQ ID NO: 914069 - DNA, 25 bp, Mus musculus
tgttgtctccttcgctctctgttgc

SEQ ID NO: 914070 - DNA, 25 bp, Mus musculus
tgttgtctccttggctctctgttgc

SEQ ID NO: 914071 - DNA, 25 bp, Mus musculus
tgttgtctctcaccatagtaatgcc

SEQ ID NO: 914072 - DNA, 25 bp, Mus musculus
tgttgtctctcagcatagtaatgcc

SEQ ID NO: 914073 - DNA, 25 bp, Mus musculus
tgttgtctgcaaatctagtctggtc

SEQ ID NO: 914074 - DNA, 25 bp, Mus musculus
tgttgtctgcaactcacccatgggc

SEQ ID NO: 914075 - DNA, 25 bp, Mus musculus
tgttgtctgcaagtcacccatgggc

SEQ ID NO: 914076 - DNA, 25 bp, Mus musculus
tgttgtctgcaattctagtctggtc

SEQ ID NO: 914077 - DNA, 25 bp, Mus musculus
tgttgtctgggtactatgcatgtgt

SEQ ID NO: 914078 - DNA, 25 bp, Mus musculus
tgttgtctgggttctatgcatgtgt

SEQ ID NO: 914079 - DNA, 25 bp, Mus musculus
tgttgtctggttacaactactgtgc

SEQ ID NO: 914080 - DNA, 25 bp, Mus musculus
tgttgtctggtttcaactactgtgc

SEQ ID NO: 914081 - DNA, 25 bp, Mus musculus
tgttgtctgtagaagtgaatcccta

SEQ ID NO: 914082 - DNA, 25 bp, Mus musculus
tgttgtctgtagtagtgaatcccta

SEQ ID NO: 914083 - DNA, 25 bp, Mus musculus
tgttgtctgtccactcttagatgag

SEQ ID NO: 914084 - DNA, 25 bp, Mus musculus
tgttgtctgtcctctcttagatgag

SEQ ID NO: 914085 - DNA, 25 bp, Mus musculus
tgttgtctgtctaggcagctgactc

SEQ ID NO: 914086 - DNA, 25 bp, Mus musculus
tgttgtctgtctctacctgtctgac

SEQ ID NO: 914087 - DNA, 25 bp, Mus musculus
tgttgtctgtctgtacctgtctgac

SEQ ID NO: 914088 - DNA, 25 bp, Mus musculus
tgttgtctgtcttggcagctgactc

SEQ ID NO: 914089 - DNA, 25 bp, Mus musculus
tgttgtctgtgcctcctttcttcat

SEQ ID NO: 914090 - DNA, 25 bp, Mus musculus
tgttgtctgtgcgtcctttcttcat

SEQ ID NO: 914091 - DNA, 25 bp, Mus musculus
tgttgtcttcacagtgatggttcat

SEQ ID NO: 914092 - DNA, 25 bp, Mus musculus
tgttgtcttcactgtgatggttcat

SEQ ID NO: 914093 - DNA, 25 bp, Mus musculus
tgttgtcttcttaggacctcagttt

SEQ ID NO: 914094 - DNA, 25 bp, Mus musculus
tgttgtcttctttggacctcagttt

SEQ ID NO: 914095 - DNA, 25 bp, Mus musculus
tgttgtcttgttcatccctagtgga

SEQ ID NO: 914096 - DNA, 25 bp, Mus musculus
tgttgtcttgttgatccctagtgga

SEQ ID NO: 914097 - DNA, 25 bp, Mus musculus
tgttgtctttagactagggcctgct

SEQ ID NO: 914098 - DNA, 25 bp, Mus musculus
tgttgtctttagtctagggcctgct

SEQ ID NO: 914099 - DNA, 25 bp, Mus musculus
tgttgtctttatcacagcttttttc

SEQ ID NO: 914100 - DNA, 25 bp, Mus musculus
tgttgtctttatgacagcttttttc

SEQ ID NO: 914101 - DNA, 25 bp, Mus musculus
tgttgtgaacgcaaatgcacccaga

SEQ ID NO: 914102 - DNA, 25 bp, Mus musculus
tgttgtgaacgctaatgcacccaga

SEQ ID NO: 914103 - DNA, 25 bp, Mus musculus
tgttgtgaagaaacctctgtgcccg

SEQ ID NO: 914104 - DNA, 25 bp, Mus musculus
tgttgtgaagaatcctctgtgcccg

SEQ ID NO: 914105 - DNA, 25 bp, Mus musculus
tgttgtgaaggcagtggctctgcca

SEQ ID NO: 914106 - DNA, 25 bp, Mus musculus
tgttgtgaaggctgtggctctgcca

SEQ ID NO: 914107 - DNA, 25 bp, Mus musculus
tgttgtgacacacccactgagaggg

SEQ ID NO: 914108 - DNA, 25 bp, Mus musculus
tgttgtgacacagccactgagaggg

SEQ ID NO: 914109 - DNA, 25 bp, Mus musculus
tgttgtgacccaatgtgaaaataaa

SEQ ID NO: 914110 - DNA, 25 bp, Mus musculus
tgttgtgacccattgtgaaaataaa

SEQ ID NO: 914111 - DNA, 25 bp, Mus musculus
tgttgtgacctaccagatttcagaa

SEQ ID NO: 914112 - DNA, 25 bp, Mus musculus
tgttgtgacctacgctaccatgcta

SEQ ID NO: 914113 - DNA, 25 bp, Mus musculus
tgttgtgacctagcagatttcagaa

SEQ ID NO: 914114 - DNA, 25 bp, Mus musculus
tgttgtgacctaggctaccatgcta

SEQ ID NO: 914115 - DNA, 25 bp, Mus musculus
tgttgtgactaacattcggccctgg

SEQ ID NO: 914116 - DNA, 25 bp, Mus musculus
tgttgtgactaagattcggccctgg

SEQ ID NO: 914117 - DNA, 25 bp, Mus musculus
tgttgtgagactatgcaccttgtgc

SEQ ID NO: 914118 - DNA, 25 bp, Mus musculus
tgttgtgagactttgcaccttgtgc

SEQ ID NO: 914119 - DNA, 25 bp, Mus musculus
tgttgtgagcaaatttccctgtgtt

SEQ ID NO: 914120 - DNA, 25 bp, Mus musculus
tgttgtgagcaattttccctgtgtt

SEQ ID NO: 914121 - DNA, 25 bp, Mus musculus
tgttgtgaggctatgcttccgcatc

SEQ ID NO: 914122 - DNA, 25 bp, Mus musculus
tgttgtgaggctttgcttccgcatc

SEQ ID NO: 914123 - DNA, 25 bp, Mus musculus
tgttgtgagggtatttctgtctgtt

SEQ ID NO: 914124 - DNA, 25 bp, Mus musculus
tgttgtgagggtttttctgtctgtt

SEQ ID NO: 914125 - DNA, 25 bp, Mus musculus
tgttgtgagtaccactgctctggga

SEQ ID NO: 914126 - DNA, 25 bp, Mus musculus
tgttgtgagtacgactgctctggga

SEQ ID NO: 914127 - DNA, 25 bp, Mus musculus
tgttgtgataggctagcatggtaat

SEQ ID NO: 914128 - DNA, 25 bp, Mus musculus
tgttgtgatagggtagcatggtaat

SEQ ID NO: 914129 - DNA, 25 bp, Mus musculus
tgttgtgatatccttttgtgttcca

SEQ ID NO: 914130 - DNA, 25 bp, Mus musculus
tgttgtgatatcgttttgtgttcca

SEQ ID NO: 914131 - DNA, 25 bp, Mus musculus
tgttgtgatcaaccctcttttaaaa

SEQ ID NO: 914132 - DNA, 25 bp, Mus musculus
tgttgtgatcaagcctcttttaaaa

SEQ ID NO: 914133 - DNA, 25 bp, Mus musculus
tgttgtgatccactgaacacatagt

SEQ ID NO: 914134 - DNA, 25 bp, Mus musculus
tgttgtgatccagtgaacacatagt

SEQ ID NO: 914135 - DNA, 25 bp, Mus musculus
tgttgtgatctcatctgatgttctc

SEQ ID NO: 914136 - DNA, 25 bp, Mus musculus
tgttgtgatctcttctgatgttctc

SEQ ID NO: 914137 - DNA, 25 bp, Mus musculus
tgttgtgatgctaatgccgcagcta

SEQ ID NO: 914138 - DNA, 25 bp, Mus musculus
tgttgtgatgcttatgccgcagcta

SEQ ID NO: 914139 - DNA, 25 bp, Mus musculus
tgttgtgatggcaggtgtaacctca

SEQ ID NO: 914140 - DNA, 25 bp, Mus musculus
tgttgtgatggctggtgtaacctca

SEQ ID NO: 914141 - DNA, 25 bp, Mus musculus
tgttgtgcaaagactcccttgtcag

SEQ ID NO: 914142 - DNA, 25 bp, Mus musculus
tgttgtgcaaagtctcccttgtcag

SEQ ID NO: 914143 - DNA, 25 bp, Mus musculus
tgttgtgcatataatcctctcattt

SEQ ID NO: 914144 - DNA, 25 bp, Mus musculus
tgttgtgcatattatcctctcattt

SEQ ID NO: 914145 - DNA, 25 bp, Mus musculus
tgttgtgcatcccttgctgcagctc

SEQ ID NO: 914146 - DNA, 25 bp, Mus musculus
tgttgtgcatccgttgctgcagctc

SEQ ID NO: 914147 - DNA, 25 bp, Mus musculus
tgttgtgcattcaatccattttaac

SEQ ID NO: 914148 - DNA, 25 bp, Mus musculus
tgttgtgcattctatccattttaac

SEQ ID NO: 914149 - DNA, 25 bp, Mus musculus
tgttgtgcattgaggtccttcagta

SEQ ID NO: 914150 - DNA, 25 bp, Mus musculus
tgttgtgcattgtggtccttcagta

SEQ ID NO: 914151 - DNA, 25 bp, Mus musculus
tgttgtgcctaaaggcaggaggtct

SEQ ID NO: 914152 - DNA, 25 bp, Mus musculus
tgttgtgcctaatggcaggaggtct

SEQ ID NO: 914153 - DNA, 25 bp, Mus musculus
tgttgtgcgctgctccacgtccgct

SEQ ID NO: 914154 - DNA, 25 bp, Mus musculus
tgttgtgcgctggtccacgtccgct

SEQ ID NO: 914155 - DNA, 25 bp, Mus musculus
tgttgtgctagccacagtagtgcta

SEQ ID NO: 914156 - DNA, 25 bp, Mus musculus
tgttgtgctagcgacagtagtgcta

SEQ ID NO: 914157 - DNA, 25 bp, Mus musculus
tgttgtgctcaaatatcccatgtga

SEQ ID NO: 914158 - DNA, 25 bp, Mus musculus
tgttgtgctcaattatcccatgtga

SEQ ID NO: 914159 - DNA, 25 bp, Mus musculus
tgttgtgctgttctgttgtgatcaa

SEQ ID NO: 914160 - DNA, 25 bp, Mus musculus
tgttgtgctgttgtgttgtgatcaa

SEQ ID NO: 914161 - DNA, 25 bp, Mus musculus
tgttgtgcttcccaacactgactgt

SEQ ID NO: 914162 - DNA, 25 bp, Mus musculus
tgttgtgcttccgaacactgactgt

SEQ ID NO: 914163 - DNA, 25 bp, Mus musculus
tgttgtgctttgaattctggactct

SEQ ID NO: 914164 - DNA, 25 bp, Mus musculus
tgttgtgctttgtattctggactct

SEQ ID NO: 914165 - DNA, 25 bp, Mus musculus
tgttgtggaccacggcatctcagga

SEQ ID NO: 914166 - DNA, 25 bp, Mus musculus
tgttgtggaccagggcatctcagga

SEQ ID NO: 914167 - DNA, 25 bp, Mus musculus
tgttgtggagcacctacacccacat

SEQ ID NO: 914168 - DNA, 25 bp, Mus musculus
tgttgtggagcagctacacccacat

SEQ ID NO: 914169 - DNA, 25 bp, Mus musculus
tgttgtggatccagggacaccaagg

SEQ ID NO: 914170 - DNA, 25 bp, Mus musculus
tgttgtggatcctgggacaccaagg

SEQ ID NO: 914171 - DNA, 25 bp, Mus musculus
tgttgtggattgctgctcatgaccc

SEQ ID NO: 914172 - DNA, 25 bp, Mus musculus
tgttgtggattggtgctcatgaccc

SEQ ID NO: 914173 - DNA, 25 bp, Mus musculus
tgttgtggcaaacaaatctgtcccc

SEQ ID NO: 914174 - DNA, 25 bp, Mus musculus
tgttgtggcaaagaaatctgtcccc

SEQ ID NO: 914175 - DNA, 25 bp, Mus musculus
tgttgtggcattactactcaggaac

SEQ ID NO: 914176 - DNA, 25 bp, Mus musculus
tgttgtggcattatcctgtttacta

SEQ ID NO: 914177 - DNA, 25 bp, Mus musculus
tgttgtggcatttctactcaggaac

SEQ ID NO: 914178 - DNA, 25 bp, Mus musculus
tgttgtggcattttcctgtttacta

SEQ ID NO: 914179 - DNA, 25 bp, Mus musculus
tgttgtggccagagataatttcaga

SEQ ID NO: 914180 - DNA, 25 bp, Mus musculus
tgttgtggccagtgataatttcaga

SEQ ID NO: 914181 - DNA, 25 bp, Mus musculus
tgttgtggcctgatggaggcacata

SEQ ID NO: 914182 - DNA, 25 bp, Mus musculus
tgttgtggcctgttggaggcacata

SEQ ID NO: 914183 - DNA, 25 bp, Mus musculus
tgttgtgtctgcagctaagggtacc

SEQ ID NO: 914184 - DNA, 25 bp, Mus musculus
tgttgtgtctgctgctaagggtacc

SEQ ID NO: 914185 - DNA, 25 bp, Mus musculus
tgttgtgtctttagtataataatta

SEQ ID NO: 914186 - DNA, 25 bp, Mus musculus
tgttgtgtcttttgtataataatta

SEQ ID NO: 914187 - DNA, 25 bp, Mus musculus
tgttgtgtgtggacaaacctaattt

SEQ ID NO: 914188 - DNA, 25 bp, Mus musculus
tgttgtgtgtggtcaaacctaattt

SEQ ID NO: 914189 - DNA, 25 bp, Mus musculus
tgttgtgttcccagccaaggctggg

SEQ ID NO: 914190 - DNA, 25 bp, Mus musculus
tgttgtgttccctgccaaggctggg

SEQ ID NO: 914191 - DNA, 25 bp, Mus musculus
tgttgtgttctgaagagggcctcat

SEQ ID NO: 914192 - DNA, 25 bp, Mus musculus
tgttgtgttctgtagagggcctcat

SEQ ID NO: 914193 - DNA, 25 bp, Mus musculus
tgttgtgttggcattgtgtctaaca

SEQ ID NO: 914194 - DNA, 25 bp, Mus musculus
tgttgtgttggctttgtgtctaaca

SEQ ID NO: 914195 - DNA, 25 bp, Mus musculus
tgttgtgtttccagcagctcatgga

SEQ ID NO: 914196 - DNA, 25 bp, Mus musculus
tgttgtgtttcctgcagctcatgga

SEQ ID NO: 914197 - DNA, 25 bp, Mus musculus
tgttgtgtttgcctctttaagtagc

SEQ ID NO: 914198 - DNA, 25 bp, Mus musculus
tgttgtgtttgcgtctttaagtagc

SEQ ID NO: 914199 - DNA, 25 bp, Mus musculus
tgttgtgtttgtatggacagatcac

SEQ ID NO: 914200 - DNA, 25 bp, Mus musculus
tgttgtgtttgtttggacagatcac

SEQ ID NO: 914201 - DNA, 25 bp, Mus musculus
tgttgtgttttcaccccaaatagat

SEQ ID NO: 914202 - DNA, 25 bp, Mus musculus
tgttgtgttttctccccaaatagat

SEQ ID NO: 914203 - DNA, 25 bp, Mus musculus
tgttgttaagccacagcccttggcc

SEQ ID NO: 914204 - DNA, 25 bp, Mus musculus
tgttgttaagcctcagcccttggcc

SEQ ID NO: 914205 - DNA, 25 bp, Mus musculus
tgttgttaatgcactccccacatag

SEQ ID NO: 914206 - DNA, 25 bp, Mus musculus
tgttgttaatgctctccccacatag

SEQ ID NO: 914207 - DNA, 25 bp, Mus musculus
tgttgttacaacagtcctcggcgac

SEQ ID NO: 914208 - DNA, 25 bp, Mus musculus
tgttgttacaactgtcctcggcgac

SEQ ID NO: 914209 - DNA, 25 bp, Mus musculus
tgttgttaccctaaacactcaaagg

SEQ ID NO: 914210 - DNA, 25 bp, Mus musculus
tgttgttacccttaacactcaaagg

SEQ ID NO: 914211 - DNA, 25 bp, Mus musculus
tgttgttacttcacagcaatgccaa

SEQ ID NO: 914212 - DNA, 25 bp, Mus musculus
tgttgttacttctcagcaatgccaa

SEQ ID NO: 914213 - DNA, 25 bp, Mus musculus
tgttgttagcttacccctgtggcac

SEQ ID NO: 914214 - DNA, 25 bp, Mus musculus
tgttgttagctttcccctgtggcac

SEQ ID NO: 914215 - DNA, 25 bp, Mus musculus
tgttgttatgctatactgtgtattc

SEQ ID NO: 914216 - DNA, 25 bp, Mus musculus
tgttgttatgctttactgtgtattc

SEQ ID NO: 914217 - DNA, 25 bp, Mus musculus
tgttgttatgttagctctcacccat

SEQ ID NO: 914218 - DNA, 25 bp, Mus musculus
tgttgttatgtttgctctcacccat

SEQ ID NO: 914219 - DNA, 25 bp, Mus musculus
tgttgttatttaaagcgagcgggca

SEQ ID NO: 914220 - DNA, 25 bp, Mus musculus
tgttgttatttatagcgagcgggca

SEQ ID NO: 914221 - DNA, 25 bp, Mus musculus
tgttgttccaagacttcggtggttt

SEQ ID NO: 914222 - DNA, 25 bp, Mus musculus
tgttgttccaagtcttcggtggttt

SEQ ID NO: 914223 - DNA, 25 bp, Mus musculus
tgttgttcccacagatgttcgaaaa

SEQ ID NO: 914224 - DNA, 25 bp, Mus musculus
tgttgttcccactgatgttcgaaaa

SEQ ID NO: 914225 - DNA, 25 bp, Mus musculus
tgttgttccctcctgtaggatctat

SEQ ID NO: 914226 - DNA, 25 bp, Mus musculus
tgttgttccctcgtgtaggatctat

SEQ ID NO: 914227 - DNA, 25 bp, Mus musculus
tgttgttccctgataacctctggat

SEQ ID NO: 914228 - DNA, 25 bp, Mus musculus
tgttgttccctgttaacctctggat

SEQ ID NO: 914229 - DNA, 25 bp, Mus musculus
tgttgttccgtaaacctgaggtgtt

SEQ ID NO: 914230 - DNA, 25 bp, Mus musculus
tgttgttccgtatacctgaggtgtt

SEQ ID NO: 914231 - DNA, 25 bp, Mus musculus
tgttgttccgttcgtgtctgtccac

SEQ ID NO: 914232 - DNA, 25 bp, Mus musculus
tgttgttccgttggtgtctgtccac

SEQ ID NO: 914233 - DNA, 25 bp, Mus musculus
tgttgttcctctatactttgttctg

SEQ ID NO: 914234 - DNA, 25 bp, Mus musculus
tgttgttcctctttactttgttctg

SEQ ID NO: 914235 - DNA, 25 bp, Mus musculus
tgttgttcctgaagcccaagggcaa

SEQ ID NO: 914236 - DNA, 25 bp, Mus musculus
tgttgttcctgatgcccaagggcaa

SEQ ID NO: 914237 - DNA, 25 bp, Mus musculus
tgttgttctactcttctaatgccca

SEQ ID NO: 914238 - DNA, 25 bp, Mus musculus
tgttgttctactgttctaatgccca

SEQ ID NO: 914239 - DNA, 25 bp, Mus musculus
tgttgttctcatcagctctatcaga

SEQ ID NO: 914240 - DNA, 25 bp, Mus musculus
tgttgttctcatgagctctatcaga

SEQ ID NO: 914241 - DNA, 25 bp, Mus musculus
tgttgttctcgtcccacacagggat

SEQ ID NO: 914242 - DNA, 25 bp, Mus musculus
tgttgttctcgtgccacacagggat

SEQ ID NO: 914243 - DNA, 25 bp, Mus musculus
tgttgttctctcagtattcacctgc

SEQ ID NO: 914244 - DNA, 25 bp, Mus musculus
tgttgttctctccttgctgtttaaa

SEQ ID NO: 914245 - DNA, 25 bp, Mus musculus
tgttgttctctcgttgctgtttaaa

SEQ ID NO: 914246 - DNA, 25 bp, Mus musculus
tgttgttctctctgtattcacctgc

SEQ ID NO: 914247 - DNA, 25 bp, Mus musculus
tgttgttctgtcatactggcttatt

SEQ ID NO: 914248 - DNA, 25 bp, Mus musculus
tgttgttctgtcttactggcttatt

SEQ ID NO: 914249 - DNA, 25 bp, Mus musculus
tgttgttctgttactacacttcgaa

SEQ ID NO: 914250 - DNA, 25 bp, Mus musculus
tgttgttctgtttctacacttcgaa

SEQ ID NO: 914251 - DNA, 25 bp, Mus musculus
tgttgttcttaacgcctctggtgga

SEQ ID NO: 914252 - DNA, 25 bp, Mus musculus
tgttgttcttaaggcctctggtgga

SEQ ID NO: 914253 - DNA, 25 bp, Mus musculus
tgttgttgacaacacagctccaccc

SEQ ID NO: 914254 - DNA, 25 bp, Mus musculus
tgttgttgacaagacagctccaccc

SEQ ID NO: 914255 - DNA, 25 bp, Mus musculus
tgttgttgacataagccctctcatg

SEQ ID NO: 914256 - DNA, 25 bp, Mus musculus
tgttgttgacattagccctctcatg

SEQ ID NO: 914257 - DNA, 25 bp, Mus musculus
tgttgttgatccaaaccctgcagtc

SEQ ID NO: 914258 - DNA, 25 bp, Mus musculus
tgttgttgatcctaaccctgcagtc

SEQ ID NO: 914259 - DNA, 25 bp, Mus musculus
tgttgttgcaagagccacaccagaa

SEQ ID NO: 914260 - DNA, 25 bp, Mus musculus
tgttgttgcaagtgccacaccagaa

SEQ ID NO: 914261 - DNA, 25 bp, Mus musculus
tgttgttgctcactcagttcatccg

SEQ ID NO: 914262 - DNA, 25 bp, Mus musculus
tgttgttgctcagtcagttcatccg

SEQ ID NO: 914263 - DNA, 25 bp, Mus musculus
tgttgttggagcataaaccccttgt

SEQ ID NO: 914264 - DNA, 25 bp, Mus musculus
tgttgttggagcttaaaccccttgt

SEQ ID NO: 914265 - DNA, 25 bp, Mus musculus
tgttgttgggacattctgtactgcc

SEQ ID NO: 914266 - DNA, 25 bp, Mus musculus
tgttgttgggactttctgtactgcc

SEQ ID NO: 914267 - DNA, 25 bp, Mus musculus
tgttgttgggatagctttgttatag

SEQ ID NO: 914268 - DNA, 25 bp, Mus musculus
tgttgttgggattgctttgttatag

SEQ ID NO: 914269 - DNA, 25 bp, Mus musculus
tgttgttgtgtaatgtaacagcact

SEQ ID NO: 914270 - DNA, 25 bp, Mus musculus
tgttgttgtgtattgtaacagcact

SEQ ID NO: 914271 - DNA, 25 bp, Mus musculus
tgttgttgtttgaagcacctctccc

SEQ ID NO: 914272 - DNA, 25 bp, Mus musculus
tgttgttgtttgtagcacctctccc

SEQ ID NO: 914273 - DNA, 25 bp, Mus musculus
tgttgtttaaacaaatgactggaac

SEQ ID NO: 914274 - DNA, 25 bp, Mus musculus
tgttgtttaaactaatgactggaac

SEQ ID NO: 914275 - DNA, 25 bp, Mus musculus
tgttgtttaacaaaggaccagtgag

SEQ ID NO: 914276 - DNA, 25 bp, Mus musculus
tgttgtttaacataggaccagtgag

SEQ ID NO: 914277 - DNA, 25 bp, Mus musculus
tgttgtttaattcccaaatatctgg

SEQ ID NO: 914278 - DNA, 25 bp, Mus musculus
tgttgtttaattgccaaatatctgg

SEQ ID NO: 914279 - DNA, 25 bp, Mus musculus
tgttgtttcaccacgagcaggagtc

SEQ ID NO: 914280 - DNA, 25 bp, Mus musculus
tgttgtttcacctcgagcaggagtc

SEQ ID NO: 914281 - DNA, 25 bp, Mus musculus
tgttgtttcatgacagcagtatttg

SEQ ID NO: 914282 - DNA, 25 bp, Mus musculus
tgttgtttcatgtcagcagtatttg

SEQ ID NO: 914283 - DNA, 25 bp, Mus musculus
tgttgtttctgcaagtctagacttc

SEQ ID NO: 914284 - DNA, 25 bp, Mus musculus
tgttgtttctgctagtctagacttc

SEQ ID NO: 914285 - DNA, 25 bp, Mus musculus
tgttgtttgagccaaggtctcaaaa

SEQ ID NO: 914286 - DNA, 25 bp, Mus musculus
tgttgtttgagcgaaggtctcaaaa

SEQ ID NO: 914287 - DNA, 25 bp, Mus musculus
tgttgtttgtaacacccgtcttagg

SEQ ID NO: 914288 - DNA, 25 bp, Mus musculus
tgttgtttgtaagacccgtcttagg

SEQ ID NO: 914289 - DNA, 25 bp, Mus musculus
tgttgttttaaaactatgcctagta

SEQ ID NO: 914290 - DNA, 25 bp, Mus musculus
tgttgttttaaatctatgcctagta

SEQ ID NO: 914291 - DNA, 25 bp, Mus musculus
tgttgttttataaactgcatgtgtt

SEQ ID NO: 914292 - DNA, 25 bp, Mus musculus
tgttgttttatatactgcatgtgtt

SEQ ID NO: 914293 - DNA, 25 bp, Mus musculus
tgttgttttcatattctacaaagta

SEQ ID NO: 914294 - DNA, 25 bp, Mus musculus
tgttgttttcattttctacaaagta

SEQ ID NO: 914295 - DNA, 25 bp, Mus musculus
tgttgttttcctcgccatagttgtt

SEQ ID NO: 914296 - DNA, 25 bp, Mus musculus
tgttgttttcctggccatagttgtt

SEQ ID NO: 914297 - DNA, 25 bp, Mus musculus
tgttgttttcttacatcgtaagcct

SEQ ID NO: 914298 - DNA, 25 bp, Mus musculus
tgttgttttctttcatcgtaagcct

SEQ ID NO: 914299 - DNA, 25 bp, Mus musculus
tgttgttttgtaacacccacatcca

SEQ ID NO: 914300 - DNA, 25 bp, Mus musculus
tgttgttttgtaagttaaggacttt

SEQ ID NO: 914301 - DNA, 25 bp, Mus musculus
tgttgttttgtatcacccacatcca

SEQ ID NO: 914302 - DNA, 25 bp, Mus musculus
tgttgttttgtatgttaaggacttt

SEQ ID NO: 914303 - DNA, 25 bp, Mus musculus
tgttgtttttcccatgctcgagact

SEQ ID NO: 914304 - DNA, 25 bp, Mus musculus
tgttgtttttccgatgctcgagact

SEQ ID NO: 914305 - DNA, 25 bp, Mus musculus
tgttgtttttctaatctggcttttt

SEQ ID NO: 914306 - DNA, 25 bp, Mus musculus
tgttgtttttctcctgagggtggaa

SEQ ID NO: 914307 - DNA, 25 bp, Mus musculus
tgttgtttttctgctgagggtggaa

SEQ ID NO: 914308 - DNA, 25 bp, Mus musculus
tgttgtttttcttatctggcttttt

SEQ ID NO: 914309 - DNA, 25 bp, Mus musculus
tgtttaaaccatacctttgcagagg

SEQ ID NO: 914310 - DNA, 25 bp, Mus musculus
tgtttaaaccattcctttgcagagg

SEQ ID NO: 914311 - DNA, 25 bp, Mus musculus
tgtttaaacccaaagttgtccacat

SEQ ID NO: 914312 - DNA, 25 bp, Mus musculus
tgtttaaacccatagttgtccacat

SEQ ID NO: 914313 - DNA, 25 bp, Mus musculus
tgtttaaaccgaagtcccatgacta

SEQ ID NO: 914314 - DNA, 25 bp, Mus musculus
tgtttaaaccgatgtcccatgacta

SEQ ID NO: 914315 - DNA, 25 bp, Mus musculus
tgtttaaagagcatgtttctgccaa

SEQ ID NO: 914316 - DNA, 25 bp, Mus musculus
tgtttaaagagcttgtttctgccaa

SEQ ID NO: 914317 - DNA, 25 bp, Mus musculus
tgtttaaatccccacgctgaaccag

SEQ ID NO: 914318 - DNA, 25 bp, Mus musculus
tgtttaaatcccgacgctgaaccag

SEQ ID NO: 914319 - DNA, 25 bp, Mus musculus
tgtttaaatcttatggctttgacca

SEQ ID NO: 914320 - DNA, 25 bp, Mus musculus
tgtttaaatcttttggctttgacca

SEQ ID NO: 914321 - DNA, 25 bp, Mus musculus
tgtttaacatcgacaggatcctgat

SEQ ID NO: 914322 - DNA, 25 bp, Mus musculus
tgtttaacatcgtcaggatcctgat

SEQ ID NO: 914323 - DNA, 25 bp, Mus musculus
tgtttaacccagatgttccttccct

SEQ ID NO: 914324 - DNA, 25 bp, Mus musculus
tgtttaacccagttgttccttccct

SEQ ID NO: 914325 - DNA, 25 bp, Mus musculus
tgtttaacccttcagaggatgttcc

SEQ ID NO: 914326 - DNA, 25 bp, Mus musculus
tgtttaacccttgagaggatgttcc

SEQ ID NO: 914327 - DNA, 25 bp, Mus musculus
tgtttaaccggaagggattcccctg

SEQ ID NO: 914328 - DNA, 25 bp, Mus musculus
tgtttaaccggatgggattcccctg

SEQ ID NO: 914329 - DNA, 25 bp, Mus musculus
tgtttaacgttaattgcggtcttat

SEQ ID NO: 914330 - DNA, 25 bp, Mus musculus
tgtttaacgttatttgcggtcttat

SEQ ID NO: 914331 - DNA, 25 bp, Mus musculus
tgtttaactctacggcagtacatgc

SEQ ID NO: 914332 - DNA, 25 bp, Mus musculus
tgtttaactctagggcagtacatgc

SEQ ID NO: 914333 - DNA, 25 bp, Mus musculus
tgtttaactttcacggtacttcttg

SEQ ID NO: 914334 - DNA, 25 bp, Mus musculus
tgtttaactttctcggtacttcttg

SEQ ID NO: 914335 - DNA, 25 bp, Mus musculus
tgtttaagacttatggttcctcttg

SEQ ID NO: 914336 - DNA, 25 bp, Mus musculus
tgtttaagacttttggttcctcttg

SEQ ID NO: 914337 - DNA, 25 bp, Mus musculus
tgtttaaggattctccttgtagcca

SEQ ID NO: 914338 - DNA, 25 bp, Mus musculus
tgtttaaggattgtccttgtagcca

SEQ ID NO: 914339 - DNA, 25 bp, Mus musculus
tgtttaagtcttacctagcagggcg

SEQ ID NO: 914340 - DNA, 25 bp, Mus musculus
tgtttaagtctttcctagcagggcg

SEQ ID NO: 914341 - DNA, 25 bp, Mus musculus
tgtttaagtgtaagcatggcctgca

SEQ ID NO: 914342 - DNA, 25 bp, Mus musculus
tgtttaagtgtatgcatggcctgca

SEQ ID NO: 914343 - DNA, 25 bp, Mus musculus
tgtttaatacttatgtggttgtcct

SEQ ID NO: 914344 - DNA, 25 bp, Mus musculus
tgtttaatacttttgtggttgtcct

SEQ ID NO: 914345 - DNA, 25 bp, Mus musculus
tgtttaatattgattcactgaagaa

SEQ ID NO: 914346 - DNA, 25 bp, Mus musculus
tgtttaatattgtttcactgaagaa

SEQ ID NO: 914347 - DNA, 25 bp, Mus musculus
tgtttaatgcagaaagagaccttga

SEQ ID NO: 914348 - DNA, 25 bp, Mus musculus
tgtttaatgcagtaagagaccttga

SEQ ID NO: 914349 - DNA, 25 bp, Mus musculus
tgtttaatgttgaagccatgcttag

SEQ ID NO: 914350 - DNA, 25 bp, Mus musculus
tgtttaatgttgtagccatgcttag

SEQ ID NO: 914351 - DNA, 25 bp, Mus musculus
tgtttaatgtttactgggcgggtat

SEQ ID NO: 914352 - DNA, 25 bp, Mus musculus
tgtttaatgttttctgggcgggtat

SEQ ID NO: 914353 - DNA, 25 bp, Mus musculus
tgtttaattggcatgggttttagat

SEQ ID NO: 914354 - DNA, 25 bp, Mus musculus
tgtttaattggcttgggttttagat

SEQ ID NO: 914355 - DNA, 25 bp, Mus musculus
tgtttacaaaccctggataactcac

SEQ ID NO: 914356 - DNA, 25 bp, Mus musculus
tgtttacaaaccgtggataactcac

SEQ ID NO: 914357 - DNA, 25 bp, Mus musculus
tgtttacaaactaccgaatctcacg

SEQ ID NO: 914358 - DNA, 25 bp, Mus musculus
tgtttacaaacttccgaatctcacg

SEQ ID NO: 914359 - DNA, 25 bp, Mus musculus
tgtttacaacttccttttgtggtct

SEQ ID NO: 914360 - DNA, 25 bp, Mus musculus
tgtttacaacttgcttttgtggtct

SEQ ID NO: 914361 - DNA, 25 bp, Mus musculus
tgtttacaatgcactacatcccgct

SEQ ID NO: 914362 - DNA, 25 bp, Mus musculus
tgtttacaatgctctacatcccgct

SEQ ID NO: 914363 - DNA, 25 bp, Mus musculus
tgtttacaatgtcacctctaggcag

SEQ ID NO: 914364 - DNA, 25 bp, Mus musculus
tgtttacaatgtgacctctaggcag

SEQ ID NO: 914365 - DNA, 25 bp, Mus musculus
tgtttacaatttccctcaatcactt

SEQ ID NO: 914366 - DNA, 25 bp, Mus musculus
tgtttacaatttgcctcaatcactt

SEQ ID NO: 914367 - DNA, 25 bp, Mus musculus
tgtttacacagcattgaggcagaag

SEQ ID NO: 914368 - DNA, 25 bp, Mus musculus
tgtttacacagctttgaggcagaag

SEQ ID NO: 914369 - DNA, 25 bp, Mus musculus
tgtttacacagtcgcaacgctacct

SEQ ID NO: 914370 - DNA, 25 bp, Mus musculus
tgtttacacagtggcaacgctacct

SEQ ID NO: 914371 - DNA, 25 bp, Mus musculus
tgtttacaccctatactattgggat

SEQ ID NO: 914372 - DNA, 25 bp, Mus musculus
tgtttacaccctcgaaatgacccct

SEQ ID NO: 914373 - DNA, 25 bp, Mus musculus
tgtttacaccctggaaatgacccct

SEQ ID NO: 914374 - DNA, 25 bp, Mus musculus
tgtttacaccctttactattgggat

SEQ ID NO: 914375 - DNA, 25 bp, Mus musculus
tgtttacagaacacgcagaattagc

SEQ ID NO: 914376 - DNA, 25 bp, Mus musculus
tgtttacagaactcgcagaattagc

SEQ ID NO: 914377 - DNA, 25 bp, Mus musculus
tgtttacagagtacctgctcacacc

SEQ ID NO: 914378 - DNA, 25 bp, Mus musculus
tgtttacagagttcctgctcacacc

SEQ ID NO: 914379 - DNA, 25 bp, Mus musculus
tgtttacatactaatcactcgggat

SEQ ID NO: 914380 - DNA, 25 bp, Mus musculus
tgtttacatacttatcactcgggat

SEQ ID NO: 914381 - DNA, 25 bp, Mus musculus
tgtttacatatcctctgtactcacc

SEQ ID NO: 914382 - DNA, 25 bp, Mus musculus
tgtttacatatcgtctgtactcacc

SEQ ID NO: 914383 - DNA, 25 bp, Mus musculus
tgtttacatattactttccagttat

SEQ ID NO: 914384 - DNA, 25 bp, Mus musculus
tgtttacatatttctttccagttat

SEQ ID NO: 914385 - DNA, 25 bp, Mus musculus
tgtttacattccctcgtgttgagct

SEQ ID NO: 914386 - DNA, 25 bp, Mus musculus
tgtttacattccgtcgtgttgagct

SEQ ID NO: 914387 - DNA, 25 bp, Mus musculus
tgtttaccagatcgtctgtgaccct

SEQ ID NO: 914388 - DNA, 25 bp, Mus musculus
tgtttaccagatggtctgtgaccct

SEQ ID NO: 914389 - DNA, 25 bp, Mus musculus
tgtttaccagctcttggtcccagaa

SEQ ID NO: 914390 - DNA, 25 bp, Mus musculus
tgtttaccagctgttggtcccagaa

SEQ ID NO: 914391 - DNA, 25 bp, Mus musculus
tgtttaccagtaatccccagaggtg

SEQ ID NO: 914392 - DNA, 25 bp, Mus musculus
tgtttaccagtattccccagaggtg

SEQ ID NO: 914393 - DNA, 25 bp, Mus musculus
tgtttacccgtcaagtattagcagc

SEQ ID NO: 914394 - DNA, 25 bp, Mus musculus
tgtttacccgtctagtattagcagc

SEQ ID NO: 914395 - DNA, 25 bp, Mus musculus
tgtttacctcggcagcacaattggc

SEQ ID NO: 914396 - DNA, 25 bp, Mus musculus
tgtttacctcgggagcacaattggc

SEQ ID NO: 914397 - DNA, 25 bp, Mus musculus
tgtttacctttcacctggagctgga

SEQ ID NO: 914398 - DNA, 25 bp, Mus musculus
tgtttacctttctcctggagctgga

SEQ ID NO: 914399 - DNA, 25 bp, Mus musculus
tgtttacgtagaactcagctgtcct

SEQ ID NO: 914400 - DNA, 25 bp, Mus musculus
tgtttacgtagatctcagctgtcct

SEQ ID NO: 914401 - DNA, 25 bp, Mus musculus
tgtttactaggaccctgacttccca

SEQ ID NO: 914402 - DNA, 25 bp, Mus musculus
tgtttactaggagcctgacttccca

SEQ ID NO: 914403 - DNA, 25 bp, Mus musculus
tgtttactatttccctctttctttg

SEQ ID NO: 914404 - DNA, 25 bp, Mus musculus
tgtttactatttgcctctttctttg

SEQ ID NO: 914405 - DNA, 25 bp, Mus musculus
tgtttactcccgatctttgtatgta

SEQ ID NO: 914406 - DNA, 25 bp, Mus musculus
tgtttactcccgttctttgtatgta

SEQ ID NO: 914407 - DNA, 25 bp, Mus musculus
tgtttactctctacatccgtgtgac

SEQ ID NO: 914408 - DNA, 25 bp, Mus musculus
tgtttactctcttcatccgtgtgac

SEQ ID NO: 914409 - DNA, 25 bp, Mus musculus
tgtttactgaatctctccccaatgt

SEQ ID NO: 914410 - DNA, 25 bp, Mus musculus
tgtttactgaatgtctccccaatgt

SEQ ID NO: 914411 - DNA, 25 bp, Mus musculus
tgtttactgcgtacaataaatgcat

SEQ ID NO: 914412 - DNA, 25 bp, Mus musculus
tgtttactgcgttcaataaatgcat

SEQ ID NO: 914413 - DNA, 25 bp, Mus musculus
tgtttactgtgaccccatcacaaca

SEQ ID NO: 914414 - DNA, 25 bp, Mus musculus
tgtttactgtgagcccatcacaaca

SEQ ID NO: 914415 - DNA, 25 bp, Mus musculus
tgtttacttcctattgacccagaga

SEQ ID NO: 914416 - DNA, 25 bp, Mus musculus
tgtttacttccttttgacccagaga

SEQ ID NO: 914417 - DNA, 25 bp, Mus musculus
tgtttactttctagtgacactcttg

SEQ ID NO: 914418 - DNA, 25 bp, Mus musculus
tgtttactttcttgtgacactcttg

SEQ ID NO: 914419 - DNA, 25 bp, Mus musculus
tgtttacttttcatacacccatcac

SEQ ID NO: 914420 - DNA, 25 bp, Mus musculus
tgtttacttttcttacacccatcac

SEQ ID NO: 914421 - DNA, 25 bp, Mus musculus
tgtttagaaagtacctggcctctct

SEQ ID NO: 914422 - DNA, 25 bp, Mus musculus
tgtttagaaagttcctggcctctct

SEQ ID NO: 914423 - DNA, 25 bp, Mus musculus
tgtttagaactcagtagcgcactcc

SEQ ID NO: 914424 - DNA, 25 bp, Mus musculus
tgtttagaactctgtagcgcactcc

SEQ ID NO: 914425 - DNA, 25 bp, Mus musculus
tgtttagaataaaaaatccgcggcg

SEQ ID NO: 914426 - DNA, 25 bp, Mus musculus
tgtttagaataataaatccgcggcg

SEQ ID NO: 914427 - DNA, 25 bp, Mus musculus
tgtttagaatttaccagccccattt

SEQ ID NO: 914428 - DNA, 25 bp, Mus musculus
tgtttagaattttccagccccattt

SEQ ID NO: 914429 - DNA, 25 bp, Mus musculus
tgtttagagtacatggtcttagacc

SEQ ID NO: 914430 - DNA, 25 bp, Mus musculus
tgtttagagtacttggtcttagacc

SEQ ID NO: 914431 - DNA, 25 bp, Mus musculus
tgtttagcattgaacctgtaatgta

SEQ ID NO: 914432 - DNA, 25 bp, Mus musculus
tgtttagcattgtacctgtaatgta

SEQ ID NO: 914433 - DNA, 25 bp, Mus musculus
tgtttagccagcacacccaatggtt

SEQ ID NO: 914434 - DNA, 25 bp, Mus musculus
tgtttagccagctcacccaatggtt

SEQ ID NO: 914435 - DNA, 25 bp, Mus musculus
tgtttagcccaaaagacctgatgtt

SEQ ID NO: 914436 - DNA, 25 bp, Mus musculus
tgtttagcccaatagacctgatgtt

SEQ ID NO: 914437 - DNA, 25 bp, Mus musculus
tgtttagctgtgatccctgggccct

SEQ ID NO: 914438 - DNA, 25 bp, Mus musculus
tgtttagctgtgttccctgggccct

SEQ ID NO: 914439 - DNA, 25 bp, Mus musculus
tgtttaggagcccacagcccagatc

SEQ ID NO: 914440 - DNA, 25 bp, Mus musculus
tgtttaggagccgacagcccagatc

SEQ ID NO: 914441 - DNA, 25 bp, Mus musculus
tgtttaggccttaacttaaggctag

SEQ ID NO: 914442 - DNA, 25 bp, Mus musculus
tgtttaggcctttacttaaggctag

SEQ ID NO: 914443 - DNA, 25 bp, Mus musculus
tgtttaggtgcaataccccatttcc

SEQ ID NO: 914444 - DNA, 25 bp, Mus musculus
tgtttaggtgcattaccccatttcc

SEQ ID NO: 914445 - DNA, 25 bp, Mus musculus
tgtttaggttgtccaaagtctccca

SEQ ID NO: 914446 - DNA, 25 bp, Mus musculus
tgtttaggttgtgcaaagtctccca

SEQ ID NO: 914447 - DNA, 25 bp, Mus musculus
tgtttaggtttcatgccaactttcg

SEQ ID NO: 914448 - DNA, 25 bp, Mus musculus
tgtttaggtttcttgccaactttcg

SEQ ID NO: 914449 - DNA, 25 bp, Mus musculus
tgtttagtccaacaggagtccaagg

SEQ ID NO: 914450 - DNA, 25 bp, Mus musculus
tgtttagtccaagaggagtccaagg

SEQ ID NO: 914451 - DNA, 25 bp, Mus musculus
tgtttagtccgtcgttcaccgagac

SEQ ID NO: 914452 - DNA, 25 bp, Mus musculus
tgtttagtccgtggttcaccgagac

SEQ ID NO: 914453 - DNA, 25 bp, Mus musculus
tgtttagtctatctcctttcccaga

SEQ ID NO: 914454 - DNA, 25 bp, Mus musculus
tgtttagtctatgtcctttcccaga

SEQ ID NO: 914455 - DNA, 25 bp, Mus musculus
tgtttagtgaccatggctctgctca

SEQ ID NO: 914456 - DNA, 25 bp, Mus musculus
tgtttagtgaccttggctctgctca

SEQ ID NO: 914457 - DNA, 25 bp, Mus musculus
tgtttagtgaggatccctgctttgt

SEQ ID NO: 914458 - DNA, 25 bp, Mus musculus
tgtttagtgaggttccctgctttgt

SEQ ID NO: 914459 - DNA, 25 bp, Mus musculus
tgtttagttgagaacctggcctctt

SEQ ID NO: 914460 - DNA, 25 bp, Mus musculus
tgtttagttgagtacctggcctctt

SEQ ID NO: 914461 - DNA, 25 bp, Mus musculus
tgtttagtttggagtcctttccaga

SEQ ID NO: 914462 - DNA, 25 bp, Mus musculus
tgtttagtttggtgtcctttccaga

SEQ ID NO: 914463 - DNA, 25 bp, Mus musculus
tgtttataagccactgtcactcggg

SEQ ID NO: 914464 - DNA, 25 bp, Mus musculus
tgtttataagcctctgtcactcggg

SEQ ID NO: 914465 - DNA, 25 bp, Mus musculus
tgtttataattactcccagagggtg

SEQ ID NO: 914466 - DNA, 25 bp, Mus musculus
tgtttataattagtcccagagggtg

SEQ ID NO: 914467 - DNA, 25 bp, Mus musculus
tgtttatacaacacttacacttatg

SEQ ID NO: 914468 - DNA, 25 bp, Mus musculus
tgtttatacaactcttacacttatg

SEQ ID NO: 914469 - DNA, 25 bp, Mus musculus
tgtttataccaacgtggatttctgg

SEQ ID NO: 914470 - DNA, 25 bp, Mus musculus
tgtttataccaaggtggatttctgg

SEQ ID NO: 914471 - DNA, 25 bp, Mus musculus
tgtttataccccactgtgtcagtac

SEQ ID NO: 914472 - DNA, 25 bp, Mus musculus
tgtttatacccctctgtgtcagtac

SEQ ID NO: 914473 - DNA, 25 bp, Mus musculus
tgtttatacctcagcccattcattt

SEQ ID NO: 914474 - DNA, 25 bp, Mus musculus
tgtttatacctctgcccattcattt

SEQ ID NO: 914475 - DNA, 25 bp, Mus musculus
tgtttataggtgacagtgctggagc

SEQ ID NO: 914476 - DNA, 25 bp, Mus musculus
tgtttataggtgtcagtgctggagc

SEQ ID NO: 914477 - DNA, 25 bp, Mus musculus
tgtttatcaactagtctctttgccc

SEQ ID NO: 914478 - DNA, 25 bp, Mus musculus
tgtttatcaacttgtctctttgccc

SEQ ID NO: 914479 - DNA, 25 bp, Mus musculus
tgtttatcaagtccctaccatgtgc

SEQ ID NO: 914480 - DNA, 25 bp, Mus musculus
tgtttatcaagtgcctaccatgtgc

SEQ ID NO: 914481 - DNA, 25 bp, Mus musculus
tgtttatcaattattacggtctttg

SEQ ID NO: 914482 - DNA, 25 bp, Mus musculus
tgtttatcaatttttacggtctttg

SEQ ID NO: 914483 - DNA, 25 bp, Mus musculus
tgtttatcacatctaggccaggtga

SEQ ID NO: 914484 - DNA, 25 bp, Mus musculus
tgtttatcacatgtaggccaggtga

SEQ ID NO: 914485 - DNA, 25 bp, Mus musculus
tgtttatcacccattcgacctataa

SEQ ID NO: 914486 - DNA, 25 bp, Mus musculus
tgtttatcaccctttcgacctataa

SEQ ID NO: 914487 - DNA, 25 bp, Mus musculus
tgtttatccactcacaccctttcgt

SEQ ID NO: 914488 - DNA, 25 bp, Mus musculus
tgtttatccactgacaccctttcgt

SEQ ID NO: 914489 - DNA, 25 bp, Mus musculus
tgtttatcggtgatgaaccccaggg

SEQ ID NO: 914490 - DNA, 25 bp, Mus musculus
tgtttatcggtgttgaaccccaggg

SEQ ID NO: 914491 - DNA, 25 bp, Mus musculus
tgtttatctgagaggcgccgcctgc

SEQ ID NO: 914492 - DNA, 25 bp, Mus musculus
tgtttatctgagtggcgccgcctgc

SEQ ID NO: 914493 - DNA, 25 bp, Mus musculus
tgtttatctggcattgacacgtctg

SEQ ID NO: 914494 - DNA, 25 bp, Mus musculus
tgtttatctggccttctgataggat

SEQ ID NO: 914495 - DNA, 25 bp, Mus musculus
tgtttatctggcgttctgataggat

SEQ ID NO: 914496 - DNA, 25 bp, Mus musculus
tgtttatctggctttgacacgtctg

SEQ ID NO: 914497 - DNA, 25 bp, Mus musculus
tgtttatgagacagtacctgccacc

SEQ ID NO: 914498 - DNA, 25 bp, Mus musculus
tgtttatgagactgtacctgccacc

SEQ ID NO: 914499 - DNA, 25 bp, Mus musculus
tgtttatgatggcaagaaaggtacc

SEQ ID NO: 914500 - DNA, 25 bp, Mus musculus
tgtttatgatgggaagaaaggtacc

SEQ ID NO: 914501 - DNA, 25 bp, Mus musculus
tgtttatgggacataaaatagcatg

SEQ ID NO: 914502 - DNA, 25 bp, Mus musculus
tgtttatgggacttaaaatagcatg

SEQ ID NO: 914503 - DNA, 25 bp, Mus musculus
tgtttattaacaccataggcgatga

SEQ ID NO: 914504 - DNA, 25 bp, Mus musculus
tgtttattaacagcataggcgatga

SEQ ID NO: 914505 - DNA, 25 bp, Mus musculus
tgtttattatagaacctcaccaccc

SEQ ID NO: 914506 - DNA, 25 bp, Mus musculus
tgtttattatagtacctcaccaccc

SEQ ID NO: 914507 - DNA, 25 bp, Mus musculus
tgtttattatttaatgttctctcaa

SEQ ID NO: 914508 - DNA, 25 bp, Mus musculus
tgtttattattttatgttctctcaa

SEQ ID NO: 914509 - DNA, 25 bp, Mus musculus
tgtttattcaaccaagggtattggt

SEQ ID NO: 914510 - DNA, 25 bp, Mus musculus
tgtttattcaacgaagggtattggt

SEQ ID NO: 914511 - DNA, 25 bp, Mus musculus
tgtttattcctcagtttcttgacta

SEQ ID NO: 914512 - DNA, 25 bp, Mus musculus
tgtttattcctctgtttcttgacta

SEQ ID NO: 914513 - DNA, 25 bp, Mus musculus
tgtttattctccaactcggatctca

SEQ ID NO: 914514 - DNA, 25 bp, Mus musculus
tgtttattctccaactttggcgaat

SEQ ID NO: 914515 - DNA, 25 bp, Mus musculus
tgtttattctccatccatctagcta

SEQ ID NO: 914516 - DNA, 25 bp, Mus musculus
tgtttattctcctactcggatctca

SEQ ID NO: 914517 - DNA, 25 bp, Mus musculus
tgtttattctcctactttggcgaat

SEQ ID NO: 914518 - DNA, 25 bp, Mus musculus
tgtttattctccttccatctagcta

SEQ ID NO: 914519 - DNA, 25 bp, Mus musculus
tgtttattgtttctctaacccaaga

SEQ ID NO: 914520 - DNA, 25 bp, Mus musculus
tgtttattgtttgtctaacccaaga

SEQ ID NO: 914521 - DNA, 25 bp, Mus musculus
tgtttatttacacccgcagatacgc

SEQ ID NO: 914522 - DNA, 25 bp, Mus musculus
tgtttatttacagccgcagatacgc

SEQ ID NO: 914523 - DNA, 25 bp, Mus musculus
tgtttatttattcctagtttctttt

SEQ ID NO: 914524 - DNA, 25 bp, Mus musculus
tgtttatttattgctagtttctttt

SEQ ID NO: 914525 - DNA, 25 bp, Mus musculus
tgtttatttctacctgctcctgcaa

SEQ ID NO: 914526 - DNA, 25 bp, Mus musculus
tgtttatttctagctgctcctgcaa

SEQ ID NO: 914527 - DNA, 25 bp, Mus musculus
tgtttatttcttacacctttctcca

SEQ ID NO: 914528 - DNA, 25 bp, Mus musculus
tgtttatttctttcacctttctcca

SEQ ID NO: 914529 - DNA, 25 bp, Mus musculus
tgtttatttgacaagcttggctcag

SEQ ID NO: 914530 - DNA, 25 bp, Mus musculus
tgtttatttgactagcttggctcag

SEQ ID NO: 914531 - DNA, 25 bp, Mus musculus
tgtttcaaaatcaaagtcctagctg

SEQ ID NO: 914532 - DNA, 25 bp, Mus musculus
tgtttcaaaatctaagtcctagctg

SEQ ID NO: 914533 - DNA, 25 bp, Mus musculus
tgtttcaaaccactacggcgggcta

SEQ ID NO: 914534 - DNA, 25 bp, Mus musculus
tgtttcaaaccagtacggcgggcta

SEQ ID NO: 914535 - DNA, 25 bp, Mus musculus
tgtttcaaacgtattctggcagaga

SEQ ID NO: 914536 - DNA, 25 bp, Mus musculus
tgtttcaaacgttttctggcagaga

SEQ ID NO: 914537 - DNA, 25 bp, Mus musculus
tgtttcaaagacataccactatgta

SEQ ID NO: 914538 - DNA, 25 bp, Mus musculus
tgtttcaaagacttaccactatgta

SEQ ID NO: 914539 - DNA, 25 bp, Mus musculus
tgtttcaaagttctggcctggcctt

SEQ ID NO: 914540 - DNA, 25 bp, Mus musculus
tgtttcaaagttgtggcctggcctt

SEQ ID NO: 914541 - DNA, 25 bp, Mus musculus
tgtttcaaataaataggcctaatag

SEQ ID NO: 914542 - DNA, 25 bp, Mus musculus
tgtttcaaataattaggcctaatag

SEQ ID NO: 914543 - DNA, 25 bp, Mus musculus
tgtttcaaccacataccatctatct

SEQ ID NO: 914544 - DNA, 25 bp, Mus musculus
tgtttcaaccacttaccatctatct

SEQ ID NO: 914545 - DNA, 25 bp, Mus musculus
tgtttcaacccactgctttatgtct

SEQ ID NO: 914546 - DNA, 25 bp, Mus musculus
tgtttcaacccagtgctttatgtct

SEQ ID NO: 914547 - DNA, 25 bp, Mus musculus
tgtttcaactaaccccagctataaa

SEQ ID NO: 914548 - DNA, 25 bp, Mus musculus
tgtttcaactaagcccagctataaa

SEQ ID NO: 914549 - DNA, 25 bp, Mus musculus
tgtttcaacttacagattctcttaa

SEQ ID NO: 914550 - DNA, 25 bp, Mus musculus
tgtttcaacttagagattctcttaa

SEQ ID NO: 914551 - DNA, 25 bp, Mus musculus
tgtttcaagtatcagtgccaccaag

SEQ ID NO: 914552 - DNA, 25 bp, Mus musculus
tgtttcaagtatgagtgccaccaag

SEQ ID NO: 914553 - DNA, 25 bp, Mus musculus
tgtttcaatttacgccaagtactag

SEQ ID NO: 914554 - DNA, 25 bp, Mus musculus
tgtttcaatttaggccaagtactag

SEQ ID NO: 914555 - DNA, 25 bp, Mus musculus
tgtttcacagaaaacacacgtcggg

SEQ ID NO: 914556 - DNA, 25 bp, Mus musculus
tgtttcacagaatacacacgtcggg

SEQ ID NO: 914557 - DNA, 25 bp, Mus musculus
tgtttcacagttcatcagccttgga

SEQ ID NO: 914558 - DNA, 25 bp, Mus musculus
tgtttcacagttgatcagccttgga

SEQ ID NO: 914559 - DNA, 25 bp, Mus musculus
tgtttcacatcacttgcctatccat

SEQ ID NO: 914560 - DNA, 25 bp, Mus musculus
tgtttcacatcagttgcctatccat

SEQ ID NO: 914561 - DNA, 25 bp, Mus musculus
tgtttcacccgtaccactcaaaccg

SEQ ID NO: 914562 - DNA, 25 bp, Mus musculus
tgtttcacccgttccactcaaaccg

SEQ ID NO: 914563 - DNA, 25 bp, Mus musculus
tgtttcaccctaatcctttcttaga

SEQ ID NO: 914564 - DNA, 25 bp, Mus musculus
tgtttcaccctattcctttcttaga

SEQ ID NO: 914565 - DNA, 25 bp, Mus musculus
tgtttcacctgccagtggtacaatc

SEQ ID NO: 914566 - DNA, 25 bp, Mus musculus
tgtttcacctgcgagtggtacaatc

SEQ ID NO: 914567 - DNA, 25 bp, Mus musculus
tgtttcacgacgaggtggagatcga

SEQ ID NO: 914568 - DNA, 25 bp, Mus musculus
tgtttcacgacgtggtggagatcga

SEQ ID NO: 914569 - DNA, 25 bp, Mus musculus
tgtttcactatgcaggaacctagaa

SEQ ID NO: 914570 - DNA, 25 bp, Mus musculus
tgtttcactatggaggaacctagaa

SEQ ID NO: 914571 - DNA, 25 bp, Mus musculus
tgtttcactattattacattataaa

SEQ ID NO: 914572 - DNA, 25 bp, Mus musculus
tgtttcactatttttacattataaa

SEQ ID NO: 914573 - DNA, 25 bp, Mus musculus
tgtttcactggcagttttagctttg

SEQ ID NO: 914574 - DNA, 25 bp, Mus musculus
tgtttcactggctgttttagctttg

SEQ ID NO: 914575 - DNA, 25 bp, Mus musculus
tgtttcacttatccactaaaacggg

SEQ ID NO: 914576 - DNA, 25 bp, Mus musculus
tgtttcacttatgcactaaaacggg

SEQ ID NO: 914577 - DNA, 25 bp, Mus musculus
tgtttcagagaaacacttggtggca

SEQ ID NO: 914578 - DNA, 25 bp, Mus musculus
tgtttcagagaatcacttggtggca

SEQ ID NO: 914579 - DNA, 25 bp, Mus musculus
tgtttcagaggcacgtgccagccaa

SEQ ID NO: 914580 - DNA, 25 bp, Mus musculus
tgtttcagaggctcgtgccagccaa

SEQ ID NO: 914581 - DNA, 25 bp, Mus musculus
tgtttcagcaaacagcaaagccact

SEQ ID NO: 914582 - DNA, 25 bp, Mus musculus
tgtttcagcaaagagcaaagccact

SEQ ID NO: 914583 - DNA, 25 bp, Mus musculus
tgtttcagccagacagatagtcagt

SEQ ID NO: 914584 - DNA, 25 bp, Mus musculus
tgtttcagccagtcagatagtcagt

SEQ ID NO: 914585 - DNA, 25 bp, Mus musculus
tgtttcagctccattcactaacgga

SEQ ID NO: 914586 - DNA, 25 bp, Mus musculus
tgtttcagctcctttcactaacgga

SEQ ID NO: 914587 - DNA, 25 bp, Mus musculus
tgtttcaggctgatgcaccgaatgc

SEQ ID NO: 914588 - DNA, 25 bp, Mus musculus
tgtttcaggctgttgcaccgaatgc

SEQ ID NO: 914589 - DNA, 25 bp, Mus musculus
tgtttcaggtatattgtggcagcaa

SEQ ID NO: 914590 - DNA, 25 bp, Mus musculus
tgtttcaggtattttgtggcagcaa

SEQ ID NO: 914591 - DNA, 25 bp, Mus musculus
tgtttcagtagaaggcaccctgcat

SEQ ID NO: 914592 - DNA, 25 bp, Mus musculus
tgtttcagtagatggcaccctgcat

SEQ ID NO: 914593 - DNA, 25 bp, Mus musculus
tgtttcagtatcattcctcagttga

SEQ ID NO: 914594 - DNA, 25 bp, Mus musculus
tgtttcagtatctttcctcagttga

SEQ ID NO: 914595 - DNA, 25 bp, Mus musculus
tgtttcagtgtacctctctaatgct

SEQ ID NO: 914596 - DNA, 25 bp, Mus musculus
tgtttcagtgtagctctctaatgct

SEQ ID NO: 914597 - DNA, 25 bp, Mus musculus
tgtttcagtgttccactggcacttc

SEQ ID NO: 914598 - DNA, 25 bp, Mus musculus
tgtttcagtgttgcactggcacttc

SEQ ID NO: 914599 - DNA, 25 bp, Mus musculus
tgtttcagttttctccagttggagc

SEQ ID NO: 914600 - DNA, 25 bp, Mus musculus
tgtttcagttttgtccagttggagc

SEQ ID NO: 914601 - DNA, 25 bp, Mus musculus
tgtttcataaggacccgtgcgggag

SEQ ID NO: 914602 - DNA, 25 bp, Mus musculus
tgtttcataaggtcccgtgcgggag

SEQ ID NO: 914603 - DNA, 25 bp, Mus musculus
tgtttcatatgcatggtggcctgtg

SEQ ID NO: 914604 - DNA, 25 bp, Mus musculus
tgtttcatatgcttggtggcctgtg

SEQ ID NO: 914605 - DNA, 25 bp, Mus musculus
tgtttcatatgtatagaccaggcac

SEQ ID NO: 914606 - DNA, 25 bp, Mus musculus
tgtttcatatgtttagaccaggcac

SEQ ID NO: 914607 - DNA, 25 bp, Mus musculus
tgtttcatcaacatctcagctgtcc

SEQ ID NO: 914608 - DNA, 25 bp, Mus musculus
tgtttcatcaacttctcagctgtcc

SEQ ID NO: 914609 - DNA, 25 bp, Mus musculus
tgtttcatcgtcattaggcctggga

SEQ ID NO: 914610 - DNA, 25 bp, Mus musculus
tgtttcatcgtctttaggcctggga

SEQ ID NO: 914611 - DNA, 25 bp, Mus musculus
tgtttcatctgaagtctccacagac

SEQ ID NO: 914612 - DNA, 25 bp, Mus musculus
tgtttcatctgatgtctccacagac

SEQ ID NO: 914613 - DNA, 25 bp, Mus musculus
tgtttcatgcgtcggttctggaacc

SEQ ID NO: 914614 - DNA, 25 bp, Mus musculus
tgtttcatgcgtgggttctggaacc

SEQ ID NO: 914615 - DNA, 25 bp, Mus musculus
tgtttcatgcttatcttgtgtccaa

SEQ ID NO: 914616 - DNA, 25 bp, Mus musculus
tgtttcatgcttttcttgtgtccaa

SEQ ID NO: 914617 - DNA, 25 bp, Mus musculus
tgtttcatggaaagtgccctttgcc

SEQ ID NO: 914618 - DNA, 25 bp, Mus musculus
tgtttcatggaatgtgccctttgcc

SEQ ID NO: 914619 - DNA, 25 bp, Mus musculus
tgtttcatgtcactaatctcagcac

SEQ ID NO: 914620 - DNA, 25 bp, Mus musculus
tgtttcatgtcagtaatctcagcac

SEQ ID NO: 914621 - DNA, 25 bp, Mus musculus
tgtttcattactacaccgaatactt

SEQ ID NO: 914622 - DNA, 25 bp, Mus musculus
tgtttcattacttcaccgaatactt

SEQ ID NO: 914623 - DNA, 25 bp, Mus musculus
tgtttcattcctaagtgtcagcact

SEQ ID NO: 914624 - DNA, 25 bp, Mus musculus
tgtttcattccttagtgtcagcact

SEQ ID NO: 914625 - DNA, 25 bp, Mus musculus
tgtttcattgccacacttggtacac

SEQ ID NO: 914626 - DNA, 25 bp, Mus musculus
tgtttcattgcctcacttggtacac

SEQ ID NO: 914627 - DNA, 25 bp, Mus musculus
tgtttcatttctccacatatccatg

SEQ ID NO: 914628 - DNA, 25 bp, Mus musculus
tgtttcatttctgcacatatccatg

SEQ ID NO: 914629 - DNA, 25 bp, Mus musculus
tgtttcatttttagaggaccccatc

SEQ ID NO: 914630 - DNA, 25 bp, Mus musculus
tgtttcattttttgaggaccccatc

SEQ ID NO: 914631 - DNA, 25 bp, Mus musculus
tgtttccaaactaataccttcgcca

SEQ ID NO: 914632 - DNA, 25 bp, Mus musculus
tgtttccaaacttataccttcgcca

SEQ ID NO: 914633 - DNA, 25 bp, Mus musculus
tgtttccaaatcatatctgcctgcc

SEQ ID NO: 914634 - DNA, 25 bp, Mus musculus
tgtttccaaatcttatctgcctgcc

SEQ ID NO: 914635 - DNA, 25 bp, Mus musculus
tgtttccaacgtctttggtcctgga

SEQ ID NO: 914636 - DNA, 25 bp, Mus musculus
tgtttccaacgtgtttggtcctgga

SEQ ID NO: 914637 - DNA, 25 bp, Mus musculus
tgtttccaagcaaccgctctctgat

SEQ ID NO: 914638 - DNA, 25 bp, Mus musculus
tgtttccaagcatccgctctctgat

SEQ ID NO: 914639 - DNA, 25 bp, Mus musculus
tgtttccaagtaaacaacctcctgg

SEQ ID NO: 914640 - DNA, 25 bp, Mus musculus
tgtttccaagtatacaacctcctgg

SEQ ID NO: 914641 - DNA, 25 bp, Mus musculus
tgtttccacaccatattgctgttgt

SEQ ID NO: 914642 - DNA, 25 bp, Mus musculus
tgtttccacaccttattgctgttgt

SEQ ID NO: 914643 - DNA, 25 bp, Mus musculus
tgtttccacactcctttgcaatgaa

SEQ ID NO: 914644 - DNA, 25 bp, Mus musculus
tgtttccacactgctttgcaatgaa

SEQ ID NO: 914645 - DNA, 25 bp, Mus musculus
tgtttccacattatcctttcggatt

SEQ ID NO: 914646 - DNA, 25 bp, Mus musculus
tgtttccacattcaatggcgacagc

SEQ ID NO: 914647 - DNA, 25 bp, Mus musculus
tgtttccacattgaatggcgacagc

SEQ ID NO: 914648 - DNA, 25 bp, Mus musculus
tgtttccacattttcctttcggatt

SEQ ID NO: 914649 - DNA, 25 bp, Mus musculus
tgtttccactcaaagccaagggtca

SEQ ID NO: 914650 - DNA, 25 bp, Mus musculus
tgtttccactcatagccaagggtca

SEQ ID NO: 914651 - DNA, 25 bp, Mus musculus
tgtttccactgccacaggtgagcaa

SEQ ID NO: 914652 - DNA, 25 bp, Mus musculus
tgtttccactgcgacaggtgagcaa

SEQ ID NO: 914653 - DNA, 25 bp, Mus musculus
tgtttccactttccatgctaccaaa

SEQ ID NO: 914654 - DNA, 25 bp, Mus musculus
tgtttccactttgcatgctaccaaa

SEQ ID NO: 914655 - DNA, 25 bp, Mus musculus
tgtttccagaaccaattccttgcca

SEQ ID NO: 914656 - DNA, 25 bp, Mus musculus
tgtttccagaacgaattccttgcca

SEQ ID NO: 914657 - DNA, 25 bp, Mus musculus
tgtttccagatgagccgccagcatg

SEQ ID NO: 914658 - DNA, 25 bp, Mus musculus
tgtttccagatgtgccgccagcatg

SEQ ID NO: 914659 - DNA, 25 bp, Mus musculus
tgtttccagcaaataaacttttcta

SEQ ID NO: 914660 - DNA, 25 bp, Mus musculus
tgtttccagcaattaaacttttcta

SEQ ID NO: 914661 - DNA, 25 bp, Mus musculus
tgtttccaggagaccttcccatcag

SEQ ID NO: 914662 - DNA, 25 bp, Mus musculus
tgtttccaggagagctagcatgttt

SEQ ID NO: 914663 - DNA, 25 bp, Mus musculus
tgtttccaggagtccttcccatcag

SEQ ID NO: 914664 - DNA, 25 bp, Mus musculus
tgtttccaggagtgctagcatgttt

SEQ ID NO: 914665 - DNA, 25 bp, Mus musculus
tgtttccagggcatgttggtacaaa

SEQ ID NO: 914666 - DNA, 25 bp, Mus musculus
tgtttccagggcttgttggtacaaa

SEQ ID NO: 914667 - DNA, 25 bp, Mus musculus
tgtttccaggtgatcccggttgaat

SEQ ID NO: 914668 - DNA, 25 bp, Mus musculus
tgtttccaggtgttcccggttgaat

SEQ ID NO: 914669 - DNA, 25 bp, Mus musculus
tgtttccagtaaactctctgataag

SEQ ID NO: 914670 - DNA, 25 bp, Mus musculus
tgtttccagtaatctctctgataag

SEQ ID NO: 914671 - DNA, 25 bp, Mus musculus
tgtttccagtaccaggcattgcctt

SEQ ID NO: 914672 - DNA, 25 bp, Mus musculus
tgtttccagtacgaggcattgcctt

SEQ ID NO: 914673 - DNA, 25 bp, Mus musculus
tgtttccagtggcatagacatgtct

SEQ ID NO: 914674 - DNA, 25 bp, Mus musculus
tgtttccagtgggatagacatgtct

SEQ ID NO: 914675 - DNA, 25 bp, Mus musculus
tgtttccatcagagcaacaacctct

SEQ ID NO: 914676 - DNA, 25 bp, Mus musculus
tgtttccatcagtgcaacaacctct

SEQ ID NO: 914677 - DNA, 25 bp, Mus musculus
tgtttccatcctctgccagcaggag

SEQ ID NO: 914678 - DNA, 25 bp, Mus musculus
tgtttccatcctgtgccagcaggag

SEQ ID NO: 914679 - DNA, 25 bp, Mus musculus
tgtttccatggacttgttcaaccgg

SEQ ID NO: 914680 - DNA, 25 bp, Mus musculus
tgtttccatggagttgttcaaccgg

SEQ ID NO: 914681 - DNA, 25 bp, Mus musculus
tgtttccattgtatcaaagcccctc

SEQ ID NO: 914682 - DNA, 25 bp, Mus musculus
tgtttccattgtttcaaagcccctc

SEQ ID NO: 914683 - DNA, 25 bp, Mus musculus
tgtttcccacctatcttccaaaaat

SEQ ID NO: 914684 - DNA, 25 bp, Mus musculus
tgtttcccacctttcttccaaaaat

SEQ ID NO: 914685 - DNA, 25 bp, Mus musculus
tgtttcccaggaatagactcagcaa

SEQ ID NO: 914686 - DNA, 25 bp, Mus musculus
tgtttcccaggattagactcagcaa

SEQ ID NO: 914687 - DNA, 25 bp, Mus musculus
tgtttcccagttccatgttagtttc

SEQ ID NO: 914688 - DNA, 25 bp, Mus musculus
tgtttcccagttgcatgttagtttc

SEQ ID NO: 914689 - DNA, 25 bp, Mus musculus
tgtttcccatgtctaacgtttcggt

SEQ ID NO: 914690 - DNA, 25 bp, Mus musculus
tgtttcccatgtgtaacgtttcggt

SEQ ID NO: 914691 - DNA, 25 bp, Mus musculus
tgtttccccacaaacctacaatgta

SEQ ID NO: 914692 - DNA, 25 bp, Mus musculus
tgtttccccacatacctacaatgta

SEQ ID NO: 914693 - DNA, 25 bp, Mus musculus
tgtttccccagaccagcatgtgcta

SEQ ID NO: 914694 - DNA, 25 bp, Mus musculus
tgtttccccagagcagcatgtgcta

SEQ ID NO: 914695 - DNA, 25 bp, Mus musculus
tgtttcccctttactaatgaaatga

SEQ ID NO: 914696 - DNA, 25 bp, Mus musculus
tgtttccccttttctaatgaaatga

SEQ ID NO: 914697 - DNA, 25 bp, Mus musculus
tgtttccctaaacgagtcttcacca

SEQ ID NO: 914698 - DNA, 25 bp, Mus musculus
tgtttccctaaaggagtcttcacca

SEQ ID NO: 914699 - DNA, 25 bp, Mus musculus
tgtttccctacaacagcaacagtat

SEQ ID NO: 914700 - DNA, 25 bp, Mus musculus
tgtttccctacatcagcaacagtat

SEQ ID NO: 914701 - DNA, 25 bp, Mus musculus
tgtttccctccgaagtttgaggaag

SEQ ID NO: 914702 - DNA, 25 bp, Mus musculus
tgtttccctccgtagtttgaggaag

SEQ ID NO: 914703 - DNA, 25 bp, Mus musculus
tgtttccctcgaaagactctactaa

SEQ ID NO: 914704 - DNA, 25 bp, Mus musculus
tgtttccctcgatagactctactaa

SEQ ID NO: 914705 - DNA, 25 bp, Mus musculus
tgtttccctctcaccgaaggtaaag

SEQ ID NO: 914706 - DNA, 25 bp, Mus musculus
tgtttccctctctccgaaggtaaag

SEQ ID NO: 914707 - DNA, 25 bp, Mus musculus
tgtttccctcttagatccaagcgga

SEQ ID NO: 914708 - DNA, 25 bp, Mus musculus
tgtttccctctttgatccaagcgga

SEQ ID NO: 914709 - DNA, 25 bp, Mus musculus
tgtttccctgcaaatcagtgttgac

SEQ ID NO: 914710 - DNA, 25 bp, Mus musculus
tgtttccctgcatatcagtgttgac

SEQ ID NO: 914711 - DNA, 25 bp, Mus musculus
tgtttccctgccctagagactccta

SEQ ID NO: 914712 - DNA, 25 bp, Mus musculus
tgtttccctgccgtagagactccta

SEQ ID NO: 914713 - DNA, 25 bp, Mus musculus
tgtttccctttgccttatagttggt

SEQ ID NO: 914714 - DNA, 25 bp, Mus musculus
tgtttccctttggcttatagttggt

SEQ ID NO: 914715 - DNA, 25 bp, Mus musculus
tgtttccgacaccttcatttttgaa

SEQ ID NO: 914716 - DNA, 25 bp, Mus musculus
tgtttccgacacgttcatttttgaa

SEQ ID NO: 914717 - DNA, 25 bp, Mus musculus
tgtttccgcttaccttaggctgaaa

SEQ ID NO: 914718 - DNA, 25 bp, Mus musculus
tgtttccgcttagcttaggctgaaa

SEQ ID NO: 914719 - DNA, 25 bp, Mus musculus
tgtttccggataactgtacctcaca

SEQ ID NO: 914720 - DNA, 25 bp, Mus musculus
tgtttccggatatctgtacctcaca

SEQ ID NO: 914721 - DNA, 25 bp, Mus musculus
tgtttccggcctaagcaatacttct

SEQ ID NO: 914722 - DNA, 25 bp, Mus musculus
tgtttccggccttagcaatacttct

SEQ ID NO: 914723 - DNA, 25 bp, Mus musculus
tgtttccggtctcctctctggacag

SEQ ID NO: 914724 - DNA, 25 bp, Mus musculus
tgtttccggtctgctctctggacag

SEQ ID NO: 914725 - DNA, 25 bp, Mus musculus
tgtttcctaaaccacatgtacccag

SEQ ID NO: 914726 - DNA, 25 bp, Mus musculus
tgtttcctaaacgacatgtacccag

SEQ ID NO: 914727 - DNA, 25 bp, Mus musculus
tgtttcctacagacaccctgaggga

SEQ ID NO: 914728 - DNA, 25 bp, Mus musculus
tgtttcctacagtcaccctgaggga

SEQ ID NO: 914729 - DNA, 25 bp, Mus musculus
tgtttcctacccactcttgtaaact

SEQ ID NO: 914730 - DNA, 25 bp, Mus musculus
tgtttcctaccctctcttgtaaact

SEQ ID NO: 914731 - DNA, 25 bp, Mus musculus
tgtttcctacctcttcagtcacgta

SEQ ID NO: 914732 - DNA, 25 bp, Mus musculus
tgtttcctacctgttcagtcacgta

SEQ ID NO: 914733 - DNA, 25 bp, Mus musculus
tgtttcctaggaaccgcatttgggt

SEQ ID NO: 914734 - DNA, 25 bp, Mus musculus
tgtttcctaggatccgcatttgggt

SEQ ID NO: 914735 - DNA, 25 bp, Mus musculus
tgtttcctcagacagggtggaagat

SEQ ID NO: 914736 - DNA, 25 bp, Mus musculus
tgtttcctcagagagggtggaagat

SEQ ID NO: 914737 - DNA, 25 bp, Mus musculus
tgtttcctccacactgcagagtaaa

SEQ ID NO: 914738 - DNA, 25 bp, Mus musculus
tgtttcctccaccaaaaggcacaag

SEQ ID NO: 914739 - DNA, 25 bp, Mus musculus
tgtttcctccacgaaaaggcacaag

SEQ ID NO: 914740 - DNA, 25 bp, Mus musculus
tgtttcctccactctgcagagtaaa

SEQ ID NO: 914741 - DNA, 25 bp, Mus musculus
tgtttcctccagcattgggcagctt

SEQ ID NO: 914742 - DNA, 25 bp, Mus musculus
tgtttcctccaggattgggcagctt

SEQ ID NO: 914743 - DNA, 25 bp, Mus musculus
tgtttcctcccaaaaagtttctatg

SEQ ID NO: 914744 - DNA, 25 bp, Mus musculus
tgtttcctcccataaagtttctatg

SEQ ID NO: 914745 - DNA, 25 bp, Mus musculus
tgtttcctccccaagaaactgaaga

SEQ ID NO: 914746 - DNA, 25 bp, Mus musculus
tgtttcctcccctagaaactgaaga

SEQ ID NO: 914747 - DNA, 25 bp, Mus musculus
tgtttcctcctcacaggacttttat

SEQ ID NO: 914748 - DNA, 25 bp, Mus musculus
tgtttcctcctctcaggacttttat

SEQ ID NO: 914749 - DNA, 25 bp, Mus musculus
tgtttcctccttctttggcaagact

SEQ ID NO: 914750 - DNA, 25 bp, Mus musculus
tgtttcctccttgtttggcaagact

SEQ ID NO: 914751 - DNA, 25 bp, Mus musculus
tgtttcctctatacacctgtgttta

SEQ ID NO: 914752 - DNA, 25 bp, Mus musculus
tgtttcctctattcacctgtgttta

SEQ ID NO: 914753 - DNA, 25 bp, Mus musculus
tgtttcctcttaaccaagccatgca

SEQ ID NO: 914754 - DNA, 25 bp, Mus musculus
tgtttcctcttatccaagccatgca

SEQ ID NO: 914755 - DNA, 25 bp, Mus musculus
tgtttcctcttcaaccgggagctga

SEQ ID NO: 914756 - DNA, 25 bp, Mus musculus
tgtttcctcttctaccgggagctga

SEQ ID NO: 914757 - DNA, 25 bp, Mus musculus
tgtttcctcttgaatgtccacgaac

SEQ ID NO: 914758 - DNA, 25 bp, Mus musculus
tgtttcctcttgtatgtccacgaac

SEQ ID NO: 914759 - DNA, 25 bp, Mus musculus
tgtttcctgcccagatgttcctgtg

SEQ ID NO: 914760 - DNA, 25 bp, Mus musculus
tgtttcctgccctgatgttcctgtg

SEQ ID NO: 914761 - DNA, 25 bp, Mus musculus
tgtttcctgcgcaaacaagtggctc

SEQ ID NO: 914762 - DNA, 25 bp, Mus musculus
tgtttcctgcgctaacaagtggctc

SEQ ID NO: 914763 - DNA, 25 bp, Mus musculus
tgtttcctgctacagatatatgtca

SEQ ID NO: 914764 - DNA, 25 bp, Mus musculus
tgtttcctgctagagatatatgtca

SEQ ID NO: 914765 - DNA, 25 bp, Mus musculus
tgtttcctgcttagtggcactgaca

SEQ ID NO: 914766 - DNA, 25 bp, Mus musculus
tgtttcctgcttccagtgtctacat

SEQ ID NO: 914767 - DNA, 25 bp, Mus musculus
tgtttcctgcttgcagtgtctacat

SEQ ID NO: 914768 - DNA, 25 bp, Mus musculus
tgtttcctgctttgtggcactgaca

SEQ ID NO: 914769 - DNA, 25 bp, Mus musculus
tgtttcctggagctccctgtgagaa

SEQ ID NO: 914770 - DNA, 25 bp, Mus musculus
tgtttcctggaggtccctgtgagaa

SEQ ID NO: 914771 - DNA, 25 bp, Mus musculus
tgtttcctgggcctgaattcagttt

SEQ ID NO: 914772 - DNA, 25 bp, Mus musculus
tgtttcctgggcgtgaattcagttt

SEQ ID NO: 914773 - DNA, 25 bp, Mus musculus
tgtttcctgggtatagaatgttcaa

SEQ ID NO: 914774 - DNA, 25 bp, Mus musculus
tgtttcctgggtttagaatgttcaa

SEQ ID NO: 914775 - DNA, 25 bp, Mus musculus
tgtttcctgtacacatatacttatg

SEQ ID NO: 914776 - DNA, 25 bp, Mus musculus
tgtttcctgtactcatatacttatg

SEQ ID NO: 914777 - DNA, 25 bp, Mus musculus
tgtttcctgtcaacctgtttgccct

SEQ ID NO: 914778 - DNA, 25 bp, Mus musculus
tgtttcctgtcatcctgtttgccct

SEQ ID NO: 914779 - DNA, 25 bp, Mus musculus
tgtttcctgtctacctgtgtgttct

SEQ ID NO: 914780 - DNA, 25 bp, Mus musculus
tgtttcctgtcttcctgtgtgttct

SEQ ID NO: 914781 - DNA, 25 bp, Mus musculus
tgtttcctgtgaaaattcatgactc

SEQ ID NO: 914782 - DNA, 25 bp, Mus musculus
tgtttcctgtgataattcatgactc

SEQ ID NO: 914783 - DNA, 25 bp, Mus musculus
tgtttcctgtgcctctggcctctag

SEQ ID NO: 914784 - DNA, 25 bp, Mus musculus
tgtttcctgtgcgtctggcctctag

SEQ ID NO: 914785 - DNA, 25 bp, Mus musculus
tgtttcctgttgatagatgctgcgt

SEQ ID NO: 914786 - DNA, 25 bp, Mus musculus
tgtttcctgttgttagatgctgcgt

SEQ ID NO: 914787 - DNA, 25 bp, Mus musculus
tgtttccttataatggccaccagta

SEQ ID NO: 914788 - DNA, 25 bp, Mus musculus
tgtttccttatattggccaccagta

SEQ ID NO: 914789 - DNA, 25 bp, Mus musculus
tgtttccttcaaatgcatgaacgga

SEQ ID NO: 914790 - DNA, 25 bp, Mus musculus
tgtttccttcaattgcatgaacgga

SEQ ID NO: 914791 - DNA, 25 bp, Mus musculus
tgtttccttcataagcaccccagac

SEQ ID NO: 914792 - DNA, 25 bp, Mus musculus
tgtttccttcattagcaccccagac

SEQ ID NO: 914793 - DNA, 25 bp, Mus musculus
tgtttccttcccaaaaggctgtatg

SEQ ID NO: 914794 - DNA, 25 bp, Mus musculus
tgtttccttccctaaaggctgtatg

SEQ ID NO: 914795 - DNA, 25 bp, Mus musculus
tgtttccttctcacctgtaagcctt

SEQ ID NO: 914796 - DNA, 25 bp, Mus musculus
tgtttccttctctcctgtaagcctt

SEQ ID NO: 914797 - DNA, 25 bp, Mus musculus
tgtttccttgaactcatccatcacc

SEQ ID NO: 914798 - DNA, 25 bp, Mus musculus
tgtttccttgaagtcatccatcacc

SEQ ID NO: 914799 - DNA, 25 bp, Mus musculus
tgtttcctttaaaccaagtatttgg

SEQ ID NO: 914800 - DNA, 25 bp, Mus musculus
tgtttcctttaatccaagtatttgg

SEQ ID NO: 914801 - DNA, 25 bp, Mus musculus
tgtttcctttagagcccgccttagc

SEQ ID NO: 914802 - DNA, 25 bp, Mus musculus
tgtttcctttagtgcccgccttagc

SEQ ID NO: 914803 - DNA, 25 bp, Mus musculus
tgtttcctttctcttagtaaactag

SEQ ID NO: 914804 - DNA, 25 bp, Mus musculus
tgtttcctttctgttagtaaactag

SEQ ID NO: 914805 - DNA, 25 bp, Mus musculus
tgtttcgctcgtagcctaacttcaa

SEQ ID NO: 914806 - DNA, 25 bp, Mus musculus
tgtttcgctcgttgcctaacttcaa

SEQ ID NO: 914807 - DNA, 25 bp, Mus musculus
tgtttcggaacgagcgcatccttca

SEQ ID NO: 914808 - DNA, 25 bp, Mus musculus
tgtttcggaacgtgcgcatccttca

SEQ ID NO: 914809 - DNA, 25 bp, Mus musculus
tgtttcgttcttagctagagcttac

SEQ ID NO: 914810 - DNA, 25 bp, Mus musculus
tgtttcgttcttatcctgtgtgctc

SEQ ID NO: 914811 - DNA, 25 bp, Mus musculus
tgtttcgttctttgctagagcttac

SEQ ID NO: 914812 - DNA, 25 bp, Mus musculus
tgtttcgttcttttcctgtgtgctc

SEQ ID NO: 914813 - DNA, 25 bp, Mus musculus
tgtttcgtttcaatatttctaagcg

SEQ ID NO: 914814 - DNA, 25 bp, Mus musculus
tgtttcgtttcattatttctaagcg

SEQ ID NO: 914815 - DNA, 25 bp, Mus musculus
tgtttctaatgcagtctgacatccc

SEQ ID NO: 914816 - DNA, 25 bp, Mus musculus
tgtttctaatgctgtctgacatccc

SEQ ID NO: 914817 - DNA, 25 bp, Mus musculus
tgtttctacactcagtatcccaacc

SEQ ID NO: 914818 - DNA, 25 bp, Mus musculus
tgtttctacactgagtatcccaacc

SEQ ID NO: 914819 - DNA, 25 bp, Mus musculus
tgtttctacatcagtctcttcattg

SEQ ID NO: 914820 - DNA, 25 bp, Mus musculus
tgtttctacatctgtctcttcattg

SEQ ID NO: 914821 - DNA, 25 bp, Mus musculus
tgtttctacccactgcttcattgtt

SEQ ID NO: 914822 - DNA, 25 bp, Mus musculus
tgtttctacccagtgcttcattgtt

SEQ ID NO: 914823 - DNA, 25 bp, Mus musculus
tgtttctacctcaacctactaatct

SEQ ID NO: 914824 - DNA, 25 bp, Mus musculus
tgtttctacctctacctactaatct

SEQ ID NO: 914825 - DNA, 25 bp, Mus musculus
tgtttctacgttaatgtcacccaaa

SEQ ID NO: 914826 - DNA, 25 bp, Mus musculus
tgtttctacgtttatgtcacccaaa

SEQ ID NO: 914827 - DNA, 25 bp, Mus musculus
tgtttctactttacctattatttct

SEQ ID NO: 914828 - DNA, 25 bp, Mus musculus
tgtttctacttttcctattatttct

SEQ ID NO: 914829 - DNA, 25 bp, Mus musculus
tgtttctagcgcaatctctctgaga

SEQ ID NO: 914830 - DNA, 25 bp, Mus musculus
tgtttctagcgctatctctctgaga

SEQ ID NO: 914831 - DNA, 25 bp, Mus musculus
tgtttctcacatatcgaccatggca

SEQ ID NO: 914832 - DNA, 25 bp, Mus musculus
tgtttctcacatttcgaccatggca

SEQ ID NO: 914833 - DNA, 25 bp, Mus musculus
tgtttctcatgaccccacacaagaa

SEQ ID NO: 914834 - DNA, 25 bp, Mus musculus
tgtttctcatgagcccacacaagaa

SEQ ID NO: 914835 - DNA, 25 bp, Mus musculus
tgtttctcattcctcagacctgagc

SEQ ID NO: 914836 - DNA, 25 bp, Mus musculus
tgtttctcattcgtcagacctgagc

SEQ ID NO: 914837 - DNA, 25 bp, Mus musculus
tgtttctccattagttcttcctgcc

SEQ ID NO: 914838 - DNA, 25 bp, Mus musculus
tgtttctccatttgttcttcctgcc

SEQ ID NO: 914839 - DNA, 25 bp, Mus musculus
tgtttctccctcaggacggatgcat

SEQ ID NO: 914840 - DNA, 25 bp, Mus musculus
tgtttctccctctggacggatgcat

SEQ ID NO: 914841 - DNA, 25 bp, Mus musculus
tgtttctccgagactgttaaagtta

SEQ ID NO: 914842 - DNA, 25 bp, Mus musculus
tgtttctccgagtctgttaaagtta

SEQ ID NO: 914843 - DNA, 25 bp, Mus musculus
tgtttctccggaatgtagtgttctc

SEQ ID NO: 914844 - DNA, 25 bp, Mus musculus
tgtttctccggattgtagtgttctc

SEQ ID NO: 914845 - DNA, 25 bp, Mus musculus
tgtttctcctcaaagatgtttctaa

SEQ ID NO: 914846 - DNA, 25 bp, Mus musculus
tgtttctcctcatagatgtttctaa

SEQ ID NO: 914847 - DNA, 25 bp, Mus musculus
tgtttctcctcgacactatcatggg

SEQ ID NO: 914848 - DNA, 25 bp, Mus musculus
tgtttctcctcgtcactatcatggg

SEQ ID NO: 914849 - DNA, 25 bp, Mus musculus
tgtttctcgataatttcttattgga

SEQ ID NO: 914850 - DNA, 25 bp, Mus musculus
tgtttctcgatattttcttattgga

SEQ ID NO: 914851 - DNA, 25 bp, Mus musculus
tgtttctcgggtacaggtggatcac

SEQ ID NO: 914852 - DNA, 25 bp, Mus musculus
tgtttctcgggttcaggtggatcac

SEQ ID NO: 914853 - DNA, 25 bp, Mus musculus
tgtttctcgtcaagcatgtctacta

SEQ ID NO: 914854 - DNA, 25 bp, Mus musculus
tgtttctcgtcatgcatgtctacta

SEQ ID NO: 914855 - DNA, 25 bp, Mus musculus
tgtttctctaatctttccttacttc

SEQ ID NO: 914856 - DNA, 25 bp, Mus musculus
tgtttctctaatgtttccttacttc

SEQ ID NO: 914857 - DNA, 25 bp, Mus musculus
tgtttctctcaaatgccagttccgg

SEQ ID NO: 914858 - DNA, 25 bp, Mus musculus
tgtttctctcaattgccagttccgg

SEQ ID NO: 914859 - DNA, 25 bp, Mus musculus
tgtttctctcacaggaggtgagcaa

SEQ ID NO: 914860 - DNA, 25 bp, Mus musculus
tgtttctctcactggaggtgagcaa

SEQ ID NO: 914861 - DNA, 25 bp, Mus musculus
tgtttctctctaccctaagtcaaat

SEQ ID NO: 914862 - DNA, 25 bp, Mus musculus
tgtttctctctagcctaagtcaaat

SEQ ID NO: 914863 - DNA, 25 bp, Mus musculus
tgtttctctctcaacagcttcagag

SEQ ID NO: 914864 - DNA, 25 bp, Mus musculus
tgtttctctctctacagcttcagag

SEQ ID NO: 914865 - DNA, 25 bp, Mus musculus
tgtttctctctgaaactaagcaaca

SEQ ID NO: 914866 - DNA, 25 bp, Mus musculus
tgtttctctctgtaactaagcaaca

SEQ ID NO: 914867 - DNA, 25 bp, Mus musculus
tgtttctctcttatgaagtgttaga

SEQ ID NO: 914868 - DNA, 25 bp, Mus musculus
tgtttctctcttttgaagtgttaga

SEQ ID NO: 914869 - DNA, 25 bp, Mus musculus
tgtttctctgccactcaggaattta

SEQ ID NO: 914870 - DNA, 25 bp, Mus musculus
tgtttctctgcctctcaggaattta

SEQ ID NO: 914871 - DNA, 25 bp, Mus musculus
tgtttctctgttcccttgattttac

SEQ ID NO: 914872 - DNA, 25 bp, Mus musculus
tgtttctctgttgccttgattttac

SEQ ID NO: 914873 - DNA, 25 bp, Mus musculus
tgtttctcttacaccataacctcgc

SEQ ID NO: 914874 - DNA, 25 bp, Mus musculus
tgtttctcttactccataacctcgc

SEQ ID NO: 914875 - DNA, 25 bp, Mus musculus
tgtttctctttcactggcccagcaa

SEQ ID NO: 914876 - DNA, 25 bp, Mus musculus
tgtttctctttctctggcccagcaa

SEQ ID NO: 914877 - DNA, 25 bp, Mus musculus
tgtttctgaaaacccctgatctctc

SEQ ID NO: 914878 - DNA, 25 bp, Mus musculus
tgtttctgaaaagccctgatctctc

SEQ ID NO: 914879 - DNA, 25 bp, Mus musculus
tgtttctgaaatcccgctgtctata

SEQ ID NO: 914880 - DNA, 25 bp, Mus musculus
tgtttctgaaatgccgctgtctata

SEQ ID NO: 914881 - DNA, 25 bp, Mus musculus
tgtttctgacaaagctggagataga

SEQ ID NO: 914882 - DNA, 25 bp, Mus musculus
tgtttctgacaatgctggagataga

SEQ ID NO: 914883 - DNA, 25 bp, Mus musculus
tgtttctgacatcgacccctcaaca

SEQ ID NO: 914884 - DNA, 25 bp, Mus musculus
tgtttctgacatggacccctcaaca

SEQ ID NO: 914885 - DNA, 25 bp, Mus musculus
tgtttctgagatcctgaacctcctc

SEQ ID NO: 914886 - DNA, 25 bp, Mus musculus
tgtttctgagatgctgaacctcctc

SEQ ID NO: 914887 - DNA, 25 bp, Mus musculus
tgtttctgagttatgtgcctctgtc

SEQ ID NO: 914888 - DNA, 25 bp, Mus musculus
tgtttctgagttttgtgcctctgtc

SEQ ID NO: 914889 - DNA, 25 bp, Mus musculus
tgtttctgatcacccttagcggctg

SEQ ID NO: 914890 - DNA, 25 bp, Mus musculus
tgtttctgatcagccttagcggctg

SEQ ID NO: 914891 - DNA, 25 bp, Mus musculus
tgtttctgatccactacgtgcaaag

SEQ ID NO: 914892 - DNA, 25 bp, Mus musculus
tgtttctgatcctctacgtgcaaag

SEQ ID NO: 914893 - DNA, 25 bp, Mus musculus
tgtttctgcaccatggctgttgaca

SEQ ID NO: 914894 - DNA, 25 bp, Mus musculus
tgtttctgcaccttggctgttgaca

SEQ ID NO: 914895 - DNA, 25 bp, Mus musculus
tgtttctgcctcaagccaggtatgt

SEQ ID NO: 914896 - DNA, 25 bp, Mus musculus
tgtttctgcctctagccaggtatgt

SEQ ID NO: 914897 - DNA, 25 bp, Mus musculus
tgtttctgccttaggctgcaacacc

SEQ ID NO: 914898 - DNA, 25 bp, Mus musculus
tgtttctgcctttggctgcaacacc

SEQ ID NO: 914899 - DNA, 25 bp, Mus musculus
tgtttctgcgagctgtgctgagcca

SEQ ID NO: 914900 - DNA, 25 bp, Mus musculus
tgtttctgcgaggtgtgctgagcca

SEQ ID NO: 914901 - DNA, 25 bp, Mus musculus
tgtttctgtaccatattcctgcctt

SEQ ID NO: 914902 - DNA, 25 bp, Mus musculus
tgtttctgtaccttattcctgcctt

SEQ ID NO: 914903 - DNA, 25 bp, Mus musculus
tgtttctgtgacaacgaacgtgccc

SEQ ID NO: 914904 - DNA, 25 bp, Mus musculus
tgtttctgtgactacgaacgtgccc

SEQ ID NO: 914905 - DNA, 25 bp, Mus musculus
tgtttctgttatcgacatcagcctg

SEQ ID NO: 914906 - DNA, 25 bp, Mus musculus
tgtttctgttatggacatcagcctg

SEQ ID NO: 914907 - DNA, 25 bp, Mus musculus
tgtttctgttgtattcgcctgtgac

SEQ ID NO: 914908 - DNA, 25 bp, Mus musculus
tgtttctgttgttttcgcctgtgac

SEQ ID NO: 914909 - DNA, 25 bp, Mus musculus
tgtttctgtttgctaatcctgctct

SEQ ID NO: 914910 - DNA, 25 bp, Mus musculus
tgtttctgtttggtaatcctgctct

SEQ ID NO: 914911 - DNA, 25 bp, Mus musculus
tgtttcttaactccccttggaatct

SEQ ID NO: 914912 - DNA, 25 bp, Mus musculus
tgtttcttaactgcccttggaatct

SEQ ID NO: 914913 - DNA, 25 bp, Mus musculus
tgtttcttacctacgagtgacttcc

SEQ ID NO: 914914 - DNA, 25 bp, Mus musculus
tgtttcttaccttcgagtgacttcc

SEQ ID NO: 914915 - DNA, 25 bp, Mus musculus
tgtttcttagacatttcatgagctc

SEQ ID NO: 914916 - DNA, 25 bp, Mus musculus
tgtttcttagacttttcatgagctc

SEQ ID NO: 914917 - DNA, 25 bp, Mus musculus
tgtttcttataccaacctttacagg

SEQ ID NO: 914918 - DNA, 25 bp, Mus musculus
tgtttcttatacgaacctttacagg

SEQ ID NO: 914919 - DNA, 25 bp, Mus musculus
tgtttcttcaacacacatgaccctc

SEQ ID NO: 914920 - DNA, 25 bp, Mus musculus
tgtttcttcaactcacatgaccctc

SEQ ID NO: 914921 - DNA, 25 bp, Mus musculus
tgtttcttcacacggaggcagggat

SEQ ID NO: 914922 - DNA, 25 bp, Mus musculus
tgtttcttcacagggaggcagggat

SEQ ID NO: 914923 - DNA, 25 bp, Mus musculus
tgtttcttcatgaatctctatagta

SEQ ID NO: 914924 - DNA, 25 bp, Mus musculus
tgtttcttcatgtatctctatagta

SEQ ID NO: 914925 - DNA, 25 bp, Mus musculus
tgtttcttccatcccagctatcact

SEQ ID NO: 914926 - DNA, 25 bp, Mus musculus
tgtttcttccatgccagctatcact

SEQ ID NO: 914927 - DNA, 25 bp, Mus musculus
tgtttcttcctcagttgacatttcc

SEQ ID NO: 914928 - DNA, 25 bp, Mus musculus
tgtttcttcctctgttgacatttcc

SEQ ID NO: 914929 - DNA, 25 bp, Mus musculus
tgtttcttctggcaacgtcaggcaa

SEQ ID NO: 914930 - DNA, 25 bp, Mus musculus
tgtttcttctgggaacgtcaggcaa

SEQ ID NO: 914931 - DNA, 25 bp, Mus musculus
tgtttcttgaggctccatcaggcat

SEQ ID NO: 914932 - DNA, 25 bp, Mus musculus
tgtttcttgagggtccatcaggcat

SEQ ID NO: 914933 - DNA, 25 bp, Mus musculus
tgtttcttgatcacagtaagttgga

SEQ ID NO: 914934 - DNA, 25 bp, Mus musculus
tgtttcttgatctcagtaagttgga

SEQ ID NO: 914935 - DNA, 25 bp, Mus musculus
tgtttcttggcgcttggagtaccag

SEQ ID NO: 914936 - DNA, 25 bp, Mus musculus
tgtttcttggcggttggagtaccag

SEQ ID NO: 914937 - DNA, 25 bp, Mus musculus
tgtttcttgggtagtttccaggctt

SEQ ID NO: 914938 - DNA, 25 bp, Mus musculus
tgtttcttgggttgtttccaggctt

SEQ ID NO: 914939 - DNA, 25 bp, Mus musculus
tgtttctttcatatgttcccttata

SEQ ID NO: 914940 - DNA, 25 bp, Mus musculus
tgtttctttcatttgttcccttata

SEQ ID NO: 914941 - DNA, 25 bp, Mus musculus
tgtttctttcctctgctcagtccgt

SEQ ID NO: 914942 - DNA, 25 bp, Mus musculus
tgtttctttcctgtgctcagtccgt

SEQ ID NO: 914943 - DNA, 25 bp, Mus musculus
tgtttctttgaaccagtaacctagc

SEQ ID NO: 914944 - DNA, 25 bp, Mus musculus
tgtttctttgaagcagtaacctagc

SEQ ID NO: 914945 - DNA, 25 bp, Mus musculus
tgtttctttgcacttcagcagccat

SEQ ID NO: 914946 - DNA, 25 bp, Mus musculus
tgtttctttgcagttcagcagccat

SEQ ID NO: 914947 - DNA, 25 bp, Mus musculus
tgtttctttgccacagcagcacatc

SEQ ID NO: 914948 - DNA, 25 bp, Mus musculus
tgtttctttgcctcagcagcacatc

SEQ ID NO: 914949 - DNA, 25 bp, Mus musculus
tgtttcttttggactgtgcaagctt

SEQ ID NO: 914950 - DNA, 25 bp, Mus musculus
tgtttcttttggtctgtgcaagctt

SEQ ID NO: 914951 - DNA, 25 bp, Mus musculus
tgtttctttttcatggcccaaaatt

SEQ ID NO: 914952 - DNA, 25 bp, Mus musculus
tgtttctttttcttggcccaaaatt

SEQ ID NO: 914953 - DNA, 25 bp, Mus musculus
tgtttgaaagcgcaaccatgccctg

SEQ ID NO: 914954 - DNA, 25 bp, Mus musculus
tgtttgaaagcggaaccatgccctg

SEQ ID NO: 914955 - DNA, 25 bp, Mus musculus
tgtttgaaattcagtttaggtctta

SEQ ID NO: 914956 - DNA, 25 bp, Mus musculus
tgtttgaaattctgtttaggtctta

SEQ ID NO: 914957 - DNA, 25 bp, Mus musculus
tgtttgaacagtataaccctgtggg

SEQ ID NO: 914958 - DNA, 25 bp, Mus musculus
tgtttgaacagtttaaccctgtggg

SEQ ID NO: 914959 - DNA, 25 bp, Mus musculus
tgtttgaaccccatgttcttcatgc

SEQ ID NO: 914960 - DNA, 25 bp, Mus musculus
tgtttgaaccccttgttcttcatgc

SEQ ID NO: 914961 - DNA, 25 bp, Mus musculus
tgtttgaactgtccgcgctgtgcct

SEQ ID NO: 914962 - DNA, 25 bp, Mus musculus
tgtttgaactgtgcgcgctgtgcct

SEQ ID NO: 914963 - DNA, 25 bp, Mus musculus
tgtttgaagagtcgccttttcccag

SEQ ID NO: 914964 - DNA, 25 bp, Mus musculus
tgtttgaagagtggccttttcccag

SEQ ID NO: 914965 - DNA, 25 bp, Mus musculus
tgtttgaagatcacacccaaggctt

SEQ ID NO: 914966 - DNA, 25 bp, Mus musculus
tgtttgaagatctcacccaaggctt

SEQ ID NO: 914967 - DNA, 25 bp, Mus musculus
tgtttgaagtgtcagctcccagctc

SEQ ID NO: 914968 - DNA, 25 bp, Mus musculus
tgtttgaagtgtgagctcccagctc

SEQ ID NO: 914969 - DNA, 25 bp, Mus musculus
tgtttgaatatactatgccctaata

SEQ ID NO: 914970 - DNA, 25 bp, Mus musculus
tgtttgaatatagtatgccctaata

SEQ ID NO: 914971 - DNA, 25 bp, Mus musculus
tgtttgaatcctaggccataggaat

SEQ ID NO: 914972 - DNA, 25 bp, Mus musculus
tgtttgaatccttggccataggaat

SEQ ID NO: 914973 - DNA, 25 bp, Mus musculus
tgtttgacaagcatgaggccccatc

SEQ ID NO: 914974 - DNA, 25 bp, Mus musculus
tgtttgacaagcttgaggccccatc

SEQ ID NO: 914975 - DNA, 25 bp, Mus musculus
tgtttgacaatgcactgagcgctct

SEQ ID NO: 914976 - DNA, 25 bp, Mus musculus
tgtttgacaatggactgagcgctct

SEQ ID NO: 914977 - DNA, 25 bp, Mus musculus
tgtttgacacttagcttcctgtgca

SEQ ID NO: 914978 - DNA, 25 bp, Mus musculus
tgtttgacactttgcttcctgtgca

SEQ ID NO: 914979 - DNA, 25 bp, Mus musculus
tgtttgacagctattcccacaattg

SEQ ID NO: 914980 - DNA, 25 bp, Mus musculus
tgtttgacagcttttcccacaattg

SEQ ID NO: 914981 - DNA, 25 bp, Mus musculus
tgtttgacattacacaccagacgcc

SEQ ID NO: 914982 - DNA, 25 bp, Mus musculus
tgtttgacattagacaccagacgcc

SEQ ID NO: 914983 - DNA, 25 bp, Mus musculus
tgtttgacccaactagctgctaatt

SEQ ID NO: 914984 - DNA, 25 bp, Mus musculus
tgtttgacccaagtagctgctaatt

SEQ ID NO: 914985 - DNA, 25 bp, Mus musculus
tgtttgaccggactccaacgggaga

SEQ ID NO: 914986 - DNA, 25 bp, Mus musculus
tgtttgaccggagtccaacgggaga

SEQ ID NO: 914987 - DNA, 25 bp, Mus musculus
tgtttgacctggaaaccaatctttt

SEQ ID NO: 914988 - DNA, 25 bp, Mus musculus
tgtttgacctggtaaccaatctttt

SEQ ID NO: 914989 - DNA, 25 bp, Mus musculus
tgtttgacctgtccatgatccggat

SEQ ID NO: 914990 - DNA, 25 bp, Mus musculus
tgtttgacctgtgcatgatccggat

SEQ ID NO: 914991 - DNA, 25 bp, Mus musculus
tgtttgacggcgcataggacgaaaa

SEQ ID NO: 914992 - DNA, 25 bp, Mus musculus
tgtttgacggcggataggacgaaaa

SEQ ID NO: 914993 - DNA, 25 bp, Mus musculus
tgtttgactcccagggcatcagtcc

SEQ ID NO: 914994 - DNA, 25 bp, Mus musculus
tgtttgactccctgggcatcagtcc

SEQ ID NO: 914995 - DNA, 25 bp, Mus musculus
tgtttgagacagaaccttggcatat

SEQ ID NO: 914996 - DNA, 25 bp, Mus musculus
tgtttgagacagtaccttggcatat

SEQ ID NO: 914997 - DNA, 25 bp, Mus musculus
tgtttgagagccacgtgactgagtc

SEQ ID NO: 914998 - DNA, 25 bp, Mus musculus
tgtttgagagcctcgtgactgagtc

SEQ ID NO: 914999 - DNA, 25 bp, Mus musculus
tgtttgagcagtctttggcctggaa

SEQ ID NO: 915000 - DNA, 25 bp, Mus musculus
tgtttgagcagtgtttggcctggaa

SEQ ID NO: 915001 - DNA, 25 bp, Mus musculus
tgtttgagccgtcaaacacctcctg

SEQ ID NO: 915002 - DNA, 25 bp, Mus musculus
tgtttgagccgtgaaacacctcctg

SEQ ID NO: 915003 - DNA, 25 bp, Mus musculus
tgtttgagggctatcacggtttcct

SEQ ID NO: 915004 - DNA, 25 bp, Mus musculus
tgtttgagggctttcacggtttcct

SEQ ID NO: 915005 - DNA, 25 bp, Mus musculus
tgtttgagtggaacgagccgccgcc

SEQ ID NO: 915006 - DNA, 25 bp, Mus musculus
tgtttgagtggatcgagccgccgcc

SEQ ID NO: 915007 - DNA, 25 bp, Mus musculus
tgtttgataagcagcctttctcttt

SEQ ID NO: 915008 - DNA, 25 bp, Mus musculus
tgtttgataagctgcctttctcttt

SEQ ID NO: 915009 - DNA, 25 bp, Mus musculus
tgtttgatactgagtgcgacgtgga

SEQ ID NO: 915010 - DNA, 25 bp, Mus musculus
tgtttgatactgtgtgcgacgtgga

SEQ ID NO: 915011 - DNA, 25 bp, Mus musculus
tgtttgatagctattcccaactctc

SEQ ID NO: 915012 - DNA, 25 bp, Mus musculus
tgtttgatagcttttcccaactctc

SEQ ID NO: 915013 - DNA, 25 bp, Mus musculus
tgtttgatccacagtcctcacatga

SEQ ID NO: 915014 - DNA, 25 bp, Mus musculus
tgtttgatccactgtcctcacatga

SEQ ID NO: 915015 - DNA, 25 bp, Mus musculus
tgtttgatctgtatagcctgaaggt

SEQ ID NO: 915016 - DNA, 25 bp, Mus musculus
tgtttgatctgtttagcctgaaggt

SEQ ID NO: 915017 - DNA, 25 bp, Mus musculus
tgtttgatgagcagacagccacata

SEQ ID NO: 915018 - DNA, 25 bp, Mus musculus
tgtttgatgagctgacagccacata

SEQ ID NO: 915019 - DNA, 25 bp, Mus musculus
tgtttgatggtcacgtgtggcccat

SEQ ID NO: 915020 - DNA, 25 bp, Mus musculus
tgtttgatggtctcgtgtggcccat

SEQ ID NO: 915021 - DNA, 25 bp, Mus musculus
tgtttgatgtctccaacgctgaccg

SEQ ID NO: 915022 - DNA, 25 bp, Mus musculus
tgtttgatgtctgcaacgctgaccg

SEQ ID NO: 915023 - DNA, 25 bp, Mus musculus
tgtttgattccacagcaatccatca

SEQ ID NO: 915024 - DNA, 25 bp, Mus musculus
tgtttgattccagagcaatccatca

SEQ ID NO: 915025 - DNA, 25 bp, Mus musculus
tgtttgattggaacacagactgctt

SEQ ID NO: 915026 - DNA, 25 bp, Mus musculus
tgtttgattggatcacagactgctt

SEQ ID NO: 915027 - DNA, 25 bp, Mus musculus
tgtttgcaaaggctctgcggtccat

SEQ ID NO: 915028 - DNA, 25 bp, Mus musculus
tgtttgcaaagggtctgcggtccat

SEQ ID NO: 915029 - DNA, 25 bp, Mus musculus
tgtttgcaacacacttaaagagggt

SEQ ID NO: 915030 - DNA, 25 bp, Mus musculus
tgtttgcaacactcttaaagagggt

SEQ ID NO: 915031 - DNA, 25 bp, Mus musculus
tgtttgcaagtcagggaaccggccc

SEQ ID NO: 915032 - DNA, 25 bp, Mus musculus
tgtttgcaagtctgggaaccggccc

SEQ ID NO: 915033 - DNA, 25 bp, Mus musculus
tgtttgcaattactgggccaagacc

SEQ ID NO: 915034 - DNA, 25 bp, Mus musculus
tgtttgcaattagtgggccaagacc

SEQ ID NO: 915035 - DNA, 25 bp, Mus musculus
tgtttgcaccaaatcaccatcattt

SEQ ID NO: 915036 - DNA, 25 bp, Mus musculus
tgtttgcaccaattcaccatcattt

SEQ ID NO: 915037 - DNA, 25 bp, Mus musculus
tgtttgcaccccaggagtcagatac

SEQ ID NO: 915038 - DNA, 25 bp, Mus musculus
tgtttgcacccctggagtcagatac

SEQ ID NO: 915039 - DNA, 25 bp, Mus musculus
tgtttgcagactcgatcccctggca

SEQ ID NO: 915040 - DNA, 25 bp, Mus musculus
tgtttgcagactggatcccctggca

SEQ ID NO: 915041 - DNA, 25 bp, Mus musculus
tgtttgcagtctcattgtgtaatca

SEQ ID NO: 915042 - DNA, 25 bp, Mus musculus
tgtttgcagtctgattgtgtaatca

SEQ ID NO: 915043 - DNA, 25 bp, Mus musculus
tgtttgcatccacacagagtatctg

SEQ ID NO: 915044 - DNA, 25 bp, Mus musculus
tgtttgcatccactggtcttcctcg

SEQ ID NO: 915045 - DNA, 25 bp, Mus musculus
tgtttgcatccagacagagtatctg

SEQ ID NO: 915046 - DNA, 25 bp, Mus musculus
tgtttgcatccagtggtcttcctcg

SEQ ID NO: 915047 - DNA, 25 bp, Mus musculus
tgtttgcatgagcagacccaacgtt

SEQ ID NO: 915048 - DNA, 25 bp, Mus musculus
tgtttgcatgaggagacccaacgtt

SEQ ID NO: 915049 - DNA, 25 bp, Mus musculus
tgtttgccaggtctcttactttgct

SEQ ID NO: 915050 - DNA, 25 bp, Mus musculus
tgtttgccaggtgtcttactttgct

SEQ ID NO: 915051 - DNA, 25 bp, Mus musculus
tgtttgcccaaaatgggtgggctcc

SEQ ID NO: 915052 - DNA, 25 bp, Mus musculus
tgtttgcccaaattgggtgggctcc

SEQ ID NO: 915053 - DNA, 25 bp, Mus musculus
tgtttgcccagtatgtgtgaagcca

SEQ ID NO: 915054 - DNA, 25 bp, Mus musculus
tgtttgcccagtttgtgtgaagcca

SEQ ID NO: 915055 - DNA, 25 bp, Mus musculus
tgtttgccctggactagaactgcca

SEQ ID NO: 915056 - DNA, 25 bp, Mus musculus
tgtttgccctggtctagaactgcca

SEQ ID NO: 915057 - DNA, 25 bp, Mus musculus
tgtttgcctccaaaatactggcctt

SEQ ID NO: 915058 - DNA, 25 bp, Mus musculus
tgtttgcctccataatactggcctt

SEQ ID NO: 915059 - DNA, 25 bp, Mus musculus
tgtttgcctggcattctcatgatcc

SEQ ID NO: 915060 - DNA, 25 bp, Mus musculus
tgtttgcctggctttctcatgatcc

SEQ ID NO: 915061 - DNA, 25 bp, Mus musculus
tgtttgcctgtactgaagagcctca

SEQ ID NO: 915062 - DNA, 25 bp, Mus musculus
tgtttgcctgtagtgaagagcctca

SEQ ID NO: 915063 - DNA, 25 bp, Mus musculus
tgtttgcctgtgaatctgctgtcaa

SEQ ID NO: 915064 - DNA, 25 bp, Mus musculus
tgtttgcctgtgtatctgctgtcaa

SEQ ID NO: 915065 - DNA, 25 bp, Mus musculus
tgtttgcctgttacacttgctctga

SEQ ID NO: 915066 - DNA, 25 bp, Mus musculus
tgtttgcctgtttcacttgctctga

SEQ ID NO: 915067 - DNA, 25 bp, Mus musculus
tgtttgcctttcaactttatccctg

SEQ ID NO: 915068 - DNA, 25 bp, Mus musculus
tgtttgcctttctactttatccctg

SEQ ID NO: 915069 - DNA, 25 bp, Mus musculus
tgtttgcctttgatgtaccctggga

SEQ ID NO: 915070 - DNA, 25 bp, Mus musculus
tgtttgcctttgttgtaccctggga

SEQ ID NO: 915071 - DNA, 25 bp, Mus musculus
tgtttgcgaaggcatttcatggacc

SEQ ID NO: 915072 - DNA, 25 bp, Mus musculus
tgtttgcgaagggatttcatggacc

SEQ ID NO: 915073 - DNA, 25 bp, Mus musculus
tgtttgcggtaacccttgaaggcta

SEQ ID NO: 915074 - DNA, 25 bp, Mus musculus
tgtttgcggtaagccttgaaggcta

SEQ ID NO: 915075 - DNA, 25 bp, Mus musculus
tgtttgcgtaacacggctcggcatt

SEQ ID NO: 915076 - DNA, 25 bp, Mus musculus
tgtttgcgtaactcggctcggcatt

SEQ ID NO: 915077 - DNA, 25 bp, Mus musculus
tgtttgcgtcaacgatctcatgtaa

SEQ ID NO: 915078 - DNA, 25 bp, Mus musculus
tgtttgcgtcaaggatctcatgtaa

SEQ ID NO: 915079 - DNA, 25 bp, Mus musculus
tgtttgctcacacacggattactga

SEQ ID NO: 915080 - DNA, 25 bp, Mus musculus
tgtttgctcacagacggattactga

SEQ ID NO: 915081 - DNA, 25 bp, Mus musculus
tgtttgctcaccctacatgtgaata

SEQ ID NO: 915082 - DNA, 25 bp, Mus musculus
tgtttgctcaccgtacatgtgaata

SEQ ID NO: 915083 - DNA, 25 bp, Mus musculus
tgtttgctctcactagctagtctat

SEQ ID NO: 915084 - DNA, 25 bp, Mus musculus
tgtttgctctcagtagctagtctat

SEQ ID NO: 915085 - DNA, 25 bp, Mus musculus
tgtttgctgagcaccttgagcagat

SEQ ID NO: 915086 - DNA, 25 bp, Mus musculus
tgtttgctgagctccttgagcagat

SEQ ID NO: 915087 - DNA, 25 bp, Mus musculus
tgtttgctgatgagaggccctagaa

SEQ ID NO: 915088 - DNA, 25 bp, Mus musculus
tgtttgctgatgtgaggccctagaa

SEQ ID NO: 915089 - DNA, 25 bp, Mus musculus
tgtttgctgccacccatgaatttgg

SEQ ID NO: 915090 - DNA, 25 bp, Mus musculus
tgtttgctgccagccatgaatttgg

SEQ ID NO: 915091 - DNA, 25 bp, Mus musculus
tgtttgctgcttatcattggtgttt

SEQ ID NO: 915092 - DNA, 25 bp, Mus musculus
tgtttgctgcttttcattggtgttt

SEQ ID NO: 915093 - DNA, 25 bp, Mus musculus
tgtttgctggctacaaagtccctca

SEQ ID NO: 915094 - DNA, 25 bp, Mus musculus
tgtttgctggcttcaaagtccctca

SEQ ID NO: 915095 - DNA, 25 bp, Mus musculus
tgtttgctgtaactgtttcctttgc

SEQ ID NO: 915096 - DNA, 25 bp, Mus musculus
tgtttgctgtaagtgtttcctttgc

SEQ ID NO: 915097 - DNA, 25 bp, Mus musculus
tgtttgctgttgctttgaggcagtt

SEQ ID NO: 915098 - DNA, 25 bp, Mus musculus
tgtttgctgttggtttgaggcagtt

SEQ ID NO: 915099 - DNA, 25 bp, Mus musculus
tgtttgcttaaaaagtgtctacaaa

SEQ ID NO: 915100 - DNA, 25 bp, Mus musculus
tgtttgcttaaatagtgtctacaaa

SEQ ID NO: 915101 - DNA, 25 bp, Mus musculus
tgtttgcttgtaaaatgtccccatt

SEQ ID NO: 915102 - DNA, 25 bp, Mus musculus
tgtttgcttgtataatgtccccatt

SEQ ID NO: 915103 - DNA, 25 bp, Mus musculus
tgtttgctttcgatggctacaatgt

SEQ ID NO: 915104 - DNA, 25 bp, Mus musculus
tgtttgctttcgcaaatgccctggc

SEQ ID NO: 915105 - DNA, 25 bp, Mus musculus
tgtttgctttcggaaatgccctggc

SEQ ID NO: 915106 - DNA, 25 bp, Mus musculus
tgtttgctttcgttggctacaatgt

SEQ ID NO: 915107 - DNA, 25 bp, Mus musculus
tgtttgctttggctgaagcccagag

SEQ ID NO: 915108 - DNA, 25 bp, Mus musculus
tgtttgctttgggtgaagcccagag

SEQ ID NO: 915109 - DNA, 25 bp, Mus musculus
tgtttgcttttgatgtatccctttg

SEQ ID NO: 915110 - DNA, 25 bp, Mus musculus
tgtttgcttttgttgtatccctttg

SEQ ID NO: 915111 - DNA, 25 bp, Mus musculus
tgtttggaaaacactgcagtttacc

SEQ ID NO: 915112 - DNA, 25 bp, Mus musculus
tgtttggaaaactctgcagtttacc

SEQ ID NO: 915113 - DNA, 25 bp, Mus musculus
tgtttggaaaagacctttgtgtttg

SEQ ID NO: 915114 - DNA, 25 bp, Mus musculus
tgtttggaaaagtcctttgtgtttg

SEQ ID NO: 915115 - DNA, 25 bp, Mus musculus
tgtttggaatcacagcgcaagcgaa

SEQ ID NO: 915116 - DNA, 25 bp, Mus musculus
tgtttggaatcagagcgcaagcgaa

SEQ ID NO: 915117 - DNA, 25 bp, Mus musculus
tgtttggaccaaccctcatgagatc

SEQ ID NO: 915118 - DNA, 25 bp, Mus musculus
tgtttggaccaagcctcatgagatc

SEQ ID NO: 915119 - DNA, 25 bp, Mus musculus
tgtttggacttcctttacctctcca

SEQ ID NO: 915120 - DNA, 25 bp, Mus musculus
tgtttggacttcgtttacctctcca

SEQ ID NO: 915121 - DNA, 25 bp, Mus musculus
tgtttggagtggctttgtcctacca

SEQ ID NO: 915122 - DNA, 25 bp, Mus musculus
tgtttggagtgggtttgtcctacca

SEQ ID NO: 915123 - DNA, 25 bp, Mus musculus
tgtttggatttcattggctgctttt

SEQ ID NO: 915124 - DNA, 25 bp, Mus musculus
tgtttggatttctttggctgctttt

SEQ ID NO: 915125 - DNA, 25 bp, Mus musculus
tgtttggcagcaacatgcaccttga

SEQ ID NO: 915126 - DNA, 25 bp, Mus musculus
tgtttggcagcatcatgcaccttga

SEQ ID NO: 915127 - DNA, 25 bp, Mus musculus
tgtttggcaggaattgacttggctc

SEQ ID NO: 915128 - DNA, 25 bp, Mus musculus
tgtttggcaggatttgacttggctc

SEQ ID NO: 915129 - DNA, 25 bp, Mus musculus
tgtttggcctagcatggaaccctga

SEQ ID NO: 915130 - DNA, 25 bp, Mus musculus
tgtttggcctaggatggaaccctga

SEQ ID NO: 915131 - DNA, 25 bp, Mus musculus
tgtttggcctctacaagaagtaccc

SEQ ID NO: 915132 - DNA, 25 bp, Mus musculus
tgtttggcctcttcaagaagtaccc

SEQ ID NO: 915133 - DNA, 25 bp, Mus musculus
tgtttggctcctattctatccaggt

SEQ ID NO: 915134 - DNA, 25 bp, Mus musculus
tgtttggctccttttctatccaggt

SEQ ID NO: 915135 - DNA, 25 bp, Mus musculus
tgtttggcttacctctgggaagaag

SEQ ID NO: 915136 - DNA, 25 bp, Mus musculus
tgtttggcttacgtctgggaagaag

SEQ ID NO: 915137 - DNA, 25 bp, Mus musculus
tgtttgggaaaaacacaccttgtat

SEQ ID NO: 915138 - DNA, 25 bp, Mus musculus
tgtttgggaaaatcacaccttgtat

SEQ ID NO: 915139 - DNA, 25 bp, Mus musculus
tgtttgggacccaagtacactccat

SEQ ID NO: 915140 - DNA, 25 bp, Mus musculus
tgtttgggaccctagtacactccat

SEQ ID NO: 915141 - DNA, 25 bp, Mus musculus
tgtttgggcagcaggcacggttcca

SEQ ID NO: 915142 - DNA, 25 bp, Mus musculus
tgtttgggcagctggcacggttcca

SEQ ID NO: 915143 - DNA, 25 bp, Mus musculus
tgtttggggaccaatatggactata

SEQ ID NO: 915144 - DNA, 25 bp, Mus musculus
tgtttggggacctatatggactata

SEQ ID NO: 915145 - DNA, 25 bp, Mus musculus
tgtttgggtcacacttgcctactat

SEQ ID NO: 915146 - DNA, 25 bp, Mus musculus
tgtttgggtcactcttgcctactat

SEQ ID NO: 915147 - DNA, 25 bp, Mus musculus
tgtttgggttgcctgaatcccttca

SEQ ID NO: 915148 - DNA, 25 bp, Mus musculus
tgtttgggttgcgtgaatcccttca

SEQ ID NO: 915149 - DNA, 25 bp, Mus musculus
tgtttgggttgtatcatgtgagatc

SEQ ID NO: 915150 - DNA, 25 bp, Mus musculus
tgtttgggttgtttcatgtgagatc

SEQ ID NO: 915151 - DNA, 25 bp, Mus musculus
tgtttgggttttcaccaggtctcac

SEQ ID NO: 915152 - DNA, 25 bp, Mus musculus
tgtttgggttttgaccaggtctcac

SEQ ID NO: 915153 - DNA, 25 bp, Mus musculus
tgtttggtacatagatttccgtgga

SEQ ID NO: 915154 - DNA, 25 bp, Mus musculus
tgtttggtacattgatttccgtgga

SEQ ID NO: 915155 - DNA, 25 bp, Mus musculus
tgtttggtaccacccattggcgata

SEQ ID NO: 915156 - DNA, 25 bp, Mus musculus
tgtttggtaccagccattggcgata

SEQ ID NO: 915157 - DNA, 25 bp, Mus musculus
tgtttggtctcaacgggagtcctgc

SEQ ID NO: 915158 - DNA, 25 bp, Mus musculus
tgtttggtctcatcgggagtcctgc

SEQ ID NO: 915159 - DNA, 25 bp, Mus musculus
tgtttggtgacaacccatcccatcc

SEQ ID NO: 915160 - DNA, 25 bp, Mus musculus
tgtttggtgacacctattctaggta

SEQ ID NO: 915161 - DNA, 25 bp, Mus musculus
tgtttggtgacagctattctaggta

SEQ ID NO: 915162 - DNA, 25 bp, Mus musculus
tgtttggtgacatcccatcccatcc

SEQ ID NO: 915163 - DNA, 25 bp, Mus musculus
tgtttggtgtacacttctctgctct

SEQ ID NO: 915164 - DNA, 25 bp, Mus musculus
tgtttggtgtactcttctctgctct

SEQ ID NO: 915165 - DNA, 25 bp, Mus musculus
tgtttggtgtctcccagatatttgc

SEQ ID NO: 915166 - DNA, 25 bp, Mus musculus
tgtttggtgtctgccagatatttgc

SEQ ID NO: 915167 - DNA, 25 bp, Mus musculus
tgtttggtgtgcacccattgatagt

SEQ ID NO: 915168 - DNA, 25 bp, Mus musculus
tgtttggtgtgccaaggttttaaag

SEQ ID NO: 915169 - DNA, 25 bp, Mus musculus
tgtttggtgtgcgaaggttttaaag

SEQ ID NO: 915170 - DNA, 25 bp, Mus musculus
tgtttggtgtgctcccattgatagt

SEQ ID NO: 915171 - DNA, 25 bp, Mus musculus
tgtttggttcctaggcagttttgaa

SEQ ID NO: 915172 - DNA, 25 bp, Mus musculus
tgtttggttccttggcagttttgaa

SEQ ID NO: 915173 - DNA, 25 bp, Mus musculus
tgtttggttcgcaacagctatatga

SEQ ID NO: 915174 - DNA, 25 bp, Mus musculus
tgtttggttcgctacagctatatga

SEQ ID NO: 915175 - DNA, 25 bp, Mus musculus
tgtttggttctcatactgttgaaag

SEQ ID NO: 915176 - DNA, 25 bp, Mus musculus
tgtttggttctcttactgttgaaag

SEQ ID NO: 915177 - DNA, 25 bp, Mus musculus
tgtttggttctgagtatgcagacac

SEQ ID NO: 915178 - DNA, 25 bp, Mus musculus
tgtttggttctgtgtatgcagacac

SEQ ID NO: 915179 - DNA, 25 bp, Mus musculus
tgtttgtaaacaacaagcccttgtt

SEQ ID NO: 915180 - DNA, 25 bp, Mus musculus
tgtttgtaaacatcaagcccttgtt

SEQ ID NO: 915181 - DNA, 25 bp, Mus musculus
tgtttgtaacccacacctgcgtgag

SEQ ID NO: 915182 - DNA, 25 bp, Mus musculus
tgtttgtaaccctcacctgcgtgag

SEQ ID NO: 915183 - DNA, 25 bp, Mus musculus
tgtttgtacacaattgacattggct

SEQ ID NO: 915184 - DNA, 25 bp, Mus musculus
tgtttgtacacatttgacattggct

SEQ ID NO: 915185 - DNA, 25 bp, Mus musculus
tgtttgtacaggctgccggtgtctc

SEQ ID NO: 915186 - DNA, 25 bp, Mus musculus
tgtttgtacagggtgccggtgtctc

SEQ ID NO: 915187 - DNA, 25 bp, Mus musculus
tgtttgtagacacggccaggaactt

SEQ ID NO: 915188 - DNA, 25 bp, Mus musculus
tgtttgtagacagggccaggaactt

SEQ ID NO: 915189 - DNA, 25 bp, Mus musculus
tgtttgtatggtcggagctagctcc

SEQ ID NO: 915190 - DNA, 25 bp, Mus musculus
tgtttgtatggtgggagctagctcc

SEQ ID NO: 915191 - DNA, 25 bp, Mus musculus
tgtttgtatgtaatcagccctgggt

SEQ ID NO: 915192 - DNA, 25 bp, Mus musculus
tgtttgtatgtattcagccctgggt

SEQ ID NO: 915193 - DNA, 25 bp, Mus musculus
tgtttgtattgtcttcctgaagcct

SEQ ID NO: 915194 - DNA, 25 bp, Mus musculus
tgtttgtattgtgttcctgaagcct

SEQ ID NO: 915195 - DNA, 25 bp, Mus musculus
tgtttgtcacacacaagtgttggct

SEQ ID NO: 915196 - DNA, 25 bp, Mus musculus
tgtttgtcacactcaagtgttggct

SEQ ID NO: 915197 - DNA, 25 bp, Mus musculus
tgtttgtcacccctcgataaagaaa

SEQ ID NO: 915198 - DNA, 25 bp, Mus musculus
tgtttgtcacccgtcgataaagaaa

SEQ ID NO: 915199 - DNA, 25 bp, Mus musculus
tgtttgtccataatccctgcaccat

SEQ ID NO: 915200 - DNA, 25 bp, Mus musculus
tgtttgtccatattccctgcaccat

SEQ ID NO: 915201 - DNA, 25 bp, Mus musculus
tgtttgtctctcaccaatggactat

SEQ ID NO: 915202 - DNA, 25 bp, Mus musculus
tgtttgtctctctccaatggactat

SEQ ID NO: 915203 - DNA, 25 bp, Mus musculus
tgtttgtctcttagcacaggctccg

SEQ ID NO: 915204 - DNA, 25 bp, Mus musculus
tgtttgtctctttgcacaggctccg

SEQ ID NO: 915205 - DNA, 25 bp, Mus musculus
tgtttgtctgtcacttaaaaggaaa

SEQ ID NO: 915206 - DNA, 25 bp, Mus musculus
tgtttgtctgtcatgaagctcagcc

SEQ ID NO: 915207 - DNA, 25 bp, Mus musculus
tgtttgtctgtctcttaaaaggaaa

SEQ ID NO: 915208 - DNA, 25 bp, Mus musculus
tgtttgtctgtcttgaagctcagcc

SEQ ID NO: 915209 - DNA, 25 bp, Mus musculus
tgtttgtcttgcagactctggctta

SEQ ID NO: 915210 - DNA, 25 bp, Mus musculus
tgtttgtcttgctgactctggctta

SEQ ID NO: 915211 - DNA, 25 bp, Mus musculus
tgtttgtctttcagagcttgcctta

SEQ ID NO: 915212 - DNA, 25 bp, Mus musculus
tgtttgtctttctgagcttgcctta

SEQ ID NO: 915213 - DNA, 25 bp, Mus musculus
tgtttgtgagtgagcacacgcgagt

SEQ ID NO: 915214 - DNA, 25 bp, Mus musculus
tgtttgtgagtgtgcacacgcgagt

SEQ ID NO: 915215 - DNA, 25 bp, Mus musculus
tgtttgtgattcaatttcttgtttg

SEQ ID NO: 915216 - DNA, 25 bp, Mus musculus
tgtttgtgattctatttcttgtttg

SEQ ID NO: 915217 - DNA, 25 bp, Mus musculus
tgtttgtgctagataacccttccat

SEQ ID NO: 915218 - DNA, 25 bp, Mus musculus
tgtttgtgctagttaacccttccat

SEQ ID NO: 915219 - DNA, 25 bp, Mus musculus
tgtttgtgcttgatctctgagagtt

SEQ ID NO: 915220 - DNA, 25 bp, Mus musculus
tgtttgtgcttgttctctgagagtt

SEQ ID NO: 915221 - DNA, 25 bp, Mus musculus
tgtttgtggacaacctacctgtgga

SEQ ID NO: 915222 - DNA, 25 bp, Mus musculus
tgtttgtggacatcctacctgtgga

SEQ ID NO: 915223 - DNA, 25 bp, Mus musculus
tgtttgtggctcagtatattacatt

SEQ ID NO: 915224 - DNA, 25 bp, Mus musculus
tgtttgtggctctgtatattacatt

SEQ ID NO: 915225 - DNA, 25 bp, Mus musculus
tgtttgtggcttatgccccaagtga

SEQ ID NO: 915226 - DNA, 25 bp, Mus musculus
tgtttgtggcttttgccccaagtga

SEQ ID NO: 915227 - DNA, 25 bp, Mus musculus
tgtttgtggttgattcactgtatac

SEQ ID NO: 915228 - DNA, 25 bp, Mus musculus
tgtttgtggttgtttcactgtatac

SEQ ID NO: 915229 - DNA, 25 bp, Mus musculus
tgtttgtgtgacactcaactgtggg

SEQ ID NO: 915230 - DNA, 25 bp, Mus musculus
tgtttgtgtgactctcaactgtggg

SEQ ID NO: 915231 - DNA, 25 bp, Mus musculus
tgtttgtgtgcaagggcccaggaca

SEQ ID NO: 915232 - DNA, 25 bp, Mus musculus
tgtttgtgtgcatgggcccaggaca

SEQ ID NO: 915233 - DNA, 25 bp, Mus musculus
tgtttgtgtgttcacatttgccagg

SEQ ID NO: 915234 - DNA, 25 bp, Mus musculus
tgtttgtgtgttgacatttgccagg

SEQ ID NO: 915235 - DNA, 25 bp, Mus musculus
tgtttgtgttacacagcatctggtc

SEQ ID NO: 915236 - DNA, 25 bp, Mus musculus
tgtttgtgttactcagcatctggtc

SEQ ID NO: 915237 - DNA, 25 bp, Mus musculus
tgtttgtgttcacagcttataggct

SEQ ID NO: 915238 - DNA, 25 bp, Mus musculus
tgtttgtgttcactgctttggttcc

SEQ ID NO: 915239 - DNA, 25 bp, Mus musculus
tgtttgtgttcagagcttataggct

SEQ ID NO: 915240 - DNA, 25 bp, Mus musculus
tgtttgtgttcagtgctttggttcc

SEQ ID NO: 915241 - DNA, 25 bp, Mus musculus
tgtttgttacgaagcagatatttaa

SEQ ID NO: 915242 - DNA, 25 bp, Mus musculus
tgtttgttacgatgcagatatttaa

SEQ ID NO: 915243 - DNA, 25 bp, Mus musculus
tgtttgttagttattctagccaata

SEQ ID NO: 915244 - DNA, 25 bp, Mus musculus
tgtttgttagtttttctagccaata

SEQ ID NO: 915245 - DNA, 25 bp, Mus musculus
tgtttgttatagcttgccccgagga

SEQ ID NO: 915246 - DNA, 25 bp, Mus musculus
tgtttgttatagcttggcccgagga

SEQ ID NO: 915247 - DNA, 25 bp, Mus musculus
tgtttgttataggttgccccgagga

SEQ ID NO: 915248 - DNA, 25 bp, Mus musculus
tgtttgttataggttggcccgagga

SEQ ID NO: 915249 - DNA, 25 bp, Mus musculus
tgtttgttcgttaccctgtgagcat

SEQ ID NO: 915250 - DNA, 25 bp, Mus musculus
tgtttgttcgtttccctgtgagcat

SEQ ID NO: 915251 - DNA, 25 bp, Mus musculus
tgtttgttctagcaataaatgctct

SEQ ID NO: 915252 - DNA, 25 bp, Mus musculus
tgtttgttctaggaataaatgctct

SEQ ID NO: 915253 - DNA, 25 bp, Mus musculus
tgtttgttgcccctggtaagtgaaa

SEQ ID NO: 915254 - DNA, 25 bp, Mus musculus
tgtttgttgcccgtggtaagtgaaa

SEQ ID NO: 915255 - DNA, 25 bp, Mus musculus
tgtttgttggccactgccacaatca

SEQ ID NO: 915256 - DNA, 25 bp, Mus musculus
tgtttgttggcctctgccacaatca

SEQ ID NO: 915257 - DNA, 25 bp, Mus musculus
tgtttgttgtggcttgaattttcta

SEQ ID NO: 915258 - DNA, 25 bp, Mus musculus
tgtttgttgtgggttgaattttcta

SEQ ID NO: 915259 - DNA, 25 bp, Mus musculus
tgtttgtttacacctaagtacctga

SEQ ID NO: 915260 - DNA, 25 bp, Mus musculus
tgtttgtttacagctaagtacctga

SEQ ID NO: 915261 - DNA, 25 bp, Mus musculus
tgtttgtttactacattttcccaga

SEQ ID NO: 915262 - DNA, 25 bp, Mus musculus
tgtttgtttacttcattttcccaga

SEQ ID NO: 915263 - DNA, 25 bp, Mus musculus
tgtttgtttagcctgcatgcccaca

SEQ ID NO: 915264 - DNA, 25 bp, Mus musculus
tgtttgtttagcgtgcatgcccaca

SEQ ID NO: 915265 - DNA, 25 bp, Mus musculus
tgtttgtttctacagatagtctccc

SEQ ID NO: 915266 - DNA, 25 bp, Mus musculus
tgtttgtttctagagatagtctccc

SEQ ID NO: 915267 - DNA, 25 bp, Mus musculus
tgtttgtttgatagagctctcttga

SEQ ID NO: 915268 - DNA, 25 bp, Mus musculus
tgtttgtttgattgagctctcttga

SEQ ID NO: 915269 - DNA, 25 bp, Mus musculus
tgtttgttttgacgctgggactcac

SEQ ID NO: 915270 - DNA, 25 bp, Mus musculus
tgtttgttttgaggctgggactcac

SEQ ID NO: 915271 - DNA, 25 bp, Mus musculus
tgtttgtttttcaaagcagcctctt

SEQ ID NO: 915272 - DNA, 25 bp, Mus musculus
tgtttgtttttcagacccgagtcag

SEQ ID NO: 915273 - DNA, 25 bp, Mus musculus
tgtttgtttttctaagcagcctctt

SEQ ID NO: 915274 - DNA, 25 bp, Mus musculus
tgtttgtttttctgacccgagtcag

SEQ ID NO: 915275 - DNA, 25 bp, Mus musculus
tgttttaaacgtatccagcttctgg

SEQ ID NO: 915276 - DNA, 25 bp, Mus musculus
tgttttaaacgtttccagcttctgg

SEQ ID NO: 915277 - DNA, 25 bp, Mus musculus
tgttttaaggcgctctcagtaaagg

SEQ ID NO: 915278 - DNA, 25 bp, Mus musculus
tgttttaaggcggtctcagtaaagg

SEQ ID NO: 915279 - DNA, 25 bp, Mus musculus
tgttttaatcctatgtgacaattcc

SEQ ID NO: 915280 - DNA, 25 bp, Mus musculus
tgttttaatcctttgtgacaattcc

SEQ ID NO: 915281 - DNA, 25 bp, Mus musculus
tgttttacactcagtaccactctgt

SEQ ID NO: 915282 - DNA, 25 bp, Mus musculus
tgttttacactctgtaccactctgt

SEQ ID NO: 915283 - DNA, 25 bp, Mus musculus
tgttttacagtgatcctttgggatc

SEQ ID NO: 915284 - DNA, 25 bp, Mus musculus
tgttttacagtgttcctttgggatc

SEQ ID NO: 915285 - DNA, 25 bp, Mus musculus
tgttttacatccaaatttactaagt

SEQ ID NO: 915286 - DNA, 25 bp, Mus musculus
tgttttacatcctaatttactaagt

SEQ ID NO: 915287 - DNA, 25 bp, Mus musculus
tgttttacatggagaggtactacct

SEQ ID NO: 915288 - DNA, 25 bp, Mus musculus
tgttttacatggtgaggtactacct

SEQ ID NO: 915289 - DNA, 25 bp, Mus musculus
tgttttaccacaagtcacaatttga

SEQ ID NO: 915290 - DNA, 25 bp, Mus musculus
tgttttaccacatgtcacaatttga

SEQ ID NO: 915291 - DNA, 25 bp, Mus musculus
tgttttaccctacaactgtgttaag

SEQ ID NO: 915292 - DNA, 25 bp, Mus musculus
tgttttaccctagaactgtgttaag

SEQ ID NO: 915293 - DNA, 25 bp, Mus musculus
tgttttacccttactactttgtcag

SEQ ID NO: 915294 - DNA, 25 bp, Mus musculus
tgttttaccctttctactttgtcag

SEQ ID NO: 915295 - DNA, 25 bp, Mus musculus
tgttttacctacaagagcttcagct

SEQ ID NO: 915296 - DNA, 25 bp, Mus musculus
tgttttacctactagagcttcagct

SEQ ID NO: 915297 - DNA, 25 bp, Mus musculus
tgttttacctgcatagtccacactt

SEQ ID NO: 915298 - DNA, 25 bp, Mus musculus
tgttttacctgcttagtccacactt

SEQ ID NO: 915299 - DNA, 25 bp, Mus musculus
tgttttactagaaatgggaatcatg

SEQ ID NO: 915300 - DNA, 25 bp, Mus musculus
tgttttactagatatgggaatcatg

SEQ ID NO: 915301 - DNA, 25 bp, Mus musculus
tgttttactcaaagctaggcatgtc

SEQ ID NO: 915302 - DNA, 25 bp, Mus musculus
tgttttactcaatgctaggcatgtc

SEQ ID NO: 915303 - DNA, 25 bp, Mus musculus
tgttttagacagctctggctggcct

SEQ ID NO: 915304 - DNA, 25 bp, Mus musculus
tgttttagacaggtctggctggcct

SEQ ID NO: 915305 - DNA, 25 bp, Mus musculus
tgttttagagagatctgcatcccaa

SEQ ID NO: 915306 - DNA, 25 bp, Mus musculus
tgttttagagagttctgcatcccaa

SEQ ID NO: 915307 - DNA, 25 bp, Mus musculus
tgttttagagctaaccatatgcaaa

SEQ ID NO: 915308 - DNA, 25 bp, Mus musculus
tgttttagagcttaccatatgcaaa

SEQ ID NO: 915309 - DNA, 25 bp, Mus musculus
tgttttagccttcaggtgtttggtt

SEQ ID NO: 915310 - DNA, 25 bp, Mus musculus
tgttttagccttgaggtgtttggtt

SEQ ID NO: 915311 - DNA, 25 bp, Mus musculus
tgttttagctacaccgatacaaaaa

SEQ ID NO: 915312 - DNA, 25 bp, Mus musculus
tgttttagctactccgatacaaaaa

SEQ ID NO: 915313 - DNA, 25 bp, Mus musculus
tgttttataccaacctacccacagc

SEQ ID NO: 915314 - DNA, 25 bp, Mus musculus
tgttttataccatcctacccacagc

SEQ ID NO: 915315 - DNA, 25 bp, Mus musculus
tgttttatactcctacttacccatt

SEQ ID NO: 915316 - DNA, 25 bp, Mus musculus
tgttttatactcgtacttacccatt

SEQ ID NO: 915317 - DNA, 25 bp, Mus musculus
tgttttatcagtacacaaagtgact

SEQ ID NO: 915318 - DNA, 25 bp, Mus musculus
tgttttatcagttcacaaagtgact

SEQ ID NO: 915319 - DNA, 25 bp, Mus musculus
tgttttatcgctactctactagtag

SEQ ID NO: 915320 - DNA, 25 bp, Mus musculus
tgttttatcgcttctctactagtag

SEQ ID NO: 915321 - DNA, 25 bp, Mus musculus
tgttttatgaaacgcccctaagctt

SEQ ID NO: 915322 - DNA, 25 bp, Mus musculus
tgttttatgaaaggcccctaagctt

SEQ ID NO: 915323 - DNA, 25 bp, Mus musculus
tgttttatgttcctagacttcttga

SEQ ID NO: 915324 - DNA, 25 bp, Mus musculus
tgttttatgttcgtagacttcttga

SEQ ID NO: 915325 - DNA, 25 bp, Mus musculus
tgttttatgtttccccttggtctaa

SEQ ID NO: 915326 - DNA, 25 bp, Mus musculus
tgttttatgtttgcccttggtctaa

SEQ ID NO: 915327 - DNA, 25 bp, Mus musculus
tgttttatttcacgatccacataaa

SEQ ID NO: 915328 - DNA, 25 bp, Mus musculus
tgttttatttcaggatccacataaa

SEQ ID NO: 915329 - DNA, 25 bp, Mus musculus
tgttttatttcgatcttcaccaaag

SEQ ID NO: 915330 - DNA, 25 bp, Mus musculus
tgttttatttcgttcttcaccaaag

SEQ ID NO: 915331 - DNA, 25 bp, Mus musculus
tgttttatttctagaccagtcttaa

SEQ ID NO: 915332 - DNA, 25 bp, Mus musculus
tgttttatttcttgaccagtcttaa

SEQ ID NO: 915333 - DNA, 25 bp, Mus musculus
tgttttcaaatacggctggcttctc

SEQ ID NO: 915334 - DNA, 25 bp, Mus musculus
tgttttcaaatagggctggcttctc

SEQ ID NO: 915335 - DNA, 25 bp, Mus musculus
tgttttcaacagactgtccacaatt

SEQ ID NO: 915336 - DNA, 25 bp, Mus musculus
tgttttcaacagtctgtccacaatt

SEQ ID NO: 915337 - DNA, 25 bp, Mus musculus
tgttttcaaccaatcccttagggat

SEQ ID NO: 915338 - DNA, 25 bp, Mus musculus
tgttttcaaccattcccttagggat

SEQ ID NO: 915339 - DNA, 25 bp, Mus musculus
tgttttcacacaccagtgtccagtg

SEQ ID NO: 915340 - DNA, 25 bp, Mus musculus
tgttttcacacagcagtgtccagtg

SEQ ID NO: 915341 - DNA, 25 bp, Mus musculus
tgttttcaccatacaaagtgctgtt

SEQ ID NO: 915342 - DNA, 25 bp, Mus musculus
tgttttcaccattcaaagtgctgtt

SEQ ID NO: 915343 - DNA, 25 bp, Mus musculus
tgttttcactatcctgccagaaagg

SEQ ID NO: 915344 - DNA, 25 bp, Mus musculus
tgttttcactatgctgccagaaagg

SEQ ID NO: 915345 - DNA, 25 bp, Mus musculus
tgttttcacttaagagctggctccc

SEQ ID NO: 915346 - DNA, 25 bp, Mus musculus
tgttttcacttatgagctggctccc

SEQ ID NO: 915347 - DNA, 25 bp, Mus musculus
tgttttcacttgatcatttttgcaa

SEQ ID NO: 915348 - DNA, 25 bp, Mus musculus
tgttttcacttgttcatttttgcaa

SEQ ID NO: 915349 - DNA, 25 bp, Mus musculus
tgttttcactttaactttgcatttg

SEQ ID NO: 915350 - DNA, 25 bp, Mus musculus
tgttttcactttatccaccaataga

SEQ ID NO: 915351 - DNA, 25 bp, Mus musculus
tgttttcacttttactttgcatttg

SEQ ID NO: 915352 - DNA, 25 bp, Mus musculus
tgttttcactttttccaccaataga

SEQ ID NO: 915353 - DNA, 25 bp, Mus musculus
tgttttcagaaaaccctaagattaa

SEQ ID NO: 915354 - DNA, 25 bp, Mus musculus
tgttttcagaaatccctaagattaa

SEQ ID NO: 915355 - DNA, 25 bp, Mus musculus
tgttttcagagcagcatctcactgc

SEQ ID NO: 915356 - DNA, 25 bp, Mus musculus
tgttttcagagctgcatctcactgc

SEQ ID NO: 915357 - DNA, 25 bp, Mus musculus
tgttttcagccacggtatctgtgct

SEQ ID NO: 915358 - DNA, 25 bp, Mus musculus
tgttttcagccagggtatctgtgct

SEQ ID NO: 915359 - DNA, 25 bp, Mus musculus
tgttttcaggccactgctcgatgag

SEQ ID NO: 915360 - DNA, 25 bp, Mus musculus
tgttttcaggcctctgctcgatgag

SEQ ID NO: 915361 - DNA, 25 bp, Mus musculus
tgttttcagggcacatcaggcactg

SEQ ID NO: 915362 - DNA, 25 bp, Mus musculus
tgttttcagggctcatcaggcactg

SEQ ID NO: 915363 - DNA, 25 bp, Mus musculus
tgttttcatcttctctcagctcagt

SEQ ID NO: 915364 - DNA, 25 bp, Mus musculus
tgttttcatcttgtctcagctcagt

SEQ ID NO: 915365 - DNA, 25 bp, Mus musculus
tgttttcatgagattccaaactgaa

SEQ ID NO: 915366 - DNA, 25 bp, Mus musculus
tgttttcatgagtttccaaactgaa

SEQ ID NO: 915367 - DNA, 25 bp, Mus musculus
tgttttcatgtcactctggaaatga

SEQ ID NO: 915368 - DNA, 25 bp, Mus musculus
tgttttcatgtcctggccaacattt

SEQ ID NO: 915369 - DNA, 25 bp, Mus musculus
tgttttcatgtcgtggccaacattt

SEQ ID NO: 915370 - DNA, 25 bp, Mus musculus
tgttttcatgtctctctggaaatga

SEQ ID NO: 915371 - DNA, 25 bp, Mus musculus
tgttttcatgttcagcagcagctgc

SEQ ID NO: 915372 - DNA, 25 bp, Mus musculus
tgttttcatgttgagcagcagctgc

SEQ ID NO: 915373 - DNA, 25 bp, Mus musculus
tgttttcattccaccgaagaagctg

SEQ ID NO: 915374 - DNA, 25 bp, Mus musculus
tgttttcattcctccgaagaagctg

SEQ ID NO: 915375 - DNA, 25 bp, Mus musculus
tgttttcattgtatcaaatatttgt

SEQ ID NO: 915376 - DNA, 25 bp, Mus musculus
tgttttcattgtttcaaatatttgt

SEQ ID NO: 915377 - DNA, 25 bp, Mus musculus
tgttttcatttgcaaggtactcaat

SEQ ID NO: 915378 - DNA, 25 bp, Mus musculus
tgttttcatttggaaggtactcaat

SEQ ID NO: 915379 - DNA, 25 bp, Mus musculus
tgttttccaaatccggtgcgaacct

SEQ ID NO: 915380 - DNA, 25 bp, Mus musculus
tgttttccaaatgcggtgcgaacct

SEQ ID NO: 915381 - DNA, 25 bp, Mus musculus
tgttttccaagccagcatccttgag

SEQ ID NO: 915382 - DNA, 25 bp, Mus musculus
tgttttccaagcgagcatccttgag

SEQ ID NO: 915383 - DNA, 25 bp, Mus musculus
tgttttccacatcacccatgtttaa

SEQ ID NO: 915384 - DNA, 25 bp, Mus musculus
tgttttccacatctccgatagccat

SEQ ID NO: 915385 - DNA, 25 bp, Mus musculus
tgttttccacatgacccatgtttaa

SEQ ID NO: 915386 - DNA, 25 bp, Mus musculus
tgttttccacatgtccgatagccat

SEQ ID NO: 915387 - DNA, 25 bp, Mus musculus
tgttttccacgtaccagtctgtctg

SEQ ID NO: 915388 - DNA, 25 bp, Mus musculus
tgttttccacgttccagtctgtctg

SEQ ID NO: 915389 - DNA, 25 bp, Mus musculus
tgttttccaggtagcacacatgcgg

SEQ ID NO: 915390 - DNA, 25 bp, Mus musculus
tgttttccaggtagtgatgttgtaa

SEQ ID NO: 915391 - DNA, 25 bp, Mus musculus
tgttttccaggttgcacacatgcgg

SEQ ID NO: 915392 - DNA, 25 bp, Mus musculus
tgttttccaggttgtgatgttgtaa

SEQ ID NO: 915393 - DNA, 25 bp, Mus musculus
tgttttcccaacacaaggtcggact

SEQ ID NO: 915394 - DNA, 25 bp, Mus musculus
tgttttcccaacagccaccaattgg

SEQ ID NO: 915395 - DNA, 25 bp, Mus musculus
tgttttcccaacagtttccatcaag

SEQ ID NO: 915396 - DNA, 25 bp, Mus musculus
tgttttcccaactcaaggtcggact

SEQ ID NO: 915397 - DNA, 25 bp, Mus musculus
tgttttcccaactgccaccaattgg

SEQ ID NO: 915398 - DNA, 25 bp, Mus musculus
tgttttcccaactgtttccatcaag

SEQ ID NO: 915399 - DNA, 25 bp, Mus musculus
tgttttcccaagaacacagtgtaaa

SEQ ID NO: 915400 - DNA, 25 bp, Mus musculus
tgttttcccaagtacacagtgtaaa

SEQ ID NO: 915401 - DNA, 25 bp, Mus musculus
tgttttcccaccacaatctgttttc

SEQ ID NO: 915402 - DNA, 25 bp, Mus musculus
tgttttcccacctcaatctgttttc

SEQ ID NO: 915403 - DNA, 25 bp, Mus musculus
tgttttcccagcatgagagcatgtt

SEQ ID NO: 915404 - DNA, 25 bp, Mus musculus
tgttttcccagcttgagagcatgtt

SEQ ID NO: 915405 - DNA, 25 bp, Mus musculus
tgttttccccataaaatctgaactt

SEQ ID NO: 915406 - DNA, 25 bp, Mus musculus
tgttttccccattaaatctgaactt

SEQ ID NO: 915407 - DNA, 25 bp, Mus musculus
tgttttcccctcaaaggatcagctg

SEQ ID NO: 915408 - DNA, 25 bp, Mus musculus
tgttttcccctctaaggatcagctg

SEQ ID NO: 915409 - DNA, 25 bp, Mus musculus
tgttttccccttaagacaaagagca

SEQ ID NO: 915410 - DNA, 25 bp, Mus musculus
tgttttccccttaggtgatacccag

SEQ ID NO: 915411 - DNA, 25 bp, Mus musculus
tgttttcccctttagacaaagagca

SEQ ID NO: 915412 - DNA, 25 bp, Mus musculus
tgttttcccctttggtgatacccag

SEQ ID NO: 915413 - DNA, 25 bp, Mus musculus
tgttttcccgcgcttggactccagg

SEQ ID NO: 915414 - DNA, 25 bp, Mus musculus
tgttttcccgcggttggactccagg

SEQ ID NO: 915415 - DNA, 25 bp, Mus musculus
tgttttccctctcaagggagtgggt

SEQ ID NO: 915416 - DNA, 25 bp, Mus musculus
tgttttccctctgaagggagtgggt

SEQ ID NO: 915417 - DNA, 25 bp, Mus musculus
tgttttcccttaagtgcattttaaa

SEQ ID NO: 915418 - DNA, 25 bp, Mus musculus
tgttttcccttatgtgcattttaaa

SEQ ID NO: 915419 - DNA, 25 bp, Mus musculus
tgttttccgcccaacaattttagca

SEQ ID NO: 915420 - DNA, 25 bp, Mus musculus
tgttttccgccctacaattttagca

SEQ ID NO: 915421 - DNA, 25 bp, Mus musculus
tgttttcctaaacctgatcccacag

SEQ ID NO: 915422 - DNA, 25 bp, Mus musculus
tgttttcctaaagctgatcccacag

SEQ ID NO: 915423 - DNA, 25 bp, Mus musculus
tgttttcctacaacctgcaggtaca

SEQ ID NO: 915424 - DNA, 25 bp, Mus musculus
tgttttcctacatcctgcaggtaca

SEQ ID NO: 915425 - DNA, 25 bp, Mus musculus
tgttttcctattccatgccttcaaa

SEQ ID NO: 915426 - DNA, 25 bp, Mus musculus
tgttttcctattgcatgccttcaaa

SEQ ID NO: 915427 - DNA, 25 bp, Mus musculus
tgttttcctcctagcctctgatggg

SEQ ID NO: 915428 - DNA, 25 bp, Mus musculus
tgttttcctccttgcctctgatggg

SEQ ID NO: 915429 - DNA, 25 bp, Mus musculus
tgttttcctctgagcactgcttaaa

SEQ ID NO: 915430 - DNA, 25 bp, Mus musculus
tgttttcctctgtgcactgcttaaa

SEQ ID NO: 915431 - DNA, 25 bp, Mus musculus
tgttttcctcttctgaccttcattc

SEQ ID NO: 915432 - DNA, 25 bp, Mus musculus
tgttttcctcttgtgaccttcattc

SEQ ID NO: 915433 - DNA, 25 bp, Mus musculus
tgttttcctgacatggctgccagca

SEQ ID NO: 915434 - DNA, 25 bp, Mus musculus
tgttttcctgacttggctgccagca

SEQ ID NO: 915435 - DNA, 25 bp, Mus musculus
tgttttcctgatagctgtgacccac

SEQ ID NO: 915436 - DNA, 25 bp, Mus musculus
tgttttcctgattgctgtgacccac

SEQ ID NO: 915437 - DNA, 25 bp, Mus musculus
tgttttcctgtaagttggatcccaa

SEQ ID NO: 915438 - DNA, 25 bp, Mus musculus
tgttttcctgtatgttggatcccaa

SEQ ID NO: 915439 - DNA, 25 bp, Mus musculus
tgttttccttagcaccctattctat

SEQ ID NO: 915440 - DNA, 25 bp, Mus musculus
tgttttccttaggaccctattctat

SEQ ID NO: 915441 - DNA, 25 bp, Mus musculus
tgttttccttctcgtcactcatgac

SEQ ID NO: 915442 - DNA, 25 bp, Mus musculus
tgttttccttctggtcactcatgac

SEQ ID NO: 915443 - DNA, 25 bp, Mus musculus
tgttttcctttcaccactttcaagt

SEQ ID NO: 915444 - DNA, 25 bp, Mus musculus
tgttttcctttctccactttcaagt

SEQ ID NO: 915445 - DNA, 25 bp, Mus musculus
tgttttcgggacaagctgaaggcac

SEQ ID NO: 915446 - DNA, 25 bp, Mus musculus
tgttttcgggactagctgaaggcac

SEQ ID NO: 915447 - DNA, 25 bp, Mus musculus
tgttttcgtgcccatcgtctcacgc

SEQ ID NO: 915448 - DNA, 25 bp, Mus musculus
tgttttcgtgccgatcgtctcacgc

SEQ ID NO: 915449 - DNA, 25 bp, Mus musculus
tgttttcgttttagcatgaatcgcg

SEQ ID NO: 915450 - DNA, 25 bp, Mus musculus
tgttttcgtttttgcatgaatcgcg

SEQ ID NO: 915451 - DNA, 25 bp, Mus musculus
tgttttctaaaaatcagctatggga

SEQ ID NO: 915452 - DNA, 25 bp, Mus musculus
tgttttctaaaattcagctatggga

SEQ ID NO: 915453 - DNA, 25 bp, Mus musculus
tgttttctaacccttgagactctcc

SEQ ID NO: 915454 - DNA, 25 bp, Mus musculus
tgttttctaaccgttgagactctcc

SEQ ID NO: 915455 - DNA, 25 bp, Mus musculus
tgttttctacttatccttgagccag

SEQ ID NO: 915456 - DNA, 25 bp, Mus musculus
tgttttctacttttccttgagccag

SEQ ID NO: 915457 - DNA, 25 bp, Mus musculus
tgttttctatataaggcgtgattgc

SEQ ID NO: 915458 - DNA, 25 bp, Mus musculus
tgttttctatattaggcgtgattgc

SEQ ID NO: 915459 - DNA, 25 bp, Mus musculus
tgttttctattaatcttcgttattt

SEQ ID NO: 915460 - DNA, 25 bp, Mus musculus
tgttttctattattcttcgttattt

SEQ ID NO: 915461 - DNA, 25 bp, Mus musculus
tgttttctcaggatttgctttttgg

SEQ ID NO: 915462 - DNA, 25 bp, Mus musculus
tgttttctcaggttttgctttttgg

SEQ ID NO: 915463 - DNA, 25 bp, Mus musculus
tgttttctcagtatttacctctact

SEQ ID NO: 915464 - DNA, 25 bp, Mus musculus
tgttttctcagtttttacctctact

SEQ ID NO: 915465 - DNA, 25 bp, Mus musculus
tgttttctcatccttgtctgttata

SEQ ID NO: 915466 - DNA, 25 bp, Mus musculus
tgttttctcatcgttgtctgttata

SEQ ID NO: 915467 - DNA, 25 bp, Mus musculus
tgttttctcatgctctaatgtaaat

SEQ ID NO: 915468 - DNA, 25 bp, Mus musculus
tgttttctcatggtctaatgtaaat

SEQ ID NO: 915469 - DNA, 25 bp, Mus musculus
tgttttctcattacggtttaccctg

SEQ ID NO: 915470 - DNA, 25 bp, Mus musculus
tgttttctcatttcggtttaccctg

SEQ ID NO: 915471 - DNA, 25 bp, Mus musculus
tgttttctctctaactattagccag

SEQ ID NO: 915472 - DNA, 25 bp, Mus musculus
tgttttctctcttactattagccag

SEQ ID NO: 915473 - DNA, 25 bp, Mus musculus
tgttttctgaaactactttggctaa

SEQ ID NO: 915474 - DNA, 25 bp, Mus musculus
tgttttctgaaagtactttggctaa

SEQ ID NO: 915475 - DNA, 25 bp, Mus musculus
tgttttctgactacctttatccatg

SEQ ID NO: 915476 - DNA, 25 bp, Mus musculus
tgttttctgacttcctttatccatg

SEQ ID NO: 915477 - DNA, 25 bp, Mus musculus
tgttttctgcagagtcctgtacaaa

SEQ ID NO: 915478 - DNA, 25 bp, Mus musculus
tgttttctgcagtgtcctgtacaaa

SEQ ID NO: 915479 - DNA, 25 bp, Mus musculus
tgttttctgcatattaatttcacgc

SEQ ID NO: 915480 - DNA, 25 bp, Mus musculus
tgttttctgcattttaatttcacgc

SEQ ID NO: 915481 - DNA, 25 bp, Mus musculus
tgttttctgccaagagggacacgaa

SEQ ID NO: 915482 - DNA, 25 bp, Mus musculus
tgttttctgccactcatcagtgtgc

SEQ ID NO: 915483 - DNA, 25 bp, Mus musculus
tgttttctgccagtcatcagtgtgc

SEQ ID NO: 915484 - DNA, 25 bp, Mus musculus
tgttttctgccatgagggacacgaa

SEQ ID NO: 915485 - DNA, 25 bp, Mus musculus
tgttttctgcctaagtctgggtgtc

SEQ ID NO: 915486 - DNA, 25 bp, Mus musculus
tgttttctgccttagtctgggtgtc

SEQ ID NO: 915487 - DNA, 25 bp, Mus musculus
tgttttctgcttaatttctttactc

SEQ ID NO: 915488 - DNA, 25 bp, Mus musculus
tgttttctgcttctaccacgtagat

SEQ ID NO: 915489 - DNA, 25 bp, Mus musculus
tgttttctgcttgtaccacgtagat

SEQ ID NO: 915490 - DNA, 25 bp, Mus musculus
tgttttctgctttatttctttactc

SEQ ID NO: 915491 - DNA, 25 bp, Mus musculus
tgttttctggaaatacggtggtggt

SEQ ID NO: 915492 - DNA, 25 bp, Mus musculus
tgttttctggaattacggtggtggt

SEQ ID NO: 915493 - DNA, 25 bp, Mus musculus
tgttttctggatatgaccatggcag

SEQ ID NO: 915494 - DNA, 25 bp, Mus musculus
tgttttctggatttgaccatggcag

SEQ ID NO: 915495 - DNA, 25 bp, Mus musculus
tgttttctgggtagctgccagctcc

SEQ ID NO: 915496 - DNA, 25 bp, Mus musculus
tgttttctgggtcttttcctgcaga

SEQ ID NO: 915497 - DNA, 25 bp, Mus musculus
tgttttctgggtgttttcctgcaga

SEQ ID NO: 915498 - DNA, 25 bp, Mus musculus
tgttttctgggttgctgccagctcc

SEQ ID NO: 915499 - DNA, 25 bp, Mus musculus
tgttttctggtactcgcacggaggt

SEQ ID NO: 915500 - DNA, 25 bp, Mus musculus
tgttttctggtagtcgcacggaggt

SEQ ID NO: 915501 - DNA, 25 bp, Mus musculus
tgttttctgtcccatgtctgtctga

SEQ ID NO: 915502 - DNA, 25 bp, Mus musculus
tgttttctgtccgatgtctgtctga

SEQ ID NO: 915503 - DNA, 25 bp, Mus musculus
tgttttctgtctcctttttaatgtc

SEQ ID NO: 915504 - DNA, 25 bp, Mus musculus
tgttttctgtctgctttttaatgtc

SEQ ID NO: 915505 - DNA, 25 bp, Mus musculus
tgttttcttaacaccaagtattctt

SEQ ID NO: 915506 - DNA, 25 bp, Mus musculus
tgttttcttaactccaagtattctt

SEQ ID NO: 915507 - DNA, 25 bp, Mus musculus
tgttttcttactcaggctcctaaag

SEQ ID NO: 915508 - DNA, 25 bp, Mus musculus
tgttttcttactgaggctcctaaag

SEQ ID NO: 915509 - DNA, 25 bp, Mus musculus
tgttttcttatcatactgtgggtag

SEQ ID NO: 915510 - DNA, 25 bp, Mus musculus
tgttttcttatcttactgtgggtag

SEQ ID NO: 915511 - DNA, 25 bp, Mus musculus
tgttttcttcacaaatggcaatggg

SEQ ID NO: 915512 - DNA, 25 bp, Mus musculus
tgttttcttcactaatggcaatggg

SEQ ID NO: 915513 - DNA, 25 bp, Mus musculus
tgttttcttccaagtgtccgttgtt

SEQ ID NO: 915514 - DNA, 25 bp, Mus musculus
tgttttcttccatgtgtccgttgtt

SEQ ID NO: 915515 - DNA, 25 bp, Mus musculus
tgttttcttctacatccaggaccac

SEQ ID NO: 915516 - DNA, 25 bp, Mus musculus
tgttttcttctagatccaggaccac

SEQ ID NO: 915517 - DNA, 25 bp, Mus musculus
tgttttcttgtactgcacagcagga

SEQ ID NO: 915518 - DNA, 25 bp, Mus musculus
tgttttcttgtagtgcacagcagga

SEQ ID NO: 915519 - DNA, 25 bp, Mus musculus
tgttttcttgtccacattgacctgc

SEQ ID NO: 915520 - DNA, 25 bp, Mus musculus
tgttttcttgtccttggtttgccta

SEQ ID NO: 915521 - DNA, 25 bp, Mus musculus
tgttttcttgtcgacattgacctgc

SEQ ID NO: 915522 - DNA, 25 bp, Mus musculus
tgttttcttgtcgttggtttgccta

SEQ ID NO: 915523 - DNA, 25 bp, Mus musculus
tgttttctttgaaggctactgagcc

SEQ ID NO: 915524 - DNA, 25 bp, Mus musculus
tgttttctttgatggctactgagcc

SEQ ID NO: 915525 - DNA, 25 bp, Mus musculus
tgttttctttgcatactgttcatcg

SEQ ID NO: 915526 - DNA, 25 bp, Mus musculus
tgttttctttgcttactgttcatcg

SEQ ID NO: 915527 - DNA, 25 bp, Mus musculus
tgttttcttttcaacagcattagag

SEQ ID NO: 915528 - DNA, 25 bp, Mus musculus
tgttttcttttcacctccttatgta

SEQ ID NO: 915529 - DNA, 25 bp, Mus musculus
tgttttcttttccatgtagcatccc

SEQ ID NO: 915530 - DNA, 25 bp, Mus musculus
tgttttcttttcgatgtagcatccc

SEQ ID NO: 915531 - DNA, 25 bp, Mus musculus
tgttttcttttctacagcattagag

SEQ ID NO: 915532 - DNA, 25 bp, Mus musculus
tgttttcttttctcctccttatgta

SEQ ID NO: 915533 - DNA, 25 bp, Mus musculus
tgttttgaaaccctggacatatttt

SEQ ID NO: 915534 - DNA, 25 bp, Mus musculus
tgttttgaaaccgtggacatatttt

SEQ ID NO: 915535 - DNA, 25 bp, Mus musculus
tgttttgaacatcacccttggcagt

SEQ ID NO: 915536 - DNA, 25 bp, Mus musculus
tgttttgaacatgacccttggcagt

SEQ ID NO: 915537 - DNA, 25 bp, Mus musculus
tgttttgacaacagacttaacagag

SEQ ID NO: 915538 - DNA, 25 bp, Mus musculus
tgttttgacaactgacttaacagag

SEQ ID NO: 915539 - DNA, 25 bp, Mus musculus
tgttttgacagcaggggatttttct

SEQ ID NO: 915540 - DNA, 25 bp, Mus musculus
tgttttgacagctggggatttttct

SEQ ID NO: 915541 - DNA, 25 bp, Mus musculus
tgttttgacctgcttgtctcgagcc

SEQ ID NO: 915542 - DNA, 25 bp, Mus musculus
tgttttgacctggttgtctcgagcc

SEQ ID NO: 915543 - DNA, 25 bp, Mus musculus
tgttttgacttgaaccttaaagctt

SEQ ID NO: 915544 - DNA, 25 bp, Mus musculus
tgttttgacttgtaccttaaagctt

SEQ ID NO: 915545 - DNA, 25 bp, Mus musculus
tgttttgagacaacccaagactctt

SEQ ID NO: 915546 - DNA, 25 bp, Mus musculus
tgttttgagacatcccaagactctt

SEQ ID NO: 915547 - DNA, 25 bp, Mus musculus
tgttttgagcacaggcgtttcagca

SEQ ID NO: 915548 - DNA, 25 bp, Mus musculus
tgttttgagcactggcgtttcagca

SEQ ID NO: 915549 - DNA, 25 bp, Mus musculus
tgttttgagtttacaatctggcatg

SEQ ID NO: 915550 - DNA, 25 bp, Mus musculus
tgttttgagttttcaatctggcatg

SEQ ID NO: 915551 - DNA, 25 bp, Mus musculus
tgttttgatcttaggaaacatcaaa

SEQ ID NO: 915552 - DNA, 25 bp, Mus musculus
tgttttgatctttggaaacatcaaa

SEQ ID NO: 915553 - DNA, 25 bp, Mus musculus
tgttttgcaattatattctctaagg

SEQ ID NO: 915554 - DNA, 25 bp, Mus musculus
tgttttgcaattttattctctaagg

SEQ ID NO: 915555 - DNA, 25 bp, Mus musculus
tgttttgcacttacagatagattgt

SEQ ID NO: 915556 - DNA, 25 bp, Mus musculus
tgttttgcactttcagatagattgt

SEQ ID NO: 915557 - DNA, 25 bp, Mus musculus
tgttttgcagtcctccgtttgcctg

SEQ ID NO: 915558 - DNA, 25 bp, Mus musculus
tgttttgcagtcgtccgtttgcctg

SEQ ID NO: 915559 - DNA, 25 bp, Mus musculus
tgttttgcagttctttgccagtatg

SEQ ID NO: 915560 - DNA, 25 bp, Mus musculus
tgttttgcagttgtttgccagtatg

SEQ ID NO: 915561 - DNA, 25 bp, Mus musculus
tgttttgcatggctttttctctttc

SEQ ID NO: 915562 - DNA, 25 bp, Mus musculus
tgttttgcatgggtttttctctttc

SEQ ID NO: 915563 - DNA, 25 bp, Mus musculus
tgttttgctcttaaggtggttgcct

SEQ ID NO: 915564 - DNA, 25 bp, Mus musculus
tgttttgctctttaggtggttgcct

SEQ ID NO: 915565 - DNA, 25 bp, Mus musculus
tgttttggaagcatgcccatctctt

SEQ ID NO: 915566 - DNA, 25 bp, Mus musculus
tgttttggaagcttgcccatctctt

SEQ ID NO: 915567 - DNA, 25 bp, Mus musculus
tgttttggctccaccgagttggtgg

SEQ ID NO: 915568 - DNA, 25 bp, Mus musculus
tgttttggctcctccgagttggtgg

SEQ ID NO: 915569 - DNA, 25 bp, Mus musculus
tgttttggctcgactgggtaatctc

SEQ ID NO: 915570 - DNA, 25 bp, Mus musculus
tgttttggctcgtctgggtaatctc

SEQ ID NO: 915571 - DNA, 25 bp, Mus musculus
tgttttgggattcagaaaactgctt

SEQ ID NO: 915572 - DNA, 25 bp, Mus musculus
tgttttgggattgagaaaactgctt

SEQ ID NO: 915573 - DNA, 25 bp, Mus musculus
tgttttgggcctatctggctataca

SEQ ID NO: 915574 - DNA, 25 bp, Mus musculus
tgttttgggcctttctggctataca

SEQ ID NO: 915575 - DNA, 25 bp, Mus musculus
tgttttggggtcaaaggctttctgt

SEQ ID NO: 915576 - DNA, 25 bp, Mus musculus
tgttttggggtctaaggctttctgt

SEQ ID NO: 915577 - DNA, 25 bp, Mus musculus
tgttttgggtacaaggcatttctaa

SEQ ID NO: 915578 - DNA, 25 bp, Mus musculus
tgttttgggtactaggcatttctaa

SEQ ID NO: 915579 - DNA, 25 bp, Mus musculus
tgttttggtgccatcttgggatctc

SEQ ID NO: 915580 - DNA, 25 bp, Mus musculus
tgttttggtgccttcttgggatctc

SEQ ID NO: 915581 - DNA, 25 bp, Mus musculus
tgttttggtgttcctcgttctgatg

SEQ ID NO: 915582 - DNA, 25 bp, Mus musculus
tgttttggtgttgctcgttctgatg

SEQ ID NO: 915583 - DNA, 25 bp, Mus musculus
tgttttggttgtatgggacacctcc

SEQ ID NO: 915584 - DNA, 25 bp, Mus musculus
tgttttggttgtttgggacacctcc

SEQ ID NO: 915585 - DNA, 25 bp, Mus musculus
tgttttggtttcatgttggctggac

SEQ ID NO: 915586 - DNA, 25 bp, Mus musculus
tgttttggtttcttgttggctggac

SEQ ID NO: 915587 - DNA, 25 bp, Mus musculus
tgttttgtaaatactccctctctca

SEQ ID NO: 915588 - DNA, 25 bp, Mus musculus
tgttttgtaaattctccctctctca

SEQ ID NO: 915589 - DNA, 25 bp, Mus musculus
tgttttgtacgaacctccattggcc

SEQ ID NO: 915590 - DNA, 25 bp, Mus musculus
tgttttgtacgatcctccattggcc

SEQ ID NO: 915591 - DNA, 25 bp, Mus musculus
tgttttgtacttaatcccatgtgat

SEQ ID NO: 915592 - DNA, 25 bp, Mus musculus
tgttttgtactttatcccatgtgat

SEQ ID NO: 915593 - DNA, 25 bp, Mus musculus
tgttttgtagatccctttaagtttc

SEQ ID NO: 915594 - DNA, 25 bp, Mus musculus
tgttttgtagatgcctttaagtttc

SEQ ID NO: 915595 - DNA, 25 bp, Mus musculus
tgttttgtcaaacagacctggatct

SEQ ID NO: 915596 - DNA, 25 bp, Mus musculus
tgttttgtcaaagagacctggatct

SEQ ID NO: 915597 - DNA, 25 bp, Mus musculus
tgttttgtccaactgcttattgctt

SEQ ID NO: 915598 - DNA, 25 bp, Mus musculus
tgttttgtccaagtgcttattgctt

SEQ ID NO: 915599 - DNA, 25 bp, Mus musculus
tgttttgtccctatcccatgaaaat

SEQ ID NO: 915600 - DNA, 25 bp, Mus musculus
tgttttgtccctttcccatgaaaat

SEQ ID NO: 915601 - DNA, 25 bp, Mus musculus
tgttttgtctgtacatgccagcaag

SEQ ID NO: 915602 - DNA, 25 bp, Mus musculus
tgttttgtctgttcatgccagcaag

SEQ ID NO: 915603 - DNA, 25 bp, Mus musculus
tgttttgtctttataactcccagca

SEQ ID NO: 915604 - DNA, 25 bp, Mus musculus
tgttttgtctttcctattgaaattt

SEQ ID NO: 915605 - DNA, 25 bp, Mus musculus
tgttttgtctttcgattacccttgc

SEQ ID NO: 915606 - DNA, 25 bp, Mus musculus
tgttttgtctttgctattgaaattt

SEQ ID NO: 915607 - DNA, 25 bp, Mus musculus
tgttttgtctttggattacccttgc

SEQ ID NO: 915608 - DNA, 25 bp, Mus musculus
tgttttgtctttttaactcccagca

SEQ ID NO: 915609 - DNA, 25 bp, Mus musculus
tgttttgtgaagcacaaggctacac

SEQ ID NO: 915610 - DNA, 25 bp, Mus musculus
tgttttgtgaaggacaaggctacac

SEQ ID NO: 915611 - DNA, 25 bp, Mus musculus
tgttttgtgattcggctctcgggaa

SEQ ID NO: 915612 - DNA, 25 bp, Mus musculus
tgttttgtgattgggctctcgggaa

SEQ ID NO: 915613 - DNA, 25 bp, Mus musculus
tgttttgtgccaatcagctcctaac

SEQ ID NO: 915614 - DNA, 25 bp, Mus musculus
tgttttgtgccattcagctcctaac

SEQ ID NO: 915615 - DNA, 25 bp, Mus musculus
tgttttgtggtcctcctatcgcgtc

SEQ ID NO: 915616 - DNA, 25 bp, Mus musculus
tgttttgtggtcgtcctatcgcgtc

SEQ ID NO: 915617 - DNA, 25 bp, Mus musculus
tgttttgtgtagacttccttgctta

SEQ ID NO: 915618 - DNA, 25 bp, Mus musculus
tgttttgtgtagtcttccttgctta

SEQ ID NO: 915619 - DNA, 25 bp, Mus musculus
tgttttgtgtcaacattcttcatgt

SEQ ID NO: 915620 - DNA, 25 bp, Mus musculus
tgttttgtgtcatcattcttcatgt

SEQ ID NO: 915621 - DNA, 25 bp, Mus musculus
tgttttgttaatcaccgcagctcta

SEQ ID NO: 915622 - DNA, 25 bp, Mus musculus
tgttttgttaatgaccgcagctcta

SEQ ID NO: 915623 - DNA, 25 bp, Mus musculus
tgttttgttactccttcataactgt

SEQ ID NO: 915624 - DNA, 25 bp, Mus musculus
tgttttgttactgcttcataactgt

SEQ ID NO: 915625 - DNA, 25 bp, Mus musculus
tgttttgttagcattcctacttcca

SEQ ID NO: 915626 - DNA, 25 bp, Mus musculus
tgttttgttagctttcctacttcca

SEQ ID NO: 915627 - DNA, 25 bp, Mus musculus
tgttttgttctgatattcctgttcg

SEQ ID NO: 915628 - DNA, 25 bp, Mus musculus
tgttttgttctgttattcctgttcg

SEQ ID NO: 915629 - DNA, 25 bp, Mus musculus
tgttttgttgatcgtgaggttttat

SEQ ID NO: 915630 - DNA, 25 bp, Mus musculus
tgttttgttgatggtgaggttttat

SEQ ID NO: 915631 - DNA, 25 bp, Mus musculus
tgttttgttgccatgcctgtaggga

SEQ ID NO: 915632 - DNA, 25 bp, Mus musculus
tgttttgttgccttgcctgtaggga

SEQ ID NO: 915633 - DNA, 25 bp, Mus musculus
tgttttgttgtactgtgctgcttag

SEQ ID NO: 915634 - DNA, 25 bp, Mus musculus
tgttttgttgtagtgtgctgcttag

SEQ ID NO: 915635 - DNA, 25 bp, Mus musculus
tgttttgttgtcacagggctcgaac

SEQ ID NO: 915636 - DNA, 25 bp, Mus musculus
tgttttgttgtcagtcatattccga

SEQ ID NO: 915637 - DNA, 25 bp, Mus musculus
tgttttgttgtctcagggctcgaac

SEQ ID NO: 915638 - DNA, 25 bp, Mus musculus
tgttttgttgtctgtcatattccga

SEQ ID NO: 915639 - DNA, 25 bp, Mus musculus
tgttttgttttcaatggttcctcct

SEQ ID NO: 915640 - DNA, 25 bp, Mus musculus
tgttttgttttctatggttcctcct

SEQ ID NO: 915641 - DNA, 25 bp, Mus musculus
tgtttttaaattcgagcccctggtg

SEQ ID NO: 915642 - DNA, 25 bp, Mus musculus
tgtttttaaattggagcccctggtg

SEQ ID NO: 915643 - DNA, 25 bp, Mus musculus
tgtttttaacctctacattgtgtaa

SEQ ID NO: 915644 - DNA, 25 bp, Mus musculus
tgtttttaacctgtacattgtgtaa

SEQ ID NO: 915645 - DNA, 25 bp, Mus musculus
tgtttttaactgcaacagttctcta

SEQ ID NO: 915646 - DNA, 25 bp, Mus musculus
tgtttttaactggaacagttctcta

SEQ ID NO: 915647 - DNA, 25 bp, Mus musculus
tgtttttaagggatggcagcggtat

SEQ ID NO: 915648 - DNA, 25 bp, Mus musculus
tgtttttaagggttggcagcggtat

SEQ ID NO: 915649 - DNA, 25 bp, Mus musculus
tgtttttaagtaaagctgccttctc

SEQ ID NO: 915650 - DNA, 25 bp, Mus musculus
tgtttttaagtatagctgccttctc

SEQ ID NO: 915651 - DNA, 25 bp, Mus musculus
tgtttttaatctctgttatcctaag

SEQ ID NO: 915652 - DNA, 25 bp, Mus musculus
tgtttttaatctgtgttatcctaag

SEQ ID NO: 915653 - DNA, 25 bp, Mus musculus
tgtttttacccaacctactgctaat

SEQ ID NO: 915654 - DNA, 25 bp, Mus musculus
tgtttttacccacaaaggattcagg

SEQ ID NO: 915655 - DNA, 25 bp, Mus musculus
tgtttttacccagaaaggattcagg

SEQ ID NO: 915656 - DNA, 25 bp, Mus musculus
tgtttttacccatcctactgctaat

SEQ ID NO: 915657 - DNA, 25 bp, Mus musculus
tgtttttactatcatcctggtgata

SEQ ID NO: 915658 - DNA, 25 bp, Mus musculus
tgtttttactatgatcctggtgata

SEQ ID NO: 915659 - DNA, 25 bp, Mus musculus
tgtttttagacaccttcattttgag

SEQ ID NO: 915660 - DNA, 25 bp, Mus musculus
tgtttttagacagcttcattttgag

SEQ ID NO: 915661 - DNA, 25 bp, Mus musculus
tgtttttagactcatcctcacaccc

SEQ ID NO: 915662 - DNA, 25 bp, Mus musculus
tgtttttagactgatcctcacaccc

SEQ ID NO: 915663 - DNA, 25 bp, Mus musculus
tgtttttagtttaagatgactccct

SEQ ID NO: 915664 - DNA, 25 bp, Mus musculus
tgtttttagttttagatgactccct

SEQ ID NO: 915665 - DNA, 25 bp, Mus musculus
tgtttttatgagcacagtaccatgt

SEQ ID NO: 915666 - DNA, 25 bp, Mus musculus
tgtttttatgaggacagtaccatgt

SEQ ID NO: 915667 - DNA, 25 bp, Mus musculus
tgtttttatgcactttcccggaaag

SEQ ID NO: 915668 - DNA, 25 bp, Mus musculus
tgtttttatgcagtttcccggaaag

SEQ ID NO: 915669 - DNA, 25 bp, Mus musculus
tgtttttcaaaccaatgggccatgg

SEQ ID NO: 915670 - DNA, 25 bp, Mus musculus
tgtttttcaaacgaatgggccatgg

SEQ ID NO: 915671 - DNA, 25 bp, Mus musculus
tgtttttcatacactcactcaccaa

SEQ ID NO: 915672 - DNA, 25 bp, Mus musculus
tgtttttcatactctcactcaccaa

SEQ ID NO: 915673 - DNA, 25 bp, Mus musculus
tgtttttcatatattagcagccctg

SEQ ID NO: 915674 - DNA, 25 bp, Mus musculus
tgtttttcatattttagcagccctg

SEQ ID NO: 915675 - DNA, 25 bp, Mus musculus
tgtttttcatcacgcgattttcaag

SEQ ID NO: 915676 - DNA, 25 bp, Mus musculus
tgtttttcatcaggcgattttcaag

SEQ ID NO: 915677 - DNA, 25 bp, Mus musculus
tgtttttccacacccaaggtgagag

SEQ ID NO: 915678 - DNA, 25 bp, Mus musculus
tgtttttccacagccaaggtgagag

SEQ ID NO: 915679 - DNA, 25 bp, Mus musculus
tgtttttccatcctgcagtcaagtg

SEQ ID NO: 915680 - DNA, 25 bp, Mus musculus
tgtttttccatcgtgcagtcaagtg

SEQ ID NO: 915681 - DNA, 25 bp, Mus musculus
tgtttttccctccagatcagcctac

SEQ ID NO: 915682 - DNA, 25 bp, Mus musculus
tgtttttccctcgagatcagcctac

SEQ ID NO: 915683 - DNA, 25 bp, Mus musculus
tgtttttcccttatagacgcagaga

SEQ ID NO: 915684 - DNA, 25 bp, Mus musculus
tgtttttcccttttagacgcagaga

SEQ ID NO: 915685 - DNA, 25 bp, Mus musculus
tgtttttccgaactctgcatttttt

SEQ ID NO: 915686 - DNA, 25 bp, Mus musculus
tgtttttccgaagtctgcatttttt

SEQ ID NO: 915687 - DNA, 25 bp, Mus musculus
tgtttttccgcaagtacactcaggc

SEQ ID NO: 915688 - DNA, 25 bp, Mus musculus
tgtttttccgcatgtacactcaggc

SEQ ID NO: 915689 - DNA, 25 bp, Mus musculus
tgtttttccggcagtacaatttgaa

SEQ ID NO: 915690 - DNA, 25 bp, Mus musculus
tgtttttccggctgtacaatttgaa

SEQ ID NO: 915691 - DNA, 25 bp, Mus musculus
tgtttttcctaccagagcctcattt

SEQ ID NO: 915692 - DNA, 25 bp, Mus musculus
tgtttttcctacgagagcctcattt

SEQ ID NO: 915693 - DNA, 25 bp, Mus musculus
tgtttttcctgtctccttgcattgt

SEQ ID NO: 915694 - DNA, 25 bp, Mus musculus
tgtttttcctgtgtccttgcattgt

SEQ ID NO: 915695 - DNA, 25 bp, Mus musculus
tgtttttccttgcacactcaaaatc

SEQ ID NO: 915696 - DNA, 25 bp, Mus musculus
tgtttttccttggacactcaaaatc

SEQ ID NO: 915697 - DNA, 25 bp, Mus musculus
tgtttttcctttatgtggtatgact

SEQ ID NO: 915698 - DNA, 25 bp, Mus musculus
tgtttttcctttttgtggtatgact

SEQ ID NO: 915699 - DNA, 25 bp, Mus musculus
tgtttttctaccagcttgtcttatt

SEQ ID NO: 915700 - DNA, 25 bp, Mus musculus
tgtttttctacctgcttgtcttatt

SEQ ID NO: 915701 - DNA, 25 bp, Mus musculus
tgtttttctacgatgctatgcagct

SEQ ID NO: 915702 - DNA, 25 bp, Mus musculus
tgtttttctacgttgctatgcagct

SEQ ID NO: 915703 - DNA, 25 bp, Mus musculus
tgtttttctagtaatttctccttct

SEQ ID NO: 915704 - DNA, 25 bp, Mus musculus
tgtttttctagttatttctccttct

SEQ ID NO: 915705 - DNA, 25 bp, Mus musculus
tgtttttctcaactgcaacatgaaa

SEQ ID NO: 915706 - DNA, 25 bp, Mus musculus
tgtttttctcaagtgcaacatgaaa

SEQ ID NO: 915707 - DNA, 25 bp, Mus musculus
tgtttttctcatagcacttttggtg

SEQ ID NO: 915708 - DNA, 25 bp, Mus musculus
tgtttttctcattgcacttttggtg

SEQ ID NO: 915709 - DNA, 25 bp, Mus musculus
tgtttttctctgattagcactgtga

SEQ ID NO: 915710 - DNA, 25 bp, Mus musculus
tgtttttctctgtttagcactgtga

SEQ ID NO: 915711 - DNA, 25 bp, Mus musculus
tgtttttctgacaataaccacattg

SEQ ID NO: 915712 - DNA, 25 bp, Mus musculus
tgtttttctgactataaccacattg

SEQ ID NO: 915713 - DNA, 25 bp, Mus musculus
tgtttttctgagaccctacacagta

SEQ ID NO: 915714 - DNA, 25 bp, Mus musculus
tgtttttctgagtccctacacagta

SEQ ID NO: 915715 - DNA, 25 bp, Mus musculus
tgtttttcttacagccggatccaaa

SEQ ID NO: 915716 - DNA, 25 bp, Mus musculus
tgtttttcttactgccggatccaaa

SEQ ID NO: 915717 - DNA, 25 bp, Mus musculus
tgtttttcttctatggttcagtcct

SEQ ID NO: 915718 - DNA, 25 bp, Mus musculus
tgtttttcttctttggttcagtcct

SEQ ID NO: 915719 - DNA, 25 bp, Mus musculus
tgtttttgacaacttctactctccc

SEQ ID NO: 915720 - DNA, 25 bp, Mus musculus
tgtttttgacaagttctactctccc

SEQ ID NO: 915721 - DNA, 25 bp, Mus musculus
tgtttttgacacagccatagcacat

SEQ ID NO: 915722 - DNA, 25 bp, Mus musculus
tgtttttgacactgccatagcacat

SEQ ID NO: 915723 - DNA, 25 bp, Mus musculus
tgtttttgacccatgctagtttctc

SEQ ID NO: 915724 - DNA, 25 bp, Mus musculus
tgtttttgacccttgctagtttctc

SEQ ID NO: 915725 - DNA, 25 bp, Mus musculus
tgtttttgagggatccggtcccaag

SEQ ID NO: 915726 - DNA, 25 bp, Mus musculus
tgtttttgagggttccggtcccaag

SEQ ID NO: 915727 - DNA, 25 bp, Mus musculus
tgtttttgcaccctcagtggttgtc

SEQ ID NO: 915728 - DNA, 25 bp, Mus musculus
tgtttttgcaccgtcagtggttgtc

SEQ ID NO: 915729 - DNA, 25 bp, Mus musculus
tgtttttgctgcatcctgggccttg

SEQ ID NO: 915730 - DNA, 25 bp, Mus musculus
tgtttttgctgcttcctgggccttg

SEQ ID NO: 915731 - DNA, 25 bp, Mus musculus
tgtttttgcttgacctcgaaaacca

SEQ ID NO: 915732 - DNA, 25 bp, Mus musculus
tgtttttgcttgtcctcgaaaacca

SEQ ID NO: 915733 - DNA, 25 bp, Mus musculus
tgtttttggcccctggattcaaatc

SEQ ID NO: 915734 - DNA, 25 bp, Mus musculus
tgtttttggcccgtggattcaaatc

SEQ ID NO: 915735 - DNA, 25 bp, Mus musculus
tgtttttggtacagagtctcagtac

SEQ ID NO: 915736 - DNA, 25 bp, Mus musculus
tgtttttggtactgagtctcagtac

SEQ ID NO: 915737 - DNA, 25 bp, Mus musculus
tgtttttgtaagattcaaggcagtt

SEQ ID NO: 915738 - DNA, 25 bp, Mus musculus
tgtttttgtaagtttcaaggcagtt

SEQ ID NO: 915739 - DNA, 25 bp, Mus musculus
tgtttttgtatacgagcccaggcag

SEQ ID NO: 915740 - DNA, 25 bp, Mus musculus
tgtttttgtataggagcccaggcag

SEQ ID NO: 915741 - DNA, 25 bp, Mus musculus
tgtttttgtcagaactgggctcgct

SEQ ID NO: 915742 - DNA, 25 bp, Mus musculus
tgtttttgtcagagagtccgacaga

SEQ ID NO: 915743 - DNA, 25 bp, Mus musculus
tgtttttgtcagtactgggctcgct

SEQ ID NO: 915744 - DNA, 25 bp, Mus musculus
tgtttttgtcagtgagtccgacaga

SEQ ID NO: 915745 - DNA, 25 bp, Mus musculus
tgtttttgtctaaaccaccactgct

SEQ ID NO: 915746 - DNA, 25 bp, Mus musculus
tgtttttgtctataccaccactgct

SEQ ID NO: 915747 - DNA, 25 bp, Mus musculus
tgtttttgtctgatcaagcccaatg

SEQ ID NO: 915748 - DNA, 25 bp, Mus musculus
tgtttttgtctgttcaagcccaatg

SEQ ID NO: 915749 - DNA, 25 bp, Mus musculus
tgtttttgtggtctgttggtttcct

SEQ ID NO: 915750 - DNA, 25 bp, Mus musculus
tgtttttgtggtgtgttggtttcct

SEQ ID NO: 915751 - DNA, 25 bp, Mus musculus
tgtttttgtttgacacccctcgata

SEQ ID NO: 915752 - DNA, 25 bp, Mus musculus
tgtttttgtttgtcacccctcgata

SEQ ID NO: 915753 - DNA, 25 bp, Mus musculus
tgttttttaagtccccgctctcaaa

SEQ ID NO: 915754 - DNA, 25 bp, Mus musculus
tgttttttaagtgcccgctctcaaa

SEQ ID NO: 915755 - DNA, 25 bp, Mus musculus
tgttttttatgacgtatgaatacct

SEQ ID NO: 915756 - DNA, 25 bp, Mus musculus
tgttttttatgaggtatgaatacct

SEQ ID NO: 915757 - DNA, 25 bp, Mus musculus
tgttttttcaaaactcaccatgtag

SEQ ID NO: 915758 - DNA, 25 bp, Mus musculus
tgttttttcaaatctcaccatgtag

SEQ ID NO: 915759 - DNA, 25 bp, Mus musculus
tgttttttcattcttcccacagata

SEQ ID NO: 915760 - DNA, 25 bp, Mus musculus
tgttttttcattgttcccacagata

SEQ ID NO: 915761 - DNA, 25 bp, Mus musculus
tgttttttccataaagtgtgctgct

SEQ ID NO: 915762 - DNA, 25 bp, Mus musculus
tgttttttccattaagtgtgctgct

SEQ ID NO: 915763 - DNA, 25 bp, Mus musculus
tgttttttccttctgcaagagaatg

SEQ ID NO: 915764 - DNA, 25 bp, Mus musculus
tgttttttccttgtgcaagagaatg

SEQ ID NO: 915765 - DNA, 25 bp, Mus musculus
tgttttttcttaagttgtgttacta

SEQ ID NO: 915766 - DNA, 25 bp, Mus musculus
tgttttttcttatgttgtgttacta

SEQ ID NO: 915767 - DNA, 25 bp, Mus musculus
tgttttttgatcatccgaacttggc

SEQ ID NO: 915768 - DNA, 25 bp, Mus musculus
tgttttttgatcttccgaacttggc

SEQ ID NO: 915769 - DNA, 25 bp, Mus musculus
tgttttttgcccaggacaaaagtct

SEQ ID NO: 915770 - DNA, 25 bp, Mus musculus
tgttttttgccctggacaaaagtct

SEQ ID NO: 915771 - DNA, 25 bp, Mus musculus
tgttttttgcctccctctatgtctg

SEQ ID NO: 915772 - DNA, 25 bp, Mus musculus
tgttttttgcctgcctctatgtctg

SEQ ID NO: 915773 - DNA, 25 bp, Mus musculus
tgttttttggatccccaagtctgaa

SEQ ID NO: 915774 - DNA, 25 bp, Mus musculus
tgttttttggatgcccaagtctgaa

SEQ ID NO: 915775 - DNA, 25 bp, Mus musculus
tgttttttgtctagtcttataaaag

SEQ ID NO: 915776 - DNA, 25 bp, Mus musculus
tgttttttgtctccgtcctacactt

SEQ ID NO: 915777 - DNA, 25 bp, Mus musculus
tgttttttgtctgcgtcctacactt

SEQ ID NO: 915778 - DNA, 25 bp, Mus musculus
tgttttttgtcttgtcttataaaag

SEQ ID NO: 915779 - DNA, 25 bp, Mus musculus
ttaaaaaatcctcttccagaagcag

SEQ ID NO: 915780 - DNA, 25 bp, Mus musculus
ttaaaaaatcctgttccagaagcag

SEQ ID NO: 915781 - DNA, 25 bp, Mus musculus
ttaaaaaattccactttcctatgct

SEQ ID NO: 915782 - DNA, 25 bp, Mus musculus
ttaaaaaattcctctttcctatgct

SEQ ID NO: 915783 - DNA, 25 bp, Mus musculus
ttaaaaacaagtatactgcaatgtg

SEQ ID NO: 915784 - DNA, 25 bp, Mus musculus
ttaaaaacaagtctctggggctgga

SEQ ID NO: 915785 - DNA, 25 bp, Mus musculus
ttaaaaacaagtgtctggggctgga

SEQ ID NO: 915786 - DNA, 25 bp, Mus musculus
ttaaaaacaagtttactgcaatgtg

SEQ ID NO: 915787 - DNA, 25 bp, Mus musculus
ttaaaaacacacatcgaagctggag

SEQ ID NO: 915788 - DNA, 25 bp, Mus musculus
ttaaaaacacacttcgaagctggag

SEQ ID NO: 915789 - DNA, 25 bp, Mus musculus
ttaaaaaccacgaagcagcccacgg

SEQ ID NO: 915790 - DNA, 25 bp, Mus musculus
ttaaaaaccacgtagcagcccacgg

SEQ ID NO: 915791 - DNA, 25 bp, Mus musculus
ttaaaaacccataaagacgatgtca

SEQ ID NO: 915792 - DNA, 25 bp, Mus musculus
ttaaaaacccattaagacgatgtca

SEQ ID NO: 915793 - DNA, 25 bp, Mus musculus
ttaaaaacggtcagtgcttccctct

SEQ ID NO: 915794 - DNA, 25 bp, Mus musculus
ttaaaaacggtctgtgcttccctct

SEQ ID NO: 915795 - DNA, 25 bp, Mus musculus
ttaaaaactcaacgcctcacacatt

SEQ ID NO: 915796 - DNA, 25 bp, Mus musculus
ttaaaaactcaaggcctcacacatt

SEQ ID NO: 915797 - DNA, 25 bp, Mus musculus
ttaaaaactgcgatcacatcctggc

SEQ ID NO: 915798 - DNA, 25 bp, Mus musculus
ttaaaaactgcgttcacatcctggc

SEQ ID NO: 915799 - DNA, 25 bp, Mus musculus
ttaaaaagcagactccgctgtcctt

SEQ ID NO: 915800 - DNA, 25 bp, Mus musculus
ttaaaaagcagagtccgctgtcctt

SEQ ID NO: 915801 - DNA, 25 bp, Mus musculus
ttaaaaagtactcgctgcccttgca

SEQ ID NO: 915802 - DNA, 25 bp, Mus musculus
ttaaaaagtactggctgcccttgca

SEQ ID NO: 915803 - DNA, 25 bp, Mus musculus
ttaaaaagtggcatactagaagaag

SEQ ID NO: 915804 - DNA, 25 bp, Mus musculus
ttaaaaagtggcttactagaagaag

SEQ ID NO: 915805 - DNA, 25 bp, Mus musculus
ttaaaaatatgcctccctccctagg

SEQ ID NO: 915806 - DNA, 25 bp, Mus musculus
ttaaaaatatgcgtccctccctagg

SEQ ID NO: 915807 - DNA, 25 bp, Mus musculus
ttaaaaatccaccaactcacacatt

SEQ ID NO: 915808 - DNA, 25 bp, Mus musculus
ttaaaaatccacgaactcacacatt

SEQ ID NO: 915809 - DNA, 25 bp, Mus musculus
ttaaaaatcgctcgcttccggttgg

SEQ ID NO: 915810 - DNA, 25 bp, Mus musculus
ttaaaaatcgctggcttccggttgg

SEQ ID NO: 915811 - DNA, 25 bp, Mus musculus
ttaaaaatcttgaaggaggctgtac

SEQ ID NO: 915812 - DNA, 25 bp, Mus musculus
ttaaaaatcttgtaggaggctgtac

SEQ ID NO: 915813 - DNA, 25 bp, Mus musculus
ttaaaaatgctgagagtaacgctga

SEQ ID NO: 915814 - DNA, 25 bp, Mus musculus
ttaaaaatgctgtgagtaacgctga

SEQ ID NO: 915815 - DNA, 25 bp, Mus musculus
ttaaaaattatacggtcctcaacag

SEQ ID NO: 915816 - DNA, 25 bp, Mus musculus
ttaaaaattatagggtcctcaacag

SEQ ID NO: 915817 - DNA, 25 bp, Mus musculus
ttaaaacacctaagtgactaccact

SEQ ID NO: 915818 - DNA, 25 bp, Mus musculus
ttaaaacacctatgtgactaccact

SEQ ID NO: 915819 - DNA, 25 bp, Mus musculus
ttaaaacagctaacattcttacatg

SEQ ID NO: 915820 - DNA, 25 bp, Mus musculus
ttaaaacagctatcattcttacatg

SEQ ID NO: 915821 - DNA, 25 bp, Mus musculus
ttaaaacaggacagggacgccatat

SEQ ID NO: 915822 - DNA, 25 bp, Mus musculus
ttaaaacaggactgggacgccatat

SEQ ID NO: 915823 - DNA, 25 bp, Mus musculus
ttaaaacagtgtacctgccctctac

SEQ ID NO: 915824 - DNA, 25 bp, Mus musculus
ttaaaacagtgttcctgccctctac

SEQ ID NO: 915825 - DNA, 25 bp, Mus musculus
ttaaaacatatcctttttctgatga

SEQ ID NO: 915826 - DNA, 25 bp, Mus musculus
ttaaaacatatcgtttttctgatga

SEQ ID NO: 915827 - DNA, 25 bp, Mus musculus
ttaaaacatgttaccttcctcctgt

SEQ ID NO: 915828 - DNA, 25 bp, Mus musculus
ttaaaacatgtttccttcctcctgt

SEQ ID NO: 915829 - DNA, 25 bp, Mus musculus
ttaaaaccacccagcatgttccatt

SEQ ID NO: 915830 - DNA, 25 bp, Mus musculus
ttaaaaccaccctgcatgttccatt

SEQ ID NO: 915831 - DNA, 25 bp, Mus musculus
ttaaaaccacgtcggatcaggatca

SEQ ID NO: 915832 - DNA, 25 bp, Mus musculus
ttaaaaccacgtgggatcaggatca

SEQ ID NO: 915833 - DNA, 25 bp, Mus musculus
ttaaaacccacaccaactcagaaga

SEQ ID NO: 915834 - DNA, 25 bp, Mus musculus
ttaaaacccacagcaactcagaaga

SEQ ID NO: 915835 - DNA, 25 bp, Mus musculus
ttaaaacccattctctgtcacacca

SEQ ID NO: 915836 - DNA, 25 bp, Mus musculus
ttaaaacccattgtctgtcacacca

SEQ ID NO: 915837 - DNA, 25 bp, Mus musculus
ttaaaacctatcaccaagcccacaa

SEQ ID NO: 915838 - DNA, 25 bp, Mus musculus
ttaaaacctatctccaagcccacaa

SEQ ID NO: 915839 - DNA, 25 bp, Mus musculus
ttaaaacctgggaccacctgacagt

SEQ ID NO: 915840 - DNA, 25 bp, Mus musculus
ttaaaacctgggtccacctgacagt

SEQ ID NO: 915841 - DNA, 25 bp, Mus musculus
ttaaaaccttgtccccatttgtgat

SEQ ID NO: 915842 - DNA, 25 bp, Mus musculus
ttaaaaccttgtgcccatttgtgat

SEQ ID NO: 915843 - DNA, 25 bp, Mus musculus
ttaaaaccttttagagatagggcat

SEQ ID NO: 915844 - DNA, 25 bp, Mus musculus
ttaaaacctttttgagatagggcat

SEQ ID NO: 915845 - DNA, 25 bp, Mus musculus
ttaaaacgacaaactgctggacaga

SEQ ID NO: 915846 - DNA, 25 bp, Mus musculus
ttaaaacgacaatctgctggacaga

SEQ ID NO: 915847 - DNA, 25 bp, Mus musculus
ttaaaacgttccagctggaggccac

SEQ ID NO: 915848 - DNA, 25 bp, Mus musculus
ttaaaacgttcctgctggaggccac

SEQ ID NO: 915849 - DNA, 25 bp, Mus musculus
ttaaaactaccacacactcatactt

SEQ ID NO: 915850 - DNA, 25 bp, Mus musculus
ttaaaactaccagacactcatactt

SEQ ID NO: 915851 - DNA, 25 bp, Mus musculus
ttaaaactagagatcctgctttggg

SEQ ID NO: 915852 - DNA, 25 bp, Mus musculus
ttaaaactagagttcctgctttggg

SEQ ID NO: 915853 - DNA, 25 bp, Mus musculus
ttaaaactagtcagcaggtcatatc

SEQ ID NO: 915854 - DNA, 25 bp, Mus musculus
ttaaaactagtctgcaggtcatatc

SEQ ID NO: 915855 - DNA, 25 bp, Mus musculus
ttaaaactcacaacatcagcaattc

SEQ ID NO: 915856 - DNA, 25 bp, Mus musculus
ttaaaactcacatcatcagcaattc

SEQ ID NO: 915857 - DNA, 25 bp, Mus musculus
ttaaaactcccactgatcccaaatt

SEQ ID NO: 915858 - DNA, 25 bp, Mus musculus
ttaaaactcccagtgatcccaaatt

SEQ ID NO: 915859 - DNA, 25 bp, Mus musculus
ttaaaactccctatagcacatctca

SEQ ID NO: 915860 - DNA, 25 bp, Mus musculus
ttaaaactccctttagcacatctca

SEQ ID NO: 915861 - DNA, 25 bp, Mus musculus
ttaaaactcgccatactgattgtag

SEQ ID NO: 915862 - DNA, 25 bp, Mus musculus
ttaaaactcgccttactgattgtag

SEQ ID NO: 915863 - DNA, 25 bp, Mus musculus
ttaaaactctctccatggttacctc

SEQ ID NO: 915864 - DNA, 25 bp, Mus musculus
ttaaaactctctgcatggttacctc

SEQ ID NO: 915865 - DNA, 25 bp, Mus musculus
ttaaaactggtcagcaacttgctct

SEQ ID NO: 915866 - DNA, 25 bp, Mus musculus
ttaaaactggtctgcaacttgctct

SEQ ID NO: 915867 - DNA, 25 bp, Mus musculus
ttaaaactgtacactgaatcatgat

SEQ ID NO: 915868 - DNA, 25 bp, Mus musculus
ttaaaactgtactctgaatcatgat

SEQ ID NO: 915869 - DNA, 25 bp, Mus musculus
ttaaaactgtagaagcagctggagt

SEQ ID NO: 915870 - DNA, 25 bp, Mus musculus
ttaaaactgtagtagcagctggagt

SEQ ID NO: 915871 - DNA, 25 bp, Mus musculus
ttaaaactgtccctgtaatgccctt

SEQ ID NO: 915872 - DNA, 25 bp, Mus musculus
ttaaaactgtccgtgtaatgccctt

SEQ ID NO: 915873 - DNA, 25 bp, Mus musculus
ttaaaactgtttcatccgggcgtgg

SEQ ID NO: 915874 - DNA, 25 bp, Mus musculus
ttaaaactgtttgatccgggcgtgg

SEQ ID NO: 915875 - DNA, 25 bp, Mus musculus
ttaaaacttgaaatgggcactgcca

SEQ ID NO: 915876 - DNA, 25 bp, Mus musculus
ttaaaacttgaattgggcactgcca

SEQ ID NO: 915877 - DNA, 25 bp, Mus musculus
ttaaaagacggaccaggcacccagg

SEQ ID NO: 915878 - DNA, 25 bp, Mus musculus
ttaaaagacggagcaggcacccagg

SEQ ID NO: 915879 - DNA, 25 bp, Mus musculus
ttaaaagagagtcacttccccagcc

SEQ ID NO: 915880 - DNA, 25 bp, Mus musculus
ttaaaagagagtgacttccccagcc

SEQ ID NO: 915881 - DNA, 25 bp, Mus musculus
ttaaaagattgccagtacccactga

SEQ ID NO: 915882 - DNA, 25 bp, Mus musculus
ttaaaagattgcgagtacccactga

SEQ ID NO: 915883 - DNA, 25 bp, Mus musculus
ttaaaagcaatcatcccctgacagc

SEQ ID NO: 915884 - DNA, 25 bp, Mus musculus
ttaaaagcaatcttcccctgacagc

SEQ ID NO: 915885 - DNA, 25 bp, Mus musculus
ttaaaagcccaaattacagccgtat

SEQ ID NO: 915886 - DNA, 25 bp, Mus musculus
ttaaaagcccaatttacagccgtat

SEQ ID NO: 915887 - DNA, 25 bp, Mus musculus
ttaaaagccccactaaagcaaatga

SEQ ID NO: 915888 - DNA, 25 bp, Mus musculus
ttaaaagccccagtaaagcaaatga

SEQ ID NO: 915889 - DNA, 25 bp, Mus musculus
ttaaaagccctgcattcaccatgat

SEQ ID NO: 915890 - DNA, 25 bp, Mus musculus
ttaaaagccctggattcaccatgat

SEQ ID NO: 915891 - DNA, 25 bp, Mus musculus
ttaaaagcctcaagccagcgtactg

SEQ ID NO: 915892 - DNA, 25 bp, Mus musculus
ttaaaagcctcatgccagcgtactg

SEQ ID NO: 915893 - DNA, 25 bp, Mus musculus
ttaaaagcctgcagttgccagcact

SEQ ID NO: 915894 - DNA, 25 bp, Mus musculus
ttaaaagcctgctgttgccagcact

SEQ ID NO: 915895 - DNA, 25 bp, Mus musculus
ttaaaagctatgacttcttccagag

SEQ ID NO: 915896 - DNA, 25 bp, Mus musculus
ttaaaagctatgtcttcttccagag

SEQ ID NO: 915897 - DNA, 25 bp, Mus musculus
ttaaaagctcaacttgtgctgggca

SEQ ID NO: 915898 - DNA, 25 bp, Mus musculus
ttaaaagctcaagttgtgctgggca

SEQ ID NO: 915899 - DNA, 25 bp, Mus musculus
ttaaaagctgccaccagtccagaaa

SEQ ID NO: 915900 - DNA, 25 bp, Mus musculus
ttaaaagctgcctccagtccagaaa

SEQ ID NO: 915901 - DNA, 25 bp, Mus musculus
ttaaaaggattgctctgccgggcgt

SEQ ID NO: 915902 - DNA, 25 bp, Mus musculus
ttaaaaggattggtctgccgggcgt

SEQ ID NO: 915903 - DNA, 25 bp, Mus musculus
ttaaaaggtgaactcatgccccggt

SEQ ID NO: 915904 - DNA, 25 bp, Mus musculus
ttaaaaggtgaagtcatgccccggt

SEQ ID NO: 915905 - DNA, 25 bp, Mus musculus
ttaaaagtacacatgctggatcaaa

SEQ ID NO: 915906 - DNA, 25 bp, Mus musculus
ttaaaagtacacttgctggatcaaa

SEQ ID NO: 915907 - DNA, 25 bp, Mus musculus
ttaaaagtactccacagcacggctc

SEQ ID NO: 915908 - DNA, 25 bp, Mus musculus
ttaaaagtactcgacagcacggctc

SEQ ID NO: 915909 - DNA, 25 bp, Mus musculus
ttaaaagtcaacaagctctaaagct

SEQ ID NO: 915910 - DNA, 25 bp, Mus musculus
ttaaaagtcaactagctctaaagct

SEQ ID NO: 915911 - DNA, 25 bp, Mus musculus
ttaaaagtcctgcaggcaggcgctc

SEQ ID NO: 915912 - DNA, 25 bp, Mus musculus
ttaaaagtcctggaggcaggcgctc

SEQ ID NO: 915913 - DNA, 25 bp, Mus musculus
ttaaaagtctcaccttaagcctaag

SEQ ID NO: 915914 - DNA, 25 bp, Mus musculus
ttaaaagtctcagcttaagcctaag

SEQ ID NO: 915915 - DNA, 25 bp, Mus musculus
ttaaaagtgtccatcatccttcaca

SEQ ID NO: 915916 - DNA, 25 bp, Mus musculus
ttaaaagtgtccttcatccttcaca

SEQ ID NO: 915917 - DNA, 25 bp, Mus musculus
ttaaaagttactcactcctgcccct

SEQ ID NO: 915918 - DNA, 25 bp, Mus musculus
ttaaaagttactgactcctgcccct

SEQ ID NO: 915919 - DNA, 25 bp, Mus musculus
ttaaaagttcacattgccccatttc

SEQ ID NO: 915920 - DNA, 25 bp, Mus musculus
ttaaaagttcactttgccccatttc

SEQ ID NO: 915921 - DNA, 25 bp, Mus musculus
ttaaaagttcttacaccccacacat

SEQ ID NO: 915922 - DNA, 25 bp, Mus musculus
ttaaaagttctttcaccccacacat

SEQ ID NO: 915923 - DNA, 25 bp, Mus musculus
ttaaaagtttcacaccccctgacat

SEQ ID NO: 915924 - DNA, 25 bp, Mus musculus
ttaaaagtttcagaccccctgacat

SEQ ID NO: 915925 - DNA, 25 bp, Mus musculus
ttaaaatatgttcttcatcccctct

SEQ ID NO: 915926 - DNA, 25 bp, Mus musculus
ttaaaatatgttgttcatcccctct

SEQ ID NO: 915927 - DNA, 25 bp, Mus musculus
ttaaaatcaccaactcagcccctgg

SEQ ID NO: 915928 - DNA, 25 bp, Mus musculus
ttaaaatcaccatctcagcccctgg

SEQ ID NO: 915929 - DNA, 25 bp, Mus musculus
ttaaaatcaccgactccatgaggat

SEQ ID NO: 915930 - DNA, 25 bp, Mus musculus
ttaaaatcaccgtctccatgaggat

SEQ ID NO: 915931 - DNA, 25 bp, Mus musculus
ttaaaatcatgtatggctcatgggt

SEQ ID NO: 915932 - DNA, 25 bp, Mus musculus
ttaaaatcatgtttggctcatgggt

SEQ ID NO: 915933 - DNA, 25 bp, Mus musculus
ttaaaatcccatcctgtaacaacag

SEQ ID NO: 915934 - DNA, 25 bp, Mus musculus
ttaaaatcccatgctgtaacaacag

SEQ ID NO: 915935 - DNA, 25 bp, Mus musculus
ttaaaatccctcacttttctcaagc

SEQ ID NO: 915936 - DNA, 25 bp, Mus musculus
ttaaaatccctctcttttctcaagc

SEQ ID NO: 915937 - DNA, 25 bp, Mus musculus
ttaaaatcgcaccagacctcctgta

SEQ ID NO: 915938 - DNA, 25 bp, Mus musculus
ttaaaatcgcacgagacctcctgta

SEQ ID NO: 915939 - DNA, 25 bp, Mus musculus
ttaaaatctataccacctgcctttg

SEQ ID NO: 915940 - DNA, 25 bp, Mus musculus
ttaaaatctatagcacctgcctttg

SEQ ID NO: 915941 - DNA, 25 bp, Mus musculus
ttaaaatctgttaaagccattgtgt

SEQ ID NO: 915942 - DNA, 25 bp, Mus musculus
ttaaaatctgtttaagccattgtgt

SEQ ID NO: 915943 - DNA, 25 bp, Mus musculus
ttaaaatcttgtccctttccattgc

SEQ ID NO: 915944 - DNA, 25 bp, Mus musculus
ttaaaatcttgtgcctttccattgc

SEQ ID NO: 915945 - DNA, 25 bp, Mus musculus
ttaaaatctttccttctcggtcaag

SEQ ID NO: 915946 - DNA, 25 bp, Mus musculus
ttaaaatctttcgttctcggtcaag

SEQ ID NO: 915947 - DNA, 25 bp, Mus musculus
ttaaaatctttgatcttttcctggt

SEQ ID NO: 915948 - DNA, 25 bp, Mus musculus
ttaaaatctttgttcttttcctggt

SEQ ID NO: 915949 - DNA, 25 bp, Mus musculus
ttaaaatgactcatcccagcaactt

SEQ ID NO: 915950 - DNA, 25 bp, Mus musculus
ttaaaatgactcttcccagcaactt

SEQ ID NO: 915951 - DNA, 25 bp, Mus musculus
ttaaaatgatccatgcccagcggtg

SEQ ID NO: 915952 - DNA, 25 bp, Mus musculus
ttaaaatgatccttgcccagcggtg

SEQ ID NO: 915953 - DNA, 25 bp, Mus musculus
ttaaaatgcatcctccttcagcctg

SEQ ID NO: 915954 - DNA, 25 bp, Mus musculus
ttaaaatgcatcgtccttcagcctg

SEQ ID NO: 915955 - DNA, 25 bp, Mus musculus
ttaaaatgccagacccgtgggcggg

SEQ ID NO: 915956 - DNA, 25 bp, Mus musculus
ttaaaatgccagtcccgtgggcggg

SEQ ID NO: 915957 - DNA, 25 bp, Mus musculus
ttaaaatggtctccctttccttcct

SEQ ID NO: 915958 - DNA, 25 bp, Mus musculus
ttaaaatggtctgcctttccttcct

SEQ ID NO: 915959 - DNA, 25 bp, Mus musculus
ttaaaatggtgtatcttgtctaaga

SEQ ID NO: 915960 - DNA, 25 bp, Mus musculus
ttaaaatggtgtttcttgtctaaga

SEQ ID NO: 915961 - DNA, 25 bp, Mus musculus
ttaaaatgtggtatccgaggctggg

SEQ ID NO: 915962 - DNA, 25 bp, Mus musculus
ttaaaatgtggtttccgaggctggg

SEQ ID NO: 915963 - DNA, 25 bp, Mus musculus
ttaaaattccctatcagtagctaga

SEQ ID NO: 915964 - DNA, 25 bp, Mus musculus
ttaaaattccctttcagtagctaga

SEQ ID NO: 915965 - DNA, 25 bp, Mus musculus
ttaaaattggttaacctcaggatga

SEQ ID NO: 915966 - DNA, 25 bp, Mus musculus
ttaaaattggtttacctcaggatga

SEQ ID NO: 915967 - DNA, 25 bp, Mus musculus
ttaaaatttcccattgcctgatgtg

SEQ ID NO: 915968 - DNA, 25 bp, Mus musculus
ttaaaatttccctttgcctgatgtg

SEQ ID NO: 915969 - DNA, 25 bp, Mus musculus
ttaaacaaagcacccctcagacttc

SEQ ID NO: 915970 - DNA, 25 bp, Mus musculus
ttaaacaaagcagccctcagacttc

SEQ ID NO: 915971 - DNA, 25 bp, Mus musculus
ttaaacaacttgaactgcaccaaat

SEQ ID NO: 915972 - DNA, 25 bp, Mus musculus
ttaaacaacttgtactgcaccaaat

SEQ ID NO: 915973 - DNA, 25 bp, Mus musculus
ttaaacaaggcaacacgggcgcagc

SEQ ID NO: 915974 - DNA, 25 bp, Mus musculus
ttaaacaaggcatcacgggcgcagc

SEQ ID NO: 915975 - DNA, 25 bp, Mus musculus
ttaaacaatccacacatagcaacag

SEQ ID NO: 915976 - DNA, 25 bp, Mus musculus
ttaaacaatccagacatagcaacag

SEQ ID NO: 915977 - DNA, 25 bp, Mus musculus
ttaaacaatgacacttcctctgagg

SEQ ID NO: 915978 - DNA, 25 bp, Mus musculus
ttaaacaatgactcttcctctgagg

SEQ ID NO: 915979 - DNA, 25 bp, Mus musculus
ttaaacacatctcagcctcacagtg

SEQ ID NO: 915980 - DNA, 25 bp, Mus musculus
ttaaacacatctgagcctcacagtg

SEQ ID NO: 915981 - DNA, 25 bp, Mus musculus
ttaaacacattacccattgtcctgg

SEQ ID NO: 915982 - DNA, 25 bp, Mus musculus
ttaaacacattagccattgtcctgg

SEQ ID NO: 915983 - DNA, 25 bp, Mus musculus
ttaaacacccttccgtgggtgagtg

SEQ ID NO: 915984 - DNA, 25 bp, Mus musculus
ttaaacacccttgcgtgggtgagtg

SEQ ID NO: 915985 - DNA, 25 bp, Mus musculus
ttaaacacggttactctacactcaa

SEQ ID NO: 915986 - DNA, 25 bp, Mus musculus
ttaaacacggtttctctacactcaa

SEQ ID NO: 915987 - DNA, 25 bp, Mus musculus
ttaaacagcagtcgcctacagagta

SEQ ID NO: 915988 - DNA, 25 bp, Mus musculus
ttaaacagcagtggcctacagagta

SEQ ID NO: 915989 - DNA, 25 bp, Mus musculus
ttaaacagcggcctggctcaactga

SEQ ID NO: 915990 - DNA, 25 bp, Mus musculus
ttaaacagcggcgtggctcaactga

SEQ ID NO: 915991 - DNA, 25 bp, Mus musculus
ttaaacagcttaattatgtatcaat

SEQ ID NO: 915992 - DNA, 25 bp, Mus musculus
ttaaacagcttatttatgtatcaat

SEQ ID NO: 915993 - DNA, 25 bp, Mus musculus
ttaaacaggaatcgccacctctccg

SEQ ID NO: 915994 - DNA, 25 bp, Mus musculus
ttaaacaggaatggccacctctccg

SEQ ID NO: 915995 - DNA, 25 bp, Mus musculus
ttaaacaggaccacagcatgcccat

SEQ ID NO: 915996 - DNA, 25 bp, Mus musculus
ttaaacaggacctcagcatgcccat

SEQ ID NO: 915997 - DNA, 25 bp, Mus musculus
ttaaacagggatctcctcctttgtt

SEQ ID NO: 915998 - DNA, 25 bp, Mus musculus
ttaaacagggatgtcctcctttgtt

SEQ ID NO: 915999 - DNA, 25 bp, Mus musculus
ttaaacatacttagcaatttctgga

SEQ ID NO: 916000 - DNA, 25 bp, Mus musculus
ttaaacatactttgcaatttctgga

SEQ ID NO: 916001 - DNA, 25 bp, Mus musculus
ttaaacatcagtatttaagttctga

SEQ ID NO: 916002 - DNA, 25 bp, Mus musculus
ttaaacatcagtttttaagttctga

SEQ ID NO: 916003 - DNA, 25 bp, Mus musculus
ttaaacatcattagcacctttttca

SEQ ID NO: 916004 - DNA, 25 bp, Mus musculus
ttaaacatcatttgcacctttttca

SEQ ID NO: 916005 - DNA, 25 bp, Mus musculus
ttaaacatccacctgacagcatatg

SEQ ID NO: 916006 - DNA, 25 bp, Mus musculus
ttaaacatccacgtgacagcatatg

SEQ ID NO: 916007 - DNA, 25 bp, Mus musculus
ttaaacatctgtaagctcagagact

SEQ ID NO: 916008 - DNA, 25 bp, Mus musculus
ttaaacatctgttagctcagagact

SEQ ID NO: 916009 - DNA, 25 bp, Mus musculus
ttaaacattgccctttatccgcatg

SEQ ID NO: 916010 - DNA, 25 bp, Mus musculus
ttaaacattgccgtttatccgcatg

SEQ ID NO: 916011 - DNA, 25 bp, Mus musculus
ttaaaccaaattacacctcctcttg

SEQ ID NO: 916012 - DNA, 25 bp, Mus musculus
ttaaaccaaatttcacctcctcttg

SEQ ID NO: 916013 - DNA, 25 bp, Mus musculus
ttaaaccacacccagagtctcttag

SEQ ID NO: 916014 - DNA, 25 bp, Mus musculus
ttaaaccacaccgagagtctcttag

SEQ ID NO: 916015 - DNA, 25 bp, Mus musculus
ttaaaccagtaactctcaatcccct

SEQ ID NO: 916016 - DNA, 25 bp, Mus musculus
ttaaaccagtaagtctcaatcccct

SEQ ID NO: 916017 - DNA, 25 bp, Mus musculus
ttaaaccagtgaacatccaagcatg

SEQ ID NO: 916018 - DNA, 25 bp, Mus musculus
ttaaaccagtgatcatccaagcatg

SEQ ID NO: 916019 - DNA, 25 bp, Mus musculus
ttaaaccataccctgttgacttgtt

SEQ ID NO: 916020 - DNA, 25 bp, Mus musculus
ttaaaccataccgtgttgacttgtt

SEQ ID NO: 916021 - DNA, 25 bp, Mus musculus
ttaaaccatcctaacactaagaggg

SEQ ID NO: 916022 - DNA, 25 bp, Mus musculus
ttaaaccatccttacactaagaggg

SEQ ID NO: 916023 - DNA, 25 bp, Mus musculus
ttaaaccatgctcgctttcactctt

SEQ ID NO: 916024 - DNA, 25 bp, Mus musculus
ttaaaccatgctggctttcactctt

SEQ ID NO: 916025 - DNA, 25 bp, Mus musculus
ttaaaccatttgctgaacttccgat

SEQ ID NO: 916026 - DNA, 25 bp, Mus musculus
ttaaaccatttggtgaacttccgat

SEQ ID NO: 916027 - DNA, 25 bp, Mus musculus
ttaaacccacaaccagctccagaca

SEQ ID NO: 916028 - DNA, 25 bp, Mus musculus
ttaaacccacaagcagctccagaca

SEQ ID NO: 916029 - DNA, 25 bp, Mus musculus
ttaaacccaccgacaatcaagacac

SEQ ID NO: 916030 - DNA, 25 bp, Mus musculus
ttaaacccaccgtcaatcaagacac

SEQ ID NO: 916031 - DNA, 25 bp, Mus musculus
ttaaacccacctagcacatgcgagg

SEQ ID NO: 916032 - DNA, 25 bp, Mus musculus
ttaaacccaccttgcacatgcgagg

SEQ ID NO: 916033 - DNA, 25 bp, Mus musculus
ttaaacccatctagtttgccttcct

SEQ ID NO: 916034 - DNA, 25 bp, Mus musculus
ttaaacccatcttgtttgccttcct

SEQ ID NO: 916035 - DNA, 25 bp, Mus musculus
ttaaacccatgcatcctgattctta

SEQ ID NO: 916036 - DNA, 25 bp, Mus musculus
ttaaacccatgcttcctgattctta

SEQ ID NO: 916037 - DNA, 25 bp, Mus musculus
ttaaaccccttgcaattttgtgaag

SEQ ID NO: 916038 - DNA, 25 bp, Mus musculus
ttaaaccccttggaattttgtgaag

SEQ ID NO: 916039 - DNA, 25 bp, Mus musculus
ttaaaccctcgaaatggcaggccac

SEQ ID NO: 916040 - DNA, 25 bp, Mus musculus
ttaaaccctcgatatggcaggccac

SEQ ID NO: 916041 - DNA, 25 bp, Mus musculus
ttaaaccctgctagaggatcctgtt

SEQ ID NO: 916042 - DNA, 25 bp, Mus musculus
ttaaaccctgcttgaggatcctgtt

SEQ ID NO: 916043 - DNA, 25 bp, Mus musculus
ttaaaccctggactactctcttggc

SEQ ID NO: 916044 - DNA, 25 bp, Mus musculus
ttaaaccctggagtactctcttggc

SEQ ID NO: 916045 - DNA, 25 bp, Mus musculus
ttaaaccctttgagaaatttgctgg

SEQ ID NO: 916046 - DNA, 25 bp, Mus musculus
ttaaaccctttgtgaaatttgctgg

SEQ ID NO: 916047 - DNA, 25 bp, Mus musculus
ttaaaccgcgtgagctcctttttgg

SEQ ID NO: 916048 - DNA, 25 bp, Mus musculus
ttaaaccgcgtgtgctcctttttgg

SEQ ID NO: 916049 - DNA, 25 bp, Mus musculus
ttaaacctagcaatcgggagggaag

SEQ ID NO: 916050 - DNA, 25 bp, Mus musculus
ttaaacctagcattcgggagggaag

SEQ ID NO: 916051 - DNA, 25 bp, Mus musculus
ttaaacctaggcctcagtcatgctt

SEQ ID NO: 916052 - DNA, 25 bp, Mus musculus
ttaaacctaggcgtcagtcatgctt

SEQ ID NO: 916053 - DNA, 25 bp, Mus musculus
ttaaacctcaatagcaagttgaagg

SEQ ID NO: 916054 - DNA, 25 bp, Mus musculus
ttaaacctcaattgcaagttgaagg

SEQ ID NO: 916055 - DNA, 25 bp, Mus musculus
ttaaacctcagcctgcctaagactc

SEQ ID NO: 916056 - DNA, 25 bp, Mus musculus
ttaaacctcagcgtgcctaagactc

SEQ ID NO: 916057 - DNA, 25 bp, Mus musculus
ttaaacctcagtacttccccgtgtg

SEQ ID NO: 916058 - DNA, 25 bp, Mus musculus
ttaaacctcagttcttccccgtgtg

SEQ ID NO: 916059 - DNA, 25 bp, Mus musculus
ttaaacctccctctatagaaaatat

SEQ ID NO: 916060 - DNA, 25 bp, Mus musculus
ttaaacctccctgtatagaaaatat

SEQ ID NO: 916061 - DNA, 25 bp, Mus musculus
ttaaacctctctccccgatgagatt

SEQ ID NO: 916062 - DNA, 25 bp, Mus musculus
ttaaacctctctgcccgatgagatt

SEQ ID NO: 916063 - DNA, 25 bp, Mus musculus
ttaaacctgcctagattctaagccc

SEQ ID NO: 916064 - DNA, 25 bp, Mus musculus
ttaaacctgccttgattctaagccc

SEQ ID NO: 916065 - DNA, 25 bp, Mus musculus
ttaaaccttaccagttgcctggaga

SEQ ID NO: 916066 - DNA, 25 bp, Mus musculus
ttaaaccttacctgttgcctggaga

SEQ ID NO: 916067 - DNA, 25 bp, Mus musculus
ttaaacgagcgtcgctcctcgctaa

SEQ ID NO: 916068 - DNA, 25 bp, Mus musculus
ttaaacgagcgtggctcctcgctaa

SEQ ID NO: 916069 - DNA, 25 bp, Mus musculus
ttaaacggcggcaggccctgctgag

SEQ ID NO: 916070 - DNA, 25 bp, Mus musculus
ttaaacggcggctggccctgctgag

SEQ ID NO: 916071 - DNA, 25 bp, Mus musculus
ttaaacggctttatcttggttcaca

SEQ ID NO: 916072 - DNA, 25 bp, Mus musculus
ttaaacggctttttcttggttcaca

SEQ ID NO: 916073 - DNA, 25 bp, Mus musculus
ttaaacgtcattctttctctctacc

SEQ ID NO: 916074 - DNA, 25 bp, Mus musculus
ttaaacgtcattgtttctctctacc

SEQ ID NO: 916075 - DNA, 25 bp, Mus musculus
ttaaacgtgacaaagccagtggcca

SEQ ID NO: 916076 - DNA, 25 bp, Mus musculus
ttaaacgtgacatagccagtggcca

SEQ ID NO: 916077 - DNA, 25 bp, Mus musculus
ttaaactaacctcctcttccagtga

SEQ ID NO: 916078 - DNA, 25 bp, Mus musculus
ttaaactaacctgctcttccagtga

SEQ ID NO: 916079 - DNA, 25 bp, Mus musculus
ttaaactacttcagtgcagtcccac

SEQ ID NO: 916080 - DNA, 25 bp, Mus musculus
ttaaactacttctgtgcagtcccac

SEQ ID NO: 916081 - DNA, 25 bp, Mus musculus
ttaaactagaatagtgtgtcctggg

SEQ ID NO: 916082 - DNA, 25 bp, Mus musculus
ttaaactagaattgtgtgtcctggg

SEQ ID NO: 916083 - DNA, 25 bp, Mus musculus
ttaaactagccacatcgtggtctct

SEQ ID NO: 916084 - DNA, 25 bp, Mus musculus
ttaaactagccagatcgtggtctct

SEQ ID NO: 916085 - DNA, 25 bp, Mus musculus
ttaaactatatacagttgctggttc

SEQ ID NO: 916086 - DNA, 25 bp, Mus musculus
ttaaactatatagagttgctggttc

SEQ ID NO: 916087 - DNA, 25 bp, Mus musculus
ttaaactatctcagcacaacactct

SEQ ID NO: 916088 - DNA, 25 bp, Mus musculus
ttaaactatctctgcacaacactct

SEQ ID NO: 916089 - DNA, 25 bp, Mus musculus
ttaaactatctgaaattgaccaata

SEQ ID NO: 916090 - DNA, 25 bp, Mus musculus
ttaaactatctgtaattgaccaata

SEQ ID NO: 916091 - DNA, 25 bp, Mus musculus
ttaaactatgaaacctcctgtctcc

SEQ ID NO: 916092 - DNA, 25 bp, Mus musculus
ttaaactatgaatcctcctgtctcc

SEQ ID NO: 916093 - DNA, 25 bp, Mus musculus
ttaaactcacagatctcttgcctca

SEQ ID NO: 916094 - DNA, 25 bp, Mus musculus
ttaaactcacagttctcttgcctca

SEQ ID NO: 916095 - DNA, 25 bp, Mus musculus
ttaaactccacaaatatctttttat

SEQ ID NO: 916096 - DNA, 25 bp, Mus musculus
ttaaactccacatatatctttttat

SEQ ID NO: 916097 - DNA, 25 bp, Mus musculus
ttaaactccagaatgccccaaagtc

SEQ ID NO: 916098 - DNA, 25 bp, Mus musculus
ttaaactccagattgccccaaagtc

SEQ ID NO: 916099 - DNA, 25 bp, Mus musculus
ttaaactccattccagtacactggc

SEQ ID NO: 916100 - DNA, 25 bp, Mus musculus
ttaaactccattgcagtacactggc

SEQ ID NO: 916101 - DNA, 25 bp, Mus musculus
ttaaactctcacactaggtacctgg

SEQ ID NO: 916102 - DNA, 25 bp, Mus musculus
ttaaactctcactctaggtacctgg

SEQ ID NO: 916103 - DNA, 25 bp, Mus musculus
ttaaactctcccagcttctagttct

SEQ ID NO: 916104 - DNA, 25 bp, Mus musculus
ttaaactctccctgcttctagttct

SEQ ID NO: 916105 - DNA, 25 bp, Mus musculus
ttaaactctgggattcttgtcaact

SEQ ID NO: 916106 - DNA, 25 bp, Mus musculus
ttaaactctgggtttcttgtcaact

SEQ ID NO: 916107 - DNA, 25 bp, Mus musculus
ttaaactcttccatcttggtgagcc

SEQ ID NO: 916108 - DNA, 25 bp, Mus musculus
ttaaactcttccttcttggtgagcc

SEQ ID NO: 916109 - DNA, 25 bp, Mus musculus
ttaaactcttgtcccctattcctta

SEQ ID NO: 916110 - DNA, 25 bp, Mus musculus
ttaaactcttgtgccctattcctta

SEQ ID NO: 916111 - DNA, 25 bp, Mus musculus
ttaaactgaaagctggcagaattct

SEQ ID NO: 916112 - DNA, 25 bp, Mus musculus
ttaaactgaaaggtggcagaattct

SEQ ID NO: 916113 - DNA, 25 bp, Mus musculus
ttaaactgagggatgtctctccgac

SEQ ID NO: 916114 - DNA, 25 bp, Mus musculus
ttaaactgagggttgtctctccgac

SEQ ID NO: 916115 - DNA, 25 bp, Mus musculus
ttaaactgcagtcttcttgcatctg

SEQ ID NO: 916116 - DNA, 25 bp, Mus musculus
ttaaactgcagtgttcttgcatctg

SEQ ID NO: 916117 - DNA, 25 bp, Mus musculus
ttaaactgcctcagatattcccagg

SEQ ID NO: 916118 - DNA, 25 bp, Mus musculus
ttaaactgcctctgatattcccagg

SEQ ID NO: 916119 - DNA, 25 bp, Mus musculus
ttaaactgtactctttgcaagtagt

SEQ ID NO: 916120 - DNA, 25 bp, Mus musculus
ttaaactgtactgtttgcaagtagt

SEQ ID NO: 916121 - DNA, 25 bp, Mus musculus
ttaaactgtttcactcgtggattgc

SEQ ID NO: 916122 - DNA, 25 bp, Mus musculus
ttaaactgtttctctcgtggattgc

SEQ ID NO: 916123 - DNA, 25 bp, Mus musculus
ttaaacttcattaggttggtgtcac

SEQ ID NO: 916124 - DNA, 25 bp, Mus musculus
ttaaacttcatttggttggtgtcac

SEQ ID NO: 916125 - DNA, 25 bp, Mus musculus
ttaaacttgaggataggctagatct

SEQ ID NO: 916126 - DNA, 25 bp, Mus musculus
ttaaacttgaggttaggctagatct

SEQ ID NO: 916127 - DNA, 25 bp, Mus musculus
ttaaacttgtgaagacttccaactc

SEQ ID NO: 916128 - DNA, 25 bp, Mus musculus
ttaaacttgtgatgacttccaactc

SEQ ID NO: 916129 - DNA, 25 bp, Mus musculus
ttaaacttgtggactaaaccaatat

SEQ ID NO: 916130 - DNA, 25 bp, Mus musculus
ttaaacttgtggtctaaaccaatat

SEQ ID NO: 916131 - DNA, 25 bp, Mus musculus
ttaaacttgtttccattctcatccc

SEQ ID NO: 916132 - DNA, 25 bp, Mus musculus
ttaaacttgtttgcattctcatccc

SEQ ID NO: 916133 - DNA, 25 bp, Mus musculus
ttaaactttcctcaccaaccataag

SEQ ID NO: 916134 - DNA, 25 bp, Mus musculus
ttaaactttcctgaccaaccataag

SEQ ID NO: 916135 - DNA, 25 bp, Mus musculus
ttaaactttcggcacacaccagtag

SEQ ID NO: 916136 - DNA, 25 bp, Mus musculus
ttaaactttcgggacacaccagtag

SEQ ID NO: 916137 - DNA, 25 bp, Mus musculus
ttaaactttcttcagcctgtatgct

SEQ ID NO: 916138 - DNA, 25 bp, Mus musculus
ttaaactttcttgagcctgtatgct

SEQ ID NO: 916139 - DNA, 25 bp, Mus musculus
ttaaacttttacatcatatttccag

SEQ ID NO: 916140 - DNA, 25 bp, Mus musculus
ttaaacttttacttcatatttccag

SEQ ID NO: 916141 - DNA, 25 bp, Mus musculus
ttaaagaactttagcactgtgctga

SEQ ID NO: 916142 - DNA, 25 bp, Mus musculus
ttaaagaacttttgcactgtgctga

SEQ ID NO: 916143 - DNA, 25 bp, Mus musculus
ttaaagaatggtcgcttgttttcat

SEQ ID NO: 916144 - DNA, 25 bp, Mus musculus
ttaaagaatggtggcttgttttcat

SEQ ID NO: 916145 - DNA, 25 bp, Mus musculus
ttaaagaattcaagtgttcacctat

SEQ ID NO: 916146 - DNA, 25 bp, Mus musculus
ttaaagaattcatgtgttcacctat

SEQ ID NO: 916147 - DNA, 25 bp, Mus musculus
ttaaagaattttctctggcaccaca

SEQ ID NO: 916148 - DNA, 25 bp, Mus musculus
ttaaagaattttgtctggcaccaca

SEQ ID NO: 916149 - DNA, 25 bp, Mus musculus
ttaaagacaaagacagctccccagt

SEQ ID NO: 916150 - DNA, 25 bp, Mus musculus
ttaaagacaaagtcagctccccagt

SEQ ID NO: 916151 - DNA, 25 bp, Mus musculus
ttaaagacaaccaccatactcaccg

SEQ ID NO: 916152 - DNA, 25 bp, Mus musculus
ttaaagacaacctccatactcaccg

SEQ ID NO: 916153 - DNA, 25 bp, Mus musculus
ttaaagacacgcacagtcccttcca

SEQ ID NO: 916154 - DNA, 25 bp, Mus musculus
ttaaagacacgctcagtcccttcca

SEQ ID NO: 916155 - DNA, 25 bp, Mus musculus
ttaaagacaggcatcctatctcagg

SEQ ID NO: 916156 - DNA, 25 bp, Mus musculus
ttaaagacaggcttcctatctcagg

SEQ ID NO: 916157 - DNA, 25 bp, Mus musculus
ttaaagacaggtcggtgctggaaac

SEQ ID NO: 916158 - DNA, 25 bp, Mus musculus
ttaaagacaggtgggtgctggaaac

SEQ ID NO: 916159 - DNA, 25 bp, Mus musculus
ttaaagacataacgcagccgggcgt

SEQ ID NO: 916160 - DNA, 25 bp, Mus musculus
ttaaagacataaggcagccgggcgt

SEQ ID NO: 916161 - DNA, 25 bp, Mus musculus
ttaaagacatatccacagacctgag

SEQ ID NO: 916162 - DNA, 25 bp, Mus musculus
ttaaagacatatgcacagacctgag

SEQ ID NO: 916163 - DNA, 25 bp, Mus musculus
ttaaagaccactccagtgtcacctg

SEQ ID NO: 916164 - DNA, 25 bp, Mus musculus
ttaaagaccactgcagtgtcacctg

SEQ ID NO: 916165 - DNA, 25 bp, Mus musculus
ttaaagacccggactctccagtcct

SEQ ID NO: 916166 - DNA, 25 bp, Mus musculus
ttaaagacccggtctctccagtcct

SEQ ID NO: 916167 - DNA, 25 bp, Mus musculus
ttaaagacctaccatcacagcacta

SEQ ID NO: 916168 - DNA, 25 bp, Mus musculus
ttaaagacctacgatcacagcacta

SEQ ID NO: 916169 - DNA, 25 bp, Mus musculus
ttaaagacgactctgcctgagatgg

SEQ ID NO: 916170 - DNA, 25 bp, Mus musculus
ttaaagacgactgtgcctgagatgg

SEQ ID NO: 916171 - DNA, 25 bp, Mus musculus
ttaaagactactatatacactgggt

SEQ ID NO: 916172 - DNA, 25 bp, Mus musculus
ttaaagactactttatacactgggt

SEQ ID NO: 916173 - DNA, 25 bp, Mus musculus
ttaaagactggacccacctgtgacc

SEQ ID NO: 916174 - DNA, 25 bp, Mus musculus
ttaaagactggagccacctgtgacc

SEQ ID NO: 916175 - DNA, 25 bp, Mus musculus
ttaaagagatctcattgcccctgcc

SEQ ID NO: 916176 - DNA, 25 bp, Mus musculus
ttaaagagatctgattgcccctgcc

SEQ ID NO: 916177 - DNA, 25 bp, Mus musculus
ttaaagagcccgcatgcatttgtgg

SEQ ID NO: 916178 - DNA, 25 bp, Mus musculus
ttaaagagcccggatgcatttgtgg

SEQ ID NO: 916179 - DNA, 25 bp, Mus musculus
ttaaagaggattatgtgcctgtgca

SEQ ID NO: 916180 - DNA, 25 bp, Mus musculus
ttaaagaggattttgtgcctgtgca

SEQ ID NO: 916181 - DNA, 25 bp, Mus musculus
ttaaagagtcccactcccatggctc

SEQ ID NO: 916182 - DNA, 25 bp, Mus musculus
ttaaagagtccctctcccatggctc

SEQ ID NO: 916183 - DNA, 25 bp, Mus musculus
ttaaagagtcgaattctttctttgg

SEQ ID NO: 916184 - DNA, 25 bp, Mus musculus
ttaaagagtcgatttctttctttgg

SEQ ID NO: 916185 - DNA, 25 bp, Mus musculus
ttaaagagttaaatggttgccacga

SEQ ID NO: 916186 - DNA, 25 bp, Mus musculus
ttaaagagttaattggttgccacga

SEQ ID NO: 916187 - DNA, 25 bp, Mus musculus
ttaaagataccaagctaagggcctg

SEQ ID NO: 916188 - DNA, 25 bp, Mus musculus
ttaaagataccatgctaagggcctg

SEQ ID NO: 916189 - DNA, 25 bp, Mus musculus
ttaaagatcttaatacctgtgagag

SEQ ID NO: 916190 - DNA, 25 bp, Mus musculus
ttaaagatcttattacctgtgagag

SEQ ID NO: 916191 - DNA, 25 bp, Mus musculus
ttaaagatgagtactggtctgcttg

SEQ ID NO: 916192 - DNA, 25 bp, Mus musculus
ttaaagatgagttctggtctgcttg

SEQ ID NO: 916193 - DNA, 25 bp, Mus musculus
ttaaagatgcacaggtttttgtgtg

SEQ ID NO: 916194 - DNA, 25 bp, Mus musculus
ttaaagatgcactggtttttgtgtg

SEQ ID NO: 916195 - DNA, 25 bp, Mus musculus
ttaaagattaccagactggctgtac

SEQ ID NO: 916196 - DNA, 25 bp, Mus musculus
ttaaagattacctgactggctgtac

SEQ ID NO: 916197 - DNA, 25 bp, Mus musculus
ttaaagattctcctaagtcatcccc

SEQ ID NO: 916198 - DNA, 25 bp, Mus musculus
ttaaagattctcgtaagtcatcccc

SEQ ID NO: 916199 - DNA, 25 bp, Mus musculus
ttaaagattgcgctgccctcgctgt

SEQ ID NO: 916200 - DNA, 25 bp, Mus musculus
ttaaagattgcggtgccctcgctgt

SEQ ID NO: 916201 - DNA, 25 bp, Mus musculus
ttaaagattgtcctctggcctctac

SEQ ID NO: 916202 - DNA, 25 bp, Mus musculus
ttaaagattgtcgtctggcctctac

SEQ ID NO: 916203 - DNA, 25 bp, Mus musculus
ttaaagatttcgaaggaggccaaat

SEQ ID NO: 916204 - DNA, 25 bp, Mus musculus
ttaaagatttcgtaggaggccaaat

SEQ ID NO: 916205 - DNA, 25 bp, Mus musculus
ttaaagatttttacatgtcacagaa

SEQ ID NO: 916206 - DNA, 25 bp, Mus musculus
ttaaagattttttcatgtcacagaa

SEQ ID NO: 916207 - DNA, 25 bp, Mus musculus
ttaaagcaatatccgctccgcttct

SEQ ID NO: 916208 - DNA, 25 bp, Mus musculus
ttaaagcaatatgcgctccgcttct

SEQ ID NO: 916209 - DNA, 25 bp, Mus musculus
ttaaagcacatgctctacccttgag

SEQ ID NO: 916210 - DNA, 25 bp, Mus musculus
ttaaagcacatggtctacccttgag

SEQ ID NO: 916211 - DNA, 25 bp, Mus musculus
ttaaagcactttctatgtctatcat

SEQ ID NO: 916212 - DNA, 25 bp, Mus musculus
ttaaagcactttgtatgtctatcat

SEQ ID NO: 916213 - DNA, 25 bp, Mus musculus
ttaaagcagcggcacacctggcgcg

SEQ ID NO: 916214 - DNA, 25 bp, Mus musculus
ttaaagcagcgggacacctggcgcg

SEQ ID NO: 916215 - DNA, 25 bp, Mus musculus
ttaaagcaggtgactctaataaaaa

SEQ ID NO: 916216 - DNA, 25 bp, Mus musculus
ttaaagcaggtgtctctaataaaaa

SEQ ID NO: 916217 - DNA, 25 bp, Mus musculus
ttaaagccactgaagccatgagcca

SEQ ID NO: 916218 - DNA, 25 bp, Mus musculus
ttaaagccactgtagccatgagcca

SEQ ID NO: 916219 - DNA, 25 bp, Mus musculus
ttaaagccaggcatgctctgtactc

SEQ ID NO: 916220 - DNA, 25 bp, Mus musculus
ttaaagccaggcttgctctgtactc

SEQ ID NO: 916221 - DNA, 25 bp, Mus musculus
ttaaagccagtgactttcccttgat

SEQ ID NO: 916222 - DNA, 25 bp, Mus musculus
ttaaagccagtgtctttcccttgat

SEQ ID NO: 916223 - DNA, 25 bp, Mus musculus
ttaaagccatctccgtcttggtggt

SEQ ID NO: 916224 - DNA, 25 bp, Mus musculus
ttaaagccatctgcgtcttggtggt

SEQ ID NO: 916225 - DNA, 25 bp, Mus musculus
ttaaagccccaacactaaaatggat

SEQ ID NO: 916226 - DNA, 25 bp, Mus musculus
ttaaagccccaagactaaaatggat

SEQ ID NO: 916227 - DNA, 25 bp, Mus musculus
ttaaagccgagcactccgtcatggg

SEQ ID NO: 916228 - DNA, 25 bp, Mus musculus
ttaaagccgagctctccgtcatggg

SEQ ID NO: 916229 - DNA, 25 bp, Mus musculus
ttaaagcctagcagtctccctttat

SEQ ID NO: 916230 - DNA, 25 bp, Mus musculus
ttaaagcctagctgtctccctttat

SEQ ID NO: 916231 - DNA, 25 bp, Mus musculus
ttaaagcctattccttctcagtctt

SEQ ID NO: 916232 - DNA, 25 bp, Mus musculus
ttaaagcctattgcttctcagtctt

SEQ ID NO: 916233 - DNA, 25 bp, Mus musculus
ttaaagccttcacaggctgctgagg

SEQ ID NO: 916234 - DNA, 25 bp, Mus musculus
ttaaagccttcagaggctgctgagg

SEQ ID NO: 916235 - DNA, 25 bp, Mus musculus
ttaaagcgctttatacattccttgc

SEQ ID NO: 916236 - DNA, 25 bp, Mus musculus
ttaaagcgctttttacattccttgc

SEQ ID NO: 916237 - DNA, 25 bp, Mus musculus
ttaaagcgggtacccaacatcctca

SEQ ID NO: 916238 - DNA, 25 bp, Mus musculus
ttaaagcgggtagccaacatcctca

SEQ ID NO: 916239 - DNA, 25 bp, Mus musculus
ttaaagctacagctgtcaccagcac

SEQ ID NO: 916240 - DNA, 25 bp, Mus musculus
ttaaagctacaggtgtcaccagcac

SEQ ID NO: 916241 - DNA, 25 bp, Mus musculus
ttaaagctacccctatcactgttgg

SEQ ID NO: 916242 - DNA, 25 bp, Mus musculus
ttaaagctacccgtatcactgttgg

SEQ ID NO: 916243 - DNA, 25 bp, Mus musculus
ttaaagctcaataacattaccctgt

SEQ ID NO: 916244 - DNA, 25 bp, Mus musculus
ttaaagctcaattacattaccctgt

SEQ ID NO: 916245 - DNA, 25 bp, Mus musculus
ttaaagctccaaaatttgttgccaa

SEQ ID NO: 916246 - DNA, 25 bp, Mus musculus
ttaaagctccaatatttgttgccaa

SEQ ID NO: 916247 - DNA, 25 bp, Mus musculus
ttaaagctccttatgcccataaaca

SEQ ID NO: 916248 - DNA, 25 bp, Mus musculus
ttaaagctccttttgcccataaaca

SEQ ID NO: 916249 - DNA, 25 bp, Mus musculus
ttaaagctcgctccccgtgatgagg

SEQ ID NO: 916250 - DNA, 25 bp, Mus musculus
ttaaagctcgctgcccgtgatgagg

SEQ ID NO: 916251 - DNA, 25 bp, Mus musculus
ttaaagctctatcatgccaaactgc

SEQ ID NO: 916252 - DNA, 25 bp, Mus musculus
ttaaagctctatgatgccaaactgc

SEQ ID NO: 916253 - DNA, 25 bp, Mus musculus
ttaaagctgctgaccatccagagcc

SEQ ID NO: 916254 - DNA, 25 bp, Mus musculus
ttaaagctgctgtccatccagagcc

SEQ ID NO: 916255 - DNA, 25 bp, Mus musculus
ttaaagcttcctctactcatttact

SEQ ID NO: 916256 - DNA, 25 bp, Mus musculus
ttaaagcttcctgtactcatttact

SEQ ID NO: 916257 - DNA, 25 bp, Mus musculus
ttaaagcttgtcctgtcacgctatg

SEQ ID NO: 916258 - DNA, 25 bp, Mus musculus
ttaaagcttgtcgtgtcacgctatg

SEQ ID NO: 916259 - DNA, 25 bp, Mus musculus
ttaaaggaacttaccagcacactgg

SEQ ID NO: 916260 - DNA, 25 bp, Mus musculus
ttaaaggaactttccagcacactgg

SEQ ID NO: 916261 - DNA, 25 bp, Mus musculus
ttaaaggaatctcacccacatggtt

SEQ ID NO: 916262 - DNA, 25 bp, Mus musculus
ttaaaggaatctgacccacatggtt

SEQ ID NO: 916263 - DNA, 25 bp, Mus musculus
ttaaaggacacccatgtaccctgct

SEQ ID NO: 916264 - DNA, 25 bp, Mus musculus
ttaaaggacaccgatgtaccctgct

SEQ ID NO: 916265 - DNA, 25 bp, Mus musculus
ttaaaggaggaaccccagcatcaac

SEQ ID NO: 916266 - DNA, 25 bp, Mus musculus
ttaaaggaggaagcccagcatcaac

SEQ ID NO: 916267 - DNA, 25 bp, Mus musculus
ttaaaggagtgccacaccaccgccg

SEQ ID NO: 916268 - DNA, 25 bp, Mus musculus
ttaaaggagtgcgacaccaccgccg

SEQ ID NO: 916269 - DNA, 25 bp, Mus musculus
ttaaaggcaatactggagttcccag

SEQ ID NO: 916270 - DNA, 25 bp, Mus musculus
ttaaaggcaatagtggagttcccag

SEQ ID NO: 916271 - DNA, 25 bp, Mus musculus
ttaaaggcaccactcaccaagcctg

SEQ ID NO: 916272 - DNA, 25 bp, Mus musculus
ttaaaggcaccagtcaccaagcctg

SEQ ID NO: 916273 - DNA, 25 bp, Mus musculus
ttaaaggcactaacgagtccctgga

SEQ ID NO: 916274 - DNA, 25 bp, Mus musculus
ttaaaggcactatcgagtccctgga

SEQ ID NO: 916275 - DNA, 25 bp, Mus musculus
ttaaaggcagcacgcatgtcctcga

SEQ ID NO: 916276 - DNA, 25 bp, Mus musculus
ttaaaggcagcaggcatgtcctcga

SEQ ID NO: 916277 - DNA, 25 bp, Mus musculus
ttaaaggcatgccactcgtggtttt

SEQ ID NO: 916278 - DNA, 25 bp, Mus musculus
ttaaaggcatgcgactcgtggtttt

SEQ ID NO: 916279 - DNA, 25 bp, Mus musculus
ttaaaggccacactgcagaccacct

SEQ ID NO: 916280 - DNA, 25 bp, Mus musculus
ttaaaggccacagtgcagaccacct

SEQ ID NO: 916281 - DNA, 25 bp, Mus musculus
ttaaaggcccggctgcttttgattt

SEQ ID NO: 916282 - DNA, 25 bp, Mus musculus
ttaaaggcccgggtgcttttgattt

SEQ ID NO: 916283 - DNA, 25 bp, Mus musculus
ttaaaggccctgatttgtcttctca

SEQ ID NO: 916284 - DNA, 25 bp, Mus musculus
ttaaaggccctgttttgtcttctca

SEQ ID NO: 916285 - DNA, 25 bp, Mus musculus
ttaaaggcctgtacgtgtggtgtca

SEQ ID NO: 916286 - DNA, 25 bp, Mus musculus
ttaaaggcctgttcgtgtggtgtca

SEQ ID NO: 916287 - DNA, 25 bp, Mus musculus
ttaaaggcgtgcacttgttcccgtc

SEQ ID NO: 916288 - DNA, 25 bp, Mus musculus
ttaaaggcgtgctcttgttcccgtc

SEQ ID NO: 916289 - DNA, 25 bp, Mus musculus
ttaaaggctccgattctccgcatac

SEQ ID NO: 916290 - DNA, 25 bp, Mus musculus
ttaaaggctccgtttctccgcatac

SEQ ID NO: 916291 - DNA, 25 bp, Mus musculus
ttaaaggctcttagcatcacccgag

SEQ ID NO: 916292 - DNA, 25 bp, Mus musculus
ttaaaggctctttgcatcacccgag

SEQ ID NO: 916293 - DNA, 25 bp, Mus musculus
ttaaaggcttatcgcactacctcca

SEQ ID NO: 916294 - DNA, 25 bp, Mus musculus
ttaaaggcttatggcactacctcca

SEQ ID NO: 916295 - DNA, 25 bp, Mus musculus
ttaaagggccagagccgcgcagccg

SEQ ID NO: 916296 - DNA, 25 bp, Mus musculus
ttaaagggccagtgccgcgcagccg

SEQ ID NO: 916297 - DNA, 25 bp, Mus musculus
ttaaagggcctgatccagcttggcc

SEQ ID NO: 916298 - DNA, 25 bp, Mus musculus
ttaaagggcctgttccagcttggcc

SEQ ID NO: 916299 - DNA, 25 bp, Mus musculus
ttaaagggtagcaccttgcctccat

SEQ ID NO: 916300 - DNA, 25 bp, Mus musculus
ttaaagggtagctccttgcctccat

SEQ ID NO: 916301 - DNA, 25 bp, Mus musculus
ttaaaggtgacgactgctaggattt

SEQ ID NO: 916302 - DNA, 25 bp, Mus musculus
ttaaaggtgacgtctgctaggattt

SEQ ID NO: 916303 - DNA, 25 bp, Mus musculus
ttaaaggtgagtccctctgtgccta

SEQ ID NO: 916304 - DNA, 25 bp, Mus musculus
ttaaaggtgagtgcctctgtgccta

SEQ ID NO: 916305 - DNA, 25 bp, Mus musculus
ttaaaggtgcatcctagcgttctgc

SEQ ID NO: 916306 - DNA, 25 bp, Mus musculus
ttaaaggtgcatgctagcgttctgc

SEQ ID NO: 916307 - DNA, 25 bp, Mus musculus
ttaaaggtgtgtaattcaaagttct

SEQ ID NO: 916308 - DNA, 25 bp, Mus musculus
ttaaaggtgtgttattcaaagttct

SEQ ID NO: 916309 - DNA, 25 bp, Mus musculus
ttaaaggttaccagtcgcctgggct

SEQ ID NO: 916310 - DNA, 25 bp, Mus musculus
ttaaaggttacctgtcgcctgggct

SEQ ID NO: 916311 - DNA, 25 bp, Mus musculus
ttaaagtagatgagactccagatgt

SEQ ID NO: 916312 - DNA, 25 bp, Mus musculus
ttaaagtagatgtgactccagatgt

SEQ ID NO: 916313 - DNA, 25 bp, Mus musculus
ttaaagtagggaatggtgaaaagct

SEQ ID NO: 916314 - DNA, 25 bp, Mus musculus
ttaaagtagggattggtgaaaagct

SEQ ID NO: 916315 - DNA, 25 bp, Mus musculus
ttaaagtcaaccagtatcttcactc

SEQ ID NO: 916316 - DNA, 25 bp, Mus musculus
ttaaagtcaacctgtatcttcactc

SEQ ID NO: 916317 - DNA, 25 bp, Mus musculus
ttaaagtcaactacgtctacggagt

SEQ ID NO: 916318 - DNA, 25 bp, Mus musculus
ttaaagtcaacttcgtctacggagt

SEQ ID NO: 916319 - DNA, 25 bp, Mus musculus
ttaaagtcaggcctggtaccagata

SEQ ID NO: 916320 - DNA, 25 bp, Mus musculus
ttaaagtcaggcgtggtaccagata

SEQ ID NO: 916321 - DNA, 25 bp, Mus musculus
ttaaagtctcataattcaaaatgtc

SEQ ID NO: 916322 - DNA, 25 bp, Mus musculus
ttaaagtctcattattcaaaatgtc

SEQ ID NO: 916323 - DNA, 25 bp, Mus musculus
ttaaagtctggaacctgttctcaca

SEQ ID NO: 916324 - DNA, 25 bp, Mus musculus
ttaaagtctggatcctgttctcaca

SEQ ID NO: 916325 - DNA, 25 bp, Mus musculus
ttaaagtctggcaacttcaggctcc

SEQ ID NO: 916326 - DNA, 25 bp, Mus musculus
ttaaagtctggctacttcaggctcc

SEQ ID NO: 916327 - DNA, 25 bp, Mus musculus
ttaaagtgaagtcagcatcagcctt

SEQ ID NO: 916328 - DNA, 25 bp, Mus musculus
ttaaagtgaagtgagcatcagcctt

SEQ ID NO: 916329 - DNA, 25 bp, Mus musculus
ttaaagtgcatgagtatttccctag

SEQ ID NO: 916330 - DNA, 25 bp, Mus musculus
ttaaagtgcatgtgtatttccctag

SEQ ID NO: 916331 - DNA, 25 bp, Mus musculus
ttaaagtgctctcctacatcagtgt

SEQ ID NO: 916332 - DNA, 25 bp, Mus musculus
ttaaagtgctctgctacatcagtgt

SEQ ID NO: 916333 - DNA, 25 bp, Mus musculus
ttaaagtgctggaatgctgcggtgc

SEQ ID NO: 916334 - DNA, 25 bp, Mus musculus
ttaaagtgctggtatgctgcggtgc

SEQ ID NO: 916335 - DNA, 25 bp, Mus musculus
ttaaagtgtcaccagtgtgcctcac

SEQ ID NO: 916336 - DNA, 25 bp, Mus musculus
ttaaagtgtcacgagtgtgcctcac

SEQ ID NO: 916337 - DNA, 25 bp, Mus musculus
ttaaagtgtcttctctccacggcct

SEQ ID NO: 916338 - DNA, 25 bp, Mus musculus
ttaaagtgtcttgtctccacggcct

SEQ ID NO: 916339 - DNA, 25 bp, Mus musculus
ttaaagtgtgatactgagccagaac

SEQ ID NO: 916340 - DNA, 25 bp, Mus musculus
ttaaagtgtgattctgagccagaac

SEQ ID NO: 916341 - DNA, 25 bp, Mus musculus
ttaaagtgtgtaagcctggcgttgt

SEQ ID NO: 916342 - DNA, 25 bp, Mus musculus
ttaaagtgtgtatgcctggcgttgt

SEQ ID NO: 916343 - DNA, 25 bp, Mus musculus
ttaaagtgttaactggtgctggaga

SEQ ID NO: 916344 - DNA, 25 bp, Mus musculus
ttaaagtgttaagtggtgctggaga

SEQ ID NO: 916345 - DNA, 25 bp, Mus musculus
ttaaagttacagagcatcacacaaa

SEQ ID NO: 916346 - DNA, 25 bp, Mus musculus
ttaaagttacagtgcatcacacaaa

SEQ ID NO: 916347 - DNA, 25 bp, Mus musculus
ttaaagttcaccaaataatctgtac

SEQ ID NO: 916348 - DNA, 25 bp, Mus musculus
ttaaagttcacctaataatctgtac

SEQ ID NO: 916349 - DNA, 25 bp, Mus musculus
ttaaagttcatcactgatccctgac

SEQ ID NO: 916350 - DNA, 25 bp, Mus musculus
ttaaagttcatctctgatccctgac

SEQ ID NO: 916351 - DNA, 25 bp, Mus musculus
ttaaagttcctcatacaacacctca

SEQ ID NO: 916352 - DNA, 25 bp, Mus musculus
ttaaagttcctcttacaacacctca

SEQ ID NO: 916353 - DNA, 25 bp, Mus musculus
ttaaagttgggcatagtgattcacc

SEQ ID NO: 916354 - DNA, 25 bp, Mus musculus
ttaaagttgggcttagtgattcacc

SEQ ID NO: 916355 - DNA, 25 bp, Mus musculus
ttaaagttttccacatttctcgcct

SEQ ID NO: 916356 - DNA, 25 bp, Mus musculus
ttaaagttttcctcatttctcgcct

SEQ ID NO: 916357 - DNA, 25 bp, Mus musculus
ttaaataaagatattccgggctggt

SEQ ID NO: 916358 - DNA, 25 bp, Mus musculus
ttaaataaagattttccgggctggt

SEQ ID NO: 916359 - DNA, 25 bp, Mus musculus
ttaaataacatgaaatatcaccctc

SEQ ID NO: 916360 - DNA, 25 bp, Mus musculus
ttaaataacatgtaatatcaccctc

SEQ ID NO: 916361 - DNA, 25 bp, Mus musculus
ttaaataactggagcttctgttcct

SEQ ID NO: 916362 - DNA, 25 bp, Mus musculus
ttaaataactggtgcttctgttcct

SEQ ID NO: 916363 - DNA, 25 bp, Mus musculus
ttaaataagactccccatatctgag

SEQ ID NO: 916364 - DNA, 25 bp, Mus musculus
ttaaataagactgcccatatctgag

SEQ ID NO: 916365 - DNA, 25 bp, Mus musculus
ttaaataagctgcactgaggcataa

SEQ ID NO: 916366 - DNA, 25 bp, Mus musculus
ttaaataagctggactgaggcataa

SEQ ID NO: 916367 - DNA, 25 bp, Mus musculus
ttaaataatctaatcctcagcccca

SEQ ID NO: 916368 - DNA, 25 bp, Mus musculus
ttaaataatctattcctcagcccca

SEQ ID NO: 916369 - DNA, 25 bp, Mus musculus
ttaaataattatctctccccacatc

SEQ ID NO: 916370 - DNA, 25 bp, Mus musculus
ttaaataattatgtctccccacatc

SEQ ID NO: 916371 - DNA, 25 bp, Mus musculus
ttaaataattcaccaggtccctccc

SEQ ID NO: 916372 - DNA, 25 bp, Mus musculus
ttaaataattcagcaggtccctccc

SEQ ID NO: 916373 - DNA, 25 bp, Mus musculus
ttaaatacacccctggctcacaatg

SEQ ID NO: 916374 - DNA, 25 bp, Mus musculus
ttaaatacacccgtggctcacaatg

SEQ ID NO: 916375 - DNA, 25 bp, Mus musculus
ttaaatacacctaccttgattccac

SEQ ID NO: 916376 - DNA, 25 bp, Mus musculus
ttaaatacaccttccttgattccac

SEQ ID NO: 916377 - DNA, 25 bp, Mus musculus
ttaaatactataaggacctttcaag

SEQ ID NO: 916378 - DNA, 25 bp, Mus musculus
ttaaatactatatggacctttcaag

SEQ ID NO: 916379 - DNA, 25 bp, Mus musculus
ttaaatagcaggaatgtttttttct

SEQ ID NO: 916380 - DNA, 25 bp, Mus musculus
ttaaatagcaggtatgtttttttct

SEQ ID NO: 916381 - DNA, 25 bp, Mus musculus
ttaaatagccatccagtcgcccaca

SEQ ID NO: 916382 - DNA, 25 bp, Mus musculus
ttaaatagccatgcagtcgcccaca

SEQ ID NO: 916383 - DNA, 25 bp, Mus musculus
ttaaataggcttaccactcagctct

SEQ ID NO: 916384 - DNA, 25 bp, Mus musculus
ttaaataggctttccactcagctct

SEQ ID NO: 916385 - DNA, 25 bp, Mus musculus
ttaaatagtctcatgtgctcacata

SEQ ID NO: 916386 - DNA, 25 bp, Mus musculus
ttaaatagtctcttgtgctcacata

SEQ ID NO: 916387 - DNA, 25 bp, Mus musculus
ttaaatagttaaatgtttcagtgac

SEQ ID NO: 916388 - DNA, 25 bp, Mus musculus
ttaaatagttaattgtttcagtgac

SEQ ID NO: 916389 - DNA, 25 bp, Mus musculus
ttaaatatgactccttccttcaccc

SEQ ID NO: 916390 - DNA, 25 bp, Mus musculus
ttaaatatgactgcttccttcaccc

SEQ ID NO: 916391 - DNA, 25 bp, Mus musculus
ttaaatatgcataccctgtctcaga

SEQ ID NO: 916392 - DNA, 25 bp, Mus musculus
ttaaatatgcattccctgtctcaga

SEQ ID NO: 916393 - DNA, 25 bp, Mus musculus
ttaaatatgctcaggtggccacaaa

SEQ ID NO: 916394 - DNA, 25 bp, Mus musculus
ttaaatatgctctggtggccacaaa

SEQ ID NO: 916395 - DNA, 25 bp, Mus musculus
ttaaatatgggaccctatgggagcc

SEQ ID NO: 916396 - DNA, 25 bp, Mus musculus
ttaaatatgggagcctatgggagcc

SEQ ID NO: 916397 - DNA, 25 bp, Mus musculus
ttaaatatgtttccctatagctaga

SEQ ID NO: 916398 - DNA, 25 bp, Mus musculus
ttaaatatgtttgcctatagctaga

SEQ ID NO: 916399 - DNA, 25 bp, Mus musculus
ttaaatcaaatgcatcccgaccttc

SEQ ID NO: 916400 - DNA, 25 bp, Mus musculus
ttaaatcaaatggatcccgaccttc

SEQ ID NO: 916401 - DNA, 25 bp, Mus musculus
ttaaatcacaccatctctaaaaaga

SEQ ID NO: 916402 - DNA, 25 bp, Mus musculus
ttaaatcacaccttctctaaaaaga

SEQ ID NO: 916403 - DNA, 25 bp, Mus musculus
ttaaatcactttaaggccagataat

SEQ ID NO: 916404 - DNA, 25 bp, Mus musculus
ttaaatcacttttaggccagataat

SEQ ID NO: 916405 - DNA, 25 bp, Mus musculus
ttaaatcagattacccacctgaagc

SEQ ID NO: 916406 - DNA, 25 bp, Mus musculus
ttaaatcagatttcccacctgaagc

SEQ ID NO: 916407 - DNA, 25 bp, Mus musculus
ttaaatcaggacaattttacatagt

SEQ ID NO: 916408 - DNA, 25 bp, Mus musculus
ttaaatcaggactattttacatagt

SEQ ID NO: 916409 - DNA, 25 bp, Mus musculus
ttaaatcatggtaggccgtctttct

SEQ ID NO: 916410 - DNA, 25 bp, Mus musculus
ttaaatcatggttggccgtctttct

SEQ ID NO: 916411 - DNA, 25 bp, Mus musculus
ttaaatccacatactccacccaagt

SEQ ID NO: 916412 - DNA, 25 bp, Mus musculus
ttaaatccacattctccacccaagt

SEQ ID NO: 916413 - DNA, 25 bp, Mus musculus
ttaaatccagatactccataactaa

SEQ ID NO: 916414 - DNA, 25 bp, Mus musculus
ttaaatccagattctccataactaa

SEQ ID NO: 916415 - DNA, 25 bp, Mus musculus
ttaaatccatttccactaggtaata

SEQ ID NO: 916416 - DNA, 25 bp, Mus musculus
ttaaatccatttgcactaggtaata

SEQ ID NO: 916417 - DNA, 25 bp, Mus musculus
ttaaatcccaatccctccagaaaga

SEQ ID NO: 916418 - DNA, 25 bp, Mus musculus
ttaaatcccaatgcctccagaaaga

SEQ ID NO: 916419 - DNA, 25 bp, Mus musculus
ttaaatccctcacctctgtctgtat

SEQ ID NO: 916420 - DNA, 25 bp, Mus musculus
ttaaatccctcagctctgtctgtat

SEQ ID NO: 916421 - DNA, 25 bp, Mus musculus
ttaaatccctgacgagtctgccctg

SEQ ID NO: 916422 - DNA, 25 bp, Mus musculus
ttaaatccctgaggagtctgccctg

SEQ ID NO: 916423 - DNA, 25 bp, Mus musculus
ttaaatccttcaacaatcacacatc

SEQ ID NO: 916424 - DNA, 25 bp, Mus musculus
ttaaatccttcatcaatcacacatc

SEQ ID NO: 916425 - DNA, 25 bp, Mus musculus
ttaaatcgccctatggtagctcaga

SEQ ID NO: 916426 - DNA, 25 bp, Mus musculus
ttaaatcgccctttggtagctcaga

SEQ ID NO: 916427 - DNA, 25 bp, Mus musculus
ttaaatcgtctcacagtcagtcacc

SEQ ID NO: 916428 - DNA, 25 bp, Mus musculus
ttaaatcgtctctcagtcagtcacc

SEQ ID NO: 916429 - DNA, 25 bp, Mus musculus
ttaaatcgttgtatcctgcagtctg

SEQ ID NO: 916430 - DNA, 25 bp, Mus musculus
ttaaatcgttgtttcctgcagtctg

SEQ ID NO: 916431 - DNA, 25 bp, Mus musculus
ttaaatctattaatcattctgggat

SEQ ID NO: 916432 - DNA, 25 bp, Mus musculus
ttaaatctattattcattctgggat

SEQ ID NO: 916433 - DNA, 25 bp, Mus musculus
ttaaatctgccgcatatttcccttt

SEQ ID NO: 916434 - DNA, 25 bp, Mus musculus
ttaaatctgccggatatttcccttt

SEQ ID NO: 916435 - DNA, 25 bp, Mus musculus
ttaaatctgtcaaggcgctctgttt

SEQ ID NO: 916436 - DNA, 25 bp, Mus musculus
ttaaatctgtcatggcgctctgttt

SEQ ID NO: 916437 - DNA, 25 bp, Mus musculus
ttaaatcttgcaccgcgcatacgat

SEQ ID NO: 916438 - DNA, 25 bp, Mus musculus
ttaaatcttgcagcgcgcatacgat

SEQ ID NO: 916439 - DNA, 25 bp, Mus musculus
ttaaatcttgctattccctgtggag

SEQ ID NO: 916440 - DNA, 25 bp, Mus musculus
ttaaatcttgcttttccctgtggag

SEQ ID NO: 916441 - DNA, 25 bp, Mus musculus
ttaaatgaaatcacttccagaagac

SEQ ID NO: 916442 - DNA, 25 bp, Mus musculus
ttaaatgaaatctcttccagaagac

SEQ ID NO: 916443 - DNA, 25 bp, Mus musculus
ttaaatgacatcacagctacatcct

SEQ ID NO: 916444 - DNA, 25 bp, Mus musculus
ttaaatgacatctcagctacatcct

SEQ ID NO: 916445 - DNA, 25 bp, Mus musculus
ttaaatgaccagcaaacacctaccc

SEQ ID NO: 916446 - DNA, 25 bp, Mus musculus
ttaaatgaccaggaaacacctaccc

SEQ ID NO: 916447 - DNA, 25 bp, Mus musculus
ttaaatgacctgagtgctttgtgga

SEQ ID NO: 916448 - DNA, 25 bp, Mus musculus
ttaaatgacctgtgtgctttgtgga

SEQ ID NO: 916449 - DNA, 25 bp, Mus musculus
ttaaatgacggtccctgctttcgaa

SEQ ID NO: 916450 - DNA, 25 bp, Mus musculus
ttaaatgacggtgcctgctttcgaa

SEQ ID NO: 916451 - DNA, 25 bp, Mus musculus
ttaaatgactgtcctgcccctttca

SEQ ID NO: 916452 - DNA, 25 bp, Mus musculus
ttaaatgactgtgctgcccctttca

SEQ ID NO: 916453 - DNA, 25 bp, Mus musculus
ttaaatgagatcagtgattccctgt

SEQ ID NO: 916454 - DNA, 25 bp, Mus musculus
ttaaatgagatctgtgattccctgt

SEQ ID NO: 916455 - DNA, 25 bp, Mus musculus
ttaaatgcacaaacctttcgtaagc

SEQ ID NO: 916456 - DNA, 25 bp, Mus musculus
ttaaatgcacaatcctttcgtaagc

SEQ ID NO: 916457 - DNA, 25 bp, Mus musculus
ttaaatgcacttactgcactggccc

SEQ ID NO: 916458 - DNA, 25 bp, Mus musculus
ttaaatgcactttctgcactggccc

SEQ ID NO: 916459 - DNA, 25 bp, Mus musculus
ttaaatgcatacatcctttgatccc

SEQ ID NO: 916460 - DNA, 25 bp, Mus musculus
ttaaatgcatacttcctttgatccc

SEQ ID NO: 916461 - DNA, 25 bp, Mus musculus
ttaaatgcatatcatcaggcttggc

SEQ ID NO: 916462 - DNA, 25 bp, Mus musculus
ttaaatgcatatgatcaggcttggc

SEQ ID NO: 916463 - DNA, 25 bp, Mus musculus
ttaaatgccaacctatcgcctccaa

SEQ ID NO: 916464 - DNA, 25 bp, Mus musculus
ttaaatgccaacgtatcgcctccaa

SEQ ID NO: 916465 - DNA, 25 bp, Mus musculus
ttaaatgcccttactcaactgccaa

SEQ ID NO: 916466 - DNA, 25 bp, Mus musculus
ttaaatgccctttctcaactgccaa

SEQ ID NO: 916467 - DNA, 25 bp, Mus musculus
ttaaatgccgagatctcactaccac

SEQ ID NO: 916468 - DNA, 25 bp, Mus musculus
ttaaatgccgagttctcactaccac

SEQ ID NO: 916469 - DNA, 25 bp, Mus musculus
ttaaatgccgatacacattactctg

SEQ ID NO: 916470 - DNA, 25 bp, Mus musculus
ttaaatgccgattcacattactctg

SEQ ID NO: 916471 - DNA, 25 bp, Mus musculus
ttaaatgctaacatctgcctgtgat

SEQ ID NO: 916472 - DNA, 25 bp, Mus musculus
ttaaatgctaacttctgcctgtgat

SEQ ID NO: 916473 - DNA, 25 bp, Mus musculus
ttaaatgctagaccccaggcttgtc

SEQ ID NO: 916474 - DNA, 25 bp, Mus musculus
ttaaatgctagagcccaggcttgtc

SEQ ID NO: 916475 - DNA, 25 bp, Mus musculus
ttaaatgctctcaaggctgccaagg

SEQ ID NO: 916476 - DNA, 25 bp, Mus musculus
ttaaatgctctctaggctgccaagg

SEQ ID NO: 916477 - DNA, 25 bp, Mus musculus
ttaaatgctggtatgttggttgttg

SEQ ID NO: 916478 - DNA, 25 bp, Mus musculus
ttaaatgctggtttgttggttgttg

SEQ ID NO: 916479 - DNA, 25 bp, Mus musculus
ttaaatgctgtaacccttattccca

SEQ ID NO: 916480 - DNA, 25 bp, Mus musculus
ttaaatgctgtatcccttattccca

SEQ ID NO: 916481 - DNA, 25 bp, Mus musculus
ttaaatggaatcatagagctttctc

SEQ ID NO: 916482 - DNA, 25 bp, Mus musculus
ttaaatggaatcttagagctttctc

SEQ ID NO: 916483 - DNA, 25 bp, Mus musculus
ttaaatggacacatactgaagcctt

SEQ ID NO: 916484 - DNA, 25 bp, Mus musculus
ttaaatggacacttactgaagcctt

SEQ ID NO: 916485 - DNA, 25 bp, Mus musculus
ttaaatggactccatgcccttggca

SEQ ID NO: 916486 - DNA, 25 bp, Mus musculus
ttaaatggactcgatgcccttggca

SEQ ID NO: 916487 - DNA, 25 bp, Mus musculus
ttaaatggatctctctctctttaga

SEQ ID NO: 916488 - DNA, 25 bp, Mus musculus
ttaaatggatctgtctctctttaga

SEQ ID NO: 916489 - DNA, 25 bp, Mus musculus
ttaaatggatgtctctgtaaactca

SEQ ID NO: 916490 - DNA, 25 bp, Mus musculus
ttaaatggatgtgtctgtaaactca

SEQ ID NO: 916491 - DNA, 25 bp, Mus musculus
ttaaatgggctcattcatgtcctca

SEQ ID NO: 916492 - DNA, 25 bp, Mus musculus
ttaaatgggctctttcatgtcctca

SEQ ID NO: 916493 - DNA, 25 bp, Mus musculus
ttaaatggtcctaaagcccaacctg

SEQ ID NO: 916494 - DNA, 25 bp, Mus musculus
ttaaatggtccttaagcccaacctg

SEQ ID NO: 916495 - DNA, 25 bp, Mus musculus
ttaaatgtagctagtcagattcacc

SEQ ID NO: 916496 - DNA, 25 bp, Mus musculus
ttaaatgtagcttgtcagattcacc

SEQ ID NO: 916497 - DNA, 25 bp, Mus musculus
ttaaatgtagtactccatgggctga

SEQ ID NO: 916498 - DNA, 25 bp, Mus musculus
ttaaatgtagtagtccatgggctga

SEQ ID NO: 916499 - DNA, 25 bp, Mus musculus
ttaaatgtcaggacagctcaggaaa

SEQ ID NO: 916500 - DNA, 25 bp, Mus musculus
ttaaatgtcaggtcagctcaggaaa

SEQ ID NO: 916501 - DNA, 25 bp, Mus musculus
ttaaatgtccaactgcctggcccta

SEQ ID NO: 916502 - DNA, 25 bp, Mus musculus
ttaaatgtccaagtgcctggcccta

SEQ ID NO: 916503 - DNA, 25 bp, Mus musculus
ttaaatgtgacgacttcatgcccct

SEQ ID NO: 916504 - DNA, 25 bp, Mus musculus
ttaaatgtgacgtcttcatgcccct

SEQ ID NO: 916505 - DNA, 25 bp, Mus musculus
ttaaatgtgagccaagccccagact

SEQ ID NO: 916506 - DNA, 25 bp, Mus musculus
ttaaatgtgagcgaagccccagact

SEQ ID NO: 916507 - DNA, 25 bp, Mus musculus
ttaaatgtgagtccttagaactgta

SEQ ID NO: 916508 - DNA, 25 bp, Mus musculus
ttaaatgtgagtgcttagaactgta

SEQ ID NO: 916509 - DNA, 25 bp, Mus musculus
ttaaatgttacacgctgctgatgtt

SEQ ID NO: 916510 - DNA, 25 bp, Mus musculus
ttaaatgttacaggctgctgatgtt

SEQ ID NO: 916511 - DNA, 25 bp, Mus musculus
ttaaatgttagacagccgcgaatca

SEQ ID NO: 916512 - DNA, 25 bp, Mus musculus
ttaaatgttagagagccgcgaatca

SEQ ID NO: 916513 - DNA, 25 bp, Mus musculus
ttaaatgttcccctattgctgggtt

SEQ ID NO: 916514 - DNA, 25 bp, Mus musculus
ttaaatgttcccgtattgctgggtt

SEQ ID NO: 916515 - DNA, 25 bp, Mus musculus
ttaaatgttctgatgctaagctgcg

SEQ ID NO: 916516 - DNA, 25 bp, Mus musculus
ttaaatgttctgttgctaagctgcg

SEQ ID NO: 916517 - DNA, 25 bp, Mus musculus
ttaaatgttcttactgggttcctgt

SEQ ID NO: 916518 - DNA, 25 bp, Mus musculus
ttaaatgttctttctgggttcctgt

SEQ ID NO: 916519 - DNA, 25 bp, Mus musculus
ttaaatgttgcccaattaagagttg

SEQ ID NO: 916520 - DNA, 25 bp, Mus musculus
ttaaatgttgccctgttttccaaat

SEQ ID NO: 916521 - DNA, 25 bp, Mus musculus
ttaaatgttgccgaattaagagttg

SEQ ID NO: 916522 - DNA, 25 bp, Mus musculus
ttaaatgttgccgtgttttccaaat

SEQ ID NO: 916523 - DNA, 25 bp, Mus musculus
ttaaattatacaatagtccctaagg

SEQ ID NO: 916524 - DNA, 25 bp, Mus musculus
ttaaattatacattagtccctaagg

SEQ ID NO: 916525 - DNA, 25 bp, Mus musculus
ttaaattatactactgtgggactgg

SEQ ID NO: 916526 - DNA, 25 bp, Mus musculus
ttaaattatacttctgtgggactgg

SEQ ID NO: 916527 - DNA, 25 bp, Mus musculus
ttaaattatcttacaatcacttttg

SEQ ID NO: 916528 - DNA, 25 bp, Mus musculus
ttaaattatctttcaatcacttttg

SEQ ID NO: 916529 - DNA, 25 bp, Mus musculus
ttaaattccgaaaggctacaggtat

SEQ ID NO: 916530 - DNA, 25 bp, Mus musculus
ttaaattccgaatggctacaggtat

SEQ ID NO: 916531 - DNA, 25 bp, Mus musculus
ttaaattcctggagcttgtgccgaa

SEQ ID NO: 916532 - DNA, 25 bp, Mus musculus
ttaaattcctggtgcttgtgccgaa

SEQ ID NO: 916533 - DNA, 25 bp, Mus musculus
ttaaattctcagacgtaagggtcag

SEQ ID NO: 916534 - DNA, 25 bp, Mus musculus
ttaaattctcagtcgtaagggtcag

SEQ ID NO: 916535 - DNA, 25 bp, Mus musculus
ttaaattctgctacatgtttccctc

SEQ ID NO: 916536 - DNA, 25 bp, Mus musculus
ttaaattctgctctggattattgag

SEQ ID NO: 916537 - DNA, 25 bp, Mus musculus
ttaaattctgctgtggattattgag

SEQ ID NO: 916538 - DNA, 25 bp, Mus musculus
ttaaattctgcttcatgtttccctc

SEQ ID NO: 916539 - DNA, 25 bp, Mus musculus
ttaaattgccttcaggactagcccc

SEQ ID NO: 916540 - DNA, 25 bp, Mus musculus
ttaaattgccttgaggactagcccc

SEQ ID NO: 916541 - DNA, 25 bp, Mus musculus
ttaaattgctggacagtctcctcca

SEQ ID NO: 916542 - DNA, 25 bp, Mus musculus
ttaaattgctggtcagtctcctcca

SEQ ID NO: 916543 - DNA, 25 bp, Mus musculus
ttaaattgtcaaactgtgcacagtg

SEQ ID NO: 916544 - DNA, 25 bp, Mus musculus
ttaaattgtcaatctgtgcacagtg

SEQ ID NO: 916545 - DNA, 25 bp, Mus musculus
ttaaattgtcagaagccaccagctc

SEQ ID NO: 916546 - DNA, 25 bp, Mus musculus
ttaaattgtcagtagccaccagctc

SEQ ID NO: 916547 - DNA, 25 bp, Mus musculus
ttaaattgtgtacttagcattttga

SEQ ID NO: 916548 - DNA, 25 bp, Mus musculus
ttaaattgtgtagttagcattttga

SEQ ID NO: 916549 - DNA, 25 bp, Mus musculus
ttaaatttacacatgatcacccagt

SEQ ID NO: 916550 - DNA, 25 bp, Mus musculus
ttaaatttacacttgatcacccagt

SEQ ID NO: 916551 - DNA, 25 bp, Mus musculus
ttaaatttcaccagagggctcctca

SEQ ID NO: 916552 - DNA, 25 bp, Mus musculus
ttaaatttcacctgagggctcctca

SEQ ID NO: 916553 - DNA, 25 bp, Mus musculus
ttaaatttcagtacagggcatgacc

SEQ ID NO: 916554 - DNA, 25 bp, Mus musculus
ttaaatttcagttcagggcatgacc

SEQ ID NO: 916555 - DNA, 25 bp, Mus musculus
ttaaatttctctatgccaacacatg

SEQ ID NO: 916556 - DNA, 25 bp, Mus musculus
ttaaatttctctttgccaacacatg

SEQ ID NO: 916557 - DNA, 25 bp, Mus musculus
ttaaatttgaatcccctgtctcggg

SEQ ID NO: 916558 - DNA, 25 bp, Mus musculus
ttaaatttgaatgccctgtctcggg

SEQ ID NO: 916559 - DNA, 25 bp, Mus musculus
ttaaattttattcgctggcaaccga

SEQ ID NO: 916560 - DNA, 25 bp, Mus musculus
ttaaattttattggctggcaaccga

SEQ ID NO: 916561 - DNA, 25 bp, Mus musculus
ttaacaaacactctggacattaaac

SEQ ID NO: 916562 - DNA, 25 bp, Mus musculus
ttaacaaacactgtggacattaaac

SEQ ID NO: 916563 - DNA, 25 bp, Mus musculus
ttaacaaactctactttcccaatct

SEQ ID NO: 916564 - DNA, 25 bp, Mus musculus
ttaacaaactcttctttcccaatct

SEQ ID NO: 916565 - DNA, 25 bp, Mus musculus
ttaacaaactgtaagcaatcaaggt

SEQ ID NO: 916566 - DNA, 25 bp, Mus musculus
ttaacaaactgttagcaatcaaggt

SEQ ID NO: 916567 - DNA, 25 bp, Mus musculus
ttaacaaatcatcaccctaacaccc

SEQ ID NO: 916568 - DNA, 25 bp, Mus musculus
ttaacaaatcatgaccctaacaccc

SEQ ID NO: 916569 - DNA, 25 bp, Mus musculus
ttaacaaccagcattgttctccagc

SEQ ID NO: 916570 - DNA, 25 bp, Mus musculus
ttaacaaccagctttgttctccagc

SEQ ID NO: 916571 - DNA, 25 bp, Mus musculus
ttaacaacccctcactgggcagtgt

SEQ ID NO: 916572 - DNA, 25 bp, Mus musculus
ttaacaacccctgactgggcagtgt

SEQ ID NO: 916573 - DNA, 25 bp, Mus musculus
ttaacaacctatcattcacagctcc

SEQ ID NO: 916574 - DNA, 25 bp, Mus musculus
ttaacaacctatgattcacagctcc

SEQ ID NO: 916575 - DNA, 25 bp, Mus musculus
ttaacaacctgcagactgacatctg

SEQ ID NO: 916576 - DNA, 25 bp, Mus musculus
ttaacaacctgctgactgacatctg

SEQ ID NO: 916577 - DNA, 25 bp, Mus musculus
ttaacaactttaacagctgcctggt

SEQ ID NO: 916578 - DNA, 25 bp, Mus musculus
ttaacaactttatcagctgcctggt

SEQ ID NO: 916579 - DNA, 25 bp, Mus musculus
ttaacaagtctcaaacatttctcat

SEQ ID NO: 916580 - DNA, 25 bp, Mus musculus
ttaacaagtctcatcgccgaatcag

SEQ ID NO: 916581 - DNA, 25 bp, Mus musculus
ttaacaagtctctaacatttctcat

SEQ ID NO: 916582 - DNA, 25 bp, Mus musculus
ttaacaagtctcttcgccgaatcag

SEQ ID NO: 916583 - DNA, 25 bp, Mus musculus
ttaacaataaggattcattttggaa

SEQ ID NO: 916584 - DNA, 25 bp, Mus musculus
ttaacaataaggtttcattttggaa

SEQ ID NO: 916585 - DNA, 25 bp, Mus musculus
ttaacaatatcccaaggtggcccct

SEQ ID NO: 916586 - DNA, 25 bp, Mus musculus
ttaacaatatccgaaggtggcccct

SEQ ID NO: 916587 - DNA, 25 bp, Mus musculus
ttaacaatcggtctggatctccagg

SEQ ID NO: 916588 - DNA, 25 bp, Mus musculus
ttaacaatcggtgtggatctccagg

SEQ ID NO: 916589 - DNA, 25 bp, Mus musculus
ttaacaatgcctagctgtttcccat

SEQ ID NO: 916590 - DNA, 25 bp, Mus musculus
ttaacaatgccttgctgtttcccat

SEQ ID NO: 916591 - DNA, 25 bp, Mus musculus
ttaacaattgggacctgcccatgtg

SEQ ID NO: 916592 - DNA, 25 bp, Mus musculus
ttaacaattgggtcctgcccatgtg

SEQ ID NO: 916593 - DNA, 25 bp, Mus musculus
ttaacacacgttaagatagcttatt

SEQ ID NO: 916594 - DNA, 25 bp, Mus musculus
ttaacacacgtttagatagcttatt

SEQ ID NO: 916595 - DNA, 25 bp, Mus musculus
ttaacacactgtccaatgttgggtt

SEQ ID NO: 916596 - DNA, 25 bp, Mus musculus
ttaacacactgtgcaatgttgggtt

SEQ ID NO: 916597 - DNA, 25 bp, Mus musculus
ttaacacaggatcatccaagctgtt

SEQ ID NO: 916598 - DNA, 25 bp, Mus musculus
ttaacacaggatgatccaagctgtt

SEQ ID NO: 916599 - DNA, 25 bp, Mus musculus
ttaacacagtgaaacctcgcttctc

SEQ ID NO: 916600 - DNA, 25 bp, Mus musculus
ttaacacagtgatacctcgcttctc

SEQ ID NO: 916601 - DNA, 25 bp, Mus musculus
ttaacacatagtattggacctcaaa

SEQ ID NO: 916602 - DNA, 25 bp, Mus musculus
ttaacacatagttttggacctcaaa

SEQ ID NO: 916603 - DNA, 25 bp, Mus musculus
ttaacaccaagcaagcaggaacctt

SEQ ID NO: 916604 - DNA, 25 bp, Mus musculus
ttaacaccaagctagcaggaacctt

SEQ ID NO: 916605 - DNA, 25 bp, Mus musculus
ttaacaccaagtccattccagaata

SEQ ID NO: 916606 - DNA, 25 bp, Mus musculus
ttaacaccaagtgcattccagaata

SEQ ID NO: 916607 - DNA, 25 bp, Mus musculus
ttaacaccactcctgttgagggctg

SEQ ID NO: 916608 - DNA, 25 bp, Mus musculus
ttaacaccactcgtgttgagggctg

SEQ ID NO: 916609 - DNA, 25 bp, Mus musculus
ttaacacccaccaaaaacacagtct

SEQ ID NO: 916610 - DNA, 25 bp, Mus musculus
ttaacacccacctaaaacacagtct

SEQ ID NO: 916611 - DNA, 25 bp, Mus musculus
ttaacacccgtgagtccagttgact

SEQ ID NO: 916612 - DNA, 25 bp, Mus musculus
ttaacacccgtgtgtccagttgact

SEQ ID NO: 916613 - DNA, 25 bp, Mus musculus
ttaacaccctttcgccatgtatctc

SEQ ID NO: 916614 - DNA, 25 bp, Mus musculus
ttaacaccctttggccatgtatctc

SEQ ID NO: 916615 - DNA, 25 bp, Mus musculus
ttaacacctgcacctttgaaccatg

SEQ ID NO: 916616 - DNA, 25 bp, Mus musculus
ttaacacctgcagctttgaaccatg

SEQ ID NO: 916617 - DNA, 25 bp, Mus musculus
ttaacacctgtactaggcgcttctg

SEQ ID NO: 916618 - DNA, 25 bp, Mus musculus
ttaacacctgtagtaggcgcttctg

SEQ ID NO: 916619 - DNA, 25 bp, Mus musculus
ttaacaccttccaacttcacaatga

SEQ ID NO: 916620 - DNA, 25 bp, Mus musculus
ttaacaccttcctacttcacaatga

SEQ ID NO: 916621 - DNA, 25 bp, Mus musculus
ttaacacgaagcatagggcctgggt

SEQ ID NO: 916622 - DNA, 25 bp, Mus musculus
ttaacacgaagcttagggcctgggt

SEQ ID NO: 916623 - DNA, 25 bp, Mus musculus
ttaacacggcttctctgctgcagca

SEQ ID NO: 916624 - DNA, 25 bp, Mus musculus
ttaacacggcttgtctgctgcagca

SEQ ID NO: 916625 - DNA, 25 bp, Mus musculus
ttaacactaacccttgcacttgtag

SEQ ID NO: 916626 - DNA, 25 bp, Mus musculus
ttaacactaaccgttgcacttgtag

SEQ ID NO: 916627 - DNA, 25 bp, Mus musculus
ttaacactatctcgccggtctcaaa

SEQ ID NO: 916628 - DNA, 25 bp, Mus musculus
ttaacactatctggccggtctcaaa

SEQ ID NO: 916629 - DNA, 25 bp, Mus musculus
ttaacactattcagggaagggccca

SEQ ID NO: 916630 - DNA, 25 bp, Mus musculus
ttaacactattctgggaagggccca

SEQ ID NO: 916631 - DNA, 25 bp, Mus musculus
ttaacactgaagaaccttgtggcag

SEQ ID NO: 916632 - DNA, 25 bp, Mus musculus
ttaacactgaagtaccttgtggcag

SEQ ID NO: 916633 - DNA, 25 bp, Mus musculus
ttaacactgctacgctagggactaa

SEQ ID NO: 916634 - DNA, 25 bp, Mus musculus
ttaacactgctaggctagggactaa

SEQ ID NO: 916635 - DNA, 25 bp, Mus musculus
ttaacactggccagccgtggacctc

SEQ ID NO: 916636 - DNA, 25 bp, Mus musculus
ttaacactggcctgccgtggacctc

SEQ ID NO: 916637 - DNA, 25 bp, Mus musculus
ttaacactgtgcactacgactcgga

SEQ ID NO: 916638 - DNA, 25 bp, Mus musculus
ttaacactgtgctctacgactcgga

SEQ ID NO: 916639 - DNA, 25 bp, Mus musculus
ttaacactgttgacccacacttcac

SEQ ID NO: 916640 - DNA, 25 bp, Mus musculus
ttaacactgttgtcccacacttcac

SEQ ID NO: 916641 - DNA, 25 bp, Mus musculus
ttaacacttgcactatggcctgaac

SEQ ID NO: 916642 - DNA, 25 bp, Mus musculus
ttaacacttgcagtatggcctgaac

SEQ ID NO: 916643 - DNA, 25 bp, Mus musculus
ttaacactttccctggtaattgtat

SEQ ID NO: 916644 - DNA, 25 bp, Mus musculus
ttaacactttccgtggtaattgtat

SEQ ID NO: 916645 - DNA, 25 bp, Mus musculus
ttaacagatggcaccaatccctgct

SEQ ID NO: 916646 - DNA, 25 bp, Mus musculus
ttaacagatggctccaatccctgct

SEQ ID NO: 916647 - DNA, 25 bp, Mus musculus
ttaacagctaagacatctctatggg

SEQ ID NO: 916648 - DNA, 25 bp, Mus musculus
ttaacagctaagtcatctctatggg

SEQ ID NO: 916649 - DNA, 25 bp, Mus musculus
ttaacagctataattaccctgccac

SEQ ID NO: 916650 - DNA, 25 bp, Mus musculus
ttaacagctatatttaccctgccac

SEQ ID NO: 916651 - DNA, 25 bp, Mus musculus
ttaacaggactgagatggcctccag

SEQ ID NO: 916652 - DNA, 25 bp, Mus musculus
ttaacaggactgtgatggcctccag

SEQ ID NO: 916653 - DNA, 25 bp, Mus musculus
ttaacaggagccacctgggaccttt

SEQ ID NO: 916654 - DNA, 25 bp, Mus musculus
ttaacaggagcctcctgggaccttt

SEQ ID NO: 916655 - DNA, 25 bp, Mus musculus
ttaacagggaatccgcatttctcac

SEQ ID NO: 916656 - DNA, 25 bp, Mus musculus
ttaacagggaatgcgcatttctcac

SEQ ID NO: 916657 - DNA, 25 bp, Mus musculus
ttaacagggcatcgctggctgagtc

SEQ ID NO: 916658 - DNA, 25 bp, Mus musculus
ttaacagggcatggctggctgagtc

SEQ ID NO: 916659 - DNA, 25 bp, Mus musculus
ttaacaggtcacaactgcggttctc

SEQ ID NO: 916660 - DNA, 25 bp, Mus musculus
ttaacaggtcactactgcggttctc

SEQ ID NO: 916661 - DNA, 25 bp, Mus musculus
ttaacagtacagaatacgccatcat

SEQ ID NO: 916662 - DNA, 25 bp, Mus musculus
ttaacagtacagtatacgccatcat

SEQ ID NO: 916663 - DNA, 25 bp, Mus musculus
ttaacagtattgacaccgcctcata

SEQ ID NO: 916664 - DNA, 25 bp, Mus musculus
ttaacagtattgtcaccgcctcata

SEQ ID NO: 916665 - DNA, 25 bp, Mus musculus
ttaacagtcatcctagacccacgtg

SEQ ID NO: 916666 - DNA, 25 bp, Mus musculus
ttaacagtcatcgtagacccacgtg

SEQ ID NO: 916667 - DNA, 25 bp, Mus musculus
ttaacagtcccaagtggcagcccaa

SEQ ID NO: 916668 - DNA, 25 bp, Mus musculus
ttaacagtcccatgtggcagcccaa

SEQ ID NO: 916669 - DNA, 25 bp, Mus musculus
ttaacagtctaacatgagggctaca

SEQ ID NO: 916670 - DNA, 25 bp, Mus musculus
ttaacagtctaagatgagggctaca

SEQ ID NO: 916671 - DNA, 25 bp, Mus musculus
ttaacagtctgtactcatcccagta

SEQ ID NO: 916672 - DNA, 25 bp, Mus musculus
ttaacagtctgttctcatcccagta

SEQ ID NO: 916673 - DNA, 25 bp, Mus musculus
ttaacagtgaacacctggtttgcag

SEQ ID NO: 916674 - DNA, 25 bp, Mus musculus
ttaacagtgaactcctggtttgcag

SEQ ID NO: 916675 - DNA, 25 bp, Mus musculus
ttaacagtgatcacacactccgagc

SEQ ID NO: 916676 - DNA, 25 bp, Mus musculus
ttaacagtgatctcacactccgagc

SEQ ID NO: 916677 - DNA, 25 bp, Mus musculus
ttaacagtgccacctctgtagacca

SEQ ID NO: 916678 - DNA, 25 bp, Mus musculus
ttaacagtgccagctctgtagacca

SEQ ID NO: 916679 - DNA, 25 bp, Mus musculus
ttaacagtggcaacttctgggtaaa

SEQ ID NO: 916680 - DNA, 25 bp, Mus musculus
ttaacagtggcatcttctgggtaaa

SEQ ID NO: 916681 - DNA, 25 bp, Mus musculus
ttaacagtggctctgatggcgtcac

SEQ ID NO: 916682 - DNA, 25 bp, Mus musculus
ttaacagtggctgtgatggcgtcac

SEQ ID NO: 916683 - DNA, 25 bp, Mus musculus
ttaacagttggcctcagatcaaagg

SEQ ID NO: 916684 - DNA, 25 bp, Mus musculus
ttaacagttggcgtcagatcaaagg

SEQ ID NO: 916685 - DNA, 25 bp, Mus musculus
ttaacagtttccatattgagcttgc

SEQ ID NO: 916686 - DNA, 25 bp, Mus musculus
ttaacagtttcccagaagctaacgg

SEQ ID NO: 916687 - DNA, 25 bp, Mus musculus
ttaacagtttccgagaagctaacgg

SEQ ID NO: 916688 - DNA, 25 bp, Mus musculus
ttaacagtttccttattgagcttgc

SEQ ID NO: 916689 - DNA, 25 bp, Mus musculus
ttaacataacagcatcttctccacg

SEQ ID NO: 916690 - DNA, 25 bp, Mus musculus
ttaacataacaggatcttctccacg

SEQ ID NO: 916691 - DNA, 25 bp, Mus musculus
ttaacataccgcatcttagccttga

SEQ ID NO: 916692 - DNA, 25 bp, Mus musculus
ttaacataccgcttcttagccttga

SEQ ID NO: 916693 - DNA, 25 bp, Mus musculus
ttaacatacctcaggcaggctgcta

SEQ ID NO: 916694 - DNA, 25 bp, Mus musculus
ttaacatacctctggcaggctgcta

SEQ ID NO: 916695 - DNA, 25 bp, Mus musculus
ttaacatactgccttcctcgctgcg

SEQ ID NO: 916696 - DNA, 25 bp, Mus musculus
ttaacatactgcgttcctcgctgcg

SEQ ID NO: 916697 - DNA, 25 bp, Mus musculus
ttaacatagtcgaggtgtctgtggc

SEQ ID NO: 916698 - DNA, 25 bp, Mus musculus
ttaacatagtcgtggtgtctgtggc

SEQ ID NO: 916699 - DNA, 25 bp, Mus musculus
ttaacatattcgcttgttctttggg

SEQ ID NO: 916700 - DNA, 25 bp, Mus musculus
ttaacatattcggttgttctttggg

SEQ ID NO: 916701 - DNA, 25 bp, Mus musculus
ttaacatcagttacccaattttatt

SEQ ID NO: 916702 - DNA, 25 bp, Mus musculus
ttaacatcagtttcccaattttatt

SEQ ID NO: 916703 - DNA, 25 bp, Mus musculus
ttaacatccgccacaacagggtgct

SEQ ID NO: 916704 - DNA, 25 bp, Mus musculus
ttaacatccgcctcaacagggtgct

SEQ ID NO: 916705 - DNA, 25 bp, Mus musculus
ttaacatcctggctaagtgcaaggg

SEQ ID NO: 916706 - DNA, 25 bp, Mus musculus
ttaacatcctgggtaagtgcaaggg

SEQ ID NO: 916707 - DNA, 25 bp, Mus musculus
ttaacatcgtggaggtgatgagccg

SEQ ID NO: 916708 - DNA, 25 bp, Mus musculus
ttaacatcgtggtggtgatgagccg

SEQ ID NO: 916709 - DNA, 25 bp, Mus musculus
ttaacatctacaccgttacccgcaa

SEQ ID NO: 916710 - DNA, 25 bp, Mus musculus
ttaacatctacagcgttacccgcaa

SEQ ID NO: 916711 - DNA, 25 bp, Mus musculus
ttaacatctgtcaccttgcatttcc

SEQ ID NO: 916712 - DNA, 25 bp, Mus musculus
ttaacatctgtctccttgcatttcc

SEQ ID NO: 916713 - DNA, 25 bp, Mus musculus
ttaacatgaaaacttacctgccccg

SEQ ID NO: 916714 - DNA, 25 bp, Mus musculus
ttaacatgaaaagttacctgccccg

SEQ ID NO: 916715 - DNA, 25 bp, Mus musculus
ttaacatgcaaaccgaggccccaga

SEQ ID NO: 916716 - DNA, 25 bp, Mus musculus
ttaacatgcaaagcgaggccccaga

SEQ ID NO: 916717 - DNA, 25 bp, Mus musculus
ttaacatgcacacacttaggtccct

SEQ ID NO: 916718 - DNA, 25 bp, Mus musculus
ttaacatgcacagacttaggtccct

SEQ ID NO: 916719 - DNA, 25 bp, Mus musculus
ttaacatgccttaagctgtggcagt

SEQ ID NO: 916720 - DNA, 25 bp, Mus musculus
ttaacatgcctttagctgtggcagt

SEQ ID NO: 916721 - DNA, 25 bp, Mus musculus
ttaacatgctcactgcttggctcgt

SEQ ID NO: 916722 - DNA, 25 bp, Mus musculus
ttaacatgctcagtgcttggctcgt

SEQ ID NO: 916723 - DNA, 25 bp, Mus musculus
ttaacatgcttcattcttctaccgt

SEQ ID NO: 916724 - DNA, 25 bp, Mus musculus
ttaacatgcttctttcttctaccgt

SEQ ID NO: 916725 - DNA, 25 bp, Mus musculus
ttaacatgggcaacagcttcctctg

SEQ ID NO: 916726 - DNA, 25 bp, Mus musculus
ttaacatgggcatcagcttcctctg

SEQ ID NO: 916727 - DNA, 25 bp, Mus musculus
ttaacatgtctcacagtggtcgcta

SEQ ID NO: 916728 - DNA, 25 bp, Mus musculus
ttaacatgtctctcagtggtcgcta

SEQ ID NO: 916729 - DNA, 25 bp, Mus musculus
ttaacatgtgtgcttctgtatatct

SEQ ID NO: 916730 - DNA, 25 bp, Mus musculus
ttaacatgtgtggttctgtatatct

SEQ ID NO: 916731 - DNA, 25 bp, Mus musculus
ttaacattacctacacaactcagag

SEQ ID NO: 916732 - DNA, 25 bp, Mus musculus
ttaacattaccttcacaactcagag

SEQ ID NO: 916733 - DNA, 25 bp, Mus musculus
ttaacattagccaggcaccctgaca

SEQ ID NO: 916734 - DNA, 25 bp, Mus musculus
ttaacattagcctggcaccctgaca

SEQ ID NO: 916735 - DNA, 25 bp, Mus musculus
ttaacattctctacccactttgtta

SEQ ID NO: 916736 - DNA, 25 bp, Mus musculus
ttaacattctcttcccactttgtta

SEQ ID NO: 916737 - DNA, 25 bp, Mus musculus
ttaacattcttcaacttcgggtctg

SEQ ID NO: 916738 - DNA, 25 bp, Mus musculus
ttaacattcttctacttcgggtctg

SEQ ID NO: 916739 - DNA, 25 bp, Mus musculus
ttaacattgcccaagctgacctcaa

SEQ ID NO: 916740 - DNA, 25 bp, Mus musculus
ttaacattgccctagctgacctcaa

SEQ ID NO: 916741 - DNA, 25 bp, Mus musculus
ttaacattggccagggagctctcca

SEQ ID NO: 916742 - DNA, 25 bp, Mus musculus
ttaacattggcctgggagctctcca

SEQ ID NO: 916743 - DNA, 25 bp, Mus musculus
ttaacattggctctgctgggaagca

SEQ ID NO: 916744 - DNA, 25 bp, Mus musculus
ttaacattggctgtgctgggaagca

SEQ ID NO: 916745 - DNA, 25 bp, Mus musculus
ttaacattgttcctgggacccctat

SEQ ID NO: 916746 - DNA, 25 bp, Mus musculus
ttaacattgttcgtgggacccctat

SEQ ID NO: 916747 - DNA, 25 bp, Mus musculus
ttaacatttcctcagggtcatcttg

SEQ ID NO: 916748 - DNA, 25 bp, Mus musculus
ttaacatttcctcctattcaaacat

SEQ ID NO: 916749 - DNA, 25 bp, Mus musculus
ttaacatttcctgagggtcatcttg

SEQ ID NO: 916750 - DNA, 25 bp, Mus musculus
ttaacatttcctgctattcaaacat

SEQ ID NO: 916751 - DNA, 25 bp, Mus musculus
ttaacatttctaaagtgggacaaac

SEQ ID NO: 916752 - DNA, 25 bp, Mus musculus
ttaacatttctatagtgggacaaac

SEQ ID NO: 916753 - DNA, 25 bp, Mus musculus
ttaacatttgtcaatgaacatgggg

SEQ ID NO: 916754 - DNA, 25 bp, Mus musculus
ttaacatttgtctatgaacatgggg

SEQ ID NO: 916755 - DNA, 25 bp, Mus musculus
ttaaccaaaaccaatcgctgcctca

SEQ ID NO: 916756 - DNA, 25 bp, Mus musculus
ttaaccaaaacctatcgctgcctca

SEQ ID NO: 916757 - DNA, 25 bp, Mus musculus
ttaaccaaaagtccagcaaattaga

SEQ ID NO: 916758 - DNA, 25 bp, Mus musculus
ttaaccaaaagtgcagcaaattaga

SEQ ID NO: 916759 - DNA, 25 bp, Mus musculus
ttaaccaacataagagagtccatac

SEQ ID NO: 916760 - DNA, 25 bp, Mus musculus
ttaaccaacatatgagagtccatac

SEQ ID NO: 916761 - DNA, 25 bp, Mus musculus
ttaaccaacctacaagctctcactt

SEQ ID NO: 916762 - DNA, 25 bp, Mus musculus
ttaaccaacctagaagctctcactt

SEQ ID NO: 916763 - DNA, 25 bp, Mus musculus
ttaaccaacctgagctttctataag

SEQ ID NO: 916764 - DNA, 25 bp, Mus musculus
ttaaccaacctgtgctttctataag

SEQ ID NO: 916765 - DNA, 25 bp, Mus musculus
ttaaccaagaggacctgcagcgctt

SEQ ID NO: 916766 - DNA, 25 bp, Mus musculus
ttaaccaagaggtcctgcagcgctt

SEQ ID NO: 916767 - DNA, 25 bp, Mus musculus
ttaaccaagcataattacacacata

SEQ ID NO: 916768 - DNA, 25 bp, Mus musculus
ttaaccaagcatccaatttctcgtg

SEQ ID NO: 916769 - DNA, 25 bp, Mus musculus
ttaaccaagcatgcaatttctcgtg

SEQ ID NO: 916770 - DNA, 25 bp, Mus musculus
ttaaccaagcattattacacacata

SEQ ID NO: 916771 - DNA, 25 bp, Mus musculus
ttaaccacagcactgggcggcagag

SEQ ID NO: 916772 - DNA, 25 bp, Mus musculus
ttaaccacagcagtgggcggcagag

SEQ ID NO: 916773 - DNA, 25 bp, Mus musculus
ttaaccacaggtatcgctctggatt

SEQ ID NO: 916774 - DNA, 25 bp, Mus musculus
ttaaccacaggtttcgctctggatt

SEQ ID NO: 916775 - DNA, 25 bp, Mus musculus
ttaaccacatcgcttaattgaaagt

SEQ ID NO: 916776 - DNA, 25 bp, Mus musculus
ttaaccacatcggttaattgaaagt

SEQ ID NO: 916777 - DNA, 25 bp, Mus musculus
ttaaccacatgcctggagcacgtat

SEQ ID NO: 916778 - DNA, 25 bp, Mus musculus
ttaaccacatgcgtggagcacgtat

SEQ ID NO: 916779 - DNA, 25 bp, Mus musculus
ttaaccaccagaaaacttcctcagg

SEQ ID NO: 916780 - DNA, 25 bp, Mus musculus
ttaaccaccagataacttcctcagg

SEQ ID NO: 916781 - DNA, 25 bp, Mus musculus
ttaaccacgcggacctttgtggtat

SEQ ID NO: 916782 - DNA, 25 bp, Mus musculus
ttaaccacgcggtcctttgtggtat

SEQ ID NO: 916783 - DNA, 25 bp, Mus musculus
ttaaccactactcaagtcttagaag

SEQ ID NO: 916784 - DNA, 25 bp, Mus musculus
ttaaccactactgaagtcttagaag

SEQ ID NO: 916785 - DNA, 25 bp, Mus musculus
ttaaccactcggaaggcagaagcaa

SEQ ID NO: 916786 - DNA, 25 bp, Mus musculus
ttaaccactcggtaggcagaagcaa

SEQ ID NO: 916787 - DNA, 25 bp, Mus musculus
ttaaccactgctcggtgcagcccaa

SEQ ID NO: 916788 - DNA, 25 bp, Mus musculus
ttaaccactgctgggtgcagcccaa

SEQ ID NO: 916789 - DNA, 25 bp, Mus musculus
ttaaccactggacagcggagtctgt

SEQ ID NO: 916790 - DNA, 25 bp, Mus musculus
ttaaccactggagagcggagtctgt

SEQ ID NO: 916791 - DNA, 25 bp, Mus musculus
ttaaccagggcacttcatgtttttt

SEQ ID NO: 916792 - DNA, 25 bp, Mus musculus
ttaaccagggcagttcatgtttttt

SEQ ID NO: 916793 - DNA, 25 bp, Mus musculus
ttaaccaggttgctcatgcttactt

SEQ ID NO: 916794 - DNA, 25 bp, Mus musculus
ttaaccaggttggtcatgcttactt

SEQ ID NO: 916795 - DNA, 25 bp, Mus musculus
ttaaccagttagacatgcctcttcc

SEQ ID NO: 916796 - DNA, 25 bp, Mus musculus
ttaaccagttagtcatgcctcttcc

SEQ ID NO: 916797 - DNA, 25 bp, Mus musculus
ttaaccataggccacctttcggcaa

SEQ ID NO: 916798 - DNA, 25 bp, Mus musculus
ttaaccataggcgacctttcggcaa

SEQ ID NO: 916799 - DNA, 25 bp, Mus musculus
ttaaccatcacactgtgcatcctgg

SEQ ID NO: 916800 - DNA, 25 bp, Mus musculus
ttaaccatcacagtgtgcatcctgg

SEQ ID NO: 916801 - DNA, 25 bp, Mus musculus
ttaaccatcattccagctatcctgc

SEQ ID NO: 916802 - DNA, 25 bp, Mus musculus
ttaaccatcattgcagctatcctgc

SEQ ID NO: 916803 - DNA, 25 bp, Mus musculus
ttaaccatgaccaatgcagctgcca

SEQ ID NO: 916804 - DNA, 25 bp, Mus musculus
ttaaccatgacctatgcagctgcca

SEQ ID NO: 916805 - DNA, 25 bp, Mus musculus
ttaaccatgcaaactctcacagcga

SEQ ID NO: 916806 - DNA, 25 bp, Mus musculus
ttaaccatgcaatctctcacagcga

SEQ ID NO: 916807 - DNA, 25 bp, Mus musculus
ttaaccattgtcagctttggttttg

SEQ ID NO: 916808 - DNA, 25 bp, Mus musculus
ttaaccattgtctgctttggttttg

SEQ ID NO: 916809 - DNA, 25 bp, Mus musculus
ttaacccaagacaagggcgggctca

SEQ ID NO: 916810 - DNA, 25 bp, Mus musculus
ttaacccaagactagggcgggctca

SEQ ID NO: 916811 - DNA, 25 bp, Mus musculus
ttaacccacataagcgaatctctgc

SEQ ID NO: 916812 - DNA, 25 bp, Mus musculus
ttaacccacatatgcgaatctctgc

SEQ ID NO: 916813 - DNA, 25 bp, Mus musculus
ttaacccactggattgatattcttc

SEQ ID NO: 916814 - DNA, 25 bp, Mus musculus
ttaacccactggtttgatattcttc

SEQ ID NO: 916815 - DNA, 25 bp, Mus musculus
ttaacccagaagcttgagacccact

SEQ ID NO: 916816 - DNA, 25 bp, Mus musculus
ttaacccagaaggttgagacccact

SEQ ID NO: 916817 - DNA, 25 bp, Mus musculus
ttaacccagacgctccatcactgaa

SEQ ID NO: 916818 - DNA, 25 bp, Mus musculus
ttaacccagacggtccatcactgaa

SEQ ID NO: 916819 - DNA, 25 bp, Mus musculus
ttaacccagattactatattaaata

SEQ ID NO: 916820 - DNA, 25 bp, Mus musculus
ttaacccagatttctatattaaata

SEQ ID NO: 916821 - DNA, 25 bp, Mus musculus
ttaacccagcacacagcctgattag

SEQ ID NO: 916822 - DNA, 25 bp, Mus musculus
ttaacccagcactcagcctgattag

SEQ ID NO: 916823 - DNA, 25 bp, Mus musculus
ttaacccagcccagagatacattgt

SEQ ID NO: 916824 - DNA, 25 bp, Mus musculus
ttaacccagccctgagatacattgt

SEQ ID NO: 916825 - DNA, 25 bp, Mus musculus
ttaacccagtccctgctgagtgtgc

SEQ ID NO: 916826 - DNA, 25 bp, Mus musculus
ttaacccagtccgtgctgagtgtgc

SEQ ID NO: 916827 - DNA, 25 bp, Mus musculus
ttaacccagttgattatctgagcta

SEQ ID NO: 916828 - DNA, 25 bp, Mus musculus
ttaacccagttgtttatctgagcta

SEQ ID NO: 916829 - DNA, 25 bp, Mus musculus
ttaacccatgtgaagtgaacttctt

SEQ ID NO: 916830 - DNA, 25 bp, Mus musculus
ttaacccatgtgtagtgaacttctt

SEQ ID NO: 916831 - DNA, 25 bp, Mus musculus
ttaaccccaaccagtcttcagatac

SEQ ID NO: 916832 - DNA, 25 bp, Mus musculus
ttaaccccaacctgtcttcagatac

SEQ ID NO: 916833 - DNA, 25 bp, Mus musculus
ttaaccccacagcagagtgcagcag

SEQ ID NO: 916834 - DNA, 25 bp, Mus musculus
ttaaccccacaggagagtgcagcag

SEQ ID NO: 916835 - DNA, 25 bp, Mus musculus
ttaaccccagtaaaataggaaagat

SEQ ID NO: 916836 - DNA, 25 bp, Mus musculus
ttaaccccagtacacgctaatttcg

SEQ ID NO: 916837 - DNA, 25 bp, Mus musculus
ttaaccccagtagacgctaatttcg

SEQ ID NO: 916838 - DNA, 25 bp, Mus musculus
ttaaccccagtataataggaaagat

SEQ ID NO: 916839 - DNA, 25 bp, Mus musculus
ttaaccccatttctttgtgacttat

SEQ ID NO: 916840 - DNA, 25 bp, Mus musculus
ttaaccccatttgtttgtgacttat

SEQ ID NO: 916841 - DNA, 25 bp, Mus musculus
ttaaccccgtcaactacactgtgtt

SEQ ID NO: 916842 - DNA, 25 bp, Mus musculus
ttaaccccgtcatctacactgtgtt

SEQ ID NO: 916843 - DNA, 25 bp, Mus musculus
ttaacccctaacaaggtcacctgag

SEQ ID NO: 916844 - DNA, 25 bp, Mus musculus
ttaacccctaactaggtcacctgag

SEQ ID NO: 916845 - DNA, 25 bp, Mus musculus
ttaacccctacccagtgagatgaga

SEQ ID NO: 916846 - DNA, 25 bp, Mus musculus
ttaacccctaccgagtgagatgaga

SEQ ID NO: 916847 - DNA, 25 bp, Mus musculus
ttaacccctgatctacatggcctag

SEQ ID NO: 916848 - DNA, 25 bp, Mus musculus
ttaacccctgatgtacatggcctag

SEQ ID NO: 916849 - DNA, 25 bp, Mus musculus
ttaacccctgtacatttggctctag

SEQ ID NO: 916850 - DNA, 25 bp, Mus musculus
ttaacccctgtagatttggctctag

SEQ ID NO: 916851 - DNA, 25 bp, Mus musculus
ttaaccccttacctgagaatgaagg

SEQ ID NO: 916852 - DNA, 25 bp, Mus musculus
ttaaccccttacgtgagaatgaagg

SEQ ID NO: 916853 - DNA, 25 bp, Mus musculus
ttaaccccttagattagcatgcaac

SEQ ID NO: 916854 - DNA, 25 bp, Mus musculus
ttaaccccttagtttagcatgcaac

SEQ ID NO: 916855 - DNA, 25 bp, Mus musculus
ttaacccgctgcactatatagagag

SEQ ID NO: 916856 - DNA, 25 bp, Mus musculus
ttaacccgctgctctatatagagag

SEQ ID NO: 916857 - DNA, 25 bp, Mus musculus
ttaacccgtgtcacttagaatgcgg

SEQ ID NO: 916858 - DNA, 25 bp, Mus musculus
ttaacccgtgtctcttagaatgcgg

SEQ ID NO: 916859 - DNA, 25 bp, Mus musculus
ttaaccctacagaattgttcccatc

SEQ ID NO: 916860 - DNA, 25 bp, Mus musculus
ttaaccctacagtattgttcccatc

SEQ ID NO: 916861 - DNA, 25 bp, Mus musculus
ttaaccctacttccagatgagcaaa

SEQ ID NO: 916862 - DNA, 25 bp, Mus musculus
ttaaccctacttgcagatgagcaaa

SEQ ID NO: 916863 - DNA, 25 bp, Mus musculus
ttaaccctagatcgctaagaaaatg

SEQ ID NO: 916864 - DNA, 25 bp, Mus musculus
ttaaccctagatggctaagaaaatg

SEQ ID NO: 916865 - DNA, 25 bp, Mus musculus
ttaaccctagtaaataagcccattg

SEQ ID NO: 916866 - DNA, 25 bp, Mus musculus
ttaaccctagtatataagcccattg

SEQ ID NO: 916867 - DNA, 25 bp, Mus musculus
ttaaccctccttaacctatcagcaa

SEQ ID NO: 916868 - DNA, 25 bp, Mus musculus
ttaaccctcctttacctatcagcaa

SEQ ID NO: 916869 - DNA, 25 bp, Mus musculus
ttaaccctcggcaatatggcagaag

SEQ ID NO: 916870 - DNA, 25 bp, Mus musculus
ttaaccctcggctatatggcagaag

SEQ ID NO: 916871 - DNA, 25 bp, Mus musculus
ttaaccctctggagccaactgttta

SEQ ID NO: 916872 - DNA, 25 bp, Mus musculus
ttaaccctctggatcgtatagggag

SEQ ID NO: 916873 - DNA, 25 bp, Mus musculus
ttaaccctctggtgccaactgttta

SEQ ID NO: 916874 - DNA, 25 bp, Mus musculus
ttaaccctctggttcgtatagggag

SEQ ID NO: 916875 - DNA, 25 bp, Mus musculus
ttaaccctgagcctaaaccgcaaca

SEQ ID NO: 916876 - DNA, 25 bp, Mus musculus
ttaaccctgagccttgaaaaacaag

SEQ ID NO: 916877 - DNA, 25 bp, Mus musculus
ttaaccctgagcgtaaaccgcaaca

SEQ ID NO: 916878 - DNA, 25 bp, Mus musculus
ttaaccctgagcgttgaaaaacaag

SEQ ID NO: 916879 - DNA, 25 bp, Mus musculus
ttaaccctgcctcggcctgtgcggt

SEQ ID NO: 916880 - DNA, 25 bp, Mus musculus
ttaaccctgcctgggcctgtgcggt

SEQ ID NO: 916881 - DNA, 25 bp, Mus musculus
ttaaccctgcggagcggtgcgcgaa

SEQ ID NO: 916882 - DNA, 25 bp, Mus musculus
ttaaccctgcggtgcggtgcgcgaa

SEQ ID NO: 916883 - DNA, 25 bp, Mus musculus
ttaaccctgtacattatgcctttgt

SEQ ID NO: 916884 - DNA, 25 bp, Mus musculus
ttaaccctgtactttatgcctttgt

SEQ ID NO: 916885 - DNA, 25 bp, Mus musculus
ttaaccctgtggctttgggcgtgcc

SEQ ID NO: 916886 - DNA, 25 bp, Mus musculus
ttaaccctgtgggtttgggcgtgcc

SEQ ID NO: 916887 - DNA, 25 bp, Mus musculus
ttaaccctgttcaacctggaattag

SEQ ID NO: 916888 - DNA, 25 bp, Mus musculus
ttaaccctgttctacctggaattag

SEQ ID NO: 916889 - DNA, 25 bp, Mus musculus
ttaacccttgagaggatgttcccag

SEQ ID NO: 916890 - DNA, 25 bp, Mus musculus
ttaacccttgagtggatgttcccag

SEQ ID NO: 916891 - DNA, 25 bp, Mus musculus
ttaaccctttataaccacagttgct

SEQ ID NO: 916892 - DNA, 25 bp, Mus musculus
ttaaccctttattaccacagttgct

SEQ ID NO: 916893 - DNA, 25 bp, Mus musculus
ttaaccctttccaaattgccaatca

SEQ ID NO: 916894 - DNA, 25 bp, Mus musculus
ttaaccctttcctaattgccaatca

SEQ ID NO: 916895 - DNA, 25 bp, Mus musculus
ttaaccctttgacgactttatctct

SEQ ID NO: 916896 - DNA, 25 bp, Mus musculus
ttaaccctttgaggactttatctct

SEQ ID NO: 916897 - DNA, 25 bp, Mus musculus
ttaaccgaagccctttggatccaga

SEQ ID NO: 916898 - DNA, 25 bp, Mus musculus
ttaaccgaagccgtttggatccaga

SEQ ID NO: 916899 - DNA, 25 bp, Mus musculus
ttaaccgaagtaactgccctgtgtt

SEQ ID NO: 916900 - DNA, 25 bp, Mus musculus
ttaaccgaagtatctgccctgtgtt

SEQ ID NO: 916901 - DNA, 25 bp, Mus musculus
ttaaccgcctccatagggcaaaatg

SEQ ID NO: 916902 - DNA, 25 bp, Mus musculus
ttaaccgcctccttagggcaaaatg

SEQ ID NO: 916903 - DNA, 25 bp, Mus musculus
ttaaccggagagcagcccttggtga

SEQ ID NO: 916904 - DNA, 25 bp, Mus musculus
ttaaccggagaggagcccttggtga

SEQ ID NO: 916905 - DNA, 25 bp, Mus musculus
ttaaccggatggcattcccctggag

SEQ ID NO: 916906 - DNA, 25 bp, Mus musculus
ttaaccggatgggattcccctggag

SEQ ID NO: 916907 - DNA, 25 bp, Mus musculus
ttaaccggcgctacgacacagagtt

SEQ ID NO: 916908 - DNA, 25 bp, Mus musculus
ttaaccggcgcttcgacacagagtt

SEQ ID NO: 916909 - DNA, 25 bp, Mus musculus
ttaaccggcggcatggagtgattac

SEQ ID NO: 916910 - DNA, 25 bp, Mus musculus
ttaaccggcggcttggagtgattac

SEQ ID NO: 916911 - DNA, 25 bp, Mus musculus
ttaaccgtacagaaatcgtcttcac

SEQ ID NO: 916912 - DNA, 25 bp, Mus musculus
ttaaccgtacagtaatcgtcttcac

SEQ ID NO: 916913 - DNA, 25 bp, Mus musculus
ttaaccgtccttctggagctgtatt

SEQ ID NO: 916914 - DNA, 25 bp, Mus musculus
ttaaccgtccttgtggagctgtatt

SEQ ID NO: 916915 - DNA, 25 bp, Mus musculus
ttaaccgtgccaacttgcgaactat

SEQ ID NO: 916916 - DNA, 25 bp, Mus musculus
ttaaccgtgccatcttgcgaactat

SEQ ID NO: 916917 - DNA, 25 bp, Mus musculus
ttaacctaacctaacagctatgcct

SEQ ID NO: 916918 - DNA, 25 bp, Mus musculus
ttaacctaaccttacagctatgcct

SEQ ID NO: 916919 - DNA, 25 bp, Mus musculus
ttaacctaagagcaggaccttcctg

SEQ ID NO: 916920 - DNA, 25 bp, Mus musculus
ttaacctaagaggaggaccttcctg

SEQ ID NO: 916921 - DNA, 25 bp, Mus musculus
ttaacctaatggacaaacagcttta

SEQ ID NO: 916922 - DNA, 25 bp, Mus musculus
ttaacctaatggtcaaacagcttta

SEQ ID NO: 916923 - DNA, 25 bp, Mus musculus
ttaacctaccctatgcatcagggac

SEQ ID NO: 916924 - DNA, 25 bp, Mus musculus
ttaacctaccctttgcatcagggac

SEQ ID NO: 916925 - DNA, 25 bp, Mus musculus
ttaacctagcttcctaacatcaatt

SEQ ID NO: 916926 - DNA, 25 bp, Mus musculus
ttaacctagcttgctaacatcaatt

SEQ ID NO: 916927 - DNA, 25 bp, Mus musculus
ttaacctatcgaaatgtggtccttt

SEQ ID NO: 916928 - DNA, 25 bp, Mus musculus
ttaacctatcgatatgtggtccttt

SEQ ID NO: 916929 - DNA, 25 bp, Mus musculus
ttaacctatgagaacctcacgagat

SEQ ID NO: 916930 - DNA, 25 bp, Mus musculus
ttaacctatgagtacctcacgagat

SEQ ID NO: 916931 - DNA, 25 bp, Mus musculus
ttaacctattgccttacctgctcag

SEQ ID NO: 916932 - DNA, 25 bp, Mus musculus
ttaacctattgcgttacctgctcag

SEQ ID NO: 916933 - DNA, 25 bp, Mus musculus
ttaacctattttctgcccatggctg

SEQ ID NO: 916934 - DNA, 25 bp, Mus musculus
ttaacctattttgtgcccatggctg

SEQ ID NO: 916935 - DNA, 25 bp, Mus musculus
ttaacctcaacaaccatctcagtga

SEQ ID NO: 916936 - DNA, 25 bp, Mus musculus
ttaacctcaacatccatctcagtga

SEQ ID NO: 916937 - DNA, 25 bp, Mus musculus
ttaacctcaagtcccagcactgaaa

SEQ ID NO: 916938 - DNA, 25 bp, Mus musculus
ttaacctcaagtgccagcactgaaa

SEQ ID NO: 916939 - DNA, 25 bp, Mus musculus
ttaacctcacctaaagtgtgtcagg

SEQ ID NO: 916940 - DNA, 25 bp, Mus musculus
ttaacctcaccttaagtgtgtcagg

SEQ ID NO: 916941 - DNA, 25 bp, Mus musculus
ttaacctcagtaatgtagtgggttt

SEQ ID NO: 916942 - DNA, 25 bp, Mus musculus
ttaacctcagtattgtagtgggttt

SEQ ID NO: 916943 - DNA, 25 bp, Mus musculus
ttaacctccatacgctgtgtttgct

SEQ ID NO: 916944 - DNA, 25 bp, Mus musculus
ttaacctccataggctgtgtttgct

SEQ ID NO: 916945 - DNA, 25 bp, Mus musculus
ttaacctccatgactattgatcctg

SEQ ID NO: 916946 - DNA, 25 bp, Mus musculus
ttaacctccatgtctattgatcctg

SEQ ID NO: 916947 - DNA, 25 bp, Mus musculus
ttaacctctaggctactgggcctct

SEQ ID NO: 916948 - DNA, 25 bp, Mus musculus
ttaacctctagggtactgggcctct

SEQ ID NO: 916949 - DNA, 25 bp, Mus musculus
ttaacctctatgcgtacagcttacc

SEQ ID NO: 916950 - DNA, 25 bp, Mus musculus
ttaacctctatgggtacagcttacc

SEQ ID NO: 916951 - DNA, 25 bp, Mus musculus
ttaacctctcaacttgcagcttttg

SEQ ID NO: 916952 - DNA, 25 bp, Mus musculus
ttaacctctcaagttgcagcttttg

SEQ ID NO: 916953 - DNA, 25 bp, Mus musculus
ttaacctctcagctaagctctgatg

SEQ ID NO: 916954 - DNA, 25 bp, Mus musculus
ttaacctctcaggtaagctctgatg

SEQ ID NO: 916955 - DNA, 25 bp, Mus musculus
ttaacctctgtaatctaatctgtgt

SEQ ID NO: 916956 - DNA, 25 bp, Mus musculus
ttaacctctgtattctaatctgtgt

SEQ ID NO: 916957 - DNA, 25 bp, Mus musculus
ttaacctcttagacatctttccatc

SEQ ID NO: 916958 - DNA, 25 bp, Mus musculus
ttaacctcttagtcatctttccatc

SEQ ID NO: 916959 - DNA, 25 bp, Mus musculus
ttaacctctttgagttcagcccaga

SEQ ID NO: 916960 - DNA, 25 bp, Mus musculus
ttaacctctttgtgttcagcccaga

SEQ ID NO: 916961 - DNA, 25 bp, Mus musculus
ttaacctgcagcagccgtttgagca

SEQ ID NO: 916962 - DNA, 25 bp, Mus musculus
ttaacctgcagctgccgtttgagca

SEQ ID NO: 916963 - DNA, 25 bp, Mus musculus
ttaacctgcctaccttgggctggga

SEQ ID NO: 916964 - DNA, 25 bp, Mus musculus
ttaacctgcctagcttgggctggga

SEQ ID NO: 916965 - DNA, 25 bp, Mus musculus
ttaacctgcgagacatcttttcagc

SEQ ID NO: 916966 - DNA, 25 bp, Mus musculus
ttaacctgcgagtcatcttttcagc

SEQ ID NO: 916967 - DNA, 25 bp, Mus musculus
ttaacctgctgaccgacctacttga

SEQ ID NO: 916968 - DNA, 25 bp, Mus musculus
ttaacctgctgagcgacctacttga

SEQ ID NO: 916969 - DNA, 25 bp, Mus musculus
ttaacctgctggatcagcttgtacc

SEQ ID NO: 916970 - DNA, 25 bp, Mus musculus
ttaacctgctggttcagcttgtacc

SEQ ID NO: 916971 - DNA, 25 bp, Mus musculus
ttaacctggatgagagtggcgtgct

SEQ ID NO: 916972 - DNA, 25 bp, Mus musculus
ttaacctggatgtgagtggcgtgct

SEQ ID NO: 916973 - DNA, 25 bp, Mus musculus
ttaacctgtgtaacacaaccctcta

SEQ ID NO: 916974 - DNA, 25 bp, Mus musculus
ttaacctgtgtatcacaaccctcta

SEQ ID NO: 916975 - DNA, 25 bp, Mus musculus
ttaacctgttgacgctttgcaatcc

SEQ ID NO: 916976 - DNA, 25 bp, Mus musculus
ttaacctgttgaggctttgcaatcc

SEQ ID NO: 916977 - DNA, 25 bp, Mus musculus
ttaaccttacaaacaaattcagcaa

SEQ ID NO: 916978 - DNA, 25 bp, Mus musculus
ttaaccttacaatcaaattcagcaa

SEQ ID NO: 916979 - DNA, 25 bp, Mus musculus
ttaaccttagtgaaaggcttattgg

SEQ ID NO: 916980 - DNA, 25 bp, Mus musculus
ttaaccttagtgtaaggcttattgg

SEQ ID NO: 916981 - DNA, 25 bp, Mus musculus
ttaaccttcaagacatcccatgtgc

SEQ ID NO: 916982 - DNA, 25 bp, Mus musculus
ttaaccttcaagtcatcccatgtgc

SEQ ID NO: 916983 - DNA, 25 bp, Mus musculus
ttaaccttcttcctcagctataaat

SEQ ID NO: 916984 - DNA, 25 bp, Mus musculus
ttaaccttcttcgtcagctataaat

SEQ ID NO: 916985 - DNA, 25 bp, Mus musculus
ttaaccttgactactggcactacag

SEQ ID NO: 916986 - DNA, 25 bp, Mus musculus
ttaaccttgacttctggcactacag

SEQ ID NO: 916987 - DNA, 25 bp, Mus musculus
ttaaccttggaaacagctttctgca

SEQ ID NO: 916988 - DNA, 25 bp, Mus musculus
ttaaccttggaatcagctttctgca

SEQ ID NO: 916989 - DNA, 25 bp, Mus musculus
ttaaccttggctagtcttcggaact

SEQ ID NO: 916990 - DNA, 25 bp, Mus musculus
ttaaccttggcttgtcttcggaact

SEQ ID NO: 916991 - DNA, 25 bp, Mus musculus
ttaaccttgggcactctggcgtgaa

SEQ ID NO: 916992 - DNA, 25 bp, Mus musculus
ttaaccttgggctctctggcgtgaa

SEQ ID NO: 916993 - DNA, 25 bp, Mus musculus
ttaacctttcctactgcatagatca

SEQ ID NO: 916994 - DNA, 25 bp, Mus musculus
ttaacctttccttctgcatagatca

SEQ ID NO: 916995 - DNA, 25 bp, Mus musculus
ttaacctttgctcatcctcagggac

SEQ ID NO: 916996 - DNA, 25 bp, Mus musculus
ttaacctttgctgatcctcagggac

SEQ ID NO: 916997 - DNA, 25 bp, Mus musculus
ttaacctttgtcactctggagactg

SEQ ID NO: 916998 - DNA, 25 bp, Mus musculus
ttaacctttgtctctctggagactg

SEQ ID NO: 916999 - DNA, 25 bp, Mus musculus
ttaaccttttaaccgatcctcacat

SEQ ID NO: 917000 - DNA, 25 bp, Mus musculus
ttaaccttttaagcgatcctcacat

SEQ ID NO: 917001 - DNA, 25 bp, Mus musculus
ttaaccttttgcctgttgctgctgg

SEQ ID NO: 917002 - DNA, 25 bp, Mus musculus
ttaaccttttgcgtgttgctgctgg

SEQ ID NO: 917003 - DNA, 25 bp, Mus musculus
ttaacgagcaatatgtctgacctgt

SEQ ID NO: 917004 - DNA, 25 bp, Mus musculus
ttaacgagcaatttgtctgacctgt

SEQ ID NO: 917005 - DNA, 25 bp, Mus musculus
ttaacgattgcaagtaccgccgcag

SEQ ID NO: 917006 - DNA, 25 bp, Mus musculus
ttaacgattgcatgtaccgccgcag

SEQ ID NO: 917007 - DNA, 25 bp, Mus musculus
ttaacgcaggatctctgaccatgag

SEQ ID NO: 917008 - DNA, 25 bp, Mus musculus
ttaacgcaggatgtctgaccatgag

SEQ ID NO: 917009 - DNA, 25 bp, Mus musculus
ttaacgcccagtccaatagccagtg

SEQ ID NO: 917010 - DNA, 25 bp, Mus musculus
ttaacgcccagtgcaatagccagtg

SEQ ID NO: 917011 - DNA, 25 bp, Mus musculus
ttaacgccgggaatcagtcactaaa

SEQ ID NO: 917012 - DNA, 25 bp, Mus musculus
ttaacgccgggattcagtcactaaa

SEQ ID NO: 917013 - DNA, 25 bp, Mus musculus
ttaacgccgtgaacttctgtgacaa

SEQ ID NO: 917014 - DNA, 25 bp, Mus musculus
ttaacgccgtgatcttctgtgacaa

SEQ ID NO: 917015 - DNA, 25 bp, Mus musculus
ttaacgccttatcacttacagtgag

SEQ ID NO: 917016 - DNA, 25 bp, Mus musculus
ttaacgccttatgacttacagtgag

SEQ ID NO: 917017 - DNA, 25 bp, Mus musculus
ttaacgcggtttcccgtcttgggat

SEQ ID NO: 917018 - DNA, 25 bp, Mus musculus
ttaacgcggtttgccgtcttgggat

SEQ ID NO: 917019 - DNA, 25 bp, Mus musculus
ttaacgctgggaagtctcagaagca

SEQ ID NO: 917020 - DNA, 25 bp, Mus musculus
ttaacgctgggatgtctcagaagca

SEQ ID NO: 917021 - DNA, 25 bp, Mus musculus
ttaacgcttcgtcttatttcctcca

SEQ ID NO: 917022 - DNA, 25 bp, Mus musculus
ttaacgcttcgtgttatttcctcca

SEQ ID NO: 917023 - DNA, 25 bp, Mus musculus
ttaacggaagtgatgcttgctccac

SEQ ID NO: 917024 - DNA, 25 bp, Mus musculus
ttaacggaagtgttgcttgctccac

SEQ ID NO: 917025 - DNA, 25 bp, Mus musculus
ttaacggatggccatgggctaccat

SEQ ID NO: 917026 - DNA, 25 bp, Mus musculus
ttaacggatggcgatgggctaccat

SEQ ID NO: 917027 - DNA, 25 bp, Mus musculus
ttaacgggcgcaatgcaccaggcgt

SEQ ID NO: 917028 - DNA, 25 bp, Mus musculus
ttaacgggcgcattgcaccaggcgt

SEQ ID NO: 917029 - DNA, 25 bp, Mus musculus
ttaacggttttcacctataatgtag

SEQ ID NO: 917030 - DNA, 25 bp, Mus musculus
ttaacggttttctcctataatgtag

SEQ ID NO: 917031 - DNA, 25 bp, Mus musculus
ttaacgtccatactgctttccagga

SEQ ID NO: 917032 - DNA, 25 bp, Mus musculus
ttaacgtccatagtgctttccagga

SEQ ID NO: 917033 - DNA, 25 bp, Mus musculus
ttaacgtgaactccagcgaggaagt

SEQ ID NO: 917034 - DNA, 25 bp, Mus musculus
ttaacgtgaactgcagcgaggaagt

SEQ ID NO: 917035 - DNA, 25 bp, Mus musculus
ttaacgtgctcacgactcgacgtgc

SEQ ID NO: 917036 - DNA, 25 bp, Mus musculus
ttaacgtgctcaggactcgacgtgc

SEQ ID NO: 917037 - DNA, 25 bp, Mus musculus
ttaacgtggaacattaacacaccag

SEQ ID NO: 917038 - DNA, 25 bp, Mus musculus
ttaacgtggaactttaacacaccag

SEQ ID NO: 917039 - DNA, 25 bp, Mus musculus
ttaacgttcgctatctgtcacagaa

SEQ ID NO: 917040 - DNA, 25 bp, Mus musculus
ttaacgttcgctttctgtcacagaa

SEQ ID NO: 917041 - DNA, 25 bp, Mus musculus
ttaacgtttgctactttctgagaag

SEQ ID NO: 917042 - DNA, 25 bp, Mus musculus
ttaacgtttgcttctttctgagaag

SEQ ID NO: 917043 - DNA, 25 bp, Mus musculus
ttaacgtttgtcatgctatgctttg

SEQ ID NO: 917044 - DNA, 25 bp, Mus musculus
ttaacgtttgtcttgctatgctttg

SEQ ID NO: 917045 - DNA, 25 bp, Mus musculus
ttaactacaacaatgaggacggtca

SEQ ID NO: 917046 - DNA, 25 bp, Mus musculus
ttaactacaacattgaggacggtca

SEQ ID NO: 917047 - DNA, 25 bp, Mus musculus
ttaactaccgaaccgtcccagctag

SEQ ID NO: 917048 - DNA, 25 bp, Mus musculus
ttaactaccgaagcgtcccagctag

SEQ ID NO: 917049 - DNA, 25 bp, Mus musculus
ttaactaccttcatttatccagcag

SEQ ID NO: 917050 - DNA, 25 bp, Mus musculus
ttaactaccttcttttatccagcag

SEQ ID NO: 917051 - DNA, 25 bp, Mus musculus
ttaactagcctacccctcaagtagt

SEQ ID NO: 917052 - DNA, 25 bp, Mus musculus
ttaactagcctagccctcaagtagt

SEQ ID NO: 917053 - DNA, 25 bp, Mus musculus
ttaactaggtttcttcactaaacat

SEQ ID NO: 917054 - DNA, 25 bp, Mus musculus
ttaactaggtttgttcactaaacat

SEQ ID NO: 917055 - DNA, 25 bp, Mus musculus
ttaactatggacctttaccagcttg

SEQ ID NO: 917056 - DNA, 25 bp, Mus musculus
ttaactatggacgtttaccagcttg

SEQ ID NO: 917057 - DNA, 25 bp, Mus musculus
ttaactatggtaatggcctgctgcc

SEQ ID NO: 917058 - DNA, 25 bp, Mus musculus
ttaactatggtattggcctgctgcc

SEQ ID NO: 917059 - DNA, 25 bp, Mus musculus
ttaactatgtcaccgaagagatcag

SEQ ID NO: 917060 - DNA, 25 bp, Mus musculus
ttaactatgtcagcgaagagatcag

SEQ ID NO: 917061 - DNA, 25 bp, Mus musculus
ttaactattgaaccacctttcctgc

SEQ ID NO: 917062 - DNA, 25 bp, Mus musculus
ttaactattgaagcacctttcctgc

SEQ ID NO: 917063 - DNA, 25 bp, Mus musculus
ttaactcaaggcactgggctctctt

SEQ ID NO: 917064 - DNA, 25 bp, Mus musculus
ttaactcaaggctctgggctctctt

SEQ ID NO: 917065 - DNA, 25 bp, Mus musculus
ttaactcacaaccaacctaagggct

SEQ ID NO: 917066 - DNA, 25 bp, Mus musculus
ttaactcacaacgaacctaagggct

SEQ ID NO: 917067 - DNA, 25 bp, Mus musculus
ttaactcacaggcagattagccaga

SEQ ID NO: 917068 - DNA, 25 bp, Mus musculus
ttaactcacagggagattagccaga

SEQ ID NO: 917069 - DNA, 25 bp, Mus musculus
ttaactcactgaatctcacaccaac

SEQ ID NO: 917070 - DNA, 25 bp, Mus musculus
ttaactcactgattctcacaccaac

SEQ ID NO: 917071 - DNA, 25 bp, Mus musculus
ttaactcactgtcagagccggcata

SEQ ID NO: 917072 - DNA, 25 bp, Mus musculus
ttaactcactgtgagagccggcata

SEQ ID NO: 917073 - DNA, 25 bp, Mus musculus
ttaactcagaccaagcaaaccagca

SEQ ID NO: 917074 - DNA, 25 bp, Mus musculus
ttaactcagacctagcaaaccagca

SEQ ID NO: 917075 - DNA, 25 bp, Mus musculus
ttaactcagcagaggccaaacatca

SEQ ID NO: 917076 - DNA, 25 bp, Mus musculus
ttaactcagcagtggccaaacatca

SEQ ID NO: 917077 - DNA, 25 bp, Mus musculus
ttaactcaggctcgcttaactgggc

SEQ ID NO: 917078 - DNA, 25 bp, Mus musculus
ttaactcaggctggcttaactgggc

SEQ ID NO: 917079 - DNA, 25 bp, Mus musculus
ttaactcagtataccacttctgccc

SEQ ID NO: 917080 - DNA, 25 bp, Mus musculus
ttaactcagtattccacttctgccc

SEQ ID NO: 917081 - DNA, 25 bp, Mus musculus
ttaactcagtggactcgacttccag

SEQ ID NO: 917082 - DNA, 25 bp, Mus musculus
ttaactcagtggtctcgacttccag

SEQ ID NO: 917083 - DNA, 25 bp, Mus musculus
ttaactcattaacacatctctcatt

SEQ ID NO: 917084 - DNA, 25 bp, Mus musculus
ttaactcattaagacatctctcatt

SEQ ID NO: 917085 - DNA, 25 bp, Mus musculus
ttaactcattccaccctgattctga

SEQ ID NO: 917086 - DNA, 25 bp, Mus musculus
ttaactcattcctccctgattctga

SEQ ID NO: 917087 - DNA, 25 bp, Mus musculus
ttaactccaagacctgccgaatata

SEQ ID NO: 917088 - DNA, 25 bp, Mus musculus
ttaactccaagagctgccgaatata

SEQ ID NO: 917089 - DNA, 25 bp, Mus musculus
ttaactccacacattgccacaggga

SEQ ID NO: 917090 - DNA, 25 bp, Mus musculus
ttaactccacactttgccacaggga

SEQ ID NO: 917091 - DNA, 25 bp, Mus musculus
ttaactccacagagaaggcacagag

SEQ ID NO: 917092 - DNA, 25 bp, Mus musculus
ttaactccacagtgaaggcacagag

SEQ ID NO: 917093 - DNA, 25 bp, Mus musculus
ttaactccagccacagaaattcctt

SEQ ID NO: 917094 - DNA, 25 bp, Mus musculus
ttaactccagcctcagaaattcctt

SEQ ID NO: 917095 - DNA, 25 bp, Mus musculus
ttaactccatcgaaccaggtgaact

SEQ ID NO: 917096 - DNA, 25 bp, Mus musculus
ttaactccatcgtaccaggtgaact

SEQ ID NO: 917097 - DNA, 25 bp, Mus musculus
ttaactccattcctttacagacgtc

SEQ ID NO: 917098 - DNA, 25 bp, Mus musculus
ttaactccattcgtttacagacgtc

SEQ ID NO: 917099 - DNA, 25 bp, Mus musculus
ttaactcccacaaagggctggcctc

SEQ ID NO: 917100 - DNA, 25 bp, Mus musculus
ttaactcccacatagggctggcctc

SEQ ID NO: 917101 - DNA, 25 bp, Mus musculus
ttaactcccagcacactataacata

SEQ ID NO: 917102 - DNA, 25 bp, Mus musculus
ttaactcccagctcactataacata

SEQ ID NO: 917103 - DNA, 25 bp, Mus musculus
ttaactcccaggatatgttccagaa

SEQ ID NO: 917104 - DNA, 25 bp, Mus musculus
ttaactcccaggttatgttccagaa

SEQ ID NO: 917105 - DNA, 25 bp, Mus musculus
ttaactccgagaacaagccaaccct

SEQ ID NO: 917106 - DNA, 25 bp, Mus musculus
ttaactccgagatcaagccaaccct

SEQ ID NO: 917107 - DNA, 25 bp, Mus musculus
ttaactcctgccacttggtgattaa

SEQ ID NO: 917108 - DNA, 25 bp, Mus musculus
ttaactcctgcctcttggtgattaa

SEQ ID NO: 917109 - DNA, 25 bp, Mus musculus
ttaactcctggcagggtggtcattc

SEQ ID NO: 917110 - DNA, 25 bp, Mus musculus
ttaactcctggctgggtggtcattc

SEQ ID NO: 917111 - DNA, 25 bp, Mus musculus
ttaactcctttaaaataggactgct

SEQ ID NO: 917112 - DNA, 25 bp, Mus musculus
ttaactcctttataataggactgct

SEQ ID NO: 917113 - DNA, 25 bp, Mus musculus
ttaactcctttgaccagcagcatgc

SEQ ID NO: 917114 - DNA, 25 bp, Mus musculus
ttaactcctttgtccagcagcatgc

SEQ ID NO: 917115 - DNA, 25 bp, Mus musculus
ttaactcgaaaccagcacacattga

SEQ ID NO: 917116 - DNA, 25 bp, Mus musculus
ttaactcgaaacgagcacacattga

SEQ ID NO: 917117 - DNA, 25 bp, Mus musculus
ttaactcgtgccagaaagcaaagca

SEQ ID NO: 917118 - DNA, 25 bp, Mus musculus
ttaactcgtgcctgaaagcaaagca

SEQ ID NO: 917119 - DNA, 25 bp, Mus musculus
ttaactctagcaccttccaggttct

SEQ ID NO: 917120 - DNA, 25 bp, Mus musculus
ttaactctagcagcttccaggttct

SEQ ID NO: 917121 - DNA, 25 bp, Mus musculus
ttaactctcagcataaataagcaaa

SEQ ID NO: 917122 - DNA, 25 bp, Mus musculus
ttaactctcagcttaaataagcaaa

SEQ ID NO: 917123 - DNA, 25 bp, Mus musculus
ttaactctctgtagcgcatggccat

SEQ ID NO: 917124 - DNA, 25 bp, Mus musculus
ttaactctctgttgcgcatggccat

SEQ ID NO: 917125 - DNA, 25 bp, Mus musculus
ttaactctgcacatgaacgttggaa

SEQ ID NO: 917126 - DNA, 25 bp, Mus musculus
ttaactctgcacttgaacgttggaa

SEQ ID NO: 917127 - DNA, 25 bp, Mus musculus
ttaactctgccgagcgaggtgcaag

SEQ ID NO: 917128 - DNA, 25 bp, Mus musculus
ttaactctgccgtgcgaggtgcaag

SEQ ID NO: 917129 - DNA, 25 bp, Mus musculus
ttaactctgtccacgagctttgctg

SEQ ID NO: 917130 - DNA, 25 bp, Mus musculus
ttaactctgtcctcgagctttgctg

SEQ ID NO: 917131 - DNA, 25 bp, Mus musculus
ttaactcttaacaactcaaaatgac

SEQ ID NO: 917132 - DNA, 25 bp, Mus musculus
ttaactcttaactactcaaaatgac

SEQ ID NO: 917133 - DNA, 25 bp, Mus musculus
ttaactcttagtactggaacctcaa

SEQ ID NO: 917134 - DNA, 25 bp, Mus musculus
ttaactcttagttctggaacctcaa

SEQ ID NO: 917135 - DNA, 25 bp, Mus musculus
ttaactcttctcaatctcgcttgga

SEQ ID NO: 917136 - DNA, 25 bp, Mus musculus
ttaactcttctctatctcgcttgga

SEQ ID NO: 917137 - DNA, 25 bp, Mus musculus
ttaactcttgatcgttagccacgaa

SEQ ID NO: 917138 - DNA, 25 bp, Mus musculus
ttaactcttgatggttagccacgaa

SEQ ID NO: 917139 - DNA, 25 bp, Mus musculus
ttaactcttgctaaggtagaaaact

SEQ ID NO: 917140 - DNA, 25 bp, Mus musculus
ttaactcttgcttaggtagaaaact

SEQ ID NO: 917141 - DNA, 25 bp, Mus musculus
ttaactcttgtacttctgattctat

SEQ ID NO: 917142 - DNA, 25 bp, Mus musculus
ttaactcttgtagttctgattctat

SEQ ID NO: 917143 - DNA, 25 bp, Mus musculus
ttaactgaattaagagctttttgct

SEQ ID NO: 917144 - DNA, 25 bp, Mus musculus
ttaactgaattatgagctttttgct

SEQ ID NO: 917145 - DNA, 25 bp, Mus musculus
ttaactgacccgcttcctggagtgt

SEQ ID NO: 917146 - DNA, 25 bp, Mus musculus
ttaactgacccggttcctggagtgt

SEQ ID NO: 917147 - DNA, 25 bp, Mus musculus
ttaactgactggactgatggtaaca

SEQ ID NO: 917148 - DNA, 25 bp, Mus musculus
ttaactgactggtctgatggtaaca

SEQ ID NO: 917149 - DNA, 25 bp, Mus musculus
ttaactgatactctcacccagtcca

SEQ ID NO: 917150 - DNA, 25 bp, Mus musculus
ttaactgatactgtcacccagtcca

SEQ ID NO: 917151 - DNA, 25 bp, Mus musculus
ttaactgatgcacggaagcctccag

SEQ ID NO: 917152 - DNA, 25 bp, Mus musculus
ttaactgatgcagggaagcctccag

SEQ ID NO: 917153 - DNA, 25 bp, Mus musculus
ttaactgattggctttcttctcacc

SEQ ID NO: 917154 - DNA, 25 bp, Mus musculus
ttaactgattgggtttcttctcacc

SEQ ID NO: 917155 - DNA, 25 bp, Mus musculus
ttaactgatttcctgtggtttttat

SEQ ID NO: 917156 - DNA, 25 bp, Mus musculus
ttaactgatttcgtgtggtttttat

SEQ ID NO: 917157 - DNA, 25 bp, Mus musculus
ttaactgatttgacatcctgttcta

SEQ ID NO: 917158 - DNA, 25 bp, Mus musculus
ttaactgatttgtcatcctgttcta

SEQ ID NO: 917159 - DNA, 25 bp, Mus musculus
ttaactgcatccagtctcacagcat

SEQ ID NO: 917160 - DNA, 25 bp, Mus musculus
ttaactgcatcctgtctcacagcat

SEQ ID NO: 917161 - DNA, 25 bp, Mus musculus
ttaactgcatgcaaagccaggcctg

SEQ ID NO: 917162 - DNA, 25 bp, Mus musculus
ttaactgcatgctaagccaggcctg

SEQ ID NO: 917163 - DNA, 25 bp, Mus musculus
ttaactgccgagctatgctcctgag

SEQ ID NO: 917164 - DNA, 25 bp, Mus musculus
ttaactgccgaggtatgctcctgag

SEQ ID NO: 917165 - DNA, 25 bp, Mus musculus
ttaactgcctagaagccagacctca

SEQ ID NO: 917166 - DNA, 25 bp, Mus musculus
ttaactgcctagtagccagacctca

SEQ ID NO: 917167 - DNA, 25 bp, Mus musculus
ttaactgcctccagggttatagggt

SEQ ID NO: 917168 - DNA, 25 bp, Mus musculus
ttaactgcctcctgggttatagggt

SEQ ID NO: 917169 - DNA, 25 bp, Mus musculus
ttaactgcgggcactgtaggaaaga

SEQ ID NO: 917170 - DNA, 25 bp, Mus musculus
ttaactgcgggctctgtaggaaaga

SEQ ID NO: 917171 - DNA, 25 bp, Mus musculus
ttaactgctcaacaggtgacagtgt

SEQ ID NO: 917172 - DNA, 25 bp, Mus musculus
ttaactgctcaagaggtgacagtgt

SEQ ID NO: 917173 - DNA, 25 bp, Mus musculus
ttaactgctccccatattgtagaca

SEQ ID NO: 917174 - DNA, 25 bp, Mus musculus
ttaactgctcccgatattgtagaca

SEQ ID NO: 917175 - DNA, 25 bp, Mus musculus
ttaactgctggaagcacgctggcca

SEQ ID NO: 917176 - DNA, 25 bp, Mus musculus
ttaactgctggatgcacgctggcca

SEQ ID NO: 917177 - DNA, 25 bp, Mus musculus
ttaactgctgttccaagatctctgc

SEQ ID NO: 917178 - DNA, 25 bp, Mus musculus
ttaactgctgttgcaagatctctgc

SEQ ID NO: 917179 - DNA, 25 bp, Mus musculus
ttaactggagacaactcacaaacct

SEQ ID NO: 917180 - DNA, 25 bp, Mus musculus
ttaactggagactactcacaaacct

SEQ ID NO: 917181 - DNA, 25 bp, Mus musculus
ttaactggattacgaaaccaaggag

SEQ ID NO: 917182 - DNA, 25 bp, Mus musculus
ttaactggattaggaaaccaaggag

SEQ ID NO: 917183 - DNA, 25 bp, Mus musculus
ttaactggcagcacaatggcaggca

SEQ ID NO: 917184 - DNA, 25 bp, Mus musculus
ttaactggcagctcaatggcaggca

SEQ ID NO: 917185 - DNA, 25 bp, Mus musculus
ttaactgggaagaacctgccacgta

SEQ ID NO: 917186 - DNA, 25 bp, Mus musculus
ttaactgggaagtacctgccacgta

SEQ ID NO: 917187 - DNA, 25 bp, Mus musculus
ttaactgggataaaatgtcaattta

SEQ ID NO: 917188 - DNA, 25 bp, Mus musculus
ttaactgggatataatgtcaattta

SEQ ID NO: 917189 - DNA, 25 bp, Mus musculus
ttaactggtatgactgccacaatcc

SEQ ID NO: 917190 - DNA, 25 bp, Mus musculus
ttaactggtatgtctgccacaatcc

SEQ ID NO: 917191 - DNA, 25 bp, Mus musculus
ttaactggtctaagtctccaacctg

SEQ ID NO: 917192 - DNA, 25 bp, Mus musculus
ttaactggtctatgtctccaacctg

SEQ ID NO: 917193 - DNA, 25 bp, Mus musculus
ttaactgtcatcacaggccatctgt

SEQ ID NO: 917194 - DNA, 25 bp, Mus musculus
ttaactgtcatctcaggccatctgt

SEQ ID NO: 917195 - DNA, 25 bp, Mus musculus
ttaactgtctccactactacttaac

SEQ ID NO: 917196 - DNA, 25 bp, Mus musculus
ttaactgtctcctctactacttaac

SEQ ID NO: 917197 - DNA, 25 bp, Mus musculus
ttaactgtcttaccttctgcttggg

SEQ ID NO: 917198 - DNA, 25 bp, Mus musculus
ttaactgtcttagcttctgcttggg

SEQ ID NO: 917199 - DNA, 25 bp, Mus musculus
ttaactgtgaacattgcagacaatc

SEQ ID NO: 917200 - DNA, 25 bp, Mus musculus
ttaactgtgaactttgcagacaatc

SEQ ID NO: 917201 - DNA, 25 bp, Mus musculus
ttaactgtgcttactccatacccca

SEQ ID NO: 917202 - DNA, 25 bp, Mus musculus
ttaactgtgctttctccatacccca

SEQ ID NO: 917203 - DNA, 25 bp, Mus musculus
ttaactgtggctcctacctaactca

SEQ ID NO: 917204 - DNA, 25 bp, Mus musculus
ttaactgtggctgctacctaactca

SEQ ID NO: 917205 - DNA, 25 bp, Mus musculus
ttaactgtggtgaaacctgctcatc

SEQ ID NO: 917206 - DNA, 25 bp, Mus musculus
ttaactgtggtgtaacctgctcatc

SEQ ID NO: 917207 - DNA, 25 bp, Mus musculus
ttaactgttagactatccgtgttct

SEQ ID NO: 917208 - DNA, 25 bp, Mus musculus
ttaactgttagagtatccgtgttct

SEQ ID NO: 917209 - DNA, 25 bp, Mus musculus
ttaacttaaccaagatgggctgggc

SEQ ID NO: 917210 - DNA, 25 bp, Mus musculus
ttaacttaaccatgatgggctgggc

SEQ ID NO: 917211 - DNA, 25 bp, Mus musculus
ttaacttaatctatgacaggagcca

SEQ ID NO: 917212 - DNA, 25 bp, Mus musculus
ttaacttaatctttgacaggagcca

SEQ ID NO: 917213 - DNA, 25 bp, Mus musculus
ttaacttacacccaaagtgcccctg

SEQ ID NO: 917214 - DNA, 25 bp, Mus musculus
ttaacttacaccgaaagtgcccctg

SEQ ID NO: 917215 - DNA, 25 bp, Mus musculus
ttaacttacatcacagacatcaggt

SEQ ID NO: 917216 - DNA, 25 bp, Mus musculus
ttaacttacatctcagacatcaggt

SEQ ID NO: 917217 - DNA, 25 bp, Mus musculus
ttaacttactttactgtctgtgatg

SEQ ID NO: 917218 - DNA, 25 bp, Mus musculus
ttaacttacttttctgtctgtgatg

SEQ ID NO: 917219 - DNA, 25 bp, Mus musculus
ttaacttcagaaatcacgaccctcc

SEQ ID NO: 917220 - DNA, 25 bp, Mus musculus
ttaacttcagaattcacgaccctcc

SEQ ID NO: 917221 - DNA, 25 bp, Mus musculus
ttaacttcatatagccttcttttct

SEQ ID NO: 917222 - DNA, 25 bp, Mus musculus
ttaacttcatattgccttcttttct

SEQ ID NO: 917223 - DNA, 25 bp, Mus musculus
ttaacttccctcaatagtcagcaga

SEQ ID NO: 917224 - DNA, 25 bp, Mus musculus
ttaacttccctctatagtcagcaga

SEQ ID NO: 917225 - DNA, 25 bp, Mus musculus
ttaacttcgatcacaagacccaagg

SEQ ID NO: 917226 - DNA, 25 bp, Mus musculus
ttaacttcgatctcaagacccaagg

SEQ ID NO: 917227 - DNA, 25 bp, Mus musculus
ttaacttctagcagacacgctcagt

SEQ ID NO: 917228 - DNA, 25 bp, Mus musculus
ttaacttctagctgacacgctcagt

SEQ ID NO: 917229 - DNA, 25 bp, Mus musculus
ttaacttctcatagttcccggtgat

SEQ ID NO: 917230 - DNA, 25 bp, Mus musculus
ttaacttctcattgttcccggtgat

SEQ ID NO: 917231 - DNA, 25 bp, Mus musculus
ttaacttctgcactccagagttttc

SEQ ID NO: 917232 - DNA, 25 bp, Mus musculus
ttaacttctgcagtccagagttttc

SEQ ID NO: 917233 - DNA, 25 bp, Mus musculus
ttaacttctggaaccaagctggagt

SEQ ID NO: 917234 - DNA, 25 bp, Mus musculus
ttaacttctggatccaagctggagt

SEQ ID NO: 917235 - DNA, 25 bp, Mus musculus
ttaacttctgttcagcttctattgc

SEQ ID NO: 917236 - DNA, 25 bp, Mus musculus
ttaacttctgttgagcttctattgc

SEQ ID NO: 917237 - DNA, 25 bp, Mus musculus
ttaacttcttgtaggctcctggcaa

SEQ ID NO: 917238 - DNA, 25 bp, Mus musculus
ttaacttcttgttggctcctggcaa

SEQ ID NO: 917239 - DNA, 25 bp, Mus musculus
ttaacttctttacgtccatgtgtga

SEQ ID NO: 917240 - DNA, 25 bp, Mus musculus
ttaacttctttaggtccatgtgtga

SEQ ID NO: 917241 - DNA, 25 bp, Mus musculus
ttaacttgcccaacctgtaggctat

SEQ ID NO: 917242 - DNA, 25 bp, Mus musculus
ttaacttgcccatcctgtaggctat

SEQ ID NO: 917243 - DNA, 25 bp, Mus musculus
ttaacttgccttaaccaccctcttg

SEQ ID NO: 917244 - DNA, 25 bp, Mus musculus
ttaacttgcctttaccaccctcttg

SEQ ID NO: 917245 - DNA, 25 bp, Mus musculus
ttaacttgcgacatatgaggaacta

SEQ ID NO: 917246 - DNA, 25 bp, Mus musculus
ttaacttgcgacttatgaggaacta

SEQ ID NO: 917247 - DNA, 25 bp, Mus musculus
ttaacttgtaagaggtacctactga

SEQ ID NO: 917248 - DNA, 25 bp, Mus musculus
ttaacttgtaagtggtacctactga

SEQ ID NO: 917249 - DNA, 25 bp, Mus musculus
ttaacttgtggccagcagtgctgac

SEQ ID NO: 917250 - DNA, 25 bp, Mus musculus
ttaacttgtggcgagcagtgctgac

SEQ ID NO: 917251 - DNA, 25 bp, Mus musculus
ttaacttgtggtatggctgtttcct

SEQ ID NO: 917252 - DNA, 25 bp, Mus musculus
ttaacttgtggtttggctgtttcct

SEQ ID NO: 917253 - DNA, 25 bp, Mus musculus
ttaacttgttggcagcgtcttaggc

SEQ ID NO: 917254 - DNA, 25 bp, Mus musculus
ttaacttgttgggagcgtcttaggc

SEQ ID NO: 917255 - DNA, 25 bp, Mus musculus
ttaactttcacaaccttagaccttt

SEQ ID NO: 917256 - DNA, 25 bp, Mus musculus
ttaactttcacatccttagaccttt

SEQ ID NO: 917257 - DNA, 25 bp, Mus musculus
ttaactttgagaaacgttttctgag

SEQ ID NO: 917258 - DNA, 25 bp, Mus musculus
ttaactttgagatacgttttctgag

SEQ ID NO: 917259 - DNA, 25 bp, Mus musculus
ttaacttttaatctctggctatggg

SEQ ID NO: 917260 - DNA, 25 bp, Mus musculus
ttaacttttaatgtctggctatggg

SEQ ID NO: 917261 - DNA, 25 bp, Mus musculus
ttaacttttcaaccctatcagtagt

SEQ ID NO: 917262 - DNA, 25 bp, Mus musculus
ttaacttttcaagcctatcagtagt

SEQ ID NO: 917263 - DNA, 25 bp, Mus musculus
ttaacttttcctctatcttcattag

SEQ ID NO: 917264 - DNA, 25 bp, Mus musculus
ttaacttttcctgtatcttcattag

SEQ ID NO: 917265 - DNA, 25 bp, Mus musculus
ttaactttttgtcagaccagatttc

SEQ ID NO: 917266 - DNA, 25 bp, Mus musculus
ttaactttttgtgagaccagatttc

SEQ ID NO: 917267 - DNA, 25 bp, Mus musculus
ttaagaaacaacaggccaaacatat

SEQ ID NO: 917268 - DNA, 25 bp, Mus musculus
ttaagaaacaactggccaaacatat

SEQ ID NO: 917269 - DNA, 25 bp, Mus musculus
ttaagaaaccaaagtgcaccaagat

SEQ ID NO: 917270 - DNA, 25 bp, Mus musculus
ttaagaaaccaatgtgcaccaagat

SEQ ID NO: 917271 - DNA, 25 bp, Mus musculus
ttaagaaagctcagacacattccca

SEQ ID NO: 917272 - DNA, 25 bp, Mus musculus
ttaagaaagctctgacacattccca

SEQ ID NO: 917273 - DNA, 25 bp, Mus musculus
ttaagaaagtctcacagtgagccct

SEQ ID NO: 917274 - DNA, 25 bp, Mus musculus
ttaagaaagtctgacagtgagccct

SEQ ID NO: 917275 - DNA, 25 bp, Mus musculus
ttaagaaatttcaggccaggcgtgg

SEQ ID NO: 917276 - DNA, 25 bp, Mus musculus
ttaagaaatttctggccaggcgtgg

SEQ ID NO: 917277 - DNA, 25 bp, Mus musculus
ttaagaacacacatcctaacgggag

SEQ ID NO: 917278 - DNA, 25 bp, Mus musculus
ttaagaacacacttcctaacgggag

SEQ ID NO: 917279 - DNA, 25 bp, Mus musculus
ttaagaacagatagctatagcagga

SEQ ID NO: 917280 - DNA, 25 bp, Mus musculus
ttaagaacagattgctatagcagga

SEQ ID NO: 917281 - DNA, 25 bp, Mus musculus
ttaagaacatctagtcagccgggcg

SEQ ID NO: 917282 - DNA, 25 bp, Mus musculus
ttaagaacatcttgtcagccgggcg

SEQ ID NO: 917283 - DNA, 25 bp, Mus musculus
ttaagaacccacaggtaaagccttg

SEQ ID NO: 917284 - DNA, 25 bp, Mus musculus
ttaagaacccactggtaaagccttg

SEQ ID NO: 917285 - DNA, 25 bp, Mus musculus
ttaagaactcccaagaccatccatg

SEQ ID NO: 917286 - DNA, 25 bp, Mus musculus
ttaagaactccctagaccatccatg

SEQ ID NO: 917287 - DNA, 25 bp, Mus musculus
ttaagaagacagctcccgggctggc

SEQ ID NO: 917288 - DNA, 25 bp, Mus musculus
ttaagaagacaggtcccgggctggc

SEQ ID NO: 917289 - DNA, 25 bp, Mus musculus
ttaagaagactcaagatggcgaact

SEQ ID NO: 917290 - DNA, 25 bp, Mus musculus
ttaagaagactctagatggcgaact

SEQ ID NO: 917291 - DNA, 25 bp, Mus musculus
ttaagaagatcaactgcgatgccac

SEQ ID NO: 917292 - DNA, 25 bp, Mus musculus
ttaagaagatcatctgcgatgccac

SEQ ID NO: 917293 - DNA, 25 bp, Mus musculus
ttaagaagccaaaggggacaccagt

SEQ ID NO: 917294 - DNA, 25 bp, Mus musculus
ttaagaagccaatggggacaccagt

SEQ ID NO: 917295 - DNA, 25 bp, Mus musculus
ttaagaagcggaacctgaggaccct

SEQ ID NO: 917296 - DNA, 25 bp, Mus musculus
ttaagaagcggatcctgaggaccct

SEQ ID NO: 917297 - DNA, 25 bp, Mus musculus
ttaagaagtagcatggtagccgggc

SEQ ID NO: 917298 - DNA, 25 bp, Mus musculus
ttaagaagtagcttggtagccgggc

SEQ ID NO: 917299 - DNA, 25 bp, Mus musculus
ttaagaatactgaccctgcttttgg

SEQ ID NO: 917300 - DNA, 25 bp, Mus musculus
ttaagaatactgtccctgcttttgg

SEQ ID NO: 917301 - DNA, 25 bp, Mus musculus
ttaagaatattaatccacccgcaga

SEQ ID NO: 917302 - DNA, 25 bp, Mus musculus
ttaagaatattattccacccgcaga

SEQ ID NO: 917303 - DNA, 25 bp, Mus musculus
ttaagaatattgactgttcttcctg

SEQ ID NO: 917304 - DNA, 25 bp, Mus musculus
ttaagaatattgtctgttcttcctg

SEQ ID NO: 917305 - DNA, 25 bp, Mus musculus
ttaagaatcacacagaccttggact

SEQ ID NO: 917306 - DNA, 25 bp, Mus musculus
ttaagaatcacagagaccttggact

SEQ ID NO: 917307 - DNA, 25 bp, Mus musculus
ttaagaatcgctccttgtttctcct

SEQ ID NO: 917308 - DNA, 25 bp, Mus musculus
ttaagaatcgctgcttgtttctcct

SEQ ID NO: 917309 - DNA, 25 bp, Mus musculus
ttaagaatgagtcgctccccagtcc

SEQ ID NO: 917310 - DNA, 25 bp, Mus musculus
ttaagaatgagtggctccccagtcc

SEQ ID NO: 917311 - DNA, 25 bp, Mus musculus
ttaagaatggtaccggccccaagtc

SEQ ID NO: 917312 - DNA, 25 bp, Mus musculus
ttaagaatggtagcggccccaagtc

SEQ ID NO: 917313 - DNA, 25 bp, Mus musculus
ttaagaattctacctgttcccagca

SEQ ID NO: 917314 - DNA, 25 bp, Mus musculus
ttaagaattctagctgttcccagca

SEQ ID NO: 917315 - DNA, 25 bp, Mus musculus
ttaagacaaaatcacagagaccctc

SEQ ID NO: 917316 - DNA, 25 bp, Mus musculus
ttaagacaaaatgacagagaccctc

SEQ ID NO: 917317 - DNA, 25 bp, Mus musculus
ttaagacaagtgatcacaggacctg

SEQ ID NO: 917318 - DNA, 25 bp, Mus musculus
ttaagacaagtgttcacaggacctg

SEQ ID NO: 917319 - DNA, 25 bp, Mus musculus
ttaagacaatttctacaggcacttg

SEQ ID NO: 917320 - DNA, 25 bp, Mus musculus
ttaagacaatttgtacaggcacttg

SEQ ID NO: 917321 - DNA, 25 bp, Mus musculus
ttaagacacattaagaggagtcacc

SEQ ID NO: 917322 - DNA, 25 bp, Mus musculus
ttaagacacatttagaggagtcacc

SEQ ID NO: 917323 - DNA, 25 bp, Mus musculus
ttaagacactgactccatgctctcc

SEQ ID NO: 917324 - DNA, 25 bp, Mus musculus
ttaagacactgagtccatgctctcc

SEQ ID NO: 917325 - DNA, 25 bp, Mus musculus
ttaagacagctgaggctgtcctgtc

SEQ ID NO: 917326 - DNA, 25 bp, Mus musculus
ttaagacagctgtggctgtcctgtc

SEQ ID NO: 917327 - DNA, 25 bp, Mus musculus
ttaagacatgaccatgccaccacat

SEQ ID NO: 917328 - DNA, 25 bp, Mus musculus
ttaagacatgacgatgccaccacat

SEQ ID NO: 917329 - DNA, 25 bp, Mus musculus
ttaagacatgctatgtggtatcaca

SEQ ID NO: 917330 - DNA, 25 bp, Mus musculus
ttaagacatgctttgtggtatcaca

SEQ ID NO: 917331 - DNA, 25 bp, Mus musculus
ttaagaccagaccatcttcaggcac

SEQ ID NO: 917332 - DNA, 25 bp, Mus musculus
ttaagaccagacgatcttcaggcac

SEQ ID NO: 917333 - DNA, 25 bp, Mus musculus
ttaagaccatggaccgctcttacag

SEQ ID NO: 917334 - DNA, 25 bp, Mus musculus
ttaagaccatggtccgctcttacag

SEQ ID NO: 917335 - DNA, 25 bp, Mus musculus
ttaagaccatgtacagccaagaccg

SEQ ID NO: 917336 - DNA, 25 bp, Mus musculus
ttaagaccatgttcagccaagaccg

SEQ ID NO: 917337 - DNA, 25 bp, Mus musculus
ttaagaccccagagttagccaagaa

SEQ ID NO: 917338 - DNA, 25 bp, Mus musculus
ttaagaccccagtgttagccaagaa

SEQ ID NO: 917339 - DNA, 25 bp, Mus musculus
ttaagacccgggaagccaactctgt

SEQ ID NO: 917340 - DNA, 25 bp, Mus musculus
ttaagacccgggtagccaactctgt

SEQ ID NO: 917341 - DNA, 25 bp, Mus musculus
ttaagaccctcgctcctgctgctaa

SEQ ID NO: 917342 - DNA, 25 bp, Mus musculus
ttaagaccctcggtcctgctgctaa

SEQ ID NO: 917343 - DNA, 25 bp, Mus musculus
ttaagaccctctatgcaattgacag

SEQ ID NO: 917344 - DNA, 25 bp, Mus musculus
ttaagaccctctttgcaattgacag

SEQ ID NO: 917345 - DNA, 25 bp, Mus musculus
ttaagacctatcaatacagtggagc

SEQ ID NO: 917346 - DNA, 25 bp, Mus musculus
ttaagacctatctatacagtggagc

SEQ ID NO: 917347 - DNA, 25 bp, Mus musculus
ttaagacctgctaagtgagtgaaca

SEQ ID NO: 917348 - DNA, 25 bp, Mus musculus
ttaagacctgcttagtgagtgaaca

SEQ ID NO: 917349 - DNA, 25 bp, Mus musculus
ttaagaccttcaaccgtggaaacca

SEQ ID NO: 917350 - DNA, 25 bp, Mus musculus
ttaagaccttcatccgtggaaacca

SEQ ID NO: 917351 - DNA, 25 bp, Mus musculus
ttaagacgtacaagaggccctcgcc

SEQ ID NO: 917352 - DNA, 25 bp, Mus musculus
ttaagacgtacatgaggccctcgcc

SEQ ID NO: 917353 - DNA, 25 bp, Mus musculus
ttaagacgtactcctgctgtgctaa

SEQ ID NO: 917354 - DNA, 25 bp, Mus musculus
ttaagacgtactgctgctgtgctaa

SEQ ID NO: 917355 - DNA, 25 bp, Mus musculus
ttaagacgttatcctcccaaggaga

SEQ ID NO: 917356 - DNA, 25 bp, Mus musculus
ttaagacgttatgctcccaaggaga

SEQ ID NO: 917357 - DNA, 25 bp, Mus musculus
ttaagacgttctagtgggctcacca

SEQ ID NO: 917358 - DNA, 25 bp, Mus musculus
ttaagacgttcttgtgggctcacca

SEQ ID NO: 917359 - DNA, 25 bp, Mus musculus
ttaagactctgcctgccatcatggc

SEQ ID NO: 917360 - DNA, 25 bp, Mus musculus
ttaagactctgcgtgccatcatggc

SEQ ID NO: 917361 - DNA, 25 bp, Mus musculus
ttaagactgatgctgtaacactgat

SEQ ID NO: 917362 - DNA, 25 bp, Mus musculus
ttaagactgatggtgtaacactgat

SEQ ID NO: 917363 - DNA, 25 bp, Mus musculus
ttaagactggacactgtcggagcct

SEQ ID NO: 917364 - DNA, 25 bp, Mus musculus
ttaagactggactctgtcggagcct

SEQ ID NO: 917365 - DNA, 25 bp, Mus musculus
ttaagactgttaccacctcgcttta

SEQ ID NO: 917366 - DNA, 25 bp, Mus musculus
ttaagactgttagcacctcgcttta

SEQ ID NO: 917367 - DNA, 25 bp, Mus musculus
ttaagacttggcaacatgggctgga

SEQ ID NO: 917368 - DNA, 25 bp, Mus musculus
ttaagacttggctacatgggctgga

SEQ ID NO: 917369 - DNA, 25 bp, Mus musculus
ttaagagaacatactgcgcttgcag

SEQ ID NO: 917370 - DNA, 25 bp, Mus musculus
ttaagagaacattctgcgcttgcag

SEQ ID NO: 917371 - DNA, 25 bp, Mus musculus
ttaagagacgaccacgccttccgag

SEQ ID NO: 917372 - DNA, 25 bp, Mus musculus
ttaagagacgacgacgccttccgag

SEQ ID NO: 917373 - DNA, 25 bp, Mus musculus
ttaagagacttgactacctgggccc

SEQ ID NO: 917374 - DNA, 25 bp, Mus musculus
ttaagagacttgtctacctgggccc

SEQ ID NO: 917375 - DNA, 25 bp, Mus musculus
ttaagagagcttactagtggagaaa

SEQ ID NO: 917376 - DNA, 25 bp, Mus musculus
ttaagagagctttctagtggagaaa

SEQ ID NO: 917377 - DNA, 25 bp, Mus musculus
ttaagagagtacctatgggcaggac

SEQ ID NO: 917378 - DNA, 25 bp, Mus musculus
ttaagagagtacgtatgggcaggac

SEQ ID NO: 917379 - DNA, 25 bp, Mus musculus
ttaagagagtggacttcccggccta

SEQ ID NO: 917380 - DNA, 25 bp, Mus musculus
ttaagagagtggtcttcccggccta

SEQ ID NO: 917381 - DNA, 25 bp, Mus musculus
ttaagagcaagtcccagcctcaggg

SEQ ID NO: 917382 - DNA, 25 bp, Mus musculus
ttaagagcaagtgccagcctcaggg

SEQ ID NO: 917383 - DNA, 25 bp, Mus musculus
ttaagagcactaccttaattcccag

SEQ ID NO: 917384 - DNA, 25 bp, Mus musculus
ttaagagcactagcttaattcccag

SEQ ID NO: 917385 - DNA, 25 bp, Mus musculus
ttaagagccaccaaacatgcaaaat

SEQ ID NO: 917386 - DNA, 25 bp, Mus musculus
ttaagagccacctaacatgcaaaat

SEQ ID NO: 917387 - DNA, 25 bp, Mus musculus
ttaagagccataccagcaggcggat

SEQ ID NO: 917388 - DNA, 25 bp, Mus musculus
ttaagagccatagcagcaggcggat

SEQ ID NO: 917389 - DNA, 25 bp, Mus musculus
ttaagagcccaaagatagaaatgtg

SEQ ID NO: 917390 - DNA, 25 bp, Mus musculus
ttaagagcccaatgatagaaatgtg

SEQ ID NO: 917391 - DNA, 25 bp, Mus musculus
ttaagagctaccagatcgagatcca

SEQ ID NO: 917392 - DNA, 25 bp, Mus musculus
ttaagagctacctgatcgagatcca

SEQ ID NO: 917393 - DNA, 25 bp, Mus musculus
ttaagagctagtatgggagttccgt

SEQ ID NO: 917394 - DNA, 25 bp, Mus musculus
ttaagagctagtttgggagttccgt

SEQ ID NO: 917395 - DNA, 25 bp, Mus musculus
ttaagagctatgaattccagaccct

SEQ ID NO: 917396 - DNA, 25 bp, Mus musculus
ttaagagctatgtattccagaccct

SEQ ID NO: 917397 - DNA, 25 bp, Mus musculus
ttaagagctgagctgtcaccccagc

SEQ ID NO: 917398 - DNA, 25 bp, Mus musculus
ttaagagctgaggtgtcaccccagc

SEQ ID NO: 917399 - DNA, 25 bp, Mus musculus
ttaagagcttcaaacgtgtccggat

SEQ ID NO: 917400 - DNA, 25 bp, Mus musculus
ttaagagcttcatacgtgtccggat

SEQ ID NO: 917401 - DNA, 25 bp, Mus musculus
ttaagaggacgcctgtccaggaccc

SEQ ID NO: 917402 - DNA, 25 bp, Mus musculus
ttaagaggacgcgtgtccaggaccc

SEQ ID NO: 917403 - DNA, 25 bp, Mus musculus
ttaagaggatataatgtggctgtca

SEQ ID NO: 917404 - DNA, 25 bp, Mus musculus
ttaagaggatattatgtggctgtca

SEQ ID NO: 917405 - DNA, 25 bp, Mus musculus
ttaagagggcaactctagcctttct

SEQ ID NO: 917406 - DNA, 25 bp, Mus musculus
ttaagagggcaagtctagcctttct

SEQ ID NO: 917407 - DNA, 25 bp, Mus musculus
ttaagaggtctaagtccatccggcc

SEQ ID NO: 917408 - DNA, 25 bp, Mus musculus
ttaagaggtctatgtccatccggcc

SEQ ID NO: 917409 - DNA, 25 bp, Mus musculus
ttaagaggttaaagcccaggacaac

SEQ ID NO: 917410 - DNA, 25 bp, Mus musculus
ttaagaggttaatgcccaggacaac

SEQ ID NO: 917411 - DNA, 25 bp, Mus musculus
ttaagagtacacatcctctctctct

SEQ ID NO: 917412 - DNA, 25 bp, Mus musculus
ttaagagtacacttcctctctctct

SEQ ID NO: 917413 - DNA, 25 bp, Mus musculus
ttaagagtacctctagctcttccag

SEQ ID NO: 917414 - DNA, 25 bp, Mus musculus
ttaagagtacctgtagctcttccag

SEQ ID NO: 917415 - DNA, 25 bp, Mus musculus
ttaagagtagcccagatgacaaata

SEQ ID NO: 917416 - DNA, 25 bp, Mus musculus
ttaagagtagccgagatgacaaata

SEQ ID NO: 917417 - DNA, 25 bp, Mus musculus
ttaagagtcatgagtttaattccag

SEQ ID NO: 917418 - DNA, 25 bp, Mus musculus
ttaagagtcatgtgtttaattccag

SEQ ID NO: 917419 - DNA, 25 bp, Mus musculus
ttaagagtcttgctttaagtagtag

SEQ ID NO: 917420 - DNA, 25 bp, Mus musculus
ttaagagtcttggtttaagtagtag

SEQ ID NO: 917421 - DNA, 25 bp, Mus musculus
ttaagagtgctcacctagcatggat

SEQ ID NO: 917422 - DNA, 25 bp, Mus musculus
ttaagagtgctctcctagcatggat

SEQ ID NO: 917423 - DNA, 25 bp, Mus musculus
ttaagagtgtgtcttgttgccaggt

SEQ ID NO: 917424 - DNA, 25 bp, Mus musculus
ttaagagtgtgtgttgttgccaggt

SEQ ID NO: 917425 - DNA, 25 bp, Mus musculus
ttaagagtgttcatgagccaggcgt

SEQ ID NO: 917426 - DNA, 25 bp, Mus musculus
ttaagagtgttcttgagccaggcgt

SEQ ID NO: 917427 - DNA, 25 bp, Mus musculus
ttaagagttaccaatgggcgggcta

SEQ ID NO: 917428 - DNA, 25 bp, Mus musculus
ttaagagttacctatgggcgggcta

SEQ ID NO: 917429 - DNA, 25 bp, Mus musculus
ttaagagttattagtgctgggcagt

SEQ ID NO: 917430 - DNA, 25 bp, Mus musculus
ttaagagttatttgtgctgggcagt

SEQ ID NO: 917431 - DNA, 25 bp, Mus musculus
ttaagagtttagacccctctctgct

SEQ ID NO: 917432 - DNA, 25 bp, Mus musculus
ttaagagtttagtcccctctctgct

SEQ ID NO: 917433 - DNA, 25 bp, Mus musculus
ttaagatacttgaacccagctgcca

SEQ ID NO: 917434 - DNA, 25 bp, Mus musculus
ttaagatacttgtacccagctgcca

SEQ ID NO: 917435 - DNA, 25 bp, Mus musculus
ttaagatatgacctggtggcctact

SEQ ID NO: 917436 - DNA, 25 bp, Mus musculus
ttaagatatgacgtggtggcctact

SEQ ID NO: 917437 - DNA, 25 bp, Mus musculus
ttaagatccctaaagtgcccagtgg

SEQ ID NO: 917438 - DNA, 25 bp, Mus musculus
ttaagatccctatagtgcccagtgg

SEQ ID NO: 917439 - DNA, 25 bp, Mus musculus
ttaagatccttaattctccctctct

SEQ ID NO: 917440 - DNA, 25 bp, Mus musculus
ttaagatccttatttctccctctct

SEQ ID NO: 917441 - DNA, 25 bp, Mus musculus
ttaagatcgccactcagccaacgaa

SEQ ID NO: 917442 - DNA, 25 bp, Mus musculus
ttaagatcgccagtcagccaacgaa

SEQ ID NO: 917443 - DNA, 25 bp, Mus musculus
ttaagatctaggcatcccttcccac

SEQ ID NO: 917444 - DNA, 25 bp, Mus musculus
ttaagatctagggatcccttcccac

SEQ ID NO: 917445 - DNA, 25 bp, Mus musculus
ttaagatcttccattgctgactggc

SEQ ID NO: 917446 - DNA, 25 bp, Mus musculus
ttaagatcttcctttgctgactggc

SEQ ID NO: 917447 - DNA, 25 bp, Mus musculus
ttaagatgaatgaggtaggacatat

SEQ ID NO: 917448 - DNA, 25 bp, Mus musculus
ttaagatgaatgtggtaggacatat

SEQ ID NO: 917449 - DNA, 25 bp, Mus musculus
ttaagatgcagcctagccattgcct

SEQ ID NO: 917450 - DNA, 25 bp, Mus musculus
ttaagatgcagcgtagccattgcct

SEQ ID NO: 917451 - DNA, 25 bp, Mus musculus
ttaagatgcttgctaatggccgggc

SEQ ID NO: 917452 - DNA, 25 bp, Mus musculus
ttaagatgcttggtaatggccgggc

SEQ ID NO: 917453 - DNA, 25 bp, Mus musculus
ttaagatggcctagacccatggtgc

SEQ ID NO: 917454 - DNA, 25 bp, Mus musculus
ttaagatggccttgacccatggtgc

SEQ ID NO: 917455 - DNA, 25 bp, Mus musculus
ttaagatggtttagagcctccgtgt

SEQ ID NO: 917456 - DNA, 25 bp, Mus musculus
ttaagatggttttgagcctccgtgt

SEQ ID NO: 917457 - DNA, 25 bp, Mus musculus
ttaagatgtgccatttgttttgcag

SEQ ID NO: 917458 - DNA, 25 bp, Mus musculus
ttaagatgtgccttttgttttgcag

SEQ ID NO: 917459 - DNA, 25 bp, Mus musculus
ttaagattaaccatcatggcttctg

SEQ ID NO: 917460 - DNA, 25 bp, Mus musculus
ttaagattaaccttcatggcttctg

SEQ ID NO: 917461 - DNA, 25 bp, Mus musculus
ttaagattactacatccgccgggcg

SEQ ID NO: 917462 - DNA, 25 bp, Mus musculus
ttaagattactagatccgccgggcg

SEQ ID NO: 917463 - DNA, 25 bp, Mus musculus
ttaagattatcgagtaccccagtag

SEQ ID NO: 917464 - DNA, 25 bp, Mus musculus
ttaagattatcgtgtaccccagtag

SEQ ID NO: 917465 - DNA, 25 bp, Mus musculus
ttaagattcaaacccagactcccaa

SEQ ID NO: 917466 - DNA, 25 bp, Mus musculus
ttaagattcaaagccagactcccaa

SEQ ID NO: 917467 - DNA, 25 bp, Mus musculus
ttaagattcagtaggccatcagcca

SEQ ID NO: 917468 - DNA, 25 bp, Mus musculus
ttaagattcagttggccatcagcca

SEQ ID NO: 917469 - DNA, 25 bp, Mus musculus
ttaagattctgacttcctagcctcc

SEQ ID NO: 917470 - DNA, 25 bp, Mus musculus
ttaagattctgagttcctagcctcc

SEQ ID NO: 917471 - DNA, 25 bp, Mus musculus
ttaagattgggaccccagtttccag

SEQ ID NO: 917472 - DNA, 25 bp, Mus musculus
ttaagattgggagcccagtttccag

SEQ ID NO: 917473 - DNA, 25 bp, Mus musculus
ttaagatttctcacccactgaagtg

SEQ ID NO: 917474 - DNA, 25 bp, Mus musculus
ttaagatttctctcccactgaagtg

SEQ ID NO: 917475 - DNA, 25 bp, Mus musculus
ttaagcaaaaatccctcccaggtgt

SEQ ID NO: 917476 - DNA, 25 bp, Mus musculus
ttaagcaaaaatgcctcccaggtgt

SEQ ID NO: 917477 - DNA, 25 bp, Mus musculus
ttaagcaaagatacctagaaggttt

SEQ ID NO: 917478 - DNA, 25 bp, Mus musculus
ttaagcaaagattcctagaaggttt

SEQ ID NO: 917479 - DNA, 25 bp, Mus musculus
ttaagcaaatgaagtcctggacgat

SEQ ID NO: 917480 - DNA, 25 bp, Mus musculus
ttaagcaaatgatgtcctggacgat

SEQ ID NO: 917481 - DNA, 25 bp, Mus musculus
ttaagcaactcccagatgccatttg

SEQ ID NO: 917482 - DNA, 25 bp, Mus musculus
ttaagcaactccgagatgccatttg

SEQ ID NO: 917483 - DNA, 25 bp, Mus musculus
ttaagcaactgacggcaagcatttt

SEQ ID NO: 917484 - DNA, 25 bp, Mus musculus
ttaagcaactgagggcaagcatttt

SEQ ID NO: 917485 - DNA, 25 bp, Mus musculus
ttaagcaactgtctgtgccagccag

SEQ ID NO: 917486 - DNA, 25 bp, Mus musculus
ttaagcaactgtgtgtgccagccag

SEQ ID NO: 917487 - DNA, 25 bp, Mus musculus
ttaagcaagcacaggctcgtgtact

SEQ ID NO: 917488 - DNA, 25 bp, Mus musculus
ttaagcaagcactggctcgtgtact

SEQ ID NO: 917489 - DNA, 25 bp, Mus musculus
ttaagcaagcctacctctcattctg

SEQ ID NO: 917490 - DNA, 25 bp, Mus musculus
ttaagcaagccttcctctcattctg

SEQ ID NO: 917491 - DNA, 25 bp, Mus musculus
ttaagcaatcccctatcttgtcaag

SEQ ID NO: 917492 - DNA, 25 bp, Mus musculus
ttaagcaatcccgtatcttgtcaag

SEQ ID NO: 917493 - DNA, 25 bp, Mus musculus
ttaagcacaatgatgacccttctgt

SEQ ID NO: 917494 - DNA, 25 bp, Mus musculus
ttaagcacaatgttgacccttctgt

SEQ ID NO: 917495 - DNA, 25 bp, Mus musculus
ttaagcacaccactcactgcaagat

SEQ ID NO: 917496 - DNA, 25 bp, Mus musculus
ttaagcacaccagtcactgcaagat

SEQ ID NO: 917497 - DNA, 25 bp, Mus musculus
ttaagcacatgccactgaacacctg

SEQ ID NO: 917498 - DNA, 25 bp, Mus musculus
ttaagcacatgcgactgaacacctg

SEQ ID NO: 917499 - DNA, 25 bp, Mus musculus
ttaagcacctacaccgtgcgggtac

SEQ ID NO: 917500 - DNA, 25 bp, Mus musculus
ttaagcacctactccgtgcgggtac

SEQ ID NO: 917501 - DNA, 25 bp, Mus musculus
ttaagcacctctatcgctttaaggg

SEQ ID NO: 917502 - DNA, 25 bp, Mus musculus
ttaagcacctctttcgctttaaggg

SEQ ID NO: 917503 - DNA, 25 bp, Mus musculus
ttaagcacgggcctctttccaggtc

SEQ ID NO: 917504 - DNA, 25 bp, Mus musculus
ttaagcacgggcgtctttccaggtc

SEQ ID NO: 917505 - DNA, 25 bp, Mus musculus
ttaagcactccacggccttgaggga

SEQ ID NO: 917506 - DNA, 25 bp, Mus musculus
ttaagcactccagggccttgaggga

SEQ ID NO: 917507 - DNA, 25 bp, Mus musculus
ttaagcactctgacattggctcatc

SEQ ID NO: 917508 - DNA, 25 bp, Mus musculus
ttaagcactctgtcattggctcatc

SEQ ID NO: 917509 - DNA, 25 bp, Mus musculus
ttaagcagccacatctacatatttc

SEQ ID NO: 917510 - DNA, 25 bp, Mus musculus
ttaagcagccacttctacatatttc

SEQ ID NO: 917511 - DNA, 25 bp, Mus musculus
ttaagcagctggatgacagacgcaa

SEQ ID NO: 917512 - DNA, 25 bp, Mus musculus
ttaagcagctggttgacagacgcaa

SEQ ID NO: 917513 - DNA, 25 bp, Mus musculus
ttaagcagggacagttctcccacct

SEQ ID NO: 917514 - DNA, 25 bp, Mus musculus
ttaagcagggactgttctcccacct

SEQ ID NO: 917515 - DNA, 25 bp, Mus musculus
ttaagcagggctaatgggccatcca

SEQ ID NO: 917516 - DNA, 25 bp, Mus musculus
ttaagcagggcttatgggccatcca

SEQ ID NO: 917517 - DNA, 25 bp, Mus musculus
ttaagcatacatacgcacattccca

SEQ ID NO: 917518 - DNA, 25 bp, Mus musculus
ttaagcatacattcgcacattccca

SEQ ID NO: 917519 - DNA, 25 bp, Mus musculus
ttaagcatcacaatcctactccact

SEQ ID NO: 917520 - DNA, 25 bp, Mus musculus
ttaagcatcacattcctactccact

SEQ ID NO: 917521 - DNA, 25 bp, Mus musculus
ttaagcatccaactccacaccagct

SEQ ID NO: 917522 - DNA, 25 bp, Mus musculus
ttaagcatccaagtccacaccagct

SEQ ID NO: 917523 - DNA, 25 bp, Mus musculus
ttaagcatccgcaggtaactctagt

SEQ ID NO: 917524 - DNA, 25 bp, Mus musculus
ttaagcatccgctggtaactctagt

SEQ ID NO: 917525 - DNA, 25 bp, Mus musculus
ttaagcatcctactgctcctaagag

SEQ ID NO: 917526 - DNA, 25 bp, Mus musculus
ttaagcatcctagtgctcctaagag

SEQ ID NO: 917527 - DNA, 25 bp, Mus musculus
ttaagcatcttcaggtccccttggg

SEQ ID NO: 917528 - DNA, 25 bp, Mus musculus
ttaagcatcttctggtccccttggg

SEQ ID NO: 917529 - DNA, 25 bp, Mus musculus
ttaagcattcagagagctgccaatt

SEQ ID NO: 917530 - DNA, 25 bp, Mus musculus
ttaagcattcagtgagctgccaatt

SEQ ID NO: 917531 - DNA, 25 bp, Mus musculus
ttaagcattccacccagcctttggg

SEQ ID NO: 917532 - DNA, 25 bp, Mus musculus
ttaagcattccagccagcctttggg

SEQ ID NO: 917533 - DNA, 25 bp, Mus musculus
ttaagcattttgatcatcttgaagt

SEQ ID NO: 917534 - DNA, 25 bp, Mus musculus
ttaagcattttgttcatcttgaagt

SEQ ID NO: 917535 - DNA, 25 bp, Mus musculus
ttaagccaattcacacacagggaag

SEQ ID NO: 917536 - DNA, 25 bp, Mus musculus
ttaagccaattctcacacagggaag

SEQ ID NO: 917537 - DNA, 25 bp, Mus musculus
ttaagccacagtcttggaactccca

SEQ ID NO: 917538 - DNA, 25 bp, Mus musculus
ttaagccacagtgttggaactccca

SEQ ID NO: 917539 - DNA, 25 bp, Mus musculus
ttaagccactagagagcctaccggt

SEQ ID NO: 917540 - DNA, 25 bp, Mus musculus
ttaagccactagtgagcctaccggt

SEQ ID NO: 917541 - DNA, 25 bp, Mus musculus
ttaagccagcttctcctataaatag

SEQ ID NO: 917542 - DNA, 25 bp, Mus musculus
ttaagccagcttgtcctataaatag

SEQ ID NO: 917543 - DNA, 25 bp, Mus musculus
ttaagccattaaatgtttggatatt

SEQ ID NO: 917544 - DNA, 25 bp, Mus musculus
ttaagccattaattgtttggatatt

SEQ ID NO: 917545 - DNA, 25 bp, Mus musculus
ttaagcccaggcagggacttgctca

SEQ ID NO: 917546 - DNA, 25 bp, Mus musculus
ttaagcccaggctgggacttgctca

SEQ ID NO: 917547 - DNA, 25 bp, Mus musculus
ttaagcccagggaaagactttgagt

SEQ ID NO: 917548 - DNA, 25 bp, Mus musculus
ttaagcccagggtaagactttgagt

SEQ ID NO: 917549 - DNA, 25 bp, Mus musculus
ttaagcccatggagttcatggaatt

SEQ ID NO: 917550 - DNA, 25 bp, Mus musculus
ttaagcccatggtgttcatggaatt

SEQ ID NO: 917551 - DNA, 25 bp, Mus musculus
ttaagccctaggagcctggaggcca

SEQ ID NO: 917552 - DNA, 25 bp, Mus musculus
ttaagccctaggtgcctggaggcca

SEQ ID NO: 917553 - DNA, 25 bp, Mus musculus
ttaagccctcataaggtgatgggtc

SEQ ID NO: 917554 - DNA, 25 bp, Mus musculus
ttaagccctcattaggtgatgggtc

SEQ ID NO: 917555 - DNA, 25 bp, Mus musculus
ttaagcccttagactcttccaaagt

SEQ ID NO: 917556 - DNA, 25 bp, Mus musculus
ttaagcccttagtctcttccaaagt

SEQ ID NO: 917557 - DNA, 25 bp, Mus musculus
ttaagcctcagcattatccttcagt

SEQ ID NO: 917558 - DNA, 25 bp, Mus musculus
ttaagcctcagctttatccttcagt

SEQ ID NO: 917559 - DNA, 25 bp, Mus musculus
ttaagcctccataagtgctccatat

SEQ ID NO: 917560 - DNA, 25 bp, Mus musculus
ttaagcctccattagtgctccatat

SEQ ID NO: 917561 - DNA, 25 bp, Mus musculus
ttaagcctgaatcactgtgctgttt

SEQ ID NO: 917562 - DNA, 25 bp, Mus musculus
ttaagcctgaatgactgtgctgttt

SEQ ID NO: 917563 - DNA, 25 bp, Mus musculus
ttaagcctgatcacgatgacaacct

SEQ ID NO: 917564 - DNA, 25 bp, Mus musculus
ttaagcctgatctcgatgacaacct

SEQ ID NO: 917565 - DNA, 25 bp, Mus musculus
ttaagcctgccaacaatggattttc

SEQ ID NO: 917566 - DNA, 25 bp, Mus musculus
ttaagcctgccatcaatggattttc

SEQ ID NO: 917567 - DNA, 25 bp, Mus musculus
ttaagcctgcctaccttccaaaggc

SEQ ID NO: 917568 - DNA, 25 bp, Mus musculus
ttaagcctgccttccttccaaaggc

SEQ ID NO: 917569 - DNA, 25 bp, Mus musculus
ttaagcctgtgtccccagagttctg

SEQ ID NO: 917570 - DNA, 25 bp, Mus musculus
ttaagcctgtgtgcccagagttctg

SEQ ID NO: 917571 - DNA, 25 bp, Mus musculus
ttaagccttcctacgtgaagcggtg

SEQ ID NO: 917572 - DNA, 25 bp, Mus musculus
ttaagccttccttcgtgaagcggtg

SEQ ID NO: 917573 - DNA, 25 bp, Mus musculus
ttaagccttctgatatggtcagctc

SEQ ID NO: 917574 - DNA, 25 bp, Mus musculus
ttaagccttctgttatggtcagctc

SEQ ID NO: 917575 - DNA, 25 bp, Mus musculus
ttaagccttcttcaaatgctccagg

SEQ ID NO: 917576 - DNA, 25 bp, Mus musculus
ttaagccttcttgaaatgctccagg

SEQ ID NO: 917577 - DNA, 25 bp, Mus musculus
ttaagcctttatatcctctccagta

SEQ ID NO: 917578 - DNA, 25 bp, Mus musculus
ttaagcctttatttcctctccagta

SEQ ID NO: 917579 - DNA, 25 bp, Mus musculus
ttaagcgcagccctgagttggagct

SEQ ID NO: 917580 - DNA, 25 bp, Mus musculus
ttaagcgcagccgtgagttggagct

SEQ ID NO: 917581 - DNA, 25 bp, Mus musculus
ttaagcggcataatgtaactccagc

SEQ ID NO: 917582 - DNA, 25 bp, Mus musculus
ttaagcggcatattgtaactccagc

SEQ ID NO: 917583 - DNA, 25 bp, Mus musculus
ttaagcgggcatcctccagaggttg

SEQ ID NO: 917584 - DNA, 25 bp, Mus musculus
ttaagcgggcatgctccagaggttg

SEQ ID NO: 917585 - DNA, 25 bp, Mus musculus
ttaagcggttacaagtcgcccagct

SEQ ID NO: 917586 - DNA, 25 bp, Mus musculus
ttaagcggttactagtcgcccagct

SEQ ID NO: 917587 - DNA, 25 bp, Mus musculus
ttaagcgtctcaagctacatcggat

SEQ ID NO: 917588 - DNA, 25 bp, Mus musculus
ttaagcgtctcatgctacatcggat

SEQ ID NO: 917589 - DNA, 25 bp, Mus musculus
ttaagcgttttcaacgtagccaaga

SEQ ID NO: 917590 - DNA, 25 bp, Mus musculus
ttaagcgttttctacgtagccaaga

SEQ ID NO: 917591 - DNA, 25 bp, Mus musculus
ttaagctaagcgatctgggcctgtc

SEQ ID NO: 917592 - DNA, 25 bp, Mus musculus
ttaagctaagcgttctgggcctgtc

SEQ ID NO: 917593 - DNA, 25 bp, Mus musculus
ttaagctacgggatcttgggttgtg

SEQ ID NO: 917594 - DNA, 25 bp, Mus musculus
ttaagctacgggttcttgggttgtg

SEQ ID NO: 917595 - DNA, 25 bp, Mus musculus
ttaagctactgaagacccataaggt

SEQ ID NO: 917596 - DNA, 25 bp, Mus musculus
ttaagctactgatgacccataaggt

SEQ ID NO: 917597 - DNA, 25 bp, Mus musculus
ttaagctactgtattattcccaaag

SEQ ID NO: 917598 - DNA, 25 bp, Mus musculus
ttaagctactgttttattcccaaag

SEQ ID NO: 917599 - DNA, 25 bp, Mus musculus
ttaagctacttaacaccattcctct

SEQ ID NO: 917600 - DNA, 25 bp, Mus musculus
ttaagctacttatcaccattcctct

SEQ ID NO: 917601 - DNA, 25 bp, Mus musculus
ttaagctatctgagagtgttgacca

SEQ ID NO: 917602 - DNA, 25 bp, Mus musculus
ttaagctatctgtgagtgttgacca

SEQ ID NO: 917603 - DNA, 25 bp, Mus musculus
ttaagctatggaccatcgtgcatga

SEQ ID NO: 917604 - DNA, 25 bp, Mus musculus
ttaagctatggagcatcgtgcatga

SEQ ID NO: 917605 - DNA, 25 bp, Mus musculus
ttaagctcactcatgtggttctgga

SEQ ID NO: 917606 - DNA, 25 bp, Mus musculus
ttaagctcactcttgtggttctgga

SEQ ID NO: 917607 - DNA, 25 bp, Mus musculus
ttaagctcagcccagtctcgttgta

SEQ ID NO: 917608 - DNA, 25 bp, Mus musculus
ttaagctcagccgagtctcgttgta

SEQ ID NO: 917609 - DNA, 25 bp, Mus musculus
ttaagctcatcgactttggcatcgc

SEQ ID NO: 917610 - DNA, 25 bp, Mus musculus
ttaagctcatcgtctttggcatcgc

SEQ ID NO: 917611 - DNA, 25 bp, Mus musculus
ttaagctcatgtcctgtcacagtgg

SEQ ID NO: 917612 - DNA, 25 bp, Mus musculus
ttaagctcatgtgctgtcacagtgg

SEQ ID NO: 917613 - DNA, 25 bp, Mus musculus
ttaagctcattcagcatcgcagacc

SEQ ID NO: 917614 - DNA, 25 bp, Mus musculus
ttaagctcattctgcatcgcagacc

SEQ ID NO: 917615 - DNA, 25 bp, Mus musculus
ttaagctccaaaacagtttgctgaa

SEQ ID NO: 917616 - DNA, 25 bp, Mus musculus
ttaagctccaaatcagtttgctgaa

SEQ ID NO: 917617 - DNA, 25 bp, Mus musculus
ttaagctccacaaaagcctttgaga

SEQ ID NO: 917618 - DNA, 25 bp, Mus musculus
ttaagctccacataagcctttgaga

SEQ ID NO: 917619 - DNA, 25 bp, Mus musculus
ttaagctcgatgaggtggcccacat

SEQ ID NO: 917620 - DNA, 25 bp, Mus musculus
ttaagctcgatgtggtggcccacat

SEQ ID NO: 917621 - DNA, 25 bp, Mus musculus
ttaagctcgcctatgtgaatgaggt

SEQ ID NO: 917622 - DNA, 25 bp, Mus musculus
ttaagctcgcctttgtgaatgaggt

SEQ ID NO: 917623 - DNA, 25 bp, Mus musculus
ttaagctgaagacagctgccaccct

SEQ ID NO: 917624 - DNA, 25 bp, Mus musculus
ttaagctgaagagagctgccaccct

SEQ ID NO: 917625 - DNA, 25 bp, Mus musculus
ttaagctgactgagcgcaaccctgc

SEQ ID NO: 917626 - DNA, 25 bp, Mus musculus
ttaagctgactgatgtgccacaaaa

SEQ ID NO: 917627 - DNA, 25 bp, Mus musculus
ttaagctgactgtgcgcaaccctgc

SEQ ID NO: 917628 - DNA, 25 bp, Mus musculus
ttaagctgactgttgtgccacaaaa

SEQ ID NO: 917629 - DNA, 25 bp, Mus musculus
ttaagctgagtgacctggttgccta

SEQ ID NO: 917630 - DNA, 25 bp, Mus musculus
ttaagctgagtgtcctggttgccta

SEQ ID NO: 917631 - DNA, 25 bp, Mus musculus
ttaagctgatcaatctcctactggc

SEQ ID NO: 917632 - DNA, 25 bp, Mus musculus
ttaagctgatcattctcctactggc

SEQ ID NO: 917633 - DNA, 25 bp, Mus musculus
ttaagctgcatacaagagtctcttc

SEQ ID NO: 917634 - DNA, 25 bp, Mus musculus
ttaagctgcatagaagagtctcttc

SEQ ID NO: 917635 - DNA, 25 bp, Mus musculus
ttaagctgccttatctgttatcatc

SEQ ID NO: 917636 - DNA, 25 bp, Mus musculus
ttaagctgccttttctgttatcatc

SEQ ID NO: 917637 - DNA, 25 bp, Mus musculus
ttaagctggaccactttttctaaag

SEQ ID NO: 917638 - DNA, 25 bp, Mus musculus
ttaagctggacctctttttctaaag

SEQ ID NO: 917639 - DNA, 25 bp, Mus musculus
ttaagctgtgtcaccacaagcggga

SEQ ID NO: 917640 - DNA, 25 bp, Mus musculus
ttaagctgtgtctccacaagcggga

SEQ ID NO: 917641 - DNA, 25 bp, Mus musculus
ttaagcttacacatggcacagtgct

SEQ ID NO: 917642 - DNA, 25 bp, Mus musculus
ttaagcttacacttggcacagtgct

SEQ ID NO: 917643 - DNA, 25 bp, Mus musculus
ttaagcttagtcagttgcaagggaa

SEQ ID NO: 917644 - DNA, 25 bp, Mus musculus
ttaagcttagtctgttgcaagggaa

SEQ ID NO: 917645 - DNA, 25 bp, Mus musculus
ttaagcttccagcatcactaccatg

SEQ ID NO: 917646 - DNA, 25 bp, Mus musculus
ttaagcttccaggatcactaccatg

SEQ ID NO: 917647 - DNA, 25 bp, Mus musculus
ttaagcttgaacatcctttgacgga

SEQ ID NO: 917648 - DNA, 25 bp, Mus musculus
ttaagcttgaacttcctttgacgga

SEQ ID NO: 917649 - DNA, 25 bp, Mus musculus
ttaagcttgggtaggcacttcctca

SEQ ID NO: 917650 - DNA, 25 bp, Mus musculus
ttaagcttgggttggcacttcctca

SEQ ID NO: 917651 - DNA, 25 bp, Mus musculus
ttaagcttgtgcaggctccccagag

SEQ ID NO: 917652 - DNA, 25 bp, Mus musculus
ttaagcttgtgctggctccccagag

SEQ ID NO: 917653 - DNA, 25 bp, Mus musculus
ttaagctttcatctgcttccaagtc

SEQ ID NO: 917654 - DNA, 25 bp, Mus musculus
ttaagctttcatgtgcttccaagtc

SEQ ID NO: 917655 - DNA, 25 bp, Mus musculus
ttaagctttcctcttgagtgacaaa

SEQ ID NO: 917656 - DNA, 25 bp, Mus musculus
ttaagctttcctgttgagtgacaaa

SEQ ID NO: 917657 - DNA, 25 bp, Mus musculus
ttaagcttttccactgacgtgccac

SEQ ID NO: 917658 - DNA, 25 bp, Mus musculus
ttaagcttttcctctgacgtgccac

SEQ ID NO: 917659 - DNA, 25 bp, Mus musculus
ttaagctttttaccggctcttgtga

SEQ ID NO: 917660 - DNA, 25 bp, Mus musculus
ttaagctttttagcggctcttgtga

SEQ ID NO: 917661 - DNA, 25 bp, Mus musculus
ttaaggaaaagactcgctcctcctc

SEQ ID NO: 917662 - DNA, 25 bp, Mus musculus
ttaaggaaaagagtcgctcctcctc

SEQ ID NO: 917663 - DNA, 25 bp, Mus musculus
ttaaggaaatcgactgggcccagtt

SEQ ID NO: 917664 - DNA, 25 bp, Mus musculus
ttaaggaaatcgtctgggcccagtt

SEQ ID NO: 917665 - DNA, 25 bp, Mus musculus
ttaaggaacagccataaccctccga

SEQ ID NO: 917666 - DNA, 25 bp, Mus musculus
ttaaggaacagcgataaccctccga

SEQ ID NO: 917667 - DNA, 25 bp, Mus musculus
ttaaggaacgttctccctcatacat

SEQ ID NO: 917668 - DNA, 25 bp, Mus musculus
ttaaggaacgttgtccctcatacat

SEQ ID NO: 917669 - DNA, 25 bp, Mus musculus
ttaaggaagtgcagtcccaaccacc

SEQ ID NO: 917670 - DNA, 25 bp, Mus musculus
ttaaggaagtgctgtcccaaccacc

SEQ ID NO: 917671 - DNA, 25 bp, Mus musculus
ttaaggacacgcactcattgttctg

SEQ ID NO: 917672 - DNA, 25 bp, Mus musculus
ttaaggacacgctctcattgttctg

SEQ ID NO: 917673 - DNA, 25 bp, Mus musculus
ttaaggacagctcaggacaccacct

SEQ ID NO: 917674 - DNA, 25 bp, Mus musculus
ttaaggacagctgaggacaccacct

SEQ ID NO: 917675 - DNA, 25 bp, Mus musculus
ttaaggaccaaacggcacttgagat

SEQ ID NO: 917676 - DNA, 25 bp, Mus musculus
ttaaggaccaaagggcacttgagat

SEQ ID NO: 917677 - DNA, 25 bp, Mus musculus
ttaaggaccaacagcctgggcaatt

SEQ ID NO: 917678 - DNA, 25 bp, Mus musculus
ttaaggaccaactgcctgggcaatt

SEQ ID NO: 917679 - DNA, 25 bp, Mus musculus
ttaaggactatcaactctccctgga

SEQ ID NO: 917680 - DNA, 25 bp, Mus musculus
ttaaggactatctactctccctgga

SEQ ID NO: 917681 - DNA, 25 bp, Mus musculus
ttaaggactcttaagggtcgctgcg

SEQ ID NO: 917682 - DNA, 25 bp, Mus musculus
ttaaggactctttagggtcgctgcg

SEQ ID NO: 917683 - DNA, 25 bp, Mus musculus
ttaaggagaccaccctacatttccg

SEQ ID NO: 917684 - DNA, 25 bp, Mus musculus
ttaaggagaccagcctacatttccg

SEQ ID NO: 917685 - DNA, 25 bp, Mus musculus
ttaaggagagctcctgctagccttg

SEQ ID NO: 917686 - DNA, 25 bp, Mus musculus
ttaaggagagctgctgctagccttg

SEQ ID NO: 917687 - DNA, 25 bp, Mus musculus
ttaaggaggtttcccttcacacaca

SEQ ID NO: 917688 - DNA, 25 bp, Mus musculus
ttaaggaggtttgccttcacacaca

SEQ ID NO: 917689 - DNA, 25 bp, Mus musculus
ttaaggagtcggatccgaggcctgc

SEQ ID NO: 917690 - DNA, 25 bp, Mus musculus
ttaaggagtcggttccgaggcctgc

SEQ ID NO: 917691 - DNA, 25 bp, Mus musculus
ttaaggagtcttacatgcagcatgc

SEQ ID NO: 917692 - DNA, 25 bp, Mus musculus
ttaaggagtctttcatgcagcatgc

SEQ ID NO: 917693 - DNA, 25 bp, Mus musculus
ttaaggagtgggatctggatcccca

SEQ ID NO: 917694 - DNA, 25 bp, Mus musculus
ttaaggagtgggttctggatcccca

SEQ ID NO: 917695 - DNA, 25 bp, Mus musculus
ttaaggataggtacacttgggccac

SEQ ID NO: 917696 - DNA, 25 bp, Mus musculus
ttaaggataggttcacttgggccac

SEQ ID NO: 917697 - DNA, 25 bp, Mus musculus
ttaaggatatcgatggccgccctgt

SEQ ID NO: 917698 - DNA, 25 bp, Mus musculus
ttaaggatatcgttggccgccctgt

SEQ ID NO: 917699 - DNA, 25 bp, Mus musculus
ttaaggatcagccagttcccactgc

SEQ ID NO: 917700 - DNA, 25 bp, Mus musculus
ttaaggatcagcgagttcccactgc

SEQ ID NO: 917701 - DNA, 25 bp, Mus musculus
ttaaggatcctcctaggatccccga

SEQ ID NO: 917702 - DNA, 25 bp, Mus musculus
ttaaggatcctcgtaggatccccga

SEQ ID NO: 917703 - DNA, 25 bp, Mus musculus
ttaaggatgagcaacgacgtctaaa

SEQ ID NO: 917704 - DNA, 25 bp, Mus musculus
ttaaggatgagctacgacgtctaaa

SEQ ID NO: 917705 - DNA, 25 bp, Mus musculus
ttaaggatgagtcccgctgcatgac

SEQ ID NO: 917706 - DNA, 25 bp, Mus musculus
ttaaggatgagtgccgctgcatgac

SEQ ID NO: 917707 - DNA, 25 bp, Mus musculus
ttaaggatggagacctttgacccta

SEQ ID NO: 917708 - DNA, 25 bp, Mus musculus
ttaaggatggagtcctttgacccta

SEQ ID NO: 917709 - DNA, 25 bp, Mus musculus
ttaaggatgtcaaggcgaagaccga

SEQ ID NO: 917710 - DNA, 25 bp, Mus musculus
ttaaggatgtcatggcgaagaccga

SEQ ID NO: 917711 - DNA, 25 bp, Mus musculus
ttaaggatttccatgtgacgcctcc

SEQ ID NO: 917712 - DNA, 25 bp, Mus musculus
ttaaggatttccttgtgacgcctcc

SEQ ID NO: 917713 - DNA, 25 bp, Mus musculus
ttaaggcaataaacttgacaacacc

SEQ ID NO: 917714 - DNA, 25 bp, Mus musculus
ttaaggcaataatcttgacaacacc

SEQ ID NO: 917715 - DNA, 25 bp, Mus musculus
ttaaggcagtgaatccaggaccgtg

SEQ ID NO: 917716 - DNA, 25 bp, Mus musculus
ttaaggcagtgattccaggaccgtg

SEQ ID NO: 917717 - DNA, 25 bp, Mus musculus
ttaaggcattcaataacctctcaag

SEQ ID NO: 917718 - DNA, 25 bp, Mus musculus
ttaaggcattcattaacctctcaag

SEQ ID NO: 917719 - DNA, 25 bp, Mus musculus
ttaaggccaccgctctctaaggagt

SEQ ID NO: 917720 - DNA, 25 bp, Mus musculus
ttaaggccaccggtctctaaggagt

SEQ ID NO: 917721 - DNA, 25 bp, Mus musculus
ttaaggccagaccagacagtgatgc

SEQ ID NO: 917722 - DNA, 25 bp, Mus musculus
ttaaggccagacgagacagtgatgc

SEQ ID NO: 917723 - DNA, 25 bp, Mus musculus
ttaaggccatgtcacaagtgctggt

SEQ ID NO: 917724 - DNA, 25 bp, Mus musculus
ttaaggccatgtgacaagtgctggt

SEQ ID NO: 917725 - DNA, 25 bp, Mus musculus
ttaaggcccagactgcttcaggcaa

SEQ ID NO: 917726 - DNA, 25 bp, Mus musculus
ttaaggcccagagtgcttcaggcaa

SEQ ID NO: 917727 - DNA, 25 bp, Mus musculus
ttaaggcctaatcccattctaataa

SEQ ID NO: 917728 - DNA, 25 bp, Mus musculus
ttaaggcctaatgccattctaataa

SEQ ID NO: 917729 - DNA, 25 bp, Mus musculus
ttaaggcctaccactttcagaagtt

SEQ ID NO: 917730 - DNA, 25 bp, Mus musculus
ttaaggcctacctctttcagaagtt

SEQ ID NO: 917731 - DNA, 25 bp, Mus musculus
ttaaggcctgcactagcatgtccag

SEQ ID NO: 917732 - DNA, 25 bp, Mus musculus
ttaaggcctgcagtagcatgtccag

SEQ ID NO: 917733 - DNA, 25 bp, Mus musculus
ttaaggcgacaacagctccgtggct

SEQ ID NO: 917734 - DNA, 25 bp, Mus musculus
ttaaggcgacaagagctccgtggct

SEQ ID NO: 917735 - DNA, 25 bp, Mus musculus
ttaaggcgagctatgtttccttctg

SEQ ID NO: 917736 - DNA, 25 bp, Mus musculus
ttaaggcgagctttgtttccttctg

SEQ ID NO: 917737 - DNA, 25 bp, Mus musculus
ttaaggcgtggtctgtccgcagaca

SEQ ID NO: 917738 - DNA, 25 bp, Mus musculus
ttaaggcgtggtgtgtccgcagaca

SEQ ID NO: 917739 - DNA, 25 bp, Mus musculus
ttaaggcgtgtgagacgcaggacct

SEQ ID NO: 917740 - DNA, 25 bp, Mus musculus
ttaaggcgtgtgtgacgcaggacct

SEQ ID NO: 917741 - DNA, 25 bp, Mus musculus
ttaaggctatggagggagaccctac

SEQ ID NO: 917742 - DNA, 25 bp, Mus musculus
ttaaggctatggtgggagaccctac

SEQ ID NO: 917743 - DNA, 25 bp, Mus musculus
ttaaggctcgggacctgcgcggcaa

SEQ ID NO: 917744 - DNA, 25 bp, Mus musculus
ttaaggctcgggtcctgcgcggcaa

SEQ ID NO: 917745 - DNA, 25 bp, Mus musculus
ttaaggctgacacgaagactgatgt

SEQ ID NO: 917746 - DNA, 25 bp, Mus musculus
ttaaggctgacaggaagactgatgt

SEQ ID NO: 917747 - DNA, 25 bp, Mus musculus
ttaaggcttagtccacatctcctgc

SEQ ID NO: 917748 - DNA, 25 bp, Mus musculus
ttaaggcttagtgcacatctcctgc

SEQ ID NO: 917749 - DNA, 25 bp, Mus musculus
ttaaggcttcacagactgttcctaa

SEQ ID NO: 917750 - DNA, 25 bp, Mus musculus
ttaaggcttcactgactgttcctaa

SEQ ID NO: 917751 - DNA, 25 bp, Mus musculus
ttaaggcttccgaggctgagaggca

SEQ ID NO: 917752 - DNA, 25 bp, Mus musculus
ttaaggcttccgtggctgagaggca

SEQ ID NO: 917753 - DNA, 25 bp, Mus musculus
ttaaggcttgaaaatgccagaagaa

SEQ ID NO: 917754 - DNA, 25 bp, Mus musculus
ttaaggcttgaaagactggctcagt

SEQ ID NO: 917755 - DNA, 25 bp, Mus musculus
ttaaggcttgaatatgccagaagaa

SEQ ID NO: 917756 - DNA, 25 bp, Mus musculus
ttaaggcttgaatgactggctcagt

SEQ ID NO: 917757 - DNA, 25 bp, Mus musculus
ttaaggcttgttctcactccctgac

SEQ ID NO: 917758 - DNA, 25 bp, Mus musculus
ttaaggcttgttgtcactccctgac

SEQ ID NO: 917759 - DNA, 25 bp, Mus musculus
ttaaggctttgaaccacatagtttt

SEQ ID NO: 917760 - DNA, 25 bp, Mus musculus
ttaaggctttgatccacatagtttt

SEQ ID NO: 917761 - DNA, 25 bp, Mus musculus
ttaagggaagccagtgcccttcatc

SEQ ID NO: 917762 - DNA, 25 bp, Mus musculus
ttaagggaagcctgtgcccttcatc

SEQ ID NO: 917763 - DNA, 25 bp, Mus musculus
ttaagggagaatactgtacatctag

SEQ ID NO: 917764 - DNA, 25 bp, Mus musculus
ttaagggagaattctgtacatctag

SEQ ID NO: 917765 - DNA, 25 bp, Mus musculus
ttaagggagctcaaggtcacaagta

SEQ ID NO: 917766 - DNA, 25 bp, Mus musculus
ttaagggagctctaggtcacaagta

SEQ ID NO: 917767 - DNA, 25 bp, Mus musculus
ttaagggatgttcacatatgtgcct

SEQ ID NO: 917768 - DNA, 25 bp, Mus musculus
ttaagggatgttgacatatgtgcct

SEQ ID NO: 917769 - DNA, 25 bp, Mus musculus
ttaagggcacatccacctgggtggt

SEQ ID NO: 917770 - DNA, 25 bp, Mus musculus
ttaagggcacatgcacctgggtggt

SEQ ID NO: 917771 - DNA, 25 bp, Mus musculus
ttaagggcatgtcccgccagcacca

SEQ ID NO: 917772 - DNA, 25 bp, Mus musculus
ttaagggcatgtgccgccagcacca

SEQ ID NO: 917773 - DNA, 25 bp, Mus musculus
ttaagggccagacaaggaaggacac

SEQ ID NO: 917774 - DNA, 25 bp, Mus musculus
ttaagggccagagaaggaaggacac

SEQ ID NO: 917775 - DNA, 25 bp, Mus musculus
ttaagggcccatagagtcctcggaa

SEQ ID NO: 917776 - DNA, 25 bp, Mus musculus
ttaagggcccattgagtcctcggaa

SEQ ID NO: 917777 - DNA, 25 bp, Mus musculus
ttaagggcggttacttactgctgcc

SEQ ID NO: 917778 - DNA, 25 bp, Mus musculus
ttaagggcggtttcttactgctgcc

SEQ ID NO: 917779 - DNA, 25 bp, Mus musculus
ttaagggctgcaagactcacaagga

SEQ ID NO: 917780 - DNA, 25 bp, Mus musculus
ttaagggctgcatgactcacaagga

SEQ ID NO: 917781 - DNA, 25 bp, Mus musculus
ttaagggcttaaactatcacagtag

SEQ ID NO: 917782 - DNA, 25 bp, Mus musculus
ttaagggcttaatctatcacagtag

SEQ ID NO: 917783 - DNA, 25 bp, Mus musculus
ttaagggtacccaagctctgttagg

SEQ ID NO: 917784 - DNA, 25 bp, Mus musculus
ttaagggtaccctagctctgttagg

SEQ ID NO: 917785 - DNA, 25 bp, Mus musculus
ttaagggtatatatgccagcatgcc

SEQ ID NO: 917786 - DNA, 25 bp, Mus musculus
ttaagggtatatttgccagcatgcc

SEQ ID NO: 917787 - DNA, 25 bp, Mus musculus
ttaagggtccatatgctagagagag

SEQ ID NO: 917788 - DNA, 25 bp, Mus musculus
ttaagggtccatttgctagagagag

SEQ ID NO: 917789 - DNA, 25 bp, Mus musculus
ttaaggtacaatatcagacagctga

SEQ ID NO: 917790 - DNA, 25 bp, Mus musculus
ttaaggtacaatttcagacagctga

SEQ ID NO: 917791 - DNA, 25 bp, Mus musculus
ttaaggtacacgactaagcattcac

SEQ ID NO: 917792 - DNA, 25 bp, Mus musculus
ttaaggtacacgtctaagcattcac

SEQ ID NO: 917793 - DNA, 25 bp, Mus musculus
ttaaggtagaccatgccttgcgtgt

SEQ ID NO: 917794 - DNA, 25 bp, Mus musculus
ttaaggtagaccttgccttgcgtgt

SEQ ID NO: 917795 - DNA, 25 bp, Mus musculus
ttaaggtcagccatttccgacctca

SEQ ID NO: 917796 - DNA, 25 bp, Mus musculus
ttaaggtcagccttttccgacctca

SEQ ID NO: 917797 - DNA, 25 bp, Mus musculus
ttaaggtccagccagacttcaggat

SEQ ID NO: 917798 - DNA, 25 bp, Mus musculus
ttaaggtccagcgagacttcaggat

SEQ ID NO: 917799 - DNA, 25 bp, Mus musculus
ttaaggtccatacacatagtcagat

SEQ ID NO: 917800 - DNA, 25 bp, Mus musculus
ttaaggtccatagacatagtcagat

SEQ ID NO: 917801 - DNA, 25 bp, Mus musculus
ttaaggtcccagctaaaaatcagtg

SEQ ID NO: 917802 - DNA, 25 bp, Mus musculus
ttaaggtcccaggtaaaaatcagtg

SEQ ID NO: 917803 - DNA, 25 bp, Mus musculus
ttaaggtccttccagtagactcctg

SEQ ID NO: 917804 - DNA, 25 bp, Mus musculus
ttaaggtccttcgagtagactcctg

SEQ ID NO: 917805 - DNA, 25 bp, Mus musculus
ttaaggtcggctagaaggatggaca

SEQ ID NO: 917806 - DNA, 25 bp, Mus musculus
ttaaggtcggcttgaaggatggaca

SEQ ID NO: 917807 - DNA, 25 bp, Mus musculus
ttaaggtctcttcgcatttatccta

SEQ ID NO: 917808 - DNA, 25 bp, Mus musculus
ttaaggtctcttggcatttatccta

SEQ ID NO: 917809 - DNA, 25 bp, Mus musculus
ttaaggtcttccagtgtaagcctcc

SEQ ID NO: 917810 - DNA, 25 bp, Mus musculus
ttaaggtcttcctgtgtaagcctcc

SEQ ID NO: 917811 - DNA, 25 bp, Mus musculus
ttaaggtgctttagggtctcagatc

SEQ ID NO: 917812 - DNA, 25 bp, Mus musculus
ttaaggtgcttttgggtctcagatc

SEQ ID NO: 917813 - DNA, 25 bp, Mus musculus
ttaaggtggcctcttgtctcaagac

SEQ ID NO: 917814 - DNA, 25 bp, Mus musculus
ttaaggtggcctgttgtctcaagac

SEQ ID NO: 917815 - DNA, 25 bp, Mus musculus
ttaaggtggtgcagcactcctgcaa

SEQ ID NO: 917816 - DNA, 25 bp, Mus musculus
ttaaggtggtgctgcactcctgcaa

SEQ ID NO: 917817 - DNA, 25 bp, Mus musculus
ttaaggtgtgcgatcagcctttagc

SEQ ID NO: 917818 - DNA, 25 bp, Mus musculus
ttaaggtgtgcgttcagcctttagc

SEQ ID NO: 917819 - DNA, 25 bp, Mus musculus
ttaaggttcttgagacagatccagt

SEQ ID NO: 917820 - DNA, 25 bp, Mus musculus
ttaaggttcttgtgacagatccagt

SEQ ID NO: 917821 - DNA, 25 bp, Mus musculus
ttaaggttgttccttcttgagcgcc

SEQ ID NO: 917822 - DNA, 25 bp, Mus musculus
ttaaggttgttcgttcttgagcgcc

SEQ ID NO: 917823 - DNA, 25 bp, Mus musculus
ttaaggtttgcacccccaaagacat

SEQ ID NO: 917824 - DNA, 25 bp, Mus musculus
ttaaggtttgcagccccaaagacat

SEQ ID NO: 917825 - DNA, 25 bp, Mus musculus
ttaaggttttatcgtggctgctgaa

SEQ ID NO: 917826 - DNA, 25 bp, Mus musculus
ttaaggttttatggtggctgctgaa

SEQ ID NO: 917827 - DNA, 25 bp, Mus musculus
ttaaggtttttaactcgcgcgctgt

SEQ ID NO: 917828 - DNA, 25 bp, Mus musculus
ttaaggtttttatctcgcgcgctgt

SEQ ID NO: 917829 - DNA, 25 bp, Mus musculus
ttaagtaaccgacagccctggcagg

SEQ ID NO: 917830 - DNA, 25 bp, Mus musculus
ttaagtaaccgagagccctggcagg

SEQ ID NO: 917831 - DNA, 25 bp, Mus musculus
ttaagtacaatcactaacgcccctc

SEQ ID NO: 917832 - DNA, 25 bp, Mus musculus
ttaagtacaatctctaacgcccctc

SEQ ID NO: 917833 - DNA, 25 bp, Mus musculus
ttaagtacacttctgccactgagac

SEQ ID NO: 917834 - DNA, 25 bp, Mus musculus
ttaagtacacttgtgccactgagac

SEQ ID NO: 917835 - DNA, 25 bp, Mus musculus
ttaagtacagcaatgcccagagtcg

SEQ ID NO: 917836 - DNA, 25 bp, Mus musculus
ttaagtacagcattgcccagagtcg

SEQ ID NO: 917837 - DNA, 25 bp, Mus musculus
ttaagtaccaacacagcctccaaag

SEQ ID NO: 917838 - DNA, 25 bp, Mus musculus
ttaagtaccaactcagcctccaaag

SEQ ID NO: 917839 - DNA, 25 bp, Mus musculus
ttaagtaccaccagtttcagcaata

SEQ ID NO: 917840 - DNA, 25 bp, Mus musculus
ttaagtaccacctgtttcagcaata

SEQ ID NO: 917841 - DNA, 25 bp, Mus musculus
ttaagtacccatcaatgctgcacgc

SEQ ID NO: 917842 - DNA, 25 bp, Mus musculus
ttaagtacccatgaatgctgcacgc

SEQ ID NO: 917843 - DNA, 25 bp, Mus musculus
ttaagtacctgccttcactcattgc

SEQ ID NO: 917844 - DNA, 25 bp, Mus musculus
ttaagtacctgcgttcactcattgc

SEQ ID NO: 917845 - DNA, 25 bp, Mus musculus
ttaagtacgagtatggacctgccat

SEQ ID NO: 917846 - DNA, 25 bp, Mus musculus
ttaagtacgagtttggacctgccat

SEQ ID NO: 917847 - DNA, 25 bp, Mus musculus
ttaagtacgtctagcaggaccccat

SEQ ID NO: 917848 - DNA, 25 bp, Mus musculus
ttaagtacgtcttgcaggaccccat

SEQ ID NO: 917849 - DNA, 25 bp, Mus musculus
ttaagtactcttctatccaccttgg

SEQ ID NO: 917850 - DNA, 25 bp, Mus musculus
ttaagtactcttgtatccaccttgg

SEQ ID NO: 917851 - DNA, 25 bp, Mus musculus
ttaagtactttgaattctggaaccg

SEQ ID NO: 917852 - DNA, 25 bp, Mus musculus
ttaagtactttgtattctggaaccg

SEQ ID NO: 917853 - DNA, 25 bp, Mus musculus
ttaagtagactgacccaagattggg

SEQ ID NO: 917854 - DNA, 25 bp, Mus musculus
ttaagtagactgtcccaagattggg

SEQ ID NO: 917855 - DNA, 25 bp, Mus musculus
ttaagtagcatccatcccattgtcc

SEQ ID NO: 917856 - DNA, 25 bp, Mus musculus
ttaagtagcatcgatcccattgtcc

SEQ ID NO: 917857 - DNA, 25 bp, Mus musculus
ttaagtagctaacctggccttggat

SEQ ID NO: 917858 - DNA, 25 bp, Mus musculus
ttaagtagctaagctggccttggat

SEQ ID NO: 917859 - DNA, 25 bp, Mus musculus
ttaagtagtcacagtcacttcctct

SEQ ID NO: 917860 - DNA, 25 bp, Mus musculus
ttaagtagtcactgtcacttcctct

SEQ ID NO: 917861 - DNA, 25 bp, Mus musculus
ttaagtagtcatatgcattgcggat

SEQ ID NO: 917862 - DNA, 25 bp, Mus musculus
ttaagtagtcatttgcattgcggat

SEQ ID NO: 917863 - DNA, 25 bp, Mus musculus
ttaagtagtcttcccacaatgagtg

SEQ ID NO: 917864 - DNA, 25 bp, Mus musculus
ttaagtagtcttgccacaatgagtg

SEQ ID NO: 917865 - DNA, 25 bp, Mus musculus
ttaagtatgccaacagagagactga

SEQ ID NO: 917866 - DNA, 25 bp, Mus musculus
ttaagtatgccatcagagagactga

SEQ ID NO: 917867 - DNA, 25 bp, Mus musculus
ttaagtatgtccctgccggctcaga

SEQ ID NO: 917868 - DNA, 25 bp, Mus musculus
ttaagtatgtccgtgccggctcaga

SEQ ID NO: 917869 - DNA, 25 bp, Mus musculus
ttaagtattcacatcgtgccgtttc

SEQ ID NO: 917870 - DNA, 25 bp, Mus musculus
ttaagtattcacttcgtgccgtttc

SEQ ID NO: 917871 - DNA, 25 bp, Mus musculus
ttaagtattccccaaagcaccaact

SEQ ID NO: 917872 - DNA, 25 bp, Mus musculus
ttaagtattcccgaaagcaccaact

SEQ ID NO: 917873 - DNA, 25 bp, Mus musculus
ttaagtattgccatcatgctgatgc

SEQ ID NO: 917874 - DNA, 25 bp, Mus musculus
ttaagtattgccttcatgctgatgc

SEQ ID NO: 917875 - DNA, 25 bp, Mus musculus
ttaagtcaactgaagtgcattctgt

SEQ ID NO: 917876 - DNA, 25 bp, Mus musculus
ttaagtcaactgtagtgcattctgt

SEQ ID NO: 917877 - DNA, 25 bp, Mus musculus
ttaagtcaccgtaccctttgatgcc

SEQ ID NO: 917878 - DNA, 25 bp, Mus musculus
ttaagtcaccgttccctttgatgcc

SEQ ID NO: 917879 - DNA, 25 bp, Mus musculus
ttaagtcactgtcccacatagcaac

SEQ ID NO: 917880 - DNA, 25 bp, Mus musculus
ttaagtcactgtgccacatagcaac

SEQ ID NO: 917881 - DNA, 25 bp, Mus musculus
ttaagtcagcagagccacatctggt

SEQ ID NO: 917882 - DNA, 25 bp, Mus musculus
ttaagtcagcagtgccacatctggt

SEQ ID NO: 917883 - DNA, 25 bp, Mus musculus
ttaagtcagccgaggcttaccgcag

SEQ ID NO: 917884 - DNA, 25 bp, Mus musculus
ttaagtcagccgtggcttaccgcag

SEQ ID NO: 917885 - DNA, 25 bp, Mus musculus
ttaagtcaggacatctctgtttagt

SEQ ID NO: 917886 - DNA, 25 bp, Mus musculus
ttaagtcaggacttctctgtttagt

SEQ ID NO: 917887 - DNA, 25 bp, Mus musculus
ttaagtcagtttccgtggcatctac

SEQ ID NO: 917888 - DNA, 25 bp, Mus musculus
ttaagtcagtttgcgtggcatctac

SEQ ID NO: 917889 - DNA, 25 bp, Mus musculus
ttaagtcatcagactggatccagag

SEQ ID NO: 917890 - DNA, 25 bp, Mus musculus
ttaagtcatcagtctggatccagag

SEQ ID NO: 917891 - DNA, 25 bp, Mus musculus
ttaagtcatcccatcccatggaaat

SEQ ID NO: 917892 - DNA, 25 bp, Mus musculus
ttaagtcatcccttcccatggaaat

SEQ ID NO: 917893 - DNA, 25 bp, Mus musculus
ttaagtccaccaaaatgcctgcctg

SEQ ID NO: 917894 - DNA, 25 bp, Mus musculus
ttaagtccaccataatgcctgcctg

SEQ ID NO: 917895 - DNA, 25 bp, Mus musculus
ttaagtccatctctcctaaacactc

SEQ ID NO: 917896 - DNA, 25 bp, Mus musculus
ttaagtccatctgtcctaaacactc

SEQ ID NO: 917897 - DNA, 25 bp, Mus musculus
ttaagtcccacacttgaccaacctc

SEQ ID NO: 917898 - DNA, 25 bp, Mus musculus
ttaagtcccacagttgaccaacctc

SEQ ID NO: 917899 - DNA, 25 bp, Mus musculus
ttaagtcccactcctcaggaacaag

SEQ ID NO: 917900 - DNA, 25 bp, Mus musculus
ttaagtcccactgctcaggaacaag

SEQ ID NO: 917901 - DNA, 25 bp, Mus musculus
ttaagtcccatcactctggagagat

SEQ ID NO: 917902 - DNA, 25 bp, Mus musculus
ttaagtcccatctctctggagagat

SEQ ID NO: 917903 - DNA, 25 bp, Mus musculus
ttaagtccccatccacgtaatcagt

SEQ ID NO: 917904 - DNA, 25 bp, Mus musculus
ttaagtccccatgcacgtaatcagt

SEQ ID NO: 917905 - DNA, 25 bp, Mus musculus
ttaagtccctccacggtttcactca

SEQ ID NO: 917906 - DNA, 25 bp, Mus musculus
ttaagtccctcctcggtttcactca

SEQ ID NO: 917907 - DNA, 25 bp, Mus musculus
ttaagtcccttactgttccacaagc

SEQ ID NO: 917908 - DNA, 25 bp, Mus musculus
ttaagtcccttagtgttccacaagc

SEQ ID NO: 917909 - DNA, 25 bp, Mus musculus
ttaagtccgtgacgaactttcccag

SEQ ID NO: 917910 - DNA, 25 bp, Mus musculus
ttaagtccgtgaggaactttcccag

SEQ ID NO: 917911 - DNA, 25 bp, Mus musculus
ttaagtcctggtacaacagttgggt

SEQ ID NO: 917912 - DNA, 25 bp, Mus musculus
ttaagtcctggttcaacagttgggt

SEQ ID NO: 917913 - DNA, 25 bp, Mus musculus
ttaagtcggcttccggcgggcttct

SEQ ID NO: 917914 - DNA, 25 bp, Mus musculus
ttaagtcggcttgcggcgggcttct

SEQ ID NO: 917915 - DNA, 25 bp, Mus musculus
ttaagtcggtgaaactgtggaaaca

SEQ ID NO: 917916 - DNA, 25 bp, Mus musculus
ttaagtcggtgatactgtggaaaca

SEQ ID NO: 917917 - DNA, 25 bp, Mus musculus
ttaagtctagccatttcctccaagg

SEQ ID NO: 917918 - DNA, 25 bp, Mus musculus
ttaagtctagccttttcctccaagg

SEQ ID NO: 917919 - DNA, 25 bp, Mus musculus
ttaagtctatcactgtctccttgcg

SEQ ID NO: 917920 - DNA, 25 bp, Mus musculus
ttaagtctatcagtgtctccttgcg

SEQ ID NO: 917921 - DNA, 25 bp, Mus musculus
ttaagtctcaccctgtaagttttgc

SEQ ID NO: 917922 - DNA, 25 bp, Mus musculus
ttaagtctcaccgtgtaagttttgc

SEQ ID NO: 917923 - DNA, 25 bp, Mus musculus
ttaagtctcactcaagatcccgtgg

SEQ ID NO: 917924 - DNA, 25 bp, Mus musculus
ttaagtctcactgaagatcccgtgg

SEQ ID NO: 917925 - DNA, 25 bp, Mus musculus
ttaagtctcatgaagcagtttaggc

SEQ ID NO: 917926 - DNA, 25 bp, Mus musculus
ttaagtctcatgtagcagtttaggc

SEQ ID NO: 917927 - DNA, 25 bp, Mus musculus
ttaagtctccaaagtcggtactcgg

SEQ ID NO: 917928 - DNA, 25 bp, Mus musculus
ttaagtctccaaccttcctcaaaat

SEQ ID NO: 917929 - DNA, 25 bp, Mus musculus
ttaagtctccaagcttcctcaaaat

SEQ ID NO: 917930 - DNA, 25 bp, Mus musculus
ttaagtctccaatgtcggtactcgg

SEQ ID NO: 917931 - DNA, 25 bp, Mus musculus
ttaagtctcctgacagaggtcgcct

SEQ ID NO: 917932 - DNA, 25 bp, Mus musculus
ttaagtctcctgtcagaggtcgcct

SEQ ID NO: 917933 - DNA, 25 bp, Mus musculus
ttaagtctctgtacttggctacaca

SEQ ID NO: 917934 - DNA, 25 bp, Mus musculus
ttaagtctctgttcttggctacaca

SEQ ID NO: 917935 - DNA, 25 bp, Mus musculus
ttaagtctctttccaacagtgtaac

SEQ ID NO: 917936 - DNA, 25 bp, Mus musculus
ttaagtctctttgcaacagtgtaac

SEQ ID NO: 917937 - DNA, 25 bp, Mus musculus
ttaagtctgaatcccatcgtgttaa

SEQ ID NO: 917938 - DNA, 25 bp, Mus musculus
ttaagtctgaatgccatcgtgttaa

SEQ ID NO: 917939 - DNA, 25 bp, Mus musculus
ttaagtctgagccttcctttccagt

SEQ ID NO: 917940 - DNA, 25 bp, Mus musculus
ttaagtctgagcgttcctttccagt

SEQ ID NO: 917941 - DNA, 25 bp, Mus musculus
ttaagtctgagtacattcctgccca

SEQ ID NO: 917942 - DNA, 25 bp, Mus musculus
ttaagtctgagttcattcctgccca

SEQ ID NO: 917943 - DNA, 25 bp, Mus musculus
ttaagtctgatgcatagcctaaatt

SEQ ID NO: 917944 - DNA, 25 bp, Mus musculus
ttaagtctgatggatagcctaaatt

SEQ ID NO: 917945 - DNA, 25 bp, Mus musculus
ttaagtcttctaactgaaccagtgt

SEQ ID NO: 917946 - DNA, 25 bp, Mus musculus
ttaagtcttctatctgaaccagtgt

SEQ ID NO: 917947 - DNA, 25 bp, Mus musculus
ttaagtcttgtactcacgcagcact

SEQ ID NO: 917948 - DNA, 25 bp, Mus musculus
ttaagtcttgtagtcacgcagcact

SEQ ID NO: 917949 - DNA, 25 bp, Mus musculus
ttaagtgaacagatgactggtgggt

SEQ ID NO: 917950 - DNA, 25 bp, Mus musculus
ttaagtgaacagttgactggtgggt

SEQ ID NO: 917951 - DNA, 25 bp, Mus musculus
ttaagtgaatatccgtctctcccat

SEQ ID NO: 917952 - DNA, 25 bp, Mus musculus
ttaagtgaatatgcgtctctcccat

SEQ ID NO: 917953 - DNA, 25 bp, Mus musculus
ttaagtgacctgagaccctcccaga

SEQ ID NO: 917954 - DNA, 25 bp, Mus musculus
ttaagtgacctgcacccgctatttt

SEQ ID NO: 917955 - DNA, 25 bp, Mus musculus
ttaagtgacctggacccgctatttt

SEQ ID NO: 917956 - DNA, 25 bp, Mus musculus
ttaagtgacctgtgaccctcccaga

SEQ ID NO: 917957 - DNA, 25 bp, Mus musculus
ttaagtgagtgtactgtcccaggac

SEQ ID NO: 917958 - DNA, 25 bp, Mus musculus
ttaagtgagtgttctgtcccaggac

SEQ ID NO: 917959 - DNA, 25 bp, Mus musculus
ttaagtgatacccaagtacccttgc

SEQ ID NO: 917960 - DNA, 25 bp, Mus musculus
ttaagtgataccgaagtacccttgc

SEQ ID NO: 917961 - DNA, 25 bp, Mus musculus
ttaagtgcacagaatcactccgcct

SEQ ID NO: 917962 - DNA, 25 bp, Mus musculus
ttaagtgcacagtatcactccgcct

SEQ ID NO: 917963 - DNA, 25 bp, Mus musculus
ttaagtgcagctcctactacacctg

SEQ ID NO: 917964 - DNA, 25 bp, Mus musculus
ttaagtgcagctgctactacacctg

SEQ ID NO: 917965 - DNA, 25 bp, Mus musculus
ttaagtgccctcatgatgggttgtg

SEQ ID NO: 917966 - DNA, 25 bp, Mus musculus
ttaagtgccctcttgatgggttgtg

SEQ ID NO: 917967 - DNA, 25 bp, Mus musculus
ttaagtgccgcccaaaggagagtgc

SEQ ID NO: 917968 - DNA, 25 bp, Mus musculus
ttaagtgccgccgaaaggagagtgc

SEQ ID NO: 917969 - DNA, 25 bp, Mus musculus
ttaagtgcctccaactggcagcaag

SEQ ID NO: 917970 - DNA, 25 bp, Mus musculus
ttaagtgcctcctactggcagcaag

SEQ ID NO: 917971 - DNA, 25 bp, Mus musculus
ttaagtgccttcactgtgacctgag

SEQ ID NO: 917972 - DNA, 25 bp, Mus musculus
ttaagtgccttctctgtgacctgag

SEQ ID NO: 917973 - DNA, 25 bp, Mus musculus
ttaagtgctgaccttgtatctctca

SEQ ID NO: 917974 - DNA, 25 bp, Mus musculus
ttaagtgctgacgttgtatctctca

SEQ ID NO: 917975 - DNA, 25 bp, Mus musculus
ttaagtgctgcaaaatggatacatt

SEQ ID NO: 917976 - DNA, 25 bp, Mus musculus
ttaagtgctgcataatggatacatt

SEQ ID NO: 917977 - DNA, 25 bp, Mus musculus
ttaagtgcttgcattttgcccgctg

SEQ ID NO: 917978 - DNA, 25 bp, Mus musculus
ttaagtgcttgctttttgcccgctg

SEQ ID NO: 917979 - DNA, 25 bp, Mus musculus
ttaagtgggaagcattacactttgc

SEQ ID NO: 917980 - DNA, 25 bp, Mus musculus
ttaagtgggaaggattacactttgc

SEQ ID NO: 917981 - DNA, 25 bp, Mus musculus
ttaagtggtacgaatgttgtgcatt

SEQ ID NO: 917982 - DNA, 25 bp, Mus musculus
ttaagtggtacgtatgttgtgcatt

SEQ ID NO: 917983 - DNA, 25 bp, Mus musculus
ttaagtggtataagatcttggacaa

SEQ ID NO: 917984 - DNA, 25 bp, Mus musculus
ttaagtggtatatgatcttggacaa

SEQ ID NO: 917985 - DNA, 25 bp, Mus musculus
ttaagtggtgtgctaccacgcctga

SEQ ID NO: 917986 - DNA, 25 bp, Mus musculus
ttaagtggtgtggtaccacgcctga

SEQ ID NO: 917987 - DNA, 25 bp, Mus musculus
ttaagtggtgttagcaggcaagttc

SEQ ID NO: 917988 - DNA, 25 bp, Mus musculus
ttaagtggtgtttgcaggcaagttc

SEQ ID NO: 917989 - DNA, 25 bp, Mus musculus
ttaagtgtagaaagcccctatgccc

SEQ ID NO: 917990 - DNA, 25 bp, Mus musculus
ttaagtgtagaatgcccctatgccc

SEQ ID NO: 917991 - DNA, 25 bp, Mus musculus
ttaagtgtatagcatatgtgtttct

SEQ ID NO: 917992 - DNA, 25 bp, Mus musculus
ttaagtgtataggatatgtgtttct

SEQ ID NO: 917993 - DNA, 25 bp, Mus musculus
ttaagtgtcaccctggctggagcca

SEQ ID NO: 917994 - DNA, 25 bp, Mus musculus
ttaagtgtcaccgtggctggagcca

SEQ ID NO: 917995 - DNA, 25 bp, Mus musculus
ttaagtgtgaagaccccgtgtccgg

SEQ ID NO: 917996 - DNA, 25 bp, Mus musculus
ttaagtgtgaagtccccgtgtccgg

SEQ ID NO: 917997 - DNA, 25 bp, Mus musculus
ttaagtgtgcctctaaatgcctcca

SEQ ID NO: 917998 - DNA, 25 bp, Mus musculus
ttaagtgtgcctgtaaatgcctcca

SEQ ID NO: 917999 - DNA, 25 bp, Mus musculus
ttaagtgtgcttcagacccagggaa

SEQ ID NO: 918000 - DNA, 25 bp, Mus musculus
ttaagtgtgcttctgttctctcaga

SEQ ID NO: 918001 - DNA, 25 bp, Mus musculus
ttaagtgtgcttgagacccagggaa

SEQ ID NO: 918002 - DNA, 25 bp, Mus musculus
ttaagtgtgcttgtgttctctcaga

SEQ ID NO: 918003 - DNA, 25 bp, Mus musculus
ttaagtgtggctacatggttctcgg

SEQ ID NO: 918004 - DNA, 25 bp, Mus musculus
ttaagtgtggcttcatggttctcgg

SEQ ID NO: 918005 - DNA, 25 bp, Mus musculus
ttaagtgttcacattctctgtattt

SEQ ID NO: 918006 - DNA, 25 bp, Mus musculus
ttaagtgttcactttctctgtattt

SEQ ID NO: 918007 - DNA, 25 bp, Mus musculus
ttaagtgttgacatgtttccacacg

SEQ ID NO: 918008 - DNA, 25 bp, Mus musculus
ttaagtgttgacttgtttccacacg

SEQ ID NO: 918009 - DNA, 25 bp, Mus musculus
ttaagtgtttgcactttccccgaag

SEQ ID NO: 918010 - DNA, 25 bp, Mus musculus
ttaagtgtttgctctttccccgaag

SEQ ID NO: 918011 - DNA, 25 bp, Mus musculus
ttaagttagtgcattcctcaacccc

SEQ ID NO: 918012 - DNA, 25 bp, Mus musculus
ttaagttagtgctttcctcaacccc

SEQ ID NO: 918013 - DNA, 25 bp, Mus musculus
ttaagttagttaatggctccccagt

SEQ ID NO: 918014 - DNA, 25 bp, Mus musculus
ttaagttagttattggctccccagt

SEQ ID NO: 918015 - DNA, 25 bp, Mus musculus
ttaagttatatccagcaatgtttct

SEQ ID NO: 918016 - DNA, 25 bp, Mus musculus
ttaagttatatcgagcaatgtttct

SEQ ID NO: 918017 - DNA, 25 bp, Mus musculus
ttaagttattaacactgcccaacct

SEQ ID NO: 918018 - DNA, 25 bp, Mus musculus
ttaagttattaagactgcccaacct

SEQ ID NO: 918019 - DNA, 25 bp, Mus musculus
ttaagttcaaacctccggcatgtga

SEQ ID NO: 918020 - DNA, 25 bp, Mus musculus
ttaagttcaaacgtccggcatgtga

SEQ ID NO: 918021 - DNA, 25 bp, Mus musculus
ttaagttcacagacctgcactctgg

SEQ ID NO: 918022 - DNA, 25 bp, Mus musculus
ttaagttcacagtcctgcactctgg

SEQ ID NO: 918023 - DNA, 25 bp, Mus musculus
ttaagttcaccccagcaacagttct

SEQ ID NO: 918024 - DNA, 25 bp, Mus musculus
ttaagttcacccgagcaacagttct

SEQ ID NO: 918025 - DNA, 25 bp, Mus musculus
ttaagttcaggtactcagactctac

SEQ ID NO: 918026 - DNA, 25 bp, Mus musculus
ttaagttcaggttctcagactctac

SEQ ID NO: 918027 - DNA, 25 bp, Mus musculus
ttaagttcagttacccagtcagttc

SEQ ID NO: 918028 - DNA, 25 bp, Mus musculus
ttaagttcagtttcccagtcagttc

SEQ ID NO: 918029 - DNA, 25 bp, Mus musculus
ttaagttccacgaggtctacacagt

SEQ ID NO: 918030 - DNA, 25 bp, Mus musculus
ttaagttccacgtggtctacacagt

SEQ ID NO: 918031 - DNA, 25 bp, Mus musculus
ttaagttccctcatcttggaacaga

SEQ ID NO: 918032 - DNA, 25 bp, Mus musculus
ttaagttccctcttcttggaacaga

SEQ ID NO: 918033 - DNA, 25 bp, Mus musculus
ttaagttctaatatcacattcccag

SEQ ID NO: 918034 - DNA, 25 bp, Mus musculus
ttaagttctaatttcacattcccag

SEQ ID NO: 918035 - DNA, 25 bp, Mus musculus
ttaagttctattacccaagcaaagg

SEQ ID NO: 918036 - DNA, 25 bp, Mus musculus
ttaagttctatttcccaagcaaagg

SEQ ID NO: 918037 - DNA, 25 bp, Mus musculus
ttaagttctcctatactgttggtag

SEQ ID NO: 918038 - DNA, 25 bp, Mus musculus
ttaagttctcctccagtgacaggaa

SEQ ID NO: 918039 - DNA, 25 bp, Mus musculus
ttaagttctcctgcagtgacaggaa

SEQ ID NO: 918040 - DNA, 25 bp, Mus musculus
ttaagttctcctttactgttggtag

SEQ ID NO: 918041 - DNA, 25 bp, Mus musculus
ttaagttctctgatctttgtcccgt

SEQ ID NO: 918042 - DNA, 25 bp, Mus musculus
ttaagttctctgttctttgtcccgt

SEQ ID NO: 918043 - DNA, 25 bp, Mus musculus
ttaagttctgacaacacactgattc

SEQ ID NO: 918044 - DNA, 25 bp, Mus musculus
ttaagttctgactacacactgattc

SEQ ID NO: 918045 - DNA, 25 bp, Mus musculus
ttaagttctgagatccaggtggcca

SEQ ID NO: 918046 - DNA, 25 bp, Mus musculus
ttaagttctgagttccaggtggcca

SEQ ID NO: 918047 - DNA, 25 bp, Mus musculus
ttaagttctgcaattctgaggtgat

SEQ ID NO: 918048 - DNA, 25 bp, Mus musculus
ttaagttctgcatttctgaggtgat

SEQ ID NO: 918049 - DNA, 25 bp, Mus musculus
ttaagttctgtgcaattgccataac

SEQ ID NO: 918050 - DNA, 25 bp, Mus musculus
ttaagttctgtggaattgccataac

SEQ ID NO: 918051 - DNA, 25 bp, Mus musculus
ttaagttctgttccttccaagagcc

SEQ ID NO: 918052 - DNA, 25 bp, Mus musculus
ttaagttctgttgcttccaagagcc

SEQ ID NO: 918053 - DNA, 25 bp, Mus musculus
ttaagttctttcagtgttctccctc

SEQ ID NO: 918054 - DNA, 25 bp, Mus musculus
ttaagttctttctgtgttctccctc

SEQ ID NO: 918055 - DNA, 25 bp, Mus musculus
ttaagttcttttactgccctaagct

SEQ ID NO: 918056 - DNA, 25 bp, Mus musculus
ttaagttctttttctgccctaagct

SEQ ID NO: 918057 - DNA, 25 bp, Mus musculus
ttaagttgaggcagtcgaccggcgc

SEQ ID NO: 918058 - DNA, 25 bp, Mus musculus
ttaagttgaggctgtcgaccggcgc

SEQ ID NO: 918059 - DNA, 25 bp, Mus musculus
ttaagttgctgaccatatgtagaaa

SEQ ID NO: 918060 - DNA, 25 bp, Mus musculus
ttaagttgctgagcatatgtagaaa

SEQ ID NO: 918061 - DNA, 25 bp, Mus musculus
ttaagttggaagctcccagctccag

SEQ ID NO: 918062 - DNA, 25 bp, Mus musculus
ttaagttggaaggtcccagctccag

SEQ ID NO: 918063 - DNA, 25 bp, Mus musculus
ttaagttggactaagcgaccttgaa

SEQ ID NO: 918064 - DNA, 25 bp, Mus musculus
ttaagttggacttagcgaccttgaa

SEQ ID NO: 918065 - DNA, 25 bp, Mus musculus
ttaagttggataattctctacattc

SEQ ID NO: 918066 - DNA, 25 bp, Mus musculus
ttaagttggatatttctctacattc

SEQ ID NO: 918067 - DNA, 25 bp, Mus musculus
ttaagttggtccatgttcctcctag

SEQ ID NO: 918068 - DNA, 25 bp, Mus musculus
ttaagttggtccttgttcctcctag

SEQ ID NO: 918069 - DNA, 25 bp, Mus musculus
ttaagttgttgccacccataaaaag

SEQ ID NO: 918070 - DNA, 25 bp, Mus musculus
ttaagttgttgcgacccataaaaag

SEQ ID NO: 918071 - DNA, 25 bp, Mus musculus
ttaagtttaataccctgagtcataa

SEQ ID NO: 918072 - DNA, 25 bp, Mus musculus
ttaagtttaatagcctgagtcataa

SEQ ID NO: 918073 - DNA, 25 bp, Mus musculus
ttaagtttactaatatcacaggatg

SEQ ID NO: 918074 - DNA, 25 bp, Mus musculus
ttaagtttactattatcacaggatg

SEQ ID NO: 918075 - DNA, 25 bp, Mus musculus
ttaagtttactccttctgttctgag

SEQ ID NO: 918076 - DNA, 25 bp, Mus musculus
ttaagtttactcgttctgttctgag

SEQ ID NO: 918077 - DNA, 25 bp, Mus musculus
ttaagtttatccaccatgtgttgta

SEQ ID NO: 918078 - DNA, 25 bp, Mus musculus
ttaagtttatccctgaagcctcctg

SEQ ID NO: 918079 - DNA, 25 bp, Mus musculus
ttaagtttatccgtgaagcctcctg

SEQ ID NO: 918080 - DNA, 25 bp, Mus musculus
ttaagtttatcctccatgtgttgta

SEQ ID NO: 918081 - DNA, 25 bp, Mus musculus
ttaagtttattaatcgtggcccatt

SEQ ID NO: 918082 - DNA, 25 bp, Mus musculus
ttaagtttattattcgtggcccatt

SEQ ID NO: 918083 - DNA, 25 bp, Mus musculus
ttaagtttccacattggtcctcaga

SEQ ID NO: 918084 - DNA, 25 bp, Mus musculus
ttaagtttccactttggtcctcaga

SEQ ID NO: 918085 - DNA, 25 bp, Mus musculus
ttaagtttctgtacttcctcaacca

SEQ ID NO: 918086 - DNA, 25 bp, Mus musculus
ttaagtttctgttcttcctcaacca

SEQ ID NO: 918087 - DNA, 25 bp, Mus musculus
ttaagtttgatacccagcactacaa

SEQ ID NO: 918088 - DNA, 25 bp, Mus musculus
ttaagtttgatagccagcactacaa

SEQ ID NO: 918089 - DNA, 25 bp, Mus musculus
ttaagtttgcttcctccctgggtat

SEQ ID NO: 918090 - DNA, 25 bp, Mus musculus
ttaagtttgcttgctccctgggtat

SEQ ID NO: 918091 - DNA, 25 bp, Mus musculus
ttaagtttgtatactcacacagtgg

SEQ ID NO: 918092 - DNA, 25 bp, Mus musculus
ttaagtttgtattctcacacagtgg

SEQ ID NO: 918093 - DNA, 25 bp, Mus musculus
ttaagttttaaaagcctgggtgtat

SEQ ID NO: 918094 - DNA, 25 bp, Mus musculus
ttaagttttaaatgcctgggtgtat

SEQ ID NO: 918095 - DNA, 25 bp, Mus musculus
ttaataaaggatcaccccacacacc

SEQ ID NO: 918096 - DNA, 25 bp, Mus musculus
ttaataaaggatgaccccacacacc

SEQ ID NO: 918097 - DNA, 25 bp, Mus musculus
ttaataaatgcaagctctgtttctt

SEQ ID NO: 918098 - DNA, 25 bp, Mus musculus
ttaataaatgcatgctctgtttctt

SEQ ID NO: 918099 - DNA, 25 bp, Mus musculus
ttaataaattacctggagcagcctg

SEQ ID NO: 918100 - DNA, 25 bp, Mus musculus
ttaataaattacgtggagcagcctg

SEQ ID NO: 918101 - DNA, 25 bp, Mus musculus
ttaataacaactcgcggcacaccct

SEQ ID NO: 918102 - DNA, 25 bp, Mus musculus
ttaataacaactggcggcacaccct

SEQ ID NO: 918103 - DNA, 25 bp, Mus musculus
ttaataacagctacagattcttcag

SEQ ID NO: 918104 - DNA, 25 bp, Mus musculus
ttaataacagcttcagattcttcag

SEQ ID NO: 918105 - DNA, 25 bp, Mus musculus
ttaataacgccgacagcaacgagaa

SEQ ID NO: 918106 - DNA, 25 bp, Mus musculus
ttaataacgccgtcagcaacgagaa

SEQ ID NO: 918107 - DNA, 25 bp, Mus musculus
ttaataactggaactatacccggat

SEQ ID NO: 918108 - DNA, 25 bp, Mus musculus
ttaataactggatctatacccggat

SEQ ID NO: 918109 - DNA, 25 bp, Mus musculus
ttaataaggagaagtcagtcacttg

SEQ ID NO: 918110 - DNA, 25 bp, Mus musculus
ttaataaggagatgtcagtcacttg

SEQ ID NO: 918111 - DNA, 25 bp, Mus musculus
ttaataaggcacaacagctaactga

SEQ ID NO: 918112 - DNA, 25 bp, Mus musculus
ttaataaggcactacagctaactga

SEQ ID NO: 918113 - DNA, 25 bp, Mus musculus
ttaataaggtttccctactgcctct

SEQ ID NO: 918114 - DNA, 25 bp, Mus musculus
ttaataaggtttgcctactgcctct

SEQ ID NO: 918115 - DNA, 25 bp, Mus musculus
ttaataatcagaaggctcccctttc

SEQ ID NO: 918116 - DNA, 25 bp, Mus musculus
ttaataatcagatggctcccctttc

SEQ ID NO: 918117 - DNA, 25 bp, Mus musculus
ttaataatcagtatgcccagggaaa

SEQ ID NO: 918118 - DNA, 25 bp, Mus musculus
ttaataatcagtttgcccagggaaa

SEQ ID NO: 918119 - DNA, 25 bp, Mus musculus
ttaataatgtttcttctaaatgcca

SEQ ID NO: 918120 - DNA, 25 bp, Mus musculus
ttaataatgtttgttctaaatgcca

SEQ ID NO: 918121 - DNA, 25 bp, Mus musculus
ttaataattattactgctcccttgt

SEQ ID NO: 918122 - DNA, 25 bp, Mus musculus
ttaataattatttctgctcccttgt

SEQ ID NO: 918123 - DNA, 25 bp, Mus musculus
ttaatacaagtcatctccccaacac

SEQ ID NO: 918124 - DNA, 25 bp, Mus musculus
ttaatacaagtcttctccccaacac

SEQ ID NO: 918125 - DNA, 25 bp, Mus musculus
ttaatacactctctatccttttctc

SEQ ID NO: 918126 - DNA, 25 bp, Mus musculus
ttaatacactctgtatccttttctc

SEQ ID NO: 918127 - DNA, 25 bp, Mus musculus
ttaatacagagcatctgatatatct

SEQ ID NO: 918128 - DNA, 25 bp, Mus musculus
ttaatacagagcttctgatatatct

SEQ ID NO: 918129 - DNA, 25 bp, Mus musculus
ttaatacagagtattctttcgcctt

SEQ ID NO: 918130 - DNA, 25 bp, Mus musculus
ttaatacagagttttctttcgcctt

SEQ ID NO: 918131 - DNA, 25 bp, Mus musculus
ttaatacatgtaagagatcctcaaa

SEQ ID NO: 918132 - DNA, 25 bp, Mus musculus
ttaatacatgtatgagatcctcaaa

SEQ ID NO: 918133 - DNA, 25 bp, Mus musculus
ttaatacatgtcatttagaaatagt

SEQ ID NO: 918134 - DNA, 25 bp, Mus musculus
ttaatacatgtcttttagaaatagt

SEQ ID NO: 918135 - DNA, 25 bp, Mus musculus
ttaatacccactagtcaatctctcc

SEQ ID NO: 918136 - DNA, 25 bp, Mus musculus
ttaatacccacttgtcaatctctcc

SEQ ID NO: 918137 - DNA, 25 bp, Mus musculus
ttaatacccgcccataaagtcaagc

SEQ ID NO: 918138 - DNA, 25 bp, Mus musculus
ttaatacccgccgataaagtcaagc

SEQ ID NO: 918139 - DNA, 25 bp, Mus musculus
ttaatacctcccagtgctggtacag

SEQ ID NO: 918140 - DNA, 25 bp, Mus musculus
ttaatacctccctgtgctggtacag

SEQ ID NO: 918141 - DNA, 25 bp, Mus musculus
ttaatacctctgcgtctcagttaat

SEQ ID NO: 918142 - DNA, 25 bp, Mus musculus
ttaatacctctgggtctcagttaat

SEQ ID NO: 918143 - DNA, 25 bp, Mus musculus
ttaatactgttgcaccctcctgctg

SEQ ID NO: 918144 - DNA, 25 bp, Mus musculus
ttaatactgttggaccctcctgctg

SEQ ID NO: 918145 - DNA, 25 bp, Mus musculus
ttaatacttgttccttcatggcgta

SEQ ID NO: 918146 - DNA, 25 bp, Mus musculus
ttaatacttgttgcttcatggcgta

SEQ ID NO: 918147 - DNA, 25 bp, Mus musculus
ttaatagaagcaccccacagccata

SEQ ID NO: 918148 - DNA, 25 bp, Mus musculus
ttaatagaagcagcccacagccata

SEQ ID NO: 918149 - DNA, 25 bp, Mus musculus
ttaatagacctacacaagccctgtg

SEQ ID NO: 918150 - DNA, 25 bp, Mus musculus
ttaatagacctagacaagccctgtg

SEQ ID NO: 918151 - DNA, 25 bp, Mus musculus
ttaatagacctgattccttcctgag

SEQ ID NO: 918152 - DNA, 25 bp, Mus musculus
ttaatagacctgtttccttcctgag

SEQ ID NO: 918153 - DNA, 25 bp, Mus musculus
ttaatagagcggactcctcccagtt

SEQ ID NO: 918154 - DNA, 25 bp, Mus musculus
ttaatagagcggtctcctcccagtt

SEQ ID NO: 918155 - DNA, 25 bp, Mus musculus
ttaatagcatttcctacctggccct

SEQ ID NO: 918156 - DNA, 25 bp, Mus musculus
ttaatagcatttgctacctggccct

SEQ ID NO: 918157 - DNA, 25 bp, Mus musculus
ttaatagccaccctgaattctgtaa

SEQ ID NO: 918158 - DNA, 25 bp, Mus musculus
ttaatagccaccgtgaattctgtaa

SEQ ID NO: 918159 - DNA, 25 bp, Mus musculus
ttaatagctactcttctttcttctt

SEQ ID NO: 918160 - DNA, 25 bp, Mus musculus
ttaatagctactgttctttcttctt

SEQ ID NO: 918161 - DNA, 25 bp, Mus musculus
ttaatagctaggatccccaacacac

SEQ ID NO: 918162 - DNA, 25 bp, Mus musculus
ttaatagctaggttccccaacacac

SEQ ID NO: 918163 - DNA, 25 bp, Mus musculus
ttaataggccgaaaatgtgcttttt

SEQ ID NO: 918164 - DNA, 25 bp, Mus musculus
ttaataggccgataatgtgcttttt

SEQ ID NO: 918165 - DNA, 25 bp, Mus musculus
ttaataggtccaaacatacaaagct

SEQ ID NO: 918166 - DNA, 25 bp, Mus musculus
ttaataggtccatacatacaaagct

SEQ ID NO: 918167 - DNA, 25 bp, Mus musculus
ttaataggtgtgcttgcctctcctg

SEQ ID NO: 918168 - DNA, 25 bp, Mus musculus
ttaataggtgtggttgcctctcctg

SEQ ID NO: 918169 - DNA, 25 bp, Mus musculus
ttaatagtagcaaccttttccccag

SEQ ID NO: 918170 - DNA, 25 bp, Mus musculus
ttaatagtagcatccttttccccag

SEQ ID NO: 918171 - DNA, 25 bp, Mus musculus
ttaatagtcacccttccatgctgtt

SEQ ID NO: 918172 - DNA, 25 bp, Mus musculus
ttaatagtcaccgttccatgctgtt

SEQ ID NO: 918173 - DNA, 25 bp, Mus musculus
ttaatagtcaggctagaatggaaat

SEQ ID NO: 918174 - DNA, 25 bp, Mus musculus
ttaatagtcagggtagaatggaaat

SEQ ID NO: 918175 - DNA, 25 bp, Mus musculus
ttaatatagcttctctcgcagtcca

SEQ ID NO: 918176 - DNA, 25 bp, Mus musculus
ttaatatagcttgtctcgcagtcca

SEQ ID NO: 918177 - DNA, 25 bp, Mus musculus
ttaatatcagatcccaagcgcacca

SEQ ID NO: 918178 - DNA, 25 bp, Mus musculus
ttaatatcagatgccaagcgcacca

SEQ ID NO: 918179 - DNA, 25 bp, Mus musculus
ttaatatcatttcgcttccctttgc

SEQ ID NO: 918180 - DNA, 25 bp, Mus musculus
ttaatatcatttggcttccctttgc

SEQ ID NO: 918181 - DNA, 25 bp, Mus musculus
ttaatatccaaactgcttcccaaac

SEQ ID NO: 918182 - DNA, 25 bp, Mus musculus
ttaatatccaaagtgcttcccaaac

SEQ ID NO: 918183 - DNA, 25 bp, Mus musculus
ttaatatccagactgctccaaggaa

SEQ ID NO: 918184 - DNA, 25 bp, Mus musculus
ttaatatccagagtgctccaaggaa

SEQ ID NO: 918185 - DNA, 25 bp, Mus musculus
ttaatatccgacatgtgagacctct

SEQ ID NO: 918186 - DNA, 25 bp, Mus musculus
ttaatatccgacttgtgagacctct

SEQ ID NO: 918187 - DNA, 25 bp, Mus musculus
ttaatatgaaatcgcgctcctggtc

SEQ ID NO: 918188 - DNA, 25 bp, Mus musculus
ttaatatgaaatggcgctcctggtc

SEQ ID NO: 918189 - DNA, 25 bp, Mus musculus
ttaatatgcattcttcccagtccac

SEQ ID NO: 918190 - DNA, 25 bp, Mus musculus
ttaatatgcattgttcccagtccac

SEQ ID NO: 918191 - DNA, 25 bp, Mus musculus
ttaatatggttcattgtgggctggt

SEQ ID NO: 918192 - DNA, 25 bp, Mus musculus
ttaatatggttctttgtgggctggt

SEQ ID NO: 918193 - DNA, 25 bp, Mus musculus
ttaatattccttacctcgtgttgta

SEQ ID NO: 918194 - DNA, 25 bp, Mus musculus
ttaatattcctttcctcgtgttgta

SEQ ID NO: 918195 - DNA, 25 bp, Mus musculus
ttaatattctccattgcctcgactt

SEQ ID NO: 918196 - DNA, 25 bp, Mus musculus
ttaatattctcctttgcctcgactt

SEQ ID NO: 918197 - DNA, 25 bp, Mus musculus
ttaatattggttctttaactgaaat

SEQ ID NO: 918198 - DNA, 25 bp, Mus musculus
ttaatattggttgtttaactgaaat

SEQ ID NO: 918199 - DNA, 25 bp, Mus musculus
ttaatattgttcaagccttctctgc

SEQ ID NO: 918200 - DNA, 25 bp, Mus musculus
ttaatattgttctagccttctctgc

SEQ ID NO: 918201 - DNA, 25 bp, Mus musculus
ttaatcaagcctactggagcagaga

SEQ ID NO: 918202 - DNA, 25 bp, Mus musculus
ttaatcaagccttctggagcagaga

SEQ ID NO: 918203 - DNA, 25 bp, Mus musculus
ttaatcacatagaagccaaccatgc

SEQ ID NO: 918204 - DNA, 25 bp, Mus musculus
ttaatcacatagtagccaaccatgc

SEQ ID NO: 918205 - DNA, 25 bp, Mus musculus
ttaatcaccgtgaagaagaactgag

SEQ ID NO: 918206 - DNA, 25 bp, Mus musculus
ttaatcaccgtgtagaagaactgag

SEQ ID NO: 918207 - DNA, 25 bp, Mus musculus
ttaatcactgaactgtctgctcacc

SEQ ID NO: 918208 - DNA, 25 bp, Mus musculus
ttaatcactgaagtgtctgctcacc

SEQ ID NO: 918209 - DNA, 25 bp, Mus musculus
ttaatcacttcaaaccagatcagtt

SEQ ID NO: 918210 - DNA, 25 bp, Mus musculus
ttaatcacttcataccagatcagtt

SEQ ID NO: 918211 - DNA, 25 bp, Mus musculus
ttaatcagctttcctcattcagatg

SEQ ID NO: 918212 - DNA, 25 bp, Mus musculus
ttaatcagctttgctcattcagatg

SEQ ID NO: 918213 - DNA, 25 bp, Mus musculus
ttaatcaggaaaagcagtggctaaa

SEQ ID NO: 918214 - DNA, 25 bp, Mus musculus
ttaatcaggaaatgcagtggctaaa

SEQ ID NO: 918215 - DNA, 25 bp, Mus musculus
ttaatcataattcccgtgctgtcta

SEQ ID NO: 918216 - DNA, 25 bp, Mus musculus
ttaatcataattgccgtgctgtcta

SEQ ID NO: 918217 - DNA, 25 bp, Mus musculus
ttaatcatccctctggctatgtgtg

SEQ ID NO: 918218 - DNA, 25 bp, Mus musculus
ttaatcatccctgtggctatgtgtg

SEQ ID NO: 918219 - DNA, 25 bp, Mus musculus
ttaatcatgagcctgtttattgcca

SEQ ID NO: 918220 - DNA, 25 bp, Mus musculus
ttaatcatgagcgtgtttattgcca

SEQ ID NO: 918221 - DNA, 25 bp, Mus musculus
ttaatcattacgataccaaccctct

SEQ ID NO: 918222 - DNA, 25 bp, Mus musculus
ttaatcattacgttaccaaccctct

SEQ ID NO: 918223 - DNA, 25 bp, Mus musculus
ttaatcattcagacttccactcaca

SEQ ID NO: 918224 - DNA, 25 bp, Mus musculus
ttaatcattcagtcttccactcaca

SEQ ID NO: 918225 - DNA, 25 bp, Mus musculus
ttaatccaatggcttctgtacagta

SEQ ID NO: 918226 - DNA, 25 bp, Mus musculus
ttaatccaatgggttctgtacagta

SEQ ID NO: 918227 - DNA, 25 bp, Mus musculus
ttaatccagtaaaggctttctcctg

SEQ ID NO: 918228 - DNA, 25 bp, Mus musculus
ttaatccagtaatggctttctcctg

SEQ ID NO: 918229 - DNA, 25 bp, Mus musculus
ttaatccagtcaccttaccaagtca

SEQ ID NO: 918230 - DNA, 25 bp, Mus musculus
ttaatccagtcagcttaccaagtca

SEQ ID NO: 918231 - DNA, 25 bp, Mus musculus
ttaatccatcgtaaattgggtccaa

SEQ ID NO: 918232 - DNA, 25 bp, Mus musculus
ttaatccatcgttaattgggtccaa

SEQ ID NO: 918233 - DNA, 25 bp, Mus musculus
ttaatccatgttacttcaggttggg

SEQ ID NO: 918234 - DNA, 25 bp, Mus musculus
ttaatccatgtttcttcaggttggg

SEQ ID NO: 918235 - DNA, 25 bp, Mus musculus
ttaatcccaacacagcagagacagt

SEQ ID NO: 918236 - DNA, 25 bp, Mus musculus
ttaatcccaacagagcagagacagt

SEQ ID NO: 918237 - DNA, 25 bp, Mus musculus
ttaatcccaagaagtgacccaccac

SEQ ID NO: 918238 - DNA, 25 bp, Mus musculus
ttaatcccaagatgtgacccaccac

SEQ ID NO: 918239 - DNA, 25 bp, Mus musculus
ttaatcccagataggcaggtaaatc

SEQ ID NO: 918240 - DNA, 25 bp, Mus musculus
ttaatcccagattggcaggtaaatc

SEQ ID NO: 918241 - DNA, 25 bp, Mus musculus
ttaatcccagccctatgcggtggaa

SEQ ID NO: 918242 - DNA, 25 bp, Mus musculus
ttaatcccagccgtatgcggtggaa

SEQ ID NO: 918243 - DNA, 25 bp, Mus musculus
ttaatcccagcgactgaggtaggaa

SEQ ID NO: 918244 - DNA, 25 bp, Mus musculus
ttaatcccagcgtctgaggtaggaa

SEQ ID NO: 918245 - DNA, 25 bp, Mus musculus
ttaatcccaggacttattatgctga

SEQ ID NO: 918246 - DNA, 25 bp, Mus musculus
ttaatcccaggagttattatgctga

SEQ ID NO: 918247 - DNA, 25 bp, Mus musculus
ttaatcccagtaagggcagtggatc

SEQ ID NO: 918248 - DNA, 25 bp, Mus musculus
ttaatcccagtatgggcagtggatc

SEQ ID NO: 918249 - DNA, 25 bp, Mus musculus
ttaatccccaaaatcttccgtgatg

SEQ ID NO: 918250 - DNA, 25 bp, Mus musculus
ttaatccccaaattcttccgtgatg

SEQ ID NO: 918251 - DNA, 25 bp, Mus musculus
ttaatccccactattcaggccgtct

SEQ ID NO: 918252 - DNA, 25 bp, Mus musculus
ttaatccccacttttcaggccgtct

SEQ ID NO: 918253 - DNA, 25 bp, Mus musculus
ttaatccctagccttaagtaaacag

SEQ ID NO: 918254 - DNA, 25 bp, Mus musculus
ttaatccctagcgttaagtaaacag

SEQ ID NO: 918255 - DNA, 25 bp, Mus musculus
ttaatccctcaaacacattatctcc

SEQ ID NO: 918256 - DNA, 25 bp, Mus musculus
ttaatccctcaatcacattatctcc

SEQ ID NO: 918257 - DNA, 25 bp, Mus musculus
ttaatccctttcaagtcacaaacac

SEQ ID NO: 918258 - DNA, 25 bp, Mus musculus
ttaatccctttctagtcacaaacac

SEQ ID NO: 918259 - DNA, 25 bp, Mus musculus
ttaatccggaccagaccagagccag

SEQ ID NO: 918260 - DNA, 25 bp, Mus musculus
ttaatccggacctgaccagagccag

SEQ ID NO: 918261 - DNA, 25 bp, Mus musculus
ttaatccgttctccctagcttttta

SEQ ID NO: 918262 - DNA, 25 bp, Mus musculus
ttaatccgttctgcctagcttttta

SEQ ID NO: 918263 - DNA, 25 bp, Mus musculus
ttaatcctcgaacgtgggatgcaga

SEQ ID NO: 918264 - DNA, 25 bp, Mus musculus
ttaatcctcgaaggtgggatgcaga

SEQ ID NO: 918265 - DNA, 25 bp, Mus musculus
ttaatcctgatcacctgggtgtttt

SEQ ID NO: 918266 - DNA, 25 bp, Mus musculus
ttaatcctgatctcctgggtgtttt

SEQ ID NO: 918267 - DNA, 25 bp, Mus musculus
ttaatcctgcacctaagacttgagt

SEQ ID NO: 918268 - DNA, 25 bp, Mus musculus
ttaatcctgcacgtaagacttgagt

SEQ ID NO: 918269 - DNA, 25 bp, Mus musculus
ttaatcctgtcaattatgcctttgt

SEQ ID NO: 918270 - DNA, 25 bp, Mus musculus
ttaatcctgtcatttatgcctttgt

SEQ ID NO: 918271 - DNA, 25 bp, Mus musculus
ttaatccttcaaattcctagccttt

SEQ ID NO: 918272 - DNA, 25 bp, Mus musculus
ttaatccttcaatttcctagccttt

SEQ ID NO: 918273 - DNA, 25 bp, Mus musculus
ttaatcctttggcatggacgcgtct

SEQ ID NO: 918274 - DNA, 25 bp, Mus musculus
ttaatcctttgggatggacgcgtct

SEQ ID NO: 918275 - DNA, 25 bp, Mus musculus
ttaatcgacctcattcacaacccac

SEQ ID NO: 918276 - DNA, 25 bp, Mus musculus
ttaatcgacctctttcacaacccac

SEQ ID NO: 918277 - DNA, 25 bp, Mus musculus
ttaatcgagcatacaatcagggact

SEQ ID NO: 918278 - DNA, 25 bp, Mus musculus
ttaatcgagcattcaatcagggact

SEQ ID NO: 918279 - DNA, 25 bp, Mus musculus
ttaatcgcgggacgccccatgtgaa

SEQ ID NO: 918280 - DNA, 25 bp, Mus musculus
ttaatcgcgggaggccccatgtgaa

SEQ ID NO: 918281 - DNA, 25 bp, Mus musculus
ttaatcggcacacaagacaggcggc

SEQ ID NO: 918282 - DNA, 25 bp, Mus musculus
ttaatcggcacagaagacaggcggc

SEQ ID NO: 918283 - DNA, 25 bp, Mus musculus
ttaatcgtttccaaagcaatgcttg

SEQ ID NO: 918284 - DNA, 25 bp, Mus musculus
ttaatcgtttcctaagcaatgcttg

SEQ ID NO: 918285 - DNA, 25 bp, Mus musculus
ttaatctatggccacacaagacttc

SEQ ID NO: 918286 - DNA, 25 bp, Mus musculus
ttaatctatggcgacacaagacttc

SEQ ID NO: 918287 - DNA, 25 bp, Mus musculus
ttaatctcacaactttcgtccgggc

SEQ ID NO: 918288 - DNA, 25 bp, Mus musculus
ttaatctcacaagtttcgtccgggc

SEQ ID NO: 918289 - DNA, 25 bp, Mus musculus
ttaatctcagcacctttaatctctg

SEQ ID NO: 918290 - DNA, 25 bp, Mus musculus
ttaatctcagcagctttaatctctg

SEQ ID NO: 918291 - DNA, 25 bp, Mus musculus
ttaatctcagcgacacaggtggcag

SEQ ID NO: 918292 - DNA, 25 bp, Mus musculus
ttaatctcagcgtcacaggtggcag

SEQ ID NO: 918293 - DNA, 25 bp, Mus musculus
ttaatctctcatccagtacatcctg

SEQ ID NO: 918294 - DNA, 25 bp, Mus musculus
ttaatctctcatgcagtacatcctg

SEQ ID NO: 918295 - DNA, 25 bp, Mus musculus
ttaatctctcttatggaacgtctga

SEQ ID NO: 918296 - DNA, 25 bp, Mus musculus
ttaatctctcttttggaacgtctga

SEQ ID NO: 918297 - DNA, 25 bp, Mus musculus
ttaatctctgcaacaaagtttcttg

SEQ ID NO: 918298 - DNA, 25 bp, Mus musculus
ttaatctctgcatcaaagtttcttg

SEQ ID NO: 918299 - DNA, 25 bp, Mus musculus
ttaatctcttctcatagcctgtact

SEQ ID NO: 918300 - DNA, 25 bp, Mus musculus
ttaatctcttctgatagcctgtact

SEQ ID NO: 918301 - DNA, 25 bp, Mus musculus
ttaatctcttgaccagcatcctcac

SEQ ID NO: 918302 - DNA, 25 bp, Mus musculus
ttaatctcttgagcagcatcctcac

SEQ ID NO: 918303 - DNA, 25 bp, Mus musculus
ttaatctgacagagggtctcccacg

SEQ ID NO: 918304 - DNA, 25 bp, Mus musculus
ttaatctgacagtgggtctcccacg

SEQ ID NO: 918305 - DNA, 25 bp, Mus musculus
ttaatctgcatcaaaaactcacgtt

SEQ ID NO: 918306 - DNA, 25 bp, Mus musculus
ttaatctgcatctaaaactcacgtt

SEQ ID NO: 918307 - DNA, 25 bp, Mus musculus
ttaatctgccttactgtggtctgac

SEQ ID NO: 918308 - DNA, 25 bp, Mus musculus
ttaatctgcctttctgtggtctgac

SEQ ID NO: 918309 - DNA, 25 bp, Mus musculus
ttaatctgcgtactgcttaagacag

SEQ ID NO: 918310 - DNA, 25 bp, Mus musculus
ttaatctgcgtagtgcttaagacag

SEQ ID NO: 918311 - DNA, 25 bp, Mus musculus
ttaatctgcgtcaacattaccctgt

SEQ ID NO: 918312 - DNA, 25 bp, Mus musculus
ttaatctgcgtctacattaccctgt

SEQ ID NO: 918313 - DNA, 25 bp, Mus musculus
ttaatctggcgccatccttaaggaa

SEQ ID NO: 918314 - DNA, 25 bp, Mus musculus
ttaatctggcgcgatccttaaggaa

SEQ ID NO: 918315 - DNA, 25 bp, Mus musculus
ttaatctgggccaatgtgtgtgtgt

SEQ ID NO: 918316 - DNA, 25 bp, Mus musculus
ttaatctgggcctatgtgtgtgtgt

SEQ ID NO: 918317 - DNA, 25 bp, Mus musculus
ttaatctgtgttacattccggttcc

SEQ ID NO: 918318 - DNA, 25 bp, Mus musculus
ttaatctgtgtttcattccggttcc

SEQ ID NO: 918319 - DNA, 25 bp, Mus musculus
ttaatcttacatagttatggccaga

SEQ ID NO: 918320 - DNA, 25 bp, Mus musculus
ttaatcttacattgttatggccaga

SEQ ID NO: 918321 - DNA, 25 bp, Mus musculus
ttaatcttactgatccaataaaacc

SEQ ID NO: 918322 - DNA, 25 bp, Mus musculus
ttaatcttactgttccaataaaacc

SEQ ID NO: 918323 - DNA, 25 bp, Mus musculus
ttaatcttagcaatccagccagagg

SEQ ID NO: 918324 - DNA, 25 bp, Mus musculus
ttaatcttagcattccagccagagg

SEQ ID NO: 918325 - DNA, 25 bp, Mus musculus
ttaatcttcgccaagctcggagagg

SEQ ID NO: 918326 - DNA, 25 bp, Mus musculus
ttaatcttcgcctagctcggagagg

SEQ ID NO: 918327 - DNA, 25 bp, Mus musculus
ttaatcttctgacttcagctcgctg

SEQ ID NO: 918328 - DNA, 25 bp, Mus musculus
ttaatcttctgagttcagctcgctg

SEQ ID NO: 918329 - DNA, 25 bp, Mus musculus
ttaatcttcttactcaaatgctgga

SEQ ID NO: 918330 - DNA, 25 bp, Mus musculus
ttaatcttcttagtcaaatgctgga

SEQ ID NO: 918331 - DNA, 25 bp, Mus musculus
ttaatcttgatcatgttttggtgtg

SEQ ID NO: 918332 - DNA, 25 bp, Mus musculus
ttaatcttgatcttgttttggtgtg

SEQ ID NO: 918333 - DNA, 25 bp, Mus musculus
ttaatcttgttacctctggagtgtt

SEQ ID NO: 918334 - DNA, 25 bp, Mus musculus
ttaatcttgttagctctggagtgtt

SEQ ID NO: 918335 - DNA, 25 bp, Mus musculus
ttaatctttccgaaacttatacaag

SEQ ID NO: 918336 - DNA, 25 bp, Mus musculus
ttaatctttccgtaacttatacaag

SEQ ID NO: 918337 - DNA, 25 bp, Mus musculus
ttaatgaaattcctcctgaggctgg

SEQ ID NO: 918338 - DNA, 25 bp, Mus musculus
ttaatgaaattcgtcctgaggctgg

SEQ ID NO: 918339 - DNA, 25 bp, Mus musculus
ttaatgaaccggcttacccagtgct

SEQ ID NO: 918340 - DNA, 25 bp, Mus musculus
ttaatgaaccgggttacccagtgct

SEQ ID NO: 918341 - DNA, 25 bp, Mus musculus
ttaatgacagtcagctctggattac

SEQ ID NO: 918342 - DNA, 25 bp, Mus musculus
ttaatgacagtctgctctggattac

SEQ ID NO: 918343 - DNA, 25 bp, Mus musculus
ttaatgaccaaaaccctccgacttg

SEQ ID NO: 918344 - DNA, 25 bp, Mus musculus
ttaatgaccaaatccctccgacttg

SEQ ID NO: 918345 - DNA, 25 bp, Mus musculus
ttaatgaccaagacactagcacgtg

SEQ ID NO: 918346 - DNA, 25 bp, Mus musculus
ttaatgaccaagtcactagcacgtg

SEQ ID NO: 918347 - DNA, 25 bp, Mus musculus
ttaatgacccatactgagacctata

SEQ ID NO: 918348 - DNA, 25 bp, Mus musculus
ttaatgacccattctgagacctata

SEQ ID NO: 918349 - DNA, 25 bp, Mus musculus
ttaatgacctggcttgtacacacac

SEQ ID NO: 918350 - DNA, 25 bp, Mus musculus
ttaatgacctgggttgtacacacac

SEQ ID NO: 918351 - DNA, 25 bp, Mus musculus
ttaatgacttctagcaccatcttgc

SEQ ID NO: 918352 - DNA, 25 bp, Mus musculus
ttaatgacttcttgcaccatcttgc

SEQ ID NO: 918353 - DNA, 25 bp, Mus musculus
ttaatgagaactcggcagcacctgg

SEQ ID NO: 918354 - DNA, 25 bp, Mus musculus
ttaatgagaactgggcagcacctgg

SEQ ID NO: 918355 - DNA, 25 bp, Mus musculus
ttaatgagcacgcttcccagtttgc

SEQ ID NO: 918356 - DNA, 25 bp, Mus musculus
ttaatgagcacggttcccagtttgc

SEQ ID NO: 918357 - DNA, 25 bp, Mus musculus
ttaatgagtgtcctgcccatgagcc

SEQ ID NO: 918358 - DNA, 25 bp, Mus musculus
ttaatgagtgtcgtgcccatgagcc

SEQ ID NO: 918359 - DNA, 25 bp, Mus musculus
ttaatgagtttacggtgatagattc

SEQ ID NO: 918360 - DNA, 25 bp, Mus musculus
ttaatgagtttagggtgatagattc

SEQ ID NO: 918361 - DNA, 25 bp, Mus musculus
ttaatgagttttcccatctccacct

SEQ ID NO: 918362 - DNA, 25 bp, Mus musculus
ttaatgagttttgccatctccacct

SEQ ID NO: 918363 - DNA, 25 bp, Mus musculus
ttaatgatactccacccttcctggt

SEQ ID NO: 918364 - DNA, 25 bp, Mus musculus
ttaatgatactcgacccttcctggt

SEQ ID NO: 918365 - DNA, 25 bp, Mus musculus
ttaatgatggcaagatgggcgcaca

SEQ ID NO: 918366 - DNA, 25 bp, Mus musculus
ttaatgatggcatgatgggcgcaca

SEQ ID NO: 918367 - DNA, 25 bp, Mus musculus
ttaatgatttatcttcttgttttcc

SEQ ID NO: 918368 - DNA, 25 bp, Mus musculus
ttaatgatttatgttcttgttttcc

SEQ ID NO: 918369 - DNA, 25 bp, Mus musculus
ttaatgcagaaacagaccttgaaag

SEQ ID NO: 918370 - DNA, 25 bp, Mus musculus
ttaatgcagaaagagaccttgaaag

SEQ ID NO: 918371 - DNA, 25 bp, Mus musculus
ttaatgcagcataagtagggaccag

SEQ ID NO: 918372 - DNA, 25 bp, Mus musculus
ttaatgcagcattagtagggaccag

SEQ ID NO: 918373 - DNA, 25 bp, Mus musculus
ttaatgcagctgacgaccccttggt

SEQ ID NO: 918374 - DNA, 25 bp, Mus musculus
ttaatgcagctgaggactgaggtgt

SEQ ID NO: 918375 - DNA, 25 bp, Mus musculus
ttaatgcagctgtcgaccccttggt

SEQ ID NO: 918376 - DNA, 25 bp, Mus musculus
ttaatgcagctgtggactgaggtgt

SEQ ID NO: 918377 - DNA, 25 bp, Mus musculus
ttaatgcatgctagtgttggtgttt

SEQ ID NO: 918378 - DNA, 25 bp, Mus musculus
ttaatgcatgcttgtgttggtgttt

SEQ ID NO: 918379 - DNA, 25 bp, Mus musculus
ttaatgcattggcttcccatggcag

SEQ ID NO: 918380 - DNA, 25 bp, Mus musculus
ttaatgcattgggttcccatggcag

SEQ ID NO: 918381 - DNA, 25 bp, Mus musculus
ttaatgccggccatcacagccataa

SEQ ID NO: 918382 - DNA, 25 bp, Mus musculus
ttaatgccggccttcacagccataa

SEQ ID NO: 918383 - DNA, 25 bp, Mus musculus
ttaatgccgggtactcagccatcta

SEQ ID NO: 918384 - DNA, 25 bp, Mus musculus
ttaatgccgggttctcagccatcta

SEQ ID NO: 918385 - DNA, 25 bp, Mus musculus
ttaatgcctacccatgtgttccatc

SEQ ID NO: 918386 - DNA, 25 bp, Mus musculus
ttaatgcctaccgatgtgttccatc

SEQ ID NO: 918387 - DNA, 25 bp, Mus musculus
ttaatgcctgcaacatgagccagat

SEQ ID NO: 918388 - DNA, 25 bp, Mus musculus
ttaatgcctgcaaccagggagacag

SEQ ID NO: 918389 - DNA, 25 bp, Mus musculus
ttaatgcctgcatcatgagccagat

SEQ ID NO: 918390 - DNA, 25 bp, Mus musculus
ttaatgcctgcatccagggagacag

SEQ ID NO: 918391 - DNA, 25 bp, Mus musculus
ttaatgccttaaaatgcctcatggg

SEQ ID NO: 918392 - DNA, 25 bp, Mus musculus
ttaatgccttaatatgcctcatggg

SEQ ID NO: 918393 - DNA, 25 bp, Mus musculus
ttaatgcgcagaagccgatccaggc

SEQ ID NO: 918394 - DNA, 25 bp, Mus musculus
ttaatgcgcagatgccgatccaggc

SEQ ID NO: 918395 - DNA, 25 bp, Mus musculus
ttaatgctaaccaacactttcagaa

SEQ ID NO: 918396 - DNA, 25 bp, Mus musculus
ttaatgctaacctacactttcagaa

SEQ ID NO: 918397 - DNA, 25 bp, Mus musculus
ttaatgctatgcaccatcatgccca

SEQ ID NO: 918398 - DNA, 25 bp, Mus musculus
ttaatgctatgctccatcatgccca

SEQ ID NO: 918399 - DNA, 25 bp, Mus musculus
ttaatgctgccccttgtaaagtagg

SEQ ID NO: 918400 - DNA, 25 bp, Mus musculus
ttaatgctgcccgttgtaaagtagg

SEQ ID NO: 918401 - DNA, 25 bp, Mus musculus
ttaatgctgcctaaacagttcggcc

SEQ ID NO: 918402 - DNA, 25 bp, Mus musculus
ttaatgctgccttaacagttcggcc

SEQ ID NO: 918403 - DNA, 25 bp, Mus musculus
ttaatgctgtgccactgctaaactg

SEQ ID NO: 918404 - DNA, 25 bp, Mus musculus
ttaatgctgtgcgactgctaaactg

SEQ ID NO: 918405 - DNA, 25 bp, Mus musculus
ttaatgcttagcacttatttttaaa

SEQ ID NO: 918406 - DNA, 25 bp, Mus musculus
ttaatgcttagctcttatttttaaa

SEQ ID NO: 918407 - DNA, 25 bp, Mus musculus
ttaatgcttgccaggcccttttcct

SEQ ID NO: 918408 - DNA, 25 bp, Mus musculus
ttaatgcttgcctggcccttttcct

SEQ ID NO: 918409 - DNA, 25 bp, Mus musculus
ttaatggaaatgatcattcctcagt

SEQ ID NO: 918410 - DNA, 25 bp, Mus musculus
ttaatggaaatgttcattcctcagt

SEQ ID NO: 918411 - DNA, 25 bp, Mus musculus
ttaatggaccaaatttcgtgtttgt

SEQ ID NO: 918412 - DNA, 25 bp, Mus musculus
ttaatggaccaattttcgtgtttgt

SEQ ID NO: 918413 - DNA, 25 bp, Mus musculus
ttaatggatccacccatgtactaag

SEQ ID NO: 918414 - DNA, 25 bp, Mus musculus
ttaatggatccagccatgtactaag

SEQ ID NO: 918415 - DNA, 25 bp, Mus musculus
ttaatggcagttcctccgaaagcac

SEQ ID NO: 918416 - DNA, 25 bp, Mus musculus
ttaatggcagttgctccgaaagcac

SEQ ID NO: 918417 - DNA, 25 bp, Mus musculus
ttaatggcattcaccttcctggcag

SEQ ID NO: 918418 - DNA, 25 bp, Mus musculus
ttaatggcattctccttcctggcag

SEQ ID NO: 918419 - DNA, 25 bp, Mus musculus
ttaatggcccacctgagcaggatcg

SEQ ID NO: 918420 - DNA, 25 bp, Mus musculus
ttaatggcccacgtgagcaggatcg

SEQ ID NO: 918421 - DNA, 25 bp, Mus musculus
ttaatggcctgtccacacaaccttt

SEQ ID NO: 918422 - DNA, 25 bp, Mus musculus
ttaatggcctgtgcacacaaccttt

SEQ ID NO: 918423 - DNA, 25 bp, Mus musculus
ttaatggcttccaagtggcacccag

SEQ ID NO: 918424 - DNA, 25 bp, Mus musculus
ttaatggcttcctagtggcacccag

SEQ ID NO: 918425 - DNA, 25 bp, Mus musculus
ttaatgggacatagactctgaatat

SEQ ID NO: 918426 - DNA, 25 bp, Mus musculus
ttaatgggacattgactctgaatat

SEQ ID NO: 918427 - DNA, 25 bp, Mus musculus
ttaatgggaccaagtgtcacacgaa

SEQ ID NO: 918428 - DNA, 25 bp, Mus musculus
ttaatgggaccatgtgtcacacgaa

SEQ ID NO: 918429 - DNA, 25 bp, Mus musculus
ttaatgggactgctggcttatgaca

SEQ ID NO: 918430 - DNA, 25 bp, Mus musculus
ttaatgggactggtggcttatgaca

SEQ ID NO: 918431 - DNA, 25 bp, Mus musculus
ttaatgggatcgaccagcccttctc

SEQ ID NO: 918432 - DNA, 25 bp, Mus musculus
ttaatgggatcgtccagcccttctc

SEQ ID NO: 918433 - DNA, 25 bp, Mus musculus
ttaatgggcctgcaggtggtacaaa

SEQ ID NO: 918434 - DNA, 25 bp, Mus musculus
ttaatgggcctggaggtggtacaaa

SEQ ID NO: 918435 - DNA, 25 bp, Mus musculus
ttaatgggctatcggaggcagccta

SEQ ID NO: 918436 - DNA, 25 bp, Mus musculus
ttaatgggctatgggaggcagccta

SEQ ID NO: 918437 - DNA, 25 bp, Mus musculus
ttaatgggtaaaccctgtcctctcc

SEQ ID NO: 918438 - DNA, 25 bp, Mus musculus
ttaatgggtaaagcctgtcctctcc

SEQ ID NO: 918439 - DNA, 25 bp, Mus musculus
ttaatggtactgagggagctgtgca

SEQ ID NO: 918440 - DNA, 25 bp, Mus musculus
ttaatggtactgtgggagctgtgca

SEQ ID NO: 918441 - DNA, 25 bp, Mus musculus
ttaatggtcactatgtcatcctgtt

SEQ ID NO: 918442 - DNA, 25 bp, Mus musculus
ttaatggtcactttgtcatcctgtt

SEQ ID NO: 918443 - DNA, 25 bp, Mus musculus
ttaatggtcatgctgccgcaggatg

SEQ ID NO: 918444 - DNA, 25 bp, Mus musculus
ttaatggtcatggtgccgcaggatg

SEQ ID NO: 918445 - DNA, 25 bp, Mus musculus
ttaatggtctcaagcataggaatgc

SEQ ID NO: 918446 - DNA, 25 bp, Mus musculus
ttaatggtctcatgcataggaatgc

SEQ ID NO: 918447 - DNA, 25 bp, Mus musculus
ttaatggttgctctctgaaaactga

SEQ ID NO: 918448 - DNA, 25 bp, Mus musculus
ttaatggttgctgtctgaaaactga

SEQ ID NO: 918449 - DNA, 25 bp, Mus musculus
ttaatgtaaccccttgatcccaaca

SEQ ID NO: 918450 - DNA, 25 bp, Mus musculus
ttaatgtaacccgttgatcccaaca

SEQ ID NO: 918451 - DNA, 25 bp, Mus musculus
ttaatgtaacgaccggtgtgcttca

SEQ ID NO: 918452 - DNA, 25 bp, Mus musculus
ttaatgtaacgagcggtgtgcttca

SEQ ID NO: 918453 - DNA, 25 bp, Mus musculus
ttaatgtaacttcatctcactgctg

SEQ ID NO: 918454 - DNA, 25 bp, Mus musculus
ttaatgtaacttgatctcactgctg

SEQ ID NO: 918455 - DNA, 25 bp, Mus musculus
ttaatgtacatgattccctttcagt

SEQ ID NO: 918456 - DNA, 25 bp, Mus musculus
ttaatgtacatgtttccctttcagt

SEQ ID NO: 918457 - DNA, 25 bp, Mus musculus
ttaatgtagcttcgcttgctttccc

SEQ ID NO: 918458 - DNA, 25 bp, Mus musculus
ttaatgtagcttggcttgctttccc

SEQ ID NO: 918459 - DNA, 25 bp, Mus musculus
ttaatgtagtttattggcaatgcca

SEQ ID NO: 918460 - DNA, 25 bp, Mus musculus
ttaatgtagttttttggcaatgcca

SEQ ID NO: 918461 - DNA, 25 bp, Mus musculus
ttaatgtatgttcctaagagtagct

SEQ ID NO: 918462 - DNA, 25 bp, Mus musculus
ttaatgtatgttgctaagagtagct

SEQ ID NO: 918463 - DNA, 25 bp, Mus musculus
ttaatgtcccttccttgagacccat

SEQ ID NO: 918464 - DNA, 25 bp, Mus musculus
ttaatgtcccttgcttgagacccat

SEQ ID NO: 918465 - DNA, 25 bp, Mus musculus
ttaatgtcgagccaggccctggata

SEQ ID NO: 918466 - DNA, 25 bp, Mus musculus
ttaatgtcgagcgaggccctggata

SEQ ID NO: 918467 - DNA, 25 bp, Mus musculus
ttaatgtctcttctgtctgtacgga

SEQ ID NO: 918468 - DNA, 25 bp, Mus musculus
ttaatgtctcttgtgtctgtacgga

SEQ ID NO: 918469 - DNA, 25 bp, Mus musculus
ttaatgtgacagatttatggatttt

SEQ ID NO: 918470 - DNA, 25 bp, Mus musculus
ttaatgtgacagttttatggatttt

SEQ ID NO: 918471 - DNA, 25 bp, Mus musculus
ttaatgtgacgcctccaggtgacct

SEQ ID NO: 918472 - DNA, 25 bp, Mus musculus
ttaatgtgacgcgtccaggtgacct

SEQ ID NO: 918473 - DNA, 25 bp, Mus musculus
ttaatgtgatccagaggcttagcaa

SEQ ID NO: 918474 - DNA, 25 bp, Mus musculus
ttaatgtgatcctgaggcttagcaa

SEQ ID NO: 918475 - DNA, 25 bp, Mus musculus
ttaatgtgcctacctaaccaggagg

SEQ ID NO: 918476 - DNA, 25 bp, Mus musculus
ttaatgtgcctagctaaccaggagg

SEQ ID NO: 918477 - DNA, 25 bp, Mus musculus
ttaatgtgtgtccttccaaaccacc

SEQ ID NO: 918478 - DNA, 25 bp, Mus musculus
ttaatgtgtgtcgttccaaaccacc

SEQ ID NO: 918479 - DNA, 25 bp, Mus musculus
ttaatgtgtgtgaccgtccttcatg

SEQ ID NO: 918480 - DNA, 25 bp, Mus musculus
ttaatgtgtgtgtccgtccttcatg

SEQ ID NO: 918481 - DNA, 25 bp, Mus musculus
ttaatgttcatgagctctactctaa

SEQ ID NO: 918482 - DNA, 25 bp, Mus musculus
ttaatgttcatgtgctctactctaa

SEQ ID NO: 918483 - DNA, 25 bp, Mus musculus
ttaatgttctctatcgtatcgatgt

SEQ ID NO: 918484 - DNA, 25 bp, Mus musculus
ttaatgttctctttcgtatcgatgt

SEQ ID NO: 918485 - DNA, 25 bp, Mus musculus
ttaatgttgttgctgtctccagccc

SEQ ID NO: 918486 - DNA, 25 bp, Mus musculus
ttaatgttgttggtgtctccagccc

SEQ ID NO: 918487 - DNA, 25 bp, Mus musculus
ttaatgtttacaccgcgggctccat

SEQ ID NO: 918488 - DNA, 25 bp, Mus musculus
ttaatgtttacagcgcgggctccat

SEQ ID NO: 918489 - DNA, 25 bp, Mus musculus
ttaatgtttactatgcttgcttttt

SEQ ID NO: 918490 - DNA, 25 bp, Mus musculus
ttaatgtttactttgcttgcttttt

SEQ ID NO: 918491 - DNA, 25 bp, Mus musculus
ttaatgtttatgcagttcattggtc

SEQ ID NO: 918492 - DNA, 25 bp, Mus musculus
ttaatgtttatggagttcattggtc

SEQ ID NO: 918493 - DNA, 25 bp, Mus musculus
ttaatgtttattcctgtgctgtgcg

SEQ ID NO: 918494 - DNA, 25 bp, Mus musculus
ttaatgtttattgctgtgctgtgcg

SEQ ID NO: 918495 - DNA, 25 bp, Mus musculus
ttaatgtttcgtcggcggaagtcgc

SEQ ID NO: 918496 - DNA, 25 bp, Mus musculus
ttaatgtttcgtgggcggaagtcgc

SEQ ID NO: 918497 - DNA, 25 bp, Mus musculus
ttaatgttttggcacttgatttttt

SEQ ID NO: 918498 - DNA, 25 bp, Mus musculus
ttaatgttttgggacttgatttttt

SEQ ID NO: 918499 - DNA, 25 bp, Mus musculus
ttaattaagccaattccctaccgtg

SEQ ID NO: 918500 - DNA, 25 bp, Mus musculus
ttaattaagccatttccctaccgtg

SEQ ID NO: 918501 - DNA, 25 bp, Mus musculus
ttaattaatacccactagcacctca

SEQ ID NO: 918502 - DNA, 25 bp, Mus musculus
ttaattaataccgactagcacctca

SEQ ID NO: 918503 - DNA, 25 bp, Mus musculus
ttaattaatactaggctgaactgga

SEQ ID NO: 918504 - DNA, 25 bp, Mus musculus
ttaattaatacttggctgaactgga

SEQ ID NO: 918505 - DNA, 25 bp, Mus musculus
ttaattaattgcattttcagacaag

SEQ ID NO: 918506 - DNA, 25 bp, Mus musculus
ttaattaattgctttttcagacaag

SEQ ID NO: 918507 - DNA, 25 bp, Mus musculus
ttaattacaactcggcagggtggct

SEQ ID NO: 918508 - DNA, 25 bp, Mus musculus
ttaattacaactgggcagggtggct

SEQ ID NO: 918509 - DNA, 25 bp, Mus musculus
ttaattactgctatgtttcttccca

SEQ ID NO: 918510 - DNA, 25 bp, Mus musculus
ttaattactgctttgtttcttccca

SEQ ID NO: 918511 - DNA, 25 bp, Mus musculus
ttaattactgtaagtcgtgagacac

SEQ ID NO: 918512 - DNA, 25 bp, Mus musculus
ttaattactgtatgtcgtgagacac

SEQ ID NO: 918513 - DNA, 25 bp, Mus musculus
ttaattactgtcacaccacttttcc

SEQ ID NO: 918514 - DNA, 25 bp, Mus musculus
ttaattactgtctcaccacttttcc

SEQ ID NO: 918515 - DNA, 25 bp, Mus musculus
ttaattagcataagtgtggaccaca

SEQ ID NO: 918516 - DNA, 25 bp, Mus musculus
ttaattagcatatgtgtggaccaca

SEQ ID NO: 918517 - DNA, 25 bp, Mus musculus
ttaattaggtcccatctgctcatcc

SEQ ID NO: 918518 - DNA, 25 bp, Mus musculus
ttaattaggtccgatctgctcatcc

SEQ ID NO: 918519 - DNA, 25 bp, Mus musculus
ttaattagtcaaaaagtcccgagct

SEQ ID NO: 918520 - DNA, 25 bp, Mus musculus
ttaattagtcaataagtcccgagct

SEQ ID NO: 918521 - DNA, 25 bp, Mus musculus
ttaattatgttgatttgaggtgtcc

SEQ ID NO: 918522 - DNA, 25 bp, Mus musculus
ttaattatgttgttttgaggtgtcc

SEQ ID NO: 918523 - DNA, 25 bp, Mus musculus
ttaattcacaacagacactttccct

SEQ ID NO: 918524 - DNA, 25 bp, Mus musculus
ttaattcacaactgacactttccct

SEQ ID NO: 918525 - DNA, 25 bp, Mus musculus
ttaattcactcccagagccatttgg

SEQ ID NO: 918526 - DNA, 25 bp, Mus musculus
ttaattcactccgagagccatttgg

SEQ ID NO: 918527 - DNA, 25 bp, Mus musculus
ttaattcacttaactactagccaat

SEQ ID NO: 918528 - DNA, 25 bp, Mus musculus
ttaattcacttatctactagccaat

SEQ ID NO: 918529 - DNA, 25 bp, Mus musculus
ttaattcactttatgaggatgcctg

SEQ ID NO: 918530 - DNA, 25 bp, Mus musculus
ttaattcactttttgaggatgcctg

SEQ ID NO: 918531 - DNA, 25 bp, Mus musculus
ttaattcagctacagattctccttt

SEQ ID NO: 918532 - DNA, 25 bp, Mus musculus
ttaattcagctagagattctccttt

SEQ ID NO: 918533 - DNA, 25 bp, Mus musculus
ttaattcattgcaagagtgtccctc

SEQ ID NO: 918534 - DNA, 25 bp, Mus musculus
ttaattcattgctagagtgtccctc

SEQ ID NO: 918535 - DNA, 25 bp, Mus musculus
ttaattcccaacaacagaccgcttc

SEQ ID NO: 918536 - DNA, 25 bp, Mus musculus
ttaattcccaactacagaccgcttc

SEQ ID NO: 918537 - DNA, 25 bp, Mus musculus
ttaattcccctgagcacacagttct

SEQ ID NO: 918538 - DNA, 25 bp, Mus musculus
ttaattcccctgtgcacacagttct

SEQ ID NO: 918539 - DNA, 25 bp, Mus musculus
ttaattccccttccactgtgggaag

SEQ ID NO: 918540 - DNA, 25 bp, Mus musculus
ttaattccccttgcactgtgggaag

SEQ ID NO: 918541 - DNA, 25 bp, Mus musculus
ttaattcccttcaggttccgtgtca

SEQ ID NO: 918542 - DNA, 25 bp, Mus musculus
ttaattcccttctggttccgtgtca

SEQ ID NO: 918543 - DNA, 25 bp, Mus musculus
ttaattccgattaatctctgggcat

SEQ ID NO: 918544 - DNA, 25 bp, Mus musculus
ttaattccgatttatctctgggcat

SEQ ID NO: 918545 - DNA, 25 bp, Mus musculus
ttaattcctactccctaattccatc

SEQ ID NO: 918546 - DNA, 25 bp, Mus musculus
ttaattcctactgcctaattccatc

SEQ ID NO: 918547 - DNA, 25 bp, Mus musculus
ttaattcctcctaggacaacaacaa

SEQ ID NO: 918548 - DNA, 25 bp, Mus musculus
ttaattcctccttggacaacaacaa

SEQ ID NO: 918549 - DNA, 25 bp, Mus musculus
ttaattcctctactgtttttcaaat

SEQ ID NO: 918550 - DNA, 25 bp, Mus musculus
ttaattcctctagtgtttttcaaat

SEQ ID NO: 918551 - DNA, 25 bp, Mus musculus
ttaattcctgagaccagagagacag

SEQ ID NO: 918552 - DNA, 25 bp, Mus musculus
ttaattcctgagaccctgcagtgtc

SEQ ID NO: 918553 - DNA, 25 bp, Mus musculus
ttaattcctgagtccagagagacag

SEQ ID NO: 918554 - DNA, 25 bp, Mus musculus
ttaattcctgagtccctgcagtgtc

SEQ ID NO: 918555 - DNA, 25 bp, Mus musculus
ttaattcgacgtatgcagaccagga

SEQ ID NO: 918556 - DNA, 25 bp, Mus musculus
ttaattcgacgtttgcagaccagga

SEQ ID NO: 918557 - DNA, 25 bp, Mus musculus
ttaattcgatgaaagctctcttagt

SEQ ID NO: 918558 - DNA, 25 bp, Mus musculus
ttaattcgatgatagctctcttagt

SEQ ID NO: 918559 - DNA, 25 bp, Mus musculus
ttaattcgccatcccctaaaaggag

SEQ ID NO: 918560 - DNA, 25 bp, Mus musculus
ttaattcgccatgccctaaaaggag

SEQ ID NO: 918561 - DNA, 25 bp, Mus musculus
ttaattctaattactggctcctcag

SEQ ID NO: 918562 - DNA, 25 bp, Mus musculus
ttaattctaatttctggctcctcag

SEQ ID NO: 918563 - DNA, 25 bp, Mus musculus
ttaattctagccacactgcccatat

SEQ ID NO: 918564 - DNA, 25 bp, Mus musculus
ttaattctagcctcactgcccatat

SEQ ID NO: 918565 - DNA, 25 bp, Mus musculus
ttaattctatgccaacctggtctgc

SEQ ID NO: 918566 - DNA, 25 bp, Mus musculus
ttaattctatgcgaacctggtctgc

SEQ ID NO: 918567 - DNA, 25 bp, Mus musculus
ttaattctccctcaattgctttacc

SEQ ID NO: 918568 - DNA, 25 bp, Mus musculus
ttaattctccctgaattgctttacc

SEQ ID NO: 918569 - DNA, 25 bp, Mus musculus
ttaattctgctaaactaatctctag

SEQ ID NO: 918570 - DNA, 25 bp, Mus musculus
ttaattctgctatactaatctctag

SEQ ID NO: 918571 - DNA, 25 bp, Mus musculus
ttaattctggaacccttcccagagg

SEQ ID NO: 918572 - DNA, 25 bp, Mus musculus
ttaattctggaagccttcccagagg

SEQ ID NO: 918573 - DNA, 25 bp, Mus musculus
ttaattcttcagagccagcagcatt

SEQ ID NO: 918574 - DNA, 25 bp, Mus musculus
ttaattcttcagtgccagcagcatt

SEQ ID NO: 918575 - DNA, 25 bp, Mus musculus
ttaattcttgaaccggtgtgggtgc

SEQ ID NO: 918576 - DNA, 25 bp, Mus musculus
ttaattcttgaagcggtgtgggtgc

SEQ ID NO: 918577 - DNA, 25 bp, Mus musculus
ttaattctttctatgcctccgaggc

SEQ ID NO: 918578 - DNA, 25 bp, Mus musculus
ttaattctttctttgcctccgaggc

SEQ ID NO: 918579 - DNA, 25 bp, Mus musculus
ttaattcttttgagtccttattcag

SEQ ID NO: 918580 - DNA, 25 bp, Mus musculus
ttaattcttttgtgtccttattcag

SEQ ID NO: 918581 - DNA, 25 bp, Mus musculus
ttaattgaactcaccctgtgtgtga

SEQ ID NO: 918582 - DNA, 25 bp, Mus musculus
ttaattgaactctccctgtgtgtga

SEQ ID NO: 918583 - DNA, 25 bp, Mus musculus
ttaattgacccaagcaacccttatc

SEQ ID NO: 918584 - DNA, 25 bp, Mus musculus
ttaattgacccatgcaacccttatc

SEQ ID NO: 918585 - DNA, 25 bp, Mus musculus
ttaattgagactcgctttcagtcct

SEQ ID NO: 918586 - DNA, 25 bp, Mus musculus
ttaattgagactggctttcagtcct

SEQ ID NO: 918587 - DNA, 25 bp, Mus musculus
ttaattgagcttatgccagtctgtc

SEQ ID NO: 918588 - DNA, 25 bp, Mus musculus
ttaattgagcttttgccagtctgtc

SEQ ID NO: 918589 - DNA, 25 bp, Mus musculus
ttaattgatacactgacctggccca

SEQ ID NO: 918590 - DNA, 25 bp, Mus musculus
ttaattgatacagtgacctggccca

SEQ ID NO: 918591 - DNA, 25 bp, Mus musculus
ttaattgcactcagtttttgtcaaa

SEQ ID NO: 918592 - DNA, 25 bp, Mus musculus
ttaattgcactctgtttttgtcaaa

SEQ ID NO: 918593 - DNA, 25 bp, Mus musculus
ttaattgccaggaagttcccatctc

SEQ ID NO: 918594 - DNA, 25 bp, Mus musculus
ttaattgccaggtagttcccatctc

SEQ ID NO: 918595 - DNA, 25 bp, Mus musculus
ttaattgccctcacagctaacattt

SEQ ID NO: 918596 - DNA, 25 bp, Mus musculus
ttaattgccctctcagctaacattt

SEQ ID NO: 918597 - DNA, 25 bp, Mus musculus
ttaattgctaagacccacatccatc

SEQ ID NO: 918598 - DNA, 25 bp, Mus musculus
ttaattgctaagtcccacatccatc

SEQ ID NO: 918599 - DNA, 25 bp, Mus musculus
ttaattgctatacggtttctggctt

SEQ ID NO: 918600 - DNA, 25 bp, Mus musculus
ttaattgctatagggtttctggctt

SEQ ID NO: 918601 - DNA, 25 bp, Mus musculus
ttaattgctctgaaggttggacccg

SEQ ID NO: 918602 - DNA, 25 bp, Mus musculus
ttaattgctctgtaggttggacccg

SEQ ID NO: 918603 - DNA, 25 bp, Mus musculus
ttaattgctgagatggcgatttctg

SEQ ID NO: 918604 - DNA, 25 bp, Mus musculus
ttaattgctgagttggcgatttctg

SEQ ID NO: 918605 - DNA, 25 bp, Mus musculus
ttaattggatctctattgtgaagaa

SEQ ID NO: 918606 - DNA, 25 bp, Mus musculus
ttaattggatctgtattgtgaagaa

SEQ ID NO: 918607 - DNA, 25 bp, Mus musculus
ttaattggcttgcgttttagatatt

SEQ ID NO: 918608 - DNA, 25 bp, Mus musculus
ttaattggcttgggttttagatatt

SEQ ID NO: 918609 - DNA, 25 bp, Mus musculus
ttaattgggcttccacagaaaagct

SEQ ID NO: 918610 - DNA, 25 bp, Mus musculus
ttaattgggcttgcacagaaaagct

SEQ ID NO: 918611 - DNA, 25 bp, Mus musculus
ttaattgtaccaagaagaagagcac

SEQ ID NO: 918612 - DNA, 25 bp, Mus musculus
ttaattgtaccatgaagaagagcac

SEQ ID NO: 918613 - DNA, 25 bp, Mus musculus
ttaattgtagagatttgaacccgat

SEQ ID NO: 918614 - DNA, 25 bp, Mus musculus
ttaattgtagagttttgaacccgat

SEQ ID NO: 918615 - DNA, 25 bp, Mus musculus
ttaattgtaggtatccaaggattct

SEQ ID NO: 918616 - DNA, 25 bp, Mus musculus
ttaattgtaggtttccaaggattct

SEQ ID NO: 918617 - DNA, 25 bp, Mus musculus
ttaattgtccttcctgttactcgct

SEQ ID NO: 918618 - DNA, 25 bp, Mus musculus
ttaattgtccttgctgttactcgct

SEQ ID NO: 918619 - DNA, 25 bp, Mus musculus
ttaattgtgaggcttatttctttcc

SEQ ID NO: 918620 - DNA, 25 bp, Mus musculus
ttaattgtgagggttatttctttcc

SEQ ID NO: 918621 - DNA, 25 bp, Mus musculus
ttaattgtgcctcccagccatctga

SEQ ID NO: 918622 - DNA, 25 bp, Mus musculus
ttaattgtgcctgccagccatctga

SEQ ID NO: 918623 - DNA, 25 bp, Mus musculus
ttaattgtggataccatcctcccca

SEQ ID NO: 918624 - DNA, 25 bp, Mus musculus
ttaattgtggattccatcctcccca

SEQ ID NO: 918625 - DNA, 25 bp, Mus musculus
ttaattgtgtctcttgtcctgtgca

SEQ ID NO: 918626 - DNA, 25 bp, Mus musculus
ttaattgtgtctgttgtcctgtgca

SEQ ID NO: 918627 - DNA, 25 bp, Mus musculus
ttaattgttcttctttccactgccg

SEQ ID NO: 918628 - DNA, 25 bp, Mus musculus
ttaattgttcttgtttccactgccg

SEQ ID NO: 918629 - DNA, 25 bp, Mus musculus
ttaattgttgctcggcttgttcttc

SEQ ID NO: 918630 - DNA, 25 bp, Mus musculus
ttaattgttgctgggcttgttcttc

SEQ ID NO: 918631 - DNA, 25 bp, Mus musculus
ttaatttaaaccagctgacccgcac

SEQ ID NO: 918632 - DNA, 25 bp, Mus musculus
ttaatttaaacctgctgacccgcac

SEQ ID NO: 918633 - DNA, 25 bp, Mus musculus
ttaatttaacctaagctctgacgtg

SEQ ID NO: 918634 - DNA, 25 bp, Mus musculus
ttaatttaaccttagctctgacgtg

SEQ ID NO: 918635 - DNA, 25 bp, Mus musculus
ttaatttaggtcctcttccctcttg

SEQ ID NO: 918636 - DNA, 25 bp, Mus musculus
ttaatttaggtcgtcttccctcttg

SEQ ID NO: 918637 - DNA, 25 bp, Mus musculus
ttaatttataatcctccgtcccctc

SEQ ID NO: 918638 - DNA, 25 bp, Mus musculus
ttaatttataatgctccgtcccctc

SEQ ID NO: 918639 - DNA, 25 bp, Mus musculus
ttaatttattaaaggacctgttggg

SEQ ID NO: 918640 - DNA, 25 bp, Mus musculus
ttaatttattaatggacctgttggg

SEQ ID NO: 918641 - DNA, 25 bp, Mus musculus
ttaatttatttcactgctgtttcag

SEQ ID NO: 918642 - DNA, 25 bp, Mus musculus
ttaatttatttctctgctgtttcag

SEQ ID NO: 918643 - DNA, 25 bp, Mus musculus
ttaatttccaccacccataagttca

SEQ ID NO: 918644 - DNA, 25 bp, Mus musculus
ttaatttccacctcccataagttca

SEQ ID NO: 918645 - DNA, 25 bp, Mus musculus
ttaatttccgctctagccggaccaa

SEQ ID NO: 918646 - DNA, 25 bp, Mus musculus
ttaatttccgctgtagccggaccaa

SEQ ID NO: 918647 - DNA, 25 bp, Mus musculus
ttaatttctatgacaccccatacac

SEQ ID NO: 918648 - DNA, 25 bp, Mus musculus
ttaatttctatgtcaccccatacac

SEQ ID NO: 918649 - DNA, 25 bp, Mus musculus
ttaatttctcagatgactatttttt

SEQ ID NO: 918650 - DNA, 25 bp, Mus musculus
ttaatttctcagttgactatttttt

SEQ ID NO: 918651 - DNA, 25 bp, Mus musculus
ttaatttctcataccatcctgagcc

SEQ ID NO: 918652 - DNA, 25 bp, Mus musculus
ttaatttctcattccatcctgagcc

SEQ ID NO: 918653 - DNA, 25 bp, Mus musculus
ttaatttctgtgactttcagtggtg

SEQ ID NO: 918654 - DNA, 25 bp, Mus musculus
ttaatttctgtgtctttcagtggtg

SEQ ID NO: 918655 - DNA, 25 bp, Mus musculus
ttaatttgaccgactactccaatcc

SEQ ID NO: 918656 - DNA, 25 bp, Mus musculus
ttaatttgaccgtctactccaatcc

SEQ ID NO: 918657 - DNA, 25 bp, Mus musculus
ttaatttgagaaccctttctgcgtc

SEQ ID NO: 918658 - DNA, 25 bp, Mus musculus
ttaatttgagaagcctttctgcgtc

SEQ ID NO: 918659 - DNA, 25 bp, Mus musculus
ttaatttgagctcatttctctcctc

SEQ ID NO: 918660 - DNA, 25 bp, Mus musculus
ttaatttgagctgatttctctcctc

SEQ ID NO: 918661 - DNA, 25 bp, Mus musculus
ttaatttgtaagcagcaaccagcat

SEQ ID NO: 918662 - DNA, 25 bp, Mus musculus
ttaatttgtaaggagcaaccagcat

SEQ ID NO: 918663 - DNA, 25 bp, Mus musculus
ttaattttccacctttgtgtgagtg

SEQ ID NO: 918664 - DNA, 25 bp, Mus musculus
ttaattttccacgtttgtgtgagtg

SEQ ID NO: 918665 - DNA, 25 bp, Mus musculus
ttaattttcttaagtgcacatggct

SEQ ID NO: 918666 - DNA, 25 bp, Mus musculus
ttaattttcttatgtgcacatggct

SEQ ID NO: 918667 - DNA, 25 bp, Mus musculus
ttaattttcttcactgtattgacaa

SEQ ID NO: 918668 - DNA, 25 bp, Mus musculus
ttaattttcttctctgtattgacaa

SEQ ID NO: 918669 - DNA, 25 bp, Mus musculus
ttaattttggtcaaaatgtagctaa

SEQ ID NO: 918670 - DNA, 25 bp, Mus musculus
ttaattttggtctaaatgtagctaa

SEQ ID NO: 918671 - DNA, 25 bp, Mus musculus
ttaatttttagcctgcctcggtgtt

SEQ ID NO: 918672 - DNA, 25 bp, Mus musculus
ttaatttttagcgtgcctcggtgtt

SEQ ID NO: 918673 - DNA, 25 bp, Mus musculus
ttaatttttcatcccgttcaatcca

SEQ ID NO: 918674 - DNA, 25 bp, Mus musculus
ttaatttttcatgccgttcaatcca

SEQ ID NO: 918675 - DNA, 25 bp, Mus musculus
ttaatttttgtgaggcctcctttgg

SEQ ID NO: 918676 - DNA, 25 bp, Mus musculus
ttaatttttgtgtggcctcctttgg

SEQ ID NO: 918677 - DNA, 25 bp, Mus musculus
ttacaaaacaccatagcgactgcct

SEQ ID NO: 918678 - DNA, 25 bp, Mus musculus
ttacaaaacaccttagcgactgcct

SEQ ID NO: 918679 - DNA, 25 bp, Mus musculus
ttacaaaaccggactaccagcttct

SEQ ID NO: 918680 - DNA, 25 bp, Mus musculus
ttacaaaaccggtctaccagcttct

SEQ ID NO: 918681 - DNA, 25 bp, Mus musculus
ttacaaaaggatcggtgtacgctct

SEQ ID NO: 918682 - DNA, 25 bp, Mus musculus
ttacaaaaggatgggtgtacgctct

SEQ ID NO: 918683 - DNA, 25 bp, Mus musculus
ttacaaaatcttcttcccgttcagt

SEQ ID NO: 918684 - DNA, 25 bp, Mus musculus
ttacaaaatcttgttcccgttcagt

SEQ ID NO: 918685 - DNA, 25 bp, Mus musculus
ttacaaacaaacacacacttggctt

SEQ ID NO: 918686 - DNA, 25 bp, Mus musculus
ttacaaacaaactcacacttggctt

SEQ ID NO: 918687 - DNA, 25 bp, Mus musculus
ttacaaacaccgcacacagactaag

SEQ ID NO: 918688 - DNA, 25 bp, Mus musculus
ttacaaacaccggacacagactaag

SEQ ID NO: 918689 - DNA, 25 bp, Mus musculus
ttacaaacacttaagcctcttcacc

SEQ ID NO: 918690 - DNA, 25 bp, Mus musculus
ttacaaacactttagcctcttcacc

SEQ ID NO: 918691 - DNA, 25 bp, Mus musculus
ttacaaacccagaggatgagagccc

SEQ ID NO: 918692 - DNA, 25 bp, Mus musculus
ttacaaacccagtggatgagagccc

SEQ ID NO: 918693 - DNA, 25 bp, Mus musculus
ttacaaacctataccaccatggctg

SEQ ID NO: 918694 - DNA, 25 bp, Mus musculus
ttacaaacctattccaccatggctg

SEQ ID NO: 918695 - DNA, 25 bp, Mus musculus
ttacaaactactacagagagctgtc

SEQ ID NO: 918696 - DNA, 25 bp, Mus musculus
ttacaaactacttcagagagctgtc

SEQ ID NO: 918697 - DNA, 25 bp, Mus musculus
ttacaaactgtactggcaagccatg

SEQ ID NO: 918698 - DNA, 25 bp, Mus musculus
ttacaaactgtagtggcaagccatg

SEQ ID NO: 918699 - DNA, 25 bp, Mus musculus
ttacaaagcagtccctaccgtacca

SEQ ID NO: 918700 - DNA, 25 bp, Mus musculus
ttacaaagcagtgcctaccgtacca

SEQ ID NO: 918701 - DNA, 25 bp, Mus musculus
ttacaaagggccactcttccacagt

SEQ ID NO: 918702 - DNA, 25 bp, Mus musculus
ttacaaagggcctctcttccacagt

SEQ ID NO: 918703 - DNA, 25 bp, Mus musculus
ttacaaagtaccaccagcatttctg

SEQ ID NO: 918704 - DNA, 25 bp, Mus musculus
ttacaaagtacctccagcatttctg

SEQ ID NO: 918705 - DNA, 25 bp, Mus musculus
ttacaaagtggcaaggacacaacat

SEQ ID NO: 918706 - DNA, 25 bp, Mus musculus
ttacaaagtggcacaggctgccctt

SEQ ID NO: 918707 - DNA, 25 bp, Mus musculus
ttacaaagtggctaggacacaacat

SEQ ID NO: 918708 - DNA, 25 bp, Mus musculus
ttacaaagtggctcaggctgccctt

SEQ ID NO: 918709 - DNA, 25 bp, Mus musculus
ttacaaagttataggcaagcaagag

SEQ ID NO: 918710 - DNA, 25 bp, Mus musculus
ttacaaagttattggcaagcaagag

SEQ ID NO: 918711 - DNA, 25 bp, Mus musculus
ttacaaatctagacccagtgggcct

SEQ ID NO: 918712 - DNA, 25 bp, Mus musculus
ttacaaatctagtcccagtgggcct

SEQ ID NO: 918713 - DNA, 25 bp, Mus musculus
ttacaaatgcctagccttgagccat

SEQ ID NO: 918714 - DNA, 25 bp, Mus musculus
ttacaaatgccttgccttgagccat

SEQ ID NO: 918715 - DNA, 25 bp, Mus musculus
ttacaaattcaaacacatctggata

SEQ ID NO: 918716 - DNA, 25 bp, Mus musculus
ttacaaattcaaagacggagcccaa

SEQ ID NO: 918717 - DNA, 25 bp, Mus musculus
ttacaaattcaatcacatctggata

SEQ ID NO: 918718 - DNA, 25 bp, Mus musculus
ttacaaattcaatgacggagcccaa

SEQ ID NO: 918719 - DNA, 25 bp, Mus musculus
ttacaacaagaaatccacccaggcc

SEQ ID NO: 918720 - DNA, 25 bp, Mus musculus
ttacaacaagaattccacccaggcc

SEQ ID NO: 918721 - DNA, 25 bp, Mus musculus
ttacaacaattgctctcctccagtg

SEQ ID NO: 918722 - DNA, 25 bp, Mus musculus
ttacaacaattggtctcctccagtg

SEQ ID NO: 918723 - DNA, 25 bp, Mus musculus
ttacaacacgccagccatatccgag

SEQ ID NO: 918724 - DNA, 25 bp, Mus musculus
ttacaacacgcctgccatatccgag

SEQ ID NO: 918725 - DNA, 25 bp, Mus musculus
ttacaacactaccaaaccaccaagc

SEQ ID NO: 918726 - DNA, 25 bp, Mus musculus
ttacaacactacgaaaccaccaagc

SEQ ID NO: 918727 - DNA, 25 bp, Mus musculus
ttacaacagtttctgtggtcccact

SEQ ID NO: 918728 - DNA, 25 bp, Mus musculus
ttacaacagtttgtgtggtcccact

SEQ ID NO: 918729 - DNA, 25 bp, Mus musculus
ttacaacattcaacctacgatctcc

SEQ ID NO: 918730 - DNA, 25 bp, Mus musculus
ttacaacattcatcctacgatctcc

SEQ ID NO: 918731 - DNA, 25 bp, Mus musculus
ttacaaccaacgctccagataacct

SEQ ID NO: 918732 - DNA, 25 bp, Mus musculus
ttacaaccaacggtccagataacct

SEQ ID NO: 918733 - DNA, 25 bp, Mus musculus
ttacaacccacaacagctgcaagac

SEQ ID NO: 918734 - DNA, 25 bp, Mus musculus
ttacaacccacatcagctgcaagac

SEQ ID NO: 918735 - DNA, 25 bp, Mus musculus
ttacaacccactacctgaagagcgg

SEQ ID NO: 918736 - DNA, 25 bp, Mus musculus
ttacaacccacttcctgaagagcgg

SEQ ID NO: 918737 - DNA, 25 bp, Mus musculus
ttacaaccccaaagactgcagaaga

SEQ ID NO: 918738 - DNA, 25 bp, Mus musculus
ttacaaccccaatgactgcagaaga

SEQ ID NO: 918739 - DNA, 25 bp, Mus musculus
ttacaaccctctcaccatacggatg

SEQ ID NO: 918740 - DNA, 25 bp, Mus musculus
ttacaaccctctgaccatacggatg

SEQ ID NO: 918741 - DNA, 25 bp, Mus musculus
ttacaacctcagatccctgggaaag

SEQ ID NO: 918742 - DNA, 25 bp, Mus musculus
ttacaacctcagttccctgggaaag

SEQ ID NO: 918743 - DNA, 25 bp, Mus musculus
ttacaacctccaagtgtcagtgtcc

SEQ ID NO: 918744 - DNA, 25 bp, Mus musculus
ttacaacctccacgtcttagacttt

SEQ ID NO: 918745 - DNA, 25 bp, Mus musculus
ttacaacctccaggtcttagacttt

SEQ ID NO: 918746 - DNA, 25 bp, Mus musculus
ttacaacctccatgtgtcagtgtcc

SEQ ID NO: 918747 - DNA, 25 bp, Mus musculus
ttacaacctgtaaatttagctgcaa

SEQ ID NO: 918748 - DNA, 25 bp, Mus musculus
ttacaacctgtaagctgtgtccaat

SEQ ID NO: 918749 - DNA, 25 bp, Mus musculus
ttacaacctgtatatttagctgcaa

SEQ ID NO: 918750 - DNA, 25 bp, Mus musculus
ttacaacctgtatgctgtgtccaat

SEQ ID NO: 918751 - DNA, 25 bp, Mus musculus
ttacaaccttggacagctcatcatt

SEQ ID NO: 918752 - DNA, 25 bp, Mus musculus
ttacaaccttggtcagctcatcatt

SEQ ID NO: 918753 - DNA, 25 bp, Mus musculus
ttacaacgaggccttcagctttgag

SEQ ID NO: 918754 - DNA, 25 bp, Mus musculus
ttacaacgaggcgttcagctttgag

SEQ ID NO: 918755 - DNA, 25 bp, Mus musculus
ttacaacgcacccacagtgaagttc

SEQ ID NO: 918756 - DNA, 25 bp, Mus musculus
ttacaacgcaccgacagtgaagttc

SEQ ID NO: 918757 - DNA, 25 bp, Mus musculus
ttacaacgctctcagtcttgggcca

SEQ ID NO: 918758 - DNA, 25 bp, Mus musculus
ttacaacgctctgagtcttgggcca

SEQ ID NO: 918759 - DNA, 25 bp, Mus musculus
ttacaactctaaaggtgacctgtga

SEQ ID NO: 918760 - DNA, 25 bp, Mus musculus
ttacaactctaatggtgacctgtga

SEQ ID NO: 918761 - DNA, 25 bp, Mus musculus
ttacaactctttattgcttgcaaaa

SEQ ID NO: 918762 - DNA, 25 bp, Mus musculus
ttacaactcttttttgcttgcaaaa

SEQ ID NO: 918763 - DNA, 25 bp, Mus musculus
ttacaactgagtccctgaatgcttt

SEQ ID NO: 918764 - DNA, 25 bp, Mus musculus
ttacaactgagtgcctgaatgcttt

SEQ ID NO: 918765 - DNA, 25 bp, Mus musculus
ttacaacttaaaacacaccatctct

SEQ ID NO: 918766 - DNA, 25 bp, Mus musculus
ttacaacttaaatcacaccatctct

SEQ ID NO: 918767 - DNA, 25 bp, Mus musculus
ttacaacttgtgcttctgtagacac

SEQ ID NO: 918768 - DNA, 25 bp, Mus musculus
ttacaacttgtggttctgtagacac

SEQ ID NO: 918769 - DNA, 25 bp, Mus musculus
ttacaagaaacaccgcgtgcacaca

SEQ ID NO: 918770 - DNA, 25 bp, Mus musculus
ttacaagaaacagcgcgtgcacaca

SEQ ID NO: 918771 - DNA, 25 bp, Mus musculus
ttacaagacaggatgctttgcaatt

SEQ ID NO: 918772 - DNA, 25 bp, Mus musculus
ttacaagacaggttgctttgcaatt

SEQ ID NO: 918773 - DNA, 25 bp, Mus musculus
ttacaagacatgacattgctgcttt

SEQ ID NO: 918774 - DNA, 25 bp, Mus musculus
ttacaagacatgtcattgctgcttt

SEQ ID NO: 918775 - DNA, 25 bp, Mus musculus
ttacaagaggctccttcccactgct

SEQ ID NO: 918776 - DNA, 25 bp, Mus musculus
ttacaagaggctgcttcccactgct

SEQ ID NO: 918777 - DNA, 25 bp, Mus musculus
ttacaagagttcagtctgttctgtt

SEQ ID NO: 918778 - DNA, 25 bp, Mus musculus
ttacaagagttctgtctgttctgtt

SEQ ID NO: 918779 - DNA, 25 bp, Mus musculus
ttacaagataaacctgaccctgagg

SEQ ID NO: 918780 - DNA, 25 bp, Mus musculus
ttacaagataaagctgaccctgagg

SEQ ID NO: 918781 - DNA, 25 bp, Mus musculus
ttacaagatcccctttagtcacttg

SEQ ID NO: 918782 - DNA, 25 bp, Mus musculus
ttacaagatcccgtttagtcacttg

SEQ ID NO: 918783 - DNA, 25 bp, Mus musculus
ttacaagattgtcccatcattcccc

SEQ ID NO: 918784 - DNA, 25 bp, Mus musculus
ttacaagattgtgccatcattcccc

SEQ ID NO: 918785 - DNA, 25 bp, Mus musculus
ttacaagcaggtccctcctttaata

SEQ ID NO: 918786 - DNA, 25 bp, Mus musculus
ttacaagcaggtgcctcctttaata

SEQ ID NO: 918787 - DNA, 25 bp, Mus musculus
ttacaagcatgcctaccctgatggc

SEQ ID NO: 918788 - DNA, 25 bp, Mus musculus
ttacaagcatgcgtaccctgatggc

SEQ ID NO: 918789 - DNA, 25 bp, Mus musculus
ttacaagcatggcacagttctcagt

SEQ ID NO: 918790 - DNA, 25 bp, Mus musculus
ttacaagcatgggacagttctcagt

SEQ ID NO: 918791 - DNA, 25 bp, Mus musculus
ttacaagcccggagtggctgcacac

SEQ ID NO: 918792 - DNA, 25 bp, Mus musculus
ttacaagcccggtgtggctgcacac

SEQ ID NO: 918793 - DNA, 25 bp, Mus musculus
ttacaagccgcaacaattttgtcct

SEQ ID NO: 918794 - DNA, 25 bp, Mus musculus
ttacaagccgcatcaattttgtcct

SEQ ID NO: 918795 - DNA, 25 bp, Mus musculus
ttacaagctcaacggccagagccca

SEQ ID NO: 918796 - DNA, 25 bp, Mus musculus
ttacaagctcaagggccagagccca

SEQ ID NO: 918797 - DNA, 25 bp, Mus musculus
ttacaagctccacaaagatgactag

SEQ ID NO: 918798 - DNA, 25 bp, Mus musculus
ttacaagctccagaaagatgactag

SEQ ID NO: 918799 - DNA, 25 bp, Mus musculus
ttacaaggacctctggctactggat

SEQ ID NO: 918800 - DNA, 25 bp, Mus musculus
ttacaaggacctgtggctactggat

SEQ ID NO: 918801 - DNA, 25 bp, Mus musculus
ttacaaggcctaacggtgactacca

SEQ ID NO: 918802 - DNA, 25 bp, Mus musculus
ttacaaggcctatcggtgactacca

SEQ ID NO: 918803 - DNA, 25 bp, Mus musculus
ttacaaggccttcactggttaaaat

SEQ ID NO: 918804 - DNA, 25 bp, Mus musculus
ttacaaggccttgactggttaaaat

SEQ ID NO: 918805 - DNA, 25 bp, Mus musculus
ttacaaggctatccatgcaccgtcc

SEQ ID NO: 918806 - DNA, 25 bp, Mus musculus
ttacaaggctatgcatgcaccgtcc

SEQ ID NO: 918807 - DNA, 25 bp, Mus musculus
ttacaaggctgacagagcgtcccat

SEQ ID NO: 918808 - DNA, 25 bp, Mus musculus
ttacaaggctgagagagcgtcccat

SEQ ID NO: 918809 - DNA, 25 bp, Mus musculus
ttacaaggcttcaggaaaccccact

SEQ ID NO: 918810 - DNA, 25 bp, Mus musculus
ttacaaggcttctggaaaccccact

SEQ ID NO: 918811 - DNA, 25 bp, Mus musculus
ttacaaggggtgcagatcctggaat

SEQ ID NO: 918812 - DNA, 25 bp, Mus musculus
ttacaaggggtggagatcctggaat

SEQ ID NO: 918813 - DNA, 25 bp, Mus musculus
ttacaaggtcagcttccaccaacta

SEQ ID NO: 918814 - DNA, 25 bp, Mus musculus
ttacaaggtcaggttccaccaacta

SEQ ID NO: 918815 - DNA, 25 bp, Mus musculus
ttacaaggtttgagcactcatctcc

SEQ ID NO: 918816 - DNA, 25 bp, Mus musculus
ttacaaggtttgtgcactcatctcc

SEQ ID NO: 918817 - DNA, 25 bp, Mus musculus
ttacaagtacctctacggcagacac

SEQ ID NO: 918818 - DNA, 25 bp, Mus musculus
ttacaagtacctgtacggcagacac

SEQ ID NO: 918819 - DNA, 25 bp, Mus musculus
ttacaagtatgactcacaggtccag

SEQ ID NO: 918820 - DNA, 25 bp, Mus musculus
ttacaagtatgagtcacaggtccag

SEQ ID NO: 918821 - DNA, 25 bp, Mus musculus
ttacaagtcctacgctggcaaccag

SEQ ID NO: 918822 - DNA, 25 bp, Mus musculus
ttacaagtcctaggctggcaaccag

SEQ ID NO: 918823 - DNA, 25 bp, Mus musculus
ttacaagtcctcaagtcaagtggtt

SEQ ID NO: 918824 - DNA, 25 bp, Mus musculus
ttacaagtcctctagtcaagtggtt

SEQ ID NO: 918825 - DNA, 25 bp, Mus musculus
ttacaagtgagaacctagcatgtca

SEQ ID NO: 918826 - DNA, 25 bp, Mus musculus
ttacaagtgagatcctagcatgtca

SEQ ID NO: 918827 - DNA, 25 bp, Mus musculus
ttacaagtgcatagatggcccctgt

SEQ ID NO: 918828 - DNA, 25 bp, Mus musculus
ttacaagtgcattgatggcccctgt

SEQ ID NO: 918829 - DNA, 25 bp, Mus musculus
ttacaagtgtgcaccaacacgcctt

SEQ ID NO: 918830 - DNA, 25 bp, Mus musculus
ttacaagtgtgctccaacacgcctt

SEQ ID NO: 918831 - DNA, 25 bp, Mus musculus
ttacaagttcctctcctattctgaa

SEQ ID NO: 918832 - DNA, 25 bp, Mus musculus
ttacaagttcctgtcctattctgaa

SEQ ID NO: 918833 - DNA, 25 bp, Mus musculus
ttacaagttctcaggcattatcccc

SEQ ID NO: 918834 - DNA, 25 bp, Mus musculus
ttacaagttctctggcattatcccc

SEQ ID NO: 918835 - DNA, 25 bp, Mus musculus
ttacaagttgttactgcacgcctag

SEQ ID NO: 918836 - DNA, 25 bp, Mus musculus
ttacaagttgtttctgcacgcctag

SEQ ID NO: 918837 - DNA, 25 bp, Mus musculus
ttacaataacacagtgtggctccgt

SEQ ID NO: 918838 - DNA, 25 bp, Mus musculus
ttacaataacactgtgtggctccgt

SEQ ID NO: 918839 - DNA, 25 bp, Mus musculus
ttacaatacactaagagctctctga

SEQ ID NO: 918840 - DNA, 25 bp, Mus musculus
ttacaatacacttagagctctctga

SEQ ID NO: 918841 - DNA, 25 bp, Mus musculus
ttacaatcagctcttgatttcttat

SEQ ID NO: 918842 - DNA, 25 bp, Mus musculus
ttacaatcagctgttgatttcttat

SEQ ID NO: 918843 - DNA, 25 bp, Mus musculus
ttacaatcatttacaggcacagcct

SEQ ID NO: 918844 - DNA, 25 bp, Mus musculus
ttacaatcattttcaggcacagcct

SEQ ID NO: 918845 - DNA, 25 bp, Mus musculus
ttacaatctagaacaggactctgtc

SEQ ID NO: 918846 - DNA, 25 bp, Mus musculus
ttacaatctagatcaggactctgtc

SEQ ID NO: 918847 - DNA, 25 bp, Mus musculus
ttacaatctctacccatgcctaaag

SEQ ID NO: 918848 - DNA, 25 bp, Mus musculus
ttacaatctctagccatgcctaaag

SEQ ID NO: 918849 - DNA, 25 bp, Mus musculus
ttacaatctttactcaggtgcccca

SEQ ID NO: 918850 - DNA, 25 bp, Mus musculus
ttacaatctttagtcaggtgcccca

SEQ ID NO: 918851 - DNA, 25 bp, Mus musculus
ttacaatgaaccagccctatcctaa

SEQ ID NO: 918852 - DNA, 25 bp, Mus musculus
ttacaatgaacctgccctatcctaa

SEQ ID NO: 918853 - DNA, 25 bp, Mus musculus
ttacaatgagacactccctgtttcc

SEQ ID NO: 918854 - DNA, 25 bp, Mus musculus
ttacaatgagactctccctgtttcc

SEQ ID NO: 918855 - DNA, 25 bp, Mus musculus
ttacaatgcattcccagtgccttat

SEQ ID NO: 918856 - DNA, 25 bp, Mus musculus
ttacaatgcattgccagtgccttat

SEQ ID NO: 918857 - DNA, 25 bp, Mus musculus
ttacaatggcccctgcttgttgaac

SEQ ID NO: 918858 - DNA, 25 bp, Mus musculus
ttacaatggcccgtgcttgttgaac

SEQ ID NO: 918859 - DNA, 25 bp, Mus musculus
ttacaatggtgcaacacccaaagaa

SEQ ID NO: 918860 - DNA, 25 bp, Mus musculus
ttacaatggtgctacacccaaagaa

SEQ ID NO: 918861 - DNA, 25 bp, Mus musculus
ttacaatgtactaggcttaggccga

SEQ ID NO: 918862 - DNA, 25 bp, Mus musculus
ttacaatgtacttggcttaggccga

SEQ ID NO: 918863 - DNA, 25 bp, Mus musculus
ttacaatgtctaccctagtatgtgg

SEQ ID NO: 918864 - DNA, 25 bp, Mus musculus
ttacaatgtctagcctagtatgtgg

SEQ ID NO: 918865 - DNA, 25 bp, Mus musculus
ttacaattaagaacgcacatacagt

SEQ ID NO: 918866 - DNA, 25 bp, Mus musculus
ttacaattaagatcgcacatacagt

SEQ ID NO: 918867 - DNA, 25 bp, Mus musculus
ttacaattagtcacctgtctgtcct

SEQ ID NO: 918868 - DNA, 25 bp, Mus musculus
ttacaattagtctcctgtctgtcct

SEQ ID NO: 918869 - DNA, 25 bp, Mus musculus
ttacaattcaggatcgctcatggat

SEQ ID NO: 918870 - DNA, 25 bp, Mus musculus
ttacaattcaggttcgctcatggat

SEQ ID NO: 918871 - DNA, 25 bp, Mus musculus
ttacaattctgaaatacacgtgcat

SEQ ID NO: 918872 - DNA, 25 bp, Mus musculus
ttacaattctgatatacacgtgcat

SEQ ID NO: 918873 - DNA, 25 bp, Mus musculus
ttacaattgcagaaccatccacttc

SEQ ID NO: 918874 - DNA, 25 bp, Mus musculus
ttacaattgcagtaccatccacttc

SEQ ID NO: 918875 - DNA, 25 bp, Mus musculus
ttacaattgctaagtttctctcccc

SEQ ID NO: 918876 - DNA, 25 bp, Mus musculus
ttacaattgctatgtttctctcccc

SEQ ID NO: 918877 - DNA, 25 bp, Mus musculus
ttacaatttccccaactaggttgat

SEQ ID NO: 918878 - DNA, 25 bp, Mus musculus
ttacaatttcccgaactaggttgat

SEQ ID NO: 918879 - DNA, 25 bp, Mus musculus
ttacaatttcctccgttattaatat

SEQ ID NO: 918880 - DNA, 25 bp, Mus musculus
ttacaatttcctgcgttattaatat

SEQ ID NO: 918881 - DNA, 25 bp, Mus musculus
ttacaatttttccatgcctcttctt

SEQ ID NO: 918882 - DNA, 25 bp, Mus musculus
ttacaatttttcgatgcctcttctt

SEQ ID NO: 918883 - DNA, 25 bp, Mus musculus
ttacacaagtcaagttgagcaccat

SEQ ID NO: 918884 - DNA, 25 bp, Mus musculus
ttacacaagtcatgttgagcaccat

SEQ ID NO: 918885 - DNA, 25 bp, Mus musculus
ttacacaagttaatgccccatcttc

SEQ ID NO: 918886 - DNA, 25 bp, Mus musculus
ttacacaagttattgccccatcttc

SEQ ID NO: 918887 - DNA, 25 bp, Mus musculus
ttacacaatgaacttttcctcttac

SEQ ID NO: 918888 - DNA, 25 bp, Mus musculus
ttacacaatgaagttttcctcttac

SEQ ID NO: 918889 - DNA, 25 bp, Mus musculus
ttacacaattatatttccagctctt

SEQ ID NO: 918890 - DNA, 25 bp, Mus musculus
ttacacaattatttttccagctctt

SEQ ID NO: 918891 - DNA, 25 bp, Mus musculus
ttacacaattctatgctaccacatg

SEQ ID NO: 918892 - DNA, 25 bp, Mus musculus
ttacacaattctttgctaccacatg

SEQ ID NO: 918893 - DNA, 25 bp, Mus musculus
ttacacacagcccatcaatgctatt

SEQ ID NO: 918894 - DNA, 25 bp, Mus musculus
ttacacacagccgatcaatgctatt

SEQ ID NO: 918895 - DNA, 25 bp, Mus musculus
ttacacacccctcggaggtatggca

SEQ ID NO: 918896 - DNA, 25 bp, Mus musculus
ttacacacccctgggaggtatggca

SEQ ID NO: 918897 - DNA, 25 bp, Mus musculus
ttacacacgcagaacgaggaccaga

SEQ ID NO: 918898 - DNA, 25 bp, Mus musculus
ttacacacgcagtacgaggaccaga

SEQ ID NO: 918899 - DNA, 25 bp, Mus musculus
ttacacactcacatactttttccaa

SEQ ID NO: 918900 - DNA, 25 bp, Mus musculus
ttacacactcacttactttttccaa

SEQ ID NO: 918901 - DNA, 25 bp, Mus musculus
ttacacactcatcggcctttttaaa

SEQ ID NO: 918902 - DNA, 25 bp, Mus musculus
ttacacactcatgggcctttttaaa

SEQ ID NO: 918903 - DNA, 25 bp, Mus musculus
ttacacactctcagagtccagtacc

SEQ ID NO: 918904 - DNA, 25 bp, Mus musculus
ttacacactctctgagtccagtacc

SEQ ID NO: 918905 - DNA, 25 bp, Mus musculus
ttacacactgccctattacagtgca

SEQ ID NO: 918906 - DNA, 25 bp, Mus musculus
ttacacactgccgtattacagtgca

SEQ ID NO: 918907 - DNA, 25 bp, Mus musculus
ttacacactggtatattactgtgta

SEQ ID NO: 918908 - DNA, 25 bp, Mus musculus
ttacacactggtttattactgtgta

SEQ ID NO: 918909 - DNA, 25 bp, Mus musculus
ttacacacttagaacagacctctcc

SEQ ID NO: 918910 - DNA, 25 bp, Mus musculus
ttacacacttagtacagacctctcc

SEQ ID NO: 918911 - DNA, 25 bp, Mus musculus
ttacacagagtgatgagggcttttg

SEQ ID NO: 918912 - DNA, 25 bp, Mus musculus
ttacacagagtgttgagggcttttg

SEQ ID NO: 918913 - DNA, 25 bp, Mus musculus
ttacacagattgcacgagccagcct

SEQ ID NO: 918914 - DNA, 25 bp, Mus musculus
ttacacagattggacgagccagcct

SEQ ID NO: 918915 - DNA, 25 bp, Mus musculus
ttacacagatttacagcggccaata

SEQ ID NO: 918916 - DNA, 25 bp, Mus musculus
ttacacagattttcagcggccaata

SEQ ID NO: 918917 - DNA, 25 bp, Mus musculus
ttacacagcacaagatccgcacatt

SEQ ID NO: 918918 - DNA, 25 bp, Mus musculus
ttacacagcacatgatccgcacatt

SEQ ID NO: 918919 - DNA, 25 bp, Mus musculus
ttacacagcctgaccttggtgttaa

SEQ ID NO: 918920 - DNA, 25 bp, Mus musculus
ttacacagcctgacgaggtgctcgc

SEQ ID NO: 918921 - DNA, 25 bp, Mus musculus
ttacacagcctgtccttggtgttaa

SEQ ID NO: 918922 - DNA, 25 bp, Mus musculus
ttacacagcctgtcgaggtgctcgc

SEQ ID NO: 918923 - DNA, 25 bp, Mus musculus
ttacacagggctactgggatgcacc

SEQ ID NO: 918924 - DNA, 25 bp, Mus musculus
ttacacagggcttctgggatgcacc

SEQ ID NO: 918925 - DNA, 25 bp, Mus musculus
ttacacagtcaacatttgtcccttc

SEQ ID NO: 918926 - DNA, 25 bp, Mus musculus
ttacacagtcaagatttgtcccttc

SEQ ID NO: 918927 - DNA, 25 bp, Mus musculus
ttacacagtcctaaaggtgcggctc

SEQ ID NO: 918928 - DNA, 25 bp, Mus musculus
ttacacagtccttaaggtgcggctc

SEQ ID NO: 918929 - DNA, 25 bp, Mus musculus
ttacacagtgcacccgtgaatgccc

SEQ ID NO: 918930 - DNA, 25 bp, Mus musculus
ttacacagtgcagccgtgaatgccc

SEQ ID NO: 918931 - DNA, 25 bp, Mus musculus
ttacacatcaaaacggacctggctt

SEQ ID NO: 918932 - DNA, 25 bp, Mus musculus
ttacacatcaaatcggacctggctt

SEQ ID NO: 918933 - DNA, 25 bp, Mus musculus
ttacacatgcaacacctgaggcttt

SEQ ID NO: 918934 - DNA, 25 bp, Mus musculus
ttacacatgcaagacctgaggcttt

SEQ ID NO: 918935 - DNA, 25 bp, Mus musculus
ttacacatttagcaagaagtttcgg

SEQ ID NO: 918936 - DNA, 25 bp, Mus musculus
ttacacatttaggaagaagtttcgg

SEQ ID NO: 918937 - DNA, 25 bp, Mus musculus
ttacacatttgtaaggaccctgcaa

SEQ ID NO: 918938 - DNA, 25 bp, Mus musculus
ttacacatttgttaggaccctgcaa

SEQ ID NO: 918939 - DNA, 25 bp, Mus musculus
ttacacattttcaattatcaaagtt

SEQ ID NO: 918940 - DNA, 25 bp, Mus musculus
ttacacattttctattatcaaagtt

SEQ ID NO: 918941 - DNA, 25 bp, Mus musculus
ttacaccaatgccactgtgtttcct

SEQ ID NO: 918942 - DNA, 25 bp, Mus musculus
ttacaccaatgcgactgtgtttcct

SEQ ID NO: 918943 - DNA, 25 bp, Mus musculus
ttacaccacagcagtttccaaatgc

SEQ ID NO: 918944 - DNA, 25 bp, Mus musculus
ttacaccacagctgtttccaaatgc

SEQ ID NO: 918945 - DNA, 25 bp, Mus musculus
ttacaccacttcattccaagttaca

SEQ ID NO: 918946 - DNA, 25 bp, Mus musculus
ttacaccacttctttccaagttaca

SEQ ID NO: 918947 - DNA, 25 bp, Mus musculus
ttacaccagaacacatccttttgtt

SEQ ID NO: 918948 - DNA, 25 bp, Mus musculus
ttacaccagaactcatccttttgtt

SEQ ID NO: 918949 - DNA, 25 bp, Mus musculus
ttacaccagagtagtttgacagcca

SEQ ID NO: 918950 - DNA, 25 bp, Mus musculus
ttacaccagagttgtttgacagcca

SEQ ID NO: 918951 - DNA, 25 bp, Mus musculus
ttacaccagcacacttttcacagac

SEQ ID NO: 918952 - DNA, 25 bp, Mus musculus
ttacaccagcactcttttcacagac

SEQ ID NO: 918953 - DNA, 25 bp, Mus musculus
ttacaccagcatctgcttggaaatc

SEQ ID NO: 918954 - DNA, 25 bp, Mus musculus
ttacaccagcatgtgcttggaaatc

SEQ ID NO: 918955 - DNA, 25 bp, Mus musculus
ttacaccagctgctttcagactagt

SEQ ID NO: 918956 - DNA, 25 bp, Mus musculus
ttacaccagctggtttcagactagt

SEQ ID NO: 918957 - DNA, 25 bp, Mus musculus
ttacaccaggtcaatcttttcaaag

SEQ ID NO: 918958 - DNA, 25 bp, Mus musculus
ttacaccaggtctatcttttcaaag

SEQ ID NO: 918959 - DNA, 25 bp, Mus musculus
ttacaccagtttcctggtcttccat

SEQ ID NO: 918960 - DNA, 25 bp, Mus musculus
ttacaccagtttgctggtcttccat

SEQ ID NO: 918961 - DNA, 25 bp, Mus musculus
ttacaccatgctccagtagtctgta

SEQ ID NO: 918962 - DNA, 25 bp, Mus musculus
ttacaccatgctccgagcatcgttt

SEQ ID NO: 918963 - DNA, 25 bp, Mus musculus
ttacaccatgctgcagtagtctgta

SEQ ID NO: 918964 - DNA, 25 bp, Mus musculus
ttacaccatgctgcgagcatcgttt

SEQ ID NO: 918965 - DNA, 25 bp, Mus musculus
ttacacccaatgattgaagaggagg

SEQ ID NO: 918966 - DNA, 25 bp, Mus musculus
ttacacccaatgtttgaagaggagg

SEQ ID NO: 918967 - DNA, 25 bp, Mus musculus
ttacacccagagctgttttcactgt

SEQ ID NO: 918968 - DNA, 25 bp, Mus musculus
ttacacccagaggtgttttcactgt

SEQ ID NO: 918969 - DNA, 25 bp, Mus musculus
ttacacccagcccctggatgaagtt

SEQ ID NO: 918970 - DNA, 25 bp, Mus musculus
ttacacccagccgctggatgaagtt

SEQ ID NO: 918971 - DNA, 25 bp, Mus musculus
ttacacccgaaccagtcttattaca

SEQ ID NO: 918972 - DNA, 25 bp, Mus musculus
ttacacccgaacgagtcttattaca

SEQ ID NO: 918973 - DNA, 25 bp, Mus musculus
ttacacccgtcaaatacgaacccgc

SEQ ID NO: 918974 - DNA, 25 bp, Mus musculus
ttacacccgtcatatacgaacccgc

SEQ ID NO: 918975 - DNA, 25 bp, Mus musculus
ttacaccctggtaatcacagacaag

SEQ ID NO: 918976 - DNA, 25 bp, Mus musculus
ttacaccctggttatcacagacaag

SEQ ID NO: 918977 - DNA, 25 bp, Mus musculus
ttacacccttccatggaggaggaga

SEQ ID NO: 918978 - DNA, 25 bp, Mus musculus
ttacacccttccttggaggaggaga

SEQ ID NO: 918979 - DNA, 25 bp, Mus musculus
ttacaccctttactattgggattgt

SEQ ID NO: 918980 - DNA, 25 bp, Mus musculus
ttacaccctttagtattgggattgt

SEQ ID NO: 918981 - DNA, 25 bp, Mus musculus
ttacaccgagtgaccaaccttttga

SEQ ID NO: 918982 - DNA, 25 bp, Mus musculus
ttacaccgagtgtccaaccttttga

SEQ ID NO: 918983 - DNA, 25 bp, Mus musculus
ttacaccgcccacaacgatgacgaa

SEQ ID NO: 918984 - DNA, 25 bp, Mus musculus
ttacaccgcccagaacgatgacgaa

SEQ ID NO: 918985 - DNA, 25 bp, Mus musculus
ttacaccggaatcttcttagcccca

SEQ ID NO: 918986 - DNA, 25 bp, Mus musculus
ttacaccggaatgttcttagcccca

SEQ ID NO: 918987 - DNA, 25 bp, Mus musculus
ttacaccgttatcctcatcgagaga

SEQ ID NO: 918988 - DNA, 25 bp, Mus musculus
ttacaccgttatgctcatcgagaga

SEQ ID NO: 918989 - DNA, 25 bp, Mus musculus
ttacacctagcaaccatcaacacta

SEQ ID NO: 918990 - DNA, 25 bp, Mus musculus
ttacacctagcatccatcaacacta

SEQ ID NO: 918991 - DNA, 25 bp, Mus musculus
ttacacctcatccatgccgtggaag

SEQ ID NO: 918992 - DNA, 25 bp, Mus musculus
ttacacctcatcgatgccgtggaag

SEQ ID NO: 918993 - DNA, 25 bp, Mus musculus
ttacacctcgtacttttaccatcaa

SEQ ID NO: 918994 - DNA, 25 bp, Mus musculus
ttacacctcgtagttttaccatcaa

SEQ ID NO: 918995 - DNA, 25 bp, Mus musculus
ttacaccttggcatgtgctaaacgt

SEQ ID NO: 918996 - DNA, 25 bp, Mus musculus
ttacaccttggcttgtgctaaacgt

SEQ ID NO: 918997 - DNA, 25 bp, Mus musculus
ttacaccttttcacggtcagtgatg

SEQ ID NO: 918998 - DNA, 25 bp, Mus musculus
ttacaccttttctcggtcagtgatg

SEQ ID NO: 918999 - DNA, 25 bp, Mus musculus
ttacacgacgaaatgctttacggat

SEQ ID NO: 919000 - DNA, 25 bp, Mus musculus
ttacacgacgaattgctttacggat

SEQ ID NO: 919001 - DNA, 25 bp, Mus musculus
ttacacgagtccaaaggccgggcgc

SEQ ID NO: 919002 - DNA, 25 bp, Mus musculus
ttacacgagtcctaaggccgggcgc

SEQ ID NO: 919003 - DNA, 25 bp, Mus musculus
ttacacgataagcaatggtcagact

SEQ ID NO: 919004 - DNA, 25 bp, Mus musculus
ttacacgataaggaatggtcagact

SEQ ID NO: 919005 - DNA, 25 bp, Mus musculus
ttacacgattctctttctcagactg

SEQ ID NO: 919006 - DNA, 25 bp, Mus musculus
ttacacgattctgtttctcagactg

SEQ ID NO: 919007 - DNA, 25 bp, Mus musculus
ttacacgccaatctattctgagcac

SEQ ID NO: 919008 - DNA, 25 bp, Mus musculus
ttacacgccaatgtattctgagcac

SEQ ID NO: 919009 - DNA, 25 bp, Mus musculus
ttacacgctaagacccattgctggg

SEQ ID NO: 919010 - DNA, 25 bp, Mus musculus
ttacacgctaagtcccattgctggg

SEQ ID NO: 919011 - DNA, 25 bp, Mus musculus
ttacacgcttatatttcccctgaaa

SEQ ID NO: 919012 - DNA, 25 bp, Mus musculus
ttacacgcttatttttcccctgaaa

SEQ ID NO: 919013 - DNA, 25 bp, Mus musculus
ttacacggaccaacagaagatttct

SEQ ID NO: 919014 - DNA, 25 bp, Mus musculus
ttacacggaccatcagaagatttct

SEQ ID NO: 919015 - DNA, 25 bp, Mus musculus
ttacacggcttcatctatctccagg

SEQ ID NO: 919016 - DNA, 25 bp, Mus musculus
ttacacggcttcttctatctccagg

SEQ ID NO: 919017 - DNA, 25 bp, Mus musculus
ttacacgtaaggcatgatctgaatt

SEQ ID NO: 919018 - DNA, 25 bp, Mus musculus
ttacacgtaaggctgttttgcctgt

SEQ ID NO: 919019 - DNA, 25 bp, Mus musculus
ttacacgtaagggatgatctgaatt

SEQ ID NO: 919020 - DNA, 25 bp, Mus musculus
ttacacgtaagggtgttttgcctgt

SEQ ID NO: 919021 - DNA, 25 bp, Mus musculus
ttacacgtccacaagcagtttgtaa

SEQ ID NO: 919022 - DNA, 25 bp, Mus musculus
ttacacgtccactagcagtttgtaa

SEQ ID NO: 919023 - DNA, 25 bp, Mus musculus
ttacacgttcaaagttcgattttat

SEQ ID NO: 919024 - DNA, 25 bp, Mus musculus
ttacacgttcaatgttcgattttat

SEQ ID NO: 919025 - DNA, 25 bp, Mus musculus
ttacacgtttccacccttctggttg

SEQ ID NO: 919026 - DNA, 25 bp, Mus musculus
ttacacgtttcctcccttctggttg

SEQ ID NO: 919027 - DNA, 25 bp, Mus musculus
ttacactacagtcagagccttcagc

SEQ ID NO: 919028 - DNA, 25 bp, Mus musculus
ttacactacagtgagagccttcagc

SEQ ID NO: 919029 - DNA, 25 bp, Mus musculus
ttacactcagagatgaagatccgga

SEQ ID NO: 919030 - DNA, 25 bp, Mus musculus
ttacactcagagttgaagatccgga

SEQ ID NO: 919031 - DNA, 25 bp, Mus musculus
ttacactcaggcacttgctacggaa

SEQ ID NO: 919032 - DNA, 25 bp, Mus musculus
ttacactcaggctcttgctacggaa

SEQ ID NO: 919033 - DNA, 25 bp, Mus musculus
ttacactccctccaaaaatcacgtg

SEQ ID NO: 919034 - DNA, 25 bp, Mus musculus
ttacactccctcgaaaaatcacgtg

SEQ ID NO: 919035 - DNA, 25 bp, Mus musculus
ttacactccctgataatctagtctc

SEQ ID NO: 919036 - DNA, 25 bp, Mus musculus
ttacactccctgttaatctagtctc

SEQ ID NO: 919037 - DNA, 25 bp, Mus musculus
ttacactcctgtacttgcgaaagca

SEQ ID NO: 919038 - DNA, 25 bp, Mus musculus
ttacactcctgttcttgcgaaagca

SEQ ID NO: 919039 - DNA, 25 bp, Mus musculus
ttacactccttcagtcgaatacact

SEQ ID NO: 919040 - DNA, 25 bp, Mus musculus
ttacactccttctgtcgaatacact

SEQ ID NO: 919041 - DNA, 25 bp, Mus musculus
ttacactctggcatgtgcaactgac

SEQ ID NO: 919042 - DNA, 25 bp, Mus musculus
ttacactctggcttgtgcaactgac

SEQ ID NO: 919043 - DNA, 25 bp, Mus musculus
ttacactctgttcctatttactaag

SEQ ID NO: 919044 - DNA, 25 bp, Mus musculus
ttacactctgttgctatttactaag

SEQ ID NO: 919045 - DNA, 25 bp, Mus musculus
ttacactgacctatgcacttgagct

SEQ ID NO: 919046 - DNA, 25 bp, Mus musculus
ttacactgacctttgcacttgagct

SEQ ID NO: 919047 - DNA, 25 bp, Mus musculus
ttacactgactactggtggcttagt

SEQ ID NO: 919048 - DNA, 25 bp, Mus musculus
ttacactgactagtggtggcttagt

SEQ ID NO: 919049 - DNA, 25 bp, Mus musculus
ttacactgtaaaatctcactgctct

SEQ ID NO: 919050 - DNA, 25 bp, Mus musculus
ttacactgtaaattctcactgctct

SEQ ID NO: 919051 - DNA, 25 bp, Mus musculus
ttacactgtaggacacacaaatgct

SEQ ID NO: 919052 - DNA, 25 bp, Mus musculus
ttacactgtaggtcacacaaatgct

SEQ ID NO: 919053 - DNA, 25 bp, Mus musculus
ttacactgtgtaacccgagtcccag

SEQ ID NO: 919054 - DNA, 25 bp, Mus musculus
ttacactgtgtatcccgagtcccag

SEQ ID NO: 919055 - DNA, 25 bp, Mus musculus
ttacactgtgttcttgggcccctca

SEQ ID NO: 919056 - DNA, 25 bp, Mus musculus
ttacactgtgttgttgggcccctca

SEQ ID NO: 919057 - DNA, 25 bp, Mus musculus
ttacacttaagcagaacacccatac

SEQ ID NO: 919058 - DNA, 25 bp, Mus musculus
ttacacttaagctgaacacccatac

SEQ ID NO: 919059 - DNA, 25 bp, Mus musculus
ttacacttataactggatgcctggg

SEQ ID NO: 919060 - DNA, 25 bp, Mus musculus
ttacacttataagtggatgcctggg

SEQ ID NO: 919061 - DNA, 25 bp, Mus musculus
ttacacttatacaccctcttgacga

SEQ ID NO: 919062 - DNA, 25 bp, Mus musculus
ttacacttatactccctcttgacga

SEQ ID NO: 919063 - DNA, 25 bp, Mus musculus
ttacacttcccaacgaggccagagt

SEQ ID NO: 919064 - DNA, 25 bp, Mus musculus
ttacacttcccatcgaggccagagt

SEQ ID NO: 919065 - DNA, 25 bp, Mus musculus
ttacacttctgtacatactgacccc

SEQ ID NO: 919066 - DNA, 25 bp, Mus musculus
ttacacttctgttcatactgacccc

SEQ ID NO: 919067 - DNA, 25 bp, Mus musculus
ttacacttgagaacagtcatgactt

SEQ ID NO: 919068 - DNA, 25 bp, Mus musculus
ttacacttgagatcagtcatgactt

SEQ ID NO: 919069 - DNA, 25 bp, Mus musculus
ttacactttaaaacctttgccctag

SEQ ID NO: 919070 - DNA, 25 bp, Mus musculus
ttacactttaaatcctttgccctag

SEQ ID NO: 919071 - DNA, 25 bp, Mus musculus
ttacactttaacattttccgccatc

SEQ ID NO: 919072 - DNA, 25 bp, Mus musculus
ttacactttaactttttccgccatc

SEQ ID NO: 919073 - DNA, 25 bp, Mus musculus
ttacacttttccatcttctctcatg

SEQ ID NO: 919074 - DNA, 25 bp, Mus musculus
ttacacttttccttcttctctcatg

SEQ ID NO: 919075 - DNA, 25 bp, Mus musculus
ttacagaaagaaaccccaaatatga

SEQ ID NO: 919076 - DNA, 25 bp, Mus musculus
ttacagaaagaatccccaaatatga

SEQ ID NO: 919077 - DNA, 25 bp, Mus musculus
ttacagaaagacacggcactgccgt

SEQ ID NO: 919078 - DNA, 25 bp, Mus musculus
ttacagaaagactcggcactgccgt

SEQ ID NO: 919079 - DNA, 25 bp, Mus musculus
ttacagaaatatcccagagactggg

SEQ ID NO: 919080 - DNA, 25 bp, Mus musculus
ttacagaaatatgccagagactggg

SEQ ID NO: 919081 - DNA, 25 bp, Mus musculus
ttacagaaattacccactaggaaat

SEQ ID NO: 919082 - DNA, 25 bp, Mus musculus
ttacagaaattagccactaggaaat

SEQ ID NO: 919083 - DNA, 25 bp, Mus musculus
ttacagaacagcaccttgtgctcat

SEQ ID NO: 919084 - DNA, 25 bp, Mus musculus
ttacagaacagctccttgtgctcat

SEQ ID NO: 919085 - DNA, 25 bp, Mus musculus
ttacagaacctaactgcatctctag

SEQ ID NO: 919086 - DNA, 25 bp, Mus musculus
ttacagaacctatctgcatctctag

SEQ ID NO: 919087 - DNA, 25 bp, Mus musculus
ttacagaagcagaccgtaggcacct

SEQ ID NO: 919088 - DNA, 25 bp, Mus musculus
ttacagaagcagaggcgagggttac

SEQ ID NO: 919089 - DNA, 25 bp, Mus musculus
ttacagaagcagtccgtaggcacct

SEQ ID NO: 919090 - DNA, 25 bp, Mus musculus
ttacagaagcagtggcgagggttac

SEQ ID NO: 919091 - DNA, 25 bp, Mus musculus
ttacagaagcttctgagtggccatg

SEQ ID NO: 919092 - DNA, 25 bp, Mus musculus
ttacagaagcttgtgagtggccatg

SEQ ID NO: 919093 - DNA, 25 bp, Mus musculus
ttacagaattctaccgattccaggt

SEQ ID NO: 919094 - DNA, 25 bp, Mus musculus
ttacagaattcttccgattccaggt

SEQ ID NO: 919095 - DNA, 25 bp, Mus musculus
ttacagacagctattaacagaaatg

SEQ ID NO: 919096 - DNA, 25 bp, Mus musculus
ttacagacagcttttaacagaaatg

SEQ ID NO: 919097 - DNA, 25 bp, Mus musculus
ttacagacatccacttgcatctgtc

SEQ ID NO: 919098 - DNA, 25 bp, Mus musculus
ttacagacatcctcttgcatctgtc

SEQ ID NO: 919099 - DNA, 25 bp, Mus musculus
ttacagacatctccagcccgggatt

SEQ ID NO: 919100 - DNA, 25 bp, Mus musculus
ttacagacatctgcagcccgggatt

SEQ ID NO: 919101 - DNA, 25 bp, Mus musculus
ttacagaccattcggagccaccatg

SEQ ID NO: 919102 - DNA, 25 bp, Mus musculus
ttacagaccattgggagccaccatg

SEQ ID NO: 919103 - DNA, 25 bp, Mus musculus
ttacagacctgtatctctagcccta

SEQ ID NO: 919104 - DNA, 25 bp, Mus musculus
ttacagacctgtttctctagcccta

SEQ ID NO: 919105 - DNA, 25 bp, Mus musculus
ttacagacgttactcatgacttggg

SEQ ID NO: 919106 - DNA, 25 bp, Mus musculus
ttacagacgttagtcatgacttggg

SEQ ID NO: 919107 - DNA, 25 bp, Mus musculus
ttacagactattactttcacctctc

SEQ ID NO: 919108 - DNA, 25 bp, Mus musculus
ttacagactatttctttcacctctc

SEQ ID NO: 919109 - DNA, 25 bp, Mus musculus
ttacagactgacagggtggctccct

SEQ ID NO: 919110 - DNA, 25 bp, Mus musculus
ttacagactgactgggtggctccct

SEQ ID NO: 919111 - DNA, 25 bp, Mus musculus
ttacagacttaaatgccgaggtgga

SEQ ID NO: 919112 - DNA, 25 bp, Mus musculus
ttacagacttaattgccgaggtgga

SEQ ID NO: 919113 - DNA, 25 bp, Mus musculus
ttacagacttgcagttctggccagg

SEQ ID NO: 919114 - DNA, 25 bp, Mus musculus
ttacagacttgctgttctggccagg

SEQ ID NO: 919115 - DNA, 25 bp, Mus musculus
ttacagactttcaggccagcaggca

SEQ ID NO: 919116 - DNA, 25 bp, Mus musculus
ttacagactttcatggcccgcaggc

SEQ ID NO: 919117 - DNA, 25 bp, Mus musculus
ttacagactttctggccagcaggca

SEQ ID NO: 919118 - DNA, 25 bp, Mus musculus
ttacagactttcttggcccgcaggc

SEQ ID NO: 919119 - DNA, 25 bp, Mus musculus
ttacagagacttattcccataacta

SEQ ID NO: 919120 - DNA, 25 bp, Mus musculus
ttacagagactttttcccataacta

SEQ ID NO: 919121 - DNA, 25 bp, Mus musculus
ttacagagaggccccttgggttgac

SEQ ID NO: 919122 - DNA, 25 bp, Mus musculus
ttacagagaggcgccttgggttgac

SEQ ID NO: 919123 - DNA, 25 bp, Mus musculus
ttacagagagttcgctatgcaataa

SEQ ID NO: 919124 - DNA, 25 bp, Mus musculus
ttacagagagttggctatgcaataa

SEQ ID NO: 919125 - DNA, 25 bp, Mus musculus
ttacagagatcccacttcaaaaggc

SEQ ID NO: 919126 - DNA, 25 bp, Mus musculus
ttacagagatccgacttcaaaaggc

SEQ ID NO: 919127 - DNA, 25 bp, Mus musculus
ttacagagccgccagcccagtagac

SEQ ID NO: 919128 - DNA, 25 bp, Mus musculus
ttacagagccgcgagcccagtagac

SEQ ID NO: 919129 - DNA, 25 bp, Mus musculus
ttacagagccttcctactcttaatt

SEQ ID NO: 919130 - DNA, 25 bp, Mus musculus
ttacagagccttgctactcttaatt

SEQ ID NO: 919131 - DNA, 25 bp, Mus musculus
ttacagagctggcagggccttgtcc

SEQ ID NO: 919132 - DNA, 25 bp, Mus musculus
ttacagagctgggagggccttgtcc

SEQ ID NO: 919133 - DNA, 25 bp, Mus musculus
ttacagaggtagatcctagggctac

SEQ ID NO: 919134 - DNA, 25 bp, Mus musculus
ttacagaggtagttcctagggctac

SEQ ID NO: 919135 - DNA, 25 bp, Mus musculus
ttacagagtagtatcctgccctgga

SEQ ID NO: 919136 - DNA, 25 bp, Mus musculus
ttacagagtagtttcctgccctgga

SEQ ID NO: 919137 - DNA, 25 bp, Mus musculus
ttacagagtgggaaggaaggcctat

SEQ ID NO: 919138 - DNA, 25 bp, Mus musculus
ttacagagtgggtaggaaggcctat

SEQ ID NO: 919139 - DNA, 25 bp, Mus musculus
ttacagatactcatcagcaacttga

SEQ ID NO: 919140 - DNA, 25 bp, Mus musculus
ttacagatactcttcagcaacttga

SEQ ID NO: 919141 - DNA, 25 bp, Mus musculus
ttacagatagaacccagcttgccct

SEQ ID NO: 919142 - DNA, 25 bp, Mus musculus
ttacagatagaagccagcttgccct

SEQ ID NO: 919143 - DNA, 25 bp, Mus musculus
ttacagatataaactcatgccacag

SEQ ID NO: 919144 - DNA, 25 bp, Mus musculus
ttacagatataatctcatgccacag

SEQ ID NO: 919145 - DNA, 25 bp, Mus musculus
ttacagatatagagctggcccgcct

SEQ ID NO: 919146 - DNA, 25 bp, Mus musculus
ttacagatatagtgctggcccgcct

SEQ ID NO: 919147 - DNA, 25 bp, Mus musculus
ttacagatcctgctttgccttgggt

SEQ ID NO: 919148 - DNA, 25 bp, Mus musculus
ttacagatcctggtttgccttgggt

SEQ ID NO: 919149 - DNA, 25 bp, Mus musculus
ttacagatcgatagggacccaatat

SEQ ID NO: 919150 - DNA, 25 bp, Mus musculus
ttacagatcgattgggacccaatat

SEQ ID NO: 919151 - DNA, 25 bp, Mus musculus
ttacagatgacaaggaacacattca

SEQ ID NO: 919152 - DNA, 25 bp, Mus musculus
ttacagatgacatggaacacattca

SEQ ID NO: 919153 - DNA, 25 bp, Mus musculus
ttacagatgaggaaccttagacaaa

SEQ ID NO: 919154 - DNA, 25 bp, Mus musculus
ttacagatgaggtaccttagacaaa

SEQ ID NO: 919155 - DNA, 25 bp, Mus musculus
ttacagatgtgactaggacgcccca

SEQ ID NO: 919156 - DNA, 25 bp, Mus musculus
ttacagatgtgagtaggacgcccca

SEQ ID NO: 919157 - DNA, 25 bp, Mus musculus
ttacagatttccacaagcaagtcac

SEQ ID NO: 919158 - DNA, 25 bp, Mus musculus
ttacagatttcctcaagcaagtcac

SEQ ID NO: 919159 - DNA, 25 bp, Mus musculus
ttacagcaatgcatatatagtccct

SEQ ID NO: 919160 - DNA, 25 bp, Mus musculus
ttacagcaatgcttatatagtccct

SEQ ID NO: 919161 - DNA, 25 bp, Mus musculus
ttacagcacctgcttataacaggaa

SEQ ID NO: 919162 - DNA, 25 bp, Mus musculus
ttacagcacctggttataacaggaa

SEQ ID NO: 919163 - DNA, 25 bp, Mus musculus
ttacagcacgtgatgcttctgctga

SEQ ID NO: 919164 - DNA, 25 bp, Mus musculus
ttacagcacgtgttgcttctgctga

SEQ ID NO: 919165 - DNA, 25 bp, Mus musculus
ttacagcactctcctctgtgaattt

SEQ ID NO: 919166 - DNA, 25 bp, Mus musculus
ttacagcactctgctctgtgaattt

SEQ ID NO: 919167 - DNA, 25 bp, Mus musculus
ttacagcagattccctccaaggagc

SEQ ID NO: 919168 - DNA, 25 bp, Mus musculus
ttacagcagattgcctccaaggagc

SEQ ID NO: 919169 - DNA, 25 bp, Mus musculus
ttacagcagccacccaacgcgaagg

SEQ ID NO: 919170 - DNA, 25 bp, Mus musculus
ttacagcagccagccaacgcgaagg

SEQ ID NO: 919171 - DNA, 25 bp, Mus musculus
ttacagcaggatctagcctcccaag

SEQ ID NO: 919172 - DNA, 25 bp, Mus musculus
ttacagcaggatgtagcctcccaag

SEQ ID NO: 919173 - DNA, 25 bp, Mus musculus
ttacagcagtgccaatttgccaaag

SEQ ID NO: 919174 - DNA, 25 bp, Mus musculus
ttacagcagtgcgaatttgccaaag

SEQ ID NO: 919175 - DNA, 25 bp, Mus musculus
ttacagcattgtattctgaaaagtt

SEQ ID NO: 919176 - DNA, 25 bp, Mus musculus
ttacagcattgttttctgaaaagtt

SEQ ID NO: 919177 - DNA, 25 bp, Mus musculus
ttacagcccagaagactaaagactt

SEQ ID NO: 919178 - DNA, 25 bp, Mus musculus
ttacagcccagatgactaaagactt

SEQ ID NO: 919179 - DNA, 25 bp, Mus musculus
ttacagccccacagacagaattttg

SEQ ID NO: 919180 - DNA, 25 bp, Mus musculus
ttacagccccactgacagaattttg

SEQ ID NO: 919181 - DNA, 25 bp, Mus musculus
ttacagccccatactgttcaatttc

SEQ ID NO: 919182 - DNA, 25 bp, Mus musculus
ttacagccccattctgttcaatttc

SEQ ID NO: 919183 - DNA, 25 bp, Mus musculus
ttacagcccccaagtatactctact

SEQ ID NO: 919184 - DNA, 25 bp, Mus musculus
ttacagcccccatgtatactctact

SEQ ID NO: 919185 - DNA, 25 bp, Mus musculus
ttacagccctgtacaatctgtttcg

SEQ ID NO: 919186 - DNA, 25 bp, Mus musculus
ttacagccctgttcaatctgtttcg

SEQ ID NO: 919187 - DNA, 25 bp, Mus musculus
ttacagccgcctaggaggacaattg

SEQ ID NO: 919188 - DNA, 25 bp, Mus musculus
ttacagccgccttggaggacaattg

SEQ ID NO: 919189 - DNA, 25 bp, Mus musculus
ttacagccggcaaggatgtcctggt

SEQ ID NO: 919190 - DNA, 25 bp, Mus musculus
ttacagccggcatggatgtcctggt

SEQ ID NO: 919191 - DNA, 25 bp, Mus musculus
ttacagcctaaacggtactttgctc

SEQ ID NO: 919192 - DNA, 25 bp, Mus musculus
ttacagcctaaagggtactttgctc

SEQ ID NO: 919193 - DNA, 25 bp, Mus musculus
ttacagcctaccactagcatgttgg

SEQ ID NO: 919194 - DNA, 25 bp, Mus musculus
ttacagcctacctctagcatgttgg

SEQ ID NO: 919195 - DNA, 25 bp, Mus musculus
ttacagcctgcgaaggtgactcact

SEQ ID NO: 919196 - DNA, 25 bp, Mus musculus
ttacagcctgcgtaggtgactcact

SEQ ID NO: 919197 - DNA, 25 bp, Mus musculus
ttacagcgacctccagaactgcttg

SEQ ID NO: 919198 - DNA, 25 bp, Mus musculus
ttacagcgacctgcagaactgcttg

SEQ ID NO: 919199 - DNA, 25 bp, Mus musculus
ttacagcgcaaaactctctgttctt

SEQ ID NO: 919200 - DNA, 25 bp, Mus musculus
ttacagcgcaaatctctctgttctt

SEQ ID NO: 919201 - DNA, 25 bp, Mus musculus
ttacagcgcctgaagaatgccccta

SEQ ID NO: 919202 - DNA, 25 bp, Mus musculus
ttacagcgcctgtagaatgccccta

SEQ ID NO: 919203 - DNA, 25 bp, Mus musculus
ttacagcgttttaaagcctccgcta

SEQ ID NO: 919204 - DNA, 25 bp, Mus musculus
ttacagcgtttttaagcctccgcta

SEQ ID NO: 919205 - DNA, 25 bp, Mus musculus
ttacagctatataccacgacaccta

SEQ ID NO: 919206 - DNA, 25 bp, Mus musculus
ttacagctatattccacgacaccta

SEQ ID NO: 919207 - DNA, 25 bp, Mus musculus
ttacagctcccacattctcaggatt

SEQ ID NO: 919208 - DNA, 25 bp, Mus musculus
ttacagctcccagattctcaggatt

SEQ ID NO: 919209 - DNA, 25 bp, Mus musculus
ttacagctgcctcccaggaacatgg

SEQ ID NO: 919210 - DNA, 25 bp, Mus musculus
ttacagctgcctgccaggaacatgg

SEQ ID NO: 919211 - DNA, 25 bp, Mus musculus
ttacagctgctcagtcgccttgaaa

SEQ ID NO: 919212 - DNA, 25 bp, Mus musculus
ttacagctgctctgtcgccttgaaa

SEQ ID NO: 919213 - DNA, 25 bp, Mus musculus
ttacagctgttgctagtctgcaccc

SEQ ID NO: 919214 - DNA, 25 bp, Mus musculus
ttacagctgttggtagtctgcaccc

SEQ ID NO: 919215 - DNA, 25 bp, Mus musculus
ttacagcttcaaacccataccttga

SEQ ID NO: 919216 - DNA, 25 bp, Mus musculus
ttacagcttcaatcccataccttga

SEQ ID NO: 919217 - DNA, 25 bp, Mus musculus
ttacaggaagacatctcgctgaccc

SEQ ID NO: 919218 - DNA, 25 bp, Mus musculus
ttacaggaagacttctcgctgaccc

SEQ ID NO: 919219 - DNA, 25 bp, Mus musculus
ttacaggaagggattgatgccagct

SEQ ID NO: 919220 - DNA, 25 bp, Mus musculus
ttacaggaagggtttgatgccagct

SEQ ID NO: 919221 - DNA, 25 bp, Mus musculus
ttacaggacagactcggcccagcgg

SEQ ID NO: 919222 - DNA, 25 bp, Mus musculus
ttacaggacagagtcggcccagcgg

SEQ ID NO: 919223 - DNA, 25 bp, Mus musculus
ttacaggactaaccccagtgacttg

SEQ ID NO: 919224 - DNA, 25 bp, Mus musculus
ttacaggactaagcccagtgacttg

SEQ ID NO: 919225 - DNA, 25 bp, Mus musculus
ttacaggaggtgatagcatgggtca

SEQ ID NO: 919226 - DNA, 25 bp, Mus musculus
ttacaggaggtgttagcatgggtca

SEQ ID NO: 919227 - DNA, 25 bp, Mus musculus
ttacaggatagaactgccttcagta

SEQ ID NO: 919228 - DNA, 25 bp, Mus musculus
ttacaggatagatctgccttcagta

SEQ ID NO: 919229 - DNA, 25 bp, Mus musculus
ttacaggatgccaccaacaatgcca

SEQ ID NO: 919230 - DNA, 25 bp, Mus musculus
ttacaggatgcctccaacaatgcca

SEQ ID NO: 919231 - DNA, 25 bp, Mus musculus
ttacaggatgctacgactctatgat

SEQ ID NO: 919232 - DNA, 25 bp, Mus musculus
ttacaggatgcttcgactctatgat

SEQ ID NO: 919233 - DNA, 25 bp, Mus musculus
ttacaggcagatctgctcacttcat

SEQ ID NO: 919234 - DNA, 25 bp, Mus musculus
ttacaggcagatgtgctcacttcat

SEQ ID NO: 919235 - DNA, 25 bp, Mus musculus
ttacaggcatgacctactatgtcta

SEQ ID NO: 919236 - DNA, 25 bp, Mus musculus
ttacaggcatgagctactatgtcta

SEQ ID NO: 919237 - DNA, 25 bp, Mus musculus
ttacaggcatgcatgaccacacgtg

SEQ ID NO: 919238 - DNA, 25 bp, Mus musculus
ttacaggcatgcatggaggacatac

SEQ ID NO: 919239 - DNA, 25 bp, Mus musculus
ttacaggcatgcttgaccacacgtg

SEQ ID NO: 919240 - DNA, 25 bp, Mus musculus
ttacaggcatgcttggaggacatac

SEQ ID NO: 919241 - DNA, 25 bp, Mus musculus
ttacaggccattcgtgtagcttgaa

SEQ ID NO: 919242 - DNA, 25 bp, Mus musculus
ttacaggccattggtgtagcttgaa

SEQ ID NO: 919243 - DNA, 25 bp, Mus musculus
ttacaggccctgcatcaataagatc

SEQ ID NO: 919244 - DNA, 25 bp, Mus musculus
ttacaggccctggatcaataagatc

SEQ ID NO: 919245 - DNA, 25 bp, Mus musculus
ttacaggctgatactctccgggcag

SEQ ID NO: 919246 - DNA, 25 bp, Mus musculus
ttacaggctgattctctccgggcag

SEQ ID NO: 919247 - DNA, 25 bp, Mus musculus
ttacaggctgcccagaattcaggaa

SEQ ID NO: 919248 - DNA, 25 bp, Mus musculus
ttacaggctgccgagaattcaggaa

SEQ ID NO: 919249 - DNA, 25 bp, Mus musculus
ttacaggctttcatattccttccag

SEQ ID NO: 919250 - DNA, 25 bp, Mus musculus
ttacaggctttcttattccttccag

SEQ ID NO: 919251 - DNA, 25 bp, Mus musculus
ttacagggaaagagacaaccaggct

SEQ ID NO: 919252 - DNA, 25 bp, Mus musculus
ttacagggaaagtgacaaccaggct

SEQ ID NO: 919253 - DNA, 25 bp, Mus musculus
ttacagggagccacgactgcaccag

SEQ ID NO: 919254 - DNA, 25 bp, Mus musculus
ttacagggagcctcgactgcaccag

SEQ ID NO: 919255 - DNA, 25 bp, Mus musculus
ttacagggatcccaattccatagaa

SEQ ID NO: 919256 - DNA, 25 bp, Mus musculus
ttacagggatccgaattccatagaa

SEQ ID NO: 919257 - DNA, 25 bp, Mus musculus
ttacagggattcacgcagtttctct

SEQ ID NO: 919258 - DNA, 25 bp, Mus musculus
ttacagggattctcgcagtttctct

SEQ ID NO: 919259 - DNA, 25 bp, Mus musculus
ttacagggcggtcaaatgaccatcc

SEQ ID NO: 919260 - DNA, 25 bp, Mus musculus
ttacagggcggtgaaatgaccatcc

SEQ ID NO: 919261 - DNA, 25 bp, Mus musculus
ttacagggtcatatcctaatgaaaa

SEQ ID NO: 919262 - DNA, 25 bp, Mus musculus
ttacagggtcatttcctaatgaaaa

SEQ ID NO: 919263 - DNA, 25 bp, Mus musculus
ttacagggtgacctgttccagctgt

SEQ ID NO: 919264 - DNA, 25 bp, Mus musculus
ttacagggtgacgtgttccagctgt

SEQ ID NO: 919265 - DNA, 25 bp, Mus musculus
ttacagggttgtcgataaaggtcca

SEQ ID NO: 919266 - DNA, 25 bp, Mus musculus
ttacagggttgtggataaaggtcca

SEQ ID NO: 919267 - DNA, 25 bp, Mus musculus
ttacaggtacacctagcttcctcgt

SEQ ID NO: 919268 - DNA, 25 bp, Mus musculus
ttacaggtacacgtagcttcctcgt

SEQ ID NO: 919269 - DNA, 25 bp, Mus musculus
ttacaggtgcacaacaggtatgctc

SEQ ID NO: 919270 - DNA, 25 bp, Mus musculus
ttacaggtgcactacaggtatgctc

SEQ ID NO: 919271 - DNA, 25 bp, Mus musculus
ttacaggtggagaccgccaaagccc

SEQ ID NO: 919272 - DNA, 25 bp, Mus musculus
ttacaggtggagtccgccaaagccc

SEQ ID NO: 919273 - DNA, 25 bp, Mus musculus
ttacaggtggatcgtcccaagcctc

SEQ ID NO: 919274 - DNA, 25 bp, Mus musculus
ttacaggtggatggtcccaagcctc

SEQ ID NO: 919275 - DNA, 25 bp, Mus musculus
ttacaggtggttacggtccagtctc

SEQ ID NO: 919276 - DNA, 25 bp, Mus musculus
ttacaggtggtttcggtccagtctc

SEQ ID NO: 919277 - DNA, 25 bp, Mus musculus
ttacaggtgtagaccccagagtctg

SEQ ID NO: 919278 - DNA, 25 bp, Mus musculus
ttacaggtgtagtccccagagtctg

SEQ ID NO: 919279 - DNA, 25 bp, Mus musculus
ttacaggtgtgtaccgccgtggctg

SEQ ID NO: 919280 - DNA, 25 bp, Mus musculus
ttacaggtgtgttccgccgtggctg

SEQ ID NO: 919281 - DNA, 25 bp, Mus musculus
ttacagtactatacggacccattgg

SEQ ID NO: 919282 - DNA, 25 bp, Mus musculus
ttacagtactattcggacccattgg

SEQ ID NO: 919283 - DNA, 25 bp, Mus musculus
ttacagtattccaaaactccttttg

SEQ ID NO: 919284 - DNA, 25 bp, Mus musculus
ttacagtattcctaaactccttttg

SEQ ID NO: 919285 - DNA, 25 bp, Mus musculus
ttacagtcagaaaaacctgcattat

SEQ ID NO: 919286 - DNA, 25 bp, Mus musculus
ttacagtcagaataacctgcattat

SEQ ID NO: 919287 - DNA, 25 bp, Mus musculus
ttacagtccaaacaggaagagctgc

SEQ ID NO: 919288 - DNA, 25 bp, Mus musculus
ttacagtccaaagaggaagagctgc

SEQ ID NO: 919289 - DNA, 25 bp, Mus musculus
ttacagtcctctacgctgtggtgac

SEQ ID NO: 919290 - DNA, 25 bp, Mus musculus
ttacagtcctcttcgctgtggtgac

SEQ ID NO: 919291 - DNA, 25 bp, Mus musculus
ttacagtctgtaagcatgtgccata

SEQ ID NO: 919292 - DNA, 25 bp, Mus musculus
ttacagtctgtatgcatgtgccata

SEQ ID NO: 919293 - DNA, 25 bp, Mus musculus
ttacagtgacatactttaataacat

SEQ ID NO: 919294 - DNA, 25 bp, Mus musculus
ttacagtgacattctttaataacat

SEQ ID NO: 919295 - DNA, 25 bp, Mus musculus
ttacagtgatctacattcgggacag

SEQ ID NO: 919296 - DNA, 25 bp, Mus musculus
ttacagtgatcttcattcgggacag

SEQ ID NO: 919297 - DNA, 25 bp, Mus musculus
ttacagtgcaagctgcagcagagac

SEQ ID NO: 919298 - DNA, 25 bp, Mus musculus
ttacagtgcaaggtgcagcagagac

SEQ ID NO: 919299 - DNA, 25 bp, Mus musculus
ttacagtgcataactggttgacaga

SEQ ID NO: 919300 - DNA, 25 bp, Mus musculus
ttacagtgcatatctggttgacaga

SEQ ID NO: 919301 - DNA, 25 bp, Mus musculus
ttacagtgggtaattactgccttct

SEQ ID NO: 919302 - DNA, 25 bp, Mus musculus
ttacagtgggtatttactgccttct

SEQ ID NO: 919303 - DNA, 25 bp, Mus musculus
ttacagtggtttcccattagcgtgt

SEQ ID NO: 919304 - DNA, 25 bp, Mus musculus
ttacagtggtttgccattagcgtgt

SEQ ID NO: 919305 - DNA, 25 bp, Mus musculus
ttacagtgtcagctgctgagctgca

SEQ ID NO: 919306 - DNA, 25 bp, Mus musculus
ttacagtgtcaggtgctgagctgca

SEQ ID NO: 919307 - DNA, 25 bp, Mus musculus
ttacagtgtcatcatccacacgctg

SEQ ID NO: 919308 - DNA, 25 bp, Mus musculus
ttacagtgtcatgatccacacgctg

SEQ ID NO: 919309 - DNA, 25 bp, Mus musculus
ttacagtgtgtcactgagggaagtc

SEQ ID NO: 919310 - DNA, 25 bp, Mus musculus
ttacagtgtgtctctgagggaagtc

SEQ ID NO: 919311 - DNA, 25 bp, Mus musculus
ttacagttaccacacttgtcaccaa

SEQ ID NO: 919312 - DNA, 25 bp, Mus musculus
ttacagttaccagacttgtcaccaa

SEQ ID NO: 919313 - DNA, 25 bp, Mus musculus
ttacagttatgtagtggtgcagaac

SEQ ID NO: 919314 - DNA, 25 bp, Mus musculus
ttacagttatgttgtggtgcagaac

SEQ ID NO: 919315 - DNA, 25 bp, Mus musculus
ttacagttcacaccattaacaaatg

SEQ ID NO: 919316 - DNA, 25 bp, Mus musculus
ttacagttcacagcattaacaaatg

SEQ ID NO: 919317 - DNA, 25 bp, Mus musculus
ttacagttcatgacgtcgtcgtcat

SEQ ID NO: 919318 - DNA, 25 bp, Mus musculus
ttacagttcatgtcgtcgtcgtcat

SEQ ID NO: 919319 - DNA, 25 bp, Mus musculus
ttacagttccccattgtggcctgat

SEQ ID NO: 919320 - DNA, 25 bp, Mus musculus
ttacagttcccctttgtggcctgat

SEQ ID NO: 919321 - DNA, 25 bp, Mus musculus
ttacagttgcagaaaacccttccac

SEQ ID NO: 919322 - DNA, 25 bp, Mus musculus
ttacagttgcagaggcttagctcat

SEQ ID NO: 919323 - DNA, 25 bp, Mus musculus
ttacagttgcagtaaacccttccac

SEQ ID NO: 919324 - DNA, 25 bp, Mus musculus
ttacagttgcagtggcttagctcat

SEQ ID NO: 919325 - DNA, 25 bp, Mus musculus
ttacagttggccctctggacgtggt

SEQ ID NO: 919326 - DNA, 25 bp, Mus musculus
ttacagttggccgtctggacgtggt

SEQ ID NO: 919327 - DNA, 25 bp, Mus musculus
ttacagttgtatctggtcagcccag

SEQ ID NO: 919328 - DNA, 25 bp, Mus musculus
ttacagttgtatgtggtcagcccag

SEQ ID NO: 919329 - DNA, 25 bp, Mus musculus
ttacagttgttgaacacaatcctag

SEQ ID NO: 919330 - DNA, 25 bp, Mus musculus
ttacagttgttgtacacaatcctag

SEQ ID NO: 919331 - DNA, 25 bp, Mus musculus
ttacagtttccccttccacaactct

SEQ ID NO: 919332 - DNA, 25 bp, Mus musculus
ttacagtttcccgttccacaactct

SEQ ID NO: 919333 - DNA, 25 bp, Mus musculus
ttacagtttggaactctgatgctat

SEQ ID NO: 919334 - DNA, 25 bp, Mus musculus
ttacagtttggatctctgatgctat

SEQ ID NO: 919335 - DNA, 25 bp, Mus musculus
ttacagtttgtgaactagctgccat

SEQ ID NO: 919336 - DNA, 25 bp, Mus musculus
ttacagtttgtgtactagctgccat

SEQ ID NO: 919337 - DNA, 25 bp, Mus musculus
ttacagttttgcagccacgtgacga

SEQ ID NO: 919338 - DNA, 25 bp, Mus musculus
ttacagttttgctgccacgtgacga

SEQ ID NO: 919339 - DNA, 25 bp, Mus musculus
ttacataaaaccaccacgactttag

SEQ ID NO: 919340 - DNA, 25 bp, Mus musculus
ttacataaaacctccacgactttag

SEQ ID NO: 919341 - DNA, 25 bp, Mus musculus
ttacataaaccacaggcgagccagg

SEQ ID NO: 919342 - DNA, 25 bp, Mus musculus
ttacataaaccagaggcgagccagg

SEQ ID NO: 919343 - DNA, 25 bp, Mus musculus
ttacataaacccctgcctaataagc

SEQ ID NO: 919344 - DNA, 25 bp, Mus musculus
ttacataaacccgtgcctaataagc

SEQ ID NO: 919345 - DNA, 25 bp, Mus musculus
ttacataacccgctcgcattccaaa

SEQ ID NO: 919346 - DNA, 25 bp, Mus musculus
ttacataacccggtcgcattccaaa

SEQ ID NO: 919347 - DNA, 25 bp, Mus musculus
ttacataacggtcgccgagtgccca

SEQ ID NO: 919348 - DNA, 25 bp, Mus musculus
ttacataacggtggccgagtgccca

SEQ ID NO: 919349 - DNA, 25 bp, Mus musculus
ttacataactaacgggttctgccaa

SEQ ID NO: 919350 - DNA, 25 bp, Mus musculus
ttacataactaaggggttctgccaa

SEQ ID NO: 919351 - DNA, 25 bp, Mus musculus
ttacataatgttagcaaggccctat

SEQ ID NO: 919352 - DNA, 25 bp, Mus musculus
ttacataatgtttgcaaggccctat

SEQ ID NO: 919353 - DNA, 25 bp, Mus musculus
ttacatacagctactgtgtcccggc

SEQ ID NO: 919354 - DNA, 25 bp, Mus musculus
ttacatacagcttctgtgtcccggc

SEQ ID NO: 919355 - DNA, 25 bp, Mus musculus
ttacatacgccacggccatgcgtgc

SEQ ID NO: 919356 - DNA, 25 bp, Mus musculus
ttacatacgccagggccatgcgtgc

SEQ ID NO: 919357 - DNA, 25 bp, Mus musculus
ttacatagcattagtcacctcagtc

SEQ ID NO: 919358 - DNA, 25 bp, Mus musculus
ttacatagcatttgtcacctcagtc

SEQ ID NO: 919359 - DNA, 25 bp, Mus musculus
ttacatagtgaacgtccagaataaa

SEQ ID NO: 919360 - DNA, 25 bp, Mus musculus
ttacatagtgaaggtccagaataaa

SEQ ID NO: 919361 - DNA, 25 bp, Mus musculus
ttacatagtgtacagcagtcctcat

SEQ ID NO: 919362 - DNA, 25 bp, Mus musculus
ttacatagtgtagagcagtcctcat

SEQ ID NO: 919363 - DNA, 25 bp, Mus musculus
ttacatagttccatgtccttttggc

SEQ ID NO: 919364 - DNA, 25 bp, Mus musculus
ttacatagttccttgtccttttggc

SEQ ID NO: 919365 - DNA, 25 bp, Mus musculus
ttacatatcaccctaatccaagctt

SEQ ID NO: 919366 - DNA, 25 bp, Mus musculus
ttacatatcaccgtaatccaagctt

SEQ ID NO: 919367 - DNA, 25 bp, Mus musculus
ttacatatcccacatctttggcgat

SEQ ID NO: 919368 - DNA, 25 bp, Mus musculus
ttacatatcccagatctttggcgat

SEQ ID NO: 919369 - DNA, 25 bp, Mus musculus
ttacatatctctactaatgctttct

SEQ ID NO: 919370 - DNA, 25 bp, Mus musculus
ttacatatctcttctaatgctttct

SEQ ID NO: 919371 - DNA, 25 bp, Mus musculus
ttacatatgcctcgtgtgttattca

SEQ ID NO: 919372 - DNA, 25 bp, Mus musculus
ttacatatgcctggtgtgttattca

SEQ ID NO: 919373 - DNA, 25 bp, Mus musculus
ttacatatgctcaccatgtcctgga

SEQ ID NO: 919374 - DNA, 25 bp, Mus musculus
ttacatatgctctccatgtcctgga

SEQ ID NO: 919375 - DNA, 25 bp, Mus musculus
ttacatatgtgcacagctttagcaa

SEQ ID NO: 919376 - DNA, 25 bp, Mus musculus
ttacatatgtgctcagctttagcaa

SEQ ID NO: 919377 - DNA, 25 bp, Mus musculus
ttacatatttacatgttcctagcca

SEQ ID NO: 919378 - DNA, 25 bp, Mus musculus
ttacatatttacttgttcctagcca

SEQ ID NO: 919379 - DNA, 25 bp, Mus musculus
ttacatcaacggaatttaaaatatc

SEQ ID NO: 919380 - DNA, 25 bp, Mus musculus
ttacatcaacggtatttaaaatatc

SEQ ID NO: 919381 - DNA, 25 bp, Mus musculus
ttacatcaatggagagaccgtagta

SEQ ID NO: 919382 - DNA, 25 bp, Mus musculus
ttacatcaatggtgagaccgtagta

SEQ ID NO: 919383 - DNA, 25 bp, Mus musculus
ttacatcacttgctcggtggtaaat

SEQ ID NO: 919384 - DNA, 25 bp, Mus musculus
ttacatcacttggtcggtggtaaat

SEQ ID NO: 919385 - DNA, 25 bp, Mus musculus
ttacatcagccaaggcgctccaggt

SEQ ID NO: 919386 - DNA, 25 bp, Mus musculus
ttacatcagccatggcgctccaggt

SEQ ID NO: 919387 - DNA, 25 bp, Mus musculus
ttacatcatgacctacggcagccag

SEQ ID NO: 919388 - DNA, 25 bp, Mus musculus
ttacatcatgacgtacggcagccag

SEQ ID NO: 919389 - DNA, 25 bp, Mus musculus
ttacatcatgtgagacgcagccctg

SEQ ID NO: 919390 - DNA, 25 bp, Mus musculus
ttacatcatgtgctttcggcgtgaa

SEQ ID NO: 919391 - DNA, 25 bp, Mus musculus
ttacatcatgtggtttcggcgtgaa

SEQ ID NO: 919392 - DNA, 25 bp, Mus musculus
ttacatcatgtgtgacgcagccctg

SEQ ID NO: 919393 - DNA, 25 bp, Mus musculus
ttacatccacagagcatggtgcatg

SEQ ID NO: 919394 - DNA, 25 bp, Mus musculus
ttacatccacagtgcatggtgcatg

SEQ ID NO: 919395 - DNA, 25 bp, Mus musculus
ttacatcccagtcatggccaatgtc

SEQ ID NO: 919396 - DNA, 25 bp, Mus musculus
ttacatcccagtgatggccaatgtc

SEQ ID NO: 919397 - DNA, 25 bp, Mus musculus
ttacatccctagcagggttgaatat

SEQ ID NO: 919398 - DNA, 25 bp, Mus musculus
ttacatccctaggagggttgaatat

SEQ ID NO: 919399 - DNA, 25 bp, Mus musculus
ttacatccgctactttacacatttg

SEQ ID NO: 919400 - DNA, 25 bp, Mus musculus
ttacatccgctagtttacacatttg

SEQ ID NO: 919401 - DNA, 25 bp, Mus musculus
ttacatcctaagatctcaagcagag

SEQ ID NO: 919402 - DNA, 25 bp, Mus musculus
ttacatcctaagttctcaagcagag

SEQ ID NO: 919403 - DNA, 25 bp, Mus musculus
ttacatcctgacatctgaaatctag

SEQ ID NO: 919404 - DNA, 25 bp, Mus musculus
ttacatcctgacttctgaaatctag

SEQ ID NO: 919405 - DNA, 25 bp, Mus musculus
ttacatcctgagaaccacaaggtgg

SEQ ID NO: 919406 - DNA, 25 bp, Mus musculus
ttacatcctgagtaccacaaggtgg

SEQ ID NO: 919407 - DNA, 25 bp, Mus musculus
ttacatcctgcaacagagcgggttg

SEQ ID NO: 919408 - DNA, 25 bp, Mus musculus
ttacatcctgcatcagagcgggttg

SEQ ID NO: 919409 - DNA, 25 bp, Mus musculus
ttacatcgatgaaatcactgtgatc

SEQ ID NO: 919410 - DNA, 25 bp, Mus musculus
ttacatcgatgatatcactgtgatc

SEQ ID NO: 919411 - DNA, 25 bp, Mus musculus
ttacatcgccatagctccaaaggaa

SEQ ID NO: 919412 - DNA, 25 bp, Mus musculus
ttacatcgccattgctccaaaggaa

SEQ ID NO: 919413 - DNA, 25 bp, Mus musculus
ttacatcggctgctttggaacaatc

SEQ ID NO: 919414 - DNA, 25 bp, Mus musculus
ttacatcggctggtttggaacaatc

SEQ ID NO: 919415 - DNA, 25 bp, Mus musculus
ttacatcggcttaatctgtttccag

SEQ ID NO: 919416 - DNA, 25 bp, Mus musculus
ttacatcggctttatctgtttccag

SEQ ID NO: 919417 - DNA, 25 bp, Mus musculus
ttacatcgggtccacctacttcgag

SEQ ID NO: 919418 - DNA, 25 bp, Mus musculus
ttacatcgggtcgacctacttcgag

SEQ ID NO: 919419 - DNA, 25 bp, Mus musculus
ttacatcgtgccaaagggactttag

SEQ ID NO: 919420 - DNA, 25 bp, Mus musculus
ttacatcgtgcctaagggactttag

SEQ ID NO: 919421 - DNA, 25 bp, Mus musculus
ttacatctagcaacaagtccacttg

SEQ ID NO: 919422 - DNA, 25 bp, Mus musculus
ttacatctagcatcaagtccacttg

SEQ ID NO: 919423 - DNA, 25 bp, Mus musculus
ttacatctcgaaaggtcaggtgttg

SEQ ID NO: 919424 - DNA, 25 bp, Mus musculus
ttacatctcgaatggtcaggtgttg

SEQ ID NO: 919425 - DNA, 25 bp, Mus musculus
ttacatctgtttagccatatcaaag

SEQ ID NO: 919426 - DNA, 25 bp, Mus musculus
ttacatctgttttgccatatcaaag

SEQ ID NO: 919427 - DNA, 25 bp, Mus musculus
ttacatcttattcttgccggtatgg

SEQ ID NO: 919428 - DNA, 25 bp, Mus musculus
ttacatcttattgttgccggtatgg

SEQ ID NO: 919429 - DNA, 25 bp, Mus musculus
ttacatcttcacaagtcattctcca

SEQ ID NO: 919430 - DNA, 25 bp, Mus musculus
ttacatcttcactagtcattctcca

SEQ ID NO: 919431 - DNA, 25 bp, Mus musculus
ttacatcttgatcaccgtgtgtgtg

SEQ ID NO: 919432 - DNA, 25 bp, Mus musculus
ttacatcttgatgaccgtgtgtgtg

SEQ ID NO: 919433 - DNA, 25 bp, Mus musculus
ttacatcttgttcttcgtgcatcat

SEQ ID NO: 919434 - DNA, 25 bp, Mus musculus
ttacatcttgttgttcgtgcatcat

SEQ ID NO: 919435 - DNA, 25 bp, Mus musculus
ttacatcttttccttatgctctaag

SEQ ID NO: 919436 - DNA, 25 bp, Mus musculus
ttacatcttttcgttatgctctaag

SEQ ID NO: 919437 - DNA, 25 bp, Mus musculus
ttacatgaagttacacgcctcgcag

SEQ ID NO: 919438 - DNA, 25 bp, Mus musculus
ttacatgaagtttcacgcctcgcag

SEQ ID NO: 919439 - DNA, 25 bp, Mus musculus
ttacatgatcctattctacccggag

SEQ ID NO: 919440 - DNA, 25 bp, Mus musculus
ttacatgatccttttctacccggag

SEQ ID NO: 919441 - DNA, 25 bp, Mus musculus
ttacatgatggtcgctattcaataa

SEQ ID NO: 919442 - DNA, 25 bp, Mus musculus
ttacatgatggtggctattcaataa

SEQ ID NO: 919443 - DNA, 25 bp, Mus musculus
ttacatgcccagaagaaggaacctt

SEQ ID NO: 919444 - DNA, 25 bp, Mus musculus
ttacatgcccagtagaaggaacctt

SEQ ID NO: 919445 - DNA, 25 bp, Mus musculus
ttacatgccccaatttcaaacctgt

SEQ ID NO: 919446 - DNA, 25 bp, Mus musculus
ttacatgccccattttcaaacctgt

SEQ ID NO: 919447 - DNA, 25 bp, Mus musculus
ttacatgcggtgaccagggatccaa

SEQ ID NO: 919448 - DNA, 25 bp, Mus musculus
ttacatgcggtgtccagggatccaa

SEQ ID NO: 919449 - DNA, 25 bp, Mus musculus
ttacatgctactaaacagtcccctc

SEQ ID NO: 919450 - DNA, 25 bp, Mus musculus
ttacatgctacttaacagtcccctc

SEQ ID NO: 919451 - DNA, 25 bp, Mus musculus
ttacatgctccacgcagctagagaa

SEQ ID NO: 919452 - DNA, 25 bp, Mus musculus
ttacatgctccaggcagctagagaa

SEQ ID NO: 919453 - DNA, 25 bp, Mus musculus
ttacatgcttataccatgactgctt

SEQ ID NO: 919454 - DNA, 25 bp, Mus musculus
ttacatgcttattccatgactgctt

SEQ ID NO: 919455 - DNA, 25 bp, Mus musculus
ttacatggaatcagcttccggtgcc

SEQ ID NO: 919456 - DNA, 25 bp, Mus musculus
ttacatggaatctgcttccggtgcc

SEQ ID NO: 919457 - DNA, 25 bp, Mus musculus
ttacatggacaaaagcgggaagaat

SEQ ID NO: 919458 - DNA, 25 bp, Mus musculus
ttacatggacaatagcgggaagaat

SEQ ID NO: 919459 - DNA, 25 bp, Mus musculus
ttacatggagctccacttcactaag

SEQ ID NO: 919460 - DNA, 25 bp, Mus musculus
ttacatggagctgcacttcactaag

SEQ ID NO: 919461 - DNA, 25 bp, Mus musculus
ttacatggcagcattcacagggtgc

SEQ ID NO: 919462 - DNA, 25 bp, Mus musculus
ttacatggcagctttcacagggtgc

SEQ ID NO: 919463 - DNA, 25 bp, Mus musculus
ttacatggccccagggctaatttga

SEQ ID NO: 919464 - DNA, 25 bp, Mus musculus
ttacatggcccctgggctaatttga

SEQ ID NO: 919465 - DNA, 25 bp, Mus musculus
ttacatggccctcatacattgaata

SEQ ID NO: 919466 - DNA, 25 bp, Mus musculus
ttacatggccctgatacattgaata

SEQ ID NO: 919467 - DNA, 25 bp, Mus musculus
ttacatggcctgcaggtcagactct

SEQ ID NO: 919468 - DNA, 25 bp, Mus musculus
ttacatggcctggaggtcagactct

SEQ ID NO: 919469 - DNA, 25 bp, Mus musculus
ttacatggctaaatgtttgctacct

SEQ ID NO: 919470 - DNA, 25 bp, Mus musculus
ttacatggctaattgtttgctacct

SEQ ID NO: 919471 - DNA, 25 bp, Mus musculus
ttacatggctagaccatcctatacc

SEQ ID NO: 919472 - DNA, 25 bp, Mus musculus
ttacatggctagtccatcctatacc

SEQ ID NO: 919473 - DNA, 25 bp, Mus musculus
ttacatgggatgaatggctcccagt

SEQ ID NO: 919474 - DNA, 25 bp, Mus musculus
ttacatgggatgtatggctcccagt

SEQ ID NO: 919475 - DNA, 25 bp, Mus musculus
ttacatgggcgaacagcacggcgtt

SEQ ID NO: 919476 - DNA, 25 bp, Mus musculus
ttacatgggcgatcagcacggcgtt

SEQ ID NO: 919477 - DNA, 25 bp, Mus musculus
ttacatgtacttacagacctctctt

SEQ ID NO: 919478 - DNA, 25 bp, Mus musculus
ttacatgtactttcagacctctctt

SEQ ID NO: 919479 - DNA, 25 bp, Mus musculus
ttacatgtatgtcccggagtgaggt

SEQ ID NO: 919480 - DNA, 25 bp, Mus musculus
ttacatgtatgtgccggagtgaggt

SEQ ID NO: 919481 - DNA, 25 bp, Mus musculus
ttacatgtcattcctttttcttatt

SEQ ID NO: 919482 - DNA, 25 bp, Mus musculus
ttacatgtcattgctttttcttatt

SEQ ID NO: 919483 - DNA, 25 bp, Mus musculus
ttacatgtccagatcatactcccat

SEQ ID NO: 919484 - DNA, 25 bp, Mus musculus
ttacatgtccagttcatactcccat

SEQ ID NO: 919485 - DNA, 25 bp, Mus musculus
ttacatgtctacagtgatctgaaca

SEQ ID NO: 919486 - DNA, 25 bp, Mus musculus
ttacatgtctactgtgatctgaaca

SEQ ID NO: 919487 - DNA, 25 bp, Mus musculus
ttacatgtgggaaccatcacacctg

SEQ ID NO: 919488 - DNA, 25 bp, Mus musculus
ttacatgtgggatccatcacacctg

SEQ ID NO: 919489 - DNA, 25 bp, Mus musculus
ttacatgtgtatctcctgtgggaaa

SEQ ID NO: 919490 - DNA, 25 bp, Mus musculus
ttacatgtgtatgtcctgtgggaaa

SEQ ID NO: 919491 - DNA, 25 bp, Mus musculus
ttacatgtgtggaggttgcctgtgc

SEQ ID NO: 919492 - DNA, 25 bp, Mus musculus
ttacatgtgtggtggttgcctgtgc

SEQ ID NO: 919493 - DNA, 25 bp, Mus musculus
ttacatgttaagacacctgcagagg

SEQ ID NO: 919494 - DNA, 25 bp, Mus musculus
ttacatgttaagtcacctgcagagg

SEQ ID NO: 919495 - DNA, 25 bp, Mus musculus
ttacatgttacaacctctttaggtt

SEQ ID NO: 919496 - DNA, 25 bp, Mus musculus
ttacatgttacatcctctttaggtt

SEQ ID NO: 919497 - DNA, 25 bp, Mus musculus
ttacatgttccgactctccaaggat

SEQ ID NO: 919498 - DNA, 25 bp, Mus musculus
ttacatgttccgtctctccaaggat

SEQ ID NO: 919499 - DNA, 25 bp, Mus musculus
ttacatgttgtcactgggcagcagt

SEQ ID NO: 919500 - DNA, 25 bp, Mus musculus
ttacatgttgtctctgggcagcagt

SEQ ID NO: 919501 - DNA, 25 bp, Mus musculus
ttacatgtttgcaacctccactgtg

SEQ ID NO: 919502 - DNA, 25 bp, Mus musculus
ttacatgtttgctacctccactgtg

SEQ ID NO: 919503 - DNA, 25 bp, Mus musculus
ttacattaatcccttggctttcaat

SEQ ID NO: 919504 - DNA, 25 bp, Mus musculus
ttacattaatccgttggctttcaat

SEQ ID NO: 919505 - DNA, 25 bp, Mus musculus
ttacattacagcagaggaatcccag

SEQ ID NO: 919506 - DNA, 25 bp, Mus musculus
ttacattacagctgaggaatcccag

SEQ ID NO: 919507 - DNA, 25 bp, Mus musculus
ttacattacagtatgggctccagcc

SEQ ID NO: 919508 - DNA, 25 bp, Mus musculus
ttacattacagtttgggctccagcc

SEQ ID NO: 919509 - DNA, 25 bp, Mus musculus
ttacattacctgacatcgtctcaag

SEQ ID NO: 919510 - DNA, 25 bp, Mus musculus
ttacattacctgtcatcgtctcaag

SEQ ID NO: 919511 - DNA, 25 bp, Mus musculus
ttacattagactctccatgttcttc

SEQ ID NO: 919512 - DNA, 25 bp, Mus musculus
ttacattagactgtccatgttcttc

SEQ ID NO: 919513 - DNA, 25 bp, Mus musculus
ttacattatattcctctaagtgagt

SEQ ID NO: 919514 - DNA, 25 bp, Mus musculus
ttacattatattgctctaagtgagt

SEQ ID NO: 919515 - DNA, 25 bp, Mus musculus
ttacattatctccacaaaaatattg

SEQ ID NO: 919516 - DNA, 25 bp, Mus musculus
ttacattatctcgacaaaaatattg

SEQ ID NO: 919517 - DNA, 25 bp, Mus musculus
ttacattatgcaatctccgctagag

SEQ ID NO: 919518 - DNA, 25 bp, Mus musculus
ttacattatgcattctccgctagag

SEQ ID NO: 919519 - DNA, 25 bp, Mus musculus
ttacattcatcaaggctacaggtag

SEQ ID NO: 919520 - DNA, 25 bp, Mus musculus
ttacattcatcatggctacaggtag

SEQ ID NO: 919521 - DNA, 25 bp, Mus musculus
ttacattcattaagggttttgccct

SEQ ID NO: 919522 - DNA, 25 bp, Mus musculus
ttacattcattatgggttttgccct

SEQ ID NO: 919523 - DNA, 25 bp, Mus musculus
ttacattccactcctgggagaaggg

SEQ ID NO: 919524 - DNA, 25 bp, Mus musculus
ttacattccactgctgggagaaggg

SEQ ID NO: 919525 - DNA, 25 bp, Mus musculus
ttacattcccacaactcgctggctg

SEQ ID NO: 919526 - DNA, 25 bp, Mus musculus
ttacattcccactactcgctggctg

SEQ ID NO: 919527 - DNA, 25 bp, Mus musculus
ttacattccctaccctaaaagcctg

SEQ ID NO: 919528 - DNA, 25 bp, Mus musculus
ttacattccctagcctaaaagcctg

SEQ ID NO: 919529 - DNA, 25 bp, Mus musculus
ttacattcggttctctgtaagctct

SEQ ID NO: 919530 - DNA, 25 bp, Mus musculus
ttacattcggttgtctgtaagctct

SEQ ID NO: 919531 - DNA, 25 bp, Mus musculus
ttacattctaacaggtttaagtcaa

SEQ ID NO: 919532 - DNA, 25 bp, Mus musculus
ttacattctaactggtttaagtcaa

SEQ ID NO: 919533 - DNA, 25 bp, Mus musculus
ttacattctcaaactgcctttggtc

SEQ ID NO: 919534 - DNA, 25 bp, Mus musculus
ttacattctcaatctgcctttggtc

SEQ ID NO: 919535 - DNA, 25 bp, Mus musculus
ttacattctgccaaggcctgatctt

SEQ ID NO: 919536 - DNA, 25 bp, Mus musculus
ttacattctgcctaggcctgatctt

SEQ ID NO: 919537 - DNA, 25 bp, Mus musculus
ttacattctttcatctctattccgc

SEQ ID NO: 919538 - DNA, 25 bp, Mus musculus
ttacattctttcttctctattccgc

SEQ ID NO: 919539 - DNA, 25 bp, Mus musculus
ttacattgatctatgccagtgtctc

SEQ ID NO: 919540 - DNA, 25 bp, Mus musculus
ttacattgatctttgccagtgtctc

SEQ ID NO: 919541 - DNA, 25 bp, Mus musculus
ttacattgctctcatgtttgttgct

SEQ ID NO: 919542 - DNA, 25 bp, Mus musculus
ttacattgctctgatgtttgttgct

SEQ ID NO: 919543 - DNA, 25 bp, Mus musculus
ttacattgctgtacccgagaccaca

SEQ ID NO: 919544 - DNA, 25 bp, Mus musculus
ttacattgctgttcccgagaccaca

SEQ ID NO: 919545 - DNA, 25 bp, Mus musculus
ttacattgtctgaaatattctacat

SEQ ID NO: 919546 - DNA, 25 bp, Mus musculus
ttacattgtctgtaatattctacat

SEQ ID NO: 919547 - DNA, 25 bp, Mus musculus
ttacatttactgcagactttctcag

SEQ ID NO: 919548 - DNA, 25 bp, Mus musculus
ttacatttactggagactttctcag

SEQ ID NO: 919549 - DNA, 25 bp, Mus musculus
ttacatttacttcactcttcacttt

SEQ ID NO: 919550 - DNA, 25 bp, Mus musculus
ttacatttacttgactcttcacttt

SEQ ID NO: 919551 - DNA, 25 bp, Mus musculus
ttacatttccgtcacttgctttgca

SEQ ID NO: 919552 - DNA, 25 bp, Mus musculus
ttacatttccgtgacttgctttgca

SEQ ID NO: 919553 - DNA, 25 bp, Mus musculus
ttacatttcctcacagctagtctaa

SEQ ID NO: 919554 - DNA, 25 bp, Mus musculus
ttacatttcctctcagctagtctaa

SEQ ID NO: 919555 - DNA, 25 bp, Mus musculus
ttacatttgcatagagaggctacat

SEQ ID NO: 919556 - DNA, 25 bp, Mus musculus
ttacatttgcattgagaggctacat

SEQ ID NO: 919557 - DNA, 25 bp, Mus musculus
ttacatttgggcaccacgacactga

SEQ ID NO: 919558 - DNA, 25 bp, Mus musculus
ttacatttgggctccacgacactga

SEQ ID NO: 919559 - DNA, 25 bp, Mus musculus
ttacatttggtcatgtttggcccca

SEQ ID NO: 919560 - DNA, 25 bp, Mus musculus
ttacatttggtcttgtttggcccca

SEQ ID NO: 919561 - DNA, 25 bp, Mus musculus
ttacatttgtggcagggttcctctg

SEQ ID NO: 919562 - DNA, 25 bp, Mus musculus
ttacatttgtgggagggttcctctg

SEQ ID NO: 919563 - DNA, 25 bp, Mus musculus
ttacatttgttcatagattgcctaa

SEQ ID NO: 919564 - DNA, 25 bp, Mus musculus
ttacatttgttcttagattgcctaa

SEQ ID NO: 919565 - DNA, 25 bp, Mus musculus
ttacatttgtttctccgttcaaact

SEQ ID NO: 919566 - DNA, 25 bp, Mus musculus
ttacatttgtttgtccgttcaaact

SEQ ID NO: 919567 - DNA, 25 bp, Mus musculus
ttacattttacactctcatcatcca

SEQ ID NO: 919568 - DNA, 25 bp, Mus musculus
ttacattttacagtctcatcatcca

SEQ ID NO: 919569 - DNA, 25 bp, Mus musculus
ttacattttgtgaccggattcaagt

SEQ ID NO: 919570 - DNA, 25 bp, Mus musculus
ttacattttgtgtccggattcaagt

SEQ ID NO: 919571 - DNA, 25 bp, Mus musculus
ttacatttttgtagttaacagaaca

SEQ ID NO: 919572 - DNA, 25 bp, Mus musculus
ttacatttttgttgttaacagaaca

SEQ ID NO: 919573 - DNA, 25 bp, Mus musculus
ttaccaaacactacaggccttcgga

SEQ ID NO: 919574 - DNA, 25 bp, Mus musculus
ttaccaaacacttcaggccttcgga

SEQ ID NO: 919575 - DNA, 25 bp, Mus musculus
ttaccaaaccacacatttgtaatga

SEQ ID NO: 919576 - DNA, 25 bp, Mus musculus
ttaccaaaccactcatttgtaatga

SEQ ID NO: 919577 - DNA, 25 bp, Mus musculus
ttaccaaagcctctgtttcaatcac

SEQ ID NO: 919578 - DNA, 25 bp, Mus musculus
ttaccaaagcctgtgtttcaatcac

SEQ ID NO: 919579 - DNA, 25 bp, Mus musculus
ttaccaaaggacacgaccagactag

SEQ ID NO: 919580 - DNA, 25 bp, Mus musculus
ttaccaaaggactcgaccagactag

SEQ ID NO: 919581 - DNA, 25 bp, Mus musculus
ttaccaaagtggatctggtgctgat

SEQ ID NO: 919582 - DNA, 25 bp, Mus musculus
ttaccaaagtggttctggtgctgat

SEQ ID NO: 919583 - DNA, 25 bp, Mus musculus
ttaccaacaaaccactatctcacat

SEQ ID NO: 919584 - DNA, 25 bp, Mus musculus
ttaccaacaaacgactatctcacat

SEQ ID NO: 919585 - DNA, 25 bp, Mus musculus
ttaccaacactgcaacctgaggacg

SEQ ID NO: 919586 - DNA, 25 bp, Mus musculus
ttaccaacactggaacctgaggacg

SEQ ID NO: 919587 - DNA, 25 bp, Mus musculus
ttaccaacctttactaatgactcgc

SEQ ID NO: 919588 - DNA, 25 bp, Mus musculus
ttaccaaccttttctaatgactcgc

SEQ ID NO: 919589 - DNA, 25 bp, Mus musculus
ttaccaactctaactgctgaaaata

SEQ ID NO: 919590 - DNA, 25 bp, Mus musculus
ttaccaactctatctgctgaaaata

SEQ ID NO: 919591 - DNA, 25 bp, Mus musculus
ttaccaactggtactgaggacctgc

SEQ ID NO: 919592 - DNA, 25 bp, Mus musculus
ttaccaactggttctgaggacctgc

SEQ ID NO: 919593 - DNA, 25 bp, Mus musculus
ttaccaacttctcgcctaggcatga

SEQ ID NO: 919594 - DNA, 25 bp, Mus musculus
ttaccaacttctggcctaggcatga

SEQ ID NO: 919595 - DNA, 25 bp, Mus musculus
ttaccaagatgtagagactctctat

SEQ ID NO: 919596 - DNA, 25 bp, Mus musculus
ttaccaagatgttgagactctctat

SEQ ID NO: 919597 - DNA, 25 bp, Mus musculus
ttaccaagcatgaagttctagcgca

SEQ ID NO: 919598 - DNA, 25 bp, Mus musculus
ttaccaagcatgtagttctagcgca

SEQ ID NO: 919599 - DNA, 25 bp, Mus musculus
ttaccaaggaccctgcacgctacag

SEQ ID NO: 919600 - DNA, 25 bp, Mus musculus
ttaccaaggaccgtgcacgctacag

SEQ ID NO: 919601 - DNA, 25 bp, Mus musculus
ttaccaaggatccaccaatcttttc

SEQ ID NO: 919602 - DNA, 25 bp, Mus musculus
ttaccaaggatcgaccaatcttttc

SEQ ID NO: 919603 - DNA, 25 bp, Mus musculus
ttaccaagtccaagtgtgaatgatt

SEQ ID NO: 919604 - DNA, 25 bp, Mus musculus
ttaccaagtccatgtgtgaatgatt

SEQ ID NO: 919605 - DNA, 25 bp, Mus musculus
ttaccaagtcgcagctttacccaga

SEQ ID NO: 919606 - DNA, 25 bp, Mus musculus
ttaccaagtcgctgctttacccaga

SEQ ID NO: 919607 - DNA, 25 bp, Mus musculus
ttaccaagtgctaggatacagtcat

SEQ ID NO: 919608 - DNA, 25 bp, Mus musculus
ttaccaagtgcttggatacagtcat

SEQ ID NO: 919609 - DNA, 25 bp, Mus musculus
ttaccaagtggaaagctagttctga

SEQ ID NO: 919610 - DNA, 25 bp, Mus musculus
ttaccaagtggatagctagttctga

SEQ ID NO: 919611 - DNA, 25 bp, Mus musculus
ttaccaataacaactcggccatcga

SEQ ID NO: 919612 - DNA, 25 bp, Mus musculus
ttaccaataacatctcggccatcga

SEQ ID NO: 919613 - DNA, 25 bp, Mus musculus
ttaccaatacctactgattcctcaa

SEQ ID NO: 919614 - DNA, 25 bp, Mus musculus
ttaccaataccttctgattcctcaa

SEQ ID NO: 919615 - DNA, 25 bp, Mus musculus
ttaccaatctccaagtgccatgttg

SEQ ID NO: 919616 - DNA, 25 bp, Mus musculus
ttaccaatctcctagtgccatgttg

SEQ ID NO: 919617 - DNA, 25 bp, Mus musculus
ttaccaatgctcatgcctggccgga

SEQ ID NO: 919618 - DNA, 25 bp, Mus musculus
ttaccaatgctccaggtccgtttgt

SEQ ID NO: 919619 - DNA, 25 bp, Mus musculus
ttaccaatgctcgaggtccgtttgt

SEQ ID NO: 919620 - DNA, 25 bp, Mus musculus
ttaccaatgctcttgcctggccgga

SEQ ID NO: 919621 - DNA, 25 bp, Mus musculus
ttaccaatggaaccctacatttgat

SEQ ID NO: 919622 - DNA, 25 bp, Mus musculus
ttaccaatggaagcctacatttgat

SEQ ID NO: 919623 - DNA, 25 bp, Mus musculus
ttaccaatggtgattggctacatga

SEQ ID NO: 919624 - DNA, 25 bp, Mus musculus
ttaccaatggtgtttggctacatga

SEQ ID NO: 919625 - DNA, 25 bp, Mus musculus
ttaccaatgtttaccaccaacctgg

SEQ ID NO: 919626 - DNA, 25 bp, Mus musculus
ttaccaatgttttccaccaacctgg

SEQ ID NO: 919627 - DNA, 25 bp, Mus musculus
ttaccaattcgtcctggctgtggaa

SEQ ID NO: 919628 - DNA, 25 bp, Mus musculus
ttaccaattcgtgctggctgtggaa

SEQ ID NO: 919629 - DNA, 25 bp, Mus musculus
ttaccaattgaccatactgtattgc

SEQ ID NO: 919630 - DNA, 25 bp, Mus musculus
ttaccaattgacgatactgtattgc

SEQ ID NO: 919631 - DNA, 25 bp, Mus musculus
ttaccaatttccacttaaccaacag

SEQ ID NO: 919632 - DNA, 25 bp, Mus musculus
ttaccaatttcctcttaaccaacag

SEQ ID NO: 919633 - DNA, 25 bp, Mus musculus
ttaccacaagaacccctgatgtcag

SEQ ID NO: 919634 - DNA, 25 bp, Mus musculus
ttaccacaagaagccctgatgtcag

SEQ ID NO: 919635 - DNA, 25 bp, Mus musculus
ttaccacaaggtcaacttctctcca

SEQ ID NO: 919636 - DNA, 25 bp, Mus musculus
ttaccacaaggtgaacttctctcca

SEQ ID NO: 919637 - DNA, 25 bp, Mus musculus
ttaccacacacaacttgatactgat

SEQ ID NO: 919638 - DNA, 25 bp, Mus musculus
ttaccacacacatcttgatactgat

SEQ ID NO: 919639 - DNA, 25 bp, Mus musculus
ttaccacacccacggagacagttga

SEQ ID NO: 919640 - DNA, 25 bp, Mus musculus
ttaccacacccagggagacagttga

SEQ ID NO: 919641 - DNA, 25 bp, Mus musculus
ttaccacactgtcctgtagggctat

SEQ ID NO: 919642 - DNA, 25 bp, Mus musculus
ttaccacactgtgctgtagggctat

SEQ ID NO: 919643 - DNA, 25 bp, Mus musculus
ttaccacagctgattctaacacaga

SEQ ID NO: 919644 - DNA, 25 bp, Mus musculus
ttaccacagctgtttctaacacaga

SEQ ID NO: 919645 - DNA, 25 bp, Mus musculus
ttaccacaggcacatttaatgagtt

SEQ ID NO: 919646 - DNA, 25 bp, Mus musculus
ttaccacaggcagatttaatgagtt

SEQ ID NO: 919647 - DNA, 25 bp, Mus musculus
ttaccacagtgcactgcactgctgc

SEQ ID NO: 919648 - DNA, 25 bp, Mus musculus
ttaccacagtgctctgcactgctgc

SEQ ID NO: 919649 - DNA, 25 bp, Mus musculus
ttaccacagtggagcctgtacgcag

SEQ ID NO: 919650 - DNA, 25 bp, Mus musculus
ttaccacagtggtgcctgtacgcag

SEQ ID NO: 919651 - DNA, 25 bp, Mus musculus
ttaccacagttacacacggcgcttc

SEQ ID NO: 919652 - DNA, 25 bp, Mus musculus
ttaccacagttagacacggcgcttc

SEQ ID NO: 919653 - DNA, 25 bp, Mus musculus
ttaccacatcacactgctgttttat

SEQ ID NO: 919654 - DNA, 25 bp, Mus musculus
ttaccacatcactctgctgttttat

SEQ ID NO: 919655 - DNA, 25 bp, Mus musculus
ttaccacatgtactaattcaactgg

SEQ ID NO: 919656 - DNA, 25 bp, Mus musculus
ttaccacatgtagtaattcaactgg

SEQ ID NO: 919657 - DNA, 25 bp, Mus musculus
ttaccacattgtaaactgtaggagc

SEQ ID NO: 919658 - DNA, 25 bp, Mus musculus
ttaccacattgtaacggagtcccca

SEQ ID NO: 919659 - DNA, 25 bp, Mus musculus
ttaccacattgttaactgtaggagc

SEQ ID NO: 919660 - DNA, 25 bp, Mus musculus
ttaccacattgttacggagtcccca

SEQ ID NO: 919661 - DNA, 25 bp, Mus musculus
ttaccaccacacagaaggcacacgg

SEQ ID NO: 919662 - DNA, 25 bp, Mus musculus
ttaccaccacactgaaggcacacgg

SEQ ID NO: 919663 - DNA, 25 bp, Mus musculus
ttaccaccacctataacgttgagtg

SEQ ID NO: 919664 - DNA, 25 bp, Mus musculus
ttaccaccacctcaagaagacgatg

SEQ ID NO: 919665 - DNA, 25 bp, Mus musculus
ttaccaccacctgaagaagacgatg

SEQ ID NO: 919666 - DNA, 25 bp, Mus musculus
ttaccaccacctttaacgttgagtg

SEQ ID NO: 919667 - DNA, 25 bp, Mus musculus
ttaccaccatggatacccttactga

SEQ ID NO: 919668 - DNA, 25 bp, Mus musculus
ttaccaccatggttacccttactga

SEQ ID NO: 919669 - DNA, 25 bp, Mus musculus
ttaccacccaaaaacaatcagccat

SEQ ID NO: 919670 - DNA, 25 bp, Mus musculus
ttaccacccaaatacaatcagccat

SEQ ID NO: 919671 - DNA, 25 bp, Mus musculus
ttaccaccggtgcatttgcgggcag

SEQ ID NO: 919672 - DNA, 25 bp, Mus musculus
ttaccaccggtggatttgcgggcag

SEQ ID NO: 919673 - DNA, 25 bp, Mus musculus
ttaccacctaccaggtgtgggtccg

SEQ ID NO: 919674 - DNA, 25 bp, Mus musculus
ttaccacctacctggtgtgggtccg

SEQ ID NO: 919675 - DNA, 25 bp, Mus musculus
ttaccacctttcatccagaggtctg

SEQ ID NO: 919676 - DNA, 25 bp, Mus musculus
ttaccacctttcttccagaggtctg

SEQ ID NO: 919677 - DNA, 25 bp, Mus musculus
ttaccacggcgactgtgagctcaca

SEQ ID NO: 919678 - DNA, 25 bp, Mus musculus
ttaccacggcgagtgtgagctcaca

SEQ ID NO: 919679 - DNA, 25 bp, Mus musculus
ttaccacgttggaggaggatagctc

SEQ ID NO: 919680 - DNA, 25 bp, Mus musculus
ttaccacgttggtggaggatagctc

SEQ ID NO: 919681 - DNA, 25 bp, Mus musculus
ttaccactatgccactgtgtaccac

SEQ ID NO: 919682 - DNA, 25 bp, Mus musculus
ttaccactatgcgactgtgtaccac

SEQ ID NO: 919683 - DNA, 25 bp, Mus musculus
ttaccactcccaccctagaaggaga

SEQ ID NO: 919684 - DNA, 25 bp, Mus musculus
ttaccactcccagcctagaaggaga

SEQ ID NO: 919685 - DNA, 25 bp, Mus musculus
ttaccactgatcatatccgttggat

SEQ ID NO: 919686 - DNA, 25 bp, Mus musculus
ttaccactgatcttatccgttggat

SEQ ID NO: 919687 - DNA, 25 bp, Mus musculus
ttaccactgtgactgggacggctgt

SEQ ID NO: 919688 - DNA, 25 bp, Mus musculus
ttaccactgtgagtgggacggctgt

SEQ ID NO: 919689 - DNA, 25 bp, Mus musculus
ttaccacttcctaaagacacagcca

SEQ ID NO: 919690 - DNA, 25 bp, Mus musculus
ttaccacttccttaagacacagcca

SEQ ID NO: 919691 - DNA, 25 bp, Mus musculus
ttaccacttgtcagctgtcacagca

SEQ ID NO: 919692 - DNA, 25 bp, Mus musculus
ttaccacttgtctgctgtcacagca

SEQ ID NO: 919693 - DNA, 25 bp, Mus musculus
ttaccactttgacttttcacctatg

SEQ ID NO: 919694 - DNA, 25 bp, Mus musculus
ttaccactttgagttttcacctatg

SEQ ID NO: 919695 - DNA, 25 bp, Mus musculus
ttaccagaaactcggcagctcctgt

SEQ ID NO: 919696 - DNA, 25 bp, Mus musculus
ttaccagaaactgggcagctcctgt

SEQ ID NO: 919697 - DNA, 25 bp, Mus musculus
ttaccagaagtgctaaccggaatgt

SEQ ID NO: 919698 - DNA, 25 bp, Mus musculus
ttaccagaagtggtaaccggaatgt

SEQ ID NO: 919699 - DNA, 25 bp, Mus musculus
ttaccagacacgcatgagaactacg

SEQ ID NO: 919700 - DNA, 25 bp, Mus musculus
ttaccagacacggatgagaactacg

SEQ ID NO: 919701 - DNA, 25 bp, Mus musculus
ttaccagacactaatctgaccccag

SEQ ID NO: 919702 - DNA, 25 bp, Mus musculus
ttaccagacacttatctgaccccag

SEQ ID NO: 919703 - DNA, 25 bp, Mus musculus
ttaccagacttgctggttctccgtt

SEQ ID NO: 919704 - DNA, 25 bp, Mus musculus
ttaccagacttggtggttctccgtt

SEQ ID NO: 919705 - DNA, 25 bp, Mus musculus
ttaccagagatcacctgtgtcgtag

SEQ ID NO: 919706 - DNA, 25 bp, Mus musculus
ttaccagagatctcctgtgtcgtag

SEQ ID NO: 919707 - DNA, 25 bp, Mus musculus
ttaccagagcaacatcaagatccgc

SEQ ID NO: 919708 - DNA, 25 bp, Mus musculus
ttaccagagcaagatcaagatccgc

SEQ ID NO: 919709 - DNA, 25 bp, Mus musculus
ttaccagagtgaccggagttgacca

SEQ ID NO: 919710 - DNA, 25 bp, Mus musculus
ttaccagagtgagcggagttgacca

SEQ ID NO: 919711 - DNA, 25 bp, Mus musculus
ttaccagcagggacctactacatag

SEQ ID NO: 919712 - DNA, 25 bp, Mus musculus
ttaccagcagggtcctactacatag

SEQ ID NO: 919713 - DNA, 25 bp, Mus musculus
ttaccagcaggtattcactcggcac

SEQ ID NO: 919714 - DNA, 25 bp, Mus musculus
ttaccagcaggttttcactcggcac

SEQ ID NO: 919715 - DNA, 25 bp, Mus musculus
ttaccagcatctccgcttccgcaca

SEQ ID NO: 919716 - DNA, 25 bp, Mus musculus
ttaccagcatctgcgcttccgcaca

SEQ ID NO: 919717 - DNA, 25 bp, Mus musculus
ttaccagcatttctcctcttgtgaa

SEQ ID NO: 919718 - DNA, 25 bp, Mus musculus
ttaccagcatttgtcctcttgtgaa

SEQ ID NO: 919719 - DNA, 25 bp, Mus musculus
ttaccagccaatactccattgtgca

SEQ ID NO: 919720 - DNA, 25 bp, Mus musculus
ttaccagccaattctccattgtgca

SEQ ID NO: 919721 - DNA, 25 bp, Mus musculus
ttaccagctccacccatgagaagaa

SEQ ID NO: 919722 - DNA, 25 bp, Mus musculus
ttaccagctccagccatgagaagaa

SEQ ID NO: 919723 - DNA, 25 bp, Mus musculus
ttaccagctgaaatctaaccaaaag

SEQ ID NO: 919724 - DNA, 25 bp, Mus musculus
ttaccagctgaattctaaccaaaag

SEQ ID NO: 919725 - DNA, 25 bp, Mus musculus
ttaccagctgctcccgtagcgcggt

SEQ ID NO: 919726 - DNA, 25 bp, Mus musculus
ttaccagctgctgccgtagcgcggt

SEQ ID NO: 919727 - DNA, 25 bp, Mus musculus
ttaccagcttctaactctgtgaggg

SEQ ID NO: 919728 - DNA, 25 bp, Mus musculus
ttaccagcttcttactctgtgaggg

SEQ ID NO: 919729 - DNA, 25 bp, Mus musculus
ttaccaggaggaacagattcgagcg

SEQ ID NO: 919730 - DNA, 25 bp, Mus musculus
ttaccaggaggatcagattcgagcg

SEQ ID NO: 919731 - DNA, 25 bp, Mus musculus
ttaccaggatcactgcaggcatagc

SEQ ID NO: 919732 - DNA, 25 bp, Mus musculus
ttaccaggatcagtgcaggcatagc

SEQ ID NO: 919733 - DNA, 25 bp, Mus musculus
ttaccaggcaaaagctccgtgagcg

SEQ ID NO: 919734 - DNA, 25 bp, Mus musculus
ttaccaggcaaatgctccgtgagcg

SEQ ID NO: 919735 - DNA, 25 bp, Mus musculus
ttaccaggcctaactaaaggacact

SEQ ID NO: 919736 - DNA, 25 bp, Mus musculus
ttaccaggcctatctaaaggacact

SEQ ID NO: 919737 - DNA, 25 bp, Mus musculus
ttaccaggctgtctcgctaaggagg

SEQ ID NO: 919738 - DNA, 25 bp, Mus musculus
ttaccaggctgtgtcgctaaggagg

SEQ ID NO: 919739 - DNA, 25 bp, Mus musculus
ttaccagggcctatgggattgccat

SEQ ID NO: 919740 - DNA, 25 bp, Mus musculus
ttaccagggcctttgggattgccat

SEQ ID NO: 919741 - DNA, 25 bp, Mus musculus
ttaccagggcttctacttttcattc

SEQ ID NO: 919742 - DNA, 25 bp, Mus musculus
ttaccagggcttgtacttttcattc

SEQ ID NO: 919743 - DNA, 25 bp, Mus musculus
ttaccaggggaacagtgctgcacaa

SEQ ID NO: 919744 - DNA, 25 bp, Mus musculus
ttaccaggggaagagtgctgcacaa

SEQ ID NO: 919745 - DNA, 25 bp, Mus musculus
ttaccaggtaccctggcatatgcct

SEQ ID NO: 919746 - DNA, 25 bp, Mus musculus
ttaccaggtaccgtggcatatgcct

SEQ ID NO: 919747 - DNA, 25 bp, Mus musculus
ttaccaggtactcatcaagggagtc

SEQ ID NO: 919748 - DNA, 25 bp, Mus musculus
ttaccaggtactgatcaagggagtc

SEQ ID NO: 919749 - DNA, 25 bp, Mus musculus
ttaccaggtggtaccggtttcatgc

SEQ ID NO: 919750 - DNA, 25 bp, Mus musculus
ttaccaggtggttccggtttcatgc

SEQ ID NO: 919751 - DNA, 25 bp, Mus musculus
ttaccagtcttgagttttccttact

SEQ ID NO: 919752 - DNA, 25 bp, Mus musculus
ttaccagtcttgtgttttccttact

SEQ ID NO: 919753 - DNA, 25 bp, Mus musculus
ttaccagtgcaaaattagaccgttt

SEQ ID NO: 919754 - DNA, 25 bp, Mus musculus
ttaccagtgcaatattagaccgttt

SEQ ID NO: 919755 - DNA, 25 bp, Mus musculus
ttaccagtggctatgagtaggatct

SEQ ID NO: 919756 - DNA, 25 bp, Mus musculus
ttaccagtggctttgagtaggatct

SEQ ID NO: 919757 - DNA, 25 bp, Mus musculus
ttaccagttcaacaattggcattta

SEQ ID NO: 919758 - DNA, 25 bp, Mus musculus
ttaccagttcaagaattggcattta

SEQ ID NO: 919759 - DNA, 25 bp, Mus musculus
ttaccagtttaacactgatgtcaga

SEQ ID NO: 919760 - DNA, 25 bp, Mus musculus
ttaccagtttaagactgatgtcaga

SEQ ID NO: 919761 - DNA, 25 bp, Mus musculus
ttaccatacagtcctcttatcgaag

SEQ ID NO: 919762 - DNA, 25 bp, Mus musculus
ttaccatacagtgctcttatcgaag

SEQ ID NO: 919763 - DNA, 25 bp, Mus musculus
ttaccataccctcagatagcagcag

SEQ ID NO: 919764 - DNA, 25 bp, Mus musculus
ttaccataccctgagatagcagcag

SEQ ID NO: 919765 - DNA, 25 bp, Mus musculus
ttaccatagcacatcatcagtgagc

SEQ ID NO: 919766 - DNA, 25 bp, Mus musculus
ttaccatagcacttcatcagtgagc

SEQ ID NO: 919767 - DNA, 25 bp, Mus musculus
ttaccatagctcactgggactggca

SEQ ID NO: 919768 - DNA, 25 bp, Mus musculus
ttaccatagctctctgggactggca

SEQ ID NO: 919769 - DNA, 25 bp, Mus musculus
ttaccatagtaacttgtctcgcctc

SEQ ID NO: 919770 - DNA, 25 bp, Mus musculus
ttaccatagtaagttgtctcgcctc

SEQ ID NO: 919771 - DNA, 25 bp, Mus musculus
ttaccatatcaccaaagctgctcag

SEQ ID NO: 919772 - DNA, 25 bp, Mus musculus
ttaccatatcacgaaagctgctcag

SEQ ID NO: 919773 - DNA, 25 bp, Mus musculus
ttaccatcagttacaaccctattga

SEQ ID NO: 919774 - DNA, 25 bp, Mus musculus
ttaccatcagtttcaaccctattga

SEQ ID NO: 919775 - DNA, 25 bp, Mus musculus
ttaccatcccatctcctcatatcca

SEQ ID NO: 919776 - DNA, 25 bp, Mus musculus
ttaccatcccatgtcctcatatcca

SEQ ID NO: 919777 - DNA, 25 bp, Mus musculus
ttaccatctaccatataaagagata

SEQ ID NO: 919778 - DNA, 25 bp, Mus musculus
ttaccatctaccttataaagagata

SEQ ID NO: 919779 - DNA, 25 bp, Mus musculus
ttaccatgaaggctgcagctgcgct

SEQ ID NO: 919780 - DNA, 25 bp, Mus musculus
ttaccatgaagggtgcagctgcgct

SEQ ID NO: 919781 - DNA, 25 bp, Mus musculus
ttaccatgcacacgagctccttgat

SEQ ID NO: 919782 - DNA, 25 bp, Mus musculus
ttaccatgcacaggagctccttgat

SEQ ID NO: 919783 - DNA, 25 bp, Mus musculus
ttaccatgcctcaaaataactccac

SEQ ID NO: 919784 - DNA, 25 bp, Mus musculus
ttaccatgcctctaaataactccac

SEQ ID NO: 919785 - DNA, 25 bp, Mus musculus
ttaccatgcggccaaatcctacagt

SEQ ID NO: 919786 - DNA, 25 bp, Mus musculus
ttaccatgcggcgaaatcctacagt

SEQ ID NO: 919787 - DNA, 25 bp, Mus musculus
ttaccatgctatatgatttatccct

SEQ ID NO: 919788 - DNA, 25 bp, Mus musculus
ttaccatgctatttgatttatccct

SEQ ID NO: 919789 - DNA, 25 bp, Mus musculus
ttaccatggatgatactagggcact

SEQ ID NO: 919790 - DNA, 25 bp, Mus musculus
ttaccatggatgttactagggcact

SEQ ID NO: 919791 - DNA, 25 bp, Mus musculus
ttaccatggctacacttccttaaat

SEQ ID NO: 919792 - DNA, 25 bp, Mus musculus
ttaccatggctagacttccttaaat

SEQ ID NO: 919793 - DNA, 25 bp, Mus musculus
ttaccatggcttcacatctaagtgg

SEQ ID NO: 919794 - DNA, 25 bp, Mus musculus
ttaccatggcttgacatctaagtgg

SEQ ID NO: 919795 - DNA, 25 bp, Mus musculus
ttaccatgtatcacagacagtcctt

SEQ ID NO: 919796 - DNA, 25 bp, Mus musculus
ttaccatgtatctcagacagtcctt

SEQ ID NO: 919797 - DNA, 25 bp, Mus musculus
ttaccatgtcatagtgcttacactt

SEQ ID NO: 919798 - DNA, 25 bp, Mus musculus
ttaccatgtcattgtgcttacactt

SEQ ID NO: 919799 - DNA, 25 bp, Mus musculus
ttaccatgtgaaatcttccattgtt

SEQ ID NO: 919800 - DNA, 25 bp, Mus musculus
ttaccatgtgaattcttccattgtt

SEQ ID NO: 919801 - DNA, 25 bp, Mus musculus
ttaccatgttctcaagactgcccgc

SEQ ID NO: 919802 - DNA, 25 bp, Mus musculus
ttaccatgttctgaagactgcccgc

SEQ ID NO: 919803 - DNA, 25 bp, Mus musculus
ttaccattaaagacctcattataat

SEQ ID NO: 919804 - DNA, 25 bp, Mus musculus
ttaccattaaagtcctcattataat

SEQ ID NO: 919805 - DNA, 25 bp, Mus musculus
ttaccattatggagctactgagcat

SEQ ID NO: 919806 - DNA, 25 bp, Mus musculus
ttaccattatggtgctactgagcat

SEQ ID NO: 919807 - DNA, 25 bp, Mus musculus
ttaccattctccagcgttactttga

SEQ ID NO: 919808 - DNA, 25 bp, Mus musculus
ttaccattctcctgcgttactttga

SEQ ID NO: 919809 - DNA, 25 bp, Mus musculus
ttaccattctggactttctgggcca

SEQ ID NO: 919810 - DNA, 25 bp, Mus musculus
ttaccattctggtctttctgggcca

SEQ ID NO: 919811 - DNA, 25 bp, Mus musculus
ttaccattctgtatgcttccacggt

SEQ ID NO: 919812 - DNA, 25 bp, Mus musculus
ttaccattctgtttgcttccacggt

SEQ ID NO: 919813 - DNA, 25 bp, Mus musculus
ttaccattcttgcttttctctgaca

SEQ ID NO: 919814 - DNA, 25 bp, Mus musculus
ttaccattcttggttttctctgaca

SEQ ID NO: 919815 - DNA, 25 bp, Mus musculus
ttaccattgaagagtacgaccccta

SEQ ID NO: 919816 - DNA, 25 bp, Mus musculus
ttaccattgaagtgtacgaccccta

SEQ ID NO: 919817 - DNA, 25 bp, Mus musculus
ttaccattgagccagacttgtccca

SEQ ID NO: 919818 - DNA, 25 bp, Mus musculus
ttaccattgagcgagacttgtccca

SEQ ID NO: 919819 - DNA, 25 bp, Mus musculus
ttaccattgggcagaatcggatcct

SEQ ID NO: 919820 - DNA, 25 bp, Mus musculus
ttaccattgggctgaatcggatcct

SEQ ID NO: 919821 - DNA, 25 bp, Mus musculus
ttaccattggtaatctagagacgtc

SEQ ID NO: 919822 - DNA, 25 bp, Mus musculus
ttaccattggtattctagagacgtc

SEQ ID NO: 919823 - DNA, 25 bp, Mus musculus
ttaccattgtcccaagcttctagca

SEQ ID NO: 919824 - DNA, 25 bp, Mus musculus
ttaccattgtccgaagcttctagca

SEQ ID NO: 919825 - DNA, 25 bp, Mus musculus
ttaccatttataaggctgcagggct

SEQ ID NO: 919826 - DNA, 25 bp, Mus musculus
ttaccatttatatggctgcagggct

SEQ ID NO: 919827 - DNA, 25 bp, Mus musculus
ttaccatttattctccttgaagcag

SEQ ID NO: 919828 - DNA, 25 bp, Mus musculus
ttaccatttattgtccttgaagcag

SEQ ID NO: 919829 - DNA, 25 bp, Mus musculus
ttaccatttcaccataggctgacca

SEQ ID NO: 919830 - DNA, 25 bp, Mus musculus
ttaccatttcacgataggctgacca

SEQ ID NO: 919831 - DNA, 25 bp, Mus musculus
ttacccaaaatacccaaccaagcag

SEQ ID NO: 919832 - DNA, 25 bp, Mus musculus
ttacccaaaatagccaaccaagcag

SEQ ID NO: 919833 - DNA, 25 bp, Mus musculus
ttacccaaagacctgtctttctttg

SEQ ID NO: 919834 - DNA, 25 bp, Mus musculus
ttacccaaagacgtgtctttctttg

SEQ ID NO: 919835 - DNA, 25 bp, Mus musculus
ttacccaaagctaagatcctctgca

SEQ ID NO: 919836 - DNA, 25 bp, Mus musculus
ttacccaaagcttagatcctctgca

SEQ ID NO: 919837 - DNA, 25 bp, Mus musculus
ttacccaaatacattcaatctgccc

SEQ ID NO: 919838 - DNA, 25 bp, Mus musculus
ttacccaaatactttcaatctgccc

SEQ ID NO: 919839 - DNA, 25 bp, Mus musculus
ttacccaaccataaatgagctcttg

SEQ ID NO: 919840 - DNA, 25 bp, Mus musculus
ttacccaaccattaatgagctcttg

SEQ ID NO: 919841 - DNA, 25 bp, Mus musculus
ttacccaactagagaatcagcttat

SEQ ID NO: 919842 - DNA, 25 bp, Mus musculus
ttacccaactagtgaatcagcttat

SEQ ID NO: 919843 - DNA, 25 bp, Mus musculus
ttacccaagctactgctgcagagtg

SEQ ID NO: 919844 - DNA, 25 bp, Mus musculus
ttacccaagctagtgctgcagagtg

SEQ ID NO: 919845 - DNA, 25 bp, Mus musculus
ttacccaagctgaaatgctagacat

SEQ ID NO: 919846 - DNA, 25 bp, Mus musculus
ttacccaagctgaggaattggctat

SEQ ID NO: 919847 - DNA, 25 bp, Mus musculus
ttacccaagctgtaatgctagacat

SEQ ID NO: 919848 - DNA, 25 bp, Mus musculus
ttacccaagctgtggaattggctat

SEQ ID NO: 919849 - DNA, 25 bp, Mus musculus
ttacccaagtaccatcagaaccaaa

SEQ ID NO: 919850 - DNA, 25 bp, Mus musculus
ttacccaagtacgatcagaaccaaa

SEQ ID NO: 919851 - DNA, 25 bp, Mus musculus
ttacccaatcataccaacagctgtg

SEQ ID NO: 919852 - DNA, 25 bp, Mus musculus
ttacccaatcattccaacagctgtg

SEQ ID NO: 919853 - DNA, 25 bp, Mus musculus
ttacccaatttcatgccatttattg

SEQ ID NO: 919854 - DNA, 25 bp, Mus musculus
ttacccaatttcttgccatttattg

SEQ ID NO: 919855 - DNA, 25 bp, Mus musculus
ttacccacaagccattactacttga

SEQ ID NO: 919856 - DNA, 25 bp, Mus musculus
ttacccacaagcgattactacttga

SEQ ID NO: 919857 - DNA, 25 bp, Mus musculus
ttacccacacgacgtcatcaggacg

SEQ ID NO: 919858 - DNA, 25 bp, Mus musculus
ttacccacacgaggtcatcaggacg

SEQ ID NO: 919859 - DNA, 25 bp, Mus musculus
ttacccacagttccaagttgccaaa

SEQ ID NO: 919860 - DNA, 25 bp, Mus musculus
ttacccacagttgcaagttgccaaa

SEQ ID NO: 919861 - DNA, 25 bp, Mus musculus
ttacccacatctattcaataatagt

SEQ ID NO: 919862 - DNA, 25 bp, Mus musculus
ttacccacatcttttcaataatagt

SEQ ID NO: 919863 - DNA, 25 bp, Mus musculus
ttacccaccccaaggaaggctctga

SEQ ID NO: 919864 - DNA, 25 bp, Mus musculus
ttacccaccccatggaaggctctga

SEQ ID NO: 919865 - DNA, 25 bp, Mus musculus
ttacccaccgacacgtcagatgaga

SEQ ID NO: 919866 - DNA, 25 bp, Mus musculus
ttacccaccgactcgtcagatgaga

SEQ ID NO: 919867 - DNA, 25 bp, Mus musculus
ttacccacctacactgtcataaaat

SEQ ID NO: 919868 - DNA, 25 bp, Mus musculus
ttacccacctactctgtcataaaat

SEQ ID NO: 919869 - DNA, 25 bp, Mus musculus
ttacccacttagcttcaaggaccct

SEQ ID NO: 919870 - DNA, 25 bp, Mus musculus
ttacccacttaggttcaaggaccct

SEQ ID NO: 919871 - DNA, 25 bp, Mus musculus
ttacccagaaccaggtgttgggcat

SEQ ID NO: 919872 - DNA, 25 bp, Mus musculus
ttacccagaacctggtgttgggcat

SEQ ID NO: 919873 - DNA, 25 bp, Mus musculus
ttacccagaagcaatctcggccata

SEQ ID NO: 919874 - DNA, 25 bp, Mus musculus
ttacccagaagctatctcggccata

SEQ ID NO: 919875 - DNA, 25 bp, Mus musculus
ttacccagaagtctgcagctctccg

SEQ ID NO: 919876 - DNA, 25 bp, Mus musculus
ttacccagaagtgtgcagctctccg

SEQ ID NO: 919877 - DNA, 25 bp, Mus musculus
ttacccagactgcaagtataatgat

SEQ ID NO: 919878 - DNA, 25 bp, Mus musculus
ttacccagactggaagtataatgat

SEQ ID NO: 919879 - DNA, 25 bp, Mus musculus
ttacccagatgtatgaggcccaatt

SEQ ID NO: 919880 - DNA, 25 bp, Mus musculus
ttacccagatgtttgaggcccaatt

SEQ ID NO: 919881 - DNA, 25 bp, Mus musculus
ttacccagccaccattatacaagaa

SEQ ID NO: 919882 - DNA, 25 bp, Mus musculus
ttacccagccacgattatacaagaa

SEQ ID NO: 919883 - DNA, 25 bp, Mus musculus
ttacccagccagcatccttgggagc

SEQ ID NO: 919884 - DNA, 25 bp, Mus musculus
ttacccagccaggatccttgggagc

SEQ ID NO: 919885 - DNA, 25 bp, Mus musculus
ttacccagctttcaaaaggaagagt

SEQ ID NO: 919886 - DNA, 25 bp, Mus musculus
ttacccagctttgaaaaggaagagt

SEQ ID NO: 919887 - DNA, 25 bp, Mus musculus
ttacccaggacaatgcagacttcgc

SEQ ID NO: 919888 - DNA, 25 bp, Mus musculus
ttacccaggacattgcagacttcgc

SEQ ID NO: 919889 - DNA, 25 bp, Mus musculus
ttacccaggagaatcccttttgccg

SEQ ID NO: 919890 - DNA, 25 bp, Mus musculus
ttacccaggagattcccttttgccg

SEQ ID NO: 919891 - DNA, 25 bp, Mus musculus
ttacccagggagcagcaatacagct

SEQ ID NO: 919892 - DNA, 25 bp, Mus musculus
ttacccagggaggagcaatacagct

SEQ ID NO: 919893 - DNA, 25 bp, Mus musculus
ttacccagtacgcatgcctgtcatc

SEQ ID NO: 919894 - DNA, 25 bp, Mus musculus
ttacccagtacggatgcctgtcatc

SEQ ID NO: 919895 - DNA, 25 bp, Mus musculus
ttacccagtcatatgtctccctttt

SEQ ID NO: 919896 - DNA, 25 bp, Mus musculus
ttacccagtcatttgtctccctttt

SEQ ID NO: 919897 - DNA, 25 bp, Mus musculus
ttacccagtcctaacacagatgcag

SEQ ID NO: 919898 - DNA, 25 bp, Mus musculus
ttacccagtccttacacagatgcag

SEQ ID NO: 919899 - DNA, 25 bp, Mus musculus
ttacccagtggtccatgtttgagcc

SEQ ID NO: 919900 - DNA, 25 bp, Mus musculus
ttacccagtggtgcatgtttgagcc

SEQ ID NO: 919901 - DNA, 25 bp, Mus musculus
ttacccagtgttccatcgctttagc

SEQ ID NO: 919902 - DNA, 25 bp, Mus musculus
ttacccagtgttgcatcgctttagc

SEQ ID NO: 919903 - DNA, 25 bp, Mus musculus
ttacccagttctatttctcctgata

SEQ ID NO: 919904 - DNA, 25 bp, Mus musculus
ttacccagttctttttctcctgata

SEQ ID NO: 919905 - DNA, 25 bp, Mus musculus
ttacccatattgattgaggcactat

SEQ ID NO: 919906 - DNA, 25 bp, Mus musculus
ttacccatattgtttgaggcactat

SEQ ID NO: 919907 - DNA, 25 bp, Mus musculus
ttacccatcatgcagggacagctga

SEQ ID NO: 919908 - DNA, 25 bp, Mus musculus
ttacccatcatggagggacagctga

SEQ ID NO: 919909 - DNA, 25 bp, Mus musculus
ttacccatcccaaagaccgtagagg

SEQ ID NO: 919910 - DNA, 25 bp, Mus musculus
ttacccatcccatagaccgtagagg

SEQ ID NO: 919911 - DNA, 25 bp, Mus musculus
ttacccatgtttatacagtgtcctg

SEQ ID NO: 919912 - DNA, 25 bp, Mus musculus
ttacccatgtttttacagtgtcctg

SEQ ID NO: 919913 - DNA, 25 bp, Mus musculus
ttacccattataacagaatttgtca

SEQ ID NO: 919914 - DNA, 25 bp, Mus musculus
ttacccattatatcagaatttgtca

SEQ ID NO: 919915 - DNA, 25 bp, Mus musculus
ttacccatttaccttggtaagagtg

SEQ ID NO: 919916 - DNA, 25 bp, Mus musculus
ttacccatttacgttggtaagagtg

SEQ ID NO: 919917 - DNA, 25 bp, Mus musculus
ttaccccaacacaagtattactgca

SEQ ID NO: 919918 - DNA, 25 bp, Mus musculus
ttaccccaacactagtattactgca

SEQ ID NO: 919919 - DNA, 25 bp, Mus musculus
ttaccccaactgaggtactaagaca

SEQ ID NO: 919920 - DNA, 25 bp, Mus musculus
ttaccccaactgtggtactaagaca

SEQ ID NO: 919921 - DNA, 25 bp, Mus musculus
ttaccccaatataaaattcaagtct

SEQ ID NO: 919922 - DNA, 25 bp, Mus musculus
ttaccccaatattaaattcaagtct

SEQ ID NO: 919923 - DNA, 25 bp, Mus musculus
ttaccccaatttcaccttagagaat

SEQ ID NO: 919924 - DNA, 25 bp, Mus musculus
ttaccccaatttgaccttagagaat

SEQ ID NO: 919925 - DNA, 25 bp, Mus musculus
ttaccccaccttctcttagagacag

SEQ ID NO: 919926 - DNA, 25 bp, Mus musculus
ttaccccaccttgtcttagagacag

SEQ ID NO: 919927 - DNA, 25 bp, Mus musculus
ttaccccactatccccaatttatat

SEQ ID NO: 919928 - DNA, 25 bp, Mus musculus
ttaccccactatgcccaatttatat

SEQ ID NO: 919929 - DNA, 25 bp, Mus musculus
ttaccccagagcaaccactaaatga

SEQ ID NO: 919930 - DNA, 25 bp, Mus musculus
ttaccccagagctaccactaaatga

SEQ ID NO: 919931 - DNA, 25 bp, Mus musculus
ttaccccagagtcatcctactaaga

SEQ ID NO: 919932 - DNA, 25 bp, Mus musculus
ttaccccagagtgatcctactaaga

SEQ ID NO: 919933 - DNA, 25 bp, Mus musculus
ttaccccagatgaagcagtgtccca

SEQ ID NO: 919934 - DNA, 25 bp, Mus musculus
ttaccccagatgtagcagtgtccca

SEQ ID NO: 919935 - DNA, 25 bp, Mus musculus
ttaccccagcatcgttgtaattttt

SEQ ID NO: 919936 - DNA, 25 bp, Mus musculus
ttaccccagcatggttgtaattttt

SEQ ID NO: 919937 - DNA, 25 bp, Mus musculus
ttaccccagggtcgattctatggct

SEQ ID NO: 919938 - DNA, 25 bp, Mus musculus
ttaccccagggtggattctatggct

SEQ ID NO: 919939 - DNA, 25 bp, Mus musculus
ttaccccagtaaccttcagttgttt

SEQ ID NO: 919940 - DNA, 25 bp, Mus musculus
ttaccccagtaagcttcagttgttt

SEQ ID NO: 919941 - DNA, 25 bp, Mus musculus
ttaccccatgtcaatgtctttcgac

SEQ ID NO: 919942 - DNA, 25 bp, Mus musculus
ttaccccatgtctatgtctttcgac

SEQ ID NO: 919943 - DNA, 25 bp, Mus musculus
ttaccccgaactacacactgaagtt

SEQ ID NO: 919944 - DNA, 25 bp, Mus musculus
ttaccccgaacttcacactgaagtt

SEQ ID NO: 919945 - DNA, 25 bp, Mus musculus
ttaccccgtggtcaaaaacatgctt

SEQ ID NO: 919946 - DNA, 25 bp, Mus musculus
ttaccccgtggtgaaaaacatgctt

SEQ ID NO: 919947 - DNA, 25 bp, Mus musculus
ttaccccgtgtcaagtcatgtgtta

SEQ ID NO: 919948 - DNA, 25 bp, Mus musculus
ttaccccgtgtctagtcatgtgtta

SEQ ID NO: 919949 - DNA, 25 bp, Mus musculus
ttacccctactactctggacttgga

SEQ ID NO: 919950 - DNA, 25 bp, Mus musculus
ttacccctactagtctggacttgga

SEQ ID NO: 919951 - DNA, 25 bp, Mus musculus
ttacccctaggcctacctaagagtg

SEQ ID NO: 919952 - DNA, 25 bp, Mus musculus
ttacccctaggcgtacctaagagtg

SEQ ID NO: 919953 - DNA, 25 bp, Mus musculus
ttacccctctacagaatcccattat

SEQ ID NO: 919954 - DNA, 25 bp, Mus musculus
ttacccctctactgaatcccattat

SEQ ID NO: 919955 - DNA, 25 bp, Mus musculus
ttacccctctatctgaataaacgca

SEQ ID NO: 919956 - DNA, 25 bp, Mus musculus
ttacccctctatgtgaataaacgca

SEQ ID NO: 919957 - DNA, 25 bp, Mus musculus
ttacccctgaatacctgaactccat

SEQ ID NO: 919958 - DNA, 25 bp, Mus musculus
ttacccctgaattcctgaactccat

SEQ ID NO: 919959 - DNA, 25 bp, Mus musculus
ttacccctgatgattatgactcttc

SEQ ID NO: 919960 - DNA, 25 bp, Mus musculus
ttacccctgatgtttatgactcttc

SEQ ID NO: 919961 - DNA, 25 bp, Mus musculus
ttacccctgccaaatgactatgttt

SEQ ID NO: 919962 - DNA, 25 bp, Mus musculus
ttacccctgccatatgactatgttt

SEQ ID NO: 919963 - DNA, 25 bp, Mus musculus
ttacccctggctactgagtccgagg

SEQ ID NO: 919964 - DNA, 25 bp, Mus musculus
ttacccctggcttctgagtccgagg

SEQ ID NO: 919965 - DNA, 25 bp, Mus musculus
ttacccctgtgccttactttatgga

SEQ ID NO: 919966 - DNA, 25 bp, Mus musculus
ttacccctgtgcgttactttatgga

SEQ ID NO: 919967 - DNA, 25 bp, Mus musculus
ttacccctgttcctaatcactacaa

SEQ ID NO: 919968 - DNA, 25 bp, Mus musculus
ttacccctgttcgtaatcactacaa

SEQ ID NO: 919969 - DNA, 25 bp, Mus musculus
ttaccccttaccaagaagctacctg

SEQ ID NO: 919970 - DNA, 25 bp, Mus musculus
ttaccccttacccaaatcaggattg

SEQ ID NO: 919971 - DNA, 25 bp, Mus musculus
ttaccccttaccgaaatcaggattg

SEQ ID NO: 919972 - DNA, 25 bp, Mus musculus
ttaccccttacctagaagctacctg

SEQ ID NO: 919973 - DNA, 25 bp, Mus musculus
ttaccccttgccaaatgaccaacaa

SEQ ID NO: 919974 - DNA, 25 bp, Mus musculus
ttaccccttgcctaatgaccaacaa

SEQ ID NO: 919975 - DNA, 25 bp, Mus musculus
ttaccccttgctctagggaatgtgt

SEQ ID NO: 919976 - DNA, 25 bp, Mus musculus
ttaccccttgctgtagggaatgtgt

SEQ ID NO: 919977 - DNA, 25 bp, Mus musculus
ttacccctttaacaaagcatcctgc

SEQ ID NO: 919978 - DNA, 25 bp, Mus musculus
ttacccctttaagaaagcatcctgc

SEQ ID NO: 919979 - DNA, 25 bp, Mus musculus
ttacccctttaccagaacagaagca

SEQ ID NO: 919980 - DNA, 25 bp, Mus musculus
ttacccctttacgagaacagaagca

SEQ ID NO: 919981 - DNA, 25 bp, Mus musculus
ttacccgaaagtacttattatctat

SEQ ID NO: 919982 - DNA, 25 bp, Mus musculus
ttacccgaaagttcttattatctat

SEQ ID NO: 919983 - DNA, 25 bp, Mus musculus
ttacccgaatctacaaggctacgtt

SEQ ID NO: 919984 - DNA, 25 bp, Mus musculus
ttacccgaatctacactgagcgaga

SEQ ID NO: 919985 - DNA, 25 bp, Mus musculus
ttacccgaatcttcaaggctacgtt

SEQ ID NO: 919986 - DNA, 25 bp, Mus musculus
ttacccgaatcttcactgagcgaga

SEQ ID NO: 919987 - DNA, 25 bp, Mus musculus
ttacccgacatccagagttcactgg

SEQ ID NO: 919988 - DNA, 25 bp, Mus musculus
ttacccgacatcgagagttcactgg

SEQ ID NO: 919989 - DNA, 25 bp, Mus musculus
ttacccgagaccctgctgcagagaa

SEQ ID NO: 919990 - DNA, 25 bp, Mus musculus
ttacccgagaccgtgctgcagagaa

SEQ ID NO: 919991 - DNA, 25 bp, Mus musculus
ttacccgagctcaataatgtccaac

SEQ ID NO: 919992 - DNA, 25 bp, Mus musculus
ttacccgagctctataatgtccaac

SEQ ID NO: 919993 - DNA, 25 bp, Mus musculus
ttacccggcaggctcaacacaggag

SEQ ID NO: 919994 - DNA, 25 bp, Mus musculus
ttacccggcagggtcaacacaggag

SEQ ID NO: 919995 - DNA, 25 bp, Mus musculus
ttacccgggactccttatcatggac

SEQ ID NO: 919996 - DNA, 25 bp, Mus musculus
ttacccgggactgcttatcatggac

SEQ ID NO: 919997 - DNA, 25 bp, Mus musculus
ttacccgggtaacgctgtgatatta

SEQ ID NO: 919998 - DNA, 25 bp, Mus musculus
ttacccgggtaaggctgtgatatta

SEQ ID NO: 919999 - DNA, 25 bp, Mus musculus
ttacccggtaccaggcagcatgagg

SEQ ID NO: 920000 - DNA, 25 bp, Mus musculus
ttacccggtacctggcagcatgagg

SEQ ID NO: 920001 - DNA, 25 bp, Mus musculus
ttacccggttctatgtgatggaaag

SEQ ID NO: 920002 - DNA, 25 bp, Mus musculus
ttacccggttctttgtgatggaaag

SEQ ID NO: 920003 - DNA, 25 bp, Mus musculus
ttacccggttgccaaggaagctgtt

SEQ ID NO: 920004 - DNA, 25 bp, Mus musculus
ttacccggttgcgaaggaagctgtt

SEQ ID NO: 920005 - DNA, 25 bp, Mus musculus
ttacccgtaactatgctgccaggat

SEQ ID NO: 920006 - DNA, 25 bp, Mus musculus
ttacccgtaactttgctgccaggat

SEQ ID NO: 920007 - DNA, 25 bp, Mus musculus
ttacccgtatcccaaccttagatgg

SEQ ID NO: 920008 - DNA, 25 bp, Mus musculus
ttacccgtatccgaaccttagatgg

SEQ ID NO: 920009 - DNA, 25 bp, Mus musculus
ttacccgtgcttcttcaacacatta

SEQ ID NO: 920010 - DNA, 25 bp, Mus musculus
ttacccgtgcttgttcaacacatta

SEQ ID NO: 920011 - DNA, 25 bp, Mus musculus
ttaccctaccatagtcagcactgag

SEQ ID NO: 920012 - DNA, 25 bp, Mus musculus
ttaccctaccattgtcagcactgag

SEQ ID NO: 920013 - DNA, 25 bp, Mus musculus
ttaccctaccttagacactgactgt

SEQ ID NO: 920014 - DNA, 25 bp, Mus musculus
ttaccctacctttgacactgactgt

SEQ ID NO: 920015 - DNA, 25 bp, Mus musculus
ttaccctagcatcccattagcttgg

SEQ ID NO: 920016 - DNA, 25 bp, Mus musculus
ttaccctagcatgccattagcttgg

SEQ ID NO: 920017 - DNA, 25 bp, Mus musculus
ttaccctaggccagtatgctcgttc

SEQ ID NO: 920018 - DNA, 25 bp, Mus musculus
ttaccctaggcctgtatgctcgttc

SEQ ID NO: 920019 - DNA, 25 bp, Mus musculus
ttaccctcaatgaggctctgggcaa

SEQ ID NO: 920020 - DNA, 25 bp, Mus musculus
ttaccctcaatgtggctctgggcaa

SEQ ID NO: 920021 - DNA, 25 bp, Mus musculus
ttaccctcacagacacttcacagat

SEQ ID NO: 920022 - DNA, 25 bp, Mus musculus
ttaccctcacagtcacttcacagat

SEQ ID NO: 920023 - DNA, 25 bp, Mus musculus
ttaccctcagatacctgacaggatt

SEQ ID NO: 920024 - DNA, 25 bp, Mus musculus
ttaccctcagattcctgacaggatt

SEQ ID NO: 920025 - DNA, 25 bp, Mus musculus
ttaccctccctcaattaaacagttg

SEQ ID NO: 920026 - DNA, 25 bp, Mus musculus
ttaccctccctctattaaacagttg

SEQ ID NO: 920027 - DNA, 25 bp, Mus musculus
ttaccctccgaacctctggatgggt

SEQ ID NO: 920028 - DNA, 25 bp, Mus musculus
ttaccctccgaagctctggatgggt

SEQ ID NO: 920029 - DNA, 25 bp, Mus musculus
ttaccctcgggcactatcgcggcgg

SEQ ID NO: 920030 - DNA, 25 bp, Mus musculus
ttaccctcgggctctatcgcggcgg

SEQ ID NO: 920031 - DNA, 25 bp, Mus musculus
ttaccctctacacgcacagtcatgg

SEQ ID NO: 920032 - DNA, 25 bp, Mus musculus
ttaccctctacaggcacagtcatgg

SEQ ID NO: 920033 - DNA, 25 bp, Mus musculus
ttaccctctccaaagtgcatttaag

SEQ ID NO: 920034 - DNA, 25 bp, Mus musculus
ttaccctctccatagtgcatttaag

SEQ ID NO: 920035 - DNA, 25 bp, Mus musculus
ttaccctctgaaactacagccaatc

SEQ ID NO: 920036 - DNA, 25 bp, Mus musculus
ttaccctctgaatctacagccaatc

SEQ ID NO: 920037 - DNA, 25 bp, Mus musculus
ttaccctctgggatgccattaacaa

SEQ ID NO: 920038 - DNA, 25 bp, Mus musculus
ttaccctctgggttgccattaacaa

SEQ ID NO: 920039 - DNA, 25 bp, Mus musculus
ttaccctctgtgaacctttgtttag

SEQ ID NO: 920040 - DNA, 25 bp, Mus musculus
ttaccctctgtgtacctttgtttag

SEQ ID NO: 920041 - DNA, 25 bp, Mus musculus
ttaccctctttgatcggatgcagtg

SEQ ID NO: 920042 - DNA, 25 bp, Mus musculus
ttaccctctttgttcggatgcagtg

SEQ ID NO: 920043 - DNA, 25 bp, Mus musculus
ttaccctgaaggaggtgaagcccag

SEQ ID NO: 920044 - DNA, 25 bp, Mus musculus
ttaccctgaaggtggtgaagcccag

SEQ ID NO: 920045 - DNA, 25 bp, Mus musculus
ttaccctgatatactagctaaaaga

SEQ ID NO: 920046 - DNA, 25 bp, Mus musculus
ttaccctgatattctagctaaaaga

SEQ ID NO: 920047 - DNA, 25 bp, Mus musculus
ttaccctgcacccaagatttgaggg

SEQ ID NO: 920048 - DNA, 25 bp, Mus musculus
ttaccctgcaccgaagatttgaggg

SEQ ID NO: 920049 - DNA, 25 bp, Mus musculus
ttaccctggaatacgaaccacccat

SEQ ID NO: 920050 - DNA, 25 bp, Mus musculus
ttaccctggaattcgaaccacccat

SEQ ID NO: 920051 - DNA, 25 bp, Mus musculus
ttaccctggagcatggtcgacactc

SEQ ID NO: 920052 - DNA, 25 bp, Mus musculus
ttaccctggagcttggtcgacactc

SEQ ID NO: 920053 - DNA, 25 bp, Mus musculus
ttaccctggaggcatgcactgtgga

SEQ ID NO: 920054 - DNA, 25 bp, Mus musculus
ttaccctggagggatgcactgtgga

SEQ ID NO: 920055 - DNA, 25 bp, Mus musculus
ttaccctggcagaggtatcggcagt

SEQ ID NO: 920056 - DNA, 25 bp, Mus musculus
ttaccctggcagtggtatcggcagt

SEQ ID NO: 920057 - DNA, 25 bp, Mus musculus
ttaccctggttgctgcgttgactga

SEQ ID NO: 920058 - DNA, 25 bp, Mus musculus
ttaccctggttggtgcgttgactga

SEQ ID NO: 920059 - DNA, 25 bp, Mus musculus
ttaccctgtctaaatgatcattcct

SEQ ID NO: 920060 - DNA, 25 bp, Mus musculus
ttaccctgtctatatgatcattcct

SEQ ID NO: 920061 - DNA, 25 bp, Mus musculus
ttacccttccctacagagaagctgt

SEQ ID NO: 920062 - DNA, 25 bp, Mus musculus
ttacccttcccttcagagaagctgt

SEQ ID NO: 920063 - DNA, 25 bp, Mus musculus
ttacccttctccatagtccatattt

SEQ ID NO: 920064 - DNA, 25 bp, Mus musculus
ttacccttctccttagtccatattt

SEQ ID NO: 920065 - DNA, 25 bp, Mus musculus
ttacccttctgaaagggttcgcact

SEQ ID NO: 920066 - DNA, 25 bp, Mus musculus
ttacccttctgatagggttcgcact

SEQ ID NO: 920067 - DNA, 25 bp, Mus musculus
ttacccttgcccagaagagaggttt

SEQ ID NO: 920068 - DNA, 25 bp, Mus musculus
ttacccttgccctgaagagaggttt

SEQ ID NO: 920069 - DNA, 25 bp, Mus musculus
ttacccttggcaacatgtacctgtg

SEQ ID NO: 920070 - DNA, 25 bp, Mus musculus
ttacccttggcatcatgtacctgtg

SEQ ID NO: 920071 - DNA, 25 bp, Mus musculus
ttacccttgggtaatgtcctggtgc

SEQ ID NO: 920072 - DNA, 25 bp, Mus musculus
ttacccttgggtagctagcatttcc

SEQ ID NO: 920073 - DNA, 25 bp, Mus musculus
ttacccttgggttatgtcctggtgc

SEQ ID NO: 920074 - DNA, 25 bp, Mus musculus
ttacccttgggttgctagcatttcc

SEQ ID NO: 920075 - DNA, 25 bp, Mus musculus
ttaccctttctgagtccattgctgg

SEQ ID NO: 920076 - DNA, 25 bp, Mus musculus
ttaccctttctgtgtccattgctgg

SEQ ID NO: 920077 - DNA, 25 bp, Mus musculus
ttaccctttttcattctcagtgtct

SEQ ID NO: 920078 - DNA, 25 bp, Mus musculus
ttaccctttttctttctcagtgtct

SEQ ID NO: 920079 - DNA, 25 bp, Mus musculus
ttaccgaagttcagattatgctgga

SEQ ID NO: 920080 - DNA, 25 bp, Mus musculus
ttaccgaagttctgattatgctgga

SEQ ID NO: 920081 - DNA, 25 bp, Mus musculus
ttaccgactctcactccagcagaag

SEQ ID NO: 920082 - DNA, 25 bp, Mus musculus
ttaccgactctctctccagcagaag

SEQ ID NO: 920083 - DNA, 25 bp, Mus musculus
ttaccgagcaccactttggatgcag

SEQ ID NO: 920084 - DNA, 25 bp, Mus musculus
ttaccgagcacctctttggatgcag

SEQ ID NO: 920085 - DNA, 25 bp, Mus musculus
ttaccgagcctcagctatcatctgt

SEQ ID NO: 920086 - DNA, 25 bp, Mus musculus
ttaccgagcctctgctatcatctgt

SEQ ID NO: 920087 - DNA, 25 bp, Mus musculus
ttaccgaggctcactgtcacattca

SEQ ID NO: 920088 - DNA, 25 bp, Mus musculus
ttaccgaggctctctgtcacattca

SEQ ID NO: 920089 - DNA, 25 bp, Mus musculus
ttaccgatgcatattcctgttgagt

SEQ ID NO: 920090 - DNA, 25 bp, Mus musculus
ttaccgatgcattttcctgttgagt

SEQ ID NO: 920091 - DNA, 25 bp, Mus musculus
ttaccgcatccacgttaacatgagc

SEQ ID NO: 920092 - DNA, 25 bp, Mus musculus
ttaccgcatccaggttaacatgagc

SEQ ID NO: 920093 - DNA, 25 bp, Mus musculus
ttaccgcccatcaccagagtaaggg

SEQ ID NO: 920094 - DNA, 25 bp, Mus musculus
ttaccgcccatctccagagtaaggg

SEQ ID NO: 920095 - DNA, 25 bp, Mus musculus
ttaccgcctcttacaggagttagga

SEQ ID NO: 920096 - DNA, 25 bp, Mus musculus
ttaccgcctctttcaggagttagga

SEQ ID NO: 920097 - DNA, 25 bp, Mus musculus
ttaccgctctacaacctgtacaaca

SEQ ID NO: 920098 - DNA, 25 bp, Mus musculus
ttaccgctctactacctgtacaaca

SEQ ID NO: 920099 - DNA, 25 bp, Mus musculus
ttaccgctgaatattgaagtcctgt

SEQ ID NO: 920100 - DNA, 25 bp, Mus musculus
ttaccgctgaattttgaagtcctgt

SEQ ID NO: 920101 - DNA, 25 bp, Mus musculus
ttaccggaacctcctcgagggccag

SEQ ID NO: 920102 - DNA, 25 bp, Mus musculus
ttaccggaacctgctcgagggccag

SEQ ID NO: 920103 - DNA, 25 bp, Mus musculus
ttaccggaggaactcagggtcccag

SEQ ID NO: 920104 - DNA, 25 bp, Mus musculus
ttaccggaggaagtcagggtcccag

SEQ ID NO: 920105 - DNA, 25 bp, Mus musculus
ttaccggcagttctgtctggaatcc

SEQ ID NO: 920106 - DNA, 25 bp, Mus musculus
ttaccggcagttgtgtctggaatcc

SEQ ID NO: 920107 - DNA, 25 bp, Mus musculus
ttaccggctagcagcccagtggagc

SEQ ID NO: 920108 - DNA, 25 bp, Mus musculus
ttaccggctagctgcccagtggagc

SEQ ID NO: 920109 - DNA, 25 bp, Mus musculus
ttaccgggaatcatgagcctgtgat

SEQ ID NO: 920110 - DNA, 25 bp, Mus musculus
ttaccgggaatcttgagcctgtgat

SEQ ID NO: 920111 - DNA, 25 bp, Mus musculus
ttaccgggaatgaccaaagtacctg

SEQ ID NO: 920112 - DNA, 25 bp, Mus musculus
ttaccgggaatgtccaaagtacctg

SEQ ID NO: 920113 - DNA, 25 bp, Mus musculus
ttaccgggacatcgtctgggagcca

SEQ ID NO: 920114 - DNA, 25 bp, Mus musculus
ttaccgggacatggtctgggagcca

SEQ ID NO: 920115 - DNA, 25 bp, Mus musculus
ttaccgggaggcagctcgttctgaa

SEQ ID NO: 920116 - DNA, 25 bp, Mus musculus
ttaccgggaggctgctcgttctgaa

SEQ ID NO: 920117 - DNA, 25 bp, Mus musculus
ttaccggttcacacctgtcctaacg

SEQ ID NO: 920118 - DNA, 25 bp, Mus musculus
ttaccggttcactcctgtcctaacg

SEQ ID NO: 920119 - DNA, 25 bp, Mus musculus
ttaccgtagctgcttctctgtcgtc

SEQ ID NO: 920120 - DNA, 25 bp, Mus musculus
ttaccgtagctggttctctgtcgtc

SEQ ID NO: 920121 - DNA, 25 bp, Mus musculus
ttaccgtctcagagagctctagctg

SEQ ID NO: 920122 - DNA, 25 bp, Mus musculus
ttaccgtctcagtgagctctagctg

SEQ ID NO: 920123 - DNA, 25 bp, Mus musculus
ttaccgtggcaactttcccaactct

SEQ ID NO: 920124 - DNA, 25 bp, Mus musculus
ttaccgtggcaagtttcccaactct

SEQ ID NO: 920125 - DNA, 25 bp, Mus musculus
ttaccgtgggaaatatggtggtggc

SEQ ID NO: 920126 - DNA, 25 bp, Mus musculus
ttaccgtgggaattatggtggtggc

SEQ ID NO: 920127 - DNA, 25 bp, Mus musculus
ttaccgtggtacatttccaagaact

SEQ ID NO: 920128 - DNA, 25 bp, Mus musculus
ttaccgtggtacttttccaagaact

SEQ ID NO: 920129 - DNA, 25 bp, Mus musculus
ttaccgtgtgccctttggcctgacc

SEQ ID NO: 920130 - DNA, 25 bp, Mus musculus
ttaccgtgtgccgtttggcctgacc

SEQ ID NO: 920131 - DNA, 25 bp, Mus musculus
ttacctaaacatctggcttgctcag

SEQ ID NO: 920132 - DNA, 25 bp, Mus musculus
ttacctaaacatgtggcttgctcag

SEQ ID NO: 920133 - DNA, 25 bp, Mus musculus
ttacctaaaggcatgactgctattt

SEQ ID NO: 920134 - DNA, 25 bp, Mus musculus
ttacctaaaggcttgactgctattt

SEQ ID NO: 920135 - DNA, 25 bp, Mus musculus
ttacctaacatactcatatacttga

SEQ ID NO: 920136 - DNA, 25 bp, Mus musculus
ttacctaacatagtcatatacttga

SEQ ID NO: 920137 - DNA, 25 bp, Mus musculus
ttacctaacctcaaactataccaca

SEQ ID NO: 920138 - DNA, 25 bp, Mus musculus
ttacctaacctctaactataccaca

SEQ ID NO: 920139 - DNA, 25 bp, Mus musculus
ttacctaaccttctctgtgagagag

SEQ ID NO: 920140 - DNA, 25 bp, Mus musculus
ttacctaaccttgtctgtgagagag

SEQ ID NO: 920141 - DNA, 25 bp, Mus musculus
ttacctaactgcacataaacatcat

SEQ ID NO: 920142 - DNA, 25 bp, Mus musculus
ttacctaactgctcataaacatcat

SEQ ID NO: 920143 - DNA, 25 bp, Mus musculus
ttacctaagcagaagtcaagtcctt

SEQ ID NO: 920144 - DNA, 25 bp, Mus musculus
ttacctaagcagtagtcaagtcctt

SEQ ID NO: 920145 - DNA, 25 bp, Mus musculus
ttacctaagctaccgtgggcttcca

SEQ ID NO: 920146 - DNA, 25 bp, Mus musculus
ttacctaagctagcgtgggcttcca

SEQ ID NO: 920147 - DNA, 25 bp, Mus musculus
ttacctaagctgagcagtctgtcag

SEQ ID NO: 920148 - DNA, 25 bp, Mus musculus
ttacctaagctgtgcagtctgtcag

SEQ ID NO: 920149 - DNA, 25 bp, Mus musculus
ttacctaagtctatgctcttcacct

SEQ ID NO: 920150 - DNA, 25 bp, Mus musculus
ttacctaagtctttgctcttcacct

SEQ ID NO: 920151 - DNA, 25 bp, Mus musculus
ttacctaagttaaggatgtcacaga

SEQ ID NO: 920152 - DNA, 25 bp, Mus musculus
ttacctaagttatggatgtcacaga

SEQ ID NO: 920153 - DNA, 25 bp, Mus musculus
ttacctacaaggctgctgcaacaga

SEQ ID NO: 920154 - DNA, 25 bp, Mus musculus
ttacctacaagggtgctgcaacaga

SEQ ID NO: 920155 - DNA, 25 bp, Mus musculus
ttacctaccaagaactaattagcat

SEQ ID NO: 920156 - DNA, 25 bp, Mus musculus
ttacctaccaagtactaattagcat

SEQ ID NO: 920157 - DNA, 25 bp, Mus musculus
ttacctaccatgcttgtagcgtcac

SEQ ID NO: 920158 - DNA, 25 bp, Mus musculus
ttacctaccatggttgtagcgtcac

SEQ ID NO: 920159 - DNA, 25 bp, Mus musculus
ttacctaccctgagccagtggatgt

SEQ ID NO: 920160 - DNA, 25 bp, Mus musculus
ttacctaccctgtgccagtggatgt

SEQ ID NO: 920161 - DNA, 25 bp, Mus musculus
ttacctactctgcttgttcattcag

SEQ ID NO: 920162 - DNA, 25 bp, Mus musculus
ttacctactctggttgttcattcag

SEQ ID NO: 920163 - DNA, 25 bp, Mus musculus
ttacctactgctaggctgtaaaggt

SEQ ID NO: 920164 - DNA, 25 bp, Mus musculus
ttacctactgcttggctgtaaaggt

SEQ ID NO: 920165 - DNA, 25 bp, Mus musculus
ttacctactgtaagccttcaccaga

SEQ ID NO: 920166 - DNA, 25 bp, Mus musculus
ttacctactgtatgccttcaccaga

SEQ ID NO: 920167 - DNA, 25 bp, Mus musculus
ttacctactgttctcatggccttta

SEQ ID NO: 920168 - DNA, 25 bp, Mus musculus
ttacctactgttgtcatggccttta

SEQ ID NO: 920169 - DNA, 25 bp, Mus musculus
ttacctactttcagctctcttggct

SEQ ID NO: 920170 - DNA, 25 bp, Mus musculus
ttacctactttctgctctcttggct

SEQ ID NO: 920171 - DNA, 25 bp, Mus musculus
ttacctagaaatccacttttcctcc

SEQ ID NO: 920172 - DNA, 25 bp, Mus musculus
ttacctagaaatgcacttttcctcc

SEQ ID NO: 920173 - DNA, 25 bp, Mus musculus
ttacctagggcaccgtctggacagt

SEQ ID NO: 920174 - DNA, 25 bp, Mus musculus
ttacctagggcagcgtctggacagt

SEQ ID NO: 920175 - DNA, 25 bp, Mus musculus
ttacctagggctcagactcacttgt

SEQ ID NO: 920176 - DNA, 25 bp, Mus musculus
ttacctagggctgagactcacttgt

SEQ ID NO: 920177 - DNA, 25 bp, Mus musculus
ttacctaggtgcctatgatcgcttc

SEQ ID NO: 920178 - DNA, 25 bp, Mus musculus
ttacctaggtgcgtatgatcgcttc

SEQ ID NO: 920179 - DNA, 25 bp, Mus musculus
ttacctaggtttacaggacgcctcg

SEQ ID NO: 920180 - DNA, 25 bp, Mus musculus
ttacctaggttttcaggacgcctcg

SEQ ID NO: 920181 - DNA, 25 bp, Mus musculus
ttacctagtggtactgtggcttgat

SEQ ID NO: 920182 - DNA, 25 bp, Mus musculus
ttacctagtggttctgtggcttgat

SEQ ID NO: 920183 - DNA, 25 bp, Mus musculus
ttacctataggccacttgcttacag

SEQ ID NO: 920184 - DNA, 25 bp, Mus musculus
ttacctataggcgacttgcttacag

SEQ ID NO: 920185 - DNA, 25 bp, Mus musculus
ttacctatcagcaatcccggaagga

SEQ ID NO: 920186 - DNA, 25 bp, Mus musculus
ttacctatcagctatcccggaagga

SEQ ID NO: 920187 - DNA, 25 bp, Mus musculus
ttacctatccatctttgctggtcag

SEQ ID NO: 920188 - DNA, 25 bp, Mus musculus
ttacctatccatgtttgctggtcag

SEQ ID NO: 920189 - DNA, 25 bp, Mus musculus
ttacctatcggaaagacatccccat

SEQ ID NO: 920190 - DNA, 25 bp, Mus musculus
ttacctatcggatagacatccccat

SEQ ID NO: 920191 - DNA, 25 bp, Mus musculus
ttacctatcttaagtggcccaagcc

SEQ ID NO: 920192 - DNA, 25 bp, Mus musculus
ttacctatcttatgtggcccaagcc

SEQ ID NO: 920193 - DNA, 25 bp, Mus musculus
ttacctatctttatccatctgacat

SEQ ID NO: 920194 - DNA, 25 bp, Mus musculus
ttacctatctttttccatctgacat

SEQ ID NO: 920195 - DNA, 25 bp, Mus musculus
ttacctatgcccatttgtgcaggtc

SEQ ID NO: 920196 - DNA, 25 bp, Mus musculus
ttacctatgcccttttgtgcaggtc

SEQ ID NO: 920197 - DNA, 25 bp, Mus musculus
ttacctatggctcactactagcttt

SEQ ID NO: 920198 - DNA, 25 bp, Mus musculus
ttacctatggctgactactagcttt

SEQ ID NO: 920199 - DNA, 25 bp, Mus musculus
ttacctatgttcaaaaaatctacct

SEQ ID NO: 920200 - DNA, 25 bp, Mus musculus
ttacctatgttctaaaaatctacct

SEQ ID NO: 920201 - DNA, 25 bp, Mus musculus
ttacctattgaacgatgggcactcc

SEQ ID NO: 920202 - DNA, 25 bp, Mus musculus
ttacctattgaaggatgggcactcc

SEQ ID NO: 920203 - DNA, 25 bp, Mus musculus
ttacctcaaatgctcacatatccca

SEQ ID NO: 920204 - DNA, 25 bp, Mus musculus
ttacctcaaatggtcacatatccca

SEQ ID NO: 920205 - DNA, 25 bp, Mus musculus
ttacctcaagtcaatttgtcttgaa

SEQ ID NO: 920206 - DNA, 25 bp, Mus musculus
ttacctcaagtctatttgtcttgaa

SEQ ID NO: 920207 - DNA, 25 bp, Mus musculus
ttacctcacacacttaccagtttct

SEQ ID NO: 920208 - DNA, 25 bp, Mus musculus
ttacctcacacagttaccagtttct

SEQ ID NO: 920209 - DNA, 25 bp, Mus musculus
ttacctcactcgacctatttgttgg

SEQ ID NO: 920210 - DNA, 25 bp, Mus musculus
ttacctcactcgtcctatttgttgg

SEQ ID NO: 920211 - DNA, 25 bp, Mus musculus
ttacctcagaggactctggccatgc

SEQ ID NO: 920212 - DNA, 25 bp, Mus musculus
ttacctcagaggtctctggccatgc

SEQ ID NO: 920213 - DNA, 25 bp, Mus musculus
ttacctcagtataaacccatgttca

SEQ ID NO: 920214 - DNA, 25 bp, Mus musculus
ttacctcagtattaacccatgttca

SEQ ID NO: 920215 - DNA, 25 bp, Mus musculus
ttacctcagtgcctcagttctggaa

SEQ ID NO: 920216 - DNA, 25 bp, Mus musculus
ttacctcagtgcgtcagttctggaa

SEQ ID NO: 920217 - DNA, 25 bp, Mus musculus
ttacctcattaactacccattgctt

SEQ ID NO: 920218 - DNA, 25 bp, Mus musculus
ttacctcattaagtacccattgctt

SEQ ID NO: 920219 - DNA, 25 bp, Mus musculus
ttacctcattcacgccatggtctga

SEQ ID NO: 920220 - DNA, 25 bp, Mus musculus
ttacctcattcaggccatggtctga

SEQ ID NO: 920221 - DNA, 25 bp, Mus musculus
ttacctccaccaaatgctatttttc

SEQ ID NO: 920222 - DNA, 25 bp, Mus musculus
ttacctccaccatatgctatttttc

SEQ ID NO: 920223 - DNA, 25 bp, Mus musculus
ttacctccacttctaggagatcggg

SEQ ID NO: 920224 - DNA, 25 bp, Mus musculus
ttacctccacttgtaggagatcggg

SEQ ID NO: 920225 - DNA, 25 bp, Mus musculus
ttacctccatctcttgcttacaaga

SEQ ID NO: 920226 - DNA, 25 bp, Mus musculus
ttacctccatctgttgcttacaaga

SEQ ID NO: 920227 - DNA, 25 bp, Mus musculus
ttacctcccagacatgaccaatttg

SEQ ID NO: 920228 - DNA, 25 bp, Mus musculus
ttacctcccagagatgaccaatttg

SEQ ID NO: 920229 - DNA, 25 bp, Mus musculus
ttacctccccgcaatggaaaagcag

SEQ ID NO: 920230 - DNA, 25 bp, Mus musculus
ttacctccccgctatggaaaagcag

SEQ ID NO: 920231 - DNA, 25 bp, Mus musculus
ttacctcccttcagagcgaattgat

SEQ ID NO: 920232 - DNA, 25 bp, Mus musculus
ttacctcccttctgagcgaattgat

SEQ ID NO: 920233 - DNA, 25 bp, Mus musculus
ttacctccgtaaatgtgtcttttgg

SEQ ID NO: 920234 - DNA, 25 bp, Mus musculus
ttacctccgtaattgtgtcttttgg

SEQ ID NO: 920235 - DNA, 25 bp, Mus musculus
ttacctcctaagcttctttgtcaac

SEQ ID NO: 920236 - DNA, 25 bp, Mus musculus
ttacctcctaaggttctttgtcaac

SEQ ID NO: 920237 - DNA, 25 bp, Mus musculus
ttacctcctactcactaattctatt

SEQ ID NO: 920238 - DNA, 25 bp, Mus musculus
ttacctcctactgactaattctatt

SEQ ID NO: 920239 - DNA, 25 bp, Mus musculus
ttacctcctctcagaaagtcttctt

SEQ ID NO: 920240 - DNA, 25 bp, Mus musculus
ttacctcctctctgaaagtcttctt

SEQ ID NO: 920241 - DNA, 25 bp, Mus musculus
ttacctcctggacataaagaagcta

SEQ ID NO: 920242 - DNA, 25 bp, Mus musculus
ttacctcctggagataaagaagcta

SEQ ID NO: 920243 - DNA, 25 bp, Mus musculus
ttacctcgcattaggtatatgccaa

SEQ ID NO: 920244 - DNA, 25 bp, Mus musculus
ttacctcgcatttggtatatgccaa

SEQ ID NO: 920245 - DNA, 25 bp, Mus musculus
ttacctcgggaacctcttagatagc

SEQ ID NO: 920246 - DNA, 25 bp, Mus musculus
ttacctcgggaagctcttagatagc

SEQ ID NO: 920247 - DNA, 25 bp, Mus musculus
ttacctctacggatgtcacctgtgc

SEQ ID NO: 920248 - DNA, 25 bp, Mus musculus
ttacctctacggttgtcacctgtgc

SEQ ID NO: 920249 - DNA, 25 bp, Mus musculus
ttacctctacttatgtttgaccaat

SEQ ID NO: 920250 - DNA, 25 bp, Mus musculus
ttacctctacttttgtttgaccaat

SEQ ID NO: 920251 - DNA, 25 bp, Mus musculus
ttacctctatggctgcactaaccag

SEQ ID NO: 920252 - DNA, 25 bp, Mus musculus
ttacctctatgggtgcactaaccag

SEQ ID NO: 920253 - DNA, 25 bp, Mus musculus
ttacctctcctactggcctacaagg

SEQ ID NO: 920254 - DNA, 25 bp, Mus musculus
ttacctctcctagtggcctacaagg

SEQ ID NO: 920255 - DNA, 25 bp, Mus musculus
ttacctctctcaccttttatatcgt

SEQ ID NO: 920256 - DNA, 25 bp, Mus musculus
ttacctctctcagcttttatatcgt

SEQ ID NO: 920257 - DNA, 25 bp, Mus musculus
ttacctctgaaaagccagtcccctt

SEQ ID NO: 920258 - DNA, 25 bp, Mus musculus
ttacctctgaaatgccagtcccctt

SEQ ID NO: 920259 - DNA, 25 bp, Mus musculus
ttacctctgagccatcctagaactg

SEQ ID NO: 920260 - DNA, 25 bp, Mus musculus
ttacctctgagcgatcctagaactg

SEQ ID NO: 920261 - DNA, 25 bp, Mus musculus
ttacctctgatgcatttcctgtgaa

SEQ ID NO: 920262 - DNA, 25 bp, Mus musculus
ttacctctgatggatttcctgtgaa

SEQ ID NO: 920263 - DNA, 25 bp, Mus musculus
ttacctctggagctatgatcgatct

SEQ ID NO: 920264 - DNA, 25 bp, Mus musculus
ttacctctggaggtatgatcgatct

SEQ ID NO: 920265 - DNA, 25 bp, Mus musculus
ttacctctggtcctcaatgacatgg

SEQ ID NO: 920266 - DNA, 25 bp, Mus musculus
ttacctctggtcgtcaatgacatgg

SEQ ID NO: 920267 - DNA, 25 bp, Mus musculus
ttacctcttctcaaatctgtctttt

SEQ ID NO: 920268 - DNA, 25 bp, Mus musculus
ttacctcttctctaatctgtctttt

SEQ ID NO: 920269 - DNA, 25 bp, Mus musculus
ttacctcttgctaggctccagttca

SEQ ID NO: 920270 - DNA, 25 bp, Mus musculus
ttacctcttgcttggctccagttca

SEQ ID NO: 920271 - DNA, 25 bp, Mus musculus
ttacctctttacatatcaggaataa

SEQ ID NO: 920272 - DNA, 25 bp, Mus musculus
ttacctctttacttatcaggaataa

SEQ ID NO: 920273 - DNA, 25 bp, Mus musculus
ttacctgaaaacattggccaatgat

SEQ ID NO: 920274 - DNA, 25 bp, Mus musculus
ttacctgaaaactttggccaatgat

SEQ ID NO: 920275 - DNA, 25 bp, Mus musculus
ttacctgaaacaagacccctgcaaa

SEQ ID NO: 920276 - DNA, 25 bp, Mus musculus
ttacctgaaacatgacccctgcaaa

SEQ ID NO: 920277 - DNA, 25 bp, Mus musculus
ttacctgaaatgcttggagcctcaa

SEQ ID NO: 920278 - DNA, 25 bp, Mus musculus
ttacctgaaatggttggagcctcaa

SEQ ID NO: 920279 - DNA, 25 bp, Mus musculus
ttacctgaacagctagaaaccttgt

SEQ ID NO: 920280 - DNA, 25 bp, Mus musculus
ttacctgaacaggtagaaaccttgt

SEQ ID NO: 920281 - DNA, 25 bp, Mus musculus
ttacctgaagacatcagagactcag

SEQ ID NO: 920282 - DNA, 25 bp, Mus musculus
ttacctgaagacttcagagactcag

SEQ ID NO: 920283 - DNA, 25 bp, Mus musculus
ttacctgaagagaaactctacacag

SEQ ID NO: 920284 - DNA, 25 bp, Mus musculus
ttacctgaagagtaactctacacag

SEQ ID NO: 920285 - DNA, 25 bp, Mus musculus
ttacctgaagtaatggtctcacatt

SEQ ID NO: 920286 - DNA, 25 bp, Mus musculus
ttacctgaagtattggtctcacatt

SEQ ID NO: 920287 - DNA, 25 bp, Mus musculus
ttacctgaatgtacatggcgcctgc

SEQ ID NO: 920288 - DNA, 25 bp, Mus musculus
ttacctgaatgttcatggcgcctgc

SEQ ID NO: 920289 - DNA, 25 bp, Mus musculus
ttacctgacagcaacttttgatctt

SEQ ID NO: 920290 - DNA, 25 bp, Mus musculus
ttacctgacagctacttttgatctt

SEQ ID NO: 920291 - DNA, 25 bp, Mus musculus
ttacctgacaggaggatgcccttct

SEQ ID NO: 920292 - DNA, 25 bp, Mus musculus
ttacctgacaggtggatgcccttct

SEQ ID NO: 920293 - DNA, 25 bp, Mus musculus
ttacctgagccacatatatctttag

SEQ ID NO: 920294 - DNA, 25 bp, Mus musculus
ttacctgagccagatatatctttag

SEQ ID NO: 920295 - DNA, 25 bp, Mus musculus
ttacctgagctcctcggccttcgag

SEQ ID NO: 920296 - DNA, 25 bp, Mus musculus
ttacctgagctcgtcggccttcgag

SEQ ID NO: 920297 - DNA, 25 bp, Mus musculus
ttacctgataagactcctccactgg

SEQ ID NO: 920298 - DNA, 25 bp, Mus musculus
ttacctgataagtctcctccactgg

SEQ ID NO: 920299 - DNA, 25 bp, Mus musculus
ttacctgatgagaactcctgggcga

SEQ ID NO: 920300 - DNA, 25 bp, Mus musculus
ttacctgatgagtactcctgggcga

SEQ ID NO: 920301 - DNA, 25 bp, Mus musculus
ttacctgatgctataatgctttcca

SEQ ID NO: 920302 - DNA, 25 bp, Mus musculus
ttacctgatgctttaatgctttcca

SEQ ID NO: 920303 - DNA, 25 bp, Mus musculus
ttacctgatgtgagccttaacttat

SEQ ID NO: 920304 - DNA, 25 bp, Mus musculus
ttacctgatgtgtgccttaacttat

SEQ ID NO: 920305 - DNA, 25 bp, Mus musculus
ttacctgatttaattttaacacgat

SEQ ID NO: 920306 - DNA, 25 bp, Mus musculus
ttacctgatttatttttaacacgat

SEQ ID NO: 920307 - DNA, 25 bp, Mus musculus
ttacctgcaactcctgtctcaggag

SEQ ID NO: 920308 - DNA, 25 bp, Mus musculus
ttacctgcaactgctgtctcaggag

SEQ ID NO: 920309 - DNA, 25 bp, Mus musculus
ttacctgcagttcattcgctttccg

SEQ ID NO: 920310 - DNA, 25 bp, Mus musculus
ttacctgcagttgattcgctttccg

SEQ ID NO: 920311 - DNA, 25 bp, Mus musculus
ttacctgccacaaggacgcctgagt

SEQ ID NO: 920312 - DNA, 25 bp, Mus musculus
ttacctgccacatggacgcctgagt

SEQ ID NO: 920313 - DNA, 25 bp, Mus musculus
ttacctgccactctgccagttaatt

SEQ ID NO: 920314 - DNA, 25 bp, Mus musculus
ttacctgccactgtgccagttaatt

SEQ ID NO: 920315 - DNA, 25 bp, Mus musculus
ttacctgccctgcatatataaagtc

SEQ ID NO: 920316 - DNA, 25 bp, Mus musculus
ttacctgccctggatatataaagtc

SEQ ID NO: 920317 - DNA, 25 bp, Mus musculus
ttacctgcccttagtagagatctgc

SEQ ID NO: 920318 - DNA, 25 bp, Mus musculus
ttacctgccctttgtagagatctgc

SEQ ID NO: 920319 - DNA, 25 bp, Mus musculus
ttacctgccgaaattgctgtggact

SEQ ID NO: 920320 - DNA, 25 bp, Mus musculus
ttacctgccgaatttgctgtggact

SEQ ID NO: 920321 - DNA, 25 bp, Mus musculus
ttacctgcctagaaacatgtctgct

SEQ ID NO: 920322 - DNA, 25 bp, Mus musculus
ttacctgcctagtaacatgtctgct

SEQ ID NO: 920323 - DNA, 25 bp, Mus musculus
ttacctgcgccgaggacactgagaa

SEQ ID NO: 920324 - DNA, 25 bp, Mus musculus
ttacctgcgccgtggacactgagaa

SEQ ID NO: 920325 - DNA, 25 bp, Mus musculus
ttacctgcgttcaactgtgagcgac

SEQ ID NO: 920326 - DNA, 25 bp, Mus musculus
ttacctgcgttctactgtgagcgac

SEQ ID NO: 920327 - DNA, 25 bp, Mus musculus
ttacctgctgctctgtatcgcctgc

SEQ ID NO: 920328 - DNA, 25 bp, Mus musculus
ttacctgctgctgtgtatcgcctgc

SEQ ID NO: 920329 - DNA, 25 bp, Mus musculus
ttacctgctgggaggaatccttttg

SEQ ID NO: 920330 - DNA, 25 bp, Mus musculus
ttacctgctgggtggaatccttttg

SEQ ID NO: 920331 - DNA, 25 bp, Mus musculus
ttacctggaagactgactcggcaat

SEQ ID NO: 920332 - DNA, 25 bp, Mus musculus
ttacctggaagagtgactcggcaat

SEQ ID NO: 920333 - DNA, 25 bp, Mus musculus
ttacctggaagccactctcaattgg

SEQ ID NO: 920334 - DNA, 25 bp, Mus musculus
ttacctggaagcgactctcaattgg

SEQ ID NO: 920335 - DNA, 25 bp, Mus musculus
ttacctggcaagcagacgtgacact

SEQ ID NO: 920336 - DNA, 25 bp, Mus musculus
ttacctggcaaggagacgtgacact

SEQ ID NO: 920337 - DNA, 25 bp, Mus musculus
ttacctggcgtcaacacttccgaaa

SEQ ID NO: 920338 - DNA, 25 bp, Mus musculus
ttacctggcgtctacacttccgaaa

SEQ ID NO: 920339 - DNA, 25 bp, Mus musculus
ttacctggctagaccgttgtgtaca

SEQ ID NO: 920340 - DNA, 25 bp, Mus musculus
ttacctggctagtccgttgtgtaca

SEQ ID NO: 920341 - DNA, 25 bp, Mus musculus
ttacctggctgcaaagtgctgtgct

SEQ ID NO: 920342 - DNA, 25 bp, Mus musculus
ttacctggctgctaagtgctgtgct

SEQ ID NO: 920343 - DNA, 25 bp, Mus musculus
ttacctggcttcctcagactcctgg

SEQ ID NO: 920344 - DNA, 25 bp, Mus musculus
ttacctggcttcgtcagactcctgg

SEQ ID NO: 920345 - DNA, 25 bp, Mus musculus
ttacctgggcatagaaatggtccat

SEQ ID NO: 920346 - DNA, 25 bp, Mus musculus
ttacctgggcatattatctttttaa

SEQ ID NO: 920347 - DNA, 25 bp, Mus musculus
ttacctgggcattgaaatggtccat

SEQ ID NO: 920348 - DNA, 25 bp, Mus musculus
ttacctgggcattttatctttttaa

SEQ ID NO: 920349 - DNA, 25 bp, Mus musculus
ttacctggtaggcttgtagcatccc

SEQ ID NO: 920350 - DNA, 25 bp, Mus musculus
ttacctggtagggttgtagcatccc

SEQ ID NO: 920351 - DNA, 25 bp, Mus musculus
ttacctggtcagctatttttcacac

SEQ ID NO: 920352 - DNA, 25 bp, Mus musculus
ttacctggtcaggtatttttcacac

SEQ ID NO: 920353 - DNA, 25 bp, Mus musculus
ttacctggtccacaaggtgaaccat

SEQ ID NO: 920354 - DNA, 25 bp, Mus musculus
ttacctggtccagaaggtgaaccat

SEQ ID NO: 920355 - DNA, 25 bp, Mus musculus
ttacctggtgataattgtcctgacg

SEQ ID NO: 920356 - DNA, 25 bp, Mus musculus
ttacctggtgattattgtcctgacg

SEQ ID NO: 920357 - DNA, 25 bp, Mus musculus
ttacctggttgtaggatgactgaat

SEQ ID NO: 920358 - DNA, 25 bp, Mus musculus
ttacctggttgttggatgactgaat

SEQ ID NO: 920359 - DNA, 25 bp, Mus musculus
ttacctggtttcataggtgtgcggt

SEQ ID NO: 920360 - DNA, 25 bp, Mus musculus
ttacctggtttcttaggtgtgcggt

SEQ ID NO: 920361 - DNA, 25 bp, Mus musculus
ttacctgtacacatcttctttgcat

SEQ ID NO: 920362 - DNA, 25 bp, Mus musculus
ttacctgtacacttcttctttgcat

SEQ ID NO: 920363 - DNA, 25 bp, Mus musculus
ttacctgtacgccaacatttgcttt

SEQ ID NO: 920364 - DNA, 25 bp, Mus musculus
ttacctgtacgcgaacatttgcttt

SEQ ID NO: 920365 - DNA, 25 bp, Mus musculus
ttacctgtcaaaccagggtggcgat

SEQ ID NO: 920366 - DNA, 25 bp, Mus musculus
ttacctgtcaaagcagggtggcgat

SEQ ID NO: 920367 - DNA, 25 bp, Mus musculus
ttacctgtcagcaatctcatagttc

SEQ ID NO: 920368 - DNA, 25 bp, Mus musculus
ttacctgtcagctatctcatagttc

SEQ ID NO: 920369 - DNA, 25 bp, Mus musculus
ttacctgtccccagtcttctacagg

SEQ ID NO: 920370 - DNA, 25 bp, Mus musculus
ttacctgtcccctgtcttctacagg

SEQ ID NO: 920371 - DNA, 25 bp, Mus musculus
ttacctgtccggctcttactgtaaa

SEQ ID NO: 920372 - DNA, 25 bp, Mus musculus
ttacctgtccgggtcttactgtaaa

SEQ ID NO: 920373 - DNA, 25 bp, Mus musculus
ttacctgtcgccacgtggaatatat

SEQ ID NO: 920374 - DNA, 25 bp, Mus musculus
ttacctgtcgcctcgtggaatatat

SEQ ID NO: 920375 - DNA, 25 bp, Mus musculus
ttacctgtctctaggttgatcccag

SEQ ID NO: 920376 - DNA, 25 bp, Mus musculus
ttacctgtctcttggttgatcccag

SEQ ID NO: 920377 - DNA, 25 bp, Mus musculus
ttacctgtgactagcagttgctgct

SEQ ID NO: 920378 - DNA, 25 bp, Mus musculus
ttacctgtgacttgcagttgctgct

SEQ ID NO: 920379 - DNA, 25 bp, Mus musculus
ttacctgtgatcactggatcccaga

SEQ ID NO: 920380 - DNA, 25 bp, Mus musculus
ttacctgtgatctctggatcccaga

SEQ ID NO: 920381 - DNA, 25 bp, Mus musculus
ttacctgtgcttagtttgtgctggg

SEQ ID NO: 920382 - DNA, 25 bp, Mus musculus
ttacctgtgctttgtttgtgctggg

SEQ ID NO: 920383 - DNA, 25 bp, Mus musculus
ttacctgtggcacagttagtgctgt

SEQ ID NO: 920384 - DNA, 25 bp, Mus musculus
ttacctgtggcagagttagtgctgt

SEQ ID NO: 920385 - DNA, 25 bp, Mus musculus
ttacctgtgggtcgcccgtcccagg

SEQ ID NO: 920386 - DNA, 25 bp, Mus musculus
ttacctgtgggtggcccgtcccagg

SEQ ID NO: 920387 - DNA, 25 bp, Mus musculus
ttacctgtggtaaacttgtctttca

SEQ ID NO: 920388 - DNA, 25 bp, Mus musculus
ttacctgtggtatacttgtctttca

SEQ ID NO: 920389 - DNA, 25 bp, Mus musculus
ttacctgtgtgtacaaggcccaagt

SEQ ID NO: 920390 - DNA, 25 bp, Mus musculus
ttacctgtgtgttcaaggcccaagt

SEQ ID NO: 920391 - DNA, 25 bp, Mus musculus
ttacctgttgagctggattccttag

SEQ ID NO: 920392 - DNA, 25 bp, Mus musculus
ttacctgttgaggtggattccttag

SEQ ID NO: 920393 - DNA, 25 bp, Mus musculus
ttacctgttgccagcagagctgaag

SEQ ID NO: 920394 - DNA, 25 bp, Mus musculus
ttacctgttgcctgcagagctgaag

SEQ ID NO: 920395 - DNA, 25 bp, Mus musculus
ttacctgttgctctcagggttacct

SEQ ID NO: 920396 - DNA, 25 bp, Mus musculus
ttacctgttgctgtcagggttacct

SEQ ID NO: 920397 - DNA, 25 bp, Mus musculus
ttacctgttggcctctgattttaga

SEQ ID NO: 920398 - DNA, 25 bp, Mus musculus
ttacctgttggcgtctgattttaga

SEQ ID NO: 920399 - DNA, 25 bp, Mus musculus
ttacctgtttcaactatccctcttt

SEQ ID NO: 920400 - DNA, 25 bp, Mus musculus
ttacctgtttcacgtactgccaaag

SEQ ID NO: 920401 - DNA, 25 bp, Mus musculus
ttacctgtttcaggtactgccaaag

SEQ ID NO: 920402 - DNA, 25 bp, Mus musculus
ttacctgtttcatctatccctcttt

SEQ ID NO: 920403 - DNA, 25 bp, Mus musculus
ttacctgtttgtacacagagagcct

SEQ ID NO: 920404 - DNA, 25 bp, Mus musculus
ttacctgtttgttcacagagagcct

SEQ ID NO: 920405 - DNA, 25 bp, Mus musculus
ttaccttaaatgcacaagcctgggc

SEQ ID NO: 920406 - DNA, 25 bp, Mus musculus
ttaccttaaatggacaagcctgggc

SEQ ID NO: 920407 - DNA, 25 bp, Mus musculus
ttaccttactacacaaaacaccacg

SEQ ID NO: 920408 - DNA, 25 bp, Mus musculus
ttaccttactactcaaaacaccacg

SEQ ID NO: 920409 - DNA, 25 bp, Mus musculus
ttaccttagatcacactcagcaaca

SEQ ID NO: 920410 - DNA, 25 bp, Mus musculus
ttaccttagatctcactcagcaaca

SEQ ID NO: 920411 - DNA, 25 bp, Mus musculus
ttaccttagctgctggcaaactgcc

SEQ ID NO: 920412 - DNA, 25 bp, Mus musculus
ttaccttagctggtggcaaactgcc

SEQ ID NO: 920413 - DNA, 25 bp, Mus musculus
ttaccttaggcacctccagtggcaa

SEQ ID NO: 920414 - DNA, 25 bp, Mus musculus
ttaccttaggcagctccagtggcaa

SEQ ID NO: 920415 - DNA, 25 bp, Mus musculus
ttaccttagttgagcccatcctgaa

SEQ ID NO: 920416 - DNA, 25 bp, Mus musculus
ttaccttagttgtgcccatcctgaa

SEQ ID NO: 920417 - DNA, 25 bp, Mus musculus
ttaccttatattatcctatttctgt

SEQ ID NO: 920418 - DNA, 25 bp, Mus musculus
ttaccttatattttcctatttctgt

SEQ ID NO: 920419 - DNA, 25 bp, Mus musculus
ttaccttatgttcgcatggtcacca

SEQ ID NO: 920420 - DNA, 25 bp, Mus musculus
ttaccttatgttggcatggtcacca

SEQ ID NO: 920421 - DNA, 25 bp, Mus musculus
ttaccttcaaacagccagccacttg

SEQ ID NO: 920422 - DNA, 25 bp, Mus musculus
ttaccttcaaactgccagccacttg

SEQ ID NO: 920423 - DNA, 25 bp, Mus musculus
ttaccttcctcaaagtacagtgatg

SEQ ID NO: 920424 - DNA, 25 bp, Mus musculus
ttaccttcctcatagtacagtgatg

SEQ ID NO: 920425 - DNA, 25 bp, Mus musculus
ttaccttccttactctcatctctag

SEQ ID NO: 920426 - DNA, 25 bp, Mus musculus
ttaccttccttagtctcatctctag

SEQ ID NO: 920427 - DNA, 25 bp, Mus musculus
ttaccttctcctagttcttgaggac

SEQ ID NO: 920428 - DNA, 25 bp, Mus musculus
ttaccttctcctctgatgttggtat

SEQ ID NO: 920429 - DNA, 25 bp, Mus musculus
ttaccttctcctgtgatgttggtat

SEQ ID NO: 920430 - DNA, 25 bp, Mus musculus
ttaccttctccttgttcttgaggac

SEQ ID NO: 920431 - DNA, 25 bp, Mus musculus
ttaccttctctcagaattggttgtg

SEQ ID NO: 920432 - DNA, 25 bp, Mus musculus
ttaccttctctctgaattggttgtg

SEQ ID NO: 920433 - DNA, 25 bp, Mus musculus
ttaccttctgtgaatggtggtggcc

SEQ ID NO: 920434 - DNA, 25 bp, Mus musculus
ttaccttctgtgtatggtggtggcc

SEQ ID NO: 920435 - DNA, 25 bp, Mus musculus
ttaccttcttccctagaacttggag

SEQ ID NO: 920436 - DNA, 25 bp, Mus musculus
ttaccttcttccgtagaacttggag

SEQ ID NO: 920437 - DNA, 25 bp, Mus musculus
ttaccttctttcacctttagtctgt

SEQ ID NO: 920438 - DNA, 25 bp, Mus musculus
ttaccttctttctcctttagtctgt

SEQ ID NO: 920439 - DNA, 25 bp, Mus musculus
ttaccttctttgatcgactacaaat

SEQ ID NO: 920440 - DNA, 25 bp, Mus musculus
ttaccttctttgttcgactacaaat

SEQ ID NO: 920441 - DNA, 25 bp, Mus musculus
ttaccttgagccactgtgtgagttg

SEQ ID NO: 920442 - DNA, 25 bp, Mus musculus
ttaccttgagcctctgtgtgagttg

SEQ ID NO: 920443 - DNA, 25 bp, Mus musculus
ttaccttgatggcactgtcttggct

SEQ ID NO: 920444 - DNA, 25 bp, Mus musculus
ttaccttgatgggactgtcttggct

SEQ ID NO: 920445 - DNA, 25 bp, Mus musculus
ttaccttgcaccatcttcaggattt

SEQ ID NO: 920446 - DNA, 25 bp, Mus musculus
ttaccttgcaccttcttcaggattt

SEQ ID NO: 920447 - DNA, 25 bp, Mus musculus
ttaccttggagaagctttgcggcgg

SEQ ID NO: 920448 - DNA, 25 bp, Mus musculus
ttaccttggagatgctttgcggcgg

SEQ ID NO: 920449 - DNA, 25 bp, Mus musculus
ttaccttggccaagtgagataacct

SEQ ID NO: 920450 - DNA, 25 bp, Mus musculus
ttaccttggccatgtgagataacct

SEQ ID NO: 920451 - DNA, 25 bp, Mus musculus
ttaccttggtaacagtggaaatgac

SEQ ID NO: 920452 - DNA, 25 bp, Mus musculus
ttaccttggtaagagtggaaatgac

SEQ ID NO: 920453 - DNA, 25 bp, Mus musculus
ttaccttgtagacggtgcatgccta

SEQ ID NO: 920454 - DNA, 25 bp, Mus musculus
ttaccttgtagagggtgcatgccta

SEQ ID NO: 920455 - DNA, 25 bp, Mus musculus
ttaccttgtttcatgggattcccac

SEQ ID NO: 920456 - DNA, 25 bp, Mus musculus
ttaccttgtttcttgggattcccac

SEQ ID NO: 920457 - DNA, 25 bp, Mus musculus
ttacctttagccagcctctagtaga

SEQ ID NO: 920458 - DNA, 25 bp, Mus musculus
ttacctttagcctgcctctagtaga

SEQ ID NO: 920459 - DNA, 25 bp, Mus musculus
ttacctttagtacttctcttttcag

SEQ ID NO: 920460 - DNA, 25 bp, Mus musculus
ttacctttagtagttctcttttcag

SEQ ID NO: 920461 - DNA, 25 bp, Mus musculus
ttacctttcagtaagatgggccatg

SEQ ID NO: 920462 - DNA, 25 bp, Mus musculus
ttacctttcagttagatgggccatg

SEQ ID NO: 920463 - DNA, 25 bp, Mus musculus
ttacctttcatcatacaatctgcag

SEQ ID NO: 920464 - DNA, 25 bp, Mus musculus
ttacctttcatcttacaatctgcag

SEQ ID NO: 920465 - DNA, 25 bp, Mus musculus
ttacctttccaaactgcattcatgc

SEQ ID NO: 920466 - DNA, 25 bp, Mus musculus
ttacctttccaatctgcattcatgc

SEQ ID NO: 920467 - DNA, 25 bp, Mus musculus
ttacctttccaccaagctggctttg

SEQ ID NO: 920468 - DNA, 25 bp, Mus musculus
ttacctttccacgaagctggctttg

SEQ ID NO: 920469 - DNA, 25 bp, Mus musculus
ttacctttcttgatattgctatggg

SEQ ID NO: 920470 - DNA, 25 bp, Mus musculus
ttacctttcttgttattgctatggg

SEQ ID NO: 920471 - DNA, 25 bp, Mus musculus
ttacctttctttcttgtcaacgtgg

SEQ ID NO: 920472 - DNA, 25 bp, Mus musculus
ttacctttctttgttgtcaacgtgg

SEQ ID NO: 920473 - DNA, 25 bp, Mus musculus
ttacctttgagtagtacctacttag

SEQ ID NO: 920474 - DNA, 25 bp, Mus musculus
ttacctttgagttgtacctacttag

SEQ ID NO: 920475 - DNA, 25 bp, Mus musculus
ttacctttgatgcttgctttgaaag

SEQ ID NO: 920476 - DNA, 25 bp, Mus musculus
ttacctttgatggttgctttgaaag

SEQ ID NO: 920477 - DNA, 25 bp, Mus musculus
ttacctttgcttcaggtgcttggta

SEQ ID NO: 920478 - DNA, 25 bp, Mus musculus
ttacctttgcttgaggtgcttggta

SEQ ID NO: 920479 - DNA, 25 bp, Mus musculus
ttacctttgggcatgactagactga

SEQ ID NO: 920480 - DNA, 25 bp, Mus musculus
ttacctttgggcttgactagactga

SEQ ID NO: 920481 - DNA, 25 bp, Mus musculus
ttaccttttgcactcggtcttaaag

SEQ ID NO: 920482 - DNA, 25 bp, Mus musculus
ttaccttttgcagtcggtcttaaag

SEQ ID NO: 920483 - DNA, 25 bp, Mus musculus
ttaccttttgctatgtcccgactct

SEQ ID NO: 920484 - DNA, 25 bp, Mus musculus
ttaccttttgctttgtcccgactct

SEQ ID NO: 920485 - DNA, 25 bp, Mus musculus
ttaccttttggaactaaactgcata

SEQ ID NO: 920486 - DNA, 25 bp, Mus musculus
ttaccttttggatctaaactgcata

SEQ ID NO: 920487 - DNA, 25 bp, Mus musculus
ttaccttttttcctgtgctgagata

SEQ ID NO: 920488 - DNA, 25 bp, Mus musculus
ttaccttttttcgtgtgctgagata

SEQ ID NO: 920489 - DNA, 25 bp, Mus musculus
ttacgaacagatacaagcattggcc

SEQ ID NO: 920490 - DNA, 25 bp, Mus musculus
ttacgaacagattcaagcattggcc

SEQ ID NO: 920491 - DNA, 25 bp, Mus musculus
ttacgaagaactatccagcagtcac

SEQ ID NO: 920492 - DNA, 25 bp, Mus musculus
ttacgaagaactttccagcagtcac

SEQ ID NO: 920493 - DNA, 25 bp, Mus musculus
ttacgacaatgcatccgaaactccc

SEQ ID NO: 920494 - DNA, 25 bp, Mus musculus
ttacgacaatgcttccgaaactccc

SEQ ID NO: 920495 - DNA, 25 bp, Mus musculus
ttacgacataggatcatacacatat

SEQ ID NO: 920496 - DNA, 25 bp, Mus musculus
ttacgacataggttcatacacatat

SEQ ID NO: 920497 - DNA, 25 bp, Mus musculus
ttacgacctctgcttccaaaggtgc

SEQ ID NO: 920498 - DNA, 25 bp, Mus musculus
ttacgacctctggttccaaaggtgc

SEQ ID NO: 920499 - DNA, 25 bp, Mus musculus
ttacgaccttgtatggttcactcca

SEQ ID NO: 920500 - DNA, 25 bp, Mus musculus
ttacgaccttgtttggttcactcca

SEQ ID NO: 920501 - DNA, 25 bp, Mus musculus
ttacgactacacataacgccttatg

SEQ ID NO: 920502 - DNA, 25 bp, Mus musculus
ttacgactacacttaacgccttatg

SEQ ID NO: 920503 - DNA, 25 bp, Mus musculus
ttacgactcgagctacaagactgga

SEQ ID NO: 920504 - DNA, 25 bp, Mus musculus
ttacgactcgaggtacaagactgga

SEQ ID NO: 920505 - DNA, 25 bp, Mus musculus
ttacgactcttaactcttgccctca

SEQ ID NO: 920506 - DNA, 25 bp, Mus musculus
ttacgactcttatctcttgccctca

SEQ ID NO: 920507 - DNA, 25 bp, Mus musculus
ttacgagaaacgctgcaaaccccta

SEQ ID NO: 920508 - DNA, 25 bp, Mus musculus
ttacgagaaacggtgcaaaccccta

SEQ ID NO: 920509 - DNA, 25 bp, Mus musculus
ttacgagctgcgatacttccagatt

SEQ ID NO: 920510 - DNA, 25 bp, Mus musculus
ttacgagctgcgttacttccagatt

SEQ ID NO: 920511 - DNA, 25 bp, Mus musculus
ttacgaggcaagctaccatcttccc

SEQ ID NO: 920512 - DNA, 25 bp, Mus musculus
ttacgaggcaaggtaccatcttccc

SEQ ID NO: 920513 - DNA, 25 bp, Mus musculus
ttacgaggtaagcctggccttgaac

SEQ ID NO: 920514 - DNA, 25 bp, Mus musculus
ttacgaggtaaggctggccttgaac

SEQ ID NO: 920515 - DNA, 25 bp, Mus musculus
ttacgaggtgcgctcatcctggatc

SEQ ID NO: 920516 - DNA, 25 bp, Mus musculus
ttacgaggtgcggtcatcctggatc

SEQ ID NO: 920517 - DNA, 25 bp, Mus musculus
ttacgagtgcacctcaggcgacaca

SEQ ID NO: 920518 - DNA, 25 bp, Mus musculus
ttacgagtgcacgtcaggcgacaca

SEQ ID NO: 920519 - DNA, 25 bp, Mus musculus
ttacgagtgctaagctttccagctc

SEQ ID NO: 920520 - DNA, 25 bp, Mus musculus
ttacgagtgctatgctttccagctc

SEQ ID NO: 920521 - DNA, 25 bp, Mus musculus
ttacgagttcccactcaacaaagta

SEQ ID NO: 920522 - DNA, 25 bp, Mus musculus
ttacgagttccctctcaacaaagta

SEQ ID NO: 920523 - DNA, 25 bp, Mus musculus
ttacgataacagagtattgaatacc

SEQ ID NO: 920524 - DNA, 25 bp, Mus musculus
ttacgataacagtgtattgaatacc

SEQ ID NO: 920525 - DNA, 25 bp, Mus musculus
ttacgatacaccctcttgtggtttt

SEQ ID NO: 920526 - DNA, 25 bp, Mus musculus
ttacgatacaccgtcttgtggtttt

SEQ ID NO: 920527 - DNA, 25 bp, Mus musculus
ttacgatcccgtagaagactactgg

SEQ ID NO: 920528 - DNA, 25 bp, Mus musculus
ttacgatcccgttgaagactactgg

SEQ ID NO: 920529 - DNA, 25 bp, Mus musculus
ttacgatcgcccacgtgaagccaag

SEQ ID NO: 920530 - DNA, 25 bp, Mus musculus
ttacgatcgccctcgtgaagccaag

SEQ ID NO: 920531 - DNA, 25 bp, Mus musculus
ttacgatgctctaacattctctcgg

SEQ ID NO: 920532 - DNA, 25 bp, Mus musculus
ttacgatgctcttacattctctcgg

SEQ ID NO: 920533 - DNA, 25 bp, Mus musculus
ttacgatgtattatgtgaggcaggt

SEQ ID NO: 920534 - DNA, 25 bp, Mus musculus
ttacgatgtattttgtgaggcaggt

SEQ ID NO: 920535 - DNA, 25 bp, Mus musculus
ttacgattaaggacagaacaccgca

SEQ ID NO: 920536 - DNA, 25 bp, Mus musculus
ttacgattaaggtcagaacaccgca

SEQ ID NO: 920537 - DNA, 25 bp, Mus musculus
ttacgatttgtccacgatgccatat

SEQ ID NO: 920538 - DNA, 25 bp, Mus musculus
ttacgatttgtcgacgatgccatat

SEQ ID NO: 920539 - DNA, 25 bp, Mus musculus
ttacgattttcacgccccatgacca

SEQ ID NO: 920540 - DNA, 25 bp, Mus musculus
ttacgattttcaggccccatgacca

SEQ ID NO: 920541 - DNA, 25 bp, Mus musculus
ttacgcagagttcccaaaggttggt

SEQ ID NO: 920542 - DNA, 25 bp, Mus musculus
ttacgcagagttgccaaaggttggt

SEQ ID NO: 920543 - DNA, 25 bp, Mus musculus
ttacgcagcaggaaactgcccgagt

SEQ ID NO: 920544 - DNA, 25 bp, Mus musculus
ttacgcagcaggtaactgcccgagt

SEQ ID NO: 920545 - DNA, 25 bp, Mus musculus
ttacgcaggctgattggcaagactt

SEQ ID NO: 920546 - DNA, 25 bp, Mus musculus
ttacgcaggctgtttggcaagactt

SEQ ID NO: 920547 - DNA, 25 bp, Mus musculus
ttacgcagtcagcaataaccaggca

SEQ ID NO: 920548 - DNA, 25 bp, Mus musculus
ttacgcagtcaggaataaccaggca

SEQ ID NO: 920549 - DNA, 25 bp, Mus musculus
ttacgcagtcctagactgagccaag

SEQ ID NO: 920550 - DNA, 25 bp, Mus musculus
ttacgcagtccttgactgagccaag

SEQ ID NO: 920551 - DNA, 25 bp, Mus musculus
ttacgcatgactccttaacaaaccg

SEQ ID NO: 920552 - DNA, 25 bp, Mus musculus
ttacgcatgactgcttaacaaaccg

SEQ ID NO: 920553 - DNA, 25 bp, Mus musculus
ttacgcatgtacacgatagaggtca

SEQ ID NO: 920554 - DNA, 25 bp, Mus musculus
ttacgcatgtactcgatagaggtca

SEQ ID NO: 920555 - DNA, 25 bp, Mus musculus
ttacgcattgagaaccaggtgccat

SEQ ID NO: 920556 - DNA, 25 bp, Mus musculus
ttacgcattgagtaccaggtgccat

SEQ ID NO: 920557 - DNA, 25 bp, Mus musculus
ttacgccaagctcattttgaggccc

SEQ ID NO: 920558 - DNA, 25 bp, Mus musculus
ttacgccaagctgattttgaggccc

SEQ ID NO: 920559 - DNA, 25 bp, Mus musculus
ttacgccaccatctcctatctgaag

SEQ ID NO: 920560 - DNA, 25 bp, Mus musculus
ttacgccaccatgtcctatctgaag

SEQ ID NO: 920561 - DNA, 25 bp, Mus musculus
ttacgccgccctctatgataaggct

SEQ ID NO: 920562 - DNA, 25 bp, Mus musculus
ttacgccgccctgtatgataaggct

SEQ ID NO: 920563 - DNA, 25 bp, Mus musculus
ttacgcctatccaacataataaccc

SEQ ID NO: 920564 - DNA, 25 bp, Mus musculus
ttacgcctatcctacataataaccc

SEQ ID NO: 920565 - DNA, 25 bp, Mus musculus
ttacgcctcctcaaatgctgctgag

SEQ ID NO: 920566 - DNA, 25 bp, Mus musculus
ttacgcctcctctaatgctgctgag

SEQ ID NO: 920567 - DNA, 25 bp, Mus musculus
ttacgcctgactccgtgggaggaaa

SEQ ID NO: 920568 - DNA, 25 bp, Mus musculus
ttacgcctgactgcgtgggaggaaa

SEQ ID NO: 920569 - DNA, 25 bp, Mus musculus
ttacgcctgtccactcagaattgta

SEQ ID NO: 920570 - DNA, 25 bp, Mus musculus
ttacgcctgtcctctcagaattgta

SEQ ID NO: 920571 - DNA, 25 bp, Mus musculus
ttacgcctttgacacgcagtgtgca

SEQ ID NO: 920572 - DNA, 25 bp, Mus musculus
ttacgcctttgagacgcagtgtgca

SEQ ID NO: 920573 - DNA, 25 bp, Mus musculus
ttacgcggcggacaaacttctctca

SEQ ID NO: 920574 - DNA, 25 bp, Mus musculus
ttacgcggcggagaaacttctctca

SEQ ID NO: 920575 - DNA, 25 bp, Mus musculus
ttacgcggtggactcttaaaactat

SEQ ID NO: 920576 - DNA, 25 bp, Mus musculus
ttacgcggtggagtcttaaaactat

SEQ ID NO: 920577 - DNA, 25 bp, Mus musculus
ttacgctcaccaaaagccgcagatg

SEQ ID NO: 920578 - DNA, 25 bp, Mus musculus
ttacgctcaccataagccgcagatg

SEQ ID NO: 920579 - DNA, 25 bp, Mus musculus
ttacgctctcttagttaagcacaga

SEQ ID NO: 920580 - DNA, 25 bp, Mus musculus
ttacgctctctttgttaagcacaga

SEQ ID NO: 920581 - DNA, 25 bp, Mus musculus
ttacgctggacaaaggctcacctat

SEQ ID NO: 920582 - DNA, 25 bp, Mus musculus
ttacgctggacataggctcacctat

SEQ ID NO: 920583 - DNA, 25 bp, Mus musculus
ttacgctggctacttttctatgaat

SEQ ID NO: 920584 - DNA, 25 bp, Mus musculus
ttacgctggctagttttctatgaat

SEQ ID NO: 920585 - DNA, 25 bp, Mus musculus
ttacgctggctgaacacgggcaagt

SEQ ID NO: 920586 - DNA, 25 bp, Mus musculus
ttacgctggctgtacacgggcaagt

SEQ ID NO: 920587 - DNA, 25 bp, Mus musculus
ttacgctgggcactacgtcggtgac

SEQ ID NO: 920588 - DNA, 25 bp, Mus musculus
ttacgctgggcagtacgtcggtgac

SEQ ID NO: 920589 - DNA, 25 bp, Mus musculus
ttacgcttaattcacggagtgctaa

SEQ ID NO: 920590 - DNA, 25 bp, Mus musculus
ttacgcttaattgacggagtgctaa

SEQ ID NO: 920591 - DNA, 25 bp, Mus musculus
ttacgcttcgtactttgatgtccca

SEQ ID NO: 920592 - DNA, 25 bp, Mus musculus
ttacgcttcgtagtttgatgtccca

SEQ ID NO: 920593 - DNA, 25 bp, Mus musculus
ttacgctttatcatccgtctggtat

SEQ ID NO: 920594 - DNA, 25 bp, Mus musculus
ttacgctttatcttccgtctggtat

SEQ ID NO: 920595 - DNA, 25 bp, Mus musculus
ttacggaatcgtacacagggacttg

SEQ ID NO: 920596 - DNA, 25 bp, Mus musculus
ttacggaatcgttcacagggacttg

SEQ ID NO: 920597 - DNA, 25 bp, Mus musculus
ttacggacatgaaccaccaagcttg

SEQ ID NO: 920598 - DNA, 25 bp, Mus musculus
ttacggacatgatccaccaagcttg

SEQ ID NO: 920599 - DNA, 25 bp, Mus musculus
ttacggaccaggagaattcagagct

SEQ ID NO: 920600 - DNA, 25 bp, Mus musculus
ttacggaccaggtgaattcagagct

SEQ ID NO: 920601 - DNA, 25 bp, Mus musculus
ttacggacccggcagcactagctgt

SEQ ID NO: 920602 - DNA, 25 bp, Mus musculus
ttacggacccgggagcactagctgt

SEQ ID NO: 920603 - DNA, 25 bp, Mus musculus
ttacggagagctattctggatcaat

SEQ ID NO: 920604 - DNA, 25 bp, Mus musculus
ttacggagagcttttctggatcaat

SEQ ID NO: 920605 - DNA, 25 bp, Mus musculus
ttacggagcatacgcagaactgcac

SEQ ID NO: 920606 - DNA, 25 bp, Mus musculus
ttacggagcataggcagaactgcac

SEQ ID NO: 920607 - DNA, 25 bp, Mus musculus
ttacggaggagtaggcatttgcaca

SEQ ID NO: 920608 - DNA, 25 bp, Mus musculus
ttacggaggagttggcatttgcaca

SEQ ID NO: 920609 - DNA, 25 bp, Mus musculus
ttacggaggttacatgcttccagga

SEQ ID NO: 920610 - DNA, 25 bp, Mus musculus
ttacggaggttagatgcttccagga

SEQ ID NO: 920611 - DNA, 25 bp, Mus musculus
ttacggagtcctctttagtttggca

SEQ ID NO: 920612 - DNA, 25 bp, Mus musculus
ttacggagtcctgtttagtttggca

SEQ ID NO: 920613 - DNA, 25 bp, Mus musculus
ttacggagtcggagtactcaatcat

SEQ ID NO: 920614 - DNA, 25 bp, Mus musculus
ttacggagtcggtgtactcaatcat

SEQ ID NO: 920615 - DNA, 25 bp, Mus musculus
ttacggataataagacgtgctttta

SEQ ID NO: 920616 - DNA, 25 bp, Mus musculus
ttacggataatatgacgtgctttta

SEQ ID NO: 920617 - DNA, 25 bp, Mus musculus
ttacggatgatgctgtttaggacaa

SEQ ID NO: 920618 - DNA, 25 bp, Mus musculus
ttacggatgatggtgtttaggacaa

SEQ ID NO: 920619 - DNA, 25 bp, Mus musculus
ttacggattcggaagccccttggtg

SEQ ID NO: 920620 - DNA, 25 bp, Mus musculus
ttacggattcggtagccccttggtg

SEQ ID NO: 920621 - DNA, 25 bp, Mus musculus
ttacggcacaaaacactgtgggaaa

SEQ ID NO: 920622 - DNA, 25 bp, Mus musculus
ttacggcacaaatcactgtgggaaa

SEQ ID NO: 920623 - DNA, 25 bp, Mus musculus
ttacggcaggataagcttcttgaac

SEQ ID NO: 920624 - DNA, 25 bp, Mus musculus
ttacggcaggattagcttcttgaac

SEQ ID NO: 920625 - DNA, 25 bp, Mus musculus
ttacggcagtctctgtcaaggtggt

SEQ ID NO: 920626 - DNA, 25 bp, Mus musculus
ttacggcagtctgtgtcaaggtggt

SEQ ID NO: 920627 - DNA, 25 bp, Mus musculus
ttacggcccaccagggtatgtaaat

SEQ ID NO: 920628 - DNA, 25 bp, Mus musculus
ttacggcccacctgggtatgtaaat

SEQ ID NO: 920629 - DNA, 25 bp, Mus musculus
ttacggcctcccagcagtttgtgat

SEQ ID NO: 920630 - DNA, 25 bp, Mus musculus
ttacggcctccctgcagtttgtgat

SEQ ID NO: 920631 - DNA, 25 bp, Mus musculus
ttacggcctggcagtgttgaggcta

SEQ ID NO: 920632 - DNA, 25 bp, Mus musculus
ttacggcctggctgtgttgaggcta

SEQ ID NO: 920633 - DNA, 25 bp, Mus musculus
ttacggcctttgacggtgaggagca

SEQ ID NO: 920634 - DNA, 25 bp, Mus musculus
ttacggcctttgtcggtgaggagca

SEQ ID NO: 920635 - DNA, 25 bp, Mus musculus
ttacggcgtggtacatactgcaggg

SEQ ID NO: 920636 - DNA, 25 bp, Mus musculus
ttacggcgtggttcatactgcaggg

SEQ ID NO: 920637 - DNA, 25 bp, Mus musculus
ttacggctttagacgcgctcttgac

SEQ ID NO: 920638 - DNA, 25 bp, Mus musculus
ttacggctttagtcgcgctcttgac

SEQ ID NO: 920639 - DNA, 25 bp, Mus musculus
ttacgggactgtaccaactcagata

SEQ ID NO: 920640 - DNA, 25 bp, Mus musculus
ttacgggactgttccaactcagata

SEQ ID NO: 920641 - DNA, 25 bp, Mus musculus
ttacgggagcagcattcacagacag

SEQ ID NO: 920642 - DNA, 25 bp, Mus musculus
ttacgggagcaggattcacagacag

SEQ ID NO: 920643 - DNA, 25 bp, Mus musculus
ttacgggtctgaaccactccattaa

SEQ ID NO: 920644 - DNA, 25 bp, Mus musculus
ttacgggtctgatccactccattaa

SEQ ID NO: 920645 - DNA, 25 bp, Mus musculus
ttacgggttccaaggcacctttgtg

SEQ ID NO: 920646 - DNA, 25 bp, Mus musculus
ttacgggttccatggcacctttgtg

SEQ ID NO: 920647 - DNA, 25 bp, Mus musculus
ttacggtagccaaaacaagcccctg

SEQ ID NO: 920648 - DNA, 25 bp, Mus musculus
ttacggtagccataacaagcccctg

SEQ ID NO: 920649 - DNA, 25 bp, Mus musculus
ttacggtagcctattcctatccact

SEQ ID NO: 920650 - DNA, 25 bp, Mus musculus
ttacggtagccttttcctatccact

SEQ ID NO: 920651 - DNA, 25 bp, Mus musculus
ttacggtagtggaattagcctttat

SEQ ID NO: 920652 - DNA, 25 bp, Mus musculus
ttacggtagtggtattagcctttat

SEQ ID NO: 920653 - DNA, 25 bp, Mus musculus
ttacggtccatcattcagataactg

SEQ ID NO: 920654 - DNA, 25 bp, Mus musculus
ttacggtccatctttcagataactg

SEQ ID NO: 920655 - DNA, 25 bp, Mus musculus
ttacggttacatcccttatacttca

SEQ ID NO: 920656 - DNA, 25 bp, Mus musculus
ttacggttacatgccttatacttca

SEQ ID NO: 920657 - DNA, 25 bp, Mus musculus
ttacggtttaccctggtaggatgct

SEQ ID NO: 920658 - DNA, 25 bp, Mus musculus
ttacggtttaccgtggtaggatgct

SEQ ID NO: 920659 - DNA, 25 bp, Mus musculus
ttacggttttcaataggccccatca

SEQ ID NO: 920660 - DNA, 25 bp, Mus musculus
ttacggttttcattaggccccatca

SEQ ID NO: 920661 - DNA, 25 bp, Mus musculus
ttacgtaagattccagttacctcat

SEQ ID NO: 920662 - DNA, 25 bp, Mus musculus
ttacgtaagattgcagttacctcat

SEQ ID NO: 920663 - DNA, 25 bp, Mus musculus
ttacgtaaggttccattataggagc

SEQ ID NO: 920664 - DNA, 25 bp, Mus musculus
ttacgtaaggttgcattataggagc

SEQ ID NO: 920665 - DNA, 25 bp, Mus musculus
ttacgtacactgataccaggacaaa

SEQ ID NO: 920666 - DNA, 25 bp, Mus musculus
ttacgtacactgttaccaggacaaa

SEQ ID NO: 920667 - DNA, 25 bp, Mus musculus
ttacgtacttccctgatatgccggg

SEQ ID NO: 920668 - DNA, 25 bp, Mus musculus
ttacgtacttccgtgatatgccggg

SEQ ID NO: 920669 - DNA, 25 bp, Mus musculus
ttacgtagtatgctgaccctgggac

SEQ ID NO: 920670 - DNA, 25 bp, Mus musculus
ttacgtagtatggtgaccctgggac

SEQ ID NO: 920671 - DNA, 25 bp, Mus musculus
ttacgtatcaccagtctgtgtcacc

SEQ ID NO: 920672 - DNA, 25 bp, Mus musculus
ttacgtatcacctgtctgtgtcacc

SEQ ID NO: 920673 - DNA, 25 bp, Mus musculus
ttacgtatttctcgttctcaattcc

SEQ ID NO: 920674 - DNA, 25 bp, Mus musculus
ttacgtatttctggttctcaattcc

SEQ ID NO: 920675 - DNA, 25 bp, Mus musculus
ttacgtcaccagcacttgaagccaa

SEQ ID NO: 920676 - DNA, 25 bp, Mus musculus
ttacgtcaccaggacttgaagccaa

SEQ ID NO: 920677 - DNA, 25 bp, Mus musculus
ttacgtcatgacactgcacttgcag

SEQ ID NO: 920678 - DNA, 25 bp, Mus musculus
ttacgtcatgactctgcacttgcag

SEQ ID NO: 920679 - DNA, 25 bp, Mus musculus
ttacgtcctctcagtttagagtctt

SEQ ID NO: 920680 - DNA, 25 bp, Mus musculus
ttacgtcctctctgtttagagtctt

SEQ ID NO: 920681 - DNA, 25 bp, Mus musculus
ttacgtcctcttcaaaaagccgaag

SEQ ID NO: 920682 - DNA, 25 bp, Mus musculus
ttacgtcctcttgaaaaagccgaag

SEQ ID NO: 920683 - DNA, 25 bp, Mus musculus
ttacgtcgggtacctgctgtggcac

SEQ ID NO: 920684 - DNA, 25 bp, Mus musculus
ttacgtcgggtagctgctgtggcac

SEQ ID NO: 920685 - DNA, 25 bp, Mus musculus
ttacgtctcttcattcccttattga

SEQ ID NO: 920686 - DNA, 25 bp, Mus musculus
ttacgtctcttctttcccttattga

SEQ ID NO: 920687 - DNA, 25 bp, Mus musculus
ttacgtctgaagagacaccctctct

SEQ ID NO: 920688 - DNA, 25 bp, Mus musculus
ttacgtctgaagtgacaccctctct

SEQ ID NO: 920689 - DNA, 25 bp, Mus musculus
ttacgtctgttgagcctgtatggca

SEQ ID NO: 920690 - DNA, 25 bp, Mus musculus
ttacgtctgttgtgcctgtatggca

SEQ ID NO: 920691 - DNA, 25 bp, Mus musculus
ttacgtcttaaaagaagcctccact

SEQ ID NO: 920692 - DNA, 25 bp, Mus musculus
ttacgtcttaaatgaagcctccact

SEQ ID NO: 920693 - DNA, 25 bp, Mus musculus
ttacgtctttaaccaatttctacag

SEQ ID NO: 920694 - DNA, 25 bp, Mus musculus
ttacgtctttaagcaatttctacag

SEQ ID NO: 920695 - DNA, 25 bp, Mus musculus
ttacgtgaccccaggcttgttggac

SEQ ID NO: 920696 - DNA, 25 bp, Mus musculus
ttacgtgacccctggcttgttggac

SEQ ID NO: 920697 - DNA, 25 bp, Mus musculus
ttacgtgcaatcatattccttgtcc

SEQ ID NO: 920698 - DNA, 25 bp, Mus musculus
ttacgtgcaatcttattccttgtcc

SEQ ID NO: 920699 - DNA, 25 bp, Mus musculus
ttacgtgcagggactcacataggcc

SEQ ID NO: 920700 - DNA, 25 bp, Mus musculus
ttacgtgcagggtctcacataggcc

SEQ ID NO: 920701 - DNA, 25 bp, Mus musculus
ttacgtgccagtcaatgtgtgcaga

SEQ ID NO: 920702 - DNA, 25 bp, Mus musculus
ttacgtgccagtgaatgtgtgcaga

SEQ ID NO: 920703 - DNA, 25 bp, Mus musculus
ttacgtgctctaagagaccgtggca

SEQ ID NO: 920704 - DNA, 25 bp, Mus musculus
ttacgtgctctatgagaccgtggca

SEQ ID NO: 920705 - DNA, 25 bp, Mus musculus
ttacgtggcaaacttttctgtgttt

SEQ ID NO: 920706 - DNA, 25 bp, Mus musculus
ttacgtggcaaagttttctgtgttt

SEQ ID NO: 920707 - DNA, 25 bp, Mus musculus
ttacgtggcttccaatttctgatct

SEQ ID NO: 920708 - DNA, 25 bp, Mus musculus
ttacgtggcttcgaatttctgatct

SEQ ID NO: 920709 - DNA, 25 bp, Mus musculus
ttacgtgggtatctctgcgcagtgt

SEQ ID NO: 920710 - DNA, 25 bp, Mus musculus
ttacgtgggtatgtctgcgcagtgt

SEQ ID NO: 920711 - DNA, 25 bp, Mus musculus
ttacgtgtaaggcaagctgaagttt

SEQ ID NO: 920712 - DNA, 25 bp, Mus musculus
ttacgtgtaagggaagctgaagttt

SEQ ID NO: 920713 - DNA, 25 bp, Mus musculus
ttacgtgtacagacaactatcggct

SEQ ID NO: 920714 - DNA, 25 bp, Mus musculus
ttacgtgtacagtcaactatcggct

SEQ ID NO: 920715 - DNA, 25 bp, Mus musculus
ttacgtgtgcctatcattcataatg

SEQ ID NO: 920716 - DNA, 25 bp, Mus musculus
ttacgtgtgcctttcattcataatg

SEQ ID NO: 920717 - DNA, 25 bp, Mus musculus
ttacgttacactaatacaccctctt

SEQ ID NO: 920718 - DNA, 25 bp, Mus musculus
ttacgttacacttatacaccctctt

SEQ ID NO: 920719 - DNA, 25 bp, Mus musculus
ttacgttcagacaccgtagctctgt

SEQ ID NO: 920720 - DNA, 25 bp, Mus musculus
ttacgttcagactccgtagctctgt

SEQ ID NO: 920721 - DNA, 25 bp, Mus musculus
ttacgttcatagactaccagccata

SEQ ID NO: 920722 - DNA, 25 bp, Mus musculus
ttacgttcatagtctaccagccata

SEQ ID NO: 920723 - DNA, 25 bp, Mus musculus
ttacgttccaagattcgagacaaat

SEQ ID NO: 920724 - DNA, 25 bp, Mus musculus
ttacgttccaagtttcgagacaaat

SEQ ID NO: 920725 - DNA, 25 bp, Mus musculus
ttacgttcccatccctcttaaaagg

SEQ ID NO: 920726 - DNA, 25 bp, Mus musculus
ttacgttcccatgcctcttaaaagg

SEQ ID NO: 920727 - DNA, 25 bp, Mus musculus
ttacgttctacccaaatctctacta

SEQ ID NO: 920728 - DNA, 25 bp, Mus musculus
ttacgttctaccgaaatctctacta

SEQ ID NO: 920729 - DNA, 25 bp, Mus musculus
ttacgttctagaaaagagcctacgc

SEQ ID NO: 920730 - DNA, 25 bp, Mus musculus
ttacgttctagataagagcctacgc

SEQ ID NO: 920731 - DNA, 25 bp, Mus musculus
ttacgttcttctacgtgtcctacaa

SEQ ID NO: 920732 - DNA, 25 bp, Mus musculus
ttacgttcttcttcgtgtcctacaa

SEQ ID NO: 920733 - DNA, 25 bp, Mus musculus
ttacgttgatagacagccccactgg

SEQ ID NO: 920734 - DNA, 25 bp, Mus musculus
ttacgttgatagtcagccccactgg

SEQ ID NO: 920735 - DNA, 25 bp, Mus musculus
ttacgttgccgaaacaagccatcgc

SEQ ID NO: 920736 - DNA, 25 bp, Mus musculus
ttacgttgccgatacaagccatcgc

SEQ ID NO: 920737 - DNA, 25 bp, Mus musculus
ttacgttgtcttaattctctgccgg

SEQ ID NO: 920738 - DNA, 25 bp, Mus musculus
ttacgttgtctttattctctgccgg

SEQ ID NO: 920739 - DNA, 25 bp, Mus musculus
ttacgtttatgcatccaccctggat

SEQ ID NO: 920740 - DNA, 25 bp, Mus musculus
ttacgtttatgcttccaccctggat

SEQ ID NO: 920741 - DNA, 25 bp, Mus musculus
ttacgtttctacatctcaccgttgg

SEQ ID NO: 920742 - DNA, 25 bp, Mus musculus
ttacgtttctacttctcaccgttgg

SEQ ID NO: 920743 - DNA, 25 bp, Mus musculus
ttacgtttggacatcacctcttcag

SEQ ID NO: 920744 - DNA, 25 bp, Mus musculus
ttacgtttggacttcacctcttcag

SEQ ID NO: 920745 - DNA, 25 bp, Mus musculus
ttacgttttcttccaggcacgtgtg

SEQ ID NO: 920746 - DNA, 25 bp, Mus musculus
ttacgttttcttgcaggcacgtgtg

SEQ ID NO: 920747 - DNA, 25 bp, Mus musculus
ttactaaaatcacagctcacaccca

SEQ ID NO: 920748 - DNA, 25 bp, Mus musculus
ttactaaaatcagagctcacaccca

SEQ ID NO: 920749 - DNA, 25 bp, Mus musculus
ttactaaaatccagggcaccccaga

SEQ ID NO: 920750 - DNA, 25 bp, Mus musculus
ttactaaaatcctgggcaccccaga

SEQ ID NO: 920751 - DNA, 25 bp, Mus musculus
ttactaaactcgcatttgtctgcaa

SEQ ID NO: 920752 - DNA, 25 bp, Mus musculus
ttactaaactcggatttgtctgcaa

SEQ ID NO: 920753 - DNA, 25 bp, Mus musculus
ttactaacatcaagctagagagcca

SEQ ID NO: 920754 - DNA, 25 bp, Mus musculus
ttactaacatcatgctagagagcca

SEQ ID NO: 920755 - DNA, 25 bp, Mus musculus
ttactaactcttagtatcgatgcct

SEQ ID NO: 920756 - DNA, 25 bp, Mus musculus
ttactaactctttgtatcgatgcct

SEQ ID NO: 920757 - DNA, 25 bp, Mus musculus
ttactaactggcagctttcacagaa

SEQ ID NO: 920758 - DNA, 25 bp, Mus musculus
ttactaactggctgctttcacagaa

SEQ ID NO: 920759 - DNA, 25 bp, Mus musculus
ttactaacttgactggttttactgc

SEQ ID NO: 920760 - DNA, 25 bp, Mus musculus
ttactaacttgagtggttttactgc

SEQ ID NO: 920761 - DNA, 25 bp, Mus musculus
ttactaagatgcacggacagcgtca

SEQ ID NO: 920762 - DNA, 25 bp, Mus musculus
ttactaagatgctcggacagcgtca

SEQ ID NO: 920763 - DNA, 25 bp, Mus musculus
ttactaaggaaactgcaggctcaag

SEQ ID NO: 920764 - DNA, 25 bp, Mus musculus
ttactaaggaaagtgcaggctcaag

SEQ ID NO: 920765 - DNA, 25 bp, Mus musculus
ttactaaggcttacaatcagatttt

SEQ ID NO: 920766 - DNA, 25 bp, Mus musculus
ttactaaggctttcaatcagatttt

SEQ ID NO: 920767 - DNA, 25 bp, Mus musculus
ttactaatacaaaaacatccaccat

SEQ ID NO: 920768 - DNA, 25 bp, Mus musculus
ttactaatacaataacatccaccat

SEQ ID NO: 920769 - DNA, 25 bp, Mus musculus
ttactaatatgtccagggccccagg

SEQ ID NO: 920770 - DNA, 25 bp, Mus musculus
ttactaatatgtgcagggccccagg

SEQ ID NO: 920771 - DNA, 25 bp, Mus musculus
ttactaatgcagactacaccacagg

SEQ ID NO: 920772 - DNA, 25 bp, Mus musculus
ttactaatgcagtctacaccacagg

SEQ ID NO: 920773 - DNA, 25 bp, Mus musculus
ttactaatgtcccatgcagcatctc

SEQ ID NO: 920774 - DNA, 25 bp, Mus musculus
ttactaatgtccgatgcagcatctc

SEQ ID NO: 920775 - DNA, 25 bp, Mus musculus
ttactaatgtgtaccccaaacctgg

SEQ ID NO: 920776 - DNA, 25 bp, Mus musculus
ttactaatgtgttccccaaacctgg

SEQ ID NO: 920777 - DNA, 25 bp, Mus musculus
ttactaattcccctggagactccag

SEQ ID NO: 920778 - DNA, 25 bp, Mus musculus
ttactaattcccgtggagactccag

SEQ ID NO: 920779 - DNA, 25 bp, Mus musculus
ttactacaaaccacccagtccaagt

SEQ ID NO: 920780 - DNA, 25 bp, Mus musculus
ttactacaaacctcccagtccaagt

SEQ ID NO: 920781 - DNA, 25 bp, Mus musculus
ttactacacactacaggtgcccttg

SEQ ID NO: 920782 - DNA, 25 bp, Mus musculus
ttactacacacttcaggtgcccttg

SEQ ID NO: 920783 - DNA, 25 bp, Mus musculus
ttactacactagagccctgatgatc

SEQ ID NO: 920784 - DNA, 25 bp, Mus musculus
ttactacactagtgccctgatgatc

SEQ ID NO: 920785 - DNA, 25 bp, Mus musculus
ttactacagcgtagcccaagtgggc

SEQ ID NO: 920786 - DNA, 25 bp, Mus musculus
ttactacagcgttgcccaagtgggc

SEQ ID NO: 920787 - DNA, 25 bp, Mus musculus
ttactacagtatcgctggtcttggc

SEQ ID NO: 920788 - DNA, 25 bp, Mus musculus
ttactacagtatggctggtcttggc

SEQ ID NO: 920789 - DNA, 25 bp, Mus musculus
ttactacatagcaaaccctggctgg

SEQ ID NO: 920790 - DNA, 25 bp, Mus musculus
ttactacatagctaaccctggctgg

SEQ ID NO: 920791 - DNA, 25 bp, Mus musculus
ttactacatcgacgacgttttccac

SEQ ID NO: 920792 - DNA, 25 bp, Mus musculus
ttactacatcgaggacgttttccac

SEQ ID NO: 920793 - DNA, 25 bp, Mus musculus
ttactacatgtgcaattcttagagc

SEQ ID NO: 920794 - DNA, 25 bp, Mus musculus
ttactacatgtggaattcttagagc

SEQ ID NO: 920795 - DNA, 25 bp, Mus musculus
ttactacatttgattcccctgtggc

SEQ ID NO: 920796 - DNA, 25 bp, Mus musculus
ttactacatttgtttcccctgtggc

SEQ ID NO: 920797 - DNA, 25 bp, Mus musculus
ttactaccaggtacagtgtcaggat

SEQ ID NO: 920798 - DNA, 25 bp, Mus musculus
ttactaccaggttcagtgtcaggat

SEQ ID NO: 920799 - DNA, 25 bp, Mus musculus
ttactaccatctattctactcggca

SEQ ID NO: 920800 - DNA, 25 bp, Mus musculus
ttactaccatcttttctactcggca

SEQ ID NO: 920801 - DNA, 25 bp, Mus musculus
ttactaccccagctgttgattaaga

SEQ ID NO: 920802 - DNA, 25 bp, Mus musculus
ttactaccccaggtgttgattaaga

SEQ ID NO: 920803 - DNA, 25 bp, Mus musculus
ttactacctgaaccgcgctggcttt

SEQ ID NO: 920804 - DNA, 25 bp, Mus musculus
ttactacctgaagcgcgctggcttt

SEQ ID NO: 920805 - DNA, 25 bp, Mus musculus
ttactacctgccactggtgcggaag

SEQ ID NO: 920806 - DNA, 25 bp, Mus musculus
ttactacctgcctctggtgcggaag

SEQ ID NO: 920807 - DNA, 25 bp, Mus musculus
ttactaccttatcctcagctgtggg

SEQ ID NO: 920808 - DNA, 25 bp, Mus musculus
ttactaccttatgctcagctgtggg

SEQ ID NO: 920809 - DNA, 25 bp, Mus musculus
ttactacgagacacacaatgtgaaa

SEQ ID NO: 920810 - DNA, 25 bp, Mus musculus
ttactacgagactcacaatgtgaaa

SEQ ID NO: 920811 - DNA, 25 bp, Mus musculus
ttactacgcatacacagctgctgtg

SEQ ID NO: 920812 - DNA, 25 bp, Mus musculus
ttactacgcatagacagctgctgtg

SEQ ID NO: 920813 - DNA, 25 bp, Mus musculus
ttactacggcccctgacagaaaaca

SEQ ID NO: 920814 - DNA, 25 bp, Mus musculus
ttactacggcccgtgacagaaaaca

SEQ ID NO: 920815 - DNA, 25 bp, Mus musculus
ttactactaaagcaaggaacccata

SEQ ID NO: 920816 - DNA, 25 bp, Mus musculus
ttactactaaaggaaggaacccata

SEQ ID NO: 920817 - DNA, 25 bp, Mus musculus
ttactactcaacaactggatgcctt

SEQ ID NO: 920818 - DNA, 25 bp, Mus musculus
ttactactcaactactggatgcctt

SEQ ID NO: 920819 - DNA, 25 bp, Mus musculus
ttactactctagagcaaggctgtgg

SEQ ID NO: 920820 - DNA, 25 bp, Mus musculus
ttactactctagtgcaaggctgtgg

SEQ ID NO: 920821 - DNA, 25 bp, Mus musculus
ttactactgcagacagcgtgtgtaa

SEQ ID NO: 920822 - DNA, 25 bp, Mus musculus
ttactactgcagtcagcgtgtgtaa

SEQ ID NO: 920823 - DNA, 25 bp, Mus musculus
ttactactggttcttgggcaggcga

SEQ ID NO: 920824 - DNA, 25 bp, Mus musculus
ttactactggttgttgggcaggcga

SEQ ID NO: 920825 - DNA, 25 bp, Mus musculus
ttactactgttccttaatggcacca

SEQ ID NO: 920826 - DNA, 25 bp, Mus musculus
ttactactgttcgttaatggcacca

SEQ ID NO: 920827 - DNA, 25 bp, Mus musculus
ttactacttatcaaaacctccctgc

SEQ ID NO: 920828 - DNA, 25 bp, Mus musculus
ttactacttatctaaacctccctgc

SEQ ID NO: 920829 - DNA, 25 bp, Mus musculus
ttactacttgacataatacacagca

SEQ ID NO: 920830 - DNA, 25 bp, Mus musculus
ttactacttgacttaatacacagca

SEQ ID NO: 920831 - DNA, 25 bp, Mus musculus
ttactagagcttcatgcacagtcat

SEQ ID NO: 920832 - DNA, 25 bp, Mus musculus
ttactagagcttgatgcacagtcat

SEQ ID NO: 920833 - DNA, 25 bp, Mus musculus
ttactagcactaatcctcagagggc

SEQ ID NO: 920834 - DNA, 25 bp, Mus musculus
ttactagcactattcctcagagggc

SEQ ID NO: 920835 - DNA, 25 bp, Mus musculus
ttactagcatatacggatccttgga

SEQ ID NO: 920836 - DNA, 25 bp, Mus musculus
ttactagcatattcggatccttgga

SEQ ID NO: 920837 - DNA, 25 bp, Mus musculus
ttactagccgttccttattctatgc

SEQ ID NO: 920838 - DNA, 25 bp, Mus musculus
ttactagccgttgcttattctatgc

SEQ ID NO: 920839 - DNA, 25 bp, Mus musculus
ttactagcgaccatctgtgagacat

SEQ ID NO: 920840 - DNA, 25 bp, Mus musculus
ttactagcgaccttctgtgagacat

SEQ ID NO: 920841 - DNA, 25 bp, Mus musculus
ttactaggctatctccccaaaggag

SEQ ID NO: 920842 - DNA, 25 bp, Mus musculus
ttactaggctatgtccccaaaggag

SEQ ID NO: 920843 - DNA, 25 bp, Mus musculus
ttactagggagaaatgatgaacatt

SEQ ID NO: 920844 - DNA, 25 bp, Mus musculus
ttactagggagatatgatgaacatt

SEQ ID NO: 920845 - DNA, 25 bp, Mus musculus
ttactagggctacttctggaagcca

SEQ ID NO: 920846 - DNA, 25 bp, Mus musculus
ttactagggctagttctggaagcca

SEQ ID NO: 920847 - DNA, 25 bp, Mus musculus
ttactagtgctcagtcttaagactc

SEQ ID NO: 920848 - DNA, 25 bp, Mus musculus
ttactagtgctctgtcttaagactc

SEQ ID NO: 920849 - DNA, 25 bp, Mus musculus
ttactataccctaatgtctgtgtct

SEQ ID NO: 920850 - DNA, 25 bp, Mus musculus
ttactatacccttatgtctgtgtct

SEQ ID NO: 920851 - DNA, 25 bp, Mus musculus
ttactatactcgcatggggatgtta

SEQ ID NO: 920852 - DNA, 25 bp, Mus musculus
ttactatactcggatggggatgtta

SEQ ID NO: 920853 - DNA, 25 bp, Mus musculus
ttactatactctaatccaggcaaca

SEQ ID NO: 920854 - DNA, 25 bp, Mus musculus
ttactatactcttatccaggcaaca

SEQ ID NO: 920855 - DNA, 25 bp, Mus musculus
ttactatctgttacggtcaggtcag

SEQ ID NO: 920856 - DNA, 25 bp, Mus musculus
ttactatctgtttcggtcaggtcag

SEQ ID NO: 920857 - DNA, 25 bp, Mus musculus
ttactatcttgacaggtgcccacac

SEQ ID NO: 920858 - DNA, 25 bp, Mus musculus
ttactatcttgagaggtgcccacac

SEQ ID NO: 920859 - DNA, 25 bp, Mus musculus
ttactatgccgccaaatctctgaag

SEQ ID NO: 920860 - DNA, 25 bp, Mus musculus
ttactatgccgcgaaatctctgaag

SEQ ID NO: 920861 - DNA, 25 bp, Mus musculus
ttactatgtaaacggcttcctaagc

SEQ ID NO: 920862 - DNA, 25 bp, Mus musculus
ttactatgtaaagggcttcctaagc

SEQ ID NO: 920863 - DNA, 25 bp, Mus musculus
ttactatgtgtgcattttacaactt

SEQ ID NO: 920864 - DNA, 25 bp, Mus musculus
ttactatgtgtggattttacaactt

SEQ ID NO: 920865 - DNA, 25 bp, Mus musculus
ttactattccatcaaaggccttaag

SEQ ID NO: 920866 - DNA, 25 bp, Mus musculus
ttactattccatgaaaggccttaag

SEQ ID NO: 920867 - DNA, 25 bp, Mus musculus
ttactattcccaaaagtgacccctc

SEQ ID NO: 920868 - DNA, 25 bp, Mus musculus
ttactattcccataagtgacccctc

SEQ ID NO: 920869 - DNA, 25 bp, Mus musculus
ttactattgccacccgcaggcatga

SEQ ID NO: 920870 - DNA, 25 bp, Mus musculus
ttactattgccagccgcaggcatga

SEQ ID NO: 920871 - DNA, 25 bp, Mus musculus
ttactattgggcatttccgagcaag

SEQ ID NO: 920872 - DNA, 25 bp, Mus musculus
ttactattgggcttttccgagcaag

SEQ ID NO: 920873 - DNA, 25 bp, Mus musculus
ttactatttcttcctcaatcggaat

SEQ ID NO: 920874 - DNA, 25 bp, Mus musculus
ttactatttcttgctcaatcggaat

SEQ ID NO: 920875 - DNA, 25 bp, Mus musculus
ttactcaatggcagtccggattgct

SEQ ID NO: 920876 - DNA, 25 bp, Mus musculus
ttactcaatggctgtccggattgct

SEQ ID NO: 920877 - DNA, 25 bp, Mus musculus
ttactcacagttctttccacaggga

SEQ ID NO: 920878 - DNA, 25 bp, Mus musculus
ttactcacagttgtttccacaggga

SEQ ID NO: 920879 - DNA, 25 bp, Mus musculus
ttactcacatgactgcttacgcttt

SEQ ID NO: 920880 - DNA, 25 bp, Mus musculus
ttactcacatgagtgcttacgcttt

SEQ ID NO: 920881 - DNA, 25 bp, Mus musculus
ttactcacatttctttcctgcaata

SEQ ID NO: 920882 - DNA, 25 bp, Mus musculus
ttactcacatttgtttcctgcaata

SEQ ID NO: 920883 - DNA, 25 bp, Mus musculus
ttactcaccattccgtaatctcctt

SEQ ID NO: 920884 - DNA, 25 bp, Mus musculus
ttactcaccattgcgtaatctcctt

SEQ ID NO: 920885 - DNA, 25 bp, Mus musculus
ttactcacctccctgaggtctagat

SEQ ID NO: 920886 - DNA, 25 bp, Mus musculus
ttactcacctccgtgaggtctagat

SEQ ID NO: 920887 - DNA, 25 bp, Mus musculus
ttactcacctggatgggcttgttaa

SEQ ID NO: 920888 - DNA, 25 bp, Mus musculus
ttactcacctggttgggcttgttaa

SEQ ID NO: 920889 - DNA, 25 bp, Mus musculus
ttactcactaccacatgctttcata

SEQ ID NO: 920890 - DNA, 25 bp, Mus musculus
ttactcactacctcatgctttcata

SEQ ID NO: 920891 - DNA, 25 bp, Mus musculus
ttactcactgtgcaaccgtcttggg

SEQ ID NO: 920892 - DNA, 25 bp, Mus musculus
ttactcactgtgcttcatcaaataa

SEQ ID NO: 920893 - DNA, 25 bp, Mus musculus
ttactcactgtggaaccgtcttggg

SEQ ID NO: 920894 - DNA, 25 bp, Mus musculus
ttactcactgtggttcatcaaataa

SEQ ID NO: 920895 - DNA, 25 bp, Mus musculus
ttactcacttggaattctttttcca

SEQ ID NO: 920896 - DNA, 25 bp, Mus musculus
ttactcacttggtattctttttcca

SEQ ID NO: 920897 - DNA, 25 bp, Mus musculus
ttactcactttaagatggtccgctt

SEQ ID NO: 920898 - DNA, 25 bp, Mus musculus
ttactcactttatgatggtccgctt

SEQ ID NO: 920899 - DNA, 25 bp, Mus musculus
ttactcagaggtacctgggccagga

SEQ ID NO: 920900 - DNA, 25 bp, Mus musculus
ttactcagaggttcctgggccagga

SEQ ID NO: 920901 - DNA, 25 bp, Mus musculus
ttactcagccttactgactgctctt

SEQ ID NO: 920902 - DNA, 25 bp, Mus musculus
ttactcagcctttctgactgctctt

SEQ ID NO: 920903 - DNA, 25 bp, Mus musculus
ttactcagtcaactttctcatccct

SEQ ID NO: 920904 - DNA, 25 bp, Mus musculus
ttactcagtcaagtttctcatccct

SEQ ID NO: 920905 - DNA, 25 bp, Mus musculus
ttactcagtgttcaactctaagaga

SEQ ID NO: 920906 - DNA, 25 bp, Mus musculus
ttactcagtgttcaagccttcagaa

SEQ ID NO: 920907 - DNA, 25 bp, Mus musculus
ttactcagtgttcgtctgcgcagca

SEQ ID NO: 920908 - DNA, 25 bp, Mus musculus
ttactcagtgttgaactctaagaga

SEQ ID NO: 920909 - DNA, 25 bp, Mus musculus
ttactcagtgttgaagccttcagaa

SEQ ID NO: 920910 - DNA, 25 bp, Mus musculus
ttactcagtgttggtctgcgcagca

SEQ ID NO: 920911 - DNA, 25 bp, Mus musculus
ttactcatccatccatgtcagttgc

SEQ ID NO: 920912 - DNA, 25 bp, Mus musculus
ttactcatccatgcatgtcagttgc

SEQ ID NO: 920913 - DNA, 25 bp, Mus musculus
ttactcatccccaacactaagatat

SEQ ID NO: 920914 - DNA, 25 bp, Mus musculus
ttactcatcccctacactaagatat

SEQ ID NO: 920915 - DNA, 25 bp, Mus musculus
ttactcatccgtatcatgactgcac

SEQ ID NO: 920916 - DNA, 25 bp, Mus musculus
ttactcatccgtttcatgactgcac

SEQ ID NO: 920917 - DNA, 25 bp, Mus musculus
ttactcatctggattttaggcaaaa

SEQ ID NO: 920918 - DNA, 25 bp, Mus musculus
ttactcatctggtttttaggcaaaa

SEQ ID NO: 920919 - DNA, 25 bp, Mus musculus
ttactcattcctctgtgggccacca

SEQ ID NO: 920920 - DNA, 25 bp, Mus musculus
ttactcattcctgtgtgggccacca

SEQ ID NO: 920921 - DNA, 25 bp, Mus musculus
ttactcattctcagtttttcacttg

SEQ ID NO: 920922 - DNA, 25 bp, Mus musculus
ttactcattctctgtttttcacttg

SEQ ID NO: 920923 - DNA, 25 bp, Mus musculus
ttactcattgacataacgctgctcc

SEQ ID NO: 920924 - DNA, 25 bp, Mus musculus
ttactcattgacttaacgctgctcc

SEQ ID NO: 920925 - DNA, 25 bp, Mus musculus
ttactcattttccaaccatcctttt

SEQ ID NO: 920926 - DNA, 25 bp, Mus musculus
ttactcattttcgaaccatcctttt

SEQ ID NO: 920927 - DNA, 25 bp, Mus musculus
ttactcattttgcagcaggtacagt

SEQ ID NO: 920928 - DNA, 25 bp, Mus musculus
ttactcattttggagcaggtacagt

SEQ ID NO: 920929 - DNA, 25 bp, Mus musculus
ttactccaaccactgcagtattttc

SEQ ID NO: 920930 - DNA, 25 bp, Mus musculus
ttactccaaccagtgcagtattttc

SEQ ID NO: 920931 - DNA, 25 bp, Mus musculus
ttactccaagagaatgctccagtgt

SEQ ID NO: 920932 - DNA, 25 bp, Mus musculus
ttactccaagagtatgctccagtgt

SEQ ID NO: 920933 - DNA, 25 bp, Mus musculus
ttactccacaccaactgaatcctag

SEQ ID NO: 920934 - DNA, 25 bp, Mus musculus
ttactccacacctactgaatcctag

SEQ ID NO: 920935 - DNA, 25 bp, Mus musculus
ttactccacccacatcttttttgag

SEQ ID NO: 920936 - DNA, 25 bp, Mus musculus
ttactccacccagatcttttttgag

SEQ ID NO: 920937 - DNA, 25 bp, Mus musculus
ttactccacttgaaacgcgctgcgt

SEQ ID NO: 920938 - DNA, 25 bp, Mus musculus
ttactccacttgtaacgcgctgcgt

SEQ ID NO: 920939 - DNA, 25 bp, Mus musculus
ttactccagactaagaggacatcat

SEQ ID NO: 920940 - DNA, 25 bp, Mus musculus
ttactccagacttagaggacatcat

SEQ ID NO: 920941 - DNA, 25 bp, Mus musculus
ttactccagcttatgttgtttcttt

SEQ ID NO: 920942 - DNA, 25 bp, Mus musculus
ttactccagcttttgttgtttcttt

SEQ ID NO: 920943 - DNA, 25 bp, Mus musculus
ttactccaggttatccacatcaggg

SEQ ID NO: 920944 - DNA, 25 bp, Mus musculus
ttactccaggttttccacatcaggg

SEQ ID NO: 920945 - DNA, 25 bp, Mus musculus
ttactccatttcaggtgatgttaca

SEQ ID NO: 920946 - DNA, 25 bp, Mus musculus
ttactccatttctggtgatgttaca

SEQ ID NO: 920947 - DNA, 25 bp, Mus musculus
ttactcccaaagctgtccttaacac

SEQ ID NO: 920948 - DNA, 25 bp, Mus musculus
ttactcccaaaggtgtccttaacac

SEQ ID NO: 920949 - DNA, 25 bp, Mus musculus
ttactcccatcccaggaggccgtaa

SEQ ID NO: 920950 - DNA, 25 bp, Mus musculus
ttactcccatccgaggaggccgtaa

SEQ ID NO: 920951 - DNA, 25 bp, Mus musculus
ttactcccattgagtccacaccagt

SEQ ID NO: 920952 - DNA, 25 bp, Mus musculus
ttactcccattgtgtccacaccagt

SEQ ID NO: 920953 - DNA, 25 bp, Mus musculus
ttactccccacaatacaccattgga

SEQ ID NO: 920954 - DNA, 25 bp, Mus musculus
ttactccccacattacaccattgga

SEQ ID NO: 920955 - DNA, 25 bp, Mus musculus
ttactccccgaaaccagaggttgaa

SEQ ID NO: 920956 - DNA, 25 bp, Mus musculus
ttactccccgaatccagaggttgaa

SEQ ID NO: 920957 - DNA, 25 bp, Mus musculus
ttactcccctccagagtctgaagca

SEQ ID NO: 920958 - DNA, 25 bp, Mus musculus
ttactcccctcctgagtctgaagca

SEQ ID NO: 920959 - DNA, 25 bp, Mus musculus
ttactcccctgcagtgtcagaaatt

SEQ ID NO: 920960 - DNA, 25 bp, Mus musculus
ttactcccctgctgtgtcagaaatt

SEQ ID NO: 920961 - DNA, 25 bp, Mus musculus
ttactccctatcattggcagctgcc

SEQ ID NO: 920962 - DNA, 25 bp, Mus musculus
ttactccctatctttggcagctgcc

SEQ ID NO: 920963 - DNA, 25 bp, Mus musculus
ttactccctgtaattttgtgtcttt

SEQ ID NO: 920964 - DNA, 25 bp, Mus musculus
ttactccctgtatttttgtgtcttt

SEQ ID NO: 920965 - DNA, 25 bp, Mus musculus
ttactccctttccttcatataatcc

SEQ ID NO: 920966 - DNA, 25 bp, Mus musculus
ttactccctttcgttcatataatcc

SEQ ID NO: 920967 - DNA, 25 bp, Mus musculus
ttactccgacttcactgctttgtta

SEQ ID NO: 920968 - DNA, 25 bp, Mus musculus
ttactccgacttgactgctttgtta

SEQ ID NO: 920969 - DNA, 25 bp, Mus musculus
ttactccgagtcaggttttcaccta

SEQ ID NO: 920970 - DNA, 25 bp, Mus musculus
ttactccgagtctggttttcaccta

SEQ ID NO: 920971 - DNA, 25 bp, Mus musculus
ttactccgcactctcctattacttt

SEQ ID NO: 920972 - DNA, 25 bp, Mus musculus
ttactccgcactgtcctattacttt

SEQ ID NO: 920973 - DNA, 25 bp, Mus musculus
ttactccggcacacgggtggtagag

SEQ ID NO: 920974 - DNA, 25 bp, Mus musculus
ttactccggcactcgggtggtagag

SEQ ID NO: 920975 - DNA, 25 bp, Mus musculus
ttactccgggtgactgtggaccaca

SEQ ID NO: 920976 - DNA, 25 bp, Mus musculus
ttactccgggtgtctgtggaccaca

SEQ ID NO: 920977 - DNA, 25 bp, Mus musculus
ttactccgtatcaaaggttgacttc

SEQ ID NO: 920978 - DNA, 25 bp, Mus musculus
ttactccgtatctaaggttgacttc

SEQ ID NO: 920979 - DNA, 25 bp, Mus musculus
ttactccgtgctcttctgggtgtga

SEQ ID NO: 920980 - DNA, 25 bp, Mus musculus
ttactccgtgctgttctgggtgtga

SEQ ID NO: 920981 - DNA, 25 bp, Mus musculus
ttactccgtgttaccataaggtggc

SEQ ID NO: 920982 - DNA, 25 bp, Mus musculus
ttactccgtgtttccataaggtggc

SEQ ID NO: 920983 - DNA, 25 bp, Mus musculus
ttactcctaattccaccactgagaa

SEQ ID NO: 920984 - DNA, 25 bp, Mus musculus
ttactcctaattgcaccactgagaa

SEQ ID NO: 920985 - DNA, 25 bp, Mus musculus
ttactcctacgactataagctgccc

SEQ ID NO: 920986 - DNA, 25 bp, Mus musculus
ttactcctacgagtataagctgccc

SEQ ID NO: 920987 - DNA, 25 bp, Mus musculus
ttactcctcagaatttcaaaacatg

SEQ ID NO: 920988 - DNA, 25 bp, Mus musculus
ttactcctcagattttcaaaacatg

SEQ ID NO: 920989 - DNA, 25 bp, Mus musculus
ttactcctcagcacctgtttcattg

SEQ ID NO: 920990 - DNA, 25 bp, Mus musculus
ttactcctcagcagcacattctgag

SEQ ID NO: 920991 - DNA, 25 bp, Mus musculus
ttactcctcagctcctgtttcattg

SEQ ID NO: 920992 - DNA, 25 bp, Mus musculus
ttactcctcagctgcacattctgag

SEQ ID NO: 920993 - DNA, 25 bp, Mus musculus
ttactcctcgtgacctgcaacacaa

SEQ ID NO: 920994 - DNA, 25 bp, Mus musculus
ttactcctcgtgtcctgcaacacaa

SEQ ID NO: 920995 - DNA, 25 bp, Mus musculus
ttactcctctaaaccgctggaccag

SEQ ID NO: 920996 - DNA, 25 bp, Mus musculus
ttactcctctaatccgctggaccag

SEQ ID NO: 920997 - DNA, 25 bp, Mus musculus
ttactcctgatcagatgtcagcagc

SEQ ID NO: 920998 - DNA, 25 bp, Mus musculus
ttactcctgatctgatgtcagcagc

SEQ ID NO: 920999 - DNA, 25 bp, Mus musculus
ttactcctgattaacttccaatttg

SEQ ID NO: 921000 - DNA, 25 bp, Mus musculus
ttactcctgatttacttccaatttg

SEQ ID NO: 921001 - DNA, 25 bp, Mus musculus
ttactcctgcacagtgacacacgag

SEQ ID NO: 921002 - DNA, 25 bp, Mus musculus
ttactcctgcactgtgacacacgag

SEQ ID NO: 921003 - DNA, 25 bp, Mus musculus
ttactcctggaaagtatccacctgc

SEQ ID NO: 921004 - DNA, 25 bp, Mus musculus
ttactcctggaatgtatccacctgc

SEQ ID NO: 921005 - DNA, 25 bp, Mus musculus
ttactccttttgacctaactcattc

SEQ ID NO: 921006 - DNA, 25 bp, Mus musculus
ttactccttttgtcctaactcattc

SEQ ID NO: 921007 - DNA, 25 bp, Mus musculus
ttactcgactctcctttttaccttg

SEQ ID NO: 921008 - DNA, 25 bp, Mus musculus
ttactcgactctgctttttaccttg

SEQ ID NO: 921009 - DNA, 25 bp, Mus musculus
ttactcgctctcaatatctgcataa

SEQ ID NO: 921010 - DNA, 25 bp, Mus musculus
ttactcgctctctatatctgcataa

SEQ ID NO: 921011 - DNA, 25 bp, Mus musculus
ttactcgggcctcctgattagcctg

SEQ ID NO: 921012 - DNA, 25 bp, Mus musculus
ttactcgggcctgctgattagcctg

SEQ ID NO: 921013 - DNA, 25 bp, Mus musculus
ttactcggtagactggatctggtgc

SEQ ID NO: 921014 - DNA, 25 bp, Mus musculus
ttactcggtagagtggatctggtgc

SEQ ID NO: 921015 - DNA, 25 bp, Mus musculus
ttactcgtacttacccagaggctgg

SEQ ID NO: 921016 - DNA, 25 bp, Mus musculus
ttactcgtactttcccagaggctgg

SEQ ID NO: 921017 - DNA, 25 bp, Mus musculus
ttactcgtcctaaccagggtgaaga

SEQ ID NO: 921018 - DNA, 25 bp, Mus musculus
ttactcgtcctatccagggtgaaga

SEQ ID NO: 921019 - DNA, 25 bp, Mus musculus
ttactcgtctctcccagagtttgag

SEQ ID NO: 921020 - DNA, 25 bp, Mus musculus
ttactcgtctctgccagagtttgag

SEQ ID NO: 921021 - DNA, 25 bp, Mus musculus
ttactctacagacctacctagcctg

SEQ ID NO: 921022 - DNA, 25 bp, Mus musculus
ttactctacagagctacctagcctg

SEQ ID NO: 921023 - DNA, 25 bp, Mus musculus
ttactctagaacagatagcctcccc

SEQ ID NO: 921024 - DNA, 25 bp, Mus musculus
ttactctagaactgatagcctcccc

SEQ ID NO: 921025 - DNA, 25 bp, Mus musculus
ttactctagatcaccaaactacctt

SEQ ID NO: 921026 - DNA, 25 bp, Mus musculus
ttactctagatctccaaactacctt

SEQ ID NO: 921027 - DNA, 25 bp, Mus musculus
ttactctagcccatcagagcagagc

SEQ ID NO: 921028 - DNA, 25 bp, Mus musculus
ttactctagcccttcagagcagagc

SEQ ID NO: 921029 - DNA, 25 bp, Mus musculus
ttactctagcttaggagcacacctg

SEQ ID NO: 921030 - DNA, 25 bp, Mus musculus
ttactctagctttggagcacacctg

SEQ ID NO: 921031 - DNA, 25 bp, Mus musculus
ttactctagggcatcccaacttggc

SEQ ID NO: 921032 - DNA, 25 bp, Mus musculus
ttactctagggcttcccaacttggc

SEQ ID NO: 921033 - DNA, 25 bp, Mus musculus
ttactctagtttctctctgtttttg

SEQ ID NO: 921034 - DNA, 25 bp, Mus musculus
ttactctagtttgtctctgtttttg

SEQ ID NO: 921035 - DNA, 25 bp, Mus musculus
ttactctatcacagtagccgcgtat

SEQ ID NO: 921036 - DNA, 25 bp, Mus musculus
ttactctatcactgtagccgcgtat

SEQ ID NO: 921037 - DNA, 25 bp, Mus musculus
ttactctcaaccatggcagtcactg

SEQ ID NO: 921038 - DNA, 25 bp, Mus musculus
ttactctcaaccttggcagtcactg

SEQ ID NO: 921039 - DNA, 25 bp, Mus musculus
ttactctcaataccaggttctcctg

SEQ ID NO: 921040 - DNA, 25 bp, Mus musculus
ttactctcaatagcaggttctcctg

SEQ ID NO: 921041 - DNA, 25 bp, Mus musculus
ttactctcaattagtgctcccagga

SEQ ID NO: 921042 - DNA, 25 bp, Mus musculus
ttactctcaatttgtgctcccagga

SEQ ID NO: 921043 - DNA, 25 bp, Mus musculus
ttactctcacaactagcgcttacaa

SEQ ID NO: 921044 - DNA, 25 bp, Mus musculus
ttactctcacaagtagcgcttacaa

SEQ ID NO: 921045 - DNA, 25 bp, Mus musculus
ttactctcaccaataaccctaactt

SEQ ID NO: 921046 - DNA, 25 bp, Mus musculus
ttactctcaccattaaccctaactt

SEQ ID NO: 921047 - DNA, 25 bp, Mus musculus
ttactctcactgcacgacttggttt

SEQ ID NO: 921048 - DNA, 25 bp, Mus musculus
ttactctcactggacgacttggttt

SEQ ID NO: 921049 - DNA, 25 bp, Mus musculus
ttactctcagtaaccctctgaactg

SEQ ID NO: 921050 - DNA, 25 bp, Mus musculus
ttactctcagtatccctctgaactg

SEQ ID NO: 921051 - DNA, 25 bp, Mus musculus
ttactctcagtgaactcatcttcga

SEQ ID NO: 921052 - DNA, 25 bp, Mus musculus
ttactctcagtgtactcatcttcga

SEQ ID NO: 921053 - DNA, 25 bp, Mus musculus
ttactctcccagagaatactctctg

SEQ ID NO: 921054 - DNA, 25 bp, Mus musculus
ttactctcccagtgaatactctctg

SEQ ID NO: 921055 - DNA, 25 bp, Mus musculus
ttactctcctttactttaccatggg

SEQ ID NO: 921056 - DNA, 25 bp, Mus musculus
ttactctccttttctttaccatggg

SEQ ID NO: 921057 - DNA, 25 bp, Mus musculus
ttactctctaccaacttatgtcttt

SEQ ID NO: 921058 - DNA, 25 bp, Mus musculus
ttactctctacctacttatgtcttt

SEQ ID NO: 921059 - DNA, 25 bp, Mus musculus
ttactctctactcgacatgaggccc

SEQ ID NO: 921060 - DNA, 25 bp, Mus musculus
ttactctctactggacatgaggccc

SEQ ID NO: 921061 - DNA, 25 bp, Mus musculus
ttactctctctgaggcaaccgtaag

SEQ ID NO: 921062 - DNA, 25 bp, Mus musculus
ttactctctctgtggcaaccgtaag

SEQ ID NO: 921063 - DNA, 25 bp, Mus musculus
ttactctctgaaagacggacgccgt

SEQ ID NO: 921064 - DNA, 25 bp, Mus musculus
ttactctctgaatgacggacgccgt

SEQ ID NO: 921065 - DNA, 25 bp, Mus musculus
ttactctctggacgttaccaacatc

SEQ ID NO: 921066 - DNA, 25 bp, Mus musculus
ttactctctggaggttaccaacatc

SEQ ID NO: 921067 - DNA, 25 bp, Mus musculus
ttactctgacctacgtttaacttcg

SEQ ID NO: 921068 - DNA, 25 bp, Mus musculus
ttactctgaccttcgtttaacttcg

SEQ ID NO: 921069 - DNA, 25 bp, Mus musculus
ttactctgactgactgtcatgcttt

SEQ ID NO: 921070 - DNA, 25 bp, Mus musculus
ttactctgactgtctgtcatgcttt

SEQ ID NO: 921071 - DNA, 25 bp, Mus musculus
ttactctgagtaccattttacgtga

SEQ ID NO: 921072 - DNA, 25 bp, Mus musculus
ttactctgagtagcattttacgtga

SEQ ID NO: 921073 - DNA, 25 bp, Mus musculus
ttactctgctttctccagtccatca

SEQ ID NO: 921074 - DNA, 25 bp, Mus musculus
ttactctgctttgtccagtccatca

SEQ ID NO: 921075 - DNA, 25 bp, Mus musculus
ttactctggacacacaagacgacag

SEQ ID NO: 921076 - DNA, 25 bp, Mus musculus
ttactctggacagacaagacgacag

SEQ ID NO: 921077 - DNA, 25 bp, Mus musculus
ttactctggcttcttcgcacatgtg

SEQ ID NO: 921078 - DNA, 25 bp, Mus musculus
ttactctggcttgttcgcacatgtg

SEQ ID NO: 921079 - DNA, 25 bp, Mus musculus
ttactctggtcaactactgctagct

SEQ ID NO: 921080 - DNA, 25 bp, Mus musculus
ttactctggtcatctactgctagct

SEQ ID NO: 921081 - DNA, 25 bp, Mus musculus
ttactctggttaactgactctcagt

SEQ ID NO: 921082 - DNA, 25 bp, Mus musculus
ttactctggttatctgactctcagt

SEQ ID NO: 921083 - DNA, 25 bp, Mus musculus
ttactcttaacaaaggatcctgtgg

SEQ ID NO: 921084 - DNA, 25 bp, Mus musculus
ttactcttaacataggatcctgtgg

SEQ ID NO: 921085 - DNA, 25 bp, Mus musculus
ttactcttcccaatacatttttcat

SEQ ID NO: 921086 - DNA, 25 bp, Mus musculus
ttactcttcccattacatttttcat

SEQ ID NO: 921087 - DNA, 25 bp, Mus musculus
ttactcttcgagcatgtcctctgaa

SEQ ID NO: 921088 - DNA, 25 bp, Mus musculus
ttactcttcgaggatgtcctctgaa

SEQ ID NO: 921089 - DNA, 25 bp, Mus musculus
ttactcttcgggacatctgcaatat

SEQ ID NO: 921090 - DNA, 25 bp, Mus musculus
ttactcttcgggtcatctgcaatat

SEQ ID NO: 921091 - DNA, 25 bp, Mus musculus
ttactcttctaccacatccaataat

SEQ ID NO: 921092 - DNA, 25 bp, Mus musculus
ttactcttctacgacatccaataat

SEQ ID NO: 921093 - DNA, 25 bp, Mus musculus
ttactcttctagatggctgccaaat

SEQ ID NO: 921094 - DNA, 25 bp, Mus musculus
ttactcttctagttggctgccaaat

SEQ ID NO: 921095 - DNA, 25 bp, Mus musculus
ttactcttctgtccgcgttgctgat

SEQ ID NO: 921096 - DNA, 25 bp, Mus musculus
ttactcttctgtcggtttaattatc

SEQ ID NO: 921097 - DNA, 25 bp, Mus musculus
ttactcttctgtgcgcgttgctgat

SEQ ID NO: 921098 - DNA, 25 bp, Mus musculus
ttactcttctgtgggtttaattatc

SEQ ID NO: 921099 - DNA, 25 bp, Mus musculus
ttactcttctttaaaggtctcctgt

SEQ ID NO: 921100 - DNA, 25 bp, Mus musculus
ttactcttcttttaaggtctcctgt

SEQ ID NO: 921101 - DNA, 25 bp, Mus musculus
ttactcttggcaaggcctggaaaat

SEQ ID NO: 921102 - DNA, 25 bp, Mus musculus
ttactcttggcatggcctggaaaat

SEQ ID NO: 921103 - DNA, 25 bp, Mus musculus
ttactctttataatccagggcatct

SEQ ID NO: 921104 - DNA, 25 bp, Mus musculus
ttactctttatattccagggcatct

SEQ ID NO: 921105 - DNA, 25 bp, Mus musculus
ttactctttattaaccaacttctgg

SEQ ID NO: 921106 - DNA, 25 bp, Mus musculus
ttactctttatttaccaacttctgg

SEQ ID NO: 921107 - DNA, 25 bp, Mus musculus
ttactctttctaccagtaggtatgg

SEQ ID NO: 921108 - DNA, 25 bp, Mus musculus
ttactctttctagcagtaggtatgg

SEQ ID NO: 921109 - DNA, 25 bp, Mus musculus
ttactctttttacccaagatagaag

SEQ ID NO: 921110 - DNA, 25 bp, Mus musculus
ttactctttttagccaagatagaag

SEQ ID NO: 921111 - DNA, 25 bp, Mus musculus
ttactgaacaccacactctccagga

SEQ ID NO: 921112 - DNA, 25 bp, Mus musculus
ttactgaacacctcactctccagga

SEQ ID NO: 921113 - DNA, 25 bp, Mus musculus
ttactgaacccaagcttcctctcaa

SEQ ID NO: 921114 - DNA, 25 bp, Mus musculus
ttactgaacccatgcttcctctcaa

SEQ ID NO: 921115 - DNA, 25 bp, Mus musculus
ttactgaacttgcagccatcctggc

SEQ ID NO: 921116 - DNA, 25 bp, Mus musculus
ttactgaacttggagccatcctggc

SEQ ID NO: 921117 - DNA, 25 bp, Mus musculus
ttactgaagaaactcgctgcctcct

SEQ ID NO: 921118 - DNA, 25 bp, Mus musculus
ttactgaagaaagtcgctgcctcct

SEQ ID NO: 921119 - DNA, 25 bp, Mus musculus
ttactgaagcctatagcttcttcag

SEQ ID NO: 921120 - DNA, 25 bp, Mus musculus
ttactgaagcctttagcttcttcag

SEQ ID NO: 921121 - DNA, 25 bp, Mus musculus
ttactgaagcggatgggttctccct

SEQ ID NO: 921122 - DNA, 25 bp, Mus musculus
ttactgaagcggttgggttctccct

SEQ ID NO: 921123 - DNA, 25 bp, Mus musculus
ttactgaaggttagatgtggaatca

SEQ ID NO: 921124 - DNA, 25 bp, Mus musculus
ttactgaaggtttgatgtggaatca

SEQ ID NO: 921125 - DNA, 25 bp, Mus musculus
ttactgacctataccttacggcttg

SEQ ID NO: 921126 - DNA, 25 bp, Mus musculus
ttactgacctattccttacggcttg

SEQ ID NO: 921127 - DNA, 25 bp, Mus musculus
ttactgactgctatgtccactgctg

SEQ ID NO: 921128 - DNA, 25 bp, Mus musculus
ttactgactgctttgtccactgctg

SEQ ID NO: 921129 - DNA, 25 bp, Mus musculus
ttactgactggcaatgtcttcttcc

SEQ ID NO: 921130 - DNA, 25 bp, Mus musculus
ttactgactggctatgtcttcttcc

SEQ ID NO: 921131 - DNA, 25 bp, Mus musculus
ttactgactgggacacgccacctct

SEQ ID NO: 921132 - DNA, 25 bp, Mus musculus
ttactgactgggtcacgccacctct

SEQ ID NO: 921133 - DNA, 25 bp, Mus musculus
ttactgacttgcatcatatcgccta

SEQ ID NO: 921134 - DNA, 25 bp, Mus musculus
ttactgacttgcttcatatcgccta

SEQ ID NO: 921135 - DNA, 25 bp, Mus musculus
ttactgagaataaccatgtgccctg

SEQ ID NO: 921136 - DNA, 25 bp, Mus musculus
ttactgagaatatccatgtgccctg

SEQ ID NO: 921137 - DNA, 25 bp, Mus musculus
ttactgagactgaacattcctagtg

SEQ ID NO: 921138 - DNA, 25 bp, Mus musculus
ttactgagactgtacattcctagtg

SEQ ID NO: 921139 - DNA, 25 bp, Mus musculus
ttactgagattcagaccacagctgg

SEQ ID NO: 921140 - DNA, 25 bp, Mus musculus
ttactgagattctgaccacagctgg

SEQ ID NO: 921141 - DNA, 25 bp, Mus musculus
ttactgagcgatcatgcttaccctg

SEQ ID NO: 921142 - DNA, 25 bp, Mus musculus
ttactgagcgatgatgcttaccctg

SEQ ID NO: 921143 - DNA, 25 bp, Mus musculus
ttactgagctgcagcctcgatgtgg

SEQ ID NO: 921144 - DNA, 25 bp, Mus musculus
ttactgagctgctgcctcgatgtgg

SEQ ID NO: 921145 - DNA, 25 bp, Mus musculus
ttactgagctggagaatgccggaga

SEQ ID NO: 921146 - DNA, 25 bp, Mus musculus
ttactgagctggtgaatgccggaga

SEQ ID NO: 921147 - DNA, 25 bp, Mus musculus
ttactgagctgtatcagacaggaag

SEQ ID NO: 921148 - DNA, 25 bp, Mus musculus
ttactgagctgtttcagacaggaag

SEQ ID NO: 921149 - DNA, 25 bp, Mus musculus
ttactgaggcagcagaacgtgttcg

SEQ ID NO: 921150 - DNA, 25 bp, Mus musculus
ttactgaggcaggagaacgtgttcg

SEQ ID NO: 921151 - DNA, 25 bp, Mus musculus
ttactgaggctcaacaggccagtgc

SEQ ID NO: 921152 - DNA, 25 bp, Mus musculus
ttactgaggctctacaggccagtgc

SEQ ID NO: 921153 - DNA, 25 bp, Mus musculus
ttactgaggtcacttttgctgaggt

SEQ ID NO: 921154 - DNA, 25 bp, Mus musculus
ttactgaggtcagttttgctgaggt

SEQ ID NO: 921155 - DNA, 25 bp, Mus musculus
ttactgagtgttaggcattgctgca

SEQ ID NO: 921156 - DNA, 25 bp, Mus musculus
ttactgagtgtttggcattgctgca

SEQ ID NO: 921157 - DNA, 25 bp, Mus musculus
ttactgagttagcacctggaacaat

SEQ ID NO: 921158 - DNA, 25 bp, Mus musculus
ttactgagttaggacctggaacaat

SEQ ID NO: 921159 - DNA, 25 bp, Mus musculus
ttactgagttccactcctggagtac

SEQ ID NO: 921160 - DNA, 25 bp, Mus musculus
ttactgagttcctctcctggagtac

SEQ ID NO: 921161 - DNA, 25 bp, Mus musculus
ttactgatagccaagggacctgaga

SEQ ID NO: 921162 - DNA, 25 bp, Mus musculus
ttactgatagcctagggacctgaga

SEQ ID NO: 921163 - DNA, 25 bp, Mus musculus
ttactgatcagtccatgtccaaact

SEQ ID NO: 921164 - DNA, 25 bp, Mus musculus
ttactgatcagtgcatgtccaaact

SEQ ID NO: 921165 - DNA, 25 bp, Mus musculus
ttactgatctgtaatcctggcttcc

SEQ ID NO: 921166 - DNA, 25 bp, Mus musculus
ttactgatctgttatcctggcttcc

SEQ ID NO: 921167 - DNA, 25 bp, Mus musculus
ttactgatctttccccatgctggga

SEQ ID NO: 921168 - DNA, 25 bp, Mus musculus
ttactgatctttgcccatgctggga

SEQ ID NO: 921169 - DNA, 25 bp, Mus musculus
ttactgattgatcaggtctgctgtc

SEQ ID NO: 921170 - DNA, 25 bp, Mus musculus
ttactgattgatgaggtctgctgtc

SEQ ID NO: 921171 - DNA, 25 bp, Mus musculus
ttactgattgccctcttattcctgt

SEQ ID NO: 921172 - DNA, 25 bp, Mus musculus
ttactgattgccgtcttattcctgt

SEQ ID NO: 921173 - DNA, 25 bp, Mus musculus
ttactgattgctcggacgtttctga

SEQ ID NO: 921174 - DNA, 25 bp, Mus musculus
ttactgattgctgggacgtttctga

SEQ ID NO: 921175 - DNA, 25 bp, Mus musculus
ttactgattgtgatattacctggcc

SEQ ID NO: 921176 - DNA, 25 bp, Mus musculus
ttactgattgtgttattacctggcc

SEQ ID NO: 921177 - DNA, 25 bp, Mus musculus
ttactgatttctcggatctctcttc

SEQ ID NO: 921178 - DNA, 25 bp, Mus musculus
ttactgatttctgggatctctcttc

SEQ ID NO: 921179 - DNA, 25 bp, Mus musculus
ttactgcaacttcccatccagaaga

SEQ ID NO: 921180 - DNA, 25 bp, Mus musculus
ttactgcaacttgccatccagaaga

SEQ ID NO: 921181 - DNA, 25 bp, Mus musculus
ttactgcaagctaccttactgtcca

SEQ ID NO: 921182 - DNA, 25 bp, Mus musculus
ttactgcaagcttccttactgtcca

SEQ ID NO: 921183 - DNA, 25 bp, Mus musculus
ttactgcaagtcaacccttcgtgta

SEQ ID NO: 921184 - DNA, 25 bp, Mus musculus
ttactgcaagtctacccttcgtgta

SEQ ID NO: 921185 - DNA, 25 bp, Mus musculus
ttactgcacccccaagtgctttggg

SEQ ID NO: 921186 - DNA, 25 bp, Mus musculus
ttactgcaccccgaagtgctttggg

SEQ ID NO: 921187 - DNA, 25 bp, Mus musculus
ttactgcacttcacaaggttctaag

SEQ ID NO: 921188 - DNA, 25 bp, Mus musculus
ttactgcacttcacacctcattgta

SEQ ID NO: 921189 - DNA, 25 bp, Mus musculus
ttactgcacttctcaaggttctaag

SEQ ID NO: 921190 - DNA, 25 bp, Mus musculus
ttactgcacttctcacctcattgta

SEQ ID NO: 921191 - DNA, 25 bp, Mus musculus
ttactgcagaagctagtgcttgctt

SEQ ID NO: 921192 - DNA, 25 bp, Mus musculus
ttactgcagaaggtagtgcttgctt

SEQ ID NO: 921193 - DNA, 25 bp, Mus musculus
ttactgcagatgaggcgacaggtgt

SEQ ID NO: 921194 - DNA, 25 bp, Mus musculus
ttactgcagatgtggcgacaggtgt

SEQ ID NO: 921195 - DNA, 25 bp, Mus musculus
ttactgcagctcagcctgtagagag

SEQ ID NO: 921196 - DNA, 25 bp, Mus musculus
ttactgcagctctgcctgtagagag

SEQ ID NO: 921197 - DNA, 25 bp, Mus musculus
ttactgcaggcaaccgactgtagag

SEQ ID NO: 921198 - DNA, 25 bp, Mus musculus
ttactgcaggcatccgactgtagag

SEQ ID NO: 921199 - DNA, 25 bp, Mus musculus
ttactgcagtttatcaggagcgcaa

SEQ ID NO: 921200 - DNA, 25 bp, Mus musculus
ttactgcagtttcatcagctcactt

SEQ ID NO: 921201 - DNA, 25 bp, Mus musculus
ttactgcagtttgatcagctcactt

SEQ ID NO: 921202 - DNA, 25 bp, Mus musculus
ttactgcagtttttcaggagcgcaa

SEQ ID NO: 921203 - DNA, 25 bp, Mus musculus
ttactgcatcttcccttgaaggact

SEQ ID NO: 921204 - DNA, 25 bp, Mus musculus
ttactgcatcttgccttgaaggact

SEQ ID NO: 921205 - DNA, 25 bp, Mus musculus
ttactgcatggtaattgacaaacat

SEQ ID NO: 921206 - DNA, 25 bp, Mus musculus
ttactgcatggttattgacaaacat

SEQ ID NO: 921207 - DNA, 25 bp, Mus musculus
ttactgccaactagtgctgtcagcc

SEQ ID NO: 921208 - DNA, 25 bp, Mus musculus
ttactgccaacttgtgctgtcagcc

SEQ ID NO: 921209 - DNA, 25 bp, Mus musculus
ttactgccagccaggattcacactg

SEQ ID NO: 921210 - DNA, 25 bp, Mus musculus
ttactgccagcctggattcacactg

SEQ ID NO: 921211 - DNA, 25 bp, Mus musculus
ttactgccattgatggttaggccag

SEQ ID NO: 921212 - DNA, 25 bp, Mus musculus
ttactgccattgttggttaggccag

SEQ ID NO: 921213 - DNA, 25 bp, Mus musculus
ttactgcccagaacctcagttgtga

SEQ ID NO: 921214 - DNA, 25 bp, Mus musculus
ttactgcccagatcctcagttgtga

SEQ ID NO: 921215 - DNA, 25 bp, Mus musculus
ttactgccgaaaagcattagttcat

SEQ ID NO: 921216 - DNA, 25 bp, Mus musculus
ttactgccgaaatgcattagttcat

SEQ ID NO: 921217 - DNA, 25 bp, Mus musculus
ttactgccggccagtcaaggccaag

SEQ ID NO: 921218 - DNA, 25 bp, Mus musculus
ttactgccggcctgtcaaggccaag

SEQ ID NO: 921219 - DNA, 25 bp, Mus musculus
ttactgcctaatcctaccaagaacg

SEQ ID NO: 921220 - DNA, 25 bp, Mus musculus
ttactgcctaatgctaccaagaacg

SEQ ID NO: 921221 - DNA, 25 bp, Mus musculus
ttactgcctcctctttttcattatc

SEQ ID NO: 921222 - DNA, 25 bp, Mus musculus
ttactgcctcctgtttttcattatc

SEQ ID NO: 921223 - DNA, 25 bp, Mus musculus
ttactgcctgctcccttgagttctt

SEQ ID NO: 921224 - DNA, 25 bp, Mus musculus
ttactgcctgctgccttgagttctt

SEQ ID NO: 921225 - DNA, 25 bp, Mus musculus
ttactgccttctcgttattttgaac

SEQ ID NO: 921226 - DNA, 25 bp, Mus musculus
ttactgccttctggttattttgaac

SEQ ID NO: 921227 - DNA, 25 bp, Mus musculus
ttactgcgacagacatgtgcgttgt

SEQ ID NO: 921228 - DNA, 25 bp, Mus musculus
ttactgcgacagtcatgtgcgttgt

SEQ ID NO: 921229 - DNA, 25 bp, Mus musculus
ttactgcgcattatcatttgggtct

SEQ ID NO: 921230 - DNA, 25 bp, Mus musculus
ttactgcgcattttcatttgggtct

SEQ ID NO: 921231 - DNA, 25 bp, Mus musculus
ttactgcgtatgcatgttttcatgc

SEQ ID NO: 921232 - DNA, 25 bp, Mus musculus
ttactgcgtatggatgttttcatgc

SEQ ID NO: 921233 - DNA, 25 bp, Mus musculus
ttactgctacagattcaacttccat

SEQ ID NO: 921234 - DNA, 25 bp, Mus musculus
ttactgctacagtttcaacttccat

SEQ ID NO: 921235 - DNA, 25 bp, Mus musculus
ttactgctagcccaagtacacacac

SEQ ID NO: 921236 - DNA, 25 bp, Mus musculus
ttactgctagccgaagtacacacac

SEQ ID NO: 921237 - DNA, 25 bp, Mus musculus
ttactgctccgtctttgctttctcc

SEQ ID NO: 921238 - DNA, 25 bp, Mus musculus
ttactgctccgtgtttgctttctcc

SEQ ID NO: 921239 - DNA, 25 bp, Mus musculus
ttactgctctgtatacagtgacctg

SEQ ID NO: 921240 - DNA, 25 bp, Mus musculus
ttactgctctgtttacagtgacctg

SEQ ID NO: 921241 - DNA, 25 bp, Mus musculus
ttactgctgacgagtggcccactaa

SEQ ID NO: 921242 - DNA, 25 bp, Mus musculus
ttactgctgacgtgtggcccactaa

SEQ ID NO: 921243 - DNA, 25 bp, Mus musculus
ttactgctgccaatgatatgacaca

SEQ ID NO: 921244 - DNA, 25 bp, Mus musculus
ttactgctgccattgatatgacaca

SEQ ID NO: 921245 - DNA, 25 bp, Mus musculus
ttactgctgcccacattttggaggg

SEQ ID NO: 921246 - DNA, 25 bp, Mus musculus
ttactgctgccccttagaagtgaga

SEQ ID NO: 921247 - DNA, 25 bp, Mus musculus
ttactgctgcccgttagaagtgaga

SEQ ID NO: 921248 - DNA, 25 bp, Mus musculus
ttactgctgccctcattttggaggg

SEQ ID NO: 921249 - DNA, 25 bp, Mus musculus
ttactgctggttacttgatatctag

SEQ ID NO: 921250 - DNA, 25 bp, Mus musculus
ttactgctggtttcttgatatctag

SEQ ID NO: 921251 - DNA, 25 bp, Mus musculus
ttactgctgtgtacgctgacctcat

SEQ ID NO: 921252 - DNA, 25 bp, Mus musculus
ttactgctgtgttcgctgacctcat

SEQ ID NO: 921253 - DNA, 25 bp, Mus musculus
ttactgcttagtcgaacaacctgct

SEQ ID NO: 921254 - DNA, 25 bp, Mus musculus
ttactgcttagtggaacaacctgct

SEQ ID NO: 921255 - DNA, 25 bp, Mus musculus
ttactgcttcaaccggcttttccat

SEQ ID NO: 921256 - DNA, 25 bp, Mus musculus
ttactgcttcaagcggcttttccat

SEQ ID NO: 921257 - DNA, 25 bp, Mus musculus
ttactgcttcatagccagcagccat

SEQ ID NO: 921258 - DNA, 25 bp, Mus musculus
ttactgcttcattgccagcagccat

SEQ ID NO: 921259 - DNA, 25 bp, Mus musculus
ttactgcttgcacttctgttttcct

SEQ ID NO: 921260 - DNA, 25 bp, Mus musculus
ttactgcttgcagttctgttttcct

SEQ ID NO: 921261 - DNA, 25 bp, Mus musculus
ttactgcttgccagagaagactcca

SEQ ID NO: 921262 - DNA, 25 bp, Mus musculus
ttactgcttgcctgagaagactcca

SEQ ID NO: 921263 - DNA, 25 bp, Mus musculus
ttactgcttgggactccaagggctg

SEQ ID NO: 921264 - DNA, 25 bp, Mus musculus
ttactgcttgggagtgcggaaccgt

SEQ ID NO: 921265 - DNA, 25 bp, Mus musculus
ttactgcttgggtctccaagggctg

SEQ ID NO: 921266 - DNA, 25 bp, Mus musculus
ttactgcttgggtgtgcggaaccgt

SEQ ID NO: 921267 - DNA, 25 bp, Mus musculus
ttactgcttgtgcagaagacctggg

SEQ ID NO: 921268 - DNA, 25 bp, Mus musculus
ttactgcttgtggagaagacctggg

SEQ ID NO: 921269 - DNA, 25 bp, Mus musculus
ttactgctttttctccaatatatgc

SEQ ID NO: 921270 - DNA, 25 bp, Mus musculus
ttactgctttttgtccaatatatgc

SEQ ID NO: 921271 - DNA, 25 bp, Mus musculus
ttactggacacgatgataatggcat

SEQ ID NO: 921272 - DNA, 25 bp, Mus musculus
ttactggacacgttgataatggcat

SEQ ID NO: 921273 - DNA, 25 bp, Mus musculus
ttactggagtcacagaacctctgcc

SEQ ID NO: 921274 - DNA, 25 bp, Mus musculus
ttactggagtcagagaacctctgcc

SEQ ID NO: 921275 - DNA, 25 bp, Mus musculus
ttactggagtccaagatgctaatgg

SEQ ID NO: 921276 - DNA, 25 bp, Mus musculus
ttactggagtcctagatgctaatgg

SEQ ID NO: 921277 - DNA, 25 bp, Mus musculus
ttactggcacagaaggtacctggat

SEQ ID NO: 921278 - DNA, 25 bp, Mus musculus
ttactggcacagtaggtacctggat

SEQ ID NO: 921279 - DNA, 25 bp, Mus musculus
ttactggcactcatgacttataatt

SEQ ID NO: 921280 - DNA, 25 bp, Mus musculus
ttactggcactcttgacttataatt

SEQ ID NO: 921281 - DNA, 25 bp, Mus musculus
ttactggcagcacgagctacgtact

SEQ ID NO: 921282 - DNA, 25 bp, Mus musculus
ttactggcagcaggagctacgtact

SEQ ID NO: 921283 - DNA, 25 bp, Mus musculus
ttactggccacactcttatgcctgt

SEQ ID NO: 921284 - DNA, 25 bp, Mus musculus
ttactggccacagtcttatgcctgt

SEQ ID NO: 921285 - DNA, 25 bp, Mus musculus
ttactggccaccctagttagcaaag

SEQ ID NO: 921286 - DNA, 25 bp, Mus musculus
ttactggccaccgtagttagcaaag

SEQ ID NO: 921287 - DNA, 25 bp, Mus musculus
ttactggcccttagagtgtcagctg

SEQ ID NO: 921288 - DNA, 25 bp, Mus musculus
ttactggccctttgagtgtcagctg

SEQ ID NO: 921289 - DNA, 25 bp, Mus musculus
ttactggcctctacttctacatgta

SEQ ID NO: 921290 - DNA, 25 bp, Mus musculus
ttactggcctcttcttctacatgta

SEQ ID NO: 921291 - DNA, 25 bp, Mus musculus
ttactggcctgcaagtagattacca

SEQ ID NO: 921292 - DNA, 25 bp, Mus musculus
ttactggcctgctagtagattacca

SEQ ID NO: 921293 - DNA, 25 bp, Mus musculus
ttactggctcagacacatgcttgta

SEQ ID NO: 921294 - DNA, 25 bp, Mus musculus
ttactggctcagtcacatgcttgta

SEQ ID NO: 921295 - DNA, 25 bp, Mus musculus
ttactggctcctcttgcagaacaaa

SEQ ID NO: 921296 - DNA, 25 bp, Mus musculus
ttactggctcctgttgcagaacaaa

SEQ ID NO: 921297 - DNA, 25 bp, Mus musculus
ttactggctctcactggtatctatg

SEQ ID NO: 921298 - DNA, 25 bp, Mus musculus
ttactggctctctctggtatctatg

SEQ ID NO: 921299 - DNA, 25 bp, Mus musculus
ttactggctgcacccagcaagacct

SEQ ID NO: 921300 - DNA, 25 bp, Mus musculus
ttactggctgcagccagcaagacct

SEQ ID NO: 921301 - DNA, 25 bp, Mus musculus
ttactggcttaacaaacctggaagt

SEQ ID NO: 921302 - DNA, 25 bp, Mus musculus
ttactggcttaagaaacctggaagt

SEQ ID NO: 921303 - DNA, 25 bp, Mus musculus
ttactggcttgcattggtactagaa

SEQ ID NO: 921304 - DNA, 25 bp, Mus musculus
ttactggcttgctttggtactagaa

SEQ ID NO: 921305 - DNA, 25 bp, Mus musculus
ttactggcttggctacccatagtga

SEQ ID NO: 921306 - DNA, 25 bp, Mus musculus
ttactggcttgggtacccatagtga

SEQ ID NO: 921307 - DNA, 25 bp, Mus musculus
ttactggcttgtactaccttgcact

SEQ ID NO: 921308 - DNA, 25 bp, Mus musculus
ttactggcttgttctaccttgcact

SEQ ID NO: 921309 - DNA, 25 bp, Mus musculus
ttactgggtcttacaaattctgcaa

SEQ ID NO: 921310 - DNA, 25 bp, Mus musculus
ttactgggtctttcaaattctgcaa

SEQ ID NO: 921311 - DNA, 25 bp, Mus musculus
ttactgggtgagacagagctgcact

SEQ ID NO: 921312 - DNA, 25 bp, Mus musculus
ttactgggtgagtcagagctgcact

SEQ ID NO: 921313 - DNA, 25 bp, Mus musculus
ttactgggtgtacaagccacacttt

SEQ ID NO: 921314 - DNA, 25 bp, Mus musculus
ttactgggtgtagaagccacacttt

SEQ ID NO: 921315 - DNA, 25 bp, Mus musculus
ttactgggttacatgtcaacaaaag

SEQ ID NO: 921316 - DNA, 25 bp, Mus musculus
ttactgggttacttgtcaacaaaag

SEQ ID NO: 921317 - DNA, 25 bp, Mus musculus
ttactggtaccaccagaggccgggc

SEQ ID NO: 921318 - DNA, 25 bp, Mus musculus
ttactggtaccagcagaggccgggc

SEQ ID NO: 921319 - DNA, 25 bp, Mus musculus
ttactggtatgtacacacccttacg

SEQ ID NO: 921320 - DNA, 25 bp, Mus musculus
ttactggtatgttcacacccttacg

SEQ ID NO: 921321 - DNA, 25 bp, Mus musculus
ttactggtcatcaagctttaactat

SEQ ID NO: 921322 - DNA, 25 bp, Mus musculus
ttactggtcatctagctttaactat

SEQ ID NO: 921323 - DNA, 25 bp, Mus musculus
ttactggtgagcaagccatcaggct

SEQ ID NO: 921324 - DNA, 25 bp, Mus musculus
ttactggtgagctagccatcaggct

SEQ ID NO: 921325 - DNA, 25 bp, Mus musculus
ttactggtgcctccttatgagtgtt

SEQ ID NO: 921326 - DNA, 25 bp, Mus musculus
ttactggtgcctgcttatgagtgtt

SEQ ID NO: 921327 - DNA, 25 bp, Mus musculus
ttactggtgtggaccatccccaaaa

SEQ ID NO: 921328 - DNA, 25 bp, Mus musculus
ttactggtgtggtccatccccaaaa

SEQ ID NO: 921329 - DNA, 25 bp, Mus musculus
ttactggttcagaaagtgcttcccc

SEQ ID NO: 921330 - DNA, 25 bp, Mus musculus
ttactggttcagtaagtgcttcccc

SEQ ID NO: 921331 - DNA, 25 bp, Mus musculus
ttactggttttcacctgtgtaacca

SEQ ID NO: 921332 - DNA, 25 bp, Mus musculus
ttactggttttctcctgtgtaacca

SEQ ID NO: 921333 - DNA, 25 bp, Mus musculus
ttactgtaacaacatccacctggtt

SEQ ID NO: 921334 - DNA, 25 bp, Mus musculus
ttactgtaacaagatccacctggtt

SEQ ID NO: 921335 - DNA, 25 bp, Mus musculus
ttactgtaagaacccgctccccatg

SEQ ID NO: 921336 - DNA, 25 bp, Mus musculus
ttactgtaagaagccgctccccatg

SEQ ID NO: 921337 - DNA, 25 bp, Mus musculus
ttactgtactcaatggaaaccttct

SEQ ID NO: 921338 - DNA, 25 bp, Mus musculus
ttactgtactcattggaaaccttct

SEQ ID NO: 921339 - DNA, 25 bp, Mus musculus
ttactgtagagtcgctctgtttcct

SEQ ID NO: 921340 - DNA, 25 bp, Mus musculus
ttactgtagagtggctctgtttcct

SEQ ID NO: 921341 - DNA, 25 bp, Mus musculus
ttactgtagtggagcatttccttcc

SEQ ID NO: 921342 - DNA, 25 bp, Mus musculus
ttactgtagtggtgcatttccttcc

SEQ ID NO: 921343 - DNA, 25 bp, Mus musculus
ttactgtatagtcttggcctcaaat

SEQ ID NO: 921344 - DNA, 25 bp, Mus musculus
ttactgtatagtgttggcctcaaat

SEQ ID NO: 921345 - DNA, 25 bp, Mus musculus
ttactgtatcccctaattccaagag

SEQ ID NO: 921346 - DNA, 25 bp, Mus musculus
ttactgtatcccgtaattccaagag

SEQ ID NO: 921347 - DNA, 25 bp, Mus musculus
ttactgtcaaggctgcgcctacaaa

SEQ ID NO: 921348 - DNA, 25 bp, Mus musculus
ttactgtcaagggtgcgcctacaaa

SEQ ID NO: 921349 - DNA, 25 bp, Mus musculus
ttactgtcactactgttcctgcgtt

SEQ ID NO: 921350 - DNA, 25 bp, Mus musculus
ttactgtcactagtgttcctgcgtt

SEQ ID NO: 921351 - DNA, 25 bp, Mus musculus
ttactgtccagactggtgccttacc

SEQ ID NO: 921352 - DNA, 25 bp, Mus musculus
ttactgtccagagtggtgccttacc

SEQ ID NO: 921353 - DNA, 25 bp, Mus musculus
ttactgtcctttcaagagtccactg

SEQ ID NO: 921354 - DNA, 25 bp, Mus musculus
ttactgtcctttgaagagtccactg

SEQ ID NO: 921355 - DNA, 25 bp, Mus musculus
ttactgtctcagacgttgcttggag

SEQ ID NO: 921356 - DNA, 25 bp, Mus musculus
ttactgtctcagtcgttgcttggag

SEQ ID NO: 921357 - DNA, 25 bp, Mus musculus
ttactgtctctgactgctaactcag

SEQ ID NO: 921358 - DNA, 25 bp, Mus musculus
ttactgtctctgtctgctaactcag

SEQ ID NO: 921359 - DNA, 25 bp, Mus musculus
ttactgtctggaattattgtgtggt

SEQ ID NO: 921360 - DNA, 25 bp, Mus musculus
ttactgtctggatttattgtgtggt

SEQ ID NO: 921361 - DNA, 25 bp, Mus musculus
ttactgtgagtcactgtctggatca

SEQ ID NO: 921362 - DNA, 25 bp, Mus musculus
ttactgtgagtctctgtctggatca

SEQ ID NO: 921363 - DNA, 25 bp, Mus musculus
ttactgtgatctagcttcctcatga

SEQ ID NO: 921364 - DNA, 25 bp, Mus musculus
ttactgtgatcttgcttcctcatga

SEQ ID NO: 921365 - DNA, 25 bp, Mus musculus
ttactgtgcaagaggtcctaactgg

SEQ ID NO: 921366 - DNA, 25 bp, Mus musculus
ttactgtgcaagatctggttactac

SEQ ID NO: 921367 - DNA, 25 bp, Mus musculus
ttactgtgcaagtggtcctaactgg

SEQ ID NO: 921368 - DNA, 25 bp, Mus musculus
ttactgtgcaagttctggttactac

SEQ ID NO: 921369 - DNA, 25 bp, Mus musculus
ttactgtgctatagggtggtttctt

SEQ ID NO: 921370 - DNA, 25 bp, Mus musculus
ttactgtgctattgggtggtttctt

SEQ ID NO: 921371 - DNA, 25 bp, Mus musculus
ttactgtggccacactatgagtcaa

SEQ ID NO: 921372 - DNA, 25 bp, Mus musculus
ttactgtggccagactatgagtcaa

SEQ ID NO: 921373 - DNA, 25 bp, Mus musculus
ttactgtgggatagactgggttcgc

SEQ ID NO: 921374 - DNA, 25 bp, Mus musculus
ttactgtgggattgactgggttcgc

SEQ ID NO: 921375 - DNA, 25 bp, Mus musculus
ttactgtgtaagattgcctcgctcc

SEQ ID NO: 921376 - DNA, 25 bp, Mus musculus
ttactgtgtaagtttgcctcgctcc

SEQ ID NO: 921377 - DNA, 25 bp, Mus musculus
ttactgtgtgtaaagatgcatgatt

SEQ ID NO: 921378 - DNA, 25 bp, Mus musculus
ttactgtgtgtatagatgcatgatt

SEQ ID NO: 921379 - DNA, 25 bp, Mus musculus
ttactgttaaagaccttgcctccct

SEQ ID NO: 921380 - DNA, 25 bp, Mus musculus
ttactgttaaagtccttgcctccct

SEQ ID NO: 921381 - DNA, 25 bp, Mus musculus
ttactgttaccaaaaataagacatt

SEQ ID NO: 921382 - DNA, 25 bp, Mus musculus
ttactgttaccataaataagacatt

SEQ ID NO: 921383 - DNA, 25 bp, Mus musculus
ttactgttacccaggcttgggatcc

SEQ ID NO: 921384 - DNA, 25 bp, Mus musculus
ttactgttaccctggcttgggatcc

SEQ ID NO: 921385 - DNA, 25 bp, Mus musculus
ttactgttcactacacaatcctagg

SEQ ID NO: 921386 - DNA, 25 bp, Mus musculus
ttactgttcacttcacaatcctagg

SEQ ID NO: 921387 - DNA, 25 bp, Mus musculus
ttactgttggccaatttgactgcat

SEQ ID NO: 921388 - DNA, 25 bp, Mus musculus
ttactgttggcctatttgactgcat

SEQ ID NO: 921389 - DNA, 25 bp, Mus musculus
ttactgttggttccatatctgtagc

SEQ ID NO: 921390 - DNA, 25 bp, Mus musculus
ttactgttggttgcatatctgtagc

SEQ ID NO: 921391 - DNA, 25 bp, Mus musculus
ttactgttgtgaacagcatctgccc

SEQ ID NO: 921392 - DNA, 25 bp, Mus musculus
ttactgttgtgatcagcatctgccc

SEQ ID NO: 921393 - DNA, 25 bp, Mus musculus
ttactgtttaaaatcctgtgtgtgt

SEQ ID NO: 921394 - DNA, 25 bp, Mus musculus
ttactgtttaaattcctgtgtgtgt

SEQ ID NO: 921395 - DNA, 25 bp, Mus musculus
ttactgtttcttatgtacaaggaac

SEQ ID NO: 921396 - DNA, 25 bp, Mus musculus
ttactgtttcttttgtacaaggaac

SEQ ID NO: 921397 - DNA, 25 bp, Mus musculus
ttactgtttgtgacctgttgggctc

SEQ ID NO: 921398 - DNA, 25 bp, Mus musculus
ttactgtttgtgtcctgttgggctc

SEQ ID NO: 921399 - DNA, 25 bp, Mus musculus
ttactgttttatactgcactgtggg

SEQ ID NO: 921400 - DNA, 25 bp, Mus musculus
ttactgttttattctgcactgtggg

SEQ ID NO: 921401 - DNA, 25 bp, Mus musculus
ttacttaaataaactgggccatccc

SEQ ID NO: 921402 - DNA, 25 bp, Mus musculus
ttacttaaataatctgggccatccc

SEQ ID NO: 921403 - DNA, 25 bp, Mus musculus
ttacttaagacactgggtagcctgt

SEQ ID NO: 921404 - DNA, 25 bp, Mus musculus
ttacttaagacagtgggtagcctgt

SEQ ID NO: 921405 - DNA, 25 bp, Mus musculus
ttacttacacgcacacatctagaaa

SEQ ID NO: 921406 - DNA, 25 bp, Mus musculus
ttacttacacgctcacatctagaaa

SEQ ID NO: 921407 - DNA, 25 bp, Mus musculus
ttacttaccatgacccaaggctctg

SEQ ID NO: 921408 - DNA, 25 bp, Mus musculus
ttacttaccatgtcccaaggctctg

SEQ ID NO: 921409 - DNA, 25 bp, Mus musculus
ttacttactcaaaacctaggtcaaa

SEQ ID NO: 921410 - DNA, 25 bp, Mus musculus
ttacttactcaatacctaggtcaaa

SEQ ID NO: 921411 - DNA, 25 bp, Mus musculus
ttacttactgacatgtggatgggac

SEQ ID NO: 921412 - DNA, 25 bp, Mus musculus
ttacttactgacttgtggatgggac

SEQ ID NO: 921413 - DNA, 25 bp, Mus musculus
ttacttactgtcactgcctcatgat

SEQ ID NO: 921414 - DNA, 25 bp, Mus musculus
ttacttactgtctctgcctcatgat

SEQ ID NO: 921415 - DNA, 25 bp, Mus musculus
ttacttactgttcttttgctgtgag

SEQ ID NO: 921416 - DNA, 25 bp, Mus musculus
ttacttactgttgttttgctgtgag

SEQ ID NO: 921417 - DNA, 25 bp, Mus musculus
ttacttagaattccctgtgaaggtc

SEQ ID NO: 921418 - DNA, 25 bp, Mus musculus
ttacttagaattgcctgtgaaggtc

SEQ ID NO: 921419 - DNA, 25 bp, Mus musculus
ttacttagatatccactccatatgg

SEQ ID NO: 921420 - DNA, 25 bp, Mus musculus
ttacttagatatgcactccatatgg

SEQ ID NO: 921421 - DNA, 25 bp, Mus musculus
ttacttagcaaaattgttcctgttg

SEQ ID NO: 921422 - DNA, 25 bp, Mus musculus
ttacttagcaaatttgttcctgttg

SEQ ID NO: 921423 - DNA, 25 bp, Mus musculus
ttacttagcataattaagcccctga

SEQ ID NO: 921424 - DNA, 25 bp, Mus musculus
ttacttagcatatttaagcccctga

SEQ ID NO: 921425 - DNA, 25 bp, Mus musculus
ttacttagcatcactcttgttttcc

SEQ ID NO: 921426 - DNA, 25 bp, Mus musculus
ttacttagcatctctcttgttttcc

SEQ ID NO: 921427 - DNA, 25 bp, Mus musculus
ttacttagcctcactactattgaac

SEQ ID NO: 921428 - DNA, 25 bp, Mus musculus
ttacttagcctcagtggctcaggca

SEQ ID NO: 921429 - DNA, 25 bp, Mus musculus
ttacttagcctctctactattgaac

SEQ ID NO: 921430 - DNA, 25 bp, Mus musculus
ttacttagcctctgtggctcaggca

SEQ ID NO: 921431 - DNA, 25 bp, Mus musculus
ttacttagctgtcaggaccccggtt

SEQ ID NO: 921432 - DNA, 25 bp, Mus musculus
ttacttagctgtgaggaccccggtt

SEQ ID NO: 921433 - DNA, 25 bp, Mus musculus
ttacttatatctagggtggctgcgt

SEQ ID NO: 921434 - DNA, 25 bp, Mus musculus
ttacttatatcttgggtggctgcgt

SEQ ID NO: 921435 - DNA, 25 bp, Mus musculus
ttacttatgagcaaccccaggctaa

SEQ ID NO: 921436 - DNA, 25 bp, Mus musculus
ttacttatgagctaccccaggctaa

SEQ ID NO: 921437 - DNA, 25 bp, Mus musculus
ttacttatgcatacaaagctcccag

SEQ ID NO: 921438 - DNA, 25 bp, Mus musculus
ttacttatgcattcaaagctcccag

SEQ ID NO: 921439 - DNA, 25 bp, Mus musculus
ttacttatgctaatttgcctcttca

SEQ ID NO: 921440 - DNA, 25 bp, Mus musculus
ttacttatgctattttgcctcttca

SEQ ID NO: 921441 - DNA, 25 bp, Mus musculus
ttacttatggcactggtatctcatt

SEQ ID NO: 921442 - DNA, 25 bp, Mus musculus
ttacttatggcagtggtatctcatt

SEQ ID NO: 921443 - DNA, 25 bp, Mus musculus
ttacttcaatggcactggcaccgtg

SEQ ID NO: 921444 - DNA, 25 bp, Mus musculus
ttacttcaatgggactggcaccgtg

SEQ ID NO: 921445 - DNA, 25 bp, Mus musculus
ttacttcacaatcacccaaactgag

SEQ ID NO: 921446 - DNA, 25 bp, Mus musculus
ttacttcacaatgacccaaactgag

SEQ ID NO: 921447 - DNA, 25 bp, Mus musculus
ttacttcacacactgggacaaaatg

SEQ ID NO: 921448 - DNA, 25 bp, Mus musculus
ttacttcacacagtgggacaaaatg

SEQ ID NO: 921449 - DNA, 25 bp, Mus musculus
ttacttcaccgaatactttctggag

SEQ ID NO: 921450 - DNA, 25 bp, Mus musculus
ttacttcaccgattactttctggag

SEQ ID NO: 921451 - DNA, 25 bp, Mus musculus
ttacttcacctcctaattctgtgga

SEQ ID NO: 921452 - DNA, 25 bp, Mus musculus
ttacttcacctcgtaattctgtgga

SEQ ID NO: 921453 - DNA, 25 bp, Mus musculus
ttacttcaccttcctcatgcatatc

SEQ ID NO: 921454 - DNA, 25 bp, Mus musculus
ttacttcaccttgctcatgcatatc

SEQ ID NO: 921455 - DNA, 25 bp, Mus musculus
ttacttcagaatccattttgtattt

SEQ ID NO: 921456 - DNA, 25 bp, Mus musculus
ttacttcagaatgcattttgtattt

SEQ ID NO: 921457 - DNA, 25 bp, Mus musculus
ttacttcagatgacgtttgctgctg

SEQ ID NO: 921458 - DNA, 25 bp, Mus musculus
ttacttcagatgtcgtttgctgctg

SEQ ID NO: 921459 - DNA, 25 bp, Mus musculus
ttacttcagggcacagaactagcaa

SEQ ID NO: 921460 - DNA, 25 bp, Mus musculus
ttacttcagggctcagaactagcaa

SEQ ID NO: 921461 - DNA, 25 bp, Mus musculus
ttacttcagtaaagcttccctcggg

SEQ ID NO: 921462 - DNA, 25 bp, Mus musculus
ttacttcagtaatgcttccctcggg

SEQ ID NO: 921463 - DNA, 25 bp, Mus musculus
ttacttcagtgtccaccgttttcag

SEQ ID NO: 921464 - DNA, 25 bp, Mus musculus
ttacttcagtgtgcaccgttttcag

SEQ ID NO: 921465 - DNA, 25 bp, Mus musculus
ttacttcataacaactcttttcagg

SEQ ID NO: 921466 - DNA, 25 bp, Mus musculus
ttacttcataactactcttttcagg

SEQ ID NO: 921467 - DNA, 25 bp, Mus musculus
ttacttcattgtctagaccactatg

SEQ ID NO: 921468 - DNA, 25 bp, Mus musculus
ttacttcattgtgtagaccactatg

SEQ ID NO: 921469 - DNA, 25 bp, Mus musculus
ttacttcatttcagacctacctttt

SEQ ID NO: 921470 - DNA, 25 bp, Mus musculus
ttacttcatttctgacctacctttt

SEQ ID NO: 921471 - DNA, 25 bp, Mus musculus
ttacttccaaaaactcccagagaga

SEQ ID NO: 921472 - DNA, 25 bp, Mus musculus
ttacttccaaaatctcccagagaga

SEQ ID NO: 921473 - DNA, 25 bp, Mus musculus
ttacttccacctaggtacagtgtga

SEQ ID NO: 921474 - DNA, 25 bp, Mus musculus
ttacttccaccttggtacagtgtga

SEQ ID NO: 921475 - DNA, 25 bp, Mus musculus
ttacttccagaaaacccagggtctc

SEQ ID NO: 921476 - DNA, 25 bp, Mus musculus
ttacttccagaatacccagggtctc

SEQ ID NO: 921477 - DNA, 25 bp, Mus musculus
ttacttccatccagtgtagcatctt

SEQ ID NO: 921478 - DNA, 25 bp, Mus musculus
ttacttccatcctgtgtagcatctt

SEQ ID NO: 921479 - DNA, 25 bp, Mus musculus
ttacttcccagaccaggtgtccggc

SEQ ID NO: 921480 - DNA, 25 bp, Mus musculus
ttacttcccagagcaggtgtccggc

SEQ ID NO: 921481 - DNA, 25 bp, Mus musculus
ttacttcccgagatcttcagagaca

SEQ ID NO: 921482 - DNA, 25 bp, Mus musculus
ttacttcccgagttcttcagagaca

SEQ ID NO: 921483 - DNA, 25 bp, Mus musculus
ttacttccctgcagtttatttgcta

SEQ ID NO: 921484 - DNA, 25 bp, Mus musculus
ttacttccctgctgtttatttgcta

SEQ ID NO: 921485 - DNA, 25 bp, Mus musculus
ttacttccgcctctggacattgttt

SEQ ID NO: 921486 - DNA, 25 bp, Mus musculus
ttacttccgcctgtggacattgttt

SEQ ID NO: 921487 - DNA, 25 bp, Mus musculus
ttacttcctatcatctgattgtgcc

SEQ ID NO: 921488 - DNA, 25 bp, Mus musculus
ttacttcctatcttctgattgtgcc

SEQ ID NO: 921489 - DNA, 25 bp, Mus musculus
ttacttcctcagacattggcaagat

SEQ ID NO: 921490 - DNA, 25 bp, Mus musculus
ttacttcctcagtcattggcaagat

SEQ ID NO: 921491 - DNA, 25 bp, Mus musculus
ttacttcctcttagttgcactgctc

SEQ ID NO: 921492 - DNA, 25 bp, Mus musculus
ttacttcctctttgttgcactgctc

SEQ ID NO: 921493 - DNA, 25 bp, Mus musculus
ttacttcctgaacctttgaacaaat

SEQ ID NO: 921494 - DNA, 25 bp, Mus musculus
ttacttcctgaagctttgaacaaat

SEQ ID NO: 921495 - DNA, 25 bp, Mus musculus
ttacttcctggacctataataacgt

SEQ ID NO: 921496 - DNA, 25 bp, Mus musculus
ttacttcctggactcatggctcaga

SEQ ID NO: 921497 - DNA, 25 bp, Mus musculus
ttacttcctggagctataataacgt

SEQ ID NO: 921498 - DNA, 25 bp, Mus musculus
ttacttcctggagtcatggctcaga

SEQ ID NO: 921499 - DNA, 25 bp, Mus musculus
ttacttcctgtaaagctcctgtagc

SEQ ID NO: 921500 - DNA, 25 bp, Mus musculus
ttacttcctgtacataagcctaaga

SEQ ID NO: 921501 - DNA, 25 bp, Mus musculus
ttacttcctgtagataagcctaaga

SEQ ID NO: 921502 - DNA, 25 bp, Mus musculus
ttacttcctgtatagctcctgtagc

SEQ ID NO: 921503 - DNA, 25 bp, Mus musculus
ttacttcctgtgctaagcacattat

SEQ ID NO: 921504 - DNA, 25 bp, Mus musculus
ttacttcctgtggtaagcacattat

SEQ ID NO: 921505 - DNA, 25 bp, Mus musculus
ttacttcctttcaacaggcttccct

SEQ ID NO: 921506 - DNA, 25 bp, Mus musculus
ttacttcctttctacaggcttccct

SEQ ID NO: 921507 - DNA, 25 bp, Mus musculus
ttacttcgcaccacttctgataaga

SEQ ID NO: 921508 - DNA, 25 bp, Mus musculus
ttacttcgcacctcttctgataaga

SEQ ID NO: 921509 - DNA, 25 bp, Mus musculus
ttacttcgtcctcacaaggtgtgca

SEQ ID NO: 921510 - DNA, 25 bp, Mus musculus
ttacttcgtcctgacaaggtgtgca

SEQ ID NO: 921511 - DNA, 25 bp, Mus musculus
ttacttcgttccagttctcttctgt

SEQ ID NO: 921512 - DNA, 25 bp, Mus musculus
ttacttcgttcctgttctcttctgt

SEQ ID NO: 921513 - DNA, 25 bp, Mus musculus
ttacttctagcacttaggaggcaga

SEQ ID NO: 921514 - DNA, 25 bp, Mus musculus
ttacttctagcagttaggaggcaga

SEQ ID NO: 921515 - DNA, 25 bp, Mus musculus
ttacttctagccataccacattgag

SEQ ID NO: 921516 - DNA, 25 bp, Mus musculus
ttacttctagccttaccacattgag

SEQ ID NO: 921517 - DNA, 25 bp, Mus musculus
ttacttctccgtaatatctattaat

SEQ ID NO: 921518 - DNA, 25 bp, Mus musculus
ttacttctccgttatatctattaat

SEQ ID NO: 921519 - DNA, 25 bp, Mus musculus
ttacttctgcgcatgagtggcctct

SEQ ID NO: 921520 - DNA, 25 bp, Mus musculus
ttacttctgcgcttgagtggcctct

SEQ ID NO: 921521 - DNA, 25 bp, Mus musculus
ttacttctggcactacacccagagt

SEQ ID NO: 921522 - DNA, 25 bp, Mus musculus
ttacttctggcagtacacccagagt

SEQ ID NO: 921523 - DNA, 25 bp, Mus musculus
ttacttctgtatcctacaacccttt

SEQ ID NO: 921524 - DNA, 25 bp, Mus musculus
ttacttctgtatgctacaacccttt

SEQ ID NO: 921525 - DNA, 25 bp, Mus musculus
ttacttctgtctcgtgccttggcct

SEQ ID NO: 921526 - DNA, 25 bp, Mus musculus
ttacttctgtctggtgccttggcct

SEQ ID NO: 921527 - DNA, 25 bp, Mus musculus
ttacttcttcgtattcctcatctta

SEQ ID NO: 921528 - DNA, 25 bp, Mus musculus
ttacttcttcgttttcctcatctta

SEQ ID NO: 921529 - DNA, 25 bp, Mus musculus
ttacttcttctaatcagagatgcat

SEQ ID NO: 921530 - DNA, 25 bp, Mus musculus
ttacttcttctattcagagatgcat

SEQ ID NO: 921531 - DNA, 25 bp, Mus musculus
ttacttcttgagacagggcactgga

SEQ ID NO: 921532 - DNA, 25 bp, Mus musculus
ttacttcttgagtcagggcactgga

SEQ ID NO: 921533 - DNA, 25 bp, Mus musculus
ttacttgaaaggagccccattatat

SEQ ID NO: 921534 - DNA, 25 bp, Mus musculus
ttacttgaaaggtgccccattatat

SEQ ID NO: 921535 - DNA, 25 bp, Mus musculus
ttacttgaagtactgggcaatttgc

SEQ ID NO: 921536 - DNA, 25 bp, Mus musculus
ttacttgaagtagtgggcaatttgc

SEQ ID NO: 921537 - DNA, 25 bp, Mus musculus
ttacttgaattacaggacccatggc

SEQ ID NO: 921538 - DNA, 25 bp, Mus musculus
ttacttgaattagaggacccatggc

SEQ ID NO: 921539 - DNA, 25 bp, Mus musculus
ttacttgactctaacctataggctt

SEQ ID NO: 921540 - DNA, 25 bp, Mus musculus
ttacttgactcttacctataggctt

SEQ ID NO: 921541 - DNA, 25 bp, Mus musculus
ttacttgatgaaccatttctggcat

SEQ ID NO: 921542 - DNA, 25 bp, Mus musculus
ttacttgatgaagcatttctggcat

SEQ ID NO: 921543 - DNA, 25 bp, Mus musculus
ttacttgatgtaataaagcttattt

SEQ ID NO: 921544 - DNA, 25 bp, Mus musculus
ttacttgatgtattaaagcttattt

SEQ ID NO: 921545 - DNA, 25 bp, Mus musculus
ttacttgcacccaccaggataagga

SEQ ID NO: 921546 - DNA, 25 bp, Mus musculus
ttacttgcaccctccaggataagga

SEQ ID NO: 921547 - DNA, 25 bp, Mus musculus
ttacttgcagcgctgtgcttgagag

SEQ ID NO: 921548 - DNA, 25 bp, Mus musculus
ttacttgcagcggtgtgcttgagag

SEQ ID NO: 921549 - DNA, 25 bp, Mus musculus
ttacttgcccatctatacgcccaat

SEQ ID NO: 921550 - DNA, 25 bp, Mus musculus
ttacttgcccatgtatacgcccaat

SEQ ID NO: 921551 - DNA, 25 bp, Mus musculus
ttacttgctcacagacttcacgata

SEQ ID NO: 921552 - DNA, 25 bp, Mus musculus
ttacttgctcactgacttcacgata

SEQ ID NO: 921553 - DNA, 25 bp, Mus musculus
ttacttgctcttcccttgctagcaa

SEQ ID NO: 921554 - DNA, 25 bp, Mus musculus
ttacttgctcttgccttgctagcaa

SEQ ID NO: 921555 - DNA, 25 bp, Mus musculus
ttacttgctggaagacactcaccct

SEQ ID NO: 921556 - DNA, 25 bp, Mus musculus
ttacttgctggatgacactcaccct

SEQ ID NO: 921557 - DNA, 25 bp, Mus musculus
ttacttgcttggacattgagactga

SEQ ID NO: 921558 - DNA, 25 bp, Mus musculus
ttacttgcttggctttgtgacacca

SEQ ID NO: 921559 - DNA, 25 bp, Mus musculus
ttacttgcttgggtttgtgacacca

SEQ ID NO: 921560 - DNA, 25 bp, Mus musculus
ttacttgcttggtcattgagactga

SEQ ID NO: 921561 - DNA, 25 bp, Mus musculus
ttacttggaattcttcatcctcctg

SEQ ID NO: 921562 - DNA, 25 bp, Mus musculus
ttacttggaattgttcatcctcctg

SEQ ID NO: 921563 - DNA, 25 bp, Mus musculus
ttacttggaggacgccttctgccag

SEQ ID NO: 921564 - DNA, 25 bp, Mus musculus
ttacttggaggaggccttctgccag

SEQ ID NO: 921565 - DNA, 25 bp, Mus musculus
ttacttggcaccatttgtcacttag

SEQ ID NO: 921566 - DNA, 25 bp, Mus musculus
ttacttggcaccttttgtcacttag

SEQ ID NO: 921567 - DNA, 25 bp, Mus musculus
ttacttggccctctggtttttctga

SEQ ID NO: 921568 - DNA, 25 bp, Mus musculus
ttacttggccctgtggtttttctga

SEQ ID NO: 921569 - DNA, 25 bp, Mus musculus
ttacttgggcaccatttatacctaa

SEQ ID NO: 921570 - DNA, 25 bp, Mus musculus
ttacttgggcacgatttatacctaa

SEQ ID NO: 921571 - DNA, 25 bp, Mus musculus
ttacttggtccaaagaacactcaaa

SEQ ID NO: 921572 - DNA, 25 bp, Mus musculus
ttacttggtccatagaacactcaaa

SEQ ID NO: 921573 - DNA, 25 bp, Mus musculus
ttacttggtgcgcactttgaggatt

SEQ ID NO: 921574 - DNA, 25 bp, Mus musculus
ttacttggtgcggactttgaggatt

SEQ ID NO: 921575 - DNA, 25 bp, Mus musculus
ttacttggttctctcacttcatgat

SEQ ID NO: 921576 - DNA, 25 bp, Mus musculus
ttacttggttctgtcacttcatgat

SEQ ID NO: 921577 - DNA, 25 bp, Mus musculus
ttacttgtctcacctgggccacgtg

SEQ ID NO: 921578 - DNA, 25 bp, Mus musculus
ttacttgtctcagctgggccacgtg

SEQ ID NO: 921579 - DNA, 25 bp, Mus musculus
ttacttgtctgaagcgaccatcggt

SEQ ID NO: 921580 - DNA, 25 bp, Mus musculus
ttacttgtctgatgcgaccatcggt

SEQ ID NO: 921581 - DNA, 25 bp, Mus musculus
ttacttgtgaccaactgatggcctc

SEQ ID NO: 921582 - DNA, 25 bp, Mus musculus
ttacttgtgacctactgatggcctc

SEQ ID NO: 921583 - DNA, 25 bp, Mus musculus
ttacttgtgccaccctggaatctca

SEQ ID NO: 921584 - DNA, 25 bp, Mus musculus
ttacttgtgccagcctggaatctca

SEQ ID NO: 921585 - DNA, 25 bp, Mus musculus
ttacttgttctcctgattgtagtga

SEQ ID NO: 921586 - DNA, 25 bp, Mus musculus
ttacttgttctcgtgattgtagtga

SEQ ID NO: 921587 - DNA, 25 bp, Mus musculus
ttacttgttgtacctttctgccatc

SEQ ID NO: 921588 - DNA, 25 bp, Mus musculus
ttacttgttgtagctttctgccatc

SEQ ID NO: 921589 - DNA, 25 bp, Mus musculus
ttactttaatataagatcatctgct

SEQ ID NO: 921590 - DNA, 25 bp, Mus musculus
ttactttaatattagatcatctgct

SEQ ID NO: 921591 - DNA, 25 bp, Mus musculus
ttactttaattgactccaccttgtt

SEQ ID NO: 921592 - DNA, 25 bp, Mus musculus
ttactttaattgtctccaccttgtt

SEQ ID NO: 921593 - DNA, 25 bp, Mus musculus
ttactttacaaaagcacacccacgc

SEQ ID NO: 921594 - DNA, 25 bp, Mus musculus
ttactttacaaatgcacacccacgc

SEQ ID NO: 921595 - DNA, 25 bp, Mus musculus
ttactttacctacatatcagtttcc

SEQ ID NO: 921596 - DNA, 25 bp, Mus musculus
ttactttacctagatatcagtttcc

SEQ ID NO: 921597 - DNA, 25 bp, Mus musculus
ttactttagactctgttatggccca

SEQ ID NO: 921598 - DNA, 25 bp, Mus musculus
ttactttagactgtgttatggccca

SEQ ID NO: 921599 - DNA, 25 bp, Mus musculus
ttactttagtagcattcctgtgttc

SEQ ID NO: 921600 - DNA, 25 bp, Mus musculus
ttactttagtaggattcctgtgttc

SEQ ID NO: 921601 - DNA, 25 bp, Mus musculus
ttactttatgctctttgttttattg

SEQ ID NO: 921602 - DNA, 25 bp, Mus musculus
ttactttatgctgtttgttttattg

SEQ ID NO: 921603 - DNA, 25 bp, Mus musculus
ttactttcaacaactcgcggtatcc

SEQ ID NO: 921604 - DNA, 25 bp, Mus musculus
ttactttcaacatctcgcggtatcc

SEQ ID NO: 921605 - DNA, 25 bp, Mus musculus
ttactttcatgcctggtgcaggttt

SEQ ID NO: 921606 - DNA, 25 bp, Mus musculus
ttactttcatgcgtggtgcaggttt

SEQ ID NO: 921607 - DNA, 25 bp, Mus musculus
ttactttccactactcaataaatgt

SEQ ID NO: 921608 - DNA, 25 bp, Mus musculus
ttactttccacttctcaataaatgt

SEQ ID NO: 921609 - DNA, 25 bp, Mus musculus
ttactttcccgtcaagctgtggttc

SEQ ID NO: 921610 - DNA, 25 bp, Mus musculus
ttactttcccgtgaagctgtggttc

SEQ ID NO: 921611 - DNA, 25 bp, Mus musculus
ttactttccctacctttatgttgtg

SEQ ID NO: 921612 - DNA, 25 bp, Mus musculus
ttactttccctagctttatgttgtg

SEQ ID NO: 921613 - DNA, 25 bp, Mus musculus
ttactttcctaacctattgccaact

SEQ ID NO: 921614 - DNA, 25 bp, Mus musculus
ttactttcctaacctgtcatggcta

SEQ ID NO: 921615 - DNA, 25 bp, Mus musculus
ttactttcctaagctattgccaact

SEQ ID NO: 921616 - DNA, 25 bp, Mus musculus
ttactttcctaagctgtcatggcta

SEQ ID NO: 921617 - DNA, 25 bp, Mus musculus
ttactttctagtaccttggcttggc

SEQ ID NO: 921618 - DNA, 25 bp, Mus musculus
ttactttctagttccttggcttggc

SEQ ID NO: 921619 - DNA, 25 bp, Mus musculus
ttactttctccaacagaatgtatag

SEQ ID NO: 921620 - DNA, 25 bp, Mus musculus
ttactttctccatcagaatgtatag

SEQ ID NO: 921621 - DNA, 25 bp, Mus musculus
ttactttctgagactttgccttcat

SEQ ID NO: 921622 - DNA, 25 bp, Mus musculus
ttactttctgagtctttgccttcat

SEQ ID NO: 921623 - DNA, 25 bp, Mus musculus
ttactttcttacagactccacaaac

SEQ ID NO: 921624 - DNA, 25 bp, Mus musculus
ttactttcttactgactccacaaac

SEQ ID NO: 921625 - DNA, 25 bp, Mus musculus
ttactttgcattagtttggtttctc

SEQ ID NO: 921626 - DNA, 25 bp, Mus musculus
ttactttgcatttgtttggtttctc

SEQ ID NO: 921627 - DNA, 25 bp, Mus musculus
ttactttgcgaacctggatggagca

SEQ ID NO: 921628 - DNA, 25 bp, Mus musculus
ttactttgcgaagctggatggagca

SEQ ID NO: 921629 - DNA, 25 bp, Mus musculus
ttactttgctaacccaatgacctgg

SEQ ID NO: 921630 - DNA, 25 bp, Mus musculus
ttactttgctaagccaatgacctgg

SEQ ID NO: 921631 - DNA, 25 bp, Mus musculus
ttactttgctagcttttcctaggga

SEQ ID NO: 921632 - DNA, 25 bp, Mus musculus
ttactttgctaggttttcctaggga

SEQ ID NO: 921633 - DNA, 25 bp, Mus musculus
ttactttggccgcactgttgagacc

SEQ ID NO: 921634 - DNA, 25 bp, Mus musculus
ttactttggccggactgttgagacc

SEQ ID NO: 921635 - DNA, 25 bp, Mus musculus
ttactttgtaacctggctgataacg

SEQ ID NO: 921636 - DNA, 25 bp, Mus musculus
ttactttgtaacgtggctgataacg

SEQ ID NO: 921637 - DNA, 25 bp, Mus musculus
ttactttgtattcccggctagcctg

SEQ ID NO: 921638 - DNA, 25 bp, Mus musculus
ttactttgtattgccggctagcctg

SEQ ID NO: 921639 - DNA, 25 bp, Mus musculus
ttactttgtcttcccttcagatggt

SEQ ID NO: 921640 - DNA, 25 bp, Mus musculus
ttactttgtcttgccttcagatggt

SEQ ID NO: 921641 - DNA, 25 bp, Mus musculus
ttactttgtgtacgcattgtgttct

SEQ ID NO: 921642 - DNA, 25 bp, Mus musculus
ttactttgtgtactgtaaggccacc

SEQ ID NO: 921643 - DNA, 25 bp, Mus musculus
ttactttgtgtaggcattgtgttct

SEQ ID NO: 921644 - DNA, 25 bp, Mus musculus
ttactttgtgtagtgtaaggccacc

SEQ ID NO: 921645 - DNA, 25 bp, Mus musculus
ttactttgtgtcattttagattcat

SEQ ID NO: 921646 - DNA, 25 bp, Mus musculus
ttactttgtgtctttttagattcat

SEQ ID NO: 921647 - DNA, 25 bp, Mus musculus
ttacttttatagagcatgccaaatt

SEQ ID NO: 921648 - DNA, 25 bp, Mus musculus
ttacttttatagtgcatgccaaatt

SEQ ID NO: 921649 - DNA, 25 bp, Mus musculus
ttacttttcacacatcaaaccggat

SEQ ID NO: 921650 - DNA, 25 bp, Mus musculus
ttacttttcacagatcaaaccggat

SEQ ID NO: 921651 - DNA, 25 bp, Mus musculus
ttacttttctctccagagggaccag

SEQ ID NO: 921652 - DNA, 25 bp, Mus musculus
ttacttttctctgcagagggaccag

SEQ ID NO: 921653 - DNA, 25 bp, Mus musculus
ttacttttctggcaaagcattcgat

SEQ ID NO: 921654 - DNA, 25 bp, Mus musculus
ttacttttctgggaaagcattcgat

SEQ ID NO: 921655 - DNA, 25 bp, Mus musculus
ttacttttgtcccagaaattctcat

SEQ ID NO: 921656 - DNA, 25 bp, Mus musculus
ttacttttgtccgagaaattctcat

SEQ ID NO: 921657 - DNA, 25 bp, Mus musculus
ttactttttagtatggtctgcgttg

SEQ ID NO: 921658 - DNA, 25 bp, Mus musculus
ttactttttagtttggtctgcgttg

SEQ ID NO: 921659 - DNA, 25 bp, Mus musculus
ttactttttctaaatcagggccatg

SEQ ID NO: 921660 - DNA, 25 bp, Mus musculus
ttactttttctatatcagggccatg

SEQ ID NO: 921661 - DNA, 25 bp, Mus musculus
ttagaaaacacgagcttccttcctc

SEQ ID NO: 921662 - DNA, 25 bp, Mus musculus
ttagaaaacacgtgcttccttcctc

SEQ ID NO: 921663 - DNA, 25 bp, Mus musculus
ttagaaaagacacccctactccaag

SEQ ID NO: 921664 - DNA, 25 bp, Mus musculus
ttagaaaagacagccctactccaag

SEQ ID NO: 921665 - DNA, 25 bp, Mus musculus
ttagaaacaaaccagctgcttccct

SEQ ID NO: 921666 - DNA, 25 bp, Mus musculus
ttagaaacaaacgagctgcttccct

SEQ ID NO: 921667 - DNA, 25 bp, Mus musculus
ttagaaacacatcggctctgtccca

SEQ ID NO: 921668 - DNA, 25 bp, Mus musculus
ttagaaacacatgggctctgtccca

SEQ ID NO: 921669 - DNA, 25 bp, Mus musculus
ttagaaaccagtccctacgctcagt

SEQ ID NO: 921670 - DNA, 25 bp, Mus musculus
ttagaaaccagtgcctacgctcagt

SEQ ID NO: 921671 - DNA, 25 bp, Mus musculus
ttagaaacggaaacggtcgagcttg

SEQ ID NO: 921672 - DNA, 25 bp, Mus musculus
ttagaaacggaatcggtcgagcttg

SEQ ID NO: 921673 - DNA, 25 bp, Mus musculus
ttagaaacgggacagatggcttcat

SEQ ID NO: 921674 - DNA, 25 bp, Mus musculus
ttagaaacgggagagatggcttcat

SEQ ID NO: 921675 - DNA, 25 bp, Mus musculus
ttagaaactatgaatgccagctgtg

SEQ ID NO: 921676 - DNA, 25 bp, Mus musculus
ttagaaactatgtatgccagctgtg

SEQ ID NO: 921677 - DNA, 25 bp, Mus musculus
ttagaaactctgctgaggttctcag

SEQ ID NO: 921678 - DNA, 25 bp, Mus musculus
ttagaaactctggtgaggttctcag

SEQ ID NO: 921679 - DNA, 25 bp, Mus musculus
ttagaaagactgacccttcagccca

SEQ ID NO: 921680 - DNA, 25 bp, Mus musculus
ttagaaagactgtcccttcagccca

SEQ ID NO: 921681 - DNA, 25 bp, Mus musculus
ttagaaagcatgctcttgcctggcc

SEQ ID NO: 921682 - DNA, 25 bp, Mus musculus
ttagaaagcatggtcttgcctggcc

SEQ ID NO: 921683 - DNA, 25 bp, Mus musculus
ttagaaagctctcgagccgcctcgc

SEQ ID NO: 921684 - DNA, 25 bp, Mus musculus
ttagaaagctctggagccgcctcgc

SEQ ID NO: 921685 - DNA, 25 bp, Mus musculus
ttagaaagctgcaatccctcaagct

SEQ ID NO: 921686 - DNA, 25 bp, Mus musculus
ttagaaagctgctatccctcaagct

SEQ ID NO: 921687 - DNA, 25 bp, Mus musculus
ttagaaaggcatccccggacctgga

SEQ ID NO: 921688 - DNA, 25 bp, Mus musculus
ttagaaaggcatgcccggacctgga

SEQ ID NO: 921689 - DNA, 25 bp, Mus musculus
ttagaaatatccactccccttaaat

SEQ ID NO: 921690 - DNA, 25 bp, Mus musculus
ttagaaatatcctctccccttaaat

SEQ ID NO: 921691 - DNA, 25 bp, Mus musculus
ttagaaatcactagtttgatacccc

SEQ ID NO: 921692 - DNA, 25 bp, Mus musculus
ttagaaatcactcggtcactcactc

SEQ ID NO: 921693 - DNA, 25 bp, Mus musculus
ttagaaatcactgggtcactcactc

SEQ ID NO: 921694 - DNA, 25 bp, Mus musculus
ttagaaatcacttgtttgatacccc

SEQ ID NO: 921695 - DNA, 25 bp, Mus musculus
ttagaaatccgcactcccctaagtg

SEQ ID NO: 921696 - DNA, 25 bp, Mus musculus
ttagaaatccgctctcccctaagtg

SEQ ID NO: 921697 - DNA, 25 bp, Mus musculus
ttagaaatgatccagcaaagacttg

SEQ ID NO: 921698 - DNA, 25 bp, Mus musculus
ttagaaatgatcgagcaaagacttg

SEQ ID NO: 921699 - DNA, 25 bp, Mus musculus
ttagaaatgcatctgtgaacgaata

SEQ ID NO: 921700 - DNA, 25 bp, Mus musculus
ttagaaatgcatgtgtgaacgaata

SEQ ID NO: 921701 - DNA, 25 bp, Mus musculus
ttagaaatgcctagtacccaaaaca

SEQ ID NO: 921702 - DNA, 25 bp, Mus musculus
ttagaaatgccttgtacccaaaaca

SEQ ID NO: 921703 - DNA, 25 bp, Mus musculus
ttagaaattaatcacttcccacaga

SEQ ID NO: 921704 - DNA, 25 bp, Mus musculus
ttagaaattaatgacttcccacaga

SEQ ID NO: 921705 - DNA, 25 bp, Mus musculus
ttagaacaaactagtgaccaaattg

SEQ ID NO: 921706 - DNA, 25 bp, Mus musculus
ttagaacaaacttgtgaccaaattg

SEQ ID NO: 921707 - DNA, 25 bp, Mus musculus
ttagaacactaaccgctgctggcag

SEQ ID NO: 921708 - DNA, 25 bp, Mus musculus
ttagaacactaagcgctgctggcag

SEQ ID NO: 921709 - DNA, 25 bp, Mus musculus
ttagaacagaaaatgcttgcttggg

SEQ ID NO: 921710 - DNA, 25 bp, Mus musculus
ttagaacagaaattgcttgcttggg

SEQ ID NO: 921711 - DNA, 25 bp, Mus musculus
ttagaacagcctcccttgcggtgag

SEQ ID NO: 921712 - DNA, 25 bp, Mus musculus
ttagaacagcctgccttgcggtgag

SEQ ID NO: 921713 - DNA, 25 bp, Mus musculus
ttagaacagcgtcgctgaggacgac

SEQ ID NO: 921714 - DNA, 25 bp, Mus musculus
ttagaacagcgtggctgaggacgac

SEQ ID NO: 921715 - DNA, 25 bp, Mus musculus
ttagaacatagactgcatcgcctgc

SEQ ID NO: 921716 - DNA, 25 bp, Mus musculus
ttagaacatagactggcatggccat

SEQ ID NO: 921717 - DNA, 25 bp, Mus musculus
ttagaacatagagtgcatcgcctgc

SEQ ID NO: 921718 - DNA, 25 bp, Mus musculus
ttagaacatagagtggcatggccat

SEQ ID NO: 921719 - DNA, 25 bp, Mus musculus
ttagaacatcgcattgccaaggtca

SEQ ID NO: 921720 - DNA, 25 bp, Mus musculus
ttagaacatcgctttgccaaggtca

SEQ ID NO: 921721 - DNA, 25 bp, Mus musculus
ttagaacatgtcatgccaggcaatg

SEQ ID NO: 921722 - DNA, 25 bp, Mus musculus
ttagaacatgtcttgccaggcaatg

SEQ ID NO: 921723 - DNA, 25 bp, Mus musculus
ttagaacatgttcgtgcccaccaag

SEQ ID NO: 921724 - DNA, 25 bp, Mus musculus
ttagaacatgttggtgcccaccaag

SEQ ID NO: 921725 - DNA, 25 bp, Mus musculus
ttagaacattcaacctccatacata

SEQ ID NO: 921726 - DNA, 25 bp, Mus musculus
ttagaacattcatcctccatacata

SEQ ID NO: 921727 - DNA, 25 bp, Mus musculus
ttagaaccaacaagctctcttccaa

SEQ ID NO: 921728 - DNA, 25 bp, Mus musculus
ttagaaccaacatgctctcttccaa

SEQ ID NO: 921729 - DNA, 25 bp, Mus musculus
ttagaacccactcttgcatgggctc

SEQ ID NO: 921730 - DNA, 25 bp, Mus musculus
ttagaacccactgttgcatgggctc

SEQ ID NO: 921731 - DNA, 25 bp, Mus musculus
ttagaacccagaacccctgtagtat

SEQ ID NO: 921732 - DNA, 25 bp, Mus musculus
ttagaacccagatcccctgtagtat

SEQ ID NO: 921733 - DNA, 25 bp, Mus musculus
ttagaaccccttcttaacgagcaat

SEQ ID NO: 921734 - DNA, 25 bp, Mus musculus
ttagaaccccttgttaacgagcaat

SEQ ID NO: 921735 - DNA, 25 bp, Mus musculus
ttagaacccgcacctttctgggtca

SEQ ID NO: 921736 - DNA, 25 bp, Mus musculus
ttagaacccgcagctttctgggtca

SEQ ID NO: 921737 - DNA, 25 bp, Mus musculus
ttagaaccggctatttccaacctat

SEQ ID NO: 921738 - DNA, 25 bp, Mus musculus
ttagaaccggctttttccaacctat

SEQ ID NO: 921739 - DNA, 25 bp, Mus musculus
ttagaacctactacttcatgactga

SEQ ID NO: 921740 - DNA, 25 bp, Mus musculus
ttagaacctacttcttcatgactga

SEQ ID NO: 921741 - DNA, 25 bp, Mus musculus
ttagaacctcagcagatactcactc

SEQ ID NO: 921742 - DNA, 25 bp, Mus musculus
ttagaacctcaggagatactcactc

SEQ ID NO: 921743 - DNA, 25 bp, Mus musculus
ttagaaccttatcgcggtgcgtgcg

SEQ ID NO: 921744 - DNA, 25 bp, Mus musculus
ttagaaccttatggcggtgcgtgcg

SEQ ID NO: 921745 - DNA, 25 bp, Mus musculus
ttagaacgtttcatgtttcctcaga

SEQ ID NO: 921746 - DNA, 25 bp, Mus musculus
ttagaacgtttcttgtttcctcaga

SEQ ID NO: 921747 - DNA, 25 bp, Mus musculus
ttagaactacaacacagcgcaaggt

SEQ ID NO: 921748 - DNA, 25 bp, Mus musculus
ttagaactacaagacagcgcaaggt

SEQ ID NO: 921749 - DNA, 25 bp, Mus musculus
ttagaactagcacagcccagagcag

SEQ ID NO: 921750 - DNA, 25 bp, Mus musculus
ttagaactagcagagcccagagcag

SEQ ID NO: 921751 - DNA, 25 bp, Mus musculus
ttagaactcaggatagccactgccc

SEQ ID NO: 921752 - DNA, 25 bp, Mus musculus
ttagaactcaggttagccactgccc

SEQ ID NO: 921753 - DNA, 25 bp, Mus musculus
ttagaactctgtaattgtccataag

SEQ ID NO: 921754 - DNA, 25 bp, Mus musculus
ttagaactctgttattgtccataag

SEQ ID NO: 921755 - DNA, 25 bp, Mus musculus
ttagaagaaacaaaaggccttagag

SEQ ID NO: 921756 - DNA, 25 bp, Mus musculus
ttagaagaaacataaggccttagag

SEQ ID NO: 921757 - DNA, 25 bp, Mus musculus
ttagaagaacagacttcttttatgc

SEQ ID NO: 921758 - DNA, 25 bp, Mus musculus
ttagaagaacagtcttcttttatgc

SEQ ID NO: 921759 - DNA, 25 bp, Mus musculus
ttagaagaagcacgcgacagctccc

SEQ ID NO: 921760 - DNA, 25 bp, Mus musculus
ttagaagaagcaggcgacagctccc

SEQ ID NO: 921761 - DNA, 25 bp, Mus musculus
ttagaagacccactagcctgtcttt

SEQ ID NO: 921762 - DNA, 25 bp, Mus musculus
ttagaagacccagtagcctgtcttt

SEQ ID NO: 921763 - DNA, 25 bp, Mus musculus
ttagaagagataccctccccttact

SEQ ID NO: 921764 - DNA, 25 bp, Mus musculus
ttagaagagatagcctccccttact

SEQ ID NO: 921765 - DNA, 25 bp, Mus musculus
ttagaagatcaccaagcagaccact

SEQ ID NO: 921766 - DNA, 25 bp, Mus musculus
ttagaagatcacgaagcagaccact

SEQ ID NO: 921767 - DNA, 25 bp, Mus musculus
ttagaagatctaacctctccagagg

SEQ ID NO: 921768 - DNA, 25 bp, Mus musculus
ttagaagatctatcctctccagagg

SEQ ID NO: 921769 - DNA, 25 bp, Mus musculus
ttagaagccaagctctcaaagcttg

SEQ ID NO: 921770 - DNA, 25 bp, Mus musculus
ttagaagccaaggtctcaaagcttg

SEQ ID NO: 921771 - DNA, 25 bp, Mus musculus
ttagaagccaatccttggcgtcgga

SEQ ID NO: 921772 - DNA, 25 bp, Mus musculus
ttagaagccaatgcttggcgtcgga

SEQ ID NO: 921773 - DNA, 25 bp, Mus musculus
ttagaagccactctggagatccctc

SEQ ID NO: 921774 - DNA, 25 bp, Mus musculus
ttagaagccactgtggagatccctc

SEQ ID NO: 921775 - DNA, 25 bp, Mus musculus
ttagaagccggactctgaggttgca

SEQ ID NO: 921776 - DNA, 25 bp, Mus musculus
ttagaagccggagtctgaggttgca

SEQ ID NO: 921777 - DNA, 25 bp, Mus musculus
ttagaagcctagagttaatccctgg

SEQ ID NO: 921778 - DNA, 25 bp, Mus musculus
ttagaagcctagtgttaatccctgg

SEQ ID NO: 921779 - DNA, 25 bp, Mus musculus
ttagaaggatctcagtttcaaagcc

SEQ ID NO: 921780 - DNA, 25 bp, Mus musculus
ttagaaggatctgagtttcaaagcc

SEQ ID NO: 921781 - DNA, 25 bp, Mus musculus
ttagaaggcaatcgattctgtagct

SEQ ID NO: 921782 - DNA, 25 bp, Mus musculus
ttagaaggcaatggattctgtagct

SEQ ID NO: 921783 - DNA, 25 bp, Mus musculus
ttagaaggcagccagacacatagct

SEQ ID NO: 921784 - DNA, 25 bp, Mus musculus
ttagaaggcagcgagacacatagct

SEQ ID NO: 921785 - DNA, 25 bp, Mus musculus
ttagaaggctctcgcaaaccctgtg

SEQ ID NO: 921786 - DNA, 25 bp, Mus musculus
ttagaaggctctggcaaaccctgtg

SEQ ID NO: 921787 - DNA, 25 bp, Mus musculus
ttagaagtaatcactagccaggcgt

SEQ ID NO: 921788 - DNA, 25 bp, Mus musculus
ttagaagtaatctctagccaggcgt

SEQ ID NO: 921789 - DNA, 25 bp, Mus musculus
ttagaagtacctctgaagtaagcac

SEQ ID NO: 921790 - DNA, 25 bp, Mus musculus
ttagaagtacctgtgaagtaagcac

SEQ ID NO: 921791 - DNA, 25 bp, Mus musculus
ttagaagtatacacagtacaactgt

SEQ ID NO: 921792 - DNA, 25 bp, Mus musculus
ttagaagtatactcagtacaactgt

SEQ ID NO: 921793 - DNA, 25 bp, Mus musculus
ttagaagtatttccaaacttttcca

SEQ ID NO: 921794 - DNA, 25 bp, Mus musculus
ttagaagtatttgcaaacttttcca

SEQ ID NO: 921795 - DNA, 25 bp, Mus musculus
ttagaagtcctgaagggttcctcat

SEQ ID NO: 921796 - DNA, 25 bp, Mus musculus
ttagaagtcctgtagggttcctcat

SEQ ID NO: 921797 - DNA, 25 bp, Mus musculus
ttagaagtcttcagcttccctcaat

SEQ ID NO: 921798 - DNA, 25 bp, Mus musculus
ttagaagtcttctgcttccctcaat

SEQ ID NO: 921799 - DNA, 25 bp, Mus musculus
ttagaagtgacgagctgtgtccctc

SEQ ID NO: 921800 - DNA, 25 bp, Mus musculus
ttagaagtgacgtgctgtgtccctc

SEQ ID NO: 921801 - DNA, 25 bp, Mus musculus
ttagaagtgggtcgagcctcctctt

SEQ ID NO: 921802 - DNA, 25 bp, Mus musculus
ttagaagtgggtggagcctcctctt

SEQ ID NO: 921803 - DNA, 25 bp, Mus musculus
ttagaagttaccactcattacagct

SEQ ID NO: 921804 - DNA, 25 bp, Mus musculus
ttagaagttacctctcattacagct

SEQ ID NO: 921805 - DNA, 25 bp, Mus musculus
ttagaagttgtcagcggagttccct

SEQ ID NO: 921806 - DNA, 25 bp, Mus musculus
ttagaagttgtctgcggagttccct

SEQ ID NO: 921807 - DNA, 25 bp, Mus musculus
ttagaagttttacatgcctgccaaa

SEQ ID NO: 921808 - DNA, 25 bp, Mus musculus
ttagaagttttagatgcctgccaaa

SEQ ID NO: 921809 - DNA, 25 bp, Mus musculus
ttagaatacatccaacccaaggctg

SEQ ID NO: 921810 - DNA, 25 bp, Mus musculus
ttagaatacatcgaacccaaggctg

SEQ ID NO: 921811 - DNA, 25 bp, Mus musculus
ttagaatactggagatgactcagca

SEQ ID NO: 921812 - DNA, 25 bp, Mus musculus
ttagaatactggtgatgactcagca

SEQ ID NO: 921813 - DNA, 25 bp, Mus musculus
ttagaatatgctctctagccaagtc

SEQ ID NO: 921814 - DNA, 25 bp, Mus musculus
ttagaatatgctgtctagccaagtc

SEQ ID NO: 921815 - DNA, 25 bp, Mus musculus
ttagaatcacttcttgcagagggcc

SEQ ID NO: 921816 - DNA, 25 bp, Mus musculus
ttagaatcacttgttgcagagggcc

SEQ ID NO: 921817 - DNA, 25 bp, Mus musculus
ttagaatcatttatggcagtggctg

SEQ ID NO: 921818 - DNA, 25 bp, Mus musculus
ttagaatcatttttggcagtggctg

SEQ ID NO: 921819 - DNA, 25 bp, Mus musculus
ttagaatcccctactgtaaaccagt

SEQ ID NO: 921820 - DNA, 25 bp, Mus musculus
ttagaatccccttctgtaaaccagt

SEQ ID NO: 921821 - DNA, 25 bp, Mus musculus
ttagaatcccgaagtcaccatcaac

SEQ ID NO: 921822 - DNA, 25 bp, Mus musculus
ttagaatcccgatgtcaccatcaac

SEQ ID NO: 921823 - DNA, 25 bp, Mus musculus
ttagaatctgctatcctaccgatag

SEQ ID NO: 921824 - DNA, 25 bp, Mus musculus
ttagaatctgctttcctaccgatag

SEQ ID NO: 921825 - DNA, 25 bp, Mus musculus
ttagaatgacttacaggctgtgctt

SEQ ID NO: 921826 - DNA, 25 bp, Mus musculus
ttagaatgactttcaggctgtgctt

SEQ ID NO: 921827 - DNA, 25 bp, Mus musculus
ttagaatgctgaccttccacatggg

SEQ ID NO: 921828 - DNA, 25 bp, Mus musculus
ttagaatgctgagcttccacatggg

SEQ ID NO: 921829 - DNA, 25 bp, Mus musculus
ttagaatgctgtacttccctgatct

SEQ ID NO: 921830 - DNA, 25 bp, Mus musculus
ttagaatgctgttcttccctgatct

SEQ ID NO: 921831 - DNA, 25 bp, Mus musculus
ttagaatgctttcatttccccgtga

SEQ ID NO: 921832 - DNA, 25 bp, Mus musculus
ttagaatgctttgatttccccgtga

SEQ ID NO: 921833 - DNA, 25 bp, Mus musculus
ttagaatggaagctccctgagggca

SEQ ID NO: 921834 - DNA, 25 bp, Mus musculus
ttagaatggaaggtccctgagggca

SEQ ID NO: 921835 - DNA, 25 bp, Mus musculus
ttagaatggcagatttcctggagtc

SEQ ID NO: 921836 - DNA, 25 bp, Mus musculus
ttagaatggcagttttcctggagtc

SEQ ID NO: 921837 - DNA, 25 bp, Mus musculus
ttagaatggccgacacagtgagctt

SEQ ID NO: 921838 - DNA, 25 bp, Mus musculus
ttagaatggccgtcacagtgagctt

SEQ ID NO: 921839 - DNA, 25 bp, Mus musculus
ttagaattcattccttgtgtttaaa

SEQ ID NO: 921840 - DNA, 25 bp, Mus musculus
ttagaattcattgcttgtgtttaaa

SEQ ID NO: 921841 - DNA, 25 bp, Mus musculus
ttagaattctccaagtgcacatcat

SEQ ID NO: 921842 - DNA, 25 bp, Mus musculus
ttagaattctcctagtgcacatcat

SEQ ID NO: 921843 - DNA, 25 bp, Mus musculus
ttagaattgctcagcccatctttca

SEQ ID NO: 921844 - DNA, 25 bp, Mus musculus
ttagaattgctctgcccatctttca

SEQ ID NO: 921845 - DNA, 25 bp, Mus musculus
ttagaattgttcagagactcaggac

SEQ ID NO: 921846 - DNA, 25 bp, Mus musculus
ttagaattgttccttccaggccacc

SEQ ID NO: 921847 - DNA, 25 bp, Mus musculus
ttagaattgttcgttccaggccacc

SEQ ID NO: 921848 - DNA, 25 bp, Mus musculus
ttagaattgttctgagactcaggac

SEQ ID NO: 921849 - DNA, 25 bp, Mus musculus
ttagacaaactcctggcctaactca

SEQ ID NO: 921850 - DNA, 25 bp, Mus musculus
ttagacaaactcgtggcctaactca

SEQ ID NO: 921851 - DNA, 25 bp, Mus musculus
ttagacaaagctcatgaccctattt

SEQ ID NO: 921852 - DNA, 25 bp, Mus musculus
ttagacaaagctgatgaccctattt

SEQ ID NO: 921853 - DNA, 25 bp, Mus musculus
ttagacaaggaactcatggctggga

SEQ ID NO: 921854 - DNA, 25 bp, Mus musculus
ttagacaaggaagtcatggctggga

SEQ ID NO: 921855 - DNA, 25 bp, Mus musculus
ttagacaagtaacagctgcgcagct

SEQ ID NO: 921856 - DNA, 25 bp, Mus musculus
ttagacaagtaagagctgcgcagct

SEQ ID NO: 921857 - DNA, 25 bp, Mus musculus
ttagacaagttcaatttagggagtt

SEQ ID NO: 921858 - DNA, 25 bp, Mus musculus
ttagacaagttctatttagggagtt

SEQ ID NO: 921859 - DNA, 25 bp, Mus musculus
ttagacaatctcaccttgcattagt

SEQ ID NO: 921860 - DNA, 25 bp, Mus musculus
ttagacaatctctccttgcattagt

SEQ ID NO: 921861 - DNA, 25 bp, Mus musculus
ttagacaatgtccttctacccctac

SEQ ID NO: 921862 - DNA, 25 bp, Mus musculus
ttagacaatgtcgttctacccctac

SEQ ID NO: 921863 - DNA, 25 bp, Mus musculus
ttagacaattccaagctcacgagcc

SEQ ID NO: 921864 - DNA, 25 bp, Mus musculus
ttagacaattcctagctcacgagcc

SEQ ID NO: 921865 - DNA, 25 bp, Mus musculus
ttagacacaagacgacccacccagg

SEQ ID NO: 921866 - DNA, 25 bp, Mus musculus
ttagacacaagaggacccacccagg

SEQ ID NO: 921867 - DNA, 25 bp, Mus musculus
ttagacacagagacacacccactaa

SEQ ID NO: 921868 - DNA, 25 bp, Mus musculus
ttagacacagagtcacacccactaa

SEQ ID NO: 921869 - DNA, 25 bp, Mus musculus
ttagacacatcaccagtccttcact

SEQ ID NO: 921870 - DNA, 25 bp, Mus musculus
ttagacacatcagcagtccttcact

SEQ ID NO: 921871 - DNA, 25 bp, Mus musculus
ttagacaccatcacgggtactggcc

SEQ ID NO: 921872 - DNA, 25 bp, Mus musculus
ttagacaccatctcgggtactggcc

SEQ ID NO: 921873 - DNA, 25 bp, Mus musculus
ttagacactgcaaggcatctgcctg

SEQ ID NO: 921874 - DNA, 25 bp, Mus musculus
ttagacactgcatggcatctgcctg

SEQ ID NO: 921875 - DNA, 25 bp, Mus musculus
ttagacactggcaagccaggcacca

SEQ ID NO: 921876 - DNA, 25 bp, Mus musculus
ttagacactggctagccaggcacca

SEQ ID NO: 921877 - DNA, 25 bp, Mus musculus
ttagacacttagattcttcatgctg

SEQ ID NO: 921878 - DNA, 25 bp, Mus musculus
ttagacacttagtttcttcatgctg

SEQ ID NO: 921879 - DNA, 25 bp, Mus musculus
ttagacagatctatgggcaccccag

SEQ ID NO: 921880 - DNA, 25 bp, Mus musculus
ttagacagatctttgggcaccccag

SEQ ID NO: 921881 - DNA, 25 bp, Mus musculus
ttagacagatgccagggtctgccct

SEQ ID NO: 921882 - DNA, 25 bp, Mus musculus
ttagacagatgcgagggtctgccct

SEQ ID NO: 921883 - DNA, 25 bp, Mus musculus
ttagacagctttattcttaagtgct

SEQ ID NO: 921884 - DNA, 25 bp, Mus musculus
ttagacagcttttttcttaagtgct

SEQ ID NO: 921885 - DNA, 25 bp, Mus musculus
ttagacaggagaaggcttcccctgc

SEQ ID NO: 921886 - DNA, 25 bp, Mus musculus
ttagacaggagatggcttcccctgc

SEQ ID NO: 921887 - DNA, 25 bp, Mus musculus
ttagacaggcatagttcgcccattg

SEQ ID NO: 921888 - DNA, 25 bp, Mus musculus
ttagacaggcattgttcgcccattg

SEQ ID NO: 921889 - DNA, 25 bp, Mus musculus
ttagacagtcctaaagtttccagaa

SEQ ID NO: 921890 - DNA, 25 bp, Mus musculus
ttagacagtccttaagtttccagaa

SEQ ID NO: 921891 - DNA, 25 bp, Mus musculus
ttagacagtctcattgtgctcctga

SEQ ID NO: 921892 - DNA, 25 bp, Mus musculus
ttagacagtctctttgtgctcctga

SEQ ID NO: 921893 - DNA, 25 bp, Mus musculus
ttagacagtctgacaatgaatgtgg

SEQ ID NO: 921894 - DNA, 25 bp, Mus musculus
ttagacagtctgtcaatgaatgtgg

SEQ ID NO: 921895 - DNA, 25 bp, Mus musculus
ttagacagtgatccattgccagtag

SEQ ID NO: 921896 - DNA, 25 bp, Mus musculus
ttagacagtgatgcattgccagtag

SEQ ID NO: 921897 - DNA, 25 bp, Mus musculus
ttagacatctggagcccatttcttc

SEQ ID NO: 921898 - DNA, 25 bp, Mus musculus
ttagacatctggtgcccatttcttc

SEQ ID NO: 921899 - DNA, 25 bp, Mus musculus
ttagacatttatcttgctgtgtaga

SEQ ID NO: 921900 - DNA, 25 bp, Mus musculus
ttagacatttatgttgctgtgtaga

SEQ ID NO: 921901 - DNA, 25 bp, Mus musculus
ttagaccaagttaagcttttagagt

SEQ ID NO: 921902 - DNA, 25 bp, Mus musculus
ttagaccaagtttagcttttagagt

SEQ ID NO: 921903 - DNA, 25 bp, Mus musculus
ttagaccaccctcgacacggatggc

SEQ ID NO: 921904 - DNA, 25 bp, Mus musculus
ttagaccaccctggacacggatggc

SEQ ID NO: 921905 - DNA, 25 bp, Mus musculus
ttagaccacttacgttggctcatct

SEQ ID NO: 921906 - DNA, 25 bp, Mus musculus
ttagaccacttaggttggctcatct

SEQ ID NO: 921907 - DNA, 25 bp, Mus musculus
ttagaccagtggctcgtcaaacagc

SEQ ID NO: 921908 - DNA, 25 bp, Mus musculus
ttagaccagtgggtcgtcaaacagc

SEQ ID NO: 921909 - DNA, 25 bp, Mus musculus
ttagacccaccacggcacgtgagaa

SEQ ID NO: 921910 - DNA, 25 bp, Mus musculus
ttagacccaccagggcacgtgagaa

SEQ ID NO: 921911 - DNA, 25 bp, Mus musculus
ttagacccagcgatgcaaggcttgt

SEQ ID NO: 921912 - DNA, 25 bp, Mus musculus
ttagacccagcgttgcaaggcttgt

SEQ ID NO: 921913 - DNA, 25 bp, Mus musculus
ttagacccagtactcctccataggt

SEQ ID NO: 921914 - DNA, 25 bp, Mus musculus
ttagacccagtagtcctccataggt

SEQ ID NO: 921915 - DNA, 25 bp, Mus musculus
ttagacccatgactttgtgccctgt

SEQ ID NO: 921916 - DNA, 25 bp, Mus musculus
ttagacccatgagtttgtgccctgt

SEQ ID NO: 921917 - DNA, 25 bp, Mus musculus
ttagaccccgtcacaaatagaaaat

SEQ ID NO: 921918 - DNA, 25 bp, Mus musculus
ttagaccccgtctcaaatagaaaat

SEQ ID NO: 921919 - DNA, 25 bp, Mus musculus
ttagacccctgactctgtgtgcact

SEQ ID NO: 921920 - DNA, 25 bp, Mus musculus
ttagacccctgagtctgtgtgcact

SEQ ID NO: 921921 - DNA, 25 bp, Mus musculus
ttagaccctacacagttgctttgac

SEQ ID NO: 921922 - DNA, 25 bp, Mus musculus
ttagaccctacagagttgctttgac

SEQ ID NO: 921923 - DNA, 25 bp, Mus musculus
ttagaccctaggaggtactcggtga

SEQ ID NO: 921924 - DNA, 25 bp, Mus musculus
ttagaccctaggtggtactcggtga

SEQ ID NO: 921925 - DNA, 25 bp, Mus musculus
ttagaccctcttcgctgaaggaagc

SEQ ID NO: 921926 - DNA, 25 bp, Mus musculus
ttagaccctcttggctgaaggaagc

SEQ ID NO: 921927 - DNA, 25 bp, Mus musculus
ttagacccttacatctagagatggt

SEQ ID NO: 921928 - DNA, 25 bp, Mus musculus
ttagacccttacttctagagatggt

SEQ ID NO: 921929 - DNA, 25 bp, Mus musculus
ttagaccctttcacattttaccttg

SEQ ID NO: 921930 - DNA, 25 bp, Mus musculus
ttagaccctttccatttagactatg

SEQ ID NO: 921931 - DNA, 25 bp, Mus musculus
ttagaccctttcgatttagactatg

SEQ ID NO: 921932 - DNA, 25 bp, Mus musculus
ttagaccctttctcattttaccttg

SEQ ID NO: 921933 - DNA, 25 bp, Mus musculus
ttagaccggcttatgtagatacaga

SEQ ID NO: 921934 - DNA, 25 bp, Mus musculus
ttagaccggcttttgtagatacaga

SEQ ID NO: 921935 - DNA, 25 bp, Mus musculus
ttagacctacagatgtgattagtga

SEQ ID NO: 921936 - DNA, 25 bp, Mus musculus
ttagacctacagttgtgattagtga

SEQ ID NO: 921937 - DNA, 25 bp, Mus musculus
ttagacctgccactttgaggacgga

SEQ ID NO: 921938 - DNA, 25 bp, Mus musculus
ttagacctgccagtttgaggacgga

SEQ ID NO: 921939 - DNA, 25 bp, Mus musculus
ttagacctgctaaaggcttctcaaa

SEQ ID NO: 921940 - DNA, 25 bp, Mus musculus
ttagacctgctataggcttctcaaa

SEQ ID NO: 921941 - DNA, 25 bp, Mus musculus
ttagacctgcttatgtataaaaaag

SEQ ID NO: 921942 - DNA, 25 bp, Mus musculus
ttagacctgcttttgtataaaaaag

SEQ ID NO: 921943 - DNA, 25 bp, Mus musculus
ttagaccttccactaataaacagcc

SEQ ID NO: 921944 - DNA, 25 bp, Mus musculus
ttagaccttccagtaataaacagcc

SEQ ID NO: 921945 - DNA, 25 bp, Mus musculus
ttagaccttgttctgatatgagcat

SEQ ID NO: 921946 - DNA, 25 bp, Mus musculus
ttagaccttgttgtgatatgagcat

SEQ ID NO: 921947 - DNA, 25 bp, Mus musculus
ttagacctttccatacacagaccct

SEQ ID NO: 921948 - DNA, 25 bp, Mus musculus
ttagacctttccttacacagaccct

SEQ ID NO: 921949 - DNA, 25 bp, Mus musculus
ttagacctttctcttgacgtggaac

SEQ ID NO: 921950 - DNA, 25 bp, Mus musculus
ttagacctttctgttgacgtggaac

SEQ ID NO: 921951 - DNA, 25 bp, Mus musculus
ttagacctttgcatgttccctgaca

SEQ ID NO: 921952 - DNA, 25 bp, Mus musculus
ttagacctttgcttgttccctgaca

SEQ ID NO: 921953 - DNA, 25 bp, Mus musculus
ttagacgagtgacaggaagtgattt

SEQ ID NO: 921954 - DNA, 25 bp, Mus musculus
ttagacgagtgagaggaagtgattt

SEQ ID NO: 921955 - DNA, 25 bp, Mus musculus
ttagacgtcatcaccatttggtaca

SEQ ID NO: 921956 - DNA, 25 bp, Mus musculus
ttagacgtcatctccatttggtaca

SEQ ID NO: 921957 - DNA, 25 bp, Mus musculus
ttagacgtgaggaagccaagaccgg

SEQ ID NO: 921958 - DNA, 25 bp, Mus musculus
ttagacgtgaggtagccaagaccgg

SEQ ID NO: 921959 - DNA, 25 bp, Mus musculus
ttagacgtgcacagcagagacccag

SEQ ID NO: 921960 - DNA, 25 bp, Mus musculus
ttagacgtgcactgcagagacccag

SEQ ID NO: 921961 - DNA, 25 bp, Mus musculus
ttagacgttccaccaatatcacagt

SEQ ID NO: 921962 - DNA, 25 bp, Mus musculus
ttagacgttccagcaatatcacagt

SEQ ID NO: 921963 - DNA, 25 bp, Mus musculus
ttagactaactgatgccccgggaaa

SEQ ID NO: 921964 - DNA, 25 bp, Mus musculus
ttagactaactgttgccccgggaaa

SEQ ID NO: 921965 - DNA, 25 bp, Mus musculus
ttagactacatgaccttctccacgg

SEQ ID NO: 921966 - DNA, 25 bp, Mus musculus
ttagactacatgtccttctccacgg

SEQ ID NO: 921967 - DNA, 25 bp, Mus musculus
ttagactacctgcaccttttcagca

SEQ ID NO: 921968 - DNA, 25 bp, Mus musculus
ttagactacctggaccttttcagca

SEQ ID NO: 921969 - DNA, 25 bp, Mus musculus
ttagactacttcctggtggttagca

SEQ ID NO: 921970 - DNA, 25 bp, Mus musculus
ttagactacttcgtggtggttagca

SEQ ID NO: 921971 - DNA, 25 bp, Mus musculus
ttagactagaccatctttagcccac

SEQ ID NO: 921972 - DNA, 25 bp, Mus musculus
ttagactagaccttctttagcccac

SEQ ID NO: 921973 - DNA, 25 bp, Mus musculus
ttagactatcaccttaaccaacctt

SEQ ID NO: 921974 - DNA, 25 bp, Mus musculus
ttagactatcacgttaaccaacctt

SEQ ID NO: 921975 - DNA, 25 bp, Mus musculus
ttagactcactgagggcccaagggt

SEQ ID NO: 921976 - DNA, 25 bp, Mus musculus
ttagactcactgtgggcccaagggt

SEQ ID NO: 921977 - DNA, 25 bp, Mus musculus
ttagactgactaactgacaacactg

SEQ ID NO: 921978 - DNA, 25 bp, Mus musculus
ttagactgactatctgacaacactg

SEQ ID NO: 921979 - DNA, 25 bp, Mus musculus
ttagactgagtaagcctcggagaca

SEQ ID NO: 921980 - DNA, 25 bp, Mus musculus
ttagactgagtatgcctcggagaca

SEQ ID NO: 921981 - DNA, 25 bp, Mus musculus
ttagactgatgcatacaacgttttc

SEQ ID NO: 921982 - DNA, 25 bp, Mus musculus
ttagactgatgcttacaacgttttc

SEQ ID NO: 921983 - DNA, 25 bp, Mus musculus
ttagactgccccagtggtagggcaa

SEQ ID NO: 921984 - DNA, 25 bp, Mus musculus
ttagactgcccctgtggtagggcaa

SEQ ID NO: 921985 - DNA, 25 bp, Mus musculus
ttagactgctgaaccgggtgatgcg

SEQ ID NO: 921986 - DNA, 25 bp, Mus musculus
ttagactgctgatccgggtgatgcg

SEQ ID NO: 921987 - DNA, 25 bp, Mus musculus
ttagactgcttcctgctaatttagg

SEQ ID NO: 921988 - DNA, 25 bp, Mus musculus
ttagactgcttcgtgctaatttagg

SEQ ID NO: 921989 - DNA, 25 bp, Mus musculus
ttagactgtccaagactgcagggta

SEQ ID NO: 921990 - DNA, 25 bp, Mus musculus
ttagactgtccatgactgcagggta

SEQ ID NO: 921991 - DNA, 25 bp, Mus musculus
ttagactgttgaattttgtttctcc

SEQ ID NO: 921992 - DNA, 25 bp, Mus musculus
ttagactgttgatttttgtttctcc

SEQ ID NO: 921993 - DNA, 25 bp, Mus musculus
ttagacttaatacactttcccagag

SEQ ID NO: 921994 - DNA, 25 bp, Mus musculus
ttagacttaatagactttcccagag

SEQ ID NO: 921995 - DNA, 25 bp, Mus musculus
ttagacttacccctgggatcctgga

SEQ ID NO: 921996 - DNA, 25 bp, Mus musculus
ttagacttacccgtgggatcctgga

SEQ ID NO: 921997 - DNA, 25 bp, Mus musculus
ttagacttgggtactaattagctaa

SEQ ID NO: 921998 - DNA, 25 bp, Mus musculus
ttagacttgggttctaattagctaa

SEQ ID NO: 921999 - DNA, 25 bp, Mus musculus
ttagactttaagacatccccagcca

SEQ ID NO: 922000 - DNA, 25 bp, Mus musculus
ttagactttaagtcatccccagcca

SEQ ID NO: 922001 - DNA, 25 bp, Mus musculus
ttagactttctcagtgctctgtaaa

SEQ ID NO: 922002 - DNA, 25 bp, Mus musculus
ttagactttctccaacatccatgtt

SEQ ID NO: 922003 - DNA, 25 bp, Mus musculus
ttagactttctcgaacatccatgtt

SEQ ID NO: 922004 - DNA, 25 bp, Mus musculus
ttagactttctctgtgctctgtaaa

SEQ ID NO: 922005 - DNA, 25 bp, Mus musculus
ttagagaaacgtccccaagcgtggg

SEQ ID NO: 922006 - DNA, 25 bp, Mus musculus
ttagagaaacgtgcccaagcgtggg

SEQ ID NO: 922007 - DNA, 25 bp, Mus musculus
ttagagaacaagacacgcaaggcgt

SEQ ID NO: 922008 - DNA, 25 bp, Mus musculus
ttagagaacaagtcacgcaaggcgt

SEQ ID NO: 922009 - DNA, 25 bp, Mus musculus
ttagagaaggcgagtactgctatgc

SEQ ID NO: 922010 - DNA, 25 bp, Mus musculus
ttagagaaggcgtgtactgctatgc

SEQ ID NO: 922011 - DNA, 25 bp, Mus musculus
ttagagacaatgctgagctgccttg

SEQ ID NO: 922012 - DNA, 25 bp, Mus musculus
ttagagacaatggtgagctgccttg

SEQ ID NO: 922013 - DNA, 25 bp, Mus musculus
ttagagaccatgcactatgtaaact

SEQ ID NO: 922014 - DNA, 25 bp, Mus musculus
ttagagaccatggactatgtaaact

SEQ ID NO: 922015 - DNA, 25 bp, Mus musculus
ttagagacgattacaagcggaggcg

SEQ ID NO: 922016 - DNA, 25 bp, Mus musculus
ttagagacgatttcaagcggaggcg

SEQ ID NO: 922017 - DNA, 25 bp, Mus musculus
ttagagactaacagttgtttccaca

SEQ ID NO: 922018 - DNA, 25 bp, Mus musculus
ttagagactaactgttgtttccaca

SEQ ID NO: 922019 - DNA, 25 bp, Mus musculus
ttagagactacaaaaccttcatgct

SEQ ID NO: 922020 - DNA, 25 bp, Mus musculus
ttagagactacataaccttcatgct

SEQ ID NO: 922021 - DNA, 25 bp, Mus musculus
ttagagactaccctattcaccctag

SEQ ID NO: 922022 - DNA, 25 bp, Mus musculus
ttagagactaccgtattcaccctag

SEQ ID NO: 922023 - DNA, 25 bp, Mus musculus
ttagagactaggaaggtggctcagt

SEQ ID NO: 922024 - DNA, 25 bp, Mus musculus
ttagagactaggtaggtggctcagt

SEQ ID NO: 922025 - DNA, 25 bp, Mus musculus
ttagagactgtccaacccggaagac

SEQ ID NO: 922026 - DNA, 25 bp, Mus musculus
ttagagactgtcgaacccggaagac

SEQ ID NO: 922027 - DNA, 25 bp, Mus musculus
ttagagagacagagcaattccagtt

SEQ ID NO: 922028 - DNA, 25 bp, Mus musculus
ttagagagacagtgcaattccagtt

SEQ ID NO: 922029 - DNA, 25 bp, Mus musculus
ttagagagacctctacttctcccca

SEQ ID NO: 922030 - DNA, 25 bp, Mus musculus
ttagagagacctgtacttctcccca

SEQ ID NO: 922031 - DNA, 25 bp, Mus musculus
ttagagagagaacctgtgcccaatt

SEQ ID NO: 922032 - DNA, 25 bp, Mus musculus
ttagagagagaagctgtgcccaatt

SEQ ID NO: 922033 - DNA, 25 bp, Mus musculus
ttagagagatgacacacctactgct

SEQ ID NO: 922034 - DNA, 25 bp, Mus musculus
ttagagagatgagacacctactgct

SEQ ID NO: 922035 - DNA, 25 bp, Mus musculus
ttagagagccaacgcctcctgtagc

SEQ ID NO: 922036 - DNA, 25 bp, Mus musculus
ttagagagccaaggcctcctgtagc

SEQ ID NO: 922037 - DNA, 25 bp, Mus musculus
ttagagaggaacctgccttccgtgc

SEQ ID NO: 922038 - DNA, 25 bp, Mus musculus
ttagagaggaacgtgccttccgtgc

SEQ ID NO: 922039 - DNA, 25 bp, Mus musculus
ttagagagggcactcctggtccaga

SEQ ID NO: 922040 - DNA, 25 bp, Mus musculus
ttagagagggcagtcctggtccaga

SEQ ID NO: 922041 - DNA, 25 bp, Mus musculus
ttagagaggtctctacaaatgtgtt

SEQ ID NO: 922042 - DNA, 25 bp, Mus musculus
ttagagaggtctgtacaaatgtgtt

SEQ ID NO: 922043 - DNA, 25 bp, Mus musculus
ttagagagtagtattcctcccttct

SEQ ID NO: 922044 - DNA, 25 bp, Mus musculus
ttagagagtagttttcctcccttct

SEQ ID NO: 922045 - DNA, 25 bp, Mus musculus
ttagagagtgggaagatttgtatat

SEQ ID NO: 922046 - DNA, 25 bp, Mus musculus
ttagagagtgggtagatttgtatat

SEQ ID NO: 922047 - DNA, 25 bp, Mus musculus
ttagagagttggaccactatattgt

SEQ ID NO: 922048 - DNA, 25 bp, Mus musculus
ttagagagttggtccactatattgt

SEQ ID NO: 922049 - DNA, 25 bp, Mus musculus
ttagagatacataccatccctgtca

SEQ ID NO: 922050 - DNA, 25 bp, Mus musculus
ttagagatacattccatccctgtca

SEQ ID NO: 922051 - DNA, 25 bp, Mus musculus
ttagagatcatcactctgccgagag

SEQ ID NO: 922052 - DNA, 25 bp, Mus musculus
ttagagatcatctctctgccgagag

SEQ ID NO: 922053 - DNA, 25 bp, Mus musculus
ttagagatgatgctttttccccttc

SEQ ID NO: 922054 - DNA, 25 bp, Mus musculus
ttagagatgatggtttttccccttc

SEQ ID NO: 922055 - DNA, 25 bp, Mus musculus
ttagagcaactcatttgacccgtgg

SEQ ID NO: 922056 - DNA, 25 bp, Mus musculus
ttagagcaactcttttgacccgtgg

SEQ ID NO: 922057 - DNA, 25 bp, Mus musculus
ttagagcacggactccgtccagttg

SEQ ID NO: 922058 - DNA, 25 bp, Mus musculus
ttagagcacggagtccgtccagttg

SEQ ID NO: 922059 - DNA, 25 bp, Mus musculus
ttagagcagcctatcctcttggatc

SEQ ID NO: 922060 - DNA, 25 bp, Mus musculus
ttagagcagcctttcctcttggatc

SEQ ID NO: 922061 - DNA, 25 bp, Mus musculus
ttagagcaggccctttatatctcct

SEQ ID NO: 922062 - DNA, 25 bp, Mus musculus
ttagagcaggccgtttatatctcct

SEQ ID NO: 922063 - DNA, 25 bp, Mus musculus
ttagagccacggattgagcgcccac

SEQ ID NO: 922064 - DNA, 25 bp, Mus musculus
ttagagccacggtttgagcgcccac

SEQ ID NO: 922065 - DNA, 25 bp, Mus musculus
ttagagccctgccaggaaggtatca

SEQ ID NO: 922066 - DNA, 25 bp, Mus musculus
ttagagccctgcgaggaaggtatca

SEQ ID NO: 922067 - DNA, 25 bp, Mus musculus
ttagagccgagtcgcatggctgccc

SEQ ID NO: 922068 - DNA, 25 bp, Mus musculus
ttagagccgagtggcatggctgccc

SEQ ID NO: 922069 - DNA, 25 bp, Mus musculus
ttagagcctgcgacatccgtgttca

SEQ ID NO: 922070 - DNA, 25 bp, Mus musculus
ttagagcctgcgtcatccgtgttca

SEQ ID NO: 922071 - DNA, 25 bp, Mus musculus
ttagagcgagagaacccttggtcct

SEQ ID NO: 922072 - DNA, 25 bp, Mus musculus
ttagagcgagagtacccttggtcct

SEQ ID NO: 922073 - DNA, 25 bp, Mus musculus
ttagagcgaggcaggtgctgtcccc

SEQ ID NO: 922074 - DNA, 25 bp, Mus musculus
ttagagcgaggctggtgctgtcccc

SEQ ID NO: 922075 - DNA, 25 bp, Mus musculus
ttagagctccaacctaccttaaggg

SEQ ID NO: 922076 - DNA, 25 bp, Mus musculus
ttagagctccaagctaccttaaggg

SEQ ID NO: 922077 - DNA, 25 bp, Mus musculus
ttagagctcccactgatgtgaaccc

SEQ ID NO: 922078 - DNA, 25 bp, Mus musculus
ttagagctcccagtgatgtgaaccc

SEQ ID NO: 922079 - DNA, 25 bp, Mus musculus
ttagagctgagtagccataaacact

SEQ ID NO: 922080 - DNA, 25 bp, Mus musculus
ttagagctgagttgccataaacact

SEQ ID NO: 922081 - DNA, 25 bp, Mus musculus
ttagagctgctaccgcagtagtgcc

SEQ ID NO: 922082 - DNA, 25 bp, Mus musculus
ttagagctgctagcgcagtagtgcc

SEQ ID NO: 922083 - DNA, 25 bp, Mus musculus
ttagagctgctcatatcagggctgc

SEQ ID NO: 922084 - DNA, 25 bp, Mus musculus
ttagagctgctcttatcagggctgc

SEQ ID NO: 922085 - DNA, 25 bp, Mus musculus
ttagagctggccacatcacagttgt

SEQ ID NO: 922086 - DNA, 25 bp, Mus musculus
ttagagctggcctcatcacagttgt

SEQ ID NO: 922087 - DNA, 25 bp, Mus musculus
ttagagctgtggacacgataggcac

SEQ ID NO: 922088 - DNA, 25 bp, Mus musculus
ttagagctgtggtcacgataggcac

SEQ ID NO: 922089 - DNA, 25 bp, Mus musculus
ttagagcttctaatgaccacacaga

SEQ ID NO: 922090 - DNA, 25 bp, Mus musculus
ttagagcttctattgaccacacaga

SEQ ID NO: 922091 - DNA, 25 bp, Mus musculus
ttagaggaacatcccaccactagtt

SEQ ID NO: 922092 - DNA, 25 bp, Mus musculus
ttagaggaacatgccaccactagtt

SEQ ID NO: 922093 - DNA, 25 bp, Mus musculus
ttagaggaatggctgggccaccctt

SEQ ID NO: 922094 - DNA, 25 bp, Mus musculus
ttagaggaatgggtgggccaccctt

SEQ ID NO: 922095 - DNA, 25 bp, Mus musculus
ttagaggacttgatgggctcatttt

SEQ ID NO: 922096 - DNA, 25 bp, Mus musculus
ttagaggacttgttgggctcatttt

SEQ ID NO: 922097 - DNA, 25 bp, Mus musculus
ttagaggcaccgaccagtaacaggg

SEQ ID NO: 922098 - DNA, 25 bp, Mus musculus
ttagaggcaccgtccagtaacaggg

SEQ ID NO: 922099 - DNA, 25 bp, Mus musculus
ttagaggcactcaaacgtgcggata

SEQ ID NO: 922100 - DNA, 25 bp, Mus musculus
ttagaggcactctaacgtgcggata

SEQ ID NO: 922101 - DNA, 25 bp, Mus musculus
ttagaggcattcatgttcttcccta

SEQ ID NO: 922102 - DNA, 25 bp, Mus musculus
ttagaggcattcttgttcttcccta

SEQ ID NO: 922103 - DNA, 25 bp, Mus musculus
ttagaggccaacatgcctctgtggc

SEQ ID NO: 922104 - DNA, 25 bp, Mus musculus
ttagaggccaacttgcctctgtggc

SEQ ID NO: 922105 - DNA, 25 bp, Mus musculus
ttagaggccatacagagttgtttct

SEQ ID NO: 922106 - DNA, 25 bp, Mus musculus
ttagaggccatagagagttgtttct

SEQ ID NO: 922107 - DNA, 25 bp, Mus musculus
ttagaggcccaaacttttaaatgat

SEQ ID NO: 922108 - DNA, 25 bp, Mus musculus
ttagaggcccaatcttttaaatgat

SEQ ID NO: 922109 - DNA, 25 bp, Mus musculus
ttagaggcgtcactgaggcaatcca

SEQ ID NO: 922110 - DNA, 25 bp, Mus musculus
ttagaggcgtcagtgaggcaatcca

SEQ ID NO: 922111 - DNA, 25 bp, Mus musculus
ttagaggcttctcactggccatcat

SEQ ID NO: 922112 - DNA, 25 bp, Mus musculus
ttagaggcttctgactggccatcat

SEQ ID NO: 922113 - DNA, 25 bp, Mus musculus
ttagaggcttgtcgctctgttccca

SEQ ID NO: 922114 - DNA, 25 bp, Mus musculus
ttagaggcttgtggctctgttccca

SEQ ID NO: 922115 - DNA, 25 bp, Mus musculus
ttagagggagggagataaccaagct

SEQ ID NO: 922116 - DNA, 25 bp, Mus musculus
ttagagggagggtgataaccaagct

SEQ ID NO: 922117 - DNA, 25 bp, Mus musculus
ttagagggccacagcgttacacagg

SEQ ID NO: 922118 - DNA, 25 bp, Mus musculus
ttagagggccactgcgttacacagg

SEQ ID NO: 922119 - DNA, 25 bp, Mus musculus
ttagagggtcagcaacccagactgg

SEQ ID NO: 922120 - DNA, 25 bp, Mus musculus
ttagagggtcaggaacccagactgg

SEQ ID NO: 922121 - DNA, 25 bp, Mus musculus
ttagaggtacccacaaattgccccg

SEQ ID NO: 922122 - DNA, 25 bp, Mus musculus
ttagaggtaccctcaaattgccccg

SEQ ID NO: 922123 - DNA, 25 bp, Mus musculus
ttagaggtagaccttcagcacaata

SEQ ID NO: 922124 - DNA, 25 bp, Mus musculus
ttagaggtagacgttcagcacaata

SEQ ID NO: 922125 - DNA, 25 bp, Mus musculus
ttagaggtcatcatactatgcagaa

SEQ ID NO: 922126 - DNA, 25 bp, Mus musculus
ttagaggtcatcttactatgcagaa

SEQ ID NO: 922127 - DNA, 25 bp, Mus musculus
ttagaggtggctctcccggagaaca

SEQ ID NO: 922128 - DNA, 25 bp, Mus musculus
ttagaggtggctgtcccggagaaca

SEQ ID NO: 922129 - DNA, 25 bp, Mus musculus
ttagagtatgctcttcacttcgtgc

SEQ ID NO: 922130 - DNA, 25 bp, Mus musculus
ttagagtatgctgttcacttcgtgc

SEQ ID NO: 922131 - DNA, 25 bp, Mus musculus
ttagagtattctacgggctgcaatt

SEQ ID NO: 922132 - DNA, 25 bp, Mus musculus
ttagagtattcttcgggctgcaatt

SEQ ID NO: 922133 - DNA, 25 bp, Mus musculus
ttagagtcacacacaggagcgcagt

SEQ ID NO: 922134 - DNA, 25 bp, Mus musculus
ttagagtcacactcaggagcgcagt

SEQ ID NO: 922135 - DNA, 25 bp, Mus musculus
ttagagtccaggaacttggcccaca

SEQ ID NO: 922136 - DNA, 25 bp, Mus musculus
ttagagtccaggtacttggcccaca

SEQ ID NO: 922137 - DNA, 25 bp, Mus musculus
ttagagtccattagactgggagact

SEQ ID NO: 922138 - DNA, 25 bp, Mus musculus
ttagagtccatttgactgggagact

SEQ ID NO: 922139 - DNA, 25 bp, Mus musculus
ttagagtcggccagctgtcattgct

SEQ ID NO: 922140 - DNA, 25 bp, Mus musculus
ttagagtcggcctgctgtcattgct

SEQ ID NO: 922141 - DNA, 25 bp, Mus musculus
ttagagtcgtctcctggccacagag

SEQ ID NO: 922142 - DNA, 25 bp, Mus musculus
ttagagtcgtctgctggccacagag

SEQ ID NO: 922143 - DNA, 25 bp, Mus musculus
ttagagtctgggactggcttgcctc

SEQ ID NO: 922144 - DNA, 25 bp, Mus musculus
ttagagtctgggtctggcttgcctc

SEQ ID NO: 922145 - DNA, 25 bp, Mus musculus
ttagagtcttatatattctgccctt

SEQ ID NO: 922146 - DNA, 25 bp, Mus musculus
ttagagtcttatttattctgccctt

SEQ ID NO: 922147 - DNA, 25 bp, Mus musculus
ttagagtgaccaataaacttgaccc

SEQ ID NO: 922148 - DNA, 25 bp, Mus musculus
ttagagtgaccattaaacttgaccc

SEQ ID NO: 922149 - DNA, 25 bp, Mus musculus
ttagagtgcactcctggcaccatta

SEQ ID NO: 922150 - DNA, 25 bp, Mus musculus
ttagagtgcactgctggcaccatta

SEQ ID NO: 922151 - DNA, 25 bp, Mus musculus
ttagagtgcccgaagccatggcttc

SEQ ID NO: 922152 - DNA, 25 bp, Mus musculus
ttagagtgcccgtagccatggcttc

SEQ ID NO: 922153 - DNA, 25 bp, Mus musculus
ttagagtgccctaagtcggacctgg

SEQ ID NO: 922154 - DNA, 25 bp, Mus musculus
ttagagtgcccttagtcggacctgg

SEQ ID NO: 922155 - DNA, 25 bp, Mus musculus
ttagagtgcttgagtgtaatttctt

SEQ ID NO: 922156 - DNA, 25 bp, Mus musculus
ttagagtgcttgtgtgtaatttctt

SEQ ID NO: 922157 - DNA, 25 bp, Mus musculus
ttagagtgggttactgtccttgcaa

SEQ ID NO: 922158 - DNA, 25 bp, Mus musculus
ttagagtgggtttctgtccttgcaa

SEQ ID NO: 922159 - DNA, 25 bp, Mus musculus
ttagagtgtggcaatgtgccccagt

SEQ ID NO: 922160 - DNA, 25 bp, Mus musculus
ttagagtgtggctatgtgccccagt

SEQ ID NO: 922161 - DNA, 25 bp, Mus musculus
ttagagtgttcaaagcaggcccgag

SEQ ID NO: 922162 - DNA, 25 bp, Mus musculus
ttagagtgttcatagcaggcccgag

SEQ ID NO: 922163 - DNA, 25 bp, Mus musculus
ttagagttacctctgttaggaaata

SEQ ID NO: 922164 - DNA, 25 bp, Mus musculus
ttagagttacctgtgttaggaaata

SEQ ID NO: 922165 - DNA, 25 bp, Mus musculus
ttagagttattcaccatttccccat

SEQ ID NO: 922166 - DNA, 25 bp, Mus musculus
ttagagttattctccatttccccat

SEQ ID NO: 922167 - DNA, 25 bp, Mus musculus
ttagagttccggctgtttcgtgtga

SEQ ID NO: 922168 - DNA, 25 bp, Mus musculus
ttagagttccgggtgtttcgtgtga

SEQ ID NO: 922169 - DNA, 25 bp, Mus musculus
ttagagttggtcaggcgcccacgag

SEQ ID NO: 922170 - DNA, 25 bp, Mus musculus
ttagagttggtctggcgcccacgag

SEQ ID NO: 922171 - DNA, 25 bp, Mus musculus
ttagagtttacaccttttccctcca

SEQ ID NO: 922172 - DNA, 25 bp, Mus musculus
ttagagtttacagcttttccctcca

SEQ ID NO: 922173 - DNA, 25 bp, Mus musculus
ttagagttttcgctggcctatcttg

SEQ ID NO: 922174 - DNA, 25 bp, Mus musculus
ttagagttttcggtggcctatcttg

SEQ ID NO: 922175 - DNA, 25 bp, Mus musculus
ttagagttttgtaagccagtcggcc

SEQ ID NO: 922176 - DNA, 25 bp, Mus musculus
ttagagttttgttagccagtcggcc

SEQ ID NO: 922177 - DNA, 25 bp, Mus musculus
ttagataaagtcactcctcgtcact

SEQ ID NO: 922178 - DNA, 25 bp, Mus musculus
ttagataaagtctctcctcgtcact

SEQ ID NO: 922179 - DNA, 25 bp, Mus musculus
ttagataaatttcaggacatggtcc

SEQ ID NO: 922180 - DNA, 25 bp, Mus musculus
ttagataaatttgaggacatggtcc

SEQ ID NO: 922181 - DNA, 25 bp, Mus musculus
ttagataagagaccctagcccttcg

SEQ ID NO: 922182 - DNA, 25 bp, Mus musculus
ttagataagagagcctagcccttcg

SEQ ID NO: 922183 - DNA, 25 bp, Mus musculus
ttagataattcgagcatgtttgtgt

SEQ ID NO: 922184 - DNA, 25 bp, Mus musculus
ttagataattcgtgcatgtttgtgt

SEQ ID NO: 922185 - DNA, 25 bp, Mus musculus
ttagatacaagacccagtgctgcac

SEQ ID NO: 922186 - DNA, 25 bp, Mus musculus
ttagatacaagagccagtgctgcac

SEQ ID NO: 922187 - DNA, 25 bp, Mus musculus
ttagataccactcttcccttgagga

SEQ ID NO: 922188 - DNA, 25 bp, Mus musculus
ttagataccactgttcccttgagga

SEQ ID NO: 922189 - DNA, 25 bp, Mus musculus
ttagatacccacaattgctgctgct

SEQ ID NO: 922190 - DNA, 25 bp, Mus musculus
ttagatacccactattgctgctgct

SEQ ID NO: 922191 - DNA, 25 bp, Mus musculus
ttagatacctgtctgcacacaatgc

SEQ ID NO: 922192 - DNA, 25 bp, Mus musculus
ttagatacctgtgtgcacacaatgc

SEQ ID NO: 922193 - DNA, 25 bp, Mus musculus
ttagatactgtcaccaccagccagg

SEQ ID NO: 922194 - DNA, 25 bp, Mus musculus
ttagatactgtctccaccagccagg

SEQ ID NO: 922195 - DNA, 25 bp, Mus musculus
ttagatagaactcacctgaagcctc

SEQ ID NO: 922196 - DNA, 25 bp, Mus musculus
ttagatagaactgacctgaagcctc

SEQ ID NO: 922197 - DNA, 25 bp, Mus musculus
ttagatagaggcaggtgatcagaaa

SEQ ID NO: 922198 - DNA, 25 bp, Mus musculus
ttagatagaggctggtgatcagaaa

SEQ ID NO: 922199 - DNA, 25 bp, Mus musculus
ttagataggcataccactctctgtg

SEQ ID NO: 922200 - DNA, 25 bp, Mus musculus
ttagataggcattccactctctgtg

SEQ ID NO: 922201 - DNA, 25 bp, Mus musculus
ttagatagtcacagggatggctcca

SEQ ID NO: 922202 - DNA, 25 bp, Mus musculus
ttagatagtcactgggatggctcca

SEQ ID NO: 922203 - DNA, 25 bp, Mus musculus
ttagatatcttgatccctttaccac

SEQ ID NO: 922204 - DNA, 25 bp, Mus musculus
ttagatatcttgttccctttaccac

SEQ ID NO: 922205 - DNA, 25 bp, Mus musculus
ttagatatgtgtcaccggtgcctga

SEQ ID NO: 922206 - DNA, 25 bp, Mus musculus
ttagatatgtgtgaccggtgcctga

SEQ ID NO: 922207 - DNA, 25 bp, Mus musculus
ttagatattgccagactcctcttct

SEQ ID NO: 922208 - DNA, 25 bp, Mus musculus
ttagatattgcctgactcctcttct

SEQ ID NO: 922209 - DNA, 25 bp, Mus musculus
ttagatcaacagaaagaacagccct

SEQ ID NO: 922210 - DNA, 25 bp, Mus musculus
ttagatcaacagtaagaacagccct

SEQ ID NO: 922211 - DNA, 25 bp, Mus musculus
ttagatcaatcactagggtccccac

SEQ ID NO: 922212 - DNA, 25 bp, Mus musculus
ttagatcaatcagtagggtccccac

SEQ ID NO: 922213 - DNA, 25 bp, Mus musculus
ttagatcagtaccttgctcagtcat

SEQ ID NO: 922214 - DNA, 25 bp, Mus musculus
ttagatcagtacgttgctcagtcat

SEQ ID NO: 922215 - DNA, 25 bp, Mus musculus
ttagatccacctactggatgctttg

SEQ ID NO: 922216 - DNA, 25 bp, Mus musculus
ttagatccaccttctggatgctttg

SEQ ID NO: 922217 - DNA, 25 bp, Mus musculus
ttagatccactgcgtcacgttacct

SEQ ID NO: 922218 - DNA, 25 bp, Mus musculus
ttagatccactgggtcacgttacct

SEQ ID NO: 922219 - DNA, 25 bp, Mus musculus
ttagatcccctacaattagagttat

SEQ ID NO: 922220 - DNA, 25 bp, Mus musculus
ttagatcccctagaattagagttat

SEQ ID NO: 922221 - DNA, 25 bp, Mus musculus
ttagatcgggtcctggtcctgtagt

SEQ ID NO: 922222 - DNA, 25 bp, Mus musculus
ttagatcgggtcgtggtcctgtagt

SEQ ID NO: 922223 - DNA, 25 bp, Mus musculus
ttagatctcactcagcaacaagtac

SEQ ID NO: 922224 - DNA, 25 bp, Mus musculus
ttagatctcactgagcaacaagtac

SEQ ID NO: 922225 - DNA, 25 bp, Mus musculus
ttagatctcctgaggctccactgaa

SEQ ID NO: 922226 - DNA, 25 bp, Mus musculus
ttagatctcctgtggctccactgaa

SEQ ID NO: 922227 - DNA, 25 bp, Mus musculus
ttagatctctcaatgcttttcctgc

SEQ ID NO: 922228 - DNA, 25 bp, Mus musculus
ttagatctctcattgcttttcctgc

SEQ ID NO: 922229 - DNA, 25 bp, Mus musculus
ttagatctgcctatatcagcctcct

SEQ ID NO: 922230 - DNA, 25 bp, Mus musculus
ttagatctgcctttatcagcctcct

SEQ ID NO: 922231 - DNA, 25 bp, Mus musculus
ttagatctgtgtccctggtttgcag

SEQ ID NO: 922232 - DNA, 25 bp, Mus musculus
ttagatctgtgtgcctggtttgcag

SEQ ID NO: 922233 - DNA, 25 bp, Mus musculus
ttagatcttagcattctgtcagaat

SEQ ID NO: 922234 - DNA, 25 bp, Mus musculus
ttagatcttagctttctgtcagaat

SEQ ID NO: 922235 - DNA, 25 bp, Mus musculus
ttagatcttgtcaacttcaccaaag

SEQ ID NO: 922236 - DNA, 25 bp, Mus musculus
ttagatcttgtctacttcaccaaag

SEQ ID NO: 922237 - DNA, 25 bp, Mus musculus
ttagatctttaaccttgcagctgcc

SEQ ID NO: 922238 - DNA, 25 bp, Mus musculus
ttagatctttaagcttgcagctgcc

SEQ ID NO: 922239 - DNA, 25 bp, Mus musculus
ttagatctttgcactatgtagctct

SEQ ID NO: 922240 - DNA, 25 bp, Mus musculus
ttagatctttgctctatgtagctct

SEQ ID NO: 922241 - DNA, 25 bp, Mus musculus
ttagatgaaagcagtgtcccgccct

SEQ ID NO: 922242 - DNA, 25 bp, Mus musculus
ttagatgaaagctgtgtcccgccct

SEQ ID NO: 922243 - DNA, 25 bp, Mus musculus
ttagatgaacccatgcacacggtct

SEQ ID NO: 922244 - DNA, 25 bp, Mus musculus
ttagatgaacccttgcacacggtct

SEQ ID NO: 922245 - DNA, 25 bp, Mus musculus
ttagatgaagccactctgctgctgt

SEQ ID NO: 922246 - DNA, 25 bp, Mus musculus
ttagatgaagcctctctgctgctgt

SEQ ID NO: 922247 - DNA, 25 bp, Mus musculus
ttagatgacattccctccatgccct

SEQ ID NO: 922248 - DNA, 25 bp, Mus musculus
ttagatgacattgcctccatgccct

SEQ ID NO: 922249 - DNA, 25 bp, Mus musculus
ttagatgactccctattttattccc

SEQ ID NO: 922250 - DNA, 25 bp, Mus musculus
ttagatgactccgtattttattccc

SEQ ID NO: 922251 - DNA, 25 bp, Mus musculus
ttagatgcaacccagtgctaccaca

SEQ ID NO: 922252 - DNA, 25 bp, Mus musculus
ttagatgcaaccgagtgctaccaca

SEQ ID NO: 922253 - DNA, 25 bp, Mus musculus
ttagatgcagtcacaacagggtttg

SEQ ID NO: 922254 - DNA, 25 bp, Mus musculus
ttagatgcagtctcaacagggtttg

SEQ ID NO: 922255 - DNA, 25 bp, Mus musculus
ttagatgccactctttactctgctg

SEQ ID NO: 922256 - DNA, 25 bp, Mus musculus
ttagatgccactgtttactctgctg

SEQ ID NO: 922257 - DNA, 25 bp, Mus musculus
ttagatgcgtcacaagtgcgcgcgc

SEQ ID NO: 922258 - DNA, 25 bp, Mus musculus
ttagatgcgtcagaagtgcgcgcgc

SEQ ID NO: 922259 - DNA, 25 bp, Mus musculus
ttagatgctataagggtgtcaaaac

SEQ ID NO: 922260 - DNA, 25 bp, Mus musculus
ttagatgctatatgggtgtcaaaac

SEQ ID NO: 922261 - DNA, 25 bp, Mus musculus
ttagatgctgctaaaccaaggcaag

SEQ ID NO: 922262 - DNA, 25 bp, Mus musculus
ttagatgctgcttaaccaaggcaag

SEQ ID NO: 922263 - DNA, 25 bp, Mus musculus
ttagatgctgttaagggctgtttaa

SEQ ID NO: 922264 - DNA, 25 bp, Mus musculus
ttagatgctgtttagggctgtttaa

SEQ ID NO: 922265 - DNA, 25 bp, Mus musculus
ttagatgctttcactggctactcac

SEQ ID NO: 922266 - DNA, 25 bp, Mus musculus
ttagatgctttctctggctactcac

SEQ ID NO: 922267 - DNA, 25 bp, Mus musculus
ttagatggcactccctactgaaggc

SEQ ID NO: 922268 - DNA, 25 bp, Mus musculus
ttagatggcactgcctactgaaggc

SEQ ID NO: 922269 - DNA, 25 bp, Mus musculus
ttagatggcaggatcagcggaaagt

SEQ ID NO: 922270 - DNA, 25 bp, Mus musculus
ttagatggcaggttcagcggaaagt

SEQ ID NO: 922271 - DNA, 25 bp, Mus musculus
ttagatgggcctacaatgacaagca

SEQ ID NO: 922272 - DNA, 25 bp, Mus musculus
ttagatgggccttcaatgacaagca

SEQ ID NO: 922273 - DNA, 25 bp, Mus musculus
ttagatggtgtgaaagctccgcccc

SEQ ID NO: 922274 - DNA, 25 bp, Mus musculus
ttagatggtgtgtaagctccgcccc

SEQ ID NO: 922275 - DNA, 25 bp, Mus musculus
ttagatgtaggaacctcagttttga

SEQ ID NO: 922276 - DNA, 25 bp, Mus musculus
ttagatgtaggatcctcagttttga

SEQ ID NO: 922277 - DNA, 25 bp, Mus musculus
ttagatgtatatctggattccagtc

SEQ ID NO: 922278 - DNA, 25 bp, Mus musculus
ttagatgtatatgtggattccagtc

SEQ ID NO: 922279 - DNA, 25 bp, Mus musculus
ttagatgtattgagcactgtgtaac

SEQ ID NO: 922280 - DNA, 25 bp, Mus musculus
ttagatgtattgtgcactgtgtaac

SEQ ID NO: 922281 - DNA, 25 bp, Mus musculus
ttagatgtcaccctatccttcaatc

SEQ ID NO: 922282 - DNA, 25 bp, Mus musculus
ttagatgtcaccgtatccttcaatc

SEQ ID NO: 922283 - DNA, 25 bp, Mus musculus
ttagatgtcagaacaccttctttgc

SEQ ID NO: 922284 - DNA, 25 bp, Mus musculus
ttagatgtcagatcaccttctttgc

SEQ ID NO: 922285 - DNA, 25 bp, Mus musculus
ttagatgtgatcaggcataaaccct

SEQ ID NO: 922286 - DNA, 25 bp, Mus musculus
ttagatgtgatctggcataaaccct

SEQ ID NO: 922287 - DNA, 25 bp, Mus musculus
ttagatgtgcttcccagactctgaa

SEQ ID NO: 922288 - DNA, 25 bp, Mus musculus
ttagatgtgcttgccagactctgaa

SEQ ID NO: 922289 - DNA, 25 bp, Mus musculus
ttagatgtggagctgcaagaagaat

SEQ ID NO: 922290 - DNA, 25 bp, Mus musculus
ttagatgtggaggtgcaagaagaat

SEQ ID NO: 922291 - DNA, 25 bp, Mus musculus
ttagatgttttccttgatacccacc

SEQ ID NO: 922292 - DNA, 25 bp, Mus musculus
ttagatgttttcgttgatacccacc

SEQ ID NO: 922293 - DNA, 25 bp, Mus musculus
ttagattaaaccacaagtgctccct

SEQ ID NO: 922294 - DNA, 25 bp, Mus musculus
ttagattaaacctcaagtgctccct

SEQ ID NO: 922295 - DNA, 25 bp, Mus musculus
ttagattagtgaatctcttggccct

SEQ ID NO: 922296 - DNA, 25 bp, Mus musculus
ttagattagtgattctcttggccct

SEQ ID NO: 922297 - DNA, 25 bp, Mus musculus
ttagattatgaaacccacgagctgg

SEQ ID NO: 922298 - DNA, 25 bp, Mus musculus
ttagattatgaatcccacgagctgg

SEQ ID NO: 922299 - DNA, 25 bp, Mus musculus
ttagattatttgacagaagtgcctc

SEQ ID NO: 922300 - DNA, 25 bp, Mus musculus
ttagattatttgtcagaagtgcctc

SEQ ID NO: 922301 - DNA, 25 bp, Mus musculus
ttagattcaacaactcttagcaggg

SEQ ID NO: 922302 - DNA, 25 bp, Mus musculus
ttagattcaacatctcttagcaggg

SEQ ID NO: 922303 - DNA, 25 bp, Mus musculus
ttagattcaagcatacacccttggc

SEQ ID NO: 922304 - DNA, 25 bp, Mus musculus
ttagattcaagcttacacccttggc

SEQ ID NO: 922305 - DNA, 25 bp, Mus musculus
ttagattcagccaaagtcctgcagg

SEQ ID NO: 922306 - DNA, 25 bp, Mus musculus
ttagattcagcctaagtcctgcagg

SEQ ID NO: 922307 - DNA, 25 bp, Mus musculus
ttagattcccctctcatcaaaggtt

SEQ ID NO: 922308 - DNA, 25 bp, Mus musculus
ttagattcccctgtcatcaaaggtt

SEQ ID NO: 922309 - DNA, 25 bp, Mus musculus
ttagattcgtttctgtcttcggtcc

SEQ ID NO: 922310 - DNA, 25 bp, Mus musculus
ttagattcgtttgtgtcttcggtcc

SEQ ID NO: 922311 - DNA, 25 bp, Mus musculus
ttagattgctgcatggtcaacccta

SEQ ID NO: 922312 - DNA, 25 bp, Mus musculus
ttagattgctgcttggtcaacccta

SEQ ID NO: 922313 - DNA, 25 bp, Mus musculus
ttagattgtcctatgaaagtggcag

SEQ ID NO: 922314 - DNA, 25 bp, Mus musculus
ttagattgtcctttgaaagtggcag

SEQ ID NO: 922315 - DNA, 25 bp, Mus musculus
ttagatttagtaataaccagctttt

SEQ ID NO: 922316 - DNA, 25 bp, Mus musculus
ttagatttagtattaaccagctttt

SEQ ID NO: 922317 - DNA, 25 bp, Mus musculus
ttagatttcagcctctagacttagg

SEQ ID NO: 922318 - DNA, 25 bp, Mus musculus
ttagatttcagcgtctagacttagg

SEQ ID NO: 922319 - DNA, 25 bp, Mus musculus
ttagattttagtccctgtcttcatc

SEQ ID NO: 922320 - DNA, 25 bp, Mus musculus
ttagattttagtgcctgtcttcatc

SEQ ID NO: 922321 - DNA, 25 bp, Mus musculus
ttagattttcccatggtatcttcca

SEQ ID NO: 922322 - DNA, 25 bp, Mus musculus
ttagattttcccttggtatcttcca

SEQ ID NO: 922323 - DNA, 25 bp, Mus musculus
ttagattttgctacctagtaggcca

SEQ ID NO: 922324 - DNA, 25 bp, Mus musculus
ttagattttgcttcctagtaggcca

SEQ ID NO: 922325 - DNA, 25 bp, Mus musculus
ttagatttttgcaacctctctgggc

SEQ ID NO: 922326 - DNA, 25 bp, Mus musculus
ttagatttttgctacctctctgggc

SEQ ID NO: 922327 - DNA, 25 bp, Mus musculus
ttagcaaactgcaggactgcgtcct

SEQ ID NO: 922328 - DNA, 25 bp, Mus musculus
ttagcaaactgctggactgcgtcct

SEQ ID NO: 922329 - DNA, 25 bp, Mus musculus
ttagcaaagttccaaagggctcttg

SEQ ID NO: 922330 - DNA, 25 bp, Mus musculus
ttagcaaagttcgaaagggctcttg

SEQ ID NO: 922331 - DNA, 25 bp, Mus musculus
ttagcaacaaacctgcatgctcttc

SEQ ID NO: 922332 - DNA, 25 bp, Mus musculus
ttagcaacaaacgtgcatgctcttc

SEQ ID NO: 922333 - DNA, 25 bp, Mus musculus
ttagcaacaagcatcagtcctgaga

SEQ ID NO: 922334 - DNA, 25 bp, Mus musculus
ttagcaacaagcttcagtcctgaga

SEQ ID NO: 922335 - DNA, 25 bp, Mus musculus
ttagcaacaaggaggcctgtgcagc

SEQ ID NO: 922336 - DNA, 25 bp, Mus musculus
ttagcaacaaggtggcctgtgcagc

SEQ ID NO: 922337 - DNA, 25 bp, Mus musculus
ttagcaacatgtcgttccccggtaa

SEQ ID NO: 922338 - DNA, 25 bp, Mus musculus
ttagcaacatgtggttccccggtaa

SEQ ID NO: 922339 - DNA, 25 bp, Mus musculus
ttagcaaccgttagttctgtgtctc

SEQ ID NO: 922340 - DNA, 25 bp, Mus musculus
ttagcaaccgtttgttctgtgtctc

SEQ ID NO: 922341 - DNA, 25 bp, Mus musculus
ttagcaactaaaagaaacgtcccag

SEQ ID NO: 922342 - DNA, 25 bp, Mus musculus
ttagcaactaaatgaaacgtcccag

SEQ ID NO: 922343 - DNA, 25 bp, Mus musculus
ttagcaagacacagggcaggctcca

SEQ ID NO: 922344 - DNA, 25 bp, Mus musculus
ttagcaagacactgggcaggctcca

SEQ ID NO: 922345 - DNA, 25 bp, Mus musculus
ttagcaagaccgcagctacccagtc

SEQ ID NO: 922346 - DNA, 25 bp, Mus musculus
ttagcaagaccggagctacccagtc

SEQ ID NO: 922347 - DNA, 25 bp, Mus musculus
ttagcaagactgaaccccgtgaacg

SEQ ID NO: 922348 - DNA, 25 bp, Mus musculus
ttagcaagactgtaccccgtgaacg

SEQ ID NO: 922349 - DNA, 25 bp, Mus musculus
ttagcaagatgtacttccacctggg

SEQ ID NO: 922350 - DNA, 25 bp, Mus musculus
ttagcaagatgttcttccacctggg

SEQ ID NO: 922351 - DNA, 25 bp, Mus musculus
ttagcaagcctaaaaccctagtctc

SEQ ID NO: 922352 - DNA, 25 bp, Mus musculus
ttagcaagcctataaccctagtctc

SEQ ID NO: 922353 - DNA, 25 bp, Mus musculus
ttagcaagtatcagcttggtacttt

SEQ ID NO: 922354 - DNA, 25 bp, Mus musculus
ttagcaagtatctgcttggtacttt

SEQ ID NO: 922355 - DNA, 25 bp, Mus musculus
ttagcaagtgccagcagcgggaaga

SEQ ID NO: 922356 - DNA, 25 bp, Mus musculus
ttagcaagtgcctgcagcgggaaga

SEQ ID NO: 922357 - DNA, 25 bp, Mus musculus
ttagcaatcaccatcaacagactgt

SEQ ID NO: 922358 - DNA, 25 bp, Mus musculus
ttagcaatcaccttcaacagactgt

SEQ ID NO: 922359 - DNA, 25 bp, Mus musculus
ttagcaatcttactgttttctggtg

SEQ ID NO: 922360 - DNA, 25 bp, Mus musculus
ttagcaatcttagtgttttctggtg

SEQ ID NO: 922361 - DNA, 25 bp, Mus musculus
ttagcaatgaaacagtcctaccttc

SEQ ID NO: 922362 - DNA, 25 bp, Mus musculus
ttagcaatgaaagagtcctaccttc

SEQ ID NO: 922363 - DNA, 25 bp, Mus musculus
ttagcaatgacacctctgatggcat

SEQ ID NO: 922364 - DNA, 25 bp, Mus musculus
ttagcaatgacagctctgatggcat

SEQ ID NO: 922365 - DNA, 25 bp, Mus musculus
ttagcaatggagacccacgtgtccc

SEQ ID NO: 922366 - DNA, 25 bp, Mus musculus
ttagcaatggagtcccacgtgtccc

SEQ ID NO: 922367 - DNA, 25 bp, Mus musculus
ttagcaattatgattgtacacgcaa

SEQ ID NO: 922368 - DNA, 25 bp, Mus musculus
ttagcaattatgtttgtacacgcaa

SEQ ID NO: 922369 - DNA, 25 bp, Mus musculus
ttagcacagaagagagtccagacac

SEQ ID NO: 922370 - DNA, 25 bp, Mus musculus
ttagcacagaagtgagtccagacac

SEQ ID NO: 922371 - DNA, 25 bp, Mus musculus
ttagcacagattcagctcatgacac

SEQ ID NO: 922372 - DNA, 25 bp, Mus musculus
ttagcacagattgagctcatgacac

SEQ ID NO: 922373 - DNA, 25 bp, Mus musculus
ttagcacaggcaactctcatgcagt

SEQ ID NO: 922374 - DNA, 25 bp, Mus musculus
ttagcacaggcatctctcatgcagt

SEQ ID NO: 922375 - DNA, 25 bp, Mus musculus
ttagcacagtacactgctcacttct

SEQ ID NO: 922376 - DNA, 25 bp, Mus musculus
ttagcacagtactctgctcacttct

SEQ ID NO: 922377 - DNA, 25 bp, Mus musculus
ttagcacagttcatcaccttgtgtt

SEQ ID NO: 922378 - DNA, 25 bp, Mus musculus
ttagcacagttcttcaccttgtgtt

SEQ ID NO: 922379 - DNA, 25 bp, Mus musculus
ttagcacatgctagaccctgcactc

SEQ ID NO: 922380 - DNA, 25 bp, Mus musculus
ttagcacatgcttgaccctgcactc

SEQ ID NO: 922381 - DNA, 25 bp, Mus musculus
ttagcaccacagaattcacccactg

SEQ ID NO: 922382 - DNA, 25 bp, Mus musculus
ttagcaccacagtattcacccactg

SEQ ID NO: 922383 - DNA, 25 bp, Mus musculus
ttagcaccagcacgctcgctcaggg

SEQ ID NO: 922384 - DNA, 25 bp, Mus musculus
ttagcaccagcaggctcgctcaggg

SEQ ID NO: 922385 - DNA, 25 bp, Mus musculus
ttagcaccatgaaccttcctccatc

SEQ ID NO: 922386 - DNA, 25 bp, Mus musculus
ttagcaccatgatccttcctccatc

SEQ ID NO: 922387 - DNA, 25 bp, Mus musculus
ttagcacccatcctgaccatagtga

SEQ ID NO: 922388 - DNA, 25 bp, Mus musculus
ttagcacccatcgtgaccatagtga

SEQ ID NO: 922389 - DNA, 25 bp, Mus musculus
ttagcaccccagagtctacatattt

SEQ ID NO: 922390 - DNA, 25 bp, Mus musculus
ttagcaccccagtgtctacatattt

SEQ ID NO: 922391 - DNA, 25 bp, Mus musculus
ttagcacctgcaagagtcagccatg

SEQ ID NO: 922392 - DNA, 25 bp, Mus musculus
ttagcacctgcatgagtcagccatg

SEQ ID NO: 922393 - DNA, 25 bp, Mus musculus
ttagcacgctcgcaggatctcgtgt

SEQ ID NO: 922394 - DNA, 25 bp, Mus musculus
ttagcacgctcggaggatctcgtgt

SEQ ID NO: 922395 - DNA, 25 bp, Mus musculus
ttagcacgctttagcctgggcaagg

SEQ ID NO: 922396 - DNA, 25 bp, Mus musculus
ttagcacgcttttgcctgggcaagg

SEQ ID NO: 922397 - DNA, 25 bp, Mus musculus
ttagcacggccaaaagagctgcatg

SEQ ID NO: 922398 - DNA, 25 bp, Mus musculus
ttagcacggccacgaaatgcaatgg

SEQ ID NO: 922399 - DNA, 25 bp, Mus musculus
ttagcacggccaggaaatgcaatgg

SEQ ID NO: 922400 - DNA, 25 bp, Mus musculus
ttagcacggccataagagctgcatg

SEQ ID NO: 922401 - DNA, 25 bp, Mus musculus
ttagcacgtggcattactgcagtca

SEQ ID NO: 922402 - DNA, 25 bp, Mus musculus
ttagcacgtggctttactgcagtca

SEQ ID NO: 922403 - DNA, 25 bp, Mus musculus
ttagcactaaagcaggctcgaagct

SEQ ID NO: 922404 - DNA, 25 bp, Mus musculus
ttagcactaaaggaggctcgaagct

SEQ ID NO: 922405 - DNA, 25 bp, Mus musculus
ttagcactaactcgattgttggagt

SEQ ID NO: 922406 - DNA, 25 bp, Mus musculus
ttagcactaactggattgttggagt

SEQ ID NO: 922407 - DNA, 25 bp, Mus musculus
ttagcactacacaaacaagcagact

SEQ ID NO: 922408 - DNA, 25 bp, Mus musculus
ttagcactacactaacaagcagact

SEQ ID NO: 922409 - DNA, 25 bp, Mus musculus
ttagcactagaaactgtcccaagtt

SEQ ID NO: 922410 - DNA, 25 bp, Mus musculus
ttagcactagaatctgtcccaagtt

SEQ ID NO: 922411 - DNA, 25 bp, Mus musculus
ttagcactcaaacggaggaacgcct

SEQ ID NO: 922412 - DNA, 25 bp, Mus musculus
ttagcactcaaagggaggaacgcct

SEQ ID NO: 922413 - DNA, 25 bp, Mus musculus
ttagcactcaagaaccaggattaca

SEQ ID NO: 922414 - DNA, 25 bp, Mus musculus
ttagcactcaagtaccaggattaca

SEQ ID NO: 922415 - DNA, 25 bp, Mus musculus
ttagcactcacgaaccatggactgg

SEQ ID NO: 922416 - DNA, 25 bp, Mus musculus
ttagcactcacgtaccatggactgg

SEQ ID NO: 922417 - DNA, 25 bp, Mus musculus
ttagcactccttactgcttcaaccg

SEQ ID NO: 922418 - DNA, 25 bp, Mus musculus
ttagcactcctttctgcttcaaccg

SEQ ID NO: 922419 - DNA, 25 bp, Mus musculus
ttagcactggtccaggaaaccctgg

SEQ ID NO: 922420 - DNA, 25 bp, Mus musculus
ttagcactggtcgaggaaaccctgg

SEQ ID NO: 922421 - DNA, 25 bp, Mus musculus
ttagcactgtgtcgttgatcttcca

SEQ ID NO: 922422 - DNA, 25 bp, Mus musculus
ttagcactgtgtggttgatcttcca

SEQ ID NO: 922423 - DNA, 25 bp, Mus musculus
ttagcactgttcatctagacctcag

SEQ ID NO: 922424 - DNA, 25 bp, Mus musculus
ttagcactgttcttctagacctcag

SEQ ID NO: 922425 - DNA, 25 bp, Mus musculus
ttagcactgttgaaacttaatgttt

SEQ ID NO: 922426 - DNA, 25 bp, Mus musculus
ttagcactgttgtaacttaatgttt

SEQ ID NO: 922427 - DNA, 25 bp, Mus musculus
ttagcacttagacccagaccaaatt

SEQ ID NO: 922428 - DNA, 25 bp, Mus musculus
ttagcacttagagccagaccaaatt

SEQ ID NO: 922429 - DNA, 25 bp, Mus musculus
ttagcacttcttagcacgcacacac

SEQ ID NO: 922430 - DNA, 25 bp, Mus musculus
ttagcacttctttgcacgcacacac

SEQ ID NO: 922431 - DNA, 25 bp, Mus musculus
ttagcacttgctagggcattgataa

SEQ ID NO: 922432 - DNA, 25 bp, Mus musculus
ttagcacttgcttgggcattgataa

SEQ ID NO: 922433 - DNA, 25 bp, Mus musculus
ttagcactttcaactgcccattaag

SEQ ID NO: 922434 - DNA, 25 bp, Mus musculus
ttagcactttcatctgcccattaag

SEQ ID NO: 922435 - DNA, 25 bp, Mus musculus
ttagcactttgtcctgtgtcagctc

SEQ ID NO: 922436 - DNA, 25 bp, Mus musculus
ttagcactttgtgctgtgtcagctc

SEQ ID NO: 922437 - DNA, 25 bp, Mus musculus
ttagcagaactgactccatgagcaa

SEQ ID NO: 922438 - DNA, 25 bp, Mus musculus
ttagcagaactgtctccatgagcaa

SEQ ID NO: 922439 - DNA, 25 bp, Mus musculus
ttagcagacctaacactggctactg

SEQ ID NO: 922440 - DNA, 25 bp, Mus musculus
ttagcagacctatcactggctactg

SEQ ID NO: 922441 - DNA, 25 bp, Mus musculus
ttagcagagactcgagctggagcaa

SEQ ID NO: 922442 - DNA, 25 bp, Mus musculus
ttagcagagactggagctggagcaa

SEQ ID NO: 922443 - DNA, 25 bp, Mus musculus
ttagcagagcgacgaccataaccca

SEQ ID NO: 922444 - DNA, 25 bp, Mus musculus
ttagcagagcgaggaccataaccca

SEQ ID NO: 922445 - DNA, 25 bp, Mus musculus
ttagcagagctgacgccagttcaca

SEQ ID NO: 922446 - DNA, 25 bp, Mus musculus
ttagcagagctgtcgccagttcaca

SEQ ID NO: 922447 - DNA, 25 bp, Mus musculus
ttagcagagttgctgtcgcctacag

SEQ ID NO: 922448 - DNA, 25 bp, Mus musculus
ttagcagagttggtgtcgcctacag

SEQ ID NO: 922449 - DNA, 25 bp, Mus musculus
ttagcagatccgcacagggccctct

SEQ ID NO: 922450 - DNA, 25 bp, Mus musculus
ttagcagatccggacagggccctct

SEQ ID NO: 922451 - DNA, 25 bp, Mus musculus
ttagcagattcacccctatgaggag

SEQ ID NO: 922452 - DNA, 25 bp, Mus musculus
ttagcagattcagccctatgaggag

SEQ ID NO: 922453 - DNA, 25 bp, Mus musculus
ttagcagcactccaacacagttgag

SEQ ID NO: 922454 - DNA, 25 bp, Mus musculus
ttagcagcactcgaacacagttgag

SEQ ID NO: 922455 - DNA, 25 bp, Mus musculus
ttagcagcaggaaaagcgttcagaa

SEQ ID NO: 922456 - DNA, 25 bp, Mus musculus
ttagcagcaggataagcgttcagaa

SEQ ID NO: 922457 - DNA, 25 bp, Mus musculus
ttagcagcagtgacagtgagcagca

SEQ ID NO: 922458 - DNA, 25 bp, Mus musculus
ttagcagcagtgtcagtgagcagca

SEQ ID NO: 922459 - DNA, 25 bp, Mus musculus
ttagcagcattcacccgtgtctgtt

SEQ ID NO: 922460 - DNA, 25 bp, Mus musculus
ttagcagcattctcccgtgtctgtt

SEQ ID NO: 922461 - DNA, 25 bp, Mus musculus
ttagcagccaaccacttgactgagt

SEQ ID NO: 922462 - DNA, 25 bp, Mus musculus
ttagcagccaacgacttgactgagt

SEQ ID NO: 922463 - DNA, 25 bp, Mus musculus
ttagcagcctgcctgttcatagagc

SEQ ID NO: 922464 - DNA, 25 bp, Mus musculus
ttagcagcctgcgtgttcatagagc

SEQ ID NO: 922465 - DNA, 25 bp, Mus musculus
ttagcagcctgtcgttactgacctg

SEQ ID NO: 922466 - DNA, 25 bp, Mus musculus
ttagcagcctgtggttactgacctg

SEQ ID NO: 922467 - DNA, 25 bp, Mus musculus
ttagcagcgctcagatactcgactt

SEQ ID NO: 922468 - DNA, 25 bp, Mus musculus
ttagcagcgctctgatactcgactt

SEQ ID NO: 922469 - DNA, 25 bp, Mus musculus
ttagcagctaacaagctacatgctt

SEQ ID NO: 922470 - DNA, 25 bp, Mus musculus
ttagcagctaactagctacatgctt

SEQ ID NO: 922471 - DNA, 25 bp, Mus musculus
ttagcagctaagaacatttgttgct

SEQ ID NO: 922472 - DNA, 25 bp, Mus musculus
ttagcagctaagtacatttgttgct

SEQ ID NO: 922473 - DNA, 25 bp, Mus musculus
ttagcagctatgaccgaggccaaac

SEQ ID NO: 922474 - DNA, 25 bp, Mus musculus
ttagcagctatgtccgaggccaaac

SEQ ID NO: 922475 - DNA, 25 bp, Mus musculus
ttagcagctctaacacacgcttcat

SEQ ID NO: 922476 - DNA, 25 bp, Mus musculus
ttagcagctctatcacacgcttcat

SEQ ID NO: 922477 - DNA, 25 bp, Mus musculus
ttagcagctggcctatggttggtca

SEQ ID NO: 922478 - DNA, 25 bp, Mus musculus
ttagcagctggcgtatggttggtca

SEQ ID NO: 922479 - DNA, 25 bp, Mus musculus
ttagcagctgttccaactgccaagg

SEQ ID NO: 922480 - DNA, 25 bp, Mus musculus
ttagcagctgttgcaactgccaagg

SEQ ID NO: 922481 - DNA, 25 bp, Mus musculus
ttagcaggactcaggagccatgcca

SEQ ID NO: 922482 - DNA, 25 bp, Mus musculus
ttagcaggactctggagccatgcca

SEQ ID NO: 922483 - DNA, 25 bp, Mus musculus
ttagcaggagtaaccactgcccgaa

SEQ ID NO: 922484 - DNA, 25 bp, Mus musculus
ttagcaggagtatccactgcccgaa

SEQ ID NO: 922485 - DNA, 25 bp, Mus musculus
ttagcaggcagcatttgctcactca

SEQ ID NO: 922486 - DNA, 25 bp, Mus musculus
ttagcaggcagcttttgctcactca

SEQ ID NO: 922487 - DNA, 25 bp, Mus musculus
ttagcaggcataacgaagccccttt

SEQ ID NO: 922488 - DNA, 25 bp, Mus musculus
ttagcaggcatatcgaagccccttt

SEQ ID NO: 922489 - DNA, 25 bp, Mus musculus
ttagcaggctagctctgtcaatccg

SEQ ID NO: 922490 - DNA, 25 bp, Mus musculus
ttagcaggctaggtctgtcaatccg

SEQ ID NO: 922491 - DNA, 25 bp, Mus musculus
ttagcagggcatcagaattctgtgc

SEQ ID NO: 922492 - DNA, 25 bp, Mus musculus
ttagcagggcatgagaattctgtgc

SEQ ID NO: 922493 - DNA, 25 bp, Mus musculus
ttagcagggctcactgctttttacc

SEQ ID NO: 922494 - DNA, 25 bp, Mus musculus
ttagcagggctctctgctttttacc

SEQ ID NO: 922495 - DNA, 25 bp, Mus musculus
ttagcaggtctgacctcatgtgact

SEQ ID NO: 922496 - DNA, 25 bp, Mus musculus
ttagcaggtctgtcctcatgtgact

SEQ ID NO: 922497 - DNA, 25 bp, Mus musculus
ttagcaggtggtcttttagagcaaa

SEQ ID NO: 922498 - DNA, 25 bp, Mus musculus
ttagcaggtggtgttttagagcaaa

SEQ ID NO: 922499 - DNA, 25 bp, Mus musculus
ttagcaggtgtactataggtgaact

SEQ ID NO: 922500 - DNA, 25 bp, Mus musculus
ttagcaggtgtagtataggtgaact

SEQ ID NO: 922501 - DNA, 25 bp, Mus musculus
ttagcaggttatccaagaatcacac

SEQ ID NO: 922502 - DNA, 25 bp, Mus musculus
ttagcaggttatgcaagaatcacac

SEQ ID NO: 922503 - DNA, 25 bp, Mus musculus
ttagcagtactaaacccgtcaggca

SEQ ID NO: 922504 - DNA, 25 bp, Mus musculus
ttagcagtactatacccgtcaggca

SEQ ID NO: 922505 - DNA, 25 bp, Mus musculus
ttagcagtcaccatattttatcgat

SEQ ID NO: 922506 - DNA, 25 bp, Mus musculus
ttagcagtcaccttattttatcgat

SEQ ID NO: 922507 - DNA, 25 bp, Mus musculus
ttagcagtctttatcagccatgcag

SEQ ID NO: 922508 - DNA, 25 bp, Mus musculus
ttagcagtctttttcagccatgcag

SEQ ID NO: 922509 - DNA, 25 bp, Mus musculus
ttagcagtgcaacccacgctcggaa

SEQ ID NO: 922510 - DNA, 25 bp, Mus musculus
ttagcagtgcaagccacgctcggaa

SEQ ID NO: 922511 - DNA, 25 bp, Mus musculus
ttagcagtgcaccttcacttccaca

SEQ ID NO: 922512 - DNA, 25 bp, Mus musculus
ttagcagtgcacgttcacttccaca

SEQ ID NO: 922513 - DNA, 25 bp, Mus musculus
ttagcagtggtcagtggttgacaat

SEQ ID NO: 922514 - DNA, 25 bp, Mus musculus
ttagcagtggtctgtggttgacaat

SEQ ID NO: 922515 - DNA, 25 bp, Mus musculus
ttagcagttccacataaaggccctc

SEQ ID NO: 922516 - DNA, 25 bp, Mus musculus
ttagcagttccagataaaggccctc

SEQ ID NO: 922517 - DNA, 25 bp, Mus musculus
ttagcagttcccagagaaattctcc

SEQ ID NO: 922518 - DNA, 25 bp, Mus musculus
ttagcagttccctgagaaattctcc

SEQ ID NO: 922519 - DNA, 25 bp, Mus musculus
ttagcagtttgccatcagaattctg

SEQ ID NO: 922520 - DNA, 25 bp, Mus musculus
ttagcagtttgcgatcagaattctg

SEQ ID NO: 922521 - DNA, 25 bp, Mus musculus
ttagcatacatgatcccaccaagaa

SEQ ID NO: 922522 - DNA, 25 bp, Mus musculus
ttagcatacatgttcccaccaagaa

SEQ ID NO: 922523 - DNA, 25 bp, Mus musculus
ttagcatagctacttgtgtgtacta

SEQ ID NO: 922524 - DNA, 25 bp, Mus musculus
ttagcatagctagttgtgtgtacta

SEQ ID NO: 922525 - DNA, 25 bp, Mus musculus
ttagcatattttcagttaacccact

SEQ ID NO: 922526 - DNA, 25 bp, Mus musculus
ttagcatattttgagttaacccact

SEQ ID NO: 922527 - DNA, 25 bp, Mus musculus
ttagcatcaacaacatctctttatc

SEQ ID NO: 922528 - DNA, 25 bp, Mus musculus
ttagcatcaacatcatctctttatc

SEQ ID NO: 922529 - DNA, 25 bp, Mus musculus
ttagcatcacaccacatagtcattc

SEQ ID NO: 922530 - DNA, 25 bp, Mus musculus
ttagcatcacacgacatagtcattc

SEQ ID NO: 922531 - DNA, 25 bp, Mus musculus
ttagcatcaccaattcagtgctgtg

SEQ ID NO: 922532 - DNA, 25 bp, Mus musculus
ttagcatcaccatttcagtgctgtg

SEQ ID NO: 922533 - DNA, 25 bp, Mus musculus
ttagcatcaggcctatatgtttatt

SEQ ID NO: 922534 - DNA, 25 bp, Mus musculus
ttagcatcaggcgtatatgtttatt

SEQ ID NO: 922535 - DNA, 25 bp, Mus musculus
ttagcatcatcgcatgtctttcctt

SEQ ID NO: 922536 - DNA, 25 bp, Mus musculus
ttagcatcatcggatgtctttcctt

SEQ ID NO: 922537 - DNA, 25 bp, Mus musculus
ttagcatcccgacattgctctcctt

SEQ ID NO: 922538 - DNA, 25 bp, Mus musculus
ttagcatcccgagattgctctcctt

SEQ ID NO: 922539 - DNA, 25 bp, Mus musculus
ttagcatctaaaaatcctcttcccg

SEQ ID NO: 922540 - DNA, 25 bp, Mus musculus
ttagcatctaaatatcctcttcccg

SEQ ID NO: 922541 - DNA, 25 bp, Mus musculus
ttagcatctcacatcctgacaagaa

SEQ ID NO: 922542 - DNA, 25 bp, Mus musculus
ttagcatctcacttcctgacaagaa

SEQ ID NO: 922543 - DNA, 25 bp, Mus musculus
ttagcatctgacctctcagcggaag

SEQ ID NO: 922544 - DNA, 25 bp, Mus musculus
ttagcatctgacgtctcagcggaag

SEQ ID NO: 922545 - DNA, 25 bp, Mus musculus
ttagcatctgccagtctcaatttgt

SEQ ID NO: 922546 - DNA, 25 bp, Mus musculus
ttagcatctgcctgtctcaatttgt

SEQ ID NO: 922547 - DNA, 25 bp, Mus musculus
ttagcatgcacaccactgtggcggc

SEQ ID NO: 922548 - DNA, 25 bp, Mus musculus
ttagcatgcacagcactgtggcggc

SEQ ID NO: 922549 - DNA, 25 bp, Mus musculus
ttagcatgctagatccatggtcctg

SEQ ID NO: 922550 - DNA, 25 bp, Mus musculus
ttagcatgctagttccatggtcctg

SEQ ID NO: 922551 - DNA, 25 bp, Mus musculus
ttagcatgggctctaacacctctct

SEQ ID NO: 922552 - DNA, 25 bp, Mus musculus
ttagcatgggctgtaacacctctct

SEQ ID NO: 922553 - DNA, 25 bp, Mus musculus
ttagcatggtcacttcctcatatcc

SEQ ID NO: 922554 - DNA, 25 bp, Mus musculus
ttagcatggtcagttcctcatatcc

SEQ ID NO: 922555 - DNA, 25 bp, Mus musculus
ttagcatgtcttagttttagtctca

SEQ ID NO: 922556 - DNA, 25 bp, Mus musculus
ttagcatgtctttgttttagtctca

SEQ ID NO: 922557 - DNA, 25 bp, Mus musculus
ttagcattagtacggccatgggtca

SEQ ID NO: 922558 - DNA, 25 bp, Mus musculus
ttagcattagtagggccatgggtca

SEQ ID NO: 922559 - DNA, 25 bp, Mus musculus
ttagcattcattaagcctgggtttg

SEQ ID NO: 922560 - DNA, 25 bp, Mus musculus
ttagcattcattcagccaggtcttc

SEQ ID NO: 922561 - DNA, 25 bp, Mus musculus
ttagcattcattgagccaggtcttc

SEQ ID NO: 922562 - DNA, 25 bp, Mus musculus
ttagcattcatttagcctgggtttg

SEQ ID NO: 922563 - DNA, 25 bp, Mus musculus
ttagcattccacagtttccctgatg

SEQ ID NO: 922564 - DNA, 25 bp, Mus musculus
ttagcattccactgtttccctgatg

SEQ ID NO: 922565 - DNA, 25 bp, Mus musculus
ttagcattccttcatgacatgtcat

SEQ ID NO: 922566 - DNA, 25 bp, Mus musculus
ttagcattccttgatgacatgtcat

SEQ ID NO: 922567 - DNA, 25 bp, Mus musculus
ttagcattgagcactacactctctc

SEQ ID NO: 922568 - DNA, 25 bp, Mus musculus
ttagcattgagctctacactctctc

SEQ ID NO: 922569 - DNA, 25 bp, Mus musculus
ttagcattgcccacatgtgcatggt

SEQ ID NO: 922570 - DNA, 25 bp, Mus musculus
ttagcattgcccctgcataaggatg

SEQ ID NO: 922571 - DNA, 25 bp, Mus musculus
ttagcattgcccgtgcataaggatg

SEQ ID NO: 922572 - DNA, 25 bp, Mus musculus
ttagcattgccctcatgtgcatggt

SEQ ID NO: 922573 - DNA, 25 bp, Mus musculus
ttagcattggaacacaacttctcat

SEQ ID NO: 922574 - DNA, 25 bp, Mus musculus
ttagcattggaagacaacttctcat

SEQ ID NO: 922575 - DNA, 25 bp, Mus musculus
ttagcattgggcagacgctgattca

SEQ ID NO: 922576 - DNA, 25 bp, Mus musculus
ttagcattgggctgacgctgattca

SEQ ID NO: 922577 - DNA, 25 bp, Mus musculus
ttagcatttgccagtcaccttgcag

SEQ ID NO: 922578 - DNA, 25 bp, Mus musculus
ttagcatttgcctgtcaccttgcag

SEQ ID NO: 922579 - DNA, 25 bp, Mus musculus
ttagcattttaaagagacccctcag

SEQ ID NO: 922580 - DNA, 25 bp, Mus musculus
ttagcattttaatgagacccctcag

SEQ ID NO: 922581 - DNA, 25 bp, Mus musculus
ttagcatttttacctagcatcttag

SEQ ID NO: 922582 - DNA, 25 bp, Mus musculus
ttagcatttttagctagcatcttag

SEQ ID NO: 922583 - DNA, 25 bp, Mus musculus
ttagccaaattactgctcactgcaa

SEQ ID NO: 922584 - DNA, 25 bp, Mus musculus
ttagccaaattagtgctcactgcaa

SEQ ID NO: 922585 - DNA, 25 bp, Mus musculus
ttagccaacgaaatgctttgaagca

SEQ ID NO: 922586 - DNA, 25 bp, Mus musculus
ttagccaacgaattgctttgaagca

SEQ ID NO: 922587 - DNA, 25 bp, Mus musculus
ttagccaactggcaccttttgaagt

SEQ ID NO: 922588 - DNA, 25 bp, Mus musculus
ttagccaactgggaccttttgaagt

SEQ ID NO: 922589 - DNA, 25 bp, Mus musculus
ttagccaagacaacaacagtaaacg

SEQ ID NO: 922590 - DNA, 25 bp, Mus musculus
ttagccaagacatcaacagtaaacg

SEQ ID NO: 922591 - DNA, 25 bp, Mus musculus
ttagccaagagcaggctgggcccct

SEQ ID NO: 922592 - DNA, 25 bp, Mus musculus
ttagccaagagctggctgggcccct

SEQ ID NO: 922593 - DNA, 25 bp, Mus musculus
ttagccaagttgaccctaacacgtc

SEQ ID NO: 922594 - DNA, 25 bp, Mus musculus
ttagccaagttgtccctaacacgtc

SEQ ID NO: 922595 - DNA, 25 bp, Mus musculus
ttagccaatgccaacccagaagtgt

SEQ ID NO: 922596 - DNA, 25 bp, Mus musculus
ttagccaatgcctacccagaagtgt

SEQ ID NO: 922597 - DNA, 25 bp, Mus musculus
ttagccacagctcgttaagatgcat

SEQ ID NO: 922598 - DNA, 25 bp, Mus musculus
ttagccacagctggttaagatgcat

SEQ ID NO: 922599 - DNA, 25 bp, Mus musculus
ttagccacataaatttaaacaactg

SEQ ID NO: 922600 - DNA, 25 bp, Mus musculus
ttagccacataattttaaacaactg

SEQ ID NO: 922601 - DNA, 25 bp, Mus musculus
ttagccaccataacacctctttctg

SEQ ID NO: 922602 - DNA, 25 bp, Mus musculus
ttagccaccatatcacctctttctg

SEQ ID NO: 922603 - DNA, 25 bp, Mus musculus
ttagccacctaacctctaagactat

SEQ ID NO: 922604 - DNA, 25 bp, Mus musculus
ttagccacctaagctctaagactat

SEQ ID NO: 922605 - DNA, 25 bp, Mus musculus
ttagccacctgcacagaactgaact

SEQ ID NO: 922606 - DNA, 25 bp, Mus musculus
ttagccacctgctcagaactgaact

SEQ ID NO: 922607 - DNA, 25 bp, Mus musculus
ttagccacgtccacctgtcatttgt

SEQ ID NO: 922608 - DNA, 25 bp, Mus musculus
ttagccacgtcctcctgtcatttgt

SEQ ID NO: 922609 - DNA, 25 bp, Mus musculus
ttagccacttcacattctgcctgta

SEQ ID NO: 922610 - DNA, 25 bp, Mus musculus
ttagccacttcagattctgcctgta

SEQ ID NO: 922611 - DNA, 25 bp, Mus musculus
ttagccagaaccaataccgttcgcc

SEQ ID NO: 922612 - DNA, 25 bp, Mus musculus
ttagccagaacctataccgttcgcc

SEQ ID NO: 922613 - DNA, 25 bp, Mus musculus
ttagccagacaaaacgccttctctt

SEQ ID NO: 922614 - DNA, 25 bp, Mus musculus
ttagccagacaatacgccttctctt

SEQ ID NO: 922615 - DNA, 25 bp, Mus musculus
ttagccagacgtagagccttcccga

SEQ ID NO: 922616 - DNA, 25 bp, Mus musculus
ttagccagacgttgagccttcccga

SEQ ID NO: 922617 - DNA, 25 bp, Mus musculus
ttagccagactaaaccttgtgtagc

SEQ ID NO: 922618 - DNA, 25 bp, Mus musculus
ttagccagactataccttgtgtagc

SEQ ID NO: 922619 - DNA, 25 bp, Mus musculus
ttagccagccatagttttgcagtgc

SEQ ID NO: 922620 - DNA, 25 bp, Mus musculus
ttagccagccattgttttgcagtgc

SEQ ID NO: 922621 - DNA, 25 bp, Mus musculus
ttagccagccctcgattactgaggt

SEQ ID NO: 922622 - DNA, 25 bp, Mus musculus
ttagccagccctggattactgaggt

SEQ ID NO: 922623 - DNA, 25 bp, Mus musculus
ttagccagccggagcagccacgacg

SEQ ID NO: 922624 - DNA, 25 bp, Mus musculus
ttagccagccggtgcagccacgacg

SEQ ID NO: 922625 - DNA, 25 bp, Mus musculus
ttagccaggcagcacctatggccat

SEQ ID NO: 922626 - DNA, 25 bp, Mus musculus
ttagccaggcaggacctatggccat

SEQ ID NO: 922627 - DNA, 25 bp, Mus musculus
ttagccaggctaatcccattccatc

SEQ ID NO: 922628 - DNA, 25 bp, Mus musculus
ttagccaggctattcccattccatc

SEQ ID NO: 922629 - DNA, 25 bp, Mus musculus
ttagccaggctcaatgaggccatgt

SEQ ID NO: 922630 - DNA, 25 bp, Mus musculus
ttagccaggctctatgaggccatgt

SEQ ID NO: 922631 - DNA, 25 bp, Mus musculus
ttagccaggtggatccccatttgag

SEQ ID NO: 922632 - DNA, 25 bp, Mus musculus
ttagccaggtggttccccatttgag

SEQ ID NO: 922633 - DNA, 25 bp, Mus musculus
ttagccatagttacaccaattcagg

SEQ ID NO: 922634 - DNA, 25 bp, Mus musculus
ttagccatagtttcaccaattcagg

SEQ ID NO: 922635 - DNA, 25 bp, Mus musculus
ttagccatcagtcctcacactggag

SEQ ID NO: 922636 - DNA, 25 bp, Mus musculus
ttagccatcagtgctcacactggag

SEQ ID NO: 922637 - DNA, 25 bp, Mus musculus
ttagccatcgccagtggcagcttgt

SEQ ID NO: 922638 - DNA, 25 bp, Mus musculus
ttagccatcgcctgtggcagcttgt

SEQ ID NO: 922639 - DNA, 25 bp, Mus musculus
ttagccatcttaaccatcagaccta

SEQ ID NO: 922640 - DNA, 25 bp, Mus musculus
ttagccatcttatccatcagaccta

SEQ ID NO: 922641 - DNA, 25 bp, Mus musculus
ttagccatcttgaaacctctttgct

SEQ ID NO: 922642 - DNA, 25 bp, Mus musculus
ttagccatcttgtaacctctttgct

SEQ ID NO: 922643 - DNA, 25 bp, Mus musculus
ttagccatgctgagtgtcttcctca

SEQ ID NO: 922644 - DNA, 25 bp, Mus musculus
ttagccatgctgtgtgtcttcctca

SEQ ID NO: 922645 - DNA, 25 bp, Mus musculus
ttagccatggccactgttcagcatt

SEQ ID NO: 922646 - DNA, 25 bp, Mus musculus
ttagccatggcctctgttcagcatt

SEQ ID NO: 922647 - DNA, 25 bp, Mus musculus
ttagccatgttcaccggacctgtga

SEQ ID NO: 922648 - DNA, 25 bp, Mus musculus
ttagccatgttctccggacctgtga

SEQ ID NO: 922649 - DNA, 25 bp, Mus musculus
ttagccattattactgctaccttgt

SEQ ID NO: 922650 - DNA, 25 bp, Mus musculus
ttagccattatttctgctaccttgt

SEQ ID NO: 922651 - DNA, 25 bp, Mus musculus
ttagccattcataaaaagaccctga

SEQ ID NO: 922652 - DNA, 25 bp, Mus musculus
ttagccattcattaaaagaccctga

SEQ ID NO: 922653 - DNA, 25 bp, Mus musculus
ttagccattgaccacctgttcaaga

SEQ ID NO: 922654 - DNA, 25 bp, Mus musculus
ttagccattgacgacctgttcaaga

SEQ ID NO: 922655 - DNA, 25 bp, Mus musculus
ttagccattgagacggaggctgagc

SEQ ID NO: 922656 - DNA, 25 bp, Mus musculus
ttagccattgagtcggaggctgagc

SEQ ID NO: 922657 - DNA, 25 bp, Mus musculus
ttagccattgcaacaagctcttgat

SEQ ID NO: 922658 - DNA, 25 bp, Mus musculus
ttagccattgcatcaagctcttgat

SEQ ID NO: 922659 - DNA, 25 bp, Mus musculus
ttagccattgttaaaatcagtgtcg

SEQ ID NO: 922660 - DNA, 25 bp, Mus musculus
ttagccattgttccacatgtggtgt

SEQ ID NO: 922661 - DNA, 25 bp, Mus musculus
ttagccattgttgcacatgtggtgt

SEQ ID NO: 922662 - DNA, 25 bp, Mus musculus
ttagccattgtttaaatcagtgtcg

SEQ ID NO: 922663 - DNA, 25 bp, Mus musculus
ttagcccaagttaaccgctagtgtt

SEQ ID NO: 922664 - DNA, 25 bp, Mus musculus
ttagcccaagtttaccgctagtgtt

SEQ ID NO: 922665 - DNA, 25 bp, Mus musculus
ttagcccaatagactgttcttgtgg

SEQ ID NO: 922666 - DNA, 25 bp, Mus musculus
ttagcccaatagtctgttcttgtgg

SEQ ID NO: 922667 - DNA, 25 bp, Mus musculus
ttagcccacagtagcaatccacagg

SEQ ID NO: 922668 - DNA, 25 bp, Mus musculus
ttagcccacagttgcaatccacagg

SEQ ID NO: 922669 - DNA, 25 bp, Mus musculus
ttagcccacccgatgtagcctttgg

SEQ ID NO: 922670 - DNA, 25 bp, Mus musculus
ttagcccacccgttgtagcctttgg

SEQ ID NO: 922671 - DNA, 25 bp, Mus musculus
ttagcccagcatcgttggtacttgt

SEQ ID NO: 922672 - DNA, 25 bp, Mus musculus
ttagcccagcatggttggtacttgt

SEQ ID NO: 922673 - DNA, 25 bp, Mus musculus
ttagcccagctgattgttgttttct

SEQ ID NO: 922674 - DNA, 25 bp, Mus musculus
ttagcccagctgtttgttgttttct

SEQ ID NO: 922675 - DNA, 25 bp, Mus musculus
ttagcccagtgccttttcatcagtt

SEQ ID NO: 922676 - DNA, 25 bp, Mus musculus
ttagcccagtgcgttttcatcagtt

SEQ ID NO: 922677 - DNA, 25 bp, Mus musculus
ttagcccataaacaaactatgatcc

SEQ ID NO: 922678 - DNA, 25 bp, Mus musculus
ttagcccataaagaaactatgatcc

SEQ ID NO: 922679 - DNA, 25 bp, Mus musculus
ttagcccatatacagagaatccctt

SEQ ID NO: 922680 - DNA, 25 bp, Mus musculus
ttagcccatatagagagaatccctt

SEQ ID NO: 922681 - DNA, 25 bp, Mus musculus
ttagcccatattcagctcatgcatc

SEQ ID NO: 922682 - DNA, 25 bp, Mus musculus
ttagcccatattgagctcatgcatc

SEQ ID NO: 922683 - DNA, 25 bp, Mus musculus
ttagcccatctaaccaattggtgag

SEQ ID NO: 922684 - DNA, 25 bp, Mus musculus
ttagcccatctatccaattggtgag

SEQ ID NO: 922685 - DNA, 25 bp, Mus musculus
ttagcccatgtcatgtcagtggcca

SEQ ID NO: 922686 - DNA, 25 bp, Mus musculus
ttagcccatgtcttgtcagtggcca

SEQ ID NO: 922687 - DNA, 25 bp, Mus musculus
ttagccccaaggacgatccacaagt

SEQ ID NO: 922688 - DNA, 25 bp, Mus musculus
ttagccccaaggtcgatccacaagt

SEQ ID NO: 922689 - DNA, 25 bp, Mus musculus
ttagccccaatgcatcaacagctga

SEQ ID NO: 922690 - DNA, 25 bp, Mus musculus
ttagccccaatggatcaacagctga

SEQ ID NO: 922691 - DNA, 25 bp, Mus musculus
ttagccccacttcctggagggattt

SEQ ID NO: 922692 - DNA, 25 bp, Mus musculus
ttagccccacttgctggagggattt

SEQ ID NO: 922693 - DNA, 25 bp, Mus musculus
ttagccccaggacttgtgcgtgcag

SEQ ID NO: 922694 - DNA, 25 bp, Mus musculus
ttagccccaggagttgtgcgtgcag

SEQ ID NO: 922695 - DNA, 25 bp, Mus musculus
ttagccccagtcataaatatcactt

SEQ ID NO: 922696 - DNA, 25 bp, Mus musculus
ttagccccagtcttaaatatcactt

SEQ ID NO: 922697 - DNA, 25 bp, Mus musculus
ttagccccgtggaagcatgttaaac

SEQ ID NO: 922698 - DNA, 25 bp, Mus musculus
ttagccccgtggtagcatgttaaac

SEQ ID NO: 922699 - DNA, 25 bp, Mus musculus
ttagcccctattaaggtcgctttgg

SEQ ID NO: 922700 - DNA, 25 bp, Mus musculus
ttagcccctatttaggtcgctttgg

SEQ ID NO: 922701 - DNA, 25 bp, Mus musculus
ttagcccctgaactggaacgttgag

SEQ ID NO: 922702 - DNA, 25 bp, Mus musculus
ttagcccctgaagtggaacgttgag

SEQ ID NO: 922703 - DNA, 25 bp, Mus musculus
ttagcccctgccagtacgccgtgga

SEQ ID NO: 922704 - DNA, 25 bp, Mus musculus
ttagcccctgcctgtacgccgtgga

SEQ ID NO: 922705 - DNA, 25 bp, Mus musculus
ttagcccctttgctcatttatttga

SEQ ID NO: 922706 - DNA, 25 bp, Mus musculus
ttagcccctttggtcatttatttga

SEQ ID NO: 922707 - DNA, 25 bp, Mus musculus
ttagccctactaagctcagactcag

SEQ ID NO: 922708 - DNA, 25 bp, Mus musculus
ttagccctactatgctcagactcag

SEQ ID NO: 922709 - DNA, 25 bp, Mus musculus
ttagccctcacaccaagcaaggcga

SEQ ID NO: 922710 - DNA, 25 bp, Mus musculus
ttagccctcacagcaagcaaggcga

SEQ ID NO: 922711 - DNA, 25 bp, Mus musculus
ttagccctcaggatgaatactttgt

SEQ ID NO: 922712 - DNA, 25 bp, Mus musculus
ttagccctcaggttgaatactttgt

SEQ ID NO: 922713 - DNA, 25 bp, Mus musculus
ttagccctccagaccctgagagcaa

SEQ ID NO: 922714 - DNA, 25 bp, Mus musculus
ttagccctccagtccctgagagcaa

SEQ ID NO: 922715 - DNA, 25 bp, Mus musculus
ttagccctctctagtgtaacatgtg

SEQ ID NO: 922716 - DNA, 25 bp, Mus musculus
ttagccctctcttgtgtaacatgtg

SEQ ID NO: 922717 - DNA, 25 bp, Mus musculus
ttagccctgaaaaatcccttatcca

SEQ ID NO: 922718 - DNA, 25 bp, Mus musculus
ttagccctgaaatatcccttatcca

SEQ ID NO: 922719 - DNA, 25 bp, Mus musculus
ttagccctgaggactcattggcgtg

SEQ ID NO: 922720 - DNA, 25 bp, Mus musculus
ttagccctgaggtctcattggcgtg

SEQ ID NO: 922721 - DNA, 25 bp, Mus musculus
ttagccctgatacccttactgacaa

SEQ ID NO: 922722 - DNA, 25 bp, Mus musculus
ttagccctgatagccttactgacaa

SEQ ID NO: 922723 - DNA, 25 bp, Mus musculus
ttagccctggaaagttccaccctgg

SEQ ID NO: 922724 - DNA, 25 bp, Mus musculus
ttagccctggaatgttccaccctgg

SEQ ID NO: 922725 - DNA, 25 bp, Mus musculus
ttagccctggctctttagcaggaca

SEQ ID NO: 922726 - DNA, 25 bp, Mus musculus
ttagccctggctgtttagcaggaca

SEQ ID NO: 922727 - DNA, 25 bp, Mus musculus
ttagcccttaaccaagcatatgtgg

SEQ ID NO: 922728 - DNA, 25 bp, Mus musculus
ttagcccttaacgaagcatatgtgg

SEQ ID NO: 922729 - DNA, 25 bp, Mus musculus
ttagcccttaccagttggcctctga

SEQ ID NO: 922730 - DNA, 25 bp, Mus musculus
ttagcccttacctgttggcctctga

SEQ ID NO: 922731 - DNA, 25 bp, Mus musculus
ttagcccttatgctcagaatctgtg

SEQ ID NO: 922732 - DNA, 25 bp, Mus musculus
ttagcccttatggtcagaatctgtg

SEQ ID NO: 922733 - DNA, 25 bp, Mus musculus
ttagcccttctcacttcagaaaaga

SEQ ID NO: 922734 - DNA, 25 bp, Mus musculus
ttagcccttctctcttcagaaaaga

SEQ ID NO: 922735 - DNA, 25 bp, Mus musculus
ttagcccttgctatgctctacagaa

SEQ ID NO: 922736 - DNA, 25 bp, Mus musculus
ttagcccttgctttgctctacagaa

SEQ ID NO: 922737 - DNA, 25 bp, Mus musculus
ttagcccttggcaaactactggctc

SEQ ID NO: 922738 - DNA, 25 bp, Mus musculus
ttagcccttggctaactactggctc

SEQ ID NO: 922739 - DNA, 25 bp, Mus musculus
ttagccctttagcagaacagcactc

SEQ ID NO: 922740 - DNA, 25 bp, Mus musculus
ttagccctttaggagaacagcactc

SEQ ID NO: 922741 - DNA, 25 bp, Mus musculus
ttagccgatggaattaaacctgtag

SEQ ID NO: 922742 - DNA, 25 bp, Mus musculus
ttagccgatggatttaaacctgtag

SEQ ID NO: 922743 - DNA, 25 bp, Mus musculus
ttagccgcctgtataaatgcaccga

SEQ ID NO: 922744 - DNA, 25 bp, Mus musculus
ttagccgcctgtttaaatgcaccga

SEQ ID NO: 922745 - DNA, 25 bp, Mus musculus
ttagccggaagtcgaagttcccgtg

SEQ ID NO: 922746 - DNA, 25 bp, Mus musculus
ttagccggaagtggaagttcccgtg

SEQ ID NO: 922747 - DNA, 25 bp, Mus musculus
ttagccggtattcgcgccttaatcg

SEQ ID NO: 922748 - DNA, 25 bp, Mus musculus
ttagccggtattggcgccttaatcg

SEQ ID NO: 922749 - DNA, 25 bp, Mus musculus
ttagccgtcaaaccttttggcacag

SEQ ID NO: 922750 - DNA, 25 bp, Mus musculus
ttagccgtcaaagcttttggcacag

SEQ ID NO: 922751 - DNA, 25 bp, Mus musculus
ttagccgtctccaagaacattctgt

SEQ ID NO: 922752 - DNA, 25 bp, Mus musculus
ttagccgtctcctagaacattctgt

SEQ ID NO: 922753 - DNA, 25 bp, Mus musculus
ttagccgtggcgaggtagcacatac

SEQ ID NO: 922754 - DNA, 25 bp, Mus musculus
ttagccgtggcgtggtagcacatac

SEQ ID NO: 922755 - DNA, 25 bp, Mus musculus
ttagccgttgtccatggtgactgga

SEQ ID NO: 922756 - DNA, 25 bp, Mus musculus
ttagccgttgtcgatggtgactgga

SEQ ID NO: 922757 - DNA, 25 bp, Mus musculus
ttagcctaaaggacaccacactaag

SEQ ID NO: 922758 - DNA, 25 bp, Mus musculus
ttagcctaaaggtcaccacactaag

SEQ ID NO: 922759 - DNA, 25 bp, Mus musculus
ttagcctacatcagtctgggccagg

SEQ ID NO: 922760 - DNA, 25 bp, Mus musculus
ttagcctacatctgtctgggccagg

SEQ ID NO: 922761 - DNA, 25 bp, Mus musculus
ttagcctagcttcccctttgtttag

SEQ ID NO: 922762 - DNA, 25 bp, Mus musculus
ttagcctagcttgccctttgtttag

SEQ ID NO: 922763 - DNA, 25 bp, Mus musculus
ttagcctaggacacaaggactgaat

SEQ ID NO: 922764 - DNA, 25 bp, Mus musculus
ttagcctaggactcaaggactgaat

SEQ ID NO: 922765 - DNA, 25 bp, Mus musculus
ttagcctagtcacttcagtgctcct

SEQ ID NO: 922766 - DNA, 25 bp, Mus musculus
ttagcctagtcagttcagtgctcct

SEQ ID NO: 922767 - DNA, 25 bp, Mus musculus
ttagcctatatgattgggttcctgc

SEQ ID NO: 922768 - DNA, 25 bp, Mus musculus
ttagcctatatgtttgggttcctgc

SEQ ID NO: 922769 - DNA, 25 bp, Mus musculus
ttagcctattaccttcattcttctg

SEQ ID NO: 922770 - DNA, 25 bp, Mus musculus
ttagcctattacgttcattcttctg

SEQ ID NO: 922771 - DNA, 25 bp, Mus musculus
ttagcctcaaccaggcgcatgggca

SEQ ID NO: 922772 - DNA, 25 bp, Mus musculus
ttagcctcaacctggcgcatgggca

SEQ ID NO: 922773 - DNA, 25 bp, Mus musculus
ttagcctcaactactatttatggtg

SEQ ID NO: 922774 - DNA, 25 bp, Mus musculus
ttagcctcaacttctatttatggtg

SEQ ID NO: 922775 - DNA, 25 bp, Mus musculus
ttagcctcacacagtaactcatact

SEQ ID NO: 922776 - DNA, 25 bp, Mus musculus
ttagcctcacactgtaactcatact

SEQ ID NO: 922777 - DNA, 25 bp, Mus musculus
ttagcctcaccgacatgcacgtggt

SEQ ID NO: 922778 - DNA, 25 bp, Mus musculus
ttagcctcaccgtcatgcacgtggt

SEQ ID NO: 922779 - DNA, 25 bp, Mus musculus
ttagcctcacttacaggatgatggc

SEQ ID NO: 922780 - DNA, 25 bp, Mus musculus
ttagcctcactttcaggatgatggc

SEQ ID NO: 922781 - DNA, 25 bp, Mus musculus
ttagcctccaaacgatgacaccatt

SEQ ID NO: 922782 - DNA, 25 bp, Mus musculus
ttagcctccaaaggatgacaccatt

SEQ ID NO: 922783 - DNA, 25 bp, Mus musculus
ttagcctcccggattgtaagatgtg

SEQ ID NO: 922784 - DNA, 25 bp, Mus musculus
ttagcctcccggtttgtaagatgtg

SEQ ID NO: 922785 - DNA, 25 bp, Mus musculus
ttagcctccgatctgtataagccct

SEQ ID NO: 922786 - DNA, 25 bp, Mus musculus
ttagcctccgatgtgtataagccct

SEQ ID NO: 922787 - DNA, 25 bp, Mus musculus
ttagcctcctcactggagcctggtt

SEQ ID NO: 922788 - DNA, 25 bp, Mus musculus
ttagcctcctcagtggagcctggtt

SEQ ID NO: 922789 - DNA, 25 bp, Mus musculus
ttagcctcctgactgcaaggttgga

SEQ ID NO: 922790 - DNA, 25 bp, Mus musculus
ttagcctcctgagtgcaaggttgga

SEQ ID NO: 922791 - DNA, 25 bp, Mus musculus
ttagcctcggaaagtggcacctgac

SEQ ID NO: 922792 - DNA, 25 bp, Mus musculus
ttagcctcggaaccttgctgtgcta

SEQ ID NO: 922793 - DNA, 25 bp, Mus musculus
ttagcctcggaagcttgctgtgcta

SEQ ID NO: 922794 - DNA, 25 bp, Mus musculus
ttagcctcggaatgtggcacctgac

SEQ ID NO: 922795 - DNA, 25 bp, Mus musculus
ttagcctcggagattttgattaact

SEQ ID NO: 922796 - DNA, 25 bp, Mus musculus
ttagcctcggagtttttgattaact

SEQ ID NO: 922797 - DNA, 25 bp, Mus musculus
ttagcctcgtgtcgtttaacaaaag

SEQ ID NO: 922798 - DNA, 25 bp, Mus musculus
ttagcctcgtgtggtttaacaaaag

SEQ ID NO: 922799 - DNA, 25 bp, Mus musculus
ttagcctctctgacatttctcaagt

SEQ ID NO: 922800 - DNA, 25 bp, Mus musculus
ttagcctctctgatttcagctcact

SEQ ID NO: 922801 - DNA, 25 bp, Mus musculus
ttagcctctctgtcatttctcaagt

SEQ ID NO: 922802 - DNA, 25 bp, Mus musculus
ttagcctctctgttttcagctcact

SEQ ID NO: 922803 - DNA, 25 bp, Mus musculus
ttagcctgacctatgatatcgagtg

SEQ ID NO: 922804 - DNA, 25 bp, Mus musculus
ttagcctgacctttgatatcgagtg

SEQ ID NO: 922805 - DNA, 25 bp, Mus musculus
ttagcctgagttcctgacccacata

SEQ ID NO: 922806 - DNA, 25 bp, Mus musculus
ttagcctgagttgctgacccacata

SEQ ID NO: 922807 - DNA, 25 bp, Mus musculus
ttagcctgccccactgagcagattt

SEQ ID NO: 922808 - DNA, 25 bp, Mus musculus
ttagcctgcccctctgagcagattt

SEQ ID NO: 922809 - DNA, 25 bp, Mus musculus
ttagcctgcgtcagttaatgtactg

SEQ ID NO: 922810 - DNA, 25 bp, Mus musculus
ttagcctgcgtcatacagaatgaat

SEQ ID NO: 922811 - DNA, 25 bp, Mus musculus
ttagcctgcgtctgttaatgtactg

SEQ ID NO: 922812 - DNA, 25 bp, Mus musculus
ttagcctgcgtcttacagaatgaat

SEQ ID NO: 922813 - DNA, 25 bp, Mus musculus
ttagcctggatgagactcggcgctg

SEQ ID NO: 922814 - DNA, 25 bp, Mus musculus
ttagcctggatgtgactcggcgctg

SEQ ID NO: 922815 - DNA, 25 bp, Mus musculus
ttagcctggcccaagagatgccact

SEQ ID NO: 922816 - DNA, 25 bp, Mus musculus
ttagcctggccctagagatgccact

SEQ ID NO: 922817 - DNA, 25 bp, Mus musculus
ttagcctgggtgagacctacgccat

SEQ ID NO: 922818 - DNA, 25 bp, Mus musculus
ttagcctgggtgtgacctacgccat

SEQ ID NO: 922819 - DNA, 25 bp, Mus musculus
ttagcctggtgtatttgtactcaaa

SEQ ID NO: 922820 - DNA, 25 bp, Mus musculus
ttagcctggtgtttttgtactcaaa

SEQ ID NO: 922821 - DNA, 25 bp, Mus musculus
ttagcctgtagaccttccacgatag

SEQ ID NO: 922822 - DNA, 25 bp, Mus musculus
ttagcctgtagagcttccacgatag

SEQ ID NO: 922823 - DNA, 25 bp, Mus musculus
ttagcctgtggcagcatttcatgac

SEQ ID NO: 922824 - DNA, 25 bp, Mus musculus
ttagcctgtggctgcatttcatgac

SEQ ID NO: 922825 - DNA, 25 bp, Mus musculus
ttagcctgtggtagtcctctggaca

SEQ ID NO: 922826 - DNA, 25 bp, Mus musculus
ttagcctgtggttgtcctctggaca

SEQ ID NO: 922827 - DNA, 25 bp, Mus musculus
ttagcctgttcacctgacgtagaag

SEQ ID NO: 922828 - DNA, 25 bp, Mus musculus
ttagcctgttcagctgacgtagaag

SEQ ID NO: 922829 - DNA, 25 bp, Mus musculus
ttagcctgtttaagtgcccaactac

SEQ ID NO: 922830 - DNA, 25 bp, Mus musculus
ttagcctgtttatgtgcccaactac

SEQ ID NO: 922831 - DNA, 25 bp, Mus musculus
ttagccttaggcacacagtaaattc

SEQ ID NO: 922832 - DNA, 25 bp, Mus musculus
ttagccttaggctcacagtaaattc

SEQ ID NO: 922833 - DNA, 25 bp, Mus musculus
ttagccttattaaaccttgcactta

SEQ ID NO: 922834 - DNA, 25 bp, Mus musculus
ttagccttattataccttgcactta

SEQ ID NO: 922835 - DNA, 25 bp, Mus musculus
ttagccttcagaccttcaagggcca

SEQ ID NO: 922836 - DNA, 25 bp, Mus musculus
ttagccttcagagcttcaagggcca

SEQ ID NO: 922837 - DNA, 25 bp, Mus musculus
ttagccttcagcatcgccgaggatt

SEQ ID NO: 922838 - DNA, 25 bp, Mus musculus
ttagccttcagcttcgccgaggatt

SEQ ID NO: 922839 - DNA, 25 bp, Mus musculus
ttagccttcaggagcagaatatgga

SEQ ID NO: 922840 - DNA, 25 bp, Mus musculus
ttagccttcaggtgcagaatatgga

SEQ ID NO: 922841 - DNA, 25 bp, Mus musculus
ttagccttcctaagtttttcatgtg

SEQ ID NO: 922842 - DNA, 25 bp, Mus musculus
ttagccttcctatgtttttcatgtg

SEQ ID NO: 922843 - DNA, 25 bp, Mus musculus
ttagccttcctccatacagcaattt

SEQ ID NO: 922844 - DNA, 25 bp, Mus musculus
ttagccttcctcgatacagcaattt

SEQ ID NO: 922845 - DNA, 25 bp, Mus musculus
ttagccttctgtacaattcctagta

SEQ ID NO: 922846 - DNA, 25 bp, Mus musculus
ttagccttctgttcaattcctagta

SEQ ID NO: 922847 - DNA, 25 bp, Mus musculus
ttagccttgatcagtgacgcgctgt

SEQ ID NO: 922848 - DNA, 25 bp, Mus musculus
ttagccttgatctgtgacgcgctgt

SEQ ID NO: 922849 - DNA, 25 bp, Mus musculus
ttagccttgcaacccatggcataac

SEQ ID NO: 922850 - DNA, 25 bp, Mus musculus
ttagccttgcaagccatggcataac

SEQ ID NO: 922851 - DNA, 25 bp, Mus musculus
ttagccttgccgaagcctatcttta

SEQ ID NO: 922852 - DNA, 25 bp, Mus musculus
ttagccttgccgtagcctatcttta

SEQ ID NO: 922853 - DNA, 25 bp, Mus musculus
ttagccttgtcaccctagagtgtga

SEQ ID NO: 922854 - DNA, 25 bp, Mus musculus
ttagccttgtcagcctagagtgtga

SEQ ID NO: 922855 - DNA, 25 bp, Mus musculus
ttagccttgttcacttttaactccg

SEQ ID NO: 922856 - DNA, 25 bp, Mus musculus
ttagccttgttctcttttaactccg

SEQ ID NO: 922857 - DNA, 25 bp, Mus musculus
ttagcctttactaggttgggctctg

SEQ ID NO: 922858 - DNA, 25 bp, Mus musculus
ttagcctttacttggttgggctctg

SEQ ID NO: 922859 - DNA, 25 bp, Mus musculus
ttagcctttattctacaaaaataag

SEQ ID NO: 922860 - DNA, 25 bp, Mus musculus
ttagcctttattgtacaaaaataag

SEQ ID NO: 922861 - DNA, 25 bp, Mus musculus
ttagcctttcccacagttgaagcat

SEQ ID NO: 922862 - DNA, 25 bp, Mus musculus
ttagcctttccctcagttgaagcat

SEQ ID NO: 922863 - DNA, 25 bp, Mus musculus
ttagcctttccgaaaaagtcctgag

SEQ ID NO: 922864 - DNA, 25 bp, Mus musculus
ttagcctttccgtaaaagtcctgag

SEQ ID NO: 922865 - DNA, 25 bp, Mus musculus
ttagcctttctgaaccccttagcta

SEQ ID NO: 922866 - DNA, 25 bp, Mus musculus
ttagcctttctgtaccccttagcta

SEQ ID NO: 922867 - DNA, 25 bp, Mus musculus
ttagcctttttcacatccttctttc

SEQ ID NO: 922868 - DNA, 25 bp, Mus musculus
ttagcctttttcattctggctgaaa

SEQ ID NO: 922869 - DNA, 25 bp, Mus musculus
ttagcctttttctcatccttctttc

SEQ ID NO: 922870 - DNA, 25 bp, Mus musculus
ttagcctttttctttctggctgaaa

SEQ ID NO: 922871 - DNA, 25 bp, Mus musculus
ttagcgaaacccagtgtccttggag

SEQ ID NO: 922872 - DNA, 25 bp, Mus musculus
ttagcgaaaccctgtgtccttggag

SEQ ID NO: 922873 - DNA, 25 bp, Mus musculus
ttagcgacagcgcaagcactcgtgc

SEQ ID NO: 922874 - DNA, 25 bp, Mus musculus
ttagcgacagcggaagcactcgtgc

SEQ ID NO: 922875 - DNA, 25 bp, Mus musculus
ttagcgagagacaataaccaccgag

SEQ ID NO: 922876 - DNA, 25 bp, Mus musculus
ttagcgagagactataaccaccgag

SEQ ID NO: 922877 - DNA, 25 bp, Mus musculus
ttagcgaggcgcaggatcaccgatt

SEQ ID NO: 922878 - DNA, 25 bp, Mus musculus
ttagcgaggcgctggatcaccgatt

SEQ ID NO: 922879 - DNA, 25 bp, Mus musculus
ttagcgataataccagttccctttg

SEQ ID NO: 922880 - DNA, 25 bp, Mus musculus
ttagcgataatagcagttccctttg

SEQ ID NO: 922881 - DNA, 25 bp, Mus musculus
ttagcgcaatgacgacacagcaaga

SEQ ID NO: 922882 - DNA, 25 bp, Mus musculus
ttagcgcaatgaggacacagcaaga

SEQ ID NO: 922883 - DNA, 25 bp, Mus musculus
ttagcgcctcctaccggtgagaagg

SEQ ID NO: 922884 - DNA, 25 bp, Mus musculus
ttagcgcctccttccggtgagaagg

SEQ ID NO: 922885 - DNA, 25 bp, Mus musculus
ttagcgccttgacttttgatcccta

SEQ ID NO: 922886 - DNA, 25 bp, Mus musculus
ttagcgccttgagttttgatcccta

SEQ ID NO: 922887 - DNA, 25 bp, Mus musculus
ttagcgcttaccagaggtggccaca

SEQ ID NO: 922888 - DNA, 25 bp, Mus musculus
ttagcgcttacctgaggtggccaca

SEQ ID NO: 922889 - DNA, 25 bp, Mus musculus
ttagcggatttgcatgctttcccag

SEQ ID NO: 922890 - DNA, 25 bp, Mus musculus
ttagcggatttggatgctttcccag

SEQ ID NO: 922891 - DNA, 25 bp, Mus musculus
ttagcggctattcagcgagcgcatg

SEQ ID NO: 922892 - DNA, 25 bp, Mus musculus
ttagcggctattgagcgagcgcatg

SEQ ID NO: 922893 - DNA, 25 bp, Mus musculus
ttagcggctgcaatgaaatcactgg

SEQ ID NO: 922894 - DNA, 25 bp, Mus musculus
ttagcggctgcattgaaatcactgg

SEQ ID NO: 922895 - DNA, 25 bp, Mus musculus
ttagcggctgctagagaatgacctt

SEQ ID NO: 922896 - DNA, 25 bp, Mus musculus
ttagcggctgcttgagaatgacctt

SEQ ID NO: 922897 - DNA, 25 bp, Mus musculus
ttagcggctgtgcagactgtcccaa

SEQ ID NO: 922898 - DNA, 25 bp, Mus musculus
ttagcggctgtggagactgtcccaa

SEQ ID NO: 922899 - DNA, 25 bp, Mus musculus
ttagcgtagcgcactgttcctggtg

SEQ ID NO: 922900 - DNA, 25 bp, Mus musculus
ttagcgtagcgctctgttcctggtg

SEQ ID NO: 922901 - DNA, 25 bp, Mus musculus
ttagcgtccaggatcttcaggtact

SEQ ID NO: 922902 - DNA, 25 bp, Mus musculus
ttagcgtccaggttcttcaggtact

SEQ ID NO: 922903 - DNA, 25 bp, Mus musculus
ttagcgtcgttcacagaggcagggc

SEQ ID NO: 922904 - DNA, 25 bp, Mus musculus
ttagcgtcgttctcagaggcagggc

SEQ ID NO: 922905 - DNA, 25 bp, Mus musculus
ttagcgtggctgatgagaggatttt

SEQ ID NO: 922906 - DNA, 25 bp, Mus musculus
ttagcgtggctgttgagaggatttt

SEQ ID NO: 922907 - DNA, 25 bp, Mus musculus
ttagcgtgtgtcctaatcttctctc

SEQ ID NO: 922908 - DNA, 25 bp, Mus musculus
ttagcgtgtgtcgtaatcttctctc

SEQ ID NO: 922909 - DNA, 25 bp, Mus musculus
ttagcgttcttactccacttctggg

SEQ ID NO: 922910 - DNA, 25 bp, Mus musculus
ttagcgttcttagtccacttctggg

SEQ ID NO: 922911 - DNA, 25 bp, Mus musculus
ttagctaaagaaccctcccttgtga

SEQ ID NO: 922912 - DNA, 25 bp, Mus musculus
ttagctaaagaagcctcccttgtga

SEQ ID NO: 922913 - DNA, 25 bp, Mus musculus
ttagctaaaggacatcgtgcaattc

SEQ ID NO: 922914 - DNA, 25 bp, Mus musculus
ttagctaaaggagatcgtgcaattc

SEQ ID NO: 922915 - DNA, 25 bp, Mus musculus
ttagctaagactatcctgacttccg

SEQ ID NO: 922916 - DNA, 25 bp, Mus musculus
ttagctaagactttcctgacttccg

SEQ ID NO: 922917 - DNA, 25 bp, Mus musculus
ttagctaaggctagccttttcctac

SEQ ID NO: 922918 - DNA, 25 bp, Mus musculus
ttagctaaggcttgccttttcctac

SEQ ID NO: 922919 - DNA, 25 bp, Mus musculus
ttagctacagctagtttaacggcag

SEQ ID NO: 922920 - DNA, 25 bp, Mus musculus
ttagctacagcttgtttaacggcag

SEQ ID NO: 922921 - DNA, 25 bp, Mus musculus
ttagctacatgcatatcaccacact

SEQ ID NO: 922922 - DNA, 25 bp, Mus musculus
ttagctacatgcttatcaccacact

SEQ ID NO: 922923 - DNA, 25 bp, Mus musculus
ttagctacccacagtgttactctgt

SEQ ID NO: 922924 - DNA, 25 bp, Mus musculus
ttagctacccactgtgttactctgt

SEQ ID NO: 922925 - DNA, 25 bp, Mus musculus
ttagctaccctgcacaatgctgtca

SEQ ID NO: 922926 - DNA, 25 bp, Mus musculus
ttagctaccctggacaatgctgtca

SEQ ID NO: 922927 - DNA, 25 bp, Mus musculus
ttagctacgtgcacatggtttgctc

SEQ ID NO: 922928 - DNA, 25 bp, Mus musculus
ttagctacgtgctcatggtttgctc

SEQ ID NO: 922929 - DNA, 25 bp, Mus musculus
ttagctactattacccacagttttc

SEQ ID NO: 922930 - DNA, 25 bp, Mus musculus
ttagctactatttcccacagttttc

SEQ ID NO: 922931 - DNA, 25 bp, Mus musculus
ttagctactccaaaagtcatatcct

SEQ ID NO: 922932 - DNA, 25 bp, Mus musculus
ttagctactccaaaggccagaacta

SEQ ID NO: 922933 - DNA, 25 bp, Mus musculus
ttagctactccataagtcatatcct

SEQ ID NO: 922934 - DNA, 25 bp, Mus musculus
ttagctactccataggccagaacta

SEQ ID NO: 922935 - DNA, 25 bp, Mus musculus
ttagctactgaacgacatggctcag

SEQ ID NO: 922936 - DNA, 25 bp, Mus musculus
ttagctactgaaggacatggctcag

SEQ ID NO: 922937 - DNA, 25 bp, Mus musculus
ttagctacttccctaaactctatgg

SEQ ID NO: 922938 - DNA, 25 bp, Mus musculus
ttagctacttccgtaaactctatgg

SEQ ID NO: 922939 - DNA, 25 bp, Mus musculus
ttagctagaggtctcccaccaggtt

SEQ ID NO: 922940 - DNA, 25 bp, Mus musculus
ttagctagaggtgtcccaccaggtt

SEQ ID NO: 922941 - DNA, 25 bp, Mus musculus
ttagctagcagtatgagtcctattc

SEQ ID NO: 922942 - DNA, 25 bp, Mus musculus
ttagctagcagtttgagtcctattc

SEQ ID NO: 922943 - DNA, 25 bp, Mus musculus
ttagctaggagcaccaggtcactca

SEQ ID NO: 922944 - DNA, 25 bp, Mus musculus
ttagctaggagctccaggtcactca

SEQ ID NO: 922945 - DNA, 25 bp, Mus musculus
ttagctagtcccaacccataaactt

SEQ ID NO: 922946 - DNA, 25 bp, Mus musculus
ttagctagtccctacccataaactt

SEQ ID NO: 922947 - DNA, 25 bp, Mus musculus
ttagctagtcctctcgactcttttt

SEQ ID NO: 922948 - DNA, 25 bp, Mus musculus
ttagctagtcctgtcgactcttttt

SEQ ID NO: 922949 - DNA, 25 bp, Mus musculus
ttagctatccatccccagggtcgga

SEQ ID NO: 922950 - DNA, 25 bp, Mus musculus
ttagctatccatgcccagggtcgga

SEQ ID NO: 922951 - DNA, 25 bp, Mus musculus
ttagctatcgtgcatcagcgacctt

SEQ ID NO: 922952 - DNA, 25 bp, Mus musculus
ttagctatcgtggatcagcgacctt

SEQ ID NO: 922953 - DNA, 25 bp, Mus musculus
ttagctatggatcaacctgcacctt

SEQ ID NO: 922954 - DNA, 25 bp, Mus musculus
ttagctatggatgaacctgcacctt

SEQ ID NO: 922955 - DNA, 25 bp, Mus musculus
ttagctatggctccatttcccaaga

SEQ ID NO: 922956 - DNA, 25 bp, Mus musculus
ttagctatggctgcatttcccaaga

SEQ ID NO: 922957 - DNA, 25 bp, Mus musculus
ttagctattagacgcccaaccccaa

SEQ ID NO: 922958 - DNA, 25 bp, Mus musculus
ttagctattagaggcccaaccccaa

SEQ ID NO: 922959 - DNA, 25 bp, Mus musculus
ttagctattctgaacgcattgttga

SEQ ID NO: 922960 - DNA, 25 bp, Mus musculus
ttagctattctgtacgcattgttga

SEQ ID NO: 922961 - DNA, 25 bp, Mus musculus
ttagctatttagagcccagcactgt

SEQ ID NO: 922962 - DNA, 25 bp, Mus musculus
ttagctatttagtgcccagcactgt

SEQ ID NO: 922963 - DNA, 25 bp, Mus musculus
ttagctcaaagtacttaagtgtcaa

SEQ ID NO: 922964 - DNA, 25 bp, Mus musculus
ttagctcaaagttcttaagtgtcaa

SEQ ID NO: 922965 - DNA, 25 bp, Mus musculus
ttagctcaattacaagcaattcctt

SEQ ID NO: 922966 - DNA, 25 bp, Mus musculus
ttagctcaattagaagcaattcctt

SEQ ID NO: 922967 - DNA, 25 bp, Mus musculus
ttagctcaccgtagcccagggaaca

SEQ ID NO: 922968 - DNA, 25 bp, Mus musculus
ttagctcaccgttgcccagggaaca

SEQ ID NO: 922969 - DNA, 25 bp, Mus musculus
ttagctcagaggctcagattcatca

SEQ ID NO: 922970 - DNA, 25 bp, Mus musculus
ttagctcagagggtcagattcatca

SEQ ID NO: 922971 - DNA, 25 bp, Mus musculus
ttagctcagcaaatccagtgcattt

SEQ ID NO: 922972 - DNA, 25 bp, Mus musculus
ttagctcagcaattccagtgcattt

SEQ ID NO: 922973 - DNA, 25 bp, Mus musculus
ttagctcagctcaatatgagaagtg

SEQ ID NO: 922974 - DNA, 25 bp, Mus musculus
ttagctcagctctatatgagaagtg

SEQ ID NO: 922975 - DNA, 25 bp, Mus musculus
ttagctcagtgacagcgcttactcg

SEQ ID NO: 922976 - DNA, 25 bp, Mus musculus
ttagctcagtgagagcgcttactcg

SEQ ID NO: 922977 - DNA, 25 bp, Mus musculus
ttagctcagtggaagagcgcttgcc

SEQ ID NO: 922978 - DNA, 25 bp, Mus musculus
ttagctcagtggtagagcgcttgcc

SEQ ID NO: 922979 - DNA, 25 bp, Mus musculus
ttagctcatctcactttcttgtatt

SEQ ID NO: 922980 - DNA, 25 bp, Mus musculus
ttagctcatctctctttcttgtatt

SEQ ID NO: 922981 - DNA, 25 bp, Mus musculus
ttagctcatgtgcaatgttcgtggc

SEQ ID NO: 922982 - DNA, 25 bp, Mus musculus
ttagctcatgtggaatgttcgtggc

SEQ ID NO: 922983 - DNA, 25 bp, Mus musculus
ttagctcattgcagctcgtcactta

SEQ ID NO: 922984 - DNA, 25 bp, Mus musculus
ttagctcattgctgctcgtcactta

SEQ ID NO: 922985 - DNA, 25 bp, Mus musculus
ttagctccaattacagcttctccta

SEQ ID NO: 922986 - DNA, 25 bp, Mus musculus
ttagctccaatttcagcttctccta

SEQ ID NO: 922987 - DNA, 25 bp, Mus musculus
ttagctccagagcattccgagagag

SEQ ID NO: 922988 - DNA, 25 bp, Mus musculus
ttagctccagaggattccgagagag

SEQ ID NO: 922989 - DNA, 25 bp, Mus musculus
ttagctcccagactagcctatgcat

SEQ ID NO: 922990 - DNA, 25 bp, Mus musculus
ttagctcccagagtagcctatgcat

SEQ ID NO: 922991 - DNA, 25 bp, Mus musculus
ttagctcccattcccagacttctgg

SEQ ID NO: 922992 - DNA, 25 bp, Mus musculus
ttagctcccattgccagacttctgg

SEQ ID NO: 922993 - DNA, 25 bp, Mus musculus
ttagctccccagaggaacactttta

SEQ ID NO: 922994 - DNA, 25 bp, Mus musculus
ttagctccccagtggaacactttta

SEQ ID NO: 922995 - DNA, 25 bp, Mus musculus
ttagctcccgtaaggctggcaatat

SEQ ID NO: 922996 - DNA, 25 bp, Mus musculus
ttagctcccgtatggctggcaatat

SEQ ID NO: 922997 - DNA, 25 bp, Mus musculus
ttagctccctgtaaacattcactga

SEQ ID NO: 922998 - DNA, 25 bp, Mus musculus
ttagctccctgttaacattcactga

SEQ ID NO: 922999 - DNA, 25 bp, Mus musculus
ttagctccggacctgaaatacttcg

SEQ ID NO: 923000 - DNA, 25 bp, Mus musculus
ttagctccggacgtgaaatacttcg

SEQ ID NO: 923001 - DNA, 25 bp, Mus musculus
ttagctcctaggatacatgaccgtg

SEQ ID NO: 923002 - DNA, 25 bp, Mus musculus
ttagctcctaggttacatgaccgtg

SEQ ID NO: 923003 - DNA, 25 bp, Mus musculus
ttagctcctcttatactaagcttat

SEQ ID NO: 923004 - DNA, 25 bp, Mus musculus
ttagctcctcttttactaagcttat

SEQ ID NO: 923005 - DNA, 25 bp, Mus musculus
ttagctcctgacacatttgacaaaa

SEQ ID NO: 923006 - DNA, 25 bp, Mus musculus
ttagctcctgactcatttgacaaaa

SEQ ID NO: 923007 - DNA, 25 bp, Mus musculus
ttagctccttaaacctctattcaga

SEQ ID NO: 923008 - DNA, 25 bp, Mus musculus
ttagctccttaactccttagtcata

SEQ ID NO: 923009 - DNA, 25 bp, Mus musculus
ttagctccttaagtccttagtcata

SEQ ID NO: 923010 - DNA, 25 bp, Mus musculus
ttagctccttaatcctctattcaga

SEQ ID NO: 923011 - DNA, 25 bp, Mus musculus
ttagctcgcgttactgatggcaaaa

SEQ ID NO: 923012 - DNA, 25 bp, Mus musculus
ttagctcgcgtttctgatggcaaaa

SEQ ID NO: 923013 - DNA, 25 bp, Mus musculus
ttagctcggacactgcagtggtgca

SEQ ID NO: 923014 - DNA, 25 bp, Mus musculus
ttagctcggacagtgcagtggtgca

SEQ ID NO: 923015 - DNA, 25 bp, Mus musculus
ttagctcggctaatttcttcttaag

SEQ ID NO: 923016 - DNA, 25 bp, Mus musculus
ttagctcggctattttcttcttaag

SEQ ID NO: 923017 - DNA, 25 bp, Mus musculus
ttagctcgggagactctgcagctta

SEQ ID NO: 923018 - DNA, 25 bp, Mus musculus
ttagctcgggagtctctgcagctta

SEQ ID NO: 923019 - DNA, 25 bp, Mus musculus
ttagctcgtgctagtcattagctcc

SEQ ID NO: 923020 - DNA, 25 bp, Mus musculus
ttagctcgtgcttgtcattagctcc

SEQ ID NO: 923021 - DNA, 25 bp, Mus musculus
ttagctcgtgtgagttactttaaaa

SEQ ID NO: 923022 - DNA, 25 bp, Mus musculus
ttagctcgtgtgtgttactttaaaa

SEQ ID NO: 923023 - DNA, 25 bp, Mus musculus
ttagctctacttcgccagcctgcag

SEQ ID NO: 923024 - DNA, 25 bp, Mus musculus
ttagctctacttggccagcctgcag

SEQ ID NO: 923025 - DNA, 25 bp, Mus musculus
ttagctctatcgctagccctagaat

SEQ ID NO: 923026 - DNA, 25 bp, Mus musculus
ttagctctatcggtagccctagaat

SEQ ID NO: 923027 - DNA, 25 bp, Mus musculus
ttagctctcagcatgtacgaggctc

SEQ ID NO: 923028 - DNA, 25 bp, Mus musculus
ttagctctcagcttgtacgaggctc

SEQ ID NO: 923029 - DNA, 25 bp, Mus musculus
ttagctctctacactttgacatcat

SEQ ID NO: 923030 - DNA, 25 bp, Mus musculus
ttagctctctactctttgacatcat

SEQ ID NO: 923031 - DNA, 25 bp, Mus musculus
ttagctctctgactgtggatggctt

SEQ ID NO: 923032 - DNA, 25 bp, Mus musculus
ttagctctctgagtgtggatggctt

SEQ ID NO: 923033 - DNA, 25 bp, Mus musculus
ttagctctctgtccaggagcaggat

SEQ ID NO: 923034 - DNA, 25 bp, Mus musculus
ttagctctctgtcctcaatattcag

SEQ ID NO: 923035 - DNA, 25 bp, Mus musculus
ttagctctctgtgcaggagcaggat

SEQ ID NO: 923036 - DNA, 25 bp, Mus musculus
ttagctctctgtgctcaatattcag

SEQ ID NO: 923037 - DNA, 25 bp, Mus musculus
ttagctctcttaacgctgcctgaaa

SEQ ID NO: 923038 - DNA, 25 bp, Mus musculus
ttagctctcttatcgctgcctgaaa

SEQ ID NO: 923039 - DNA, 25 bp, Mus musculus
ttagctctgagccaacttcctggag

SEQ ID NO: 923040 - DNA, 25 bp, Mus musculus
ttagctctgagcgaacttcctggag

SEQ ID NO: 923041 - DNA, 25 bp, Mus musculus
ttagctctgaggcatcctgggtatt

SEQ ID NO: 923042 - DNA, 25 bp, Mus musculus
ttagctctgagggatcctgggtatt

SEQ ID NO: 923043 - DNA, 25 bp, Mus musculus
ttagctctgcacctggatctgccat

SEQ ID NO: 923044 - DNA, 25 bp, Mus musculus
ttagctctgcacgtggatctgccat

SEQ ID NO: 923045 - DNA, 25 bp, Mus musculus
ttagctctgcatctagacaacgcgc

SEQ ID NO: 923046 - DNA, 25 bp, Mus musculus
ttagctctgcatgtagacaacgcgc

SEQ ID NO: 923047 - DNA, 25 bp, Mus musculus
ttagctctgcctattgagataagat

SEQ ID NO: 923048 - DNA, 25 bp, Mus musculus
ttagctctgcctctacgggctaatt

SEQ ID NO: 923049 - DNA, 25 bp, Mus musculus
ttagctctgcctgtacgggctaatt

SEQ ID NO: 923050 - DNA, 25 bp, Mus musculus
ttagctctgccttttgagataagat

SEQ ID NO: 923051 - DNA, 25 bp, Mus musculus
ttagctctgctccaagggcaaattt

SEQ ID NO: 923052 - DNA, 25 bp, Mus musculus
ttagctctgctcgaagggcaaattt

SEQ ID NO: 923053 - DNA, 25 bp, Mus musculus
ttagctctgctgcttgggagaacat

SEQ ID NO: 923054 - DNA, 25 bp, Mus musculus
ttagctctgctggttgggagaacat

SEQ ID NO: 923055 - DNA, 25 bp, Mus musculus
ttagctctgcttacgattactttta

SEQ ID NO: 923056 - DNA, 25 bp, Mus musculus
ttagctctgctttcgattactttta

SEQ ID NO: 923057 - DNA, 25 bp, Mus musculus
ttagctctgggcctggctcagcact

SEQ ID NO: 923058 - DNA, 25 bp, Mus musculus
ttagctctgggcgtggctcagcact

SEQ ID NO: 923059 - DNA, 25 bp, Mus musculus
ttagctctggttctccatggaatca

SEQ ID NO: 923060 - DNA, 25 bp, Mus musculus
ttagctctggttgtccatggaatca

SEQ ID NO: 923061 - DNA, 25 bp, Mus musculus
ttagctctgtgtctcctgttttact

SEQ ID NO: 923062 - DNA, 25 bp, Mus musculus
ttagctctgtgtgtcctgttttact

SEQ ID NO: 923063 - DNA, 25 bp, Mus musculus
ttagctctgtttctcccttgggtag

SEQ ID NO: 923064 - DNA, 25 bp, Mus musculus
ttagctctgtttgtcccttgggtag

SEQ ID NO: 923065 - DNA, 25 bp, Mus musculus
ttagctcttgctcatctaggacata

SEQ ID NO: 923066 - DNA, 25 bp, Mus musculus
ttagctcttgctgatctaggacata

SEQ ID NO: 923067 - DNA, 25 bp, Mus musculus
ttagctgaagacatcctccgaaaga

SEQ ID NO: 923068 - DNA, 25 bp, Mus musculus
ttagctgaagacttcctccgaaaga

SEQ ID NO: 923069 - DNA, 25 bp, Mus musculus
ttagctgactgacttggtggatctt

SEQ ID NO: 923070 - DNA, 25 bp, Mus musculus
ttagctgactgagttggtggatctt

SEQ ID NO: 923071 - DNA, 25 bp, Mus musculus
ttagctgagcagcagggctcgctta

SEQ ID NO: 923072 - DNA, 25 bp, Mus musculus
ttagctgagcaggagggctcgctta

SEQ ID NO: 923073 - DNA, 25 bp, Mus musculus
ttagctgagtcaatttcctgccttt

SEQ ID NO: 923074 - DNA, 25 bp, Mus musculus
ttagctgagtcattttcctgccttt

SEQ ID NO: 923075 - DNA, 25 bp, Mus musculus
ttagctgagtgcagttttctgcatc

SEQ ID NO: 923076 - DNA, 25 bp, Mus musculus
ttagctgagtgctgttttctgcatc

SEQ ID NO: 923077 - DNA, 25 bp, Mus musculus
ttagctgagttgctcagcccactag

SEQ ID NO: 923078 - DNA, 25 bp, Mus musculus
ttagctgagttggtcagcccactag

SEQ ID NO: 923079 - DNA, 25 bp, Mus musculus
ttagctgcaaaaaacaacttggtgt

SEQ ID NO: 923080 - DNA, 25 bp, Mus musculus
ttagctgcaaaatacaacttggtgt

SEQ ID NO: 923081 - DNA, 25 bp, Mus musculus
ttagctgcactgaccctgtagctaa

SEQ ID NO: 923082 - DNA, 25 bp, Mus musculus
ttagctgcactgtccctgtagctaa

SEQ ID NO: 923083 - DNA, 25 bp, Mus musculus
ttagctgccagactgaatatgctca

SEQ ID NO: 923084 - DNA, 25 bp, Mus musculus
ttagctgccagagtgaatatgctca

SEQ ID NO: 923085 - DNA, 25 bp, Mus musculus
ttagctgccctgacaacagcctagg

SEQ ID NO: 923086 - DNA, 25 bp, Mus musculus
ttagctgccctgtcaacagcctagg

SEQ ID NO: 923087 - DNA, 25 bp, Mus musculus
ttagctgcctttcctattgtttccg

SEQ ID NO: 923088 - DNA, 25 bp, Mus musculus
ttagctgcctttgctattgtttccg

SEQ ID NO: 923089 - DNA, 25 bp, Mus musculus
ttagctgcgatcctgcttttgaact

SEQ ID NO: 923090 - DNA, 25 bp, Mus musculus
ttagctgcgatcgtgcttttgaact

SEQ ID NO: 923091 - DNA, 25 bp, Mus musculus
ttagctgctccaaagatatccagta

SEQ ID NO: 923092 - DNA, 25 bp, Mus musculus
ttagctgctccatagatatccagta

SEQ ID NO: 923093 - DNA, 25 bp, Mus musculus
ttagctgctccgagtagttaactga

SEQ ID NO: 923094 - DNA, 25 bp, Mus musculus
ttagctgctccgtgtagttaactga

SEQ ID NO: 923095 - DNA, 25 bp, Mus musculus
ttagctgctgccacattatgcagag

SEQ ID NO: 923096 - DNA, 25 bp, Mus musculus
ttagctgctgcctcattatgcagag

SEQ ID NO: 923097 - DNA, 25 bp, Mus musculus
ttagctgctggcagtgaatgcgctt

SEQ ID NO: 923098 - DNA, 25 bp, Mus musculus
ttagctgctggctgtgaatgcgctt

SEQ ID NO: 923099 - DNA, 25 bp, Mus musculus
ttagctggaagtattgtccttaccc

SEQ ID NO: 923100 - DNA, 25 bp, Mus musculus
ttagctggaagttttgtccttaccc

SEQ ID NO: 923101 - DNA, 25 bp, Mus musculus
ttagctgggatgagcggccaccatg

SEQ ID NO: 923102 - DNA, 25 bp, Mus musculus
ttagctgggatgtgcggccaccatg

SEQ ID NO: 923103 - DNA, 25 bp, Mus musculus
ttagctgggttaaaccttcttctct

SEQ ID NO: 923104 - DNA, 25 bp, Mus musculus
ttagctgggttataccttcttctct

SEQ ID NO: 923105 - DNA, 25 bp, Mus musculus
ttagctggtcacacacggagcacaa

SEQ ID NO: 923106 - DNA, 25 bp, Mus musculus
ttagctggtcactcacggagcacaa

SEQ ID NO: 923107 - DNA, 25 bp, Mus musculus
ttagctggtctaactgcccggaggc

SEQ ID NO: 923108 - DNA, 25 bp, Mus musculus
ttagctggtctatctgcccggaggc

SEQ ID NO: 923109 - DNA, 25 bp, Mus musculus
ttagctggtctcaaaaacccaccac

SEQ ID NO: 923110 - DNA, 25 bp, Mus musculus
ttagctggtctctaaaacccaccac

SEQ ID NO: 923111 - DNA, 25 bp, Mus musculus
ttagctgtagctctcagtgggacct

SEQ ID NO: 923112 - DNA, 25 bp, Mus musculus
ttagctgtagctgtcagtgggacct

SEQ ID NO: 923113 - DNA, 25 bp, Mus musculus
ttagctgtatacaatcacagtgggc

SEQ ID NO: 923114 - DNA, 25 bp, Mus musculus
ttagctgtatactatcacagtgggc

SEQ ID NO: 923115 - DNA, 25 bp, Mus musculus
ttagctgtccagatggcagacctga

SEQ ID NO: 923116 - DNA, 25 bp, Mus musculus
ttagctgtccagttggcagacctga

SEQ ID NO: 923117 - DNA, 25 bp, Mus musculus
ttagctgtccccaaataaagttgtg

SEQ ID NO: 923118 - DNA, 25 bp, Mus musculus
ttagctgtcccctaataaagttgtg

SEQ ID NO: 923119 - DNA, 25 bp, Mus musculus
ttagctgtcctgaatgtgttaccat

SEQ ID NO: 923120 - DNA, 25 bp, Mus musculus
ttagctgtcctgtatgtgttaccat

SEQ ID NO: 923121 - DNA, 25 bp, Mus musculus
ttagctgtgagtacttcagcccaga

SEQ ID NO: 923122 - DNA, 25 bp, Mus musculus
ttagctgtgagtcctctccataagc

SEQ ID NO: 923123 - DNA, 25 bp, Mus musculus
ttagctgtgagtgctctccataagc

SEQ ID NO: 923124 - DNA, 25 bp, Mus musculus
ttagctgtgagttcttcagcccaga

SEQ ID NO: 923125 - DNA, 25 bp, Mus musculus
ttagctgtgcccaagtcagcagcca

SEQ ID NO: 923126 - DNA, 25 bp, Mus musculus
ttagctgtgcccatatagactgaag

SEQ ID NO: 923127 - DNA, 25 bp, Mus musculus
ttagctgtgccctagtcagcagcca

SEQ ID NO: 923128 - DNA, 25 bp, Mus musculus
ttagctgtgcccttatagactgaag

SEQ ID NO: 923129 - DNA, 25 bp, Mus musculus
ttagctgtgggcctctgtcttatga

SEQ ID NO: 923130 - DNA, 25 bp, Mus musculus
ttagctgtgggcgtctgtcttatga

SEQ ID NO: 923131 - DNA, 25 bp, Mus musculus
ttagctgtgtcccatggcttcaaga

SEQ ID NO: 923132 - DNA, 25 bp, Mus musculus
ttagctgtgtccgatggcttcaaga

SEQ ID NO: 923133 - DNA, 25 bp, Mus musculus
ttagctgtgtgtatgcgagaccaga

SEQ ID NO: 923134 - DNA, 25 bp, Mus musculus
ttagctgtgtgtttgcgagaccaga

SEQ ID NO: 923135 - DNA, 25 bp, Mus musculus
ttagctgtgtttaggactccgtgtc

SEQ ID NO: 923136 - DNA, 25 bp, Mus musculus
ttagctgtgttttggactccgtgtc

SEQ ID NO: 923137 - DNA, 25 bp, Mus musculus
ttagctgttcatccctgtaactcca

SEQ ID NO: 923138 - DNA, 25 bp, Mus musculus
ttagctgttcatgcctgtaactcca

SEQ ID NO: 923139 - DNA, 25 bp, Mus musculus
ttagctgttcctagactctggtcac

SEQ ID NO: 923140 - DNA, 25 bp, Mus musculus
ttagctgttccttgactctggtcac

SEQ ID NO: 923141 - DNA, 25 bp, Mus musculus
ttagctgttgtcagtgtgctgtgaa

SEQ ID NO: 923142 - DNA, 25 bp, Mus musculus
ttagctgttgtctgtgtgctgtgaa

SEQ ID NO: 923143 - DNA, 25 bp, Mus musculus
ttagcttaacttacacttgcatgtt

SEQ ID NO: 923144 - DNA, 25 bp, Mus musculus
ttagcttaactttcacttgcatgtt

SEQ ID NO: 923145 - DNA, 25 bp, Mus musculus
ttagcttaaggaactattacccaaa

SEQ ID NO: 923146 - DNA, 25 bp, Mus musculus
ttagcttaaggatctattacccaaa

SEQ ID NO: 923147 - DNA, 25 bp, Mus musculus
ttagcttagccgactagtggtgtct

SEQ ID NO: 923148 - DNA, 25 bp, Mus musculus
ttagcttagccgtctagtggtgtct

SEQ ID NO: 923149 - DNA, 25 bp, Mus musculus
ttagcttagcgaagtacaccagact

SEQ ID NO: 923150 - DNA, 25 bp, Mus musculus
ttagcttagcgatgtacaccagact

SEQ ID NO: 923151 - DNA, 25 bp, Mus musculus
ttagcttagcttcctgtctgtgaat

SEQ ID NO: 923152 - DNA, 25 bp, Mus musculus
ttagcttagcttgctgtctgtgaat

SEQ ID NO: 923153 - DNA, 25 bp, Mus musculus
ttagcttagggcatgggcatttcat

SEQ ID NO: 923154 - DNA, 25 bp, Mus musculus
ttagcttagggcttgggcatttcat

SEQ ID NO: 923155 - DNA, 25 bp, Mus musculus
ttagcttatgacatctacacttcca

SEQ ID NO: 923156 - DNA, 25 bp, Mus musculus
ttagcttatgacttctacacttcca

SEQ ID NO: 923157 - DNA, 25 bp, Mus musculus
ttagcttatgatcacaagccagact

SEQ ID NO: 923158 - DNA, 25 bp, Mus musculus
ttagcttatgatgacaagccagact

SEQ ID NO: 923159 - DNA, 25 bp, Mus musculus
ttagcttattttcatctctgtgaag

SEQ ID NO: 923160 - DNA, 25 bp, Mus musculus
ttagcttattttgatctctgtgaag

SEQ ID NO: 923161 - DNA, 25 bp, Mus musculus
ttagcttcacctagggcacgatttt

SEQ ID NO: 923162 - DNA, 25 bp, Mus musculus
ttagcttcaccttgggcacgatttt

SEQ ID NO: 923163 - DNA, 25 bp, Mus musculus
ttagcttcatctactggatacagga

SEQ ID NO: 923164 - DNA, 25 bp, Mus musculus
ttagcttcatcttctggatacagga

SEQ ID NO: 923165 - DNA, 25 bp, Mus musculus
ttagcttccactctgtgcctacaat

SEQ ID NO: 923166 - DNA, 25 bp, Mus musculus
ttagcttccactgtgtgcctacaat

SEQ ID NO: 923167 - DNA, 25 bp, Mus musculus
ttagcttcccaaacagctgagagtt

SEQ ID NO: 923168 - DNA, 25 bp, Mus musculus
ttagcttcccaatcagctgagagtt

SEQ ID NO: 923169 - DNA, 25 bp, Mus musculus
ttagcttcccgcagctgggagaatc

SEQ ID NO: 923170 - DNA, 25 bp, Mus musculus
ttagcttcccgctgctgggagaatc

SEQ ID NO: 923171 - DNA, 25 bp, Mus musculus
ttagcttcccgtctgttagtggaga

SEQ ID NO: 923172 - DNA, 25 bp, Mus musculus
ttagcttcccgtgtgttagtggaga

SEQ ID NO: 923173 - DNA, 25 bp, Mus musculus
ttagcttccctgaatactacctgta

SEQ ID NO: 923174 - DNA, 25 bp, Mus musculus
ttagcttccctgaggtcattaaatg

SEQ ID NO: 923175 - DNA, 25 bp, Mus musculus
ttagcttccctgtatactacctgta

SEQ ID NO: 923176 - DNA, 25 bp, Mus musculus
ttagcttccctgtggtcattaaatg

SEQ ID NO: 923177 - DNA, 25 bp, Mus musculus
ttagcttccgatagtggcactctga

SEQ ID NO: 923178 - DNA, 25 bp, Mus musculus
ttagcttccgattgtggcactctga

SEQ ID NO: 923179 - DNA, 25 bp, Mus musculus
ttagcttcctggcttcccatgaact

SEQ ID NO: 923180 - DNA, 25 bp, Mus musculus
ttagcttcctgggttcccatgaact

SEQ ID NO: 923181 - DNA, 25 bp, Mus musculus
ttagcttcctgtataaggccccgct

SEQ ID NO: 923182 - DNA, 25 bp, Mus musculus
ttagcttcctgtttaaggccccgct

SEQ ID NO: 923183 - DNA, 25 bp, Mus musculus
ttagcttcgtcactcactgttcttg

SEQ ID NO: 923184 - DNA, 25 bp, Mus musculus
ttagcttcgtcagtcactgttcttg

SEQ ID NO: 923185 - DNA, 25 bp, Mus musculus
ttagcttctaatactagtgggaaac

SEQ ID NO: 923186 - DNA, 25 bp, Mus musculus
ttagcttctaattctagtgggaaac

SEQ ID NO: 923187 - DNA, 25 bp, Mus musculus
ttagcttctataagatctccctttg

SEQ ID NO: 923188 - DNA, 25 bp, Mus musculus
ttagcttctatatgatctccctttg

SEQ ID NO: 923189 - DNA, 25 bp, Mus musculus
ttagcttctgacatattccaccatg

SEQ ID NO: 923190 - DNA, 25 bp, Mus musculus
ttagcttctgacttattccaccatg

SEQ ID NO: 923191 - DNA, 25 bp, Mus musculus
ttagcttctgccactgcaaaacaca

SEQ ID NO: 923192 - DNA, 25 bp, Mus musculus
ttagcttctgcctctgcaaaacaca

SEQ ID NO: 923193 - DNA, 25 bp, Mus musculus
ttagcttctgtaatgagggtttgga

SEQ ID NO: 923194 - DNA, 25 bp, Mus musculus
ttagcttctgtattgagggtttgga

SEQ ID NO: 923195 - DNA, 25 bp, Mus musculus
ttagcttcttctatgttttcttgga

SEQ ID NO: 923196 - DNA, 25 bp, Mus musculus
ttagcttcttctttgttttcttgga

SEQ ID NO: 923197 - DNA, 25 bp, Mus musculus
ttagcttgagacacctaggatacgg

SEQ ID NO: 923198 - DNA, 25 bp, Mus musculus
ttagcttgagactcctaggatacgg

SEQ ID NO: 923199 - DNA, 25 bp, Mus musculus
ttagcttgagagctcatgctctgag

SEQ ID NO: 923200 - DNA, 25 bp, Mus musculus
ttagcttgagaggtcatgctctgag

SEQ ID NO: 923201 - DNA, 25 bp, Mus musculus
ttagcttgctttattcctaacccct

SEQ ID NO: 923202 - DNA, 25 bp, Mus musculus
ttagcttgcttttttcctaacccct

SEQ ID NO: 923203 - DNA, 25 bp, Mus musculus
ttagcttggataccaggctggctct

SEQ ID NO: 923204 - DNA, 25 bp, Mus musculus
ttagcttggatagcaggctggctct

SEQ ID NO: 923205 - DNA, 25 bp, Mus musculus
ttagcttgtattacagaccatcatc

SEQ ID NO: 923206 - DNA, 25 bp, Mus musculus
ttagcttgtatttcagaccatcatc

SEQ ID NO: 923207 - DNA, 25 bp, Mus musculus
ttagcttgtcatcaaatgtcaacga

SEQ ID NO: 923208 - DNA, 25 bp, Mus musculus
ttagcttgtcatgaaatgtcaacga

SEQ ID NO: 923209 - DNA, 25 bp, Mus musculus
ttagcttgtgatctatagagctttg

SEQ ID NO: 923210 - DNA, 25 bp, Mus musculus
ttagcttgtgatgtatagagctttg

SEQ ID NO: 923211 - DNA, 25 bp, Mus musculus
ttagctttagagagaacgttaacca

SEQ ID NO: 923212 - DNA, 25 bp, Mus musculus
ttagctttagagtgaacgttaacca

SEQ ID NO: 923213 - DNA, 25 bp, Mus musculus
ttagctttcatgaaactcccagtgt

SEQ ID NO: 923214 - DNA, 25 bp, Mus musculus
ttagctttcatgtaactcccagtgt

SEQ ID NO: 923215 - DNA, 25 bp, Mus musculus
ttagctttcccaaaatccgtcattt

SEQ ID NO: 923216 - DNA, 25 bp, Mus musculus
ttagctttcccataatccgtcattt

SEQ ID NO: 923217 - DNA, 25 bp, Mus musculus
ttagctttctagcatctaccacact

SEQ ID NO: 923218 - DNA, 25 bp, Mus musculus
ttagctttctaggatctaccacact

SEQ ID NO: 923219 - DNA, 25 bp, Mus musculus
ttagctttctttcgttgacctttga

SEQ ID NO: 923220 - DNA, 25 bp, Mus musculus
ttagctttctttggttgacctttga

SEQ ID NO: 923221 - DNA, 25 bp, Mus musculus
ttagctttgagcatgggccagtcaa

SEQ ID NO: 923222 - DNA, 25 bp, Mus musculus
ttagctttgagcttgggccagtcaa

SEQ ID NO: 923223 - DNA, 25 bp, Mus musculus
ttagctttgaggagactttgccctt

SEQ ID NO: 923224 - DNA, 25 bp, Mus musculus
ttagctttgaggcaacattctgatt

SEQ ID NO: 923225 - DNA, 25 bp, Mus musculus
ttagctttgagggaacattctgatt

SEQ ID NO: 923226 - DNA, 25 bp, Mus musculus
ttagctttgaggtgactttgccctt

SEQ ID NO: 923227 - DNA, 25 bp, Mus musculus
ttagctttgggtcatgatgtctgca

SEQ ID NO: 923228 - DNA, 25 bp, Mus musculus
ttagctttgggtgatgatgtctgca

SEQ ID NO: 923229 - DNA, 25 bp, Mus musculus
ttagctttgtccagctcccctgcag

SEQ ID NO: 923230 - DNA, 25 bp, Mus musculus
ttagctttgtcctgctcccctgcag

SEQ ID NO: 923231 - DNA, 25 bp, Mus musculus
ttagctttgtggcttcctgatggca

SEQ ID NO: 923232 - DNA, 25 bp, Mus musculus
ttagctttgtgggttcctgatggca

SEQ ID NO: 923233 - DNA, 25 bp, Mus musculus
ttagcttttagaaatttcgtagaca

SEQ ID NO: 923234 - DNA, 25 bp, Mus musculus
ttagcttttagatatttcgtagaca

SEQ ID NO: 923235 - DNA, 25 bp, Mus musculus
ttagcttttatacattgtccaggtc

SEQ ID NO: 923236 - DNA, 25 bp, Mus musculus
ttagcttttatagattgtccaggtc

SEQ ID NO: 923237 - DNA, 25 bp, Mus musculus
ttagcttttcatagaactgacagga

SEQ ID NO: 923238 - DNA, 25 bp, Mus musculus
ttagcttttcattgaactgacagga

SEQ ID NO: 923239 - DNA, 25 bp, Mus musculus
ttagcttttctcacggtctgtagat

SEQ ID NO: 923240 - DNA, 25 bp, Mus musculus
ttagcttttctctcggtctgtagat

SEQ ID NO: 923241 - DNA, 25 bp, Mus musculus
ttagcttttcttcctagcaaaattt

SEQ ID NO: 923242 - DNA, 25 bp, Mus musculus
ttagcttttcttgctagcaaaattt

SEQ ID NO: 923243 - DNA, 25 bp, Mus musculus
ttagcttttgcacagttccctggcc

SEQ ID NO: 923244 - DNA, 25 bp, Mus musculus
ttagcttttgcagagttccctggcc

SEQ ID NO: 923245 - DNA, 25 bp, Mus musculus
ttagctttttgtaaggtcaacatgt

SEQ ID NO: 923246 - DNA, 25 bp, Mus musculus
ttagctttttgttaggtcaacatgt

SEQ ID NO: 923247 - DNA, 25 bp, Mus musculus
ttaggaaaaccgactccgagcagca

SEQ ID NO: 923248 - DNA, 25 bp, Mus musculus
ttaggaaaaccgtctccgagcagca

SEQ ID NO: 923249 - DNA, 25 bp, Mus musculus
ttaggaaaccccaaagccttctgtg

SEQ ID NO: 923250 - DNA, 25 bp, Mus musculus
ttaggaaacccctaagccttctgtg

SEQ ID NO: 923251 - DNA, 25 bp, Mus musculus
ttaggaaacggcctgactcgctcat

SEQ ID NO: 923252 - DNA, 25 bp, Mus musculus
ttaggaaacggcgtgactcgctcat

SEQ ID NO: 923253 - DNA, 25 bp, Mus musculus
ttaggaaatcttactgcggcgcaaa

SEQ ID NO: 923254 - DNA, 25 bp, Mus musculus
ttaggaaatctttctgcggcgcaaa

SEQ ID NO: 923255 - DNA, 25 bp, Mus musculus
ttaggaaatgcacctcggagaaatt

SEQ ID NO: 923256 - DNA, 25 bp, Mus musculus
ttaggaaatgcagctcggagaaatt

SEQ ID NO: 923257 - DNA, 25 bp, Mus musculus
ttaggaaatgtgacagctttaaggt

SEQ ID NO: 923258 - DNA, 25 bp, Mus musculus
ttaggaaatgtgtcagctttaaggt

SEQ ID NO: 923259 - DNA, 25 bp, Mus musculus
ttaggaaccactatcttctacacaa

SEQ ID NO: 923260 - DNA, 25 bp, Mus musculus
ttaggaaccactttcttctacacaa

SEQ ID NO: 923261 - DNA, 25 bp, Mus musculus
ttaggaacgaacagttctccaggaa

SEQ ID NO: 923262 - DNA, 25 bp, Mus musculus
ttaggaacgaactgttctccaggaa

SEQ ID NO: 923263 - DNA, 25 bp, Mus musculus
ttaggaactctgcatatacatctct

SEQ ID NO: 923264 - DNA, 25 bp, Mus musculus
ttaggaactctggatatacatctct

SEQ ID NO: 923265 - DNA, 25 bp, Mus musculus
ttaggaactggaatacgactcaatc

SEQ ID NO: 923266 - DNA, 25 bp, Mus musculus
ttaggaactggattacgactcaatc

SEQ ID NO: 923267 - DNA, 25 bp, Mus musculus
ttaggaactgtactgacccagctgc

SEQ ID NO: 923268 - DNA, 25 bp, Mus musculus
ttaggaactgtagtgacccagctgc

SEQ ID NO: 923269 - DNA, 25 bp, Mus musculus
ttaggaagaattaccctgctaccag

SEQ ID NO: 923270 - DNA, 25 bp, Mus musculus
ttaggaagaatttccctgctaccag

SEQ ID NO: 923271 - DNA, 25 bp, Mus musculus
ttaggaagcactacatctgaccgtg

SEQ ID NO: 923272 - DNA, 25 bp, Mus musculus
ttaggaagcacttcatctgaccgtg

SEQ ID NO: 923273 - DNA, 25 bp, Mus musculus
ttaggaagcttcactcttcagcaca

SEQ ID NO: 923274 - DNA, 25 bp, Mus musculus
ttaggaagcttctctcttcagcaca

SEQ ID NO: 923275 - DNA, 25 bp, Mus musculus
ttaggaaggaatccctgagcacgga

SEQ ID NO: 923276 - DNA, 25 bp, Mus musculus
ttaggaaggaatgcctgagcacgga

SEQ ID NO: 923277 - DNA, 25 bp, Mus musculus
ttaggaagttgcaattggccacata

SEQ ID NO: 923278 - DNA, 25 bp, Mus musculus
ttaggaagttgctattggccacata

SEQ ID NO: 923279 - DNA, 25 bp, Mus musculus
ttaggaatacagaccaggcaggctg

SEQ ID NO: 923280 - DNA, 25 bp, Mus musculus
ttaggaatacagtccaggcaggctg

SEQ ID NO: 923281 - DNA, 25 bp, Mus musculus
ttaggaatacctctgactgcagccc

SEQ ID NO: 923282 - DNA, 25 bp, Mus musculus
ttaggaatacctgtgactgcagccc

SEQ ID NO: 923283 - DNA, 25 bp, Mus musculus
ttaggaatgcatatctaccaaaaga

SEQ ID NO: 923284 - DNA, 25 bp, Mus musculus
ttaggaatgcatttctaccaaaaga

SEQ ID NO: 923285 - DNA, 25 bp, Mus musculus
ttaggaatgccacatgacagtcatc

SEQ ID NO: 923286 - DNA, 25 bp, Mus musculus
ttaggaatgccagatgacagtcatc

SEQ ID NO: 923287 - DNA, 25 bp, Mus musculus
ttaggaatggaaatcgctgagcgtt

SEQ ID NO: 923288 - DNA, 25 bp, Mus musculus
ttaggaatggaattcgctgagcgtt

SEQ ID NO: 923289 - DNA, 25 bp, Mus musculus
ttaggaatgggacacacgccccttg

SEQ ID NO: 923290 - DNA, 25 bp, Mus musculus
ttaggaatgggagacacgccccttg

SEQ ID NO: 923291 - DNA, 25 bp, Mus musculus
ttaggaattagcagtttccctatga

SEQ ID NO: 923292 - DNA, 25 bp, Mus musculus
ttaggaattagctgtttccctatga

SEQ ID NO: 923293 - DNA, 25 bp, Mus musculus
ttaggacaacgccttcccaccatgg

SEQ ID NO: 923294 - DNA, 25 bp, Mus musculus
ttaggacaacgcgttcccaccatgg

SEQ ID NO: 923295 - DNA, 25 bp, Mus musculus
ttaggacaatccatctttactagat

SEQ ID NO: 923296 - DNA, 25 bp, Mus musculus
ttaggacaatccttctttactagat

SEQ ID NO: 923297 - DNA, 25 bp, Mus musculus
ttaggacaatgacctcaccaagtag

SEQ ID NO: 923298 - DNA, 25 bp, Mus musculus
ttaggacaatgagctcaccaagtag

SEQ ID NO: 923299 - DNA, 25 bp, Mus musculus
ttaggacaccttacacaaatcaaga

SEQ ID NO: 923300 - DNA, 25 bp, Mus musculus
ttaggacacctttcacaaatcaaga

SEQ ID NO: 923301 - DNA, 25 bp, Mus musculus
ttaggacacttcaggtccatctgtg

SEQ ID NO: 923302 - DNA, 25 bp, Mus musculus
ttaggacacttctggtccatctgtg

SEQ ID NO: 923303 - DNA, 25 bp, Mus musculus
ttaggacagctcacaagcacttatt

SEQ ID NO: 923304 - DNA, 25 bp, Mus musculus
ttaggacagctctcaagcacttatt

SEQ ID NO: 923305 - DNA, 25 bp, Mus musculus
ttaggacagtaaccagagccgcggc

SEQ ID NO: 923306 - DNA, 25 bp, Mus musculus
ttaggacagtaagcagagccgcggc

SEQ ID NO: 923307 - DNA, 25 bp, Mus musculus
ttaggacatgttcaaattacgcatt

SEQ ID NO: 923308 - DNA, 25 bp, Mus musculus
ttaggacatgttgaaattacgcatt

SEQ ID NO: 923309 - DNA, 25 bp, Mus musculus
ttaggaccaagcaaccttgccaggc

SEQ ID NO: 923310 - DNA, 25 bp, Mus musculus
ttaggaccaagctaccttgccaggc

SEQ ID NO: 923311 - DNA, 25 bp, Mus musculus
ttaggaccactgagccagaaagctg

SEQ ID NO: 923312 - DNA, 25 bp, Mus musculus
ttaggaccactgtgccagaaagctg

SEQ ID NO: 923313 - DNA, 25 bp, Mus musculus
ttaggaccaggcacgtcagctctct

SEQ ID NO: 923314 - DNA, 25 bp, Mus musculus
ttaggaccaggctcgtcagctctct

SEQ ID NO: 923315 - DNA, 25 bp, Mus musculus
ttaggaccctagcttgccactgttg

SEQ ID NO: 923316 - DNA, 25 bp, Mus musculus
ttaggaccctaggttgccactgttg

SEQ ID NO: 923317 - DNA, 25 bp, Mus musculus
ttaggacctcaaagaccagacttgt

SEQ ID NO: 923318 - DNA, 25 bp, Mus musculus
ttaggacctcaatgaccagacttgt

SEQ ID NO: 923319 - DNA, 25 bp, Mus musculus
ttaggacctgctacccaacgagggc

SEQ ID NO: 923320 - DNA, 25 bp, Mus musculus
ttaggacctgcttcccaacgagggc

SEQ ID NO: 923321 - DNA, 25 bp, Mus musculus
ttaggacctggaacaatgacatcat

SEQ ID NO: 923322 - DNA, 25 bp, Mus musculus
ttaggacctggatcaatgacatcat

SEQ ID NO: 923323 - DNA, 25 bp, Mus musculus
ttaggacgtgagacgctggcctgct

SEQ ID NO: 923324 - DNA, 25 bp, Mus musculus
ttaggacgtgagtcgctggcctgct

SEQ ID NO: 923325 - DNA, 25 bp, Mus musculus
ttaggactccacacagcgagactgc

SEQ ID NO: 923326 - DNA, 25 bp, Mus musculus
ttaggactccactcagcgagactgc

SEQ ID NO: 923327 - DNA, 25 bp, Mus musculus
ttaggactcctcacaggactcaata

SEQ ID NO: 923328 - DNA, 25 bp, Mus musculus
ttaggactcctctcaggactcaata

SEQ ID NO: 923329 - DNA, 25 bp, Mus musculus
ttaggactcttccatgacgggccaa

SEQ ID NO: 923330 - DNA, 25 bp, Mus musculus
ttaggactcttcgatgacgggccaa

SEQ ID NO: 923331 - DNA, 25 bp, Mus musculus
ttaggactgctgctcactacccaca

SEQ ID NO: 923332 - DNA, 25 bp, Mus musculus
ttaggactgctggtcactacccaca

SEQ ID NO: 923333 - DNA, 25 bp, Mus musculus
ttaggactgttcctcattgctggca

SEQ ID NO: 923334 - DNA, 25 bp, Mus musculus
ttaggactgttcctccagttcagaa

SEQ ID NO: 923335 - DNA, 25 bp, Mus musculus
ttaggactgttcgtcattgctggca

SEQ ID NO: 923336 - DNA, 25 bp, Mus musculus
ttaggactgttcgtccagttcagaa

SEQ ID NO: 923337 - DNA, 25 bp, Mus musculus
ttaggactgtttccttacgggccac

SEQ ID NO: 923338 - DNA, 25 bp, Mus musculus
ttaggactgtttgcttacgggccac

SEQ ID NO: 923339 - DNA, 25 bp, Mus musculus
ttaggacttttcatgccattctttg

SEQ ID NO: 923340 - DNA, 25 bp, Mus musculus
ttaggacttttcttgccattctttg

SEQ ID NO: 923341 - DNA, 25 bp, Mus musculus
ttaggagaagctccctaaccgggct

SEQ ID NO: 923342 - DNA, 25 bp, Mus musculus
ttaggagaagctgcctaaccgggct

SEQ ID NO: 923343 - DNA, 25 bp, Mus musculus
ttaggagatgctcaggacctggctt

SEQ ID NO: 923344 - DNA, 25 bp, Mus musculus
ttaggagatgctgaggacctggctt

SEQ ID NO: 923345 - DNA, 25 bp, Mus musculus
ttaggagcagcgcaacactgcccag

SEQ ID NO: 923346 - DNA, 25 bp, Mus musculus
ttaggagcagcggaacactgcccag

SEQ ID NO: 923347 - DNA, 25 bp, Mus musculus
ttaggagccacgagtgacctactga

SEQ ID NO: 923348 - DNA, 25 bp, Mus musculus
ttaggagccacgtgtgacctactga

SEQ ID NO: 923349 - DNA, 25 bp, Mus musculus
ttaggagccatcacacagtcttttc

SEQ ID NO: 923350 - DNA, 25 bp, Mus musculus
ttaggagccatctcacagtcttttc

SEQ ID NO: 923351 - DNA, 25 bp, Mus musculus
ttaggagccgccatgtagtgctggt

SEQ ID NO: 923352 - DNA, 25 bp, Mus musculus
ttaggagccgccttgtagtgctggt

SEQ ID NO: 923353 - DNA, 25 bp, Mus musculus
ttaggagccgctctgcttttgaaca

SEQ ID NO: 923354 - DNA, 25 bp, Mus musculus
ttaggagccgctgtgcttttgaaca

SEQ ID NO: 923355 - DNA, 25 bp, Mus musculus
ttaggagcgactctttgctacccag

SEQ ID NO: 923356 - DNA, 25 bp, Mus musculus
ttaggagcgactgtttgctacccag

SEQ ID NO: 923357 - DNA, 25 bp, Mus musculus
ttaggagctattcatctttccactt

SEQ ID NO: 923358 - DNA, 25 bp, Mus musculus
ttaggagctattgatctttccactt

SEQ ID NO: 923359 - DNA, 25 bp, Mus musculus
ttaggagctctacttatttggacca

SEQ ID NO: 923360 - DNA, 25 bp, Mus musculus
ttaggagctctagttatttggacca

SEQ ID NO: 923361 - DNA, 25 bp, Mus musculus
ttaggagctctgctaagatgcccct

SEQ ID NO: 923362 - DNA, 25 bp, Mus musculus
ttaggagctctggtaagatgcccct

SEQ ID NO: 923363 - DNA, 25 bp, Mus musculus
ttaggagctgtaaggcctgctgtct

SEQ ID NO: 923364 - DNA, 25 bp, Mus musculus
ttaggagctgtatggcctgctgtct

SEQ ID NO: 923365 - DNA, 25 bp, Mus musculus
ttaggaggaaacaatcagcactcag

SEQ ID NO: 923366 - DNA, 25 bp, Mus musculus
ttaggaggaaactatcagcactcag

SEQ ID NO: 923367 - DNA, 25 bp, Mus musculus
ttaggaggacttacctgggcaggtc

SEQ ID NO: 923368 - DNA, 25 bp, Mus musculus
ttaggaggactttcctgggcaggtc

SEQ ID NO: 923369 - DNA, 25 bp, Mus musculus
ttaggaggatctcccacaaggtgga

SEQ ID NO: 923370 - DNA, 25 bp, Mus musculus
ttaggaggatctgccacaaggtgga

SEQ ID NO: 923371 - DNA, 25 bp, Mus musculus
ttaggaggcctgagacctcagtcct

SEQ ID NO: 923372 - DNA, 25 bp, Mus musculus
ttaggaggcctgtgacctcagtcct

SEQ ID NO: 923373 - DNA, 25 bp, Mus musculus
ttaggagggcatcctcctcttttcc

SEQ ID NO: 923374 - DNA, 25 bp, Mus musculus
ttaggagggcatgctcctcttttcc

SEQ ID NO: 923375 - DNA, 25 bp, Mus musculus
ttaggagggcgtcctttccctaagg

SEQ ID NO: 923376 - DNA, 25 bp, Mus musculus
ttaggagggcgtgctttccctaagg

SEQ ID NO: 923377 - DNA, 25 bp, Mus musculus
ttaggagtaatgacccctgccctgg

SEQ ID NO: 923378 - DNA, 25 bp, Mus musculus
ttaggagtaatgtcccctgccctgg

SEQ ID NO: 923379 - DNA, 25 bp, Mus musculus
ttaggagtcaagacctctccagacc

SEQ ID NO: 923380 - DNA, 25 bp, Mus musculus
ttaggagtcaagtcctctccagacc

SEQ ID NO: 923381 - DNA, 25 bp, Mus musculus
ttaggagtcccacagaatgccaagc

SEQ ID NO: 923382 - DNA, 25 bp, Mus musculus
ttaggagtcccacagtcggtttctt

SEQ ID NO: 923383 - DNA, 25 bp, Mus musculus
ttaggagtcccagagaatgccaagc

SEQ ID NO: 923384 - DNA, 25 bp, Mus musculus
ttaggagtcccagagtcggtttctt

SEQ ID NO: 923385 - DNA, 25 bp, Mus musculus
ttaggagtccccagcacagatctgc

SEQ ID NO: 923386 - DNA, 25 bp, Mus musculus
ttaggagtcccctgcacagatctgc

SEQ ID NO: 923387 - DNA, 25 bp, Mus musculus
ttaggagtgaagatgtggcccagca

SEQ ID NO: 923388 - DNA, 25 bp, Mus musculus
ttaggagtgaagttgtggcccagca

SEQ ID NO: 923389 - DNA, 25 bp, Mus musculus
ttaggagtgcacaactgtgcccagc

SEQ ID NO: 923390 - DNA, 25 bp, Mus musculus
ttaggagtgcactactgtgcccagc

SEQ ID NO: 923391 - DNA, 25 bp, Mus musculus
ttaggagtgctgaggcagcttccct

SEQ ID NO: 923392 - DNA, 25 bp, Mus musculus
ttaggagtgctgtggcagcttccct

SEQ ID NO: 923393 - DNA, 25 bp, Mus musculus
ttaggagtggatagcttcctttgca

SEQ ID NO: 923394 - DNA, 25 bp, Mus musculus
ttaggagtggattgcttcctttgca

SEQ ID NO: 923395 - DNA, 25 bp, Mus musculus
ttaggagttattaggctcttcaagc

SEQ ID NO: 923396 - DNA, 25 bp, Mus musculus
ttaggagttatttggctcttcaagc

SEQ ID NO: 923397 - DNA, 25 bp, Mus musculus
ttaggagttggtaacagtgtcacat

SEQ ID NO: 923398 - DNA, 25 bp, Mus musculus
ttaggagttggttacagtgtcacat

SEQ ID NO: 923399 - DNA, 25 bp, Mus musculus
ttaggataacaactgactctgattc

SEQ ID NO: 923400 - DNA, 25 bp, Mus musculus
ttaggataacaagtgactctgattc

SEQ ID NO: 923401 - DNA, 25 bp, Mus musculus
ttaggatacctcactcatcacagga

SEQ ID NO: 923402 - DNA, 25 bp, Mus musculus
ttaggatacctctctcatcacagga

SEQ ID NO: 923403 - DNA, 25 bp, Mus musculus
ttaggatactttatgctgcaagatt

SEQ ID NO: 923404 - DNA, 25 bp, Mus musculus
ttaggatactttttgctgcaagatt

SEQ ID NO: 923405 - DNA, 25 bp, Mus musculus
ttaggatcaagtcgcacaatgcttt

SEQ ID NO: 923406 - DNA, 25 bp, Mus musculus
ttaggatcaagtggcacaatgcttt

SEQ ID NO: 923407 - DNA, 25 bp, Mus musculus
ttaggatcaatccttccaatccact

SEQ ID NO: 923408 - DNA, 25 bp, Mus musculus
ttaggatcaatcgttccaatccact

SEQ ID NO: 923409 - DNA, 25 bp, Mus musculus
ttaggatcatttattcaccctctct

SEQ ID NO: 923410 - DNA, 25 bp, Mus musculus
ttaggatcatttccacacctcaaat

SEQ ID NO: 923411 - DNA, 25 bp, Mus musculus
ttaggatcatttgcacacctcaaat

SEQ ID NO: 923412 - DNA, 25 bp, Mus musculus
ttaggatcattttttcaccctctct

SEQ ID NO: 923413 - DNA, 25 bp, Mus musculus
ttaggatccaggaacagactgcagt

SEQ ID NO: 923414 - DNA, 25 bp, Mus musculus
ttaggatccaggtacagactgcagt

SEQ ID NO: 923415 - DNA, 25 bp, Mus musculus
ttaggatccccgagactgcagtgaa

SEQ ID NO: 923416 - DNA, 25 bp, Mus musculus
ttaggatccccgtgactgcagtgaa

SEQ ID NO: 923417 - DNA, 25 bp, Mus musculus
ttaggatcctcacgcaaggcccctg

SEQ ID NO: 923418 - DNA, 25 bp, Mus musculus
ttaggatcctcaggcaaggcccctg

SEQ ID NO: 923419 - DNA, 25 bp, Mus musculus
ttaggatcctggcaaattctctcag

SEQ ID NO: 923420 - DNA, 25 bp, Mus musculus
ttaggatcctgggaaattctctcag

SEQ ID NO: 923421 - DNA, 25 bp, Mus musculus
ttaggatcttccagagtctcatggg

SEQ ID NO: 923422 - DNA, 25 bp, Mus musculus
ttaggatcttcctgagtctcatggg

SEQ ID NO: 923423 - DNA, 25 bp, Mus musculus
ttaggatgattccacaccagactca

SEQ ID NO: 923424 - DNA, 25 bp, Mus musculus
ttaggatgattcgacaccagactca

SEQ ID NO: 923425 - DNA, 25 bp, Mus musculus
ttaggatgcacccacactttaaagt

SEQ ID NO: 923426 - DNA, 25 bp, Mus musculus
ttaggatgcaccgacactttaaagt

SEQ ID NO: 923427 - DNA, 25 bp, Mus musculus
ttaggatgcccacactgaagcttct

SEQ ID NO: 923428 - DNA, 25 bp, Mus musculus
ttaggatgcccagactgaagcttct

SEQ ID NO: 923429 - DNA, 25 bp, Mus musculus
ttaggatggaccaccctgtgggaaa

SEQ ID NO: 923430 - DNA, 25 bp, Mus musculus
ttaggatggacctccctgtgggaaa

SEQ ID NO: 923431 - DNA, 25 bp, Mus musculus
ttaggatggatacattcgctgccct

SEQ ID NO: 923432 - DNA, 25 bp, Mus musculus
ttaggatggatagattcgctgccct

SEQ ID NO: 923433 - DNA, 25 bp, Mus musculus
ttaggatgttctcagtctccatacg

SEQ ID NO: 923434 - DNA, 25 bp, Mus musculus
ttaggatgttctgagtctccatacg

SEQ ID NO: 923435 - DNA, 25 bp, Mus musculus
ttaggattacctaacattgctggta

SEQ ID NO: 923436 - DNA, 25 bp, Mus musculus
ttaggattaccttacattgctggta

SEQ ID NO: 923437 - DNA, 25 bp, Mus musculus
ttaggattcgaacagcaggcattac

SEQ ID NO: 923438 - DNA, 25 bp, Mus musculus
ttaggattcgaagagcaggcattac

SEQ ID NO: 923439 - DNA, 25 bp, Mus musculus
ttaggattcgcccattcctgtctct

SEQ ID NO: 923440 - DNA, 25 bp, Mus musculus
ttaggattcgccgattcctgtctct

SEQ ID NO: 923441 - DNA, 25 bp, Mus musculus
ttaggattgtctcttaccttctgta

SEQ ID NO: 923442 - DNA, 25 bp, Mus musculus
ttaggattgtctgttaccttctgta

SEQ ID NO: 923443 - DNA, 25 bp, Mus musculus
ttaggatttctgagatagcctcatc

SEQ ID NO: 923444 - DNA, 25 bp, Mus musculus
ttaggatttctgtgatagcctcatc

SEQ ID NO: 923445 - DNA, 25 bp, Mus musculus
ttaggatttttcatcataataccac

SEQ ID NO: 923446 - DNA, 25 bp, Mus musculus
ttaggatttttcttcataataccac

SEQ ID NO: 923447 - DNA, 25 bp, Mus musculus
ttaggcaaactcatcatggcccagg

SEQ ID NO: 923448 - DNA, 25 bp, Mus musculus
ttaggcaaactcttcatggcccagg

SEQ ID NO: 923449 - DNA, 25 bp, Mus musculus
ttaggcaaaggcagcgcaatggatt

SEQ ID NO: 923450 - DNA, 25 bp, Mus musculus
ttaggcaaaggctgcgcaatggatt

SEQ ID NO: 923451 - DNA, 25 bp, Mus musculus
ttaggcaaggtgaactgccctgtgc

SEQ ID NO: 923452 - DNA, 25 bp, Mus musculus
ttaggcaaggtgtactgccctgtgc

SEQ ID NO: 923453 - DNA, 25 bp, Mus musculus
ttaggcaatcccacctagtgtagtc

SEQ ID NO: 923454 - DNA, 25 bp, Mus musculus
ttaggcaatccctcctagtgtagtc

SEQ ID NO: 923455 - DNA, 25 bp, Mus musculus
ttaggcaatgcgaggacccagaccc

SEQ ID NO: 923456 - DNA, 25 bp, Mus musculus
ttaggcaatgcgtggacccagaccc

SEQ ID NO: 923457 - DNA, 25 bp, Mus musculus
ttaggcacagtcaggctcaaagaga

SEQ ID NO: 923458 - DNA, 25 bp, Mus musculus
ttaggcacagtctggctcaaagaga

SEQ ID NO: 923459 - DNA, 25 bp, Mus musculus
ttaggcacatggatgttccacacca

SEQ ID NO: 923460 - DNA, 25 bp, Mus musculus
ttaggcacatggttgttccacacca

SEQ ID NO: 923461 - DNA, 25 bp, Mus musculus
ttaggcacctcaaggacttttctgc

SEQ ID NO: 923462 - DNA, 25 bp, Mus musculus
ttaggcacctcatggacttttctgc

SEQ ID NO: 923463 - DNA, 25 bp, Mus musculus
ttaggcagcatccttggctctgaat

SEQ ID NO: 923464 - DNA, 25 bp, Mus musculus
ttaggcagcatcgttggctctgaat

SEQ ID NO: 923465 - DNA, 25 bp, Mus musculus
ttaggcagccagcaattggaacccc

SEQ ID NO: 923466 - DNA, 25 bp, Mus musculus
ttaggcagccaggaattggaacccc

SEQ ID NO: 923467 - DNA, 25 bp, Mus musculus
ttaggcaggactactcttctgagct

SEQ ID NO: 923468 - DNA, 25 bp, Mus musculus
ttaggcaggacttctcttctgagct

SEQ ID NO: 923469 - DNA, 25 bp, Mus musculus
ttaggcaggagaaatggtcccctat

SEQ ID NO: 923470 - DNA, 25 bp, Mus musculus
ttaggcaggagatatggtcccctat

SEQ ID NO: 923471 - DNA, 25 bp, Mus musculus
ttaggcagggccaatcccataccag

SEQ ID NO: 923472 - DNA, 25 bp, Mus musculus
ttaggcagggccataccagctgaaa

SEQ ID NO: 923473 - DNA, 25 bp, Mus musculus
ttaggcagggcctatcccataccag

SEQ ID NO: 923474 - DNA, 25 bp, Mus musculus
ttaggcagggccttaccagctgaaa

SEQ ID NO: 923475 - DNA, 25 bp, Mus musculus
ttaggcagtctgattccacggtcca

SEQ ID NO: 923476 - DNA, 25 bp, Mus musculus
ttaggcagtctgtttccacggtcca

SEQ ID NO: 923477 - DNA, 25 bp, Mus musculus
ttaggcagtgttacctcatgttcct

SEQ ID NO: 923478 - DNA, 25 bp, Mus musculus
ttaggcagtgtttcctcatgttcct

SEQ ID NO: 923479 - DNA, 25 bp, Mus musculus
ttaggcatactaaccaagagattca

SEQ ID NO: 923480 - DNA, 25 bp, Mus musculus
ttaggcatactatccaagagattca

SEQ ID NO: 923481 - DNA, 25 bp, Mus musculus
ttaggcatcagcatgccgggtccaa

SEQ ID NO: 923482 - DNA, 25 bp, Mus musculus
ttaggcatcagcttgccgggtccaa

SEQ ID NO: 923483 - DNA, 25 bp, Mus musculus
ttaggcatctttaggtcacatgaac

SEQ ID NO: 923484 - DNA, 25 bp, Mus musculus
ttaggcatcttttggtcacatgaac

SEQ ID NO: 923485 - DNA, 25 bp, Mus musculus
ttaggcatgataatctagtactttc

SEQ ID NO: 923486 - DNA, 25 bp, Mus musculus
ttaggcatgatattctagtactttc

SEQ ID NO: 923487 - DNA, 25 bp, Mus musculus
ttaggccaagtactcctgacctgta

SEQ ID NO: 923488 - DNA, 25 bp, Mus musculus
ttaggccaagtagtcctgacctgta

SEQ ID NO: 923489 - DNA, 25 bp, Mus musculus
ttaggccaagtgattttattccaaa

SEQ ID NO: 923490 - DNA, 25 bp, Mus musculus
ttaggccaagtgtttttattccaaa

SEQ ID NO: 923491 - DNA, 25 bp, Mus musculus
ttaggccaatgtagtttaaagtaca

SEQ ID NO: 923492 - DNA, 25 bp, Mus musculus
ttaggccaatgttgtttaaagtaca

SEQ ID NO: 923493 - DNA, 25 bp, Mus musculus
ttaggccacacactgttggctgttt

SEQ ID NO: 923494 - DNA, 25 bp, Mus musculus
ttaggccacacagtgttggctgttt

SEQ ID NO: 923495 - DNA, 25 bp, Mus musculus
ttaggccaccgcaacagtgaccgac

SEQ ID NO: 923496 - DNA, 25 bp, Mus musculus
ttaggccaccgctacagtgaccgac

SEQ ID NO: 923497 - DNA, 25 bp, Mus musculus
ttaggccagtctcacctgggcagtt

SEQ ID NO: 923498 - DNA, 25 bp, Mus musculus
ttaggccagtctgacctgggcagtt
